US007432049B2

(12) United States Patent
Liew et al.

(10) Patent No.: US 7,432,049 B2

(45) Date of Patent: Oct. 7, 2008

(54) COMPOSITIONS AND METHODS RELATING TO OSTEOARTHRITIS

(75) Inventors: Choong-Chin Liew, Toronto (CA); Wayne Marshall, Toronto (CA); Hongwei Zhang, Toronto (CA)

(73) Assignee: Chondrogene Limited, Toronto, Ontario (CA)

(*) Notice: Subject to any disclaimer, the term of this patent is extended or adjusted under 35 U.S.C. 154(b) by 233 days.

(21) Appl. No.: 10/085,783

(22) Filed: Feb. 28, 2002

(65) Prior Publication Data

US 2004/0037841 A1 Feb. 26, 2004

Related U.S. Application Data

(60) Provisional application No. 60/305,340, filed on Jul. 13, 2001, provisional application No. 60/275,017, filed on Mar. 12, 2001, provisional application No. 60/271,955, filed on Feb. 28, 2001.

(51) Int. Cl.
*C12Q 1/68* (2006.01)
*C12P 19/34* (2006.01)

(52) U.S. Cl. .......................... 435/6; 435/91.1; 435/91.2

(58) Field of Classification Search ..................... 435/6, 435/91.2

See application file for complete search history.

(56) References Cited

U.S. PATENT DOCUMENTS 5,539,096 A * 7/1996 Babai et al. ................ 536/24.3

FOREIGN PATENT DOCUMENTS

| | | | |
|---|---|---|---|
| EP | 0 705 842 | A | 4/1996 |
| EP | 0705842 | A2 | 4/1996 |
| WO | WO 99 32610 | A | 7/1999 |

OTHER PUBLICATIONS

Todesco et al., Journal of Rheumatology, 1980, 7(4)555-558.*

Reimer et al. Journal of Virology, 2000, vol. 74, No. 21, pp. 10245-10248.*

Kumar et al., (2001), "Identification and Initial characterization of 5000 expressed sequenced tags (ESTs) each from adult human normal and osteoarthritic cartilage cDNA libraries," *Osteoarthritis and cartilage/OARS* V.9(7) p. 641-653.

Database EMBL Online! Van Asseldonk et al., *Homo Sapiens Alpha Gene Sequence*, Database accession No. AF203815, XP002243659, Abstract, Jun. 6, 2003.

Andrews J. et al., *Gene Discovery Using Computational and Microarray Analysis of Transcription in the Drosophila Melanogaster Testis. Genome Research*, vol. 10, Dec. 2000, pp. 2030-2043.

Patel I.R. et al., *TNF-Alpha Convertase Enzyme From Human Arthritis—Affected Cartilage: Isolation of cDNA by Differential Display, Expression of the Active enzyme, and Regulation of TNF—Alpha*, The Journal of Immunology, 1998, 160: pp. 4570-4579.

Shukunami et al., *Expression of Cartilage-Specific Functional Matrix Chondromodulin-I mRNA in Rabbit Growth Plate Chondrocytes and Its Responsiveness to Growth Stimuli in Vitro*, Biochemical and Biophysical Research Communication, vol. 249, No. 3, Aug. 28, 1998, pp. 885-890.

Alizadeh A. et al., *The Lymphochip: A Specialized CDNA Microarray for the Genomic-Scale Analysis of Gene Expression in Normal and Malignant Lymphocytes*, Cold Spring Harbor Symposia on Quantitative Biology, vol. 64, No. 1, 1999, pp. 71-78.

Duggan D. J. et al, *Expression Profiling Using cDNA Microarrays*, Nature Genetics, vol. 21, , Jan. 1999, pp. 10-14.

Aigner T, Zien A, Gehrsitz A, Gebhard PM, McKenna L. Anabolic and catabolic gene expression pattern analysis in normal versus osteoarthritic cartilage using complementary DNA-array technology. Arthritis Rheum. Dec. 2001;44(12):2777-89.

European Search Report for Application No. EP 03 75 4646, Dec. 6, 2007.

Bayliss M. T. et al.(Jan. 2001) Osteoarthritis and Cartilage, vol. 9: (1):42-48.

Nentwich et al. (May 3, 2002) J. Biol. Chem. 277(18):15354-15362.

* cited by examiner

*Primary Examiner*—Juliet C Switzer

(74) *Attorney, Agent, or Firm*—Edwards Angell Palmer & Dodge LLP; Kathleen Williams

(57) ABSTRACT

The invention provides for nucleic acid sequences that are expressed in chondrocytes from any of the following developmental and disease stages: fetal, normal, mild osteoarthritic, moderate osteoarthritic, marked and osteoarthritic. The invention also relates to arrays and compositions comprising any combination of these nucleic acid sequences. The invention also provides for methods of using the arrays of the invention to diagnose osteoarthritis. The invention also provides for methods of identifying therapeutic agents that alter the level of expression of the nucleic acids of the invention or alter the anabolic level of a chondrocyte.

10 Claims, 676 Drawing Sheets

Figure 1. - Relative EST Frequencies of Selected ECM Proteins

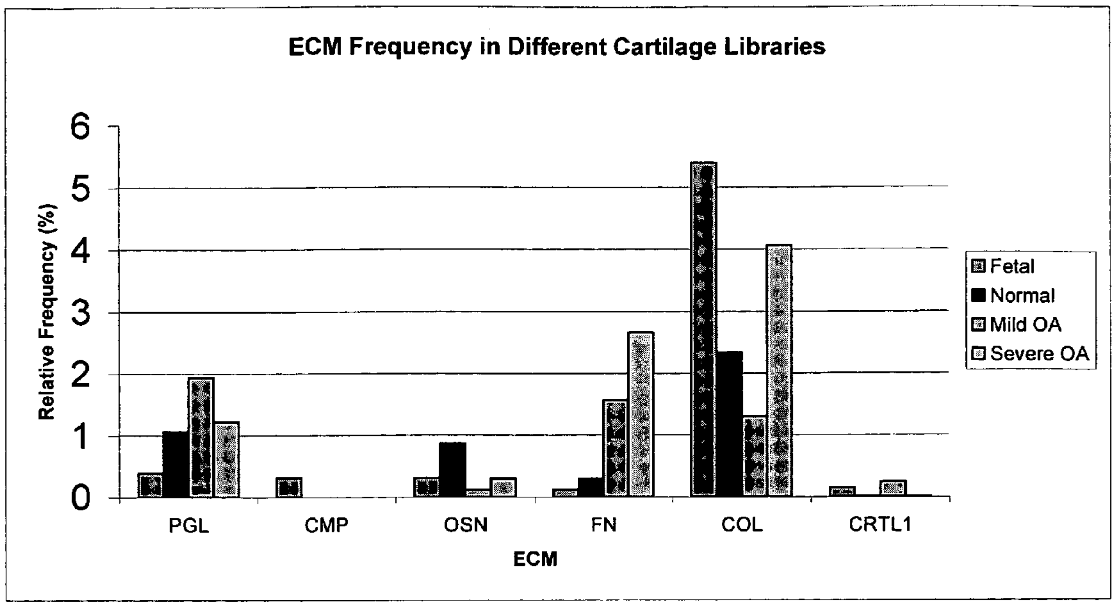

Legend: PGL=proteoglycan, CMP=cartilage matrix proteins, OSN=osteonectin, FN=fibronectin, COL=collagens, CRTL 1=cartilage link protein

| | Fetal | | Normal | | Mild | | Severe | |
|---|---|---|---|---|---|---|---|---|
| **PROTEOGLYCANS** | | | | | | | | |
| aggrecan (cartilage specific proteoglycan) | 14 | | 1 | | 4 | | 3 | |
| chondroitin sulfate proteoglycan 2 (versican) (CSPG2) | 1 | | 4 | | 2 | | 0 | |
| chondroitin sulfate proteoglycan 4 (melanoma-associated) (CSPG4) | 3 | | 0 | | 0 | | 0 | |
| dermatan sulfate proteoglycan 3 (DSPG3) | 7 | | 0 | | 0 | | 0 | |
| heparan sulfate proteoglycan (HSPG) | 9 | | 4 | | 4 | | 12 | |
| keratocan (keratan sulfate proteoglycan) | 2 | | 0 | | 0 | | 0 | |
| bone/cartilage proteoglycan I precursor (Biglycan) (PG-S1) | 2 | | 1 | | 1 | | 4 | |
| decorin (chondroitin/dermatan sulfate proteoglycan PG40 =DCN) | 14 | | 172 | | 234 | | 154 | |
| **Total** | **52** | | **182** | | **245** | | **173** | |
| | | | | | | | | |
| | | % | | % | | % | | % |
| Proteoglycans | 52 | 0.39 | 182 | 1.06 | 245 | 1.94 | 173 | 1.22 |
| cartilage matrix protein (CMP)gene | 42 | 0.31 | 0 | 0.00 | 0 | 0.00 | 0 | 0.00 |
| osteonectin (secreted protein, acidic,cysteine-rich SPARC) | 42 | 0.31 | 149 | 0.87 | 15 | 0.12 | 42 | 0.30 |
| fibronectin | 16 | 0.12 | 50 | 0.29 | 198 | 1.57 | 379 | 2.67 |
| Collagen | 722 | 5.39 | 401 | 2.34 | 164 | 1.30 | 578 | 4.06 |
| cartilage link protein (CRTL1) (ORF) | 20 | 0.15 | 2 | 0.01 | 31 | 0.25 | 1 | 0.01 |
| **Total** | 894 | | 784 | | 653 | | 1173 | |

Figure 2. - Relative Frequency of Collagen ESTs
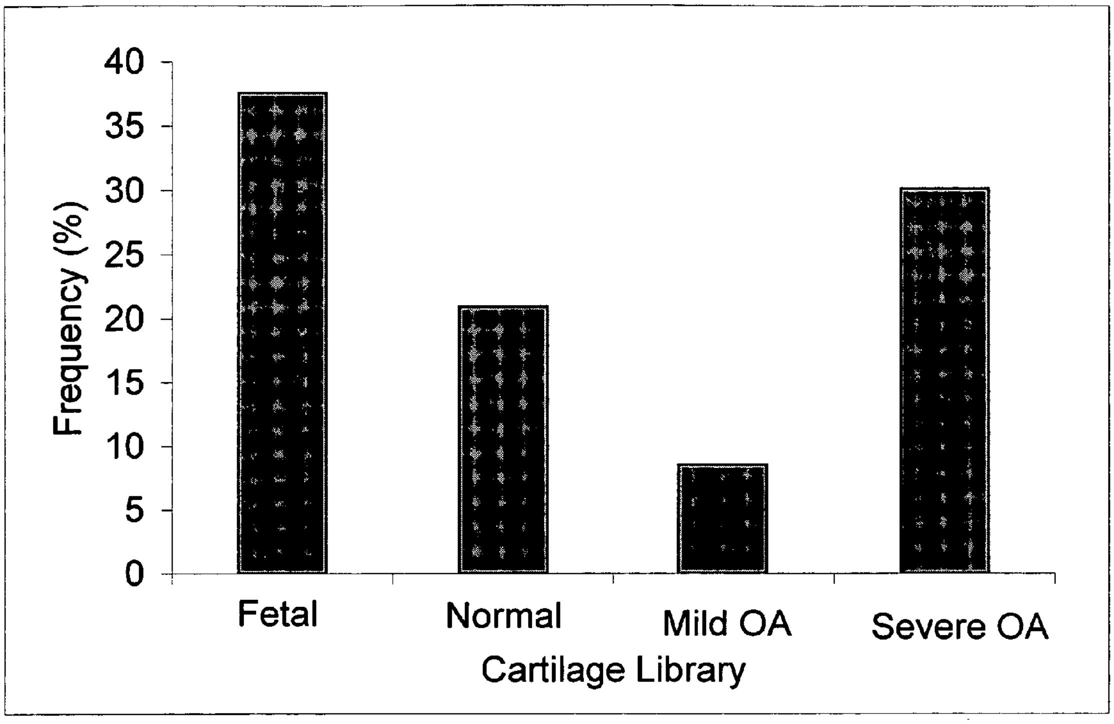
| cDNA Library | Collagen ESTs | Frequency (%) |
|---|---|---|
| Fetal | 722 | 37.6 |
| Normal | 401 | 20.9 |
| Mild OA | 164 | 8.5 |
| Severe OA | 578 | 30.1 |
| | | |
| **Total Collagen ESTs** | **1865** | |

Figure 3. - Relative Frequencies of Collagen ESTs in Human Cartilage Libraries

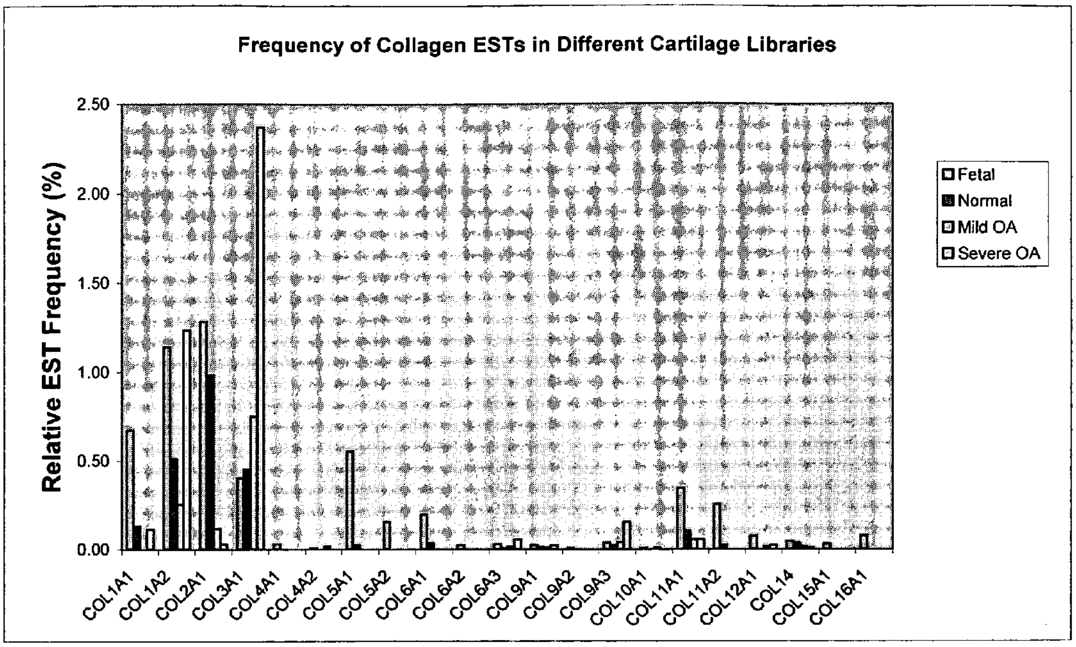

| | Fetal | 13398 | Normal | 17152 | Mild | 12651 | Severe | 14221 |
|---|---|---|---|---|---|---|---|---|
| **Collagen Genes** | 722 | % | 401 | % | 164 | % | 578 | % |
| | | | | | | | | |
| collagen type I alpha 1 (COL1A1) | 90 | 0.67 | 22 | 0.13 | 0 | 0.00 | 16 | 0.11 |
| collagen type I alpha 2 (COL1A2) | 153 | 1.14 | 88 | 0.51 | 32 | 0.25 | 176 | 1.24 |
| collagen type II alpha 1 (COL2A1) | 172 | 1.28 | 169 | 0.99 | 15 | 0.12 | 4 | 0.03 |
| collagen type III alpha 1 (COL3A1) | 54 | 0.40 | 77 | 0.45 | 95 | 0.75 | 337 | 2.37 |
| collagen type IV alpha 2 (COL4A2) | 4 | 0.03 | 0 | 0.00 | 0 | 0.00 | 0 | 0.00 |
| collagen type IV alpha 1 (COL4A1) | 1 | 0.01 | 0 | 0.00 | 2 | 0.02 | 0 | 0.00 |
| collagen type IX alpha 1(COL9A1) | 74 | 0.55 | 4 | 0.02 | 0 | 0.00 | 0 | 0.00 |
| collagen type IX alpha 2 (COL9A2) | 21 | 0.16 | 0 | 0.00 | 0 | 0.00 | 0 | 0.00 |
| Collagen type IX alpha 3 (COL9A3) | 26 | 0.19 | 6 | 0.03 | 0 | 0.00 | 0 | 0.00 |
| collagen type V alpha 1 (COL5A1) | 3 | 0.02 | 0 | 0.00 | 0 | 0.00 | 0 | 0.00 |
| collagen type V alpha 2 (COL5A2) | 4 | 0.03 | 1 | 0.01 | 2 | 0.02 | 8 | 0.06 |
| collagen type VI alpha 1 (COL6A1) | 3 | 0.02 | 2 | 0.01 | 1 | 0.01 | 3 | 0.02 |
| Collagen type VI alpha 2 (COL6A2) | 1 | 0.01 | 0 | 0.00 | 0 | 0.00 | 0 | 0.00 |
| collagen type VI alpha 3 (COL6A3) | 5 | 0.04 | 4 | 0.02 | 5 | 0.04 | 22 | 0.15 |
| collagen type X alpha 1 (COL10A1) | 1 | 0.01 | 0 | 0.00 | 1 | 0.01 | 0 | 0.00 |
| collagen type XI alpha 1 (COL11A1) | 46 | 0.34 | 18 | 0.10 | 7 | 0.06 | 8 | 0.06 |
| collagen type XI alpha2 (COL11A2) | 34 | 0.25 | 4 | 0.02 | 0 | 0.00 | 0 | 0.00 |
| collagen type XII alpha 1 (COL12A1) | 10 | 0.07 | 0 | 0.00 | 2 | 0.02 | 3 | 0.02 |
| collagen type XIV (COL14) | 6 | 0.04 | 6 | 0.03 | 2 | 0.02 | 1 | 0.01 |
| collagen type XV alpha 1 (COL15A1) | 4 | 0.03 | 0 | 0.00 | 0 | 0.00 | 0 | 0.00 |
| collagen type XVI collagen alpha 1 (COL16A1) | 10 | 0.07 | 0 | 0.00 | 0 | 0.00 | 0 | 0.00 |
| Total | 722 | 5.39 | 401 | 2.34 | 164 | 1.30 | 578 | 4.06 |

Figure 4. - Relative EST Frequencies of Selected Chondrocyte Genes

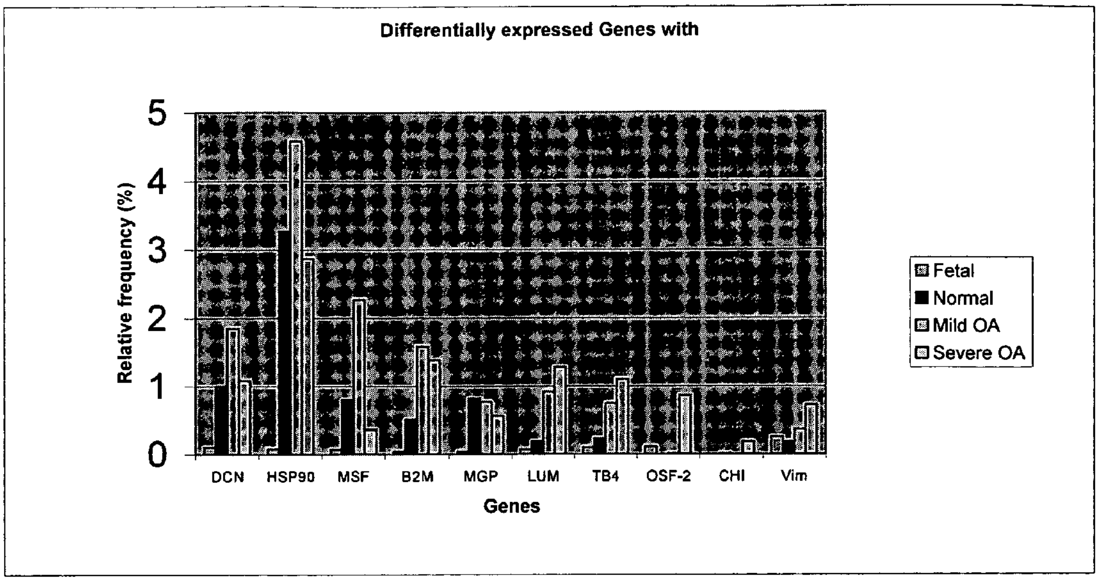

| Selected Genes | Fetal | % | Normal | % | Mild | % | Severe | % |
|---|---|---|---|---|---|---|---|---|
| | | 13398 | | 17152 | | 12651 | | 14221 |
| decorin (chondroitin/dermatan sulfate proteoglycan PG40 =DCN) | 14 | 0.10 | 172 | 1.00 | 234 | 1.85 | 154 | 1.08 |
| alpha gene sequence (=heat shock protein 90) (=PRO2853)(=HSP90) | 11 | 0.08 | 561 | 3.27 | 580 | 4.58 | 408 | 2.87 |
| proteoglycan 4=megakaryocyte stimulating factor; MSF=SZP | 10 | 0.07 | 138 | 0.80 | 287 | 2.27 | 51 | 0.36 |
| beta-2-microglobulin (RefSeq aa 6e-66) | 6 | 0.04 | 88 | 0.51 | 200 | 1.58 | 196 | 1.38 |
| matrix Gla protein (MGP) | 6 | 0.04 | 140 | 0.82 | 97 | 0.77 | 80 | 0.56 |
| lumican (LUM) | 9 | 0.07 | 33 | 0.19 | 116 | 0.92 | 182 | 1.28 |
| thymosin beta-4 | 14 | 0.10 | 40 | 0.23 | 95 | 0.75 | 156 | 1.10 |
| osf-2 mRNA for osteoblast specific factor 2 (OSF-2p1) | 15 | 0.11 | 0 | 0.00 | 1 | 0.01 | 123 | 0.86 |
| chitinase (HUMTCHIT) | 0 | 0.00 | 1 | 0.01 | 0 | 0.00 | 25 | 0.18 |
| vimentin gene | 33 | 0.25 | 31 | 0.18 | 46 | 0.36 | 102 | 0.72 |
| Total | 118 | | 1204 | | 1656 | | 1477 | |

Figure 5 - Breakdown of Total ESTs in Four Human Cartilage cDNA Libraries

| Category | Fetal | | Normal | | Mild | | Severe | | Total |
|---|---|---|---|---|---|---|---|---|---|
| | # of ESTs | | # of ESTs | | # of ESTs | | # of ESTs | | |
| Known/Named Genes | 5747 | 41.80% | 6755 | 39.20% | 5467 | 42.90% | 7298 | 51.10% | 25267 |
| Mitochondrial | 258 | 1.90% | 392 | 2.30% | 485 | 3.80% | 385 | 2.70% | 1520 |
| Ribosomal | 1930 | 14.10% | 1254 | 7.30% | 539 | 4.20% | 883 | 6.20% | 4606 |
| Repetitive Sequences | 586 | 4.30% | 1362 | 7.90% | 725 | 5.60% | 399 | 2.80% | 3072 |
| Vector | 107 | 0.80% | 5 | 0.00% | 1 | 0.00% | 1 | 0.00% | 114 |
| EST Match | 1855 | 13.40% | 1522 | 8.80% | 1976 | 15.40% | 2048 | 14.30% | 7401 |
| Genomic Sequence Match | 1948 | 13.80% | 3979 | 22.90% | 2442 | 18.70% | 1939 | 13.40% | 10308 |
| cDNA/Hypothetical Protein | 758 | 5.20% | 1750 | 10.20% | 868 | 6.80% | 1140 | 7.90% | 4516 |
| No Significant Match | 209 | 4.70% | 132 | 1.40% | 148 | 2.60% | 129 | 1.50% | 618 |
| | **13398** | | **17151** | | **12651** | | **14222** | | **57422** |

Note: See Figure 5A for graphical breakdown in each of the four human cartilage cDNA libraries

Breakdown of ESTs in Four Human Cartilage cDNA Libraries

Figure 6 - Unique Known Genes Identified In Four cDNA Cartilage Libraries and EST Frequency Analysis - Page 1 of 102

| | Total ESTs from each library | | 13398 | | 17151 | | 12651 | | 14222 | | 57422 |
|---|---|---|---|---|---|---|---|---|---|---|---|
| | | | | | | | | | | | |
| | Gene Name | Accession # | Fetal | | Normal | | Mild | | Severe | | Total |
| 1 | alpha gene sequence (=HSP90) | AF203815.1 | 11 | 0.08% | 561 | 3.27% | 580 | 4.58% | 408 | 2.87% | 1560 |
| 2 | mitochondrial genome (consensus sequence) | X62996 | 112 | 0.84% | 181 | 1.06% | 291 | 2.30% | 194 | 1.36% | 778 |
| 3 | fibronectin (FN) | X02761.1 | 16 | 0.12% | 50 | 0.29% | 198 | 1.57% | 379 | 2.66% | 643 |
| 4 | decorin (DCN) | NM_001920.1 | 14 | 0.10% | 172 | 1.00% | 234 | 1.85% | 154 | 1.08% | 574 |
| 5 | collagen type III alpha 1 (COL3A1) | X06700\| | 54 | 0.40% | 77 | 0.45% | 95 | 0.75% | 337 | 2.37% | 563 |
| 6 | beta-2 microglobulin gene (B2M) | gb\|AF072097.1 | 6 | 0.04% | 88 | 0.51% | 200 | 1.58% | 196 | 1.38% | 490 |
| 7 | proteoglycan 4 (=megakaryocyte stimulating fac | AAB09089.1 | 10 | 0.07% | 138 | 0.80% | 287 | 2.27% | 51 | 0.36% | 486 |
| 8 | collagen type I alpha 2 (COL1A2) | NM_000089.1 | 153 | 1.14% | 88 | 0.51% | 32 | 0.25% | 176 | 1.24% | 449 |
| 9 | mitochondrion, complete genome (=AF382012.1 | NC_001807.2 | 96 | 0.72% | 141 | 0.82% | 114 | 0.90% | 92 | 0.65% | 443 |
| 10 | collagen type II alpha 1 (COL2A1) | J00116.1 | 172 | 1.28% | 169 | 0.99% | 15 | 0.12% | 4 | 0.03% | 360 |
| 11 | ribosomal DNA complete repeating unit | U13369.1 | 11 | 0.08% | 303 | 1.77% | 28 | 0.22% | 15 | 0.11% | 357 |
| 12 | elongation factor 1 alpha 1 (EEF1A1) | NM_001402.1 | 150 | 1.12% | 66 | 0.38% | 36 | 0.28% | 89 | 0.63% | 341 |
| 13 | lumican (LUM) | NM_002345.1 | 9 | 0.07% | 33 | 0.19% | 116 | 0.92% | 182 | 1.28% | 340 |
| 14 | matrix Gla protein (MGP) | X53331 | 6 | 0.04% | 140 | 0.82% | 97 | 0.77% | 80 | 0.56% | 323 |
| 15 | thymosin beta-4 (TMSB4X) | M17733 | 14 | 0.10% | 40 | 0.23% | 95 | 0.75% | 156 | 1.10% | 305 |
| 16 | osteonectin gene (SPARC) secreted protein, aci | M25746.1 | 42 | 0.31% | 149 | 0.87% | 15 | 0.12% | 42 | 0.30% | 248 |
| 17 | ribosomal protein S27 (=(metallopanstimulin 1 M | NM_001030.1 | 36 | 0.27% | 105 | 0.61% | 36 | 0.28% | 70 | 0.49% | 247 |
| 18 | vimentin gene (VIM) | Z19554 | 33 | 0.25% | 31 | 0.18% | 46 | 0.36% | 102 | 0.72% | 212 |
| 19 | ribosomal protein L7 | X52967 | 45 | 0.34% | 44 | 0.26% | 63 | 0.50% | 54 | 0.38% | 206 |
| 20 | scrapie responsive protein 1 (SCRG1) | NM_007281.1 | 3 | 0.02% | 59 | 0.34% | 56 | 0.44% | 50 | 0.35% | 168 |
| 21 | connective tissue growth factor (CTGF) | U14750 | 6 | 0.04% | 78 | 0.45% | 44 | 0.35% | 31 | 0.22% | 159 |
| 22 | tumor protein translationally-controlled 1 (TPT1) | NM_003295.1 | 45 | 0.34% | 50 | 0.29% | 26 | 0.21% | 37 | 0.26% | 158 |
| 23 | putative p150 | AAC51271.1 | 4 | 0.03% | 99 | 0.58% | 20 | 0.16% | 22 | 0.15% | 145 |
| 24 | osteoblast specific factor 2 (OSF-2os) | D13666.1 | 15 | 0.11% | 0 | 0.00% | 1 | 0.01% | 123 | 0.86% | 139 |
| 25 | collagen type I alpha 1 (COL1A1) | X06269 | 90 | 0.67% | 22 | 0.13% | 0 | 0.00% | 16 | 0.11% | 128 |
| 26 | Ribosomal protein S20 (RPS20) | NM_001023.1 | 42 | 0.31% | 17 | 0.10% | 23 | 0.18% | 42 | 0.30% | 124 |
| 27 | ribosomal protein L9 | U09953 | 47 | 0.35% | 30 | 0.17% | 12 | 0.09% | 30 | 0.21% | 119 |
| 28 | ribosomal protein L34 (RPL34) | NM_000995.1 | 23 | 0.17% | 27 | 0.16% | 22 | 0.17% | 36 | 0.25% | 108 |
| 29 | calmodulin 1 (phosphorylase kinase, delta) (CAL | NM_006888.1 | 7 | 0.05% | 23 | 0.13% | 31 | 0.25% | 46 | 0.32% | 107 |
| 30 | ribosomal RNA 18S | X03205 | 12 | 0.09% | 47 | 0.27% | 24 | 0.19% | 20 | 0.14% | 103 |
| 31 | ribosomal protein L41 | AF026844.1 | 22 | 0.16% | 47 | 0.27% | 14 | 0.11% | 20 | 0.14% | 103 |
| 32 | serine protease=HTRA serine protease (PRSS1 | Y07921 | 5 | 0.04% | 7 | 0.04% | 32 | 0.25% | 57 | 0.40% | 101 |
| 33 | ribosomal protein S3a | M77234 | 22 | 0.16% | 31 | 0.18% | 18 | 0.14% | 28 | 0.20% | 99 |
| 34 | ribosomal protein, large, P0 (RPLP0) | NM_001002.1 | 56 | 0.42% | 23 | 0.13% | 6 | 0.05% | 11 | 0.08% | 96 |
| 35 | metallothionein 1L (MT1L) | NM_002450.1 | 2 | 0.01% | 85 | 0.50% | 5 | 0.04% | 1 | 0.01% | 93 |
| 36 | ribosomal protein S8 (RPS8) | NM_001012.1 | 42 | 0.31% | 35 | 0.20% | 3 | 0.02% | 12 | 0.08% | 92 |
| 37 | ribosomal protein S6 | M20020 | 27 | 0.20% | 35 | 0.20% | 13 | 0.10% | 17 | 0.12% | 92 |
| 38 | ribosomal protein L21 | U14967.1 | 17 | 0.13% | 34 | 0.20% | 14 | 0.11% | 26 | 0.18% | 91 |
| 39 | transmembrane protein BRI | AF246221.1 | 4 | 0.03% | 16 | 0.09% | 37 | 0.29% | 33 | 0.23% | 90 |
| 40 | ribosomal protein L13a (RPL13A) | NM_012423.1 | 64 | 0.48% | 17 | 0.10% | 4 | 0.03% | 4 | 0.03% | 89 |
| 41 | ribosomal protein L37a | L22154 | 56 | 0.42% | 12 | 0.07% | 8 | 0.06% | 11 | 0.08% | 87 |
| 42 | ribosomal protein S11 (RPS11) | NM_001015.1 | 38 | 0.28% | 19 | 0.11% | 11 | 0.09% | 19 | 0.13% | 87 |
| 43 | cytochrome c oxidase subunit VIc (COX6C) | NM_004374.1 | 3 | 0.02% | 16 | 0.09% | 22 | 0.17% | 44 | 0.31% | 85 |
| 44 | RIBOSOMAL PROTEIN L10 (QM PROTEIN) (TI | spP27635 | 53 | 0.40% | 13 | 0.08% | 6 | 0.05% | 13 | 0.09% | 85 |
| 45 | ribosomal protein L31 | NM_000993.1 | 15 | 0.11% | 31 | 0.18% | 13 | 0.10% | 25 | 0.18% | 84 |
| 46 | annexin A2 (ANXA2)(lipocortin II) | NM_004039.1 | 14 | 0.10% | 28 | 0.16% | 7 | 0.06% | 34 | 0.24% | 83 |
| 47 | translationally controlled tumor protein (TCTP) | X16064 | 23 | 0.17% | 14 | 0.08% | 17 | 0.13% | 28 | 0.20% | 82 |
| 48 | RIBOSOMAL PROTEIN L17 | spP18621 | 31 | 0.23% | 12 | 0.07% | 10 | 0.08% | 27 | 0.19% | 80 |
| 49 | ribosomal protein S25 (RPS25) | NM_001028.1 | 17 | 0.13% | 13 | 0.08% | 17 | 0.13% | 32 | 0.23% | 79 |
| 50 | collagen type XI alpha 1 (COL11A1) | NM_001854.1 | 46 | 0.34% | 18 | 0.10% | 7 | 0.06% | 8 | 0.06% | 79 |
| 51 | fibromodulin (FMOD) | NM_002023.2 | 8 | 0.06% | 41 | 0.24% | 19 | 0.15% | 11 | 0.08% | 79 |
| 52 | collagen type IX alpha 1 (COL9A1)(ORF) | NM_001851.1 | 74 | 0.55% | 4 | 0.02% | 0 | 0.00% | 0 | 0.00% | 78 |
| 53 | thioredoxin (TXN) | J04026 | 4 | 0.03% | 13 | 0.08% | 22 | 0.17% | 36 | 0.25% | 75 |
| 54 | ribosomal protein L37 | L11567 | 34 | 0.25% | 19 | 0.11% | 6 | 0.05% | 16 | 0.11% | 75 |

Figure 6 - Unique Known Genes Identified In Four cDNA Cartilage Libraries and EST Frequency Analysis - Page 2 of 102

| | | | | | | | | | | | |
|---|---|---|---|---|---|---|---|---|---|---|---|
| 55 | ribosomal protein S4, X-linked (RPS4X) | NM_001007.1 | 33 | 0.25% | 18 | 0.10% | 12 | 0.09% | 8 | 0.06% | 71 |
| 56 | NADH dehydrogenase (ubiquinone) 1 alpha sub | NM_002489.1 | 5 | 0.04% | 4 | 0.02% | 14 | 0.11% | 46 | 0.32% | 69 |
| 57 | ribosomal protein L3 (RPL3) | NM_000967.1 | 42 | 0.31% | 10 | 0.06% | 7 | 0.06% | 10 | 0.07% | 69 |
| 58 | LINE-1 REVERSE TRANSCRIPTASE HOMOLO | spP08547 | 1 | 0.01% | 46 | 0.27% | 14 | 0.11% | 7 | 0.05% | 68 |
| 59 | ribosomal protein L6 | X69391 | 24 | 0.18% | 17 | 0.10% | 11 | 0.09% | 14 | 0.10% | 66 |
| 60 | ribosomal protein L32 (RPL32) | NM_000994.1 | 38 | 0.28% | 16 | 0.09% | 6 | 0.05% | 6 | 0.04% | 66 |
| 61 | ribosomal protein L27 (RPL27) | NM_000988.1 | 27 | 0.20% | 12 | 0.07% | 7 | 0.06% | 19 | 0.13% | 65 |
| 62 | reverse transCRiptase | D84391 | 1 | 0.01% | 45 | 0.26% | 12 | 0.09% | 6 | 0.04% | 64 |
| 63 | asporin (ASPN) (LRR class 1) | NM_017680.1 | 0 | 0.00% | 4 | 0.02% | 24 | 0.19% | 35 | 0.25% | 63 |
| 64 | ribosomal protein L13 | AF112214 | 33 | 0.25% | 10 | 0.06% | 6 | 0.05% | 12 | 0.08% | 61 |
| 65 | Ribosomal protein L4 | NM_000968.1 | 18 | 0.13% | 27 | 0.16% | 4 | 0.03% | 12 | 0.08% | 61 |
| 66 | ribosomal protein S29 | L31610.1 | 18 | 0.13% | 16 | 0.09% | 8 | 0.06% | 17 | 0.12% | 59 |
| 67 | ribosomal protein L7a (surf 3) large subunit | M36072 | 25 | 0.19% | 15 | 0.09% | 8 | 0.06% | 10 | 0.07% | 58 |
| 68 | transforming growth factor beta-induced, 68kD ( | NM_000358.1 | 3 | 0.02% | 5 | 0.03% | 3 | 0.02% | 47 | 0.33% | 58 |
| 69 | ribosomal protein L30 | L05095.1 | 24 | 0.18% | 14 | 0.08% | 6 | 0.05% | 13 | 0.09% | 57 |
| 70 | ribosomal protein S12 | X53505 | 35 | 0.26% | 13 | 0.08% | 3 | 0.02% | 6 | 0.04% | 57 |
| 71 | ribosomal protein L23 | NM_000978.1 | 18 | 0.13% | 27 | 0.16% | 1 | 0.01% | 9 | 0.06% | 55 |
| 72 | ribosomal protein S13 | NM_001017.1 | 17 | 0.13% | 9 | 0.05% | 8 | 0.06% | 21 | 0.15% | 55 |
| 73 | hexabrachion (tenascin C, cytotactin) (HXB) | NM_002160.1 | 4 | 0.03% | 7 | 0.04% | 7 | 0.06% | 37 | 0.26% | 55 |
| 74 | ribosomal protein S24 | M31520 | 23 | 0.17% | 8 | 0.05% | 10 | 0.08% | 13 | 0.09% | 54 |
| 75 | cartilage link protein (CRTL1) | U43328.1 | 20 | 0.15% | 2 | 0.01% | 31 | 0.25% | 1 | 0.01% | 54 |
| 76 | actin, beta (ACTB) | NM_001101.2 | 21 | 0.16% | 25 | 0.15% | 4 | 0.03% | 3 | 0.02% | 53 |
| 77 | Ribosomal protein L36 (=RPL44) | AF077043.1 | 20 | 0.15% | 11 | 0.06% | 10 | 0.08% | 12 | 0.08% | 53 |
| 78 | ribosomal protein S17 | M13932 | 28 | 0.21% | 12 | 0.07% | 5 | 0.04% | 7 | 0.05% | 52 |
| 79 | cytokine-like protein C17 | NM_018659.1 | 0 | 0.00% | 42 | 0.24% | 9 | 0.07% | 0 | 0.00% | 51 |
| 80 | PRO2003 | AF116679.1 | 14 | 0.10% | 24 | 0.14% | 2 | 0.02% | 11 | 0.08% | 51 |
| 81 | prothymosin alpha | M14630 | 18 | 0.13% | 9 | 0.05% | 9 | 0.07% | 15 | 0.11% | 51 |
| 82 | tumor rejection antigen (gp96) 1 (TRA1) | X15187 | 10 | 0.07% | 7 | 0.04% | 19 | 0.15% | 15 | 0.11% | 51 |
| 83 | actin, gamma 1 (ACTG1) | NM_001614.1 | 31 | 0.23% | 10 | 0.06% | 3 | 0.02% | 7 | 0.05% | 51 |
| 84 | ferritin heavy chain | L20941.1 | 4 | 0.03% | 6 | 0.03% | 7 | 0.06% | 33 | 0.23% | 50 |
| 85 | PRO2853 | AF119905.1 | 0 | 0.00% | 35 | 0.20% | 10 | 0.08% | 5 | 0.04% | 50 |
| 86 | ribosomal protein L5 | U76609 | 23 | 0.17% | 8 | 0.05% | 10 | 0.08% | 7 | 0.05% | 48 |
| 87 | ribosomal protein L26 | X69392 | 18 | 0.13% | 6 | 0.03% | 11 | 0.09% | 13 | 0.09% | 48 |
| 88 | ribosomal protein, large, P1 (RPLP1) | NM_001003.1 | 40 | 0.30% | 1 | 0.01% | 3 | 0.02% | 4 | 0.03% | 48 |
| 89 | ribosomal protein L11 | L05092.1 | 25 | 0.19% | 0 | 0.00% | 16 | 0.13% | 7 | 0.05% | 48 |
| 90 | guanine nucleotide binding protein (G protein), b | NM_006098.1 | 21 | 0.16% | 20 | 0.12% | 4 | 0.03% | 3 | 0.02% | 48 |
| 91 | vitamin A responsive cytoskeleton related (JWA) | NM_006407.2 | 0 | 0.00% | 11 | 0.06% | 18 | 0.14% | 18 | 0.13% | 47 |
| 92 | HSPC312 (ORF) = AF161428.1 (=HSPC310) | AF161430 | 0 | 0.00% | 29 | 0.17% | 10 | 0.08% | 8 | 0.06% | 47 |
| 93 | H factor 1 (complement) (HF1) | NM_000186.1 | 1 | 0.01% | 19 | 0.11% | 17 | 0.13% | 10 | 0.07% | 47 |
| 94 | mimecan (OGN) (OIF) | AF202167.1 | 1 | 0.01% | 1 | 0.01% | 19 | 0.15% | 24 | 0.17% | 45 |
| 95 | S100 calcium-binding protein A4 (calcium protei | gi4506764 | 1 | 0.01% | 18 | 0.10% | 11 | 0.09% | 14 | 0.10% | 44 |
| 96 | annexin I (lipocortin I) (ANX1) =X05908 (ORF) | NM_000700.1 | 0 | 0.00% | 9 | 0.05% | 11 | 0.09% | 24 | 0.17% | 44 |
| 97 | glyceraldehyde 3-phosphate dehydrogenase (G/ | J02642 | 41 | 0.31% | 2 | 0.01% | 1 | 0.01% | 0 | 0.00% | 44 |
| 98 | ribosomal protein L27A | AB020236.1 | 34 | 0.25% | 7 | 0.04% | 1 | 0.01% | 2 | 0.01% | 44 |
| 99 | HSPC310 (=HSPC312) | AF161428.1 | 0 | 0.00% | 29 | 0.17% | 8 | 0.06% | 7 | 0.05% | 44 |
| 100 | calmodulin 2 (phosphorylase kinase, delta) (CA | NM_001743.1 | 0 | 0.00% | 7 | 0.04% | 25 | 0.20% | 11 | 0.08% | 43 |
| 101 | ribosomal protein L39 | D79205 | 15 | 0.11% | 11 | 0.06% | 4 | 0.03% | 13 | 0.09% | 43 |
| 102 | nascent-polypeptide-associated complex alpha p | NM_005594.1 | 6 | 0.04% | 6 | 0.03% | 13 | 0.10% | 18 | 0.13% | 43 |
| 103 | ribosomal protein L44 (RPL44) | NM_001001.1 | 14 | 0.10% | 5 | 0.03% | 10 | 0.08% | 13 | 0.09% | 42 |
| 104 | ubiquitin A-52 residue ribosomal protein fusion p | gi4507760 | 7 | 0.05% | 32 | 0.19% | 1 | 0.01% | 2 | 0.01% | 42 |
| 105 | cartilage matrix protein (CMP) gene | M55682.1 | 42 | 0.31% | 0 | 0.00% | 0 | 0.00% | 0 | 0.00% | 42 |
| 106 | TSC-22 protein | U35048 | 8 | 0.06% | 14 | 0.08% | 12 | 0.09% | 8 | 0.06% | 42 |
| 107 | mitochondrial genes for several tRNAs (Phe, Va | V00710.1 | 0 | 0.00% | 41 | 0.24% | 1 | 0.01% | 0 | 0.00% | 42 |
| 108 | ribosomal protein S19 | M81757.1 | 39 | 0.29% | 0 | 0.00% | 0 | 0.00% | 2 | 0.01% | 41 |
| 109 | ribosomal protein S28, yeast homologue | D14530 | 38 | 0.28% | 1 | 0.01% | 0 | 0.00% | 2 | 0.01% | 41 |
| 110 | deleted in split hand/split foot 1 (DSS1) | U41515 | 0 | 0.00% | 8 | 0.05% | 11 | 0.09% | 22 | 0.15% | 41 |
| 111 | ribosomal protein L35a | NM_000996.1 | 14 | 0.10% | 10 | 0.06% | 3 | 0.02% | 14 | 0.10% | 41 |

Figure 6 - Unique Known Genes Identified In Four cDNA Cartilage Libraries and EST Frequency Analysis - Page 3 of 102

| | | | | | | | | | | | |
|---|---|---|---|---|---|---|---|---|---|---|---|
| 112 | cytochrome c oxidase subunit VIIb | Z14244 | 4 | 0.03% | 5 | 0.03% | 12 | 0.09% | 20 | 0.14% | 41 |
| 113 | hH3.3B gene for histone H3.3 | Z48950.1 | 10 | 0.07% | 12 | 0.07% | 6 | 0.05% | 13 | 0.09% | 41 |
| 114 | RIBOSOMAL PROTEIN L10A (CSA-19)(RPL10/ | P53025 | 18 | 0.13% | 10 | 0.06% | 7 | 0.06% | 5 | 0.04% | 40 |
| 115 | ribosomal protein S15a | X84407 | 23 | 0.17% | 9 | 0.05% | 2 | 0.02% | 6 | 0.04% | 40 |
| 116 | ribosomal protein L15 | NM_002948.1 | 26 | 0.19% | 6 | 0.03% | 4 | 0.03% | 4 | 0.03% | 40 |
| 117 | eukaryotic translation initiation factor 3 (EIF3S6) | NM_001568.1 | 13 | 0.10% | 10 | 0.06% | 8 | 0.06% | 9 | 0.06% | 40 |
| 118 | ribosomal protein L23a | U43701 | 11 | 0.08% | 2 | 0.01% | 13 | 0.10% | 12 | 0.08% | 38 |
| 119 | KIAA0005 | D13630 | 0 | 0.00% | 6 | 0.03% | 19 | 0.15% | 13 | 0.09% | 38 |
| 120 | collagen type XI alpha2 (COL11A2) | U41068.1 | 34 | 0.25% | 4 | 0.02% | 0 | 0.00% | 0 | 0.00% | 38 |
| 121 | transcription elongation factor B (SIII), polypeptid | NM_003197.2 | 1 | 0.01% | 20 | 0.12% | 7 | 0.06% | 10 | 0.07% | 38 |
| 122 | lysosome-associated protein, transmembrane - 4 | U34259.1 | 6 | 0.04% | 7 | 0.04% | 10 | 0.08% | 15 | 0.11% | 38 |
| 123 | SUI1 isolog | AF083441.1 | 8 | 0.06% | 20 | 0.12% | 6 | 0.05% | 4 | 0.03% | 38 |
| 124 | small nuclear ribonucleoprotein polypeptide G (S | X85373 | 1 | 0.01% | 0 | 0.00% | 7 | 0.06% | 29 | 0.20% | 37 |
| 125 | 1-phosphatidylinositol-4-phosphate 5-kinase | S78798.1 | 37 | 0.28% | 0 | 0.00% | 0 | 0.00% | 0 | 0.00% | 37 |
| 126 | ribosomal protein L38 | Z26876 | 8 | 0.06% | 8 | 0.05% | 7 | 0.06% | 14 | 0.10% | 37 |
| 127 | cartilage intermediate layer protein, CILP | AB022430.1 | 1 | 0.01% | 5 | 0.03% | 17 | 0.13% | 14 | 0.10% | 37 |
| 128 | collagen type VI alpha 3 (COL6A3) | NM_004369.1 | 5 | 0.04% | 4 | 0.02% | 5 | 0.04% | 22 | 0.15% | 36 |
| 129 | ribosomal protein S18 | X69150.1 | 33 | 0.25% | 1 | 0.01% | 1 | 0.01% | 1 | 0.01% | 36 |
| 130 | F1-ATPase epsilon-subunit (ATP5E) | AF052955.1 | 3 | 0.02% | 8 | 0.05% | 7 | 0.06% | 15 | 0.11% | 33 |
| 131 | NADH dehydrogenase | X81900 | 2 | 0.01% | 20 | 0.12% | 3 | 0.02% | 8 | 0.06% | 33 |
| 132 | ribosomal protein L12 | L06505 | 12 | 0.09% | 8 | 0.05% | 3 | 0.02% | 10 | 0.07% | 33 |
| 133 | ribosomal protein S5 (RPS5) | NM_001009.1 | 29 | 0.22% | 2 | 0.01% | 1 | 0.01% | 1 | 0.01% | 33 |
| 134 | cytoskeletal gamma-actin | X04098 | 19 | 0.14% | 9 | 0.05% | 3 | 0.02% | 2 | 0.01% | 33 |
| 135 | androgen receptor associated protein 24 (ARA2 | AF052578 | 8 | 0.06% | 1 | 0.01% | 7 | 0.06% | 17 | 0.12% | 33 |
| 136 | collagen type IX alpha 3 (COL9A3) | AF026802.1 | 26 | 0.19% | 6 | 0.03% | 0 | 0.00% | 0 | 0.00% | 32 |
| 137 | cytochrome c oxidase, liver specific (EC 1.9.3.1. | X15822 | 4 | 0.03% | 3 | 0.02% | 10 | 0.08% | 15 | 0.11% | 32 |
| 138 | tubulin beta | AF070561 | 19 | 0.14% | 5 | 0.03% | 6 | 0.05% | 2 | 0.01% | 32 |
| 139 | myosin regulatory light chain | X54304 | 6 | 0.04% | 5 | 0.03% | 4 | 0.03% | 16 | 0.11% | 31 |
| 140 | ribosomal protein L19 | X63527 | 16 | 0.12% | 3 | 0.02% | 3 | 0.02% | 9 | 0.06% | 31 |
| 141 | ribosomal protein S3 (RPS3) | NM_001005.1 | 21 | 0.16% | 2 | 0.01% | 5 | 0.04% | 3 | 0.02% | 31 |
| 142 | clusterin (CLU) SP40,40 (=M63379 TRPM-2 pro | NM_001831.1 | 1 | 0.01% | 14 | 0.08% | 7 | 0.06% | 9 | 0.06% | 31 |
| 143 | ribosomal protein L18 (RPL18) | NM_000979.1 | 28 | 0.21% | 1 | 0.01% | 0 | 0.00% | 2 | 0.01% | 31 |
| 144 | nephropontin (=X13694.1 osteopontin) | M83248.1 | 0 | 0.00% | 9 | 0.05% | 0 | 0.00% | 22 | 0.15% | 31 |
| 145 | ribonuclease, RNase A family, 1(pancreatic) (Re | NP_002924.1 | 1 | 0.01% | 28 | 0.16% | 0 | 0.00% | 2 | 0.01% | 31 |
| 146 | Tubulin alpha isoform 1 | AF081484 | 16 | 0.12% | 3 | 0.02% | 2 | 0.02% | 9 | 0.06% | 30 |
| 147 | ribosomal protein S23 (RPS23) =D14530 (ORF) | NM_001025.1 | 8 | 0.06% | 13 | 0.08% | 3 | 0.02% | 6 | 0.04% | 30 |
| 148 | T-cell cyclophilin | Y00052 | 18 | 0.13% | 4 | 0.02% | 2 | 0.02% | 6 | 0.04% | 30 |
| 149 | ribosomal protein L22 (RPL22) | NM_000983.1 | 6 | 0.04% | 14 | 0.08% | 3 | 0.02% | 7 | 0.05% | 30 |
| 150 | ribosomal protein L35 | U12465 | 27 | 0.20% | 2 | 0.01% | 0 | 0.00% | 1 | 0.01% | 30 |
| 151 | ribonuclease, RNase A | NM_002937.1 | 1 | 0.01% | 27 | 0.16% | 0 | 0.00% | 2 | 0.01% | 30 |
| 152 | collagen lysyl hydroxylase isoform 2 (PLOD2) | U84573 | 2 | 0.01% | 7 | 0.04% | 8 | 0.06% | 13 | 0.09% | 30 |
| 153 | heterogeneous nuclear ribonucleoprotein A1 (HN | NM_002136.1 | 14 | 0.10% | 8 | 0.05% | 3 | 0.02% | 4 | 0.03% | 29 |
| 154 | ATP synthase, H transporting,mitochondrial F0 | NP_009031.1 | 0 | 0.00% | 16 | 0.09% | 4 | 0.03% | 9 | 0.06% | 29 |
| 155 | eukaryotic translation initiation factor 4 gamma, | NM_001418.1 | 3 | 0.02% | 5 | 0.03% | 4 | 0.03% | 17 | 0.12% | 29 |
| 156 | integrin-binding sialoprotein (bone sialoprotein, b | NM_004967.1 | 0 | 0.00% | 29 | 0.17% | 0 | 0.00% | 0 | 0.00% | 29 |
| 157 | mitochondrial ATPase coupling factor 6 subunit ( | M37104 | 0 | 0.00% | 1 | 0.01% | 6 | 0.05% | 22 | 0.15% | 29 |
| 158 | heparan sulfate proteoglycan (HSPG) (OCI5) | J04621.1 | 9 | 0.07% | 4 | 0.02% | 4 | 0.03% | 12 | 0.08% | 29 |
| 159 | ribosomal protein S21 (RPS21) | L04483 | 21 | 0.16% | 3 | 0.02% | 1 | 0.01% | 4 | 0.03% | 29 |
| 160 | nucleolar phosphoprotein B23 (NPM1) | M28699 | 4 | 0.03% | 14 | 0.08% | 4 | 0.03% | 7 | 0.05% | 29 |
| 161 | cartilage-derived C-type lectin (CLECSF1) | AF077345 | 0 | 0.00% | 18 | 0.10% | 4 | 0.03% | 7 | 0.05% | 29 |
| 162 | ribosomal protein L8 | Z28407 | 24 | 0.18% | 0 | 0.00% | 3 | 0.02% | 1 | 0.01% | 28 |
| 163 | spermidine/spermine N1-acetyltransferase | Z14136 | 1 | 0.01% | 7 | 0.04% | 10 | 0.08% | 10 | 0.07% | 28 |
| 164 | Sec61 gamma | AF054184 | 3 | 0.02% | 5 | 0.03% | 3 | 0.02% | 17 | 0.12% | 28 |
| 165 | MEN1 region clone epsilon/beta | AF001893.1 | 0 | 0.00% | 16 | 0.09% | 8 | 0.06% | 4 | 0.03% | 28 |
| 166 | polyubiquitin | E12605 | 13 | 0.10% | 8 | 0.05% | 2 | 0.02% | 5 | 0.04% | 28 |
| 167 | ribosomal protein S7 | M77233 | 8 | 0.06% | 7 | 0.04% | 2 | 0.02% | 11 | 0.08% | 28 |
| 168 | caveolin 1 (CAV1) | AF125348.1 | 0 | 0.00% | 6 | 0.03% | 11 | 0.09% | 11 | 0.08% | 28 |

Figure 6 - Unique Known Genes Identified In Four cDNA Cartilage Libraries and EST Frequency Analysis - Page 4 of 102

| | | | | | | | | | | | |
|---|---|---|---|---|---|---|---|---|---|---|---|
| 169 | ribosomal protein L18a | L05093.1 | 27 | 0.20% | 1 | 0.01% | 0 | 0.00% | 0 | 0.00% | 28 |
| 170 | HSPC036 protein (=AF077200.1 HSPC014) | AF125097.1 | 2 | 0.01% | 0 | 0.00% | 8 | 0.06% | 18 | 0.13% | 28 |
| 171 | lectin, galactoside-binding, soluble, 1 (galectin 1 | NM_002305.2 | 22 | 0.16% | 4 | 0.02% | 2 | 0.02% | 0 | 0.00% | 28 |
| 172 | hemoglobin, gamma G (HBG2) (=PRO2898) | NM_000184.1 | 27 | 0.20% | 0 | 0.00% | 0 | 0.00% | 0 | 0.00% | 27 |
| 173 | ribosomal protein L24 (RPL24) (=ribosomal prot | NM_000986.1 | 8 | 0.06% | 12 | 0.07% | 1 | 0.01% | 6 | 0.04% | 27 |
| 174 | high mobility group-1 protein (HMG-1) | X12597 | 4 | 0.03% | 1 | 0.01% | 12 | 0.09% | 10 | 0.07% | 27 |
| 175 | integrin beta 1 subunit | X07979.1 | 1 | 0.01% | 4 | 0.02% | 6 | 0.05% | 16 | 0.11% | 27 |
| 176 | hemoglobin, gamma A (HBG1) | NM_000559.1 | 27 | 0.20% | 0 | 0.00% | 0 | 0.00% | 0 | 0.00% | 27 |
| 177 | ribosomal protein S9 | U14971 | 27 | 0.20% | 0 | 0.00% | 0 | 0.00% | 0 | 0.00% | 27 |
| 178 | lysosomal membrane glycoprotein CD63 (=M59 | M58485 | 7 | 0.05% | 12 | 0.07% | 3 | 0.02% | 4 | 0.03% | 26 |
| 179 | RIBOSOMAL PROTEIN S2 (S4) (LLREP3 PRO | spP15880 | 24 | 0.18% | 1 | 0.01% | 1 | 0.01% | 0 | 0.00% | 26 |
| 180 | matrilin-3 (MATR3) | Y13341 | 7 | 0.05% | 7 | 0.04% | 3 | 0.02% | 9 | 0.06% | 26 |
| 181 | chitinase (HUMTCHIT) | U58515 | 0 | 0.00% | 1 | 0.01% | 0 | 0.00% | 25 | 0.18% | 26 |
| 182 | CGI-134 protein (LOC51023) | NM_016067.1 | 0 | 0.00% | 4 | 0.02% | 4 | 0.03% | 18 | 0.13% | 26 |
| 183 | ribosomal protein S10 | NM_001014.1 | 22 | 0.16% | 1 | 0.01% | 0 | 0.00% | 3 | 0.02% | 26 |
| 184 | tissue inhibitor of metalloproteinase 3 (Sorsby fu | NM_000362.1 | 2 | 0.01% | 3 | 0.02% | 15 | 0.12% | 6 | 0.04% | 26 |
| 185 | H19 (=PRO2605) | M32053 | 25 | 0.19% | 1 | 0.01% | 0 | 0.00% | 0 | 0.00% | 26 |
| 186 | histone H3.3 | Z48950 | 3 | 0.02% | 12 | 0.07% | 4 | 0.03% | 7 | 0.05% | 26 |
| 187 | ferritin L chain | M11147 | 9 | 0.07% | 12 | 0.07% | 1 | 0.01% | 3 | 0.02% | 25 |
| 188 | signal recognition particle 14kD (homologous Al | NM_003134.1 | 3 | 0.02% | 15 | 0.09% | 6 | 0.05% | 1 | 0.01% | 25 |
| 189 | fatty acid binding protein (adipocyte lipid-binding | NM_001442.1 | 4 | 0.03% | 2 | 0.01% | 18 | 0.14% | 1 | 0.01% | 25 |
| 190 | ribosomal protein, large P2 (RPLP2) | NM_001004.1 | 14 | 0.10% | 7 | 0.04% | 2 | 0.02% | 2 | 0.01% | 25 |
| 191 | CD63 antigen (melanoma 1 antigen) (CD63) | NM_001780.1 | 7 | 0.05% | 12 | 0.07% | 4 | 0.03% | 2 | 0.01% | 25 |
| 192 | defender against cell death 1 (DAD1) | NM_001344.1 | 3 | 0.02% | 9 | 0.05% | 5 | 0.04% | 8 | 0.06% | 25 |
| 193 | cytochrome b (ORF) | U09500 | 5 | 0.04% | 8 | 0.05% | 5 | 0.04% | 7 | 0.05% | 25 |
| 194 | metallothionein-II (mt-II) | J00271 | 0 | 0.00% | 23 | 0.13% | 1 | 0.01% | 1 | 0.01% | 25 |
| 195 | RNA polymerase II elongation factor-like protein | Z47087 | 8 | 0.06% | 2 | 0.01% | 5 | 0.04% | 10 | 0.07% | 25 |
| 196 | insulin-like growth factor II (IGF-2) | X07868 | 24 | 0.18% | 0 | 0.00% | 0 | 0.00% | 0 | 0.00% | 24 |
| 197 | CD9 antigen (p24/CD9) | L08125 | 3 | 0.02% | 2 | 0.01% | 10 | 0.08% | 9 | 0.06% | 24 |
| 198 | lactate dehydrogenase A (LDHA) | NM_005566.1 | 4 | 0.03% | 4 | 0.02% | 5 | 0.04% | 11 | 0.08% | 24 |
| 199 | poly(A)-binding protein (PABP) | U68105 | 6 | 0.04% | 8 | 0.05% | 1 | 0.01% | 9 | 0.06% | 24 |
| 200 | mitochondrial ubiquinone-binding protein | M26700 | 4 | 0.03% | 3 | 0.02% | 10 | 0.08% | 7 | 0.05% | 24 |
| 201 | ATP synthase, H transporting, mitochondrial F0 | Hs.107476 | 4 | 0.03% | 9 | 0.05% | 4 | 0.03% | 7 | 0.05% | 24 |
| 202 | MORF-related gene X (KIAA0026) (=MRG15) | NM_012286.1 | 2 | 0.01% | 11 | 0.06% | 4 | 0.03% | 7 | 0.05% | 24 |
| 203 | brain-expressed HHCPA78 homologue (VDUP1 | S73591 | 2 | 0.01% | 17 | 0.10% | 0 | 0.00% | 5 | 0.04% | 24 |
| 204 | PRO1574 (mitochondrial proteolipid 68MP homo | AF116639.1 | 2 | 0.01% | 11 | 0.06% | 5 | 0.04% | 6 | 0.04% | 24 |
| 205 | heat shock 10kD protein 1 (chaperonin 10) (HSF | NM_002157.1 | 1 | 0.01% | 13 | 0.08% | 5 | 0.04% | 4 | 0.03% | 23 |
| 206 | complement factor H (=M17517) | Y00716 | 2 | 0.01% | 2 | 0.01% | 15 | 0.12% | 4 | 0.03% | 23 |
| 207 | osteomodulin (OMD) | AB000114 | 0 | 0.00% | 6 | 0.03% | 6 | 0.05% | 11 | 0.08% | 23 |
| 208 | epithelial membrane protein 1 (EMP1) | NM_001423.1 | 1 | 0.01% | 7 | 0.04% | 6 | 0.05% | 9 | 0.06% | 23 |
| 209 | Tigger1 transposable element | U49973.1 | 5 | 0.04% | 8 | 0.05% | 7 | 0.06% | 3 | 0.02% | 23 |
| 210 | cysteine dioxygenase | D85777 | 0 | 0.00% | 1 | 0.01% | 10 | 0.08% | 12 | 0.08% | 23 |
| 211 | dynein light chain 1 (hdlc1), cytoplasmic | U32944 | 5 | 0.04% | 3 | 0.02% | 4 | 0.03% | 11 | 0.08% | 23 |
| 212 | calcyclin (=M14300 growth factor-inducible 2A9 | J02763 | 10 | 0.07% | 1 | 0.01% | 4 | 0.03% | 8 | 0.06% | 23 |
| 213 | ATP synthase, H transporting, mitochondrial F1 | NM_006476.1 | 7 | 0.05% | 1 | 0.01% | 7 | 0.06% | 7 | 0.05% | 22 |
| 214 | ribosomal protein L29 (RPL29) | NM_000992.1 | 21 | 0.16% | 1 | 0.01% | 0 | 0.00% | 0 | 0.00% | 22 |
| 215 | FK506 binding protein (Fkbp63) | AF090334 | 8 | 0.06% | 6 | 0.03% | 2 | 0.02% | 6 | 0.04% | 22 |
| 216 | COX17 (yeast) homolog, cytochrome c oxidase | NM_005694.1 | 0 | 0.00% | 5 | 0.03% | 8 | 0.06% | 9 | 0.06% | 22 |
| 217 | ribosomal protein S14 (RPS14) | NM_005617.1 | 21 | 0.16% | 0 | 0.00% | 0 | 0.00% | 1 | 0.01% | 22 |
| 218 | ribosomal protein S16 | M60854 | 14 | 0.10% | 2 | 0.01% | 1 | 0.01% | 5 | 0.04% | 22 |
| 219 | solute carrier family 25 (mitochondrial carrier; ph | NM_005888.1 | 6 | 0.04% | 4 | 0.02% | 4 | 0.03% | 8 | 0.06% | 22 |
| 220 | aggrecan (chondroitin sulfate proteoglycan 1, lar | U13613 | 14 | 0.10% | 1 | 0.01% | 4 | 0.03% | 3 | 0.02% | 22 |
| 221 | BiP protein | X87949 | 5 | 0.04% | 2 | 0.01% | 6 | 0.05% | 9 | 0.06% | 22 |
| 222 | 78 kD glucose-regulated protein (GRP78) gene ( | M19645.1 | 4 | 0.03% | 2 | 0.01% | 6 | 0.05% | 10 | 0.07% | 22 |
| 223 | hemoglobin beta chain (HBB) | AF117710 | 0 | 0.00% | 4 | 0.02% | 16 | 0.13% | 1 | 0.01% | 21 |
| 224 | cytochrome c oxidase subunit I | D38112 | 0 | 0.00% | 20 | 0.12% | 1 | 0.01% | 0 | 0.00% | 21 |
| 225 | tyrosine 3-monooxygenase/tryptophan 5-monoo | NM_003404.1 | 4 | 0.03% | 4 | 0.02% | 4 | 0.03% | 9 | 0.06% | 21 |

Figure 6 - Unique Known Genes Identified In Four cDNA Cartilage Libraries and EST Frequency Analysis - Page 5 of 102

| | | | | | | | | | | | |
|---|---|---|---|---|---|---|---|---|---|---|---|
| 226 | selenoprotein P (SEPP1) | Z11793 | 1 | 0.01% | 10 | 0.06% | 5 | 0.04% | 5 | 0.04% | 21 |
| 227 | elongation factor 2 | X51466 | 16 | 0.12% | 1 | 0.01% | 0 | 0.00% | 4 | 0.03% | 21 |
| 228 | ribosomal protein L14 | D87735 | 12 | 0.09% | 4 | 0.02% | 2 | 0.02% | 3 | 0.02% | 21 |
| 229 | endozepine (putative ligand of benzodiazepine r | M15887.1 | 2 | 0.01% | 1 | 0.01% | 6 | 0.05% | 12 | 0.08% | 21 |
| 230 | annexin A5 (ANXA5)(lipocortin-V) | NM_001154.2 | 9 | 0.07% | 4 | 0.02% | 1 | 0.01% | 7 | 0.05% | 21 |
| 231 | carboxypeptidase E (CPE) | NM_001873.1 | 6 | 0.04% | 8 | 0.05% | 7 | 0.06% | 0 | 0.00% | 21 |
| 232 | collagen type IX alpha 2 (COL9A2) | M95610 | 21 | 0.16% | 0 | 0.00% | 0 | 0.00% | 0 | 0.00% | 21 |
| 233 | myosin, light polypeptide, regulatory, non-sarcor | Hs.233936 | 2 | 0.01% | 7 | 0.04% | 4 | 0.03% | 8 | 0.06% | 21 |
| 234 | SPARC-like 1 (mast9, hevin) (SPARCL1) | NM_004684.1 | 2 | 0.01% | 2 | 0.01% | 16 | 0.13% | 0 | 0.00% | 20 |
| 235 | Cyr61 protein (CYR61) | AF031385 | 6 | 0.04% | 7 | 0.04% | 3 | 0.02% | 4 | 0.03% | 20 |
| 236 | fibrillin (FBN1) | X63556 | 4 | 0.03% | 2 | 0.01% | 3 | 0.02% | 11 | 0.08% | 20 |
| 237 | trophoblast STAT utron | AF080092.1 | 0 | 0.00% | 13 | 0.08% | 4 | 0.03% | 3 | 0.02% | 20 |
| 238 | prefoldin 5 (PFDN5) (=D89667 c-myc binding pr | NP_002615.1 | 3 | 0.02% | 2 | 0.01% | 4 | 0.03% | 10 | 0.07% | 19 |
| 239 | cytochrome c oxidase subunit VIIc (COX7C) | NM_001867.1 | 2 | 0.01% | 3 | 0.02% | 7 | 0.06% | 7 | 0.05% | 19 |
| 240 | ring-box 1 (RBX1) | NM_014248.1 | 1 | 0.01% | 5 | 0.03% | 2 | 0.02% | 11 | 0.08% | 19 |
| 241 | epididymal seCRetory protein (19.5kD) (HE1) | gi5453677 | 0 | 0.00% | 6 | 0.03% | 6 | 0.05% | 7 | 0.05% | 19 |
| 242 | SRY (sex-determining region Y)-box 9 (campom | NM_000346.1 | 4 | 0.03% | 13 | 0.08% | 0 | 0.00% | 2 | 0.01% | 19 |
| 243 | H4 histone family, member G (H4FG) | NM_003542.2 | 0 | 0.00% | 2 | 0.01% | 3 | 0.02% | 14 | 0.10% | 19 |
| 244 | apolipoprotein D (APOD) | J02611 | 0 | 0.00% | 17 | 0.10% | 2 | 0.02% | 0 | 0.00% | 19 |
| 245 | cathepsin K (pycnodysostosis)(CTSK) | NM_000396.1 | 5 | 0.04% | 5 | 0.03% | 3 | 0.02% | 6 | 0.04% | 19 |
| 246 | peptidylglycine alpha-amidating monooxygenase | M37721 | 2 | 0.01% | 5 | 0.03% | 7 | 0.06% | 5 | 0.04% | 19 |
| 247 | zinc finger protein 216 (ZNF216) | AF062072.1 | 3 | 0.02% | 10 | 0.06% | 4 | 0.03% | 2 | 0.01% | 19 |
| 248 | heterogeneous nuclear ribonucleoprotein D-like ( | NM_005463.1 | 4 | 0.03% | 4 | 0.02% | 5 | 0.04% | 6 | 0.04% | 19 |
| 249 | chondromodulin I precursor (CHM-I) | NM_007015.1 | 15 | 0.11% | 4 | 0.02% | 0 | 0.00% | 0 | 0.00% | 19 |
| 250 | osteoclastogenesis inhibitory factor | AB008822 | 2 | 0.01% | 0 | 0.00% | 8 | 0.06% | 9 | 0.06% | 19 |
| 251 | enolase 1 (alpha) (ENO1) | NM_001428.1 | 16 | 0.12% | 0 | 0.00% | 1 | 0.01% | 2 | 0.01% | 19 |
| 252 | v-fos FBJ murine osteosarcoma viral oncogene ( | NM_005252.2 | 12 | 0.09% | 5 | 0.03% | 1 | 0.01% | 1 | 0.01% | 19 |
| 253 | palladin (KIAA0992)= CGI-151 | NM_016081.1 | 3 | 0.02% | 7 | 0.04% | 2 | 0.02% | 7 | 0.05% | 19 |
| 254 | heterogeneous nuclear ribonucleoprotein D (hnR | D55671 | 4 | 0.03% | 4 | 0.02% | 5 | 0.04% | 6 | 0.04% | 19 |
| 255 | procollagen-lysine, 2-oxoglutarate 5-dioxygenas | Hs.41270 | 2 | 0.01% | 7 | 0.04% | 4 | 0.03% | 6 | 0.04% | 19 |
| 256 | lysyl oxidase | U22384 | 6 | 0.04% | 5 | 0.03% | 0 | 0.00% | 7 | 0.05% | 18 |
| 257 | gap junction protein, alpha 1, 43kD (connexin 43 | NM_000165.2 | 1 | 0.01% | 0 | 0.00% | 1 | 0.01% | 16 | 0.11% | 18 |
| 258 | procollagen C-endopeptidase enhancer 2 (PCOL | NM_013363.1 | 1 | 0.01% | 12 | 0.07% | 5 | 0.04% | 0 | 0.00% | 18 |
| 259 | NADH dehydrogenase subunit 4L (RefSeq aa 2e | gi5835396 | 0 | 0.00% | 12 | 0.07% | 1 | 0.01% | 5 | 0.04% | 18 |
| 260 | ubiquinol-cytochrome c reductase complex (7.2 | NP_037519.1 | 2 | 0.01% | 4 | 0.02% | 8 | 0.06% | 4 | 0.03% | 18 |
| 261 | ATPase, H transporting, lysosomal (vacuolar pr | NM_003945.1 | 1 | 0.01% | 9 | 0.05% | 2 | 0.02% | 6 | 0.04% | 18 |
| 262 | ATP synthase, H transporting, mitochondrial F1 | NM_005174.1 | 5 | 0.04% | 2 | 0.01% | 4 | 0.03% | 7 | 0.05% | 18 |
| 263 | muscleblind (Drosophila)-like (MBNL) (=KIAA04 | NM_021038.1 | 1 | 0.01% | 7 | 0.04% | 3 | 0.02% | 7 | 0.05% | 18 |
| 264 | calumein (Calu) (calumenin) | AF013759 | 8 | 0.06% | 2 | 0.01% | 2 | 0.02% | 6 | 0.04% | 18 |
| 265 | ATP synthase, H transporting, mitochondrial F1 | NM_004046.1 | 5 | 0.04% | 2 | 0.01% | 4 | 0.03% | 7 | 0.05% | 18 |
| 266 | guanine nucleotide binding protein (G protein), a | NM_000516.2 | 7 | 0.05% | 7 | 0.04% | 1 | 0.01% | 3 | 0.02% | 18 |
| 267 | vacuolar H-ATPase subunit | AF038954 | 1 | 0.01% | 8 | 0.05% | 2 | 0.02% | 7 | 0.05% | 18 |
| 268 | ribosomal protein 40S S27 isoform (RefSeq aa 4 | NP_057004.1 | 0 | 0.00% | 3 | 0.02% | 0 | 0.00% | 15 | 0.11% | 18 |
| 269 | elongation factor 1 beta 2 (EEF1B2) | NM_001959.1 | 10 | 0.07% | 2 | 0.01% | 3 | 0.02% | 2 | 0.01% | 17 |
| 270 | laminin receptor 1 (67kD, ribosomal protein SA) | NM_002295.1 | 12 | 0.09% | 2 | 0.01% | 2 | 0.02% | 1 | 0.01% | 17 |
| 271 | B-cell translocation protein 1 (BTG1) | X61123 | 5 | 0.04% | 5 | 0.03% | 2 | 0.02% | 5 | 0.04% | 17 |
| 272 | NADH dehydrogenase(ubiquinone) Fe-S protein | NM_004552.1 | 4 | 0.03% | 8 | 0.05% | 3 | 0.02% | 2 | 0.01% | 17 |
| 273 | dolichyl-phosphate beta-glucosyltransferase (AL | AF102850.1 | 13 | 0.10% | 1 | 0.01% | 1 | 0.01% | 2 | 0.01% | 17 |
| 274 | frizzled-related protein (FRZB) | NM_001463.1 | 3 | 0.02% | 8 | 0.05% | 2 | 0.02% | 4 | 0.03% | 17 |
| 275 | pp21 homolog | AF125535.1 | 1 | 0.01% | 0 | 0.00% | 4 | 0.03% | 12 | 0.08% | 17 |
| 276 | neuroendocrine-specific protein C like (foocen) ( | NM_007008.1 | 1 | 0.01% | 3 | 0.02% | 5 | 0.04% | 8 | 0.06% | 17 |
| 277 | testis enhanced gene transCRipt protein (TEGT) | AF033095 | 4 | 0.03% | 6 | 0.03% | 4 | 0.03% | 3 | 0.02% | 17 |
| 278 | SOD-2 manganese superoxide dismutase | X65965 | 1 | 0.01% | 7 | 0.04% | 4 | 0.03% | 5 | 0.04% | 17 |
| 279 | decay-accelerating factor | M31516 | 0 | 0.00% | 4 | 0.02% | 7 | 0.06% | 6 | 0.04% | 17 |
| 280 | metallothionein-le (hMT-le) | M10942 | 0 | 0.00% | 13 | 0.08% | 2 | 0.02% | 2 | 0.01% | 17 |
| 281 | platelet-derived growth factor receptor alpha (PD | M21574 | 4 | 0.03% | 4 | 0.02% | 5 | 0.04% | 4 | 0.03% | 17 |
| 282 | miCRosomal signal peptidase | AF061737 | 3 | 0.02% | 5 | 0.03% | 4 | 0.03% | 5 | 0.04% | 17 |

Figure 6 - Unique Known Genes Identified In Four cDNA Cartilage Libraries and EST Frequency Analysis - Page 6 of 102

| | | | | | | | | | | |
|---|---|---|---|---|---|---|---|---|---|---|
| 283 | enhancer of rudimentary homologue | U66871 | 5 | 0.04% | 4 | 0.02% | 5 | 0.04% | 3 | 0.02% | 17 |
| 284 | tomoregulin | AB004064.1 | 3 | 0.02% | 2 | 0.01% | 4 | 0.03% | 8 | 0.06% | 17 |
| 285 | cell division cycle 10 (homologous to CDC10 of | NM_001788.1 | 4 | 0.03% | 5 | 0.03% | 2 | 0.02% | 6 | 0.04% | 17 |
| 286 | cytochrome c oxidase subunitIII (RefSeq aa 8e-4 | 5835394 | 0 | 0.00% | 17 | 0.10% | 0 | 0.00% | 0 | 0.00% | 17 |
| 287 | t-complex-associated-testis-expressed 1-like 1 ( | NM_006519.1 | 2 | 0.01% | 12 | 0.07% | 2 | 0.02% | 1 | 0.01% | 17 |
| 288 | guanine nucleotide binding protein (G protein), a | BC008855.1 | 8 | 0.06% | 7 | 0.04% | 0 | 0.00% | 2 | 0.01% | 17 |
| 289 | DEAD/H (Asp-Glu-Ala-Asp/His) box polypeptide | NM_004396.1 | 2 | 0.01% | 4 | 0.02% | 6 | 0.05% | 4 | 0.03% | 16 |
| 290 | calpactin 1 light chain | M81457 | 0 | 0.00% | 0 | 0.00% | 3 | 0.02% | 13 | 0.09% | 16 |
| 291 | hairy (Drosophila)-homolog (HRY) | NM_005524.2 | 0 | 0.00% | 11 | 0.06% | 3 | 0.02% | 2 | 0.01% | 16 |
| 292 | rapa-2 (rapa gene) | AJ277276.1 | 16 | 0.12% | 0 | 0.00% | 0 | 0.00% | 0 | 0.00% | 16 |
| 293 | deiodinase, iodothyronine, type II (DIO2), transC | gi7549802 | 0 | 0.00% | 14 | 0.08% | 1 | 0.01% | 1 | 0.01% | 16 |
| 294 | ADP-ribosylation factor 4 (ARF4) | AF104238.1 | 0 | 0.00% | 6 | 0.03% | 3 | 0.02% | 7 | 0.05% | 16 |
| 295 | KVLQT1 gene (=p150) | AJ006345.1 | 2 | 0.01% | 7 | 0.04% | 6 | 0.05% | 1 | 0.01% | 16 |
| 296 | thrombospondin 2 (THBS2) | L12350 | 5 | 0.04% | 2 | 0.01% | 1 | 0.01% | 8 | 0.06% | 16 |
| 297 | fatty acid binding protein 4, adipocyte (FABP4), | Hs.83213 | 0 | 0.00% | 0 | 0.00% | 15 | 0.12% | 1 | 0.01% | 16 |
| 298 | p40 | AAC51266.1 | 0 | 0.00% | 7 | 0.04% | 3 | 0.02% | 6 | 0.04% | 16 |
| 299 | TI-227H (=tomoregulin; mitchondrial) | D50525 | 2 | 0.01% | 9 | 0.05% | 1 | 0.01% | 4 | 0.03% | 16 |
| 300 | cyclin I | D50310 | 4 | 0.03% | 4 | 0.02% | 3 | 0.02% | 5 | 0.04% | 16 |
| 301 | S100 calcium-binding protein A10 (annexin II lig | NM_002966.1 | 0 | 0.00% | 3 | 0.02% | 3 | 0.02% | 10 | 0.07% | 16 |
| 302 | ribosomal protein L28 | U14969 | 16 | 0.12% | 0 | 0.00% | 0 | 0.00% | 0 | 0.00% | 16 |
| 303 | glucocorticoid-induced GILZ | AF228339 | 3 | 0.02% | 8 | 0.05% | 1 | 0.01% | 4 | 0.03% | 16 |
| 304 | collagen type V alpha 2 (COL5A2) | M11718 | 4 | 0.03% | 1 | 0.01% | 2 | 0.02% | 8 | 0.06% | 15 |
| 305 | H3 histone, family 3A (H3F3A) | NM_002107.1 | 8 | 0.06% | 3 | 0.02% | 0 | 0.00% | 4 | 0.03% | 15 |
| 306 | neural precursor cell expressed, developmentall | NM_004404.1 | 6 | 0.04% | 3 | 0.02% | 3 | 0.02% | 3 | 0.02% | 15 |
| 307 | heat shock factor binding protein 1 (HSBP1) | NM_001537.1 | 1 | 0.01% | 2 | 0.01% | 2 | 0.02% | 10 | 0.07% | 15 |
| 308 | glypican 3 (GPC3) (chromosome X) (=L47176 G | L47125 | 15 | 0.11% | 0 | 0.00% | 0 | 0.00% | 0 | 0.00% | 15 |
| 309 | translocation protein 1(TLOC1) | NM_003262.1 | 3 | 0.02% | 6 | 0.03% | 6 | 0.05% | 0 | 0.00% | 15 |
| 310 | thrombospondin 4 (THBS4) | NM_003248.1 | 4 | 0.03% | 8 | 0.05% | 3 | 0.02% | 0 | 0.00% | 15 |
| 311 | 6.2 kd protein | AJ011007 | 0 | 0.00% | 14 | 0.08% | 1 | 0.01% | 0 | 0.00% | 15 |
| 312 | mannosidase, beta A, lysosomal (MANBA) gene | AF224669.1 | 3 | 0.02% | 6 | 0.03% | 1 | 0.01% | 5 | 0.04% | 15 |
| 313 | ubiquitin-like 1 (sentrin) (UBL1) (=SUMO-1) | NM_003352.1 | 2 | 0.01% | 3 | 0.02% | 9 | 0.07% | 1 | 0.01% | 15 |
| 314 | TGF-betaIIR alpha | D50683 | 1 | 0.01% | 4 | 0.02% | 2 | 0.02% | 8 | 0.06% | 15 |
| 315 | H2A histone family, member Z (H2AFZ) = D284 | NM_002106.1 | 4 | 0.03% | 10 | 0.06% | 0 | 0.00% | 1 | 0.01% | 15 |
| 316 | MAFB/Kreisler basic region/leucine zipper trans | AF134157.1 | 1 | 0.01% | 1 | 0.01% | 0 | 0.00% | 13 | 0.09% | 15 |
| 317 | cig19 (=D31887.1 KIAA0062) | AF026940.1 | 1 | 0.01% | 6 | 0.03% | 2 | 0.02% | 6 | 0.04% | 15 |
| 318 | UMP-CMP kinase | AF110643.1 | 0 | 0.00% | 3 | 0.02% | 5 | 0.04% | 7 | 0.05% | 15 |
| 319 | cytochrome c oxidase subunit II gene (ORF) | AF004339 | 3 | 0.02% | 10 | 0.06% | 2 | 0.02% | 0 | 0.00% | 15 |
| 320 | cytosolic selenium-dependent glutathione peroxi | M83094 | 2 | 0.01% | 3 | 0.02% | 7 | 0.06% | 3 | 0.02% | 15 |
| 321 | collagen type XIV variant C-terminal NC1 and 3' | Y11711 | 6 | 0.04% | 6 | 0.03% | 2 | 0.02% | 1 | 0.01% | 15 |
| 322 | phosphoglycerate mutase (PGAM-B) | J04173 | 6 | 0.04% | 1 | 0.01% | 1 | 0.01% | 7 | 0.05% | 15 |
| 323 | phosphoglycerate kinase 1 (PGK1) (ORF) | NM_000291.1 | 3 | 0.02% | 4 | 0.02% | 2 | 0.02% | 6 | 0.04% | 15 |
| 324 | reverse transcriptase related protein | prf1207289A | 1 | 0.01% | 11 | 0.06% | 2 | 0.02% | 1 | 0.01% | 15 |
| 325 | Heterogeneous nuclear ribonucleoprotein U (sca | NM_004501.1 | 3 | 0.02% | 4 | 0.02% | 5 | 0.04% | 3 | 0.02% | 15 |
| 326 | collagen type XII alpha 1 (COL12A1) | U57362 | 10 | 0.07% | 0 | 0.00% | 2 | 0.02% | 3 | 0.02% | 15 |
| 327 | small nuclear ribonucleoprotein D2 polypeptide ( | NM_004597.3 | 2 | 0.01% | 5 | 0.03% | 2 | 0.02% | 5 | 0.04% | 14 |
| 328 | Cu/Zn superoxide dismutase (SOD) | X02317 | 3 | 0.02% | 1 | 0.01% | 4 | 0.03% | 6 | 0.04% | 14 |
| 329 | nuclease sensitive element binding protein 1 (NS | NM_004559.1 | 4 | 0.03% | 2 | 0.01% | 2 | 0.02% | 6 | 0.04% | 14 |
| 330 | phospholipase A2 | M86400 | 0 | 0.00% | 3 | 0.02% | 5 | 0.04% | 6 | 0.04% | 14 |
| 331 | glutamine synthetase | S70290 | 0 | 0.00% | 11 | 0.06% | 1 | 0.01% | 2 | 0.01% | 14 |
| 332 | cathepsin B (CTSB) | L22569 | 3 | 0.02% | 3 | 0.02% | 2 | 0.02% | 6 | 0.04% | 14 |
| 333 | thyroid receptor interactor (TRIP7) | L40357 | 3 | 0.02% | 3 | 0.02% | 4 | 0.03% | 4 | 0.03% | 14 |
| 334 | alpha-2-macroglobulin | D83196 | 3 | 0.02% | 4 | 0.02% | 6 | 0.05% | 1 | 0.01% | 14 |
| 335 | Tis11d gene | U07802 | 5 | 0.04% | 6 | 0.03% | 3 | 0.02% | 0 | 0.00% | 14 |
| 336 | vacuolar sorting protein VPS29/PEP11 (LOC516 | NM_016226.1 | 2 | 0.01% | 2 | 0.01% | 3 | 0.02% | 7 | 0.05% | 14 |
| 337 | low molecular mass ubiquinone-binding protein | D50369 | 4 | 0.03% | 3 | 0.02% | 0 | 0.00% | 7 | 0.05% | 14 |
| 338 | Ku autoimmune antigen gene | J04977.1 | 1 | 0.01% | 1 | 0.01% | 9 | 0.07% | 3 | 0.02% | 14 |
| 339 | transforming growth factor beta-stimulated prote | NM_006022.1 | 5 | 0.04% | 6 | 0.03% | 3 | 0.02% | 0 | 0.00% | 14 |

Figure 6 - Unique Known Genes Identified In Four cDNA Cartilage Libraries and EST Frequency Analysis - Page 7 of 102

| | | | | | | | | | | | |
|---|---|---|---|---|---|---|---|---|---|---|---|
| 340 | caldesmon | M64110 | 0 | 0.00% | 0 | 0.00% | 3 | 0.02% | 11 | 0.08% | 14 |
| 341 | HSPC330 mRNA(=HSPC016) | AF161448.1 | 5 | 0.04% | 4 | 0.02% | 0 | 0.00% | 5 | 0.04% | 14 |
| 342 | syndecan binding protein (syntenin) (SDCBP)(O | NM_005625.1 | 2 | 0.01% | 5 | 0.03% | 5 | 0.04% | 2 | 0.01% | 14 |
| 343 | triosephosphate isomerase (TPI1) | M10036 | 8 | 0.06% | 5 | 0.03% | 1 | 0.01% | 0 | 0.00% | 14 |
| 344 | transcription elongation factor Bpolypeptide 1-lik | NP_003188.1 | 0 | 0.00% | 14 | 0.08% | 0 | 0.00% | 0 | 0.00% | 14 |
| 345 | heat shock 70kD protein 10 (HSC71) (HSPA10) | NM_006597.1 | 1 | 0.01% | 7 | 0.04% | 1 | 0.01% | 4 | 0.03% | 13 |
| 346 | transmembrane protein (CD59) | M84349.1 | 1 | 0.01% | 6 | 0.03% | 0 | 0.00% | 6 | 0.04% | 13 |
| 347 | chloride intracellular channel 4 like (CLIC4L) | NM_013943.1 | 1 | 0.01% | 6 | 0.03% | 3 | 0.02% | 3 | 0.02% | 13 |
| 348 | phenylalkylamine binding protein gene | AF196969.1 | 3 | 0.02% | 2 | 0.01% | 7 | 0.06% | 1 | 0.01% | 13 |
| 349 | collagenase type IV | J03210 | 10 | 0.07% | 2 | 0.01% | 0 | 0.00% | 1 | 0.01% | 13 |
| 350 | calnexin (CANX) integral membrane protein, ca | M94859 | 0 | 0.00% | 4 | 0.02% | 2 | 0.02% | 7 | 0.05% | 13 |
| 351 | actin binding protein ABP620 | AB029290.1 | 3 | 0.02% | 5 | 0.03% | 1 | 0.01% | 4 | 0.03% | 13 |
| 352 | peripheral myelin protein 22 | M94048 | 5 | 0.04% | 4 | 0.02% | 3 | 0.02% | 1 | 0.01% | 13 |
| 353 | syntaxin 4 binding protein UNC-18c (UNC-18c) | AF032922.1 | 10 | 0.07% | 0 | 0.00% | 1 | 0.01% | 2 | 0.01% | 13 |
| 354 | CGI-110 protein | AF151868.1 | 1 | 0.01% | 4 | 0.02% | 2 | 0.02% | 6 | 0.04% | 13 |
| 355 | HSPC163 | AF161512 | 0 | 0.00% | 2 | 0.01% | 4 | 0.03% | 7 | 0.05% | 13 |
| 356 | sin3 associated polypeptide (SAP18) | AF153608 | 3 | 0.02% | 4 | 0.02% | 4 | 0.03% | 2 | 0.01% | 13 |
| 357 | TPT1 gene for translationally controlled tumor pr | AJ400717.1 | 2 | 0.01% | 10 | 0.06% | 0 | 0.00% | 1 | 0.01% | 13 |
| 358 | ribosomal protein S15 (RPS15) (=insulinoma rig- | NM_001018.1 | 11 | 0.08% | 2 | 0.01% | 0 | 0.00% | 0 | 0.00% | 13 |
| 359 | ribosomal protein S26 | NM_001029.1 | 6 | 0.04% | 7 | 0.04% | 0 | 0.00% | 0 | 0.00% | 13 |
| 360 | pre-mRNA splicing factor (SFRS3) | AF107405.1 | 3 | 0.02% | 3 | 0.02% | 2 | 0.02% | 5 | 0.04% | 13 |
| 361 | thrombospondin 1 (THBS1) | NM_003246.1 | 5 | 0.04% | 2 | 0.01% | 5 | 0.04% | 1 | 0.01% | 13 |
| 362 | insulin-like growth factor binding protein 5 (IGFB | L27556.1 | 6 | 0.04% | 5 | 0.03% | 1 | 0.01% | 1 | 0.01% | 13 |
| 363 | fibroblast activation protein, alpha; seprase (FAF | NM_004460.1 | 2 | 0.01% | 6 | 0.03% | 0 | 0.00% | 5 | 0.04% | 13 |
| 364 | thymosin beta-10 | S54005 | 9 | 0.07% | 0 | 0.00% | 2 | 0.02% | 2 | 0.01% | 13 |
| 365 | HSPC005 (=C11orf10) | AF070661 | 0 | 0.00% | 1 | 0.01% | 1 | 0.01% | 11 | 0.08% | 13 |
| 366 | Chaperonin (hsp60 gene) | AJ249625.1 | 13 | 0.10% | 0 | 0.00% | 0 | 0.00% | 0 | 0.00% | 13 |
| 367 | HS1 protein (=YWHAQ) | X57347 | 1 | 0.01% | 4 | 0.02% | 2 | 0.02% | 6 | 0.04% | 13 |
| 368 | electron transfer flavoprotein alpha-subunit | J04058.1 | 1 | 0.01% | 12 | 0.07% | 0 | 0.00% | 0 | 0.00% | 13 |
| 369 | integrin, beta 1(fibronectin receptor, beta polype | NM_002211.1 | 0 | 0.00% | 4 | 0.02% | 3 | 0.02% | 6 | 0.04% | 13 |
| 370 | Fritz mRNA, complete cds | U91903.1 | 2 | 0.01% | 8 | 0.05% | 3 | 0.02% | 0 | 0.00% | 13 |
| 371 | heterogeneous nuclear ribonucleoprotein K (HNI | NM_002140.1 | 5 | 0.04% | 0 | 0.00% | 4 | 0.03% | 3 | 0.02% | 12 |
| 372 | heat shock 90kD protein 1 beta (HSPCB) | NM_007355.1 | 6 | 0.04% | 3 | 0.02% | 3 | 0.02% | 0 | 0.00% | 12 |
| 373 | insulin-like growth factor binding protein 7 (IGFB | 4504618 | 0 | 0.00% | 2 | 0.01% | 5 | 0.04% | 5 | 0.04% | 12 |
| 374 | hypoxia-inducible factor 1 alpha (HIF-1 alpha) | U22431 | 0 | 0.00% | 2 | 0.01% | 6 | 0.05% | 4 | 0.03% | 12 |
| 375 | growth arrest-specific 1 (GAS1) | NM_002048.1 | 0 | 0.00% | 2 | 0.01% | 5 | 0.04% | 5 | 0.04% | 12 |
| 376 | lactate dehydrogenase B (LDH-B) | Y00711 | 3 | 0.02% | 6 | 0.03% | 1 | 0.01% | 2 | 0.01% | 12 |
| 377 | sterol carrier protein 2 | S52450 | 0 | 0.00% | 3 | 0.02% | 6 | 0.05% | 3 | 0.02% | 12 |
| 378 | mitochondrial proteolipid 68MP homolog (PLPM) | NM_004894.1 | 1 | 0.01% | 3 | 0.02% | 3 | 0.02% | 5 | 0.04% | 12 |
| 379 | hepatitis B virus X interacting protein (XIP) | AF029890 | 1 | 0.01% | 3 | 0.02% | 3 | 0.02% | 5 | 0.04% | 12 |
| 380 | nicotinamide N-methyltransferase (NNMT) | U08021 | 0 | 0.00% | 8 | 0.05% | 1 | 0.01% | 3 | 0.02% | 12 |
| 381 | ATP synthase epsilon chain | AF077045.1 | 1 | 0.01% | 0 | 0.00% | 3 | 0.02% | 8 | 0.06% | 12 |
| 382 | cytochrome c oxidase subunit VIIa (COX7A) mu | M83186 | 0 | 0.00% | 1 | 0.01% | 2 | 0.02% | 9 | 0.06% | 12 |
| 383 | DEK oncogene (DNA binding) (DEK) | gi4503248 | 5 | 0.04% | 1 | 0.01% | 3 | 0.02% | 3 | 0.02% | 12 |
| 384 | hypoxia-inducible gene 1 (HIG1) (=HSPC010) | AF145385.1 | 1 | 0.01% | 0 | 0.00% | 8 | 0.06% | 3 | 0.02% | 12 |
| 385 | activated RNA polymerase (PC4) | NM_006713.1 | 1 | 0.01% | 3 | 0.02% | 3 | 0.02% | 5 | 0.04% | 12 |
| 386 | breast carcinoma amplified sequence 2 (BCAS2 | NM_005872.1 | 0 | 0.00% | 0 | 0.00% | 8 | 0.06% | 4 | 0.03% | 12 |
| 387 | enhancer-of-split and hairy-related protein 1 (SH | AF009329.1 | 0 | 0.00% | 10 | 0.06% | 1 | 0.01% | 1 | 0.01% | 12 |
| 388 | BCL2/adenovirus E1B 19kD-interacting protein 3 | U15174 | 2 | 0.01% | 3 | 0.02% | 3 | 0.02% | 4 | 0.03% | 12 |
| 389 | protein tyrosine phosphatase (hR-PTPu) | X58288 | 4 | 0.03% | 3 | 0.02% | 2 | 0.02% | 3 | 0.02% | 12 |
| 390 | TRPM-2, cytosolic epoxide hydrolase, nicotinic a | AF311103.1 | 0 | 0.00% | 11 | 0.06% | 1 | 0.01% | 0 | 0.00% | 12 |
| 391 | colon carcinoma laminin-binding protein (=RIBO | J03799.1 | 10 | 0.07% | 0 | 0.00% | 1 | 0.01% | 1 | 0.01% | 12 |
| 392 | alpha E-catenin (CTNNA1) gene | AF102803.1 | 3 | 0.02% | 3 | 0.02% | 2 | 0.02% | 4 | 0.03% | 12 |
| 393 | Clk-associated RS cyclophilin CARS-Cyp | U40763 | 0 | 0.00% | 3 | 0.02% | 5 | 0.04% | 4 | 0.03% | 12 |
| 394 | suppression of tumorigenicity 13 (Hsp70-interact | NM_003932.1 | 2 | 0.01% | 7 | 0.04% | 0 | 0.00% | 3 | 0.02% | 12 |
| 395 | cytochrome c oxidase subunit VIIa polypeptide 2 | NM_004718.1 | 1 | 0.01% | 4 | 0.02% | 2 | 0.02% | 5 | 0.04% | 12 |
| 396 | cyclin | M74091 | 4 | 0.03% | 1 | 0.01% | 1 | 0.01% | 6 | 0.04% | 12 |

Figure 6 - Unique Known Genes Identified In Four cDNA Cartilage Libraries and EST Frequency Analysis - Page 8 of 102

| | | | | | | | | | | | |
|---|---|---|---|---|---|---|---|---|---|---|---|
| 397 | NADH dehydrogenase subunit 2 (ND2) | AF014897.2 | 2 | 0.01% | 3 | 0.02% | 1 | 0.01% | 6 | 0.04% | 12 |
| 398 | ATP synthase, H transporting,mitochondrial (Re | NP_001676.1 | 0 | 0.00% | 12 | 0.07% | 0 | 0.00% | 0 | 0.00% | 12 |
| 399 | nuclear protein SDK3 (=MEMA) | Y10351 | 6 | 0.04% | 4 | 0.02% | 0 | 0.00% | 2 | 0.01% | 12 |
| 400 | 15 kDa selenoprotein (SEP15) | AF051894 | 1 | 0.01% | 2 | 0.01% | 3 | 0.02% | 6 | 0.04% | 12 |
| 401 | eukaryotic translation elongation factor 1 gamma | NM_001404.1 | 6 | 0.04% | 3 | 0.02% | 0 | 0.00% | 2 | 0.01% | 11 |
| 402 | transmembrane protein (p63) | X69910 | 8 | 0.06% | 1 | 0.01% | 1 | 0.01% | 1 | 0.01% | 11 |
| 403 | clathrin, heavy polypeptide-like 2 (CLTCL2) (=Kl | NM_004859.1 | 3 | 0.02% | 0 | 0.00% | 0 | 0.00% | 8 | 0.06% | 11 |
| 404 | extracellular matrix protein | AB011792 | 0 | 0.00% | 1 | 0.01% | 5 | 0.04% | 5 | 0.04% | 11 |
| 405 | mesoderm specific transcript (mouse) homolog | NM_002402.1 | 10 | 0.07% | 1 | 0.01% | 0 | 0.00% | 0 | 0.00% | 11 |
| 406 | KIAA0728 | AB018271.1 | 0 | 0.00% | 1 | 0.01% | 6 | 0.05% | 4 | 0.03% | 11 |
| 407 | ADP/ATP translocase | J03592 | 5 | 0.04% | 6 | 0.03% | 0 | 0.00% | 0 | 0.00% | 11 |
| 408 | UDP-glucose dehydrogenase (UGDH) | AF061016 | 2 | 0.01% | 2 | 0.01% | 4 | 0.03% | 3 | 0.02% | 11 |
| 409 | protein phosphatase 2 (formerly 2A), catalytic su | NM_002715.1 | 4 | 0.03% | 4 | 0.02% | 1 | 0.01% | 2 | 0.01% | 11 |
| 410 | protein C inhibitor [human, leukocytes, Genomic | S69366.1 | 1 | 0.01% | 6 | 0.03% | 1 | 0.01% | 3 | 0.02% | 11 |
| 411 | ribophorin II (RPN2) | Y00282 | 7 | 0.05% | 3 | 0.02% | 0 | 0.00% | 1 | 0.01% | 11 |
| 412 | ubiquitin-conjugating enzyme E2B (RAD6 homol | NM_003337.1 | 1 | 0.01% | 6 | 0.03% | 2 | 0.02% | 2 | 0.01% | 11 |
| 413 | ERF-1 | X79067.1 | 3 | 0.02% | 2 | 0.01% | 0 | 0.00% | 6 | 0.04% | 11 |
| 414 | zinc finger transCRiption factor GKLF | AF105036.1 | 1 | 0.01% | 4 | 0.02% | 2 | 0.02% | 4 | 0.03% | 11 |
| 415 | GABA(A) receptor-associated protein (GABARA | NM_007278.1 | 5 | 0.04% | 3 | 0.02% | 0 | 0.00% | 3 | 0.02% | 11 |
| 416 | titin (TTN) gene | CAA49245.1 | 5 | 0.04% | 1 | 0.01% | 2 | 0.02% | 3 | 0.02% | 11 |
| 417 | epidermal growth factor receptor kinase substrat | U12535 | 1 | 0.01% | 2 | 0.01% | 5 | 0.04% | 3 | 0.02% | 11 |
| 418 | FRG1 | L76159 | 1 | 0.01% | 3 | 0.02% | 2 | 0.02% | 5 | 0.04% | 11 |
| 419 | E25B protein | U76253 | 10 | 0.07% | 0 | 0.00% | 1 | 0.01% | 0 | 0.00% | 11 |
| 420 | transCRiption factor BTF 3 | X74070 | 6 | 0.04% | 1 | 0.01% | 1 | 0.01% | 3 | 0.02% | 11 |
| 421 | transmembrane glycoprotein (GPNMB) | X76534 | 0 | 0.00% | 2 | 0.01% | 4 | 0.03% | 5 | 0.04% | 11 |
| 422 | profilin II | L10678.1 | 3 | 0.02% | 3 | 0.02% | 1 | 0.01% | 4 | 0.03% | 11 |
| 423 | calreticulin (CALR) | M84739 | 7 | 0.05% | 2 | 0.01% | 0 | 0.00% | 2 | 0.01% | 11 |
| 424 | ADP-ribosylation factor 1 | M84326.1 | 7 | 0.05% | 1 | 0.01% | 3 | 0.02% | 0 | 0.00% | 11 |
| 425 | 16.7Kd protein | AF078845.1 | 3 | 0.02% | 3 | 0.02% | 2 | 0.02% | 3 | 0.02% | 11 |
| 426 | KIAA1247 | AB033073.1 | 0 | 0.00% | 5 | 0.03% | 2 | 0.02% | 4 | 0.03% | 11 |
| 427 | peroxiredoxin 1 (PRDX1) (=NKEFA) | NM_002574.1 | 3 | 0.02% | 6 | 0.03% | 1 | 0.01% | 1 | 0.01% | 11 |
| 428 | poly(A)-binding protein, cytoplasmic 1 (PABPC1 | NM_002568.1 | 2 | 0.01% | 3 | 0.02% | 0 | 0.00% | 6 | 0.04% | 11 |
| 429 | tyrosine 3-monooxygenase/tryptophan 5-monoo: | NM_006826.1 | 3 | 0.02% | 3 | 0.02% | 1 | 0.01% | 4 | 0.03% | 11 |
| 430 | myosin light chain 3 non-muscle (MLC3nm) | M31212 | 1 | 0.01% | 1 | 0.01% | 3 | 0.02% | 5 | 0.04% | 10 |
| 431 | Lsm3 protein | AJ238095.1 | 0 | 0.00% | 4 | 0.02% | 2 | 0.02% | 4 | 0.03% | 10 |
| 432 | CD164 antigen, sialomucin (CD164) | NM_006016.1 | 1 | 0.01% | 3 | 0.02% | 1 | 0.01% | 5 | 0.04% | 10 |
| 433 | collagen type XVI collagen alpha 1 (COL16A1) | S57132.1 | 10 | 0.07% | 0 | 0.00% | 0 | 0.00% | 0 | 0.00% | 10 |
| 434 | SET translocation (myeloid leukemia-associated | NM_003011.1 | 2 | 0.01% | 2 | 0.01% | 2 | 0.02% | 4 | 0.03% | 10 |
| 435 | amyloid-beta protein (APP) | M33112.1 | 0 | 0.00% | 3 | 0.02% | 3 | 0.02% | 4 | 0.03% | 10 |
| 436 | vesicle docking protein p115 (P115) | NM_003715.1 | 0 | 0.00% | 2 | 0.01% | 4 | 0.03% | 4 | 0.03% | 10 |
| 437 | hereditary haemochromatosis region, histone 2A | U91328.1 | 0 | 0.00% | 3 | 0.02% | 3 | 0.02% | 4 | 0.03% | 10 |
| 438 | cell cycle progression 8 protein (CPR8)(ORF)=A | NM_004748.1 | 0 | 0.00% | 2 | 0.01% | 2 | 0.02% | 6 | 0.04% | 10 |
| 439 | KIAA0438 | AB007898.1 | 1 | 0.01% | 4 | 0.02% | 2 | 0.02% | 3 | 0.02% | 10 |
| 440 | actin, alpha, cardiac muscle | NP_005150.1 | 2 | 0.01% | 8 | 0.05% | 0 | 0.00% | 0 | 0.00% | 10 |
| 441 | GAP-associated tyrosine phosphoprotein p62 (S | NM_006559.1 | 2 | 0.01% | 4 | 0.02% | 1 | 0.01% | 3 | 0.02% | 10 |
| 442 | sphingolipid activator protein 1 | J03015 | 4 | 0.03% | 1 | 0.01% | 1 | 0.01% | 4 | 0.03% | 10 |
| 443 | transcription elongation factor A (SII), 1 (TCEA1) | NM_006756.1 | 0 | 0.00% | 1 | 0.01% | 4 | 0.03% | 5 | 0.04% | 10 |
| 444 | nuclear pore complex interacting protein (NPIP) | AF132984.1 | 1 | 0.01% | 9 | 0.05% | 0 | 0.00% | 0 | 0.00% | 10 |
| 445 | ganglioside expression factor 2 (GEF-2) | NM_007285.1 | 1 | 0.01% | 3 | 0.02% | 1 | 0.01% | 5 | 0.04% | 10 |
| 446 | Down syndrome candidate region 1 (DSCR1) | NM_004414.2 | 1 | 0.01% | 2 | 0.01% | 1 | 0.01% | 6 | 0.04% | 10 |
| 447 | S164 (=AC004858 U1 small ribonucleoprotein 1 | AF109907 | 1 | 0.01% | 3 | 0.02% | 3 | 0.02% | 3 | 0.02% | 10 |
| 448 | proline-rich protein with nuclear targeting signal ( | NM_006813.1 | 0 | 0.00% | 3 | 0.02% | 5 | 0.04% | 2 | 0.01% | 10 |
| 449 | PAPS synthetase-2 (PAPSS2) | AF074331.1 | 2 | 0.01% | 3 | 0.02% | 2 | 0.02% | 3 | 0.02% | 10 |
| 450 | RIBOSOMAL PROTEIN SA (P40) | spP08865 | 8 | 0.06% | 0 | 0.00% | 1 | 0.01% | 1 | 0.01% | 10 |
| 451 | ataxia telangiectasia (ATM) gene | U82828.1 | 0 | 0.00% | 5 | 0.03% | 2 | 0.02% | 3 | 0.02% | 10 |
| 452 | ARP2/3 protein complex subunit p21 (ARC21=A | NM_005719.1 | 1 | 0.01% | 1 | 0.01% | 6 | 0.05% | 2 | 0.01% | 10 |
| 453 | HSPC297 (=HSPC030) | AF161415.1 | 0 | 0.00% | 1 | 0.01% | 4 | 0.03% | 5 | 0.04% | 10 |

Figure 6 - Unique Known Genes Identified In Four cDNA Cartilage Libraries and EST Frequency Analysis - Page 9 of 102

| | | | | | | | | | | | |
|---|---|---|---|---|---|---|---|---|---|---|---|
| 454 | NS1-binding protein (NS1-BP) (=AB020657 KIA/ | AJ012449 | 1 | 0.01% | 1 | 0.01% | 6 | 0.05% | 2 | 0.01% | 10 |
| 455 | dioxin-inducible cytochrome P450 (CYP1B1) | U03688.1 | 0 | 0.00% | 6 | 0.03% | 3 | 0.02% | 1 | 0.01% | 10 |
| 456 | WSB-1 isoform | AF106684.1 | 3 | 0.02% | 5 | 0.03% | 1 | 0.01% | 1 | 0.01% | 10 |
| 457 | protein disulfide isomerase-related protein (P5)= | NM_005742.1 | 2 | 0.01% | 0 | 0.00% | 5 | 0.04% | 3 | 0.02% | 10 |
| 458 | membrane protein CH1 (CH1) | AB020980 | 3 | 0.02% | 6 | 0.03% | 1 | 0.01% | 0 | 0.00% | 10 |
| 459 | sema domain immunoglobulin domain (Ig)(sema | NM_012431.1 | 1 | 0.01% | 3 | 0.02% | 4 | 0.03% | 2 | 0.01% | 10 |
| 460 | heat shock J2 protein (HSJ2) | AF075601.1 | 2 | 0.01% | 0 | 0.00% | 4 | 0.03% | 4 | 0.03% | 10 |
| 461 | T245 protein (T245) =TM4SF6=TM4-D | AF043906 | 1 | 0.01% | 4 | 0.02% | 0 | 0.00% | 5 | 0.04% | 10 |
| 462 | inositol polyphosphate 1-phosphatase gene (INF | AF141324.1 | 1 | 0.01% | 1 | 0.01% | 2 | 0.02% | 6 | 0.04% | 10 |
| 463 | RAN, member RAS oncogene family (RAN), mR | Hs.10842 | 2 | 0.01% | 1 | 0.01% | 0 | 0.00% | 7 | 0.05% | 10 |
| 464 | HSPC016, mRNA /cds=(38,232) /gb=NM_01593 | Hs.171774 | 4 | 0.03% | 2 | 0.01% | 0 | 0.00% | 4 | 0.03% | 10 |
| 465 | JKTBP2, JKTBP1, complete cds | AB017018.1 | 2 | 0.01% | 5 | 0.03% | 2 | 0.02% | 1 | 0.01% | 10 |
| 466 | ribosomal 18S, 58S, and 28S (=45S pre rRNA g | V01270.1 | 0 | 0.00% | 9 | 0.05% | 0 | 0.00% | 0 | 0.00% | 9 |
| 467 | SEC24 (S. cerevisiae)related gene family, meml | NM_014822.1 | 0 | 0.00% | 2 | 0.01% | 3 | 0.02% | 4 | 0.03% | 9 |
| 468 | annexin A4 (ANXA4) | NM_001153.2 | 0 | 0.00% | 2 | 0.01% | 3 | 0.02% | 4 | 0.03% | 9 |
| 469 | arginine-rich nuclear protein | M74002 | 3 | 0.02% | 0 | 0.00% | 2 | 0.02% | 4 | 0.03% | 9 |
| 470 | malate dehydrogenase 1, NAD (soluble) (MDH1 | NM_005917.1 | 0 | 0.00% | 3 | 0.02% | 3 | 0.02% | 3 | 0.02% | 9 |
| 471 | collagen type VI alpha 1(COL6A1) | X15880 | 3 | 0.02% | 2 | 0.01% | 1 | 0.01% | 3 | 0.02% | 9 |
| 472 | SMT3 (suppressor of mif two 3, yeast) homolog | NM_006937.1 | 1 | 0.01% | 4 | 0.02% | 2 | 0.02% | 2 | 0.01% | 9 |
| 473 | cyclophilin B (hCyPB) | M60857 | 5 | 0.04% | 3 | 0.02% | 0 | 0.00% | 1 | 0.01% | 9 |
| 474 | YAP65 | X80507.1 | 3 | 0.02% | 1 | 0.01% | 4 | 0.03% | 1 | 0.01% | 9 |
| 475 | uridine diphosphoglucose pyrophosphorylase | U27460 | 1 | 0.01% | 1 | 0.01% | 4 | 0.03% | 3 | 0.02% | 9 |
| 476 | prolyl 4-hydroxylase gene | U14608.1 | 3 | 0.02% | 1 | 0.01% | 1 | 0.01% | 4 | 0.03% | 9 |
| 477 | melanoma-associated antigen MG50 | AF200348.1 | 7 | 0.05% | 1 | 0.01% | 1 | 0.01% | 0 | 0.00% | 9 |
| 478 | kinectin 1 (kinesin receptor) (KTN1)(= KIAA0004 | NM_004986.1 | 0 | 0.00% | 2 | 0.01% | 4 | 0.03% | 3 | 0.02% | 9 |
| 479 | Dickkopf gene 3 (DKK-3) | NM_013253.1 | 0 | 0.00% | 1 | 0.01% | 0 | 0.00% | 8 | 0.06% | 9 |
| 480 | AD-017 protein | AF157318.1 | 1 | 0.01% | 4 | 0.02% | 2 | 0.02% | 2 | 0.01% | 9 |
| 481 | Fn54 | AF001533.2 | 0 | 0.00% | 0 | 0.00% | 3 | 0.02% | 6 | 0.04% | 9 |
| 482 | HSPC035 protein (LOC51669), NPD003 | NM_016127.1 | 2 | 0.01% | 2 | 0.01% | 3 | 0.02% | 2 | 0.01% | 9 |
| 483 | KIAA0164 | D79986 | 1 | 0.01% | 4 | 0.02% | 2 | 0.02% | 2 | 0.01% | 9 |
| 484 | KIAA0970 | AB023187.1 | 0 | 0.00% | 4 | 0.02% | 3 | 0.02% | 2 | 0.01% | 9 |
| 485 | KIAA1077 | AB029000.1 | 3 | 0.02% | 2 | 0.01% | 2 | 0.02% | 2 | 0.01% | 9 |
| 486 | prion protein (p27-30) (Creutzfeld-Jakob disease | NM_000311.1 | 1 | 0.01% | 3 | 0.02% | 1 | 0.01% | 4 | 0.03% | 9 |
| 487 | trichorhinophalangeal syndrome I gene (TRPS1) | NM_014112.1 | 0 | 0.00% | 5 | 0.03% | 2 | 0.02% | 2 | 0.01% | 9 |
| 488 | activating transCRiption factor 4 (tax-responsive | gi4502264 | 4 | 0.03% | 5 | 0.03% | 0 | 0.00% | 0 | 0.00% | 9 |
| 489 | sox | AF070669 | 0 | 0.00% | 6 | 0.03% | 0 | 0.00% | 3 | 0.02% | 9 |
| 490 | TATA box binding protein (TBP)-associated fact | NM_005642.1 | 2 | 0.01% | 3 | 0.02% | 2 | 0.02% | 2 | 0.01% | 9 |
| 491 | allograft inflammatory factor 1 (AIF1) | NM_001623.2 | 1 | 0.01% | 5 | 0.03% | 0 | 0.00% | 3 | 0.02% | 9 |
| 492 | heat shock protein 86 (HSP86) | M30626.1 | 1 | 0.01% | 0 | 0.00% | 3 | 0.02% | 5 | 0.04% | 9 |
| 493 | t-complex-associated-testis-expressed 1-like (T( | NM_006520.1 | 0 | 0.00% | 5 | 0.03% | 1 | 0.01% | 3 | 0.02% | 9 |
| 494 | matrilin-2 precursor | U69263 | 1 | 0.01% | 2 | 0.01% | 3 | 0.02% | 3 | 0.02% | 9 |
| 495 | actin-related protein Arp3 (ARP3)(actin-related p | AF006083.1 | 2 | 0.01% | 1 | 0.01% | 2 | 0.02% | 4 | 0.03% | 9 |
| 496 | bone sialoprotein (BNSP) | L10363.1 | 5 | 0.04% | 4 | 0.02% | 0 | 0.00% | 0 | 0.00% | 9 |
| 497 | interleukin 1 receptor, type I (IL1R1) = M27492.1 | NM_000877.1 | 1 | 0.01% | 3 | 0.02% | 1 | 0.01% | 4 | 0.03% | 9 |
| 498 | serine/threonine protein kinase Kp78 splice vari | AF159295.1 | 1 | 0.01% | 8 | 0.05% | 0 | 0.00% | 0 | 0.00% | 9 |
| 499 | latent transforming growth factor beta binding pr | NM_000627.1 | 2 | 0.01% | 4 | 0.02% | 2 | 0.02% | 1 | 0.01% | 9 |
| 500 | MAGUK protein p55T (=AB002323 KIAA0325) | AF162130.1 | 2 | 0.01% | 3 | 0.02% | 3 | 0.02% | 1 | 0.01% | 9 |
| 501 | NAP (nucleosome assembly protein) | M86667 | 0 | 0.00% | 2 | 0.01% | 1 | 0.01% | 6 | 0.04% | 9 |
| 502 | fragile 16D oxido reductase (FOR) | AF217490.1 | 1 | 0.01% | 5 | 0.03% | 3 | 0.02% | 0 | 0.00% | 9 |
| 503 | factor H homologue | M65294.1 | 0 | 0.00% | 3 | 0.02% | 1 | 0.01% | 5 | 0.04% | 9 |
| 504 | CYTOCHROME C OXIDASE POLYPEPTIDE I | P00395 | 1 | 0.01% | 2 | 0.01% | 2 | 0.02% | 4 | 0.03% | 9 |
| 505 | stathmin (=J04991 p18 protein; Z11566 Pr22 prc | X53305 | 8 | 0.06% | 0 | 0.00% | 0 | 0.00% | 1 | 0.01% | 9 |
| 506 | cellular growth-regulating protein | L10844 | 4 | 0.03% | 2 | 0.01% | 1 | 0.01% | 2 | 0.01% | 9 |
| 507 | paired mesoderm homeo box 1 (PMX1) | gi5902023 | 1 | 0.01% | 0 | 0.00% | 5 | 0.04% | 3 | 0.02% | 9 |
| 508 | PTD014 | AF092135.1 | 0 | 0.00% | 1 | 0.01% | 3 | 0.02% | 5 | 0.04% | 9 |
| 509 | SWI/SNF related, matrix associated (SMARCA1 | gi4507066 | 3 | 0.02% | 2 | 0.01% | 2 | 0.02% | 2 | 0.01% | 9 |
| 510 | fos proto-oncogene (c-fos) | K00650.1 | 8 | 0.06% | 0 | 0.00% | 0 | 0.00% | 1 | 0.01% | 9 |

Figure 6 - Unique Known Genes Identified In Four cDNA Cartilage Libraries and EST Frequency Analysis - Page 10 of 102

| | | | | | | | | | | | |
|---|---|---|---|---|---|---|---|---|---|---|---|
| 511 | integral membrane protein 2A (ITM2A) | NM_004867.1 | 4 | 0.03% | 5 | 0.03% | 0 | 0.00% | 0 | 0.00% | 9 |
| 512 | ATP synthase F0 subunit 6 (RefSeq aa 8e-74) | 5835393 | 0 | 0.00% | 9 | 0.05% | 0 | 0.00% | 0 | 0.00% | 9 |
| 513 | protein phosphatase 2A catalytic subunit-beta | M60484 | 3 | 0.02% | 1 | 0.01% | 4 | 0.03% | 1 | 0.01% | 9 |
| 514 | semaphorin E | AB000220 | 0 | 0.00% | 2 | 0.01% | 3 | 0.02% | 4 | 0.03% | 9 |
| 515 | HSPC061 | AF161546.1 | 0 | 0.00% | 7 | 0.04% | 0 | 0.00% | 2 | 0.01% | 9 |
| 516 | heterogeneous nuclear ribonucleoprotein A2/B1 | NM_002137.1 | 3 | 0.02% | 5 | 0.03% | 0 | 0.00% | 0 | 0.00% | 8 |
| 517 | zinc finger protein 9 (a cellular retroviral nucleic | gi4827070 | 1 | 0.01% | 3 | 0.02% | 0 | 0.00% | 4 | 0.03% | 8 |
| 518 | HepG2 | D17039 | 2 | 0.01% | 0 | 0.00% | 4 | 0.03% | 2 | 0.01% | 8 |
| 519 | laminin B2 chain | M55210 | 1 | 0.01% | 4 | 0.02% | 2 | 0.02% | 1 | 0.01% | 8 |
| 520 | matrix metalloproteinase 3 (stromelysin 1, proge | NM_002422.1 | 0 | 0.00% | 7 | 0.04% | 0 | 0.00% | 1 | 0.01% | 8 |
| 521 | MRG15 protein (MRG15) | AF100615.1 | 0 | 0.00% | 1 | 0.01% | 1 | 0.01% | 6 | 0.04% | 8 |
| 522 | HSPC025 (HSPC025) | NM_016091.1 | 0 | 0.00% | 5 | 0.03% | 2 | 0.02% | 1 | 0.01% | 8 |
| 523 | RGC32 protein (RGC32) | NM_014059.1 | 0 | 0.00% | 2 | 0.01% | 4 | 0.03% | 2 | 0.01% | 8 |
| 524 | NADH-ubiquinone oxidoreductase AGGG subun | AF067166.1 | 4 | 0.03% | 0 | 0.00% | 1 | 0.01% | 3 | 0.02% | 8 |
| 525 | ubiquitin gene | U49869 | 3 | 0.02% | 1 | 0.01% | 1 | 0.01% | 3 | 0.02% | 8 |
| 526 | karyopherin alpha 4 (=importin alpha 3) (KPNA4 | NM_002268.1 | 2 | 0.01% | 2 | 0.01% | 2 | 0.02% | 2 | 0.01% | 8 |
| 527 | DEAD-box protein (BAT1) gene | AF029062.1 | 8 | 0.06% | 0 | 0.00% | 0 | 0.00% | 0 | 0.00% | 8 |
| 528 | glutaminyl-tRNA synthetase(QARS) | NM_005051.1 | 8 | 0.06% | 0 | 0.00% | 0 | 0.00% | 0 | 0.00% | 8 |
| 529 | GOLGI 4-TRANSMEMBRANE SPANNING TRA | spQ15012 | 1 | 0.01% | 0 | 0.00% | 4 | 0.03% | 3 | 0.02% | 8 |
| 530 | high-mobility group (nonhistone chromosomal) p | NM_005517.1 | 6 | 0.04% | 0 | 0.00% | 1 | 0.01% | 1 | 0.01% | 8 |
| 531 | tumor neCRosis factor-inducible (TSG-6) | M31165 | 0 | 0.00% | 0 | 0.00% | 4 | 0.03% | 4 | 0.03% | 8 |
| 532 | antigen NY-CO-33 (NY-CO-33) | AF039698.1 | 8 | 0.06% | 0 | 0.00% | 0 | 0.00% | 0 | 0.00% | 8 |
| 533 | anti-oxidant protein 2 (non-selenium glutathione | NM_004905.1 | 4 | 0.03% | 2 | 0.01% | 0 | 0.00% | 2 | 0.01% | 8 |
| 534 | constitutive fragile region FRA3B | AF152363.1 | 0 | 0.00% | 3 | 0.02% | 2 | 0.02% | 3 | 0.02% | 8 |
| 535 | KIAA0242 | D87684 | 1 | 0.01% | 3 | 0.02% | 4 | 0.03% | 0 | 0.00% | 8 |
| 536 | KIAA0663 | AB014563 | 1 | 0.01% | 2 | 0.01% | 1 | 0.01% | 4 | 0.03% | 8 |
| 537 | UDP-glucose pyrophosphorylase 2 (ORF) | NM_006759.1 | 1 | 0.01% | 1 | 0.01% | 4 | 0.03% | 2 | 0.01% | 8 |
| 538 | palmitoyl-protein thioesterase (PPT) | AF022211 | 1 | 0.01% | 2 | 0.01% | 1 | 0.01% | 4 | 0.03% | 8 |
| 539 | N-acylsphingosine amidohydrolase (ASAH) (acic | NM_004315.1 | 0 | 0.00% | 3 | 0.02% | 1 | 0.01% | 4 | 0.03% | 8 |
| 540 | prostatic binding protein (PBP) | NM_002567.1 | 3 | 0.02% | 3 | 0.02% | 1 | 0.01% | 1 | 0.01% | 8 |
| 541 | CYTOCHROME C OXIDASE POLYPEPTIDE II | spP00403 | 2 | 0.01% | 2 | 0.01% | 1 | 0.01% | 3 | 0.02% | 8 |
| 542 | ornithine aminotransferase | M29927 | 3 | 0.02% | 2 | 0.01% | 1 | 0.01% | 2 | 0.01% | 8 |
| 543 | basic transcription element binding protein 1 (BT | NM_001206.1 | 0 | 0.00% | 7 | 0.04% | 1 | 0.01% | 0 | 0.00% | 8 |
| 544 | Huntingtin interacting protein | AF049103 | 4 | 0.03% | 3 | 0.02% | 0 | 0.00% | 1 | 0.01% | 8 |
| 545 | thyroid hormone binding protein (p55) (=M22806 | J02783 | 6 | 0.04% | 0 | 0.00% | 0 | 0.00% | 2 | 0.01% | 8 |
| 546 | ISLR (immunoglobulin superfamily containing le | AB024537 | 5 | 0.04% | 1 | 0.01% | 0 | 0.00% | 2 | 0.01% | 8 |
| 547 | biglycan BGN | U11686.1 | 2 | 0.01% | 1 | 0.01% | 1 | 0.01% | 4 | 0.03% | 8 |
| 548 | PPP1R5 | AF110824.1 | 1 | 0.01% | 3 | 0.02% | 3 | 0.02% | 1 | 0.01% | 8 |
| 549 | MADS/MEF2-family transcription factor (MEF2C | L08895.1 | 1 | 0.01% | 7 | 0.04% | 0 | 0.00% | 0 | 0.00% | 8 |
| 550 | RAN binding protein 2 (RANBP2) | NM_006267.2 | 0 | 0.00% | 3 | 0.02% | 0 | 0.00% | 5 | 0.04% | 8 |
| 551 | insulin-like growth factor I | X57025 | 0 | 0.00% | 5 | 0.03% | 2 | 0.02% | 1 | 0.01% | 8 |
| 552 | single-stranded DNA-binding protein (SSBP), nu | NM_003143.1 | 0 | 0.00% | 1 | 0.01% | 3 | 0.02% | 4 | 0.03% | 8 |
| 553 | Nck-associated protein 1 (Nap1) (=AB011159 KI | AB014509.1 | 0 | 0.00% | 1 | 0.01% | 5 | 0.04% | 2 | 0.01% | 8 |
| 554 | cisplatin resistance-associated overexpressed p | AB034205.1 | 0 | 0.00% | 4 | 0.02% | 1 | 0.01% | 3 | 0.02% | 8 |
| 555 | dihydropyrimidinase-like 3 (DPYSL3) | NM_001387.1 | 0 | 0.00% | 2 | 0.01% | 1 | 0.01% | 5 | 0.04% | 8 |
| 556 | KIAA0102 | D14658 | 1 | 0.01% | 2 | 0.01% | 1 | 0.01% | 4 | 0.03% | 8 |
| 557 | KIAA0191 (zinc finger homolog) | D83776 | 0 | 0.00% | 3 | 0.02% | 4 | 0.03% | 1 | 0.01% | 8 |
| 558 | NADH dehydrogenase (ubiquinone) 1 alpha sub | NM_005000.1 | 1 | 0.01% | 2 | 0.01% | 2 | 0.02% | 3 | 0.02% | 8 |
| 559 | proteasome (prosome, macropain) 26Ssubunit, / | NP_002793.1 | 0 | 0.00% | 8 | 0.05% | 0 | 0.00% | 0 | 0.00% | 8 |
| 560 | lysosomal-associated protein transmembrane 4 | NM_014713.1 | 0 | 0.00% | 7 | 0.04% | 0 | 0.00% | 1 | 0.01% | 8 |
| 561 | adaptor-related protein complex 3, sigma 1 subu | NM_001284.1 | 2 | 0.01% | 3 | 0.02% | 0 | 0.00% | 3 | 0.02% | 8 |
| 562 | nidogen-2 | AJ223500 | 3 | 0.02% | 3 | 0.02% | 0 | 0.00% | 2 | 0.01% | 8 |
| 563 | melanoma growth regulatory protein MIA | X75450 | 4 | 0.03% | 4 | 0.02% | 0 | 0.00% | 0 | 0.00% | 8 |
| 564 | Arp2/3 protein complex subunit p16 (ARC16) =A | NM_005717.1 | 3 | 0.02% | 1 | 0.01% | 1 | 0.01% | 3 | 0.02% | 8 |
| 565 | Kallmann syndrome 1 (KAL1) (=ADMLX=putativ | NM_000216.1 | 0 | 0.00% | 2 | 0.01% | 5 | 0.04% | 1 | 0.01% | 8 |
| 566 | apoptosis related protein APR-1 | AF143235.2 | 2 | 0.01% | 2 | 0.01% | 2 | 0.02% | 2 | 0.01% | 8 |
| 567 | TRAM protein | CAA45218.1 | 1 | 0.01% | 4 | 0.02% | 0 | 0.00% | 3 | 0.02% | 8 |

Figure 6 - Unique Known Genes Identified In Four cDNA Cartilage Libraries and EST Frequency Analysis - Page 11 of 102

| | | | | | | | | | | | |
|---|---|---|---|---|---|---|---|---|---|---|---|
| 568 | 1-8U gene from interferon-inducible gene family | X57352.1 | 6 | 0.04% | 2 | 0.01% | 0 | 0.00% | 0 | 0.00% | 8 |
| 569 | splicing factor SRp40-1 (SRp40) | U30826.1 | 0 | 0.00% | 4 | 0.02% | 3 | 0.02% | 1 | 0.01% | 8 |
| 570 | ORF2 contains a reverse transcriptase domain | AAA51622.1 | 0 | 0.00% | 5 | 0.03% | 1 | 0.01% | 2 | 0.01% | 8 |
| 571 | ORF2 contains a reverse transcriptase domain | AAB59368.1 | 0 | 0.00% | 5 | 0.03% | 1 | 0.01% | 2 | 0.01% | 8 |
| 572 | splicing factor, arginine/serine-rich 5 (RefSeq aa | NP_008856.1 | 0 | 0.00% | 4 | 0.02% | 3 | 0.02% | 1 | 0.01% | 8 |
| 573 | REIC/Dkk-3 | AB034203.1 | 0 | 0.00% | 7 | 0.04% | 0 | 0.00% | 1 | 0.01% | 8 |
| 574 | Golgi autoantigen, golgin subfamily a, 4 (GOLGA | NM_002078.2 | 0 | 0.00% | 1 | 0.01% | 3 | 0.02% | 3 | 0.02% | 7 |
| 575 | complement component 1, s subcomponent (C1 | NM_001734.1 | 0 | 0.00% | 5 | 0.03% | 1 | 0.01% | 1 | 0.01% | 7 |
| 576 | reticulocalbin 2, EF-hand calcium binding domai | NM_002902.1 | 3 | 0.02% | 2 | 0.01% | 0 | 0.00% | 2 | 0.01% | 7 |
| 577 | Eukaryotic translation initiation factor 2, subunit | NM_003908.1 | 2 | 0.01% | 1 | 0.01% | 1 | 0.01% | 3 | 0.02% | 7 |
| 578 | 5' nucleotidase (EC 3.1.3.5) | X55740 | 0 | 0.00% | 0 | 0.00% | 3 | 0.02% | 4 | 0.03% | 7 |
| 579 | interferon induced transmembrane protein 1 (9-2 | NM_003641.1 | 0 | 0.00% | 6 | 0.03% | 0 | 0.00% | 1 | 0.01% | 7 |
| 580 | transforming, acidic coiled-coil containing protein | NM_006283.1 | 1 | 0.01% | 3 | 0.02% | 1 | 0.01% | 2 | 0.01% | 7 |
| 581 | fau | X65923 | 7 | 0.05% | 0 | 0.00% | 0 | 0.00% | 0 | 0.00% | 7 |
| 582 | KIAA0372 | AB002370.1 | 2 | 0.01% | 3 | 0.02% | 0 | 0.00% | 2 | 0.01% | 7 |
| 583 | MEK binding partner 1 | AF201947.1 | 0 | 0.00% | 4 | 0.02% | 0 | 0.00% | 3 | 0.02% | 7 |
| 584 | stearoyl-CoA desaturase | AB032261.1 | 3 | 0.02% | 0 | 0.00% | 4 | 0.03% | 0 | 0.00% | 7 |
| 585 | protein immuno-reactive with anti-PTH polyclona | U28831.1 | 0 | 0.00% | 2 | 0.01% | 4 | 0.03% | 1 | 0.01% | 7 |
| 586 | AgX-1 antigen | S73498 | 0 | 0.00% | 0 | 0.00% | 3 | 0.02% | 4 | 0.03% | 7 |
| 587 | erythrocyte membrane protein band 4.1-like 2 (E | NM_001431.1 | 0 | 0.00% | 4 | 0.02% | 3 | 0.02% | 0 | 0.00% | 7 |
| 588 | valosin-containing protein(VCP) | NM_007126.2 | 3 | 0.02% | 3 | 0.02% | 1 | 0.01% | 0 | 0.00% | 7 |
| 589 | clathrin, light polypeptide (Lca) (CLTA) | NM_007096.1 | 1 | 0.01% | 3 | 0.02% | 2 | 0.02% | 1 | 0.01% | 7 |
| 590 | spectrin SH3 domain binding protein 1 (SSH3BF | NM_005470.1 | 0 | 0.00% | 1 | 0.01% | 3 | 0.02% | 3 | 0.02% | 7 |
| 591 | dual specificity phosphatase 1 (DUSP1) | NM_004417.2 | 1 | 0.01% | 4 | 0.02% | 1 | 0.01% | 1 | 0.01% | 7 |
| 592 | p75NTR-associated cell death executor (NADE) | AF187064.1 | 3 | 0.02% | 0 | 0.00% | 1 | 0.01% | 3 | 0.02% | 7 |
| 593 | GW128 | AF107406 | 1 | 0.01% | 2 | 0.01% | 1 | 0.01% | 3 | 0.02% | 7 |
| 594 | HSPC194 | AF151028.1 | 2 | 0.01% | 2 | 0.01% | 0 | 0.00% | 3 | 0.02% | 7 |
| 595 | HSPC238 | AF151072.1 | 0 | 0.00% | 1 | 0.01% | 4 | 0.03% | 2 | 0.01% | 7 |
| 596 | IDN3 | AB019494.1 | 0 | 0.00% | 4 | 0.02% | 2 | 0.02% | 1 | 0.01% | 7 |
| 597 | KIAA0069 gene | D31885.1 | 1 | 0.01% | 3 | 0.02% | 2 | 0.02% | 1 | 0.01% | 7 |
| 598 | KIAA0143 gene | D63477.1 | 3 | 0.02% | 2 | 0.01% | 1 | 0.01% | 1 | 0.01% | 7 |
| 599 | KIAA0332 | AB002330 | 1 | 0.01% | 1 | 0.01% | 3 | 0.02% | 2 | 0.01% | 7 |
| 600 | non-metastatic cells 2, protein (NM23B) express | NM_002512.1 | 4 | 0.03% | 1 | 0.01% | 1 | 0.01% | 1 | 0.01% | 7 |
| 601 | over-expressed breast tumor protein | L34839 | 1 | 0.01% | 4 | 0.02% | 2 | 0.02% | 0 | 0.00% | 7 |
| 602 | PRO0530 | AF111849.1 | 1 | 0.01% | 0 | 0.00% | 2 | 0.02% | 4 | 0.03% | 7 |
| 603 | PTD010 | AF078863.1 | 2 | 0.01% | 0 | 0.00% | 3 | 0.02% | 2 | 0.01% | 7 |
| 604 | glyoxalase-I (GLO1) | AF146651.1 | 0 | 0.00% | 2 | 0.01% | 3 | 0.02% | 2 | 0.01% | 7 |
| 605 | high density lipoprotein binding protein (HBP) | M64098 | 5 | 0.04% | 0 | 0.00% | 1 | 0.01% | 1 | 0.01% | 7 |
| 606 | eukaryotic translation initiation factor 3, subunit | gi4503514 | 3 | 0.02% | 1 | 0.01% | 0 | 0.00% | 3 | 0.02% | 7 |
| 607 | cathepsin L (CTSL) | NM_001912.1 | 1 | 0.01% | 4 | 0.02% | 1 | 0.01% | 1 | 0.01% | 7 |
| 608 | sorting nexin 6 (SNX6) | AF121856.1 | 0 | 0.00% | 3 | 0.02% | 2 | 0.02% | 2 | 0.01% | 7 |
| 609 | KDEL (Lys-Asp-Glu-Leu) endoplasmic reticulum | NM_006854.2 | 2 | 0.01% | 2 | 0.01% | 1 | 0.01% | 2 | 0.01% | 7 |
| 610 | nuclear factor of kappa light polypeptide gene er | AF213884.1 | 1 | 0.01% | 6 | 0.03% | 0 | 0.00% | 0 | 0.00% | 7 |
| 611 | transCRiptional coactivator PC4 | U12979 | 0 | 0.00% | 0 | 0.00% | 0 | 0.00% | 7 | 0.05% | 7 |
| 612 | poly(rC)-binding protein 1 (PCBP1) | NM_006196.1 | 2 | 0.01% | 2 | 0.01% | 1 | 0.01% | 2 | 0.01% | 7 |
| 613 | Ia-associated invariant gamma-chain gene | M13560 | 0 | 0.00% | 4 | 0.02% | 1 | 0.01% | 2 | 0.01% | 7 |
| 614 | immunoglobulin lambda gene | D87003.1 | 2 | 0.01% | 2 | 0.01% | 2 | 0.02% | 1 | 0.01% | 7 |
| 615 | uncharacterized bone marrow protein BM034 (=/ | AF217511.1 | 1 | 0.01% | 3 | 0.02% | 1 | 0.01% | 2 | 0.01% | 7 |
| 616 | small membrane protein 1 (SMP1) | AF081282 | 2 | 0.01% | 0 | 0.00% | 2 | 0.02% | 3 | 0.02% | 7 |
| 617 | chondroitin sulfate proteoglycan 2 (versican) (CS | NM_004385.1 | 1 | 0.01% | 4 | 0.02% | 2 | 0.02% | 0 | 0.00% | 7 |
| 618 | dermatan sulfate proteoglycan 3 (DSPG3) | U59111 | 7 | 0.05% | 0 | 0.00% | 0 | 0.00% | 0 | 0.00% | 7 |
| 619 | stromal cell derived factor receptor 1 (SDFR1) | NM_012428.1 | 1 | 0.01% | 0 | 0.00% | 1 | 0.01% | 5 | 0.04% | 7 |
| 620 | ras-related GTP-binding protein | AF106681.1 | 1 | 0.01% | 1 | 0.01% | 3 | 0.02% | 2 | 0.01% | 7 |
| 621 | cytosolic thyroid hormone-binding protein (=M23 | M26252 | 5 | 0.04% | 2 | 0.01% | 0 | 0.00% | 0 | 0.00% | 7 |
| 622 | SLC11A3 iron transporter | AF215636.1 | 1 | 0.01% | 2 | 0.01% | 1 | 0.01% | 3 | 0.02% | 7 |
| 623 | syntaxin 8 | AAD20831.1 | 0 | 0.00% | 4 | 0.02% | 3 | 0.02% | 0 | 0.00% | 7 |
| 624 | vascular cell adhesion molecule 1 (VCAM1) | M30257 | 0 | 0.00% | 2 | 0.01% | 1 | 0.01% | 4 | 0.03% | 7 |

Figure 6 - Unique Known Genes Identified In Four cDNA Cartilage Libraries and EST Frequency Analysis - Page 12 of 102

| | | | | | | | | | | | |
|---|---|---|---|---|---|---|---|---|---|---|---|
| 625 | GTP-binding protein Sara | AF092130.1 | 1 | 0.01% | 0 | 0.00% | 3 | 0.02% | 3 | 0.02% | 7 |
| 626 | interCRine-alpha (hIRH) | U19495 | 4 | 0.03% | 3 | 0.02% | 0 | 0.00% | 0 | 0.00% | 7 |
| 627 | line-1 protein ORF2 (=p150) | B28096 | 0 | 0.00% | 3 | 0.02% | 1 | 0.01% | 3 | 0.02% | 7 |
| 628 | small acidic protein | U51678 | 0 | 0.00% | 1 | 0.01% | 2 | 0.02% | 4 | 0.03% | 7 |
| 629 | small EDRK-rich factor 2 (SERF2) | NM_005770.1 | 4 | 0.03% | 2 | 0.01% | 1 | 0.01% | 0 | 0.00% | 7 |
| 630 | ATP SYNTHASE E CHAIN, MITOCHONDRIAL | spP56385 | 1 | 0.01% | 0 | 0.00% | 2 | 0.02% | 4 | 0.03% | 7 |
| 631 | ubiquitin-conjugating enzyme E2 variant 1 (UBE | NM_003349.1 | 1 | 0.01% | 4 | 0.02% | 0 | 0.00% | 2 | 0.01% | 7 |
| 632 | zinc finger protein SLUG (SLUG) gene | AF084243.1 | 3 | 0.02% | 1 | 0.01% | 1 | 0.01% | 2 | 0.01% | 7 |
| 633 | RNA binding motif protein 8B (RBM8B) | AF231512.1 | 0 | 0.00% | 5 | 0.03% | 0 | 0.00% | 2 | 0.01% | 7 |
| 634 | CGI-149 protein | AF151907.1 | 2 | 0.01% | 1 | 0.01% | 4 | 0.03% | 0 | 0.00% | 7 |
| 635 | elastin (ELN) | U62292 | 7 | 0.05% | 0 | 0.00% | 0 | 0.00% | 0 | 0.00% | 7 |
| 636 | non-histone chromosomal protein (HMG-1) | L08048.1 | 1 | 0.01% | 1 | 0.01% | 3 | 0.02% | 2 | 0.01% | 7 |
| 637 | KIAA0038 gene | D26068.1 | 3 | 0.02% | 1 | 0.01% | 2 | 0.02% | 1 | 0.01% | 7 |
| 638 | NADH dehydrogenase (ubiquinone) 1 beta subc | NM_005004.1 | 2 | 0.01% | 2 | 0.01% | 0 | 0.00% | 3 | 0.02% | 7 |
| 639 | esterase D | AF112219 | 1 | 0.01% | 2 | 0.01% | 1 | 0.01% | 3 | 0.02% | 7 |
| 640 | lost on transformation LOT1 (=PLAGL1) | U72621.2 | 1 | 0.01% | 0 | 0.00% | 2 | 0.02% | 4 | 0.03% | 7 |
| 641 | N2A3 (=DPYSL2) (=dihydropyrimidinase related | U97105 | 1 | 0.01% | 0 | 0.00% | 2 | 0.02% | 4 | 0.03% | 7 |
| 642 | SON DNA binding protein (SON) | X63753 | 2 | 0.01% | 0 | 0.00% | 3 | 0.02% | 2 | 0.01% | 7 |
| 643 | polyposis locus (DP1 gene) | M73547 | 1 | 0.01% | 0 | 0.00% | 4 | 0.03% | 2 | 0.01% | 7 |
| 644 | LENG7 mRNA, (=PRO2003 mRNA)(= elongatio | AF211972.1 | 0 | 0.00% | 7 | 0.04% | 0 | 0.00% | 0 | 0.00% | 7 |
| 645 | matrilin 1, cartilage matrix protein (MATN1) | NM_002379.2 | 7 | 0.05% | 0 | 0.00% | 0 | 0.00% | 0 | 0.00% | 7 |
| 646 | NADH dehydrogenase (ubiquinone) 1 beta subc | NM_004545.1 | 0 | 0.00% | 4 | 0.02% | 1 | 0.01% | 1 | 0.01% | 6 |
| 647 | proteasome (prosome, maCRopain) subunit, bet | NM_002793.1 | 0 | 0.00% | 0 | 0.00% | 4 | 0.03% | 2 | 0.01% | 6 |
| 648 | Deleted in oral cancer-1 (DOC1) | NM_004642.1 | 2 | 0.01% | 0 | 0.00% | 0 | 0.00% | 4 | 0.03% | 6 |
| 649 | cyclophilin-related protein (NKTR) gene (=PAC F | AF184110.1 | 2 | 0.01% | 2 | 0.01% | 1 | 0.01% | 1 | 0.01% | 6 |
| 650 | NADH-UBIQUINONE OXIDOREDUCTASE CHA | spP03886 | 0 | 0.00% | 2 | 0.01% | 3 | 0.02% | 1 | 0.01% | 6 |
| 651 | myristoylated alanine-rich C-kinase substrate (= | M68956 | 3 | 0.02% | 2 | 0.01% | 0 | 0.00% | 1 | 0.01% | 6 |
| 652 | signal recognition particle subunit 9 (SRP9) | U20998 | 1 | 0.01% | 0 | 0.00% | 1 | 0.01% | 4 | 0.03% | 6 |
| 653 | heterogeneous nuclear ribonucleoprotein C (C1/ | NM_004500.1 | 5 | 0.04% | 0 | 0.00% | 0 | 0.00% | 1 | 0.01% | 6 |
| 654 | laminin, alpha 4 (LAMA4) | NM_002290.1 | 3 | 0.02% | 2 | 0.01% | 1 | 0.01% | 0 | 0.00% | 6 |
| 655 | DRP-2 dihydropyrimidinase related protein 2 | AB020777.1 | 1 | 0.01% | 2 | 0.01% | 0 | 0.00% | 3 | 0.02% | 6 |
| 656 | HSPC307 | AF161425.1 | 0 | 0.00% | 2 | 0.01% | 3 | 0.02% | 1 | 0.01% | 6 |
| 657 | progesterone binding protein (HPR6.6) | gi5729874 | 2 | 0.01% | 0 | 0.00% | 2 | 0.02% | 2 | 0.01% | 6 |
| 658 | inositol 1,4,5-triphosphate receptor, type 2 (ITPF | NM_002223.1 | 0 | 0.00% | 2 | 0.01% | 1 | 0.01% | 3 | 0.02% | 6 |
| 659 | ubiquinol-cytochrome c reductase hinge protein | NM_006004.1 | 2 | 0.01% | 3 | 0.02% | 1 | 0.01% | 0 | 0.00% | 6 |
| 660 | eukaryotic translation initiation factor 4A, isoform | NM_001967.2 | 0 | 0.00% | 5 | 0.03% | 0 | 0.00% | 1 | 0.01% | 6 |
| 661 | proteasome subunit HC9 | D00763 | 2 | 0.01% | 0 | 0.00% | 2 | 0.02% | 2 | 0.01% | 6 |
| 662 | basic transCRiption factor 2 p44 (btf2p44) gene, | U80017.1 | 2 | 0.01% | 1 | 0.01% | 1 | 0.01% | 2 | 0.01% | 6 |
| 663 | U50HG genes for U50' snoRNA and U50 snoRN | AB017710 | 3 | 0.02% | 1 | 0.01% | 1 | 0.01% | 1 | 0.01% | 6 |
| 664 | alpha-2 globin (HBA1) | AF097635 | 6 | 0.04% | 0 | 0.00% | 0 | 0.00% | 0 | 0.00% | 6 |
| 665 | RAD21 (S. pombe) homolog (RAD21) (=X98294 | gi5453993 | 3 | 0.02% | 1 | 0.01% | 1 | 0.01% | 1 | 0.01% | 6 |
| 666 | GDP dissociation inhibitor 2 (GDI2) | NM_001494.2 | 0 | 0.00% | 2 | 0.01% | 0 | 0.00% | 4 | 0.03% | 6 |
| 667 | disabled 2 p93 (DAB2) (mitogen-responsive pho | AF188298.1 | 0 | 0.00% | 3 | 0.02% | 2 | 0.02% | 1 | 0.01% | 6 |
| 668 | KIAA1074 | AB028997.1 | 0 | 0.00% | 3 | 0.02% | 3 | 0.02% | 0 | 0.00% | 6 |
| 669 | myeloid/lymphoid or mixed-lineage leukemia (trit | NM_005935.1 | 0 | 0.00% | 4 | 0.02% | 1 | 0.01% | 1 | 0.01% | 6 |
| 670 | N-terminal acetyltransferase complex ard1 subu | AF085355.1 | 0 | 0.00% | 1 | 0.01% | 3 | 0.02% | 2 | 0.01% | 6 |
| 671 | PRO1873 | AF119859.1 | 1 | 0.01% | 5 | 0.03% | 0 | 0.00% | 0 | 0.00% | 6 |
| 672 | CMP-N-acetylneuraminic acid hydroxylase | AF074480.1 | 0 | 0.00% | 1 | 0.01% | 3 | 0.02% | 2 | 0.01% | 6 |
| 673 | somatic cytochrome c (HCS) gene | M22877.1 | 0 | 0.00% | 1 | 0.01% | 1 | 0.01% | 4 | 0.03% | 6 |
| 674 | chaperonin containing T-complex subunit 6 (CC | NM_001762.1 | 2 | 0.01% | 2 | 0.01% | 0 | 0.00% | 2 | 0.01% | 6 |
| 675 | C2H2 zinc finger protein (ZNF189) | AF025772.1 | 0 | 0.00% | 0 | 0.00% | 3 | 0.02% | 3 | 0.02% | 6 |
| 676 | homeobox protein CDX4 (CDX4) gene | AF003530.1 | 0 | 0.00% | 3 | 0.02% | 1 | 0.01% | 2 | 0.01% | 6 |
| 677 | immunoglobulin light chain | D87000 | 2 | 0.01% | 0 | 0.00% | 3 | 0.02% | 1 | 0.01% | 6 |
| 678 | antioxidant protein 1 (AOP1) (=peroxiredoxin 3 ( | NM_006793.1 | 0 | 0.00% | 1 | 0.01% | 0 | 0.00% | 5 | 0.04% | 6 |
| 679 | lysosomal-associated membrane glycoprotein-1 | L08582 | 1 | 0.01% | 1 | 0.01% | 3 | 0.02% | 1 | 0.01% | 6 |
| 680 | glutaredoxin | X76648.1 | 0 | 0.00% | 1 | 0.01% | 2 | 0.02% | 3 | 0.02% | 6 |
| 681 | cornichon protein | AF070654.1 | 1 | 0.01% | 1 | 0.01% | 3 | 0.02% | 1 | 0.01% | 6 |

Figure 6 - Unique Known Genes Identified In Four cDNA Cartilage Libraries and EST Frequency Analysis - Page 13 of 102

| | | | | | | | | | | | |
|---|---|---|---|---|---|---|---|---|---|---|---|
| 682 | dermatopontin | Z22865 | 0 | 0.00% | 2 | 0.01% | 2 | 0.02% | 2 | 0.01% | 6 |
| 683 | myosin, light polypeptide 1, alkali; skeletal, fast ( | NM_002475.1 | 2 | 0.01% | 4 | 0.02% | 0 | 0.00% | 0 | 0.00% | 6 |
| 684 | CD36 antigen | L06850.1 | 2 | 0.01% | 1 | 0.01% | 2 | 0.02% | 1 | 0.01% | 6 |
| 685 | guanine nucleotide binding protein 11 (GNG11) : | NM_004126.1 | 0 | 0.00% | 3 | 0.02% | 2 | 0.02% | 1 | 0.01% | 6 |
| 686 | vascular endothelial growth factor (VEGF) | AF024710.1 | 3 | 0.02% | 2 | 0.01% | 0 | 0.00% | 1 | 0.01% | 6 |
| 687 | integrin alpha 10 subunit (ITGA10) | AF112345.1 | 1 | 0.01% | 4 | 0.02% | 0 | 0.00% | 1 | 0.01% | 6 |
| 688 | HIC protein | AF054589 | 0 | 0.00% | 0 | 0.00% | 2 | 0.02% | 4 | 0.03% | 6 |
| 689 | KIAA0187 gene | NM_014753.1 | 0 | 0.00% | 5 | 0.03% | 0 | 0.00% | 1 | 0.01% | 6 |
| 690 | KIAA0436 | AB007896 | 2 | 0.01% | 1 | 0.01% | 2 | 0.02% | 1 | 0.01% | 6 |
| 691 | KIAA0530 | AB011102 | 1 | 0.01% | 2 | 0.01% | 1 | 0.01% | 2 | 0.01% | 6 |
| 692 | KIAA0569 | AB011141 | 0 | 0.00% | 1 | 0.01% | 2 | 0.02% | 3 | 0.02% | 6 |
| 693 | KIAA0766 | AB018309.1 | 1 | 0.01% | 1 | 0.01% | 2 | 0.02% | 2 | 0.01% | 6 |
| 694 | KIAA0942 protein (KIAA0942) | NM_015310.1 | 0 | 0.00% | 1 | 0.01% | 2 | 0.02% | 3 | 0.02% | 6 |
| 695 | Pcp-2=Purkinje cell protein 2 | S40022 | 0 | 0.00% | 0 | 0.00% | 1 | 0.01% | 5 | 0.04% | 6 |
| 696 | PRO1073 | AF113016 | 0 | 0.00% | 1 | 0.01% | 5 | 0.04% | 0 | 0.00% | 6 |
| 697 | PRO2640 | AF116710.1 | 6 | 0.04% | 0 | 0.00% | 0 | 0.00% | 0 | 0.00% | 6 |
| 698 | SON protein | AF193606 | 0 | 0.00% | 0 | 0.00% | 3 | 0.02% | 3 | 0.02% | 6 |
| 699 | protein tyrosine phosphatase type IVA, member | NM_003479.1 | 0 | 0.00% | 2 | 0.01% | 0 | 0.00% | 4 | 0.03% | 6 |
| 700 | low density lipoprotein receptor | L00352 | 2 | 0.01% | 2 | 0.01% | 2 | 0.02% | 0 | 0.00% | 6 |
| 701 | ATP SYNTHASE GAMMA CHAIN, MITOCHON[ | spP36542 | 1 | 0.01% | 0 | 0.00% | 4 | 0.03% | 1 | 0.01% | 6 |
| 702 | cytochrome c oxidase subunit VIII (COX8) | J04823 | 6 | 0.04% | 0 | 0.00% | 0 | 0.00% | 0 | 0.00% | 6 |
| 703 | leucine aminopeptidase | AF061738 | 0 | 0.00% | 2 | 0.01% | 0 | 0.00% | 4 | 0.03% | 6 |
| 704 | calpastatin | D50827 | 1 | 0.01% | 0 | 0.00% | 1 | 0.01% | 4 | 0.03% | 6 |
| 705 | threonyl-tRNA synthetase (TARS) | NM_003191.1 | 0 | 0.00% | 1 | 0.01% | 0 | 0.00% | 5 | 0.04% | 6 |
| 706 | ribosomal protein L33-like protein | AF047440 | 1 | 0.01% | 2 | 0.01% | 1 | 0.01% | 2 | 0.01% | 6 |
| 707 | chaperonin containing TCP1 subunit 4 (delta) (C | NM_006430.1 | 2 | 0.01% | 2 | 0.01% | 1 | 0.01% | 1 | 0.01% | 6 |
| 708 | Finkel-Biskis-Reilly murine sarcoma virus (FBR-( | NM_001997.1 | 5 | 0.04% | 1 | 0.01% | 0 | 0.00% | 0 | 0.00% | 6 |
| 709 | Id-2H | D13891 | 1 | 0.01% | 1 | 0.01% | 2 | 0.02% | 2 | 0.01% | 6 |
| 710 | shox gene | U82668 | 5 | 0.04% | 1 | 0.01% | 0 | 0.00% | 0 | 0.00% | 6 |
| 711 | SOX4 | AF124147.1 | 0 | 0.00% | 3 | 0.02% | 1 | 0.01% | 2 | 0.01% | 6 |
| 712 | transCRiption factor (CBFB) | L20298 | 1 | 0.01% | 1 | 0.01% | 0 | 0.00% | 4 | 0.03% | 6 |
| 713 | poly(rC)-binding protein 2 (PCBP2) | NM_005016.1 | 1 | 0.01% | 5 | 0.03% | 0 | 0.00% | 0 | 0.00% | 6 |
| 714 | RNA-binding protein regulatory subunit | AF021819 | 3 | 0.02% | 2 | 0.01% | 0 | 0.00% | 1 | 0.01% | 6 |
| 715 | Membrane cofactor protein | X59408.1 | 1 | 0.01% | 3 | 0.02% | 1 | 0.01% | 1 | 0.01% | 6 |
| 716 | catalase | X04076 | 0 | 0.00% | 1 | 0.01% | 4 | 0.03% | 1 | 0.01% | 6 |
| 717 | complement C1r | M14058 | 1 | 0.01% | 0 | 0.00% | 0 | 0.00% | 5 | 0.04% | 6 |
| 718 | glutathione peroxidase 3 (plasma) (GPX3) | NM_002084.2 | 0 | 0.00% | 6 | 0.03% | 0 | 0.00% | 0 | 0.00% | 6 |
| 719 | synaptophysin-like protein (SYPL) | gi5803184 | 1 | 0.01% | 2 | 0.01% | 0 | 0.00% | 3 | 0.02% | 6 |
| 720 | CGI-07 protein | AF132941.1 | 0 | 0.00% | 2 | 0.01% | 2 | 0.02% | 2 | 0.01% | 6 |
| 721 | CGI-148 protein | AF151906 | 0 | 0.00% | 0 | 0.00% | 2 | 0.02% | 4 | 0.03% | 6 |
| 722 | filamin (FLNB) | AF191633.1 | 4 | 0.03% | 1 | 0.01% | 1 | 0.01% | 0 | 0.00% | 6 |
| 723 | chondroadherin (CHAD) | U96769 | 4 | 0.03% | 2 | 0.01% | 0 | 0.00% | 0 | 0.00% | 6 |
| 724 | nonmuscle myosin heavy chain-B (MYH10) | M69181 | 5 | 0.04% | 0 | 0.00% | 0 | 0.00% | 1 | 0.01% | 6 |
| 725 | conserved gene amplified in osteosarcoma (OS4 | NM_005730.1 | 1 | 0.01% | 2 | 0.01% | 2 | 0.02% | 1 | 0.01% | 6 |
| 726 | signal sequence receptor, gamma (translocon-as | NM_007107.1 | 1 | 0.01% | 4 | 0.02% | 0 | 0.00% | 1 | 0.01% | 6 |
| 727 | okadaic acid-inducible and cAMP-regulated pho: | AF084555.1 | 2 | 0.01% | 0 | 0.00% | 3 | 0.02% | 1 | 0.01% | 6 |
| 728 | SH3 domain-containing protein SH3P18 | U61167 | 2 | 0.01% | 0 | 0.00% | 3 | 0.02% | 1 | 0.01% | 6 |
| 729 | transformer-2 alpha (htra-2 alpha) | U53209.1 | 3 | 0.02% | 1 | 0.01% | 0 | 0.00% | 2 | 0.01% | 6 |
| 730 | cullin 4A (CUL4A) | AF077188.1 | 0 | 0.00% | 1 | 0.01% | 2 | 0.02% | 3 | 0.02% | 6 |
| 731 | dendritic cell protein (GA17)= AF064603 GA17 p | NM_006360.1 | 0 | 0.00% | 6 | 0.03% | 0 | 0.00% | 0 | 0.00% | 6 |
| 732 | voltage-dependent anion channel (VDAC1) | AF151097.1 | 0 | 0.00% | 1 | 0.01% | 2 | 0.02% | 3 | 0.02% | 6 |
| 733 | bullous pemphigoid antigen (BPAG1) | L11690.1 | 0 | 0.00% | 4 | 0.02% | 2 | 0.02% | 0 | 0.00% | 6 |
| 734 | IGSF4 gene | AB017563.1 | 0 | 0.00% | 0 | 0.00% | 1 | 0.01% | 5 | 0.04% | 6 |
| 735 | exportin 1 (CRM1,yeast, homolog) (XPO1)(ORF | NM_003400.1 | 0 | 0.00% | 1 | 0.01% | 2 | 0.02% | 3 | 0.02% | 6 |
| 736 | H3 histone, family 3B (H3.3B) (H3F3B) | NM_005324.1 | 4 | 0.03% | 1 | 0.01% | 1 | 0.01% | 0 | 0.00% | 6 |
| 737 | Histone 4 family, member M (RefSeq aa 7e-53) | NP_003486.1 | 0 | 0.00% | 6 | 0.03% | 0 | 0.00% | 0 | 0.00% | 6 |
| 738 | non-histone chromosome protein 2 (S. cerevisia( | NM_005008.1 | 2 | 0.01% | 3 | 0.02% | 0 | 0.00% | 1 | 0.01% | 6 |

Figure 6 - Unique Known Genes Identified In Four cDNA Cartilage Libraries and EST Frequency Analysis - Page 14 of 102

| | | | | | | | | | | | |
|---|---|---|---|---|---|---|---|---|---|---|---|
| 739 | growth arrest specific transCRipt 5 gene | AF141346.1 | 2 | 0.01% | 1 | 0.01% | 1 | 0.01% | 2 | 0.01% | 6 |
| 740 | SPHAR gene for cyclin-related protein | X82554.1 | 0 | 0.00% | 2 | 0.01% | 1 | 0.01% | 3 | 0.02% | 6 |
| 741 | H-2K binding factor-2 | D14041 | 0 | 0.00% | 1 | 0.01% | 1 | 0.01% | 4 | 0.03% | 6 |
| 742 | KIAA0349 gene | AB002347.1 | 1 | 0.01% | 3 | 0.02% | 1 | 0.01% | 1 | 0.01% | 6 |
| 743 | KIAA0885 | AB020692.1 | 0 | 0.00% | 2 | 0.01% | 0 | 0.00% | 4 | 0.03% | 6 |
| 744 | KIAA1025 | AB028948.1 | 1 | 0.01% | 1 | 0.01% | 3 | 0.02% | 1 | 0.01% | 6 |
| 745 | LGMD2B | AJ007973 | 1 | 0.01% | 1 | 0.01% | 3 | 0.02% | 1 | 0.01% | 6 |
| 746 | 6-phosphofructo-2-kinase/fructose-2,6-bisphospl | AF041832 | 4 | 0.03% | 1 | 0.01% | 0 | 0.00% | 1 | 0.01% | 6 |
| 747 | protein phosphatase 1 catalytic subunit, beta iso | NM_002709.1 | 0 | 0.00% | 3 | 0.02% | 1 | 0.01% | 2 | 0.01% | 6 |
| 748 | mitochondrial 16S rRNA | Z70759 | 2 | 0.01% | 0 | 0.00% | 1 | 0.01% | 3 | 0.02% | 6 |
| 749 | mitochondrial coxII | X55654.1 | 3 | 0.02% | 0 | 0.00% | 2 | 0.02% | 1 | 0.01% | 6 |
| 750 | glutaminase C | AF158555.1 | 0 | 0.00% | 3 | 0.02% | 1 | 0.01% | 2 | 0.01% | 6 |
| 751 | DNA-binding protein A gene | L29073.1 | 1 | 0.01% | 2 | 0.01% | 1 | 0.01% | 2 | 0.01% | 6 |
| 752 | general transcription factor 2-I (GTF2I) | AF038968 | 4 | 0.03% | 2 | 0.01% | 0 | 0.00% | 0 | 0.00% | 6 |
| 753 | YME1 (S.cerevisiae)-like 1(YME1L1), = AJ1326 | NM_014263.1 | 1 | 0.01% | 2 | 0.01% | 1 | 0.01% | 2 | 0.01% | 6 |
| 754 | splicing factor, arginine/serine-rich (transformer | NM_004593.1 | 2 | 0.01% | 0 | 0.00% | 0 | 0.00% | 4 | 0.03% | 6 |
| 755 | LIM and SH3 protein 1 (LASP1) (=X82456 MLN | gi5453709 | 3 | 0.02% | 0 | 0.00% | 1 | 0.01% | 2 | 0.01% | 6 |
| 756 | TGF-beta inducible early protein (TIEG) | U21847 | 1 | 0.01% | 3 | 0.02% | 0 | 0.00% | 2 | 0.01% | 6 |
| 757 | pigment epithelium-derived factor (PEDF) | NM_002615.1 | 6 | 0.04% | 0 | 0.00% | 0 | 0.00% | 0 | 0.00% | 6 |
| 758 | ARP2/3 protein complex subunit 34 (ARC34) | NM_005731.1 | 2 | 0.01% | 1 | 0.01% | 0 | 0.00% | 3 | 0.02% | 6 |
| 759 | high mobility group 2 protein (HMG-2) | M83665 | 2 | 0.01% | 1 | 0.01% | 1 | 0.01% | 2 | 0.01% | 6 |
| 760 | jumping translocation breakpoint (JTB) =AB016 | NM_006694.1 | 1 | 0.01% | 2 | 0.01% | 0 | 0.00% | 3 | 0.02% | 6 |
| 761 | murine leukemia viral (bmi-1) oncogene homolo | NM_005180.1 | 0 | 0.00% | 2 | 0.01% | 1 | 0.01% | 3 | 0.02% | 6 |
| 762 | 13kDa differentiation-associated protein | AAF17196.1 | 0 | 0.00% | 2 | 0.01% | 0 | 0.00% | 4 | 0.03% | 6 |
| 763 | hypothetical protein Nop10p (RefSeq aa 1e-33) | NP_061118.1 | 0 | 0.00% | 6 | 0.03% | 0 | 0.00% | 0 | 0.00% | 6 |
| 764 | KIAA0103 | D14659 | 1 | 0.01% | 1 | 0.01% | 0 | 0.00% | 4 | 0.03% | 6 |
| 765 | p130 (130K protein) | X76061.1 | 0 | 0.00% | 4 | 0.02% | 1 | 0.01% | 1 | 0.01% | 6 |
| 766 | S1R protein (S1R) (=CGI-119) | AF113127.1 | 0 | 0.00% | 2 | 0.01% | 1 | 0.01% | 3 | 0.02% | 6 |
| 767 | ATP synthase, H transporting, mitochondrial F0 | NM_005175.1 | 0 | 0.00% | 3 | 0.02% | 3 | 0.02% | 0 | 0.00% | 6 |
| 768 | fragile X mental retardation 1 (FMR1) | NM_002024.1 | 1 | 0.01% | 4 | 0.02% | 1 | 0.01% | 0 | 0.00% | 6 |
| 769 | nucleobindin 2 (NUCB2)(NEFA protein) | X76732 | 0 | 0.00% | 1 | 0.01% | 1 | 0.01% | 4 | 0.03% | 6 |
| 770 | progesterone membrane binding protein (PMBP) | 5453915 | 0 | 0.00% | 1 | 0.01% | 2 | 0.02% | 3 | 0.02% | 6 |
| 771 | melanoma inhibitory | NM_006533.1 | 2 | 0.01% | 4 | 0.02% | 0 | 0.00% | 0 | 0.00% | 6 |
| 772 | KIAA1250 | AB033076.1 | 1 | 0.01% | 0 | 0.00% | 3 | 0.02% | 2 | 0.01% | 6 |
| 773 | ORF2 [Canis familiaris](60%) | AB012223 | 0 | 0.00% | 4 | 0.02% | 1 | 0.01% | 1 | 0.01% | 6 |
| 774 | POLR2K gene for RPB10 alpha | AJ252078.1 | 0 | 0.00% | 3 | 0.02% | 0 | 0.00% | 3 | 0.02% | 6 |
| 775 | cytochrome C oxidase II subunit (ORF) | X55654 | 3 | 0.02% | 0 | 0.00% | 2 | 0.02% | 1 | 0.01% | 6 |
| 776 | karyopherin (importin) beta 1 (KPNB1) (=L38951 | gi4504904 | 3 | 0.02% | 1 | 0.01% | 1 | 0.01% | 1 | 0.01% | 6 |
| 777 | CD59 antigen p18-20 (antigen identified by mon | NM_000611.1 | 1 | 0.01% | 3 | 0.02% | 0 | 0.00% | 2 | 0.01% | 6 |
| 778 | CAR (RFP2) | AF279660 | 2 | 0.01% | 0 | 0.00% | 3 | 0.02% | 1 | 0.01% | 6 |
| 779 | signal peptidase complex (18kD) (SPC18) | NM_014300.1 | 1 | 0.01% | 3 | 0.02% | 1 | 0.01% | 1 | 0.01% | 6 |
| 780 | basic helix-loop-helix domain containing, class B | Hs.171825 | 1 | 0.01% | 1 | 0.01% | 1 | 0.01% | 3 | 0.02% | 6 |
| 781 | 5-aminoimidazole-4-carboxamide ribonucleotide | NM_004044.1 | 1 | 0.01% | 0 | 0.00% | 3 | 0.02% | 2 | 0.01% | 6 |
| 782 | actin, alpha 2, smooth muscle, aorta (ACTA2) (C | NM_001613.1 | 0 | 0.00% | 5 | 0.03% | 0 | 0.00% | 0 | 0.00% | 5 |
| 783 | NADH dehydrogenase(ubiquinone) 1 beta subco | NM_002491.1 | 1 | 0.01% | 0 | 0.00% | 3 | 0.02% | 1 | 0.01% | 5 |
| 784 | heterogeneous nuclear ribonucleoprotein (hnRN | X12671 | 3 | 0.02% | 0 | 0.00% | 0 | 0.00% | 2 | 0.01% | 5 |
| 785 | eukaryotic translation initiation factor 3, subunit | gi4503508 | 1 | 0.01% | 1 | 0.01% | 1 | 0.01% | 2 | 0.01% | 5 |
| 786 | adenylyl cyclase-associated protein (CAP) | L12168 | 0 | 0.00% | 0 | 0.00% | 3 | 0.02% | 2 | 0.01% | 5 |
| 787 | tetratricopeptide repeat domain 3 (TTC3)(= DCR | NM_003316.1 | 0 | 0.00% | 4 | 0.02% | 0 | 0.00% | 1 | 0.01% | 5 |
| 788 | endothelial differentiation-related factor 1 (EDF1 | NM_003792.1 | 3 | 0.02% | 1 | 0.01% | 0 | 0.00% | 1 | 0.01% | 5 |
| 789 | ATP SYNTHASE A CHAIN (PROTEIN 6)(ORF) | P00846 | 3 | 0.02% | 2 | 0.01% | 0 | 0.00% | 0 | 0.00% | 5 |
| 790 | NADH-ubiquinone oxidoreductase subunit CI-B1 | AF047182 | 2 | 0.01% | 0 | 0.00% | 2 | 0.02% | 1 | 0.01% | 5 |
| 791 | MHC class 1 region | AF055066 | 1 | 0.01% | 2 | 0.01% | 2 | 0.02% | 0 | 0.00% | 5 |
| 792 | plastin 3 (T isoform) (PLS3) | NM_005032.2 | 1 | 0.01% | 2 | 0.01% | 2 | 0.02% | 0 | 0.00% | 5 |
| 793 | hexosaminidase B (beta polypeptide) (HEXB)(O | NM_000521.1 | 0 | 0.00% | 3 | 0.02% | 1 | 0.01% | 1 | 0.01% | 5 |
| 794 | breast cancer associated gene 1 protein (BCG1) | AF128528.1 | 5 | 0.04% | 0 | 0.00% | 0 | 0.00% | 0 | 0.00% | 5 |
| 795 | ornithine decarboxylase antizyme | D87914 | 4 | 0.03% | 1 | 0.01% | 0 | 0.00% | 0 | 0.00% | 5 |

Figure 6 - Unique Known Genes Identified In Four cDNA Cartilage Libraries and EST Frequency Analysis - Page 15 of 102

| | | | | | | | | | | | |
|---|---|---|---|---|---|---|---|---|---|---|---|
| 796 | enterocyte differentiation associated factor EDAI | U62136.2 | 0 | 0.00% | 0 | 0.00% | 3 | 0.02% | 2 | 0.01% | 5 |
| 797 | four and a half LIM domains 1 (FHL1) | NM_001449.1 | 0 | 0.00% | 3 | 0.02% | 1 | 0.01% | 1 | 0.01% | 5 |
| 798 | translocase of outer mitochondrial membrane 20 | NM_014765.1 | 2 | 0.01% | 2 | 0.01% | 0 | 0.00% | 1 | 0.01% | 5 |
| 799 | mouse tropomyosin homolog (HSPC001) =AF04 | NM_004872.1 | 2 | 0.01% | 0 | 0.00% | 2 | 0.02% | 1 | 0.01% | 5 |
| 800 | DNA polymerase zeta catalytic subunit (REV3) | AF157476.1 | 0 | 0.00% | 1 | 0.01% | 2 | 0.02% | 2 | 0.01% | 5 |
| 801 | eukaryotic initiation factor 4 gamma (eIF-4 gamn | D12686 | 3 | 0.02% | 0 | 0.00% | 0 | 0.00% | 2 | 0.01% | 5 |
| 802 | eukaryotic translation initiation factor 4A, isoform | D13748 | 5 | 0.04% | 0 | 0.00% | 0 | 0.00% | 0 | 0.00% | 5 |
| 803 | E6-AP ubiquitin-protein ligase (UBE3A) | AF009341.1 | 0 | 0.00% | 0 | 0.00% | 3 | 0.02% | 2 | 0.01% | 5 |
| 804 | prolyl 4-hydroxylase beta-subunit and disulfide is | M22806.1 | 5 | 0.04% | 0 | 0.00% | 0 | 0.00% | 0 | 0.00% | 5 |
| 805 | archain 1 (ARCN1) | gi4502194 | 1 | 0.01% | 3 | 0.02% | 0 | 0.00% | 1 | 0.01% | 5 |
| 806 | protein kinase C inhibitor-I | U27143 | 1 | 0.01% | 1 | 0.01% | 1 | 0.01% | 2 | 0.01% | 5 |
| 807 | serine/threonine kinase KPM | AF207547.1 | 2 | 0.01% | 2 | 0.01% | 1 | 0.01% | 0 | 0.00% | 5 |
| 808 | fibroblast growth factor 2 (basic)(FGF2) | NM_002006.1 | 1 | 0.01% | 2 | 0.01% | 1 | 0.01% | 1 | 0.01% | 5 |
| 809 | predicted osteoblast protein (GS3786), mRNA | NM_014888.1 | 0 | 0.00% | 1 | 0.01% | 1 | 0.01% | 3 | 0.02% | 5 |
| 810 | HSPC204 | AF151038.1 | 0 | 0.00% | 0 | 0.00% | 2 | 0.02% | 3 | 0.02% | 5 |
| 811 | KIAA0579 | AB011151.1 | 0 | 0.00% | 1 | 0.01% | 3 | 0.02% | 1 | 0.01% | 5 |
| 812 | Rap1B | U07795 | 0 | 0.00% | 0 | 0.00% | 1 | 0.01% | 4 | 0.03% | 5 |
| 813 | X (inactive)-specific transCRipt (XIST) | M97168 | 0 | 0.00% | 0 | 0.00% | 1 | 0.01% | 4 | 0.03% | 5 |
| 814 | alcohol dehydrogenase,class III (ADH5) chi subu | M30471 | 2 | 0.01% | 2 | 0.01% | 1 | 0.01% | 0 | 0.00% | 5 |
| 815 | diphosphoinositol polyphosphate phosphohydrol | AF191654.2 | 0 | 0.00% | 2 | 0.01% | 1 | 0.01% | 2 | 0.01% | 5 |
| 816 | phosphatidic acid phosphatase 2a | AB000888 | 2 | 0.01% | 2 | 0.01% | 1 | 0.01% | 0 | 0.00% | 5 |
| 817 | NADH dehydrogenase (ubiquinone) 1 beta subc | NM_005005.1 | 2 | 0.01% | 0 | 0.00% | 0 | 0.00% | 3 | 0.02% | 5 |
| 818 | NADH dehydrogenase(ubiquinone) 1, alpha/beta | NM_005003.1 | 1 | 0.01% | 2 | 0.01% | 1 | 0.01% | 1 | 0.01% | 5 |
| 819 | selenoprotein W (hSelW) | AF015283.1 | 1 | 0.01% | 3 | 0.02% | 1 | 0.01% | 0 | 0.00% | 5 |
| 820 | frizzled (Drosophila) homolog 1 (FZD1) | NM_003505.1 | 1 | 0.01% | 0 | 0.00% | 1 | 0.01% | 3 | 0.02% | 5 |
| 821 | nuclear factor I/B (NFIB) | NM_005596.1 | 1 | 0.01% | 3 | 0.02% | 1 | 0.01% | 0 | 0.00% | 5 |
| 822 | heterogeneous nuclear ribonucleoprotein M (HN | 5174610 | 2 | 0.01% | 3 | 0.02% | 0 | 0.00% | 0 | 0.00% | 5 |
| 823 | heterogeneous nuclear ribonucleoprotein R (ORI | AF000364 | 1 | 0.01% | 1 | 0.01% | 2 | 0.02% | 1 | 0.01% | 5 |
| 824 | nuclear protein (NP220) | NM_014497.1 | 1 | 0.01% | 0 | 0.00% | 0 | 0.00% | 4 | 0.03% | 5 |
| 825 | T-cell receptor alpha delta locus | AE000659 | 2 | 0.01% | 0 | 0.00% | 3 | 0.02% | 0 | 0.00% | 5 |
| 826 | translocase of inner mitochondrial membrane 17 | NM_006335.1 | 0 | 0.00% | 4 | 0.02% | 1 | 0.01% | 0 | 0.00% | 5 |
| 827 | miCRosomal glutathione S-transferase 3 (MGST | AF026977.1 | 0 | 0.00% | 3 | 0.02% | 0 | 0.00% | 2 | 0.01% | 5 |
| 828 | copine III (CPNE3) (=AB014536 KIAA0636) | gi4503014 | 0 | 0.00% | 2 | 0.01% | 1 | 0.01% | 2 | 0.01% | 5 |
| 829 | Golgi apparatus protein 1 (GLG1) | NM_012201.1 | 2 | 0.01% | 3 | 0.02% | 0 | 0.00% | 0 | 0.00% | 5 |
| 830 | destrin (actin depolymerizing factor) (ADF) | 5802965 | 2 | 0.01% | 0 | 0.00% | 2 | 0.02% | 1 | 0.01% | 5 |
| 831 | growth arrest and DNA-damage-inducible, alpha | NM_001924.1 | 1 | 0.01% | 1 | 0.01% | 0 | 0.00% | 3 | 0.02% | 5 |
| 832 | 5T4 oncofetal trophoblast glycoprotein (5T4) | NM_006670.1 | 0 | 0.00% | 3 | 0.02% | 1 | 0.01% | 1 | 0.01% | 5 |
| 833 | Autosomal Highly Conserved Protein (AHCP) (= | NM_016255.1 | 0 | 0.00% | 3 | 0.02% | 1 | 0.01% | 1 | 0.01% | 5 |
| 834 | Diff33 protein homolog | AF164794.1 | 1 | 0.01% | 0 | 0.00% | 1 | 0.01% | 3 | 0.02% | 5 |
| 835 | G8 protein (G8) | NM_016947.1 | 3 | 0.02% | 1 | 0.01% | 0 | 0.00% | 1 | 0.01% | 5 |
| 836 | HSPC067 | AF161552_1 | 0 | 0.00% | 0 | 0.00% | 4 | 0.03% | 1 | 0.01% | 5 |
| 837 | HSPC316 | AF161434.1 | 0 | 0.00% | 5 | 0.03% | 0 | 0.00% | 0 | 0.00% | 5 |
| 838 | HSPCO34 protein | AF100747.1 | 0 | 0.00% | 0 | 0.00% | 2 | 0.02% | 3 | 0.02% | 5 |
| 839 | KIAA0077 gene | D38521.1 | 1 | 0.01% | 1 | 0.01% | 1 | 0.01% | 2 | 0.01% | 5 |
| 840 | KIAA0107 | D14663 | 3 | 0.02% | 1 | 0.01% | 0 | 0.00% | 1 | 0.01% | 5 |
| 841 | KIAA0127 | NM_014755.1 | 0 | 0.00% | 2 | 0.01% | 2 | 0.02% | 1 | 0.01% | 5 |
| 842 | KIAA0174 | D79996 | 1 | 0.01% | 3 | 0.02% | 1 | 0.01% | 0 | 0.00% | 5 |
| 843 | KIAA0244 gene | D87685 | 1 | 0.01% | 0 | 0.00% | 1 | 0.01% | 3 | 0.02% | 5 |
| 844 | KIAA0265 | D87454 | 2 | 0.01% | 0 | 0.00% | 3 | 0.02% | 0 | 0.00% | 5 |
| 845 | KIAA0308 | AB002306 | 0 | 0.00% | 2 | 0.01% | 3 | 0.02% | 0 | 0.00% | 5 |
| 846 | KIAA0325 gene | AB002323.1 | 3 | 0.02% | 1 | 0.01% | 0 | 0.00% | 1 | 0.01% | 5 |
| 847 | KIAA0382 | AB002380 | 0 | 0.00% | 1 | 0.01% | 2 | 0.02% | 2 | 0.01% | 5 |
| 848 | KIAA0577 | AB011149 | 0 | 0.00% | 2 | 0.01% | 2 | 0.02% | 1 | 0.01% | 5 |
| 849 | KIAA0670 protein/acinusL (no-exact match 42% | NP_055792.1 | 2 | 0.01% | 2 | 0.01% | 0 | 0.00% | 1 | 0.01% | 5 |
| 850 | KIAA0680 gene product (KIAA0680) | NM_014721.1 | 0 | 0.00% | 2 | 0.01% | 1 | 0.01% | 2 | 0.01% | 5 |
| 851 | KIAA0853 | AB020660.1 | 0 | 0.00% | 3 | 0.02% | 1 | 0.01% | 1 | 0.01% | 5 |
| 852 | KIAA0977 | AB023194.1 | 0 | 0.00% | 1 | 0.01% | 3 | 0.02% | 1 | 0.01% | 5 |

Figure 6 - Unique Known Genes Identified In Four cDNA Cartilage Libraries and EST Frequency Analysis - Page 16 of 102

| | | | | | | | | | | | |
|---|---|---|---|---|---|---|---|---|---|---|---|
| 853 | KIAA1013 | AB023230.1 | 0 | 0.00% | 3 | 0.02% | 1 | 0.01% | 2 | 0.01% | 5 |
| 854 | KIAA1053 | AB028976.1 | 1 | 0.01% | 0 | 0.00% | 2 | 0.02% | 2 | 0.01% | 5 |
| 855 | meningioma-expressed antigen 5 (MEA5) (=KIA | AF036145 | 0 | 0.00% | 3 | 0.02% | 1 | 0.01% | 1 | 0.01% | 5 |
| 856 | myeloid leukemia factor 2 (MLF2) | NM_005439.1 | 4 | 0.03% | 1 | 0.01% | 0 | 0.00% | 0 | 0.00% | 5 |
| 857 | NY-REN-45 antigen (LOC51133) | NM_016121.1 | 0 | 0.00% | 1 | 0.01% | 2 | 0.02% | 2 | 0.01% | 5 |
| 858 | PEG1/MEST | D87367.1 | 5 | 0.04% | 0 | 0.00% | 0 | 0.00% | 0 | 0.00% | 5 |
| 859 | PRO2605 | AF116709.1 | 4 | 0.03% | 1 | 0.01% | 0 | 0.00% | 0 | 0.00% | 5 |
| 860 | PRO2751 | AF119896.1 | 1 | 0.01% | 0 | 0.00% | 1 | 0.01% | 3 | 0.02% | 5 |
| 861 | PTH-responsive osteosarcoma D1 protein | AAD25980.1 | 0 | 0.00% | 2 | 0.01% | 2 | 0.02% | 1 | 0.01% | 5 |
| 862 | seCReted protein of unknown function (SPUF) | AF173937.1 | 0 | 0.00% | 2 | 0.01% | 1 | 0.01% | 2 | 0.01% | 5 |
| 863 | steroid sensitive gene-1 protein (SSG-1) | AF223677.1 | 1 | 0.01% | 2 | 0.01% | 0 | 0.00% | 2 | 0.01% | 5 |
| 864 | uncoupling protein 2 (ucp2 gene homologue) | AJ243250.1 | 5 | 0.04% | 0 | 0.00% | 0 | 0.00% | 0 | 0.00% | 5 |
| 865 | X-linked anhidroitic ectodermal dysplasia protein | AF003528.1 | 1 | 0.01% | 4 | 0.02% | 0 | 0.00% | 0 | 0.00% | 5 |
| 866 | S100 calcium-binding protein A13 (S100A13) | NM_005979.1 | 3 | 0.02% | 2 | 0.01% | 0 | 0.00% | 0 | 0.00% | 5 |
| 867 | pyruvate dehydrogenase (lipoamide) alpha 1 (P | NM_000284.1 | 2 | 0.01% | 1 | 0.01% | 2 | 0.02% | 0 | 0.00% | 5 |
| 868 | protein x 0001 | AF117230 | 0 | 0.00% | 1 | 0.01% | 1 | 0.01% | 3 | 0.02% | 5 |
| 869 | PTEN (PTEN) gene | AF143312.1 | 0 | 0.00% | 3 | 0.02% | 1 | 0.01% | 1 | 0.01% | 5 |
| 870 | lipoprotein lipase (LPL) | NM_000237.1 | 0 | 0.00% | 1 | 0.01% | 4 | 0.03% | 0 | 0.00% | 5 |
| 871 | CYTOCHROME C OXIDASE POLYPEPTIDE III | P00414 | 1 | 0.01% | 1 | 0.01% | 1 | 0.01% | 2 | 0.01% | 5 |
| 872 | NADH dehydrogenase subunit 1(RefSeq aa 2e-7 | gi5835388 | 0 | 0.00% | 5 | 0.03% | 0 | 0.00% | 0 | 0.00% | 5 |
| 873 | NADH-UBIQUINONE OXIDOREDUCTASE CHA | P03905 | 1 | 0.01% | 2 | 0.01% | 0 | 0.00% | 2 | 0.01% | 5 |
| 874 | NADH-UBIQUINONE OXIDOREDUCTASE MLR | spO00483 | 0 | 0.00% | 0 | 0.00% | 1 | 0.01% | 4 | 0.03% | 5 |
| 875 | dihydrofolate reductase (DHFR) | NM_000791.2 | 0 | 0.00% | 1 | 0.01% | 1 | 0.01% | 3 | 0.02% | 5 |
| 876 | aspartyl-tRNA synthetase (DARS) | NM_001349.1 | 2 | 0.01% | 2 | 0.01% | 0 | 0.00% | 1 | 0.01% | 5 |
| 877 | mitochondrial serine hydroxymethyltransferase g | U23143.1 | 3 | 0.02% | 0 | 0.00% | 0 | 0.00% | 2 | 0.01% | 5 |
| 878 | cystatin B | U46692 | 2 | 0.01% | 2 | 0.01% | 0 | 0.00% | 1 | 0.01% | 5 |
| 879 | PROS-27 | X59417 | 1 | 0.01% | 2 | 0.01% | 0 | 0.00% | 2 | 0.01% | 5 |
| 880 | sorting nexin 3 (SNX3) | AF034546 | 1 | 0.01% | 0 | 0.00% | 1 | 0.01% | 3 | 0.02% | 5 |
| 881 | AKAP450 protein | AJ131693.1 | 0 | 0.00% | 0 | 0.00% | 3 | 0.02% | 2 | 0.01% | 5 |
| 882 | farnesyl-protein transferase alpha-subunit | L00634 | 1 | 0.01% | 1 | 0.01% | 1 | 0.01% | 2 | 0.01% | 5 |
| 883 | prolylcarboxypeptidase (angiotensinase C) (PRC | NM_005040.1 | 1 | 0.01% | 2 | 0.01% | 1 | 0.01% | 1 | 0.01% | 5 |
| 884 | sequestosome 1 (SQSTM1) (=U46751.1 phosph | NM_003900.1 | 2 | 0.01% | 0 | 0.00% | 1 | 0.01% | 2 | 0.01% | 5 |
| 885 | GLI-Kruppel family member GLI3 (Greig cephalo | gi4504014 | 1 | 0.01% | 2 | 0.01% | 1 | 0.01% | 1 | 0.01% | 5 |
| 886 | TATA element modulatory factor | L01042.1 | 0 | 0.00% | 0 | 0.00% | 2 | 0.02% | 3 | 0.02% | 5 |
| 887 | two-handed zinc finger protein ZEB | U19969 | 0 | 0.00% | 1 | 0.01% | 1 | 0.01% | 3 | 0.02% | 5 |
| 888 | XAGL protein | Y15906.1 | 0 | 0.00% | 0 | 0.00% | 1 | 0.01% | 4 | 0.03% | 5 |
| 889 | zinc finger protein 262 (ZNF262) (=AB007885 K | gi4827068 | 4 | 0.03% | 0 | 0.00% | 1 | 0.01% | 0 | 0.00% | 5 |
| 890 | zinc finger protein 84 (HPF2) (ZNF84) | NM_003428.1 | 1 | 0.01% | 2 | 0.01% | 1 | 0.01% | 1 | 0.01% | 5 |
| 891 | heterogeneous nuclear ribonucleoprotein H1 (H) | NM_005520.1 | 1 | 0.01% | 3 | 0.02% | 1 | 0.01% | 0 | 0.00% | 5 |
| 892 | Polyadenylate binding protein | U75686.1 | 1 | 0.01% | 1 | 0.01% | 2 | 0.02% | 1 | 0.01% | 5 |
| 893 | spliceosomal protein SAP 155 | AF054284 | 3 | 0.02% | 0 | 0.00% | 2 | 0.02% | 0 | 0.00% | 5 |
| 894 | splicing factor (CC1.4) | L10911.1 | 1 | 0.01% | 0 | 0.00% | 2 | 0.02% | 2 | 0.01% | 5 |
| 895 | Splicing factor proline/glutamine rich (polypyrimi | NM_005066.1 | 1 | 0.01% | 1 | 0.01% | 1 | 0.01% | 2 | 0.01% | 5 |
| 896 | RNA polymerase II subunit hsRPB7 | U20659.1 | 2 | 0.01% | 0 | 0.00% | 1 | 0.01% | 1 | 0.01% | 5 |
| 897 | lymphocyte activation-associated protein | AF123320.1 | 0 | 0.00% | 2 | 0.01% | 2 | 0.02% | 1 | 0.01% | 5 |
| 898 | heat shock 60kD protein 1 (chaperonin) (HSPD1 | NM_002156.1 | 0 | 0.00% | 3 | 0.02% | 0 | 0.00% | 2 | 0.01% | 5 |
| 899 | lysosomal-associated membrane protein 2 (LAM | NM_013995.1 | 0 | 0.00% | 4 | 0.02% | 0 | 0.00% | 1 | 0.01% | 5 |
| 900 | beta-COP | X82103 | 1 | 0.01% | 0 | 0.00% | 1 | 0.01% | 3 | 0.02% | 5 |
| 901 | RAD23 (S. cerevisiae) homolog B (RAD23B) | NM_002874.1 | 0 | 0.00% | 1 | 0.01% | 1 | 0.01% | 3 | 0.02% | 5 |
| 902 | t-complex polypeptide 1 | X52882 | 1 | 0.01% | 0 | 0.00% | 2 | 0.02% | 2 | 0.01% | 5 |
| 903 | xeroderma pigmentosum group E UV-damaged | U32986.1 | 3 | 0.02% | 1 | 0.01% | 0 | 0.00% | 1 | 0.01% | 5 |
| 904 | CGI-121 protein (LOC51002) | NM_016058.1 | 0 | 0.00% | 0 | 0.00% | 2 | 0.02% | 3 | 0.02% | 5 |
| 905 | restin (Reed-Steinberg cell-expressed intermedi | NM_002956.1 | 0 | 0.00% | 1 | 0.01% | 2 | 0.02% | 2 | 0.01% | 5 |
| 906 | sarcoglycan, beta (43kD dystrophin-associated | NM_000232.1 | 2 | 0.01% | 1 | 0.01% | 2 | 0.02% | 0 | 0.00% | 5 |
| 907 | Actinin-alpha | X55187.1 | 0 | 0.00% | 0 | 0.00% | 0 | 0.00% | 5 | 0.04% | 5 |
| 908 | cytoplasmic beta-actin | M10277 | 2 | 0.01% | 2 | 0.01% | 0 | 0.00% | 1 | 0.01% | 5 |
| 909 | MEMA protein | Y09703.1 | 0 | 0.00% | 3 | 0.02% | 0 | 0.00% | 2 | 0.01% | 5 |

Figure 6 - Unique Known Genes Identified In Four cDNA Cartilage Libraries and EST Frequency Analysis - Page 17 of 102

| | | | | | | | | | | | |
|---|---|---|---|---|---|---|---|---|---|---|---|
| 910 | moesin (MSN) | NM_002444.1 | 2 | 0.01% | 3 | 0.02% | 0 | 0.00% | 0 | 0.00% | 5 |
| 911 | tubulin-specific chaperone a (TBCA) (=AF03895 | gi4759211 | 2 | 0.01% | 1 | 0.01% | 1 | 0.01% | 1 | 0.01% | 5 |
| 912 | myosin class I, myh-1c | AJ001382 | 1 | 0.01% | 1 | 0.01% | 0 | 0.00% | 3 | 0.02% | 5 |
| 913 | oligodendrocyte myelin glycoprotein (OMG) | L05367 | 1 | 0.01% | 0 | 0.00% | 1 | 0.01% | 3 | 0.02% | 5 |
| 914 | activin A receptor, type I (ACVR1) =Z22534 ALK | NM_001105.1 | 1 | 0.01% | 1 | 0.01% | 1 | 0.01% | 2 | 0.01% | 5 |
| 915 | CD81 antigen (target of antiproliferative antibody | NM_004356.1 | 5 | 0.04% | 0 | 0.00% | 0 | 0.00% | 0 | 0.00% | 5 |
| 916 | CDA14 (RefSeq aa 2e-31) | NP_057654.1 | 0 | 0.00% | 4 | 0.02% | 0 | 0.00% | 1 | 0.01% | 5 |
| 917 | mannose 6-phosphate receptor, 46 kD (MPR46) | X56257 | 1 | 0.01% | 0 | 0.00% | 2 | 0.02% | 2 | 0.01% | 5 |
| 918 | secreted frizzled-related protein 1 (SFRP1) | NM_003012.2 | 1 | 0.01% | 4 | 0.02% | 0 | 0.00% | 0 | 0.00% | 5 |
| 919 | calcineurin A2 | M29551 | 2 | 0.01% | 0 | 0.00% | 2 | 0.02% | 1 | 0.01% | 5 |
| 920 | activin beta-A subunit (=(cDNA FLJ11041 fis, clc | X57580.1 | 0 | 0.00% | 0 | 0.00% | 2 | 0.02% | 3 | 0.02% | 5 |
| 921 | insuline-like growth factor II receptor | Y00285 | 4 | 0.03% | 0 | 0.00% | 1 | 0.01% | 0 | 0.00% | 5 |
| 922 | calcium modulating cyclophilin ligand CAMLG (C | AF068179.1 | 1 | 0.01% | 3 | 0.02% | 1 | 0.01% | 0 | 0.00% | 5 |
| 923 | polycystic kidney disease 2 (autosomal dominan | NM_000297.1 | 0 | 0.00% | 3 | 0.02% | 1 | 0.01% | 1 | 0.01% | 5 |
| 924 | Thy-1 glycoprotein | M11749 | 5 | 0.04% | 0 | 0.00% | 0 | 0.00% | 0 | 0.00% | 5 |
| 925 | histone (H2A.Z) | M37583 | 0 | 0.00% | 0 | 0.00% | 0 | 0.00% | 5 | 0.04% | 5 |
| 926 | histone H4 | X67081 | 0 | 0.00% | 0 | 0.00% | 0 | 0.00% | 5 | 0.04% | 5 |
| 927 | M-phase phosphoprotein homologue | AF100742.1 | 0 | 0.00% | 2 | 0.01% | 1 | 0.01% | 2 | 0.01% | 5 |
| 928 | cell division cycle 27 (CDC27) | NM_001256.1 | 0 | 0.00% | 4 | 0.02% | 1 | 0.01% | 0 | 0.00% | 5 |
| 929 | GTP-binding protein (RAB1) | M28209 | 0 | 0.00% | 1 | 0.01% | 0 | 0.00% | 4 | 0.03% | 5 |
| 930 | prefoldin 4 (PFDN4) | gi4505740 | 1 | 0.01% | 0 | 0.00% | 0 | 0.00% | 4 | 0.03% | 5 |
| 931 | replication factor C (activator 1) 1 (145kD) (RFC | NM_002913.1 | 3 | 0.02% | 1 | 0.01% | 0 | 0.00% | 1 | 0.01% | 5 |
| 932 | replication protein A3 (14kD) (RPA3) | NM_002947.1 | 0 | 0.00% | 1 | 0.01% | 2 | 0.02% | 2 | 0.01% | 5 |
| 933 | anaphase promoting complex subunit 10 | AF132794.1 | 0 | 0.00% | 1 | 0.01% | 2 | 0.02% | 2 | 0.01% | 5 |
| 934 | KIAA0075 | D38550.1 | 0 | 0.00% | 3 | 0.02% | 0 | 0.00% | 2 | 0.01% | 5 |
| 935 | KIAA0336 gene | NM_014635.1 | 0 | 0.00% | 2 | 0.01% | 1 | 0.01% | 2 | 0.01% | 5 |
| 936 | KIAA0527 | AB011099.1 | 1 | 0.01% | 3 | 0.02% | 0 | 0.00% | 1 | 0.01% | 5 |
| 937 | KIAA0573 | AB011145 | 0 | 0.00% | 1 | 0.01% | 3 | 0.02% | 1 | 0.01% | 5 |
| 938 | KIAA0610 | AB011182 | 0 | 0.00% | 2 | 0.01% | 2 | 0.02% | 1 | 0.01% | 5 |
| 939 | KIAA0810 | AB018353.1 | 2 | 0.01% | 1 | 0.01% | 2 | 0.02% | 0 | 0.00% | 5 |
| 940 | KIAA1073 | AB028996.1 | 1 | 0.01% | 0 | 0.00% | 1 | 0.01% | 3 | 0.02% | 5 |
| 941 | PTD011 | AF078864 | 0 | 0.00% | 1 | 0.01% | 1 | 0.01% | 3 | 0.02% | 5 |
| 942 | retrovirus-related hypothetical protein II (=X5223 | S23650 | 1 | 0.01% | 3 | 0.02% | 0 | 0.00% | 1 | 0.01% | 5 |
| 943 | SRY (sex-determining region Y)-box 5 (SOX5) | NM_006940.1 | 0 | 0.00% | 2 | 0.01% | 2 | 0.02% | 1 | 0.01% | 5 |
| 944 | YEAF1 (YY1 and E4TF1 associated factor 1) | AB029551.1 | 2 | 0.01% | 2 | 0.01% | 1 | 0.01% | 0 | 0.00% | 5 |
| 945 | glucan (1,4-alpha-), branching enzyme 1(ORF)(c | NM_000158.1 | 0 | 0.00% | 2 | 0.01% | 2 | 0.02% | 1 | 0.01% | 5 |
| 946 | hexokinase 1 (HK1) (=AF016365;X66957) | M75126 | 3 | 0.02% | 1 | 0.01% | 1 | 0.01% | 0 | 0.00% | 5 |
| 947 | fatty acid binding protein 5 (psoriasis-associated | NM_001444.1 | 2 | 0.01% | 1 | 0.01% | 2 | 0.02% | 0 | 0.00% | 5 |
| 948 | oxysterol-binding protein | AB017026 | 1 | 0.01% | 2 | 0.01% | 1 | 0.01% | 1 | 0.01% | 5 |
| 949 | ubiquinol-cytochrome c reductase core protein II | NM_003366.1 | 2 | 0.01% | 1 | 0.01% | 1 | 0.01% | 1 | 0.01% | 5 |
| 950 | amino acid transporter system A (ATA2) (=AB03 | AF249673.1 | 0 | 0.00% | 3 | 0.02% | 2 | 0.02% | 0 | 0.00% | 5 |
| 951 | Arginine-rich protein (ARP) | NM_006010.1 | 1 | 0.01% | 0 | 0.00% | 1 | 0.01% | 3 | 0.02% | 5 |
| 952 | translation initiation factor (=D21853 hypothetica | X79538 | 1 | 0.01% | 2 | 0.01% | 0 | 0.00% | 2 | 0.01% | 5 |
| 953 | proteasome (prosome macropain) beta type, 4 (F | NM_002796.1 | 1 | 0.01% | 4 | 0.02% | 0 | 0.00% | 1 | 0.01% | 5 |
| 954 | proteasome (prosome, macropain) 26Ssubunit, A | NP_002794.1 | 0 | 0.00% | 5 | 0.03% | 0 | 0.00% | 0 | 0.00% | 5 |
| 955 | PEX10 peroxisome biogenesis factor (peroxin) 1 | AB013818.1 | 5 | 0.04% | 0 | 0.00% | 0 | 0.00% | 0 | 0.00% | 5 |
| 956 | DNA-dependent protein kinase catalytic subunit | U47077.3 | 3 | 0.02% | 1 | 0.01% | 1 | 0.01% | 0 | 0.00% | 5 |
| 957 | putative translation initiation factor(RefSeq aa 4e | NP_005792.1 | 0 | 0.00% | 5 | 0.03% | 0 | 0.00% | 0 | 0.00% | 5 |
| 958 | transCRiption factor forkhead-like 7 (FKHL7) ger | AF048693.1 | 0 | 0.00% | 3 | 0.02% | 0 | 0.00% | 2 | 0.01% | 5 |
| 959 | polyadenylate binding protein-interacting protein | NM_006451.1 | 0 | 0.00% | 1 | 0.01% | 3 | 0.02% | 1 | 0.01% | 5 |
| 960 | protein-L-isoaspartate (D-aspartate) O-methyltra | NM_005389.1 | 0 | 0.00% | 0 | 0.00% | 3 | 0.02% | 2 | 0.01% | 5 |
| 961 | CGI-130 protein | AF151888.1 | 0 | 0.00% | 2 | 0.01% | 1 | 0.01% | 2 | 0.01% | 5 |
| 962 | endocytic receptor (macrophage mannose recep | NM_006039.1 | 5 | 0.04% | 0 | 0.00% | 0 | 0.00% | 0 | 0.00% | 5 |
| 963 | glucocorticoid receptor AF-1 specific elongation | AF174496.1 | 3 | 0.02% | 2 | 0.01% | 0 | 0.00% | 0 | 0.00% | 5 |
| 964 | thrombospondin 3 (THBS3) (RefSeq aa 3e-59) | NP_009043.1 | 1 | 0.01% | 4 | 0.02% | 0 | 0.00% | 0 | 0.00% | 5 |
| 965 | cyclin G2 | U47414 | 0 | 0.00% | 1 | 0.01% | 1 | 0.01% | 3 | 0.02% | 5 |
| 966 | nucleolar phosphoprotein p130 (P130) | NM_004741.1 | 2 | 0.01% | 3 | 0.02% | 0 | 0.00% | 0 | 0.00% | 5 |

Figure 6 - Unique Known Genes Identified In Four cDNA Cartilage Libraries and EST Frequency Analysis - Page 18 of 102

| | | | | | | | | | | | |
|---|---|---|---|---|---|---|---|---|---|---|---|
| 967 | polymerase (RNA) II polypeptide G (POLR2G) | NM_002696.1 | 1 | 0.01% | 3 | 0.02% | 0 | 0.00% | 1 | 0.01% | 5 |
| 968 | KIAA0433 (ORF) | AB007893 | 0 | 0.00% | 3 | 0.02% | 0 | 0.00% | 2 | 0.01% | 5 |
| 969 | KIAA0729 | AB018272.1 | 0 | 0.00% | 1 | 0.01% | 2 | 0.02% | 2 | 0.01% | 5 |
| 970 | KIAA1038 | AB028961 | 0 | 0.00% | 0 | 0.00% | 1 | 0.01% | 4 | 0.03% | 5 |
| 971 | KIAA1058 protein | AB028981.1 | 1 | 0.01% | 1 | 0.01% | 1 | 0.01% | 2 | 0.01% | 5 |
| 972 | lipoma preferred partner (LPP)gene, exon 11, an | U49968.1 | 0 | 0.00% | 2 | 0.01% | 3 | 0.02% | 0 | 0.00% | 5 |
| 973 | prostate cancer tumor suppressor (N33) | NM_006765.1 | 1 | 0.01% | 2 | 0.01% | 0 | 0.00% | 2 | 0.01% | 5 |
| 974 | protein S alpha gene (PROS1) | M36564 | 0 | 0.00% | 2 | 0.01% | 3 | 0.02% | 0 | 0.00% | 5 |
| 975 | NADH-UBIQUINONE OXIDOREDUCTASE CHA | spP03901 | 0 | 0.00% | 3 | 0.02% | 1 | 0.01% | 1 | 0.01% | 5 |
| 976 | ribosomal protein L36 60S | AF077043 | 5 | 0.04% | 0 | 0.00% | 0 | 0.00% | 0 | 0.00% | 5 |
| 977 | peptidylprolyl isomerase A (cyclophilin A) (PPIA) | Hs.342389 | 1 | 0.01% | 3 | 0.02% | 0 | 0.00% | 1 | 0.01% | 5 |
| 978 | calpobindin II= ANNEXIN VI | D00510.1 | 5 | 0.04% | 0 | 0.00% | 0 | 0.00% | 0 | 0.00% | 5 |
| 979 | thioredoxin peroxidase (antioxidant enzyme) (AC | NM_006406.1 | 3 | 0.02% | 0 | 0.00% | 1 | 0.01% | 1 | 0.01% | 5 |
| 980 | cytoskeletal tropomyosin TM30(nm) | X04588.1 | 1 | 0.01% | 2 | 0.01% | 1 | 0.01% | 1 | 0.01% | 5 |
| 981 | LIV-1 protein, estrogen regulated (LIV-1) (=U41C | 7106340 | 0 | 0.00% | 2 | 0.01% | 1 | 0.01% | 2 | 0.01% | 5 |
| 982 | dehydrogenase subunit 4 (RefSeq aa 3e-34) | gi5835397 | 0 | 0.00% | 5 | 0.03% | 0 | 0.00% | 0 | 0.00% | 5 |
| 983 | phosphoglycerate mutase 1 (brain) (PGAM1), m | Hs.181013 | 2 | 0.01% | 1 | 0.01% | 0 | 0.00% | 2 | 0.01% | 5 |
| 984 | ribosomal RNA 16S gene | AF036006.1 | 0 | 0.00% | 0 | 0.00% | 4 | 0.03% | 1 | 0.01% | 5 |
| 985 | Zn-15 transCRiption factor (Zfp-15) (=AB011102 | AF017806 | 2 | 0.01% | 2 | 0.01% | 1 | 0.01% | 0 | 0.00% | 5 |
| 986 | tetraspan TM4SF(TSPAN-6) | AF053453 | 1 | 0.01% | 1 | 0.01% | 0 | 0.00% | 3 | 0.02% | 5 |
| 987 | CGI-119 protein (LOC51643), mRNA /cds=(0,77 | Hs.283670 | 0 | 0.00% | 2 | 0.01% | 0 | 0.00% | 3 | 0.02% | 5 |
| 988 | laminin, gamma 1 (formerly LAMB2) (LAMC1), | NM_002293.2 | 1 | 0.01% | 4 | 0.02% | 0 | 0.00% | 0 | 0.00% | 5 |
| 989 | Rosenthal fiber protein (alpha-B-CRystallin) | M24906 | 1 | 0.01% | 1 | 0.01% | 1 | 0.01% | 2 | 0.01% | 5 |
| 990 | BPTF mRNA for bromodomain PHD finger trans | AB032251.1 | 0 | 0.00% | 2 | 0.01% | 1 | 0.01% | 2 | 0.01% | 5 |
| 991 | nucleosome assembly protein 1-like 1 (NAP1L1) | XM_047969.1 | 3 | 0.02% | 1 | 0.01% | 1 | 0.01% | 0 | 0.00% | 5 |
| 992 | alpha subunit of GsGTP binding protein (GSA) | X56009 | 1 | 0.01% | 0 | 0.00% | 1 | 0.01% | 2 | 0.01% | 4 |
| 993 | ring finger protein 4 (RNF4) | gi4506560 | 1 | 0.01% | 1 | 0.01% | 1 | 0.01% | 1 | 0.01% | 4 |
| 994 | small nuclear ribonucleoprotein polypeptide E (S | NM_003094.1 | 0 | 0.00% | 1 | 0.01% | 0 | 0.00% | 3 | 0.02% | 4 |
| 995 | ATP synthase, H transporting, mitochondrial F0 | NM_001688.1 | 3 | 0.02% | 0 | 0.00% | 0 | 0.00% | 1 | 0.01% | 4 |
| 996 | capping protein (actin filament) muscle Z-line, al | NM_006136.1 | 1 | 0.01% | 2 | 0.01% | 1 | 0.01% | 0 | 0.00% | 4 |
| 997 | TSE1=protein kinase A regulatory subunit | S54711 | 0 | 0.00% | 2 | 0.01% | 1 | 0.01% | 1 | 0.01% | 4 |
| 998 | proteasome (prosome, maCRopain) subunit, bet | NM_002795.1 | 1 | 0.01% | 0 | 0.00% | 1 | 0.01% | 2 | 0.01% | 4 |
| 999 | Hmob33 protein | Y14155.1 | 0 | 0.00% | 0 | 0.00% | 1 | 0.01% | 3 | 0.02% | 4 |
| 1000 | transmembrane 9 superfamily member 2 (TM9S | NM_004800.1 | 1 | 0.01% | 0 | 0.00% | 3 | 0.02% | 0 | 0.00% | 4 |
| 1001 | procollagen C-proteinase enhancer protein, type | AB008549 | 3 | 0.02% | 0 | 0.00% | 1 | 0.01% | 0 | 0.00% | 4 |
| 1002 | differentiated embryo chondrocyte expressed ge | AB004066 | 1 | 0.01% | 0 | 0.00% | 3 | 0.02% | 0 | 0.00% | 4 |
| 1003 | trinucleotide repeat containing 3 (TNRC3) | NM_005878.1 | 0 | 0.00% | 1 | 0.01% | 0 | 0.00% | 3 | 0.02% | 4 |
| 1004 | MHC class I (HLA-A) | U59701 | 3 | 0.02% | 1 | 0.01% | 0 | 0.00% | 0 | 0.00% | 4 |
| 1005 | glutathione S-transferase M3 (brain) (GSTM3) | NM_000849.1 | 0 | 0.00% | 2 | 0.01% | 0 | 0.00% | 2 | 0.01% | 4 |
| 1006 | muscle specific gene M9 (=PTD001) | BAA76626.1 | 0 | 0.00% | 3 | 0.02% | 0 | 0.00% | 1 | 0.01% | 4 |
| 1007 | platelet-derived growth factor receptor-like (PDG | NM_006207.1 | 0 | 0.00% | 2 | 0.01% | 0 | 0.00% | 2 | 0.01% | 4 |
| 1008 | COBW-like placental protein | AF065414 | 0 | 0.00% | 0 | 0.00% | 0 | 0.00% | 4 | 0.03% | 4 |
| 1009 | SUMO-1-specific protease (KIAA0797) | NM_015571.1 | 0 | 0.00% | 2 | 0.01% | 1 | 0.01% | 1 | 0.01% | 4 |
| 1010 | p58/GTA (galactosyltransferase associated prot | M37712.1 | 0 | 0.00% | 1 | 0.01% | 2 | 0.02% | 1 | 0.01% | 4 |
| 1011 | lysophospholipase I (LYPLA1) | NM_006330.1 | 0 | 0.00% | 0 | 0.00% | 2 | 0.02% | 2 | 0.01% | 4 |
| 1012 | proteasome (prosome, macropain) subunit, beta | NM_002799.1 | 2 | 0.01% | 2 | 0.01% | 0 | 0.00% | 0 | 0.00% | 4 |
| 1013 | chaperonin containing TCP1,subunit 8 (theta) (C | NM_006585.1 | 1 | 0.01% | 2 | 0.01% | 1 | 0.01% | 0 | 0.00% | 4 |
| 1014 | Sec23 (S. cerevisiae) homolog A (RefSeq aa 5e | NP_006355.1 | 0 | 0.00% | 2 | 0.01% | 2 | 0.02% | 0 | 0.00% | 4 |
| 1015 | Translocon associated protein gamma subunit | spQ9UNL2 | 0 | 0.00% | 0 | 0.00% | 3 | 0.02% | 1 | 0.01% | 4 |
| 1016 | nuclear factor (erythroid-derived 2)-like 2 (NFE2l | gi5453775 | 1 | 0.01% | 1 | 0.01% | 0 | 0.00% | 2 | 0.01% | 4 |
| 1017 | RAP1A, member of RAS oncogene family (RAP | NM_002884.1 | 0 | 0.00% | 2 | 0.01% | 0 | 0.00% | 2 | 0.01% | 4 |
| 1018 | RNaseP protein p30 (RPP30) | U77665 | 0 | 0.00% | 0 | 0.00% | 0 | 0.00% | 4 | 0.03% | 4 |
| 1019 | glutathione S-transferase P1c (GSTp1c) | U62589.1 | 4 | 0.03% | 0 | 0.00% | 0 | 0.00% | 0 | 0.00% | 4 |
| 1020 | collagen type XV alpha 1 (COL15A1) | L25280 | 4 | 0.03% | 0 | 0.00% | 0 | 0.00% | 0 | 0.00% | 4 |
| 1021 | myosin-binding protein C, cardiac (MYBPC3) | NM_000256.1 | 1 | 0.01% | 1 | 0.01% | 1 | 0.01% | 1 | 0.01% | 4 |
| 1022 | secreted frizzled-related protein 4 (SFRP4) | NM_003014.2 | 0 | 0.00% | 0 | 0.00% | 3 | 0.02% | 1 | 0.01% | 4 |
| 1023 | IQ motif containing GTPase activating protein 1 | NM_003870.1 | 1 | 0.01% | 1 | 0.01% | 0 | 0.00% | 2 | 0.01% | 4 |

Figure 6 - Unique Known Genes Identified In Four cDNA Cartilage Libraries and EST Frequency Analysis - Page 19 of 102

| | | | | | | | | | | | |
|---|---|---|---|---|---|---|---|---|---|---|---|
| 1024 | cadherin 13,H-cadherin (heart) (CDH13) | NM_001257.1 | 0 | 0.00% | 2 | 0.01% | 2 | 0.02% | 0 | 0.00% | 4 |
| 1025 | Death associated protein 3 (DAP3) | NM_004632.1 | 0 | 0.00% | 4 | 0.02% | 0 | 0.00% | 0 | 0.00% | 4 |
| 1026 | enhancer of polycomb (Epc1) | AF079765 | 2 | 0.01% | 1 | 0.01% | 1 | 0.01% | 0 | 0.00% | 4 |
| 1027 | mesenchyme homeo box 2 (growth arrest-speci | NM_005924.1 | 0 | 0.00% | 1 | 0.01% | 2 | 0.02% | 1 | 0.01% | 4 |
| 1028 | nucleolar autoantigen | NM_006455.1 | 4 | 0.03% | 0 | 0.00% | 0 | 0.00% | 0 | 0.00% | 4 |
| 1029 | ADP/ATP carrier protein(ANT-2) gene | L78810.1 | 1 | 0.01% | 0 | 0.00% | 3 | 0.02% | 0 | 0.00% | 4 |
| 1030 | S100 calcium-binding protein, beta (neural) (S10 | NM_006272.1 | 1 | 0.01% | 3 | 0.02% | 0 | 0.00% | 0 | 0.00% | 4 |
| 1031 | 3-phosphoglycerate dehydrogenase (PGAD) | NM_006623.1 | 4 | 0.03% | 0 | 0.00% | 0 | 0.00% | 0 | 0.00% | 4 |
| 1032 | phosphoinositol 3-phosphate binding protein-1 (F | NM_020904.1 | 0 | 0.00% | 4 | 0.02% | 0 | 0.00% | 0 | 0.00% | 4 |
| 1033 | Dimethyladenosine transferase (HSA9761) | NM_014473.1 | 1 | 0.01% | 0 | 0.00% | 0 | 0.00% | 3 | 0.02% | 4 |
| 1034 | fatty-acid-Coenzyme A ligase, long-chain 4 (FAC | NM_004458.1 | 0 | 0.00% | 3 | 0.02% | 0 | 0.00% | 1 | 0.01% | 4 |
| 1035 | phosphatidic acid phosphatase 2b (PPAP2B) | AB000889 | 1 | 0.01% | 3 | 0.02% | 0 | 0.00% | 0 | 0.00% | 4 |
| 1036 | ATP synthase, H transporting, mitochondrial F0 | NM_004889.1 | 1 | 0.01% | 1 | 0.01% | 1 | 0.01% | 1 | 0.01% | 4 |
| 1037 | cytochrome c oxidase subunit Vb (coxVb) | M19961 | 1 | 0.01% | 1 | 0.01% | 2 | 0.02% | 0 | 0.00% | 4 |
| 1038 | methylenetetrahydrofolate dehydrogenase- meth | J04031 | 3 | 0.02% | 0 | 0.00% | 1 | 0.01% | 0 | 0.00% | 4 |
| 1039 | methyl-CpG binding domain protein 2 (MBD2), tr | gi7710146 | 1 | 0.01% | 0 | 0.00% | 0 | 0.00% | 3 | 0.02% | 4 |
| 1040 | proteasome (prosome, macropain) subunit, alph | NM_002787.1 | 1 | 0.01% | 0 | 0.00% | 2 | 0.02% | 1 | 0.01% | 4 |
| 1041 | hypoxia-inducible protein 2 (HIG2) | NM_013332.1 | 0 | 0.00% | 4 | 0.02% | 0 | 0.00% | 0 | 0.00% | 4 |
| 1042 | CAAX box 1 (CXX1) | fi4503180 | 3 | 0.02% | 0 | 0.00% | 0 | 0.00% | 1 | 0.01% | 4 |
| 1043 | forkhead box O1A (rhabdomyosarcoma) (FOXO | NM_002015.1 | 0 | 0.00% | 3 | 0.02% | 1 | 0.01% | 0 | 0.00% | 4 |
| 1044 | heterogeneous nuclear protein similar to rat heli | NM_005758.1 | 0 | 0.00% | 1 | 0.01% | 1 | 0.01% | 2 | 0.01% | 4 |
| 1045 | Golgi vesicular membrane trafficking protein p18 | gi5031610 | 0 | 0.00% | 1 | 0.01% | 1 | 0.01% | 2 | 0.01% | 4 |
| 1046 | hect domain and RLD 2(HERC2) (=KIAA0393) | NM_004667.2 | 1 | 0.01% | 1 | 0.01% | 1 | 0.01% | 1 | 0.01% | 4 |
| 1047 | collagen type IV alpha (2) chain | X05610.1 | 4 | 0.03% | 0 | 0.00% | 0 | 0.00% | 0 | 0.00% | 4 |
| 1048 | cofilin isoform 1 | AF134802 | 0 | 0.00% | 0 | 0.00% | 2 | 0.02% | 2 | 0.01% | 4 |
| 1049 | myosin IXA (MYO9A) | NM_006901.1 | 0 | 0.00% | 3 | 0.02% | 1 | 0.01% | 0 | 0.00% | 4 |
| 1050 | fukutin | AB038490.1 | 0 | 0.00% | 1 | 0.01% | 1 | 0.01% | 2 | 0.01% | 4 |
| 1051 | G protein-coupled receptor 64 (GPR64) | NM_005756.1 | 0 | 0.00% | 1 | 0.01% | 2 | 0.02% | 1 | 0.01% | 4 |
| 1052 | germline T-cell receptor beta chain | U66061 | 1 | 0.01% | 0 | 0.00% | 2 | 0.02% | 1 | 0.01% | 4 |
| 1053 | signal sequence receptor, alpha (translocon-ass | NM_003144.2 | 0 | 0.00% | 3 | 0.02% | 0 | 0.00% | 1 | 0.01% | 4 |
| 1054 | signal sequence receptor, beta (translocon-asso | X74104 | 3 | 0.02% | 1 | 0.01% | 0 | 0.00% | 0 | 0.00% | 4 |
| 1055 | SH3 domain binding glutamic acid-rich protein li | NM_003022.1 | 0 | 0.00% | 1 | 0.01% | 2 | 0.02% | 1 | 0.01% | 4 |
| 1056 | neuroendocrine-specific protein-like protein 1 (N | AF119297.1 | 0 | 0.00% | 2 | 0.01% | 2 | 0.02% | 0 | 0.00% | 4 |
| 1057 | ARFGAP1 protein (ARFGAP1) | AF111847.1 | 0 | 0.00% | 2 | 0.01% | 0 | 0.00% | 2 | 0.01% | 4 |
| 1058 | gelsolin, plasma (GSN) | X04412 | 2 | 0.01% | 2 | 0.01% | 0 | 0.00% | 0 | 0.00% | 4 |
| 1059 | integrin cytoplasmic domain associated protein ( | AF012023 | 1 | 0.01% | 1 | 0.01% | 1 | 0.01% | 1 | 0.01% | 4 |
| 1060 | integrin, alpha E (antigen CD103, human mucos | NM_002208.3 | 1 | 0.01% | 2 | 0.01% | 1 | 0.01% | 0 | 0.00% | 4 |
| 1061 | acidic 82 kDa protein | U15552 | 0 | 0.00% | 0 | 0.00% | 0 | 0.00% | 4 | 0.03% | 4 |
| 1062 | BUP | AF078848.1 | 0 | 0.00% | 2 | 0.01% | 1 | 0.01% | 1 | 0.01% | 4 |
| 1063 | C90RF3 | AF043897.1 | 2 | 0.01% | 2 | 0.01% | 0 | 0.00% | 0 | 0.00% | 4 |
| 1064 | chondrosarcoma-associated protein 2 (CSA2) | AF182645.1 | 1 | 0.01% | 2 | 0.01% | 0 | 0.00% | 1 | 0.01% | 4 |
| 1065 | density regulated protein drp1 | AF038554.1 | 1 | 0.01% | 0 | 0.00% | 0 | 0.00% | 3 | 0.02% | 4 |
| 1066 | E2IG5 | AF191020 | 0 | 0.00% | 0 | 0.00% | 0 | 0.00% | 4 | 0.03% | 4 |
| 1067 | housekeeping (Q1Z 7F5) gene | M81806.1 | 1 | 0.01% | 2 | 0.01% | 0 | 0.00% | 1 | 0.01% | 4 |
| 1068 | HSPC039 protein | AF125100.1 | 0 | 0.00% | 0 | 0.00% | 1 | 0.01% | 3 | 0.02% | 4 |
| 1069 | HSPC139 | AF161488.1 | 0 | 0.00% | 1 | 0.01% | 0 | 0.00% | 3 | 0.02% | 4 |
| 1070 | HSPC213 (=HSPC327) | AAF36133.1 | 0 | 0.00% | 0 | 0.00% | 2 | 0.02% | 2 | 0.01% | 4 |
| 1071 | KIAA0022 | BAA03498.1 | 0 | 0.00% | 2 | 0.01% | 0 | 0.00% | 2 | 0.01% | 4 |
| 1072 | KIAA0136 | D50926.1 | 2 | 0.01% | 1 | 0.01% | 0 | 0.00% | 1 | 0.01% | 4 |
| 1073 | KIAA0232 | D86985.2 | 1 | 0.01% | 0 | 0.00% | 0 | 0.00% | 3 | 0.02% | 4 |
| 1074 | KIAA0235 | D87078 | 1 | 0.01% | 1 | 0.01% | 1 | 0.01% | 1 | 0.01% | 4 |
| 1075 | KIAA0251 | D87438 | 3 | 0.02% | 1 | 0.01% | 0 | 0.00% | 0 | 0.00% | 4 |
| 1076 | KIAA0252 | D87440 | 1 | 0.01% | 1 | 0.01% | 0 | 0.00% | 2 | 0.01% | 4 |
| 1077 | KIAA0256 | D87445 | 0 | 0.00% | 1 | 0.01% | 2 | 0.02% | 1 | 0.01% | 4 |
| 1078 | KIAA0276 | D87466 | 0 | 0.00% | 1 | 0.01% | 1 | 0.01% | 2 | 0.01% | 4 |
| 1079 | KIAA0429 | AB007889 | 0 | 0.00% | 1 | 0.01% | 3 | 0.02% | 0 | 0.00% | 4 |
| 1080 | KIAA0477 | AB007946.1 | 0 | 0.00% | 3 | 0.02% | 1 | 0.01% | 0 | 0.00% | 4 |

Figure 6 - Unique Known Genes Identified In Four cDNA Cartilage Libraries and EST Frequency Analysis - Page 20 of 102

| | | | | | | | | | | | |
|---|---|---|---|---|---|---|---|---|---|---|---|
| 1081 | KIAA0660 | AB014560 | 3 | 0.02% | 0 | 0.00% | 1 | 0.01% | 0 | 0.00% | 4 |
| 1082 | KIAA0671 | AB014571.1 | 1 | 0.01% | 2 | 0.01% | 0 | 0.00% | 1 | 0.01% | 4 |
| 1083 | KIAA0693 | AB014593 | 1 | 0.01% | 1 | 0.01% | 0 | 0.00% | 2 | 0.01% | 4 |
| 1084 | KIAA0971 | AB023188.1 | 0 | 0.00% | 2 | 0.01% | 2 | 0.02% | 0 | 0.00% | 4 |
| 1085 | KIAA1102 | AB029025.1 | 0 | 0.00% | 1 | 0.01% | 2 | 0.02% | 1 | 0.01% | 4 |
| 1086 | KIAA1354 | AB037775 | 1 | 0.01% | 3 | 0.02% | 0 | 0.00% | 0 | 0.00% | 4 |
| 1087 | KIAA1376 protein | AB037797.1 | 1 | 0.01% | 2 | 0.01% | 0 | 0.00% | 1 | 0.01% | 4 |
| 1088 | KIAA1380 protein | AB037801.1 | 0 | 0.00% | 1 | 0.01% | 2 | 0.02% | 1 | 0.01% | 4 |
| 1089 | KIAA1451 protein | AB040884 | 0 | 0.00% | 0 | 0.00% | 0 | 0.00% | 4 | 0.03% | 4 |
| 1090 | mesenchymal stem cell protein DSC92 (LOC513 | NM_016645.1 | 0 | 0.00% | 3 | 0.02% | 0 | 0.00% | 1 | 0.01% | 4 |
| 1091 | nickel-specific induction protein (Cap43) | AF004162.1 | 1 | 0.01% | 1 | 0.01% | 0 | 0.00% | 2 | 0.01% | 4 |
| 1092 | NifU-like protein (hNifU) | U47101 | 0 | 0.00% | 2 | 0.01% | 2 | 0.02% | 0 | 0.00% | 4 |
| 1093 | Nuclear antigen Sp100 (SP100) | NM_003113.1 | 0 | 0.00% | 0 | 0.00% | 1 | 0.01% | 3 | 0.02% | 4 |
| 1094 | PRO1608 | AF119850.1 | 1 | 0.01% | 1 | 0.01% | 0 | 0.00% | 2 | 0.01% | 4 |
| 1095 | PRO1828 | AF116669.1 | 2 | 0.01% | 0 | 0.00% | 0 | 0.00% | 2 | 0.01% | 4 |
| 1096 | promyelocytic leukemia cell | M11948 | 0 | 0.00% | 1 | 0.01% | 1 | 0.01% | 2 | 0.01% | 4 |
| 1097 | squamous cell carcinoma antigen recognized by | NM_013352.1, | 0 | 0.00% | 2 | 0.01% | 0 | 0.00% | 2 | 0.01% | 4 |
| 1098 | STAT-induced STAT inhibitor-2 | AF037989 | 0 | 0.00% | 2 | 0.01% | 0 | 0.00% | 2 | 0.01% | 4 |
| 1099 | vesicle transport-related protein | AF110646.1 | 0 | 0.00% | 1 | 0.01% | 3 | 0.02% | 0 | 0.00% | 4 |
| 1100 | phosphoglucomutase 1 (PGM1) | M83088 | 0 | 0.00% | 1 | 0.01% | 1 | 0.01% | 2 | 0.01% | 4 |
| 1101 | transaldolase | L19437.2 | 3 | 0.02% | 0 | 0.00% | 0 | 0.00% | 1 | 0.01% | 4 |
| 1102 | nucleotide binding protein, estradiol-induced (E2 | NM_014366.1 | 0 | 0.00% | 1 | 0.01% | 1 | 0.01% | 2 | 0.01% | 4 |
| 1103 | PDNP1 gene (nucleotide pyrophosphatase) | AF110304.1 | 0 | 0.00% | 2 | 0.01% | 1 | 0.01% | 1 | 0.01% | 4 |
| 1104 | phosphoribosyl pyrophosphate synthetase subu | D00860.1 | 1 | 0.01% | 1 | 0.01% | 1 | 0.01% | 1 | 0.01% | 4 |
| 1105 | dihydrolipoamide dehydrogenase | J03620 | 1 | 0.01% | 0 | 0.00% | 0 | 0.00% | 3 | 0.02% | 4 |
| 1106 | lecithin-cholesterol acyltransferase (LCAT) | X04981.1 | 3 | 0.02% | 0 | 0.00% | 1 | 0.01% | 0 | 0.00% | 4 |
| 1107 | phosphatase 1, catalytic subunit, gamma isoform | NM_002710.1 | 0 | 0.00% | 0 | 0.00% | 3 | 0.02% | 1 | 0.01% | 4 |
| 1108 | phospholipid sCRamblase 1 PLSCR1) | AF098642 | 1 | 0.01% | 1 | 0.01% | 0 | 0.00% | 2 | 0.01% | 4 |
| 1109 | serine palmitoyl transferase | AF111168.2 | 1 | 0.01% | 2 | 0.01% | 1 | 0.01% | 0 | 0.00% | 4 |
| 1110 | cytochrome oxidase subunit I (COI) and subunit | AF035429.1 | 1 | 0.01% | 1 | 0.01% | 0 | 0.00% | 2 | 0.01% | 4 |
| 1111 | cytochrome-c oxidase subunit VIIaL precursor (C | AF134406.1 | 0 | 0.00% | 0 | 0.00% | 1 | 0.01% | 3 | 0.02% | 4 |
| 1112 | electron-transfer-flavoprotein, beta polypeptide ( | X71129 | 4 | 0.03% | 0 | 0.00% | 0 | 0.00% | 0 | 0.00% | 4 |
| 1113 | NADH-ubiquinone oxidoreductase B17 | AF067167.1 | 1 | 0.01% | 2 | 0.01% | 0 | 0.00% | 1 | 0.01% | 4 |
| 1114 | ubiquinol-cytochrome c reductase (6.4kD) subun | NM_006830.1 | 2 | 0.01% | 1 | 0.01% | 1 | 0.01% | 0 | 0.00% | 4 |
| 1115 | acidic protein rich in leucines (SSP29) | NM_006401.1 | 2 | 0.01% | 0 | 0.00% | 0 | 0.00% | 2 | 0.01% | 4 |
| 1116 | Lysyl tRNA Synthetase | D32053.1 | 1 | 0.01% | 0 | 0.00% | 1 | 0.01% | 2 | 0.01% | 4 |
| 1117 | methionine aminopeptidase | U29607 | 0 | 0.00% | 2 | 0.01% | 0 | 0.00% | 2 | 0.01% | 4 |
| 1118 | eIF4E-like cap-binding protein (4EHP) (=translat | NM_004846.1 | 3 | 0.02% | 1 | 0.01% | 0 | 0.00% | 0 | 0.00% | 4 |
| 1119 | proteasome-associated pad1 homologue (POH1 | U86782 | 2 | 0.01% | 1 | 0.01% | 1 | 0.01% | 0 | 0.00% | 4 |
| 1120 | wbsCR1 (WBSCR1) | AF045555.1 | 1 | 0.01% | 1 | 0.01% | 1 | 0.01% | 1 | 0.01% | 4 |
| 1121 | basic transcription factor 3 (RefSeq aa 4e-39) | NP_001198.1 | 1 | 0.01% | 2 | 0.01% | 1 | 0.01% | 0 | 0.00% | 4 |
| 1122 | isolate 5 12S ribosomal RNA gene | AF121220.1 | 0 | 0.00% | 3 | 0.02% | 1 | 0.01% | 0 | 0.00% | 4 |
| 1123 | cathepsin F (CATSF) | AF071749 | 2 | 0.01% | 1 | 0.01% | 0 | 0.00% | 1 | 0.01% | 4 |
| 1124 | metalloproteinase inhibitor TIMP-2 | AF127803.1 | 0 | 0.00% | 0 | 0.00% | 1 | 0.01% | 3 | 0.02% | 4 |
| 1125 | protease inhibitor 6 (placental thrombin inhibitor) | NM_004568.1 | 0 | 0.00% | 4 | 0.02% | 0 | 0.00% | 0 | 0.00% | 4 |
| 1126 | proteasome (prosome, macropain) subunit, alph | NM_002788.1 | 1 | 0.01% | 1 | 0.01% | 1 | 0.01% | 1 | 0.01% | 4 |
| 1127 | proteasome subunit Y (=X61971 maCRopain su | D29012 | 3 | 0.02% | 0 | 0.00% | 1 | 0.01% | 0 | 0.00% | 4 |
| 1128 | protein activator of the interferon-induced protein | AF072860 | 2 | 0.01% | 0 | 0.00% | 2 | 0.02% | 0 | 0.00% | 4 |
| 1129 | peptidylprolyl isomerase F (cyclophilinF) (RefSe | NP_005720.1 | 0 | 0.00% | 4 | 0.02% | 0 | 0.00% | 0 | 0.00% | 4 |
| 1130 | CCAAT/enhancer binding protein (C/EBP), delta | 4885130 | 0 | 0.00% | 3 | 0.02% | 0 | 0.00% | 1 | 0.01% | 4 |
| 1131 | CLP (CLPP) | L54057.1 | 1 | 0.01% | 1 | 0.01% | 1 | 0.01% | 1 | 0.01% | 4 |
| 1132 | necdin | AB007828 | 2 | 0.01% | 0 | 0.00% | 0 | 0.00% | 2 | 0.01% | 4 |
| 1133 | oxidoreductase UCPA (RefSeq aa 4e-82) | NP_064524.1 | 0 | 0.00% | 4 | 0.02% | 0 | 0.00% | 0 | 0.00% | 4 |
| 1134 | ring finger protein (C3H2C3 type) 6 (RNF6) | NM_005977.1 | 0 | 0.00% | 0 | 0.00% | 3 | 0.02% | 1 | 0.01% | 4 |
| 1135 | TPRC (=X97124 papillary renal cell carcinoma (t | X99720 | 1 | 0.01% | 0 | 0.00% | 1 | 0.01% | 2 | 0.01% | 4 |
| 1136 | trinucleotide repeat DNA binding protein p20-CG | AF094481 | 0 | 0.00% | 1 | 0.01% | 0 | 0.00% | 3 | 0.02% | 4 |
| 1137 | twist gene | Y10871.1 | 0 | 0.00% | 2 | 0.01% | 0 | 0.00% | 2 | 0.01% | 4 |

Figure 6 - Unique Known Genes Identified In Four cDNA Cartilage Libraries and EST Frequency Analysis - Page 21 of 102

| | | | | | | | | | | | |
|---|---|---|---|---|---|---|---|---|---|---|---|
| 1138 | Zinc finger protein expressed in cerebellum (KF1 | NM_005667.1 | 0 | 0.00% | 2 | 0.01% | 2 | 0.02% | 0 | 0.00% | 4 |
| 1139 | glycyl-tRNA synthetase; glycine tRNAligase (Re | NP_002038.1 | 1 | 0.01% | 3 | 0.02% | 0 | 0.00% | 0 | 0.00% | 4 |
| 1140 | heterogeneous nuclear ribonucleoprotein H3 (2H | NM_021644.1 | 0 | 0.00% | 2 | 0.01% | 0 | 0.00% | 2 | 0.01% | 4 |
| 1141 | heterogenous nuclear RNA W16W | X17272 | 0 | 0.00% | 0 | 0.00% | 4 | 0.03% | 0 | 0.00% | 4 |
| 1142 | nuclear matrix protein 55 | U89867.1 | 0 | 0.00% | 1 | 0.01% | 1 | 0.01% | 2 | 0.01% | 4 |
| 1143 | RNA binding motif protein 3 (RBM3) (=U28686) | 5803136 | 1 | 0.01% | 0 | 0.00% | 1 | 0.01% | 2 | 0.01% | 4 |
| 1144 | RNA binding motif protein 5 (RBM5) | AF091263.1 | 3 | 0.02% | 1 | 0.01% | 0 | 0.00% | 0 | 0.00% | 4 |
| 1145 | snRNP protein B | X17567 | 3 | 0.02% | 0 | 0.00% | 0 | 0.00% | 1 | 0.01% | 4 |
| 1146 | splicing factor 3b, subunit 2, 145kD (SF3B2) | NM_006842.1 | 2 | 0.01% | 2 | 0.01% | 0 | 0.00% | 0 | 0.00% | 4 |
| 1147 | splicing factor, arginine/serine-rich 4 (SFRS4) | NM_005626.1 | 2 | 0.01% | 2 | 0.01% | 0 | 0.00% | 0 | 0.00% | 4 |
| 1148 | U13 snRNA pseudogene U13.4B | X58062.1 | 0 | 0.00% | 4 | 0.02% | 0 | 0.00% | 0 | 0.00% | 4 |
| 1149 | MIL1 protein (MIL1), nuclear gene encoding mitc | NM_015367.1 | 0 | 0.00% | 4 | 0.02% | 0 | 0.00% | 0 | 0.00% | 4 |
| 1150 | HLA class-I (HLA-A26) heavy chain | D32129.1 | 0 | 0.00% | 4 | 0.02% | 0 | 0.00% | 0 | 0.00% | 4 |
| 1151 | antigen identified by monoclonal antibodies 12E | NM_002414.1 | 3 | 0.02% | 0 | 0.00% | 0 | 0.00% | 1 | 0.01% | 4 |
| 1152 | DNAJ domain-containing protein MCJ (MCJ) | AF126743.1 | 0 | 0.00% | 0 | 0.00% | 1 | 0.01% | 3 | 0.02% | 4 |
| 1153 | hepatocellular carcinoma-associated antigen 33 | AF244137.1 | 2 | 0.01% | 0 | 0.00% | 0 | 0.00% | 2 | 0.01% | 4 |
| 1154 | sperm antigen-36 | AF187554.1 | 0 | 0.00% | 0 | 0.00% | 2 | 0.02% | 2 | 0.01% | 4 |
| 1155 | Tax1 (human T-cell leukemia virus type I) bindin | NM_006024.2 | 0 | 0.00% | 2 | 0.01% | 1 | 0.01% | 1 | 0.01% | 4 |
| 1156 | isolate Liv chaperone protein HSP90 beta (HSP | AF275719.1 | 3 | 0.02% | 1 | 0.01% | 0 | 0.00% | 0 | 0.00% | 4 |
| 1157 | membrane component, chromosome 11, surface | NM_005898.1 | 2 | 0.01% | 1 | 0.01% | 0 | 0.00% | 1 | 0.01% | 4 |
| 1158 | putative transmembrane protein E3-16 | AF092128.1 | 0 | 0.00% | 0 | 0.00% | 3 | 0.02% | 1 | 0.01% | 4 |
| 1159 | tetraspan TM4SF (TSPAN-2) | AF054839.1 | 0 | 0.00% | 1 | 0.01% | 0 | 0.00% | 3 | 0.02% | 4 |
| 1160 | coagulation factor XIII, A1 polypeptide (F13A1) | NM_000129.1 | 1 | 0.01% | 3 | 0.02% | 0 | 0.00% | 0 | 0.00% | 4 |
| 1161 | platelet-activating factor acetylhydrolase, isoform | 4557740 | 1 | 0.01% | 1 | 0.01% | 1 | 0.01% | 1 | 0.01% | 4 |
| 1162 | transferrin receptor (TFRC) gene | AF187320 | 0 | 0.00% | 2 | 0.01% | 1 | 0.01% | 1 | 0.01% | 4 |
| 1163 | divalent cation tolerant protein CUTA (LOC5159 | 7706243 | 0 | 0.00% | 3 | 0.02% | 0 | 0.00% | 1 | 0.01% | 4 |
| 1164 | CGI-120 protein (LOC51644) | NM_016057.1 | 2 | 0.01% | 2 | 0.01% | 0 | 0.00% | 0 | 0.00% | 4 |
| 1165 | CGI-127 protein | AF151885.1 | 0 | 0.00% | 2 | 0.01% | 1 | 0.01% | 1 | 0.01% | 4 |
| 1166 | CGI-139 protein (=AF078858 PTD003) | AF151897.1 | 0 | 0.00% | 1 | 0.01% | 0 | 0.00% | 3 | 0.02% | 4 |
| 1167 | CGI-31 protein (LOC51075), | NM_015959.1 | 1 | 0.01% | 3 | 0.02% | 0 | 0.00% | 0 | 0.00% | 4 |
| 1168 | CGI-34 protein | AF132968.1 | 0 | 0.00% | 1 | 0.01% | 1 | 0.01% | 2 | 0.01% | 4 |
| 1169 | CGI-39 protein | AF132973.1 | 4 | 0.03% | 0 | 0.00% | 0 | 0.00% | 0 | 0.00% | 4 |
| 1170 | CGI-74 protein | AF151832.1 | 1 | 0.01% | 2 | 0.01% | 0 | 0.00% | 1 | 0.01% | 4 |
| 1171 | echinoderm miCRotubule-associated protein hor | U97018 | 3 | 0.02% | 1 | 0.01% | 0 | 0.00% | 0 | 0.00% | 4 |
| 1172 | pericentrin (Pcnt) | U05823 | 2 | 0.01% | 0 | 0.00% | 0 | 0.00% | 2 | 0.01% | 4 |
| 1173 | MLL septin-like fusion protein MSF-A | AF189713.2 | 4 | 0.03% | 0 | 0.00% | 0 | 0.00% | 0 | 0.00% | 4 |
| 1174 | nebulette (NEBL) | Y16241 | 0 | 0.00% | 2 | 0.01% | 2 | 0.02% | 0 | 0.00% | 4 |
| 1175 | myosin light chain 2 | NM_013292.1 | 4 | 0.03% | 0 | 0.00% | 0 | 0.00% | 0 | 0.00% | 4 |
| 1176 | coxsackievirus and adenovirus receptor (CXADF | AF200465.1 | 1 | 0.01% | 2 | 0.01% | 0 | 0.00% | 1 | 0.01% | 4 |
| 1177 | discoidin domain receptor family, member 2 (DD | NM_006182.1 | 0 | 0.00% | 4 | 0.02% | 0 | 0.00% | 0 | 0.00% | 4 |
| 1178 | epidermal growth factor receptor, precursor | X00588 | 0 | 0.00% | 0 | 0.00% | 4 | 0.03% | 0 | 0.00% | 4 |
| 1179 | insulin receptor | L07782 | 1 | 0.01% | 2 | 0.01% | 0 | 0.00% | 1 | 0.01% | 4 |
| 1180 | leptin receptor (ORF) | U66496 | 1 | 0.01% | 2 | 0.01% | 1 | 0.01% | 0 | 0.00% | 4 |
| 1181 | microvascular endothelial differentiation gene 1 | AB026908.1 | 0 | 0.00% | 2 | 0.01% | 1 | 0.01% | 1 | 0.01% | 4 |
| 1182 | vanilloid receptor; CARKL and CTNS; TIP1; P2X | AF168787.1 | 2 | 0.01% | 0 | 0.00% | 1 | 0.01% | 1 | 0.01% | 4 |
| 1183 | vitiligo-associated protein VIT-1 (VIT1) (=DKFZp | AF264714.1 | 0 | 0.00% | 2 | 0.01% | 1 | 0.01% | 1 | 0.01% | 4 |
| 1184 | epithelial protein lost in neoplasm beta (EPLIN) | NM_016357.1 | 0 | 0.00% | 0 | 0.00% | 3 | 0.02% | 1 | 0.01% | 4 |
| 1185 | mitogen-activated protein kinase 3 (MAP4K3) | 4506376 | 0 | 0.00% | 1 | 0.01% | 1 | 0.01% | 2 | 0.01% | 4 |
| 1186 | protein-kinase, interferon-inducible double strand | NP_006251.1 | 1 | 0.01% | 2 | 0.01% | 1 | 0.01% | 0 | 0.00% | 4 |
| 1187 | ser-thr protein kinase PK428 | U59305 | 0 | 0.00% | 1 | 0.01% | 0 | 0.00% | 3 | 0.02% | 4 |
| 1188 | signal transducer and activator of transcription 1 | NM_007315.1 | 2 | 0.01% | 1 | 0.01% | 1 | 0.01% | 0 | 0.00% | 4 |
| 1189 | angiopoietin-like 1 (ANGPTL1) | NM_004673.1 | 0 | 0.00% | 1 | 0.01% | 2 | 0.02% | 1 | 0.01% | 4 |
| 1190 | lens epithelium-derived growth factor gene, alter | AF199339.1 | 1 | 0.01% | 0 | 0.00% | 3 | 0.02% | 0 | 0.00% | 4 |
| 1191 | transforming growth factor-beta 3 (TGF-beta 3) | X14891 | 0 | 0.00% | 1 | 0.01% | 0 | 0.00% | 3 | 0.02% | 4 |
| 1192 | uncharacterized hypothalamus protein HARP11 | NM_018477.1 | 1 | 0.01% | 0 | 0.00% | 2 | 0.02% | 1 | 0.01% | 4 |
| 1193 | calcium channel alpha1E subunit (CACNA1E) ge | AF223391.1 | 1 | 0.01% | 0 | 0.00% | 1 | 0.01% | 2 | 0.01% | 4 |
| 1194 | multiple PDZ domain protein (MPDZ) = AF09341 | NM_003829.1 | 0 | 0.00% | 1 | 0.01% | 2 | 0.02% | 1 | 0.01% | 4 |

Figure 6 - Unique Known Genes Identified In Four cDNA Cartilage Libraries and EST Frequency Analysis - Page 22 of 102

| | | | | | | | | | | | |
|---|---|---|---|---|---|---|---|---|---|---|---|
| 1195 | heterochromatin-like protein 1 (HECH) | NM_016587.1 | 0 | 0.00% | 2 | 0.01% | 0 | 0.00% | 2 | 0.01% | 4 |
| 1196 | high-glucose-regulated protein 8 (HGRG8) | AF192968.1 | 1 | 0.01% | 2 | 0.01% | 1 | 0.01% | 0 | 0.00% | 4 |
| 1197 | BM-001 (=cyclin L ania-6a) | AF208843.1 | 0 | 0.00% | 3 | 0.02% | 0 | 0.00% | 1 | 0.01% | 4 |
| 1198 | caltractin (20kD calcium-binding protein) (CALT) | NM_004344.1 | 1 | 0.01% | 3 | 0.02% | 0 | 0.00% | 0 | 0.00% | 4 |
| 1199 | cullin 1 (CUL1)+D1167 | AF062536.1 | 0 | 0.00% | 1 | 0.01% | 3 | 0.02% | 0 | 0.00% | 4 |
| 1200 | cyclin D2(=KIAK0002 gene) | NM_001759.1 | 2 | 0.01% | 1 | 0.01% | 0 | 0.00% | 1 | 0.01% | 4 |
| 1201 | M phase phosphoprotein 10 | X98494 | 0 | 0.00% | 0 | 0.00% | 4 | 0.03% | 0 | 0.00% | 4 |
| 1202 | prefoldin 1 (PFDN1) | NM_002622.1 | 1 | 0.01% | 2 | 0.01% | 0 | 0.00% | 1 | 0.01% | 4 |
| 1203 | brain cellular apoptosis susceptibility protein (CS | AF053641 | 1 | 0.01% | 0 | 0.00% | 1 | 0.01% | 2 | 0.01% | 4 |
| 1204 | p66shc (SHC) | U73377.1 | 3 | 0.02% | 0 | 0.00% | 1 | 0.01% | 0 | 0.00% | 4 |
| 1205 | adrenomedullin (ADM) | NM_001124.1 | 0 | 0.00% | 2 | 0.01% | 0 | 0.00% | 2 | 0.01% | 4 |
| 1206 | BUB3 (budding uninhibited by benzimidazoles 3 | NM_004725.1 | 0 | 0.00% | 3 | 0.02% | 0 | 0.00% | 1 | 0.01% | 4 |
| 1207 | proto-oncogene tyrosine-protein kinase (ABL) ge | U07563.1 | 1 | 0.01% | 0 | 0.00% | 2 | 0.02% | 1 | 0.01% | 4 |
| 1208 | tumor endothelial marker 8 (TEM8) | AF279145.1 | 0 | 0.00% | 3 | 0.02% | 0 | 0.00% | 1 | 0.01% | 4 |
| 1209 | hypothetical protein (RefSeq aa 5e-76) | NP_057578.1 | 0 | 0.00% | 4 | 0.02% | 0 | 0.00% | 0 | 0.00% | 4 |
| 1210 | KIAA0206 | D86961 | 0 | 0.00% | 2 | 0.01% | 0 | 0.00% | 2 | 0.01% | 4 |
| 1211 | KIAA0877 | AB020684 | 3 | 0.02% | 0 | 0.00% | 0 | 0.00% | 1 | 0.01% | 4 |
| 1212 | KIAA0993 | AB023210.1 | 1 | 0.01% | 2 | 0.01% | 0 | 0.00% | 2 | 0.01% | 4 |
| 1213 | KIAA1436 protein | AB037857.1 | 3 | 0.02% | 0 | 0.00% | 1 | 0.01% | 0 | 0.00% | 4 |
| 1214 | P311 protein (P311), mRNA /cds=(202,408) /gb= | Hs.142827 | 1 | 0.01% | 1 | 0.01% | 0 | 0.00% | 2 | 0.01% | 4 |
| 1215 | small EDRK-rich factor 1, long isoform (SERF1) | AF073519.1 | 1 | 0.01% | 1 | 0.01% | 1 | 0.01% | 1 | 0.01% | 4 |
| 1216 | v-yes-1 Yamaguchi sarcoma viral oncogene hon | NM_005433.1 | 1 | 0.01% | 0 | 0.00% | 2 | 0.02% | 1 | 0.01% | 4 |
| 1217 | vacuolar ATPase isoform VA68 | AF113129.1 | 1 | 0.01% | 0 | 0.00% | 1 | 0.01% | 2 | 0.01% | 4 |
| 1218 | deoxyuridine triphosphatase(DUT) mRNA, comp | U62891.1 | 2 | 0.01% | 1 | 0.01% | 1 | 0.01% | 0 | 0.00% | 4 |
| 1219 | steroid dehydrogenase homolog | AF078850.1 | 0 | 0.00% | 0 | 0.00% | 1 | 0.01% | 3 | 0.02% | 4 |
| 1220 | sterol carrier protein-X/sterol carrier protein-2 (S | U11313.1 | 0 | 0.00% | 2 | 0.01% | 0 | 0.00% | 2 | 0.01% | 4 |
| 1221 | translin | X78627 | 2 | 0.01% | 0 | 0.00% | 1 | 0.01% | 1 | 0.01% | 4 |
| 1222 | ribosomal protein L36a (RefSeq aa 1e-54) | NP_000992.1 | 0 | 0.00% | 4 | 0.02% | 0 | 0.00% | 0 | 0.00% | 4 |
| 1223 | calpain-like protease (CANPX) | NM_014289.1 | 4 | 0.03% | 0 | 0.00% | 0 | 0.00% | 0 | 0.00% | 4 |
| 1224 | cysteinyl-tRNA synthetase | L06845.1 | 2 | 0.01% | 1 | 0.01% | 0 | 0.00% | 1 | 0.01% | 4 |
| 1225 | ubiquitin-like 3 (UBL3) | NM_007106.1 | 0 | 0.00% | 3 | 0.02% | 1 | 0.01% | 0 | 0.00% | 4 |
| 1226 | YY1 transcription factor (YY1) | NM_003403.2 | 0 | 0.00% | 2 | 0.01% | 0 | 0.00% | 2 | 0.01% | 4 |
| 1227 | SR protein (RNPS1) | AF015608.1 | 2 | 0.01% | 0 | 0.00% | 0 | 0.00% | 2 | 0.01% | 4 |
| 1228 | major histocompatibility complex, class II, DR al | NP_061984.1 | 0 | 0.00% | 4 | 0.02% | 0 | 0.00% | 0 | 0.00% | 4 |
| 1229 | epb72 | X85117 | 0 | 0.00% | 0 | 0.00% | 2 | 0.02% | 2 | 0.01% | 4 |
| 1230 | putative type II membrane protein (HP10390), (C | NM_014255.1 | 2 | 0.01% | 0 | 0.00% | 2 | 0.02% | 0 | 0.00% | 4 |
| 1231 | metallothionein 1X (MT1X) gene | X65607.1 | 0 | 0.00% | 3 | 0.02% | 0 | 0.00% | 1 | 0.01% | 4 |
| 1232 | ionizing radiation resistance conferring protein (= | U18321 | 2 | 0.01% | 0 | 0.00% | 1 | 0.01% | 1 | 0.01% | 4 |
| 1233 | CGI-116 protein(LOC51019)(ORF)= AF155655 p | NM_016053.1 | 0 | 0.00% | 2 | 0.01% | 1 | 0.01% | 1 | 0.01% | 4 |
| 1234 | actin2 | D12816.1 | 0 | 0.00% | 0 | 0.00% | 0 | 0.00% | 4 | 0.03% | 4 |
| 1235 | tropomyosin | M19267 | 2 | 0.01% | 0 | 0.00% | 1 | 0.01% | 1 | 0.01% | 4 |
| 1236 | integral membrane protein 2B (ITM2B), mRNA /c | Hs.239625 | 0 | 0.00% | 1 | 0.01% | 0 | 0.00% | 3 | 0.02% | 4 |
| 1237 | unactive progesterone receptor, 23 kD (P23) = L | NM_006601.1 | 0 | 0.00% | 1 | 0.01% | 2 | 0.02% | 1 | 0.01% | 4 |
| 1238 | RAN binding protein 1 (RANBP1), low match | NM_002882.2 | 4 | 0.03% | 0 | 0.00% | 0 | 0.00% | 0 | 0.00% | 4 |
| 1239 | voltage-dependent anion channel isoform 1 (VDA | L06132 | 3 | 0.02% | 0 | 0.00% | 1 | 0.01% | 0 | 0.00% | 4 |
| 1240 | histone acetyltransferase 1 | AF030424 | 0 | 0.00% | 1 | 0.01% | 2 | 0.02% | 1 | 0.01% | 4 |
| 1241 | Nijmegen breakage syndrome 1 (nibrin) (NBS1) | NM_002485.2 | 1 | 0.01% | 2 | 0.01% | 1 | 0.01% | 0 | 0.00% | 4 |
| 1242 | apoptosis-related protein TFAR15 (TFAR15) | AF022385 | 0 | 0.00% | 1 | 0.01% | 3 | 0.02% | 0 | 0.00% | 4 |
| 1243 | septin 2-like cell division control protein | AF146760.1 | 0 | 0.00% | 1 | 0.01% | 1 | 0.01% | 2 | 0.01% | 4 |
| 1244 | tumor antigen (L6) | M90657.1 | 2 | 0.01% | 2 | 0.01% | 0 | 0.00% | 0 | 0.00% | 4 |
| 1245 | hypothetical 43.2 Kd protein (RefSeq aa 7e-35) | NP_057050.1 | 0 | 0.00% | 4 | 0.02% | 0 | 0.00% | 0 | 0.00% | 4 |
| 1246 | KIAA0592 (ORF) | AB011164 | 1 | 0.01% | 1 | 0.01% | 0 | 0.00% | 2 | 0.01% | 4 |
| 1247 | KIAA0829 | AB020636 | 0 | 0.00% | 0 | 0.00% | 1 | 0.01% | 3 | 0.02% | 4 |
| 1248 | KIAA1265 | AB033091 | 1 | 0.01% | 0 | 0.00% | 1 | 0.01% | 2 | 0.01% | 4 |
| 1249 | murine mammary tumor integration site 6(oncog | NP_001559.1 | 0 | 0.00% | 4 | 0.02% | 0 | 0.00% | 0 | 0.00% | 4 |
| 1250 | PC3 cell line (TL27) | X75684.1 | 1 | 0.01% | 3 | 0.02% | 0 | 0.00% | 0 | 0.00% | 4 |
| 1251 | small acidic protein (IMAGE145052) | NM_014267.1 | 0 | 0.00% | 1 | 0.01% | 2 | 0.02% | 1 | 0.01% | 4 |

Figure 6 - Unique Known Genes Identified In Four cDNA Cartilage Libraries and EST Frequency Analysis - Page 23 of 102

| | | | | | | | | | | | |
|---|---|---|---|---|---|---|---|---|---|---|---|
| 1252 | lysophospholipase (LPL1) | AF081281 | 1 | 0.01% | 1 | 0.01% | 0 | 0.00% | 3 | 0.02% | 4 |
| 1253 | mitochondrial ATP synthase subunit 9 | U09813 | 2 | 0.01% | 0 | 0.00% | 0 | 0.00% | 2 | 0.01% | 4 |
| 1254 | hXBP-1 transcription factor DNA (=TREB proteir | L13850.1 | 0 | 0.00% | 2 | 0.01% | 1 | 0.01% | 1 | 0.01% | 4 |
| 1255 | zinc finger protein(MAZ) | M94046 | 4 | 0.03% | 0 | 0.00% | 0 | 0.00% | 0 | 0.00% | 4 |
| 1256 | KARP-1-binding protein 3 (=KIAA0470) | AB022659.1 | 1 | 0.01% | 1 | 0.01% | 1 | 0.01% | 1 | 0.01% | 4 |
| 1257 | miCRofibril-associated glycoprotein (MFAP2) | U19718 | 4 | 0.03% | 0 | 0.00% | 0 | 0.00% | 0 | 0.00% | 4 |
| 1258 | smooth muscle myosin alkali light chain | U02629.1 | 2 | 0.01% | 1 | 0.01% | 1 | 0.01% | 0 | 0.00% | 4 |
| 1259 | novel growth factor receptor | M64347 | 3 | 0.02% | 0 | 0.00% | 0 | 0.00% | 1 | 0.01% | 4 |
| 1260 | inducible 6-phosphofructo-2-kinase/fructose 2,6- | AF056320 | 1 | 0.01% | 1 | 0.01% | 1 | 0.01% | 1 | 0.01% | 4 |
| 1261 | GTPase activating protein (rap1GAP) | M64788 | 2 | 0.01% | 0 | 0.00% | 1 | 0.01% | 1 | 0.01% | 4 |
| 1262 | chromodomain helicase DNA binding protein 1 (( | NP_001261.1 | 0 | 0.00% | 2 | 0.01% | 0 | 0.00% | 2 | 0.01% | 4 |
| 1263 | topoisomerase IIb mRNA,(= TOP2 mRNA for DN | U54831.1 | 1 | 0.01% | 2 | 0.01% | 1 | 0.01% | 0 | 0.00% | 4 |
| 1264 | CUG triplet repeat,RNA-binding protein 2 (CUGE | NM_006561.1 | 1 | 0.01% | 2 | 0.01% | 1 | 0.01% | 0 | 0.00% | 4 |
| 1265 | retinoblastoma 1 (including osteosarcoma) (RB1 | NM_000321.1 | 0 | 0.00% | 1 | 0.01% | 2 | 0.02% | 0 | 0.00% | 3 |
| 1266 | lectin, galactoside-binding, soluble, 3 (galectin 3 | NM_002306.1 | 0 | 0.00% | 2 | 0.01% | 1 | 0.01% | 0 | 0.00% | 3 |
| 1267 | guanine nucleotide binding protein (G protein), a | NM_006496.1 | 0 | 0.00% | 1 | 0.01% | 1 | 0.01% | 1 | 0.01% | 3 |
| 1268 | protein phosphatase 2A B56-epsilon (PP2A) | L76703 | 1 | 0.01% | 0 | 0.00% | 0 | 0.00% | 2 | 0.01% | 3 |
| 1269 | COX VIa-L cytochrome c oxidase liver-specific s | X15341.1 | 1 | 0.01% | 0 | 0.00% | 1 | 0.01% | 1 | 0.01% | 3 |
| 1270 | VDUP1 upregulated by 1,25-dihydroxyvitamin D- | NM_006472.1 | 0 | 0.00% | 3 | 0.02% | 0 | 0.00% | 0 | 0.00% | 3 |
| 1271 | reticulocalbin 1, EF-hand calcium binding domai | NM_002901.1 | 1 | 0.01% | 1 | 0.01% | 1 | 0.01% | 0 | 0.00% | 3 |
| 1272 | NADH dehydrogenase (ubiquinone) 1 beta subc | NM_002492.1 | 1 | 0.01% | 1 | 0.01% | 1 | 0.01% | 0 | 0.00% | 3 |
| 1273 | translation initiation factor A121/Sui1 (A121/SUI1 | AF100737 | 3 | 0.02% | 0 | 0.00% | 0 | 0.00% | 0 | 0.00% | 3 |
| 1274 | proteasome (prosome macropain) 26S subunit, / | NM_002802.1 | 2 | 0.01% | 0 | 0.00% | 0 | 0.00% | 1 | 0.01% | 3 |
| 1275 | integrin, beta 5 (ITGB5) | NM_002213.1 | 0 | 0.00% | 1 | 0.01% | 1 | 0.01% | 1 | 0.01% | 3 |
| 1276 | plasma membrane calcium ATPase isoform 1 (A | L14561 | 0 | 0.00% | 2 | 0.01% | 0 | 0.00% | 1 | 0.01% | 3 |
| 1277 | mannosidase, alpha, class 1A, member 2 (MAN | NM_006699.1 | 0 | 0.00% | 3 | 0.02% | 0 | 0.00% | 0 | 0.00% | 3 |
| 1278 | delta-like homolog (Drosophila) (DLK1)(= adrena | NM_003836.1 | 3 | 0.02% | 0 | 0.00% | 0 | 0.00% | 0 | 0.00% | 3 |
| 1279 | FAT tumor suppressor (Drosophila) homolog | NP_005236.1 | 0 | 0.00% | 1 | 0.01% | 2 | 0.02% | 0 | 0.00% | 3 |
| 1280 | FUS glycine rich protein | X71428.1 | 3 | 0.02% | 0 | 0.00% | 0 | 0.00% | 0 | 0.00% | 3 |
| 1281 | eukaryotic translation elongation factor 1 delta (g | NM_001960.1 | 3 | 0.02% | 0 | 0.00% | 0 | 0.00% | 0 | 0.00% | 3 |
| 1282 | ubiquitin-conjugating enzyme E2 | AB017644.1 | 0 | 0.00% | 1 | 0.01% | 0 | 0.00% | 2 | 0.01% | 3 |
| 1283 | thyroid hormone receptor interactor 12 (TRIP12) | NM_004238.1 | 0 | 0.00% | 2 | 0.01% | 0 | 0.00% | 1 | 0.01% | 3 |
| 1284 | IMP (inosine monophosphate)dehydrogenase 2 | NM_000884.1 | 1 | 0.01% | 0 | 0.00% | 2 | 0.02% | 0 | 0.00% | 3 |
| 1285 | major histocompatibility complex, class II, DR be | NM_002124.1 | 1 | 0.01% | 1 | 0.01% | 0 | 0.00% | 1 | 0.01% | 3 |
| 1286 | DNA topoisomerase II (TOP2) | Z15115 | 1 | 0.01% | 0 | 0.00% | 1 | 0.01% | 1 | 0.01% | 3 |
| 1287 | laminin, beta 1 (LAMB1) | NM_002291.1 | 2 | 0.01% | 0 | 0.00% | 0 | 0.00% | 1 | 0.01% | 3 |
| 1288 | hum-a-tub1 alpha-tubulin | AF141348.1 | 3 | 0.02% | 0 | 0.00% | 0 | 0.00% | 0 | 0.00% | 3 |
| 1289 | nerve growth factor (HBNF-1)(= OSF-1)(= pleiotr | M57399.1 | 1 | 0.01% | 1 | 0.01% | 1 | 0.01% | 0 | 0.00% | 3 |
| 1290 | ras-related C3 botulinum toxin substrate (rac) | M29870 | 1 | 0.01% | 1 | 0.01% | 1 | 0.01% | 0 | 0.00% | 3 |
| 1291 | voltage dependent anion channel form 3 (=AF0 | U90943 | 1 | 0.01% | 0 | 0.00% | 0 | 0.00% | 2 | 0.01% | 3 |
| 1292 | polymerase (DNA directed) delta 2, regulatory su | NM_006230.1 | 3 | 0.02% | 0 | 0.00% | 0 | 0.00% | 0 | 0.00% | 3 |
| 1293 | guanylate binding protein isoform II (GBP-2) | M55543 | 0 | 0.00% | 0 | 0.00% | 1 | 0.01% | 2 | 0.01% | 3 |
| 1294 | HSPC328 | AF161446.1 | 1 | 0.01% | 1 | 0.01% | 1 | 0.01% | 0 | 0.00% | 3 |
| 1295 | spinocerebellar ataxia 1(olivopontocerebellar ata | NM_000332.1 | 0 | 0.00% | 1 | 0.01% | 2 | 0.02% | 0 | 0.00% | 3 |
| 1296 | ATP-binding cassette, sub-family A (ABC1), mer | 6005701 | 0 | 0.00% | 1 | 0.01% | 2 | 0.02% | 0 | 0.00% | 3 |
| 1297 | galactosidase, alpha (GLA) | NM_000169.1 | 1 | 0.01% | 2 | 0.01% | 0 | 0.00% | 0 | 0.00% | 3 |
| 1298 | glucose regulated protein, 58kD (GRP58) | NM_005313.1 | 0 | 0.00% | 2 | 0.01% | 0 | 0.00% | 1 | 0.01% | 3 |
| 1299 | dihydrodiol dehydrogenase 2 (trans-1,2-dihydrob | NP_001345.1 | 0 | 0.00% | 3 | 0.02% | 0 | 0.00% | 0 | 0.00% | 3 |
| 1300 | squalene epoxidase | D78129 | 1 | 0.01% | 0 | 0.00% | 1 | 0.01% | 1 | 0.01% | 3 |
| 1301 | CYTOCHROME C OXIDASE POLYPEPTIDE VI | spP15954 | 1 | 0.01% | 0 | 0.00% | 0 | 0.00% | 2 | 0.01% | 3 |
| 1302 | cytochrome c oxidase subunit III (RefSeq aa 1e- | gi5835394 | 0 | 0.00% | 3 | 0.02% | 0 | 0.00% | 0 | 0.00% | 3 |
| 1303 | methionine adenosyltransferase alpha subunit | L43509 | 1 | 0.01% | 2 | 0.01% | 0 | 0.00% | 0 | 0.00% | 3 |
| 1304 | Krueppel-related DNA-binding protein (PF4) | M61866 | 0 | 0.00% | 1 | 0.01% | 1 | 0.01% | 1 | 0.01% | 3 |
| 1305 | RING zinc finger protein (RZF) | AF037204 | 0 | 0.00% | 0 | 0.00% | 1 | 0.01% | 2 | 0.01% | 3 |
| 1306 | RNA helicase | AJ223948 | 0 | 0.00% | 1 | 0.01% | 1 | 0.01% | 1 | 0.01% | 3 |
| 1307 | Glutathione transferase omega (GSTO1) | AF212303.1 | 1 | 0.01% | 1 | 0.01% | 0 | 0.00% | 1 | 0.01% | 3 |
| 1308 | L-isoaspartyl/D-aspartyl protein carboxyl methylt | M93009 | 0 | 0.00% | 0 | 0.00% | 1 | 0.01% | 2 | 0.01% | 3 |

Figure 6 - Unique Known Genes Identified In Four cDNA Cartilage Libraries and EST Frequency Analysis - Page 24 of 102

| | | | | | | | | | | | |
|---|---|---|---|---|---|---|---|---|---|---|---|
| 1309 | collagen type V alpha 1(COL5A1) | D90279 | 3 | 0.02% | 0 | 0.00% | 0 | 0.00% | 0 | 0.00% | 3 |
| 1310 | interferon gamma receptor 2 (interferon gamma | 5031782 | 0 | 0.00% | 2 | 0.01% | 1 | 0.01% | 0 | 0.00% | 3 |
| 1311 | nuclear receptor subfamily 3, group C, member | NM_000176.1 | 0 | 0.00% | 1 | 0.01% | 1 | 0.01% | 1 | 0.01% | 3 |
| 1312 | insulin-like growth factor binding protein-3 | X64875 | 2 | 0.01% | 0 | 0.00% | 0 | 0.00% | 1 | 0.01% | 3 |
| 1313 | potassium channel modulatory factor (=DKFZp4 | AF155652.1 | 1 | 0.01% | 0 | 0.00% | 1 | 0.01% | 1 | 0.01% | 3 |
| 1314 | cyclin protein | M15796 | 1 | 0.01% | 0 | 0.00% | 0 | 0.00% | 2 | 0.01% | 3 |
| 1315 | nuclear phosphoprotein similar to S. cerevisiae | NM_007062.1 | 1 | 0.01% | 0 | 0.00% | 1 | 0.01% | 1 | 0.01% | 3 |
| 1316 | COP9 complex subunit 4 (LOC51138) | NM_016129.1 | 0 | 0.00% | 1 | 0.01% | 1 | 0.01% | 1 | 0.01% | 3 |
| 1317 | endomembrane protein EMP70 precusor isologu | U95973 | 1 | 0.01% | 0 | 0.00% | 1 | 0.01% | 1 | 0.01% | 3 |
| 1318 | KIAA0695 | AB014595 | 0 | 0.00% | 1 | 0.01% | 2 | 0.02% | 0 | 0.00% | 3 |
| 1319 | KIAA0769 gene product (KIAA0769) | NM_014824.1 | 1 | 0.01% | 0 | 0.00% | 2 | 0.02% | 0 | 0.00% | 3 |
| 1320 | neuronal protein | X79682 | 2 | 0.01% | 0 | 0.00% | 0 | 0.00% | 1 | 0.01% | 3 |
| 1321 | NRAS-related gene (D1S155E) (=DKFZp586J06 | NM_007158.1 | 1 | 0.01% | 1 | 0.01% | 1 | 0.01% | 0 | 0.00% | 3 |
| 1322 | RAB13, member RAS oncogene family (RAB13) | NM_002870.1 | 1 | 0.01% | 1 | 0.01% | 1 | 0.01% | 0 | 0.00% | 3 |
| 1323 | retrotransposon 3' long terminal repeat | Z48633 | 0 | 0.00% | 1 | 0.01% | 0 | 0.00% | 2 | 0.01% | 3 |
| 1324 | sex-regulated protein janus A | S77099 | 3 | 0.02% | 0 | 0.00% | 0 | 0.00% | 0 | 0.00% | 3 |
| 1325 | ATPase, Ca transporting, cardiac muscle, slow | NM_001681.1 | 2 | 0.01% | 0 | 0.00% | 0 | 0.00% | 1 | 0.01% | 3 |
| 1326 | cysteine protease | D55696.1 | 1 | 0.01% | 2 | 0.01% | 0 | 0.00% | 0 | 0.00% | 3 |
| 1327 | protein-tyrosine-phosphatase G1 | D13380.1 | 2 | 0.01% | 0 | 0.00% | 1 | 0.01% | 0 | 0.00% | 3 |
| 1328 | adipocyte acid phosphatase beta=phenylarsine | S62885.1 | 0 | 0.00% | 1 | 0.01% | 1 | 0.01% | 1 | 0.01% | 3 |
| 1329 | ATP SYNTHASE PROTEIN 8 (A6L) | P03928 | 0 | 0.00% | 3 | 0.02% | 0 | 0.00% | 0 | 0.00% | 3 |
| 1330 | hinge=OXPHOS system complex III | S61826 | 0 | 0.00% | 1 | 0.01% | 0 | 0.00% | 2 | 0.01% | 3 |
| 1331 | mitochondrial aldehyde dehydrogenase (ALDH I | Y00109 | 1 | 0.01% | 0 | 0.00% | 2 | 0.02% | 0 | 0.00% | 3 |
| 1332 | NADH dehydrogenase (ubiquinone) 1, subcomp | NM_002494.1 | 1 | 0.01% | 1 | 0.01% | 0 | 0.00% | 1 | 0.01% | 3 |
| 1333 | NADH dehydrogenase (ubiquinone) Fe-S protein | NM_004553.1 | 1 | 0.01% | 1 | 0.01% | 0 | 0.00% | 1 | 0.01% | 3 |
| 1334 | Na,K-ATPase beta subunit (ATP1B) | M25160 | 1 | 0.01% | 1 | 0.01% | 1 | 0.01% | 0 | 0.00% | 3 |
| 1335 | wingless-type MMTV integration site family, mer | NM_004185.1 | 0 | 0.00% | 2 | 0.01% | 0 | 0.00% | 1 | 0.01% | 3 |
| 1336 | alpha-1-antichymotrypsin, precursor;actichymotr | NP_001076.1 | 0 | 0.00% | 3 | 0.02% | 0 | 0.00% | 0 | 0.00% | 3 |
| 1337 | cystatin C | X52255 | 3 | 0.02% | 0 | 0.00% | 0 | 0.00% | 0 | 0.00% | 3 |
| 1338 | proteasome (prosome, macropain) 26S subunit, | NM_002804.1 | 3 | 0.02% | 0 | 0.00% | 0 | 0.00% | 0 | 0.00% | 3 |
| 1339 | sorting nexin 2 (SNX2) | AF065482.1 | 0 | 0.00% | 1 | 0.01% | 2 | 0.02% | 0 | 0.00% | 3 |
| 1340 | DiGeorge syndrome critical region gene 6 (DGC | NM_005675.1 | 2 | 0.01% | 1 | 0.01% | 0 | 0.00% | 0 | 0.00% | 3 |
| 1341 | ubiquitin-conjugating enzyme E2L 3 (UBE2L3) | NM_003347.1 | 0 | 0.00% | 2 | 0.01% | 0 | 0.00% | 1 | 0.01% | 3 |
| 1342 | Cdc5-related protein (PCDC5RP) (=AB007892.1 | U86753.1 | 0 | 0.00% | 0 | 0.00% | 0 | 0.00% | 3 | 0.02% | 3 |
| 1343 | CGI-99 protein = homeobox prox 1= AF100755. | AF151857 | 0 | 0.00% | 0 | 0.00% | 2 | 0.02% | 1 | 0.01% | 3 |
| 1344 | jun B proto-oncogene (JUNB) | NM_002229.1 | 3 | 0.02% | 0 | 0.00% | 0 | 0.00% | 0 | 0.00% | 3 |
| 1345 | mSin3A (sin3A) | U22394 | 0 | 0.00% | 0 | 0.00% | 2 | 0.02% | 1 | 0.01% | 3 |
| 1346 | retinoblastoma-binding protein 7 (RBBP7) | NM_002893.1 | 1 | 0.01% | 1 | 0.01% | 0 | 0.00% | 1 | 0.01% | 3 |
| 1347 | X-box binding protein 1 (RefSeq aa 3e-37) | NP_005071.1 | 0 | 0.00% | 2 | 0.01% | 0 | 0.00% | 1 | 0.01% | 3 |
| 1348 | zinc finger protein 133 (clone pHZ-13) (ZNF133) | NM_003434.1 | 1 | 0.01% | 1 | 0.01% | 1 | 0.01% | 0 | 0.00% | 3 |
| 1349 | dead box, X isoform (DBX) | AF000982.1 | 1 | 0.01% | 0 | 0.00% | 1 | 0.01% | 1 | 0.01% | 3 |
| 1350 | six transmembrane epithelial antigen of prostate | AF186249.1 | 1 | 0.01% | 2 | 0.01% | 0 | 0.00% | 0 | 0.00% | 3 |
| 1351 | coatomer protein complex, subunit beta 2 (beta | NM_004766.1 | 0 | 0.00% | 1 | 0.01% | 2 | 0.02% | 0 | 0.00% | 3 |
| 1352 | helicase II (RAD54L) (=ATRX) | U09820 | 0 | 0.00% | 2 | 0.01% | 1 | 0.01% | 0 | 0.00% | 3 |
| 1353 | topoisomerase (DNA) II alpha (170kD) (TOP2A) | NM_001067.1 | 0 | 0.00% | 2 | 0.01% | 1 | 0.01% | 0 | 0.00% | 3 |
| 1354 | cytochrome succinate dehydrogenase, small sut | AB026906.1 | 0 | 0.00% | 0 | 0.00% | 1 | 0.01% | 2 | 0.01% | 3 |
| 1355 | GTT1 | AF270647 | 1 | 0.01% | 2 | 0.01% | 0 | 0.00% | 0 | 0.00% | 3 |
| 1356 | major histocompatibility locus class III regions H | AF109905 | 1 | 0.01% | 0 | 0.00% | 1 | 0.01% | 1 | 0.01% | 3 |
| 1357 | prenylated rab acceptor 1 (PRA1) | AF025506 | 3 | 0.02% | 0 | 0.00% | 0 | 0.00% | 0 | 0.00% | 3 |
| 1358 | CGI-49 protein | AF151807.1 | 0 | 0.00% | 1 | 0.01% | 2 | 0.02% | 0 | 0.00% | 3 |
| 1359 | spindle pole body protein spc98 homologue GCF | AF042378 | 0 | 0.00% | 1 | 0.01% | 2 | 0.02% | 0 | 0.00% | 3 |
| 1360 | chondroitin sulfate proteoglycan 4 (melanoma-as | NM_001897.1 | 3 | 0.02% | 0 | 0.00% | 0 | 0.00% | 0 | 0.00% | 3 |
| 1361 | ankyrin G (ANK-3) | U13616.1 | 1 | 0.01% | 0 | 0.00% | 1 | 0.01% | 1 | 0.01% | 3 |
| 1362 | spectrin beta protein (pAZSP 3' end) | X91849.2 | 1 | 0.01% | 0 | 0.00% | 1 | 0.01% | 1 | 0.01% | 3 |
| 1363 | cold inducible RNA-binding protein (CIRBP) | NM_001280.1 | 2 | 0.01% | 1 | 0.01% | 0 | 0.00% | 0 | 0.00% | 3 |
| 1364 | lamin A | M13452 | 3 | 0.02% | 0 | 0.00% | 0 | 0.00% | 0 | 0.00% | 3 |
| 1365 | phosphatidylinositol glycan, class B (PIGB) | NM_004855.1 | 0 | 0.00% | 2 | 0.01% | 1 | 0.01% | 0 | 0.00% | 3 |

Figure 6 - Unique Known Genes Identified In Four cDNA Cartilage Libraries and EST Frequency Analysis - Page 25 of 102

| | | | | | | | | | | | |
|---|---|---|---|---|---|---|---|---|---|---|---|
| 1366 | interleukin 13 receptor alpha 1 (IL13RA1) | NM_001560.1 | 0 | 0.00% | 0 | 0.00% | 1 | 0.01% | 2 | 0.01% | 3 |
| 1367 | retinoic acid suppression protein A (RSG-A) | AF038964.1 | 1 | 0.01% | 1 | 0.01% | 0 | 0.00% | 1 | 0.01% | 3 |
| 1368 | CDC28 protein kinase 1 (RefSeq aa 4e-44) | NP_001817.1 | 0 | 0.00% | 2 | 0.01% | 1 | 0.01% | 0 | 0.00% | 3 |
| 1369 | latent transforming growth factor beta binding pr | NM_000428.1 | 1 | 0.01% | 1 | 0.01% | 1 | 0.01% | 0 | 0.00% | 3 |
| 1370 | fibroblast growth factor 7 (keratinocyte growth fa | NM_002009.1 | 2 | 0.01% | 0 | 0.00% | 1 | 0.01% | 0 | 0.00% | 3 |
| 1371 | PDZ domain containing-protein (PDZK1) | AF012281 | 0 | 0.00% | 2 | 0.01% | 1 | 0.01% | 0 | 0.00% | 3 |
| 1372 | stanniocalcin 1 (STC1) | NM_003155.1 | 0 | 0.00% | 3 | 0.02% | 0 | 0.00% | 0 | 0.00% | 3 |
| 1373 | fer-1 (C. elegans)-like 3 (FER1L3) (=AF182317 r | NM_013451.1 | 1 | 0.01% | 1 | 0.01% | 0 | 0.00% | 1 | 0.01% | 3 |
| 1374 | chromobox homolog 1(Drosophila HP1 beta) (CE | NM_006807.1 | 2 | 0.01% | 0 | 0.00% | 1 | 0.01% | 0 | 0.00% | 3 |
| 1375 | telomeric repeat binding factor (TRF1) | U40705.1 | 1 | 0.01% | 1 | 0.01% | 1 | 0.01% | 0 | 0.00% | 3 |
| 1376 | prefoldin 2 (PFDN2) | NM_012394.1 | 1 | 0.01% | 1 | 0.01% | 0 | 0.00% | 1 | 0.01% | 3 |
| 1377 | 15 kDa selenoprotein (SEP15), mRNA /cds=(4,4 | Hs.90606 | 0 | 0.00% | 0 | 0.00% | 1 | 0.01% | 2 | 0.01% | 3 |
| 1378 | 4F5rel | AF073298 | 3 | 0.02% | 0 | 0.00% | 0 | 0.00% | 0 | 0.00% | 3 |
| 1379 | androgen induced protein (AIG-1) (=AF151861 ( | AF153605.1 | 0 | 0.00% | 0 | 0.00% | 0 | 0.00% | 3 | 0.02% | 3 |
| 1380 | antigen NY-CO-1 (NY-CO-1) | AF039687.1 | 1 | 0.01% | 0 | 0.00% | 1 | 0.01% | 1 | 0.01% | 3 |
| 1381 | ceroid-lipofuscinosis, neuronal 2, late infantile (J | NM_000391.2 | 0 | 0.00% | 2 | 0.01% | 0 | 0.00% | 1 | 0.01% | 3 |
| 1382 | CG3450 gene product [Drosophila melanogaster | AAF57398.1 | 0 | 0.00% | 0 | 0.00% | 2 | 0.02% | 1 | 0.01% | 3 |
| 1383 | ELK1 (ELK1) | AF080616 | 1 | 0.01% | 1 | 0.01% | 0 | 0.00% | 1 | 0.01% | 3 |
| 1384 | embryonic lung protein (HUEL) | AF006621.1 | 0 | 0.00% | 1 | 0.01% | 2 | 0.02% | 0 | 0.00% | 3 |
| 1385 | ENDOPLASMIN PRECURSOR (94 KD GLUCOS | spP14625 | 0 | 0.00% | 0 | 0.00% | 2 | 0.02% | 1 | 0.01% | 3 |
| 1386 | gene hY3 encoding a cytoplasmic Ro RNA | V00585.1 | 0 | 0.00% | 0 | 0.00% | 2 | 0.02% | 1 | 0.01% | 3 |
| 1387 | GS3955 | D87119 | 1 | 0.01% | 0 | 0.00% | 1 | 0.01% | 1 | 0.01% | 3 |
| 1388 | HBV pX associated protein-8 (LOC51773) | NM_016578.1 | 0 | 0.00% | 1 | 0.01% | 1 | 0.01% | 1 | 0.01% | 3 |
| 1389 | HRIHFB2072 (=AF115778 M.musculus short coi | AB015335.1 | 0 | 0.00% | 1 | 0.01% | 2 | 0.02% | 0 | 0.00% | 3 |
| 1390 | HSPC004 | AF070660 | 0 | 0.00% | 0 | 0.00% | 2 | 0.02% | 1 | 0.01% | 3 |
| 1391 | HSPC019 | AF077205.1 | 0 | 0.00% | 0 | 0.00% | 1 | 0.01% | 2 | 0.01% | 3 |
| 1392 | HSPC033 protein (HSPC033) | NM_014041.1 | 1 | 0.01% | 2 | 0.01% | 0 | 0.00% | 0 | 0.00% | 3 |
| 1393 | HSPC037 protein (LOC51659) | NM_016095.1 | 2 | 0.01% | 1 | 0.01% | 0 | 0.00% | 0 | 0.00% | 3 |
| 1394 | HSPC158 protein (RefSeq aa 3e-87) | NP_054899.1 | 0 | 0.00% | 3 | 0.02% | 0 | 0.00% | 0 | 0.00% | 3 |
| 1395 | HSPC161 | AF161510 | 0 | 0.00% | 0 | 0.00% | 2 | 0.02% | 1 | 0.01% | 3 |
| 1396 | HSPC162 protein (HSPC162) | NM_014183.1 | 1 | 0.01% | 1 | 0.01% | 0 | 0.00% | 1 | 0.01% | 3 |
| 1397 | HSPC218 | AF151052.1 | 1 | 0.01% | 1 | 0.01% | 0 | 0.00% | 1 | 0.01% | 3 |
| 1398 | HSPC241 | AF151075.1 | 0 | 0.00% | 0 | 0.00% | 0 | 0.00% | 3 | 0.02% | 3 |
| 1399 | HSPC275 | AF161393 | 0 | 0.00% | 3 | 0.02% | 0 | 0.00% | 0 | 0.00% | 3 |
| 1400 | HSPC337 | AF161455.1 | 1 | 0.01% | 1 | 0.01% | 0 | 0.00% | 1 | 0.01% | 3 |
| 1401 | HTGN29 protein (HTGN29) | NM_020199.1 | 0 | 0.00% | 3 | 0.02% | 0 | 0.00% | 0 | 0.00% | 3 |
| 1402 | hyperion gene | AJ010770 | 0 | 0.00% | 1 | 0.01% | 1 | 0.01% | 1 | 0.01% | 3 |
| 1403 | hypothetical protein (RefSeq aa 5e-73) | NP_057016.1 | 0 | 0.00% | 3 | 0.02% | 0 | 0.00% | 0 | 0.00% | 3 |
| 1404 | iduronate sulphate sulphatase (IDS) gene | L35485.1 | 1 | 0.01% | 1 | 0.01% | 1 | 0.01% | 0 | 0.00% | 3 |
| 1405 | KIAA0040 | D25539 | 0 | 0.00% | 2 | 0.01% | 0 | 0.00% | 1 | 0.01% | 3 |
| 1406 | KIAA0065 (ZNF33A Kruppel-related) | D31763 | 1 | 0.01% | 0 | 0.00% | 2 | 0.02% | 0 | 0.00% | 3 |
| 1407 | KIAA0076 | D38548 | 3 | 0.02% | 0 | 0.00% | 0 | 0.00% | 0 | 0.00% | 3 |
| 1408 | KIAA0081 | D42039 | 1 | 0.01% | 1 | 0.01% | 1 | 0.01% | 0 | 0.00% | 3 |
| 1409 | KIAA0090 | D42044 | 1 | 0.01% | 0 | 0.00% | 1 | 0.01% | 1 | 0.01% | 3 |
| 1410 | KIAA0099 protein, partial cds | D43951.1 | 1 | 0.01% | 1 | 0.01% | 0 | 0.00% | 1 | 0.01% | 3 |
| 1411 | KIAA0104 | D14660.1 | 1 | 0.01% | 0 | 0.00% | 0 | 0.00% | 2 | 0.01% | 3 |
| 1412 | KIAA0121 | D50911 | 3 | 0.02% | 0 | 0.00% | 0 | 0.00% | 0 | 0.00% | 3 |
| 1413 | KIAA0128 | D50918 | 3 | 0.02% | 0 | 0.00% | 0 | 0.00% | 0 | 0.00% | 3 |
| 1414 | KIAA0146 | D63480 | 2 | 0.01% | 0 | 0.00% | 0 | 0.00% | 1 | 0.01% | 3 |
| 1415 | KIAA0152 (cytotoxic T-cell membrane glycoprot | NM_014730.1 | 1 | 0.01% | 1 | 0.01% | 0 | 0.00% | 1 | 0.01% | 3 |
| 1416 | KIAA0170 | D79992 | 1 | 0.01% | 0 | 0.00% | 1 | 0.01% | 1 | 0.01% | 3 |
| 1417 | KIAA0182 gene | D80004.1 | 0 | 0.00% | 3 | 0.02% | 0 | 0.00% | 0 | 0.00% | 3 |
| 1418 | KIAA0188 | D80010 | 1 | 0.01% | 1 | 0.01% | 1 | 0.01% | 0 | 0.00% | 3 |
| 1419 | KIAA0205 | D86960 | 0 | 0.00% | 0 | 0.00% | 2 | 0.02% | 1 | 0.01% | 3 |
| 1420 | KIAA0238 | D87075 | 0 | 0.00% | 0 | 0.00% | 2 | 0.02% | 1 | 0.01% | 3 |
| 1421 | KIAA0255 gene | D87444 | 2 | 0.01% | 0 | 0.00% | 2 | 0.02% | 0 | 0.00% | 3 |
| 1422 | KIAA0261 | D87450 | 0 | 0.00% | 1 | 0.01% | 0 | 0.00% | 2 | 0.01% | 3 |

Figure 6 - Unique Known Genes Identified In Four cDNA Cartilage Libraries and EST Frequency Analysis - Page 26 of 102

| | | | | | | | | | | | |
|---|---|---|---|---|---|---|---|---|---|---|---|
| 1423 | KIAA0262 | D87451 | 2 | 0.01% | 0 | 0.00% | 1 | 0.01% | 0 | 0.00% | 3 |
| 1424 | KIAA0310 protein | AB002308.2 | 1 | 0.01% | 0 | 0.00% | 0 | 0.00% | 2 | 0.01% | 3 |
| 1425 | KIAA0379 | AB002377 | 0 | 0.00% | 1 | 0.01% | 1 | 0.01% | 1 | 0.01% | 3 |
| 1426 | KIAA0419 gene product (KIAA0419) | NM_014711.1 | 1 | 0.01% | 1 | 0.01% | 0 | 0.00% | 1 | 0.01% | 3 |
| 1427 | KIAA0443 gene product | NM_014710.1 | 0 | 0.00% | 1 | 0.01% | 0 | 0.00% | 2 | 0.01% | 3 |
| 1428 | KIAA0458 | AB007927.1 | 1 | 0.01% | 1 | 0.01% | 0 | 0.00% | 1 | 0.01% | 3 |
| 1429 | KIAA0461 | AB007930 | 1 | 0.01% | 0 | 0.00% | 0 | 0.00% | 2 | 0.01% | 3 |
| 1430 | KIAA0484 | AB007953.1 | 1 | 0.01% | 1 | 0.01% | 1 | 0.01% | 0 | 0.00% | 3 |
| 1431 | KIAA0537 | AB011109 | 0 | 0.00% | 2 | 0.01% | 0 | 0.00% | 1 | 0.01% | 3 |
| 1432 | KIAA0642 | AB014542 | 0 | 0.00% | 3 | 0.02% | 0 | 0.00% | 0 | 0.00% | 3 |
| 1433 | KIAA0666 | AB014566 | 0 | 0.00% | 2 | 0.01% | 0 | 0.00% | 1 | 0.01% | 3 |
| 1434 | KIAA0692 | AB014592.1 | 2 | 0.01% | 0 | 0.00% | 0 | 0.00% | 1 | 0.01% | 3 |
| 1435 | KIAA0696 protein | AB014596 | 1 | 0.01% | 1 | 0.01% | 0 | 0.00% | 1 | 0.01% | 3 |
| 1436 | KIAA0716 | AB018259.1 | 0 | 0.00% | 0 | 0.00% | 2 | 0.02% | 1 | 0.01% | 3 |
| 1437 | KIAA0783 | AB018326.1 | 0 | 0.00% | 0 | 0.00% | 1 | 0.01% | 2 | 0.01% | 3 |
| 1438 | KIAA0851 gene | AJ297357.1 | 1 | 0.01% | 1 | 0.01% | 1 | 0.01% | 0 | 0.00% | 3 |
| 1439 | KIAA0929 protein Msx2 interacting nuclear targe | NM_015001.1 | 0 | 0.00% | 3 | 0.02% | 0 | 0.00% | 0 | 0.00% | 3 |
| 1440 | KIAA0936 | AB023153.1 | 0 | 0.00% | 1 | 0.01% | 0 | 0.00% | 2 | 0.01% | 3 |
| 1441 | KIAA0958 | AB023175.1 | 1 | 0.01% | 0 | 0.00% | 0 | 0.00% | 2 | 0.01% | 3 |
| 1442 | KIAA0965 | AB023182.1 | 0 | 0.00% | 1 | 0.01% | 0 | 0.00% | 2 | 0.01% | 3 |
| 1443 | KIAA1162 | AB032988.1 | 1 | 0.01% | 1 | 0.01% | 1 | 0.01% | 0 | 0.00% | 3 |
| 1444 | KIAA1212 protein | AB033038.1 | 2 | 0.01% | 0 | 0.00% | 1 | 0.01% | 0 | 0.00% | 3 |
| 1445 | KIAA1288 | AB033114.1 | 0 | 0.00% | 2 | 0.01% | 1 | 0.01% | 0 | 0.00% | 3 |
| 1446 | KIAA1311 | AB037732.1 | 0 | 0.00% | 2 | 0.01% | 0 | 0.00% | 1 | 0.01% | 3 |
| 1447 | KIAA1439 | AB037860.1 | 0 | 0.00% | 2 | 0.01% | 0 | 0.00% | 1 | 0.01% | 3 |
| 1448 | KIAA1581 | AB046801 | 0 | 0.00% | 3 | 0.02% | 0 | 0.00% | 0 | 0.00% | 3 |
| 1449 | L1 repetitive element ORF (aa 1e-23,75%) | B28096 | 0 | 0.00% | 3 | 0.02% | 0 | 0.00% | 0 | 0.00% | 3 |
| 1450 | MDS016 (MDS016) | AF182417.1 | 0 | 0.00% | 3 | 0.02% | 0 | 0.00% | 0 | 0.00% | 3 |
| 1451 | MO25 protein (LOC51719) (=cDNA FLJ20797 fis | NM_016289.1 | 0 | 0.00% | 1 | 0.01% | 2 | 0.02% | 0 | 0.00% | 3 |
| 1452 | myeloid cell nuclear differentiation antigen | M81750 | 0 | 0.00% | 1 | 0.01% | 1 | 0.01% | 1 | 0.01% | 3 |
| 1453 | NDPP-1 protein | D10727.1 | 0 | 0.00% | 0 | 0.00% | 1 | 0.01% | 2 | 0.01% | 3 |
| 1454 | Nm23 protein, involved in developmental regulat | X17620 | 1 | 0.01% | 0 | 0.00% | 0 | 0.00% | 2 | 0.01% | 3 |
| 1455 | nuclear distribution gene C (A.nidulans) homolog | NM_006600.1 | 2 | 0.01% | 1 | 0.01% | 0 | 0.00% | 0 | 0.00% | 3 |
| 1456 | P13-kinase associated p85 | M61906 | 0 | 0.00% | 2 | 0.01% | 1 | 0.01% | 0 | 0.00% | 3 |
| 1457 | PEG3 (=AB006625 hypothetical protein (KIAA02 | U90336 | 3 | 0.02% | 0 | 0.00% | 0 | 0.00% | 0 | 0.00% | 3 |
| 1458 | peroxisomal acyl-CoA:dihydroxyacetonephosph | AF043937 | 1 | 0.01% | 0 | 0.00% | 1 | 0.01% | 1 | 0.01% | 3 |
| 1459 | PRO0657 | AAF24054.1 | 0 | 0.00% | 0 | 0.00% | 0 | 0.00% | 3 | 0.02% | 3 |
| 1460 | PRO2550 | AF130089 | 0 | 0.00% | 3 | 0.02% | 0 | 0.00% | 0 | 0.00% | 3 |
| 1461 | PTD015 | AF092136.1 | 0 | 0.00% | 1 | 0.01% | 0 | 0.00% | 2 | 0.01% | 3 |
| 1462 | PTP1C/HCP gene | X82818.1 | 3 | 0.02% | 0 | 0.00% | 0 | 0.00% | 0 | 0.00% | 3 |
| 1463 | Rab geranylgeranyltransferase, beta subunit (RA | NM_004582.1 | 0 | 0.00% | 2 | 0.01% | 0 | 0.00% | 1 | 0.01% | 3 |
| 1464 | retinal pigment epithelium | L07393.1 | 1 | 0.01% | 2 | 0.01% | 0 | 0.00% | 0 | 0.00% | 3 |
| 1465 | retinol-binding protein 4, interstitial (RBP4) | NM_006744.2 | 0 | 0.00% | 3 | 0.02% | 0 | 0.00% | 0 | 0.00% | 3 |
| 1466 | ribulose-5-phosphate-epimerase, (ORF) | AJ224326 | 0 | 0.00% | 2 | 0.01% | 0 | 0.00% | 1 | 0.01% | 3 |
| 1467 | serologically defined colon cancer antigen 1 (SD | NM_004713.1 | 0 | 0.00% | 1 | 0.01% | 1 | 0.01% | 1 | 0.01% | 3 |
| 1468 | Sid3177 | AB024935.1 | 0 | 0.00% | 0 | 0.00% | 1 | 0.01% | 2 | 0.01% | 3 |
| 1469 | snuportin-1 (KPNBL) | NM_005701.1 | 2 | 0.01% | 0 | 0.00% | 0 | 0.00% | 1 | 0.01% | 3 |
| 1470 | SON DNA binding protein isoform E (SON) mRN | Hs.92909 | 0 | 0.00% | 0 | 0.00% | 1 | 0.01% | 2 | 0.01% | 3 |
| 1471 | split hand/foot deleted gene 1 | NP_033195.1 | 0 | 0.00% | 0 | 0.00% | 1 | 0.01% | 2 | 0.01% | 3 |
| 1472 | ST15 | D50406.1 | 0 | 0.00% | 1 | 0.01% | 2 | 0.02% | 0 | 0.00% | 3 |
| 1473 | SUMO-1 activating enzyme subunit 2 (UBA2) | NM_005499.1 | 0 | 0.00% | 0 | 0.00% | 2 | 0.02% | 1 | 0.01% | 3 |
| 1474 | suppressor of G2 allele | NM_006704.1 | 1 | 0.01% | 0 | 0.00% | 1 | 0.01% | 1 | 0.01% | 3 |
| 1475 | TEB4 protein (=AB011169 KIAA0597) | AF009301 | 0 | 0.00% | 0 | 0.00% | 2 | 0.02% | 1 | 0.01% | 3 |
| 1476 | thiosulfate sulfurtransferase (rhodanese) (TST) | X59434 | 2 | 0.01% | 1 | 0.01% | 0 | 0.00% | 0 | 0.00% | 3 |
| 1477 | TL27 (from PC3 cell line) | X75684 | 2 | 0.01% | 1 | 0.01% | 0 | 0.00% | 0 | 0.00% | 3 |
| 1478 | translocated promoter region (to activated MET ( | NM_003292.1 | 0 | 0.00% | 0 | 0.00% | 3 | 0.02% | 0 | 0.00% | 3 |
| 1479 | WS-3 | D84145.1 | 0 | 0.00% | 1 | 0.01% | 0 | 0.00% | 2 | 0.01% | 3 |

Figure 6 - Unique Known Genes Identified In Four cDNA Cartilage Libraries and EST Frequency Analysis - Page 27 of 102

| | | | | | | | | | | | |
|---|---|---|---|---|---|---|---|---|---|---|---|
| 1480 | WW domain binding protein-1 (ORF) | U79457.17 | 2 | 0.01% | 1 | 0.01% | 0 | 0.00% | 0 | 0.00% | 3 |
| 1481 | XIST | X56196 | 0 | 0.00% | 0 | 0.00% | 2 | 0.02% | 1 | 0.01% | 3 |
| 1482 | annexin A11 (ANXA11 gene) | AJ278465.1 | 0 | 0.00% | 2 | 0.01% | 0 | 0.00% | 1 | 0.01% | 3 |
| 1483 | ATPase, Na /K transporting, beta 3 polypeptide | NM_001679.1 | 0 | 0.00% | 1 | 0.01% | 2 | 0.02% | 0 | 0.00% | 3 |
| 1484 | channel-like integral membrane protein (AQP-1) | U41518.1 | 1 | 0.01% | 1 | 0.01% | 0 | 0.00% | 1 | 0.01% | 3 |
| 1485 | citrin (SLC25A13) | AF118838.1 | 1 | 0.01% | 1 | 0.01% | 1 | 0.01% | 0 | 0.00% | 3 |
| 1486 | X-linked phosphoglycerate kinase | M11968 | 0 | 0.00% | 0 | 0.00% | 0 | 0.00% | 3 | 0.02% | 3 |
| 1487 | aldehyde dehydrogenase 6 (ALDH6) | NM_000693.1 | 0 | 0.00% | 0 | 0.00% | 3 | 0.02% | 0 | 0.00% | 3 |
| 1488 | aldehyde reductase | J04794 | 2 | 0.01% | 0 | 0.00% | 0 | 0.00% | 1 | 0.01% | 3 |
| 1489 | dTDP-D-glucose 4, 6-dehydratase | AJ006068 | 0 | 0.00% | 1 | 0.01% | 2 | 0.02% | 0 | 0.00% | 3 |
| 1490 | platelet-type phosphofructokinase | D25328.1 | 0 | 0.00% | 1 | 0.01% | 0 | 0.00% | 2 | 0.01% | 3 |
| 1491 | MKP-1 like protein tyrosine phosphatase | AF038844 | 0 | 0.00% | 0 | 0.00% | 1 | 0.01% | 2 | 0.01% | 3 |
| 1492 | Gem GTPase (gem) | U10550 | 0 | 0.00% | 0 | 0.00% | 1 | 0.01% | 2 | 0.01% | 3 |
| 1493 | hypoxanthine phosphoribosyltransferase (HPRT | M26434 | 1 | 0.01% | 0 | 0.00% | 2 | 0.02% | 0 | 0.00% | 3 |
| 1494 | plasma cell membrane glycoprotein (PC-1) | M57736.1 | 0 | 0.00% | 0 | 0.00% | 1 | 0.01% | 2 | 0.01% | 3 |
| 1495 | pyrophosphatase | Z48605 | 0 | 0.00% | 0 | 0.00% | 0 | 0.00% | 3 | 0.02% | 3 |
| 1496 | acetyl-Coenzyme A acetyltransferase 2 (acetoac | gi5174388 | 0 | 0.00% | 1 | 0.01% | 0 | 0.00% | 2 | 0.01% | 3 |
| 1497 | acyl-CoA synthetase 4 (ACS4) | AF030555 | 0 | 0.00% | 0 | 0.00% | 1 | 0.01% | 2 | 0.01% | 3 |
| 1498 | acyl-Coenzyme A dehydrogenase, very long cha | NM_000018.1 | 2 | 0.01% | 1 | 0.01% | 0 | 0.00% | 0 | 0.00% | 3 |
| 1499 | L3 pigment (L3) | AF189062.3 | 1 | 0.01% | 1 | 0.01% | 1 | 0.01% | 0 | 0.00% | 3 |
| 1500 | leukotriene A-4 hydrolase | J02959 | 1 | 0.01% | 0 | 0.00% | 0 | 0.00% | 2 | 0.01% | 3 |
| 1501 | cytochrome b5 reductase 1 (B5R.1) (RefSeq aa | NP_057327.1 | 0 | 0.00% | 3 | 0.02% | 0 | 0.00% | 0 | 0.00% | 3 |
| 1502 | NADH-ubiquinone oxidoreductase MNLL subuni | AF050638.1 | 0 | 0.00% | 0 | 0.00% | 1 | 0.01% | 2 | 0.01% | 3 |
| 1503 | ubiquinol-cytochrome c reductase, Rieske iron-s | 5174742 | 1 | 0.01% | 1 | 0.01% | 0 | 0.00% | 1 | 0.01% | 3 |
| 1504 | methylene tetrahydrofolate dehydrogenase (NAD | NM_006636.1 | 1 | 0.01% | 0 | 0.00% | 1 | 0.01% | 1 | 0.01% | 3 |
| 1505 | aspartyl glucosaminidase (AGA) | X55330 | 0 | 0.00% | 1 | 0.01% | 1 | 0.01% | 1 | 0.01% | 3 |
| 1506 | leucine-rich repeat (LRR) protein (P37NB) 37 kD | NM_005824.1 | 0 | 0.00% | 0 | 0.00% | 1 | 0.01% | 2 | 0.01% | 3 |
| 1507 | methionine synthase reductase (MTRR) | AF025794 | 0 | 0.00% | 2 | 0.01% | 1 | 0.01% | 0 | 0.00% | 3 |
| 1508 | osteoblast specific cysteine-rich protein, comple | AB008375 | 0 | 0.00% | 1 | 0.01% | 1 | 0.01% | 1 | 0.01% | 3 |
| 1509 | pyrroline-5-carboxylate reductase 1 (PYCR1) | NM_006907.1 | 1 | 0.01% | 2 | 0.01% | 0 | 0.00% | 0 | 0.00% | 3 |
| 1510 | S-adenosylmethionine decarboxylase 1 (AMD1) | NM_001634.3 | 1 | 0.01% | 2 | 0.01% | 0 | 0.00% | 0 | 0.00% | 3 |
| 1511 | selenophosphate synthetase 2 (SPS2) | U43286 | 1 | 0.01% | 0 | 0.00% | 0 | 0.00% | 2 | 0.01% | 3 |
| 1512 | tryptophan rich basic protein (WRB) (ORF) | NM_004627.1 | 2 | 0.01% | 0 | 0.00% | 0 | 0.00% | 1 | 0.01% | 3 |
| 1513 | glutamic-oxaloacetic transaminase 2, mitochond | NM_002080.1 | 1 | 0.01% | 0 | 0.00% | 1 | 0.01% | 1 | 0.01% | 3 |
| 1514 | eukaryotic translation initiationfactor 4E (RefSeq | NP_001959.1 | 0 | 0.00% | 3 | 0.02% | 0 | 0.00% | 0 | 0.00% | 3 |
| 1515 | GC20 protein (=AF077052 protein translation fac | AF064607 | 1 | 0.01% | 0 | 0.00% | 0 | 0.00% | 2 | 0.01% | 3 |
| 1516 | p80 protein (=M23613.1 nucleophosmin) | D45915.1 | 0 | 0.00% | 1 | 0.01% | 0 | 0.00% | 2 | 0.01% | 3 |
| 1517 | translation initiation factor 3 47 kDa subunit | U94855 | 2 | 0.01% | 0 | 0.00% | 1 | 0.01% | 0 | 0.00% | 3 |
| 1518 | ribosome binding protein 1 (dog 180kD homolog | gi4759055 | 3 | 0.02% | 0 | 0.00% | 0 | 0.00% | 0 | 0.00% | 3 |
| 1519 | stress-associated endoplasmic reticulum protein | NM_014445.1 | 0 | 0.00% | 0 | 0.00% | 0 | 0.00% | 3 | 0.02% | 3 |
| 1520 | aminopeptidase puromycin sensitive (NPEPPS) | NM_006310.1 | 2 | 0.01% | 0 | 0.00% | 1 | 0.01% | 0 | 0.00% | 3 |
| 1521 | beta-migrating plasminogen activator inhibitor I | M14083 | 0 | 0.00% | 0 | 0.00% | 1 | 0.01% | 2 | 0.01% | 3 |
| 1522 | calpain, large polypeptide L2 (CAPN2) mRNA | NM_001748.1 | 0 | 0.00% | 2 | 0.01% | 0 | 0.00% | 1 | 0.01% | 3 |
| 1523 | collagenase inhibitor | M59906 | 2 | 0.01% | 0 | 0.00% | 0 | 0.00% | 1 | 0.01% | 3 |
| 1524 | cysteine-rich heart protein (hCRHP) | U09770.1 | 2 | 0.01% | 0 | 0.00% | 0 | 0.00% | 1 | 0.01% | 3 |
| 1525 | cysteine-rich repeat-containing protein S52 prec | AF167706.1 | 0 | 0.00% | 2 | 0.01% | 0 | 0.00% | 1 | 0.01% | 3 |
| 1526 | matrix metalloprotease(ADAMTS1) mRNA, com | AF207664.1 | 1 | 0.01% | 1 | 0.01% | 0 | 0.00% | 1 | 0.01% | 3 |
| 1527 | nardilysin (N-arginine dibasic convertase) (NRD1 | NM_002525.1 | 2 | 0.01% | 0 | 0.00% | 0 | 0.00% | 1 | 0.01% | 3 |
| 1528 | procollagen, type XI, alpha 1 (Col11a1) | NM_007729.1 | 2 | 0.01% | 0 | 0.00% | 1 | 0.01% | 0 | 0.00% | 3 |
| 1529 | protease inhibitor 12 (neuroserpin) (PI12) | NM_005025.1 | 0 | 0.00% | 1 | 0.01% | 2 | 0.02% | 0 | 0.00% | 3 |
| 1530 | proteasome (prosome, macropain) subunit, alph | NM_002790.1 | 0 | 0.00% | 0 | 0.00% | 0 | 0.00% | 3 | 0.02% | 3 |
| 1531 | proteasome (prosome, macropain) subunit, alph | NM_002792.1 | 0 | 0.00% | 2 | 0.01% | 0 | 0.00% | 1 | 0.01% | 3 |
| 1532 | PROTEASOME COMPONENT C9 (MACROPAI | spP25789 | 0 | 0.00% | 0 | 0.00% | 0 | 0.00% | 3 | 0.02% | 3 |
| 1533 | proteasome subunit X (=X95586 MB1) | D29011 | 0 | 0.00% | 0 | 0.00% | 1 | 0.01% | 2 | 0.01% | 3 |
| 1534 | proteinx0008 (AD013) | NM_013395.1 | 0 | 0.00% | 1 | 0.01% | 1 | 0.01% | 1 | 0.01% | 3 |
| 1535 | sorting nexin 1 (SNX1) | NM_003099.1 | 1 | 0.01% | 2 | 0.01% | 0 | 0.00% | 0 | 0.00% | 3 |
| 1536 | chaperonin containing TCP1, subunit 2 (beta) (C | NM_006431.1 | 0 | 0.00% | 2 | 0.01% | 0 | 0.00% | 1 | 0.01% | 3 |

Figure 6 - Unique Known Genes Identified In Four cDNA Cartilage Libraries and EST Frequency Analysis - Page 28 of 102

| | | | | | | | | | | | |
|---|---|---|---|---|---|---|---|---|---|---|---|
| 1537 | farnesyl diphosphate synthase (farnesyl pyrophc | NM_002004.1 | 2 | 0.01% | 0 | 0.00% | 0 | 0.00% | 1 | 0.01% | 3 |
| 1538 | huntingtin interacting protein 2 (HIP2) | NM_005339.1 | 0 | 0.00% | 2 | 0.01% | 0 | 0.00% | 1 | 0.01% | 3 |
| 1539 | karyopherin alpha 2 (RAG cohort 1, importin alpl | NM_002266.1 | 3 | 0.02% | 0 | 0.00% | 0 | 0.00% | 0 | 0.00% | 3 |
| 1540 | nuclear localization signal deleted in velocardiof | NM_003776.1 | 0 | 0.00% | 1 | 0.01% | 2 | 0.02% | 0 | 0.00% | 3 |
| 1541 | signal recognition particle (SRP), 19kD protein | X12791 | 0 | 0.00% | 2 | 0.01% | 1 | 0.01% | 0 | 0.00% | 3 |
| 1542 | TRAM-like protein (KIAA0057), mRNA | NM_012288.1 | 1 | 0.01% | 2 | 0.01% | 0 | 0.00% | 0 | 0.00% | 3 |
| 1543 | ubiquitin-activating enzyme E1C (homologous tc | gi4507764 | 0 | 0.00% | 1 | 0.01% | 1 | 0.01% | 1 | 0.01% | 3 |
| 1544 | AE-binding protein 1, AEBP1 | D86479 | 0 | 0.00% | 0 | 0.00% | 0 | 0.00% | 3 | 0.02% | 3 |
| 1545 | alternative splicing factor | M72709.1 | 0 | 0.00% | 1 | 0.01% | 0 | 0.00% | 2 | 0.01% | 3 |
| 1546 | amplified in osteosarcoma (OS-9) | NM_006812.1 | 3 | 0.02% | 0 | 0.00% | 0 | 0.00% | 0 | 0.00% | 3 |
| 1547 | bromodomain-containing 2 (BRD2)= KIAA9001 | NM_005104.1 | 1 | 0.01% | 2 | 0.01% | 0 | 0.00% | 0 | 0.00% | 3 |
| 1548 | CCAAT-box-binding transcription factor (CBF2) | NM_005760.1 | 0 | 0.00% | 1 | 0.01% | 1 | 0.01% | 1 | 0.01% | 3 |
| 1549 | c-Cbl-interacting protein (CIN85) | AF230904.1 | 0 | 0.00% | 1 | 0.01% | 1 | 0.01% | 1 | 0.01% | 3 |
| 1550 | c-myc transcription factor (puf) = M36981(ORF) | L16785.1 | 0 | 0.00% | 1 | 0.01% | 0 | 0.00% | 2 | 0.01% | 3 |
| 1551 | FUSE binding protein 3 (FBP3) | U69127.1 | 0 | 0.00% | 0 | 0.00% | 1 | 0.01% | 2 | 0.01% | 3 |
| 1552 | GA-binding protein transcription factor, beta sub | NM_016654.1 | 0 | 0.00% | 1 | 0.01% | 1 | 0.01% | 1 | 0.01% | 3 |
| 1553 | helix-loop-helix basic phosphoprotein (G0S8) | L13391 | 0 | 0.00% | 0 | 0.00% | 0 | 0.00% | 3 | 0.02% | 3 |
| 1554 | myocyte-specific enhancer factor 2A (MEF2A) | U49020 | 1 | 0.01% | 1 | 0.01% | 0 | 0.00% | 1 | 0.01% | 3 |
| 1555 | retinoblastoma-associated protein RAP140 (=KI | AAD55098.1 | 0 | 0.00% | 2 | 0.01% | 0 | 0.00% | 1 | 0.01% | 3 |
| 1556 | retinoblastoma-binding protein 4 (RBBP4) =X74 | NM_005610.1 | 1 | 0.01% | 1 | 0.01% | 0 | 0.00% | 1 | 0.01% | 3 |
| 1557 | ring finger protein 11 (RNF11) | NM_014372.1 | 0 | 0.00% | 2 | 0.01% | 1 | 0.01% | 0 | 0.00% | 3 |
| 1558 | ring finger protein 14 (RNF14) (=HFB30) | NM_004290.1 | 0 | 0.00% | 0 | 0.00% | 0 | 0.00% | 3 | 0.02% | 3 |
| 1559 | T-box transCRiption factor (Tbx15) | AF041822 | 1 | 0.01% | 1 | 0.01% | 0 | 0.00% | 1 | 0.01% | 3 |
| 1560 | thyroid hormone receptor interactor 11 (TRIP11) | NM_004239.1 | 0 | 0.00% | 1 | 0.01% | 0 | 0.00% | 2 | 0.01% | 3 |
| 1561 | thyroid receptor interactor (TRIP3) | L40410.1 | 1 | 0.01% | 0 | 0.00% | 1 | 0.01% | 1 | 0.01% | 3 |
| 1562 | transCRiptional activation factor TAFII32 (=AF1 | U21858 | 0 | 0.00% | 0 | 0.00% | 1 | 0.01% | 2 | 0.01% | 3 |
| 1563 | transducin (beta) like 2 (TBL2) | NM_012453.1 | 2 | 0.01% | 1 | 0.01% | 0 | 0.00% | 0 | 0.00% | 3 |
| 1564 | Y-linked zinc finger protein (ZFY) gene (=DKFZ | AF114156.1 | 1 | 0.01% | 1 | 0.01% | 0 | 0.00% | 1 | 0.01% | 3 |
| 1565 | ZINC FINGER PROTEIN 135 | spP52742 | 2 | 0.01% | 0 | 0.00% | 0 | 0.00% | 1 | 0.01% | 3 |
| 1566 | ZNF01 and HUMORFKG1B genes, partial seque | AF205588.1 | 0 | 0.00% | 1 | 0.01% | 1 | 0.01% | 1 | 0.01% | 3 |
| 1567 | nCL1 gene | X85032.1 | 0 | 0.00% | 0 | 0.00% | 2 | 0.02% | 1 | 0.01% | 3 |
| 1568 | endoplasmic reticulum lumenal Ca2 binding pro | AF216292.1 | 1 | 0.01% | 0 | 0.00% | 1 | 0.01% | 1 | 0.01% | 3 |
| 1569 | hnRNP-E2 (poly(rC)-binding protein 2 (PCBP2)) | X78136 | 2 | 0.01% | 0 | 0.00% | 1 | 0.01% | 0 | 0.00% | 3 |
| 1570 | leukophysin (LKP) = NM_001357.1 DEAD/H box | U03643.1 | 0 | 0.00% | 1 | 0.01% | 1 | 0.01% | 1 | 0.01% | 3 |
| 1571 | polyadenylate binding protein(TIA-1) | M77142 | 1 | 0.01% | 1 | 0.01% | 1 | 0.01% | 0 | 0.00% | 3 |
| 1572 | PR264 | X75755 | 0 | 0.00% | 2 | 0.01% | 0 | 0.00% | 1 | 0.01% | 3 |
| 1573 | seryl-tRNA synthetase (SARS) | NM_006513.1 | 1 | 0.01% | 0 | 0.00% | 0 | 0.00% | 2 | 0.01% | 3 |
| 1574 | small nuclear ribonucleoprotein D1 polypeptide ( | NM_006938.1 | 0 | 0.00% | 0 | 0.00% | 2 | 0.02% | 1 | 0.01% | 3 |
| 1575 | small nuclear ribonucleoprotein polypeptide F (S | NM_003095.1 | 2 | 0.01% | 1 | 0.01% | 0 | 0.00% | 0 | 0.00% | 3 |
| 1576 | splicing factor 3b, subunit 1, 155kD (SF3B1) | NM_012433.1 | 0 | 0.00% | 2 | 0.01% | 0 | 0.00% | 1 | 0.01% | 3 |
| 1577 | splicing factor, arginine/serine-rich 9 (SFRS9) | NM_003769.1 | 3 | 0.02% | 0 | 0.00% | 0 | 0.00% | 0 | 0.00% | 3 |
| 1578 | breast cancer-associated gene 1 protein (BCG1 | AF126181.1 | 3 | 0.02% | 0 | 0.00% | 0 | 0.00% | 0 | 0.00% | 3 |
| 1579 | cartilage-associated protein (CASP) | AJ006470 | 3 | 0.02% | 0 | 0.00% | 0 | 0.00% | 0 | 0.00% | 3 |
| 1580 | DC2 (DC2) | AF201937.1 | 0 | 0.00% | 3 | 0.02% | 0 | 0.00% | 0 | 0.00% | 3 |
| 1581 | T-cell gamma receptor locus | AF159056.1 | 0 | 0.00% | 2 | 0.01% | 0 | 0.00% | 1 | 0.01% | 3 |
| 1582 | 28 kDa heat shock protein | Z23090.1 | 1 | 0.01% | 0 | 0.00% | 0 | 0.00% | 2 | 0.01% | 3 |
| 1583 | ALEX1 protein (LOC51309) | NM_016608.1 | 0 | 0.00% | 0 | 0.00% | 2 | 0.02% | 1 | 0.01% | 3 |
| 1584 | LIM and senescent cell antigen-like domains 1 ( | NM_004987.1 | 0 | 0.00% | 1 | 0.01% | 0 | 0.00% | 2 | 0.01% | 3 |
| 1585 | coatomer protein complex, subunit alpha (COPA | NM_004371.2 | 2 | 0.01% | 1 | 0.01% | 0 | 0.00% | 0 | 0.00% | 3 |
| 1586 | endoglin (Osler-Rendu-Weber syndrome 1) (EN | NM_000118.1 | 3 | 0.02% | 0 | 0.00% | 0 | 0.00% | 0 | 0.00% | 3 |
| 1587 | tetraspanin TM4-A | AF133423.1 | 1 | 0.01% | 1 | 0.01% | 1 | 0.01% | 0 | 0.00% | 3 |
| 1588 | ERCC5 excision repair protein | L20046 | 0 | 0.00% | 0 | 0.00% | 3 | 0.02% | 0 | 0.00% | 3 |
| 1589 | MHC class II lymphocyte antigen beta-chain (HL | M28202.1 | 0 | 0.00% | 0 | 0.00% | 2 | 0.02% | 1 | 0.01% | 3 |
| 1590 | thioredoxin-like (TXNL2) | gi5730103 | 0 | 0.00% | 1 | 0.01% | 2 | 0.02% | 0 | 0.00% | 3 |
| 1591 | Apg12 | BAA36493.1 | 0 | 0.00% | 1 | 0.01% | 0 | 0.00% | 2 | 0.01% | 3 |
| 1592 | calponin 3, acidic (CNN3) | NM_001839.1 | 1 | 0.01% | 1 | 0.01% | 0 | 0.00% | 1 | 0.01% | 3 |
| 1593 | capping protein (actin filament) muscle Z-line, al | NM_006135.1 | 0 | 0.00% | 2 | 0.01% | 1 | 0.01% | 0 | 0.00% | 3 |

Figure 6 - Unique Known Genes Identified In Four cDNA Cartilage Libraries and EST Frequency Analysis - Page 29 of 102

| | | | | | | | | | | | |
|---|---|---|---|---|---|---|---|---|---|---|---|
| 1594 | CGI-101 protein (LOC51009) | NM_016041.1 | 3 | 0.02% | 0 | 0.00% | 0 | 0.00% | 0 | 0.00% | 3 |
| 1595 | CGI-114 protein (=DKFZp566E144) | AF151872.1 | 0 | 0.00% | 0 | 0.00% | 1 | 0.01% | 2 | 0.01% | 3 |
| 1596 | CGI-123 protein | AF151881.1 | 0 | 0.00% | 0 | 0.00% | 1 | 0.01% | 2 | 0.01% | 3 |
| 1597 | CGI-129 protein | AF151887.1 | 1 | 0.01% | 0 | 0.00% | 1 | 0.01% | 1 | 0.01% | 3 |
| 1598 | CGI-142 protein | AF151900.1 | 0 | 0.00% | 1 | 0.01% | 0 | 0.00% | 2 | 0.01% | 3 |
| 1599 | CGI-151 protein (RefSeq aa 6e-51) | NP_057165.1 | 0 | 0.00% | 1 | 0.01% | 0 | 0.00% | 0 | 0.00% | 3 |
| 1600 | CGI-24 protein | AF132958.1 | 0 | 0.00% | 0 | 0.00% | 1 | 0.01% | 2 | 0.01% | 3 |
| 1601 | CGI-29 protein | AF132963.1 | 0 | 0.00% | 1 | 0.01% | 0 | 0.00% | 2 | 0.01% | 3 |
| 1602 | CGI-86 protein (LOC51635) | NM_016029.1 | 0 | 0.00% | 1 | 0.01% | 1 | 0.01% | 1 | 0.01% | 3 |
| 1603 | cytoplasmic dynein intermediate chain 1 | AF123074 | 0 | 0.00% | 1 | 0.01% | 2 | 0.02% | 0 | 0.00% | 3 |
| 1604 | FRA3B common fragile region, diadenosine tripl | AF020503.1 | 0 | 0.00% | 1 | 0.01% | 2 | 0.02% | 0 | 0.00% | 3 |
| 1605 | LIC-2 dynein light intermediate chain 53/55 | U15138.1 | 1 | 0.01% | 0 | 0.00% | 1 | 0.01% | 1 | 0.01% | 3 |
| 1606 | sorcin (SRI) | L12387.1 | 2 | 0.01% | 1 | 0.01% | 0 | 0.00% | 0 | 0.00% | 3 |
| 1607 | collagen type IV alpha 1(COL4A1) | M26576 | 1 | 0.01% | 0 | 0.00% | 2 | 0.02% | 0 | 0.00% | 3 |
| 1608 | fibrinogen-like 2 precursor;fibroleukin (RefSeq aa | NP_006673.1 | 0 | 0.00% | 3 | 0.02% | 0 | 0.00% | 0 | 0.00% | 3 |
| 1609 | glypican 1 (GPC1) | NM_002081.1 | 3 | 0.02% | 0 | 0.00% | 0 | 0.00% | 0 | 0.00% | 3 |
| 1610 | glypican 4 (GPC4) | NM_001448.1 | 0 | 0.00% | 2 | 0.01% | 0 | 0.00% | 1 | 0.01% | 3 |
| 1611 | laminin, beta 2 (laminin S)(LAMB2) mRNA | NM_002292.1 | 1 | 0.01% | 2 | 0.01% | 0 | 0.00% | 0 | 0.00% | 3 |
| 1612 | sarcospan (Sspn) | AF120276.1 | 0 | 0.00% | 2 | 0.01% | 1 | 0.01% | 0 | 0.00% | 3 |
| 1613 | AHNAK nucleoprotein | M80902.1 | 0 | 0.00% | 1 | 0.01% | 2 | 0.02% | 0 | 0.00% | 3 |
| 1614 | capping protein (actin filament), gelsolin-like (CA | M94345 | 2 | 0.01% | 1 | 0.01% | 0 | 0.00% | 0 | 0.00% | 3 |
| 1615 | crystallin, zeta (quinone reductase) (CRYZ) | NM_001889.1 | 1 | 0.01% | 0 | 0.00% | 0 | 0.00% | 2 | 0.01% | 3 |
| 1616 | dystrophin (DMD) | M18533 | 0 | 0.00% | 1 | 0.01% | 2 | 0.02% | 0 | 0.00% | 3 |
| 1617 | keratin 10 (epidermolytic hyperkeratosis; keratos | NM_000421.1 | 2 | 0.01% | 0 | 0.00% | 1 | 0.01% | 0 | 0.00% | 3 |
| 1618 | protein 4.1-G, erythrocyte membrane protein (clo | AF054999 | 1 | 0.01% | 0 | 0.00% | 1 | 0.01% | 1 | 0.01% | 3 |
| 1619 | myosin phosphatase target subunit 1 (MYPT1) | D87930.1 | 0 | 0.00% | 1 | 0.01% | 0 | 0.00% | 2 | 0.01% | 3 |
| 1620 | non-muscle alpha-actinin | U48734.1 | 3 | 0.02% | 0 | 0.00% | 0 | 0.00% | 0 | 0.00% | 3 |
| 1621 | nonmuscle myosin heavy chain (NMHC) | M31013 | 1 | 0.01% | 1 | 0.01% | 1 | 0.01% | 0 | 0.00% | 3 |
| 1622 | tropomodulin (TMOD) | M77016 | 0 | 0.00% | 1 | 0.01% | 1 | 0.01% | 1 | 0.01% | 3 |
| 1623 | nuclear pore complex protein hnup153 | Z25535 | 0 | 0.00% | 0 | 0.00% | 1 | 0.01% | 2 | 0.01% | 3 |
| 1624 | TIP120 (=AB020636 KIAA0829) | D87671 | 0 | 0.00% | 1 | 0.01% | 1 | 0.01% | 1 | 0.01% | 3 |
| 1625 | angiotensin receptor-like 2 (AGTRL2), mRNA | NM_005162.2 | 3 | 0.02% | 0 | 0.00% | 0 | 0.00% | 0 | 0.00% | 3 |
| 1626 | B4-2 protein | U03105.1 | 1 | 0.01% | 0 | 0.00% | 0 | 0.00% | 2 | 0.01% | 3 |
| 1627 | diazepam binding inhibitor (GABA receptor modu | Hs.78888 | 0 | 0.00% | 2 | 0.01% | 0 | 0.00% | 1 | 0.01% | 3 |
| 1628 | glucocorticoid receptor (GRL) gene | U80947.1 | 1 | 0.01% | 1 | 0.01% | 0 | 0.00% | 1 | 0.01% | 3 |
| 1629 | glutamate dehydrogenase 1 (GLUD1) | NM_005271.1 | 1 | 0.01% | 2 | 0.01% | 0 | 0.00% | 0 | 0.00% | 3 |
| 1630 | HindIII K4L ORF (HU-K4) | NM_012268.1 | 3 | 0.02% | 0 | 0.00% | 0 | 0.00% | 0 | 0.00% | 3 |
| 1631 | inositol 1,4,5-triphosphate receptor, type 3 (ITPR | U01062 | 2 | 0.01% | 1 | 0.01% | 0 | 0.00% | 0 | 0.00% | 3 |
| 1632 | insulin receptor substrate-2 (IRS2) | AF073310 | 0 | 0.00% | 2 | 0.01% | 1 | 0.01% | 0 | 0.00% | 3 |
| 1633 | interleukin 11 receptor, alpha (IL11RA) | NM_004512.1 | 2 | 0.01% | 1 | 0.01% | 0 | 0.00% | 0 | 0.00% | 3 |
| 1634 | leptin receptor gene-related protein (HSOBRGR | NM_017526.1 | 1 | 0.01% | 2 | 0.01% | 0 | 0.00% | 0 | 0.00% | 3 |
| 1635 | multiple membrane spanning receptor TRC8 (TR | AF064801.1 | 0 | 0.00% | 1 | 0.01% | 0 | 0.00% | 2 | 0.01% | 3 |
| 1636 | orphan G protein-coupled receptor (RDC1) | U67784 | 0 | 0.00% | 1 | 0.01% | 1 | 0.01% | 1 | 0.01% | 3 |
| 1637 | regulator of G-protein signalling 2, 24kD (RGS2) | NM_002923.1 | 0 | 0.00% | 1 | 0.01% | 0 | 0.00% | 2 | 0.01% | 3 |
| 1638 | regulator of G-protein signalling 5 (RGS5) | AF159570.1 | 0 | 0.00% | 2 | 0.01% | 1 | 0.01% | 0 | 0.00% | 3 |
| 1639 | retinoic acid repressible protein (RARG-1) | AF172066.1 | 0 | 0.00% | 1 | 0.01% | 0 | 0.00% | 2 | 0.01% | 3 |
| 1640 | SGRF | AB030001.1 | 2 | 0.01% | 0 | 0.00% | 0 | 0.00% | 1 | 0.01% | 3 |
| 1641 | transforming growth factor, beta receptor III (beta | NM_003243.1 | 0 | 0.00% | 3 | 0.02% | 0 | 0.00% | 0 | 0.00% | 3 |
| 1642 | 14-3-3 gamma | AB024334.1 | 0 | 0.00% | 3 | 0.02% | 0 | 0.00% | 0 | 0.00% | 3 |
| 1643 | cAMP-dependent protein kinase subunit RII-beta | M31158 | 0 | 0.00% | 0 | 0.00% | 2 | 0.02% | 1 | 0.01% | 3 |
| 1644 | CDC-like kinase (CLK) | NM_004071.1 | 1 | 0.01% | 1 | 0.01% | 0 | 0.00% | 1 | 0.01% | 3 |
| 1645 | mitogen-activated protein kinase 14 (MAPK14) | 4503068 | 0 | 0.00% | 1 | 0.01% | 1 | 0.01% | 1 | 0.01% | 3 |
| 1646 | protein kinase, cAMP-dependent, regulatory, typ | NM_002734.1 | 0 | 0.00% | 0 | 0.00% | 2 | 0.02% | 1 | 0.01% | 3 |
| 1647 | Ser/Arg-related nuclear matrix protein (plenty of | NM_005839.1 | 1 | 0.01% | 2 | 0.01% | 0 | 0.00% | 0 | 0.00% | 3 |
| 1648 | serum-inducible kinase (SNK) | AF223574.1 | 1 | 0.01% | 2 | 0.01% | 0 | 0.00% | 0 | 0.00% | 3 |
| 1649 | tyrosylprotein sulfotransferase-1(TPST1) | AF038009 | 1 | 0.01% | 1 | 0.01% | 1 | 0.01% | 0 | 0.00% | 3 |
| 1650 | GTPase-activating protein ras p21 (RASA) | M23379 | 1 | 0.01% | 1 | 0.01% | 1 | 0.01% | 0 | 0.00% | 3 |

Figure 6 - Unique Known Genes Identified In Four cDNA Cartilage Libraries and EST Frequency Analysis - Page 30 of 102

| | | | | | | | | | | | |
|---|---|---|---|---|---|---|---|---|---|---|---|
| 1651 | rab11a GTPase | AF000231 | 0 | 0.00% | 0 | 0.00% | 2 | 0.02% | 1 | 0.01% | 3 |
| 1652 | rab3 GTPase-activating protein, non-catalytic su | NM_012414.1 | 0 | 0.00% | 0 | 0.00% | 2 | 0.02% | 1 | 0.01% | 3 |
| 1653 | ralA binding protein 1 (RALBP1) | NM_006788.1 | 0 | 0.00% | 1 | 0.01% | 1 | 0.01% | 1 | 0.01% | 3 |
| 1654 | ras-related YPT1 protein (ORF) | P11476 | 0 | 0.00% | 0 | 0.00% | 1 | 0.01% | 2 | 0.01% | 3 |
| 1655 | signal transduction protein (SH3 containing) (EF | gi5031680 | 0 | 0.00% | 2 | 0.01% | 1 | 0.01% | 0 | 0.00% | 3 |
| 1656 | CC chemokine gene cluster | AF088219.1 | 1 | 0.01% | 1 | 0.01% | 1 | 0.01% | 0 | 0.00% | 3 |
| 1657 | EGR1 gene for early growth response protein 1 ( | AJ243425.1 | 2 | 0.01% | 1 | 0.01% | 0 | 0.00% | 0 | 0.00% | 3 |
| 1658 | growth differentiation factor 10 (GDF10) =D4949 | NM_004962.1 | 0 | 0.00% | 0 | 0.00% | 3 | 0.02% | 0 | 0.00% | 3 |
| 1659 | quiescin Q6 (QSCN6)(= bone-derived growth fac | NM_002826.1 | 1 | 0.01% | 2 | 0.01% | 0 | 0.00% | 0 | 0.00% | 3 |
| 1660 | SDF2 | D50645 | 1 | 0.01% | 0 | 0.00% | 2 | 0.02% | 0 | 0.00% | 3 |
| 1661 | seCRetory growth factor-like protein fallotein | AF091434.1 | 0 | 0.00% | 0 | 0.00% | 0 | 0.00% | 3 | 0.02% | 3 |
| 1662 | uncharacterized bone marrow protein BM036 (B | NM_018453.1 | 0 | 0.00% | 2 | 0.01% | 0 | 0.00% | 1 | 0.01% | 3 |
| 1663 | WNT1 inducible signaling pathway protein 3 (Re | NP_003871.1 | 0 | 0.00% | 3 | 0.02% | 0 | 0.00% | 0 | 0.00% | 3 |
| 1664 | ADP-ribosylation factor-like 2 (ARL2) | NM_001667.1 | 3 | 0.02% | 0 | 0.00% | 0 | 0.00% | 0 | 0.00% | 3 |
| 1665 | ARP2 (actin-related protein 2, yeast) homolog (A | NM_005722.1 | 1 | 0.01% | 1 | 0.01% | 0 | 0.00% | 1 | 0.01% | 3 |
| 1666 | beta-catenin | X87838 | 2 | 0.01% | 0 | 0.00% | 0 | 0.00% | 1 | 0.01% | 3 |
| 1667 | Ca2-activated neutral protease large subunit (CA | M23254.1 | 0 | 0.00% | 0 | 0.00% | 2 | 0.02% | 1 | 0.01% | 3 |
| 1668 | calcium/calmodulin-dependent serine protein kin | NM_003688.1 | 0 | 0.00% | 1 | 0.01% | 2 | 0.02% | 0 | 0.00% | 3 |
| 1669 | hHDC for homolog of Drosophila headcase (LOC | NM_016217.1 | 0 | 0.00% | 1 | 0.01% | 0 | 0.00% | 2 | 0.01% | 3 |
| 1670 | MAX-interacting protein 1 (MXI1) | NM_005962.1 | 0 | 0.00% | 2 | 0.01% | 1 | 0.01% | 0 | 0.00% | 3 |
| 1671 | Opa-interacting protein OIP2 | AF025438 | 0 | 0.00% | 0 | 0.00% | 1 | 0.01% | 2 | 0.01% | 3 |
| 1672 | Sprouty 2 (SPRY2) | AF039843 | 0 | 0.00% | 2 | 0.01% | 1 | 0.01% | 0 | 0.00% | 3 |
| 1673 | POM121 membrane glycoprotein (rat homolog)-( | Hs.8198 | 0 | 0.00% | 0 | 0.00% | 0 | 0.00% | 3 | 0.02% | 3 |
| 1674 | voltage-dependent anion channel 2 (VDAC2), nu | NM_003375.1 | 0 | 0.00% | 1 | 0.01% | 2 | 0.02% | 0 | 0.00% | 3 |
| 1675 | alpha-parvin (PARVA) | AF237771.1 | 0 | 0.00% | 3 | 0.02% | 0 | 0.00% | 0 | 0.00% | 3 |
| 1676 | claudin-12 gene (CLDN12) | AJ250713.1 | 0 | 0.00% | 2 | 0.01% | 1 | 0.01% | 0 | 0.00% | 3 |
| 1677 | C-type lectin | BAA95671.1 | 0 | 0.00% | 1 | 0.01% | 1 | 0.01% | 1 | 0.01% | 3 |
| 1678 | integrin, alpha subunit 1(ORF) | X68742 | 0 | 0.00% | 2 | 0.01% | 0 | 0.00% | 1 | 0.01% | 3 |
| 1679 | integrin-linked kinase (ILK) | U40282 | 3 | 0.02% | 0 | 0.00% | 0 | 0.00% | 0 | 0.00% | 3 |
| 1680 | podocalyxin-like (PODXL) | NM_005397.1 | 1 | 0.01% | 0 | 0.00% | 2 | 0.02% | 0 | 0.00% | 3 |
| 1681 | syntaxin 7 | U77942 | 0 | 0.00% | 1 | 0.01% | 2 | 0.02% | 0 | 0.00% | 3 |
| 1682 | DNA dependent ATPase and helicase (ATRX) | U72938.2 | 0 | 0.00% | 2 | 0.01% | 0 | 0.00% | 1 | 0.01% | 3 |
| 1683 | histone H1 (0) | X03473 | 3 | 0.02% | 0 | 0.00% | 0 | 0.00% | 0 | 0.00% | 3 |
| 1684 | histone H2A.Z= M37583 | X52317 | 0 | 0.00% | 0 | 0.00% | 2 | 0.02% | 1 | 0.01% | 3 |
| 1685 | histone H2B | AJ223352 | 3 | 0.02% | 0 | 0.00% | 0 | 0.00% | 0 | 0.00% | 3 |
| 1686 | non-histone chromosomal protein HMG-14 | M21339.1 | 1 | 0.01% | 0 | 0.00% | 1 | 0.01% | 1 | 0.01% | 3 |
| 1687 | cdk inhibitor p21 binding protein (TOK-1),(ORF)= | NM_016567.1 | 1 | 0.01% | 1 | 0.01% | 0 | 0.00% | 1 | 0.01% | 3 |
| 1688 | cyclin L ania-6a (RefSeq aa 1e-66) | NP_064703.1 | 0 | 0.00% | 3 | 0.02% | 0 | 0.00% | 0 | 0.00% | 3 |
| 1689 | GTP-binding protein (HSR1) | L25665 | 3 | 0.02% | 0 | 0.00% | 0 | 0.00% | 0 | 0.00% | 3 |
| 1690 | GTP-binding protein(=KIAA0741) | AJ006412 | 0 | 0.00% | 1 | 0.01% | 0 | 0.00% | 2 | 0.01% | 3 |
| 1691 | caspase 4, apoptosis-related cysteine protease ( | NM_001225.1 | 0 | 0.00% | 2 | 0.01% | 0 | 0.00% | 1 | 0.01% | 3 |
| 1692 | inhibitor of apoptosis protein 2 | U45879 | 0 | 0.00% | 0 | 0.00% | 2 | 0.02% | 1 | 0.01% | 3 |
| 1693 | polymerase (RNA) II (DNA directed) polypeptide | NM_005034.1 | 0 | 0.00% | 3 | 0.02% | 0 | 0.00% | 0 | 0.00% | 3 |
| 1694 | inhibin, beta A (activin A, activin AB alpha polype | NM_002192.1 | 0 | 0.00% | 0 | 0.00% | 0 | 0.00% | 3 | 0.02% | 3 |
| 1695 | NCK adaptor protein 1(NCK1)=X17576 melanom | NM_006153.1 | 0 | 0.00% | 1 | 0.01% | 1 | 0.01% | 1 | 0.01% | 3 |
| 1696 | tumor suppressing subtransferable candidate 4 ( | 5032204 | 3 | 0.02% | 0 | 0.00% | 0 | 0.00% | 0 | 0.00% | 3 |
| 1697 | ASCL3; CEGP1; C11orf14, C11orf15, C11orf16 | AJ400877.1 | 2 | 0.01% | 0 | 0.00% | 1 | 0.01% | 0 | 0.00% | 3 |
| 1698 | brain cDNA, clone:QnpA-18828 | AB049881.1 | 0 | 0.00% | 3 | 0.02% | 0 | 0.00% | 0 | 0.00% | 3 |
| 1699 | brain-specific STE20-like protein kinase 3 (STK3 | AF083420.1 | 1 | 0.01% | 2 | 0.01% | 0 | 0.00% | 0 | 0.00% | 3 |
| 1700 | DD6A4-1 | AF034237 | 0 | 0.00% | 0 | 0.00% | 0 | 0.00% | 3 | 0.02% | 3 |
| 1701 | expressed only in placental villi, clone SMAP47 | AB019564 | 0 | 0.00% | 0 | 0.00% | 3 | 0.02% | 0 | 0.00% | 3 |
| 1702 | hypothetical gene supported by M29548; X0355( | XM_059967.1 | 2 | 0.01% | 0 | 0.00% | 1 | 0.01% | 0 | 0.00% | 3 |
| 1703 | hypothetical protein (RefSeq aa 4e-65) | NP_055701.1 | 0 | 0.00% | 3 | 0.02% | 0 | 0.00% | 0 | 0.00% | 3 |
| 1704 | KIAA0160 | D63881 | 1 | 0.01% | 1 | 0.01% | 0 | 0.00% | 1 | 0.01% | 3 |
| 1705 | KIAA0594 | AB011166 | 0 | 0.00% | 0 | 0.00% | 2 | 0.02% | 1 | 0.01% | 3 |
| 1706 | KIAA1128 protein, partial cds | AB032954.1 | 0 | 0.00% | 2 | 0.01% | 0 | 0.00% | 1 | 0.01% | 3 |
| 1707 | PCTAIRE2 | AB005540 | 0 | 0.00% | 0 | 0.00% | 0 | 0.00% | 3 | 0.02% | 3 |

Figure 6 - Unique Known Genes Identified In Four cDNA Cartilage Libraries and EST Frequency Analysis - Page 31 of 102

| | | | | | | | | | | | |
|---|---|---|---|---|---|---|---|---|---|---|---|
| 1708 | PRO0989 | AF116614 | 1 | 0.01% | 1 | 0.01% | 1 | 0.01% | 0 | 0.00% | 3 |
| 1709 | PRO2221 (RefSeq aa 1e-34) | NP_061094.1 | 0 | 0.00% | 2 | 0.01% | 1 | 0.01% | 0 | 0.00% | 3 |
| 1710 | putative breast adenocarcinoma marker (32kD) ( | Hs.12107 | 0 | 0.00% | 1 | 0.01% | 0 | 0.00% | 2 | 0.01% | 3 |
| 1711 | transposon-like element | M23161 | 1 | 0.01% | 1 | 0.01% | 1 | 0.01% | 0 | 0.00% | 3 |
| 1712 | WSB1 isoform 2 (WSB1) | AF240696.1 | 1 | 0.01% | 1 | 0.01% | 0 | 0.00% | 1 | 0.01% | 3 |
| 1713 | ATP cassette binding transporter 1 (ABC1) | AF165281.1 | 0 | 0.00% | 2 | 0.01% | 1 | 0.01% | 0 | 0.00% | 3 |
| 1714 | beta-1,4-galactosyltransferase (=D38551 hypoth | D37790 | 2 | 0.01% | 0 | 0.00% | 0 | 0.00% | 1 | 0.01% | 3 |
| 1715 | UDP-N-acetyl-alpha-D-galactosamine:polypeptid | NM_004481.1 | 1 | 0.01% | 1 | 0.01% | 0 | 0.00% | 1 | 0.01% | 3 |
| 1716 | long-chain acyl-CoA synthetase | D10040 | 0 | 0.00% | 0 | 0.00% | 3 | 0.02% | 0 | 0.00% | 3 |
| 1717 | cytochrome b-245, beta polypeptide (chronic gra | NM_000397.2 | 0 | 0.00% | 2 | 0.01% | 1 | 0.01% | 0 | 0.00% | 3 |
| 1718 | eukaryotic translation initiation factor 3, subunit 2 | gi4503512 | 2 | 0.01% | 0 | 0.00% | 0 | 0.00% | 1 | 0.01% | 3 |
| 1719 | Sec31 protein | AF139184.1 | 1 | 0.01% | 2 | 0.01% | 0 | 0.00% | 0 | 0.00% | 3 |
| 1720 | DNA-binding protein (CROC-1B) | U39361 | 1 | 0.01% | 0 | 0.00% | 0 | 0.00% | 2 | 0.01% | 3 |
| 1721 | ring finger protein 13 (RNF13), mRNA /cds=(151 | Hs.6900 | 0 | 0.00% | 0 | 0.00% | 2 | 0.02% | 1 | 0.01% | 3 |
| 1722 | SPR-2 mRNA for GT box binding protein | X68560.1 | 0 | 0.00% | 0 | 0.00% | 0 | 0.00% | 3 | 0.02% | 3 |
| 1723 | T-box 15 (Tbx15) | NM_009323.1 | 0 | 0.00% | 3 | 0.02% | 0 | 0.00% | 0 | 0.00% | 3 |
| 1724 | zinc finger protein 207 (ZNF207) | NM_003457.1 | 1 | 0.01% | 0 | 0.00% | 0 | 0.00% | 2 | 0.01% | 3 |
| 1725 | alpha-2-macroglobulin precursor (RefSeq aa 1e- | NP_000005.1 | 0 | 0.00% | 3 | 0.02% | 0 | 0.00% | 0 | 0.00% | 3 |
| 1726 | transmembrane 4 superfamily member 6 (TM4S | NM_003270.1 | 0 | 0.00% | 3 | 0.02% | 0 | 0.00% | 0 | 0.00% | 3 |
| 1727 | cargo selection protein TIP47 (TIP47)(=PP17) | AF057140 | 1 | 0.01% | 0 | 0.00% | 1 | 0.01% | 1 | 0.01% | 3 |
| 1728 | coatomer protein (COPA) | U24105 | 2 | 0.01% | 1 | 0.01% | 0 | 0.00% | 0 | 0.00% | 3 |
| 1729 | CGI-43 protein | AF151801.1 | 0 | 0.00% | 1 | 0.01% | 1 | 0.01% | 1 | 0.01% | 3 |
| 1730 | novel RGD-containing protein (WS-3) | NM_006571.1 | 2 | 0.01% | 0 | 0.00% | 1 | 0.01% | 0 | 0.00% | 3 |
| 1731 | CDC42-binding protein kinase beta (DMPK-like) | XM_040911.1 | 3 | 0.02% | 0 | 0.00% | 0 | 0.00% | 0 | 0.00% | 3 |
| 1732 | Rab5 GDP/GTP exchange factor homologue (R/ | NM_014504.1 | 1 | 0.01% | 1 | 0.01% | 0 | 0.00% | 1 | 0.01% | 3 |
| 1733 | heparin-binding neurite outgrowth promoting fac | S60110 | 3 | 0.02% | 0 | 0.00% | 0 | 0.00% | 0 | 0.00% | 3 |
| 1734 | parathymosin | M24398 | 3 | 0.02% | 0 | 0.00% | 0 | 0.00% | 0 | 0.00% | 3 |
| 1735 | calcium-binding protein in macrophages (MRP-8 | X06234.1 | 0 | 0.00% | 0 | 0.00% | 0 | 0.00% | 3 | 0.02% | 3 |
| 1736 | membrane nucleoside transporter (RefSeq aa 8e | NP_055528.1 | 0 | 0.00% | 3 | 0.02% | 0 | 0.00% | 0 | 0.00% | 3 |
| 1737 | pinin, desmosome associated protein(RefSeq aa | NP_002678.1 | 0 | 0.00% | 3 | 0.02% | 0 | 0.00% | 0 | 0.00% | 3 |
| 1738 | high-mobility group (nonhistone chromosomal) p | NM_004965.1 | 1 | 0.01% | 2 | 0.01% | 0 | 0.00% | 0 | 0.00% | 3 |
| 1739 | RCC1 gene, exons 1, 2, 3,4, 5, 6, 7, 8, 9, 10, 11, | D00591.1 | 2 | 0.01% | 0 | 0.00% | 0 | 0.00% | 1 | 0.01% | 3 |
| 1740 | XPB/ERCC-3-like protein | Y17148.1 | 3 | 0.02% | 0 | 0.00% | 0 | 0.00% | 0 | 0.00% | 3 |
| 1741 | GT box binding protein (SPR-2) | X68560 | 0 | 0.00% | 0 | 0.00% | 0 | 0.00% | 3 | 0.02% | 3 |
| 1742 | ribosomal 45S pre rRNA gene | X82564.1 | 0 | 0.00% | 3 | 0.02% | 0 | 0.00% | 0 | 0.00% | 3 |
| 1743 | flap structure-specific endonuclease 1 (FEN1), n | NM_004111.3 | 3 | 0.02% | 0 | 0.00% | 0 | 0.00% | 0 | 0.00% | 3 |
| 1744 | postmeiotic segregation increased (S. cerevisiae | NP_000526.1 | 0 | 0.00% | 3 | 0.02% | 0 | 0.00% | 0 | 0.00% | 3 |
| 1815 | KIAA0068 gene | D38549.1 | 0 | 0.00% | 1 | 0.01% | 0 | 0.00% | 1 | 0.01% | 2 |
| 1745 | eukaryotic translation elongation factor 1 alpha 1 | NM_001403.1 | 2 | 0.01% | 0 | 0.00% | 0 | 0.00% | 0 | 0.00% | 2 |
| 1746 | ribosomal 28S RNA | M11167 | 0 | 0.00% | 1 | 0.01% | 0 | 0.00% | 1 | 0.01% | 2 |
| 1747 | zinc-finger, splicing (RefSeq aa 4e-74) | NP_005446.1 | 0 | 0.00% | 2 | 0.01% | 0 | 0.00% | 0 | 0.00% | 2 |
| 1748 | DNA repair helicase (ERCC3) | M31899.1 | 0 | 0.00% | 0 | 0.00% | 1 | 0.01% | 1 | 0.01% | 2 |
| 1749 | minichromosome maintenance deficient (S. cere | NM_002388.2 | 2 | 0.01% | 0 | 0.00% | 0 | 0.00% | 0 | 0.00% | 2 |
| 1750 | NRF1 protein (NRF1)= non-functional folate binc | L24123.1 | 0 | 0.00% | 1 | 0.01% | 1 | 0.01% | 0 | 0.00% | 2 |
| 1751 | RNA binding motif, single stranded interacting pr | gi8400721 | 0 | 0.00% | 1 | 0.01% | 0 | 0.00% | 1 | 0.01% | 2 |
| 1752 | beta-netrin | AF278532 | 0 | 0.00% | 2 | 0.01% | 0 | 0.00% | 0 | 0.00% | 2 |
| 1753 | kinesin (heavy chain) | X65873 | 0 | 0.00% | 1 | 0.01% | 0 | 0.00% | 1 | 0.01% | 2 |
| 1754 | bamacan (RefSeq aa 1e-76) | NP_005436.1 | 0 | 0.00% | 2 | 0.01% | 0 | 0.00% | 0 | 0.00% | 2 |
| 1755 | cartilage oligomeric matrix protein (COMP) | NM_000095.1 | 2 | 0.01% | 0 | 0.00% | 0 | 0.00% | 0 | 0.00% | 2 |
| 1756 | collagen type X alpha 1(COL10A1) | X72580 | 1 | 0.01% | 0 | 0.00% | 1 | 0.01% | 0 | 0.00% | 2 |
| 1757 | chemokine-like factor 1 (CKLF1) | AF096895.1 | 2 | 0.01% | 0 | 0.00% | 0 | 0.00% | 0 | 0.00% | 2 |
| 1758 | ecotropic viral integration site 2A (EVI2A) | NM_014210.1 | 0 | 0.00% | 1 | 0.01% | 1 | 0.01% | 0 | 0.00% | 2 |
| 1759 | apoptosis inhibitor (IEX-1L) gene | AF071596.1 | 1 | 0.01% | 0 | 0.00% | 1 | 0.01% | 0 | 0.00% | 2 |
| 1760 | fructose 1,6-diphosphate aldolase A (=X05236;N | M21190 | 1 | 0.01% | 0 | 0.00% | 1 | 0.01% | 0 | 0.00% | 2 |
| 1761 | UDP-GalNAc:polypeptide N-acetylgalactosamin | X85018 | 0 | 0.00% | 0 | 0.00% | 1 | 0.01% | 1 | 0.01% | 2 |
| 1762 | NADH:ubiquinone oxidoreductase B15 subunit ( | AF044957 | 1 | 0.01% | 0 | 0.00% | 0 | 0.00% | 1 | 0.01% | 2 |
| 1763 | aspartate beta-hydroxylase (ASPH) | NM_004318.1 | 1 | 0.01% | 0 | 0.00% | 1 | 0.01% | 0 | 0.00% | 2 |

Figure 6 - Unique Known Genes Identified In Four cDNA Cartilage Libraries and EST Frequency Analysis - Page 32 of 102

| | | | | | | | | | | | |
|---|---|---|---|---|---|---|---|---|---|---|---|
| 1764 | fragile X mental retardation protein 1 homologue | U25165 | 0 | 0.00% | 0 | 0.00% | 0 | 0.00% | 2 | 0.01% | 2 |
| 1765 | protein disulfide isomerase related protein (ERp7 | J05016.1 | 1 | 0.01% | 0 | 0.00% | 1 | 0.01% | 0 | 0.00% | 2 |
| 1766 | ubiquitin specific protease 16 (USP16) | NM_006447.1 | 0 | 0.00% | 1 | 0.01% | 0 | 0.00% | 1 | 0.01% | 2 |
| 1767 | retinoblastoma-like 2 (p130)(RBL2) | NM_005611.1 | 0 | 0.00% | 1 | 0.01% | 1 | 0.01% | 0 | 0.00% | 2 |
| 1768 | U6 snRNA-associated Sm-like protein 2e-32 | NP_036454.1 | 0 | 0.00% | 2 | 0.01% | 0 | 0.00% | 0 | 0.00% | 2 |
| 1769 | autoantigen | L05425 | 1 | 0.01% | 0 | 0.00% | 0 | 0.00% | 1 | 0.01% | 2 |
| 1770 | microtubule-associated protein 4 (MAP4) | NM_002375.1 | 2 | 0.01% | 0 | 0.00% | 0 | 0.00% | 0 | 0.00% | 2 |
| 1771 | RBP1-like protein (LOC51742) | NM_016374.1 | 0 | 0.00% | 1 | 0.01% | 1 | 0.01% | 0 | 0.00% | 2 |
| 1772 | glioma pathogenesis-related protein (GliPR) | U16307.1 | 0 | 0.00% | 1 | 0.01% | 0 | 0.00% | 1 | 0.01% | 2 |
| 1773 | SMT3 (suppressor of mif two 3, yeast) homolog | NM_006936.1 | 0 | 0.00% | 0 | 0.00% | 1 | 0.01% | 1 | 0.01% | 2 |
| 1774 | surface glycoprotein | Z50022.1 | 0 | 0.00% | 1 | 0.01% | 1 | 0.01% | 0 | 0.00% | 2 |
| 1775 | tetratricopeptide repeat domain 1 (TTC1) | NM_003314.1 | 0 | 0.00% | 1 | 0.01% | 0 | 0.00% | 1 | 0.01% | 2 |
| 1776 | ATPase, vacuolar, 14 kD (ATP6S14) | NM_004231.1 | 2 | 0.01% | 0 | 0.00% | 0 | 0.00% | 0 | 0.00% | 2 |
| 1777 | solute carrier family 20 (phosphate transporter), | 7382462 | 0 | 0.00% | 0 | 0.00% | 1 | 0.01% | 1 | 0.01% | 2 |
| 1778 | glycogen phosphorylase | Y15233 | 0 | 0.00% | 0 | 0.00% | 1 | 0.01% | 1 | 0.01% | 2 |
| 1779 | ribonuclease L (2',5'-oligoisoadenylate syntheta | 4506558 | 0 | 0.00% | 0 | 0.00% | 1 | 0.01% | 1 | 0.01% | 2 |
| 1780 | cytochrome c oxidase subunit VII-related protein | AB007618 | 1 | 0.01% | 0 | 0.00% | 0 | 0.00% | 1 | 0.01% | 2 |
| 1781 | lymphocyte dihydropyrimidine dehydrogenase (D | U20938 | 0 | 0.00% | 0 | 0.00% | 1 | 0.01% | 1 | 0.01% | 2 |
| 1782 | eukaryotic translation initiation factor 3, subunit 7 | NM_003753.1 | 1 | 0.01% | 1 | 0.01% | 0 | 0.00% | 0 | 0.00% | 2 |
| 1783 | chaperonin containing TCP1, subunit 7 (eta) (CC | NM_006429.1 | 2 | 0.01% | 0 | 0.00% | 0 | 0.00% | 0 | 0.00% | 2 |
| 1784 | ubiquitin carboxyl-terminal esterase L3 (ubiquitin | NM_006002.1 | 0 | 0.00% | 0 | 0.00% | 1 | 0.01% | 1 | 0.01% | 2 |
| 1785 | ubiquitination factor E4A (homologous to yeast U | 4759287 | 1 | 0.01% | 0 | 0.00% | 0 | 0.00% | 1 | 0.01% | 2 |
| 1786 | Vacuolar protein sorting 26 (yeast homolog) (VP | NM_004896.1 | 0 | 0.00% | 0 | 0.00% | 2 | 0.02% | 0 | 0.00% | 2 |
| 1787 | cAMP responsive element binding protein-like 2 | NM_001310.1 | 0 | 0.00% | 0 | 0.00% | 2 | 0.02% | 0 | 0.00% | 2 |
| 1788 | erg protein (ets-related gene) | M21535 | 1 | 0.01% | 0 | 0.00% | 0 | 0.00% | 1 | 0.01% | 2 |
| 1789 | Id3 gene for HLH type transcription factor | X73428.1 | 1 | 0.01% | 1 | 0.01% | 0 | 0.00% | 0 | 0.00% | 2 |
| 1790 | Kruppel-like factor (LOC51713) | NM_016270.1 | 2 | 0.01% | 0 | 0.00% | 0 | 0.00% | 0 | 0.00% | 2 |
| 1791 | THYROID HORMONE-INDUCED PROTEIN B F | Q91641 | 0 | 0.00% | 1 | 0.01% | 0 | 0.00% | 1 | 0.01% | 2 |
| 1792 | zinc finger transCRiptional regulator (GOS24) | M92844 | 1 | 0.01% | 0 | 0.00% | 1 | 0.01% | 0 | 0.00% | 2 |
| 1793 | splicing factor, arginine/serine-rich 3 (RefSeq aa | NP_003008.1 | 0 | 0.00% | 2 | 0.01% | 0 | 0.00% | 0 | 0.00% | 2 |
| 1794 | chromodomain helicase DNA | NM_001271.1 | 1 | 0.01% | 0 | 0.00% | 0 | 0.00% | 1 | 0.01% | 2 |
| 1795 | keratocan (KERA), (=keratocan gene, promoter) | NM_007035.2 | 2 | 0.01% | 0 | 0.00% | 0 | 0.00% | 0 | 0.00% | 2 |
| 1796 | beta tropomyosin (TPM2) gene | AF209746.1 | 2 | 0.01% | 0 | 0.00% | 0 | 0.00% | 0 | 0.00% | 2 |
| 1797 | muscle mRNA for embryonic myosin heavy chai | X15696.1 | 2 | 0.01% | 0 | 0.00% | 0 | 0.00% | 0 | 0.00% | 2 |
| 1798 | nuclear receptor coactivator (=TRBP) | AF245115 | 0 | 0.00% | 0 | 0.00% | 1 | 0.01% | 1 | 0.01% | 2 |
| 1799 | protein tyrosine kinase 9 (PTK9) | NM_002822.1 | 1 | 0.01% | 0 | 0.00% | 0 | 0.00% | 1 | 0.01% | 2 |
| 1800 | serine kinase SRPK2 | U88666 | 0 | 0.00% | 0 | 0.00% | 1 | 0.01% | 1 | 0.01% | 2 |
| 1801 | bone morphogenetic protein 6 (BMP6)(= transfo | NM_001718.2 | 0 | 0.00% | 1 | 0.01% | 1 | 0.01% | 0 | 0.00% | 2 |
| 1802 | cell adhesion molecule (CD44) | M59040 | 0 | 0.00% | 0 | 0.00% | 0 | 0.00% | 2 | 0.01% | 2 |
| 1803 | C-type (calcium dependent, carbohydrate-recog | 4826676 | 0 | 0.00% | 1 | 0.01% | 0 | 0.00% | 1 | 0.01% | 2 |
| 1804 | cyclin-dependent kinase 4 (CDK4) | U37022 | 2 | 0.01% | 0 | 0.00% | 0 | 0.00% | 0 | 0.00% | 2 |
| 1805 | WEE1 gene for protein kinase and partial ZNF14 | AJ277546.1 | 0 | 0.00% | 2 | 0.01% | 0 | 0.00% | 0 | 0.00% | 2 |
| 1806 | programmed cell death 4 (RefSeq aa 7e-54) | NP_055271.1 | 0 | 0.00% | 2 | 0.01% | 0 | 0.00% | 0 | 0.00% | 2 |
| 1807 | 130 kD Golgi-localized phosphoprotein (GPP13C | U55853 | 1 | 0.01% | 0 | 0.00% | 0 | 0.00% | 1 | 0.01% | 2 |
| 1808 | ALL-1 gene | Z69780.1 | 0 | 0.00% | 1 | 0.01% | 1 | 0.01% | 0 | 0.00% | 2 |
| 1809 | deleted in pancreatic carcinoma (DPC4) gene, e | AF045440.1 | 1 | 0.01% | 0 | 0.00% | 1 | 0.01% | 0 | 0.00% | 2 |
| 1810 | E-1 enzyme (MASA) | AF113125.1 | 0 | 0.00% | 1 | 0.01% | 1 | 0.01% | 0 | 0.00% | 2 |
| 1811 | FSHD-associated repeat DNA, proximal region= | U85056 | 1 | 0.01% | 0 | 0.00% | 0 | 0.00% | 1 | 0.01% | 2 |
| 1812 | GalNAc-T2 gene | Y10344.1 | 1 | 0.01% | 0 | 0.00% | 1 | 0.01% | 0 | 0.00% | 2 |
| 1813 | glycolipid transfer protein (LOC51228) | NM_016433.1 | 1 | 0.01% | 0 | 0.00% | 0 | 0.00% | 1 | 0.01% | 2 |
| 1814 | golgi autoantigen, golgin subfamily a, 3 (GOLGA | NM_005895.1 | 1 | 0.01% | 0 | 0.00% | 0 | 0.00% | 1 | 0.01% | 2 |
| 1816 | KIAA0423 | AB007883.1 | 0 | 0.00% | 1 | 0.01% | 1 | 0.01% | 0 | 0.00% | 2 |
| 1817 | KIAA0738 | AB018281 | 1 | 0.01% | 0 | 0.00% | 1 | 0.01% | 0 | 0.00% | 2 |
| 1818 | leukemogenic homolog protein (MEIS1) | U85707.1 | 1 | 0.01% | 0 | 0.00% | 1 | 0.01% | 0 | 0.00% | 2 |
| 1819 | nuclear autoantigenic sperm protein (histone-bin | NM_002482.1 | 1 | 0.01% | 1 | 0.01% | 0 | 0.00% | 0 | 0.00% | 2 |
| 1820 | p21WAF1/CIP1 promoter-interacting protein (=K | AF265443.1 | 1 | 0.01% | 0 | 0.00% | 1 | 0.01% | 0 | 0.00% | 2 |
| 1821 | tetracycline transporter-like protein | D88315 | 1 | 0.01% | 0 | 0.00% | 0 | 0.00% | 1 | 0.01% | 2 |

Figure 6 - Unique Known Genes Identified In Four cDNA Cartilage Libraries and EST Frequency Analysis - Page 33 of 102

| | | | | | | | | | | | |
|---|---|---|---|---|---|---|---|---|---|---|---|
| 1822 | lung type-I cell membrane-associated glycoprote | NP_006465.1 | 0 | 0.00% | 2 | 0.01% | 0 | 0.00% | 0 | 0.00% | 2 |
| 1823 | acyl-coenzyme A:cholesterol acyltransferase (O | L21934.2 | 0 | 0.00% | 0 | 0.00% | 1 | 0.01% | 1 | 0.01% | 2 |
| 1824 | casein kinase II alpha subunit | M55268 | 1 | 0.01% | 0 | 0.00% | 1 | 0.01% | 0 | 0.00% | 2 |
| 1825 | protein tyrosine phosphatase type IVA, member | NM_003463.1 | 0 | 0.00% | 1 | 0.01% | 0 | 0.00% | 1 | 0.01% | 2 |
| 1826 | protein tyrosine phosphatase, non-receptor type | NM_002835.1 | 0 | 0.00% | 0 | 0.00% | 2 | 0.02% | 0 | 0.00% | 2 |
| 1827 | protein tyrosine phosphatase, non-receptor type | NM_006264.1 | 0 | 0.00% | 1 | 0.01% | 1 | 0.01% | 0 | 0.00% | 2 |
| 1828 | 5'-3' exoribonuclease 2 (XRN2) | NM_012255.1 | 0 | 0.00% | 0 | 0.00% | 2 | 0.02% | 0 | 0.00% | 2 |
| 1829 | APEX nuclease (multifunctional DNA repair enzy | NP_001632.1 | 1 | 0.01% | 1 | 0.01% | 0 | 0.00% | 0 | 0.00% | 2 |
| 1830 | carbamoyl-phosphate synthetase 2, aspartate tr | NM_004341.1 | 2 | 0.01% | 0 | 0.00% | 0 | 0.00% | 0 | 0.00% | 2 |
| 1831 | phosphoribosyl pyrophosphate synthetase-asso | NM_002766.1 | 1 | 0.01% | 1 | 0.01% | 0 | 0.00% | 0 | 0.00% | 2 |
| 1832 | aldehyde dehydrogenase (ALD10), miCRosomal | U46689 | 0 | 0.00% | 0 | 0.00% | 2 | 0.02% | 0 | 0.00% | 2 |
| 1833 | low density lipoprotein-related protein 1 (alpha-2 | NM_002332.1 | 1 | 0.01% | 1 | 0.01% | 0 | 0.00% | 0 | 0.00% | 2 |
| 1834 | NADP dependent cytoplasmic malic enzyme (= | X77244 | 0 | 0.00% | 0 | 0.00% | 1 | 0.01% | 1 | 0.01% | 2 |
| 1835 | hyaluronan-binding protein precursor (HABP1) | AF275902.1 | 1 | 0.01% | 0 | 0.00% | 0 | 0.00% | 1 | 0.01% | 2 |
| 1836 | leucine rich repeat (in FLII) interacting protein 1 ( | NM_004735.1 | 0 | 0.00% | 0 | 0.00% | 1 | 0.01% | 1 | 0.01% | 2 |
| 1837 | serine-rich protein | AF246705.1 | 1 | 0.01% | 0 | 0.00% | 1 | 0.01% | 0 | 0.00% | 2 |
| 1838 | EUKARYOTIC TRANSLATION INITIATION FAC | spQ14152 | 0 | 0.00% | 1 | 0.01% | 0 | 0.00% | 1 | 0.01% | 2 |
| 1839 | translation initiation factor eIF-3 p110 subunit | U46025 | 2 | 0.01% | 0 | 0.00% | 0 | 0.00% | 0 | 0.00% | 2 |
| 1840 | metalloprotease/disintegrin/cysteine-rich protein | U41766 | 0 | 0.00% | 0 | 0.00% | 1 | 0.01% | 1 | 0.01% | 2 |
| 1841 | proteasome (prosome, macropain) activator sub | NM_006263.1 | 0 | 0.00% | 0 | 0.00% | 0 | 0.00% | 2 | 0.01% | 2 |
| 1842 | weak similarity to Arabidopsis thaliana ubiquitin- | U88173 | 0 | 0.00% | 0 | 0.00% | 0 | 0.00% | 2 | 0.01% | 2 |
| 1843 | cullin 3 (CUL3) (=AB014517 KIAA0617) | gi4503164 | 1 | 0.01% | 0 | 0.00% | 1 | 0.01% | 0 | 0.00% | 2 |
| 1844 | cyclophilin 40 | D63861.1 | 0 | 0.00% | 0 | 0.00% | 0 | 0.00% | 2 | 0.01% | 2 |
| 1845 | cellular retinoic acid-binding protein 2 (CRABP2) | NM_001878.2 | 2 | 0.01% | 0 | 0.00% | 0 | 0.00% | 0 | 0.00% | 2 |
| 1846 | DNA binding protein NAK1 | D49728 | 2 | 0.01% | 0 | 0.00% | 0 | 0.00% | 0 | 0.00% | 2 |
| 1847 | host cell factor 2 (HCF-2) | NM_013320.1 | 0 | 0.00% | 0 | 0.00% | 1 | 0.01% | 1 | 0.01% | 2 |
| 1848 | LIM protein (similar to rat protein kinase C-bindir | NM_006457.1 | 0 | 0.00% | 1 | 0.01% | 1 | 0.01% | 0 | 0.00% | 2 |
| 1849 | von Hippel-Lindau binding protein (VBP-1) | U96759 | 0 | 0.00% | 1 | 0.01% | 0 | 0.00% | 1 | 0.01% | 2 |
| 1850 | heterogeneous nuclear ribonucleoprotein F (HNI | NM_004966.1 | 0 | 0.00% | 1 | 0.01% | 1 | 0.01% | 0 | 0.00% | 2 |
| 1851 | poly(A)-binding protein, nuclear 1 (PABPN1) | gi4758875 | 1 | 0.01% | 1 | 0.01% | 0 | 0.00% | 0 | 0.00% | 2 |
| 1852 | Sjogren syndrome antigen A1 (SSA1) | NM_003141.1 | 1 | 0.01% | 0 | 0.00% | 1 | 0.01% | 0 | 0.00% | 2 |
| 1853 | core-binding factor, runt domain, alpha subunit 2 | NM_004349.1 | 0 | 0.00% | 1 | 0.01% | 0 | 0.00% | 1 | 0.01% | 2 |
| 1854 | membrane component, chromosome 17, surfac | gi5174504 | 0 | 0.00% | 1 | 0.01% | 0 | 0.00% | 1 | 0.01% | 2 |
| 1855 | X-ray repair complementing defective repair in C | gi4507944 | 0 | 0.00% | 0 | 0.00% | 1 | 0.01% | 1 | 0.01% | 2 |
| 1856 | factor I (C3b/C4b inactivator) | J02770.1 | 0 | 0.00% | 0 | 0.00% | 2 | 0.02% | 0 | 0.00% | 2 |
| 1857 | MHC class II HLA-DR-beta | M20430.1 | 0 | 0.00% | 0 | 0.00% | 0 | 0.00% | 2 | 0.01% | 2 |
| 1858 | CGI-45 protein (LOC51094) | NM_015999.1 | 2 | 0.01% | 0 | 0.00% | 0 | 0.00% | 0 | 0.00% | 2 |
| 1859 | golgi matrix protein GM130 (GOLGA2) (non-exa | AAF65550.1 | 0 | 0.00% | 2 | 0.01% | 0 | 0.00% | 0 | 0.00% | 2 |
| 1860 | EGF-like repeats and discoidin I-likedomains 3 ( | NP_005702.1 | 0 | 0.00% | 2 | 0.01% | 0 | 0.00% | 0 | 0.00% | 2 |
| 1861 | fibrillin-2 | U03272 | 2 | 0.01% | 0 | 0.00% | 0 | 0.00% | 0 | 0.00% | 2 |
| 1862 | fibulin 5 (FBLN5) | NM_006329.1 | 0 | 0.00% | 1 | 0.01% | 0 | 0.00% | 1 | 0.01% | 2 |
| 1863 | microfibrillar-associated protein 1 (MFAP1) | NM_005926.1 | 1 | 0.01% | 1 | 0.01% | 0 | 0.00% | 0 | 0.00% | 2 |
| 1864 | actin-binding LIM protein (ABLIM) | NM_006719.2 | 0 | 0.00% | 2 | 0.01% | 0 | 0.00% | 0 | 0.00% | 2 |
| 1865 | thyroid autoantigen 70kD (Ku antigen) (G22P1) | NM_001469.1 | 2 | 0.01% | 0 | 0.00% | 0 | 0.00% | 0 | 0.00% | 2 |
| 1866 | vinculin | M33308 | 0 | 0.00% | 0 | 0.00% | 0 | 0.00% | 0 | 0.00% | 2 |
| 1867 | cardiac myosin binding protein-C (ORF) | X84075 | 0 | 0.00% | 0 | 0.00% | 1 | 0.01% | 1 | 0.01% | 2 |
| 1868 | tropomyosin 4 (TPM4) | Y00169.1 | 1 | 0.01% | 0 | 0.00% | 0 | 0.00% | 1 | 0.01% | 2 |
| 1869 | troponin T3, skeletal fast (TNNT3) | NM_006757.1 | 2 | 0.01% | 0 | 0.00% | 0 | 0.00% | 0 | 0.00% | 2 |
| 1870 | lamin B receptor (LBR) | NM_002296.1 | 1 | 0.01% | 1 | 0.01% | 0 | 0.00% | 0 | 0.00% | 2 |
| 1871 | surfeit 1 (SURF1) | NM_003172.1 | 0 | 0.00% | 1 | 0.01% | 0 | 0.00% | 1 | 0.01% | 2 |
| 1872 | unc-50 related protein homologue | AF077038.1 | 0 | 0.00% | 0 | 0.00% | 1 | 0.01% | 1 | 0.01% | 2 |
| 1873 | 100 kDa coactivator | U22055 | 0 | 0.00% | 0 | 0.00% | 2 | 0.02% | 0 | 0.00% | 2 |
| 1874 | diphtheria toxin receptor (heparin-binding epider | NM_001945.1 | 0 | 0.00% | 2 | 0.01% | 0 | 0.00% | 0 | 0.00% | 2 |
| 1875 | Fc fragment of IgE, high affinity I, receptor for; g | gi4758343 | 0 | 0.00% | 1 | 0.01% | 0 | 0.00% | 1 | 0.01% | 2 |
| 1876 | fibroblast growth factor receptor (FGFR-4) | X57205 | 2 | 0.01% | 0 | 0.00% | 0 | 0.00% | 0 | 0.00% | 2 |
| 1877 | G protein-coupled receptor 23 (GPR23) | NM_005296.1 | 0 | 0.00% | 2 | 0.01% | 0 | 0.00% | 0 | 0.00% | 2 |
| 1878 | stromal cell protein isoform | AF126024 | 0 | 0.00% | 1 | 0.01% | 0 | 0.00% | 1 | 0.01% | 2 |

Figure 6 - Unique Known Genes Identified In Four cDNA Cartilage Libraries and EST Frequency Analysis - Page 34 of 102

| | | | | | | | | | | | |
|---|---|---|---|---|---|---|---|---|---|---|---|
| 1879 | mitogen-activated protein kinase kinase kinase k | NM_004834.1 | 0 | 0.00% | 0 | 0.00% | 2 | 0.02% | 0 | 0.00% | 2 |
| 1880 | protein kinase, cGMP-dependent, type I (PRKG1 | NM_006258.1 | 0 | 0.00% | 1 | 0.01% | 1 | 0.01% | 0 | 0.00% | 2 |
| 1881 | serine/threonine protein kinase MASK (LOC517( | NM_016542.1 | 0 | 0.00% | 2 | 0.01% | 0 | 0.00% | 0 | 0.00% | 2 |
| 1882 | guanine nucleotide binding protein 10 (GNG10) | NM_004125.1 | 1 | 0.01% | 1 | 0.01% | 0 | 0.00% | 0 | 0.00% | 2 |
| 1883 | angiopoietin-related protein | AF153606.1 | 0 | 0.00% | 0 | 0.00% | 0 | 0.00% | 2 | 0.01% | 2 |
| 1884 | macrophage migration inhibitory factor (glycosyl | NM_002415.1 | 2 | 0.01% | 0 | 0.00% | 0 | 0.00% | 0 | 0.00% | 2 |
| 1885 | uncharacterized hypothalamus protein HTMP (L | NM_018475.1 | 1 | 0.01% | 0 | 0.00% | 0 | 0.00% | 1 | 0.01% | 2 |
| 1886 | histone H2A.F/Z variant (H2AV) | AF081192 | 1 | 0.01% | 1 | 0.01% | 0 | 0.00% | 0 | 0.00% | 2 |
| 1887 | C-1 | U41816 | 1 | 0.01% | 0 | 0.00% | 0 | 0.00% | 1 | 0.01% | 2 |
| 1888 | cyclin-D binding Myb-like protein | AF084530.1 | 0 | 0.00% | 0 | 0.00% | 0 | 0.00% | 2 | 0.01% | 2 |
| 1889 | GTP-binding protein G25K | AL121737.1 | 1 | 0.01% | 0 | 0.00% | 0 | 0.00% | 1 | 0.01% | 2 |
| 1890 | reverse transcriptase homolog - human retrotran | pir\|I38588 | 1 | 0.01% | 0 | 0.00% | 1 | 0.01% | 0 | 0.00% | 2 |
| 1891 | ATP binding protein | AB006679 | 0 | 0.00% | 0 | 0.00% | 0 | 0.00% | 2 | 0.01% | 2 |
| 1892 | BCL2 gene, exon 3 and breakpoint region | AF217803.1 | 0 | 0.00% | 0 | 0.00% | 2 | 0.02% | 0 | 0.00% | 2 |
| 1893 | PRP4/STK/WD splicing factor (HPRP4P) | NM_004697.1 | 2 | 0.01% | 0 | 0.00% | 0 | 0.00% | 0 | 0.00% | 2 |
| 1894 | tumor protein D52-like 1 (TPD52L1) | NM_003287.1 | 1 | 0.01% | 0 | 0.00% | 1 | 0.01% | 0 | 0.00% | 2 |
| 1895 | 7-60 (gene) | AF112980 | 2 | 0.01% | 0 | 0.00% | 0 | 0.00% | 0 | 0.00% | 2 |
| 1896 | activated in tumor suppression | AJ012502.1 | 0 | 0.00% | 0 | 0.00% | 1 | 0.01% | 1 | 0.01% | 2 |
| 1897 | adipose differentiation-related protein (ADFP) | XM_048266.2 | 1 | 0.01% | 1 | 0.01% | 0 | 0.00% | 0 | 0.00% | 2 |
| 1898 | ALL1-fused gene from chromosome 1q (AF1Q) | NM_006818.1 | 1 | 0.01% | 0 | 0.00% | 0 | 0.00% | 1 | 0.01% | 2 |
| 1899 | AML1 AML1c protein (alternatively spliced produ | D43969.1 | 0 | 0.00% | 0 | 0.00% | 0 | 0.00% | 2 | 0.01% | 2 |
| 1900 | antigen NY-CO-10 (NY-CO-10) | AF039692.1 | 0 | 0.00% | 0 | 0.00% | 2 | 0.02% | 0 | 0.00% | 2 |
| 1901 | BABP gene for bile acid-binding protein [AKR 1C | AB032151.1 | 0 | 0.00% | 2 | 0.01% | 0 | 0.00% | 0 | 0.00% | 2 |
| 1902 | beige-like protein (BGL) | M83822.1 | 0 | 0.00% | 1 | 0.01% | 1 | 0.01% | 0 | 0.00% | 2 |
| 1903 | BRCA2 region= ARP2/3 protein compex subunit | U50523 | 1 | 0.01% | 0 | 0.00% | 0 | 0.00% | 1 | 0.01% | 2 |
| 1904 | Brush-1=tumor suppressor (=AB020707 KIAA09 | S69790 | 0 | 0.00% | 0 | 0.00% | 0 | 0.00% | 2 | 0.01% | 2 |
| 1905 | BTK region clone 2f10-rpi | U01925.1 | 1 | 0.01% | 0 | 0.00% | 0 | 0.00% | 1 | 0.01% | 2 |
| 1906 | candidate tumor suppressor p33 ING1 homolog | NM_016162.1 | 2 | 0.01% | 0 | 0.00% | 0 | 0.00% | 0 | 0.00% | 2 |
| 1907 | CG14483 gene product (35% ORF) [Drosophila | AE003802 | 0 | 0.00% | 0 | 0.00% | 0 | 0.00% | 2 | 0.01% | 2 |
| 1908 | chitobiase, di-N-acetyl- (CTBS) | NM_004388.1 | 0 | 0.00% | 1 | 0.01% | 0 | 0.00% | 1 | 0.01% | 2 |
| 1909 | COP9 (constitutive photomorphogenic,Arabidops | NP_006828.1 | 0 | 0.00% | 2 | 0.01% | 0 | 0.00% | 0 | 0.00% | 2 |
| 1910 | COP9 homolog (HCOP9) | U51205 | 2 | 0.01% | 0 | 0.00% | 0 | 0.00% | 0 | 0.00% | 2 |
| 1911 | cytokine inducible SH2-containing protein 3 (Cis | gi6671757 | 0 | 0.00% | 0 | 0.00% | 0 | 0.00% | 2 | 0.01% | 2 |
| 1912 | cytokine-inducible SH2 protein 6 (CISH6) (=AB0 | AF073958.1 | 0 | 0.00% | 0 | 0.00% | 1 | 0.01% | 1 | 0.01% | 2 |
| 1913 | DAPIT protein | AJ271158 | 0 | 0.00% | 0 | 0.00% | 1 | 0.01% | 1 | 0.01% | 2 |
| 1914 | Dim1p homolog (hdim1 ) | AF023611 | 1 | 0.01% | 0 | 0.00% | 1 | 0.01% | 0 | 0.00% | 2 |
| 1915 | DMA, DMB, HLA-Z1, IPP2, LMP2, TAP1, LMP7, | X87344 | 0 | 0.00% | 1 | 0.01% | 1 | 0.01% | 0 | 0.00% | 2 |
| 1916 | Dmx-like 1 (DMXL1) | NM_005509.1 | 1 | 0.01% | 0 | 0.00% | 0 | 0.00% | 1 | 0.01% | 2 |
| 1917 | down-regulated in metastasis (DRIM) | NM_014503.1 | 0 | 0.00% | 1 | 0.01% | 1 | 0.01% | 0 | 0.00% | 2 |
| 1918 | downregulated in ovarian cancer 1 (DOC1) | NM_014890.1 | 1 | 0.01% | 0 | 0.00% | 0 | 0.00% | 1 | 0.01% | 2 |
| 1919 | enhancer of invasion 10 (HEI10) (=DKFZp564A( | AF216381.1 | 0 | 0.00% | 1 | 0.01% | 1 | 0.01% | 0 | 0.00% | 2 |
| 1920 | EXLM1 | AB006651.1 | 1 | 0.01% | 0 | 0.00% | 0 | 0.00% | 1 | 0.01% | 2 |
| 1921 | FLI-LRR associated protein-1 | AF045573 | 1 | 0.01% | 0 | 0.00% | 1 | 0.01% | 0 | 0.00% | 2 |
| 1922 | fvt1 | X63657 | 0 | 0.00% | 0 | 0.00% | 0 | 0.00% | 2 | 0.01% | 2 |
| 1923 | GA17 protein (dendritic cell protein) | AF064603 | 1 | 0.01% | 0 | 0.00% | 1 | 0.01% | 0 | 0.00% | 2 |
| 1924 | GL004 protein (RefSeq aa 2e-34) | NP_064579.1 | 1 | 0.01% | 1 | 0.01% | 0 | 0.00% | 0 | 0.00% | 2 |
| 1925 | glioma tumor suppressor candidate region protei | AAF62873.1 | 1 | 0.01% | 0 | 0.00% | 0 | 0.00% | 1 | 0.01% | 2 |
| 1926 | guanylate binding protein 1, interferon-inducible, | NP_002044.1 | 0 | 0.00% | 2 | 0.01% | 0 | 0.00% | 0 | 0.00% | 2 |
| 1927 | HDCMA18P protein (HDCMA18P) | NM_016648.1 | 0 | 0.00% | 0 | 0.00% | 0 | 0.00% | 2 | 0.01% | 2 |
| 1928 | HDCMC29P | AF068295.1 | 1 | 0.01% | 1 | 0.01% | 0 | 0.00% | 0 | 0.00% | 2 |
| 1929 | hDj9 (=AL032657) (65% aa) | AB028859 | 0 | 0.00% | 1 | 0.01% | 1 | 0.01% | 0 | 0.00% | 2 |
| 1930 | HepG2 3' region MboI cDNA, clone hmd3c06m3 | D17196.1 | 0 | 0.00% | 0 | 0.00% | 1 | 0.01% | 1 | 0.01% | 2 |
| 1931 | HP protein (HP) | AF026219.1 | 0 | 0.00% | 1 | 0.01% | 1 | 0.01% | 0 | 0.00% | 2 |
| 1932 | HSPC007 protein | NP_054737.1 | 0 | 0.00% | 1 | 0.01% | 0 | 0.00% | 1 | 0.01% | 2 |
| 1933 | HSPC023 protein (HSPC023), D2217 | NM_014047.1 | 2 | 0.01% | 0 | 0.00% | 0 | 0.00% | 0 | 0.00% | 2 |
| 1934 | HSPC043 protein mRNA, (=HSPC291) | AF161411.2 | 1 | 0.01% | 0 | 0.00% | 1 | 0.01% | 0 | 0.00% | 2 |
| 1935 | HSPC085 | AF161348.1 | 0 | 0.00% | 1 | 0.01% | 1 | 0.01% | 0 | 0.00% | 2 |

Figure 6 - Unique Known Genes Identified In Four cDNA Cartilage Libraries and EST Frequency Analysis - Page 35 of 102

| | | | | | | | | | | |
|---|---|---|---|---|---|---|---|---|---|---|
| 1936 | HSPC095 | AF161358.1 | 0 | 0.00% | 1 | 0.01% | 1 | 0.01% | 0 | 0.00% | 2 |
| 1937 | HSPC115 mRNA,(= adenosine 5'-diphosphosug | AF161464.1 | 0 | 0.00% | 1 | 0.01% | 1 | 0.01% | 0 | 0.00% | 2 |
| 1938 | HSPC132 (ORF) | AF161481 | 1 | 0.01% | 0 | 0.00% | 0 | 0.00% | 1 | 0.01% | 2 |
| 1939 | HSPC133 protein (HSPC133) (=cDNA FLJ10459 | NM_014168.1 | 0 | 0.00% | 1 | 0.01% | 0 | 0.00% | 1 | 0.01% | 2 |
| 1940 | HSPC134 protein (HSPC134) | NM_014169.1 | 0 | 0.00% | 2 | 0.01% | 0 | 0.00% | 0 | 0.00% | 2 |
| 1941 | HSPC229 | AF151063.1 | 1 | 0.01% | 1 | 0.01% | 0 | 0.00% | 0 | 0.00% | 2 |
| 1942 | HSPC250 (ORF) | AF151084 | 0 | 0.00% | 0 | 0.00% | 0 | 0.00% | 2 | 0.01% | 2 |
| 1943 | HSPC292 | AAF28970.1 | 0 | 0.00% | 1 | 0.01% | 0 | 0.00% | 1 | 0.01% | 2 |
| 1944 | HSPC302 | AF161420.1 | 0 | 0.00% | 1 | 0.01% | 0 | 0.00% | 0 | 0.00% | 2 |
| 1945 | HT005 protein (=ariadne (Drosophila) homolog 2 | AF183427.1 | 0 | 0.00% | 2 | 0.01% | 0 | 0.00% | 0 | 0.00% | 2 |
| 1946 | HT014 (HT014) | AF221595.1 | 0 | 0.00% | 2 | 0.01% | 0 | 0.00% | 0 | 0.00% | 2 |
| 1947 | HYA22 | D88153 | 1 | 0.01% | 0 | 0.00% | 1 | 0.01% | 0 | 0.00% | 2 |
| 1948 | hypothalamus protein HT007 (RefSeq aa 2e-64) | NP_060950.1 | 0 | 0.00% | 1 | 0.01% | 1 | 0.01% | 0 | 0.00% | 2 |
| 1949 | hypothetical gene (LOC115009) | XM_055020.1 | 2 | 0.01% | 0 | 0.00% | 0 | 0.00% | 0 | 0.00% | 2 |
| 1950 | intergenic DNA between SURF-2 and SURF-4 | Y17214 | 1 | 0.01% | 0 | 0.00% | 0 | 0.00% | 1 | 0.01% | 2 |
| 1951 | IRLB gene (exon5) | X82334.1 | 0 | 0.00% | 0 | 0.00% | 2 | 0.02% | 0 | 0.00% | 2 |
| 1952 | ITBA1 protein | X92475 | 2 | 0.01% | 0 | 0.00% | 0 | 0.00% | 0 | 0.00% | 2 |
| 1953 | JM4 protein (JM4) | NM_007213.1 | 2 | 0.01% | 0 | 0.00% | 0 | 0.00% | 0 | 0.00% | 2 |
| 1954 | KIAA0006 | D25304 | 0 | 0.00% | 0 | 0.00% | 1 | 0.01% | 1 | 0.01% | 2 |
| 1955 | KIAA0009 | D13634.1 | 0 | 0.00% | 0 | 0.00% | 0 | 0.00% | 2 | 0.01% | 2 |
| 1956 | KIAA0010 | D13635 | 1 | 0.01% | 0 | 0.00% | 1 | 0.01% | 0 | 0.00% | 2 |
| 1957 | KIAA0017 | D13642 | 2 | 0.01% | 0 | 0.00% | 0 | 0.00% | 0 | 0.00% | 2 |
| 1958 | KIAA0025 gene product; MMS-inducible gene (K | NM_014685.1 | 0 | 0.00% | 1 | 0.01% | 0 | 0.00% | 0 | 0.00% | 2 |
| 1959 | KIAA0036 | D25278 | 2 | 0.01% | 0 | 0.00% | 0 | 0.00% | 0 | 0.00% | 2 |
| 1960 | KIAA0039 (ORF) | D26018.1 | 2 | 0.01% | 0 | 0.00% | 0 | 0.00% | 0 | 0.00% | 2 |
| 1961 | KIAA0041 | D26069 | 0 | 0.00% | 0 | 0.00% | 1 | 0.01% | 1 | 0.01% | 2 |
| 1962 | KIAA0049 | D30756.1 | 0 | 0.00% | 0 | 0.00% | 0 | 0.00% | 2 | 0.01% | 2 |
| 1963 | KIAA0058 | NM_014764.1 | 0 | 0.00% | 1 | 0.01% | 1 | 0.01% | 0 | 0.00% | 2 |
| 1964 | KIAA0066 | D31886.1 | 0 | 0.00% | 1 | 0.01% | 0 | 0.00% | 1 | 0.01% | 2 |
| 1965 | KIAA0072 gene | D31889.1 | 0 | 0.00% | 0 | 0.00% | 2 | 0.02% | 0 | 0.00% | 2 |
| 1966 | KIAA0073 (cyclophilin related) | D38552 | 0 | 0.00% | 1 | 0.01% | 1 | 0.01% | 0 | 0.00% | 2 |
| 1967 | KIAA0093 | D42055.1 | 0 | 0.00% | 2 | 0.01% | 0 | 0.00% | 0 | 0.00% | 2 |
| 1968 | KIAA0095 gene | NM_014669.1 | 0 | 0.00% | 0 | 0.00% | 1 | 0.01% | 1 | 0.01% | 2 |
| 1969 | KIAA0105 | NM_004906.1 | 2 | 0.01% | 0 | 0.00% | 0 | 0.00% | 0 | 0.00% | 2 |
| 1970 | KIAA0112 | D25218 | 0 | 0.00% | 1 | 0.01% | 0 | 0.00% | 1 | 0.01% | 2 |
| 1971 | KIAA0117 | D38491 | 1 | 0.01% | 1 | 0.01% | 0 | 0.00% | 0 | 0.00% | 2 |
| 1972 | KIAA0155 gene | NM_014633.1 | 1 | 0.01% | 0 | 0.00% | 1 | 0.01% | 0 | 0.00% | 2 |
| 1973 | KIAA0156 gene product (KIAA0156) | NM_014706.1 | 0 | 0.00% | 2 | 0.01% | 0 | 0.00% | 0 | 0.00% | 2 |
| 1974 | KIAA0161 | D79983 | 0 | 0.00% | 0 | 0.00% | 0 | 0.00% | 2 | 0.01% | 2 |
| 1975 | KIAA0178 | D80000 | 0 | 0.00% | 0 | 0.00% | 0 | 0.00% | 2 | 0.01% | 2 |
| 1976 | KIAA0180 | D80002 | 2 | 0.01% | 0 | 0.00% | 0 | 0.00% | 0 | 0.00% | 2 |
| 1977 | KIAA0183 gene | D80005.1 | 0 | 0.00% | 0 | 0.00% | 2 | 0.02% | 0 | 0.00% | 2 |
| 1978 | septin 2 (SEP2) | AF179995.1 | 1 | 0.01% | 0 | 0.00% | 0 | 0.00% | 1 | 0.01% | 2 |
| 1979 | KIAA0203 | D86958 | 0 | 0.00% | 0 | 0.00% | 0 | 0.00% | 2 | 0.01% | 2 |
| 1980 | KIAA0217 | D86971 | 2 | 0.01% | 0 | 0.00% | 0 | 0.00% | 0 | 0.00% | 2 |
| 1981 | KIAA0225 gene | D86978.1 | 0 | 0.00% | 2 | 0.01% | 0 | 0.00% | 0 | 0.00% | 2 |
| 1982 | KIAA0227 | D86980 | 0 | 0.00% | 0 | 0.00% | 1 | 0.01% | 1 | 0.01% | 2 |
| 1983 | KIAA0228 gene | D86981.1 | 0 | 0.00% | 2 | 0.01% | 0 | 0.00% | 0 | 0.00% | 2 |
| 1984 | KIAA0233 | NM_014745.1 | 2 | 0.01% | 0 | 0.00% | 0 | 0.00% | 0 | 0.00% | 2 |
| 1985 | KIAA0253 | D87442 | 2 | 0.01% | 0 | 0.00% | 0 | 0.00% | 0 | 0.00% | 2 |
| 1986 | KIAA0254 | D87443 | 1 | 0.01% | 0 | 0.00% | 0 | 0.00% | 1 | 0.01% | 2 |
| 1987 | KIAA0258 gene | NM_014785.1 | 0 | 0.00% | 2 | 0.01% | 0 | 0.00% | 0 | 0.00% | 2 |
| 1988 | KIAA0266 gene, (ORF) | D87455 | 0 | 0.00% | 1 | 0.01% | 1 | 0.01% | 0 | 0.00% | 2 |
| 1989 | KIAA0324 | AB002322.2 | 1 | 0.01% | 1 | 0.01% | 0 | 0.00% | 0 | 0.00% | 2 |
| 1990 | KIAA0353 | AB002351 | 0 | 0.00% | 1 | 0.01% | 0 | 0.00% | 1 | 0.01% | 2 |
| 1991 | KIAA0368 | AB002366 | 1 | 0.01% | 0 | 0.00% | 1 | 0.01% | 0 | 0.00% | 2 |
| 1992 | KIAA0370 gene | AB002368.1 | 1 | 0.01% | 0 | 0.00% | 0 | 0.00% | 1 | 0.01% | 2 |

Figure 6 - Unique Known Genes Identified In Four cDNA Cartilage Libraries and EST Frequency Analysis - Page 36 of 102

| | | | | | | | | | | | |
|---|---|---|---|---|---|---|---|---|---|---|---|
| 1993 | KIAA0447 | AB007916 | 1 | 0.01% | 1 | 0.01% | 0 | 0.00% | 0 | 0.00% | 2 |
| 1994 | KIAA0451 | NM_014826.1 | 0 | 0.00% | 1 | 0.01% | 0 | 0.00% | 1 | 0.01% | 2 |
| 1995 | KIAA0456 | AB007925 | 2 | 0.01% | 0 | 0.00% | 0 | 0.00% | 0 | 0.00% | 2 |
| 1996 | KIAA0466 protein | AB007935.1 | 1 | 0.01% | 0 | 0.00% | 0 | 0.00% | 1 | 0.01% | 2 |
| 1997 | KIAA0470 | AB007939 | 1 | 0.01% | 1 | 0.01% | 0 | 0.00% | 0 | 0.00% | 2 |
| 1998 | KIAA0471 gene product (KIAA0471) | NM_014857.1 | 0 | 0.00% | 2 | 0.01% | 0 | 0.00% | 0 | 0.00% | 2 |
| 1999 | KIAA0475 | NM_014864.1 | 0 | 0.00% | 1 | 0.01% | 0 | 0.00% | 1 | 0.01% | 2 |
| 2000 | KIAA0480 | AB007949 | 0 | 0.00% | 0 | 0.00% | 2 | 0.02% | 0 | 0.00% | 2 |
| 2001 | KIAA0488 | AB007957.1 | 1 | 0.01% | 1 | 0.01% | 0 | 0.00% | 0 | 0.00% | 2 |
| 2002 | KIAA0491 | AB007960 | 0 | 0.00% | 0 | 0.00% | 0 | 0.00% | 2 | 0.01% | 2 |
| 2003 | KIAA0553 | AB011125 | 2 | 0.01% | 0 | 0.00% | 0 | 0.00% | 0 | 0.00% | 2 |
| 2004 | KIAA0564 protein | AB011136.1 | 0 | 0.00% | 2 | 0.01% | 0 | 0.00% | 0 | 0.00% | 2 |
| 2005 | KIAA0611 | AB014511 | 0 | 0.00% | 1 | 0.01% | 0 | 0.00% | 1 | 0.01% | 2 |
| 2006 | KIAA0618 gene product (KIAA0618), mRNA | XM_018359.3 | 1 | 0.01% | 0 | 0.00% | 0 | 0.00% | 0 | 0.00% | 2 |
| 2007 | KIAA0638 | AB014538 | 2 | 0.01% | 0 | 0.00% | 0 | 0.00% | 0 | 0.00% | 2 |
| 2008 | KIAA0639 | AB014539 | 1 | 0.01% | 0 | 0.00% | 1 | 0.01% | 0 | 0.00% | 2 |
| 2009 | KIAA0648 | AB014548 | 1 | 0.01% | 0 | 0.00% | 1 | 0.01% | 0 | 0.00% | 2 |
| 2010 | KIAA0689 | AB014589.1 | 0 | 0.00% | 2 | 0.01% | 0 | 0.00% | 0 | 0.00% | 2 |
| 2011 | KIAA0697 protein | AB014597.1 | 0 | 0.00% | 2 | 0.01% | 0 | 0.00% | 0 | 0.00% | 2 |
| 2012 | KIAA0701 protein | AB014601.1 | 0 | 0.00% | 2 | 0.01% | 0 | 0.00% | 0 | 0.00% | 2 |
| 2013 | KIAA0727 (ORF) | AB018270 | 0 | 0.00% | 1 | 0.01% | 0 | 0.00% | 1 | 0.01% | 2 |
| 2014 | KIAA0745 | AB018288.1 | 0 | 0.00% | 1 | 0.01% | 0 | 0.00% | 1 | 0.01% | 2 |
| 2015 | KIAA0761 protein | AB018304.1 | 0 | 0.00% | 0 | 0.00% | 2 | 0.02% | 0 | 0.00% | 2 |
| 2016 | KIAA0762 | AB018305.1 | 0 | 0.00% | 1 | 0.01% | 0 | 0.00% | 1 | 0.01% | 2 |
| 2017 | KIAA0765 | AB018308.1 | 1 | 0.01% | 0 | 0.00% | 0 | 0.00% | 1 | 0.01% | 2 |
| 2018 | KIAA0770 | AB018313.1 | 1 | 0.01% | 1 | 0.01% | 0 | 0.00% | 0 | 0.00% | 2 |
| 2019 | KIAA0772 gene | NM_014835.1 | 1 | 0.01% | 1 | 0.01% | 0 | 0.00% | 0 | 0.00% | 2 |
| 2020 | KIAA0776 protein | AB018319.1 | 0 | 0.00% | 2 | 0.01% | 0 | 0.00% | 0 | 0.00% | 2 |
| 2021 | KIAA0824 (=PCF11p homolog) | AB020631.1 | 0 | 0.00% | 1 | 0.01% | 0 | 0.00% | 1 | 0.01% | 2 |
| 2022 | KIAA0830 | AB020637.1 | 0 | 0.00% | 0 | 0.00% | 2 | 0.02% | 0 | 0.00% | 2 |
| 2023 | KIAA0843 | AB020650.1 | 0 | 0.00% | 1 | 0.01% | 0 | 0.00% | 1 | 0.01% | 2 |
| 2024 | KIAA0847 protein | AB020654.1 | 0 | 0.00% | 2 | 0.01% | 0 | 0.00% | 0 | 0.00% | 2 |
| 2025 | KIAA0862=leucine-rich repeat protein SHOC-2 ( | AB020669 | 0 | 0.00% | 0 | 0.00% | 1 | 0.01% | 1 | 0.01% | 2 |
| 2026 | KIAA0903(ORF) | AB020710 | 0 | 0.00% | 0 | 0.00% | 2 | 0.02% | 0 | 0.00% | 2 |
| 2027 | KIAA0907 | AB020714.1 | 0 | 0.00% | 1 | 0.01% | 0 | 0.00% | 1 | 0.01% | 2 |
| 2028 | KIAA0909 protein | BAA74932.1 | 1 | 0.01% | 0 | 0.00% | 1 | 0.01% | 0 | 0.00% | 2 |
| 2029 | KIAA0911 protein (KIAA0911), | NM_014944.1 | 0 | 0.00% | 2 | 0.01% | 0 | 0.00% | 0 | 0.00% | 2 |
| 2030 | KIAA0914 gene product | NM_014883.1 | 0 | 0.00% | 1 | 0.01% | 0 | 0.00% | 1 | 0.01% | 2 |
| 2031 | KIAA0934 protein | AB023151.1 | 0 | 0.00% | 0 | 0.00% | 1 | 0.01% | 1 | 0.01% | 2 |
| 2032 | KIAA0947 | AB023164.1 | 1 | 0.01% | 0 | 0.00% | 0 | 0.00% | 1 | 0.01% | 2 |
| 2033 | KIAA0952 | AB023169.1 | 2 | 0.01% | 0 | 0.00% | 0 | 0.00% | 0 | 0.00% | 2 |
| 2034 | KIAA0955 protein (KIAA0955) | NM_014959.1 | 0 | 0.00% | 1 | 0.01% | 1 | 0.01% | 0 | 0.00% | 2 |
| 2035 | KIAA0978 | AB023195 | 0 | 0.00% | 1 | 0.01% | 0 | 0.00% | 1 | 0.01% | 2 |
| 2036 | KIAA0997 | NM_014950.1 | 0 | 0.00% | 0 | 0.00% | 1 | 0.01% | 1 | 0.01% | 2 |
| 2037 | KIAA1014 | AB023231.1 | 0 | 0.00% | 0 | 0.00% | 0 | 0.00% | 2 | 0.01% | 2 |
| 2038 | KIAA1033 | AB028956.1 | 0 | 0.00% | 0 | 0.00% | 1 | 0.01% | 1 | 0.01% | 2 |
| 2039 | KIAA1063 | AB028986.1 | 0 | 0.00% | 1 | 0.01% | 1 | 0.01% | 0 | 0.00% | 2 |
| 2040 | KIAA1064 | AB028987.1 | 1 | 0.01% | 0 | 0.00% | 0 | 0.00% | 1 | 0.01% | 2 |
| 2041 | KIAA1131 | AB032957.1 | 2 | 0.01% | 0 | 0.00% | 0 | 0.00% | 0 | 0.00% | 2 |
| 2042 | KIAA1137 | AB032963.1 | 1 | 0.01% | 0 | 0.00% | 0 | 0.00% | 1 | 0.01% | 2 |
| 2043 | KIAA1190 | AB033016.1 | 1 | 0.01% | 1 | 0.01% | 0 | 0.00% | 0 | 0.00% | 2 |
| 2044 | KIAA1223 | AB033049.1 | 0 | 0.00% | 0 | 0.00% | 0 | 0.00% | 2 | 0.01% | 2 |
| 2045 | KIAA1249 protein | AB033075.1 | 0 | 0.00% | 1 | 0.01% | 1 | 0.01% | 0 | 0.00% | 2 |
| 2046 | KIAA1287 | AB033113 | 0 | 0.00% | 2 | 0.01% | 0 | 0.00% | 0 | 0.00% | 2 |
| 2047 | KIAA1310 | AB037731.1 | 2 | 0.01% | 0 | 0.00% | 0 | 0.00% | 0 | 0.00% | 2 |
| 2048 | KIAA1338 protein | AB037759.1 | 0 | 0.00% | 0 | 0.00% | 2 | 0.02% | 0 | 0.00% | 2 |
| 2049 | KIAA1350 protein | AB037771.1 | 0 | 0.00% | 0 | 0.00% | 2 | 0.02% | 0 | 0.00% | 2 |

Figure 6 - Unique Known Genes Identified In Four cDNA Cartilage Libraries and EST Frequency Analysis - Page 37 of 102

| | | | | | | | | | | | |
|---|---|---|---|---|---|---|---|---|---|---|---|
| 2050 | KIAA1381 | AB037802 | 0 | 0.00% | 2 | 0.01% | 0 | 0.00% | 0 | 0.00% | 2 |
| 2051 | KIAA1404 | AB037825.1 | 1 | 0.01% | 1 | 0.01% | 0 | 0.00% | 0 | 0.00% | 2 |
| 2052 | KIAA1423 | AB037844.1 | 0 | 0.00% | 0 | 0.00% | 1 | 0.01% | 1 | 0.01% | 2 |
| 2053 | KIAA1424 protein | AB037845.1 | 0 | 0.00% | 1 | 0.01% | 0 | 0.00% | 1 | 0.01% | 2 |
| 2054 | KIAA1458 | AB040891.1 | 0 | 0.00% | 0 | 0.00% | 0 | 0.00% | 2 | 0.01% | 2 |
| 2055 | KIAA1507(=FLJ20654) | AB040940.1 | 1 | 0.01% | 1 | 0.01% | 0 | 0.00% | 0 | 0.00% | 2 |
| 2056 | KIAA1518 | AB040951 | 1 | 0.01% | 0 | 0.00% | 0 | 0.00% | 1 | 0.01% | 2 |
| 2057 | KIAA1519 | AB040952.1 | 2 | 0.01% | 0 | 0.00% | 0 | 0.00% | 0 | 0.00% | 2 |
| 2058 | KIAA1536 | AB040969.1 | 0 | 0.00% | 2 | 0.01% | 0 | 0.00% | 0 | 0.00% | 2 |
| 2059 | KIAA1577 | AB046797.1 | 0 | 0.00% | 2 | 0.01% | 0 | 0.00% | 0 | 0.00% | 2 |
| 2060 | KIAA1610 | AB046830.1 | 0 | 0.00% | 2 | 0.01% | 0 | 0.00% | 0 | 0.00% | 2 |
| 2061 | KIAA1633 protein | BAB13459.1 | 0 | 0.00% | 2 | 0.01% | 0 | 0.00% | 0 | 0.00% | 2 |
| 2062 | L13 protein (RefSeq aa 8e-78) | NP_054797.1 | 0 | 0.00% | 2 | 0.01% | 0 | 0.00% | 0 | 0.00% | 2 |
| 2063 | La/SS-B protein | X69804 | 0 | 0.00% | 0 | 0.00% | 1 | 0.01% | 1 | 0.01% | 2 |
| 2064 | like mouse brain protein E46(E46L) | NM_013236.1 | 0 | 0.00% | 1 | 0.01% | 0 | 0.00% | 1 | 0.01% | 2 |
| 2065 | lipoma HMGIC fusion partner (LHFP) | AF098807.1 | 0 | 0.00% | 0 | 0.00% | 0 | 0.00% | 2 | 0.01% | 2 |
| 2066 | LQFBS-1 (=AB011087 hypothetical protein (KIA | AF062385 | 1 | 0.01% | 0 | 0.00% | 0 | 0.00% | 1 | 0.01% | 2 |
| 2067 | male sterility protein 2-like protein | AJ272073 | 0 | 0.00% | 0 | 0.00% | 0 | 0.00% | 2 | 0.01% | 2 |
| 2068 | maternal G10 transcript (G10) | NM_003910.1 | 1 | 0.01% | 0 | 0.00% | 0 | 0.00% | 1 | 0.01% | 2 |
| 2069 | maternal-embryonic 3 (Mem3) | U47024 | 0 | 0.00% | 0 | 0.00% | 1 | 0.01% | 1 | 0.01% | 2 |
| 2070 | MCT-1 protein (MCT-1) | NM_014060.1 | 1 | 0.01% | 1 | 0.01% | 0 | 0.00% | 0 | 0.00% | 2 |
| 2071 | MDS011 (MDS011) | AF182424.1 | 0 | 0.00% | 2 | 0.01% | 0 | 0.00% | 0 | 0.00% | 2 |
| 2072 | MEF3L1 MEF3 like 1 | AB049150.1 | 1 | 0.01% | 0 | 0.00% | 0 | 0.00% | 0 | 0.00% | 2 |
| 2073 | melanoma antigen, family D 1 (MAGED1) | NM_006986.2 | 1 | 0.01% | 0 | 0.00% | 0 | 0.00% | 0 | 0.00% | 2 |
| 2074 | meningioma (disrupted in balanced translocatior | NM_002430.1 | 1 | 0.01% | 0 | 0.00% | 1 | 0.01% | 0 | 0.00% | 2 |
| 2075 | microspherule protein 1 (MCRS1) | NM_006337.1 | 1 | 0.01% | 1 | 0.01% | 0 | 0.00% | 0 | 0.00% | 2 |
| 2076 | neuroblastoma-amplified protein | AF056195 | 1 | 0.01% | 1 | 0.01% | 0 | 0.00% | 0 | 0.00% | 2 |
| 2077 | Neurofibromatosis 1 locus on Chromosome 17 ( | AC004526.1 | 0 | 0.00% | 1 | 0.01% | 0 | 0.00% | 1 | 0.01% | 2 |
| 2078 | NICE-5 protein =AF116721) PRO3094 | AJ243666 | 1 | 0.01% | 1 | 0.01% | 0 | 0.00% | 0 | 0.00% | 2 |
| 2079 | non-metastatic cells 1, protein (NM23A) express | 4557796 | 2 | 0.01% | 0 | 0.00% | 0 | 0.00% | 0 | 0.00% | 2 |
| 2080 | non-ocogenic Rho GTPase-specific GTP exchar | AF127481.1 | 1 | 0.01% | 1 | 0.01% | 0 | 0.00% | 0 | 0.00% | 2 |
| 2081 | NY-REN-55 antigen (=DKFZp564L2416) | AF155113.1 | 0 | 0.00% | 1 | 0.01% | 0 | 0.00% | 1 | 0.01% | 2 |
| 2082 | p45SKP2-like protein (=FLR1) | AF157323.1 | 0 | 0.00% | 1 | 0.01% | 1 | 0.01% | 0 | 0.00% | 2 |
| 2083 | p47 (=Y10769 R.norvegicus XY40 protein) (low | AF078856 | 0 | 0.00% | 1 | 0.01% | 1 | 0.01% | 0 | 0.00% | 2 |
| 2084 | partial polr2H gene for RPB8, exons 1-5, and joi | AJ252079.1 | 0 | 0.00% | 2 | 0.01% | 0 | 0.00% | 0 | 0.00% | 2 |
| 2085 | PB1 | X90849 | 0 | 0.00% | 0 | 0.00% | 1 | 0.01% | 1 | 0.01% | 2 |
| 2086 | PBK1 protein | AJ007398.1 | 1 | 0.01% | 0 | 0.00% | 1 | 0.01% | 0 | 0.00% | 2 |
| 2087 | period (Drosophila) homolog (PER) (RIGUI) (=A | AF022991 | 1 | 0.01% | 0 | 0.00% | 0 | 0.00% | 1 | 0.01% | 2 |
| 2088 | phosphoserine phosphatase-like (PSPHL) | NM_003832.1 | 1 | 0.01% | 0 | 0.00% | 1 | 0.01% | 0 | 0.00% | 2 |
| 2089 | PIBF1 protein | Y09631 | 0 | 0.00% | 0 | 0.00% | 0 | 0.00% | 2 | 0.01% | 2 |
| 2090 | PIX1 mRNA (ORF) | AF037219 | 0 | 0.00% | 1 | 0.01% | 1 | 0.01% | 0 | 0.00% | 2 |
| 2091 | PRO2160 | AF119863.1 | 2 | 0.01% | 0 | 0.00% | 0 | 0.00% | 0 | 0.00% | 2 |
| 2092 | PRO2275 | AF119873.1 | 0 | 0.00% | 1 | 0.01% | 0 | 0.00% | 0 | 0.00% | 2 |
| 2093 | PRO2898 | AF116717.1 | 2 | 0.01% | 0 | 0.00% | 0 | 0.00% | 0 | 0.00% | 2 |
| 2094 | PTD008 protein(=CGI-140 protein) | NM_016145.1 | 0 | 0.00% | 1 | 0.01% | 1 | 0.01% | 0 | 0.00% | 2 |
| 2095 | PTD009 protein (PTD009) (=HSPC172) | NM_016146.1 | 0 | 0.00% | 1 | 0.01% | 1 | 0.01% | 0 | 0.00% | 2 |
| 2096 | PTD016 protein (LOC51136) | NM_016125.1 | 0 | 0.00% | 2 | 0.01% | 0 | 0.00% | 0 | 0.00% | 2 |
| 2097 | PTPRF interacting protein, bindingprotein 1 (lipr | NP_003613.1 | 1 | 0.01% | 1 | 0.01% | 0 | 0.00% | 0 | 0.00% | 2 |
| 2098 | putative Rab5-interacting protein(RefSeq aa 6e- | NP_061328.1 | 0 | 0.00% | 2 | 0.01% | 0 | 0.00% | 0 | 0.00% | 2 |
| 2099 | RD RNA-binding protein(RDBP), mRNA | NM_002904.3 | 1 | 0.01% | 0 | 0.00% | 0 | 0.00% | 0 | 0.00% | 2 |
| 2100 | retinal short-chain dehydrogenase/reductase ret | AF061741 | 1 | 0.01% | 0 | 0.00% | 1 | 0.01% | 0 | 0.00% | 2 |
| 2101 | retrovirus-related leucine zipper protein p40 - hu | I38587 | 0 | 0.00% | 1 | 0.01% | 0 | 0.00% | 1 | 0.01% | 2 |
| 2102 | RETROVIRUS-RELATED POL POLYPROTEIN | spP11369 | 0 | 0.00% | 1 | 0.01% | 0 | 0.00% | 1 | 0.01% | 2 |
| 2103 | REV1 protein (REV1) | NM_016316.1 | 0 | 0.00% | 0 | 0.00% | 2 | 0.02% | 0 | 0.00% | 2 |
| 2104 | reversion-inducing-cysteine-rich protein with kaz | Hs.29640 | 1 | 0.01% | 0 | 0.00% | 0 | 0.00% | 1 | 0.01% | 2 |
| 2105 | rrlB operon | AF053965.1 | 0 | 0.00% | 0 | 0.00% | 0 | 0.00% | 2 | 0.01% | 2 |
| 2106 | SCID complementing gene 2 | D78188.1 | 0 | 0.00% | 0 | 0.00% | 1 | 0.01% | 1 | 0.01% | 2 |

Figure 6 - Unique Known Genes Identified In Four cDNA Cartilage Libraries and EST Frequency Analysis - Page 38 of 102

| | | | | | | | | | | | |
|---|---|---|---|---|---|---|---|---|---|---|---|
| 2107 | SEC14 (S. cerevisiae)-like 1 (SEC14L1), mRNA | NM_003003.1 | 1 | 0.01% | 0 | 0.00% | 1 | 0.01% | 0 | 0.00% | 2 |
| 2108 | SEC63 protein | AJ011779.1 | 0 | 0.00% | 0 | 0.00% | 2 | 0.02% | 0 | 0.00% | 2 |
| 2109 | single-strand selective monofunctional uracil DN | AF125182 | 1 | 0.01% | 0 | 0.00% | 1 | 0.01% | 0 | 0.00% | 2 |
| 2110 | small glutamine-rich tetratricopeptide repeat (TP | AJ223828 | 2 | 0.01% | 0 | 0.00% | 0 | 0.00% | 0 | 0.00% | 2 |
| 2111 | SP100-HMG nuclear autoantigen (SP100) | AF056322.1 | 0 | 0.00% | 0 | 0.00% | 2 | 0.02% | 0 | 0.00% | 2 |
| 2112 | sperm autoantigenic protein 17 (SPA17) | NM_017425.1 | 1 | 0.01% | 0 | 0.00% | 0 | 0.00% | 1 | 0.01% | 2 |
| 2113 | sperm specific antigen 2 (SSFA2=M61199=clea | NM_006751.1 | 0 | 0.00% | 0 | 0.00% | 1 | 0.01% | 0 | 0.00% | 2 |
| 2114 | splice variant AKAP350 | AF091711.1 | 0 | 0.00% | 1 | 0.01% | 0 | 0.00% | 0 | 0.00% | 2 |
| 2115 | stabilin-1 (stab1 gene) (=KIAA0246) | AJ275213.1 | 1 | 0.01% | 0 | 0.00% | 0 | 0.00% | 1 | 0.01% | 2 |
| 2116 | SULT1C sulfotransferase (SULT1C) | NM_006588.1 | 2 | 0.01% | 0 | 0.00% | 0 | 0.00% | 0 | 0.00% | 2 |
| 2117 | TCTEL1 (t-complex-associated-testis-expressed | D50663.1 | 0 | 0.00% | 0 | 0.00% | 1 | 0.01% | 1 | 0.01% | 2 |
| 2118 | testis specific protein | AF146738.1 | 1 | 0.01% | 1 | 0.01% | 0 | 0.00% | 0 | 0.00% | 2 |
| 2119 | TMEM1and PWP2 | AB001523.1 | 0 | 0.00% | 2 | 0.01% | 0 | 0.00% | 0 | 0.00% | 2 |
| 2120 | torsin B (DQ1) | AF007872 | 1 | 0.01% | 0 | 0.00% | 1 | 0.01% | 0 | 0.00% | 2 |
| 2121 | WD-40 repeat protein | AB024327.1 | 0 | 0.00% | 0 | 0.00% | 0 | 0.00% | 2 | 0.01% | 2 |
| 2122 | wild-type p53 activated fragment-1 (WAF1) | U03106.1 | 0 | 0.00% | 1 | 0.01% | 0 | 0.00% | 1 | 0.01% | 2 |
| 2123 | WRN (WRN) | AF181897.1 | 1 | 0.01% | 1 | 0.01% | 0 | 0.00% | 0 | 0.00% | 2 |
| 2124 | WW domain binding protein 11 | AF071186 | 1 | 0.01% | 0 | 0.00% | 0 | 0.00% | 1 | 0.01% | 2 |
| 2125 | WW domain binding protein 5 | U92454 | 0 | 0.00% | 0 | 0.00% | 2 | 0.02% | 0 | 0.00% | 2 |
| 2126 | XRP2 protein (retinitis pigmentosa 2 (X-linked re | AJ007590 | 0 | 0.00% | 0 | 0.00% | 0 | 0.00% | 2 | 0.01% | 2 |
| 2127 | annexin A6 (ANXA6) | NM_004033.1 | 2 | 0.01% | 0 | 0.00% | 0 | 0.00% | 0 | 0.00% | 2 |
| 2128 | annexin VII (synexin)(ANX7) | NM_001156.2 | 0 | 0.00% | 1 | 0.01% | 1 | 0.01% | 0 | 0.00% | 2 |
| 2129 | ATP-specific succinyl-CoA synthetase beta subu | AF058953 | 0 | 0.00% | 0 | 0.00% | 0 | 0.00% | 2 | 0.01% | 2 |
| 2130 | sodium calcium exchanger 1 (NCX1) | U83657 | 1 | 0.01% | 1 | 0.01% | 0 | 0.00% | 0 | 0.00% | 2 |
| 2131 | solute carrier family 11 (proton-coupled divalent | Hs.57435 | 0 | 0.00% | 1 | 0.01% | 0 | 0.00% | 1 | 0.01% | 2 |
| 2132 | solute carrier family 31 (copper transporters), me | NM_001860.1 | 0 | 0.00% | 1 | 0.01% | 1 | 0.01% | 0 | 0.00% | 2 |
| 2133 | 6-phosphogluconolactonase (PGLS) | NM_012088.1 | 2 | 0.01% | 0 | 0.00% | 0 | 0.00% | 0 | 0.00% | 2 |
| 2134 | aldehyde oxidase gene=AOX1) | Z99567 | 0 | 0.00% | 1 | 0.01% | 0 | 0.00% | 1 | 0.01% | 2 |
| 2135 | alpha mannosidase II | U31520.1 | 1 | 0.01% | 0 | 0.00% | 1 | 0.01% | 0 | 0.00% | 2 |
| 2136 | hexokinase 2 (HK2) | NM_000189.1 | 2 | 0.01% | 0 | 0.00% | 0 | 0.00% | 0 | 0.00% | 2 |
| 2137 | Na -D-glucose cotransport regulator gene | X82877 | 0 | 0.00% | 0 | 0.00% | 2 | 0.02% | 0 | 0.00% | 2 |
| 2138 | oligosaccharyl transferase STT3 subunit homolo | L38961 | 2 | 0.01% | 0 | 0.00% | 0 | 0.00% | 0 | 0.00% | 2 |
| 2139 | paraoxonase 2 (PON2) | NM_000305.1 | 1 | 0.01% | 1 | 0.01% | 0 | 0.00% | 0 | 0.00% | 2 |
| 2140 | phosphomannomutase | U86070.1 | 2 | 0.01% | 0 | 0.00% | 0 | 0.00% | 0 | 0.00% | 2 |
| 2141 | proteolipid protein 2 (colonic epithelium-enriched | NM_002668.1 | 0 | 0.00% | 2 | 0.01% | 0 | 0.00% | 0 | 0.00% | 2 |
| 2142 | RGL protein (RGL) | AF186779.1 | 0 | 0.00% | 2 | 0.01% | 0 | 0.00% | 0 | 0.00% | 2 |
| 2143 | UDP-N-acetyl-alpha-D-galactosamine:polypeptid | gi8393408 | 0 | 0.00% | 0 | 0.00% | 1 | 0.01% | 1 | 0.01% | 2 |
| 2144 | protein phosphatase methylesterase-1 (PME-1) | NM_016147.1 | 1 | 0.01% | 0 | 0.00% | 0 | 0.00% | 1 | 0.01% | 2 |
| 2145 | protein tyrosine phosphatase, receptor type, F (F | NM_002840.1 | 0 | 0.00% | 1 | 0.01% | 0 | 0.00% | 1 | 0.01% | 2 |
| 2146 | protein x 0004 (ORF) | AF117229 | 0 | 0.00% | 1 | 0.01% | 0 | 0.00% | 1 | 0.01% | 2 |
| 2147 | protein x 013 | AF164793.1 | 2 | 0.01% | 0 | 0.00% | 0 | 0.00% | 0 | 0.00% | 2 |
| 2148 | TPI1 gene for triosephosphate isomerase | X69723.1 | 1 | 0.01% | 1 | 0.01% | 0 | 0.00% | 0 | 0.00% | 2 |
| 2149 | adenosine deaminase, RNA-specific (ADAR), tra | gi7669474 | 0 | 0.00% | 0 | 0.00% | 2 | 0.02% | 0 | 0.00% | 2 |
| 2150 | adenylosuccinate lyase(ADSL) | NM_000026.1 | 1 | 0.01% | 1 | 0.01% | 0 | 0.00% | 0 | 0.00% | 2 |
| 2151 | adenylosuccinate synthetase | X66503 | 1 | 0.01% | 0 | 0.00% | 0 | 0.00% | 1 | 0.01% | 2 |
| 2152 | deoxyguanosine kinase (DGUOK) | NM_001929.1 | 2 | 0.01% | 0 | 0.00% | 0 | 0.00% | 0 | 0.00% | 2 |
| 2153 | deoxyribonuclease II | AF060222.1 | 0 | 0.00% | 1 | 0.01% | 0 | 0.00% | 1 | 0.01% | 2 |
| 2154 | inositol (myo)-1(or 4)-monophosphatase 1 (IMPA | NM_005536.2 | 0 | 0.00% | 2 | 0.01% | 0 | 0.00% | 0 | 0.00% | 2 |
| 2155 | nucleotide pyrophosphatase (=plasma cell meml | D12485.1 | 0 | 0.00% | 0 | 0.00% | 0 | 0.00% | 2 | 0.01% | 2 |
| 2156 | p53R2 gene for ribonucleotide reductase, exon 9 | AB036532.1 | 0 | 0.00% | 0 | 0.00% | 0 | 0.00% | 2 | 0.01% | 2 |
| 2157 | phosphoribosyl pyrophosphate synthetase-asso | NM_002767.1 | 0 | 0.00% | 0 | 0.00% | 0 | 0.00% | 2 | 0.01% | 2 |
| 2158 | phosphoribosylglycinamide formyltransferase (P | M32082.1 | 0 | 0.00% | 0 | 0.00% | 0 | 0.00% | 2 | 0.01% | 2 |
| 2159 | purine nucleoside phosphorylase | X00737 | 1 | 0.01% | 1 | 0.01% | 0 | 0.00% | 0 | 0.00% | 2 |
| 2160 | thymidylate synthase | D00596 | 2 | 0.01% | 0 | 0.00% | 0 | 0.00% | 0 | 0.00% | 2 |
| 2161 | 1-acylglycerol-3-phosphate O-acyltransferase | Y09565.1 | 2 | 0.01% | 0 | 0.00% | 0 | 0.00% | 0 | 0.00% | 2 |
| 2162 | adaptor protein p150 | Y08991 | 1 | 0.01% | 0 | 0.00% | 0 | 0.00% | 1 | 0.01% | 2 |
| 2163 | mutant cerebroside sulfate activator protein (SAF | M60258 | 2 | 0.01% | 0 | 0.00% | 0 | 0.00% | 0 | 0.00% | 2 |

Figure 6 - Unique Known Genes Identified In Four cDNA Cartilage Libraries and EST Frequency Analysis - Page 39 of 102

| | | | | | | | | | | | |
|---|---|---|---|---|---|---|---|---|---|---|---|
| 2164 | Niemann-Pick C disease protein (NPC1) | AF002020.1 | 0 | 0.00% | 0 | 0.00% | 0 | 0.00% | 2 | 0.01% | 2 |
| 2165 | 5-methyltetrahydrofolate-homocysteine methyltra | NM_000254.1 | 0 | 0.00% | 2 | 0.01% | 0 | 0.00% | 0 | 0.00% | 2 |
| 2166 | AAPT1-like protein | AF047431.1 | 1 | 0.01% | 0 | 0.00% | 1 | 0.01% | 0 | 0.00% | 2 |
| 2167 | acetyl-coenzyme A transporter | D88152 | 1 | 0.01% | 0 | 0.00% | 0 | 0.00% | 1 | 0.01% | 2 |
| 2168 | ARF protein | NM_016632.1 | 0 | 0.00% | 1 | 0.01% | 0 | 0.00% | 1 | 0.01% | 2 |
| 2169 | attractin precursor (ATRN) gene | AF218915.1 | 1 | 0.01% | 0 | 0.00% | 0 | 0.00% | 1 | 0.01% | 2 |
| 2170 | biliverdin reductase A (BLVRA) | NM_000712.1 | 1 | 0.01% | 0 | 0.00% | 1 | 0.01% | 0 | 0.00% | 2 |
| 2171 | choline/ethanolaminephosphotransferase (CEPT | NM_006090.1 | 0 | 0.00% | 2 | 0.01% | 0 | 0.00% | 0 | 0.00% | 2 |
| 2172 | enoyl-CoA hydratase/3-hydroxyacyl-CoA dehydr | D16480 | 1 | 0.01% | 1 | 0.01% | 0 | 0.00% | 0 | 0.00% | 2 |
| 2173 | galactocerebrosidase (GALC) gene | L38559 | 0 | 0.00% | 0 | 0.00% | 1 | 0.01% | 1 | 0.01% | 2 |
| 2174 | hydroxysteroid (17-beta) dehydrogenase 4 (HSD | NM_000414.1 | 0 | 0.00% | 1 | 0.01% | 0 | 0.00% | 1 | 0.01% | 2 |
| 2175 | methylmalonyl-CoA mutase (MCM) | M65131 | 0 | 0.00% | 1 | 0.01% | 1 | 0.01% | 0 | 0.00% | 2 |
| 2176 | nucleus-encoded mitochondrial aldehyde dehydı | M20456.1 | 0 | 0.00% | 1 | 0.01% | 0 | 0.00% | 1 | 0.01% | 2 |
| 2177 | phospholipase C beta 4 (PLCB4) | L41349 | 0 | 0.00% | 0 | 0.00% | 2 | 0.02% | 0 | 0.00% | 2 |
| 2178 | phospholipase C-beta-3 (PLCB3) | U26425.1 | 2 | 0.01% | 0 | 0.00% | 0 | 0.00% | 0 | 0.00% | 2 |
| 2179 | transacylase (DBT) | X66785 | 2 | 0.01% | 0 | 0.00% | 0 | 0.00% | 0 | 0.00% | 2 |
| 2180 | cytochrome c oxidase assembly protein COX11 | AF044321 | 0 | 0.00% | 0 | 0.00% | 2 | 0.02% | 0 | 0.00% | 2 |
| 2181 | cytochrome c oxidase subunit VIa gene | U83702.1 | 1 | 0.01% | 0 | 0.00% | 0 | 0.00% | 1 | 0.01% | 2 |
| 2182 | mitochondrial 75 kDa iron sulphur protein | X61100 | 1 | 0.01% | 0 | 0.00% | 0 | 0.00% | 1 | 0.01% | 2 |
| 2183 | mitochondrial carrier homologue 2 | AF176008.1 | 0 | 0.00% | 1 | 0.01% | 1 | 0.01% | 0 | 0.00% | 2 |
| 2184 | mitochondrial carrier protein ARALAR1 | Y14494 | 0 | 0.00% | 0 | 0.00% | 2 | 0.02% | 0 | 0.00% | 2 |
| 2185 | mitochondrial cytochrome c oxidase Va subunit | M22760 | 1 | 0.01% | 0 | 0.00% | 0 | 0.00% | 1 | 0.01% | 2 |
| 2186 | mitochondrial inner membrane translocase Tim2 | AF030162.1 | 1 | 0.01% | 0 | 0.00% | 1 | 0.01% | 0 | 0.00% | 2 |
| 2187 | NAD+-specific isocitrate dehydrogenase beta su | U49283 | 2 | 0.01% | 0 | 0.00% | 0 | 0.00% | 0 | 0.00% | 2 |
| 2188 | NADH dehydrogenase (ubiquinone) Fe-Sprotein | NP_004543.1 | 0 | 0.00% | 1 | 0.01% | 0 | 0.00% | 0 | 0.00% | 2 |
| 2189 | NADH dehydrogenase (ubiquinone) flavoprotein | NM_021074.1 | 0 | 0.00% | 1 | 0.01% | 0 | 0.00% | 1 | 0.01% | 2 |
| 2190 | NADH dehydrogenase subunit {heteroplasmic G | S73804 | 0 | 0.00% | 2 | 0.01% | 0 | 0.00% | 0 | 0.00% | 2 |
| 2191 | NADH dehydrogenase(ubiquinone) 1, subcompl | NM_004549.1 | 1 | 0.01% | 0 | 0.00% | 0 | 0.00% | 1 | 0.01% | 2 |
| 2192 | NADH dehydrogenase-ubiquinone Fe-S protein | AF038406 | 1 | 0.01% | 0 | 0.00% | 0 | 0.00% | 1 | 0.01% | 2 |
| 2193 | NADH:ubiquinone dehydrogenase 51 kDa subur | AF053070 | 2 | 0.01% | 0 | 0.00% | 0 | 0.00% | 0 | 0.00% | 2 |
| 2194 | NADH:ubiquinone oxidoreductase B17 subunit | AF035840.1 | 1 | 0.01% | 0 | 0.00% | 1 | 0.01% | 0 | 0.00% | 2 |
| 2195 | oxidase (cytochrome c) assembly 1-like (OXA1L | NM_005015.1 | 2 | 0.01% | 0 | 0.00% | 0 | 0.00% | 0 | 0.00% | 2 |
| 2196 | PNAS-105 (=NADH dehydrogenase subunit 2 (N | AF275801.1 | 0 | 0.00% | 2 | 0.01% | 0 | 0.00% | 0 | 0.00% | 2 |
| 2197 | QUINONE OXIDOREDUCTASE (NADPH:QUIN | spQ08257 | 0 | 0.00% | 0 | 0.00% | 1 | 0.01% | 1 | 0.01% | 2 |
| 2198 | succinyl CoA:3-oxoacid CoA transferase precurs | U62961.1 | 0 | 0.00% | 0 | 0.00% | 0 | 0.00% | 2 | 0.01% | 2 |
| 2199 | ubiquilin 2 (UBQLN2) | NM_013444.1 | 0 | 0.00% | 0 | 0.00% | 2 | 0.02% | 0 | 0.00% | 2 |
| 2200 | antizyme inhibitor | NM_015878.1 | 0 | 0.00% | 2 | 0.01% | 0 | 0.00% | 0 | 0.00% | 2 |
| 2201 | arginase, type II (ARG2), nuclear gene encoding | NM_001172.2 | 0 | 0.00% | 2 | 0.01% | 0 | 0.00% | 0 | 0.00% | 2 |
| 2202 | Asparaginyl tRNA Synthetase (NARS) | D84273 | 0 | 0.00% | 0 | 0.00% | 2 | 0.02% | 0 | 0.00% | 2 |
| 2203 | dolichyl-phosphate mannosyltransferase polype | NM_003859.1 | 1 | 0.01% | 1 | 0.01% | 0 | 0.00% | 0 | 0.00% | 2 |
| 2204 | Fas-activated serine/threonine kinase (FASTK) | NM_006712.1 | 2 | 0.01% | 0 | 0.00% | 0 | 0.00% | 0 | 0.00% | 2 |
| 2205 | golgi phosphoprotein 1 (GOLPH1) | XM_037292.1 | 1 | 0.01% | 0 | 0.00% | 0 | 0.00% | 0 | 0.00% | 2 |
| 2206 | isopentenyl-diphosphate delta isomerase (IDI1)( | NM_004508.1 | 0 | 0.00% | 1 | 0.01% | 0 | 0.00% | 0 | 0.00% | 2 |
| 2207 | isoprenylcysteine carboxyl methyltransferase (IC | NM_012405.1 | 1 | 0.01% | 0 | 0.00% | 0 | 0.00% | 1 | 0.01% | 2 |
| 2208 | leucine zipper, down-regulated in cancer 1 (LDC | NM_012317.1 | 1 | 0.01% | 1 | 0.01% | 0 | 0.00% | 0 | 0.00% | 2 |
| 2209 | leucine-rich protein | M92439.1 | 0 | 0.00% | 2 | 0.01% | 0 | 0.00% | 0 | 0.00% | 2 |
| 2210 | lysyl hydroxylase (=L06419) | M98252 | 2 | 0.01% | 0 | 0.00% | 0 | 0.00% | 0 | 0.00% | 2 |
| 2211 | Npw38-binding protein NpwBP (LOC51729) | NM_016312.1 | 0 | 0.00% | 2 | 0.01% | 0 | 0.00% | 0 | 0.00% | 2 |
| 2212 | ORNITHINE DECARBOXYLASE (ODC) | spP00860 | 1 | 0.01% | 1 | 0.01% | 0 | 0.00% | 0 | 0.00% | 2 |
| 2213 | phenylalanyl-tRNA synthetase beta-subunit; Phe | NP_005678.1 | 0 | 0.00% | 2 | 0.01% | 0 | 0.00% | 0 | 0.00% | 2 |
| 2214 | proline arginine-rich end leucine-rich repeat prot | NM_002725.1 | 0 | 0.00% | 0 | 0.00% | 1 | 0.01% | 1 | 0.01% | 2 |
| 2215 | Proline synthetase associated | AB018566.1 | 0 | 0.00% | 1 | 0.01% | 1 | 0.01% | 0 | 0.00% | 2 |
| 2216 | S-adenosyl homocysteine hydrolase homolog (X | U82761 | 1 | 0.01% | 0 | 0.00% | 1 | 0.01% | 0 | 0.00% | 2 |
| 2217 | cytidine monophosphate kinase CMP mRNA, (= | AF259961.1 | 0 | 0.00% | 2 | 0.01% | 0 | 0.00% | 0 | 0.00% | 2 |
| 2218 | selenoprotein T(LOC51714) | NM_016275.1 | 0 | 0.00% | 0 | 0.00% | 1 | 0.01% | 1 | 0.01% | 2 |
| 2219 | eukaryotic translation initiation factor 2 alpha kin | AF110146 | 0 | 0.00% | 0 | 0.00% | 1 | 0.01% | 1 | 0.01% | 2 |
| 2220 | eukaryotic translation initiation factor 2, subunit | gi4758255 | 0 | 0.00% | 1 | 0.01% | 0 | 0.00% | 1 | 0.01% | 2 |

Figure 6 - Unique Known Genes Identified In Four cDNA Cartilage Libraries and EST Frequency Analysis - Page 40 of 102

| | | | | | | | | | | | |
|---|---|---|---|---|---|---|---|---|---|---|---|
| 2221 | eukaryotic translation initiation factor 3, subunit 1 | NM_003758.1 | 0 | 0.00% | 1 | 0.01% | 0 | 0.00% | 1 | 0.01% | 2 |
| 2222 | EUKARYOTIC TRANSLATION INITIATION FAC | spP55010 | 0 | 0.00% | 0 | 0.00% | 1 | 0.01% | 1 | 0.01% | 2 |
| 2223 | fasciculation and elongation protein zeta 2 (zygin | NM_005102.1 | 1 | 0.01% | 0 | 0.00% | 0 | 0.00% | 1 | 0.01% | 2 |
| 2224 | homolog of rat elongation factor p18 (P18) | NM_004280.1 | 0 | 0.00% | 1 | 0.01% | 0 | 0.00% | 1 | 0.01% | 2 |
| 2225 | mitochondrial translational release factor 1 | AF072934 | 1 | 0.01% | 0 | 0.00% | 1 | 0.01% | 0 | 0.00% | 2 |
| 2226 | translation initiation factor eIF-2alpha | U26032.1 | 0 | 0.00% | 2 | 0.01% | 0 | 0.00% | 0 | 0.00% | 2 |
| 2227 | translational inhibitor protein p14.5 (UK114) = X9 | NM_005836.1 | 0 | 0.00% | 0 | 0.00% | 1 | 0.01% | 1 | 0.01% | 2 |
| 2228 | translin associated protein X | X95073 | 0 | 0.00% | 0 | 0.00% | 1 | 0.01% | 1 | 0.01% | 2 |
| 2229 | Tu translation elongation factor, mitochondrial (T | NM_003321.1 | 1 | 0.01% | 0 | 0.00% | 0 | 0.00% | 1 | 0.01% | 2 |
| 2230 | unr protein (=AB020692 KIAA0885) | AF077054.1 | 0 | 0.00% | 0 | 0.00% | 0 | 0.00% | 2 | 0.01% | 2 |
| 2231 | arginyl-tRNA synthetase (RARS) | NM_002887.1 | 1 | 0.01% | 0 | 0.00% | 0 | 0.00% | 1 | 0.01% | 2 |
| 2232 | 5.8S ribosomal RNA | J01866.1 | 1 | 0.01% | 0 | 0.00% | 0 | 0.00% | 1 | 0.01% | 2 |
| 2233 | mitochondrial ribosomal protein S11 (MRPS11), | Hs.111286 | 1 | 0.01% | 0 | 0.00% | 0 | 0.00% | 1 | 0.01% | 2 |
| 2234 | mitochondrial ribosomal protein S33 (MRPS33), | Hs.83006 | 1 | 0.01% | 0 | 0.00% | 0 | 0.00% | 1 | 0.01% | 2 |
| 2235 | PRO1181 (=ribosomal protein L29(RPL29))(= ce | AF116627.1 | 2 | 0.01% | 0 | 0.00% | 0 | 0.00% | 0 | 0.00% | 2 |
| 2236 | alpha-1-antitrypsin | K01396.1 | 1 | 0.01% | 1 | 0.01% | 0 | 0.00% | 0 | 0.00% | 2 |
| 2237 | amyloid beta precursor protein-binding protein 1, | NM_003905.1 | 0 | 0.00% | 0 | 0.00% | 2 | 0.02% | 0 | 0.00% | 2 |
| 2238 | antiseCRetory factor-1 (=U51007 26S protease s | U24704 | 2 | 0.01% | 0 | 0.00% | 0 | 0.00% | 0 | 0.00% | 2 |
| 2239 | ATP-dependent metalloprotease YME1L (contai | AJ132637.1 | 0 | 0.00% | 0 | 0.00% | 1 | 0.01% | 1 | 0.01% | 2 |
| 2240 | matrix metalloproteinase 13 (collagenase 3) (MM | NM_002427.1 | 1 | 0.01% | 0 | 0.00% | 0 | 0.00% | 1 | 0.01% | 2 |
| 2241 | matrix metalloproteinase 15 (membrane-inserted | NM_002428.1 | 2 | 0.01% | 0 | 0.00% | 0 | 0.00% | 0 | 0.00% | 2 |
| 2242 | matrix metalloproteinase 2 (gelatinase A, 72kD g | XM_048244.1 | 1 | 0.01% | 0 | 0.00% | 0 | 0.00% | 0 | 0.00% | 2 |
| 2243 | matrix metalloproteinase 9 (gelatinase B, 92kD g | NM_004994.1 | 0 | 0.00% | 1 | 0.01% | 0 | 0.00% | 0 | 0.00% | 2 |
| 2244 | MB1 (=D29011 proteasome subunit X) | X95586 | 0 | 0.00% | 1 | 0.01% | 1 | 0.01% | 0 | 0.00% | 2 |
| 2245 | mitogen-activated kinase kinase kinase 5 (MAPK | U67156 | 0 | 0.00% | 0 | 0.00% | 2 | 0.02% | 0 | 0.00% | 2 |
| 2246 | peptidase homolog | AF010141 | 2 | 0.01% | 0 | 0.00% | 0 | 0.00% | 0 | 0.00% | 2 |
| 2247 | plasminogen activator inhibitor-1 | J03764 | 1 | 0.01% | 0 | 0.00% | 0 | 0.00% | 1 | 0.01% | 2 |
| 2248 | proteasome activator hPA28 subunit beta | D45248 | 1 | 0.01% | 0 | 0.00% | 0 | 0.00% | 1 | 0.01% | 2 |
| 2249 | proteasome subunit p42 | D78275 | 0 | 0.00% | 0 | 0.00% | 1 | 0.01% | 1 | 0.01% | 2 |
| 2250 | protein associated with Myc (=AB020723 KIAA0 | AF075587.1 | 0 | 0.00% | 1 | 0.01% | 1 | 0.01% | 0 | 0.00% | 2 |
| 2251 | protein associated with PRK1 (AWP1), mRNA /c | Hs.83954 | 0 | 0.00% | 0 | 0.00% | 2 | 0.02% | 0 | 0.00% | 2 |
| 2252 | protein regulator of cytokinesis 1 (PRC1) | NM_003981.1 | 2 | 0.01% | 0 | 0.00% | 0 | 0.00% | 0 | 0.00% | 2 |
| 2253 | sorting nexin 14 (SNX14) | AF121863.1 | 0 | 0.00% | 0 | 0.00% | 1 | 0.01% | 1 | 0.01% | 2 |
| 2254 | sorting nexin 4 | AF065485 | 0 | 0.00% | 0 | 0.00% | 2 | 0.02% | 0 | 0.00% | 2 |
| 2255 | sorting nexin 5 (SNX5) | AF121855.1 | 0 | 0.00% | 0 | 0.00% | 0 | 0.00% | 2 | 0.01% | 2 |
| 2256 | sorting nexin 7 (SNX7) | AF121857.1 | 0 | 0.00% | 0 | 0.00% | 0 | 0.00% | 2 | 0.01% | 2 |
| 2257 | TIMP3 tissue inhibitor of metalloproteinases-3 | X76227 | 0 | 0.00% | 0 | 0.00% | 1 | 0.01% | 1 | 0.01% | 2 |
| 2258 | BRCA1 associated protein 1 (BAP1) | AF045581 | 2 | 0.01% | 0 | 0.00% | 0 | 0.00% | 0 | 0.00% | 2 |
| 2259 | coated vesicle membrane protein (RNP24) | NM_006815.1 | 0 | 0.00% | 1 | 0.01% | 1 | 0.01% | 0 | 0.00% | 2 |
| 2260 | F-box protein 7 (FBX7) | NM_012179.1 | 1 | 0.01% | 1 | 0.01% | 0 | 0.00% | 0 | 0.00% | 2 |
| 2261 | KDEL receptor(Xenopus laevis) | AL035081 | 1 | 0.01% | 0 | 0.00% | 1 | 0.01% | 0 | 0.00% | 2 |
| 2262 | peroxisomal biogenesis factor 12 (PEX12) | NM_000286.1 | 1 | 0.01% | 1 | 0.01% | 0 | 0.00% | 0 | 0.00% | 2 |
| 2263 | peroxisomal D3,D2-enoyl-CoA isomerase (PECI | AF153612 | 0 | 0.00% | 0 | 0.00% | 2 | 0.02% | 0 | 0.00% | 2 |
| 2264 | peroxisomal enoyl-CoA hydratase-like protein (H | U16660 | 2 | 0.01% | 0 | 0.00% | 0 | 0.00% | 0 | 0.00% | 2 |
| 2265 | peroxisomal farnesylated protein (PXF) | NM_002857.1 | 0 | 0.00% | 1 | 0.01% | 0 | 0.00% | 1 | 0.01% | 2 |
| 2266 | rapamycin-binding protein (FKBP25) (=M90309) | M90820 | 1 | 0.01% | 0 | 0.00% | 0 | 0.00% | 1 | 0.01% | 2 |
| 2267 | signal recognition particle (SRP54) | U51920 | 0 | 0.00% | 1 | 0.01% | 0 | 0.00% | 1 | 0.01% | 2 |
| 2268 | signal recognition particle 72kD (SRP72)(ORF) | NM_006947.1 | 0 | 0.00% | 1 | 0.01% | 1 | 0.01% | 0 | 0.00% | 2 |
| 2269 | stimulator of TAR RNA binding (SRB) (=AF0262 | U38846 | 1 | 0.01% | 0 | 0.00% | 1 | 0.01% | 0 | 0.00% | 2 |
| 2270 | ubiquitin conjugating enzyme, UbcH6 | X92963 | 0 | 0.00% | 0 | 0.00% | 1 | 0.01% | 1 | 0.01% | 2 |
| 2271 | ubiquitin C-terminal hydrolase UCH37 (UCH37) | AF147717.1 | 0 | 0.00% | 0 | 0.00% | 2 | 0.02% | 0 | 0.00% | 2 |
| 2272 | ubiquitin hydrolyzing enzyme I (UBH1) | AF022789 | 0 | 0.00% | 1 | 0.01% | 0 | 0.00% | 1 | 0.01% | 2 |
| 2273 | ubiquitin-52 amino acid fusion protein | X56998.1 | 0 | 0.00% | 0 | 0.00% | 0 | 0.00% | 2 | 0.01% | 2 |
| 2274 | ubiquitin-conjugating enzyme E2D 3 (homologou | NM_003340.1 | 0 | 0.00% | 0 | 0.00% | 1 | 0.01% | 1 | 0.01% | 2 |
| 2275 | ubiquitin-conjugating enzyme E2L 6 (UBE2L6) = | NM_004223.1 | 0 | 0.00% | 0 | 0.00% | 1 | 0.01% | 1 | 0.01% | 2 |
| 2276 | ubiquitin-conjugating enzyme UbcH2 | Z29331 | 1 | 0.01% | 0 | 0.00% | 1 | 0.01% | 0 | 0.00% | 2 |
| 2277 | ubiquitously-expressed transCRipt (UXT)(ORF)= | NM_004182.1 | 0 | 0.00% | 0 | 0.00% | 0 | 0.00% | 2 | 0.01% | 2 |

Figure 6 - Unique Known Genes Identified In Four cDNA Cartilage Libraries and EST Frequency Analysis - Page 41 of 102

| | | | | | | | | | | | |
|---|---|---|---|---|---|---|---|---|---|---|---|
| 2278 | WDR1 protein | AF020260 | 0 | 0.00% | 0 | 0.00% | 1 | 0.01% | 1 | 0.01% | 2 |
| 2279 | bithoraxoid-like protein (BLP)(= HSPC162 protei | AF165516.1 | 1 | 0.01% | 1 | 0.01% | 0 | 0.00% | 0 | 0.00% | 2 |
| 2280 | glioma-amplified sequence-41 (GAS41) | NM_006530.1 | 1 | 0.01% | 1 | 0.01% | 0 | 0.00% | 0 | 0.00% | 2 |
| 2281 | MAT-1 oncogene (HUMMAT1H) (=PEA15) | NM_013287.1 | 1 | 0.01% | 0 | 0.00% | 1 | 0.01% | 0 | 0.00% | 2 |
| 2282 | methyl-CpG binding protein 1 (MBD1) | AF120982.1 | 1 | 0.01% | 0 | 0.00% | 0 | 0.00% | 1 | 0.01% | 2 |
| 2283 | methyl-CpG binding protein MBD4 | AAC68879.1 | 1 | 0.01% | 0 | 0.00% | 0 | 0.00% | 1 | 0.01% | 2 |
| 2284 | 33 kDa transcriptional co-activator (CRSP33) (=I | NM_004270.1 | 0 | 0.00% | 0 | 0.00% | 2 | 0.02% | 0 | 0.00% | 2 |
| 2285 | ataxia telangiectasia and Rad3 related (ATR) | NM_001184.1 | 0 | 0.00% | 2 | 0.01% | 0 | 0.00% | 0 | 0.00% | 2 |
| 2286 | B cell RAG associated protein (BRAG) (=AB011 | AF026477 | 1 | 0.01% | 1 | 0.01% | 0 | 0.00% | 0 | 0.00% | 2 |
| 2287 | B-cell CLL/lymphoma 6 (zinc finger protein 51) (I | NM_001706.1 | 1 | 0.01% | 0 | 0.00% | 1 | 0.01% | 0 | 0.00% | 2 |
| 2288 | bromodomain adjacent to zinc finger domain, 2A | NP_038477.1 | 0 | 0.00% | 2 | 0.01% | 0 | 0.00% | 0 | 0.00% | 2 |
| 2289 | CAAT-box DNA binding protein subunit B (NF-YI | X59710 | 0 | 0.00% | 1 | 0.01% | 1 | 0.01% | 0 | 0.00% | 2 |
| 2290 | CAG-isl 7 | U16738.1 | 2 | 0.01% | 0 | 0.00% | 0 | 0.00% | 0 | 0.00% | 2 |
| 2291 | CBF1 interacting corepressor CIR (=U03644.1 re | AF098297.1 | 0 | 0.00% | 1 | 0.01% | 1 | 0.01% | 0 | 0.00% | 2 |
| 2292 | CCR4-associated factor 1 (POP2) | AF053318 | 2 | 0.01% | 0 | 0.00% | 0 | 0.00% | 0 | 0.00% | 2 |
| 2293 | cellular oncogene c-fos (=K00650) | V01512 | 2 | 0.01% | 0 | 0.00% | 0 | 0.00% | 0 | 0.00% | 2 |
| 2294 | chromatin-specific transCRiption elongation fact | AF152961.1 | 0 | 0.00% | 0 | 0.00% | 0 | 0.00% | 2 | 0.01% | 2 |
| 2295 | class I histone deacetylase (HDAC8) | AF230097.1 | 2 | 0.01% | 0 | 0.00% | 0 | 0.00% | 0 | 0.00% | 2 |
| 2296 | ets variant gene 5 (ets-related molecule) (ETV5) | NM_004454.1 | 0 | 0.00% | 1 | 0.01% | 0 | 0.00% | 1 | 0.01% | 2 |
| 2297 | GC box binding protein | D31716 | 0 | 0.00% | 0 | 0.00% | 2 | 0.02% | 0 | 0.00% | 2 |
| 2298 | hepatocellular carcinoma novel gene-3 protein (I | NM_016651.2 | 2 | 0.01% | 0 | 0.00% | 0 | 0.00% | 0 | 0.00% | 2 |
| 2299 | HMG-2 | X62534.1 | 2 | 0.01% | 0 | 0.00% | 0 | 0.00% | 0 | 0.00% | 2 |
| 2300 | Id2 protein (Id-2) | M69293.1 | 0 | 0.00% | 1 | 0.01% | 1 | 0.01% | 0 | 0.00% | 2 |
| 2301 | interferon regulatory factor 2 (IRF2) | NM_002199.2 | 1 | 0.01% | 0 | 0.00% | 1 | 0.01% | 0 | 0.00% | 2 |
| 2302 | jun D proto-oncogene (JUND) | NM_005354.1 | 1 | 0.01% | 1 | 0.01% | 0 | 0.00% | 0 | 0.00% | 2 |
| 2303 | kaiso (ZNF-kaiso) | gi5803228 | 0 | 0.00% | 0 | 0.00% | 1 | 0.01% | 1 | 0.01% | 2 |
| 2304 | KRAB domain zinc finger protein (ZFP37) | AF022158 | 0 | 0.00% | 0 | 0.00% | 0 | 0.00% | 2 | 0.01% | 2 |
| 2305 | mel transforming oncogene (derived from cell lin | NM_005370.2 | 1 | 0.01% | 1 | 0.01% | 0 | 0.00% | 0 | 0.00% | 2 |
| 2306 | microphthalmia-associated transcription factor (I | NM_000248.1 | 0 | 0.00% | 1 | 0.01% | 1 | 0.01% | 0 | 0.00% | 2 |
| 2307 | NF-kappa-B transCRiption factor p65 subunit | L19067 | 1 | 0.01% | 0 | 0.00% | 0 | 0.00% | 1 | 0.01% | 2 |
| 2308 | nuclear factor NF-IL6 | X52560.1 | 0 | 0.00% | 1 | 0.01% | 0 | 0.00% | 1 | 0.01% | 2 |
| 2309 | nuclear factor of activated T-cells, cytoplasmic 4 | NM_004554.1 | 1 | 0.01% | 1 | 0.01% | 0 | 0.00% | 0 | 0.00% | 2 |
| 2310 | promyelocytic leukemia zinc finger protein (PLZF | AF060568 | 0 | 0.00% | 2 | 0.01% | 0 | 0.00% | 0 | 0.00% | 2 |
| 2311 | putative transCRiption factor, partial | AJ009770 | 0 | 0.00% | 0 | 0.00% | 2 | 0.02% | 0 | 0.00% | 2 |
| 2312 | RE1-silencing transCRiption factor (REST) | NM_005612.1 | 0 | 0.00% | 1 | 0.01% | 0 | 0.00% | 1 | 0.01% | 2 |
| 2313 | retinoblastoma-binding protein 1; RBP1 (RefSeq | NP_002883.1 | 0 | 0.00% | 2 | 0.01% | 0 | 0.00% | 0 | 0.00% | 2 |
| 2314 | retinoblastoma-binding protein 2 (RBBP2) | NM_005056.1 | 0 | 0.00% | 0 | 0.00% | 1 | 0.01% | 1 | 0.01% | 2 |
| 2315 | SEF2-1A protein (SEF2-1A) | M74718.1 | 1 | 0.01% | 0 | 0.00% | 0 | 0.00% | 1 | 0.01% | 2 |
| 2316 | seven in absentia (Drosophila) homolog 1 (SIAH | NM_003031.1 | 0 | 0.00% | 2 | 0.01% | 0 | 0.00% | 0 | 0.00% | 2 |
| 2317 | small zinc finger-like protein (DDP2) | AF150087.1 | 0 | 0.00% | 0 | 0.00% | 0 | 0.00% | 2 | 0.01% | 2 |
| 2318 | target of myb 1 (TOM1) | AJ006973.1 | 2 | 0.01% | 0 | 0.00% | 0 | 0.00% | 0 | 0.00% | 2 |
| 2319 | TG-interacting factor (TALE family homeobox) (T | NM_003244.1 | 0 | 0.00% | 2 | 0.01% | 0 | 0.00% | 0 | 0.00% | 2 |
| 2320 | thyroid hormone receptor-associated protein cor | AF117756.1 | 0 | 0.00% | 1 | 0.01% | 0 | 0.00% | 1 | 0.01% | 2 |
| 2321 | thyroid receptor interactor trip15 | AF100762.1 | 0 | 0.00% | 2 | 0.01% | 0 | 0.00% | 0 | 0.00% | 2 |
| 2322 | transCRiption elongation factor A (SII)-like 1 | M99701 | 0 | 0.00% | 0 | 0.00% | 0 | 0.00% | 2 | 0.01% | 2 |
| 2323 | transCRiption factor ETR101 | M62831 | 1 | 0.01% | 1 | 0.01% | 0 | 0.00% | 0 | 0.00% | 2 |
| 2324 | transcription factor IIB | AF093680 | 2 | 0.01% | 0 | 0.00% | 0 | 0.00% | 0 | 0.00% | 2 |
| 2325 | transCRiption factor TFIID subunit TAFII28 | X83928 | 2 | 0.01% | 0 | 0.00% | 0 | 0.00% | 0 | 0.00% | 2 |
| 2326 | transCRiption factor WSTF (=AF084479 William | AF072810 | 0 | 0.00% | 1 | 0.01% | 0 | 0.00% | 1 | 0.01% | 2 |
| 2327 | zinc finger protein (MAZ) (=KNSL4, MAZ) | M94046.1 | 2 | 0.01% | 0 | 0.00% | 0 | 0.00% | 0 | 0.00% | 2 |
| 2328 | zinc finger protein (ZFD25) (62% aa) | AB027251 | 0 | 0.00% | 1 | 0.01% | 1 | 0.01% | 0 | 0.00% | 2 |
| 2329 | zinc finger protein 137 (ZNF137) | NM_003438.1 | 0 | 0.00% | 1 | 0.01% | 1 | 0.01% | 0 | 0.00% | 2 |
| 2330 | zinc finger protein 261 (ZNF261) (=AB002383 KI | gi4827066 | 2 | 0.01% | 0 | 0.00% | 0 | 0.00% | 0 | 0.00% | 2 |
| 2331 | zinc finger protein 264 (ZNF264), mRNA /cds=(3 | Hs.117077 | 0 | 0.00% | 0 | 0.00% | 0 | 0.00% | 1 | 0.01% | 2 |
| 2332 | zinc finger protein ZNF140-like protein (LOC558 | NM_018443.1 | 0 | 0.00% | 0 | 0.00% | 0 | 0.00% | 2 | 0.01% | 2 |
| 2333 | zinc-finger DNA-binding protein | D45132 | 1 | 0.01% | 0 | 0.00% | 0 | 0.00% | 1 | 0.01% | 2 |
| 2334 | mago-nashi (Drosophila) homolog, proliferation-a | NM_002370.1 | 0 | 0.00% | 1 | 0.01% | 1 | 0.01% | 0 | 0.00% | 2 |

Figure 6 - Unique Known Genes Identified In Four cDNA Cartilage Libraries and EST Frequency Analysis - Page 42 of 102

| | | | | | | | | | | | |
|---|---|---|---|---|---|---|---|---|---|---|---|
| 2335 | cleavage and polyadenylation specificity factor 7 | AF171877.1 | 1 | 0.01% | 0 | 0.00% | 0 | 0.00% | 1 | 0.01% | 2 |
| 2336 | DEAD/H (Asp-Glu-Ala-Asp/His) box polypeptide | NM_004939.1 | 1 | 0.01% | 0 | 0.00% | 0 | 0.00% | 1 | 0.01% | 2 |
| 2337 | double-stranded RNA-binding nuclear protein NF | AF167569.1 | 0 | 0.00% | 1 | 0.01% | 1 | 0.01% | 0 | 0.00% | 2 |
| 2338 | endonuclease/reverse transCRiptase [Mus musc | AAC53542.1 | 0 | 0.00% | 0 | 0.00% | 2 | 0.02% | 0 | 0.00% | 2 |
| 2339 | M5-14 protein (LOC51300) | NM_016589.1 | 1 | 0.01% | 1 | 0.01% | 0 | 0.00% | 0 | 0.00% | 2 |
| 2340 | nuclear matrix protein NMP200 related to splicin | NM_014502.1 | 0 | 0.00% | 0 | 0.00% | 0 | 0.00% | 2 | 0.01% | 2 |
| 2341 | Nuclear protein SA-2 (=STAG2) | Z75331.1 | 0 | 0.00% | 0 | 0.00% | 1 | 0.01% | 1 | 0.01% | 2 |
| 2342 | nucleic acid binding protein sub2.3 | Z29505 | 0 | 0.00% | 1 | 0.01% | 0 | 0.00% | 1 | 0.01% | 2 |
| 2343 | polyA site DNA | Z24724.1 | 0 | 0.00% | 0 | 0.00% | 2 | 0.02% | 0 | 0.00% | 2 |
| 2344 | RNA binding motif protein 6 (RBM6) | NM_005777.1 | 0 | 0.00% | 0 | 0.00% | 0 | 0.00% | 2 | 0.01% | 2 |
| 2345 | RNA binding motif protein 7 | AF156098.1 | 0 | 0.00% | 0 | 0.00% | 0 | 0.00% | 2 | 0.01% | 2 |
| 2346 | RNA binding motif protein 8 (RBM8) (=AF16146 | gi4826971 | 0 | 0.00% | 0 | 0.00% | 0 | 0.00% | 2 | 0.01% | 2 |
| 2347 | RNA binding protein 15.5 kD | AF155235 | 0 | 0.00% | 1 | 0.01% | 0 | 0.00% | 1 | 0.01% | 2 |
| 2348 | RNA helicase II/Gu protein | AF261917.1 | 0 | 0.00% | 0 | 0.00% | 0 | 0.00% | 2 | 0.01% | 2 |
| 2349 | RNA-directed DNA polymerase (EC | pirS21976 | 0 | 0.00% | 0 | 0.00% | 2 | 0.02% | 0 | 0.00% | 2 |
| 2350 | small nuclear ribonucleoprotein polypeptide B" ( | NM_003092.1 | 0 | 0.00% | 0 | 0.00% | 1 | 0.01% | 1 | 0.01% | 2 |
| 2351 | small nuclear RNA (U2) | L37793.1 | 0 | 0.00% | 1 | 0.01% | 0 | 0.00% | 1 | 0.01% | 2 |
| 2352 | SNAP-23 | U55936 | 1 | 0.01% | 0 | 0.00% | 0 | 0.00% | 1 | 0.01% | 2 |
| 2353 | splicing factor 3a, subunit 3, 60kD (SF3A3) | NM_006802.1 | 1 | 0.01% | 0 | 0.00% | 1 | 0.01% | 0 | 0.00% | 2 |
| 2354 | splicing factor arginine/serine-rich 7 (SFRS7) ge | L41887.1 | 1 | 0.01% | 1 | 0.01% | 0 | 0.00% | 0 | 0.00% | 2 |
| 2355 | splicing factor similar to dnaJ (SPF31) | NM_014280.1 | 1 | 0.01% | 1 | 0.01% | 0 | 0.00% | 0 | 0.00% | 2 |
| 2356 | splicing factor SRp30c gene | U87279.1 | 1 | 0.01% | 1 | 0.01% | 0 | 0.00% | 0 | 0.00% | 2 |
| 2357 | splicing factor, arginine/serine-rich 7 (35kD) (SF | NM_006276.2 | 2 | 0.01% | 0 | 0.00% | 0 | 0.00% | 0 | 0.00% | 2 |
| 2358 | U2 small nuclear ribonucleoprotein auxiliary fact | NM_005083.1 | 0 | 0.00% | 2 | 0.01% | 0 | 0.00% | 0 | 0.00% | 2 |
| 2359 | U4/U6-associated RNA splicing factor (HPRP3P | NM_004698.1 | 0 | 0.00% | 1 | 0.01% | 0 | 0.00% | 1 | 0.01% | 2 |
| 2360 | U5 snRNP-associated 102 kDa protein | AF221842.1 | 1 | 0.01% | 1 | 0.01% | 0 | 0.00% | 0 | 0.00% | 2 |
| 2361 | mitochondrial 12S and 16S rRNA | J01438 | 0 | 0.00% | 0 | 0.00% | 1 | 0.01% | 1 | 0.01% | 2 |
| 2362 | pre-mRNA cleavage factor I subunit | AJ001810 | 0 | 0.00% | 0 | 0.00% | 2 | 0.02% | 0 | 0.00% | 2 |
| 2363 | pre-mRNA cleavage factor Im (68kD) (CFIM) (=) | 5901927 | 0 | 0.00% | 0 | 0.00% | 1 | 0.01% | 1 | 0.01% | 2 |
| 2364 | pre-mRNA splicing factor SF2p32 | M69039 | 0 | 0.00% | 1 | 0.01% | 1 | 0.01% | 0 | 0.00% | 2 |
| 2365 | RNA polymerase I 40kD subunit | AF047441 | 1 | 0.01% | 1 | 0.01% | 0 | 0.00% | 0 | 0.00% | 2 |
| 2366 | RNA polymerase II transCRiption factor SIII p18 | L42856 | 2 | 0.01% | 0 | 0.00% | 0 | 0.00% | 0 | 0.00% | 2 |
| 2367 | RPB5-mediating protein (RefSeq aa 3e-33) | NP_003787.1 | 0 | 0.00% | 2 | 0.01% | 0 | 0.00% | 0 | 0.00% | 2 |
| 2368 | MN/CA9 | Z54349 | 2 | 0.01% | 0 | 0.00% | 0 | 0.00% | 0 | 0.00% | 2 |
| 2369 | class II invariant gamma-chain | X03340 | 0 | 0.00% | 0 | 0.00% | 0 | 0.00% | 2 | 0.01% | 2 |
| 2370 | COT kinase proto-oncogene | AF133211.1 | 0 | 0.00% | 2 | 0.01% | 0 | 0.00% | 0 | 0.00% | 2 |
| 2371 | EBNA-2 co-activator (100kD) (p100) | NM_014390.1 | 1 | 0.01% | 1 | 0.01% | 0 | 0.00% | 0 | 0.00% | 2 |
| 2372 | immunogloblin light chain (lambda) (=D80009 KI | D87018 | 0 | 0.00% | 0 | 0.00% | 2 | 0.02% | 0 | 0.00% | 2 |
| 2373 | immunoglobulin heavy-chain | AB019441.1 | 0 | 0.00% | 1 | 0.01% | 0 | 0.00% | 1 | 0.01% | 2 |
| 2374 | Jk-recombination signal binding protein (RBPJK) | L07872 | 0 | 0.00% | 1 | 0.01% | 0 | 0.00% | 1 | 0.01% | 2 |
| 2375 | male-specific lethal-3 (Drosophila)-like 1 (MSL3L | NM_006800.1 | 0 | 0.00% | 0 | 0.00% | 1 | 0.01% | 1 | 0.01% | 2 |
| 2376 | MHC class I HLA-B51 haplotype A2, B27/B51,C | M28205.1 | 0 | 0.00% | 0 | 0.00% | 2 | 0.02% | 0 | 0.00% | 2 |
| 2377 | MHC class I HLA-Bw62 | M28204.1 | 0 | 0.00% | 1 | 0.01% | 0 | 0.00% | 1 | 0.01% | 2 |
| 2378 | PC326 protein (PC326) | NM_018442.1 | 0 | 0.00% | 1 | 0.01% | 1 | 0.01% | 0 | 0.00% | 2 |
| 2379 | recombination acitivating protein (RAG2) | M94633 | 0 | 0.00% | 1 | 0.01% | 1 | 0.01% | 0 | 0.00% | 2 |
| 2380 | strain ECOR 52 rrlD operon | AF053964.1 | 0 | 0.00% | 0 | 0.00% | 0 | 0.00% | 2 | 0.01% | 2 |
| 2381 | brain and reproductive organ-expressed (TNFRS | NM_004899.1 | 1 | 0.01% | 1 | 0.01% | 0 | 0.00% | 0 | 0.00% | 2 |
| 2382 | ALEX3 protein (ALEX3) | NM_016607.1 | 1 | 0.01% | 1 | 0.01% | 0 | 0.00% | 0 | 0.00% | 2 |
| 2383 | antigen identified by monoclonal antibody Ki-67 | NM_002417.1 | 2 | 0.01% | 0 | 0.00% | 0 | 0.00% | 0 | 0.00% | 2 |
| 2384 | Centrosome- and Golgi-localized PKN-associate | AB019691.1 | 0 | 0.00% | 0 | 0.00% | 0 | 0.00% | 2 | 0.01% | 2 |
| 2385 | DnaJ-like protein (Hsj2) | AF055664 | 0 | 0.00% | 0 | 0.00% | 2 | 0.02% | 0 | 0.00% | 2 |
| 2386 | hepatocellular carcinoma-associated antigen 58 | NM_016436.1 | 0 | 0.00% | 1 | 0.01% | 1 | 0.01% | 0 | 0.00% | 2 |
| 2387 | MAGE tumor antigen D1 (MAGE-D1) | AF124440.1 | 1 | 0.01% | 0 | 0.00% | 0 | 0.00% | 1 | 0.01% | 2 |
| 2388 | modulator recognition factor 2 (MRF-2) | M73837.1 | 0 | 0.00% | 2 | 0.01% | 0 | 0.00% | 0 | 0.00% | 2 |
| 2389 | nuclear protein stromal antigen 1 (SA-1) | NM_005862.1 | 0 | 0.00% | 0 | 0.00% | 1 | 0.01% | 1 | 0.01% | 2 |
| 2390 | paraneoplastic antigen MA1 (PNMA1) | NM_006029.1 | 0 | 0.00% | 2 | 0.01% | 0 | 0.00% | 0 | 0.00% | 2 |
| 2391 | partial CHI3L1 gene for cartilage glycoprotein-39 | AJ251847.1 | 0 | 0.00% | 2 | 0.01% | 0 | 0.00% | 0 | 0.00% | 2 |

Figure 6 - Unique Known Genes Identified In Four cDNA Cartilage Libraries and EST Frequency Analysis - Page 43 of 102

| | | | | | | | | | | | |
|---|---|---|---|---|---|---|---|---|---|---|---|
| 2392 | stress protein Herp, = KIAA0025 | AB034989 | 0 | 0.00% | 1 | 0.01% | 0 | 0.00% | 1 | 0.01% | 2 |
| 2393 | sulfotransferase family, cytosolic, 1A, phenol-pre | NM_003166.1 | 0 | 0.00% | 2 | 0.01% | 0 | 0.00% | 0 | 0.00% | 2 |
| 2394 | T-cell activation protein (PGR1) gene | AF116272.1 | 0 | 0.00% | 1 | 0.01% | 1 | 0.01% | 0 | 0.00% | 2 |
| 2395 | T-cluster binding protein | D64015.1 | 0 | 0.00% | 1 | 0.01% | 0 | 0.00% | 1 | 0.01% | 2 |
| 2396 | Alg5, S. cerevisiae, homolog of (ALG5) (=AF161 | NM_013338.1 | 0 | 0.00% | 0 | 0.00% | 0 | 0.00% | 2 | 0.01% | 2 |
| 2397 | B-factor, properdin (RefSeq aa 5e-30) | NP_001701.1 | 0 | 0.00% | 2 | 0.01% | 0 | 0.00% | 0 | 0.00% | 2 |
| 2398 | cytovillin 2 (VIL2) (=X51521 ezrin) | J05021 | 1 | 0.01% | 0 | 0.00% | 1 | 0.01% | 0 | 0.00% | 2 |
| 2399 | lysosomal sialoglycoprotein | D12676.1 | 0 | 0.00% | 0 | 0.00% | 2 | 0.02% | 0 | 0.00% | 2 |
| 2400 | beta-subunit signal transducing proteins GS/GI ( | AF070597 | 1 | 0.01% | 1 | 0.01% | 0 | 0.00% | 0 | 0.00% | 2 |
| 2401 | epithelial membrane protein-3 (=U52101 YMP; U | X94771 | 2 | 0.01% | 0 | 0.00% | 0 | 0.00% | 0 | 0.00% | 2 |
| 2402 | globin alpha | M69023 | 1 | 0.01% | 0 | 0.00% | 0 | 0.00% | 1 | 0.01% | 2 |
| 2403 | integral membrane serine protease Seprase | U76833 | 0 | 0.00% | 0 | 0.00% | 0 | 0.00% | 2 | 0.01% | 2 |
| 2404 | LIM domain only 4 (LMO4) | gi7108354 | 0 | 0.00% | 0 | 0.00% | 0 | 0.00% | 2 | 0.01% | 2 |
| 2405 | multispanning membrane protein | U94831 | 2 | 0.01% | 0 | 0.00% | 0 | 0.00% | 0 | 0.00% | 2 |
| 2406 | PLASMA-CELL MEMBRANE GLYCOPROTEIN | P22413 | 0 | 0.00% | 1 | 0.01% | 0 | 0.00% | 0 | 0.00% | 2 |
| 2407 | pM5 protein (PM5) | NM_014287.1 | 0 | 0.00% | 1 | 0.01% | 0 | 0.00% | 1 | 0.01% | 2 |
| 2408 | progesterone receptor membrane component 2 ( | Hs.9071 | 0 | 0.00% | 0 | 0.00% | 0 | 0.00% | 2 | 0.01% | 2 |
| 2409 | secretory carrier membrane protein 1 (SCAMP1) | NM_004866.1 | 0 | 0.00% | 1 | 0.01% | 0 | 0.00% | 1 | 0.01% | 2 |
| 2410 | Translocase of outer mitochondrial membrane 7( | NM_014820.1 | 0 | 0.00% | 2 | 0.01% | 0 | 0.00% | 0 | 0.00% | 2 |
| 2411 | transmembrane glycoprotein (CD44 gene) | AJ251595.1 | 0 | 0.00% | 0 | 0.00% | 0 | 0.00% | 2 | 0.01% | 2 |
| 2412 | transmembrane protein Jagged 1 (HJ1) | AF028593.1 | 0 | 0.00% | 2 | 0.01% | 0 | 0.00% | 0 | 0.00% | 2 |
| 2413 | mutL homolog 1 (RefSeq aa 4e-76) | NP_000240.1 | 0 | 0.00% | 2 | 0.01% | 0 | 0.00% | 0 | 0.00% | 2 |
| 2414 | DNA/RNA-binding protein | U20272.1 | 0 | 0.00% | 1 | 0.01% | 0 | 0.00% | 1 | 0.01% | 2 |
| 2415 | RAD50 | Z75311 | 0 | 0.00% | 1 | 0.01% | 0 | 0.00% | 1 | 0.01% | 2 |
| 2416 | adenylate kinase 1 (hAK1) | AB021871.1 | 2 | 0.01% | 0 | 0.00% | 0 | 0.00% | 0 | 0.00% | 2 |
| 2417 | adenylate kinase 3 alpha (AK3) | AB021870 | 0 | 0.00% | 1 | 0.01% | 1 | 0.01% | 0 | 0.00% | 2 |
| 2418 | C1-inhibitor | X54486 | 0 | 0.00% | 0 | 0.00% | 2 | 0.02% | 0 | 0.00% | 2 |
| 2419 | carbonyl reductase 1 (CBR1) | NM_001757.1 | 1 | 0.01% | 1 | 0.01% | 0 | 0.00% | 0 | 0.00% | 2 |
| 2420 | coagulation factor V (proaccelerin, labile factor) ( | NM_000130.1 | 0 | 0.00% | 0 | 0.00% | 1 | 0.01% | 1 | 0.01% | 2 |
| 2421 | glutathione peroxidase 4 (phospholipid hydroper | NM_002085.1 | 2 | 0.01% | 0 | 0.00% | 0 | 0.00% | 0 | 0.00% | 2 |
| 2422 | glutathione-S-transferase like; glutathione transf | Hs.11465 | 1 | 0.01% | 0 | 0.00% | 1 | 0.01% | 0 | 0.00% | 2 |
| 2423 | gp25L2 protein | X90872 | 2 | 0.01% | 0 | 0.00% | 0 | 0.00% | 0 | 0.00% | 2 |
| 2424 | metallothionein isoform 1R | X97261.1 | 0 | 0.00% | 1 | 0.01% | 1 | 0.01% | 0 | 0.00% | 2 |
| 2425 | MITOCHONDRIAL THIOREDOXIN-DEPENDEN | spP30048 | 0 | 0.00% | 0 | 0.00% | 0 | 0.00% | 2 | 0.01% | 2 |
| 2426 | peroxiredoxin 5 (PRDX5), mRNA /cds=(36,680) | Hs.31731 | 0 | 0.00% | 0 | 0.00% | 0 | 0.00% | 1 | 0.01% | 2 |
| 2427 | thioredoxin-like, 32kD (TXNL) | NM_004786.1 | 1 | 0.01% | 1 | 0.01% | 0 | 0.00% | 0 | 0.00% | 2 |
| 2428 | truncated SON protein (Son) (=AF161430.1 HSF | AF193607.1 | 0 | 0.00% | 0 | 0.00% | 1 | 0.01% | 1 | 0.01% | 2 |
| 2429 | von Willebrand factor (=X04385) | M10321 | 1 | 0.01% | 0 | 0.00% | 1 | 0.01% | 0 | 0.00% | 2 |
| 2430 | Arfaptin 2 (partner of RAC1) (POR1) | NM_012402.1 | 2 | 0.01% | 0 | 0.00% | 0 | 0.00% | 0 | 0.00% | 2 |
| 2431 | Arf-like 2 binding protein BART1 | AF126062.1 | 0 | 0.00% | 1 | 0.01% | 0 | 0.00% | 1 | 0.01% | 2 |
| 2432 | clathrin heavy chain (=D21260 human hypotheti | J03583 | 1 | 0.01% | 1 | 0.01% | 0 | 0.00% | 0 | 0.00% | 2 |
| 2433 | sodium-dependent multivitamin transporter (SMV | AF116241.1 | 1 | 0.01% | 1 | 0.01% | 0 | 0.00% | 0 | 0.00% | 2 |
| 2434 | synaptic glycoprotein SC2 spliced variant | AF038958 | 1 | 0.01% | 1 | 0.01% | 0 | 0.00% | 0 | 0.00% | 2 |
| 2435 | synaptobrevin-like 1 (SYBL1) | gi5032136 | 0 | 0.00% | 0 | 0.00% | 0 | 0.00% | 2 | 0.01% | 2 |
| 2436 | ch-TOG protein (=D43948.1 KIAA0097) | X92474.1 | 1 | 0.01% | 0 | 0.00% | 0 | 0.00% | 1 | 0.01% | 2 |
| 2437 | centrin 3; Saccharomyces cerevisiaeCDC31 hor | NP_004356.1 | 0 | 0.00% | 3 | 0.02% | 0 | 0.00% | 0 | 0.00% | 2 |
| 2438 | CGI-09 protein | AF132943.1 | 1 | 0.01% | 0 | 0.00% | 1 | 0.01% | 0 | 0.00% | 2 |
| 2439 | CGI-104 protein (=AF078862.1 PTD009) | AF151862.1 | 1 | 0.01% | 0 | 0.00% | 1 | 0.01% | 0 | 0.00% | 2 |
| 2440 | CGI-107 protein | AF151865.1 | 0 | 0.00% | 0 | 0.00% | 1 | 0.01% | 1 | 0.01% | 2 |
| 2441 | CGI-108 protein (LOC51013) | NM_016046.1 | 0 | 0.00% | 2 | 0.01% | 0 | 0.00% | 0 | 0.00% | 2 |
| 2442 | CGI-132 protein | AF151890.1 | 0 | 0.00% | 1 | 0.01% | 1 | 0.01% | 0 | 0.00% | 2 |
| 2443 | CGI-141 protein | AF151899.1 | 0 | 0.00% | 1 | 0.01% | 0 | 0.00% | 1 | 0.01% | 2 |
| 2444 | CGI-30 protein (=Z49907 c.elegans diphthine sy | AF132964.1 | 0 | 0.00% | 1 | 0.01% | 1 | 0.01% | 0 | 0.00% | 2 |
| 2445 | CGI-60 protein (LOC51626), | NM_016008.1 | 0 | 0.00% | 0 | 0.00% | 1 | 0.01% | 1 | 0.01% | 2 |
| 2446 | CGI-61 protein | AF151819.1 | 0 | 0.00% | 0 | 0.00% | 0 | 0.00% | 2 | 0.01% | 2 |
| 2447 | CGI-72 protein (RefSeq aa 2e-90) | NP_057102.1 | 0 | 0.00% | 2 | 0.01% | 0 | 0.00% | 0 | 0.00% | 2 |
| 2448 | CGI-75 protein (RefSeq aa 4e-57) | NP_057104.1 | 0 | 0.00% | 2 | 0.01% | 0 | 0.00% | 0 | 0.00% | 2 |

Figure 6 - Unique Known Genes Identified In Four cDNA Cartilage Libraries and EST Frequency Analysis - Page 44 of 102

| | | | | | | | | | | | |
|---|---|---|---|---|---|---|---|---|---|---|---|
| 2449 | CGI-81 protein | AF151839.1 | 0 | 0.00% | 0 | 0.00% | 1 | 0.01% | 1 | 0.01% | 2 |
| 2450 | CGI-82 protein | AF151840.1 | 0 | 0.00% | 0 | 0.00% | 0 | 0.00% | 2 | 0.01% | 2 |
| 2451 | CGI-83 protein (LOC51110) | NM_016027.1 | 1 | 0.01% | 0 | 0.00% | 0 | 0.00% | 1 | 0.01% | 2 |
| 2452 | CGI-97 protein | AF151855.1 | 0 | 0.00% | 0 | 0.00% | 2 | 0.02% | 0 | 0.00% | 2 |
| 2453 | cytoplasmic dynein intermediate chain 2 (Dncic2 | AF063231 | 0 | 0.00% | 0 | 0.00% | 0 | 0.00% | 2 | 0.01% | 2 |
| 2454 | cytoplasmic intermediate filament protein | AJ004935.1 | 2 | 0.01% | 0 | 0.00% | 0 | 0.00% | 0 | 0.00% | 2 |
| 2455 | Dynein intermediate chain 2, cytosolic (dh ic-2) ( | spO88487 | 0 | 0.00% | 0 | 0.00% | 0 | 0.00% | 2 | 0.01% | 2 |
| 2456 | golgin-like protein(GLP) gene (=U61167.1 SH3 c | AF266285.1 | 1 | 0.01% | 0 | 0.00% | 0 | 0.00% | 1 | 0.01% | 2 |
| 2457 | kinesin family member 4 (KIF4), mRNA | NM_012310.2 | 2 | 0.01% | 0 | 0.00% | 0 | 0.00% | 0 | 0.00% | 2 |
| 2458 | microtubule-associated protein 1a (MAP1A) | U38292.1 | 1 | 0.01% | 1 | 0.01% | 0 | 0.00% | 0 | 0.00% | 2 |
| 2459 | MICROTUBULE-ASSOCIATED PROTEIN 1B [C | P46821 | 1 | 0.01% | 0 | 0.00% | 1 | 0.01% | 0 | 0.00% | 2 |
| 2460 | NC2 alpha | X96506.1 | 2 | 0.01% | 0 | 0.00% | 0 | 0.00% | 0 | 0.00% | 2 |
| 2461 | Norrie disease protein (NDP) | X65882 | 0 | 0.00% | 0 | 0.00% | 1 | 0.01% | 1 | 0.01% | 2 |
| 2462 | collagen-binding protein 2 (collagen 2) (CBP2) | NM_001235.1 | 2 | 0.01% | 0 | 0.00% | 0 | 0.00% | 0 | 0.00% | 2 |
| 2463 | entactin | X14194 | 0 | 0.00% | 0 | 0.00% | 0 | 0.00% | 2 | 0.01% | 2 |
| 2464 | epsilon-sarcoglycan | AJ000534.1 | 1 | 0.01% | 0 | 0.00% | 0 | 0.00% | 1 | 0.01% | 2 |
| 2465 | hematopoetic proteoglycan core protein (=M900 | X17042 | 0 | 0.00% | 1 | 0.01% | 0 | 0.00% | 1 | 0.01% | 2 |
| 2466 | osteonidogen (=AJ223500 nidogen-2) | D86425 | 0 | 0.00% | 0 | 0.00% | 1 | 0.01% | 1 | 0.01% | 2 |
| 2467 | STIP1 homology and U-Box containing protein 1 | NM_005861.1 | 2 | 0.01% | 0 | 0.00% | 0 | 0.00% | 0 | 0.00% | 2 |
| 2468 | tenascin | X56160 | 0 | 0.00% | 0 | 0.00% | 0 | 0.00% | 2 | 0.01% | 2 |
| 2469 | lymphocyte cytosolic protein 1 (L-plastin) (LCP1) | NM_002298.2 | 0 | 0.00% | 0 | 0.00% | 0 | 0.00% | 2 | 0.01% | 2 |
| 2470 | actin binding protein MAYVEN | AF059569.1 | 0 | 0.00% | 2 | 0.01% | 0 | 0.00% | 0 | 0.00% | 2 |
| 2471 | actin depolymerizing factor | S65738 | 0 | 0.00% | 0 | 0.00% | 2 | 0.02% | 0 | 0.00% | 2 |
| 2472 | adapter protein CMS | AF146277.1 | 0 | 0.00% | 0 | 0.00% | 1 | 0.01% | 1 | 0.01% | 2 |
| 2473 | alpha-actinin-2 associated LIM protein | AF002282 | 1 | 0.01% | 0 | 0.00% | 1 | 0.01% | 0 | 0.00% | 2 |
| 2474 | CRystallin, zeta (quinone reductase)-like 1 (CRY | NM_005111.1 | 0 | 0.00% | 0 | 0.00% | 2 | 0.02% | 0 | 0.00% | 2 |
| 2475 | cytoplasmic dynein heavy chain (=AB002323 Hu | D13896 | 1 | 0.01% | 0 | 0.00% | 1 | 0.01% | 0 | 0.00% | 2 |
| 2476 | gamma adducin | Y14379.1 | 0 | 0.00% | 0 | 0.00% | 2 | 0.02% | 0 | 0.00% | 2 |
| 2477 | keratin 18 (K18) | M24842 | 0 | 0.00% | 0 | 0.00% | 1 | 0.01% | 1 | 0.01% | 2 |
| 2478 | plakophilin 2b (ORF) | X97675 | 0 | 0.00% | 1 | 0.01% | 1 | 0.01% | 0 | 0.00% | 2 |
| 2479 | profilin | J03191 | 2 | 0.01% | 0 | 0.00% | 0 | 0.00% | 0 | 0.00% | 2 |
| 2480 | utrophin (homologous to dystrophin) (UTRN) | NM_007124.1 | 0 | 0.00% | 2 | 0.01% | 0 | 0.00% | 0 | 0.00% | 2 |
| 2481 | actin related protein 2/3 complex, subunit 3 (21 k | Hs.6895 | 1 | 0.01% | 0 | 0.00% | 0 | 0.00% | 1 | 0.01% | 2 |
| 2482 | muscle-specific protein (LOC51778) | NM_016599.1 | 1 | 0.01% | 0 | 0.00% | 0 | 0.00% | 1 | 0.01% | 2 |
| 2483 | myosin X (MYO10) | AF247457.1 | 0 | 0.00% | 0 | 0.00% | 0 | 0.00% | 2 | 0.01% | 2 |
| 2484 | myosin, heavy polypeptide 3, skeletal muscle, e | XM_052579.2 | 1 | 0.01% | 0 | 0.00% | 0 | 0.00% | 0 | 0.00% | 2 |
| 2485 | myotubularin related protein 6 | AF072928 | 0 | 0.00% | 0 | 0.00% | 1 | 0.01% | 1 | 0.01% | 2 |
| 2486 | integral inner nuclear | NM_014319.2 | 0 | 0.00% | 2 | 0.01% | 0 | 0.00% | 0 | 0.00% | 2 |
| 2487 | lamin A/C (LMNA) | XM_044160.1 | 1 | 0.01% | 0 | 0.00% | 0 | 0.00% | 0 | 0.00% | 2 |
| 2488 | nucleoporin p54 | U63840 | 0 | 0.00% | 0 | 0.00% | 1 | 0.01% | 1 | 0.01% | 2 |
| 2489 | plectin (PLEC1) | U63610 | 1 | 0.01% | 0 | 0.00% | 0 | 0.00% | 1 | 0.01% | 2 |
| 2490 | aryl hydrocarbon receptor-interacting protein (AI | NM_003977.1 | 2 | 0.01% | 0 | 0.00% | 0 | 0.00% | 0 | 0.00% | 2 |
| 2491 | Toll-like receptor 2 (TLR2) mRNA, (ORF) | U88878 | 1 | 0.01% | 0 | 0.00% | 1 | 0.01% | 0 | 0.00% | 2 |
| 2492 | Toll-like receptor 4 (TLR4) | U88880 | 0 | 0.00% | 1 | 0.01% | 0 | 0.00% | 1 | 0.01% | 2 |
| 2493 | B219/OB receptor isoform HuB219.1 | U52912 | 0 | 0.00% | 0 | 0.00% | 1 | 0.01% | 1 | 0.01% | 2 |
| 2494 | bone morphogenetic protein receptor, type IA (B | NM_004329.1 | 1 | 0.01% | 0 | 0.00% | 0 | 0.00% | 1 | 0.01% | 2 |
| 2495 | Ets transCRiption factor (NERF-2) | U43188 | 0 | 0.00% | 0 | 0.00% | 2 | 0.02% | 0 | 0.00% | 2 |
| 2496 | Fc-gamma-receptor IIIB (FCGR3B) | M90746 | 0 | 0.00% | 0 | 0.00% | 0 | 0.00% | 2 | 0.01% | 2 |
| 2497 | G protein gamma 5 subunit | AF038955.1 | 0 | 0.00% | 1 | 0.01% | 0 | 0.00% | 1 | 0.01% | 2 |
| 2498 | G protein-coupled receptor 69A (GPR69A) (=p4( | NM_006055.1 | 0 | 0.00% | 0 | 0.00% | 1 | 0.01% | 1 | 0.01% | 2 |
| 2499 | histamine N-methyltransferase(HNMT) | U08092 | 0 | 0.00% | 1 | 0.01% | 1 | 0.01% | 0 | 0.00% | 2 |
| 2500 | h-ryk | X69970.1 | 0 | 0.00% | 0 | 0.00% | 1 | 0.01% | 1 | 0.01% | 2 |
| 2501 | interferon gamma receptor 1 (IFNGR1) (ORF) | NM_000416.1 | 0 | 0.00% | 2 | 0.01% | 0 | 0.00% | 0 | 0.00% | 2 |
| 2502 | interferon gamma receptor accessory factor-1 (A | U05877 | 2 | 0.01% | 0 | 0.00% | 0 | 0.00% | 0 | 0.00% | 2 |
| 2503 | interleukin 16 (IL16) | AF077011 | 0 | 0.00% | 2 | 0.01% | 0 | 0.00% | 0 | 0.00% | 2 |
| 2504 | mannose receptor, C type 1 (MRC1) | NM_002438.1 | 0 | 0.00% | 2 | 0.01% | 0 | 0.00% | 0 | 0.00% | 2 |
| 2505 | nuclear receptor coactivator 3 (NCOA3) | NM_006534.1 | 1 | 0.01% | 0 | 0.00% | 0 | 0.00% | 1 | 0.01% | 2 |

Figure 6 - Unique Known Genes Identified In Four cDNA Cartilage Libraries and EST Frequency Analysis - Page 45 of 102

| | | | | | | | | | | | |
|---|---|---|---|---|---|---|---|---|---|---|---|
| 2506 | nuclear receptor co-repressor 1 (NCOR1) | NM_006311.1 | 0 | 0.00% | 2 | 0.01% | 0 | 0.00% | 0 | 0.00% | 2 |
| 2507 | nuclear receptor subfamily 4, group A, member 2 | NM_006186.1 | 0 | 0.00% | 2 | 0.01% | 0 | 0.00% | 0 | 0.00% | 2 |
| 2508 | nuclear RNA helicase, DECD variant of DEAD b | NM_005804.1 | 2 | 0.01% | 0 | 0.00% | 0 | 0.00% | 0 | 0.00% | 2 |
| 2509 | PAR3 (PAR3) | AF252293.1 | 1 | 0.01% | 0 | 0.00% | 0 | 0.00% | 1 | 0.01% | 2 |
| 2510 | peripheral benzodiazepine receptor-associated p | NM_004758.1 | 2 | 0.01% | 0 | 0.00% | 0 | 0.00% | 0 | 0.00% | 2 |
| 2511 | platelet-derived growth factor A chain (PDGFA) ( | M83575 | 1 | 0.01% | 1 | 0.01% | 0 | 0.00% | 0 | 0.00% | 2 |
| 2512 | PMEPA1 protein (PMEPA1) | NM_020182.1 | 0 | 0.00% | 2 | 0.01% | 0 | 0.00% | 0 | 0.00% | 2 |
| 2513 | retinoic acid-binding protein II (CRABP-II) (=M68 | M97814 | 2 | 0.01% | 0 | 0.00% | 0 | 0.00% | 0 | 0.00% | 2 |
| 2514 | RYK tyrosine kinase | S59184.1 | 0 | 0.00% | 0 | 0.00% | 1 | 0.01% | 1 | 0.01% | 2 |
| 2515 | TRIP6 (thyroid receptor interacting protein) (=AF | AJ001902 | 2 | 0.01% | 0 | 0.00% | 0 | 0.00% | 0 | 0.00% | 2 |
| 2516 | v-jun avian sarcoma virus 17 oncogene homolog | NM_002228.2 | 1 | 0.01% | 1 | 0.01% | 0 | 0.00% | 0 | 0.00% | 2 |
| 2517 | xenotropic and polytropic murine leukemia virus | AF089744.1 | 2 | 0.01% | 0 | 0.00% | 0 | 0.00% | 0 | 0.00% | 2 |
| 2518 | 14-3-3 protein, a protein kinase regulator | X56468 | 0 | 0.00% | 0 | 0.00% | 0 | 0.00% | 2 | 0.01% | 2 |
| 2519 | bifunctional ATP sulfurylase/adenosine 5'-phosp | AF033026.1 | 0 | 0.00% | 0 | 0.00% | 2 | 0.02% | 0 | 0.00% | 2 |
| 2520 | calmodulin-dependent protein phosphatase cata | L14778 | 0 | 0.00% | 0 | 0.00% | 0 | 0.00% | 2 | 0.01% | 2 |
| 2521 | ERK activator kinase (MEK2) | L11285 | 2 | 0.01% | 0 | 0.00% | 0 | 0.00% | 0 | 0.00% | 2 |
| 2522 | mitogen-responsive phosphoprotein DOC-2 | U53446 | 0 | 0.00% | 0 | 0.00% | 2 | 0.02% | 0 | 0.00% | 2 |
| 2523 | protein kinase C, mu (PRKCM) | NM_002742.1 | 1 | 0.01% | 0 | 0.00% | 0 | 0.00% | 1 | 0.01% | 2 |
| 2524 | serine-threonine protein kinase (MNBH) | AF108830.1 | 0 | 0.00% | 1 | 0.01% | 1 | 0.01% | 0 | 0.00% | 2 |
| 2525 | cAMP-specific phosphodiesterase 8B (PDE8B) | AF079529 | 0 | 0.00% | 0 | 0.00% | 2 | 0.02% | 0 | 0.00% | 2 |
| 2526 | cGMP phosphodiesterase | X62695 | 0 | 0.00% | 0 | 0.00% | 0 | 0.00% | 2 | 0.01% | 2 |
| 2527 | monoamine oxidase B (MAOB) | NM_000898.1 | 0 | 0.00% | 2 | 0.01% | 0 | 0.00% | 0 | 0.00% | 2 |
| 2528 | A kinase (PRKA) anchor protein 2 (AKAP2)(= KI | NM_007203.1 | 0 | 0.00% | 1 | 0.01% | 1 | 0.01% | 0 | 0.00% | 2 |
| 2529 | associated molecule with the SH3 domain of ST | NM_006463.1 | 0 | 0.00% | 1 | 0.01% | 1 | 0.01% | 0 | 0.00% | 2 |
| 2530 | adenomatosis polyposis coli (APC) | gi4557318 | 1 | 0.01% | 0 | 0.00% | 0 | 0.00% | 1 | 0.01% | 2 |
| 2531 | breakpoint cluster region (BCR) gene | U07000.1 | 2 | 0.01% | 0 | 0.00% | 0 | 0.00% | 0 | 0.00% | 2 |
| 2532 | brefeldin A-inhibited | NM_006421.2 | 0 | 0.00% | 1 | 0.01% | 1 | 0.01% | 0 | 0.00% | 2 |
| 2533 | dexamethasone-induced ras-related protein 1 (D | AF262018.1 | 0 | 0.00% | 2 | 0.01% | 0 | 0.00% | 0 | 0.00% | 2 |
| 2534 | guanine nucleotide exchange factor p532 | U50078 | 0 | 0.00% | 1 | 0.01% | 0 | 0.00% | 1 | 0.01% | 2 |
| 2535 | GUANINE NUCLEOTIDE-BINDING PROTEIN B | spP25388 | 0 | 0.00% | 0 | 0.00% | 0 | 0.00% | 2 | 0.01% | 2 |
| 2536 | low-Mr GTP-binding protein (RAB32) | U59878 | 0 | 0.00% | 0 | 0.00% | 1 | 0.01% | 1 | 0.01% | 2 |
| 2537 | MAD-3 (IkB-like activity) | M69043 | 0 | 0.00% | 0 | 0.00% | 0 | 0.00% | 2 | 0.01% | 2 |
| 2538 | N-acetylneuraminic acid phosphate synthase; si | NM_018946.1 | 0 | 0.00% | 1 | 0.01% | 0 | 0.00% | 1 | 0.01% | 2 |
| 2539 | nucleolar GTPase (HUMAUANTIG) | NM_013285.1 | 0 | 0.00% | 1 | 0.01% | 0 | 0.00% | 1 | 0.01% | 2 |
| 2540 | Rab5-interacting protein | AF112213.1 | 0 | 0.00% | 2 | 0.01% | 0 | 0.00% | 0 | 0.00% | 2 |
| 2541 | Rab9 effector p40 | Z97074 | 1 | 0.01% | 1 | 0.01% | 0 | 0.00% | 0 | 0.00% | 2 |
| 2542 | Ran_GTP binding protein 5 | Y08890.1 | 1 | 0.01% | 0 | 0.00% | 0 | 0.00% | 1 | 0.01% | 2 |
| 2543 | Ras suppressor protein 1(RSU1),(= RSU-1/RSP | NM_012425.2 | 1 | 0.01% | 0 | 0.00% | 0 | 0.00% | 0 | 0.00% | 2 |
| 2544 | Rho guanine nucleotide exchange factor (GEF) | NM_004706.1 | 2 | 0.01% | 0 | 0.00% | 0 | 0.00% | 0 | 0.00% | 2 |
| 2545 | Rho guanine nucleotide-exchange factor, splice | AJ010045.1 | 1 | 0.01% | 1 | 0.01% | 0 | 0.00% | 0 | 0.00% | 2 |
| 2546 | Rho-associated, coiled-coil containing protein ki | NM_005406.1 | 0 | 0.00% | 1 | 0.01% | 1 | 0.01% | 0 | 0.00% | 2 |
| 2547 | SH3 binding protein | AB005047 | 0 | 0.00% | 1 | 0.01% | 1 | 0.01% | 0 | 0.00% | 2 |
| 2548 | SH3-domain binding protein 5 (BTK-associated) | NM_004844.1 | 0 | 0.00% | 1 | 0.01% | 0 | 0.00% | 1 | 0.01% | 2 |
| 2549 | signal transducing adaptor molecule (SH3 doma | NM_003473.1 | 0 | 0.00% | 0 | 0.00% | 2 | 0.02% | 0 | 0.00% | 2 |
| 2550 | small GTP-binding protein rab22b | AF183421.1 | 0 | 0.00% | 2 | 0.01% | 0 | 0.00% | 0 | 0.00% | 2 |
| 2551 | Src-like-adapter (SLA) | NM_006748.1 | 0 | 0.00% | 1 | 0.01% | 1 | 0.01% | 0 | 0.00% | 2 |
| 2552 | adrenal specific pG2 (=U15981 dlk) | X17544 | 2 | 0.01% | 0 | 0.00% | 0 | 0.00% | 0 | 0.00% | 2 |
| 2553 | novel antagonist of FGF signaling (sprouty-1) | AF041037.1 | 1 | 0.01% | 0 | 0.00% | 0 | 0.00% | 1 | 0.01% | 2 |
| 2554 | abundant in neuroepithelium area (BTG3) (=D64 | gi5802989 | 0 | 0.00% | 0 | 0.00% | 1 | 0.01% | 1 | 0.01% | 2 |
| 2555 | bone morphogenetic protein 5 (BMP5) | NM_021073.1 | 0 | 0.00% | 2 | 0.01% | 0 | 0.00% | 0 | 0.00% | 2 |
| 2556 | bone morphogenetic protein-3b gene | D49493.1 | 0 | 0.00% | 2 | 0.01% | 0 | 0.00% | 0 | 0.00% | 2 |
| 2557 | follistatin | M19480 | 1 | 0.01% | 0 | 0.00% | 0 | 0.00% | 1 | 0.01% | 2 |
| 2558 | glioblastoma amplified sequence (GBAS) | AF029786 | 0 | 0.00% | 0 | 0.00% | 1 | 0.01% | 1 | 0.01% | 2 |
| 2559 | growth associated protein 43 (GAP43) | NM_002045.1 | 0 | 0.00% | 1 | 0.01% | 0 | 0.00% | 1 | 0.01% | 2 |
| 2560 | hepatocyte growth factor activator inhibitor type | AB006534 | 0 | 0.00% | 1 | 0.01% | 0 | 0.00% | 1 | 0.01% | 2 |
| 2561 | hepatoma-derived growth factor | D16431 | 1 | 0.01% | 0 | 0.00% | 0 | 0.00% | 1 | 0.01% | 2 |
| 2562 | high-risk human papilloma viruses E6 oncoprote | AF090989.1 | 1 | 0.01% | 0 | 0.00% | 0 | 0.00% | 1 | 0.01% | 2 |

Figure 6 - Unique Known Genes Identified In Four cDNA Cartilage Libraries and EST Frequency Analysis - Page 46 of 102

| | | | | | | | | | | | |
|---|---|---|---|---|---|---|---|---|---|---|---|
| 2563 | interferon-gamma | U10360 | 0 | 0.00% | 0 | 0.00% | 0 | 0.00% | 2 | 0.01% | 2 |
| 2564 | macrophage-specific colony-stimulating factor (C | M37435.1 | 0 | 0.00% | 0 | 0.00% | 1 | 0.01% | 1 | 0.01% | 2 |
| 2565 | midkine (neurite growth-promoting factor 2) (MD | gi4505134 | 2 | 0.01% | 0 | 0.00% | 0 | 0.00% | 0 | 0.00% | 2 |
| 2566 | monocyte chemotactic protein-3 (MCP-3) | X72308 | 0 | 0.00% | 0 | 0.00% | 1 | 0.01% | 1 | 0.01% | 2 |
| 2567 | neuromedin B | M21551 | 1 | 0.01% | 0 | 0.00% | 1 | 0.01% | 0 | 0.00% | 2 |
| 2568 | p8 protein (candidate of metastasis 1) (P8) | NM_012385.1 | 1 | 0.01% | 1 | 0.01% | 0 | 0.00% | 0 | 0.00% | 2 |
| 2569 | polydom protein | AAG32160.1 | 0 | 0.00% | 2 | 0.01% | 0 | 0.00% | 0 | 0.00% | 2 |
| 2570 | SKI-INTERACTING PROTEIN (RefSeq aa 7e-5 | NP_036377.1 | 0 | 0.00% | 2 | 0.01% | 0 | 0.00% | 0 | 0.00% | 2 |
| 2571 | uncharacterized bone marrow protein BM042 (B | NM_018458.1 | 1 | 0.01% | 1 | 0.01% | 0 | 0.00% | 0 | 0.00% | 2 |
| 2572 | cullin 5 (CUL5) | NM_003478.1 | 1 | 0.01% | 1 | 0.01% | 0 | 0.00% | 0 | 0.00% | 2 |
| 2573 | ADP-ribosylation factor 6 (ARF6) | NM_001663.2 | 1 | 0.01% | 1 | 0.01% | 0 | 0.00% | 0 | 0.00% | 2 |
| 2574 | ADP-ribosylation factor domain protein 1, 64kD ( | NM_001656.1 | 0 | 0.00% | 1 | 0.01% | 0 | 0.00% | 1 | 0.01% | 2 |
| 2575 | ADP-ribosylation factor[arf]-directed GTPase act | gi4502248 | 0 | 0.00% | 0 | 0.00% | 0 | 0.00% | 2 | 0.01% | 2 |
| 2576 | ADP-ribosylation factor-like 3 (ARL3) | NM_004311.1 | 0 | 0.00% | 0 | 0.00% | 0 | 0.00% | 2 | 0.01% | 2 |
| 2577 | calcyclin binding protein | AF057356.1 | 1 | 0.01% | 0 | 0.00% | 1 | 0.01% | 0 | 0.00% | 2 |
| 2578 | FE65-like protein (hFE65L) | U62325.1 | 0 | 0.00% | 1 | 0.01% | 0 | 0.00% | 1 | 0.01% | 2 |
| 2579 | hepatocyte growth factor-like protein homolog (lc | U28055 | 2 | 0.01% | 0 | 0.00% | 0 | 0.00% | 0 | 0.00% | 2 |
| 2580 | monocyte/neutrophil elastase inhibitor | AF053630 | 0 | 0.00% | 0 | 0.00% | 0 | 0.00% | 2 | 0.01% | 2 |
| 2581 | poly (ADP-ribose) polymerase (=J03473; M2978 | M18112 | 2 | 0.01% | 0 | 0.00% | 0 | 0.00% | 0 | 0.00% | 2 |
| 2582 | chloride channel nucleotide-sensitive, 1A (CLNS | NM_001293.1 | 1 | 0.01% | 1 | 0.01% | 0 | 0.00% | 0 | 0.00% | 2 |
| 2583 | ecotropic viral integration site 5 (EVI5) | NM_005665.1 | 0 | 0.00% | 0 | 0.00% | 1 | 0.01% | 1 | 0.01% | 2 |
| 2584 | JTV-1 (JTV-1) | U24169 | 1 | 0.01% | 1 | 0.01% | 0 | 0.00% | 0 | 0.00% | 2 |
| 2585 | membrane protein, type II clone:HP10390 | AB015631.1 | 2 | 0.01% | 0 | 0.00% | 0 | 0.00% | 0 | 0.00% | 2 |
| 2586 | membrane protein-like protein | U21556 | 1 | 0.01% | 1 | 0.01% | 0 | 0.00% | 0 | 0.00% | 2 |
| 2587 | potassium voltage-gated channel, delayed-rectifi | NM_002252.1 | 0 | 0.00% | 0 | 0.00% | 1 | 0.01% | 1 | 0.01% | 2 |
| 2588 | stomatin-like protein 2 (SLP-2) | NM_013442.1 | 1 | 0.01% | 0 | 0.00% | 1 | 0.01% | 0 | 0.00% | 2 |
| 2589 | voltage-dependent anion channel isoform 2 (VD/ | AF152227.1 | 1 | 0.01% | 0 | 0.00% | 0 | 0.00% | 1 | 0.01% | 2 |
| 2590 | MacMarcks | X70326 | 1 | 0.01% | 0 | 0.00% | 0 | 0.00% | 1 | 0.01% | 2 |
| 2591 | mast cell carboxypeptidase A | M27717 | 0 | 0.00% | 1 | 0.01% | 1 | 0.01% | 0 | 0.00% | 2 |
| 2592 | cell adhesion protein (vitronectin) receptor alpha | M14648 | 0 | 0.00% | 0 | 0.00% | 0 | 0.00% | 2 | 0.01% | 2 |
| 2593 | goliath protein | AF155650.1 | 0 | 0.00% | 1 | 0.01% | 0 | 0.00% | 1 | 0.01% | 2 |
| 2594 | integrin alpha-11 subunit precursor (ITGA11) | AF109681.1 | 1 | 0.01% | 1 | 0.01% | 0 | 0.00% | 0 | 0.00% | 2 |
| 2595 | integrin, alpha V(vitronectin receptor, alpha poly | NM_002210.1 | 0 | 0.00% | 0 | 0.00% | 1 | 0.01% | 1 | 0.01% | 2 |
| 2596 | platelet/endothelial cell adhesion molecule-1 (PE | L34657 | 0 | 0.00% | 1 | 0.01% | 1 | 0.01% | 0 | 0.00% | 2 |
| 2597 | protocadherin 43 gene | AF119570 | 2 | 0.01% | 0 | 0.00% | 0 | 0.00% | 0 | 0.00% | 2 |
| 2598 | TRAF and TNF receptor associated protein (ttra | AJ269473.1 | 1 | 0.01% | 1 | 0.01% | 0 | 0.00% | 0 | 0.00% | 2 |
| 2599 | chromodomain helicase DNA binding protein 4 ( | NM_001273.1 | 1 | 0.01% | 1 | 0.01% | 0 | 0.00% | 0 | 0.00% | 2 |
| 2600 | chromodomain protein, Y chromosome-like (CD | NM_004824.1 | 0 | 0.00% | 0 | 0.00% | 1 | 0.01% | 1 | 0.01% | 2 |
| 2601 | chromosome-associated polypeptide C (CAP-C) | NM_005496.1 | 0 | 0.00% | 1 | 0.01% | 0 | 0.00% | 1 | 0.01% | 2 |
| 2602 | Gu protein = PC6010 RNA helicase Gu | U41387.1 | 1 | 0.01% | 1 | 0.01% | 0 | 0.00% | 0 | 0.00% | 2 |
| 2603 | histone acetyltransferase (HBOA) | NM_007067.1 | 0 | 0.00% | 2 | 0.01% | 0 | 0.00% | 0 | 0.00% | 2 |
| 2604 | histone acetyltransferase (MORF), (ORF) | NM_012330.1 | 0 | 0.00% | 1 | 0.01% | 1 | 0.01% | 0 | 0.00% | 2 |
| 2605 | histone deacetylase 2 (HDAC2) (=U31814 trans | gi4557640 | 0 | 0.00% | 0 | 0.00% | 0 | 0.00% | 2 | 0.01% | 2 |
| 2606 | histone maCRoH2A1.2 | AF054174 | 2 | 0.01% | 0 | 0.00% | 0 | 0.00% | 0 | 0.00% | 2 |
| 2607 | non-histone chromatin protein HMG1 (HMG1) ge | U51677.1 | 2 | 0.01% | 0 | 0.00% | 0 | 0.00% | 0 | 0.00% | 2 |
| 2608 | SCG10 like-protein, helicase-like protein NHL, M | AF217796.1 | 0 | 0.00% | 1 | 0.01% | 0 | 0.00% | 1 | 0.01% | 2 |
| 2609 | telomerase binding protein p23 (LOC56351) | NM_019766.1 | 0 | 0.00% | 2 | 0.01% | 0 | 0.00% | 0 | 0.00% | 2 |
| 2610 | menage a trois 1 (CAK assembly factor) (MNAT | NM_002431.1 | 0 | 0.00% | 1 | 0.01% | 0 | 0.00% | 1 | 0.01% | 2 |
| 2611 | camptothecin resistant clone CEM/C2 DNA topo | U07806.1 | 1 | 0.01% | 1 | 0.01% | 0 | 0.00% | 0 | 0.00% | 2 |
| 2612 | cdc14 homologue | AF000367 | 1 | 0.01% | 1 | 0.01% | 0 | 0.00% | 0 | 0.00% | 2 |
| 2613 | CDC28 protein kinase 2 (CKS2) | 4502858 | 1 | 0.01% | 0 | 0.00% | 0 | 0.00% | 1 | 0.01% | 2 |
| 2614 | cell cycle protein (PA2G4) gene | AF104670.1 | 2 | 0.01% | 0 | 0.00% | 0 | 0.00% | 0 | 0.00% | 2 |
| 2615 | cell division cycle 20, S.cerevisiae homolog (CD | NM_001255.1 | 2 | 0.01% | 0 | 0.00% | 0 | 0.00% | 0 | 0.00% | 2 |
| 2616 | cullin 2 (CUL2) | AF126404.1 | 0 | 0.00% | 0 | 0.00% | 2 | 0.02% | 0 | 0.00% | 2 |
| 2617 | dedicator of cytokinesis 1 (DOCK1) | NM_001380.1 | 0 | 0.00% | 2 | 0.01% | 0 | 0.00% | 0 | 0.00% | 2 |
| 2618 | DNA for (CGG)n trinucleotide repeat region, isol | AJ001216.1 | 0 | 0.00% | 1 | 0.01% | 1 | 0.01% | 0 | 0.00% | 2 |
| 2619 | G1 to S phase transition 1 (GSPT1) | XM_055673.1 | 1 | 0.01% | 1 | 0.01% | 0 | 0.00% | 0 | 0.00% | 2 |

Figure 6 - Unique Known Genes Identified In Four cDNA Cartilage Libraries and EST Frequency Analysis - Page 47 of 102

| | | | | | | | | | | | |
|---|---|---|---|---|---|---|---|---|---|---|---|
| 2620 | growth arrest-specific 6 (GAS6) | NM_000820.1 | 2 | 0.01% | 0 | 0.00% | 0 | 0.00% | 0 | 0.00% | 2 |
| 2621 | growth arrest-specific 7 (GAS7), transCRipt varia | 5360211 | 0 | 0.00% | 1 | 0.01% | 1 | 0.01% | 0 | 0.00% | 2 |
| 2622 | GTP-binding protein RAB21 (RAB21) = KIAA011 | AF091035 | 0 | 0.00% | 0 | 0.00% | 1 | 0.01% | 1 | 0.01% | 2 |
| 2623 | MAC30 | L19183 | 2 | 0.01% | 0 | 0.00% | 0 | 0.00% | 0 | 0.00% | 2 |
| 2624 | rhoB | M74295 | 1 | 0.01% | 0 | 0.00% | 0 | 0.00% | 1 | 0.01% | 2 |
| 2625 | Topoisomerase I | CAA18536.1 | 0 | 0.00% | 1 | 0.01% | 1 | 0.01% | 0 | 0.00% | 2 |
| 2626 | X-linked nuclear protein (ATRX) | AF000160 | 2 | 0.01% | 0 | 0.00% | 0 | 0.00% | 0 | 0.00% | 2 |
| 2627 | API5-like 1 (API5L1) | NM_006595.1 | 0 | 0.00% | 1 | 0.01% | 0 | 0.00% | 1 | 0.01% | 2 |
| 2628 | beclin 1 (BECN1)mRNA, (=beclin 1 (coiled-coil, | AF139131.1 | 1 | 0.01% | 0 | 0.00% | 0 | 0.00% | 1 | 0.01% | 2 |
| 2629 | BNIP3L | AB004788.1 | 0 | 0.00% | 0 | 0.00% | 0 | 0.00% | 2 | 0.01% | 2 |
| 2630 | CASP8 associated protein 2 (RefSeq aa 2e-87) | NP_036247.1 | 1 | 0.01% | 1 | 0.01% | 0 | 0.00% | 0 | 0.00% | 2 |
| 2631 | CED-6 protein (CED-6) | NM_016315.1 | 0 | 0.00% | 1 | 0.01% | 1 | 0.01% | 0 | 0.00% | 2 |
| 2632 | dual-specificity protein phosphatase | U15932.1 | 0 | 0.00% | 1 | 0.01% | 0 | 0.00% | 1 | 0.01% | 2 |
| 2633 | neuronal apoptosis inhibitory protein | U19251 | 0 | 0.00% | 0 | 0.00% | 1 | 0.01% | 1 | 0.01% | 2 |
| 2634 | NOD1 protein (NOD1) gene | AF149773.1 | 0 | 0.00% | 0 | 0.00% | 2 | 0.02% | 0 | 0.00% | 2 |
| 2635 | programmed cell death 6 (PDCD6) | NM_013232.1 | 1 | 0.01% | 1 | 0.01% | 0 | 0.00% | 0 | 0.00% | 2 |
| 2636 | 45kDa splicing factor | AF083384 | 2 | 0.01% | 0 | 0.00% | 0 | 0.00% | 0 | 0.00% | 2 |
| 2637 | KH-type splicing regulatory protein (KHSRP) | NM_003685.1 | 2 | 0.01% | 0 | 0.00% | 0 | 0.00% | 0 | 0.00% | 2 |
| 2638 | polymerase (DNA-directed) kappa (POLK), mRN | Hs.135756 | 1 | 0.01% | 1 | 0.01% | 0 | 0.00% | 1 | 0.01% | 2 |
| 2639 | polymerase (RNA) II (DNA directed) polypeptide | NM_006234.1 | 2 | 0.01% | 0 | 0.00% | 0 | 0.00% | 0 | 0.00% | 2 |
| 2640 | Replication factor C (activator 1) 4 (37kD) | NM_002916.1 | 0 | 0.00% | 0 | 0.00% | 0 | 0.00% | 2 | 0.01% | 2 |
| 2641 | replication protein A1 (70kD) (RPA1) | NM_002945.1 | 0 | 0.00% | 2 | 0.01% | 0 | 0.00% | 0 | 0.00% | 2 |
| 2642 | replication protein A2 (32kD)(RPA2) | NM_002946.1 | 1 | 0.01% | 1 | 0.01% | 0 | 0.00% | 0 | 0.00% | 2 |
| 2643 | anaphase-promoting complex subunit 4 (APC4) | NM_013367.1 | 0 | 0.00% | 0 | 0.00% | 0 | 0.00% | 2 | 0.01% | 2 |
| 2644 | cell division control protein 16 (CDC16) mRNA, ( | AF164598.1 | 1 | 0.01% | 0 | 0.00% | 0 | 0.00% | 1 | 0.01% | 2 |
| 2645 | cysteine and glycine-rich protein 2 (CSRP2) (cor | U95018 | 1 | 0.01% | 0 | 0.00% | 1 | 0.01% | 0 | 0.00% | 2 |
| 2646 | Notch2-like (Notch2l) | NM_008715.1 | 0 | 0.00% | 2 | 0.01% | 0 | 0.00% | 0 | 0.00% | 2 |
| 2647 | p53 regulated PA26 nuclear protein (PA26) | NM_014454.1 | 0 | 0.00% | 2 | 0.01% | 0 | 0.00% | 0 | 0.00% | 2 |
| 2648 | proto-oncogene (Wnt-5a) | L20681.1 | 0 | 0.00% | 0 | 0.00% | 1 | 0.01% | 1 | 0.01% | 2 |
| 2649 | Pro-X carboxypeptidase precursor (RefSeq aa 7 | NP_005031.1 | 0 | 0.00% | 2 | 0.01% | 0 | 0.00% | 0 | 0.00% | 2 |
| 2650 | ras inhibitor | M37190 | 2 | 0.01% | 0 | 0.00% | 0 | 0.00% | 0 | 0.00% | 2 |
| 2651 | SEPTIN 2 HOMOLOGUE (SEP2) | Q14141 | 1 | 0.01% | 0 | 0.00% | 0 | 0.00% | 1 | 0.01% | 2 |
| 2652 | tumor antigen SLP-8p (HCC8)= AF102177.1(OR | NM_016516.1 | 0 | 0.00% | 1 | 0.01% | 0 | 0.00% | 1 | 0.01% | 2 |
| 2653 | tumor differentially expressed 1 (RefSeq aa 1e-7 | NP_006802.1 | 0 | 0.00% | 2 | 0.01% | 0 | 0.00% | 0 | 0.00% | 2 |
| 2654 | tumor necrosis factor alpha-induced protein 6 (T | NM_007115.1 | 0 | 0.00% | 0 | 0.00% | 1 | 0.01% | 1 | 0.01% | 2 |
| 2655 | tumor neCRosis factor receptor | M58286 | 1 | 0.01% | 1 | 0.01% | 0 | 0.00% | 0 | 0.00% | 2 |
| 2656 | tumor necrosis factor(ligand) superfamily, memb | NM_003810.1 | 0 | 0.00% | 0 | 0.00% | 0 | 0.00% | 2 | 0.01% | 2 |
| 2657 | tumor protein D52 (TPD52)(= N8=tumor express | NM_005079.1 | 0 | 0.00% | 1 | 0.01% | 1 | 0.01% | 0 | 0.00% | 2 |
| 2658 | tumor suppressor protein (101F6), putative | AF040704 | 1 | 0.01% | 1 | 0.01% | 0 | 0.00% | 0 | 0.00% | 2 |
| 2659 | tumor susceptiblity protein (TSG101) | U82130 | 1 | 0.01% | 0 | 0.00% | 0 | 0.00% | 1 | 0.01% | 2 |
| 2660 | integral type I protein | NM_007364.1 | 1 | 0.01% | 1 | 0.01% | 0 | 0.00% | 0 | 0.00% | 2 |
| 2661 | musculus DnaJ-like protein 1 (Dnajl1) | NM_007869.1 | 1 | 0.01% | 1 | 0.01% | 0 | 0.00% | 0 | 0.00% | 2 |
| 2662 | PROBABLE ARP2/3 COMPLEX 20 KD SUBUNI | spQ18491 | 1 | 0.01% | 0 | 0.00% | 1 | 0.01% | 0 | 0.00% | 2 |
| 2663 | protein kinase NY-REN-64 antigen (LOC51135) | NM_016123.1 | 0 | 0.00% | 0 | 0.00% | 2 | 0.02% | 0 | 0.00% | 2 |
| 2664 | semipalmatus 18S ribosomal RNA gene, comple | AF173638.1 | 0 | 0.00% | 1 | 0.01% | 0 | 0.00% | 1 | 0.01% | 2 |
| 2665 | 19 kDa subunit of NADH (complex I) | X59697 | 2 | 0.01% | 0 | 0.00% | 0 | 0.00% | 0 | 0.00% | 2 |
| 2666 | proteasome (prosome macropain) activator subu | NM_002818.1 | 1 | 0.01% | 0 | 0.00% | 1 | 0.01% | 0 | 0.00% | 2 |
| 2667 | proteasome subunit p45 26S | D44467 | 1 | 0.01% | 0 | 0.00% | 1 | 0.01% | 0 | 0.00% | 2 |
| 2668 | F-box only protein 2 (FBXO2) | NM_012168.1 | 0 | 0.00% | 1 | 0.01% | 0 | 0.00% | 1 | 0.01% | 2 |
| 2669 | ubiquitin specific protease | NM_004505.1 | 0 | 0.00% | 2 | 0.01% | 0 | 0.00% | 0 | 0.00% | 2 |
| 2670 | transCRiption factor ZFM1 (=L49380;L49345;Y0 | D26120 | 1 | 0.01% | 0 | 0.00% | 1 | 0.01% | 0 | 0.00% | 2 |
| 2671 | RNA for Golgi protein (GPP34 gene) | AJ296152.1 | 0 | 0.00% | 2 | 0.01% | 0 | 0.00% | 0 | 0.00% | 2 |
| 2672 | dnchc2 cytoplasmic dynein heavy chain | AB041881.1 | 0 | 0.00% | 0 | 0.00% | 2 | 0.02% | 0 | 0.00% | 2 |
| 2673 | kinesin family member 3B (KIF3B) (=KIAA0359) | NM_004798.1 | 0 | 0.00% | 1 | 0.01% | 0 | 0.00% | 1 | 0.01% | 2 |
| 2674 | CAK1 mRNA for Cdk-activating kinase=cyclin-de | X77303 | 0 | 0.00% | 0 | 0.00% | 2 | 0.02% | 0 | 0.00% | 2 |
| 2675 | guanylate binding protein isoform I (GBP-2) | M55542 | 0 | 0.00% | 0 | 0.00% | 2 | 0.02% | 0 | 0.00% | 2 |
| 2676 | CYTOCHROME C OXIDASE POLYPEPTIDE VI | P09669 | 0 | 0.00% | 0 | 0.00% | 0 | 0.00% | 2 | 0.01% | 2 |

Figure 6 - Unique Known Genes Identified In Four cDNA Cartilage Libraries and EST Frequency Analysis - Page 48 of 102

| | | | | | | | | | | | |
|---|---|---|---|---|---|---|---|---|---|---|---|
| 2677 | solute carrier family 16 (monocarboxylic acid tra | NM_004731.1 | 0 | 0.00% | 0 | 0.00% | 1 | 0.01% | 1 | 0.01% | 2 |
| 2678 | eukaryotic translation initiation factor 4B (EIF4B) | NM_001417.1 | 0 | 0.00% | 1 | 0.01% | 0 | 0.00% | 0 | 0.00% | 1 |
| 2679 | mitogen inducible gene mig-2 | Z24725 | 0 | 0.00% | 0 | 0.00% | 1 | 0.01% | 0 | 0.00% | 1 |
| 2680 | metallothionein | X97260 | 0 | 0.00% | 0 | 0.00% | 0 | 0.00% | 1 | 0.01% | 1 |
| 2681 | nucleoplasmin-3 (NPM3) | AF081280 | 1 | 0.01% | 0 | 0.00% | 0 | 0.00% | 0 | 0.00% | 1 |
| 2682 | ATP SYNTHASE COUPLING FACTOR 6, MITO | spP18859 | 0 | 0.00% | 0 | 0.00% | 0 | 0.00% | 1 | 0.01% | 1 |
| 2683 | cytochrome c oxidase COX subunit IV (COX IV) | M21575 | 1 | 0.01% | 0 | 0.00% | 0 | 0.00% | 0 | 0.00% | 1 |
| 2684 | aminopeptidase PILS (APPILS) | AF183569.1 | 0 | 0.00% | 0 | 0.00% | 0 | 0.00% | 1 | 0.01% | 1 |
| 2685 | heat shock protein, DNAJ-like 2 (HSJ2) | NM_001539.1 | 1 | 0.01% | 0 | 0.00% | 0 | 0.00% | 0 | 0.00% | 1 |
| 2686 | cytochrome P450 (CYP1A2) | M31667 | 1 | 0.01% | 0 | 0.00% | 0 | 0.00% | 0 | 0.00% | 1 |
| 2687 | integral membrane protein Tmp21-I (p23) | AJ004913.1 | 0 | 0.00% | 0 | 0.00% | 0 | 0.00% | 1 | 0.01% | 1 |
| 2688 | cadherin 11, OB-cadherin(osteoblast) (CDH11)( | NM_001797.1 | 0 | 0.00% | 1 | 0.01% | 0 | 0.00% | 0 | 0.00% | 1 |
| 2689 | solute carrier family 4, anion exchanger, membe | NM_005070.1 | 1 | 0.01% | 0 | 0.00% | 0 | 0.00% | 0 | 0.00% | 1 |
| 2690 | beta-galactosidase (GLB1) | M34423.1 | 1 | 0.01% | 0 | 0.00% | 0 | 0.00% | 0 | 0.00% | 1 |
| 2691 | protein phosphatase 2A 130 kDa regulatory sub | L07590 | 0 | 0.00% | 0 | 0.00% | 1 | 0.01% | 0 | 0.00% | 1 |
| 2692 | 5' cap guanine-N-7 methyltransferase (RNMT) | AF067791.1 | 0 | 0.00% | 0 | 0.00% | 1 | 0.01% | 1 | 0.01% | 1 |
| 2693 | calcineurin A1 | M29550.1 | 0 | 0.00% | 0 | 0.00% | 1 | 0.01% | 0 | 0.00% | 1 |
| 2694 | baculoviral IAP repeat-containing 6 (BIRC6) | NM_016252.1 | 0 | 0.00% | 1 | 0.01% | 0 | 0.00% | 0 | 0.00% | 1 |
| 2695 | PTD019 (=HSPC203) | AF226729.1 | 0 | 0.00% | 1 | 0.01% | 0 | 0.00% | 0 | 0.00% | 1 |
| 2696 | spastic paraplegia 4 | NM_014946.1 | 0 | 0.00% | 1 | 0.01% | 0 | 0.00% | 0 | 0.00% | 1 |
| 2697 | uncharacterized protein | AK002062 | 0 | 0.00% | 0 | 0.00% | 1 | 0.01% | 0 | 0.00% | 1 |
| 2698 | a disintegrin and metalloproteinase domain 28 ( | NM_014265.1 | 0 | 0.00% | 0 | 0.00% | 1 | 0.01% | 0 | 0.00% | 1 |
| 2699 | procollagen-proline, 2-oxoglutarate4-dioxygenas | NP_000908.1 | 0 | 0.00% | 1 | 0.01% | 0 | 0.00% | 0 | 0.00% | 1 |
| 2700 | proteasome (prosome, maCRopain) 26S subuni | NM_002816.1 | 0 | 0.00% | 0 | 0.00% | 1 | 0.01% | 0 | 0.00% | 1 |
| 2701 | c-maf long form | AF055377.1 | 0 | 0.00% | 0 | 0.00% | 0 | 0.00% | 1 | 0.01% | 1 |
| 2702 | Kruppel-like zinc finger protein Zf9 | AF001461 | 1 | 0.01% | 0 | 0.00% | 0 | 0.00% | 0 | 0.00% | 1 |
| 2703 | Tat-interacting protein (30kD) (TIP30) | 5454125 | 0 | 0.00% | 0 | 0.00% | 0 | 0.00% | 1 | 0.01% | 1 |
| 2704 | zinc finger protein | L16896 | 1 | 0.01% | 0 | 0.00% | 0 | 0.00% | 0 | 0.00% | 1 |
| 2705 | zinc finger protein 22 (KOX 15) (RefSeq aa 1e-4 | NP_008894.1 | 0 | 0.00% | 1 | 0.01% | 0 | 0.00% | 0 | 0.00% | 1 |
| 2706 | ribonucleoprotein gene 60-kD SS-A/Ro D8 | U44388.1 | 0 | 0.00% | 0 | 0.00% | 0 | 0.00% | 1 | 0.01% | 1 |
| 2707 | betaglycan (TBR III gene) | AJ251961.1 | 0 | 0.00% | 1 | 0.01% | 0 | 0.00% | 0 | 0.00% | 1 |
| 2708 | Estrogen receptor 1 (ESR1) | NM_000125.1 | 0 | 0.00% | 1 | 0.01% | 0 | 0.00% | 1 | 0.01% | 1 |
| 2709 | glucocorticoid-induced leucine zipper GILZ prote | AF024519 | 1 | 0.01% | 0 | 0.00% | 0 | 0.00% | 0 | 0.00% | 1 |
| 2710 | activated leucocyte cell adhesion molecule (ALC | NM_001627.1 | 0 | 0.00% | 0 | 0.00% | 0 | 0.00% | 1 | 0.01% | 1 |
| 2711 | BCL2-associated athanogene 3 (BAG3), mRNA | Hs.15259 | 0 | 0.00% | 0 | 0.00% | 0 | 0.00% | 1 | 0.01% | 1 |
| 2712 | fetal liver cDNA library | AI133292.1 | 0 | 0.00% | 0 | 0.00% | 1 | 0.01% | 0 | 0.00% | 1 |
| 2713 | unnamed protein product | BAB15083.1 | 0 | 0.00% | 1 | 0.01% | 0 | 0.00% | 0 | 0.00% | 1 |
| 2714 | solute carrier family 16 (monocarboxylic acid tra | gi4759113 | 0 | 0.00% | 0 | 0.00% | 0 | 0.00% | 1 | 0.01% | 1 |
| 2715 | muscle-type phosphofructokinase (PFK-M) gene | M59741 | 0 | 0.00% | 0 | 0.00% | 0 | 0.00% | 1 | 0.01% | 1 |
| 2716 | protein tyrosine phosphatase (PRL-1) | L39000 | 1 | 0.01% | 0 | 0.00% | 0 | 0.00% | 0 | 0.00% | 1 |
| 2717 | 5-lipoxygenase activating protein (FLAP) (arach | M63262.1 | 0 | 0.00% | 0 | 0.00% | 1 | 0.01% | 0 | 0.00% | 1 |
| 2718 | NADH dehydrogenase (ubiquinone) 1 alpha sub | NM_004542.1 | 1 | 0.01% | 0 | 0.00% | 0 | 0.00% | 0 | 0.00% | 1 |
| 2719 | SUCCINATE DEHYDROGENASE [UBIQUINON | spP31040 | 0 | 0.00% | 0 | 0.00% | 1 | 0.01% | 0 | 0.00% | 1 |
| 2720 | translation initiation factor IF2 (IF2)(ORF) | NM_015904.1 | 0 | 0.00% | 0 | 0.00% | 0 | 0.00% | 1 | 0.01% | 1 |
| 2721 | PROTEASOME THETA CHAIN (MACROPAIN T | spP49720 | 0 | 0.00% | 0 | 0.00% | 0 | 0.00% | 1 | 0.01% | 1 |
| 2722 | general transcription factor IIE, polypeptide 2 | NM_002095.1 | 1 | 0.01% | 0 | 0.00% | 0 | 0.00% | 0 | 0.00% | 1 |
| 2723 | hematopoietic-derived zinc fingerprotein (RefSe | NP_004867.1 | 0 | 0.00% | 1 | 0.01% | 0 | 0.00% | 0 | 0.00% | 1 |
| 2724 | zinc finger protein 208(ZNF208) | NM_007153.1 | 0 | 0.00% | 0 | 0.00% | 1 | 0.01% | 0 | 0.00% | 1 |
| 2725 | ZNF202 beta (ZNF202) | AF027219 | 0 | 0.00% | 0 | 0.00% | 1 | 0.01% | 0 | 0.00% | 1 |
| 2726 | pirin (PIR) | gi4505822 | 0 | 0.00% | 0 | 0.00% | 1 | 0.01% | 0 | 0.00% | 1 |
| 2727 | U6 snRNA | X59362 | 1 | 0.01% | 0 | 0.00% | 0 | 0.00% | 0 | 0.00% | 1 |
| 2728 | RNA polymerase II subunit | U37690.1 | 1 | 0.01% | 0 | 0.00% | 0 | 0.00% | 0 | 0.00% | 1 |
| 2729 | mitochondrial ribosomal protein L20 (MRPL20), | XM_027716.1 | 0 | 0.00% | 0 | 0.00% | 0 | 0.00% | 1 | 0.01% | 1 |
| 2730 | MHC class I HLA-C-alpha-2 chain | M24097 | 0 | 0.00% | 0 | 0.00% | 1 | 0.01% | 0 | 0.00% | 1 |
| 2731 | beta-preprotachykinin | X54469.1 | 0 | 0.00% | 1 | 0.01% | 0 | 0.00% | 0 | 0.00% | 1 |
| 2732 | pre-B-cell colony-enhancing factor (PBEF) | NM_005746.1 | 0 | 0.00% | 0 | 0.00% | 1 | 0.01% | 0 | 0.00% | 1 |
| 2733 | adaptor-related protein complex 3, beta 1 subun | NM_003664.1 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 49 of 102

| | | | | | | | | | | | |
|---|---|---|---|---|---|---|---|---|---|---|---|
| 2734 | transmembrane 4 superfamily member (tetraspa | NM_012338.1 | 0 | 0.00% | 0 | 0.00% | 1 | 0.01% | 0 | 0.00% | 1 |
| 2735 | adaptor-related protein complex 3, delta 1 subur | NM_003938.1 | 1 | 0.01% | 0 | 0.00% | 0 | 0.00% | 0 | 0.00% | 1 |
| 2736 | seven transmembrane domain protein (NIFIE14) | NM_006326.1 | 1 | 0.01% | 0 | 0.00% | 0 | 0.00% | 0 | 0.00% | 1 |
| 2737 | DNA topoisomerase III | U43431.1 | 1 | 0.01% | 0 | 0.00% | 0 | 0.00% | 0 | 0.00% | 1 |
| 2738 | SWI/SNF related, matrix associated, actin deper | NP_003061.1 | 0 | 0.00% | 0 | 0.00% | 1 | 0.01% | 0 | 0.00% | 1 |
| 2739 | methyltransferase (HASJ4442) | NM_017528.1 | 1 | 0.01% | 0 | 0.00% | 0 | 0.00% | 0 | 0.00% | 1 |
| 2740 | collagen binding protein 2 | D83174.1 | 1 | 0.01% | 0 | 0.00% | 0 | 0.00% | 0 | 0.00% | 1 |
| 2741 | syndecan-1 gene (exons 2-5) | Z48199.1 | 0 | 0.00% | 0 | 0.00% | 1 | 0.01% | 0 | 0.00% | 1 |
| 2742 | CC-chemokine receptor(CCR-5) gene, delta-32 a | AF009962.1 | 0 | 0.00% | 0 | 0.00% | 0 | 0.00% | 1 | 0.01% | 1 |
| 2743 | interferon, alpha-inducible protein 27(RefSeq aa | NP_005523.1 | 0 | 0.00% | 1 | 0.01% | 0 | 0.00% | 0 | 0.00% | 1 |
| 2744 | mitogen-activated protein kinase 6 (MAPK6) | NM_002748.1 | 0 | 0.00% | 1 | 0.01% | 0 | 0.00% | 0 | 0.00% | 1 |
| 2745 | MAD (mothers against decapentaplegic, Drosop | NM_005904.1 | 0 | 0.00% | 1 | 0.01% | 0 | 0.00% | 0 | 0.00% | 1 |
| 2746 | developmentally regulated GTP-binding protein : | X80754 | 1 | 0.01% | 0 | 0.00% | 0 | 0.00% | 0 | 0.00% | 1 |
| 2747 | melanoma differentiation associated (mda-6)= L | U09579.1 | 1 | 0.01% | 0 | 0.00% | 0 | 0.00% | 0 | 0.00% | 1 |
| 2748 | ADP-ribosylation factor-like 1 (ARL1) | NM_001177.2 | 0 | 0.00% | 0 | 0.00% | 0 | 0.00% | 1 | 0.01% | 1 |
| 2749 | mannose-specific lectin (MR60) | U09716.1 | 0 | 0.00% | 0 | 0.00% | 0 | 0.00% | 1 | 0.01% | 1 |
| 2750 | postmeiotic segregation increased 2-like 8 (RefS | NP_005385.1 | 0 | 0.00% | 1 | 0.01% | 0 | 0.00% | 0 | 0.00% | 1 |
| 2751 | spindlin (Spin) | NM_011462.1 | 0 | 0.00% | 0 | 0.00% | 0 | 0.00% | 1 | 0.01% | 1 |
| 2752 | p53 binding protein | U82939.1 | 0 | 0.00% | 0 | 0.00% | 0 | 0.00% | 1 | 0.01% | 1 |
| 2753 | BRAIN PROTEIN I3 | P28662 | 1 | 0.01% | 0 | 0.00% | 0 | 0.00% | 0 | 0.00% | 1 |
| 2754 | cerebellar degeneration-related protein (34kD) (( | NM_004065.1 | 0 | 0.00% | 1 | 0.01% | 0 | 0.00% | 0 | 0.00% | 1 |
| 2755 | fetal brain oculocerebrorenal syndrome (OCRL1 | U57627 | 0 | 0.00% | 0 | 0.00% | 0 | 0.00% | 1 | 0.01% | 1 |
| 2756 | fungal sterol-C5-desaturase homolog | D85181.1 | 0 | 0.00% | 0 | 0.00% | 0 | 0.00% | 1 | 0.01% | 1 |
| 2757 | HSPC280 | AF161398.1 | 0 | 0.00% | 0 | 0.00% | 1 | 0.01% | 0 | 0.00% | 1 |
| 2758 | HSPC282 | AF161400 | 0 | 0.00% | 1 | 0.01% | 0 | 0.00% | 0 | 0.00% | 1 |
| 2759 | hypothetical protein MGC3037 (MGC3037), mRl | Hs.301789 | 0 | 0.00% | 0 | 0.00% | 0 | 0.00% | 1 | 0.01% | 1 |
| 2760 | immature colon carcinoma transcript 1(RefSeq a | NP_001536.1 | 0 | 0.00% | 1 | 0.01% | 0 | 0.00% | 0 | 0.00% | 1 |
| 2761 | integral membrane protein type II (NKG2-D) (=U | AF001297 | 0 | 0.00% | 0 | 0.00% | 1 | 0.01% | 0 | 0.00% | 1 |
| 2762 | isolate Indonesian 79 type 299 mitochondrial co | AF176203 | 1 | 0.01% | 0 | 0.00% | 0 | 0.00% | 0 | 0.00% | 1 |
| 2763 | KIAA0250 gene | NM_014837.1 | 0 | 0.00% | 0 | 0.00% | 1 | 0.01% | 0 | 0.00% | 1 |
| 2764 | KIAA0260 gene | D87449.1 | 0 | 0.00% | 0 | 0.00% | 1 | 0.01% | 0 | 0.00% | 1 |
| 2765 | KIAA0388 | AB002386.1 | 0 | 0.00% | 1 | 0.01% | 0 | 0.00% | 0 | 0.00% | 1 |
| 2766 | KIAA0576 protein | AB011148.1 | 0 | 0.00% | 0 | 0.00% | 1 | 0.01% | 0 | 0.00% | 1 |
| 2767 | NTT gene (L1 Alu and MER 38 repeat regions) | U54776.1 | 0 | 0.00% | 0 | 0.00% | 1 | 0.01% | 0 | 0.00% | 1 |
| 2768 | ORF2-like protein | AAD04635.1 | 0 | 0.00% | 0 | 0.00% | 1 | 0.01% | 0 | 0.00% | 1 |
| 2769 | PMS2L13 | AB017004.1 | 0 | 0.00% | 0 | 0.00% | 0 | 0.00% | 1 | 0.01% | 1 |
| 2770 | putative (LOC116228), mRNA | XM_057659.2 | 0 | 0.00% | 0 | 0.00% | 0 | 0.00% | 1 | 0.01% | 1 |
| 2771 | RAB, member of RAS oncogene family-like 2B (I | NM_007081.1 | 0 | 0.00% | 0 | 0.00% | 1 | 0.01% | 0 | 0.00% | 1 |
| 2772 | sushi-repeat protein (SRPUL) | NM_014467.1 | 1 | 0.01% | 0 | 0.00% | 0 | 0.00% | 0 | 0.00% | 1 |
| 2773 | VACUOLAR ATP SYNTHASE SUBUNIT H (V-A | spO15342 | 0 | 0.00% | 0 | 0.00% | 0 | 0.00% | 1 | 0.01% | 1 |
| 2774 | nicotinamide nucleotide transhydrogenase (NNT | NM_012343.1 | 0 | 0.00% | 0 | 0.00% | 1 | 0.01% | 0 | 0.00% | 1 |
| 2775 | palmitoylated membrane protein 3 (RefSeq aa 1 | NP_001923.1 | 0 | 0.00% | 1 | 0.01% | 0 | 0.00% | 0 | 0.00% | 1 |
| 2776 | protein phosphatase 4 regulatory subunit 1 (PPF | NM_005134.1 | 1 | 0.01% | 0 | 0.00% | 0 | 0.00% | 0 | 0.00% | 1 |
| 2777 | POLY(A) POLYMERASE (PAP) (POLYNUCLEO | spP51003 | 0 | 0.00% | 0 | 0.00% | 0 | 0.00% | 1 | 0.01% | 1 |
| 2778 | ATP-citrate lyase | X64330 | 1 | 0.01% | 0 | 0.00% | 0 | 0.00% | 0 | 0.00% | 1 |
| 2779 | phosphatidic acid phosphatase type 2c (Ppap2c | AF123611.1 | 0 | 0.00% | 0 | 0.00% | 0 | 0.00% | 1 | 0.01% | 1 |
| 2780 | cytochrome c (HS7) processed pseudogene | M22893.1 | 0 | 0.00% | 0 | 0.00% | 1 | 0.01% | 0 | 0.00% | 1 |
| 2781 | mitochondrial 3-ketoacyl-CoA thiolase beta-subu | D16481.1 | 0 | 0.00% | 0 | 0.00% | 1 | 0.01% | 0 | 0.00% | 1 |
| 2782 | mitochondrial acetoacetyl-coenzyme A thiolase ( | D90228 | 0 | 0.00% | 0 | 0.00% | 0 | 0.00% | 1 | 0.01% | 1 |
| 2783 | mitochondrial elongation factor G | L14684 | 0 | 0.00% | 0 | 0.00% | 1 | 0.01% | 0 | 0.00% | 1 |
| 2784 | mitochondrial F1FO-type ATPase subunit d | AF087135.1 | 0 | 0.00% | 0 | 0.00% | 0 | 0.00% | 1 | 0.01% | 1 |
| 2785 | NADH dehydrogenase (ubiquinone) 1 alpha sub | NP_004993.1 | 0 | 0.00% | 1 | 0.01% | 0 | 0.00% | 0 | 0.00% | 1 |
| 2786 | ubiquinol cytochrome-c reductase core I protein | L16842 | 0 | 0.00% | 0 | 0.00% | 0 | 0.00% | 1 | 0.01% | 1 |
| 2787 | aspartyl protease(BACE2) mRNA, complete cds | AF188277.1 | 1 | 0.01% | 0 | 0.00% | 0 | 0.00% | 0 | 0.00% | 1 |
| 2788 | carbamyl phosphate synthetase I | AF154830.1 | 0 | 0.00% | 0 | 0.00% | 1 | 0.01% | 0 | 0.00% | 1 |
| 2789 | glutamine:fructose-6-phosphate amidotransferas | M90516.1 | 0 | 0.00% | 0 | 0.00% | 0 | 0.00% | 1 | 0.01% | 1 |
| 2790 | selenium donor protein (selD) | U34044 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 50 of 102

| | | | | | | | | | | | |
|---|---|---|---|---|---|---|---|---|---|---|---|
| 2791 | tousled-like kinase 1 (RefSeq aa 1e-49) | NP_036422.1 | 0 | 0.00% | 1 | 0.01% | 0 | 0.00% | 0 | 0.00% | 1 |
| 2792 | peroxisomal biogenesis factor 3 (PEX3) | NM_003630.1 | 0 | 0.00% | 0 | 0.00% | 1 | 0.01% | 0 | 0.00% | 1 |
| 2793 | peroxisome biogenesis disorder protein 1 (PEX1 | AF026086 | 1 | 0.01% | 0 | 0.00% | 0 | 0.00% | 0 | 0.00% | 1 |
| 2794 | signal recognition particle receptor ('docking pro | NM_003139.1 | 0 | 0.00% | 1 | 0.01% | 0 | 0.00% | 0 | 0.00% | 1 |
| 2795 | UBIQUITIN CARBOXYL-TERMINAL HYDROLA | spO75317 | 0 | 0.00% | 0 | 0.00% | 1 | 0.01% | 0 | 0.00% | 1 |
| 2796 | ubiquitin specific protease 11 (USP11) | NM_004651.1 | 1 | 0.01% | 0 | 0.00% | 0 | 0.00% | 0 | 0.00% | 1 |
| 2797 | ASH2L (absent, small, or homeotic, Drosophila, | NM_004674.1 | 0 | 0.00% | 0 | 0.00% | 1 | 0.01% | 0 | 0.00% | 1 |
| 2798 | c-myc gene | 1001205A | 0 | 0.00% | 1 | 0.01% | 0 | 0.00% | 0 | 0.00% | 1 |
| 2799 | colon Kruppel-like factor (CKLF) | AF132818.1 | 1 | 0.01% | 0 | 0.00% | 0 | 0.00% | 0 | 0.00% | 1 |
| 2800 | general transcription factor IIF, polypeptide 1 (74 | NM_002096.1 | 0 | 0.00% | 1 | 0.01% | 0 | 0.00% | 0 | 0.00% | 1 |
| 2801 | hedgehog-interacting protein (Hip) | AF116865.1 | 0 | 0.00% | 0 | 0.00% | 1 | 0.01% | 0 | 0.00% | 1 |
| 2802 | HZF3 mRNA for zinc finger protein(ORF) | X78926 | 0 | 0.00% | 0 | 0.00% | 1 | 0.01% | 0 | 0.00% | 1 |
| 2803 | Nef-associated factor 1(NAF1) mRNA | NM_006058.1 | 0 | 0.00% | 0 | 0.00% | 0 | 0.00% | 1 | 0.01% | 1 |
| 2804 | retinoblastoma-binding protein 8 (RBBP8) | NM_002894.1 | 0 | 0.00% | 0 | 0.00% | 1 | 0.01% | 0 | 0.00% | 1 |
| 2805 | transCRiption elongation factor S-II, hS-II-T1 | D50495 | 1 | 0.01% | 0 | 0.00% | 0 | 0.00% | 0 | 0.00% | 1 |
| 2806 | transCRiption factor 4, Helix-loop-helix transCRi | M65209 | 0 | 0.00% | 0 | 0.00% | 0 | 0.00% | 1 | 0.01% | 1 |
| 2807 | zinc finger protein (PRD51) gene | U88082.1 | 0 | 0.00% | 1 | 0.01% | 0 | 0.00% | 0 | 0.00% | 1 |
| 2808 | Zinc-finger helicase (hZFH) | U91543.1 | 1 | 0.01% | 0 | 0.00% | 0 | 0.00% | 0 | 0.00% | 1 |
| 2809 | capping enzyme (HCE) | AF025654 | 0 | 0.00% | 0 | 0.00% | 0 | 0.00% | 1 | 0.01% | 1 |
| 2810 | cleavage and polyadenylation specific factor 4, 3 | NM_006693.1 | 0 | 0.00% | 1 | 0.01% | 0 | 0.00% | 0 | 0.00% | 1 |
| 2811 | DEAD-box protein p72 (P72) | U59321 | 1 | 0.01% | 0 | 0.00% | 0 | 0.00% | 0 | 0.00% | 1 |
| 2812 | TFIID subunit p22 | D50544 | 0 | 0.00% | 0 | 0.00% | 1 | 0.01% | 0 | 0.00% | 1 |
| 2813 | U5 snRNP 100 kD protein | AF026402.1 | 1 | 0.01% | 0 | 0.00% | 0 | 0.00% | 0 | 0.00% | 1 |
| 2814 | nasopharyngeal carcinoma susceptibility protein | NP_037407.1 | 0 | 0.00% | 1 | 0.01% | 0 | 0.00% | 0 | 0.00% | 1 |
| 2815 | HLA-B gene (HLA-B*0801 allele), complete cds | D83956.1 | 0 | 0.00% | 1 | 0.01% | 0 | 0.00% | 0 | 0.00% | 1 |
| 2816 | diptheria toxin resistance protein required for dip | NM_001383.1 | 0 | 0.00% | 1 | 0.01% | 0 | 0.00% | 0 | 0.00% | 1 |
| 2817 | heat-responsive protein 12 (Hrsp12) | NM_008287.1 | 0 | 0.00% | 0 | 0.00% | 1 | 0.01% | 0 | 0.00% | 1 |
| 2818 | neuronal tissue-enriched acidic protein (NAP-22 | AF039656 | 0 | 0.00% | 0 | 0.00% | 0 | 0.00% | 1 | 0.01% | 1 |
| 2819 | xeroderma pigmentosum complementation grou | NM_004628.1 | 0 | 0.00% | 0 | 0.00% | 0 | 0.00% | 1 | 0.01% | 1 |
| 2820 | carbonic anhydrase II (CA2) | NM_000067.1 | 1 | 0.01% | 0 | 0.00% | 0 | 0.00% | 0 | 0.00% | 1 |
| 2821 | PKCq-interacting protein PICOT (PICOT) (ORF) | AF118652 | 0 | 0.00% | 0 | 0.00% | 1 | 0.01% | 0 | 0.00% | 1 |
| 2822 | hect domain and RLD 3 (HERC3) | NM_014606.1 | 0 | 0.00% | 1 | 0.01% | 0 | 0.00% | 0 | 0.00% | 1 |
| 2823 | 33 kDa Vamp-associated protein (VAP33) | AF044670 | 0 | 0.00% | 0 | 0.00% | 0 | 0.00% | 1 | 0.01% | 1 |
| 2824 | CGI-76 protein | AF151834.1 | 0 | 0.00% | 0 | 0.00% | 0 | 0.00% | 1 | 0.01% | 1 |
| 2825 | ankyrin-like protein | Y10601.1 | 0 | 0.00% | 0 | 0.00% | 1 | 0.01% | 0 | 0.00% | 1 |
| 2826 | F-actin capping protein beta subunit | U03271 | 0 | 0.00% | 0 | 0.00% | 1 | 0.01% | 0 | 0.00% | 1 |
| 2827 | cardiac ventricular troponin C | AF020769 | 1 | 0.01% | 0 | 0.00% | 0 | 0.00% | 0 | 0.00% | 1 |
| 2828 | tropomyosin isoform | Z24727 | 0 | 0.00% | 0 | 0.00% | 0 | 0.00% | 1 | 0.01% | 1 |
| 2829 | 22 kDa peroxisomal membrane protein-like (LO( | NM_018663.1 | 1 | 0.01% | 0 | 0.00% | 0 | 0.00% | 0 | 0.00% | 1 |
| 2830 | angiotensin receptor 1 (AGTR1) | NM_009585.1 | 0 | 0.00% | 0 | 0.00% | 1 | 0.01% | 0 | 0.00% | 1 |
| 2831 | dickkopf (Xenopus laevis) homolog 1 (DKK1) | NM_012242.1 | 0 | 0.00% | 0 | 0.00% | 1 | 0.01% | 0 | 0.00% | 1 |
| 2832 | epidermal growth factor receptor substrate (eps1 | U07707 | 0 | 0.00% | 0 | 0.00% | 1 | 0.01% | 0 | 0.00% | 1 |
| 2833 | FYN oncogene related to SRC, FGR, YES (FYN | NM_002037.1 | 1 | 0.01% | 0 | 0.00% | 0 | 0.00% | 0 | 0.00% | 1 |
| 2834 | G protein Golf alpha gene | U55184.1 | 0 | 0.00% | 1 | 0.01% | 0 | 0.00% | 0 | 0.00% | 1 |
| 2835 | glucocorticoid receptor alpha | U25029.1 | 0 | 0.00% | 1 | 0.01% | 0 | 0.00% | 0 | 0.00% | 1 |
| 2836 | Homer, neuronal immediate early gene, 1B (SYN | NM_004272.1 | 1 | 0.01% | 0 | 0.00% | 0 | 0.00% | 0 | 0.00% | 1 |
| 2837 | interferon, alpha-inducible protein (clone IFI-6-16 | NM_002038.1 | 0 | 0.00% | 1 | 0.01% | 0 | 0.00% | 0 | 0.00% | 1 |
| 2838 | interleukin 6 signal transducer (gp130, oncostati | NM_002184.1 | 0 | 0.00% | 0 | 0.00% | 1 | 0.01% | 0 | 0.00% | 1 |
| 2839 | vesicle-associated soluble NSFattachment prote | NP_006361.1 | 0 | 0.00% | 1 | 0.01% | 0 | 0.00% | 0 | 0.00% | 1 |
| 2840 | mitogen-activated protein kinase 7 (MAPK7) | NM_002749.1 | 1 | 0.01% | 0 | 0.00% | 0 | 0.00% | 0 | 0.00% | 1 |
| 2841 | phosphoenolpyruvate carboxykinase (PCK1) (cl | L05144 | 0 | 0.00% | 0 | 0.00% | 1 | 0.01% | 0 | 0.00% | 1 |
| 2842 | serine/threonine protein phosphatase catalytic s | NM_016294.1 | 1 | 0.01% | 0 | 0.00% | 0 | 0.00% | 0 | 0.00% | 1 |
| 2843 | serine-arginine-rich splicing regulatory protein S | AAF37578.1 | 0 | 0.00% | 0 | 0.00% | 1 | 0.01% | 0 | 0.00% | 1 |
| 2844 | tyrosine kinase (HTK) | U07695 | 1 | 0.01% | 0 | 0.00% | 0 | 0.00% | 0 | 0.00% | 1 |
| 2845 | cAMP-specific phosphodiesterase 4D (PDE4DN | AJ250854.1 | 0 | 0.00% | 1 | 0.01% | 0 | 0.00% | 0 | 0.00% | 1 |
| 2846 | RAB23 protein (LOC51715)(HSPC137) | NM_016277.1 | 0 | 0.00% | 0 | 0.00% | 0 | 0.00% | 1 | 0.01% | 1 |
| 2847 | Rab3D (rab3d) | AF263366.1 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 51 of 102

| | | | | | | | | | | | |
|---|---|---|---|---|---|---|---|---|---|---|---|
| 2848 | alpha-amidating monooxygenase | AF010472 | 0 | 0.00% | 0 | 0.00% | 1 | 0.01% | 0 | 0.00% | 1 |
| 2849 | granulin (GRN) | NM_002087.1 | 0 | 0.00% | 1 | 0.01% | 0 | 0.00% | 0 | 0.00% | 1 |
| 2850 | monocyte chemoattractant protein 4 | X98306 | 0 | 0.00% | 0 | 0.00% | 0 | 0.00% | 1 | 0.01% | 1 |
| 2851 | uncharacterized hematopoieticstem/progenitor c | NP_060936.1 | 0 | 0.00% | 1 | 0.01% | 0 | 0.00% | 0 | 0.00% | 1 |
| 2852 | ADP-ribosyltransferase (NAD ; poly (ADP-ribose | gi5915659 | 0 | 0.00% | 0 | 0.00% | 0 | 0.00% | 1 | 0.01% | 1 |
| 2853 | calgizzarin (=D49355 S100C protein; X80201 MI | D38583 | 1 | 0.01% | 0 | 0.00% | 0 | 0.00% | 0 | 0.00% | 1 |
| 2854 | ABC transporter umat (ABCB6 gene)(= MT-ABC | AJ289233.2 | 1 | 0.01% | 0 | 0.00% | 0 | 0.00% | 0 | 0.00% | 1 |
| 2855 | heme-regulated eukaryotic initiation factor 2 alph | AF255050.1 | 1 | 0.01% | 0 | 0.00% | 0 | 0.00% | 0 | 0.00% | 1 |
| 2856 | potassium inwardly-rectifying channel, subfamily | NP_002236.1 | 0 | 0.00% | 1 | 0.01% | 0 | 0.00% | 0 | 0.00% | 1 |
| 2857 | PAK-interacting exchange factor beta (P85SPR) | NM_003899.1 | 0 | 0.00% | 0 | 0.00% | 0 | 0.00% | 1 | 0.01% | 1 |
| 2858 | Heterochromatin protein 1 gamma | AB030905.1 | 0 | 0.00% | 0 | 0.00% | 0 | 0.00% | 1 | 0.01% | 1 |
| 2859 | histone deacetylase 6 (KIAA0901) | NM_006044.1 | 1 | 0.01% | 0 | 0.00% | 0 | 0.00% | 0 | 0.00% | 1 |
| 2860 | histone stem-loop binding protein (SLBP) | U75679 | 1 | 0.01% | 0 | 0.00% | 0 | 0.00% | 0 | 0.00% | 1 |
| 2861 | RecQ protein-like (DNA helicase Q1-like) (RECQ | NM_002907.1 | 0 | 0.00% | 0 | 0.00% | 1 | 0.01% | 0 | 0.00% | 1 |
| 2862 | CYCLIN A/CDK2-ASSOCIATED PROTEIN P19 | spP34991 | 0 | 0.00% | 0 | 0.00% | 0 | 0.00% | 1 | 0.01% | 1 |
| 2863 | polymerase (RNA) II (DNA directed) polypeptide | NP_000929.1 | 0 | 0.00% | 1 | 0.01% | 0 | 0.00% | 0 | 0.00% | 1 |
| 2864 | 10kD protein (BC10) | AF053470 | 1 | 0.01% | 0 | 0.00% | 0 | 0.00% | 0 | 0.00% | 1 |
| 2865 | 14-3-3 sigma protein promoter and gene, comple | AF029081.1 | 1 | 0.01% | 0 | 0.00% | 0 | 0.00% | 0 | 0.00% | 1 |
| 2866 | 19.5 protein | M32486 | 0 | 0.00% | 0 | 0.00% | 1 | 0.01% | 0 | 0.00% | 1 |
| 2867 | 1-aminocyclopropane-1-carboxylate synthase | A35516 | 1 | 0.01% | 0 | 0.00% | 0 | 0.00% | 0 | 0.00% | 1 |
| 2868 | 23 kD highly basic protein | X56932 | 1 | 0.01% | 0 | 0.00% | 0 | 0.00% | 0 | 0.00% | 1 |
| 2869 | 2-hydroxyacid dehydrogenase | AF113251.1 | 1 | 0.01% | 0 | 0.00% | 0 | 0.00% | 0 | 0.00% | 1 |
| 2870 | 2-hydroxyphytanoyl-CoA lyase (RefSeq aa 7e-6 | NP_036392.1 | 0 | 0.00% | 1 | 0.01% | 0 | 0.00% | 0 | 0.00% | 1 |
| 2871 | 3-7 gene product | D64159 | 0 | 0.00% | 0 | 0.00% | 1 | 0.01% | 0 | 0.00% | 1 |
| 2872 | 3pv2 and 5p152 genes | sp\|P39194 | 0 | 0.00% | 1 | 0.01% | 0 | 0.00% | 0 | 0.00% | 1 |
| 2873 | 40 kDa product (=M19503 ORF1; putative) | AAB59367.1 | 0 | 0.00% | 0 | 0.00% | 1 | 0.01% | 0 | 0.00% | 1 |
| 2874 | 54TMp (54tm) (=S83365 RAB5-interaction prote | AF004876 | 1 | 0.01% | 0 | 0.00% | 0 | 0.00% | 0 | 0.00% | 1 |
| 2875 | 55 kDa protein | AF155658.1 | 0 | 0.00% | 0 | 0.00% | 0 | 0.00% | 1 | 0.01% | 1 |
| 2876 | 7h3 protein | AF209931 | 1 | 0.01% | 0 | 0.00% | 0 | 0.00% | 0 | 0.00% | 1 |
| 2877 | 88.8 kDa protein | AF225417.1 | 0 | 0.00% | 1 | 0.01% | 0 | 0.00% | 0 | 0.00% | 1 |
| 2878 | 959 kb contig between AML1 and CBR1 on chro | AJ229043.1 | 0 | 0.00% | 1 | 0.01% | 0 | 0.00% | 0 | 0.00% | 1 |
| 2879 | ABL (M8604 Met) gene | U07561.1 | 0 | 0.00% | 0 | 0.00% | 1 | 0.01% | 0 | 0.00% | 1 |
| 2880 | acetyl LDL receptor; SREC=scavenger receptor | NM_003693.1 | 0 | 0.00% | 1 | 0.01% | 0 | 0.00% | 0 | 0.00% | 1 |
| 2881 | acetylserotonin N-methyltransferase-like (ASMT | gi4757793 | 1 | 0.01% | 0 | 0.00% | 0 | 0.00% | 0 | 0.00% | 1 |
| 2882 | acid phosphatase type 5 | X14618 | 1 | 0.01% | 0 | 0.00% | 0 | 0.00% | 0 | 0.00% | 1 |
| 2883 | Acyl carrier protein, Mitochondrial (ACP) (non-ex | AC002400 | 1 | 0.01% | 0 | 0.00% | 0 | 0.00% | 0 | 0.00% | 1 |
| 2884 | AD-012 protein (LOC55833) (=AB040924 KIAA1 | gi8923858 | 1 | 0.01% | 0 | 0.00% | 0 | 0.00% | 0 | 0.00% | 1 |
| 2885 | AD-014 protein | AF150733.1 | 1 | 0.01% | 0 | 0.00% | 0 | 0.00% | 0 | 0.00% | 1 |
| 2886 | ADMLX=putative adhesion molecule [human mR | S60088 | 0 | 0.00% | 0 | 0.00% | 1 | 0.01% | 0 | 0.00% | 1 |
| 2887 | adrenal gland protein AD-002 | AF110775.1 | 0 | 0.00% | 0 | 0.00% | 0 | 0.00% | 1 | 0.01% | 1 |
| 2888 | adrenal gland protein AD-004 (RefSeq aa 2e-91) | NP_057367.1 | 0 | 0.00% | 1 | 0.01% | 0 | 0.00% | 0 | 0.00% | 1 |
| 2889 | ANC_2H01 (ORF) | AF003924_1 | 0 | 0.00% | 0 | 0.00% | 1 | 0.01% | 0 | 0.00% | 1 |
| 2890 | ancient ubiquitous protein 1(AUP1), mRNA | NM_012103.1 | 1 | 0.01% | 0 | 0.00% | 0 | 0.00% | 0 | 0.00% | 1 |
| 2891 | androgen-regulated short-chain dehydrogenase/ | AF167438.1 | 0 | 0.00% | 1 | 0.01% | 0 | 0.00% | 0 | 0.00% | 1 |
| 2892 | antigen NY-CO-25(NY-CO-25) (=KIAA0201) | AF039695.1 | 0 | 0.00% | 1 | 0.01% | 0 | 0.00% | 0 | 0.00% | 1 |
| 2893 | antigen NY-CO-41 (NY-CO-41)(= clone DKFZp5 | AF039701.1 | 1 | 0.01% | 0 | 0.00% | 0 | 0.00% | 0 | 0.00% | 1 |
| 2894 | antigen NY-CO-9 (NY-CO-9) (=AB011172 hypot | AF039691 | 1 | 0.01% | 0 | 0.00% | 0 | 0.00% | 0 | 0.00% | 1 |
| 2895 | antigenic determinant of recA protein (mouse) ho | BC017309.1 | 1 | 0.01% | 0 | 0.00% | 0 | 0.00% | 0 | 0.00% | 1 |
| 2896 | anti-oncogene | M98056.1 | 0 | 0.00% | 1 | 0.01% | 0 | 0.00% | 0 | 0.00% | 1 |
| 2897 | APMCF1 (APMCF1) | AF141882.1 | 0 | 0.00% | 0 | 0.00% | 1 | 0.01% | 0 | 0.00% | 1 |
| 2898 | arsenate resistance protein ARS2 arsenite-resis | NP_056992.1 | 0 | 0.00% | 1 | 0.01% | 0 | 0.00% | 0 | 0.00% | 1 |
| 2899 | arsenite translocating ATPase (ASNA1) (=U602 | AF047469 | 1 | 0.01% | 0 | 0.00% | 0 | 0.00% | 0 | 0.00% | 1 |
| 2900 | atypical PKC specific binding protein | AB005549 | 1 | 0.01% | 0 | 0.00% | 0 | 0.00% | 0 | 0.00% | 1 |
| 2901 | autonomously replicating sequence (ARS) | L08437.1 | 0 | 0.00% | 0 | 0.00% | 1 | 0.01% | 0 | 0.00% | 1 |
| 2902 | autosomal dominant polycystic kidney disease ty | AF054992.1 | 0 | 0.00% | 0 | 0.00% | 1 | 0.01% | 0 | 0.00% | 1 |
| 2903 | AV723190 HTB cDNA clone HTBAXA03 5' | AV723190.1 | 0 | 0.00% | 1 | 0.01% | 0 | 0.00% | 0 | 0.00% | 1 |
| 2904 | B.subtilis YQJC protein (TR:G1303954) | CAA98118.1 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 52 of 102

| | | | | | | | | | | | |
|---|---|---|---|---|---|---|---|---|---|---|---|
| 2905 | B12 protein | M80783.1 | 0 | 0.00% | 0 | 0.00% | 0 | 0.00% | 1 | 0.01% | 1 |
| 2906 | B17 | AF232674.1 | 0 | 0.00% | 0 | 0.00% | 0 | 0.00% | 1 | 0.01% | 1 |
| 2907 | B6D2F1(clone 2C11B) | U01139 | 1 | 0.01% | 0 | 0.00% | 0 | 0.00% | 0 | 0.00% | 1 |
| 2908 | Bak protein | U23765 | 1 | 0.01% | 0 | 0.00% | 0 | 0.00% | 0 | 0.00% | 1 |
| 2909 | BANP homolog (FLJ20538) | NM_017869.1 | 0 | 0.00% | 1 | 0.01% | 0 | 0.00% | 0 | 0.00% | 1 |
| 2910 | BCL7B protein | X89985 | 1 | 0.01% | 0 | 0.00% | 0 | 0.00% | 0 | 0.00% | 1 |
| 2911 | BCNT | AB009270 | 1 | 0.01% | 0 | 0.00% | 0 | 0.00% | 0 | 0.00% | 1 |
| 2912 | beta-ureidopropionase | NM_016327.1 | 0 | 0.00% | 1 | 0.01% | 0 | 0.00% | 0 | 0.00% | 1 |
| 2913 | blood-stage membrane protein Ag-1 [Plasmodiu | AF103869 | 0 | 0.00% | 1 | 0.01% | 0 | 0.00% | 0 | 0.00% | 1 |
| 2914 | BNIP3H (BNIP3H) nuclear gene for mitochondri | AF255051.1 | 0 | 0.00% | 1 | 0.01% | 0 | 0.00% | 0 | 0.00% | 1 |
| 2915 | Br140 | M91585 | 0 | 0.00% | 0 | 0.00% | 0 | 0.00% | 1 | 0.01% | 1 |
| 2916 | brain 4.1(L) protein (=AB002336 Human KIAA03 | AB019257.1 | 0 | 0.00% | 0 | 0.00% | 1 | 0.01% | 0 | 0.00% | 1 |
| 2917 | breast adenocarcinoma marker (32kD) (BC-2) | NM_014453.1 | 0 | 0.00% | 1 | 0.01% | 0 | 0.00% | 0 | 0.00% | 1 |
| 2918 | BRI3 | AF272043.1 | 1 | 0.01% | 1 | 0.01% | 0 | 0.00% | 0 | 0.00% | 1 |
| 2919 | brother of CDO (BOC) | AY027658.1 | 1 | 0.01% | 0 | 0.00% | 0 | 0.00% | 0 | 0.00% | 1 |
| 2920 | C13F10.4 gene product [Caenorhabditis elegans | U97006 | 0 | 0.00% | 0 | 0.00% | 0 | 0.00% | 1 | 0.01% | 1 |
| 2921 | C1D protein (nuclear DNA-binding protein) | X95592 | 0 | 0.00% | 0 | 0.00% | 0 | 0.00% | 1 | 0.01% | 1 |
| 2922 | C367G8.1 (melanoma antigen P15) (LOC12410 | XM_058771.1 | 1 | 0.01% | 0 | 0.00% | 0 | 0.00% | 0 | 0.00% | 1 |
| 2923 | C43H8.1 gene product | AF098499 | 0 | 0.00% | 0 | 0.00% | 1 | 0.01% | 0 | 0.00% | 1 |
| 2924 | C44E4.5 gene product | AF003140 | 0 | 0.00% | 0 | 0.00% | 1 | 0.01% | 0 | 0.00% | 1 |
| 2925 | C6f mRNA, partial 3'UTR | U72516.1 | 0 | 0.00% | 1 | 0.01% | 0 | 0.00% | 0 | 0.00% | 1 |
| 2926 | calmodulin-like, processed pseudogene (302 bp | M73792.1 | 0 | 0.00% | 1 | 0.01% | 0 | 0.00% | 0 | 0.00% | 1 |
| 2927 | candidate tumor suppressor protein DICE1 | AF097645.1 | 0 | 0.00% | 0 | 0.00% | 1 | 0.01% | 0 | 0.00% | 1 |
| 2928 | CDM (=ref\|NM_005745.2\| accessory proteins B/ | Z31696.1 | 0 | 0.00% | 0 | 0.00% | 1 | 0.01% | 0 | 0.00% | 1 |
| 2929 | cell-line RPMI 8226 chloride ion current inducer | AF232225 | 0 | 0.00% | 0 | 0.00% | 1 | 0.01% | 0 | 0.00% | 1 |
| 2930 | CGI-111 protein (LOC51015) | NM_016048.1 | 1 | 0.01% | 0 | 0.00% | 0 | 0.00% | 0 | 0.00% | 1 |
| 2931 | CGI-113 protein | AF151871.1 | 0 | 0.00% | 0 | 0.00% | 1 | 0.01% | 0 | 0.00% | 1 |
| 2932 | CGI-126 protein | AF151884.1 | 0 | 0.00% | 0 | 0.00% | 1 | 0.01% | 0 | 0.00% | 1 |
| 2933 | chorionic gonadotropin beta subunit | K03189 | 1 | 0.01% | 0 | 0.00% | 0 | 0.00% | 0 | 0.00% | 1 |
| 2934 | choroideremia (ORF) | X78121 | 0 | 0.00% | 0 | 0.00% | 0 | 0.00% | 1 | 0.01% | 1 |
| 2935 | Churchill protein | AAG09759.1 | 0 | 0.00% | 1 | 0.01% | 0 | 0.00% | 0 | 0.00% | 1 |
| 2936 | citb_173_i_12 | AC005887.3 | 0 | 0.00% | 1 | 0.01% | 0 | 0.00% | 0 | 0.00% | 1 |
| 2937 | citb_179_n_3 | AC005210.3 | 0 | 0.00% | 0 | 0.00% | 1 | 0.01% | 0 | 0.00% | 1 |
| 2938 | citb_43_a_11, complete sequence | AC005880.3 | 0 | 0.00% | 1 | 0.01% | 0 | 0.00% | 0 | 0.00% | 1 |
| 2939 | citb_79_e_16, complete sequence | AC005881.3 | 1 | 0.01% | 0 | 0.00% | 0 | 0.00% | 0 | 0.00% | 1 |
| 2940 | clock (mouse) homologue (CLOCK) (=AB00233 | gi4758009 | 0 | 0.00% | 0 | 0.00% | 1 | 0.01% | 0 | 0.00% | 1 |
| 2941 | cn04g01.y1 Normal Human Trabecular Bone Ce | AI750662.1 | 0 | 0.00% | 1 | 0.01% | 0 | 0.00% | 0 | 0.00% | 1 |
| 2942 | CocoaCrisp (LOC83690), mRNA /cds=(85,1587) | Hs.182364 | 0 | 0.00% | 0 | 0.00% | 1 | 0.01% | 0 | 0.00% | 1 |
| 2943 | COP9 subunit 6 (MOV34 homolog, 34 kD)(RefS | NP_006824.1 | 0 | 0.00% | 1 | 0.01% | 0 | 0.00% | 0 | 0.00% | 1 |
| 2944 | COX4AL | AF005888 | 1 | 0.01% | 0 | 0.00% | 0 | 0.00% | 0 | 0.00% | 1 |
| 2945 | cp1508.seq.F Human fetal heart, Lambda ZAP E | AA248069 | 0 | 0.00% | 0 | 0.00% | 1 | 0.01% | 0 | 0.00% | 1 |
| 2946 | CpG island DNA genomic Mse1 fragment, clone | Z61961.1 | 0 | 0.00% | 1 | 0.01% | 0 | 0.00% | 0 | 0.00% | 1 |
| 2947 | CpG island DNA genomic Mse1 fragment, clone | Z62622.1 | 0 | 0.00% | 1 | 0.01% | 0 | 0.00% | 0 | 0.00% | 1 |
| 2948 | CSR2 | AB007830.1 | 1 | 0.01% | 0 | 0.00% | 0 | 0.00% | 0 | 0.00% | 1 |
| 2949 | CTD-2314M3 | AC026273.7 | 0 | 0.00% | 1 | 0.01% | 0 | 0.00% | 0 | 0.00% | 1 |
| 2950 | CTP synthase (CTPS) | NM_001905.1 | 1 | 0.01% | 0 | 0.00% | 0 | 0.00% | 0 | 0.00% | 1 |
| 2951 | CUB and Sushi multiple domains 1 (CSMD1), m | Hs.123468 | 0 | 0.00% | 0 | 0.00% | 0 | 0.00% | 1 | 0.01% | 1 |
| 2952 | CX3C chemokine precursor | U84487 | 1 | 0.01% | 0 | 0.00% | 0 | 0.00% | 0 | 0.00% | 1 |
| 2953 | cystinosin | AJ222967 | 1 | 0.01% | 0 | 0.00% | 0 | 0.00% | 0 | 0.00% | 1 |
| 2954 | cytokine SDF-1-beta (=L36033) | U16752 | 1 | 0.01% | 0 | 0.00% | 0 | 0.00% | 0 | 0.00% | 1 |
| 2955 | cytokine-like factor-1 precursor (CLF-1) | AF059293 | 1 | 0.01% | 0 | 0.00% | 0 | 0.00% | 0 | 0.00% | 1 |
| 2956 | D15F37 pseudogene, S4 allele | AF041081.1 | 0 | 0.00% | 1 | 0.01% | 0 | 0.00% | 0 | 0.00% | 1 |
| 2957 | D54 isoform (hD54) | AF004429.1 | 1 | 0.01% | 0 | 0.00% | 0 | 0.00% | 0 | 0.00% | 1 |
| 2958 | DAN gene | D89013 | 1 | 0.01% | 0 | 0.00% | 0 | 0.00% | 0 | 0.00% | 1 |
| 2959 | dbpB-like protein | L28809.1 | 0 | 0.00% | 1 | 0.01% | 0 | 0.00% | 0 | 0.00% | 1 |
| 2960 | DC11 protein (RefSeq aa 3e-63) | NP_064571.1 | 0 | 0.00% | 1 | 0.01% | 0 | 0.00% | 0 | 0.00% | 1 |
| 2961 | DC6 protein (RefSeq aa 2e-52) | NP_064574.1 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 53 of 102

| | | | | | | | | | | | |
|---|---|---|---|---|---|---|---|---|---|---|---|
| 2962 | D-dopachrome tautomerase (=U49785; Y11151) | AF058293 | 1 | 0.01% | 0 | 0.00% | 0 | 0.00% | 0 | 0.00% | 1 |
| 2963 | DEAD (aspartate-glutamate-alanine-aspartate) b | NM_007841.1 | 0 | 0.00% | 0 | 0.00% | 0 | 0.00% | 1 | 0.01% | 1 |
| 2964 | differentiation-related gene 1 (nickel-specific ind | NM_006096.1 | 0 | 0.00% | 0 | 0.00% | 0 | 0.00% | 1 | 0.01% | 1 |
| 2965 | dJ1158H2.1 (novel protein similar to D. melanog | CAC05315.1 | 0 | 0.00% | 1 | 0.01% | 0 | 0.00% | 0 | 0.00% | 1 |
| 2966 | dJ28H20.2 (novel protein) | CAC00561.1 | 0 | 0.00% | 1 | 0.01% | 0 | 0.00% | 0 | 0.00% | 1 |
| 2967 | dJ671D7.1 (similar to D. melanogaster CG5986 | CAC04152.1 | 0 | 0.00% | 1 | 0.01% | 0 | 0.00% | 0 | 0.00% | 1 |
| 2968 | dJ756N5.2 (A novel protein (DKFZp727M231) si | CAC14946.1 | 0 | 0.00% | 1 | 0.01% | 0 | 0.00% | 0 | 0.00% | 1 |
| 2969 | dJ93K22.1 (novel protein (contains DKFZP564B | AL050333 | 0 | 0.00% | 0 | 0.00% | 1 | 0.01% | 0 | 0.00% | 1 |
| 2970 | Dlgh1 homologue | U93309 | 0 | 0.00% | 0 | 0.00% | 1 | 0.01% | 0 | 0.00% | 1 |
| 2971 | DMBT1 candidate tumour suppressor gene, exo | AJ243211.1 | 0 | 0.00% | 0 | 0.00% | 1 | 0.01% | 0 | 0.00% | 1 |
| 2972 | DMR-N9 myotonic dystrophy kinase (DM kinase | L08835.1 | 1 | 0.01% | 0 | 0.00% | 0 | 0.00% | 0 | 0.00% | 1 |
| 2973 | DNA containing putative Ac-like transposon | Y17156 | 1 | 0.01% | 0 | 0.00% | 0 | 0.00% | 0 | 0.00% | 1 |
| 2974 | DNA for tob family, complete cds | D78382.1 | 0 | 0.00% | 0 | 0.00% | 0 | 0.00% | 1 | 0.01% | 1 |
| 2975 | Down syndrome critical region gene 1-like 1 | NM_005822.1 | 0 | 0.00% | 1 | 0.01% | 0 | 0.00% | 0 | 0.00% | 1 |
| 2976 | down-regulator of transCRiption 1, TBP-binding ( | NM_001938.1 | 0 | 0.00% | 0 | 0.00% | 0 | 0.00% | 1 | 0.01% | 1 |
| 2977 | DROME TWISTED GASTRULATION PROTEIN | spP54356 | 0 | 0.00% | 0 | 0.00% | 0 | 0.00% | 1 | 0.01% | 1 |
| 2978 | DSCR5a | AB037162.1 | 0 | 0.00% | 1 | 0.01% | 0 | 0.00% | 0 | 0.00% | 1 |
| 2979 | dUTP pyrophosphatase (DUT) | NM_001948.1 | 0 | 0.00% | 1 | 0.01% | 0 | 0.00% | 0 | 0.00% | 1 |
| 2980 | DVS27-related protein | BAA75892.1 | 0 | 0.00% | 1 | 0.01% | 0 | 0.00% | 0 | 0.00% | 1 |
| 2981 | DXS8237E (=D50912 hypothetical protein (KIAA | U35373 | 1 | 0.01% | 0 | 0.00% | 0 | 0.00% | 0 | 0.00% | 1 |
| 2982 | dye | U77595 | 1 | 0.01% | 0 | 0.00% | 0 | 0.00% | 0 | 0.00% | 1 |
| 2983 | E46 protein | AF119662.1 | 0 | 0.00% | 1 | 0.01% | 0 | 0.00% | 0 | 0.00% | 1 |
| 2984 | early B-cell transcription factor (EBF) | AF208502.1 | 0 | 0.00% | 1 | 0.01% | 0 | 0.00% | 0 | 0.00% | 1 |
| 2985 | early development regulator 2 (homolog of polyh | NM_004427.1 | 1 | 0.01% | 0 | 0.00% | 0 | 0.00% | 0 | 0.00% | 1 |
| 2986 | EB1 | U24166 | 1 | 0.01% | 0 | 0.00% | 0 | 0.00% | 0 | 0.00% | 1 |
| 2987 | EF1a-like protein | AF267861.1 | 1 | 0.01% | 0 | 0.00% | 0 | 0.00% | 0 | 0.00% | 1 |
| 2988 | endogenous retrovirus H HERV-H/env62 provira | AJ289709.1 | 0 | 0.00% | 1 | 0.01% | 0 | 0.00% | 0 | 0.00% | 1 |
| 2989 | endogenous retrovirus HERV-K102 | AF164610.1 | 0 | 0.00% | 0 | 0.00% | 1 | 0.01% | 0 | 0.00% | 1 |
| 2990 | endogenous retrovirus type C oncovirus sequen | M74509 | 1 | 0.01% | 0 | 0.00% | 0 | 0.00% | 0 | 0.00% | 1 |
| 2991 | envelope protein | AF164615 | 0 | 0.00% | 0 | 0.00% | 1 | 0.01% | 0 | 0.00% | 1 |
| 2992 | EPC-1 (=M76979 PEDF;U29953;M90493) | U57446 | 1 | 0.01% | 0 | 0.00% | 0 | 0.00% | 0 | 0.00% | 1 |
| 2993 | ER1 (=AB033019 KIAA1193) (67% aa) | AF015454 | 0 | 0.00% | 0 | 0.00% | 1 | 0.01% | 0 | 0.00% | 1 |
| 2994 | erbb2-interacting protein ERBIN | NM_018695.1 | 1 | 0.01% | 0 | 0.00% | 0 | 0.00% | 0 | 0.00% | 1 |
| 2995 | ERp28 protein | X94910 | 1 | 0.01% | 0 | 0.00% | 0 | 0.00% | 0 | 0.00% | 1 |
| 2996 | esophageal cancer related gene 4 protein (ECR( | Hs.43125 | 0 | 0.00% | 0 | 0.00% | 1 | 0.01% | 0 | 0.00% | 1 |
| 2997 | ETAA16 protein (RefSeq aa 1e-75) | NP_061875.1 | 0 | 0.00% | 1 | 0.01% | 0 | 0.00% | 0 | 0.00% | 1 |
| 2998 | EXOSTOSIN-1 (PUTATIVE TUMOR SUPPRES | spQ16394 | 0 | 0.00% | 0 | 0.00% | 0 | 0.00% | 1 | 0.01% | 1 |
| 2999 | F1D9.26~unknown protein [Arabidopsis thaliana | BAA97098.1 | 0 | 0.00% | 0 | 0.00% | 1 | 0.01% | 0 | 0.00% | 1 |
| 3000 | faciogenital dysplasia (Aarskog-Scott syndrome) | NM_004463.1 | 1 | 0.01% | 0 | 0.00% | 0 | 0.00% | 0 | 0.00% | 1 |
| 3001 | f-box and leucine-rich repeat protein 11 (FBXL1 | XM_040025.2 | 1 | 0.01% | 0 | 0.00% | 0 | 0.00% | 0 | 0.00% | 1 |
| 3002 | f-box and leucine-rich repeat protein 3A (FBXL3/ | NM_012158.1 | 1 | 0.01% | 0 | 0.00% | 0 | 0.00% | 0 | 0.00% | 1 |
| 3003 | FEZ2 protein (FEZ2) | AF113124.1 | 1 | 0.01% | 0 | 0.00% | 0 | 0.00% | 0 | 0.00% | 1 |
| 3004 | fgr proto-oncogene encoded p55-c-fgr protein | M19722.1 | 0 | 0.00% | 0 | 0.00% | 1 | 0.01% | 0 | 0.00% | 1 |
| 3005 | FH1/FH2 domain-containing protein FHOS (FHC | AF113615.1 | 0 | 0.00% | 0 | 0.00% | 0 | 0.00% | 1 | 0.01% | 1 |
| 3006 | FLAME-1 | AAB70909.1 | 0 | 0.00% | 1 | 0.01% | 0 | 0.00% | 0 | 0.00% | 1 |
| 3007 | fosB | X14897 | 0 | 0.00% | 0 | 0.00% | 0 | 0.00% | 1 | 0.01% | 1 |
| 3008 | FT005 protein (FT005) | NM_014054.1 | 1 | 0.01% | 0 | 0.00% | 0 | 0.00% | 0 | 0.00% | 1 |
| 3009 | fused in glioblastoma mRNA, complete cds /cds | Hs.23120 | 0 | 0.00% | 0 | 0.00% | 1 | 0.01% | 0 | 0.00% | 1 |
| 3010 | FXYD domain-containing ion transport regulator | NM_022003.1 | 1 | 0.01% | 0 | 0.00% | 0 | 0.00% | 0 | 0.00% | 1 |
| 3011 | G antigen 1 | XP_010196.1 | 0 | 0.00% | 1 | 0.01% | 0 | 0.00% | 0 | 0.00% | 1 |
| 3012 | G9011 gene product | AAF52302.2 | 0 | 0.00% | 1 | 0.01% | 0 | 0.00% | 0 | 0.00% | 1 |
| 3013 | ganglioside-induced differentiation associated pr | Y17852 | 1 | 0.01% | 0 | 0.00% | 0 | 0.00% | 0 | 0.00% | 1 |
| 3014 | GASC-1 | AB037901.1 | 0 | 0.00% | 1 | 0.01% | 0 | 0.00% | 0 | 0.00% | 1 |
| 3015 | gcp372 | BAA05025.1 | 0 | 0.00% | 1 | 0.01% | 0 | 0.00% | 0 | 0.00% | 1 |
| 3016 | GEC-1 (gec-1) | AF012920 | 0 | 0.00% | 0 | 0.00% | 1 | 0.01% | 0 | 0.00% | 1 |
| 3017 | GEF-2 | AB003515 | 1 | 0.01% | 0 | 0.00% | 0 | 0.00% | 0 | 0.00% | 1 |
| 3018 | GEG-154 mRNA | X71642 | 0 | 0.00% | 0 | 0.00% | 1 | 0.01% | 0 | 0.00% | 1 |

Figure 6 - Unique Known Genes Identified In Four cDNA Cartilage Libraries and EST Frequency Analysis - Page 54 of 102

| | | | | | | | | | | | |
|---|---|---|---|---|---|---|---|---|---|---|---|
| 3019 | gene 33 polypeptide | M23572.1 | 0 | 0.00% | 0 | 0.00% | 1 | 0.01% | 0 | 0.00% | 1 |
| 3020 | gene encoding HLA-Cw6 | Z22754.1 | 0 | 0.00% | 1 | 0.01% | 0 | 0.00% | 0 | 0.00% | 1 |
| 3021 | gene_id:F1D9.26~unknown protein | AP002460 | 0 | 0.00% | 1 | 0.01% | 0 | 0.00% | 0 | 0.00% | 1 |
| 3022 | GILZ, complete cds /cds=(233,637) /gb=AB0254 | Hs.75450 | 0 | 0.00% | 0 | 0.00% | 0 | 0.00% | 1 | 0.01% | 1 |
| 3023 | GK001 protein (GK001), | NM_020198.1 | 0 | 0.00% | 1 | 0.01% | 0 | 0.00% | 0 | 0.00% | 1 |
| 3024 | GK003 (GK003) | AF226046.1 | 0 | 0.00% | 1 | 0.01% | 0 | 0.00% | 0 | 0.00% | 1 |
| 3025 | GL002 protein (GL002) | NM_020193.1 | 0 | 0.00% | 1 | 0.01% | 0 | 0.00% | 0 | 0.00% | 1 |
| 3026 | golgi antigen gcp372 | D25542.1 | 0 | 0.00% | 0 | 0.00% | 0 | 0.00% | 1 | 0.01% | 1 |
| 3027 | GSTmu3 gene for a glutathione S-transferase M | X56838.1 | 1 | 0.01% | 0 | 0.00% | 0 | 0.00% | 0 | 0.00% | 1 |
| 3028 | Gx protein | AF120103.1 | 1 | 0.01% | 0 | 0.00% | 0 | 0.00% | 0 | 0.00% | 1 |
| 3029 | hamartin (TSC1) | AF013168 | 0 | 0.00% | 0 | 0.00% | 0 | 0.00% | 1 | 0.01% | 1 |
| 3030 | haplotype D6 beta-globin (HBB) gene, replicatior | AF186620.1 | 0 | 0.00% | 0 | 0.00% | 1 | 0.01% | 0 | 0.00% | 1 |
| 3031 | hBKLF for basic kruppel like factor (LOC51274) | NM_016531.1 | 0 | 0.00% | 1 | 0.01% | 0 | 0.00% | 0 | 0.00% | 1 |
| 3032 | HBV associated factor(XAP4) | NM_006462.1 | 0 | 0.00% | 1 | 0.01% | 0 | 0.00% | 0 | 0.00% | 1 |
| 3033 | HC71C | AF177343.1 | 0 | 0.00% | 1 | 0.01% | 0 | 0.00% | 0 | 0.00% | 1 |
| 3034 | hCDC10=CDC10 homolog | S72008 | 0 | 0.00% | 0 | 0.00% | 0 | 0.00% | 1 | 0.01% | 1 |
| 3035 | hcgVIII protein | X92110 | 0 | 0.00% | 0 | 0.00% | 0 | 0.00% | 1 | 0.01% | 1 |
| 3036 | HCMOGT-1 mRNA for sperm antigen, complete | Hs.15053 | 0 | 0.00% | 0 | 0.00% | 0 | 0.00% | 1 | 0.01% | 1 |
| 3037 | HDCMB12P | AF067802.1 | 0 | 0.00% | 0 | 0.00% | 0 | 0.00% | 1 | 0.01% | 1 |
| 3038 | HDCMC04P | AF067804.1 | 0 | 0.00% | 1 | 0.01% | 0 | 0.00% | 0 | 0.00% | 1 |
| 3039 | HDCMC28P protein (HDCMC28P) | NM_016649.1 | 1 | 0.01% | 0 | 0.00% | 0 | 0.00% | 0 | 0.00% | 1 |
| 3040 | HELG protein (HELG) | NM_018412.1 | 0 | 0.00% | 1 | 0.01% | 0 | 0.00% | 0 | 0.00% | 1 |
| 3041 | hematopoietic stem/progenitor cells protein MDS | NM_018462.1 | 0 | 0.00% | 1 | 0.01% | 0 | 0.00% | 0 | 0.00% | 1 |
| 3042 | HF.12 gene | X07290.1 | 1 | 0.01% | 0 | 0.00% | 0 | 0.00% | 0 | 0.00% | 1 |
| 3043 | HGTD-P (HGTD-P) (=E2IG5) | AF201944.1 | 0 | 0.00% | 1 | 0.01% | 0 | 0.00% | 0 | 0.00% | 1 |
| 3044 | HIS1 protein | AB021179 | 1 | 0.01% | 0 | 0.00% | 0 | 0.00% | 0 | 0.00% | 1 |
| 3045 | hMSH6 | U73737 | 1 | 0.01% | 0 | 0.00% | 0 | 0.00% | 0 | 0.00% | 1 |
| 3046 | homolog of yeast mutL (hPMS1) gene | U13695.1 | 0 | 0.00% | 0 | 0.00% | 1 | 0.01% | 0 | 0.00% | 1 |
| 3047 | hook1 protein (69% aa) | AF044923 | 0 | 0.00% | 0 | 0.00% | 0 | 0.00% | 1 | 0.01% | 1 |
| 3048 | HOTTL protein mRNA, complete cds | AF078842.1 | 1 | 0.01% | 0 | 0.00% | 0 | 0.00% | 0 | 0.00% | 1 |
| 3049 | HPBRII-4 | X67337 | 1 | 0.01% | 0 | 0.00% | 0 | 0.00% | 0 | 0.00% | 1 |
| 3050 | hSLK (=D86959 hypothetical protein (KIAA0204) | AB002804 | 1 | 0.01% | 0 | 0.00% | 0 | 0.00% | 0 | 0.00% | 1 |
| 3051 | HSPC006 | AF070662.1 | 0 | 0.00% | 1 | 0.01% | 0 | 0.00% | 0 | 0.00% | 1 |
| 3052 | HSPC009 protein (HSPC009), mRNA | NM_014019.1 | 1 | 0.01% | 0 | 0.00% | 0 | 0.00% | 0 | 0.00% | 1 |
| 3053 | HSPC028 | AF083246.1 | 0 | 0.00% | 0 | 0.00% | 0 | 0.00% | 1 | 0.01% | 1 |
| 3054 | HSPC030 | AF085359.1 | 0 | 0.00% | 1 | 0.01% | 0 | 0.00% | 0 | 0.00% | 1 |
| 3055 | HSPC031 mRNA,=CGI-37 protein (ORF) | AF085360 | 0 | 0.00% | 0 | 0.00% | 0 | 0.00% | 1 | 0.01% | 1 |
| 3056 | HSPC038 protein (LOC51123) | NM_016096.1 | 0 | 0.00% | 0 | 0.00% | 0 | 0.00% | 1 | 0.01% | 1 |
| 3057 | HSPC040 protein (RefSeq aa 1e-58) | NP_057182.1 | 0 | 0.00% | 1 | 0.01% | 0 | 0.00% | 0 | 0.00% | 1 |
| 3058 | HSPC042 protein (contains Alu repeat) | AF125096.1 | 0 | 0.00% | 0 | 0.00% | 1 | 0.01% | 0 | 0.00% | 1 |
| 3059 | HSPC049 protein (HSPC049) | NM_014149.1 | 1 | 0.01% | 0 | 0.00% | 0 | 0.00% | 0 | 0.00% | 1 |
| 3060 | HSPC055 protein (HSPC055) (=FLJ11007 fis) | NM_014153.1 | 0 | 0.00% | 0 | 0.00% | 0 | 0.00% | 1 | 0.01% | 1 |
| 3061 | HSPC056 protein (HSPC056) | NM_014154.1 | 0 | 0.00% | 1 | 0.01% | 0 | 0.00% | 0 | 0.00% | 1 |
| 3062 | HSPC059 protein (HSPC059) | NM_016536.1 | 1 | 0.01% | 0 | 0.00% | 0 | 0.00% | 0 | 0.00% | 1 |
| 3063 | HSPC071 | AF161556.1 | 0 | 0.00% | 0 | 0.00% | 0 | 0.00% | 1 | 0.01% | 1 |
| 3064 | HSPC092 | AF161355.1 | 0 | 0.00% | 1 | 0.01% | 0 | 0.00% | 0 | 0.00% | 1 |
| 3065 | HSPC093 (aa 9e-13,65%) | AAF28916.1 | 0 | 0.00% | 1 | 0.01% | 0 | 0.00% | 0 | 0.00% | 1 |
| 3066 | HSPC121 (=B-ind1 protein) | AAF29085.1 | 0 | 0.00% | 0 | 0.00% | 0 | 0.00% | 1 | 0.01% | 1 |
| 3067 | HSPC125 | AF161474 | 0 | 0.00% | 0 | 0.00% | 0 | 0.00% | 1 | 0.01% | 1 |
| 3068 | HSPC126 protein (RefSeq aa 4e-46) | NP_054885.1 | 0 | 0.00% | 1 | 0.01% | 0 | 0.00% | 0 | 0.00% | 1 |
| 3069 | HSPC140 (=SUMO-1-activating enzyme E1 N su | AF161489.1 | 0 | 0.00% | 1 | 0.01% | 0 | 0.00% | 0 | 0.00% | 1 |
| 3070 | HSPC141 protein (HSPC141)(= sex-regulated pr | XM_038043.1 | 1 | 0.01% | 0 | 0.00% | 0 | 0.00% | 0 | 0.00% | 1 |
| 3071 | HSPC144 protein (RefSeq aa 1e-69) | NP_054893.1 | 0 | 0.00% | 1 | 0.01% | 0 | 0.00% | 0 | 0.00% | 1 |
| 3072 | HSPC145 | AF161494.1 | 1 | 0.01% | 0 | 0.00% | 0 | 0.00% | 0 | 0.00% | 1 |
| 3073 | HSPC151 | AAF29115.1 | 0 | 0.00% | 0 | 0.00% | 1 | 0.01% | 0 | 0.00% | 1 |
| 3074 | HSPC154 protein (HSPC154) | NM_014177.1 | 0 | 0.00% | 0 | 0.00% | 1 | 0.01% | 0 | 0.00% | 1 |
| 3075 | HSPC155 | AF161504.1 | 0 | 0.00% | 0 | 0.00% | 0 | 0.00% | 1 | 0.01% | 1 |

Figure 6 - Unique Known Genes Identified In Four cDNA Cartilage Libraries and EST Frequency Analysis - Page 55 of 102

| | | | | | | | | | | | |
|---|---|---|---|---|---|---|---|---|---|---|---|
| 3076 | HSPC160 protein (RefSeq aa 5e-77) | NP_054901.1 | 0 | 0.00% | 1 | 0.01% | 0 | 0.00% | 0 | 0.00% | 1 |
| 3077 | HSPC164 | XM_009549.4 | 1 | 0.01% | 0 | 0.00% | 0 | 0.00% | 0 | 0.00% | 1 |
| 3078 | HSPC173 mRNA, | AF161521.1 | 0 | 0.00% | 1 | 0.01% | 0 | 0.00% | 0 | 0.00% | 1 |
| 3079 | HSPC174 | AF161522.1 | 0 | 0.00% | 1 | 0.01% | 0 | 0.00% | 0 | 0.00% | 1 |
| 3080 | HSPC176 | AF161524.1 | 1 | 0.01% | 0 | 0.00% | 0 | 0.00% | 0 | 0.00% | 1 |
| 3081 | HSPC177 | BC016698.1 | 0 | 0.00% | 0 | 0.00% | 0 | 0.00% | 1 | 0.01% | 1 |
| 3082 | HSPC182 protein (HSPC182) | NM_014188.1 | 0 | 0.00% | 1 | 0.01% | 0 | 0.00% | 0 | 0.00% | 1 |
| 3083 | HSPC184 | AF151018.1 | 0 | 0.00% | 0 | 0.00% | 0 | 0.00% | 1 | 0.01% | 1 |
| 3084 | HSPC187 | AF151021.1 | 0 | 0.00% | 1 | 0.01% | 0 | 0.00% | 0 | 0.00% | 1 |
| 3085 | HSPC197 | AF151031.1 | 1 | 0.01% | 0 | 0.00% | 0 | 0.00% | 0 | 0.00% | 1 |
| 3086 | HSPC199 | AF151033.1 | 1 | 0.01% | 0 | 0.00% | 0 | 0.00% | 0 | 0.00% | 1 |
| 3087 | HSPC209 | AF151043.1 | 0 | 0.00% | 1 | 0.01% | 0 | 0.00% | 0 | 0.00% | 1 |
| 3088 | HSPC210 | AF151044 | 0 | 0.00% | 0 | 0.00% | 1 | 0.01% | 0 | 0.00% | 1 |
| 3089 | HSPC212 | AF151046.1 | 0 | 0.00% | 0 | 0.00% | 1 | 0.01% | 0 | 0.00% | 1 |
| 3090 | HSPC235 | AF151069.1 | 0 | 0.00% | 0 | 0.00% | 0 | 0.00% | 1 | 0.01% | 1 |
| 3091 | HSPC240 | AF151074.1 | 0 | 0.00% | 1 | 0.01% | 0 | 0.00% | 0 | 0.00% | 1 |
| 3092 | HSPC245 | AF151079.1 | 0 | 0.00% | 0 | 0.00% | 0 | 0.00% | 1 | 0.01% | 1 |
| 3093 | HSPC261 (=DKFZp564B0769.1) | AAF28939.1 | 0 | 0.00% | 0 | 0.00% | 0 | 0.00% | 1 | 0.01% | 1 |
| 3094 | HSPC273 (=KIAA1192) | AF161391.1 | 0 | 0.00% | 1 | 0.01% | 0 | 0.00% | 0 | 0.00% | 1 |
| 3095 | HSPC274 protein (RefSeq aa 1e-38) | NP_054864.1 | 0 | 0.00% | 1 | 0.01% | 0 | 0.00% | 0 | 0.00% | 1 |
| 3096 | HSPC299 | AF161417.1 | 0 | 0.00% | 1 | 0.01% | 0 | 0.00% | 0 | 0.00% | 1 |
| 3097 | HSPC301 | AF161419.1 | 0 | 0.00% | 1 | 0.01% | 0 | 0.00% | 0 | 0.00% | 1 |
| 3098 | HSPC306 | AF161424.1 | 0 | 0.00% | 1 | 0.01% | 0 | 0.00% | 0 | 0.00% | 1 |
| 3099 | HSPC311 | AF161429.1 | 0 | 0.00% | 1 | 0.01% | 0 | 0.00% | 0 | 0.00% | 1 |
| 3100 | HSPC331 (=SPF31) | AAF29009.1 | 0 | 0.00% | 0 | 0.00% | 0 | 0.00% | 1 | 0.01% | 1 |
| 3101 | HT002 protein (HT002) | NM_014066.1 | 1 | 0.01% | 0 | 0.00% | 0 | 0.00% | 0 | 0.00% | 1 |
| 3102 | HT015 protein (HT015) | AF223466.1 | 1 | 0.01% | 0 | 0.00% | 0 | 0.00% | 0 | 0.00% | 1 |
| 3103 | HU-K4 | U60644 | 1 | 0.01% | 0 | 0.00% | 0 | 0.00% | 0 | 0.00% | 1 |
| 3104 | human homolog of a mouse imprinted gene | AB006625 | 1 | 0.01% | 0 | 0.00% | 0 | 0.00% | 0 | 0.00% | 1 |
| 3105 | HUT11 protein mRNA, partial 3' UTR | AF263545.1 | 0 | 0.00% | 1 | 0.01% | 0 | 0.00% | 0 | 0.00% | 1 |
| 3106 | hydroxyacyl-Coenzyme A dehydrogenase/3-ketc | NM_000183.1 | 0 | 0.00% | 1 | 0.01% | 0 | 0.00% | 0 | 0.00% | 1 |
| 3107 | hypothalamus protein HBEX2 | XP_010123.1 | 0 | 0.00% | 1 | 0.01% | 0 | 0.00% | 0 | 0.00% | 1 |
| 3108 | hypothalamus protein HT001 (=AF225981 calciu | AF113539 | 0 | 0.00% | 0 | 0.00% | 0 | 0.00% | 1 | 0.01% | 1 |
| 3109 | hypothetical brain protein similar to X96994 BR-' | NM_019836.1 | 0 | 0.00% | 1 | 0.01% | 0 | 0.00% | 0 | 0.00% | 1 |
| 3110 | hypothetical garp protein | CAB63561.1 | 0 | 0.00% | 0 | 0.00% | 0 | 0.00% | 1 | 0.01% | 1 |
| 3111 | hypothetical gene (AK026938 (LOC91933)) | XM_041609.2 | 0 | 0.00% | 0 | 0.00% | 0 | 0.00% | 1 | 0.01% | 1 |
| 3112 | hypothetical gene (AL137319; NM_017586) (LO | XM_011838.3 | 1 | 0.01% | 0 | 0.00% | 0 | 0.00% | 0 | 0.00% | 1 |
| 3113 | hypothetical gene (BC009875; BC014023 (LOC' | XM_055021.1 | 1 | 0.01% | 0 | 0.00% | 0 | 0.00% | 0 | 0.00% | 1 |
| 3114 | hypothetical gene (LOC87167) | XM_016787.2 | 1 | 0.01% | 0 | 0.00% | 0 | 0.00% | 0 | 0.00% | 1 |
| 3115 | hypothetical gene (LOC87240) | XM_015947.2 | 1 | 0.01% | 0 | 0.00% | 0 | 0.00% | 0 | 0.00% | 1 |
| 3116 | hypothetical gene (LOC96648) | XM_055006.1 | 1 | 0.01% | 0 | 0.00% | 0 | 0.00% | 0 | 0.00% | 1 |
| 3117 | hypothetical gene AK023725 (LOC92923) | XM_048072.1 | 1 | 0.01% | 0 | 0.00% | 0 | 0.00% | 0 | 0.00% | 1 |
| 3118 | hypothetical gene supported by AF055004 (LOC | XM_051593.3 | 1 | 0.01% | 0 | 0.00% | 0 | 0.00% | 0 | 0.00% | 1 |
| 3119 | hypothetical gene supported by AF132973; BC0 | XM_048487.3 | 1 | 0.01% | 0 | 0.00% | 0 | 0.00% | 0 | 0.00% | 1 |
| 3120 | hypothetical gene supported by AF267861; AK0 | XM_016170.4 | 0 | 0.00% | 0 | 0.00% | 0 | 0.00% | 1 | 0.01% | 1 |
| 3121 | hypothetical gene supported by AK027830; AL1 | XM_072050.1 | 0 | 0.00% | 0 | 0.00% | 0 | 0.00% | 1 | 0.01% | 1 |
| 3122 | hypothetical gene supported by AL096738; BC0 | XM_047202.2 | 1 | 0.01% | 0 | 0.00% | 0 | 0.00% | 0 | 0.00% | 1 |
| 3123 | hypothetical gene supported by AL137544 (LOC | XM_028218.2 | 1 | 0.01% | 0 | 0.00% | 0 | 0.00% | 0 | 0.00% | 1 |
| 3124 | hypothetical gene supported by BC008765 (LOC | XM_059474.1 | 1 | 0.01% | 0 | 0.00% | 0 | 0.00% | 0 | 0.00% | 1 |
| 3125 | hypothetical gene supported by BC009329 (LOC | XM_071761.1 | 1 | 0.01% | 0 | 0.00% | 0 | 0.00% | 0 | 0.00% | 1 |
| 3126 | hypothetical gene supported by BC009875; BC0 | XM_072528.1 | 1 | 0.01% | 0 | 0.00% | 0 | 0.00% | 0 | 0.00% | 1 |
| 3127 | hypothetical gene supported by D38441; AF141 | XM_002828.5 | 1 | 0.01% | 0 | 0.00% | 0 | 0.00% | 0 | 0.00% | 1 |
| 3128 | hypothetical gene supported by U60644 (LOC12 | XM_047409.2 | 1 | 0.01% | 0 | 0.00% | 0 | 0.00% | 0 | 0.00% | 1 |
| 3129 | hypothetical gene supported by XM_000590 (LO | XM_000590.1 | 0 | 0.00% | 1 | 0.01% | 0 | 0.00% | 0 | 0.00% | 1 |
| 3130 | hypothetical gene supported by XM_059059 (LO | XM_059059.1 | 0 | 0.00% | 0 | 0.00% | 1 | 0.01% | 0 | 0.00% | 1 |
| 3131 | hypothetical gene supported by Y10313; BC001 | XM_011551.5 | 0 | 0.00% | 0 | 0.00% | 0 | 0.00% | 1 | 0.01% | 1 |
| 3132 | hypothetical protein | B34087 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 56 of 102

| | | | | | | | | | | | |
|---|---|---|---|---|---|---|---|---|---|---|---|
| 3133 | hypothetical protein | CAB43380.1 | 0 | 0.00% | 1 | 0.01% | 0 | 0.00% | 0 | 0.00% | 1 |
| 3134 | hypothetical protein | CAB55973.1 | 0 | 0.00% | 1 | 0.01% | 0 | 0.00% | 0 | 0.00% | 1 |
| 3135 | hypothetical protein | CAB70761.1 | 0 | 0.00% | 1 | 0.01% | 0 | 0.00% | 0 | 0.00% | 1 |
| 3136 | hypothetical protein (aa 2e-27) | NP_062551.1 | 0 | 0.00% | 1 | 0.01% | 0 | 0.00% | 0 | 0.00% | 1 |
| 3137 | hypothetical protein (CL25084) | XM_056548.1 | 1 | 0.01% | 0 | 0.00% | 0 | 0.00% | 0 | 0.00% | 1 |
| 3138 | hypothetical protein (LOC51060), mRNA | XM_045762.1 | 0 | 0.00% | 0 | 0.00% | 0 | 0.00% | 1 | 0.01% | 1 |
| 3139 | hypothetical protein (LOC51255), mRNA /cds=(( | Hs.11156 | 0 | 0.00% | 0 | 0.00% | 0 | 0.00% | 1 | 0.01% | 1 |
| 3140 | hypothetical protein (LOC51315) | NM_016618.1 | 0 | 0.00% | 1 | 0.01% | 0 | 0.00% | 0 | 0.00% | 1 |
| 3141 | hypothetical protein (MGC4175) | XM_016063.2 | 1 | 0.01% | 0 | 0.00% | 0 | 0.00% | 0 | 0.00% | 1 |
| 3142 | hypothetical protein (MGC4415) | XM_050738.2 | 1 | 0.01% | 0 | 0.00% | 0 | 0.00% | 0 | 0.00% | 1 |
| 3143 | Hypothetical protein (non-exact 37-54% a.a.) | NP_061952.1 | 0 | 0.00% | 1 | 0.01% | 0 | 0.00% | 0 | 0.00% | 1 |
| 3144 | hypothetical protein (ORF)(48%) | AL050011 | 0 | 0.00% | 0 | 0.00% | 1 | 0.01% | 0 | 0.00% | 1 |
| 3145 | hypothetical protein (RefSeq aa 2e-38) | NP_056198.1 | 0 | 0.00% | 1 | 0.01% | 0 | 0.00% | 0 | 0.00% | 1 |
| 3146 | hypothetical protein (RefSeq aa 2e-60) | NP_057280.1 | 0 | 0.00% | 1 | 0.01% | 0 | 0.00% | 0 | 0.00% | 1 |
| 3147 | hypothetical protein (RefSeq aa 3e-61) | NP_056999.1 | 0 | 0.00% | 1 | 0.01% | 0 | 0.00% | 0 | 0.00% | 1 |
| 3148 | hypothetical protein (RefSeq aa 5e-50) | NP_057169.1 | 0 | 0.00% | 1 | 0.01% | 0 | 0.00% | 0 | 0.00% | 1 |
| 3149 | hypothetical protein (RefSeq aa 5e-63) | NP_056158.1 | 0 | 0.00% | 1 | 0.01% | 0 | 0.00% | 0 | 0.00% | 1 |
| 3150 | hypothetical protein (RefSeq aa 9e-33) | NP_057711.1 | 0 | 0.00% | 1 | 0.01% | 0 | 0.00% | 0 | 0.00% | 1 |
| 3151 | hypothetical protein (RefSeq aa 9e-43) | NP_057701.1 | 0 | 0.00% | 1 | 0.01% | 0 | 0.00% | 0 | 0.00% | 1 |
| 3152 | hypothetical protein (XP_029545) | XP_029545.1 | 1 | 0.01% | 0 | 0.00% | 0 | 0.00% | 0 | 0.00% | 1 |
| 3153 | hypothetical protein ASH1 (RefSeq aa 2e-68) | NP_060959.1 | 0 | 0.00% | 1 | 0.01% | 0 | 0.00% | 0 | 0.00% | 1 |
| 3154 | hypothetical protein clone 24952 mRNA | AF131758 | 0 | 0.00% | 0 | 0.00% | 1 | 0.01% | 0 | 0.00% | 1 |
| 3155 | hypothetical protein HDCMC04P | XP_004843.1 | 0 | 0.00% | 1 | 0.01% | 0 | 0.00% | 0 | 0.00% | 1 |
| 3156 | hypothetical protein IMAGE3455200 (IMAGE345 | NM_024006.1 | 1 | 0.01% | 0 | 0.00% | 0 | 0.00% | 0 | 0.00% | 1 |
| 3157 | hypothetical protein MGC10753 (MGC10753), m | NM_016628.1 | 1 | 0.01% | 0 | 0.00% | 0 | 0.00% | 0 | 0.00% | 1 |
| 3158 | hypothetical protein MGC10947 (MGC10947), m | Hs.326740 | 0 | 0.00% | 0 | 0.00% | 0 | 0.00% | 1 | 0.01% | 1 |
| 3159 | hypothetical protein MGC14433 (MGC14433), m | Hs.83572 | 0 | 0.00% | 0 | 0.00% | 1 | 0.01% | 0 | 0.00% | 1 |
| 3160 | hypothetical protein MGC14833 (MGC14833) | XM_042640.1 | 1 | 0.01% | 0 | 0.00% | 0 | 0.00% | 0 | 0.00% | 1 |
| 3161 | hypothetical protein MGC2217 (MGC2217), mRI | Hs.323164 | 0 | 0.00% | 0 | 0.00% | 0 | 0.00% | 1 | 0.01% | 1 |
| 3162 | hypothetical protein MGC2744, clone MGC:4371 | BC019324.1 | 1 | 0.01% | 0 | 0.00% | 0 | 0.00% | 0 | 0.00% | 1 |
| 3163 | hypothetical protein MGC2827 (MGC2827), mRI | Hs.8035 | 0 | 0.00% | 0 | 0.00% | 0 | 0.00% | 1 | 0.01% | 1 |
| 3164 | hypothetical protein MGC3178 (MGC3178) | XM_037853.1 | 1 | 0.01% | 0 | 0.00% | 0 | 0.00% | 0 | 0.00% | 1 |
| 3165 | hypothetical protein MGC3200 (MGC3200) | XM_034630.1 | 1 | 0.01% | 0 | 0.00% | 0 | 0.00% | 0 | 0.00% | 1 |
| 3166 | hypothetical protein MGC3251 (MGC3251), mRI | Hs.13467 | 0 | 0.00% | 0 | 0.00% | 0 | 0.00% | 1 | 0.01% | 1 |
| 3167 | hypothetical protein MGC4174 (MGC4174) | XM_018439.2 | 1 | 0.01% | 0 | 0.00% | 0 | 0.00% | 0 | 0.00% | 1 |
| 3168 | hypothetical protein MGC5306 (MGC5306), mRI | XM_048376.1 | 1 | 0.01% | 0 | 0.00% | 0 | 0.00% | 0 | 0.00% | 1 |
| 3169 | hypothetical protein similar to mouse Dnajl1 (DN | Hs.13015 | 0 | 0.00% | 0 | 0.00% | 1 | 0.01% | 0 | 0.00% | 1 |
| 3170 | HYPOTHETICAL PROTEIN ZAP3 | P49750 | 0 | 0.00% | 1 | 0.01% | 0 | 0.00% | 0 | 0.00% | 1 |
| 3171 | hypothetical protein, clone MGC:19514 IMAGE:4 | BC011720.1 | 0 | 0.00% | 0 | 0.00% | 0 | 0.00% | 1 | 0.01% | 1 |
| 3172 | hypothetical protein, clone MGC:20386 IMAGE:4 | BC015919.1 | 0 | 0.00% | 0 | 0.00% | 0 | 0.00% | 1 | 0.01% | 1 |
| 3173 | hypothetical protein, expressed in osteoblast (G | NM_006820.1 | 0 | 0.00% | 1 | 0.01% | 0 | 0.00% | 0 | 0.00% | 1 |
| 3174 | I factor (complement) (IF), mRNA /cds=(14,1765 | Hs.36602 | 0 | 0.00% | 0 | 0.00% | 1 | 0.01% | 0 | 0.00% | 1 |
| 3175 | ID YG39-2B | AJ227863.1 | 0 | 0.00% | 1 | 0.01% | 0 | 0.00% | 0 | 0.00% | 1 |
| 3176 | IFI16b (IFI16b) | AF208043.1 | 0 | 0.00% | 1 | 0.01% | 0 | 0.00% | 0 | 0.00% | 1 |
| 3177 | IkB kinase-b(IKK-beta) mRNA, complete cds | AF080158.1 | 0 | 0.00% | 1 | 0.01% | 0 | 0.00% | 0 | 0.00% | 1 |
| 3178 | IL0-CT0080-030899-107-c07 CT0080 | AW062569.1 | 0 | 0.00% | 1 | 0.01% | 0 | 0.00% | 0 | 0.00% | 1 |
| 3179 | I-mfa domain-containing protein (HIC), mRNA | XM_041273.1 | 0 | 0.00% | 0 | 0.00% | 0 | 0.00% | 1 | 0.01% | 1 |
| 3180 | implantation-associated protein (IAG2) (ORF) | AF008554 | 0 | 0.00% | 0 | 0.00% | 1 | 0.01% | 0 | 0.00% | 1 |
| 3181 | INE2 | Y10697.1 | 0 | 0.00% | 0 | 0.00% | 0 | 0.00% | 1 | 0.01% | 1 |
| 3182 | infant brain mRNA, clone 13cDNA65 | U57962.1 | 0 | 0.00% | 1 | 0.01% | 0 | 0.00% | 0 | 0.00% | 1 |
| 3183 | ING1Lp | AB012853.1 | 0 | 0.00% | 0 | 0.00% | 0 | 0.00% | 1 | 0.01% | 1 |
| 3184 | inner mitochondrial membrane translocase Tim1 | AF034790 | 1 | 0.01% | 0 | 0.00% | 0 | 0.00% | 0 | 0.00% | 1 |
| 3185 | insulin induced gene 1 (INSIG1) | NM_005542.1 | 0 | 0.00% | 0 | 0.00% | 0 | 0.00% | 1 | 0.01% | 1 |
| 3186 | integrative vector pRS306 with URA3 marker, cc | U03438.1 | 1 | 0.01% | 0 | 0.00% | 0 | 0.00% | 0 | 0.00% | 1 |
| 3187 | interferon-induced, hepatitis C-associated micro | NM_006417.1 | 0 | 0.00% | 1 | 0.01% | 0 | 0.00% | 0 | 0.00% | 1 |
| 3188 | intracisternal A particle-promoted polypeptide (IF | NM_005897.1 | 0 | 0.00% | 1 | 0.01% | 0 | 0.00% | 0 | 0.00% | 1 |
| 3189 | IRA1 mRNA, complete cds, alternatively spliced | Hs.315111 | 0 | 0.00% | 0 | 0.00% | 0 | 0.00% | 1 | 0.01% | 1 |

Figure 6 - Unique Known Genes Identified In Four cDNA Cartilage Libraries and EST Frequency Analysis - Page 57 of 102

| | | | | | | | | | | | |
|---|---|---|---|---|---|---|---|---|---|---|---|
| 3190 | Isoform 1 from chromosome 22 | AL359401.1 | 1 | 0.01% | 0 | 0.00% | 0 | 0.00% | 0 | 0.00% | 1 |
| 3191 | isoform 2 of a novel human mRNA from chromos | AL160112.1 | 1 | 0.01% | 0 | 0.00% | 0 | 0.00% | 0 | 0.00% | 1 |
| 3192 | ITBA2 protein(ORF) | X92896.1 | 1 | 0.01% | 0 | 0.00% | 0 | 0.00% | 0 | 0.00% | 1 |
| 3193 | J domain containing protein 1 isoform a | AAD52650.1 | 0 | 0.00% | 0 | 0.00% | 1 | 0.01% | 0 | 0.00% | 1 |
| 3194 | JAZF1 (JJAZ1) | XM_050093.1 | 1 | 0.01% | 0 | 0.00% | 0 | 0.00% | 0 | 0.00% | 1 |
| 3195 | jerky (mouse) homolog-like (JRKL) | NM_003772.1 | 0 | 0.00% | 0 | 0.00% | 0 | 0.00% | 1 | 0.01% | 1 |
| 3196 | kappa B-ras | AF229839.1 | 0 | 0.00% | 1 | 0.01% | 0 | 0.00% | 0 | 0.00% | 1 |
| 3197 | KFZp586B1821 | AL133114.1 | 0 | 0.00% | 0 | 0.00% | 0 | 0.00% | 1 | 0.01% | 1 |
| 3198 | KH domain RNA binding protein QKI-5B | AF090403.1 | 0 | 0.00% | 0 | 0.00% | 0 | 0.00% | 1 | 0.01% | 1 |
| 3199 | KIAA0008 | D13633 | 1 | 0.01% | 0 | 0.00% | 0 | 0.00% | 0 | 0.00% | 1 |
| 3200 | KIAA0013 | D87717.1 | 0 | 0.00% | 0 | 0.00% | 0 | 0.00% | 1 | 0.01% | 1 |
| 3201 | KIAA0020 gene product (KIAA0020) | NM_014878.1 | 0 | 0.00% | 1 | 0.01% | 0 | 0.00% | 0 | 0.00% | 1 |
| 3202 | KIAA0029 | D21852 | 0 | 0.00% | 0 | 0.00% | 0 | 0.00% | 1 | 0.01% | 1 |
| 3203 | KIAA0033 | D26067.1 | 0 | 0.00% | 0 | 0.00% | 1 | 0.01% | 0 | 0.00% | 1 |
| 3204 | KIAA0035 gene | D21262.1 | 0 | 0.00% | 1 | 0.01% | 0 | 0.00% | 0 | 0.00% | 1 |
| 3205 | KIAA0051 gene | D29640.1 | 0 | 0.00% | 1 | 0.01% | 0 | 0.00% | 0 | 0.00% | 1 |
| 3206 | KIAA0052 protein, partial cds | D29641.2 | 0 | 0.00% | 1 | 0.01% | 0 | 0.00% | 0 | 0.00% | 1 |
| 3207 | KIAA0063 gene product (KIAA0063) | NM_014876.1 | 0 | 0.00% | 0 | 0.00% | 0 | 0.00% | 1 | 0.01% | 1 |
| 3208 | KIAA0078 gene | D38551.1 | 0 | 0.00% | 1 | 0.01% | 0 | 0.00% | 0 | 0.00% | 1 |
| 3209 | KIAA0088 gene, partial cds | D42041.1 | 1 | 0.01% | 0 | 0.00% | 0 | 0.00% | 0 | 0.00% | 1 |
| 3210 | KIAA0089 gene | D42047.1 | 0 | 0.00% | 1 | 0.01% | 0 | 0.00% | 0 | 0.00% | 1 |
| 3211 | KIAA0091 gene | D42053.1 | 1 | 0.01% | 0 | 0.00% | 0 | 0.00% | 0 | 0.00% | 1 |
| 3212 | KIAA0096 | D43636 | 1 | 0.01% | 0 | 0.00% | 0 | 0.00% | 0 | 0.00% | 1 |
| 3213 | KIAA0098 (chaperonin containing TCP-1) | D43950 | 0 | 0.00% | 0 | 0.00% | 1 | 0.01% | 0 | 0.00% | 1 |
| 3214 | KIAA0101 | D14657 | 1 | 0.01% | 0 | 0.00% | 0 | 0.00% | 0 | 0.00% | 1 |
| 3215 | KIAA0108 (golgi 4-transmembrane spanning trar | D14696 | 0 | 0.00% | 0 | 0.00% | 0 | 0.00% | 1 | 0.01% | 1 |
| 3216 | KIAA0109 gene | D63475.1 | 0 | 0.00% | 1 | 0.01% | 0 | 0.00% | 0 | 0.00% | 1 |
| 3217 | KIAA0110 | D14811 | 1 | 0.01% | 0 | 0.00% | 0 | 0.00% | 0 | 0.00% | 1 |
| 3218 | KIAA0123 protein (KIAA0123) | XM_054752.1 | 1 | 0.01% | 0 | 0.00% | 0 | 0.00% | 0 | 0.00% | 1 |
| 3219 | KIAA0150 | D63484 | 1 | 0.01% | 0 | 0.00% | 0 | 0.00% | 0 | 0.00% | 1 |
| 3220 | KIAA0154 | D63876 | 1 | 0.01% | 0 | 0.00% | 0 | 0.00% | 0 | 0.00% | 1 |
| 3221 | KIAA0157 gene, partial | D63877.1 | 0 | 0.00% | 1 | 0.01% | 0 | 0.00% | 0 | 0.00% | 1 |
| 3222 | KIAA0171 gene product (KIAA0171) | NM_014666.1 | 0 | 0.00% | 1 | 0.01% | 0 | 0.00% | 0 | 0.00% | 1 |
| 3223 | KIAA0184 | D80006 | 0 | 0.00% | 0 | 0.00% | 1 | 0.01% | 0 | 0.00% | 1 |
| 3224 | KIAA0190 gene | D80012.1 | 0 | 0.00% | 1 | 0.01% | 0 | 0.00% | 0 | 0.00% | 1 |
| 3225 | KIAA0193 gene product (KIAA0193) | NM_014766.1 | 0 | 0.00% | 0 | 0.00% | 0 | 0.00% | 1 | 0.01% | 1 |
| 3226 | KIAA0197 gene | D83781 | 0 | 0.00% | 0 | 0.00% | 0 | 0.00% | 1 | 0.01% | 1 |
| 3227 | KIAA0200 gene | NM_014757.1 | 1 | 0.01% | 0 | 0.00% | 0 | 0.00% | 0 | 0.00% | 1 |
| 3228 | KIAA0220 | D86974.1 | 1 | 0.01% | 0 | 0.00% | 0 | 0.00% | 0 | 0.00% | 1 |
| 3229 | KIAA0224 | NM_014003.1 | 1 | 0.01% | 0 | 0.00% | 0 | 0.00% | 0 | 0.00% | 1 |
| 3230 | KIAA0240 | D87077 | 0 | 0.00% | 0 | 0.00% | 1 | 0.01% | 0 | 0.00% | 1 |
| 3231 | KIAA0247 gene product (KIAA0247), mRNA /cds | Hs.82426 | 0 | 0.00% | 0 | 0.00% | 0 | 0.00% | 1 | 0.01% | 1 |
| 3232 | KIAA0257 gene, partial cds | D87446.1 | 0 | 0.00% | 1 | 0.01% | 0 | 0.00% | 0 | 0.00% | 1 |
| 3233 | KIAA0259 | D87448.1 | 0 | 0.00% | 1 | 0.01% | 0 | 0.00% | 0 | 0.00% | 1 |
| 3234 | KIAA0263 protein | D87452.1 | 1 | 0.01% | 0 | 0.00% | 0 | 0.00% | 0 | 0.00% | 1 |
| 3235 | KIAA0268 gene | D87742.1 | 0 | 0.00% | 1 | 0.01% | 0 | 0.00% | 0 | 0.00% | 1 |
| 3236 | KIAA0271 gene | D87461 | 0 | 0.00% | 1 | 0.01% | 0 | 0.00% | 0 | 0.00% | 1 |
| 3237 | KIAA0280 gene, partial cds /cds=UNKNOWN /g | Hs.75400 | 0 | 0.00% | 0 | 0.00% | 0 | 0.00% | 1 | 0.01% | 1 |
| 3238 | KIAA0281 gene product | NM_014800.1 | 0 | 0.00% | 0 | 0.00% | 0 | 0.00% | 1 | 0.01% | 1 |
| 3239 | KIAA0286 gene | AB006624.1 | 0 | 0.00% | 1 | 0.01% | 0 | 0.00% | 0 | 0.00% | 1 |
| 3240 | KIAA0290 (non-exact match 80% a.a.) | BAA22959.1 | 0 | 0.00% | 1 | 0.01% | 0 | 0.00% | 0 | 0.00% | 1 |
| 3241 | KIAA0294 | NM_014629.1 | 0 | 0.00% | 0 | 0.00% | 1 | 0.01% | 0 | 0.00% | 1 |
| 3242 | KIAA0297 gene | AB002295.1 | 0 | 0.00% | 0 | 0.00% | 0 | 0.00% | 1 | 0.01% | 1 |
| 3243 | KIAA0301 gene | AB002299.1 | 0 | 0.00% | 1 | 0.01% | 0 | 0.00% | 0 | 0.00% | 1 |
| 3244 | KIAA0305 gene product (RefSeq aa 2e-32) | NP_055548.1 | 0 | 0.00% | 1 | 0.01% | 0 | 0.00% | 0 | 0.00% | 1 |
| 3245 | KIAA0323 gene | AB002321.1 | 1 | 0.01% | 0 | 0.00% | 0 | 0.00% | 0 | 0.00% | 1 |
| 3246 | KIAA0337 | AB002335 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 58 of 102

| | | | | | | | | | | | |
|---|---|---|---|---|---|---|---|---|---|---|---|
| 3247 | KIAA0361 | AB002359 | 1 | 0.01% | 0 | 0.00% | 0 | 0.00% | 0 | 0.00% | 1 |
| 3248 | KIAA0365 | AB002363 | 1 | 0.01% | 0 | 0.00% | 0 | 0.00% | 0 | 0.00% | 1 |
| 3249 | KIAA0367 | AB002365.1 | 0 | 0.00% | 0 | 0.00% | 0 | 0.00% | 1 | 0.01% | 1 |
| 3250 | KIAA0373 | AB002371.1 | 0 | 0.00% | 0 | 0.00% | 1 | 0.01% | 0 | 0.00% | 1 |
| 3251 | KIAA0391 gene product (RefSeq aa 2e-31) | NP_055487.1 | 0 | 0.00% | 1 | 0.01% | 0 | 0.00% | 0 | 0.00% | 1 |
| 3252 | KIAA0393 | AB002391.2 | 1 | 0.01% | 0 | 0.00% | 0 | 0.00% | 0 | 0.00% | 1 |
| 3253 | KIAA0395 | AB007855.1 | 0 | 0.00% | 0 | 0.00% | 0 | 0.00% | 1 | 0.01% | 1 |
| 3254 | KIAA0397 gene product (KIAA0397) | XM_029438.1 | 1 | 0.01% | 0 | 0.00% | 0 | 0.00% | 0 | 0.00% | 1 |
| 3255 | KIAA0399 | AB007859.2 | 0 | 0.00% | 1 | 0.01% | 0 | 0.00% | 0 | 0.00% | 1 |
| 3256 | KIAA0402 | AB007862 | 1 | 0.01% | 0 | 0.00% | 0 | 0.00% | 0 | 0.00% | 1 |
| 3257 | KIAA0405 | AB007865 | 1 | 0.01% | 0 | 0.00% | 0 | 0.00% | 0 | 0.00% | 1 |
| 3258 | KIAA0407 | AB007867.1 | 1 | 0.01% | 0 | 0.00% | 0 | 0.00% | 0 | 0.00% | 1 |
| 3259 | KIAA0409 | AB007869.1 | 0 | 0.00% | 1 | 0.01% | 0 | 0.00% | 0 | 0.00% | 1 |
| 3260 | KIAA0416 | AB007876 | 0 | 0.00% | 0 | 0.00% | 0 | 0.00% | 1 | 0.01% | 1 |
| 3261 | KIAA0418 gene | NM_014631.1 | 1 | 0.01% | 0 | 0.00% | 0 | 0.00% | 0 | 0.00% | 1 |
| 3262 | KIAA0430 | AB007890 | 0 | 0.00% | 0 | 0.00% | 1 | 0.01% | 0 | 0.00% | 1 |
| 3263 | KIAA0437 | AB007897 | 1 | 0.01% | 0 | 0.00% | 0 | 0.00% | 0 | 0.00% | 1 |
| 3264 | KIAA0441 | AB007901 | 0 | 0.00% | 0 | 0.00% | 0 | 0.00% | 1 | 0.01% | 1 |
| 3265 | KIAA0442 | AB007902.1 | 0 | 0.00% | 1 | 0.01% | 0 | 0.00% | 0 | 0.00% | 1 |
| 3266 | KIAA0445 | AB007914 | 1 | 0.01% | 0 | 0.00% | 0 | 0.00% | 0 | 0.00% | 1 |
| 3267 | KIAA0469 | AB007938 | 0 | 0.00% | 0 | 0.00% | 1 | 0.01% | 0 | 0.00% | 1 |
| 3268 | KIAA0473 gene product | NM_014787.1 | 0 | 0.00% | 0 | 0.00% | 1 | 0.01% | 0 | 0.00% | 1 |
| 3269 | KIAA0487 chromosome 1 specific transCRipt) | AB007956 | 1 | 0.01% | 0 | 0.00% | 0 | 0.00% | 0 | 0.00% | 1 |
| 3270 | KIAA0494 | NM_014774.1 | 0 | 0.00% | 1 | 0.01% | 0 | 0.00% | 0 | 0.00% | 1 |
| 3271 | KIAA0511 protein | AB011083 | 0 | 0.00% | 0 | 0.00% | 0 | 0.00% | 1 | 0.01% | 1 |
| 3272 | KIAA0516 | BAA25442.1 | 0 | 0.00% | 0 | 0.00% | 1 | 0.01% | 0 | 0.00% | 1 |
| 3273 | KIAA0517 protein | AB011089.1 | 0 | 0.00% | 0 | 0.00% | 0 | 0.00% | 1 | 0.01% | 1 |
| 3274 | KIAA0518 (=mouse Mad5) | AB011090.1 | 0 | 0.00% | 1 | 0.01% | 0 | 0.00% | 0 | 0.00% | 1 |
| 3275 | KIAA0524 | AB011096 | 1 | 0.01% | 0 | 0.00% | 0 | 0.00% | 0 | 0.00% | 1 |
| 3276 | KIAA0528 | AB011100.2 | 0 | 0.00% | 0 | 0.00% | 0 | 0.00% | 1 | 0.01% | 1 |
| 3277 | KIAA0529 | AB011101 | 1 | 0.01% | 0 | 0.00% | 0 | 0.00% | 0 | 0.00% | 1 |
| 3278 | KIAA0532 | AB011104.1 | 0 | 0.00% | 0 | 0.00% | 0 | 0.00% | 1 | 0.01% | 1 |
| 3279 | KIAA0536 | AB011108 | 0 | 0.00% | 0 | 0.00% | 0 | 0.00% | 1 | 0.01% | 1 |
| 3280 | KIAA0538 protein, partial cds | AB011110.2 | 0 | 0.00% | 1 | 0.01% | 0 | 0.00% | 0 | 0.00% | 1 |
| 3281 | KIAA0549 protein | AB011121 | 0 | 0.00% | 0 | 0.00% | 0 | 0.00% | 1 | 0.01% | 1 |
| 3282 | KIAA0554 (=DKFZp564O1116) | AB011126 | 0 | 0.00% | 0 | 0.00% | 1 | 0.01% | 0 | 0.00% | 1 |
| 3283 | KIAA0565 | AB011137 | 0 | 0.00% | 0 | 0.00% | 1 | 0.01% | 0 | 0.00% | 1 |
| 3284 | KIAA0584 | AB011156.1 | 0 | 0.00% | 0 | 0.00% | 0 | 0.00% | 1 | 0.01% | 1 |
| 3285 | KIAA0593 | AB011165 | 1 | 0.01% | 0 | 0.00% | 0 | 0.00% | 0 | 0.00% | 1 |
| 3286 | KIAA0601 | AB011173.1 | 1 | 0.01% | 0 | 0.00% | 0 | 0.00% | 0 | 0.00% | 1 |
| 3287 | KIAA0608 | AB011180 | 1 | 0.01% | 0 | 0.00% | 0 | 0.00% | 0 | 0.00% | 1 |
| 3288 | KIAA0614 | AB014514 | 0 | 0.00% | 0 | 0.00% | 1 | 0.01% | 0 | 0.00% | 1 |
| 3289 | KIAA0615 | AB014515 | 1 | 0.01% | 0 | 0.00% | 0 | 0.00% | 0 | 0.00% | 1 |
| 3290 | KIAA0621 | NM_015071.1 | 0 | 0.00% | 0 | 0.00% | 1 | 0.01% | 0 | 0.00% | 1 |
| 3291 | KIAA0625 | AB014525.1 | 0 | 0.00% | 1 | 0.01% | 0 | 0.00% | 0 | 0.00% | 1 |
| 3292 | KIAA0627 protein | AB014527.1 | 0 | 0.00% | 1 | 0.01% | 0 | 0.00% | 0 | 0.00% | 1 |
| 3293 | KIAA0628 | AB014528 | 0 | 0.00% | 0 | 0.00% | 0 | 0.00% | 1 | 0.01% | 1 |
| 3294 | KIAA0643 | AB014543 | 0 | 0.00% | 0 | 0.00% | 1 | 0.01% | 0 | 0.00% | 1 |
| 3295 | KIAA0644 | AB014544 | 1 | 0.01% | 0 | 0.00% | 0 | 0.00% | 0 | 0.00% | 1 |
| 3296 | KIAA0647 protein | AB014547.1 | 0 | 0.00% | 0 | 0.00% | 0 | 0.00% | 1 | 0.01% | 1 |
| 3297 | KIAA0649 (=L11910 retinoblastoma susceptibilit | AB014549 | 1 | 0.01% | 0 | 0.00% | 0 | 0.00% | 0 | 0.00% | 1 |
| 3298 | KIAA0650 | AB014550.1 | 0 | 0.00% | 1 | 0.01% | 0 | 0.00% | 0 | 0.00% | 1 |
| 3299 | KIAA0652 | AB014552 | 1 | 0.01% | 0 | 0.00% | 0 | 0.00% | 0 | 0.00% | 1 |
| 3300 | KIAA0657 protein | AB014557.1 | 1 | 0.01% | 0 | 0.00% | 0 | 0.00% | 0 | 0.00% | 1 |
| 3301 | KIAA0658 | AB014558 | 0 | 0.00% | 1 | 0.01% | 0 | 0.00% | 0 | 0.00% | 1 |
| 3302 | KIAA0668 protein | AB014568.1 | 0 | 0.00% | 1 | 0.01% | 0 | 0.00% | 0 | 0.00% | 1 |
| 3303 | KIAA0669 | AB014569 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 59 of 102

| | | | | | | | | | | | |
|---|---|---|---|---|---|---|---|---|---|---|---|
| 3304 | KIAA0677 gene product (KIAA0677) | NM_014663.1 | 0 | 0.00% | 0 | 0.00% | 1 | 0.01% | 0 | 0.00% | 1 |
| 3305 | KIAA0678 | AB014578 | 0 | 0.00% | 0 | 0.00% | 0 | 0.00% | 1 | 0.01% | 1 |
| 3306 | KIAA0690 protein | AB014590.1 | 0 | 0.00% | 0 | 0.00% | 0 | 0.00% | 1 | 0.01% | 1 |
| 3307 | KIAA0700 protein (KIAA0700) | XM_050561.2 | 1 | 0.01% | 0 | 0.00% | 0 | 0.00% | 0 | 0.00% | 1 |
| 3308 | KIAA0707 protein, partial cds /cds=UNKNOWN | Hs.234786 | 0 | 0.00% | 0 | 0.00% | 1 | 0.01% | 0 | 0.00% | 1 |
| 3309 | KIAA0714 | AB018257.1 | 0 | 0.00% | 0 | 0.00% | 1 | 0.01% | 0 | 0.00% | 1 |
| 3310 | KIAA0721 | AB018264.1 | 0 | 0.00% | 0 | 0.00% | 1 | 0.01% | 0 | 0.00% | 1 |
| 3311 | KIAA0726 | NM_014718.1 | 1 | 0.01% | 0 | 0.00% | 0 | 0.00% | 0 | 0.00% | 1 |
| 3312 | KIAA0733 | AB018276.1 | 0 | 0.00% | 1 | 0.01% | 0 | 0.00% | 0 | 0.00% | 1 |
| 3313 | KIAA0737 | AB018280 | 1 | 0.01% | 0 | 0.00% | 0 | 0.00% | 0 | 0.00% | 1 |
| 3314 | KIAA0742 | AB018285.1 | 0 | 0.00% | 1 | 0.01% | 0 | 0.00% | 0 | 0.00% | 1 |
| 3315 | KIAA0752 protein (KIAA0752) | XM_040324.1 | 1 | 0.01% | 0 | 0.00% | 0 | 0.00% | 0 | 0.00% | 1 |
| 3316 | KIAA0758 protein | AB018301 | 0 | 0.00% | 0 | 0.00% | 1 | 0.01% | 0 | 0.00% | 1 |
| 3317 | KIAA0764 | NM_014860.1 | 1 | 0.01% | 0 | 0.00% | 0 | 0.00% | 0 | 0.00% | 1 |
| 3318 | KIAA0774 | AB018317.1 | 1 | 0.01% | 0 | 0.00% | 0 | 0.00% | 0 | 0.00% | 1 |
| 3319 | KIAA0781 | AB018324.1 | 0 | 0.00% | 0 | 0.00% | 1 | 0.01% | 0 | 0.00% | 1 |
| 3320 | KIAA0784 | AB018327.1 | 0 | 0.00% | 0 | 0.00% | 0 | 0.00% | 1 | 0.01% | 1 |
| 3321 | KIAA0788 | AB018331.1 | 0 | 0.00% | 1 | 0.01% | 0 | 0.00% | 0 | 0.00% | 1 |
| 3322 | KIAA0790 protein | AB018333.1 | 0 | 0.00% | 1 | 0.01% | 0 | 0.00% | 0 | 0.00% | 1 |
| 3323 | KIAA0795 protein (KIAA0795), mRNA | XM_016166.3 | 1 | 0.01% | 0 | 0.00% | 0 | 0.00% | 0 | 0.00% | 1 |
| 3324 | KIAA0798 gene product (KIAA0798) | NM_014650.1 | 0 | 0.00% | 1 | 0.01% | 0 | 0.00% | 0 | 0.00% | 1 |
| 3325 | KIAA0801 gene product (RefSeq aa 3e-73) | NP_055644.1 | 0 | 0.00% | 1 | 0.01% | 0 | 0.00% | 0 | 0.00% | 1 |
| 3326 | KIAA0823 protein, partial cds | AB020630.1 | 0 | 0.00% | 1 | 0.01% | 0 | 0.00% | 0 | 0.00% | 1 |
| 3327 | KIAA0826 | AB020633 | 0 | 0.00% | 0 | 0.00% | 0 | 0.00% | 1 | 0.01% | 1 |
| 3328 | KIAA0831 | AB020638.1 | 0 | 0.00% | 0 | 0.00% | 0 | 0.00% | 1 | 0.01% | 1 |
| 3329 | KIAA0836 protein | AB020643.1 | 0 | 0.00% | 1 | 0.01% | 0 | 0.00% | 0 | 0.00% | 1 |
| 3330 | KIAA0840 protein | AB020647.1 | 1 | 0.01% | 0 | 0.00% | 0 | 0.00% | 0 | 0.00% | 1 |
| 3331 | KIAA0856 | AB020663.1 | 0 | 0.00% | 1 | 0.01% | 0 | 0.00% | 0 | 0.00% | 1 |
| 3332 | KIAA0857 protein (=DKFZp434H018) | AB020664.1 | 0 | 0.00% | 0 | 0.00% | 0 | 0.00% | 1 | 0.01% | 1 |
| 3333 | KIAA0859 | AB020666.2 | 0 | 0.00% | 1 | 0.01% | 0 | 0.00% | 0 | 0.00% | 1 |
| 3334 | KIAA0860 | AB020667 | 1 | 0.01% | 0 | 0.00% | 0 | 0.00% | 0 | 0.00% | 1 |
| 3335 | KIAA0866 protein | AB020673.1 | 0 | 0.00% | 1 | 0.01% | 0 | 0.00% | 0 | 0.00% | 1 |
| 3336 | KIAA0867 | NM_014938.1 | 0 | 0.00% | 0 | 0.00% | 1 | 0.01% | 0 | 0.00% | 1 |
| 3337 | KIAA0874 | AB020681.1 | 0 | 0.00% | 1 | 0.01% | 0 | 0.00% | 0 | 0.00% | 1 |
| 3338 | KIAA0878 (contains Alu repeat) | AB020685.1 | 0 | 0.00% | 0 | 0.00% | 0 | 0.00% | 1 | 0.01% | 1 |
| 3339 | KIAA0879 protein (KIAA0879) | NM_014936.1 | 0 | 0.00% | 0 | 0.00% | 0 | 0.00% | 1 | 0.01% | 1 |
| 3340 | KIAA0883 | AB020690 | 0 | 0.00% | 0 | 0.00% | 0 | 0.00% | 1 | 0.01% | 1 |
| 3341 | KIAA0887 protein, | AB020694.1 | 0 | 0.00% | 1 | 0.01% | 0 | 0.00% | 0 | 0.00% | 1 |
| 3342 | KIAA0890 protein (KIAA0890) | NM_014966.1 | 0 | 0.00% | 0 | 0.00% | 0 | 0.00% | 1 | 0.01% | 1 |
| 3343 | KIAA0892 | AB020699.1 | 1 | 0.01% | 0 | 0.00% | 0 | 0.00% | 0 | 0.00% | 1 |
| 3344 | KIAA0898 | AB020705.1 | 0 | 0.00% | 0 | 0.00% | 1 | 0.01% | 0 | 0.00% | 1 |
| 3345 | KIAA0908 protein | AB020715.1 | 1 | 0.01% | 0 | 0.00% | 0 | 0.00% | 0 | 0.00% | 1 |
| 3346 | KIAA0912 | AB020719.1 | 0 | 0.00% | 1 | 0.01% | 0 | 0.00% | 0 | 0.00% | 1 |
| 3347 | KIAA0922 | AB023139.1 | 1 | 0.01% | 0 | 0.00% | 0 | 0.00% | 0 | 0.00% | 1 |
| 3348 | KIAA0923 | AB023140.1 | 0 | 0.00% | 0 | 0.00% | 0 | 0.00% | 1 | 0.01% | 1 |
| 3349 | KIAA0926 protein (KIAA0926), | NM_014922.1 | 0 | 0.00% | 0 | 0.00% | 1 | 0.01% | 0 | 0.00% | 1 |
| 3350 | KIAA0937 | AB023154.1 | 1 | 0.01% | 0 | 0.00% | 0 | 0.00% | 0 | 0.00% | 1 |
| 3351 | KIAA0940 protein (RefSeq aa 3e-75) | NP_055727.1 | 0 | 0.00% | 1 | 0.01% | 0 | 0.00% | 0 | 0.00% | 1 |
| 3352 | KIAA0941 | AB023158.1 | 0 | 0.00% | 0 | 0.00% | 0 | 0.00% | 1 | 0.01% | 1 |
| 3353 | KIAA0946 | AB023163.1 | 1 | 0.01% | 0 | 0.00% | 0 | 0.00% | 0 | 0.00% | 1 |
| 3354 | KIAA0949 | AB023166.1 | 0 | 0.00% | 0 | 0.00% | 0 | 0.00% | 1 | 0.01% | 1 |
| 3355 | KIAA0951 protein (KIAA0951), | NM_014893.1 | 0 | 0.00% | 0 | 0.00% | 0 | 0.00% | 1 | 0.01% | 1 |
| 3356 | KIAA0957 protein (RefSeq aa 1e-33) | NP_055757.1 | 0 | 0.00% | 1 | 0.01% | 0 | 0.00% | 0 | 0.00% | 1 |
| 3357 | KIAA0961 protein | NM_014898.1 | 1 | 0.01% | 0 | 0.00% | 0 | 0.00% | 0 | 0.00% | 1 |
| 3358 | KIAA0962(=DKFZp564D022) | AB023179.1 | 1 | 0.01% | 0 | 0.00% | 0 | 0.00% | 0 | 0.00% | 1 |
| 3359 | KIAA0974 | AB023191 | 1 | 0.01% | 0 | 0.00% | 0 | 0.00% | 0 | 0.00% | 1 |
| 3360 | KIAA0979 protein | BAA76823.1 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 60 of 102

| | | | | | | | | | | | |
|---|---|---|---|---|---|---|---|---|---|---|---|
| 3361 | KIAA0980 | AB023197 | 0 | 0.00% | 0 | 0.00% | 1 | 0.01% | 0 | 0.00% | 1 |
| 3362 | KIAA0981 | AB023198.1 | 0 | 0.00% | 0 | 0.00% | 0 | 0.00% | 1 | 0.01% | 1 |
| 3363 | KIAA0996 | NM_014934.1 | 0 | 0.00% | 0 | 0.00% | 0 | 0.00% | 1 | 0.01% | 1 |
| 3364 | KIAA1007 protein (KIAA1007) | NM_016284.1 | 0 | 0.00% | 1 | 0.01% | 0 | 0.00% | 0 | 0.00% | 1 |
| 3365 | KIAA1018 | AB023235.1 | 0 | 0.00% | 0 | 0.00% | 1 | 0.01% | 0 | 0.00% | 1 |
| 3366 | KIAA1023 | AB028946 | 0 | 0.00% | 1 | 0.01% | 0 | 0.00% | 0 | 0.00% | 1 |
| 3367 | KIAA1028 | AB028951.1 | 0 | 0.00% | 0 | 0.00% | 0 | 0.00% | 1 | 0.01% | 1 |
| 3368 | KIAA1031 | AB028954.1 | 0 | 0.00% | 0 | 0.00% | 0 | 0.00% | 1 | 0.01% | 1 |
| 3369 | KIAA1041 | NM_014947.1 | 1 | 0.01% | 0 | 0.00% | 0 | 0.00% | 0 | 0.00% | 1 |
| 3370 | KIAA1042 | AB028965.1 | 0 | 0.00% | 0 | 0.00% | 0 | 0.00% | 1 | 0.01% | 1 |
| 3371 | KIAA1044 | AB028967.1 | 0 | 0.00% | 1 | 0.01% | 0 | 0.00% | 0 | 0.00% | 1 |
| 3372 | KIAA1046 protein (KIAA1046) | NM_014928.1 | 0 | 0.00% | 1 | 0.01% | 0 | 0.00% | 0 | 0.00% | 1 |
| 3373 | KIAA1049 | AB028972.1 | 0 | 0.00% | 0 | 0.00% | 0 | 0.00% | 1 | 0.01% | 1 |
| 3374 | KIAA1050 | AB028973.1 | 0 | 0.00% | 0 | 0.00% | 1 | 0.01% | 0 | 0.00% | 1 |
| 3375 | KIAA1055 | AB028978.1 | 1 | 0.01% | 0 | 0.00% | 0 | 0.00% | 0 | 0.00% | 1 |
| 3376 | KIAA1057 | AB028980.1 | 0 | 0.00% | 0 | 0.00% | 0 | 0.00% | 1 | 0.01% | 1 |
| 3377 | KIAA1067 | AB028990.1 | 1 | 0.01% | 0 | 0.00% | 0 | 0.00% | 0 | 0.00% | 1 |
| 3378 | KIAA1071 | AB028994.1 | 0 | 0.00% | 0 | 0.00% | 1 | 0.01% | 0 | 0.00% | 1 |
| 3379 | KIAA1075 protein | AB028998.1 | 1 | 0.01% | 0 | 0.00% | 0 | 0.00% | 0 | 0.00% | 1 |
| 3380 | KIAA1078 protein, | AB029001.1 | 0 | 0.00% | 1 | 0.01% | 0 | 0.00% | 0 | 0.00% | 1 |
| 3381 | KIAA1085 | AB029008.1 | 0 | 0.00% | 1 | 0.01% | 0 | 0.00% | 0 | 0.00% | 1 |
| 3382 | KIAA1093 | AB029016.1 | 0 | 0.00% | 0 | 0.00% | 1 | 0.01% | 0 | 0.00% | 1 |
| 3383 | KIAA1095 protein, partial cds | AB029018.1 | 0 | 0.00% | 1 | 0.01% | 0 | 0.00% | 0 | 0.00% | 1 |
| 3384 | KIAA1097 | AB029020.1 | 0 | 0.00% | 0 | 0.00% | 0 | 0.00% | 1 | 0.01% | 1 |
| 3385 | KIAA1098 protein | AB029021.1 | 0 | 0.00% | 1 | 0.01% | 0 | 0.00% | 0 | 0.00% | 1 |
| 3386 | KIAA1099 protein (KIAA1099) | NM_014914.1 | 0 | 0.00% | 1 | 0.01% | 0 | 0.00% | 0 | 0.00% | 1 |
| 3387 | KIAA1109 | AB029032.1 | 0 | 0.00% | 0 | 0.00% | 1 | 0.01% | 0 | 0.00% | 1 |
| 3388 | KIAA1110 protein | AB029033.1 | 1 | 0.01% | 0 | 0.00% | 0 | 0.00% | 0 | 0.00% | 1 |
| 3389 | KIAA1114 protein (KIAA1114) | NM_016157.1 | 1 | 0.01% | 0 | 0.00% | 0 | 0.00% | 0 | 0.00% | 1 |
| 3390 | KIAA1116 protein (KIAA1116) | NM_014892.1 | 0 | 0.00% | 1 | 0.01% | 0 | 0.00% | 0 | 0.00% | 1 |
| 3391 | KIAA1119 protein | AB032945.1 | 0 | 0.00% | 1 | 0.01% | 0 | 0.00% | 0 | 0.00% | 1 |
| 3392 | KIAA1122 | AB032948 | 0 | 0.00% | 0 | 0.00% | 0 | 0.00% | 1 | 0.01% | 1 |
| 3393 | KIAA1124 | AK000716.1 | 0 | 0.00% | 1 | 0.01% | 0 | 0.00% | 0 | 0.00% | 1 |
| 3394 | KIAA1143 protein | AB032969.1 | 0 | 0.00% | 1 | 0.01% | 0 | 0.00% | 0 | 0.00% | 1 |
| 3395 | KIAA1146 | AB032972.1 | 0 | 0.00% | 1 | 0.01% | 0 | 0.00% | 0 | 0.00% | 1 |
| 3396 | KIAA1147 protein | AB032973.1 | 0 | 0.00% | 0 | 0.00% | 1 | 0.01% | 0 | 0.00% | 1 |
| 3397 | KIAA1151 | AB032977.1 | 0 | 0.00% | 0 | 0.00% | 1 | 0.01% | 0 | 0.00% | 1 |
| 3398 | KIAA1156 | AB032982.1 | 0 | 0.00% | 1 | 0.01% | 0 | 0.00% | 0 | 0.00% | 1 |
| 3399 | KIAA1164 protein, partial cds | AB032990.1 | 0 | 0.00% | 1 | 0.01% | 0 | 0.00% | 0 | 0.00% | 1 |
| 3400 | KIAA1165 | AB032991.1 | 0 | 0.00% | 1 | 0.01% | 0 | 0.00% | 0 | 0.00% | 1 |
| 3401 | KIAA1178 | AB033004.1 | 0 | 0.00% | 1 | 0.01% | 0 | 0.00% | 0 | 0.00% | 1 |
| 3402 | KIAA1179 | AB033005.1 | 0 | 0.00% | 1 | 0.01% | 0 | 0.00% | 0 | 0.00% | 1 |
| 3403 | KIAA1180 | AB033006.1 | 1 | 0.01% | 0 | 0.00% | 0 | 0.00% | 0 | 0.00% | 1 |
| 3404 | KIAA1187 protein | AB033013.1 | 1 | 0.01% | 0 | 0.00% | 0 | 0.00% | 0 | 0.00% | 1 |
| 3405 | KIAA1197 protein, partial cds | AB033023.1 | 0 | 0.00% | 1 | 0.01% | 0 | 0.00% | 0 | 0.00% | 1 |
| 3406 | KIAA1213 (low match) | AB033039 | 0 | 0.00% | 0 | 0.00% | 1 | 0.01% | 0 | 0.00% | 1 |
| 3407 | KIAA1214 | BAA86528.1 | 0 | 0.00% | 0 | 0.00% | 1 | 0.01% | 0 | 0.00% | 1 |
| 3408 | KIAA1218 | AB033044.1 | 0 | 0.00% | 0 | 0.00% | 1 | 0.01% | 0 | 0.00% | 1 |
| 3409 | KIAA1224 | AB033050.1 | 0 | 0.00% | 1 | 0.01% | 0 | 0.00% | 0 | 0.00% | 1 |
| 3410 | KIAA1229 | AB033055.1 | 0 | 0.00% | 0 | 0.00% | 0 | 0.00% | 1 | 0.01% | 1 |
| 3411 | KIAA1233 protein | AB033059.1 | 0 | 0.00% | 1 | 0.01% | 0 | 0.00% | 0 | 0.00% | 1 |
| 3412 | KIAA1235 | AB033061.1 | 0 | 0.00% | 0 | 0.00% | 0 | 0.00% | 1 | 0.01% | 1 |
| 3413 | KIAA1242 | AB033068.1 | 1 | 0.01% | 0 | 0.00% | 0 | 0.00% | 0 | 0.00% | 1 |
| 3414 | KIAA1243 protein, partial cds /cds=UNKNOWN / | Hs.151076 | 0 | 0.00% | 0 | 0.00% | 0 | 0.00% | 1 | 0.01% | 1 |
| 3415 | KIAA1255 (ANKHZN) | AB033081 | 1 | 0.01% | 0 | 0.00% | 0 | 0.00% | 0 | 0.00% | 1 |
| 3416 | KIAA1274 | AB033100.1 | 1 | 0.01% | 0 | 0.00% | 0 | 0.00% | 0 | 0.00% | 1 |
| 3417 | KIAA1279 protein | AB033105.1 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 61 of 102

| | | | | | | | | | | | |
|---|---|---|---|---|---|---|---|---|---|---|---|
| 3418 | KIAA1283 | AB033109.1 | 0 | 0.00% | 1 | 0.01% | 0 | 0.00% | 0 | 0.00% | 1 |
| 3419 | KIAA1294 | AB037715.1 | 1 | 0.01% | 0 | 0.00% | 0 | 0.00% | 0 | 0.00% | 1 |
| 3420 | KIAA1306 | AB037727.1 | 1 | 0.01% | 0 | 0.00% | 0 | 0.00% | 0 | 0.00% | 1 |
| 3421 | KIAA1308 | AB037729 | 1 | 0.01% | 0 | 0.00% | 0 | 0.00% | 0 | 0.00% | 1 |
| 3422 | KIAA1320 | AB037741.1 | 0 | 0.00% | 1 | 0.01% | 0 | 0.00% | 0 | 0.00% | 1 |
| 3423 | KIAA1323 | AB037744.1 | 0 | 0.00% | 0 | 0.00% | 1 | 0.01% | 0 | 0.00% | 1 |
| 3424 | KIAA1327 | AB037748.1 | 0 | 0.00% | 1 | 0.01% | 0 | 0.00% | 0 | 0.00% | 1 |
| 3425 | KIAA1328 protein | AB037749.1 | 0 | 0.00% | 1 | 0.01% | 0 | 0.00% | 0 | 0.00% | 1 |
| 3426 | KIAA1332 | AB037753.1 | 0 | 0.00% | 0 | 0.00% | 0 | 0.00% | 1 | 0.01% | 1 |
| 3427 | KIAA1333 | AB037754.1 | 0 | 0.00% | 0 | 0.00% | 0 | 0.00% | 1 | 0.01% | 1 |
| 3428 | KIAA1335 | AB037756.1 | 1 | 0.01% | 0 | 0.00% | 0 | 0.00% | 0 | 0.00% | 1 |
| 3429 | KIAA1343 | AB037764.1 | 0 | 0.00% | 1 | 0.01% | 0 | 0.00% | 0 | 0.00% | 1 |
| 3430 | KIAA1344 | AB037765.1 | 0 | 0.00% | 0 | 0.00% | 0 | 0.00% | 1 | 0.01% | 1 |
| 3431 | KIAA1352 | AB037773.1 | 0 | 0.00% | 1 | 0.01% | 0 | 0.00% | 0 | 0.00% | 1 |
| 3432 | KIAA1353 protein (KIAA1353) | XM_035589.1 | 1 | 0.01% | 0 | 0.00% | 0 | 0.00% | 0 | 0.00% | 1 |
| 3433 | KIAA1360 | AB037781.1 | 1 | 0.01% | 0 | 0.00% | 0 | 0.00% | 0 | 0.00% | 1 |
| 3434 | KIAA1365 | AB037786.1 | 1 | 0.01% | 0 | 0.00% | 0 | 0.00% | 0 | 0.00% | 1 |
| 3435 | KIAA1367 | AB037788.1 | 0 | 0.00% | 1 | 0.01% | 0 | 0.00% | 0 | 0.00% | 1 |
| 3436 | KIAA1373 | AB037794.1 | 0 | 0.00% | 0 | 0.00% | 1 | 0.01% | 0 | 0.00% | 1 |
| 3437 | KIAA1375 (PDCD6IP) | AB037796 | 1 | 0.01% | 0 | 0.00% | 0 | 0.00% | 0 | 0.00% | 1 |
| 3438 | KIAA1390protein | AB037811.1 | 0 | 0.00% | 1 | 0.01% | 0 | 0.00% | 0 | 0.00% | 1 |
| 3439 | KIAA1400 protein | AB037821.1 | 1 | 0.01% | 0 | 0.00% | 0 | 0.00% | 0 | 0.00% | 1 |
| 3440 | KIAA1403 | AB037824 | 0 | 0.00% | 0 | 0.00% | 0 | 0.00% | 1 | 0.01% | 1 |
| 3441 | KIAA1408 protein | AB037829.1 | 1 | 0.01% | 0 | 0.00% | 0 | 0.00% | 0 | 0.00% | 1 |
| 3442 | KIAA1412 protein | AB037833.1 | 0 | 0.00% | 1 | 0.01% | 0 | 0.00% | 0 | 0.00% | 1 |
| 3443 | KIAA1415 protein | AB037836.1 | 0 | 0.00% | 1 | 0.01% | 0 | 0.00% | 0 | 0.00% | 1 |
| 3444 | KIAA1417 | AB037838.1 | 1 | 0.01% | 0 | 0.00% | 0 | 0.00% | 0 | 0.00% | 1 |
| 3445 | KIAA1419 protein | AB037840.1 | 1 | 0.01% | 0 | 0.00% | 0 | 0.00% | 0 | 0.00% | 1 |
| 3446 | KIAA1421 protein | AB037842.1 | 0 | 0.00% | 1 | 0.01% | 0 | 0.00% | 0 | 0.00% | 1 |
| 3447 | KIAA1430 | AB037851.1 | 0 | 0.00% | 0 | 0.00% | 0 | 0.00% | 1 | 0.01% | 1 |
| 3448 | KIAA1432 | AB037853.1 | 0 | 0.00% | 0 | 0.00% | 0 | 0.00% | 1 | 0.01% | 1 |
| 3449 | KIAA1434 protein | AB037855.1 | 0 | 0.00% | 1 | 0.01% | 0 | 0.00% | 0 | 0.00% | 1 |
| 3450 | KIAA1435 | AB037856.1 | 1 | 0.01% | 0 | 0.00% | 0 | 0.00% | 0 | 0.00% | 1 |
| 3451 | KIAA1440 protein | AB037861.1 | 1 | 0.01% | 0 | 0.00% | 0 | 0.00% | 0 | 0.00% | 1 |
| 3452 | KIAA1454 protein | AB040887.1 | 0 | 0.00% | 0 | 0.00% | 1 | 0.01% | 0 | 0.00% | 1 |
| 3453 | KIAA1460 | AB040893.1 | 1 | 0.01% | 0 | 0.00% | 0 | 0.00% | 0 | 0.00% | 1 |
| 3454 | KIAA1461 (ORF) | AB040894 | 0 | 0.00% | 0 | 0.00% | 0 | 0.00% | 1 | 0.01% | 1 |
| 3455 | KIAA1462 | AB040895.1 | 0 | 0.00% | 1 | 0.01% | 0 | 0.00% | 0 | 0.00% | 1 |
| 3456 | KIAA1463 | AB040896.1 | 1 | 0.01% | 0 | 0.00% | 0 | 0.00% | 0 | 0.00% | 1 |
| 3457 | KIAA1472 | AB040905.1 | 0 | 0.00% | 0 | 0.00% | 0 | 0.00% | 1 | 0.01% | 1 |
| 3458 | KIAA1476 protein (=NM_013450.1 BAZ2B) | AB040909.1 | 0 | 0.00% | 0 | 0.00% | 0 | 0.00% | 1 | 0.01% | 1 |
| 3459 | KIAA1478 | AB040911.1 | 1 | 0.01% | 0 | 0.00% | 0 | 0.00% | 0 | 0.00% | 1 |
| 3460 | KIAA1483 protein (KIAA1483) | XM_045920.1 | 1 | 0.01% | 0 | 0.00% | 0 | 0.00% | 0 | 0.00% | 1 |
| 3461 | KIAA1495 protein | AB040928.1 | 1 | 0.01% | 0 | 0.00% | 0 | 0.00% | 0 | 0.00% | 1 |
| 3462 | KIAA1497 | AB040930.1 | 1 | 0.01% | 0 | 0.00% | 0 | 0.00% | 0 | 0.00% | 1 |
| 3463 | KIAA1521 | AB040954 | 0 | 0.00% | 0 | 0.00% | 0 | 0.00% | 1 | 0.01% | 1 |
| 3464 | KIAA1528 protein (KIAA1528) | XM_055933.1 | 1 | 0.01% | 0 | 0.00% | 0 | 0.00% | 0 | 0.00% | 1 |
| 3465 | KIAA1533 protein | AB040966.1 | 0 | 0.00% | 0 | 0.00% | 0 | 0.00% | 1 | 0.01% | 1 |
| 3466 | KIAA1537 | AB040970.1 | 0 | 0.00% | 1 | 0.01% | 0 | 0.00% | 0 | 0.00% | 1 |
| 3467 | KIAA1538 protein | AB040971.1 | 0 | 0.00% | 1 | 0.01% | 0 | 0.00% | 0 | 0.00% | 1 |
| 3468 | KIAA1558 | AB046778 | 0 | 0.00% | 1 | 0.01% | 0 | 0.00% | 0 | 0.00% | 1 |
| 3469 | KIAA1562 protein | AB046782.1 | 0 | 0.00% | 1 | 0.01% | 0 | 0.00% | 0 | 0.00% | 1 |
| 3470 | KIAA1565 protein, partial cds | AB046785.1 | 0 | 0.00% | 1 | 0.01% | 0 | 0.00% | 0 | 0.00% | 1 |
| 3471 | KIAA1571 | AB046791.1 | 0 | 0.00% | 1 | 0.01% | 0 | 0.00% | 0 | 0.00% | 1 |
| 3472 | KIAA1572 protein, partial cds /cds=UNKNOWN / | Hs.5638 | 0 | 0.00% | 0 | 0.00% | 0 | 0.00% | 1 | 0.01% | 1 |
| 3473 | KIAA1573 | AB046793 | 0 | 0.00% | 0 | 0.00% | 0 | 0.00% | 1 | 0.01% | 1 |
| 3474 | KIAA1578 protein | AB046798.1 | 0 | 0.00% | 1 | 0.01% | 0 | 0.00% | 0 | 0.00% | 1 |

Figure 6:
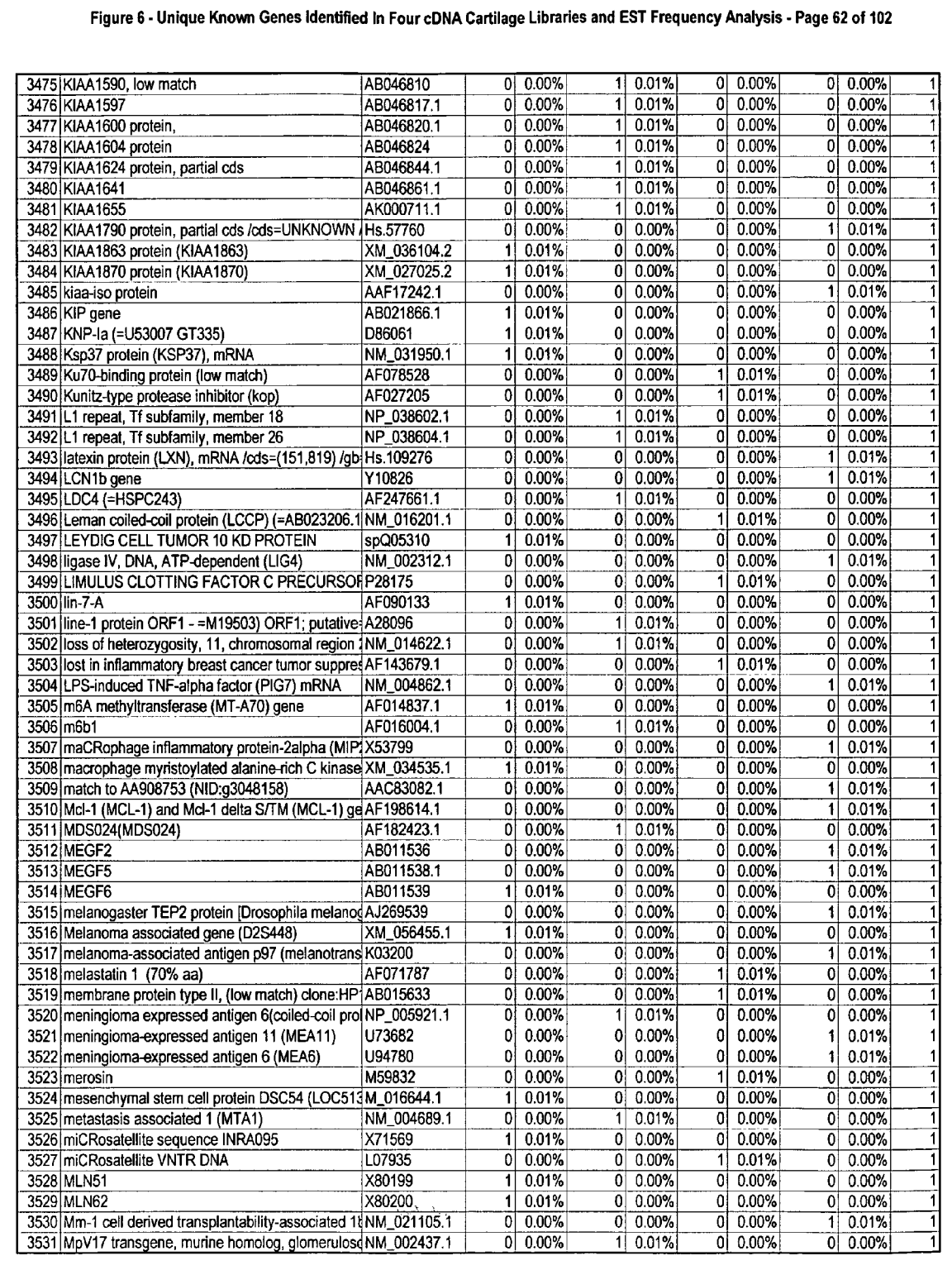

Figure 6 - Unique Known Genes Identified In Four cDNA Cartilage Libraries and EST Frequency Analysis - Page 62 of 102

| | | | | | | | | | | | |
|---|---|---|---|---|---|---|---|---|---|---|---|
| 3475 | KIAA1590, low match | AB046810 | 0 | 0.00% | 1 | 0.01% | 0 | 0.00% | 0 | 0.00% | 1 |
| 3476 | KIAA1597 | AB046817.1 | 0 | 0.00% | 1 | 0.01% | 0 | 0.00% | 0 | 0.00% | 1 |
| 3477 | KIAA1600 protein, | AB046820.1 | 0 | 0.00% | 1 | 0.01% | 0 | 0.00% | 0 | 0.00% | 1 |
| 3478 | KIAA1604 protein | AB046824 | 0 | 0.00% | 1 | 0.01% | 0 | 0.00% | 0 | 0.00% | 1 |
| 3479 | KIAA1624 protein, partial cds | AB046844.1 | 0 | 0.00% | 1 | 0.01% | 0 | 0.00% | 0 | 0.00% | 1 |
| 3480 | KIAA1641 | AB046861.1 | 0 | 0.00% | 1 | 0.01% | 0 | 0.00% | 0 | 0.00% | 1 |
| 3481 | KIAA1655 | AK000711.1 | 0 | 0.00% | 1 | 0.01% | 0 | 0.00% | 0 | 0.00% | 1 |
| 3482 | KIAA1790 protein, partial cds /cds=UNKNOWN / | Hs.57760 | 0 | 0.00% | 0 | 0.00% | 0 | 0.00% | 1 | 0.01% | 1 |
| 3483 | KIAA1863 protein (KIAA1863) | XM_036104.2 | 1 | 0.01% | 0 | 0.00% | 0 | 0.00% | 0 | 0.00% | 1 |
| 3484 | KIAA1870 protein (KIAA1870) | XM_027025.2 | 1 | 0.01% | 0 | 0.00% | 0 | 0.00% | 0 | 0.00% | 1 |
| 3485 | kiaa-iso protein | AAF17242.1 | 0 | 0.00% | 0 | 0.00% | 0 | 0.00% | 1 | 0.01% | 1 |
| 3486 | KIP gene | AB021866.1 | 1 | 0.01% | 0 | 0.00% | 0 | 0.00% | 0 | 0.00% | 1 |
| 3487 | KNP-Ia (=U53007 GT335) | D86061 | 1 | 0.01% | 0 | 0.00% | 0 | 0.00% | 0 | 0.00% | 1 |
| 3488 | Ksp37 protein (KSP37), mRNA | NM_031950.1 | 1 | 0.01% | 0 | 0.00% | 0 | 0.00% | 0 | 0.00% | 1 |
| 3489 | Ku70-binding protein (low match) | AF078528 | 0 | 0.00% | 0 | 0.00% | 1 | 0.01% | 0 | 0.00% | 1 |
| 3490 | Kunitz-type protease inhibitor (kop) | AF027205 | 0 | 0.00% | 0 | 0.00% | 1 | 0.01% | 0 | 0.00% | 1 |
| 3491 | L1 repeat, Tf subfamily, member 18 | NP_038602.1 | 0 | 0.00% | 1 | 0.01% | 0 | 0.00% | 0 | 0.00% | 1 |
| 3492 | L1 repeat, Tf subfamily, member 26 | NP_038604.1 | 0 | 0.00% | 1 | 0.01% | 0 | 0.00% | 0 | 0.00% | 1 |
| 3493 | latexin protein (LXN), mRNA /cds=(151,819) /gb | Hs.109276 | 0 | 0.00% | 0 | 0.00% | 0 | 0.00% | 1 | 0.01% | 1 |
| 3494 | LCN1b gene | Y10826 | 0 | 0.00% | 0 | 0.00% | 0 | 0.00% | 1 | 0.01% | 1 |
| 3495 | LDC4 (=HSPC243) | AF247661.1 | 0 | 0.00% | 1 | 0.01% | 0 | 0.00% | 0 | 0.00% | 1 |
| 3496 | Leman coiled-coil protein (LCCP) (=AB023206.1 | NM_016201.1 | 0 | 0.00% | 0 | 0.00% | 1 | 0.01% | 0 | 0.00% | 1 |
| 3497 | LEYDIG CELL TUMOR 10 KD PROTEIN | spQ05310 | 1 | 0.01% | 0 | 0.00% | 0 | 0.00% | 0 | 0.00% | 1 |
| 3498 | ligase IV, DNA, ATP-dependent (LIG4) | NM_002312.1 | 0 | 0.00% | 0 | 0.00% | 0 | 0.00% | 1 | 0.01% | 1 |
| 3499 | LIMULUS CLOTTING FACTOR C PRECURSOF | P28175 | 0 | 0.00% | 0 | 0.00% | 1 | 0.01% | 0 | 0.00% | 1 |
| 3500 | lin-7-A | AF090133 | 1 | 0.01% | 0 | 0.00% | 0 | 0.00% | 0 | 0.00% | 1 |
| 3501 | line-1 protein ORF1 - =M19503) ORF1; putative | A28096 | 0 | 0.00% | 1 | 0.01% | 0 | 0.00% | 0 | 0.00% | 1 |
| 3502 | loss of heterozygosity, 11, chromosomal region | NM_014622.1 | 0 | 0.00% | 1 | 0.01% | 0 | 0.00% | 0 | 0.00% | 1 |
| 3503 | lost in inflammatory breast cancer tumor suppres | AF143679.1 | 0 | 0.00% | 0 | 0.00% | 1 | 0.01% | 0 | 0.00% | 1 |
| 3504 | LPS-induced TNF-alpha factor (PIG7) mRNA | NM_004862.1 | 0 | 0.00% | 0 | 0.00% | 0 | 0.00% | 1 | 0.01% | 1 |
| 3505 | m6A methyltransferase (MT-A70) gene | AF014837.1 | 1 | 0.01% | 0 | 0.00% | 0 | 0.00% | 0 | 0.00% | 1 |
| 3506 | m6b1 | AF016004.1 | 0 | 0.00% | 1 | 0.01% | 0 | 0.00% | 0 | 0.00% | 1 |
| 3507 | maCRophage inflammatory protein-2alpha (MIP | X53799 | 0 | 0.00% | 0 | 0.00% | 0 | 0.00% | 1 | 0.01% | 1 |
| 3508 | macrophage myristoylated alanine-rich C kinase | XM_034535.1 | 1 | 0.01% | 0 | 0.00% | 0 | 0.00% | 0 | 0.00% | 1 |
| 3509 | match to AA908753 (NID:g3048158) | AAC83082.1 | 0 | 0.00% | 0 | 0.00% | 0 | 0.00% | 1 | 0.01% | 1 |
| 3510 | Mcl-1 (MCL-1) and Mcl-1 delta S/TM (MCL-1) ge | AF198614.1 | 0 | 0.00% | 0 | 0.00% | 0 | 0.00% | 1 | 0.01% | 1 |
| 3511 | MDS024(MDS024) | AF182423.1 | 0 | 0.00% | 1 | 0.01% | 0 | 0.00% | 0 | 0.00% | 1 |
| 3512 | MEGF2 | AB011536 | 0 | 0.00% | 0 | 0.00% | 0 | 0.00% | 1 | 0.01% | 1 |
| 3513 | MEGF5 | AB011538.1 | 0 | 0.00% | 0 | 0.00% | 0 | 0.00% | 1 | 0.01% | 1 |
| 3514 | MEGF6 | AB011539 | 1 | 0.01% | 0 | 0.00% | 0 | 0.00% | 0 | 0.00% | 1 |
| 3515 | melanogaster TEP2 protein [Drosophila melano | AJ269539 | 0 | 0.00% | 0 | 0.00% | 0 | 0.00% | 1 | 0.01% | 1 |
| 3516 | Melanoma associated gene (D2S448) | XM_056455.1 | 1 | 0.01% | 0 | 0.00% | 0 | 0.00% | 0 | 0.00% | 1 |
| 3517 | melanoma-associated antigen p97 (melanotrans | K03200 | 0 | 0.00% | 0 | 0.00% | 0 | 0.00% | 1 | 0.01% | 1 |
| 3518 | melastatin 1 (70% aa) | AF071787 | 0 | 0.00% | 0 | 0.00% | 1 | 0.01% | 0 | 0.00% | 1 |
| 3519 | membrane protein type II, (low match) clone:HP | AB015633 | 0 | 0.00% | 0 | 0.00% | 1 | 0.01% | 0 | 0.00% | 1 |
| 3520 | meningioma expressed antigen 6(coiled-coil pro | NP_005921.1 | 0 | 0.00% | 1 | 0.01% | 0 | 0.00% | 0 | 0.00% | 1 |
| 3521 | meningioma-expressed antigen 11 (MEA11) | U73682 | 0 | 0.00% | 0 | 0.00% | 0 | 0.00% | 1 | 0.01% | 1 |
| 3522 | meningioma-expressed antigen 6 (MEA6) | U94780 | 0 | 0.00% | 0 | 0.00% | 0 | 0.00% | 1 | 0.01% | 1 |
| 3523 | merosin | M59832 | 0 | 0.00% | 0 | 0.00% | 1 | 0.01% | 0 | 0.00% | 1 |
| 3524 | mesenchymal stem cell protein DSC54 (LOC51 | M_016644.1 | 1 | 0.01% | 0 | 0.00% | 0 | 0.00% | 0 | 0.00% | 1 |
| 3525 | metastasis associated 1 (MTA1) | NM_004689.1 | 0 | 0.00% | 1 | 0.01% | 0 | 0.00% | 0 | 0.00% | 1 |
| 3526 | miCRosatellite sequence INRA095 | X71569 | 1 | 0.01% | 0 | 0.00% | 0 | 0.00% | 0 | 0.00% | 1 |
| 3527 | miCRosatellite VNTR DNA | L07935 | 0 | 0.00% | 0 | 0.00% | 1 | 0.01% | 0 | 0.00% | 1 |
| 3528 | MLN51 | X80199 | 1 | 0.01% | 0 | 0.00% | 0 | 0.00% | 0 | 0.00% | 1 |
| 3529 | MLN62 | X80200 | 1 | 0.01% | 0 | 0.00% | 0 | 0.00% | 0 | 0.00% | 1 |
| 3530 | Mm-1 cell derived transplantability-associated 1 | NM_021105.1 | 0 | 0.00% | 0 | 0.00% | 0 | 0.00% | 1 | 0.01% | 1 |
| 3531 | MpV17 transgene, murine homolog, glomerulos | NM_002437.1 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 63 of 102

| | | | | | | | | | | | |
|---|---|---|---|---|---|---|---|---|---|---|---|
| 3532 | mRNA similar to rat myomegalin | AB042557.1 | 1 | 0.01% | 0 | 0.00% | 0 | 0.00% | 0 | 0.00% | 1 |
| 3533 | MSTP031 | AAG39282.1 | 0 | 0.00% | 1 | 0.01% | 0 | 0.00% | 0 | 0.00% | 1 |
| 3534 | MSTP033 protein (MSTP033) | XM_029351.1 | 1 | 0.01% | 0 | 0.00% | 0 | 0.00% | 0 | 0.00% | 1 |
| 3535 | MUF1 protein (MUF1) | NM_006369.1 | 0 | 0.00% | 0 | 0.00% | 0 | 0.00% | 1 | 0.01% | 1 |
| 3536 | mutS (E. coli) homolog 3 (RefSeq aa 1e-66) | NP_002430.1 | 0 | 0.00% | 1 | 0.01% | 0 | 0.00% | 0 | 0.00% | 1 |
| 3537 | myelodysplasia/myeloid leukemia factor 1 (Mlf1) | AF100171 | 0 | 0.00% | 0 | 0.00% | 0 | 0.00% | 1 | 0.01% | 1 |
| 3538 | NDUFV3 gene for mitochondrial NADH-Ubiquinc | AB038163.1 | 1 | 0.01% | 0 | 0.00% | 0 | 0.00% | 0 | 0.00% | 1 |
| 3539 | neural polypyrimidine tract binding protein (PTB) | AF176085.1 | 1 | 0.01% | 0 | 0.00% | 0 | 0.00% | 0 | 0.00% | 1 |
| 3540 | neuritin (LOC51299), mRNA /cds=(168,596) /gb | Hs.103291 | 0 | 0.00% | 0 | 0.00% | 0 | 0.00% | 1 | 0.01% | 1 |
| 3541 | NF2 gene | Y18000.1 | 1 | 0.01% | 0 | 0.00% | 0 | 0.00% | 0 | 0.00% | 1 |
| 3542 | NG,NG-dimethylarginine dimethylaminohydrolas | AB001915 | 0 | 0.00% | 0 | 0.00% | 0 | 0.00% | 1 | 0.01% | 1 |
| 3543 | NIBAN | AB050477.1 | 0 | 0.00% | 1 | 0.01% | 0 | 0.00% | 0 | 0.00% | 1 |
| 3544 | NICE-3 protein (clone 3038j13) | AJ243665.1 | 0 | 0.00% | 0 | 0.00% | 1 | 0.01% | 0 | 0.00% | 1 |
| 3545 | nitrilase 1 (NIT1) | NM_005600.1 | 0 | 0.00% | 1 | 0.01% | 0 | 0.00% | 0 | 0.00% | 1 |
| 3546 | NJAC protein (NJAC) | AF144103.1 | 0 | 0.00% | 1 | 0.01% | 0 | 0.00% | 0 | 0.00% | 1 |
| 3547 | nm23-H7 (NME7) | AF153191.1 | 1 | 0.01% | 0 | 0.00% | 0 | 0.00% | 0 | 0.00% | 1 |
| 3548 | Nmi | U32849.1 | 0 | 0.00% | 0 | 0.00% | 0 | 0.00% | 1 | 0.01% | 1 |
| 3549 | N-myc and STAT interactor (RefSeq aa 4e-56) | NM_016508.1 | 0 | 0.00% | 1 | 0.01% | 0 | 0.00% | 0 | 0.00% | 1 |
| 3550 | NORI-1 (ORF) | AB010427 | 1 | 0.01% | 0 | 0.00% | 0 | 0.00% | 0 | 0.00% | 1 |
| 3551 | novel protein (HSNOV1) | XM_017365.2 | 1 | 0.01% | 1 | 0.01% | 0 | 0.00% | 0 | 0.00% | 1 |
| 3552 | NPD001 | AF078853.1 | 0 | 0.00% | 0 | 0.00% | 1 | 0.01% | 0 | 0.00% | 1 |
| 3553 | N-ras | X02751 | 1 | 0.01% | 0 | 0.00% | 0 | 0.00% | 0 | 0.00% | 1 |
| 3554 | nuclear body associated kinase 2b (Nbak2) (=AE | AF170304.1 | 0 | 0.00% | 0 | 0.00% | 1 | 0.01% | 0 | 0.00% | 1 |
| 3555 | nucleobindin 2 (RefSeq aa 9e-90) | NP_005004.1 | 0 | 0.00% | 1 | 0.01% | 0 | 0.00% | 0 | 0.00% | 1 |
| 3556 | nucleolar protein (KKE/D repeat) (NOP56) =Y12 | NM_006392. | 0 | 0.00% | 0 | 0.00% | 0 | 0.00% | 1 | 0.01% | 1 |
| 3557 | nucleolar protein ANKT(ANKT), mRNA | NM_016359.1 | 1 | 0.01% | 0 | 0.00% | 0 | 0.00% | 0 | 0.00% | 1 |
| 3558 | nucleolar protein family A, member 3 (H/ACA sm | Hs.14317 | 0 | 0.00% | 0 | 0.00% | 0 | 0.00% | 1 | 0.01% | 1 |
| 3559 | nucleotide-binding protein | U01833 | 0 | 0.00% | 0 | 0.00% | 0 | 0.00% | 1 | 0.01% | 1 |
| 3560 | NUMB | AF171941.1 | 0 | 0.00% | 0 | 0.00% | 0 | 0.00% | 1 | 0.01% | 1 |
| 3561 | NY-REN-49 antigen | AF155111.1 | 0 | 0.00% | 0 | 0.00% | 1 | 0.01% | 0 | 0.00% | 1 |
| 3562 | NY-REN-57 antigen | AF155114.1 | 1 | 0.01% | 0 | 0.00% | 0 | 0.00% | 0 | 0.00% | 1 |
| 3563 | NY-REN-6 antigen (ORF) | AF155096 | 0 | 0.00% | 0 | 0.00% | 0 | 0.00% | 1 | 0.01% | 1 |
| 3564 | OBPIIa gene | AJ251029.1 | 0 | 0.00% | 0 | 0.00% | 1 | 0.01% | 0 | 0.00% | 1 |
| 3565 | okadaic acid-inducible phosphoprotein (OA48-18 | AF069250 | 0 | 0.00% | 0 | 0.00% | 0 | 0.00% | 1 | 0.01% | 1 |
| 3566 | Opa-interacting protein OIP5 | AF025441 | 1 | 0.01% | 0 | 0.00% | 0 | 0.00% | 0 | 0.00% | 1 |
| 3567 | OPN-b (low match: aa 8e-06) | BAA05950.1 | 0 | 0.00% | 0 | 0.00% | 1 | 0.01% | 0 | 0.00% | 1 |
| 3568 | ORF1, encodes a 40 kDa product | AAB60344.1 | 0 | 0.00% | 1 | 0.01% | 0 | 0.00% | 0 | 0.00% | 1 |
| 3569 | ORF2 (aa 4e-15,65%) | BAA25253.1 | 0 | 0.00% | 1 | 0.01% | 0 | 0.00% | 0 | 0.00% | 1 |
| 3570 | ORF4 | CAA37647.1 | 0 | 0.00% | 0 | 0.00% | 0 | 0.00% | 1 | 0.01% | 1 |
| 3571 | ORFII (X52235)(= LIN1_HUMAN LINE-1 REVEF | CAA36480.1 | 0 | 0.00% | 1 | 0.01% | 0 | 0.00% | 0 | 0.00% | 1 |
| 3572 | ORFYGR054w | CAA97056.1 | 0 | 0.00% | 0 | 0.00% | 1 | 0.01% | 0 | 0.00% | 1 |
| 3573 | OTF3 gene | Z11900.1 | 1 | 0.01% | 0 | 0.00% | 0 | 0.00% | 0 | 0.00% | 1 |
| 3574 | p150 (67% a.a.) | AAC51279.1 | 1 | 0.01% | 0 | 0.00% | 0 | 0.00% | 0 | 0.00% | 1 |
| 3575 | P1-Cdc21 (=ALU8_HUMAN ALU SUBFAMILY S | X74794.1 | 0 | 0.00% | 1 | 0.01% | 0 | 0.00% | 0 | 0.00% | 1 |
| 3576 | P1cdc47 (=hMCM2) (=p85Mcm) | D55716.1 | 0 | 0.00% | 1 | 0.01% | 0 | 0.00% | 0 | 0.00% | 1 |
| 3577 | p21-activated protein kinase-like protein (non-ex | AAF82310.1 | 0 | 0.00% | 0 | 0.00% | 1 | 0.01% | 0 | 0.00% | 1 |
| 3578 | P3ECSL (LIECG3), mRNA | NM_022164.1 | 1 | 0.01% | 0 | 0.00% | 0 | 0.00% | 0 | 0.00% | 1 |
| 3579 | PA4=candidate oncogene | S82075 | 0 | 0.00% | 0 | 0.00% | 0 | 0.00% | 1 | 0.01% | 1 |
| 3580 | PAC 747L4 gene | AL035297.1 | 0 | 0.00% | 1 | 0.01% | 0 | 0.00% | 0 | 0.00% | 1 |
| 3581 | PAC P336P3 (12q24) | gi\|2961441 | 1 | 0.01% | 0 | 0.00% | 0 | 0.00% | 0 | 0.00% | 1 |
| 3582 | PAI-1 gene, PAI-1-HindIII-2 allele | AF110527.1 | 0 | 0.00% | 0 | 0.00% | 0 | 0.00% | 1 | 0.01% | 1 |
| 3583 | PAK2 mRNA, | AF092132 | 0 | 0.00% | 0 | 0.00% | 0 | 0.00% | 1 | 0.01% | 1 |
| 3584 | PAN2 protein (PAN2) | NM_020905.1 | 0 | 0.00% | 1 | 0.01% | 0 | 0.00% | 0 | 0.00% | 1 |
| 3585 | pancreas tumor-related protein (FKSG12) | AF311912.1 | 1 | 0.01% | 0 | 0.00% | 0 | 0.00% | 0 | 0.00% | 1 |
| 3586 | parathyroid hormone-like protein(PLP) gene, exc | M24349.1 | 0 | 0.00% | 0 | 0.00% | 1 | 0.01% | 0 | 0.00% | 1 |
| 3587 | partial AF-4 gene | AJ238093.1 | 0 | 0.00% | 1 | 0.01% | 0 | 0.00% | 0 | 0.00% | 1 |
| 3588 | partial LIMD1 gene for LIM domains | AJ312686.1 | 1 | 0.01% | 0 | 0.00% | 0 | 0.00% | 0 | 0.00% | 1 |

Figure 6 - Unique Known Genes Identified in Four cDNA Cartilage Libraries and EST Frequency Analysis - Page 64 of 102

| | | | | | | | | | | | |
|---|---|---|---|---|---|---|---|---|---|---|---|
| 3589 | partial unknown mRNA from drug-resistant mela | AJ270695.1 | 0 | 0.00% | 1 | 0.01% | 0 | 0.00% | 0 | 0.00% | 1 |
| 3590 | PCCX2 mRNA for protein containing CXXC dom | AB031230.1 | 0 | 0.00% | 1 | 0.01% | 0 | 0.00% | 0 | 0.00% | 1 |
| 3591 | PDCL2 | AAD30564.2 | 0 | 0.00% | 1 | 0.01% | 0 | 0.00% | 0 | 0.00% | 1 |
| 3592 | peanut-like protein 1, PNUTL1 (hCDCRel-1) (=A | Y11593 | 1 | 0.01% | 0 | 0.00% | 0 | 0.00% | 0 | 0.00% | 1 |
| 3593 | pendrin (PDS) | AF030880 | 1 | 0.01% | 0 | 0.00% | 0 | 0.00% | 0 | 0.00% | 1 |
| 3594 | PEP11 PROTEIN | spP38759 | 0 | 0.00% | 0 | 0.00% | 0 | 0.00% | 1 | 0.01% | 1 |
| 3595 | PEP19 (PCP4) (=X93349;U53709) | U52969 | 1 | 0.01% | 0 | 0.00% | 0 | 0.00% | 0 | 0.00% | 1 |
| 3596 | PER1 gene (=Rigui (RIGUI)) | AF102137.1 | 0 | 0.00% | 1 | 0.01% | 0 | 0.00% | 0 | 0.00% | 1 |
| 3597 | pescadillo (PES1) | U78310 | 1 | 0.01% | 0 | 0.00% | 0 | 0.00% | 0 | 0.00% | 1 |
| 3598 | Pig3 (PIG3) | AF010309 | 1 | 0.01% | 0 | 0.00% | 0 | 0.00% | 0 | 0.00% | 1 |
| 3599 | pituitary tumor-transforming 1 interacting protein | NM_004339.2 | 0 | 0.00% | 1 | 0.01% | 0 | 0.00% | 0 | 0.00% | 1 |
| 3600 | PiUS | U74297 | 1 | 0.01% | 0 | 0.00% | 0 | 0.00% | 0 | 0.00% | 1 |
| 3601 | plasma glutamate carboxypeptidase (PGCP) | NM_006102.1 | 0 | 0.00% | 1 | 0.01% | 0 | 0.00% | 0 | 0.00% | 1 |
| 3602 | platelet glycoprotein Iib precursor | AAA60115.1 | 0 | 0.00% | 1 | 0.01% | 0 | 0.00% | 0 | 0.00% | 1 |
| 3603 | PMF16 | AB006881 | 1 | 0.01% | 0 | 0.00% | 0 | 0.00% | 0 | 0.00% | 1 |
| 3604 | PMS1 PROTEIN HOMOLOG 1 (DNA MISMATC | spP54277 | 0 | 0.00% | 0 | 0.00% | 1 | 0.01% | 0 | 0.00% | 1 |
| 3605 | PM-Scl-75 autoantigen (PM-sc1) (=M58460) | U09215 | 0 | 0.00% | 0 | 0.00% | 0 | 0.00% | 1 | 0.01% | 1 |
| 3606 | polymorphic HindIII site DNA (THRB region) | X58041 | 0 | 0.00% | 0 | 0.00% | 1 | 0.01% | 0 | 0.00% | 1 |
| 3607 | polypyrimidine tract binding protein (heterogene | NM_002819.1 | 0 | 0.00% | 0 | 0.00% | 0 | 0.00% | 1 | 0.01% | 1 |
| 3608 | PP1201 mRNA, | AF193045.1 | 0 | 0.00% | 1 | 0.01% | 0 | 0.00% | 0 | 0.00% | 1 |
| 3609 | PP2703 | AF193051.1 | 0 | 0.00% | 1 | 0.01% | 0 | 0.00% | 0 | 0.00% | 1 |
| 3610 | PR-domain containing protein 10 (PRDM10) | NM_020228.1 | 0 | 0.00% | 1 | 0.01% | 0 | 0.00% | 0 | 0.00% | 1 |
| 3611 | PREGNANCY ZONE PROTEIN PRECURSOR ( | spP20742 | 0 | 0.00% | 0 | 0.00% | 0 | 0.00% | 1 | 0.01% | 1 |
| 3612 | PRKG1 gene | Z92885 | 0 | 0.00% | 0 | 0.00% | 1 | 0.01% | 0 | 0.00% | 1 |
| 3613 | PRO0066 | AF113007.1 | 0 | 0.00% | 1 | 0.01% | 0 | 0.00% | 0 | 0.00% | 1 |
| 3614 | PRO0214 protein (PRO0214) | NM_014120.1 | 0 | 0.00% | 1 | 0.01% | 0 | 0.00% | 0 | 0.00% | 1 |
| 3615 | PRO0245 protein (PRO0245) | NM_014122.1 | 0 | 0.00% | 0 | 0.00% | 1 | 0.01% | 0 | 0.00% | 1 |
| 3616 | PRO0412 mRNA (=KIAA0213 gene )(= mitogen- | AF116604.1 | 0 | 0.00% | 1 | 0.01% | 0 | 0.00% | 0 | 0.00% | 1 |
| 3617 | PRO0461 protein (PRO0461) | NM_014072.1 | 0 | 0.00% | 0 | 0.00% | 0 | 0.00% | 1 | 0.01% | 1 |
| 3618 | PRO0529 protein (PRO0529)= AF111848.1 | NM_014074.1 | 0 | 0.00% | 0 | 0.00% | 0 | 0.00% | 1 | 0.01% | 1 |
| 3619 | PRO0786 (=putative tumor suppressor ST13 (S | AF116650.1 | 0 | 0.00% | 1 | 0.01% | 0 | 0.00% | 0 | 0.00% | 1 |
| 3620 | PRO0989 (=CGI-54 protein) | AF116614.1 | 0 | 0.00% | 1 | 0.01% | 0 | 0.00% | 0 | 0.00% | 1 |
| 3621 | PRO1155 (=RBBP6) | AF116625.1 | 0 | 0.00% | 1 | 0.01% | 0 | 0.00% | 0 | 0.00% | 1 |
| 3622 | PRO1489 | AF116637.1 | 0 | 0.00% | 1 | 0.01% | 0 | 0.00% | 0 | 0.00% | 1 |
| 3623 | PRO1546 (aa 1e-14,58%) | NP_061055.1 | 0 | 0.00% | 1 | 0.01% | 0 | 0.00% | 0 | 0.00% | 1 |
| 3624 | PRO1722 | AAF69605.1 | 0 | 0.00% | 0 | 0.00% | 1 | 0.01% | 0 | 0.00% | 1 |
| 3625 | PRO1843 mRNA,(= initiation factor 4B) | AF119854.1 | 0 | 0.00% | 1 | 0.01% | 0 | 0.00% | 0 | 0.00% | 1 |
| 3626 | PRO1996 protein (PRO1996) | NM_014108.1 | 0 | 0.00% | 1 | 0.01% | 0 | 0.00% | 0 | 0.00% | 1 |
| 3627 | PRO2047 protein (PRO2047) (=PRO2003) | NM_014110.1 | 0 | 0.00% | 1 | 0.01% | 0 | 0.00% | 0 | 0.00% | 1 |
| 3628 | PRO2061 | AF118092.1 | 0 | 0.00% | 1 | 0.01% | 0 | 0.00% | 0 | 0.00% | 1 |
| 3629 | PRO2134 | AF118094.1 | 1 | 0.01% | 0 | 0.00% | 0 | 0.00% | 0 | 0.00% | 1 |
| 3630 | PRO2207 | AF116692.1 | 1 | 0.01% | 0 | 0.00% | 0 | 0.00% | 0 | 0.00% | 1 |
| 3631 | PRO2219 mRNA, complete cds /cds=(823,1056 | Hs.103657 | 0 | 0.00% | 0 | 0.00% | 0 | 0.00% | 1 | 0.01% | 1 |
| 3632 | PRO2222 | AF119868.1 | 0 | 0.00% | 1 | 0.01% | 0 | 0.00% | 0 | 0.00% | 1 |
| 3633 | PRO2239 | AF116696 | 0 | 0.00% | 0 | 0.00% | 0 | 0.00% | 1 | 0.01% | 1 |
| 3634 | PRO2309 | AF119875.1 | 0 | 0.00% | 1 | 0.01% | 0 | 0.00% | 0 | 0.00% | 1 |
| 3635 | PRO2646(=RPS4Y) | AF116711.1 | 1 | 0.01% | 0 | 0.00% | 0 | 0.00% | 0 | 0.00% | 1 |
| 3636 | selective LIM binding factor, rat homolog (SLB) | AAF69654.1 | 0 | 0.00% | 0 | 0.00% | 1 | 0.01% | 0 | 0.00% | 1 |
| 3637 | PRO2832 (PRO2832) | NM_018541.1 | 0 | 0.00% | 1 | 0.01% | 0 | 0.00% | 0 | 0.00% | 1 |
| 3638 | PRO2975 (PRO2975) | NM_018548.1 | 0 | 0.00% | 1 | 0.01% | 0 | 0.00% | 0 | 0.00% | 1 |
| 3639 | PRO3091 | AF119916.1 | 0 | 0.00% | 1 | 0.01% | 0 | 0.00% | 0 | 0.00% | 1 |
| 3640 | PRO3098 | AF119917.1 | 0 | 0.00% | 0 | 0.00% | 1 | 0.01% | 0 | 0.00% | 1 |
| 3641 | Pro-Pol-dUTPase polyprotein | Y12713 | 1 | 0.01% | 0 | 0.00% | 0 | 0.00% | 0 | 0.00% | 1 |
| 3642 | prostacyclin synthase | D83402 | 1 | 0.01% | 0 | 0.00% | 0 | 0.00% | 0 | 0.00% | 1 |
| 3643 | prostaglandin-D synthase (RefSeq aa 3e-36) | NP_055300.1 | 0 | 0.00% | 1 | 0.01% | 0 | 0.00% | 0 | 0.00% | 1 |
| 3644 | prostate carcinoma tumor antigen (pcta-1) (ORF | L78132.1 | 0 | 0.00% | 0 | 0.00% | 1 | 0.01% | 0 | 0.00% | 1 |
| 3645 | prostate specific and androgen regulated cDNA | AF163475 | 0 | 0.00% | 0 | 0.00% | 1 | 0.01% | 0 | 0.00% | 1 |

Figure 6 - Unique Known Genes Identified In Four cDNA Cartilage Libraries and EST Frequency Analysis - Page 65 of 102

| | | | | | | | | | | | |
|---|---|---|---|---|---|---|---|---|---|---|---|
| 3646 | prostatein c3 subunit | M71245 | 1 | 0.01% | 0 | 0.00% | 0 | 0.00% | 0 | 0.00% | 1 |
| 3647 | protein | L76155 | 1 | 0.01% | 0 | 0.00% | 0 | 0.00% | 0 | 0.00% | 1 |
| 3648 | protein (peptidyl-prolyl cis/trans isomerase) NIMA | NM_006223.1 | 0 | 0.00% | 0 | 0.00% | 0 | 0.00% | 1 | 0.01% | 1 |
| 3649 | protein B | AF146793.1 | 0 | 0.00% | 0 | 0.00% | 0 | 0.00% | 1 | 0.01% | 1 |
| 3650 | protein inhibitor of activated STAT-1(RefSeq aa | NP_057250.1 | 0 | 0.00% | 1 | 0.01% | 0 | 0.00% | 0 | 0.00% | 1 |
| 3651 | protein S-alpha (PROS1) (=Y00692) | M23599 | 0 | 0.00% | 0 | 0.00% | 1 | 0.01% | 0 | 0.00% | 1 |
| 3652 | PSD-Zip45 | AB017140 | 0 | 0.00% | 0 | 0.00% | 1 | 0.01% | 0 | 0.00% | 1 |
| 3653 | PTB domain adaptor protein CED-6 | AF200715.1 | 0 | 0.00% | 1 | 0.01% | 0 | 0.00% | 0 | 0.00% | 1 |
| 3654 | PTB-like protein | AJ010585.1 | 0 | 0.00% | 0 | 0.00% | 1 | 0.01% | 0 | 0.00% | 1 |
| 3655 | PTD002 protein (PTD002) (=HSPC305) | NM_016144.1 | 0 | 0.00% | 1 | 0.01% | 0 | 0.00% | 0 | 0.00% | 1 |
| 3656 | PTD012 | AF092133.1 | 0 | 0.00% | 0 | 0.00% | 1 | 0.01% | 0 | 0.00% | 1 |
| 3657 | PTD017 protein (PTD017) | NM_014046.1 | 0 | 0.00% | 1 | 0.01% | 0 | 0.00% | 0 | 0.00% | 1 |
| 3658 | PTH-responsive osteosarcoma B1 protein (B1) r | AF095771.1 | 0 | 0.00% | 1 | 0.01% | 0 | 0.00% | 0 | 0.00% | 1 |
| 3659 | PTPL1-associated RhoGAP | U90920 | 0 | 0.00% | 0 | 0.00% | 0 | 0.00% | 1 | 0.01% | 1 |
| 3660 | PTS gene for 6-pyruvoyltetrahydropterin synthas | AB042297.1 | 0 | 0.00% | 1 | 0.01% | 0 | 0.00% | 0 | 0.00% | 1 |
| 3661 | putative (H. sapiens) (LOC134301) | XM_059705.1 | 0 | 0.00% | 0 | 0.00% | 1 | 0.01% | 0 | 0.00% | 1 |
| 3662 | PUTATIVE C10 PROTEIN (LOC113246) L | XM_053988.2 | 1 | 0.01% | 0 | 0.00% | 0 | 0.00% | 0 | 0.00% | 1 |
| 3663 | Putative prostate cancer tumorsuppressor (RefS | NP_006756.1 | 0 | 0.00% | 1 | 0.01% | 0 | 0.00% | 0 | 0.00% | 1 |
| 3664 | putative tumor suppressor ST13 (ST13) (=PROC | U17714.1 | 0 | 0.00% | 1 | 0.01% | 0 | 0.00% | 0 | 0.00% | 1 |
| 3665 | QM [nontumorigenic Wilms' microcell hybrid cell | S64169.1 | 0 | 0.00% | 1 | 0.01% | 0 | 0.00% | 0 | 0.00% | 1 |
| 3666 | R3H domain (binds single-strandednucleic acids | NP_056970.1 | 0 | 0.00% | 1 | 0.01% | 0 | 0.00% | 0 | 0.00% | 1 |
| 3667 | RAB14, member RAS oncogene family (RAB14) | XM_005342.4 | 1 | 0.01% | 0 | 0.00% | 0 | 0.00% | 0 | 0.00% | 1 |
| 3668 | RAB6C, member RAS oncogene family (RAB6C | XM_038274.1 | 1 | 0.01% | 0 | 0.00% | 0 | 0.00% | 0 | 0.00% | 1 |
| 3669 | Rap2 interacting protein; similar to U73941 (PID | AAC82532.1 | 0 | 0.00% | 0 | 0.00% | 1 | 0.01% | 0 | 0.00% | 1 |
| 3670 | rat activator of G-protein signaling 3 (AGS3) (like | XM_054763.2 | 1 | 0.01% | 0 | 0.00% | 0 | 0.00% | 0 | 0.00% | 1 |
| 3671 | rat myomegalin | NP_071754.1 | 0 | 0.00% | 1 | 0.01% | 0 | 0.00% | 0 | 0.00% | 1 |
| 3672 | RB-binding protein (rbbp2h1a gene) | AJ243706.1 | 0 | 0.00% | 1 | 0.01% | 0 | 0.00% | 0 | 0.00% | 1 |
| 3673 | RC1-ST0278-160200-014-f03 ST0278 cDNA | AW818395.1 | 0 | 0.00% | 1 | 0.01% | 0 | 0.00% | 0 | 0.00% | 1 |
| 3674 | RC3-BT0319-240200-015-e12 BT0319 | BE066091.1 | 1 | 0.01% | 0 | 0.00% | 0 | 0.00% | 0 | 0.00% | 1 |
| 3675 | recepin (CBF1 interacting corepressor (CIR) | U03644.1 | 0 | 0.00% | 0 | 0.00% | 0 | 0.00% | 1 | 0.01% | 1 |
| 3676 | Rer1 protein | AJ001421 | 1 | 0.01% | 0 | 0.00% | 0 | 0.00% | 0 | 0.00% | 1 |
| 3677 | RES4-22 gene with multiple splice variants near | NM_003704.1 | 1 | 0.01% | 0 | 0.00% | 0 | 0.00% | 0 | 0.00% | 1 |
| 3678 | reticulon 4c (=reticulon 4b)(= reticulon 4a) | AF087901.1 | 0 | 0.00% | 1 | 0.01% | 0 | 0.00% | 0 | 0.00% | 1 |
| 3679 | retinal short-chain dehydrogenase/reductase ret | NM_016245.1 | 0 | 0.00% | 1 | 0.01% | 0 | 0.00% | 0 | 0.00% | 1 |
| 3680 | retina-specific 15.7 kDa protein | M34915 | 1 | 0.01% | 0 | 0.00% | 0 | 0.00% | 0 | 0.00% | 1 |
| 3681 | retinol-binding protein (RBP) | M10934 | 0 | 0.00% | 0 | 0.00% | 1 | 0.01% | 0 | 0.00% | 1 |
| 3682 | RETINOL-BINDING PROTEIN II, CELLULAR (C | P50121 | 0 | 0.00% | 0 | 0.00% | 1 | 0.01% | 0 | 0.00% | 1 |
| 3683 | REV3 (yeast homolog)-like, catalyticsubunit of D | NP_002903.1 | 0 | 0.00% | 1 | 0.01% | 0 | 0.00% | 0 | 0.00% | 1 |
| 3684 | RGP3 | U27655.1 | 1 | 0.01% | 0 | 0.00% | 0 | 0.00% | 0 | 0.00% | 1 |
| 3685 | RP42 homolog (RP42), mRNA /cds=(29,808) /gb | Hs.104613 | 0 | 0.00% | 0 | 0.00% | 0 | 0.00% | 1 | 0.01% | 1 |
| 3686 | rpmJ, prlA, rplO, rpmD, rpsE, rplR, rplF, rpsH, rp | AE000408 | 0 | 0.00% | 0 | 0.00% | 1 | 0.01% | 0 | 0.00% | 1 |
| 3687 | rrlC, rrfC, aspT, trpT, yifA, pssR, yifE, yifB, ilvL, i | AE000453 | 0 | 0.00% | 0 | 0.00% | 0 | 0.00% | 1 | 0.01% | 1 |
| 3688 | SCL gene locus | AJ131016.1 | 0 | 0.00% | 1 | 0.01% | 0 | 0.00% | 0 | 0.00% | 1 |
| 3689 | seladin-1 (=KIAA0018) | AF261758.1 | 0 | 0.00% | 1 | 0.01% | 0 | 0.00% | 0 | 0.00% | 1 |
| 3690 | selective LIM binding factor, rat homolog (SLB) | XM_033196.1 | 1 | 0.01% | 0 | 0.00% | 0 | 0.00% | 0 | 0.00% | 1 |
| 3691 | serologically defined colon cancer antigen 10 (N | NM_005869.1 | 1 | 0.01% | 0 | 0.00% | 0 | 0.00% | 0 | 0.00% | 1 |
| 3692 | SH3GLP1 pseudogene, 5' | X99658.1 | 1 | 0.01% | 0 | 0.00% | 0 | 0.00% | 0 | 0.00% | 1 |
| 3693 | Si-1-8-16 mRNA, partial cds | AB044752.1 | 1 | 0.01% | 0 | 0.00% | 0 | 0.00% | 0 | 0.00% | 1 |
| 3694 | SIK similar protein | AF053232 | 1 | 0.01% | 0 | 0.00% | 0 | 0.00% | 0 | 0.00% | 1 |
| 3695 | single-minded (Drosophila) homolog 2 (SIM2), tr | NM_005069.2 | 0 | 0.00% | 1 | 0.01% | 0 | 0.00% | 0 | 0.00% | 1 |
| 3696 | Sjogren's syndrome/scleroderma autoantigen 1 ( | NM_006396.1 | 1 | 0.01% | 0 | 0.00% | 0 | 0.00% | 0 | 0.00% | 1 |
| 3697 | Slit-2 protein | AB017168 | 1 | 0.01% | 0 | 0.00% | 0 | 0.00% | 0 | 0.00% | 1 |
| 3698 | Sm protein F (RefSeq aa 2e-41) | NP_009011.1 | 0 | 0.00% | 1 | 0.01% | 0 | 0.00% | 0 | 0.00% | 1 |
| 3699 | small cytoplasmic Y RNA (Y4) (=X57566 hy4 Ro | L32608 | 1 | 0.01% | 0 | 0.00% | 0 | 0.00% | 0 | 0.00% | 1 |
| 3700 | small EDRK-rich factor 1, short isoform (SERF1) | AF073518.1 | 0 | 0.00% | 1 | 0.01% | 0 | 0.00% | 0 | 0.00% | 1 |
| 3701 | small fragment nuclease (DKFZP566E144) | NM_015523.1 | 0 | 0.00% | 1 | 0.01% | 0 | 0.00% | 0 | 0.00% | 1 |
| 3702 | SMART/HDAC1 associated repressor protein (S | XM_057104.1 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 66 of 102

| | | | | | | | | | | | |
|---|---|---|---|---|---|---|---|---|---|---|---|
| 3703 | SOCS box-containing WD protein SWiP-1 (SWIF | AF072880.1 | 0 | 0.00% | 0 | 0.00% | 1 | 0.01% | 0 | 0.00% | 1 |
| 3704 | spastic ataxia of Charlevoix-Saguenay (sacsin) ( | NP_055178.1 | 0 | 0.00% | 1 | 0.01% | 0 | 0.00% | 0 | 0.00% | 1 |
| 3705 | speckle-type POZ protein (SPOP) | NM_003563.1 | 0 | 0.00% | 1 | 0.01% | 0 | 0.00% | 0 | 0.00% | 1 |
| 3706 | spm1 protein | Y15794.1 | 0 | 0.00% | 1 | 0.01% | 0 | 0.00% | 0 | 0.00% | 1 |
| 3707 | SRY (sex determining region Y)-box 13 (SOX13) | NM_005686.1 | 0 | 0.00% | 1 | 0.01% | 0 | 0.00% | 0 | 0.00% | 1 |
| 3708 | SRY (sex determining regionY)-box 22 (SOX22) | NM_006943.1 | 0 | 0.00% | 1 | 0.01% | 0 | 0.00% | 0 | 0.00% | 1 |
| 3709 | SRY-box containing gene 5 (Sox5) | NM_011444.1 | 0 | 0.00% | 0 | 0.00% | 1 | 0.01% | 0 | 0.00% | 1 |
| 3710 | SS-A/Ro ribonucleoprotein autoantigen 60 kd su | M25077 | 0 | 0.00% | 0 | 0.00% | 1 | 0.01% | 0 | 0.00% | 1 |
| 3711 | SSR alpha subunit | Z12830 | 0 | 0.00% | 0 | 0.00% | 0 | 0.00% | 1 | 0.01% | 1 |
| 3712 | SSX4 protein gene | AF196972.1 | 1 | 0.01% | 0 | 0.00% | 0 | 0.00% | 0 | 0.00% | 1 |
| 3713 | stat-like protein (Fe65) | L77864 | 1 | 0.01% | 0 | 0.00% | 0 | 0.00% | 0 | 0.00% | 1 |
| 3714 | STS(STS SHGC-35393) | G28601 | 1 | 0.01% | 0 | 0.00% | 0 | 0.00% | 0 | 0.00% | 1 |
| 3715 | sudD (suppressor of bimD6, Aspergillus nidulans | gi4507298 | 0 | 0.00% | 0 | 0.00% | 0 | 0.00% | 1 | 0.01% | 1 |
| 3716 | suppressor of cytokine signalling-1 (SOCS-1) (=/ | U88326 | 1 | 0.01% | 0 | 0.00% | 0 | 0.00% | 0 | 0.00% | 1 |
| 3717 | Syne-1B | AAG24393.1 | 0 | 0.00% | 1 | 0.01% | 0 | 0.00% | 0 | 0.00% | 1 |
| 3718 | synuclein, alpha (non A4 component of amyloid | NM_007308.1 | 0 | 0.00% | 0 | 0.00% | 1 | 0.01% | 0 | 0.00% | 1 |
| 3719 | Tandem PH Domain Containing Protein-1 (TAPF | NM_021622.1 | 0 | 0.00% | 1 | 0.01% | 0 | 0.00% | 0 | 0.00% | 1 |
| 3720 | Tax interaction protein 2 | AF028824.1 | 1 | 0.01% | 0 | 0.00% | 0 | 0.00% | 0 | 0.00% | 1 |
| 3721 | TB1 | M74089.1 | 0 | 0.00% | 0 | 0.00% | 1 | 0.01% | 0 | 0.00% | 1 |
| 3722 | TCP1 (t-complex-1) ring complex, polypeptide 5 | NM_005998.1 | 0 | 0.00% | 0 | 0.00% | 1 | 0.01% | 0 | 0.00% | 1 |
| 3723 | tctex-1 | E13405 | 0 | 0.00% | 0 | 0.00% | 0 | 0.00% | 1 | 0.01% | 1 |
| 3724 | TESS 2 protein (TESS 2 gene) (=DKFZp586B20 | AJ250865.1 | 0 | 0.00% | 0 | 0.00% | 0 | 0.00% | 1 | 0.01% | 1 |
| 3725 | testis specific ankyrin-like protein 1 (LOC51281) | NM_016552.1 | 0 | 0.00% | 1 | 0.01% | 0 | 0.00% | 0 | 0.00% | 1 |
| 3726 | tex292 | X80433 | 1 | 0.01% | 0 | 0.00% | 0 | 0.00% | 0 | 0.00% | 1 |
| 3727 | TFII-I protein(TFII-I) mRNA, (=general transcripti | AF015553.1 | 1 | 0.01% | 0 | 0.00% | 0 | 0.00% | 0 | 0.00% | 1 |
| 3728 | tip associating protein (TAP) | U80073 | 1 | 0.01% | 0 | 0.00% | 0 | 0.00% | 0 | 0.00% | 1 |
| 3729 | TPA regulated locus; uncharacterized hypothala | XM_054971.2 | 0 | 0.00% | 0 | 0.00% | 0 | 0.00% | 1 | 0.01% | 1 |
| 3730 | TPRD | D83077 | 0 | 0.00% | 0 | 0.00% | 1 | 0.01% | 0 | 0.00% | 1 |
| 3731 | transitional epithelia response protein (TERE1) | NM_013319.1 | 1 | 0.01% | 0 | 0.00% | 0 | 0.00% | 0 | 0.00% | 1 |
| 3732 | translocating chain-associating membrane prote | XM_005185.3 | 1 | 0.01% | 0 | 0.00% | 0 | 0.00% | 0 | 0.00% | 1 |
| 3733 | Treacher Collins-Franceschetti syndrome 1 (TC( | NM_000356.1 | 1 | 0.01% | 0 | 0.00% | 0 | 0.00% | 0 | 0.00% | 1 |
| 3734 | TSA305 | AB024763.1 | 0 | 0.00% | 1 | 0.01% | 0 | 0.00% | 0 | 0.00% | 1 |
| 3735 | TSC2 mRNA for tuberin | X75621 | 0 | 0.00% | 0 | 0.00% | 0 | 0.00% | 1 | 0.01% | 1 |
| 3736 | TYL gene | X99688 | 1 | 0.01% | 0 | 0.00% | 0 | 0.00% | 0 | 0.00% | 1 |
| 3737 | unknown mRNA /cds=(1758,2294) /gb=AF32161 | Hs.33032 | 0 | 0.00% | 0 | 0.00% | 0 | 0.00% | 1 | 0.01% | 1 |
| 3738 | unknown protein 3'UTR | Y09836.1 | 0 | 0.00% | 1 | 0.01% | 0 | 0.00% | 0 | 0.00% | 1 |
| 3739 | unknown protein LOC51035 (H. sapiens) (LOC1 | XM_058485.1 | 1 | 0.01% | 0 | 0.00% | 0 | 0.00% | 0 | 0.00% | 1 |
| 3740 | unnamed protein product | AK001715 | 0 | 0.00% | 0 | 0.00% | 1 | 0.01% | 0 | 0.00% | 1 |
| 3741 | unnamed protein product | BAA91748.1 | 0 | 0.00% | 1 | 0.01% | 0 | 0.00% | 0 | 0.00% | 1 |
| 3742 | unnamed protein product | BAA91974.1 | 0 | 0.00% | 1 | 0.01% | 0 | 0.00% | 0 | 0.00% | 1 |
| 3743 | unnamed protein product | BAB14098.1 | 0 | 0.00% | 1 | 0.01% | 0 | 0.00% | 0 | 0.00% | 1 |
| 3744 | unnamed protein product | BAB14662.1 | 0 | 0.00% | 1 | 0.01% | 0 | 0.00% | 0 | 0.00% | 1 |
| 3745 | unnamed protein product | BAB14687.1 | 0 | 0.00% | 1 | 0.01% | 0 | 0.00% | 0 | 0.00% | 1 |
| 3746 | unnamed protein product | BAB14809.1 | 0 | 0.00% | 1 | 0.01% | 0 | 0.00% | 0 | 0.00% | 1 |
| 3747 | unnamed protein product | BAB15239.1 | 0 | 0.00% | 1 | 0.01% | 0 | 0.00% | 0 | 0.00% | 1 |
| 3748 | unnamed protein product | BAB15362.1 | 0 | 0.00% | 1 | 0.01% | 0 | 0.00% | 0 | 0.00% | 1 |
| 3749 | unnamed protein product | BAB15407.1 | 0 | 0.00% | 1 | 0.01% | 0 | 0.00% | 0 | 0.00% | 1 |
| 3750 | unnamed protein product | BAB15427.1 | 0 | 0.00% | 1 | 0.01% | 0 | 0.00% | 0 | 0.00% | 1 |
| 3751 | unnamed protein product | BAB15579.1 | 0 | 0.00% | 1 | 0.01% | 0 | 0.00% | 0 | 0.00% | 1 |
| 3752 | unnamed protein product (=HSPC314) | BAB14755.1 | 0 | 0.00% | 1 | 0.01% | 0 | 0.00% | 0 | 0.00% | 1 |
| 3753 | unnamed protein product (aa 1e-15) | BAB15433.1 | 0 | 0.00% | 1 | 0.01% | 0 | 0.00% | 0 | 0.00% | 1 |
| 3754 | UPF3 (UPF3) | AF318575.1 | 1 | 0.01% | 0 | 0.00% | 0 | 0.00% | 0 | 0.00% | 1 |
| 3755 | up-regulated by BCG-CWS (=KIAA0062,=KIAA1 | NP_071437.1 | 0 | 0.00% | 1 | 0.01% | 0 | 0.00% | 0 | 0.00% | 1 |
| 3756 | vault-associated RNA 1, complete sequence | AF045143.1 | 0 | 0.00% | 1 | 0.01% | 0 | 0.00% | 0 | 0.00% | 1 |
| 3757 | vav 3 oncogene (VAV3) | NM_006113.2 | 0 | 0.00% | 1 | 0.01% | 0 | 0.00% | 0 | 0.00% | 1 |
| 3758 | v-maf musculoaponeurotic fibrosarcoma(avian) ( | NP_005351.2 | 0 | 0.00% | 1 | 0.01% | 0 | 0.00% | 0 | 0.00% | 1 |
| 3759 | v-raf-1 murine leukemia viral oncogene homolog | NM_002880.1 | 0 | 0.00% | 0 | 0.00% | 0 | 0.00% | 1 | 0.01% | 1 |

Figure 6 - Unique Known Genes Identified In Four cDNA Cartilage Libraries and EST Frequency Analysis - Page 67 of 102

| | | | | | | | | | | | |
|---|---|---|---|---|---|---|---|---|---|---|---|
| 3760 | WAS protein family, member 1 (WASF1) (=KIAA | NM_003931.1 | 0 | 0.00% | 0 | 0.00% | 1 | 0.01% | 0 | 0.00% | 1 |
| 3761 | WD-repeat protein (HAN11) | NM_005828.1 | 0 | 0.00% | 1 | 0.01% | 0 | 0.00% | 0 | 0.00% | 1 |
| 3762 | Williams-Beuren syndrome chromosome region | XM_051839.2 | 1 | 0.01% | 0 | 0.00% | 0 | 0.00% | 0 | 0.00% | 1 |
| 3763 | Wilms' tumour 1-associating protein (KIAA0105) | Hs.119 | 0 | 0.00% | 0 | 0.00% | 0 | 0.00% | 1 | 0.01% | 1 |
| 3764 | Wiskott-Aldrich syndrome protein interacting pro | Hs.24143 | 0 | 0.00% | 0 | 0.00% | 0 | 0.00% | 1 | 0.01% | 1 |
| 3765 | XE7 | L03426 | 1 | 0.01% | 0 | 0.00% | 0 | 0.00% | 0 | 0.00% | 1 |
| 3766 | Xp22 bins 16-17 BAC GSHB-531I17 (Genome S | AC004805.1 | 0 | 0.00% | 1 | 0.01% | 0 | 0.00% | 0 | 0.00% | 1 |
| 3767 | Xq pseudoautosomal region; segment 1/2 | AJ271735.1 | 1 | 0.01% | 0 | 0.00% | 0 | 0.00% | 0 | 0.00% | 1 |
| 3768 | xs31 | Z36832 | 0 | 0.00% | 0 | 0.00% | 0 | 0.00% | 1 | 0.01% | 1 |
| 3769 | yeast Sec31p homolog (RefSeq aa 5e-76) | NP_057295.1 | 0 | 0.00% | 2 | 0.01% | 0 | 0.00% | 0 | 0.00% | 1 |
| 3770 | YGR163, yeast homologue | AB017616 | 0 | 0.00% | 0 | 0.00% | 0 | 0.00% | 1 | 0.01% | 1 |
| 3771 | adrenodoxin gene, exon 4 | M23668.1 | 0 | 0.00% | 1 | 0.01% | 0 | 0.00% | 0 | 0.00% | 1 |
| 3772 | annexin V-binding protein (ABP-10),(ORF) | D64062 | 0 | 0.00% | 1 | 0.01% | 0 | 0.00% | 0 | 0.00% | 1 |
| 3773 | ATPase subunit 6 | BAA07295.1 | 0 | 0.00% | 0 | 0.00% | 1 | 0.01% | 0 | 0.00% | 1 |
| 3774 | ATPase, Ca sequestering (ATP2C1) (=KIAA134 | NM_014382.1 | 0 | 0.00% | 0 | 0.00% | 0 | 0.00% | 1 | 0.01% | 1 |
| 3775 | ATPase, Class I, type 8B member 2 (ATP8B2) | XM_036933.2 | 1 | 0.01% | 0 | 0.00% | 0 | 0.00% | 0 | 0.00% | 1 |
| 3776 | ATPase, H transporting, lysosomal (vacuolar pr | NM_004047.1 | 1 | 0.01% | 0 | 0.00% | 0 | 0.00% | 0 | 0.00% | 1 |
| 3777 | ATPase, H transporting, lysosomal (vacuolar pr | NM_005177.1 | 0 | 0.00% | 0 | 0.00% | 0 | 0.00% | 1 | 0.01% | 1 |
| 3778 | ATPase, H transporting, lysosomal (vacuolar pr | NM_001693.1 | 0 | 0.00% | 1 | 0.01% | 0 | 0.00% | 0 | 0.00% | 1 |
| 3779 | ATPase, H transporting, lysosomal (vacuolar pr | NM_004888.1 | 0 | 0.00% | 1 | 0.01% | 0 | 0.00% | 0 | 0.00% | 1 |
| 3780 | ATPase, Na /K transporting, alpha 2 ( ) polypep | NM_000702.1 | 1 | 0.01% | 0 | 0.00% | 0 | 0.00% | 0 | 0.00% | 1 |
| 3781 | ATPase, Na /K transporting, beta 1polypeptide ( | NP_001668.1 | 0 | 0.00% | 1 | 0.01% | 0 | 0.00% | 0 | 0.00% | 1 |
| 3782 | ATP-binding cassette 7 iron transporter (ABC7) | AF133659.1 | 1 | 0.01% | 0 | 0.00% | 0 | 0.00% | 0 | 0.00% | 1 |
| 3783 | Ca2 -transporting ATPase, (ORF) | AJ010953 | 0 | 0.00% | 0 | 0.00% | 1 | 0.01% | 0 | 0.00% | 1 |
| 3784 | calsequestrin, cardiac | D55655 | 1 | 0.01% | 0 | 0.00% | 0 | 0.00% | 0 | 0.00% | 1 |
| 3785 | copper chaperone for superoxide dismutase (CC | AF002210 | 1 | 0.01% | 0 | 0.00% | 0 | 0.00% | 0 | 0.00% | 1 |
| 3786 | F1-ATPase beta subunit (F-1 beta) (=X05606;M | X03559 | 1 | 0.01% | 0 | 0.00% | 0 | 0.00% | 0 | 0.00% | 1 |
| 3787 | F1-F0-ATPase | M64751 | 1 | 0.01% | 0 | 0.00% | 0 | 0.00% | 0 | 0.00% | 1 |
| 3788 | F1Fo-ATP synthase complex Fo membrane dom | S70447 | 1 | 0.01% | 0 | 0.00% | 0 | 0.00% | 0 | 0.00% | 1 |
| 3789 | monocarboxylate transporter 1 (SLC16A1) | L31801 | 0 | 0.00% | 0 | 0.00% | 1 | 0.01% | 0 | 0.00% | 1 |
| 3790 | non-erythroid band 3-like protein (HKB3) (=U265 | X03918 | 1 | 0.01% | 0 | 0.00% | 0 | 0.00% | 0 | 0.00% | 1 |
| 3791 | nonerythroid beta-spectrin | L02897 | 0 | 0.00% | 0 | 0.00% | 1 | 0.01% | 0 | 0.00% | 1 |
| 3792 | NRAMP2 gene for natural resistance-associated | AB015355.1 | 1 | 0.01% | 0 | 0.00% | 0 | 0.00% | 0 | 0.00% | 1 |
| 3793 | S100 calcium-binding protein A11 (calgizzarin) ( | NM_005620.1 | 0 | 0.00% | 1 | 0.01% | 0 | 0.00% | 0 | 0.00% | 1 |
| 3794 | S100 calcium-binding protein A6 (calcyclin) (S10 | XM_058243.1 | 1 | 0.01% | 0 | 0.00% | 0 | 0.00% | 0 | 0.00% | 1 |
| 3795 | sodium bicarbonate cotransporter 2b (NBC2B)(= | AF089726.1 | 0 | 0.00% | 1 | 0.01% | 0 | 0.00% | 0 | 0.00% | 1 |
| 3796 | sodium bicarbonate cotransporter 3 (SLC4A7) | AF047033.1 | 0 | 0.00% | 0 | 0.00% | 0 | 0.00% | 1 | 0.01% | 1 |
| 3797 | solute carrier family 26 | NM_000112.1 | 0 | 0.00% | 1 | 0.01% | 0 | 0.00% | 0 | 0.00% | 1 |
| 3798 | solute carrier family 5(sodium-dependent vitamir | NM_021095.1 | 0 | 0.00% | 1 | 0.01% | 0 | 0.00% | 0 | 0.00% | 1 |
| 3799 | solute carrier family 7 (cationic amino acid trans | gi4507052 | 0 | 0.00% | 0 | 0.00% | 1 | 0.01% | 0 | 0.00% | 1 |
| 3800 | vacuolar H ( )-ATPase subunit=13.7 kda F-ATPa | S82464.1 | 0 | 0.00% | 0 | 0.00% | 0 | 0.00% | 1 | 0.01% | 1 |
| 3801 | vacuolar H -ATPase Mr 56,000 subunit (HO57) | L35249.1 | 0 | 0.00% | 1 | 0.01% | 0 | 0.00% | 0 | 0.00% | 1 |
| 3802 | vacuolar H ATPase Mr 70000 subunit | X61612 | 0 | 0.00% | 0 | 0.00% | 1 | 0.01% | 0 | 0.00% | 1 |
| 3803 | vacuolar proton ATPase membrane sector asso | Y17975 | 1 | 0.01% | 0 | 0.00% | 0 | 0.00% | 0 | 0.00% | 1 |
| 3804 | vacuolar sorting protein 35 | AF191298 | 0 | 0.00% | 0 | 0.00% | 0 | 0.00% | 1 | 0.01% | 1 |
| 3805 | white gene protein (=AF038175) | X91249 | 1 | 0.01% | 0 | 0.00% | 0 | 0.00% | 0 | 0.00% | 1 |
| 3806 | Glycosyl transferase, similar to (=AF031835 ppG | AL033514 | 1 | 0.01% | 0 | 0.00% | 0 | 0.00% | 0 | 0.00% | 1 |
| 3807 | 1,4-alpha-glucan branching enzyme (HGBE) | L07956 | 0 | 0.00% | 0 | 0.00% | 0 | 0.00% | 1 | 0.01% | 1 |
| 3808 | 3-phosphoinositide dependent protein kinase-1 ( | NM_002613.1 | 1 | 0.01% | 0 | 0.00% | 0 | 0.00% | 0 | 0.00% | 1 |
| 3809 | aldehyde dehydrogenase 1 | K03000.1 | 0 | 0.00% | 1 | 0.01% | 0 | 0.00% | 0 | 0.00% | 1 |
| 3810 | aldo-keto reductase family 7, member A2 (aflato | AF026947 | 1 | 0.01% | 0 | 0.00% | 0 | 0.00% | 0 | 0.00% | 1 |
| 3811 | aldose reductase (EC 1.1.1.2) | X15414 | 0 | 0.00% | 0 | 0.00% | 0 | 0.00% | 1 | 0.01% | 1 |
| 3812 | alpha-1,3(6)-mannosyl glycoprotein beta-1 (RefS | NP_002401.1 | 0 | 0.00% | 1 | 0.01% | 0 | 0.00% | 0 | 0.00% | 1 |
| 3813 | alpha-aminoadipic semialdehyde dehydrogenas | AF302110.1 | 0 | 0.00% | 1 | 0.01% | 0 | 0.00% | 0 | 0.00% | 1 |
| 3814 | Alu co-repressor 1 (ACR1)(=AOEB166) | AF231705.1 | 1 | 0.01% | 0 | 0.00% | 0 | 0.00% | 0 | 0.00% | 1 |
| 3815 | amylo-1,6-glucosidase,4-alpha-glucanotransfera | NM_000646.1 | 1 | 0.01% | 0 | 0.00% | 0 | 0.00% | 0 | 0.00% | 1 |
| 3816 | beta-1,3-glucuronyltransferase 3 (glucuronosyltr | NM_012200.1 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 68 of 102

| | | | | | | | | | | | |
|---|---|---|---|---|---|---|---|---|---|---|---|
| 3817 | beta-1,3-N-acetyl glucosaminyl transferase (BET | NM_006876.1 | 0 | 0.00% | 1 | 0.01% | 0 | 0.00% | 0 | 0.00% | 1 |
| 3818 | beta-globin (HBB) gene haplotype C17, replicati | AF186616.1 | 0 | 0.00% | 1 | 0.01% | 0 | 0.00% | 0 | 0.00% | 1 |
| 3819 | carbohydrate (keratan sulfate Gal-6) sulfotransfe | NM_003654.1 | 0 | 0.00% | 1 | 0.01% | 0 | 0.00% | 0 | 0.00% | 1 |
| 3820 | carbohydrate (N-acetylglucosamine 6-O) sulfotra | NM_021615.1 | 0 | 0.00% | 1 | 0.01% | 0 | 0.00% | 0 | 0.00% | 1 |
| 3821 | co-beta glucosidase (proactivator) | J03077 | 0 | 0.00% | 0 | 0.00% | 1 | 0.01% | 0 | 0.00% | 1 |
| 3822 | dTDP-4-keto-6-deoxy-D-glucose 4-reductase (tg | AJ243721.1 | 0 | 0.00% | 0 | 0.00% | 0 | 0.00% | 1 | 0.01% | 1 |
| 3823 | extracellular glycoprotein EMILIN-2 precursor (L | XM_029741.1 | 1 | 0.01% | 0 | 0.00% | 0 | 0.00% | 0 | 0.00% | 1 |
| 3824 | galactokinase (galK) | U26401 | 1 | 0.01% | 0 | 0.00% | 0 | 0.00% | 0 | 0.00% | 1 |
| 3825 | galactose-1-phosphate uridyl transferase (GALT | M96264 | 1 | 0.01% | 0 | 0.00% | 0 | 0.00% | 0 | 0.00% | 1 |
| 3826 | GALT3 protein mRNA, complete cds | AF154848.1 | 1 | 0.01% | 0 | 0.00% | 0 | 0.00% | 0 | 0.00% | 1 |
| 3827 | glucosamine-6-phosphate | AJ002231.1 | 0 | 0.00% | 1 | 0.01% | 0 | 0.00% | 0 | 0.00% | 1 |
| 3828 | glucosyltransferase | AJ224875.1 | 0 | 0.00% | 1 | 0.01% | 0 | 0.00% | 0 | 0.00% | 1 |
| 3829 | glycogen debranching enzyme isoform 2 (AGL) | U84008 | 1 | 0.01% | 0 | 0.00% | 0 | 0.00% | 0 | 0.00% | 1 |
| 3830 | glycogen synthase 1 (muscle) (GYS1) | NM_002103.1 | 0 | 0.00% | 1 | 0.01% | 0 | 0.00% | 0 | 0.00% | 1 |
| 3831 | glycogenin= glycogenin-1 | X79537.1 | 0 | 0.00% | 0 | 0.00% | 0 | 0.00% | 1 | 0.01% | 1 |
| 3832 | glycogenin-2 delta (glycogenin-2) (=U94359;U94 | U94360 | 1 | 0.01% | 0 | 0.00% | 0 | 0.00% | 0 | 0.00% | 1 |
| 3833 | hexokinase II pseudogene | U28387 | 0 | 0.00% | 0 | 0.00% | 0 | 0.00% | 1 | 0.01% | 1 |
| 3834 | hippocampus abundant gene transcript 1 (Hiat1) | NM_008246.1 | 0 | 0.00% | 1 | 0.01% | 0 | 0.00% | 0 | 0.00% | 1 |
| 3835 | liver-type 1-phosphofructokinase (PFKL) (=X169 | X15573 | 1 | 0.01% | 0 | 0.00% | 0 | 0.00% | 0 | 0.00% | 1 |
| 3836 | LNR42 (=AJ012409.1 Human hypothetical prote | AF238866 | 0 | 0.00% | 0 | 0.00% | 1 | 0.01% | 0 | 0.00% | 1 |
| 3837 | lysosomal alpha-mannosidase (MANB) | U05572.1 | 1 | 0.01% | 0 | 0.00% | 0 | 0.00% | 0 | 0.00% | 1 |
| 3838 | lysozyme | M19045.1 | 0 | 0.00% | 0 | 0.00% | 0 | 0.00% | 1 | 0.01% | 1 |
| 3839 | mannosyl (alpha-1,3-)-glycoprotein beta-1,2-N-a | NM_002406.2 | 1 | 0.01% | 0 | 0.00% | 0 | 0.00% | 0 | 0.00% | 1 |
| 3840 | mannosyl (alpha-1,6-)-glycoprotein beta-1,2-N-a | NM_002408.2 | 0 | 0.00% | 1 | 0.01% | 0 | 0.00% | 0 | 0.00% | 1 |
| 3841 | mannosyl-oligosaccharide alpha-1,2-mannosida | U04301.1 | 0 | 0.00% | 0 | 0.00% | 0 | 0.00% | 1 | 0.01% | 1 |
| 3842 | N-acetyl-alpha-glucosaminidase (HEXA), alpha- | M13520 | 1 | 0.01% | 0 | 0.00% | 0 | 0.00% | 0 | 0.00% | 1 |
| 3843 | N-acetylgalactosamine 6-sulfate sulfatase (GAL | D17629 | 0 | 0.00% | 0 | 0.00% | 1 | 0.01% | 0 | 0.00% | 1 |
| 3844 | N-acetylglucosamine-phosphate mutase; DKFZ | NM_015599.1 | 0 | 0.00% | 0 | 0.00% | 1 | 0.01% | 0 | 0.00% | 1 |
| 3845 | N-acetylglucosaminyl transferase component G | NM_004204.1 | 1 | 0.01% | 0 | 0.00% | 0 | 0.00% | 0 | 0.00% | 1 |
| 3846 | O-linked N-acetylglucosamine(GlcNAc) transfer | NM_003605.2 | 0 | 0.00% | 1 | 0.01% | 0 | 0.00% | 0 | 0.00% | 1 |
| 3847 | Phosphoglucomutase and phosphomannomutas | AL021481 | 0 | 0.00% | 0 | 0.00% | 1 | 0.01% | 0 | 0.00% | 1 |
| 3848 | phosphoglycerate mutase 2 (muscle specific iso | M55673 | 1 | 0.01% | 0 | 0.00% | 0 | 0.00% | 0 | 0.00% | 1 |
| 3849 | phosphoinositide-3-kinase, catalytic, alpha polyp | NM_006218.1 | 1 | 0.01% | 0 | 0.00% | 0 | 0.00% | 0 | 0.00% | 1 |
| 3850 | phosphomannomutase 2 (PMM2) gene (5e-10 m | AF157794.1 | 0 | 0.00% | 0 | 0.00% | 0 | 0.00% | 1 | 0.01% | 1 |
| 3851 | phosphoprotein enriched in astrocytes 15 (PEA1 | NM_003768.1 | 0 | 0.00% | 0 | 0.00% | 1 | 0.01% | 0 | 0.00% | 1 |
| 3852 | platelet activating factor acetylhydrolase, brain is | U72342 | 0 | 0.00% | 0 | 0.00% | 0 | 0.00% | 1 | 0.01% | 1 |
| 3853 | pyruvate dehydrogenase (lipoamide) beta (PDH | NM_000925.1 | 0 | 0.00% | 0 | 0.00% | 0 | 0.00% | 1 | 0.01% | 1 |
| 3854 | pyruvate kinase, muscle (PKM2)(=TCB) | NM_002654.1 | 1 | 0.01% | 0 | 0.00% | 0 | 0.00% | 0 | 0.00% | 1 |
| 3855 | siah binding protein 1 (SiahBP1) | U51586 | 1 | 0.01% | 0 | 0.00% | 0 | 0.00% | 0 | 0.00% | 1 |
| 3856 | sialidase 1 (lysosomal sialidase) (NEU1) | gi4557790 | 0 | 0.00% | 0 | 0.00% | 0 | 0.00% | 1 | 0.01% | 1 |
| 3857 | sialyltransferase 4C (beta-galactosidase alpha-2 | NM_006278.1 | 1 | 0.01% | 0 | 0.00% | 0 | 0.00% | 0 | 0.00% | 1 |
| 3858 | sialyltransferase SThM (sthm) | U14550 | 1 | 0.01% | 0 | 0.00% | 0 | 0.00% | 0 | 0.00% | 1 |
| 3859 | sorbitol dehydrogenase (SORD) | U67243.1 | 0 | 0.00% | 0 | 0.00% | 0 | 0.00% | 1 | 0.01% | 1 |
| 3860 | suCRase-isomaltase (SI) | M84646 | 0 | 0.00% | 0 | 0.00% | 1 | 0.01% | 0 | 0.00% | 1 |
| 3861 | UDP-galactose transporter related | AB041549.1 | 0 | 0.00% | 1 | 0.01% | 0 | 0.00% | 0 | 0.00% | 1 |
| 3862 | UDP-galactose transporter related isozyme 1 | D87989.1 | 0 | 0.00% | 0 | 0.00% | 0 | 0.00% | 1 | 0.01% | 1 |
| 3863 | UDP-glucose:glycoprotein glucosyltransferase 2 | NM_020121.1 | 0 | 0.00% | 1 | 0.01% | 0 | 0.00% | 0 | 0.00% | 1 |
| 3864 | aldolase A, fructose-bisphosphate (ALDOA) | NM_000034.1 | 0 | 0.00% | 1 | 0.01% | 0 | 0.00% | 0 | 0.00% | 1 |
| 3865 | acid phosphatase 1, soluble (ACP1), transcript v | NM_004300.1 | 0 | 0.00% | 0 | 0.00% | 1 | 0.01% | 0 | 0.00% | 1 |
| 3866 | acyl-Coenzyme A oxidase 3, pristanoyl (ACOX3 | NM_003501.1 | 0 | 0.00% | 1 | 0.01% | 0 | 0.00% | 0 | 0.00% | 1 |
| 3867 | bleomycin hydrolase | X92106 | 1 | 0.01% | 0 | 0.00% | 0 | 0.00% | 0 | 0.00% | 1 |
| 3868 | casein kinase 1, epsilon (CSNK1E) | NM_001894.1 | 1 | 0.01% | 0 | 0.00% | 0 | 0.00% | 0 | 0.00% | 1 |
| 3869 | casein kinase 2, alpha 1 polypeptide (CSNK2A1 | XM_049424.2 | 1 | 0.01% | 0 | 0.00% | 0 | 0.00% | 0 | 0.00% | 1 |
| 3870 | casein kinase 2, beta polypeptide (CSNK2B) | NM_001320.1 | 1 | 0.01% | 0 | 0.00% | 0 | 0.00% | 0 | 0.00% | 1 |
| 3871 | casein kinase I gamma 2 (=AF001177) | U89896 | 1 | 0.01% | 0 | 0.00% | 0 | 0.00% | 0 | 0.00% | 1 |
| 3872 | cysteine knot superfamily 1, BMP antagonist 1 ( | NM_013372.1 | 0 | 0.00% | 1 | 0.01% | 0 | 0.00% | 0 | 0.00% | 1 |
| 3873 | dual adaptor of phosphotyrosine and 3-phospho | XM_052416.1 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 69 of 102

| | | | | | | | | | | | |
|---|---|---|---|---|---|---|---|---|---|---|---|
| 3874 | GAP SH3 binding protein (Ras-GTPase-activatir | U32519 | 0 | 0.00% | 0 | 0.00% | 0 | 0.00% | 1 | 0.01% | 1 |
| 3875 | GAP-associated protein (p190) | M94721 | 0 | 0.00% | 0 | 0.00% | 1 | 0.01% | 0 | 0.00% | 1 |
| 3876 | GAP-like protein (LOC51306) | NM_016603.1 | 0 | 0.00% | 0 | 0.00% | 0 | 0.00% | 1 | 0.01% | 1 |
| 3877 | kappa-casein | U51899 | 1 | 0.01% | 0 | 0.00% | 0 | 0.00% | 0 | 0.00% | 1 |
| 3878 | kinase substrate HASPP28 | U26541.1 | 0 | 0.00% | 1 | 0.01% | 0 | 0.00% | 0 | 0.00% | 1 |
| 3879 | lysosomal acid phosphatase (=X12548) | X15535 | 1 | 0.01% | 0 | 0.00% | 0 | 0.00% | 0 | 0.00% | 1 |
| 3880 | PALM (=D87460 (KIAA0270)) | Y16277 | 1 | 0.01% | 0 | 0.00% | 0 | 0.00% | 0 | 0.00% | 1 |
| 3881 | palmitoylated erythrocyte membrane protein (MF | M64925 | 1 | 0.01% | 0 | 0.00% | 0 | 0.00% | 0 | 0.00% | 1 |
| 3882 | PHKB gene (exon 25) | X84930.1 | 0 | 0.00% | 1 | 0.01% | 0 | 0.00% | 0 | 0.00% | 1 |
| 3883 | protein phosphatase (KAP1) | L27711.1 | 0 | 0.00% | 0 | 0.00% | 0 | 0.00% | 1 | 0.01% | 1 |
| 3884 | protein phosphatase 1 (PPP1R5) | Y18207 | 0 | 0.00% | 0 | 0.00% | 1 | 0.01% | 0 | 0.00% | 1 |
| 3885 | protein phosphatase 1 regulatory subunit 7 (PPF | NM_002712.1 | 1 | 0.01% | 0 | 0.00% | 0 | 0.00% | 0 | 0.00% | 1 |
| 3886 | protein phosphatase 1, catalytic subunit, alpha is | NM_002708.1 | 1 | 0.01% | 0 | 0.00% | 0 | 0.00% | 0 | 0.00% | 1 |
| 3887 | protein phosphatase 1, catalytic subunit, gamma | Hs.79081 | 0 | 0.00% | 0 | 0.00% | 1 | 0.01% | 0 | 0.00% | 1 |
| 3888 | protein phosphatase 1, regulatory (inhibitor) subu | NM_005398.1 | 0 | 0.00% | 1 | 0.01% | 0 | 0.00% | 0 | 0.00% | 1 |
| 3889 | protein phosphatase 1, regulatory subunit 10 (PF | gi4506008 | 0 | 0.00% | 0 | 0.00% | 0 | 0.00% | 1 | 0.01% | 1 |
| 3890 | protein phosphatase 1, regulatory(inhibitor) subu | NP_005389.1 | 1 | 0.01% | 0 | 0.00% | 0 | 0.00% | 0 | 0.00% | 1 |
| 3891 | protein phosphatase 1, regulatorysubunit 7 (Ref | NP_002703.1 | 0 | 0.00% | 1 | 0.01% | 0 | 0.00% | 0 | 0.00% | 1 |
| 3892 | protein phosphatase 1G (formerly 2C), magnesiu | XM_033185.1 | 1 | 0.01% | 0 | 0.00% | 0 | 0.00% | 0 | 0.00% | 1 |
| 3893 | protein phosphatase 2 (formerly 2A), regulatory | XM_041325.1 | 1 | 0.01% | 0 | 0.00% | 0 | 0.00% | 0 | 0.00% | 1 |
| 3894 | protein phosphatase 2, regulatory subunit B (B56 | NM_006243.1 | 0 | 0.00% | 1 | 0.01% | 0 | 0.00% | 0 | 0.00% | 1 |
| 3895 | protein phosphatase 2A B'alpha1 regulatory sub | U37352 | 0 | 0.00% | 0 | 0.00% | 0 | 0.00% | 1 | 0.01% | 1 |
| 3896 | protein phosphatase 2A regulatory subunit alpha | J02902 | 1 | 0.01% | 0 | 0.00% | 0 | 0.00% | 0 | 0.00% | 1 |
| 3897 | protein phosphatase 2C beta | AJ005458.1 | 0 | 0.00% | 0 | 0.00% | 0 | 0.00% | 1 | 0.01% | 1 |
| 3898 | protein phosphatase 5 (=U25174) | X89416 | 0 | 0.00% | 0 | 0.00% | 0 | 0.00% | 1 | 0.01% | 1 |
| 3899 | protein phosphatase-1 catalytic subunit | M63960 | 1 | 0.01% | 0 | 0.00% | 0 | 0.00% | 0 | 0.00% | 1 |
| 3900 | protein tyrosine phosphatase receptor type K (P | NM_002844.1 | 1 | 0.01% | 0 | 0.00% | 0 | 0.00% | 0 | 0.00% | 1 |
| 3901 | protein tyrosine phosphatase(TEP1) (ORF) | U96180 | 0 | 0.00% | 0 | 0.00% | 0 | 0.00% | 1 | 0.01% | 1 |
| 3902 | protein tyrosine phosphatase, receptor type, alph | NM_002836.1 | 1 | 0.01% | 0 | 0.00% | 0 | 0.00% | 0 | 0.00% | 1 |
| 3903 | protein tyrosine phosphatase, receptor type, eps | NP_006495.1 | 0 | 0.00% | 1 | 0.01% | 0 | 0.00% | 0 | 0.00% | 1 |
| 3904 | protein tyrosine phosphatase, receptor type, f po | NP_003616.1 | 0 | 0.00% | 1 | 0.01% | 0 | 0.00% | 0 | 0.00% | 1 |
| 3905 | protein tyrosine phosphatase, receptor type, M ( | NM_002845.1 | 1 | 0.01% | 0 | 0.00% | 0 | 0.00% | 0 | 0.00% | 1 |
| 3906 | protein-tyrosine kinase, trkB | X75958.1 | 0 | 0.00% | 0 | 0.00% | 1 | 0.01% | 0 | 0.00% | 1 |
| 3907 | 3-hydroxy-3-methylglutaryl-coenzyme A (HMG-C | M62633 | 0 | 0.00% | 0 | 0.00% | 0 | 0.00% | 1 | 0.01% | 1 |
| 3908 | 3'-phosphoadenosine 5'-phosphosulfate synthet | AF105227.1 | 0 | 0.00% | 0 | 0.00% | 1 | 0.01% | 0 | 0.00% | 1 |
| 3909 | 3'-phosphoadenosine 5-prime-phosphosulfate sy | NP_005434.1 | 0 | 0.00% | 1 | 0.01% | 0 | 0.00% | 0 | 0.00% | 1 |
| 3910 | 5'(3')-deoxyribonucleotidase; RB-associated KR | NM_014595.1 | 1 | 0.01% | 0 | 0.00% | 0 | 0.00% | 0 | 0.00% | 1 |
| 3911 | 5'-3' exoribonuclease 1 | NP_036046.1 | 0 | 0.00% | 1 | 0.01% | 0 | 0.00% | 0 | 0.00% | 1 |
| 3912 | 5'-3'exonuclease | X91617.1 | 0 | 0.00% | 1 | 0.01% | 0 | 0.00% | 0 | 0.00% | 1 |
| 3913 | 5'-nucleotidase (purine) | NM_012229.1 | 0 | 0.00% | 1 | 0.01% | 0 | 0.00% | 0 | 0.00% | 1 |
| 3914 | 6-O-methylguanine-DNA methyltransferase (MG | M29971.1 | 1 | 0.01% | 0 | 0.00% | 0 | 0.00% | 0 | 0.00% | 1 |
| 3915 | adenosine deaminase tRNA-specific 1 (ADAT1) | NM_012091.2 | 0 | 0.00% | 1 | 0.01% | 0 | 0.00% | 0 | 0.00% | 1 |
| 3916 | adenosine monophosphate deaminase (isoform | NM_000480.1 | 0 | 0.00% | 0 | 0.00% | 0 | 0.00% | 1 | 0.01% | 1 |
| 3917 | adenosine triphosphatase | M95541.1 | 0 | 0.00% | 0 | 0.00% | 1 | 0.01% | 0 | 0.00% | 1 |
| 3918 | deoxyhypusine synthase | L39068.1 | 1 | 0.01% | 0 | 0.00% | 0 | 0.00% | 0 | 0.00% | 1 |
| 3919 | deoxyribonuclease I-like 3 (DNASE1L3) | NM_004944.1 | 0 | 0.00% | 1 | 0.01% | 0 | 0.00% | 0 | 0.00% | 1 |
| 3920 | dinucleotide miCRosatellite HUJII77 | M96348 | 0 | 0.00% | 0 | 0.00% | 1 | 0.01% | 0 | 0.00% | 1 |
| 3921 | exoribonuclease 1 (Xrn1) | NM_011916.1 | 0 | 0.00% | 1 | 0.01% | 0 | 0.00% | 0 | 0.00% | 1 |
| 3922 | G/T MISMATCH-SPECIFIC THYMINE DNA GLY | Q13569 | 0 | 0.00% | 1 | 0.01% | 0 | 0.00% | 0 | 0.00% | 1 |
| 3923 | guanylate kinase 1 (GUK1) | XM_056887.1 | 1 | 0.01% | 0 | 0.00% | 0 | 0.00% | 0 | 0.00% | 1 |
| 3924 | inorganic pyrophosphatase | AF119665.1 | 0 | 0.00% | 0 | 0.00% | 0 | 0.00% | 1 | 0.01% | 1 |
| 3925 | nucleoside diphosphate kinase homolog (DR-nm | U80813.1 | 1 | 0.01% | 0 | 0.00% | 0 | 0.00% | 0 | 0.00% | 1 |
| 3926 | nudix (nucleoside diphosphate linked moiety X)- | NM_006703.1 | 1 | 0.01% | 0 | 0.00% | 0 | 0.00% | 0 | 0.00% | 1 |
| 3927 | nudix (nucleoside diphosphate linked moiety X)- | NM_007083.1 | 0 | 0.00% | 1 | 0.01% | 0 | 0.00% | 0 | 0.00% | 1 |
| 3928 | phosphodiesterase 10A (PDE10A) | NM_006661.1 | 1 | 0.01% | 0 | 0.00% | 0 | 0.00% | 0 | 0.00% | 1 |
| 3929 | phosphodiesterase 1A, calmodulin-dependent (P | NM_005019.1 | 0 | 0.00% | 0 | 0.00% | 0 | 0.00% | 1 | 0.01% | 1 |
| 3930 | phosphodiesterase 2A cGMP-stimulated (PDE2/ | NM_002599.1 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 70 of 102

| | | | | | | | | | | | |
|---|---|---|---|---|---|---|---|---|---|---|---|
| 3931 | phosphodiesterase 4B, cAMP-specific(dunce (D | NP_002591.1 | 0 | 0.00% | 1 | 0.01% | 0 | 0.00% | 0 | 0.00% | 1 |
| 3932 | phosphodiesterase I/nucleotide pyrophosphatas | NM_006209.1 | 1 | 0.01% | 0 | 0.00% | 0 | 0.00% | 0 | 0.00% | 1 |
| 3933 | RhoGAP, rat homologue (chromosome 13) | gi4902677 | 0 | 0.00% | 0 | 0.00% | 1 | 0.01% | 0 | 0.00% | 1 |
| 3934 | ribonuclease A (RNase A) | D26129 | 1 | 0.01% | 0 | 0.00% | 0 | 0.00% | 0 | 0.00% | 1 |
| 3935 | ribonuclease HI, large subunit (RNASEHI) | NM_006397.1 | 1 | 0.01% | 0 | 0.00% | 0 | 0.00% | 0 | 0.00% | 1 |
| 3936 | ribonuclease P (30kD) (RefSeq aa 2e-78) | NP_006404.1 | 0 | 0.00% | 1 | 0.01% | 0 | 0.00% | 0 | 0.00% | 1 |
| 3937 | RIBONUCLEASE PH-LIKE PROTEIN B0564.1 | spQ17533 | 1 | 0.01% | 0 | 0.00% | 0 | 0.00% | 0 | 0.00% | 1 |
| 3938 | rod cGMP-phosphodiesterase gamma-subunit (F | U00482 | 1 | 0.01% | 0 | 0.00% | 0 | 0.00% | 0 | 0.00% | 1 |
| 3939 | RY-1 putative nucleic acid binding protein | X76302.1 | 0 | 0.00% | 1 | 0.01% | 0 | 0.00% | 0 | 0.00% | 1 |
| 3940 | single strand DNA-binding protein | AF077048.1 | 1 | 0.01% | 0 | 0.00% | 0 | 0.00% | 0 | 0.00% | 1 |
| 3941 | thymidine kinase 1, soluble (TK1) | K02581 | 1 | 0.01% | 0 | 0.00% | 0 | 0.00% | 0 | 0.00% | 1 |
| 3942 | thymine-DNA glycosylase (TDG) | NM_003211.1 | 0 | 0.00% | 1 | 0.01% | 0 | 0.00% | 0 | 0.00% | 1 |
| 3943 | L apoferritin | X03742 | 1 | 0.01% | 0 | 0.00% | 0 | 0.00% | 0 | 0.00% | 1 |
| 3944 | long-chain-fatty-acid-CoA ligase, homologue (SV | Z81071 | 1 | 0.01% | 0 | 0.00% | 0 | 0.00% | 0 | 0.00% | 1 |
| 3945 | 3-hydroxyisobutyryl-coenzyme A hydrolase | U66669 | 1 | 0.01% | 0 | 0.00% | 0 | 0.00% | 0 | 0.00% | 1 |
| 3946 | 43 kDa inositol polyphosphate 5-phosphatase | Z31695 | 1 | 0.01% | 0 | 0.00% | 0 | 0.00% | 0 | 0.00% | 1 |
| 3947 | 7-dehydrocholesterol reductase (DHCR7) | AF067127.1 | 0 | 0.00% | 0 | 0.00% | 0 | 0.00% | 1 | 0.01% | 1 |
| 3948 | abc1 | X75926 | 1 | 0.01% | 0 | 0.00% | 0 | 0.00% | 0 | 0.00% | 1 |
| 3949 | acetyl-CoA carboxylase | X68968 | 1 | 0.01% | 0 | 0.00% | 0 | 0.00% | 0 | 0.00% | 1 |
| 3950 | acetyl-Coenzyme A acyltransferase 2 (mitochon | NM_006111.1 | 0 | 0.00% | 0 | 0.00% | 0 | 0.00% | 1 | 0.01% | 1 |
| 3951 | acylphosphatase 2, muscle type (ACYP2) | X84195 | 0 | 0.00% | 0 | 0.00% | 0 | 0.00% | 1 | 0.01% | 1 |
| 3952 | alcohol dehydrogenase beta-1-subunit (ADH1-2 | X03350 | 0 | 0.00% | 0 | 0.00% | 1 | 0.01% | 0 | 0.00% | 1 |
| 3953 | alpha-methylacyl-CoA racemase | AF047020 | 1 | 0.01% | 0 | 0.00% | 0 | 0.00% | 0 | 0.00% | 1 |
| 3954 | aquaporin adipose | AB006190 | 1 | 0.01% | 0 | 0.00% | 0 | 0.00% | 0 | 0.00% | 1 |
| 3955 | carnitine carrier | Y10319 | 1 | 0.01% | 0 | 0.00% | 0 | 0.00% | 0 | 0.00% | 1 |
| 3956 | carnitine octanoyltransferase | AF073770.1 | 0 | 0.00% | 1 | 0.01% | 0 | 0.00% | 0 | 0.00% | 1 |
| 3957 | carnitine palmitoyltransferase II, precursor (CPT | U09646 | 0 | 0.00% | 0 | 0.00% | 1 | 0.01% | 0 | 0.00% | 1 |
| 3958 | CDP-diacylglycerol synthase(phosphatidate cytid | NP_001254.1 | 0 | 0.00% | 1 | 0.01% | 0 | 0.00% | 0 | 0.00% | 1 |
| 3959 | choline kinase isolog 384D8_3 | U62317 | 1 | 0.01% | 0 | 0.00% | 0 | 0.00% | 0 | 0.00% | 1 |
| 3960 | choline phosphotransferase 1 beta (=cholinepho | AF195624.1 | 0 | 0.00% | 1 | 0.01% | 0 | 0.00% | 0 | 0.00% | 1 |
| 3961 | CTL1 protein (70% aa) | AJ245620 | 0 | 0.00% | 0 | 0.00% | 0 | 0.00% | 1 | 0.01% | 1 |
| 3962 | CTL2 gene | AJ245621.1 | 1 | 0.01% | 0 | 0.00% | 0 | 0.00% | 0 | 0.00% | 1 |
| 3963 | delta-6 fatty acid desaturase (FADSD6) | NM_004265.1 | 1 | 0.01% | 0 | 0.00% | 0 | 0.00% | 0 | 0.00% | 1 |
| 3964 | dihydrolipoamide acetyltransferase (PDC-E2) (E | Y00978.1 | 0 | 0.00% | 1 | 0.01% | 0 | 0.00% | 0 | 0.00% | 1 |
| 3965 | dihydrolipoamide branched chain transacylase (I | XP_001705.1 | 0 | 0.00% | 1 | 0.01% | 0 | 0.00% | 0 | 0.00% | 1 |
| 3966 | Drosophila fat facets related, X-linked (RefSeq a | NP_004643.1 | 0 | 0.00% | 1 | 0.01% | 0 | 0.00% | 0 | 0.00% | 1 |
| 3967 | fat facets protein | AJ012078 | 0 | 0.00% | 0 | 0.00% | 0 | 0.00% | 1 | 0.01% | 1 |
| 3968 | fatty acid binding protein 3, muscle and heart (m | NM_004102.2 | 0 | 0.00% | 1 | 0.01% | 0 | 0.00% | 0 | 0.00% | 1 |
| 3969 | fatty acid binding protein 7, brain (FABP7) mRN/ | NM_001446.1 | 1 | 0.01% | 0 | 0.00% | 0 | 0.00% | 0 | 0.00% | 1 |
| 3970 | fatty acid desaturase MLD, putative (contains Al | AF002668 | 0 | 0.00% | 0 | 0.00% | 0 | 0.00% | 1 | 0.01% | 1 |
| 3971 | fatty-acid-Coenzyme A ligase,long-chain 3 (RefS | NP_004448.1 | 0 | 0.00% | 1 | 0.01% | 0 | 0.00% | 0 | 0.00% | 1 |
| 3972 | fumarylacetoacetate hydrolase | M55150.1 | 0 | 0.00% | 0 | 0.00% | 0 | 0.00% | 1 | 0.01% | 1 |
| 3973 | geranylgeranyl diphosphate synthase 1(RefSeq | NP_004828.1 | 0 | 0.00% | 1 | 0.01% | 0 | 0.00% | 0 | 0.00% | 1 |
| 3974 | hydroxysteroid (17-beta) dehydrogenase 7 (RefS | NP_057455.1 | 0 | 0.00% | 1 | 0.01% | 0 | 0.00% | 0 | 0.00% | 1 |
| 3975 | L-3-hydroxyacyl-CoA dehydrogenase (=AF0019 | X96752 | 1 | 0.01% | 0 | 0.00% | 0 | 0.00% | 0 | 0.00% | 1 |
| 3976 | lanosterol 14-alpha demethylase cytochrome P4 | U51692.1 | 0 | 0.00% | 0 | 0.00% | 0 | 0.00% | 1 | 0.01% | 1 |
| 3977 | lipoyltransferase, complete cds | AB017567.1 | 0 | 0.00% | 1 | 0.01% | 0 | 0.00% | 0 | 0.00% | 1 |
| 3978 | methylmalonate-semialdehyde dehydrogenase ( | NM_005589.1 | 0 | 0.00% | 1 | 0.01% | 0 | 0.00% | 0 | 0.00% | 1 |
| 3979 | mitochondrial short-chain enoyl-CoA hydratase | D13900 | 1 | 0.01% | 0 | 0.00% | 0 | 0.00% | 0 | 0.00% | 1 |
| 3980 | muscle fatty-acid-binding protein (FABP) | X56549.1 | 1 | 0.01% | 0 | 0.00% | 0 | 0.00% | 0 | 0.00% | 1 |
| 3981 | neuronal PAS domain protein 3 (Npas3) | NM_013780.1 | 0 | 0.00% | 1 | 0.01% | 0 | 0.00% | 0 | 0.00% | 1 |
| 3982 | oxysterol binding protein (RefSeq aa 1e-87) | NP_002547.1 | 0 | 0.00% | 1 | 0.01% | 0 | 0.00% | 0 | 0.00% | 1 |
| 3983 | p55PIK phosphatidylinositol 3-kinase regulatory | S79169 | 1 | 0.01% | 0 | 0.00% | 0 | 0.00% | 0 | 0.00% | 1 |
| 3984 | perilipin | AB005293.1 | 0 | 0.00% | 0 | 0.00% | 1 | 0.01% | 0 | 0.00% | 1 |
| 3985 | phosphatidylcholine 2-acylhydrolase (cPLA2) | M68874.1 | 0 | 0.00% | 0 | 0.00% | 0 | 0.00% | 1 | 0.01% | 1 |
| 3986 | phosphatidylinositol 3-kinase, class 3 (RefSeq a | NP_002638.1 | 0 | 0.00% | 1 | 0.01% | 0 | 0.00% | 0 | 0.00% | 1 |
| 3987 | Phosphatidylinositol transfer protein (PI-TPalpha | D30036.1 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 71 of 102

| | | | | | | | | | | | |
|---|---|---|---|---|---|---|---|---|---|---|---|
| 3988 | phospholipase C, epsilon (PLCE)=D42108 | NM_006226.1 | 0 | 0.00% | 0 | 0.00% | 1 | 0.01% | 0 | 0.00% | 1 |
| 3989 | Phospholipase C-delta1 (Plcd1) | NM_017035.1 | 0 | 0.00% | 0 | 0.00% | 0 | 0.00% | 1 | 0.01% | 1 |
| 3990 | phospholipase D1, phophatidylcholine-specific (I | NM_002662.1 | 0 | 0.00% | 1 | 0.01% | 0 | 0.00% | 0 | 0.00% | 1 |
| 3991 | pleckstrin homology domain-containing, family A | XM_011878.3 | 0 | 0.00% | 0 | 0.00% | 0 | 0.00% | 1 | 0.01% | 1 |
| 3992 | prostaglandin endoperoxide H synthase-1 | AF129755.1 | 0 | 0.00% | 0 | 0.00% | 1 | 0.01% | 0 | 0.00% | 1 |
| 3993 | prostaglandin endoperoxide synthase-2, PTGS2 | D28235 | 0 | 0.00% | 0 | 0.00% | 1 | 0.01% | 0 | 0.00% | 1 |
| 3994 | RASF-A PLA2 (synovial phospholipase) | M22431 | 0 | 0.00% | 0 | 0.00% | 1 | 0.01% | 0 | 0.00% | 1 |
| 3995 | RED CELL ACID PHOSPHATASE 1, ISOZYME | spP24666 | 0 | 0.00% | 0 | 0.00% | 1 | 0.01% | 0 | 0.00% | 1 |
| 3996 | Sac domain-containing inositol phosphatase 2 (S | NM_014937.1 | 1 | 0.01% | 0 | 0.00% | 0 | 0.00% | 0 | 0.00% | 1 |
| 3997 | saposin proteins A-D | M32221 | 1 | 0.01% | 0 | 0.00% | 0 | 0.00% | 0 | 0.00% | 1 |
| 3998 | squalene synthase | X69141 | 0 | 0.00% | 0 | 0.00% | 1 | 0.01% | 0 | 0.00% | 1 |
| 3999 | steroid 5-alpha-reductase | M32313 | 0 | 0.00% | 0 | 0.00% | 0 | 0.00% | 1 | 0.01% | 1 |
| 4000 | steroid membrane binding protein | X99714 | 1 | 0.01% | 0 | 0.00% | 0 | 0.00% | 0 | 0.00% | 1 |
| 4001 | steroid sulfatase (STS) | M16505 | 0 | 0.00% | 0 | 0.00% | 1 | 0.01% | 0 | 0.00% | 1 |
| 4002 | tissue factor pathway inhibitor (lipoprotein-assoc | NP_006278.1 | 0 | 0.00% | 1 | 0.01% | 0 | 0.00% | 0 | 0.00% | 1 |
| 4003 | urf4 (ORF)= NADH-UBIQUINONE OXIDOREDU | L00016 | 1 | 0.01% | 0 | 0.00% | 0 | 0.00% | 0 | 0.00% | 1 |
| 4004 | ATP SYNTHASE B CHAIN, MITOCHONDRIAL | spP24539 | 0 | 0.00% | 0 | 0.00% | 0 | 0.00% | 1 | 0.01% | 1 |
| 4005 | ATP synthase inhibitor protein | M22559 | 1 | 0.01% | 0 | 0.00% | 0 | 0.00% | 0 | 0.00% | 1 |
| 4006 | ATP synthase subunit c, P1 | D13118 | 0 | 0.00% | 0 | 0.00% | 1 | 0.01% | 0 | 0.00% | 1 |
| 4007 | ATP synthase, H transporting, mitochondrial F0 | NM_005176.3 | 1 | 0.01% | 0 | 0.00% | 0 | 0.00% | 0 | 0.00% | 1 |
| 4008 | ATP synthase, H transporting, mitochondrial F1 | NM_001686.1 | 1 | 0.01% | 0 | 0.00% | 0 | 0.00% | 0 | 0.00% | 1 |
| 4009 | ATP synthase, H transporting, mitochondrial F1 | NM_006886.1 | 0 | 0.00% | 1 | 0.01% | 0 | 0.00% | 0 | 0.00% | 1 |
| 4010 | ATP synthase, H transporting,mitochondrial F1 | NP_001688.1 | 0 | 0.00% | 1 | 0.01% | 0 | 0.00% | 0 | 0.00% | 1 |
| 4011 | ATP synthetase beta-subunit | X05606 | 0 | 0.00% | 0 | 0.00% | 1 | 0.01% | 0 | 0.00% | 1 |
| 4012 | ATP synthetase epsilon-subunit, nuclear-endcod | X16978 | 1 | 0.01% | 0 | 0.00% | 0 | 0.00% | 0 | 0.00% | 1 |
| 4013 | ATP(GTP)-binding protein | AJ010842.1 | 1 | 0.01% | 0 | 0.00% | 0 | 0.00% | 0 | 0.00% | 1 |
| 4014 | breast cancer metastasis-suppressor 1 (BRMS1 | AF159141.1 | 0 | 0.00% | 1 | 0.01% | 0 | 0.00% | 0 | 0.00% | 1 |
| 4015 | COX15 (yeast) homolog, cytochrome c oxidase | NM_004376.1 | 0 | 0.00% | 1 | 0.01% | 0 | 0.00% | 0 | 0.00% | 1 |
| 4016 | CYTOCHROME B | P00156 | 0 | 0.00% | 1 | 0.01% | 0 | 0.00% | 0 | 0.00% | 1 |
| 4017 | cytochrome b large subunit of complex II | D49737 | 1 | 0.01% | 0 | 0.00% | 0 | 0.00% | 0 | 0.00% | 1 |
| 4018 | cytochrome bc-1 complex core P | S74321 | 0 | 0.00% | 0 | 0.00% | 1 | 0.01% | 0 | 0.00% | 1 |
| 4019 | cytochrome c oxidase chain I [MesoCRicetus au | U97674 | 0 | 0.00% | 0 | 0.00% | 1 | 0.01% | 0 | 0.00% | 1 |
| 4020 | cytochrome c oxidase subunit II [Artibeus jamaic | AF061340 | 0 | 0.00% | 1 | 0.01% | 0 | 0.00% | 0 | 0.00% | 1 |
| 4021 | cytochrome c oxidase subunit IV (COX4), nuclea | NM_001861.1 | 0 | 0.00% | 1 | 0.01% | 0 | 0.00% | 0 | 0.00% | 1 |
| 4022 | cytochrome c oxidase subunit VIb (EC 1.9.3.1) | X13923 | 0 | 0.00% | 0 | 0.00% | 0 | 0.00% | 1 | 0.01% | 1 |
| 4023 | cytochrome c oxidase subunit VIIa polypeptide 1 | NP_001855.1 | 0 | 0.00% | 1 | 0.01% | 0 | 0.00% | 0 | 0.00% | 1 |
| 4024 | cytochrome c oxidase VIIc (EC 1.9.3.1) | X52940 | 0 | 0.00% | 0 | 0.00% | 1 | 0.01% | 0 | 0.00% | 1 |
| 4025 | cytochrome c-1 (CYC1) | NM_001916.1 | 1 | 0.01% | 0 | 0.00% | 0 | 0.00% | 0 | 0.00% | 1 |
| 4026 | cytochrome oxidase I | CAA24028.1 | 0 | 0.00% | 0 | 0.00% | 0 | 0.00% | 1 | 0.01% | 1 |
| 4027 | cytochrome-c oxidase (EC 1.9.3.1) chain I | C59153 | 0 | 0.00% | 1 | 0.01% | 0 | 0.00% | 0 | 0.00% | 1 |
| 4028 | ferredoxin 1 (FDX1) mRNA | NM_004109.1 | 0 | 0.00% | 0 | 0.00% | 0 | 0.00% | 1 | 0.01% | 1 |
| 4029 | glyoxylate reductase/hydroxypyruvatereductase | NP_036335.1 | 0 | 0.00% | 1 | 0.01% | 0 | 0.00% | 0 | 0.00% | 1 |
| 4030 | GTP AMP phosphotransferase mRNA, complete | AF183419.1 | 0 | 0.00% | 1 | 0.01% | 0 | 0.00% | 0 | 0.00% | 1 |
| 4031 | Hsa4 mitochondrion cytochrome oxidase subuni | U12692.1 | 1 | 0.01% | 0 | 0.00% | 0 | 0.00% | 0 | 0.00% | 1 |
| 4032 | isocitrate dehydrogenase | U52144.1 | 1 | 0.01% | 0 | 0.00% | 0 | 0.00% | 0 | 0.00% | 1 |
| 4033 | isocitrate dehydrogenase 1 (NADP ), soluble (ID | NM_005896.1 | 1 | 0.01% | 0 | 0.00% | 0 | 0.00% | 0 | 0.00% | 1 |
| 4034 | isocitrate dehydrogenase 3 (NAD ) gamma (IDH | NM_004135.1 | 1 | 0.01% | 0 | 0.00% | 0 | 0.00% | 0 | 0.00% | 1 |
| 4035 | malate dehydrogenase precursor (MDH) (mitoch | AF047470 | 1 | 0.01% | 0 | 0.00% | 0 | 0.00% | 0 | 0.00% | 1 |
| 4036 | malonyl-CoA decarboxylase precursor (MLYCD) | AF097832.2 | 0 | 0.00% | 1 | 0.01% | 0 | 0.00% | 0 | 0.00% | 1 |
| 4037 | mitochondria isolate Aus3 cytochrome b (CYTB | AF042516 | 1 | 0.01% | 0 | 0.00% | 0 | 0.00% | 0 | 0.00% | 1 |
| 4038 | mitochondria solute carrier protein (MSCP) | AY032628.1 | 1 | 0.01% | 0 | 0.00% | 0 | 0.00% | 0 | 0.00% | 1 |
| 4039 | mitochondrial (Asian) DNA control region, seque | M76321.1 | 0 | 0.00% | 0 | 0.00% | 1 | 0.01% | 0 | 0.00% | 1 |
| 4040 | mitochondrial ATP synthase c subunit (P2 form) | X69908 | 1 | 0.01% | 0 | 0.00% | 0 | 0.00% | 0 | 0.00% | 1 |
| 4041 | mitochondrial ATPase subunit 9 | M16439 | 1 | 0.01% | 0 | 0.00% | 0 | 0.00% | 0 | 0.00% | 1 |
| 4042 | mitochondrial carrier homologue 1 (=CGI protein | AF176006.1 | 0 | 0.00% | 0 | 0.00% | 0 | 0.00% | 1 | 0.01% | 1 |
| 4043 | mitochondrial control region II, sample NG14 | L39338 | 1 | 0.01% | 0 | 0.00% | 0 | 0.00% | 0 | 0.00% | 1 |
| 4044 | mitochondrial cytochrome b | AB033713.1 | 0 | 0.00% | 0 | 0.00% | 0 | 0.00% | 1 | 0.01% | 1 |

Figure 6 - Unique Known Genes Identified In Four cDNA Cartilage Libraries and EST Frequency Analysis - Page 72 of 102

| | | | | | | | | | | | |
|---|---|---|---|---|---|---|---|---|---|---|---|
| 4045 | MITOCHONDRIAL CYTOCHROME B-245 HEA | spQ61093 | 0 | 0.00% | 0 | 0.00% | 1 | 0.01% | 0 | 0.00% | 1 |
| 4046 | mitochondrial cytochrome c oxidase subunits I, I | M27315 | 0 | 0.00% | 0 | 0.00% | 0 | 0.00% | 1 | 0.01% | 1 |
| 4047 | mitochondrial D-loop (isolate RomB15) | AJ230609.1 | 0 | 0.00% | 0 | 0.00% | 1 | 0.01% | 0 | 0.00% | 1 |
| 4048 | mitochondrial DNA complete genome | X93334.1 | 1 | 0.01% | 0 | 0.00% | 0 | 0.00% | 0 | 0.00% | 1 |
| 4049 | mitochondrial DNA, | D38112.1 | 0 | 0.00% | 1 | 0.01% | 0 | 0.00% | 0 | 0.00% | 1 |
| 4050 | mitochondrial genes coding for three transfer RN | V00665 | 0 | 0.00% | 0 | 0.00% | 1 | 0.01% | 0 | 0.00% | 1 |
| 4051 | mitochondrial glutathione reductase and cytosoli | AF228703.1 | 1 | 0.01% | 0 | 0.00% | 0 | 0.00% | 0 | 0.00% | 1 |
| 4052 | mitochondrial HSP75 | L15189 | 0 | 0.00% | 0 | 0.00% | 0 | 0.00% | 1 | 0.01% | 1 |
| 4053 | mitochondrial initiation factor 2 | L34600 | 0 | 0.00% | 0 | 0.00% | 1 | 0.01% | 0 | 0.00% | 1 |
| 4054 | mitochondrial intermediate peptidase (MIPEP), r | NM_005932.1 | 0 | 0.00% | 0 | 0.00% | 0 | 0.00% | 1 | 0.01% | 1 |
| 4055 | MITOCHONDRIAL PROCESSING PEPTIDASE | spO75439 | 0 | 0.00% | 0 | 0.00% | 0 | 0.00% | 1 | 0.01% | 1 |
| 4056 | mitochondrial processing peptidase beta-subunit | AF054182 | 0 | 0.00% | 0 | 0.00% | 1 | 0.01% | 0 | 0.00% | 1 |
| 4057 | mitochondrial solute carrier (LOC51312) | XM_040570.1 | 1 | 0.01% | 0 | 0.00% | 0 | 0.00% | 0 | 0.00% | 1 |
| 4058 | NAD(P)H: quinone oxireductase gene | M81600.1 | 0 | 0.00% | 1 | 0.01% | 0 | 0.00% | 0 | 0.00% | 1 |
| 4059 | NADH dehydrogenase (ubiquinone) 1 beta subc | gi4758781 | 1 | 0.01% | 0 | 0.00% | 0 | 0.00% | 0 | 0.00% | 1 |
| 4060 | NADH dehydrogenase (ubiquinone) Fe-Sprotein | NP_002486.1 | 0 | 0.00% | 1 | 0.01% | 0 | 0.00% | 0 | 0.00% | 1 |
| 4061 | NADH dehydrogenase subunit 3(RefSeq aa 8e-3 | gi5835395 | 0 | 0.00% | 1 | 0.01% | 0 | 0.00% | 0 | 0.00% | 1 |
| 4062 | NADH dehydrogenase subunit 5 (RefSeq aa 3e- | gi5835398 | 0 | 0.00% | 1 | 0.01% | 0 | 0.00% | 0 | 0.00% | 1 |
| 4063 | NADH dehydrogenase(ubiquinone) 1 alpha subc | NM_004544.1 | 0 | 0.00% | 1 | 0.01% | 0 | 0.00% | 0 | 0.00% | 1 |
| 4064 | NADH:ubiquinone oxidoreductase MLRQ subuni | AF164796.1 | 1 | 0.01% | 0 | 0.00% | 0 | 0.00% | 0 | 0.00% | 1 |
| 4065 | NADH:ubiquinone oxidoreductase NDUFS3 (OR | AF067139 | 0 | 0.00% | 0 | 0.00% | 1 | 0.01% | 0 | 0.00% | 1 |
| 4066 | NADH-cytochrome b5 reductase isoform | AF125533.1 | 0 | 0.00% | 1 | 0.01% | 0 | 0.00% | 0 | 0.00% | 1 |
| 4067 | NADH-UBIQUINONE OXIDOREDUCTASE 18 K | spO43181 | 0 | 0.00% | 0 | 0.00% | 0 | 0.00% | 1 | 0.01% | 1 |
| 4068 | NADH-UBIQUINONE OXIDOREDUCTASE 30 K | P23709 | 0 | 0.00% | 0 | 0.00% | 0 | 0.00% | 1 | 0.01% | 1 |
| 4069 | NADH-UBIQUINONE OXIDOREDUCTASE B17 | spQ29259 | 1 | 0.01% | 0 | 0.00% | 0 | 0.00% | 0 | 0.00% | 1 |
| 4070 | NADH-ubiquinone oxidoreductase B8 subunit m | AF077029 | 0 | 0.00% | 0 | 0.00% | 0 | 0.00% | 1 | 0.01% | 1 |
| 4071 | NADH-UBIQUINONE OXIDOREDUCTASE CHA | P03897 | 1 | 0.01% | 0 | 0.00% | 0 | 0.00% | 0 | 0.00% | 1 |
| 4072 | NADH-UBIQUINONE OXIDOREDUCTASE CHA | P03915 | 0 | 0.00% | 1 | 0.01% | 0 | 0.00% | 0 | 0.00% | 1 |
| 4073 | NADH-UBIQUINONE OXIDOREDUCTASE MWI | spO15239 | 0 | 0.00% | 0 | 0.00% | 0 | 0.00% | 1 | 0.01% | 1 |
| 4074 | NADH-ubiquinone oxidoreductase subunit B14.5 | AF070652.1 | 0 | 0.00% | 1 | 0.01% | 0 | 0.00% | 0 | 0.00% | 1 |
| 4075 | NADH-ubiquinone oxidoreductase subunit CI-B8 | AF047185 | 1 | 0.01% | 0 | 0.00% | 0 | 0.00% | 0 | 0.00% | 1 |
| 4076 | NADPH-flavin reductase | D26308 | 1 | 0.01% | 0 | 0.00% | 0 | 0.00% | 0 | 0.00% | 1 |
| 4077 | NDUFB8 gene | Y16004.1 | 0 | 0.00% | 1 | 0.01% | 0 | 0.00% | 0 | 0.00% | 1 |
| 4078 | NRH:quinone oxidoreductase 2 gene (NQO2) | AB050248.1 | 0 | 0.00% | 1 | 0.01% | 0 | 0.00% | 0 | 0.00% | 1 |
| 4079 | nuclear aconitase (mitochondrial) | U80040 | 1 | 0.01% | 0 | 0.00% | 0 | 0.00% | 0 | 0.00% | 1 |
| 4080 | p6=cytochrome c oxidase subunit VIc homolog/( | S82616 | 0 | 0.00% | 0 | 0.00% | 1 | 0.01% | 0 | 0.00% | 1 |
| 4081 | quinolinate phosphoribosyltransferase (nicotinat | NM_014298.2 | 0 | 0.00% | 1 | 0.01% | 0 | 0.00% | 0 | 0.00% | 1 |
| 4082 | succinate dehydrogenase iron-protein subunit (s | U17248.1 | 1 | 0.01% | 0 | 0.00% | 0 | 0.00% | 0 | 0.00% | 1 |
| 4083 | Succinic semialdehyde dehydrogenase (SSADH | NM_001080.1 | 1 | 0.01% | 0 | 0.00% | 0 | 0.00% | 0 | 0.00% | 1 |
| 4084 | succinyl-CoA synthetase GTP-specific beta sub | AF171077.1 | 0 | 0.00% | 0 | 0.00% | 1 | 0.01% | 0 | 0.00% | 1 |
| 4085 | UBIQUINOL-CYTOCHROME C REDUCTASE C | spO14949 | 0 | 0.00% | 0 | 0.00% | 0 | 0.00% | 1 | 0.01% | 1 |
| 4086 | beacon | AAG34704.1 | 0 | 0.00% | 1 | 0.01% | 0 | 0.00% | 0 | 0.00% | 1 |
| 4087 | biotinidase | U03274 | 0 | 0.00% | 0 | 0.00% | 0 | 0.00% | 1 | 0.01% | 1 |
| 4088 | dihydroxypolyprenylbenzoate methyltransferase | L20427 | 1 | 0.01% | 0 | 0.00% | 0 | 0.00% | 0 | 0.00% | 1 |
| 4089 | folylpolyglutamate synthase (FPGS) mRNA | NM_004957.1 | 1 | 0.01% | 0 | 0.00% | 0 | 0.00% | 0 | 0.00% | 1 |
| 4090 | isolate sporadic PCT patient 10 uroporphyrinoge | AF104440.1 | 1 | 0.01% | 0 | 0.00% | 0 | 0.00% | 0 | 0.00% | 1 |
| 4091 | non-functional folate binding protein | NP_037439.1 | 0 | 0.00% | 0 | 0.00% | 0 | 0.00% | 1 | 0.01% | 1 |
| 4092 | nonfunctional GM3 synthase | AF119417.1 | 0 | 0.00% | 1 | 0.01% | 0 | 0.00% | 0 | 0.00% | 1 |
| 4093 | Porphobilinogen deaminase (PBG-D, EC 4.3.1.8 | X04217.1 | 1 | 0.01% | 0 | 0.00% | 0 | 0.00% | 0 | 0.00% | 1 |
| 4094 | pterin-4a-carbinolamine dehydratase (PCBD) (=I | L41559 | 1 | 0.01% | 0 | 0.00% | 0 | 0.00% | 0 | 0.00% | 1 |
| 4095 | nonhepatic arginase | D86724.1 | 0 | 0.00% | 0 | 0.00% | 0 | 0.00% | 1 | 0.01% | 1 |
| 4096 | 6-pyruvoyltetrahydropterin synthase(RefSeq aa | NP_000308.1 | 0 | 0.00% | 1 | 0.01% | 0 | 0.00% | 0 | 0.00% | 1 |
| 4097 | amine oxidase, copper containing 3 (vascular ad | NM_003734.2 | 0 | 0.00% | 0 | 0.00% | 1 | 0.01% | 0 | 0.00% | 1 |
| 4098 | Arg/Abl-interacting protein ArgBP2a (ArgBP2a) ( | AF049884 | 1 | 0.01% | 0 | 0.00% | 0 | 0.00% | 0 | 0.00% | 1 |
| 4099 | ArgBPIB protein (=Arg protein tyrosine kinase-bi | X95677.1 | 0 | 0.00% | 1 | 0.01% | 0 | 0.00% | 0 | 0.00% | 1 |
| 4100 | arginine methyltransferase | Y10806 | 1 | 0.01% | 0 | 0.00% | 0 | 0.00% | 0 | 0.00% | 1 |
| 4101 | aspartate aminotransferase 1 (RefSeq aa 1e-51) | NP_002070.1 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 73 of 102

| | | | | | | | | | | |
|---|---|---|---|---|---|---|---|---|---|---|
| 4102 | basic leucine zipper nuclear factor 1 (JEM-1) (Bl | NM_003666.1 | 1 | 0.01% | 1 | 0.01% | 0 | 0.00% | 0 | 0.00% | 1 |
| 4103 | colon and small intestine-specific cysteine-rich p | Hs.307047 | 0 | 0.00% | 0 | 0.00% | 1 | 0.01% | 0 | 0.00% | 1 |
| 4104 | cytidine deaminase | AF061658.1 | 0 | 0.00% | 1 | 0.01% | 0 | 0.00% | 0 | 0.00% | 1 |
| 4105 | DHHC1 protein | AF247703.1 | 1 | 0.01% | 0 | 0.00% | 0 | 0.00% | 0 | 0.00% | 1 |
| 4106 | dipeptidyl peptidase IV (CD26) | U13735.1 | 0 | 0.00% | 0 | 0.00% | 0 | 0.00% | 1 | 0.01% | 1 |
| 4107 | duodenal cytochrome b (FLJ23462), mRNA | XM_015916.2 | 1 | 0.01% | 0 | 0.00% | 0 | 0.00% | 0 | 0.00% | 1 |
| 4108 | extremely cysteine/valine rich protein [Leishman | AL390114 | 0 | 0.00% | 1 | 0.01% | 0 | 0.00% | 0 | 0.00% | 1 |
| 4109 | fucosidase, alpha-L- 1, tissue (FUCA1) | gi4503802 | 0 | 0.00% | 0 | 0.00% | 1 | 0.01% | 0 | 0.00% | 1 |
| 4110 | fumarase nuclear gene encoding mitochondrial p | U48857.1 | 1 | 0.01% | 0 | 0.00% | 0 | 0.00% | 0 | 0.00% | 1 |
| 4111 | fumarase precursor (FH) (mitochondrial) | U59309 | 0 | 0.00% | 0 | 0.00% | 0 | 0.00% | 1 | 0.01% | 1 |
| 4112 | gamma-glutamyl hydrolase (conjugase, folylpoly | XM_005313.4 | 1 | 0.01% | 0 | 0.00% | 0 | 0.00% | 0 | 0.00% | 1 |
| 4113 | glutaminase isoform C mRNA, 3'UTR | AF097494.1 | 0 | 0.00% | 1 | 0.01% | 0 | 0.00% | 0 | 0.00% | 1 |
| 4114 | glutaminyl-peptide cyclotransferase (glutaminyl c | Hs.79033 | 0 | 0.00% | 0 | 0.00% | 0 | 0.00% | 1 | 0.01% | 1 |
| 4115 | glycine C-acetyltransferase (2-amino-3-ketobuty | NM_014291.1 | 0 | 0.00% | 1 | 0.01% | 0 | 0.00% | 0 | 0.00% | 1 |
| 4116 | glycine cleavage system protein H (aminomethy | NP_004474.1 | 1 | 0.01% | 1 | 0.01% | 0 | 0.00% | 0 | 0.00% | 1 |
| 4117 | glycine-rich protein 2 | AJ130887 | 1 | 0.01% | 0 | 0.00% | 0 | 0.00% | 0 | 0.00% | 1 |
| 4118 | glycosylasparaginase (=X55330;M64073) | X55762 | 1 | 0.01% | 0 | 0.00% | 0 | 0.00% | 0 | 0.00% | 1 |
| 4119 | glycosyltransferase (LOC83468) | XM_049187.2 | 1 | 0.01% | 0 | 0.00% | 0 | 0.00% | 0 | 0.00% | 1 |
| 4120 | H-protein | M69175 | 0 | 0.00% | 0 | 0.00% | 0 | 0.00% | 1 | 0.01% | 1 |
| 4121 | HPV16 E1 protein binding protein | U96131.1 | 1 | 0.01% | 0 | 0.00% | 0 | 0.00% | 0 | 0.00% | 1 |
| 4122 | HPV-16 E2 binding protein (E2BP-1) (=TCFL5) | AF070992.1 | 0 | 0.00% | 1 | 0.01% | 0 | 0.00% | 0 | 0.00% | 1 |
| 4123 | isoleucyl-tRNA synthetase | D28473 | 1 | 0.01% | 0 | 0.00% | 0 | 0.00% | 0 | 0.00% | 1 |
| 4124 | isovaleryl-CoA dehydrogenase (IVD) gene, exon | AF038318.1 | 0 | 0.00% | 1 | 0.01% | 0 | 0.00% | 0 | 0.00% | 1 |
| 4125 | Kreisler (mouse) maf-related leucine zipper hom | NM_005461.1 | 0 | 0.00% | 1 | 0.01% | 0 | 0.00% | 0 | 0.00% | 1 |
| 4126 | kynurenine 3-monooxygenase (kynurenine 3-hyd | NM_003679.1 | 0 | 0.00% | 0 | 0.00% | 1 | 0.01% | 0 | 0.00% | 1 |
| 4127 | lacrimal proline rich protein (RefSeq aa 2e-78) | NP_009175.1 | 0 | 0.00% | 1 | 0.01% | 0 | 0.00% | 0 | 0.00% | 1 |
| 4128 | L-arginine:glycine amidinotransferase | X86401 | 0 | 0.00% | 0 | 0.00% | 0 | 0.00% | 1 | 0.01% | 1 |
| 4129 | Leu zipper protein p40(61%) | gi\|382917 | 0 | 0.00% | 0 | 0.00% | 1 | 0.01% | 0 | 0.00% | 1 |
| 4130 | leucine zipper protein Fip3p (=AF074382 IkB kin | AF062089 | 1 | 0.01% | 0 | 0.00% | 0 | 0.00% | 0 | 0.00% | 1 |
| 4131 | leucine-zipper protein FKSG13 (LOC90598) | XM_032849.1 | 1 | 0.01% | 0 | 0.00% | 0 | 0.00% | 0 | 0.00% | 1 |
| 4132 | lysosomal glycosylasparaginase (AGA) (=X5533 | U21281.1 | 0 | 0.00% | 0 | 0.00% | 0 | 0.00% | 1 | 0.01% | 1 |
| 4133 | MBIP protein (MBIP) | NM_016586.1 | 0 | 0.00% | 1 | 0.01% | 0 | 0.00% | 0 | 0.00% | 1 |
| 4134 | methionine adenosyltransferase regulatory beta | AF182814 | 0 | 0.00% | 0 | 0.00% | 0 | 0.00% | 1 | 0.01% | 1 |
| 4135 | methionyl tRNA synthetase | D84224 | 0 | 0.00% | 1 | 0.01% | 0 | 0.00% | 0 | 0.00% | 1 |
| 4136 | methyl-CpG binding domain protein 3 (MBD3) | NM_003926.4 | 1 | 0.01% | 0 | 0.00% | 0 | 0.00% | 0 | 0.00% | 1 |
| 4137 | mitochondrial isoleucine tRNA synthetase, | D28500.1 | 1 | 0.01% | 1 | 0.01% | 0 | 0.00% | 0 | 0.00% | 1 |
| 4138 | ornithine decarboxylase (contains Alu repeat) | M33764 | 0 | 0.00% | 0 | 0.00% | 1 | 0.01% | 0 | 0.00% | 1 |
| 4139 | ornithine decarboxylase antizyme 2 (OAZ2) | NM_002537.1 | 0 | 0.00% | 1 | 0.01% | 0 | 0.00% | 0 | 0.00% | 1 |
| 4140 | orotidine 5'-monophosphate decarboxylase | M36661 | 0 | 0.00% | 0 | 0.00% | 0 | 0.00% | 1 | 0.01% | 1 |
| 4141 | periodic tryptophan protein 2 (PWP2) | U56085 | 1 | 0.01% | 0 | 0.00% | 0 | 0.00% | 0 | 0.00% | 1 |
| 4142 | polyglutamine-containing C14ORF4 gene | AJ277365.1 | 0 | 0.00% | 1 | 0.01% | 0 | 0.00% | 0 | 0.00% | 1 |
| 4143 | proline isomerase FK506-binding protein (FKBP | L18980.1 | 1 | 0.01% | 0 | 0.00% | 0 | 0.00% | 0 | 0.00% | 1 |
| 4144 | pyrroline-5-carboxylate synthase long form (P5C | U76542.1 | 0 | 0.00% | 0 | 0.00% | 1 | 0.01% | 0 | 0.00% | 1 |
| 4145 | selenium binding protein 1 (RefSeq aa 8e-40) | NP_003935.1 | 0 | 0.00% | 1 | 0.01% | 0 | 0.00% | 0 | 0.00% | 1 |
| 4146 | selenocysteine lyase (SCLY) | NM_016510.1 | 1 | 0.01% | 0 | 0.00% | 0 | 0.00% | 0 | 0.00% | 1 |
| 4147 | serine (or cysteine) proteinase inhibitor, clade H | XM_035024.2 | 1 | 0.01% | 0 | 0.00% | 0 | 0.00% | 0 | 0.00% | 1 |
| 4148 | serine carboxypeptidase 1 precursor protein (HS | NM_021626.1 | 0 | 0.00% | 1 | 0.01% | 0 | 0.00% | 0 | 0.00% | 1 |
| 4149 | spermine synthase gene | AJ009633.1 | 0 | 0.00% | 0 | 0.00% | 0 | 0.00% | 1 | 0.01% | 1 |
| 4150 | suppressor of S. cerevisiae gcr2 (HSGT1) | NM_007265.1 | 1 | 0.01% | 0 | 0.00% | 0 | 0.00% | 0 | 0.00% | 1 |
| 4151 | BCS1 (yeast homolog)-like (BCS1L) | AF026849 | 1 | 0.01% | 0 | 0.00% | 0 | 0.00% | 0 | 0.00% | 1 |
| 4152 | SCAD gene, 5' UTR exon 1 and 2 (and joined C | Z80345.1 | 0 | 0.00% | 0 | 0.00% | 1 | 0.01% | 0 | 0.00% | 1 |
| 4153 | selenoprotein N | AF166125.1 | 1 | 0.01% | 0 | 0.00% | 0 | 0.00% | 0 | 0.00% | 1 |
| 4154 | selenoprotein X (LOC51734) | NM_016332.1 | 1 | 0.01% | 0 | 0.00% | 0 | 0.00% | 0 | 0.00% | 1 |
| 4155 | LENG5 protein (LENG5), mRNA | NM_024075.1 | 1 | 0.01% | 1 | 0.01% | 0 | 0.00% | 0 | 0.00% | 1 |
| 4156 | cap-binding protein 4EHP | AF047695 | 1 | 0.01% | 0 | 0.00% | 0 | 0.00% | 0 | 0.00% | 1 |
| 4157 | elongin B; transcription elongation factor B, poly | NP_009039.1 | 0 | 0.00% | 1 | 0.01% | 0 | 0.00% | 0 | 0.00% | 1 |
| 4158 | eukaryotic initiation factor 2B-epsilon | U23028.1 | 0 | 0.00% | 0 | 0.00% | 1 | 0.01% | 0 | 0.00% | 1 |

Figure 6 - Unique Known Genes Identified in Four cDNA Cartilage Libraries and EST Frequency Analysis - Page 74 of 102

| | | | | | | | | | | |
|---|---|---|---|---|---|---|---|---|---|---|
| 4159 | eukaryotic translation initiation factor (eIF3) | U78525 | 1 | 0.01% | 0 | 0.00% | 0 | 0.00% | 0 | 0.00% | 1 |
| 4160 | eukaryotic translation initiation factor 1A (RefSeq | NP_001403.1 | 0 | 0.00% | 1 | 0.01% | 0 | 0.00% | 0 | 0.00% | 1 |
| 4161 | eukaryotic translation initiation factor 3, subunit 5 | NM_003754.1 | 0 | 0.00% | 0 | 0.00% | 1 | 0.01% | 0 | 0.00% | 1 |
| 4162 | eukaryotic translation initiation factor 3, subunit 8 | NM_003752.2 | 1 | 0.01% | 0 | 0.00% | 0 | 0.00% | 0 | 0.00% | 1 |
| 4163 | eukaryotic translation initiation factor 3, subunit 9 | NM_003751.1 | 1 | 0.01% | 0 | 0.00% | 0 | 0.00% | 0 | 0.00% | 1 |
| 4164 | eukaryotic translation initiation factor 4 gamma, | NM_003760.2 | 0 | 0.00% | 1 | 0.01% | 0 | 0.00% | 0 | 0.00% | 1 |
| 4165 | hydatidiform mole associated and imprinted (HY | AF241534.1 | 0 | 0.00% | 1 | 0.01% | 0 | 0.00% | 0 | 0.00% | 1 |
| 4166 | initiation factor eIF-2B gamma subunit (eIF-2B g | U38253.1 | 0 | 0.00% | 0 | 0.00% | 0 | 0.00% | 1 | 0.01% | 1 |
| 4167 | MAMMA1 cDNA clone MAMMA1001942 5 | AU122237.1 | 0 | 0.00% | 1 | 0.01% | 0 | 0.00% | 0 | 0.00% | 1 |
| 4168 | met-tRNA-i gene 2 (clone lambda-htm2) | J00311 | 0 | 0.00% | 0 | 0.00% | 0 | 0.00% | 1 | 0.01% | 1 |
| 4169 | peptide elongation factor 1-beta mRNA, complet | AF103726 | 1 | 0.01% | 0 | 0.00% | 0 | 0.00% | 0 | 0.00% | 1 |
| 4170 | region containing eukaryotic translation elongatic | XM_016036.1 | 0 | 0.00% | 0 | 0.00% | 1 | 0.01% | 0 | 0.00% | 1 |
| 4171 | translation initiation factor 4e | AF038957.1 | 1 | 0.01% | 0 | 0.00% | 0 | 0.00% | 0 | 0.00% | 1 |
| 4172 | translation repressor NAT1 (=eukaryotic translati | U76111.1 | 0 | 0.00% | 0 | 0.00% | 0 | 0.00% | 1 | 0.01% | 1 |
| 4173 | unr-interacting protein | AJ010025.1 | 0 | 0.00% | 0 | 0.00% | 0 | 0.00% | 1 | 0.01% | 1 |
| 4174 | 838.98 23S ribosomal RNA gene | AF146762.1 | 0 | 0.00% | 0 | 0.00% | 0 | 0.00% | 1 | 0.01% | 1 |
| 4175 | GAR1 protein (GAR1 gene) | AJ276003.1 | 0 | 0.00% | 0 | 0.00% | 1 | 0.01% | 0 | 0.00% | 1 |
| 4176 | mitochondrial ribosomal protein L11 (MRPL11) | XM_006493.4 | 1 | 0.01% | 0 | 0.00% | 0 | 0.00% | 0 | 0.00% | 1 |
| 4177 | mitochondrial ribosomal protein L18 (MRPL18), | Hs.23038 | 0 | 0.00% | 0 | 0.00% | 0 | 0.00% | 1 | 0.01% | 1 |
| 4178 | mitochondrial ribosomal protein L22 (MRPL22), | Hs.41007 | 0 | 0.00% | 0 | 0.00% | 0 | 0.00% | 1 | 0.01% | 1 |
| 4179 | mitochondrial ribosomal protein L3 (MRPL3), mR | Hs.79086 | 0 | 0.00% | 0 | 0.00% | 0 | 0.00% | 1 | 0.01% | 1 |
| 4180 | mitochondrial ribosomal protein L33 (MRPL33), | Hs.14454 | 0 | 0.00% | 0 | 0.00% | 0 | 0.00% | 1 | 0.01% | 1 |
| 4181 | mitochondrial ribosomal protein S12 | Y11681 | 1 | 0.01% | 0 | 0.00% | 0 | 0.00% | 0 | 0.00% | 1 |
| 4182 | mitochondrial ribosomal protein S21 (MRPS21), | Hs.81281 | 0 | 0.00% | 0 | 0.00% | 1 | 0.01% | 0 | 0.00% | 1 |
| 4183 | mitochondrial ribosomal protein S30 (MRPS30), | Hs.28555 | 0 | 0.00% | 0 | 0.00% | 0 | 0.00% | 1 | 0.01% | 1 |
| 4184 | ribosomal L21 protein gene | L38826.1 | 0 | 0.00% | 1 | 0.01% | 0 | 0.00% | 0 | 0.00% | 1 |
| 4185 | ribosomal protein (RPS4Y) isoform | M58459 | 1 | 0.01% | 0 | 0.00% | 0 | 0.00% | 0 | 0.00% | 1 |
| 4186 | ribosomal protein 60S acidic ribosomal | NM_016183.1 | 0 | 0.00% | 1 | 0.01% | 0 | 0.00% | 0 | 0.00% | 1 |
| 4187 | ribosomal protein L17 isolog | AF164797 | 0 | 0.00% | 0 | 0.00% | 1 | 0.01% | 0 | 0.00% | 1 |
| 4188 | ribosomal protein L20 | AE002038 | 0 | 0.00% | 0 | 0.00% | 0 | 0.00% | 1 | 0.01% | 1 |
| 4189 | ribosomal protein LLRep3 | X17206 | 1 | 0.01% | 0 | 0.00% | 0 | 0.00% | 0 | 0.00% | 1 |
| 4190 | ribosomal protein, complete cds | D23660.1 | 0 | 0.00% | 1 | 0.01% | 0 | 0.00% | 0 | 0.00% | 1 |
| 4191 | ribosomal RNA 12S | X13956 | 1 | 0.01% | 0 | 0.00% | 0 | 0.00% | 0 | 0.00% | 1 |
| 4192 | ribosomal RNA 23S gene | AF146762 | 0 | 0.00% | 0 | 0.00% | 0 | 0.00% | 1 | 0.01% | 1 |
| 4193 | ribosomal RNA 28S | M30952.1 | 0 | 0.00% | 0 | 0.00% | 1 | 0.01% | 0 | 0.00% | 1 |
| 4194 | Ribosomal RNA processing | NM_014285.1 | 0 | 0.00% | 1 | 0.01% | 0 | 0.00% | 0 | 0.00% | 1 |
| 4195 | ribosomal RNA, large subunit ATCC 46578 | U17421 | 0 | 0.00% | 0 | 0.00% | 0 | 0.00% | 1 | 0.01% | 1 |
| 4196 | ribosomal subunit protein L13 | AE000402 | 0 | 0.00% | 0 | 0.00% | 1 | 0.01% | 0 | 0.00% | 1 |
| 4197 | ribosome associated membrane protein RAMP4 | AJ238236.1 | 0 | 0.00% | 0 | 0.00% | 0 | 0.00% | 1 | 0.01% | 1 |
| 4198 | ribosome receptor, p180 | X87224 | 1 | 0.01% | 0 | 0.00% | 0 | 0.00% | 0 | 0.00% | 1 |
| 4199 | RPL15 gene for ribosomal protein L15, complete | AB061823.1 | 1 | 0.01% | 0 | 0.00% | 0 | 0.00% | 0 | 0.00% | 1 |
| 4200 | RPL6 gene for ribosomal protein L6, complete c | AB042820.1 | 0 | 0.00% | 1 | 0.01% | 0 | 0.00% | 0 | 0.00% | 1 |
| 4201 | STEROL-REGULATORY ELEMENT-BINDING F | spO43462 | 0 | 0.00% | 0 | 0.00% | 0 | 0.00% | 1 | 0.01% | 1 |
| 4202 | surf3 gene (ribosomal protein L7a) | X61923.1 | 0 | 0.00% | 1 | 0.01% | 0 | 0.00% | 0 | 0.00% | 1 |
| 4203 | acid sphingomyelinase (ASM) gene, exons a, an | M59917 | 0 | 0.00% | 0 | 0.00% | 1 | 0.01% | 0 | 0.00% | 1 |
| 4204 | ADAMTS-1 | AB001735 | 0 | 0.00% | 0 | 0.00% | 0 | 0.00% | 1 | 0.01% | 1 |
| 4205 | amyloid precursor protein homolog HSD-2 | AF168956.1 | 0 | 0.00% | 0 | 0.00% | 0 | 0.00% | 1 | 0.01% | 1 |
| 4206 | amyloid precursor protein-binding protein 1 | U50939 | 0 | 0.00% | 1 | 0.01% | 0 | 0.00% | 0 | 0.00% | 1 |
| 4207 | antileukoprotease (ALP) | X04470 | 1 | 0.01% | 0 | 0.00% | 0 | 0.00% | 0 | 0.00% | 1 |
| 4208 | basigin (BSG)(= M6 antigen) | NM_001728.1 | 1 | 0.01% | 0 | 0.00% | 0 | 0.00% | 0 | 0.00% | 1 |
| 4209 | CARBOXYPEPTIDASE H PRECURSOR (CPH) | spP16870 | 0 | 0.00% | 0 | 0.00% | 1 | 0.01% | 0 | 0.00% | 1 |
| 4210 | carboxypeptidase Z (CPZ) | NM_003652.1 | 1 | 0.01% | 0 | 0.00% | 0 | 0.00% | 0 | 0.00% | 1 |
| 4211 | cathepsin S (CTSS) | M90696.1 | 0 | 0.00% | 0 | 0.00% | 1 | 0.01% | 0 | 0.00% | 1 |
| 4212 | cathepsin Z precursor (CTSZ) gene, exons 4, 5, | AF136276.1 | 0 | 0.00% | 0 | 0.00% | 0 | 0.00% | 1 | 0.01% | 1 |
| 4213 | collagenase stimulatory factor (EMMPRIN) (=L2 | L10240 | 1 | 0.01% | 0 | 0.00% | 0 | 0.00% | 0 | 0.00% | 1 |
| 4214 | cysteine sulfinic acid decarboxylase-related prot | AF116548.1 | 0 | 0.00% | 1 | 0.01% | 0 | 0.00% | 0 | 0.00% | 1 |
| 4215 | ENO2 gene for neuron specific (gamma) enolase | X51956.1 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 75 of 102

| | | | | | | | | | | | |
|---|---|---|---|---|---|---|---|---|---|---|---|
| 4216 | inhibitor 2 of protein phosphatase 1 | AJ133812.1 | 0 | 0.00% | 0 | 0.00% | 0 | 0.00% | 1 | 0.01% | 1 |
| 4217 | matrix metalloproteinase 19 (MMP19) | NM_002429.1 | 1 | 0.01% | 0 | 0.00% | 0 | 0.00% | 0 | 0.00% | 1 |
| 4218 | metallocarboxypeptidase CPX-1 | AF077738 | 1 | 0.01% | 0 | 0.00% | 0 | 0.00% | 0 | 0.00% | 1 |
| 4219 | metalloproteinase, complete cds | D83646.1 | 0 | 0.00% | 0 | 0.00% | 0 | 0.00% | 1 | 0.01% | 1 |
| 4220 | pancreatic carboxypeptidase B1precursor (RefS | NP_001862.1 | 0 | 0.00% | 1 | 0.01% | 0 | 0.00% | 0 | 0.00% | 1 |
| 4221 | parvulin | AB009690.1 | 0 | 0.00% | 0 | 0.00% | 1 | 0.01% | 0 | 0.00% | 1 |
| 4222 | peflin (PEF) | NM_012392.1 | 0 | 0.00% | 1 | 0.01% | 0 | 0.00% | 0 | 0.00% | 1 |
| 4223 | peptidase (mitochondrial processing) beta (PMP | XM_055749.1 | 1 | 0.01% | 0 | 0.00% | 0 | 0.00% | 0 | 0.00% | 1 |
| 4224 | peptidase D (PEPD) =J04605, prolidase(imidodi | NM_000285.1 | 0 | 0.00% | 0 | 0.00% | 0 | 0.00% | 1 | 0.01% | 1 |
| 4225 | placental leucine aminopeptidase | D50810.1 | 1 | 0.01% | 0 | 0.00% | 0 | 0.00% | 0 | 0.00% | 1 |
| 4226 | procollagen C-proteinase enhancer protein type | AB008549.1 | 0 | 0.00% | 1 | 0.01% | 0 | 0.00% | 0 | 0.00% | 1 |
| 4227 | procollagen type I proalpha 1 | K01228.1 | 0 | 0.00% | 1 | 0.01% | 0 | 0.00% | 0 | 0.00% | 1 |
| 4228 | procollagen type I pro-alpha 2 chain (COL1A2) r | AF035120 | 1 | 0.01% | 0 | 0.00% | 0 | 0.00% | 0 | 0.00% | 1 |
| 4229 | prostasin | U33446 | 0 | 0.00% | 0 | 0.00% | 1 | 0.01% | 0 | 0.00% | 1 |
| 4230 | protease inhibitor 1 (anti-elastase),alpha-1-antitr | NP_000286.1 | 0 | 0.00% | 1 | 0.01% | 0 | 0.00% | 0 | 0.00% | 1 |
| 4231 | protease inhibitor 9 (ovalbumin type)(RefSeq aa | NP_004146.1 | 0 | 0.00% | 1 | 0.01% | 0 | 0.00% | 0 | 0.00% | 1 |
| 4232 | protease subunit S5a (=U72664 S5a/antiseCRet | U51007 | 1 | 0.01% | 0 | 0.00% | 0 | 0.00% | 0 | 0.00% | 1 |
| 4233 | protease, serine, 15 (PRSS15) (=Lon protease) | NM_004793.1 | 1 | 0.01% | 0 | 0.00% | 0 | 0.00% | 0 | 0.00% | 1 |
| 4234 | proteasome (prosome, macropain) 26S subunit, | NM_006503.1 | 1 | 0.01% | 0 | 0.00% | 0 | 0.00% | 0 | 0.00% | 1 |
| 4235 | proteasome (prosome, macropain) 26S subunit, | NM_002814.1 | 0 | 0.00% | 1 | 0.01% | 0 | 0.00% | 0 | 0.00% | 1 |
| 4236 | proteasome (prosome, macropain) 26S subunit, | NM_002811.1 | 1 | 0.01% | 0 | 0.00% | 0 | 0.00% | 0 | 0.00% | 1 |
| 4237 | proteasome (prosome, macropain)activator subu | NP_002809.1 | 0 | 0.00% | 1 | 0.01% | 0 | 0.00% | 0 | 0.00% | 1 |
| 4238 | proteasome (prosome, macropain)subunit, alpha | NP_002777.1 | 0 | 0.00% | 1 | 0.01% | 0 | 0.00% | 0 | 0.00% | 1 |
| 4239 | proteasome (prosome, macropain)subunit, alpha | NP_002781.1 | 0 | 0.00% | 1 | 0.01% | 0 | 0.00% | 0 | 0.00% | 1 |
| 4240 | proteasome (prosome, macropain)subunit, beta | NP_002788.1 | 0 | 0.00% | 1 | 0.01% | 0 | 0.00% | 0 | 0.00% | 1 |
| 4241 | proteasome (prosome,maCRopain) 26S subunit, | NM_002807.1 | 0 | 0.00% | 0 | 0.00% | 1 | 0.01% | 0 | 0.00% | 1 |
| 4242 | proteasome (prosome,macropain) 26S subunit, r | NM_002813.1 | 0 | 0.00% | 1 | 0.01% | 0 | 0.00% | 0 | 0.00% | 1 |
| 4243 | PROTEASOME COMPONENT C3 (MACROPAI | spP25787 | 0 | 0.00% | 0 | 0.00% | 0 | 0.00% | 1 | 0.01% | 1 |
| 4244 | PROTEASOME COMPONENT C5 (MACROPAI | spP20618 | 0 | 0.00% | 0 | 0.00% | 0 | 0.00% | 1 | 0.01% | 1 |
| 4245 | proteasome inhibitor hPI31 subunit | D88378 | 1 | 0.01% | 0 | 0.00% | 0 | 0.00% | 0 | 0.00% | 1 |
| 4246 | proteasome subunit HsC7-I | D26599 | 0 | 0.00% | 0 | 0.00% | 1 | 0.01% | 0 | 0.00% | 1 |
| 4247 | proteasome subunit p3126S | D38047 | 1 | 0.01% | 0 | 0.00% | 0 | 0.00% | 0 | 0.00% | 1 |
| 4248 | proteasome subunit p44.5 26S | AB003102 | 1 | 0.01% | 0 | 0.00% | 0 | 0.00% | 0 | 0.00% | 1 |
| 4249 | proteasome subunit p58 | D67025 | 1 | 0.01% | 0 | 0.00% | 0 | 0.00% | 0 | 0.00% | 1 |
| 4250 | proteasome subunit p97 26S | D78151.1 | 1 | 0.01% | 0 | 0.00% | 0 | 0.00% | 0 | 0.00% | 1 |
| 4251 | protein arginine N-methyltransferase 1 (HRMT1L | AF222689 | 1 | 0.01% | 0 | 0.00% | 0 | 0.00% | 0 | 0.00% | 1 |
| 4252 | protein arginine N-methyltransferase 2 (PRMT2) | U80213 | 0 | 0.00% | 0 | 0.00% | 1 | 0.01% | 0 | 0.00% | 1 |
| 4253 | PROTEIN PLT | spQ02083 | 0 | 0.00% | 0 | 0.00% | 0 | 0.00% | 1 | 0.01% | 1 |
| 4254 | protein product (=AF125387) D.melanogaster L8 | AK000987 | 0 | 0.00% | 0 | 0.00% | 0 | 0.00% | 1 | 0.01% | 1 |
| 4255 | protein rapamycin associated protein (FRAP2) g | U88966.1 | 0 | 0.00% | 1 | 0.01% | 0 | 0.00% | 0 | 0.00% | 1 |
| 4256 | protein translocation complex beta (SEC61B) | NM_006808.1 | 0 | 0.00% | 1 | 0.01% | 0 | 0.00% | 0 | 0.00% | 1 |
| 4257 | proteinase chain 5a (non-exact 71%) 26S | NM_002810.1 | 1 | 0.01% | 0 | 0.00% | 0 | 0.00% | 0 | 0.00% | 1 |
| 4258 | serine protease, umbilical endothelium (SPUVE) | NM_007173.1 | 0 | 0.00% | 0 | 0.00% | 1 | 0.01% | 0 | 0.00% | 1 |
| 4259 | sorting nexin 10 (SNX10) | AF121860.1 | 0 | 0.00% | 0 | 0.00% | 0 | 0.00% | 1 | 0.01% | 1 |
| 4260 | sorting nexin 11 (SNX11) | NM_013323.1 | 1 | 0.01% | 0 | 0.00% | 0 | 0.00% | 0 | 0.00% | 1 |
| 4261 | stromelysin-3 | X57766 | 0 | 0.00% | 0 | 0.00% | 0 | 0.00% | 1 | 0.01% | 1 |
| 4262 | thimet oligopeptidase (metalloproteinase) (=U29 | Z50115 | 1 | 0.01% | 0 | 0.00% | 0 | 0.00% | 0 | 0.00% | 1 |
| 4263 | thrombin inhibitor | Z22658.1 | 0 | 0.00% | 0 | 0.00% | 1 | 0.01% | 0 | 0.00% | 1 |
| 4264 | TIMP-3 (=mig-5) (=K222) | D45917 | 0 | 0.00% | 0 | 0.00% | 1 | 0.01% | 0 | 0.00% | 1 |
| 4265 | tissue inhibitor of metalloproteinase 2 (TIMP2) | NM_003255.1 | 0 | 0.00% | 0 | 0.00% | 0 | 0.00% | 1 | 0.01% | 1 |
| 4266 | tissue inhibitor of metalloproteinase 4 (TIMP4) g | AF057532.1 | 0 | 0.00% | 0 | 0.00% | 0 | 0.00% | 1 | 0.01% | 1 |
| 4267 | tripeptidyl peptidase II (TPP2) | NM_003291.1 | 0 | 0.00% | 0 | 0.00% | 0 | 0.00% | 1 | 0.01% | 1 |
| 4268 | trypsin-like serine protease (TLSP) gene | AF164623.1 | 0 | 0.00% | 1 | 0.01% | 0 | 0.00% | 0 | 0.00% | 1 |
| 4269 | Ubc6p homolog | U93242.1 | 1 | 0.01% | 0 | 0.00% | 0 | 0.00% | 0 | 0.00% | 1 |
| 4270 | 33 polypeptide | X07266 | 0 | 0.00% | 0 | 0.00% | 1 | 0.01% | 0 | 0.00% | 1 |
| 4271 | BRCA1, Rho7 and vatl genes | L78833.1 | 0 | 0.00% | 0 | 0.00% | 0 | 0.00% | 1 | 0.01% | 1 |
| 4272 | BRCA1-associated RING domain protein (BARD | AF038042.1 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 76 of 102

| | | | | | | | | | | | |
|---|---|---|---|---|---|---|---|---|---|---|---|
| 4273 | chaperonin subunit 5 (epsilon) (Cct5) (=D43950. | gi6671701 | 1 | 0.01% | 0 | 0.00% | 0 | 0.00% | 0 | 0.00% | 1 |
| 4274 | deubiquitinating enzyme (UNPH4)= AF153604 u | AF106069 | 0 | 0.00% | 0 | 0.00% | 0 | 0.00% | 1 | 0.01% | 1 |
| 4275 | E1-E2 ATPase | AF155913.1 | 0 | 0.00% | 0 | 0.00% | 1 | 0.01% | 0 | 0.00% | 1 |
| 4276 | farnesy ltransferase,CAAX box, beta (FNTB) | NM_002028.1 | 0 | 0.00% | 1 | 0.01% | 0 | 0.00% | 0 | 0.00% | 1 |
| 4277 | F-box only protein 3 (FBXO3) | NM_012175.1 | 0 | 0.00% | 1 | 0.01% | 0 | 0.00% | 0 | 0.00% | 1 |
| 4278 | F-box only protein 9 (FBXO9), transcript variant | Hs.11050 | 0 | 0.00% | 0 | 0.00% | 0 | 0.00% | 1 | 0.01% | 1 |
| 4279 | F-box protein Fbl3a (ORF) | AF129532_1 | 0 | 0.00% | 0 | 0.00% | 0 | 0.00% | 1 | 0.01% | 1 |
| 4280 | F-box protein FBX11 | AF176706 | 0 | 0.00% | 0 | 0.00% | 0 | 0.00% | 1 | 0.01% | 1 |
| 4281 | F-box protein Fbx25 | AAF04526.1 | 0 | 0.00% | 0 | 0.00% | 1 | 0.01% | 0 | 0.00% | 1 |
| 4282 | F-box protein FBX29 (FBX29) | AF176707.1 | 0 | 0.00% | 1 | 0.01% | 0 | 0.00% | 0 | 0.00% | 1 |
| 4283 | F-box protein Lilina (LILINA) | AF179221.1 | 0 | 0.00% | 1 | 0.01% | 0 | 0.00% | 0 | 0.00% | 1 |
| 4284 | hkf-1 | D76444 | 1 | 0.01% | 0 | 0.00% | 0 | 0.00% | 0 | 0.00% | 1 |
| 4285 | huntingtin interacting protein HYPB | AF049610.1 | 1 | 0.01% | 0 | 0.00% | 0 | 0.00% | 0 | 0.00% | 1 |
| 4286 | huntingtin-interacting | AF049528 | 0 | 0.00% | 1 | 0.01% | 0 | 0.00% | 0 | 0.00% | 1 |
| 4287 | LUCA-15 protein splice variant | AF107493 | 0 | 0.00% | 1 | 0.01% | 0 | 0.00% | 0 | 0.00% | 1 |
| 4288 | miCRosomal signal peptidase complex (SPC 18 | J05466 | 1 | 0.01% | 0 | 0.00% | 0 | 0.00% | 0 | 0.00% | 1 |
| 4289 | MRS1 protein (MRS1) | NM_015368.1 | 1 | 0.01% | 0 | 0.00% | 0 | 0.00% | 0 | 0.00% | 1 |
| 4290 | myristoyl-CoA:protein N-myristoyltransferase | Y17208.1 | 0 | 0.00% | 1 | 0.01% | 0 | 0.00% | 0 | 0.00% | 1 |
| 4291 | Nedd-4-like ubiquitin-protein ligase (LOC116013 | XM_057201.1 | 1 | 0.01% | 0 | 0.00% | 0 | 0.00% | 0 | 0.00% | 1 |
| 4292 | neuronal calcium sensor (NCS-1) | L27421 | 1 | 0.01% | 0 | 0.00% | 0 | 0.00% | 0 | 0.00% | 1 |
| 4293 | N-myristoyltransferase 2 (NMT2) | NM_004808.1 | 0 | 0.00% | 0 | 0.00% | 0 | 0.00% | 1 | 0.01% | 1 |
| 4294 | paired basic amino acid cleaving enzyme (furin, | NM_002569.1 | 1 | 0.01% | 0 | 0.00% | 0 | 0.00% | 0 | 0.00% | 1 |
| 4295 | peptidylprolyl isomerase (cyclophilin)-like 3 (PPI | NM_032472.1 | 1 | 0.01% | 0 | 0.00% | 0 | 0.00% | 0 | 0.00% | 1 |
| 4296 | peptidylprolyl isomerase D (cyclophilin D) (PPID | Hs.143482 | 1 | 0.01% | 0 | 0.00% | 0 | 0.00% | 0 | 0.00% | 1 |
| 4297 | peroxisomal acyl-coenzyme A oxidase | S69189 | 1 | 0.01% | 0 | 0.00% | 0 | 0.00% | 0 | 0.00% | 1 |
| 4298 | PEROXISOMAL ANTIOXIDANT ENZYME (LIVE | spP30044 | 1 | 0.01% | 0 | 0.00% | 0 | 0.00% | 0 | 0.00% | 1 |
| 4299 | peroxisomal Ca-dependent solute carrier | AF004161 | 0 | 0.00% | 0 | 0.00% | 0 | 0.00% | 1 | 0.01% | 1 |
| 4300 | prolyl oligopeptidase | X74496 | 1 | 0.01% | 0 | 0.00% | 0 | 0.00% | 0 | 0.00% | 1 |
| 4301 | protein disulfide isomerase-related (PDIR) | NM_006810.1 | 0 | 0.00% | 0 | 0.00% | 1 | 0.01% | 0 | 0.00% | 1 |
| 4302 | protein gene product (PGP) 9.5 (=P09936 UBIQ | X04741 | 1 | 0.01% | 0 | 0.00% | 0 | 0.00% | 0 | 0.00% | 1 |
| 4303 | rapamycin- and FK506-binding protein | M75099.1 | 1 | 0.01% | 0 | 0.00% | 0 | 0.00% | 0 | 0.00% | 1 |
| 4304 | ribophorin I | Y00281 | 0 | 0.00% | 0 | 0.00% | 1 | 0.01% | 0 | 0.00% | 1 |
| 4305 | signal recognition particle 19kD (SRP19), mRNA | NM_003135.1 | 0 | 0.00% | 1 | 0.01% | 0 | 0.00% | 0 | 0.00% | 1 |
| 4306 | site-1 protease(subtilisin-like, sterol-regulated, c | NM_003791.1 | 0 | 0.00% | 0 | 0.00% | 1 | 0.01% | 0 | 0.00% | 1 |
| 4307 | SRcyp protein (=U40763 Clk-associated RS cyc | X99717 | 0 | 0.00% | 0 | 0.00% | 1 | 0.01% | 0 | 0.00% | 1 |
| 4308 | synthetic ubiquitin (UBCEP80) gene | M24507.1 | 1 | 0.01% | 0 | 0.00% | 0 | 0.00% | 0 | 0.00% | 1 |
| 4309 | TL132 | AJ012755 | 0 | 0.00% | 0 | 0.00% | 0 | 0.00% | 1 | 0.01% | 1 |
| 4310 | translocon-associated protein alpha subunit (=D | AF156965.1 | 0 | 0.00% | 0 | 0.00% | 1 | 0.01% | 0 | 0.00% | 1 |
| 4311 | ubiquinone oxidoreductase complex CI-PDSW | X63224 | 1 | 0.01% | 0 | 0.00% | 0 | 0.00% | 0 | 0.00% | 1 |
| 4312 | ubiquitin associated protein (UBAP), | NM_016525.2 | 0 | 0.00% | 1 | 0.01% | 0 | 0.00% | 0 | 0.00% | 1 |
| 4313 | UBIQUITIN CARBOXYL-TERMINAL HYDROLA | spQ24574 | 0 | 0.00% | 0 | 0.00% | 0 | 0.00% | 1 | 0.01% | 1 |
| 4314 | ubiquitin carrier protein E2-C (UBCH10)(= cyclin | NM_007019.1 | 1 | 0.01% | 0 | 0.00% | 0 | 0.00% | 0 | 0.00% | 1 |
| 4315 | ubiquitin conjugating enzyme (UbcH8) | AF031141 | 1 | 0.01% | 0 | 0.00% | 0 | 0.00% | 0 | 0.00% | 1 |
| 4316 | ubiquitin conjugating enzyme type UBC9 | X96427.1 | 1 | 0.01% | 0 | 0.00% | 0 | 0.00% | 0 | 0.00% | 1 |
| 4317 | Ubiquitin conjugating enzyme UEV1Bs (UBE2V) | U97280.1 | 0 | 0.00% | 0 | 0.00% | 0 | 0.00% | 1 | 0.01% | 1 |
| 4318 | ubiquitin fusion degradation 1-like(RefSeq aa 6e | NP_005650.1 | 0 | 0.00% | 1 | 0.01% | 0 | 0.00% | 0 | 0.00% | 1 |
| 4319 | ubiquitin ligase (Nedd4) protein | U50842 | 1 | 0.01% | 0 | 0.00% | 0 | 0.00% | 0 | 0.00% | 1 |
| 4320 | ubiquitin specific protease 13 (isopeptidase T-3) | NP_003931.1 | 0 | 0.00% | 1 | 0.01% | 0 | 0.00% | 0 | 0.00% | 1 |
| 4321 | ubiquitin specific protease 3 (USP3), mRNA /cds | Hs.251636 | 0 | 0.00% | 0 | 0.00% | 0 | 0.00% | 1 | 0.01% | 1 |
| 4322 | ubiquitin specific protease 7 (herpes virus-assoc | NM_003470.1 | 0 | 0.00% | 1 | 0.01% | 0 | 0.00% | 0 | 0.00% | 1 |
| 4323 | ubiquitin specific protease 8 (USP8)(=KIAA0055 | NM_005154.1 | 0 | 0.00% | 0 | 0.00% | 0 | 0.00% | 1 | 0.01% | 1 |
| 4324 | ubiquitin specific protease 9 (USP9Y) | XM_000563.1 | 0 | 0.00% | 1 | 0.01% | 0 | 0.00% | 0 | 0.00% | 1 |
| 4325 | ubiquitin-activating enzyme E1 (A1S9T and BN7 | NM_003334.1 | 0 | 0.00% | 1 | 0.01% | 0 | 0.00% | 0 | 0.00% | 1 |
| 4326 | ubiquitinating enzyme E2-230 kDa | U20780.1 | 1 | 0.01% | 0 | 0.00% | 0 | 0.00% | 0 | 0.00% | 1 |
| 4327 | UBIQUITIN-CONJUGATING ENZYME E2-17 KI | spP23567 | 0 | 0.00% | 0 | 0.00% | 1 | 0.01% | 0 | 0.00% | 1 |
| 4328 | ubiquitin-conjugating enzyme E2A (RAD6 homol | gi4507768 | 0 | 0.00% | 0 | 0.00% | 1 | 0.01% | 0 | 0.00% | 1 |
| 4329 | ubiquitin-conjugating enzyme E2I (homologous t | XM_007786.5 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 77 of 102

| | | | | | | | | | | | |
|---|---|---|---|---|---|---|---|---|---|---|---|
| 4330 | ubiquitin-conjugating enzyme E2L 1 (UBE2L1) = | NM_003346.1 | 0 | 0.00% | 0 | 0.00% | 0 | 0.00% | 1 | 0.01% | 1 |
| 4331 | ubiquitin-conjugating enzyme HBUCE1 (LOC51( | NM_015983.1 | 0 | 0.00% | 1 | 0.01% | 0 | 0.00% | 0 | 0.00% | 1 |
| 4332 | ubiquitin-conjugating enzyme UbcM2 | AF003346 | 1 | 0.01% | 0 | 0.00% | 0 | 0.00% | 0 | 0.00% | 1 |
| 4333 | ubiquitin-conjugating enzyme UbcM3 | X92665 | 0 | 0.00% | 0 | 0.00% | 0 | 0.00% | 1 | 0.01% | 1 |
| 4334 | ubiquitin-like protein | D23662 | 1 | 0.01% | 0 | 0.00% | 0 | 0.00% | 0 | 0.00% | 1 |
| 4335 | ubiquitin-protein ligase E3-alpha (UBR1) gene, e | AF067385.1 | 0 | 0.00% | 1 | 0.01% | 0 | 0.00% | 0 | 0.00% | 1 |
| 4336 | ubiquitin-protein ligase NEDD4-like (NEDD4L) | NM_015277.1 | 1 | 0.01% | 0 | 0.00% | 0 | 0.00% | 0 | 0.00% | 1 |
| 4337 | vacuolar protein sorting 35 | NM_018206.1 | 0 | 0.00% | 1 | 0.01% | 0 | 0.00% | 0 | 0.00% | 1 |
| 4338 | vacuolar protein sorting 45B (yeast homolog) (V | NM_007259.1 | 0 | 0.00% | 0 | 0.00% | 0 | 0.00% | 1 | 0.01% | 1 |
| 4339 | vacuolar protein sorting homologue h-vps45 | U35246 | 1 | 0.01% | 0 | 0.00% | 0 | 0.00% | 0 | 0.00% | 1 |
| 4340 | vacuolar protein sorting protein 16 | AAG34678.1 | 0 | 0.00% | 1 | 0.01% | 0 | 0.00% | 0 | 0.00% | 1 |
| 4341 | VACUOLAR PROTEIN SORTING-ASSOCIATE | spQ02767 | 1 | 0.01% | 0 | 0.00% | 0 | 0.00% | 0 | 0.00% | 1 |
| 4342 | vacuolar proton pump delta polypeptide (VATD) | NM_015994.1 | 0 | 0.00% | 0 | 0.00% | 0 | 0.00% | 1 | 0.01% | 1 |
| 4343 | zinc metalloproteinase,STE24 (yeast, homolog) | NM_005857.1 | 0 | 0.00% | 0 | 0.00% | 1 | 0.01% | 0 | 0.00% | 1 |
| 4344 | zinc transporter 1 (ZNT1) | AF048701.1 | 0 | 0.00% | 0 | 0.00% | 0 | 0.00% | 1 | 0.01% | 1 |
| 4345 | AZ2 | AB007141 | 0 | 0.00% | 0 | 0.00% | 1 | 0.01% | 0 | 0.00% | 1 |
| 4346 | bromodomain protein CELTIX1 | AAF19526.1 | 0 | 0.00% | 0 | 0.00% | 1 | 0.01% | 0 | 0.00% | 1 |
| 4347 | corticotropin releasing hormone-binding protein ( | NM_001882.2 | 0 | 0.00% | 1 | 0.01% | 0 | 0.00% | 0 | 0.00% | 1 |
| 4348 | ID4 protein | Y07958 | 0 | 0.00% | 0 | 0.00% | 0 | 0.00% | 1 | 0.01% | 1 |
| 4349 | inhibitor of DNA binding 2, dominant negative he | XM_045365.1 | 1 | 0.01% | 0 | 0.00% | 0 | 0.00% | 0 | 0.00% | 1 |
| 4350 | inhibitor of kappa light polypeptide gene enhanc | NP_003631.1 | 0 | 0.00% | 1 | 0.01% | 0 | 0.00% | 0 | 0.00% | 1 |
| 4351 | methyl-CpG-binding protein 2 | AJ132917.1 | 0 | 0.00% | 0 | 0.00% | 1 | 0.01% | 0 | 0.00% | 1 |
| 4352 | modifier 3 (M33) (=Y13274 M33 polycomb-like p | Y13274 | 1 | 0.01% | 0 | 0.00% | 0 | 0.00% | 0 | 0.00% | 1 |
| 4353 | neural retinal-specific | U95012.1 | 0 | 0.00% | 1 | 0.01% | 0 | 0.00% | 0 | 0.00% | 1 |
| 4354 | neural specific protein CRMP-2 gene | U83278.1 | 1 | 0.01% | 0 | 0.00% | 0 | 0.00% | 0 | 0.00% | 1 |
| 4355 | TANK-binding kinase 1 (TBK1) | NM_013254.1 | 0 | 0.00% | 1 | 0.01% | 0 | 0.00% | 0 | 0.00% | 1 |
| 4356 | TBP-associated factor 170 (TAFII170)(low matcl | AJ001017.2 | 0 | 0.00% | 0 | 0.00% | 1 | 0.01% | 0 | 0.00% | 1 |
| 4357 | 4-aminobutyrate aminotransferase (ABAT), nucl | NM_000663.1 | 1 | 0.01% | 0 | 0.00% | 0 | 0.00% | 0 | 0.00% | 1 |
| 4358 | activating transcription factor 6 (RefSeq aa 2e-7( | NP_031374.1 | 0 | 0.00% | 1 | 0.01% | 0 | 0.00% | 0 | 0.00% | 1 |
| 4359 | adenovirus 5 E1A binding protein (BS69) | NM_006624.1 | 0 | 0.00% | 1 | 0.01% | 0 | 0.00% | 0 | 0.00% | 1 |
| 4360 | AF-6 | AB011399 | 0 | 0.00% | 0 | 0.00% | 0 | 0.00% | 1 | 0.01% | 1 |
| 4361 | AT-binding transcription factor 1 (ATBF1)(= zinc | NM_006885.1 | 0 | 0.00% | 1 | 0.01% | 0 | 0.00% | 0 | 0.00% | 1 |
| 4362 | BACH1 | AB002803.1 | 0 | 0.00% | 0 | 0.00% | 0 | 0.00% | 1 | 0.01% | 1 |
| 4363 | basic transCRiption factor 62kD subunit (BTF2) | M95809 | 0 | 0.00% | 0 | 0.00% | 0 | 0.00% | 1 | 0.01% | 1 |
| 4364 | basic-leucine zipper nuclear factor (JEM-1) | U79751 | 0 | 0.00% | 0 | 0.00% | 1 | 0.01% | 0 | 0.00% | 1 |
| 4365 | BCE-1 protein (BCE-1) | NM_007005.1 | 0 | 0.00% | 0 | 0.00% | 1 | 0.01% | 0 | 0.00% | 1 |
| 4366 | B-cell CLL/lymphoma 3 (BCL3) | NM_005178.1 | 0 | 0.00% | 1 | 0.01% | 0 | 0.00% | 0 | 0.00% | 1 |
| 4367 | Bcl-2-associated transcription factor short form r | AF249273.1 | 0 | 0.00% | 1 | 0.01% | 0 | 0.00% | 0 | 0.00% | 1 |
| 4368 | beta-hydroxysteroid dehydrogenase type VII 17 | AF098786.2 | 0 | 0.00% | 0 | 0.00% | 1 | 0.01% | 0 | 0.00% | 1 |
| 4369 | B-IND1 protein (B-ind1) | Z97207.2 | 0 | 0.00% | 0 | 0.00% | 0 | 0.00% | 1 | 0.01% | 1 |
| 4370 | B-myb | X13293 | 1 | 0.01% | 0 | 0.00% | 0 | 0.00% | 0 | 0.00% | 1 |
| 4371 | BTF3 protein homologue gene, complete cds /cc | Hs.181967 | 0 | 0.00% | 0 | 0.00% | 0 | 0.00% | 1 | 0.01% | 1 |
| 4372 | C3HC4-like zinc finger protein | AF214680 | 0 | 0.00% | 0 | 0.00% | 0 | 0.00% | 1 | 0.01% | 1 |
| 4373 | CAGH1a (CAGH1) | U80738 | 1 | 0.01% | 0 | 0.00% | 0 | 0.00% | 0 | 0.00% | 1 |
| 4374 | cAMP responsive element modulator (CREM) | AF213898.1 | 1 | 0.01% | 0 | 0.00% | 0 | 0.00% | 0 | 0.00% | 1 |
| 4375 | CCAAT transCRiption binding factor subunit gan | Z74792 | 1 | 0.01% | 0 | 0.00% | 0 | 0.00% | 0 | 0.00% | 1 |
| 4376 | CCT (chaperonin containing TCP-1) epsilon sub | Z31555 | 1 | 0.01% | 0 | 0.00% | 0 | 0.00% | 0 | 0.00% | 1 |
| 4377 | cell growth regulatory with ring finger domain (C( | NM_006568.1 | 0 | 0.00% | 0 | 0.00% | 1 | 0.01% | 0 | 0.00% | 1 |
| 4378 | Che-1 (ORF) | AF083208 | 0 | 0.00% | 0 | 0.00% | 1 | 0.01% | 0 | 0.00% | 1 |
| 4379 | c-helix-loop-helix-PAS orphan MOP3 | AF044288.1 | 0 | 0.00% | 1 | 0.01% | 0 | 0.00% | 0 | 0.00% | 1 |
| 4380 | chick ovalbumin upstream promoter transcriptior | M62760.1 | 0 | 0.00% | 1 | 0.01% | 0 | 0.00% | 0 | 0.00% | 1 |
| 4381 | cis-acting sequence | M82882.1 | 0 | 0.00% | 0 | 0.00% | 0 | 0.00% | 1 | 0.01% | 1 |
| 4382 | CREB binding protein (Rubinstein-Taybi syndror | gi4758055 | 0 | 0.00% | 0 | 0.00% | 0 | 0.00% | 1 | 0.01% | 1 |
| 4383 | CREB327=cyclic AMP-responsive enhancer bin | S72459 | 0 | 0.00% | 0 | 0.00% | 1 | 0.01% | 0 | 0.00% | 1 |
| 4384 | CRE-BP1 transcription factor = cyclic AMP resp | U16028.1 | 1 | 0.01% | 0 | 0.00% | 0 | 0.00% | 0 | 0.00% | 1 |
| 4385 | DNA (cytosine-5-)-methyltransferase 1(RefSeq a | NP_001370.1 | 0 | 0.00% | 1 | 0.01% | 0 | 0.00% | 0 | 0.00% | 1 |
| 4386 | DNA for 3' untranslated region of the Id4 domina | AJ001971 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 78 of 102

| | | | | | | | | | | | |
|---|---|---|---|---|---|---|---|---|---|---|---|
| 4387 | DNA-binding factor (ORF) | M29204 | 0 | 0.00% | 0 | 0.00% | 0 | 0.00% | 1 | 0.01% | 1 |
| 4388 | DNA-binding protein (mbp-1) | M32019.1 | 1 | 0.01% | 0 | 0.00% | 0 | 0.00% | 0 | 0.00% | 1 |
| 4389 | DNA-BINDING PROTEIN RFXANK | spO14593 | 0 | 0.00% | 0 | 0.00% | 0 | 0.00% | 1 | 0.01% | 1 |
| 4390 | Dr1-associated corepressor (DRAP1) | U41843 | 1 | 0.01% | 0 | 0.00% | 0 | 0.00% | 0 | 0.00% | 1 |
| 4391 | erm | X96375 | 1 | 0.01% | 0 | 0.00% | 0 | 0.00% | 0 | 0.00% | 1 |
| 4392 | erythroid differentiation-related factor 1 | AF040247.1 | 0 | 0.00% | 0 | 0.00% | 0 | 0.00% | 1 | 0.01% | 1 |
| 4393 | ETO=MTG8 (=X79990;D14289;D43638;D13979 | S78158 | 1 | 0.01% | 0 | 0.00% | 0 | 0.00% | 0 | 0.00% | 1 |
| 4394 | ETS (qh43e05.x1 Soares_NFL_T_GBC_S1 clon | AI239823 | 1 | 0.01% | 0 | 0.00% | 0 | 0.00% | 0 | 0.00% | 1 |
| 4395 | ets-like protein (clone 3A) | Z49982.1 | 1 | 0.01% | 0 | 0.00% | 0 | 0.00% | 0 | 0.00% | 1 |
| 4396 | ETX1, ETX1=X-linked retintis pigmentosa (RP3) | S82496.1 | 1 | 0.01% | 0 | 0.00% | 0 | 0.00% | 0 | 0.00% | 1 |
| 4397 | frezzled (fre) mRNA, complete cds | U68057.1 | 1 | 0.01% | 0 | 0.00% | 0 | 0.00% | 0 | 0.00% | 1 |
| 4398 | Friend of GATA2 (FOG2) | NM_012082.2 | 0 | 0.00% | 1 | 0.01% | 0 | 0.00% | 0 | 0.00% | 1 |
| 4399 | frizzled-1 | AB017363 | 0 | 0.00% | 0 | 0.00% | 0 | 0.00% | 1 | 0.01% | 1 |
| 4400 | frizzled-7 | AB017365 | 1 | 0.01% | 0 | 0.00% | 0 | 0.00% | 0 | 0.00% | 1 |
| 4401 | g1-related zinc finger protein | AF171875 | 0 | 0.00% | 0 | 0.00% | 1 | 0.01% | 0 | 0.00% | 1 |
| 4402 | GCN5 (general control of amino-acid synthesis, | NM_001487.1 | 1 | 0.01% | 0 | 0.00% | 0 | 0.00% | 0 | 0.00% | 1 |
| 4403 | general transcription factor IIIC, polypeptide 2 (b | NP_001512.1 | 0 | 0.00% | 1 | 0.01% | 0 | 0.00% | 0 | 0.00% | 1 |
| 4404 | GT212 | L38935.1 | 1 | 0.01% | 0 | 0.00% | 0 | 0.00% | 0 | 0.00% | 1 |
| 4405 | hairy/enhancer-of-split related with YRPW motif | NM_012258.1 | 1 | 0.01% | 0 | 0.00% | 0 | 0.00% | 0 | 0.00% | 1 |
| 4406 | hbrm | X72889.1 | 0 | 0.00% | 0 | 0.00% | 1 | 0.01% | 0 | 0.00% | 1 |
| 4407 | helix-loop-helix protein (Id-2) | M97796.1 | 0 | 0.00% | 0 | 0.00% | 1 | 0.01% | 0 | 0.00% | 1 |
| 4408 | helix-loop-helix transcription factor sequence | M97636.1 | 0 | 0.00% | 0 | 0.00% | 0 | 0.00% | 1 | 0.01% | 1 |
| 4409 | hepatocellular carcinoma associated ring finger | AF247565.1 | 1 | 0.01% | 0 | 0.00% | 0 | 0.00% | 0 | 0.00% | 1 |
| 4410 | HIV associated non-Hodgkin's lymphoma (clone | Y16715 | 1 | 0.01% | 0 | 0.00% | 0 | 0.00% | 0 | 0.00% | 1 |
| 4411 | HIV-1 rev binding protein 2 (RefSeq aa 5e-83) | NP_008974.1 | 0 | 0.00% | 1 | 0.01% | 0 | 0.00% | 0 | 0.00% | 1 |
| 4412 | HIV-1 Vpr-binding protein (VprBP) | AF061935.1 | 0 | 0.00% | 1 | 0.01% | 0 | 0.00% | 0 | 0.00% | 1 |
| 4413 | HIV-associated non-Hodgkin's lymphoma (clone | Y17170 | 0 | 0.00% | 0 | 0.00% | 0 | 0.00% | 1 | 0.01% | 1 |
| 4414 | HIV-EP2/Schnurri-2 | M60119.1 | 0 | 0.00% | 0 | 0.00% | 0 | 0.00% | 1 | 0.01% | 1 |
| 4415 | HMG box containing protein 1 | AF019214 | 0 | 0.00% | 0 | 0.00% | 1 | 0.01% | 0 | 0.00% | 1 |
| 4416 | homeo box B5 (HOXB5) | NM_002147.1 | 1 | 0.01% | 0 | 0.00% | 0 | 0.00% | 0 | 0.00% | 1 |
| 4417 | homeo box C10 (HOXC10), (=homeoprotein C1( | NM_017409.1 | 1 | 0.01% | 0 | 0.00% | 0 | 0.00% | 0 | 0.00% | 1 |
| 4418 | homeobox protein mRNA, 3' end,clone HOX2.3 | M30598.1 | 1 | 0.01% | 0 | 0.00% | 0 | 0.00% | 0 | 0.00% | 1 |
| 4419 | homeodomain interacting protein kinase 2 (Hipk: | NM_010433.1 | 0 | 0.00% | 1 | 0.01% | 0 | 0.00% | 0 | 0.00% | 1 |
| 4420 | homeostasis endoplasmic reticulum protein (ER| | NM_006387.2 | 0 | 0.00% | 1 | 0.01% | 0 | 0.00% | 0 | 0.00% | 1 |
| 4421 | HOX2H | X16665 | 0 | 0.00% | 0 | 0.00% | 0 | 0.00% | 1 | 0.01% | 1 |
| 4422 | HRS gene, partial cds (=SRp40-1) | AF020307.1 | 0 | 0.00% | 1 | 0.01% | 0 | 0.00% | 0 | 0.00% | 1 |
| 4423 | Hypothetical zinc finger-like protein | AAF88107.1 | 0 | 0.00% | 1 | 0.01% | 0 | 0.00% | 0 | 0.00% | 1 |
| 4424 | hypoxia inducible factor (aHIF) antisense R+D2: | U85044.1 | 0 | 0.00% | 1 | 0.01% | 0 | 0.00% | 0 | 0.00% | 1 |
| 4425 | hypoxia inducible gene-14 | AB017708.1 | 0 | 0.00% | 0 | 0.00% | 1 | 0.01% | 0 | 0.00% | 1 |
| 4426 | HZF2 zinc finger protein | X78925 | 0 | 0.00% | 0 | 0.00% | 1 | 0.01% | 0 | 0.00% | 1 |
| 4427 | HZF4 mRNA for zinc finger protein | X78927.1 | 1 | 0.01% | 0 | 0.00% | 0 | 0.00% | 0 | 0.00% | 1 |
| 4428 | HZF9 zinc finger protein | X78932.1 | 0 | 0.00% | 0 | 0.00% | 0 | 0.00% | 1 | 0.01% | 1 |
| 4429 | Id1 (=U57645;S78825) | X77956 | 1 | 0.01% | 0 | 0.00% | 0 | 0.00% | 0 | 0.00% | 1 |
| 4430 | interferon regulatory factor 3 (IRF3) | NM_001571.1 | 1 | 0.01% | 0 | 0.00% | 0 | 0.00% | 0 | 0.00% | 1 |
| 4431 | Jun activation domain binding protein | U65928.1 | 0 | 0.00% | 0 | 0.00% | 1 | 0.01% | 0 | 0.00% | 1 |
| 4432 | jun dimerization protein gene | AF111167.2 | 1 | 0.01% | 0 | 0.00% | 0 | 0.00% | 0 | 0.00% | 1 |
| 4433 | KIAA0744 gene product; histone deacetylase 7 ( | NM_014707.1 | 0 | 0.00% | 1 | 0.01% | 0 | 0.00% | 0 | 0.00% | 1 |
| 4434 | KIAA1605 (=transcription factor LZIP-alpha gene | AB046825.1 | 0 | 0.00% | 1 | 0.01% | 0 | 0.00% | 0 | 0.00% | 1 |
| 4435 | KIAA1611 protein (=ZINC FINGER PROTEIN 1S | BAB13437.1 | 0 | 0.00% | 1 | 0.01% | 0 | 0.00% | 0 | 0.00% | 1 |
| 4436 | KNSL4 and MAZ(kinesin-like DNA binding protei | AB017335 | 1 | 0.01% | 0 | 0.00% | 0 | 0.00% | 0 | 0.00% | 1 |
| 4437 | KRAB zinc finger protein (RITA) | AF272148.1 | 1 | 0.01% | 0 | 0.00% | 0 | 0.00% | 0 | 0.00% | 1 |
| 4438 | krueppel-like zinc finger protein HZF2 | AF220492.1 | 0 | 0.00% | 0 | 0.00% | 1 | 0.01% | 0 | 0.00% | 1 |
| 4439 | leucine zipper transcription factor-like 1 (LZTFL1 | AJ297351.1 | 0 | 0.00% | 0 | 0.00% | 0 | 0.00% | 1 | 0.01% | 1 |
| 4440 | LIM-domain binding factor CLIM1 (CLIM1) | AF068651.1 | 0 | 0.00% | 0 | 0.00% | 0 | 0.00% | 1 | 0.01% | 1 |
| 4441 | MAR/SAR DNA binding protein (SATB1) | M97287 | 1 | 0.01% | 0 | 0.00% | 0 | 0.00% | 0 | 0.00% | 1 |
| 4442 | Meis1-related protein 1b (Mrg1b) | U68384 | 1 | 0.01% | 0 | 0.00% | 0 | 0.00% | 0 | 0.00% | 1 |
| 4443 | Meis1-related protein 2 (MRG2) | U68385 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 79 of 102

| | | | | | | | | | | | |
|---|---|---|---|---|---|---|---|---|---|---|---|
| 4444 | MFH-1 (=X74040) | Y08223 | 0 | 0.00% | 0 | 0.00% | 1 | 0.01% | 0 | 0.00% | 1 |
| 4445 | MIDA1 (=U53208 ZRF1) | D63784 | 1 | 0.01% | 0 | 0.00% | 0 | 0.00% | 0 | 0.00% | 1 |
| 4446 | midline 1 fetal kidney isoform 2 (MID1) | AF041209 | 1 | 0.01% | 0 | 0.00% | 0 | 0.00% | 0 | 0.00% | 1 |
| 4447 | midline 1 fetal kidney isoform 3 (MID1) | AF041210.1 | 0 | 0.00% | 1 | 0.01% | 0 | 0.00% | 0 | 0.00% | 1 |
| 4448 | monocytic leukaemia zinc finger protein (MOZ) | U47742.1 | 0 | 0.00% | 1 | 0.01% | 0 | 0.00% | 0 | 0.00% | 1 |
| 4449 | monokine induced by gamma interferon (MIG) | NM_002416.1 | 0 | 0.00% | 0 | 0.00% | 1 | 0.01% | 0 | 0.00% | 1 |
| 4450 | MYCL2 (low match) | J03069 | 0 | 0.00% | 0 | 0.00% | 0 | 0.00% | 1 | 0.01% | 1 |
| 4451 | novH | X78354 | 0 | 0.00% | 0 | 0.00% | 1 | 0.01% | 0 | 0.00% | 1 |
| 4452 | NPAT gene | D89854.1 | 1 | 0.01% | 0 | 0.00% | 0 | 0.00% | 0 | 0.00% | 1 |
| 4453 | nuclear cap binding protein 1, 80kD (NCBP1) | NM_002486.1 | 0 | 0.00% | 1 | 0.01% | 0 | 0.00% | 0 | 0.00% | 1 |
| 4454 | nuclear factor I (NFI) | U18761.1 | 1 | 0.01% | 0 | 0.00% | 0 | 0.00% | 0 | 0.00% | 1 |
| 4455 | nuclear factor NF45 | U10323.1 | 0 | 0.00% | 0 | 0.00% | 0 | 0.00% | 1 | 0.01% | 1 |
| 4456 | nuclear factor of activated T-cells 5 (NFAT5)(OR | NM_006599.1 | 0 | 0.00% | 0 | 0.00% | 1 | 0.01% | 0 | 0.00% | 1 |
| 4457 | nuclear inhibitor of protein phosphatase-1 (PPP1 | AF064757.1 | 0 | 0.00% | 0 | 0.00% | 0 | 0.00% | 1 | 0.01% | 1 |
| 4458 | nuclear protein, ataxia-telangiectasia locus (Ref | NP_002510.1 | 0 | 0.00% | 1 | 0.01% | 0 | 0.00% | 0 | 0.00% | 1 |
| 4459 | OZF | X70394 | 0 | 0.00% | 0 | 0.00% | 0 | 0.00% | 1 | 0.01% | 1 |
| 4460 | paired-like homeodomain transcription factor 2 (( | NM_000325.1 | 1 | 0.01% | 0 | 0.00% | 0 | 0.00% | 0 | 0.00% | 1 |
| 4461 | PEBP2a1 protein | D14636 | 1 | 0.01% | 0 | 0.00% | 0 | 0.00% | 0 | 0.00% | 1 |
| 4462 | pleomorphic adenoma gene-like 1 (PLAGL1) | U81992 | 0 | 0.00% | 0 | 0.00% | 0 | 0.00% | 1 | 0.01% | 1 |
| 4463 | PP15 (placental protein 15) | X07315 | 1 | 0.01% | 0 | 0.00% | 0 | 0.00% | 0 | 0.00% | 1 |
| 4464 | Pur (pur-alpha) | M96684.1 | 0 | 0.00% | 1 | 0.01% | 0 | 0.00% | 0 | 0.00% | 1 |
| 4465 | putative hepatic transcription factor (WBSCR14) | AF156673.1 | 0 | 0.00% | 1 | 0.01% | 0 | 0.00% | 0 | 0.00% | 1 |
| 4466 | putative transCRiption factor CA150 (ORF) | AF017789 | 0 | 0.00% | 0 | 0.00% | 0 | 0.00% | 1 | 0.01% | 1 |
| 4467 | putative transcription factor-like nuclear regulato | CAC04245.1 | 0 | 0.00% | 1 | 0.01% | 0 | 0.00% | 0 | 0.00% | 1 |
| 4468 | putative translation initiation factor (SUI1) =L262 | NM_005801.1 | 0 | 0.00% | 0 | 0.00% | 0 | 0.00% | 1 | 0.01% | 1 |
| 4469 | putative zinc finger protein (RefSeq aa 2e-30) | NP_057688.1 | 0 | 0.00% | 1 | 0.01% | 0 | 0.00% | 0 | 0.00% | 1 |
| 4470 | putative zinc finger protein NY-REN-34 antigen ( | NM_016119.1 | 0 | 0.00% | 1 | 0.01% | 0 | 0.00% | 0 | 0.00% | 1 |
| 4471 | RELA (v-rel avian reticuloendotheliosis viral onc | CAB66119.2 | 1 | 0.01% | 0 | 0.00% | 0 | 0.00% | 0 | 0.00% | 1 |
| 4472 | retinoblastoma binding protein RBQ-1 | X85133 | 1 | 0.01% | 0 | 0.00% | 0 | 0.00% | 0 | 0.00% | 1 |
| 4473 | ring finger protein 1 (RING1) | Z14000 | 1 | 0.01% | 0 | 0.00% | 0 | 0.00% | 0 | 0.00% | 1 |
| 4474 | ring finger protein 5 (RNF5) | XM_057888.1 | 1 | 0.01% | 0 | 0.00% | 0 | 0.00% | 0 | 0.00% | 1 |
| 4475 | Ring1 and YY1 binding protein (RYBP) | NM_012234.1 | 1 | 0.01% | 0 | 0.00% | 0 | 0.00% | 0 | 0.00% | 1 |
| 4476 | RING12 | X62741.1 | 0 | 0.00% | 0 | 0.00% | 1 | 0.01% | 0 | 0.00% | 1 |
| 4477 | RING4 | X57522.1 | 0 | 0.00% | 0 | 0.00% | 1 | 0.01% | 0 | 0.00% | 1 |
| 4478 | runt-related transcription factor 3 (RUNX3), (=PE | XM_001616.3 | 1 | 0.01% | 0 | 0.00% | 0 | 0.00% | 0 | 0.00% | 1 |
| 4479 | SAP18, Sin3-associated-polypeptide 18 | Z97062 | 1 | 0.01% | 0 | 0.00% | 0 | 0.00% | 0 | 0.00% | 1 |
| 4480 | short form transcription factor C-MAF (c-maf) | AF055376.1 | 0 | 0.00% | 1 | 0.01% | 0 | 0.00% | 0 | 0.00% | 1 |
| 4481 | SIX4 gene | AB024687.1 | 0 | 0.00% | 1 | 0.01% | 0 | 0.00% | 0 | 0.00% | 1 |
| 4482 | SMAD5 (Smad5) | AF010607 | 0 | 0.00% | 0 | 0.00% | 1 | 0.01% | 0 | 0.00% | 1 |
| 4483 | small zinc finger-like protein (TIM13) | AF144700.1 | 1 | 0.01% | 0 | 0.00% | 0 | 0.00% | 0 | 0.00% | 1 |
| 4484 | small zinc finger-like protein (TIM9a) | AF150100.1 | 0 | 0.00% | 0 | 0.00% | 0 | 0.00% | 1 | 0.01% | 1 |
| 4485 | SOX11 | AB028641.1 | 1 | 0.01% | 0 | 0.00% | 0 | 0.00% | 0 | 0.00% | 1 |
| 4486 | SOX6 (SOX6) gene | AF309471.1 | 0 | 0.00% | 1 | 0.01% | 0 | 0.00% | 0 | 0.00% | 1 |
| 4487 | SRD-2 mutant sterol regulatory element binding | U22818 | 0 | 0.00% | 0 | 0.00% | 1 | 0.01% | 0 | 0.00% | 1 |
| 4488 | SRE-ZBP | Z11773 | 0 | 0.00% | 0 | 0.00% | 1 | 0.01% | 0 | 0.00% | 1 |
| 4489 | SRF accessory protein 1B (SAP-1) | M85164.1 | 1 | 0.01% | 0 | 0.00% | 0 | 0.00% | 0 | 0.00% | 1 |
| 4490 | Staf50 | X82200.1 | 0 | 0.00% | 0 | 0.00% | 1 | 0.01% | 0 | 0.00% | 1 |
| 4491 | strain C57BL/6 zinc finger protein 106 (Zfp106) | AF060246.1 | 0 | 0.00% | 0 | 0.00% | 1 | 0.01% | 0 | 0.00% | 1 |
| 4492 | survival of motor neuron protein interacting prote | AF027150.1 | 0 | 0.00% | 0 | 0.00% | 0 | 0.00% | 1 | 0.01% | 1 |
| 4493 | SYBL1 (contains L1 repeat) | gi4165269 | 0 | 0.00% | 0 | 0.00% | 0 | 0.00% | 1 | 0.01% | 1 |
| 4494 | TAR (HIV) RNA-binding protein 1 (TARBP1)(OR | NM_005646.1 | 0 | 0.00% | 0 | 0.00% | 0 | 0.00% | 1 | 0.01% | 1 |
| 4495 | TAR DNA binding protein(TARDBP) (=DKFZp56 | NM_007375.1 | 0 | 0.00% | 0 | 0.00% | 1 | 0.01% | 0 | 0.00% | 1 |
| 4496 | TATA binding protein associated factor (TAFII15 | AF040701.1 | 0 | 0.00% | 1 | 0.01% | 0 | 0.00% | 0 | 0.00% | 1 |
| 4497 | TATA box binding protein (TBP)-associated fac | NM_006284.1 | 1 | 0.01% | 0 | 0.00% | 0 | 0.00% | 0 | 0.00% | 1 |
| 4498 | TATA box binding protein (TBP)-associated fact | NM_005681.1 | 0 | 0.00% | 1 | 0.01% | 0 | 0.00% | 0 | 0.00% | 1 |
| 4499 | TATA box binding protein(TBP)-associated factc | NP_005636.1 | 0 | 0.00% | 1 | 0.01% | 0 | 0.00% | 0 | 0.00% | 1 |
| 4500 | TATA box binding protein-related factor 2 mRNA | AF136570 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 80 of 102

| | | | | | | | | | | | |
|---|---|---|---|---|---|---|---|---|---|---|---|
| 4501 | TATA-binding protein (=Z22828 TFIID) | M55654 | 1 | 0.01% | 0 | 0.00% | 0 | 0.00% | 0 | 0.00% | 1 |
| 4502 | Tat-SF1 | U76992 | 1 | 0.01% | 0 | 0.00% | 0 | 0.00% | 0 | 0.00% | 1 |
| 4503 | TGF(beta)-induced transcription factor 2 (LOC11 | XM_057236.1 | 1 | 0.01% | 0 | 0.00% | 0 | 0.00% | 0 | 0.00% | 1 |
| 4504 | thyroid hormone receptor coactivating protein (S | NM_006696.1 | 1 | 0.01% | 0 | 0.00% | 0 | 0.00% | 0 | 0.00% | 1 |
| 4505 | thyroid receptor interactor (TRIP8) | L40411.1 | 1 | 0.01% | 0 | 0.00% | 0 | 0.00% | 0 | 0.00% | 1 |
| 4506 | thyroid receptor interactor (TRIP9) | L40407 | 1 | 0.01% | 0 | 0.00% | 0 | 0.00% | 0 | 0.00% | 1 |
| 4507 | tissue-type pituitary Kruppel-associated box prot | AF070666 | 0 | 0.00% | 0 | 0.00% | 1 | 0.01% | 0 | 0.00% | 1 |
| 4508 | TPMT thiopurine S-methyltransferase gene | AB045146.1 | 0 | 0.00% | 1 | 0.01% | 0 | 0.00% | 0 | 0.00% | 1 |
| 4509 | transCRipt associated with monocyte to maCRo | X85750 | 0 | 0.00% | 0 | 0.00% | 0 | 0.00% | 1 | 0.01% | 1 |
| 4510 | transcription elongation factor B (SIII), polypeptic | NM_005648.1 | 0 | 0.00% | 1 | 0.01% | 0 | 0.00% | 0 | 0.00% | 1 |
| 4511 | transCRiption elongation factor TFIIS.h | AJ223473 | 1 | 0.01% | 0 | 0.00% | 0 | 0.00% | 0 | 0.00% | 1 |
| 4512 | transCRiption factor (TFIIB) | M76766 | 0 | 0.00% | 0 | 0.00% | 1 | 0.01% | 0 | 0.00% | 1 |
| 4513 | transcription factor 12 (RefSeq aa 1e-54) | NP_003196.1 | 0 | 0.00% | 1 | 0.01% | 0 | 0.00% | 0 | 0.00% | 1 |
| 4514 | transcription factor 17(TCF17) (ORF) | NM_005649.1 | 0 | 0.00% | 1 | 0.01% | 0 | 0.00% | 0 | 0.00% | 1 |
| 4515 | transcription factor BMAL2 (RefSeq aa 8e-35) | NP_064568.1 | 0 | 0.00% | 1 | 0.01% | 0 | 0.00% | 0 | 0.00% | 1 |
| 4516 | transCRiption factor CA150 (CA150) (=AF01778 | gi5729753 | 0 | 0.00% | 0 | 0.00% | 0 | 0.00% | 1 | 0.01% | 1 |
| 4517 | transcription factor Dp-2 (E2F dimerization partr | NM_006286.1 | 0 | 0.00% | 1 | 0.01% | 0 | 0.00% | 0 | 0.00% | 1 |
| 4518 | transCRiption factor ETR103 | M62829 | 1 | 0.01% | 0 | 0.00% | 0 | 0.00% | 0 | 0.00% | 1 |
| 4519 | transcription factor IGHM enhancer 3, JM11 prot | AF196779.1 | 0 | 0.00% | 0 | 0.00% | 1 | 0.01% | 0 | 0.00% | 1 |
| 4520 | transcription factor IIIC102 | AF133123.1 | 0 | 0.00% | 0 | 0.00% | 1 | 0.01% | 0 | 0.00% | 1 |
| 4521 | transCRiption factor L-Sox5 | AJ010604.1 | 0 | 0.00% | 0 | 0.00% | 0 | 0.00% | 1 | 0.01% | 1 |
| 4522 | transCRiption factor RTEF-1 (RTEF1) | U63824 | 1 | 0.01% | 0 | 0.00% | 0 | 0.00% | 0 | 0.00% | 1 |
| 4523 | transCRiption factor SL1 | L39060 | 1 | 0.01% | 0 | 0.00% | 0 | 0.00% | 0 | 0.00% | 1 |
| 4524 | transcription factor SOX8 (SOX8) | AF164104.1 | 1 | 0.01% | 0 | 0.00% | 0 | 0.00% | 0 | 0.00% | 1 |
| 4525 | transCRiption factor TFIIA small subunit p12 | U21242 | 0 | 0.00% | 0 | 0.00% | 1 | 0.01% | 0 | 0.00% | 1 |
| 4526 | transcription factor(HSA130894) | NM_017569.1 | 1 | 0.01% | 0 | 0.00% | 0 | 0.00% | 0 | 0.00% | 1 |
| 4527 | transcription factor-like 1(TCFL1)(= YL-1 mRNA | NM_005997.1 | 0 | 0.00% | 1 | 0.01% | 0 | 0.00% | 0 | 0.00% | 1 |
| 4528 | transcription initiation factor IA protein (TIF-IA ge | AJ272050.1 | 0 | 0.00% | 1 | 0.01% | 0 | 0.00% | 0 | 0.00% | 1 |
| 4529 | transCRiption initiation factor TFIID subunit TAF | U30504 | 0 | 0.00% | 0 | 0.00% | 0 | 0.00% | 1 | 0.01% | 1 |
| 4530 | transCRiption regulator protein (BACH1) | AF026199 | 0 | 0.00% | 0 | 0.00% | 0 | 0.00% | 1 | 0.01% | 1 |
| 4531 | transCRiption regulator RPD3-2B (=AF039703 h | U75697 | 1 | 0.01% | 0 | 0.00% | 0 | 0.00% | 0 | 0.00% | 1 |
| 4532 | transcription termination factor, RNA polymerase | NP_031370.1 | 0 | 0.00% | 1 | 0.01% | 0 | 0.00% | 0 | 0.00% | 1 |
| 4533 | transCRiptional activator hSNF2a (=X72889 hbr | D26155 | 1 | 0.01% | 0 | 0.00% | 0 | 0.00% | 0 | 0.00% | 1 |
| 4534 | transCRiptional co-activator CRSP33 (CRSP33) | AF104251 | 0 | 0.00% | 0 | 0.00% | 1 | 0.01% | 0 | 0.00% | 1 |
| 4535 | transcriptional enhancer factor (TEF1) | M63896.1 | 0 | 0.00% | 0 | 0.00% | 0 | 0.00% | 1 | 0.01% | 1 |
| 4536 | transCRiptional intermediary factor 1 alpha | AF119042 | 0 | 0.00% | 0 | 0.00% | 0 | 0.00% | 1 | 0.01% | 1 |
| 4537 | transCRiptional repressor (CTCF) | U25435.1 | 0 | 0.00% | 0 | 0.00% | 0 | 0.00% | 1 | 0.01% | 1 |
| 4538 | transcription-associated zinc ribbon protein (ZNF | AF024617.1 | 0 | 0.00% | 1 | 0.01% | 0 | 0.00% | 0 | 0.00% | 1 |
| 4539 | transducin beta-2 subunit (=M16538 signal-trans | M36429 | 1 | 0.01% | 0 | 0.00% | 0 | 0.00% | 0 | 0.00% | 1 |
| 4540 | ubinuclein (UBN1) gene, exons 1b and 2 | AF108454.1 | 0 | 0.00% | 0 | 0.00% | 1 | 0.01% | 0 | 0.00% | 1 |
| 4541 | WD repeat domain 6 (WDR6) | NM_018031.2 | 0 | 0.00% | 1 | 0.01% | 0 | 0.00% | 0 | 0.00% | 1 |
| 4542 | X2 box repressor | U22680 | 0 | 0.00% | 0 | 0.00% | 1 | 0.01% | 0 | 0.00% | 1 |
| 4543 | X28 region near ALD locus containing dual spec | U52111.2 | 0 | 0.00% | 0 | 0.00% | 0 | 0.00% | 1 | 0.01% | 1 |
| 4544 | XAP-4 GDI (=X79353) | X79353 | 1 | 0.01% | 0 | 0.00% | 0 | 0.00% | 0 | 0.00% | 1 |
| 4545 | YSK1 | D63780.1 | 1 | 0.01% | 0 | 0.00% | 0 | 0.00% | 0 | 0.00% | 1 |
| 4546 | yz99g12.r1 Soares melanocyte 2NbHM cDNA cl | W03533.1 | 1 | 0.01% | 0 | 0.00% | 0 | 0.00% | 0 | 0.00% | 1 |
| 4547 | ZFX transcription activator | X59739.1 | 1 | 0.01% | 0 | 0.00% | 0 | 0.00% | 0 | 0.00% | 1 |
| 4548 | ZHX1 protein (ZHX1) | AF195766.1 | 0 | 0.00% | 0 | 0.00% | 0 | 0.00% | 1 | 0.01% | 1 |
| 4549 | zinc finger 2 (ZNF2 gene) | X60152.1 | 0 | 0.00% | 0 | 0.00% | 0 | 0.00% | 1 | 0.01% | 1 |
| 4550 | zinc finger 5 protein | D89859.1 | 0 | 0.00% | 0 | 0.00% | 1 | 0.01% | 0 | 0.00% | 1 |
| 4551 | zinc finger homeobox protein ZHX1 | AF106862.1 | 0 | 0.00% | 0 | 0.00% | 0 | 0.00% | 1 | 0.01% | 1 |
| 4552 | zinc finger homeodomain protein | U12170.1 | 0 | 0.00% | 0 | 0.00% | 1 | 0.01% | 0 | 0.00% | 1 |
| 4553 | zinc finger protein (HZF6) (non-exact, 66%) | AF027513 | 1 | 0.01% | 0 | 0.00% | 0 | 0.00% | 0 | 0.00% | 1 |
| 4554 | zinc finger protein (LOC51042) | NM_015871.1 | 1 | 0.01% | 0 | 0.00% | 0 | 0.00% | 0 | 0.00% | 1 |
| 4555 | zinc finger protein (low match) | X78933 | 1 | 0.01% | 0 | 0.00% | 0 | 0.00% | 0 | 0.00% | 1 |
| 4556 | zinc finger protein (ZAN75) | NM_018759.1 | 0 | 0.00% | 1 | 0.01% | 0 | 0.00% | 0 | 0.00% | 1 |
| 4557 | zinc finger protein (ZNF139)mRNA | U09848.1 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 81 of 102

| | | | | | | | | | | | |
|---|---|---|---|---|---|---|---|---|---|---|---|
| 4558 | zinc finger protein (ZNF141) | L15309 | 0 | 0.00% | 0 | 0.00% | 0 | 0.00% | 1 | 0.01% | 1 |
| 4559 | zinc finger protein (ZNF155) | U09852 | 0 | 0.00% | 0 | 0.00% | 0 | 0.00% | 1 | 0.01% | 1 |
| 4560 | zinc finger protein (ZNF741) | U28282 | 1 | 0.01% | 0 | 0.00% | 0 | 0.00% | 0 | 0.00% | 1 |
| 4561 | zinc finger protein (ZNF-U69274) | NM_014415.1 | 0 | 0.00% | 0 | 0.00% | 1 | 0.01% | 0 | 0.00% | 1 |
| 4562 | zinc finger protein 10 (KOX 1) (RefSeq aa 3e-47 | NP_003410.1 | 0 | 0.00% | 1 | 0.01% | 0 | 0.00% | 0 | 0.00% | 1 |
| 4563 | zinc finger protein 124 (HZF-16) (ZNF124) | NM_003431.1 | 0 | 0.00% | 0 | 0.00% | 1 | 0.01% | 0 | 0.00% | 1 |
| 4564 | ZINC FINGER PROTEIN 136 (61% aa) | spP52737 | 0 | 0.00% | 0 | 0.00% | 0 | 0.00% | 1 | 0.01% | 1 |
| 4565 | zinc finger protein 136 (clone pHZ-20)(RefSeq a | NP_003428.1 | 0 | 0.00% | 1 | 0.01% | 0 | 0.00% | 0 | 0.00% | 1 |
| 4566 | zinc finger protein 146 (ZNF146) | NM_007145.1 | 0 | 0.00% | 1 | 0.01% | 0 | 0.00% | 0 | 0.00% | 1 |
| 4567 | zinc finger protein 161 (RefSeq aa 1e-74) | NP_009077.1 | 0 | 0.00% | 1 | 0.01% | 0 | 0.00% | 0 | 0.00% | 1 |
| 4568 | zinc finger protein 162 (ZNF162) | NM_004630.1 | 0 | 0.00% | 1 | 0.01% | 0 | 0.00% | 0 | 0.00% | 1 |
| 4569 | ZINC FINGER PROTEIN 177 (69% aa) | spQ13360 | 0 | 0.00% | 0 | 0.00% | 0 | 0.00% | 1 | 0.01% | 1 |
| 4570 | zinc finger protein 195 (ZNF195) | gi6005973 | 0 | 0.00% | 0 | 0.00% | 1 | 0.01% | 0 | 0.00% | 1 |
| 4571 | zinc finger protein 198 (ZNF198) | NM_003453.1 | 0 | 0.00% | 0 | 0.00% | 1 | 0.01% | 0 | 0.00% | 1 |
| 4572 | zinc finger protein 202(ZNF202) | NM_003455.1 | 0 | 0.00% | 1 | 0.01% | 0 | 0.00% | 0 | 0.00% | 1 |
| 4573 | zinc finger protein 223 (ZNF223) | NM_013361.1 | 0 | 0.00% | 0 | 0.00% | 1 | 0.01% | 0 | 0.00% | 1 |
| 4574 | zinc finger protein 232 (RefSeq aa 2e-68) | NP_055334.1 | 0 | 0.00% | 1 | 0.01% | 0 | 0.00% | 0 | 0.00% | 1 |
| 4575 | zinc finger protein 258 (ZNF258) | NM_007167.1 | 0 | 0.00% | 1 | 0.01% | 0 | 0.00% | 0 | 0.00% | 1 |
| 4576 | zinc finger protein 268 (ZNF268) mRNA, comple | Hs.183291 | 0 | 0.00% | 0 | 0.00% | 0 | 0.00% | 1 | 0.01% | 1 |
| 4577 | zinc finger protein 281 (ZNF281) (ORF) | NM_012482.1 | 0 | 0.00% | 0 | 0.00% | 0 | 0.00% | 1 | 0.01% | 1 |
| 4578 | zinc finger protein 288 (ZNF288), mRNA /cds=(4 | Hs.159456 | 0 | 0.00% | 0 | 0.00% | 1 | 0.01% | 0 | 0.00% | 1 |
| 4579 | zinc finger protein 297 (ZNF297) | NM_005453.2 | 1 | 0.01% | 0 | 0.00% | 0 | 0.00% | 0 | 0.00% | 1 |
| 4580 | zinc finger protein 41 (ZNF41) | M92443.1 | 0 | 0.00% | 0 | 0.00% | 1 | 0.01% | 0 | 0.00% | 1 |
| 4581 | ZINC FINGER PROTEIN 83 (ZINC FINGER PR( | spP51522 | 1 | 0.01% | 0 | 0.00% | 0 | 0.00% | 0 | 0.00% | 1 |
| 4582 | zinc finger protein dp | AF153201.1 | 0 | 0.00% | 1 | 0.01% | 0 | 0.00% | 0 | 0.00% | 1 |
| 4583 | zinc finger protein EZNF (EZNF) | AF116030 | 0 | 0.00% | 0 | 0.00% | 0 | 0.00% | 1 | 0.01% | 1 |
| 4584 | zinc finger protein FOG-2 | AF119334.1 | 0 | 0.00% | 0 | 0.00% | 1 | 0.01% | 0 | 0.00% | 1 |
| 4585 | zinc finger protein homologous to Zfp-36 in mou | NM_003407.1 | 0 | 0.00% | 1 | 0.01% | 0 | 0.00% | 0 | 0.00% | 1 |
| 4586 | zinc finger protein mRNA | Y14443.1 | 1 | 0.01% | 0 | 0.00% | 0 | 0.00% | 0 | 0.00% | 1 |
| 4587 | zinc finger protein NY-REN-21 antigen | AF155100.1 | 1 | 0.01% | 0 | 0.00% | 0 | 0.00% | 0 | 0.00% | 1 |
| 4588 | zinc finger protein SBZF2 mRNA, complete cds | AF139460.1 | 0 | 0.00% | 1 | 0.01% | 0 | 0.00% | 0 | 0.00% | 1 |
| 4589 | zinc finger protein ZNF131 | U09410 | 0 | 0.00% | 0 | 0.00% | 1 | 0.01% | 0 | 0.00% | 1 |
| 4590 | zinc finger protein ZNF140 | U09368.1 | 0 | 0.00% | 0 | 0.00% | 0 | 0.00% | 1 | 0.01% | 1 |
| 4591 | zinc finger protein(ZF5128) | NM_014347.1 | 0 | 0.00% | 1 | 0.01% | 0 | 0.00% | 0 | 0.00% | 1 |
| 4592 | zinc finger protein, C3H-type =AF061261 zinc fir | NM_005757.1 | 0 | 0.00% | 0 | 0.00% | 1 | 0.01% | 0 | 0.00% | 1 |
| 4593 | zinc finger protein, HZF2 | X78925.1 | 0 | 0.00% | 0 | 0.00% | 0 | 0.00% | 1 | 0.01% | 1 |
| 4594 | zinc finger protein219 | NM_016423.1 | 0 | 0.00% | 1 | 0.01% | 0 | 0.00% | 0 | 0.00% | 1 |
| 4595 | zinc finger RNA binding protein (Zfr) | AF071059.1 | 1 | 0.01% | 0 | 0.00% | 0 | 0.00% | 0 | 0.00% | 1 |
| 4596 | zinc-finger protein (ZNF76) | M91592 | 1 | 0.01% | 0 | 0.00% | 0 | 0.00% | 0 | 0.00% | 1 |
| 4597 | zinc-finger protein PFM1, PR-domain | AF144757.1 | 0 | 0.00% | 0 | 0.00% | 0 | 0.00% | 1 | 0.01% | 1 |
| 4598 | Zn-15 related zinc finger protein (rlf) mRNA, com | U22377.1 | 0 | 0.00% | 1 | 0.01% | 0 | 0.00% | 0 | 0.00% | 1 |
| 4599 | ZNF135-like protein | AF265236.1 | 0 | 0.00% | 0 | 0.00% | 0 | 0.00% | 1 | 0.01% | 1 |
| 4600 | ZNF258 (ZNF258) | AF055470 | 0 | 0.00% | 0 | 0.00% | 1 | 0.01% | 0 | 0.00% | 1 |
| 4601 | ZNF81 (non-exact) | X68011 | 1 | 0.01% | 0 | 0.00% | 0 | 0.00% | 0 | 0.00% | 1 |
| 4602 | bromodomain-containing 7 (BRD7), mRNA | NM_013263.1 | 1 | 0.01% | 0 | 0.00% | 0 | 0.00% | 0 | 0.00% | 1 |
| 4603 | 218 kD Mi-2 protein (= proliferating cell nucleola | X86691 | 1 | 0.01% | 0 | 0.00% | 0 | 0.00% | 0 | 0.00% | 1 |
| 4604 | cell-line THP-1 GTP cyclohydrolase I | U66095.1 | 0 | 0.00% | 0 | 0.00% | 1 | 0.01% | 0 | 0.00% | 1 |
| 4605 | cleavage stimulation factor, 3' pre-RNA, subunit | NM_001326.1 | 0 | 0.00% | 0 | 0.00% | 1 | 0.01% | 0 | 0.00% | 1 |
| 4606 | CPSF (cleavage and polyadenylation specificity | X95906 | 1 | 0.01% | 0 | 0.00% | 0 | 0.00% | 0 | 0.00% | 1 |
| 4607 | CTD-binding SR-like protein rA8 | U49055 | 1 | 0.01% | 0 | 0.00% | 0 | 0.00% | 0 | 0.00% | 1 |
| 4608 | C-terminal binding protein 2 (CTBP2) | NM_001329.1 | 0 | 0.00% | 1 | 0.01% | 0 | 0.00% | 0 | 0.00% | 1 |
| 4609 | dCMP deaminase (DCTD) | NM_001921.1 | 1 | 0.01% | 0 | 0.00% | 0 | 0.00% | 0 | 0.00% | 1 |
| 4610 | DEAD/H (Asp-Glu-Ala-Asp/His) box polypeptide | NM_007242.1 | 1 | 0.01% | 0 | 0.00% | 0 | 0.00% | 0 | 0.00% | 1 |
| 4611 | DEAD/H (Asp-Glu-Ala-Asp/His) box polypeptide | NM_004397.1 | 0 | 0.00% | 0 | 0.00% | 1 | 0.01% | 0 | 0.00% | 1 |
| 4612 | DEAD-box protein abstrakt(ABS), (ORF) | NM_016222.1 | 1 | 0.01% | 0 | 0.00% | 0 | 0.00% | 0 | 0.00% | 1 |
| 4613 | double stranded RNA activated protein kinase (F | AF167458.1 | 0 | 0.00% | 1 | 0.01% | 0 | 0.00% | 0 | 0.00% | 1 |
| 4614 | double-stranded RNA binding nuclear protein DF | AJ271746.1 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 82 of 102

| | | | | | | | | | | | |
|---|---|---|---|---|---|---|---|---|---|---|---|
| 4615 | endoplasmic reticulum lumenal protein (ERP28) | NM_006817.1 | 0 | 0.00% | 1 | 0.01% | 0 | 0.00% | 0 | 0.00% | 1 |
| 4616 | EWS gene | AB016207.1 | 1 | 0.01% | 0 | 0.00% | 0 | 0.00% | 0 | 0.00% | 1 |
| 4617 | glutamyl-prolyl tRNA synthetase; proline tRNA li | NP_004437.1 | 1 | 0.01% | 0 | 0.00% | 0 | 0.00% | 0 | 0.00% | 1 |
| 4618 | heterogeneous nuclear ribonucleoprotein A0 (HN | NM_006805.1 | 1 | 0.01% | 0 | 0.00% | 0 | 0.00% | 0 | 0.00% | 1 |
| 4619 | heterogeneous nuclear ribonucleoprotein L (HNF | X16135 | 0 | 0.00% | 0 | 0.00% | 0 | 0.00% | 1 | 0.01% | 1 |
| 4620 | hnRNA-binding protein M4 (M4 protein) | S35532 | 1 | 0.01% | 0 | 0.00% | 0 | 0.00% | 0 | 0.00% | 1 |
| 4621 | hnRNP-E1 | X78137.1 | 0 | 0.00% | 0 | 0.00% | 0 | 0.00% | 1 | 0.01% | 1 |
| 4622 | LRR FLI-I interacting protein 2 (LRRFIP2) | AF115509.1 | 1 | 0.01% | 0 | 0.00% | 0 | 0.00% | 0 | 0.00% | 1 |
| 4623 | nuclear matrix protein p84 | NM_005131.1 | 0 | 0.00% | 0 | 0.00% | 1 | 0.01% | 0 | 0.00% | 1 |
| 4624 | nuclear protein (mdm-1) | M20823.1 | 1 | 0.01% | 0 | 0.00% | 0 | 0.00% | 0 | 0.00% | 1 |
| 4625 | nuclear protein double minute 1 | AF267851.1 | 0 | 0.00% | 1 | 0.01% | 0 | 0.00% | 0 | 0.00% | 1 |
| 4626 | nuclear protein, NP220 | D83032 | 0 | 0.00% | 0 | 0.00% | 0 | 0.00% | 1 | 0.01% | 1 |
| 4627 | ORF2 consensus sequence encoding endonucle | AAB41224.1 | 0 | 0.00% | 1 | 0.01% | 0 | 0.00% | 0 | 0.00% | 1 |
| 4628 | partial mRNA for double stranded RNA binding r | AJ271747.1 | 0 | 0.00% | 1 | 0.01% | 0 | 0.00% | 0 | 0.00% | 1 |
| 4629 | poly(A)-binding protein, cytoplasmic 4 (inducible | NM_003819.2 | 0 | 0.00% | 1 | 0.01% | 0 | 0.00% | 0 | 0.00% | 1 |
| 4630 | pur alpha extended | X91648 | 1 | 0.01% | 0 | 0.00% | 0 | 0.00% | 0 | 0.00% | 1 |
| 4631 | ribonucleoprotein SS-B/La (=J04205) | X13697 | 1 | 0.01% | 0 | 0.00% | 0 | 0.00% | 0 | 0.00% | 1 |
| 4632 | RNA 3'-terminal phosphate cyclase (RPC) mRN | NM_003729.1 | 0 | 0.00% | 1 | 0.01% | 0 | 0.00% | 0 | 0.00% | 1 |
| 4633 | RNA binding motif protein 4 (RBM4) | gi4506444 | 1 | 0.01% | 0 | 0.00% | 0 | 0.00% | 0 | 0.00% | 1 |
| 4634 | RNA binding motif protein 9 (isoform 1) (=AL00 | CAB63054.1 | 0 | 0.00% | 0 | 0.00% | 1 | 0.01% | 0 | 0.00% | 1 |
| 4635 | RNA binding motif protein, X chromosome (RBM | NM_002139.1 | 0 | 0.00% | 1 | 0.01% | 0 | 0.00% | 0 | 0.00% | 1 |
| 4636 | RNA cyclase homolog | AF067172.1 | 0 | 0.00% | 0 | 0.00% | 1 | 0.01% | 0 | 0.00% | 1 |
| 4637 | RNA helicase (LOC51139)(= KIAA0801) | NM_016130.1 | 1 | 0.01% | 0 | 0.00% | 0 | 0.00% | 0 | 0.00% | 1 |
| 4638 | RNA helicase (RIG-I) | AF038963.1 | 0 | 0.00% | 0 | 0.00% | 0 | 0.00% | 1 | 0.01% | 1 |
| 4639 | RNA helicase HDB/DICE1 | AF141326.1 | 0 | 0.00% | 0 | 0.00% | 1 | 0.01% | 0 | 0.00% | 1 |
| 4640 | RNA helicase-related protein | AF083255 | 0 | 0.00% | 0 | 0.00% | 0 | 0.00% | 1 | 0.01% | 1 |
| 4641 | RNA helicase-related protein (RNAHP) | XM_044384.1 | 1 | 0.01% | 0 | 0.00% | 0 | 0.00% | 0 | 0.00% | 1 |
| 4642 | RNA-binding protein (autoantigenic) (RALY) | NM_016732.1 | 1 | 0.01% | 0 | 0.00% | 0 | 0.00% | 0 | 0.00% | 1 |
| 4643 | RRM RNA binding protein Gry-rbp (GRY-RBP) | AF037448.1 | 1 | 0.01% | 0 | 0.00% | 0 | 0.00% | 0 | 0.00% | 1 |
| 4644 | SIR2 (silent mating type information regulation 2 | NM_012237.1 | 0 | 0.00% | 1 | 0.01% | 0 | 0.00% | 0 | 0.00% | 1 |
| 4645 | sir2-like 1 (SIRT1) | NM_012238.2 | 0 | 0.00% | 1 | 0.01% | 0 | 0.00% | 0 | 0.00% | 1 |
| 4646 | small nuclear ribonucleoprotein D3 polypeptide ( | NM_004175.1 | 1 | 0.01% | 0 | 0.00% | 0 | 0.00% | 0 | 0.00% | 1 |
| 4647 | small nuclear rna (snrna) gene (clone pu1-6) anc | K00529.1 | 0 | 0.00% | 0 | 0.00% | 0 | 0.00% | 1 | 0.01% | 1 |
| 4648 | small nuclear RNA activating complex, polypepti | 4507100 | 0 | 0.00% | 0 | 0.00% | 0 | 0.00% | 1 | 0.01% | 1 |
| 4649 | Smg GDS-associated protein SMAP | U59919 | 0 | 0.00% | 0 | 0.00% | 0 | 0.00% | 1 | 0.01% | 1 |
| 4650 | SnRNP assembly defective 1 homologue (SAD1 | gi5730024 | 0 | 0.00% | 0 | 0.00% | 1 | 0.01% | 0 | 0.00% | 1 |
| 4651 | SNRPN | U81001.1 | 0 | 0.00% | 1 | 0.01% | 0 | 0.00% | 0 | 0.00% | 1 |
| 4652 | SOF1 PROTEIN | spP33750 | 0 | 0.00% | 0 | 0.00% | 0 | 0.00% | 1 | 0.01% | 1 |
| 4653 | SPF31 (SPF31) | AF083190 | 0 | 0.00% | 0 | 0.00% | 1 | 0.01% | 0 | 0.00% | 1 |
| 4654 | splicing factor (45kD) (SPF45) (ORF) | NM_006450.1 | 0 | 0.00% | 0 | 0.00% | 0 | 0.00% | 1 | 0.01% | 1 |
| 4655 | splicing factor 30, survival of motor neuron-relate | NM_005871.1 | 0 | 0.00% | 0 | 0.00% | 1 | 0.01% | 0 | 0.00% | 1 |
| 4656 | splicing factor arginine/serine-rich 5 (SFRS5) | XM_031133.1 | 1 | 0.01% | 0 | 0.00% | 0 | 0.00% | 0 | 0.00% | 1 |
| 4657 | splicing factor Prp8 | AF092565.1 | 1 | 0.01% | 0 | 0.00% | 0 | 0.00% | 0 | 0.00% | 1 |
| 4658 | splicing factor SC35 | M90104.1 | 1 | 0.01% | 0 | 0.00% | 0 | 0.00% | 0 | 0.00% | 1 |
| 4659 | splicing factor SRp40-3 (SRp40) | U30827.1 | 0 | 0.00% | 0 | 0.00% | 1 | 0.01% | 0 | 0.00% | 1 |
| 4660 | splicing factor SRp55-1 (SRp-55) | U30883.1 | 0 | 0.00% | 0 | 0.00% | 0 | 0.00% | 1 | 0.01% | 1 |
| 4661 | splicing factor, arginine/serine-rich 2, interacting | Hs.51957 | 0 | 0.00% | 0 | 0.00% | 1 | 0.01% | 0 | 0.00% | 1 |
| 4662 | SPLICING FACTOR, ARGININE/SERINE-RICH | spQ12872 | 1 | 0.01% | 0 | 0.00% | 0 | 0.00% | 0 | 0.00% | 1 |
| 4663 | splicing factor, arginine/serine-rich2, interacting | NP_004710.1 | 0 | 0.00% | 1 | 0.01% | 0 | 0.00% | 0 | 0.00% | 1 |
| 4664 | splicing factor, SF1-HL1 isoform | Y08765 | 1 | 0.01% | 0 | 0.00% | 0 | 0.00% | 0 | 0.00% | 1 |
| 4665 | SRp25 nuclear protein(LOC51329) | NM_016638.1 | 1 | 0.01% | 0 | 0.00% | 0 | 0.00% | 0 | 0.00% | 1 |
| 4666 | SRp46 splicing factor retropseudogene | AF031166.1 | 0 | 0.00% | 1 | 0.01% | 0 | 0.00% | 0 | 0.00% | 1 |
| 4667 | SR-related protein LD2 (=RNA-binding protein S | AF247662.1 | 1 | 0.01% | 0 | 0.00% | 0 | 0.00% | 0 | 0.00% | 1 |
| 4668 | staufen (Drosophila,RNA-binding protein) homol | NM_014393.1 | 0 | 0.00% | 1 | 0.01% | 0 | 0.00% | 0 | 0.00% | 1 |
| 4669 | staufen protein (STAU) | AF061940 | 0 | 0.00% | 0 | 0.00% | 1 | 0.01% | 0 | 0.00% | 1 |
| 4670 | step II splicing factor SLU7 (SLU7) (ORF) | NM_006425.1 | 0 | 0.00% | 0 | 0.00% | 0 | 0.00% | 1 | 0.01% | 1 |
| 4671 | SYNCRIP | AB035725.1 | 0 | 0.00% | 0 | 0.00% | 1 | 0.01% | 0 | 0.00% | 1 |

Figure 6 - Unique Known Genes Identified In Four cDNA Cartilage Libraries and EST Frequency Analysis - Page 83 of 102

| | | | | | | | | | | | |
|---|---|---|---|---|---|---|---|---|---|---|---|
| 4672 | TIA1 cytotoxic granule-associated RNA-binding | NM_003252.1 | 1 | 0.01% | 0 | 0.00% | 0 | 0.00% | 0 | 0.00% | 1 |
| 4673 | tRNA-Lys gene (low match:nt 1e-10) | U00939.1 | 0 | 0.00% | 0 | 0.00% | 0 | 0.00% | 1 | 0.01% | 1 |
| 4674 | U1 small nuclear ribonucleoprotein 70 kd protein | M22636 | 1 | 0.01% | 0 | 0.00% | 0 | 0.00% | 0 | 0.00% | 1 |
| 4675 | u1B-IC/SNRPN transCRipt | L80005.1 | 0 | 0.00% | 0 | 0.00% | 0 | 0.00% | 1 | 0.01% | 1 |
| 4676 | U2 small nuclear RNA gene | K03022.1 | 0 | 0.00% | 1 | 0.01% | 0 | 0.00% | 0 | 0.00% | 1 |
| 4677 | U2 snRNP auxiliary factor small subunit | M96982 | 1 | 0.01% | 0 | 0.00% | 0 | 0.00% | 0 | 0.00% | 1 |
| 4678 | U5 snRNP-specific protein, 116 kD (U5-116KD) | gi4759279 | 0 | 0.00% | 0 | 0.00% | 1 | 0.01% | 0 | 0.00% | 1 |
| 4679 | U50' snoRNA and U50 snoRNA | AB017710.1 | 0 | 0.00% | 0 | 0.00% | 0 | 0.00% | 1 | 0.01% | 1 |
| 4680 | U6 snRNA-associated Sm-like protein LSm6 | AF182292.1 | 0 | 0.00% | 0 | 0.00% | 0 | 0.00% | 1 | 0.01% | 1 |
| 4681 | U6 snRNA-associated Sm-like protein LSm7 (LC | NM_016199.1 | 1 | 0.01% | 0 | 0.00% | 0 | 0.00% | 0 | 0.00% | 1 |
| 4682 | U6 snRNA-associated Sm-like protein LSm8 | AF182294.1 | 0 | 0.00% | 0 | 0.00% | 0 | 0.00% | 1 | 0.01% | 1 |
| 4683 | pre-mRNA splicing factor (PRP18) | NM_003675.1 | 0 | 0.00% | 1 | 0.01% | 0 | 0.00% | 0 | 0.00% | 1 |
| 4684 | RNA polymerase II 14.5 kDa subunit | Z23102 | 1 | 0.01% | 0 | 0.00% | 0 | 0.00% | 0 | 0.00% | 1 |
| 4685 | RNA polymerase subunit hRPB 33 | J05448 | 0 | 0.00% | 0 | 0.00% | 1 | 0.01% | 0 | 0.00% | 1 |
| 4686 | rsly1p | U57687 | 1 | 0.01% | 0 | 0.00% | 0 | 0.00% | 0 | 0.00% | 1 |
| 4687 | SC35-interacting protein 1 (SRRP129)(= splicing | NM_004719.1 | 0 | 0.00% | 0 | 0.00% | 1 | 0.01% | 0 | 0.00% | 1 |
| 4688 | TAF13 RNA polymerase II, TATA box binding pr | BC017821.1 | 0 | 0.00% | 0 | 0.00% | 0 | 0.00% | 1 | 0.01% | 1 |
| 4689 | TAF7 RNA polymerase II, TATA box binding pro | Hs.155188 | 0 | 0.00% | 0 | 0.00% | 0 | 0.00% | 1 | 0.01% | 1 |
| 4690 | BAT2-related gene | AL096857.1 | 1 | 0.01% | 0 | 0.00% | 0 | 0.00% | 0 | 0.00% | 1 |
| 4691 | BC-2 protein | AF042384 | 0 | 0.00% | 0 | 0.00% | 0 | 0.00% | 1 | 0.01% | 1 |
| 4692 | chitinase 3-like 1(cartilage glycoprotein-39) (CHI | NM_001276.1 | 0 | 0.00% | 1 | 0.01% | 0 | 0.00% | 0 | 0.00% | 1 |
| 4693 | Ig superfamily protein (Z39IG) | NM_007268.1 | 0 | 0.00% | 1 | 0.01% | 0 | 0.00% | 0 | 0.00% | 1 |
| 4694 | lymphocyte antigen 6 complex, locus E (LY6E), | XM_051298.1 | 1 | 0.01% | 0 | 0.00% | 0 | 0.00% | 0 | 0.00% | 1 |
| 4695 | natural killer cell enhancing factor (NKEFB) | L19185.1 | 1 | 0.01% | 0 | 0.00% | 0 | 0.00% | 0 | 0.00% | 1 |
| 4696 | 75-kD autoantigen (PM-Sc1) | M58460 | 0 | 0.00% | 0 | 0.00% | 0 | 0.00% | 1 | 0.01% | 1 |
| 4697 | activity and neurotransmitter-induced early gene | AF050663 | 0 | 0.00% | 0 | 0.00% | 1 | 0.01% | 0 | 0.00% | 1 |
| 4698 | alpha-2-macroglobulin receptor-associated prote | M63959.1 | 1 | 0.01% | 0 | 0.00% | 0 | 0.00% | 0 | 0.00% | 1 |
| 4699 | B-cell receptor associated protein (hBAP) | U72511 | 1 | 0.01% | 0 | 0.00% | 0 | 0.00% | 0 | 0.00% | 1 |
| 4700 | B-cell receptor-associated protein BAP29 | AF126020 | 0 | 0.00% | 0 | 0.00% | 1 | 0.01% | 0 | 0.00% | 1 |
| 4701 | cartilage associated protein | X97607 | 1 | 0.01% | 0 | 0.00% | 0 | 0.00% | 0 | 0.00% | 1 |
| 4702 | cartilage associated protein(CRTAP) | NM_006371.1 | 1 | 0.01% | 0 | 0.00% | 0 | 0.00% | 0 | 0.00% | 1 |
| 4703 | cbl-b | U26710.1 | 0 | 0.00% | 1 | 0.01% | 0 | 0.00% | 0 | 0.00% | 1 |
| 4704 | chromosome 1 immunoglobulin V (K)I | X17278 | 1 | 0.01% | 0 | 0.00% | 0 | 0.00% | 0 | 0.00% | 1 |
| 4705 | early activation antigen CD69 | L07555 | 0 | 0.00% | 0 | 0.00% | 0 | 0.00% | 1 | 0.01% | 1 |
| 4706 | early endosome antigen 1, 162kD (EEA1) | NM_003566.1 | 0 | 0.00% | 0 | 0.00% | 1 | 0.01% | 0 | 0.00% | 1 |
| 4707 | erythroblast macrophage protein EMP | AF084928.1 | 1 | 0.01% | 0 | 0.00% | 0 | 0.00% | 0 | 0.00% | 1 |
| 4708 | HLA CLASS I HISTOCOMPATIBILITY ANTIGEN | P30511 | 0 | 0.00% | 1 | 0.01% | 0 | 0.00% | 0 | 0.00% | 1 |
| 4709 | HLA class I locus C heavy chain | X58536.1 | 0 | 0.00% | 0 | 0.00% | 1 | 0.01% | 0 | 0.00% | 1 |
| 4710 | HLA class III region (NOTCH4 gene) | U89336 | 1 | 0.01% | 0 | 0.00% | 0 | 0.00% | 0 | 0.00% | 1 |
| 4711 | HLA-A gene, HLA-A*0205 allele | L76290.1 | 0 | 0.00% | 1 | 0.01% | 0 | 0.00% | 0 | 0.00% | 1 |
| 4712 | HLA-B associated transcript-2 (D6S51E) =( MSH | NM_004638.1 | 1 | 0.01% | 0 | 0.00% | 0 | 0.00% | 0 | 0.00% | 1 |
| 4713 | HLA-B35 mRNA (ORF) | Z22651 | 0 | 0.00% | 0 | 0.00% | 1 | 0.01% | 0 | 0.00% | 1 |
| 4714 | hla-dr heavy chain cooh terminus | J00200.1 | 0 | 0.00% | 1 | 0.01% | 0 | 0.00% | 0 | 0.00% | 1 |
| 4715 | HMBA-inducible (HIS1)=AB021179 , HEXIM1 pr | NM_006460.1 | 0 | 0.00% | 0 | 0.00% | 1 | 0.01% | 0 | 0.00% | 1 |
| 4716 | immunoglobulin (CD79A) binding protein 1 (IGBI | NM_001551.1 | 1 | 0.01% | 0 | 0.00% | 0 | 0.00% | 0 | 0.00% | 1 |
| 4717 | immunoglobulin G Fc receptor (ORF) | J03619.1 | 0 | 0.00% | 0 | 0.00% | 0 | 0.00% | 1 | 0.01% | 1 |
| 4718 | immunoglobulin superfamily containing leucine-r | AB024537.1 | 0 | 0.00% | 0 | 0.00% | 0 | 0.00% | 1 | 0.01% | 1 |
| 4719 | immunoglobulin superfamily member protein (BL | AF132811.1 | 1 | 0.01% | 0 | 0.00% | 0 | 0.00% | 0 | 0.00% | 1 |
| 4720 | immunoglobulin superfamily, member 6 (IGSF6) | gi5031672 | 0 | 0.00% | 0 | 0.00% | 1 | 0.01% | 0 | 0.00% | 1 |
| 4721 | imogen 38 (RefSeq aa 1e-60) | NP_005821.1 | 0 | 0.00% | 1 | 0.01% | 0 | 0.00% | 0 | 0.00% | 1 |
| 4722 | leukocyte common antigen (T200) | Y00638 | 0 | 0.00% | 0 | 0.00% | 1 | 0.01% | 0 | 0.00% | 1 |
| 4723 | major histocompatibility class II antigen gamma | K01144 | 0 | 0.00% | 0 | 0.00% | 0 | 0.00% | 1 | 0.01% | 1 |
| 4724 | major histocompatibility complex, class I, E (HLA | NM_005516.1 | 0 | 0.00% | 1 | 0.01% | 0 | 0.00% | 0 | 0.00% | 1 |
| 4725 | major Yo paraneoplastic antigen(CDR2) | M63256 | 0 | 0.00% | 0 | 0.00% | 0 | 0.00% | 1 | 0.01% | 1 |
| 4726 | male-enhanced antigen(MEA) | NM_014623.1 | 0 | 0.00% | 1 | 0.01% | 0 | 0.00% | 0 | 0.00% | 1 |
| 4727 | MHC binding protein-2 | AAA36202.1 | 0 | 0.00% | 1 | 0.01% | 0 | 0.00% | 0 | 0.00% | 1 |
| 4728 | MHC class I promoter binding protein (=AF1201( | X65463 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 84 of 102

| | | | | | | | | | | | |
|---|---|---|---|---|---|---|---|---|---|---|---|
| 4729 | miCRoglobulin (ORF){C to A point mutation at n | S82300 | 0 | 0.00% | 0 | 0.00% | 0 | 0.00% | 1 | 0.01% | 1 |
| 4730 | mutant (Daudi) beta2 - miCRoglobulin (ORF) | X07621 | 0 | 0.00% | 0 | 0.00% | 1 | 0.01% | 0 | 0.00% | 1 |
| 4731 | PA28 gamma subunit (Psme3) | AB007139 | 1 | 0.01% | 0 | 0.00% | 0 | 0.00% | 0 | 0.00% | 1 |
| 4732 | SART-1 | AB006198.1 | 0 | 0.00% | 0 | 0.00% | 0 | 0.00% | 1 | 0.01% | 1 |
| 4733 | strain ECOR 24 rrlB operon, complete sequence | AF053967 | 0 | 0.00% | 0 | 0.00% | 0 | 0.00% | 1 | 0.01% | 1 |
| 4734 | SWAP-70 homolog | AF134894.1 | 0 | 0.00% | 1 | 0.01% | 0 | 0.00% | 0 | 0.00% | 1 |
| 4735 | T-cell antigen receptor alpha-chain (TCR-ATF2) | M77167.1 | 0 | 0.00% | 0 | 0.00% | 1 | 0.01% | 0 | 0.00% | 1 |
| 4736 | T-cell nuclear receptor NOT (Nurr1) | AB019433.1 | 0 | 0.00% | 0 | 0.00% | 0 | 0.00% | 1 | 0.01% | 1 |
| 4737 | T-cell receptor alpha chain-c6.1A fusion protein ( | S72931.1 | 0 | 0.00% | 0 | 0.00% | 0 | 0.00% | 1 | 0.01% | 1 |
| 4738 | T-cell receptor alpha delta locus | AF283991.1 | 0 | 0.00% | 1 | 0.01% | 0 | 0.00% | 0 | 0.00% | 1 |
| 4739 | T-cell receptor alpha delta locus from bases 1 to | AE000658.1 | 0 | 0.00% | 0 | 0.00% | 1 | 0.01% | 0 | 0.00% | 1 |
| 4740 | TJ6 protein (RefSeq aa 8e-56) | NP_036595.1 | 0 | 0.00% | 1 | 0.01% | 0 | 0.00% | 0 | 0.00% | 1 |
| 4741 | 180 kDa transmembrane PLA2 receptor | U17033.1 | 0 | 0.00% | 1 | 0.01% | 0 | 0.00% | 0 | 0.00% | 1 |
| 4742 | adult T-cell leukemia derived factor | E01915 | 0 | 0.00% | 0 | 0.00% | 0 | 0.00% | 1 | 0.01% | 1 |
| 4743 | BAG-family molecular chaperone regulator-3 | AF095193 | 1 | 0.01% | 0 | 0.00% | 0 | 0.00% | 0 | 0.00% | 1 |
| 4744 | BAG-family molecular chaperone regulator-5 (=A | AF095195.2 | 0 | 0.00% | 0 | 0.00% | 1 | 0.01% | 0 | 0.00% | 1 |
| 4745 | beta-defensin-1,2 | U50931 | 0 | 0.00% | 0 | 0.00% | 0 | 0.00% | 1 | 0.01% | 1 |
| 4746 | breast epithelial antigen BA46 | U58516 | 1 | 0.01% | 0 | 0.00% | 0 | 0.00% | 0 | 0.00% | 1 |
| 4747 | BTK-binding protein mRNA, complete cds | AF235049.1 | 0 | 0.00% | 1 | 0.01% | 0 | 0.00% | 0 | 0.00% | 1 |
| 4748 | cellular repressor of E1A-stimulated genes (CRE | NM_003851.1 | 0 | 0.00% | 1 | 0.01% | 0 | 0.00% | 0 | 0.00% | 1 |
| 4749 | centromere autoantigen C (CENPC) | M95724 | 0 | 0.00% | 0 | 0.00% | 1 | 0.01% | 0 | 0.00% | 1 |
| 4750 | colon cancer antigen NY-CO-45 mRNA, partial c | AF039442.1 | 0 | 0.00% | 1 | 0.01% | 0 | 0.00% | 0 | 0.00% | 1 |
| 4751 | DARC | X85785.1 | 0 | 0.00% | 1 | 0.01% | 0 | 0.00% | 0 | 0.00% | 1 |
| 4752 | defensin, alpha 3, neutrophil-specific (DEFA3) (= | NM_005217.1 | 0 | 0.00% | 0 | 0.00% | 1 | 0.01% | 0 | 0.00% | 1 |
| 4753 | heat shock 105kD (HSP105B) | NM_006644.1 | 0 | 0.00% | 1 | 0.01% | 0 | 0.00% | 0 | 0.00% | 1 |
| 4754 | HEAT SHOCK COGNATE 71 KD PROTEIN | spP11142 | 1 | 0.01% | 0 | 0.00% | 0 | 0.00% | 0 | 0.00% | 1 |
| 4755 | heat shock factor 2 (HSF2) | M65217 | 1 | 0.01% | 0 | 0.00% | 0 | 0.00% | 0 | 0.00% | 1 |
| 4756 | heat shock protein (=AF085359.1 HSPC030) | AF170920 | 0 | 0.00% | 0 | 0.00% | 0 | 0.00% | 1 | 0.01% | 1 |
| 4757 | heat shock protein (HSP21) mRNA, chloroplast ( | U66300.1 | 1 | 0.01% | 0 | 0.00% | 0 | 0.00% | 0 | 0.00% | 1 |
| 4758 | Heat shock protein 70 testis variant (=M59829 M | D85730 | 1 | 0.01% | 0 | 0.00% | 0 | 0.00% | 0 | 0.00% | 1 |
| 4759 | heat shock protein apg-2 | AB023420.1 | 0 | 0.00% | 0 | 0.00% | 0 | 0.00% | 1 | 0.01% | 1 |
| 4760 | heat shock protein hsp40 =U41290 DNAJ homol | U40992 | 0 | 0.00% | 0 | 0.00% | 0 | 0.00% | 1 | 0.01% | 1 |
| 4761 | HEAT SHOCK PROTEIN, MITOCHONDRIAL 10 | spQ04984 | 0 | 0.00% | 0 | 0.00% | 0 | 0.00% | 1 | 0.01% | 1 |
| 4762 | heat shock protein= HSPA2= L26336= U10284 | U56725 | 0 | 0.00% | 0 | 0.00% | 1 | 0.01% | 0 | 0.00% | 1 |
| 4763 | hepatocellular carcinoma-associated antigen 56/ | AF262403.1 | 1 | 0.01% | 0 | 0.00% | 0 | 0.00% | 0 | 0.00% | 1 |
| 4764 | hepatocellular carcinoma-associated antigen 64 | Hs.314977 | 0 | 0.00% | 0 | 0.00% | 0 | 0.00% | 1 | 0.01% | 1 |
| 4765 | HSP105 alpha (=AF039695.1 antigen NY-CO-25 | AB003334.1 | 0 | 0.00% | 0 | 0.00% | 1 | 0.01% | 0 | 0.00% | 1 |
| 4766 | HSP27 | AB020027.1 | 0 | 0.00% | 1 | 0.01% | 0 | 0.00% | 0 | 0.00% | 1 |
| 4767 | mixed lineage kinase (MLK-3) (=U07747 sprk) | L32976 | 1 | 0.01% | 0 | 0.00% | 0 | 0.00% | 0 | 0.00% | 1 |
| 4768 | MSJ-1 | AB014888 | 1 | 0.01% | 0 | 0.00% | 0 | 0.00% | 0 | 0.00% | 1 |
| 4769 | NA14 protein | Z96932 | 1 | 0.01% | 0 | 0.00% | 0 | 0.00% | 0 | 0.00% | 1 |
| 4770 | novel T-cell activation protein | X94232.1 | 0 | 0.00% | 0 | 0.00% | 1 | 0.01% | 0 | 0.00% | 1 |
| 4771 | p38gamma MAP Kinase (=Y10487 stress activa | U66243 | 1 | 0.01% | 0 | 0.00% | 0 | 0.00% | 0 | 0.00% | 1 |
| 4772 | platelet-endothelial tetraspan antigen 3 | U14650.1 | 0 | 0.00% | 0 | 0.00% | 1 | 0.01% | 0 | 0.00% | 1 |
| 4773 | PML-1 | M79462.1 | 1 | 0.01% | 0 | 0.00% | 0 | 0.00% | 0 | 0.00% | 1 |
| 4774 | polymyositis/scleroderma autoantigen 1(75kD) (I | NP_005024.1 | 0 | 0.00% | 1 | 0.01% | 0 | 0.00% | 0 | 0.00% | 1 |
| 4775 | pre-B cell stimulating factor homologue (SDF1b) | L36033.1 | 1 | 0.01% | 0 | 0.00% | 0 | 0.00% | 0 | 0.00% | 1 |
| 4776 | PX19 protein | AF112203.1 | 0 | 0.00% | 0 | 0.00% | 0 | 0.00% | 1 | 0.01% | 1 |
| 4777 | renal cell carcinoma associated antigen G250 | AJ010588.1 | 1 | 0.01% | 0 | 0.00% | 0 | 0.00% | 0 | 0.00% | 1 |
| 4778 | rheumatoid arthritis related antigen RA-A47 | AB044781.1 | 1 | 0.01% | 0 | 0.00% | 0 | 0.00% | 0 | 0.00% | 1 |
| 4779 | stannin (=DKFZp761P2414) | AF070673.1 | 1 | 0.01% | 0 | 0.00% | 0 | 0.00% | 0 | 0.00% | 1 |
| 4780 | Ste-20 related kinase (RefSeq aa 2e-41) | NP_037365.1 | 0 | 0.00% | 1 | 0.01% | 0 | 0.00% | 0 | 0.00% | 1 |
| 4781 | Ste20-like kinase | X99325 | 1 | 0.01% | 0 | 0.00% | 0 | 0.00% | 0 | 0.00% | 1 |
| 4782 | stress 70 protein chaperone, microsome-associ | NM_006948.1 | 0 | 0.00% | 0 | 0.00% | 0 | 0.00% | 1 | 0.01% | 1 |
| 4783 | stromal antigen 3 (STAG3) | NM_012447.1 | 0 | 0.00% | 1 | 0.01% | 0 | 0.00% | 0 | 0.00% | 1 |
| 4784 | sulfotransferase 1C2 (SULT1C2) gene, complete | AF186263.1 | 0 | 0.00% | 1 | 0.01% | 0 | 0.00% | 0 | 0.00% | 1 |
| 4785 | TP53 target gene (TP53TG1) | NM_007233.1 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 85 of 102

| | | | | | | | | | | | |
|---|---|---|---|---|---|---|---|---|---|---|---|
| 4786 | WP34 (phosphorylated lymphocyte differentiatio | X55188 | 1 | 0.01% | 0 | 0.00% | 0 | 0.00% | 0 | 0.00% | 1 |
| 4787 | ATPase inhibitor precursor | NP_057395.1 | 0 | 0.00% | 1 | 0.01% | 0 | 0.00% | 0 | 0.00% | 1 |
| 4788 | BAI-associated protein 3 (=AB018277 hypothetic | AB017111 | 1 | 0.01% | 0 | 0.00% | 0 | 0.00% | 0 | 0.00% | 1 |
| 4789 | beta-site APP-cleaving enzyme (RefSeq aa 5e-8 | NP_036236.1 | 0 | 0.00% | 1 | 0.01% | 0 | 0.00% | 0 | 0.00% | 1 |
| 4790 | interferon induced transmembrane protein 3 (1-8 | NM_021034.1 | 1 | 0.01% | 0 | 0.00% | 0 | 0.00% | 0 | 0.00% | 1 |
| 4791 | INTERFERON-INDUCED TRANSMEMBRANE I | spQ01628 | 0 | 0.00% | 1 | 0.01% | 0 | 0.00% | 0 | 0.00% | 1 |
| 4792 | MEMBRANE PROTEIN C21ORF4 17.9 KD | P56557 | 0 | 0.00% | 0 | 0.00% | 1 | 0.01% | 0 | 0.00% | 1 |
| 4793 | trans-Golgi p230 | U41740 | 0 | 0.00% | 0 | 0.00% | 0 | 0.00% | 1 | 0.01% | 1 |
| 4794 | Adaptor protein containing pH domain, PTB dom | NM_012096.1 | 0 | 0.00% | 0 | 0.00% | 0 | 0.00% | 1 | 0.01% | 1 |
| 4795 | adaptor-related protein complex 1, gamma 2 sub | NM_003917.1 | 1 | 0.01% | 0 | 0.00% | 0 | 0.00% | 0 | 0.00% | 1 |
| 4796 | apoferritin H (=M11146) | X03488 | 0 | 0.00% | 0 | 0.00% | 1 | 0.01% | 0 | 0.00% | 1 |
| 4797 | BIOTIN CARBOXYL CARRIER PROTEIN OF M | P02904 | 0 | 0.00% | 0 | 0.00% | 1 | 0.01% | 0 | 0.00% | 1 |
| 4798 | cationic amino acid transporter-2A (ATRC2) | U76368 | 0 | 0.00% | 0 | 0.00% | 0 | 0.00% | 1 | 0.01% | 1 |
| 4799 | coatomer protein complex, subunit beta (COPB) | NM_016451.1 | 0 | 0.00% | 1 | 0.01% | 0 | 0.00% | 0 | 0.00% | 1 |
| 4800 | coatomer protein complex, subunit epsilon (COF | NM_007263.1 | 1 | 0.01% | 0 | 0.00% | 0 | 0.00% | 0 | 0.00% | 1 |
| 4801 | coatomer protein complex, subunit gamma 2 (Re | NP_036265.1 | 0 | 0.00% | 1 | 0.01% | 0 | 0.00% | 0 | 0.00% | 1 |
| 4802 | constitutively expressed serum amyloid A protei | L05920.1 | 0 | 0.00% | 0 | 0.00% | 0 | 0.00% | 1 | 0.01% | 1 |
| 4803 | COPZ2 for nonclathrin coat protein zeta-COP (L | NM_016429.1 | 1 | 0.01% | 0 | 0.00% | 0 | 0.00% | 0 | 0.00% | 1 |
| 4804 | corin (RefSeq aa 7e-45) | NP_006578.1 | 0 | 0.00% | 1 | 0.01% | 0 | 0.00% | 0 | 0.00% | 1 |
| 4805 | DUTT1 (chromosome 3) | Z95705.1 | 0 | 0.00% | 0 | 0.00% | 0 | 0.00% | 1 | 0.01% | 1 |
| 4806 | EGF repeat transmembrane protein | U57368 | 0 | 0.00% | 0 | 0.00% | 1 | 0.01% | 0 | 0.00% | 1 |
| 4807 | ENIGMA protein | AF265209.1 | 1 | 0.01% | 0 | 0.00% | 0 | 0.00% | 0 | 0.00% | 1 |
| 4808 | epithelial membrane protein 2 (EMP2) | NM_001424.1 | 0 | 0.00% | 0 | 0.00% | 0 | 0.00% | 1 | 0.01% | 1 |
| 4809 | erythrocyte adducin alpha subunit | X58141 | 1 | 0.01% | 0 | 0.00% | 0 | 0.00% | 0 | 0.00% | 1 |
| 4810 | ferroportin 1; iron regulated gene 1 (FPN1)(= SL | NM_014585.1 | 1 | 0.01% | 0 | 0.00% | 0 | 0.00% | 0 | 0.00% | 1 |
| 4811 | golgi membrane protein GP73(LOC51280) | NM_016548.1 | 0 | 0.00% | 1 | 0.01% | 0 | 0.00% | 0 | 0.00% | 1 |
| 4812 | Golgi membrane protein type II (RefSeq aa 4e-3 | NP_055313.1 | 0 | 0.00% | 1 | 0.01% | 0 | 0.00% | 0 | 0.00% | 1 |
| 4813 | Ke4 gene, mouse, human homolog of (D6S2244 | NM_006979.1 | 1 | 0.01% | 0 | 0.00% | 0 | 0.00% | 0 | 0.00% | 1 |
| 4814 | LIM domain kinase 2 (LIMK2) | NM_005569.2 | 1 | 0.01% | 0 | 0.00% | 0 | 0.00% | 0 | 0.00% | 1 |
| 4815 | lysosomal apyrase-like 1 (LYSAL1) | XM_040572.1 | 1 | 0.01% | 0 | 0.00% | 0 | 0.00% | 0 | 0.00% | 1 |
| 4816 | membrane interacting protein of RGS16 (MIR16) | NM_016641.1 | 1 | 0.01% | 0 | 0.00% | 0 | 0.00% | 0 | 0.00% | 1 |
| 4817 | membrane metallo-endopeptidase (neutral endo | NM_000902.1 | 0 | 0.00% | 0 | 0.00% | 1 | 0.01% | 0 | 0.00% | 1 |
| 4818 | mouse SKD1 homolog (SKD1) | NM_004869.1 | 0 | 0.00% | 0 | 0.00% | 1 | 0.01% | 0 | 0.00% | 1 |
| 4819 | multispanning nuclear envelope membrane prote | AF143676.1 | 1 | 0.01% | 0 | 0.00% | 0 | 0.00% | 0 | 0.00% | 1 |
| 4820 | myoglobin (MB), mRNA | NM_005368.1 | 1 | 0.01% | 0 | 0.00% | 0 | 0.00% | 0 | 0.00% | 1 |
| 4821 | myo-inositol monophosphatase A3 (IMPA3) | AY032885.1 | 1 | 0.01% | 0 | 0.00% | 0 | 0.00% | 0 | 0.00% | 1 |
| 4822 | N-ethylmaleimide-sensitive factor (NSF) | AF135168.1 | 0 | 0.00% | 0 | 0.00% | 0 | 0.00% | 1 | 0.01% | 1 |
| 4823 | neuronal membrane glycoprotein M6b | U45955 | 0 | 0.00% | 0 | 0.00% | 1 | 0.01% | 0 | 0.00% | 1 |
| 4824 | PEX13 | AB022192.1 | 0 | 0.00% | 0 | 0.00% | 0 | 0.00% | 1 | 0.01% | 1 |
| 4825 | phosphate carrier precursor isoform 1a;phospha | NP_005879.1 | 0 | 0.00% | 1 | 0.01% | 0 | 0.00% | 0 | 0.00% | 1 |
| 4826 | placental protein 17b1 (PP17)(=cargo selection | AF055574.1 | 0 | 0.00% | 0 | 0.00% | 1 | 0.01% | 0 | 0.00% | 1 |
| 4827 | progestin induced protein (DD5), mRNA /cds=(3 | Hs.278428 | 0 | 0.00% | 0 | 0.00% | 0 | 0.00% | 1 | 0.01% | 1 |
| 4828 | putative membrane protein, complete cds | AB020980.1 | 0 | 0.00% | 0 | 0.00% | 0 | 0.00% | 1 | 0.01% | 1 |
| 4829 | putative heme-binding protein (SOUL) | NM_014320.1 | 0 | 0.00% | 1 | 0.01% | 0 | 0.00% | 0 | 0.00% | 1 |
| 4830 | putative integral membrane transporter (LC27) | NM_018407.1 | 1 | 0.01% | 0 | 0.00% | 0 | 0.00% | 0 | 0.00% | 1 |
| 4831 | putative transmembrane receptor (frizzled 4) | U43317 | 1 | 0.01% | 0 | 0.00% | 0 | 0.00% | 0 | 0.00% | 1 |
| 4832 | secretory granule neuroendocrine protein 1 (7B2 | NM_003020.1 | 1 | 0.01% | 0 | 0.00% | 0 | 0.00% | 0 | 0.00% | 1 |
| 4833 | seven transmembrane segment receptor | M99293 | 0 | 0.00% | 0 | 0.00% | 1 | 0.01% | 0 | 0.00% | 1 |
| 4834 | supervillin (SVIL) | XM_030476.2 | 1 | 0.01% | 0 | 0.00% | 0 | 0.00% | 0 | 0.00% | 1 |
| 4835 | tetraspan 3; Tspan-3 (RefSeq aa 8e-51) | NP_005715.1 | 0 | 0.00% | 1 | 0.01% | 0 | 0.00% | 0 | 0.00% | 1 |
| 4836 | tetraspan NET-1 | AF065388.1 | 0 | 0.00% | 0 | 0.00% | 1 | 0.01% | 0 | 0.00% | 1 |
| 4837 | tetraspan NET-6 protein(NET-6), mRNA | NM_014399.1 | 1 | 0.01% | 0 | 0.00% | 0 | 0.00% | 0 | 0.00% | 1 |
| 4838 | tetraspanin TM4-D | AF133426.1 | 0 | 0.00% | 0 | 0.00% | 0 | 0.00% | 1 | 0.01% | 1 |
| 4839 | translocase of inner mitochondrial membrane 10 | NM_012456.1 | 1 | 0.01% | 0 | 0.00% | 0 | 0.00% | 0 | 0.00% | 1 |
| 4840 | translocase of inner mitochondrial membrane 8 ( | XM_041384.1 | 1 | 0.01% | 0 | 0.00% | 0 | 0.00% | 0 | 0.00% | 1 |
| 4841 | transmembrane 4 superfamily protein (SAS) (OF | U01160 | 0 | 0.00% | 0 | 0.00% | 0 | 0.00% | 1 | 0.01% | 1 |
| 4842 | transmembrane 7 superfamily member 1 (upregu | gi4507544 | 0 | 0.00% | 0 | 0.00% | 0 | 0.00% | 1 | 0.01% | 1 |

Figure 6 - Unique Known Genes Identified In Four cDNA Cartilage Libraries and EST Frequency Analysis - Page 86 of 102

| | | | | | | | | | | | |
|---|---|---|---|---|---|---|---|---|---|---|---|
| 4843 | transmembrane GTPase | U95822.1 | 0 | 0.00% | 1 | 0.01% | 0 | 0.00% | 0 | 0.00% | 1 |
| 4844 | transmembrane protein 4 (TMEM4), mRNA /cds | Hs.8752 | 0 | 0.00% | 0 | 0.00% | 1 | 0.01% | 0 | 0.00% | 1 |
| 4845 | transmembrane protein CD99 type II | U82164 | 1 | 0.01% | 0 | 0.00% | 0 | 0.00% | 0 | 0.00% | 1 |
| 4846 | transmembrane protein with EGF-like and two fo | U19878 | 0 | 0.00% | 0 | 0.00% | 0 | 0.00% | 1 | 0.01% | 1 |
| 4847 | transmembrane proteolipid (HSPC224) | NM_016951.2 | 0 | 0.00% | 1 | 0.01% | 0 | 0.00% | 0 | 0.00% | 1 |
| 4848 | transmembrane trafficking protein (TMP21), mRI | Hs.74137 | 0 | 0.00% | 0 | 0.00% | 1 | 0.01% | 0 | 0.00% | 1 |
| 4849 | VAMP (vesicle-associated membrane protein)-a | NM_004738.1 | 1 | 0.01% | 0 | 0.00% | 0 | 0.00% | 0 | 0.00% | 1 |
| 4850 | mutL (E. coli) homolog 3 (MLH3) | NM_014381.1 | 1 | 0.01% | 0 | 0.00% | 0 | 0.00% | 0 | 0.00% | 1 |
| 4851 | mutY homolog (hMYH) | U63329 | 1 | 0.01% | 0 | 0.00% | 0 | 0.00% | 0 | 0.00% | 1 |
| 4852 | alanyl-tRNA synthetase (AARS) | NM_001605.1 | 0 | 0.00% | 1 | 0.01% | 0 | 0.00% | 0 | 0.00% | 1 |
| 4853 | damage-specific DNA binding protein 2 (48kD) ( | NM_000107.1 | 1 | 0.01% | 0 | 0.00% | 0 | 0.00% | 0 | 0.00% | 1 |
| 4854 | DNA recombination and repair protein (MRE11B | AF022778 | 0 | 0.00% | 0 | 0.00% | 0 | 0.00% | 1 | 0.01% | 1 |
| 4855 | DNA repair protein XRCC4 | U40622 | 0 | 0.00% | 0 | 0.00% | 0 | 0.00% | 1 | 0.01% | 1 |
| 4856 | DNA topoisomerase gene type I, exon 8 | M60694.1 | 0 | 0.00% | 1 | 0.01% | 0 | 0.00% | 0 | 0.00% | 1 |
| 4857 | DNA topoisomerase II binding protein | AB019397 | 1 | 0.01% | 0 | 0.00% | 0 | 0.00% | 0 | 0.00% | 1 |
| 4858 | excision repair gene ERCC-1 | X07415 | 1 | 0.01% | 0 | 0.00% | 0 | 0.00% | 0 | 0.00% | 1 |
| 4859 | Helicase (KIAA0054) | NM_014877.1 | 1 | 0.01% | 0 | 0.00% | 0 | 0.00% | 0 | 0.00% | 1 |
| 4860 | HHR23A protein | D21235 | 0 | 0.00% | 0 | 0.00% | 0 | 0.00% | 1 | 0.01% | 1 |
| 4861 | KIAA0054 gene product; Helicase (RefSeq aa 1 | NP_055692.1 | 0 | 0.00% | 1 | 0.01% | 0 | 0.00% | 0 | 0.00% | 1 |
| 4862 | nucleolar RNA-helicase (noH61 gene) | AJ131712.1 | 1 | 0.01% | 0 | 0.00% | 0 | 0.00% | 0 | 0.00% | 1 |
| 4863 | putative RNA helicase, 3' end | AJ223948.1 | 0 | 0.00% | 1 | 0.01% | 0 | 0.00% | 0 | 0.00% | 1 |
| 4864 | RAD50 (S. cerevisiae) homolog (RefSeq aa 2e-3 | NP_005723.1 | 0 | 0.00% | 1 | 0.01% | 0 | 0.00% | 0 | 0.00% | 1 |
| 4865 | RAD50-2 protein (RAD50) | AF057299.1 | 0 | 0.00% | 0 | 0.00% | 1 | 0.01% | 0 | 0.00% | 1 |
| 4866 | Rad51-interacting protein (60% aa) | AF006259 | 0 | 0.00% | 0 | 0.00% | 1 | 0.01% | 0 | 0.00% | 1 |
| 4867 | RAD9 (S. pombe)(RAD9)(=cell cycle checkpoint | NM_004584.1 | 1 | 0.01% | 0 | 0.00% | 0 | 0.00% | 0 | 0.00% | 1 |
| 4868 | SWI/SNF related, matrix associated, actin deper | NM_003078.1 | 1 | 0.01% | 0 | 0.00% | 0 | 0.00% | 0 | 0.00% | 1 |
| 4869 | SWI/SNF related, matrix associated, actin deper | NM_003079.1 | 1 | 0.01% | 0 | 0.00% | 0 | 0.00% | 0 | 0.00% | 1 |
| 4870 | T-COMPLEX PROTEIN 1, EPSILON SUBUNIT ( | spP48643 | 0 | 0.00% | 0 | 0.00% | 0 | 0.00% | 1 | 0.01% | 1 |
| 4871 | T-COMPLEX PROTEIN 1, THETA SUBUNIT (T( | spP50990 | 0 | 0.00% | 0 | 0.00% | 1 | 0.01% | 0 | 0.00% | 1 |
| 4872 | transketolase-like 1 (TKTL1) | NM_012253.1 | 0 | 0.00% | 1 | 0.01% | 0 | 0.00% | 0 | 0.00% | 1 |
| 4873 | xeroderma pigmentosum complementation grou | NM_000380.1 | 0 | 0.00% | 1 | 0.01% | 0 | 0.00% | 0 | 0.00% | 1 |
| 4874 | adenylate kinase 2 (AK2),transcript variant AK2/ | NM_001625.1 | 0 | 0.00% | 0 | 0.00% | 1 | 0.01% | 0 | 0.00% | 1 |
| 4875 | carbonic anhydrase III | M29452 | 1 | 0.01% | 0 | 0.00% | 0 | 0.00% | 0 | 0.00% | 1 |
| 4876 | carbonic anhydrase XII (CA12) | NM_001218.1 | 1 | 0.01% | 0 | 0.00% | 0 | 0.00% | 0 | 0.00% | 1 |
| 4877 | ceruloplasmin, exon 10 (ORF) | D45037 | 0 | 0.00% | 0 | 0.00% | 1 | 0.01% | 0 | 0.00% | 1 |
| 4878 | coagulation factor VIII | AF062515 | 0 | 0.00% | 0 | 0.00% | 1 | 0.01% | 0 | 0.00% | 1 |
| 4879 | complement C1q A chain precursor | AF135157.1 | 0 | 0.00% | 0 | 0.00% | 0 | 0.00% | 1 | 0.01% | 1 |
| 4880 | complement component 2 (RefSeq aa 7e-80) | NP_000054.1 | 0 | 0.00% | 1 | 0.01% | 0 | 0.00% | 0 | 0.00% | 1 |
| 4881 | complement component 3 precursor (RefSeq aa | NP_000055.1 | 0 | 0.00% | 1 | 0.01% | 0 | 0.00% | 0 | 0.00% | 1 |
| 4882 | complement component 3a receptor 1 (RefSeq a | NP_004045.1 | 0 | 0.00% | 1 | 0.01% | 0 | 0.00% | 0 | 0.00% | 1 |
| 4883 | complement decay-accelerating factor (DAF) (=I | M15799 | 0 | 0.00% | 0 | 0.00% | 1 | 0.01% | 0 | 0.00% | 1 |
| 4884 | cytochrome P450 21-hydroxylase (CYP21) gene | AF077974.1 | 1 | 0.01% | 0 | 0.00% | 0 | 0.00% | 0 | 0.00% | 1 |
| 4885 | cytochrome P450 3A9 | U46118 | 1 | 0.01% | 0 | 0.00% | 0 | 0.00% | 0 | 0.00% | 1 |
| 4886 | cytochrome P450 monooxygenase (LOC57404) | NM_020674.1 | 0 | 0.00% | 1 | 0.01% | 0 | 0.00% | 0 | 0.00% | 1 |
| 4887 | cytochrome P450, subfamily IVA, polypeptide 11 | NP_000769.1 | 0 | 0.00% | 1 | 0.01% | 0 | 0.00% | 0 | 0.00% | 1 |
| 4888 | epoxide hydrolase 2, cytoplasmic (EPHX2) | NM_001979.1 | 0 | 0.00% | 1 | 0.01% | 0 | 0.00% | 0 | 0.00% | 1 |
| 4889 | glutathione S-transferase A4 (GSTA4) | NM_001512.1 | 0 | 0.00% | 0 | 0.00% | 1 | 0.01% | 0 | 0.00% | 1 |
| 4890 | glutathione S-transferase theta 2 (GSTT2) (GST | AF240786.1 | 0 | 0.00% | 1 | 0.01% | 0 | 0.00% | 0 | 0.00% | 1 |
| 4891 | glutathione S-transferase= (MICROSOMAL GST | J03746.1 | 0 | 0.00% | 0 | 0.00% | 1 | 0.01% | 0 | 0.00% | 1 |
| 4892 | glutathione synthetase | U34683 | 1 | 0.01% | 0 | 0.00% | 0 | 0.00% | 0 | 0.00% | 1 |
| 4893 | glutathione transferase M2 (GSTM2) | M63509 | 1 | 0.01% | 0 | 0.00% | 0 | 0.00% | 0 | 0.00% | 1 |
| 4894 | gpx1 gluthatione peroxidase (=Y00433) | X13709 | 1 | 0.01% | 0 | 0.00% | 0 | 0.00% | 0 | 0.00% | 1 |
| 4895 | iron-responsive element-binding protein/iron reg | M58510 | 1 | 0.01% | 0 | 0.00% | 0 | 0.00% | 0 | 0.00% | 1 |
| 4896 | lactoferrin BTLF3 | L24753 | 1 | 0.01% | 0 | 0.00% | 0 | 0.00% | 0 | 0.00% | 1 |
| 4897 | light chain of factor I | CAA68418.1 | 0 | 0.00% | 0 | 0.00% | 1 | 0.01% | 0 | 0.00% | 1 |
| 4898 | metallothionein 2A; MT-II (RefSeq aa 8e-30) | NP_005944.1 | 0 | 0.00% | 1 | 0.01% | 0 | 0.00% | 0 | 0.00% | 1 |
| 4899 | MHC class II DR subtype Dw12 | M16086.1 | 0 | 0.00% | 0 | 0.00% | 1 | 0.01% | 0 | 0.00% | 1 |

Figure 6 - Unique Known Genes Identified In Four cDNA Cartilage Libraries and EST Frequency Analysis - Page 87 of 102

| | | | | | | | | | | | |
|---|---|---|---|---|---|---|---|---|---|---|---|
| 4900 | MHC class II HLA-DR7-associated glycoprotein | M16941.1 | 0 | 0.00% | 0 | 0.00% | 0 | 0.00% | 1 | 0.01% | 1 |
| 4901 | MHC class II HLA-DR-beta-1 (HLA-DRB1) | M33600 | 0 | 0.00% | 0 | 0.00% | 0 | 0.00% | 1 | 0.01% | 1 |
| 4902 | MHC HLA-Dw12 DQ-beta chain | M57650.1 | 0 | 0.00% | 0 | 0.00% | 1 | 0.01% | 0 | 0.00% | 1 |
| 4903 | MHC leukocyte antigen (HLA-A) gene, HLA-A*2 | L47206.1 | 1 | 0.01% | 0 | 0.00% | 0 | 0.00% | 0 | 0.00% | 1 |
| 4904 | MTA1 like1 | AB016591.1 | 1 | 0.01% | 0 | 0.00% | 0 | 0.00% | 0 | 0.00% | 1 |
| 4905 | MTG8-like protein(MTGR1) gene | AF076461.1 | 0 | 0.00% | 0 | 0.00% | 1 | 0.01% | 0 | 0.00% | 1 |
| 4906 | MTH1b (p22), MTH1c (p21), MTH1d (p18) | AB025239.1 | 1 | 0.01% | 0 | 0.00% | 0 | 0.00% | 0 | 0.00% | 1 |
| 4907 | pentaxin-related gene rapidly induced by IL-1 be | NM_002852.1 | 1 | 0.01% | 0 | 0.00% | 0 | 0.00% | 0 | 0.00% | 1 |
| 4908 | peroxiredoxin 3; thioredoxin-dependentperoxide | NP_006784.1 | 0 | 0.00% | 1 | 0.01% | 0 | 0.00% | 0 | 0.00% | 1 |
| 4909 | PHEX gene | Y10196.1 | 0 | 0.00% | 1 | 0.01% | 0 | 0.00% | 0 | 0.00% | 1 |
| 4910 | prothrombin (F2) gene (Alu and KpnI repeats) | M17262.1 | 0 | 0.00% | 0 | 0.00% | 1 | 0.01% | 0 | 0.00% | 1 |
| 4911 | small inducible cytokine subfamily A(Cys-Cys), r | NP_005614.1 | 0 | 0.00% | 1 | 0.01% | 0 | 0.00% | 0 | 0.00% | 1 |
| 4912 | small inducible cytokine subfamily B (Cys-X-Cys | NM_004887.1 | 0 | 0.00% | 1 | 0.01% | 0 | 0.00% | 0 | 0.00% | 1 |
| 4913 | Sop2p-like protein | Y08999 | 0 | 0.00% | 0 | 0.00% | 1 | 0.01% | 0 | 0.00% | 1 |
| 4914 | Su (P) (=Z70310 C.elegans glutathione S-transf | AJ011320 | 1 | 0.01% | 0 | 0.00% | 0 | 0.00% | 0 | 0.00% | 1 |
| 4915 | superoxide dismutase 1 soluble (amyotrophic la | XM_047885.1 | 1 | 0.01% | 0 | 0.00% | 0 | 0.00% | 0 | 0.00% | 1 |
| 4916 | superoxide dismutase 3, extracellular (SOD3) | NM_003102.1 | 1 | 0.01% | 0 | 0.00% | 0 | 0.00% | 0 | 0.00% | 1 |
| 4917 | superoxide dismutase Mn (EC 1.15.1.1+D3527) | Y00472.1 | 0 | 0.00% | 1 | 0.01% | 0 | 0.00% | 0 | 0.00% | 1 |
| 4918 | thiol-specific antioxidant | X82321 | 1 | 0.01% | 0 | 0.00% | 0 | 0.00% | 0 | 0.00% | 1 |
| 4919 | thioredoxin reductase 1 (TXNRD1) | NM_003330.1 | 0 | 0.00% | 1 | 0.01% | 0 | 0.00% | 0 | 0.00% | 1 |
| 4920 | Chediak-Higashi syndrome 1 (CHS1) | NM_000081.1 | 0 | 0.00% | 0 | 0.00% | 0 | 0.00% | 1 | 0.01% | 1 |
| 4921 | Ankhzn mRNA, | AB011370 | 0 | 0.00% | 0 | 0.00% | 1 | 0.01% | 0 | 0.00% | 1 |
| 4922 | arfaptin 1 (HSU52521) | NM_014447.1 | 0 | 0.00% | 1 | 0.01% | 0 | 0.00% | 0 | 0.00% | 1 |
| 4923 | intersectin short form | AF064243 | 0 | 0.00% | 0 | 0.00% | 1 | 0.01% | 0 | 0.00% | 1 |
| 4924 | alpha endosulfine | AF157509.1 | 0 | 0.00% | 1 | 0.01% | 0 | 0.00% | 0 | 0.00% | 1 |
| 4925 | caveolin 2 (CAV2) | NM_001233.1 | 0 | 0.00% | 0 | 0.00% | 0 | 0.00% | 1 | 0.01% | 1 |
| 4926 | caveolin 3 (CAV3) | NM_001234.2 | 1 | 0.01% | 0 | 0.00% | 0 | 0.00% | 0 | 0.00% | 1 |
| 4927 | caveolin-1/-2 locus, Contig1, D7S522, genes CA | AJ133269.1 | 0 | 0.00% | 0 | 0.00% | 1 | 0.01% | 0 | 0.00% | 1 |
| 4928 | clathrin assembly protein 50 (AP50) (=D63475 h | U36188 | 1 | 0.01% | 0 | 0.00% | 0 | 0.00% | 0 | 0.00% | 1 |
| 4929 | clathrin coat assembly protein | E13406 | 0 | 0.00% | 0 | 0.00% | 0 | 0.00% | 1 | 0.01% | 1 |
| 4930 | clathrin, light polypeptide (Lcb) (CLTB) | NM_001834.1 | 1 | 0.01% | 0 | 0.00% | 0 | 0.00% | 0 | 0.00% | 1 |
| 4931 | clathrin-associated protein | X97074.1 | 1 | 0.01% | 0 | 0.00% | 0 | 0.00% | 0 | 0.00% | 1 |
| 4932 | Hermansky-Pudlak syndrome (HPS) | NM_000195.1 | 1 | 0.01% | 0 | 0.00% | 0 | 0.00% | 0 | 0.00% | 1 |
| 4933 | kanadaptin | AF035526 | 0 | 0.00% | 0 | 0.00% | 1 | 0.01% | 0 | 0.00% | 1 |
| 4934 | myoM [Dictyostelium discoideum](38%ORF) | AB017910 | 1 | 0.01% | 0 | 0.00% | 0 | 0.00% | 0 | 0.00% | 1 |
| 4935 | partial SNAP-23 gene for synaptosome associat | AJ278974.1 | 0 | 0.00% | 1 | 0.01% | 0 | 0.00% | 0 | 0.00% | 1 |
| 4936 | Rab7 protein | X89650 | 0 | 0.00% | 0 | 0.00% | 0 | 0.00% | 1 | 0.01% | 1 |
| 4937 | SKD1 homologue | AF038960 | 1 | 0.01% | 0 | 0.00% | 0 | 0.00% | 0 | 0.00% | 1 |
| 4938 | SMCY (H-Y) | U52191 | 1 | 0.01% | 0 | 0.00% | 0 | 0.00% | 0 | 0.00% | 1 |
| 4939 | symplekin; Huntingtin interacting protein I (SPK) | XM_017129.2 | 1 | 0.01% | 0 | 0.00% | 0 | 0.00% | 0 | 0.00% | 1 |
| 4940 | synaptosome associated protein 23 kD isoform | AJ011915.1 | 0 | 0.00% | 0 | 0.00% | 1 | 0.01% | 0 | 0.00% | 1 |
| 4941 | vesicle trafficking protein (SEC22C) (ORF) | AF039568 | 0 | 0.00% | 0 | 0.00% | 1 | 0.01% | 0 | 0.00% | 1 |
| 4942 | VPS28 protein (LOC51160)(ORF) | NM_016208.1 | 1 | 0.01% | 0 | 0.00% | 0 | 0.00% | 0 | 0.00% | 1 |
| 4943 | zinc/ iron regulated transporter-like (ZIRTL) (=pu | NM_014437.1 | 0 | 0.00% | 1 | 0.01% | 0 | 0.00% | 0 | 0.00% | 1 |
| 4944 | synaptosomal-associated protein 25kD (SNAP2 | XM_056115.1 | 1 | 0.01% | 0 | 0.00% | 0 | 0.00% | 0 | 0.00% | 1 |
| 4945 | 4F2 heavy chain | AB018010.1 | 1 | 0.01% | 0 | 0.00% | 0 | 0.00% | 0 | 0.00% | 1 |
| 4946 | 88-kDa Golgi protein (GM88) | AF204231.1 | 0 | 0.00% | 0 | 0.00% | 0 | 0.00% | 1 | 0.01% | 1 |
| 4947 | CG12935 gene product | AAF58754.1 | 0 | 0.00% | 0 | 0.00% | 1 | 0.01% | 0 | 0.00% | 1 |
| 4948 | CG13865 gene product [Drosophila melanogast | AE003066 | 0 | 0.00% | 1 | 0.01% | 0 | 0.00% | 0 | 0.00% | 1 |
| 4949 | CG13919 gene product | AE003472 | 0 | 0.00% | 0 | 0.00% | 0 | 0.00% | 1 | 0.01% | 1 |
| 4950 | CG14037 gene product | AAF52201.1 | 0 | 0.00% | 1 | 0.01% | 0 | 0.00% | 0 | 0.00% | 1 |
| 4951 | CG14903 gene product | AAF55335.1 | 0 | 0.00% | 1 | 0.01% | 0 | 0.00% | 0 | 0.00% | 1 |
| 4952 | CG17593 gene product [Drosophila melanogast | AE003579 | 0 | 0.00% | 1 | 0.01% | 0 | 0.00% | 0 | 0.00% | 1 |
| 4953 | CG2839 gene product | AAF51469.1 | 0 | 0.00% | 0 | 0.00% | 1 | 0.01% | 0 | 0.00% | 1 |
| 4954 | CG3358 gene product | AAF57413.1 | 0 | 0.00% | 0 | 0.00% | 0 | 0.00% | 1 | 0.01% | 1 |
| 4955 | CG3918 gene product [Drosophila melanogaster | AAF46166.1 | 0 | 0.00% | 0 | 0.00% | 1 | 0.01% | 0 | 0.00% | 1 |
| 4956 | CG6949 gene product | AE003739 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 88 of 102

| | | | | | | | | | | | |
|---|---|---|---|---|---|---|---|---|---|---|---|
| 4957 | CG8605 gene product [Drosophila melanogaster | AE003559 | 1 | 0.01% | 0 | 0.00% | 0 | 0.00% | 0 | 0.00% | 1 |
| 4958 | CG9469 gene product | AAF57414.1 | 0 | 0.00% | 0 | 0.00% | 1 | 0.01% | 0 | 0.00% | 1 |
| 4959 | CGI-03 protein (=AF106798 fas-associated facto | AF132938.1 | 0 | 0.00% | 0 | 0.00% | 1 | 0.01% | 0 | 0.00% | 1 |
| 4960 | CGI-06 protein (LOC51604), | NM_015937.1 | 0 | 0.00% | 1 | 0.01% | 0 | 0.00% | 0 | 0.00% | 1 |
| 4961 | CGI-10 protein (LOC51004), | NM_015940.1 | 0 | 0.00% | 1 | 0.01% | 0 | 0.00% | 0 | 0.00% | 1 |
| 4962 | CGI-12 protein (RefSeq aa 1e-68) | NP_057026.1 | 0 | 0.00% | 1 | 0.01% | 0 | 0.00% | 0 | 0.00% | 1 |
| 4963 | CGI-125 protein (RefSeq aa 1e-30) | NP_057144.1 | 0 | 0.00% | 1 | 0.01% | 0 | 0.00% | 0 | 0.00% | 1 |
| 4964 | CGI-128 protein (ORF) | AF151886 | 0 | 0.00% | 0 | 0.00% | 0 | 0.00% | 1 | 0.01% | 1 |
| 4965 | CGI-145 protein (RefSeq aa 2e-48) | NP_057159.1 | 0 | 0.00% | 1 | 0.01% | 0 | 0.00% | 0 | 0.00% | 1 |
| 4966 | CGI-17 protein | AF132951.1 | 0 | 0.00% | 0 | 0.00% | 0 | 0.00% | 1 | 0.01% | 1 |
| 4967 | CGI-18 protein (LOC51008) | NM_015947.1 | 1 | 0.01% | 0 | 0.00% | 0 | 0.00% | 0 | 0.00% | 1 |
| 4968 | CGI-26 protein (LOC51071) | NM_015954.1 | 0 | 0.00% | 0 | 0.00% | 0 | 0.00% | 1 | 0.01% | 1 |
| 4969 | CGI-27 protein | AF132961.1 | 0 | 0.00% | 0 | 0.00% | 0 | 0.00% | 1 | 0.01% | 1 |
| 4970 | CGI-35 protein (LOC51077) | NM_015962.1 | 0 | 0.00% | 1 | 0.01% | 0 | 0.00% | 0 | 0.00% | 1 |
| 4971 | CGI-47 protein (LOC51095)(ORF) | NM_016000.1 | 0 | 0.00% | 0 | 0.00% | 0 | 0.00% | 1 | 0.01% | 1 |
| 4972 | CGI-48 protein (LOC51096) | NM_016001.1 | 1 | 0.01% | 0 | 0.00% | 0 | 0.00% | 0 | 0.00% | 1 |
| 4973 | CGI-54 protein (60% aa) | AF151812 | 0 | 0.00% | 0 | 0.00% | 0 | 0.00% | 1 | 0.01% | 1 |
| 4974 | CGI-79 protein (RefSeq aa 2e-76) | NP_057108.1 | 0 | 0.00% | 1 | 0.01% | 0 | 0.00% | 0 | 0.00% | 1 |
| 4975 | CGI-80 protein | AF151838.1 | 0 | 0.00% | 0 | 0.00% | 1 | 0.01% | 0 | 0.00% | 1 |
| 4976 | CGI-85 protein (LOC51111) | NM_016028.1 | 0 | 0.00% | 1 | 0.01% | 0 | 0.00% | 0 | 0.00% | 1 |
| 4977 | CGI-87 protein (LOC51112) | NM_016030.1 | 1 | 0.01% | 0 | 0.00% | 0 | 0.00% | 0 | 0.00% | 1 |
| 4978 | cytoplasmic dynein intermediate chain 2C mRNA | U39046.1 | 0 | 0.00% | 0 | 0.00% | 0 | 0.00% | 1 | 0.01% | 1 |
| 4979 | cytoskeleton-associated protein 4 (CKAP4), mRI | XM_006940.4 | 1 | 0.01% | 0 | 0.00% | 0 | 0.00% | 0 | 0.00% | 1 |
| 4980 | diaphanous 1 (HDIA1) | AF051782.1 | 0 | 0.00% | 0 | 0.00% | 1 | 0.01% | 0 | 0.00% | 1 |
| 4981 | dynactin light chain (DCTN-22) | NM_007234.1 | 1 | 0.01% | 0 | 0.00% | 0 | 0.00% | 0 | 0.00% | 1 |
| 4982 | dynactin p62 subunit(LOC51164)(= putative tum | NM_016221.1 | 0 | 0.00% | 0 | 0.00% | 1 | 0.01% | 0 | 0.00% | 1 |
| 4983 | dynein light chain-A (LOC51143)(ORF) | NM_016141.1 | 0 | 0.00% | 1 | 0.01% | 0 | 0.00% | 0 | 0.00% | 1 |
| 4984 | dynein light intermediate chain 2 (LIC2) | AF035812 | 0 | 0.00% | 0 | 0.00% | 0 | 0.00% | 1 | 0.01% | 1 |
| 4985 | dynein, cytoplasmic, intermediate polypeptide 1 | NP_004402.1 | 0 | 0.00% | 1 | 0.01% | 0 | 0.00% | 0 | 0.00% | 1 |
| 4986 | dynein, cytoplasmic, light intermediate polypepti | BC010928.1 | 1 | 0.01% | 0 | 0.00% | 0 | 0.00% | 0 | 0.00% | 1 |
| 4987 | flightless I (Drosophila) homolog (FLII), mRNA | NM_002018.1 | 1 | 0.01% | 0 | 0.00% | 0 | 0.00% | 0 | 0.00% | 1 |
| 4988 | gamma-tubulin complex protein 2 (GCP2) | XM_057524.1 | 1 | 0.01% | 0 | 0.00% | 0 | 0.00% | 0 | 0.00% | 1 |
| 4989 | golgi SNAP receptor complex member 1 (GOSR | NM_004871.1 | 0 | 0.00% | 0 | 0.00% | 1 | 0.01% | 0 | 0.00% | 1 |
| 4990 | golgi SNAP receptor complex member 2 (GOSR | NM_004287.1 | 0 | 0.00% | 1 | 0.01% | 0 | 0.00% | 0 | 0.00% | 1 |
| 4991 | Golgi transport complex protein (90 kDa) (GTC9 | NM_006348.1 | 0 | 0.00% | 1 | 0.01% | 0 | 0.00% | 0 | 0.00% | 1 |
| 4992 | golgin-67 (GOLGA5) D1886 | AF164622.1 | 1 | 0.01% | 0 | 0.00% | 0 | 0.00% | 0 | 0.00% | 1 |
| 4993 | kinectin 1 (156 kDa Protein) (=CG1) | CAA80271.1 | 0 | 0.00% | 0 | 0.00% | 0 | 0.00% | 1 | 0.01% | 1 |
| 4994 | kinesin heavy chain member 2 (KIF2) | NM_004520.1 | 0 | 0.00% | 1 | 0.01% | 0 | 0.00% | 0 | 0.00% | 1 |
| 4995 | kinesin-like protein GAKIN | AF279865.1 | 0 | 0.00% | 0 | 0.00% | 1 | 0.01% | 0 | 0.00% | 1 |
| 4996 | kinesin-like spindle protein HKSP (=X85137) | U37426 | 1 | 0.01% | 0 | 0.00% | 0 | 0.00% | 0 | 0.00% | 1 |
| 4997 | kinesin-related protein, partial cds | D14678.1 | 0 | 0.00% | 1 | 0.01% | 0 | 0.00% | 0 | 0.00% | 1 |
| 4998 | MAP1B protein | AF115776.1 | 0 | 0.00% | 0 | 0.00% | 1 | 0.01% | 0 | 0.00% | 1 |
| 4999 | microtubule-associated proteins 1A/1B light chai | AF303888.1 | 0 | 0.00% | 1 | 0.01% | 0 | 0.00% | 0 | 0.00% | 1 |
| 5000 | novel centrosomal protein RanBPM (RANBPM) | NM_005493.1 | 1 | 0.01% | 0 | 0.00% | 0 | 0.00% | 0 | 0.00% | 1 |
| 5001 | spindle pole body protein spc97 homologue GCF | AF042379 | 1 | 0.01% | 0 | 0.00% | 0 | 0.00% | 0 | 0.00% | 1 |
| 5002 | Sprague-Dawley acidic calponin | U06755 | 0 | 0.00% | 0 | 0.00% | 0 | 0.00% | 1 | 0.01% | 1 |
| 5003 | TACC2 protein (TACC2) (=AF176646.1 anti zuai | AF095791.1 | 0 | 0.00% | 0 | 0.00% | 1 | 0.01% | 0 | 0.00% | 1 |
| 5004 | CG2974 gene product (aa 2e-41,52%) | AAF46554.1 | 0 | 0.00% | 1 | 0.01% | 0 | 0.00% | 0 | 0.00% | 1 |
| 5005 | CG6353 gene product (aa 3e-20,68%) | AAF55906.1 | 0 | 0.00% | 1 | 0.01% | 0 | 0.00% | 0 | 0.00% | 1 |
| 5006 | CG8198 gene product | AAF48498.1 | 0 | 0.00% | 1 | 0.01% | 0 | 0.00% | 0 | 0.00% | 1 |
| 5007 | CGI-01 protein (CGI-01), mRNA | NM_015935.2 | 1 | 0.01% | 0 | 0.00% | 0 | 0.00% | 0 | 0.00% | 1 |
| 5008 | CGI-11 protein (RefSeq aa 2e-35) | NP_057025.1 | 0 | 0.00% | 1 | 0.01% | 0 | 0.00% | 0 | 0.00% | 1 |
| 5009 | CGI-144 protein | AF151902.1 | 1 | 0.01% | 0 | 0.00% | 0 | 0.00% | 0 | 0.00% | 1 |
| 5010 | CGI-55 protein | AF151813.1 | 0 | 0.00% | 1 | 0.01% | 0 | 0.00% | 0 | 0.00% | 1 |
| 5011 | dJ797M17.1 (Dermatopontin) | CAB46693.1 | 0 | 0.00% | 0 | 0.00% | 0 | 0.00% | 1 | 0.01% | 1 |
| 5012 | adlican | AF245505.1 | 0 | 0.00% | 1 | 0.01% | 0 | 0.00% | 0 | 0.00% | 1 |
| 5013 | chondrocyte expressed protein 68 kDa (CEP-68 | AJ279016.1 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 89 of 102

| | | | | | | | | | | | |
|---|---|---|---|---|---|---|---|---|---|---|---|
| 5014 | chondroitin 4-O-sulfotransferase 2 | AF239822 | 0 | 0.00% | 1 | 0.01% | 0 | 0.00% | 0 | 0.00% | 1 |
| 5015 | chondroitin 6-sulfotransferase | AB017915 | 0 | 0.00% | 1 | 0.01% | 0 | 0.00% | 0 | 0.00% | 1 |
| 5016 | collagen type III N-endopeptidase (PCOLN3), (= | NM_002768.1 | 1 | 0.01% | 0 | 0.00% | 0 | 0.00% | 0 | 0.00% | 1 |
| 5017 | collagen type VI alpha 2 (COL6A2) | M81836.1 | 1 | 0.01% | 0 | 0.00% | 0 | 0.00% | 0 | 0.00% | 1 |
| 5018 | collagenous repeat-containing sequence of 26kD | AAG33704.1 | 0 | 0.00% | 1 | 0.01% | 0 | 0.00% | 0 | 0.00% | 1 |
| 5019 | dentin matrix acidic | NM_004407.1 | 0 | 0.00% | 1 | 0.01% | 0 | 0.00% | 0 | 0.00% | 1 |
| 5020 | dystroglycan 1 | NM_004393.1 | 0 | 0.00% | 1 | 0.01% | 0 | 0.00% | 0 | 0.00% | 1 |
| 5021 | EGF-containing fibulin-like extracellular matrix p | NM_004105.1 | 0 | 0.00% | 0 | 0.00% | 1 | 0.01% | 0 | 0.00% | 1 |
| 5022 | elastin gene, partial cds and partial 3'UTR | U77846.1 | 1 | 0.01% | 0 | 0.00% | 0 | 0.00% | 0 | 0.00% | 1 |
| 5023 | EPSILON-COAT PROTEIN (EPSILON-COP; LD | spAC005197 | 1 | 0.01% | 0 | 0.00% | 0 | 0.00% | 0 | 0.00% | 1 |
| 5024 | extracellular protein (S1-5) | U03877 | 1 | 0.01% | 0 | 0.00% | 0 | 0.00% | 0 | 0.00% | 1 |
| 5025 | fibrillarin (FBL) | NM_001436.1 | 1 | 0.01% | 0 | 0.00% | 0 | 0.00% | 0 | 0.00% | 1 |
| 5026 | fibulin 1 (FBLN1) | XM_047231.1 | 1 | 0.01% | 0 | 0.00% | 0 | 0.00% | 0 | 0.00% | 1 |
| 5027 | fibulin 2 (FBLN2) | NM_001998.1 | 1 | 0.01% | 0 | 0.00% | 0 | 0.00% | 0 | 0.00% | 1 |
| 5028 | fibulin-4 | AJ132819 | 1 | 0.01% | 0 | 0.00% | 0 | 0.00% | 0 | 0.00% | 1 |
| 5029 | germ line gene homologous to bladder carcinom | V00574.1 | 1 | 0.01% | 0 | 0.00% | 0 | 0.00% | 0 | 0.00% | 1 |
| 5030 | glypican-5 (GPC5) (=AF001462) | U66033 | 1 | 0.01% | 0 | 0.00% | 0 | 0.00% | 0 | 0.00% | 1 |
| 5031 | glypican-6 (GPC6) | AF105267.1 | 1 | 0.01% | 0 | 0.00% | 0 | 0.00% | 0 | 0.00% | 1 |
| 5032 | Hakata antigen | D88587 | 0 | 0.00% | 0 | 0.00% | 1 | 0.01% | 0 | 0.00% | 1 |
| 5033 | heparan-sulfate 6-sulfotransferase | AB006179 | 1 | 0.01% | 0 | 0.00% | 0 | 0.00% | 0 | 0.00% | 1 |
| 5034 | hepatic leukemia factor (HLF) | M95585 | 0 | 0.00% | 0 | 0.00% | 1 | 0.01% | 0 | 0.00% | 1 |
| 5035 | interphotoreceptor matrix proteoglycan 200 (SPA | NM_016247.1 | 1 | 0.01% | 0 | 0.00% | 0 | 0.00% | 0 | 0.00% | 1 |
| 5036 | lamin-like protein (low match) | M24732 | 0 | 0.00% | 0 | 0.00% | 0 | 0.00% | 1 | 0.01% | 1 |
| 5037 | linker for activation of T cells (LAT) | AF036906.1 | 1 | 0.01% | 0 | 0.00% | 0 | 0.00% | 0 | 0.00% | 1 |
| 5038 | LST1 mRNA, cLST1/E splice variant, complete c | AF000426.1 | 0 | 0.00% | 0 | 0.00% | 0 | 0.00% | 1 | 0.01% | 1 |
| 5039 | matrilin 4 (RefSeq aa 5e-44) | NP_003824.1 | 0 | 0.00% | 1 | 0.01% | 0 | 0.00% | 0 | 0.00% | 1 |
| 5040 | miCRofibril-associated glycoprotein 4 (MFAP4) | L38486 | 1 | 0.01% | 0 | 0.00% | 0 | 0.00% | 0 | 0.00% | 1 |
| 5041 | miCRofibril-associated glycoprotein-2 MAGP-2 | U37283.1 | 0 | 0.00% | 0 | 0.00% | 1 | 0.01% | 0 | 0.00% | 1 |
| 5042 | microfibrillar-associated protein 2 (MFAP2) | NM_002403.1 | 1 | 0.01% | 0 | 0.00% | 0 | 0.00% | 0 | 0.00% | 1 |
| 5043 | mucin MUC1 (=M61170) | X69118 | 1 | 0.01% | 0 | 0.00% | 0 | 0.00% | 0 | 0.00% | 1 |
| 5044 | nidogen (=M27445;M30269) (low match) | X84837 | 1 | 0.01% | 0 | 0.00% | 0 | 0.00% | 0 | 0.00% | 1 |
| 5045 | period (per) region proteoglycan gene | M13655 | 1 | 0.01% | 0 | 0.00% | 0 | 0.00% | 0 | 0.00% | 1 |
| 5046 | PG-M core protein | D45889.1 | 0 | 0.00% | 1 | 0.01% | 0 | 0.00% | 0 | 0.00% | 1 |
| 5047 | phosphatidylinositol glycan, class H (PIGH) | L19783 | 0 | 0.00% | 0 | 0.00% | 0 | 0.00% | 1 | 0.01% | 1 |
| 5048 | phosphatidylinositol glycan, class K (PIGK)(= AF | XM_039644.2 | 1 | 0.01% | 0 | 0.00% | 0 | 0.00% | 0 | 0.00% | 1 |
| 5049 | pRGR1 | AF041429.1 | 0 | 0.00% | 0 | 0.00% | 1 | 0.01% | 0 | 0.00% | 1 |
| 5050 | psihHbC pseudogene for hair keratin | Y19215.1 | 0 | 0.00% | 1 | 0.01% | 0 | 0.00% | 0 | 0.00% | 1 |
| 5051 | sarcolemmal associated protein (SLAP1) mRNA | U21155.1 | 0 | 0.00% | 0 | 0.00% | 1 | 0.01% | 0 | 0.00% | 1 |
| 5052 | sarcolipin (SLN) | NM_003063.1 | 0 | 0.00% | 1 | 0.01% | 0 | 0.00% | 0 | 0.00% | 1 |
| 5053 | sarcosin | AF056929 | 1 | 0.01% | 0 | 0.00% | 0 | 0.00% | 0 | 0.00% | 1 |
| 5054 | sarcospan (Kras) | NM_005086.2 | 0 | 0.00% | 1 | 0.01% | 0 | 0.00% | 0 | 0.00% | 1 |
| 5055 | sarcospan (Sspn), mRNA | NM_010656.1 | 0 | 0.00% | 1 | 0.01% | 0 | 0.00% | 0 | 0.00% | 1 |
| 5056 | serglycin gene | M90058.1 | 0 | 0.00% | 1 | 0.01% | 0 | 0.00% | 0 | 0.00% | 1 |
| 5057 | SHORT-CHAIN COLLAGEN C4 | P18503 | 1 | 0.01% | 0 | 0.00% | 0 | 0.00% | 0 | 0.00% | 1 |
| 5058 | tenascin XA (TNXA) | NM_007116.1 | 1 | 0.01% | 0 | 0.00% | 0 | 0.00% | 0 | 0.00% | 1 |
| 5059 | Z-crystallin/quinone reductase (CRYZ) gene seq | L31526.1 | 0 | 0.00% | 1 | 0.01% | 0 | 0.00% | 0 | 0.00% | 1 |
| 5060 | Hem-2 | X80029.1 | 0 | 0.00% | 1 | 0.01% | 0 | 0.00% | 0 | 0.00% | 1 |
| 5061 | LAZ3/BCL6 gene | Z79581.1 | 0 | 0.00% | 1 | 0.01% | 0 | 0.00% | 0 | 0.00% | 1 |
| 5062 | MLL (MLL) gene, exons 1-3,similar to MARINEF | AF036405 | 0 | 0.00% | 0 | 0.00% | 1 | 0.01% | 0 | 0.00% | 1 |
| 5063 | 22kDa smooth muscle protein (SM22) | M95787 | 1 | 0.01% | 0 | 0.00% | 0 | 0.00% | 0 | 0.00% | 1 |
| 5064 | actin binding protein (Schizosaccharomyces por | NM_006409.1 | 1 | 0.01% | 0 | 0.00% | 0 | 0.00% | 0 | 0.00% | 1 |
| 5065 | actin related protein 2/3 complex, subunit 1B (41 | NM_005720.1 | 1 | 0.01% | 0 | 0.00% | 0 | 0.00% | 0 | 0.00% | 1 |
| 5066 | actin-binding protein 22 kDa (SM22) gene | AF013711.1 | 0 | 0.00% | 1 | 0.01% | 0 | 0.00% | 0 | 0.00% | 1 |
| 5067 | actin-binding protein homolog ABP-278 | AF043045.1 | 0 | 0.00% | 1 | 0.01% | 0 | 0.00% | 0 | 0.00% | 1 |
| 5068 | actinin-associated LIM protein | AF039018 | 0 | 0.00% | 0 | 0.00% | 1 | 0.01% | 0 | 0.00% | 1 |
| 5069 | actin-like 6 (ACTL6)=AF041474 =BAF53a (BAF5 | NM_004301.1 | 0 | 0.00% | 0 | 0.00% | 1 | 0.01% | 0 | 0.00% | 1 |
| 5070 | ACTN2 gene for alpha-Actinin 2, exon 21 | AJ249776.1 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 90 of 102

| | | | | | | | | | | | |
|---|---|---|---|---|---|---|---|---|---|---|---|
| 5071 | A-kinase anchoring protein 220 (=AB014529 KIA | AF176555.1 | 0 | 0.00% | 0 | 0.00% | 0 | 0.00% | 1 | 0.01% | 1 |
| 5072 | alpha 1-syntrophin (SNT A1) | U40571 | 1 | 0.01% | 0 | 0.00% | 0 | 0.00% | 0 | 0.00% | 1 |
| 5073 | alpha II spectrin (=J05243;X86901) | U83867 | 1 | 0.01% | 0 | 0.00% | 0 | 0.00% | 0 | 0.00% | 1 |
| 5074 | alpha-adducin | L29294 | 1 | 0.01% | 0 | 0.00% | 0 | 0.00% | 0 | 0.00% | 1 |
| 5075 | alpha-tropomyosin | AJ001055.1 | 1 | 0.01% | 0 | 0.00% | 0 | 0.00% | 0 | 0.00% | 1 |
| 5076 | alpha-tubulin | K00557.1 | 0 | 0.00% | 0 | 0.00% | 0 | 0.00% | 1 | 0.01% | 1 |
| 5077 | ankyrin 1 (ANK1) (=M28880) | AF005213 | 1 | 0.01% | 0 | 0.00% | 0 | 0.00% | 0 | 0.00% | 1 |
| 5078 | ankyrin alt. variant 2.2 (53%,aa) | X16609 | 1 | 0.01% | 0 | 0.00% | 0 | 0.00% | 0 | 0.00% | 1 |
| 5079 | ankyrin binding glycoprotein-1 related mRNA se | L11002 | 1 | 0.01% | 0 | 0.00% | 0 | 0.00% | 0 | 0.00% | 1 |
| 5080 | ankyrin-repeat containing protein (Krit1) gene | U90269.1 | 0 | 0.00% | 0 | 0.00% | 1 | 0.01% | 0 | 0.00% | 1 |
| 5081 | A-raf-1 oncogene | X04790.1 | 0 | 0.00% | 1 | 0.01% | 0 | 0.00% | 0 | 0.00% | 1 |
| 5082 | archvillin (SVIL) | AF109135.1 | 1 | 0.01% | 0 | 0.00% | 0 | 0.00% | 0 | 0.00% | 1 |
| 5083 | beta tubulin (clone nuk_278) | X79535 | 1 | 0.01% | 0 | 0.00% | 0 | 0.00% | 0 | 0.00% | 1 |
| 5084 | beta-filamin | AF042166 | 0 | 0.00% | 0 | 0.00% | 1 | 0.01% | 0 | 0.00% | 1 |
| 5085 | beta-tubulin | AF141349.1 | 0 | 0.00% | 0 | 0.00% | 0 | 0.00% | 1 | 0.01% | 1 |
| 5086 | capping protein alpha mRNA, partial cds /cds=U | Hs.75546 | 0 | 0.00% | 0 | 0.00% | 0 | 0.00% | 1 | 0.01% | 1 |
| 5087 | capping protein beta-subunit isoform 1 | U10406 | 1 | 0.01% | 0 | 0.00% | 0 | 0.00% | 0 | 0.00% | 1 |
| 5088 | CDC42-binding protein kinase beta (DMPK-like) | NM_006035.1 | 1 | 0.01% | 0 | 0.00% | 0 | 0.00% | 0 | 0.00% | 1 |
| 5089 | cofilin, non-muscle type (=U21909) | X95404 | 1 | 0.01% | 0 | 0.00% | 0 | 0.00% | 0 | 0.00% | 1 |
| 5090 | cytohesin 1, isoform 2 (RefSeq aa 3e-30) | NP_059430.1 | 0 | 0.00% | 1 | 0.01% | 0 | 0.00% | 0 | 0.00% | 1 |
| 5091 | cytokeratin 8 | U76549.1 | 1 | 0.01% | 0 | 0.00% | 0 | 0.00% | 0 | 0.00% | 1 |
| 5092 | desmosome associated protein pinin | U77716 | 1 | 0.01% | 0 | 0.00% | 0 | 0.00% | 0 | 0.00% | 1 |
| 5093 | destrin-2 (=actin depolymerizing factor) | U72518 | 1 | 0.01% | 0 | 0.00% | 0 | 0.00% | 0 | 0.00% | 1 |
| 5094 | drebrin E | D17530.1 | 0 | 0.00% | 0 | 0.00% | 0 | 0.00% | 1 | 0.01% | 1 |
| 5095 | dynamin | L07807 | 1 | 0.01% | 0 | 0.00% | 0 | 0.00% | 0 | 0.00% | 1 |
| 5096 | dystrobrevin B DTN-B1 | Y15722 | 1 | 0.01% | 0 | 0.00% | 0 | 0.00% | 0 | 0.00% | 1 |
| 5097 | GLUT1 C-terminal binding protein (GLUT1CBP) | NM_005716.1 | 1 | 0.01% | 0 | 0.00% | 0 | 0.00% | 0 | 0.00% | 1 |
| 5098 | hCRNN4 | AB030656.1 | 0 | 0.00% | 0 | 0.00% | 0 | 0.00% | 1 | 0.01% | 1 |
| 5099 | kelch (Drosophila)-like 3(=kelch-like protein | NM_017415.1 | 0 | 0.00% | 1 | 0.01% | 0 | 0.00% | 0 | 0.00% | 1 |
| 5100 | keratin type II (58 kD) | M21389.1 | 0 | 0.00% | 0 | 0.00% | 1 | 0.01% | 0 | 0.00% | 1 |
| 5101 | NuMA protein (=Z11584;Z14229;Z14227) | Z11583 | 1 | 0.01% | 0 | 0.00% | 0 | 0.00% | 0 | 0.00% | 1 |
| 5102 | partial TTN gene for titin | AJ277892.2 | 0 | 0.00% | 0 | 0.00% | 0 | 0.00% | 1 | 0.01% | 1 |
| 5103 | phosvitin/casein kinase type II beta subunit (EC | X16937.1 | 1 | 0.01% | 0 | 0.00% | 0 | 0.00% | 0 | 0.00% | 1 |
| 5104 | regulatory factor X-associated ankyrin-containin | NM_003721.1 | 0 | 0.00% | 0 | 0.00% | 1 | 0.01% | 0 | 0.00% | 1 |
| 5105 | scinderin (SCIN), mRNA /cds=(276,1682) /gb=N | Hs.210473 | 0 | 0.00% | 0 | 0.00% | 1 | 0.01% | 0 | 0.00% | 1 |
| 5106 | singed (Drosophila)-like(sea urchin fascin homol | NM_003088.1 | 1 | 0.01% | 0 | 0.00% | 0 | 0.00% | 0 | 0.00% | 1 |
| 5107 | skeletal muscle alpha-actin gene (ACTA1) | AF182035.1 | 1 | 0.01% | 0 | 0.00% | 0 | 0.00% | 0 | 0.00% | 1 |
| 5108 | skeletal muscle HSB84A051 STRATAGENE cD | Z28721.1 | 0 | 0.00% | 1 | 0.01% | 0 | 0.00% | 0 | 0.00% | 1 |
| 5109 | skeletal muscle selenoprotein W (SelW) | U25264 | 1 | 0.01% | 0 | 0.00% | 0 | 0.00% | 0 | 0.00% | 1 |
| 5110 | smoothelin | AC005005 | 1 | 0.01% | 0 | 0.00% | 0 | 0.00% | 0 | 0.00% | 1 |
| 5111 | spectrin, alpha,non-erythrocytic 1 (alpha-fodrin) | NM_003127.1 | 0 | 0.00% | 1 | 0.01% | 0 | 0.00% | 0 | 0.00% | 1 |
| 5112 | spectrin, beta, non-erythrocytic 1 (SPTBN1)(OR | NM_003128.1 | 1 | 0.01% | 0 | 0.00% | 0 | 0.00% | 0 | 0.00% | 1 |
| 5113 | stretch regulated skeletal | CAC03620.1 | 0 | 0.00% | 1 | 0.01% | 0 | 0.00% | 0 | 0.00% | 1 |
| 5114 | striated muscle contraction regulatory protein (Id | M96843.1 | 0 | 0.00% | 1 | 0.01% | 0 | 0.00% | 0 | 0.00% | 1 |
| 5115 | TANKYRASE (RefSeq aa 9e-90) | NP_003738.1 | 0 | 0.00% | 1 | 0.01% | 0 | 0.00% | 0 | 0.00% | 1 |
| 5116 | telethonin | AJ000491 | 1 | 0.01% | 0 | 0.00% | 0 | 0.00% | 0 | 0.00% | 1 |
| 5117 | testican-1 | AF231124 | 0 | 0.00% | 0 | 0.00% | 0 | 0.00% | 1 | 0.01% | 1 |
| 5118 | TRICHOHYALIN | spP37709 | 0 | 0.00% | 0 | 0.00% | 0 | 0.00% | 1 | 0.01% | 1 |
| 5119 | tubulin alpha 6 (TUBA6) | XM_028724.2 | 1 | 0.01% | 0 | 0.00% | 0 | 0.00% | 0 | 0.00% | 1 |
| 5120 | tubulin, alpha, ubiquitous (K-ALPHA-1) | NM_006082.1 | 1 | 0.01% | 0 | 0.00% | 0 | 0.00% | 0 | 0.00% | 1 |
| 5121 | tubulin, beta, 2 (TUBB2) (ORF) | NM_006088.1 | 1 | 0.01% | 0 | 0.00% | 0 | 0.00% | 0 | 0.00% | 1 |
| 5122 | tubulin, beta, 4 (TUBB4) | NM_006086.1 | 1 | 0.01% | 0 | 0.00% | 0 | 0.00% | 0 | 0.00% | 1 |
| 5123 | tubulin-specific chaperone d (TBCD)= AJ006417 | NM_005993.2 | 1 | 0.01% | 0 | 0.00% | 0 | 0.00% | 0 | 0.00% | 1 |
| 5124 | uroporphyrinogen decarboxylase (UROD) | AF047383 | 1 | 0.01% | 0 | 0.00% | 0 | 0.00% | 0 | 0.00% | 1 |
| 5125 | vasodilator-stimulated phosphoprotein (VASP) | NM_003370.1 | 1 | 0.01% | 0 | 0.00% | 0 | 0.00% | 0 | 0.00% | 1 |
| 5126 | zyxin (ZYX) (=ESP-2 ) | NM_003461.1 | 1 | 0.01% | 0 | 0.00% | 0 | 0.00% | 0 | 0.00% | 1 |
| 5127 | actin binding protein; macrophin(microfilament a | NP_036222.1 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 91 of 102

| | | | | | | | | | | | |
|---|---|---|---|---|---|---|---|---|---|---|---|
| 5128 | alpha actinin 4 (Actn4) | NM_021895.1 | 1 | 0.01% | 0 | 0.00% | 0 | 0.00% | 0 | 0.00% | 1 |
| 5129 | alpha tropomyosin (tpma) | AF180892.1 | 0 | 0.00% | 0 | 0.00% | 0 | 0.00% | 1 | 0.01% | 1 |
| 5130 | aortic-type smooth muscle alpha-actin (SM-alph | M33216.1 | 1 | 0.01% | 0 | 0.00% | 0 | 0.00% | 0 | 0.00% | 1 |
| 5131 | fast skeletal troponin C | X07898 | 1 | 0.01% | 0 | 0.00% | 0 | 0.00% | 0 | 0.00% | 1 |
| 5132 | myosin alkali light chain (ventricular) | M24122 | 1 | 0.01% | 0 | 0.00% | 0 | 0.00% | 0 | 0.00% | 1 |
| 5133 | myosin binding protein H | L05606 | 1 | 0.01% | 0 | 0.00% | 0 | 0.00% | 0 | 0.00% | 1 |
| 5134 | myosin IC (MYO1C) | NM_004998.1 | 0 | 0.00% | 1 | 0.01% | 0 | 0.00% | 0 | 0.00% | 1 |
| 5135 | myosin, light polypeptide 6, alkali, smooth muscl | XM_049089.1 | 1 | 0.01% | 0 | 0.00% | 0 | 0.00% | 0 | 0.00% | 1 |
| 5136 | myosin, light polypeptide kinase (RefSeq aa 2e- | NP_005956.1 | 0 | 0.00% | 1 | 0.01% | 0 | 0.00% | 0 | 0.00% | 1 |
| 5137 | myosin-IXb | U42391 | 1 | 0.01% | 0 | 0.00% | 0 | 0.00% | 0 | 0.00% | 1 |
| 5138 | myotubular myopathy 1(MTM1) | NM_000252.1 | 0 | 0.00% | 1 | 0.01% | 0 | 0.00% | 0 | 0.00% | 1 |
| 5139 | regulatory myosin light chain (MYL5) | L03785 | 1 | 0.01% | 0 | 0.00% | 0 | 0.00% | 0 | 0.00% | 1 |
| 5140 | slow skeletal muscle troponin T (clone H22h) | M19309 | 1 | 0.01% | 0 | 0.00% | 0 | 0.00% | 0 | 0.00% | 1 |
| 5141 | slow-twitch skeletal troponin I (TNN1) | J04760 | 1 | 0.01% | 0 | 0.00% | 0 | 0.00% | 0 | 0.00% | 1 |
| 5142 | SMAP-5 smooth muscle cell associated protein | AB014733 | 0 | 0.00% | 0 | 0.00% | 0 | 0.00% | 1 | 0.01% | 1 |
| 5143 | SMC-like protein | AJ005015.1 | 0 | 0.00% | 0 | 0.00% | 0 | 0.00% | 1 | 0.01% | 1 |
| 5144 | smooth muscle myosin light chain kinase | M76233.1 | 1 | 0.01% | 0 | 0.00% | 0 | 0.00% | 0 | 0.00% | 1 |
| 5145 | troponin I, skeletal, fast 2 (Tnni2), mRNA | NM_009405.1 | 0 | 0.00% | 0 | 0.00% | 0 | 0.00% | 1 | 0.01% | 1 |
| 5146 | adapt78 protein gene= U85266 | U53821.1 | 0 | 0.00% | 1 | 0.01% | 0 | 0.00% | 0 | 0.00% | 1 |
| 5147 | colon cancer-associated protein Mic1 | NM_013326.1 | 0 | 0.00% | 0 | 0.00% | 1 | 0.01% | 0 | 0.00% | 1 |
| 5148 | CRIB-containing BORG2 protein (BORG2) | AF164118.1 | 0 | 0.00% | 0 | 0.00% | 1 | 0.01% | 0 | 0.00% | 1 |
| 5149 | laforin (EPM2A) | AF084535.2 | 0 | 0.00% | 0 | 0.00% | 1 | 0.01% | 0 | 0.00% | 1 |
| 5150 | neuroligin 3 | AF217413.1 | 0 | 0.00% | 0 | 0.00% | 1 | 0.01% | 0 | 0.00% | 1 |
| 5151 | peroxisomal membrane protein 20 | AF124993.1 | 1 | 0.01% | 0 | 0.00% | 0 | 0.00% | 0 | 0.00% | 1 |
| 5152 | peroxisomal membrane protein 3 (35kD, Zellweg | NM_000318.1 | 0 | 0.00% | 0 | 0.00% | 1 | 0.01% | 0 | 0.00% | 1 |
| 5153 | peroxisomal targeting signal 1 (SKL type) recept | Z48054.1 | 0 | 0.00% | 1 | 0.01% | 0 | 0.00% | 0 | 0.00% | 1 |
| 5154 | peroxisome assembly factor-2 (PEX6) gene | AF108098.1 | 0 | 0.00% | 1 | 0.01% | 0 | 0.00% | 0 | 0.00% | 1 |
| 5155 | phosphatidylinositol glycan, class C (PIGC) | gi4505794 | 1 | 0.01% | 0 | 0.00% | 0 | 0.00% | 0 | 0.00% | 1 |
| 5156 | PIG-A protein | D11466 | 0 | 0.00% | 0 | 0.00% | 0 | 0.00% | 1 | 0.01% | 1 |
| 5157 | tight junction protein 1 (zona occludens 1) (TJP1 | NM_003257.1 | 1 | 0.01% | 0 | 0.00% | 0 | 0.00% | 0 | 0.00% | 1 |
| 5158 | tight junction protein ZO-2 (TJP2) | AF177533.1 | 0 | 0.00% | 0 | 0.00% | 1 | 0.01% | 0 | 0.00% | 1 |
| 5159 | 78 kDa gastrin-binding protein | U04627.1 | 1 | 0.01% | 0 | 0.00% | 0 | 0.00% | 0 | 0.00% | 1 |
| 5160 | AP-3 complex sigma3A subunit | U91932.1 | 0 | 0.00% | 0 | 0.00% | 0 | 0.00% | 1 | 0.01% | 1 |
| 5161 | ARE1-like protein | AJ006026.1 | 1 | 0.01% | 0 | 0.00% | 0 | 0.00% | 0 | 0.00% | 1 |
| 5162 | ASIALOGLYCOPROTEIN RECEPTOR 2 (HEPA | P24721 | 0 | 0.00% | 0 | 0.00% | 1 | 0.01% | 0 | 0.00% | 1 |
| 5163 | ESR (EST84588 Colon adenocarcinoma IV cDN | AA372592.1 | 0 | 0.00% | 0 | 0.00% | 1 | 0.01% | 0 | 0.00% | 1 |
| 5164 | neuropilin-2 (a5) | AF022861 | 1 | 0.01% | 0 | 0.00% | 0 | 0.00% | 0 | 0.00% | 1 |
| 5165 | son of sevenless 1 | Z11574 | 0 | 0.00% | 0 | 0.00% | 1 | 0.01% | 0 | 0.00% | 1 |
| 5166 | toll-like receptor3 (RefSeq aa 3e-41) | NP_003256.1 | 0 | 0.00% | 1 | 0.01% | 0 | 0.00% | 0 | 0.00% | 1 |
| 5167 | trg (=AB028981 KIAA1058) | X68101 | 0 | 0.00% | 0 | 0.00% | 1 | 0.01% | 0 | 0.00% | 1 |
| 5168 | UCC1 protein (UCC1 gene) | AJ250475.2 | 0 | 0.00% | 1 | 0.01% | 0 | 0.00% | 0 | 0.00% | 1 |
| 5169 | 5-HT4 receptor gene | AJ243213.1 | 0 | 0.00% | 0 | 0.00% | 0 | 0.00% | 1 | 0.01% | 1 |
| 5170 | alpha 7 neuronal nicotinic receptor | AF029838 | 1 | 0.01% | 0 | 0.00% | 0 | 0.00% | 0 | 0.00% | 1 |
| 5171 | alpha-CP1 (=X78137 hnRNP-E1) | U24223 | 1 | 0.01% | 0 | 0.00% | 0 | 0.00% | 0 | 0.00% | 1 |
| 5172 | alpha-globin transCRiption factor CP2 | M84810.1 | 0 | 0.00% | 0 | 0.00% | 0 | 0.00% | 1 | 0.01% | 1 |
| 5173 | autocrine motility factor receptor (AMFR) | NM_001144.1 | 0 | 0.00% | 0 | 0.00% | 0 | 0.00% | 1 | 0.01% | 1 |
| 5174 | beta-hydroxysteroid dehydrogenase 11 (HSD11) | M76661 | 0 | 0.00% | 0 | 0.00% | 0 | 0.00% | 1 | 0.01% | 1 |
| 5175 | bradykinin receptor B2 (BDKRB2) | NM_000623.1 | 0 | 0.00% | 0 | 0.00% | 0 | 0.00% | 1 | 0.01% | 1 |
| 5176 | breast cancer nuclear receptor-binding auxiliary | AF126008.1 | 0 | 0.00% | 1 | 0.01% | 0 | 0.00% | 0 | 0.00% | 1 |
| 5177 | calcitonin receptor-like receptor activity modifyin | NM_005854.1 | 1 | 0.01% | 0 | 0.00% | 0 | 0.00% | 0 | 0.00% | 1 |
| 5178 | CD163 antigen (CD163) (=M130 antigen (cytoso | NM_004244.1 | 0 | 0.00% | 0 | 0.00% | 1 | 0.01% | 0 | 0.00% | 1 |
| 5179 | CD33 differentiation antigen (CD33) | M23197 | 0 | 0.00% | 0 | 0.00% | 1 | 0.01% | 0 | 0.00% | 1 |
| 5180 | CD34 | M81104 | 1 | 0.01% | 0 | 0.00% | 0 | 0.00% | 0 | 0.00% | 1 |
| 5181 | CD39L2 (CD39L2) | AF039916 | 1 | 0.01% | 0 | 0.00% | 0 | 0.00% | 0 | 0.00% | 1 |
| 5182 | CD3G antigen, gamma polypeptide (TiT3 compl | X04145 | 0 | 0.00% | 0 | 0.00% | 0 | 0.00% | 1 | 0.01% | 1 |
| 5183 | CD58 | Y14785 | 0 | 0.00% | 0 | 0.00% | 0 | 0.00% | 1 | 0.01% | 1 |
| 5184 | CDA11 protein (CDA11), mRNA /cds=(25,918) /( | Hs.11810 | 0 | 0.00% | 0 | 0.00% | 1 | 0.01% | 0 | 0.00% | 1 |

Figure 6 - Unique Known Genes Identified In Four cDNA Cartilage Libraries and EST Frequency Analysis - Page 92 of 102

| | | | | | | | | | | | |
|---|---|---|---|---|---|---|---|---|---|---|---|
| 5185 | CHRM3 gene for muscarinic acetylcholine recep | AB041395.1 | 0 | 0.00% | 1 | 0.01% | 0 | 0.00% | 0 | 0.00% | 1 |
| 5186 | class I cytokine receptor (zcytor5) | AF178684.1 | 1 | 0.01% | 0 | 0.00% | 0 | 0.00% | 0 | 0.00% | 1 |
| 5187 | colony stimulating factor 1 receptor (CSF1R) ger | M33210.1 | 0 | 0.00% | 0 | 0.00% | 0 | 0.00% | 1 | 0.01% | 1 |
| 5188 | CSF-1 receptor (FMS) gene (=KIAA0194) | U63963.1 | 0 | 0.00% | 1 | 0.01% | 0 | 0.00% | 0 | 0.00% | 1 |
| 5189 | CSF2RA=GM-CSF receptor alpha subunit | S48475.1 | 0 | 0.00% | 1 | 0.01% | 0 | 0.00% | 0 | 0.00% | 1 |
| 5190 | endothelial protein C receptor | AB026584.2 | 0 | 0.00% | 0 | 0.00% | 0 | 0.00% | 1 | 0.01% | 1 |
| 5191 | endothelin receptor type A (EDNRA) | NM_001957.1 | 0 | 0.00% | 1 | 0.01% | 0 | 0.00% | 0 | 0.00% | 1 |
| 5192 | endothelin receptor type B-like protein | U87460.1 | 0 | 0.00% | 1 | 0.01% | 0 | 0.00% | 0 | 0.00% | 1 |
| 5193 | epidermal growth factor repeat containing protei | AF186084 | 0 | 0.00% | 0 | 0.00% | 1 | 0.01% | 0 | 0.00% | 1 |
| 5194 | Epstein-Barr virus induced gene 2(lymphocyte-s | NP_004942.1 | 0 | 0.00% | 0 | 0.00% | 1 | 0.01% | 0 | 0.00% | 1 |
| 5195 | estrogen receptor gene, 5' partial (422 bp) | AJ002562.1 | 0 | 0.00% | 1 | 0.01% | 0 | 0.00% | 0 | 0.00% | 1 |
| 5196 | estrogen receptor-bindingfragment-associated g | NP_004206.1 | 0 | 0.00% | 1 | 0.01% | 0 | 0.00% | 0 | 0.00% | 1 |
| 5197 | estrogen related receptor alpha (ESTRRA) pseu | U85258.1 | 0 | 0.00% | 0 | 0.00% | 1 | 0.01% | 0 | 0.00% | 1 |
| 5198 | estrogen-related receptor gamma (ESRRG) | NM_001438.1 | 1 | 0.01% | 0 | 0.00% | 0 | 0.00% | 0 | 0.00% | 1 |
| 5199 | Ewing sarcoma breakpoint region 1 (EWSR1), tr | NM_005243.1 | 0 | 0.00% | 1 | 0.01% | 0 | 0.00% | 0 | 0.00% | 1 |
| 5200 | fibroblast growth factor receptor 2 (bacteria-expr | NM_000141.1 | 0 | 0.00% | 0 | 0.00% | 0 | 0.00% | 1 | 0.01% | 1 |
| 5201 | fibroblast growth factor receptor 3 (achondroplas | XM_044120.1 | 1 | 0.01% | 0 | 0.00% | 0 | 0.00% | 0 | 0.00% | 1 |
| 5202 | fibroblast growth factor receptor(N-sam) | X66945 | 1 | 0.01% | 0 | 0.00% | 0 | 0.00% | 0 | 0.00% | 1 |
| 5203 | FYN-binding protein (FYB-120/130) (RefSeq aa | NP_001456.1 | 0 | 0.00% | 1 | 0.01% | 0 | 0.00% | 0 | 0.00% | 1 |
| 5204 | G protein-coupled receptor 30 (GPR30) | NM_001505.1 | 0 | 0.00% | 1 | 0.01% | 0 | 0.00% | 0 | 0.00% | 1 |
| 5205 | G protein-coupled receptor 48 (GPR48) | NM_018490.1 | 0 | 0.00% | 1 | 0.01% | 0 | 0.00% | 0 | 0.00% | 1 |
| 5206 | G protein-coupled receptor Edg-2 | Y09479 | 0 | 0.00% | 0 | 0.00% | 1 | 0.01% | 0 | 0.00% | 1 |
| 5207 | G protein-coupled receptor kinase 5 (GPRK5) | NM_005308.1 | 0 | 0.00% | 1 | 0.01% | 0 | 0.00% | 0 | 0.00% | 1 |
| 5208 | GABAA receptor subunit alpha4 | U30461 | 0 | 0.00% | 0 | 0.00% | 1 | 0.01% | 0 | 0.00% | 1 |
| 5209 | gene for vitamin D receptor, exon 9 (=(1,25-dihy | AB002168.1 | 0 | 0.00% | 0 | 0.00% | 0 | 0.00% | 1 | 0.01% | 1 |
| 5210 | genes for vasopressin, oxytocin and a long inter | X59496.1 | 0 | 0.00% | 0 | 0.00% | 1 | 0.01% | 0 | 0.00% | 1 |
| 5211 | gephyrin (GPH) | NM_020806.1 | 0 | 0.00% | 1 | 0.01% | 0 | 0.00% | 0 | 0.00% | 1 |
| 5212 | G-protein coupled receptor (SH120) | gi7706703 | 0 | 0.00% | 0 | 0.00% | 0 | 0.00% | 1 | 0.01% | 1 |
| 5213 | G-protein-coupled receptor 48 (GPR48) | AF257182.1 | 0 | 0.00% | 0 | 0.00% | 0 | 0.00% | 1 | 0.01% | 1 |
| 5214 | growth factor receptor bound protein 2 (Grb2) | NM_008163.1 | 0 | 0.00% | 0 | 0.00% | 0 | 0.00% | 1 | 0.01% | 1 |
| 5215 | growth hormone receptor (contains Alu repeat) | X06562 | 0 | 0.00% | 0 | 0.00% | 1 | 0.01% | 0 | 0.00% | 1 |
| 5216 | H1 histamine receptor | Z34897.1 | 0 | 0.00% | 0 | 0.00% | 0 | 0.00% | 1 | 0.01% | 1 |
| 5217 | Hin-2 (=U40396 steroid receptor coactivator SR( | U19179 | 1 | 0.01% | 0 | 0.00% | 0 | 0.00% | 0 | 0.00% | 1 |
| 5218 | histamine H1-receptor | D14436.1 | 0 | 0.00% | 0 | 0.00% | 0 | 0.00% | 1 | 0.01% | 1 |
| 5219 | IL-1 receptor antagonist IL-1Ra (IL-1RN) | U65590 | 0 | 0.00% | 0 | 0.00% | 1 | 0.01% | 0 | 0.00% | 1 |
| 5220 | IL-13 receptor | Y08768 | 0 | 0.00% | 0 | 0.00% | 1 | 0.01% | 0 | 0.00% | 1 |
| 5221 | interferon alpha/beta receptor (IFNAR) gene, ex( | U06244 | 0 | 0.00% | 0 | 0.00% | 0 | 0.00% | 1 | 0.01% | 1 |
| 5222 | interferon, gamma-inducible protein 16 (IFI16) | NM_005531.1 | 0 | 0.00% | 1 | 0.01% | 0 | 0.00% | 0 | 0.00% | 1 |
| 5223 | interferon,gamma-inducible protein 30 (IFI30)(O | NM_006332.1 | 0 | 0.00% | 0 | 0.00% | 1 | 0.01% | 0 | 0.00% | 1 |
| 5224 | interleukin-1 receptor-associated kinase 1 (IRAK | Hs.182018 | 0 | 0.00% | 0 | 0.00% | 1 | 0.01% | 0 | 0.00% | 1 |
| 5225 | interleukin-11 receptor | Z38102 | 1 | 0.01% | 0 | 0.00% | 0 | 0.00% | 0 | 0.00% | 1 |
| 5226 | interleukin-18 binding protein c precursor (IL18B | AF110801.1 | 0 | 0.00% | 1 | 0.01% | 0 | 0.00% | 0 | 0.00% | 1 |
| 5227 | laminin receptor precursor/p40 ribosome associa | U43901.1 | 1 | 0.01% | 0 | 0.00% | 0 | 0.00% | 0 | 0.00% | 1 |
| 5228 | leukemia inhibitory factor receptor (LIFR) | NM_002310.2 | 0 | 0.00% | 0 | 0.00% | 1 | 0.01% | 0 | 0.00% | 1 |
| 5229 | lymphatic vessel endothelial hyaluronan recepto | NM_006691.1 | 0 | 0.00% | 1 | 0.01% | 0 | 0.00% | 0 | 0.00% | 1 |
| 5230 | M2-type pyruvate kinase | M23725 | 1 | 0.01% | 0 | 0.00% | 0 | 0.00% | 0 | 0.00% | 1 |
| 5231 | m3 muscarinic acetylcholine receptor (CHRM3) | U29589.1 | 0 | 0.00% | 1 | 0.01% | 0 | 0.00% | 0 | 0.00% | 1 |
| 5232 | metabotropic glutamate receptor 6 (mGluR6) ge | U82083.1 | 1 | 0.01% | 0 | 0.00% | 0 | 0.00% | 0 | 0.00% | 1 |
| 5233 | mineralocorticoid receptor (=hMR) (low match) | M80582 | 1 | 0.01% | 0 | 0.00% | 0 | 0.00% | 0 | 0.00% | 1 |
| 5234 | natriuretic peptide precursor B (NPPB) | NM_002521.1 | 1 | 0.01% | 0 | 0.00% | 0 | 0.00% | 0 | 0.00% | 1 |
| 5235 | neurotrophic tyrosine kinase, receptor, type 2 (N | NM_006180.1 | 1 | 0.01% | 0 | 0.00% | 0 | 0.00% | 0 | 0.00% | 1 |
| 5236 | NK receptor Ly-49L gene | AF126036.1 | 0 | 0.00% | 1 | 0.01% | 0 | 0.00% | 0 | 0.00% | 1 |
| 5237 | NKG2D gene | AJ001689.1 | 0 | 0.00% | 0 | 0.00% | 0 | 0.00% | 1 | 0.01% | 1 |
| 5238 | novel retinal pigment epithelial cell protein (NOR | AF155135.1 | 0 | 0.00% | 0 | 0.00% | 0 | 0.00% | 1 | 0.01% | 1 |
| 5239 | NRBF-2 nuclear receptor binding factor-2 | AB024930.1 | 0 | 0.00% | 1 | 0.01% | 0 | 0.00% | 0 | 0.00% | 1 |
| 5240 | nuclear receptor binding protein (NRBP) | NM_013392.1 | 1 | 0.01% | 0 | 0.00% | 0 | 0.00% | 0 | 0.00% | 1 |
| 5241 | nuclear receptor interacting protein 1 (NRIP1) | gi4505454 | 0 | 0.00% | 0 | 0.00% | 1 | 0.01% | 0 | 0.00% | 1 |

Figure 6 - Unique Known Genes Identified In Four cDNA Cartilage Libraries and EST Frequency Analysis - Page 93 of 102

| | | | | | | | | | | | |
|---|---|---|---|---|---|---|---|---|---|---|---|
| 5242 | nuclear receptor Rev-ErbA-beta | U20796.1 | 0 | 0.00% | 1 | 0.01% | 0 | 0.00% | 0 | 0.00% | 1 |
| 5243 | nuclear receptor subfamily 1, group I, member 3 | NM_005122.1 | 1 | 0.01% | 0 | 0.00% | 0 | 0.00% | 0 | 0.00% | 1 |
| 5244 | olfactory receptor (OR2D2) gene, partial cds | AF065876.1 | 0 | 0.00% | 1 | 0.01% | 0 | 0.00% | 0 | 0.00% | 1 |
| 5245 | olfactory receptor (OR7-86) pseudogene U8628 | U86282 | 1 | 0.01% | 0 | 0.00% | 0 | 0.00% | 0 | 0.00% | 1 |
| 5246 | olfactory receptor 17-93 (OR17-93) and olfactory | U76377 | 0 | 0.00% | 0 | 0.00% | 1 | 0.01% | 0 | 0.00% | 1 |
| 5247 | oncostatin M receptor (OSMR) | NM_003999.1 | 0 | 0.00% | 0 | 0.00% | 1 | 0.01% | 0 | 0.00% | 1 |
| 5248 | osteoprotegrin ligand | AF053712 | 0 | 0.00% | 0 | 0.00% | 0 | 0.00% | 1 | 0.01% | 1 |
| 5249 | outer membrane receptor Tom20 (TOM20) gene | AF126962.1 | 1 | 0.01% | 0 | 0.00% | 0 | 0.00% | 0 | 0.00% | 1 |
| 5250 | oxytocin receptor | X64878 | 0 | 0.00% | 0 | 0.00% | 0 | 0.00% | 1 | 0.01% | 1 |
| 5251 | oxytocinase splice variant 1 | U62768 | 1 | 0.01% | 0 | 0.00% | 0 | 0.00% | 0 | 0.00% | 1 |
| 5252 | P2X7 | Y12853 | 0 | 0.00% | 0 | 0.00% | 1 | 0.01% | 0 | 0.00% | 1 |
| 5253 | p50B/p97 (Lyt-10) transCRiption factor | D16367 | 1 | 0.01% | 0 | 0.00% | 0 | 0.00% | 0 | 0.00% | 1 |
| 5254 | PAR protein (PAR) | NM_012389.1 | 1 | 0.01% | 0 | 0.00% | 0 | 0.00% | 0 | 0.00% | 1 |
| 5255 | peroxisome proliferative activated receptor delta | AF246296S8 | 1 | 0.01% | 0 | 0.00% | 0 | 0.00% | 0 | 0.00% | 1 |
| 5256 | peroxisome proliferative activated receptor, gam | NM_013261.1 | 0 | 0.00% | 0 | 0.00% | 1 | 0.01% | 0 | 0.00% | 1 |
| 5257 | peroxisome receptor 1 (PXR1) | NM_000319.1 | 0 | 0.00% | 0 | 0.00% | 0 | 0.00% | 1 | 0.01% | 1 |
| 5258 | PEST-containing nuclear protein (pcnp) | NM_020357.1 | 0 | 0.00% | 1 | 0.01% | 0 | 0.00% | 0 | 0.00% | 1 |
| 5259 | photolyase, complete cds | D83702.1 | 0 | 0.00% | 1 | 0.01% | 0 | 0.00% | 0 | 0.00% | 1 |
| 5260 | pilin-like transCRiption factor | AF122004.1 | 0 | 0.00% | 0 | 0.00% | 1 | 0.01% | 0 | 0.00% | 1 |
| 5261 | PNR gene | AJ276674.1 | 1 | 0.01% | 0 | 0.00% | 0 | 0.00% | 0 | 0.00% | 1 |
| 5262 | pro-oncosis receptor inducing membrane injury ( | Hs.172089 | 0 | 0.00% | 0 | 0.00% | 0 | 0.00% | 1 | 0.01% | 1 |
| 5263 | prostaglandin E2 receptor EP4 | AF177934 | 0 | 0.00% | 0 | 0.00% | 1 | 0.01% | 0 | 0.00% | 1 |
| 5264 | putative G-protein coupled receptor RA1c | AAD12761.1 | 0 | 0.00% | 0 | 0.00% | 1 | 0.01% | 0 | 0.00% | 1 |
| 5265 | receptor (calcitonin) activity modifying protein 3 ( | NM_005856.1 | 0 | 0.00% | 1 | 0.01% | 0 | 0.00% | 0 | 0.00% | 1 |
| 5266 | receptor of retinoic acid (=M73779 PML-RAR pr | X06614 | 1 | 0.01% | 0 | 0.00% | 0 | 0.00% | 0 | 0.00% | 1 |
| 5267 | receptor tyrosine kinase-like orphan receptor 2 ( | Hs.155585 | 0 | 0.00% | 0 | 0.00% | 0 | 0.00% | 1 | 0.01% | 1 |
| 5268 | receptor tyrosine phosphatase gamma (PTPRG) | U46116.1 | 0 | 0.00% | 0 | 0.00% | 0 | 0.00% | 1 | 0.01% | 1 |
| 5269 | receptor-associated protein of the synapse, 43kD | XM_037181.1 | 1 | 0.01% | 0 | 0.00% | 0 | 0.00% | 0 | 0.00% | 1 |
| 5270 | regulator of G protein signaling (RGS5) | AF030108 | 0 | 0.00% | 0 | 0.00% | 1 | 0.01% | 0 | 0.00% | 1 |
| 5271 | Rel domain-containing transCRiption factor NFA | AF162853.1 | 0 | 0.00% | 0 | 0.00% | 1 | 0.01% | 0 | 0.00% | 1 |
| 5272 | RETINOIC ACID- AND INTERFERON-INDUCIB | spQ13325 | 0 | 0.00% | 0 | 0.00% | 0 | 0.00% | 1 | 0.01% | 1 |
| 5273 | retinoic acid receptor gamma (RARG) | NM_000966.1 | 1 | 0.01% | 0 | 0.00% | 0 | 0.00% | 0 | 0.00% | 1 |
| 5274 | retinoic acid receptor responder (tazarotene indu | NM_002888.1 | 0 | 0.00% | 0 | 0.00% | 0 | 0.00% | 1 | 0.01% | 1 |
| 5275 | retinoic acid receptor, beta (RARB) =Y00291 ha | NM_000965.1 | 0 | 0.00% | 0 | 0.00% | 0 | 0.00% | 1 | 0.01% | 1 |
| 5276 | retinoic acid-induced protein (RAI2) | AF136587.1 | 0 | 0.00% | 0 | 0.00% | 0 | 0.00% | 1 | 0.01% | 1 |
| 5277 | retinoid x receptor interacting protein (LOC5172 | NM_016290.1 | 0 | 0.00% | 0 | 0.00% | 1 | 0.01% | 0 | 0.00% | 1 |
| 5278 | retinoid X receptor, alpha (RXRA) | NM_002957.2 | 0 | 0.00% | 1 | 0.01% | 0 | 0.00% | 0 | 0.00% | 1 |
| 5279 | retinoid X receptor, gamma (RXRG) | NM_006917.1 | 1 | 0.01% | 0 | 0.00% | 0 | 0.00% | 0 | 0.00% | 1 |
| 5280 | RS21-C6 (Tdrg-TL1) | AF110764.1 | 1 | 0.01% | 0 | 0.00% | 0 | 0.00% | 0 | 0.00% | 1 |
| 5281 | scg | D67015.1 | 1 | 0.01% | 0 | 0.00% | 0 | 0.00% | 0 | 0.00% | 1 |
| 5282 | Sck, partial | AB001451 | 1 | 0.01% | 0 | 0.00% | 0 | 0.00% | 0 | 0.00% | 1 |
| 5283 | secreted modular calcium-binding protein 2 (smo | AJ249902.1 | 0 | 0.00% | 1 | 0.01% | 0 | 0.00% | 0 | 0.00% | 1 |
| 5284 | sigma receptor (SR31747 binding protein 1) (SR | NM_005866.1 | 0 | 0.00% | 1 | 0.01% | 0 | 0.00% | 0 | 0.00% | 1 |
| 5285 | steroid receptor (TR2-11) | M29960 | 0 | 0.00% | 0 | 0.00% | 1 | 0.01% | 0 | 0.00% | 1 |
| 5286 | steroid receptor RNA activator | AF092038.1 | 1 | 0.01% | 0 | 0.00% | 0 | 0.00% | 0 | 0.00% | 1 |
| 5287 | T41p (C8orf1) | AF061326.1 | 0 | 0.00% | 1 | 0.01% | 0 | 0.00% | 0 | 0.00% | 1 |
| 5288 | TAFII20 transcription factor TFIID(=TFIID subun | X84002.1 | 0 | 0.00% | 1 | 0.01% | 0 | 0.00% | 0 | 0.00% | 1 |
| 5289 | transmebrane receptor protein | Z17227.1 | 1 | 0.01% | 0 | 0.00% | 0 | 0.00% | 0 | 0.00% | 1 |
| 5290 | transportin-SR (TRN-SR) | AF145029.1 | 1 | 0.01% | 0 | 0.00% | 0 | 0.00% | 0 | 0.00% | 1 |
| 5291 | TRHR gene promoter (low match) | AJ011701 | 0 | 0.00% | 0 | 0.00% | 1 | 0.01% | 0 | 0.00% | 1 |
| 5292 | V beta T-cell receptor (TCRBV) (low match) | U03115 | 1 | 0.01% | 0 | 0.00% | 0 | 0.00% | 0 | 0.00% | 1 |
| 5293 | vanilloid receptor-like protein (VRL) | NM_016113.1 | 1 | 0.01% | 0 | 0.00% | 0 | 0.00% | 0 | 0.00% | 1 |
| 5294 | vasoactive intestinal peptide receptor 1 (VIPR1) | NM_004624.1 | 1 | 0.01% | 0 | 0.00% | 0 | 0.00% | 0 | 0.00% | 1 |
| 5295 | very low density lipoprotein receptor | D16532 | 0 | 0.00% | 0 | 0.00% | 0 | 0.00% | 1 | 0.01% | 1 |
| 5296 | v-Ki-ras2 Kirsten rat sarcoma 2 viral oncogene h | NM_004985.1 | 0 | 0.00% | 0 | 0.00% | 1 | 0.01% | 0 | 0.00% | 1 |
| 5297 | v-kit Hardy-Zuckerman 4 feline sarcoma viral on | NM_000222.1 | 0 | 0.00% | 1 | 0.01% | 0 | 0.00% | 0 | 0.00% | 1 |
| 5298 | benzodiazapine receptor (peripheral) (BZRP) | XM_040167.1 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 94 of 102

| | | | | | | | | | | | |
|---|---|---|---|---|---|---|---|---|---|---|---|
| 5299 | 14-3-3 epsilon | U54778 | 1 | 0.01% | 0 | 0.00% | 0 | 0.00% | 0 | 0.00% | 1 |
| 5300 | 14-3-3 protein beta subtype=putative protein kin | S55223 | 1 | 0.01% | 0 | 0.00% | 0 | 0.00% | 0 | 0.00% | 1 |
| 5301 | 14-3-3 protein eta chain | D78577.1 | 1 | 0.01% | 0 | 0.00% | 0 | 0.00% | 0 | 0.00% | 1 |
| 5302 | 14-3-3 protein gamma subtype=putative protein | S55305 | 1 | 0.01% | 0 | 0.00% | 0 | 0.00% | 0 | 0.00% | 1 |
| 5303 | 14-3-3n protein (=D78577) | L20422 | 1 | 0.01% | 0 | 0.00% | 0 | 0.00% | 0 | 0.00% | 1 |
| 5304 | 40 kDa protein kinase related to rat ERK2 | Z11695 | 0 | 0.00% | 0 | 0.00% | 0 | 0.00% | 1 | 0.01% | 1 |
| 5305 | BIFUNCTIONAL 3'-PHOSPHOADENOSINE 5'-F | spO43252 | 0 | 0.00% | 0 | 0.00% | 1 | 0.01% | 0 | 0.00% | 1 |
| 5306 | calcineurin B | M30773.1 | 1 | 0.01% | 0 | 0.00% | 0 | 0.00% | 0 | 0.00% | 1 |
| 5307 | cAMP-dependent protein kinase regulatory subu | M65066 | 1 | 0.01% | 0 | 0.00% | 0 | 0.00% | 0 | 0.00% | 1 |
| 5308 | CDC-like kinase 3 (CLK3) transcript variant phcl | NM_003992.1 | 1 | 0.01% | 0 | 0.00% | 0 | 0.00% | 0 | 0.00% | 1 |
| 5309 | DCHT (=AF030403 Ste20-like protein kinase) | AF017635 | 0 | 0.00% | 0 | 0.00% | 1 | 0.01% | 0 | 0.00% | 1 |
| 5310 | ILK-1 gene for integrin-linked kinase 1, exons 1- | AJ404847.1 | 0 | 0.00% | 1 | 0.01% | 0 | 0.00% | 0 | 0.00% | 1 |
| 5311 | JAB1-containing signalosome subunit 3 (SGN3) | AF031647 | 1 | 0.01% | 0 | 0.00% | 0 | 0.00% | 0 | 0.00% | 1 |
| 5312 | JNK2 beta2 protein kinase (JNK2B2) (ORF) | U35003.1 | 0 | 0.00% | 0 | 0.00% | 1 | 0.01% | 0 | 0.00% | 1 |
| 5313 | MAP kinase-interacting serine/threonine kinase | NM_003684.1 | 1 | 0.01% | 0 | 0.00% | 0 | 0.00% | 0 | 0.00% | 1 |
| 5314 | mitogen-activated protein kinase 5 (MAP4K5) | NM_006575.1 | 0 | 0.00% | 0 | 0.00% | 1 | 0.01% | 0 | 0.00% | 1 |
| 5315 | mitogen-activated protein kinase 8 (MAPK8)(= k | NM_002750.1 | 0 | 0.00% | 1 | 0.01% | 0 | 0.00% | 0 | 0.00% | 1 |
| 5316 | mitogen-activated protein kinase phosphatase x | NM_020185.1 | 0 | 0.00% | 1 | 0.01% | 0 | 0.00% | 0 | 0.00% | 1 |
| 5317 | mitogen-activated proteinkinase-activated protei | NP_003659.1 | 0 | 0.00% | 1 | 0.01% | 0 | 0.00% | 0 | 0.00% | 1 |
| 5318 | mitotic spindle coiled-coil related protein (DEEPI | NM_006461.1 | 1 | 0.01% | 0 | 0.00% | 0 | 0.00% | 0 | 0.00% | 1 |
| 5319 | pim-1 oncogene | M16750 | 0 | 0.00% | 0 | 0.00% | 0 | 0.00% | 1 | 0.01% | 1 |
| 5320 | PKU-alpha | AB004884 | 1 | 0.01% | 0 | 0.00% | 0 | 0.00% | 0 | 0.00% | 1 |
| 5321 | PKY protein kinase | AF004849.1 | 0 | 0.00% | 0 | 0.00% | 0 | 0.00% | 1 | 0.01% | 1 |
| 5322 | plk-1 (=U01038) | X73458 | 1 | 0.01% | 0 | 0.00% | 0 | 0.00% | 0 | 0.00% | 1 |
| 5323 | protein kinase C delta-type | D10495.1 | 0 | 0.00% | 1 | 0.01% | 0 | 0.00% | 0 | 0.00% | 1 |
| 5324 | protein kinase C zeta | Z15108 | 1 | 0.01% | 0 | 0.00% | 0 | 0.00% | 0 | 0.00% | 1 |
| 5325 | protein kinase C, alpha (RefSeq aa 3e-31) | NP_002728.1 | 0 | 0.00% | 1 | 0.01% | 0 | 0.00% | 0 | 0.00% | 1 |
| 5326 | protein kinase C, nu (PRKCN) | NM_005813.2 | 0 | 0.00% | 0 | 0.00% | 1 | 0.01% | 0 | 0.00% | 1 |
| 5327 | protein kinase CDK9(CDK9) gene | AF255306 | 1 | 0.01% | 0 | 0.00% | 0 | 0.00% | 0 | 0.00% | 1 |
| 5328 | protein kinase Chk2 (RAD53) | NM_007194.1 | 1 | 0.01% | 0 | 0.00% | 0 | 0.00% | 0 | 0.00% | 1 |
| 5329 | protein kinase C-theta (PRKCT) | L01087.1 | 0 | 0.00% | 0 | 0.00% | 0 | 0.00% | 1 | 0.01% | 1 |
| 5330 | protein kinase Dyrk2 | Y13493 | 1 | 0.01% | 0 | 0.00% | 0 | 0.00% | 0 | 0.00% | 1 |
| 5331 | protein kinase inhibitor p58 | U28424 | 0 | 0.00% | 0 | 0.00% | 0 | 0.00% | 1 | 0.01% | 1 |
| 5332 | protein kinase inhibitor(testicular isoform) (ORF) | L02241 | 0 | 0.00% | 0 | 0.00% | 1 | 0.01% | 0 | 0.00% | 1 |
| 5333 | PROTEIN MOV-10 | spP23249 | 1 | 0.01% | 0 | 0.00% | 0 | 0.00% | 0 | 0.00% | 1 |
| 5334 | PROTEIN N-TERMINAL ASPARAGINE AMIDOI | spQ64311 | 0 | 0.00% | 0 | 0.00% | 1 | 0.01% | 0 | 0.00% | 1 |
| 5335 | PROTEIN OS-9 PRECURSOR (non-exact 48%) | spQ13438 | 1 | 0.01% | 0 | 0.00% | 0 | 0.00% | 0 | 0.00% | 1 |
| 5336 | protein tyrosine kinase t-Ror1 (Ror1) (=AF05952 | U38894 | 1 | 0.01% | 0 | 0.00% | 0 | 0.00% | 0 | 0.00% | 1 |
| 5337 | rac protein kinase beta | M77198.1 | 1 | 0.01% | 0 | 0.00% | 0 | 0.00% | 0 | 0.00% | 1 |
| 5338 | Ser/Thr protein phosphatase type 2C beta 2 isof | AF294792.1 | 0 | 0.00% | 1 | 0.01% | 0 | 0.00% | 0 | 0.00% | 1 |
| 5339 | serine racemase | AF169974.1 | 0 | 0.00% | 1 | 0.01% | 0 | 0.00% | 0 | 0.00% | 1 |
| 5340 | serine/threonine protein kinase (HSA250839) | NM_018401.1 | 1 | 0.01% | 0 | 0.00% | 0 | 0.00% | 0 | 0.00% | 1 |
| 5341 | serum inducible kinase (SNK) | M96163 | 1 | 0.01% | 0 | 0.00% | 0 | 0.00% | 0 | 0.00% | 1 |
| 5342 | serum/glucocorticoid regulated kinase-like | gi7019527 | 0 | 0.00% | 0 | 0.00% | 0 | 0.00% | 1 | 0.01% | 1 |
| 5343 | SFRS protein kinase 1 (SRPK1) | NM_003137.1 | 0 | 0.00% | 0 | 0.00% | 0 | 0.00% | 1 | 0.01% | 1 |
| 5344 | SFRS protein kinase 2 (SRPK2) | NM_003138.1 | 0 | 0.00% | 1 | 0.01% | 0 | 0.00% | 0 | 0.00% | 1 |
| 5345 | T2K protein kinase homologue | AF145705.1 | 0 | 0.00% | 0 | 0.00% | 0 | 0.00% | 1 | 0.01% | 1 |
| 5346 | tyrosine 3-monooxygenase/tryptophan 5-monoo: | NM_006761.1 | 1 | 0.01% | 0 | 0.00% | 0 | 0.00% | 0 | 0.00% | 1 |
| 5347 | tyrosine 3-monooxygenase/tryptophan 5-monoo: | NM_003406.1 | 1 | 0.01% | 0 | 0.00% | 0 | 0.00% | 0 | 0.00% | 1 |
| 5348 | tyrosyl-tRNA synthetase | U89436 | 1 | 0.01% | 0 | 0.00% | 0 | 0.00% | 0 | 0.00% | 1 |
| 5349 | VRK2 | AB000450 | 0 | 0.00% | 0 | 0.00% | 0 | 0.00% | 1 | 0.01% | 1 |
| 5350 | cGMP phosphodiesterase delta subunit | AF022912 | 0 | 0.00% | 0 | 0.00% | 0 | 0.00% | 1 | 0.01% | 1 |
| 5351 | cGMP-binding cGMP-specific phosphodiesteras | AB001633.1 | 0 | 0.00% | 0 | 0.00% | 1 | 0.01% | 0 | 0.00% | 1 |
| 5352 | cyclic AMP-regulated phosphoprotein (90% matc | AF112220.1 | 0 | 0.00% | 0 | 0.00% | 1 | 0.01% | 0 | 0.00% | 1 |
| 5353 | CYCLIC-AMP-DEPENDENT TRANSCRIPTION | spP18848 | 1 | 0.01% | 0 | 0.00% | 0 | 0.00% | 0 | 0.00% | 1 |
| 5354 | Golgi membrane sialoglycoprotein MG160 (GLG | U64791.1 | 0 | 0.00% | 1 | 0.01% | 0 | 0.00% | 0 | 0.00% | 1 |
| 5355 | breakpoint cluster region protein 2 (BCRG2) | AF044774 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 95 of 102

| | | | | | | | | | | | |
|---|---|---|---|---|---|---|---|---|---|---|---|
| 5356 | cAMP-regulated guanine nucleotide exchange fa | NM_007023.1 | 0 | 0.00% | 1 | 0.01% | 0 | 0.00% | 0 | 0.00% | 1 |
| 5357 | dishevelled 2 (homologous to Drosophila dsh) (D | NM_004422.1 | 1 | 0.01% | 0 | 0.00% | 0 | 0.00% | 0 | 0.00% | 1 |
| 5358 | formin (Fmn) | NM_010230.1 | 0 | 0.00% | 1 | 0.01% | 0 | 0.00% | 0 | 0.00% | 1 |
| 5359 | formin-binding protein 17 (FBP17) | AF265550.1 | 1 | 0.01% | 0 | 0.00% | 0 | 0.00% | 0 | 0.00% | 1 |
| 5360 | GDP dissociation inhibitor 1(GDI1) | NM_001493.1 | 0 | 0.00% | 0 | 0.00% | 0 | 0.00% | 1 | 0.01% | 1 |
| 5361 | GRB2-associated binding protein 1 (GAB1) | NM_002039.1 | 0 | 0.00% | 1 | 0.01% | 0 | 0.00% | 0 | 0.00% | 1 |
| 5362 | GTPase Rab14 (LOC51730) (=DKFZp762K091 | NM_016322.1 | 0 | 0.00% | 0 | 0.00% | 0 | 0.00% | 1 | 0.01% | 1 |
| 5363 | GTPase-activating protein GAPIII | U20238 | 0 | 0.00% | 0 | 0.00% | 0 | 0.00% | 1 | 0.01% | 1 |
| 5364 | GTP-binding protein similar to RAY/RAB1C (RA | NM_006860.1 | 0 | 0.00% | 1 | 0.01% | 0 | 0.00% | 0 | 0.00% | 1 |
| 5365 | guanine nucleotide exchange factor delta subuni | M98036 | 0 | 0.00% | 0 | 0.00% | 0 | 0.00% | 1 | 0.01% | 1 |
| 5366 | guanine nucleotide exchange factor GRP1 (=A2 | AJ005197 | 1 | 0.01% | 0 | 0.00% | 0 | 0.00% | 0 | 0.00% | 1 |
| 5367 | guanine nucleotide regulatory protein (ABR) | U01147 | 1 | 0.01% | 0 | 0.00% | 0 | 0.00% | 0 | 0.00% | 1 |
| 5368 | guanine nucleotide regulatory protein (oncogene | NM_005863.1 | 0 | 0.00% | 0 | 0.00% | 0 | 0.00% | 1 | 0.01% | 1 |
| 5369 | Intracellular hyaluronan-binding protein | AF241831.1 | 1 | 0.01% | 0 | 0.00% | 0 | 0.00% | 0 | 0.00% | 1 |
| 5370 | mad protein homolog (hMAD-2) | U68018 | 1 | 0.01% | 0 | 0.00% | 0 | 0.00% | 0 | 0.00% | 1 |
| 5371 | MAD2 protein (=U31278) | AJ000186 | 1 | 0.01% | 0 | 0.00% | 0 | 0.00% | 0 | 0.00% | 1 |
| 5372 | Na /H exchanger 2 (A57644) (ORF) | D87743 | 0 | 0.00% | 1 | 0.01% | 0 | 0.00% | 0 | 0.00% | 1 |
| 5373 | Na /H exchanger regulatory factor 2 (NHERF-2) | AF035771 | 1 | 0.01% | 0 | 0.00% | 0 | 0.00% | 0 | 0.00% | 1 |
| 5374 | N-acetylneuraminate lyase (EC 4.1.3.3)(Non-exa | CAA27051.1 | 0 | 0.00% | 0 | 0.00% | 1 | 0.01% | 0 | 0.00% | 1 |
| 5375 | non-receptor tyrosine kinase (TNK1) gene, comp | AF097738 | 1 | 0.01% | 0 | 0.00% | 0 | 0.00% | 0 | 0.00% | 1 |
| 5376 | partial RAB18 gene for RAS-related small GTPa | AJ277148.1 | 0 | 0.00% | 1 | 0.01% | 0 | 0.00% | 0 | 0.00% | 1 |
| 5377 | phosphoprotein p53 | M22898 | 0 | 0.00% | 0 | 0.00% | 0 | 0.00% | 1 | 0.01% | 1 |
| 5378 | Rab acceptor 1 (prenylated) (RABAC1) | NM_006423.1 | 1 | 0.01% | 0 | 0.00% | 0 | 0.00% | 0 | 0.00% | 1 |
| 5379 | RAB10 | XM_002267 | 0 | 0.00% | 0 | 0.00% | 1 | 0.01% | 0 | 0.00% | 1 |
| 5380 | RAB2, member RAS oncogene family (RAB2) (C | NM_002865.1 | 0 | 0.00% | 1 | 0.01% | 0 | 0.00% | 0 | 0.00% | 1 |
| 5381 | Rab27a (=AF154840.1 Ras-like GTP-binding pro | U38654.3 | 0 | 0.00% | 0 | 0.00% | 1 | 0.01% | 0 | 0.00% | 1 |
| 5382 | RAB31, member RAS oncogene family (RAB31) | NM_006868.1 | 1 | 0.01% | 0 | 0.00% | 0 | 0.00% | 0 | 0.00% | 1 |
| 5383 | RAB39 (RAB39) | AF322067 | 1 | 0.01% | 0 | 0.00% | 0 | 0.00% | 0 | 0.00% | 1 |
| 5384 | RAB-8b protein (LOC51762),mRNA | NM_016530.1 | 0 | 0.00% | 0 | 0.00% | 0 | 0.00% | 1 | 0.01% | 1 |
| 5385 | rah=ras-related homologue | S72304 | 1 | 0.01% | 0 | 0.00% | 0 | 0.00% | 0 | 0.00% | 1 |
| 5386 | RalBP1 associated Eps domain containing prote | NM_009048.1 | 1 | 0.01% | 0 | 0.00% | 0 | 0.00% | 0 | 0.00% | 1 |
| 5387 | RalGDS-like 2 (RGL2) | U68142 | 1 | 0.01% | 0 | 0.00% | 0 | 0.00% | 0 | 0.00% | 1 |
| 5388 | RAN binding protein 3 (RANBP3), transcript vari | NM_007321.1 | 1 | 0.01% | 0 | 0.00% | 0 | 0.00% | 0 | 0.00% | 1 |
| 5389 | RAN-SPECIFIC GTPASE-ACTIVATING PROTE | spP43487 | 1 | 0.01% | 0 | 0.00% | 0 | 0.00% | 0 | 0.00% | 1 |
| 5390 | Ras association (RalGDS/AF-6) domain family 2 | NM_014737.1 | 0 | 0.00% | 1 | 0.01% | 0 | 0.00% | 0 | 0.00% | 1 |
| 5391 | ras GTPase activating protein-like (NGAP) mRN | NM_004841.1 | 0 | 0.00% | 0 | 0.00% | 0 | 0.00% | 1 | 0.01% | 1 |
| 5392 | ras GTPase-activating-like protein (IQGAP1) (=D | L33075 | 0 | 0.00% | 0 | 0.00% | 1 | 0.01% | 0 | 0.00% | 1 |
| 5393 | Ras homolog enriched in brain 2 (RHEB2) | NM_005614.1 | 0 | 0.00% | 1 | 0.01% | 0 | 0.00% | 0 | 0.00% | 1 |
| 5394 | ras homolog gene family member A (ARHA)(= G | NM_001664.1 | 0 | 0.00% | 1 | 0.01% | 0 | 0.00% | 0 | 0.00% | 1 |
| 5395 | RasGAP-related protein (IQGAP2) | U51903.1 | 0 | 0.00% | 0 | 0.00% | 0 | 0.00% | 1 | 0.01% | 1 |
| 5396 | ras-like protein | M31467 | 0 | 0.00% | 0 | 0.00% | 0 | 0.00% | 1 | 0.01% | 1 |
| 5397 | ras-like protein (low match, 57% aa) | M31468 | 1 | 0.01% | 0 | 0.00% | 0 | 0.00% | 0 | 0.00% | 1 |
| 5398 | ras-related protein (rab18) | L04966 | 0 | 0.00% | 0 | 0.00% | 1 | 0.01% | 0 | 0.00% | 1 |
| 5399 | RAS-RELATED PROTEIN RAH1(AS-RELATED | spQ64008 | 1 | 0.01% | 0 | 0.00% | 0 | 0.00% | 0 | 0.00% | 1 |
| 5400 | RAS-RELATED PROTEIN RAP-1A (C21KG)(KR | spP10113 | 0 | 0.00% | 0 | 0.00% | 1 | 0.01% | 0 | 0.00% | 1 |
| 5401 | rho GDP-dissociation Inhibitor 1 | X69550 | 0 | 0.00% | 0 | 0.00% | 1 | 0.01% | 0 | 0.00% | 1 |
| 5402 | Rho GTPase activating protein 6 isoform5 (RefS | NP_038266.1 | 0 | 0.00% | 1 | 0.01% | 0 | 0.00% | 0 | 0.00% | 1 |
| 5403 | Rho-associated, coiled-coil containing protein ki | NM_004850.2 | 0 | 0.00% | 0 | 0.00% | 0 | 0.00% | 1 | 0.01% | 1 |
| 5404 | SH3 and PX domain-containing protein SH3PX1 | NM_016224.1 | 0 | 0.00% | 1 | 0.01% | 0 | 0.00% | 0 | 0.00% | 1 |
| 5405 | SH3 domain-containing protein 6511 (LOC5116 | NM_016223.1 | 1 | 0.01% | 0 | 0.00% | 0 | 0.00% | 0 | 0.00% | 1 |
| 5406 | SH3-containing adaptor molecule-1 | AF037261.1 | 1 | 0.01% | 0 | 0.00% | 0 | 0.00% | 0 | 0.00% | 1 |
| 5407 | SH3-containing protein EEN (EEN) and chromat | AF190465.1 | 0 | 0.00% | 1 | 0.01% | 0 | 0.00% | 0 | 0.00% | 1 |
| 5408 | signal transducer and activator of transCRiption | L29277 | 1 | 0.01% | 0 | 0.00% | 0 | 0.00% | 0 | 0.00% | 1 |
| 5409 | signal transducing adaptor molecule 2A (STAM | AF042273 | 0 | 0.00% | 0 | 0.00% | 0 | 0.00% | 1 | 0.01% | 1 |
| 5410 | signal-induced proliferation-associated gene 1 (S | NM_006747.1 | 1 | 0.01% | 0 | 0.00% | 0 | 0.00% | 0 | 0.00% | 1 |
| 5411 | small GTP-binding protein RAB1A | AF226873.1 | 0 | 0.00% | 0 | 0.00% | 0 | 0.00% | 1 | 0.01% | 1 |
| 5412 | Testin 2 (testin 3) | AF260225 | 0 | 0.00% | 0 | 0.00% | 1 | 0.01% | 0 | 0.00% | 1 |

Figure 6 - Unique Known Genes Identified In Four cDNA Cartilage Libraries and EST Frequency Analysis - Page 96 of 102

| | | | | | | | | | | | |
|---|---|---|---|---|---|---|---|---|---|---|---|
| 5413 | T-lymphoma invasion and metastasis inducing T | U16296 | 0 | 0.00% | 0 | 0.00% | 0 | 0.00% | 1 | 0.01% | 1 |
| 5414 | transducer of ERBB2, 1 (RefSeq aa 2e-64) | NP_005740.1 | 0 | 0.00% | 1 | 0.01% | 0 | 0.00% | 0 | 0.00% | 1 |
| 5415 | transducer of ERBB2, 2(TOB2) | NM_016272.1 | 0 | 0.00% | 0 | 0.00% | 1 | 0.01% | 0 | 0.00% | 1 |
| 5416 | transducin (beta) like 1 protein | Y12781 | 0 | 0.00% | 0 | 0.00% | 1 | 0.01% | 0 | 0.00% | 1 |
| 5417 | A kinase (PRKA) anchor protein 1 (AKAP1) | XM_008154.3 | 1 | 0.01% | 0 | 0.00% | 0 | 0.00% | 0 | 0.00% | 1 |
| 5418 | ANG2 (ANG2) | AF024631.2 | 1 | 0.01% | 0 | 0.00% | 0 | 0.00% | 0 | 0.00% | 1 |
| 5419 | angiopoietin-like 2 (ANGPTL2) | NM_012098.1 | 0 | 0.00% | 0 | 0.00% | 0 | 0.00% | 1 | 0.01% | 1 |
| 5420 | Aspergillus nidulans sudD homologue | AF013591 | 1 | 0.01% | 0 | 0.00% | 0 | 0.00% | 0 | 0.00% | 1 |
| 5421 | BB1=malignant cell expression-enhanced gene/t | gi1699264 | 1 | 0.01% | 0 | 0.00% | 0 | 0.00% | 0 | 0.00% | 1 |
| 5422 | bone-derived growth factor (BPGF-1) | L42379.1 | 1 | 0.01% | 0 | 0.00% | 0 | 0.00% | 0 | 0.00% | 1 |
| 5423 | EXT-like protein 2 (EXTL2) | AF000416.1 | 0 | 0.00% | 1 | 0.01% | 0 | 0.00% | 0 | 0.00% | 1 |
| 5424 | factor C=endotoxin-sensitive intracellular serine | S77064 | 0 | 0.00% | 0 | 0.00% | 1 | 0.01% | 0 | 0.00% | 1 |
| 5425 | gliosarcoma-related antigen MIDA1 (MIDA1) | AF118853.1 | 0 | 0.00% | 0 | 0.00% | 0 | 0.00% | 1 | 0.01% | 1 |
| 5426 | glycine amidinotransferase (L-arginine:glycine a | NM_001482.1 | 1 | 0.01% | 0 | 0.00% | 0 | 0.00% | 0 | 0.00% | 1 |
| 5427 | insulin-like growth factor binding protein 6 (IGFB | M69054.1 | 0 | 0.00% | 1 | 0.01% | 0 | 0.00% | 0 | 0.00% | 1 |
| 5428 | interferon-related developmental regulator 1 | NP_001541.1 | 0 | 0.00% | 1 | 0.01% | 0 | 0.00% | 0 | 0.00% | 1 |
| 5429 | MAGE-Xp (non-exact 60%) (=M80840 Mouse ne | X82539 | 1 | 0.01% | 0 | 0.00% | 0 | 0.00% | 0 | 0.00% | 1 |
| 5430 | non-erythrocyte beta spectrin | AF017112 | 0 | 0.00% | 0 | 0.00% | 1 | 0.01% | 0 | 0.00% | 1 |
| 5431 | NOV protein | X96585 | 0 | 0.00% | 0 | 0.00% | 0 | 0.00% | 1 | 0.01% | 1 |
| 5432 | SKB1Hs | AF015913 | 1 | 0.01% | 0 | 0.00% | 0 | 0.00% | 0 | 0.00% | 1 |
| 5433 | angiopoietin-like factor (CTD6) | NM_021146.1 | 0 | 0.00% | 1 | 0.01% | 0 | 0.00% | 0 | 0.00% | 1 |
| 5434 | activin beta-C chain | X82540 | 1 | 0.01% | 0 | 0.00% | 0 | 0.00% | 0 | 0.00% | 1 |
| 5435 | angiogenin ribonuclease RNase A family, 5 (AN( | NM_001145.1 | 0 | 0.00% | 1 | 0.01% | 0 | 0.00% | 0 | 0.00% | 1 |
| 5436 | bone morphogenetic protein 4 precursor(RefSeq | NP_001193.1 | 0 | 0.00% | 1 | 0.01% | 0 | 0.00% | 0 | 0.00% | 1 |
| 5437 | bone morphogenetic protein 7 (osteogenic prote | NM_001719.1 | 1 | 0.01% | 0 | 0.00% | 0 | 0.00% | 0 | 0.00% | 1 |
| 5438 | bone morphogenetic protein1 (BMP1) (clone KT | L35279 | 1 | 0.01% | 0 | 0.00% | 0 | 0.00% | 0 | 0.00% | 1 |
| 5439 | CC-chemokine MCP-4 | AJ001634.1 | 0 | 0.00% | 0 | 0.00% | 0 | 0.00% | 1 | 0.01% | 1 |
| 5440 | chemokine (C-X3-C) receptor 1 (CX3CR1) | NM_001337.1 | 0 | 0.00% | 0 | 0.00% | 1 | 0.01% | 0 | 0.00% | 1 |
| 5441 | chemokine receptor X(CKRX) | AF014958 | 0 | 0.00% | 0 | 0.00% | 1 | 0.01% | 0 | 0.00% | 1 |
| 5442 | chimaeric transCRipt of collagen type 1 alpha 1 | Y15913 | 1 | 0.01% | 0 | 0.00% | 0 | 0.00% | 0 | 0.00% | 1 |
| 5443 | decidual protein induced by progesterone (DEPI | NM_007021.1 | 0 | 0.00% | 1 | 0.01% | 0 | 0.00% | 0 | 0.00% | 1 |
| 5444 | developmental arteries and neural crest EGF-lik | AF112152.1 | 0 | 0.00% | 1 | 0.01% | 0 | 0.00% | 0 | 0.00% | 1 |
| 5445 | developmental protein DG1071 | AAC67538.1 | 0 | 0.00% | 0 | 0.00% | 1 | 0.01% | 0 | 0.00% | 1 |
| 5446 | endocrine regulator (RefSeq aa 2e-88) | NP_055160.1 | 0 | 0.00% | 1 | 0.01% | 0 | 0.00% | 0 | 0.00% | 1 |
| 5447 | enkephalin | K00489 | 0 | 0.00% | 0 | 0.00% | 0 | 0.00% | 1 | 0.01% | 1 |
| 5448 | fibroblast growth factor 13 (FGF13) | NM_004114.1 | 1 | 0.01% | 0 | 0.00% | 0 | 0.00% | 0 | 0.00% | 1 |
| 5449 | fibroblasts of periodontal ligament | AB019409 | 1 | 0.01% | 0 | 0.00% | 0 | 0.00% | 0 | 0.00% | 1 |
| 5450 | glia maturation factor beta | M86492 | 0 | 0.00% | 0 | 0.00% | 0 | 0.00% | 1 | 0.01% | 1 |
| 5451 | glia maturation factor homologous protein | AB001993.1 | 0 | 0.00% | 0 | 0.00% | 1 | 0.01% | 0 | 0.00% | 1 |
| 5452 | gonadotropin-releasing hormone (=X01059) | X15215.1 | 0 | 0.00% | 0 | 0.00% | 0 | 0.00% | 1 | 0.01% | 1 |
| 5453 | GRO3 oncogene (GRO3) | NM_002090.1 | 0 | 0.00% | 0 | 0.00% | 0 | 0.00% | 1 | 0.01% | 1 |
| 5454 | growth factor-responsive protein, vascular smoo | A53770 | 0 | 0.00% | 0 | 0.00% | 0 | 0.00% | 1 | 0.01% | 1 |
| 5455 | growth hormone secretagogue precursor (GHRE | AF296558.1 | 0 | 0.00% | 1 | 0.01% | 0 | 0.00% | 0 | 0.00% | 1 |
| 5456 | growth inhibitor p33ING1 (ING1) | AF001954 | 0 | 0.00% | 0 | 0.00% | 0 | 0.00% | 1 | 0.01% | 1 |
| 5457 | heparin cofactor II (HCF2) | M58600 | 1 | 0.01% | 0 | 0.00% | 0 | 0.00% | 0 | 0.00% | 1 |
| 5458 | heparin-binding growth factor binding protein (nc | NP_005121.1 | 1 | 0.01% | 0 | 0.00% | 0 | 0.00% | 0 | 0.00% | 1 |
| 5459 | insulin-like growth factor binding protein 5 | U02026 | 1 | 0.01% | 0 | 0.00% | 0 | 0.00% | 0 | 0.00% | 1 |
| 5460 | insulin-like growth factor binding protein (IGFBP | X16302 | 1 | 0.01% | 0 | 0.00% | 0 | 0.00% | 0 | 0.00% | 1 |
| 5461 | interferon-induced leucine zipper protein (IFP35) | U72882.1 | 1 | 0.01% | 0 | 0.00% | 0 | 0.00% | 0 | 0.00% | 1 |
| 5462 | keratinocyte, normal | U33270.1 | 0 | 0.00% | 0 | 0.00% | 1 | 0.01% | 0 | 0.00% | 1 |
| 5463 | mast cell growth factor (Mgf) | U44725 | 0 | 0.00% | 0 | 0.00% | 0 | 0.00% | 1 | 0.01% | 1 |
| 5464 | monocyte seCRetory protein, JE (=S69738) | M28226.1 | 0 | 0.00% | 0 | 0.00% | 0 | 0.00% | 1 | 0.01% | 1 |
| 5465 | NB thymosin beta | D82345.1 | 0 | 0.00% | 0 | 0.00% | 0 | 0.00% | 1 | 0.01% | 1 |
| 5466 | neuroendoCRine seCRetory protein 55 | AF105253.1 | 0 | 0.00% | 0 | 0.00% | 1 | 0.01% | 0 | 0.00% | 1 |
| 5467 | placental growth factor vascular endothelial grov | XM_040405.1 | 1 | 0.01% | 0 | 0.00% | 0 | 0.00% | 0 | 0.00% | 1 |
| 5468 | prepro insulin-like growth factor-I (IGF-I) gene, e | M59812.1 | 0 | 0.00% | 1 | 0.01% | 0 | 0.00% | 0 | 0.00% | 1 |
| 5469 | preproadrenomedullin, complete cds (exon 1-4) | D43639.1 | 0 | 0.00% | 1 | 0.01% | 0 | 0.00% | 0 | 0.00% | 1 |

Figure 6 - Unique Known Genes Identified In Four cDNA Cartilage Libraries and EST Frequency Analysis - Page 97 of 102

| | | | | | | | | | | | |
|---|---|---|---|---|---|---|---|---|---|---|---|
| 5470 | schwannomin interacting protein 1 (SCHIP-1) | NM_014575.1 | 0 | 0.00% | 0 | 0.00% | 1 | 0.01% | 0 | 0.00% | 1 |
| 5471 | seCRetory protein clone 1.1 (=D79993 KIAA017 | U00157 | 0 | 0.00% | 0 | 0.00% | 0 | 0.00% | 1 | 0.01% | 1 |
| 5472 | thymocyte protein cThy28kD (=AF161493 HSPC | U34350 | 0 | 0.00% | 0 | 0.00% | 1 | 0.01% | 0 | 0.00% | 1 |
| 5473 | Transformation-related protein | AAA36776.1 | 1 | 0.01% | 0 | 0.00% | 0 | 0.00% | 0 | 0.00% | 1 |
| 5474 | transformation-sensitive protein (IEF SSP 3521) | M86752 | 1 | 0.01% | 0 | 0.00% | 0 | 0.00% | 0 | 0.00% | 1 |
| 5475 | transforming acidic coiled-coil containing protein | AF093543.1 | 1 | 0.01% | 0 | 0.00% | 0 | 0.00% | 0 | 0.00% | 1 |
| 5476 | transforming growth factor, alpha (TGFA) | NM_003236.1 | 0 | 0.00% | 1 | 0.01% | 0 | 0.00% | 0 | 0.00% | 1 |
| 5477 | transforming growth factor-beta type I receptor | AF035669 | 0 | 0.00% | 0 | 0.00% | 0 | 0.00% | 1 | 0.01% | 1 |
| 5478 | TRANSFORMING PROTEIN P21/H-RAS-1 (C-H | spP01112 | 1 | 0.01% | 0 | 0.00% | 0 | 0.00% | 0 | 0.00% | 1 |
| 5479 | TRK-fused gene (NOTE: non-standard symbol a | NM_006070.1 | 1 | 0.01% | 0 | 0.00% | 0 | 0.00% | 0 | 0.00% | 1 |
| 5480 | uncharacterized bone marrow protein BM028 (=( | AF217505.1 | 0 | 0.00% | 1 | 0.01% | 0 | 0.00% | 0 | 0.00% | 1 |
| 5481 | uncharacterized bone marrow protein BM029 (B | NM_018450.1 | 0 | 0.00% | 0 | 0.00% | 0 | 0.00% | 1 | 0.01% | 1 |
| 5482 | uncharacterized bone marrow protein BM031 | AF217508.1 | 0 | 0.00% | 0 | 0.00% | 0 | 0.00% | 1 | 0.01% | 1 |
| 5483 | uncharacterized bone marrow protein BM033 | AF217510.1 | 0 | 0.00% | 0 | 0.00% | 0 | 0.00% | 1 | 0.01% | 1 |
| 5484 | uncharacterized bone marrow protein BM044 | AF217520.1 | 0 | 0.00% | 0 | 0.00% | 1 | 0.01% | 0 | 0.00% | 1 |
| 5485 | uncharacterized hypothalamus protein HT010 (H | NM_018471.1 | 0 | 0.00% | 0 | 0.00% | 1 | 0.01% | 0 | 0.00% | 1 |
| 5486 | vascular endothelial growth factor C (RefSeq aa | NP_005420.1 | 0 | 0.00% | 1 | 0.01% | 0 | 0.00% | 0 | 0.00% | 1 |
| 5487 | vascular endothelial junction-associated molecul | AF255910.1 | 0 | 0.00% | 1 | 0.01% | 0 | 0.00% | 0 | 0.00% | 1 |
| 5488 | vascular Rab-GAP/TBC-containing (VRP) | XM_010826.2 | 1 | 0.01% | 0 | 0.00% | 0 | 0.00% | 0 | 0.00% | 1 |
| 5489 | WNT1 inducible signalling pathway protein 2 (W | NM_003881.1 | 0 | 0.00% | 1 | 0.01% | 0 | 0.00% | 0 | 0.00% | 1 |
| 5490 | adenylyl cyclase | AF070583.1 | 1 | 0.01% | 0 | 0.00% | 0 | 0.00% | 0 | 0.00% | 1 |
| 5491 | adenylyl cyclase type V (=AB007882 hypothetic | M96159 | 1 | 0.01% | 0 | 0.00% | 0 | 0.00% | 0 | 0.00% | 1 |
| 5492 | bone gamma-carboxyglutamate (gla) protein (os | X51699 | 1 | 0.01% | 0 | 0.00% | 0 | 0.00% | 0 | 0.00% | 1 |
| 5493 | motch B | X68279 | 0 | 0.00% | 0 | 0.00% | 0 | 0.00% | 1 | 0.01% | 1 |
| 5494 | NAALADase II protein | AJ012370.1 | 0 | 0.00% | 0 | 0.00% | 0 | 0.00% | 1 | 0.01% | 1 |
| 5495 | adenylate cyclase 7 (ADCY7) (=D25538 KIAA00 | gi4557254 | 0 | 0.00% | 0 | 0.00% | 0 | 0.00% | 1 | 0.01% | 1 |
| 5496 | adenylate cyclase activating polypeptide 1 (pitui | NM_001118.1 | 1 | 0.01% | 0 | 0.00% | 0 | 0.00% | 0 | 0.00% | 1 |
| 5497 | ADP-ribosylation factor | L38490 | 0 | 0.00% | 1 | 0.01% | 0 | 0.00% | 0 | 0.00% | 1 |
| 5498 | ADP-ribosylation factor (hARF5) | M57567 | 1 | 0.01% | 0 | 0.00% | 0 | 0.00% | 0 | 0.00% | 1 |
| 5499 | ADP-ribosylation factor 3 (ARF3) | NM_001659.1 | 0 | 0.00% | 1 | 0.01% | 0 | 0.00% | 0 | 0.00% | 1 |
| 5500 | ADP-ribosylation factor binding protein (GGA1) | AF190862.1 | 1 | 0.01% | 0 | 0.00% | 0 | 0.00% | 0 | 0.00% | 1 |
| 5501 | ADP-ribosylation factor GTPase activating protei | BC005122.1 | 0 | 0.00% | 0 | 0.00% | 1 | 0.01% | 0 | 0.00% | 1 |
| 5502 | ADP-ribosylation factor-like 5 (ARL5), mRNA | NM_012097.1 | 0 | 0.00% | 1 | 0.01% | 0 | 0.00% | 0 | 0.00% | 1 |
| 5503 | ADP-ribosylation factor-like 6 interacting protein | XM_027365.2 | 1 | 0.01% | 0 | 0.00% | 0 | 0.00% | 0 | 0.00% | 1 |
| 5504 | alpha-catenin-like protein (CTNNAL1) | AF030233 | 0 | 0.00% | 0 | 0.00% | 0 | 0.00% | 1 | 0.01% | 1 |
| 5505 | ARP1 (actin-related protein 1, yeast) homolog A | XM_031949.1 | 0 | 0.00% | 0 | 0.00% | 0 | 0.00% | 1 | 0.01% | 1 |
| 5506 | beta-arrestin 2(=ARRB2) | AF106941.1 | 0 | 0.00% | 0 | 0.00% | 1 | 0.01% | 0 | 0.00% | 1 |
| 5507 | Ca/calmodulin-dependent protein kinase II, delta | NM_012519.1 | 0 | 0.00% | 1 | 0.01% | 0 | 0.00% | 0 | 0.00% | 1 |
| 5508 | Ca2 -transporting ATPase (EC 3.6.1.38), fast sk | S24359 | 0 | 0.00% | 0 | 0.00% | 0 | 0.00% | 1 | 0.01% | 1 |
| 5509 | calcium/calmodulin-dependent protein kinase I ( | NM_003656.2 | 1 | 0.01% | 0 | 0.00% | 0 | 0.00% | 0 | 0.00% | 1 |
| 5510 | CALCIUM-BINDING PROTEIN E63-1=U25882( | P48593 | 0 | 0.00% | 0 | 0.00% | 1 | 0.01% | 0 | 0.00% | 1 |
| 5511 | calcium-independent alpha-latrotoxin receptor h | AF063102 | 0 | 0.00% | 0 | 0.00% | 0 | 0.00% | 1 | 0.01% | 1 |
| 5512 | catenin (cadherin-associated protein), beta 1 (C | NM_001904.1 | 0 | 0.00% | 1 | 0.01% | 0 | 0.00% | 0 | 0.00% | 1 |
| 5513 | catenin(cadherin-associated protein), delta 1 (C | NM_001331.1 | 0 | 0.00% | 1 | 0.01% | 0 | 0.00% | 0 | 0.00% | 1 |
| 5514 | collapsin response mediator protein CRMP-1 (= | U17278 | 1 | 0.01% | 0 | 0.00% | 0 | 0.00% | 0 | 0.00% | 1 |
| 5515 | ECSIT (LOC51295) | NM_016581.1 | 1 | 0.01% | 0 | 0.00% | 0 | 0.00% | 0 | 0.00% | 1 |
| 5516 | Gi3 alpha protein | X54048.1 | 1 | 0.01% | 0 | 0.00% | 0 | 0.00% | 0 | 0.00% | 1 |
| 5517 | grancalcin (GCL) | NM_012198.1 | 0 | 0.00% | 0 | 0.00% | 1 | 0.01% | 0 | 0.00% | 1 |
| 5518 | guanyl cyclase C gene | U20230 | 0 | 0.00% | 0 | 0.00% | 1 | 0.01% | 0 | 0.00% | 1 |
| 5519 | homer-2a | AF093263 | 1 | 0.01% | 0 | 0.00% | 0 | 0.00% | 0 | 0.00% | 1 |
| 5520 | indian hedgehog protein (IHH) | L38517.1 | 1 | 0.01% | 0 | 0.00% | 0 | 0.00% | 0 | 0.00% | 1 |
| 5521 | max gene | X66867.1 | 1 | 0.01% | 0 | 0.00% | 0 | 0.00% | 0 | 0.00% | 1 |
| 5522 | NAD ADP-ribosyltransferase 3 (ADPRT3) | AF085734.1 | 0 | 0.00% | 0 | 0.00% | 1 | 0.01% | 0 | 0.00% | 1 |
| 5523 | nuclear receptor subfamily 2, group C, member | NM_003297.1 | 0 | 0.00% | 0 | 0.00% | 1 | 0.01% | 0 | 0.00% | 1 |
| 5524 | SAR1 (SAR1) | AF261717 | 0 | 0.00% | 0 | 0.00% | 0 | 0.00% | 1 | 0.01% | 1 |
| 5525 | soluble guanylate cyclase small subunit | X66533 | 1 | 0.01% | 0 | 0.00% | 0 | 0.00% | 0 | 0.00% | 1 |
| 5526 | terminal transferase | M11722.1 | 0 | 0.00% | 0 | 0.00% | 1 | 0.01% | 0 | 0.00% | 1 |

Figure 6 - Unique Known Genes Identified In Four cDNA Cartilage Libraries and EST Frequency Analysis - Page 98 of 102

| | | | | | | | | | | |
|---|---|---|---|---|---|---|---|---|---|---|
| 5527 | TIRC7 protein (TCIRG1) | AF033033.2 | 0 | 0.00% | 0 | 0.00% | 0 | 0.00% | 1 | 0.01% | 1 |
| 5528 | TNF receptor-1 associated protein (TRADD) | L41690 | 0 | 0.00% | 0 | 0.00% | 0 | 0.00% | 1 | 0.01% | 1 |
| 5529 | TNF receptor-associated factor 1 (TRAF1) | NM_005658.1 | 1 | 0.01% | 0 | 0.00% | 0 | 0.00% | 0 | 0.00% | 1 |
| 5530 | TNF-alpha stimulated ABC protein (ABC50) | AF027302.1 | 1 | 0.01% | 0 | 0.00% | 0 | 0.00% | 0 | 0.00% | 1 |
| 5531 | TNF-receptor associated factor-3 (TRAF-3) | AF110908.1 | 1 | 0.01% | 0 | 0.00% | 0 | 0.00% | 0 | 0.00% | 1 |
| 5532 | TOK-1beta | AB040451.1 | 0 | 0.00% | 0 | 0.00% | 0 | 0.00% | 1 | 0.01% | 1 |
| 5533 | vitamin D3 receptor interacting protein (DRIP80) | AF105421.1 | 0 | 0.00% | 0 | 0.00% | 1 | 0.01% | 0 | 0.00% | 1 |
| 5534 | inner membrane protein mitochondrial (mitofilin) | gi5803114 | 1 | 0.01% | 0 | 0.00% | 0 | 0.00% | 0 | 0.00% | 1 |
| 5535 | thiamine transporter 1 (THT1) | AF160812.1 | 0 | 0.00% | 1 | 0.01% | 0 | 0.00% | 0 | 0.00% | 1 |
| 5536 | ABC transporter (ATM1) | AF078777.1 | 0 | 0.00% | 0 | 0.00% | 1 | 0.01% | 0 | 0.00% | 1 |
| 5537 | calcium activated neutral protease large subunit | X04366 | 1 | 0.01% | 0 | 0.00% | 0 | 0.00% | 0 | 0.00% | 1 |
| 5538 | calcium transport ATPase ATP2C1 (ATP2C1) | AF225981.1 | 0 | 0.00% | 1 | 0.01% | 0 | 0.00% | 0 | 0.00% | 1 |
| 5539 | calcium-activated potassium channel | U093833 | 0 | 0.00% | 0 | 0.00% | 1 | 0.01% | 0 | 0.00% | 1 |
| 5540 | channel-kinase 1 (CHAK1) | AF346629 | 0 | 0.00% | 0 | 0.00% | 1 | 0.01% | 0 | 0.00% | 1 |
| 5541 | chloride channel 3 (CLCN3) | X78520 | 1 | 0.01% | 0 | 0.00% | 0 | 0.00% | 0 | 0.00% | 1 |
| 5542 | chloride channel protein 4 | AB019432.1 | 0 | 0.00% | 0 | 0.00% | 0 | 0.00% | 1 | 0.01% | 1 |
| 5543 | chloride channel regulatory protein | U17899 | 0 | 0.00% | 0 | 0.00% | 1 | 0.01% | 0 | 0.00% | 1 |
| 5544 | connexin 26 (GJB2) | M86849.2 | 0 | 0.00% | 0 | 0.00% | 1 | 0.01% | 0 | 0.00% | 1 |
| 5545 | Creatine transporter (SLC6A8) and (CDM) paral | gi1401058 | 1 | 0.01% | 0 | 0.00% | 0 | 0.00% | 0 | 0.00% | 1 |
| 5546 | dopamine responsive protein DRG-1 | AF271994.1 | 0 | 0.00% | 0 | 0.00% | 0 | 0.00% | 1 | 0.01% | 1 |
| 5547 | familial intrahepatic cholestasis 1, (progressive, | NP_005594.1 | 0 | 0.00% | 1 | 0.01% | 0 | 0.00% | 0 | 0.00% | 1 |
| 5548 | gamma-aminobutyraldehyde dehydrogenase (=l | U34252 | 1 | 0.01% | 0 | 0.00% | 0 | 0.00% | 0 | 0.00% | 1 |
| 5549 | gamma-aminobutyric acid (GABA) A receptor, al | NM_000809.1 | 0 | 0.00% | 0 | 0.00% | 1 | 0.01% | 0 | 0.00% | 1 |
| 5550 | gamma-aminobutyric acid (GABA) B receptor, 1 | NM_001471.1 | 1 | 0.01% | 0 | 0.00% | 0 | 0.00% | 0 | 0.00% | 1 |
| 5551 | glycoprotein (transmembrane) nmb (GPNMB), m | Hs.82226 | 0 | 0.00% | 0 | 0.00% | 0 | 0.00% | 1 | 0.01% | 1 |
| 5552 | hemoglobin, alpha 1 (HBA1) | NM_000558.3 | 1 | 0.01% | 0 | 0.00% | 0 | 0.00% | 0 | 0.00% | 1 |
| 5553 | hemoglobin, alpha 2 (HBA2), | NM_000517.3 | 1 | 0.01% | 0 | 0.00% | 0 | 0.00% | 0 | 0.00% | 1 |
| 5554 | large conductance calcium- and voltage-depend | U11058.2 | 0 | 0.00% | 1 | 0.01% | 0 | 0.00% | 0 | 0.00% | 1 |
| 5555 | L-type calcium channel beta-1 subunit (CACNLE | U39412 | 1 | 0.01% | 0 | 0.00% | 0 | 0.00% | 0 | 0.00% | 1 |
| 5556 | Machado-Joseph disease (MJD) | NM_004993.1 | 0 | 0.00% | 1 | 0.01% | 0 | 0.00% | 0 | 0.00% | 1 |
| 5557 | membrane-bound aminopeptidase P (XNPEP2) | AF195953.1 | 0 | 0.00% | 1 | 0.01% | 0 | 0.00% | 0 | 0.00% | 1 |
| 5558 | minK-related peptide 3 | AF076533.1 | 0 | 0.00% | 0 | 0.00% | 1 | 0.01% | 0 | 0.00% | 1 |
| 5559 | OCTN2 | AB016625.1 | 0 | 0.00% | 0 | 0.00% | 1 | 0.01% | 0 | 0.00% | 1 |
| 5560 | PALS1 | AF199008 | 0 | 0.00% | 0 | 0.00% | 0 | 0.00% | 1 | 0.01% | 1 |
| 5561 | potassium channel subunit (=AB037843 KIAA14 | AF089730 | 0 | 0.00% | 0 | 0.00% | 0 | 0.00% | 1 | 0.01% | 1 |
| 5562 | potassium large conductancecalcium-activated c | NP_002238.1 | 0 | 0.00% | 1 | 0.01% | 0 | 0.00% | 0 | 0.00% | 1 |
| 5563 | potassium voltage-gated channel, shaker-relatec | NM_003471.1 | 0 | 0.00% | 0 | 0.00% | 0 | 0.00% | 1 | 0.01% | 1 |
| 5564 | proton pump polypeptide | M58758 | 1 | 0.01% | 0 | 0.00% | 0 | 0.00% | 0 | 0.00% | 1 |
| 5565 | SODIUM/HYDROGEN EXCHANGER 6 (NA( )/H | Q92581NAH6 | 0 | 0.00% | 0 | 0.00% | 1 | 0.01% | 0 | 0.00% | 1 |
| 5566 | TRPC1 protein | X89066 | 1 | 0.01% | 0 | 0.00% | 0 | 0.00% | 0 | 0.00% | 1 |
| 5567 | VDAC1 gene porin isoform 1 | AJ250039.1 | 0 | 0.00% | 0 | 0.00% | 1 | 0.01% | 0 | 0.00% | 1 |
| 5568 | voltage-gated potassium channel KCNQ5 (KCN( | AF263835.1 | 0 | 0.00% | 0 | 0.00% | 1 | 0.01% | 0 | 0.00% | 1 |
| 5569 | cell surface glycoprotein P1H12 precursor | AF089868.1 | 1 | 0.01% | 0 | 0.00% | 0 | 0.00% | 0 | 0.00% | 1 |
| 5570 | killer cell lectin-like receptor subfamily B, membe | NM_002258.1 | 0 | 0.00% | 0 | 0.00% | 1 | 0.01% | 0 | 0.00% | 1 |
| 5571 | METAXIN | spQ13505 | 1 | 0.01% | 0 | 0.00% | 0 | 0.00% | 0 | 0.00% | 1 |
| 5572 | beta 2 | X02344 | 1 | 0.01% | 0 | 0.00% | 0 | 0.00% | 0 | 0.00% | 1 |
| 5573 | beta4-integrin (ITGB4) (low match) | U66534 | 1 | 0.01% | 0 | 0.00% | 0 | 0.00% | 0 | 0.00% | 1 |
| 5574 | cadherin 5, VE-cadherin (vascular epithelium) (C | NM_001795.1 | 0 | 0.00% | 0 | 0.00% | 1 | 0.01% | 0 | 0.00% | 1 |
| 5575 | cadherin-15 | D83542 | 1 | 0.01% | 0 | 0.00% | 0 | 0.00% | 0 | 0.00% | 1 |
| 5576 | cerebral cell adhesion molecule (=AB011156 KI | AF177203.1 | 0 | 0.00% | 0 | 0.00% | 1 | 0.01% | 0 | 0.00% | 1 |
| 5577 | c-type lectin DCL1 (ORF) | AF121352 | 0 | 0.00% | 0 | 0.00% | 1 | 0.01% | 0 | 0.00% | 1 |
| 5578 | cysLT1 LTD4 receptor (CYSLT1) | AF119711.1 | 0 | 0.00% | 0 | 0.00% | 0 | 0.00% | 1 | 0.01% | 1 |
| 5579 | desmoplakin (DPI, DPII) (RefSeq aa 1e-88) | NP_004406.1 | 0 | 0.00% | 1 | 0.01% | 0 | 0.00% | 0 | 0.00% | 1 |
| 5580 | flotillin 1 (FLOT1) | NM_005803.2 | 1 | 0.01% | 0 | 0.00% | 0 | 0.00% | 0 | 0.00% | 1 |
| 5581 | focal adhesion kinase (FAK) | L13616.1 | 0 | 0.00% | 1 | 0.01% | 0 | 0.00% | 0 | 0.00% | 1 |
| 5582 | fucosyltransferase 8 (alpha (1,6)fucosyltransfera | NP_004471.1 | 0 | 0.00% | 0 | 0.00% | 0 | 0.00% | 1 | 0.01% | 1 |
| 5583 | GPI transamidase | AF022913 | 0 | 0.00% | 0 | 0.00% | 1 | 0.01% | 0 | 0.00% | 1 |

Figure 6 - Unique Known Genes Identified In Four cDNA Cartilage Libraries and EST Frequency Analysis - Page 99 of 102

| | | | | | | | | | | | |
|---|---|---|---|---|---|---|---|---|---|---|---|
| 5584 | hGAA1 | AB006969 | 1 | 0.01% | 0 | 0.00% | 0 | 0.00% | 0 | 0.00% | 1 |
| 5585 | ICHIT protein (52/53) | AJ010903.1 | 1 | 0.01% | 0 | 0.00% | 0 | 0.00% | 0 | 0.00% | 1 |
| 5586 | insulin-like growth factor binding protein 4 (IGFB | M62403.1 | 1 | 0.01% | 0 | 0.00% | 0 | 0.00% | 0 | 0.00% | 1 |
| 5587 | integrin alpha 6 | X53586 | 0 | 0.00% | 0 | 0.00% | 1 | 0.01% | 0 | 0.00% | 1 |
| 5588 | integrin associated protein | Z25524.1 | 0 | 0.00% | 0 | 0.00% | 1 | 0.01% | 0 | 0.00% | 1 |
| 5589 | integrin beta 3 binding protein (beta3-endonexin | NM_014288.1 | 0 | 0.00% | 1 | 0.01% | 0 | 0.00% | 0 | 0.00% | 1 |
| 5590 | INTEGRIN BETA-8 PRECURSOR | spP26012 | 0 | 0.00% | 0 | 0.00% | 0 | 0.00% | 1 | 0.01% | 1 |
| 5591 | integrin, alpha 5 (fibronectin receptor, alpha poly | NM_002205.1 | 1 | 0.01% | 0 | 0.00% | 0 | 0.00% | 0 | 0.00% | 1 |
| 5592 | junctional adhesion molecule 3 (JAM3) | XM_053514.1 | 1 | 0.01% | 0 | 0.00% | 0 | 0.00% | 0 | 0.00% | 1 |
| 5593 | N-cadherin mRNA, complete cds | M34064.1 | 0 | 0.00% | 1 | 0.01% | 0 | 0.00% | 0 | 0.00% | 1 |
| 5594 | nel (chicken)-like 2 (NELL2) | NM_006159.1 | 1 | 0.01% | 0 | 0.00% | 0 | 0.00% | 0 | 0.00% | 1 |
| 5595 | neural cell adhesion molecule | X07200.1 | 1 | 0.01% | 0 | 0.00% | 0 | 0.00% | 0 | 0.00% | 1 |
| 5596 | neural F box protein NFB42 | AF098301 | 1 | 0.01% | 0 | 0.00% | 0 | 0.00% | 0 | 0.00% | 1 |
| 5597 | ninjurin 2 (NINJ2) | NM_016533.1 | 1 | 0.01% | 0 | 0.00% | 0 | 0.00% | 0 | 0.00% | 1 |
| 5598 | novel protein AHNAK mRNA, partial sequence | M80899.1 | 0 | 0.00% | 1 | 0.01% | 0 | 0.00% | 0 | 0.00% | 1 |
| 5599 | p55-related MAGUK protein DLG3 (dlg3) | AF124435.1 | 0 | 0.00% | 0 | 0.00% | 1 | 0.01% | 0 | 0.00% | 1 |
| 5600 | PCDH-psi3 pseudogene | AF152529.1 | 0 | 0.00% | 0 | 0.00% | 0 | 0.00% | 1 | 0.01% | 1 |
| 5601 | PNGase | AF250924.1 | 0 | 0.00% | 0 | 0.00% | 1 | 0.01% | 0 | 0.00% | 1 |
| 5602 | polycystic kidney disease 1(autosomal dominant | NM_000296.1 | 1 | 0.01% | 0 | 0.00% | 0 | 0.00% | 0 | 0.00% | 1 |
| 5603 | Semaphorin A (V)(SEMA5) | NM_004636.1 | 1 | 0.01% | 0 | 0.00% | 0 | 0.00% | 0 | 0.00% | 1 |
| 5604 | semaphorin V | U28369 | 1 | 0.01% | 0 | 0.00% | 0 | 0.00% | 0 | 0.00% | 1 |
| 5605 | syntaxin 5 | U26648 | 1 | 0.01% | 0 | 0.00% | 0 | 0.00% | 0 | 0.00% | 1 |
| 5606 | syntaxin4-interacting protein synip (ORF) | AF152924 | 0 | 0.00% | 0 | 0.00% | 0 | 0.00% | 1 | 0.01% | 1 |
| 5607 | SYT | X79201 | 1 | 0.01% | 0 | 0.00% | 0 | 0.00% | 0 | 0.00% | 1 |
| 5608 | thrombomodulin, endothelial cell | M16552 | 0 | 0.00% | 0 | 0.00% | 1 | 0.01% | 0 | 0.00% | 1 |
| 5609 | TRAF interacting protein (TRIP) | NM_005879.1 | 1 | 0.01% | 0 | 0.00% | 0 | 0.00% | 0 | 0.00% | 1 |
| 5610 | TRAF5 | AB000509.1 | 0 | 0.00% | 0 | 0.00% | 0 | 0.00% | 1 | 0.01% | 1 |
| 5611 | TRAF-interacting protein I-TRAF | U59863.1 | 0 | 0.00% | 1 | 0.01% | 0 | 0.00% | 0 | 0.00% | 1 |
| 5612 | triple functional domain(PTPRF interacting) (TRI | NM_007118.1 | 0 | 0.00% | 1 | 0.01% | 0 | 0.00% | 0 | 0.00% | 1 |
| 5613 | Tspan-3 | AF054840 | 1 | 0.01% | 0 | 0.00% | 0 | 0.00% | 0 | 0.00% | 1 |
| 5614 | Nop10p | NM_018648.1 | 0 | 0.00% | 1 | 0.01% | 0 | 0.00% | 0 | 0.00% | 1 |
| 5615 | chromodomain helicase DNA binding protein 3 (( | NM_001272.1 | 1 | 0.01% | 0 | 0.00% | 0 | 0.00% | 0 | 0.00% | 1 |
| 5616 | chromosomal protein HMG1 related gene | D14718 | 1 | 0.01% | 0 | 0.00% | 0 | 0.00% | 0 | 0.00% | 1 |
| 5617 | chromosome-specific mRNA | L23207.1 | 1 | 0.01% | 0 | 0.00% | 0 | 0.00% | 0 | 0.00% | 1 |
| 5618 | cisplatin resistance associated (CRA) | NM_006697.1 | 0 | 0.00% | 0 | 0.00% | 1 | 0.01% | 0 | 0.00% | 1 |
| 5619 | H1 histone (H1F0) | NM_005318.1 | 1 | 0.01% | 0 | 0.00% | 0 | 0.00% | 0 | 0.00% | 1 |
| 5620 | H2A histone family, member Y (H2AFY)(= histor | NM_004893.1 | 0 | 0.00% | 1 | 0.01% | 0 | 0.00% | 0 | 0.00% | 1 |
| 5621 | H2B histone family, member Q (H2BFQ) | NM_003528.1 | 1 | 0.01% | 0 | 0.00% | 0 | 0.00% | 0 | 0.00% | 1 |
| 5622 | heterochromatin protein homologue (HP1) | L07515.1 | 0 | 0.00% | 1 | 0.01% | 0 | 0.00% | 0 | 0.00% | 1 |
| 5623 | heterochromatin protein p25 | U35451 | 0 | 0.00% | 0 | 0.00% | 0 | 0.00% | 1 | 0.01% | 1 |
| 5624 | high mobility group 1 protein | L13804 | 1 | 0.01% | 0 | 0.00% | 0 | 0.00% | 0 | 0.00% | 1 |
| 5625 | high mobility group 1-like protein L6 (HMG1L6) r | AF076678.1 | 1 | 0.01% | 0 | 0.00% | 0 | 0.00% | 0 | 0.00% | 1 |
| 5626 | high mobility group box (SSRP1) | M86737 | 1 | 0.01% | 0 | 0.00% | 0 | 0.00% | 0 | 0.00% | 1 |
| 5627 | high mobility group HMGIC/NFIB fusion protein ( | AF022215 | 1 | 0.01% | 0 | 0.00% | 0 | 0.00% | 0 | 0.00% | 1 |
| 5628 | high mobility group-box containing protein 1 (HB | NM_012257.1 | 0 | 0.00% | 0 | 0.00% | 1 | 0.01% | 0 | 0.00% | 1 |
| 5629 | highly charged protein (D13S106E) (=X59131) | gi5031648 | 0 | 0.00% | 0 | 0.00% | 1 | 0.01% | 0 | 0.00% | 1 |
| 5630 | high-mobility group (nonhistone chromosomal) p | XM_028234.1 | 1 | 0.01% | 0 | 0.00% | 0 | 0.00% | 0 | 0.00% | 1 |
| 5631 | high-mobility group phosphoprotein (HMGI-C) | L41044 | 1 | 0.01% | 0 | 0.00% | 0 | 0.00% | 0 | 0.00% | 1 |
| 5632 | high-mobility group phosphoprotein isoform I-C ( | U28754.1 | 1 | 0.01% | 0 | 0.00% | 0 | 0.00% | 0 | 0.00% | 1 |
| 5633 | histone acetylase complex subunit (SPT3) | AF073930.1 | 0 | 0.00% | 0 | 0.00% | 1 | 0.01% | 0 | 0.00% | 1 |
| 5634 | histone H2A.X. | X14850 | 1 | 0.01% | 0 | 0.00% | 0 | 0.00% | 0 | 0.00% | 1 |
| 5635 | hp1-gamma+D2192 Heterochromatin protein 1 g | AB030905 | 0 | 0.00% | 0 | 0.00% | 0 | 0.00% | 1 | 0.01% | 1 |
| 5636 | importin beta subunit | L38951.1 | 0 | 0.00% | 1 | 0.01% | 0 | 0.00% | 0 | 0.00% | 1 |
| 5637 | Nap1 protein (=AB011159 hypothetical protein (I | D84346 | 1 | 0.01% | 0 | 0.00% | 0 | 0.00% | 0 | 0.00% | 1 |
| 5638 | non-histone chromosomal protein (NHC) | U90549.1 | 1 | 0.01% | 0 | 0.00% | 0 | 0.00% | 0 | 0.00% | 1 |
| 5639 | nonhistone protein HMG1 | M21683 | 1 | 0.01% | 0 | 0.00% | 0 | 0.00% | 0 | 0.00% | 1 |
| 5640 | nucleosome assembly protein 2 | U77456 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 100 of 102

| | | | | | | | | | | | |
|---|---|---|---|---|---|---|---|---|---|---|---|
| 5641 | PDNA sequence AC clone 219d7, | AF225899 | 1 | 0.01% | 0 | 0.00% | 0 | 0.00% | 0 | 0.00% | 1 |
| 5642 | pericentriolar material 1 (PCM1), mRNA /cds=(4 | Hs.75737 | 0 | 0.00% | 0 | 0.00% | 0 | 0.00% | 1 | 0.01% | 1 |
| 5643 | RecQ4 DNA helicase | AB006532 | 1 | 0.01% | 0 | 0.00% | 0 | 0.00% | 0 | 0.00% | 1 |
| 5644 | RPA interacting protein alpha (44% ORF) | CAB45690.1 | 0 | 0.00% | 0 | 0.00% | 0 | 0.00% | 1 | 0.01% | 1 |
| 5645 | RTS gene | AF305057.1 | 0 | 0.00% | 1 | 0.01% | 0 | 0.00% | 0 | 0.00% | 1 |
| 5646 | RuvB (E coli homolog)-like 2(RUVBL2) (=erythro | NM_006666.1 | 1 | 0.01% | 0 | 0.00% | 0 | 0.00% | 0 | 0.00% | 1 |
| 5647 | telomeric repeat binding factor 2 (TERF2) | NM_005652.1 | 0 | 0.00% | 0 | 0.00% | 0 | 0.00% | 1 | 0.01% | 1 |
| 5648 | TERF1 (TRF1)-interacting nuclear factor 2 (TINF | XM_033252.1 | 1 | 0.01% | 0 | 0.00% | 0 | 0.00% | 0 | 0.00% | 1 |
| 5649 | TRF2-interacting telomeric RAP1 protein (RAP1 | AF262988.1 | 1 | 0.01% | 0 | 0.00% | 0 | 0.00% | 0 | 0.00% | 1 |
| 5650 | 34 kDa Mov34 homolog | U70735 | 1 | 0.01% | 0 | 0.00% | 0 | 0.00% | 0 | 0.00% | 1 |
| 5651 | BTG family, member 3 (BTG3) | 5802989 | 0 | 0.00% | 0 | 0.00% | 1 | 0.01% | 0 | 0.00% | 1 |
| 5652 | cdk inhibitor p27KIP1 | AY004255.1 | 0 | 0.00% | 1 | 0.01% | 0 | 0.00% | 0 | 0.00% | 1 |
| 5653 | MD-2 protein (MD-2) | NM_015364.1 | 0 | 0.00% | 0 | 0.00% | 0 | 0.00% | 1 | 0.01% | 1 |
| 5654 | M-phase phosphoprotein 4 (MMP4) | NM_012218.1 | 0 | 0.00% | 0 | 0.00% | 1 | 0.01% | 0 | 0.00% | 1 |
| 5655 | OM-1 | X67534 | 0 | 0.00% | 0 | 0.00% | 0 | 0.00% | 1 | 0.01% | 1 |
| 5656 | 200 kD protein | X80169 | 1 | 0.01% | 0 | 0.00% | 0 | 0.00% | 0 | 0.00% | 1 |
| 5657 | 5-azacytidine induced gene 2 (Azi2) | NM_013727.1 | 0 | 0.00% | 0 | 0.00% | 0 | 0.00% | 1 | 0.01% | 1 |
| 5658 | BM-006 | AF208848 | 0 | 0.00% | 0 | 0.00% | 1 | 0.01% | 0 | 0.00% | 1 |
| 5659 | BM-008 | AF208850 | 0 | 0.00% | 1 | 0.01% | 0 | 0.00% | 0 | 0.00% | 1 |
| 5660 | BM-017 (=ALEX3) | AF208859.1 | 0 | 0.00% | 1 | 0.01% | 0 | 0.00% | 0 | 0.00% | 1 |
| 5661 | BM022 mRNA | AF212225.1 | 0 | 0.00% | 1 | 0.01% | 0 | 0.00% | 0 | 0.00% | 1 |
| 5662 | CDC23 (cell division cycle 23, yeast, homolog) ( | NM_004661.1 | 0 | 0.00% | 0 | 0.00% | 0 | 0.00% | 1 | 0.01% | 1 |
| 5663 | CDC37 homologue | U43077 | 1 | 0.01% | 0 | 0.00% | 0 | 0.00% | 0 | 0.00% | 1 |
| 5664 | Cdc7 (CDC7) | AF015592.1 | 0 | 0.00% | 0 | 0.00% | 0 | 0.00% | 1 | 0.01% | 1 |
| 5665 | cdk-inhibitor p57/KIP2 (CDKN1C) (=U22398) | U48869 | 1 | 0.01% | 0 | 0.00% | 0 | 0.00% | 0 | 0.00% | 1 |
| 5666 | cell cycle gene RCC1 | X12654.1 | 0 | 0.00% | 0 | 0.00% | 0 | 0.00% | 1 | 0.01% | 1 |
| 5667 | clk1 | L29219 | 0 | 0.00% | 0 | 0.00% | 0 | 0.00% | 1 | 0.01% | 1 |
| 5668 | cycA gene for cyclin A | X68303.1 | 1 | 0.01% | 0 | 0.00% | 0 | 0.00% | 0 | 0.00% | 1 |
| 5669 | cyclin B | M25753 | 1 | 0.01% | 0 | 0.00% | 0 | 0.00% | 0 | 0.00% | 1 |
| 5670 | cyclin C (CCNC) | NM_005190.2 | 0 | 0.00% | 0 | 0.00% | 1 | 0.01% | 0 | 0.00% | 1 |
| 5671 | cyclin G1 interacting protein | U61837 | 0 | 0.00% | 0 | 0.00% | 1 | 0.01% | 0 | 0.00% | 1 |
| 5672 | cyclin H (CCNH) mRNA | NM_001239.1 | 0 | 0.00% | 0 | 0.00% | 0 | 0.00% | 1 | 0.01% | 1 |
| 5673 | cyclin K (RefSeq aa 5e-62) | NP_003849.1 | 0 | 0.00% | 1 | 0.01% | 0 | 0.00% | 0 | 0.00% | 1 |
| 5674 | cyclin T1 (RefSeq aa 7e-75) | NP_001231.1 | 0 | 0.00% | 1 | 0.01% | 0 | 0.00% | 0 | 0.00% | 1 |
| 5675 | cyclin T2 (CCNT2) | NM_001241.1 | 1 | 0.01% | 0 | 0.00% | 0 | 0.00% | 0 | 0.00% | 1 |
| 5676 | Cyclin-dependent kinase (CDC2-like) 10 (CDK1( | NM_003674.1 | 1 | 0.01% | 0 | 0.00% | 0 | 0.00% | 0 | 0.00% | 1 |
| 5677 | CYCLIN-DEPENDENT KINASES REGULATOR | spP33551 | 0 | 0.00% | 0 | 0.00% | 0 | 0.00% | 1 | 0.01% | 1 |
| 5678 | D-type cyclin-interacting protein 1 (DIP1) | AF082569 | 0 | 0.00% | 0 | 0.00% | 0 | 0.00% | 1 | 0.01% | 1 |
| 5679 | enhancer of zeste (Drosophila) homolog 2 (EZH | NM_004456.1 | 1 | 0.01% | 0 | 0.00% | 0 | 0.00% | 0 | 0.00% | 1 |
| 5680 | Fanconi anemia, complementation group G (FA | NM_004629.1 | 1 | 0.01% | 0 | 0.00% | 0 | 0.00% | 0 | 0.00% | 1 |
| 5681 | GANP protein (=KIAA0572 protein ) | AJ010089.1 | 0 | 0.00% | 1 | 0.01% | 0 | 0.00% | 0 | 0.00% | 1 |
| 5682 | geminin | AF067855.1 | 0 | 0.00% | 0 | 0.00% | 0 | 0.00% | 1 | 0.01% | 1 |
| 5683 | GTP binding protein similar to S. cerevisiae HBS | NM_006620.1 | 1 | 0.01% | 0 | 0.00% | 0 | 0.00% | 0 | 0.00% | 1 |
| 5684 | GTP-binding protein | Z49068 | 0 | 0.00% | 0 | 0.00% | 1 | 0.01% | 0 | 0.00% | 1 |
| 5685 | GTP-binding protein (RAB4) | M28211 | 1 | 0.01% | 0 | 0.00% | 0 | 0.00% | 0 | 0.00% | 1 |
| 5686 | GTP-binding protein (rhoB) | AF098515 | 1 | 0.01% | 0 | 0.00% | 0 | 0.00% | 0 | 0.00% | 1 |
| 5687 | GTP-binding protein (rhoC) (=X05026;L09159) | L25080 | 1 | 0.01% | 0 | 0.00% | 0 | 0.00% | 0 | 0.00% | 1 |
| 5688 | GTP-binding protein alpha q subunit (GNAQ) mF | U40038.1 | 0 | 0.00% | 0 | 0.00% | 1 | 0.01% | 0 | 0.00% | 1 |
| 5689 | GTP-binding protein NGB | AF120334 | 0 | 0.00% | 0 | 0.00% | 0 | 0.00% | 1 | 0.01% | 1 |
| 5690 | GTP-binding protein rah | AF058807 | 0 | 0.00% | 0 | 0.00% | 1 | 0.01% | 0 | 0.00% | 1 |
| 5691 | HARP (HARP) gene | AF210835.1 | 0 | 0.00% | 1 | 0.01% | 0 | 0.00% | 0 | 0.00% | 1 |
| 5692 | HsGAK | D88435 | 1 | 0.01% | 0 | 0.00% | 0 | 0.00% | 0 | 0.00% | 1 |
| 5693 | lodestar protein | AF080255.1 | 1 | 0.01% | 0 | 0.00% | 0 | 0.00% | 0 | 0.00% | 1 |
| 5694 | Mig-6=mitogen-inducible gene mig-6 product | gi1037127 | 0 | 0.00% | 0 | 0.00% | 1 | 0.01% | 0 | 0.00% | 1 |
| 5695 | minichromosome maintenance deficient (mis5, S | NM_005915.2 | 0 | 0.00% | 0 | 0.00% | 1 | 0.01% | 0 | 0.00% | 1 |
| 5696 | Miz-1 protein | Y09723 | 1 | 0.01% | 0 | 0.00% | 0 | 0.00% | 0 | 0.00% | 1 |
| 5697 | myleoid differentiation primary response protein | U70451 | 0 | 0.00% | 0 | 0.00% | 1 | 0.01% | 0 | 0.00% | 1 |

Figure 6 - Unique Known Genes Identified In Four cDNA Cartilage Libraries and EST Frequency Analysis - Page 101 of 102

| | | | | | | | | | | | |
|---|---|---|---|---|---|---|---|---|---|---|---|
| 5698 | NIMA (never in mitosis gene a)-related kinase 6 | NM_014397.1 | 0 | 0.00% | 1 | 0.01% | 0 | 0.00% | 0 | 0.00% | 1 |
| 5699 | nucleolar protein p40 | AAB46731.1 | 0 | 0.00% | 0 | 0.00% | 0 | 0.00% | 1 | 0.01% | 1 |
| 5700 | nucleolin (NCL) (=FLJ20214 fis) | NM_005381.1 | 0 | 0.00% | 0 | 0.00% | 0 | 0.00% | 1 | 0.01% | 1 |
| 5701 | p85Mcm (=D55716 P1cdc47; D28480 hMCM2) | X74796 | 0 | 0.00% | 0 | 0.00% | 1 | 0.01% | 0 | 0.00% | 1 |
| 5702 | PRAD1 cyclin | X59798 | 1 | 0.01% | 0 | 0.00% | 0 | 0.00% | 0 | 0.00% | 1 |
| 5703 | Pseudoautosomal GTP-binding protein-like (PGI | NM_012227.1 | 1 | 0.01% | 0 | 0.00% | 0 | 0.00% | 0 | 0.00% | 1 |
| 5704 | RhoE=26 kda GTPase homolog | S82240 | 1 | 0.01% | 0 | 0.00% | 0 | 0.00% | 0 | 0.00% | 1 |
| 5705 | topoisomerase II alpha-4 (AF285159) | AAG13405.1 | 0 | 0.00% | 1 | 0.01% | 0 | 0.00% | 0 | 0.00% | 1 |
| 5706 | Fas-associated factor, FAF1 (Faf1 gene) | AJ271408.1 | 0 | 0.00% | 0 | 0.00% | 0 | 0.00% | 1 | 0.01% | 1 |
| 5707 | neuronal thread protein AD7c-NTP | NP_055301.1 | 0 | 0.00% | 1 | 0.01% | 0 | 0.00% | 0 | 0.00% | 1 |
| 5708 | neutral sphingomyelinase (N-SMase) activation | gi4505464 | 0 | 0.00% | 0 | 0.00% | 1 | 0.01% | 0 | 0.00% | 1 |
| 5709 | Newcastle disease virus inducible protein | U25276 | 0 | 0.00% | 0 | 0.00% | 0 | 0.00% | 1 | 0.01% | 1 |
| 5710 | APG5 (autophagy 5, S.cerevisiae)-like (APG5L) | NM_004849.1 | 1 | 0.01% | 0 | 0.00% | 0 | 0.00% | 0 | 0.00% | 1 |
| 5711 | apoptosis inhibitor 1 (API1) | NM_001166.1 | 0 | 0.00% | 1 | 0.01% | 0 | 0.00% | 0 | 0.00% | 1 |
| 5712 | apoptosis inhibitor survivin gene, complete cds | U75285.1 | 1 | 0.01% | 0 | 0.00% | 0 | 0.00% | 0 | 0.00% | 1 |
| 5713 | apoptosis related protein APR-3 | AF144055.2 | 0 | 0.00% | 0 | 0.00% | 0 | 0.00% | 1 | 0.01% | 1 |
| 5714 | apoptosis-associated nuclear protein (PHLDA1) | AF239986.1 | 0 | 0.00% | 1 | 0.01% | 0 | 0.00% | 0 | 0.00% | 1 |
| 5715 | Baculoviral IAP repeat-containing 3 (BIRC3)(=inl | NM_001165.2 | 0 | 0.00% | 1 | 0.01% | 0 | 0.00% | 0 | 0.00% | 1 |
| 5716 | Bcl-2-binding protein (BAG-1) | AF022224 | 0 | 0.00% | 0 | 0.00% | 1 | 0.01% | 0 | 0.00% | 1 |
| 5717 | bridging integrator protein-1 (BIN1) gene | U84000.1 | 0 | 0.00% | 1 | 0.01% | 0 | 0.00% | 0 | 0.00% | 1 |
| 5718 | caspase 3, apoptosis-related cysteine protease | NM_004346.1 | 1 | 0.01% | 0 | 0.00% | 0 | 0.00% | 0 | 0.00% | 1 |
| 5719 | caspase 6, apoptosis-related cysteine protease | XP_003600.1 | 0 | 0.00% | 1 | 0.01% | 0 | 0.00% | 0 | 0.00% | 1 |
| 5720 | cell death suppressor (WA1) (=AF049672) | AF000267 | 1 | 0.01% | 0 | 0.00% | 0 | 0.00% | 0 | 0.00% | 1 |
| 5721 | cell recognition molecule Caspr2 (=AB020675 K | AF193613 | 0 | 0.00% | 0 | 0.00% | 1 | 0.01% | 0 | 0.00% | 1 |
| 5722 | death-associated protein kinase 1 (DAPK1) | NM_004938.1 | 0 | 0.00% | 0 | 0.00% | 1 | 0.01% | 0 | 0.00% | 1 |
| 5723 | DRAK1 | AB011420 | 0 | 0.00% | 0 | 0.00% | 1 | 0.01% | 0 | 0.00% | 1 |
| 5724 | dual specificity phosphatase 6, clone MGC:3789 | BC003143.1 | 0 | 0.00% | 0 | 0.00% | 0 | 0.00% | 1 | 0.01% | 1 |
| 5725 | DUSP6 (=X93920 protein-tyrosine-phosphatase) | AB013382.1 | 1 | 0.01% | 0 | 0.00% | 0 | 0.00% | 0 | 0.00% | 1 |
| 5726 | ES18 | AF083930 | 0 | 0.00% | 0 | 0.00% | 1 | 0.01% | 0 | 0.00% | 1 |
| 5727 | Fas-apoptosis inhibitory molecule (Faim) | AF130367.1 | 0 | 0.00% | 0 | 0.00% | 1 | 0.01% | 0 | 0.00% | 1 |
| 5728 | neuronal apoptosis inhibitory protein 6 (Naip6); N | AF242431.1 | 0 | 0.00% | 0 | 0.00% | 0 | 0.00% | 1 | 0.01% | 1 |
| 5729 | neuronal cell death-related protein (LOC51616), | NM_015975.1 | 0 | 0.00% | 0 | 0.00% | 1 | 0.01% | 0 | 0.00% | 1 |
| 5730 | neurotrophin-3 (NT-3) | M37763 | 1 | 0.01% | 0 | 0.00% | 0 | 0.00% | 0 | 0.00% | 1 |
| 5731 | programmed cell death 5(PDCD5),(= TFAR1) | NM_004708.1 | 1 | 0.01% | 0 | 0.00% | 0 | 0.00% | 0 | 0.00% | 1 |
| 5732 | programmed cell death 9 (PDCD9) (ORF) | AF146192 | 0 | 0.00% | 0 | 0.00% | 0 | 0.00% | 1 | 0.01% | 1 |
| 5733 | RIP protein kinase | U50062.1 | 0 | 0.00% | 0 | 0.00% | 0 | 0.00% | 1 | 0.01% | 1 |
| 5734 | seCReted apoptosis related protein 1 (Sarp1) | AF017989 | 0 | 0.00% | 0 | 0.00% | 1 | 0.01% | 0 | 0.00% | 1 |
| 5735 | Siva-2 (ORF) | AF033111 | 1 | 0.01% | 0 | 0.00% | 0 | 0.00% | 0 | 0.00% | 1 |
| 5736 | Kin17 protein | AJ005273.1 | 0 | 0.00% | 1 | 0.01% | 0 | 0.00% | 0 | 0.00% | 1 |
| 5737 | MSSP | D82352 | 1 | 0.01% | 0 | 0.00% | 0 | 0.00% | 0 | 0.00% | 1 |
| 5738 | ATP-DEPENDENT DNA HELICASE II, 80 KDA | spP13010 | 0 | 0.00% | 1 | 0.01% | 0 | 0.00% | 0 | 0.00% | 1 |
| 5739 | DNA fragmentation factor, 45 kD, alpha polypep | NM_004401.1 | 0 | 0.00% | 1 | 0.01% | 0 | 0.00% | 0 | 0.00% | 1 |
| 5740 | DNA polymerase delta | M81735 | 1 | 0.01% | 0 | 0.00% | 0 | 0.00% | 0 | 0.00% | 1 |
| 5741 | DNA replication licensing factor (huMCM2) (=D2 | D83987 | 1 | 0.01% | 0 | 0.00% | 0 | 0.00% | 0 | 0.00% | 1 |
| 5742 | DNA-DIRECTED RNA POLYMERASE II 19 KDA | spP52433 | 0 | 0.00% | 0 | 0.00% | 0 | 0.00% | 1 | 0.01% | 1 |
| 5743 | DNA-DIRECTED RNA POLYMERASES I, II, AN | spP53803 | 0 | 0.00% | 0 | 0.00% | 0 | 0.00% | 1 | 0.01% | 1 |
| 5744 | gene encoding splicing factor SF1 | AJ000052.1 | 0 | 0.00% | 1 | 0.01% | 0 | 0.00% | 0 | 0.00% | 1 |
| 5745 | line-1 reverse transcriptase | AAC51337.1 | 0 | 0.00% | 1 | 0.01% | 0 | 0.00% | 0 | 0.00% | 1 |
| 5746 | meiotic recombination (S. cerevisiae)11 homolo | NP_005582.1 | 0 | 0.00% | 1 | 0.01% | 0 | 0.00% | 0 | 0.00% | 1 |
| 5747 | meiotic recombination protein REC14 | AAG31639.1 | 0 | 0.00% | 1 | 0.01% | 0 | 0.00% | 0 | 0.00% | 1 |
| 5748 | origin recognition complex protein 2 homologue | U27459 | 0 | 0.00% | 0 | 0.00% | 1 | 0.01% | 0 | 0.00% | 1 |
| 5749 | origin recognition complex subunit 4 (ORC4L) (= | AF047598 | 1 | 0.01% | 0 | 0.00% | 0 | 0.00% | 0 | 0.00% | 1 |
| 5750 | origin recognition complex subunit LATHEO (LA | AF093535.1 | 0 | 0.00% | 0 | 0.00% | 1 | 0.01% | 0 | 0.00% | 1 |
| 5751 | origin recognition complex, subunit 3(yeast hom | NP_036513.1 | 0 | 0.00% | 1 | 0.01% | 0 | 0.00% | 0 | 0.00% | 1 |
| 5752 | polymerase (RNA) II (DNA directed) polypeptide | NM_000937.1 | 0 | 0.00% | 0 | 0.00% | 0 | 0.00% | 1 | 0.01% | 1 |
| 5753 | polymerase (RNA) II (DNA directed) polypeptide | NM_002694.1 | 0 | 0.00% | 1 | 0.01% | 0 | 0.00% | 0 | 0.00% | 1 |
| 5754 | polymerase (RNA) II (DNA directed) polypeptide | NM_002695.1 | 1 | 0.01% | 0 | 0.00% | 0 | 0.00% | 0 | 0.00% | 1 |

Figure 6 - Unique Known Genes Identified In Four cDNA Cartilage Libraries and EST Frequency Analysis - Page 102 of 102

| | | | | | | | | | | | |
|---|---|---|---|---|---|---|---|---|---|---|---|
| 5755 | polymerase (RNA) II (DNA directed) polypeptide | NM_006233.2 | 1 | 0.01% | 0 | 0.00% | 0 | 0.00% | 0 | 0.00% | 1 |
| 5756 | polymerase (RNA) III (DNA directed) (39kD) (RP | NM_006466.1 | 1 | 0.01% | 0 | 0.00% | 0 | 0.00% | 0 | 0.00% | 1 |
| 5757 | polymerase II subunit hsRPB4 | U89387 | 1 | 0.01% | 0 | 0.00% | 0 | 0.00% | 0 | 0.00% | 1 |
| 5758 | primase, polypeptide 1(49kD) (PRIM1)(= (subun | NM_000946.1 | 1 | 0.01% | 0 | 0.00% | 0 | 0.00% | 0 | 0.00% | 1 |
| 5759 | replication factor C, 40-kDa subunit (A1) (=AF04 | M87338 | 1 | 0.01% | 0 | 0.00% | 0 | 0.00% | 0 | 0.00% | 1 |
| 5760 | reverse transcriptase (non-exact) | AAB02291.1 | 0 | 0.00% | 1 | 0.01% | 0 | 0.00% | 0 | 0.00% | 1 |
| 5761 | BAF60b | AF068245 | 1 | 0.01% | 0 | 0.00% | 0 | 0.00% | 0 | 0.00% | 1 |
| 5762 | binding protein(SRM300)(= HSPC075)(= splicin | NM_016333.1 | 0 | 0.00% | 0 | 0.00% | 1 | 0.01% | 0 | 0.00% | 1 |
| 5763 | budding uninhibited by benzimidazoles 1 (yeast | NM_001211.2 | 1 | 0.01% | 0 | 0.00% | 0 | 0.00% | 0 | 0.00% | 1 |
| 5764 | anaphase-promoting complex subunit 7 (APC7) | AF191340.1 | 0 | 0.00% | 0 | 0.00% | 0 | 0.00% | 1 | 0.01% | 1 |
| 5765 | BCL2-associated athanogene 2 (BAG2) | NM_004282.2 | 0 | 0.00% | 0 | 0.00% | 1 | 0.01% | 0 | 0.00% | 1 |
| 5766 | CDEI binding protein | Z22572.1 | 0 | 0.00% | 1 | 0.01% | 0 | 0.00% | 0 | 0.00% | 1 |
| 5767 | cell division protein (=AJ005892 JM23 protein) | AF063015 | 0 | 0.00% | 0 | 0.00% | 0 | 0.00% | 1 | 0.01% | 1 |
| 5768 | cytosolic adenylate kinase (AK1) | J04809 | 1 | 0.01% | 0 | 0.00% | 0 | 0.00% | 0 | 0.00% | 1 |
| 5769 | D9 splice variant A | U95006 | 1 | 0.01% | 0 | 0.00% | 0 | 0.00% | 0 | 0.00% | 1 |
| 5770 | disabled (Drosophila) homolog 1 (DAB1) | NM_021080.1 | 0 | 0.00% | 1 | 0.01% | 0 | 0.00% | 0 | 0.00% | 1 |
| 5771 | discs, large (Drosophila) homolog 1 (DLG1) | gi4758161 | 0 | 0.00% | 0 | 0.00% | 0 | 0.00% | 1 | 0.01% | 1 |
| 5772 | D-prohibitin | AF178980 | 1 | 0.01% | 0 | 0.00% | 0 | 0.00% | 0 | 0.00% | 1 |
| 5773 | hERV1 | U31176 | 1 | 0.01% | 0 | 0.00% | 0 | 0.00% | 0 | 0.00% | 1 |
| 5774 | hevin like protein =high endothelial venule (ORF | X82157 | 0 | 0.00% | 0 | 0.00% | 1 | 0.01% | 0 | 0.00% | 1 |
| 5775 | Murr2 (=AB018272 KIAA0729) | D85434 | 0 | 0.00% | 0 | 0.00% | 1 | 0.01% | 0 | 0.00% | 1 |
| 5776 | Notch2 | D32210.1 | 0 | 0.00% | 1 | 0.01% | 0 | 0.00% | 0 | 0.00% | 1 |
| 5777 | progestin induced protein (RefSeq aa 6e-32) | NP_056986.1 | 0 | 0.00% | 1 | 0.01% | 0 | 0.00% | 0 | 0.00% | 1 |
| 5778 | prohibitin (PHB) | NM_002634.2 | 0 | 0.00% | 0 | 0.00% | 1 | 0.01% | 0 | 0.00% | 1 |
| 5779 | proliferating cell nuclear antigen (PCNA), mRNA | Hs.78996 | 0 | 0.00% | 0 | 0.00% | 0 | 0.00% | 1 | 0.01% | 1 |
| 5780 | proliferation potential-related protein | AF352051.1 | 1 | 0.01% | 0 | 0.00% | 0 | 0.00% | 0 | 0.00% | 1 |
| 5781 | proto-oncogene (Wnt-5a) | L20861.1 | 0 | 0.00% | 0 | 0.00% | 0 | 0.00% | 1 | 0.01% | 1 |
| 5782 | RFG | X77548.1 | 0 | 0.00% | 0 | 0.00% | 1 | 0.01% | 0 | 0.00% | 1 |
| 5783 | SEPTIN 6 type II (SEPTIN6) mRNA, complete c | AF403059.1 | 1 | 0.01% | 0 | 0.00% | 0 | 0.00% | 0 | 0.00% | 1 |
| 5784 | tumor endothelial marker 7 precursor (aa 3e-13) | NP_065138.1 | 0 | 0.00% | 1 | 0.01% | 0 | 0.00% | 0 | 0.00% | 1 |
| 5785 | tumor neCRosis factor receptor 2 (TNFR2) | U52165 | 0 | 0.00% | 0 | 0.00% | 1 | 0.01% | 0 | 0.00% | 1 |
| 5786 | tumor necrosis factor type 1 receptor associated | NM_016292.1 | 1 | 0.01% | 0 | 0.00% | 0 | 0.00% | 0 | 0.00% | 1 |
| 5787 | tumor necrosis factor type 2 receptor associated | U12597.1 | 1 | 0.01% | 0 | 0.00% | 0 | 0.00% | 0 | 0.00% | 1 |
| 5788 | tumor necrosis factor(ligand) superfamily, memb | NM_003809.1 | 0 | 0.00% | 0 | 0.00% | 0 | 0.00% | 1 | 0.01% | 1 |
| 5789 | tumor necrosis factor, alpha-induced protein 1 (e | NM_021137.1 | 0 | 0.00% | 1 | 0.01% | 0 | 0.00% | 0 | 0.00% | 1 |
| 5790 | tumor necrosis factor, alpha-induced protein 3 (T | NM_006290.1 | 0 | 0.00% | 0 | 0.00% | 0 | 0.00% | 1 | 0.01% | 1 |
| 5791 | tumor protein D52-like 2 (TPD52L2) | NM_003288.1 | 1 | 0.01% | 0 | 0.00% | 0 | 0.00% | 0 | 0.00% | 1 |
| 5792 | tumor protein p53-binding protein, 2 (TP53BP2) | NM_005426.1 | 0 | 0.00% | 0 | 0.00% | 0 | 0.00% | 1 | 0.01% | 1 |
| 5793 | tumor suppressing subtransferable candidate 1 ( | NM_003310.1 | 1 | 0.01% | 0 | 0.00% | 0 | 0.00% | 0 | 0.00% | 1 |
| 5794 | tumor susceptibility gene 101 (RefSeq aa 2e-61) | NP_006283.1 | 0 | 0.00% | 1 | 0.01% | 0 | 0.00% | 0 | 0.00% | 1 |
| 5795 | raf oncogene | X03484 | 0 | 0.00% | 0 | 0.00% | 0 | 0.00% | 1 | 0.01% | 1 |
| 5796 | mitochondrial precursor receptor (=D13641 Hum | D63411 | 1 | 0.01% | 0 | 0.00% | 0 | 0.00% | 0 | 0.00% | 1 |
| 5797 | mannan-binding lectin-associated serine proteas | X98400.1 | 0 | 0.00% | 0 | 0.00% | 0 | 0.00% | 1 | 0.01% | 1 |
| 5798 | T cell-activating protein (HRF20) | M27909 | 0 | 0.00% | 0 | 0.00% | 0 | 0.00% | 1 | 0.01% | 1 |
| 5799 | ragB protein | X90530 | 0 | 0.00% | 0 | 0.00% | 0 | 0.00% | 1 | 0.01% | 1 |
| 5800 | mitochondrial F1Fo-ATPase synthase f subunit | AF047436 | 0 | 0.00% | 0 | 0.00% | 0 | 0.00% | 1 | 0.01% | 1 |
| 5801 | actinin, alpha 4 (H. sapiens) (LOC126227) | XM_059002.1 | 1 | 0.01% | 0 | 0.00% | 0 | 0.00% | 0 | 0.00% | 1 |
| 5802 | SH3 domain binding glutamic acid-rich protein (S | XM_049754.1 | 1 | 0.01% | 0 | 0.00% | 0 | 0.00% | 0 | 0.00% | 1 |
| 5803 | fetal liver cDNA library Homo sapiens cDNA | AI174701.1 | 1 | 0.01% | 0 | 0.00% | 0 | 0.00% | 0 | 0.00% | 1 |
| 5804 | FSHD region gene 1 (RefSeq aa 7e-36) | NP_004468.1 | 0 | 0.00% | 1 | 0.01% | 0 | 0.00% | 0 | 0.00% | 1 |
| 5805 | glycoprotein (transmembrane) nmb (GPNMB), m | Hs#S1731822 | 0 | 0.00% | 0 | 0.00% | 0 | 0.00% | 1 | 0.01% | 1 |
| 5806 | apurinic/apyrimidinic endonuclease(APEX nucle | NM_014481.1 | 1 | 0.01% | 0 | 0.00% | 0 | 0.00% | 0 | 0.00% | 1 |
| 5807 | glutamine-fructose-6-phosphate transaminase 1 | NM_002056.1 | 0 | 0.00% | 0 | 0.00% | 0 | 0.00% | 1 | 0.01% | 1 |

Figure 6A – EST Names Corresponding to Unique Known Genes of Figure 6

1. alpha gene sequence (=HSP90) AF203815.1 1560

| | | | | | | | | | |
|---|---|---|---|---|---|---|---|---|---|
| ncrc6517 | ncrc5859 | MIOA1269 | MIOA3021a | MIOA5069a | mioa7731a | mioa9659n | miob1344 | miob3091 |
| ncrc6624 | ncrc6408 | MIOA1347a | MIOA3028a | MIOA5105a | mioa7856 | mioa9668 | miob1376 | miob3097 |
| ncrc5747 | ncrc6727 | MIOA1381a | MIOA3039a | MIOA5118a | MIOA7988a | mioa9688 | miob1454 | miob3125 |
| ncrc5725 | ncrc7054 | MIOA1402a | MIOA3123a | MIOA5151a | MIOA7993a | mioa9694 | miob1457 | miob3181 |
| ncrc6233 | ncrc6904 | MIOA1406a | MIOA3154a | MIOA5195a | MIOA8009a | mioa9737 | MIOB1491 | miob3188 |
| ncrc7150 | ncrc6971 | MIOA1407a | MIOA3166a | MIOA5449a | MIOA8022a | mioa9758 | MIOB1498 | miob3190 |
| ncrc6706 | ncrc6773 | MIOA1415 | MIOA3189a | MIOA5546a | MIOA8025a | mioa9775 | MIOB1553 | miob3193 |
| ncrc7164 | ncrc6886 | MIOA1419 | MIOA3372a | MIOA5562a | MIOA8057a | mioa9852 | MIOB1554 | miob3201 |
| ncrc7111 | CR0444 | MIOA1422 | MIOA3422a | MIOA5644a | MIOA8100 | mioa9869 | MIOB1565 | miob3202 |
| ncrc3534 | FCR5216 | MIOA1428 | MIOA3435a | MIOA5650 | MIOA8154 | mioa9872 | miob1777 | miob3206 |
| ncrc3651 | fcrb1838 | MIOA1567 | MIOA3444a | MIOA5699 | MIOA8218 | mioa9889 | miob1850n | miob3220 |
| ncrc2277 | fcrb2577 | MIOA1583 | MIOA3465a | mioa5711n | MIOA8237 | mioa9899 | miob1875 | miob3228 |
| ncrc2551 | hfcr0495 | MIOA1611a | MIOA3522a | MIOA5759a | MIOA8469 | mioa9900 | miob1881 | miob3263 |
| ncrc4128 | hfcr2686 | MIOA1639a | MIOA3523a | MIOA5788a | MIOA8497 | mioa9902 | miob1891 | miob3287 |
| ncrc4187 | hfcr3457 | MIOA1651a | MIOA3555a | MIOA5802a | MIOA8535 | mioa9918 | miob1905 | miob3289 |
| ncrc3945 | hfcr3502 | MIOA1696a | MIOA3586a | MIOA5809a | MIOA8563 | mioa9934 | miob1919 | miob3366 |
| ncrc4202 | hfcr5094 | MIOA1707a | MIOA3667 | MIOA5821a | MIOA8573 | mioa9948 | miob1957 | miob3369 |
| ncrc4427 | hfcr5772 | MIOA1741 | MIOA3690a | MIOA5875a | MIOA8620 | mioa9980 | miob1958 | miob3392 |
| ncrc4625 | hfcr7350 | MIOA1784 | MIOA3705a | MIOA5878a | MIOA8723 | miob0002 | miob1968 | miob3402 |
| ncrc4641 | MIOA0002a | MIOA1801m | MIOA3781 | MIOA5880a | MIOA8758 | miob0132 | MIOB2130 | miob3412 |
| ncrc4657 | MIOA0028a | MIOA1866a | MIOA3885a | MIOA5943a | MIOA8793 | miob0159 | MIOB2137 | miob3423 |
| ncrc4611 | MIOA0036a | MIOA1999n | MIOA3901a | MIOA5944a | MIOA8833 | miob0198 | MIOB2150 | miob3435 |
| ncrc4417 | MIOA0047a | MIOA2078 | MIOA3922a | MIOA6014a | MIOA8834 | miob0220 | miob2365 | miob3459 |
| ncrc4556 | MIOA0127 | MIOA2100 | MIOA3973a | MIOA6061a | MIOA8875 | miob0222 | miob2433 | miob3467 |
| ncrc5118 | MIOA0186 | MIOA2120 | MIOA4006a | MIOA6062 | MIOA8882 | miob0235 | miob2434 | miob3469 |
| ncrc4803 | MIOA0191n | MIOA2159a | MIOA4025a | MIOA6092 | MIOA8885 | miob0260 | miob2480 | miob3507 |
| ncrc4968 | MIOA0198a | MIOA2201a | MIOA4067a | MIOA6095a | MIOA8889 | miob0288 | miob2494 | miob3537 |
| ncrc5111 | MIOA0199a | MIOA2206a | MIOA4105 | MIOA6098a | MIOA8901 | miob0357 | MIOB2570 | miob3558 |
| ncrc4913 | MIOA0208a | MIOA2212a | MIOA4227 | MIOA6157a | MIOA8911 | miob0365 | MIOB2585 | miob3627 |
| ncrc4927 | MIOA0226a | MIOA2233a | MIOA4239 | MIOA6166a | MIOA8940 | miob0581 | MIOB2605 | miob3687 |
| ncrc4268 | MIOA0254a | MIOA2258a | MIOA4243 | MIOA6167a | MIOA8941 | miob0627 | MIOB2611 | miob3692 |
| ncrc4751 | MIOA0259 | MIOA2280a | MIOA4253 | MIOA6175a | MIOA8954 | miob0642 | MIOB2616 | miob3722 |
| ncrc4249 | MIOA0262 | MIOA2389a | MIOA4274 | MIOA6181a | MIOA8967 | miob0658 | MIOB2621 | miob3752 |
| ncrc4774 | MIOA0290 | MIOA2411a | MIOA4315a | MIOA6402a | MIOA8974 | miob0721 | MIOB2675 | miob3765 |
| ncrc4276 | MIOA0292 | MIOA2433a | MIOA4337a | MIOA6459a | MIOA8991 | miob0742 | MIOB2692 | miob3777 |
| ncrc5278 | MIOA0298n | MIOA2518a | MIOA4347a | MIOA6466a | MIOA8995 | miob0751 | MIOB2698 | miob3844 |
| ncrc4784 | MIOA0416a | MIOA2524a | MIOA4420 | MIOA6478a | MIOA8996 | miob0759 | MIOB2717 | miob3870 |
| ncrc5236 | MIOA0418a | MIOA2529a | MIOA4423 | MIOA6533a | MIOA9001 | miob0805 | MIOB2720 | miob3914 |
| ncrc4769 | MIOA0505n | MIOA2590a | MIOA4425 | MIOA6712a | MIOA9027 | miob0814 | MIOB2727 | miob3930 |
| ncrc4730 | MIOA0522 | MIOA2591a | MIOA4527a | MIOA6749a | MIOA9049 | miob0830 | MIOB2728 | miob3964 |
| ncrc5406 | mioa0568 | MIOA2602a | MIOA4541a | MIOA6759a | MIOA9114 | miob0843 | MIOB2787 | miob3966 |
| ncrc5497 | mioa0709m | MIOA2613a | MIOA4599a | MIOA6775a | MIOA9174 | miob0848n | MIOB2808 | miob3987 |
| ncrc5480 | MIOA0710 | MIOA2617a | MIOA4620a | MIOA6777a | mioa9232 | miob0869 | MIOB2849 | miob3988 |
| ncrc5319 | MIOA0725 | mioa2638m | MIOA4660a | MIOA6802a | mioa9238 | miob0889 | MIOB2867 | miob4012 |
| ncrc5612 | MIOA0746 | MIOA2689a | MIOA4675 | MIOA6844a | mioa9292 | miob1014 | miob2886 | miob4029 |
| ncrc5305 | MIOA0827 | MIOA2770a | MIOA4703 | MIOA6877a | mioa9302 | miob1034 | miob2898 | miob4045 |
| ncrc5599 | MIOA0837a | MIOA2810a | MIOA4728 | MIOA7084a | mioa9306 | miob1073 | miob2919 | miob4049 |
| ncrc5945 | MIOA0888a | MIOA2823a | MIOA4781a | MIOA7111a | mioa9322 | miob1089 | miob2929 | miob4066 |
| ncrc5969 | MIOA0956 | MIOA2826a | MIOA4815a | MIOA7138a | mioa9342 | miob1090 | miob2931 | miob4098 |
| ncrc5968 | MIOA0975n | MIOA2874a | MIOA4828a | MIOA7182a | mioa9415 | miob1092 | miob2945 | miob4128 |
| ncrc6286 | MIOA1005 | MIOA2878a | MIOA4894a | MIOA7227a | mioa9497 | miob1097n | miob2958 | miob4138 |
| ncrc6032 | mioa1043m | MIOA2885a | MIOA4906a | MIOA7286 | mioa9534 | miob1100 | miob2969 | miob4141 |
| ncrc6429 | MIOA1206 | MIOA2888a | MIOA4942a | MIOA7363a | mioa9574 | miob1108 | miob2984 | miob4158 |
| ncrc6300 | MIOA1210 | MIOA2889a | MIOA4995a | MIOA7368a | mioa9584 | miob1140 | miob2991 | miob4165 |
| ncrc6400 | MIOA1229 | MIOA2931a | MIOA5012a | MIOA7430a | mioa9597 | miob1226 | miob3051 | miob4185 |
| ncrc5893 | MIOA1262n | MIOA2944a | MIOA5024a | MIOA7437a | mioa9621 | miob1304 | miob3064 | miob4206 |
| ncrc6269 | MIOA1268 | MIOA2959a | MIOA5042a | MIOA7539a | mioa9622 | miob1312 | miob3073 | miob4212 |

Figure 6A – EST Names Corresponding to Unique Known Genes of Figure 6

| | | | | | | | | |
|---|---|---|---|---|---|---|---|---|
| miob4214 | miob5116 | miob6538 | ncr1851 | ncr4537 | ncr6260 | ncr9214 | ncrb1759 | ncrb6509 |
| miob4226 | miob5451 | miob6573 | ncr1889 | ncr4580 | ncr6306 | ncr9282 | ncrb1886 | ncrb6540 |
| miob4231 | miob5458 | miob6590 | ncr1892 | ncr4598 | ncr6383 | ncr9332 | ncrb1887 | ncrb6565 |
| miob4257 | miob5459 | miob6621 | ncr1951 | ncr4600 | ncr6385 | ncr9361 | ncrb1893 | ncrb6593 |
| miob4265 | miob5460 | miob6623 | ncr2054 | ncr4609 | ncr6398 | ncr9393 | ncrb1913 | ncrb6735 |
| miob4295 | miob5464 | miob6699 | ncr2283 | ncr4619 | ncr6402 | ncr9458 | ncrb1924 | ncrb6741 |
| miob4296 | miob5469 | miob6720 | ncr2294 | ncr4655 | ncr6588 | ncr9480 | ncrb2072 | ncrb6809 |
| miob4303 | miob5615 | miob6785 | ncr2478 | ncr4682 | ncr6608 | ncr9485 | ncrb2096 | ncrb6840 |
| miob4323 | miob5622 | miob6798 | ncr2483 | ncr4702 | ncr6659 | ncr9498 | ncrb2189 | ncrb6848 |
| miob4342 | miob5640 | miob6806 | ncr2503 | ncr4742 | ncr6664 | ncr9500 | ncrb2204 | ncrb6859 |
| miob4365 | miob5673 | miob6807 | ncr2584 | ncr4770 | ncr6694 | ncr9511 | ncrb2336 | ncrb6864 |
| miob4371 | miob5710 | miob6826 | ncr2596 | ncr4789 | ncr6917 | ncr9519 | ncrb2480 | ncrb6892 |
| miob4404 | miob5719 | miob6838 | ncr2620 | ncr4856 | ncr6958 | ncr9527 | ncrb2492 | ncrb6899 |
| miob4410 | miob5725 | miob6854 | ncr2642 | ncr4864 | ncr7056 | ncr9537 | ncrb2568 | ncrb7061 |
| miob4434 | miob5729 | miob6886 | ncr2643 | ncr4883 | ncr7074 | ncr9557 | ncrb2601 | ncrb7106 |
| miob4443 | miob5743 | miob6894 | ncr2829 | ncr4916 | ncr7159 | ncr9564 | ncrb2677 | ncrb7159 |
| miob4447 | miob5750 | miob6907 | ncr2855 | ncr4917 | ncr7234 | ncr9580 | ncrb2796 | ncrb7180 |
| miob4467 | miob5757 | miob6909 | ncr2955 | ncr4920 | ncr7254 | ncr9598 | ncrb2800 | ncrb7208 |
| miob4492 | miob5782 | miob6916 | ncr3000 | ncr4930 | ncr7263 | ncr9621 | ncrb2817 | ncrb7241 |
| miob4506 | miob5801 | miob6917 | ncr3085 | ncr4944 | ncr7276 | ncr9695 | ncrb3054 | ncrb7242 |
| miob4507 | miob5817 | miob6920 | ncr3103 | ncr4953 | ncr7289 | ncr9713 | ncrb3143 | ncrb7248 |
| miob4511 | miob5850 | miob6934 | ncr3158 | ncr4999 | ncr7334 | ncr9723 | ncrb3152 | ncrb7351 |
| miob4520 | miob5851 | miob6938 | ncr3220 | ncr5113 | ncr7352 | ncr9725 | ncrb3165 | ncrb7379 |
| miob4521 | miob5896 | ncr0023 | ncr3223 | ncr5127 | ncr7389 | ncr9746 | ncrb3302 | ncrb7396 |
| miob4555 | miob5899 | ncr0028 | ncr3259 | ncr5150 | ncr7390 | ncr9750 | ncrb3522 | ncrb7400 |
| miob4622 | miob5906 | ncr0198 | ncr3322 | ncr5157 | ncr7392 | ncr9765 | ncrb3604 | ncrb7450 |
| miob4623 | miob5907 | ncr0201 | ncr3333 | ncr5161 | ncr7468 | ncr9974 | ncrb3770 | ncrb7469 |
| miob4633 | miob5911 | ncr0209 | ncr3350 | ncr5179 | ncr7485 | ncrb0048 | ncrb3848 | ncrb7536 |
| miob4644 | miob5928 | ncr0215 | ncr3375 | ncr5227 | ncr7486 | ncrb0104 | ncrb3861 | ncrb7647 |
| miob4649 | miob5934 | ncr0233 | ncr3456 | ncr5285 | ncr7511 | ncrb0111 | ncrb4165 | ncrb7654 |
| miob4659 | miob5942 | ncr0312 | ncr3477 | ncr5323 | ncr7513 | ncrb0186 | ncrb4204 | ncrb7728 |
| miob4671 | miob5951 | ncr0331 | ncr3490 | ncr5338 | ncr7564 | ncrb0212 | ncrb4207 | ncrb7737 |
| miob4685 | miob5955 | ncr0333 | ncr3589 | ncr5436 | ncr7643 | ncrb0305 | ncrb4253 | ncrb7770 |
| miob4699 | miob5974 | ncr0338 | ncr3631 | ncr5444 | ncr7705 | ncrb0308 | ncrb4525 | ncrb7801 |
| miob4709 | miob5976 | ncr0392 | ncr3697 | ncr5446 | ncr7711 | ncrb0324 | ncrb4675 | ncrb7987 |
| miob4740 | miob5982 | ncr0404 | ncr3745 | ncr5536 | ncr7724 | ncrb0656 | ncrb4708 | ncrb8025 |
| miob4753 | miob5985 | ncr0427 | ncr3767 | ncr5543 | ncr7731 | ncrb0660 | ncrb4836 | ncrb8047 |
| miob4759 | miob5986 | ncr0442 | ncr3824 | ncr5558 | ncr7816 | ncrb0706 | ncrb4945 | ncrb8097 |
| miob4762 | miob5988 | ncr0500 | ncr3847 | ncr5573 | ncr7909 | ncrb0716 | ncrb4958 | ncrb8190 |
| miob4772 | miob5992 | ncr0522 | ncr3900 | ncr5597 | ncr7912 | ncrb0759 | ncrb4981 | ncrb8223 |
| miob4778 | miob6002 | ncr0618 | ncr3919 | ncr5629 | ncr8031 | ncrb0783 | ncrb5187 | ncrb8300 |
| miob4780 | miob6004 | ncr0656 | ncr3941 | ncr5631 | ncr8058 | ncrb1123 | ncrb5189 | ncrb8410 |
| miob4801 | miob6009 | ncr0739 | ncr3987 | ncr5695 | ncr8216 | ncrb1235 | ncrb5251 | ncrb8439 |
| miob4891 | miob6035 | ncr0914 | ncr3995 | ncr5714 | ncr8292 | ncrb1245 | ncrb5275 | ncrb8563 |
| miob4893 | miob6091 | ncr0928 | ncr4010 | ncr5750 | ncr8346 | ncrb1255 | ncrb5428 | ncrb8565 |
| miob4924 | miob6104 | ncr0931 | ncr4039 | ncr5753 | ncr8560 | ncrb1300 | ncrb5551 | ncrb8611 |
| miob4938 | miob6109 | ncr0948 | ncr4069 | ncr5787 | ncr8602 | ncrb1348 | ncrb5603 | ncrb8655 |
| miob4954 | miob6134 | ncr0963 | ncr4083 | ncr5793 | ncr8630 | ncrb1394 | ncrb5642 | ncrb8785 |
| miob4959 | miob6146 | ncr0968 | ncr4092 | ncr5797 | ncr8647 | ncrb1429 | ncrb5673 | ncrc0035 |
| miob4983 | miob6170 | ncr1032 | ncr4109 | ncr5808 | ncr8708 | ncrb1432 | ncrb5791 | ncrc0159 |
| miob4987 | miob6247 | ncr1217 | ncr4217 | ncr5854 | ncr8730 | ncrb1487 | ncrb5812 | ncrc0236 |
| miob4988 | miob6248 | ncr1251 | ncr4347 | ncr5915 | ncr8793 | ncrb1506 | ncrb5921 | ncrc0243 |
| miob5014 | miob6259 | ncr1274 | ncr4363 | ncr5969 | ncr8844 | ncrb1530 | ncrb5947 | ncrc0253 |
| miob5026 | miob6305 | ncr1323 | ncr4365 | ncr6013 | ncr8919 | ncrb1533 | ncrb5983 | ncrc0261 |
| miob5048 | miob6344 | ncr1376 | ncr4367 | ncr6023 | ncr8961 | ncrb1600 | ncrb5994 | ncrc0263 |
| miob5055 | miob6396 | ncr1410 | ncr4374 | ncr6104 | ncr9049 | ncrb1664 | ncrb6107 | ncrc0272 |
| miob5061 | miob6400 | ncr1605 | ncr4376 | ncr6143 | ncr9063 | ncrb1676 | ncrb6111 | ncrc0297 |
| miob5067 | miob6426 | ncr1622 | ncr4388 | ncr6152 | ncr9070 | ncrb1697 | ncrb6259 | ncrc0318 |
| miob5072 | miob6475 | ncr1719 | ncr4400 | ncr6226 | ncr9079 | ncrb1698 | ncrb6330 | ncrc0351 |
| miob5110 | miob6505 | ncr1817 | ncr4404 | ncr6235 | ncr9082 | ncrb1756 | ncrb6501 | ncrc0367 |

Figure 6A – EST Names Corresponding to Unique Known Genes of Figure 6

| | | | | | | | | |
|---|---|---|---|---|---|---|---|---|
| ncrc0391 | ncrc3334 | SEOA1096a | SEOA4142a | SEOA7514a | SEOB0895a | SEOB3582 | seob5262 | seob6864 |
| ncrc0399 | ncrc3454 | SEOA1140a | SEOA4183a | SEOA7585a | SEOB0973 | SEOB3587 | seob5274 | seob6898 |
| ncrc0446 | ncrc3505 | SEOA1164A | SEOA4218a | seoa7967 | SEOB1020 | seob3658 | seob5282 | seob6899 |
| ncrc0456 | ncrc3772 | SEOA1196A | SEOA4335a | SEOA8308a | SEOB1034 | seob3683 | seob5295 | seob6904 |
| ncrc0521 | ncrc3873 | SEOA1252A | SEOA4348a | SEOA8430 | seob1036 | seob3711 | seob5300 | seob7036 |
| ncrc0550 | ncrc4014 | SEOA1311a | SEOA4355a | SEOA8454 | SEOB1094 | seob3714 | seob5312 | seob7040 |
| ncrc0561 | ncrc4020 | SEOA1459a | seoa4367an | SEOA8455 | SEOB1099 | seob3719 | seob5322 | seob7058 |
| ncrc0595 | ncrc4381 | SEOA1488 | SEOA4481 | SEOA8508 | SEOB1109 | seob3729 | seob5325 | seob7079 |
| ncrc0670 | ncrc4670 | SEOA1510 | SEOA4516 | SEOA8611 | SEOB1112 | seob3843 | seob5343 | seob7152 |
| ncrc0763 | ncrc5067 | SEOA1528 | SEOA4559 | SEOA8720 | SEOB1137 | seob3857 | seob5369 | seob7193 |
| ncrc0765 | ncrc5208 | SEOA1537 | SEOA4569 | SEOA8745 | SEOB1138 | seob3860 | seob5430 | seob7293 |
| ncrc0848 | ncrc5819 | SEOA1607a | SEOA4582 | SEOA8764 | SEOB1203 | seob3877 | seob5432 | seob7297 |
| ncrc0944 | ncrc5910 | SEOA1650a | SEOA4591 | SEOA8766 | SEOB1223 | seob3885 | seob5437 | seob7315 |
| ncrc0951 | ncrc6356 | SEOA1713a | SEOA4619a | SEOA8767 | SEOB1289 | seob3913 | seob5462 | seob7335 |
| ncrc1012 | ncrc6881 | SEOA1774a | SEOA4663a | SEOA8792 | SEOB1431 | seob3924 | seob5492 | seob7365 |
| ncrc1020 | ncrc7195 | SEOA1876a | SEOA4695a | SEOA8797 | SEOB1450 | seob3933 | seob5527 | seob7382 |
| ncrc1024 | ncrc8965 | SEOA1911n | SEOA5052a | SEOA8831 | SEOB1600 | seob3946 | seob5563 | seob7388 |
| ncrc1092 | ncrc8977 | SEOA1953 | SEOA5111a | SEOA8859 | SEOB1706 | seob3976 | seob5566 | seob7400 |
| ncrc1115 | ncrc8992 | SEOA2011 | SEOA5255a | SEOA8903 | SEOB1738 | seob4006 | seob5573 | seob7408 |
| ncrc1208 | ncrc9005 | SEOA2150 | SEOA5329a | SEOA8917 | SEOB1741 | seob4009 | seob5597 | seob7449 |
| ncrc1211 | ncrc9009 | SEOA2159n | SEOA5389 | SEOA8926 | SEOB1794 | seob4028 | seob5638 | seob7539 |
| ncrc1285 | ncrc9105 | SEOA2176 | SEOA5462 | SEOA8974 | SEOB1831 | seob4042 | seob5735 | seob7593 |
| ncrc1307 | ncrc9119 | SEOA2186a | SEOA5476a | SEOA9095 | SEOB1918 | seob4061 | seob5749 | seob7640 |
| ncrc1330 | ncrc9179 | SEOA2257a | SEOA5517a | SEOA9096 | SEOB1937 | seob4066 | seob5758 | seob7642 |
| ncrc1508 | ncrc9205 | SEOA2290a | SEOA5531a | SEOA9162 | SEOB2026 | seob4078 | seob5781 | seob7646 |
| ncrc1582 | ncrc9218 | SEOA2304a | SEOA5663a | SEOA9267 | SEOB2112 | seob4104 | seob5828 | seob7651 |
| ncrc1632 | ncrc9233 | SEOA2333a | SEOA5729a | SEOA9336 | SEOB2187 | seob4141 | seob5853 | seob7659 |
| ncrc1639 | ncrc9325 | seoa2412n | SEOA5735a | SEOA9378 | SEOB2220 | seob4183 | seob5865 | seob7678 |
| ncrc1845 | ncrc9403 | seoa2510m | SEOA5752a | SEOA9547 | SEOB2267 | seob4190 | seob5878 | seob7679 |
| ncrc1853 | ncrc9420 | SEOA2530 | SEOA5761 | SEOA9554 | SEOB2288 | seob4274 | seob5879 | seob7687 |
| ncrc1991 | ncrc9429 | SEOA2544 | SEOA5779 | SEOA9584 | seob2316 | seob4327 | seob5925 | seob7701 |
| ncrc2013 | ncrc9447 | SEOA2546 | SEOA5783 | SEOA9625 | seob2544 | seob4448 | seob5943 | seob7707 |
| ncrc2112 | ncrc9480 | seoa2650n | SEOA5812 | SEOA9684 | seob2547 | seob4471 | seob5947 | seob7737 |
| ncrc2152 | ncrc9561 | SEOA2651 | SEOA5824 | SEOA9742 | seob2551 | seob4475 | seob6013 | seob7872 |
| ncrc2232 | ncrc9576 | SEOA2933a | SEOA5834 | SEOA9751 | seob2567 | seob4525 | seob6034 | seob7911 |
| ncrc2302 | ncrc9593 | SEOA2942a | SEOA5837 | SEOA9801 | SEOB2749 | seob4543 | seob6058 | seob7926 |
| ncrc2400 | ncrc9703 | SEOA2959a | SEOA5947 | SEOA9896 | SEOB2762 | seob4653 | seob6074 | seob7986 |
| ncrc2580 | ncrc9705 | SEOA2984a | SEOA6028a | SEOA9937 | SEOB2768 | seob4655 | seob6127 | seob8013 |
| ncrc2625 | ncrc9804 | SEOA3190 | SEOA6217a | SEOB0088 | SEOB2812 | seob4677 | seob6232 | seob8019 |
| ncrc2639 | ncrc9903 | SEOA3195 | SEOA6431 | SEOB0102 | SEOB2817 | seob4702 | seob6234 | seob8048 |
| ncrc2669 | ncrc9929 | SEOA3243 | SEOA6437 | SEOB0164 | SEOB2926 | seob4708 | seob6236 | seob8100 |
| ncrc2758 | ncrc9943 | SEOA3247 | SEOA6451a | SEOB0169 | SEOB2934 | seob4713 | seob6248 | seob8107 |
| ncrc2762 | SEOA0068 | SEOA3261 | SEOA6458a | SEOB0237 | SEOB2951 | seob4743 | seob6250 | seob8140 |
| ncrc2779 | SEOA0112 | SEOA3426a | SEOA6582a | SEOB0251 | SEOB3038 | seob4753 | seob6255 | seob8141 |
| ncrc2865 | SEOA0136 | SEOA3498a | SEOA6623a | SEOB0351 | SEOB3048 | seob4801 | seob6310 | seob8182 |
| ncrc2904 | SEOA0189A | SEOA3503a | SEOA6649a | SEOB0422 | SEOB3056 | seob4802 | seob6344 | seob8188 |
| ncrc2905 | SEOA0194A | SEOA3608a | SEOA6688a | SEOB0461 | SEOB3079 | seob4829 | seob6409 | seob8191 |
| ncrc3052 | SEOA0372 | SEOA3691a | SEOA6911 | SEOB0553 | SEOB3108 | seob4888 | seob6411 | seob8192 |
| ncrc3066 | SEOA0453 | SEOA3712a | seoa6956 | SEOB0561 | SEOB3157 | seob4929 | seob6465 | seob8202 |
| ncrc3137 | SEOA0475 | SEOA3735a | SEOA7070a | SEOB0698a | SEOB3230 | seob4944 | seob6553 | SOA0253 |
| ncrc3149 | SEOA0493 | SEOA3801a | SEOA7134a | SEOB0701a | SEOB3329 | seob5001 | seob6557 | SOA0505 |
| ncrc3150 | SEOA0576n | SEOA3894 | SEOA7161a | SEOB0758 | SEOB3344 | seob5060 | seob6566 | |
| ncrc3236 | SEOA0833 | SEOA3902 | SEOA7292a | SEOB0823a | SEOB3346 | seob5124 | seob6638 | |
| ncrc3288 | SEOA0878 | SEOA3927 | SEOA7311a | SEOB0834a | SEOB3444 | seob5153 | seob6687 | |
| ncrc3303 | SEOA0948 | SEOA3956a | SEOA7348a | SEOB0849a | SEOB3475 | seob5161 | seob6779 | |
| ncrc3304 | SEOA0991 | SEOA3983a | SEOA7362a | SEOB0886a | SEOB3522 | seob5243 | seob6826 | |
| ncrc3326 | SEOA1068a | SEOA4013a | SEOA7507a | SEOB0893a | SEOB3525 | seob5255 | seob6852 | |

Figure 6A - EST Names Corresponding to Unique Known Genes of Figure 6

2. mitochondrial genome (consensus sequence) X62996 778

| | | | | | | | | |
|---|---|---|---|---|---|---|---|---|
| ncrc1692 | BFCN0254 | FCR4413 | MIOA0327 | MIOA1990 | MIOA3982a | MIOA6834a | mioa9687 | miob6995 |
| ncrc6464 | BFCS0277 | FCR4575 | MIOA0339 | MIOA2123 | MIOA4205 | MIOA6886a | mioa9705 | miob7024 |
| ncrc6551 | BFCS0368 | FCR4610 | MIOA0373a | MIOA2186a | MIOA4211 | MIOA6892a | mioa9860 | miob7027 |
| ncrc7194 | BFCW0235 | FCR4637 | MIOA0393a | MIOA2191a | MIOA4383a | MIOA6980a | mioa9875 | ncr0534 |
| ncrc7143 | BFCW0406 | FCR4693 | MIOA0420a | MIOA2243a | MIOA4406 | MIOA7022a | mioa9882 | ncr1016 |
| ncrc7167 | CR0025 | FCR4729 | MIOA0468 | MIOA2257a | MIOA4418 | MIOA7034a | miob0046 | ncr1025 |
| ncrc5715 | CR0046 | FCR4817 | MIOA0479n | MIOA2276a | MIOA4430 | MIOA7045a | miob0519 | ncr1142 |
| ncrc5704 | CR0074 | FCR4911 | MIOA0489 | MIOA2293a | MIOA4485a | MIOA7158a | miob0765 | ncr1317 |
| ncrc3493 | CR0178 | FCR4997 | MIOA0515 | MIOA2296a | MIOA4594a | MIOA7174a | miob0817 | ncr1552 |
| ncrc3576 | CR0180 | FCR5057 | MIOA0559n | MIOA2324a | MIOA4717 | MIOA7193a | miob0892 | ncr1787 |
| ncrc3652 | CR0423 | FCR5151 | MIOA0565n | MIOA2326a | MIOA4746 | MIOA7235a | miob0920 | ncr1793 |
| ncrc3437 | CR0641 | FCR5165 | MIOA0590a | MIOA2397a | MIOA4832a | MIOA7327 | miob0921 | ncr1971 |
| ncrc3518 | FCR0116 | FCR5223 | MIOA0608a | MIOA2419a | MIOA4853a | MIOA7337a | miob0945 | ncr2657 |
| ncrc3825 | FCR0170 | FCR5246 | MIOA0713 | MIOA2486a | MIOA4923a | MIOA7357a | miob1316 | ncr2731 |
| ncrc3833 | FCR0208 | FCR5471 | MIOA0714 | MIOA2630 | MIOA4947a | MIOA7425a | miob1726 | ncr2844 |
| ncrc2278 | FCR0209 | FCR5479 | MIOA0729 | MIOA2643 | MIOA5005a | MIOA7520a | miob1810 | ncr3864 |
| ncrc2263 | FCR0263 | FCR5541 | MIOA0835a | MIOA2645 | MIOA5011a | MIOA7521a | miob1815 | ncr3935 |
| ncrc2271 | FCR0312 | FCR5959 | MIOA0851a | MIOA2662a | MIOA5025a | MIOA7526a | miob1822 | ncr3970 |
| ncrc2458 | FCR0328 | FCR6079 | MIOA0875a | MIOA2735a | MIOA5031a | MIOA7548a | MIOB2630 | ncr3997 |
| ncrc2316 | FCR0625 | FCR6103 | MIOA0929 | MIOA2787a | MIOA5056a | MIOA7604a | MIOB2636 | ncr4107 |
| ncrc2383 | FCR0649 | FCR6116 | MIOA0931 | MIOA2799a | MIOA5129a | MIOA7623a | MIOB2781 | ncr4222 |
| ncrc3983 | FCR0654 | FCR6163 | MIOA0944 | MIOA2820a | MIOA5132a | MIOA7950a | miob3791 | ncr5318 |
| ncrc4140 | FCR0834 | FCR6202 | MIOA0967 | MIOA2822a | MIOA5163a | MIOA7982a | miob4505 | ncr5867 |
| ncrc4599 | FCR0839 | FCR6209 | MIOA0981 | MIOA2837a | MIOA5286a | MIOA8015a | miob4526 | ncr5912 |
| ncrc4686 | FCR0865 | FCR6257 | MIOA0998 | MIOA2855a | MIOA5330a | MIOA8030a | miob4589 | ncr7495 |
| ncrc4884 | FCR0888 | FCR6258 | MIOA1007 | MIOA2859a | MIOA5413a | MIOA8062a | miob4600 | ncr7508 |
| ncrc5004 | FCR0899 | FCR6414 | MIOA1102 | MIOA2866a | MIOA5446a | MIOA8109 | miob4682 | ncr7676 |
| ncrc5170 | FCR1009n | FCR6463 | MIOA1141 | MIOA2925a | MIOA5472a | MIOA8115 | miob4688 | ncr7728 |
| ncrc5148 | FCR1016 | FCR6476 | MIOA1157 | MIOA2938a | MIOA5539a | MIOA8165 | miob4774 | ncr8536 |
| ncrc5011 | FCR1048n | FCR6556 | MIOA1204 | MIOA2975a | MIOA5541a | MIOA8193 | miob4843 | ncr8548 |
| ncrc5044 | FCR1123 | FCR6795 | MIOA1222m | MIOA3025a | MIOA5544a | MIOA8204 | miob4908 | ncr8716 |
| ncrc4898 | FCR1139 | FCR6798 | MIOA1253 | MIOA3043a | MIOA5551a | MIOA8235 | miob4915 | ncr8757 |
| ncrc5116 | FCR1352 | FCR7010 | MIOA1254 | MIOA3053a | MIOA5603a | MIOA8255 | miob4930 | ncr8792 |
| ncrc1390 | FCR1354 | FCR7044 | MIOA1261 | MIOA3057a | MIOA5760a | MIOA8303 | miob4937 | ncr8871 |
| ncrc4314 | FCR1373 | FCR7274 | MIOA1270 | MIOA3105a | MIOA5765a | MIOA8310 | miob4958 | ncr8886 |
| ncrc4260 | FCR1419 | FCR7280 | MIOA1311 | MIOA3107a | MIOA5852a | MIOA8428 | miob4978 | ncr8904 |
| ncrc5185 | FCR1532 | FCR7361 | MIOA1313a | MIOA3151a | MIOA5928a | MIOA8503 | miob5006 | ncr8922 |
| ncrc5201 | FCR1561 | FCR7407 | MIOA1330a | MIOA3157a | MIOA5935a | MIOA8630 | miob5095 | ncr8941 |
| ncrc5307 | FCR1563 | fcrb0082 | MIOA1334a | MIOA3199a | MIOA5976a | MIOA8638 | miob5101 | ncr9304 |
| ncrc5459 | FCR1605 | fcrb0959 | MIOA1358a | MIOA3223a | MIOA6049a | MIOA8649 | miob6102 | ncr9461 |
| ncrc5617 | FCR1638 | hfcr0087 | MIOA1360a | MIOA3286a | MIOA6058a | MIOA8685 | miob6240 | ncr9486 |
| ncrc5642 | FCR1651 | hfcr0688 | MIOA1367a | MIOA3311a | MIOA6063a | MIOA8730 | miob6253 | ncrb0031 |
| ncrc5468 | FCR1910 | hfcr0842 | MIOA1372a | MIOA3340a | MIOA6127a | MIOA8746 | miob6297 | ncrb0057 |
| ncrc5383 | FCR2130 | hfcr1269 | MIOA1382a | MIOA3408a | MIOA6179a | MIOA8764 | miob6316 | ncrb0139 |
| ncrc5585 | FCR2175 | hfcr1325 | MIOA1460 | MIOA3478a | MIOA6323a | MIOA8780 | miob6319 | ncrb0217 |
| ncrc5630 | FCR2215 | hfcr1353 | MIOA1472 | MIOA3511a | MIOA6370a | MIOA9028 | miob6325 | ncrb0311 |
| ncrc5337 | FCR2251 | HFCR3166 | MIOA1474 | MIOA3536a | MIOA6437a | MIOA9110 | miob6330 | ncrb0344 |
| ncrc5623 | FCR2600 | HFCR3264 | MIOA1624a | MIOA3537a | MIOA6490a | MIOA9184 | miob6358 | ncrb0437 |
| ncrc6335 | FCR2662 | hfcr3600 | MIOA1681a | MIOA3557a | MIOA6566a | mioa9226 | miob6463 | ncrb0481 |
| ncrc5771 | FCR2698 | hfcr3794 | MIOA1713a | MIOA3734a | MIOA6600a | mioa9278 | miob6558 | ncrb0522 |
| ncrc6351 | FCR2812 | hfcr3841 | MIOA1738 | MIOA3759a | MIOA6631a | mioa9339 | miob6675 | ncrb0563 |
| ncrc6303 | FCR3078 | hfcr3942 | MIOA1771 | MIOA3791 | MIOA6679a | mioa9341 | miob6705 | ncrb2036 |
| ncrc6296 | FCR3119 | hfcr4026 | MIOA1838a | MIOA3831 | MIOA6736a | mioa9369 | miob6716 | ncrb2059 |
| ncrc5796 | FCR3361 | hfcr4530 | MIOA1892a | MIOA3844 | MIOA6737a | mioa9376 | miob6725 | ncrb2104 |
| ncrc6022 | FCR3460 | MIOA0232a | MIOA1898a | MIOA3846 | MIOA6762a | mioa9531 | miob6853 | ncrb2118 |
| ncrc6431 | FCR3560 | MIOA0250a | MIOA1905a | MIOA3851 | MIOA6771a | mioa9559 | miob6857 | ncrb2181 |
| BFCN0180 | FCR3947N | MIOA0276 | MIOA1988 | MIOA3910a | MIOA6822a | mioa9641 | miob6872 | ncrb2242 |

Figure 6A – EST Names Corresponding to Unique Known Genes of Figure 6

| | | | | | | | | |
|---|---|---|---|---|---|---|---|---|
| ncrb2261 | ncrb8791 | ncrc7010 | SEOA0989 | SEOA3126a | SEOA4854a | SEOA7183a | SEOB0090 | seob5121 |
| ncrb2330 | ncrc1057 | ncrc8947 | SEOA1115a | SEOA3183 | SEOA5034a | SEOA7384a | SEOB0198 | seob5249 |
| ncrb2361 | ncrc1169 | ncrc8952 | SEOA1151a | SEOA3277n | SEOA5158a | SEOA7401a | SEOB0274 | seob5266 |
| ncrb2453 | ncrc1509 | ncrc9061 | SEOA1275a | SEOA3291 | SEOA5353 | SEOA7430a | SEOB1123 | seob5311 |
| ncrb2787 | ncrc1783 | ncrc9161 | SEOA1283a | SEOA3446a | SEOA5438 | SEOA7431a | SEOB1129 | seob5440 |
| ncrb2838 | ncrc1839 | ncrc9172 | SEOA1339n | SEOA3509a | SEOA5573a | SEOA7488a | SEOB1314 | seob5678 |
| ncrb2862 | ncrc1924 | ncrc9182 | SEOA1423a | SEOA3530a | SEOA5587a | SEOA7550a | SEOB1401 | seob5823 |
| ncrb3663 | ncrc2160 | ncrc9308 | SEOA1475 | SEOA3535a | SEOA5659a | SEOA7586a | SEOB1547 | seob5834 |
| ncrb3997 | ncrc2177 | ncrc9318 | SEOA1506 | SEOA3540a | SEOA5718a | SEOA7621a | SEOB1573 | seob5846 |
| ncrb4002 | ncrc2224 | ncrc9349 | SEOA1620a | SEOA3564a | SEOA5788 | SEOA7939a | SEOB1593 | seob6308 |
| ncrb4104 | ncrc2588 | ncrc9535 | SEOA1638a | SEOA3642a | SEOA5854 | SEOA8312a | SEOB1626 | seob6390 |
| ncrb4173 | ncrc2667 | SEOA0043 | SEOA1645a | SEOA3703a | SEOA5928 | SEOA8368a | SEOB1704 | seob6548 |
| ncrb4218 | ncrc2716 | seoa0095m | SEOA1652a | SEOA3715a | SEOA5959 | SEOA8534 | SEOB2076 | seob6783 |
| ncrb4243 | ncrc2769 | SEOA0131 | SEOA1705a | SEOA3883 | SEOA5983a | SEOA8613 | SEOB2798 | seob6813 |
| ncrb4622 | ncrc2775 | SEOA0164a | SEOA1712a | SEOA3884 | SEOA5987a | SEOA9076 | SEOB3100 | seob6843 |
| ncrb4693 | ncrc2819 | SEOA0175a | SEOA1757a | SEOA3897 | SEOA5997a | SEOA9137 | seob3646 | seob7002 |
| ncrb4887 | ncrc2945 | SEOA0195A | SEOA1835a | SEOA3942a | SEOA6002a | SEOA9175 | seob3709 | seob7099 |
| ncrb5277 | ncrc3115 | SEOA0246a | SEOA1921n | SEOA3980a | SEOA6020a | SEOA9188 | seob3896 | seob7405 |
| ncrb5300 | ncrc3177 | SEOA0251a | SEOA1938n | SEOA4189a | SEOA6205a | SEOA9224 | seob3919 | seob7439 |
| ncrb5364 | ncrc3227 | SEOA0287 | SEOA1985 | SEOA4247a | SEOA6283 | SEOA9427 | seob4070 | seob7905 |
| ncrb5425 | ncrc3797 | SEOA0421 | SEOA2050 | SEOA4248a | SEOA6290 | SEOA9459 | seob4164 | seob7934 |
| ncrb5452 | ncrc4024 | SEOA0513 | SEOA2055n | SEOA4385a | SEOA6307 | SEOA9495 | seob4232 | seob8269 |
| ncrb5522 | ncrc4515 | SEOA0582 | SEOA2843 | SEOA4462a | SEOA6408 | SEOA9606 | seob4291 | seob8324 |
| ncrb5534 | ncrc4621 | SEOA0590a | SEOA2915a | SEOA4473a | SEOA6478a | SEOA9640 | seob4337 | seob8339 |
| ncrb5567 | ncrc4720 | SEOA0614a | SEOA2920a | SEOA4506 | SEOA6569a | SEOA9725 | seob4345 | SOA0667 |
| ncrb8095 | ncrc5031 | SEOA0806 | SEOA2965a | SEOA4521 | SEOA6639a | SEOA9748 | seob4443 | |
| ncrb8368 | ncrc5552 | SEOA0843 | SEOA3013a | SEOA4540 | SEOA6716 | SEOA9825 | seob4517 | |
| ncrb8480 | ncrc6104 | SEOA0886 | SEOA3077a | SEOA4590 | SEOA6909 | SEOA9878 | seob4757 | |
| ncrb8617 | ncrc6959 | SEOA0892 | SEOA3085a | SEOA4689a | SEOA6917 | SEOB0004 | seob4758 | |
| ncrb8778 | ncrc7002 | SEOA0942 | SEOA3110a | SEOA4710a | SEOA7087a | SEOB0087 | seob5038 | |

3. fibronectin (FN)X02761.1 643

| | | | | | | | | |
|---|---|---|---|---|---|---|---|---|
| ncrc3404 | MIOA1122 | MIOA3250a | MIOA5623a | MIOA7224a | MIOA9032 | miob1103 | miob3770 | miob6596 |
| ncrc3455 | MIOA1224m | MIOA3385a | MIOA5652 | MIOA7243a | MIOA9084 | miob1168 | miob3812 | miob6650 |
| FCR0872 | MIOA1260 | MIOA3423a | mioa5683n | MIOA7256a | MIOA9143 | miob1227 | miob3901 | miob6672 |
| FCR1701 | MIOA1536 | MIOA3433a | MIOA5733a | MIOA7296 | mioa9464 | miob1258 | miob4149 | miob6775 |
| FCR1932 | MIOA1742 | MIOA3461a | MIOA5746a | MIOA7407a | mioa9592 | miob1310 | miob4177 | miob6845 |
| FCR1973 | MIOA1781 | MIOA3502a | MIOA5888a | MIOA7414a | mioa9669 | miob1716 | miob4336 | miob6918 |
| FCR3094 | MIOA1943a | MIOA3595a | MIOA5904a | MIOA7447a | mioa9676 | miob1751 | miob4439 | miob6985 |
| FCR5537 | MIOA1957a | MIOA3601a | MIOA5953a | MIOA7527a | mioa9684 | miob1792 | miob4459 | miob7022 |
| FCR6007 | MIOA1959a | MIOA3900a | MIOA6085a | MIOA7543a | mioa9771 | miob1824 | miob4516 | ncr1668 |
| fcrb2581 | MIOA1968a | MIOA3929a | MIOA6214a | mioa7640a | mioa9796 | miob1846 | miob4550 | ncr1917 |
| hfcr1723 | MIOA1969a | MIOA4049a | MIOA6282a | mioa7815a | mioa9946 | miob1887 | miob4652 | ncr3076 |
| hfcr1764 | MIOA2001n | MIOA4142 | MIOA6288a | MIOA7994a | miob0025 | MIOB2232 | miob4890 | ncr5017 |
| hfcr1862 | MIOA2034 | MIOA4368a | MIOA6448a | MIOA7997a | miob0108 | MIOB2306 | miob5111 | ncr5233 |
| HFCR3211 | MIOA2102 | MIOA4373a | MIOA6547a | MIOA8331 | miob0195 | MIOB2309 | miob5652 | ncr5699 |
| hfcr4316 | MIOA2305a | MIOA4547a | MIOA6613a | MIOA8333 | miob0241 | miob2411 | miob5655 | ncr5919 |
| hfcr5399 | MIOA2349a | MIOA4566a | MIOA6622a | MIOA8376 | miob0272n | miob2455 | miob5705 | ncr6650 |
| hfcr6812 | MIOA2401a | MIOA4689 | MIOA6632a | MIOA8446 | miob0421 | miob2522 | miob5739 | ncr7006 |
| hfcr9913 | MIOA2462a | MIOA4851a | MIOA6672a | MIOA8466 | miob0502 | MIOB2673 | miob5819 | ncr7244 |
| MIOA0295 | MIOA2761a | MIOA4899a | MIOA6744a | MIOA8543 | MIOB0574 | miob3063 | miob5864 | ncr7454 |
| MIOA0344 | MIOA2827a | MIOA5155a | MIOA6867a | MIOA8558 | miob0824 | miob3085 | miob5909 | ncr7749 |
| MIOA0495 | MIOA2875a | MIOA5164a | MIOA6934a | MIOA8651 | miob0831 | miob3170 | miob5953 | ncr8684 |
| MIOA0643n | MIOA2904a | MIOA5211a | MIOA7067a | MIOA8776 | miob0880 | miob3210 | miob5973 | ncr8701 |
| MIOA0779 | MIOA2921a | MIOA5297a | MIOA7125a | MIOA8853 | miob0980 | miob3325 | miob6051 | ncr9925 |
| MIOA0847a | MIOA3036a | MIOA5401a | MIOA7153a | MIOA8887 | miob0997 | miob3466 | miob6308 | ncrb0585 |
| MIOA0997n | MIOA3067a | MIOA5506a | MIOA7162a | MIOA8960 | miob1010 | miob3608 | miob6557 | ncrb0754 |
| mioa1042m | MIOA3244a | MIOA5581a | MIOA7192a | MIOA9012 | miob1065 | miob3652 | miob6565 | ncrb2341 |

Figure 6A – EST Names Corresponding to Unique Known Genes of Figure 6

| | | | | | | | | |
|---|---|---|---|---|---|---|---|---|
| ncrb2581 | SEOA0859 | SEOA3468a | SEOA5970a | seoa7985 | SEOB0057 | seob2593 | seob5158 | seob7873 |
| ncrb2853 | SEOA0868 | SEOA3492a | SEOA6026a | seoa8048 | SEOB0115 | seob2624 | seob5221 | seob7962 |
| ncrb3086 | SEOA0924 | SEOA3513a | SEOA6089a | seoa8059 | SEOB0213 | SEOB2690 | seob5340 | seob8250 |
| ncrb3384 | SEOA0929n | SEOA3616a | SEOA6097a | seoa8078 | SEOB0233 | SEOB2808 | seob5374 | seob8284 |
| ncrb3799 | SEOA1001 | SEOA3722a | SEOA6101a | seoa8141 | SEOB0255 | SEOB2989 | seob5393 | seob8317 |
| ncrb4570 | SEOA1013n | SEOA3765a | SEOA6252 | seoa8160 | SEOB0260 | SEOB3042 | seob5444 | SOA0046 |
| ncrb4943 | SEOA1057a | seoa3899n | SEOA6330 | SEOA8201a | SEOB0273 | SEOB3099 | seob5534 | SOA0064 |
| ncrb5396 | SEOA1113a | SEOA4086 | SEOA6381 | SEOA8233 | SEOB0357 | SEOB3134 | seob5613 | SOA0107 |
| ncrb5681 | SEOA1131a | SEOA4094 | SEOA6468a | SEOA8248 | SEOB0381 | SEOB3206 | seob5653 | SOA0117 |
| ncrb5883 | SEOA1139a | SEOA4095 | SEOA6548a | SEOA8258 | SEOB0485 | SEOB3227 | seob5666 | SOA0138 |
| ncrb5949 | SEOA1328 | SEOA4208a | SEOA6561a | SEOA8369a | SEOB0520 | seob3267n | seob5695 | SOA0147 |
| ncrb6596 | SEOA1332 | SEOA4302a | SEOA6585a | SEOA8381a | SEOB0574 | SEOB3319 | seob5708 | soa0204n |
| ncrb7373 | SEOA1383 | SEOA4350a | SEOA6631a | SEOA8382a | SEOB0618 | SEOB3351 | seob5723 | SOA0229 |
| ncrc1093 | SEOA1461a | SEOA4378a | SEOA6707 | SEOA8394a | SEOB0875a | SEOB3476 | seob5858 | SOA0233 |
| ncrc1909 | SEOA1505 | SEOA4379a | seoa6765 | SEOA8462 | SEOB1019 | SEOB3541 | seob5902 | SOA0239 |
| ncrc2017 | SEOA1554 | SEOA4714a | seoa6792 | SEOA8590 | seob1055 | SEOB3571 | seob5977 | SOA0242 |
| ncrc2423 | SEOA1602a | SEOA4723a | SEOA6877 | SEOA8603 | SEOB1072 | SEOB3575 | seob6037 | SOA0262 |
| ncrc2620 | SEOA1609a | SEOA4728a | SEOA6902 | SEOA8644 | SEOB1148 | seob3665 | seob6075 | SOA0263 |
| ncrc2662 | SEOA1681a | SEOA4751a | seoa6957 | SEOA8657 | SEOB1244 | seob3679 | seob6090 | SOA0289 |
| ncrc2872 | SEOA1837a | SEOA4765a | seoa6992 | SEOA8698 | SEOB1252 | seob3690 | seob6111 | SOA0304 |
| ncrc3127 | SEOA1890n | SEOA4805a | seoa6994 | SEOA8706 | SEOB1296 | seob3855 | seob6149 | SOA0319 |
| ncrc4787 | SEOA1949 | SEOA4819a | seoa6995 | SEOA8739 | SEOB1297 | seob3958 | seob6244 | SOA0328 |
| ncrc5083 | SEOA1961a | seoa4894a | seoa7009 | SEOA8784 | SEOB1476 | seob3965 | seob6364 | SOA0331 |
| ncrc5496 | SEOA1981a | seoa4986a | seoa7041 | SEOA8840 | SEOB1615 | seob4062 | seob6495 | SOA0334 |
| ncrc5729 | SEOA1990 | SEOA5025a | SEOA7117a | SEOA8904 | SEOB1627 | seob4268 | seob6554 | SOA0354 |
| ncrc6440 | SEOA2074n | SEOA5086a | SEOA7170a | SEOA8907 | SEOB1642 | seob4304 | seob6579 | SOA0372 |
| ncrc6707 | SEOA2075n | SEOA5107a | SEOA7180a | SEOA8954 | SEOB1681 | seob4423 | seob6589 | SOA0381 |
| ncrc6864 | SEOA2080n | SEOA5143a | SEOA7264a | SEOA8966 | SEOB1691 | seob4457 | seob6590 | SOA0436 |
| ncrc8933 | SEOA2094 | SEOA5244a | SEOA7290a | SEOA9013 | SEOB1708 | seob4474 | seob6592 | SOA0450 |
| ncrc9178 | SEOA2102n | SEOA5290a | SEOA7293a | SEOA9185 | SEOB1712 | seob4482 | seob6597 | SOA0464 |
| ncrc9313 | SEOA2171 | SEOA5380 | SEOA7325a | SEOA9219 | SEOB1727 | seob4483 | seob6614 | SOA0491 |
| ncrc9743 | SEOA2220a | SEOA5390 | SEOA7333a | SEOA9401 | SEOB1768 | seob4564 | seob6699 | SOA0495 |
| SEOA0018 | SEOA2268a | SEOA5428 | SEOA7364a | SEOA9432 | SEOB1780 | seob4598 | seob6789 | SOA0518 |
| SEOA0019 | SEOA2350a | SEOA5443 | SEOA7418a | SEOA9433 | SEOB1827 | seob4634 | seob6794 | SOA0526 |
| SEOA0025 | SEOA2556 | SEOA5458 | SEOA7429a | SEOA9486 | SEOB1887 | seob4661 | seob6802 | SOA0527 |
| SEOA0035 | SEOA2586 | SEOA5500a | SEOA7497a | SEOA9492 | SEOB1929 | seob4694 | seob6846 | SOA0532 |
| seoa0097m | SEOA2676n | SEOA5512a | SEOA7515a | SEOA9510 | SEOB1945 | seob4720 | seob7182 | SOA0549 |
| SEOA0143 | SEOA2756 | SEOA5513a | SEOA7532a | SEOA9586 | SEOB2049 | seob4730 | seob7228 | SOA0575 |
| SEOA0291 | SEOA2804 | SEOA5581a | SEOA7558a | SEOA9617 | SEOB2065 | seob4772 | seob7292 | SOA0580 |
| SEOA0294 | SEOA2848 | SEOA5585a | SEOA7562a | SEOA9628 | SEOB2102 | seob4839 | seob7333 | SOA0598 |
| SEOA0408 | SEOA3098a | SEOA5674a | SEOA7588a | SEOA9716 | SEOB2118 | seob4852 | seob7398 | SOA0651 |
| SEOA0428 | SEOA3165 | SEOA5704a | seoa7734a | SEOA9834 | SEOB2178 | seob4931 | seob7412 | SOA0662 |
| SEOA0431 | SEOA3228 | SEOA5724a | SEOA7894a | SEOA9905 | SEOB2180 | seob4933 | seob7441 | SOA0715 |
| SEOA0454 | SEOA3348a | SEOA5840 | SEOA7900a | SEOA9946 | SEOB2189 | seob4962 | seob7632 | |
| SEOA0802 | SEOA3363a | SEOA5901 | SEOA7947a | SEOB0050 | seob2543 | seob4985 | seob7715 | |
| SEOA0825 | SEOA3388a | SEOA5940 | SEOA7949a | SEOB0056 | seob2568 | seob5011 | seob7745 | |

4. decorin (DCN) NM_001920.1 574

| | | | | | | | | | |
|---|---|---|---|---|---|---|---|---|---|
| ncrc2471 | ncrc5437 | FCR5863 | MIOA0058a | MIOA0821 | mioa1119m | MIOA1615a | MIOA2420a | MIOA3464a |
| ncrc2332 | ncrc5820 | FCR6461 | MIOA0087a | MIOA0839a | MIOA1164 | MIOA1846a | MIOA2435a | MIOA3518a |
| ncrc2494 | ncrc6289 | FCR6725 | MIOA0284 | MIOA0844a | MIOA1223m | MIOA1983a | MIOA2465a | MIOA3545a |
| ncrc2308 | ncrc5913 | FCR7502 | MIOA0375a | MIOA0904a | MIOA1227 | MIOA1989 | MIOA2549a | MIOA3552a |
| ncrc2460 | ncrc5987 | FCR7511 | MIOA0526 | MIOA0927a | MIOA1284 | MIOA2018 | MIOA2754a | MIOA3591a |
| ncrc4097 | BFCW0415 | fcrb0585 | MIOA0593a | MIOA0946 | MIOA1333a | mioa2047m | MIOA2930a | MIOA3626a |
| ncrc4216 | FCR1431 | fcrb1768 | MIOA0652 | MIOA0990n | MIOA1475 | MIOA2089 | MIOA3014a | MIOA3628a |
| ncrc4690 | FCR3727 | hfcr0299 | MIOA0742 | MIOA1029 | MIOA1487 | MIOA2113 | MIOA3096a | MIOA3711a |
| ncrc4695 | FCR4086 | hfcr6553 | MIOA0773 | MIOA1083 | MIOA1540 | MIOA2217a | MIOA3233a | MIOA3716a |
| ncrc5323 | FCR5247 | MIOA0057a | MIOA0808 | mioa1111m | MIOA1575 | MIOA2358a | MIOA3419a | MIOA3763 |

Figure 6A – EST Names Corresponding to Unique Known Genes of Figure 6

| | | | | | | | | |
|---|---|---|---|---|---|---|---|---|
| MIOA3777 | MIOA7318 | miob1299 | miob6068 | ncr7250 | ncrb6121 | ncrc9201 | SEOA5539a | SEOB3403 |
| MIOA3849 | MIOA7444a | miob1380 | miob6141 | ncr7409 | ncrb6239 | ncrc9369 | SEOA5882 | SEOB3426 |
| MIOA3850 | MIOA7456a | MIOB1504 | miob6345 | ncr7568 | ncrb6574 | ncrc9548 | SEOA5885 | SEOB3441 |
| MIOA3866 | MIOA7487a | miob1537n | miob6362 | ncr7936 | ncrb6736 | ncrc9694 | SEOA5957 | SEOB3470 |
| MIOA4012a | MIOA7632a | miob1834 | miob6366 | ncr8005 | ncrb6737 | ncrc9763 | SEOA6023a | SEOB3511 |
| MIOA4033a | mioa7758a | miob1840 | miob6540 | ncr8083 | ncrb6763 | ncrc9865 | SEOA6067a | seob3603 |
| MIOA4055a | mioa7767a | miob1916 | miob6620 | ncr8287 | ncrb6768 | SEOA0448 | SEOA6391 | seob3738 |
| MIOA4073a | mioa7861 | miob1920 | miob6657 | ncr8392 | ncrb6825 | SEOA0458n | SEOA6531a | seob4021 |
| MIOA4174 | mioa7869 | miob1959 | miob6801 | ncr8519 | ncrb6938 | SEOA0547A | seoa6803 | seob4049 |
| MIOA4225 | MIOA8108 | MIOB2113 | miob6958 | ncr8898 | ncrb7428 | SEOA0876 | SEOA6927 | seob4154 |
| MIOA4284 | MIOA8110 | MIOB2159 | miob6964 | ncr9035 | ncrb7633 | SEOA0938n | SEOA7132a | seob4243 |
| MIOA4333a | MIOA8230 | MIOB2310 | ncr0081 | ncr9349 | ncrb7663 | SEOA0952 | SEOA7260a | seob4272 |
| MIOA4340a | MIOA8236 | miob2409 | ncr0157 | ncr9360 | ncrb7978 | SEOA1048a | SEOA7468a | seob4366 |
| MIOA4356a | mioa8296n | MIOB2551 | ncr0239 | ncr9368 | ncrb8339 | SEOA1112a | SEOA7575a | seob4411 |
| MIOA4393 | MIOA8347 | MIOB2609 | ncr0343 | ncr9388 | ncrb8351 | SEOA1258A | SEOA7627a | seob4444 |
| MIOA4400 | MIOA8710 | MIOB2682 | ncr0598 | ncr9398 | ncrb8525 | SEOA1260A | seoa7991 | seob4491 |
| MIOA4415 | MIOA8786 | miob3020 | ncr1139 | ncr9433 | ncrb8627 | SEOA1371 | seoa8007 | seob4508 |
| MIOA4488a | MIOA8800 | miob3080 | ncr1295 | ncr9556 | ncrc0009 | SEOA1395 | SEOA8166a | seob4594 |
| MIOA4520a | MIOA8947 | miob3117 | ncr1315 | ncr9799 | ncrc0099 | SEOA1695a | SEOA8211 | seob4707 |
| MIOA4536a | MIOA9005 | miob3146 | ncr1532 | ncr9850 | ncrc0354 | SEOA1696a | SEOA8220 | seob4742 |
| MIOA4544a | MIOA9015 | miob3265 | ncr1709 | ncrb0116 | ncrc0360 | SEOA1792a | SEOA8367a | seob4970 |
| MIOA4581a | mioa9291 | miob3326 | ncr1763 | ncrb0216 | ncrc0563 | SEOA1891 | SEOA8601 | seob5176 |
| MIOA4603a | mioa9347 | miob3349 | ncr1767 | ncrb0260 | ncrc0659 | seoa1928n | SEOA8949 | seob5253 |
| MIOA4624a | mioa9365 | miob3389 | ncr1792 | ncrb0316 | ncrc0785 | SEOA1988a | SEOA9068 | seob5328 |
| MIOA4740 | mioa9445 | miob3462 | ncr1869 | ncrb0761 | ncrc1030 | SEOA2001 | SEOA9132 | seob5352 |
| MIOA5000a | mioa9551 | miob3553 | ncr2070 | ncrb0842 | ncrc1055 | SEOA2028 | SEOA9675 | seob5744 |
| MIOA5035a | mioa9558 | miob3629 | ncr2094 | ncrb0877 | ncrc1131 | SEOA2062 | SEOA9769 | seob5755 |
| MIOA5102a | mioa9677 | miob3800 | ncr3030 | ncrb1125 | ncrc1163 | SEOA2113n | SEOA9891 | seob5895 |
| MIOA5158a | mioa9695 | miob3813 | ncr3356 | ncrb1459 | ncrc1198 | SEOA2114 | SEOB0015 | seob6099 |
| MIOA5181a | mioa9847 | miob3820 | ncr3502 | ncrb1617 | ncrc1363 | SEOA2289a | SEOB0374 | seob6175 |
| MIOA5218a | mioa9890 | miob3824 | ncr3658 | ncrb1986 | ncrc1415 | SEOA2522 | SEOB0434 | seob6213 |
| MIOA5371a | mioa9905 | miob3854 | ncr3720 | ncrb2115 | ncrc1628 | SEOA2568 | SEOB0437 | seob6405 |
| MIOA5474a | mioa9950 | miob3880 | ncr3829 | ncrb2251 | ncrc1647 | SEOA2720 | SEOB0607 | seob6607 |
| MIOA5510a | mioa9953 | miob3886 | ncr3990 | ncrb2258 | ncrc1967 | SEOA3001a | SEOB0611 | seob6648 |
| MIOA5545a | miob0019n | miob4043 | ncr4051 | ncrb2362 | ncrc2119 | SEOA3288 | SEOB0657a | seob6756 |
| MIOA5552a | miob0129 | miob4167 | ncr4125 | ncrb2868 | ncrc2144 | SEOA3294 | SEOB0712a | seob6763 |
| MIOA5645a | miob0156 | miob4252 | ncr4794 | ncrb3924 | ncrc2151 | SEOA3329a | SEOB0933 | seob6774 |
| MIOA5654 | miob0181 | miob4289 | ncr4805 | ncrb3941 | ncrc2734 | SEOA3551a | SEOB1246 | seob7020 |
| MIOA5837a | MIOB0331 | miob4310 | ncr4863 | ncrb4037 | ncrc2848 | SEOA3572a | SEOB1453 | seob7107 |
| MIOA5997a | miob0434 | miob4332 | ncr4965 | ncrb4093 | ncrc2891 | SEOA3718a | SEOB1750 | seob7277 |
| MIOA6114a | miob0454 | miob4341 | ncr5120 | ncrb4190 | ncrc2956 | SEOA3739a | SEOB1797 | seob8154 |
| MIOA6134a | MIOB0556 | miob4430 | ncr5630 | ncrb4539 | ncrc3083 | SEOA4078 | SEOB1826 | seob8209 |
| MIOA6314a | miob0678 | miob4456 | ncr5861 | ncrb4756 | ncrc3782 | SEOA4201a | SEOB1902 | seob8225 |
| MIOA6521a | miob0725 | miob4578 | ncr6003 | ncrb4805 | ncrc3911 | SEOA4449a | SEOB1966 | seob8264 |
| MIOA6684a | miob0775 | miob4621 | ncr6269 | ncrb4918 | ncrc5036 | SEOA4581 | SEOB1994 | SOA0132 |
| MIOA6687a | miob0979 | miob4641 | ncr6272 | ncrb5016 | ncrc5289 | SEOA4612a | SEOB2043 | SOA0163 |
| MIOA6732a | miob0981 | miob4856 | ncr6425 | ncrb5046 | ncrc5713 | SEOA4669a | SEOB2110 | SOA0330 |
| MIOA6818a | miob0988 | miob4936 | ncr6651 | ncrb5128 | ncrc5781 | SEOA4707a | SEOB2159 | SOA0332 |
| MIOA6855a | miob1017 | miob5032 | ncr6921 | ncrb5228 | ncrc6239 | SEOA4794a | SEOB2737 | SOA0419 |
| MIOA6899a | miob1036 | miob5120 | ncr6983 | ncrb5296 | ncrc6790 | SEOA4836a | SEOB2770 | SOA0421 |
| MIOA7031a | miob1078 | miob5410 | ncr7027 | ncrb5323 | ncrc6843 | SEOA5296a | SEOB2809 | SOA0444 |
| MIOA7050a | miob1128 | miob5418 | ncr7033 | ncrb5477 | ncrc6915 | SEOA5300a | SEOB3112 | SOA0634 |
| MIOA7175a | miob1160 | miob5741 | ncr7119 | ncrb5650 | ncrc6985 | SEOA5386 | SEOB3127 | |
| MIOA7301 | miob1197 | miob5808 | ncr7131 | ncrb5689 | ncrc9057 | SEOA5491a | SEOB3397 | |

5. collagen type III alpha 1 (COL3A1)X06700| 563

| | | | | | | | | |
|---|---|---|---|---|---|---|---|---|
| ncrc3869 | BFCS0050 | CR0477 | FCR0230 | FCR1146 | FCR1477 | FCR3158 | FCR4117 | FCR5942 |
| ncrc3938 | BFCS0241 | CR0550 | FCR0247 | FCR1210 | FCR1972 | FCR3171 | FCR4280 | FCR6219 |
| ncrc4044 | CR0140 | FCR0036n | FCR0292 | FCR1457 | FCR2683 | FCR4051 | FCR5090 | FCR7282 |

Figure 6A – EST Names Corresponding to Unique Known Genes of Figure 6

| | | | | | | | | |
|---|---|---|---|---|---|---|---|---|
| fcrb0298 | MIOA4945a | miob6446 | ncrc0610 | seoa2077n | SEOA4205a | seoa6952 | SEOB1327 | seob4851 |
| fcrb0305 | MIOA5046a | miob6555 | ncrc1786 | seoa2123m | SEOA4253a | seoa6987 | SEOB1349 | seob4986 |
| fcrb0408 | MIOA5143a | miob6738 | ncrc1887 | SEOA2170 | SEOA4263a | seoa7027 | SEOB1398 | seob4995 |
| fcrb0434 | MIOA5534a | miob6819 | ncrc1937 | SEOA2199a | SEOA4305a | SEOA7237a | SEOB1434 | seob5065 |
| fcrb1303 | MIOA5844a | miob7017 | ncrc2129 | SEOA2205a | SEOA4341a | SEOA7280a | SEOB1437 | seob5112 |
| fcrb1486 | MIOA6168a | ncr0369 | ncrc3003 | SEOA2227a | SEOA4342a | SEOA7285a | SEOB1499 | seob5172 |
| fcrb1589 | MIOA6222a | ncr0947 | ncrc3034 | SEOA2258a | SEOA4450a | SEOA7319a | SEOB1514 | seob5177 |
| fcrb2097 | mioa6246a | ncr1246 | ncrc4356 | SEOA2273a | SEOA4542 | SEOA7520a | SEOB1525 | seob5184 |
| fcrb2505 | MIOA7341a | ncr1302 | ncrc4799 | SEOA2284a | SEOA4573 | SEOA7569a | SEOB1562 | seob5198 |
| fcrb2526 | MIOA7416a | ncr1590 | ncrc4942 | SEOA2390a | SEOA4578 | SEOA7600a | SEOB1597 | seob5231 |
| fcrb2571 | MIOA7488a | ncr1637 | ncrc5253 | SEOA2462a | SEOA4690a | SEOA7613a | SEOB1630 | seob5417 |
| hfcr0322 | MIOA7610a | ncr1726 | ncrc5999 | SEOA2476 | SEOA4744a | SEOA7638a | SEOB1742 | seob5456 |
| hfcr0937 | mioa7891 | ncr2612 | ncrc6063 | SEOA2532 | SEOA4759a | seoa7679a | SEOB1838 | seob5550 |
| hfcr0942 | MIOA8305 | ncr3239 | ncrc6203 | SEOA2548 | seoa4909a | seoa7750a | SEOB1873 | seob5565 |
| hfcr1380 | MIOA8337 | ncr3292 | ncrc6997 | SEOA2557 | seoa4981a | seoa7820a | SEOB1897 | seob5600 |
| hfcr1403 | MIOA8405 | ncr3688 | ncrc9252 | SEOA2588 | SEOA5004a | SEOA7950a | SEOB2173 | seob5620 |
| hfcr1700 | MIOA8618 | ncr4128 | ncrc9669 | SEOA2615 | SEOA5037a | seoa7974 | SEOB2206 | seob5663 |
| hfcr1766 | MIOA8968 | ncr4615 | ncrc9866 | SEOA2645 | SEOA5063a | seoa8118 | SEOB2246 | seob5752 |
| hfcr2556 | MIOA9119 | ncr5171 | ncrc9955 | SEOA2649 | SEOA5135a | SEOA8189a | SEOB2270 | seob5766 |
| hfcr3658 | mioa9230 | ncr5846 | SEOA0042 | seoa2688m | SEOA5355 | SEOA8241 | SEOB2293 | seob5845 |
| hfcr3748 | mioa9567 | ncr6854 | SEOA0075n | SEOA2712 | SEOA5381 | SEOA8307a | seob2314 | seob5871 |
| hfcr4677 | mioa9726 | ncr6880 | SEOA0154 | SEOA2739 | SEOA5385 | SEOA8309a | seob2587 | seob5990 |
| hfcr5396 | mioa9732 | ncr7395 | SEOA0283 | seoa2776m | SEOA5401 | SEOA8315a | seob2599 | seob6029 |
| hfcr6514 | miob0023 | ncr7452 | SEOA0309 | SEOA2794 | SEOA5408 | SEOA8554 | seob2614 | seob6057 |
| hfcr6773 | miob0048 | ncr7688 | SEOA0328 | SEOA2828 | SEOA5485a | SEOA8599 | seob2625 | seob6091 |
| hfcr9154 | miob0163 | ncr8154 | SEOA0335 | SEOA2856 | SEOA5515a | SEOA8637 | SEOB2635 | seob6147 |
| hfcr9185 | miob0346 | ncr8249 | seoa0342m | SEOA2940a | SEOA5722a | SEOA8681 | SEOB2683 | seob6243 |
| hfcr9567 | miob0428 | ncr8556 | SEOA0505 | SEOA2945a | SEOA5732a | SEOA8830 | SEOB2705 | seob6262 |
| hfcr9599 | miob0707 | ncr8685 | SEOA0506 | SEOA2946a | SEOA5737a | SEOA8964 | SEOB2711 | seob6289 |
| hfcr9842 | miob1095 | ncr8992 | SEOA0580 | SEOA3019a | SEOA5745a | SEOA8992 | SEOB2751 | seob6290 |
| MIOA0103 | miob1369 | ncr9211 | SEOA0722a | SEOA3111a | SEOA5756a | SEOA9311 | SEOB2921 | seob6321 |
| MIOA0178 | MIOB1566 | ncr9299 | SEOA0789 | SEOA3134a | SEOA5808 | SEOA9315 | SEOB2999 | seob6358 |
| MIOA0331 | miob1723 | ncr9764 | SEOA0814 | seoa3168mn | SEOA5821 | SEOA9371 | SEOB3059 | seob6403 |
| MIOA0368a | miob1765 | ncrb0075 | SEOA0877 | SEOA3198 | SEOA5878 | SEOA9420 | SEOB3078 | seob6453 |
| MIOA0372a | miob1781 | ncrb0396 | SEOA0908 | SEOA3200 | SEOA5883 | SEOA9451 | SEOB3104 | seob6575 |
| MIOA0392a | miob1791 | ncrb0451 | SEOA0943 | SEOA3264 | SEOA5919 | SEOA9534 | SEOB3190 | seob6611 |
| MIOA0464 | miob1960 | ncrb0807 | SEOA0946 | SEOA3319a | SEOA5920 | SEOA9557 | SEOB3238 | seob6694 |
| MIOA0500 | MIOB2090 | ncrb0881 | SEOA0984 | SEOA3340a | SEOA5966 | SEOA9576 | SEOB3257 | seob6745 |
| MIOA0598a | miob2391 | ncrb1302 | seoa1014m | SEOA3349a | SEOA5989a | SEOA9601 | SEOB3323 | seob6769 |
| MIOA0722 | miob2504 | ncrb1377 | SEOA1024 | SEOA3425a | SEOA6021a | SEOA9629 | SEOB3359 | seob6792 |
| MIOA0846a | miob2540 | ncrb2038 | SEOA1094a | SEOA3430a | SEOA6042a | SEOA9826 | SEOB3423 | seob6873 |
| MIOA0982 | MIOB2674 | ncrb2636 | SEOA1107a | SEOA3546a | SEOA6063a | SEOA9915 | SEOB3457 | seob7081 |
| MIOA1000 | MIOB2746 | ncrb3087 | SEOA1315 | SEOA3559a | SEOA6073a | SEOB0105 | seob3676 | seob7163 |
| MIOA1453 | miob3045 | ncrb3377 | SEOA1321 | SEOA3643a | SEOA6139a | SEOB0150 | seob3688 | seob7254 |
| MIOA1722a | miob3101 | ncrb3408 | SEOA1330 | SEOA3654a | SEOA6148a | SEOB0256 | seob4012 | seob7336 |
| MIOA1755 | miob3613 | ncrb3890 | SEOA1350 | SEOA3678a | SEOA6151 | SEOB0269 | seob4051 | seob7407 |
| MIOA2027 | miob3739 | ncrb4532 | SEOA1351 | SEOA3685a | SEOA6171a | SEOB0312 | seob4074 | seob7434 |
| MIOA2194a | miob3855 | ncrb4576 | SEOA1411a | SEOA3686a | SEOA6212a | SEOB0314 | seob4083 | seob7447 |
| MIOA2241a | miob4016 | ncrb5116 | SEOA1416a | SEOA3695a | SEOA6272 | seob0331n | seob4096 | seob7482 |
| MIOA2390a | miob4087 | ncrb5304 | SEOA1424a | SEOA3702a | SEOA6278 | SEOB0431 | seob4153 | seob7568 |
| MIOA2507a | miob4403 | ncrb5640 | SEOA1444a | SEOA3759a | SEOA6646a | SEOB0440 | seob4226 | seob7604 |
| MIOA2727a | miob4446 | ncrb5831 | SEOA1492n | SEOA3774a | SEOA6653a | SEOB0577 | seob4242 | seob7703 |
| MIOA2850a | miob4512 | ncrb6214 | SEOA1590a | SEOA3879 | SEOA6699a | SEOB0671a | seob4503 | seob8022 |
| MIOA2872a | miob4870 | ncrb6359 | SEOA1703a | SEOA3900 | SEOA6727 | SEOB0726 | seob4506 | seob8042 |
| MIOA3382a | miob5740 | ncrb6457 | SEOA1833a | SEOA3948a | SEOA6735 | SEOB0835a | seob4526 | seob8326 |
| MIOA3434a | miob5874 | ncrb6732 | SEOA1869a | SEOA4038a | SEOA6737 | SEOB0904a | seob4622 | seob8343 |
| MIOA3526a | miob5890 | ncrb6890 | SEOA1894 | SEOA4052a | seoa6769 | SEOB0959 | seob4648 | |
| MIOA3935a | miob5994 | ncrb7367 | SEOA1916n | SEOA4072 | seoa6798 | SEOB1073 | seob4719 | |
| MIOA4011a | miob6047 | ncrb7578 | SEOA1946 | SEOA4115a | seoa6812 | SEOB1077 | seob4785 | |
| MIOA4306a | miob6404 | ncrb7912 | SEOA2016 | SEOA4199a | SEOA6893 | SEOB1253 | seob4797 | |

Figure 6A – EST Names Corresponding to Unique Known Genes of Figure 6

6. beta-2 microglobulin gene (B2M) gb|AF072097.1 490

| | | | | | | | | |
|---|---|---|---|---|---|---|---|---|
| ncrc3559 | MIOA3212a | MIOA7478a | miob2368 | ncr2228 | ncrb7821 | SEOA2867 | SEOA9324 | seob4285 |
| ncrc3507 | MIOA3213a | MIOA7490a | miob2502 | ncr2513 | ncrb8424 | SEOA2882 | SEOA9387 | seob4524 |
| ncrc3633 | MIOA3410a | MIOA7514a | MIOB2623 | ncr2588 | ncrb8544 | SEOA3035a | SEOA9403 | seob4657 |
| ncrc4414 | MIOA3447a | MIOA7523a | MIOB2739 | ncr3312 | ncrc0007 | SEOA3103a | SEOA9667 | seob4767 |
| ncrc4612 | MIOA3583a | MIOA7570a | MIOB2872 | ncr3949 | ncrc0074 | SEOA3179n | SEOA9702 | seob4808 |
| FCR1909 | MIOA3663a | MIOA7574a | miob2878 | ncr4325 | ncrc0150 | SEOA3225 | SEOA9884 | seob4817 |
| FCR5317 | MIOA3884a | mioa7917 | miob2935 | ncr4421 | ncrc0416 | SEOA3256n | SEOA9900 | seob4977 |
| FCR5378 | MIOA4028a | mioa7922 | miob3092 | ncr4519 | ncrc0483 | SEOA3345a | SEOA9907 | seob5023 |
| fcrb1163 | MIOA4050a | MIOA8063a | miob3225 | ncr4617 | ncrc1206 | SEOA3671a | SEOB0011 | seob5109 |
| hfcr0959 | MIOA4053a | MIOA8188 | miob3244 | ncr4821 | ncrc1409 | SEOA3775a | SEOB0049 | seob5206 |
| hfcr2926 | MIOA4162 | MIOA8206 | miob3281 | ncr4939 | ncrc1536 | SEOA3797a | SEOB0144 | seob5345 |
| MIOA0063a | MIOA4202 | MIOA8227 | miob3387 | ncr5189 | ncrc1777 | SEOA3957a | SEOB0149 | seob5359 |
| MIOA0077a | MIOA4257 | MIOA8349 | miob3641 | ncr5819 | ncrc2092 | SEOA3978a | SEOB0264 | seob5392 |
| MIOA0141 | MIOA4289a | MIOA8366 | miob3672 | ncr6044 | ncrc3923 | SEOA4109a | SEOB0318 | seob5470 |
| MIOA0146 | MIOA4293a | MIOA8368 | miob3913 | ncr6760 | ncrc6311 | SEOA4110a | SEOB0367 | seob5505 |
| MIOA0179 | MIOA4353a | MIOA8409 | miob3943 | ncr6837 | ncrc6488 | SEOA4315a | SEOB0387 | seob5665 |
| MIOA0231a | MIOA4515a | MIOA8553 | miob4225 | ncr7016 | ncrc9180 | SEOA4370a | SEOB0408 | seob5683 |
| MIOA0242a | MIOA4610a | MIOA8591 | miob4242 | ncr7764 | ncrc9588 | SEOA4451a | SEOB0484 | seob5827 |
| MIOA0338 | MIOA4679 | MIOA8595 | miob4266 | ncr7901 | ncrc9892 | SEOA4497 | SEOB0529 | seob5861 |
| MIOA0387a | MIOA4680 | MIOA8625 | miob4270 | ncr7946 | seoa0265m | SEOA4585 | SEOB0530 | seob5983 |
| mioa0463m | MIOA4722 | MIOA8664 | miob4617 | ncr8261 | SEOA0286 | SEOA4770a | SEOB0622 | seob6068 |
| MIOA0471 | MIOA4745 | MIOA8741 | miob4624 | ncr8335 | SEOA0338 | SEOA5029a | SEOB0705a | seob6173 |
| MIOA0476 | MIOA4806a | MIOA8976 | miob4630 | ncr8437 | SEOA0395 | SEOA5304a | SEOB0870a | seob6334 |
| MIOA0532 | MIOA4817a | MIOA9070 | miob4643 | ncr8663 | SEOA0398 | SEOA5313a | SEOB0894a | seob6424 |
| MIOA0537 | MIOA4842a | MIOA9081 | miob4690 | ncr8775 | SEOA0456 | SEOA5399 | SEOB0953 | seob6547 |
| MIOA0696 | MIOA4929a | MIOA9113 | miob5049 | ncr9202 | SEOA0760 | SEOA5529a | SEOB0990 | seob6603 |
| MIOA0966 | MIOA4935a | MIOA9151 | miob5082 | ncr9824 | SEOA0778 | SEOA5555a | SEOB1168 | seob6791 |
| MIOA1001 | MIOA4998a | MIOA9163 | miob5100 | ncr9947 | SEOA0780 | SEOA5604a | SEOB1202 | seob6803 |
| MIOA1047 | MIOA5034a | MIOA9167 | miob5785 | ncr9980 | SEOA0820 | SEOA5702a | SEOB1229 | seob6847 |
| MIOA1050 | MIOA5047a | mioa9252 | miob5815 | ncrb0281 | SEOA0831 | SEOA5754a | SEOB1406 | seob6860 |
| MIOA1235 | MIOA5210a | mioa9632 | miob5952 | ncrb0531 | SEOA0857 | SEOA5855 | SEOB1655 | seob7202 |
| MIOA1332a | MIOA5226a | mioa9704 | miob5956 | ncrb0829 | SEOA0916 | SEOA6007a | SEOB1855 | seob7231 |
| MIOA1336a | MIOA5367a | mioa9871 | miob5975 | ncrb0854 | SEOA1063a | SEOA6300 | SEOB1961 | seob7414 |
| MIOA1552 | MIOA5525a | mioa9920 | miob5977 | ncrb0861 | SEOA1407 | SEOA6486a | SEOB1996 | seob7423 |
| MIOA1563m | MIOA5632a | mioa9971 | miob6007 | ncrb1668 | SEOA1519 | SEOA6492a | SEOB2009 | seob7564 |
| MIOA1577 | MIOA5649 | miob0157 | miob6125 | ncrb2071 | SEOA1679a | SEOA7076a | SEOB2151 | seob7580 |
| MIOA1613a | MIOA5689 | miob0165 | miob6126 | ncrb2416 | SEOA1794a | SEOA7136a | SEOB2214 | seob7600 |
| MIOA1904a | MIOA5766a | miob0377 | miob6204 | ncrb2681 | SEOA1853a | SEOA7332a | SEOB2215 | seob7618 |
| MIOA1909a | MIOA5899a | miob0419 | miob6312 | ncrb2850 | SEOA1861a | SEOA7606a | SEOB2217 | seob7653 |
| MIOA2110 | MIOA6038 | miob0451 | miob6696 | ncrb3080 | SEOA1942 | SEOA7641a | SEOB2688 | seob7769 |
| mioa2133m | MIOA6106a | MIOB0538 | miob6817 | ncrb3205 | SEOA1967a | seoa7862a | SEOB2722 | seob7920 |
| MIOA2141 | MIOA6185a | miob0547n | miob6833 | ncrb3519 | SEOA2039 | seoa8008 | SEOB3010 | seob8020 |
| MIOA2175a | MIOA6191a | miob0770 | miob6837 | ncrb3536 | SEOA2046 | SEOA8378a | SEOB3029 | seob8094 |
| MIOA2227a | MIOA6651a | miob1159 | miob6939 | ncrb3597 | SEOA2059 | SEOA8390a | SEOB3209 | seob8177 |
| MIOA2244a | MIOA6668a | miob1200 | miob6976 | ncrb3919 | SEOA2085 | SEOA8517 | SEOB3299 | seob8248 |
| MIOA2270a | MIOA6845a | miob1270 | miob7001 | ncrb4213 | SEOA2110n | SEOA8557 | SEOB3459 | seob8249 |
| MIOA2371a | MIOA6923a | miob1277 | ncr0733 | ncrb4482 | SEOA2191a | SEOA8744 | SEOB3489 | SOA0234 |
| MIOA2553a | MIOA6987a | miob1307 | ncr0956 | ncrb4799 | SEOA2193a | SEOA8873 | SEOB3509 | SOA0612 |
| MIOA2839a | MIOA7127a | miob1391 | ncr1361 | ncrb5916 | SEOA2274a | SEOA8955 | SEOB3512 | soa0613n |
| MIOA2927a | MIOA7178a | MIOB1509 | ncr1398 | ncrb6138 | SEOA2387a | SEOA8972 | SEOB3546 | SOA0614 |
| MIOA2990a | MIOA7208a | miob1808 | ncr1527 | ncrb6316 | SEOA2437a | SEOA8977 | seob3674 | |
| MIOA3023a | MIOA7267a | miob1940 | ncr1685 | ncrb6328 | SEOA2513 | SEOA9040 | seob3944 | |
| MIOA3153a | MIOA7298 | MIOB2157 | ncr1694 | ncrb6698 | SEOA2614 | SEOA9118 | seob3985 | |
| MIOA3179a | MIOA7307 | MIOB2244 | ncr1744 | ncrb7515 | SEOA2656 | SEOA9272 | seob4089 | |
| MIOA3187a | MIOA7390a | MIOB2300 | ncr2205 | ncrb7800 | SEOA2657 | SEOA9320 | seob4097 | |

Figure 6A - EST Names Corresponding to Unique Known Genes of Figure 6

7. nproteoglycan 4 (=megakaryocyte stimulating factor) AAB09089.1 486

| | | | | | | | | |
|---|---|---|---|---|---|---|---|---|
| BFCS0347 | MIOA2180a | MIOA4881a | MIOA8624 | miob2408 | miob5112 | ncr5223 | ncrb7118 | ncrc9721 |
| BFCW0415 | MIOA2299a | MIOA4993a | MIOA8671 | miob2464 | miob5129 | ncr5482 | ncrb7797 | ncrc9917 |
| FCR0264 | MIOA2311a | MIOA5070a | MIOA8787 | miob2509 | miob5424 | ncr5506 | ncrb7888 | ncrc9962 |
| FCR1431 | MIOA2315a | MIOA5096a | MIOA8822 | miob2519 | miob5428 | ncr5576 | ncrb8281 | SEOA1486 |
| FCR4086 | MIOA2418a | MIOA5354a | MIOA8823 | miob2523 | miob5494 | ncr5660 | ncrb8328 | SEOA1499 |
| FCR4931 | MIOA2491a | MIOA5489a | MIOA8827 | miob2542 | miob5613 | ncr6009 | ncrb8409 | SEOA1682a |
| FCR5798 | MIOA2545a | MIOA5497a | MIOA8830 | MIOB2584 | miob5635 | ncr6063 | ncrb8814 | SEOA2259a |
| FCR6725 | MIOA2554a | MIOA5597a | MIOA8850 | MIOB2695 | miob5773 | ncr6091 | ncrc0268 | seoa2869m |
| hfcr6734 | MIOA2558a | MIOA5616a | MIOA9004 | MIOB2818 | miob5837 | ncr6278 | ncrc0639 | SEOA3029a |
| hfcr8016 | MIOA2559a | MIOA5634a | MIOA9126 | miob2896 | miob5972 | ncr6301 | ncrc0753 | SEOA3033a |
| MIOA0031a | MIOA2634 | MIOA5698 | mioa9227 | miob2986 | miob6145 | ncr6661 | ncrc0965 | SEOA3421a |
| MIOA0096a | MIOA2711a | MIOA5791a | mioa9375 | miob3142 | miob6208 | ncr7589 | ncrc1112 | SEOA4602a |
| MIOA0134 | MIOA2757a | MIOA5932a | mioa9416 | miob3189 | miob6292 | ncr8219 | ncrc1292 | seoa4949a |
| MIOA0180 | MIOA2809a | MIOA5978a | mioa9469 | miob3223 | miob6357 | ncr8441 | ncrc1371 | SEOA5367 |
| MIOA0280 | MIOA2863a | mioa5988a | mioa9524 | miob3233 | miob6522 | ncr8635 | ncrc1563 | SEOA5474a |
| MIOA0310 | MIOA2943a | MIOA6126a | mioa9527 | miob3245 | miob6566 | ncr8636 | ncrc1744 | SEOA6061a |
| mioa0350m | MIOA2960a | MIOA6250a | mioa9578 | miob3444 | miob6579 | ncr8648 | ncrc1816 | SEOA6322 |
| MIOA0379a | MIOA2976a | MIOA6500a | mioa9653 | miob3494 | miob6619 | ncr8712 | ncrc1919 | SEOA6370 |
| MIOA0517 | MIOA2983a | MIOA6526a | mioa9663 | miob3644 | miob6667 | ncr8735 | ncrc2016 | SEOA7282a |
| MIOA0518 | MIOA2996a | MIOA6531a | mioa9667 | miob3660 | miob6682 | ncr8763 | ncrc2082 | SEOA7611a |
| MIOA0519n | MIOA3048a | MIOA6553a | mioa9785 | miob3682 | miob6799 | ncr8974 | ncrc2286 | seoa8089 |
| MIOA0688 | MIOA3106a | MIOA6563a | mioa9838 | miob3706 | miob6890 | ncr9152 | ncrc2296 | seoa8094 |
| MIOA0705 | MIOA3152a | MIOA6586a | mioa9992 | miob3728 | miob6924 | ncr9389 | ncrc2348 | seoa8095 |
| MIOA0733 | MIOA3173a | MIOA6677a | miob0151 | miob3748 | miob6935 | ncr9420 | ncrc2496 | seoa8104 |
| MIOA0735 | MIOA3192a | MIOA6828a | miob0212 | miob3792 | miob6998 | ncr9533 | ncrc2725 | SEOA8661 |
| MIOA0794 | MIOA3315a | MIOA6874a | miob0214 | miob3831 | miob7005 | ncr9597 | ncrc3112 | SEOA8900 |
| MIOA1013 | MIOA3322a | MIOA6879a | miob0243 | miob3861 | miob7014 | ncr9607 | ncrc3148 | SEOA9418 |
| MIOA1014 | MIOA3326a | MIOA6937a | miob0311 | miob3929 | ncr0036 | ncr9658 | ncrc3201 | SEOA9508 |
| mioa1034m | MIOA3346a | MIOA6964a | MIOB0328 | miob3951 | ncr0535 | ncr9852 | ncrc3369 | SEOA9682 |
| MIOA1051 | MIOA3362a | MIOA6986a | miob0348 | miob4011 | ncr0687 | ncr9945 | ncrc3794 | SEOA9849 |
| mioa1101m | MIOA3381a | MIOA7068a | miob0403 | miob4046 | ncr0969 | ncrb0729 | ncrc3852 | SEOB0608 |
| MIOA1106 | MIOA3401a | MIOA7273 | miob0439 | miob4079 | ncr1177 | ncrb1591 | ncrc3933 | SEOB0757 |
| MIOA1167 | MIOA3429a | MIOA7374a | miob0449 | miob4102 | ncr1283 | ncrb2294 | ncrc4005 | SEOB1162 |
| MIOA1181 | MIOA3455a | MIOA7402a | MIOB0469 | miob4109 | ncr1567 | ncrb2309 | ncrc4007 | SEOB1570 |
| MIOA1190n | MIOA3501a | MIOA7532a | MIOB0572 | miob4119 | ncr1575 | ncrb2701 | ncrc4122 | SEOB1689 |
| MIOA1205 | MIOA3580a | MIOA7572a | miob0712 | miob4156 | ncr1608 | ncrb3063 | ncrc4424 | SEOB2025 |
| MIOA1208 | MIOA3596a | mioa7641a | miob0720 | miob4159 | ncr1623 | ncrb3544 | ncrc4683 | SEOB3051 |
| MIOA1211 | MIOA3698a | mioa7644a | miob0735n | miob4208 | ncr1815 | ncrb3568 | ncrc4685 | SEOB3114 |
| MIOA1225 | MIOA3813 | mioa7653a | miob0752 | miob4210 | ncr1911 | ncrb3572 | ncrc4793 | SEOB3328 |
| MIOA1237 | MIOA3882a | mioa7685a | miob0890 | miob4324 | ncr2617 | ncrb3949 | ncrc4812 | seob3991 |
| MIOA1244m | MIOA3941a | mioa7846a | miob0913 | miob4670 | ncr2982 | ncrb4063 | ncrc4867 | seob4157 |
| MIOA1245 | MIOA3948a | MIOA7958a | miob1119 | miob4672 | ncr3022 | ncrb4762 | ncrc5280 | seob4722 |
| MIOA1316a | MIOA3964a | MIOA7967a | miob1158 | miob4700 | ncr3023 | ncrb5499 | ncrc5451 | seob4783 |
| MIOA1317a | MIOA3994a | MIOA8069 | miob1196 | miob4710 | ncr3115 | ncrb5569 | ncrc5557 | seob5464 |
| MIOA1390a | MIOA4043a | MIOA8122 | miob1242 | miob4717 | ncr3224 | ncrb5611 | ncrc5928 | seob5842 |
| MIOA1576 | MIOA4085a | MIOA8163 | MIOB1490 | miob4775 | ncr3338 | ncrb5859 | ncrc6084 | seob6085 |
| MIOA1760 | MIOA4145 | MIOA8198 | MIOB1497 | miob4820 | ncr3445 | ncrb5873 | ncrc6456 | seob6444 |
| MIOA1817a | MIOA4398 | MIOA8205 | miob1696 | miob4825 | ncr3569 | ncrb5966 | ncrc6740 | seob6626 |
| MIOA1825a | MIOA4510a | MIOA8225 | miob1735 | miob4873 | ncr3764 | ncrb5992 | ncrc6845 | seob7266 |
| MIOA1837a | MIOA4543a | MIOA8247 | miob1843 | miob4879 | ncr4045 | ncrb6260 | ncrc6906 | seob7362 |
| MIOA2007 | MIOA4617a | MIOA8334 | miob1849 | miob4907 | ncr4090 | ncrb6369 | ncrc8849 | seob7935 |
| MIOA2024 | MIOA4629a | MIOA8387 | MIOB2109 | miob4935 | ncr4364 | ncrb6471 | ncrc8888 | SOA0141 |
| MIOA2155a | MIOA4684 | MIOA8454 | MIOB2114 | miob4965 | ncr4625 | ncrb6615 | ncrc9049 | soa0196n |
| MIOA2176a | MIOA4699 | MIOA8592 | MIOB2125 | miob5011 | ncr4792 | ncrb6636 | ncrc9112 | SOA0467 |

Figure 6A – EST Names Corresponding to Unique Known Genes of Figure 6

8. collagen type I alpha 2 (COL1A2) NM_000089.1 449

| | | | | | | | | |
|---|---|---|---|---|---|---|---|---|
| BFCN0005 | FCR3953 | fcrb2104 | hfcr9871 | ncr4775 | ncrc1825 | SEOA2328a | SEOA8176a | SEOB2804 |
| BFCN0050 | FCR3974 | fcrb2213 | hfcr9897 | ncr4829 | ncrc2063 | SEOA2555 | SEOA8197a | SEOB2805 |
| BFCN0062 | FCR4059 | fcrb2328 | hfcr9959 | ncr5202 | ncrc2590 | SEOA2593m | SEOA8344a | SEOB3109 |
| BFCN0225 | FCR4072 | fcrb2329 | MIOA0086a | ncr5764 | ncrc2863 | SEOA2769 | seoa8812n | SEOB3165 |
| BFCS0326 | FCR4137 | hfcr0085 | MIOA0097 | ncr6033 | ncrc2926 | SEOA2912a | SEOA9025 | SEOB3235 |
| BFCS0508 | FCR4149 | hfcr0181 | MIOA0901a | ncr6394 | ncrc3060 | SEOA3070a | SEOA9084 | SEOB3354 |
| BFCS0553n | FCR4220 | hfcr0267 | MIOA1053 | ncr7823 | ncrc3199 | seoa3150m | seoa9164n | SEOB3411 |
| CR0093 | FCR4316 | hfcr0287 | MIOA1359a | ncr8039 | ncrc3643 | SEOA3524a | SEOA9207 | seob3701 |
| CR0274 | FCR4703 | hfcr0326 | MIOA1956a | ncr8076 | ncrc3759 | SEOA3802a | SEOA9419 | seob4086 |
| CR0291 | FCR4983 | hfcr0418 | MIOA3886a | ncr8095 | ncrc3765 | SEOA3846 | SEOA9598 | seob4228 |
| CR0484 | FCR5033 | hfcr0442 | MIOA5080a | ncr8318 | ncrc4125 | SEOA4278a | SEOA9799 | seob4229 |
| CR0725 | FCR5167 | hfcr0483 | MIOA5600a | ncr8467 | ncrc4436 | SEOA4371a | SEOA9886 | seob4355 |
| CR0912 | FCR5261 | hfcr0709 | MIOA5719 | ncr8477 | ncrc4964 | SEOA4412a | SEOB0070 | seob4472 |
| CR0992 | FCR5703 | hfcr0806 | MIOA5914a | ncr9204 | ncrc5000 | SEOA4507 | SEOB0136 | seob4614 |
| FCR0162 | FCR5943 | hfcr1095 | MIOA6212a | ncrb0242 | ncrc5233 | SEOA4511 | SEOB0165 | seob4615 |
| FCR0304 | FCR6710 | hfcr1408 | MIOA6362a | ncrb0334 | ncrc5921 | SEOA4513 | SEOB0335 | seob4626 |
| FCR0395 | FCR6838 | hfcr1677 | MIOA6733a | ncrb0568 | ncrc6137 | SEOA4563 | SEOB0378 | seob4810 |
| FCR0497 | FCR6879 | hfcr1815 | MIOA6930a | ncrb1370 | ncrc6155 | SEOA4605a | SEOB0438 | seob4963 |
| FCR0640 | FCR6893 | hfcr1882 | MIOA7102a | ncrb2224 | ncrc6868 | SEOA4610a | SEOB0621 | seob5013 |
| FCR0700 | FCR6930 | hfcr1945 | MIOA8090 | ncrb2856 | ncrc7035 | SEOA4623a | SEOB0660a | seob5079 |
| FCR0825 | FCR7217 | hfcr2230 | MIOA8159 | ncrb2856 | ncrc7136 | SEOA4803a | SEOB0692a | seob5313 |
| FCR1032 | fcr7404n | HFCR3215 | MIOA8159 | ncrb2997 | ncrc9371 | seoa4920a | SEOB0728 | seob5438 |
| FCR1057 | FCR7423 | hfcr3370 | MIOA9048 | ncrb3021 | ncrc9558 | SEOA5061a | SEOB0900a | seob5578 |
| FCR1113 | FCR7428 | hfcr3591 | mioa9501 | ncrb3619 | saeoa2593m | SEOA5125a | SEOB0968 | seob5700 |
| FCR1326 | FCR7471 | hfcr4157 | mioa9864 | ncrb4056 | SEOA0032 | SEOA5144a | SEOB1254 | seob5738 |
| FCR1339 | FCR7498 | hfcr4195 | miob0937 | ncrb4371 | SEOA0053 | SEOA5276a | SEOB1263 | seob5747 |
| FCR1422 | fcrb0004 | hfcr5014 | miob0949 | ncrb4641 | SEOA0058 | SEOA5360 | SEOB1291 | seob5803 |
| FCR1429 | fcrb0032 | hfcr5649 | miob1755 | ncrb4761 | SEOA0059 | SEOA5412 | SEOB1332 | seob5917 |
| FCR1487 | fcrb0042 | hfcr6060 | MIOB2665 | ncrb4778 | SEOA0081 | SEOA5419 | SEOB1336 | seob6024 |
| FCR1504 | fcrb0261 | hfcr6065 | miob3598 | ncrb4878 | SEOA0122 | SEOA5548a | SEOB1556 | seob6138 |
| FCR1845 | fcrb0429 | hfcr6393 | miob3598 | ncrb5328 | SEOA0134 | SEOA5553a | SEOB1577 | seob6419 |
| FCR1941 | fcrb0991 | hfcr6719 | miob4071 | ncrb5353 | SEOA0278n | SEOA5643a | SEOB1641 | seob6563 |
| FCR2038 | fcrb0997 | hfcr6837 | miob4882 | ncrb5683 | SEOA0314 | SEOA5953 | SEOB1732 | seob6771 |
| FCR2051 | fcrb1081 | hfcr6858 | miob6233 | ncrb6122 | SEOA0583 | SEOA5963 | SEOB1740 | seob6786 |
| FCR2058 | fcrb1128 | hfcr7048 | miob6304 | ncrb6241 | SEOA0744 | SEOA5981a | SEOB1900 | seob6798 |
| FCR2114 | fcrb1128 | hfcr7394 | ncr0020 | ncrb6708 | SEOA0796 | SEOA6409 | SEOB1936 | seob7307 |
| FCR2275 | fcrb1243 | hfcr7419 | ncr0667 | ncrb6985 | SEOA0998 | SEOA6455a | SEOB1951 | seob7401 |
| FCR2297 | fcrb1357 | hfcr7496 | ncr0910 | ncrb7081 | SEOA1007n | SEOA6520a | SEOB2057 | seob7406 |
| FCR2314 | fcrb1429 | hfcr8028 | ncr1512 | ncrb8040 | SEOA1152a | SEOA6611a | SEOB2115 | seob7457 |
| FCR2410 | fcrb1546 | hfcr8369 | ncr1602 | ncrb8164 | SEOA1292a | seoa6783 | SEOB2168 | seob7531 |
| FCR2612 | fcrb1574 | hfcr8464 | ncr2659 | ncrb8251 | SEOA1335 | SEOA7149a | SEOB2243 | seob7623 |
| FCR2947 | fcrb1622 | hfcr8632 | ncr3360 | ncrb8764 | SEOA1388 | SEOA7162a | SEOB2253 | seob7730 |
| FCR3014 | fcrb1622 | hfcr8679 | ncr3373 | ncrc0693 | SEOA1414a | SEOA7221a | seob2589 | seob7875 |
| FCR3030 | fcrb1744 | hfcr8727 | ncr3671 | ncrc0780 | SEOA1594a | SEOA7309a | seob2600 | seob8341 |
| FCR3074 | fcrb1805 | hfcr8898 | ncr3999 | ncrc0800 | SEOA1764a | SEOA7512a | SEOB2651 | SOA0077 |
| FCR3453 | fcrb1805 | hfcr9315 | ncr4094 | ncrc1013 | SEOA1879 | SEOA7560a | SEOB2666 | SOA0077 |
| FCR3592 | fcrb1986 | hfcr9402 | ncr4172 | ncrc1148 | SEOA1907 | SEOA7636a | SEOB2674 | SOA0308 |
| FCR3661 | fcrb1999 | hfcr9507 | ncr4355 | ncrc1207 | SEOA1958 | SEOA7644a | SEOB2678 | SOA0310 |
| FCR3845 | fcrb2039 | hfcr9514 | ncr4481 | ncrc1226 | SEOA1968a | seoa7715a | SEOB2773 | SOA0310 |
| FCR3894 | fcrb2104 | hfcr9623 | ncr4540 | ncrc1339 | SEOA2327a | seoa7887a | SEOB2801 | |

9. mitochondrion, complete genome (=AF382012.1 haplotype M*1 mitochondrion) "NC_001807.2 443

| | | | | | | | | |
|---|---|---|---|---|---|---|---|---|
| FCR5088 | fcrb1759 | fcrb2636 | hfcr0519 | hfcr1959 | hfcr2523 | hfcr2811 | hfcr3468 | hfcr5257 |
| fcrb0308 | fcrb2336 | fcrb2733 | hfcr1738 | hfcr2022 | hfcr2559 | hfcr3044 | hfcr3766 | hfcr5420 |
| fcrb0358 | fcrb2404 | fcrb2751 | hfcr1772 | hfcr2022 | hfcr2580 | hfcr3407 | hfcr5162 | hfcr5658 |
| fcrb0712 | fcrb2441 | hfcr0402 | hfcr1822 | hfcr2052 | hfcr2613 | hfcr3410 | hfcr5170 | hfcr5704 |
| fcrb1759 | fcrb2560 | hfcr0441 | hfcr1917 | hfcr2306 | hfcr2728 | hfcr3463 | hfcr5225 | hfcr5720 |

Figure 6A – EST Names Corresponding to Unique Known Genes of Figure 6

| | | | | | | | | |
|---|---|---|---|---|---|---|---|---|
| hfcr5803 | hfcr9265 | MIOA8992 | miob3434 | ncr1886 | ncr5212 | ncr8059 | SEOA4784a | SEOB3045 |
| hfcr5911 | hfcr9286 | miob0197 | miob3472 | ncr1906 | ncr5237 | ncr8198 | seoa4959a | SEOB3144 |
| hfcr5973 | hfcr9510 | miob0236 | miob3479 | ncr2081 | ncr5312 | ncr8377 | SEOA5420 | SEOB3210 |
| hfcr5996 | hfcr9569 | miob0267 | miob3483 | ncr2096 | ncr5515 | ncr8640 | seoa6837 | SEOB3237 |
| hfcr6057 | hfcr9677 | miob0268 | miob3501 | ncr2152 | ncr5628 | ncr8689 | SEOA6928 | SEOB3256 |
| hfcr6253 | hfcr9679 | miob0273 | miob3669 | ncr2152 | ncr5637 | ncr8785 | seoa7010 | SEOB3256 |
| hfcr6307 | MIOA0101 | miob0310 | miob3837 | ncr2252 | ncr5823 | ncr9040 | SEOA7120a | SEOB3355 |
| hfcr6312 | MIOA0277 | MIOB0466 | miob3920 | ncr2350 | ncr6047 | ncr9098 | seoa7705a | SEOB3355 |
| hfcr6320 | MIOA0318 | miob0685 | miob3961 | ncr2380 | ncr6123 | ncr9162 | seoa7811a | seob4418 |
| hfcr6326 | MIOA1622a | miob0835n | miob3962 | ncr2398 | ncr6128 | ncr9504 | seoa7844a | seob4827 |
| hfcr6474 | MIOA1702a | miob1012 | miob3984 | ncr2629 | ncr6165 | ncr9700 | seoa7863a | seob4831 |
| hfcr6563 | MIOA2066 | miob1023 | miob4030 | ncr2911 | ncr6200 | ncr9838 | SEOA8340a | seob4919 |
| hfcr6595 | MIOA2310a | miob1023 | miob4073 | ncr2937 | ncr6224 | ncr9862 | SEOA8471 | seob5457 |
| hfcr6616 | MIOA2355a | miob1041 | miob4195 | ncr2953 | ncr6245 | ncr9893 | SEOA8483 | seob5945 |
| hfcr6736 | MIOA2581a | miob1107 | miob4199 | ncr2972 | ncr6252 | ncr9897 | SEOA8484 | seob5969 |
| hfcr6810 | MIOA3305a | miob1333 | miob4223 | ncr2977 | ncr6277 | ncrb0017 | SEOA8498 | seob5980 |
| hfcr6916 | MIOA3483a | miob1335 | miob4267 | ncr3003 | ncr6325 | ncrb0024 | SEOA8625 | seob6021 |
| hfcr6938 | MIOA3710a | miob1388 | miob4419 | ncr3031 | ncr6330 | ncrb0153 | SEOA8650 | seob6078 |
| hfcr6982 | MIOA3787 | miob1440 | miob4421 | ncr3066 | ncr6331 | ncrb1059 | SEOA8699 | seob6081 |
| hfcr6985 | MIOA4127 | MIOB1524 | miob4437 | ncr3072 | ncr6360 | ncrb1546 | SEOA8757 | seob6088 |
| hfcr7008 | MIOA4148 | miob1719 | miob4465 | ncr3079 | ncr6393 | ncrb1557 | SEOA8773 | seob6113 |
| hfcr7022 | MIOA4235 | miob1851 | miob5056 | ncr3087 | ncr6412 | ncrb1648 | SEOA8818 | seob6164 |
| hfcr7054 | MIOA4366a | miob1859 | miob5612 | ncr3107 | ncr6548 | ncrb2007 | SEOA8924 | seob6193 |
| hfcr7423 | MIOA4790a | miob1936 | miob5701 | ncr3196 | ncr6746 | ncrb3140 | SEOA8939 | seob6894 |
| hfcr7469 | MIOA5008a | miob1949 | miob5820 | ncr3250 | ncr6813 | ncrb3173 | SEOA9103 | seob7161 |
| hfcr7605 | MIOA5479a | MIOB2147 | miob5820 | ncr3251 | ncr6867 | ncrb3567 | SEOA9226 | seob7173 |
| hfcr7668 | mioa5627a | MIOB2261 | miob5996 | ncr3417 | ncr6891 | ncrb7491 | SEOA9230 | seob7588 |
| hfcr7702 | MIOA5714 | miob2400 | miob6289 | ncr3474 | ncr6945 | ncrb7669 | SEOA9765 | seob7603 |
| hfcr7796 | MIOA5895a | miob2486 | miob6419 | ncr3479 | ncr6979 | ncrb8120 | SEOA9833 | seob8071 |
| hfcr7820 | MIOA5958a | miob2497 | miob6634 | ncr3571 | ncr7051 | ncrb8206 | SEOB0275 | seob8080 |
| hfcr8206 | MIOA6451a | miob2507 | ncr0011 | ncr3668 | ncr7072 | ncrc0554 | SEOB0353 | seob8176 |
| hfcr8234 | MIOA6550a | miob2508 | ncr0013 | ncr3791 | ncr7162 | ncrc0741 | SEOB0533 | seob8211 |
| hfcr8451 | MIOA6794a | miob2510 | ncr0073 | ncr4348 | ncr7164 | ncrc0750 | SEOB0829a | seob8227 |
| hfcr8504 | mioa7646a | miob2520 | ncr0313 | ncr4354 | ncr7373 | ncrc0796 | SEOB1167 | seob8236 |
| hfcr8515 | mioa7659a | miob2534 | ncr0580 | ncr4437 | ncr7396 | ncrc0799 | SEOB1234 | seob8237 |
| hfcr8538 | mioa7763a | miob2539 | ncr0626 | ncr4529 | ncr7841 | ncrc2568 | SEOB1360 | seob8238 |
| hfcr8760 | mioa7839a | MIOB2643 | ncr0729 | ncr4605 | ncr7857 | SEOA0050 | SEOB1392 | seob8320 |
| hfcr8780 | mioa7870 | MIOB2842 | ncr0826 | ncr4623 | ncr7859 | SEOA1512 | SEOB1824 | SOA0125 |
| hfcr8860 | mioa7873 | MIOB2853 | ncr0872 | ncr4749 | ncr7885 | SEOA1767a | SEOB1933 | |
| hfcr9047 | mioa7899 | miob2976 | ncr1256 | ncr4780 | ncr7908 | SEOA2354a | SEOB2679 | |
| hfcr9073 | mioa7919 | miob3032 | ncr1513 | ncr4858 | ncr7957 | SEOA3939 | SEOB2760 | |
| hfcr9171 | MIOA8907 | miob3156 | ncr1589 | ncr5131 | ncr7989 | SEOA4230a | SEOB2774 | |
| hfcr9211 | MIOA8953 | miob3311 | ncr1671 | ncr5160 | ncr7999 | SEOA4231a | SEOB2778 | |
| hfcr9216 | MIOA8953 | miob3340 | ncr1841 | ncr5173 | ncr8008 | SEOA4428a | SEOB2929 | |
| hfcr9218 | MIOA8992 | miob3352 | ncr1845 | ncr5195 | ncr8017 | SEOA4476a | SEOB2956 | |

10. collagen type II alpha 1 (COL2A1) J00116.1 360

| | | | | | | | | |
|---|---|---|---|---|---|---|---|---|
| ncrc6204 | ncrc6785 | BFCW0378 | CR0565 | FCR1429 | FCR2869 | FCR3702 | FCR4440 | FCR5770 |
| ncrc6152 | ncrc6882 | BFCW0425 | CR0750 | FCR1448 | FCR2980 | FCR3703 | FCR5004 | FCR5795 |
| ncrc6701 | ncrc6901 | CR0033 | CR0816 | FCR1487 | FCR3068 | FCR3831 | FCR5033 | FCR5797 |
| ncrc7182 | BFCN0081 | CR0038 | FCR0367 | FCR1556 | FCR3100 | FCR3928 | FCR5059 | FCR6047 |
| ncrc3826 | BFCN0225 | CR0270 | FCR0369 | FCR1763 | fcr3109 | FCR4018 | FCR5167 | FCR6205 |
| ncrc3755 | BFCN0268 | CR0276 | FCR0569 | FCR1820 | FCR3152 | FCR4034 | FCR5362 | FCR6269 |
| ncrc5840 | BFCS0292 | CR0323 | FCR0810 | FCR1963 | FCR3178 | FCR4043 | fcr5387n | FCR6282 |
| ncrc6019 | BFCS0509 | CR0358 | FCR0822 | FCR2083 | FCR3187 | FCR4203 | FCR5422 | FCR6420 |
| ncrc5924 | BFCS0553n | CR0429 | FCR1066 | FCR2114 | FCR3332 | FCR4271 | FCR5585 | FCR6425 |
| ncrc6099 | BFCW0062 | CR0442 | FCR1326 | fcr2556n | fcr3495n | FCR4397 | FCR5701 | FCR6557 |
| ncrc5973 | BFCW0238 | CR0485 | FCR1339 | FCR2687 | FCR3504 | FCR4411 | FCR5719 | FCR6628 |
| ncrc6430 | BFCW0341 | CR0495 | FCR1422 | FCR2763 | fcr3678n | FCR4412 | FCR5761 | FCR6670 |

Figure 6A – EST Names Corresponding to Unique Known Genes of Figure 6

| | | | | | | | | |
|---|---|---|---|---|---|---|---|---|
| FCR6697 | fcrb2264 | hfcr4479 | MIOA5001a | ncr2824 | ncr7063 | ncrb0468 | ncrb7573 | ncrc2884 |
| FCR6723 | fcrb2280 | hfcr4621 | MIOA5098a | ncr3116 | ncr7219 | ncrb0600 | ncrb7813 | ncrc2989 |
| FCR6888 | fcrb2360 | hfcr5248 | MIOA5099a | ncr3169 | ncr7240 | ncrb0699 | ncrb7880 | ncrc3059 |
| FCR6962 | fcrb2672 | hfcr5745 | MIOA7451a | ncr3288 | ncr7356 | ncrb1335 | ncrb7882 | ncrc3237 |
| FCR7055 | fcrb2680 | hfcr5746 | MIOA7608a | ncr3345 | ncr7426 | ncrb1341 | ncrb7955 | ncrc3271 |
| FCR7225 | fcrb2717 | hfcr5986 | MIOA8813 | ncr3733 | ncr7481 | ncrb1679 | ncrb8031 | ncrc3287 |
| FCR7267 | fcrb2725 | hfcr6101 | MIOA9079 | ncr3739 | ncr7542 | ncrb1937 | ncrb8116 | ncrc3424 |
| FCR7344 | fcrb2740 | hfcr6642 | mioa9206 | ncr3748 | ncr7772 | ncrb2082 | ncrb8143 | ncrc4177 |
| FCR7476 | hfcr0288 | hfcr6925 | miob4876 | ncr4011 | ncr7836 | ncrb2906 | ncrb8255 | ncrc4619 |
| FCR7683 | hfcr0481 | hfcr7017 | miob6233 | ncr4032 | ncr7922 | ncrb3325 | ncrb8478 | ncrc4688 |
| FCR7692 | hfcr0575 | hfcr7034 | ncr0067 | ncr4094 | ncr8035 | ncrb3426 | ncrb8583 | ncrc4724 |
| fcrb0027 | hfcr0684 | hfcr7073 | ncr0109 | ncr4383 | ncr8068 | ncrb4123 | ncrb8810 | ncrc4840 |
| fcrb0187 | hfcr0738 | hfcr7518 | ncr0243 | ncr4512 | ncr8086 | ncrb4359 | ncrc0065 | ncrc5139 |
| fcrb0975 | hfcr1813 | hfcr8044 | ncr0244 | ncr4631 | ncr8329 | ncrb4395 | ncrc0135 | ncrc5603 |
| fcrb0994 | hfcr1956 | hfcr8057 | ncr0628 | ncr4762 | ncr8471 | ncrb4476 | ncrc0276 | ncrc8951 |
| fcrb1117 | hfcr1960 | hfcr8365 | ncr0785 | ncr4857 | ncr8498 | ncrb4541 | ncrc0315 | ncrc9013 |
| fcrb1401 | HFCR2375 | hfcr8416 | ncr0988 | ncr5209 | ncr9377 | ncrb4744 | ncrc0664 | ncrc9124 |
| fcrb1473 | hfcr2532 | hfcr8704 | ncr1127 | ncr5238 | ncr9540 | ncrb4823 | ncrc0954 | ncrc9175 |
| fcrb1514 | hfcr2688 | hfcr8989 | ncr1181 | ncr5305 | ncr9625 | ncrb5143 | ncrc1123 | ncrc9200 |
| fcrb1617 | hfcr2859 | hfcr9023 | ncr1434 | ncr5673 | ncr9766 | ncrb5402 | ncrc1148 | ncrc9356 |
| fcrb1672 | hfcr2861 | hfcr9196 | ncr1452 | ncr5702 | ncr9965 | ncrb5523 | ncrc1207 | ncrc9551 |
| fcrb1676 | hfcr2980 | hfcr9459 | ncr1536 | ncr5788 | ncrb0042 | ncrb5766 | ncrc1226 | ncrc9723 |
| fcrb1756 | HFCR3115 | hfcr9934 | ncr1571 | ncr6061 | ncrb0066 | ncrb5911 | ncrc1300 | ncrc9738 |
| fcrb1761 | HFCR3164 | MIOA1174 | ncr1682 | ncr6074 | ncrb0072 | ncrb6401 | ncrc1312 | ncrc9976 |
| fcrb1784 | HFCR3263 | MIOA1669a | ncr2099 | ncr6262 | ncrb0280 | ncrb6641 | ncrc1521 | SEOA9348 |
| fcrb1833 | hfcr3393 | MIOA1950a | ncr2384 | ncr6347 | ncrb0282 | ncrb6800 | ncrc2008 | SEOB0075 |
| fcrb1984 | hfcr4121 | MIOA3989a | ncr2659 | ncr6396 | ncrb0377 | ncrb6984 | ncrc2771 | SEOB2054 |
| fcrb2248 | hfcr4190 | MIOA4357a | ncr2767 | ncr6537 | ncrb0436 | ncrb7008 | ncrc2828 | seob6542 |

11. ribosomal DNA complete repeating unitU13369.1 357

| | | | | | | | | |
|---|---|---|---|---|---|---|---|---|
| ncrc6607 | ncrc6338 | miob0704 | ncr1863 | ncr3106 | ncr5417 | ncr8714 | ncrb0548 | ncrb3160 |
| ncrc6491 | ncrc6914 | miob0779 | ncr2009 | ncr3242 | ncr5455 | ncr8726 | ncrb0619 | ncrb3285 |
| ncrc6529 | ncrc6943 | miob0816 | ncr2045 | ncr3264 | ncr5533 | ncr8823 | ncrb0689 | ncrb3371 |
| ncrc6547 | ncrc6983 | miob1225 | ncr2049 | ncr3295 | ncr5545 | ncr8845 | ncrb0748 | ncrb3390 |
| ncrc6555 | ncrc7036 | miob1934 | ncr2100 | ncr3381 | ncr5712 | ncr8858 | ncrb0830 | ncrb3520 |
| ncrc1667 | fcr2707nn | miob2407 | ncr2119 | ncr3401 | ncr5873 | ncr8939 | ncrb0851 | ncrb3550 |
| ncrc6502 | fcrb0145 | miob2471 | ncr2171 | ncr3507 | ncr5918 | ncr8951 | ncrb0936 | ncrb3551 |
| ncrc3715 | fcrb2291 | miob3151 | ncr2232 | ncr3557 | ncr5949 | ncr8976 | ncrb1087 | ncrb3646 |
| ncrc3388 | hfcr0497 | miob3601 | ncr2254 | ncr3585 | ncr6048 | ncr8978 | ncrb1116 | ncrb3765 |
| ncrc3701 | hfcr3546 | miob3876 | ncr2287 | ncr3597 | ncr6176 | ncr9166 | ncrb1192 | ncrb3856 |
| ncrc2251 | hfcr3923 | miob4405 | ncr2394 | ncr3599 | ncr6317 | ncr9463 | ncrb1328 | ncrb3879 |
| ncrc2411 | hfcr5038 | miob6148 | ncr2466 | ncr3775 | ncr6384 | ncr9507 | ncrb1368 | ncrb4030 |
| ncrc2528 | hfcr6355 | miob6246 | ncr2646 | ncr3853 | ncr6424 | ncr9595 | ncrb1484 | ncrb4458 |
| ncrc3863 | hfcr6611 | miob6862 | ncr2697 | ncr3912 | ncr6788 | ncr9627 | ncrb1494 | ncrb4503 |
| ncrc3962 | hfcr7675 | miob6990 | ncr2698 | ncr3925 | ncr6901 | ncr9699 | ncrb1505 | ncrb4527 |
| ncrc3861 | hfcr9646 | ncr0049 | ncr2707 | ncr4036 | ncr6905 | ncr9741 | ncrb1510 | ncrb4566 |
| ncrc4080 | mioa0787m | ncr0055 | ncr2771 | ncr4110 | ncr7085 | ncr9753 | ncrb1621 | ncrb4704 |
| ncrc4643 | MIOA0830 | ncr0092 | ncr2803 | ncr4175 | ncr7375 | ncr9829 | ncrb1685 | ncrb4845 |
| ncrc4523 | MIOA3162a | ncr0105 | ncr2833 | ncr4432 | ncr7736 | ncr9869 | ncrb1733 | ncrb5059 |
| ncrc4581 | MIOA4223 | ncr0108 | ncr2834 | ncr4491 | ncr7802 | ncr9921 | ncrb2178 | ncrb5092 |
| ncrc4823 | MIOA8128 | ncr0449 | ncr2863 | ncr4601 | ncr7848 | ncr9950 | ncrb2281 | ncrb5162 |
| ncrc4915 | MIOA8269 | ncr0484 | ncr2865 | ncr4795 | ncr8034 | ncr9976 | ncrb2320 | ncrb5432 |
| ncrc5166 | MIOA8893 | ncr0513 | ncr2888 | ncr4887 | ncr8077 | ncrb0087 | ncrb2370 | ncrb5443 |
| ncrc5096 | MIOA8904 | ncr0749 | ncr2896 | ncr4959 | ncr8157 | ncrb0101 | ncrb2693 | ncrb5491 |
| ncrc5873 | mioa9199 | ncr1080 | ncr2952 | ncr4976 | ncr8180 | ncrb0102 | ncrb2763 | ncrb5497 |
| ncrc5898 | mioa9260 | ncr1183 | ncr3018 | ncr5070 | ncr8313 | ncrb0149 | ncrb2773 | ncrb5633 |
| ncrc6054 | mioa9484 | ncr1652 | ncr3024 | ncr5080 | ncr8378 | ncrb0204 | ncrb2818 | ncrb5732 |
| ncrc6248 | miob0090 | ncr1657 | ncr3028 | ncr5354 | ncr8607 | ncrb0503 | ncrb2842 | ncrb5863 |
| ncrc6270 | miob0638 | ncr1674 | ncr3047 | ncr5402 | ncr8672 | ncrb0514 | ncrb3031 | ncrb5924 |

Figure 6A – EST Names Corresponding to Unique Known Genes of Figure 6

| | | | | | | | | |
|---|---|---|---|---|---|---|---|---|
| ncrb5959 | ncrb7220 | ncrb8121 | ncrc1000 | ncrc1764 | ncrc2835 | ncrc6979 | ncrc9682 | SEOB3547 |
| ncrb6202 | ncrb7233 | ncrb8176 | ncrc1067 | ncrc1832 | ncrc2972 | ncrc8910 | ncrc9776 | seob3945 |
| ncrb6321 | ncrb7235 | ncrb8327 | ncrc1126 | ncrc1849 | ncrc3098 | ncrc9012 | ncrc9911 | seob4779 |
| ncrb6387 | ncrb7349 | ncrb8557 | ncrc1137 | ncrc1951 | ncrc3198 | ncrc9047 | ncrc9928 | seob5192 |
| ncrb6555 | ncrb7531 | ncrb8618 | ncrc1146 | ncrc1969 | ncrc3325 | ncrc9073 | SEOA2160 | seob5330 |
| ncrb6773 | ncrb7605 | ncrb8683 | ncrc1184 | ncrc1981 | ncrc3805 | ncrc9098 | SEOA3777a | seob6327 |
| ncrb6788 | ncrb7630 | ncrc0171 | ncrc1201 | ncrc2055 | ncrc4594 | ncrc9246 | SEOA8474 | seob6565 |
| ncrb6863 | ncrb7792 | ncrc0212 | ncrc1343 | ncrc2208 | ncrc5098 | ncrc9248 | SEOA9624 | seob7368 |
| ncrb6895 | ncrb7812 | ncrc0448 | ncrc1437 | ncrc2585 | ncrc5835 | ncrc9306 | SEOB0016 | |
| ncrb7095 | ncrb8052 | ncrc0474 | ncrc1572 | ncrc2622 | ncrc6173 | ncrc9364 | SEOB1771 | |
| ncrb7153 | ncrb8080 | ncrc0861 | ncrc1747 | ncrc2747 | ncrc6228 | ncrc9386 | SEOB2129 | |

12. elongation factor 1 alpha 1 (EEF1A1) NM_001402.1 341

| | | | | | | | | |
|---|---|---|---|---|---|---|---|---|
| ncrc3488 | FCR1226 | FCR7119 | HFCR3250 | hfcr9501 | miob5950 | ncrb0677 | SEOA2998a | SEOB0693a |
| ncrc3646 | FCR1329 | FCR7202 | hfcr3593 | hfcr9501 | miob6220 | ncrb1451 | SEOA3048a | SEOB0796 |
| ncrc2304 | FCR1344 | FCR7341 | hfcr3604 | hfcr9559 | miob6427 | ncrb2045 | SEOA3338a | SEOB0958 |
| ncrc2307 | FCR1356 | FCR7597 | hfcr3795 | hfcr9706 | miob6971 | ncrb2135 | SEOA3450a | SEOB1160 |
| ncrc3994 | FCR1377 | FCR7682 | hfcr3878 | hfcr9869 | ncr0180 | ncrb2809 | SEOA3502a | SEOB1463 |
| ncrc4141 | FCR1454 | fcrb0179 | hfcr3884 | hfcr9915 | ncr0185 | ncrb2809 | SEOA3507a | SEOB1711 |
| ncrc4476 | FCR1621 | fcrb0194 | hfcr3889 | MIOA0211a | ncr0206 | ncrb2834 | SEOA3965a | SEOB1777 |
| ncrc4593 | FCR1940 | fcrb0386 | hfcr4058 | MIOA0398a | ncr0299 | ncrb2836 | SEOA4390a | SEOB1856 |
| BFCN0027 | FCR1948 | fcrb0440 | hfcr5894 | mioa0558a | ncr0300 | ncrb3131 | SEOA4758a | SEOB2111 |
| BFCN0051 | FCR2046 | fcrb1219 | hfcr6022 | MIOA0691 | ncr0424 | ncrb3389 | SEOA5224a | SEOB2257 |
| BFCS0034 | FCR2166 | fcrb1355 | hfcr6102 | MIOA0703 | ncr0590 | ncrb5220 | SEOA5466a | SEOB2264 |
| BFCS0199 | FCR2200 | fcrb1458 | hfcr6104 | MIOA0924a | ncr0611 | ncrb6013 | SEOA5782 | SEOB2276 |
| BFCS0335 | FCR2267 | fcrb1850 | hfcr6244 | MIOA1526 | ncr1797 | ncrb6969 | SEOA6116a | SEOB3302 |
| BFCS0404 | FCR2278 | fcrb2004 | hfcr6407 | MIOA1895a | ncr2467 | ncrb7103 | SEOA6336 | seob3986 |
| BFCS0469n | FCR2638 | fcrb2346 | hfcr6542 | MIOA2055 | ncr2859 | ncrb7780 | SEOA6535a | seob4081 |
| BFCS0500 | FCR2848N | fcrb2436 | hfcr6560 | MIOA2690a | ncr3040 | ncrb7836 | SEOA6713 | seob4314 |
| BFCW0210 | FCR3514 | fcrb2532 | hfcr6585 | MIOA2951a | ncr3040 | ncrb8500 | SEOA7179a | seob4580 |
| BFCW0390 | FCR3892 | hfcr0030 | hfcr6588 | MIOA2966a | ncr3075 | ncrb8723 | SEOA7194a | seob4662 |
| BFCW0551n | FCR3950 | hfcr0059 | hfcr6659 | MIOA3196a | ncr3128 | ncrc0213 | SEOA7224a | seob4813 |
| BFCW0583 | FCR4243 | hfcr0334 | hfcr6725 | MIOA3507a | ncr3253 | ncrc0259 | SEOA7259a | seob4870 |
| BFCW0607 | FCR4274 | hfcr0378 | hfcr7078 | MIOA3544a | ncr3286 | ncrc0910 | SEOA7372a | seob4903 |
| CR0070 | FCR4747 | hfcr0520 | hfcr7387 | MIOA4500a | ncr3369 | ncrc3315 | SEOA7413a | seob5004 |
| CR0088 | FCR4814 | hfcr0544 | hfcr7648 | MIOA4633a | ncr3452 | ncrc8859 | SEOA7441a | seob5541 |
| CR0488 | FCR5113 | hfcr0668 | hfcr7725 | MIOA5753a | ncr3882 | ncrc9210 | SEOA7548a | seob5987 |
| CR0715 | FCR5342 | hfcr0830 | hfcr7725 | MIOA6824a | ncr5471 | ncrc9515 | seoa8028 | seob6329 |
| CR0823 | FCR5622 | hfcr0863 | hfcr7953 | MIOA7554a | ncr5779 | SEOA0366 | SEOA8190a | seob6624 |
| CR0922 | FCR5777 | hfcr0893 | hfcr8001 | MIOA8026a | ncr5818 | SEOA0414n | SEOA8316a | seob6875 |
| FCR0140 | FCR5890 | hfcr1126 | hfcr8210 | MIOA8167 | ncr6758 | SEOA0723a | SEOA8325a | seob7298 |
| FCR0168 | FCR5952 | hfcr1189 | hfcr8477 | MIOA8251 | ncr6859 | SEOA1018 | SEOA8634 | seob7459 |
| FCR0239 | FCR6158 | hfcr1207 | hfcr8910 | MIOA8300 | ncr7827 | SEOA1550 | SEOA8833 | seob7589 |
| FCR0663 | FCR6178 | hfcr1384 | hfcr9040 | MIOA8566 | ncr8020 | SEOA1641a | SEOA9049 | seob7954 |
| FCR0670 | FCR6295 | hfcr1409 | hfcr9068 | MIOA8860 | ncr8191 | SEOA1651a | SEOA9149 | seob8054 |
| FCR0740 | FCR6335 | hfcr1693 | hfcr9105 | mioa9565 | ncr8579 | SEOA2213a | SEOA9431 | seob8088 |
| FCR0845 | FCR6565 | hfcr2499 | hfcr9209 | miob0264 | ncr9022 | SEOA2435a | SEOA9505 | SOA0195 |
| FCR0858 | FCR6738 | hfcr2574 | hfcr9264 | miob1031 | ncr9066 | SEOA2511 | SEOA9759 | SOA0207 |
| FCR0870 | FCR6778 | hfcr2596 | hfcr9368 | MIOB2314 | ncr9141 | SEOA2644 | SEOB0052 | SOA0219 |
| FCR1053 | FCR6836 | hfcr2596 | hfcr9480 | miob3429 | ncr9343 | SEOA2668 | SEOB0080 | SOA0619 |
| FCR1212 | FCR6892 | HFCR3189 | hfcr9496 | miob5044 | ncrb0021 | SEOA2989a | SEOB0385 | SOA0694 |

13. lumican (LUM) NM_002345.1 340

| | | | | | | | | |
|---|---|---|---|---|---|---|---|---|
| FCR2877 | hfcr2558 | MIOA0214a | MIOA0653 | MIOA1843a | MIOA2095 | MIOA2847a | MIOA4210 | MIOA5142a |
| FCR5350 | hfcr4014 | MIOA0312n | MIOA1018 | MIOA1865a | MIOA2202a | MIOA2968a | MIOA4345a | MIOA5436a |
| FCR5945 | hfcr8821 | MIOA0536 | MIOA1246 | MIOA1937a | MIOA2439a | MIOA3659a | MIOA4589a | MIOA5512a |
| fcrb1455 | hfcr8891 | MIOA0604a | MIOA1423 | MIOA2025 | MIOA2441a | MIOA3958a | MIOA4814a | MIOA5687 |
| hfcr0199 | MIOA0056a | MIOA0622a | MIOA1793 | MIOA2088 | MIOA2779a | MIOA4200 | MIOA4934a | MIOA5688 |

Figure 6A – EST Names Corresponding to Unique Known Genes of Figure 6

| | | | | | | | | |
|---|---|---|---|---|---|---|---|---|
| MIOA5690 | mioa9896 | miob4275 | ncrb5575 | SEOA1384 | SEOA5137a | SEOA8254 | SEOB1022 | seob5802 |
| MIOA5750a | mioa9933 | miob4311 | ncrb6294 | SEOA1437a | SEOA5141a | SEOA8505 | SEOB1110 | seob5924 |
| MIOA5969a | miob0256 | miob4681 | ncrb8152 | SEOA1758a | SEOA5289a | SEOA8686 | SEOB1201 | seob6106 |
| MIOA5993a | miob0266 | miob5093 | ncrc0871 | SEOA1772a | SEOA5309a | SEOA8944 | SEOB1407 | seob6152 |
| MIOA6078a | miob0413 | miob5125 | ncrc1105 | SEOA1775a | SEOA5519a | SEOA9014 | SEOB1494 | seob6343 |
| MIOA6256a | miob0482 | miob5414 | ncrc1562 | seoa1914n | SEOA5634a | SEOA9047 | SEOB1576 | seob6533 |
| MIOA6417a | MIOB0544 | miob5853 | ncrc1776 | SEOA2137 | SEOA5789 | SEOA9072 | SEOB1920 | seob6574 |
| MIOA6578a | miob0634 | miob5939 | ncrc2392 | SEOA2430a | SEOA5791 | SEOA9101 | SEOB1924 | seob6583 |
| MIOA6649a | miob0645 | miob6244 | ncrc2474 | SEOA2477 | SEOA5974a | SEOA9108 | SEOB1985 | seob6612 |
| MIOA6851a | miob0904 | miob6441 | ncrc4105 | SEOA2845 | SEOA6012a | SEOA9201 | SEOB2005 | seob6664 |
| MIOA6908a | miob0965 | miob6855 | ncrc4175 | SEOA3000a | SEOA6018a | SEOA9323 | SEOB2122 | seob6714 |
| MIOA6978a | miob1022 | miob6888 | ncrc4725 | SEOA3004a | SEOA6162a | SEOA9332 | seob2539 | seob6755 |
| mioa7679a | miob1141 | miob7037 | ncrc4748 | SEOA3014a | SEOA6202a | SEOA9368 | SEOB3035 | seob7064 |
| mioa7732a | miob1341 | miob7040 | ncrc6993 | SEOA3064a | SEOA6244 | SEOA9479 | SEOB3050 | seob7127 |
| mioa7810a | miob1358 | ncr0485 | SEOA0069 | SEOA3078a | SEOA6415 | SEOA9574 | SEOB3102 | seob7175 |
| mioa7867 | miob1867 | ncr0527 | seoa0093m | SEOA3451a | SEOA6738 | SEOA9618 | SEOB3166 | seob7208 |
| MIOA8175 | MIOB2112 | ncr1094 | SEOA0569 | SEOA3690a | seoa6778 | SEOA9650 | SEOB3212 | seob7422 |
| MIOA8374 | MIOB2128 | ncr1292 | SEOA0724a | SEOA3817a | seoa6940 | SEOA9728 | SEOB3254 | seob7893 |
| MIOA8488 | MIOB2256 | ncr1942 | SEOA0742 | SEOA3867 | seoa6976 | SEOA9901 | SEOB3265 | seob7917 |
| MIOA8551 | MIOB2291 | ncr2392 | SEOA0834 | SEOA3959a | SEOA7062a | SEOA9917 | SEOB3273 | seob8190 |
| MIOA8757 | miob2412 | ncr4026 | SEOA0842 | SEOA4262a | SEOA7376a | SEOA9957 | seob3866 | seob8313 |
| MIOA8840 | miob2416 | ncr5744 | SEOA0879 | SEOA4277a | SEOA7420a | SEOB0097 | seob4093 | SOA0024 |
| MIOA8890 | miob2418 | ncr6679 | SEOA0903 | SEOA4320a | SEOA7425a | SEOB0116 | seob4184 | SOA0143 |
| MIOA9071 | miob2543 | ncr6688 | SEOA0937 | SEOA4394a | SEOA7491a | SEOB0413 | seob4278 | SOA0269 |
| MIOA9078 | miob2545 | ncr7450 | seoa0968m | SEOA4437a | SEOA7604a | SEOB0532 | seob4287 | soa0300n |
| MIOA9115 | miob2932 | ncr7578 | SEOA0988 | SEOA4787a | seoa7735a | SEOB0550 | seob4412 | SOA0349 |
| mioa9287 | miob3404 | ncr8973 | SEOA1090a | SEOA4820a | seoa7805a | SEOB0604 | seob4608 | SOA0448 |
| mioa9315 | miob3912 | ncrb0143 | SEOA1153a | SEOA4821a | seoa7847a | SEOB0664a | seob4619 | SOA0476 |
| mioa9360 | miob3958 | ncrb0234 | SEOA1157a | SEOA4859a | SEOA7895a | SEOB0791 | seob4643 | SOA0631 |
| mioa9739 | miob3972 | ncrb0592 | SEOA1178A | SEOA4890a | seoa7956 | SEOB0880a | seob4815 | SOA0659 |
| mioa9791 | miob4067 | ncrb4031 | SEOA1229A | seoa4998a | seoa8084 | SEOB0901a | seob4828 | SOA0684 |
| mioa9845 | miob4196 | ncrb4315 | SEOA1262A | SEOA5079a | SEOA8172a | SEOB0926 | seob5189 | |
| mioa9876 | miob4251 | ncrb4659 | SEOA1303a | SEOA5101a | SEOA8212 | SEOB0943 | seob5787 | |

14. matrix Gla protein (MGP) X53331 323

| | | | | | | | | |
|---|---|---|---|---|---|---|---|---|
| FCR5827 | MIOA2778a | MIOA6898a | miob0968 | miob5607 | ncr4035 | ncr9730 | ncrb4507 | ncrb8522 |
| hfcr0997 | MIOA2802a | MIOA7427a | miob1076 | miob5857 | ncr4041 | ncr9842 | ncrb4559 | ncrb8604 |
| hfcr2712 | MIOA3193a | MIOA7438a | miob1132 | miob5925 | ncr4117 | ncr9941 | ncrb4581 | ncrb8762 |
| hfcr3598 | MIOA3241a | mioa7672a | miob1143 | miob6001 | ncr4686 | ncrb0229 | ncrb4779 | ncrc0059 |
| hfcr5781 | MIOA3245a | mioa7684a | miob1190 | miob6090 | ncr5125 | ncrb0270 | ncrb4920 | ncrc0305 |
| hfcr8227 | MIOA3373a | mioa7694a | miob1234 | miob6213 | ncr5345 | ncrb0403 | ncrb5000 | ncrc0901 |
| MIOA0131 | MIOA3534a | mioa7934 | miob1951 | miob6822 | ncr5610 | ncrb0609 | ncrb5028 | ncrc0949 |
| MIOA0155 | MIOA3651a | MIOA8524 | MIOB2103 | ncr0416 | ncr5653 | ncrb0655 | ncrb5238 | ncrc1388 |
| MIOA0234a | MIOA3733a | MIOA8603 | MIOB2108 | ncr0559 | ncr6370 | ncrb0750 | ncrb5358 | ncrc1517 |
| MIOA0410a | MIOA3776 | MIOA8845 | miob2388 | ncr1115 | ncr6560 | ncrb0751 | ncrb5723 | ncrc1758 |
| MIOA0413a | MIOA3809 | MIOA9111 | miob2489 | ncr1783 | ncr6657 | ncrb1088 | ncrb6275 | ncrc2378 |
| MIOA0475 | MIOA3902a | mioa9337 | MIOB2693 | ncr1784 | ncr6673 | ncrb1144 | ncrb6390 | ncrc2380 |
| MIOA0585a | MIOA4065a | mioa9380 | MIOB2721 | ncr1957 | ncr6749 | ncrb1492 | ncrb6812 | ncrc2950 |
| MIOA0648 | MIOA4341a | mioa9535 | miob3205 | ncr2095 | ncr6894 | ncrb1638 | ncrb6841 | ncrc3027 |
| MIOA0845a | MIOA4937a | mioa9680 | miob3440 | ncr2147 | ncr7932 | ncrb2019 | ncrb7290 | ncrc3120 |
| MIOA0923a | MIOA5051a | mioa9696 | miob3478 | ncr2411 | ncr8347 | ncrb2512 | ncrb7407 | ncrc3427 |
| MIOA1132 | MIOA5110a | mioa9903 | miob3621 | ncr2544 | ncr8405 | ncrb3888 | ncrb7620 | ncrc3467 |
| MIOA1309 | MIOA5455a | miob0270 | miob3657 | ncr3060 | ncr8831 | ncrb4121 | ncrb7732 | ncrc3549 |
| MIOA1418 | MIOA5492a | miob0271 | miob3768 | ncr3135 | ncr8849 | ncrb4141 | ncrb7738 | ncrc3677 |
| MIOA1635a | MIOA5637a | miob0276 | miob4181 | ncr3475 | ncr8936 | ncrb4188 | ncrb7773 | ncrc3705 |
| MIOA1664a | MIOA5823a | miob0367 | miob4363 | ncr3660 | ncr9133 | ncrb4210 | ncrb8141 | ncrc3897 |
| MIOA1815a | MIOA6030 | miob0455 | miob4416 | ncr3694 | ncr9157 | ncrb4250 | ncrb8325 | ncrc3960 |
| MIOA2064 | MIOA6133a | miob0490 | miob4871 | ncr3828 | ncr9177 | ncrb4459 | ncrb8405 | ncrc4010 |
| MIOA2663a | MIOA6896a | miob0943 | miob5020 | ncr3879 | ncr9179 | ncrb4475 | ncrb8508 | ncrc4183 |

Figure 6A – EST Names Corresponding to Unique Known Genes of Figure 6

| | | | | | | | | |
|---|---|---|---|---|---|---|---|---|
| ncrc4396 | ncrc5991 | ncrc9240 | SEOA1337 | SEOA3845 | seoa7855a | SEOB0878a | seob4080 | seob6007 |
| ncrc4638 | ncrc6215 | ncrc9285 | SEOA1509 | SEOA4356a | SEOA8386a | SEOB1021 | seob4139 | seob6639 |
| ncrc4743 | ncrc6218 | ncrc9298 | SEOA2119 | SEOA4721a | SEOA8674 | SEOB1305 | seob4429 | seob6788 |
| ncrc4858 | ncrc6263 | seoa0006m | SEOA2239a | SEOA5560a | SEOA8705 | SEOB1536 | seob4522 | seob7072 |
| ncrc4890 | ncrc6514 | SEOA0387 | SEOA2262a | SEOA5626a | SEOA9151 | SEOB2016 | seob4585 | seob7226 |
| ncrc5055 | ncrc6536 | SEOA0544 | SEOA2400a | SEOA6875 | SEOA9225 | SEOB2042 | seob4897 | seob7592 |
| ncrc5144 | ncrc6569 | SEOA0734a | seoa2680m | SEOA7065a | SEOA9385 | seob2311 | seob4915 | seob7648 |
| ncrc5332 | ncrc6593 | SEOA0885n | SEOA2681 | SEOA7128a | SEOA9390 | seob2563 | seob5212 | seob7674 |
| ncrc5351 | ncrc6799 | SEOA0907 | SEOA2893a | SEOA7176a | SEOB0159 | SEOB3142 | seob5228 | seob7968 |
| ncrc5401 | ncrc6967 | SEOA1124a | SEOA3026a | SEOA7276a | SEOB0195 | SEOB3432 | seob5237 | SOA0133 |
| ncrc5795 | ncrc9032 | SEOA1158a | SEOA3568a | SEOA7528a | SEOB0205 | SEOB3490 | seob5671 | SOA0567 |
| ncrc5855 | ncrc9037 | SEOA1253A | SEOA3844 | seoa7677a | SEOB0521 | seob3696 | seob6002 | |

15. thymosin beta-4 (TMSB4X) M17733 305

| | | | | | | | | |
|---|---|---|---|---|---|---|---|---|
| BFCW0250 | MIOA2636 | mioa9579 | miob5076 | ncrb8681 | SEOA2254a | SEOA6590a | SEOB0449 | seob4218 |
| CR0904 | MIOA2781a | mioa9685 | miob6054 | ncrc0792 | SEOA2386a | SEOA6634a | SEOB0555 | seob4484 |
| FCR1838 | MIOA3295a | mioa9749 | miob6088 | ncrc1257 | SEOA2463a | SEOA6635a | SEOB0590 | seob4611 |
| FCR4092 | MIOA3325a | mioa9968 | miob6542 | ncrc1571 | SEOA2871 | seoa6800 | SEOB0691a | seob4718 |
| FCR4109 | MIOA3635a | miob0076 | miob6760 | ncrc1768 | SEOA3023a | SEOA7068a | SEOB0842a | seob4747 |
| FCR4506 | MIOA3836 | miob0301 | miob6914 | ncrc2096 | SEOA3197 | SEOA7125a | SEOB1024 | seob4748 |
| fcrb0136 | MIOA4021a | miob0325 | miob6989 | ncrc2677 | SEOA3529a | SEOA7168a | seob1041 | seob4769 |
| fcrb0631 | MIOA4075a | miob1080 | ncr0934 | ncrc3216 | SEOA3630a | SEOA7238a | SEOB1225 | seob4774 |
| fcrb2061 | MIOA4130 | miob1116 | ncr0934 | ncrc4394 | SEOA3729a | SEOA7248a | SEOB1400 | seob4818 |
| hfcr1297 | MIOA4207 | miob1149 | ncr2290 | ncrc4792 | SEOA3859 | SEOA7265a | SEOB1516 | seob4883 |
| hfcr2655 | MIOA4221 | miob1210 | ncr2569 | ncrc5616 | SEOA3911 | SEOA7304a | SEOB1540 | seob5246 |
| hfcr2827 | MIOA4823a | MIOB1535 | ncr2738 | ncrc6574 | SEOA3933 | SEOA7591a | SEOB1666 | seob5504 |
| hfcr3840 | MIOA5435a | miob1770 | ncr3088 | ncrc9683 | SEOA3934 | seoa7725a | SEOB1671 | seob5615 |
| hfcr5976 | MIOA5640a | MIOB2213 | ncr3952 | SEOA0040 | SEOA3996a | seoa7744a | SEOB1867 | seob5623 |
| MIOA0100 | MIOA5724 | MIOB2299 | ncr4997 | seoa0094m | SEOA4164a | seoa7751a | SEOB1876 | seob5757 |
| MIOA0116 | MIOA6132a | miob2396 | ncr5357 | SEOA0296 | SEOA4306a | seoa7765a | SEOB1997 | seob5788 |
| MIOA0140 | MIOA6152a | miob2444 | ncr6031 | seoa0434m | SEOA4594 | seoa7832a | SEOB2044 | seob5832 |
| MIOA0185 | MIOA6372a | miob2446 | ncr6120 | SEOA0478 | SEOA4766a | seoa7886a | seob2091n | seob5836 |
| MIOA0825 | MIOA6401a | miob2997 | ncr6702 | SEOA0502 | SEOA4804a | seoa8114 | seob2091n | seob5848 |
| MIOA1104 | MIOA6656a | miob2998 | ncr6986 | SEOA0835 | SEOA4827a | seoa8116 | seob2322 | seob5869 |
| MIOA1121 | MIOA6979a | miob3005 | ncr7438 | SEOA0888 | seoa4938a | seoa8151 | seob2612 | seob5936 |
| MIOA1297 | MIOA6989a | miob3090 | ncr7591 | SEOA0891 | seoa4942a | SEOA8184a | SEOB2691 | seob6194 |
| MIOA1396a | MIOA7011a | miob3583 | ncr9127 | SEOA1135a | seoa4966a | SEOA8283 | SEOB3003 | seob6306 |
| MIOA1589 | MIOA7383a | miob3762 | ncrb0283 | SEOA1138a | SEOA5012a | SEOA8341a | SEOB3162 | seob6354 |
| MIOA1839a | mioa7642a | miob3868 | ncrb1305 | SEOA1191A | SEOA5033a | SEOA8573 | seob3268 | seob6360 |
| MIOA2157a | mioa7670a | miob4052 | ncrb1483 | SEOA1209A | SEOA5051a | SEOA8680 | SEOB3580 | seob6516 |
| MIOA2168a | mioa7855 | miob4117 | ncrb2090 | SEOA1224A | SEOA5204a | SEOA8709 | seob3872 | seob6754 |
| MIOA2232a | mioa7883 | miob4136 | ncrb2608 | SEOA1494 | SEOA5879 | SEOA8876 | seob3891 | seob7166 |
| MIOA2289a | MIOA8035a | miob4139 | ncrb3648 | SEOA1504 | SEOA6204a | SEOA8905 | seob3912 | seob7201 |
| MIOA2304a | MIOA8339 | miob4253 | ncrb5209 | SEOA1515 | SEOA6268 | SEOA9031 | seob3963 | seob7621 |
| MIOA2445a | MIOA8702 | miob4380 | ncrb6031 | SEOA1520 | SEOA6380 | SEOA9134 | seob3964 | seob8007 |
| MIOA2455a | MIOA8781 | miob4417 | ncrb6050 | seoa1548m | SEOA6394 | SEOA9148 | seob4004 | seob8045 |
| MIOA2468a | MIOA8825 | miob4971 | ncrb7745 | SEOA2076 | SEOA6444a | SEOA9417 | seob4119 | seob8060 |
| MIOA2599a | MIOA9133 | miob5047 | ncrb8487 | SEOA2168n | SEOA6488a | SEOA9700 | seob4207 | |

16. osteonectin gene (SPARC) secreted protein, acidic,cysteine-rich M25746.1 248

| | | | | | | | | |
|---|---|---|---|---|---|---|---|---|
| ncrc6598 | ncrc3640 | ncrc4730 | CR0591 | FCR5250 | fcrb1865 | hfcr3960 | hfcr5716 | MIOA0970 |
| ncrc6559 | ncrc2241 | ncrc5858 | FCR0375 | FCR5263 | fcrb2192 | hfcr4106 | hfcr6283 | MIOA1549 |
| ncrc6168 | ncrc2515 | ncrc5790 | FCR1029 | FCR5898 | fcrb2300 | hfcr4120 | hfcr6860 | MIOA2171a |
| ncrc5684 | ncrc4382 | ncrc6061 | FCR1423 | FCR5971 | fcrb2454 | hfcr4132 | hfcr7683 | MIOA4892a |
| ncrc6201 | ncrc4660 | BFCS0074 | FCR1955 | FCR6766 | hfcr0310 | hfcr4333 | hfcr8827 | MIOA5898a |
| ncrc7119 | ncrc1427 | BFCS0284 | FCR2296 | FCR6802 | hfcr1377 | hfcr5065 | hfcr9977 | MIOA7583a |
| ncrc3680 | ncrc4761 | CR0119 | FCR2822 | fcrb0168 | hfcr2040 | hfcr5433 | MIOA0458 | mioa7929 |
| ncrc3642 | ncrc1385 | CR0370 | FCR4871 | fcrb1432 | hfcr3568 | hfcr5601 | mioa0789m | mioa9693 |

Figure 6A – EST Names Corresponding to Unique Known Genes of Figure 6

| | | | | | | | | |
|---|---|---|---|---|---|---|---|---|
| miob1722 | ncr2867 | ncr6896 | ncrb0812 | ncrb4904 | ncrb7719 | ncrc1870 | SEOA5398 | SEOB0916 |
| MIOB2708 | ncr3049 | ncr7150 | ncrb0914 | ncrb4965 | ncrb7793 | ncrc2800 | SEOA5576a | SEOB1125 |
| miob3926 | ncr3206 | ncr7190 | ncrb1081 | ncrb5068 | ncrb7861 | ncrc2955 | SEOA5871 | SEOB2704 |
| miob3981 | ncr3573 | ncr7216 | ncrb1562 | ncrb5181 | ncrb8149 | ncrc3012 | SEOA7396a | SEOB2763 |
| miob5104 | ncr3575 | ncr7272 | ncrb1656 | ncrb5407 | ncrb8382 | ncrc3085 | SEOA7495a | SEOB2944 |
| ncr0136 | ncr3667 | ncr7558 | ncrb1822 | ncrb5539 | ncrb8422 | ncrc4144 | seoa7965 | SEOB3357 |
| ncr0305 | ncr3699 | ncr8330 | ncrb2164 | ncrb5615 | ncrb8429 | ncrc5087 | SEOA8417 | seob3995 |
| ncr0316 | ncr3731 | ncr8434 | ncrb2519 | ncrb5834 | ncrb8435 | ncrc6564 | SEOA8436 | seob4092 |
| ncr0352 | ncr3901 | ncr8511 | ncrb2527 | ncrb5976 | ncrb8718 | ncrc6803 | SEOA8626 | seob4881 |
| ncr0494 | ncr4073 | ncr8933 | ncrb2715 | ncrb6249 | ncrb8783 | ncrc6944 | SEOA8958 | seob5561 |
| ncr0855 | ncr4137 | ncr9344 | ncrb2738 | ncrb6569 | ncrc0142 | ncrc9425 | SEOA9138 | seob5780 |
| ncr1197 | ncr4200 | ncr9565 | ncrb3338 | ncrb6670 | ncrc0285 | ncrc9437 | SEOA9342 | seob6679 |
| ncr1201 | ncr4567 | ncr9682 | ncrb3563 | ncrb6785 | ncrc0359 | ncrc9727 | SEOA9552 | seob7222 |
| ncr1748 | ncr4750 | ncr9771 | ncrb3621 | ncrb6942 | ncrc0381 | ncrc9742 | SEOA9747 | seob7348 |
| ncr1990 | ncr4833 | ncr9784 | ncrb3844 | ncrb6994 | ncrc0464 | SEOA1683a | SEOA9757 | SOA0212 |
| ncr2187 | ncr5218 | ncrb0120 | ncrb3872 | ncrb7067 | ncrc0510 | SEOA1733a | SEOA9875 | SOA0674n |
| ncr2215 | ncr5328 | ncrb0166 | ncrb4019 | ncrb7246 | ncrc0628 | SEOA2742 | SEOB0329 | |
| ncr2223 | ncr5463 | ncrb0544 | ncrb4118 | ncrb7528 | ncrc0813 | SEOA3222 | SEOB0405 | |
| ncr2837 | ncr5826 | ncrb0589 | ncrb4573 | ncrb7624 | ncrc0885 | SEOA3904 | SEOB0662a | |
| ncr2840 | ncr6138 | ncrb0745 | ncrb4804 | ncrb7706 | ncrc1617 | SEOA4101a | SEOB0770 | |

17. ribosomal protein S27 (=(metallopanstimulin 1 MPS1)NM_001030.1 247

| | | | | | | | | |
|---|---|---|---|---|---|---|---|---|
| ncrc4378 | fcrb1711 | MIOA5281a | ncr1666 | ncr7618 | ncrb6222 | ncrc4953 | seoa4891a | SEOB3467 |
| ncrc4607 | fcrb2289 | MIOA6294a | ncr2073 | ncr7652 | ncrb6279 | ncrc5537 | SEOA5814 | seob4091 |
| ncrc6259 | hfcr0276 | MIOA6706a | ncr2389 | ncr7956 | ncrb6325 | ncrc6387 | seoa6855 | seob4105 |
| ncrc5963 | hfcr0559 | MIOA7201a | ncr2647 | ncr8440 | ncrb6528 | ncrc6677 | SEOA6886 | seob4313 |
| ncrc5964 | hfcr0608 | MIOA7226a | ncr2671 | ncr8839 | ncrb6647 | ncrc8922 | seoa7019 | seob4341 |
| ncrc5995 | hfcr1343 | mioa7886 | ncr2934 | ncr8960 | ncrb7201 | ncrc8959 | SEOA7241a | seob4421 |
| ncrc6333 | hfcr1362 | MIOA8399 | ncr3121 | ncrb0044 | ncrb7612 | ncrc9071 | SEOA7525a | seob4515 |
| ncrc5865 | hfcr2166 | MIOA9039 | ncr3195 | ncrb0413 | ncrb7683 | ncrc9339 | seoa7817a | seob4600 |
| ncrc6413 | hfcr2823 | MIOA9051 | ncr3549 | ncrb0551 | ncrb8026 | ncrc9796 | SEOA7932a | seob4920 |
| ncrc6911 | hfcr2910 | mioa9814 | ncr3565 | ncrb0708 | ncrb8256 | SEOA0144 | SEOA8460 | seob4934 |
| ncrc7017 | hfcr5264 | miob1154 | ncr3804 | ncrb1619 | ncrb8788 | SEOA0171a | SEOA8592 | seob5725 |
| BFCS0398 | hfcr5856 | MIOB2803 | ncr4184 | ncrb2393 | ncrc0400 | SEOA0293 | SEOA8592 | seob5753 |
| FCR0848 | hfcr5890 | miob2921 | ncr4220 | ncrb2590 | ncrc0471 | SEOA0362 | SEOA9136 | seob6062 |
| FCR1554 | hfcr7569 | miob3771 | ncr4568 | ncrb2821 | ncrc0523 | SEOA0525 | SEOA9785 | seob6633 |
| FCR1907 | hfcr7842 | miob3995 | ncr4688 | ncrb2957 | ncrc0906 | SEOA1120a | SEOA9984 | seob7357 |
| FCR2113 | hfcr8358 | miob4198 | ncr4778 | ncrb3123 | ncrc0985 | SEOA1298a | SEOB0001 | seob7469 |
| FCR2473 | hfcr9150 | miob4361 | ncr4910 | ncrb3392 | ncrc1056 | SEOA1960 | SEOB0036 | seob7523 |
| FCR2840 | hfcr9495 | miob4381 | ncr4921 | ncrb3552 | ncrc1489 | SEOA2078 | SEOB0673a | seob7692 |
| FCR4154 | hfcr9566 | miob4777 | ncr4982 | ncrb4106 | ncrc2202 | seoa2682m | SEOB0786a | seob7876 |
| FCR4870 | MIOA0229a | miob4863 | ncr5108 | ncrb4911 | ncrc2396 | SEOA2683 | SEOB1241 | seob7938 |
| FCR5749 | MIOA0818 | miob5021 | ncr5639 | ncrb5015 | ncrc2765 | SEOA2896a | SEOB1474 | seob7987 |
| FCR6589 | MIOA0865a | miob5678 | ncr5942 | ncrb5276 | ncrc2988 | SEOA3402a | SEOB1512 | SOA0437 |
| fcrb0046 | MIOA1066 | miob6261 | ncr6395 | ncrb5423 | ncrc3203 | SEOA3537a | SEOB1552 | SOA0506 |
| fcrb0190 | MIOA2249a | miob6299 | ncr6581 | ncrb5601 | ncrc3625 | SEOA3589a | SEOB2041 | |
| fcrb0317 | MIOA2650 | miob6350 | ncr6968 | ncrb6003 | ncrc3909 | SEOA4003a | SEOB2119 | |
| fcrb0335 | MIOA4133 | miob6507 | ncr7333 | ncrb6006 | ncrc4159 | SEOA4408a | seob2574 | |
| fcrb1412 | MIOA4237 | miob6956 | ncr7378 | ncrb6089 | ncrc4309 | SEOA4555 | seob2579 | |
| fcrb1708 | MIOA4870a | ncr0908 | ncr7517 | ncrb6187 | ncrc4671 | SEOA4839a | seob3266 | |

18. vimentin gene (VIM) Z19554 212

| | | | | | | | | |
|---|---|---|---|---|---|---|---|---|
| ncrc4509 | FCR0909 | FCR6621 | fcrb2210 | hfcr1739 | hfcr6021 | MIOA0019a | MIOA1833a | MIOA4040a |
| ncrc4369 | FCR2425 | FCR7153 | fcrb2245 | hfcr2801 | hfcr6571 | MIOA0404a | MIOA2099 | MIOA4305a |
| ncrc4543 | FCR3170 | FCR7255 | hfcr0284 | hfcr4430 | hfcr7091 | MIOA1074 | MIOA2254a | MIOA4665a |
| BFCN0265 | FCR5713 | FCR7685 | hfcr0436 | hfcr5120 | hfcr7772 | MIOA1080 | MIOA2572a | MIOA5121a |
| BFCS0557 | FCR5818 | fcrb1817 | hfcr1275 | hfcr5428 | hfcr8393 | MIOA1363a | MIOA2588a | MIOA5761a |
| CR1003 | FCR6503 | fcrb1886 | hfcr1404 | hfcr5686 | hfcr8422 | MIOA1627a | MIOA4027a | MIOA5824a |

Figure 6A - EST Names Corresponding to Unique Known Genes of Figure 6

| | | | | | | | | |
|---|---|---|---|---|---|---|---|---|
| MIOA5925a | miob3333 | ncr8802 | ncrc6757 | SEOA2093 | SEOA6418 | SEOA8819 | SEOB2980 | seob5970 |
| MIOA6806a | miob3408 | ncrb0134 | ncrc9194 | SEOA2185a | SEOA6529a | SEOA9212 | SEOB3033 | seob6117 |
| MIOA7269a | miob4518 | ncrb2591 | SEOA0056 | SEOA2358a | SEOA6629a | SEOA9346 | SEOB3041 | seob6178 |
| MIOA7472a | miob4927 | ncrb4011 | SEOA0256a | SEOA2414 | seoa6934 | SEOA9462 | SEOB3072 | seob6801 |
| MIOA8351 | miob4948 | ncrb5519 | SEOA0440 | SEOA3213 | seoa6953 | SEOA9488 | SEOB3135 | seob7217 |
| MIOA8613 | miob5025 | ncrb7093 | seoa0459m | SEOA3246 | SEOA7111a | SEOA9560 | SEOB3407 | seob7285 |
| mioa9330 | miob5966 | ncrb8740 | SEOA0508 | SEOA3591a | SEOA7165a | SEOA9938 | SEOB3471 | seob7355 |
| mioa9945 | miob6384 | ncrc0401 | SEOA0551A | SEOA3848 | SEOA7192a | SEOA9987 | seob3936 | seob7417 |
| miob0173 | miob6489 | ncrc0507 | SEOA0584 | SEOA4075 | SEOA7217a | SEOB0346 | seob4130 | seob7462 |
| MIOB0552 | miob6843 | ncrc0676 | SEOA0592a | SEOA5011a | SEOA7446a | SEOB0924 | seob4234 | seob7464 |
| miob1298 | ncr1147 | ncrc1084 | SEOA0923 | SEOA5109a | seoa7700a | SEOB1157 | seob4887 | seob7641 |
| miob1786 | ncr2577 | ncrc1337 | SEOA1281a | SEOA5280a | seoa7853a | SEOB1214 | seob5098 | seob7724 |
| miob1912 | ncr2736 | ncrc1716 | SEOA1286a | SEOA5521a | SEOA7907a | SEOB1613 | seob5163 | seob8286 |
| MIOB2736 | ncr4460 | ncrc1914 | SEOA1592a | SEOA5538a | SEOA8217 | SEOB1829 | seob5660 | soa0461n |
| miob2916 | ncr6552 | ncrc4253 | SEOA1937n | SEOA5600a | SEOA8259 | SEOB1899 | seob5728 | |
| miob2950 | ncr6562 | ncrc5575 | SEOA1943 | SEOA5666a | SEOA8518 | seob2590 | seob5806 | |
| miob3013 | ncr7288 | ncrc6192 | seoa2037 | SEOA5713a | SEOA8628 | SEOB2753 | seob5885 | |
| miob3204 | ncr8252 | ncrc6421 | seoa2045m | SEOA6190a | SEOA8782 | SEOB2764 | seob5904 | |

19. ribosomal protein L7 X52967 206

| | | | | | | | | |
|---|---|---|---|---|---|---|---|---|
| BFCW0079 | fcrb2509 | MIOA0727 | MIOA6125a | miob2500 | ncr4911 | ncrc0072 | SEOA3041a | SEOB0871a |
| CR0292 | hfcr0384 | MIOA1288 | MIOA6453a | miob3165 | ncr5566 | ncrc0195 | SEOA3963a | SEOB1028 |
| FCR0850 | hfcr0540 | MIOA1558 | MIOA6460a | miob3707 | ncr5626 | ncrc0633 | SEOA4299a | SEOB1529 |
| FCR1484 | hfcr0856 | MIOA1893a | MIOA6486a | miob3731 | ncr5900 | ncrc1864 | SEOA4769a | SEOB1631 |
| FCR1817 | hfcr0890 | MIOA1924a | MIOA7148a | miob3939 | ncr6111 | ncrc2691 | SEOA4812a | SEOB1874 |
| FCR2164 | hfcr1385 | MIOA2096 | MIOA7406a | miob3990 | ncr7001 | ncrc3548 | SEOA5579a | SEOB2216 |
| FCR4011 | hfcr1784 | MIOA2338a | MIOA7426a | miob4026 | ncr7979 | ncrc4027 | SEOA6482a | seob2573 |
| FCR4039 | hfcr1789 | MIOA2680a | MIOA7441a | miob4027 | ncr8127 | ncrc4662 | SEOA6578a | SEOB3233 |
| FCR5047 | hfcr1791 | MIOA2706a | mioa7790a | miob4608 | ncr9721 | ncrc5109 | SEOA6910 | SEOB3392 |
| FCR5327 | hfcr1901 | MIOA2803a | MIOA8157 | miob5118 | ncr9865 | ncrc6681 | SEOA7336a | SEOB3483 |
| FCR5343 | hfcr3024 | MIOA3200a | MIOA8221 | miob5626 | ncrb0784 | ncrc6853 | SEOA7937a | seob4128 |
| FCR5421 | HFCR3152 | MIOA3347a | MIOA8577 | miob5668 | ncrb1531 | ncrc6935 | seoa8015 | seob4531 |
| FCR5683 | HFCR3181 | MIOA3418a | MIOA8712 | miob5861 | ncrb2112 | ncrc8942 | SEOA8267 | seob5039 |
| FCR6483 | HFCR3191 | MIOA3730a | MIOA9132 | miob6110 | ncrb2317 | ncrc9970 | SEOA8678 | seob5494 |
| FCR6582 | hfcr5895 | MIOA3967a | mioa9363 | miob6534 | ncrb3334 | SEOA0289 | SEOA9124 | seob5881 |
| fcrb0081 | hfcr6068 | MIOA4310a | mioa9460 | miob6737 | ncrb4390 | SEOA0887 | SEOA9210 | seob6012 |
| fcrb0202 | hfcr6907 | MIOA4487a | mioa9626 | ncr0503 | ncrb5048 | SEOA1266A | SEOA9512 | seob6697 |
| fcrb0735 | hfcr6929 | MIOA4512a | miob0418 | ncr0600 | ncrb5591 | SEOA1309a | SEOA9639 | seob6775 |
| fcrb1318 | hfcr7791 | MIOA4645a | miob0714 | ncr0680 | ncrb6196 | SEOA1950 | SEOB0203 | seob7317 |
| fcrb1639 | hfcr7965 | MIOA5053a | miob1205 | ncr1651 | ncrb6301 | SEOA2165 | SEOB0395 | seob7331 |
| fcrb1973 | hfcr8505 | MIOA5777a | MIOB1580 | ncr2532 | ncrb6704 | SEOA2180a | SEOB0579 | seob7666 |
| fcrb2080 | hfcr8752 | MIOA5970a | miob1796 | ncr4203 | ncrb7656 | SEOA2420a | SEOB0665a | seob8006 |
| fcrb2119 | MIOA0607a | MIOA6069a | MIOB2189 | ncr4377 | ncrb8657 | SEOA3031a | SEOB0750 | |

20. scrapie responsive protein 1 (SCRG1)NM_007281.1 168

| | | | | | | | | |
|---|---|---|---|---|---|---|---|---|
| ncrc7177 | MIOA0025a | MIOA4526a | mioa9320 | MIOB2345 | miob5995 | ncr2712 | ncr7385 | ncrb5459 |
| ncrc5681 | MIOA0202a | MIOA5580a | mioa9675 | miob2506 | miob6075 | ncr2772 | ncr7563 | ncrb5717 |
| ncrc4340 | mioa0556a | MIOA5656 | miob0385 | MIOB2670 | miob6346 | ncr2974 | ncr8237 | ncrb7075 |
| ncrc4610 | mioa0640an | MIOA5994a | miob0404 | miob2876 | miob6583 | ncr3062 | ncr8397 | ncrb7467 |
| ncrc4301 | MIOA0756 | MIOA6039 | miob0447 | miob3065 | ncr0576 | ncr3092 | ncr8790 | ncrb8265 |
| ncrc5261 | MIOA1234 | MIOA6280a | miob0750 | miob3733 | ncr0763 | ncr3124 | ncrb0226 | ncrb8331 |
| ncrc5311 | MIOA1600 | MIOA7166a | miob0975 | miob4217 | ncr0807 | ncr4585 | ncrb0395 | ncrb8707 |
| ncrc5567 | MIOA1823a | MIOA7364a | miob1203 | miob4391 | ncr0817 | ncr5010 | ncrb0449 | ncrc0167 |
| ncrc6780 | MIOA1853a | MIOA7367a | miob1373 | miob4528 | ncr0917 | ncr5475 | ncrb1522 | ncrc0313 |
| ncrc6876 | MIOA2458a | MIOA7435a | miob1858 | miob4584 | ncr1848 | ncr5752 | ncrb1817 | ncrc0537 |
| FCR4957 | MIOA2605a | mioa7830a | miob1895 | miob4818 | ncr2036 | ncr6221 | ncrb2359 | ncrc3277 |
| fcr5406n | MIOA3933a | MIOA8127 | MIOB2139 | miob4877 | ncr2237 | ncr6575 | ncrb2678 | ncrc3296 |
| hfcr5939 | MIOA4187 | mioa9280 | MIOB2265 | miob5984 | ncr2599 | ncr6772 | ncrb4483 | ncrc3535 |

Figure 6A – EST Names Corresponding to Unique Known Genes of Figure 6

| | | | | | | | | |
|---|---|---|---|---|---|---|---|---|
| ncrc4976 | seoa2672m | SEOA5347 | SEOA6459a | SEOA9153 | SEOB2916 | seob4798 | seob6650 | SOA0285 |
| SEOA0487 | SEOA2941a | SEOA5831 | SEOA7267a | SEOA9250 | SEOB3083 | seob4922 | seob6725 | SOA0288 |
| SEOA0777 | SEOA3620a | SEOA5835 | SEOA7598a | SEOA9422 | SEOB3300 | seob5239 | seob6824 | SOA0632 |
| SEOA0858 | SEOA3780a | SEOA6333 | seoa7754a | SEOB1130 | seob4013 | seob5786 | seob7663 | |
| SEOA2271a | SEOA3905 | SEOA6376 | seoa8080 | SEOB1819 | seob4121 | seob5966 | seob8034 | |
| SEOA2480 | SEOA4575 | SEOA6422 | SEOA8584 | SEOB2648 | seob4206 | seob6301 | seob8266 | |

21. connective tissue growth factor (CTGF) U14750 159

| | | | | | | | | |
|---|---|---|---|---|---|---|---|---|
| ncrc2273 | MIOA2961a | miob0248 | ncr0137 | ncr5898 | ncrb2777 | ncrb6968 | ncrc9327 | seoa8087 |
| ncrc2535 | MIOA3188a | miob0778 | ncr0480 | ncr6535 | ncrb2833 | ncrb7783 | ncrc9834 | SEOA8788 |
| ncrc6828 | MIOA3406a | miob1692n | ncr0507 | ncr6675 | ncrb3539 | ncrb7824 | SEOA1413a | SEOB0827a |
| ncrc6973 | MIOA4999a | miob2429 | ncr0780 | ncr7193 | ncrb4196 | ncrb8186 | SEOA1472a | SEOB1078 |
| BFCS0303 | MIOA5052a | miob2442 | ncr0819 | ncr7774 | ncrb4377 | ncrc0156 | SEOA1530 | seob2534 |
| FCR6229 | MIOA5220 | miob3007 | ncr0842 | ncr7780 | ncrb4628 | ncrc1321 | SEOA2979a | SEOB2940 |
| fcrb1224 | MIOA5756a | miob3255 | ncr1551 | ncr8671 | ncrb4893 | ncrc1492 | SEOA2983a | SEOB3234 |
| hfcr1829 | MIOA5939a | miob3744 | ncr1715 | ncr9004 | ncrb5027 | ncrc1493 | SEOA3099a | seob5257 |
| hfcr2297 | MIOA5940a | miob3895 | ncr1777 | ncr9160 | ncrb5312 | ncrc1611 | seoa3145m | seob6654 |
| hfcr5724 | MIOA6725a | miob3978 | ncr2006 | ncr9320 | ncrb5724 | ncrc3290 | SEOA3542a | seob6667 |
| MIOA0390a | MIOA6842a | miob4116 | ncr2168 | ncr9326 | ncrb5960 | ncrc3865 | SEOA4077 | seob6690 |
| MIOA0792 | MIOA6990a | miob4283 | ncr3019 | ncr9846 | ncrb6102 | ncrc4197 | SEOA4458a | seob6902 |
| MIOA1135 | MIOA7250a | miob4382 | ncr3145 | ncrb0205 | ncrb6475 | ncrc4580 | SEOA4665a | seob7467 |
| MIOA1178 | mioa8326n | miob4894 | ncr3798 | ncrb0254 | ncrb6559 | ncrc4824 | SEOA5416 | seob7475 |
| MIOA1308m | MIOA8803 | miob5107 | ncr4536 | ncrb0654 | ncrb6655 | ncrc5277 | SEOA5944 | soa0277n |
| MIOA1521 | MIOA8922 | miob5772 | ncr5263 | ncrb0899 | ncrb6715 | ncrc5493 | SEOA6048a | |
| MIOA1727a | MIOA9055 | miob6086 | ncr5272 | ncrb2187 | ncrb6789 | ncrc6443 | SEOA7116a | |
| MIOA1917a | mioa9503 | miob6864 | ncr5644 | ncrb2421 | ncrb6935 | ncrc9043 | SEOA7440a | |

22. tumor protein translationally-controlled 1 (TPT1) NM_003295.1 158

| | | | | | | | | |
|---|---|---|---|---|---|---|---|---|
| ncrc5662 | FCR5935 | hfcr1426 | MIOA3619a | miob3873 | ncrb0952 | ncrc0138 | SEOA1987 | SEOA9701 |
| ncrc5445 | FCR6031 | hfcr2667 | MIOA3917a | miob4047 | ncrb1792 | ncrc0452 | SEOA2034 | SEOB1249 |
| ncrc5600 | FCR6303 | hfcr2876 | MIOA3960a | miob4445 | ncrb2192 | ncrc0872 | SEOA2609 | SEOB1523 |
| ncrc5943 | FCR6871 | hfcr2913 | MIOA4926a | miob5787 | ncrb3248 | ncrc1956 | seoa2643m | SEOB1828 |
| ncrc6425 | FCR6996 | hfcr3720 | MIOA6264a | ncr0604 | ncrb3609 | ncrc3336 | seoa3156mn | seob2620 |
| CR0235 | FCR7449 | hfcr3810 | MIOA6798a | ncr1703 | ncrb3684 | ncrc3392 | SEOA4492 | SEOB2650 |
| FCR0743 | FCR7719 | hfcr3900 | MIOA7320 | ncr1806 | ncrb3878 | ncrc3736 | SEOA5510a | SEOB3382 |
| FCR2273 | fcrb1508 | hfcr5471 | MIOA8959 | ncr2172 | ncrb4023 | ncrc3829 | SEOA5511a | seob3715 |
| fcr2505nn | fcrb2011 | hfcr5474 | MIOA9120 | ncr2352 | ncrb4876 | ncrc4170 | SEOA5862 | seob4360 |
| FCR2735 | fcrb2352 | hfcr5744 | mioa9200 | ncr2945 | ncrb4935 | ncrc4273 | SEOA6282 | seob6101 |
| FCR2766 | hfcr0012 | hfcr7271 | mioa9419 | ncr5069 | ncrb4952 | ncrc8984 | SEOA6448a | seob6472 |
| FCR3436 | hfcr0108 | hfcr7362 | mioa9553 | ncr5164 | ncrb4984 | ncrc9108 | SEOA6719 | seob7500 |
| FCR3530 | hfcr0315 | hfcr7551 | mioa9981 | ncr6410 | ncrb5374 | ncrc9735 | SEOA7154a | seob8229 |
| FCR4260 | hfcr0599 | hfcr9899 | miob0091 | ncr8241 | ncrb5626 | SEOA0044n | seoa7710a | SOA0249 |
| FCR4829 | hfcr0728 | MIOA0138 | miob0238 | ncr8721 | ncrb6164 | seoa0268m | SEOA8441 | SOA0283 |
| FCR4948 | hfcr1174 | MIOA1107 | miob0366 | ncrb0459 | ncrb7711 | SEOA0369 | SEOA8576 | |
| FCR4950 | hfcr1193 | MIOA1884a | miob0774 | ncrb0529 | ncrb8101 | SEOA0397 | SEOA8742 | |
| FCR5099 | hfcr1205 | MIOA2302a | MIOB2667 | ncrb0687 | ncrb8494 | SEOA1899 | SEOA9026 | |

23. putative p150 AAC51271.1 145

| | | | | | | | | |
|---|---|---|---|---|---|---|---|---|
| ncrc2447 | MIOA8759 | miob3183 | ncr0273 | ncr3591 | ncr5659 | ncr6817 | ncr8253 | ncrb1114 |
| ncrc2577 | mioa9329 | miob3805 | ncr1002 | ncr4048 | ncr5692 | ncr7117 | ncr8702 | ncrb1127 |
| hfcr5810 | miob0749 | miob4213 | ncr1560 | ncr4380 | ncr5711 | ncr7187 | ncr8851 | ncrb2647 |
| hfcr6201 | miob0883 | miob6535 | ncr1593 | ncr4543 | ncr5720 | ncr7663 | ncr9719 | ncrb2808 |
| hfcr8551 | miob1813 | miob6700 | ncr2505 | ncr4642 | ncr5727 | ncr7881 | ncrb0058 | ncrb3038 |
| hfcr9949 | miob2923 | miob6784 | ncr2523 | ncr5544 | ncr5734 | ncr7918 | ncrb0093 | ncrb3360 |
| MIOA8149 | miob2930 | miob6961 | ncr3306 | ncr5586 | ncr5908 | ncr8024 | ncrb0245 | ncrb3587 |
| MIOA8499 | miob2939 | miob7018 | ncr3379 | ncr5600 | ncr6656 | ncr8122 | ncrb0466 | ncrb3960 |
| MIOA8538 | miob3094 | ncr0060 | ncr3499 | ncr5648 | ncr6683 | ncr8134 | ncrb0923 | ncrb4713 |

Figure 6A – EST Names Corresponding to Unique Known Genes of Figure 6

| ncrb5360 | ncrc0478 | ncrc2318 | ncrc4733 | ncrc6487 | ncrc9697 | SEOB3117 | seob6240 |
| --- | --- | --- | --- | --- | --- | --- | --- |
| ncrb6717 | ncrc0601 | ncrc2493 | ncrc4874 | ncrc6703 | ncrc9952 | SEOB3585 | seob6283 |
| ncrb6757 | ncrc0814 | ncrc2849 | ncrc5065 | ncrc6800 | seoa6937 | seob3686 | seob6545 |
| ncrb7339 | ncrc0853 | ncrc3135 | ncrc5223 | ncrc7091 | SEOA9020 | seob3941 | seob6663 |
| ncrb8412 | ncrc2003 | ncrc3678 | ncrc5475 | ncrc9197 | SEOA9577 | seob5332 | seob6671 |
| ncrb8623 | ncrc2149 | ncrc4160 | ncrc5563 | ncrc9229 | SEOA9707 | seob5473 | seob6692 |
| ncrb8704 | ncrc2154 | ncrc4513 | ncrc5909 | ncrc9506 | SEOB1624 | seob5877 | seob6757 |
| ncrb8795 | ncrc2233 | ncrc4540 | ncrc6319 | ncrc9564 | SEOB2114 | seob6047 | seob6780 |

24. osteoblast specific factor 2 (OSF-2os) D13666.1   139

| BFCW0085 | SEOA0083 | seoa2604m | SEOA5939 | SEOA8311a | seob1301n | SEOB3398 | seob5155 | seob6732 |
| --- | --- | --- | --- | --- | --- | --- | --- | --- |
| CR0146 | SEOA0142 | SEOA2714 | SEOA6368 | SEOA8737 | SEOB1303 | SEOB3420 | seob5162 | seob6865 |
| CR0557 | SEOA0204A | SEOA2904a | SEOA6442 | SEOA8809 | SEOB1445 | SEOB3469 | seob5443 | seob7220 |
| CR0900 | SEOA0497 | SEOA2921a | SEOA6915 | SEOA8824 | SEOB1473 | SEOB3487 | seob5487 | seob7486 |
| FCR3064 | seoa0498m | seoa3152m | seoa6933 | SEOA8848 | SEOB1504 | SEOB3521 | seob5512 | seob7508 |
| FCR4409 | SEOA0585 | SEOA3214 | seoa6946 | SEOA8879 | SEOB1603 | seob3992 | seob5535 | seob7612 |
| FCR5767 | SEOA0593a | SEOA3266 | seoa7028 | SEOA8989 | SEOB1609 | seob4005 | seob5575 | seob7766 |
| FCR7251 | seoa0764m | SEOA3420a | SEOA7097a | SEOA9133 | SEOB1745 | seob4240 | seob5754 | seob7910 |
| hfcr0734 | SEOA0846 | SEOA4316a | SEOA7358a | SEOA9169 | SEOB1928 | seob4280 | seob5813 | seob7979 |
| hfcr0765 | SEOA1194A | SEOA4346a | seoa7691a | SEOA9851 | SEOB1982 | seob4488 | seob5910 | seob8068 |
| hfcr1823 | SEOA1291a | SEOA4455a | seoa7773a | SEOA9951 | SEOB2255 | seob4651 | seob6185 | SOA0646 |
| hfcr2141 | SEOA1440a | SEOA5129a | seoa7834a | SEOA9993 | seob2607 | seob4695 | seob6349 | |
| HFCR3195 | SEOA1660a | SEOA5173a | seoa7878a | SEOB0118 | SEOB2663 | seob4746 | seob6382 | |
| hfcr5075 | SEOA2007 | SEOA5312a | seoa8029 | SEOB0398 | SEOB2998 | seob4786 | seob6412 | |
| hfcr5836 | SEOA2124 | SEOA5505a | seoa8055 | SEOB0628a | seob3269 | seob5150 | seob6517 | |
| MIOA6728a | SEOA2434a | SEOA5582a | SEOA8204 | SEOB1154 | SEOB3336 | seob5154 | seob6681 | |

25. collagen type I alpha 1 (COL1A1) X06269   128

| BFCN0211 | FCR1967 | fcrb1506 | hfcr1125 | hfcr6010 | hfcr7956 | ncr4067 | ncrb8285 | seob3983 |
| --- | --- | --- | --- | --- | --- | --- | --- | --- |
| BFCS0077 | FCR2008 | fcrb1510 | hfcr1152 | hfcr6223 | hfcr7979 | ncr4544 | ncrb8420 | seob4352 |
| BFCW0090 | FCR4702 | fcrb1588 | hfcr1262 | hfcr6445 | hfcr9006 | ncr4613 | ncrc2729 | seob5382 |
| cr0131n | FCR4768 | fcrb1612 | hfcr1315 | hfcr6574 | hfcr9043 | ncr4813 | ncrc3292 | seob5394 |
| fcr0038n | FCR4999 | fcrb1978 | hfcr1320 | hfcr6623 | hfcr9355 | ncr5280 | ncrc3679 | seob5427 |
| fcr0039n | FCR5251 | fcrb2001 | hfcr1383 | hfcr6681 | hfcr9384 | ncr8761 | ncrc4119 | seob5435 |
| FCR0488 | fcrb0056 | fcrb2157 | hfcr2066 | hfcr6904 | hfcr9386 | ncr9314 | ncrc6222 | seob5471 |
| FCR0607 | fcrb0089 | fcrb2538 | hfcr2872 | hfcr6988 | hfcr9519 | ncr9579 | SEOA4529 | seob8181 |
| FCR0682 | fcrb0296 | fcrb2767 | hfcr2939 | hfcr7059 | hfcr9520 | ncrb1898 | SEOA7221a | |
| FCR0734 | fcrb0370 | hfcr0078 | hfcr3541 | hfcr7088 | hfcr9707 | ncrb2179 | SEOA7607a | |
| FCR1148 | fcrb0407 | hfcr0174 | hfcr3986 | hfcr7366 | hfcr9887 | ncrb5229 | SEOA8327a | |
| FCR1389 | fcrb0568 | hfcr0613 | hfcr4164 | hfcr7414 | hfcr9919 | ncrb5536 | SEOA9590 | |
| FCR1425 | fcrb0815 | hfcr0718 | hfcr5199 | hfcr7609 | hfcr9938 | ncrb6628 | SEOA9812 | |
| FCR1737 | fcrb1465 | hfcr0730 | hfcr5654 | hfcr7618 | hfcr9965 | ncrb7568 | SEOB2756 | |
| FCR1964 | fcrb1476 | hfcr0763 | hfcr5811 | hfcr7858 | hfcr9966 | ncrb8245 | SEOB3460 | |

26. Ribosomal protein S20 (RPS20) NM_001023.1   124

| BFCS0560 | FCR3397 | hfcr2209 | hfcr6705 | MIOA5473a | miob3476 | ncr7115 | SEOA1687a | SEOA5728a |
| --- | --- | --- | --- | --- | --- | --- | --- | --- |
| CR0955 | FCR4850 | hfcr2842 | hfcr6958 | MIOA5826a | miob4134 | ncrb0440 | SEOA1711a | SEOA5828 |
| FCR0088 | FCR5345 | hfcr2880 | hfcr7712 | MIOA7073a | miob4201 | ncrb2472 | SEOA1887 | SEOA6043a |
| FCR0284 | FCR7236 | hfcr2931 | hfcr8280 | MIOA7223a | miob4577 | ncrb3418 | SEOA2260a | SEOA6522a |
| FCR0402 | fcrb0198 | hfcr3659 | hfcr8914 | MIOA7306 | miob4934 | ncrb4480 | SEOA3355a | SEOA7291a |
| FCR0448 | fcrb0397 | hfcr4454 | hfcr9039 | mioa9353 | ncr0005 | ncrb4840 | SEOA3631a | SEOA7529a |
| FCR1040n | fcrb1159 | hfcr5171 | MIOA1283m | miob0231 | ncr0186 | ncrb6460 | SEOA3659a | SEOA8806 |
| FCR1206 | fcrb1683 | hfcr5619 | MIOA2265a | miob0326 | ncr0408 | ncrc0458 | SEOA3892 | SEOA9345 |
| FCR1291 | fcrb2763 | hfcr5823 | MIOA2417a | miob0649 | ncr1228 | ncrc0752 | SEOA3893 | SEOA9364 |
| FCR1492 | hfcr0438 | hfcr5943 | MIOA3719a | miob1208 | ncr5258 | ncrc5542 | SEOA4720a | SEOA9503 |
| FCR1754 | hfcr0825 | hfcr6005 | MIOA3867 | miob1314 | ncr5355 | SEOA0307 | SEOA4825a | SEOA9710 |
| FCR3122 | hfcr1368 | hfcr6591 | MIOA4940a | miob1807 | ncr6264 | SEOA0771 | SEOA5112a | SEOB0240 |

Figure 6A – EST Names Corresponding to Unique Known Genes of Figure 6

| | | | | | | | |
|---|---|---|---|---|---|---|---|
| SEOB1262 | SEOB2952 | seob3757 | seob4768 | seob5305 | seob6299 | seob6652 | seob7940 |
| seob2559 | SEOB3086 | seob3966 | seob5259 | seob5932 | seob6632 | seob7031 | seob7975 |

27. nribosomal protein L9 U09953 119

| | | | | | | | | |
|---|---|---|---|---|---|---|---|---|
| FCR0069 | FCR5198 | hfcr0359 | hfcr8058 | MIOA8398 | ncrb2265 | ncrc6541 | SEOA9001 | seob4125 |
| FCR0802 | FCR5359 | hfcr0532 | hfcr8202 | miob5897 | ncrb2565 | ncrc9121 | SEOA9425 | seob4230 |
| FCR1036 | FCR5437 | hfcr0950 | hfcr8961 | miob5927 | ncrb3211 | ncrc9278 | SEOA9631 | seob5175 |
| FCR1399 | FCR6334 | hfcr1322 | hfcr9375 | ncr1175 | ncrb4245 | ncrc9406 | SEOB0496 | seob7179 |
| FCR1612 | FCR6525 | hfcr1345 | hfcr9598 | ncr1585 | ncrb4963 | ncrc9475 | SEOB0759 | seob7581 |
| FCR2007 | FCR6631 | hfcr2053 | MIOA0088a | ncr3061 | ncrb7856 | SEOA0170a | SEOB0967 | seob7704 |
| FCR2286 | FCR6975 | hfcr3037 | MIOA0151 | ncr6320 | ncrb8042 | SEOA2169 | seob1037 | SOA0264 |
| FCR2320 | FCR7237 | hfcr3364 | MIOA0469 | ncr6334 | ncrc2744 | SEOA3090a | SEOB1403 | |
| FCR3665 | fcrb0053 | hfcr5858 | MIOA0910a | ncr6579 | ncrc2746 | SEOA4363a | SEOB1616 | |
| FCR4134 | fcrb0275 | hfcr6123 | MIOA2527a | ncr7175 | ncrc3641 | SEOA5017a | SEOB1762 | |
| FCR4198 | fcrb0750 | hfcr6185 | MIOA3038a | ncr8304 | ncrc4041 | SEOA5149a | SEOB2232 | |
| FCR4326 | fcrb1627 | hfcr6203 | MIOA3253a | ncrb0123 | ncrc5163 | SEOA7628a | SEOB3277 | |
| FCR4660 | fcrb2260 | hfcr6460 | MIOA6455a | ncrb0442 | ncrc5526 | SEOA8207 | SEOB3348 | |
| FCR5131 | fcrb2486 | hfcr6520 | MIOA7584a | ncrb0719 | ncrc6247 | SEOA8919 | seob4064 | |

28. ribosomal protein L34 (RPL34) NM_000995.1 108

| | | | | | | | | |
|---|---|---|---|---|---|---|---|---|
| BFCS0229 | fcrb2294 | MIOA1016 | mioa7693a | ncr7231 | ncrb7056 | SEOA0185a | SEOA7432a | seob2622 |
| BFCW0375 | hfcr1048 | MIOA1374a | MIOA8463 | ncr8316 | ncrb7438 | SEOA0321 | seoa7986 | SEOB2964 |
| CR0585 | hfcr1184 | MIOA2856a | miob0080 | ncr8715 | ncrb7687 | SEOA0994 | seoa8088 | SEOB3437 |
| CR0808 | hfcr1840 | MIOA3986a | miob1385 | ncr9203 | ncrc0184 | SEOA2628 | SEOA9473 | seob3951 |
| FCR1163 | hfcr1872 | MIOA4329a | miob1806 | ncrb0607 | ncrc1847 | SEOA2664 | SEOA9797 | seob3989 |
| FCR2412 | hfcr2140 | MIOA4623a | miob1927 | ncrb2328 | ncrc2432 | seoa4914a | SEOA9836 | seob3990 |
| FCR4205 | hfcr5279 | MIOA5086a | miob3452 | ncrb2531 | ncrc3452 | SEOA5139a | SEOB0103 | seob4518 |
| FCR5338 | hfcr5505 | MIOA5573a | miob4812 | ncrb2697 | ncrc3731 | SEOA5147a | SEOB0491 | seob5034 |
| FCR7139 | hfcr7562 | MIOA5847a | miob5695 | ncrb4004 | ncrc3905 | SEOA5506a | SEOB0713a | seob5516 |
| FCR7547 | hfcr7595 | MIOA6086a | ncr0132 | ncrb4240 | ncrc4592 | SEOA6219a | SEOB0978 | seob5951 |
| fcrb1336 | hfcr7771 | MIOA6626a | ncr0379 | ncrb5271 | ncrc5854 | SEOA6233 | SEOB2147 | seob7199 |
| fcrb1370 | MIOA0715 | MIOA6681a | ncr1272 | ncrb6009 | ncrc9424 | SEOA7327a | SEOB2254 | seob7550 |

29. "calmodulin 1 (phosphorylase kinase, delta) (CALM1) "NM_006888.1 107

| | | | | | | | | |
|---|---|---|---|---|---|---|---|---|
| BFCW0036n | MIOA1914a | miob0448 | miob6828 | ncrb5657 | ncrc6932 | SEOA2860 | SEOA8523 | SEOB2947 |
| BFCW0056n | MIOA2391a | miob0718 | miob6979 | ncrb5748 | SEOA0090n | SEOA3208 | SEOA8805 | seob5014 |
| BFCW0276 | MIOA3330a | miob0912 | ncr0615 | ncrb6549 | SEOA0188A | SEOA3604a | SEOA9546 | seob5614 |
| CR0452 | MIOA3887a | miob1759 | ncr3165 | ncrb6624 | SEOA0323 | SEOA3710a | SEOB0020 | seob5650 |
| CR0797 | MIOA6083a | MIOB2324 | ncr4361 | ncrb7784 | SEOA0430 | SEOA3719a | SEOB0475 | seob5657 |
| FCR2310 | MIOA6148a | miob3196 | ncr4743 | ncrb8355 | SEOA1409a | seoa4941a | SEOB0551 | seob5693 |
| fcrb1493 | MIOA7173a | miob4478 | ncr5222 | ncrb8705 | SEOA1516 | SEOA5056a | SEOB1120 | seob6593 |
| MIOA0035a | MIOA7272 | miob4545 | ncr7024 | ncrc1087 | SEOA1518 | SEOA5349 | SEOB1817 | seob6806 |
| MIOA0360a | MIOA8024a | miob4689 | ncr7483 | ncrc2504 | SEOA1604a | SEOA5657a | SEOB1894 | seob7162 |
| MIOA0650 | MIOA8071 | miob6221 | ncr7555 | ncrc4785 | SEOA1686a | SEOA6310 | seob2545 | seob7749 |
| MIOA1090 | MIOA8185 | miob6255 | ncr8573 | ncrc6452 | SEOA2502 | SEOA7306a | SEOB2755 | seob8155 |
| MIOA1648a | mioa9766 | miob6697 | ncrb3934 | ncrc6680 | SEOA2766 | SEOA8434 | SEOB2925 | SOA0650 |

30. ribosomal RNA 18S X03205 103

| | | | | | | | | |
|---|---|---|---|---|---|---|---|---|
| ncrc6547 | CR1009 | hfcr6355 | MIOA6320a | miob0779 | miob6862 | ncr5402 | ncr8858 | ncrb2773 |
| ncrc6555 | FCR0199 | hfcr7675 | MIOA7404a | miob0816 | miob6990 | ncr6384 | ncr8976 | ncrb3520 |
| ncrc1667 | FCR3479 | MIOA1351a | MIOA8128 | MIOB2574 | ncr1183 | ncr7375 | ncr9166 | ncrb3879 |
| ncrc6502 | FCR3903 | MIOA1700 | MIOA8269 | MIOB2859 | ncr2394 | ncr7802 | ncr9463 | ncrb5491 |
| ncrc4823 | FCR4287 | MIOA2489a | MIOA8893 | miob3601 | ncr2698 | ncr8157 | ncr9627 | ncrb6321 |
| ncrc4915 | FCR6421 | MIOA2910a | MIOA8904 | miob3876 | ncr4539 | ncr8672 | ncrb0204 | ncrb8176 |
| BFCN0226 | FCR6746 | MIOA3065a | mioa9199 | miob4968 | ncr4601 | ncr8823 | ncrb0503 | ncrc0212 |
| BFCS0228 | FCR7049 | MIOA3965a | miob0704 | miob6246 | ncr5080 | ncr8845 | ncrb1685 | ncrc0836 |

Figure 6A – EST Names Corresponding to Unique Known Genes of Figure 6

| | | | | | | | |
|---|---|---|---|---|---|---|---|
| ncrc1146 | ncrc1849 | ncrc6173 | SEOA1150a | SEOA6447a | SEOB0317 | seob3945 | seob6565 |
| ncrc1184 | ncrc2972 | ncrc6979 | SEOA1524 | SEOA6504a | SEOB1771 | seob5192 | seob7368 |
| ncrc1437 | ncrc3198 | ncrc9386 | SEOA1700a | SEOA8474 | SEOB2129 | seob5330 | SOA0131 |
| ncrc1764 | ncrc5835 | SEOA1149a | SEOA5614a | SEOB0299 | seob2299 | seob6327 | |

31. ribosomal protein L41 AF026844.1 103

| | | | | | | | | |
|---|---|---|---|---|---|---|---|---|
| ncrc5811 | FCR1531 | hfcr9505 | miob2995 | ncr5776 | ncrb1173 | ncrb8830 | SEOA1324 | SEOB2957 |
| ncrc6095 | FCR2052 | hfcr9990 | miob3625 | ncr5836 | ncrb2051 | ncrc0602 | SEOA1692a | SEOB3436 |
| ncrc6879 | FCR2056 | MIOA3321a | miob4273 | ncr5838 | ncrb2659 | ncrc0658 | SEOA3552a | seob4404 |
| ncrc6956 | FCR4450 | MIOA4503a | miob6926 | ncr5856 | ncrb2883 | ncrc0671 | SEOA5242a | seob5867 |
| BFCS0527 | FCR4934 | MIOA8307 | ncr0669 | ncr7992 | ncrb3299 | ncrc1599 | SEOA5906 | seob5926 |
| CR0650 | FCR4978 | MIOA9140 | ncr1212 | ncr8540 | ncrb3686 | ncrc1727 | SEOA6518a | seob6319 |
| FCR0087 | fcrb0192 | mioa9611 | ncr2365 | ncr9200 | ncrb5532 | ncrc1891 | SEOA7370a | seob6399 |
| FCR0100 | fcrb0441 | miob0565n | ncr3327 | ncr9328 | ncrb6130 | ncrc2850 | seoa7766a | |
| FCR0158 | fcrb2521 | miob1707 | ncr4146 | ncrb0416 | ncrb6181 | ncrc3433 | SEOA9339 | |
| FCR0393 | fcrb2639 | MIOB2338 | ncr4854 | ncrb0461 | ncrb6513 | ncrc4723 | SEOB0222 | |
| FCR0771 | hfcr6038 | MIOB2559 | ncr5128 | ncrb0797 | ncrb7276 | ncrc9939 | SEOB0717a | |
| FCR1134 | hfcr8915 | MIOB2579 | ncr5478 | ncrb0833 | ncrb7621 | SEOA0363 | SEOB0821a | |

32. serine protease=HTRA serine protease (PRSS11)=AF157623.1 Y07921 101

| | | | | | | | | |
|---|---|---|---|---|---|---|---|---|
| BFCS0081 | MIOA4193 | miob0729 | miob6359 | SEOA1743a | SEOA4742a | seoa7961 | SEOB2238 | seob5251 |
| hfcr5447 | MIOA4264 | miob0941 | ncr2818 | SEOA2142 | SEOA5620a | seoa7998 | seob2538 | seob5398 |
| hfcr6311 | MIOA4370a | miob1127 | ncr3916 | SEOA2142 | SEOA6375 | SEOA8263 | seob2585 | seob6858 |
| hfcr6405 | MIOA4920a | miob2462 | ncr5126 | SEOA2142 | SEOA6678a | SEOA9236 | seob2597 | SOA0488 |
| hfcr7590 | MIOA5225a | miob3655 | ncrb0634 | SEOA2208a | SEOA6740 | SEOA9634 | SEOB3164 | SOA0706 |
| MIOA0732 | MIOA6019a | miob3719 | ncrb7771 | SEOA2352a | seoa6848 | SEOA9920 | SEOB3196 | |
| MIOA1145 | MIOA6646a | miob3719 | ncrb8720 | SEOA2571 | SEOA7127a | SEOB0456 | SEOB3218 | |
| MIOA1145 | MIOA7249a | miob4436 | ncrc5121 | seoa2607mn | SEOA7210a | SEOB0768 | SEOB3343 | |
| MIOA1840a | mioa7936 | miob4470 | seoa0003m | SEOA3341a | SEOA7272a | SEOB0999 | SEOB3435 | |
| MIOA2913a | MIOA8957 | miob4724 | SEOA0354 | SEOA3663a | SEOA7331a | SEOB1674 | SEOB3478 | |
| MIOA3022a | mioa9750 | miob4929 | SEOA0379 | SEOA3668a | SEOA7561a | SEOB1825 | seob4665 | |
| mioa4151n | mioa9901 | miob6108 | SEOA1130a | SEOA4614a | seoa7885a | SEOB2209 | seob5135 | |

33. ribosomal protein S3a M77234 99

| | | | | | | | | |
|---|---|---|---|---|---|---|---|---|
| ncrc5852 | fcrb0051 | hfcr3864 | miob0719 | ncr1309 | ncrb5789 | ncrc3242 | SEOA3792a | SEOB2079 |
| ncrc6245 | fcrb0080 | hfcr6710 | miob1253 | ncr2571 | ncrb5824 | ncrc3757 | SEOA4108a | SEOB2969 |
| ncrc6349 | fcrb0108 | hfcr9581 | miob3250 | ncr3097 | ncrb5877 | ncrc3998 | SEOA4368a | SEOB3591 |
| BFCW0319 | fcrb2277 | MIOA0026a | miob3617 | ncr3324 | ncrb5971 | ncrc4505 | SEOA6046a | seob3698 |
| FCR2198 | fcrb2365 | MIOA1718a | miob4367 | ncr5088 | ncrb6101 | ncrc5241 | SEOA6428 | seob5376 |
| FCR2868 | fcrb2572 | mioa7881 | miob4802 | ncr5230 | ncrb7348 | seoa0062m | SEOA7222a | seob5887 |
| FCR2977 | fcrb2629 | MIOA8118 | miob5734 | ncr7008 | ncrb8019 | seoa0496m | SEOA7670a | seob6128 |
| FCR4858 | fcrb2696 | MIOA8248 | miob5887 | ncrb2575 | ncrc1787 | SEOA1489 | seoa8090 | seob6130 |
| FCR5523 | hfcr0787 | MIOA8263 | miob6195 | ncrb3672 | ncrc2452 | SEOA1664a | SEOA8426 | seob6201 |
| FCR5944 | hfcr1873 | MIOA8905 | miob6212 | ncrb4790 | ncrc2671 | SEOA2164 | SEOA8710 | seob8001 |
| FCR7713 | hfcr3803 | miob0068 | ncr1200 | ncrb5165 | ncrc2995 | SEOA3505a | SEOB1098 | SOA0210 |

34. "ribosomal protein, large, P0 (RPLP0) "NM_001002.1 96

| | | | | | | | | |
|---|---|---|---|---|---|---|---|---|
| BFCW0609 | FCR1244 | FCR5025 | fcrb1593 | hfcr1825 | hfcr4211 | hfcr9225 | ncr0134 | ncrb0630 |
| CR0064 | FCR2646 | FCR7177 | fcrb1625 | hfcr2075 | hfcr6452 | hfcr9708 | ncr0459 | ncrb1496 |
| CR0066 | FCR3083 | FCR7227 | hfcr0243 | hfcr2076 | hfcr6480 | MIOA0297 | ncr0586 | ncrb1797 |
| CR0729 | FCR3260 | FCR7253 | hfcr0579 | hfcr2502 | hfcr6788 | MIOA1028 | ncr0768 | ncrb5292 |
| FCR0316 | FCR3717 | fcrb0153 | hfcr0712 | hfcr2869 | hfcr7382 | MIOA7553a | ncr1630 | ncrb5580 |
| FCR0496 | FCR4167 | fcrb0342 | hfcr0736 | HFCR3237 | hfcr7672 | MIOA8913 | ncr3656 | ncrb5891 |
| FCR0543 | FCR4583 | fcrb1070 | hfcr1191 | hfcr3827 | hfcr8935 | miob2401 | ncr4124 | ncrb6011 |
| FCR0726 | FCR4705 | fcrb1164 | hfcr1286 | hfcr3995 | hfcr8965 | miob3102 | ncr4668 | ncrc0529 |
| FCR0921 | FCR4810 | fcrb1522 | hfcr1747 | hfcr3996 | hfcr9072 | ncr0047 | ncr8197 | ncrc0980 |

Figure 6A – EST Names Corresponding to Unique Known Genes of Figure 6

| | | | | | | | |
|---|---|---|---|---|---|---|---|
| ncrc2542 | ncrc6507 | SEOA1144a | SEOA2030 | SEOA3958a | SEOA6473a | seob4596 | seob7126 |
| ncrc4025 | ncrc9867 | SEOA1668a | SEOA2101 | SEOA5460 | SEOB0174 | seob5961 | |

35. metallothionein 1L (MT1L) NM_002450.1 93

| | | | | | | | | |
|---|---|---|---|---|---|---|---|---|
| ncrc6596 | ncrc5918 | ncr2127 | ncr4788 | ncr7755 | ncrb1129 | ncrb4132 | ncrc0489 | ncrc7102 |
| ncrc6590 | ncrc6014 | ncr2149 | ncr4969 | ncr7819 | ncrb1396 | ncrb4293 | ncrc1264 | ncrc9251 |
| ncrc3899 | BFCN0136 | ncr2488 | ncr5174 | ncr8423 | ncrb1418 | ncrb5543 | ncrc1271 | ncrc9321 |
| ncrc4109 | hfcr1386 | ncr2770 | ncr5216 | ncr8551 | ncrb2074 | ncrb5741 | ncrc1322 | ncrc9843 |
| ncrc4821 | MIOA1400a | ncr2811 | ncr5423 | ncr9370 | ncrb2719 | ncrb6155 | ncrc2206 | SEOA4716a |
| ncrc5161 | miob2353n | ncr2876 | ncr6182 | ncr9440 | ncrb3091 | ncrb6547 | ncrc2375 | |
| ncrc1440 | miob3396 | ncr3058 | ncr6748 | ncr9612 | ncrb3344 | ncrb6727 | ncrc2804 | |
| ncrc4280 | miob6171 | ncr3814 | ncr6995 | ncr9640 | ncrb3354 | ncrb6776 | ncrc2938 | |
| ncrc1385 | miob6216 | ncr3876 | ncr6997 | ncrb0247 | ncrb3379 | ncrb7481 | ncrc2941 | |
| ncrc4717 | ncr1040 | ncr4548 | ncr7465 | ncrb0358 | ncrb3581 | ncrb7842 | ncrc3102 | |
| ncrc6355 | ncr2098 | ncr4763 | ncr7503 | ncrb0872 | ncrb3873 | ncrb8546 | ncrc4346 | |

36. ribosomal protein S8 (RPS8) NM_001012.1 92

| | | | | | | | | |
|---|---|---|---|---|---|---|---|---|
| ncrc2281 | FCR2962 | FCR6774 | hfcr0896 | hfcr8279 | ncr7864 | ncrb1326 | ncrc0157 | seob6651 |
| ncrc2374 | FCR3382 | FCR6808 | hfcr1293 | MIOA8984 | ncr8103 | ncrb1716 | ncrc1068 | seob7389 |
| BFCS0299 | FCR3564 | FCR6821 | hfcr1785 | miob1743 | ncr8613 | ncrb3524 | ncrc1960 | seob8158 |
| BFCS0479 | FCR3750 | FCR7116 | hfcr1832 | miob1868 | ncr8860 | ncrb4575 | ncrc3054 | SOA0417 |
| cr0045 | FCR3840 | FCR7586 | hfcr2857 | miob2938 | ncr9107 | ncrb4703 | ncrc7153 | |
| CR0480 | FCR3977 | fcrb0622 | hfcr3371 | ncr0436 | ncr9441 | ncrb4901 | SEOA1511 | |
| FCR0040 | FCR4505 | fcrb1210 | hfcr3487 | ncr4108 | ncr9478 | ncrb5399 | SEOA1957 | |
| FCR0458 | FCR5064 | fcrb2130 | hfcr4076 | ncr4530 | ncr9787 | ncrb5431 | SEOA3580a | |
| FCR0563 | FCR5080 | fcrb2432 | hfcr6569 | ncr6807 | ncrb0319 | ncrb6139 | SEOA3936 | |
| FCR0902 | FCR5533 | hfcr0699 | hfcr6898 | ncr7177 | ncrb0380 | ncrb7217 | SEOA5096a | |
| FCR1947 | FCR5894 | hfcr0892 | hfcr7176 | ncr7541 | ncrb1280 | ncrb7374 | SEOB3152 | |

37. ribosomal protein S6 M20020 92

| | | | | | | | | |
|---|---|---|---|---|---|---|---|---|
| BFCS0320 | fcrb0015 | hfcr6489 | MIOA5425a | ncr2495 | ncr9010 | ncrc0770 | SEOA3083a | seob5036 |
| FCR0830 | fcrb0745 | hfcr8483 | MIOA7433a | ncr2727 | ncr9687 | ncrc1373 | SEOA4171a | seob6441 |
| FCR1415 | fcrb1462 | hfcr8997 | MIOA8112 | ncr3389 | ncrb0051 | ncrc2700 | SEOA4698a | SOA0317 |
| FCR1483 | hfcr0445 | hfcr9195 | mioa9295 | ncr3460 | ncrb3422 | ncrc2713 | SEOA5889 | SOA0621 |
| FCR3118 | hfcr0474 | hfcr9616 | miob4061 | ncr3765 | ncrb4432 | ncrc3631 | SEOA7423a | |
| FCR3461 | hfcr1296 | MIOA2156a | miob5431 | ncr4584 | ncrb5179 | ncrc4353 | SEOA9666 | |
| FCR3724 | hfcr3034 | MIOA2836a | miob6320 | ncr6884 | ncrb5821 | ncrc6156 | SEOA9990 | |
| FCR3981 | hfcr3521 | MIOA3231a | ncr0044 | ncr7079 | ncrb6185 | ncrc6859 | SEOB1733 | |
| FCR4808 | hfcr4472 | MIOA4585a | ncr0454 | ncr7670 | ncrb6296 | ncrc9608 | SEOB2001 | |
| FCR5654 | hfcr6270 | MIOA4837a | ncr1534 | ncr7831 | ncrb8667 | SEOA2156n | SEOB3193 | |
| FCR6058 | hfcr6442 | MIOA5334a | ncr2225 | ncr8892 | ncrb8802 | SEOA2200a | seob4277 | |

38. ribosomal protein L21 U14967.1 91

| | | | | | | | | |
|---|---|---|---|---|---|---|---|---|
| ncrc3372 | hfcr0846 | MIOA1131 | miob6681 | ncrb0632 | ncrc1449 | SEOA3609a | SEOB0223 | seob7993 |
| ncrc3606 | hfcr1209 | MIOA2994a | miob6752 | ncrb0945 | ncrc1484 | SEOA4347a | SEOB1417 | seob8084 |
| ncrc1420 | hfcr2528 | MIOA4331a | ncr3880 | ncrb2128 | ncrc2166 | SEOA4631a | SEOB1544 | SOA0017 |
| ncrc4279 | hfcr2786 | MIOA4949a | ncr5510 | ncrb3991 | ncrc2248 | SEOA4660a | SEOB1958 | |
| CR0476 | hfcr2923 | MIOA7549a | ncr6752 | ncrb4035 | ncrc2749 | SEOA5409 | seob3749 | |
| FCR2339 | hfcr5850 | MIOA8037a | ncr6964 | ncrb4125 | ncrc4848 | SEOA6297 | seob3994 | |
| FCR3306 | hfcr6363 | mioa9193 | ncr7600 | ncrb4695 | ncrc5416 | SEOA7119a | seob4325 | |
| FCR5792 | hfcr6817 | mioa9646 | ncr8360 | ncrb6963 | ncrc6745 | SEOA7316a | seob4592 | |
| FCR6062 | hfcr7584 | miob1718 | ncr9497 | ncrc0179 | ncrc8927 | SEOA7434a | seob6137 | |
| FCR6192 | hfcr9351 | miob2910 | ncr9592 | ncrc1006 | ncrc9649 | SEOA7539a | seob6212 | |
| fcrb1950 | MIOA0193a | miob6403 | ncrb0365 | ncrc1260 | SEOA0376 | SEOA9549 | seob7136 | |

Figure 6A – EST Names Corresponding to Unique Known Genes of Figure 6

39. transmembrane protein BRI AF246221.1 90

| | | | | | | | | |
|---|---|---|---|---|---|---|---|---|
| fcrb0049 | MIOA3090a | MIOA6560a | mioa9822 | miob6996 | ncrc0632 | SEOA1601a | SEOA7073a | SEOB2158 |
| hfcr0422 | MIOA3475a | MIOA7251a | MIOB0564 | ncr3871 | ncrc1486 | SEOA3828a | SEOA7556a | SEOB2226 |
| hfcr1123 | MIOA3798 | MIOA7289 | miob0690 | ncr5316 | ncrc4137 | SEOA5104a | SEOA8514 | SEOB2744 |
| hfcr8791 | MIOA3834 | MIOA7597a | miob0731 | ncr8081 | ncrc4829 | SEOA5384 | SEOA9023 | seob3956 |
| MIOA0073a | MIOA3930a | MIOA8276 | miob0959 | ncr9770 | ncrc6305 | SEOA6025a | SEOA9925 | seob4431 |
| MIOA0159 | MIOA4093a | MIOA8510 | miob1246 | ncrb2954 | ncrc9601 | SEOA6085a | SEOB0340 | seob4673 |
| MIOA0282 | MIOA4378a | MIOA9066 | miob1820 | ncrb3002 | ncrc9698 | SEOA6167a | SEOB0368 | seob5481 |
| MIOA0877a | MIOA4608a | mioa9543 | MIOB2277 | ncrb3421 | SEOA0517 | SEOA6209a | SEOB0910a | seob7740 |
| MIOA1666a | MIOA5090a | mioa9747 | miob4821 | ncrb5559 | SEOA0922 | SEOA6485a | SEOB0984 | SOA0589 |
| MIOA1753 | MIOA6487a | mioa9786 | miob6417 | ncrb6226 | SEOA1119a | SEOA6549a | SEOB1083 | SOA0670 |

40. ribosomal protein L13a (RPL13A) NM_012423.1 89

| | | | | | | | | |
|---|---|---|---|---|---|---|---|---|
| ncrc5322 | FCR0383 | FCR3398 | fcrb0122 | fcrb2103 | hfcr3523 | hfcr8819 | ncr0827 | ncrc6560 |
| ncrc5392 | FCR0587 | FCR3922 | fcrb0302 | fcrb2128 | hfcr4464 | hfcr8835 | ncr1141 | ncrc9145 |
| BFCN0001 | FCR0684 | FCR4901 | fcrb0325 | fcrb2736 | hfcr5962 | hfcr8926 | ncr3815 | ncrc9231 |
| BFCN0042 | FCR0945 | FCR5852 | fcrb0665 | hfcr0293 | hfcr6193 | hfcr9084 | ncr9208 | ncrc9835 |
| BFCS0045 | FCR1384 | FCR6579 | fcrb1348 | hfcr0332 | hfcr6289 | hfcr9139 | ncrb4313 | ncrc9836 |
| BFCW0245 | FCR1390 | FCR7118 | fcrb1356 | hfcr0390 | hfcr7356 | hfcr9327 | ncrb4569 | SEOA6153a |
| CR0016 | FCR1929 | FCR7130 | fcrb1624 | hfcr0531 | hfcr7836 | MIOA4107 | ncrb5977 | SEOA7283a |
| CR0307 | FCR2062 | FCR7375 | fcrb1710 | hfcr2288 | hfcr8371 | MIOB2271 | ncrc0199 | SEOA8985 |
| FCR0146 | FCR2243 | FCR7391 | fcrb1880 | hfcr2515 | hfcr8672 | miob2518 | ncrc5349 | SEOB2294 |
| FCR0242 | FCR2621 | FCR7694 | fcrb1967 | HFCR3141 | hfcr8738 | MIOB2561 | ncrc5939 | |

41. ribosomal protein L37a L22154 87

| | | | | | | | | |
|---|---|---|---|---|---|---|---|---|
| BFCN0039 | FCR2475 | FCR7103 | fcrb1673 | hfcr3882 | hfcr6889 | MIOA8018a | ncrc2239 | SEOA7150a |
| BFCW0137 | FCR2890 | FCR7241 | fcrb1828 | hfcr3905 | hfcr8025 | MIOA9080 | ncrc3259 | SEOA7308a |
| BFCW0422 | FCR3009 | FCR7354 | fcrb1919 | hfcr4037 | hfcr8499 | miob0060 | ncrc3272 | SEOA7456a |
| CR0006 | FCR3381 | fcrb0106 | fcrb2063 | hfcr5153 | hfcr9001 | miob1853 | ncrc9276 | SEOA9732 |
| CR0217 | FCR3858 | fcrb0322 | fcrb2072 | hfcr5786 | hfcr9415 | ncr7844 | ncrc9390 | SEOB0113 |
| FCR0365 | FCR4399 | fcrb0428 | fcrb2146 | hfcr5964 | hfcr9671 | ncrb0175 | ncrc9948 | SEOB1652 |
| FCR0614 | FCR4867 | fcrb0688 | fcrb2440 | hfcr6200 | MIOA0716 | ncrb2365 | SEOA1977a | seob6266 |
| FCR1101 | FCR5163 | fcrb1058 | fcrb2461 | hfcr6298 | MIOA1063 | ncrb3599 | SEOA3625a | seob6567 |
| FCR1434 | FCR6170 | fcrb1208 | fcrb2646 | hfcr6572 | MIOA6115a | ncrb6759 | SEOA4288a | |
| FCR2420 | FCR6618 | fcrb1343 | hfcr3017 | hfcr6775 | MIOA7026a | ncrc0173 | SEOA6906 | |

42. ribosomal protein S11 (RPS11) NM_001015.1 87

| | | | | | | | | |
|---|---|---|---|---|---|---|---|---|
| BFCN0109 | FCR2873 | fcrb2237 | hfcr6381 | MIOA2795a | ncr1669 | ncrc0656 | SEOA2155 | SEOB0180 |
| BFCN0164 | FCR3380 | fcrb2568 | hfcr6702 | MIOA4019a | ncr2400 | ncrc1555 | SEOA3855 | SEOB0459 |
| BFCS0093 | FCR4898 | fcrb2631 | hfcr7019 | MIOA5358a | ncr2926 | ncrc1645 | SEOA4508 | SEOB1623 |
| FCR0091 | FCR5168 | hfcr1109 | hfcr7224 | MIOA6131a | ncr4900 | ncrc2199 | SEOA4775a | seob5835 |
| FCR0598 | FCR5883 | hfcr1316 | hfcr7657 | MIOA6928a | ncr7041 | ncrc2772 | seoa4961a | seob6838 |
| FCR1643 | FCR7519 | hfcr2254 | hfcr7872 | MIOA8717 | ncr7765 | ncrc2939 | SEOA6660a | seob8314 |
| FCR2246 | fcrb1157 | hfcr3935 | hfcr9215 | mioa9207 | ncrb0088 | ncrc3025 | seoa6773 | SOA0284 |
| FCR2280 | fcrb1480 | hfcr4031 | hfcr9973 | mioa9707 | ncrb2540 | ncrc5454 | seoa6991 | |
| FCR2636 | fcrb1860 | hfcr4565 | MIOA0415a | miob6710 | ncrb3602 | SEOA0089n | seoa7880a | |
| FCR2772 | fcrb2225 | hfcr6209 | MIOA2057 | ncr0387 | ncrb3829 | SEOA1697a | SEOA8832 | |

43. cytochrome c oxidase subunit VIc (COX6C) NM_004374.1 85

| | | | | | | | | |
|---|---|---|---|---|---|---|---|---|
| FCR3769 | MIOA0838a | MIOA7097a | miob2491 | miob6222 | ncr6601 | ncrb7161 | SEOA0758 | SEOA4824a |
| FCR5066 | MIOA1938a | mioa7874 | MIOB2712 | ncr2967 | ncr8631 | ncrc1290 | SEOA1020 | seoa4911a |
| hfcr9412 | MIOA3578a | MIOA8232 | miob3241 | ncr3799 | ncr8846 | ncrc3029 | SEOA1663a | SEOA5028a |
| MIOA0139 | MIOA3975a | miob1117 | miob3727 | ncr5381 | ncrb3122 | ncrc6197 | SEOA2514 | SEOA5030a |
| MIOA0367a | MIOA5326a | miob1273 | miob4568 | ncr5505 | ncrb3410 | ncrc6913 | SEOA2927a | SEOA6146a |
| mioa0575a | MIOA5585a | MIOB1577 | miob4674 | ncr5560 | ncrb5108 | SEOA0022 | SEOA4499 | SEOA6194a |

Figure 6A – EST Names Corresponding to Unique Known Genes of Figure 6

| | | | | | | | |
|---|---|---|---|---|---|---|---|
| SEOA6465a | seoa7972 | SEOA8614 | SEOA9839 | SEOB1870 | seob4032 | seob6069 | seob7665 |
| seoa6789 | seoa8058 | SEOA8656 | SEOB0300 | SEOB2645 | seob4033 | seob6635 | seob7957 |
| seoa7047 | SEOA8208 | SEOA9176 | SEOB1242 | SEOB2732 | seob4557 | seob6767 | seob8279 |
| SEOA7302a | SEOA8209 | SEOA9303 | SEOB1532 | SEOB3519 | seob5018 | seob7375 | |

44. Ribosomal Protein L10 (QM Protein) (Tumor Supressor QM) (Laminin Receptor Homolog) spP27635 85

| | | | | | | | | |
|---|---|---|---|---|---|---|---|---|
| BFCS0048n | FCR1331 | FCR5580 | fcrb2057 | hfcr3890 | hfcr8838 | ncr7679 | ncrc9189 | SEOB0707a |
| BFCS0058 | FCR1458 | FCR5629 | fcrb2348 | hfcr3982 | hfcr8917 | ncr8150 | ncrc9223 | SEOB1822 |
| BFCS0491 | FCR1742 | FCR5916 | hfcr1156 | hfcr4337 | hfcr9853 | ncrb3537 | SEOA1469a | seob4010 |
| CR0354 | FCR2043 | FCR6327 | hfcr1306 | hfcr5193 | MIOA1095 | ncrb6865 | SEOA5712a | seob4394 |
| CR0453 | FCR2312 | FCR6626 | hfcr1333 | hfcr5799 | MIOA1720a | ncrb8056 | SEOA6742 | seob6398 |
| FCR0079 | FCR2778 | FCR7373 | hfcr1661 | hfcr7348 | MIOA2736a | ncrc3787 | seoa6978 | |
| FCR0556 | FCR2823 | FCR7427 | hfcr1669 | hfcr7542 | MIOA4313a | ncrc4900 | seoa6988 | |
| FCR0756 | FCR3733 | fcrb1790 | hfcr2062 | hfcr8015 | MIOA6843a | ncrc5693 | SEOA8379a | |
| FCR0991 | FCR3897 | fcrb1841 | hfcr2310 | hfcr8420 | MIOA8515 | ncrc6119 | SEOA9824 | |
| FCR1059 | FCR4690 | fcrb2018 | hfcr3861 | hfcr8433 | ncr7020 | ncrc8940 | SEOB0512 | |

45. ribosomal protein L31 NM_000993.1 84

| | | | | | | | | |
|---|---|---|---|---|---|---|---|---|
| FCR0952 | hfcr5252 | MIOA6805a | ncr3614 | ncrb1164 | ncrc1491 | SEOA0839 | seoa8096 | seob4981 |
| FCR3791 | hfcr6945 | MIOA7345a | ncr3676 | ncrb1463 | ncrc2416 | SEOA1995 | SEOA8321a | seob6335 |
| FCR4215 | hfcr9060 | mioa7817a | ncr4958 | ncrb4144 | ncrc2665 | SEOA2573 | SEOA9947 | seob6726 |
| FCR5289 | hfcr9123 | mioa9921 | ncr5794 | ncrb4991 | ncrc2735 | SEOA2601 | SEOB0563 | seob8095 |
| FCR6400 | hfcr9652 | miob1118 | ncr6365 | ncrb5373 | ncrc3956 | SEOA3541a | SEOB1228 | |
| fcrb0284 | MIOA3951a | miob3729 | ncr7464 | ncrb5989 | ncrc5191 | SEOA4448a | SEOB1256 | |
| fcrb1587 | MIOA4895a | miob3781 | ncr7682 | ncrb6220 | ncrc6071 | SEOA5269a | SEOB3443 | |
| hfcr1691 | MIOA4974a | miob4463 | ncr7709 | ncrb6277 | ncrc9083 | seoa6762 | seob3667 | |
| hfcr3439 | MIOA5858a | ncr2554 | ncr8349 | ncrb7092 | ncrc9656 | SEOA6925 | seob4351 | |
| hfcr4078 | MIOA6151a | ncr2832 | ncrb1063 | ncrb7567 | SEOA0555A | SEOA7345a | seob4647 | |

46. annexin A2 (ANXA2)(lipocortin II) NM_004039.1 83

| | | | | | | | | |
|---|---|---|---|---|---|---|---|---|
| ncrc6847 | fcrb0268 | MIOB0541 | ncr8869 | ncrb8813 | SEOA2035 | SEOA5294a | SEOB0365 | seob6800 |
| ncrc7095 | fcrb2393 | miob5957 | ncrb0015 | ncrc0238 | SEOA2118 | SEOA5404 | SEOB1016 | seob8052 |
| BFCN0172 | hfcr3839 | miob6422 | ncrb0253 | ncrc2659 | SEOA2151 | SEOA5786 | SEOB1209 | seob8287 |
| CR0814 | hfcr6846 | ncr0995 | ncrb1234 | ncrc3859 | SEOA2294a | SEOA7619a | seob2564 | |
| FCR0148 | hfcr7701 | ncr1134 | ncrb2271 | ncrc6073 | SEOA2460a | SEOA8762 | SEOB2781 | |
| FCR0200 | hfcr7800 | ncr1284 | ncrb2405 | ncrc6525 | SEOA2707 | SEOA8787 | SEOB3025 | |
| FCR0478 | MIOA2109 | ncr5458 | ncrb2585 | ncrc6591 | SEOA3539a | SEOA8908 | SEOB3184 | |
| FCR2896 | MIOA6230a | ncr5521 | ncrb4027 | ncrc7163 | SEOA3849 | SEOB0108 | seob5555 | |
| FCR6410 | MIOA7313 | ncr6850 | ncrb5565 | ncrc9281 | SEOA3850 | SEOB0129 | seob5587 | |
| FCR7071 | mioa9212 | ncr8200 | ncrb7363 | SEOA0067 | seoa4906a | SEOB0236 | seob5992 | |

47. translationally controlled tumor protein (TCTP) X16064 82

| | | | | | | | | |
|---|---|---|---|---|---|---|---|---|
| CR0235 | FCR4950 | hfcr0108 | MIOA4926a | ncr0604 | ncrc0138 | SEOA2034 | SEOA7154a | SEOB3382 |
| FCR0743 | FCR5099 | hfcr0599 | MIOA6264a | ncr2172 | ncrc4170 | SEOA2609 | SEOA8441 | SOA0249 |
| FCR2273 | FCR5935 | hfcr3810 | MIOA6798a | ncr5164 | ncrc4323 | seoa2643m | SEOA8576 | |
| FCR2735 | FCR6031 | MIOA0138 | MIOA7320 | ncr8721 | ncrc8984 | SEOA4492 | SEOA8742 | |
| FCR2766 | FCR6303 | MIOA1107 | MIOA8959 | ncrb0459 | SEOA0044n | SEOA5510a | SEOA9701 | |
| FCR3436 | FCR6871 | MIOA1884a | MIOA9120 | ncrb0687 | seoa0268m | SEOA5511a | SEOB1249 | |
| FCR3530 | FCR6996 | MIOA2302a | mioa9200 | ncrb0952 | SEOA0369 | SEOA5862 | SEOB1523 | |
| FCR4260 | FCR7449 | MIOA3619a | mioa9553 | ncrb6164 | SEOA0397 | SEOA6282 | SEOB1523 | |
| FCR4829 | FCR7719 | MIOA3917a | miob2445 | ncrb8101 | SEOA1899 | SEOA6448a | SEOB1828 | |
| FCR4948 | hfcr0012 | MIOA3960a | MIOB2667 | ncrb8494 | SEOA1987 | SEOA6719 | SEOB2650 | |

Figure 6A – EST Names Corresponding to Unique Known Genes of Figure 6

48. RIBOSOMAL PROTEIN L17 spP18621 80

| | | | | | | | | |
|---|---|---|---|---|---|---|---|---|
| BFCW0231 | FCR1470 | FCR5427 | hfcr7001 | MIOA4123 | ncr9761 | SEOA0818 | SEOA5842 | SEOA9688 |
| CR0875 | FCR1782 | FCR5460 | hfcr7401 | MIOA6680a | ncrb2369 | SEOA1344 | SEOA6104a | SEOB1356 |
| FCR0164 | FCR1861 | FCR6352 | hfcr7491 | MIOA7066a | ncrb2437 | SEOA2419a | SEOA6113a | SEOB2023 |
| FCR0222 | FCR1949 | FCR6884 | hfcr7980 | mioa9722 | ncrb4612 | SEOA3386a | SEOA6239 | SEOB2028 |
| FCR0412 | FCR2883 | FCR7228 | MIOA0359a | miob3069 | ncrb8229 | SEOA3655a | SEOA6385 | seob5955 |
| FCR0596 | FCR4060 | fcrb1236 | MIOA2383a | ncr0556 | ncrc2071 | SEOA3858 | SEOA6440 | seob6387 |
| FCR0878 | FCR4228 | hfcr1002 | MIOA3605a | ncr1803 | ncrc3041 | SEOA4557 | SEOA7391a | seob6889 |
| FCR0995 | FCR5093 | hfcr1166 | MIOA3806 | ncr5931 | ncrc5793 | SEOA5327a | SEOA9168 | seob7461 |
| FCR1321N | FCR5193 | hfcr5708 | MIOA3823 | ncr7601 | SEOA0483 | SEOA5815 | SEOA9587 | seob8311 |

49. ribosomal protein S25 (RPS25) NM_001028.1 79

| | | | | | | | | |
|---|---|---|---|---|---|---|---|---|
| FCR1003 | fcrb2444 | MIOA2426a | miob0371 | ncr2968 | ncrc9084 | SEOA4319a | SEOB0330 | SEOB3474 |
| FCR1400 | hfcr0974 | MIOA2715a | miob1214 | ncr5553 | ncrc9322 | SEOA5083a | SEOB0441 | seob3979 |
| FCR1436 | hfcr2936 | MIOA5188a | miob3716 | ncr8080 | SEOA1878 | SEOA5231a | SEOB0543 | seob4303 |
| FCR1528 | hfcr3072 | MIOA6735a | miob4977 | ncrb5680 | SEOA1915 | SEOA6274 | SEOB0684a | seob4445 |
| FCR4138 | hfcr6082 | MIOA7454a | miob5094 | ncrb5774 | SEOA2596 | SEOA6279 | SEOB0858a | seob5436 |
| FCR4851 | hfcr6510 | MIOA7502a | miob5641 | ncrb6095 | SEOA3021a | seoa6962 | SEOB0911a | seob6073 |
| FCR5169 | hfcr6917 | mioa7906 | miob6744 | ncrb6183 | SEOA3201 | seoa7057 | SEOB1811 | seob6787 |
| FCR6522 | hfcr7507 | MIOA8482 | ncr0469 | ncrc4055 | seoa3254m | SEOA7482a | SEOB2145 | seob7045 |
| fcrb0576 | MIOA0642 | MIOA8487 | ncr2918 | ncrc5117 | SEOA3776a | SEOA8630 | SEOB3388 | |

50. collagen type XI alpha 1 (COL11A1) NM_001854.1 79

| | | | | | | | | |
|---|---|---|---|---|---|---|---|---|
| BFCN0019 | FCR3061 | FCR6740 | fcrb1959 | hfcr3645 | hfcr9803 | ncr0765 | ncrb8744 | SEOA1078a |
| BFCW0067 | FCR4065 | FCR7338 | fcrb2337 | hfcr3667 | MIOA1616a | ncr0862 | ncrc0612 | SEOA3652a |
| CR0981 | FCR4480 | fcrb0295 | fcrb2427 | hfcr4440 | MIOA2398a | ncr3972 | ncrc3547 | SEOA3721a |
| FCR1183 | FCR4833 | fcrb0311 | fcrb2700 | hfcr5821 | mioa9888 | ncr4845 | ncrc3851 | SEOA5863 |
| FCR1389 | FCR4999 | fcrb0718 | hfcr0971 | hfcr6956 | miob1059 | ncr5322 | ncrc4919 | SEOA8846 |
| FCR1425 | FCR5251 | fcrb1524 | hfcr2334 | hfcr6981 | MIOB2095 | ncr8476 | ncrc5211 | SEOB2193 |
| FCR1964 | fcr5270n | fcrb1637 | hfcr2833 | hfcr8011 | miob3187 | ncrb6982 | ncrc5295 | seob5225 |
| FCR2008 | FCR5847 | fcrb1681 | hfcr3379 | hfcr8492 | miob3187 | ncrb7182 | ncrc6628 | seob6665 |
| FCR2481 | FCR5986 | fcrb1857 | hfcr3421 | hfcr9540 | ncr0320 | ncrb7998 | SEOA0779 | |

51. fibromodulin (FMOD) NM_002023.2 79

| | | | | | | | | |
|---|---|---|---|---|---|---|---|---|
| ncrc3689 | hfcr0607 | MIOA6171a | miob4090 | ncr8395 | ncrb3446 | ncrb6898 | ncrc5001 | SEOA3929 |
| ncrc3688 | MIOA0370a | MIOA6274a | miob4738 | ncr8762 | ncrb3845 | ncrb6927 | ncrc6146 | SEOA6054a |
| BFCW0462 | MIOA0748 | MIOA6465a | ncr0409 | ncr9396 | ncrb3853 | ncrb7552 | ncrc8915 | SEOB0081 |
| FCR4298 | MIOA1265 | MIOA6711a | ncr0975 | ncr9645 | ncrb5434 | ncrc0681 | ncrc9183 | SEOB0372 |
| FCR4577 | MIOA1553 | MIOA8507 | ncr1035 | ncrb0925 | ncrb5483 | ncrc1265 | ncrc9366 | seob2613 |
| FCR4915 | MIOA3682a | mioa9288 | ncr1261 | ncrb1139 | ncrb5607 | ncrc3028 | SEOA0274 | seob4593 |
| FCR5511 | MIOA4214 | mioa9725 | ncr2354 | ncrb1189 | ncrb5636 | ncrc3220 | SEOA0530 | seob5346 |
| fcrb0079 | MIOA5535a | miob1460 | ncr4525 | ncrb1680 | ncrb6014 | ncrc3814 | SEOA0815 | seob6471 |
| fcrb2318 | MIOA5961a | miob3317 | ncr5756 | ncrb2396 | ncrb6743 | ncrc3984 | SEOA1331 | |

52. collagen type IX alpha 1 (COL9A1)(ORF) NM_001851.1 78

| | | | | | | | | |
|---|---|---|---|---|---|---|---|---|
| BFCN0097 | FCR1975 | FCR6017 | fcrb0316 | fcrb2508 | hfcr0697 | hfcr2916 | hfcr6335 | hfcr9124 |
| BFCN0239 | FCR3734 | FCR6469 | fcrb0592 | fcrb2598 | hfcr0840 | hfcr3384 | hfcr6362 | hfcr9922 |
| CR0556 | FCR3934 | FCR6735 | fcrb1063 | hfcr0044 | hfcr0978 | hfcr3764 | hfcr6895 | ncr9432 |
| CR0794 | FCR4299 | FCR6874 | fcrb1199 | hfcr0140 | hfcr1075 | hfcr3958 | hfcr7353 | ncrb3492 |
| FCR0150 | FCR4334 | FCR7008 | fcrb1628 | hfcr0303 | hfcr1167 | hfcr4545 | hfcr8399 | ncrb5133 |
| FCR1323 | FCR4799 | FCR7124 | fcrb1670 | hfcr0356 | hfcr1235 | hfcr4604 | hfcr8501 | ncrc5843 |
| FCR1330N | FCR5027 | fcrb0008 | fcrb1778 | hfcr0398 | hfcr1335 | hfcr5086 | hfcr8969 | ncrc6823 |
| FCR1363N | FCR5582 | fcrb0072 | fcrb2079 | hfcr0509 | hfcr2069 | hfcr5468 | hfcr9033 | |
| FCR1716 | FCR5920 | fcrb0266 | fcrb2459 | hfcr0639 | hfcr2807 | hfcr5756 | hfcr9085 | |

Figure 6A – EST Names Corresponding to Unique Known Genes of Figure 6

53. thioredoxin (TXN) J04026 75

| | | | | | | | | |
|---|---|---|---|---|---|---|---|---|
| FCR1367 | MIOA3109a | mioa7827a | ncr2285 | ncrc2111 | SEOA3091a | SEOA6537a | SEOB0681a | seob6623 |
| FCR3058 | MIOA5049a | mioa7880 | ncr6012 | ncrc8909 | SEOA3267 | seoa6780 | SEOB0743 | seob7005 |
| hfcr0309 | MIOA6508a | MIOA8233 | ncr6585 | ncrc9237 | SEOA3457a | SEOA7464a | SEOB1475 | seob7729 |
| hfcr3642 | MIOA6525a | mioa9231 | ncr8720 | SEOA0315n | SEOA3545a | seoa8024 | SEOB1591 | |
| MIOA0947 | MIOA6571a | mioa9868 | ncrb3007 | SEOA0432 | SEOA3601a | SEOA9247 | SEOB1890 | |
| MIOA2278a | MIOA7079a | miob0922 | ncrb4305 | seoa1008m | SEOA4786a | SEOA9457 | SEOB3116 | |
| MIOA2697a | MIOA7290 | miob5437 | ncrb6218 | SEOA1850a | SEOA5350 | SEOA9591 | SEOB3178 | |
| MIOA2902a | MIOA7448a | miob5681 | ncrb6455 | SEOA2594 | SEOA5964 | SEOA9743 | SEOB3321 | |
| MIOA2958a | MIOA7508a | ncr2050 | ncrc0668 | SEOA2997a | SEOA6464a | SEOA9941 | seob4248 | |

54. ribosomal protein L37 L11567 75

| | | | | | | | | |
|---|---|---|---|---|---|---|---|---|
| BFCN0210 | FCR3548 | fcrb2186 | hfcr4154 | MIOA7049a | ncr7262 | ncrc1556 | SEOA6906 | seob4744 |
| BFCS0513 | FCR3829 | fcrb2657 | hfcr7688 | miob1083 | ncr8629 | ncrc5178 | SEOA9936 | seob6086 |
| BFCW0114 | FCR5149 | hfcr0073 | hfcr7961 | miob4794 | ncr9661 | ncrc5721 | SEOB0390 | seob7553 |
| FCR0151 | FCR7304 | hfcr0664 | hfcr7974 | miob6493 | ncrb2533 | ncrc9220 | SEOB1393 | |
| FCR1302 | FCR7305 | hfcr0753 | hfcr8859 | ncr1236 | ncrb2548 | ncrc9904 | SEOB1652 | |
| FCR1514 | FCR7354 | hfcr2282 | hfcr9555 | ncr1779 | ncrb2571 | SEOA1391 | SEOB1755 | |
| FCR1746 | fcrb0253 | hfcr2623 | hfcr9649 | ncr3420 | ncrb3712 | SEOA2490 | SEOB2197 | |
| FCR1786 | fcrb1705 | HFCR3132 | MIOA6216a | ncr5324 | ncrb5379 | SEOA4467a | SEOB2677 | |
| FCR2443 | fcrb1804 | hfcr3613 | MIOA6421a | ncr5723 | ncrc0170 | SEOA5523a | SEOB3018 | |

55. "ribosomal protein S4, X-linked (RPS4X) "NM_001007.1 71

| | | | | | | | | |
|---|---|---|---|---|---|---|---|---|
| BFCS0092 | FCR3761 | fcrb2510 | hfcr2508 | hfcr9644 | miob0940 | ncr2387 | ncrb0240 | SEOA3972a |
| BFCW0574 | FCR4010 | fcrb2549 | hfcr2563 | MIOA0205a | MIOB2248 | ncr3579 | ncrb3959 | SEOA4280a |
| CR0312 | FCR4862 | fcrb2639 | hfcr3947 | MIOA1292 | MIOB2865 | ncr4082 | ncrb4535 | SEOA4413a |
| CR0505 | FCR5766 | hfcr0351 | hfcr5067 | MIOA8695 | miob4527 | ncr4705 | ncrb8117 | SEOB0178 |
| FCR0248 | fcrb0389 | hfcr0682 | hfcr6019 | MIOA8695 | miob6112 | ncr5887 | ncrc1627 | SEOB1170 |
| FCR1343 | fcrb0963 | hfcr0976 | hfcr6887 | mioa9772 | ncr0330 | ncr9424 | ncrc2180 | seob7253 |
| FCR1858 | fcrb1598 | hfcr2027 | hfcr7173 | miob0761 | ncr0466 | ncr9491 | ncrc9858 | seob8252 |
| FCR2326 | fcrb1849 | hfcr2045 | hfcr7642 | miob0855 | ncr1916 | ncrb0201 | SEOA2799 | |

56. "NADH dehydrogenase (ubiquinone) 1 alpha subcomplex, 4 (9kD, MLRQ) (NDUFA4) "NM_002489.1 69

| | | | | | | | | |
|---|---|---|---|---|---|---|---|---|
| FCR0841 | MIOA7558a | miob3832 | SEOA0481 | SEOA3466a | seoa6942 | SEOA9155 | SEOB1156 | seob5356 |
| FCR6689 | MIOA8394 | miob4329 | SEOA1342 | SEOA3547a | SEOA7243a | SEOA9171 | SEOB1283 | seob5449 |
| FCR6961 | MIOA9117 | miob4896 | SEOA1786a | SEOA4187a | SEOA7360a | SEOA9890 | seob1679n | seob6192 |
| hfcr3816 | mioa9728 | ncr3341 | SEOA1884 | SEOA4736a | SEOA7461a | SEOB0095 | SEOB2213 | seob6514 |
| hfcr5659 | mioa9961 | ncrb2861 | SEOA2453a | SEOA4773a | seoa7813a | SEOB0225 | SEOB3145 | seob7888 |
| MIOA1307 | miob0758 | ncrc1472 | SEOA2661 | SEOA5547a | seoa8064 | SEOB0363 | SEOB3504 | |
| MIOA5514a | MIOB2111 | ncrc1727 | SEOA2993a | SEOA5741a | seoa8065 | SEOB0601 | seob4470 | |
| MIOA6662a | miob2985 | SEOA0162a | SEOA3371a | SEOA6551a | seoa8072 | SEOB1033 | seob5245 | |

57. ribosomal protein L3 (RPL3) NM_000967.1 69

| | | | | | | | | |
|---|---|---|---|---|---|---|---|---|
| BFCN0003 | FCR4459 | FCR6508 | fcrb2071 | hfcr1714 | hfcr9439 | miob6781 | ncrc6720 | SEOA7534a |
| BFCW0014 | FCR4661 | FCR6660 | fcrb2188 | hfcr2513 | hfcr9550 | ncr3906 | ncrc8939 | SEOB0216 |
| FCR0555 | FCR4772 | FCR7448 | fcrb2219 | HFCR3228 | MIOA1289 | ncr8373 | ncrc9244 | SEOB3228 |
| FCR1489 | FCR4863 | fcrb0681 | fcrb2535 | hfcr6433 | MIOA1633a | ncr8593 | SEOA0402 | seob3987 |
| FCR1596N | FCR5014 | fcrb0684 | hfcr0149 | hfcr6765 | MIOA3451a | ncrc0110 | SEOA2266a | seob4978 |
| FCR1832 | FCR5155 | fcrb1322 | hfcr0798 | hfcr6896 | miob0936 | ncrc1064 | SEOA2305a | |
| FCR2055 | FCR5196 | fcrb1388 | hfcr0933 | hfcr7828 | miob4239 | ncrc2189 | SEOA7493a | |
| FCR4135 | FCR5623 | fcrb1577 | hfcr0940 | hfcr8908 | miob5656 | ncrc4926 | SEOA7516a | |

Figure 6A – EST Names Corresponding to Unique Known Genes of Figure 6

58. LINE-1 REVERSE TRANSCRIPTASE HOMOLOG (=putative p150) spP08547 68

| | | | | | | | | |
|---|---|---|---|---|---|---|---|---|
| ncrc4841 | mioa9715 | miob6928 | ncr3330 | ncr7951 | ncrb3860 | ncrc3159 | ncrc6703 | seob6148 |
| ncrc5022 | miob0184 | ncr0422 | ncr3468 | ncr8310 | ncrb6723 | ncrc3204 | ncrc7091 | seob6182 |
| hfcr0882 | miob0522 | ncr0505 | ncr5681 | ncr9305 | ncrb7313 | ncrc3786 | ncrc9267 | seob6283 |
| mioa0136m | miob0669 | ncr0514 | ncr5708 | ncr9853 | ncrb7775 | ncrc4112 | ncrc9309 | seob6822 |
| MIOA3911a | miob1725 | ncr0525 | ncr7128 | ncrb0725 | ncrb8499 | ncrc4516 | ncrc9564 | |
| MIOA7295 | miob3754 | ncr3120 | ncr7143 | ncrb2043 | ncrc0853 | ncrc4551 | seob1042 | |
| mioa9386 | miob6328 | ncr3231 | ncr7471 | ncrb2239 | ncrc1754 | ncrc5181 | seob3686 | |
| mioa9402 | miob6630 | ncr3287 | ncr7949 | ncrb3587 | ncrc3087 | ncrc6672 | seob5686 | |

59. ribosomal protein L6 X69391 66

| | | | | | | | | |
|---|---|---|---|---|---|---|---|---|
| FCR0265 | FCR5508 | fcrb2236 | MIOA1529 | mioa9877 | ncr7770 | ncrc2295 | SEOA5916 | seob7870 |
| FCR1061n | FCR6827 | fcrb2315 | MIOA3177a | miob3620 | ncrb0037 | ncrc3544 | SEOA7568a | seob8172 |
| FCR2738 | fcrb1088 | hfcr1252 | MIOA4563a | miob3631 | ncrb0223 | ncrc3648 | SEOB3316 | |
| FCR3740 | fcrb1305 | hfcr1778 | MIOA6194a | ncr0393 | ncrb6689 | ncrc3648 | seob5041 | |
| FCR4019 | fcrb1685 | hfcr5769 | MIOA6799a | ncr1578 | ncrb7097 | SEOA1155a | seob5270 | |
| FCR4350 | fcrb1780 | hfcr7778 | MIOA7132a | ncr2808 | ncrb7185 | SEOA1276a | seob5685 | |
| FCR4497 | fcrb2045 | hfcr9176 | MIOA8936 | ncr2870 | ncrc0617 | SEOA5059a | seob5746 | |
| FCR4779 | fcrb2105 | hfcr9226 | mioa9762 | ncr7349 | ncrc0732 | SEOA5545a | seob7309 | |

60. ribosomal protein L32 (RPL32) NM_000994.1 66

| | | | | | | | | |
|---|---|---|---|---|---|---|---|---|
| BFCS0083 | FCR0886 | fcrb2032 | hfcr2514 | hfcr9071 | MIOA3608a | ncrb0488 | ncrc1799 | seob4964 |
| BFCS0389 | FCR4652 | fcrb2081 | hfcr2682 | hfcr9210 | mioa9507 | ncrb4083 | ncrc2065 | seob6094 |
| BFCW0384 | FCR4726 | fcrb2092 | hfcr3773 | hfcr9471 | mioa9664 | ncrb4929 | ncrc5204 | |
| BFCW0605 | FCR4875 | fcrb2406 | hfcr4156 | hfcr9539 | miob0777 | ncrb6587 | ncrc9397 | |
| CR0042 | FCR5201 | fcrb2563 | hfcr5671 | hfcr9640 | ncr2995 | ncrb7604 | SEOA5904 | |
| CR0167 | FCR5727 | fcrb2705 | hfcr6091 | hfcr9663 | ncr4816 | ncrb7839 | SEOB0167 | |
| CR0231 | FCR6443 | hfcr0558 | hfcr6213 | MIOA0197a | ncr6019 | ncrc0049 | SEOB1114 | |
| FCR0235 | fcrb0037 | hfcr0605 | hfcr6865 | MIOA1668a | ncr6375 | ncrc0397 | SEOB1184 | |

61. ribosomal protein L27 (RPL27) NM_000988.1 65

| | | | | | | | | |
|---|---|---|---|---|---|---|---|---|
| BFCW0589 | FCR4638 | hfcr3676 | hfcr9143 | miob3736 | ncrb4847 | SEOA4009a | SEOA7083a | seob7060 |
| cr0018n | FCR5376 | hfcr4166 | hfcr9958 | miob6605 | ncrb5528 | SEOA4131a | seoa7753a | |
| FCR0890 | FCR6255 | hfcr5037 | hfcr9985 | ncr1992 | ncrc3556 | SEOA4217a | SEOA8256 | |
| FCR2721 | FCR6345 | hfcr5133 | MIOA0698 | ncr2490 | ncrc6030 | SEOA4838a | SEOA8256 | |
| FCR3569 | FCR7291 | hfcr6272 | MIOA8066 | ncr3363 | ncrc6509 | SEOA5274a | SEOB0945 | |
| FCR3716 | fcrb0327 | hfcr7376 | MIOA8126 | ncr5683 | ncrc9692 | SEOA5497a | seob5557 | |
| FCR3955 | hfcr0089 | hfcr7841 | MIOA8126 | ncr7157 | SEOA1456a | SEOA6276 | seob6322 | |
| FCR4487 | HFCR3236 | hfcr8887 | miob0789 | ncr8651 | SEOA3244 | SEOA6461a | seob6380 | |

62. reverse transCRiptase D84391 64

| | | | | | | | |
|---|---|---|---|---|---|---|---|
| hfcr0882 | miob1725 | ncr0525 | ncr5708 | ncr9853 | ncrc0853 | ncrc4551 | ncrc9309 |
| MIOA3538a | miob3754 | ncr3120 | ncr7128 | ncrb0725 | ncrc1754 | ncrc4841 | ncrc9564 |
| mioa9386 | miob6328 | ncr3231 | ncr7143 | ncrb2043 | ncrc3087 | ncrc5022 | seob1042 |
| mioa9402 | miob6630 | ncr3260 | ncr7471 | ncrb2239 | ncrc3159 | ncrc5181 | seob5686 |
| mioa9715 | miob6928 | ncr3287 | ncr7949 | ncrb6723 | ncrc3204 | ncrc6672 | seob6148 |
| miob0184 | ncr0422 | ncr3330 | ncr7951 | ncrb7313 | ncrc3786 | ncrc6703 | seob6182 |
| miob0522 | ncr0505 | ncr3468 | ncr8310 | ncrb7775 | ncrc4112 | ncrc7091 | seob6283 |
| miob0669 | ncr0514 | ncr5681 | ncr9305 | ncrb8499 | ncrc4516 | ncrc9267 | seob6822 |

63. asporin (ASPN) (LRR class 1) NM_017680.1 63

| | | | | | | | | |
|---|---|---|---|---|---|---|---|---|
| SEOA2496 | mioa9350 | miob1075 | MIOB1547 | miob1952 | miob3568 | miob6013 | miob6733 | miob7035 |
| mioa7722a | mioa9361 | miob1138 | miob1744 | MIOB2094 | miob3821 | miob6458 | miob6919 | ncrb1583 |
| mioa9267 | miob0652 | MIOB1541 | miob1772 | miob2889 | miob4143 | miob6569 | miob7032 | ncrb4256 |

Figure 6A – EST Names Corresponding to Unique Known Genes of Figure 6

| | | | | | | | | |
|---|---|---|---|---|---|---|---|---|
| ncrc1221 | seoa8039 | SEOA8780 | seob0215n | SEOB1634 | SEOB1941 | seob4979 | seob6284 | seob6840 |
| ncrc4009 | SEOA8671 | SEOA9316 | SEOB0508 | SEOB1677 | SEOB2092 | seob5136 | seob6474 | seob7095 |
| seoa2496 | SEOA8694 | SEOB0086 | SEOB0575 | SEOB1776 | seob4241 | seob5354 | seob6520 | seob7492 |
| seoa6842 | SEOA8772 | SEOB0112 | SEOB1107 | SEOB1826 | seob4765 | seob6278 | seob6534 | seob7974 |

64. ribosomal protein L13 AF112214 61

| | | | | | | | | |
|---|---|---|---|---|---|---|---|---|
| BFCN0142 | FCR7167 | fcrb1246 | hfcr3533 | hfcr8404 | MIOA6006a | ncrb3415 | SEOA1584a | seob6616 |
| BFCN0181 | FCR7431 | fcrb2583 | hfcr4169 | hfcr8525 | MIOA6511a | ncrb5350 | SEOA3293 | seob7110 |
| BFCN0216 | FCR7500 | fcrb2732 | hfcr5435 | hfcr8534 | mioa9789 | ncrc1893 | SEOA3331a | seob7990 |
| FCR2501 | FCR7643 | hfcr0499 | hfcr5742 | hfcr8554 | miob3548 | ncrc2655 | SEOA5062a | seob8044 |
| FCR2838 | fcrb0063 | hfcr0634 | hfcr6436 | hfcr9512 | ncr0796 | ncrc6153 | SEOA9288 | seob8108 |
| FCR4845 | fcrb0155 | hfcr1145 | hfcr7708 | MIOA2019 | ncr4434 | ncrc6522 | SEOB0548 | |
| FCR5157 | fcrb0173 | HFCR3206 | hfcr7852 | MIOA4663a | ncr5152 | ncrc9443 | SEOB0600 | |

65. Ribosomal protein L4 NM_000968.1 61

| | | | | | | | | |
|---|---|---|---|---|---|---|---|---|
| BFCS0487 | FCR6274 | hfcr6558 | miob5649 | ncr6815 | ncrb5268 | ncrc2391 | SEOA0121 | SEOA9030 |
| FCR0500 | FCR7020 | hfcr7492 | ncr0056 | ncrb1065 | ncrb5780 | ncrc2795 | seoa0767m | seob3911 |
| FCR0580 | hfcr0700 | hfcr7981 | ncr0588 | ncrb2550 | ncrb6679 | ncrc3086 | SEOA1847a | seob4054 |
| FCR1218 | hfcr2860 | hfcr9257 | ncr2141 | ncrb4648 | ncrb7625 | ncrc4536 | SEOA3918 | seob7114 |
| FCR1386 | hfcr3483 | mioa9255 | ncr4070 | ncrb5090 | ncrb8104 | ncrc6692 | SEOA5850 | seob7575 |
| FCR1735 | hfcr3762 | MIOB2311 | ncr4661 | ncrb5173 | ncrc0899 | ncrc7174 | SEOA7275a | |
| FCR4879 | hfcr5690 | miob3796 | ncr5677 | ncrb5195 | ncrc1923 | ncrc9002 | seoa8030 | |

66. ribosomal protein S29 L31610.1 59

| | | | | | | | | |
|---|---|---|---|---|---|---|---|---|
| CR0835 | FCR5996 | hfcr7397 | miob0047 | ncr1388 | ncrb2676 | SEOA1644a | SEOA4343a | SEOA9923 |
| FCR0342 | fcrb0048 | hfcr8285 | miob0695 | ncr4424 | ncrb4605 | SEOA2088 | SEOA4429a | SEOB2268 |
| FCR2984 | fcrb1360 | hfcr9634 | miob0906 | ncr5084 | ncrb5634 | SEOA2341a | SEOA4531 | seob5210 |
| FCR3877 | fcrb1372 | hfcr9775 | miob4438 | ncrb0545 | ncrc0480 | SEOA2433a | SEOA4855a | |
| FCR5409 | fcrb2621 | MIOA5949a | miob6150 | ncrb1739 | ncrc0835 | SEOA2529 | SEOA5730a | |
| FCR5416 | HFCR3167 | MIOA6463a | ncr0253 | ncrb1977 | ncrc5559 | seoa2782n | SEOA8365a | |
| FCR5744 | hfcr3584 | MIOA8586 | ncr0307 | ncrb2133 | ncrc9894 | SEOA3872 | SEOA8555 | |

67. ribosomal protein L7a (surf 3) large subunitM36072 58

| | | | | | | | | |
|---|---|---|---|---|---|---|---|---|
| CR0292 | FCR5327 | hfcr0540 | HFCR3191 | MIOA6125a | ncr2532 | ncrc0633 | SEOA6482a | seob4128 |
| FCR0850 | FCR5421 | hfcr0856 | hfcr5895 | mioa9460 | ncr5626 | ncrc1864 | SEOA6578a | seob7666 |
| FCR1817 | FCR5683 | hfcr1385 | hfcr6068 | miob3731 | ncr7001 | ncrc4027 | SEOA9124 | |
| FCR2164 | FCR6582 | hfcr1784 | hfcr6907 | miob5118 | ncr7979 | ncrc4662 | SEOA9639 | |
| FCR4011 | fcrb0735 | hfcr1789 | MIOA3200a | miob5861 | ncr9865 | ncrc5109 | SEOB1631 | |
| FCR4039 | fcrb2080 | hfcr1901 | MIOA3730a | ncr0503 | ncrb4390 | ncrc6681 | SEOB2216 | |
| FCR5047 | hfcr0384 | HFCR3152 | MIOA4487a | ncr1651 | ncrb5591 | SEOA3041a | SEOB3483 | |

68. transforming growth factor beta-induced, 68kD (TGFBI) "NM_000358.1 58

| | | | | | | | | |
|---|---|---|---|---|---|---|---|---|
| FCR1324" | ncr5219 | SEOA2298a | SEOA3796a | SEOA5218a | SEOA7347a | SEOA9356 | SEOB2275 | seob6500 |
| FCR3283 | ncrc1237 | seoa2576m | SEOA3906 | SEOA5407 | SEOA7424a | SEOA9493 | SEOB3047 | seob7572 |
| hfcr3625 | ncrc3047 | SEOA3015a | SEOA4655a | SEOA5591a | SEOA7911a | SEOA9733 | SEOB3115 | |
| MIOB2862 | ncrc5571 | SEOA3296 | SEOA4755a | SEOA6003a | SEOA8708 | SEOB0110 | SEOB3192 | |
| miob5796 | SEOA1251A | SEOA3458a | SEOA4799a | SEOA6006a | SEOA8969 | SEOB0151 | SEOB3307 | |
| miob6897 | SEOA1600a | SEOA3473a | SEOA5069a | SEOA6158a | SEOA9145 | SEOB0465 | seob4133 | |
| ncr2025 | SEOA2236a | SEOA3583a | SEOA5217a | seoa7024 | SEOA9297 | SEOB0970 | seob5157 | |

69. ribosomal protein L30 L05095.1 57

| | | | | | | | | |
|---|---|---|---|---|---|---|---|---|
| ncrc3521 | CR0296 | FCR0963 | FCR6117 | fcrb2493 | hfcr1279 | HFCR3212 | hfcr7426 | hfcr9160 |
| ncrc3617 | CR0587 | FCR2784N | FCR6872 | fcrb2602 | hfcr2267 | hfcr3872 | hfcr8413 | hfcr9784 |
| BFCN0270 | FCR0159 | FCR5850 | fcrb2143 | hfcr0257 | HFCR3194 | hfcr4494 | hfcr8945 | MIOA3332a |

Figure 6A – EST Names Corresponding to Unique Known Genes of Figure 6

| | | | | | | | |
|---|---|---|---|---|---|---|---|
| MIOA3955a | miob0952 | ncr9147 | ncrb5470 | ncrc3999 | SEOA4887a | SEOB1458 | SOA0002 |
| MIOA4217 | ncr3598 | ncrb1231 | ncrc0553 | SEOA0957 | SEOA5601a | SEOB1471 | SOA0473 |
| MIOA5663 | ncr6079 | ncrb2177 | ncrc2711 | SEOA3967a | SEOA7143a | SEOB1496 | |
| miob0045 | ncr8767 | ncrb2576 | ncrc3196 | SEOA4789a | SEOA7479a | seob7948 | |

70. ribosomal protein S12 X53505 57

| | | | | | | | | |
|---|---|---|---|---|---|---|---|---|
| BFCN0203 | FCR3270 | fcrb0025 | fcrb1497 | hfcr6693 | MIOA1587 | ncrb2424 | ncrc2556 | SOA0347 |
| BFCS0314 | FCR4686 | fcrb0156 | fcrb1700 | hfcr6805 | mioa7858 | ncrb2692 | ncrc3749 | |
| BFCW0072 | FCR4945 | fcrb0221 | fcrb2632 | hfcr7063 | miob7036 | ncrb4310 | seoa1017m | |
| BFCW0372 | FCR6109 | fcrb0315 | fcrb2737 | hfcr7408 | ncr2762 | ncrb4753 | SEOA4041a | |
| FCR0055 | FCR6428 | fcrb1076 | hfcr0657 | hfcr7537 | ncr4970 | ncrb5760 | SEOA5967a | |
| fcr0063n | FCR7102 | fcrb1166 | hfcr2806 | hfcr7644 | ncr6819 | ncrc0025 | SEOA6746 | |
| FCR2716 | FCR7625 | fcrb1482 | hfcr3892 | hfcr9594 | ncrb0375 | ncrc1216 | SEOA9067 | |

71. ribosomal protein L23 NM_000978.1 55

| | | | | | | | |
|---|---|---|---|---|---|---|---|
| BFCS0007 | fcrb1414 | hfcr7082 | ncr3372 | ncrb3708 | ncrc0190 | ncrc2924 | SEOB1171 |
| CR0028 | fcrb1533 | hfcr7520 | ncr3431 | ncrb4203 | ncrc1121 | ncrc2958 | seob3662 |
| CR0275 | fcrb1554 | hfcr8513 | ncr4005 | ncrb4672 | ncrc1147 | ncrc4856 | seob4438 |
| FCR1138 | fcrb1844 | hfcr9036 | ncr7080 | ncrb5176 | ncrc1352 | ncrc9467 | seob4867 |
| FCR4605 | fcrb2247 | mioa9808 | ncr7095 | ncrb6617 | ncrc1467 | SEOA6873 | seob4872 |
| FCR4700 | hfcr4054 | ncr0742 | ncrb1419 | ncrb7787 | ncrc2168 | SEOA6926 | seob5284 |
| fcrb0326 | hfcr5011 | ncr2450 | ncrb1995 | ncrb8132 | ncrc2516 | SEOA9268 | seob5424 |

72. ribosomal protein S13 NM_001017.1 55

| | | | | | | | |
|---|---|---|---|---|---|---|---|
| BFCN0256 | fcrb2586 | hfcr7670 | MIOA8714 | ncr6681 | SEOA6214a | SEOA9404 | SEOB2981 |
| CR0941 | fcrb2689 | hfcr7932 | miob1202 | ncr6870 | SEOA6496a | SEOA9573 | seob3969 |
| FCR0586 | hfcr0946 | hfcr9610 | miob4654 | ncrb5584 | SEOA6667a | SEOA9895 | seob5488 |
| FCR2807 | hfcr1810 | MIOA0330n | miob5859 | ncrb7473 | SEOA6720 | SEOB0107 | seob6005 |
| FCR3656 | hfcr5469 | MIOA6099a | ncr0926 | ncrb7759 | SEOA7501a | SEOB0624 | seob6784 |
| FCR4037 | hfcr6927 | MIOA6170a | ncr2363 | ncrc7139 | seoa8082 | SEOB1869 | seob8164 |
| FCR6479 | hfcr7031 | MIOA8677 | ncr5093 | SEOA5810 | SEOA8571 | SEOB2078 | |

73. "hexabrachion (tenascin C, cytotactin) (HXB) "NM_002160.1 55

| | | | | | | | |
|---|---|---|---|---|---|---|---|
| fcrb2028 | miob0111 | ncrb4081 | SEOA0480 | SEOA6331 | SEOA9341 | SEOB2053 | seob5533 |
| hfcr0679 | miob1389 | ncrb7059 | SEOA1296a | seoa7021 | SEOA9558 | SEOB2082 | seob5838 |
| hfcr6406 | MIOB1519 | ncrc0973 | SEOA2357a | seoa7959 | SEOA9882 | SEOB2225 | seob5956 |
| hfcr6627 | miob3932 | ncrc0999 | SEOA4599 | seoa7968 | SEOB0293 | SEOB3281 | seob6378 |
| MIOA0613a | ncr0025 | SEOA0179a | SEOA5093a | seoa8009 | SEOB1685 | SEOB3447 | seob7144 |
| MIOA2181a | ncrb0076 | SEOA0218a | SEOA5366 | SEOA8620 | SEOB1781 | SEOB3584 | SOA0442N |
| MIOA2246a | ncrb1455 | SEOA0460 | SEOA6079a | SEOA9325 | SEOB1935 | seob4389 | |

74. ribosomal protein S24 M31520 54

| | | | | | | | | |
|---|---|---|---|---|---|---|---|---|
| CR0682 | FCR3912 | fcrb1286 | hfcr6040 | MIOA1654a | miob3637 | ncr6633 | SEOA4352a | SEOA9827 |
| FCR0161 | FCR5082 | hfcr0815 | hfcr8029 | MIOA5416a | miob4409 | ncr7525 | SEOA4494 | SEOA9843 |
| FCR0193 | FCR5213 | hfcr1688 | hfcr8277 | MIOA7536a | miob6201 | ncrb8345 | SEOA7395a | SEOB1917 |
| FCR1971 | FCR5870 | hfcr4174 | hfcr9277 | mioa9623 | ncr0323 | ncrc1358 | seoa7846a | seob4523 |
| FCR2813 | FCR6136 | hfcr4816 | hfcr9896 | mioa9700 | ncr3055 | ncrc4163 | SEOA8560 | seob4866 |
| FCR3430 | FCR6932 | hfcr5082 | MIOA0246a | miob1713 | ncr5725 | SEOA1087a | SEOA9089 | seob8072 |

75. cartilage link protein (CRTL1) U43328.1 54

| | | | | | | | | |
|---|---|---|---|---|---|---|---|---|
| ncrc4577 | FCR0818 | fcrb0409 | hfcr0979 | hfcr5807 | hfcr8602 | ncr0193 | ncr3922 | ncr7451 |
| ncrc4602 | FCR2128 | fcrb1038 | hfcr2918 | hfcr7538 | hfcr9366 | ncr0935 | ncr5056 | ncr7788 |
| BFCN0006 | FCR6309 | fcrb1853 | hfcr4100 | hfcr8053 | MIOA9154 | ncr0985 | ncr6991 | ncr9362 |
| CR0196 | FCR6669 | hfcr0638 | hfcr4438 | hfcr8584 | miob0708 | ncr2987 | ncr7109 | ncr9395 |

Figure 6A – EST Names Corresponding to Unique Known Genes of Figure 6

| | | | | | | | | |
|---|---|---|---|---|---|---|---|---|
| ncr9551 | ncr9811 | ncrb1555 | ncrb5231 | ncrc1005 | ncrc4201 | ncrc6252 | ncrc6804 | ncrc4602 |
| ncr9566 | ncrb0423 | ncrb2864 | ncrb8053 | ncrc1610 | ncrc4924 | ncrc6679 | ncrc4577 | SEOA8956 |

76. "actin, beta (ACTB) "NM_001101.2 53

| | | | | | | | | |
|---|---|---|---|---|---|---|---|---|
| BFCS0541 | FCR0233 | FCR6433 | hfcr5579 | miob6242 | ncr7430 | ncrb4668 | ncrb7747 | ncrc4876 |
| CR0054 | FCR0767 | fcrb0617 | hfcr6706 | ncr2461 | ncr8795 | ncrb5255 | ncrb8144 | ncrc9113 |
| CR0359 | FCR2620 | hfcr0305 | hfcr6900 | ncr3648 | ncrb0064 | ncrb5509 | ncrb8159 | SEOA9991 |
| CR0873 | FCR3097 | hfcr2832 | MIOA2341a | ncr5377 | ncrb0567 | ncrb6755 | ncrb8323 | SEOB0709a |
| CR0944 | FCR4029 | HFCR3125 | MIOA2621 | ncr6931 | ncrb2169 | ncrb7282 | ncrc1603 | seob5132 |
| CR1028 | FCR4755 | hfcr4325 | MIOA7237a | ncr7407 | ncrb4442 | ncrb7284 | ncrc1719 | |

77. Ribosomal protein L36 (=RPL44)AF077043.1 53

| | | | | | | | | |
|---|---|---|---|---|---|---|---|---|
| BFCN0045 | FCR1503 | FCR6206 | hfcr8568 | mioa9590 | ncr0097 | ncrb4370 | seoa7851a | seob4623 |
| BFCN0202n | FCR2123 | FCR7286 | hfcr8976 | miob0139 | ncr0847 | ncrb6223 | SEOB0585 | seob5429 |
| FCR0099 | FCR2543 | fcrb1449 | MIOA3482a | miob3799 | ncr2270 | ncrb8088 | SEOB1267 | seob7061 |
| FCR0558 | fcr3368n | fcrb1923 | MIOA3912a | miob3894 | ncr3305 | ncrc2298 | SEOB1596 | seob7264 |
| FCR0855 | FCR4617 | fcrb2739 | MIOA5618a | miob4540 | ncr4575 | ncrc2976 | SEOB2954 | seob7466 |
| FCR1203 | FCR4872 | hfcr0980 | MIOA6960a | miob6079 | ncr6711 | SEOA4202a | SEOB2967 | |

78. ribosomal protein S17 M13932 52

| | | | | | | | | |
|---|---|---|---|---|---|---|---|---|
| BFCN0222 | FCR2769 | fcrb2403 | hfcr0977 | hfcr6084 | miob0829 | ncr4754 | ncrb7749 | SEOA9500 |
| CR0050 | FCR4781 | fcrb2434 | hfcr1290 | hfcr6919 | miob4009 | ncr6756 | ncrb8512 | SEOB1433 |
| CR0414 | FCR6358 | hfcr0363 | hfcr2081 | hfcr9441 | miob6646 | ncrb6716 | ncrc2035 | seob3647 |
| CR0590 | FCR6532 | hfcr0625 | hfcr2713 | hfcr9609 | ncr0697 | ncrb7004 | SEOA2797 | seob6105 |
| fcr1019nn | fcrb1579 | hfcr0632 | hfcr2935 | MIOA3987a | ncr1219 | ncrb7221 | seoa7870a | |
| FCR1771 | fcrb2016 | hfcr0813 | HFCR3218 | MIOA6057a | ncr3787 | ncrb7353 | SEOA9471 | |

79. cytokine-like protein C17 NM_018659.1 51

| | | | | | | | | |
|---|---|---|---|---|---|---|---|---|
| ncrc3898 | miob2535 | ncr1310 | ncr3855 | ncr7165 | ncrb1094 | ncrb4927 | ncrc1080 | ncrc5090 |
| ncrc4120 | miob2963 | ncr2140 | ncr3859 | ncr8805 | ncrb1488 | ncrb4939 | ncrc1700 | ncrc5444 |
| mioa7725a | miob3172 | ncr2480 | ncr4721 | ncr8879 | ncrb1671 | ncrb6021 | ncrc2323 | ncrc5871 |
| MIOA9129 | miob3774 | ncr2708 | ncr5349 | ncr9169 | ncrb2739 | ncrb7176 | ncrc2881 | |
| mioa9529 | miob5605 | ncr2854 | ncr5976 | ncrb0117 | ncrb3147 | ncrc0120 | ncrc4179 | |
| miob1268 | ncr0269 | ncr3483 | ncr6769 | ncrb0721 | ncrb3851 | ncrc0437 | ncrc4284 | |

80. PRO2003 AF116679.1 51

| | | | | | | | | |
|---|---|---|---|---|---|---|---|---|
| ncrc2304 | hfcr0863 | hfcr7648 | hfcr9706 | ncr5471 | ncrb2836 | ncrc0213 | SEOB1777 | seob5987 |
| ncrc2307 | hfcr0893 | hfcr7953 | hfcr9915 | ncr9022 | ncrb3389 | ncrc0910 | SEOB2111 | seob6329 |
| ncrc3994 | hfcr2499 | hfcr8001 | miob0264 | ncr9343 | ncrb6969 | ncrc3257 | SEOB2276 | seob7459 |
| ncrc4141 | hfcr6104 | hfcr8210 | miob6220 | ncrb0677 | ncrb7780 | ncrc9515 | seob4314 | |
| ncrc4476 | hfcr6542 | hfcr8910 | ncr1797 | ncrb2135 | ncrb7836 | SEOB0080 | seob5004 | |
| ncrc4593 | hfcr6725 | hfcr9559 | ncr2467 | ncrb2834 | ncrb8723 | SEOB1463 | seob5541 | |

81. prothymosin alpha M14630 51

| | | | | | | | | |
|---|---|---|---|---|---|---|---|---|
| CR0302 | FCR3466 | hfcr1734 | MIOA2416a | miob1793 | ncrb6724 | SEOA2613 | SEOA9772 | seob6179 |
| CR0768 | FCR5068 | HFCR3097 | MIOA3296a | miob5650 | ncrc0481 | SEOA4152a | SEOA9944 | seob6795 |
| FCR0469 | FCR6419 | HFCR3148 | MIOA4615a | miob6633 | ncrc4208 | SEOA6138a | SEOA9978 | SOA0630 |
| FCR0611 | fcrb0952 | hfcr4600 | MIOA5169a | ncr1756 | ncrc7100 | SEOA6683a | SEOB0522 | |
| FCR1133 | fcrb1532 | hfcr8455 | miob0457 | ncr2091 | ncrc8969 | SEOA7329a | SEOB3176 | |
| FCR3022 | hfcr1133 | hfcr8906 | miob0688 | ncr8485 | ncrc9527 | SEOA9322 | seob5676 | |

Figure 6A – EST Names Corresponding to Unique Known Genes of Figure 6

82. tumor rejection antigen (gp96) 1 (TRA1) X15187 51

| | | | | | | | | |
|---|---|---|---|---|---|---|---|---|
| FCR2424 | hfcr2017 | MIOA5601a | MIOB2798 | miob5436 | ncr8443 | SEOA0899 | SEOA9754 | seob7485 |
| FCR4949 | hfcr3736 | MIOA6103a | miob3367 | miob6085 | ncr8848 | seoa1357m | SEOA9919 | seob7970 |
| FCR5092 | hfcr4140 | MIOA6704a | miob3975 | miob6175 | ncrb5222 | SEOA2148n | SEOB1422 | SOA0327 |
| FCR7473 | hfcr5481 | MIOA7467a | miob4069 | miob6184 | ncrc2842 | SEOA3353a | seob6151 | |
| FCR7642 | MIOA2495a | MIOA8468 | miob4412 | miob6763 | ncrc3133 | SEOA6403 | seob6549 | |
| fcrb1656 | MIOA2777a | miob0951 | miob4883 | ncr7371 | ncrc5240 | SEOA8275 | seob7328 | |

83. "actin, gamma 1 (ACTG1) "NM_001614.1 51

| | | | | | | | | |
|---|---|---|---|---|---|---|---|---|
| BFCS0504 | FCR0595 | fcrb0427 | hfcr3576 | hfcr6740 | hfcr9960 | ncrb1137 | ncrc9679 | seob6869 |
| BFCW0404 | FCR2311 | fcrb1075 | hfcr4467 | hfcr6797 | MIOA8852 | ncrb2109 | ncrc9850 | seob7563 |
| BFCW0558 | FCR2503 | fcrb1487 | hfcr4476 | hfcr7025 | miob0933 | ncrb7748 | SEOA0412 | SOA0673 |
| FCR0273 | FCR3102 | fcrb1937 | hfcr5166 | hfcr8387 | miob3532 | ncrc0240 | SEOA5639a | |
| FCR0438 | FCR3478 | hfcr1183 | hfcr6471 | hfcr8409 | ncr6706 | ncrc0623 | SEOA6908 | |
| FCR0525 | FCR3637 | hfcr3491 | hfcr6619 | hfcr9933 | ncr9365 | ncrc4043 | seob5705 | |

84. ferritin heavy chain L20941.1 50

| | | | | | | | | |
|---|---|---|---|---|---|---|---|---|
| FCR6907 | MIOA5974a | ncr6856 | SEOA0589a | SEOA2861 | SEOA4496 | seoa6960 | SEOA9191 | seob8263 |
| fcrb0752 | miob1004 | ncr9053 | SEOA1715a | SEOA3043a | SEOA4539 | seoa6965 | SEOB3562 | seob8333 |
| hfcr1741 | miob2883 | ncrb1223 | SEOA1919n | seoa3177m | SEOA5126a | SEOA7227a | seob3681 | |
| hfcr9236 | miob2961 | ncrb3177 | SEOA2019 | SEOA3573a | SEOA5165a | seoa8115 | seob5030 | |
| MIOA5834a | miob3041 | ncrb6581 | SEOA2238a | SEOA4032a | SEOA6228 | SEOA8690 | seob5347 | |
| MIOA5930a | ncr5675 | SEOA0581 | SEOA2241a | SEOA4495 | SEOA6257 | SEOA8691 | seob7869 | |

85. PRO2853 AF119905.1 50

| | | | | | | | | |
|---|---|---|---|---|---|---|---|---|
| ncrc6233 | miob0751 | ncrb0660 | ncrb1530 | ncrb4708 | ncrc0297 | ncrc3873 | ncrc9561 | seob6864 |
| ncrc7150 | miob1376 | ncrb0759 | ncrb2189 | ncrb4836 | ncrc0399 | ncrc4670 | ncrc9703 | seob7315 |
| mioa7731a | miob2945 | ncrb1235 | ncrb2601 | ncrb6809 | ncrc0561 | ncrc5067 | ncrc9804 | |
| mioa9306 | miob3459 | ncrb1300 | ncrb3152 | ncrb7647 | ncrc1632 | ncrc5910 | SEOB1109 | |
| mioa9758 | miob4938 | ncrb1394 | ncrb3165 | ncrb7987 | ncrc2580 | ncrc6356 | SEOB2762 | |
| miob0742 | miob6344 | ncrb1487 | ncrb3522 | ncrc0263 | ncrc3304 | ncrc9005 | SEOB3079 | |

86. ribosomal protein L5 U76609 48

| | | | | | | | |
|---|---|---|---|---|---|---|---|
| BFCW0010 | FCR4848 | fcrb1390 | hfcr4122 | MIOA8734 | miob4246 | ncrb2963 | SEOB1903 |
| CR0394 | FCR5515 | hfcr0494 | hfcr5240 | miob1093 | miob6302 | ncrb7950 | seob3692 |
| CR0874 | FCR5987 | hfcr1208 | hfcr8222 | MIOB2121 | miob6386 | ncrc1138 | seob3972 |
| FCR0332 | FCR7697 | hfcr1272 | hfcr8452 | MIOB2789 | ncr1492 | ncrc3238 | seob4595 |
| FCR2853N | fcrb1035 | hfcr1682 | hfcr9774 | miob4056 | ncr5412 | ncrc9912 | seob4864 |
| FCR4096 | fcrb1138 | hfcr2509 | MIOA6875a | miob4211 | ncrb1521 | SEOA1118a | seob7667 |

87. nribosomal protein L26 X69392 48

| | | | | | | | |
|---|---|---|---|---|---|---|---|
| bfcw0519 | FCR5982 | hfcr1112 | MIOA1704a | miob2515 | ncrb2182 | seoa4905a | SEOB0278 |
| CR0351 | FCR6554 | hfcr1225 | MIOA1780 | miob3428 | ncrb6350 | SEOA6501a | SEOB0646a |
| CR0532 | FCR6916 | hfcr2743 | MIOA2056 | miob3454 | ncrb6976 | SEOA6533a | SEOB1528 |
| FCR0868 | fcrb1730 | hfcr3589 | MIOA2332a | miob4406 | ncrc5956 | SEOA7171a | SEOB2643 |
| FCR4049 | hfcr0962 | hfcr9444 | MIOA3991a | miob5941 | ncrc9294 | seoa7859a | SEOB3118 |
| FCR4578 | hfcr1093 | hfcr9704 | MIOA5747a | ncrb1141 | SEOA4119a | SEOA9571 | seob4349 |

88. "ribosomal protein, large, P1 (RPLP1) "NM_001003.1 48

| | | | | | | | | |
|---|---|---|---|---|---|---|---|---|
| BFCW0055 | CR0861 | FCR1286 | FCR3492 | FCR4264 | FCR7069 | fcrb1647 | hfcr1875 | hfcr4027 |
| BFCW0412 | FCR0667 | FCR1831 | FCR3812 | FCR4340 | fcrb0204 | fcrb2174 | hfcr3542 | hfcr5767 |
| CR0283 | FCR0729 | FCR2186 | FCR4095 | FCR5330 | fcrb1313 | hfcr0922 | hfcr3588 | hfcr6675 |
| CR0859 | FCR1117N | FCR2694 | FCR4232 | FCR6800 | fcrb1505 | hfcr1074 | hfcr3651 | hfcr7578 |

Figure 6A – EST Names Corresponding to Unique Known Genes of Figure 6

| | | | | | | | | |
|---|---|---|---|---|---|---|---|---|
| hfcr7866 | hfcr9661 | MIOA1273 | miob1255 | SEOA4147a | seob6226 | | | |
| hfcr9473 | hfcr9696 | MIOA1790 | ncr0336 | SEOB3513 | seob7978 | | | |

89. ribosomal protein L11 L05092.1 48

| | | | | | | | |
|---|---|---|---|---|---|---|---|
| BFCW0433 | FCR2602 | fcrb1541 | hfcr3869 | MIOA6598a | ncr7355 | ncrb7480 | SEOA5534a |
| CR0545 | FCR3500 | hfcr0573 | hfcr5796 | ncr2533 | ncrb0789 | ncrc1008 | SEOA6566a |
| CR0830 | FCR4655 | hfcr1894 | hfcr6105 | ncr3037 | ncrb2295 | ncrc2731 | SEOA8322a |
| FCR0167 | FCR4842 | hfcr1896 | hfcr6522 | ncr3083 | ncrb3967 | ncrc4222 | SEOB0912a |
| FCR0471 | FCR7248 | hfcr2588 | hfcr8362 | ncr3874 | ncrb6272 | ncrc4419 | seob2548 |
| FCR1540 | FCR7477 | hfcr2628 | hfcr9731 | ncr4339 | ncrb7479 | SEOA1885 | seob8315 |

90. "guanine nucleotide binding protein (G protein), beta polypeptide 2-like 1 (GNB2L1) "NM_006098.1 48

| | | | | | | | |
|---|---|---|---|---|---|---|---|
| FCR0068 | FCR2537 | hfcr0338 | hfcr8458 | miob1071 | ncr8620 | ncrb5828 | ncrc1735 |
| FCR0603 | FCR2633 | hfcr0399 | hfcr8507 | ncr2251 | ncrb2728 | ncrb6304 | ncrc2045 |
| FCR0765 | FCR4805 | hfcr3802 | hfcr9053 | ncr3962 | ncrb3965 | ncrb6391 | ncrc4250 |
| FCR1289 | fcrb1688 | hfcr5246 | MIOA1401a | ncr5713 | ncrb4362 | ncrc1152 | SEOA3128a |
| FCR1466 | fcrb1925 | hfcr6291 | MIOA9171 | ncr5758 | ncrb4487 | ncrc1200 | seoa7861a |
| FCR2096 | fcrb2086 | hfcr7018 | miob0932 | ncr6203 | ncrb4934 | ncrc1204 | seob3908 |

91. vitamin A responsive cytoskeleton related (JWA) NM_006407.2 47

| | | | | | | | |
|---|---|---|---|---|---|---|---|
| MIOA0651 | MIOA6790a | MIOB2216 | ncr0376 | ncrc0387 | SEOA1289a | SEOA8380a | seob6827 |
| MIOA1315a | MIOA7042a | miob2420 | ncr2407 | ncrc4304 | SEOA1784a | SEOA9197 | seob7310 |
| MIOA2681a | MIOA7194a | miob3029 | ncr2413 | ncrc5456 | SEOA2439a | SEOA9517 | seob7541 |
| MIOA3400a | MIOA7246a | miob3457 | ncr2442 | ncrc6712 | SEOA3816a | SEOA9791 | seob8040 |
| MIOA5825a | MIOA8806 | miob5724 | ncrb2543 | ncrc6908 | SEOA4734a | SEOB1085 | soa0240n |
| MIOA6569a | miob0794 | miob6274 | ncrb2617 | SEOA0336 | seoa7058 | SEOB1337 | |

92. HSPC312 (ORF) = AF161428.1 (=HSPC310)AF161430 47

| | | | | | | | |
|---|---|---|---|---|---|---|---|
| MIOA1274m | miob3060 | ncr2595 | ncr7344 | ncrb4119 | ncrc2448 | ncrc6670 | SEOB3066 |
| miob0100 | miob3656 | ncr3182 | ncr7350 | ncrb4347 | ncrc2953 | ncrc7049 | SEOB3514 |
| miob1291 | miob5122 | ncr3989 | ncr9923 | ncrb6046 | ncrc3813 | ncrc9877 | seob3699 |
| miob1869 | miob5762 | ncr5115 | ncrb2076 | ncrb7830 | ncrc3928 | SEOA4771a | seob7027 |
| miob2402 | ncr1390 | ncr5176 | ncrb2748 | ncrb7914 | ncrc4317 | SEOA9480 | seob7744 |
| miob2436 | ncr2560 | ncr5477 | ncrb3902 | ncrb8016 | ncrc4428 | SEOA9572 | |

93. H factor 1 (complement) (HF1) NM_000186.1 47

| | | | | | | | |
|---|---|---|---|---|---|---|---|
| FCR4832 | MIOA6523a | miob1113 | ncr1313 | ncr7734 | ncrc0663 | ncrc9585 | SEOB1216 |
| MIOA0119 | MIOA7036a | MIOB2080 | ncr5158 | ncr8426 | ncrc1852 | SEOA4625a | seob4628 |
| MIOA1338a | miob0465 | miob6360 | ncr5182 | ncrb4282 | ncrc3002 | SEOA5210 | seob6372 |
| MIOA2593a | miob0692 | miob6948 | ncr5401 | ncrb6766 | ncrc6363 | SEOA7182a | seob6426 |
| MIOA4422 | miob0709 | miob6978 | ncr6099 | ncrb7494 | ncrc6476 | SEOB0200 | seob7338 |
| MIOA6504a | miob1111 | miob7041 | ncr6912 | ncrb8592 | ncrc6936 | SEOB0972 | |

94. mimecan (OGN) (OIF) AF202167.1 45

| | | | | | | | | |
|---|---|---|---|---|---|---|---|---|
| FCR5442 | MIOA2568a | miob3974 | miob5983 | ncrb5896 | seoa6793 | SEOA8250 | SEOB3214 | seob6287 |
| MIOA0852a | MIOA5495a | miob3980 | miob6107 | SEOA2992a | seoa6802 | SEOA9718 | SEOB3245 | seob6713 |
| MIOA1588 | MIOA7387a | miob4952 | miob6295 | SEOA3954a | SEOA7427a | SEOA9909 | seob3718 | seob8240 |
| MIOA1841a | mioa9465 | miob5001 | miob6776 | SEOA4828a | SEOA7597a | SEOB1081 | seob4882 | SOA0121 |
| MIOA2415a | mioa9991n | miob5063 | miob6848 | SEOA5869 | seoa7704a | SEOB1505 | seob6218 | SOA0256 |

Figure 6A – EST Names Corresponding to Unique Known Genes of Figure 6

95. "S100 calcium-binding protein A4 (calcium protein, calvasculin, metastasin, murine placental homolog) (S100A4) " gi4506764 44

| | | | | | | | | |
|---|---|---|---|---|---|---|---|---|
| hfcr9607 | mioa7809a | miob3176 | ncr4603 | ncrb3097 | ncrc4492 | seoa4916a | SEOA8418 | seob5333 |
| MIOA5003a | MIOA8229 | miob6915 | ncr5163 | ncrc0506 | ncrc4844 | SEOA6170a | SEOA9037 | seob5358 |
| MIOA6456a | MIOA8842 | ncr0184 | ncr8139 | ncrc0512 | ncrc6478 | SEOA6894 | SEOA9758 | seob6018 |
| MIOA6540a | miob0016 | ncr0347 | ncr8280 | ncrc2974 | ncrc9115 | seoa7740a | SEOB1119 | seob6747 |
| MIOA6878a | miob0661 | ncr2603 | ncrb2310 | ncrc4228 | ncrc9469 | SEOA8193a | seob4697 | |

96. annexin I (lipocortin I) (ANX1) =X05908 (ORF) NM_000700.1 44

| | | | | | | | | |
|---|---|---|---|---|---|---|---|---|
| MIOA4681 | miob1144 | miob6267 | ncrb8153 | SEOA4421a | SEOA8765 | SEOB0182 | SEOB3077 | seob4737 |
| MIOA4682 | miob1443 | ncr2764 | ncrc1587 | SEOA4510 | SEOA8920 | SEOB0694a | SEOB3508 | seob5733 |
| MIOA5996a | miob3338 | ncr3620 | ncrc3589 | SEOA4561 | SEOA9429 | SEOB1150 | SEOB3576 | seob6644 |
| MIOA8978 | miob3822 | ncr6739 | ncrc4011 | SEOA4636a | SEOA9838 | SEOB2284 | seob3756 | SOA0340 |
| miob0431 | miob5843 | ncr7042 | ncrc5982 | seoa7739a | SEOA9927 | SEOB2734 | seob3943 | |

97. glyceraldehyde 3-phosphate dehydrogenase (GADPH)J02642 44

| | | | | | | | | |
|---|---|---|---|---|---|---|---|---|
| BFCN0082 | FCR0905 | FCR1777 | FCR3113 | FCR6586 | fcrb2285 | hfcr2318 | hfcr6340 | hfcr9317 |
| BFCW0520 | FCR1515N | FCR1891 | FCR3705 | FCR7546 | fcrb2494 | hfcr2864 | hfcr6855 | miob4702 |
| CR0685 | FCR1516 | FCR2240 | FCR4159 | fcrb0710 | hfcr0405 | hfcr3524 | hfcr7453 | ncrb2952 |
| FCR0310 | FCR1729 | FCR2283 | FCR4860 | fcrb1584 | hfcr1711 | hfcr3936 | hfcr7845 | ncrc4936 |
| FCR0755 | FCR1772 | FCR2688 | FCR5194 | fcrb1900 | hfcr1859 | hfcr6120 | hfcr8879 | |

98. ribosomal protein L27A AB020236.1 44

| | | | | | | | | |
|---|---|---|---|---|---|---|---|---|
| BFCW0194 | FCR3185 | FCR6429 | fcrb1391 | hfcr2221 | HFCR3190 | hfcr6994 | ncr6910 | ncrb5446 |
| BFCW0258 | FCR3868 | FCR6751 | fcrb2254 | hfcr2271 | hfcr3405 | hfcr7069 | ncr7368 | ncrc4888 |
| CR0469 | FCR4626 | FCR6894 | hfcr0569 | hfcr2793 | hfcr3991 | hfcr7436 | ncr8555 | SEOB0042 |
| FCR1818 | FCR4783 | FCR6960 | hfcr2071 | hfcr2837 | hfcr3994 | hfcr8887 | ncr8813 | seob7953 |
| FCR3092 | FCR6389 | FCR7206 | hfcr2074 | hfcr3015 | hfcr4527 | MIOA6389a | ncrb5445 | |

99. HSPC310 (=HSPC312) AF161428.1 44

| | | | | | | | | |
|---|---|---|---|---|---|---|---|---|
| MIOA1274m | miob3060 | ncr2595 | ncr5477 | ncrb2748 | ncrb7830 | ncrc3813 | ncrc7049 | SEOB3066 |
| miob0100 | miob3656 | ncr3182 | ncr7344 | ncrb3902 | ncrb7914 | ncrc3928 | ncrc9877 | SEOB3514 |
| miob1291 | miob5762 | ncr3989 | ncr7350 | ncrb4119 | ncrb8016 | ncrc4317 | SEOA4771a | seob3699 |
| miob2402 | ncr1390 | ncr5115 | ncr9923 | ncrb4347 | ncrc2448 | ncrc4428 | SEOA9480 | seob7027 |
| miob2436 | ncr2560 | ncr5176 | ncrb2076 | ncrb6046 | ncrc2953 | ncrc6670 | SEOA9572 | |

100. "calmodulin 2 (phosphorylase kinase, delta) (CALM2) "NM_001743.1 43

| | | | | | | | | |
|---|---|---|---|---|---|---|---|---|
| MIOA4349a | MIOA6831a | miob1860 | miob3925 | miob5683 | ncr3101 | ncrc5420 | SEOA4137a | seob3862 |
| MIOA4903a | MIOA6891a | miob1860 | miob3945 | miob5852 | ncr7322 | ncrc5420 | SEOA4741a | seob4267 |
| MIOA5237a | mioa9624 | miob3025 | miob4048 | miob5868 | ncr9323 | SEOA0129 | SEOA5470a | seob5979 |
| MIOA5257a | miob0055 | miob3025 | miob4203 | miob5962 | ncrb3028 | SEOA2708 | SEOB0082 | |
| MIOA5684 | miob1747 | miob3272 | miob4335 | miob6050 | ncrb3028 | SEOA3862 | SEOB0082 | |

101. ribosomal protein L39 D79205 43

| | | | | | | | | |
|---|---|---|---|---|---|---|---|---|
| FCR0169 | fcrb1442 | hfcr0588 | MIOA0909a | ncrb0203 | ncrc2237 | SEOA1576a | SEOB2249 | seob4528 |
| FCR4623 | fcrb2397 | hfcr4463 | MIOA1466 | ncrb0676 | ncrc3575 | SEOA2383a | SEOB2265 | seob5190 |
| FCR7745 | fcrb2433 | hfcr5670 | MIOA3141a | ncrb2887 | ncrc4675 | seoa7729a | SEOB3211 | seob6270 |
| fcrb0093 | fcrb2727 | hfcr6113 | MIOA6469a | ncrb4817 | ncrc5035 | SEOA9773 | SEOB3491 | |
| fcrb0418 | hfcr0527 | hfcr6803 | ncr0178 | ncrc1387 | ncrc5546 | SEOB1785 | seob3937 | |

Figure 6A – EST Names Corresponding to Unique Known Genes of Figure 6

102. ascent-polypeptide-associated complex alpha polypeptide (NACA) NM_005594.1 43

| | | | | | | | | |
|---|---|---|---|---|---|---|---|---|
| BFCW0500n | hfcr7955 | MIOA6720a | miob1801 | ncrb4406 | SEOA1089a | SEOA4848a | SEOA9335 | SEOB3122 |
| FCR4155 | MIOA2196a | MIOA8169 | miob2463 | ncrc2607 | SEOA1200A | SEOA7105a | SEOA9832 | SEOB3278 |
| FCR6870 | MIOA2899a | mioa9297 | miob4817 | ncrc2971 | SEOA1451a | SEOA8438 | SEOB1282 | seob7977 |
| fcrb2218 | MIOA3466a | miob1000 | miob7039 | ncrc4852 | SEOA4554 | SEOA8524 | SEOB2746 | |
| hfcr1318 | MIOA5983a | miob1267 | ncrb2888 | ncrc9274 | SEOA4719a | SEOA9110 | SEOB2793 | |

103. ribosomal protein L44 (RPL44)NM_001001.1 42

| | | | | | | | | |
|---|---|---|---|---|---|---|---|---|
| BFCN0045 | FCR4872 | hfcr0872 | MIOA3912a | miob3799 | ncrb6223 | seoa7851a | SEOB2954 | seob7264 |
| BFCN0202n | FCR7465 | hfcr0980 | MIOA5618a | miob3894 | ncrb8088 | SEOA9692 | SEOB2967 | seob7466 |
| FCR0099 | fcrb1449 | hfcr1192 | MIOA6960a | miob4540 | ncrc2298 | SEOB0585 | seob4623 | |
| FCR1203 | fcrb1923 | hfcr8976 | mioa9590 | miob6079 | ncrc2976 | SEOB1267 | seob5429 | |
| FCR2543 | fcrb2739 | MIOA3482a | miob0139 | ncr3305 | SEOA4202a | SEOB1596 | seob7061 | |

104. ubiquitin A-52 residue ribosomal protein fusion product 1 (UBA52) gi4507760 42

| | | | | | | | | |
|---|---|---|---|---|---|---|---|---|
| FCR1156 | hfcr8751 | ncr0856 | ncr5947 | ncr8504 | ncrb2211 | ncrb8366 | ncrc5588 | SEOA2256a |
| fcrb2195 | hfcr9421 | ncr2763 | ncr6957 | ncrb0543 | ncrb2283 | ncrc1308 | ncrc6359 | SEOA7124a |
| hfcr2641 | MIOA6428a | ncr5097 | ncr7877 | ncrb1157 | ncrb3887 | ncrc3328 | ncrc7039 | |
| hfcr5099 | ncr0272 | ncr5519 | ncr7888 | ncrb1596 | ncrb5153 | ncrc4065 | ncrc9400 | |
| hfcr5626 | ncr0411 | ncr5863 | ncr8089 | ncrb2146 | ncrb5242 | ncrc4634 | ncrc9980 | |

105. BFCN0171cartilage matrix protein (CMP) geneM55682.1 42

| | | | | | | | | |
|---|---|---|---|---|---|---|---|---|
| BFCS0501 | FCR0537 | FCR2673 | FCR4415 | FCR6900 | fcrb2212 | hfcr3954 | hfcr6327 | hfcr9028 |
| BFCW0329 | FCR0976 | FCR3169 | FCR5724 | fcrb0121 | hfcr2626 | hfcr4662 | hfcr6557 | |
| CR0256 | FCR1017 | FCR3839 | FCR5973 | fcrb1122 | hfcr2950 | hfcr5095 | hfcr6671 | |
| FCR0322 | FCR1119 | FCR4097 | FCR6498 | fcrb1133 | hfcr3631 | hfcr6033 | hfcr6842 | |
| FCR0353 | FCR2178 | FCR4404 | FCR6739 | fcrb2015 | hfcr3652 | hfcr6275 | hfcr8946 | |

106. TSC-22 protein U35048 42

| | | | | | | | | |
|---|---|---|---|---|---|---|---|---|
| fcrb0349 | hfcr6448 | MIOA5175a | miob1797 | ncr1247 | ncrb3821 | ncrc5347 | SEOA5264a | seob4041 |
| hfcr1866 | hfcr6635 | MIOA6889a | MIOB2751 | ncr1471 | ncrb8237 | ncrc5607 | SEOA7394a | seob8258 |
| hfcr2723 | hfcr9358 | MIOA7092a | MIOB2875 | ncr4524 | ncrb8665 | ncrc6092 | SEOA9623 | |
| hfcr3050 | MIOA0245a | mioa9403 | miob6391 | ncr4640 | ncrc1704 | ncrc7008 | SEOB0596 | |
| hfcr5167 | MIOA2648 | miob0277 | miob6739 | ncr4787 | ncrc2593 | SEOA4366a | seob3680 | |

107. "mitochondrial genes for several tRNAs (Phe, Val, Leu) and 12S and 16S ribosomal RNAs "V00710.1 42

| | | | | | | | | |
|---|---|---|---|---|---|---|---|---|
| miob1690 | ncrb1220 | ncrb1436 | ncrb3324 | ncrb6400 | ncrb7449 | ncrb8234 | ncrc0920 | ncrc9849 |
| ncrb0803 | ncrb1243 | ncrb1485 | ncrb3434 | ncrb6504 | ncrb7660 | ncrc0260 | ncrc0926 | ncrc9972 |
| ncrb0943 | ncrb1318 | ncrb1486 | ncrb3504 | ncrb6590 | ncrb7753 | ncrc0267 | ncrc0934 | |
| ncrb1115 | ncrb1363 | ncrb2658 | ncrb3841 | ncrb6650 | ncrb7855 | ncrc0556 | ncrc9671 | |
| ncrb1152 | ncrb1380 | ncrb3304 | ncrb6360 | ncrb6858 | ncrb8215 | ncrc0580 | ncrc9673 | |

108. ribosomal protein S19 M81757.1 41

| | | | | | | | | |
|---|---|---|---|---|---|---|---|---|
| BFCS0037n | FCR1529 | FCR4873 | fcrb1664 | hfcr0159 | HFCR3168 | hfcr6007 | hfcr9267 | SEOB2959 |
| FCR0683 | FCR2893 | FCR7307 | fcrb1846 | hfcr1059 | hfcr3386 | hfcr6749 | hfcr9667 | |
| FCR0731 | FCR3139 | FCR7310 | fcrb2309 | hfcr2049 | hfcr4126 | hfcr6976 | ncrc1894 | |
| FCR0853 | FCR4078 | FCR7742 | fcrb2601 | HFCR2366 | hfcr5801 | hfcr7446 | ncrc9747 | |
| FCR0900 | FCR4355 | fcrb1192 | hfcr0063 | hfcr2595 | hfcr5861 | hfcr8379 | SEOA9992 | |

109. "ribosomal protein S28, yeast homologue "D14530 41

| | | | | | | | | |
|---|---|---|---|---|---|---|---|---|
| BFCN0255 | BFCW0587 | CR0599 | FCR1257 | FCR2685 | FCR4365 | FCR6147 | FCR7000 | FCR7168 |
| BFCS0462 | CR0526 | CR0699 | FCR2308 | FCR3920 | FCR6122 | FCR6760 | FCR7034 | FCR7414 |

Figure 6A – EST Names Corresponding to Unique Known Genes of Figure 6

| | | | | | | | | |
|---|---|---|---|---|---|---|---|---|
| FCR7609 | fcrb1722 | fcrb2165 | hfcr0766 | hfcr3603 | hfcr6354 | hfcr8536 | SEOA2162 | |
| FCR7721 | fcrb1827 | hfcr0196 | hfcr1232 | hfcr5849 | hfcr6975 | hfcr8984 | SEOA6195a | |
| fcrb0104 | fcrb2085 | hfcr0238 | hfcr1436 | hfcr5868 | hfcr8519 | ncrc9724 | | |

110. deleted in split hand/split foot 1 (DSS1) U41515 41

| | | | | | | | | |
|---|---|---|---|---|---|---|---|---|
| MIOA0646 | MIOB2153 | miob5866 | ncrb7169 | SEOA0602a | SEOA2356a | SEOA6568a | SEOA9852 | seob5511 |
| MIOA6044 | miob2373 | ncr1473 | ncrc2124 | SEOA1015n | SEOA3194 | SEOA6601a | SEOA9995 | |
| miob0520 | miob3941 | ncr7455 | ncrc2132 | SEOA1034a | SEOA4501 | SEOA7090a | SEOB1346 | |
| miob0868 | miob5496 | ncr7995 | ncrc6920 | SEOA1176A | SEOA4651a | SEOA9128 | SEOB3296 | |
| miob1915 | miob5776 | ncrb4629 | SEOA0574a | SEOA1370 | SEOA6062a | SEOA9428 | seob4414 | |

111. ribosomal protein L35a NM_000996.1 41

| | | | | | | | | |
|---|---|---|---|---|---|---|---|---|
| BFCW0311 | FCR6322 | hfcr6342 | mioa9208 | ncr5184 | ncrc5016 | SEOA3133a | SEOA7581a | soa0291n |
| FCR0017 | FCR7198 | hfcr6730 | miob5439 | ncrb0446 | ncrc8837 | SEOA4643a | SEOB0524 | |
| FCR0092 | fcrb1913 | hfcr7554 | ncr1724 | ncrb5455 | SEOA1098a | SEOA5113a | SEOB3225 | |
| FCR0498 | hfcr1655 | hfcr9270 | ncr3339 | ncrc2970 | SEOA1284a | SEOA5317a | seob4663 | |
| FCR0560 | hfcr4470 | MIOA6888a | ncr4709 | ncrc3982 | SEOA1637a | SEOA5324a | seob6052 | |

112. cytochrome c oxidase subunit VIIb Z14244 41

| | | | | | | | |
|---|---|---|---|---|---|---|---|
| FCR1855 | mioa1218m | MIOA7188a | miob6127 | ncrc7107 | SEOA3961a | SEOA6213a | seob4415 |
| FCR4849 | MIOA1456 | MIOA7392a | ncrb3935 | seoa0348m | SEOA4790a | SEOA6673a | seob4454 |
| hfcr7418 | MIOA1733 | miob3141 | ncrc1745 | SEOA2018 | SEOA5078a | SEOA7198a | seob5911 |
| hfcr8919 | MIOA2188a | miob3921 | ncrc1772 | SEOA3919 | SEOA5087a | SEOA9977 | seob5995 |
| MIOA0388a | MIOA7113a | miob3993 | ncrc2368 | SEOA3920 | SEOA5316a | SEOB3535 | seob7186 |

113. hH3.3B gene for histone H3.3 Z48950.1 41

| | | | | | | | | |
|---|---|---|---|---|---|---|---|---|
| FCR1836 | FCR7196 | MIOA4335a | miob6622 | ncrb2649 | ncrc3395 | SEOA5628a | SEOB2031 | SOA0251 |
| FCR4015 | FCR7406 | MIOA4611a | ncr0547 | ncrb3172 | ncrc3900 | SEOA6258 | SEOB3175 | |
| FCR4207 | fcrb2487 | MIOA6839a | ncr3664 | ncrb5585 | ncrc6405 | SEOA9789 | seob5866 | |
| FCR4730 | hfcr7068 | miob2490 | ncr6903 | ncrc0334 | SEOA3422a | SEOB1402 | seob6700 | |
| FCR6611 | hfcr9690 | miob3989 | ncrb1585 | ncrc1980 | SEOA4502 | SEOB1649 | seob7119 | |

114. RIBOSOMAL PROTEIN L10A (CSA-19)(RPL10A) P53025 40

| | | | | | | | |
|---|---|---|---|---|---|---|---|
| BFCN0010 | FCR3550 | fcrb2334 | hfcr6561 | MIOA6783a | ncr0643 | ncrb0736 | SEOA0417 |
| BFCS0533 | FCR4164 | hfcr0403 | hfcr6828 | MIOA6843a | ncr4765 | ncrb2016 | SEOA1026 |
| FCR0227 | FCR6548 | hfcr0465 | hfcr9527 | mioa9213 | ncr7194 | ncrb5004 | SEOB3368 |
| FCR1652 | fcrb0277 | hfcr1906 | MIOA4509a | miob0654 | ncr8770 | ncrc0228 | seob5067 |
| FCR3193 | fcrb1226 | hfcr3609 | MIOA6652a | miob6742 | ncrb0452 | ncrc0330 | seob5851 |

115. ribosomal protein S15a X84407 40

| | | | | | | | |
|---|---|---|---|---|---|---|---|
| BFCN0273 | FCR2491 | FCR7245 | hfcr0780 | hfcr6517 | ncr0869 | ncrc4372 | SEOA5357 |
| BFCW0180 | FCR4108 | FCR7331 | HFCR3094 | hfcr7722 | ncr2234 | ncrc4500 | SEOA7925a |
| BFCW0588 | FCR5245 | fcrb1191 | HFCR3254 | hfcr8559 | ncrb2077 | ncrc9263 | SEOA8722 |
| CR0831 | FCR6523 | hfcr0491 | hfcr3781 | MIOA3693a | ncrb8678 | ncrc9560 | SEOB0511 |
| FCR1349 | FCR7147 | hfcr0636 | hfcr6001 | MIOA3735a | ncrb8682 | SEOA3966a | SEOB3383 |

116. ribosomal protein L15 NM_002948.1 40

| | | | | | | | |
|---|---|---|---|---|---|---|---|
| FCR5807 | hfcr1156 | hfcr2062 | hfcr3982 | hfcr7348 | hfcr9853 | ncr7679 | ncrc9223 |
| fcrb1790 | hfcr1333 | hfcr2310 | hfcr4279 | hfcr7542 | MIOA4695 | ncr8150 | seoa6978 |
| fcrb1841 | hfcr1661 | HFCR3145 | hfcr4337 | hfcr8015 | MIOA4890a | ncrc4539 | seoa6988 |
| fcrb2018 | hfcr1669 | hfcr3861 | hfcr5193 | hfcr8838 | mioa9279 | ncrc4900 | SEOB3275 |
| fcrb2757 | hfcr1803 | hfcr3890 | hfcr5799 | hfcr8917 | miob3809 | ncrc8940 | seob6398 |

Figure 6A – EST Names Corresponding to Unique Known Genes of Figure 6

117. eukaryotic translation initiation factor 3 (EIF3S6) (=INT6) NM_001568.1 40

| | | | | | | | |
|---|---|---|---|---|---|---|---|
| fcrb1837 | miob1448 | hfcr0493 | hfcr3540 | MIOA6315a | ncr0582 | ncrc2097 | SEOA7334a |
| ncrc5088 | ncr0582 | hfcr0556 | hfcr5388 | miob0784 | ncrb0473 | ncrc5088 | SEOA9855 |
| hfcr2945 | ncrb8727 | hfcr2945 | hfcr6866 | miob1448 | ncrb1337 | SEOA5577a | SEOB1357 |
| hfcr3485 | seob7245 | hfcr3485 | hfcr8591 | miob4352 | ncrb1514 | SEOA7086a | SEOB1986 |
| MIOA6315a | miob4352 | hfcr3509 | hfcr8963 | miob4606 | ncrb8727 | SEOA7122a | seob7245 |

118. ribosomal protein L23a U43701 38

| | | | | | | | |
|---|---|---|---|---|---|---|---|
| ncrc5074 | fcrb2002 | MIOA5247a | miob5089 | ncrb0478 | ncrb7076 | ncrc6307 | SEOA5099a |
| ncrc5142 | fcrb2753 | MIOA5894a | miob5980 | ncrb1113 | ncrb7240 | ncrc6619 | seoa5395n |
| FCR1913 | hfcr0629 | MIOA6364a | ncr1090 | ncrb4549 | ncrb7665 | ncrc9088 | seoa5757an |
| FCR2143 | hfcr7840 | miob0153 | ncr2051 | ncrb4644 | ncrb8062 | ncrc9167 | SEOA8330a |
| fcr3146 | hfcr9840 | miob0845 | ncr4037 | ncrb4645 | ncrb8699 | SEOA0429 | SEOB0092 |
| FCR3555 | MIOA2444a | miob1461 | ncr4373 | ncrb4700 | ncrc0158 | SEOA0817 | SEOB1653 |
| FCR3728 | MIOA3515a | miob3611 | ncr9521 | ncrb4857 | ncrc3699 | SEOA0893 | SEOB2113 |
| FCR4062 | MIOA4631a | miob4258 | ncr9875 | ncrb6314 | ncrc4068 | SEOA3080a | seob6770 |

119. KIAA0005D13630 38

| | | | | | | | |
|---|---|---|---|---|---|---|---|
| MIOA1858m | MIOA8211 | miob2946 | miob4910 | ncr3544 | SEOA2957a | SEOB0840a | seob6320 |
| MIOA4111 | MIOA8634 | miob2967 | miob4966 | ncr3550 | SEOA3653a | SEOB2729 | seob6323 |
| MIOA5459a | MIOA9029 | miob3606 | miob6341 | ncr5208 | SEOA4294a | SEOB3063 | seob6429 |
| MIOA5543a | miob0590 | miob3838 | miob6955 | ncrb3322 | SEOA5999a | seob4609 | |
| MIOA7322 | miob1832 | miob4529 | ncr1757 | ncrc5149 | SEOA8749 | seob5475 | |

120. collagen type XI alpha2 (COL11A2) U41068.1 38

| | | | | | | | |
|---|---|---|---|---|---|---|---|
| BFCS0313 | BFCW0457 | FCR3037N | FCR7702 | hfcr0348 | hfcr8414 | hfcr9446 | ncrb5688 |
| BFCS0393 | FCR0205 | FCR5986 | fcrb0338 | hfcr0357 | hfcr8468 | hfcr9465 | ncrc1439 |
| BFCS0468n | FCR0450 | FCR6284 | fcrb1150 | hfcr0536 | hfcr8921 | hfcr9631 | ncrc9320 |
| BFCS0520n | FCR1183 | FCR6584 | fcrb1479 | hfcr4180 | hfcr9300 | hfcr9929 | |
| BFCW0389 | FCR2580 | FCR7175 | fcrb2179 | hfcr5757 | hfcr9437 | ncrb1699 | |

121. "transcription elongation factor B (SIII), polypeptide 1-like (TCEB1L) "NM_003197.2 38

| | | | | | | | |
|---|---|---|---|---|---|---|---|
| hfcr7245 | miob2917 | ncr2397 | ncr7565 | ncrb3532 | ncrc5576 | seob4568 | seob7478 |
| mioa0740m | miob2922 | ncr2805 | ncr8305 | ncrc1877 | ncrc7196 | seob5428 | seob7584 |
| MIOA4595a | miob3455 | ncr4000 | ncr8482 | ncrc1883 | ncrc9332 | seob5605 | SOA0369 |
| MIOA5593a | ncr1480 | ncr4101 | ncrb2749 | ncrc2475 | SEOA4816a | seob6006 | |
| MIOA5776a | ncr1720 | ncr5540 | ncrb3369 | ncrc3358 | SEOB3092 | seob7097 | |

122. "lysosome-associated protein, transmembane - 4alpha (=D14696.1 Human KIAA0108) "U34259.1 38

| | | | | | | | |
|---|---|---|---|---|---|---|---|
| BFCS0270 | hfcr9427 | MIOA4951a | miob6219 | ncrc0855 | SEOA2844 | SEOA9821 | seob5940 |
| FCR3890 | MIOA0038a | MIOA8794 | ncr1743 | ncrc5950 | SEOA4862a | SEOB0605 | seob7187 |
| FCR4020 | MIOA3786 | mioa9897 | ncrb2628 | ncrc9127 | SEOA7646a | SEOB1984 | seob7923 |
| fcrb0160 | MIOA4007a | miob3977 | ncrb2897 | SEOA0826 | seoa8159 | SEOB2726 | |
| hfcr6554 | MIOA4256 | miob4194 | ncrb8558 | seoa0993m | SEOA8588 | seob4479 | |

123. SUI1 isolog AF083441.1 38

| | | | | | | | |
|---|---|---|---|---|---|---|---|
| FCR2362 | hfcr4136 | miob1161 | ncr2000 | ncr9517 | ncrb1361 | ncrc1742 | SEOA9334 |
| hfcr0156 | hfcr5187 | miob2512 | ncr3835 | ncr9517 | ncrb1547 | ncrc1742 | SEOA9334 |
| hfcr3415 | hfcr5187 | miob2512 | ncr3835 | ncrb1183 | ncrb1547 | ncrc8841 | SEOB2034 |
| hfcr3415 | MIOA0181 | MIOB2568 | ncr8251 | ncrb1183 | ncrb6091 | ncrc8841 | |
| hfcr4136 | miob1161 | ncr2000 | ncr8251 | ncrb1361 | ncrb6091 | SEOA1956 | |

Figure 6A – EST Names Corresponding to Unique Known Genes of Figure 6

124. small nuclear ribonucleoprotein polypeptide G (SNRPG) X85373 37

| | | | | | | | |
|---|---|---|---|---|---|---|---|
| hfcr1695 | MIOA9068 | SEOA3227 | SEOA6109a | SEOA9768 | seob4374 | seob6499 | seob8174 |
| MIOA3352a | miob3268 | SEOA3688a | SEOA6460a | SEOB0836a | seob4739 | seob7004 | seob8254 |
| MIOA4475a | miob4146 | SEOA3810a | seoa7850a | SEOB0845a | seob4811 | seob7049 | |
| MIOA6765a | SEOA0167a | SEOA4686a | SEOA8647 | SEOB0983 | seob4833 | seob7089 | |
| mioa7895 | SEOA0564A | SEOA5684a | SEOA9559 | SEOB3069 | seob5931 | seob7501 | |

125. N1-phosphatidylinositol-4-phosphate 5-kinase S78798.1 37

| | | | | | | | |
|---|---|---|---|---|---|---|---|
| FCR2492 | hfcr0489 | hfcr0761 | hfcr0805 | hfcr0899 | hfcr1397 | hfcr4012 | hfcr4334 |
| hfcr0040 | hfcr0735 | hfcr0762 | hfcr0820 | hfcr0993 | hfcr2018 | hfcr4159 | hfcr4351 |
| hfcr0379 | hfcr0748 | hfcr0768 | hfcr0868 | hfcr1331 | hfcr4002 | hfcr4171 | |
| hfcr0391 | hfcr0757 | hfcr0790 | hfcr0884 | hfcr1376 | hfcr4006 | hfcr4220 | |
| hfcr0456 | hfcr0758 | hfcr0792 | hfcr0887 | hfcr1394 | hfcr4008 | hfcr4327 | |

126. ribosomal protein L38 Z26876 37

| | | | | | | | |
|---|---|---|---|---|---|---|---|
| FCR0398 | hfcr5123 | MIOA6090a | ncr0479 | ncrc4894 | SEOA4781a | SEOB3174 | seob6376 |
| FCR3949 | hfcr5602 | MIOA6674a | ncr9840 | ncrc8956 | SEOA5081a | SEOB3338 | seob8308 |
| fcrb0608 | hfcr8832 | miob2399 | ncrb0902 | ncrc9647 | seoa7014 | seob5164 | |
| fcrb2709 | MIOA0364a | miob3242 | ncrb8766 | SEOA0385 | SEOB0989 | seob5181 | |
| hfcr3492 | MIOA3284a | miob3410 | ncrc4026 | SEOA4151a | SEOB1725 | seob6169 | |

127. "cartilage intermediate layer protein, CILP "AB022430.1 37

| | | | | | | | |
|---|---|---|---|---|---|---|---|
| HFCR3276 | MIOA3341a | MIOB2082 | miob5775 | ncr6641 | SEOA2906a | SEOB0417 | SOA0399 |
| MIOA1366a | MIOA3923a | MIOB2622 | miob6191 | ncrb6308 | SEOA3793a | SEOB1165 | SOA0545 |
| MIOA2049 | mioa9474 | miob3195 | miob6831 | ncrb7277 | seoa6816 | seob4869 | |
| MIOA2298a | miob0671 | miob3252 | ncr2979 | SEOA0239a | seoa7045 | seob6863 | |
| MIOA3110a | miob1909 | miob3425 | ncr4832 | SEOA0435 | SEOA9483 | seob7212 | |

128. collagen type VI alpha 3 (COL6A3) NM_004369.1 36

| | | | | | | | | |
|---|---|---|---|---|---|---|---|---|
| FCR7098 | hfcr6167 | miob4254 | ncrb1171 | SEOA2061 | SEOA5142a | SEOB1610 | seob5581 | seob7451 |
| FCR7602 | mioa9618 | miob4588 | ncrc1483 | SEOA2082 | SEOA8493 | SEOB2235 | seob6393 | seob7711 |
| hfcr3692 | mioa9836 | ncr1047 | SEOA1360 | SEOA3350a | SEOA9381 | seob2315 | seob6425 | seob8018 |
| hfcr5140 | miob1384 | ncr6959 | SEOA1442a | SEOA4504 | SEOB0068 | seob3642 | seob6470 | seob8329 |

129. ribosomal protein S18 X69150.1 36

| | | | | | | | | |
|---|---|---|---|---|---|---|---|---|
| BFCN0120 | FCR0920 | FCR3151 | FCR6538 | FCR7725 | fcrb2326 | hfcr0689 | hfcr1659 | hfcr8990 |
| BFCS0280 | FCR1253 | FCR3795 | FCR6826 | fcrb1184 | fcrb2492 | hfcr0733 | hfcr1916 | miob1182 |
| CR0938 | FCR1375 | FCR5380 | FCR6964 | fcrb1797 | hfcr0093 | hfcr0975 | hfcr2218 | ncr7308 |
| FCR0417 | FCR1558 | FCR6323 | FCR7360 | fcrb2030 | hfcr0189 | hfcr1393 | hfcr8754 | seob5044 |

130. F1-ATPase epsilon-subunit (ATP5E) AF052955.1 33

| | | | | | | | | |
|---|---|---|---|---|---|---|---|---|
| fcrb1103 | miob1689 | miob6334 | ncr3715 | ncrc1088 | SEOB0133 | seob2317 | seob5104 | seob7538 |
| hfcr2699 | miob4171 | miob6884 | ncr5416 | ncrc4885 | SEOB0476 | SEOB2660 | seob6221 | |
| hfcr9038 | miob4846 | ncr0384 | ncrb7466 | seoa7869a | SEOB1233 | SEOB3333 | seob6307 | |
| miob0444 | miob6205 | ncr2417 | ncrb8509 | SEOA8727 | SEOB1786 | seob4832 | seob7443 | |

131. NADH dehydrogenase X81900 33

| | | | | | | | | |
|---|---|---|---|---|---|---|---|---|
| hfcr0678 | MIOA1191n | ncr1506 | ncr4605 | ncr6331 | ncr8017 | ncr8689 | SEOA1202A | SEOA3547a |
| hfcr5996 | MIOA6101a | ncr2398 | ncr5195 | ncr6746 | ncr8169 | ncr9504 | SEOA2407 | SEOA6036a |
| (=mitochondr | MIOA6662a | ncr2629 | ncr6047 | ncr7396 | ncr8568 | ncrc2579 | SEOA2954a | seob5642 |
| ial genome) | ncr1256 | ncr3143 | ncr6128 | ncr7857 | ncr8640 | SEOA0481 | SEOA3371a | |

Figure 6A - EST Names Corresponding to Unique Known Genes of Figure 6

132. ribosomal protein L12 L06505 33

| | | | | | | | | |
|---|---|---|---|---|---|---|---|---|
| BFCN0205 | hfcr1742 | hfcr4475 | MIOA4139 | ncr6287 | ncrb7207 | seoa2022n | SEOB1288 | seob7949 |
| BFCS0232 | hfcr1885 | hfcr4615 | MIOA8966 | ncr6832 | ncrb7613 | SEOA7416a | seob4302 | |
| FCR1078 | hfcr2064 | hfcr4766 | miob5477 | ncrb1965 | ncrc1429 | SEOB0867a | seob4459 | |
| FCR4737 | hfcr3984 | hfcr6135 | ncr2170 | ncrb5368 | SEOA1737a | SEOB1261 | seob7349 | |

133. BFCN0105ribosomal protein S5 (RPS5) NM_001009.1 33

| | | | | | | | |
|---|---|---|---|---|---|---|---|
| BFCS0055 | FCR2149 | FCR4669 | FCR6168 | fcrb2557 | hfcr2501 | hfcr6543 | MIOB2805 |
| CR0055 | FCR2256 | FCR5966 | FCR6651 | hfcr0681 | hfcr2578 | hfcr7045 | ncr4119 |
| FCR1609 | fcr3375n | FCR6066 | FCR7163 | hfcr1846 | hfcr2961 | hfcr7809 | ncrc1059 |
| FCR1930 | FCR4324 | FCR6152 | fcrb2161 | hfcr1870 | hfcr2975 | hfcr9637 | SEOA0405 |

134. cytoskeletal gamma-actin X04098 33

| | | | | | | | | |
|---|---|---|---|---|---|---|---|---|
| FCR0438 | fcrb1075 | hfcr3576 | hfcr6471 | hfcr7025 | miob0933 | ncrb2109 | ncrc4043 | seob7563 |
| FCR2503 | fcrb1487 | hfcr4467 | hfcr6619 | hfcr8387 | miob3532 | ncrb7748 | ncrc9679 | |
| FCR3102 | hfcr1183 | hfcr4476 | hfcr6740 | hfcr8409 | ncr6706 | ncrc0240 | ncrc9909 | |
| fcrb0427 | hfcr3491 | hfcr5166 | hfcr6797 | MIOA8852 | ncr9365 | ncrc0623 | SEOA6908 | |

135. androgen receptor associated protein 24 (ARA24) (=AF054183 GTP binding protein)AF052578 33

| | | | | | | | | |
|---|---|---|---|---|---|---|---|---|
| FCR0288 | FCR6517 | MIOA1674a | miob1953 | SEOA1302a | SEOA3644a | SEOA5900 | SEOB0519 | seob5296 |
| FCR2417 | FCR6577 | MIOA4792a | miob3175 | SEOA2183a | SEOA3930 | SEOA6467a | SEOB0848a | |
| FCR3772 | fcrb2317 | MIOA5729a | miob6209 | SEOA2686 | SEOA3931 | SEOA8605 | SEOB1907 | |
| FCR5127 | hfcr9736 | MIOA9062 | ncrc5877 | seoa2691m | SEOA4246a | SEOB0263 | seob4485 | |

136. collagen type IX alpha 3 (COL9A3) AF026802.1 32

| | | | | | | | |
|---|---|---|---|---|---|---|---|
| BFCW0515 | FCR2886 | FCR4500 | FCR7468 | hfcr1406 | hfcr4118 | hfcr7761 | ncr5121 |
| FCR0477 | fcr3141 | FCR4819 | fcrb0312 | HFCR3243 | hfcr5882 | hfcr9970 | ncrb2643 |
| FCR2080 | FCR3660 | FCR5271 | hfcr0226 | HFCR3282 | hfcr6780 | ncr1265 | ncrb4813 |
| FCR2319 | FCR3799 | FCR6336 | hfcr1148 | hfcr4035 | hfcr7464 | ncr2830 | ncrb6579 |

137. "cytochrome c oxidase, liver specific (EC 1.9.3.1.) "X15822 32

| | | | | | | | |
|---|---|---|---|---|---|---|---|
| FCR5121 | MIOA1511 | MIOA7077a | miob3919 | ncr8299 | SEOA2255a | SEOA7397a | SEOB2757 |
| FCR6754 | MIOA3452a | MIOA8045a | miob4390 | SEOA0367n | SEOA4708a | seoa8046 | seob4679 |
| fcrb0703 | MIOA4975a | miob1124 | ncr2262 | SEOA1086a | SEOA5167a | SEOB1795 | seob6809 |
| hfcr2767 | MIOA6756a | MIOB2553 | ncr3535 | SEOA1688a | SEOA5574a | SEOB2074 | seob7929 |

138. tubulin betaAF070561 32

| | | | | | | | |
|---|---|---|---|---|---|---|---|
| BFCW0529 | FCR2349 | FCR5760 | hfcr3517 | hfcr4480 | mioa2130m | mioa9421 | ncrb3423 |
| CR0300 | FCR2722 | FCR7108 | hfcr3796 | hfcr5555 | MIOA2890a | ncr0326 | ncrc2912 |
| FCR0485 | FCR4373 | hfcr1648 | hfcr3913 | hfcr6092 | MIOA6624a | ncr8267 | SEOB1124 |
| FCR2122 | FCR4938 | hfcr1787 | hfcr4114 | mioa0991nn | MIOA8975 | ncr9473 | seob5640 |

139. nmyosin regulatory light chain X54304 31

| | | | | | | | |
|---|---|---|---|---|---|---|---|
| BFCS0421 | fcrb1969 | miob0433 | ncr3691 | SEOA1463a | SEOA6099a | SEOB0697a | SEOB2629 |
| FCR4304 | hfcr9608 | miob7008 | ncr3993 | SEOA2343a | SEOA6298 | SEOB0729 | SEOB2771 |
| FCR4640 | MIOA5885a | ncr0678 | ncr5207 | SEOA3300 | SEOA7398a | SEOB1440 | seob6765 |
| fcrb1242 | mioa9849 | ncr3311 | SEOA0740 | SEOA4562 | SEOA8842 | SEOB1535 | |

140. ribosomal protein L19 X63527 31

| | | | | | | | | |
|---|---|---|---|---|---|---|---|---|
| FCR1522 | FCR3746 | FCR6957 | fcrb0030 | fcrb1811 | fcrb2477 | hfcr3464 | hfcr8003 | MIOA8627 |
| FCR1626 | FCR3793 | FCR7025 | fcrb1581 | fcrb2447 | hfcr2592 | hfcr7612 | hfcr9542 | mioa9853 |

Figure 6A - EST Names Corresponding to Unique Known Genes of Figure 6

| | | | | | | | |
|---|---|---|---|---|---|---|---|
| miob4197 | ncrb2426 | SEOA5201a | SEOA7605a | SEOA8748 | seob6042 | seob6602 | |
| ncrb1897 | ncrc5237 | seoa7001 | SEOA7656a | SEOB3058 | seob6238 | | |

141. ribosomal protein S3 (RPS3) NM_001005.1 31

| | | | | | | | |
|---|---|---|---|---|---|---|---|
| BFCN0075 | FCR1273 | FCR2281 | fcrb0039 | hfcr1865 | hfcr7506 | miob0662 | SEOA1035a |
| BFCS0502 | FCR1604 | FCR2918 | fcrb1054 | hfcr2328 | MIOA1233 | miob6972 | SEOA5669a |
| CR0253 | FCR1740 | FCR5477 | hfcr0857 | HFCR3252 | MIOA1481 | ncr1855 | SEOA9880 |
| FCR0260 | FCR1759N | FCR7136 | hfcr1857 | hfcr5987 | miob0370 | ncr5622 | |

142. "clusterin (CLU) SP40,40 (=M63379 TRPM-2 protein) "NM_001831.1 31

| | | | | | | | |
|---|---|---|---|---|---|---|---|
| fcrb1155 | miob0446 | ncr0114 | ncr4415 | ncr9673 | ncrc1669 | SEOA3766a | seob4926 |
| MIOA0543 | miob2404 | ncr1339 | ncr7093 | ncrb0412 | ncrc9539 | SEOA3824a | SOA0440 |
| MIOA2797a | miob5969 | ncr3207 | ncr7160 | ncrb2846 | SEOA2140 | SEOA8238 | SOA0544 |
| mioa9401 | miob6902 | ncr3352 | ncr8225 | ncrb3488 | SEOA2977a | SEOA8446 | |

143. ribosomal protein L18 (RPL18) NM_000979.1 31

| | | | | | | | |
|---|---|---|---|---|---|---|---|
| FCR0320 | FCR3626 | FCR5922 | fcrb1619 | hfcr2632 | hfcr4187 | hfcr7051 | ncr0289 |
| FCR0798 | FCR3658 | FCR6176 | fcrb2543 | hfcr2921 | hfcr4461 | hfcr7415 | seoa7890a |
| FCR1655 | FCR4765 | FCR6970 | hfcr2024 | HFCR3119 | hfcr4482 | hfcr9718 | seob6522 |
| FCR2067 | FCR5834 | fcrb0671 | hfcr2622 | hfcr3944 | hfcr6504 | hfcr9942 | |

144. nephropontin (=X13694.1 osteopontin) M83248.1 31

| | | | | | | | |
|---|---|---|---|---|---|---|---|
| ncrc5787 | ncr3988 | ncrc6287 | SEOA2924a | SEOA6005a | seoa7053 | seob3901 | seob7498 |
| ncrc6085 | ncr4513 | SEOA0527 | SEOA3923 | SEOA6031a | SEOA7080a | seob5406 | SOA0083 |
| ncrc5779 | ncrb6852 | SEOA1300a | SEOA4576 | SEOA6876 | SEOB1095 | seob7243 | SOA0583 |
| ncrc6057 | ncrc2011 | SEOA2278a | SEOA5284a | seoa7003 | SEOB2733 | seob7495 | |

145. "ribonuclease, RNase A family, 1(pancreatic) (RefSeq aa 9e-73) "NP_002924.1 31

| | | | | | | | |
|---|---|---|---|---|---|---|---|
| fcrb2007 | ncr0820 | ncr2636 | ncr8064 | ncrb2094 | ncrc0549 | ncrc2869 | ncrc9859 |
| ncrc6055 | ncr2039 | ncr3496 | ncrb0135 | ncrb4001 | ncrc1134 | ncrc4974 | SEOA4325a |
| ncrc6253 | ncr2343 | ncr5432 | ncrb1334 | ncrb5267 | ncrc1134 | ncrc5867 | SEOA5267a |
| ncr0174 | ncr2455 | ncr7331 | ncrb1615 | ncrc0358 | ncrc2862 | ncrc6500 | |

146. Tubulin alpha isoform 1 AF081484 30

| | | | | | | | |
|---|---|---|---|---|---|---|---|
| FCR1795 | FCR7188 | hfcr0102 | hfcr7099 | mioa0991nn | ncrb7237 | SEOA6216a | SEOB1260 |
| FCR2929 | fcrb1539 | hfcr0693 | hfcr8782 | MIOA5966a | SEOA0824 | SEOA6420 | seob6818 |
| FCR6333 | fcrb1618 | hfcr1298 | hfcr9141 | ncrb1285 | seoa3475an | SEOA9454 | |
| FCR6909 | hfcr0006 | hfcr6235 | hfcr9403 | ncrb4045 | SEOA6010a | SEOB0450 | |

147. ribosomal protein S23 (RPS23) =D14530 (ORF) NM_001025.1 30

| | | | | | | | |
|---|---|---|---|---|---|---|---|
| BFCN0135 | hfcr5192 | MIOA4720 | ncr4205 | ncrb3926 | ncrc3707 | SEOA3648a | seob8069 |
| FCR5091 | hfcr5765 | MIOA7015a | ncr4684 | ncrb7037 | ncrc4503 | SEOA6250 | SOA0282 |
| hfcr0538 | hfcr5999 | miob0955 | ncr5220 | ncrc1749 | ncrc4746 | SEOB2194 | |
| hfcr1117 | hfcr9928 | ncr2349 | ncrb1471 | ncrc2596 | ncrc5528 | seob5567 | |

148. T-cell cyclophilin Y00052 30

| | | | | | | | |
|---|---|---|---|---|---|---|---|
| FCR1368 | FCR4681 | fcrb1523 | hfcr5034 | hfcr9100 | ncr0099 | SEOA0588a | seob5128 |
| FCR1627 | FCR5391 | hfcr2645 | hfcr6252 | hfcr9717 | ncrb3852 | SEOA1756a | seob8194 |
| FCR2480 | FCR7032 | hfcr2802 | hfcr8411 | MIOA3009a | ncrb6939 | seoa7970 | |
| FCR3402 | fcrb0625 | hfcr3770 | hfcr9086 | mioa9204 | ncrc3978 | seob4379 | |

Figure 6A – EST Names Corresponding to Unique Known Genes of Figure 6

149. ribosomal protein L22 (RPL22) NM_000983.1 30

| | | | | | | | |
|---|---|---|---|---|---|---|---|
| BFCW0280 | hfcr0376 | miob3816 | ncr6816 | ncrb2344 | ncrc2681 | SEOA2885n | SEOB3168 |
| CR0936 | hfcr7087 | ncr0412 | ncr9448 | ncrb3805 | ncrc5041 | SEOA5524a | SEOB3295 |
| FCR1365 | MIOA3236a | ncr0640 | ncr9456 | ncrb6877 | ncrc9016 | seoa7707a | |
| fcrb0582 | mioa9526 | ncr6040 | ncrb0703 | ncrc0756 | SEOA2877 | seoa7801a | |

150. ribosomal protein L35 U12465 30

| | | | | | | | |
|---|---|---|---|---|---|---|---|
| BFCN0059 | FCR0077 | FCR2499 | FCR7328 | hfcr2684 | hfcr6301 | hfcr9015 | ncrb5697 |
| BFCS0297 | FCR1325 | FCR3049 | fcrb0360 | hfcr2730 | hfcr6374 | hfcr9817 | SEOA0747 |
| BFCW0403 | FCR1656N | FCR4332 | fcrb1557 | hfcr3779 | hfcr7543 | hfcr9880 | |
| BFCW0436 | FCR2142 | FCR4473 | hfcr2534 | hfcr5998 | hfcr7625 | ncr5143 | |

151. "ribonuclease, RNase A "NM_002937.1 30

| | | | | | | | |
|---|---|---|---|---|---|---|---|
| ncrc6055 | ncr0820 | ncr2636 | ncr8064 | ncrb2094 | ncrc0549 | ncrc4974 | SEOA4325a |
| ncrc6253 | ncr2039 | ncr3496 | ncrb0135 | ncrb4001 | ncrc1134 | ncrc5867 | SEOA5267a |
| fcrb2007 | ncr2343 | ncr5432 | ncrb1334 | ncrb5267 | ncrc2862 | ncrc6500 | |
| ncr0174 | ncr2455 | ncr7331 | ncrb1615 | ncrc0358 | ncrc2869 | ncrc9859 | |

152. collagen lysyl hydroxylase isoform 2 (PLOD2) U84573 30

| | | | | | | | |
|---|---|---|---|---|---|---|---|
| FCR5085 | miob0240 | miob2475 | ncrb4358 | ncrc9078 | SEOA3747a | SEOA8633 | seob7196 |
| hfcr7472 | MIOB2126 | MIOB2587 | ncrb6691 | SEOA0977 | SEOA3752a | SEOB1823 | seob7512 |
| MIOA5244a | MIOB2240 | ncr0800 | ncrb7447 | SEOA2509 | SEOA5368 | seob5353 | |
| mioa5668n | MIOB2305 | ncrb0840 | ncrc8982 | seoa3271n | seoa7848a | seob5515 | |

153. heterogeneous nuclear ribonucleoprotein A1 (HNRPA1) NM_002136.1 29

| | | | | | | | |
|---|---|---|---|---|---|---|---|
| FCR7133 | hfcr1136 | hfcr5440 | hfcr7867 | miob1188 | ncrb5479 | ncrc6718 | seob6874 |
| BFCS0207n | hfcr1144 | hfcr6516 | hfcr9017 | ncr0471 | ncrb6072 | SEOB0126 | |
| fcrb2000 | hfcr1683 | hfcr6587 | MIOA8719 | ncr5859 | ncrc2816 | seob3894 | |
| fcrb2624 | HFCR3235 | hfcr6641 | MIOA9040 | ncrb4766 | ncrc3013 | seob6324 | |

154. "ATP synthase, H transporting,mitochondrial F0 complex, subunit e (RefSeq aa 1e-33) "NP_009031.1 29

| | | | | | | | |
|---|---|---|---|---|---|---|---|
| MIOA6076a | ncr2795 | ncrb0054 | ncrc1917 | ncrc4548 | SEOA0811 | SEOA5960 | seob7622 |
| MIOA6360a | ncr6036 | ncrb1493 | ncrc2205 | ncrc4947 | SEOA1220A | SEOA6546a | |
| MIOA7461a | ncr6041 | ncrb3252 | ncrc2365 | ncrc6411 | SEOA2269a | SEOB2160 | |
| miob1479 | ncr9036 | ncrb7962 | ncrc3798 | ncrc6515 | SEOA5648a | seob6617 | |

155. "eukaryotic translation initiation factor 4 gamma, 2 (EIF4G2) "NM_001418.1 29

| | | | | | | | |
|---|---|---|---|---|---|---|---|
| fcrb0263 | MIOA2528a | ncrb1718 | SEOA1597a | SEOA5903 | SEOA9027 | seob5840 | seob7314 |
| fcrb2550 | MIOA6612a | ncrb1802 | SEOA5410 | SEOA8273 | SEOA9220 | seob5857 | |
| hfcr2761 | MIOA7547a | ncrc1395 | SEOA5653a | SEOA8403a | SEOA9649 | seob7165 | |
| MIOA1847a | ncr7964 | ncrc3655 | SEOA5763 | SEOA8967 | SEOB3589 | seob7256 | |

156. "integrin-binding sialoprotein (bone sialoprotein, bone sialoprotein II)(IBSP) "NM_004967.1 29

| | | | | | | | |
|---|---|---|---|---|---|---|---|
| ncr0491 | ncr2685 | ncr8418 | ncrb3547 | ncrb7107 | ncrc1097 | ncrc2967 | ncrc6857 |
| ncr2481 | ncr4839 | ncr8529 | ncrb4386 | ncrb7676 | ncrc2243 | ncrc4585 | |
| ncr2501 | ncr6195 | ncrb1375 | ncrb5605 | ncrb8060 | ncrc2699 | ncrc5177 | |
| ncr2585 | ncr6676 | ncrb2683 | ncrb6577 | ncrb8111 | ncrc2841 | ncrc6651 | |

157. mitochondrial ATPase coupling factor 6 subunit (ATP5A) M37104 29

| | | | | | | | | |
|---|---|---|---|---|---|---|---|---|
| MIOA3079a | miob1025n | miob5893 | ncr3501 | SEOA0108 | SEOA1325n | seoa2520m | seoa3379an | SEOA3909 |
| miob0836 | miob4833 | miob6940 | SEOA0049 | SEOA0313 | SEOA1503 | seoa2612n | SEOA3791a | SEOA5929 |

Figure 6A – EST Names Corresponding to Unique Known Genes of Figure 6

| | | | | | |
|---|---|---|---|---|---|
| SEOA5948 | SEOA6706 | SEOA7254a | SEOA7630a | SEOB3573 | seob7078 |
| SEOA6446a | SEOA7200a | SEOA7580a | SEOA8354a | seob4019 | |

158. heparan sulfate proteoglycan (HSPG) (OCI5) J04621.1 29

| | | | | | | | |
|---|---|---|---|---|---|---|---|
| BFCS0024 | FCR6060 | hfcr5127 | MIOA8162 | ncrc6240 | SEOA4737a | SEOB0902a | seob7282 |
| FCR0174 | hfcr2554 | MIOA1598 | ncr4046 | SEOA0364 | SEOA6872 | SEOB3362 | |
| FCR0690 | hfcr2943 | MIOA2782a | ncrb3611 | SEOA2987a | SEOA7498a | seob3997 | |
| FCR4967 | HFCR3203 | MIOA7573a | ncrc3074 | SEOA4266a | seoa8086 | seob5308 | |

159. ribosomal protein S21 (RPS21) L04483 29

| | | | | | | | |
|---|---|---|---|---|---|---|---|
| FCR0650 | FCR3744 | fcrb0398 | hfcr0084 | hfcr6664 | hfcr9183 | ncrb8701 | SEOB1698 |
| FCR1172 | FCR5218 | fcrb1332 | hfcr0180 | hfcr6748 | mioa7875 | SEOA0933 | |
| FCR1498 | FCR5355 | fcrb2093 | hfcr5209 | hfcr7465 | ncr1426 | SEOA2648 | |
| FCR3357 | FCR6375 | fcrb2246 | hfcr6095 | hfcr8680 | ncr2423 | SEOA5551a | |

160. nucleolar phosphoprotein B23 (NPM1) M28699 29

| | | | | | | | |
|---|---|---|---|---|---|---|---|
| FCR5634 | MIOA0832 | ncr2369 | ncrb5486 | ncrc1076 | ncrc6667 | SEOA6899 | seob7537 |
| hfcr2026 | MIOA4798a | ncr7161 | ncrb6604 | ncrc2900 | ncrc9039 | SEOB0844a | |
| hfcr3946 | miob4364 | ncr8645 | ncrb6793 | ncrc4778 | seoa3444an | SEOB1408 | |
| hfcr7854 | miob6262 | ncrb4481 | ncrc0277 | ncrc4851 | SEOA5578a | seob5626 | |

161. cartilage-derived C-type lectin (CLECSF1) AF077345 29

| | | | | | | | |
|---|---|---|---|---|---|---|---|
| MIOA2327a | ncr0623 | ncr2654 | ncr9350 | ncrb5530 | ncrc5911 | SEOB1449 | SOA0535 |
| MIOA6484a | ncr1572 | ncr6793 | ncrb0620 | ncrb6995 | ncrc6787 | seob4606 | |
| MIOA6929a | ncr1677 | ncr7071 | ncrb2089 | ncrb7892 | SEOA2713 | SOA0387 | |
| mioa9940 | ncr2644 | ncr7769 | ncrb2744 | ncrc5751 | SEOA6135a | SOA0411 | |

162. ribosomal protein L8 Z28407 28

| | | | | | | |
|---|---|---|---|---|---|---|
| FCR2414 | FCR3919N | fcr6664n | hfcr0028 | hfcr4038 | hfcr6703 | miob0269 |
| FCR3275 | FCR3951 | FCR7166 | hfcr0124 | hfcr5280 | hfcr8465 | miob0275 |
| FCR3396 | FCR6231 | FCR7380 | hfcr0410 | hfcr6031 | hfcr9647 | ncr8019 |
| fcr3675n | FCR6256 | fcrb2620 | hfcr0665 | hfcr6066 | hfcr9769 | SEOA0926 |

163. spermidine/spermine N1-acetyltransferase Z14136 28

| | | | | | | |
|---|---|---|---|---|---|---|
| hfcr7616 | MIOA4928a | mioa9977 | ncr1214 | ncrc9310 | SEOA2638 | SEOB2010 |
| MIOA0055a | MIOA5820a | miob3826 | ncr1825 | ncrc9944 | seoa4893a | SEOB2098 |
| mioa0503m | MIOA6000a | miob6750 | ncrb0484 | SEOA0047 | SEOA5067a | seob4298 |
| MIOA3132a | MIOA6431a | ncr0617 | ncrb5385 | SEOA1788a | SEOA5472a | soa0042n |

164. Sec61 gamma AF054184 28

| | | | | | | |
|---|---|---|---|---|---|---|
| FCR3832 | MIOA8832 | ncrb4437 | SEOA2340a | SEOA7371a | SEOA9918 | seob2575 |
| FCR4359 | miob4360 | ncrb6426 | SEOA2495 | SEOA7617a | SEOB0565 | seob3664 |
| hfcr1427 | ncr2265 | ncrc6782 | SEOA3401a | SEOA8420 | SEOB0772 | seob6165 |
| MIOA0099 | ncr7621 | SEOA1844a | SEOA7326a | SEOA8922 | SEOB1934 | seob7138 |

165. MEN1 region clone epsilon/beta AF001893.1 28

| | | | | | | |
|---|---|---|---|---|---|---|
| MIOA0405a | MIOA8621 | ncr9483 | ncrb4192 | ncrc2879 | ncrc5700 | SEOA1385 |
| MIOA0793 | MIOA8674 | ncrb0407 | ncrb5722 | ncrc3332 | ncrc5908 | seob4134 |
| MIOA0907a | miob0900 | ncrb0485 | ncrc0837 | ncrc4355 | ncrc7162 | seob4143 |
| MIOA0930 | miob6967 | ncrb3235 | ncrc1918 | ncrc4481 | ncrc9360 | SOA0661 |

Figure 6A – EST Names Corresponding to Unique Known Genes of Figure 6

166. polyubiquitin E12605 28

| | | | | | | |
|---|---|---|---|---|---|---|
| BFCS0396 | FCR6987 | hfcr0662 | hfcr9999 | ncr0897 | ncr6429 | SEOA6677a |
| FCR2562 | FCR7073 | hfcr1277 | miob0409 | ncr1996 | ncrb0711 | SEOA8335a |
| FCR3939 | fcrb0306 | hfcr5070 | miob4003 | ncr2776 | ncrb1153 | SEOA8461 |
| FCR4937 | hfcr0562 | hfcr7779 | ncr0734 | ncr3661 | SEOA0754 | seob6494 |

167. ribosomal protein S7M77233 28

| | | | | | | |
|---|---|---|---|---|---|---|
| CR0281 | hfcr4241 | miob1742 | ncrb8336 | ncrc6557 | SEOA5441 | seob5819 |
| FCR1731 | hfcr5119 | miob3356 | ncrc1018 | SEOA0757 | SEOA7406a | seob6336 |
| FCR3936 | hfcr6111 | ncrb0929 | ncrc4973 | SEOA1560 | SEOB1988 | seob6511 |
| hfcr0377 | hfcr8500 | ncrb3843 | ncrc5937 | SEOA2215a | SEOB3310 | seob7573 |

168. caveolin 1 (CAV1) AF125348.1 28

| | | | | | | |
|---|---|---|---|---|---|---|
| MIOA0293n | MIOA5134a | mioa9976 | ncrc0569 | ncrc4957 | SEOA3328a | seob1046 |
| MIOA2029 | MIOA5926a | miob3938 | ncrc1302 | SEOA1353 | SEOA8203a | SEOB1117 |
| MIOA2583a | MIOA7205a | miob6265 | ncrc3957 | SEOA1732a | SEOA9595 | SEOB1915 |
| MIOA2804a | mioa9768 | ncr1981 | ncrc4111 | SEOA2139 | SEOB0191 | seob7610 |

169. ribosomal protein L18a L05093.1 28

| | | | | | | |
|---|---|---|---|---|---|---|
| BFCN0047 | FCR2285 | FCR5748 | fcrb2626 | hfcr0900 | hfcr4194 | hfcr9583 |
| BFCN0220 | FCR3077 | fcrb1007 | hfcr0047 | hfcr1199 | hfcr5274 | hfcr9723 |
| BFCW0244 | FCR4620 | fcrb1474 | hfcr0143 | hfcr1963 | hfcr6781 | hfcr9991 |
| FCR0658 | FCR5015 | fcrb2542 | hfcr0716 | hfcr3422 | hfcr9046 | ncr0289 |

170. HSPC036 protein (=AF077200.1 HSPC014) AF125097.1 28

| | | | | | | |
|---|---|---|---|---|---|---|
| hfcr1933 | MIOA3339a | miob2884 | SEOA2242a | SEOA6407 | SEOB1030 | seob6397 |
| hfcr5898 | MIOA6663a | miob3380 | SEOA2444a | SEOA6901 | SEOB1374 | seob7003 |
| MIOA0098 | miob0087 | SEOA0217a | SEOA4376a | SEOA9848 | seob4581 | seob7476 |
| MIOA2319a | miob0934 | SEOA0537 | SEOA6351 | SEOB0171 | seob6204 | seob7742 |

171. "lectin, galactoside-binding, soluble, 1 (galectin 1) (LGALS1)mRNA (=14 kd lectin )( =14kDa beta-galactoside-binding lectin) "NM_002305.2 28

| | | | | | | |
|---|---|---|---|---|---|---|
| BFCW0064n | fcr2015 | fcrb1302 | hfcr0706 | hfcr5709 | hfcr9605 | ncr1051 |
| bfcw0088 | fcr6533 | fcrb2037 | hfcr1638 | hfcr7444 | hfcr9847 | ncrb4378 |
| fcr0632 | fcrb0144 | hfcr0458 | hfcr2721 | hfcr9482 | mioa9311 | ncrc9700 |
| fcr0736 | fcrb0304 | hfcr0548 | hfcr5253 | hfcr9532 | miob1785 | ncrc9772 |

172. "hemoglobin, gamma G (HBG2) (=PRO2898) "NM_000184.1 27

| | | | | | | | | |
|---|---|---|---|---|---|---|---|---|
| BFCS0516 | FCR5910 | fcrb2084 | hfcr0121 | hfcr2217 | hfcr5164 | hfcr6804 | hfcr7825 | hfcr9346 |
| FCR4116 | fcrb1614 | fcrb2137 | hfcr0546 | hfcr2552 | hfcr5206 | hfcr7007 | hfcr8372 | hfcr9521 |
| FCR4970 | fcrb1693 | hfcr0025 | hfcr1899 | hfcr5149 | hfcr5775 | hfcr7721 | hfcr8415 | hfcr9746 |

173. ribosomal protein L24 (RPL24) (=ribosomal protein L30) NM_000986.1 27

| | | | | | | | | |
|---|---|---|---|---|---|---|---|---|
| FCR0334 | fcrb2731 | hfcr8448 | ncr3529 | ncrb5939 | ncrc0468 | ncrc4719 | seoa4970a | seob3953 |
| fcrb0995 | hfcr4142 | hfcr9343 | ncrb1433 | ncrb6273 | ncrc4052 | ncrc7003 | SEOB1564 | seob6371 |
| fcrb2383 | hfcr5422 | miob3086 | ncrb2277 | ncrb7811 | ncrc4554 | ncrc9838 | seob3865 | seob6837 |

174. high mobility group-1 protein (HMG-1) X12597 27

| | | | | | | | | |
|---|---|---|---|---|---|---|---|---|
| FCR5559 | hfcr7623 | MIOA6870a | mioa7858 | miob1888 | miob6405 | SEOA3561a | SEOB1978 | SEOB3204 |
| hfcr1285 | MIOA0757 | MIOA7274 | MIOA8597 | miob1911 | ncr6311 | SEOA4746a | SEOB2059 | seob5574 |
| hfcr3535 | MIOA4642a | MIOA7408a | MIOB1530 | miob4189 | SEOA1632a | SEOA9563 | SEOB2772 | SOA0701 |

Figure 6A – EST Names Corresponding to Unique Known Genes of Figure 6

175. integrin beta 1 subunit X07979.1 27

| | | | | | | | | |
|---|---|---|---|---|---|---|---|---|
| FCR5190 | MIOA7070a | miob3079 | ncrb8189 | SEOA2047 | SEOA6173a | seoa7845a | SEOB0137 | seob5191 |
| MIOA3317a | mioa9237 | ncr8569 | ncrc1083 | SEOA4642a | SEOA6335 | SEOA8383a | seob4014 | seob7044 |
| MIOA5808a | miob0717 | ncrb3229 | seoa1012m | SEOA6040a | SEOA6892 | SEOA8715 | seob4875 | seob7933 |

176. "hemoglobin, gamma A (HBG1) "NM_000559.1 27

| | | | | | | | | |
|---|---|---|---|---|---|---|---|---|
| FCR5530 | fcrb1614 | fcrb2137 | hfcr1642 | hfcr2552 | hfcr5164 | hfcr6804 | hfcr8372 | hfcr9372 |
| fcr5733 | fcrb1693 | hfcr0546 | hfcr1899 | hfcr2993 | hfcr5215 | hfcr7509 | hfcr8415 | hfcr9521 |
| FCR6383 | fcrb2084 | hfcr1170 | hfcr2217 | hfcr5149 | hfcr5775 | hfcr7825 | hfcr9346 | hfcr9746 |

177. ribosomal protein S9U14971 27

| | | | | | | | | |
|---|---|---|---|---|---|---|---|---|
| FCR1755 | FCR0492 | FCR6478 | hfcr6920 | fcrb1701 | hfcr4267 | hfcr7057 | hfcr1295 | fcrb2473 |
| CR1010 | BFCW0534 | FCR6985 | hfcr9200 | hfcr0873 | hfcr5131 | hfcr7428 | hfcr3801 | fcrb1349 |
| BFCS0492 | FCR2003 | hfcr5643 | fcrb0686 | hfcr4032 | hfcr5442 | hfcr7737 | hfcr0454 | hfcr9920 |

178. lysosomal membrane glycoprotein CD63 (=M59907 ME491;X07982) M58485 26

| | | | | | | | | |
|---|---|---|---|---|---|---|---|---|
| FCR3254 | hfcr0266 | hfcr9428 | miob0233 | ncr7636 | ncrb0815 | ncrc0714 | ncrc9523 | SEOA5990a |
| FCR5074 | hfcr2575 | MIOA3480a | ncr2775 | ncr8322 | ncrb2197 | ncrc3939 | SEOA2291a | SEOB1672 |
| fcrb1852 | hfcr7949 | MIOA5403a | ncr4126 | ncrb0383 | ncrb3126 | ncrc6315 | SEOA5846 | |

179. RIBOSOMAL PROTEIN S2 (S4) (LLREP3 PROTEIN) spP15880 26

| | | | | | | | | |
|---|---|---|---|---|---|---|---|---|
| FCR0879 | FCR2294 | FCR4318 | FCR6617 | fcrb1295 | hfcr2520 | hfcr3874 | hfcr8570 | MIOA4319a |
| FCR1472 | FCR2358 | FCR5517 | FCR7205 | hfcr1415 | hfcr2733 | hfcr5636 | hfcr9050 | ncrc0321 |
| FCR1475 | FCR4302 | FCR6068 | FCR7659 | hfcr1830 | hfcr3420 | hfcr7534 | hfcr9159 | |

180. matrilin-3 (MATR3)Y13341 26

| | | | | | | | | |
|---|---|---|---|---|---|---|---|---|
| BFCW0186 | hfcr1159 | hfcr7807 | miob4496 | ncr9477 | ncrb5011 | SEOA3917 | SEOB0570 | seob5661 |
| FCR6514 | FCR1705 | MIOA3510a | ncr1617 | ncrb2696 | ncrc5091 | seoa7842a | seob3703 | soa0489n |
| fcrb0352 | hfcr4348 | miob2988 | ncr9020 | ncrb2799 | SEOA1653a | SEOB0380 | seob5238 | |

181. chitinase (HUMTCHIT) U58515 26

| | | | | | | | | |
|---|---|---|---|---|---|---|---|---|
| ncrb0045 | SEOA1079a | SEOA2866 | SEOA5145a | SEOA6498a | SEOA8271 | SEOB1255 | SEOB3140 | seob5679 |
| SEOA0467 | SEOA1105a | SEOA3538a | SEOA5248a | SEOA7338a | SEOA9135 | SEOB1753 | seob4571 | seob7557 |
| SEOA0890n | SEOA2789 | SEOA4574 | SEOA6236 | SEOA7363a | SEOB0277 | SEOB2239 | seob4845 | |

182. CGI-134 protein (LOC51023) NM_016067.1 26

| | | | | | | | | |
|---|---|---|---|---|---|---|---|---|
| MIOA0149 | mioa9417 | ncr1020 | SEOA3204 | SEOA5536a | SEOA6636a | seoa7800a | SEOB0908a | seob7191 |
| MIOA0361a | ncr0533 | ncr7959 | SEOA3757a | SEOA6022a | SEOA7330a | SEOA8817 | SEOB1909 | SOA0622 |
| MIOA6581a | ncr0740 | SEOA0921 | SEOA5535a | SEOA6595a | SEOA7650a | SEOB0272 | seob6887 | |

183. ribosomal protein S10 NM_001014.1 26

| | | | | | | | | |
|---|---|---|---|---|---|---|---|---|
| BFCW0038 | FCR4675 | FCR6560 | fcrb1530 | hfcr2503 | hfcr7571 | hfcr8944 | hfcr9675 | seob4505 |
| FCR0066 | FCR5035 | fcrb0346 | fcrb1972 | hfcr3363 | hfcr7693 | hfcr9162 | ncrb5257 | seob8223 |
| FCR4502 | FCR6207 | fcrb0567 | hfcr1281 | hfcr5840 | hfcr7886 | hfcr9664 | SEOA9460 | |

184. "tissue inhibitor of metalloproteinase 3 (Sorsby fundus dystrophy, pseudoinflammatory) (TIMP3) "NM_000362.1 26

| | | | | | | | | |
|---|---|---|---|---|---|---|---|---|
| hfcr0853 | MIOA1458 | MIOA3750a | MIOA6197a | miob3184 | miob6629 | ncrb0644 | SEOA1639a | SEOB1686 |
| hfcr3708 | MIOA2274a | MIOA5114a | MIOA9036 | miob3351 | miob6779 | ncrb8231 | SEOA4649a | seob5003 |
| MIOA1026 | MIOA3440a | mioa5706n | mioa9627 | miob6019 | ncr6690 | SEOA0556A | seoa6833 | |

Figure 6A – EST Names Corresponding to Unique Known Genes of Figure 6

185. H19 (=PRO2605) M32053 26

| | | | | | | | | |
|---|---|---|---|---|---|---|---|---|
| FCR0238 | FCR0966 | FCR4762 | FCR5645 | FCR6528 | FCR7541 | hfcr2794 | hfcr5975 | hfcr8968 |
| FCR0388 | FCR2689 | FCR4926 | FCR5717 | FCR7155 | fcrb1513 | hfcr3026 | hfcr6546 | ncr0923 |
| FCR0532 | FCR4379 | FCR5160 | FCR6465 | FCR7180 | hfcr2725 | hfcr5111 | hfcr8967 | |

186. histone H3.3 Z48950 26

| | | | | | | | | |
|---|---|---|---|---|---|---|---|---|
| fcrb2487 | MIOA4611a | miob6622 | ncr6903 | ncrb3172 | ncrc1980 | ncrc6405 | SEOA9789 | seob5866 |
| hfcr7068 | MIOA6839a | ncr0547 | ncrb1585 | ncrb5585 | ncrc3395 | SEOA3422a | SEOB1402 | seob6700 |
| hfcr9690 | miob2490 | ncr3664 | ncrb2649 | ncrc0334 | ncrc3900 | SEOA4502 | SEOB1649 | |

187. ferritin L chain M11147 25

| | | | | | | | | |
|---|---|---|---|---|---|---|---|---|
| BFCS0408 | FCR2727 | hfcr7425 | miob1387 | ncr3229 | ncrb2191 | ncrc0917 | ncrc3778 | SEOB1859 |
| FCR0796 | FCR5438 | hfcr7531 | ncr1710 | ncrb0904 | ncrb5746 | ncrc1019 | SEOB0037 | |
| FCR1304 | fcrb2612 | hfcr9630 | ncr2648 | ncrb1997 | ncrb6778 | ncrc3061 | SEOB1240 | |

188. signal recognition particle 14kD (homologous Alu RNA-binding protein)(SRP14) (=18 kDa Alu RNA binding protein)( =signal recognition particle subunit 14) NM_003134.1 25

| | | | | | | | | |
|---|---|---|---|---|---|---|---|---|
| hfcr7287 | mioa7754a | miob0873 | ncr2112 | ncr6909 | ncrb0288 | ncrb4343 | ncrc1473 | seob4773 |
| hfcr8858 | MIOA8039a | miob3385 | ncr4652 | ncr7339 | ncrb2627 | ncrb7015 | ncrc4270 | |
| hfcr9266 | MIOA8797 | miob3433 | ncr4814 | ncr7727 | ncrb3151 | ncrb8377 | ncrc7080 | |

189. fatty acid binding protein (adipocyte lipid-binding protein) NM_001442.1 25

| | | | | | | | | |
|---|---|---|---|---|---|---|---|---|
| fcrb1839 | hfcr5971 | mioa7723a | MIOA8687 | mioa9612 | miob1199 | miob3808 | miob6651 | SEOA4424a |
| hfcr0854 | MIOA5583a | mioa7818a | mioa9547 | mioa9745 | miob1343 | miob3872 | ncrc1367 | |
| HFCR3233 | MIOA6577a | mioa7892 | mioa9575 | mioa9757 | miob3155 | miob6508 | ncrc6545 | |

190. "ribosomal protein, large P2 (RPLP2) "NM_001004.1 25

| | | | | | | | | |
|---|---|---|---|---|---|---|---|---|
| fcrb0211 | hfcr1435 | hfcr3362 | hfcr5950 | hfcr9232 | miob3857 | ncr5599 | ncrc4221 | seob6350 |
| fcrb0436 | hfcr2587 | hfcr4082 | hfcr6892 | hfcr9408 | ncr1396 | ncrb2067 | ncrc9710 | |
| fcrb2253 | hfcr2978 | hfcr5175 | hfcr7680 | miob3406 | ncr4218 | ncrb6307 | SEOB3326 | |

191. CD63 antigen (melanoma 1 antigen) (CD63) NM_001780.1 25

| | | | | | | | | |
|---|---|---|---|---|---|---|---|---|
| FCR1521 | hfcr0266 | hfcr9428 | mioa5713n | ncr4126 | ncrb0383 | ncrb3126 | ncrc6315 | SEOB1672 |
| fcr3117 | hfcr2575 | MIOA3480a | miob0233 | ncr7636 | ncrb0815 | ncrc0714 | ncrc9523 | |
| fcrb1852 | hfcr7949 | MIOA5403a | ncr2775 | ncr8322 | ncrb2197 | ncrc3939 | SEOA2291a | |

192. defender against cell death 1 (DAD1) NM_001344.1 25

| | | | | | | | | |
|---|---|---|---|---|---|---|---|---|
| CR0535 | MIOA1614a | miob0508 | ncrb2755 | ncrc0828 | ncrc6613 | SEOA1146a | SEOA8336a | seob5645 |
| fcrb2319 | MIOA2472a | miob6556 | ncrb3356 | ncrc2649 | ncrc9725 | SEOA1972a | SEOB3120 | |
| hfcr6819 | MIOA5261a | ncr8713 | ncrb5662 | ncrc6026 | SEOA1126a | SEOA6710 | seob4219 | |

193. cytochrome b (ORF) U09500 25

| | | | | | | | | |
|---|---|---|---|---|---|---|---|---|
| hfcr0746 | hfcr8907 | MIOA4082a | miob6526 | ncrb0043 | ncrb7347 | SEOA0030 | SEOA9157 | seob6512 |
| hfcr4542 | hfcr9967 | MIOA4191 | ncr0524 | ncrb2803 | ncrc8887 | SEOA7405a | SEOB0153 | |
| hfcr6736 | MIOA3796 | miob4421 | ncr6298 | ncrb6145 | ncrc9654 | SEOA9029 | seob4179 | |

194. metallothionein-II (mt-II) J00271 25

| | | | | | | | | |
|---|---|---|---|---|---|---|---|---|
| MIOA1752 | ncr0160 | ncr1260 | ncr3029 | ncr4331 | ncr9167 | ncrb1106 | ncrb3053 | ncrb4133 |
| ncr0152 | ncr0575 | ncr2536 | ncr3927 | ncr7626 | ncrb0160 | ncrb1410 | ncrb3608 | ncrb4287 |

Figure 6A – EST Names Corresponding to Unique Known Genes of Figure 6 ncrb5892 ncrb7587 ncrb8475 ncrc1609 ncrc3571 ncrc5048 seob5707

195. RNA polymerase II elongation factor-like protein Z47087 25

| | | | | | | | | |
|---|---|---|---|---|---|---|---|---|
| BFCW0573 | FCR0272 | hfcr5473 | MIOA1146 | miob4657 | SEOA1739a | SEOA7592a | SEOB0852a | SEOB3137 |
| CR0020 | FCR0425 | hfcr7399 | MIOA2790a | ncr0261 | SEOA3187 | SEOA8682 | SEOB0872a | |
| CR0206 | FCR1541 | MIOA0980 | MIOA3835 | ncr8400 | SEOA6280 | SEOB0364 | SEOB2223 | |

196. Insulin-like growth factor II (IGF-2)X07868 24

| | | | | | | | |
|---|---|---|---|---|---|---|---|
| CR0707 | FCR2233 | FCR5076 | fcrb0086 | hfcr0512 | hfcr1264 | HFCR3210 | hfcr3896 |
| FCR1247 | FCR4398 | FCR6185 | fcrb2116 | hfcr1057 | hfcr1647 | hfcr3653 | hfcr6550 |
| FCR1750 | FCR4839 | FCR7604 | hfcr0432 | hfcr1157 | hfcr2569 | hfcr3875 | hfcr7606 |

197. CD9 antigen (p24/CD9) L08125 24

| | | | | | | | |
|---|---|---|---|---|---|---|---|
| CR0271 | MIOA0587a | MIOA2542a | mioa9998 | miob6921 | SEOA1622a | SEOA5341 | SEOA9286 |
| FCR2770 | MIOA1814a | MIOA7104a | miob3878 | ncr9149 | SEOA3593a | SEOA7933a | seob6645 |
| fcrb2020 | MIOA2323a | mioa9420 | miob4837 | ncrb6548 | SEOA5154a | seoa8054 | seob8332 |

198. actate dehydrogenase A (LDHA) NM_005566.1 24

| | | | | | | | |
|---|---|---|---|---|---|---|---|
| FCR4584 | hfcr1276 | MIOA2189a | ncr1964 | ncrc6277 | SEOA2542 | SEOA3683a | SEOB0063 |
| FCR7125 | MIOA0170 | MIOA4901a | ncr2621 | SEOA0808 | SEOA2684 | SEOA6094a | seob4050 |
| fcrb1519 | MIOA1454 | MIOA9035 | ncrb6167 | SEOA1247A | SEOA3138 | SEOA7492a | seob5086 |

199. poly(A)-binding protein (PABP) U68105 24

| | | | | | | | |
|---|---|---|---|---|---|---|---|
| CR0716 | HFCR3197 | miob6072 | ncrb2288 | ncrb6910 | seoa2058n | SEOA5046a | seob5908 |
| fcrb0961 | hfcr9288 | ncr6603 | ncrb3185 | ncrb8464 | SEOA2087 | SEOA7270a | seob6202 |
| fcrb1942 | hfcr9963 | ncr7069 | ncrb3414 | ncrc6635 | SEOA3477a | SEOA8468 | seob7555 |

200. mitochondrial ubiquinone-binding protein M26700 24

| | | | | | | | |
|---|---|---|---|---|---|---|---|
| fcrb1720 | hfcr1047 | MIOA5975a | miob0369 | miob6022 | ncrb4771 | SEOA4764a | SEOB0837a |
| hfcr0609 | MIOA1530 | MIOA6363a | miob2378 | miob7000 | ncrb7806 | SEOA5998a | SEOB2121 |
| hfcr0838 | MIOA2765a | mioa9209 | miob5470 | ncr2965 | SEOA1132a | SEOB0803 | SEOB2132 |

201. "ATP synthase, H transporting, mitochondrial F0 complex, subunit g (ATP5L), mRNA /cds=(73,384) /gb=NM_006476 /gi=5453560 /ug=Hs.107476 /len=482 "Hs.107476 24

| | | | | | | | |
|---|---|---|---|---|---|---|---|
| BFCN0168n | hfcr6692 | miob1479 | ncr6126 | ncrb5117 | ncrc3798 | seoa7002 | seob6617 |
| hfcr1792 | MIOA4283 | miob3229 | ncr6223 | ncrc2365 | ncrc6515 | SEOA8968 | seob6758 |
| hfcr1913 | MIOA5955a | ncr6036 | ncr6236 | ncrc3468 | seoa6768 | SEOB2160 | seob7622 |

202. MORF-related gene X (KIAA0026) (=MRG15)NM_012286.1 24

| | | | | | | | |
|---|---|---|---|---|---|---|---|
| hfcr3501 | miob0832 | ncr0054 | ncr3263 | ncrb2263 | ncrc4842 | SEOB1391 | seob4752 |
| hfcr6768 | miob1944 | ncr0444 | ncrb0151 | ncrb3135 | ncrc9135 | seob4155 | seob6197 |
| mioa9661 | miob6758 | ncr3096 | ncrb0370 | ncrc3769 | SEOA9283 | seob4602 | seob7946 |

203. brain-expressed HHCPA78 homologue (VDUP1)S73591 24

| | | | | | | | |
|---|---|---|---|---|---|---|---|
| FCR0447 | ncr0650 | ncr1819 | ncr8422 | ncrc1708 | ncrc4409 | ncrc7050 | SEOB0396 |
| FCR0735 | ncr1194 | ncr3777 | ncrb7507 | ncrc1713 | ncrc4650 | SEOA0860 | SEOB1503 |
| ncr0066 | ncr1688 | ncr4078 | ncrc1296 | ncrc2356 | ncrc6656 | SEOA0860 | SEOB1668 |

204. PRO1574 (mitochondrial proteolipid 68MP homolog (PLPM) AF116639.1 24 hfcr7596 hfcr8228 MIOA5119a MIOA5789a MIOA7530a miob1709 miob3767 ncr1800 ncr7075

Figure 6A – EST Names Corresponding to Unique Known Genes of Figure 6 ncrb1731 ncrb8564 ncrb8804 ncrc2887 ncrc6126 SEOA8959 SEOA9889 seob7484
ncrb3385 ncrb8732 ncrc0591 ncrc4114 SEOA2669 SEOA9152 SEOB3189

205. heat shock 10kD protein 1 (chaperonin 10) (HSPE1) NM_002157.1 23 hfcr0849 MIOA8715 ncr1936 ncr7291 ncrb6032 ncrc0562 ncrc5738 SEOA9736
MIOA4426 miob6448 ncr3918 ncr8776 ncrb7226 ncrc3725 SEOA4169a SEOA9810
MIOA5027a miob6849 ncr6389 ncr9129 ncrc0385 ncrc4367 SEOA5293a 206. complement factor H (=M17517) Y00716 23

FCR4832 MIOA0268 MIOA3751a MIOA5795a MIOA6523a MIOB2080 ncrb3127 SEOA7182a
hfcr9180 MIOA1338a MIOA4422 MIOA6210a MIOA7036a miob6954 SEOA4625a seob5601
MIOA0119 MIOA2593a MIOA4760 MIOA6504a miob0465 ncr1717 SEOA5210

207. osteomodulin (OMD) AB000114 23

MIOA0354a MIOB2092 ncr1977 ncrc2907 SEOA0231a SEOA3175 SEOA9350 seob4656
MIOA1786 miob3604 ncr6381 ncrc3306 SEOA0543 SEOA6000a SEOB0124 seob5948
mioa9359 miob5648 ncrb5344 ncrc9155 SEOA2850 SEOA6326 SEOB3371

208. epithelial membrane protein 1 (EMP1) NM_001423.1 23 fcrb1575 MIOA6635a miob6959 ncr8852 ncrc3465 SEOA8938 SEOB1113 seob6076
MIOA3084a miob6115 ncr3553 ncr9096 ncrc6606 SEOA8975 seob4601 seob8242
MIOA5409a miob6841 ncr8411 ncrb8696 SEOA8921 SEOA9898 seob4700

209. Tigger1 transposable elementU49973.1 23 fcrb2008 hfcr6044 MIOA8111 miob4669 ncr3032 ncrb0232 ncrb4921 SEOA8852
hfcr0614 hfcr7546 MIOA8290 miob4745 ncr6734 ncrb0808 ncrc4958 seob6206
hfcr2710 MIOA5828a miob0416 miob6698 ncr6987 ncrb1667 SEOA3305n 210. cysteine dioxygenase D85777 23

MIOA0195a MIOA4821a miob0071 miob5761 SEOA2214a SEOA7654a seob2304 soa0201n
MIOA2134 MIOA8805 miob4020 ncrb8177 SEOA3925 SEOA9033 SEOB3014 SOA0410
MIOA3970a MIOA8962 miob4369 SEOA2134n seoa4989a SEOB0531 seob6410

211. "dynein light chain 1 (hdlc1), cytoplasmic "U32944 23

FCR0542 hfcr3684 MIOA6833a ncr0145 SEOA1538 SEOA6929 SEOB0528 seob5404
FCR1927 hfcr9720 MIOA8088 ncr0335 SEOA3233n SEOA8475 SEOB2930 seob7115
hfcr2994 MIOA5621a MIOB2124 ncr5291 SEOA3990a SEOA9908 SEOB3039

212. calcyclin (=M14300 growth factor-inducible 2A9 gene; U04815 protein kinase PITSLRE alpha 1) J02763 23

BFCN0266 FCR3266 hfcr0549 hfcr9646 mioa9484 seoa0499m SEOB0404 seob5777
FCR2682N FCR7261 hfcr2989 MIOA0241a miob4760 SEOA6019a SEOB3005 seob6245
fcr2707nn fcrb2291 hfcr8585 MIOA3629a ncrb8392 SEOA6602a seob4422

213. "ATP synthase, H transporting, mitochondrial F1F0, subunit g (ATP5JG) "NM_006476.1 22 hfcr1106 hfcr4146 hfcr6665 MIOA6623a miob3488 SEOA7914a SEOB1735 seob4756
hfcr1422 hfcr4813 MIOA4199 mioa9607 miob4355 SEOA8703 seob2546
hfcr2824 hfcr6411 MIOA5537a miob2901 ncrb0646 SEOA9262 SEOB3378

214. ribosomal protein L29 (RPL29) NM_000992.1 22

FCR0573 FCR1943 FCR2165 FCR4283 FCR4621 FCR5144 FCR6213 fcrb0120 fcrb1453

Figure 6A – EST Names Corresponding to Unique Known Genes of Figure 6

| | | | | | | | |
|---|---|---|---|---|---|---|---|
| fcrb1988 | hfcr2078 | hfcr2685 | hfcr3725 | hfcr4807 | hfcr8774 | ncrc4861 | |
| hfcr1238 | hfcr2344 | hfcr3628 | hfcr3998 | hfcr5412 | hfcr8880 | | |

215. FK506 binding protein (Fkbp63) AF090334 22

| | | | | | | | |
|---|---|---|---|---|---|---|---|
| BFCS0239n | HFCR3187 | hfcr7300 | miob5901 | ncr3908 | ncrc8932 | SEOA3186 | SEOB0535 |
| FCR3766 | hfcr3635 | hfcr7652 | ncr1683 | ncrb3895 | SEOA0060 | SEOA7212a | |
| hfcr1081 | hfcr6473 | miob3395 | ncr3509 | ncrb8050 | SEOA2451a | seoa8139 | |

216. "COX17 (yeast) homolog, cytochrome c oxidase assembly protein (COX17) "NM_005694.1 22

| | | | | | | | |
|---|---|---|---|---|---|---|---|
| MIOA1516 | MIOA7047a | miob3231 | ncr3734 | ncrc5288 | SEOA3778a | seob6143 | seob8233 |
| MIOA2552a | miob1691 | miob3891 | ncrb4552 | SEOA2090 | SEOA7353a | seob7007 | |
| MIOA3919a | MIOB2780 | ncr2477 | ncrc3007 | SEOA3356a | seob4044 | seob7216 | |

217. ribosomal protein S14 (RPS14)NM_005617.1 22

| | | | | | | | |
|---|---|---|---|---|---|---|---|
| FCR1450 | FCR6568 | fcrb1640 | fcrb1981 | fcrb2703 | hfcr2937 | hfcr6878 | seob5769 |
| FCR1713 | fcrb0095 | fcrb1762 | fcrb2106 | hfcr1067 | hfcr2976 | hfcr6913 | |
| FCR3327 | fcrb1416 | fcrb1885 | fcrb2377 | hfcr1715 | HFCR3137 | hfcr9478 | |

218. ribosomal protein S16 M60854 22

| | | | | | | | |
|---|---|---|---|---|---|---|---|
| BFCW0608 | FCR2712 | FCR5077 | hfcr0419 | hfcr6722 | ncr9119 | SEOA8395a | seob7712 |
| FCR0847 | FCR4344 | FCR7154 | hfcr1776 | hfcr8278 | ncrb5496 | SEOB1004 | |
| FCR2152 | FCR4741 | fcrb1862 | HFCR3162 | MIOA0486 | SEOA0306 | seob5377 | |

219. "solute carrier family 25 (mitochondrial carrier; phosphate carrier), member 3 (SLC25A3), nuclear gene encoding mitochondrial protein, transcript variant 1a "NM_005888.1 22

| | | | | | | | |
|---|---|---|---|---|---|---|---|
| FCR0455 | fcrb2051 | MIOA0461 | MIOA2971a | ncrb1209 | SEOA1834a | SEOB1025 | seob7440 |
| fcrb0300 | hfcr0505 | MIOA0848a | ncr0578 | ncrc0960 | SEOA3767a | seob4294 | |
| fcrb1691 | hfcr7380 | MIOA2343a | ncr4835 | SEOA0388 | SEOA9750 | seob4294 | |

220. "aggrecan (chondroitin sulfate proteoglycan 1, large aggregating proteoglycan antigen identified by monoclonal antibody A0122) (AGC1) "U13613 22

| | | | | | | | |
|---|---|---|---|---|---|---|---|
| bfcn0134n | FCR4395N | fcrb2217 | fcr6665 | hfcr6741 | MIOA0921a | ncr9383 | SEOB2211 |
| FCR1127 | fcr5224n | fcr7424 | hfcr0426 | hfcr8607 | miob1933 | seoa6856 | |
| FCR2313N | fcrb1563 | fcr0720 | hfcr1175 | MIOA0902a | miob5696 | SEOA8635 | |

221. BiP protein X87949 22

| | | | | | | | |
|---|---|---|---|---|---|---|---|
| BFCW0020 | FCR6873 | MIOA0993n | MIOA6485a | ncrc9567 | SEOA7235a | seob6439 | SOA0641 |
| FCR2990 | hfcr9400 | MIOA4836a | miob5638 | SEOA4706a | SEOB1191 | SOA0248 | |
| FCR3699 | MIOA0184 | MIOA5602a | ncrb6663 | SEOA5429 | SEOB2198 | SOA0520 | |

222. 78 kD glucose-regulated protein (GRP78) gene (=BiP protein) M19645.1 22

| | | | | | | | |
|---|---|---|---|---|---|---|---|
| SEOB1191 | FCR3699 | MIOA0993n | MIOA6485a | ncrc9567 | SEOA7235a | seob6439 | SOA0641 |
| BFCW0020 | FCR6873 | MIOA4836a | miob5638 | SEOA4706a | SEOB1191 | SOA0248 | |
| FCR2990 | MIOA0184 | MIOA5602a | ncrb6663 | SEOA5429 | SEOB2198 | SOA0520 | |

223. ahemoglobin beta chain (HBB) AF117710 21

| | | | | | | |
|---|---|---|---|---|---|---|
| MIOA6356 | mioa7836a | miob1935 | MIOB2613 | miob4001 | miob6419 | ncrc6171 |
| mioa7692a | MIOA8958 | MIOB2211 | miob3322 | miob4427 | ncr5086 | ncrc9190 |
| mioa7733a | mioa9436 | miob2426 | miob3859 | miob5029 | ncrc2568 | SEOA9720 |

Figure 6A – EST Names Corresponding to Unique Known Genes of Figure 6

224. cytochrome c oxidase subunit I D38112 21

| | | | | | | |
|---|---|---|---|---|---|---|
| mioa9557 | ncr5160 | ncr6200 | ncrb0843 | ncrc1806 | ncrc2704 | ncrc5673 |
| ncr1513 | ncr5237 | ncr6277 | ncrb2257 | ncrc1856 | ncrc3916 | ncrc5998 |
| ncr1671 | ncr5312 | ncrb0153 | ncrb3402 | ncrc2306 | ncrc5324 | ncrc9235 |

225. "tyrosine 3-monooxygenase/tryptophan 5-monooxygenase activation protein, beta polypeptide (YWHAB) " NM_003404.1 21

| | | | | | | |
|---|---|---|---|---|---|---|
| hfcr1164 | hfcr7957 | miob3075 | ncrb1953 | SEOA3467a | SEOA9524 | seob5521 |
| hfcr2237 | MIOA2773a | miob6592 | ncrb2474 | SEOA6921 | SEOB1575 | seob6061 |
| hfcr6130 | mioa9884 | ncr2931 | ncrb8416 | SEOA9172 | seob5336 | seob6736 |

226. selenoprotein P (SEPP1) Z11793 21

| | | | | | | |
|---|---|---|---|---|---|---|
| FCR1239N | miob0874 | ncr6677 | ncrb3990 | ncrb5409 | ncrc6601 | SEOB3097 |
| MIOA3765 | miob6077 | ncr6719 | ncrb5024 | ncrb8533 | SEOA5303a | seob4529 |
| MIOA9063 | miob6603 | ncr7684 | ncrb5150 | ncrc1905 | SEOB1638 | seob5258 |

227. elongation factor 2 X51466 21

| | | | | | | |
|---|---|---|---|---|---|---|
| FCR0541 | hfcr0567 | hfcr0826 | hfcr1278 | hfcr1398 | hfcr7857 | SEOA7232a |
| FCR3401 | hfcr0694 | hfcr0902 | hfcr1289 | hfcr1839 | ncrb8651 | SEOA9872 |
| fcrb0110 | hfcr0784 | hfcr1054 | hfcr1381 | hfcr2883 | SEOA6111a | seob5420 |

228. ribosomal protein L14 D87735 21

| | | | | | | |
|---|---|---|---|---|---|---|
| FCR0588 | FCR2867 | fcrb1773 | hfcr5126 | MIOA2213a | ncrb1232 | SEOA5649a |
| FCR1063 | FCR5950 | hfcr0039 | hfcr8481 | miob4776 | ncrb4600 | SEOB3181 |
| FCR2292 | fcrb0678 | hfcr0916 | hfcr9518 | ncr5981 | ncrc3516 | seob4814 |

229. endozepine (putative ligand of benzodiazepine receptor) M15887.1 21

| | | | | | | |
|---|---|---|---|---|---|---|
| FCR6055 | MIOA1373a | miob4979 | SEOA2143 | SEOA4245a | SEOB0636a | SEOB3186 |
| hfcr9680 | miob3364 | miob6078 | SEOA2619 | SEOA4414a | SEOB0663a | seob5216 |
| MIOA0366a | miob4000 | ncrc5539 | SEOA4241a | SEOA9139 | SEOB1155 | seob8031 |

230. annexin A5 (ANXA5)(lipocortin-V) NM_001154.2 21

| | | | | | | |
|---|---|---|---|---|---|---|
| CR0389 | fcrb1792 | hfcr3472 | MIOA2775a | ncr9547 | SEOB1355 | seob4689 |
| FCR2801 | hfcr0626 | hfcr4133 | ncr0159 | ncrc1597 | seob4188 | seob5022 |
| fcrb1307 | hfcr1308 | hfcr6198 | ncr9109 | SEOA9192 | seob4563 | seob5772 |

231. carboxypeptidase E (CPE) NM_001873.1 21

| | | | | | | |
|---|---|---|---|---|---|---|
| BFCS0518 n | hfcr3742 | MIOA3575a | MIOA5174a | miob3307 | ncr5368 | ncrb7082 |
| FCR2628 | hfcr7473 | MIOA3803 | MIOA7336a | ncr1285 | ncrb0636 | ncrc3351 |
| FCR3543 | hfcr8715 | MIOA4044a | mioa7647a | ncr2298 | ncrb1807 | ncrc6444 |

232. collagen type IX alpha 2 (COL9A2)M95610 21

| | | | | | | |
|---|---|---|---|---|---|---|
| FCR1285 | FCR6241 | fcrb1290 | hfcr3620 | hfcr4045 | hfcr7160 | hfcr9406 |
| FCR1414 | FCR6756 | hfcr0514 | hfcr3854 | hfcr5785 | hfcr8956 | hfcr9802 |
| FCR2909 | FCR6896 | hfcr0934 | hfcr3899 | hfcr6100 | hfcr9314 | hfcr9996 |

233. "myosin, light polypeptide, regulatory, non-sarcomeric (20kD) (MLCB), mRNA /cds=(114,629) /gb=NM_006471 /gi=5453739 /ug=Hs.233936 /len=944 "Hs.233936 21

| | | | | | | | | |
|---|---|---|---|---|---|---|---|---|
| mioa7900 | miob5703 | miob6293 | SEOA9233 | SEOB0158 | SEOB3446 | seob6598 | MIOA5293a | ncr6205 |
| hfcr7533 | hfcr2522 | ncr2458 | SEOB0111 | SEOB3012 | seob5327 | seob6451 | ncrb6190 | ncrb0121 |

Figure 6A – EST Names Corresponding to Unique Known Genes of Figure 6

| | | |
|---|---|---|
| ncrb2432 | ncrc2080 | ncrb7585 |

234. "SPARC-like 1 (mast9, hevin) (SPARCL1) "NM_004684.1 20

| | | | | | | |
|---|---|---|---|---|---|---|
| FCR4684 | MIOA1623a | MIOA5622a | mioa7823a | miob0199 | miob4596 | ncr8176 |
| FCR4925 | MIOA2531a | MIOA7114a | MIOA8601 | miob0741 | miob4758 | ncrb1381 |
| mioa0506m | MIOA2956a | mioa7801a | mioa9518 | MIOB1533 | miob6099 | |

235. Cyr61 protein (CYR61) AF031385 20

| | | | | | | |
|---|---|---|---|---|---|---|
| FCR0376 | hfcr4053 | MIOA0204a | ncr2826 | ncr4768 | ncrb4955 | seob4290 |
| FCR3098 | hfcr6724 | mioa9610 | ncr3592 | ncr6596 | SEOA2064 | seob6374 |
| hfcr0698 | hfcr8231 | miob0984 | ncr4657 | ncr7021 | seoa2174n | |

236. fibrillin (FBN1) X63556 20

| | | | | | | |
|---|---|---|---|---|---|---|
| FCR0536 | hfcr3862 | miob0305 | SEOA1616a | SEOA6029a | SEOA9528 | seob4500 |
| fcrb1405 | MIOA6423a | ncr5829 | SEOA4360a | SEOA6329 | SEOB0326 | seob7945 |
| HFCR3251 | MIOA8116 | ncrc1139 | SEOA5726a | SEOA6685a | SEOB2045 | |

237. trophoblast STAT utron AF080092.1 20

| | | | | | | |
|---|---|---|---|---|---|---|
| MIOA7331 | miob4433 | ncr1959 | ncr5430 | ncrb0834 | ncrc9007 | SEOA1385 |
| miob0900 | ncr0143 | ncr2007 | ncr5755 | ncrb8551 | ncrc9086 | SEOA3624a |
| miob3148 | ncr0474 | ncr3909 | ncr6114 | ncrc1918 | SEOA1159A | |

238. prefoldin 5 (PFDN5) (=D89667 c-myc binding protein) NP_002615.1 19

| | | | | | | |
|---|---|---|---|---|---|---|
| ncrc3920 | HFCR3231 | MIOB2548 | ncr7891 | ncrc5915 | SEOA2441a | SEOA6317 |
| ncrc4212 | MIOA0285 | ncr1203 | ncrb6696 | ncrc9784 | SEOA3733a | SEOA6606a |
| BFCS0038 | MIOA3684a | ncr2756 | ncrc3442 | SEOA1768a | SEOA3736a | SEOA7409a |
| hfcr2511 | MIOA5082a | ncr4406 | ncrc4703 | SEOA1952 | SEOA5488a | SEOA9507 |

239. cytochrome c oxidase subunit VIIc (COX7C) NM_001867.1 19

| | | | | | | |
|---|---|---|---|---|---|---|
| fcrb0703 | MIOA7077a | MIOB2553 | ncr2262 | seoa8046 | SEOB2757 | seob7929 |
| hfcr2767 | MIOA8045a | miob3919 | ncr3535 | SEOB1795 | seob4679 | |
| MIOA6336a | miob1124 | miob4390 | ncr8299 | SEOB2074 | seob6809 | |

240. ring-box 1 (RBX1) NM_014248.1 19

| | | | | | | |
|---|---|---|---|---|---|---|
| hfcr9741 | ncr7182 | ncrc0846 | SEOA2841 | seoa7029 | SEOB3400 | seob7903 |
| MIOA7103a | ncrb0730 | ncrc6763 | SEOA3916 | SEOB0379 | seob5126 | |
| miob5797 | ncrb2922 | SEOA2285a | SEOA5565a | SEOB1893 | seob6556 | |

241. epididymal seCRetory protein (19.5kD) (HE1) gi5453677 19

| | | | | | | |
|---|---|---|---|---|---|---|
| MIOA0315 | MIOA3972a | ncr1619 | ncrb7171 | SEOA0033 | SEOA8558 | seob5649 |
| MIOA1660a | miob0723 | ncr8507 | ncrc0133 | SEOA7093a | SEOA9671 | |
| MIOA1758 | miob6136 | ncrb3560 | ncrc2560 | SEOA8376a | SEOB1325 | |

242. "SRY (sex-determining region Y)-box 9 (campomelic dysplasia, autosomal sex-reversal)(SOX9) "NM_000346.1 19

| | | | | | | |
|---|---|---|---|---|---|---|
| FCR1905 | hfcr9790 | ncr6764 | ncrb2414 | ncrb4773 | ncrb5638 | SEOB2779 |
| FCR6688 | ncr0625 | ncr8239 | ncrb2644 | ncrb5147 | ncrc3855 | |
| hfcr2908 | ncr5236 | ncrb2208 | ncrb3987 | ncrb5282 | SEOA8195a | |

243. "H4 histone family, member G (H4FG) "NM_003542.2 19

| | | | | | | | |
|---|---|---|---|---|---|---|---|---|
| MIOA9170 | miob0857 | miob5495 | ncr6094 | ncrb1291 | SEOA5507a | SEOA5568a | SEOA5660a | SEOA6503a |

Figure 6A – EST Names Corresponding to Unique Known Genes of Figure 6

SEOA7082a SEOA9985 SEOB2050 SEOB3130 seob6187
SEOA7389a SEOB1090 SEOB2123 seob4681 seob6900

244. napolipoprotein D (APOD) J02611 19

MIOA0776 ncr6928 ncr9773 ncrb5196 ncrc0513 ncrc3594 ncrc9722
MIOA2245a ncr8230 ncrb0351 ncrb6142 ncrc1596 ncrc4933
ncr6167 ncr9616 ncrb3441 ncrb7993 ncrc2712 ncrc9460

245. cathepsin K (pycnodysostosis)(CTSK) NM_000396.1 19

FCR0846 hfcr3721 miob0063 ncr3385 ncr9593 seoa4917a seob7135
hfcr1240 hfcr7982 miob1956 ncr5507 SEOA1363 SEOB0338
hfcr1303 MIOA8053a ncr0609 ncr7917 SEOA2426a seob4495

246. peptidylglycine alpha-amidating monooxygenase (PAM)M37721 19

FCR1299 MIOA1371a MIOA8844 ncr5383 ncrb3340 SEOA7527a seob6023
hfcr9244 mioa7935 mioa9405 ncr9348 ncrb3847 SEOA9853
MIOA0802 MIOA8058a MIOB0550 ncrb0263 SEOA2063 SEOB1126

247. zinc finger protein 216 (ZNF216) AF062072.1 19

FCR4966 MIOA0085a MIOA8929 ncr5542 ncrb3469 ncrc1801 SEOA6627a
hfcr6024 MIOA3342a ncr0596 ncr8484 ncrb5243 ncrc3922
hfcr6463 MIOA8599 ncr1289 ncrb2097 ncrb6726 SEOA2421a

248. heterogeneous nuclear ribonucleoprotein D-like (HNRPDL) NM_005463.1 19

FCR0349 hfcr6195 MIOA7607a ncr8367 ncrc9060 seoa8070 SOA0579
fcrb1968 MIOA3018a MIOA8315 ncrb5972 SEOA0540n SEOA8947
fcrb2164 MIOA6588a miob2461 ncrc0346 SEOA1306a SEOB2030

249. chondromodulin I precursor (CHM-I) NM_007015.1 19

FCR4903 fcrb0019 fcrb2504 HFCR2380 hfcr5057 ncr5210 ncrc0531
FCR5145 fcrb0716 fcrb2619 hfcr3051 hfcr6914 ncrb2479
FCR5420 fcrb1265 hfcr0292 hfcr3778 hfcr8401 ncrb8252

250. osteoclastogenesis inhibitory factor AB008822 19

FCR0188 MIOA1502 MIOA6530a miob5658 SEOA5973a SEOB0230 SOA0365
FCR1309 MIOA2604a MIOA8215 SEOA3102a SEOA6128a SEOB3364
MIOA1441 MIOA4918a MIOB1527 SEOA5403 SEOA9619 seob7546

251. enolase 1 (alpha) (ENO1) NM_001428.1 19

CR0911 FCR4596 fcrb0365 hfcr2664 hfcr6373 hfcr8541 seob8321
FCR0019n FCR5921 hfcr0380 hfcr2782 hfcr7782 MIOB1555
FCR0298 FCR7060 hfcr2330 hfcr5091 hfcr8490 SEOA0829

252. v-fos FBJ murine osteosarcoma viral oncogene homolog (FOS) NM_005252.2 19

FCR6019 hfcr0182 hfcr1921 hfcr4101 MIOA6738a ncr4153 seob4446
fcrb0420 hfcr1401 hfcr2044 hfcr8479 ncr0168 ncr6045
fcrb2098 hfcr1909 hfcr3964 hfcr8828 ncr2021 ncrb1996

253. npalladin (KIAA0992)= CGI-151 NM_016081.1 19

BFCS0088 FCR7367 FCR7425 MIOA6104a miob6323 ncr5146 ncr8677 ncrc1607 ncrc3233

Figure 6A – EST Names Corresponding to Unique Known Genes of Figure 6

| | | | | |
|---|---|---|---|---|
| ncrc3268 | ncrc9805 | SEOA5310a | SEOB1185 | seob5235 |
| ncrc4684 | SEOA3392a | SEOA8733 | SEOB1866 | seob7471 |

254. heterogeneous nuclear ribonucleoprotein D (hnRNP D) (52% aa) D55671 19

| | | | | | | |
|---|---|---|---|---|---|---|
| FCR0349 | hfcr6195 | MIOA7607a | ncr8367 | ncrc9060 | seoa8070 | SOA0579 |
| fcrb1968 | MIOA3018a | MIOA8315 | ncrb5972 | SEOA0540n | SEOA8947 | |
| fcrb2164 | MIOA6588a | miob2461 | ncrc0346 | SEOA1306a | SEOB2030 | |

255. "procollagen-lysine, 2-oxoglutarate 5-dioxygenase (lysine hydroxylase) 2 (PLOD2), mRNA /cds=(0,2213) /gb=NM_000935 /gi=4505888 /ug=Hs.41270 /len=3503 "Hs.41270 19

| | | | | | | |
|---|---|---|---|---|---|---|
| seoa7848a | MIOA5244a | miob2475 | ncrb4358 | ncrc8982 | seob5353 | seob7512 |
| FCR5085 | mioa5668n | ncr0800 | ncrb6691 | ncrc9078 | seob5515 | |
| hfcr7472 | miob0240 | ncrb0840 | ncrb7447 | seoa3271n | seob7196 | |

256. lysyl oxidase U22384 18

| | | | | | | | | |
|---|---|---|---|---|---|---|---|---|
| FCR0075 | FCR4305 | FCR6562 | ncr6188 | ncrb5595 | ncrc5297 | SEOA3215 | SEOA5558a | SEOB3011 |
| FCR1083 | FCR6194 | hfcr1263 | ncrb1782 | ncrc0112 | SEOA2308a | SEOA4881a | SEOA7614a | seob3897 |

257. "gap junction protein, alpha 1, 43kD (connexin 43) (GJA1) "NM_000165.2 18

| | | | | | | | | |
|---|---|---|---|---|---|---|---|---|
| hfcr0652 | SEOA3820a | seoa8138 | SEOA9241 | SEOA9956 | SEOB2984 | SEOB3553 | seob5082 | seob5785 |
| miob1760 | SEOA4172a | SEOA9143 | SEOA9704 | SEOB1628 | SEOB3096 | seob4441 | seob5646 | seob7105 |

258. procollagen C-endopeptidase enhancer 2 (PCOLCE2) NM_013363.1 18

| | | | | | | |
|---|---|---|---|---|---|---|
| hfcr3052 | miob5783 | ncr0460 | ncr3217 | ncrb5289 | ncrc2682 | SEOB0301 |
| miob2361 | miob5895 | ncr0701 | ncr4147 | ncrc0492 | ncrc3581 | seob6080 |
| miob3749 | miob6487 | ncr1138 | ncrb1431 | ncrc2260 | ncrc4233 | |

259. NADH dehydrogenase subunit 4L (RefSeq aa 2e-45) gi5835396 18

| | | | | | | | | |
|---|---|---|---|---|---|---|---|---|
| miob0758 | ncr2398 | ncr5195 | ncr6331 | ncr7396 | ncr8017 | ncr9504 | SEOA4736a | seob4470 |
| ncr1256 | ncr2629 | ncr6047 | ncr6746 | ncr7857 | ncr8689 | SEOA4187a | SEOA9155 | seob5245 |

260. ubiquinol-cytochrome c reductase complex (7.2 kD); hypothetical protein (RefSeq aa 2e-35) NP_037519.1 18

| | | | | | | | | |
|---|---|---|---|---|---|---|---|---|
| hfcr0609 | MIOA2704a | MIOA6363a | miob5470 | miob6447 | ncr0944 | ncrb4771 | SEOA6131a | SEOA8957 |
| hfcr0838 | MIOA4796a | mioa9209 | miob6022 | miob7000 | ncr0944 | ncrb6632 | SEOA6887 | seob4118 |

261. "ATPase, H transporting, lysosomal (vacuolar proton pump) 9kD (ATP6H) "NM_003945.1 18

| | | | | | | | | |
|---|---|---|---|---|---|---|---|---|
| hfcr0829 | miob1893 | ncr1895 | ncr5109 | ncrb4794 | ncrb8752 | SEOA2943a | SEOB3421 | seob6416 |
| miob0432 | ncr0721 | ncr4666 | ncr5336 | ncrb8543 | ncrc2468 | SEOA9395 | seob6087 | seob8163 |

262. "ATP synthase, H transporting, mitochondrial F1 complex, gamma polypeptide 1 (ATP5C1), nuclear gene encoding mitochondrial protein "NM_005174.1 18

| | | | | | | | | |
|---|---|---|---|---|---|---|---|---|
| fcr3713n | hfcr1342 | hfcr8370 | miob2511 | miob6644 | ncr5416 | seoa7869a | SEOB3093 | seob4691 |
| hfcr0129 | hfcr5961 | miob0415 | miob2532 | ncr3316 | seoa7812a | SEOA9407 | seob4381 | seob5796 |

263. muscleblind (Drosophila)-like (MBNL) (=KIAA0428) NM_021038.1 18

| | | | | | | | | |
|---|---|---|---|---|---|---|---|---|
| fcr3551n | MIOA7495a | ncr5842 | ncr7810 | ncrc5239 | ncrc6988 | SEOA5291a | SEOB3429 | seob4642 |
| MIOA5519a | miob3391 | ncr7192 | ncrb4376 | ncrc5360 | SEOA4831a | SEOA5405 | SEOB3461 | seob5624 |

Figure 6A – EST Names Corresponding to Unique Known Genes of Figure 6

264. calumein (Calu) (calumenin)AF013759 18

BFCS0330 FCR2755 FCR7741 hfcr8986 MIOA7436a ncr3808 SEOA1979a seoa6958 SEOB1418
FCR1055 FCR7247 hfcr7784 hfcr9617 miob1855 ncrb0525 SEOA2459a SEOA9115 seob7098

265. "ATP synthase, H transporting, mitochondrial F1 complex, alpha subunit, isoform 1, cardiac muscle (ATP5A1)(ORF) " NM_004046.1 18 fcr3713n hfcr1342 hfcr8370 miob2511 miob6644 ncr5416 seoa7869a SEOB3093 seob4691
hfcr0129 hfcr5961 miob0415 miob2532 ncr3316 seoa7812a SEOA9407 seob4381 seob5796

266. "guanine nucleotide binding protein (G protein), alpha stimulating activity polypeptide 1 (GNAS1) "NM_000516.2 18

FCR3053 fcrb2083 hfcr4208 hfcr7607 ncr1206 ncrb7659 ncrc2720 ncrc4566 seob7982
fcrb0564 hfcr2856 hfcr6873 MIOA3737a ncrb2324 ncrc1538 ncrc3312 SEOA9802

267. vacuolar H-ATPase subunit AF038954 18 hfcr0829 ncr0721 ncr5109 ncrb8543 SEOA2051 SEOB3421 seob8163
miob0432 ncr1895 ncr5336 ncrb8752 SEOA2943a seob6087
miob1893 ncr4666 ncrb4794 ncrc2468 SEOA9395 seob6416

268. ribosomal protein 40S S27 isoform (RefSeq aa 4e-35) NP_057004.1 18 ncrb6528 ncrc6387 SEOA8460 SEOA9785 SEOB0036 SEOB1474 seob4313 seob4920 seob6633
ncrb7612 SEOA6886 SEOA9136 SEOB0001 SEOB0673a SEOB2119 seob4515 seob5725 seob7523

269. elongation factor 1 beta 2 (EEF1B2) NM_001959.1 17 fcrb2491 hfcr3025 hfcr4760 hfcr7692 hfcr8590 miob0246 miob3475 ncrb3376 seob7649
hfcr1189 hfcr3763 hfcr6701 hfcr8402 hfcr9638 miob2369n ncr8579 seoa8006

270. "laminin receptor 1 (67kD, ribosomal protein SA) (LAMR1)(ORF) "NM_002295.1 17 ncrc4969 FCR1495N FCR4902 FCR7681 hfcr6507 MIOA6326a ncr9496 ncrc3364 ncrc9393
ncrc5164 FCR2185 FCR5901 hfcr1668 hfcr8736 ncr1113 ncrb3108 ncrc4771 seob7177
BFCW0145 FCR3371 FCR5915 hfcr2624 MIOA4639a ncr6688 ncrc1245 ncrc9228

271. B-cell translocation protein 1 (BTG1) X61123 17

FCR0133 hfcr8744 hfcr9921 miob2453 ncr4646 ncr7707 SEOA1596a SEOA5117a SEOA9922
FCR2140 hfcr8750 MIOA0540 ncr3177 ncr7449 ncrb0570 seoa4915a SEOA5446

272. NADH dehydrogenase(ubiquinone) Fe-S protein 5 (15kD) (NADH-coenzyme Q reductase) (=NADH-ubiquinone oxidoreductase 15kDa subunit ) NM_004552.1 17 fcrb2760 hfcr8032 mioa8199n miob6599 ncr4178 ncrb7952 ncrc5316 ncrc5993 SEOB0089
hfcr6789 hfcr9535 miob5856 ncr1939 ncrb3188 ncrb8297 ncrc5464 seoa2647n

273. dolichyl-phosphate beta-glucosyltransferase (ALG5) AF102850.1 17
hfcr0014 hfcr0361 hfcr0953 hfcr3751 hfcr4103 hfcr4214 hfcr5450 ncr9289 seob5972
hfcr0255 hfcr0928 hfcr3678 hfcr3855 hfcr4119 hfcr4335 MIOA1571 seob5213

274. frizzled-related protein (FRZB) NM_001463.1 17

FCR6733 hfcr6164 miob5102 ncr5454 ncrb0850 ncrc2191 ncrc6735 SEOA5370 seob6242
fcrb2499 MIOA1933a ncr2136 ncr6741 ncrb5140 ncrc4940 seoa0985m SEOA9209

Figure 6A - EST Names Corresponding to Unique Known Genes of Figure 6

275. pp21 homolog AF125535.1 17 hfcr3933 MIOB2177 MIOB2642 seoa8154 SEOB0937 seob5137 seob5702 seob6734 seob8221
miob0126 MIOB2183 SEOA1316n SEOA9831 SEOB2103 seob5539 seob6207 seob6739

276. neuroendocrine-specific protein C like (foocen) (NSP-CL) reticulon 4 (RTN4) NM_007008.1 17

FCR5928 MIOA2571a miob0141 ncr2958 ncrc8861 SEOA9400 seob2312 seob7329 SOA0713
MIOA2235a MIOA4035a miob5644 ncrb6109 SEOA2505 SEOB1319 seob5009 seob7385

277. testis enhanced gene transCRipt protein (TEGT) AF033095 17

FCR0759 hfcr0912 mioa0788m MIOA1902a ncr2465 ncr6541 ncr8033 SEOA5426 SEOA8310a
FCR6541 hfcr8932 MIOA0974 mioa6645a ncr2660 ncr7129 ncrc1631 SEOA6697a 278. SOD-2 manganese superoxide dismutase X65965 17 hfcr8900 miob0135 miob2977 ncr3482 ncrc3509 ncrc5440 SEOA2919a SEOB0163 SOA0427
MIOA7395a miob2966 ncr3211 ncrb6672 ncrc3605 ncrc7024 SEOA4477a seob4553

279. decay-accelerating factor M31516 17

MIOA0577a MIOA2185a miob2364 miob3564 ncrc6575 ncrc9345 seoa3258m SEOB2262 seob4465
MIOA0749 miob0899 miob3451 ncrc4814 ncrc9272 SEOA0895 SEOB0188 SEOB2714

280. ametallothionein-le (hMT-le) M10942 17

MIOA7500 ncr2321 ncr9955 ncrb0108 ncrb4871 ncrc3169 ncrc3952 ncrc9597 SEOA6348
miob6431 ncr5594 ncrb0036 ncrb4320 ncrc2985 ncrc3667 ncrc4932 SEOA2487

281. platelet-derived growth factor receptor alpha (PDGFRA) M21574 17

FCR1046 hfcr5079 MIOA2041 MIOA5913a miob5411 ncr9016 ncrc9910 SEOA7908a SEOB1142
FCR3287 hfcr5839 MIOA3938a MIOA6112a ncr7509 ncrc5200 SEOA7266a SEOA9123

282. miCRosomal signal peptidase AF061737 17

FCR2102 FCR7159 MIOA2490a miob6747 ncrb6431 ncrc1025 SEOA1422a SEOA8551 SEOB1193
fcr4976n MIOA2478a MIOA7562a ncrb4948 ncrb6750 ncrc7181 SEOA7060a SEOB0490

283. enhancer of rudimentary homologue U66871 17

FCR3200 FCR5961 hfcr8765 MIOA2965a miob1857 ncr4352 ncr8475 SEOA4019a SEOB2241
FCR3577 hfcr0851 mioa1036m miob0677 miob3899 ncr7070 ncrb7162 SEOA6480a 284. tomoregulin AB004064.1 17 fcrb0009 hfcr7796 miob1787 miob3316 ncrb5375 SEOA9257 SEOB3563 seob5670 seob7517
hfcr3414 miob0850 MIOB2852 ncr5437 SEOA8442 SEOB3502 seob4913 seob7210

285. cell division cycle 10 (homologous to CDC10 of S. cerevisiae) (CDC10) NM_001788.1 17

FCR2089 FCR3759 hfcr1754 MIOA8378 ncrb2452 ncrc9542 SEOA1851a seob3888 seob8281
ncrc9542 FCR6393 MIOA0381a ncr7372 ncrc4668 seoa0102m SEOA5917 seob8275

286. cytochrome c oxidase subunitIII (RefSeq aa 8e-49) 5835394 17 ncrc1381 ncr4858 ncrb0017 ncrb2489 ncrc0317 ncrc2235 ncrc4489 ncrc5441 ncrc6091
ncrc5195 ncr5131 ncrb1983 ncrb8746 ncrc0555 ncrc2961 ncrc4977 ncrc5441

Figure 6A – EST Names Corresponding to Unique Known Genes of Figure 6

287. t-complex-associated-testis-expressed 1-like 1 (TCTEL1) NM_006519.1     17

| | | | | | | | | |
|---|---|---|---|---|---|---|---|---|
| hfcr5977 | MIOA4605a | ncr0828 | ncr6135 | ncr7799 | ncrb4478 | ncrb6371 | ncrc2830 | seob3279n |
| hfcr9302 | miob0178 | ncr5497 | ncr6595 | ncrb1626 | ncrb6367 | ncrb7887 | ncrc6581 | |

288. "guanine nucleotide binding protein (G protein), alpha stimulating activity polypeptide 1, clone MGC:15368 IMAGE:4106768, mRNA, complete cds "BC008855.1     17

| | | | | | | | |
|---|---|---|---|---|---|---|---|
| fcrb0564 | fcrb2608 | hfcr2856 | hfcr6873 | ncr1206 | ncrb7659 | ncrc2720 | ncrc4566 | seob7982 |
| fcrb2083 | fcrb2675 | hfcr4208 | hfcr7607 | ncrb2324 | ncrc1538 | ncrc3312 | SEOA9802 | |

289. "DEAD/H (Asp-Glu-Ala-Asp/His) box polypeptide 5 (RNA helicase, 68kD) (DDX5) "NM_004396.1     16

| | | | | | | |
|---|---|---|---|---|---|---|
| fcrb0621 | MIOA8782 | miob3177 | miob5949 | ncrc4028 | seoa7006 | seob5751 |
| hfcr3002 | miob0378 | miob3276 | miob6773 | SEOA3352a | SEOA8356a | |

290. calpactin 1 light chain M81457     16

| | | | | | | |
|---|---|---|---|---|---|---|
| MIOA0917a | miob4884 | SEOA1763a | SEOA3273n | SEOA3876 | SEOA5961 | SEOA8587 | SEOB2219 |
| MIOA2784a | SEOA1736a | SEOA2968a | SEOA3307 | SEOA5569a | SEOA7205a | SEOB0285 | SEOB2681 |

291. hairy (Drosophila)-homolog (HRY) NM_005524.2     16

| | | | | | | |
|---|---|---|---|---|---|---|
| MIOA9166 | miob5836 | ncr1833 | ncr2996 | ncrb0718 | ncrb6955 | ncrc4471 | SEOA7953a |
| miob4995 | ncr0183 | ncr1901 | ncr3851 | ncrb5702 | ncrc2027 | ncrc9249 | SEOA9097 |

292. rapa-2 (rapa gene) AJ277276.1     16

| | | | | | | |
|---|---|---|---|---|---|---|
| fcrb0345 | hfcr0003 | hfcr0393 | hfcr3389 | hfcr4659 | hfcr6214 | hfcr6779 | hfcr6906 |
| fcrb1056 | hfcr0385 | hfcr3369 | hfcr3871 | hfcr5122 | hfcr6317 | hfcr6903 | hfcr7346 |

293. "deiodinase, iodothyronine, type II (DIO2), transCRipt variant 1 "gi7549802     16

| | | | | | | |
|---|---|---|---|---|---|---|
| miob6287 | ncr1345 | ncr7253 | ncrb2028 | ncrb2772 | ncrb6654 | ncrc3049 | ncrc8891 |
| ncr0902 | ncr1627 | ncrb1228 | ncrb2058 | ncrb4789 | ncrb7188 | ncrc3877 | SEOB1268 |

294. ADP-ribosylation factor 4 (ARF4) AF104238.1     16

| | | | | | | |
|---|---|---|---|---|---|---|
| MIOA0013a | miob4316 | ncr8452 | ncrb3973 | ncrc1496 | SEOA5652a | SEOA7343a | seob4251 |
| MIOA6439a | ncr5196 | ncrb0810 | ncrb4061 | SEOA4281a | seoa7018 | seoa7759a | seob5745 |

295. KVLQT1 gene (=p150)AJ006345.1     16

| | | | | | | |
|---|---|---|---|---|---|---|
| hfcr3775 | MIOA0061a | MIOA3695a | MIOA7334a | ncr4048 | ncr7137 | ncrb1701 | ncrc0505 |
| hfcr9450 | MIOA2978a | MIOA5265a | miob6704 | ncr6696 | ncr8660 | ncrb7100 | seob7430 |

296. thrombospondin 2 (THBS2) L12350     16

| | | | | | | |
|---|---|---|---|---|---|---|
| FCR1336 | FCR3370 | hfcr0291 | ncrc5883 | SEOA2455a | SEOA6905 | seoa7807a | SEOB0123 |
| FCR2141 | FCR6952 | MIOA8304 | ncrc9957 | SEOA2831n | SEOA7593a | seoa8097 | SEOB0410 |

297. "fatty acid binding protein 4, adipocyte (FABP4), mRNA /cds=(47,445) /gb=NM_001442 /gi=4557578 /ug=Hs.83213 /len=619 "Hs.83213     16

| | | | | | | |
|---|---|---|---|---|---|---|
| MIOA5583a | mioa7723a | mioa7892 | mioa9575 | mioa9745 | miob1199 | miob3155 | miob6651 |
| MIOA6577a | mioa7818a | mioa9547 | mioa9612 | mioa9757 | miob1343 | miob6508 | SEOA4424a |

298. p40 AAC51266.1     16

| | | | | | | | |
|---|---|---|---|---|---|---|---|
| MIOA8456 | mioa9960 | miob6410 | ncr7569 | ncr8062 | ncrb0428 | ncrc2019 | ncrc2421 | ncrc2632 |

Figure 6A – EST Names Corresponding to Unique Known Genes of Figure 6 ncrc3070 SEOB1737 seob3844 seob4249 seob6622 seob8025 seob8207

299. TI-227H (=tomoregulin; mitchondrial)D50525 16 hfcr6746 MIOA4915a ncrb0156 ncrb6158 ncrb8012 ncrc2139 SEOA0515 seob3601
hfcr7806 ncr5437 ncrb4149 ncrb6360 ncrb8434 ncrc5677 SEOB3502 seob4664

300. cyclin I D50310 16

FCR6877 fcrb1464 MIOA2886a miob0137 ncrb0272 ncrc3844 SEOA5769 seob7021
fcrb0677 fcrb2275 MIOA9014 ncr5249 ncrb2704 SEOA2837 SEOB3183 SOA0525

301. "S100 calcium-binding protein A10 (annexin II ligand, calpactin I, light polypeptide (p11)) (S100A10) "NM_002966.1 16 ncrc6127 MIOA8130 ncrc3807 seob5087 seob5292 seob7460 SEOA9659 SEOA9691
ncr9646 miob0686 SEOB2130 seob5107 seob5648 seob5893 mioa9434 SEOA3273n

302. ribosomal protein L28U14969 16

FCR3685 FCR5469 hfcr1824 hfcr7392 hfcr2235 hfcr9020 fcrb0010 hfcr9872
BFCN0034 FCR7290 hfcr6942 hfcr0889 hfcr6267 fcrb1186 fcrb1000 fcrb2713

303. glucocorticoid-induced GILZ AF228339 16 ncrb3628 ncrc4721 ncr9178 hfcr1866 hfcr9358 ncrc1704 SEOA7394a ncrb8665
ncr5693 ncrc5763 ncr1667 hfcr6635 MIOA7092a SEOA5264a seob8258 seob4041

304. collagen type V alpha 2 (COL5A2)M11718 15 hfcr0692 hfcr3750 mioa6246a ncrb4867 seoa4971a seoa8393an SEOA9535 seob6479
hfcr0832 hfcr6073 mioa9938 SEOA4846a seoa6419n seoa8393an SEOA9668

305. "H3 histone, family 3A (H3F3A) "NM_002107.1 15 fcrb0728 hfcr0574 hfcr6070 hfcr8767 ncrb3203 ncrb8743 seob2329 seob6674
fcrb1821 hfcr5845 hfcr6281 hfcr9782 ncrb5790 SEOA9693 seob4122

306. "neural precursor cell expressed, developmentally down-regulated 5 (NEDD5) "NM_004404.1 15

FCR2089 FCR6785 hfcr0837 MIOA0951 mioa9366 ncrb6204 SEOB1151 SOA0100
FCR4924 fcrb2635 hfcr6723 MIOA6248a ncrb1349 ncrb8561 seob5400

307. heat shock factor binding protein 1 (HSBP1) NM_001537.1 15 fcrb1777 miob5862 ncrb4380 SEOA4024a SEOA6354 SEOA8902 SEOB2208 seob3916
MIOA1255m ncr7470 SEOA0509 SEOA5851 seoa6834 SEOB0101 SEOB2945

308. glypican 3 (GPC3) (chromosome X) (=L47176 GTR2-2) L47125 15

FCR0107 fcrb1848 hfcr0861 hfcr2549 hfcr4266 hfcr7490 hfcr9156 hfcr9601
fcrb0751 fcrb2136 hfcr2498 hfcr3504 hfcr5994 hfcr8374 hfcr9472

309. translocation protein 1(TLOC1) NM_003262.1 15

FCR2485 hfcr9543 MIOA5784a miob0372n miob7015 ncr6289 ncrb1747 ncrc2675
hfcr3911 MIOA3185a MIOA6270a miob5755 ncr5465 ncrb1723 ncrb8259

310. thrombospondin 4 (THBS4) NM_003248.1 15 hfcr4670 hfcr6037 hfcr6189 hfcr9433 MIOA2828a miob3329 miob5746 ncr0164 ncr0692

Figure 6A – EST Names Corresponding to Unique Known Genes of Figure 6

| | | | | | | | |
|---|---|---|---|---|---|---|---|
| ncr7649 | ncrb6505 | ncrb6507 | ncrb8139 | ncrc9757 | ncrc9921 | | |

311. 6.2 kd protein AJ011007 15

| | | | | | | | |
|---|---|---|---|---|---|---|---|
| MIOA4177 | ncr6892 | ncr8110 | ncrb1495 | ncrb6119 | ncrc1696 | ncrc4632 | ncrc6050 |
| ncr2492 | ncr7965 | ncrb0317 | ncrb2966 | ncrb6205 | ncrc3935 | ncrc5244 | |

312. "mannosidase, beta A, lysosomal (MANBA) gene, and ubiquitin-conjugating enzyme E2D 3 (UBE2D3) genes, complete cds "AF224669.1 15

| | | | | | | | |
|---|---|---|---|---|---|---|---|
| fcrb2158 | hfcr9522 | ncr2012 | ncr7125 | ncrb8391 | SEOA9333 | seob4910 | seob6136 |
| hfcr9008 | miob6641 | ncr5211 | ncrb6794 | ncrc9207 | SEOB0295 | seob5524 | |

313. ubiquitin-like 1 (sentrin) (UBL1) (=SUMO-1)NM_003352.1 15

| | | | | | | | |
|---|---|---|---|---|---|---|---|
| fcrb2299 | MIOA1514 | MIOA3298a | MIOA6545a | miob6701 | miob6966 | ncrb5111 | SEOA7278a |
| hfcr7812 | MIOA2366a | MIOA4597a | MIOA9158 | miob6839 | ncrb1915 | ncrb7655 | |

314. TGF-betaIIR alpha D50683 15

| | | | | | | |
|---|---|---|---|---|---|---|
| fcrb1569 | miob3701 | ncr4732 | SEOA4878a | seoa8150 | SEOB3138 | seob7413 |
| MIOA0324 | ncr0091 | ncrb8188 | seoa7877a | SEOB2962 | seob6540 | seob8187 |

315. "H2A histone family, member Z (H2AFZ) = D28450.1 "NM_002106.1 15

| | | | | | | | |
|---|---|---|---|---|---|---|---|
| fcrb0069 | fcrb2616 | ncr0833 | ncr8131 | ncrb1741 | ncrb6897 | ncrc6131 | SEOA9935 |
| fcrb1660 | hfcr4345 | ncr5159 | ncrb1101 | ncrb2751 | ncrc0444 | ncrc6991 | |

316. MAFB/Kreisler basic region/leucine zipper transCRiption factor (MAFB) AF134157.1 15

| | | | | | | | |
|---|---|---|---|---|---|---|---|
| hfcr3058 | SEOA0180a | SEOA1690a | SEOA2929a | SEOA8326a | SEOA9070 | seob5371 | seob7477 |
| ncrc4224 | seoa0260m | SEOA1819a | SEOA3962a | SEOA8976 | SEOA9680 | seob5999 | |

317. cig19 (=D31887.1 KIAA0062) AF026940.1 15

| | | | | | | | |
|---|---|---|---|---|---|---|---|
| hfcr1965 | MIOB2703 | ncr4393 | ncrb4383 | ncrc9696 | SEOA4722a | SEOA6527a | seob5027 |
| MIOA4567a | ncr2005 | ncr7680 | ncrc0876 | SEOA3008a | SEOA6292 | SEOB2802 | |

318. UMP-CMP kinase AF110643.1 15

| | | | | | | | |
|---|---|---|---|---|---|---|---|
| MIOA1365a | MIOA7560a | miob0186 | ncrc0572 | seoa4939a | SEOB0045 | SEOB1884 | seob6043 |
| MIOA7266a | MIOA9137 | ncrb2630 | ncrc4257 | SEOA6412 | SEOB1232 | seob5801 | |

319. cytochrome c oxidase subunit II gene (ORF) AF004339 15

| | | | | | | | |
|---|---|---|---|---|---|---|---|
| FCR3769 | hfcr8463 | MIOA4601a | ncr5293 | ncrb2486 | ncrc0064 | ncrc1831 | ncrc4975 |
| hfcr1831 | MIOA4601a | ncr1620 | ncrb0496 | ncrb4172 | ncrc1511 | ncrc4860 | |

320. cytosolic selenium-dependent glutathione peroxidase (=L09159 RHOA proto-oncogene multi-drug-resistance protein) M83094 15

| | | | | | | | |
|---|---|---|---|---|---|---|---|
| BFCS0206 | MIOA0220a | MIOA3294a | miob1458 | miob1894 | ncrc4029 | SEOA9393 | seob5049 |
| nfcrb0870 | MIOA2195a | miob0947 | miob1748 | ncrb2586 | ncrc9885 | seob4283 | |

321. collagen type XIV variant C-terminal NC1 and 3'UTR Y11711 15

| | | | | | | | |
|---|---|---|---|---|---|---|---|
| BFCS0522 | FCR1646 | hfcr1344 | MIOA2838a | ncr1024 | ncr9503 | ncrc4809 | ncrc6460 |
| FCR0816 | FCR3768 | hfcr1775 | MIOA9064 | ncr1338 | ncrb2515 | ncrc6241 | seob5159 |

Figure 6A – EST Names Corresponding to Unique Known Genes of Figure 6

322. phosphoglycerate mutase (PGAM-B) J04173 15

BFCW0352 FCR6693 hfcr3845 MIOA1429 SEOA3533a SEOB0725 seob3893 seob7720
FCR2076 hfcr2965 hfcr6961 ncrc3529 seoa7828a seob2297 seob6729

323. phosphoglycerate kinase 1 (PGK1) (ORF) NM_000291.1 15 fcrb0185 hfcr9745 mioa9525 ncrb5872 ncrc2098 SEOB0670a SEOB2750 seob6351
hfcr7097 MIOA9052 ncr0939 ncrc1503 SEOA9010 SEOB2062 seob3387n 324. reverse transcriptase related proteinprf1207289A 15 hfcr5810 miob7018 ncr7663 ncrb0058 ncrb2808 ncrb3960 ncrc2318 seob6545
miob6700 ncr5586 ncr8851 ncrb1127 ncrb3038 ncrc2149 ncrc4513

325. Heterogeneous nuclear ribonucleoprotein U (scaffold attachment factor A) NM_004501.1 15

FCR2042 FCR7696 MIOA3671a MIOB2606 ncr1165 ncrb3222 SEOA0939 seob6049
FCR6889 MIOA3620a miob1275 miob5679 ncr6939 ncrc5417 SEOA9383

326. collagen type XII alpha 1 (COL12A1) U57362 15

BFCW0395 CR0866 fcr4678n FCR7100 fcrb1407 MIOA3675a SEOA1025 SEOA6056a
CR0076 FCR0866 FCR6369 FCR7288 HFCR2379 MIOA4015a SEOA2365a 327. small nuclear ribonucleoprotein D2 polypeptide (16.5kD) (SNRPD2) NM_004597.3 14 fcrb0985 mioa9470 ncr1413 ncr9880 ncrb7754 SEOA9585 seob7497
hfcr7462 miob3301 ncr8798 ncrb5052 SEOA8206 seob3734 seob8055

328. Cu/Zn superoxide dismutase (SOD) X02317 14

FCR6102 hfcr8874 MIOA9169 miob3138 SEOA1101a SEOA2727 seob2608
hfcr3731 MIOA5160a MIOB2635 ncrc4376 SEOA1268A SEOA8342a seob7364

329. Nnuclease sensitive element binding protein 1 (NSEP1) = L28809.1 dbpB-like protein (ORF) NM_004559.1 14

FCR2939 hfcr6678 MIOA4737 ncrb0819 SEOA1238A SEOA9679 SEOB2988
hfcr3434 hfcr9668 MIOA8629 ncrc8901 SEOA8619 SEOB1772 seob5301

330. phospholipase A2 M86400 14

MIOA2136 miob2432 miob4828 ncrb1392 SEOA1403 SEOA2378a SEOB3568
mioa9884 miob3597 ncr1732 ncrb1953 SEOA1427a SEOA9524 seob8096

331. glutamine synthetase S70290 14

MIOA4201 ncr7533 ncrb1325 ncrb4472 ncrc6671 ncrc9338 SEOA7552a
ncr7420 ncrb1309 ncrb1878 ncrc2437 ncrc9174 ncrc9969 SEOB2955

332. cathepsin B (CTSB) L22569 14

FCR2119 hfcr9002 miob4773 ncrb7777 SEOA4703a SEOA6052a seob1053
hfcr7871 MIOB2795 ncr2242 ncrc3151 SEOA5433 SEOA9083 seob8032

333. thyroid receptor interactor (TRIP7) L40357 14

FCR6704 hfcr8493 MIOA6546a miob4925 ncr9546 SEOA7469a seob4762
hfcr5410 MIOA1247 mioa9893 ncr7617 ncrb1198 SEOB0010 seob7634

Figure 6A – EST Names Corresponding to Unique Known Genes of Figure 6

334. alpha-2-macroglobulin D83196 14

| | | | | | | |
|---|---|---|---|---|---|---|
| CR0112 | hfcr7076 | mioa7943 | miob1378 | miob5627 | ncrb5537 | ncrc9619 |
| FCR5854 | MIOA3772 | mioa9817 | miob2385 | ncr1275 | ncrb5865 | SEOA1661a |

335. Tis11d geneU07802 14

| | | | | | | |
|---|---|---|---|---|---|---|
| CR0496 | FCR3451 | hfcr8497 | miob3896 | ncr5461 | ncr9142 | ncrb7969 |
| FCR0253 | hfcr0547 | MIOA1535 | miob6162 | ncr8884 | ncrb5080 | ncrc6872 |

336. vacuolar sorting protein VPS29/PEP11 (LOC51699) NM_016226.1 14

| | | | | | | |
|---|---|---|---|---|---|---|
| hfcr6881 | MIOA5730a | MIOB1568 | ncrb4877 | SEOA7543a | seob5045 | seob6569 |
| hfcr9626 | MIOA8246 | ncr2248 | SEOA5766 | seob2604 | seob5706 | seob7384 |

337. low molecular mass ubiquinone-binding proteinD50369 14

| | | | | | | | |
|---|---|---|---|---|---|---|---|
| FCR2991 | hfcr2646 | ncr1603 | ncr7460 | SEOA0176a | SEOA7629a | seoa8045 | SEOA9638 |
| FCR7364 | hfcr9416 | ncr7247 | ncrb1907 | SEOA5354 | seoa7868a | SEOA9331 | |

338. Ku autoimmune antigen gene J04977.1 14

| | | | | | | |
|---|---|---|---|---|---|---|
| FCR0653 | MIOA1602a | MIOA3680a | miob1804 | miob6317 | ncr0258 | SEOB3440 |
| MIOA1532 | MIOA2183a | MIOA4039a | miob4819 | miob6911 | SEOA3837 | seob3998 |

339. transforming growth factor beta-stimulated protein TSC-22 (TSC22) NM_006022.1 14

| | | | | | | |
|---|---|---|---|---|---|---|
| fcrb0349 | hfcr3050 | hfcr6448 | mioa9403 | ncr1471 | ncr4787 | ncrc5607 |
| hfcr2723 | hfcr5167 | MIOA6889a | miob6391 | ncr4524 | ncrb3821 | ncrc6092 |

340. caldesmon M64110 14

| | | | | | | |
|---|---|---|---|---|---|---|
| MIOA2292a | miob3460 | seoa0807m | SEOA5711a | SEOA9254 | seob5202 | seob7763 |
| MIOA6949a | SEOA0282 | SEOA2519 | SEOA8350a | SEOB3381 | seob6640 | SOA0068 |

341. HSPC330 mRNA(=HSPC016) AF161448.1 14

| | | | | | | |
|---|---|---|---|---|---|---|
| fcrb1888 | hfcr0240 | hfcr4067 | ncr2059 | ncrb7599 | seob3875 | seob6067 |
| fcrb2719 | hfcr2635 | ncr1733 | ncr3556 | seoa7837a | seob4169 | seob7037 |

342. syndecan binding protein (syntenin) (SDCBP)(ORF) = AF000652.1 NM_005625.1 14

| | | | | | | |
|---|---|---|---|---|---|---|
| FCR2042 | MIOA3620a | MIOA9097 | miob2839n | ncr6939 | ncrb4505 | SEOA9383 |
| FCR2427 | MIOA3671a | MIOB2606 | ncr4115 | ncr7354 | ncrc5417 | seob4008 |

343. triosephosphate isomerase (TPI1) M10036 14

| | | | | | | |
|---|---|---|---|---|---|---|
| BFCS0054 | FCR0163 | fcrb0241 | hfcr0774 | MIOA7123a | ncr7776 | ncrb3431 |
| BFCS0420 | FCR4704 | fcrb1261 | hfcr3496 | ncr2105 | ncrb2857 | ncrb3988 |

344. transcription elongation factor Bpolypeptide 1-like (RefSeq aa 8e-72) NP_003188.1 14

| | | | | | | |
|---|---|---|---|---|---|---|
| ncr1480 | ncr2397 | ncr7565 | ncrb3532 | ncrc1883 | ncrc3358 | ncrc9332 |
| ncr1720 | ncr2805 | ncr8305 | ncrc1877 | ncrc2475 | ncrc7196 | |

345. heat shock 70kD protein 10 (HSC71) (HSPA10) NM_006597.1 13

| | | | | | | |
|---|---|---|---|---|---|---|
| ncrc3867 | hfcr5148 | ncr1798 | ncr9949 | ncrb7512 | seoa8132 | SEOA4092 |
| ncrc4108 | miob0188 | ncr2528 | ncrb4368 | seoa8016 | seob4292 | |

Figure 6A – EST Names Corresponding to Unique Known Genes of Figure 6

346. transmembrane protein (CD59) M84349.1 13

FCR2333 ncr2042 ncrc5429 ncrc6795 SEOA7603a SEOA9654 seob3884
ncr0236 ncrb1165 ncrc6553 SEOA3563a SEOA8701 SEOB1555

347. hfcr4485chloride intracellular channel 4 like (CLIC4L) NM_013943.1 13

MIOA8910 miob3235 ncr7412 ncrb1849 ncrb5798 seob3838
mioa9483 ncr1808 ncr7528 ncrb2510 seob3668 seob5252

348. phenylalkylamine binding protein gene AF196969.1 13

FCR2647 hfcr4215 miob1300 miob3982 miob6402 ncr2512 SEOB0406
hfcr2986 mioa9636 miob2538 miob5462 miob6718 ncr4972

349. collagenase type IVJ03210 13

FCR0355 FCR3441 FCR4854 hfcr2294 hfcr9228 ncrc3432 SEOA0130
FCR1534 FCR3539 hfcr0037 hfcr8964 hfcr9946 ncrc3882

350. "calnexin (CANX) integral membrane protein, calnexin, (IP90) "M94859 13

MIOA6162a ncr6614 ncrb1367 SEOA0869 SEOA4420a SEOA9949 seob5341
miob6612 ncrb1142 ncrb2157 SEOA1989 SEOA7415a seob4255

351. actin binding protein ABP620 AB029290.1 13

FCR1348 FCR3355 ncr3194 ncrb0124 ncrc5929 SEOA2658 SOA0569
FCR1900N MIOA8740 ncr4577 ncrb0911 SEOA0184a SEOB3191

352. peripheral myelin protein 22 M94048 13 hfcr0969 hfcr3059 hfcr5497 MIOA3290a ncr2264 ncrc2363 seoa4963a
hfcr2787 hfcr3682 MIOA1470 MIOA5176a ncrc0314 ncrc2627

353. syntaxin 4 binding protein UNC-18c (UNC-18c) AF032922.1 13

FCR7201 hfcr0295 hfcr0772 hfcr3830 hfcr4111 miob4441 SEOA4380a
fcrb0289 hfcr0395 hfcr1250 hfcr4000 hfcr4115 SEOA2626

354. CGI-110 protein AF151868.1 13 fcrb1776 miob4563 ncr5234 ncrc1717 SEOA7339a SEOB1648 seob6261
MIOA5710 ncr2898 ncrb0381 SEOA3748a SEOA9793 seob5117

355. HSPC163 AF161512 13

MIOA5738a MIOB2099 ncrc3860 SEOA2928a SEOA7936a SEOA8913 seob6440
MIOA8029a miob4040 ncrc6931 seoa6936 SEOA8398a seob5818

356. sin3 associated polypeptide (SAP18) AF153608 13

FCR3825 hfcr9011 MIOA5075a miob4559 ncr8336 ncrb4084 seob8035
FCR4035 MIOA3802 MIOA5712 ncr5807 ncrb1672 seob4419

357. "TPT1 gene for translationally controlled tumor protein (TCTP), exons 1-6 "AJ400717.1 13 hfcr0599 ncr0604 ncrb0687 ncrb6164 ncrb8494 ncrc4170 SEOA9701
hfcr3810 ncr5164 ncrb0952 ncrb8101 ncrc0138 ncrc8984

Figure 6A - EST Names Corresponding to Unique Known Genes of Figure 6

358. ribosomal protein S15 (RPS15) (=insulinoma rig-analog encoding DNA-binding protein mRNA) NM_001018.1 13

| | | | | | | |
|---|---|---|---|---|---|---|
| BFCN0261 | FCR3376 | FCR4979 | FCR7585 | hfcr0265 | hfcr9648 | ncrc9050 |
| FCR0773 | FCR4474 | FCR6413 | fcrb0599 | hfcr0855 | ncrc5329 | |

359. ribosomal protein S26 NM_001029.1 13

| | | | | | | |
|---|---|---|---|---|---|---|
| CR0144 | FCR5838 | hfcr0998 | hfcr8913 | ncr8817 | ncrb7370 | ncrc5524 |
| FCR5835 | fcrb1728 | hfcr3880 | ncr3357 | ncrb3875 | ncrb8503 | |

360. pre-mRNA splicing factor (SFRS3) AF107405.1 13

| | | | | | | |
|---|---|---|---|---|---|---|
| hfcr6649 | hfcr9687 | MIOA6587a | ncr5614 | SEOA1065a | SEOB1333 | seob6325 |
| hfcr7969 | MIOA2789a | ncr4018 | ncrb1089 | SEOA7438a | seob4889 | |

361. thrombospondin 1 (THBS1) NM_003246.1 13

| | | | | | | |
|---|---|---|---|---|---|---|
| FCR1938 | FCR4904 | hfcr3776 | MIOA3306a | miob1337 | ncrc1989 | SEOB1572 |
| FCR2322 | hfcr3694 | MIOA1849a | MIOA7230a | miob4729 | ncrc3235 | |

362. insulin-like growth factor binding protein 5 (IGFBP5) geneL27556.1 13

| | | | | | | |
|---|---|---|---|---|---|---|
| BFCS0531 | fcrb2284 | hfcr0163 | miob3679 | ncr2186 | ncrb7583 | SEOA2999a |
| FCR4401 | hfcr0067 | hfcr5815 | ncr0212 | ncrb6251 | ncrc9365 | |

363. "fibroblast activation protein, alpha; seprase (FAP) "NM_004460.1 13

| | | | | | | |
|---|---|---|---|---|---|---|
| BFCS0081 | ncr7976 | ncrb8430 | ncrc4864 | SEOA0379 | SEOA9349 | seob7378 |
| hfcr6348 | ncrb4216 | ncrc4637 | ncrc5644 | SEOA0418 | seob6762 | |

364. thymosin beta-10 S54005 13

| | | | | | | |
|---|---|---|---|---|---|---|
| BFCN0192 | BFCS0498 | FCR7015 | hfcr1651 | hfcr6708 | miob5040 | seob2594 |
| BFCS0260 | FCR0901 | fcrb1755 | hfcr5138 | miob2952 | SEOA9445 | |

365. HSPC005 (=C11orf10)AF070661 13

| | | | | | | |
|---|---|---|---|---|---|---|
| miob2949 | SEOA0838 | SEOA7508a | SEOB1851 | SEOB3550 | seob5321 | seob8099 |
| ncr3751 | SEOA5845 | SEOA9282 | SEOB3304 | seob3671 | seob7871 | |

366. Chaperonin (hsp60 gene) AJ249625.1 13

| | | | | | | |
|---|---|---|---|---|---|---|
| FCR3042 | hfcr0048 | hfcr0617 | hfcr0740 | hfcr0913 | hfcr1382 | hfcr4080 |
| FCR3101 | hfcr0056 | hfcr0619 | hfcr0801 | hfcr1043 | hfcr3915 | SEOA8776 |

367. HS1 protein (=YWHAQ)X57347 13

| | | | | | | |
|---|---|---|---|---|---|---|
| hfcr1164 | miob3075 | ncrb2474 | ncrc2895 | SEOA3467a | SEOB1575 | seob6736 |
| MIOA6703a | ncr2931 | ncrb8416 | SEOA3219 | SEOA4083 | seob5521 | |

368. electron transfer flavoprotein alpha-subunit J04058.1 13

| | | | | | | |
|---|---|---|---|---|---|---|
| HFCR3110 | ncr2474 | ncrb1083 | ncrb5146 | ncrc1288 | ncrc9056 | ncrc9148 |
| ncr0832 | ncrb0363 | ncrb1888 | ncrc0647 | ncrc6380 | ncrc9082 | |

369. "integrin, beta 1(fibronectin receptor, beta polypeptide, antigen CD29 includes MDF2, MSK12) (ITGB1), mRNA " NM_002211.1 13

| | | | | | | |
|---|---|---|---|---|---|---|
| ncrb8189 | SEOA8715 | seob5191 | seob4014 | seob4875 | miob3079 | ncrb3229 |
| ncrc1083 | SEOB0137 | mioa9237 | seoa7845a | miob0717 | ncr8569 | |

Figure 6A – EST Names Corresponding to Unique Known Genes of Figure 6

370. "Fritz mRNA, complete cds "U91903.1 13

| | | | | | | |
|---|---|---|---|---|---|---|
| ncrc6687 | hfcr1679 | MIOA0833a | ncr2567 | ncrb4792 | ncrb7677 | ncrc2638 |
| fcrb2710 | MIOA0224a | MIOA7285 | ncrb3850 | ncrb5984 | ncrc0145 | |

371. heterogeneous nuclear ribonucleoprotein K (HNRPK) NM_002140.1 12

| | | | | | |
|---|---|---|---|---|---|
| fcrb1262 | hfcr1844 | hfcr3761 | mioa7636a | miob6560 | SEOA9424 |
| hfcr0751 | hfcr3650 | MIOA0039a | MIOA9095 | SEOA8679 | seob8004 |

372. heat shock 90kD protein 1 beta (HSPCB) NM_007355.1 12

| | | | | | |
|---|---|---|---|---|---|
| hfcr0495 | hfcr3515 | hfcr7576 | MIOA3880a | miob6886 | ncrb7400 |
| hfcr2686 | hfcr5772 | hfcr9685 | MIOA8974 | ncr1628 | ncrc4020 |

373. insulin-like growth factor binding protein 7 (IGFBP7) 4504618 12

| | | | | | |
|---|---|---|---|---|---|
| MIOA0182 | MIOA6745a | miob3745 | ncrc8954 | SEOA1183A | seob6586 |
| MIOA2144 | MIOB1561 | ncrc5415 | SEOA0416 | SEOA5155a | seob7545 |

374. hypoxia-inducible factor 1 alpha (HIF-1 alpha) U22431 12

| | | | | | |
|---|---|---|---|---|---|
| MIOA0603a | MIOA7154a | miob0140 | ncrb6740 | SEOA1466a | SEOB0350 |
| mioa3898a | MIOA7541a | miob3753 | ncrc3656 | SEOA3639a | SEOB1224 |

375. growth arrest-specific 1 (GAS1) NM_002048.1 12

| | | | | | |
|---|---|---|---|---|---|
| MIOA5990a | miob1739 | miob5798 | ncrb5201 | seob1347n | seob4339 |
| miob1147 | miob4166 | ncr3800 | SEOA8389a | SEOB3074 | seob8015 |

376. lactate dehydrogenase B (LDH-B) Y00711 12

| | | | | | |
|---|---|---|---|---|---|
| FCR0225 | fcrb1042 | ncr3885 | ncrb0728 | ncrb3542 | SEOA6560a |
| FCR0518 | MIOB2861 | ncr9600 | ncrb2465 | ncrc6273 | seob5680 |

377. sterol carrier protein 2 S52450 12

| | | | | | |
|---|---|---|---|---|---|
| MIOA1913a | MIOA5681 | miob3137 | ncrb6820 | ncrc7097 | seoa4895a |
| MIOA4816a | mioa9798 | miob5709 | ncrc2280 | SEOA4301a | SEOB1877 |

378. mitochondrial proteolipid 68MP homolog (PLPM) NM_004894.1 12

| | | | | | | |
|---|---|---|---|---|---|---|
| hfcr7596 | MIOA5789a | miob3767 | ncr7075 | SEOA2669 | SEOA9152 | seob7484 |
| MIOA5119a | MIOA7530a | ncr1800 | ncrb1731 | SEOA8959 | SEOA9889 | |

379. hepatitis B virus X interacting protein (XIP) AF029890 12

| | | | | | |
|---|---|---|---|---|---|
| FCR3841 | MIOA6150a | ncr0149 | ncrc2441 | SEOA6547a | SEOB1344 |
| MIOA3945a | miob3312 | ncrb0651 | SEOA6122a | SEOA9098 | SEOB3428 |

380. nicotinamide N-methyltransferase (NNMT) U08021 12

| | | | | | |
|---|---|---|---|---|---|
| MIOA4755 | ncr3954 | ncr8431 | ncrb8284 | ncrc1280 | SEOB0864a |
| ncr0597 | ncr7303 | ncrb6904 | ncrc1241 | SEOA3223 | seob5789 |

381. ATP synthase epsilon chain AF077045.1 12

| | | | | | |
|---|---|---|---|---|---|
| FCR4880 | MIOA4312a | SEOA1308 | SEOA2478 | SEOA6053a | SEOA8387a |
| MIOA2871a | MIOA5667 | SEOA2409 | SEOA2908a | SEOA6198a | SEOB2195 |

Figure 6A – EST Names Corresponding to Unique Known Genes of Figure 6

382. cytochrome c oxidase subunit VIIa (COX7A) muscle isoform M83186 12

| | | | | | |
|---|---|---|---|---|---|
| MIOA2493a | ncr3706 | SEOA4885a | SEOB0876a | SEOB1416 | seob6384 |
| miob5066 | SEOA4329a | SEOB0748 | SEOB1071 | seob5208 | seob8323 |

383. DEK oncogene (DNA binding) (DEK) gi4503248 12

| | | | | | |
|---|---|---|---|---|---|
| FCR0339 | hfcr2790 | hfcr9463 | MIOA3237a | ncr5875 | SEOB1007 |
| FCR7054 | hfcr6686 | MIOA0472 | MIOA4215 | SEOB0471 | seob6348 |

384. hypoxia-inducible gene 1 (HIG1) (=HSPC010) AF145385.1 12

| | | | | | |
|---|---|---|---|---|---|
| hfcr0150 | MIOA5613a | MIOA5941a | mioa9550 | miob1969 | SEOA9012 |
| MIOA1954a | MIOA5768a | mioa9187 | miob1879 | SEOA3504a | seob5528 |

385. activated RNA polymerase (PC4)NM_006713.1 12

| | | | | | |
|---|---|---|---|---|---|
| hfcr9414 | miob1183 | ncr3435 | ncrc7012 | SEOA8877 | SEOA9897 |
| MIOB0554 | MIOB2342 | ncrc0222 | seoa7984 | SEOA9111 | seob4098 |

386. breast carcinoma amplified sequence 2 (BCAS2) NM_005872.1 12

| | | | | | |
|---|---|---|---|---|---|
| MIOA5124a | MIOA5507a | miob0819 | miob4064 | SEOA5065a | SEOA5806 |
| MIOA5126a | mioa9919 | MIOB2617 | miob6601 | SEOA5748a | seob6450 |

387. enhancer-of-split and hairy-related protein 1 (SHARP-1) AF009329.1 12

| | | | | | |
|---|---|---|---|---|---|
| miob4684 | ncr6729 | ncr9492 | ncrc0160 | ncrc2142 | ncrc4240 |
| ncr1486 | ncr8183 | ncrb0726 | ncrc2140 | ncrc2583 | SEOB2671 |

388. BCL2/adenovirus E1B 19kD-interacting protein 3 (BNIP3) U15174 12

| | | | | |
|---|---|---|---|---|
| fcrb2181 | hfcr5556 | ncr6328 | SEOA2875 | SEOB1998 |
| hfcr4449 | ncr5697 | ncrb5526 | SEOA5387 | seob5618 |

389. protein tyrosine phosphatase (hR-PTPu) X58288 12

| | | | | | |
|---|---|---|---|---|---|
| FCR2920 | FCR5885 | MIOA1520 | ncr3398 | ncrc1247 | SEOA3322a |
| FCR5337 | fcrb1962 | miob4108 | ncrb5871 | SEOA1567 | SEOA3324a |

390. "TRPM-2, cytosolic epoxide hydrolase, nicotinic acetylcholine receptor alpha2 subunit, and focal adhesion kinase genes "AF311103.1 12

| | | | | | |
|---|---|---|---|---|---|
| MIOA7452a | ncr7028 | ncrb1939 | ncrb4627 | ncrb7915 | ncrc5182 |
| ncr2160 | ncr8289 | ncrb1988 | ncrb7679 | ncrc0149 | ncrc8836 |

391. colon carcinoma laminin-binding protein (=RIBOSOMAL PROTEIN SA (P40) )J03799.1 12

| | | | | | |
|---|---|---|---|---|---|
| BFCW0145 | FCR2185 | FCR4902 | FCR5915 | fcrb1190 | MIOA6326a |
| FCR1495N | FCR3371 | FCR5901 | FCR7681 | fcrb2256 | seob7177 |

392. alpha E-catenin (CTNNA1) gene AF102803.1 12

| | | | | | |
|---|---|---|---|---|---|
| FCR2472 | hfcr8861 | miob4276 | ncr4127 | SEOA3989a | SEOA9438 |
| FCR5779 | MIOA7108a | ncr3682 | ncr6932 | SEOA8177a | seob2335 |

393. Clk-associated RS cyclophilin CARS-Cyp U40763 12

| | | | | | |
|---|---|---|---|---|---|
| MIOA1457 | MIOA2993a | miob4354 | ncrb0670 | SEOA0863 | SEOB0469 |
| MIOA1734 | miob0841 | ncr5843 | ncrb2626 | SEOA6363 | seob5220 |

Figure 6A – EST Names Corresponding to Unique Known Genes of Figure 6

394. suppression of tumorigenicity 13 (Hsp70-interacting protein) (ST13) NM_003932.1 12

| | | | | | |
|---|---|---|---|---|---|
| hfcr0952 | ncr6902 | ncrc0583 | ncrc4561 | SEOB0964 | seob5241 |
| hfcr2718 | ncr8215 | ncrc1533 | ncrc5276 | SEOB3244 | |

395. cytochrome c oxidase subunit VIIa polypeptide 2 like (COX7A2L) NM_004718.1 12

| | | | | | |
|---|---|---|---|---|---|
| hfcr6880 | miob6860 | ncr7259 | ncrc0817 | SEOB3431 | seob6161 |
| mioa7706a | ncr2971 | ncr9722 | SEOB0923 | seob4178 | SOA0565 |

396. cyclin M74091 12

| | | | | | |
|---|---|---|---|---|---|
| BFCN0266 | FCR7261 | MIOA0241a | seoa0499m | SEOB0404 | seob5777 |
| FCR2682N | hfcr2989 | ncrb8392 | SEOA1056a | seob4422 | seob6245 |

397. NADH dehydrogenase subunit 2 (ND2) AF014897.2 12

| | | | | | |
|---|---|---|---|---|---|
| FCR7621 | MIOA6662a | ncrb6869 | SEOA0409 | SEOA1279a | SEOA3371a |
| hfcr6020 | ncrb6062 | ncrc3708 | SEOA0481 | SEOA1973a | SEOA3547a |

398. "ATP synthase, H transporting,mitochondrial (RefSeq aa 1e-50) "NP_001676.1 12

| | | | | | |
|---|---|---|---|---|---|
| ncr0832 | ncrb0363 | ncrb1888 | ncrc0647 | ncrc6380 | ncrc9082 |
| ncr2474 | ncrb1083 | ncrb5146 | ncrc1288 | ncrc9056 | ncrc9148 |

399. nuclear protein SDK3 (=MEMA)Y10351 12

| | | | | | |
|---|---|---|---|---|---|
| FCR0707 | fcrb0353 | HFCR3146 | ncr0660 | ncr6593 | SEOA2326a |
| FCR1426 | hfcr1637 | hfcr9206 | ncr1920 | ncrb8214 | SEOB2739 |

400. 15 kDa selenoprotein (SEP15)AF051894 12

| | | | | | |
|---|---|---|---|---|---|
| MIOA195 | MIOA6180a | SEOB3179 | seoa4940a | ncr0420 | SEOA4853a |
| FCR6830 | SEOA7540a | mioa0509 | seoa7871a | ncrb0814 | SEOB1638 |

401. eukaryotic translation elongation factor 1 gamma (EEF1G) NM_001404.1 11

| | | | | | |
|---|---|---|---|---|---|
| hfcr2557 | hfcr5010 | hfcr6590 | ncr6705 | ncrc3650 | seoa8014 |
| hfcr3408 | hfcr6570 | hfcr6853 | ncr7493 | SEOA5795 | |

402. transmembrane protein (p63)X69910 11

| | | | | | |
|---|---|---|---|---|---|
| BFCN0138 | FCR1353 | FCR7158 | hfcr2704 | MIOA0878a | SEOA0166a |
| FCR0881 | FCR1509 | hfcr1356 | hfcr6370 | ncrb7028 | |

403. "clathrin, heavy polypeptide-like 2 (CLTCL2) (=KIAA0034) "NM_004859.1 11

| | | | | | |
|---|---|---|---|---|---|
| FCR7110 | hfcr5482 | SEOA2832 | SEOA9443 | seob6028 | seob7702 |
| hfcr0645 | SEOA2237a | SEOA8296 | seob4053 | seob6599 | |

404. extracellular matrix protein AB011792 11

| | | | | | |
|---|---|---|---|---|---|
| MIOA2065 | MIOB1515 | miob6658 | SEOA4536 | SEOA8914 | seob1044 |
| MIOA7588a | miob6616 | ncrb2008 | SEOA7366a | SEOB0985 | |

405. mesoderm specific transcript (mouse) homolog (MEST) NM_002402.1 11

| | | | | | | |
|---|---|---|---|---|---|---|
| BFCN0024 | fcrb0367 | hfcr0635 | hfcr2868 | hfcr7711 | hfcr8189 | ncrb5171 |
| CR0995 | fcrb2221 | hfcr2678 | hfcr6331 | hfcr7824 | hfcr8438 | |

Figure 6A – EST Names Corresponding to Unique Known Genes of Figure 6

406. KIAA0728 AB018271.1 11

MIOA3589 a MIOA8647 MIOA8775 SEOA0308 SEOA8567
MIOA7326 MIOA8675 mioa9927 SEOA2922a SEOA9461

407. ADP/ATP translocase J03592 11 ncrc6219 FCR0529 hfcr6003 hfcr7352 ncrb1143 ncrc5156
ncrc5690 FCR1979 hfcr6806 ncr8840 ncrb4275

408. UDP-glucose dehydrogenase (UGDH) AF061016 11 fcrb2127 MIOA1608a mioa9188 ncrc5802 seoa0343m seob5608
hfcr8759 MIOA9041 miob4237 ncrc9871 SEOA9556

409. "protein phosphatase 2 (formerly 2A), catalytic subunit, alpha isoform (PPP2CA) "NM_002715.1 11 fcrb1134 HFCR2381 mioa3115an miob7006 ncr5363 ncrc1624 SEOA8973
fcrb1963 hfcr6350 miob1757 ncr4735 ncrb6870 SEOA4626a 410. "protein C inhibitor [human, leukocytes, Genomic, 1402 nt, segment 5 of 5] "S69366.1 11 hfcr3465 ncr0429 ncr2174 ncrb5531 SEOA2955a SEOB0695a
miob4855 ncr0429 ncrb4919 ncrc5655 SEOA3799a 411. ribophorin II (RPN2) Y00282 11

FCR4984 fcrb0657 hfcr3783 hfcr6196 ncrb8779 seob5724
FCR7138 hfcr3424 hfcr6013 ncrb0908 ncrc3753

412. ubiquitin-conjugating enzyme E2B (RAD6 homolog) (UBE2B) NM_003337.1 11

FCR6968 miob0578 ncr0613 ncrb1221 ncrb4008
MIOA4635a ncr0613 ncrb0276 ncrb2399 SEOB2171

413. ERF-1 X79067.1 11

CR0906 hfcr9738 ncrc9385 SEOA2917a SEOB3385 seob5452
FCR6901 ncr0644 SEOA1455a SEOA6169a seob4150

414. zinc finger transCRiption factor GKLF AF105036.1 11

MIOA3760a miob0453 ncr6403 ncrb1729 ncrb4528 ncrc9808 seob6490

415. GABA(A) receptor-associated protein (GABARAP) NM_007278.1 11 fcrb1695 hfcr6884 hfcr9432 ncrb7119 SEOB2081 seob8081
hfcr6729 hfcr7370 ncr9828 ncrc6747 SEOB2104

416. titin (TTN) gene CAA49245.1 11

FCR0499 FCR5534 hfcr6093 MIOA8863 SEOA4869a SEOA8910
FCR2596 FCR6432 MIOA4234 ncrb4960 seoa8101

417. epidermal growth factor receptor kinase substrate (Eps8) U12535 11 fcrb1872 MIOA1201 MIOA4808a ncr6937 SEOA4469a SEOB0882a
MIOA0693 MIOA2792a miob0990 ncrb5095 SEOA5575a Figure 6A – EST Names Corresponding to Unique Known Genes of Figure 6

418. FRG1 L76159 11

MIOA6784a SEOA3640a hfcr1853 ncrb2291 ncr6852
SEOA1873a seob4930 miob6153 ncrb1068 seoa3167m 419. E25B protein U76253 11

FCR0217 FCR2239 FCR2511 FCR5801 FCR6983 MIOA0857a
FCR2117 FCR2287 FCR4052 FCR6929 FCR7277

420. transCRiption factor BTF 3 X74070 11

FCR1704 fcrb0272 hfcr2234 MIOA2119 SEOA3555a SOA0021
FCR3732 fcrb1093 hfcr6397 ncrc4193 seob6890

421. transmembrane glycoprotein (GPNMB) X76534 11

MIOA3399a miob4678 ncr3485 SEOA1246A SEOA3036a seob6227
miob3330 miob5777 ncrb4997 SEOA2740 SEOB2060

422. profilin II L10678.1 11 ncrc5357 FCR2109 hfcr8624 ncrb7680 SEOB0325 seob6303
ncrc5350 FCR6090 miob5440 SEOB0325 SEOB2002

423. calreticulin (CALR) M84739 11

FCR0725 FCR1394 FCR7051 hfcr7494 ncrc4798 seob4731
FCR1173 FCR1823 hfcr6791 ncr2516 seoa0010m 424. ADP-ribosylation factor 1 M84326.1 11

CR0077 FCR1252 hfcr2772 hfcr7510 MIOA2898a ncrb4497
CR0311 fcrb1341 hfcr7361 MIOA2560a miob4593

425. 16.7Kd protein AF078845.1 11 fcrb0336 hfcr6732 miob5108 ncrb1288 SEOA2829 seob5750
hfcr3798 MIOA0132 ncr1427 ncrb5245 SEOB0808a 426. KIAA1247 AB033073.1 11
SEOB3220 ncrb7995 ncrc0060 ncrb1281 miob4798 seoa7776a
seob4939 ncrb2014 seoa8102 miob4746 ncr9102

427. peroxiredoxin 1 (PRDX1) (=NKEFA) NM_002574.1 11 ncrc3471 ncr5721 ncrb3579 ncrc0249 hfcr8786 SEOB3098
FCR6941 ncrb0368 ncrb7886 hfcr2783 miob3468

428. "poly(A)-binding protein, cytoplasmic 1 (PABPC1) "NM_002568.1 11 ncrc6635 ncrb3185 seob5908 hfcr9288 seob7555 SEOA2058
SEOA8468 ncrb6910 seob6202 fcrb1942 seoa2058n 429. tyrosine 3-monooxygenase/tryptophan 5-monooxygenase activation protein, theta polypeptide (YWHAQ) "NM_006826.1
11
ncr2931 hfcr6130 ncrb8416 seob6736 miob3075 ncrb2474
hfcr2237 SEOB1575 seob5521 SEOA3467a hfcr1164

Figure 6A – EST Names Corresponding to Unique Known Genes of Figure 6

430. myosin light chain 3 non-muscle (MLC3nm) M31212 10 hfcr2213 MIOA3051a MIOA3334a MIOB2174 SEOA1364 SEOA6199a SEOA6397 SEOA6604a SEOA7112a 431. Lsm3 protein AJ238095.1 10 mioa0741m ncr5137 ncrb6036 SEOA7286a seob5389
MIOA3289a ncrb1203 ncrc2240 seob2556 seob8030

432. "CD164 antigen, sialomucin (CD164) "NM_006016.1 10 fcrb1826 ncrb1665 ncrc2268 seoa7036 SEOA8770 seob4040
miob2905 ncrc0020 ncrc6819 SEOA7109a SEOB0595

433. collagen type XVI collagen alpha 1 (COL16A1) S57132.1 10

FCR2199 FCR7264 hfcr5718 hfcr7042 hfcr9095
FCR5660 hfcr0053 hfcr6204 hfcr7659 hfcr9497

434. SET translocation (myeloid leukemia-associated) (SET) =M93651 NM_003011.1 10 hfcr0401 MIOA0230a ncr4100 SEOA1477 seoa7738a
hfcr2673 MIOA5576a ncr8300 SEOA1654a SEOA8677

435. myloid-beta protein (APP) M33112.110 mioa9979a miob5608 ncrb5060 SEOA0978 SEOB0612
miob4923 ncrb2598 ncrb7184 SEOA4840a seob6030

436. vesicle docking protein p115 (P115) NM_003715.1 10

MIOA3774 MIOA3950a ncrb8653 SEOA3389a seob5337
MIOA3820 MIOB1552 ncrc9202 seob4058 seob8173

437. "hereditary haemochromatosis region, histone 2A-like protein gene, hereditary haemochromatosis (HLA-H) gene, RoRet gene, and sodium phosphate transporter (NPT3) gene, complete cds (=H4 histone ) "U91328.1 10

MIOA6860a miob6810 ncr9508 SEOA9196 SEOB3101
miob6462 ncr9038 ncrb4405 SEOB2709 seob5891

438. cell cycle progression 8 protein (CPR8)(ORF)=AF011794 NM_004748.1 10 miob0822 ncr6004 SEOA4460a seob5776 seob7569
miob4330 ncrb2939 seob4894 seob7167 SOA0471

439. KIAA0438 AB007898.1 10

FCR6408 miob1296 ncr1347 ncrc0544 SEOB2994
MIOA2068 ncr1161 ncr8905 SEOA9249 seob7431

440. actin, alpha, cardiac muscle "NP_005150.1 10 hfcr0046 ncr0287 ncr8053 ncrb3944 ncrc2893
hfcr3820 ncr2635 ncrb3585 ncrb8314 ncrc3564

441. GAP-associated tyrosine phosphoprotein p62 (Sam68) (SAM68) (=p62) NM_006559.1 10 fcrb1633 miob6430 ncrc1099 ncrc5184 SEOA5333a
HFCR3200 ncrb2174 ncrc1836 SEOA5331a SOA0445

Figure 6A – EST Names Corresponding to Unique Known Genes of Figure 6

442. sphingolipid activator protein 1 J03015 10

FCR7349 hfcr9348 MIOA1408a SEOA2418a seob6722
hfcr0602 hfcr9582 ncrc2060 seob4670 seob7354

443. "transcription elongation factor A (SII), 1 (TCEA1) "NM_006756.1 10

MIOA5194a ncrc5961 SEOA1623a seoa4102an seob4855 seob6112

444. nuclear pore complex interacting protein (NPIP) AF132984.1 10 hfcr1964 ncr3945 ncr9327 ncrb4262 ncrb6295
ncr1009 ncr7884 ncrb1406 ncrb5333 ncrc1279

445. ganglioside expression factor 2 (GEF-2) NM_007285.1 10 hfcr3627 ncrb1310 ncrc6693 SEOA9183 SEOB1173
miob6881 ncrb6571 SEOA3391a SEOA9809 SEOB1236

446. Down syndrome candidate region 1 (DSCR1) NM_004414.2 10 hfcr7398 ncr8456 SEOA1248A seob5168 seob5500
MIOB2263 ncrb4080 seoa6971 seob5383 seob7052

447. S164 (=AC004858 U1 small ribonucleoprotein 1SNRP homologue) AF109907 10 hfcr1142 MIOA3915a ncrb4859 ncrc3300 SEOA4391a
MIOA3717a MIOA5193a ncrc0819 SEOA1429a seob6832

448. proline-rich protein with nuclear targeting signal (B4-2) NM_006813.1 10 mioa3816 n MIOA9107 miob3358 ncrb2712 SEOA9943
mioa7798a miob1918 ncr9124 ncrc3319 SEOB1152

449. PAPS synthetase-2 (PAPSS2) AF074331.1 10 hfcr5974 MIOA7506a ncr1495 ncrc5328 SEOA9469
hfcr8446 miob4104 ncrb6432 SEOA6390 seob7696

450. RIBOSOMAL PROTEIN SA (P40) spP08865 10

BFCW0145 FCR2185 FCR4902 FCR5915 MIOA6326a
FCR1495N FCR3371 FCR5901 FCR7681 seob7177

451. ataxia telangiectasia (ATM) gene U82828.1 10 miob1883 ncr1491 ncr9171 ncrc0220 seob4846
miob3905 ncr4946 ncrb5211 seob3726 seob5131

452. ARP2/3 protein complex subunit p21 (ARC21=AF006086 (ORF) NM_005719.1 10
hfcr6039 MIOA1940a miob1825 miob6279 SEOA4107a
MIOA1830a MIOA7630a miob5687 ncrb2955 SEOA4673a

453. HSPC297 (=HSPC030) AF161415.1 10 mioa1436n MIOA2987a ncrc6495 SEOA6495a SEOB0207
MIOA1880a MIOA4074a SEOA6494a SEOA8693 seob7370

Figure 6A – EST Names Corresponding to Unique Known Genes of Figure 6

454. NS1-binding protein (NS1-BP) (=AB020657 KIAA0850) AJ012449 10

| | | | | |
|---|---|---|---|---|
| FCR3736 | MIOA3066a | MIOA5587a | MIOB2297 | SEOA6481a |
| MIOA2652a | MIOA4407 | miob1821 | ncrb3245 | SOA0391 |

455. dioxin-inducible cytochrome P450 (CYP1B1) U03688.1 10

| | | | | |
|---|---|---|---|---|
| MIOA8103 | mioa9742 | ncr5812 | ncrb6245 | ncrc8949 |
| mioa9439 | ncr1433 | ncr9175 | ncrb6403 | SEOB1836 |

456. WSB-1 isoform AF106684.1 10

| | | | | |
|---|---|---|---|---|
| FCR4477 | hfcr3563 | ncr1210 | ncrc0183 | ncrc5720 |
| hfcr2731 | miob4059 | ncr5549 | ncrc1665 | seob5048 |

457. protein disulfide isomerase-related protein (P5)= D49489 NM_005742.1 10

| | | | | |
|---|---|---|---|---|
| FCR5687 | MIOA1009 | mioa9314 | miob6521 | seob2569 |
| fcrb0402 | MIOA8219 | miob0838 | SEOA7535a | seob5742 |

458. membrane protein CH1 (CH1) AB020980 10

| | | | | |
|---|---|---|---|---|
| FCR5663 | FCR7710 | ncr0679 | ncr5960 | ncrc4048 |
| FCR5800 | MIOA0535n | ncr2291 | ncrb2053 | ncrc9869 |

459. sema domain immunoglobulin domain (Ig)(semaphorin) 3E (SEMA3E)(= KIAA0331) NM_012431.1 10

| | | | | |
|---|---|---|---|---|
| fcrb2690 | mioa9802 | miob4091 | ncrb2375 | seoa7819a |
| MIOA8348 | miob1135 | ncr0153 | ncrc6652 | SOA0623 |

460. heat shock J2 protein (HSJ2) AF075601.1 10

| | | | | |
|---|---|---|---|---|
| SEOA1762 a | miob4232 | seoa9125 | miob2219 | mioa0701 |
| hfcr8761 | seob2531 | mioa7231a | seoa1762a | hfcr9312 |

461. T245 protein (T245) =TM4SF6=TM4-DAF043906 10

| | | | | |
|---|---|---|---|---|
| SEOA0457 | ncr1475 | ncrc0994 | SEOA0207a | seob7047 |
| FCR4382 | ncr9639 | ncrc5162 | SEOB0279 | SOA0692 |

462. Inositol polyphosphate 1-phosphatase gene (INPP1) (low match) AF141324.1 10

| | | | | |
|---|---|---|---|---|
| SEOA3560a | MIOA3768 | ncrb0417 | SEOA8586 | SEOB1292 |
| hfcr0944 | MIOA5612a | SEOA5807 | SEOA9651 | SEOB2051 |

463. RAN, member RAS oncogene family (RAN), mRNA /cds=(114,764) /gb=NM_006325 /gi=6042206 /ug=Hs.10842 /len=1656 "Hs.10842 10

| | | | | |
|---|---|---|---|---|
| seoa6972" | FCR6517 | SEOA1302a | SEOB1907 | seob4485 |
| FCR3367 | ncrb6319 | SEOA2183a | SEOB1974 | seob5296 |

464. HSPC016, mRNA /cds=(38,232) /gb=NM_015933 /gi=7705430 /ug=Hs.171774 /len=384 "Hs.171774 10

| | | | | |
|---|---|---|---|---|
| seoa7837a | hfcr0240 | hfcr4067 | seob6067 | seob3875 |
| fcrb1888 | hfcr2635 | ncr2059 | seob4169 | ncr1733 |

465. "JKTBP2, JKTBP1, complete cds "AB017018.1 10

| | | | | |
|---|---|---|---|---|
| ncrc5500 | ncrb4595 | FCR4753 | MIOA2760a | ncrc2647 |
| fcrb1002 | MIOA6588a | ncr4370 | SEOB3312 | ncr140 |

Figure 6A – EST Names Corresponding to Unique Known Genes of Figure 6

| | | | | |
|---|---|---|---|---|
| 466 | ncr1765 | ribosomal 18S, 58S, and 28S (=45S pre rRNA gene) | V01270.1 | 9 |
| | ncr1824 | | | |
| | ncr9627 | | | |
| | ncrb0438 | | | |
| | ncrb3815 | | | |
| | ncrb5491 | | | |
| | ncrb6511 | | | |
| | ncrb7610 | | | |
| | ncrc5255 | | | |
| 467 | mioa9615 | SEC24 (S. cerevisiae)related gene family, member D (SEC24D), = AK001390 | NM_014822.1 | 9 |
| | miob0445 | | | |
| | miob6513 | | | |
| | miob6953 | | | |
| | ncr3343 | | | |
| | ncrb8454 | | | |
| | seoa7969 | | | |
| | seoa7977 | | | |
| | seob6463 | | | |
| | seob7750 | | | |
| 468 | mioa9202 | annexin A4 (ANXA4) | NM_001153.2 | 9 |
| | miob1067 | | | |
| | miob3174 | | | |
| | ncr5763 | | | |
| | ncrb2508 | | | |
| | SEOA9399 | | | |
| | SEOA9660 | | | |
| | SEOB0173 | | | |
| | seob5411 | | | |
| 469 | FCR1318 | arginine-rich nuclear protein | M74002 | 9 |
| | FCR3065 | | | |
| | FCR4366 | | | |
| | MIOB2646 | | | |
| | miob3461 | | | |
| | SEOA0501 | | | |
| | SEOA1404 | | | |
| | SEOA2761 | | | |
| | seob4794 | | | |
| 470 | MIOA5013a | malate dehydrogenase 1, NAD (soluble) (MDH1) | NM_005917.1 | 9 |
| | mioa7673a | | | |
| | miob6080 | | | |
| | ncrb0292 | | | |
| | ncrb4784 | | | |
| | ncrc2110 | | | |
| | SEOA4863a | | | |
| | seob4332 | | | |
| | seob6260 | | | |
| 471 | FCR6246 | collagen type VI alpha 1(COL6A1) | X15880 | 9 |
| | hfcr1292 | | | |
| | hfcr9823 | | | |
| | MIOA7992a | | | |
| | ncrb0178 | | | |

Figure 6A – EST Names Corresponding to Unique Known Genes of Figure 6

| | | | | |
|---|---|---|---|---|
| | ncrb4632<br>SEOA0319<br>SEOA8363a<br>SEOA9181 | | | |
| 472 | fcrb1346<br>MIOA4963a<br>miob5747<br>ncr2632<br>ncr8859<br>ncrc0438<br>ncrc3318<br>SEOB0221<br>SEOB3419 | SMT3 (suppressor of mif two 3, yeast) homolog 2 (SMT3H2) | NM_006937.1 | 9 |
| 473 | BFCW0318<br>CR0179<br>FCR0113<br>FCR3447<br>fcrb2005<br>MIOA2794a<br>ncr4738<br>ncrb3852<br>ncrb5521<br>seob7631 | cyclophilin B (hCyPB) | M60857 | 9 |
| 474 | FCR5032<br>FCR7293<br>hfcr9295<br>MIOA0160<br>MIOA1942a<br>MIOA4752<br>miob5803<br>ncr0090<br>seob5652 | YAP65 | X80507.1 | 9 |
| 475 | hfcr0404<br>MIOA4634a<br>mioa9235<br>mioa9809<br>miob4006<br>ncrb1580<br>SEOA0135<br>SEOA4453a<br>SEOA9892 | uridine diphosphoglucose pyrophosphorylase | U27460 | 9 |
| 476 | FCR0023<br>FCR3691<br>FCR6259<br>miob5425<br>ncr2573<br>SEOA8237<br>SEOB0819a | prolyl 4-hydroxylase gene | U14608.1 | 9 |
| 477 | fcrb0109<br>fcrb2067<br>hfcr3477 | melanoma-associated antigen MG50 | AF200348.1 | 9 |

Figure 6A – EST Names Corresponding to Unique Known Genes of Figure 6

| | | | | |
|---|---|---|---|---|
| | hfcr3867 | | | |
| | hfcr7756 | | | |
| | hfcr8784 | | | |
| | hfcr9629 | | | |
| | miob4662 | | | |
| | ncrb1840 | | | |
| 478 | MIOA2037 | kinectin 1 (kinesin receptor) (KTN1)(= KIAA0004) | NM_004986.1 | 9 |
| | MIOA5198a | | | |
| | MIOA5896a | | | |
| | miob6499 | | | |
| | ncr0839 | | | |
| | ncrb3309 | | | |
| | SEOA6414 | | | |
| | SEOA8835 | | | |
| | seob4993 | | | |
| 479 | seob4036 | Dickkopf gene 3 (DKK-3) | NM_013253.1 | 9 |
| | seob5076 | | | |
| | seob5368 | | | |
| | seob6302 | | | |
| | seob7410 | | | |
| | seob7591 | | | |
| | seob6508 | | | |
| | seob6460 | | | |
| 480 | hfcr7355 | AD-017 protein | AF157318.1 | 9 |
| | miob0637 | | | |
| | miob3849 | | | |
| | ncr0497 | | | |
| | ncr2047 | | | |
| | ncrb3620 | | | |
| | ncrc2619 | | | |
| | SEOB0426 | | | |
| | seob6346 | | | |
| 481 | MIOA2620 | Fn54 | AF001533.2 | 9 |
| | MIOA6962a | | | |
| | MIOB2658 | | | |
| | SEOA0234a | | | |
| | SEOA2112n | | | |
| | SEOA4877a | | | |
| | SEOA6700a | | | |
| | seob3659 | | | |
| | seob6668 | | | |
| 482 | fcrb1202 | HSPC035 protein (LOC51669), NPD003 | NM_016127.1 | 9 |
| | fcrb1793 | | | |
| | MIOA8011a | | | |
| | mioa9619 | | | |
| | miob4610 | | | |
| | ncrb7141 | | | |
| | ncrc8961 | | | |
| | SEOB0160 | | | |
| | seob4056 | | | |
| 483 | hfcr3411 | KIAA0164 | D79986 | 9 |
| | MIOA6982a | | | |

Figure 6A – EST Names Corresponding to Unique Known Genes of Figure 6

| | | | | |
|---|---|---|---|---|
| | miob6652 | | | |
| | ncr1587 | | | |
| | ncr7163 | | | |
| | ncrb1605 | | | |
| | ncrc4600 | | | |
| | SEOA1857a | | | |
| | SEOB2796 | | | |
| 484 | SEOA1410a | KIAA0970 | AB023187.1 | 9 |
| | ncrb7345 | | | |
| | ncrc0079 | | | |
| | ncrc6796 | | | |
| | ncr5245 | | | |
| | MIOA2342a | | | |
| | MIOA7096a | | | |
| | SEOA1410a | | | |
| | SEOA5541a | | | |
| 485 | fcrb2101 | KIAA1077 | AB029000.1 | 9 |
| | hfcr5729 | | | |
| | hfcr6674 | | | |
| | MIOA0142 | | | |
| | mioa7831a | | | |
| | ncrb1479 | | | |
| | ncrc5064 | | | |
| | SEOA7404a | | | |
| | SEOB0832a | | | |
| 486 | hfcr0894 | prion protein (p27-30) (Creutzfeld-Jakob disease, Gerstmann-Strausler-Scheinker syndrome, fatal familial insomnia) (PRNP) mRNA | NM_000311.1 | 9 |
| | MIOA4568a | | | |
| | ncr0756 | | | |
| | ncr8808 | | | |
| | ncr9475 | | | |
| | SEOA9156 | | | |
| | SEOB1274 | | | |
| | seob6510 | | | |
| | seob7921 | | | |
| 487 | miob1938 | trichorhinophalangeal syndrome I gene (TRPS1) | NM_014112.1 | 9 |
| | miob5923 | | | |
| | ncr4185 | | | |
| | ncrb1447 | | | |
| | ncrb6767 | | | |
| | ncrb7715 | | | |
| | ncrc3713 | | | |
| | seob4057 | | | |
| | seob7326 | | | |
| 488 | fcrb1866 | activating transCRiption factor 4 (tax-responsive enhancer element B67) (ATF4) | gi4502264 | 9 |
| | fcrb2138 | | | |
| | HFCR3143 | | | |
| | hfcr4079 | | | |
| | ncr5188 | | | |
| | ncr5990 | | | |

Figure 6A – EST Names Corresponding to Unique Known Genes of Figure 6

| | | | | |
|---|---|---|---|---|
| | ncr8537 | | | |
| | ncr8797 | | | |
| | ncrc5691 | | | |
| 489 | ncr1031 | sox | AF070669 | 9 |
| | ncrb0511 | | | |
| | ncrb5112 | | | |
| | ncrb6193 | | | |
| | ncrb6267 | | | |
| | ncrc6688 | | | |
| | SEOA0563A | | | |
| | SEOA2089 | | | |
| | seob7438 | | | |
| 490 | miob6290 | TATA box binding protein (TBP)-associated factor, RNA polymerase II, F, 55kD (TAF2F) | NM_005642.1 | 9 |
| | ncr3778 | | | |
| | fcrb0664 | | | |
| | ncr3701 | | | |
| | ncrb4832 | | | |
| | fcrb2182 | | | |
| | fcrb2184 | | | |
| | miob6290 | | | |
| | SOA0384 | | | |
| | ncrc9215 | | | |
| 491 | ncr2785 | allograft inflammatory factor 1 (AIF1) | NM_001623.2 | 9 |
| | ncr3795 | | | |
| | ncr8982 | | | |
| | ncrb2637 | | | |
| | ncrb7295 | | | |
| | SEOB0185 | | | |
| | SEOB1086 | | | |
| | seob5634 | | | |
| 492 | hfcr0770 | heat shock protein 86 (HSP86) | M30626.1 | 9 |
| | MIOA2641 | | | |
| | miob4473 | | | |
| | miob5657 | | | |
| | SEOA7643a | | | |
| | seob3948 | | | |
| | seob4102 | | | |
| | seob6120 | | | |
| | seob7172 | | | |
| 493 | hfcr5977 | t-complex-associated-testis-expressed 1-like (TCTE1L)=U02556=RP3 | NM_006520.1 | 9 |
| | hfcr9302 | | | |
| | MIOA4605a | | | |
| | miob0178 | | | |
| | ncr6595 | | | |
| | ncrb1626 | | | |
| | ncrb6371 | | | |
| | ncrb7887 | | | |
| | seob3279n | | | |
| 494 | fcrb1013 | matrilin-2 precursor | U69263 | 9 |
| | MIOA2505a | | | |

Figure 6A – EST Names Corresponding to Unique Known Genes of Figure 6

| | | | | |
|---|---|---|---|---|
| | MIOA4183 | | | |
| | MIOA7576a | | | |
| | ncr6962 | | | |
| | ncrc1434 | | | |
| | SEOA4312a | | | |
| | seob5815 | | | |
| | seob7016 | | | |
| 495 | hfcr2814 | actin-related protein Arp3 (ARP3)(actin-related protein 3 yeast)homolog(ACTR3) | AF006083.1 | 9 |
| | hfcr7041 | | | |
| | miob0429 | | | |
| | miob1451 | | | |
| | ncrb0722 | | | |
| | SEOB1231 | | | |
| | SEOB1683 | | | |
| | SEOB1821 | | | |
| | seob3910 | | | |
| 496 | fcrb1740 | bone sialoprotein (BNSP) | L10363.1 | 9 |
| | hfcr4350 | | | |
| | hfcr7527 | | | |
| | hfcr9174 | | | |
| | hfcr9481 | | | |
| | ncr3210 | | | |
| | ncr4925 | | | |
| | ncr8863 | | | |
| | ncrb3535 | | | |
| 497 | hfcr3769 | interleukin 1 receptor, type I (IL1R1) = M27492.1 | NM_000877.1 | 9 |
| | MIOA5859a | | | |
| | ncrb7852 | | | |
| | ncrc3434 | | | |
| | ncrc3593 | | | |
| | SEOA0472 | | | |
| | SEOA3124a | | | |
| | SEOA7538a | | | |
| | SEOA9582 | | | |
| 498 | hfcr6611 | serine/threonine protein kinase Kp78 splice variant CTAK75a | AF159295.1 | 9 |
| | ncr5080 | | | |
| | ncr5402 | | | |
| | ncr7375 | | | |
| | ncr8672 | | | |
| | ncrb0748 | | | |
| | ncrb6321 | | | |
| | ncrb8176 | | | |
| | ncrc0212 | | | |
| 499 | hfcr1879 | latent transforming growth factor beta binding protein 1 (LTBP1) | NM_000627.1 | 9 |
| | hfcr2812 | | | |
| | miob3320 | | | |
| | miob3320 | | | |
| | ncr6879 | | | |
| | ncr9199 | | | |

Figure 6A – EST Names Corresponding to Unique Known Genes of Figure 6

| | | | | |
|---|---|---|---|---|
| | ncrb1949<br>ncrc5355<br>SOA0215 | | | |
| 500 | hfcr0029<br>hfcr0125<br>MIOA0414a<br>MIOA6312a<br>miob1180<br>ncr6818<br>ncr7482<br>ncrc5150<br>SEOB0656a | MAGUK protein p55T (=AB002323 KIAA0325) | AF162130.1 | 9 |
| 501 | MIOA5398a<br>ncrc3628<br>ncrc4425<br>SEOA1480<br>SEOA5608a<br>SEOA6732<br>SEOA8482<br>SEOA9581<br>seob4990 | NAP (nucleosome assembly protein) | M86667 | 9 |
| 502 | cr0056N<br>miob0442<br>MIOB0542<br>miob0807<br>ncr0085<br>ncrb1439<br>ncrb5156<br>ncrb6567<br>ncrc2922 | fragile 16D oxido reductase (FOR) | AF217490.1 | 9 |
| 503 | MIOA7275<br>ncr1461<br>ncr7245<br>ncrb5169<br>SEOA9270<br>SEOB0212<br>seob4497<br>seob7656<br>SOA0615 | factor H homologue | M65294.1 | 9 |
| 504 | hfcr1130<br>mioa2129m<br>mioa9650<br>ncr1524<br>ncrc3587<br>SEOA8874<br>SEOB0041<br>seob4733<br>seob6705 | CYTOCHROME C OXIDASE POLYPEPTIDE I | P00395 | 9 |
| 505 | CR0516<br>FCR0287<br>FCR5189<br>FCR7324 | stathmin (=J04991 p18 protein; Z11566 Pr22 protein) | X53305 | 9 |

Figure 6A – EST Names Corresponding to Unique Known Genes of Figure 6

| | | | | |
|---|---|---|---|---|
| | hfcr1707 | | | |
| | hfcr1932 | | | |
| | hfcr3432 | | | |
| | hfcr9692 | | | |
| | SEOB3320 | | | |
| 506 | BFCN0236 | cellular growth-regulating protein | L10844 | 9 |
| | FCR7050 | | | |
| | hfcr0317 | | | |
| | hfcr9237 | | | |
| | miob5109 | | | |
| | ncrb7266 | | | |
| | ncrc6224 | | | |
| | SEOA2815 | | | |
| | seob6723 | | | |
| 507 | hfcr8609 | paired mesoderm homeo box 1 (PMX1) | gi5902023 | 9 |
| | MIOA2603a | | | |
| | MIOA3566a | | | |
| | MIOA4266 | | | |
| | MIOA6413a | | | |
| | MIOA8213 | | | |
| | SEOA2812m | | | |
| | seoa2812m | | | |
| | soa0022n | | | |
| 508 | MIOA3194a | PTD014 | AF092135.1 | 9 |
| | MIOA5957a | | | |
| | miob3948 | | | |
| | ncr6233 | | | |
| | SEOA2385a | | | |
| | SEOA2385a | | | |
| | SEOA3027a | | | |
| | SEOA3997a | | | |
| | SOA0639 | | | |
| 509 | hfcr6663 | SWI/SNF related, matrix associated (SMARCA1) | gi4507066 | 9 |
| | hfcr6783 | | | |
| | hfcr9757 | | | |
| | MIOA5781a | | | |
| | MIOA8557 | | | |
| | ncrb8709 | | | |
| | ncrc0997 | | | |
| | SEOA2938a | | | |
| 510 | SEOB1322 | fos proto-oncogene (c-fos) | K00650.1 | 9 |
| | BFCS0244 | | | |
| | CR0310 | | | |
| | CR0885 | | | |
| | FCR2161 | | | |
| | FCR3603 | | | |
| | FCR6407 | | | |
| | FCR6636 | | | |
| | hfcr0086 | | | |
| 511 | hfcr1947 | integral membrane protein 2A (ITM2A) | NM_004867.1 | 9 |
| | fcrb1823 | | | |
| | hfcr1947 | | | |

Figure 6A – EST Names Corresponding to Unique Known Genes of Figure 6

| | | | | |
|---|---|---|---|---|
| | hfcr6465 | | | |
| | contigmar21-010016 | | | |
| | ncrc3866 | | | |
| | ncr4034 | | | |
| | ncrb4634 | | | |
| | ncrc5209 | | | |
| | ncrc3141 | | | |
| 512 | ncrc0477 | ATP synthase F0 subunit 6 (RefSeq aa 8e-74) | 5835393 | 9 |
| | ncrc9566 | | | |
| | ncrb1169 | | | |
| | ncrb2227 | | | |
| | ncrc4104 | | | |
| | ncrc0073 | | | |
| | ncrb2604 | | | |
| | ncrb8695 | | | |
| | ncrb3783 | | | |
| 513 | FCR6321 | protein phosphatase 2A catalytic subunit-beta | M60484 | 9 |
| | SEOA0311 | | | |
| | hfcr2343 | | | |
| | miob0044 | | | |
| | miob6664 | | | |
| | hfcr0683 | | | |
| | miob3050 | | | |
| | ncr1268 | | | |
| | miob3012 | | | |
| 514 | SEOA5532a | semaphorin E | AB000220 | 9 |
| | miob1135 | | | |
| | ncrc6652 | | | |
| | SOA0623 | | | |
| | mioa9802 | | | |
| | seoa7819a | | | |
| | ncr0153 | | | |
| | MIOA8348 | | | |
| | SEOA5938 | | | |
| 515 | SEOB1391 | HSPC061 | AF161546.1 | 9 |
| | ncr0054 | | | |
| | ncr0444 | | | |
| | ncr3263 | | | |
| | ncrb0151 | | | |
| | ncrb3135 | | | |
| | ncrc3769 | | | |
| | ncrc4842 | | | |
| | seob4752 | | | |
| 516 | fcrb2141 | heterogeneous nuclear ribonucleoprotein A2/B1 (HNRPA2B1) | NM_002137.1 | 8 |
| | hfcr1914 | | | |
| | hfcr6582 | | | |
| | ncrb1311 | | | |
| | ncrb7920 | | | |
| | ncrc3084 | | | |
| | ncrc4857 | | | |
| | ncrc9811 | | | |

Figure 6A – EST Names Corresponding to Unique Known Genes of Figure 6

| | | | | |
|---|---|---|---|---|
| 517 | FCR4930 | zinc finger protein 9 (a cellular retroviral nucleic acid binding protein) (ZNF9) | gi4827070 | 8 |
| | ncr5633 | | | |
| | ncr6946 | | | |
| | ncrc7043 | | | |
| | SEOA3122a | | | |
| | SEOA3122a | | | |
| | SEOA9000 | | | |
| | SEOA9545 | | | |
| 518 | hfcr0445 | HepG2 | D17039 | 8 |
| | hfcr4437 | | | |
| | MIOA8338 | | | |
| | MIOA8533 | | | |
| | miob0781 | | | |
| | miob6582 | | | |
| | SEOB0682a | | | |
| | seob6415 | | | |
| 519 | hfcr9622 | laminin B2 chain | M55210 | 8 |
| | MIOA3479a | | | |
| | miob6052 | | | |
| | ncr4986 | | | |
| | ncr9836 | | | |
| | ncrc5436 | | | |
| | ncrc9440 | | | |
| | SEOA0469n | | | |
| 520 | ncr0797 | matrix metalloproteinase 3 (stromelysin 1, progelatinase) (MMP3) | NM_002422.1 | 8 |
| | ncr1230 | | | |
| | ncr6196 | | | |
| | ncr9952 | | | |
| | ncrb1942 | | | |
| | ncrb7181 | | | |
| | ncrb7576 | | | |
| | seoa8105 | | | |
| 521 | MIOA1433 | MRG15 protein (MRG15) | AF100615.1 | 8 |
| | ncr6803 | | | |
| | SEOA1081a | | | |
| | SEOA1993 | | | |
| | SEOA2461a | | | |
| | SEOA3988a | | | |
| | SEOA5471a | | | |
| | SEOA5770 | | | |
| 522 | miob0176 | HSPC025 (HSPC025) | NM_016091.1 | 8 |
| | miob6551 | | | |
| | ncr2940 | | | |
| | ncr8073 | | | |
| | ncrb6026 | | | |
| | ncrb7007 | | | |
| | ncrb8689 | | | |
| | SEOA8649 | | | |
| 523 | MIOA0679 | RGC32 protein (RGC32) | NM_014059.1 | 8 |
| | miob0497 | | | |

Figure 6A – EST Names Corresponding to Unique Known Genes of Figure 6

| | | | | |
|---|---|---|---|---|
| | miob1738 | | | |
| | miob5885 | | | |
| | ncrb4874 | | | |
| | ncrc2581 | | | |
| | SEOA1471a | | | |
| | SEOA9706 | | | |
| 524 | hfcr0534 | NADH-ubiquinone oxidoreductase AGGG subunit precursor homolog | AF067166.1 | 8 |
| | hfcr1696 | | | |
| | hfcr4188 | | | |
| | hfcr5920 | | | |
| | miob6937 | | | |
| | SEOA4159a | | | |
| | seob4579 | | | |
| | seob5205 | | | |
| 525 | CR0069 | ubiquitin gene | U49869 | 8 |
| | hfcr0117 | | | |
| | hfcr9063 | | | |
| | miob0436 | | | |
| | ncr0284 | | | |
| | SEOA4681a | | | |
| | SEOA4850a | | | |
| | seob5588 | | | |
| 526 | fcrb0211 | karyopherin alpha 4 (=importin alpha 3) (KPNA4) | NM_002268.1 | 8 |
| | hfcr3362 | | | |
| | miob3406 | | | |
| | miob3857 | | | |
| | ncr1396 | | | |
| | ncr5599 | | | |
| | SEOB3326 | | | |
| | seob6350 | | | |
| 527 | FCR2914N | DEAD-box protein (BAT1) gene | AF029062.1 | 8 |
| | FCR3076 | | | |
| | hfcr0459 | | | |
| | hfcr0550 | | | |
| | hfcr0957 | | | |
| | hfcr2546 | | | |
| | hfcr2834 | | | |
| | hfcr6934 | | | |
| 528 | fcrb2112 | glutaminyl-tRNA synthetase(QARS) | NM_005051.1 | 8 |
| | hfcr0096 | | | |
| | hfcr0192 | | | |
| | hfcr2766 | | | |
| | hfcr2809 | | | |
| | hfcr2825 | | | |
| | hfcr3010 | | | |
| | hfcr4023 | | | |
| 529 | FCR3890 | GOLGI 4-TRANSMEMBRANE SPANNING TRANSPORTER MTP (KIAA0108) | spQ15012 | 8 |
| | MIOA0038a | | | |
| | MIOA3786 | | | |
| | MIOA4007a | | | |

Figure 6A – EST Names Corresponding to Unique Known Genes of Figure 6

| | | | | |
|---|---|---|---|---|
| | MIOA8794 | | | |
| | SEOA2844 | | | |
| | SEOA8588 | | | |
| | seob7923 | | | |
| 530 | fcrb0050 | high-mobility group (nonhistone chromosomal) protein 17 (HMG17) | NM_005517.1 | 8 |
| | fcrb0623 | | | |
| | hfcr0831 | | | |
| | hfcr5835 | | | |
| | hfcr7819 | | | |
| | hfcr8813 | | | |
| | miob6477 | | | |
| | SEOB1911 | | | |
| 531 | MIOA1492m | tumor neCRosis factor-inducible (TSG-6) | M31165 | 8 |
| | MIOA5836a | | | |
| | MIOA6532a | | | |
| | miob4878 | | | |
| | SEOA1334 | | | |
| | seoa3146m | | | |
| | SEOA6321 | | | |
| | SEOA6545a | | | |
| 532 | hfcr0214 | antigen NY-CO-33 (NY-CO-33) | AF039698.1 | 8 |
| | hfcr0252 | | | |
| | hfcr0262 | | | |
| | hfcr0308 | | | |
| | hfcr0343 | | | |
| | hfcr0941 | | | |
| | hfcr1392 | | | |
| | hfcr4696 | | | |
| 533 | FCR1442 | anti-oxidant protein 2 (non-selenium glutathione peroxidase, acidic calcium-independent phospholipase A2) (KIAA0106) | NM_004905.1 | 8 |
| | FCR7137 | | | |
| | hfcr0510 | | | |
| | hfcr9490 | | | |
| | ncrb1614 | | | |
| | ncrb3101 | | | |
| | SEOA8541 | | | |
| | SEOB2161 | | | |
| 534 | fcr0540n | constitutive fragile region FRA3B | AF152363.1 | 8 |
| | MIOA7239a | | | |
| | miob6678 | | | |
| | ncr8376 | | | |
| | ncrc2927 | | | |
| | ncrc7083 | | | |
| | SEOB0025 | | | |
| | seob5222 | | | |
| | seob8024 | | | |
| 535 | MIOA3282a | KIAA0242 | D87684 | 8 |
| | miob1327 | | | |
| | miob3761 | | | |
| | ncr0541 | | | |

Figure 6A – EST Names Corresponding to Unique Known Genes of Figure 6

| | | | | |
|---|---|---|---|---|
| | ncr7342 | | | |
| | ncrb3564 | | | |
| | ncrb4340 | | | |
| 536 | fcrb2658 | KIAA0663 | AB014563 | 8 |
| | MIOA3650a | | | |
| | ncr0546 | | | |
| | ncrc1725 | | | |
| | SEOA1910 | | | |
| | SEOA2506 | | | |
| | SEOA3218 | | | |
| | SEOA6086a | | | |
| 537 | hfcr0404 | UDP-glucose pyrophosphorylase 2 (ORF) | NM_006759.1 | 8 |
| | MIOA4634a | | | |
| | mioa9235 | | | |
| | mioa9809 | | | |
| | miob4006 | | | |
| | ncrb1580 | | | |
| | SEOA4453a | | | |
| | SEOA9892 | | | |
| 538 | FCR7272 | palmitoyl-protein thioesterase (PPT) | AF022211 | 8 |
| | MIOA4166 | | | |
| | ncr1140 | | | |
| | ncrc2500 | | | |
| | SEOA1377 | | | |
| | SEOA3557a | | | |
| | SEOA6041a | | | |
| | SEOA6747 | | | |
| 539 | mioa7866 | N-acylsphingosine amidohydrolase (ASAH) (acid ceramidase) | NM_004315.1 | 8 |
| | ncr0632 | | | |
| | ncr1711 | | | |
| | ncr4133 | | | |
| | ncr9209 | | | |
| | SEOA1375 | | | |
| | SEOA3768a | | | |
| | SEOA5606a | | | |
| | seob3717 | | | |
| 540 | fcrb1283 | prostatic binding protein (PBP) | NM_002567.1 | 8 |
| | hfcr0715 | | | |
| | hfcr3806 | | | |
| | mioa9396 | | | |
| | ncrb6331 | | | |
| | ncrc3457 | | | |
| | ncrc6961 | | | |
| | seob5142 | | | |
| 541 | hfcr3516 | CYTOCHROME C OXIDASE POLYPEPTIDE II | spP00403 | 8 |
| | hfcr3903 | | | |
| | miob1708 | | | |
| | ncr7588 | | | |
| | ncrb8408 | | | |
| | SEOA8827 | | | |
| | seob3744 | | | |

Figure 6A – EST Names Corresponding to Unique Known Genes of Figure 6

| | | | | |
|---|---|---|---|---|
| | seob7435 | | | |
| 542 | FCR3798 | ornithine aminotransferase | M29927 | 8 |
| | hfcr4129 | | | |
| | hfcr6796 | | | |
| | MIOA1928a | | | |
| | ncrb5224 | | | |
| | ncrc5948 | | | |
| | SEOA4323a | | | |
| | SEOA8348a | | | |
| 543 | MIOA7421a | basic transcription element binding protein 1 (BTEB1) | NM_001206.1 | 8 |
| | ncrb1206 | | | |
| | ncrb4351 | | | |
| | ncrc1907 | | | |
| | ncrc2210 | | | |
| | ncrc2736 | | | |
| | ncrc4464 | | | |
| | ncrc9041 | | | |
| 544 | FCR0154 | Huntingtin interacting protein | AF049103 | 8 |
| | FCR4419 | | | |
| | hfcr2784 | | | |
| | hfcr2956 | | | |
| | ncr3376 | | | |
| | ncrb1833 | | | |
| | ncrc1703 | | | |
| | SEOA7448a | | | |
| 545 | FCR0366 | thyroid hormone binding protein (p55) (=M22806 prolyl 4-hydroxylase beta-subunit and disulfide isomerase (P4HB)) | J02783 | 8 |
| | FCR6276 | | | |
| | FCR6937 | | | |
| | fcrb1423 | | | |
| | fcrb2193 | | | |
| | hfcr4252 | | | |
| | SEOA5373 | | | |
| | SEOB0257 | | | |
| 546 | FCR3819 | ISLR (immunoglobulin superfamily containing leucine-rich repeat) gene, | AB024537 | 8 |
| | hfcr3612 | | | |
| | hfcr7582 | | | |
| | hfcr9389 | | | |
| | hfcr9523 | | | |
| | ncrb8735 | | | |
| | SEOA2639 | | | |
| | seob4629 | | | |
| 547 | hfcr6771 | biglycan BGN | U11686.1 | 8 |
| | hfcr8516 | | | |
| | miob4757 | | | |
| | ncrc1193 | | | |
| | SEOA2971a | | | |
| | SEOB0194 | | | |
| | SEOB2292 | | | |
| | seob6134 | | | |

Figure 6A – EST Names Corresponding to Unique Known Genes of Figure 6

| | | | | |
|---|---|---|---|---|
| 548 | hfcr0921 | PPP1R5 | AF110824.1 | 8 |
| | MIOA0311n | | | |
| | miob6636 | | | |
| | miob6636 | | | |
| | ncr6733 | | | |
| | ncrb5130 | | | |
| | ncrb6542 | | | |
| | SEOA9074 | | | |
| 549 | hfcr5942 | MADS/MEF2-family transcription factor (MEF2C) mRNA, complete cds | L08895.1 | 8 |
| | ncr0925 | | | |
| | ncr2301 | | | |
| | ncr8396 | | | |
| | ncrb2831 | | | |
| | ncrb7924 | | | |
| | ncrc1442 | | | |
| | ncrc2444 | | | |
| 550 | ncr0676 | RAN binding protein 2 (RANBP2) | NM_006267.2 | 8 |
| | ncrb1705 | | | |
| | ncrb8364 | | | |
| | ncrc0771 | | | |
| | SEOA0836 | | | |
| | SEOA1186A | | | |
| | SEOA3500a | | | |
| | SEOA3575a | | | |
| 551 | MIOA3594a | insulin-like growth factor I | X57025 | 8 |
| | mioa9989 | | | |
| | ncr0893 | | | |
| | ncr8032 | | | |
| | ncrb3026 | | | |
| | ncrc3893 | | | |
| | ncrc4828 | | | |
| | seob4198 | | | |
| 552 | seob8029 | single-stranded DNA-binding protein (SSBP), nuclear gene encoding mitochondrial protein | NM_003143.1 | 8 |
| | miob1235 | | | |
| | miob3098 | | | |
| | SEOA8240 | | | |
| | seob5993 | | | |
| 553 | MIOA7417a | Nck-associated protein 1 (Nap1) (=AB011159 KIAA0587) | AB014509.1 | 8 |
| | MIOA8238 | | | |
| | MIOA9100 | | | |
| | miob1334 | | | |
| | miob3047 | | | |
| | ncr8026 | | | |
| | SEOA4587 | | | |
| | SEOA7215a | | | |
| 554 | miob6717 | cisplatin resistance-associated overexpressed protein | AB034205.1 | 8 |
| | ncr5828 | | | |
| | ncrb0743 | | | |
| | ncrb2032 | | | |

Figure 6A – EST Names Corresponding to Unique Known Genes of Figure 6

| | | | | |
|---|---|---|---|---|
| | ncrc3881 | | | |
| | SEOA8800 | | | |
| | SEOA9509 | | | |
| | SEOB3559 | | | |
| 555 | MIOA5786a | dihydropyrimidinase-like 3 (DPYSL3) | NM_001387.1 | 8 |
| | ncr8736 | | | |
| | ncr9724 | | | |
| | SEOA0743 | | | |
| | SEOA6507a | | | |
| | SEOB0093 | | | |
| | SEOB0891a | | | |
| | SEOB1584 | | | |
| 556 | fcrb2457 | KIAA0102 | D14658 | 8 |
| | MIOA4552a | | | |
| | ncr9174 | | | |
| | ncrb3625 | | | |
| | SEOA1422a | | | |
| | seoa6847 | | | |
| | SEOA7060a | | | |
| | SEOB1193 | | | |
| 557 | MIOA1403a | KIAA0191 (zinc finger homolog) | D83776 | 8 |
| | MIOA3292a | | | |
| | MIOA3303a | | | |
| | miob3381 | | | |
| | ncr4974 | | | |
| | ncr5387 | | | |
| | ncrc6700 | | | |
| | SEOA1963a | | | |
| 558 | FCR0338 | NADH dehydrogenase (ubiquinone) 1 alpha subcomplex, 5 (13kD, B13) (NDUFA5) | NM_005000.1 | 8 |
| | MIOA4149 | | | |
| | miob2985 | | | |
| | ncrb0256 | | | |
| | ncrc4121 | | | |
| | SEOA6508a | | | |
| | SEOA8194a | | | |
| | seob6851 | | | |
| 559 | ncr1976 | proteasome (prosome, macropain) 26Ssubunit, ATPase, 1 (RefSeq aa 1e-56) | NP_002793.1 | 8 |
| | ncr2459 | | | |
| | ncrb0874 | | | |
| | ncrb4777 | | | |
| | ncrc0393 | | | |
| | ncrc3030 | | | |
| | ncrc4306 | | | |
| | ncrc5716 | | | |
| 560 | ncr1743 | lysosomal-associated protein transmembrane 4 alpha (MBNT) | NM_014713.1 | 8 |
| | ncrb2628 | | | |
| | ncrb2897 | | | |
| | ncrb8558 | | | |
| | ncrc0855 | | | |

Figure 6A – EST Names Corresponding to Unique Known Genes of Figure 6

| | | | | |
|---|---|---|---|---|
| | ncrc5950 | | | |
| | ncrc9127 | | | |
| | SEOB2726 | | | |
| 561 | hfcr1201 | adaptor-related protein complex 3, sigma 1 subunit (CLAPS3) | NM_001284.1 | 8 |
| | hfcr7699 | | | |
| | ncr8459 | | | |
| | ncrb0323 | | | |
| | ncrb2391 | | | |
| | SEOA8808 | | | |
| | seob5433 | | | |
| | seob6879 | | | |
| 562 | FCR1783 | nidogen-2 | AJ223500 | 8 |
| | FCR5462 | | | |
| | hfcr0417 | | | |
| | ncrb4856 | | | |
| | ncrb6659 | | | |
| | ncrc4006 | | | |
| | SEOA1496n | | | |
| | SEOA8986 | | | |
| 563 | FCR3322 | melanoma growth regulatory protein MIA | X75450 | 8 |
| | FCR4048 | | | |
| | hfcr4223 | | | |
| | hfcr6761 | | | |
| | ncr7560 | | | |
| | ncr9772 | | | |
| | ncrc0635 | | | |
| | ncrc3620 | | | |
| 564 | FCR2323 | Arp2/3 protein complex subunit p16 (ARC16) =AF006088 (ORF) | NM_005717.1 | 8 |
| | FCR2644 | | | |
| | hfcr9709 | | | |
| | miob0293 | | | |
| | SEOA2424a | | | |
| | SEOA4634a | | | |
| | ncrc6996 | | | |
| | SEOA7952a | | | |
| 565 | mioa1112m | Kallmann syndrome 1 (KAL1) (=ADMLX=putative adhesion molecule) | NM_000216.1 | 8 |
| | MIOA8433 | | | |
| | MIOA8937 | | | |
| | miob0390 | | | |
| | miob3344 | | | |
| | ncr0262 | | | |
| | ncrc3092 | | | |
| | SEOA2854 | | | |
| 566 | hfcr9289 | apoptosis related protein APR-1 | AF143235.2 | 8 |
| | hfcr9945 | | | |
| | MIOA4465a | | | |
| | MIOB2840 | | | |
| | ncrc5217 | | | |
| | ncrc6548 | | | |

Figure 6A – EST Names Corresponding to Unique Known Genes of Figure 6

| | | | | |
|---|---|---|---|---|
| | SEOA2775<br>SEOB0514 | | | |
| 567 | SEOB0044<br>ncr8069<br>ncrb5345<br>SEOA1969a<br>SEOB1430<br>fcrb1835<br>ncrb8586<br>ncrb3980 | TRAM protein | CAA45218.1 | 8 |
| 568 | hfcr1115<br>FCR2512<br>FCR6593<br>FCR7190<br>fcrb0784<br>hfcr3885<br>ncr3926<br>ncrc3046 | 1-8U gene from interferon-inducible gene family | X57352.1 | 8 |
| 569 | miob5752<br>MIOA1341a<br>MIOA3031a<br>ncrb5570<br>ncrb8614<br>ncrc1114<br>ncrc9428<br>seob5734 | splicing factor SRp40-1 (SRp40) | U30826.1 | 8 |
| 570 | ncrc2673<br>miob6537<br>ncr9356<br>ncrb8417<br>ncrc0737<br>ncrc9952<br>seob6537<br>seob6876 | ORF2 contains a reverse transcriptase domain | AAA51622.1 | 8 |
| 571 | seob6876<br>ncrc0737<br>ncrc9952<br>miob6537<br>ncr9356<br>ncrb8417<br>ncrc2673<br>seob6537 | ORF2 contains a reverse transcriptase domain | AAB59368.1 | 8 |
| 572 | ncrb5570<br>MIOA1341a<br>MIOA3031a<br>miob5752<br>ncrb8614<br>ncrc1114<br>ncrc9428<br>seob5734 | splicing factor, arginine/serine-rich 5 (RefSeq aa 1e-54) | NP_008856.1 | 8 |

Figure 6A – EST Names Corresponding to Unique Known Genes of Figure 6

| | | | | |
|---|---|---|---|---|
| 573 | seob8063<br>ncr6594<br>ncr9379<br>ncr2864<br>ncr5057<br>ncrb3596<br>ncr4533<br>ncrc3260 | REIC/Dkk-3 | AB034203.1 | 8 |
| 574 | miob2957<br>miob3015<br>miob4294<br>ncr3291<br>seob4617<br>seob6019<br>seob8000 | Golgi autoantigen, golgin subfamily a, 4 (GOLGA4) | NM_002078.2 | 7 |
| 575 | miob6968<br>ncrb2788<br>ncrb8154<br>ncrc0218<br>ncrc0868<br>ncrc6123<br>seob3716 | complement component 1, s subcomponent (C1S) | NM_001734.1 | 7 |
| 576 | FCR5083<br>hfcr1267<br>hfcr5657<br>ncrb1959<br>ncrc4152<br>SEOA5076a<br>seob4654 | reticulocalbin 2, EF-hand calcium binding domain (RCN2) =X78669 (ORF) | NM_002902.1 | 7 |
| 577 | hfcr0154<br>hfcr0227<br>mioa9587<br>ncr0019<br>SEOA6115a<br>SEOA9637<br>seob4170 | Eukaryotic translation initiation factor 2, subunit 2 (beta, 38kD)(EIF2S2) | NM_003908.1 | 7 |
| 578 | mioa7660a<br>MIOA8182<br>miob1947<br>SEOA2726<br>SEOA4144a<br>seoa8033<br>seoa8121 | 5' nucleotidase (EC 3.1.3.5) | X55740 | 7 |
| 579 | ncr7434<br>ncr8522<br>ncrb2248<br>ncrb7408<br>ncrc0040<br>ncrc4397 | interferon induced transmembrane protein 1 (9-27) (IFITM1) | NM_003641.1 | 7 |

Figure 6A – EST Names Corresponding to Unique Known Genes of Figure 6

| | | | | |
|---|---|---|---|---|
| | SEOA9287 | | | |
| 580 | FCR7561 | transforming, acidic coiled-coil containing protein 1 (TACC1=AF049910 | NM_006283.1 | 7 |
| | MIOA6376a | | | |
| | ncr1229 | | | |
| | ncr3973 | | | |
| | ncrc9343 | | | |
| | SEOA4813a | | | |
| | SEOA7942a | | | |
| 581 | FCR0027 | fau | X65923 | 7 |
| | CR0022 | | | |
| | CR0838 | | | |
| | FCR0335 | | | |
| | FCR1281 | | | |
| | FCR6026 | | | |
| 582 | fcrb2480 | KIAA0372 | AB002370.1 | 7 |
| | hfcr0372 | | | |
| | ncr5872 | | | |
| | ncrb4396 | | | |
| | ncrb6434 | | | |
| | SEOB3182 | | | |
| 583 | ncr5571 | MEK binding partner 1 | AF201947.1 | 7 |
| | ncr9674 | | | |
| | ncrc0625 | | | |
| | ncrc4059 | | | |
| | SEOA2371a | | | |
| | seoa6779 | | | |
| | SEOB3088 | | | |
| 584 | hfcr7351 | stearoyl-CoA desaturase | AB032261.1 | 7 |
| | hfcr8238 | | | |
| | hfcr8576 | | | |
| | MIOA3163a | | | |
| | MIOA6904a | | | |
| | miob5826 | | | |
| | miob5889 | | | |
| 585 | MIOA2698a | protein immuno-reactive with anti-PTH polyclonal antibodies | U28831.1 | 7 |
| | MIOA5481a | | | |
| | miob0916 | | | |
| | miob4849 | | | |
| | ncrc2327 | | | |
| | ncrc3585 | | | |
| | seob4085 | | | |
| 586 | MIOA2922a | AgX-1 antigen | S73498 | 7 |
| | MIOA4698 | | | |
| | miob6055 | | | |
| | SEOA8388a | | | |
| | SEOA8525 | | | |
| | seob4430 | | | |
| | seob7352 | | | |
| 587 | MIOA1726a | erythrocyte membrane protein band 4.1-like 2 (EPB41L2) | NM_001431.1 | 7 |

Figure 6A – EST Names Corresponding to Unique Known Genes of Figure 6

| | | | | |
|---|---|---|---|---|
| | MIOA8952 | | | |
| | mioa9333 | | | |
| | ncr6956 | | | |
| | ncrc4093 | | | |
| | ncrc5141 | | | |
| | ncrc7000 | | | |
| 588 | hfcr0788 | valosin-containing protein(VCP) | NM_007126.2 | 7 |
| | hfcr6249 | | | |
| | hfcr7663 | | | |
| | miob0865 | | | |
| | ncrb1772 | | | |
| | ncrb2278 | | | |
| | ncrc1976 | | | |
| 589 | hfcr5792 | clathrin, light polypeptide (Lca) (CLTA) | NM_007096.1 | 7 |
| | miob3917 | | | |
| | miob4440 | | | |
| | ncr3887 | | | |
| | ncrb0269 | | | |
| | ncrb5707 | | | |
| | seob5739 | | | |
| 590 | MIOA0176 | spectrin SH3 domain binding protein 1 (SSH3BP1) | NM_005470.1 | 7 |
| | MIOA3826 | | | |
| | MIOA7455a | | | |
| | ncrb3386 | | | |
| | SEOA3117a | | | |
| | SEOA9034 | | | |
| | SEOB3560 | | | |
| 591 | hfcr2150 | dual specificity phosphatase 1 (DUSP1) | NM_004417.2 | 7 |
| | miob4625 | | | |
| | ncr1771 | | | |
| | ncrb2780 | | | |
| | ncrb8457 | | | |
| | ncrc6322 | | | |
| | SEOB3360 | | | |
| 592 | hfcr0742 | p75NTR-associated cell death executor (NADE) | AF187064.1 | 7 |
| | hfcr5900 | | | |
| | hfcr6598 | | | |
| | mioa9711 | | | |
| | SEOA8612 | | | |
| | seob5922 | | | |
| | seob7019 | | | |
| 593 | fcrb1871 | GW128 | AF107406 | 7 |
| | MIOA5951a | | | |
| | ncr5777 | | | |
| | ncrb2246 | | | |
| | SEOA2283a | | | |
| | SEOA5893 | | | |
| | SEOB0414 | | | |
| 594 | hfcr0320 | HSPC194 | AF151028.1 | 7 |
| | hfcr1288 | | | |
| | ncr4712 | | | |
| | ncr6391 | | | |

Figure 6A – EST Names Corresponding to Unique Known Genes of Figure 6

| | | | | |
|---|---|---|---|---|
| | SEOB1118<br>seob6526<br>seob7915 | | | |
| 595 | MIOA3349a<br>mioa9794<br>miob3168<br>miob4900<br>ncr4118<br>SEOA3706a<br>SEOA7566a | HSPC238 | AF151072.1 | 7 |
| 596 | MIOA2079n<br>MIOA8014a<br>ncr2587<br>ncr6577<br>ncrc1235<br>ncrc5589<br>seob3264 | IDN3 | AB019494.1 | 7 |
| 597 | hfcr9534<br>MIOA2596a<br>miob6597<br>ncrb1387<br>ncrb6004<br>ncrb8172<br>seob8247 | KIAA0069 gene | D31885.1 | 7 |
| 598 | FCR5589<br>hfcr1653<br>hfcr5817<br>miob0363<br>ncr0554<br>ncrc5077<br>seob7504 | KIAA0143 gene | D63477.1 | 7 |
| 599 | hfcr5121<br>MIOA5061a<br>MIOA8854<br>miob1453<br>ncrb7252<br>SEOA1882<br>seob3935 | KIAA0332 | AB002330 | 7 |
| 600 | FCR5903<br>fcrb2089<br>hfcr6484<br>hfcr9556<br>miob3477<br>ncrb3217<br>seob5403 | non-metastatic cells 2, protein (NM23B) expressed in (NME2) | NM_002512.1 | 7 |
| 601 | FCR4406<br>MIOA0278<br>MIOA0763n<br>ncr4716<br>ncrb1136<br>ncrb5142 | over-expressed breast tumor protein | L34839 | 7 |

Figure 6A – EST Names Corresponding to Unique Known Genes of Figure 6

| | | | | |
|---|---|---|---|---|
| | ncrc9744 | | | |
| 602 | hfcr3691 | PRO0530 | AF111849.1 | 7 |
| | MIOA9161 | | | |
| | miob2527 | | | |
| | SEOB1197 | | | |
| | seob5460 | | | |
| | seob7437 | | | |
| | seob7994 | | | |
| 603 | fcrb1337 | PTD010 | AF078863.1 | 7 |
| | hfcr3498 | | | |
| | MIOA6242a | | | |
| | miob3002 | | | |
| | SEOA0008 | | | |
| | seob7764 | | | |
| | miob3002 | | | |
| 604 | MIOA1626a | glyoxalase-I (GLO1) | AF146651.1 | 7 |
| | MIOA7480a | | | |
| | miob2437 | | | |
| | ncrb2645 | | | |
| | ncrc0180 | | | |
| | SEOA4826a | | | |
| | SEOB1339 | | | |
| 605 | FCR2714 | high density lipoprotein binding protein (HBP) | M64098 | 7 |
| | FCR4465 | | | |
| | FCR6028 | | | |
| | FCR7362 | | | |
| | hfcr6389 | | | |
| | miob3907 | | | |
| | SEOA4548 | | | |
| 606 | hfcr0493 | eukaryotic translation initiation factor 3, subunit 3 (gamma, 40kD) | gi4503514 | 7 |
| | hfcr0556 | | | |
| | hfcr5388 | | | |
| | ncrc2097 | | | |
| | SEOA5577a | | | |
| | SEOA7122a | | | |
| | SEOB1986 | | | |
| 607 | fcrb1402 | cathepsin L (CTSL) | NM_001912.1 | 7 |
| | MIOA6594a | | | |
| | ncr0638 | | | |
| | ncrb2161 | | | |
| | ncrc2325 | | | |
| | ncrc5650 | | | |
| | seob6577 | | | |
| 608 | MIOA4785a | sorting nexin 6 (SNX6) | AF121856.1 | 7 |
| | MIOA7191a | | | |
| | ncr1232 | | | |
| | ncrb1831 | | | |
| | ncrc0913 | | | |
| | SEOA7443a | | | |
| | seob4175 | | | |

Figure 6A – EST Names Corresponding to Unique Known Genes of Figure 6

| | | | | |
|---|---|---|---|---|
| 609 | FCR3132 | KDEL (Lys-Asp-Glu-Leu) endoplasmic reticulum protein retention receptor 2(KDELR2) | NM_006854.2 | 7 |
| | hfcr0708 | | | |
| | MIOA5447a | | | |
| | ncr7758 | | | |
| | ncrc8873 | | | |
| | seoa7981 | | | |
| | seob4821 | | | |
| 610 | fcr1387n | nuclear factor of kappa light polypeptide gene enhancer in B-cells 1(NFKB1) gene, complete cds | AF213884.1 | 7 |
| | ncr2493 | | | |
| | ncrb7249 | | | |
| | ncrc0131 | | | |
| | ncrc4374 | | | |
| | ncrc9387 | | | |
| | ncrc9528 | | | |
| 611 | SEOA1765a | transCRiptional coactivator PC4 | U12979 | 7 |
| | SEOA3645a | | | |
| | SEOA7323a | | | |
| | SEOB0415 | | | |
| | SEOB3171 | | | |
| | seob7880 | | | |
| | SEOA8181a | | | |
| 612 | fcrb0265 | poly(rC)-binding protein 1 (PCBP1) | NM_006196.1 | 7 |
| | fcrb0734 | | | |
| | miob3473 | | | |
| | ncrb8307 | | | |
| | ncrc5850 | | | |
| | SEOA9477 | | | |
| | SEOB0715a | | | |
| 613 | MIOA9057 | Ia-associated invariant gamma-chain gene | M13560 | 7 |
| | ncr6286 | | | |
| | ncrc1045 | | | |
| | ncrc1583 | | | |
| | ncrc6523 | | | |
| | SEOA0200A | | | |
| | SEOA9355 | | | |
| 614 | hfcr5847 | immunoglobulin lambda gene | D87003.1 | 7 |
| | hfcr8920 | | | |
| | mioa5881an | | | |
| | miob6511 | | | |
| | ncr8575 | | | |
| | ncrc3661 | | | |
| | seoa7782a | | | |
| 615 | HFCR3185 | uncharacterized bone marrow protein BM034 (=AK000571 FLJ20564 fis) (=P11142 HEAT SHOCK COGNATE 71 KD PROTEIN) | AF217511.1 | 7 |
| | MIOB2229 | | | |
| | ncrb4087 | | | |
| | ncrb4095 | | | |
| | ncrb6427 | | | |
| | seob5099 | | | |

Figure 6A – EST Names Corresponding to Unique Known Genes of Figure 6

| | | | | |
|---|---|---|---|---|
| | seob6408 | | | |
| 616 | fcrb1174 | small membrane protein 1 (SMP1) | AF081282 | 7 |
| | hfcr9094 | | | |
| | miob1924 | | | |
| | miob4634 | | | |
| | SEOA0486 | | | |
| | SEOB3236 | | | |
| | seob5016 | | | |
| 617 | hfcr2256 | chondroitin sulfate proteoglycan 2 (versican) (CSPG2) | NM_004385.1 | 7 |
| | MIOA4716 | | | |
| | miob6865 | | | |
| | ncrb1501 | | | |
| | ncrb4916 | | | |
| | ncrb7145 | | | |
| | ncrc7070 | | | |
| 618 | FCR1983 | dermatan sulfate proteoglycan 3 (DSPG3) | U59111 | 7 |
| | FCR2582 | | | |
| | FCR5067 | | | |
| | fcrb2122 | | | |
| | hfcr2037 | | | |
| | hfcr6461 | | | |
| | hfcr9524 | | | |
| 619 | hfcr8818 | stromal cell derived factor receptor 1 (SDFR1) | NM_012428.1 | 7 |
| | mioa9880 | | | |
| | SEOA6039a | | | |
| | SEOA8246 | | | |
| | SEOA9170 | | | |
| | SEOB1931 | | | |
| | seob7278 | | | |
| 620 | hfcr9418 | ras-related GTP-binding protein | AF106681.1 | 7 |
| | MIOA5884a | | | |
| | miob1006 | | | |
| | MIOB2285 | | | |
| | ncrc1176 | | | |
| | SEOB1490 | | | |
| | seob6333 | | | |
| 621 | FCR1420 | cytosolic thyroid hormone-binding protein (=M23725 M2-type pyruvate kinase) | M26252 | 7 |
| | FCR2940 | | | |
| | hfcr3717 | | | |
| | hfcr4897 | | | |
| | hfcr5087 | | | |
| | ncrb1999 | | | |
| | ncrb6924 | | | |
| 622 | hfcr6490 | SLC11A3 iron transporter | AF215636.1 | 7 |
| | miob2424 | | | |
| | ncr1325 | | | |
| | ncrb7383 | | | |
| | SEOB3027 | | | |
| | SEOB3322 | | | |
| | seob5451 | | | |
| 623 | MIOA6841a | syntaxin 8 | AAD20831.1 | 7 |

Figure 6A – EST Names Corresponding to Unique Known Genes of Figure 6

| | | | | |
|---|---|---|---|---|
| | MIOA8820 | | | |
| | miob3261 | | | |
| | ncr1544 | | | |
| | ncrb3098 | | | |
| | ncrb6810 | | | |
| | ncrc3718 | | | |
| 624 | miob4513 | vascular cell adhesion molecule 1 (VCAM1) | M30257 | 7 |
| | ncr0865 | | | |
| | ncr6827 | | | |
| | SEOA5447 | | | |
| | SEOA9187 | | | |
| | SEOB0637a | | | |
| | seob4362 | | | |
| 625 | fcrb2317 | GTP-binding protein Sara | AF092130.1 | 7 |
| | MIOA5729a | | | |
| | miob1953 | | | |
| | miob6209 | | | |
| | SEOA3644a | | | |
| | SEOA3930 | | | |
| | SEOA3931 | | | |
| 626 | FCR0472 | interCRine-alpha (hIRH) | U19495 | 7 |
| | FCR5699 | | | |
| | FCR5699 | | | |
| | hfcr7895 | | | |
| | ncr0368 | | | |
| | ncrc1859 | | | |
| | ncrc2508 | | | |
| 627 | miob6611 | line-1 protein ORF2 (=p150) | B28096 | 7 |
| | ncr2368 | | | |
| | ncr5299 | | | |
| | ncrc9411 | | | |
| | SEOA9020 | | | |
| | SEOB0209 | | | |
| | seob6757 | | | |
| 628 | mioa9336 | small acidic protein | U51678 | 7 |
| | miob3741 | | | |
| | ncrc4955 | | | |
| | SEOA1145a | | | |
| | SEOA5864 | | | |
| | SEOB0761 | | | |
| | seob5146 | | | |
| 629 | hfcr0328 | small EDRK-rich factor 2 (SERF2) | NM_005770.1 | 7 |
| | hfcr7793 | | | |
| | hfcr8745 | | | |
| | hfcr9633 | | | |
| | miob6029 | | | |
| | ncr6010 | | | |
| | ncr6011 | | | |
| 630 | SEOB1145 | ATP SYNTHASE E CHAIN, MITOCHONDRIAL | spP56385 | 7 |
| | FCR4880 | | | |
| | MIOA2871a | | | |
| | MIOA5667 | | | |

Figure 6A – EST Names Corresponding to Unique Known Genes of Figure 6

| | | | | |
|---|---|---|---|---|
| | SEOA1308<br>SEOA2478<br>SEOB2195 | | | |
| 631 | seob6198<br>hfcr7749<br>seob6778<br>ncrb4067<br>ncr6539<br>ncr5375<br>ncrc1540 | ubiquitin-conjugating enzyme E2 variant 1 (UBE2V1) | NM_003349.1 | 7 |
| 632 | seob4160<br>MIOA0736<br>SEOB0458<br>fcr5448n<br>hfcr6324<br>hfcr0535<br>ncrc3727 | zinc finger protein SLUG (SLUG) gene | AF084243.1 | 7 |
| 633 | ncrb4517<br>ncr1126<br>ncrb5449<br>ncrc1132<br>ncrc3039<br>seoa7034<br>seoa8071 | RNA binding motif protein 8B (RBM8B) | AF231512.1 | 7 |
| 634 | MIOA2818a<br>MIOB1538<br>fcr6041n<br>hfcr7079<br>miob1828<br>MIOA5860a<br>ncr6947 | CGI-149 protein | AF151907.1 | 7 |
| 635 | FCR6330<br>CR0193<br>FCR7104<br>fcrb1340<br>hfcr3614<br>hfcr1211<br>hfcr3539 | elastin (ELN) | U62292 | 7 |
| 636 | SEOB3204<br>miob4189<br>ncr6311<br>miob1888<br>miob1911<br>SEOA9563<br>hfcr5965 | non-histone chromosomal protein (HMG-1) | L08048.1 | 7 |
| 637 | miob3443<br>hfcr6464<br>hfcr6922<br>FCR0177<br>SEOB1862<br>miob3164<br>ncrb2299 | KIAA0038 gene | D26068.1 | 7 |

Figure 6A – EST Names Corresponding to Unique Known Genes of Figure 6

| | | | | |
|---|---|---|---|---|
| 638 | seob8232 | NADH dehydrogenase (ubiquinone) 1 beta subcomplex, 8 (19kD, ASHI) (NDUFB8) | NM_005004.1 | 7 |
| | hfcr2763 | | | |
| | ncr7871 | | | |
| | ncr1351 | | | |
| | SEOB0754 | | | |
| | SEOA2750 | | | |
| | FCR7018 | | | |
| 639 | MIOA7373a | esterase D | AF112219 | 7 |
| | hfcr3894 | | | |
| | ncrb6449 | | | |
| | ncrc2584 | | | |
| | SEOA8884 | | | |
| | SOA0558 | | | |
| | seoa7761a | | | |
| 640 | SEOB1586 | lost on transformation LOT1 (=PLAGL1) | U72621.2 | 7 |
| | seoa7702a | | | |
| | FCR1645 | | | |
| | MIOA0694 | | | |
| | MIOA5302a | | | |
| | SOA0537 | | | |
| | SEOA0187a | | | |
| 641 | SEOA1215A | N2A3 (=DPYSL2) (=dihydropyrimidinase related protein-2) | U97105 | 7 |
| | SEOB0541 | | | |
| | MIOA2580a | | | |
| | SEOA7570a | | | |
| | BFCS0014 | | | |
| | SEOA5084a | | | |
| | MIOA2251a | | | |
| 642 | MIOA7378a | SON DNA binding protein (SON) | X63753 | 7 |
| | mioa7825a | | | |
| | seoa6989 | | | |
| | seoa7755a | | | |
| | miob3236 | | | |
| | hfcr3835 | | | |
| | hfcr8812 | | | |
| 643 | MIOA8646 | polyposis locus (DP1 gene) | M73547 | 7 |
| | FCR3416 | | | |
| | MIOA2481a | | | |
| | MIOA3331a | | | |
| | mioa7661a | | | |
| | SEOA6263 | | | |
| | SOA0704 | | | |
| 644 | ncrc0259 | LENG7 mRNA, (=PRO2003 mRNA)(= elongation factor EF-1-alpha) | AF211972.1 | 7 |
| | ncrc8859 | | | |
| | ncr6859 | | | |
| | ncrb1451 | | | |
| | ncrb3131 | | | |
| | ncr9141 | | | |
| | ncr9066 | | | |

Figure 6A – EST Names Corresponding to Unique Known Genes of Figure 6

| | | | | |
|---|---|---|---|---|
| 645 | fcrb2212<br>fcrb2015<br>hfcr4662<br>hfcr5095<br>hfcr6275<br>hfcr6557<br>hfcr6842 | matrilin 1, cartilage matrix protein (MATN1) | NM_002379.2 | 7 |
| 646 | miob4343<br>ncr5880<br>ncrb5160<br>ncrc2991<br>ncrc3595<br>seob6132 | NADH dehydrogenase (ubiquinone) 1 beta subcomplex, 1 (7kD, MNLL) (NDUFB1) | NM_004545.1 | 6 |
| 647 | MIOA8804<br>miob3003<br>miob3918<br>miob5845<br>seob5335<br>seob7425 | proteasome (prosome, maCRopain) subunit, beta type, 1 (PSMB1) | NM_002793.1 | 6 |
| 648 | hfcr0695<br>hfcr5791<br>SEOA9163<br>SEOB3064<br>seob5592<br>seob7274 | Deleted in oral cancer-1 (DOC1) | NM_004642.1 | 6 |
| 649 | CR0179<br>fcrb2005<br>MIOA2794a<br>ncr4738<br>ncrb5521<br>seob7631 | cyclophilin-related protein (NKTR) gene (=PAC RPCI4-613B23) | AF184110.1 | 6 |
| 650 | MIOA9065<br>mioa9854<br>miob0811<br>ncrb8640<br>ncrc3776<br>seob6568 | NADH-UBIQUINONE OXIDOREDUCTASE CHAIN 1 | spP03886 | 6 |
| 651 | FCR2959<br>fcrb1666<br>hfcr9755<br>ncrb3284<br>ncrc0883<br>seoa7757a | myristoylated alanine-rich C-kinase substrate (=D10522 80K-L protein) | M68956 | 6 |
| 652 | FCR5714<br>MIOA2457a<br>SEOA3137m<br>SEOA7092a<br>SEOB1506 | signal recognition particle subunit 9 (SRP9) | U20998 | 6 |

Figure 6A – EST Names Corresponding to Unique Known Genes of Figure 6

| | | | | |
|---|---|---|---|---|
| | SEOB2941 | | | |
| 653 | fcrb0450 | heterogeneous nuclear ribonucleoprotein C (C1/C2) (HNRPC) | NM_004500.1 | 6 |
| | fcrb2634 | | | |
| | hfcr3570 | | | |
| | hfcr6391 | | | |
| | hfcr7945 | | | |
| | SEOA6580a | | | |
| 654 | hfcr1782 | laminin, alpha 4 (LAMA4) | NM_002290.1 | 6 |
| | hfcr2068 | | | |
| | hfcr3988 | | | |
| | miob1096 | | | |
| | ncr4066 | | | |
| | ncr8572 | | | |
| 655 | hfcr1800 | DRP-2 dihydropyrimidinase related protein 2 | AB020777.1 | 6 |
| | ncrb1218 | | | |
| | ncrb4685 | | | |
| | seob4393 | | | |
| | seob4972 | | | |
| | seob7544 | | | |
| 656 | MIOA7202a | HSPC307 | AF161425.1 | 6 |
| | miob3194 | | | |
| | miob6922 | | | |
| | ncr9648 | | | |
| | ncrb6545 | | | |
| | seob6314 | | | |
| 657 | FCR1493 | progesterone binding protein (HPR6.6) | gi5729874 | 6 |
| | hfcr5242 | | | |
| | MIOA0006a | | | |
| | miob1925 | | | |
| | SEOA1657a | | | |
| | SEOA6133a | | | |
| 658 | miob3319 | inositol 1,4,5-triphosphate receptor, type 2 (ITPR2) | NM_002223.1 | 6 |
| | ncr0911 | | | |
| | ncrc9470 | | | |
| | seob6096 | | | |
| | seob7321 | | | |
| 659 | hfcr1828 | ubiquinol-cytochrome c reductase hinge protein (UQCRH) | NM_006004.1 | 6 |
| | hfcr9364 | | | |
| | MIOA7063a | | | |
| | ncr3717 | | | |
| | ncrb0103 | | | |
| | ncrb4529 | | | |
| 660 | ncr9732 | eukaryotic translation initiation factor 4A, isoform 2(EIF4A2) | NM_001967.2 | 6 |
| | ncrb0362 | | | |
| | ncrb5085 | | | |
| | ncrb6064 | | | |
| | ncrc2495 | | | |
| | SEOA9146 | | | |
| 661 | FCR3156 | proteasome subunit HC9 | D00763 | 6 |

Figure 6A – EST Names Corresponding to Unique Known Genes of Figure 6

| | | | | |
|---|---|---|---|---|
| | FCR4958<br>MIOA0579a<br>MIOA2053<br>SEOA0909<br>SEOA8301 | | | |
| 662 | BFCS0021<br>hfcr3912<br>MIOA4092a<br>ncrb3804<br>SEOA8672<br>seob4675 | basic transCRiption factor 2 p44 (btf2p44) gene, partial cds, neuronal apoptosis inhibitory protein (naip) and survival motor neuron protein (smn) | U80017.1 | 6 |
| 663 | hfcr1203<br>hfcr3549<br>hfcr8537<br>miob4169<br>ncrb3516<br>seoa0979m | U50HG genes for U50' snoRNA and U50 snoRNA, complete sequence | AB017710 | 6 |
| 664 | FCR2421<br>FCR5670<br>FCR7657<br>hfcr5789<br>hfcr5902<br>hfcr9602 | alpha-2 globin (HBA1) | AF097635 | 6 |
| 665 | fcrb1916<br>hfcr7084<br>hfcr7342<br>MIOA0887a<br>ncrb4249<br>SEOB2199 | RAD21 (S. pombe) homolog (RAD21) (=X98294) | gi5453993 | 6 |
| 666 | ncrc4312<br>ncrc6832<br>SEOA9835<br>seob3960<br>seob5935<br>seob6156 | GDP dissociation inhibitor 2 (GDI2) | NM_001494.2 | 6 |
| 667 | miob0656<br>miob0804<br>ncr5508<br>ncr9024<br>ncrc3647<br>SEOA9643 | disabled 2 p93 (DAB2) (mitogen-responsive phosphoprotein) (DAB2) | AF188298.1 | 6 |
| 668 | MIOA2073<br>miob3863<br>miob3985<br>ncr7609<br>ncrb0016<br>ncrc9517 | KIAA1074 | AB028997.1 | 6 |

Figure 6A – EST Names Corresponding to Unique Known Genes of Figure 6

| | | | | |
|---|---|---|---|---|
| 669 | MIOA4184 | myeloid/lymphoid or mixed-lineage leukemia (trithorax (Drosophila) homolog); translocated to, 2 (MLLT2) | NM_005935.1 | 6 |
| | ncr5939 | | | |
| | ncr8703 | | | |
| | ncrc1992 | | | |
| | ncrc2644 | | | |
| | SEOA8265 | | | |
| 670 | MIOA1103 | N-terminal acetyltransferase complex ard1 subunit | AF085355.1 | 6 |
| | MIOA1278m | | | |
| | MIOA7277 | | | |
| | ncr5603 | | | |
| | SEOA7340a | | | |
| | SEOA7578a | | | |
| 671 | fcrb2676 | PRO1873 | AF119859.1 | 6 |
| | ncr5034 | | | |
| | ncr6257 | | | |
| | ncr8633 | | | |
| | ncrb4355 | | | |
| | ncrb7713 | | | |
| 672 | MIOA5833a | CMP-N-acetylneuraminic acid hydroxylase | AF074480.1 | 6 |
| | MIOA7183a | | | |
| | miob2956 | | | |
| | ncr5825 | | | |
| | SEOA0573 | | | |
| | SEOA2975a | | | |
| 673 | ncr9792 | somatic cytochrome c (HCS) gene | M22877.1 | 6 |
| | seob5073 | | | |
| | seob6377 | | | |
| | seob7454 | | | |
| | SOA0409 | | | |
| 674 | fcrb0702 | chaperonin containing T-complex subunit 6 (CCT6) = L27706.1 | NM_001762.1 | 6 |
| | hfcr6785 | | | |
| | ncrb0888 | | | |
| | ncrb1096 | | | |
| | SEOA9627 | | | |
| | seob4582 | | | |
| 675 | MIOA0400a | C2H2 zinc finger protein (ZNF189) | AF025772.1 | 6 |
| | MIOA6570a | | | |
| | miob0706 | | | |
| | SEOA0187a | | | |
| | SEOA7094a | | | |
| | SEOB2247 | | | |
| 676 | miob1706 | homeobox protein CDX4 (CDX4) gene | AF003530.1 | 6 |
| | ncr0904 | | | |
| | ncr3832 | | | |
| | ncr4865 | | | |
| | seob4900 | | | |
| | seob7554 | | | |
| 677 | FCR2907 | immunoglobulin light chain | D87000 | 6 |
| | FCR4393 | | | |

Figure 6A – EST Names Corresponding to Unique Known Genes of Figure 6

| | | | | |
|---|---|---|---|---|
| | MIOA1581 | | | |
| | MIOA2952a | | | |
| | MIOA5588a | | | |
| | SEOA1691a | | | |
| 678 | ncr4890 | antioxidant protein 1 (AOP1) (=peroxiredoxin 3 (PRDX3)) | NM_006793.1 | 6 |
| | ncrc2839 | | | |
| | SEOA3445a | | | |
| | SEOA5589a | | | |
| | seob6383 | | | |
| | seob7624 | | | |
| 679 | FCR1914 | lysosomal-associated membrane glycoprotein-1 (LAMP1) (=J04182) | L08582 | 6 |
| | MIOA8993 | | | |
| | miob3562 | | | |
| | miob5914 | | | |
| | ncr7696 | | | |
| | SEOA1636a | | | |
| 680 | MIOA2815a | glutaredoxin | X76648.1 | 6 |
| | miob4892 | | | |
| | ncrc9227 | | | |
| | seoa8047 | | | |
| | seob5490 | | | |
| | seob7169 | | | |
| 681 | hfcr0350 | cornichon protein | AF070654.1 | 6 |
| | MIOA5494a | | | |
| | mioa9911 | | | |
| | miob6193 | | | |
| | ncrc1904 | | | |
| | SEOA1301a | | | |
| 682 | MIOA2290a | dermatopontin | Z22865 | 6 |
| | MIOA4841a | | | |
| | ncr7747 | | | |
| | ncrc9704 | | | |
| | SEOA0920 | | | |
| | seob7728 | | | |
| 683 | fcrb0293 | myosin, light polypeptide 1, alkali; skeletal, fast (MYL1) | NM_002475.1 | 6 |
| | hfcr9628 | | | |
| | ncr5036 | | | |
| | ncr5424 | | | |
| | ncrc0266 | | | |
| | ncrc4135 | | | |
| 684 | hfcr3979 | CD36 antigen | L06850.1 | 6 |
| | hfcr5117 | | | |
| | MIOA6435a | | | |
| | miob4477 | | | |
| | ncrc5806 | | | |
| | SEOA6313 | | | |
| 685 | SEOA9610 | guanine nucleotide binding protein 11 (GNG11) = U31384.1 | NM_004126.1 | 6 |
| | MIOA2059n | | | |

Figure 6A – EST Names Corresponding to Unique Known Genes of Figure 6

| | | | | |
|---|---|---|---|---|
| | miob3442<br>ncrb1413<br>ncrb1848<br>ncrc1048 | | | |
| 686 | FCR2946<br>hfcr4663<br>ncr3248<br>ncrb0366<br>ncrc9100<br>seob5606 | vascular endothelial growth factor (VEGF) | AF024710.1 | 6 |
| 687 | hfcr3716<br>ncr0448<br>ncr0661<br>ncrb4941<br>ncrc4986<br>seob5612 | integrin alpha 10 subunit (ITGA10) | AF112345.1 | 6 |
| 688 | MIOA8121<br>miob0172<br>SEOA0393<br>SEOA8946<br>SEOB0014<br>SEOB3261 | HIC protein | AF054589 | 6 |
| 689 | ncr3184<br>ncr4505<br>ncr5984<br>ncrb1780<br>ncrb2003<br>seob7341 | KIAA0187 gene | NM_014753.1 | 6 |
| 690 | FCR2540<br>FCR6658<br>MIOA0188<br>MIOA6153a<br>ncrc0051<br>SEOA1903 | KIAA0436 | AB007896 | 6 |
| 691 | hfcr6412<br>miob4808<br>ncrc4835<br>ncrc9880<br>SEOA5699a<br>SEOB2814 | KIAA0530 | AB011102 | 6 |
| 692 | MIOA0067A<br>miob0983<br>ncr2553<br>SEOA2715<br>SEOA5977a<br>seob6277 | KIAA0569 | AB011141 | 6 |
| 693 | FCR6471<br>MIOA2190a<br>MIOA7592a<br>ncr6553<br>SEOA0950<br>SEOB0809 | KIAA0766 | AB018309.1 | 6 |

Figure 6A – EST Names Corresponding to Unique Known Genes of Figure 6

| | | | | |
|---|---|---|---|---|
| 694 | miob0596<br>miob4906<br>ncr3297<br>SEOA1314<br>seoa3178m<br>seob5344 | KIAA0942 protein (KIAA0942) | NM_015310.1 | 6 |
| 695 | MIOA0030a<br>SEOA0007<br>SEOA1897<br>SEOA3738a<br>SEOA5374<br>SEOA6641a | Pcp-2=Purkinje cell protein 2 | S40022 | 6 |
| 696 | MIOA0505n<br>MIOA2518a<br>MIOA3973a<br>MIOA6533a<br>MIOA7182a<br>ncrc4381 | PRO1073 | AF113016 | 6 |
| 697 | hfcr0615<br>hfcr3726<br>hfcr3771<br>hfcr7481<br>hfcr7487<br>hfcr8284 | PRO2640 | AF116710.1 | 6 |
| 698 | MIOA5979a<br>MIOA6825a<br>MIOA6850a<br>SEOA5894<br>SEOA6083a<br>SEOA6159a | SON protein | AF193606 | 6 |
| 699 | seob8241<br><br>ncr2520<br>ncrc3703<br>SEOA8528<br>SEOB2109<br>seob8241 | protein tyrosine phosphatase type IVA, member 2 (PTP4A2) | NM_003479.1 | 6 |
| 700 | FCR5509<br>hfcr4176<br>miob0944<br>miob3471<br>ncr8966<br>ncrb4057 | low density lipoprotein receptor | L00352 | 6 |
| 701 | MIOA8858<br><br>MIOA8894<br>SEOA1962a<br>hfcr0033<br>MIOA3788<br>MIOA3178a | ATP SYNTHASE GAMMA CHAIN, MITOCHONDRIAL PRECURSOR | spP36542 | 6 |
| 702 | FCR4622<br>HFCR3147 | cytochrome c oxidase subunit VIII (COX8) | J04823 | 6 |

Figure 6A – EST Names Corresponding to Unique Known Genes of Figure 6

| | | | | |
|---|---|---|---|---|
| | hfcr4776 | | | |
| | hfcr0818 | | | |
| | hfcr4203 | | | |
| | hfcr5820 | | | |
| 703 | SEOA1789a | leucine aminopeptidase | AF061738 | 6 |
| | ncr5718 | | | |
| | SEOB0345 | | | |
| | SEOB1614 | | | |
| | SEOA9719 | | | |
| | ncr7880 | | | |
| 704 | SEOA0470n | calpastatin | D50827 | 6 |
| | MIOA8201 | | | |
| | SEOA1848a | | | |
| | SEOA5437 | | | |
| | SEOA7081a | | | |
| | hfcr7677 | | | |
| 705 | SEOB3493 | threonyl-tRNA synthetase (TARS) | NM_003191.1 | 6 |
| | SEOA4402a | | | |
| | SEOA9372 | | | |
| | ncr0255 | | | |
| | seoa7033 | | | |
| | SEOB0675a | | | |
| 706 | SEOA7897a | ribosomal protein L33-like protein | AF047440 | 6 |
| | ncrb7195 | | | |
| | HFCR3117 | | | |
| | seob4671 | | | |
| | MIOA8856 | | | |
| | ncr9979 | | | |
| 707 | miob4424 | chaperonin containing TCP1 subunit 4 (delta) (CCT4) | NM_006430.1 | 6 |
| | hfcr6487 | | | |
| | hfcr1890 | | | |
| | ncrb2160 | | | |
| | seoa8124 | | | |
| | ncr2061 | | | |
| 708 | hfcr6687 | Finkel-Biskis-Reilly murine sarcoma virus (FBR-MuSV) | NM_001997.1 | 6 |
| | hfcr4125 | | | |
| | fcrb2382 | | | |
| | hfcr0964 | | | |
| | fcrb2651 | | | |
| | ncrc5376 | | | |
| 709 | MIOA3473a | Id-2H | D13891 | 6 |
| | FCR5297 | | | |
| | MIOA6202a | | | |
| | ncrc9908 | | | |
| | SEOB0005 | | | |
| | SEOA4446a | | | |
| 710 | FCR0274 | shox gene | U82668 | 6 |
| | hfcr9250 | | | |
| | hfcr4141 | | | |
| | hfcr7863 | | | |
| | hfcr7860 | | | |

Figure 6A – EST Names Corresponding to Unique Known Genes of Figure 6

| | | | | |
|---|---|---|---|---|
| | ncr1568 | | | |
| 711 | SEOB0128 | SOX4 | AF124147.1 | 6 |
| | MIOA6316a | | | |
| | SEOB1953 | | | |
| | ncr7035 | | | |
| | ncr4210 | | | |
| | ncr7425 | | | |
| 712 | SEOA7459a | transCRiption factor (CBFB) | L20298 | 6 |
| | hfcr6500 | | | |
| | ncrb1839 | | | |
| | SEOB0243 | | | |
| | SEOB0723 | | | |
| | SEOA9661 | | | |
| 713 | hfcr3441 | poly(rC)-binding protein 2 (PCBP2) | NM_005016.1 | 6 |
| | ncrb5742 | | | |
| | ncrc3244 | | | |
| | ncrb0564 | | | |
| | ncrb7115 | | | |
| | ncrb3300 | | | |
| 714 | ncr0317 | RNA-binding protein regulatory subunit | AF021819 | 6 |
| | seob5774 | | | |
| | BFCS0219 | | | |
| | FCR2416 | | | |
| | fcrb0250 | | | |
| | ncr5896 | | | |
| 715 | ncr3768 | Membrane cofactor protein | X59408.1 | 6 |
| | hfcr9297 | | | |
| | miob5828 | | | |
| | ncr3809 | | | |
| | ncr8508 | | | |
| | SEOA0775 | | | |
| 716 | SEOA2053 | catalase | X04076 | 6 |
| | MIOA1543 | | | |
| | MIOA2533a | | | |
| | SEOA2053 | | | |
| | miob6008 | | | |
| | ncrc4647 | | | |
| | miob3167 | | | |
| 717 | SEOA2436a | complement C1r | M14058 | 6 |
| | SOA0616 | | | |
| | FCR3050 | | | |
| | SEOA9841 | | | |
| | SEOA9656 | | | |
| | seob6402 | | | |
| 718 | ncr1186 | glutathione peroxidase 3 (plasma) (GPX3) | NM_002084.2 | 6 |
| | ncr8192 | | | |
| | ncrb2444 | | | |
| | ncr8401 | | | |
| | ncrc6668 | | | |
| | ncr9019 | | | |
| 719 | SEOA6751 | synaptophysin-like protein (SYPL) | gi5803184 | 6 |
| | SEOA8669 | | | |

Figure 6A – EST Names Corresponding to Unique Known Genes of Figure 6

| | | | | |
|---|---|---|---|---|
| | seob6710 | | | |
| | ncrc5023 | | | |
| | ncrc6308 | | | |
| | fcrb2466 | | | |
| 720 | miob5491 | CGI-07 protein | AF132941.1 | 6 |
| | ncrb1765 | | | |
| | seob6562 | | | |
| | MIOA5229a | | | |
| | ncrb7804 | | | |
| | seoa7680a | | | |
| 721 | MIOA6580a | CGI-148 protein | AF151906 | 6 |
| | MIOA7590a | | | |
| | seob7383 | | | |
| | SEOA9722 | | | |
| | SEOA9478 | | | |
| | SEOA4178a | | | |
| 722 | hfcr1671 | filamin (FLNB) | AF191633.1 | 6 |
| | miob5429 | | | |
| | hfcr6699 | | | |
| | ncrb8576 | | | |
| | hfcr9796 | | | |
| | bfcw0340n | | | |
| 723 | FCR0766 | chondroadherin (CHAD) | U96769 | 6 |
| | fcrb1608 | | | |
| | hfcr1927 | | | |
| | hfcr2572 | | | |
| | ncrb6441 | | | |
| | ncrc5155 | | | |
| 724 | FCR3823 | nonmuscle myosin heavy chain-B (MYH10) | M69181 | 6 |
| | hfcr0725 | | | |
| | hfcr7493 | | | |
| | SEOA9760 | | | |
| | FCR3199 | | | |
| | hfcr0720 | | | |
| 725 | hfcr4275 | conserved gene amplified in osteosarcoma (OS4) | NM_005730.1 | 6 |
| | ncr7149 | | | |
| | miob1711 | | | |
| | ncrc6309 | | | |
| | SEOA3486a | | | |
| | miob1882 | | | |
| 726 | hfcr3660 | signal sequence receptor, gamma (translocon-associated protein gamma) (SSR3) | NM_007107.1 | 6 |
| | ncrb0092 | | | |
| | SEOB2184 | | | |
| | ncrc6272 | | | |
| | ncr7270 | | | |
| | ncrb5301 | | | |
| 727 | SEOA3514a | okadaic acid-inducible and cAMP-regulated phosphoprotein 19 (ARPP-19) (=Y16968.1 I-myc homologue) | AF084555.1 | 6 |
| | hfcr4172 | | | |
| | hfcr6485 | | | |

Figure 6A – EST Names Corresponding to Unique Known Genes of Figure 6

| | | | | |
|---|---|---|---|---|
| | MIOA4343a | | | |
| | miob6685 | | | |
| | MIOA3082a | | | |
| 728 | SEOA4403a | SH3 domain-containing protein SH3P18 | U61167 | 6 |
| | FCR2818 | | | |
| | MIOA8084 | | | |
| | MIOB2144 | | | |
| | miob6440 | | | |
| | FCR3990 | | | |
| 729 | SEOB0976 | transformer-2 alpha (htra-2 alpha) | U53209.1 | 6 |
| | FCR1460 | | | |
| | hfcr0375 | | | |
| | hfcr8735 | | | |
| | seob4137 | | | |
| | ncrc5823 | | | |
| 730 | SEOA2233a | cullin 4A (CUL4A) | AF077188.1 | 6 |
| | MIOA6458a | | | |
| | miob3664 | | | |
| | ncrc3610 | | | |
| | SEOA4120a | | | |
| | SEOA9107 | | | |
| 731 | ncr0213 | dendritic cell protein (GA17)= AF064603 GA17 protein | NM_006360.1 | 6 |
| | ncrc9604 | | | |
| | ncrc0289 | | | |
| | ncrb2323 | | | |
| | ncr8054 | | | |
| | ncrc3246 | | | |
| 732 | SEOB3197 | voltage-dependent anion channel (VDAC1) | AF151097.1 | 6 |
| | ncr6293 | | | |
| | MIOA4930a | | | |
| | MIOA4943a | | | |
| | seob6357 | | | |
| | SEOA4197a | | | |
| 733 | MIOB2664 | bullous pemphigoid antigen (BPAG1) | L11690.1 | 6 |
| | miob3540 | | | |
| | ncr7176 | | | |
| | ncrb7556 | | | |
| | ncrc1408 | | | |
| | ncrc4295 | | | |
| 734 | SEOB3386 | IGSF4 gene | AB017563.1 | 6 |
| | MIOA1439 | | | |
| | SEOB2973 | | | |
| | SEOA8585 | | | |
| | seob6239 | | | |
| | SEOB1715 | | | |
| 735 | SEOA4730a | exportin 1 (CRM1,yeast, homolog) (XPO1)(ORF) =D89729, CRM1 protein, | NM_003400.1 | 6 |
| | MIOA5849a | | | |
| | SEOA9516 | | | |
| | SOA0058 | | | |
| | ncrc9586 | | | |

Figure 6A – EST Names Corresponding to Unique Known Genes of Figure 6

| | | | | |
|---|---|---|---|---|
| | miob3291 | | | |
| 736 | miob2375 | H3 histone, family 3B (H3.3B) (H3F3B) | NM_005324.1 | 6 |
| | fcrb1771 | | | |
| | fcrb1772 | | | |
| | hfcr7548 | | | |
| | ncrc2123 | | | |
| | hfcr0335 | | | |
| 737 | ncr8693 | Histone 4 family, member M (RefSeq aa 7e-53) | NP_003486.1 | 6 |
| | ncr6178 | | | |
| | ncrb2655 | | | |
| | ncrb1630 | | | |
| | ncrc3022 | | | |
| | ncrc6643 | | | |
| 738 | SEOA4822a | non-histone chromosome protein 2 (S. cerevisiae)-like 1 (NHP2L1)=D50420,OTK27 | NM_005008.1 | 6 |
| | hfcr3712 | | | |
| | fcrb0016 | | | |
| | ncrb4543 | | | |
| | ncrb6317 | | | |
| | ncrb5158 | | | |
| 739 | SEOA1237A | growth arrest specific transCRipt 5 gene | AF141346.1 | 6 |
| | MIOA7951a | | | |
| | hfcr9207 | | | |
| | hfcr9592 | | | |
| | ncrc9825 | | | |
| | SEOA8569 | | | |
| 740 | SEOB3520 | SPHAR gene for cyclin-related protein | X82554.1 | 6 |
| | mioa9997 | | | |
| | ncrb4597 | | | |
| | seob4477 | | | |
| | ncrb0859 | | | |
| | SEOA0240a | | | |
| 741 | MIOA2333a | H-2K binding factor-2 | D14041 | 6 |
| | seoa0461m | | | |
| | SEOA4036a | | | |
| | SEOA6555a | | | |
| | SEOA8366a | | | |
| | ncrb3320 | | | |
| 742 | seob5621 | KIAA0349 gene | AB002347.1 | 6 |
| | miob0647 | | | |
| | ncrb4506 | | | |
| | ncrb5811 | | | |
| | ncr0148 | | | |
| | hfcr3746 | | | |
| 743 | SEOB1908 | KIAA0885 | AB020692.1 | 6 |
| | SEOA8583 | | | |
| | ncrb2651 | | | |
| | ncrb1336 | | | |
| | SEOA1398 | | | |
| | SEOA3405a | | | |
| 744 | SEOB0950 | KIAA1025 | AB028948.1 | 6 |
| | MIOA1128 | | | |

Figure 6A – EST Names Corresponding to Unique Known Genes of Figure 6

| | | | | |
|---|---|---|---|---|
| | MIOB1518 | | | |
| | mioa1127m | | | |
| | hfcr9528 | | | |
| | ncrc5946 | | | |
| 745 | MIOA0493 | LGMD2B | AJ007973 | 6 |
| | SOA0482 | | | |
| | hfcr7958 | | | |
| | miob2360 | | | |
| | miob6443 | | | |
| | ncrc6939 | | | |
| 746 | FCR5026 | 6-phosphofructo-2-kinase/fructose-2,6-bisphosphatase (PF2K) (=AB007902 KIAA0442) | AF041832 | 6 |
| | SEOA1361 | | | |
| | FCR2817 | | | |
| | hfcr4652 | | | |
| | ncrc2796 | | | |
| | hfcr9564 | | | |
| 747 | MIOA8998 | protein phosphatase 1 catalytic subunit, beta isoform (PPP1CB) | NM_002709.1 | 6 |
| | seob4826 | | | |
| | ncr4122 | | | |
| | SEOA1116a | | | |
| | ncr1405 | | | |
| | ncr5392 | | | |
| 748 | SEOA0285 | mitochondrial 16S rRNA | Z70759 | 6 |
| | mioa0762m | | | |
| | SEOA1241A | | | |
| | CR0928 | | | |
| | FCR3940 | | | |
| | SEOB1358 | | | |
| 749 | SEOB2792 | mitochondrial coxII | X55654.1 | 6 |
| | FCR1749 | | | |
| | FCR1465 | | | |
| | FCR5408 | | | |
| | MIOA4643a | | | |
| | mioa9983 | | | |
| 750 | SEOA0150 | glutaminase C | AF158555.1 | 6 |
| | SEOA8539 | | | |
| | ncrc1549 | | | |
| | miob2384 | | | |
| | ncr7103 | | | |
| | ncrc3453 | | | |
| 751 | miob2478 | DNA-binding protein A gene | L29073.1 | 6 |
| | SEOB1354 | | | |
| | SEOB1365 | | | |
| | hfcr8418 | | | |
| | ncr6210 | | | |
| | ncrb1117 | | | |
| 752 | FCR7744 | general transcription factor 2-I (GTF2I) | AF038968 | 6 |
| | BFCS0407 | | | |
| | hfcr6694 | | | |
| | ncr2543 | | | |

Figure 6A – EST Names Corresponding to Unique Known Genes of Figure 6

| | | | | |
|---|---|---|---|---|
| | hfcr6016 | | | |
| | ncr7742 | | | |
| 753 | mioa9679 | YME1 (S.cerevisiae)-like 1(YME1L1), = AJ132637.1 ATP-dependent metalloprotease YME1L (ORF) | NM_014263.1 | 6 |
| | hfcr6352 | | | |
| | ncr1319 | | | |
| | ncrc6000 | | | |
| | MIOA1432 | | | |
| | SEOA2219a | | | |
| 754 | seob4807 | splicing factor, arginine/serine-rich (transformer 2 Drosophila homolog)(SFRS10) | NM_004593.1 | 6 |
| | hfcr9217 | | | |
| | SEOA9022 | | | |
| | SEOB1682 | | | |
| | SOA0161 | | | |
| | hfcr2131 | | | |
| 755 | SEOA5784 | LIM and SH3 protein 1 (LASP1) (=X82456 MLN50) | gi5453709 | 6 |
| | hfcr5177 | | | |
| | MIOA0271 | | | |
| | hfcr7830 | | | |
| | CR0219 | | | |
| | SEOA2098 | | | |
| 756 | SEOA5358 | TGF-beta inducible early protein (TIEG) | U21847 | 6 |
| | ncrb5869 | | | |
| | ncrc5458 | | | |
| | hfcr3848 | | | |
| | SEOA5615a | | | |
| | ncrb3329 | | | |
| 757 | hfcr1724 | pigment epithelium-derived factor (PEDF) | NM_002615.1 | 6 |
| | hfcr6870 | | | |
| | hfcr7833 | | | |
| | BFCN0013 | | | |
| | hfcr7440 | | | |
| | hfcr3065 | | | |
| 758 | SEOB3499 | ARP2/3 protein complex subunit 34 (ARC34) | NM_005731.1 | 6 |
| | fcrb0140 | | | |
| | SEOA1813a | | | |
| | SEOA3189 | | | |
| | FCR1881N | | | |
| | ncrc5648 | | | |
| 759 | SEOA0915 | high mobility group 2 protein (HMG-2) | M83665 | 6 |
| | miob1172 | | | |
| | soa0197n | | | |
| | ncrb8219 | | | |
| | hfcr4439 | | | |
| | fcrb2458 | | | |
| 760 | SEOA4646a | jumping translocation breakpoint (JTB) =AB016488 hJTB (ORF) | NM_006694.1 | 6 |
| | ncrb1911 | | | |
| | ncrc3417 | | | |
| | BFCW0333 | | | |
| | SEOA7626a | | | |

Figure 6A – EST Names Corresponding to Unique Known Genes of Figure 6

| | | | | |
|---|---|---|---|---|
| | SEOA7640a | | | |
| 761 | seob8220 | murine leukemia viral (bmi-1) oncogene homolog (BMI1) | NM_005180.1 | 6 |
| | ncrb5247 | | | |
| | ncrc0904 | | | |
| | SEOA2126n | | | |
| | SEOA9678 | | | |
| | mioa2126m | | | |
| 762 | SEOA8566 | 13kDa differentiation-associated protein | AAF17196.1 | 6 |
| | seoa4977a | | | |
| | SEOA9376 | | | |
| | SEOA9605 | | | |
| | ncrb6853 | | | |
| | ncr2783 | | | |
| 763 | ncrc9793 | hypothetical protein Nop10p (RefSeq aa 1e-33) | NP_061118.1 | 6 |
| | ncr0648 | | | |
| | ncrc3681 | | | |
| | ncr6315 | | | |
| | ncrc3009 | | | |
| | ncrc5705 | | | |
| 764 | SEOA1348 | KIAA0103 | D14659 | 6 |
| | mioa3137an | | | |
| | ncr7551 | | | |
| | seoa1348 | | | |
| | SEOA9416 | | | |
| | hfcr6131 | | | |
| 765 | ncrb7102 | p130 (130K protein) | X76061.1 | 6 |
| | SOA0056 | | | |
| | ncrc0207 | | | |
| | ncrc0889 | | | |
| | ncrc1004 | | | |
| | miob6408 | | | |
| 766 | MIOB2724 | S1R protein (S1R) (=CGI-119) | AF113127.1 | 6 |
| | SEOA5994a | | | |
| | seob4211 | | | |
| | seoa7989 | | | |
| | ncr0918 | | | |
| | ncrb8318 | | | |
| 767 | MIOA5955a | ATP synthase, H transporting, mitochondrial F0 complex, subunit c (subunit 9), isoform 1 (ATP5G1) (ORF) | NM_005175.1 | 6 |
| | ncr6126 | | | |
| | ncr6223 | | | |
| | ncr6236 | | | |
| | miob3229 | | | |
| | MIOA4283 | | | |
| 768 | ncr0075 | fragile X mental retardation 1 (FMR1) | NM_002024.1 | 6 |
| | fcrb1974 | | | |
| | miob6546 | | | |
| | ncrc0924 | | | |
| | ncrc2070 | | | |
| | ncrb3355 | | | |

Figure 6A – EST Names Corresponding to Unique Known Genes of Figure 6

| | | | | |
|---|---|---|---|---|
| 769 | MIOA6135a<br>SEOA9353<br>SOA0165<br>ncrc5608<br>SEOA0316<br>SEOA1356 | nucleobindin 2 (NUCB2)(NEFA protein) | X76732 | 6 |
| 770 | SEOA8397a<br>MIOB1558<br>ncrb1624<br>seob6528<br>mioa7699a<br>seoa7748a | progesterone membrane binding protein (PMBP) | 5453915 | 6 |
| 771 | ncr9772<br>hfcr4223<br>hfcr6761<br>ncrc0635<br>ncrc3620<br>ncr7560 | melanoma inhibitory | NM_006533.1 | 6 |
| 772 | MIOB2641<br>hfcr8275<br>miob1455<br>miob6414<br>SEOA9374<br>SEOB1567 | KIAA1250 | AB033076.1 | 6 |
| 773 | ncr0189<br>ncr1240<br>ncr8649<br>ncrb2351<br>seob3748<br>mioa9259 | ORF2 [Canis familiaris](60%) | AB012223 | 6 |
| 774 | seob5730<br>seob6483<br>SEOB3252<br>ncr2058<br>ncr4208<br>ncr6110 | POLR2K gene for RPB10 alpha | AJ252078.1 | 6 |
| 775 | MIOA4643a<br>mioa9983<br>SEOB2792<br>FCR5408<br>FCR1749<br>FCR1465 | cytochrome C oxidase II subunit (ORF) | X55654 | 6 |
| 776 | FCR4633<br><br>hfcr1590<br>CR0857<br>miob1209<br>ncrc7189<br>seob4669 | karyopherin (importin) beta 1 (KPNB1) (=L38951 importin beta subunit) | gi4504904 | 6 |
| 777 | ncrc6553 | CD59 antigen p18-20 (antigen identified by monoclonal antibodies 16.3A5, EJ16, EJ30, EL32 and G344) (CD59) | NM_000611.1 | 6 |

Figure 6A – EST Names Corresponding to Unique Known Genes of Figure 6

| | | | | |
|---|---|---|---|---|
| | HFCR3081 | | | |
| | SEOA5775 | | | |
| | seob4103 | | | |
| | ncrb1896 | | | |
| | ncrb1856 | | | |
| 778 | MIOB1094 | CAR (RFP2) | AF279660 | 6 |
| | bfcn0217n | | | |
| | fcrb2023 | | | |
| | seoa0124nn | | | |
| | mioa5565a | | | |
| | mioa7915 | | | |
| 779 | ncrc7181 | signal peptidase complex (18kD) (SPC18) | NM_014300.1 | 6 |
| | SEOB0490 | | | |
| | ncrb4948 | | | |
| | fcr4976n | | | |
| | miob6747 | | | |
| | ncrc1025 | | | |
| 780 | mioa7857 | basic helix-loop-helix domain containing, class B, 2 (BHLHB2), mRNA /cds=(196,1434) /gb=NM_003670 /gi=4503298 /ug=Hs.171825 /len=2922 | Hs.171825 | 6 |
| | ncrb8797 | | | |
| | SEOA8638 | | | |
| | SEOB0592 | | | |
| | SEOB0598 | | | |
| | hfcr1185 | | | |
| 781 | miob1355 | 5-aminoimidazole-4-carboxamide ribonucleotide | NM_004044.1 | 6 |
| | seob6473 | | | |
| | MIOA8782 | | | |
| | FCR4676 | | | |
| | miob2528 | | | |
| | SEOB0971 | | | |
| 782 | ncr0287 | actin, alpha 2, smooth muscle, aorta (ACTA2) (ORF)= J05192.1 | NM_001613.1 | 5 |
| | ncr2635 | | | |
| | ncrb3585 | | | |
| | ncrb3944 | | | |
| | ncrc3564 | | | |
| 783 | hfcr9778 | NADH dehydrogenase(ubiquinone) 1 beta subcomplex, 3 (12kD, B12) (NDUFB3) | NM_002491.1 | 5 |
| | mioa3852n | | | |
| | miob0376 | | | |
| | miob2355 | | | |
| | seob6618 | | | |
| 784 | BFCN0018 | heterogeneous nuclear ribonucleoprotein (hnRNP) core protein A1 | X12671 | 5 |
| | FCR4486 | | | |
| | hfcr6912 | | | |
| | SEOA1075a | | | |
| | SEOA1075a | | | |
| 785 | SEOB1357 | eukaryotic translation initiation factor 3, subunit 10 (theta, 150/170kD) | gi4503508 | 5 |
| | SEOB1357 | | | |

Figure 6A – EST Names Corresponding to Unique Known Genes of Figure 6

| | | | | |
|---|---|---|---|---|
| | hfcr8963 | | | |
| | miob4606 | | | |
| | ncrb1514 | | | |
| 786 | MIOA1628a | adenylyl cyclase-associated protein (CAP) | L12168 | 5 |
| | MIOA1911a | | | |
| | miob6258 | | | |
| | SEOA5986a | | | |
| | SEOB2745 | | | |
| 787 | ncr5499 | tetratricopeptide repeat domain 3 (TTC3)(= DCRR1 )(= TPRDIII) | NM_003316.1 | 5 |
| | ncr7417 | | | |
| | ncrb7614 | | | |
| | ncrc2641 | | | |
| | SEOB3517 | | | |
| 788 | hfcr2651 | endothelial differentiation-related factor 1 (EDF1) | NM_003792.1 | 5 |
| | hfcr7455 | | | |
| | ncrc4130 | | | |
| | seob7024 | | | |
| | fcrb2765 | | | |
| 789 | CR0778 | ATP SYNTHASE A CHAIN (PROTEIN 6)(ORF) | P00846 | 5 |
| | FCR6882 | | | |
| | hfcr0242 | | | |
| | ncr0221 | | | |
| | ncr1046 | | | |
| 790 | FCR2508 | NADH-ubiquinone oxidoreductase subunit CI-B14 | AF047182 | 5 |
| | FCR4175 | | | |
| | MIOA4763 | | | |
| | MIOA8252 | | | |
| | SEOA7921a | | | |
| 791 | hfcr5881 | MHC class 1 region | AF055066 | 5 |
| | MIOA1763 | | | |
| | MIOA3969a | | | |
| | ncrc2058 | | | |
| | ncrc5587 | | | |
| 792 | hfcr7512 | plastin 3 (T isoform) (PLS3) | NM_005032.2 | 5 |
| | miob4132 | | | |
| | miob4132 | | | |
| | ncrb0415 | | | |
| | ncrc6977 | | | |
| 793 | MIOA0510 | hexosaminidase B (beta polypeptide) (HEXB)(ORF) | NM_000521.1 | 5 |
| | ncr4385 | | | |
| | ncr7017 | | | |
| | ncrb6361 | | | |
| | seob5415 | | | |
| 794 | hfcr0503 | breast cancer associated gene 1 protein (BCG1) (ORF) | AF128528.1 | 5 |
| | hfcr0985 | | | |
| | hfcr3916 | | | |
| | hfcr7081 | | | |
| | hfcr9191 | | | |
| 795 | FCR4719 | ornithine decarboxylase antizyme | D87914 | 5 |
| | fcrb0057 | | | |

Figure 6A – EST Names Corresponding to Unique Known Genes of Figure 6

| | | | | |
|---|---|---|---|---|
| | hfcr0282<br>hfcr7611<br>ncr0851 | | | |
| 796 | MIOA1636a<br>MIOA1876a<br>miob1131<br>SEOB0077<br>seob7022 | enterocyte differentiation associated factor EDAF-1 | U62136.2 | 5 |
| 797 | miob6338<br>ncr4606<br>ncrb0157<br>ncrc1679<br>SEOA4140a | four and a half LIM domains 1 (FHL1) | NM_001449.1 | 5 |
| 798 | fcrb0157<br>hfcr7695<br>ncr0170<br>ncr1597<br>seob5419 | translocase of outer mitochondrial membrane 20 (yeast) homolog (KIAA0016), | NM_014765.1 | 5 |
| 799 | fcrb0727<br>hfcr1347<br>MIOA4651a<br>MIOB2737<br>miob6829<br>SEOA4717a | mouse tropomyosin homolog (HSPC001) =AF047439(ORF) | NM_004872.1 | 5 |
| 800 | MIOA0940<br>MIOA3260a<br>ncrc6637<br>SEOA0727a<br>seob3753 | DNA polymerase zeta catalytic subunit (REV3) | AF157476.1 | 5 |
| 801 | FCR0821<br>FCR2648<br>FCR5513<br>SEOA0356<br>SEOA3863 | eukaryotic initiation factor 4 gamma (eIF-4 gamma) | D12686 | 5 |
| 802 | FCR0946N<br>fcrb1741<br>hfcr3479<br>hfcr4499<br>hfcr7513 | eukaryotic translation initiation factor 4A, isoform 1 (EIF4A1) | D13748 | 5 |
| 803 | MIOA2150<br>MIOA4882a<br>MIOA4946a<br>SEOA8582<br>SEOB1898 | E6-AP ubiquitin-protein ligase (UBE3A) | AF009341.1 | 5 |
| 804 | fcrb1561<br>fcrb2091<br>fcrb2134<br>hfcr3738 | prolyl 4-hydroxylase beta-subunit and disulfide isomerase (P4HB) | M22806.1 | 5 |

Figure 6A – EST Names Corresponding to Unique Known Genes of Figure 6

| | | | | |
|---|---|---|---|---|
| | hfcr6176 | | | |
| 805 | HFCR3155<br>ncr1786<br>ncr5526<br>ncrb5363<br>seoa7004 | archain 1 (ARCN1) | gi4502194 | 5 |
| 806 | CR0959<br>mioa9356<br>ncr6898<br>SEOA1109a<br>seob6092 | protein kinase C inhibitor-I | U27143 | 5 |
| 807 | FCR1598N<br>fcrb0114<br>miob6098<br>ncrc1986<br>ncrc3313 | serine/threonine kinase KPM | AF207547.1 | 5 |
| 808 | hfcr2759<br>miob5937<br>ncr6797<br>ncrb2503<br>seob5260 | fibroblast growth factor 2 (basic)(FGF2) | NM_002006.1 | 5 |
| 809 | miob0278<br>ncrc6526<br>seoa6950<br>SEOA9761<br>SEOB3258 | predicted osteoblast protein (GS3786), mRNA | NM_014888.1 | 5 |
| 810 | SEOB0509<br>miob0978<br>miob5676<br>seob3881<br>seob7185 | HSPC204 | AF151038.1 | 5 |
| 811 | MIOA1544<br>MIOA1761<br>MIOA4010a<br>ncr8101<br>SEOB0906a | KIAA0579 | AB011151.1 | 5 |
| 812 | MIOA1515<br>SEOA3628a<br>SEOA3689a<br>SEOA3960a<br>SEOB3356 | Rap1B | U07795 | 5 |
| 813 | MIOA0317<br>SEOA0533<br>SEOA1182A<br>seob5631<br>seob7582 | X (inactive)-specific transCRipt (XIST) | M97168 | 5 |
| 814 | MIOA8320<br>BFCW0325<br>FCR0677<br>ncrb0136<br>ncrb4885 | alcohol dehydrogenase,class III (ADH5) chi subunit | M30471 | 5 |

Figure 6A – EST Names Corresponding to Unique Known Genes of Figure 6

| | | | | |
|---|---|---|---|---|
| 815 | SEOB2661 | diphosphoinositol polyphosphate phosphohydrolase type 2 (NUDT4) | AF191654.2 | 5 |
| | miob5793 | | | |
| | ncr1098 | | | |
| | ncrb2186 | | | |
| | seob5622 | | | |
| 816 | MIOA1310 | phosphatidic acid phosphatase 2a | AB000888 | 5 |
| | FCR0141 | | | |
| | FCR7002 | | | |
| | ncrb0293 | | | |
| | ncrc1498 | | | |
| 817 | SEOB0248 | NADH dehydrogenase (ubiquinone) 1 beta subcomplex, 9 (22kD, B22) (NDUFB9) | NM_005005.1 | 5 |
| | hfcr4134 | | | |
| | hfcr9345 | | | |
| | seob5360 | | | |
| | seob6636 | | | |
| 818 | hfcr0669 | NADH dehydrogenase(ubiquinone) 1, alpha/beta subcomplex, 1 (8kD, SDAP)(NDUFAB1) mRNA | NM_005003.1 | 5 |
| | ncrc9166 | | | |
| | MIOA7040a | | | |
| | ncrb1914 | | | |
| | seob2334 | | | |
| 819 | miob6188 | selenoprotein W (hSelW) | AF015283.1 | 5 |
| | FCR6107 | | | |
| | ncrc6511 | | | |
| | ncr3500 | | | |
| | ncrb1532 | | | |
| 820 | hfcr6164 | frizzled (Drosophila) homolog 1 (FZD1) | NM_003505.1 | 5 |
| | seob6242 | | | |
| | miob5102 | | | |
| | seoa0985m | | | |
| | SEOA5370 | | | |
| 821 | miob3911 | nuclear factor I/B (NFIB) | NM_005596.1 | 5 |
| | fcr3494n | | | |
| | ncr0605 | | | |
| | ncrc5282 | | | |
| | ncrc9204 | | | |
| 822 | HFCR2390 | heterogeneous nuclear ribonucleoprotein M (HNRPM) | 5174610 | 5 |
| | ncr3281 | | | |
| | ncr3858 | | | |
| | ncrc6353 | | | |
| | hfcr0961 | | | |
| 823 | SEOA9705 | heterogeneous nuclear ribonucleoprotein R (ORF) | AF000364 | 5 |
| | hfcr8939 | | | |
| | MIOA0329n | | | |
| | mioa0766n | | | |
| | ncrb7626 | | | |
| 824 | seob4145 | nuclear protein (NP220) | NM_014497.1 | 5 |
| | hfcr6824 | | | |
| | seob7074 | | | |
| | SOA0429 | | | |

Figure 6A – EST Names Corresponding to Unique Known Genes of Figure 6

| | | | | |
|---|---|---|---|---|
| | SEOA0898 | | | |
| 825 | MIOA2300a | T-cell receptor alpha delta locus | AE000659 | 5 |
| | FCR0081 | | | |
| | MIOA2596a | | | |
| | miob0986 | | | |
| | FCR0567 | | | |
| 826 | miob3107 | translocase of inner mitochondrial membrane 17 (yeast) homolog A (TIM17), mRNA | NM_006335.1 | 5 |
| | ncr1425 | | | |
| | ncrc1971 | | | |
| | ncrc3053 | | | |
| | ncrc4089 | | | |
| 827 | SEOB1889 | miCRosomal glutathione S-transferase 3 (MGST3) | AF026977.1 | 5 |
| | seob6050 | | | |
| | ncrc2832 | | | |
| | ncrc9941 | | | |
| | ncrc0356 | | | |
| 828 | MIOA2537a | copine III (CPNE3) (=AB014536 KIAA0636) | gi4503014 | 5 |
| | seob7100 | | | |
| | seoa6761 | | | |
| | ncr8341 | | | |
| | ncrb3029 | | | |
| | ncr1004 | | | |
| 829 | hfcr2201 | Golgi apparatus protein 1 (GLG1) | NM_012201.1 | 5 |
| | ncr6757 | | | |
| | hfcr7555 | | | |
| | ncrc3695 | | | |
| | ncrc5363 | | | |
| 830 | MIOA0192 | destrin (actin depolymerizing factor) (ADF) | 5802965 | 5 |
| | hfcr7375 | | | |
| | seoa0800m | | | |
| | hfcr0425 | | | |
| | MIOA9175 | | | |
| 831 | seob3905 | growth arrest and DNA-damage-inducible, alpha (GADD45A) | NM_001924.1 | 5 |
| | SEOA3665a | | | |
| | SEOA8604 | | | |
| | hfcr9666 | | | |
| | ncr8870 | | | |
| 832 | SEOB1426 | 5T4 oncofetal trophoblast glycoprotein (5T4) | NM_006670.1 | 5 |
| | ncrc1875 | | | |
| | ncrc4357 | | | |
| | MIOA4590a | | | |
| | ncr9027 | | | |
| 833 | seob5342 | Autosomal Highly Conserved Protein (AHCP) (=DKFZp586G051) | NM_016255.1 | 5 |
| | ncrb0492 | | | |
| | ncrc1763 | | | |
| | miob6121 | | | |
| | ncrc9116 | | | |
| 834 | MIOB2869 | Diff33 protein homolog | AF164794.1 | 5 |
| | FCR3579 | | | |

Figure 6A – EST Names Corresponding to Unique Known Genes of Figure 6

| | | | | |
|---|---|---|---|---|
| | seob5434<br>SEOB3017<br>seob4026 | | | |
| 835 | seob5556<br>hfcr6308<br>hfcr3437<br>ncrb6034<br>hfcr5912 | G8 protein (G8) | NM_016947.1 | 5 |
| 836 | MIOA1279m<br>MIOB1540<br>SEOA1643a<br>miob0919<br>mioa7807a | HSPC067 | AF161552_1 | 5 |
| 837 | ncr3084<br>ncr4369<br>ncrc1336<br>ncrc1828<br>ncrc6535 | HSPC316 | AF161434.1 | 5 |
| 838 | SEOB0497<br>MIOA0167<br>SEOA9653<br>seob4237<br>MIOA5356a | HSPCO34 protein | AF100747.1 | 5 |
| 839 | seob7658<br>ncrb1639<br>FCR1106<br>MIOA2004<br>seob7056 | KIAA0077 gene | D38521.1 | 5 |
| 840 | SEOA1992<br>FCR0785<br>FCR3435<br>FCR5951<br>ncrb5343 | KIAA0107 | D14663 | 5 |
| 841 | seob4560<br>miob0915<br>ncr1675<br>ncrc0802<br>MIOA0452 | KIAA0127 | NM_014755.1 | 5 |
| 842 | FCR2966<br>miob5732<br>ncr6155<br>ncrc3936<br>ncr3520 | KIAA0174 | D79996 | 5 |
| 843 | FCR4084<br>SEOA3018a<br>MIOA0323<br>SEOA5747a<br>seob5941 | KIAA0244 gene | D87685 | 5 |
| 844 | MIOA1226<br>MIOA3645a<br>MIOA6537a<br>hfcr4143 | KIAA0265 | D87454 | 5 |

Figure 6A – EST Names Corresponding to Unique Known Genes of Figure 6

| | | | | |
|---|---|---|---|---|
| | hfcr8394 | | | |
| 845 | MIOA0804 | KIAA0308 | AB002306 | 5 |
| | ncr4372 | | | |
| | miob3331 | | | |
| | miob6074 | | | |
| | ncr6809 | | | |
| 846 | seob6584 | KIAA0325 gene | AB002323.1 | 5 |
| | ncrc6852 | | | |
| | FCR3803 | | | |
| | FCR4027 | | | |
| | hfcr1178 | | | |
| 847 | SEOA6530a | KIAA0382 | AB002380 | 5 |
| | ncr1409 | | | |
| | SEOA9902 | | | |
| | MIOA4061a | | | |
| | MIOA4797a | | | |
| 848 | MIOA6147a | KIAA0577 | AB011149 | 5 |
| | MIOA6434a | | | |
| | SEOA5572a | | | |
| | ncr3899 | | | |
| | ncrc0534 | | | |
| 849 | ncr0034 | KIAA0670 protein/acinusL (no-exact match 42% a.a.) | NP_055792.1 | 5 |
| | hfcr7105 | | | |
| | SEOA3701a | | | |
| | FCR5200 | | | |
| | ncr0034 | | | |
| 850 | seob4087 | KIAA0680 gene product (KIAA0680) | NM_014721.1 | 5 |
| | ncr2613 | | | |
| | ncrb4278 | | | |
| | miob3096 | | | |
| | seob7093 | | | |
| 851 | ncr3368 | KIAA0853 | AB020660.1 | 5 |
| | ncrb0506 | | | |
| | ncrb0491 | | | |
| | seob3889 | | | |
| | MIOA7059a | | | |
| 852 | SEOA2952a | KIAA0977 | AB023194.1 | 5 |
| | MIOA5986a | | | |
| | MIOA9162 | | | |
| | miob4396 | | | |
| | ncr8971 | | | |
| 853 | SEOA6184a | KIAA1013 | AB023230.1 | 5 |
| | SEOB1293 | | | |
| | ncrc9596 | | | |
| | ncrc9874 | | | |
| | ncr0366 | | | |
| | miob3052 | | | |
| 854 | hfcr7671 | KIAA1053 | AB028976.1 | 5 |
| | SEOA5705a | | | |
| | MIOA4754 | | | |
| | MIOA5006a | | | |
| | SEOA9038 | | | |

Figure 6A – EST Names Corresponding to Unique Known Genes of Figure 6

| | | | | |
|---|---|---|---|---|
| 855 | SEOA1228A<br>MIOA3291a<br>ncr6887<br>ncr0456<br>ncrc9959 | meningioma-expressed antigen 5 (MEA5) (=KIAA0679) | AF036145 | 5 |
| 856 | hfcr9242<br>hfcr0341<br>hfcr6069<br>ncr6897<br>FCR6235 | myeloid leukemia factor 2 (MLF2) | NM_005439.1 | 5 |
| 857 | SEOB2259<br>MIOA8191<br>miob3916<br>seob4778<br>ncr0292 | NY-REN-45 antigen (LOC51133) | NM_016121.1 | 5 |
| 858 | hfcr0023<br>HFCR3077<br>hfcr6532<br>FCR3822<br>hfcr0119 | PEG1/MEST | D87367.1 | 5 |
| 859 | hfcr2725<br>hfcr6546<br>hfcr8968<br>ncr0923<br>fcrb1513 | PRO2605 | AF116709.1 | 5 |
| 860 | seob4591<br>hfcr0246<br>miob3431<br>seob5006<br>SEOA9796 | PRO2751 | AF119896.1 | 5 |
| 861 | MIOA8652<br>SEOA4697a<br>ncrc6395<br>MIOA4474a<br>ncr8741 | PTH-responsive osteosarcoma D1 protein | AAD25980.1 | 5 |
| 862 | SEOA3207<br>MIOA8498<br>ncrc9163<br>SEOA0226a<br>ncr2297 | seCReted protein of unknown function (SPUF) | AF173937.1 | 5 |
| 863 | SEOA8642<br>ncr3551<br>ncrb5377<br>fcrb1152<br>SEOA9609 | steroid sensitive gene-1 protein (SSG-1) | AF223677.1 | 5 |
| 864 | hfcr0347<br>hfcr1001<br>hfcr1367<br>hfcr1388<br>hfcr4651 | uncoupling protein 2 (ucp2 gene homologue) | AJ243250.1 | 5 |

Figure 6A – EST Names Corresponding to Unique Known Genes of Figure 6

| | | | | |
|---|---|---|---|---|
| 865 | hfcr0545 | X-linked anhidroitic ectodermal dysplasia protein gene (EDA), exon 2 and flanking repeat regions | AF003528.1 | 5 |
| | ncrb5925 | | | |
| | ncrc8907 | | | |
| | ncrc0857 | | | |
| | ncrc9773 | | | |
| 866 | hfcr3445 | S100 calcium-binding protein A13 (S100A13) | NM_005979.1 | 5 |
| | ncrb7829 | | | |
| | hfcr8655 | | | |
| | ncrb6415 | | | |
| | hfcr9742 | | | |
| 867 | hfcr9052 | pyruvate dehydrogenase (lipoamide) alpha 1 (PDHA1) | NM_000284.1 | 5 |
| | MIOA6773a | | | |
| | hfcr1402 | | | |
| | ncr7413 | | | |
| | MIOA2714a | | | |
| 868 | SEOA3578a | protein x 0001 | AF117230 | 5 |
| | MIOA6124a | | | |
| | SEOA3525a | | | |
| | seob7101 | | | |
| | ncrb6041 | | | |
| 869 | MIOA5346a | PTEN (PTEN) gene | AF143312.1 | 5 |
| | ncr6647 | | | |
| | ncr2129 | | | |
| | ncrc2820 | | | |
| | SEOA9406 | | | |
| 870 | MIOA9147 | lipoprotein lipase (LPL) | NM_000237.1 | 5 |
| | MIOA2642 | | | |
| | miob2419 | | | |
| | miob3712 | | | |
| | ncrc9466 | | | |
| 871 | hfcr0967 | CYTOCHROME C OXIDASE POLYPEPTIDE III | P00414 | 5 |
| | miob0875 | | | |
| | ncrc2056 | | | |
| | SEOA8962 | | | |
| | SEOA9392 | | | |
| 872 | ncr8640 | NADH dehydrogenase subunit 1(RefSeq aa 2e-70) | gi5835388 | 5 |
| | ncr4605 | | | |
| | ncrb6186 | | | |
| | ncrb2292 | | | |
| | ncrc2840 | | | |
| 873 | seob4502 | NADH-UBIQUINONE OXIDOREDUCTASE CHAIN 4 | P03905 | 5 |
| | ncrc5143 | | | |
| | ncr0274 | | | |
| | seob2309 | | | |
| | hfcr3534 | | | |
| 874 | SEOA1041a | NADH-UBIQUINONE OXIDOREDUCTASE MLRQ SUBUNIT (COMPLEX I-MLRQ) (CI-MLRQ) | spO00483 | 5 |
| | MIOA8244 | | | |
| | SEOA8579 | | | |
| | SEOB0714a | | | |

Figure 6A – EST Names Corresponding to Unique Known Genes of Figure 6

| | | | | |
|---|---|---|---|---|
| | SEOB1676 | | | |
| 875 | ncr2954 | dihydrofolate reductase (DHFR) | NM_000791.2 | 5 |
| | SEOB2096 | | | |
| | seob4187 | | | |
| | MIOA6820a | | | |
| | seob7891 | | | |
| 876 | fcrb0598 | aspartyl-tRNA synthetase (DARS) | NM_001349.1 | 5 |
| | hfcr9449 | | | |
| | ncrb2461 | | | |
| | ncr9863 | | | |
| | SEOB2719 | | | |
| 877 | seob4782 | mitochondrial serine hydroxymethyltransferase gene, nuclear encoded mitochondrion protein, complete cds | U23143.1 | 5 |
| | hfcr9189 | | | |
| | seob6658 | | | |
| | FCR3911 | | | |
| | hfcr7674 | | | |
| 878 | FCR5803 | cystatin B | U46692 | 5 |
| | FCR7458 | | | |
| | SEOA6273 | | | |
| | ncrb5418 | | | |
| | ncrc9905 | | | |
| 879 | SEOA2381a | PROS-27 | X59417 | 5 |
| | FCR2002 | | | |
| | ncr2482 | | | |
| | ncrb6236 | | | |
| | seoa0340m | | | |
| 880 | SEOA6497a | sorting nexin 3 (SNX3) | AF034546 | 5 |
| | hfcr0745 | | | |
| | SEOA4830a | | | |
| | seoa7802a | | | |
| | miob0313 | | | |
| 881 | SEOB2717 | AKAP450 protein | AJ131693.1 | 5 |
| | miob5452 | | | |
| | MIOA0302 | | | |
| | MIOA8156 | | | |
| | seob6682 | | | |
| 882 | SEOA6155a | farnesyl-protein transferase alpha-subunit | L00634 | 5 |
| | SEOA7642a | | | |
| | FCR6784 | | | |
| | ncrb1912 | | | |
| | MIOA4824a | | | |
| 883 | seob4209 | prolylcarboxypeptidase (angiotensinase C) (PRCP) | NM_005040.1 | 5 |
| | miob0809 | | | |
| | ncrb0441 | | | |
| | ncr0769 | | | |
| | hfcr0298 | | | |
| 884 | hfcr4034 | sequestosome 1 (SQSTM1) (=U46751.1 phosphotyrosine independent ligand p62) | NM_003900.1 | 5 |
| | fcrb1527 | | | |
| | seoa7717a | | | |
| | MIOA6918a | | | |

Figure 6A – EST Names Corresponding to Unique Known Genes of Figure 6

| | | | | |
|---|---|---|---|---|
| | SEOA2949a | | | |
| 885 | SEOA7175a | GLI-Kruppel family member GLI3 (Greig cephalopolysyndactyly syndrome) (GLI3) | gi4504014 | 5 |
| | ncr7328 | | | |
| | ncrb7454 | | | |
| | FCR1345 | | | |
| | mioa9690 | | | |
| 886 | miob4673 | TATA element modulatory factor | L01042.1 | 5 |
| | SEOA0450 | | | |
| | SEOB0030 | | | |
| | seob3942 | | | |
| | mioa7652a | | | |
| 887 | MIOA2970a | two-handed zinc finger protein ZEB | U19969 | 5 |
| | SEOA0774 | | | |
| | SEOA2665 | | | |
| | seob6046 | | | |
| | ncr5431 | | | |
| 888 | SEOA6598a | XAGL protein | Y15906.1 | 5 |
| | SEOB3291 | | | |
| | MIOA6244a | | | |
| | SEOA0271 | | | |
| | SEOA1804a | | | |
| 889 | FCR1153N | zinc finger protein 262 (ZNF262) (=AB007885 KIAA0425) | gi4827068 | 5 |
| | MIOA4334a | | | |
| | hfcr8010 | | | |
| | FCR0324 | | | |
| | FCR1149 | | | |
| 890 | miob3421 | zinc finger protein 84 (HPF2) (ZNF84) | NM_003428.1 | 5 |
| | ncrb7843 | | | |
| | ncr2550 | | | |
| | SEOA0940 | | | |
| | FCR1879N | | | |
| 891 | MIOA6582a | heterogeneous nuclear ribonucleoprotein H1 (H) (HNRPH1) | NM_005520.1 | 5 |
| | hfcr1431 | | | |
| | ncr8977 | | | |
| | ncrc7132 | | | |
| | ncrc0189 | | | |
| 892 | SEOB3172 | Polyadenylate binding protein | U75686.1 | 5 |
| | MIOB2796 | | | |
| | FCR2203 | | | |
| | ncrc2424 | | | |
| | MIOA8346 | | | |
| 893 | MIOA3379a | spliceosomal protein SAP 155 | AF054284 | 5 |
| | FCR7200 | | | |
| | fcrb1620 | | | |
| | fcrb1952 | | | |
| | MIOA8120 | | | |
| 894 | SEOB0843a | splicing factor (CC1.4) | L10911.1 | 5 |
| | miob1250 | | | |
| | seob6015 | | | |

Figure 6A – EST Names Corresponding to Unique Known Genes of Figure 6

| | | | | |
|---|---|---|---|---|
| | FCR2092 | | | |
| | mioa0457m | | | |
| 895 | hfcr8647 | Splicing factor proline/glutamine rich (polypyrimidine tract-binding protein-associated)(SFPQ) | NM_005066.1 | 5 |
| | ncr1747 | | | |
| | SEOA2402a | | | |
| | SEOA4148a | | | |
| | MIOA0494 | | | |
| 896 | SEOB0872a | RNA polymerase II subunit hsRPB7 | U20659.1 | 5 |
| | FCR1541 | | | |
| | MIOA3835 | | | |
| | FCR0425 | | | |
| 897 | MIOA0249a | lymphocyte activation-associated protein | AF123320.1 | 5 |
| | MIOA5500a | | | |
| | SEOA1670a | | | |
| | ncr4013 | | | |
| | ncrc8851 | | | |
| 898 | SEOA8227 | heat shock 60kD protein 1 (chaperonin) (HSPD1) | NM_002156.1 | 5 |
| | SOA0642 | | | |
| | ncrc0092 | | | |
| | ncr7531 | | | |
| | ncrb7423 | | | |
| 899 | SEOA9373 | lysosomal-associated membrane protein 2 (LAMP2), transCRipt variant LAMP2B = U36336.1 | NM_013995.1 | 5 |
| | ncrb4102 | | | |
| | ncrc1243 | | | |
| | ncrb0860 | | | |
| | ncrb3144 | | | |
| 900 | FCR7026 | beta-COP | X82103 | 5 |
| | SEOA2153n | | | |
| | SEOA2872 | | | |
| | SEOA6572a | | | |
| | mioa2153m | | | |
| 901 | seob4075 | RAD23 (S. cerevisiae) homolog B (RAD23B) | NM_002874.1 | 5 |
| | seob6294 | | | |
| | ncrb1466 | | | |
| | SEOA4715a | | | |
| | miob4832 | | | |
| 902 | MIOA3343a | t-complex polypeptide 1 | X52882 | 5 |
| | SEOA1490n | | | |
| | SEOB2738 | | | |
| | hfcr3743 | | | |
| | MIOA6835a | | | |
| 903 | seob6680 | xeroderma pigmentosum group E UV-damaged DNA binding factor = NM_001923.1 damage-specific DNA binding protein 1 (127kD) (DDB1) | U32986.1 | 5 |
| | hfcr2128 | | | |
| | hfcr4347 | | | |
| | ncr0079 | | | |
| | fcrb0148 | | | |
| 904 | seob7432 | CGI-121 protein (LOC51002) | NM_016058.1 | 5 |
| | MIOA0680 | | | |

Figure 6A – EST Names Corresponding to Unique Known Genes of Figure 6

| | | | | |
|---|---|---|---|---|
| | SEOA8222 | | | |
| | seoa7872a | | | |
| | MIOA7002a | | | |
| 905 | miob3474 | restin (Reed-Steinberg cell-expressed intermediate filament-associated protein) (RSN) | NM_002956.1 | 5 |
| | SEOB3358 | | | |
| | ncrb3271 | | | |
| | MIOA6637a | | | |
| | seob3980 | | | |
| 906 | hfcr7656 | sarcoglycan, beta (43kD dystrophin-associated glycoprotein) (SGCB) | NM_000232.1 | 5 |
| | ncr5089 | | | |
| | MIOA0473 | | | |
| | FCR7007 | | | |
| | miob5022 | | | |
| 907 | SEOB0201 | Actinin-alpha | X55187.1 | 5 |
| | seoa6941 | | | |
| | SEOB0615 | | | |
| | SEOB1500 | | | |
| | seoa6941 | | | |
| 908 | FCR6312 | cytoplasmic beta-actin | M10277 | 5 |
| | fcrb1979 | | | |
| | ncrc9637 | | | |
| | SEOA4298a | | | |
| | ncrb7746 | | | |
| 909 | ncr0660 | MEMA protein | Y09703.1 | 5 |
| | ncr1920 | | | |
| | ncr6593 | | | |
| | SEOB2739 | | | |
| | SEOA2326a | | | |
| 910 | hfcr0229 | moesin (MSN) | NM_002444.1 | 5 |
| | hfcr1416 | | | |
| | ncr4518 | | | |
| | ncrc6331 | | | |
| | ncr1215 | | | |
| 911 | seob7050 | tubulin-specific chaperone a (TBCA) (=AF038952 cofactor A protein) | gi4759211 | 5 |
| | hfcr5211 | | | |
| | miob0665 | | | |
| | ncr8760 | | | |
| | FCR1791 | | | |
| 912 | SEOA1039a | myosin class I, myh-1c | AJ001382 | 5 |
| | FCR3060 | | | |
| | ncr2272 | | | |
| | SEOA4871a | | | |
| | SEOA6197a | | | |
| 913 | SEOA2962a | oligodendrocyte myelin glycoprotein (OMG) | L05367 | 5 |
| | hfcr8018 | | | |
| | SEOB1386 | | | |
| | SEOB2965 | | | |
| | miob4130 | | | |
| 914 | MIOA6567a | activin A receptor, type I (ACVR1) =Z22534 ALK-2 | NM_001105.1 | 5 |

Figure 6A – EST Names Corresponding to Unique Known Genes of Figure 6

| | | | | |
|---|---|---|---|---|
| | seob2592 | | | |
| | seob7091 | | | |
| | ncrc9173 | | | |
| | hfcr0572 | | | |
| 915 | hfcr2930 | CD81 antigen (target of antiproliferative antibody 1) (CD81) | NM_004356.1 | 5 |
| | hfcr6285 | | | |
| | hfcr9092 | | | |
| | hfcr9943 | | | |
| | hfcr5768 | | | |
| 916 | ncr5570 | CDA14 (RefSeq aa 2e-31) | NP_057654.1 | 5 |
| | SEOB1673 | | | |
| | ncr6160 | | | |
| | ncrb1890 | | | |
| | ncrb1399 | | | |
| 917 | SEOA1452a | mannose 6-phosphate receptor, 46 kD (MPR46) | X56257 | 5 |
| | hfcr8398 | | | |
| | MIOA3353a | | | |
| | MIOA6080a | | | |
| | SEOA5436 | | | |
| 918 | hfcr4645 | secreted frizzled-related protein 1 (SFRP1) | NM_003012.2 | 5 |
| | ncr2586 | | | |
| | ncrc6717 | | | |
| | ncr8282 | | | |
| | ncr8596 | | | |
| 919 | MIOA6240a | calcineurin A2 | M29551 | 5 |
| | miob1106 | | | |
| | fcrb1065 | | | |
| | hfcr1360 | | | |
| | seob6482 | | | |
| 920 | SEOB3565 | activin beta-A subunit (=(cDNA FLJ11041 fis, clone PLACE1004405, dbj\|AK001903.1) | X57580.1 | 5 |
| | MIOA4017a | | | |
| | MIOA4029a | | | |
| | SEOB1728 | | | |
| | SEOB2282 | | | |
| 921 | MIOA2989a | insuline-like growth factor II receptor | Y00285 | 5 |
| | fcrb1230 | | | |
| | FCR5791 | | | |
| | FCR7610 | | | |
| | FCR7043 | | | |
| 922 | HFCR3073 | calcium modulating cyclophilin ligand CAMLG (CAMLG) | AF068179.1 | 5 |
| | ncrb2451 | | | |
| | ncrc6530 | | | |
| | mioa7852 | | | |
| | ncrb0938 | | | |
| 923 | seob5636 | polycystic kidney disease 2 (autosomal dominant) | NM_000297.1 | 5 |
| | mioa9975n | | | |
| | ncr2029 | | | |
| | ncrb8166 | | | |
| | ncrb3200 | | | |

Figure 6A – EST Names Corresponding to Unique Known Genes of Figure 6

| | | | | |
|---|---|---|---|---|
| 924 | FCR1150<br>FCR1439<br>fcrb0036<br>hfcr1066<br>hfcr9844 | Thy-1 glycoprotein | M11749 | 5 |
| 925 | SEOA1598a<br>SEOA2071<br>SEOA3584a<br>SEOA8663<br>SEOB0302 | histone (H2A.Z) | M37583 | 5 |
| 926 | SEOA3038a<br>SEOA8274<br>SEOB3417<br>SEOA5174a<br>SEOB3496 | histone H4 | X67081 | 5 |
| 927 | SEOA1036a<br>mioa1179m<br>ncrc1481<br>ncrc6888<br>SEOA9015 | M-phase phosphoprotein homologue | AF100742.1 | 5 |
| 928 | miob3353<br>ncrb8596<br>ncrc4734<br>ncrb0931<br>ncr8473 | cell division cycle 27 (CDC27) | NM_001256.1 | 5 |
| 929 | SEOA2686<br>SEOA5900<br>SEOB0519<br>SEOB0848a<br>ncrb4232 | GTP-binding protein (RAB1) | M28209 | 5 |
| 930 | SEOB0266<br>SEOB1380<br>seob8345<br>seob3710<br>fcrb2507 | prefoldin 4 (PFDN4) | gi4505740 | 5 |
| 931 | hfcr2031<br>fcrb1448<br>hfcr3951<br>ncr5662<br>seob6711 | replication factor C (activator 1) 1 (145kD) (RFC1) mRNA | NM_002913.1 | 5 |
| 932 | seob7530<br>SEOA9664<br>ncrb4699<br>miob3118<br>MIOA1632a | replication protein A3 (14kD) (RPA3) | NM_002947.1 | 5 |
| 933 | SEOA5363<br>MIOA8020a<br>miob4601<br>seoa2072n<br>ncrc0511 | anaphase promoting complex subunit 10 | AF132794.1 | 5 |
| 934 | seob6041 | KIAA0075 | D38550.1 | 5 |

Figure 6A – EST Names Corresponding to Unique Known Genes of Figure 6

| | | | | |
|---|---|---|---|---|
| | seob6721 | | | |
| | ncr0235 | | | |
| | ncr8546 | | | |
| | ncrc0805 | | | |
| 935 | miob3357 | KIAA0336 gene | NM_014635.1 | 5 |
| | SEOA3575a | | | |
| | SEOA9442 | | | |
| | ncrc1701 | | | |
| | ncr3168 | | | |
| 936 | SEOB3332 | KIAA0527 | AB011099.1 | 5 |
| | ncrb2010 | | | |
| | ncr0181 | | | |
| | ncrb2761 | | | |
| | hfcr6936 | | | |
| 937 | MIOA7110a | KIAA0573 | AB011145 | 5 |
| | MIOA5841a | | | |
| | seob4605 | | | |
| | MIOA6981a | | | |
| | ncr5995 | | | |
| 938 | MIOA8187 | KIAA0610 | AB011182 | 5 |
| | ncrb0760 | | | |
| | SEOA9885 | | | |
| | mioa9806 | | | |
| | ncrb7611 | | | |
| 939 | MIOA8150 | KIAA0810 | AB018353.1 | 5 |
| | FCR5072 | | | |
| | SOA0541 | | | |
| | fcrb0052 | | | |
| | ncrc7092 | | | |
| 940 | SEOA3229 | KIAA1073 | AB028996.1 | 5 |
| | seob8276 | | | |
| | MIOA2622 | | | |
| | seob5549 | | | |
| | fcrb2485 | | | |
| 941 | SEOA4795a | PTD011 | AF078864 | 5 |
| | SEOA4696a | | | |
| | seob6588 | | | |
| | mioa9986n | | | |
| | ncrc9169 | | | |
| 942 | seob5816 | retrovirus-related hypothetical protein II (=X52235 ORFII) | S23650 | 5 |
| | ncr2476 | | | |
| | hfcr3582 | | | |
| | ncrc5313 | | | |
| | ncrc9280 | | | |
| 943 | miob6539 | SRY (sex-determining region Y)-box 5 (SOX5) | NM_006940.1 | 5 |
| | ncr9940 | | | |
| | SEOB0547 | | | |
| | miob6467 | | | |
| | ncr8610 | | | |
| 944 | hfcr1635 | YEAF1 (YY1 and E4TF1 associated factor 1) | AB029551.1 | 5 |
| | hfcr0259 | | | |

Figure 6A – EST Names Corresponding to Unique Known Genes of Figure 6

| | | | | |
|---|---|---|---|---|
| | ncr8659<br>miob2469<br>ncrb3975 | | | |
| 945 | MIOA4476a | glucan (1,4-alpha-), branching enzyme 1(ORF)(glycogen branching enzyme, Andersendisease, glycogen storage disease type IV) (GBE1) mRNA | NM_000158.1 | 5 |
| | ncr4621<br>MIOA0866a<br>ncrc2689<br>seob2328 | | | |
| 946 | FCR4786<br>FCR2081<br>hfcr1560<br>ncrc7023<br>miob6814 | hexokinase 1 (HK1) (=AF016365;X66957) | M75126 | 5 |
| 947 | hfcr0854 | fatty acid binding protein 5 (psoriasis-associated) (FABP5) | NM_001444.1 | 5 |
| | miob3808<br>miob3872<br>fcrb1839<br>ncrc6545 | | | |
| 948 | SEOA5382<br>ncr4604<br>ncrc3763<br>CR0972<br>mioa7803a | oxysterol-binding protein | AB017026 | 5 |
| 949 | SEOA9689 | ubiquinol-cytochrome c reductase core protein II (UQCRC2)(ORF) = J04973.1 | NM_003366.1 | 5 |
| | ncrb1517<br>fcrb2547<br>fcrb1652<br>MIOA5686 | | | |
| 950 | miob4933 | amino acid transporter system A (ATA2) (=AB037803.1 Human KIAA1382) | AF249673.1 | 5 |
| | ncrb4302<br>ncrc4129<br>ncrc8971<br>miob2459n | | | |
| 951 | miob3461<br>SEOA1404<br>SEOA2761<br>seob4794<br>FCR4366 | Arginine-rich protein (ARP) | NM_006010.1 | 5 |
| 952 | FCR4614 | translation initiation factor (=D21853 hypothetical protein (KIAA0111)) | X79538 | 5 |
| | seob4065<br>ncrb2933<br>ncr8144<br>SEOA5762 | | | |
| 953 | ncrb6073 | proteasome (prosome macropain) beta type, 4 (PSMB4) | NM_002796.1 | 5 |

Figure 6A – EST Names Corresponding to Unique Known Genes of Figure 6

| | | | | |
|---|---|---|---|---|
| | ncr5742 | | | |
| | ncrb5044 | | | |
| | ncrc0383 | | | |
| | hfcr7775 | | | |
| 954 | ncr2459 | proteasome (prosome, macropain) 26Ssubunit, ATPase, 2 (RefSeq aa 2e-60) | NP_002794.1 | 5 |
| | ncrb4777 | | | |
| | ncrc0393 | | | |
| | ncrb0874 | | | |
| | ncrc4306 | | | |
| 955 | hfcr7789 | PEX10 peroxisome biogenesis factor (peroxin) 10 | AB013818.1 | 5 |
| | hfcr7838 | | | |
| | hfcr7583 | | | |
| | hfcr6369 | | | |
| | hfcr7746 | | | |
| 956 | miob3432 | DNA-dependent protein kinase catalytic subunit (DNA-PKcs) | U47077.3 | 5 |
| | FCR2419 | | | |
| | hfcr0091 | | | |
| | hfcr0187 | | | |
| | ncrc2069 | | | |
| 957 | ncrc0191 | putative translation initiation factor(RefSeq aa 4e-60) | NP_005792.1 | 5 |
| | ncrc1497 | | | |
| | ncr9515 | | | |
| | ncrc5247 | | | |
| | ncrb0845 | | | |
| 958 | SEOA8909 | transCRiption factor forkhead-like 7 (FKHL7) gene | AF048693.1 | 5 |
| | ncr8743 | | | |
| | ncrc6499 | | | |
| | seoa3411an | | | |
| | ncr5767 | | | |
| 959 | miob6536 | polyadenylate binding protein-interacting protein 1 (PAIP1) | NM_006451.1 | 5 |
| | ncr6059 | | | |
| | MIOA0610a | | | |
| | SEOB2022 | | | |
| | MIOA4819a | | | |
| 960 | MIOA9116 | protein-L-isoaspartate (D-aspartate) O-methyltransferase (PCMT1) (ORF) | NM_005389.1 | 5 |
| | MIOA4416 | | | |
| | MIOA4229 | | | |
| | seob5195 | | | |
| | SEOB0995 | | | |
| 961 | SEOA1263A | CGI-130 protein | AF151888.1 | 5 |
| | MIOA7147a | | | |
| | ncrc0669 | | | |
| | seob5114 | | | |
| | ncrc6087 | | | |
| 962 | fcrb0359 | endocytic receptor (macrophage mannose receptor family) (KIAA0709) | NM_006039.1 | 5 |
| | hfcr7365 | | | |
| | FCR7329 | | | |

Figure 6A – EST Names Corresponding to Unique Known Genes of Figure 6

| | | | | |
|---|---|---|---|---|
| | FCR0763<br>hfcr9673 | | | |
| 963 | ncr3040 | glucocorticoid receptor AF-1 specific elongation factor | AF174496.1 | 5 |
| | hfcr2596<br>hfcr7725<br>hfcr9501<br>ncrb2809 | | | |
| 964 | ncrb4015 | thrombospondin 3 (THBS3) (RefSeq aa 3e-59) | NP_009043.1 | 5 |
| | ncrc0916<br>ncrc9269<br>BFCW0093<br>ncrb1422 | | | |
| 965 | SEOA3359a | cyclin G2 | U47414 | 5 |
| | seob6850<br>seob5669<br>ncrc0847<br>MIOA1214 | | | |
| 966 | hfcr9341 | nucleolar phosphoprotein p130 (P130) | NM_004741.1 | 5 |
| | ncrb8204<br>hfcr9909<br>ncrb2496<br>ncrb6576 | | | |
| 967 | seob4861 | polymerase (RNA) II polypeptide G (POLR2G) | NM_002696.1 | 5 |
| | ncr3951<br>ncrb4402<br>ncrc3632<br>hfcr6670 | | | |
| 968 | SEOA4647a | KIAA0433 (ORF) | AB007893 | 5 |
| | seob4659<br>ncrb5017<br>ncrc2472<br>ncrb7696 | | | |
| 969 | SEOA3403a | KIAA0729 | AB018272.1 | 5 |
| | MIOA2700a<br>SEOA9256<br>ncrc1525<br>MIOA3685a | | | |
| 970 | MIOA5085a | KIAA1038 | AB028961 | 5 |
| | seob6448<br>SEOA8605<br>SEOA9184<br>SEOB1330 | | | |
| 971 | seob5899 | KIAA1058 protein | AB028981.1 | 5 |
| | hfcr7047<br>ncrc0096<br>seoa6809<br>MIOA6252a | | | |
| 972 | miob2885 | lipoma preferred partner (LPP)gene, exon 11, and complete cds | U49968.1 | 5 |
| | ncrb1827<br>MIOA2261a | | | |

Figure 6A – EST Names Corresponding to Unique Known Genes of Figure 6

| | | | | |
|---|---|---|---|---|
| | MIOA8676 | | | |
| | ncrb2063 | | | |
| 973 | ncr6292 | prostate cancer tumor suppressor (N33) | NM_006765.1 | 5 |
| | ncrc4076 | | | |
| | FCR6998 | | | |
| | SEOA2744 | | | |
| | SOA0156 | | | |
| 974 | MIOA1277m | protein S alpha gene (PROS1) | M36564 | 5 |
| | ncrb7903 | | | |
| | mioa7768a | | | |
| | ncrc5303 | | | |
| | MIOA2998a | | | |
| 975 | ncrb2170 | NADH-UBIQUINONE OXIDOREDUCTASE CHAIN 4L | spP03901 | 5 |
| | miob1331 | | | |
| | ncrc2043 | | | |
| | ncrc2250 | | | |
| | seob5092 | | | |
| 976 | fcrb1296 | ribosomal protein L36 60S | AF077043 | 5 |
| | hfcr2940 | | | |
| | hfcr6380 | | | |
| | hfcr7585 | | | |
| | hfcr1124 | | | |
| 977 | seoa7970 | peptidylprolyl isomerase A (cyclophilin A) (PPIA), mRNA /cds=(44,541) /gb=NM_021130 /gi=10863926 /ug=Hs.342389 /len=753 | Hs.342389 | 5 |
| | fcrb1523 | | | |
| | ncrc3978 | | | |
| | ncrb6939 | | | |
| | ncrb3852 | | | |
| 978 | hfcr1137 | calpobindin II= ANNEXIN VI | D00510.1 | 5 |
| | hfcr6029 | | | |
| | hfcr1926 | | | |
| | BFCN0055 | | | |
| | BFCS0338 | | | |
| 979 | SEOA4786a | thioredoxin peroxidase (antioxidant enzyme) (AOE372) =U25182(ORF) | NM_006406.1 | 5 |
| | BFCS0547 | | | |
| | FCR4007 | | | |
| | hfcr0309 | | | |
| | mioa9868 | | | |
| 980 | SEOB1208 | cytoskeletal tropomyosin TM30(nm) | X04588.1 | 5 |
| | hfcr3733 | | | |
| | miob1829 | | | |
| | ncrc2948 | | | |
| | ncrc2948 | | | |
| 981 | seob7952 | LIV-1 protein, estrogen regulated (LIV-1) (=U41060) | 7106340 | 5 |
| | ncr4456 | | | |
| | ncrc3489 | | | |
| | seoa5764n | | | |
| | MIOA2303a | | | |
| 982 | ncr2398 | dehydrogenase subunit 4 (RefSeq aa 3e-34) | gi5835397 | 5 |
| | ncrb2245 | | | |

Figure 6A – EST Names Corresponding to Unique Known Genes of Figure 6

| | | | | |
|---|---|---|---|---|
| | ncrc6897 | | | |
| | ncrc4303 | | | |
| | ncrc5033 | | | |
| 983 | seoa7828a | phosphoglycerate mutase 1 (brain) (PGAM1), mRNA /cds=(31,795) /gb=NM_002629 /gi=4505752 /ug=Hs.181013 /len=1709 | Hs.181013 | 5 |
| | seob3893 | | | |
| | hfcr2965 | | | |
| | hfcr6961 | | | |
| | ncrc3529 | | | |
| 984 | MIOA8512 | ribosomal RNA 16S gene | AF036006.1 | 5 |
| | MIOA4182 | | | |
| | SEOA4718a | | | |
| | MIOA8748 | | | |
| | MIOA2521a | | | |
| 985 | MIOA2140 | Zn-15 transCRiption factor (Zfp-15) (=AB011102 Human KIAA0530) | AF017806 | 5 |
| | hfcr1387 | | | |
| | hfcr6412 | | | |
| | ncrc4835 | | | |
| | ncrc9880 | | | |
| 986 | SEOA0207a | tetraspan TM4SF(TSPAN-6) | AF053453 | 5 |
| | SEOB3143 | | | |
| | SOA0692 | | | |
| | ncrc0994 | | | |
| | FCR4382 | | | |
| 987 | seoa7989 | CGI-119 protein (LOC51643), mRNA /cds=(0,776) /gb=NM_016056 /gi=7706334 /ug=Hs.283670 /len=1325 | Hs.283670 | 5 |
| | SEOA5994a | | | |
| | seob4211 | | | |
| | ncr0918 | | | |
| | ncrb8318 | | | |
| 988 | ncrc9440 | laminin, gamma 1 (formerly LAMB2) (LAMC1), | NM_002293.2 | 5 |
| | ncr9836 | | | |
| | ncrc5436 | | | |
| | hfcr9622 | | | |
| | ncr4986 | | | |
| 989 | SEOA1084a | Rosenthal fiber protein (alpha-B-CRystallin) | M24906 | 5 |
| | hfcr8407 | | | |
| | MIOA8863 | | | |
| | SEOA8910 | | | |
| | ncrb4960 | | | |
| 990 | ncrb3501 | BPTF mRNA for bromodomain PHD finger transcription factor | AB032251.1 | 5 |
| | MIOA5865a | | | |
| | seob6773 | | | |
| | seob6773 | | | |
| | ncrb3501 | | | |
| 991 | fcrb1995 | nucleosome assembly protein 1-like 1 (NAP1L1) | XM_047969.1 | 5 |
| | hfcr9031 | | | |
| | ncrc4352 | | | |

Figure 6A – EST Names Corresponding to Unique Known Genes of Figure 6

| | | | | |
|---|---|---|---|---|
| | hfcr4145<br>mioa9276 | | | |
| 992 | BFCS0082<br>MIOA0908a<br>SEOA6088a<br>SEOA8565 | alpha subunit of GsGTP binding protein (GSA) | X56009 | 4 |
| 993 | hfcr9219<br>miob2423<br>ncr2309<br>SEOA7126a | ring finger protein 4 (RNF4) | gi4506560 | 4 |
| 994 | ncrb8000<br>seob3882<br>seob5185<br>seob6504 | small nuclear ribonucleoprotein polypeptide E (SNRPE) | NM_003094.1 | 4 |
| 995 | BFCN0168n<br>hfcr1792<br>hfcr1913<br>seob6758 | ATP synthase, H transporting, mitochondrial F0 complex, subunit b, isoform 1 (ATP5F1), nuclear gene encoding mitochondrial | NM_001688.1 | 4 |
| 996 | miob0788<br>ncr3673<br>ncr9659<br>FCR5257 | capping protein (actin filament) muscle Z-line, alpha 2 (CAPZA2) | NM_006136.1 | 4 |
| 997 | MIOA6719a<br>ncr7808<br>ncrc0368<br>SEOA7256a | TSE1=protein kinase A regulatory subunit | S54711 | 4 |
| 998 | fcrb2525<br>miob4255<br>SEOA4778a<br>SEOB2077 | proteasome (prosome, maCRopain) subunit, beta type, 3 (PSMB3) | NM_002795.1 | 4 |
| 999 | miob5855<br>SEOA5493a<br>SEOA4865a<br>SEOA9955 | Hmob33 protein | Y14155.1 | 4 |
| 1000 | miob3743<br>miob4015<br>miob6313<br>hfcr0530 | transmembrane 9 superfamily member 2 (TM9SF2) | NM_004800.1 | 4 |
| 1001 | MIOA1979a<br>FCR0282<br>FCR5320<br>FCR5788 | procollagen C-proteinase enhancer protein, type 1 | AB008549 | 4 |
| 1002 | MIOA6232a<br>MIOA0951<br>MIOA6248a<br>FCR6785 | differentiated embryo chondrocyte expressed gene 1 (DEC1) | AB004066 | 4 |

Figure 6A – EST Names Corresponding to Unique Known Genes of Figure 6

| | | | | |
|---|---|---|---|---|
| 1003 | seob7374<br>seob7374<br>ncr0987<br>seob4486 | trinucleotide repeat containing 3 (TNRC3) | NM_005878.1 | 4 |
| 1004 | FCR2210<br>FCR6319<br>fcrb0607<br>ncrb3867 | MHC class I (HLA-A) | U59701 | 4 |
| 1005 | miob5816<br>ncr3709<br>ncr4846<br>SEOA9777<br>SEOB1507 | glutathione S-transferase M3 (brain) (GSTM3) | NM_000849.1 | 4 |
| 1006 | SEOA8892<br>ncrc5079<br>ncr5409<br>ncrc2273 | muscle specific gene M9 (=PTD001) | BAA76626.1 | 4 |
| 1007 | SEOB2128<br>ncrc4226<br>SEOB3537<br>ncr0788 | platelet-derived growth factor receptor-like (PDGFRL) | NM_006207.1 | 4 |
| 1008 | SEOA2272a<br>SEOA6186a<br>SEOA6600a<br>SOA0487 | COBW-like placental protein | AF065414 | 4 |
| 1009 | MIOA7353a<br>ncrb1915<br>ncrb7655<br>SEOA7647a | SUMO-1-specific protease (KIAA0797) | NM_015571.1 | 4 |
| 1010 | SEOB2939<br>miob5963<br>ncr3302<br>ncr8294 | p58/GTA (galactosyltransferase associated protein kinase) | M37712.1 | 4 |
| 1011 | miob3470<br>miob5653<br>seob6895<br>seoa6774 | lysophospholipase I (LYPLA1) | NM_006330.1 | 4 |
| 1012 | hfcr6935<br>ncr8803<br>ncrc4629<br>hfcr6045 | proteasome (prosome, macropain) subunit, beta type, 7 (PSMB7) | NM_002799.1 | 4 |
| 1013 | MIOA9179<br>fcrb0255<br>ncr8487<br>ncr7514 | chaperonin containing TCP1,subunit 8 (theta) (CCT8)(ORF) | NM_006585.1 | 4 |
| 1014 | ncr6619<br>ncrb3776<br>MIOA8932<br>MIOA0145 | Sec23 (S. cerevisiae) homolog A (RefSeq aa 5e-49) | NP_006355.1 | 4 |

Figure 6A – EST Names Corresponding to Unique Known Genes of Figure 6

| | | | |
|---|---|---|---|
| 1015 SEOB3151<br>MIOA2365a<br>MIOA4299a<br>MIOA4696 | Translocon associated protein gamma subunit | spQ9UNL2 | 4 |
| 1016 SEOA5376<br>ncrc4728<br>seob3867<br>hfcr0580 | nuclear factor (erythroid-derived 2)-like 2 (NFE2L2) (=S74017 Nrf2=NF-E2-like basic leucine zipper transCRiptional activator) | gi5453775 | 4 |
| 1017 SEOA5094a<br>ncrb0737<br>ncrc1102<br>SEOA8980 | RAP1A, member of RAS oncogene family (RAP1A) =M22995 | NM_002884.1 | 4 |
| 1018 SEOA0782<br>SEOA0782<br>SEOA3822a<br>seob7087 | RNaseP protein p30 (RPP30) | U77665 | 4 |
| 1019 hfcr0749<br>hfcr1214<br>hfcr7846<br>hfcr3385 | glutathione S-transferase P1c (GSTp1c) | U62589.1 | 4 |
| 1020 FCR1760<br>hfcr0042<br>CR0929<br>FCR1760 | collagen type XV alpha 1 (COL15A1) | L25280 | 4 |
| 1021 seob6878<br>ncrb7571<br>miob6314<br>hfcr7868 | myosin-binding protein C, cardiac (MYBPC3) | NM_000256.1 | 4 |
| 1022 miob5891<br>miob1802<br>miob5891<br>SEOA5279a | secreted frizzled-related protein 4 (SFRP4) | NM_003014.2 | 4 |
| 1023 seob6026<br>CR0881<br>ncrc5783<br>seob3984 | IQ motif containing GTPase activating protein 1 (IQGAP1) | NM_003870.1 | 4 |
| 1024 MIOA4606a<br>ncrb2429<br>ncr3698<br>MIOA4606a | cadherin 13,H-cadherin (heart) (CDH13) | NM_001257.1 | 4 |
| 1025 ncr4104<br>ncr8167<br>ncrc1896<br>ncrc9916 | Death associated protein 3 (DAP3) | NM_004632.1 | 4 |
| 1026 FCR5181<br>FCR7091<br>miob1823<br>ncrc6521 | enhancer of polycomb (Epc1) | AF079765 | 4 |

Figure 6A – EST Names Corresponding to Unique Known Genes of Figure 6

| | | | | |
|---|---|---|---|---|
| 1027 | miob4308 | mesenchyme homeo box 2 (growth arrest-specific homeo box) (MEOX2) | NM_005924.1 | 4 |
| | ncrb4088 | | | |
| | seoa8164 | | | |
| | MIOA4156 | | | |
| 1028 | hfcr2295 | nucleolar autoantigen | NM_006455.1 | 4 |
| | hfcr7363 | | | |
| | hfcr1410 | | | |
| | hfcr9399 | | | |
| 1029 | hfcr9794 | ADP/ATP carrier protein(ANT-2) gene | L78810.1 | 4 |
| | miob4207 | | | |
| | mioa9196 | | | |
| | MIOA4365a | | | |
| 1030 | hfcr5030 | S100 calcium-binding protein, beta (neural) (S100B) | NM_006272.1 | 4 |
| | ncrc9563 | | | |
| | ncr8921 | | | |
| | ncrc3918 | | | |
| 1031 | hfcr2781 | 3-phosphoglycerate dehydrogenase (PGAD) | NM_006623.1 | 4 |
| | hfcr6915 | | | |
| | hfcr9035 | | | |
| | hfcr3583 | | | |
| 1032 | ncrb7726 | phosphoinositol 3-phosphate binding protein-1 (PEPP1 | NM_020904.1 | 4 |
| | ncrb1972 | | | |
| | ncrc1684 | | | |
| | ncrc4497 | | | |
| 1033 | SEOB3545 | Dimethyladenosine transferase (HSA9761) | NM_014473.1 | 4 |
| | FCR0010 | | | |
| | SEOA0390 | | | |
| | SEOB0161 | | | |
| 1034 | ncr3118 | fatty-acid-Coenzyme A ligase, long-chain 4 (FACL4) | NM_004458.1 | 4 |
| | ncr2084 | | | |
| | ncr6759 | | | |
| | seoa7711a | | | |
| 1035 | FCR0141 | phosphatidic acid phosphatase 2b (PPAP2B) | AB000889 | 4 |
| | ncr3193 | | | |
| | ncr6161 | | | |
| | ncr8874 | | | |
| 1036 | ncrb5117 | ATP synthase, H transporting, mitochondrial F0 complex, subunit f, isoform 2 (ATP5J2) | NM_004889.1 | 4 |
| | FCR4629 | | | |
| | seob5984 | | | |
| | MIOA1729a | | | |
| 1037 | MIOA0187n | cytochrome c oxidase subunit Vb (coxVb) | M19961 | 4 |
| | ncrb3156 | | | |
| | FCR2960 | | | |
| | MIOA6118a | | | |
| 1038 | FCR5799 | methylenetetrahydrofolate dehydrogenase-methenyltetrahydrofolate cyclohydrolase-formyltetrahydrofolate synthetase | J04031 | 4 |
| | mioa1216m | | | |
| | hfcr6843 | | | |

Figure 6A – EST Names Corresponding to Unique Known Genes of Figure 6

| | | | | |
|---|---|---|---|---|
| | FCR5799 | | | |
| 1039 | SEOB1100 | methyl-CpG binding domain protein 2 (MBD2), transCRipt variant 1 | gi7710146 | 4 |
| | seob4452 | | | |
| | SEOA3565a | | | |
| | hfcr6774 | | | |
| 1040 | miob5751 | proteasome (prosome, macropain) subunit, alpha type, 2 (PSMA2) | NM_002787.1 | 4 |
| | SEOA9522 | | | |
| | mioa9883 | | | |
| | hfcr8666 | | | |
| 1041 | ncr0531 | hypoxia-inducible protein 2 (HIG2) | NM_013332.1 | 4 |
| | ncrc4524 | | | |
| | ncrc5060 | | | |
| | ncrb3339 | | | |
| 1042 | SEOB2987 | CAAX box 1 (CXX1) | fi4503180 | 4 |
| | hfcr1740 | | | |
| | hfcr0161 | | | |
| | fcr4791 | | | |
| 1043 | miob3496 | forkhead box O1A (rhabdomyosarcoma) (FOXO1A) | NM_002015.1 | 4 |
| | ncr1348 | | | |
| | ncrb3793 | | | |
| | ncrb4079 | | | |
| 1044 | SEOB0220 | heterogeneous nuclear protein similar to rat helix destabilizing protein (FBRNP) | NM_005758.1 | 4 |
| | MIOA0530 | | | |
| | SEOA0254a | | | |
| | ncr1356 | | | |
| 1045 | SEOB1865 | Golgi vesicular membrane trafficking protein p18 (BET1) | gi5031610 | 4 |
| | miob4263 | | | |
| | seob5169 | | | |
| | ncrb1230 | | | |
| 1046 | miob0745 | hect domain and RLD 2(HERC2) (=KIAA0393) | NM_004667.2 | 4 |
| | ncrb2311 | | | |
| | SEOA9803 | | | |
| | hfcr8485 | | | |
| 1047 | hfcr7635 | collagen type IV alpha (2) chain | X05610.1 | 4 |
| | FCR4896 | | | |
| | FCR0175 | | | |
| | hfcr9902 | | | |
| 1048 | MIOA5594a | cofilin isoform 1 | AF134802 | 4 |
| | SEOA9652 | | | |
| | miob3403 | | | |
| | SEOB1014 | | | |
| 1049 | miob4274 | myosin IXA (MYO9A) | NM_006901.1 | 4 |
| | ncrb0507 | | | |
| | ncrb7505 | | | |
| | ncrb7534 | | | |
| 1050 | MIOB2122 | fukutin | AB038490.1 | 4 |
| | ncrc2708 | | | |
| | SEOA9253 | | | |

Figure 6A – EST Names Corresponding to Unique Known Genes of Figure 6

| | | | | |
|---|---|---|---|---|
| | seob4162 | | | |
| 1051 | seob6882 | G protein-coupled receptor 64 (GPR64) | NM_005756.1 | 4 |
| | miob5611 | | | |
| | ncrb5913 | | | |
| | miob0635 | | | |
| 1052 | MIOA5586a | germline T-cell receptor beta chain | U66061 | 4 |
| | fcrb2506 | | | |
| | SEOB1174 | | | |
| | miob3266 | | | |
| 1053 | seob3684 | signal sequence receptor, alpha (translocon-associated protein alpha) (SSR1) (=DCN) | NM_003144.2 | 4 |
| | ncr4114 | | | |
| | ncr9981 | | | |
| | ncrc9879 | | | |
| 1054 | FCR4899 | signal sequence receptor, beta (translocon-associated protein beta) (SSR2) (=D37991) | X74104 | 4 |
| | hfcr8941 | | | |
| | ncrc3391 | | | |
| | BFCS0417 | | | |
| 1055 | SEOB3414 | SH3 domain binding glutamic acid-rich protein like (SH3BGRL) | NM_003022.1 | 4 |
| | ncr3411 | | | |
| | miob6804 | | | |
| | MIOA8335 | | | |
| 1056 | ncrb6109 | neuroendocrine-specific protein-like protein 1 (NSPL1) | AF119297.1 | 4 |
| | ncrc8861 | | | |
| | miob0601 | | | |
| | mioa9519 | | | |
| 1057 | SEOA8621 | ARFGAP1 protein (ARFGAP1) | AF111847.1 | 4 |
| | ncr0540 | | | |
| | seob4453 | | | |
| | ncrb8273 | | | |
| 1058 | FCR0843 | gelsolin, plasma (GSN) | X04412 | 4 |
| | fcrb0184 | | | |
| | ncrb5341 | | | |
| | ncr1519 | | | |
| 1059 | MIOA1496 | integrin cytoplasmic domain associated protein (Icap-1a) | AF012023 | 4 |
| | SEOB2205 | | | |
| | hfcr0817 | | | |
| | ncrb7822 | | | |
| 1060 | ncr3577 | integrin, alpha E (antigen CD103, human mucosal lymphocyte antigen 1; alpha polypeptide) (ITGAE) | NM_002208.3 | 4 |
| | hfcr6620 | | | |
| | ncrb0140 | | | |
| | miob1937 | | | |
| 1061 | SEOA1570 | acidic 82 kDa protein | U15552 | 4 |
| | SEOA3813a | | | |
| | seob8077 | | | |
| | seob5974 | | | |
| 1062 | MIOA0702 | BUP | AF078848.1 | 4 |

Figure 6A – EST Names Corresponding to Unique Known Genes of Figure 6

| | | | | |
|---|---|---|---|---|
| | SEOA2618<br>ncrc9603<br>ncrb0353 | | | |
| 1063 | hfcr9012<br>ncrb7387<br>ncrb0755<br>hfcr6372 | C90RF3 | AF043897.1 | 4 |
| 1064 | hfcr2985<br>SEOA2838<br>ncrc3925<br>ncr1985 | chondrosarcoma-associated protein 2 (CSA2) | AF182645.1 | 4 |
| 1065 | SEOA2244a<br>SEOA6347<br>SEOB0026<br>hfcr1413 | density regulated protein drp1 | AF038554.1 | 4 |
| 1066 | SEOA7652a<br>SEOA8743<br>SEOB1618<br>SEOB0100 | E2IG5 | AF191020 | 4 |
| 1067 | hfcr8004<br>ncrb3537<br>ncrc9709<br>seob5876 | housekeeping (Q1Z 7F5) gene | M81806.1 | 4 |
| 1068 | SEOA1634a<br>seob5807<br>SEOA2468<br>MIOA7003a | HSPC039 protein | AF125100.1 | 4 |
| 1069 | SEOB1372<br>seob5042<br>seob7556<br>ncrc0379 | HSPC139 | AF161488.1 | 4 |
| 1070 | SEOA8738<br>MIOA3498a<br>seob7218<br>mioa9740 | HSPC213 (=HSPC327) | AAF36133.1 | 4 |
| 1071 | SEOA8443<br>ncrb1276<br>ncrc2379<br>seoa7007 | KIAA0022 | BAA03498.1 | 4 |
| 1072 | SEOB1790<br>fcr6367<br>ncrc2635<br>hfcr4061 | KIAA0136 | D50926.1 | 4 |
| 1073 | SEOB0336<br>seob2007<br>hfcr3752<br>seob7630 | KIAA0232 | D86985.2 | 4 |
| 1074 | MIOA1427<br>hfcr2661<br>SEOA6644a<br>ncr0584 | KIAA0235 | D87078 | 4 |
| 1075 | FCR3483 | KIAA0251 | D87438 | 4 |

Figure 6A – EST Names Corresponding to Unique Known Genes of Figure 6

| | | | | |
|---|---|---|---|---|
| | hfcr8988 | | | |
| | ncr4878 | | | |
| | fcrb2664 | | | |
| 1076 | SEOA5822 | KIAA0252 | D87440 | 4 |
| | FCR3576 | | | |
| | SEOA4106a | | | |
| | ncrb7232 | | | |
| 1077 | MIOA1584 | KIAA0256 | D87445 | 4 |
| | MIOA6654a | | | |
| | SEOA3232 | | | |
| | ncr4989 | | | |
| 1078 | SEOA2876 | KIAA0276 | D87466 | 4 |
| | ncrc3700 | | | |
| | mioa7937 | | | |
| | miob2655n | | | |
| 1079 | MIOA3367a | KIAA0429 | AB007889 | 4 |
| | ncr8149 | | | |
| | MIOA3367a | | | |
| | miob6509 | | | |
| 1080 | miob2900 | KIAA0477 | AB007946.1 | 4 |
| | ncr7762 | | | |
| | ncrc3451 | | | |
| | ncrc4575 | | | |
| 1081 | FCR6140 | KIAA0660 | AB014560 | 4 |
| | MIOA3696a | | | |
| | hfcr0032 | | | |
| | hfcr0128 | | | |
| 1082 | SEOB3216 | KIAA0671 | AB014571.1 | 4 |
| | fcr6212 | | | |
| | ncr9818 | | | |
| | ncrb1208 | | | |
| 1083 | SEOA7373a | KIAA0693 | AB014593 | 4 |
| | seob1717 | | | |
| | FCR0856 | | | |
| | ncrb8404 | | | |
| 1084 | MIOA2506a | KIAA0971 | AB023188.1 | 4 |
| | MIOA7027a | | | |
| | ncrc6382 | | | |
| | ncrb2949 | | | |
| 1085 | SEOB1818 | KIAA1102 | AB029025.1 | 4 |
| | MIOA6432a | | | |
| | MIOA6509a | | | |
| | ncrc4203 | | | |
| 1086 | ncr0004 | KIAA1354 | AB037775 | 4 |
| | hfcr1332 | | | |
| | ncr5689 | | | |
| | ncr2566 | | | |
| 1087 | seob5075 | KIAA1376 protein | AB037797.1 | 4 |
| | ncr8350 | | | |
| | ncrc2654 | | | |
| | fcrb0348 | | | |
| 1088 | miob6254 | KIAA1380 protein | AB037801.1 | 4 |

Figure 6A – EST Names Corresponding to Unique Known Genes of Figure 6

| | | | | |
|---|---|---|---|---|
| | mioa9487 | | | |
| | seob0423 | | | |
| | ncrc6205 | | | |
| 1089 | seob3887 | KIAA1451 protein | AB040884 | 4 |
| | seob7151 | | | |
| | seob5741 | | | |
| | SEOA9405 | | | |
| 1090 | seob5193 | mesenchymal stem cell protein DSC92 (LOC51335) | NM_016645.1 | 4 |
| | ncrb0832 | | | |
| | ncrb7012 | | | |
| | ncrb8679 | | | |
| 1091 | SEOB0787a | nickel-specific induction protein (Cap43) | AF004162.1 | 4 |
| | SEOA7579a | | | |
| | ncr8623 | | | |
| | FCR0561 | | | |
| 1092 | MIOA2708a | NifU-like protein (hNifU) | U47101 | 4 |
| | MIOA6100a | | | |
| | ncr6005 | | | |
| | ncrb5380 | | | |
| 1093 | seob6153 | Nuclear antigen Sp100 (SP100) | NM_003113.1 | 4 |
| | MIOA2281a | | | |
| | seob8328 | | | |
| | SEOA5225a | | | |
| 1094 | seob4165 | PRO1608 | AF119850.1 | 4 |
| | seob6396 | | | |
| | fcrb1507 | | | |
| | ncrb5448 | | | |
| 1095 | seob4766 | PRO1828 | AF116669.1 | 4 |
| | SEOB1182 | | | |
| | hfcr3014 | | | |
| | hfcr9711 | | | |
| 1096 | SEOA0174a | promyelocytic leukemia cell | M11948 | 4 |
| | SEOA8526 | | | |
| | ncr0799 | | | |
| | miob2392 | | | |
| 1097 | seob7535 | squamous cell carcinoma antigen recognized by T cell (SART-2) | NM_013352.1 | 4 |
| | ncrc9914 | | | |
| | SEOA9158 | | | |
| | ncr3893 | | | |
| 1098 | SEOA3635a | STAT-induced STAT inhibitor-2 | AF037989 | 4 |
| | ncr2812 | | | |
| | SEOA9926 | | | |
| | ncrb8258 | | | |
| 1099 | MIOA1055 | vesicle transport-related protein | AF110646.1 | 4 |
| | MIOA1497 | | | |
| | miob0763 | | | |
| | ncrb5818 | | | |
| 1100 | SEOA0101 | phosphoglucomutase 1 (PGM1) | M83088 | 4 |
| | seob8330 | | | |
| | ncrb8433 | | | |
| | miob5035 | | | |

Figure 6A - EST Names Corresponding to Unique Known Genes of Figure 6

| | | | | |
|---|---|---|---|---|
| 1101 | SEOA2178a<br>BFCW0511<br>BFCN0119<br>FCR0473 | transaldolase | L19437.2 | 4 |
| 1102 | seob3720<br>MIOA8818<br>seoa4632a<br>ncrb0779 | nucleotide binding protein, estradiol-induced (E2IG3) | NM_014366.1 | 4 |
| 1103 | seob6812<br>ncr6586<br>miob3659<br>ncrc9956 | PDNP1 gene (nucleotide pyrophosphatase) | AF110304.1 | 4 |
| 1104 | SEOB1850<br>ncr3705<br>FCR5628<br>MIOB2115 | phosphoribosyl pyrophosphate synthetase subunit I | D00860.1 | 4 |
| 1105 | SEOA1883<br>SEOA7342a<br>SEOB1518<br>hfcr9173 | dihydrolipoamide dehydrogenase | J03620 | 4 |
| 1106 | hfcr9483<br>FCR4608<br>hfcr3547<br>MIOA1314a | lecithin-cholesterol acyltransferase (LCAT) | X04981.1 | 4 |
| 1107 | seob5903<br>miob0716<br>miob6852<br>mioa7740a | phosphatase 1, catalytic subunit, gamma isoform (PPP1CC) mRNA | NM_002710.1 | 4 |
| 1108 | SEOA2449a<br>SEOA9065<br>hfcr9027<br>ncrb2467 | phospholipid sCRamblase 1 PLSCR1) | AF098642 | 4 |
| 1109 | hfcr3473<br>miob4014<br>ncr2181<br>ncr7002 | serine palmitoyl transferase | AF111168.2 | 4 |
| 1110 | SEOB3194<br>hfcr0686<br>ncrc5752<br>seob7313 | cytochrome oxidase subunit I (COI) and subunit II (COII) pseudogenes | AF035429.1 | 4 |
| 1111 | SEOB0876a<br>miob5066<br>SEOB1071<br>seob8323 | cytochrome-c oxidase subunit VIIaL precursor (COX7AL) | AF134406.1 | 4 |
| 1112 | FCR1185N<br>hfcr5439<br>hfcr6638<br>hfcr6877 | electron-transfer-flavoprotein, beta polypeptide (ETFB) | X71129 | 4 |
| 1113 | seob7229 | NADH-ubiquinone oxidoreductase B17 | AF067167.1 | 4 |

Figure 6A – EST Names Corresponding to Unique Known Genes of Figure 6

| | | | | |
|---|---|---|---|---|
| | FCR0297 | | | |
| | ncr0301 | | | |
| | ncr3740 | | | |
| 1114 | hfcr0609 | ubiquinol-cytochrome c reductase (6.4kD) subunit (UQCR) | NM_006830.1 | 4 |
| | hfcr0838 | | | |
| | miob7000 | | | |
| | ncrb4771 | | | |
| 1115 | seob5537 | acidic protein rich in leucines (SSP29) | NM_006401.1 | 4 |
| | hfcr4529 | | | |
| | SEOB1568 | | | |
| | hfcr1855 | | | |
| 1116 | SEOB1285 | Lysyl tRNA Synthetase | D32053.1 | 4 |
| | hfcr0906 | | | |
| | SEOA8911 | | | |
| | mioa9368 | | | |
| 1117 | SEOA5683a | methionine aminopeptidase | U29607 | 4 |
| | SEOB0925 | | | |
| | ncr1244 | | | |
| | ncrc4732 | | | |
| 1118 | hfcr9551 | eIF4E-like cap-binding protein (4EHP) (=translation initiation factor 4e ) | NM_004846.1 | 4 |
| | ncrb2929 | | | |
| | FCR5472 | | | |
| | FCR6862 | | | |
| 1119 | MIOA6698a | proteasome-associated pad1 homologue (POH1) 26S | U86782 | 4 |
| | FCR1456 | | | |
| | FCR5999 | | | |
| | ncrb8059 | | | |
| 1120 | SEOB1862 | wbsCR1 (WBSCR1) | AF045555.1 | 4 |
| | miob3164 | | | |
| | ncrb2299 | | | |
| | FCR0177 | | | |
| 1121 | ncr8542 | basic transcription factor 3 (RefSeq aa 4e-39) | NP_001198.1 | 4 |
| | ncrc9612 | | | |
| | fcrb1809 | | | |
| | mioa7814a | | | |
| 1122 | miob4121 | isolate 5 12S ribosomal RNA gene | AF121220.1 | 4 |
| | ncr2634 | | | |
| | ncr2691 | | | |
| | ncr6800 | | | |
| 1123 | SEOA1535 | cathepsin F (CATSF) | AF071749 | 4 |
| | hfcr6784 | | | |
| | hfcr7763 | | | |
| | ncr2797 | | | |
| 1124 | SEOA2974a | metalloproteinase inhibitor TIMP-2 | AF127803.1 | 4 |
| | SEOA3922 | | | |
| | SEOA2833n | | | |
| | MIOA1634a | | | |
| 1125 | ncr0018 | protease inhibitor 6 (placental thrombin inhibitor) (PI6) | NM_004568.1 | 4 |
| | ncrb6780 | | | |

Figure 6A – EST Names Corresponding to Unique Known Genes of Figure 6

| | | | | |
|---|---|---|---|---|
| | ncrc4294 | | | |
| | ncr8856 | | | |
| 1126 | seob5673 | proteasome (prosome, macropain) subunit, alpha type, 3 (PSMA3) | NM_002788.1 | 4 |
| | hfcr6658 | | | |
| | miob0430 | | | |
| | ncr3191 | | | |
| 1127 | MIOA7415a | proteasome subunit Y (=X61971 maCRopain subunit delta) | D29012 | 4 |
| | hfcr6857 | | | |
| | fcrb2685 | | | |
| | hfcr5903 | | | |
| 1128 | FCR4315 | protein activator of the interferon-induced protein kinase (PACT) | AF072860 | 4 |
| | MIOA3514a | | | |
| | MIOA2449a | | | |
| | FCR4836 | | | |
| 1129 | ncr9933 | peptidylprolyl isomerase F (cyclophilinF) (RefSeq aa 4e-43) | NP_005720.1 | 4 |
| | ncrc2668 | | | |
| | ncrc1421 | | | |
| | ncrc4827 | | | |
| 1130 | SEOA6151a | CCAAT/enhancer binding protein (C/EBP), delta (CEBPD) | 4885130 | 4 |
| | ncr7142 | | | |
| | ncr9376 | | | |
| | ncrc6489 | | | |
| 1131 | hfcr3844 | CLP (CLPP) | L54057.1 | 4 |
| | MIOA2031 | | | |
| | SEOA8290 | | | |
| | ncrb5197 | | | |
| 1132 | FCR5941 | necdin | AB007828 | 4 |
| | FCR6189 | | | |
| | seob7347 | | | |
| | seob6905 | | | |
| 1133 | ncr7923 | oxidoreductase UCPA (RefSeq aa 4e-82) | NP_064524.1 | 4 |
| | ncrc5548 | | | |
| | ncrc6369 | | | |
| | ncrb8378 | | | |
| 1134 | miob3965 | ring finger protein (C3H2C3 type) 6 (RNF6) | NM_005977.1 | 4 |
| | soa0078n | | | |
| | MIOA5676 | | | |
| | miob0359 | | | |
| 1135 | MIOA0861a | TPRC (=X97124 papillary renal cell carcinoma (translocation-associated) (PRCC)) | X99720 | 4 |
| | SEOA5721a | | | |
| | SEOA6715 | | | |
| | hfcr6292 | | | |
| 1136 | SEOA9740 | trinucleotide repeat DNA binding protein p20-CGGBP (CGGBP) gene, complete cds | AF094481 | 4 |
| | ncr9347 | | | |
| | SEOA9296 | | | |

Figure 6A – EST Names Corresponding to Unique Known Genes of Figure 6

| | | | | |
|---|---|---|---|---|
| | seob7984 | | | |
| 1137 | SEOA9205 | twist gene | Y10871.1 | 4 |
| | ncr1900 | | | |
| | ncrb7616 | | | |
| | SEOB1508 | | | |
| 1138 | ncr0122 | Zinc finger protein expressed in cerebellum (KF1) (ORF) | NM_005667.1 | 4 |
| | ncrc9689 | | | |
| | miob0764 | | | |
| | MIOB2194 | | | |
| 1139 | ncr5473 | glycyl-tRNA synthetase; glycine tRNAligase (RefSeq aa 1e-45) | NP_002038.1 | 4 |
| | ncrb2042 | | | |
| | ncr8589 | | | |
| | fcrb2029 | | | |
| 1140 | ncrb2606 | heterogeneous nuclear ribonucleoprotein H3 (2H9) (HNRPH3) (=hnRNP 2H9B) | NM_021644.1 | 4 |
| | ncrc0972 | | | |
| | seoa6759 | | | |
| | seoa6997 | | | |
| 1141 | MIOA1680a | heterogenous nuclear RNA W16W | X17272 | 4 |
| | MIOA1824a | | | |
| | MIOA5606a | | | |
| | MIOA7566a | | | |
| 1142 | ncr9744 | nuclear matrix protein 55 | U89867.1 | 4 |
| | seob5773 | | | |
| | seob3645 | | | |
| | miob0644 | | | |
| 1143 | SEOA5552a | RNA binding motif protein 3 (RBM3) (=U28686) | 5803136 | 4 |
| | SEOA7601a | | | |
| | hfcr8381 | | | |
| | mioa1031m | | | |
| 1144 | hfcr8599 | RNA binding motif protein 5 (RBM5) | AF091263.1 | 4 |
| | FCR2969 | | | |
| | FCR3571 | | | |
| | ncrb5063 | | | |
| 1145 | SEOA5292a | snRNP protein B | X17567 | 4 |
| | FCR5804 | | | |
| | FCR6227 | | | |
| 1146 | hfcr0852 | splicing factor 3b, subunit 2, 145kD (SF3B2) | NM_006842.1 | 4 |
| | fcrb2597 | | | |
| | ncrb3349 | | | |
| | ncrb6065 | | | |
| 1147 | hfcr6573 | splicing factor, arginine/serine-rich 4 (SFRS4) | NM_005626.1 | 4 |
| | hfcr9224 | | | |
| | ncrb0457 | | | |
| | ncrc8834 | | | |
| 1148 | ncr9539 | U13 snRNA pseudogene U13.4B | X58062.1 | 4 |
| | ncrb2116 | | | |
| | ncrb2930 | | | |
| | ncrc4786 | | | |

Figure 6A – EST Names Corresponding to Unique Known Genes of Figure 6

| | | | | |
|---|---|---|---|---|
| 1149 | ncr7539 | MIL1 protein (MIL1), nuclear gene encoding mitochondrial protein | NM_015367.1 | 4 |
| | ncrb2368 | | | |
| | ncr5372 | | | |
| | ncr7985 | | | |
| 1150 | ncr5649 | HLA class-I (HLA-A26) heavy chain | D32129.1 | 4 |
| | ncrb4212 | | | |
| | ncrc6304 | | | |
| | ncrb7038 | | | |
| 1151 | SEOA9344 | antigen identified by monoclonal antibodies 12E7, F21 and O13 (MIC2) mRNA | NM_002414.1 | 4 |
| | hfcr7046 | | | |
| | hfcr8532 | | | |
| | fcrb2726 | | | |
| 1152 | SEOA0024 | DNAJ domain-containing protein MCJ (MCJ) | AF126743.1 | 4 |
| | SEOB0477 | | | |
| | SEOA8768 | | | |
| | miob4494 | | | |
| 1153 | seob5562 | hepatocellular carcinoma-associated antigen 33 (HCA33) | AF244137.1 | 4 |
| | hfcr3967 | | | |
| | seob5373 | | | |
| | hfcr2047 | | | |
| | FCR6035 | | | |
| 1154 | MIOB2720 | sperm antigen-36 | AF187554.1 | 4 |
| | MIOB2728 | | | |
| | SEOB0422 | | | |
| | SEOB0461 | | | |
| 1155 | ncr3713 | Tax1 (human T-cell leukemia virus type I) binding protein 1 (TAX1BP1) | NM_006024.2 | 4 |
| | seob4022 | | | |
| | MIOA5391a | | | |
| | ncrb6068 | | | |
| 1156 | hfcr7576 | isolate Liv chaperone protein HSP90 beta (HSP90BETA) | AF275719.1 | 4 |
| | ncr1628 | | | |
| | hfcr9685 | | | |
| | hfcr3515 | | | |
| 1157 | seob4493 | membrane component, chromosome 11, surface marker 1 (M11S1) = Z48042.1 GPI-anchored protein p137 | NM_005898.1 | 4 |
| | FCR2160 | | | |
| | fcrb0292 | | | |
| | ncr6053 | | | |
| 1158 | MIOA5461a | putative transmembrane protein E3-16 | AF092128.1 | 4 |
| | MIOA7014a | | | |
| | MIOA5678 | | | |
| | SEOA4798a | | | |
| 1159 | SEOB3143 | tetraspan TM4SF (TSPAN-2) | AF054839.1 | 4 |
| | SOA0692 | | | |
| | ncrc0994 | | | |
| | SEOA0207a | | | |

Figure 6A – EST Names Corresponding to Unique Known Genes of Figure 6

| | | | | |
|---|---|---|---|---|
| 1160 | fcrb1289<br>ncrb5180<br>ncrc2192<br>ncrc4985 | coagulation factor XIII, A1 polypeptide (F13A1) | NM_000129.1 | 4 |
| 1161 | MIOA3275<br>SEOA9302<br>hfcr2862<br>ncr5492 | platelet-activating factor acetylhydrolase, isoform 1b, alpha subunit (PAFAH1B1) | 4557740 | 4 |
| 1162 | ncr0478<br>miob4451<br>ncrb7098<br>SEOA9837 | transferrin receptor (TFRC) gene | AF187320 | 4 |
| 1163 | seob7752<br>ncrb8260<br>ncrb4731<br>ncrb4883 | divalent cation tolerant protein CUTA (LOC51596) | 7706243 | 4 |
| 1164 | hfcr8877<br>ncr9462<br>ncrb4085<br>fcrb2755 | CGI-120 protein (LOC51644) | NM_016057.1 | 4 |
| 1165 | MIOA3913a<br>SEOB0633a<br>ncr7484<br>ncrc7090 | CGI-127 protein | AF151885.1 | 4 |
| 1166 | SEOA1104a<br>seob5479<br>seob7619<br>ncr0242 | CGI-139 protein (=AF078858 PTD003) | AF151897.1 | 4 |
| 1167 | ncr3402<br>ncr6275<br>hfcr8766<br>ncrb7509 | CGI-31 protein (LOC51075), | NM_015959.1 | 4 |
| 1168 | MIOA1354a<br>ncr2920<br>SEOB1684<br>SEOB0069 | CGI-34 protein | AF132968.1 | 4 |
| 1169 | FCR4787<br>FCR4907<br>hfcr1748<br>hfcr5702 | CGI-39 protein | AF132973.1 | 4 |
| 1170 | SEOB1526<br>fcrb1394<br>ncrb0152<br>ncrb5941 | CGI-74 protein | AF151832.1 | 4 |
| 1171 | FCR7318<br>FCR0530<br>ncr2601<br>hfcr0990 | echinoderm miCRotubule-associated protein homolog HuEMAP | U97018 | 4 |
| 1172 | FCR0703<br>SEOA1621a | pericentrin (Pcnt) | U05823 | 4 |

Figure 6A – EST Names Corresponding to Unique Known Genes of Figure 6

| | | | | |
|---|---|---|---|---|
| | hfcr9768<br>seob3743 | | | |
| 1173 | hfcr4423<br>fcrb1933<br>hfcr3572<br>fcrb1460 | MLL septin-like fusion protein MSF-A | AF189713.2 | 4 |
| 1174 | MIOA6174a<br>ncrb4408<br>ncrc1444<br>mioa1032m | nebulette (NEBL) | Y16241 | 4 |
| 1175 | hfcr1903<br>hfcr2804<br>hfcr6206<br>hfcr0427 | myosin light chain 2 | NM_013292.1 | 4 |
| 1176 | SEOB0343<br>ncrc2817<br>hfcr6310<br>ncrb4613 | coxsackievirus and adenovirus receptor (CXADR) | AF200465.1 | 4 |
| 1177 | ncrb0207<br>ncrb4907<br>ncrc1807<br>ncrc5719 | discoidin domain receptor family, member 2 (DDR2) | NM_006182.1 | 4 |
| 1178 | MIOA0252a<br>MIOA0358a<br>MIOA2796a<br>MIOB2699 | epidermal growth factor receptor, precursor | X00588 | 4 |
| 1179 | SEOA1436a<br>hfcr6960<br>ncr7257<br>ncrb5598 | insulin receptor | L07782 | 4 |
| 1180 | MIOA5411m<br>contigmar28-29-010038<br>FCR5331 | leptin receptor (ORF) | U66496 | 4 |
| 1181 | seob5203<br>miob3144<br>ncr3602<br>ncrc0413 | microvascular endothelial differentiation gene 1 product | AB026908.1 | 4 |
| 1182 | miob4895<br>fcrb2021<br>SEOB2083<br>hfcr9713 | vanilloid receptor; CARKL and CTNS; TIP1; P2X5b and P2X5a | AF168787.1 | 4 |
| 1183 | seob4090<br>ncrb5355<br>ncrb7258<br>miob6367 | vitiligo-associated protein VIT-1 (VIT1) (=DKFZp564K2364) | AF264714.1 | 4 |
| 1184 | seob6413<br>miob6076<br>mioa7907<br>miob6378 | epithelial protein lost in neoplasm beta (EPLIN) | NM_016357.1 | 4 |

Figure 6A – EST Names Corresponding to Unique Known Genes of Figure 6

| | | | | |
|---|---|---|---|---|
| 1185 | SEOB1895<br>miob6523<br>ncrb4912<br>seob5095 | mitogen-activated protein kinase 3 (MAP4K3) | 4506376 | 4 |
| 1186 | MIOA8361<br>ncr1109<br>ncr6899<br>hfcr7713 | protein-kinase, interferon-inducible double stranded RNA dependent inhibitor (=p58k protein) | NP_006251.1 | 4 |
| 1187 | SEOA4876a<br>ncrb6843<br>seob5662<br>seob6559 | ser-thr protein kinase PK428 | U59305 | 4 |
| 1188 | miob1044<br>hfcr6864<br>hfcr9911<br>ncr7630 | signal transducer and activator of transcription 1, 91kD (STAT1)(=transcription factor ISGF-3) | NM_007315.1 | 4 |
| 1189 | miob6960<br>seoa7806a<br>mioa8345n<br>ncr3455 | angiopoietin-like 1 (ANGPTL1) | NM_004673.1 | 4 |
| 1190 | mioa9456<br>MIOB2592<br>hfcr2867<br>mioa1144 | lens epithelium-derived growth factor gene, alternatively spliced, complete cds | AF199339.1 | 4 |
| 1191 | SEOA3296<br>ncrc3047<br>SEOA9733<br>SEOA4655a | transforming growth factor-beta 3 (TGF-beta 3) | X14891 | 4 |
| 1192 | seob5209<br>MIOB2666<br>miob1354<br>hfcr7817 | uncharacterized hypothalamus protein HARP11 (HARP11) | NM_018477.1 | 4 |
| 1193 | miob3259<br>hfcr1807<br>seob6355<br>seob6881 | calcium channel alpha1E subunit (CACNA1E) gene | AF223391.1 | 4 |
| 1194 | SEOA9620<br>MIOA2377a<br>ncr2774<br>miob1812 | multiple PDZ domain protein (MPDZ) = AF093419.1 | NM_003829.1 | 4 |
| 1195 | SEOB2108<br>seob7602<br>ncrb3528<br>ncr0801 | heterochromatin-like protein 1 (HECH) | NM_016587.1 | 4 |
| 1196 | miob4793<br>ncr8967<br>ncr1324<br>fcrb1680 | high-glucose-regulated protein 8 (HGRG8) | AF192968.1 | 4 |

Figure 6A – EST Names Corresponding to Unique Known Genes of Figure 6

| | | | |
|---|---|---|---|
| 1197 ncr3686<br>SEOA9723<br>ncr8208<br>ncrb0878 | BM-001 (=cyclin L ania-6a) | AF208843.1 | 4 |
| 1198 ncr3825<br>hfcr3730<br>ncrb1754<br>ncr6740 | caltractin (20kD calcium-binding protein) (CALT) | NM_004344.1 | 4 |
| 1199 miob5443<br>MIOA7236a<br>ncrb3013<br>MIOA4650a | cullin 1 (CUL1)+D1167 | AF062536.1 | 4 |
| 1200 ncr3642<br>SOA0044<br>fcrb0196<br>fcrb0276 | cyclin D2(=KIAK0002 gene) | NM_001759.1 | 4 |
| 1201 MIOA1343a<br>MIOA6830a<br>miob0891<br>MIOB2181 | M phase phosphoprotein 10 | X98494 | 4 |
| 1202 seob8157<br>hfcr9961<br>ncr1245<br>ncrb8624 | prefoldin 1 (PFDN1) | NM_002622.1 | 4 |
| 1203 FCR4639<br>MIOA2747a<br>SEOA9360<br>SEOA5249a | brain cellular apoptosis susceptibility protein (CSE1) | AF053641 | 4 |
| 1204 miob1818<br>hfcr0330<br>hfcr5188<br>hfcr6833 | p66shc (SHC) | U73377.1 | 4 |
| 1205 ncr3442<br>SEOA5351<br>SEOA1382<br>ncrc9655 | adrenomedullin (ADM) | NM_001124.1 | 4 |
| 1206 ncr0100<br>seob4996<br>ncrb3168<br>ncrb6700 | BUB3 (budding uninhibited by benzimidazoles 3, yeast) homolog (BUB3) = AF047472 | NM_004725.1 | 4 |
| 1207 SEOB1166<br>miob0954<br>fcrb1073<br>miob3394 | proto-oncogene tyrosine-protein kinase (ABL) gene | U07563.1 | 4 |
| 1208 ncr8096<br>ncrb2661<br>ncrc2284<br>seoa8011 | tumor endothelial marker 8 (TEM8) | AF279145.1 | 4 |
| 1209 ncrc0194<br>ncrc6226<br>ncrc2748 | hypothetical protein (RefSeq aa 5e-76) | NP_057578.1 | 4 |

Figure 6A – EST Names Corresponding to Unique Known Genes of Figure 6

| | | | | |
|---|---|---|---|---|
| | ncrb5121 | | | |
| 1210 | SEOA5909 | KIAA0206 | D86961 | 4 |
| | seob7710 | | | |
| | ncrc5564 | | | |
| | ncrb3993 | | | |
| 1211 | FCR4576 | KIAA0877 | AB020684 | 4 |
| | SEOA2813 | | | |
| | hfcr6766 | | | |
| | fcrb1501 | | | |
| 1212 | SEOB0228 | KIAA0993 | AB023210.1 | 4 |
| | ncrc5438 | | | |
| | hfcr8390 | | | |
| | SEOA0074 | | | |
| 1213 | hfcr0713 | KIAA1436 protein | AB037857.1 | 4 |
| | miob4106 | | | |
| | hfcr6183 | | | |
| | fcrb2020 | | | |
| 1214 | seoa7793a | P311 protein (P311), mRNA /cds=(202,408) /gb=NM_004772 /gi=4758865 /ug=Hs.142827 /len=2036 | Hs.142827 | 4 |
| | fcrb1616 | | | |
| | ncrb8337 | | | |
| | SEOB1956 | | | |
| 1215 | SEOA8771 | small EDRK-rich factor 1, long isoform (SERF1) (=btf2p44) | AF073519.1 | 4 |
| | miob5445 | | | |
| | hfcr1307 | | | |
| | ncrc6345 | | | |
| 1216 | miob5736 | v-yes-1 Yamaguchi sarcoma viral oncogene homolog 1 (YES1) | NM_005433.1 | 4 |
| | SOA0368 | | | |
| | miob4875 | | | |
| | fcrb2605 | | | |
| 1217 | seob5767 | vacuolar ATPase isoform VA68 | AF113129.1 | 4 |
| | hfcr0612 | | | |
| | miob0948 | | | |
| | seob8086 | | | |
| 1218 | hfcr9536 | deoxyuridine triphosphatase(DUT) mRNA, complete cds | U62891.1 | 4 |
| | miob0757 | | | |
| | ncrc1885 | | | |
| | FCR5349 | | | |
| 1219 | SEOA8564 | steroid dehydrogenase homolog | AF078850.1 | 4 |
| | SOA0643 | | | |
| | SEOA9235 | | | |
| | miob0411 | | | |
| 1220 | SEOB3141 | sterol carrier protein-X/sterol carrier protein-2 (SCP-X/SCP-2) | U11313.1 | 4 |
| | ncrb6232 | | | |
| | ncrc1127 | | | |
| | seob4712 | | | |
| 1221 | SEOA7530a | translin | X78627 | 4 |

Figure 6A – EST Names Corresponding to Unique Known Genes of Figure 6

| | | | | |
|---|---|---|---|---|
| | FCR1116 | | | |
| | fcr3817n | | | |
| | miob3890 | | | |
| 1222 | ncr0847 | ribosomal protein L36a (RefSeq aa 1e-54) | NP_000992.1 | 4 |
| | ncrb4370 | | | |
| | ncr2270 | | | |
| | ncr6711 | | | |
| 1223 | hfcr0382 | calpain-like protease (CANPX) | NM_014289.1 | 4 |
| | BFCS0457 | | | |
| | FCR4971 | | | |
| | hfcr7802 | | | |
| 1224 | fcrb1259 | cysteinyl-tRNA synthetase | L06845.1 | 4 |
| | BFCW0115 | | | |
| | ncr5140 | | | |
| | seob7102 | | | |
| 1225 | ncr3419 | ubiquitin-like 3 (UBL3) | NM_007106.1 | 4 |
| | ncrc4047 | | | |
| | mioa9974n | | | |
| | ncr5296 | | | |
| 1226 | ncrb3975 | YY1 transcription factor (YY1) | NM_003403.2 | 4 |
| | seob7686 | | | |
| | ncrc9592 | | | |
| | SEOA4336a | | | |
| 1227 | SEOB1251 | SR protein (RNPS1) | AF015608.1 | 4 |
| | hfcr3043 | | | |
| | hfcr9099 | | | |
| | SEOB3523 | | | |
| 1228 | ncrb5058 | major histocompatibility complex, class II, DR alpha (RefSeq aa 4e-78) | NP_061984.1 | 4 |
| | ncrb2093 | | | |
| | ncrc5104 | | | |
| | ncrc5513 | | | |
| 1229 | SEOA7169a | epb72 | X85117 | 4 |
| | seoa0964 | | | |
| | MIOA5204a | | | |
| | MIOA8146 | | | |
| 1230 | mioa9234 | putative type II membrane protein (HP10390), (ORF) | NM_014255.1 | 4 |
| | mioa9242 | | | |
| | FCR5663 | | | |
| | FCR7710 | | | |
| 1231 | SEOA8894 | metallothionein 1X (MT1X) gene | X65607.1 | 4 |
| | ncrb6524 | | | |
| | ncrb8393 | | | |
| | ncrc0948 | | | |
| 1232 | SEOA2106 | ionizing radiation resistance conferring protein (=X83544 DAP-3) | U18321 | 4 |
| | BFCW0177 | | | |
| | FCR7039 | | | |
| | MIOA1324a | | | |
| 1233 | ncr0110 | CGI-116 protein(LOC51019)(ORF)= AF155655 protein x 0009 mRNA | NM_016053.1 | 4 |
| | MIOA0454 | | | |

Figure 6A – EST Names Corresponding to Unique Known Genes of Figure 6

| | | | | |
|---|---|---|---|---|
| | seob6004 | | | |
| | ncr8099 | | | |
| 1234 | SEOA1277a | actin2 | D12816.1 | 4 |
| | SEOA9295 | | | |
| | SOA0337 | | | |
| | seob4754 | | | |
| 1235 | SEOA0014 | tropomyosin | M19267 | 4 |
| | fcrb1160 | | | |
| | fcrb1954 | | | |
| | miob4850 | | | |
| 1236 | seoa8119 | integral membrane protein 2B (ITM2B), mRNA /cds=(170,970) /gb=NM_021999 /gi=11527401 /ug=Hs.239625 /len=1843 | Hs.239625 | 4 |
| | ncrb7961 | | | |
| | seoa6255n | | | |
| | seoa6969 | | | |
| 1237 | SEOA9131 | unactive progesterone receptor, 23 kD (P23) = L24804.1= Q15185 (orf) | NM_006601.1 | 4 |
| | MIOA5087a | | | |
| | miob2677n | | | |
| | ncrc6175 | | | |
| 1238 | fcrb1072 | RAN binding protein 1 (RANBP1), low match | NM_002882.2 | 4 |
| | FCR3025 | | | |
| | CR0290 | | | |
| | FCR6139 | | | |
| 1239 | FCR4954 | voltage-dependent anion channel isoform 1 (VDAC) | L06132 | 4 |
| | BFCN0053 | | | |
| | FCR5809 | | | |
| | MIOA2077 | | | |
| 1240 | MIOA1149 | histone acetyltransferase 1 | AF030424 | 4 |
| | mioa1148n | | | |
| | seob4639 | | | |
| | ncr8990 | | | |
| 1241 | miob6355 | Nijmegen breakage syndrome 1 (nibrin) (NBS1) | NM_002485.2 | 4 |
| | fcrb1914 | | | |
| | ncr5232 | | | |
| | ncrb7525 | | | |
| 1242 | MIOA3239a | apoptosis-related protein TFAR15 (TFAR15) | AF022385 | 4 |
| | mioa3229an | | | |
| | miob6406 | | | |
| | ncrb3506 | | | |
| 1243 | miob3147 | septin 2-like cell division control protein | AF146760.1 | 4 |
| | SEOA9119 | | | |
| | seoa2602n | | | |
| | ncr5077 | | | |
| 1244 | hfcr0383 | tumor antigen (L6) | M90657.1 | 4 |
| | BFCN0186 | | | |
| | ncr5200 | | | |
| | ncrb4180 | | | |
| 1245 | ncrb8063 | hypothetical 43.2 Kd protein (RefSeq aa 7e-35) | NP_057050.1 | 4 |
| | ncrc9617 | | | |
| | ncrb4729 | | | |

Figure 6A – EST Names Corresponding to Unique Known Genes of Figure 6

| | | | | |
|---|---|---|---|---|
| | ncr8503 | | | |
| 1246 | SEOA4330a<br>FCR3134N<br>seob7936<br>ncrb7377 | KIAA0592 (ORF) | AB011164 | 4 |
| 1247 | seob3996<br>SEOA4545<br>SEOA6510a<br>miob4558 | KIAA0829 | AB020636 | 4 |
| 1248 | seob5414<br>seob4281<br>miob0082<br>ncrb5244 | KIAA1265 | AB033091 | 4 |
| 1249 | ncrc1871<br>ncrc1089<br>ncrb3119<br>ncrb6496 | murine mammary tumor integration site 6(oncogene homolog) (RefSeq aa 6e-84) | NP_001559.1 | 4 |
| 1250 | ncrc3036<br>ncrb7897<br>FCR2601<br>ncr9715 | PC3 cell line (TL27) | X75684.1 | 4 |
| 1251 | miob3741<br>ncrc4955<br>seob5146<br>mioa9336 | small acidic protein (IMAGE145052) | NM_014267.1 | 4 |
| 1252 | FCR0134<br>SEOA2909a<br>SEOA5912<br>SOA0478 | lysophospholipase (LPL1) | AF081281 | 4 |
| 1253 | SEOA1575a<br>CR0215<br>SEOB1226<br>fCR0215 | mitochondrial ATP synthase subunit 9 | U09813 | 4 |
| 1254 | seob6836<br>miob6743<br>ncrc0983<br>ncrc0983 | hXBP-1 transcription factor DNA (=TREB protein) | L13850.1 | 4 |
| 1255 | FCR0704<br>FCR0739<br>hfcr7066<br>FCR3843 | zinc finger protein(MAZ) | M94046 | 4 |
| 1256 | SEOB2295<br>ncr7647<br>FCR7063<br>MIOA4939a | KARP-1-binding protein 3 (=KIAA0470) | AB022659.1 | 4 |
| 1257 | FCR2074<br>hfcr8814<br>hfcr8677<br>hfcr7123 | miCRofibril-associated glycoprotein (MFAP2) | U19718 | 4 |
| 1258 | fcrb2208<br>hfcr1763 | smooth muscle myosin alkali light chain | U02629.1 | 4 |

Figure 6A – EST Names Corresponding to Unique Known Genes of Figure 6

| | | | | |
|---|---|---|---|---|
| | MIOA6251a | | | |
| | ncr7096 | | | |
| 1259 | FCR3790 | novel growth factor receptor | M64347 | 4 |
| | CR0584 | | | |
| | FCR1184 | | | |
| | SEOA8289 | | | |
| 1260 | mioa9821 | inducible 6-phosphofructo-2-kinase/fructose 2,6-bisphosphatase (IPFK-2) = NM_004566.1 | AF056320 | 4 |
| | SEOA1361 | | | |
| | FCR5026 | | | |
| | ncrc2341 | | | |
| 1261 | FCR5810 | GTPase activating protein (rap1GAP) | M64788 | 4 |
| | FCR2099 | | | |
| | SEOA1909 | | | |
| | MIOA0152 | | | |
| 1262 | ncr4993 | chromodomain helicase DNA binding protein 1 (CHD1)(RefSeq aa 1e-72) | NP_001261.1 | 4 |
| | ncrc9020 | | | |
| | SEOA8540 | | | |
| | SEOA4292a | | | |
| 1263 | ncrc0421 | topoisomerase IIb mRNA,(= TOP2 mRNA for DNA topoisomeraseII ) | U54831.1 | 4 |
| | hfcr6482 | | | |
| | miob6277 | | | |
| | ncrc1272 | | | |
| 1264 | hfcr3007 | CUG triplet repeat,RNA-binding protein 2 (CUGBP2), (=apoptosis-related RNA binding protein (NAPOR-2)) | NM_006561.1 | 4 |
| | ncrc3546 | | | |
| | miob3363 | | | |
| | ncrc3546 | | | |
| 1265 | MIOA7139a | retinoblastoma 1 (including osteosarcoma) (RB1) | NM_000321.1 | 3 |
| | miob3033 | | | |
| | ncr3149 | | | |
| 1266 | miob1785 | lectin, galactoside-binding, soluble, 3 (galectin 3) (LGALS3) | NM_002306.1 | 3 |
| | ncr1051 | | | |
| | ncrc9700 | | | |
| 1267 | seob3854 | guanine nucleotide binding protein (G protein), alpha inhibiting activity polypeptide 3 (GNAI3) | NM_006496.1 | 3 |
| | miob0767 | | | |
| | ncr1330 | | | |
| 1268 | SEOA0190A | protein phosphatase 2A B56-epsilon (PP2A) | L76703 | 3 |
| | FCR0669 | | | |
| | SEOA0190A | | | |
| 1269 | hfcr2506 | COX VIa-L cytochrome c oxidase liver-specific subunit VIa (EC 1.9.3.1) | X15341.1 | 3 |
| | miob3378 | | | |
| | seob4326 | | | |
| 1270 | ncr2197 | VDUP1 upregulated by 1,25-dihydroxyvitamin D-3, mRNA(=HHCPA78 homolog VDUP1 ) | NM_006472.1 | 3 |
| | ncrc0863 | | | |
| | ncrc9639 | | | |

Figure 6A – EST Names Corresponding to Unique Known Genes of Figure 6

| | | | | |
|---|---|---|---|---|
| 1271 | hfcr2874<br>ncrb0165<br>mioa7893 | reticulocalbin 1, EF-hand calcium binding domain (RCN1) | NM_002901.1 | 3 |
| 1272 | miob6730<br>ncrc6198<br>hfcr6047 | NADH dehydrogenase (ubiquinone) 1 beta subcomplex, 5 (16kD, SGDH) (NDUFB5) | NM_002492.1 | 3 |
| 1273 | FCR4616<br>hfcr0060<br>FCR4616 | translation initiation factor A121/Sui1 (A121/SUI1), putative | AF100737 | 3 |
| 1274 | fcrb1803<br>hfcr2770<br>seob4489 | proteasome (prosome macropain) 26S subunit, ATPase, 1 (PSMC1) | NM_002802.1 | 3 |
| 1275 | miob1381<br>ncrb3429<br>seob7265 | integrin, beta 5 (ITGB5) | NM_002213.1 | 3 |
| 1276 | ncr2522<br>ncrb0115<br>SEOA5285a | plasma membrane calcium ATPase isoform 1 (ATP2B1) gene,= J04027 | L14561 | 3 |
| 1277 | ncr3188<br>ncrc1192<br>ncrc2289 | mannosidase, alpha, class 1A, member 2 (MAN1A2) | NM_006699.1 | 3 |
| 1278 | hfcr0250<br>hfcr3028<br>hfcr5735 | delta-like homolog (Drosophila) (DLK1)(= adrenal specific) | NM_003836.1 | 3 |
| 1279 | MIOA8857<br>ncrc5931<br>miob0360 | FAT tumor suppressor (Drosophila) homolog | NP_005236.1 | 3 |
| 1280 | hfcr5275<br>fcrb1944<br>hfcr0365 | FUS glycine rich protein | X71428.1 | 3 |
| 1281 | hfcr3727<br>hfcr4557<br>hfcr7039 | eukaryotic translation elongation factor 1 delta (guanine nucleotide exchange protein) (EEF1D) | NM_001960.1 | 3 |
| 1282 | SEOA0099<br>ncr4671<br>SEOA1487 | ubiquitin-conjugating enzyme E2 | AB017644.1 | 3 |
| 1283 | ncr2631<br>ncr2115<br>SEOB0009 | thyroid hormone receptor interactor 12 (TRIP12) (=KIAA0045) | NM_004238.1 | 3 |
| 1284 | miob3552<br>hfcr2639<br>miob3552 | IMP (inosine monophosphate)dehydrogenase 2 (IMPDH2) | NM_000884.1 | 3 |

Figure 6A – EST Names Corresponding to Unique Known Genes of Figure 6

| | | | | |
|---|---|---|---|---|
| 1285 | seob6582 | major histocompatibility complex, class II, DR beta 1 (HLA-DRB1) | NM_002124.1 | 3 |
| | hfcr9066 | | | |
| | ncrc6811 | | | |
| 1286 | MIOA3089a | DNA topoisomerase II (TOP2) | Z15115 | 3 |
| | FCR5288 | | | |
| | SEOA5755a | | | |
| 1287 | seob5817 | laminin, beta 1 (LAMB1) | NM_002291.1 | 3 |
| | hfcr4273 | | | |
| | hfcr0452 | | | |
| 1288 | hfcr2670 | hum-a-tub1 alpha-tubulin | AF141348.1 | 3 |
| | hfcr6844 | | | |
| | hfcr1298 | | | |
| 1289 | miob3247 | nerve growth factor (HBNF-1)(= OSF-1)(= pleiotropin ) | M57399.1 | 3 |
| | ncrb5203 | | | |
| | fcrb1511 | | | |
| 1290 | MIOA4005a | ras-related C3 botulinum toxin substrate (rac) | M29870 | 3 |
| | BFCW0170 | | | |
| | ncrc3179 | | | |
| 1291 | FCR1748 | voltage dependent anion channel form 3 (=AF038962) | U90943 | 3 |
| | SEOA6124a | | | |
| | SEOA0850n | | | |
| 1292 | hfcr6404 | polymerase (DNA directed) delta 2, regulatory subunit (50kD) (POLD2) | NM_006230.1 | 3 |
| | hfcr6576 | | | |
| | hfcr7231 | | | |
| 1293 | SEOA7231a | guanylate binding protein isoform II (GBP-2) | M55543 | 3 |
| | miob4567 | | | |
| | SEOB0962 | | | |
| 1294 | miob5629 | HSPC328 | AF161446.1 | 3 |
| | hfcr3670 | | | |
| | ncr4120 | | | |
| 1295 | miob1864 | spinocerebellar ataxia 1(olivopontocerebellar ataxia 1, autosomal dominant, ataxin 1) (SCA1), mRNA | NM_000332.1 | 3 |
| | ncrc2259 | | | |
| | MIOA4427 | | | |
| 1296 | MIOA2563a | ATP-binding cassette, sub-family A (ABC1), member 8, putative (=AB020629 KIAA0822) (67% aa) | 6005701 | 3 |
| | MIOA1685a | | | |
| | ncrc9736 | | | |
| 1297 | ncr3346 | galactosidase, alpha (GLA) | NM_000169.1 | 3 |
| | ncr5715 | | | |
| | FCR6279 | | | |
| 1298 | ncr4009 | glucose regulated protein, 58kD (GRP58) | NM_005313.1 | 3 |
| | seob5268 | | | |
| | ncrb1868 | | | |
| 1299 | ncrb5931 | dihydrodiol dehydrogenase 2 (trans-1,2-dihydrobenzene-1,2-diol dehydrogenase) (RefSeq aa 1e-67) | NP_001345.1 | 3 |
| | ncrb2388 | | | |
| | ncrb6284 | | | |

Figure 6A – EST Names Corresponding to Unique Known Genes of Figure 6

| | | | | |
|---|---|---|---|---|
| 1300 | MIOA6091<br>SEOA6117a<br>HFCR3261 | squalene epoxidase | D78129 | 3 |
| 1301 | FCR4568<br>seoa0263m<br>SEOA8795 | CYTOCHROME C OXIDASE POLYPEPTIDE VIIC PRECURSOR | spP15954 | 3 |
| 1302 | ncrb0017<br>ncr5131<br>ncr4858 | cytochrome c oxidase subunit III (RefSeq aa 1e-54) | gi5835394 | 3 |
| 1303 | FCR6264<br>ncr3710<br>ncrc4659 | methionine adenosyltransferase alpha subunit | L43509 | 3 |
| 1304 | MIOA0582a<br>ncr3915<br>SEOA4405a | Krueppel-related DNA-binding protein (PF4) | M61866 | 3 |
| 1305 | SEOA4029a<br>MIOA7187a<br>seob7190 | RING zinc finger protein (RZF) | AF037204 | 3 |
| 1306 | MIOA3668a<br>ncrc4296<br>seob7429 | RNA helicase | AJ223948 | 3 |
| 1307 | SEOB3139<br>hfcr6630<br>ncrb4116 | Glutathione transferase omega (GSTO1) | AF212303.1 | 3 |
| 1308 | SEOA3641a<br>SEOA5425<br>mioa9530 | L-isoaspartyl/D-aspartyl protein carboxyl methyltransferase isozyme I | M93009 | 3 |
| 1309 | FCR2882<br>fcrb2198<br>fcr7552 | collagen type V alpha 1(COL5A1) | D90279 | 3 |
| 1310 | MIOB2743<br>ncrb5547<br>ncrc3349 | interferon gamma receptor 2 (interferon gamma transducer 1) (IFNGR2) | 5031782 | 3 |
| 1311 | SEOB2139<br>miob1087<br>ncrb4709 | nuclear receptor subfamily 3, group C, member 1 (NR3C1) | NM_000176.1 | 3 |
| 1312 | FCR2546N<br>SEOA4416a<br>hfcr7794 | insulin-like growth factor binding protein-3 | X64875 | 3 |
| 1313 | seob4108<br>MIOB2821<br>hfcr3392 | potassium channel modulatory factor (=DKFZp434L1021) | AF155652.1 | 3 |
| 1314 | SEOA0844<br>FCR2629<br>seob8129 | cyclin protein | M15796 | 3 |
| 1315 | seob6437<br>MIOA2402a | nuclear phosphoprotein similar to S. cerevisiae | NM_007062.1 | 3 |

Figure 6A – EST Names Corresponding to Unique Known Genes of Figure 6

| | | | | |
|---|---|---|---|---|
| | hfcr3048 | | | |
| 1316 | seob7369 | COP9 complex subunit 4 (LOC51138) | NM_016129.1 | 3 |
| | MIOA1448 | | | |
| | ncrc4988 | | | |
| 1317 | FCR2034N | endomembrane protein EMP70 precusor isologue | U95973 | 3 |
| | seob5180 | | | |
| | miob6271 | | | |
| 1318 | MIOA1980a | KIAA0695 | AB014595 | 3 |
| | ncrb3948 | | | |
| | miob6668 | | | |
| 1319 | miob6382 | KIAA0769 gene product (KIAA0769) | NM_014824.1 | 3 |
| | mioa9367 | | | |
| | hfcr6821 | | | |
| 1320 | SEOA0733a | neuronal protein | X79682 | 3 |
| | FCR1241N | | | |
| | FCR3024N | | | |
| 1321 | miob6372 | NRAS-related gene (D1S155E) (=DKFZp586J0620) | NM_007158.1 | 3 |
| | fcrb0125 | | | |
| | ncrb2006 | | | |
| 1322 | miob3043 | RAB13, member RAS oncogene family (RAB13) mRNA | NM_002870.1 | 3 |
| | fcrb1977 | | | |
| | ncr1689 | | | |
| 1323 | SEOA4487 | retrotransposon 3' long terminal repeat | Z48633 | 3 |
| | ncr2856 | | | |
| | SEOB1696 | | | |
| 1324 | FCR1499 | sex-regulated protein janus A | S77099 | 3 |
| | hfcr2633 | | | |
| | fcrb1225 | | | |
| 1325 | seob7402 | ATPase, Ca transporting, cardiac muscle, slow twitch 2 (ATP2A2) | NM_001681.1 | 3 |
| | fcrb0299 | | | |
| | fcrb0177 | | | |
| 1326 | ncr3763 | cysteine protease | D55696.1 | 3 |
| | ncr0400 | | | |
| | hfcr9560 | | | |
| 1327 | MIOA8356 | protein-tyrosine-phosphatase G1 | D13380.1 | 3 |
| | FCR2978 | | | |
| | FCR2889 | | | |
| 1328 | SEOB0606 | adipocyte acid phosphatase beta=phenylarsine oxide-sensitive tyrosyl phosphatase | S62885.1 | 3 |
| | miob6813 | | | |
| | ncrb0012 | | | |
| 1329 | ncr1782 | ATP SYNTHASE PROTEIN 8 (A6L) | P03928 | 3 |
| | ncrc6510 | | | |
| | ncrc7099 | | | |
| 1330 | SEOA4395a | hinge=OXPHOS system complex III | S61826 | 3 |
| | ncrb7427 | | | |
| | seob6438 | | | |
| 1331 | MIOA0985 | mitochondrial aldehyde dehydrogenase (ALDH I) | Y00109 | 3 |
| | MIOA6826a | | | |
| | FCR5949 | | | |

Figure 6A – EST Names Corresponding to Unique Known Genes of Figure 6

| | | | | |
|---|---|---|---|---|
| 1332 | SEOB3479<br>FCR0874<br>ncr2425 | NADH dehydrogenase (ubiquinone) 1, subcomplex unknown, 1 (6kD, KFYI) (NDUFC1) | NM_002494.1 | 3 |
| 1333 | SEOB0089<br>hfcr9535<br>ncrc5993 | NADH dehydrogenase (ubiquinone) Fe-S protein 6 (13kD) (NADH-coenzyme Q reductase) (NDUFS6) | NM_004553.1 | 3 |
| 1334 | MIOA6501a<br>fcrb1115<br>ncrb4021 | Na,K-ATPase beta subunit (ATP1B) | M25160 | 3 |
| 1335 | seob6203<br>ncrc9021<br>ncr1672 | wingless-type MMTV integration site family, member 2B (WNT2B), mRNA | NM_004185.1 | 3 |
| 1336 | ncr5426<br>ncrc8572<br>ncrc3154 | alpha-1-antichymotrypsin, precursor;actichymotrypsin (RefSeq aa 6e-32) | NP_001076.1 | 3 |
| 1337 | FCR6234<br>hfcr7570<br>hfcr8811 | cystatin C | X52255 | 3 |
| 1338 | hfcr7603<br>hfcr6178<br>hfcr3873 | proteasome (prosome, macropain) 26S subunit, ATPase, 3 (PSMC3) | NM_002804.1 | 3 |
| 1339 | miob4570<br>miob5628<br>ncrb0131 | sorting nexin 2 (SNX2) | AF065482.1 | 3 |
| 1340 | hfcr7967<br>ncrc8833<br>FCR5474 | DiGeorge syndrome critical region gene 6 (DGCR6) | NM_005675.1 | 3 |
| 1341 | ncr8975<br>SEOA4606a<br>ncrb0669 | ubiquitin-conjugating enzyme E2L 3 (UBE2L3) | NM_003347.1 | 3 |
| 1342 | SEOB1345<br>SEOA9337<br>seob7608 | Cdc5-related protein (PCDC5RP) (=AB007892.1 KIAA0432) | U86753.1 | 3 |
| 1343 | MIOA4845a<br>SEOA8845<br>mioa7687a | CGI-99 protein = homeobox prox 1= AF100755.1(ORF) | AF151857 | 3 |
| 1344 | fcrb0355<br>hfcr0822<br>hfcr1323 | jun B proto-oncogene (JUNB) | NM_002229.1 | 3 |
| 1345 | MIOA7485a<br>miob5128<br>SEOA6920 | mSin3A (sin3A) | U22394 | 3 |
| 1346 | hfcr6568<br>seoa7854a<br>ncr7947 | retinoblastoma-binding protein 7 (RBBP7) | NM_002893.1 | 3 |

Figure 6A – EST Names Corresponding to Unique Known Genes of Figure 6

| | | | | |
|---|---|---|---|---|
| 1347 | ncrb2389<br>ncrc3283<br>seoa7997 | X-box binding protein 1 (RefSeq aa 3e-37) | NP_005071.1 | 3 |
| 1348 | seob7424<br>ncr1431<br>miob6715 | zinc finger protein 133 (clone pHZ-13) (ZNF133) | NM_003434.1 | 3 |
| 1349 | SEOB1839<br>fcrb0200<br>mioa9761 | dead box, X isoform (DBX) | AF000982.1 | 3 |
| 1350 | hfcr1843<br>ncrb7905<br>ncrc4087 | six transmembrane epithelial antigen of prostate (STEAP1) | AF186249.1 | 3 |
| 1351 | mioa9908<br>miob0999<br>ncrb7970 | coatomer protein complex, subunit beta 2 (beta prime) (COPB2) | NM_004766.1 | 3 |
| 1352 | MIOA3393a<br>FCR5707<br>FCR5704 | helicase II (RAD54L) (=ATRX) | U09820 | 3 |
| 1353 | mioa9792<br>ncrc9774<br>ncr4700 | topoisomerase (DNA) II alpha (170kD) (TOP2A) (ORF) | NM_001067.1 | 3 |
| 1354 | SEOA0853<br>SEOA9029<br>miob6526 | cytochrome succinate dehydrogenase, small subunit | AB026906.1 | 3 |
| 1355 | hfcr3503<br>ncrc6484<br>ncrb3301 | GTT1 | AF270647 | 3 |
| 1356 | MIOA1252<br>FCR6027<br>SEOA3749a | major histocompatibility locus class III regions Hsc70t (smRNP, G7A, NG23, MutS homolog, CLCP, NG24, NG25, and NG26) | AF109905 | 3 |
| 1357 | FCR1347<br>hfcr0839<br>FCR3106 | prenylated rab acceptor 1 (PRA1) | AF025506 | 3 |
| 1358 | MIOA1882a<br>miob4205<br>ncrb4819 | CGI-49 protein | AF151807.1 | 3 |
| 1359 | MIOA2038<br>ncrb7065<br>mioa9787 | spindle pole body protein spc98 homologue GCP3 | AF042378 | 3 |
| 1360 | hfcr6734<br>BFCS0347n<br>hfcr8016 | chondroitin sulfate proteoglycan 4 (melanoma-associated) (CSPG4) | NM_001897.1 | 3 |
| 1361 | miob3967<br>SEOA5942<br>hfcr3529 | ankyrin G (ANK-3) | U13616.1 | 3 |
| 1362 | SEOB1972 | spectrin beta protein (pAZSP 3' end) | X91849.2 | 3 |

Figure 6A – EST Names Corresponding to Unique Known Genes of Figure 6

| | | | | |
|---|---|---|---|---|
| | hfcr8428 | | | |
| | MIOA4185 | | | |
| 1363 | hfcr5445 | cold inducible RNA-binding protein (CIRBP) | NM_001280.1 | 3 |
| | ncrc0696 | | | |
| | fcrb2628 | | | |
| 1364 | FCR7453 | lamin A | M13452 | 3 |
| | hfcr2666 | | | |
| | HFCR3201 | | | |
| 1365 | miob1800 | phosphatidylinositol glycan, class B (PIGB) | NM_004855.1 | 3 |
| | ncrb6353 | | | |
| | ncrc9847 | | | |
| 1366 | seob4945 | interleukin 13 receptor alpha 1 (IL13RA1) | NM_001560.1 | 3 |
| | seoa3877n | | | |
| | MIOA1565n | | | |
| 1367 | seob5012 | retinoic acid suppression protein A (RSG-A) | AF038964.1 | 3 |
| | ncr9982 | | | |
| | hfcr2959 | | | |
| 1368 | ncr2176 | CDC28 protein kinase 1 (RefSeq aa 4e-44) | NP_001817.1 | 3 |
| | mioa7789a | | | |
| | ncrc6059 | | | |
| 1369 | miob4378 | latent transforming growth factor beta binding protein 2 (LTBP2) | NM_000428.1 | 3 |
| | ncrc0953 | | | |
| | hfcr2873 | | | |
| 1370 | hfcr9125 | fibroblast growth factor 7 (keratinocyte growth factor) (FGF7) | NM_002009.1 | 3 |
| | hfcr7617 | | | |
| | mioa2127m | | | |
| 1371 | MIOA0332 | PDZ domain containing-protein (PDZK1) | AF012281 | 3 |
| | ncrb8577 | | | |
| | ncr1352 | | | |
| 1372 | ncrb7211 | stanniocalcin 1 (STC1) | NM_003155.1 | 3 |
| | ncrb7212 | | | |
| | ncrb8524 | | | |
| 1373 | seob1039 | fer-1 (C. elegans)-like 3 (FER1L3) (=AF182317 myoferlin (MYOF)) | NM_013451.1 | 3 |
| | fcrb2041 | | | |
| | ncrb3393 | | | |
| 1374 | fcrb0988 | chromobox homolog 1(Drosophila HP1 beta) (CBX1), mRNA | NM_006807.1 | 3 |
| | hfcr1931 | | | |
| | miob0898 | | | |
| 1375 | MIOB2247 | telomeric repeat binding factor (TRF1) | U40705.1 | 3 |
| | fcrb1990 | | | |
| | ncrb1159 | | | |
| 1376 | hfcr6700 | prefoldin 2 (PFDN2) | NM_012394.1 | 3 |
| | ncrb2029 | | | |
| | seoa0442n | | | |
| 1377 | seoa7871a | 15 kDa selenoprotein (SEP15), mRNA /cds=(4,492) /gb=NM_004261 /gi=4759095 /ug=Hs.90606 /len=1244 | Hs.90606 | 3 |
| | mioa0509 | | | |

Figure 6A – EST Names Corresponding to Unique Known Genes of Figure 6

| | | | | |
|---|---|---|---|---|
| | seoa4940a | | | |
| 1378 | FCR2530 | 4F5rel | AF073298 | 3 |
| | FCR6804 | | | |
| | FCR6897 | | | |
| 1379 | SEOA7115a | androgen induced protein (AIG-1) (=AF151861 CGI-103 protein) | AF153605.1 | 3 |
| | SEOA8714 | | | |
| | SEOA1076a | | | |
| 1380 | MIOA6102a | antigen NY-CO-1 (NY-CO-1) | AF039687.1 | 3 |
| | FCR0105 | | | |
| | SEOA0445 | | | |
| 1381 | SEOA4158a | ceroid-lipofuscinosis, neuronal 2, late infantile (Jansky-Bielschowsky disease)CLN2) mRNA | NM_000391.2 | 3 |
| | ncr2337 | | | |
| | ncrc4188 | | | |
| 1382 | MIOA9033 | CG3450 gene product [Drosophila melanogaster](86% ORF) | AAF57398.1 | 3 |
| | miob0680 | | | |
| | SEOB1605 | | | |
| 1383 | SEOA5785 | ELK1 (ELK1) | AF080616 | 3 |
| | ncr4341 | | | |
| | fcrb1387 | | | |
| 1384 | MIOA4318a | embryonic lung protein (HUEL) | AF006621.1 | 3 |
| | ncrb3510 | | | |
| | miob1338 | | | |
| 1385 | MIOA6704a | ENDOPLASMIN PRECURSOR (94 KD GLUCOSE-REGULATED PROTEIN) (GRP94) (GP96 HOMOLOG) (TUMOR REJECTION ANTIGEN 1) | spP14625 | 3 |
| | MIOA8468 | | | |
| | seoa1357m | | | |
| 1386 | miob3004 | gene hY3 encoding a cytoplasmic Ro RNA | V00585.1 | 3 |
| | MIOA3445a | | | |
| | SEOA6193a | | | |
| 1387 | MIOA1976a | GS3955 | D87119 | 3 |
| | FCR4758 | | | |
| | seoa7714a | | | |
| 1388 | seob6486 | HBV pX associated protein-8 (LOC51773) | NM_016578.1 | 3 |
| | miob4918 | | | |
| | ncr6407 | | | |
| 1389 | MIOB2691 | HRIHFB2072 (=AF115778 M.musculus short coiled coil protein SCOCO (Scoc)) | AB015335.1 | 3 |
| | ncr8993 | | | |
| | MIOA9146 | | | |
| 1390 | MIOA2285a | HSPC004 | AF070660 | 3 |
| | MIOA4003a | | | |
| | SEOA1931 | | | |
| 1391 | SEOA3164m | HSPC019 | AF077205.1 | 3 |
| | MIOA2023 | | | |
| | seob7273 | | | |
| 1392 | hfcr6375 | HSPC033 protein (HSPC033) | NM_014041.1 | 3 |
| | ncrb6697 | | | |
| | ncrc2049 | | | |

Figure 6A – EST Names Corresponding to Unique Known Genes of Figure 6

| | | | | |
|---|---|---|---|---|
| 1393 | hfcr3679<br>hfcr9030<br>ncrc5876 | HSPC037 protein (LOC51659) | NM_016095.1 | 3 |
| 1394 | ncr4535<br>ncrc6062<br>ncrb8559 | HSPC158 protein (RefSeq aa 3e-87) | NP_054899.1 | 3 |
| 1395 | SEOA2889a<br>miob0856<br>miob4576 | HSPC161 | AF161510 | 3 |
| 1396 | hfcr8475<br>seoa8032<br>ncrb8222 | HSPC162 protein (HSPC162) | NM_014183.1 | 3 |
| 1397 | SEOB1009<br>hfcr0177<br>ncrc6040 | HSPC218 | AF151052.1 | 3 |
| 1398 | SEOB2221<br>seob7902<br>seob5973 | HSPC241 | AF151075.1 | 3 |
| 1399 | ncr0438<br>ncrb0069<br>ncrc5887 | HSPC275 | AF161393 | 3 |
| 1400 | ncr3197<br>hfcr8940<br>seob5469 | HSPC337 | AF161455.1 | 3 |
| 1401 | ncr6344<br>ncrc3390<br>ncr4628 | HTGN29 protein (HTGN29) | NM_020199.1 | 3 |
| 1402 | MIOA4678<br>ncrc5614<br>SEOB1637 | hyperion gene | AJ010770 | 3 |
| 1403 | ncrc0423<br>ncrc1944<br>ncrc9193 | hypothetical protein (RefSeq aa 5e-73) | NP_057016.1 | 3 |
| 1404 | ncr0276<br>FCR3618<br>MIOA0320 | iduronate sulphate sulphatase (IDS) gene | L35485.1 | 3 |
| 1405 | SEOA7542a<br>ncr0889<br>ncrb1871 | KIAA0040 | D25539 | 3 |
| 1406 | FCR5490<br>MIOA1671a<br>miob4374 | KIAA0065 (ZNF33A Kruppel-related) | D31763 | 3 |
| 1407 | FCR0593<br>fcrb0926<br>fcrb1898 | KIAA0076 | D38548 | 3 |
| 1408 | FCR3034<br>MIOA4750<br>ncr4870 | KIAA0081 | D42039 | 3 |
| 1409 | FCR6616<br>SEOA9840<br>miob3140 | KIAA0090 | D42044 | 3 |
| 1410 | ncr3793 | KIAA0099 protein, partial cds | D43951.1 | 3 |

Figure 6A – EST Names Corresponding to Unique Known Genes of Figure 6

| | | | | |
|---|---|---|---|---|
| | hfcr2900 | | | |
| | SEOA8841 | | | |
| 1411 | SEOB0857a | KIAA0104 | D14660.1 | 3 |
| | seob7035 | | | |
| | hfcr7412 | | | |
| 1412 | FCR6188 | KIAA0121 | D50911 | 3 |
| | hfcr2512 | | | |
| | fcrb2500 | | | |
| 1413 | FCR1328 | KIAA0128 | D50918 | 3 |
| | FCR1045 | | | |
| | FCR5975 | | | |
| 1414 | SEOA1617a | KIAA0146 | D63480 | 3 |
| | FCR6437 | | | |
| | FCR1717 | | | |
| 1415 | SEOB3105 | KIAA0152 (cytotoxic T-cell membrane glycoprotein Ly-3 isolog) | NM_014730.1 | 3 |
| | ncrb0826 | | | |
| | FCR5866 | | | |
| 1416 | SEOA7383a | KIAA0170 | D79992 | 3 |
| | miob5463 | | | |
| | fcrb0023 | | | |
| 1417 | ncrb0027 | KIAA0182 gene | D80004.1 | 3 |
| | ncrc3569 | | | |
| | ncrc6896 | | | |
| 1418 | MIOA0891a | KIAA0188 | D80010 | 3 |
| | fcrb0881 | | | |
| | ncrb5284 | | | |
| 1419 | MIOA8367 | KIAA0205 | D86960 | 3 |
| | seoa7825a | | | |
| | MIOA4803a | | | |
| 1420 | SEOA4056 | KIAA0238 | D87075 | 3 |
| | MIOA8900 | | | |
| | miob3561 | | | |
| 1421 | MIOA5231a | KIAA0255 gene | D87444 | 3 |
| | CR0454 | | | |
| | FCR2957 | | | |
| | MIOA0217a | | | |
| 1422 | SEOA5503a | KIAA0261 | D87450 | 3 |
| | ncr4142 | | | |
| | seob4907 | | | |
| 1423 | MIOA3486a | KIAA0262 | D87451 | 3 |
| | FCR5887 | | | |
| | FCR1912 | | | |
| 1424 | seob6264 | KIAA0310 protein | AB002308.2 | 3 |
| | hfcr2621 | | | |
| | seob7171 | | | |
| 1425 | SEOA6648a | KIAA0379 | AB002377 | 3 |
| | MIOA3500a | | | |
| | ncrc2195 | | | |
| 1426 | seob4029 | KIAA0419 gene product (KIAA0419) | NM_014711.1 | 3 |
| | ncrb5616 | | | |
| | FCR4766 | | | |

Figure 6A – EST Names Corresponding to Unique Known Genes of Figure 6

| | | | | |
|---|---|---|---|---|
| 1427 | seob7345<br>ncrc7081<br>SEOA1723a | KIAA0443 gene product | NM_014710.1 | 3 |
| 1428 | SEOB1842<br>hfcr9061<br>ncrb8398 | KIAA0458 | AB007927.1 | 3 |
| 1429 | SEOA3670a<br>hfcr1939<br>seob4759 | KIAA0461 | AB007930 | 3 |
| 1430 | miob5708<br>fcr0004<br>ncr0364 | KIAA0484 | AB007953.1 | 3 |
| 1431 | SEOA6574a<br>ncrc0419<br>ncrc1606 | KIAA0537 | AB011109 | 3 |
| 1432 | ncrb3626<br>ncrb1067<br>ncrc2507 | KIAA0642 | AB014542 | 3 |
| 1433 | SEOA1213A<br>ncrc0105<br>ncrc7113 | KIAA0666 | AB014566 | 3 |
| 1434 | SEOB2271<br>hfcr5222<br>FCR5911 | KIAA0692 | AB014592.1 | 3 |
| 1435 | SEOA9948<br>hfcr3365<br>SEOA9948 | KIAA0696 protein | AB014596 | 3 |
| 1436 | MIOA2204a<br>MIOB2750<br>SEOA5654a | KIAA0716 | AB018259.1 | 3 |
| 1437 | MIOA3467a<br>seob4898<br>seob6772 | KIAA0783 | AB018326.1 | 3 |
| 1438 | hfcr6792<br>ncrb6169<br>miob1155 | KIAA0851 gene | AJ297357.1 | 3 |
| 1439 | ncr3237<br>ncrc3383<br>ncr9114 | KIAA0929 protein Msx2 interacting nuclear target (MINT) homolog | NM_015001.1 | 3 |
| 1440 | SEOA0549A<br>SEOB3581<br>ncr2725 | KIAA0936 | AB023153.1 | 3 |
| 1441 | SEOA2654<br>HFCR3262<br>seob4704 | KIAA0958 | AB023175.1 | 3 |
| 1442 | SEOA0145<br>ncr1818<br>SEOB1533 | KIAA0965 | AB023182.1 | 3 |
| 1443 | MIOB2804<br>fcrb0285<br>ncr4455 | KIAA1162 | AB032988.1 | 3 |

Figure 6A – EST Names Corresponding to Unique Known Genes of Figure 6

| | | | | |
|---|---|---|---|---|
| 1444 | miob0304<br>hfcr5538<br>hfcr3759 | KIAA1212 protein | AB033038.1 | 3 |
| 1445 | miob3986<br>ncrc9463<br>ncr0441 | KIAA1288 | AB033114.1 | 3 |
| 1446 | SEOA8472<br>ncrb1200<br>ncrb4554 | KIAA1311 | AB037732.1 | 3 |
| 1447 | SEOB2938<br>ncr8695<br>ncrc0408 | KIAA1439 | AB037860.1 | 3 |
| 1448 | ncrb2511<br>ncrb4678<br>ncrc1502 | KIAA1581 | AB046801 | 3 |
| 1449 | ncrb8066<br>ncrc1899<br>ncrb7895 | L1 repetitive element ORF (aa 1e-23,75%) | B28096 | 3 |
| 1450 | ncr9956<br>ncrb8719<br>ncrc1722 | MDS016 (MDS016) | AF182417.1 | 3 |
| 1451 | miob6373<br>ncr3752<br>ncrc4741 | MO25 protein (LOC51719) (=cDNA FLJ20797 fis) | NM_016289.1 | 3 |
| 1452 | SEOA0288<br>MIOA3232a<br>ncr1867 | myeloid cell nuclear differentiation antigen | M81750 | 3 |
| 1453 | MIOA1077<br>SEOA3132a<br>SEOA6434 | NDPP-1 protein | D10727.1 | 3 |
| 1454 | SEOA0054<br>BFCW0275<br>SEOA6722 | Nm23 protein, involved in developmental regulation (Drosophila Awd protein homologue) | X17620 | 3 |
| 1455 | hfcr4349<br>ncrb8112<br>HFCR3255 | nuclear distribution gene C (A.nidulans) homolog (NUDC) | NM_006600.1 | 3 |
| 1456 | MIOA5692<br>ncrc6330<br>ncrc2663 | P13-kinase associated p85 | M61906 | 3 |
| 1457 | FCR1147<br>FCR3338<br>hfcr4680 | PEG3 (=AB006625 hypothetical protein (KIAA0287)) | U90336 | 3 |
| 1458 | SEOA6049a<br>FCR7648<br>MIOA8970 | peroxisomal acyl-CoA:dihydroxyacetonephosphate acyltransferase (DHAPAT) | AF043937 | 3 |
| 1459 | SEOB1153<br>SEOA8234<br>SEOA8935 | PRO0657 | AAF24054.1 | 3 |
| 1460 | ncr2847 | PRO2550 | AF130089 | 3 |

Figure 6A – EST Names Corresponding to Unique Known Genes of Figure 6

| | | | | |
|---|---|---|---|---|
| | ncrc5595 | | | |
| | ncrc6347 | | | |
| 1461 | SEOA2443a | PTD015 | AF092136.1 | 3 |
| | seob6686 | | | |
| | ncrc9519 | | | |
| 1462 | hfcr3446 | PTP1C/HCP gene | X82818.1 | 3 |
| | fcrb1520 | | | |
| | fcrb0035 | | | |
| 1463 | SEOA9712 | Rab geranylgeranyltransferase, beta subunit (RABGGTB)(ORF) = Y08201.1 | NM_004582.1 | 3 |
| | ncrc9495 | | | |
| | ncrc2555 | | | |
| 1464 | hfcr9529 | retinal pigment epithelium | L07393.1 | 3 |
| | ncr5408 | | | |
| | ncrc3993 | | | |
| 1465 | ncr7792 | retinol-binding protein 4, interstitial (RBP4) | NM_006744.2 | 3 |
| | ncrb0587 | | | |
| | ncrc0117 | | | |
| 1466 | SEOA4611a | ribulose-5-phosphate-epimerase, (ORF) | AJ224326 | 3 |
| | ncrb3307 | | | |
| | ncr3780 | | | |
| 1467 | miob3725 | serologically defined colon cancer antigen 1 (SDCCAG1) | NM_004713.1 | 3 |
| | ncr2793 | | | |
| | seoa6983 | | | |
| 1468 | SEOB0168 | Sid3177 | AB024935.1 | 3 |
| | seob5690 | | | |
| | miob3021 | | | |
| 1469 | hfcr1891 | snuportin-1 (KPNBL) | NM_005701.1 | 3 |
| | SEOA4743a | | | |
| | FCR2810 | | | |
| 1470 | seoa7755a | SON DNA binding protein isoform E (SON) mRNA, complete cds, alternatively spliced /cds=(29,6355) /gb=AF380183 /gi=17046380 /ug=Hs.92909 /len=8438 | Hs.92909 | 3 |
| | mioa7825a | | | |
| | seoa6989 | | | |
| 1471 | MIOA8773 | split hand/foot deleted gene 1 | NP_033195.1 | 3 |
| | SEOA4155a | | | |
| | SEOA8598 | | | |
| 1472 | miob0931 | ST15 | D50406.1 | 3 |
| | miob1758 | | | |
| | ncrb4291 | | | |
| 1473 | miob6839 | SUMO-1 activating enzyme subunit 2 (UBA2) | NM_005499.1 | 3 |
| | miob6701 | | | |
| | SEOA7278a | | | |
| 1474 | miob3811 | suppressor of G2 allele | NM_006704.1 | 3 |
| | seob5811 | | | |
| | fcrb0916 | | | |
| 1475 | MIOA1610a | TEB4 protein (=AB011169 KIAA0597) | AF009301 | 3 |
| | SEOB0751 | | | |
| | MIOA4869a | | | |

Figure 6A – EST Names Corresponding to Unique Known Genes of Figure 6

| | | | | |
|---|---|---|---|---|
| 1476 | FCR5075<br>hfcr9337<br>ncrc5923 | thiosulfate sulfurtransferase (rhodanese) (TST) | X59434 | 3 |
| 1477 | FCR2601<br>ncr9715<br>hfcr4204 | TL27 (from PC3 cell line) | X75684 | 3 |
| 1478 | miob6632<br>MIOA9173<br>miob2990 | translocated promoter region (to activated MET oncogene) (TPR) | NM_003292.1 | 3 |
| 1479 | ncr1042<br>SEOA2802<br>SEOB0782a | WS-3 | D84145.1 | 3 |
| 1480 | fcrb0378<br>ncrc1693<br>hfcr5774 | WW domain binding protein-1 (ORF) | U79457.17 | 3 |
| 1481 | SEOA7379a<br>miob3836<br>miob4847 | XIST | X56196 | 3 |
| 1482 | ncr0663<br>ncrc5708<br>SEOB2780 | annexin A11 (ANXA11 gene) | AJ278465.1 | 3 |
| 1483 | MIOA4810a<br>ncr3203<br>miob1965 | ATPase, Na /K transporting, beta 3 polypeptide (ATP1B3= sodium/potassium-transporting ATPase beta-3 subunit = U51478(ORF) | NM_001679.1 | 3 |
| 1484 | seob4925<br>hfcr7773<br>ncrc0611 | channel-like integral membrane protein (AQP-1) | U41518.1 | 3 |
| 1485 | MIOA0461<br>ncr0578<br>fcrb0300 | citrin (SLC25A13) | AF118838.1 | 3 |
| 1486 | SEOA2448a<br>SEOA3617a<br>SEOA5226a | X-linked phosphoglycerate kinase | M11968 | 3 |
| 1487 | miob3618<br>miob2393<br>mioa9533 | aldehyde dehydrogenase 6 (ALDH6) | NM_000693.1 | 3 |
| 1488 | FCR3167<br>hfcr2714<br>SEOA9363 | aldehyde reductase | J04794 | 3 |
| 1489 | MIOA3888a<br>MIOB2627<br>ncr3181 | dTDP-D-glucose 4, 6-dehydratase | AJ006068 | 3 |
| 1490 | seob7662<br>SEOA4489<br>ncrb1491 | platelet-type phosphofructokinase | D25328.1 | 3 |
| 1491 | SEOA3322a<br>SEOA3324a<br>miob4108 | MKP-1 like protein tyrosine phosphatase | AF038844 | 3 |
| 1492 | SEOA2910a | Gem GTPase (gem) | U10550 | 3 |

Figure 6A – EST Names Corresponding to Unique Known Genes of Figure 6

| | | | | |
|---|---|---|---|---|
| | MIOA3756a | | | |
| | SEOA6196a | | | |
| 1493 | MIOA4241 | hypoxanthine phosphoribosyltransferase (HPRT) gene, complete cds. | M26434 | 3 |
| | hfcr5129 | | | |
| | miob2499 | | | |
| 1494 | SEOB3170 | plasma cell membrane glycoprotein (PC-1) | M57736.1 | 3 |
| | MIOA5162a | | | |
| | SEOA0191A | | | |
| 1495 | SEOA1900n | pyrophosphatase | Z48605 | 3 |
| | SEOA2024a | | | |
| | SEOA7145a | | | |
| 1496 | SEOB0949 | acetyl-Coenzyme A acetyltransferase 2 (acetoacetyl Coenzyme A thiolase) | gi5174388 | 3 |
| | SEOB3564 | | | |
| | ncrb4951 | | | |
| 1497 | SEOA3408a | acyl-CoA synthetase 4 (ACS4) | AF030555 | 3 |
| | MIOB2701 | | | |
| | SEOA3474a | | | |
| 1498 | fcrb0131 | acyl-Coenzyme A dehydrogenase, very long chain (ACADVL), nuclear gene encoding mitochondrial protein, mRNA | NM_000018.1 | 3 |
| | fcrb1715 | | | |
| | ncrc4896 | | | |
| 1499 | miob5016 | L3 pigment (L3) | AF189062.3 | 3 |
| | hfcr6712 | | | |
| | ncrc3709 | | | |
| 1500 | SEOA5554a | leukotriene A-4 hydrolase | J02959 | 3 |
| | fcrb0425 | | | |
| | seoa6975 | | | |
| 1501 | ncr2145 | cytochrome b5 reductase 1 (B5R.1) (RefSeq aa 1e-31) | NP_057327.1 | 3 |
| | ncrb3813 | | | |
| | ncrc0472 | | | |
| 1502 | SEOB0386 | NADH-ubiquinone oxidoreductase MNLL subunit | AF050638.1 | 3 |
| | MIOA8031a | | | |
| | seob5635 | | | |
| 1503 | HFCR2384 | ubiquinol-cytochrome c reductase, Rieske iron-sulfur polypeptide 1 (UQCRFS1) | 5174742 | 3 |
| | ncr7576 | | | |
| | MIOA2704a | | | |
| 1504 | SEOA9709 | methylene tetrahydrofolate dehydrogenase (NAD dependent), methenyltetrahydrofolate cyclohydrolase (MTHFD2) = X16396.1 | NM_006636.1 | 3 |
| | mioa1216m | | | |
| | hfcr6843 | | | |
| 1505 | MIOA6969a | aspartyl glucosaminidase (AGA) | X55330 | 3 |
| | ncr4531 | | | |
| | seob4045 | | | |
| 1506 | seob5053 | leucine-rich repeat (LRR) protein (P37NB) 37 kDa | NM_005824.1 | 3 |
| | miob0724 | | | |
| | seob7356 | | | |

Figure 6A – EST Names Corresponding to Unique Known Genes of Figure 6

| | | | | |
|---|---|---|---|---|
| 1507 | MIOA1473<br>ncr6113<br>ncr8622 | methionine synthase reductase (MTRR) | AF025794 | 3 |
| 1508 | seob4645<br><br>MIOA3702a<br>ncrc0793 | osteoblast specific cysteine-rich protein, complete cds | AB008375 | 3 |
| 1509 | hfcr5207<br>ncrb3985<br>ncrb2274 | pyrroline-5-carboxylate reductase 1 (PYCR1) | NM_006907.1 | 3 |
| 1510 | hfcr4444<br>ncrb0397<br>ncrc1227 | S-adenosylmethionine decarboxylase 1 (AMD1) | NM_001634.3 | 3 |
| 1511 | SEOA0464<br>FCR2049<br>seob4630 | selenophosphate synthetase 2 (SPS2) | U43286 | 3 |
| 1512 | seob4621<br>FCR4742<br>hfcr2810 | tryptophan rich basic protein (WRB) (ORF) | NM_004627.1 | 3 |
| 1513 | MIOA8536<br><br><br>SEOA5164a<br>hfcr1309 | glutamic-oxaloacetic transaminase 2, mitochondrial (aspartate aminotransferase 2) (GOT2), nuclear gene encoding mitochondrial protein | NM_002080.1 | 3 |
| 1514 | ncr7876<br><br>ncrc5739<br>ncrc6815 | eukaryotic translation initiationfactor 4E (RefSeq aa 4e-86) | NP_001959.1 | 3 |
| 1515 | FCR7550<br><br>SEOA6753<br>SEOA1346 | GC20 protein (=AF077052 protein translation factor sui1 homologue) | AF064607 | 3 |
| 1516 | seob3731<br>ncr9561<br>SEOA0790 | p80 protein (=M23613.1 nucleophosmin) | D45915.1 | 3 |
| 1517 | FCR0111<br>FCR2289<br>MIOA9046 | translation initiation factor 3 47 kDa subunit | U94855 | 3 |
| 1518 | HFCR3144<br><br>hfcr7381<br>FCR4031N | ribosome binding protein 1 (dog 180kD homolog) (RRBP1) | gi4759055 | 3 |
| 1519 | SEOA8759<br><br>SEOB1743<br>SEOA5234a | stress-associated endoplasmic reticulum protein 1; ribosome associated membrane protein 4 (SERP1) | NM_014445.1 | 3 |
| 1520 | hfcr3500<br><br><br>mioa1721a<br>hfcr9097 | aminopeptidase puromycin sensitive (NPEPPS)= AJ132583.1 puromycin sensitive aminopeptidase (ORF) | NM_006310.1 | 3 |
| 1521 | MIOA1380a | beta-migrating plasminogen activator inhibitor I | M14083 | 3 |

Figure 6A – EST Names Corresponding to Unique Known Genes of Figure 6

| | | | | |
|---|---|---|---|---|
| | SEOB3294<br>seob5286 | | | |
| 1522 | ncr0496<br>seob5607<br>ncrc0654 | calpain, large polypeptide L2 (CAPN2) mRNA | NM_001748.1 | 3 |
| 1523 | SEOA8374a<br>FCR2753<br>hfcr9508 | collagenase inhibitor | M59906 | 3 |
| 1524 | seob6368<br>fcrb1421<br>fcrb0071 | cysteine-rich heart protein (hCRHP) | U09770.1 | 3 |
| 1525 | seob4928<br>ncrc6644<br>ncrb8230 | cysteine-rich repeat-containing protein S52 precursor | AF167706.1 | 3 |
| 1526 | hfcr0413<br>SEOA6661a<br>ncr7672 | matrix metalloprotease(ADAMTS1) mRNA, complete cds | AF207664.1 | 3 |
| 1527 | hfcr7769<br>SEOA4537<br>hfcr9509 | nardilysin (N-arginine dibasic convertase) (NRD1) | NM_002525.1 | 3 |
| 1528 | miob1059<br>hfcr6981<br>fcrb2427 | procollagen, type XI, alpha 1 (Col11a1) | NM_007729.1 | 3 |
| 1529 | miob6688<br>ncr1298<br>MIOA5147a | protease inhibitor 12 (neuroserpin) (PI12) | NM_005025.1 | 3 |
| 1530 | seob2560<br>SEOB0928<br>SEOB1497 | proteasome (prosome, macropain) subunit, alpha type, 5 (PSMA5) | NM_002790.1 | 3 |
| 1531 | seob6572<br>ncr2670<br>ncr4193 | proteasome (prosome, macropain) subunit, alpha type, 7 (PSMA7) mRNA, and translated products | NM_002792.1 | 3 |
| 1532 | SEOA8300<br>SEOA8747<br>SEOB1774 | PROTEASOME COMPONENT C9 (MACROPAIN SUBUNIT C9) (MULTICATALYTIC ENDOPEPTIDASE COMPLEX SUBUNIT C9) | spP25789 | 3 |
| 1533 | MIOA3857<br>seob2611<br>SEOA4121a | proteasome subunit X (=X95586 MB1) | D29011 | 3 |
| 1534 | seob4992<br>miob4145<br>ncrc6722 | proteinx0008 (AD013) | NM_013395.1 | 3 |
| 1535 | ncr2892<br>hfcr7665<br>ncrb0547 | sorting nexin 1 (SNX1) | NM_003099.1 | 3 |
| 1536 | seob5792<br>ncr1704<br>ncrb6324 | chaperonin containing TCP1, subunit 2 (beta) (CCT2) | NM_006431.1 | 3 |

Figure 6A – EST Names Corresponding to Unique Known Genes of Figure 6

| | | | | |
|---|---|---|---|---|
| 1537 | seob6189 | farnesyl diphosphate synthase (farnesyl pyrophosphate synthetase, dimethylallyltranstransferase, geranyltranstransferase) | NM_002004.1 | 3 |
| | hfcr9650 | | | |
| | hfcr9252 | | | |
| 1538 | ncrb1833 | huntingtin interacting protein 2 (HIP2) | NM_005339.1 | 3 |
| | SEOA7448a | | | |
| | ncrc1703 | | | |
| 1539 | hfcr0676 | karyopherin alpha 2 (RAG cohort 1, importin alpha 1) (KPNA2) | NM_002266.1 | 3 |
| | hfcr7834 | | | |
| | FCR3069 | | | |
| 1540 | miob5829 | nuclear localization signal deleted in velocardiofacial syndrome (NLVCF) | NM_003776.1 | 3 |
| | miob0406 | | | |
| | ncrb4889 | | | |
| 1541 | MIOA3395a | signal recognition particle (SRP), 19kD protein | X12791 | 3 |
| | ncrb5912 | | | |
| | ncrc0508 | | | |
| 1542 | ncrb3980 | TRAM-like protein (KIAA0057), mRNA | NM_012288.1 | 3 |
| | fcrb1835 | | | |
| | ncrb8586 | | | |
| 1543 | MIOB2116 | ubiquitin-activating enzyme E1C (homologous to yeast UBA3) (UBE1C) | gi4507764 | 3 |
| | seob3673 | | | |
| | ncrb6221 | | | |
| 1544 | SEOA3263 | AE-binding protein 1, AEBP1 | D86479 | 3 |
| | seob6103 | | | |
| | SEOA6860 | | | |
| 1545 | SEOB1423 | alternative splicing factor | M72709.1 | 3 |
| | ncrb2475 | | | |
| | SEOA4873a | | | |
| 1546 | hfcr5260 | amplified in osteosarcoma (OS-9) | NM_006812.1 | 3 |
| | fcrb2201 | | | |
| | FCR4877 | | | |
| 1547 | ncr8588 | bromodomain-containing 2 (BRD2)= KIAA9001 | NM_005104.1 | 3 |
| | hfcr4049 | | | |
| | ncrb1987 | | | |
| 1548 | seob6291 | CCAAT-box-binding transcription factor (CBF2) | NM_005760.1 | 3 |
| | miob2487 | | | |
| | ncrb2980 | | | |
| 1549 | SEOB2775 | c-Cbl-interacting protein (CIN85) | AF230904.1 | 3 |
| | miob1393 | | | |
| | ncrb6469 | | | |
| 1550 | ncr0176 | c-myc transcription factor (puf) = M36981(ORF) | L16785.1 | 3 |
| | SEOA0015 | | | |
| | SEOA1108a | | | |
| 1551 | miob2974 | FUSE binding protein 3 (FBP3) | U69127.1 | 3 |
| | SEOA2507 | | | |
| | seoa6998 | | | |

Figure 6A – EST Names Corresponding to Unique Known Genes of Figure 6

| | | | | |
|---|---|---|---|---|
| 1552 | mioa9334<br>ncr1381<br>SEOA1102a | GA-binding protein transcription factor, beta subunit 1 (53kD) (GABPB1) | NM_016654.1 | 3 |
| 1553 | SEOA2361a<br>SEOB0974<br>SEOA4099a | helix-loop-helix basic phosphoprotein (G0S8) | L13391 | 3 |
| 1554 | SEOA0884<br>BFCS0481<br>ncrc9468 | myocyte-specific enhancer factor 2A (MEF2A) | U49020 | 3 |
| 1555 | SEOB1758<br>ncr4836<br>ncr2893 | retinoblastoma-associated protein RAP140 (=KIAA1105) | AAD55098.1 | 3 |
| 1556 | SEOA4332a<br>hfcr4612<br>ncrc3500 | retinoblastoma-binding protein 4 (RBBP4) =X74262 RbAp48 | NM_005610.1 | 3 |
| 1557 | miob3953<br>ncr2798<br>ncrc4472 | ring finger protein 11 (RNF11) | NM_014372.1 | 3 |
| 1558 | seob4819<br>seob4917<br>SEOB3597 | ring finger protein 14 (RNF14) (=HFB30) | NM_004290.1 | 3 |
| 1559 | SEOA3101a<br>ncrc6589<br>FCR2913N | T-box transCRiption factor (Tbx15) | AF041822 | 3 |
| 1560 | ncrb6699<br>SEOA0925<br>seob6054 | thyroid hormone receptor interactor 11 (TRIP11) (=Golgi-associated microtubule-binding protein) | NM_004239.1 | 3 |
| 1561 | SEOB0991<br>hfcr9164<br>MIOA5915a | thyroid receptor interactor (TRIP3) | L40410.1 | 3 |
| 1562 | MIOA3688a<br>SEOA3843<br>seob4127 | transCRiptional activation factor TAFII32 (=AF151895 CGI-137 protein) | U21858 | 3 |
| 1563 | ncr4113<br>hfcr9303<br>fcrb1767 | transducin (beta) like 2 (TBL2) | NM_012453.1 | 3 |
| 1564 | SEOA8716<br>hfcr0960<br>ncrc3630 | Y-linked zinc finger protein (ZFY) gene (=DKFZp434F2311) | AF114156.1 | 3 |
| 1565 | SEOB0922<br>HFCR3226<br>fcrb2206 | ZINC FINGER PROTEIN 135 | spP52742 | 3 |
| 1566 | seob5558<br>miob4645<br>ncrc9716 | ZNF01 and HUMORFKG1B genes, partial sequence | AF205588.1 | 3 |
| 1567 | SEOA8424 | nCL1 gene | X85032.1 | 3 |

Figure 6A – EST Names Corresponding to Unique Known Genes of Figure 6

| | | | | |
|---|---|---|---|---|
| | miob5472 | | | |
| | MIOA5639a | | | |
| 1568 | seob4793 | endoplasmic reticulum lumenal Ca2 binding protein grp78 | AF216292.1 | 3 |
| | hfcr3784 | | | |
| | miob0158 | | | |
| 1569 | MIOA2173a | hnRNP-E2 (poly(rC)-binding protein 2 (PCBP2)) | X78136 | 3 |
| | FCR2490 | | | |
| | FCR6292 | | | |
| 1570 | mioa9328 | leukophysin (LKP) = NM_001357.1 DEAD/H box polypeptide 9 (DDX9) | U03643.1 | 3 |
| | SEOA2428a | | | |
| | ncr1714 | | | |
| 1571 | MIOA8346 | polyadenylate binding protein(TIA-1) | M77142 | 3 |
| | FCR2203 | | | |
| | ncrc2424 | | | |
| 1572 | SEOA1100a | PR264 | X75755 | 3 |
| | ncrb3573 | | | |
| | ncrb6248 | | | |
| 1573 | seob3892 | seryl-tRNA synthetase (SARS) | NM_006513.1 | 3 |
| | SEOB3224 | | | |
| | fcrb1040 | | | |
| 1574 | seob5762 | small nuclear ribonucleoprotein D1 polypeptide (16kD) (SNRPD1) | NM_006938.1 | 3 |
| | MIOA7265a | | | |
| | MIOA6942a | | | |
| 1575 | hfcr6993 | small nuclear ribonucleoprotein polypeptide F (SNRPF) | NM_003095.1 | 3 |
| | hfcr9272 | | | |
| | ncrc5568 | | | |
| 1576 | SEOB3415 | splicing factor 3b, subunit 1, 155kD (SF3B1) | NM_012433.1 | 3 |
| | ncr9313 | | | |
| | ncrc3338 | | | |
| 1577 | hfcr2850 | splicing factor, arginine/serine-rich 9 (SFRS9) | NM_003769.1 | 3 |
| | hfcr3920 | | | |
| | hfcr7012 | | | |
| 1578 | hfcr9014 | breast cancer-associated gene 1 protein (BCG1 | AF126181.1 | 3 |
| | FCR7559 | | | |
| | fcrb2241 | | | |
| 1579 | FCR4128 | cartilage-associated protein (CASP) | AJ006470 | 3 |
| | FCR5831 | | | |
| | FCR5366 | | | |
| 1580 | ncr7973 | DC2 (DC2) | AF201937.1 | 3 |
| | ncrb8380 | | | |
| | ncrc3145 | | | |
| 1581 | SEOA0848 | T-cell gamma receptor locus | AF159056.1 | 3 |
| | ncrb2087 | | | |
| | ncrb2188 | | | |
| 1582 | seob6492 | 28 kDa heat shock protein | Z23090.1 | 3 |
| | hfcr6798 | | | |
| | seoa1568m | | | |
| 1583 | miob1134 | ALEX1 protein (LOC51309) | NM_016608.1 | 3 |

Figure 6A – EST Names Corresponding to Unique Known Genes of Figure 6

| | | | | |
|---|---|---|---|---|
| | seoa7833a<br>miob1442 | | | |
| 1584 | SEOA4174a | LIM and senescent cell antigen-like domains 1 (LIMS1) =U09284, PINCH protein | NM_004987.1 | 3 |
| | ncrc0461<br>SEOA2429a | | | |
| 1585 | hfcr1127 | coatomer protein complex, subunit alpha (COPA), mRNA | NM_004371.2 | 3 |
| | FCR2442<br>ncrc1129 | | | |
| 1586 | hfcr0691<br>hfcr1675<br>hfcr4341 | endoglin (Osler-Rendu-Weber syndrome 1) (ENG) | NM_000118.1 | 3 |
| 1587 | MIOB2668<br>hfcr6918<br>ncr9191 | tetraspanin TM4-A | AF133423.1 | 3 |
| 1588 | MIOA1735<br>MIOA2161a<br>MIOA4922a | ERCC5 excision repair protein | L20046 | 3 |
| 1589 | miob5840 | MHC class II lymphocyte antigen beta-chain (HLA-DPB1) | M28202.1 | 3 |
| | seob5447<br>SEOA3472a | | | |
| 1590 | miob5437<br>ncrc9237<br>mioa7880 | thioredoxin-like (TXNL2) | gi5730103 | 3 |
| 1591 | SEOB0685a<br>SEOB1495<br>ncr5226 | Apg12 | BAA36493.1 | 3 |
| 1592 | hfcr7341<br>SEOA8883<br>ncr2874 | calponin 3, acidic (CNN3) | NM_001839.1 | 3 |
| 1593 | ncr3673 | capping protein (actin filament) muscle Z-line, alpha 1 (CAPZA1), (=capping protein alpha subunit isoform 1) | NM_006135.1 | 3 |
| | ncr9659<br>miob3116 | | | |
| 1594 | hfcr4007<br>fcrb1450<br>hfcr9907 | CGI-101 protein (LOC51009) | NM_016041.1 | 3 |
| 1595 | MIOA8739<br>SEOA3006a<br>seob4780 | CGI-114 protein (=DKFZp566E144) | AF151872.1 | 3 |
| 1596 | SEOA2823<br>MIOA3493a<br>SEOA6291 | CGI-123 protein | AF151881.1 | 3 |
| 1597 | SEOB1273<br>miob3173<br>hfcr6067 | CGI-129 protein | AF151887.1 | 3 |
| 1598 | SEOA3544a<br>ncrc5775<br>SEOA3588a | CGI-142 protein | AF151900.1 | 3 |
| 1599 | ncrc3233 | CGI-151 protein (RefSeq aa 6e-51) | NP_057165.1 | 3 |

Figure 6A – EST Names Corresponding to Unique Known Genes of Figure 6

| | | | | |
|---|---|---|---|---|
| | ncrc1607<br>SEOA5310a | | | |
| 1600 | SEOA5685a<br>MIOA1130<br>SEOB1070 | CGI-24 protein | AF132958.1 | 3 |
| 1601 | SEOA7546a<br>seob6031<br>ncrb1874 | CGI-29 protein | AF132963.1 | 3 |
| 1602 | seob4735<br>miob0668<br>ncr7132 | CGI-86 protein (LOC51635) | NM_016029.1 | 3 |
| 1603 | MIOA6833a<br>MIOA8088<br>ncr5291 | cytoplasmic dynein intermediate chain 1 | AF123074 | 3 |
| 1604 | miob4957<br><br>ncrb5183<br>MIOA5605a | FRA3B common fragile region, diadenosine triphosphate hydrolase (FHIT) | AF020503.1 | 3 |
| 1605 | SEOB1793<br>fcrb1435<br>mioa9263 | LIC-2 dynein light intermediate chain 53/55 | U15138.1 | 3 |
| 1606 | HFCR3209<br>fcrb2677<br>ncr7697 | sorcin (SRI) | L12387.1 | 3 |
| 1607 | MIOA6556a<br>FCR3833<br>MIOB1583 | collagen type IV alpha 1(COL4A1) | M26576 | 3 |
| 1608 | ncr9502<br><br>ncrb5084<br>ncrc3020 | fibrinogen-like 2 precursor;fibroleukin (RefSeq aa 2e-74) | NP_006673.1 | 3 |
| 1609 | hfcr2963<br>hfcr7574<br>hfcr7971 | glypican 1 (GPC1) | NM_002081.1 | 3 |
| 1610 | SEOA8945<br>ncr6704<br>ncr8468 | glypican 4 (GPC4) | NM_001448.1 | 3 |
| 1611 | hfcr6129<br>ncrc3934<br>ncrc1661 | laminin, beta 2 (laminin S)(LAMB2) mRNA | NM_002292.1 | 3 |
| 1612 | MIOA7482a<br>ncr2391<br>ncrb2422 | sarcospan (Sspn) | AF120276.1 | 3 |
| 1613 | miob6625<br>ncrb5035<br>MIOA7037a | AHNAK nucleoprotein | M80902.1 | 3 |
| 1614 | FCR0793N<br>ncr7869<br>FCR0431 | capping protein (actin filament), gelsolin-like (CAPG) | M94345 | 3 |
| 1615 | seob7578<br>SEOA8825<br>hfcr0576 | crystallin, zeta (quinone reductase) (CRYZ) | NM_001889.1 | 3 |

Figure 6A – EST Names Corresponding to Unique Known Genes of Figure 6

| | | | | |
|---|---|---|---|---|
| 1616 | MIOA7218a<br>ncr0591<br>MIOA5718 | dystrophin (DMD) | M18533 | 3 |
| 1617 | hfcr0476<br>mioa0567a<br>hfcr0475 | keratin 10 (epidermolytic hyperkeratosis; keratosis palmaris et plantaris) (KRT10)mRNA =( acidic keratin-10 )=( keratin 10 type I intermediate filament ) | NM_000421.1 | 3 |
| 1618 | MIOA7361a<br>SEOA3664a<br>FCR2669 | protein 4.1-G, erythrocyte membrane protein (clone 24719) | AF054999 | 3 |
| 1619 | SEOB2966<br>ncrc2128<br>seob5844 | myosin phosphatase target subunit 1 (MYPT1) | D87930.1 | 3 |
| 1620 | hfcr1304<br>fcrb2687<br>hfcr8261 | non-muscle alpha-actinin | U48734.1 | 3 |
| 1621 | MIOA6721a<br>ncrc6732<br>hfcr4162 | nonmuscle myosin heavy chain (NMHC) | M31013 | 3 |
| 1622 | SEOA2786<br>MIOA8718<br>ncrb6071 | tropomodulin (TMOD) | M77016 | 3 |
| 1623 | SEOA6238<br>MIOA3390a<br>SEOA9771 | nuclear pore complex protein hnup153 | Z25535 | 3 |
| 1624 | SEOA6510a<br>ncrc6457<br>miob6595 | TIP120 (=AB020636 KIAA0829) | D87671 | 3 |
| 1625 | hfcr0543<br>hfcr3760<br>fcrb0040 | angiotensin receptor-like 2 (AGTRL2), mRNA | NM_005162.2 | 3 |
| 1626 | SEOB0745<br>FCR0882<br>SEOB1812 | B4-2 protein | U03105.1 | 3 |
| 1627 | seoa4922a<br>ncrc0984<br>ncrc6756 | diazepam binding inhibitor (GABA receptor modulator, acyl-Coenzyme A binding protein) (DBI), mRNA /cds=(0,314) /gb=NM_020548 /gi=10140852 /ug=Hs.78888 /len=537 | Hs.78888 | 3 |
| 1628 | seob7209<br>FCR1486<br>ncrc6497 | glucocorticoid receptor (GRL) gene | U80947.1 | 3 |
| 1629 | hfcr9362<br>ncrc6257<br>ncrc0778 | glutamate dehydrogenase 1 (GLUD1) | NM_005271.1 | 3 |
| 1630 | hfcr2803<br>hfcr2938<br>FCR0706 | HindIII K4L ORF (HU-K4) | NM_012268.1 | 3 |
| 1631 | FCR4604 | inositol 1,4,5-triphosphate receptor, type 3 (ITPR3) | U01062 | 3 |

Figure 6A – EST Names Corresponding to Unique Known Genes of Figure 6

| | | | | |
|---|---|---|---|---|
| | ncrc4012 | | | |
| | FCR7029 | | | |
| 1632 | MIOA5131a | insulin receptor substrate-2 (IRS2) | AF073310 | 3 |
| | ncr5183 | | | |
| | ncr1653 | | | |
| 1633 | ncrb8064 | interleukin 11 receptor, alpha (IL11RA) | NM_004512.1 | 3 |
| | fcrb2031 | | | |
| | fcrb2075 | | | |
| 1634 | fcrb0972 | leptin receptor gene-related protein (HSOBRGRP) | NM_017526.1 | 3 |
| | ncr7638 | | | |
| | ncrc3008 | | | |
| 1635 | SEOB0815 | multiple membrane spanning receptor TRC8 (TRC8) | AF064801.1 | 3 |
| | ncr1172 | | | |
| | SEOB3004 | | | |
| 1636 | MIOA2616a | orphan G protein-coupled receptor (RDC1) | U67784 | 3 |
| | ncrb1603 | | | |
| | SEOA9912 | | | |
| 1637 | seob7533 | regulator of G-protein signalling 2, 24kD (RGS2) | NM_002923.1 | 3 |
| | ncr7023 | | | |
| | seob6515 | | | |
| 1638 | ncrc5317 | regulator of G-protein signalling 5 (RGS5) | AF159570.1 | 3 |
| | ncrc3408 | | | |
| | MIOA6502a | | | |
| 1639 | SEOB0321 | retinoic acid repressible protein (RARG-1) | AF172066.1 | 3 |
| | seob5012 | | | |
| | ncr9982 | | | |
| 1640 | seob4068 | SGRF | AB030001.1 | 3 |
| | hfcr6648 | | | |
| | hfcr7052 | | | |
| 1641 | ncrc0288 | transforming growth factor, beta receptor III (betaglycan, 300kD) (TGFBR3), mRNA | NM_003243.1 | 3 |
| | ncrc2784 | | | |
| | ncrc9160 | | | |
| 1642 | ncr7904 | 14-3-3 gamma | AB024334.1 | 3 |
| | ncrb2918 | | | |
| | ncrc7168 | | | |
| 1643 | MIOA7169a | cAMP-dependent protein kinase subunit RII-beta | M31158 | 3 |
| | MIOA7206a | | | |
| | SEOA6076a | | | |
| 1644 | seob4192 | CDC-like kinase (CLK) | NM_004071.1 | 3 |
| | hfcr7519 | | | |
| | ncrc4991 | | | |
| 1645 | SEOB2185 | mitogen-activated protein kinase 14 (MAPK14) | 4503068 | 3 |
| | ncrc6818 | | | |
| | MIOA8542 | | | |
| 1646 | miob0175 | protein kinase, cAMP-dependent, regulatory, type I, alpha (tissue specific extinguisher 1) (PRKAR1A) | NM_002734.1 | 3 |
| | mioa7804a | | | |
| | seoa7838a | | | |
| 1647 | hfcr3834 | Ser/Arg-related nuclear matrix protein (plenty of prolines 101-like) (SRM160)(ORF) | NM_005839.1 | 3 |
| | ncrb3267 | | | |

Figure 6A – EST Names Corresponding to Unique Known Genes of Figure 6

| | | | | |
|---|---|---|---|---|
| | ncr5407 | | | |
| 1648 | ncr4212 | serum-inducible kinase (SNK) | AF223574.1 | 3 |
| | FCR2253 | | | |
| | ncrc6276 | | | |
| 1649 | MIOA5540a | tyrosylprotein sulfotransferase-1(TPST1) | AF038009 | 3 |
| | ncrc4532 | | | |
| | hfcr9293 | | | |
| 1650 | MIOA0152 | GTPase-activating protein ras p21 (RASA) | M23379 | 3 |
| | hfcr3695 | | | |
| | ncrb5637 | | | |
| 1651 | MIOA3060a | rab11a GTPase | AF000231 | 3 |
| | miob6707 | | | |
| | SEOA3662a | | | |
| 1652 | seob2308 | rab3 GTPase-activating protein, non-catalytic subunit (150kD) (RAB3-GAP150)(ORF) | NM_012414.1 | 3 |
| | MIOA7283 | | | |
| | MIOA3092a | | | |
| 1653 | miob6401 | ralA binding protein 1 (RALBP1) | NM_006788.1 | 3 |
| | ncrc4318 | | | |
| | seob6454 | | | |
| 1654 | SEOA4586 | ras-related YPT1 protein (ORF) | P11476 | 3 |
| | MIOA2203a | | | |
| | SEOA4373a | | | |
| 1655 | MIOB2645 | signal transduction protein (SH3 containing) (EFS2) | gi5031680 | 3 |
| | ncrb2221 | | | |
| | ncr8639 | | | |
| 1656 | miob5892 | CC chemokine gene cluster | AF088219.1 | 3 |
| | hfcr1712 | | | |
| | ncr4933 | | | |
| 1657 | hfcr8385 | EGR1 gene for early growth response protein 1 (=zinc finger protein)(= transcription factor ETR103) | AJ243425.1 | 3 |
| | ncrb4170 | | | |
| | hfcr9947 | | | |
| 1658 | MIOA4632a | growth differentiation factor 10 (GDF10) =D49492 = bone morphogenetic protein-3b | NM_004962.1 | 3 |
| | mioa0557a | | | |
| | miob0675 | | | |
| 1659 | ncrb3903 | quiescin Q6 (QSCN6)(= bone-derived growth factor (BPGF-1)) | NM_002826.1 | 3 |
| | fcrb1657 | | | |
| | ncrc6280 | | | |
| 1660 | MIOA8796 | SDF2 | D50645 | 3 |
| | FCR0639 | | | |
| | MIOB2105 | | | |
| 1661 | SEOB1213 | seCRetory growth factor-like protein fallotein | AF091434.1 | 3 |
| | seob4844 | | | |
| | seob4338 | | | |
| 1662 | seob3751 | uncharacterized bone marrow protein BM036 (BM036),(ORF) | NM_018453.1 | 3 |
| | ncrc5385 | | | |
| | ncrb0788 | | | |

Figure 6A – EST Names Corresponding to Unique Known Genes of Figure 6

| | | | | |
|---|---|---|---|---|
| 1663 | ncr1494 | WNT1 inducible signaling pathway protein 3 (RefSeq aa 5e-38) | NP_003871.1 | 3 |
| | ncrb1217 | | | |
| | ncrb3121 | | | |
| 1664 | hfcr8864 | ADP-ribosylation factor-like 2 (ARL2) | NM_001667.1 | 3 |
| | hfcr7510 | | | |
| | FCR4026 | | | |
| 1665 | seob4095 | ARP2 (actin-related protein 2, yeast) homolog (ACTR2) | NM_005722.1 | 3 |
| | hfcr7541 | | | |
| | ncrb6807 | | | |
| 1666 | SEOA0840 | beta-catenin | X87838 | 3 |
| | hfcr2643 | | | |
| | FCR2504 | | | |
| 1667 | SEOB1238 | Ca2-activated neutral protease large subunit (CANP) | M23254.1 | 3 |
| | MIOA2093 | | | |
| | MIOA2301a | | | |
| 1668 | ncrb7027 | calcium/calmodulin-dependent serine protein kinase (MAGUK family) (CASK) | NM_003688.1 | 3 |
| | MIOA5357a | | | |
| | MIOA5595a | | | |
| 1669 | seob6000 | hHDC for homolog of Drosophila headcase (LOC51696) | NM_016217.1 | 3 |
| | ncrb5295 | | | |
| | seob7394 | | | |
| 1670 | miob3693 | MAX-interacting protein 1 (MXI1) | NM_005962.1 | 3 |
| | ncrb4515 | | | |
| | ncrc0296 | | | |
| 1671 | SEOA7893a | Opa-interacting protein OIP2 | AF025438 | 3 |
| | MIOA8196 | | | |
| | SEOA8402a | | | |
| 1672 | MIOA5608a | Sprouty 2 (SPRY2) | AF039843 | 3 |
| | ncr9763 | | | |
| | ncr9039 | | | |
| 1673 | seoa7808a | POM121 membrane glycoprotein (rat homolog)-like 2 (POM121L2), mRNA /cds=UNKNOWN /gb=NM_033482 /gi=15718529 /ug=Hs.8198 /len=154066 | Hs.8198 | 3 |
| | seoa4956a | | | |
| | seoa4985a | | | |
| 1674 | miob3705 | voltage-dependent anion channel 2 (VDAC2), nuclear gene encoding mitochondrial protein | NM_003375.1 | 3 |
| | ncrb0230 | | | |
| | mioa7783a | | | |
| 1675 | ncr2591 | alpha-parvin (PARVA) | AF237771.1 | 3 |
| | ncrb1534 | | | |
| | ncrc1274 | | | |
| 1676 | miob1350 | claudin-12 gene (CLDN12) | AJ250713.1 | 3 |
| | ncr3314 | | | |
| | ncrb2448 | | | |
| 1677 | SEOB1449 | C-type lectin | BAA95671.1 | 3 |
| | ncrc6787 | | | |

Figure 6A – EST Names Corresponding to Unique Known Genes of Figure 6

| | | | | |
|---|---|---|---|---|
| | MIOA6484a | | | |
| 1678 | SEOA4386a | integrin, alpha subunit 1(ORF) | X68742 | 3 |
| | ncr3071 | | | |
| | ncr7644 | | | |
| 1679 | FCR2598 | integrin-linked kinase (ILK) | U40282 | 3 |
| | hfcr6466 | | | |
| | hfcr9993 | | | |
| 1680 | hfcr6509 | podocalyxin-like (PODXL) | NM_005397.1 | 3 |
| | MIOB2107 | | | |
| | miob4716 | | | |
| 1681 | MIOA0497n | syntaxin 7 | U77942 | 3 |
| | MIOA8036a | | | |
| | ncrc6827 | | | |
| 1682 | SEOB0047 | DNA dependent ATPase and helicase (ATRX) | U72938.2 | 3 |
| | ncr4693 | | | |
| | ncr3596 | | | |
| 1683 | FCR3181 | histone H1 (0) | X03473 | 3 |
| | FCR6945 | | | |
| | hfcr9927 | | | |
| 1684 | SEOA2847n | histone H2A.Z= M37583 | X52317 | 3 |
| | MIOA1249 | | | |
| | MIOA6228a | | | |
| 1685 | FCR5958 | histone H2B | AJ223352 | 3 |
| | fcrb1941 | | | |
| | fcrb1960 | | | |
| 1686 | SEOA8670 | non-histone chromosomal protein HMG-14 | M21339.1 | 3 |
| | CR0718 | | | |
| | miob5080 | | | |
| 1687 | SEOA9140 | cdk inhibitor p21 binding protein (TOK-1),(ORF)= AB040450.1 | NM_016567.1 | 3 |
| | ncrc3816 | | | |
| | hfcr6041 | | | |
| 1688 | ncrb5737 | cyclin L ania-6a (RefSeq aa 1e-66) | NP_064703.1 | 3 |
| | ncrc4316 | | | |
| | ncrb2757 | | | |
| 1689 | FCR2417 | GTP-binding protein (HSR1) | L25665 | 3 |
| | FCR5127 | | | |
| | FCR6703 | | | |
| 1690 | SEOA1169A | GTP-binding protein(=KIAA0741) | AJ006412 | 3 |
| | SEOB2937 | | | |
| | ncr5440 | | | |
| 1691 | SEOA9539 | caspase 4, apoptosis-related cysteine protease (CASP4) (ORF) | NM_001225.1 | 3 |
| | ncrb1295 | | | |
| | ncr5992 | | | |
| 1692 | MIOA6659a | inhibitor of apoptosis protein 2 | U45879 | 3 |
| | SEOA1352 | | | |
| | MIOA2160a | | | |
| 1693 | ncr4208 | polymerase (RNA) II (DNA directed) polypeptide K (7.0kD) (POLR2K) | NM_005034.1 | 3 |
| | ncr2058 | | | |
| | ncr6110 | | | |

Figure 6A – EST Names Corresponding to Unique Known Genes of Figure 6

| | | | | |
|---|---|---|---|---|
| 1694 | SEOB0085 | inhibin, beta A (activin A, activin AB alpha polypeptide) (INHBA) | NM_002192.1 | 3 |
| | SEOB1298 | | | |
| | seob5123 | | | |
| 1695 | SEOA4587 | NCK adaptor protein 1(NCK1)=X17576 melanoma mRNA for nck protein, showing homology to src (ORF) | NM_006153.1 | 3 |
| | miob1334 | | | |
| | ncr8026 | | | |
| 1696 | HFCR3154 | tumor suppressing subtransferable candidate 4 (TSSC4) | 5032204 | 3 |
| | hfcr0342 | | | |
| | HFCR3142 | | | |
| 1697 | miob4668 | ASCL3; CEGP1; C11orf14, C11orf15, C11orf16 and C11orf17 | AJ400877.1 | 3 |
| | fcr6124n | | | |
| | hfcr0610 | | | |
| 1698 | ncrb2916 | brain cDNA, clone:QnpA-18828 | AB049881.1 | 3 |
| | ncr1455 | | | |
| | ncrc2135 | | | |
| 1699 | ncrb6936 | brain-specific STE20-like protein kinase 3 (STK3) | AF083420.1 | 3 |
| | fcrb1926 | | | |
| | ncrc4302 | | | |
| 1700 | SEOA6698a | DD6A4-1 | AF034237 | 3 |
| | SEOA7089a | | | |
| | SOA0134 | | | |
| 1701 | MIOA4827a | expressed only in placental villi, clone SMAP47 | AB019564 | 3 |
| | mioa9515 | | | |
| | MIOA4941a | | | |
| 1702 | fcrb2430 | hypothetical gene supported by M29548; X03558; X16869; BC010735; BC014224; BC014377; BC014892; BC015777; NM_001402; NM_001403 (LOC138328), mRNA | XM_059967.1 | 3 |
| | fcrb2379 | | | |
| | miob6011 | | | |
| 1703 | ncrc2133 | hypothetical protein (RefSeq aa 4e-65) | NP_055701.1 | 3 |
| | ncr5924 | | | |
| | ncrc4645 | | | |
| 1704 | SEOA1483n | KIAA0160 | D63881 | 3 |
| | ncrb2466 | | | |
| | hfcr0687 | | | |
| 1705 | SEOA7251a | KIAA0594 | AB011166 | 3 |
| | miob4679 | | | |
| | miob4950 | | | |
| 1706 | ncrc5804 | KIAA1128 protein, partial cds | AB032954.1 | 3 |
| | ncrc9582 | | | |
| | seob0992 | | | |
| 1707 | SEOA1750a | PCTAIRE2 | AB005540 | 3 |
| | seob5110 | | | |
| | SOA0209 | | | |
| 1708 | mioa9246 | PRO0989 | AF116614 | 3 |
| | hfcr7792 | | | |

Figure 6A – EST Names Corresponding to Unique Known Genes of Figure 6

| | | | | |
|---|---|---|---|---|
| | ncrc2484 | | | |
| 1709 | ncrc0742 | PRO2221 (RefSeq aa 1e-34) | NP_061094.1 | 3 |
| | miob2526 | | | |
| | ncrb8760 | | | |
| 1710 | seoa8092 | putative breast adenocarcinoma marker (32kD) (BC-2), mRNA /cds=(129,797) /gb=NM_014453 /gi=7656921 /ug=Hs.12107 /len=903 | Hs.12107 | 3 |
| | ncrb1899 | | | |
| | seoa8091 | | | |
| 1711 | MIOA8716 | transposon-like element | M23161 | 3 |
| | hfcr2906 | | | |
| | ncrc1952 | | | |
| 1712 | hfcr2731 | WSB1 isoform 2 (WSB1) | AF240696.1 | 3 |
| | seob5048 | | | |
| | ncrc1665 | | | |
| 1713 | MIOA8183 | ATP cassette binding transporter 1 (ABC1) | AF165281.1 | 3 |
| | ncrb1891 | | | |
| | ncrc3219 | | | |
| 1714 | FCR1068 | beta-1,4-galactosyltransferase (=D38551 hypothetical protien (KIAA0078)) | D37790 | 3 |
| | FCR5778 | | | |
| | seob2327 | | | |
| 1715 | hfcr7438 | UDP-N-acetyl-alpha-D-galactosamine:polypeptide | NM_004481.1 | 3 |
| | SEOB1783 | | | |
| | mioa9741 | | | |
| 1716 | MIOA0647 | long-chain acyl-CoA synthetase | D10040 | 3 |
| | miob0441 | | | |
| | MIOA6552a | | | |
| 1717 | ncrb3498 | cytochrome b-245, beta polypeptide (chronic granulomatous disease) (CYBB), (= X-CGD gene involved in chronic granulomatous disease located on chromosome X) | NM_000397.2 | 3 |
| | MIOA4572a | | | |
| | ncrc6974 | | | |
| 1718 | SEOA7334a | eukaryotic translation initiation factor 3, subunit 2 (beta, 36kD) | gi4503512 | 3 |
| | fcrb1837 | | | |
| | hfcr6866 | | | |
| 1719 | hfcr7553 | Sec31 protein | AF139184.1 | 3 |
| | ncrc0455 | | | |
| | ncrc3072 | | | |
| 1720 | SEOA2996a | DNA-binding protein (CROC-1B) | U39361 | 3 |
| | BFCW0493 | | | |
| | seob8293 | | | |
| 1721 | seoa4896a | ring finger protein 13 (RNF13), mRNA /cds=(151,1296) /gb=NM_007282 /gi=6005863 /ug=Hs.6900 /len=2339 | Hs.6900 | 3 |
| | mioa9820 | | | |
| | miob6796 | | | |
| 1722 | seob8246 | SPR-2 mRNA for GT box binding protein | X68560.1 | 3 |
| | SEOA8728 | | | |
| | SEOA2874 | | | |

Figure 6A – EST Names Corresponding to Unique Known Genes of Figure 6

| | | | | |
|---|---|---|---|---|
| 1723 | ncr4337<br>ncrc6589<br>ncrb8712 | T-box 15 (Tbx15) | NM_009323.1 | 3 |
| 1724 | hfcr5045<br>SEOA9755<br>SEOA9781 | zinc finger protein 207 (ZNF207) | NM_003457.1 | 3 |
| 1725 | ncrb5537<br>ncrb5865<br>ncrc9619 | alpha-2-macroglobulin precursor (RefSeq aa 1e-56) | NP_000005.1 | 3 |
| 1726 | ncr9639<br>ncrc5162<br>ncr1475 | transmembrane 4 superfamily member 6 (TM4SF6) | NM_003270.1 | 3 |
| 1727 | FCR3615<br>seob4570<br>MIOA8946 | cargo selection protein TIP47 (TIP47)(=PP17) | AF057140 | 3 |
| 1728 | FCR2442<br>ncrc1129<br>hfcr1127 | coatomer protein (COPA) | U24105 | 3 |
| 1729 | SEOA6612a<br>miob4096<br>ncrb7369 | CGI-43 protein | AF151801.1 | 3 |
| 1730 | hfcr0618<br>hfcr7643<br>miob0776 | novel RGD-containing protein (WS-3) | NM_006571.1 | 3 |
| 1731 | hfcr9881<br>fcr3676n<br>fcrb1101 | CDC42-binding protein kinase beta (DMPK-like) | XM_040911.1 | 3 |
| 1732 | SEOA9082<br>hfcr5205<br>ncrc1171 | Rab5 GDP/GTP exchange factor homologue (RABEX5) | NM_014504.1 | 3 |
| 1733 | FCR2107<br>BFCW0140<br>fcrb1257 | heparin-binding neurite outgrowth promoting factor (genomic sequence) | S60110 | 3 |
| 1734 | FCR3276<br>CR0740<br>FCR5880 | parathymosin | M24398 | 3 |
| 1735 | seob5962<br>SOA0608<br>SOA0604 | calcium-binding protein in macrophages (MRP-8) macrophage migration inhibitory factor (MIF)-related protein(S100 calcium-binding protein A8 (calgranulin A))(= cystic fibrosis antigen (CFAg)) | X06234.1 | 3 |
| 1736 | ncrc1231<br>ncrc5518<br>ncr6302 | membrane nucleoside transporter (RefSeq aa 8e-89) | NP_055528.1 | 3 |
| 1737 | ncrb1584<br>ncr7530<br>ncrc1633 | pinin, desmosome associated protein(RefSeq aa 7e-34) | NP_002678.1 | 3 |

Figure 6A – EST Names Corresponding to Unique Known Genes of Figure 6

| | | | | |
|---|---|---|---|---|
| 1738 | ncrc5369 | high-mobility group (nonhistone chromosomal) protein 14 (HMG14) | NM_004965.1 | 3 |
| | hfcr2966 | | | |
| | ncrc2171 | | | |
| 1739 | fcrb0171 | RCC1 gene, exons 1, 2, 3,4, 5, 6, 7, 8, 9, 10, 11, 12, 13, 14, complete cds= P18754\| CELL CYCLE REGULATORY PROTEIN | D00591.1 | 3 |
| | SEOA5448 | | | |
| | BFCW0332 | | | |
| 1740 | hfcr1378 | XPB/ERCC-3-like protein | Y17148.1 | 3 |
| | hfcr3808 | | | |
| | hfcr0487 | | | |
| 1741 | SEOA2874 | GT box binding protein (SPR-2) | X68560 | 3 |
| | SEOA8728 | | | |
| | seob8246 | | | |
| 1742 | ncr1765 | ribosomal 45S pre rRNA gene | X82564.1 | 3 |
| | ncrc5255 | | | |
| | ncrb7610 | | | |
| 1743 | hfcr3922 | flap structure-specific endonuclease 1 (FEN1), mRNA | NM_004111.3 | 3 |
| | hfcr5591 | | | |
| | hfcr3922 | | | |
| 1744 | ncrc2745 | postmeiotic segregation increased (S. cerevisiae) 2 (RefSeq aa 1e-67) | NP_000526.1 | 3 |
| | ncrb4798 | | | |
| | ncrc2745 | | | |
| 1745 | fcrb0194 | eukaryotic translation elongation factor 1 alpha 1-like 14 (EEF1A1L14) | NM_001403.1 | 2 |
| | fcrb0386 | | | |
| 1746 | SEOA4081 | ribosomal 28S RNA | M11167 | 2 |
| | ncr5632 | | | |
| 1747 | ncr4522 | zinc-finger, splicing (RefSeq aa 4e-74) | NP_005446.1 | 2 |
| | ncr5376 | | | |
| 1748 | seob6670 | DNA repair helicase (ERCC3) | M31899.1 | 2 |
| | MIOA8728 | | | |
| 1749 | hfcr4462 | minichromosome maintenance deficient (S. cerevisiae) 3 (MCM3) | NM_002388.2 | 2 |
| | FCR0915 | | | |
| 1750 | miob6124 | NRF1 protein (NRF1)= non-functional folate binding protein | L24123.1 | 2 |
| | ncrb1109 | | | |
| 1751 | SEOB2807 | RNA binding motif, single stranded interacting protein 1 (RBMS1) | gi8400721 | 2 |
| | ncr6703 | | | |
| 1752 | ncr8709 | beta-netrin | AF278532 | 2 |
| | ncrb6592 | | | |
| 1753 | SEOA7553a | kinesin (heavy chain) | X65873 | 2 |
| | ncr7801 | | | |
| 1754 | ncr6881 | bamacan (RefSeq aa 1e-76) | NP_005436.1 | 2 |
| | ncrb1740 | | | |
| 1755 | hfcr5232 | cartilage oligomeric matrix protein (COMP) | NM_000095.1 | 2 |
| | hfcr7454 | | | |
| 1756 | FCR7199 | collagen type X alpha 1(COL10A1) | X72580 | 2 |

Figure 6A – EST Names Corresponding to Unique Known Genes of Figure 6

| | | | | |
|---|---|---|---|---|
| | miob6336 | | | |
| 1757 | hfcr0074 | chemokine-like factor 1 (CKLF1) | AF096895.1 | 2 |
| | hfcr0170 | | | |
| 1758 | miob3411 | ecotropic viral integration site 2A (EVI2A) | NM_014210.1 | 2 |
| | ncrb4460 | | | |
| 1759 | miob6226 | apoptosis inhibitor (IEX-1L) gene | AF071596.1 | 2 |
| | hfcr2815 | | | |
| 1760 | FCR1976 | fructose 1,6-diphosphate aldolase A (=X05236;M11560;X12447) | M21190 | 2 |
| | MIOA7258a | | | |
| 1761 | SEOA6470a | UDP-GalNAc:polypeptide N-acetylgalactosaminyltransferase (T1) | X85018 | 2 |
| | miob4741 | | | |
| 1762 | FCR4570 | NADH:ubiquinone oxidoreductase B15 subunit (mitochondrial) | AF044957 | 2 |
| | SEOA7072a | | | |
| 1763 | miob5713 | aspartate beta-hydroxylase (ASPH) | NM_004318.1 | 2 |
| | FCR2135 | | | |
| 1764 | SEOA2209a | fragile X mental retardation protein 1 homologue FXR1 | U25165 | 2 |
| | SEOA2858 | | | |
| 1765 | miob6521 | protein disulfide isomerase related protein (ERp72) (clone pA3) | J05016.1 | 2 |
| | FCR5687 | | | |
| 1766 | seob4035 | ubiquitin specific protease 16 (USP16) | NM_006447.1 | 2 |
| | ncrb7048 | | | |
| 1767 | miob1827 | retinoblastoma-like 2 (p130)(RBL2) | NM_005611.1 | 2 |
| | ncr5151 | | | |
| 1768 | ncr4474 | U6 snRNA-associated Sm-like protein 2e-32 | NP_036454.1 | 2 |
| | ncr5061 | | | |
| 1769 | SEOA0010 | autoantigen | L05425 | 2 |
| | FCR7051 | | | |
| 1770 | hfcr1856 | microtubule-associated protein 4 (MAP4) | NM_002375.1 | 2 |
| | CR0044 | | | |
| 1771 | miob7009 | RBP1-like protein (LOC51742) | NM_016374.1 | 2 |
| | ncr0690 | | | |
| 1772 | ncr4194 | glioma pathogenesis-related protein (GliPR) | U16307.1 | 2 |
| | SEOA9423 | | | |
| 1773 | SEOB0221 | SMT3 (suppressor of mif two 3, yeast) homolog 1 (SMT3H1) | NM_006936.1 | 2 |
| | miob5747 | | | |
| 1774 | miob3955 | surface glycoprotein | Z50022.1 | 2 |
| | ncrb6903 | | | |
| 1775 | SEOB3517 | tetratricopeptide repeat domain 1 (TTC1) | NM_003314.1 | 2 |
| | ncrc2641 | | | |
| 1776 | hfcr9287 | ATPase, vacuolar, 14 kD (ATP6S14) | NM_004231.1 | 2 |
| | hfcr7989 | | | |
| 1777 | seob8301 | solute carrier family 20 (phosphate transporter), member 1 (SLC20A1) (=L20859.1 leukemia virus receptor 1) | 7382462 | 2 |
| | miob6354 | | | |
| 1778 | MIOA6093a | glycogen phosphorylase | Y15233 | 2 |
| | SEOA0482 | | | |

Figure 6A – EST Names Corresponding to Unique Known Genes of Figure 6

| | | | | |
|---|---|---|---|---|
| 1779 | MIOA3793<br>SEOA1044a | ribonuclease L (2',5'-oligoisoadenylate synthetase-dependent) inhibitor (RNASELI) | 4506558 | 2 |
| 1780 | FCR6299<br>SEOA0729a | cytochrome c oxidase subunit VII-related protein (COX7RP) | AB007618 | 2 |
| 1781 | MIOA5813a<br>SEOA8927 | lymphocyte dihydropyrimidine dehydrogenase (DPYD) | U20938 | 2 |
| 1782 | ncrb1337<br>hfcr3509 | eukaryotic translation initiation factor 3, subunit 7 (zeta, 66/67kD) | NM_003753.1 | 2 |
| 1783 | hfcr1904<br>hfcr1098 | chaperonin containing TCP1, subunit 7 (eta) (CCT7) | NM_006429.1 | 2 |
| 1784 | SEOB3090<br>miob0263 | ubiquitin carboxyl-terminal esterase L3 (ubiquitin thiolesterase) (UCHL3) | NM_006002.1 | 2 |
| 1785 | SEOB2657<br>hfcr7704 | ubiquitination factor E4A (homologous to yeast UFD2) (UBE4A) | 4759287 | 2 |
| 1786 | miob3700<br>miob3413 | Vacuolar protein sorting 26 (yeast homolog) (VPS26) | NM_004896.1 | 2 |
| 1787 | MIOA4818a<br>MIOA0190 | cAMP responsive element binding protein-like 2 (CREBL2) | NM_001310.1 | 2 |
| 1788 | SEOA7099a<br>FCR2127 | erg protein (ets-related gene) | M21535 | 2 |
| 1789 | hfcr0300<br>ncr2123 | Id3 gene for HLH type transcription factor | X73428.1 | 2 |
| 1790 | hfcr3413<br>hfcr6286 | Kruppel-like factor (LOC51713) | NM_016270.1 | 2 |
| 1791 | seob3367<br>ncrc5021 | THYROID HORMONE-INDUCED PROTEIN B PRECURSOR (aa 9e-21, 59%) | Q91641 | 2 |
| 1792 | MIOA5212a<br>FCR6546 | zinc finger transCRiptional regulator (GOS24) | M92844 | 2 |
| 1793 | ncr5341<br>ncr8615 | splicing factor, arginine/serine-rich 3 (RefSeq aa 5e-32) | NP_003008.1 | 2 |
| 1794 | seob8073<br>hfcr1886 | chromodomain helicase DNA | NM_001271.1 | 2 |
| 1795 | hfcr8821<br>hfcr4014 | keratocan (KERA), (=keratocan gene, promoter)( keratan sulfate proteoglycan ) | NM_007035.2 | 2 |
| 1796 | hfcr9342<br>hfcr9728 | beta tropomyosin (TPM2) gene | AF209746.1 | 2 |
| 1797 | hfcr9822<br>hfcr7948 | muscle mRNA for embryonic myosin heavy chain (SMHCE) | X15696.1 | 2 |
| 1798 | SEOA9997<br>MIOA4295a | nuclear receptor coactivator (=TRBP) | AF245115 | 2 |
| 1799 | hfcr3398 | protein tyrosine kinase 9 (PTK9) | NM_002822.1 | 2 |

Figure 6A – EST Names Corresponding to Unique Known Genes of Figure 6

| | | | | |
|---|---|---|---|---|
| | seob5981 | | | |
| 1800 | SEOA7555a | serine kinase SRPK2 | U88666 | 2 |
| | MIOA7093a | | | |
| 1801 | miob3131 | bone morphogenetic protein 6 (BMP6)(= transforming growth factor-beta(tgf-beta) ) | NM_001718.2 | 2 |
| | ncr9964 | | | |
| 1802 | SEOA5106a | cell adhesion molecule (CD44) | M59040 | 2 |
| | SEOA4443a | | | |
| 1803 | SEOA3839 | C-type (calcium dependent, carbohydrate-recognition domain) lectin, superfamily member 2 (activation-induced) (CLECSF2) (=E17140; X96719) | 4826676 | 2 |
| | ncr9092 | | | |
| 1804 | FCR2821 | cyclin-dependent kinase 4 (CDK4) | U37022 | 2 |
| | hfcr3039 | | | |
| 1805 | ncr9113 | WEE1 gene for protein kinase and partial ZNF143 gene for zinc finger transcription factor | AJ277546.1 | 2 |
| | ncrb7006 | | | |
| 1806 | ncr2807 | programmed cell death 4 (RefSeq aa 7e-54) | NP_055271.1 | 2 |
| | ncrc4772 | | | |
| 1807 | SEOA1770a | 130 kD Golgi-localized phosphoprotein (GPP130) | U55853 | 2 |
| | FCR6285 | | | |
| 1808 | miob0960 | ALL-1 gene | Z69780.1 | 2 |
| | ncrb0150 | | | |
| 1809 | mioa9304 | deleted in pancreatic carcinoma (DPC4) gene, exon 3 | AF045440.1 | 2 |
| | FCR4952 | | | |
| 1810 | miob1939 | E-1 enzyme (MASA) | AF113125.1 | 2 |
| | ncr1754 | | | |
| 1811 | SEOA4675a | FSHD-associated repeat DNA, proximal region=(AK001145) unnamed protein product (ORF) | U85056 | 2 |
| | FCR1919 | | | |
| 1812 | miob2881 | GalNAc-T2 gene | Y10344.1 | 2 |
| | hfcr0394 | | | |
| 1813 | hfcr0400 | glycolipid transfer protein (LOC51228) | NM_016433.1 | 2 |
| | SEOA5665a | | | |
| 1814 | hfcr2836 | golgi autoantigen, golgin subfamily a, 3 (GOLGA3) | NM_005895.1 | 2 |
| | seoa7879a | | | |
| 1815 | ncr6232 | KIAA0068 gene | D38549.1 | 2 |
| | SEOB1770 | | | |
| 1816 | miob3927 | KIAA0423 | AB007883.1 | 2 |
| | ncrc9225 | | | |
| 1817 | FCR3278 | KIAA0738 | AB018281 | 2 |
| | miob6061 | | | |
| 1818 | hfcr5383 | leukemogenic homolog protein (MEIS1) | U85707.1 | 2 |
| | miob3797 | | | |
| 1819 | ncr4180 | nuclear autoantigenic sperm protein (histone-binding) (NASP) | NM_002482.1 | 2 |
| | hfcr0424 | | | |
| 1820 | MIOB0336 | p21WAF1/CIP1 promoter-interacting protein (=KIAA0547) | AF265443.1 | 2 |
| | FCR5560 | | | |
| 1821 | SEOA5746a | tetracycline transporter-like protein | D88315 | 2 |
| | hfcr2656 | | | |

Figure 6A – EST Names Corresponding to Unique Known Genes of Figure 6

| | | | | |
|---|---|---|---|---|
| 1822 | ncr2486<br>ncrc9462 | lung type-I cell membrane-associated glycoprotein (RefSeq aa 2e-47) | NP_006465.1 | 2 |
| 1823 | SEOA4289a<br>MIOA8965 | acyl-coenzyme A:cholesterol acyltransferase (ORF) | L21934.2 | 2 |
| 1824 | FCR7656<br>MIOA8657 | casein kinase II alpha subunit | M55268 | 2 |
| 1825 | ncr3782<br>seoa7973 | protein tyrosine phosphatase type IVA, member 1 (PTP4A1) | NM_003463.1 | 2 |
| 1826 | miob4126<br>miob5731 | protein tyrosine phosphatase, non-receptor type 12 (PTPN12) | NM_002835.1 | 2 |
| 1827 | miob6702<br>ncr0140 | protein tyrosine phosphatase, non-receptor type 13 (APO-1/CD95 (Fas)-associated phosphatase) (PTPN13) | NM_006264.1 | 2 |
| 1828 | miob5770<br>mioa9210 | 5'-3' exoribonuclease 2 (XRN2) | NM_012255.1 | 2 |
| 1829 | ncrb1670<br>hfcr2526 | APEX nuclease (multifunctional DNA repair enzyme) (RefSeq aa 4e-74) | NP_001632.1 | 2 |
| 1830 | fcrb0743<br>fcrb1339 | carbamoyl-phosphate synthetase 2, aspartate transcarbamylase, and dihydroorotase (CAD) | NM_004341.1 | 2 |
| 1831 | hfcr7977<br>ncrb4849 | phosphoribosyl pyrophosphate synthetase-associated protein 1 (PRPSAP1) | NM_002766.1 | 2 |
| 1832 | MIOA3103a<br>MIOA3255a | aldehyde dehydrogenase (ALD10), miCRosomal | U46689 | 2 |
| 1833 | hfcr4176<br>ncrb4057 | low density lipoprotein-related protein 1 (alpha-2-macroglobulin receptor) (LRP1) | NM_002332.1 | 2 |
| 1834 | MIOA1848a<br>SEOA7219a | NADP dependent cytoplasmic malic enzyme (=U43944) | X77244 | 2 |
| 1835 | SEOB3156<br>hfcr3476 | hyaluronan-binding protein precursor (HABP1) | AF275902.1 | 2 |
| 1836 | miob6797<br>seob5570 | leucine rich repeat (in FLII) interacting protein 1 (LRRFIP1) (=GCF2) | NM_004735.1 | 2 |
| 1837 | miob3360<br>hfcr9600 | serine-rich protein | AF246705.1 | 2 |
| 1838 | SEOA7086a<br>ncr4929 | EUKARYOTIC TRANSLATION INITIATION FACTOR 3 SUBUNIT 10 (EIF-3 THETA) (EIF3 P167) (EIF3 P180) (EIF3 P185) (KIAA0139) | spQ14152 | 2 |
| 1839 | FCR7208<br>FCR0333 | translation initiation factor eIF-3 p110 subunit | U46025 | 2 |
| 1840 | SEOA2345a<br>MIOA2986a | metalloprotease/disintegrin/cysteine-rich protein precursor (MDC9) (=D14665 KIAA0021) | U41766 | 2 |

Figure 6A – EST Names Corresponding to Unique Known Genes of Figure 6

| | | | | |
|---|---|---|---|---|
| 1841 | seob5144 SEOB1350 | proteasome (prosome, macropain) activator subunit 1 (PA28 alpha) (PSME1) | NM_006263.1 | 2 |
| 1842 | SEOA5253a SEOA8223 | weak similarity to Arabidopsis thaliana ubiquitin-like protein 8 (77% ORF) | U88173 | 2 |
| 1843 | MIOA1662a hfcr1771 | cullin 3 (CUL3) (=AB014517 KIAA0617) | gi4503164 | 2 |
| 1844 | seob7896 SEOA1009n | cyclophilin 40 | D63861.1 | 2 |
| 1845 | hfcr9249 FCR0599 | cellular retinoic acid-binding protein 2 (CRABP2) | NM_001878.2 | 2 |
| 1846 | FCR5721 BFCW0542n | DNA binding protein NAK1 | D49728 | 2 |
| 1847 | miob4385 seob4297 | host cell factor 2 (HCF-2) | NM_013320.1 | 2 |
| 1848 | miob3798 ncrb3171 | LIM protein (similar to rat protein kinase C-binding enigma) (LIM) | NM_006457.1 | 2 |
| 1849 | SEOA0158 ncr1257 | von Hippel-Lindau binding protein (VBP-1) | U96759 | 2 |
| 1850 | miob3348 ncrc2490 | heterogeneous nuclear ribonucleoprotein F (HNRPF) | NM_004966.1 | 2 |
| 1851 | HFCR3197 ncrb2288 | poly(A)-binding protein, nuclear 1 (PABPN1) | gi4758875 | 2 |
| 1852 | hfcr9032 miob1342 | Sjogren syndrome antigen A1 (SSA1) | NM_003141.1 | 2 |
| 1853 | seob7613 ncrc9488 | core-binding factor, runt domain, alpha subunit 2; translocated to, 1; cyclin D-related (CBFA2T1) | NM_004349.1 | 2 |
| 1854 | SEOA1362a ncr8524 | membrane component, chromosome 17, surface marker 2 (ovarian carcinoma antigen CA125) (M17S2) (=X76952 IAI.3B; D30756 KIAA0049) | gi5174504 | 2 |
| 1855 | MIOA7088a SEOA6203a | X-ray repair complementing defective repair in Chinese hamster cells 4 (XRCC4) (=U40622) | gi4507944 | 2 |
| 1856 | miob4975 miob6272 | factor I (C3b/C4b inactivator) | J02770.1 | 2 |
| 1857 | SEOB3370 SEOA3192 | MHC class II HLA-DR-beta | M20430.1 | 2 |
| 1858 | hfcr1743 fcrb1813 | CGI-45 protein (LOC51094) | NM_015999.1 | 2 |
| 1859 | ncr3325 ncrb7460 | golgi matrix protein GM130 (GOLGA2) (non-exact 78% a.a.) %FL | AAF65550.1 | 2 |
| 1860 | ncr9096 ncrc3465 | EGF-like repeats and discoidin I-likedomains 3 (RefSeq aa 2e-55) | NP_005702.1 | 2 |
| 1861 | FCR0536 HFCR3251 | fibrillin-2 | U03272 | 2 |
| 1862 | seob5493 | fibulin 5 (FBLN5) | NM_006329.1 | 2 |

Figure 6A – EST Names Corresponding to Unique Known Genes of Figure 6

| | | | | |
|---|---|---|---|---|
| | ncrb0611 | | | |
| 1863 | hfcr2979 | microfibrillar-associated protein 1 (MFAP1) | NM_005926.1 | 2 |
| | ncr1104 | | | |
| 1864 | ncr3052 | actin-binding LIM protein (ABLIM) | NM_006719.2 | 2 |
| | ncrc4669 | | | |
| 1865 | hfcr9445 | thyroid autoantigen 70kD (Ku antigen) (G22P1) | NM_001469.1 | 2 |
| | hfcr0428 | | | |
| 1866 | SEOA7178a | vinculin | M33308 | 2 |
| | SEOB3155 | | | |
| 1867 | SEOA5239a | cardiac myosin binding protein-C (ORF) | X84075 | 2 |
| | MIOA4106 | | | |
| 1868 | SEOB3462 | tropomyosin 4 (TPM4) | Y00169.1 | 2 |
| | hfcr2715 | | | |
| 1869 | hfcr6841 | troponin T3, skeletal fast (TNNT3) | NM_006757.1 | 2 |
| | hfcr7396 | | | |
| 1870 | hfcr2536 | lamin B receptor (LBR) | NM_002296.1 | 2 |
| | ncrb4988 | | | |
| 1871 | seob4987 | surfeit 1 (SURF1) | NM_003172.1 | 2 |
| | ncr7098 | | | |
| 1872 | SEOA5455 | unc-50 related protein homologue | AF077038.1 | 2 |
| | miob4351 | | | |
| 1873 | MIOA1906a | 100 kDa coactivator | U22055 | 2 |
| | miob4490 | | | |
| 1874 | ncr6401 | diphtheria toxin receptor (heparin-binding epidermal growth factor-like growth factor)(DTR) | NM_001945.1 | 2 |
| | ncrc6846 | | | |
| 1875 | SEOA8609 | Fc fragment of IgE, high affinity I, receptor for; gamma polypeptide (FCER1G) | gi4758343 | 2 |
| | ncrb1563 | | | |
| 1876 | FCR7045 | fibroblast growth factor receptor (FGFR-4) | X57205 | 2 |
| | hfcr7360 | | | |
| 1877 | ncr2015 | G protein-coupled receptor 23 (GPR23) | NM_005296.1 | 2 |
| | ncrc1236 | | | |
| 1878 | seob4676 | stromal cell protein isoform | AF126024 | 2 |
| | hfcr0344 | | | |
| 1879 | miob3763 | mitogen-activated protein kinase kinase kinase kinase 4 (MAP4K4) | NM_004834.1 | 2 |
| | miob6081 | | | |
| 1880 | ncr4683 | protein kinase, cGMP-dependent, type I (PRKG1) | NM_006258.1 | 2 |
| | MIOA8228 | | | |
| 1881 | ncrb6337 | serine/threonine protein kinase MASK (LOC51765) | NM_016542.1 | 2 |
| | ncrb8443 | | | |
| 1882 | hfcr3690 | guanine nucleotide binding protein 10 (GNG10) | NM_004125.1 | 2 |
| | ncr2251 | | | |
| 1883 | SEOB0879a | angiopoietin-related protein | AF153606.1 | 2 |
| | seob5223 | | | |
| 1884 | hfcr2846 | macrophage migration inhibitory factor (glycosylation-inhibiting factor)(MIF) | NM_002415.1 | 2 |
| | FCR1351 | | | |
| 1885 | SEOA9343 | uncharacterized hypothalamus protein HTMP (LOC55858)(ORF) | NM_018475.1 | 2 |
| | hfcr7790 | | | |

Figure 6A – EST Names Corresponding to Unique Known Genes of Figure 6

| | | | | |
|---|---|---|---|---|
| 1886 | FCR7418<br>ncr1460 | histone H2A.F/Z variant (H2AV) | AF081192 | 2 |
| 1887 | SEOA0823<br>FCR1081 | C-1 | U41816 | 2 |
| 1888 | SEOB0046<br>seob7294 | cyclin-D binding Myb-like protein | AF084530.1 | 2 |
| 1889 | hfcr4489<br>SEOB0263 | GTP-binding protein G25K | AL121737.1 | 2 |
| 1890 | miob4213<br>hfcr9949 | reverse transcriptase homolog - human retrotransposon L1 | pir\|I38588 | 2 |
| 1891 | SEOA2734<br>SEOB3221 | ATP binding protein | AB006679 | 2 |
| 1892 | miob6486<br>miob5426 | BCL2 gene, exon 3 and breakpoint region | AF217803.1 | 2 |
| 1893 | hfcr5691<br>hfcr3551 | PRP4/STK/WD splicing factor (HPRP4P) | NM_004697.1 | 2 |
| 1894 | miob6351<br>hfcr1713 | tumor protein D52-like 1 (TPD52L1) | NM_003287.1 | 2 |
| 1895 | FCR1388N<br>hfcr2948 | 7-60 (gene) | AF112980 | 2 |
| 1896 | MIOA6471a<br>SEOA4811a | activated in tumor suppression | AJ012502.1 | 2 |
| 1897 | fcrb2100<br>ncrc4196 | adipose differentiation-related protein (ADFP) | XM_048266.2 | 2 |
| 1898 | seob6279<br>hfcr0901 | ALL1-fused gene from chromosome 1q (AF1Q) | NM_006818.1 | 2 |
| 1899 | SEOB1860<br>SEOA6687a | AML1 AML1c protein (alternatively spliced product) | D43969.1 | 2 |
| 1900 | miob4956<br>MIOA2977a | antigen NY-CO-10 (NY-CO-10) | AF039692.1 | 2 |
| 1901 | ncrb2754<br>ncrb8537 | BABP gene for bile acid-binding protein [AKR 1C2] | AB032151.1 | 2 |
| 1902 | mioa9429<br>ncrc9473 | beige-like protein (BGL) | M83822.1 | 2 |
| 1903 | SEOA4457a<br>fcrb0140 | BRCA2 region= ARP2/3 protein compex subunit 34 (ARC34)(ORF) | U50523 | 2 |
| 1904 | SEOA0772n<br>SEOA1782a | Brush-1=tumor suppressor (=AB020707 KIAA0900) | S69790 | 2 |
| 1905 | seob5214<br>FCR6088 | BTK region clone 2f10-rpi | U01925.1 | 2 |
| 1906 | hfcr6265<br>fcrb2255 | candidate tumor suppressor p33 ING1 homolog (LOC51147) | NM_016162.1 | 2 |
| 1907 | SEOA9161<br>SEOA9365 | CG14483 gene product (35% ORF) [Drosophila melanogaster] | AE003802 | 2 |
| 1908 | SEOB1678<br>ncr2243 | chitobiase, di-N-acetyl- (CTBS) | NM_004388.1 | 2 |
| 1909 | ncrc1945 | COP9 (constitutive photomorphogenic,Arabidopsis, homolog) subunit 5 (RefSeq aa 8e-74) | NP_006828.1 | 2 |

Figure 6A – EST Names Corresponding to Unique Known Genes of Figure 6

| | | | | |
|---|---|---|---|---|
| | seob6224 | | | |
| 1910 | FCR4725<br>FCR6629 | COP9 homolog (HCOP9) | U51205 | 2 |
| 1911 | seob7944<br>SEOA9636 | cytokine inducible SH2-containing protein 3 (Cish3) | gi6671757 | 2 |
| 1912 | SEOA1067a<br>MIOA0409a | cytokine-inducible SH2 protein 6 (CISH6) (=AB014571 KIAA0671) | AF073958.1 | 2 |
| 1913 | MIOA7347a<br>SEOA9513 | DAPIT protein | AJ271158 | 2 |
| 1914 | MIOA1603a<br>fcrb2234 | Dim1p homolog (hdim1 ) | AF023611 | 2 |
| 1915 | MIOA6188a<br>ncr9000 | DMA, DMB, HLA-Z1, IPP2, LMP2, TAP1, LMP7, TAP2, DOB, DQB2 and RING8 | X87344 | 2 |
| 1916 | SEOB1196<br>hfcr1221 | Dmx-like 1 (DMXL1) | NM_005509.1 | 2 |
| 1917 | ncr5397<br>MIOA0933 | down-regulated in metastasis (DRIM) | NM_014503.1 | 2 |
| 1918 | seob5592<br>hfcr5791 | downregulated in ovarian cancer 1 (DOC1) | NM_014890.1 | 2 |
| 1919 | miob6904<br>ncr9647 | enhancer of invasion 10 (HEI10) (=DKFZp564A0772) | AF216381.1 | 2 |
| 1920 | seob6560<br>FCR1653 | EXLM1 | AB006651.1 | 2 |
| 1921 | MIOA7170a<br>FCR2782 | FLI-LRR associated protein-1 | AF045573 | 2 |
| 1922 | SEOA1901<br>SEOB0247 | fvt1 | X63657 | 2 |
| 1923 | MIOA2330a<br>FCR3115N | GA17 protein (dendritic cell protein) | AF064603 | 2 |
| 1924 | ncrb3107<br>hfcr1908 | GL004 protein (RefSeq aa 2e-34) | NP_064579.1 | 2 |
| 1925 | SEOA8754<br>hfcr7716 | glioma tumor suppressor candidate region protein 2 | AAF62873.1 | 2 |
| 1926 | ncrb3077<br>ncrc0538 | guanylate binding protein 1, interferon-inducible, 67kD (RefSeq aa 4e-56) | NP_002044.1 | 2 |
| 1927 | seob7614<br>SEOB0210 | HDCMA18P protein (HDCMA18P) | NM_016648.1 | 2 |
| 1928 | ncr3397<br>hfcr9657 | HDCMC29P | AF068295.1 | 2 |
| 1929 | miob4822<br>ncrb6802 | hDj9 (=AL032657) (65% aa) | AB028859 | 2 |
| 1930 | seob6415<br>miob6582 | HepG2 3' region MboI cDNA, clone hmd3c06m3 | D17196.1 | 2 |
| 1931 | ncr3843<br>miob1954 | HP protein (HP) | AF026219.1 | 2 |
| 1932 | SEOB1754<br>ncrb8459 | HSPC007 protein | NP_054737.1 | 2 |
| 1933 | fcrb1120<br>fcrb1918 | HSPC023 protein (HSPC023), D2217 | NM_014047.1 | 2 |

Figure 6A – EST Names Corresponding to Unique Known Genes of Figure 6

| | | | | |
|---|---|---|---|---|
| 1934 | hfcr9837<br>miob0537 | HSPC043 protein mRNA, (=HSPC291) | AF161411.2 | 2 |
| 1935 | miob2492<br>ncrb3330 | HSPC085 | AF161348.1 | 2 |
| 1936 | miob3199<br>ncrc5413 | HSPC095 | AF161358.1 | 2 |
| 1937 | ncr3528<br>mioa2522a | HSPC115 mRNA,(= adenosine 5'-diphosphosugar pyrophosphatase (NUDT5))(= nudix (nucleoside diphosphate linked moiety X)-type motif 5 (NUDT5)) | AF161464.1 | 2 |
| 1938 | SEOA4163a<br>fcrb1698 | HSPC132 (ORF) | AF161481 | 2 |
| 1939 | seob6386<br>ncr9297 | HSPC133 protein (HSPC133) (=cDNA FLJ10459 fis) | NM_014168.1 | 2 |
| 1940 | ncrb0145<br>ncrb7315 | HSPC134 protein (HSPC134) | NM_014169.1 | 2 |
| 1941 | hfcr1779<br>ncrc1053 | HSPC229 | AF151063.1 | 2 |
| 1942 | SEOA4802a<br>SEOB1549 | HSPC250 (ORF) | AF151084 | 2 |
| 1943 | SEOB0065<br>ncrb1836 | HSPC292 | AAF28970.1 | 2 |
| 1944 | ncrc0922<br>ncrb8183 | HSPC302 | AF161420.1 | 2 |
| 1945 | ncrb7329<br>ncrc9674 | HT005 protein (=ariadne (Drosophila) homolog 2 (ARIH2))(= TRIAD1 type I) | AF183427.1 | 2 |
| 1946 | ncrb3348<br>ncrb2289 | HT014 (HT014) | AF221595.1 | 2 |
| 1947 | MIOA1301m<br>BFCS0315n | HYA22 | D88153 | 2 |
| 1948 | ncr2695<br>miob6144 | hypothalamus protein HT007 (RefSeq aa 2e-64) | NP_060950.1 | 2 |
| 1949 | fcrb1492<br>fcrb1373 | hypothetical gene (LOC115009) | XM_055020.1 | 2 |
| 1950 | SEOB0688a<br>hfcr1330 | intergenic DNA between SURF-2 and SURF-4 | Y17214 | 2 |
| 1951 | miob1967<br>mioa5679n | IRLB gene (exon5) | X82334.1 | 2 |
| 1952 | FCR1844<br>hfcr8628 | ITBA1 protein | X92475 | 2 |
| 1953 | fcrb1158<br>FCR7256 | JM4 protein (JM4) | NM_007213.1 | 2 |
| 1954 | MIOA7140a<br>SEOB0106 | KIAA0006 | D25304 | 2 |
| 1955 | SEOB1335<br>seob5089 | KIAA0009 | D13634.1 | 2 |
| 1956 | MIOA1585<br>hfcr3548 | KIAA0010 | D13635 | 2 |
| 1957 | FCR6847<br>hfcr3575 | KIAA0017 | D13642 | 2 |

Figure 6A – EST Names Corresponding to Unique Known Genes of Figure 6

| | | | | |
|---|---|---|---|---|
| 1958 | ncrc4597<br>ncrc2025 | KIAA0025 gene product; MMS-inducible gene (KIAA0025) | NM_014685.1 | 2 |
| 1959 | FCR6700<br>hfcr0862 | KIAA0036 | D25278 | 2 |
| 1960 | hfcr1395<br>hfcr6778 | KIAA0039 (ORF) | D26018.1 | 2 |
| 1961 | MIOA3380a<br>SEOB1589 | KIAA0041 | D26069 | 2 |
| 1962 | SEOB3149<br>seob7753 | KIAA0049 | D30756.1 | 2 |
| 1963 | miob3427<br>ncrc5813 | KIAA0058 | NM_014764.1 | 2 |
| 1964 | SEOB0915<br>ncrb8403 | KIAA0066 | D31886.1 | 2 |
| 1965 | miob6878<br>BFCS0484 | KIAA0072 gene | D31889.1 | 2 |
| 1966 | MIOA1006<br>ncr4779 | KIAA0073 (cyclophilin related) | D38552 | 2 |
| 1967 | ncr7249<br>ncr2212 | KIAA0093 | D42055.1 | 2 |
| 1968 | miob3420<br>SEOA8890 | KIAA0095 gene | NM_014669.1 | 2 |
| 1969 | hfcr3962<br>hfcr2042 | KIAA0105 | NM_004906.1 | 2 |
| 1970 | SEOA7509a<br>ncrb1859 | KIAA0112 | D25218 | 2 |
| 1971 | FCR4722<br>ncr4515 | KIAA0117 | D38491 | 2 |
| 1972 | miob4413<br>fcr4888 | KIAA0155 gene | NM_014633.1 | 2 |
| 1973 | ncrb0696<br>ncrb4398 | KIAA0156 gene product (KIAA0156) | NM_014706.1 | 2 |
| 1974 | SEOA8370a<br>SEOA2747 | KIAA0161 | D79983 | 2 |
| 1975 | SEOA1582a<br>seob4356 | KIAA0178 | D80000 | 2 |
| 1976 | FCR4634<br>hfcr0207 | KIAA0180 | D80002 | 2 |
| 1977 | miob5940<br>MIOA7280 | KIAA0183 gene | D80005.1 | 2 |
| 1978 | seob4254<br>FCR5975 | septin 2 (SEP2) | AF179995.1 | 2 |
| 1979 | SEOA4070<br>seob5582 | KIAA0203 | D86958 | 2 |
| 1980 | FCR2116<br>hfcr9280 | KIAA0217 | D86971 | 2 |
| 1981 | ncrb6796<br>ncr7906 | KIAA0225 gene | D86978.1 | 2 |
| 1982 | SEOA2499<br>mioa9936 | KIAA0227 | D86980 | 2 |
| 1983 | ncrb0200 | KIAA0228 gene | D86981.1 | 2 |

Figure 6A – EST Names Corresponding to Unique Known Genes of Figure 6

| | | | | |
|---|---|---|---|---|
| | ncrc2692 | | | |
| 1984 | hfcr0486 | KIAA0233 | NM_014745.1 | 2 |
| | hfcr5829 | | | |
| 1985 | FCR5228 | KIAA0253 | D87442 | 2 |
| | hfcr9294 | | | |
| 1986 | FCR0609 | KIAA0254 | D87443 | 2 |
| | SEOA8578 | | | |
| 1987 | ncrb2909 | KIAA0258 gene | NM_014785.1 | 2 |
| | ncrc3514 | | | |
| 1988 | mioa9649 | KIAA0266 gene, (ORF) | D87455 | 2 |
| | ncrb3629 | | | |
| 1989 | fcrb0673 | KIAA0324 | AB002322.2 | 2 |
| | ncrb1593 | | | |
| 1990 | SEOA7943a | KIAA0353 | AB002351 | 2 |
| | ncrc8835 | | | |
| 1991 | MIOA1890a | KIAA0368 | AB002366 | 2 |
| | hfcr2727 | | | |
| 1992 | fcrb0301 | KIAA0370 gene | AB002368.1 | 2 |
| | seob7096 | | | |
| 1993 | FCR7623 | KIAA0447 | AB007916 | 2 |
| | ncrc6905 | | | |
| 1994 | SEOB1775 | KIAA0451 | NM_014826.1 | 2 |
| | ncrc3108 | | | |
| 1995 | FCR4240 | KIAA0456 | AB007925 | 2 |
| | FCR4246 | | | |
| 1996 | seob6268 | KIAA0466 protein | AB007935.1 | 2 |
| | hfcr8498 | | | |
| 1997 | FCR7063 | KIAA0470 | AB007939 | 2 |
| | ncr7647 | | | |
| 1998 | ncr2583 | KIAA0471 gene product (KIAA0471) | NM_014857.1 | 2 |
| | ncrb1548 | | | |
| 1999 | SEOB3594 | KIAA0475 | NM_014864.1 | 2 |
| | ncr6765 | | | |
| 2000 | MIOA6034 | KIAA0480 | AB007949 | 2 |
| | miob5779 | | | |
| 2001 | hfcr7629 | KIAA0488 | AB007957.1 | 2 |
| | ncr7091 | | | |
| 2002 | SEOA9924 | KIAA0491 | AB007960 | 2 |
| | SEOB0235 | | | |
| 2003 | FCR4794 | KIAA0553 | AB011125 | 2 |
| | hfcr7345 | | | |
| 2004 | ncr5768 | KIAA0564 protein | AB011136.1 | 2 |
| | ncrc3119 | | | |
| 2005 | SEOA3566a | KIAA0611 | AB014511 | 2 |
| | ncr7086 | | | |
| 2006 | fcrb2592 | KIAA0618 gene product (KIAA0618), mRNA | XM_018359.3 | 2 |
| | ncrc6715 | | | |
| 2007 | FCR2307 | KIAA0638 | AB014538 | 2 |
| | HFCR3177 | | | |
| 2008 | MIOA6442a | KIAA0639 | AB014539 | 2 |
| | hfcr6655 | | | |
| 2009 | FCR6142 | KIAA0648 | AB014548 | 2 |

Figure 6A – EST Names Corresponding to Unique Known Genes of Figure 6

| | | | | |
|---|---|---|---|---|
| | MIOA1299 | | | |
| 2010 | ncrb5837 | KIAA0689 | AB014589.1 | 2 |
| | ncrb8622 | | | |
| 2011 | ncrb3003 | KIAA0697 protein | AB014597.1 | 2 |
| | ncrc9232 | | | |
| 2012 | ncr4190 | KIAA0701 protein | AB014601.1 | 2 |
| | ncr3936 | | | |
| 2013 | SEOA4867a | KIAA0727 (ORF) | AB018270 | 2 |
| | ncr6276 | | | |
| 2014 | SEOB3331 | KIAA0745 | AB018288.1 | 2 |
| | ncrb3557 | | | |
| 2015 | miob6164 | KIAA0761 protein | AB018304.1 | 2 |
| | seob4641 | | | |
| 2016 | SEOA7672a | KIAA0762 | AB018305.1 | 2 |
| | ncrb1543 | | | |
| 2017 | SEOB0219 | KIAA0765 | AB018308.1 | 2 |
| | FCR5650 | | | |
| 2018 | hfcr2946 | KIAA0770 | AB018313.1 | 2 |
| | ncrb6815 | | | |
| 2019 | hfcr6256 | KIAA0772 gene | NM_014835.1 | 2 |
| | ncrc4032 | | | |
| 2020 | ncrb5065 | KIAA0776 protein | AB018319.1 | 2 |
| | ncrc4315 | | | |
| 2021 | SEOB3317 | KIAA0824 (=PCF11p homolog) | AB020631.1 | 2 |
| | ncrc4074 | | | |
| 2022 | MIOA8064a | KIAA0830 | AB020637.1 | 2 |
| | miob0174 | | | |
| 2023 | SEOA0982n | KIAA0843 | AB020650.1 | 2 |
| | ncr2564 | | | |
| 2024 | ncr0920 | KIAA0847 protein | AB020654.1 | 2 |
| | ncrc1309 | | | |
| 2025 | MIOA4245 | KIAA0862=leucine-rich repeat protein SHOC-2 (SHOC-2)=AF054828 | AB020669 | 2 |
| | seob2662 | | | |
| 2026 | MIOA6404a | KIAA0903(ORF) | AB020710 | 2 |
| | miob0072 | | | |
| 2027 | SEOB1385 | KIAA0907 | AB020714.1 | 2 |
| | miob4770 | | | |
| 2028 | hfcr8640 | KIAA0909 protein | BAA74932.1 | 2 |
| | mioa4372a | | | |
| 2029 | ncr1640 | KIAA0911 protein (KIAA0911), | NM_014944.1 | 2 |
| | ncrb1181 | | | |
| 2030 | seob6835 | KIAA0914 gene product | NM_014883.1 | 2 |
| | ncrc9212 | | | |
| 2031 | SEOB3203 | KIAA0934 protein | AB023151.1 | 2 |
| | miob2496 | | | |
| 2032 | SEOA1190A | KIAA0947 | AB023164.1 | 2 |
| | hfcr2284 | | | |
| 2033 | FCR7381 | KIAA0952 | AB023169.1 | 2 |
| | FCR6064 | | | |
| 2034 | miob6483 | KIAA0955 protein (KIAA0955) | NM_014959.1 | 2 |
| | ncrb4537 | | | |

Figure 6A – EST Names Corresponding to Unique Known Genes of Figure 6

| | | | | |
|---|---|---|---|---|
| 2035 | SEOA4422a<br>ncr8273 | KIAA0978 | AB023195 | 2 |
| 2036 | miob3314<br>seoa4397a | KIAA0997 | NM_014950.1 | 2 |
| 2037 | SEOA5392<br>SEOA5270a | KIAA1014 | AB023231.1 | 2 |
| 2038 | SEOA2041<br>MIOA4713 | KIAA1033 | AB028956.1 | 2 |
| 2039 | MIOA2340a<br>ncr6842 | KIAA1063 | AB028986.1 | 2 |
| 2040 | SEOA3181<br>hfcr8542 | KIAA1064 | AB028987.1 | 2 |
| 2041 | hfcr6894<br>fcrb2176 | KIAA1131 | AB032957.1 | 2 |
| 2042 | seob6109<br>hfcr0015 | KIAA1137 | AB032963.1 | 2 |
| 2043 | hfcr8982<br>ncrc1573 | KIAA1190 | AB033016.1 | 2 |
| 2044 | SEOB3510<br>SEOA9487 | KIAA1223 | AB033049.1 | 2 |
| 2045 | miob0341<br>ncrb7959 | KIAA1249 protein | AB033075.1 | 2 |
| 2046 | ncr1437<br>ncrb0915 | KIAA1287 | AB033113 | 2 |
| 2047 | hfcr5228<br>hfcr7449 | KIAA1310 | AB037731.1 | 2 |
| 2048 | miob3038<br>miob1876 | KIAA1338 protein | AB037759.1 | 2 |
| 2049 | miob6182<br>miob2428 | KIAA1350 protein | AB037771.1 | 2 |
| 2050 | ncr2869<br>ncrc5341 | KIAA1381 | AB037802 | 2 |
| 2051 | hfcr1811<br>ncrc4327 | KIAA1404 | AB037825.1 | 2 |
| 2052 | seob7247<br>miob5660 | KIAA1423 | AB037844.1 | 2 |
| 2053 | ncr4020<br>seob7046 | KIAA1424 protein | AB037845.1 | 2 |
| 2054 | SEOB2786<br>SEOB1871 | KIAA1458 | AB040891.1 | 2 |
| 2055 | hfcr3486<br>ncr8295 | KIAA1507(=FLJ20654) | AB040940.1 | 2 |
| 2056 | seob3940<br>hfcr5570 | KIAA1518 | AB040951 | 2 |
| 2057 | hfcr2657<br>hfcr4084 | KIAA1519 | AB040952.1 | 2 |
| 2058 | ncr2013<br>ncrc0388 | KIAA1536 | AB040969.1 | 2 |
| 2059 | ncrb7156<br>ncrc5100 | KIAA1577 | AB046797.1 | 2 |
| 2060 | ncr0976<br>ncr1053 | KIAA1610 | AB046830.1 | 2 |

Figure 6A – EST Names Corresponding to Unique Known Genes of Figure 6

| | | | | |
|---|---|---|---|---|
| 2061 | ncrc0473<br>ncrc5645 | KIAA1633 protein | BAB13459.1 | 2 |
| 2062 | ncrc9022<br>ncrc9376 | L13 protein (RefSeq aa 8e-78) | NP_054797.1 | 2 |
| 2063 | MIOA0081a<br>SEOA9211 | La/SS-B protein | X69804 | 2 |
| 2064 | seob5889<br>ncr9844 | like mouse brain protein E46(E46L) | NM_013236.1 | 2 |
| 2065 | SEOA2652<br>SEOA4515 | lipoma HMGIC fusion partner (LHFP) | AF098807.1 | 2 |
| 2066 | FCR4773<br>seob4577 | LQFBS-1 (=AB011087 hypothetical protein (KIAA0515)) | AF062385 | 2 |
| 2067 | SEOA6557a<br>SEOA0730a | male sterility protein 2-like protein | AJ272073 | 2 |
| 2068 | seob7474<br>hfcr6212 | maternal G10 transcript (G10) | NM_003910.1 | 2 |
| 2069 | SEOA3556a<br>MIOA6290a | maternal-embryonic 3 (Mem3) | U47024 | 2 |
| 2070 | hfcr3757<br>ncrc0436 | MCT-1 protein (MCT-1) | NM_014060.1 | 2 |
| 2071 | ncr9664<br>ncrc9751 | MDS011 (MDS011) | AF182424.1 | 2 |
| 2072 | fcrb2189<br>fcrb2117 | MEF3L1 MEF3 like 1 | AB049150.1 | 2 |
| 2073 | fcrb2040<br>ncrc0320 | melanoma antigen, family D 1 (MAGED1) | NM_006986.2 | 2 |
| 2074 | miob4057<br>FCR1857 | meningioma (disrupted in balanced translocation) 1 (MN1) | NM_002430.1 | 2 |
| 2075 | ncr3219<br>hfcr5234 | microspherule protein 1 (MCRS1) | NM_006337.1 | 2 |
| 2076 | FCR6931<br>ncr9439 | neuroblastoma-amplified protein | AF056195 | 2 |
| 2077 | seob6032<br>ncrb6040 | Neurofibromatosis 1 locus on Chromosome 17 complete sequence | AC004526.1 | 2 |
| 2078 | hfcr1217<br>ncrc5492 | NICE-5 protein =AF116721) PRO3094 | AJ243666 | 2 |
| 2079 | HFCR3207<br>fcrb1795 | non-metastatic cells 1, protein (NM23A) expressed in (NME1) | 4557796 | 2 |
| 2080 | ncr3976<br>hfcr5813 | non-ocogenic Rho GTPase-specific GTP exchange factor (proto-LBC) | AF127481.1 | 2 |
| 2081 | SEOB0156<br>ncrb4128 | NY-REN-55 antigen (=DKFZp564L2416) | AF155113.1 | 2 |
| 2082 | miob3594<br>ncr5585 | p45SKP2-like protein (=FLR1) | AF157323.1 | 2 |
| 2083 | MIOA7233a<br>ncr9101 | p47 (=Y10769 R.norvegicus XY40 protein) (low match) | AF078856 | 2 |

Figure 6A – EST Names Corresponding to Unique Known Genes of Figure 6

| | | | | |
|---|---|---|---|---|
| 2084 | ncrb2091 | partial polr2H gene for RPB8, exons 1-5, and joined CDS (=RPB17) | AJ252079.1 | 2 |
| | ncrb2215 | | | |
| 2085 | SEOA1924n | PB1 | X90849 | 2 |
| | miob4697 | | | |
| 2086 | MIOA0813 | PBK1 protein | AJ007398.1 | 2 |
| | FCR4432 | | | |
| 2087 | FCR4846 | period (Drosophila) homolog (PER) (RIGUI) (=AB002107) | AF022991 | 2 |
| | seoa6787 | | | |
| 2088 | MIOA9127 | phosphoserine phosphatase-like (PSPHL) | NM_003832.1 | 2 |
| | hfcr6222 | | | |
| 2089 | SEOA1611a | PIBF1 protein | Y09631 | 2 |
| | SEOA2842 | | | |
| 2090 | MIOA4751 | PIX1 mRNA (ORF) | AF037219 | 2 |
| | ncrb1416 | | | |
| 2091 | hfcr9635 | PRO2160 | AF119863.1 | 2 |
| | hfcr5896 | | | |
| 2092 | ncrc1615 | PRO2275 | AF119873.1 | 2 |
| | ncrb8090 | | | |
| 2093 | hfcr7721 | PRO2898 | AF116717.1 | 2 |
| | hfcr5206 | | | |
| 2094 | miob3271 | PTD008 protein(=CGI-140 protein) | NM_016145.1 | 2 |
| | ncrb3104 | | | |
| 2095 | miob1746 | PTD009 protein (PTD009) (=HSPC172) | NM_016146.1 | 2 |
| | ncr7778 | | | |
| 2096 | ncr9487 | PTD016 protein (LOC51136) | NM_016125.1 | 2 |
| | ncrb6686 | | | |
| 2097 | ncrc4882 | PTPRF interacting protein, bindingprotein 1 (liprin beta 1) (RefSeq aa 2e-35) | NP_003613.1 | 2 |
| | fcrb1653 | | | |
| 2098 | ncrc2643 | putative Rab5-interacting protein(RefSeq aa 6e-34) | NP_061328.1 | 2 |
| | ncrb6174 | | | |
| 2099 | fcrb2756 | RD RNA-binding protein(RDBP), mRNA | NM_002904.3 | 2 |
| | ncrc3132 | | | |
| 2100 | FCR6947 | retinal short-chain dehydrogenase/reductase retSDR1 | AF061741 | 2 |
| | MIOA4355a | | | |
| 2101 | seob3841 | retrovirus-related leucine zipper protein p40 - human retrotransposon L1.1 | I38587 | 2 |
| | ncrc9445 | | | |
| 2102 | SEOA1886n | RETROVIRUS-RELATED POL POLYPROTEIN | spP11369 | 2 |
| | ncr5833 | | | |
| 2103 | miob4333 | REV1 protein (REV1) | NM_016316.1 | 2 |
| | ncrc6375 | | | |
| 2104 | seoa8002 | reversion-inducing-cysteine-rich protein with kazal motifs (RECK), mRNA /cds=(92,3007) /gb=NM_021111 /gi=11863155 /ug=Hs.29640 /len=4414 | Hs.29640 | 2 |
| | fcrb2049 | | | |
| 2105 | SEOB3262 | rrlB operon | AF053965.1 | 2 |
| | SEOB3270 | | | |
| 2106 | SEOB0298 | SCID complementing gene 2 | D78188.1 | 2 |

Figure 6A – EST Names Corresponding to Unique Known Genes of Figure 6

| | | | | |
|---|---|---|---|---|
| | MIOA2006 | | | |
| 2107 | mioa9357 | SEC14 (S. cerevisiae)-like 1 (SEC14L1), mRNA | NM_003003.1 | 2 |
| | FCR0797 | | | |
| 2108 | MIOA4753 | SEC63 protein | AJ011779.1 | 2 |
| | miob5073 | | | |
| 2109 | MIOA6121a | single-strand selective monofunctional uracil DNA glycosylase | AF125182 | 2 |
| | FCR6581 | | | |
| 2110 | FCR6074 | small glutamine-rich tetratricopeptide repeat (TPR) containing protein | AJ223828 | 2 |
| | hfcr9130 | | | |
| 2111 | miob0075 | SP100-HMG nuclear autoantigen (SP100) | AF056322.1 | 2 |
| | MIOA5508a | | | |
| 2112 | seob6853 | sperm autoantigenic protein 17 (SPA17) | NM_017425.1 | 2 |
| | hfcr7295 | | | |
| 2113 | mioa1108m | sperm specific antigen 2 (SSFA2=M61199=cleavage signal 1 protein mRNA, (ORF) | NM_006751.1 | 2 |
| | ncrc5549 | | | |
| 2114 | ncrc1032 | splice variant AKAP350 | AF091711.1 | 2 |
| | ncrc2957 | | | |
| 2115 | SEOB0166 | stabilin-1 (stab1 gene) (=KIAA0246) | AJ275213.1 | 2 |
| | FCR1099 | | | |
| 2116 | hfcr1083 | SULT1C sulfotransferase (SULT1C) | NM_006588.1 | 2 |
| | hfcr9041 | | | |
| 2117 | SEOB3455 | TCTEL1 (t-complex-associated-testis-expressed 1-like 1) | D50663.1 | 2 |
| | miob5422 | | | |
| 2118 | ncr6578 | testis specific protein | AF146738.1 | 2 |
| | fcrb1992 | | | |
| 2119 | ncr5384 | TMEM1and PWP2 | AB001523.1 | 2 |
| | ncrb1213 | | | |
| 2120 | MIOA0874a | torsin B (DQ1) | AF007872 | 2 |
| | FCR4650 | | | |
| 2121 | SEOA7341a | WD-40 repeat protein | AB024327.1 | 2 |
| | SEOA4181a | | | |
| 2122 | SEOB2974 | wild-type p53 activated fragment-1 (WAF1) | U03106.1 | 2 |
| | ncr1595 | | | |
| 2123 | hfcr6720 | WRN (WRN) | AF181897.1 | 2 |
| | ncrc9502 | | | |
| 2124 | SEOA2181a | WW domain binding protein 11 | AF071186 | 2 |
| | fcrb1362 | | | |
| 2125 | MIOA6156a | WW domain binding protein 5 | U92454 | 2 |
| | MIOA6730a | | | |
| 2126 | SEOA2800 | XRP2 protein (retinitis pigmentosa 2 (X-linked recessive) (RP2)) | AJ007590 | 2 |
| | SEOA8542 | | | |
| 2127 | hfcr9468 | annexin A6 (ANXA6) | NM_004033.1 | 2 |
| | fcrb2224 | | | |
| 2128 | MIOA5054a | annexin VII (synexin)(ANX7) | NM_001156.2 | 2 |
| | ncr1276 | | | |
| 2129 | SEOA0070 | ATP-specific succinyl-CoA synthetase beta subunit (SCS) | AF058953 | 2 |

Figure 6A – EST Names Corresponding to Unique Known Genes of Figure 6

| | | | | |
|---|---|---|---|---|
| | SEOA1134a | | | |
| 2130 | FCR6324 | sodium calcium exchanger 1 (NCX1) | U83657 | 2 |
| | ncr5273 | | | |
| 2131 | seoa7046 | solute carrier family 11 (proton-coupled divalent metal ion transporters), member 2 (SLC11A2), mRNA /cds=(88,1773) /gb=NM_000617 /gi=10835168 /ug=Hs.57435 /len=4103 | Hs.57435 | 2 |
| | ncrc3011 | | | |
| 2132 | ncrb1085 | solute carrier family 31 (copper transporters), member 2 (SLC31A2), (=putative copper uptake protein(hCTR2)) | NM_001860.1 | 2 |
| | mioa7719a | | | |
| 2133 | hfcr2616 | 6-phosphogluconolactonase (PGLS) | NM_012088.1 | 2 |
| | hfcr1046 | | | |
| 2134 | SEOA4608a | aldehyde oxidase gene=AOX1) | Z99567 | 2 |
| | ncrc3684 | | | |
| 2135 | miob4735 | alpha mannosidase II | U31520.1 | 2 |
| | FCR4216 | | | |
| 2136 | hfcr2629 | hexokinase 2 (HK2) | NM_000189.1 | 2 |
| | hfcr4186 | | | |
| 2137 | MIOA6541a | Na -D-glucose cotransport regulator gene | X82877 | 2 |
| | MIOA8151 | | | |
| 2138 | FCR1883N | oligosaccharyl transferase STT3 subunit homolog (B5) (integral membrane protein 1) | L38961 | 2 |
| | FCR3594 | | | |
| 2139 | hfcr5397 | paraoxonase 2 (PON2) | NM_000305.1 | 2 |
| | ncr5053 | | | |
| 2140 | hfcr1689 | phosphomannomutase | U86070.1 | 2 |
| | hfcr1291 | | | |
| 2141 | ncr4384 | proteolipid protein 2 (colonic epithelium-enriched) (PLP2) | NM_002668.1 | 2 |
| | ncrc9432 | | | |
| 2142 | ncr5621 | RGL protein (RGL) | AF186779.1 | 2 |
| | ncrb6332 | | | |
| 2143 | SEOB1783 | UDP-N-acetyl-alpha-D-galactosamine:polypeptide N-acetylgalactosaminyltransferase 7 (GalNAc-T7) (GALNAC-T7)) | gi8393408 | 2 |
| | mioa9741 | | | |
| 2144 | seob6872 | protein phosphatase methylesterase-1 (PME-1) | NM_016147.1 | 2 |
| | hfcr7632 | | | |
| 2145 | SEOA5468a | protein tyrosine phosphatase, receptor type, F (PTPRF) =Y00815 | NM_002840.1 | 2 |
| | ncr8232 | | | |
| 2146 | seob4696 | protein x 0004 (ORF) | AF117229 | 2 |
| | ncr0989 | | | |
| 2147 | hfcr1768 | protein x 013 | AF164793.1 | 2 |
| | hfcr2915 | | | |
| 2148 | hfcr3496 | TPI1 gene for triosephosphate isomerase | X69723.1 | 2 |
| | ncrb2857 | | | |
| 2149 | MIOB2593 | adenosine deaminase, RNA-specific (ADAR), transCRipt variant ADAR-c | gi7669474 | 2 |
| | MIOA0514 | | | |

Figure 6A – EST Names Corresponding to Unique Known Genes of Figure 6

| | | | | |
|---|---|---|---|---|
| 2150 | hfcr3054<br>ncrc2265 | adenylosuccinate lyase(ADSL) | NM_000026.1 | 2 |
| 2151 | SEOA5679a<br>FCR7523 | adenylosuccinate synthetase | X66503 | 2 |
| 2152 | hfcr0473<br>fcrb1727 | deoxyguanosine kinase (DGUOK) | NM_001929.1 | 2 |
| 2153 | SEOB2685<br>ncr2431 | deoxyribonuclease II | AF060222.1 | 2 |
| 2154 | ncr0475<br>ncrb6846 | inositol (myo)-1(or 4)-monophosphatase 1 (IMPA1), | NM_005536.2 | 2 |
| 2155 | SEOB2085<br>SEOA9526 | nucleotide pyrophosphatase (=plasma cell membrane glycoprotein (PC-1)) | D12485.1 | 2 |
| 2156 | SEOA9792<br>seob5455 | p53R2 gene for ribonucleotide reductase, exon 9 and complete cds | AB036532.1 | 2 |
| 2157 | seob6272<br>SEOA6878 | phosphoribosyl pyrophosphate synthetase-associated protein 2 (PRPSAP2) | NM_002767.1 | 2 |
| 2158 | seob7883<br>seob6162 | phosphoribosylglycinamide formyltransferase (PGFT) | M32082.1 | 2 |
| 2159 | FCR4831<br>ncrb4946 | purine nucleoside phosphorylase | X00737 | 2 |
| 2160 | FCR6753<br>fcrb0655 | thymidylate synthase | D00596 | 2 |
| 2161 | hfcr2658<br>hfcr9511 | 1-acylglycerol-3-phosphate O-acyltransferase | Y09565.1 | 2 |
| 2162 | SEOA2631<br>hfcr6201 | adaptor protein p150 | Y08991 | 2 |
| 2163 | FCR6637<br>FCR3707 | mutant cerebroside sulfate activator protein (SAP-MU-6) (=J03015 sphingolipid activator protein 1) | M60258 | 2 |
| 2164 | SEOB0288<br>BFCS0238 | Niemann-Pick C disease protein (NPC1) | AF002020.1 | 2 |
| 2165 | ncrb1719<br>ncrc3991 | 5-methyltetrahydrofolate-homocysteine methyltransferase (MTR) | NM_000254.1 | 2 |
| 2166 | MIOA5452a<br>hfcr7461 | AAPT1-like protein | AF047431.1 | 2 |
| 2167 | SEOA1606a<br>FCR4813 | acetyl-coenzyme A transporter | D88152 | 2 |
| 2168 | ncr3148<br>SEOA9518 | ARF protein | NM_016632.1 | 2 |
| 2169 | seob5069<br>hfcr7938 | attractin precursor (ATRN) gene | AF218915.1 | 2 |
| 2170 | miob2386<br>FCR2779 | biliverdin reductase A (BLVRA) | NM_000712.1 | 2 |
| 2171 | ncrb5155<br>ncrc5176 | choline/ethanolaminephosphotransferase (CEPT1) | NM_006090.1 | 2 |
| 2172 | FCR0824 | enoyl-CoA hydratase/3-hydroxyacyl-CoA dehydrogenese alpha-subunit of trifunctional protein, mitochondrial | D16480 | 2 |

Figure 6A – EST Names Corresponding to Unique Known Genes of Figure 6

| | | | | |
|---|---|---|---|---|
| 2173 | ncrc0865<br>SEOB0674a | galactocerebrosidase (GALC) gene | L38559 | 2 |
| 2174 | MIOA5233a<br>ncrb1625 | hydroxysteroid (17-beta) dehydrogenase 4 (HSD17B4) | NM_000414.1 | 2 |
| 2175 | SEOA8399a<br>MIOA1445 | methylmalonyl-CoA mutase (MCM) | M65131 | 2 |
| 2176 | ncrc0991<br>ncrb1646 | nucleus-encoded mitochondrial aldehyde dehydrogenase 2 (ALDH2) gene | M20456.1 | 2 |
| 2177 | SEOA4739a<br>MIOA3598a | phospholipase C beta 4 (PLCB4) | L41349 | 2 |
| 2178 | MIOA4278<br>hfcr0061 | phospholipase C-beta-3 (PLCB3) | U26425.1 | 2 |
| 2179 | hfcr0157<br>FCR1463 | transacylase (DBT) | X66785 | 2 |
| 2180 | hfcr0005<br>MIOA1570 | cytochrome c oxidase assembly protein COX11 (COX11) | AF044321 | 2 |
| 2181 | MIOA8963<br>SEOA9874 | cytochrome c oxidase subunit VIa gene | U83702.1 | 2 |
| 2182 | fcrb2012<br>SEOA0066 | mitochondrial 75 kDa iron sulphur protein | X61100 | 2 |
| 2183 | FCR7430<br>MIOA2343a | mitochondrial carrier homologue 2 | AF176008.1 | 2 |
| 2184 | ncrc0960<br>MIOA0848a | mitochondrial carrier protein ARALAR1 | Y14494 | 2 |
| 2185 | MIOA2971a<br>SEOA3088a | mitochondrial cytochrome c oxidase Va subunit | M22760 | 2 |
| 2186 | HFCR3133<br>MIOA3512a | mitochondrial inner membrane translocase Tim23 (TIM23) | AF030162.1 | 2 |
| 2187 | FCR5152<br>FCR1994 | NAD+-specific isocitrate dehydrogenase beta subunit precursor (mitochondrial) | U49283 | 2 |
| 2188 | FCR0432<br>ncrb7952 | NADH dehydrogenase (ubiquinone) Fe-Sprotein 5 (15kD) (NADH-coenzyme Q reductase); CI-15protein (RefSeq aa 2e-62) | NP_004543.1 | 2 |
| 2189 | ncrc5464<br>ncr5871 | NADH dehydrogenase (ubiquinone) flavoprotein 2 (24kD) (NDUFV2) | NM_021074.1 | 2 |
| 2190 | seob4368<br>ncr1506 | NADH dehydrogenase subunit {heteroplasmic G->A transition in codon 331} | S73804 | 2 |
| 2191 | ncrc2579<br>SEOA4327a | NADH dehydrogenase(ubiquinone) 1, subcomplex unknown, 2 (14.5kD, B14.5b)NDUFC2=AF087659 (ORF) | NM_004549.1 | 2 |
| 2192 | fcrb0126<br>SEOA2642 | NADH dehydrogenase-ubiquinone Fe-S protein 8 23 kDa subunit (NDUFS8) | AF038406 | 2 |

Figure 6A – EST Names Corresponding to Unique Known Genes of Figure 6

| | | | | |
|---|---|---|---|---|
| | hfcr9142 | | | |
| 2193 | FCR3779 | NADH:ubiquinone dehydrogenase 51 kDa subunit (NDUFV1) (mitochondrial) | AF053070 | 2 |
| | hfcr6059 | | | |
| 2194 | miob5003 | NADH:ubiquinone oxidoreductase B17 subunit | AF035840.1 | 2 |
| | FCR0043n | | | |
| 2195 | hfcr3557 | oxidase (cytochrome c) assembly 1-like (OXA1L) | NM_005015.1 | 2 |
| | FCR4816 | | | |
| 2196 | ncrb1409 | PNAS-105 (=NADH dehydrogenase subunit 2 (ND2) gene, mitochondrial gene encoding mitochondrial protein), | AF275801.1 | 2 |
| | ncrc0209 | | | |
| 2197 | MIOA8077 | QUINONE OXIDOREDUCTASE (NADPH:QUINONE REDUCTASE) (ZETA-CRYSTALLIN) | spQ08257 | 2 |
| | SEOB1703 | | | |
| 2198 | seob7907 | succinyl CoA:3-oxoacid CoA transferase precursor (OXCT) | U62961.1 | 2 |
| | miob1125 | | | |
| 2199 | miob0361 | ubiquilin 2 (UBQLN2) | NM_013444.1 | 2 |
| | miob0837 | | | |
| 2200 | ncr8067 | antizyme inhibitor | NM_015878.1 | 2 |
| | ncrc1616 | | | |
| 2201 | ncrb1373 | arginase, type II (ARG2), nuclear gene encoding mitochondrial protein, (=vesicle-associated soluble NSF attachment protein receptor (v-SNARE; homolog of S. cerevisiae VTI1)) | NM_001172.2 | 2 |
| | ncrc3230 | | | |
| 2202 | MIOA6726a | Asparaginyl tRNA Synthetase (NARS) | D84273 | 2 |
| | miob1776 | | | |
| 2203 | ncr1235 | dolichyl-phosphate mannosyltransferase polypeptide 1, catalytic subunit (DPM1) | NM_003859.1 | 2 |
| | fcrb1419 | | | |
| 2204 | hfcr0789 | Fas-activated serine/threonine kinase (FASTK) | NM_006712.1 | 2 |
| | hfcr5163 | | | |
| 2205 | fcrb1729 | golgi phosphoprotein 1 (GOLPH1) | XM_037292.1 | 2 |
| | fcrb1484 | | | |
| 2206 | ncrc0439 | isopentenyl-diphosphate delta isomerase (IDI1)(= homolog of yeast IPP isomerase) | NM_004508.1 | 2 |
| | ncrc6468 | | | |
| 2207 | seob5007 | isoprenylcysteine carboxyl methyltransferase (ICMT) | NM_012405.1 | 2 |
| | hfcr7430 | | | |
| 2208 | ncrc2044 | leucine zipper, down-regulated in cancer 1 (LDOC1) | NM_012317.1 | 2 |
| | fcrb1376 | | | |
| 2209 | ncr6072 | leucine-rich protein | M92439.1 | 2 |
| | ncrb1713 | | | |
| 2210 | FCR0392 | lysyl hydroxylase (=L06419) | M98252 | 2 |
| | FCR6585 | | | |
| 2211 | ncr9003 | Npw38-binding protein NpwBP (LOC51729) | NM_016312.1 | 2 |
| | ncrb0732 | | | |
| 2212 | BFCN0197 | ORNITHINE DECARBOXYLASE (ODC) | spP00860 | 2 |
| | MIOA7593a | | | |

Figure 6A – EST Names Corresponding to Unique Known Genes of Figure 6

| | | | | |
|---|---|---|---|---|
| 2213 | ncr6811<br>ncrb0787 | phenylalanyl-tRNA synthetase beta-subunit; PheHB (RefSeq aa 4e-66) | NP_005678.1 | 2 |
| 2214 | MIOA5310a<br>seob6146 | proline arginine-rich end leucine-rich repeat protein (PRELP) =U29089 (ORF) | NM_002725.1 | 2 |
| 2215 | miob2443<br>ncr5672 | Proline synthetase associated | AB018566.1 | 2 |
| 2216 | FCR0578<br>mioa7741a | S-adenosyl homocysteine hydrolase homolog (XPVkona) | U82761 | 2 |
| 2217 | ncrc0572<br>ncrc4257 | cytidine monophosphate kinase CMP mRNA, (=UMP-CMP kinase (LOC51727)) | AF259961.1 | 2 |
| 2218 | miob3169<br>SEOB3451 | selenoprotein T(LOC51714) | NM_016275.1 | 2 |
| 2219 | SEOA1083a<br>miob3321 | eukaryotic translation initiation factor 2 alpha kinase PEK | AF110146 | 2 |
| 2220 | SEOB1981<br>ncrc6862 | eukaryotic translation initiation factor 2, subunit 1 (alpha, 35kD ) (EIF2S1) | gi4758255 | 2 |
| 2221 | SEOA9855<br>ncrb0473 | eukaryotic translation initiation factor 3, subunit 1 (alpha, 35kD) (EIF3S1) | NM_003758.1 | 2 |
| 2222 | MIOA1708a<br>seob7324 | EUKARYOTIC TRANSLATION INITIATION FACTOR 5 (EIF-5) | spP55010 | 2 |
| 2223 | seob4965<br>hfcr1883 | fasciculation and elongation protein zeta 2 (zygin II) (FEZ2) | NM_005102.1 | 2 |
| 2224 | SEOB1414<br>ncrc6008 | homolog of rat elongation factor p18 (P18) | NM_004280.1 | 2 |
| 2225 | FCR0206<br>miob0769 | mitochondrial translational release factor 1 | AF072934 | 2 |
| 2226 | ncr9469<br>ncr8144 | translation initiation factor elF-2alpha | U26032.1 | 2 |
| 2227 | SEOA9642<br>MIOA1778 | translational inhibitor protein p14.5 (UK114) = X95384.1 | NM_005836.1 | 2 |
| 2228 | MIOA0684<br>SEOA6356 | translin associated protein X | X95073 | 2 |
| 2229 | seob6751<br>hfcr5427 | Tu translation elongation factor, mitochondrial (TUFM) | NM_003321.1 | 2 |
| 2230 | SEOA1398<br>SEOA3405a | unr protein (=AB020692 KIAA0885) | AF077054.1 | 2 |
| 2231 | hfcr9374<br>SEOA3016a | arginyl-tRNA synthetase (RARS) | NM_002887.1 | 2 |
| 2232 | SEOB1680<br>hfcr3940 | 5.8S ribosomal RNA | J01866.1 | 2 |

Figure 6A – EST Names Corresponding to Unique Known Genes of Figure 6

| | | | | |
|---|---|---|---|---|
| 2233 | seoa4961a<br>fcrb2568 | mitochondrial ribosomal protein S11 (MRPS11), nuclear gene encoding mitochondrial protein, mRNA /cds=(265,849) /gb=NM_022839 /gi=16554608 /ug=Hs.111286 /len=1136 | Hs.111286 | 2 |
| 2234 | seoa7827a<br>fcrb1573 | mitochondrial ribosomal protein S33 (MRPS33), transcript variant 1, nuclear gene encoding mitochondrial protein, mRNA /cds=(138,458) /gb=NM_016071 /gi=16950595 /ug=Hs.83006 /len=727 | Hs.83006 | 2 |
| 2235 | hfcr8880<br>hfcr5412 | PRO1181 (=ribosomal protein L29(RPL29))(= cell surface heparin binding protein HIP ) | AF116627.1 | 2 |
| 2236 | hfcr0439<br>ncrc9288 | alpha-1-antitrypsin | K01396.1 | 2 |
| 2237 | miob5608<br>mioa9979 | amyloid beta precursor protein-binding protein 1, 59kD (APPBP1) | NM_003905.1 | 2 |
| 2238 | FCR4946<br>FCR0751 | antiseCRetory factor-1 (=U51007 26S protease subunit S5a) | U24704 | 2 |
| 2239 | SEOA2219a<br>MIOA1432 | ATP-dependent metalloprotease YME1L (contains Alu repeat) | AJ132637.1 | 2 |
| 2240 | seob5113<br>fcrb2269 | matrix metalloproteinase 13 (collagenase 3) (MMP13) | NM_002427.1 | 2 |
| 2241 | fcrb1271<br>hfcr3556 | matrix metalloproteinase 15 (membrane-inserted) (MMP15) | NM_002428.1 | 2 |
| 2242 | fcrb1529<br>fcrb1481 | matrix metalloproteinase 2 (gelatinase A, 72kD gelatinase, 72kD type IV collagenase)(MMP2) | XM_048244.1 | 2 |
| 2243 | ncrc3777<br>ncrc7068 | matrix metalloproteinase 9 (gelatinase B, 92kD gelatinase, 92kD type IV collagenase)(MMP9) | NM_004994.1 | 2 |
| 2244 | MIOA0826<br>ncrc5577 | MB1 (=D29011 proteasome subunit X) | X95586 | 2 |
| 2245 | MIOA2344a<br>MIOA4285 | mitogen-activated kinase kinase kinase 5 (MAPKKK5) | U67156 | 2 |
| 2246 | FCR3985<br>FCR3916N | peptidase homolog | AF010141 | 2 |
| 2247 | SEOA6176a<br>FCR3729 | plasminogen activator inhibitor-1 | J03764 | 2 |
| 2248 | SEOA1269a<br>FCR6958 | proteasome activator hPA28 subunit beta | D45248 | 2 |
| 2249 | SEOA3093a<br>miob4653 | proteasome subunit p42 | D78275 | 2 |
| 2250 | miob4733<br>ncrb1518 | protein associated with Myc (=AB020723 KIAA0916) | AF075587.1 | 2 |

Figure 6A – EST Names Corresponding to Unique Known Genes of Figure 6

| | | | | |
|---|---|---|---|---|
| 2251 | mioa7805a<br>mioa7645a | protein associated with PRK1 (AWP1), mRNA /cds=(244,804) /gb=NM_019006 /gi=9506852 /ug=Hs.83954 /len=1613 | Hs.83954 | 2 |
| 2252 | hfcr1428<br>fcrb2325 | protein regulator of cytokinesis 1 (PRC1) | NM_003981.1 | 2 |
| 2253 | SEOA6344<br>miob5037 | sorting nexin 14 (SNX14) | AF121863.1 | 2 |
| 2254 | MIOA3744a<br>miob5663 | sorting nexin 4 | AF065485 | 2 |
| 2255 | SEOA0078<br>SEOA3698a | sorting nexin 5 (SNX5) | AF121855.1 | 2 |
| 2256 | SEOA0511<br>seob6014 | sorting nexin 7 (SNX7) | AF121857.1 | 2 |
| 2257 | MIOA3440a<br>SEOA4649a | TIMP3 tissue inhibitor of metalloproteinases-3 | X76227 | 2 |
| 2258 | FCR0390<br>FCR1407N | BRCA1 associated protein 1 (BAP1) | AF045581 | 2 |
| 2259 | ncr3276<br>MIOA4852a | coated vesicle membrane protein (RNP24) | NM_006815.1 | 2 |
| 2260 | hfcr8615<br>ncr1696 | F-box protein 7 (FBX7) | NM_012179.1 | 2 |
| 2261 | MIOA5447a<br>FCR3132 | KDEL receptor(Xenopus laevis) | AL035081 | 2 |
| 2262 | hfcr1411<br>ncr4812 | peroxisomal biogenesis factor 12 (PEX12) | NM_000286.1 | 2 |
| 2263 | MIOA6388a<br>miob3766 | peroxisomal D3,D2-enoyl-CoA isomerase (PECI) | AF153612 | 2 |
| 2264 | FCR0781<br>FCR2361 | peroxisomal enoyl-CoA hydratase-like protein (HPXEL) | U16660 | 2 |
| 2265 | SEOB1172<br>ncr7423 | peroxisomal farnesylated protein (PXF) | NM_002857.1 | 2 |
| 2266 | SEOA0973<br>FCR4612 | rapamycin-binding protein (FKBP25) (=M90309) | M90820 | 2 |
| 2267 | SEOA7408a<br>ncrb0758 | signal recognition particle (SRP54) | U51920 | 2 |
| 2268 | miob6118<br>ncr3185 | signal recognition particle 72kD (SRP72)(ORF) | NM_006947.1 | 2 |
| 2269 | FCR3042<br>MIOA3856 | stimulator of TAR RNA binding (SRB) (=AF026291 chaperonin containing t-complex polypeptide 1, delta subunit (Cctd)) | U38846 | 2 |
| 2270 | SEOA2363a<br>miob4514 | ubiquitin conjugating enzyme, UbcH6 | X92963 | 2 |
| 2271 | MIOA6739a<br>mioa7806a | ubiquitin C-terminal hydrolase UCH37 (UCH37) | AF147717.1 | 2 |
| 2272 | SEOA1282a<br>ncrc6649 | ubiquitin hydrolyzing enzyme I (UBH1) | AF022789 | 2 |
| 2273 | SEOB2803<br>MIOA6428a | ubiquitin-52 amino acid fusion protein | X56998.1 | 2 |

Figure 6A – EST Names Corresponding to Unique Known Genes of Figure 6

| | | | | |
|---|---|---|---|---|
| 2274 | miob0839<br>seoa8005 | ubiquitin-conjugating enzyme E2D 3 (homologous to yeast UBC4/5) (UBE2D3) | NM_003340.1 | 2 |
| 2275 | MIOA6543a<br>SEOB1136 | ubiquitin-conjugating enzyme E2L 6 (UBE2L6) =AF061736 ubiquitin-conjugating enzyme RIG-B | NM_004223.1 | 2 |
| 2276 | MIOA4694<br>SEOA4688a | ubiquitin-conjugating enzyme UbcH2 | Z29331 | 2 |
| 2277 | SEOA9873<br>SEOB0578 | ubiquitously-expressed transCRipt (UXT)(ORF)= AF092737 | NM_004182.1 | 2 |
| 2278 | SEOA5157a<br>MIOA2107 | WDR1 protein | AF020260 | 2 |
| 2279 | FCR4885<br>ncrc9752 | bithoraxoid-like protein (BLP)(= HSPC162 protein (HSPC162)) | AF165516.1 | 2 |
| 2280 | ncrb7586<br>fcrb1621 | glioma-amplified sequence-41 (GAS41) | NM_006530.1 | 2 |
| 2281 | miob0202<br>hfcr6508 | MAT-1 oncogene (HUMMAT1H) (=PEA15) | NM_013287.1 | 2 |
| 2282 | SEOA0404<br>ncr8759 | methyl-CpG binding protein 1 (MBD1) | AF120982.1 | 2 |
| 2283 | SEOA8867<br>hfcr1897 | methyl-CpG binding protein MBD4 | AAC68879.1 | 2 |
| 2284 | MIOA8341<br>miob2430 | 33 kDa transcriptional co-activator (CRSP33) (=hMed7) | NM_004270.1 | 2 |
| 2285 | ncr4946<br>seob3726 | ataxia telangiectasia and Rad3 related (ATR) | NM_001184.1 | 2 |
| 2286 | FCR2196<br>ncrb4094 | B cell RAG associated protein (BRAG) (=AB011170 hypothetical protein (KIAA0598)) | AF026477 | 2 |
| 2287 | MIOA8774<br>fcrb2588 | B-cell CLL/lymphoma 6 (zinc finger protein 51) (BCL6) | NM_001706.1 | 2 |
| 2288 | ncr2421<br>ncrc1941 | bromodomain adjacent to zinc finger domain, 2A (RefSeq aa 5e-62) | NP_038477.1 | 2 |
| 2289 | MIOA3558a<br>ncr7376 | CAAT-box DNA binding protein subunit B (NF-YB) | X59710 | 2 |
| 2290 | hfcr5009<br>hfcr9579 | CAG-isl 7 | U16738.1 | 2 |
| 2291 | miob4864<br>ncrb1482 | CBF1 interacting corepressor CIR (=U03644.1 recepin) | AF098297.1 | 2 |
| 2292 | FCR6482<br>fcrb2429 | CCR4-associated factor 1 (POP2) | AF053318 | 2 |
| 2293 | FCR2088<br>FCR0750 | cellular oncogene c-fos (=K00650) | V01512 | 2 |
| 2294 | SEOA0235a<br>SEOA3742a | chromatin-specific transCRiption elongation factor FACT | AF152961.1 | 2 |

Figure 6A – EST Names Corresponding to Unique Known Genes of Figure 6

| | | | | |
|---|---|---|---|---|
| 2295 | hfcr3469<br>hfcr6300 | class I histone deacetylase (HDAC8) | AF230097.1 | 2 |
| 2296 | SEOB0253<br>ncrb5540 | ets variant gene 5 (ets-related molecule) (ETV5) | NM_004454.1 | 2 |
| 2297 | MIOA1417<br>MIOA2385a | GC box binding protein | D31716 | 2 |
| 2298 | hfcr2548<br>hfcr6495 | hepatocellular carcinoma novel gene-3 protein (LOC51339) | NM_016651.2 | 2 |
| 2299 | hfcr4439<br>fcrb2458 | HMG-2 | X62534.1 | 2 |
| 2300 | miob6130<br>ncrc1344 | Id2 protein (Id-2) | M69293.1 | 2 |
| 2301 | MIOA8360<br>hfcr7439 | interferon regulatory factor 2 (IRF2) | NM_002199.2 | 2 |
| 2302 | hfcr3634<br>ncrc4071 | jun D proto-oncogene (JUND) | NM_005354.1 | 2 |
| 2303 | MIOA2791a<br>SEOB0655a | kaiso (ZNF-kaiso) | gi5803228 | 2 |
| 2304 | SEOA6365<br>SEOA1647a | KRAB domain zinc finger protein (ZFP37) | AF022158 | 2 |
| 2305 | hfcr5969<br>ncr1735 | mel transforming oncogene (derived from cell line NK14)-RAB8 homolog (MEL), mRNA | NM_005370.2 | 2 |
| 2306 | miob1778<br>ncrb5439 | microphthalmia-associated transcription factor (MITF) (=DKFZp586B2217) | NM_000248.1 | 2 |
| 2307 | SEOA3417a<br>FCR5192 | NF-kappa-B transCRiption factor p65 subunit | L19067 | 2 |
| 2308 | SEOA4436a<br>ncr7544 | nuclear factor NF-IL6 | X52560.1 | 2 |
| 2309 | hfcr5956<br>ncrc4907 | nuclear factor of activated T-cells, cytoplasmic 4 (NFATC4) mRNA | NM_004554.1 | 2 |
| 2310 | ncr1204<br>ncrc5443 | promyelocytic leukemia zinc finger protein (PLZF) gene | AF060568 | 2 |
| 2311 | MIOA4770<br>SEOA4870a | putative transCRiption factor, partial | AJ009770 | 2 |
| 2312 | SEOA8952<br>ncrb2874 | RE1-silencing transCRiption factor (REST) | NM_005612.1 | 2 |
| 2313 | ncr5923<br>ncrb0455 | retinoblastoma-binding protein 1; RBP1 (RefSeq aa 4e-48) | NP_002883.1 | 2 |
| 2314 | seob7200<br>miob1252 | retinoblastoma-binding protein 2 (RBBP2) | NM_005056.1 | 2 |
| 2315 | SEOB2011<br>FCR3290 | SEF2-1A protein (SEF2-1A) | M74718.1 | 2 |
| 2316 | ncrb4719<br>ncrb7127 | seven in absentia (Drosophila) homolog 1 (SIAH1) | NM_003031.1 | 2 |
| 2317 | seob7746<br>seob5958 | small zinc finger-like protein (DDP2) | AF150087.1 | 2 |

Figure 6A – EST Names Corresponding to Unique Known Genes of Figure 6

| | | | | |
|---|---|---|---|---|
| 2318 | hfcr0011<br>hfcr4717 | target of myb 1 (TOM1) | AJ006973.1 | 2 |
| 2319 | ncr0377<br>ncrb1317 | TG-interacting factor (TALE family homeobox) (TGIF) (ORF) | NM_003244.1 | 2 |
| 2320 | SEOA2300a<br>ncrc3256 | thyroid hormone receptor-associated protein complex component TRAP150 | AF117756.1 | 2 |
| 2321 | ncr0403<br>ncrb1303 | thyroid receptor interactor trip15 | AF100762.1 | 2 |
| 2322 | SEOA1623a<br>seoa4102an | transCRiption elongation factor A (SII)-like 1 | M99701 | 2 |
| 2323 | FCR2006<br>fcrb1567 | transCRiption factor ETR101 | M62831 | 2 |
| 2324 | hfcr3961<br>hfcr2041 | transcription factor IIB | AF093680 | 2 |
| 2325 | FCR6091<br>fcr1004n | transCRiption factor TFIID subunit TAFII28 | X83928 | 2 |
| 2326 | SEOA2611<br>ncr7753 | transCRiption factor WSTF (=AF084479 Williams-Beuren syndrome deletion transCRipt 9 (WBSCR9)) | AF072810 | 2 |
| 2327 | hfcr7066<br>FCR3843 | zinc finger protein (MAZ) (=KNSL4, MAZ) | M94046.1 | 2 |
| 2328 | MIOA4484a<br>ncr2443 | zinc finger protein (ZFD25) (62% aa) | AB027251 | 2 |
| 2329 | ncrb1663<br>miob4845 | zinc finger protein 137 (ZNF137) | NM_003438.1 | 2 |
| 2330 | FCR6331<br>hfcr6290 | zinc finger protein 261 (ZNF261) (=AB002383 KIAA0385) | gi4827066 | 2 |
| 2331 | seoa4969a<br>mioa0562a | zinc finger protein 264 (ZNF264), mRNA /cds=(363,2246) /gb=NM_003417 /gi=4585642 /ug=Hs.117077 /len=6530 | Hs.117077 | 2 |
| 2332 | SEOA9042<br>seob4271 | zinc finger protein ZNF140-like protein (LOC55828) | NM_018443.1 | 2 |
| 2333 | FCR5259<br>SEOA8595 | zinc-finger DNA-binding protein | D45132 | 2 |
| 2334 | MIOA4738<br>ncr0035 | mago-nashi (Drosophila) homolog, proliferation-associated (MAGOH) and translated products=AF035940 (ORF)= MAGOH | NM_002370.1 | 2 |
| 2335 | SEOB0303<br>FCR2860 | cleavage and polyadenylation specificity factor 73 kDa subunit | AF171877.1 | 2 |
| 2336 | seob6781<br>hfcr5184 | DEAD/H (Asp-Glu-Ala-Asp/His) box polypeptide 1 (DDX1) | NM_004939.1 | 2 |
| 2337 | MIOA8912<br>ncrc6031 | double-stranded RNA-binding nuclear protein NFAR-1 | AF167569.1 | 2 |
| 2338 | MIOA9134<br>MIOA4630a | endonuclease/reverse transCRiptase [Mus musculus] | AAC53542.1 | 2 |

Figure 6A – EST Names Corresponding to Unique Known Genes of Figure 6

| | | | | |
|---|---|---|---|---|
| 2339 | fcrb1053<br>ncrc2696 | M5-14 protein (LOC51300) | NM_016589.1 | 2 |
| 2340 | seob5773<br>seob3645 | nuclear matrix protein NMP200 related to splicing factor PRP19 (NMP200) | NM_014502.1 | 2 |
| 2341 | SEOB3303<br>miob4147 | Nuclear protein SA-2 (=STAG2) | Z75331.1 | 2 |
| 2342 | SEOA0036<br>SOA0060 | nucleic acid binding protein sub2.3 | Z29505 | 2 |
| 2343 | miob4462<br>miob1366 | polyA site DNA | Z24724.1 | 2 |
| 2344 | seob7250<br>SEOA5110a | RNA binding motif protein 6 (RBM6) | NM_005777.1 | 2 |
| 2345 | SEOA0111<br>SEOA8516 | RNA binding motif protein 7 | AF156098.1 | 2 |
| 2346 | SEOB2728<br>SEOA1439a | RNA binding motif protein 8 (RBM8) (=AF161463.1 HSPC114) | gi4826971 | 2 |
| 2347 | SEOA9916<br>ncr3646 | RNA binding protein 15.5 kD | AF155235 | 2 |
| 2348 | SEOB0586<br>seob5115 | RNA helicase II/Gu protein | AF261917.1 | 2 |
| 2349 | miob3823<br>miob0042 | RNA-directed DNA polymerase (EC | pirS21976 | 2 |
| 2350 | seob7237<br>MIOA6596a | small nuclear ribonucleoprotein polypeptide B" (SNRPB2) | NM_003092.1 | 2 |
| 2351 | SEOB2228<br>ncrb8811 | small nuclear RNA (U2) | L37793.1 | 2 |
| 2352 | SEOA2814<br>FCR2047 | SNAP-23 | U55936 | 2 |
| 2353 | miob6598<br>hfcr1051 | splicing factor 3a, subunit 3, 60kD (SF3A3) | NM_006802.1 | 2 |
| 2354 | hfcr7452<br>hfcr6886 | splicing factor arginine/serine-rich 7 (SFRS7) gene | L41887.1 | 2 |
| 2355 | hfcr6770<br>ncr4412 | splicing factor similar to dnaJ (SPF31) | NM_014280.1 | 2 |
| 2356 | hfcr7395<br>ncrc6568 | splicing factor SRp30c gene | U87279.1 | 2 |
| 2357 | hfcr6110<br>ncr2055 | splicing factor, arginine/serine-rich 7 (35kD) (SFRS7), (=9G8 splicing factor) | NM_006276.2 | 2 |
| 2358 | ncr7915<br>ncrb2504 | U2 small nuclear ribonucleoprotein auxiliary factor (U2AF1RS1) | NM_005083.1 | 2 |
| 2359 | SEOA8822<br>ncrc2211 | U4/U6-associated RNA splicing factor (HPRP3P) | NM_004698.1 | 2 |
| 2360 | HFCR3134<br>ncrb3947 | U5 snRNP-associated 102 kDa protein | AF221842.1 | 2 |
| 2361 | SEOA6744<br>MIOA7072a | mitochondrial 12S and 16S rRNA | J01438 | 2 |
| 2362 | MIOA1655a | pre-mRNA cleavage factor I subunit | AJ001810 | 2 |

Figure 6A – EST Names Corresponding to Unique Known Genes of Figure 6

| | | | | |
|---|---|---|---|---|
| 2363 | MIOB1571<br>SEOB0265 | pre-mRNA cleavage factor Im (68kD) (CFIM) (=X67336) | 5901927 | 2 |
| 2364 | miob2987<br>MIOA0905a | pre-mRNA splicing factor SF2p32 | M69039 | 2 |
| 2365 | BFCS0223<br>FCR6386 | RNA polymerase I 40kD subunit | AF047441 | 2 |
| 2366 | ncrb4127<br>FCR5758 | RNA polymerase II transCRiption factor SIII p18 subunit | L42856 | 2 |
| 2367 | HFCR2376<br>ncr7967 | RPB5-mediating protein (RefSeq aa 3e-33) | NP_003787.1 | 2 |
| 2368 | ncrb3381<br>FCR5212 | MN/CA9 | Z54349 | 2 |
| 2369 | FCR7301<br>SEOA4040a | class II invariant gamma-chain | X03340 | 2 |
| 2370 | SEOA2653<br>ncr5789 | COT kinase proto-oncogene | AF133211.1 | 2 |
| 2371 | ncrc3439<br>ncr3045 | EBNA-2 co-activator (100kD) (p100) | NM_014390.1 | 2 |
| 2372 | hfcr9515<br>MIOA7624a | immunogloblin light chain (lambda) (=D80009 KIAA0187) | D87018 | 2 |
| 2373 | MIOA0309<br>seob7207 | immunoglobulin heavy-chain | AB019441.1 | 2 |
| 2374 | ncr1944<br>SEOA8366a | Jk-recombination signal binding protein (RBPJK) (=D14041 H-2K binding factor-2) | L07872 | 2 |
| 2375 | ncrb3320<br>seob5688 | male-specific lethal-3 (Drosophila)-like 1 (MSL3L1) (=DKFZp586J1822) | NM_006800.1 | 2 |
| 2376 | mioa7649a<br>miob6631 | MHC class I HLA-B51 haplotype A2, B27/B51,Cw2/Cw3 | M28205.1 | 2 |
| 2377 | MIOA4978a<br>ncr3975 | MHC class I HLA-Bw62 | M28204.1 | 2 |
| 2378 | SEOA1448a<br>miob0154 | PC326 protein (PC326) | NM_018442.1 | 2 |
| 2379 | ncrc5384<br>MIOA0580a | recombination acitivating protein (RAG2) | M94633 | 2 |
| 2380 | ncrc4389<br>SEOB0192 | strain ECOR 52 rrlD operon | AF053964.1 | 2 |
| 2381 | SEOA2337a<br>hfcr7717 | brain and reproductive organ-expressed (TNFRSF1A modulator) (BRE) | NM_004899.1 | 2 |
| 2382 | ncrc4191<br>hfcr2863 | ALEX3 protein (ALEX3) | NM_016607.1 | 2 |
| 2383 | ncrb3454<br>hfcr2696 | antigen identified by monoclonal antibody Ki-67 (MKI67) | NM_002417.1 | 2 |
| | fcrb0068 | | | |

Figure 6A – EST Names Corresponding to Unique Known Genes of Figure 6

| | | | | |
|---|---|---|---|---|
| 2384 | seob8106<br>SEOB1847 | Centrosome- and Golgi-localized PKN-associated protein (CG-NAP) (=AJ131693.1 AKAP450 protein) | AB019691.1 | 2 |
| 2385 | MIOA7231a<br>MIOB2219 | DnaJ-like protein (Hsj2) | AF055664 | 2 |
| 2386 | miob4157<br>ncr9629 | hepatocellular carcinoma-associated antigen 58 (LOC51230) | NM_016436.1 | 2 |
| 2387 | FCR5415<br>SEOA5477a | MAGE tumor antigen D1 (MAGE-D1) | AF124440.1 | 2 |
| 2388 | ncr7805<br>ncr5552 | modulator recognition factor 2 (MRF-2) | M73837.1 | 2 |
| 2389 | seob5478<br>MIOA9141 | nuclear protein stromal antigen 1 (SA-1) | NM_005862.1 | 2 |
| 2390 | ncr0634<br>ncr1225 | paraneoplastic antigen MA1 (PNMA1) | NM_006029.1 | 2 |
| 2391 | ncr8628<br>ncr5532 | partial CHI3L1 gene for cartilage glycoprotein-39 | AJ251847.1 | 2 |
| 2392 | ncr8711<br>SEOB1853 | stress protein Herp, = KIAA0025 | AB034989 | 2 |
| 2393 | ncrc7123<br>ncrc4970 | sulfotransferase family, cytosolic, 1A, phenol-preferring, member 3 (SULT1A3) | NM_003166.1 | 2 |
| 2394 | ncr3588<br>miob6137 | T-cell activation protein (PGR1) gene | AF116272.1 | 2 |
| 2395 | SEOB0569<br>ncrc6105 | T-cluster binding protein | D64015.1 | 2 |
| 2396 | seob5213<br>seob5972 | Alg5, S. cerevisiae, homolog of (ALG5) (=AF161498.1 HSPC149) | NM_013338.1 | 2 |
| 2397 | ncrb0782<br>ncrc1519 | B-factor, properdin (RefSeq aa 5e-30) | NP_001701.1 | 2 |
| 2398 | FCR3379<br>miob4764 | cytovillin 2 (VIL2) (=X51521 ezrin) | J05021 | 2 |
| 2399 | MIOB2824<br>MIOA1413 | lysosomal sialoglycoprotein | D12676.1 | 2 |
| 2400 | FCR2103<br>ncrb0129 | beta-subunit signal transducing proteins GS/GI (clone 24596) | AF070597 | 2 |
| 2401 | FCR2303<br>fcrb2759 | epithelial membrane protein-3 (=U52101 YMP; U87947 hematopoietic neural membrane protein (HNMP-1) | X94771 | 2 |
| 2402 | SEOA6637a<br>FCR5619 | globin alpha | M69023 | 2 |
| 2403 | SEOA0379<br>BFCS0081 | integral membrane serine protease Seprase | U76833 | 2 |
| 2404 | SEOB1916<br>SEOA4620a | LIM domain only 4 (LMO4) | gi7108354 | 2 |
| 2405 | FCR3006<br>FCR2030 | multispanning membrane protein | U94831 | 2 |

Figure 6A – EST Names Corresponding to Unique Known Genes of Figure 6

| | | | | |
|---|---|---|---|---|
| 2406 | ncrc4413 | PLASMA-CELL MEMBRANE GLYCOPROTEIN PC-1 [INCLUDES: ALKALINE PHOSPHODIESTERASE I; NUCLEOTIDE PYROPHOSPHATASE (NPPASE)] | P22413 | 2 |
| | ncrc7096 | | | |
| 2407 | seob4197 | pM5 protein (PM5) | NM_014287.1 | 2 |
| | ncrc2067 | | | |
| 2408 | seoa7748a | progesterone receptor membrane component 2 (PGRMC2), mRNA /cds=(6,677) /gb=NM_006320 /gi=5453915 /ug=Hs.9071 /len=1874 | Hs.9071 | 2 |
| | mioa7699a | | | |
| 2409 | seob6678 | secretory carrier membrane protein 1 (SCAMP1) | NM_004866.1 | 2 |
| | ncrb6452 | | | |
| 2410 | ncr0046 | Translocase of outer mitochondrial membrane 70 (yeast) homolog A (TOMM70A)(= KIAA0719) | NM_014820.1 | 2 |
| | ncrc5072 | | | |
| 2411 | SEOB1103 | transmembrane glycoprotein (CD44 gene) | AJ251595.1 | 2 |
| | seob7117 | | | |
| 2412 | ncrb0164 | transmembrane protein Jagged 1 (HJ1) | AF028593.1 | 2 |
| | ncrc5395 | | | |
| 2413 | ncr7852 | mutL homolog 1 (RefSeq aa 4e-76) | NP_000240.1 | 2 |
| | ncrc6159 | | | |
| 2414 | SEOB2697 | DNA/RNA-binding protein | U20272.1 | 2 |
| | ncrb6575 | | | |
| 2415 | SEOB0690a | RAD50 | Z75311 | 2 |
| | ncrc1811 | | | |
| 2416 | hfcr4640 | adenylate kinase 1 (hAK1) | AB021871.1 | 2 |
| | hfcr5083 | | | |
| 2417 | MIOA7401a | adenylate kinase 3 alpha (AK3) | AB021870 | 2 |
| | ncrb6151 | | | |
| 2418 | MIOA1296 | C1-inhibitor | X54486 | 2 |
| | MIOA2287a | | | |
| 2419 | ncrb1384 | carbonyl reductase 1 (CBR1) | NM_001757.1 | 2 |
| | FCR5571 | | | |
| 2420 | miob4221 | coagulation factor V (proaccelerin, labile factor) (F5) | NM_000130.1 | 2 |
| | seob5316 | | | |
| 2421 | hfcr9627 | glutathione peroxidase 4 (phospholipid hydroperoxidase) (GPX4) | NM_002085.1 | 2 |
| | fcr7012n | | | |
| 2422 | mioa7717a | glutathione-S-transferase like; glutathione transferase omega (GSTTLp28), mRNA /cds=(9,734) /gb=NM_004832 /gi=4758483 /ug=Hs.11465 /len=793 | Hs.11465 | 2 |
| | cr0027 | | | |
| 2423 | FCR5316 | gp25L2 protein | X90872 | 2 |
| | hfcr2690 | | | |
| 2424 | miob0977 | metallothionein isoform 1R | X97261.1 | 2 |
| | ncrb8242 | | | |
| 2425 | SEOA0575 | MITOCHONDRIAL THIOREDOXIN-DEPENDENT PEROXIDE REDUCTASE PRECURSOR (ANTIOXIDANT PROTEIN 1) (AOP-1) (MER5 PROTEIN HOMOLOG) (HBC189) | spP30048 | 2 |
| | SEOB0060 | | | |

Figure 6A – EST Names Corresponding to Unique Known Genes of Figure 6

| | | | | |
|---|---|---|---|---|
| 2426 | seoa6806<br>ncrc7040 | peroxiredoxin 5 (PRDX5), mRNA /cds=(36,680) /gb=NM_012094 /gi=6912237 /ug=Hs.31731 /len=805 | Hs.31731 | 2 |
| 2427 | ncr8720<br>FCR1367 | thioredoxin-like, 32kD (TXNL) | NM_004786.1 | 2 |
| 2428 | miob5122<br>seob7744 | truncated SON protein (Son) (=AF161430.1 HSPC312) | AF193607.1 | 2 |
| 2429 | FCR1496<br>miob3846 | von Willebrand factor (=X04385) | M10321 | 2 |
| 2430 | hfcr1804<br>hfcr7679 | Arfaptin 2 (partner of RAC1) (POR1) | NM_012402.1 | 2 |
| 2431 | SEOA0064<br>ncrb8419 | Arf-like 2 binding protein BART1 | AF126062.1 | 2 |
| 2432 | FCR0343<br>ncrb4795 | clathrin heavy chain (=D21260 human hypothetical protein (KIAA0034)) | J03583 | 2 |
| 2433 | hfcr6096<br>ncrc1516 | sodium-dependent multivitamin transporter (SMVT) gene, partial cds | AF116241.1 | 2 |
| 2434 | FCR5470<br>ncr7739 | synaptic glycoprotein SC2 spliced variant | AF038958 | 2 |
| 2435 | SEOA8669<br>seob6710 | synaptobrevin-like 1 (SYBL1) | gi5032136 | 2 |
| 2436 | SEOB0523<br>hfcr8373 | ch-TOG protein (=D43948.1 KIAA0097) | X92474.1 | 2 |
| 2437 | ncrc0424<br>ncrc2085 | centrin 3; Saccharomyces cerevisiaeCDC31 homolog; EF-hand protein superfamily member (RefSeq aa 3e-65) | NP_004356.1 | 2 |
| 2438 | MIOA4077a<br>fcrb1260 | CGI-09 protein | AF132943.1 | 2 |
| 2439 | MIOA2013<br>hfcr7077 | CGI-104 protein (=AF078862.1 PTD009) | AF151862.1 | 2 |
| 2440 | SEOA6226<br>miob1762 | CGI-107 protein | AF151865.1 | 2 |
| 2441 | ncr0252<br>ncr2779 | CGI-108 protein (LOC51013) | NM_016046.1 | 2 |
| 2442 | MIOB2714<br>ncr5063 | CGI-132 protein | AF151890.1 | 2 |
| 2443 | SEOA1392<br>ncr3407 | CGI-141 protein | AF151899.1 | 2 |
| 2444 | MIOA2413a<br>ncrb1800 | CGI-30 protein (=Z49907 c.elegans diphthine synthase) | AF132964.1 | 2 |
| 2445 | seob6628<br>miob3198 | CGI-60 protein (LOC51626), | NM_016008.1 | 2 |
| 2446 | seob7890<br>seob8243 | CGI-61 protein | AF151819.1 | 2 |
| 2447 | ncrb7561<br>ncrc9815 | CGI-72 protein (RefSeq aa 2e-90) | NP_057102.1 | 2 |
| 2448 | ncr1780 | CGI-75 protein (RefSeq aa 4e-57) | NP_057104.1 | 2 |

Figure 6A – EST Names Corresponding to Unique Known Genes of Figure 6

| | | | | |
|---|---|---|---|---|
| | ncrc3211 | | | |
| 2449 | SEOA7157a<br>miob2882 | CGI-81 protein | AF151839.1 | 2 |
| 2450 | SEOA3847<br>seob4715 | CGI-82 protein | AF151840.1 | 2 |
| 2451 | seob4126<br>hfcr1699 | CGI-83 protein (LOC51110) | NM_016027.1 | 2 |
| 2452 | miob4838<br>MIOB2573 | CGI-97 protein | AF151855.1 | 2 |
| 2453 | SEOA2859<br>SEOA6512a | cytoplasmic dynein intermediate chain 2 (Dncic2) | AF063231 | 2 |
| 2454 | hfcr0918<br>hfcr3886 | cytoplasmic intermediate filament protein | AJ004935.1 | 2 |
| 2455 | SEOB3464<br>SEOA6512a | Dynein intermediate chain 2, cytosolic (dh ic-2) (cytoplasmic dynein intermediate chain 2) | spO88487 | 2 |
| 2456 | seob6257<br>hfcr8929 | golgin-like protein(GLP) gene (=U61167.1 SH3 domain-containing protein SH3P18) | AF266285.1 | 2 |
| 2457 | fcrb1327<br>fcr3108 | kinesin family member 4 (KIF4), mRNA | NM_012310.2 | 2 |
| 2458 | hfcr8804<br>ncrb4899 | microtubule-associated protein 1a (MAP1A) | U38292.1 | 2 |
| 2459 | MIOA5468a<br>FCR2190 | MICROTUBULE-ASSOCIATED PROTEIN 1B [CONTAINS: MAP1 LIGHT CHAIN LC1] | P46821 | 2 |
| 2460 | hfcr5244<br>hfcr0515 | NC2 alpha | X96506.1 | 2 |
| 2461 | SEOA7935a<br>MIOA8153 | Norrie disease protein (NDP) | X65882 | 2 |
| 2462 | hfcr7437<br>hfcr0593 | collagen-binding protein 2 (collagen 2) (CBP2) | NM_001235.1 | 2 |
| 2463 | SEOA4400a<br>SEOA8552 | entactin | X14194 | 2 |
| 2464 | seob3869<br>hfcr8506 | epsilon-sarcoglycan | AJ000534.1 | 2 |
| 2465 | SEOA5396<br>ncrb4485 | hematopoetic proteoglycan core protein (=M90058 serglycin) | X17042 | 2 |
| 2466 | MIOA3572a<br>SEOA6243 | osteonidogen (=AJ223500 nidogen-2) | D86425 | 2 |
| 2467 | hfcr6245<br>hfcr0908 | STIP1 homology and U-Box containing protein 1 (STUB1) | NM_005861.1 | 2 |
| 2468 | SEOA5366<br>SEOA5093a | tenascin | X56160 | 2 |
| 2469 | seob6133<br>seob5439 | lymphocyte cytosolic protein 1 (L-plastin) (LCP1) | NM_002298.2 | 2 |
| 2470 | MIOA8740<br>SEOA0184a | actin binding protein MAYVEN | AF059569.1 | 2 |
| 2471 | MIOA2072<br>MIOA2339a | actin depolymerizing factor | S65738 | 2 |

Figure 6A – EST Names Corresponding to Unique Known Genes of Figure 6

| | | | | |
|---|---|---|---|---|
| 2472 | MIOA1494<br>SEOA6869 | adapter protein CMS | AF146277.1 | 2 |
| 2473 | BFCS0384<br>mioa7897 | alpha-actinin-2 associated LIM protein | AF002282 | 2 |
| 2474 | MIOA5202a<br>miob2289n | CRystallin, zeta (quinone reductase)-like 1 (CRYZL1) | NM_005111.1 | 2 |
| 2475 | FCR4460<br>miob0994 | cytoplasmic dynein heavy chain (=AB002323 Human KIAA0325;L08505) | D13896 | 2 |
| 2476 | MIOA3672a<br>miob2422 | gamma adducin | Y14379.1 | 2 |
| 2477 | MIOA1287<br>SEOA9502 | keratin 18 (K18) | M24842 | 2 |
| 2478 | ncr0267<br>mioa9910 | plakophilin 2b (ORF) | X97675 | 2 |
| 2479 | FCR6928<br>FCR6963 | profilin | J03191 | 2 |
| 2480 | ncr3233<br>ncr6970 | utrophin (homologous to dystrophin) (UTRN) | NM_007124.1 | 2 |
| 2481 | seoa6829<br>fcrb2166 | actin related protein 2/3 complex, subunit 3 (21 kD) (ARPC3), mRNA /cds=(25,561) /gb=NM_005719 /gi=5031596 /ug=Hs.6895 /len=840 | Hs.6895 | 2 |
| 2482 | ncr2723<br>SEOB0856a | muscle-specific protein (LOC51778) | NM_016599.1 | 2 |
| 2483 | SEOB1001<br>SEOB3377 | myosin X (MYO10) | AF247457.1 | 2 |
| 2484 | fcrb2749<br>fcrb2175 | myosin, heavy polypeptide 3, skeletal muscle, embryonic (MYH3), mRNA | XM_052579.2 | 2 |
| 2485 | SEOA5898<br>MIOA6108a | myotubularin related protein 6 | AF072928 | 2 |
| 2486 | ncr3404<br>ncrc2227 | integral inner nuclear | NM_014319.2 | 2 |
| 2487 | fcrb2162<br>fcrb1430 | lamin A/C (LMNA) | XM_044160.1 | 2 |
| 2488 | SEOA5235a<br>mioa5651n | nucleoporin p54 | U63840 | 2 |
| 2489 | SEOA1097a<br>FCR0817 | plectin (PLEC1) | U63610 | 2 |
| 2490 | hfcr6486<br>hfcr8161 | aryl hydrocarbon receptor-interacting protein (AIP) | NM_003977.1 | 2 |
| 2491 | MIOA6418a<br>hfcr6533 | Toll-like receptor 2 (TLR2) mRNA, (ORF) | U88878 | 2 |
| 2492 | SEOA7129a<br>ncrb3220 | Toll-like receptor 4 (TLR4) | U88880 | 2 |
| 2493 | SEOA3375a<br>MIOA2252a | B219/OB receptor isoform HuB219.1 | U52912 | 2 |
| 2494 | seob6683<br>fcrb2017 | bone morphogenetic protein receptor, type IA (BMPR1A) | NM_004329.1 | 2 |
| 2495 | MIOA5533a | Ets transCRiption factor (NERF-2) | U43188 | 2 |

Figure 6A – EST Names Corresponding to Unique Known Genes of Figure 6

| | | | | |
|---|---|---|---|---|
| | MIOA5197a | | | |
| 2496 | SEOA2892a | Fc-gamma-receptor IIIB (FCGR3B) | M90746 | 2 |
| | SEOA9950 | | | |
| 2497 | SEOB3009 | G protein gamma 5 subunit | AF038955.1 | 2 |
| | ncrc6024 | | | |
| 2498 | SEOB1617 | G protein-coupled receptor 69A (GPR69A) (=p40) | NM_006055.1 | 2 |
| | mioa9466 | | | |
| 2499 | MIOA6476a | histamine N-methyltransferase(HNMT) | U08092 | 2 |
| | ncrb7099 | | | |
| 2500 | miob6771 | h-ryk | X69970.1 | 2 |
| | SEOB3106 | | | |
| 2501 | ncr0194 | interferon gamma receptor 1 (IFNGR1) (ORF) | NM_000416.1 | 2 |
| | ncrb7034 | | | |
| 2502 | FCR6623 | interferon gamma receptor accessory factor-1 (AF-1) (clone pJS3) | U05877 | 2 |
| | FCR3690 | | | |
| 2503 | ncr8686 | interleukin 16 (IL16) | AF077011 | 2 |
| | ncrc4704 | | | |
| 2504 | ncrb0581 | mannose receptor, C type 1 (MRC1) | NM_002438.1 | 2 |
| | ncrc9412 | | | |
| 2505 | seob7409 | nuclear receptor coactivator 3 (NCOA3) | NM_006534.1 | 2 |
| | FCR4981 | | | |
| 2506 | ncr2508 | nuclear receptor co-repressor 1 (NCOR1) | NM_006311.1 | 2 |
| | ncr8224 | | | |
| 2507 | ncrb2938 | nuclear receptor subfamily 4, group A, member 2 (NR4A2) | NM_006186.1 | 2 |
| | ncrc2485 | | | |
| 2508 | hfcr2030 | nuclear RNA helicase, DECD variant of DEAD box family (DDXL) | NM_005804.1 | 2 |
| | hfcr3753 | | | |
| 2509 | seob5240 | PAR3 (PAR3) | AF252293.1 | 2 |
| | hfcr6118 | | | |
| 2510 | hfcr0484 | peripheral benzodiazepine receptor-associated protein 1 (PRAX-1) mRNA | NM_004758.1 | 2 |
| | CR0724 | | | |
| 2511 | FCR3287 | platelet-derived growth factor A chain (PDGFA) (=X06374) | M83575 | 2 |
| | ncr9016 | | | |
| 2512 | ncr7097 | PMEPA1 protein (PMEPA1) | NM_020182.1 | 2 |
| | ncrb2398 | | | |
| 2513 | FCR4308 | retinoic acid-binding protein II (CRABP-II) (=M68867) | M97814 | 2 |
| | FCR4490 | | | |
| 2514 | seob7529 | RYK tyrosine kinase | S59184.1 | 2 |
| | mioa9873 | | | |
| 2515 | FCR6340 | TRIP6 (thyroid receptor interacting protein) (=AF025437 Opa-interacting protein OIP1; AF000974 zyxin related protein ZRP-1) | AJ001902 | 2 |
| | hfcr1265 | | | |
| 2516 | hfcr9547 | v-jun avian sarcoma virus 17 oncogene homolog (JUN), (=c-jun proto oncogene (JUN ) | NM_002228.2 | 2 |
| | ncr1559 | | | |

Figure 6A – EST Names Corresponding to Unique Known Genes of Figure 6

| | | | | |
|---|---|---|---|---|
| 2517 | hfcr8429<br>hfcr9184 | xenotropic and polytropic murine leukemia virus receptor (X3) | AF089744.1 | 2 |
| 2518 | SEOA5520a<br>SEOA0133 | 14-3-3 protein, a protein kinase regulator | X56468 | 2 |
| 2519 | miob4401<br>MIOA8767 | bifunctional ATP sulfurylase/adenosine 5'-phosphosulfate kinase | AF033026.1 | 2 |
| 2520 | SEOA1117a<br>seob8082 | calmodulin-dependent protein phosphatase catalytic subunit (PPP3CA) (=J05480) | L14778 | 2 |
| 2521 | FCR1020<br>hfcr1907 | ERK activator kinase (MEK2) | L11285 | 2 |
| 2522 | MIOA2536a<br>MIOA7350a | mitogen-responsive phosphoprotein DOC-2 | U53446 | 2 |
| 2523 | hfcr2504<br>SEOB0716a | protein kinase C, mu (PRKCM) | NM_002742.1 | 2 |
| 2524 | MIOA7629a<br>ncrc0777 | serine-threonine protein kinase (MNBH) | AF108830.1 | 2 |
| 2525 | MIOA1388a<br>MIOA4718 | cAMP-specific phosphodiesterase 8B (PDE8B) | AF079529 | 2 |
| 2526 | SEOA7354a<br>SEOA3811a | cGMP phosphodiesterase | X62695 | 2 |
| 2527 | ncr5719<br>ncrb8573 | monoamine oxidase B (MAOB) | NM_000898.1 | 2 |
| 2528 | miob4055<br>ncrc3623 | A kinase (PRKA) anchor protein 2 (AKAP2)(= KIAA0920) | NM_007203.1 | 2 |
| 2529 | mioa9831<br>ncr1528 | associated molecule with the SH3 domain of STAM (AMSH) mRNA | NM_006463.1 | 2 |
| 2530 | SEOA1580a<br>FCR0061n | adenomatosis polyposis coli (APC) | gi4557318 | 2 |
| 2531 | hfcr9134<br>CR0533 | breakpoint cluster region (BCR) gene | U07000.1 | 2 |
| 2532 | ncr3432<br>miob3609 | brefeldin A-inhibited | NM_006421.2 | 2 |
| 2533 | ncrb7350<br>ncrc9311 | dexamethasone-induced ras-related protein 1 (DEXRAS1) gene, (=activator of G protein signaling (AGS1)) | AF262018.1 | 2 |
| 2534 | SEOA6033a<br>ncr0156 | guanine nucleotide exchange factor p532 | U50078 | 2 |
| 2535 | SEOB0885a<br>SEOA8447 | GUANINE NUCLEOTIDE-BINDING PROTEIN BETA SUBUNIT-LIKE PROTEIN 12.3 (P205) (RECEPTOR OF ACTIVATED PROTEIN KINASE C 1) (RACK1) | spP25388 | 2 |
| 2536 | MIOA3963a<br>SEOB3569 | low-Mr GTP-binding protein (RAB32) | U59878 | 2 |
| 2537 | SEOA3516a<br>SEOA7367a | MAD-3 (IkB-like activity) | M69043 | 2 |

Figure 6A – EST Names Corresponding to Unique Known Genes of Figure 6

| | | | | |
|---|---|---|---|---|
| 2538 | ncr6920<br>SEOA9931 | N-acetylneuraminic acid phosphate synthase; sialic acid synthase (SAS) | NM_018946.1 | 2 |
| 2539 | seob2303<br>ncrc6817 | nucleolar GTPase (HUMAUANTIG) | NM_013285.1 | 2 |
| 2540 | ncr3262<br>ncrb6174 | Rab5-interacting protein | AF112213.1 | 2 |
| 2541 | FCR0990<br>ncrc5553 | Rab9 effector p40 | Z97074 | 2 |
| 2542 | SEOB2642<br>FCR6495 | Ran_GTP binding protein 5 | Y08890.1 | 2 |
| 2543 | fcrb2722<br>ncrc2963 | Ras suppressor protein 1(RSU1),(= RSU-1/RSP-1 mRNA) | NM_012425.2 | 2 |
| 2544 | hfcr2535<br>hfcr6117 | Rho guanine nucleotide exchange factor (GEF) 1 (ARHGEF1) | NM_004706.1 | 2 |
| 2545 | ncr0266<br>FCR0935N | Rho guanine nucleotide-exchange factor, splice variant NET1A | AJ010045.1 | 2 |
| 2546 | miob3696<br>ncr5724 | Rho-associated, coiled-coil containing protein kinase 1 (ROCK1) | NM_005406.1 | 2 |
| 2547 | MIOA3548a<br>ncrb8356 | SH3 binding protein | AB005047 | 2 |
| 2548 | seob5551<br>ncrc5501 | SH3-domain binding protein 5 (BTK-associated) (SH3BP5) (=DKFZp434H068) | NM_004844.1 | 2 |
| 2549 | miob3531<br>miob6377 | signal transducing adaptor molecule (SH3 domain and ITAM motif) 1 (STAM) | NM_003473.1 | 2 |
| 2550 | ncr0924<br>ncrb4316 | small GTP-binding protein rab22b | AF183421.1 | 2 |
| 2551 | miob3456<br>ncrc0958 | Src-like-adapter (SLA) | NM_006748.1 | 2 |
| 2552 | FCR2541<br>fcrb2643 | adrenal specific pG2 (=U15981 dlk) | X17544 | 2 |
| 2553 | SEOB2979<br>FCR0918 | novel antagonist of FGF signaling (sprouty-1) | AF041037.1 | 2 |
| 2554 | SEOA0539n<br>MIOB2564 | abundant in neuroepithelium area (BTG3) (=D64110 ANA) | gi5802989 | 2 |
| 2555 | ncr0775<br>ncr1148 | bone morphogenetic protein 5 (BMP5) | NM_021073.1 | 2 |
| 2556 | ncrb5631<br>ncrc1178 | bone morphogenetic protein-3b gene | D49493.1 | 2 |
| 2557 | FCR2195<br>seoa8133 | follistatin | M19480 | 2 |
| 2558 | SEOA5494a<br>SOA0678 | glioblastoma amplified sequence (GBAS) | AF029786 | 2 |
| 2559 | seob6089<br>ncrb6144 | growth associated protein 43 (GAP43) | NM_002045.1 | 2 |

Figure 6A – EST Names Corresponding to Unique Known Genes of Figure 6

| | | | | |
|---|---|---|---|---|
| 2560 | SEOA2978a<br>ncrc5679 | hepatocyte growth factor activator inhibitor type 2 (=AF027205 Kunitz-type protease inhibitor (kop)) | AB006534 | 2 |
| 2561 | SEOA7369a<br>FCR0863 | hepatoma-derived growth factor | D16431 | 2 |
| 2562 | seob7039<br>hfcr0241 | high-risk human papilloma viruses E6 oncoproteins targeted protein E6TP1 alpha (=AB007900 KIAA0440) | AF090989.1 | 2 |
| 2563 | SEOA7442a<br>SEOA5095a | interferon-gamma | U10360 | 2 |
| 2564 | seob7184<br>MIOA8693 | macrophage-specific colony-stimulating factor (CSF-1) | M37435.1 | 2 |
| 2565 | FCR7004<br>fcrb0384 | midkine (neurite growth-promoting factor 2) (MDK) (=X55110 neurite outgrowth-promoting protein) | gi4505134 | 2 |
| 2566 | MIOA4271<br>SEOA4204a | monocyte chemotactic protein-3 (MCP-3) | X72308 | 2 |
| 2567 | MIOA2774a<br>FCR3540 | neuromedin B | M21551 | 2 |
| 2568 | ncr3963<br>hfcr3605 | p8 protein (candidate of metastasis 1) (P8) | NM_012385.1 | 2 |
| 2569 | ncr8995<br>ncrc5580 | polydom protein | AAG32160.1 | 2 |
| 2570 | ncr2792<br>ncrb5813 | SKI-INTERACTING PROTEIN (RefSeq aa 7e-55) | NP_036377.1 | 2 |
| 2571 | ncr3869<br>hfcr2529 | uncharacterized bone marrow protein BM042 (BM042) (=DKFZp761A1124) | NM_018458.1 | 2 |
| 2572 | hfcr6211<br>ncr4667 | cullin 5 (CUL5) | NM_003478.1 | 2 |
| 2573 | hfcr9846<br>ncrc5099 | ADP-ribosylation factor 6 (ARF6) | NM_001663.2 | 2 |
| 2574 | seob7404<br>ncrb7225 | ADP-ribosylation factor domain protein 1, 64kD (ARFD1) | NM_001656.1 | 2 |
| 2575 | SEOA4023a<br>SEOA5557a | ADP-ribosylation factor[arf]-directed GTPase activating protein (ASAP1) (=AB007860 KIAA0400) | gi4502248 | 2 |
| 2576 | seob5454<br>SEOA8761 | ADP-ribosylation factor-like 3 (ARL3) | NM_004311.1 | 2 |
| 2577 | miob4760<br>SEOA6019a | calcyclin binding protein | AF057356.1 | 2 |
| 2578 | SEOB3067<br>ncr6116 | FE65-like protein (hFE65L) | U62325.1 | 2 |
| 2579 | FCR3754<br>FCR6350 | hepatocyte growth factor-like protein homolog (low match) | U28055 | 2 |
| 2580 | SEOA5490a<br>SEOA1443a | monocyte/neutrophil elastase inhibitor | AF053630 | 2 |
| 2581 | FCR3033 | poly (ADP-ribose) polymerase (=J03473; M29786) | M18112 | 2 |

Figure 6A – EST Names Corresponding to Unique Known Genes of Figure 6

| | | | | |
|---|---|---|---|---|
| | FCR4760 | | | |
| 2582 | hfcr7146 | chloride channel nucleotide-sensitive, 1A (CLNS1A) | NM_001293.1 | 2 |
| | ncr7893 | | | |
| 2583 | miob6677 | ecotropic viral integration site 5 (EVI5) | NM_005665.1 | 2 |
| | seob6122 | | | |
| 2584 | FCR1608 | JTV-1 (JTV-1) | U24169 | 2 |
| | ncrc2007 | | | |
| 2585 | FCR5663 | membrane protein, type II clone:HP10390 | AB015631.1 | 2 |
| | FCR7710 | | | |
| 2586 | FCR5800 | membrane protein-like protein | U21556 | 2 |
| | ncr5960 | | | |
| 2587 | SEOA4461a | potassium voltage-gated channel, delayed-rectifier, subfamily S, member 3 (KCNS3)=AF043472 Shab-related delayed-rectifier K channel alpha subunit | NM_002252.1 | 2 |
| | miob3803 | | | |
| 2588 | hfcr2601 | stomatin-like protein 2 (SLP-2) | NM_013442.1 | 2 |
| | MIOA9010 | | | |
| 2589 | SEOA3717a | voltage-dependent anion channel isoform 2 (VDAC2) | AF152227.1 | 2 |
| | hfcr1867 | | | |
| 2590 | SEOA0114 | MacMarcks | X70326 | 2 |
| | hfcr9595 | | | |
| 2591 | MIOA3795 | mast cell carboxypeptidase A | M27717 | 2 |
| | ncrc4531 | | | |
| 2592 | SEOA0956 | cell adhesion protein (vitronectin) receptor alpha subunit | M14648 | 2 |
| | SEOA1525 | | | |
| 2593 | SEOB1362 | goliath protein | AF155650.1 | 2 |
| | ncr2883 | | | |
| 2594 | ncrb3880 | integrin alpha-11 subunit precursor (ITGA11) | AF109681.1 | 2 |
| | hfcr0506 | | | |
| 2595 | seob5976 | integrin, alpha V(vitronectin receptor, alpha polypeptide, antigen CD51)(ITGAV) | NM_002210.1 | 2 |
| | MIOA8308 | | | |
| 2596 | MIOA3940a | platelet/endothelial cell adhesion molecule-1 (PECAM-1) | L34657 | 2 |
| | ncr2928 | | | |
| 2597 | hfcr1210 | protocadherin 43 gene | AF119570 | 2 |
| | hfcr9914 | | | |
| 2598 | hfcr0358 | TRAF and TNF receptor associated protein (ttrap gene) | AJ269473.1 | 2 |
| | ncrc0203 | | | |
| 2599 | fcrb0662 | chromodomain helicase DNA binding protein 4 (CHD4) | NM_001273.1 | 2 |
| | ncrc1452 | | | |
| 2600 | SEOA4640a | chromodomain protein, Y chromosome-like (CDYL) =AF081259 | NM_004824.1 | 2 |
| | MIOA3378a | | | |
| 2601 | seob5523 | chromosome-associated polypeptide C (CAP-C) (=DKFZp434F205) | NM_005496.1 | 2 |
| | ncrb8661 | | | |
| 2602 | hfcr3821 | Gu protein = PC6010 RNA helicase Gu | U41387.1 | 2 |
| | ncrc3248 | | | |

Figure 6A – EST Names Corresponding to Unique Known Genes of Figure 6

| | | | | |
|---|---|---|---|---|
| 2603 | ncr0451<br>ncr1415 | histone acetyltransferase (HBOA) | NM_007067.1 | 2 |
| 2604 | mioa9555<br>ncr1415 | histone acetyltransferase (MORF), (ORF) | NM_012330.1 | 2 |
| 2605 | SEOA5580a<br>SEOA6157a | histone deacetylase 2 (HDAC2) (=U31814 transCRiptional regulator homologue RPD3) | gi4557640 | 2 |
| 2606 | FCR1473<br>FCR6859 | histone maCRoH2A1.2 | AF054174 | 2 |
| 2607 | fcrb1689<br>fcrb1558 | non-histone chromatin protein HMG1 (HMG1) gene | U51677.1 | 2 |
| 2608 | SEOB2283<br>ncrc2847 | SCG10 like-protein, helicase-like protein NHL, M68, and ADP-ribosylation factor related protein 1 (ARFRP1) genes, complete cds | AF217796.1 | 2 |
| 2609 | ncrb2798<br>ncrb8542 | telomerase binding protein p23 (LOC56351) | NM_019766.1 | 2 |
| 2610 | seob6696<br>ncr6088 | menage a trois 1 (CAK assembly factor) (MNAT1) = X92669.1 p35, cyclin-like CAK1-associated protein(ORF) | NM_002431.1 | 2 |
| 2611 | hfcr5905<br>ncrc3345 | camptothecin resistant clone CEM/C2 DNA topoisomerase I mRNA, partial cds | U07806.1 | 2 |
| 2612 | FCR6395<br>ncr7669 | cdc14 homologue | AF000367 | 2 |
| 2613 | SEOB0752<br>seoa7696a | CDC28 protein kinase 2 (CKS2) | 4502858 | 2 |
| 2614 | hfcr6613<br>FCR5881 | cell cycle protein (PA2G4) gene | AF104670.1 | 2 |
| 2615 | hfcr4741<br>hfcr9178 | cell division cycle 20, S.cerevisiae homolog (CDC20) | NM_001255.1 | 2 |
| 2616 | miob3313<br>MIOA9096 | cullin 2 (CUL2) | AF126404.1 | 2 |
| 2617 | ncr3172<br>ncr2556 | dedicator of cytokinesis 1 (DOCK1) | NM_001380.1 | 2 |
| 2618 | miob0050<br>ncrc0545 | DNA for (CGG)n trinucleotide repeat region, isolate E7 | AJ001216.1 | 2 |
| 2619 | fcrb1788<br>ncrb8763 | G1 to S phase transition 1 (GSPT1) | XM_055673.1 | 2 |
| 2620 | hfcr6829<br>hfcr9596 | growth arrest-specific 6 (GAS6) | NM_000820.1 | 2 |
| 2621 | MIOB2293<br>hfcr6829 | growth arrest-specific 7 (GAS7), transCRipt variant b | 5360211 | 2 |
| 2622 | MIOA9062<br>SEOA6398 | GTP-binding protein RAB21 (RAB21) = KIAA0118 | AF091035 | 2 |
| 2623 | FCR5023<br>hfcr9101 | MAC30 | L19183 | 2 |
| 2624 | SEOA6152a<br>BFCS0302 | rhoB | M74295 | 2 |
| 2625 | MIOA8239 | Topoisomerase I | CAA18536.1 | 2 |

Figure 6A – EST Names Corresponding to Unique Known Genes of Figure 6

| | | | |
|---|---|---|---|
| ncrc1460 | | | |
| 2626 FCR5707 | X-linked nuclear protein (ATRX) | AF000160 | 2 |
| FCR5704 | | | |
| 2627 SEOB1720 | API5-like 1 (API5L1) | NM_006595.1 | 2 |
| ncr2404 | | | |
| 2628 hfcr9982 | beclin 1 (BECN1)mRNA, (=beclin 1 (coiled-coil, myosin-like BCL2-interacting protein) (BECN1))( =GT197 partial ORF) | AF139131.1 | 2 |
| SEOA9079 | | | |
| 2629 SEOA5387 | BNIP3L | AB004788.1 | 2 |
| SEOB1998 | | | |
| 2630 ncrb5704 | CASP8 associated protein 2 (RefSeq aa 2e-87) | NP_036247.1 | 2 |
| fcrb2400 | | | |
| 2631 miob6721 | CED-6 protein (CED-6) | NM_016315.1 | 2 |
| ncrc9794 | | | |
| 2632 SEOB0294 | dual-specificity protein phosphatase | U15932.1 | 2 |
| ncr2473 | | | |
| 2633 MIOA1294n | neuronal apoptosis inhibitory protein | U19251 | 2 |
| SEOB0418 | | | |
| 2634 miob5878 | NOD1 protein (NOD1) gene | AF149773.1 | 2 |
| miob5958 | | | |
| 2635 hfcr6747 | programmed cell death 6 (PDCD6) | NM_013232.1 | 2 |
| ncr8007 | | | |
| 2636 FCR2729 | 45kDa splicing factor | AF083384 | 2 |
| FCR4489 | | | |
| 2637 hfcr6849 | KH-type splicing regulatory protein (KHSRP) | NM_003685.1 | 2 |
| fcrb1648 | | | |
| 2638 seoa6797 | polymerase (DNA-directed) kappa (POLK), mRNA /cds=(172,2784) /gb=NM_016218 /gi=7705343 /ug=Hs.135756 /len=4074 | Hs.135756 | 2 |
| ncrc2394 | | | |
| 2639 hfcr2821 | polymerase (RNA) II (DNA directed) polypeptide J (13.3kD) (POLR2J) | NM_006234.1 | 2 |
| hfcr8656 | | | |
| 2640 seob6131 | Replication factor C (activator 1) 4 (37kD) | NM_002916.1 | 2 |
| ncrc9255 | | | |
| 2641 ncrb4843 | replication protein A1 (70kD) (RPA1) | NM_002945.1 | 2 |
| ncrb7041 | | | |
| 2642 ncr0673 | replication protein A2 (32kD)(RPA2) | NM_002946.1 | 2 |
| hfcr4151 | | | |
| 2643 seob4816 | anaphase-promoting complex subunit 4 (APC4) | NM_013367.1 | 2 |
| seoa7822a | | | |
| 2644 hfcr5827 | cell division control protein 16 (CDC16) mRNA, complete cds | AF164598.1 | 2 |
| SEOB0703a | | | |
| 2645 MIOA3354a | cysteine and glycine-rich protein 2 (CSRP2) (contains Alu repeat) | U95018 | 2 |
| hfcr6154 | | | |
| 2646 ncr4140 | Notch2-like (Notch2l) | NM_008715.1 | 2 |
| ncrb1861 | | | |
| 2647 ncr3284 | p53 regulated PA26 nuclear protein (PA26) | NM_014454.1 | 2 |
| miob1079n | | | |

Figure 6A – EST Names Corresponding to Unique Known Genes of Figure 6

| | | | | |
|---|---|---|---|---|
| 2648 | SEOB0376<br>SEOB0439 | proto-oncogene (Wnt-5a) | L20681.1 | 2 |
| 2649 | ncrc8863<br>ncrc1788 | Pro-X carboxypeptidase precursor (RefSeq aa 7e-49) | NP_005031.1 | 2 |
| 2650 | FCR1478<br>hfcr7027 | ras inhibitor | M37190 | 2 |
| 2651 | FCR5975<br>FCR1045 | SEPTIN 2 HOMOLOGUE (SEP2) | Q14141 | 2 |
| 2652 | SEOA9150<br>ncrc4313 | tumor antigen SLP-8p (HCC8)= AF102177.1(ORF) | NM_016516.1 | 2 |
| 2653 | ncr1526<br>ncr9117 | tumor differentially expressed 1 (RefSeq aa 1e-77) | NP_006802.1 | 2 |
| 2654 | seob8160<br>miob3900 | tumor necrosis factor alpha-induced protein 6 (TNFAIP6) | NM_007115.1 | 2 |
| 2655 | FCR0652N<br>MIOA3725a | tumor neCRosis factor receptor | M58286 | 2 |
| 2656 | seob3697<br>seob5604 | tumor necrosis factor(ligand) superfamily, member 10 (TNFSF10) mRNA | NM_003810.1 | 2 |
| 2657 | miob2918<br>ncrb2024 | tumor protein D52 (TPD52)(= N8=tumor expression-enhanced gene)(= 19.8 kDa protein) | NM_005079.1 | 2 |
| 2658 | FCR7689<br>ncrb5384 | tumor suppressor protein (101F6), putative | AF040704 | 2 |
| 2659 | SEOA1856a<br>FCR6807 | tumor susceptiblity protein (TSG101) | U82130 | 2 |
| 2660 | ncr2293<br>fcrb2524 | integral type I protein | NM_007364.1 | 2 |
| 2661 | ncrc7137<br>hfcr0732 | musculus DnaJ-like protein 1 (Dnajl1) | NM_007869.1 | 2 |
| 2662 | FCR4433<br>MIOA4076a | PROBABLE ARP2/3 COMPLEX 20 KD SUBUNIT (P20-ARC) | spQ18491 | 2 |
| 2663 | miob6228 | protein kinase NY-REN-64 antigen (LOC51135) | NM_016123.1 | 2 |
| 2664 | ncrc0836<br>seob2299 | semipalmatus 18S ribosomal RNA gene, complete sequence | AF173638.1 | 2 |
| 2665 | FCR2054<br>FCR3701 | 19 kDa subunit of NADH (complex I) | X59697 | 2 |
| 2666 | hfcr5611<br>mioa1118m | proteasome (prosome macropain) activator subunit 2 (PA28 beta) (PSME2) | NM_002818.1 | 2 |
| 2667 | FCR6057<br>MIOA1687a | proteasome subunit p45 26S | D44467 | 2 |
| 2668 | ncrc8935<br>seob5743 | F-box only protein 2 (FBXO2) | NM_012168.1 | 2 |
| 2669 | ncr7178<br>ncrc6595 | ubiquitin specific protease | NM_004505.1 | 2 |
| 2670 | FCR4238 | transCRiption factor ZFM1 (=L49380;L49345;Y08765 splicing factor SF1-hl1)) | D26120 | 2 |

Figure 6A – EST Names Corresponding to Unique Known Genes of Figure 6

| | | | | |
|---|---|---|---|---|
| | MIOA1370a | | | |
| 2671 | ncrb8142 | RNA for Golgi protein (GPP34 gene) | AJ296152.1 | 2 |
| | ncrb0460 | | | |
| 2672 | miob4144 | dnchc2 cytoplasmic dynein heavy chain | AB041881.1 | 2 |
| | miob0994 | | | |
| 2673 | ncrb8693 | kinesin family member 3B (KIF3B) (=KIAA0359) | NM_004798.1 | 2 |
| | SEOA6930 | | | |
| 2674 | MIOA4667a | CAK1 mRNA for Cdk-activating kinase=cyclin-dependent kinase 7=X77743 | X77303 | 2 |
| | MIOA5773a | | | |
| 2675 | MIOA6673a | guanylate binding protein isoform I (GBP-2) | M55542 | 2 |
| | miob4524 | | | |
| 2676 | SEOA8511 | CYTOCHROME C OXIDASE POLYPEPTIDE VIC PRECURSOR | P09669 | 2 |
| | SEOA8951 | | | |
| 2677 | miob6128 | solute carrier family 16 (monocarboxylic acid transporters), member 7 (SLC16A7) | NM_004731.1 | 2 |
| | SOA0356 | | | |
| 2678 | ncr1658 | eukaryotic translation initiation factor 4B (EIF4B) | NM_001417.1 | 1 |
| 2679 | SEOA6732 | mitogen inducible gene mig-2 | Z24725 | 1 |
| 2680 | SEOA4716a | metallothionein | X97260 | 1 |
| 2681 | FCR0211 | nucleoplasmin-3 (NPM3) | AF081280 | 1 |
| 2682 | SEOA8232 | ATP SYNTHASE COUPLING FACTOR 6, MITOCHONDRIAL PRECURSOR (F6) | spP18859 | 1 |
| 2683 | FCR5354 | cytochrome c oxidase COX subunit IV (COX IV) | M21575 | 1 |
| 2684 | SEOB0483 | aminopeptidase PILS (APPILS) | AF183569.1 | 1 |
| 2685 | hfcr9312 | heat shock protein, DNAJ-like 2 (HSJ2) | NM_001539.1 | 1 |
| 2686 | FCR1079 | cytochrome P450 (CYP1A2) | M31667 | 1 |
| 2687 | SEOA2819 | integral membrane protein Tmp21-I (p23) | AJ004913.1 | 1 |
| 2688 | ncr5264 | cadherin 11, OB-cadherin(osteoblast) (CDH11)(= OB-cadherin-2)(= OB-cadherin-1)(= cadherin-11 ) | NM_001797.1 | 1 |
| 2689 | hfcr9447 | solute carrier family 4, anion exchanger, member 3 (SLC4A3) | NM_005070.1 | 1 |
| 2690 | hfcr3489 | beta-galactosidase (GLB1) | M34423.1 | 1 |
| 2691 | MIOA1524 | protein phosphatase 2A 130 kDa regulatory subunit | L07590 | 1 |
| 2692 | MIOB2756 | 5' cap guanine-N-7 methyltransferase (RNMT) | AF067791.1 | 1 |
| 2693 | miob0636 | calcineurin A1 | M29550.1 | 1 |
| 2694 | ncrb5940 | baculoviral IAP repeat-containing 6 (BIRC6) | NM_016252.1 | 1 |
| 2695 | ncrb3226 | PTD019 (=HSPC203) | AF226729.1 | 1 |
| 2696 | ncr7181 | spastic paraplegia 4 | NM_014946.1 | 1 |
| 2697 | MIOA3269a | uncharacterized protein | AK002062 | 1 |
| 2698 | miob1136 | a disintegrin and metalloproteinase domain 28 (ADAM28)(= eMDC II) | NM_014265.1 | 1 |
| 2699 | ncrc4565 | procollagen-proline, 2-oxoglutarate4-dioxygenase (proline 4-hydroxylase), alpha polypeptide(RefSeq aa 1e-44) | NP_000908.1 | 1 |
| 2700 | MIOA4628a | proteasome (prosome, maCRopain) 26S subunit, non-ATPase, 12 (PSMD12)=AB003103 = 26S proteasome subunit p55, | NM_002816.1 | 1 |
| 2701 | SEOB3158 | c-maf long form | AF055377.1 | 1 |
| 2702 | FCR2306 | Kruppel-like zinc finger protein Zf9 | AF001461 | 1 |
| 2703 | SEOA8640 | Tat-interacting protein (30kD) (TIP30) | 5454125 | 1 |

Figure 6A – EST Names Corresponding to Unique Known Genes of Figure 6

| | | | |
|---|---|---|---|
| 2704 FCR5620 | zinc finger protein | L16896 | 1 |
| 2705 ncrb0090 | zinc finger protein 22 (KOX 15) (RefSeq aa 1e-48) | NP_008894.1 | 1 |
| 2706 seob5860 | ribonucleoprotein gene 60-kD SS-A/Ro D8 | U44388.1 | 1 |
| 2707 ncrb7111 | betaglycan (TBR III gene) | AJ251961.1 | 1 |
| 2708 ncr0016 | Estrogen receptor 1 (ESR1) | NM_000125.1 | 1 |
| 2709 FCR6902 | glucocorticoid-induced leucine zipper GILZ protein | AF024519 | 1 |
| 2710 seob7262 | activated leucocyte cell adhesion molecule (ALCAM) | NM_001627.1 | 1 |
| 2711 seoa8019 | BCL2-associated athanogene 3 (BAG3), mRNA /cds=(306,2033) /gb=NM_004281 /gi=14043023 /ug=Hs.15259 /len=2605 | Hs.15259 | 1 |
| 2712 miob2944 | fetal liver cDNA library | AI133292.1 | 1 |
| 2713 ncrc9117 | unnamed protein product | BAB15083.1 | 1 |
| 2714 SEOA6701a | solute carrier family 16 (monocarboxylic acid transporters), member 4 (SLC16A4) (contains Alu repeat) | gi4759113 | 1 |
| 2715 SEOA5299a | muscle-type phosphofructokinase (PFK-M) gene | M59741 | 1 |
| 2716 FCR5337 | protein tyrosine phosphatase (PRL-1) | L39000 | 1 |
| 2717 MIOB0468 | 5-lipoxygenase activating protein (FLAP) (arachidonate 5-lipoxygenase-activating protein) (ALOX5AP) | M63262.1 | 1 |
| 2718 hfcr5181 | NADH dehydrogenase (ubiquinone) 1 alpha subcomplex, 3 (9kD, B9)(NDUFA3) | NM_004542.1 | 1 |
| 2719 MIOA5484a | SUCCINATE DEHYDROGENASE [UBIQUINONE] FLAVOPROTEIN SUBUNIT, MITOCHONDRIAL PRECURSOR (FP) (FLAVOPROTEIN SUBUNIT OF COMPLEX II) Length = 664 | spP31040 | 1 |
| 2720 seob4487 | translation initiation factor IF2 (IF2)(ORF) | NM_015904.1 | 1 |
| 2721 SEOA6867 | PROTEASOME THETA CHAIN (MACROPAIN THETA CHAIN) (MULTICATALYTIC ENDOPEPTIDASE COMPLEX THETA CHAIN) (PROTEASOME CHAIN 13) (PROTEASOME COMPONENT C10-II) | spP49720 | 1 |
| 2722 hfcr1073 | general transcription factor IIE, polypeptide 2 | NM_002095.1 | 1 |
| 2723 ncr4550 | hematopoietic-derived zinc fingerprotein (RefSeq aa 1e-48) | NP_004867.1 | 1 |
| 2724 miob3044 | zinc finger protein 208(ZNF208) | NM_007153.1 | 1 |
| 2725 MIOA3528a | ZNF202 beta (ZNF202) | AF027219 | 1 |
| 2726 MIOB2227 | pirin (PIR) | gi4505822 | 1 |
| 2727 FCR1779 | U6 snRNA | X59362 | 1 |
| 2728 hfcr5473 | RNA polymerase II subunit | U37690.1 | 1 |
| 2729 seob1667n | mitochondrial ribosomal protein L20 (MRPL20), mRNA | XM_027716.1 | 1 |
| 2730 MIOA1556 | MHC class I HLA-C-alpha-2 chain | M24097 | 1 |
| 2731 ncr3035 | beta-preprotachykinin | X54469.1 | 1 |
| 2732 miob0942 | pre-B-cell colony-enhancing factor (PBEF) | NM_005746.1 | 1 |
| 2733 ncrb0323 | adaptor-related protein complex 3, beta 1 subunit (AP3B1) | NM_003664.1 | 1 |
| 2734 miob4370 | transmembrane 4 superfamily member (tetraspan NET-2) (NET-2) | NM_012338.1 | 1 |
| 2735 hfcr1201 | adaptor-related protein complex 3, delta 1 subunit (ADTD), mRNA | NM_003938.1 | 1 |
| 2736 hfcr3774 | seven transmembrane domain protein (NIFIE14) | NM_006326.1 | 1 |

Figure 6A – EST Names Corresponding to Unique Known Genes of Figure 6

| | | | | |
|---|---|---|---|---|
| 2737 | hfcr3494 | DNA topoisomerase III | U43431.1 | 1 |
| 2738 | MIOA8557 | SWI/SNF related, matrix associated, actin dependent regulator of chromatin, subfamily a, member 2 (=SNF2alpha protein) | NP_003061.1 | 1 |
| 2739 | hfcr6715 | methyltransferase (HASJ4442) | NM_017528.1 | 1 |
| 2740 | HFCR3091 | collagen binding protein 2 | D83174.1 | 1 |
| 2741 | miob6645 | syndecan-1 gene (exons 2-5) | Z48199.1 | 1 |
| 2742 | SEOA8501 | CC-chemokine receptor(CCR-5) gene, delta-32 allele | AF009962.1 | 1 |
| 2743 | ncrb5361 | interferon, alpha-inducible protein 27(RefSeq aa 7e-39) | NP_005523.1 | 1 |
| 2744 | ncr3891 | mitogen-activated protein kinase 6 (MAPK6) | NM_002748.1 | 1 |
| 2745 | ncrc4920 | MAD (mothers against decapentaplegic, Drosophila) homolog 7 (MADH7) | NM_005904.1 | 1 |
| 2746 | FCR3173N | developmentally regulated GTP-binding protein 2 (DRG2) | X80754 | 1 |
| 2747 | fcrb1136 | melanoma differentiation associated (mda-6)= L25610.1 cyclin-dependent kinase inhibitor Length = 2120 | U09579.1 | 1 |
| 2748 | seob5894 | ADP-ribosylation factor-like 1 (ARL1) | NM_001177.2 | 1 |
| 2749 | seob7755 | mannose-specific lectin (MR60) | U09716.1 | 1 |
| 2750 | ncrb1852 | postmeiotic segregation increased 2-like 8 (RefSeq aa 2e-57) | NP_005385.1 | 1 |
| 2751 | seob3675 | spindlin (Spin) | NM_011462.1 | 1 |
| 2752 | SEOB1316 | p53 binding protein | U82939.1 | 1 |
| 2753 | FCR2301 | BRAIN PROTEIN I3 | P28662 | 1 |
| 2754 | ncrc2693 | cerebellar degeneration-related protein (34kD) (CDR1) | NM_004065.1 | 1 |
| 2755 | SEOA5461 | fetal brain oculocerebrorenal syndrome (OCRL1) | U57627 | 1 |
| 2756 | SEOA9016 | fungal sterol-C5-desaturase homolog | D85181.1 | 1 |
| 2757 | miob0213 | HSPC280 | AF161398.1 | 1 |
| 2758 | ncr5865 | HSPC282 | AF161400 | 1 |
| 2759 | seoa8035 | hypothetical protein MGC3037 (MGC3037), mRNA /cds=(99,1151) /gb=NM_024047 /gi=13129009 /ug=Hs.301789 /len=1507 | Hs.301789 | 1 |
| 2760 | ncrb1100 | immature colon carcinoma transcript 1(RefSeq aa 5e-76) | NP_001536.1 | 1 |
| 2761 | MIOA3801 | integral membrane protein type II (NKG2-D) (=U08988 CRFB4 ) | AF001297 | 1 |
| 2762 | hfcr1340 | isolate Indonesian 79 type 299 mitochondrial control region, partial | AF176203 | 1 |
| 2763 | miob5915 | KIAA0250 gene | NM_014837.1 | 1 |
| 2764 | miob4004 | KIAA0260 gene | D87449.1 | 1 |
| 2765 | ncr3189 | KIAA0388 | AB002386.1 | 1 |
| 2766 | miob6485 | KIAA0576 protein | AB011148.1 | 1 |
| 2767 | miob6092 | NTT gene (L1 Alu and MER 38 repeat regions) | U54776.1 | 1 |
| 2768 | MIOA8862 | ORF2-like protein | AAD04635.1 | 1 |
| 2769 | SEOA7485a | PMS2L13 | AB017004.1 | 1 |
| 2770 | seoa7788a | putative (LOC116228), mRNA | XM_057659.2 | 1 |
| 2771 | ncrc6617 | RAB, member of RAS oncogene family-like 2B (RABL2B) | NM_007081.1 | 1 |
| 2772 | hfcr9807 | sushi-repeat protein (SRPUL) | NM_014467.1 | 1 |

Figure 6A – EST Names Corresponding to Unique Known Genes of Figure 6

| | | | | |
|---|---|---|---|---|
| 2773 | SEOA8960 | VACUOLAR ATP SYNTHASE SUBUNIT H (V-ATPASE H SUBUNIT) (V-ATPASE M9.2 SUBUNIT) (9.2 KD MEMBRANE ACCESSORY PROTEIN) | spO15342 | 1 |
| 2774 | miob1306 | nicotinamide nucleotide transhydrogenase (NNT) | NM_012343.1 | 1 |
| 2775 | ncrb6476 | palmitoylated membrane protein 3 (RefSeq aa 1e-86) | NP_001923.1 | 1 |
| 2776 | hfcr5157 | protein phosphatase 4 regulatory subunit 1 (PPP4R1) | NM_005134.1 | 1 |
| 2777 | SEOB0510 | POLY(A) POLYMERASE (PAP) (POLYNUCLEOTIDE ADENYLYLTRANSFERASE) | spP51003 | 1 |
| 2778 | FCR1098 | ATP-citrate lyase | X64330 | 1 |
| 2779 | SEOA1812a | phosphatidic acid phosphatase type 2c (Ppap2c) (=D38522 KIAA0080) | AF123611.1 | 1 |
| 2780 | MIOA8919 | cytochrome c (HS7) processed pseudogene | M22893.1 | 1 |
| 2781 | MIOA2853a | mitochondrial 3-ketoacyl-CoA thiolase beta-subunit of trifunctional protein | D16481.1 | 1 |
| 2782 | MIOA3397a | mitochondrial acetoacetyl-coenzyme A thiolase (EC 2.3.1.9) | D90228 | 1 |
| 2783 | MIOA7423a | mitochondrial elongation factor G | L14684 | 1 |
| 2784 | SEOB0352 | mitochondrial F1FO-type ATPase subunit d | AF087135.1 | 1 |
| 2785 | ncrb7167 | NADH dehydrogenase (ubiquinone) 1 alpha subcomplex, 9 (39kD) (RefSeq aa 2e-80) | NP_004993.1 | 1 |
| 2786 | SEOA6131a | ubiquinol cytochrome-c reductase core I protein | L16842 | 1 |
| 2787 | hfcr8033 | aspartyl protease(BACE2) mRNA, complete cds, alternatively spliced | AF188277.1 | 1 |
| 2788 | miob6834 | carbamyl phosphate synthetase I | AF154830.1 | 1 |
| 2789 | SEOB3131 | glutamine:fructose-6-phosphate amidotransferase (GFAT) | M90516.1 | 1 |
| 2790 | FCR6092 | selenium donor protein (selD) | U34044 | 1 |
| 2791 | ncrb6907 | tousled-like kinase 1 (RefSeq aa 1e-49) | NP_036422.1 | 1 |
| 2792 | miob5675 | peroxisomal biogenesis factor 3 (PEX3) | NM_003630.1 | 1 |
| 2793 | FCR4129 | peroxisome biogenesis disorder protein 1 (PEX1) | AF026086 | 1 |
| 2794 | ncrb5322 | signal recognition particle receptor ('docking protein') (SRPR) | NM_003139.1 | 1 |
| 2795 | miob6518 | UBIQUITIN CARBOXYL-TERMINAL HYDROLASE 12 (UBIQUITIN THIOLESTERASE 12)(UBIQUITIN-SPECIFIC PROCESSING PROTEASE 12) (DEUBIQUITINATING ENZYME 12) (UBIQUITIN HYDROLYZING ENZYME 1) | spO75317 | 1 |
| 2796 | hfcr9420 | ubiquitin specific protease 11 (USP11) | NM_004651.1 | 1 |
| 2797 | miob3695 | ASH2L (absent, small, or homeotic, Drosophila, homolog)-like | NM_004674.1 | 1 |
| 2798 | ncrb4166 | c-myc gene | 1001205A | 1 |
| 2799 | hfcr9656 | colon Kruppel-like factor (CKLF) | AF132818.1 | 1 |
| 2800 | ncrb2524 | general transcription factor IIF, polypeptide 1 (74kD subunit) (GTF2F1) | NM_002096.1 | 1 |
| 2801 | miob6794 | hedgehog-interacting protein (Hip) | AF116865.1 | 1 |
| 2802 | MIOA5691 | HZF3 mRNA for zinc finger protein(ORF) | X78926 | 1 |
| 2803 | seob4284 | Nef-associated factor 1(NAF1) mRNA | NM_006058.1 | 1 |
| 2804 | MIOA8914 | retinoblastoma-binding protein 8 (RBBP8) | NM_002894.1 | 1 |
| 2805 | FCR0089 | transCRiption elongation factor S-II, hS-II-T1 | D50495 | 1 |
| 2806 | SEOA8242 | transCRiption factor 4, Helix-loop-helix transCRiption factor 4 (HTF4/TCF12) | M65209 | 1 |
| 2807 | ncr6431 | zinc finger protein (PRD51) gene | U88082.1 | 1 |

Figure 6A – EST Names Corresponding to Unique Known Genes of Figure 6

| | | | |
|---|---|---|---|
| 2808 hfcr8631 | Zinc-finger helicase (hZFH) | U91543.1 | 1 |
| 2809 SEOA6223 | capping enzyme (HCE) | AF025654 | 1 |
| 2810 ncrb6639 | cleavage and polyadenylation specific factor 4, 30kD subunit (CPSF4) | NM_006693.1 | 1 |
| 2811 FCR3076 | DEAD-box protein p72 (P72) | U59321 | 1 |
| 2812 MIOA5558a | TFIID subunit p22 | D50544 | 1 |
| 2813 HFCR3118 | U5 snRNP 100 kD protein | AF026402.1 | 1 |
| 2814 miob2947 | nasopharyngeal carcinoma susceptibility protein | NP_037407.1 | 1 |
| 2815 ncrc1510 | HLA-B gene (HLA-B*0801 allele), complete cds | D83956.1 | 1 |
| 2816 ncrb7557 | diptheria toxin resistance protein required for diphthamide biosynthesis (Saccharomyces)-like 1 (DPH2L1) | NM_001383.1 | 1 |
| 2817 miob6528 | heat-responsive protein 12 (Hrsp12) | NM_008287.1 | 1 |
| 2818 SEOA0784n | neuronal tissue-enriched acidic protein (NAP-22) | AF039656 | 1 |
| 2819 SEOA4132a | xeroderma pigmentosum complementation group C (XPC)=X65024 | NM_004628.1 | 1 |
| 2820 hfcr5706 | carbonic anhydrase II (CA2) | NM_000067.1 | 1 |
| 2821 mioa9505 | PKCq-interacting protein PICOT (PICOT) (ORF) | AF118652 | 1 |
| 2822 ncr1712 | hect domain and RLD 3 (HERC3) | NM_014606.1 | 1 |
| 2823 SEOA4485 | 33 kDa Vamp-associated protein (VAP33) | AF044670 | 1 |
| 2824 SEOA2472 | CGI-76 protein | AF151834.1 | 1 |
| 2825 MIOA4532a | ankyrin-like protein | Y10601.1 | 1 |
| 2826 MIOA0212a | F-actin capping protein beta subunit | U03271 | 1 |
| 2827 FCR2266 | cardiac ventricular troponin C | AF020769 | 1 |
| 2828 SEOA1278a | tropomyosin isoform | Z24727 | 1 |
| 2829 hfcr0256 | 22 kDa peroxisomal membrane protein-like (LOC55895) | NM_018663.1 | 1 |
| 2830 miob5978 | angiotensin receptor 1 (AGTR1) | NM_009585.1 | 1 |
| 2831 ncr9754 | dickkopf (Xenopus laevis) homolog 1 (DKK1) | NM_012242.1 | 1 |
| 2832 MIOA2796a | epidermal growth factor receptor substrate (eps15) | U07707 | 1 |
| 2833 hfcr6992 | FYN oncogene related to SRC, FGR, YES (FYN) | NM_002037.1 | 1 |
| 2834 ncrb4962 | G protein Golf alpha gene | U55184.1 | 1 |
| 2835 ncrb5965 | glucocorticoid receptor alpha | U25029.1 | 1 |
| 2836 hfcr2892 | Homer, neuronal immediate early gene, 1B (SYN47) | NM_004272.1 | 1 |
| 2837 ncrb0602 | interferon, alpha-inducible protein (clone IFI-6-16) (G1P3) | NM_002038.1 | 1 |
| 2838 miob3149 | interleukin 6 signal transducer (gp130, oncostatin M receptor) (IL6ST)(= membrane glycoprotein gp130) | NM_002184.1 | 1 |
| 2839 ncrb0916 | vesicle-associated soluble NSFattachment protein receptor (v-SNARE; homolog of S.cerevisiae VTI1) (RefSeq aa 2e-37) | NP_006361.1 | 1 |
| 2840 hfcr8442 | mitogen-activated protein kinase 7 (MAPK7) | NM_002749.1 | 1 |
| 2841 MIOA0291 | phosphoenolpyruvate carboxykinase (PCK1) (clone lamda-hPEC-3) | L05144 | 1 |
| 2842 hfcr0470 | serine/threonine protein phosphatase catalytic subunit (LOC51723), mRNA =( protein phosphatase 6) | NM_016294.1 | 1 |
| 2843 miob6459 | serine-arginine-rich splicing regulatory protein SRRP86 | AAF37578.1 | 1 |
| 2844 BFCS0524 | tyrosine kinase (HTK) | U07695 | 1 |
| 2845 ncr4435 | cAMP-specific phosphodiesterase 4D (PDE4DN3 gene) | AJ250854.1 | 1 |

Figure 6A – EST Names Corresponding to Unique Known Genes of Figure 6

| | | | | |
|---|---|---|---|---|
| 2846 | seob5963 | RAB23 protein (LOC51715)(HSPC137) | NM_016277.1 | 1 |
| 2847 | hfcr1709 | Rab3D (rab3d) | AF263366.1 | 1 |
| 2848 | MIOA4326a | alpha-amidating monooxygenase | AF010472 | 1 |
| 2849 | ncrb4749 | granulin (GRN) | NM_002087.1 | 1 |
| 2850 | SEOA5473a | monocyte chemoattractant protein 4 | X98306 | 1 |
| 2851 | ncrc0262 | uncharacterized hematopoieticstem/progenitor cells protein MDS031 (RefSeq aa 6e-81) | NP_060936.1 | 1 |
| 2852 | SEOA6332 | ADP-ribosyltransferase (NAD ; poly (ADP-ribose) polymerase)-like 1 (ADPRTL1) (=D79999 KIAA0177; AF158255 vault protein) | gi5915659 | 1 |
| 2853 | FCR0997 | calgizzarin (=D49355 S100C protein; X80201 MLN70) | D38583 | 1 |
| 2854 | hfcr9703 | ABC transporter umat (ABCB6 gene)(= MT-ABC transporter) | AJ289233.2 | 1 |
| 2855 | HFCR2367 | heme-regulated eukaryotic initiation factor 2 alpha kinase (HRI) | AF255050.1 | 1 |
| 2856 | ncrb2247 | potassium inwardly-rectifying channel, subfamily K, member 1 (RefSeq aa 5e-52) | NP_002236.1 | 1 |
| 2857 | seob3903 | PAK-interacting exchange factor beta (P85SPR) mRNA | NM_003899.1 | 1 |
| 2858 | SEOA1173A | Heterochromatin protein 1 gamma | AB030905.1 | 1 |
| 2859 | hfcr6274 | histone deacetylase 6 (KIAA0901) | NM_006044.1 | 1 |
| 2860 | FCR7675 | histone stem-loop binding protein (SLBP) | U75679 | 1 |
| 2861 | miob0255 | RecQ protein-like (DNA helicase Q1-like) (RECQL) | NM_002907.1 | 1 |
| 2862 | SEOB0058 | CYCLIN A/CDK2-ASSOCIATED PROTEIN P19 (RNA POLYMERASE II ELONGATION FACTOR-LIKE PROTEIN) (ORGAN OF CORTI PROTEIN 2) (OCP-II PROTEIN) (OCP-2) | spP34991 | 1 |
| 2863 | ncrc6012 | polymerase (RNA) II (DNA directed) polypeptide B (140kD) (RefSeq aa 4e-32) | NP_000929.1 | 1 |
| 2864 | FCR6442 | 10kD protein (BC10) | AF053470 | 1 |
| 2865 | fcrb2661 | 14-3-3 sigma protein promoter and gene, complete cds | AF029081.1 | 1 |
| 2866 | MIOA6772a | 19.5 protein | M32486 | 1 |
| 2867 | FCR4272 | 1-aminocyclopropane-1-carboxylate synthase | A35516 | 1 |
| 2868 | FCR7508 | 23 kD highly basic protein | X56932 | 1 |
| 2869 | hfcr9546 | 2-hydroxyacid dehydrogenase | AF113251.1 | 1 |
| 2870 | ncrc0640 | 2-hydroxyphytanoyl-CoA lyase (RefSeq aa 7e-62) | NP_036392.1 | 1 |
| 2871 | MIOA7262a | 3-7 gene product | D64159 | 1 |
| 2872 | ncr2857 | 3pv2 and 5p152 genes | sp\|P39194 | 1 |
| 2873 | MIOA8653 | 40 kDa product (=M19503 ORF1; putative) | AAB59367.1 | 1 |
| 2874 | FCR4056 | 54TMp (54tm) (=S83365 RAB5-interaction protein) | AF004876 | 1 |
| 2875 | seob5054 | 55 kDa protein | AF155658.1 | 1 |
| 2876 | hfcr1359 | 7h3 protein | AF209931 | 1 |
| 2877 | ncr4612 | 88.8 kDa protein | AF225417.1 | 1 |
| 2878 | ncrc1921 | 959 kb contig between AML1 and CBR1 on chromosome 21q22, segment 3/3 | AJ229043.1 | 1 |
| 2879 | miob5749 | ABL (M8604 Met) gene | U07561.1 | 1 |
| 2880 | ncrc0342 | acetyl LDL receptor; SREC=scavenger receptor expressed by endothelial cells (SREC),(= KIAA0149 gene) | NM_003693.1 | 1 |
| 2881 | FCR6915 | acetylserotonin N-methyltransferase-like (ASMTL) (=Y15521) | gi4757793 | 1 |

Figure 6A – EST Names Corresponding to Unique Known Genes of Figure 6

| | | | | |
|---|---|---|---|---|
| 2882 | fCR0255 | acid phosphatase type 5 | X14618 | 1 |
| 2883 | FCR3595 | Acyl carrier protein, Mitochondrial (ACP) (non-exact 64%) | AC002400 | 1 |
| 2884 | HFCR3089 | AD-012 protein (LOC55833) (=AB040924 KIAA1491) | gi8923858 | 1 |
| 2885 | hfcr1795 | AD-014 protein | AF150733.1 | 1 |
| 2886 | mioa1112m | ADMLX=putative adhesion molecule [human mRNA, 4121 nt, segment 2 of 2]= Kallmann syndrome (KAL)= M97252 | S60088 | 1 |
| 2887 | seob5771 | adrenal gland protein AD-002 | AF110775.1 | 1 |
| 2888 | ncrc2814 | adrenal gland protein AD-004 (RefSeq aa 2e-91) | NP_057367.1 | 1 |
| 2889 | MIOA5902a | ANC_2H01 (ORF) | AF003924_1 | 1 |
| 2890 | hfcr5991 | ancient ubiquitous protein 1(AUP1), mRNA | NM_012103.1 | 1 |
| 2891 | ncrc6841 | androgen-regulated short-chain dehydrogenase/reductase 1 (ARSDR1) | AF167438.1 | 1 |
| 2892 | ncrb5507 | antigen NY-CO-25(NY-CO-25) (=KIAA0201) | AF039695.1 | 1 |
| 2893 | hfcr6774 | antigen NY-CO-41 (NY-CO-41)(= clone DKFZp586O0821) | AF039701.1 | 1 |
| 2894 | FCR0186 | antigen NY-CO-9 (NY-CO-9) (=AB011172 hypothetical protein (KIAA0600)) | AF039691 | 1 |
| 2895 | fcrb2292 | antigenic determinant of recA protein (mouse) homolog, clone MGC:29595 IMAGE:5089578, mRNA, complete cds | BC017309.1 | 1 |
| 2896 | ncrb0571 | anti-oncogene | M98056.1 | 1 |
| 2897 | MIOA4014a | APMCF1 (APMCF1) | AF141882.1 | 1 |
| 2898 | ncr4408 | arsenate resistance protein ARS2 arsenite-resistance protein 2 (RefSeq aa 2e-37) | NP_056992.1 | 1 |
| 2899 | FCR4099 | arsenite translocating ATPase (ASNA1) (=U60276) | AF047469 | 1 |
| 2900 | BFCN0031 | atypical PKC specific binding protein | AB005549 | 1 |
| 2901 | MIOB2131 | autonomously replicating sequence (ARS) | L08437.1 | 1 |
| 2902 | miob1115 | autosomal dominant polycystic kidney disease type II (clone 23778) | AF054992.1 | 1 |
| 2903 | ncr7473 | AV723190 HTB cDNA clone HTBAXA03 5' | AV723190.1 | 1 |
| 2904 | ncr8111 | B.subtilis YQJC protein (TR:G1303954) | CAA98118.1 | 1 |
| 2905 | seob7577 | B12 protein | M80783.1 | 1 |
| 2906 | SEOB0850a | B17 | AF232674.1 | 1 |
| 2907 | FCR2167 | B6D2F1(clone 2C11B) | U01139 | 1 |
| 2908 | FCR7070 | Bak protein | U23765 | 1 |
| 2909 | ncrc0304 | BANP homolog (FLJ20538) | NM_017869.1 | 1 |
| 2910 | FCR5199 | BCL7B protein | X89985 | 1 |
| 2911 | FCR5507 | BCNT | AB009270 | 1 |
| 2912 | ncr7050 | beta-ureidopropionase | NM_016327.1 | 1 |
| 2913 | ncr7557 | blood-stage membrane protein Ag-1 [Plasmodium yoelii] | AF103869 | 1 |
| 2914 | ncr5697 | BNIP3H (BNIP3H) nuclear gene for mitochondrial product | AF255051.1 | 1 |
| 2915 | SEOA0870 | Br140 | M91585 | 1 |
| 2916 | MIOA0089a | brain 4.1(L) protein (=AB002336 Human KIAA0338) | AB019257.1 | 1 |
| 2917 | ncrb1899 | breast adenocarcinoma marker (32kD) (BC-2) | NM_014453.1 | 1 |
| 2918 | ncrc1022 | BRI3 | AF272043.1 | 1 |
| 2919 | HFCR6141 | brother of CDO (BOC) | AY027658.1 | 1 |
| 2920 | SEOA4628a | C13F10.4 gene product [Caenorhabditis elegans] | U97006 | 1 |
| 2921 | SEOA5809 | C1D protein (nuclear DNA-binding protein) | X95592 | 1 |

Figure 6A – EST Names Corresponding to Unique Known Genes of Figure 6

| | | | | |
|---|---|---|---|---|
| 2922 | fcr0195 | C367G8.1 (melanoma antigen P15) (LOC124104) | XM_058771.1 | 1 |
| 2923 | MIOA3639a | C43H8.1 gene product | AF098499 | 1 |
| 2924 | MIOA2475a | C44E4.5 gene product | AF003140 | 1 |
| 2925 | ncrb3647 | C6f mRNA, partial 3'UTR | U72516.1 | 1 |
| 2926 | ncrb8474 | calmodulin-like, processed pseudogene (302 bp identical to the 3' untranslated region) (=DKFZp434A012) | M73792.1 | 1 |
| 2927 | miob3591 | candidate tumor suppressor protein DICE1 | AF097645.1 | 1 |
| 2928 | miob6245 | CDM (=ref\|NM_005745.2\| accessory proteins BAP31/BAP29) | Z31696.1 | 1 |
| 2929 | mioa9954 | cell-line RPMI 8226 chloride ion current inducer protein I(Cln) gene, | AF232225 | 1 |
| 2930 | hfcr1874 | CGI-111 protein (LOC51015) | NM_016048.1 | 1 |
| 2931 | MIOA0916a | CGI-113 protein | AF151871.1 | 1 |
| 2932 | MIOA0294 | CGI-126 protein | AF151884.1 | 1 |
| 2933 | BFCW0371 | chorionic gonadotropin beta subunit | K03189 | 1 |
| 2934 | SEOA4518 | choroideremia (ORF) | X78121 | 1 |
| 2935 | ncr5781 | Churchill protein | AAG09759.1 | 1 |
| 2936 | ncr8259 | citb_173_i_12 | AC005887.3 | 1 |
| 2937 | miob1826 | citb_179_n_3 | AC005210.3 | 1 |
| 2938 | ncrb4215 | citb_43_a_11, complete sequence | AC005880.3 | 1 |
| 2939 | hfcr0827 | citb_79_e_16, complete sequence | AC005881.3 | 1 |
| 2940 | MIOA6035 | clock (mouse) homologue (CLOCK) (=AB002332 KIAA0334) | gi4758009 | 1 |
| 2941 | ncrb2660 | cn04g01.y1 Normal Human Trabecular Bone Cells cDNA clone NHTBC_cn04g01 random | AI750662.1 | 1 |
| 2942 | mioa7878 | CocoaCrisp (LOC83690), mRNA /cds=(85,1587) /gb=NM_031461 /gi=13899302 /ug=Hs.182364 /len=2667 | Hs.182364 | 1 |
| 2943 | ncr7666 | COP9 subunit 6 (MOV34 homolog, 34 kD)(RefSeq aa 3e-61) | NP_006824.1 | 1 |
| 2944 | BFCS0371 | COX4AL | AF005888 | 1 |
| 2945 | MIOA4602a | cp1508.seq.F Human fetal heart, Lambda ZAP Express cDNA 5' | AA248069 | 1 |
| 2946 | ncr0395 | CpG island DNA genomic Mse1 fragment, clone 60h1, reverse read cpg60h1.rt1a | Z61961.1 | 1 |
| 2947 | ncr3811 | CpG island DNA genomic Mse1 fragment, clone 70g11, reverse read cpg70g11.rt1a | Z62622.1 | 1 |
| 2948 | hfcr1433 | CSR2 | AB007830.1 | 1 |
| 2949 | ncr4774 | CTD-2314M3 | AC026273.7 | 1 |
| 2950 | fcrb2124 | CTP synthase (CTPS) | NM_001905.1 | 1 |
| 2951 | seoa6830 | CUB and Sushi multiple domains 1 (CSMD1), mRNA /cds=(285,10811) /gb=NM_033225 /gi=15100167 /ug=Hs.123468 /len=11301 | Hs.123468 | 1 |
| 2952 | FCR0226 | CX3C chemokine precursor | U84487 | 1 |
| 2953 | FCR1657 | cystinosin | AJ222967 | 1 |
| 2954 | FCR4892 | cytokine SDF-1-beta (=L36033) | U16752 | 1 |
| 2955 | FCR4824 | cytokine-like factor-1 precursor (CLF-1) | AF059293 | 1 |
| 2956 | ncrc5372 | D15F37 pseudogene, S4 allele | AF041081.1 | 1 |
| 2957 | hfcr5198 | D54 isoform (hD54) | AF004429.1 | 1 |
| 2958 | hfcr0954 | DAN gene | D89013 | 1 |
| 2959 | ncrc8901 | dbpB-like protein | L28809.1 | 1 |

Figure 6A – EST Names Corresponding to Unique Known Genes of Figure 6

| | | | |
|---|---|---|---|
| 2960 ncr4332 | DC11 protein (RefSeq aa 3e-63) | NP_064571.1 | 1 |
| 2961 ncrc0749 | DC6 protein (RefSeq aa 2e-52) | NP_064574.1 | 1 |
| 2962 FCR4024 | D-dopachrome tautomerase (=U49785; Y11151) | AF058293 | 1 |
| 2963 seob6823 | DEAD (aspartate-glutamate-alanine-aspartate) box polypeptide 6 (Ddx6) | NM_007841.1 | 1 |
| 2964 seob4726 | differentiation-related gene 1 (nickel-specific induction protein) (RTP) | NM_006096.1 | 1 |
| 2965 ncrc0747 | dJ1158H2.1 (novel protein similar to D. melanogaster CG11048 and CG8959) | CAC05315.1 | 1 |
| 2966 ncrc9217 | dJ28H20.2 (novel protein) | CAC00561.1 | 1 |
| 2967 ncr4545 | dJ671D7.1 (similar to D. melanogaster CG5986 protein) | CAC04152.1 | 1 |
| 2968 ncrc4808 | dJ756N5.2 (A novel protein (DKFZp727M231) similar to Trp4-associated protein TAP1 (ABCB2)) | CAC14946.1 | 1 |
| 2969 miob4692 | dJ93K22.1 (novel protein (contains DKFZP564B116)) | AL050333 | 1 |
| 2970 MIOA6053a | Dlgh1 homologue | U93309 | 1 |
| 2971 mioa9714 | DMBT1 candidate tumour suppressor gene, exons 1 to 55(low match) | AJ243211.1 | 1 |
| 2972 hfcr9258 | DMR-N9 myotonic dystrophy kinase (DM kinase) gene | L08835.1 | 1 |
| 2973 BFCW0102n | DNA containing putative Ac-like transposon | Y17156 | 1 |
| 2974 seob5726 | DNA for tob family, complete cds | D78382.1 | 1 |
| 2975 ncr8456 | Down syndrome critical region gene 1-like 1 | NM_005822.1 | 1 |
| 2976 SEOB3485 | down-regulator of transCRiption 1, TBP-binding (negative cofactor 2) (DR1) | NM_001938.1 | 1 |
| 2977 SEOA6654a | DROME TWISTED GASTRULATION PROTEIN PRECURSOR | spP54356 | 1 |
| 2978 ncrb4224 | DSCR5a | AB037162.1 | 1 |
| 2979 ncrc1885 | dUTP pyrophosphatase (DUT) | NM_001948.1 | 1 |
| 2980 ncrb4145 | DVS27-related protein | BAA75892.1 | 1 |
| 2981 FCR2684 | DXS8237E (=D50912 hypothetical protein (KIAA0122)) | U35373 | 1 |
| 2982 fCR0558 | dye | U77595 | 1 |
| 2983 ncrc6861 | E46 protein | AF119662.1 | 1 |
| 2984 ncrc1995 | early B-cell transcription factor (EBF) | AF208502.1 | 1 |
| 2985 hfcr5737 | early development regulator 2 (homolog of polyhomeotic 2) (EDR2), mRNA | NM_004427.1 | 1 |
| 2986 FCR0470 | EB1 | U24166 | 1 |
| 2987 fcrb2207 | EF1a-like protein | AF267861.1 | 1 |
| 2988 ncr0103 | endogenous retrovirus H HERV-H/env62 proviral copy, clone 231E12 | AJ289709.1 | 1 |
| 2989 MIOA2421a | endogenous retrovirus HERV-K102 | AF164610.1 | 1 |
| 2990 FCR4040 | endogenous retrovirus type C oncovirus sequence | M74509 | 1 |
| 2991 MIOA0478 | envelope protein | AF164615 | 1 |
| 2992 FCR3559 | EPC-1 (=M76979 PEDF;U29953;M90493) | U57446 | 1 |
| 2993 MIOA2981a | ER1 (=AB033019 KIAA1193) (67% aa) | AF015454 | 1 |
| 2994 hfcr8796 | erbb2-interacting protein ERBIN | NM_018695.1 | 1 |
| 2995 FCR5006 | ERp28 protein | X94910 | 1 |
| 2996 mioa0573a | esophageal cancer related gene 4 protein (ECRG4), mRNA /cds=(108,554) /gb=NM_032411 /gi=14165275 /ug=Hs.43125 /len=772 | Hs.43125 | 1 |
| 2997 hcr0927 | ETAA16 protein (RefSeq aa 1e-75) | NP_061875.1 | 1 |

Figure 6A – EST Names Corresponding to Unique Known Genes of Figure 6

| | | | | |
|---|---|---|---|---|
| 2998 | SEOA8266 | EXOSTOSIN-1 (PUTATIVE TUMOR SUPPRESSOR PROTEIN EXT1) (MULTIPLE EXOSTOSES PROTEIN 1) | spQ16394 | 1 |
| 2999 | mioa9865 | F1D9.26~unknown protein [Arabidopsis thaliana](71%ORF) | BAA97098.1 | 1 |
| 3000 | hfcr3518 | faciogenital dysplasia (Aarskog-Scott syndrome) (FGD1), mRNA | NM_004463.1 | 1 |
| 3001 | fcrb2575 | f-box and leucine-rich repeat protein 11 (FBXL11), mRNA | XM_040025.2 | 1 |
| 3002 | fcrb2622 | f-box and leucine-rich repeat protein 3A (FBXL3A), mRNA | NM_012158.1 | 1 |
| 3003 | fcrb1550 | FEZ2 protein (FEZ2) | AF113124.1 | 1 |
| 3004 | miob4712 | fgr proto-oncogene encoded p55-c-fgr protein | M19722.1 | 1 |
| 3005 | SEOA2784 | FH1/FH2 domain-containing protein FHOS (FHOS) | AF113615.1 | 1 |
| 3006 | ncrc8903 | FLAME-1 | AAB70909.1 | 1 |
| 3007 | SEOA0424n | fosB | X14897 | 1 |
| 3008 | hfcr2314 | FT005 protein (FT005) | NM_014054.1 | 1 |
| 3009 | mioa7908 | fused in glioblastoma mRNA, complete cds /cds=(207,1571) /gb=AY033606 /gi=14289128 /ug=Hs.23120 /len=4567 | Hs.23120 | 1 |
| 3010 | fcrb1547 | FXYD domain-containing ion transport regulator 6 (FXYD6) | NM_022003.1 | 1 |
| 3011 | ncr4466 | G antigen 1 | XP_010196.1 | 1 |
| 3012 | ncr4503 | G9011 gene product | AAF52302.2 | 1 |
| 3013 | FCR0149 | ganglioside-induced differentiation associated protein 3 | Y17852 | 1 |
| 3014 | ncr4647 | GASC-1 | AB037901.1 | 1 |
| 3015 | ncrc7131 | gcp372 | BAA05025.1 | 1 |
| 3016 | MIOA5614a | GEC-1 (gec-1) | AF012920 | 1 |
| 3017 | FCR2660 | GEF-2 | AB003515 | 1 |
| 3018 | MIOA4196 | GEG-154 mRNA | X71642 | 1 |
| 3019 | miob4581 | gene 33 polypeptide | M23572.1 | 1 |
| 3020 | ncr5066 | gene encoding HLA-Cw6 | Z22754.1 | 1 |
| 3021 | ncr8733 | gene_id:F1D9.26~unknown protein | AP002460 | 1 |
| 3022 | seoa8004 | GILZ, complete cds /cds=(233,637) /gb=AB025432 /gi=11527558 /ug=Hs.75450 /len=2028 | Hs.75450 | 1 |
| 3023 | ncr7411 | GK001 protein (GK001), | NM_020198.1 | 1 |
| 3024 | ncrc3856 | GK003 (GK003) | AF226046.1 | 1 |
| 3025 | ncrc5565 | GL002 protein (GL002) | NM_020193.1 | 1 |
| 3026 | SEOA0023 | golgi antigen gcp372 | D25542.1 | 1 |
| 3027 | hfcr7558 | GSTmu3 gene for a glutathione S-transferase Mu class protein | X56838.1 | 1 |
| 3028 | hfcr3729 | Gx protein | AF120103.1 | 1 |
| 3029 | SEOA5848 | hamartin (TSC1) | AF013168 | 1 |
| 3030 | miob6419 | haplotype D6 beta-globin (HBB) gene, replication origin initiation region and partial cds | AF186620.1 | 1 |
| 3031 | ncrc5245 | hBKLF for basic kruppel like factor (LOC51274) | NM_016531.1 | 1 |
| 3032 | ncrb3702 | HBV associated factor(XAP4) | NM_006462.1 | 1 |
| 3033 | ncr4790 | HC71C | AF177343.1 | 1 |
| 3034 | seoa0102m | hCDC10=CDC10 homolog | S72008 | 1 |
| 3035 | SEOA4398a | hcgVIII protein | X92110 | 1 |

Figure 6A – EST Names Corresponding to Unique Known Genes of Figure 6

| | | | | |
|---|---|---|---|---|
| 3036 | seoa7681a | HCMOGT-1 mRNA for sperm antigen, complete cds /cds=(144,2423) /gb=AB041533 /gi=10798803 /ug=Hs.15053 /len=2725 | Hs.15053 | 1 |
| 3037 | seob4079 | HDCMB12P | AF067802.1 | 1 |
| 3038 | ncrc8865 | HDCMC04P | AF067804.1 | 1 |
| 3039 | fcrb1380 | HDCMC28P protein (HDCMC28P) | NM_016649.1 | 1 |
| 3040 | ncr6841 | HELG protein (HELG) | NM_018412.1 | 1 |
| 3041 | ncr7789 | hematopoietic stem/progenitor cells protein MDS027 (MDS027), mRNA | NM_018462.1 | 1 |
| 3042 | hfcr2505 | HF.12 gene | X07290.1 | 1 |
| 3043 | ncrb2992 | HGTD-P (HGTD-P) (=E2IG5) | AF201944.1 | 1 |
| 3044 | FCR6811 | HIS1 protein | AB021179 | 1 |
| 3045 | FCR7667 | hMSH6 | U73737 | 1 |
| 3046 | mioa9630 | homolog of yeast mutL (hPMS1) gene | U13695.1 | 1 |
| 3047 | SEOA5544a | hook1 protein (69% aa) | AF044923 | 1 |
| 3048 | fcrb2552 | HOTTL protein mRNA, complete cds | AF078842.1 | 1 |
| 3049 | FCR5222 | HPBRII-4 | X67337 | 1 |
| 3050 | FCR2079 | hSLK (=D86959 hypothetical protein (KIAA0204)) | AB002804 | 1 |
| 3051 | ncrc5717 | HSPC006 | AF070662.1 | 1 |
| 3052 | fcrb2545 | HSPC009 protein (HSPC009), mRNA | NM_014019.1 | 1 |
| 3053 | SEOB1891 | HSPC028 | AF083246.1 | 1 |
| 3054 | ncrc6495 | HSPC030 | AF085359.1 | 1 |
| 3055 | SEOA4727a | HSPC031 mRNA,=CGI-37 protein (ORF) | AF085360 | 1 |
| 3056 | seob6558 | HSPC038 protein (LOC51123) | NM_016096.1 | 1 |
| 3057 | ncrc9159 | HSPC040 protein (RefSeq aa 1e-58) | NP_057182.1 | 1 |
| 3058 | MIOA3673a | HSPC042 protein (contains Alu repeat) | AF125096.1 | 1 |
| 3059 | hfcr6628 | HSPC049 protein (HSPC049) | NM_014149.1 | 1 |
| 3060 | SEOB2148 | HSPC055 protein (HSPC055) (=FLJ11007 fis) | NM_014153.1 | 1 |
| 3061 | ncrc3624 | HSPC056 protein (HSPC056) | NM_014154.1 | 1 |
| 3062 | hfcr0731 | HSPC059 protein (HSPC059) | NM_016536.1 | 1 |
| 3063 | SEOB0339 | HSPC071 | AF161556.1 | 1 |
| 3064 | ncrc2401 | HSPC092 | AF161355.1 | 1 |
| 3065 | ncrc2393 | HSPC093 (aa 9e-13,65%) | AAF28916.1 | 1 |
| 3066 | SEOB0008 | HSPC121 (=B-ind1 protein) | AAF29085.1 | 1 |
| 3067 | SEOA3694a | HSPC125 | AF161474 | 1 |
| 3068 | ncrb3317 | HSPC126 protein (RefSeq aa 4e-46) | NP_054885.1 | 1 |
| 3069 | ncrb7667 | HSPC140 (=SUMO-1-activating enzyme E1 N subunit (SUA1)) | AF161489.1 | 1 |
| 3070 | fcrb1489 | HSPC141 protein (HSPC141)(= sex-regulated protein janus-a mRNA) | XM_038043.1 | 1 |
| 3071 | ncr0859 | HSPC144 protein (RefSeq aa 1e-69) | NP_054893.1 | 1 |
| 3072 | hfcr0010 | HSPC145 | AF161494.1 | 1 |
| 3073 | MIOA8810 | HSPC151 | AAF29115.1 | 1 |
| 3074 | miob4037 | HSPC154 protein (HSPC154) | NM_014177.1 | 1 |
| 3075 | SEOB0375 | HSPC155 | AF161504.1 | 1 |
| 3076 | ncr4859 | HSPC160 protein (RefSeq aa 5e-77) | NP_054901.1 | 1 |
| 3077 | fcrb1801 | HSPC164 | XM_009549.4 | 1 |
| 3078 | ncrc0292 | HSPC173 mRNA, | AF161521.1 | 1 |
| 3079 | ncrb1519 | HSPC174 | AF161522.1 | 1 |
| 3080 | fcrb1940 | HSPC176 | AF161524.1 | 1 |
| 3081 | seoa6772 | HSPC177 | BC016698.1 | 1 |
| 3082 | ncr9108 | HSPC182 protein (HSPC182) | NM_014188.1 | 1 |

Figure 6A – EST Names Corresponding to Unique Known Genes of Figure 6

| | | | | |
|---|---|---|---|---|
| 3083 | SEOB2149 | HSPC184 | AF151018.1 | 1 |
| 3084 | ncr9324 | HSPC187 | AF151021.1 | 1 |
| 3085 | hfcr9283 | HSPC197 | AF151031.1 | 1 |
| 3086 | hfcr6243 | HSPC199 | AF151033.1 | 1 |
| 3087 | ncrb2108 | HSPC209 | AF151043.1 | 1 |
| 3088 | MIOA3471a | HSPC210 | AF151044 | 1 |
| 3089 | miob0167 | HSPC212 | AF151046.1 | 1 |
| 3090 | SEOB1748 | HSPC235 | AF151069.1 | 1 |
| 3091 | ncr5613 | HSPC240 | AF151074.1 | 1 |
| 3092 | SEOB0394 | HSPC245 | AF151079.1 | 1 |
| 3093 | SEOA8750 | HSPC261 (=DKFZp564B0769.1) | AAF28939.1 | 1 |
| 3094 | ncrc4383 | HSPC273 (=KIAA1192) | AF161391.1 | 1 |
| 3095 | ncrb4620 | HSPC274 protein (RefSeq aa 1e-38) | NP_054864.1 | 1 |
| 3096 | ncrc3927 | HSPC299 | AF161417.1 | 1 |
| 3097 | ncr8171 | HSPC301 | AF161419.1 | 1 |
| 3098 | ncrb5909 | HSPC306 | AF161424.1 | 1 |
| 3099 | ncrc9877 | HSPC311 | AF161429.1 | 1 |
| 3100 | SEOB1187 | HSPC331 (=SPF31) | AAF29009.1 | 1 |
| 3101 | fcrb0376 | HT002 protein (HT002) | NM_014066.1 | 1 |
| 3102 | HFCR3149 | HT015 protein (HT015) | AF223466.1 | 1 |
| 3103 | FCR0706 | HU-K4 | U60644 | 1 |
| 3104 | hfcr0963 | human homolog of a mouse imprinted gene | AB006625 | 1 |
| 3105 | ncrc6376 | HUT11 protein mRNA, partial 3' UTR | AF263545.1 | 1 |
| 3106 | ncrc8856 | hydroxyacyl-Coenzyme A dehydrogenase/3-ketoacyl-Coenzyme A thiolase/enoyl-Coenzyme A hydratase (trifunctional protein), beta subunit (HADHB) | NM_000183.1 | 1 |
| 3107 | ncr7595 | hypothalamus protein HBEX2 | XP_010123.1 | 1 |
| 3108 | SEOA7223a | hypothalamus protein HT001 (=AF225981 calcium transport ATPase ATP2C1) | AF113539 | 1 |
| 3109 | ncrc9055 | hypothetical brain protein similar to X96994 BR-1 protein (Helix pomatia) (LOC56412) | NM_019836.1 | 1 |
| 3110 | seoa1028m | hypothetical garp protein | CAB63561.1 | 1 |
| 3111 | seoa8075 | hypothetical gene (AK026938 (LOC91933)) | XM_041609.2 | 1 |
| 3112 | fcrb2150 | hypothetical gene (AL137319; NM_017586) (LOC115423) | XM_011838.3 | 1 |
| 3113 | fcr5736 | hypothetical gene (BC009875; BC014023 (LOC115010)) | XM_055021.1 | 1 |
| 3114 | fcrb2120 | hypothetical gene (LOC87167) | XM_016787.2 | 1 |
| 3115 | fcrb1451 | hypothetical gene (LOC87240) | XM_015947.2 | 1 |
| 3116 | fcrb2133 | hypothetical gene (LOC96648) | XM_055006.1 | 1 |
| 3117 | fcrb1345 | hypothetical gene AK023725 (LOC92923) | XM_048072.1 | 1 |
| 3118 | fcrb2307 | hypothetical gene supported by AF055004 (LOC93477), mRNA | XM_051593.3 | 1 |
| 3119 | fcrb2353 | hypothetical gene supported by AF132973; BC000589; BC009189; NM_015965 (LOC112763), mRNA | XM_048487.3 | 1 |
| 3120 | seoa4973a | hypothetical gene supported by AF267861; AK026650 (LOC88021), mRNA | XM_016170.4 | 1 |
| 3121 | seoa4964a | hypothetical gene supported by AK027830; AL137274 (LOC126897), mRNA | XM_072050.1 | 1 |
| 3122 | fcrb2693 | hypothetical gene supported by AL096738; BC013144 (LOC115576), | XM_047202.2 | 1 |

Figure 6A – EST Names Corresponding to Unique Known Genes of Figure 6

| | | | | |
|---|---|---|---|---|
| 3123 | fcrb2320 | hypothetical gene supported by AL137544 (LOC90025), mRNA | XM_028218.2 | 1 |
| 3124 | fcrb2350 | hypothetical gene supported by BC008765 (LOC130852), mRNA | XM_059474.1 | 1 |
| 3125 | fcrb2474 | hypothetical gene supported by BC009329 (LOC121573), mRNA | XM_071761.1 | 1 |
| 3126 | fcrb2305 | hypothetical gene supported by BC009875; BC014023 (LOC138327), mRNA | XM_072528.1 | 1 |
| 3127 | fcrb2331 | hypothetical gene supported by D38441; AF141383; BC000362; BC001826; NM_001640 (LOC95915), mRNA | XM_002828.5 | 1 |
| 3128 | fcr3149 | hypothetical gene supported by U60644 (LOC126527) | XM_047409.2 | 1 |
| 3129 | ncrc3706 | hypothetical gene supported by XM_000590 (LOC59176) | XM_000590.1 | 1 |
| 3130 | mioa7859 | hypothetical gene supported by XM_059059 (LOC126616), mRNA | XM_059059.1 | 1 |
| 3131 | seoa8017 | hypothetical gene supported by Y10313; BC001272; NM_001550 (LOC95049), mRNA | XM_011551.5 | 1 |
| 3132 | ncrc4218 | hypothetical protein | B34087 | 1 |
| 3133 | ncrc6741 | hypothetical protein | CAB43380.1 | 1 |
| 3134 | ncrc3596 | hypothetical protein | CAB55973.1 | 1 |
| 3135 | ncrc4875 | hypothetical protein | CAB70761.1 | 1 |
| 3136 | ncrc1168 | hypothetical protein (aa 2e-27) | NP_062551.1 | 1 |
| 3137 | fcrb2118 | hypothetical protein (CL25084) | XM_056548.1 | 1 |
| 3138 | seoa8161 | hypothetical protein (LOC51060), mRNA | XM_045762.1 | 1 |
| 3139 | seoa8108 | hypothetical protein (LOC51255), mRNA /cds=(0,461) /gb=NM_016494 /gi=7706038 /ug=Hs.11156 /len=462 | Hs.11156 | 1 |
| 3140 | ncrc6332 | hypothetical protein (LOC51315) | NM_016618.1 | 1 |
| 3141 | fcrb1580 | hypothetical protein (MGC4175) | XM_016063.2 | 1 |
| 3142 | fcrb1560 | hypothetical protein (MGC4415) | XM_050738.2 | 1 |
| 3143 | ncr7926 | Hypothetical protein (non-exact 37-54% a.a.) | NP_061952.1 | 1 |
| 3144 | mioa1183m | hypothetical protein (ORF)(48%) | AL050011 | 1 |
| 3145 | ncrc9947 | hypothetical protein (RefSeq aa 2e-38) | NP_056198.1 | 1 |
| 3146 | ncrc4996 | hypothetical protein (RefSeq aa 2e-60) | NP_057280.1 | 1 |
| 3147 | ncrc0573 | hypothetical protein (RefSeq aa 3e-61) | NP_056999.1 | 1 |
| 3148 | ncrc5907 | hypothetical protein (RefSeq aa 5e-50) | NP_057169.1 | 1 |
| 3149 | ncrc1593 | hypothetical protein (RefSeq aa 5e-63) | NP_056158.1 | 1 |
| 3150 | ncrb8383 | hypothetical protein (RefSeq aa 9e-33) | NP_057711.1 | 1 |
| 3151 | ncrc6015 | hypothetical protein (RefSeq aa 9e-43) | NP_057701.1 | 1 |
| 3152 | fcrb1775 | hypothetical protein (XP_029545) | XP_029545.1 | 1 |
| 3153 | ncrb7994 | hypothetical protein ASH1 (RefSeq aa 2e-68) | NP_060959.1 | 1 |
| 3154 | mioa0347m | hypothetical protein clone 24952 mRNA | AF131758 | 1 |
| 3155 | ncrc5310 | hypothetical protein HDCMC04P | XP_004843.1 | 1 |
| 3156 | fcrb2746 | hypothetical protein IMAGE3455200 (IMAGE3455200), mRNA | NM_024006.1 | 1 |
| 3157 | fcrb2460 | hypothetical protein MGC10753 (MGC10753), mRNA | NM_016628.1 | 1 |
| 3158 | seoa7983 | hypothetical protein MGC10947 (MGC10947), mRNA /cds=(906,1223) /gb=NM_032674 /gi=14249241 /ug=Hs.326740 /len=2090 | Hs.326740 | 1 |
| 3159 | mioa7637a | hypothetical protein MGC14433 (MGC14433), mRNA /cds=(174,326) /gb=NM_032904 /gi=14249675 /ug=Hs.83572 /len=1797 | Hs.83572 | 1 |

Figure 6A – EST Names Corresponding to Unique Known Genes of Figure 6

| | | | |
|---|---|---|---|
| 3160 fcrb2163 | hypothetical protein MGC14833 (MGC14833) | XM_042640.1 | 1 |
| 3161 seoa7856a | hypothetical protein MGC2217 (MGC2217), mRNA /cds=(192,449) /gb=NM_024300 /gi=13236525 /ug=Hs.323164 /len=1669 | Hs.323164 | 1 |
| 3162 fcrb2671 | hypothetical protein MGC2744, clone MGC:4371 IMAGE:2823004, mRNA, complete cds | BC019324.1 | 1 |
| 3163 seoa7049 | hypothetical protein MGC2827 (MGC2827), mRNA /cds=(189,935) /gb=NM_023940 /gi=13027611 /ug=Hs.8035 /len=1988 | Hs.8035 | 1 |
| 3164 fcrb2102 | hypothetical protein MGC3178 (MGC3178) | XM_037853.1 | 1 |
| 3165 fcrb2034 | hypothetical protein MGC3200 (MGC3200) | XM_034630.1 | 1 |
| 3166 seoa4929a | hypothetical protein MGC3251 (MGC3251), mRNA /cds=(93,797) /gb=NM_032016 /gi=14042926 /ug=Hs.13467 /len=1591 | Hs.13467 | 1 |
| 3167 fcrb1353 | hypothetical protein MGC4174 (MGC4174) | XM_018439.2 | 1 |
| 3168 fcrb2449 | hypothetical protein MGC5306 (MGC5306), mRNA | XM_048376.1 | 1 |
| 3169 mioa7650a | hypothetical protein similar to mouse Dnajl1 (DNAJL1), mRNA /cds=(202,1224) /gb=NM_022365 /gi=11641286 /ug=Hs.13015 /len=1350 | Hs.13015 | 1 |
| 3170 ncrc3165 | HYPOTHETICAL PROTEIN ZAP3 | P49750 | 1 |
| 3171 seoa4957a | hypothetical protein, clone MGC:19514 IMAGE:4040098, mRNA, complete cds | BC011720.1 | 1 |
| 3172 seoa4901a | hypothetical protein, clone MGC:20386 IMAGE:4564286, mRNA, complete cds | BC015919.1 | 1 |
| 3173 ncrb8569 | hypothetical protein, expressed in osteoblast (GS3686) | NM_006820.1 | 1 |
| 3174 mioa7844a | I factor (complement) (IF), mRNA /cds=(14,1765) /gb=NM_000204 /gi=4504578 /ug=Hs.36602 /len=1963 | Hs.36602 | 1 |
| 3175 ncrb3298 | ID YG39-2B | AJ227863.1 | 1 |
| 3176 ncrc9481 | IFI16b (IFI16b) | AF208043.1 | 1 |
| 3177 ncrc6994 | IkB kinase-b(IKK-beta) mRNA, complete cds | AF080158.1 | 1 |
| 3178 ncr4680 | IL0-CT0080-030899-107-c07 CT0080 | AW062569.1 | 1 |
| 3179 seoa8050 | I-mfa domain-containing protein (HIC), mRNA | XM_041273.1 | 1 |
| 3180 MIOA9007 | implantation-associated protein (IAG2) (ORF) | AF008554 | 1 |
| 3181 SEOB0625 | INE2 | Y10697.1 | 1 |
| 3182 ncr9961 | infant brain mRNA, clone 13cDNA65 | U57962.1 | 1 |
| 3183 SEOA5833 | ING1Lp | AB012853.1 | 1 |
| 3184 FCR5123 | inner mitochondrial membrane translocase Tim1+D23777b, nuclear gene encoding mitochondrial protein (=AF077039) | AF034790 | 1 |
| 3185 seob5812 | insulin induced gene 1 (INSIG1) | NM_005542.1 | 1 |
| 3186 hfcr3552 | integrative vector pRS306 with URA3 marker, complete sequence | U03438.1 | 1 |
| 3187 ncrb0299 | interferon-induced, hepatitis C-associated microtubular aggregate protein (44kD) (MTAP44) | NM_006417.1 | 1 |
| 3188 ncr1802 | intracisternal A particle-promoted polypeptide (IPP) | NM_005897.1 | 1 |
| 3189 seoa4925a | IRA1 mRNA, complete cds, alternatively spliced /cds=(160,1704) /gb=AF268193 /gi=12006103 /ug=Hs.315111 /len=3885 | Hs.315111 | 1 |
| 3190 hfcr7411 | Isoform 1 from chromosome 22 | AL359401.1 | 1 |

Figure 6A – EST Names Corresponding to Unique Known Genes of Figure 6

| | | | |
|---|---|---|---|
| 3191 hfcr9573 | isoform 2 of a novel human mRNA from chromosome 22(=Isoform 1 of a novel human mRNA from chromosome 22) | AL160112.1 | 1 |
| 3192 hfcr3893 | ITBA2 protein(ORF) | X92896.1 | 1 |
| 3193 MIOA8594 | J domain containing protein 1 isoform a | AAD52650.1 | 1 |
| 3194 fcrb2156 | JAZF1 (JJAZ1) | XM_050093.1 | 1 |
| 3195 seob4537 | jerky (mouse) homolog-like (JRKL) | NM_003772.1 | 1 |
| 3196 ncr3587 | kappa B-ras | AF229839.1 | 1 |
| 3197 SEOB0034 | KFZp586B1821 | AL133114.1 | 1 |
| 3198 SEOA0353 | KH domain RNA binding protein QKI-5B | AF090403.1 | 1 |
| 3199 FCR4566 | KIAA0008 | D13633 | 1 |
| 3200 SEOB1269 | KIAA0013 | D87717.1 | 1 |
| 3201 ncrc6749 | KIAA0020 gene product (KIAA0020) | NM_014878.1 | 1 |
| 3202 SEOA7926a | KIAA0029 | D21852 | 1 |
| 3203 MIOB1520 | KIAA0033 | D26067.1 | 1 |
| 3204 ncrb8204 | KIAA0035 gene | D21262.1 | 1 |
| 3205 ncrc0829 | KIAA0051 gene | D29640.1 | 1 |
| 3206 ncrb8638 | KIAA0052 protein, partial cds | D29641.2 | 1 |
| 3207 seob5711 | KIAA0063 gene product (KIAA0063) | NM_014876.1 | 1 |
| 3208 ncrc1595 | KIAA0078 gene | D38551.1 | 1 |
| 3209 hfcr8902 | KIAA0088 gene, partial cds | D42041.1 | 1 |
| 3210 ncr1523 | KIAA0089 gene | D42047.1 | 1 |
| 3211 hfcr9122 | KIAA0091 gene | D42053.1 | 1 |
| 3212 FCR1992 | KIAA0096 | D43636 | 1 |
| 3213 MIOA3503a | KIAA0098 (chaperonin containing TCP-1) | D43950 | 1 |
| 3214 FCR4376 | KIAA0101 | D14657 | 1 |
| 3215 seoa0993m | KIAA0108 (golgi 4-transmembrane spanning transporter MTP) | D14696 | 1 |
| 3216 ncr6142 | KIAA0109 gene | D63475.1 | 1 |
| 3217 FCR6801 | KIAA0110 | D14811 | 1 |
| 3218 fcrb2054 | KIAA0123 protein (KIAA0123) | XM_054752.1 | 1 |
| 3219 FCR0419 | KIAA0150 | D63484 | 1 |
| 3220 FCR2220 | KIAA0154 | D63876 | 1 |
| 3221 ncrb3363 | KIAA0157 gene, partial | D63877.1 | 1 |
| 3222 ncrc3121 | KIAA0171 gene product (KIAA0171) | NM_014666.1 | 1 |
| 3223 MIOA2696a | KIAA0184 | D80006 | 1 |
| 3224 ncr5488 | KIAA0190 gene | D80012.1 | 1 |
| 3225 seob5100 | KIAA0193 gene product (KIAA0193) | NM_014766.1 | 1 |
| 3226 SEOA4128a | KIAA0197 gene | D83781 | 1 |
| 3227 hfcr7277 | KIAA0200 gene | NM_014757.1 | 1 |
| 3228 hfcr7098 | KIAA0220 | D86974.1 | 1 |
| 3229 hfcr1793 | KIAA0224 | NM_014003.1 | 1 |
| 3230 MIOA1049 | KIAA0240 | D87077 | 1 |
| 3231 seoa8018 | KIAA0247 gene product (KIAA0247), mRNA /cds=(268,1179) /gb=NM_014734 /gi=7662019 /ug=Hs.82426 /len=5338 | Hs.82426 | 1 |
| 3232 ncrb8515 | KIAA0257 gene, partial cds | D87446.1 | 1 |
| 3233 ncr3313 | KIAA0259 | D87448.1 | 1 |
| 3234 fcrb1635 | KIAA0263 protein | D87452.1 | 1 |
| 3235 ncr3016 | KIAA0268 gene | D87742.1 | 1 |
| 3236 ncr7712 | KIAA0271 gene | D87461 | 1 |

Figure 6A – EST Names Corresponding to Unique Known Genes of Figure 6

| | | | | |
|---|---|---|---|---|
| 3237 | seoa6776 | KIAA0280 gene, partial cds /cds=UNKNOWN /gb=D87470 /gi=1665822 /ug=Hs.75400 /len=6837 | Hs.75400 | 1 |
| 3238 | SEOA9690 | KIAA0281 gene product | NM_014800.1 | 1 |
| 3239 | ncr1982 | KIAA0286 gene | AB006624.1 | 1 |
| 3240 | ncr3258 | KIAA0290 (non-exact match 80% a.a.) | BAA22959.1 | 1 |
| 3241 | miob1126 | KIAA0294 | NM_014629.1 | 1 |
| 3242 | seob6871 | KIAA0297 gene | AB002295.1 | 1 |
| 3243 | ncr7456 | KIAA0301 gene | AB002299.1 | 1 |
| 3244 | ncr4590 | KIAA0305 gene product (RefSeq aa 2e-32) | NP_055548.1 | 1 |
| 3245 | hfcr9170 | KIAA0323 gene | AB002321.1 | 1 |
| 3246 | FCR1204 | KIAA0337 | AB002335 | 1 |
| 3247 | FCR4727 | KIAA0361 | AB002359 | 1 |
| 3248 | FCR3389 | KIAA0365 | AB002363 | 1 |
| 3249 | seob8196 | KIAA0367 | AB002365.1 | 1 |
| 3250 | MIOB1493 | KIAA0373 | AB002371.1 | 1 |
| 3251 | ncr1550 | KIAA0391 gene product (RefSeq aa 2e-31) | NP_055487.1 | 1 |
| 3252 | hfcr8485 | KIAA0393 | AB002391.2 | 1 |
| 3253 | SEOB0783a | KIAA0395 | AB007855.1 | 1 |
| 3254 | fcrb1945 | KIAA0397 gene product (KIAA0397) | XM_029438.1 | 1 |
| 3255 | ncrc4654 | KIAA0399 | AB007859.2 | 1 |
| 3256 | FCR2641 | KIAA0402 | AB007862 | 1 |
| 3257 | FCR6224 | KIAA0405 | AB007865 | 1 |
| 3258 | hfcr6689 | KIAA0407 | AB007867.1 | 1 |
| 3259 | ncrc4399 | KIAA0409 | AB007869.1 | 1 |
| 3260 | SEOA4055 | KIAA0416 | AB007876 | 1 |
| 3261 | hfcr9090 | KIAA0418 gene | NM_014631.1 | 1 |
| 3262 | MIOA6690a | KIAA0430 | AB007890 | 1 |
| 3263 | FCR5679 | KIAA0437 | AB007897 | 1 |
| 3264 | SEOA1080a | KIAA0441 | AB007901 | 1 |
| 3265 | ncrc2796 | KIAA0442 | AB007902.1 | 1 |
| 3266 | FCR6876 | KIAA0445 | AB007914 | 1 |
| 3267 | MIOA8742 | KIAA0469 | AB007938 | 1 |
| 3268 | MIOA9025 | KIAA0473 gene product | NM_014787.1 | 1 |
| 3269 | FCR4804 | KIAA0487 chromosome 1 specific transCRipt) | AB007956 | 1 |
| 3270 | ncr7136 | KIAA0494 | NM_014774.1 | 1 |
| 3271 | SEOA9377 | KIAA0511 protein | AB011083 | 1 |
| 3272 | MIOA8733 | KIAA0516 | BAA25442.1 | 1 |
| 3273 | seob7463 | KIAA0517 protein | AB011089.1 | 1 |
| 3274 | ncr7815 | KIAA0518 (=mouse Mad5) | AB011090.1 | 1 |
| 3275 | FCR6427 | KIAA0524 | AB011096 | 1 |
| 3276 | SEOB1968 | KIAA0528 | AB011100.2 | 1 |
| 3277 | FCR6691 | KIAA0529 | AB011101 | 1 |
| 3278 | seob6008 | KIAA0532 | AB011104.1 | 1 |
| 3279 | SEOA1559 | KIAA0536 | AB011108 | 1 |
| 3280 | ncrc2701 | KIAA0538 protein, partial cds | AB011110.2 | 1 |
| 3281 | SEOA9160 | KIAA0549 protein | AB011121 | 1 |
| 3282 | MIOA8872 | KIAA0554 (=DKFZp564O1116) | AB011126 | 1 |
| 3283 | MIOA7215a | KIAA0565 | AB011137 | 1 |
| 3284 | SEOB0241 | KIAA0584 | AB011156.1 | 1 |
| 3285 | FCR3593 | KIAA0593 | AB011165 | 1 |
| 3286 | hfcr6541 | KIAA0601 | AB011173.1 | 1 |
| 3287 | FCR5630 | KIAA0608 | AB011180 | 1 |

Figure 6A – EST Names Corresponding to Unique Known Genes of Figure 6

| | | | | |
|---|---|---|---|---|
| 3288 | MIOA5427a | KIAA0614 | AB014514 | 1 |
| 3289 | FCR1555 | KIAA0615 | AB014515 | 1 |
| 3290 | miob5967 | KIAA0621 | NM_015071.1 | 1 |
| 3291 | ncrc5061 | KIAA0625 | AB014525.1 | 1 |
| 3292 | ncrb7657 | KIAA0627 protein | AB014527.1 | 1 |
| 3293 | SEOA1803a | KIAA0628 | AB014528 | 1 |
| 3294 | MIOA8275 | KIAA0643 | AB014543 | 1 |
| 3295 | FCR3445 | KIAA0644 | AB014544 | 1 |
| 3296 | seob6066 | KIAA0647 protein | AB014547.1 | 1 |
| 3297 | FCR3857 | KIAA0649 (=L11910 retinoblastoma susceptibility gene) | AB014549 | 1 |
| 3298 | ncr6148 | KIAA0650 | AB014550.1 | 1 |
| 3299 | FCR0291 | KIAA0652 | AB014552 | 1 |
| 3300 | hfcr0717 | KIAA0657 protein | AB014557.1 | 1 |
| 3301 | ncr2700 | KIAA0658 | AB014558 | 1 |
| 3302 | ncrb0664 | KIAA0668 protein | AB014568.1 | 1 |
| 3303 | FCR7684 | KIAA0669 | AB014569 | 1 |
| 3304 | mioa9523 | KIAA0677 gene product (KIAA0677) | NM_014663.1 | 1 |
| 3305 | SEOA9538 | KIAA0678 | AB014578 | 1 |
| 3306 | seob4584 | KIAA0690 protein | AB014590.1 | 1 |
| 3307 | fcrb2257 | KIAA0700 protein (KIAA0700) | XM_050561.2 | 1 |
| 3308 | mioa7728a | KIAA0707 protein, partial cds /cds=UNKNOWN /gb=AB014607 /gi=3327227 /ug=Hs.234786 /len=6359 | Hs.234786 | 1 |
| 3309 | MIOA0937 | KIAA0714 | AB018257.1 | 1 |
| 3310 | MIOA8925 | KIAA0721 | AB018264.1 | 1 |
| 3311 | hfcr6501 | KIAA0726 | NM_014718.1 | 1 |
| 3312 | ncr0761 | KIAA0733 | AB018276.1 | 1 |
| 3313 | FCR5029 | KIAA0737 | AB018280 | 1 |
| 3314 | ncr3391 | KIAA0742 | AB018285.1 | 1 |
| 3315 | fcrb2169 | KIAA0752 protein (KIAA0752) | XM_040324.1 | 1 |
| 3316 | mioa9804 | KIAA0758 protein | AB018301 | 1 |
| 3317 | hfcr2148 | KIAA0764 | NM_014860.1 | 1 |
| 3318 | hfcr3435 | KIAA0774 | AB018317.1 | 1 |
| 3319 | miob3465 | KIAA0781 | AB018324.1 | 1 |
| 3320 | SEOA8239 | KIAA0784 | AB018327.1 | 1 |
| 3321 | ncr8153 | KIAA0788 | AB018331.1 | 1 |
| 3322 | ncrb0773 | KIAA0790 protein | AB018333.1 | 1 |
| 3323 | fcrb2738 | KIAA0795 protein (KIAA0795), mRNA | XM_016166.3 | 1 |
| 3324 | ncrb4536 | KIAA0798 gene product (KIAA0798) | NM_014650.1 | 1 |
| 3325 | ncrc9530 | KIAA0801 gene product (RefSeq aa 3e-73) | NP_055644.1 | 1 |
| 3326 | ncrc5405 | KIAA0823 protein, partial cds | AB020630.1 | 1 |
| 3327 | seob5423 | KIAA0826 | AB020633 | 1 |
| 3328 | SEOA0116 | KIAA0831 | AB020638.1 | 1 |
| 3329 | ncrb1314 | KIAA0836 protein | AB020643.1 | 1 |
| 3330 | hfcr4063 | KIAA0840 protein | AB020647.1 | 1 |
| 3331 | ncrc9351 | KIAA0856 | AB020663.1 | 1 |
| 3332 | seob4545 | KIAA0857 protein (=DKFZp434H018) | AB020664.1 | 1 |
| 3333 | ncrb8091 | KIAA0859 | AB020666.2 | 1 |
| 3334 | FCR4592 | KIAA0860 | AB020667 | 1 |
| 3335 | ncrb2131 | KIAA0866 protein | AB020673.1 | 1 |
| 3336 | miob0189 | KIAA0867 | NM_014938.1 | 1 |

Figure 6A – EST Names Corresponding to Unique Known Genes of Figure 6

| | | | |
|---|---|---|---|
| 3337 ncrc7173 | KIAA0874 | AB020681.1 | 1 |
| 3338 SEOA3633a | KIAA0878 (contains Alu repeat) | AB020685.1 | 1 |
| 3339 SEOB1411 | KIAA0879 protein (KIAA0879) | NM_014936.1 | 1 |
| 3340 SEOA4783a | KIAA0883 | AB020690 | 1 |
| 3341 ncrc0090 | KIAA0887 protein, | AB020694.1 | 1 |
| 3342 seob1054 | KIAA0890 protein (KIAA0890) | NM_014966.1 | 1 |
| 3343 hfcr2740 | KIAA0892 | AB020699.1 | 1 |
| 3344 MIOA2172a | KIAA0898 | AB020705.1 | 1 |
| 3345 hfcr7808 | KIAA0908 protein | AB020715.1 | 1 |
| 3346 ncr5822 | KIAA0912 | AB020719.1 | 1 |
| 3347 hfcr0237 | KIAA0922 | AB023139.1 | 1 |
| 3348 SEOA6172a | KIAA0923 | AB023140.1 | 1 |
| 3349 MIOA9103 | KIAA0926 protein (KIAA0926), | NM_014922.1 | 1 |
| 3350 HFCR2391 | KIAA0937 | AB023154.1 | 1 |
| 3351 ncrc4139 | KIAA0940 protein (RefSeq aa 3e-75) | NP_055727.1 | 1 |
| 3352 SEOA5525a | KIAA0941 | AB023158.1 | 1 |
| 3353 hfcr8533 | KIAA0946 | AB023163.1 | 1 |
| 3354 SEOB2242 | KIAA0949 | AB023166.1 | 1 |
| 3355 SEOA9921 | KIAA0951 protein (KIAA0951), | NM_014893.1 | 1 |
| 3356 ncrb5233 | KIAA0957 protein (RefSeq aa 1e-33) | NP_055757.1 | 1 |
| 3357 hfcr6626 | KIAA0961 protein | NM_014898.1 | 1 |
| 3358 hfcr0270 | KIAA0962(=DKFZp564D022) | AB023179.1 | 1 |
| 3359 fcrb1168 | KIAA0974 | AB023191 | 1 |
| 3360 ncrc2807 | KIAA0979 protein | BAA76823.1 | 1 |
| 3361 mioa9788 | KIAA0980 | AB023197 | 1 |
| 3362 SEOA9099 | KIAA0981 | AB023198.1 | 1 |
| 3363 seob7668 | KIAA0996 | NM_014934.1 | 1 |
| 3364 ncrc1578 | KIAA1007 protein (KIAA1007) | NM_016284.1 | 1 |
| 3365 MIOA2423a | KIAA1018 | AB023235.1 | 1 |
| 3366 ncr1503 | KIAA1023 | AB028946 | 1 |
| 3367 SEOA7186a | KIAA1028 | AB028951.1 | 1 |
| 3368 SEOB0466 | KIAA1031 | AB028954.1 | 1 |
| 3369 hfcr7739 | KIAA1041 | NM_014947.1 | 1 |
| 3370 SEOA5933 | KIAA1042 | AB028965.1 | 1 |
| 3371 ncr0806 | KIAA1044 | AB028967.1 | 1 |
| 3372 ncrb2125 | KIAA1046 protein (KIAA1046) | NM_014928.1 | 1 |
| 3373 SEOB0122 | KIAA1049 | AB028972.1 | 1 |
| 3374 MIOA2783a | KIAA1050 | AB028973.1 | 1 |
| 3375 hfcr3011 | KIAA1055 | AB028978.1 | 1 |
| 3376 SEOA1365 | KIAA1057 | AB028980.1 | 1 |
| 3377 hfcr5620 | KIAA1067 | AB028990.1 | 1 |
| 3378 MIOA1068 | KIAA1071 | AB028994.1 | 1 |
| 3379 hfcr8052 | KIAA1075 protein | AB028998.1 | 1 |
| 3380 ncrb3574 | KIAA1078 protein, | AB029001.1 | 1 |
| 3381 ncr7037 | KIAA1085 | AB029008.1 | 1 |
| 3382 MIOA2995a | KIAA1093 | AB029016.1 | 1 |
| 3383 ncrc6856 | KIAA1095 protein, partial cds | AB029018.1 | 1 |
| 3384 SEOA6315 | KIAA1097 | AB029020.1 | 1 |
| 3385 ncrc9436 | KIAA1098 protein | AB029021.1 | 1 |
| 3386 ncrb4175 | KIAA1099 protein (KIAA1099) | NM_014914.1 | 1 |
| 3387 MIOA3773 | KIAA1109 | AB029032.1 | 1 |
| 3388 fcrb2145 | KIAA1110 protein | AB029033.1 | 1 |

Figure 6A – EST Names Corresponding to Unique Known Genes of Figure 6

| | | | | |
|---|---|---|---|---|
| 3389 | hfcr5797 | KIAA1114 protein (KIAA1114) | NM_016157.1 | 1 |
| 3390 | ncrb3942 | KIAA1116 protein (KIAA1116) | NM_014892.1 | 1 |
| 3391 | ncr3677 | KIAA1119 protein | AB032945.1 | 1 |
| 3392 | seob4002 | KIAA1122 | AB032948 | 1 |
| 3393 | ncr0662 | KIAA1124 | AK000716.1 | 1 |
| 3394 | ncrc9421 | KIAA1143 protein | AB032969.1 | 1 |
| 3395 | ncrc9044 | KIAA1146 | AB032972.1 | 1 |
| 3396 | miob3124 | KIAA1147 protein | AB032973.1 | 1 |
| 3397 | MIOB2601 | KIAA1151 | AB032977.1 | 1 |
| 3398 | ncr7168 | KIAA1156 | AB032982.1 | 1 |
| 3399 | ncrb8715 | KIAA1164 protein, partial cds | AB032990.1 | 1 |
| 3400 | ncr0594 | KIAA1165 | AB032991.1 | 1 |
| 3401 | ncrb7194 | KIAA1178 | AB033004.1 | 1 |
| 3402 | ncrc1949 | KIAA1179 | AB033005.1 | 1 |
| 3403 | hfcr2584 | KIAA1180 | AB033006.1 | 1 |
| 3404 | hfcr8837 | KIAA1187 protein | AB033013.1 | 1 |
| 3405 | ncrc0178 | KIAA1197 protein, partial cds | AB033023.1 | 1 |
| 3406 | mioa9398 | KIAA1213 (low match) | AB033039 | 1 |
| 3407 | MIOA8314 | KIAA1214 | BAA86528.1 | 1 |
| 3408 | miob0207 | KIAA1218 | AB033044.1 | 1 |
| 3409 | ncrb7635 | KIAA1224 | AB033050.1 | 1 |
| 3410 | seob7549 | KIAA1229 | AB033055.1 | 1 |
| 3411 | ncrb2847 | KIAA1233 protein | AB033059.1 | 1 |
| 3412 | SEOB0892a | KIAA1235 | AB033061.1 | 1 |
| 3413 | hfcr7762 | KIAA1242 | AB033068.1 | 1 |
| 3414 | seoa4945a | KIAA1243 protein, partial cds /cds=UNKNOWN /gb=AB033069 /gi=6330811 /ug=Hs.151076 /len=6384 | Hs.151076 | 1 |
| 3415 | fcrb1161 | KIAA1255 (ANKHZN) | AB033081 | 1 |
| 3416 | hfcr6255 | KIAA1274 | AB033100.1 | 1 |
| 3417 | ncrb2119 | KIAA1279 protein | AB033105.1 | 1 |
| 3418 | ncrc2868 | KIAA1283 | AB033109.1 | 1 |
| 3419 | hfcr7003 | KIAA1294 | AB037715.1 | 1 |
| 3420 | hfcr5254 | KIAA1306 | AB037727.1 | 1 |
| 3421 | fcrb1229 | KIAA1308 | AB037729 | 1 |
| 3422 | ncrc6556 | KIAA1320 | AB037741.1 | 1 |
| 3423 | miob1371 | KIAA1323 | AB037744.1 | 1 |
| 3424 | ncrc4344 | KIAA1327 | AB037748.1 | 1 |
| 3425 | ncr7919 | KIAA1328 protein | AB037749.1 | 1 |
| 3426 | seob4822 | KIAA1332 | AB037753.1 | 1 |
| 3427 | SEOA8696 | KIAA1333 | AB037754.1 | 1 |
| 3428 | hfcr0560 | KIAA1335 | AB037756.1 | 1 |
| 3429 | ncr4436 | KIAA1343 | AB037764.1 | 1 |
| 3430 | SEOA8923 | KIAA1344 | AB037765.1 | 1 |
| 3431 | ncr2288 | KIAA1352 | AB037773.1 | 1 |
| 3432 | fcrb1663 | KIAA1353 protein (KIAA1353) | XM_035589.1 | 1 |
| 3433 | hfcr5114 | KIAA1360 | AB037781.1 | 1 |
| 3434 | hfcr8557 | KIAA1365 | AB037786.1 | 1 |
| 3435 | ncrc3100 | KIAA1367 | AB037788.1 | 1 |
| 3436 | MIOA8948 | KIAA1373 | AB037794.1 | 1 |
| 3437 | hfcr3756 | KIAA1375 (PDCD6IP) | AB037796 | 1 |
| 3438 | ncrb6656 | KIAA1390protein | AB037811.1 | 1 |

Figure 6A – EST Names Corresponding to Unique Known Genes of Figure 6

| | | | | |
|---|---|---|---|---|
| 3439 | hfcr0624 | KIAA1400 protein | AB037821.1 | 1 |
| 3440 | seob4273 | KIAA1403 | AB037824 | 1 |
| 3441 | hfcr5865 | KIAA1408 protein | AB037829.1 | 1 |
| 3442 | ncr9373 | KIAA1412 protein | AB037833.1 | 1 |
| 3443 | ncr3961 | KIAA1415 protein | AB037836.1 | 1 |
| 3444 | fcrb1904 | KIAA1417 | AB037838.1 | 1 |
| 3445 | hfcr9821 | KIAA1419 protein | AB037840.1 | 1 |
| 3446 | ncr5746 | KIAA1421 protein | AB037842.1 | 1 |
| 3447 | seob8216 | KIAA1430 | AB037851.1 | 1 |
| 3448 | SEOB1140 | KIAA1432 | AB037853.1 | 1 |
| 3449 | ncrb4076 | KIAA1434 protein | AB037855.1 | 1 |
| 3450 | hfcr6640 | KIAA1435 | AB037856.1 | 1 |
| 3451 | hfcr9729 | KIAA1440 protein | AB037861.1 | 1 |
| 3452 | mioa9709 | KIAA1454 protein | AB040887.1 | 1 |
| 3453 | hfcr7706 | KIAA1460 | AB040893.1 | 1 |
| 3454 | seob4263 | KIAA1461 (ORF) | AB040894 | 1 |
| 3455 | ncr4368 | KIAA1462 | AB040895.1 | 1 |
| 3456 | hfcr2960 | KIAA1463 | AB040896.1 | 1 |
| 3457 | seob7180 | KIAA1472 | AB040905.1 | 1 |
| 3458 | seob5761 | KIAA1476 protein (=NM_013450.1 BAZ2B) | AB040909.1 | 1 |
| 3459 | hfcr6376 | KIAA1478 | AB040911.1 | 1 |
| 3460 | fcrb1930 | KIAA1483 protein (KIAA1483) | XM_045920.1 | 1 |
| 3461 | hfcr9586 | KIAA1495 protein | AB040928.1 | 1 |
| 3462 | hfcr3404 | KIAA1497 | AB040930.1 | 1 |
| 3463 | seob4383 | KIAA1521 | AB040954 | 1 |
| 3464 | fcrb1439 | KIAA1528 protein (KIAA1528) | XM_055933.1 | 1 |
| 3465 | seob4147 | KIAA1533 protein | AB040966.1 | 1 |
| 3466 | ncr1941 | KIAA1537 | AB040970.1 | 1 |
| 3467 | ncrb7394 | KIAA1538 protein | AB040971.1 | 1 |
| 3468 | ncrb3700 | KIAA1558 | AB046778 | 1 |
| 3469 | ncrb7376 | KIAA1562 protein | AB046782.1 | 1 |
| 3470 | ncrc4164 | KIAA1565 protein, partial cds | AB046785.1 | 1 |
| 3471 | ncrb4440 | KIAA1571 | AB046791.1 | 1 |
| 3472 | seoa7790a | KIAA1572 protein, partial cds /cds=UNKNOWN /gb=AB046792 /gi=10047208 /ug=Hs.5638 /len=5609 | Hs.5638 | 1 |
| 3473 | SEOB0652 | KIAA1573 | AB046793 | 1 |
| 3474 | ncrb1456 | KIAA1578 protein | AB046798.1 | 1 |
| 3475 | ncr7737 | KIAA1590, low match | AB046810 | 1 |
| 3476 | ncrb6661 | KIAA1597 | AB046817.1 | 1 |
| 3477 | ncrc0187 | KIAA1600 protein, | AB046820.1 | 1 |
| 3478 | ncrb3624 | KIAA1604 protein | AB046824 | 1 |
| 3479 | ncrc4069 | KIAA1624 protein, partial cds | AB046844.1 | 1 |
| 3480 | ncr6107 | KIAA1641 | AB046861.1 | 1 |
| 3481 | ncr3957 | KIAA1655 | AK000711.1 | 1 |
| 3482 | seoa4930a | KIAA1790 protein, partial cds /cds=UNKNOWN /gb=AB058693 /gi=14017796 /ug=Hs.57760 /len=5370 | Hs.57760 | 1 |
| 3483 | fcr3140 | KIAA1863 protein (KIAA1863) | XM_036104.2 | 1 |
| 3484 | fcrb2144 | KIAA1870 protein (KIAA1870) | XM_027025.2 | 1 |
| 3485 | SEOB1574 | kiaa-iso protein | AAF17242.1 | 1 |
| 3486 | hfcr5531 | KIP gene | AB021866.1 | 1 |
| 3487 | FCR2484 | KNP-Ia (=U53007 GT335) | D86061 | 1 |

Figure 6A – EST Names Corresponding to Unique Known Genes of Figure 6

| | | | |
|---|---|---|---|
| 3488 fcrb2396 | Ksp37 protein (KSP37), mRNA | NM_031950.1 | 1 |
| 3489 MIOA2183a | Ku70-binding protein (low match) | AF078528 | 1 |
| 3490 MIOA6722a | Kunitz-type protease inhibitor (kop) | AF027205 | 1 |
| 3491 ncrc5052 | L1 repeat, Tf subfamily, member 18 | NP_038602.1 | 1 |
| 3492 ncrc6907 | L1 repeat, Tf subfamily, member 26 | NP_038604.1 | 1 |
| 3493 seoa7775a | latexin protein (LXN), mRNA /cds=(151,819) /gb=NM_020169 /gi=9910395 /ug=Hs.109276 /len=1049 | Hs.109276 | 1 |
| 3494 SEOA4184a | LCN1b gene | Y10826 | 1 |
| 3495 ncr3968 | LDC4 (=HSPC243) | AF247661.1 | 1 |
| 3496 miob1833 | Leman coiled-coil protein (LCCP) (=AB023206.1 KIAA0989) | NM_016201.1 | 1 |
| 3497 FCR1633 | LEYDIG CELL TUMOR 10 KD PROTEIN | spQ05310 | 1 |
| 3498 seob7346 | ligase IV, DNA, ATP-dependent (LIG4) | NM_002312.1 | 1 |
| 3499 MIOA5599a | LIMULUS CLOTTING FACTOR C PRECURSOR (39%aa) | P28175 | 1 |
| 3500 FCR6044 | lin-7-A | AF090133 | 1 |
| 3501 ncr1318 | line-1 protein ORF1 - =M19503) ORF1; putative=(U93570) p40 | A28096 | 1 |
| 3502 ncr8272 | loss of heterozygosity, 11, chromosomal region 2, gene A (LOH11CR2A) (bcsc-1) | NM_014622.1 | 1 |
| 3503 miob3426 | lost in inflammatory breast cancer tumor suppressor protein (LIBC) | AF143679.1 | 1 |
| 3504 seob3904 | LPS-induced TNF-alpha factor (PIG7) mRNA | NM_004862.1 | 1 |
| 3505 hfcr9387 | m6A methyltransferase (MT-A70) gene | AF014837.1 | 1 |
| 3506 ncrb0220 | m6b1 | AF016004.1 | 1 |
| 3507 SEOA4425a | maCRophage inflammatory protein-2alpha (MIP2alpha) | X53799 | 1 |
| 3508 fcrb2203 | macrophage myristoylated alanine-rich C kinase substrate (MACMARCKS) | XM_034535.1 | 1 |
| 3509 seob6570 | match to AA908753 (NID:g3048158) | AAC83082.1 | 1 |
| 3510 seob4039 | Mcl-1 (MCL-1) and Mcl-1 delta S/TM (MCL-1) genes | AF198614.1 | 1 |
| 3511 ncrb6640 | MDS024(MDS024) | AF182423.1 | 1 |
| 3512 SEOA4333 | MEGF2 | AB011536 | 1 |
| 3513 SEOA8906 | MEGF5 | AB011538.1 | 1 |
| 3514 fcrb0132 | MEGF6 | AB011539. | 1 |
| 3515 seob4451 | melanogaster TEP2 protein [Drosophila melanogaster] | AJ269539 | 1 |
| 3516 fcrb2262 | Melanoma associated gene (D2S448) | XM_056455.1 | 1 |
| 3517 SEOA1400 | melanoma-associated antigen p97 (melanotransferrin) | K03200 | 1 |
| 3518 MIOA4057a | melastatin 1 (70% aa) | AF071787 | 1 |
| 3519 MIOA4987a | membrane protein type II, (low match) clone:HP10481 | AB015633 | 1 |
| 3520 ncrc9491 | meningioma expressed antigen 6(coiled-coil proline-rich) (RefSeq aa 2e-33) | NP_005921.1 | 1 |
| 3521 SEOA4012a | meningioma-expressed antigen 11 (MEA11) | U73682 | 1 |
| 3522 SEOA5717a | meningioma-expressed antigen 6 (MEA6) | U94780 | 1 |
| 3523 MIOA1885a | merosin | M59832 | 1 |
| 3524 hfcr3511 | mesenchymal stem cell protein DSC54 (LOC51334)= AF242769.1 | M_016644.1 | 1 |
| 3525 ncrc1393 | metastasis associated 1 (MTA1) | NM_004689.1 | 1 |
| 3526 FCR0571 | miCRosatellite sequence INRA095 | X71569 | 1 |

Figure 6A – EST Names Corresponding to Unique Known Genes of Figure 6

| | | | | |
|---|---|---|---|---|
| 3527 | MIOA3611a | miCRosatellite VNTR DNA | L07935 | 1 |
| 3528 | FCR6018 | MLN51 | X80199 | 1 |
| 3529 | FCR1984 | MLN62 | X80200 | 1 |
| 3530 | SEOA9065 | Mm-1 cell derived transplantability-associated 1b (hMmTRA1b) | NM_021105.1 | 1 |
| 3531 | ncrc9268 | MpV17 transgene, murine homolog, glomerulosclerosis (MPV17) | NM_002437.1 | 1 |
| 3532 | fcrb1477 | mRNA similar to rat myomegalin | AB042557.1 | 1 |
| 3533 | ncrc4759 | MSTP031 | AAG39282.1 | 1 |
| 3534 | fcrb1381 | MSTP033 protein (MSTP033) | XM_029351.1 | 1 |
| 3535 | SEOB1420 | MUF1 protein (MUF1) | NM_006369.1 | 1 |
| 3536 | ncr6878 | mutS (E. coli) homolog 3 (RefSeq aa 1e-66) | NP_002430.1 | 1 |
| 3537 | SOA0236 | myelodysplasia/myeloid leukemia factor 1 (Mlf1) | AF100171 | 1 |
| 3538 | fcrb1731 | NDUFV3 gene for mitochondrial NADH-Ubiquinone oxidoreductase | AB038163.1 | 1 |
| 3539 | hfcr2555 | neural polypyrimidine tract binding protein (PTB) | AF176085.1 | 1 |
| 3540 | seoa7011 | neuritin (LOC51299), mRNA /cds=(168,596) /gb=NM_016588 /gi=7706122 /ug=Hs.103291 /len=1589 | Hs.103291 | 1 |
| 3541 | fcrb0102 | NF2 gene | Y18000.1 | 1 |
| 3542 | SEOA1399 | NG,NG-dimethylarginine dimethylaminohydrolase | AB001915 | 1 |
| 3543 | ncrb1540 | NIBAN | AB050477.1 | 1 |
| 3544 | miob1224 | NICE-3 protein (clone 3038j13) | AJ243665.1 | 1 |
| 3545 | ncrb8253 | nitrilase 1 (NIT1) | NM_005600.1 | 1 |
| 3546 | ncrb7941 | NJAC protein (NJAC) | AF144103.1 | 1 |
| 3547 | MIOA8380 | nm23-H7 (NME7) | AF153191.1 | 1 |
| 3548 | SEOB1093 | Nmi | U32849.1 | 1 |
| 3549 | ncrc0797 | N-myc and STAT interactor (RefSeq aa 4e-56) | NM_016508.1 | 1 |
| 3550 | fcrb0146 | NORI-1 (ORF) | AB010427 | 1 |
| 3551 | fcrb2223 | novel protein (HSNOV1) | XM_017365.2 | 1 |
| 3552 | MIOA0972 | NPD001 | AF078853.1 | 1 |
| 3553 | FCR2139 | N-ras | X02751 | 1 |
| 3554 | miob5489 | nuclear body associated kinase 2b (Nbak2) (=AB014530.1 KIAA0630) | AF170304.1 | 1 |
| 3555 | ncrc5608 | nucleobindin 2 (RefSeq aa 9e-90) | NP_005004.1 | 1 |
| 3556 | SEOA4264a | nucleolar protein (KKE/D repeat) (NOP56) =Y12065,nucleolar protein hNop56 | NM_006392. | 1 |
| 3557 | fcrb2647 | nucleolar protein ANKT(ANKT), mRNA | NM_016359.1 | 1 |
| 3558 | seoa6814 | nucleolar protein family A, member 3 (H/ACA small nucleolar RNPs) (NOLA3), mRNA /cds=(97,291) /gb=NM_018648 /gi=15011920 /ug=Hs.14317 /len=556 | Hs.14317 | 1 |
| 3559 | SEOA1720a | nucleotide-binding protein | U01833 | 1 |
| 3560 | SEOB3518 | NUMB | AF171941.1 | 1 |
| 3561 | MIOA2165a | NY-REN-49 antigen | AF155111.1 | 1 |
| 3562 | hfcr9111 | NY-REN-57 antigen | AF155114.1 | 1 |
| 3563 | SEOA4440 | NY-REN-6 antigen (ORF) | AF155096 | 1 |
| 3564 | miob5954 | OBPIIa gene | AJ251029.1 | 1 |
| 3565 | SEOA7902a | okadaic acid-inducible phosphoprotein (OA48-18) | AF069250 | 1 |
| 3566 | BFCW0310 | Opa-interacting protein OIP5 | AF025441 | 1 |
| 3567 | miob1734 | OPN-b (low match: aa 8e-06) | BAA05950.1 | 1 |
| 3568 | ncrb0364 | ORF1, encodes a 40 kDa product | AAB60344.1 | 1 |

Figure 6A – EST Names Corresponding to Unique Known Genes of Figure 6

| | | | |
|---|---|---|---|
| 3569 ncrc9019 | ORF2 (aa 4e-15,65%) | BAA25253.1 | 1 |
| 3570 SEOA8213 | ORF4 | CAA37647.1 | 1 |
| 3571 ncrb3860 | ORFII (X52235)(= LIN1_HUMAN LINE-1 REVERSE TRANSCRIPTASE HOMOLOG ) | CAA36480.1 | 1 |
| 3572 miob3845 | ORFYGR054w | CAA97056.1 | 1 |
| 3573 hfcr5875 | OTF3 gene | Z11900.1 | 1 |
| 3574 hfcr1678 | p150 (67% a.a.) | AAC51279.1 | 1 |
| 3575 ncr5568 | P1-Cdc21 (=ALU8_HUMAN ALU SUBFAMILY SX SEQUENCE) | X74794.1 | 1 |
| 3576 ncrc2131 | P1cdc47 (=hMCM2) (=p85Mcm) | D55716.1 | 1 |
| 3577 miob0182 | p21-activated protein kinase-like protein (non-exact match 34% a.a. identity) | AAF82310.1 | 1 |
| 3578 fcrb2523 | P3ECSL (LIECG3), mRNA | NM_022164.1 | 1 |
| 3579 SEOA0728a | PA4=candidate oncogene | S82075 | 1 |
| 3580 ncrb5885 | PAC 747L4 gene | AL035297.1 | 1 |
| 3581 hfcr6233 | PAC P336P3 (12q24) | gi\|2961441 | 1 |
| 3582 SEOA6895 | PAI-1 gene, PAI-1-HindIII-2 allele | AF110527.1 | 1 |
| 3583 SEOA5156a | PAK2 mRNA, | AF092132 | 1 |
| 3584 ncrc0284 | PAN2 protein (PAN2) | NM_020905.1 | 1 |
| 3585 fcr3111 | pancreas tumor-related protein (FKSG12) | AF311912.1 | 1 |
| 3586 mioa9843 | parathyroid hormone-like protein(PLP) gene, exon 4, clones lambda-PLPg(1,3,7-2) | M24349.1 | 1 |
| 3587 ncr6563 | partial AF-4 gene | AJ238093.1 | 1 |
| 3588 fcrb1682 | partial LIMD1 gene for LIM domains | AJ312686.1 | 1 |
| 3589 ncrb2079 | partial unknown mRNA from drug-resistant melanoma cells, 3'UTR, clone | AJ270695.1 | 1 |
| 3590 ncrc9293 | PCCX2 mRNA for protein containing CXXC domain 2, partial cds | AB031230.1 | 1 |
| 3591 ncr8827 | PDCL2 | AAD30564.2 | 1 |
| 3592 FCR6547 | peanut-like protein 1, PNUTL1 (hCDCRel-1) (=AF006988 septin (CDCRel-1)) | Y11593 | 1 |
| 3593 FCR4965 | pendrin (PDS) | AF030880 | 1 |
| 3594 SEOA0799 | PEP11 PROTEIN | spP38759 | 1 |
| 3595 FCR3599 | PEP19 (PCP4) (=X93349;U53709) | U52969 | 1 |
| 3596 ncrb8191 | PER1 gene (=Rigui (RIGUI)) | AF102137.1 | 1 |
| 3597 FCR0187 | pescadillo (PES1) | U78310 | 1 |
| 3598 BFCS0022 | Pig3 (PIG3) | AF010309 | 1 |
| 3599 ncrb8666 | pituitary tumor-transforming 1 interacting protein (PTTG1IP) | NM_004339.2 | 1 |
| 3600 FCR3072N | PiUS | U74297 | 1 |
| 3601 ncrc4259 | plasma glutamate carboxypeptidase (PGCP) | NM_006102.1 | 1 |
| 3602 ncr4448 | platelet glycoprotein lib precursor | AAA60115.1 | 1 |
| 3603 fcrb0385 | PMF16 | AB006881 | 1 |
| 3604 miob4980 | PMS1 PROTEIN HOMOLOG 1 (DNA MISMATCH REPAIR PROTEIN PMS1) | spP54277 | 1 |
| 3605 SEOA2934a | PM-Scl-75 autoantigen (PM-sc1) (=M58460) | U09215 | 1 |
| 3606 MIOA6234a | polymorphic HindIII site DNA (THRB region) | X58041 | 1 |
| 3607 seob7465 | polypyrimidine tract binding protein (heterogeneous nuclear ribonucleoprotein I) (PTB) | NM_002819.1 | 1 |
| 3608 ncrc0028 | PP1201 mRNA, | AF193045.1 | 1 |
| 3609 ncrc2404 | PP2703 | AF193051.1 | 1 |
| 3610 ncrc9023 | PR-domain containing protein 10 (PRDM10) | NM_020228.1 | 1 |

Figure 6A – EST Names Corresponding to Unique Known Genes of Figure 6

| | | | | |
|---|---|---|---|---|
| 3611 | SEOA2528 | PREGNANCY ZONE PROTEIN PRECURSOR (low match) | spP20742 | 1 |
| 3612 | MIOA8228 | PRKG1 gene | Z92885 | 1 |
| 3613 | ncrc0838 | PRO0066 | AF113007.1 | 1 |
| 3614 | ncr2035 | PRO0214 protein (PRO0214) | NM_014120.1 | 1 |
| 3615 | miob0673 | PRO0245 protein (PRO0245) | NM_014122.1 | 1 |
| 3616 | ncrc0715 | PRO0412 mRNA (=KIAA0213 gene )(= mitogen-activated protein kinase kinase kinase 4 (MAP3K4), transcript variant 2) | AF116604.1 | 1 |
| 3617 | seob5748 | PRO0461 protein (PRO0461) | NM_014072.1 | 1 |
| 3618 | SEOA9744 | PRO0529 protein (PRO0529)= AF111848.1 | NM_014074.1 | 1 |
| 3619 | ncrc5276 | PRO0786 (=putative tumor suppressor ST13 (ST13)) | AF116650.1 | 1 |
| 3620 | ncrc2484 | PRO0989 (=CGI-54 protein) | AF116614.1 | 1 |
| 3621 | ncr9919 | PRO1155 (=RBBP6) | AF116625.1 | 1 |
| 3622 | ncrb1167 | PRO1489 | AF116637.1 | 1 |
| 3623 | ncrc4583 | PRO1546 (aa 1e-14,58%) | NP_061055.1 | 1 |
| 3624 | miob0910 | PRO1722 | AAF69605.1 | 1 |
| 3625 | ncrc0151 | PRO1843 mRNA,(= initiation factor 4B) | AF119854.1 | 1 |
| 3626 | ncrc5179 | PRO1996 protein (PRO1996) | NM_014108.1 | 1 |
| 3627 | ncrc3257 | PRO2047 protein (PRO2047) (=PRO2003) | NM_014110.1 | 1 |
| 3628 | ncrb5438 | PRO2061 | AF118092.1 | 1 |
| 3629 | hfcr4055 | PRO2134 | AF118094.1 | 1 |
| 3630 | hfcr9558 | PRO2207 | AF116692.1 | 1 |
| 3631 | seoa7722a | PRO2219 mRNA, complete cds /cds=(823,1056) /gb=AF116694 /gi=7959886 /ug=Hs.103657 /len=1083 | Hs.103657 | 1 |
| 3632 | ncrb5918 | PRO2222 | AF119868.1 | 1 |
| 3633 | SEOA9409 | PRO2239 | AF116696 | 1 |
| 3634 | ncr9044 | PRO2309 | AF119875.1 | 1 |
| 3635 | hfcr0345 | PRO2646(=RPS4Y) | AF116711.1 | 1 |
| 3636 | miob0700 | selective LIM binding factor, rat homolog (SLB) | AAF69654.1 | 1 |
| 3637 | ncrc2831 | PRO2832 (PRO2832) | NM_018541.1 | 1 |
| 3638 | ncrc5312 | PRO2975 (PRO2975) | NM_018548.1 | 1 |
| 3639 | ncrc4555 | PRO3091 | AF119916.1 | 1 |
| 3640 | miob5117 | PRO3098 | AF119917.1 | 1 |
| 3641 | FCR4364 | Pro-Pol-dUTPase polyprotein | Y12713 | 1 |
| 3642 | FCR6936 | prostacyclin synthase | D83402 | 1 |
| 3643 | ncrb2611 | prostaglandin-D synthase (RefSeq aa 3e-36) | NP_055300.1 | 1 |
| 3644 | mioa9323 | prostate carcinoma tumor antigen (pcta-1) (ORF) | L78132.1 | 1 |
| 3645 | mioa9540 | prostate specific and androgen regulated cDNA 14D7 = AL050198 hypothetical protein | AF163475 | 1 |
| 3646 | fCR0237 | prostatein c3 subunit | M71245 | 1 |
| 3647 | FCR1393 | protein | L76155 | 1 |
| 3648 | seob6417 | protein (peptidyl-prolyl cis/trans isomerase) NIMA-interacting, 4 (parvulin) (PIN4) | NM_006223.1 | 1 |
| 3649 | SEOA7471a | protein B | AF146793.1 | 1 |
| 3650 | ncrc6708 | protein inhibitor of activated STAT-1(RefSeq aa 2e-82) | NP_057250.1 | 1 |
| 3651 | MIOA2998a | protein S-alpha (PROS1) (=Y00692) | M23599 | 1 |
| 3652 | MIOA6488a | PSD-Zip45 | AB017140 | 1 |
| 3653 | ncrc4132 | PTB domain adaptor protein CED-6 | AF200715.1 | 1 |
| 3654 | MIOA0494 | PTB-like protein | AJ010585.1 | 1 |
| 3655 | ncr8811 | PTD002 protein (PTD002) (=HSPC305) | NM_016144.1 | 1 |

Figure 6A – EST Names Corresponding to Unique Known Genes of Figure 6

| | | | |
|---|---|---|---|
| 3656 MIOA3439a | PTD012 | AF092133.1 | 1 |
| 3657 ncrc5335 | PTD017 protein (PTD017) | NM_014046.1 | 1 |
| 3658 ncrc2079 | PTH-responsive osteosarcoma B1 protein (B1) mRNA, complete cds | AF095771.1 | 1 |
| 3659 SEOA5584a | PTPL1-associated RhoGAP | U90920 | 1 |
| 3660 ncr2496 | PTS gene for 6-pyruvoyltetrahydropterin synthase | AB042297.1 | 1 |
| 3661 mioa6307a | putative (H. sapiens) (LOC134301) | XM_059705.1 | 1 |
| 3662 fcrb2591 | PUTATIVE C10 PROTEIN (LOC113246) Length = 755 | XM_053988.2 | 1 |
| 3663 ncrc4076 | Putative prostate cancer tumorsuppressor (RefSeq aa 5e-81) | NP_006756.1 | 1 |
| 3664 ncrc5592 | putative tumor suppressor ST13 (ST13) (=PRO0786) | U17714.1 | 1 |
| 3665 ncrc9709 | QM [nontumorigenic Wilms' microcell hybrid cells, Genomic, 2623 nt, segment 2 of 2](= housekeeping (Q1Z 7F5) gene exons 2 through 7, complete cds) | S64169.1 | 1 |
| 3666 ncrc0100 | R3H domain (binds single-strandednucleic acids) containing (RefSeq aa 7e-54) | NP_056970.1 | 1 |
| 3667 fcrb1457 | RAB14, member RAS oncogene family (RAB14) | XM_005342.4 | 1 |
| 3668 fcrb2344 | RAB6C, member RAS oncogene family (RAB6C), mRNA | XM_038274.1 | 1 |
| 3669 miob0036 | Rap2 interacting protein; similar to U73941 (PID:g1916018) | AAC82532.1 | 1 |
| 3670 fcrb2087 | rat activator of G-protein signaling 3 (AGS3) (likely ortholog) | XM_054763.2 | 1 |
| 3671 ncrb7932 | rat myomegalin | NP_071754.1 | 1 |
| 3672 ncrc5296 | RB-binding protein (rbbp2h1a gene) | AJ243706.1 | 1 |
| 3673 ncrb6676 | RC1-ST0278-160200-014-f03 ST0278 cDNA | AW818395.1 | 1 |
| 3674 hfcr6143 | RC3-BT0319-240200-015-e12 BT0319 | BE066091.1 | 1 |
| 3675 SEOB3497 | recepin (CBF1 interacting corepressor (CIR) | U03644.1 | 1 |
| 3676 FCR2338 | Rer1 protein | AJ001421 | 1 |
| 3677 hfcr8412 | RES4-22 gene with multiple splice variants near HD locus on 4p16.3 | NM_003704.1 | 1 |
| 3678 ncrc0807 | reticulon 4c (=reticulon 4b)(= reticulon 4a) | AF087901.1 | 1 |
| 3679 ncrc0185 | retinal short-chain dehydrogenase/reductase retSDR2 (LOC51170), mRNA | NM_016245.1 | 1 |
| 3680 fCR0841 | retina-specific 15.7 kDa protein | M34915 | 1 |
| 3681 MIOA5531a | retinol-binding protein (RBP) | M10934 | 1 |
| 3682 MIOA6585a | RETINOL-BINDING PROTEIN II, CELLULAR (CRBP-II) | P50121 | 1 |
| 3683 ncrb8721 | REV3 (yeast homolog)-like, catalyticsubunit of DNA polymerase zeta (RefSeq aa 2e-39) | NP_002903.1 | 1 |
| 3684 hfcr1733 | RGP3 | U27655.1 | 1 |
| 3685 seoa4926a | RP42 homolog (RP42), mRNA /cds=(29,808) /gb=NM_020640 /gi=10190677 /ug=Hs.104613 /len=3552 | Hs.104613 | 1 |
| 3686 miob6451 | rpmJ, prlA, rplO, rpmD, rpsE, rplR, rplF, rpsH, rpsN, rplE, rplX, rplN, rpsQ, rpmC, rplP, rpsC, rplV, rpsS, rplB, rplW, rplD, rplC, rpsJ genes from bases 3440111 to 3451054 (section 298 of 400) of th... | AE000408 | 1 |

Figure 6A – EST Names Corresponding to Unique Known Genes of Figure 6

| | | | |
|---|---|---|---|
| 3687 seob4136 | rrlC, rrfC, aspT, trpT, yifA, pssR, yifE, yifB, ilvL, ilvG_1, ilvG_2, ilvM, ilvE, ilvD, ilvA, ilvY genes from bases 3941264 to 3955588 (section 343 of 400) of the complete genome | AE000453 | 1 |
| 3688 ncrc5432 | SCL gene locus | AJ131016.1 | 1 |
| 3689 ncrc4001 | seladin-1 (=KIAA0018) | AF261758.1 | 1 |
| 3690 fcrb1724 | selective LIM binding factor, rat homolog (SLB) | XM_033196.1 | 1 |
| 3691 fcrb0693 | serologically defined colon cancer antigen 10 (NY-CO-10) | NM_005869.1 | 1 |
| 3692 hfcr0622 | SH3GLP1 pseudogene, 5' | X99658.1 | 1 |
| 3693 hfcr0525 | Si-1-8-16 mRNA, partial cds | AB044752.1 | 1 |
| 3694 FCR3121 | SIK similar protein | AF053232 | 1 |
| 3695 ncrb8035 | single-minded (Drosophila) homolog 2 (SIM2), transcript variant SIM2 | NM_005069.2 | 1 |
| 3696 hfcr0750 | Sjogren's syndrome/scleroderma autoantigen 1 (SSSCA1) (=AB001740 p27) | NM_006396.1 | 1 |
| 3697 FCR6792 | Slit-2 protein | AB017168 | 1 |
| 3698 ncrc5508 | Sm protein F (RefSeq aa 2e-41) | NP_009011.1 | 1 |
| 3699 FCR6529 | small cytoplasmic Y RNA (Y4) (=X57566 hy4 Ro RNA (associated with erythrocyte Ro RNP's)) | L32608 | 1 |
| 3700 ncrc6345 | small EDRK-rich factor 1, short isoform (SERF1) | AF073518.1 | 1 |
| 3701 ncrc3840 | small fragment nuclease (DKFZP566E144) | NM_015523.1 | 1 |
| 3702 fcrb1894 | SMART/HDAC1 associated repressor protein (SHARP) | XM_057104.1 | 1 |
| 3703 MIOA6731a | SOCS box-containing WD protein SWiP-1 (SWIP1) (=AF106683 WSB-1) | AF072880.1 | 1 |
| 3704 ncrc5243 | spastic ataxia of Charlevoix-Saguenay (sacsin) (RefSeq aa 2e-91) | NP_055178.1 | 1 |
| 3705 ncrc5327 | speckle-type POZ protein (SPOP) | NM_003563.1 | 1 |
| 3706 ncrb0303 | spm1 protein | Y15794.1 | 1 |
| 3707 ncr6821 | SRY (sex determining region Y)-box 13 (SOX13)(= type 1 diabetes autoantigen ICA12) | NM_005686.1 | 1 |
| 3708 ncrb1420 | SRY (sex determining regionY)-box 22 (SOX22) | NM_006943.1 | 1 |
| 3709 miob6467 | SRY-box containing gene 5 (Sox5) | NM_011444.1 | 1 |
| 3710 MIOA1921a | SS-A/Ro ribonucleoprotein autoantigen 60 kd subunit | M25077 | 1 |
| 3711 SEOA3852 | SSR alpha subunit | Z12830 | 1 |
| 3712 hfcr9240 | SSX4 protein gene | AF196972.1 | 1 |
| 3713 FCR5574 | stat-like protein (Fe65) | L77864 | 1 |
| 3714 FCR6841 | STS(STS SHGC-35393) | G28601 | 1 |
| 3715 SEOA8651 | sudD (suppressor of bimD6, Aspergillus nidulans) homolog (SUDD) (Alu repeat) | gi4507298 | 1 |
| 3716 FCR3286 | suppressor of cytokine signalling-1 (SOCS-1) (=AB000734 TIP3) | U88326 | 1 |
| 3717 ncrc5113 | Syne-1B | AAG24393.1 | 1 |
| 3718 mioa9648 | synuclein, alpha (non A4 component of amyloid precursor) (SNCA), transcript variant NACP112,(ORF) | NM_007308.1 | 1 |
| 3719 ncr8584 | Tandem PH Domain Containing Protein-1 (TAPP1) | NM_021622.1 | 1 |
| 3720 hfcr4087 | Tax interaction protein 2 | AF028824.1 | 1 |
| 3721 miob4613 | TB1 | M74089.1 | 1 |
| 3722 mioa9581 | TCP1 (t-complex-1) ring complex, polypeptide 5 (TRIC5)(ORF) = X74801.1 | NM_005998.1 | 1 |
| 3723 SEOA8401a | tctex-1 | E13405 | 1 |

Figure 6A – EST Names Corresponding to Unique Known Genes of Figure 6

| | | | | |
|---|---|---|---|---|
| 3724 | seob5658 | TESS 2 protein (TESS 2 gene) (=DKFZp586B2022) | AJ250865.1 | 1 |
| 3725 | ncrc6072 | testis specific ankyrin-like protein 1 (LOC51281) | NM_016552.1 | 1 |
| 3726 | FCR2798 | tex292 | X80433 | 1 |
| 3727 | hfcr8816 | TFII-I protein(TFII-I) mRNA, (=general transcription factor 2-I (GTF2I) | AF015553.1 | 1 |
| 3728 | FCR1092 | tip associating protein (TAP) | U80073 | 1 |
| 3729 | seoa7736a | TPA regulated locus; uncharacterized hypothalamus protein HTMP (H. sapiens) (LOC132748), mRNA | XM_054971.2 | 1 |
| 3730 | MIOA7372a | TPRD | D83077 | 1 |
| 3731 | hfcr0171 | transitional epithelia response protein (TERE1) | NM_013319.1 | 1 |
| 3732 | fcrb1397 | translocating chain-associating membrane protein (TRAM) | XM_005185.3 | 1 |
| 3733 | hfcr8857 | Treacher Collins-Franceschetti syndrome 1 (TCOF1) mRNA | NM_000356.1 | 1 |
| 3734 | ncr3718 | TSA305 | AB024763.1 | 1 |
| 3735 | SEOA4366a | TSC2 mRNA for tuberin | X75621 | 1 |
| 3736 | fCR0969 | TYL gene | X99688 | 1 |
| 3737 | seoa7056 | unknown mRNA /cds=(1758,2294) /gb=AF321617 /gi=11596417 /ug=Hs.33032 /len=3109 | Hs.33032 | 1 |
| 3738 | ncrc1153 | unknown protein 3'UTR | Y09836.1 | 1 |
| 3739 | fcrb2422 | unknown protein LOC51035 (H. sapiens) (LOC120685), mRNA | XM_058485.1 | 1 |
| 3740 | mioa0739m | unnamed protein product | AK001715 | 1 |
| 3741 | ncrc5949 | unnamed protein product | BAA91748.1 | 1 |
| 3742 | ncrc8937 | unnamed protein product | BAA91974.1 | 1 |
| 3743 | ncrc1402 | unnamed protein product | BAB14098.1 | 1 |
| 3744 | ncrc4015 | unnamed protein product | BAB14662.1 | 1 |
| 3745 | ncrc2531 | unnamed protein product | BAB14687.1 | 1 |
| 3746 | ncrb8526 | unnamed protein product | BAB14809.1 | 1 |
| 3747 | ncrc3171 | unnamed protein product | BAB15239.1 | 1 |
| 3748 | ncrc3503 | unnamed protein product | BAB15362.1 | 1 |
| 3749 | ncrc3080 | unnamed protein product | BAB15407.1 | 1 |
| 3750 | ncrc9052 | unnamed protein product | BAB15427.1 | 1 |
| 3751 | ncrc9368 | unnamed protein product | BAB15579.1 | 1 |
| 3752 | ncrc1889 | unnamed protein product (=HSPC314) | BAB14755.1 | 1 |
| 3753 | ncrb8790 | unnamed protein product (aa 1e-15) | BAB15433.1 | 1 |
| 3754 | fcrb2199 | UPF3 (UPF3) | AF318575.1 | 1 |
| 3755 | ncrb5244 | up-regulated by BCG-CWS (=KIAA0062,=KIAA1265) | NP_071437.1 | 1 |
| 3756 | ncrc2451 | vault-associated RNA 1, complete sequence | AF045143.1 | 1 |
| 3757 | ncrc7065 | vav 3 oncogene (VAV3) | NM_006113.2 | 1 |
| 3758 | ncrc9729 | v-maf musculoaponeurotic fibrosarcoma(avian) oncogene homolog (RefSeq aa 4e-33) | NP_005351.2 | 1 |
| 3759 | SEOA9421 | v-raf-1 murine leukemia viral oncogene homolog 1 (RAF1),= X03484.1 | NM_002880.1 | 1 |
| 3760 | MIOA8644 | WAS protein family, member 1 (WASF1) (=KIAA0269) | NM_003931.1 | 1 |
| 3761 | ncrb2848 | WD-repeat protein (HAN11) | NM_005828.1 | 1 |
| 3762 | fcrb1420 | Williams-Beuren syndrome chromosome region 1 (WBSCR1) | XM_051839.2 | 1 |
| 3763 | seoa6846 | Wilms' tumour 1-associating protein (KIAA0105), mRNA /cds=(124,579) /gb=NM_004906 /gi=4758635 /ug=Hs.119 /len=1622 | Hs.119 | 1 |

Figure 6A – EST Names Corresponding to Unique Known Genes of Figure 6

| | | | | |
|---|---|---|---|---|
| 3764 | seoa6818 | Wiskott-Aldrich syndrome protein interacting protein (WASPIP), mRNA /cds=(108,1619) /gb=NM_003387 /gi=8400739 /ug=Hs.24143 /len=1985 | Hs.24143 | 1 |
| 3765 | FCR6578 | XE7 | L03426 | 1 |
| 3766 | ncr4202 | Xp22 bins 16-17 BAC GSHB-531I17 (Genome Systems Human BAC Library) complete sequence | AC004805.1 | 1 |
| 3767 | hfcr9956 | Xq pseudoautosomal region; segment 1/2 | AJ271735.1 | 1 |
| 3768 | SEOA4600a | xs31 | Z36832 | 1 |
| 3769 | ncrc0455 | yeast Sec31p homolog (RefSeq aa 5e-76) | NP_057295.1 | 1 |
| 3770 | SEOA1875a | YGR163, yeast homologue | AB017616 | 1 |
| 3771 | ncrc1374 | adrenodoxin gene, exon 4 | M23668.1 | 1 |
| 3772 | ncr0159 | annexin V-binding protein (ABP-10),(ORF) | D64062 | 1 |
| 3773 | MIOA8828 | ATPase subunit 6 | BAA07295.1 | 1 |
| 3774 | seob5326 | ATPase, Ca sequestering (ATP2C1) (=KIAA1347) | NM_014382.1 | 1 |
| 3775 | fcrb1607 | ATPase, Class I, type 8B member 2 (ATP8B2) | XM_036933.2 | 1 |
| 3776 | hfcr0829 | ATPase, H transporting, lysosomal (vacuolar proton pump) 21kD (ATP6F) | NM_004047.1 | 1 |
| 3777 | seob6087 | ATPase, H transporting, lysosomal (vacuolar proton pump) non-catalytic accessory protein 1A (110/116kD) (ATP6N1A) | NM_005177.1 | 1 |
| 3778 | ncr5109 | ATPase, H transporting, lysosomal (vacuolar proton pump), beta polypeptide,56/58kD, isoform 2 (ATP6B2)( vacuolar H -ATPase Mr 56,000 subunit (HO57))( =isoform 2 of vacuolar H ATPase Mr 56,000 subunit) | NM_001693.1 | 1 |
| 3779 | ncr5336 | ATPase, H transporting, lysosomal (vacuolar proton pump), member J (ATP6J) | NM_004888.1 | 1 |
| 3780 | hfcr0366 | ATPase, Na /K transporting, alpha 2 ( ) polypeptide (ATP1A2) | NM_000702.1 | 1 |
| 3781 | ncrc9279 | ATPase, Na /K transporting, beta 1polypeptide (RefSeq aa 7e-66) | NP_001668.1 | 1 |
| 3782 | hfcr2323 | ATP-binding cassette 7 iron transporter (ABC7) | AF133659.1 | 1 |
| 3783 | MIOA1276m | Ca2 -transporting ATPase, (ORF) | AJ010953 | 1 |
| 3784 | FCR7128 | calsequestrin, cardiac | D55655 | 1 |
| 3785 | FCR0257 | copper chaperone for superoxide dismutase (CCS) | AF002210 | 1 |
| 3786 | FCR4166 | F1-ATPase beta subunit (F-1 beta) (=X05606;M27132) | X03559 | 1 |
| 3787 | fCR1004 | F1-F0-ATPase | M64751 | 1 |
| 3788 | fCR1016 | F1Fo-ATP synthase complex Fo membrane domain F subunit | S70447 | 1 |
| 3789 | MIOA1621a | monocarboxylate transporter 1 (SLC16A1) | L31801 | 1 |
| 3790 | FCR3715 | non-erythroid band 3-like protein (HKB3) (=U26531 anion exchanger AE2;X62137 anion exchanger protein) | X03918 | 1 |
| 3791 | MIOA0572n | nonerythroid beta-spectrin | L02897 | 1 |
| 3792 | hfcr8509 | NRAMP2 gene for natural resistance-associated macrophage protein 2 | AB015355.1 | 1 |
| 3793 | ncrc6623 | S100 calcium-binding protein A11 (calgizzarin) (S100A11) | NM_005620.1 | 1 |
| 3794 | fcrb2291 | S100 calcium-binding protein A6 (calcyclin) (S100A6), mRNA | XM_058243.1 | 1 |

Figure 6A – EST Names Corresponding to Unique Known Genes of Figure 6

| | | | | |
|---|---|---|---|---|
| 3795 | ncrb1216 | sodium bicarbonate cotransporter 2b (NBC2B)(= sodium bicarbonate cotransporter 3 (SLC4A7)) | AF089726.1 | 1 |
| 3796 | SEOA2620 | sodium bicarbonate cotransporter 3 (SLC4A7) | AF047033.1 | 1 |
| 3797 | ncr2256 | solute carrier family 26 | NM_000112.1 | 1 |
| 3798 | ncrc5930 | solute carrier family 5(sodium-dependent vitamin transporter), member 6(SLC5A6) | NM_021095.1 | 1 |
| 3799 | MIOA1353a | solute carrier family 7 (cationic amino acid transporter, y system), member 6 (SLC7A6) (=D87432.1 KIAA0245) | gi4507052 | 1 |
| 3800 | seob7125 | vacuolar H ( )-ATPase subunit=13.7 kda F-ATPases subunit b homologue | S82464.1 | 1 |
| 3801 | ncr1428 | vacuolar H -ATPase Mr 56,000 subunit (HO57) | L35249.1 | 1 |
| 3802 | MIOA8034a | vacuolar H ATPase Mr 70000 subunit | X61612 | 1 |
| 3803 | FCR0748 | vacuolar proton ATPase membrane sector associated protein M8-9 | Y17975 | 1 |
| 3804 | SEOA7543a | vacuolar sorting protein 35 | AF191298 | 1 |
| 3805 | FCR3915 | white gene protein (=AF038175) | X91249 | 1 |
| 3806 | FCR4226 | Glycosyl transferase, similar to (=AF031835 ppGaNTase) | AL033514 | 1 |
| 3807 | SEOA1980a | 1,4-alpha-glucan branching enzyme (HGBE) | L07956 | 1 |
| 3808 | hfcr4466 | 3-phosphoinositide dependent protein kinase-1 (PDPK1) | NM_002613.1 | 1 |
| 3809 | ncrb6462 | aldehyde dehydrogenase 1 | K03000.1 | 1 |
| 3810 | FCR4900 | aldo-keto reductase family 7, member A2 (aflatoxin aldehyde reductase) (AKR7A2) (=Y16675) | AF026947 | 1 |
| 3811 | SEOA6123a | aldose reductase (EC 1.1.1.2) | X15414 | 1 |
| 3812 | ncrb0913 | alpha-1,3(6)-mannosyl glycoprotein beta-1 (RefSeq aa 1e-79) | NP_002401.1 | 1 |
| 3813 | ncrc1495 | alpha-aminoadipic semialdehyde dehydrogenase-phosphopantetheinyl transferase | AF302110.1 | 1 |
| 3814 | hfcr6753 | Alu co-repressor 1 (ACR1)(=AOEB166) | AF231705.1 | 1 |
| 3815 | hfcr6085 | amylo-1,6-glucosidase,4-alpha-glucanotransferase (glycogen debranching enzyme,glycogen storage disease type III) (AGL), splice variant 6, mRNA | NM_000646.1 | 1 |
| 3816 | hfcr5499 | beta-1,3-glucuronyltransferase 3 (glucuronosyltransferase I) (B3GAT3) | NM_012200.1 | 1 |
| 3817 | ncr9549 | beta-1,3-N-acetyl glucosaminyl transferase (BETA3GNTI) | NM_006876.1 | 1 |
| 3818 | ncrc2568 | beta-globin (HBB) gene haplotype C17, replication origin initiation region and partial cds | AF186616.1 | 1 |
| 3819 | ncr0251 | carbohydrate (keratan sulfate Gal-6) sulfotransferase 1 (CHST1), mRNA | NM_003654.1 | 1 |
| 3820 | ncrb5197 | carbohydrate (N-acetylglucosamine 6-O) sulfotransferase 6 (CHST6) (=CLP) | NM_021615.1 | 1 |
| 3821 | MIOA1513 | co-beta glucosidase (proactivator) | J03077 | 1 |
| 3822 | SEOB1844 | dTDP-4-keto-6-deoxy-D-glucose 4-reductase (tgr gene) (=AF182814 methionine adenosyltransferase regulatory beta subunit) | AJ243721.1 | 1 |
| 3823 | fcrb2043 | extracellular glycoprotein EMILIN-2 precursor (LOC90187) | XM_029741.1 | 1 |
| 3824 | FCR2299 | galactokinase (galK) | U26401 | 1 |
| 3825 | FCR0894 | galactose-1-phosphate uridyl transferase (GALT) | M96264 | 1 |

Figure 6A – EST Names Corresponding to Unique Known Genes of Figure 6

| | | | | |
|---|---|---|---|---|
| 3826 | hfcr7968 | GALT3 protein mRNA, complete cds | AF154848.1 | 1 |
| 3827 | ncrb4154 | glucosamine-6-phosphate | AJ002231.1 | 1 |
| 3828 | ncrb7340 | glucosyltransferase | AJ224875.1 | 1 |
| 3829 | FCR6054 | glycogen debranching enzyme isoform 2 (AGL) | U84008 | 1 |
| 3830 | ncrc3799 | glycogen synthase 1 (muscle) (GYS1) | NM_002103.1 | 1 |
| 3831 | seob4492 | glycogenin= glycogenin-1 | X79537.1 | 1 |
| 3832 | FCR4878 | glycogenin-2 delta (glycogenin-2) (=U94359;U94363) | U94360 | 1 |
| 3833 | SEOA4809a | hexokinase II pseudogene | U28387 | 1 |
| 3834 | ncr7768 | hippocampus abundant gene transcript 1 (Hiat1) | NM_008246.1 | 1 |
| 3835 | FCR3946 | liver-type 1-phosphofructokinase (PFKL) (=X16930) | X15573 | 1 |
| 3836 | miob4869 | LNR42 (=AJ012409.1 Human hypothetical protein (clone YR-29)) | AF238866 | 1 |
| 3837 | fcrb0151 | lysosomal alpha-mannosidase (MANB) | U05572.1 | 1 |
| 3838 | seob8338 | lysozyme | M19045.1 | 1 |
| 3839 | hfcr6099 | mannosyl (alpha-1,3-)-glycoprotein beta-1,2-N-acetylglucosaminyltransferase (MGAT1) gene | NM_002406.2 | 1 |
| 3840 | ncr1421 | mannosyl (alpha-1,6-)-glycoprotein beta-1,2-N-acetylglucosaminyltransferase (MGAT2) | NM_002408.2 | 1 |
| 3841 | SEOB1340 | mannosyl-oligosaccharide alpha-1,2-mannosidase | U04301.1 | 1 |
| 3842 | BFCW0216 | N-acetyl-alpha-glucosaminidase (HEXA), alpha-polypeptide | M13520 | 1 |
| 3843 | MIOA0533 | N-acetylgalactosamine 6-sulfate sulfatase (GALNS) | D17629 | 1 |
| 3844 | miob6858 | N-acetylglucosamine-phosphate mutase; DKFZP434B187 | NM_015599.1 | 1 |
| 3845 | hfcr9613 | N-acetylglucosaminyl transferase component Gpi1 (GPI1) mRNA | NM_004204.1 | 1 |
| 3846 | ncrc5688 | O-linked N-acetylglucosamine(GlcNAc) transferase(UDP-N-acetylglucosamine:polypeptide-N-acetylglucosaminyl transferase) (OGT) | NM_003605.2 | 1 |
| 3847 | MIOA5779a | Phosphoglucomutase and phosphomannomutase phosphoserine homologues (68% aa) | AL021481 | 1 |
| 3848 | BFCW0352 | phosphoglycerate mutase 2 (muscle specific isozyme) (PGAM2) | M55673 | 1 |
| 3849 | fcrb0212 | phosphoinositide-3-kinase, catalytic, alpha polypeptide (PIK3CA) | NM_006218.1 | 1 |
| 3850 | SEOB0672a | phosphomannomutase 2 (PMM2) gene (5e-10 match) | AF157794.1 | 1 |
| 3851 | mioa9491 | phosphoprotein enriched in astrocytes 15 (PEA15) mRNA | NM_003768.1 | 1 |
| 3852 | SEOA5662a | platelet activating factor acetylhydrolase, brain isoform, 45 kDa subunit (LIS1) | U72342 | 1 |
| 3853 | SEOA9883 | pyruvate dehydrogenase (lipoamide) beta (PDHB) | NM_000925.1 | 1 |
| 3854 | hfcr6400 | pyruvate kinase, muscle (PKM2)(=TCB) | NM_002654.1 | 1 |
| 3855 | BFCS0345 | siah binding protein 1 (SiahBP1) | U51586 | 1 |
| 3856 | SEOB0918 | sialidase 1 (lysosomal sialidase) (NEU1) | gi4557790 | 1 |
| 3857 | fcrb2556 | sialyltransferase 4C (beta-galactosidase alpha-2,3-sialytransferase) (SIAT4C), mRNA | NM_006278.1 | 1 |
| 3858 | FCR4682 | sialyltransferase SThM (sthm) | U14550 | 1 |
| 3859 | SEOB2958 | sorbitol dehydrogenase (SORD) | U67243.1 | 1 |
| 3860 | MIOA1424 | suCRase-isomaltase (SI) | M84646 | 1 |
| 3861 | ncr0083 | UDP-galactose transporter related | AB041549.1 | 1 |
| 3862 | SEOA0420 | UDP-galactose transporter related isozyme 1 | D87989.1 | 1 |

Figure 6A – EST Names Corresponding to Unique Known Genes of Figure 6

| | | | | |
|---|---|---|---|---|
| 3863 | ncr4975 | UDP-glucose:glycoprotein glucosyltransferase 2 (FLJ10873) | NM_020121.1 | 1 |
| 3864 | ncrc6147 | aldolase A, fructose-bisphosphate (ALDOA) | NM_000034.1 | 1 |
| 3865 | miob6364 | acid phosphatase 1, soluble (ACP1), transcript variant a | NM_004300.1 | 1 |
| 3866 | MIOA8971 | acyl-Coenzyme A oxidase 3, pristanoyl (ACOX3) | NM_003501.1 | 1 |
| 3867 | FCR7059 | bleomycin hydrolase | X92106 | 1 |
| 3868 | hfcr8427 | casein kinase 1, epsilon (CSNK1E) | NM_001894.1 | 1 |
| 3869 | fcrb1494 | casein kinase 2, alpha 1 polypeptide (CSNK2A1) | XM_049424.2 | 1 |
| 3870 | fcrb1496 | casein kinase 2, beta polypeptide (CSNK2B) | NM_001320.1 | 1 |
| 3871 | FCR1462 | casein kinase I gamma 2 (=AF001177) | U89896 | 1 |
| 3872 | ncr8997 | cysteine knot superfamily 1, BMP antagonist 1 (CKTSF1B1) | NM_013372.1 | 1 |
| 3873 | bfcw0579 | dual adaptor of phosphotyrosine and 3-phosphoinositides (DAPP1) | XM_052416.1 | 1 |
| 3874 | SEOA1923 | GAP SH3 binding protein (Ras-GTPase-activating protein SH3-domain-binding protein (G3BP)) | U32519 | 1 |
| 3875 | MIOA0890a | GAP-associated protein (p190) | M94721 | 1 |
| 3876 | seob5668 | GAP-like protein (LOC51306) | NM_016603.1 | 1 |
| 3877 | FCR7327 | kappa-casein | U51899 | 1 |
| 3878 | ncr0107 | kinase substrate HASPP28 | U26541.1 | 1 |
| 3879 | FCR4927 | lysosomal acid phosphatase (=X12548) | X15535 | 1 |
| 3880 | FCR2908 | PALM (=D87460 (KIAA0270)) | Y16277 | 1 |
| 3881 | FCR3043 | palmitoylated erythrocyte membrane protein (MPP1) | M64925 | 1 |
| 3882 | ncr3979 | PHKB gene (exon 25) | X84930.1 | 1 |
| 3883 | seob7189 | protein phosphatase (KAP1) | L27711.1 | 1 |
| 3884 | MIOA0790 | protein phosphatase 1 (PPP1R5) | Y18207 | 1 |
| 3885 | hfcr3739 | protein phosphatase 1 regulatory subunit 7 (PPP1R7) | NM_002712.1 | 1 |
| 3886 | fcrb0894 | protein phosphatase 1, catalytic subunit, alpha isoform (PPP1CA) | NM_002708.1 | 1 |
| 3887 | mioa7740a | protein phosphatase 1, catalytic subunit, gamma isoform (PPP1CC), mRNA /cds=(154,1125) /gb=NM_002710 /gi=4506006 /ug=Hs.79081 /len=2263 | Hs.79081 | 1 |
| 3888 | ncrc1975 | protein phosphatase 1, regulatory (inhibitor) subunit 5 (PPP1R5) | NM_005398.1 | 1 |
| 3889 | SEOA5528a | protein phosphatase 1, regulatory subunit 10 (PPP1R10) (=Y13247 fb19) | gi4506008 | 1 |
| 3890 | ncr9620 | protein phosphatase 1, regulatory(inhibitor) subunit 5 (RefSeq aa 5e-40) | NP_005389.1 | 1 |
| 3891 | ncrc7085 | protein phosphatase 1, regulatorysubunit 7 (RefSeq aa 5e-77) | NP_002703.1 | 1 |
| 3892 | fcrb1901 | protein phosphatase 1G (formerly 2C), magnesium-dependent, gamma isoform (PPM1G) | XM_033185.1 | 1 |
| 3893 | fcrb1963 | protein phosphatase 2 (formerly 2A), regulatory subunit A (PR 65), beta isoform (PPP2R1B) | XM_041325.1 | 1 |
| 3894 | ncrc1624 | protein phosphatase 2, regulatory subunit B (B56), alpha isoform (PPP2R5A) | NM_006243.1 | 1 |
| 3895 | SEOA0383 | protein phosphatase 2A B'alpha1 regulatory subunit (=D26445 KIAA0044) | U37352 | 1 |

Figure 6A – EST Names Corresponding to Unique Known Genes of Figure 6

| | | | | |
|---|---|---|---|---|
| 3896 | FCR0429 | protein phosphatase 2A regulatory subunit alpha-isotype (alpha-PR65) (=M31786 tumor antigen-associated 61kd protein) | J02902 | 1 |
| 3897 | SEOA9046 | protein phosphatase 2C beta | AJ005458.1 | 1 |
| 3898 | SEOA0038 | protein phosphatase 5 (=U25174) | X89416 | 1 |
| 3899 | FCR6181 | protein phosphatase-1 catalytic subunit | M63960 | 1 |
| 3900 | fcrb1466 | protein tyrosine phosphatase receptor type K (PTPRK) | NM_002844.1 | 1 |
| 3901 | SEOA4670a | protein tyrosine phosphatase(TEP1) (ORF) | U96180 | 1 |
| 3902 | fcrb1201 | protein tyrosine phosphatase, receptor type, alpha polypeptide (PTPRA) | NM_002836.1 | 1 |
| 3903 | ncrc4869 | protein tyrosine phosphatase, receptor type, epsilon polypeptide (RefSeq aa 2e-43) | NP_006495.1 | 1 |
| 3904 | ncr8232 | protein tyrosine phosphatase, receptor type, f polypeptide (PTPRF), interacting protein (liprin), alpha 2 (RefSeq aa 5e-75) | NP_003616.1 | 1 |
| 3905 | hfcr8983 | protein tyrosine phosphatase, receptor type, M (PTPRM) | NM_002845.1 | 1 |
| 3906 | miob4561 | protein-tyrosine kinase, trkB | X75958.1 | 1 |
| 3907 | SEOA5787 | 3-hydroxy-3-methylglutaryl-coenzyme A (HMG-CoA) reductase | M62633 | 1 |
| 3908 | miob4104 | 3'-phosphoadenosine 5'-phosphosulfate synthetase (PAPSS) | AF105227.1 | 1 |
| 3909 | ncr1101 | 3'-phosphoadenosine 5-prime-phosphosulfate synthase 1 | NP_005434.1 | 1 |
| 3910 | hfcr9681 | 5'(3')-deoxyribonucleotidase; RB-associated KRAB repressor (DNT), mRNA | NM_014595.1 | 1 |
| 3911 | ncrb4000 | 5'-3' exoribonuclease 1 | NP_036046.1 | 1 |
| 3912 | ncr0867 | 5'-3'exonuclease | X91617.1 | 1 |
| 3913 | ncr4648 | 5'-nucleotidase (purine) | NM_012229.1 | 1 |
| 3914 | hfcr3453 | 6-O-methylguanine-DNA methyltransferase (MGMT) | M29971.1 | 1 |
| 3915 | ncrb6085 | adenosine deaminase tRNA-specific 1 (ADAT1) | NM_012091.2 | 1 |
| 3916 | SEOB1133 | adenosine monophosphate deaminase (isoform E) (AMPD3) | NM_000480.1 | 1 |
| 3917 | miob3161 | adenosine triphosphatase | M95541.1 | 1 |
| 3918 | hfcr1646 | deoxyhypusine synthase | L39068.1 | 1 |
| 3919 | ncrc2730 | deoxyribonuclease I-like 3 (DNASE1L3) | NM_004944.1 | 1 |
| 3920 | MIOA1300n | dinucleotide miCRosatellite HUJII77 | M96348 | 1 |
| 3921 | ncr3034 | exoribonuclease 1 (Xrn1) | NM_011916.1 | 1 |
| 3922 | ncr0495 | G/T MISMATCH-SPECIFIC THYMINE DNA GLYCOSYLASE | Q13569 | 1 |
| 3923 | fcrb2196 | guanylate kinase 1 (GUK1) | XM_056887.1 | 1 |
| 3924 | seob4076 | inorganic pyrophosphatase | AF119665.1 | 1 |
| 3925 | hfcr9835 | nucleoside diphosphate kinase homolog (DR-nm23) gene, complete sequence | U80813.1 | 1 |
| 3926 | hfcr3070 | nudix (nucleoside diphosphate linked moiety X)-type motif 3 (NUDT3), mRNA | NM_006703.1 | 1 |
| 3927 | ncrb2339 | nudix (nucleoside diphosphate linked moiety X)-type motif 6 (NUDT6)= AF019633 antisense basic fibroblast growth factor B alternatively spliced mRNA, | NM_007083.1 | 1 |
| 3928 | hfcr5872 | phosphodiesterase 10A (PDE10A) | NM_006661.1 | 1 |

Figure 6A – EST Names Corresponding to Unique Known Genes of Figure 6

| | | | | |
|---|---|---|---|---|
| 3929 | seob4363 | phosphodiesterase 1A, calmodulin-dependent (PDE1A) | NM_005019.1 | 1 |
| 3930 | hfcr3467 | phosphodiesterase 2A cGMP-stimulated (PDE2A) | NM_002599.1 | 1 |
| 3931 | ncrb0897 | phosphodiesterase 4B, cAMP-specific(dunce (Drosophila)-homolog phosphodiesterase E4) (RefSeq aa 3e-43) | NP_002591.1 | 1 |
| 3932 | hfcr9924 | phosphodiesterase I/nucleotide pyrophosphatase 2 (autotaxin) (PDNP2) (=autotaxin-t (atx-t) gene) | NM_006209.1 | 1 |
| 3933 | MIOA1304 | RhoGAP, rat homologue (chromosome 13) | gi4902677 | 1 |
| 3934 | BFCW0467 | ribonuclease A (RNase A) | D26129 | 1 |
| 3935 | hfcr2894 | ribonuclease HI, large subunit (RNASEHI) | NM_006397.1 | 1 |
| 3936 | ncrc1592 | ribonuclease P (30kD) (RefSeq aa 2e-78) | NP_006404.1 | 1 |
| 3937 | FCR5712 | RIBONUCLEASE PH-LIKE PROTEIN B0564.1 | spQ17533 | 1 |
| 3938 | FCR5412 | rod cGMP-phosphodiesterase gamma-subunit (PDEG) | U00482 | 1 |
| 3939 | ncr0612 | RY-1 putative nucleic acid binding protein | X76302.1 | 1 |
| 3940 | FCR5822 | single strand DNA-binding protein | AF077048.1 | 1 |
| 3941 | FCR4503 | thymidine kinase 1, soluble (TK1) | K02581 | 1 |
| 3942 | ncrc6778 | thymine-DNA glycosylase (TDG) | NM_003211.1 | 1 |
| 3943 | FCR5339 | L apoferritin | X03742 | 1 |
| 3944 | BFCS0286 | long-chain-fatty-acid-CoA ligase, homologue (SW:P29212) | Z81071 | 1 |
| 3945 | FCR5895 | 3-hydroxyisobutyryl-coenzyme A hydrolase | U66669 | 1 |
| 3946 | FCR0535 | 43 kDa inositol polyphosphate 5-phosphatase | Z31695 | 1 |
| 3947 | SEOB0007 | 7-dehydrocholesterol reductase (DHCR7) | AF067127.1 | 1 |
| 3948 | BFCW0160 | abc1 | X75926 | 1 |
| 3949 | fCR0872 | acetyl-CoA carboxylase | X68968 | 1 |
| 3950 | SEOB3564 | acetyl-Coenzyme A acyltransferase 2 (mitochondrial 3-oxoacyl-Coenzyme A thiolase) (ACAA2), nuclear gene encoding mitochondrial protein | NM_006111.1 | 1 |
| 3951 | SOA0105 | acylphosphatase 2, muscle type (ACYP2) | X84195 | 1 |
| 3952 | MIOA1785 | alcohol dehydrogenase beta-1-subunit (ADH1-2 allele) | X03350 | 1 |
| 3953 | FCR4763 | alpha-methylacyl-CoA racemase | AF047020 | 1 |
| 3954 | FCR6329 | aquaporin adipose | AB006190 | 1 |
| 3955 | FCR1997 | carnitine carrier | Y10319 | 1 |
| 3956 | ncr2966 | carnitine octanoyltransferase | AF073770.1 | 1 |
| 3957 | MIOA3335a | carnitine palmitoyltransferase II, precursor (CPT1) | U09646 | 1 |
| 3958 | ncrb5192 | CDP-diacylglycerol synthase(phosphatidate cytidylyltransferase) 1 (RefSeq aa 4e-40) | NP_001254.1 | 1 |
| 3959 | FCR6635 | choline kinase isolog 384D8_3 | U62317 | 1 |
| 3960 | ncrb1515 | choline phosphotransferase 1 beta (=cholinephosphotransferase 1 alpha)(= AAPT1-like protein) | AF195624.1 | 1 |
| 3961 | SEOB2797 | CTL1 protein (70% aa) | AJ245620 | 1 |
| 3962 | hfcr3067 | CTL2 gene | AJ245621.1 | 1 |
| 3963 | hfcr1639 | delta-6 fatty acid desaturase (FADSD6) | NM_004265.1 | 1 |
| 3964 | ncrc7180 | dihydrolipoamide acetyltransferase (PDC-E2) (EC 2.3.1.12) | Y00978.1 | 1 |
| 3965 | ncrb8703 | dihydrolipoamide branched chain transacylase (E2 component of branched chain keto acid dehydrogenase complex; maple syrup urine disease) | XP_001705.1 | 1 |

Figure 6A – EST Names Corresponding to Unique Known Genes of Figure 6

| | | | | |
|---|---|---|---|---|
| 3966 | ncr5065 | Drosophila fat facets related, X-linked (RefSeq aa 5e-56) | NP_004643.1 | 1 |
| 3967 | SEOA8556 | fat facets protein | AJ012078 | 1 |
| 3968 | ncrc1367 | fatty acid binding protein 3, muscle and heart (mammary-derived growth inhibitor) (FABP3) | NM_004102.2 | 1 |
| 3969 | hfcr5971 | fatty acid binding protein 7, brain (FABP7) mRNA | NM_001446.1 | 1 |
| 3970 | SEOA0792 | fatty acid desaturase MLD, putative (contains Alu repeat) | AF002668 | 1 |
| 3971 | ncrb5608 | fatty-acid-Coenzyme A ligase,long-chain 3 (RefSeq aa 4e-31) | NP_004448.1 | 1 |
| 3972 | SEOB0370 | fumarylacetoacetate hydrolase | M55150.1 | 1 |
| 3973 | ncrc0174 | geranylgeranyl diphosphate synthase 1(RefSeq aa 1e-34) | NP_004828.1 | 1 |
| 3974 | ncr1631 | hydroxysteroid (17-beta) dehydrogenase 7 (RefSeq aa 4e-86) | NP_057455.1 | 1 |
| 3975 | FCR1756 | L-3-hydroxyacyl-CoA dehydrogenase (=AF001902) | X96752 | 1 |
| 3976 | SEOA7920a | lanosterol 14-alpha demethylase cytochrome P450 (CYP51) | U51692.1 | 1 |
| 3977 | ncrc2670 | lipoyltransferase, complete cds | AB017567.1 | 1 |
| 3978 | ncrb4474 | methylmalonate-semialdehyde dehydrogenase (MMSDH) | NM_005589.1 | 1 |
| 3979 | BFCW0268 | mitochondrial short-chain enoyl-CoA hydratase | D13900 | 1 |
| 3980 | hfcr6515 | muscle fatty-acid-binding protein (FABP) | X56549.1 | 1 |
| 3981 | ncrb2256 | neuronal PAS domain protein 3 (Npas3) | NM_013780.1 | 1 |
| 3982 | ncr4604 | oxysterol binding protein (RefSeq aa 1e-87) | NP_002547.1 | 1 |
| 3983 | fCR0918 | p55PIK phosphatidylinositol 3-kinase regulatory subunit | S79169 | 1 |
| 3984 | MIOB1573 | perilipin | AB005293.1 | 1 |
| 3985 | seob4213 | phosphatidylcholine 2-acylhydrolase (cPLA2) | M68874.1 | 1 |
| 3986 | ncrb7200 | phosphatidylinositol 3-kinase, class 3 (RefSeq aa 2e-88) | NP_002638.1 | 1 |
| 3987 | ncr4793 | Phosphatidylinositol transfer protein (PI-TPalpha) | D30036.1 | 1 |
| 3988 | MIOA4278 | phospholipase C, epsilon (PLCE)=D42108 | NM_006226.1 | 1 |
| 3989 | seob5363 | Phospholipase C-delta1 (Plcd1) | NM_017035.1 | 1 |
| 3990 | ncr7341 | phospholipase D1, phophatidylcholine-specific (PLD1) | NM_002662.1 | 1 |
| 3991 | seoa6788 | pleckstrin homology domain-containing, family A (phosphoinositide binding specific) member 1 (PLEKHA1), mRNA | XM_011878.3 | 1 |
| 3992 | MIOA2273a | prostaglandin endoperoxide H synthase-1 | AF129755.1 | 1 |
| 3993 | MIOA2691a | prostaglandin endoperoxide synthase-2, PTGS2 | D28235 | 1 |
| 3994 | MIOA3944a | RASF-A PLA2 (synovial phospholipase) | M22431 | 1 |
| 3995 | MIOA3891a | RED CELL ACID PHOSPHATASE 1, ISOZYME F (ACP1) (LOW MOLECULAR WEIGHT PHOSPHOTYROSINE PROTEIN PHOSPHATASE) (ADIPOCYTE ACID PHOSPHATASE, ISOZYME ALPHA) (62% aa) | spP24666 | 1 |
| 3996 | hfcr5454 | Sac domain-containing inositol phosphatase 2 (SAC2) | NM_014937.1 | 1 |
| 3997 | FCR0999 | saposin proteins A-D | M32221 | 1 |
| 3998 | MIOA2862a | squalene synthase | X69141 | 1 |
| 3999 | SEOA5162a | steroid 5-alpha-reductase | M32313 | 1 |

Figure 6A – EST Names Corresponding to Unique Known Genes of Figure 6

| | | | | |
|---|---|---|---|---|
| 4000 | fCR0837 | steroid membrane binding protein | X99714 | 1 |
| 4001 | MIOA0595a | steroid sulfatase (STS) | M16505 | 1 |
| 4002 | ncrc5653 | tissue factor pathway inhibitor (lipoprotein-associated coagulation inhibitor) (RefSeq aa 1e-41) | NP_006278.1 | 1 |
| 4003 | hfcr3534 | urf4 (ORF)= NADH-UBIQUINONE OXIDOREDUCTASE CHAIN= P03905 | L00016 | 1 |
| 4004 | SEOA9060 | ATP SYNTHASE B CHAIN, MITOCHONDRIAL PRECURSOR | spP24539 | 1 |
| 4005 | FCR1741 | ATP synthase inhibitor protein | M22559 | 1 |
| 4006 | MIOA0707 | ATP synthase subunit c, P1 | D13118 | 1 |
| 4007 | hfcr6692 | ATP synthase, H transporting, mitochondrial F0 complex, subunit c (subunit 9), isoform 2 (ATP5G2) | NM_005176.3 | 1 |
| 4008 | hfcr5961 | ATP synthase, H transporting, mitochondrial F1 complex, beta polypeptide(ATP5B), nuclear gene encoding mitochondrial protein,=( F1 beta subunit ) | NM_001686.1 | 1 |
| 4009 | ncr5416 | ATP synthase, H transporting, mitochondrial F1 complex, epsilon subunit(ATP5E) | NM_006886.1 | 1 |
| 4010 | ncrb6327 | ATP synthase, H transporting,mitochondrial F1 complex, O subunit (oligomycinsensitivity conferring protein) (RefSeq aa 5e-88) | NP_001688.1 | 1 |
| 4011 | MIOA3646a | ATP synthetase beta-subunit | X05606 | 1 |
| 4012 | FCR0955 | ATP synthetase epsilon-subunit, nuclear-endcoded mitochondrial | X16978 | 1 |
| 4013 | hfcr2238 | ATP(GTP)-binding protein | AJ010842.1 | 1 |
| 4014 | ncrb1175 | breast cancer metastasis-suppressor 1 (BRMS1) | AF159141.1 | 1 |
| 4015 | ncr8594 | COX15 (yeast) homolog, cytochrome c oxidase assembly protein (COX15) | NM_004376.1 | 1 |
| 4016 | ncr0524 | CYTOCHROME B | P00156 | 1 |
| 4017 | MIOA4082a | cytochrome b large subunit of complex II | D49737 | 1 |
| 4018 | MIOA0482n | cytochrome bc-1 complex core P | S74321 | 1 |
| 4019 | MIOA5893a | cytochrome c oxidase chain I [MesoCRicetus auratus] | U97674 | 1 |
| 4020 | ncr5293 | cytochrome c oxidase subunit II [Artibeus jamaicensis] | AF061340 | 1 |
| 4021 | ncrc9401 | cytochrome c oxidase subunit IV (COX4), nuclear gene encoding mitochondrial | NM_001861.1 | 1 |
| 4022 | SEOA5843 | cytochrome c oxidase subunit VIb (EC 1.9.3.1) | X13923 | 1 |
| 4023 | ncrc9438 | cytochrome c oxidase subunit VIIa polypeptide 1 (muscle) (RefSeq aa 3e-40) | NP_001855.1 | 1 |
| 4024 | MIOA3452a | cytochrome c oxidase VIIc (EC 1.9.3.1) | X52940 | 1 |
| 4025 | fcrb1867 | cytochrome c-1 (CYC1) | NM_001916.1 | 1 |
| 4026 | SEOA8550 | cytochrome oxidase I | CAA24028.1 | 1 |
| 4027 | ncr7629 | cytochrome-c oxidase (EC 1.9.3.1) chain I | C59153 | 1 |
| 4028 | seob6704 | ferredoxin 1 (FDX1) mRNA | NM_004109.1 | 1 |
| 4029 | ncrb8468 | glyoxylate reductase/hydroxypyruvatereductase (RefSeq aa 1e-62) | NP_036335.1 | 1 |
| 4030 | ncrb8102 | GTP AMP phosphotransferase mRNA, complete cds; nuclear gene for mitochondrial product | AF183419.1 | 1 |
| 4031 | hfcr9285 | Hsa4 mitochondrion cytochrome oxidase subunit II (COII) gene | U12692.1 | 1 |
| 4032 | hfcr5522 | isocitrate dehydrogenase | U52144.1 | 1 |
| 4033 | hfcr0225 | isocitrate dehydrogenase 1 (NADP ), soluble (IDH1) | NM_005896.1 | 1 |

Figure 6A – EST Names Corresponding to Unique Known Genes of Figure 6

| | | | | |
|---|---|---|---|---|
| 4034 | hfcr1694 | isocitrate dehydrogenase 3 (NAD ) gamma (IDH3G) | NM_004135.1 | 1 |
| 4035 | FCR5875 | malate dehydrogenase precursor (MDH) (mitochondrial) | AF047470 | 1 |
| 4036 | ncr7295 | malonyl-CoA decarboxylase precursor (MLYCD) | AF097832.2 | 1 |
| 4037 | BFCW0108 | mitochondria isolate Aus3 cytochrome b (CYTB) | AF042516 | 1 |
| 4038 | fcrb1922 | mitochondria solute carrier protein (MSCP) | AY032628.1 | 1 |
| 4039 | miob2926 | mitochondrial (Asian) DNA control region, sequence 87 | M76321.1 | 1 |
| 4040 | FCR4468 | mitochondrial ATP synthase c subunit (P2 form) | X69908 | 1 |
| 4041 | FCR7403 | mitochondrial ATPase subunit 9 | M16439 | 1 |
| 4042 | SEOA0388 | mitochondrial carrier homologue 1 (=CGI protein) | AF176006.1 | 1 |
| 4043 | FCR6698 | mitochondrial control region II, sample NG14 | L39338 | 1 |
| 4044 | SEOB0536 | mitochondrial cytochrome b | AB033713.1 | 1 |
| 4045 | MIOA3602a | MITOCHONDRIAL CYTOCHROME B-245 HEAVY CHAIN (P22 PHAGOCYTE B-CYTOCHROME) (NEUTROPHIL CYTOCHROME B, 91 KD POLYPEPTIDE) (CGD91-PHOX) (GP91-PHOX | spQ61093 | 1 |
| 4046 | SEOA2194a | mitochondrial cytochrome c oxidase subunits I, II and III, and ATPase subunit 6 | M27315 | 1 |
| 4047 | MIOA2569a | mitochondrial D-loop (isolate RomB15) | AJ230609.1 | 1 |
| 4048 | fcrb1759 | mitochondrial DNA complete genome | X93334.1 | 1 |
| 4049 | ncrb8206 | mitochondrial DNA, | D38112.1 | 1 |
| 4050 | MIOA4068a | mitochondrial genes coding for three transfer RNAs (specific for Phe, Val and Leu) | V00665 | 1 |
| 4051 | hfcr9726 | mitochondrial glutathione reductase and cytosolic glutathione reductase(GRD1) gene, complete cds, alternatively spliced | AF228703.1 | 1 |
| 4052 | SEOA0512 | mitochondrial HSP75 | L15189 | 1 |
| 4053 | MIOA7481a | mitochondrial initiation factor 2 | L34600 | 1 |
| 4054 | seob5033 | mitochondrial intermediate peptidase (MIPEP), nuclear gene encoding mitochondrial protein | NM_005932.1 | 1 |
| 4055 | seob4172 | MITOCHONDRIAL PROCESSING PEPTIDASE BETA SUBUNIT PRECURSOR (BETA-MPP) (P-52) | spO75439 | 1 |
| 4056 | MIOA1303 | mitochondrial processing peptidase beta-subunit | AF054182 | 1 |
| 4057 | fcrb2168 | mitochondrial solute carrier (LOC51312) | XM_040570.1 | 1 |
| 4058 | ncrb0513 | NAD(P)H: quinone oxireductase gene | M81600.1 | 1 |
| 4059 | FCR1237N | NADH dehydrogenase (ubiquinone) 1 beta subcomplex, 7 (18kD, B18) (NDUFB7) (= M33374 cell adhesion protein (SQM1)) | gi4758781 | 1 |
| 4060 | ncr1939 | NADH dehydrogenase (ubiquinone) Fe-Sprotein 4 (18kD) (NADH-coenzyme Q reductase) (RefSeq aa 4e-63) | NP_002486.1 | 1 |
| 4061 | ncr6128 | NADH dehydrogenase subunit 3(RefSeq aa 8e-35) | gi5835395 | 1 |
| 4062 | ncrb1788 | NADH dehydrogenase subunit 5 (RefSeq aa 3e-31) | gi5835398 | 1 |
| 4063 | ncrb4072 | NADH dehydrogenase(ubiquinone) 1 alpha subcomplex, 10 (42kD) (NDUFA10) | NM_004544.1 | 1 |
| 4064 | hfcr1910 | NADH:ubiquinone oxidoreductase MLRQ subunit homolog | AF164796.1 | 1 |
| 4065 | MIOA6913a | NADH:ubiquinone oxidoreductase NDUFS3 (ORF) | AF067139 | 1 |
| 4066 | ncrc2523 | NADH-cytochrome b5 reductase isoform | AF125533.1 | 1 |

Figure 6A – EST Names Corresponding to Unique Known Genes of Figure 6

| | | | | |
|---|---|---|---|---|
| 4067 | SEOA8543 | NADH-UBIQUINONE OXIDOREDUCTASE 18 KD SUBUNIT PRECURSOR (COMPLEX I-18 KD) (CI-18 KD) (COMPLEX I-AQDQ) (CI-AQDQ) | spO43181 | 1 |
| 4068 | seoa8026 | NADH-UBIQUINONE OXIDOREDUCTASE 30 KD SUBUNIT PRECURSOR (COMPLEX I-30KD) (CI-30KD) | P23709 | 1 |
| 4069 | FCR0297 | NADH-UBIQUINONE OXIDOREDUCTASE B17 SUBUNIT (COMPLEX I-B17) (CI-B17) | spQ29259 | 1 |
| 4070 | seob3670 | NADH-ubiquinone oxidoreductase B8 subunit mRNA, nuclear gene encoding mitochondrial protein, | AF077029 | 1 |
| 4071 | hfcr3972 | NADH-UBIQUINONE OXIDOREDUCTASE CHAIN 3 | P03897 | 1 |
| 4072 | ncr0171 | NADH-UBIQUINONE OXIDOREDUCTASE CHAIN 5 | P03915 | 1 |
| 4073 | SEOA8276 | NADH-UBIQUINONE OXIDOREDUCTASE MWFE SUBUNIT (COMPLEX I-MWFE) (CI-MWFE) | spO15239 | 1 |
| 4074 | ncrc0798 | NADH-ubiquinone oxidoreductase subunit B14.5B homolog mRNA, complete cds | AF070652.1 | 1 |
| 4075 | FCR4160 | NADH-ubiquinone oxidoreductase subunit CI-B8 | AF047185 | 1 |
| 4076 | FCR7031 | NADPH-flavin reductase | D26308 | 1 |
| 4077 | ncr1351 | NDUFB8 gene | Y16004.1 | 1 |
| 4078 | ncrb5609 | NRH:quinone oxidoreductase 2 gene (NQO2) | AB050248.1 | 1 |
| 4079 | FCR6455 | nuclear aconitase (mitochondrial) | U80040 | 1 |
| 4080 | MIOA5326a | p6=cytochrome c oxidase subunit VIc homolog/COSVIc/prostatic carcinoma upregulated gene (ORF) | S82616 | 1 |
| 4081 | ncrc0564 | quinolinate phosphoribosyltransferase (nicotinate-nucleotide pyrophosphorylase (carboxylating)) (QPRT), mRNA | NM_014298.2 | 1 |
| 4082 | hfcr9940 | succinate dehydrogenase iron-protein subunit (sdhB) gene | U17248.1 | 1 |
| 4083 | hfcr3921 | Succinic semialdehyde dehydrogenase (SSADH) (ORF) | NM_001080.1 | 1 |
| 4084 | miob1125 | succinyl-CoA synthetase GTP-specific beta subunit | AF171077.1 | 1 |
| 4085 | SEOA6887 | UBIQUINOL-CYTOCHROME C REDUCTASE COMPLEX UBIQUINONE-BINDING PROTEIN QP-C(UBIQUINOL-CYTOCHROME C REDUCTASE COMPLEX 9.5 KD PROTEIN) (COMPLEX III SUBUNIT VII) | spO14949 | 1 |
| 4086 | ncrb5227 | beacon | AAG34704.1 | 1 |
| 4087 | SEOA0045n | biotinidase | U03274 | 1 |
| 4088 | BFCS0198 | dihydroxypolyprenylbenzoate methyltransferase (low match) | L20427 | 1 |
| 4089 | fcrb1241 | folylpolyglutamate synthase (FPGS) mRNA | NM_004957.1 | 1 |
| 4090 | hfcr9475 | isolate sporadic PCT patient 10 uroporphyrinogen decarboxylase (UROD) | AF104440.1 | 1 |
| 4091 | SEOA9321 | non-functional folate binding protein | NP_037439.1 | 1 |
| 4092 | ncr3319 | nonfunctional GM3 synthase | AF119417.1 | 1 |
| 4093 | hfcr1806 | Porphobilinogen deaminase (PBG-D, EC 4.3.1.8)(=hydroxymethylbilane synthase) | X04217.1 | 1 |
| 4094 | FCR3706 | pterin-4a-carbinolamine dehydratase (PCBD) (=M83742 cofactor) | L41559 | 1 |
| 4095 | seob6414 | nonhepatic arginase | D86724.1 | 1 |
| 4096 | ncrb2428 | 6-pyruvoyltetrahydropterin synthase(RefSeq aa 7e-39) | NP_000308.1 | 1 |

Figure 6A – EST Names Corresponding to Unique Known Genes of Figure 6

| | | | |
|---|---|---|---|
| 4097 MIOA9061 | amine oxidase, copper containing 3 (vascular adhesion protein 1) (AOC3), mRNA | NM_003734.2 | 1 |
| 4098 BFCN0124 | Arg/Abl-interacting protein ArgBP2a (ArgBP2a) (=AB018320 hypothetical protein (KIAA0777)) | AF049884 | 1 |
| 4099 ncr0791 | ArgBPIB protein (=Arg protein tyrosine kinase-binding protein) | X95677.1 | 1 |
| 4100 FCR5407 | arginine methyltransferase | Y10806 | 1 |
| 4101 ncr6408 | aspartate aminotransferase 1 (RefSeq aa 1e-51) | NP_002070.1 | 1 |
| 4102 ncrc1775 | basic leucine zipper nuclear factor 1 (JEM-1) (BLZF1) | NM_003666.1 | 1 |
| 4103 mioa7688a | colon and small intestine-specific cysteine-rich protein precursor similar to FIZZ2/resistin-like protein (HXCP2), mRNA /cds=(98,433) /gb=NM_032579 /gi=14211896 /ug=Hs.307047 /len=1250 | Hs.307047 | 1 |
| 4104 ncr2273 | cytidine deaminase | AF061658.1 | 1 |
| 4105 HFCR3256 | DHHC1 protein | AF247703.1 | 1 |
| 4106 seob7931 | dipeptidyl peptidase IV (CD26) | U13735.1 | 1 |
| 4107 fcrb2462 | duodenal cytochrome b (FLJ23462), mRNA | XM_015916.2 | 1 |
| 4108 ncr1420 | extremely cysteine/valine rich protein [Leishmania major] | AL390114 | 1 |
| 4109 MIOA7241a | fucosidase, alpha-L- 1, tissue (FUCA1) | gi4503802 | 1 |
| 4110 hfcr6524 | fumarase nuclear gene encoding mitochondrial protein | U48857.1 | 1 |
| 4111 SEOA3063a | fumarase precursor (FH) (mitochondrial) | U59309 | 1 |
| 4112 fcrb2160 | gamma-glutamyl hydrolase (conjugase, folylpolygammaglutamyl hydrolase) (GGH) | XM_005313.4 | 1 |
| 4113 ncrc3453 | glutaminase isoform C mRNA, 3'UTR | AF097494.1 | 1 |
| 4114 seoa6801 | glutaminyl-peptide cyclotransferase (glutaminyl cyclase) (QPCT), mRNA /cds=(11,1096) /gb=NM_012413 /gi=9257235 /ug=Hs.79033 /len=1573 | Hs.79033 | 1 |
| 4115 ncr3138 | glycine C-acetyltransferase (2-amino-3-ketobutyrate-CoA ligase) (GCAT) | NM_014291.1 | 1 |
| 4116 ncrc6435 | glycine cleavage system protein H (aminomethyl carrier) (RefSeq aa 2e-43) | NP_004474.1 | 1 |
| 4117 FCR6866 | glycine-rich protein 2 | AJ130887 | 1 |
| 4118 FCR3883 | glycosylasparaginase (=X55330;M64073) | X55762 | 1 |
| 4119 fcrb1604 | glycosyltransferase (LOC83468) | XM_049187.2 | 1 |
| 4120 SEOA6235 | H-protein | M69175 | 1 |
| 4121 hfcr3579 | HPV16 E1 protein binding protein | U96131.1 | 1 |
| 4122 ncrb5272 | HPV-16 E2 binding protein (E2BP-1) (=TCFL5) | AF070992.1 | 1 |
| 4123 FCR4467 | isoleucyl-tRNA synthetase | D28473 | 1 |
| 4124 ncrc6953 | isovaleryl-CoA dehydrogenase (IVD) gene, exon 12 and partial cds | AF038318.1 | 1 |
| 4125 ncrc4224 | Kreisler (mouse) maf-related leucine zipper homolog (KRML) | NM_005461.1 | 1 |
| 4126 miob3794 | kynurenine 3-monooxygenase (kynurenine 3-hydroxylase) (KMO) | NM_003679.1 | 1 |
| 4127 ncrc3255 | lacrimal proline rich protein (RefSeq aa 2e-78) | NP_009175.1 | 1 |
| 4128 SEOA2413 | L-arginine:glycine amidinotransferase | X86401 | 1 |
| 4129 MIOA4109 | Leu zipper protein p40(61%) | gi\|382917 | 1 |
| 4130 FCR3528 | leucine zipper protein Fip3p (=AF074382 IkB kinase gamma subunit) | AF062089 | 1 |

Figure 6A – EST Names Corresponding to Unique Known Genes of Figure 6

| | | | | |
|---|---|---|---|---|
| 4131 | fcrb1996 | leucine-zipper protein FKSG13 (LOC90598) | XM_032849.1 | 1 |
| 4132 | seob7681 | lysosomal glycosylasparaginase (AGA) (=X55330.1 aspartylglucosaminidase) | U21281.1 | 1 |
| 4133 | ncr0007 | MBIP protein (MBIP) | NM_016586.1 | 1 |
| 4134 | SEOA6078a | methionine adenosyltransferase regulatory beta subunit | AF182814 | 1 |
| 4135 | ncr0291 | methionyl tRNA synthetase | D84224 | 1 |
| 4136 | hfcr9995 | methyl-CpG binding domain protein 3 (MBD3) | NM_003926.4 | 1 |
| 4137 | ncrc9707 | mitochondrial isoleucine tRNA synthetase, Length = 3387 | D28500.1 | 1 |
| 4138 | MIOA7593a | ornithine decarboxylase (contains Alu repeat) | M33764 | 1 |
| 4139 | ncr0851 | ornithine decarboxylase antizyme 2 (OAZ2) | NM_002537.1 | 1 |
| 4140 | SEOA3144 | orotidine 5'-monophosphate decarboxylase | M36661 | 1 |
| 4141 | FCR5627 | periodic tryptophan protein 2 (PWP2) | U56085 | 1 |
| 4142 | ncrc4757 | polyglutamine-containing C14ORF4 gene | AJ277365.1 | 1 |
| 4143 | hfcr7498 | proline isomerase FK506-binding protein (FKBP13) gene | L18980.1 | 1 |
| 4144 | miob6728 | pyrroline-5-carboxylate synthase long form (P5CSL) | U76542.1 | 1 |
| 4145 | ncr6316 | selenium binding protein 1 (RefSeq aa 8e-40) | NP_003935.1 | 1 |
| 4146 | hfcr7320 | selenocysteine lyase (SCLY) | NM_016510.1 | 1 |
| 4147 | fcrb1611 | serine (or cysteine) proteinase inhibitor, clade H (heat shock protein 47) member 2 (SERPINH2) | XM_035024.2 | 1 |
| 4148 | ncrc3161 | serine carboxypeptidase 1 precursor protein (HSCP1) | NM_021626.1 | 1 |
| 4149 | seob7304 | spermine synthase gene | AJ009633.1 | 1 |
| 4150 | hfcr6288 | suppressor of S. cerevisiae gcr2 (HSGT1) | NM_007265.1 | 1 |
| 4151 | FCR2842N | BCS1 (yeast homolog)-like (BCS1L) | AF026849 | 1 |
| 4152 | mioa9258 | SCAD gene, 5' UTR exon 1 and 2 (and joined CDS) | Z80345.1 | 1 |
| 4153 | hfcr3450 | selenoprotein N | AF166125.1 | 1 |
| 4154 | hfcr0710 | selenoprotein X (LOC51734) | NM_016332.1 | 1 |
| 4155 | fcrb2437 | LENG5 protein (LENG5), mRNA | NM_024075.1 | 1 |
| 4156 | FCR5472 | cap-binding protein 4EHP | AF047695 | 1 |
| 4157 | ncr8867 | elongin B; transcription elongation factor B, polypeptide 2 (RefSeq aa 2e-44) | NP_009039.1 | 1 |
| 4158 | miob2903 | eukaryotic initiation factor 2B-epsilon | U23028.1 | 1 |
| 4159 | FCR5728 | eukaryotic translation initiation factor (eIF3) | U78525 | 1 |
| 4160 | ncrb6949 | eukaryotic translation initiation factor 1A (RefSeq aa 6e-69) | NP_001403.1 | 1 |
| 4161 | miob0784 | eukaryotic translation initiation factor 3, subunit 5 (epsilon, 47kD) (EIF3S5) | NM_003754.1 | 1 |
| 4162 | hfcr3540 | eukaryotic translation initiation factor 3, subunit 8 (110kD) (EIF3S8)(ORF) | NM_003752.2 | 1 |
| 4163 | hfcr8591 | eukaryotic translation initiation factor 3, subunit 9 (eta, 116kD) (EIF3S9) | NM_003751.1 | 1 |
| 4164 | ncrb1802 | eukaryotic translation initiation factor 4 gamma, 3 (EIF4G3) | NM_003760.2 | 1 |
| 4165 | ncrb6480 | hydatidiform mole associated and imprinted (HYMAI) | AF241534.1 | 1 |
| 4166 | seob4539 | initiation factor eIF-2B gamma subunit (eIF-2B gamma) | U38253.1 | 1 |
| 4167 | ncr5803 | MAMMA1 cDNA clone MAMMA1001942 5 | AU122237.1 | 1 |
| 4168 | SEOA6144a | met-tRNA-i gene 2 (clone lambda-htm2) | J00311 | 1 |
| 4169 | hfcr1254 | peptide elongation factor 1-beta mRNA, complete cds | AF103726 | 1 |

Figure 6A – EST Names Corresponding to Unique Known Genes of Figure 6

| | | | |
|---|---|---|---|
| 4170 mioa0571a | region containing eukaryotic translation elongation factor 1 alpha 1-like 14; eukaryotic translation elongation factor 1 alpha 1(LOC82256) | XM_016036.1 | 1 |
| 4171 hfcr7815 | translation initiation factor 4e | AF038957.1 | 1 |
| 4172 SEOB3589 | translation repressor NAT1 (=eukaryotic translation initiation factor 4 gamma, 2 (EIF4G2) | U76111.1 | 1 |
| 4173 SEOA0545A | unr-interacting protein | AJ010025.1 | 1 |
| 4174 seob6342 | 838.98 23S ribosomal RNA gene | AF146762.1 | 1 |
| 4175 mioa9541 | GAR1 protein (GAR1 gene) | AJ276003.1 | 1 |
| 4176 fcrb1541 | mitochondrial ribosomal protein L11 (MRPL11) | XM_006493.4 | 1 |
| 4177 seoa7890a | mitochondrial ribosomal protein L18 (MRPL18), mRNA /cds=(123,662) /gb=NM_014161 /gi=7661777 /ug=Hs.23038 /len=968 | Hs.23038 | 1 |
| 4178 seoa7707a | mitochondrial ribosomal protein L22 (MRPL22), mRNA /cds=(6,692) /gb=NM_014180 /gi=7661815 /ug=Hs.41007 /len=724 | Hs.41007 | 1 |
| 4179 seoa7975 | mitochondrial ribosomal protein L3 (MRPL3), mRNA /cds=(76,1122) /gb=NM_007208 /gi=6005861 /ug=Hs.79086 /len=1634 | Hs.79086 | 1 |
| 4180 seoa7839a | mitochondrial ribosomal protein L33 (MRPL33), mRNA /cds=(35,232) /gb=NM_004891 /gi=4759047 /ug=Hs.14454 /len=512 | Hs.14454 | 1 |
| 4181 BFCN0203 | mitochondrial ribosomal protein S12 | Y11681 | 1 |
| 4182 mioa7875 | mitochondrial ribosomal protein S21 (MRPS21), transcript variant 2, nuclear gene encoding mitochondrial protein, mRNA /cds=(518,781) /gb=NM_018997 /gi=16950592 /ug=Hs.81281 /len=939 | Hs.81281 | 1 |
| 4183 seoa8126 | mitochondrial ribosomal protein S30 (MRPS30), mRNA /cds=(38,1357) /gb=NM_016640 /gi=16950598 /ug=Hs.28555 /len=1482 | Hs.28555 | 1 |
| 4184 ncr3655 | ribosomal L21 protein gene | L38826.1 | 1 |
| 4185 FCR4212 | ribosomal protein (RPS4Y) isoform | M58459 | 1 |
| 4186 ncr5760 | ribosomal protein 60S acidic ribosomal | NM_016183.1 | 1 |
| 4187 mioa9722 | ribosomal protein L17 isolog | AF164797 | 1 |
| 4188 SEOA3737a | ribosomal protein L20 | AE002038 | 1 |
| 4189 FCR1312 | ribosomal protein LLRep3 | X17206 | 1 |
| 4190 ncrc9867 | ribosomal protein, complete cds | D23660.1 | 1 |
| 4191 FCR6630 | ribosomal RNA 12S | X13956 | 1 |
| 4192 SEOA4293a | ribosomal RNA 23S gene | AF146762 | 1 |
| 4193 MIOB2859 | ribosomal RNA 28S | M30952.1 | 1 |
| 4194 ncr4539 | Ribosomal RNA processing | NM_014285.1 | 1 |
| 4195 SEOA6504a | ribosomal RNA, large subunit ATCC 46578 | U17421 | 1 |
| 4196 MIOA2214a | ribosomal subunit protein L13 | AE000402 | 1 |
| 4197 SEOB1008 | ribosome associated membrane protein RAMP4 | AJ238236.1 | 1 |
| 4198 BFCW0530 | ribosome receptor, p180 | X87224 | 1 |
| 4199 fcrb2757 | RPL15 gene for ribosomal protein L15, complete cds and sequence | AB061823.1 | 1 |
| 4200 ncrc3648 | RPL6 gene for ribosomal protein L6, complete cds | AB042820.1 | 1 |
| 4201 SEOA8783 | STEROL-REGULATORY ELEMENT-BINDING PROTEINS INTRAMEMBRANE PROTEASE (SITE-2 PROTEASE) | spO43462 | 1 |

Figure 6A – EST Names Corresponding to Unique Known Genes of Figure 6

| | | | | |
|---|---|---|---|---|
| 4202 | ncrb4390 | surf3 gene (ribosomal protein L7a) | X61923.1 | 1 |
| 4203 | MIOA4686 | acid sphingomyelinase (ASM) gene, exons a, and alternative a (3' end), b and c (5' end). | M59917 | 1 |
| 4204 | SEOA6661a | ADAMTS-1 | AB001735 | 1 |
| 4205 | seob7906 | amyloid precursor protein homolog HSD-2 | AF168956.1 | 1 |
| 4206 | MIOA7606a | amyloid precursor protein-binding protein 1 | U50939 | 1 |
| 4207 | FCR1060 | antileukoprotease (ALP) | X04470 | 1 |
| 4208 | hfcr0285 | basigin (BSG)(= M6 antigen) | NM_001728.1 | 1 |
| 4209 | MIOA8648 | CARBOXYPEPTIDASE H PRECURSOR (CPH) (CARBOXYPEPTIDASE E) (CPE) (ENKEPHALIN CONVERTASE) (PROHORMONE PROCESSING CARBOXYPEPTIDASE) | spP16870 | 1 |
| 4210 | hfcr8510 | carboxypeptidase Z (CPZ) | NM_003652.1 | 1 |
| 4211 | MIOB2836 | cathepsin S (CTSS) | M90696.1 | 1 |
| 4212 | seob6256 | cathepsin Z precursor (CTSZ) gene, exons 4, 5, and 6 and complete cds; and TH1 gene partial sequence (=HSPC130) | AF136276.1 | 1 |
| 4213 | FCR6553 | collagenase stimulatory factor (EMMPRIN) (=L20471 extracellular matrix metalloproteinase inducer) | L10240 | 1 |
| 4214 | ncrb5145 | cysteine sulfinic acid decarboxylase-related protein 4 (CSAD) | AF116548.1 | 1 |
| 4215 | hfcr9884 | ENO2 gene for neuron specific (gamma) enolase (=enolase 2, (gamma, neuronal)) | X51956.1 | 1 |
| 4216 | seob4612 | inhibitor 2 of protein phosphatase 1 | AJ133812.1 | 1 |
| 4217 | hfcr6921 | matrix metalloproteinase 19 (MMP19) | NM_002429.1 | 1 |
| 4218 | FCR5141 | metallocarboxypeptidase CPX-1 | AF077738 | 1 |
| 4219 | seob6625 | metalloproteinase, complete cds | D83646.1 | 1 |
| 4220 | ncrb4782 | pancreatic carboxypeptidase B1precursor (RefSeq aa 5e-49) | NP_001862.1 | 1 |
| 4221 | miob1074 | parvulin | AB009690.1 | 1 |
| 4222 | ncrc5744 | peflin (PEF) | NM_012392.1 | 1 |
| 4223 | fcrb1929 | peptidase (mitochondrial processing) beta (PMPCB) | XM_055749.1 | 1 |
| 4224 | SEOA4452a | peptidase D (PEPD) =J04605, prolidase(imidodipeptidase) | NM_000285.1 | 1 |
| 4225 | hfcr8361 | placental leucine aminopeptidase | D50810.1 | 1 |
| 4226 | ncrc0254 | procollagen C-proteinase enhancer protein type , complete cds | AB008549.1 | 1 |
| 4227 | ncrb6394 | procollagen type I proalpha 1 | K01228.1 | 1 |
| 4228 | fcrb1128 | procollagen type I pro-alpha 2 chain (COL1A2) mRNA, complete cds | AF035120 | 1 |
| 4229 | MIOA7973a | prostasin | U33446 | 1 |
| 4230 | ncr7382 | protease inhibitor 1 (anti-elastase),alpha-1-antitrypsin (RefSeq aa 3e-43) | NP_000286.1 | 1 |
| 4231 | ncr8866 | protease inhibitor 9 (ovalbumin type)(RefSeq aa 6e-31) | NP_004146.1 | 1 |
| 4232 | FCR0751 | protease subunit S5a (=U72664 S5a/antiseCRetory factor protein) 26S | U51007 | 1 |
| 4233 | hfcr8495 | protease, serine, 15 (PRSS15) (=Lon protease) | NM_004793.1 | 1 |
| 4234 | hfcr6840 | proteasome (prosome, macropain) 26S subunit, ATPase, 4 (PSMC4) (=MIP224) | NM_006503.1 | 1 |
| 4235 | ncr4737 | proteasome (prosome, macropain) 26S subunit, non-ATPase, 10 (PSMD10) | NM_002814.1 | 1 |

Figure 6A – EST Names Corresponding to Unique Known Genes of Figure 6

| | | | |
|---|---|---|---|
| 4236 hfcr1324 | proteasome (prosome, macropain) 26S subunit, non-ATPase, 7 (Mov34 homolog)(PSMD7) (ORF) | NM_002811.1 | 1 |
| 4237 ncrc9978 | proteasome (prosome, macropain)activator subunit 2 (PA28 beta) (RefSeq aa 6e-83) | NP_002809.1 | 1 |
| 4238 ncrc0803 | proteasome (prosome, macropain)subunit, alpha type, 1 (RefSeq aa 3e-36) | NP_002777.1 | 1 |
| 4239 ncrc2685 | proteasome (prosome, macropain)subunit, alpha type, 5 (RefSeq aa 6e-35) | NP_002781.1 | 1 |
| 4240 ncrc6367 | proteasome (prosome, macropain)subunit, beta type, 5 (RefSeq aa 2e-41) | NP_002788.1 | 1 |
| 4241 MIOA5695 | proteasome (prosome,maCRopain) 26S subunit, non-ATPase, 1 (PSMD1) =D44466 ,proteasome subunit p112, | NM_002807.1 | 1 |
| 4242 ncr8314 | proteasome (prosome,macropain) 26S subunit, non-ATPase, 9 (PSMD9), mRNA | NM_002813.1 | 1 |
| 4243 SEOB0678a | PROTEASOME COMPONENT C3 (MACROPAIN SUBUNIT C3)(MULTICATALYTIC ENDOPEPTIDASE COMPLEX SUBUNIT C3) | spP25787 | 1 |
| 4244 SEOA8854 | PROTEASOME COMPONENT C5 (MACROPAIN SUBUNIT C5) (PROTEASOME GAMMA CHAIN) (MULTICATALYTIC ENDOPEPTIDASE COMPLEX SUBUNIT C5) | spP20618 | 1 |
| 4245 BFCN0096 | proteasome inhibitor hPI31 subunit | D88378 | 1 |
| 4246 MIOA2094 | proteasome subunit HsC7-I | D26599 | 1 |
| 4247 FCR4012 | proteasome subunit p3126S | D38047 | 1 |
| 4248 FCR7386 | proteasome subunit p44.5 26S | AB003102 | 1 |
| 4249 FCR7171 | proteasome subunit p58 | D67025 | 1 |
| 4250 hfcr6847 | proteasome subunit p97 26S | D78151.1 | 1 |
| 4251 fcrb1066 | protein arginine N-methyltransferase 1 (HRMT1L2) gene, complete cds, alternatively spliced, low match | AF222689 | 1 |
| 4252 MIOA7465a | protein arginine N-methyltransferase 2 (PRMT2) | U80213 | 1 |
| 4253 SEOB0002 | PROTEIN PLT | spQ02083 | 1 |
| 4254 SEOA0721a | protein product (=AF125387) D.melanogaster L82D) | AK000987 | 1 |
| 4255 ncr1122 | protein rapamycin associated protein (FRAP2) gene | U88966.1 | 1 |
| 4256 ncr3396 | protein translocation complex beta (SEC61B) | NM_006808.1 | 1 |
| 4257 FCR3575 | proteinase chain 5a (non-exact 71%) 26S | NM_002810.1 | 1 |
| 4258 miob3655 | serine protease, umbilical endothelium (SPUVE) | NM_007173.1 | 1 |
| 4259 SEOA6565a | sorting nexin 10 (SNX10) | AF121860.1 | 1 |
| 4260 hfcr6727 | sorting nexin 11 (SNX11) | NM_013323.1 | 1 |
| 4261 SEOA6621a | stromelysin-3 | X57766 | 1 |
| 4262 FCR3731 | thimet oligopeptidase (metalloproteinase) (=U29366) | Z50115 | 1 |
| 4263 MIOB2656 | thrombin inhibitor | Z22658.1 | 1 |
| 4264 MIOA8666 | TIMP-3 (=mig-5) (=K222) | D45917 | 1 |
| 4265 seob5003 | tissue inhibitor of metalloproteinase 2 (TIMP2) | NM_003255.1 | 1 |
| 4266 seob4896 | tissue inhibitor of metalloproteinase 4 (TIMP4) gene | AF057532.1 | 1 |
| 4267 seob4804 | tripeptidyl peptidase II (TPP2) | NM_003291.1 | 1 |
| 4268 ncr9460 | trypsin-like serine protease (TLSP) gene | AF164623.1 | 1 |
| 4269 hfcr9894 | Ubc6p homolog | U93242.1 | 1 |
| 4270 MIOA0626a | 33 polypeptide | X07266 | 1 |
| 4271 seob5538 | BRCA1, Rho7 and vatI genes | L78833.1 | 1 |
| 4272 ncr3139 | BRCA1-associated RING domain protein (BARD1) | AF038042.1 | 1 |

Figure 6A – EST Names Corresponding to Unique Known Genes of Figure 6

| | | | | |
|---|---|---|---|---|
| 4273 | HFCR3165 | chaperonin subunit 5 (epsilon) (Cct5) (=D43950.1 Human KIAA0098) | gi6671701 | 1 |
| 4274 | seob4322 | deubiquitinating enzyme (UNPH4)= AF153604 ubiquitin-specific protease homolog (UPH) | AF106069 | 1 |
| 4275 | miob4756 | E1-E2 ATPase | AF155913.1 | 1 |
| 4276 | ncr5442 | farnesy ltransferase,CAAX box, beta (FNTB) | NM_002028.1 | 1 |
| 4277 | ncrb1549 | F-box only protein 3 (FBXO3) | NM_012175.1 | 1 |
| 4278 | seoa7709a | F-box only protein 9 (FBXO9), transcript variant 2, mRNA /cds=(367,1680) /gb=NM_033480 /gi=15812200 /ug=Hs.11050 /len=3454 | Hs.11050 | 1 |
| 4279 | SEOA5465a | F-box protein Fbl3a (ORF) | AF129532_1 | 1 |
| 4280 | SEOA6129a | F-box protein FBX11 | AF176706 | 1 |
| 4281 | miob2960 | F-box protein Fbx25 | AAF04526.1 | 1 |
| 4282 | ncrb2771 | F-box protein FBX29 (FBX29) | AF176707.1 | 1 |
| 4283 | ncrc1029 | F-box protein Lilina (LILINA) | AF179221.1 | 1 |
| 4284 | FCR3698 | hkf-1 | D76444 | 1 |
| 4285 | hfcr2784 | huntingtin interacting protein HYPB | AF049610.1 | 1 |
| 4286 | ncr3376 | huntingtin-interacting | AF049528 | 1 |
| 4287 | ncr1507 | LUCA-15 protein splice variant | AF107493 | 1 |
| 4288 | FCR2102 | miCRosomal signal peptidase complex (SPC 18) | J05466 | 1 |
| 4289 | hfcr1259 | MRS1 protein (MRS1) | NM_015368.1 | 1 |
| 4290 | ncrb3284 | myristoyl-CoA:protein N-myristoyltransferase | Y17208.1 | 1 |
| 4291 | fcrb2167 | Nedd-4-like ubiquitin-protein ligase (LOC116013) | XM_057201.1 | 1 |
| 4292 | fCR0791 | neuronal calcium sensor (NCS-1) | L27421 | 1 |
| 4293 | SEOB3503 | N-myristoyltransferase 2 (NMT2) | NM_004808.1 | 1 |
| 4294 | hfcr0263 | paired basic amino acid cleaving enzyme (furin, membrane associated receptor protein) (PACE) | NM_002569.1 | 1 |
| 4295 | fcrb2652 | peptidylprolyl isomerase (cyclophilin)-like 3 (PPIL3)(= similar to 4-1BB-mediated signaling molecule,) | NM_032472.1 | 1 |
| 4296 | cr0026 | peptidylprolyl isomerase D (cyclophilin D) (PPID), mRNA /cds=(99,1211) /gb=NM_005038 /gi=4826931 /ug=Hs.143482 /len=1812 | Hs.143482 | 1 |
| 4297 | FCR3005 | peroxisomal acyl-coenzyme A oxidase | S69189 | 1 |
| 4298 | BFCW0326 | PEROXISOMAL ANTIOXIDANT ENZYME (LIVER TISSUE 2D-PAGE SPOT 71B) | spP30044 | 1 |
| 4299 | SEOA2972a | peroxisomal Ca-dependent solute carrier | AF004161 | 1 |
| 4300 | FCR0637 | prolyl oligopeptidase | X74496 | 1 |
| 4301 | miob6087 | protein disulfide isomerase-related (PDIR) | NM_006810.1 | 1 |
| 4302 | FCR1182 | protein gene product (PGP) 9.5 (=P09936 UBIQUITIN CARBOXYL-TERMINAL HYDROLASE ISOZYME L1 (UCH-L1)) | X04741 | 1 |
| 4303 | hfcr8957 | rapamycin- and FK506-binding protein | M75099.1 | 1 |
| 4304 | MIOA8051a | ribophorin I | Y00281 | 1 |
| 4305 | ncrc0508 | signal recognition particle 19kD (SRP19), mRNA | NM_003135.1 | 1 |
| 4306 | MIOA8622 | site-1 protease(subtilisin-like, sterol-regulated, cleaves sterol regulatory element binding proteins) (S1P) (=KIAA0091) | NM_003791.1 | 1 |
| 4307 | MIOA2993a | SRcyp protein (=U40763 Clk-associated RS cyclophilin CARS-Cyp) | X99717 | 1 |
| 4308 | hfcr5514 | synthetic ubiquitin (UBCEP80) gene | M24507.1 | 1 |
| 4309 | SEOA2467 | TL132 | AJ012755 | 1 |
| 4310 | MIOA8704 | translocon-associated protein alpha subunit (=DCN) | AF156965.1 | 1 |

Figure 6A – EST Names Corresponding to Unique Known Genes of Figure 6

| | | | |
|---|---|---|---|
| 4311 FCR4214 | ubiquinone oxidoreductase complex CI-PDSW | X63224 | 1 |
| 4312 ncrc0095 | ubiquitin associated protein (UBAP), | NM_016525.2 | 1 |
| 4313 SEOA0488 | UBIQUITIN CARBOXYL-TERMINAL HYDROLASE 64E (UBIQUITIN THIOLESTERASE 64E) | spQ24574 | 1 |
| 4314 hfcr9727 | ubiquitin carrier protein E2-C (UBCH10)(= cyclin-selective ubiquitin carrier protein) | NM_007019.1 | 1 |
| 4315 FCR2859 | ubiquitin conjugating enzyme (UbcH8) | AF031141 | 1 |
| 4316 hfcr4112 | ubiquitin conjugating enzyme type UBC9 | X96427.1 | 1 |
| 4317 SEOB3313 | Ubiquitin conjugating enzyme UEV1Bs (UBE2V) | U97280.1 | 1 |
| 4318 ncrc6984 | ubiquitin fusion degradation 1-like(RefSeq aa 6e-57) | NP_005650.1 | 1 |
| 4319 fCR1002 | ubiquitin ligase (Nedd4) protein | U50842 | 1 |
| 4320 ncr9105 | ubiquitin specific protease 13 (isopeptidase T-3) (RefSeq aa 2e-63) | NP_003931.1 | 1 |
| 4321 seoa8109 | ubiquitin specific protease 3 (USP3), mRNA /cds=(93,1658) /gb=NM_006537 /gi=5730109 /ug=Hs.251636 /len=2309 | Hs.251636 | 1 |
| 4322 ncr8337 | ubiquitin specific protease 7 (herpes virus-associated) (USP7), mRNA | NM_003470.1 | 1 |
| 4323 seob4835 | ubiquitin specific protease 8 (USP8)(=KIAA0055) | NM_005154.1 | 1 |
| 4324 ncrb4990 | ubiquitin specific protease 9 (USP9Y) | XM_000563.1 | 1 |
| 4325 ncr9587 | ubiquitin-activating enzyme E1 (A1S9T and BN75 temperature sensitivity complementing)(UBE1) | NM_003334.1 | 1 |
| 4326 hfcr1744 | ubiquitinating enzyme E2-230 kDa | U20780.1 | 1 |
| 4327 MIOA8274 | UBIQUITIN-CONJUGATING ENZYME E2-17 KD (UBIQUITIN-PROTEIN LIGASE) (UBIQUITIN CARRIER PROTEIN) (HR6B) | spP23567 | 1 |
| 4328 MIOA1971a | ubiquitin-conjugating enzyme E2A (RAD6 homolog) (UBE2A) (=M74524 HHR6A (yeast RAD 6 homologue)) | gi4507768 | 1 |
| 4329 fcrb2596 | ubiquitin-conjugating enzyme E2I (homologous to yeast UBC9) | XM_007786.5 | 1 |
| 4330 SEOA4606a | ubiquitin-conjugating enzyme E2L 1 (UBE2L1) = (UBE2L3) =UbcH7(ORF) | NM_003346.1 | 1 |
| 4331 ncrb4547 | ubiquitin-conjugating enzyme HBUCE1 (LOC51619) | NM_015983.1 | 1 |
| 4332 FCR4405 | ubiquitin-conjugating enzyme UbcM2 | AF003346 | 1 |
| 4333 SEOA0065 | ubiquitin-conjugating enzyme UbcM3 | X92665 | 1 |
| 4334 fCR0285 | ubiquitin-like protein | D23662 | 1 |
| 4335 ncrc6096 | ubiquitin-protein ligase E3-alpha (UBR1) gene, exon 9 | AF067385.1 | 1 |
| 4336 fcrb1921 | ubiquitin-protein ligase NEDD4-like (NEDD4L) | NM_015277.1 | 1 |
| 4337 ncr7151 | vacuolar protein sorting 35 | NM_018206.1 | 1 |
| 4338 seob5080 | vacuolar protein sorting 45B (yeast homolog) (VPS45B) | NM_007259.1 | 1 |
| 4339 BFCW0426 | vacuolar protein sorting homologue h-vps45 | U35246 | 1 |
| 4340 ncrb8538 | vacuolar protein sorting protein 16 | AAG34678.1 | 1 |
| 4341 FCR0018n | VACUOLAR PROTEIN SORTING-ASSOCIATED PROTEIN VPS28 | spQ02767 | 1 |
| 4342 seob4805 | vacuolar proton pump delta polypeptide (VATD) | NM_015994.1 | 1 |
| 4343 mioa9510 | zinc metalloproteinase,STE24 (yeast, homolog) (ZMPSTE24) | NM_005857.1 | 1 |
| 4344 seob8090 | zinc transporter 1 (ZNT1) | AF048701.1 | 1 |
| 4345 MIOA7555a | AZ2 | AB007141 | 1 |
| 4346 MIOA8261 | bromodomain protein CELTIX1 | AAF19526.1 | 1 |

Figure 6A – EST Names Corresponding to Unique Known Genes of Figure 6

| | | | | |
|---|---|---|---|---|
| 4347 | ncr2370 | corticotropin releasing hormone-binding protein (CRHBP) | NM_001882.2 | 1 |
| 4348 | SEOA3007a | ID4 protein | Y07958 | 1 |
| 4349 | fcrb1989 | inhibitor of DNA binding 2, dominant negative helix-loop-helix protein (ID2) | XM_045365.1 | 1 |
| 4350 | ncr8843 | inhibitor of kappa light polypeptide gene enhancer in B-cells, kinase complex-associated protein; IKAP (RefSeq aa 3e-69) | NP_003631.1 | 1 |
| 4351 | MIOA5511a | methyl-CpG-binding protein 2 | AJ132917.1 | 1 |
| 4352 | FCR0259 | modifier 3 (M33) (=Y13274 M33 polycomb-like protein) | Y13274 | 1 |
| 4353 | ncrb6960 | neural retinal-specific | U95012.1 | 1 |
| 4354 | hfcr1339 | neural specific protein CRMP-2 gene | U83278.1 | 1 |
| 4355 | ncrb1892 | TANK-binding kinase 1 (TBK1) | NM_013254.1 | 1 |
| 4356 | mioa9891 | TBP-associated factor 170 (TAFII170)(low match) | AJ001017.2 | 1 |
| 4357 | hfcr7864 | 4-aminobutyrate aminotransferase (ABAT), nuclear gene encoding mitochondrial protein, (= GABAT) | NM_000663.1 | 1 |
| 4358 | ncrb0367 | activating transcription factor 6 (RefSeq aa 2e-70) | NP_031374.1 | 1 |
| 4359 | ncrb6833 | adenovirus 5 E1A binding protein (BS69) | NM_006624.1 | 1 |
| 4360 | SEOA4404a | AF-6 | AB011399 | 1 |
| 4361 | ncrb6357 | AT-binding transcription factor 1 (ATBF1)(= zinc finger homeodomain protein (ATBF1-A)(= for alpha-fetoprotein enhancer binding protein) | NM_006885.1 | 1 |
| 4362 | SEOB0304 | BACH1 | AB002803.1 | 1 |
| 4363 | SEOA6377 | basic transCRiption factor 62kD subunit (BTF2) | M95809 | 1 |
| 4364 | MIOA0307 | basic-leucine zipper nuclear factor (JEM-1) | U79751 | 1 |
| 4365 | miob3035 | BCE-1 protein (BCE-1) | NM_007005.1 | 1 |
| 4366 | ncr3380 | B-cell CLL/lymphoma 3 (BCL3) | NM_005178.1 | 1 |
| 4367 | ncr5651 | Bcl-2-associated transcription factor short form mRNA | AF249273.1 | 1 |
| 4368 | miob5031 | beta-hydroxysteroid dehydrogenase type VII 17 (HSD17B7) | AF098786.2 | 1 |
| 4369 | SEOA1069a | B-IND1 protein (B-ind1) | Z97207.2 | 1 |
| 4370 | FCR2686 | B-myb | X13293 | 1 |
| 4371 | seoa8083 | BTF3 protein homologue gene, complete cds /cds=(0,644) /gb=M90356 /gi=179575 /ug=Hs.181967 /len=645 | Hs.181967 | 1 |
| 4372 | SEOA7094a | C3HC4-like zinc finger protein | AF214680 | 1 |
| 4373 | FCR5723 | CAGH1a (CAGH1) | U80738 | 1 |
| 4374 | hfcr2301 | cAMP responsive element modulator (CREM) | AF213898.1 | 1 |
| 4375 | FCR2999 | CCAAT transCRiption binding factor subunit gamma (=U78774 NFY-C) | Z74792 | 1 |
| 4376 | FCR3101 | CCT (chaperonin containing TCP-1) epsilon subunit (=D43950 human hypothetical protein (KIAA0098)) | Z31555 | 1 |
| 4377 | MIOA6840a | cell growth regulatory with ring finger domain (CGR19=U66469 (ORF) | NM_006568.1 | 1 |
| 4378 | MIOA5368a | Che-1 (ORF) | AF083208 | 1 |
| 4379 | ncr3412 | c-helix-loop-helix-PAS orphan MOP3 | AF044288.1 | 1 |
| 4380 | ncrb8319 | chick ovalbumin upstream promoter transcription factor II (COUP-TFII) | M62760.1 | 1 |
| 4381 | SEOB2169 | cis-acting sequence | M82882.1 | 1 |

Figure 6A – EST Names Corresponding to Unique Known Genes of Figure 6

| | | | | |
|---|---|---|---|---|
| 4382 | SEOB2658 | CREB binding protein (Rubinstein-Taybi syndrome) (CREBBP) | gi4758055 | 1 |
| 4383 | MIOA7323 | CREB327=cyclic AMP-responsive enhancer binding protein | S72459 | 1 |
| 4384 | hfcr5798 | CRE-BP1 transcription factor = cyclic AMP response | U16028.1 | 1 |
| 4385 | ncrc6129 | DNA (cytosine-5-)-methyltransferase 1(RefSeq aa 3e-58) | NP_001370.1 | 1 |
| 4386 | FCR1378 | DNA for 3' untranslated region of the Id4 dominant negative helix-loop-helix gene | AJ001971 | 1 |
| 4387 | SEOA5258a | DNA-binding factor (ORF) | M29204 | 1 |
| 4388 | hfcr3454 | DNA-binding protein (mbp-1) | M32019.1 | 1 |
| 4389 | SEOA8870 | DNA-BINDING PROTEIN RFXANK | spO14593 | 1 |
| 4390 | fCR0483 | Dr1-associated corepressor (DRAP1) | U41843 | 1 |
| 4391 | BFCS0503 | erm | X96375 | 1 |
| 4392 | seob7419 | erythroid differentiation-related factor 1 | AF040247.1 | 1 |
| 4393 | FCR3686 | ETO=MTG8 (=X79990;D14289;D43638;D13979;D14821) | S78158 | 1 |
| 4394 | FCR4782 | ETS (qh43e05.x1 Soares_NFL_T_GBC_S1 clone IMAGE:1847456 3') | AI239823 | 1 |
| 4395 | hfcr9140 | ets-like protein (clone 3A) | Z49982.1 | 1 |
| 4396 | hfcr5150 | ETX1, ETX1=X-linked retintis pigmentosa (RP3) | S82496.1 | 1 |
| 4397 | fcrb2710 | frezzled (fre) mRNA, complete cds | U68057.1 | 1 |
| 4398 | ncrc5292 | Friend of GATA2 (FOG2) | NM_012082.2 | 1 |
| 4399 | seoa0985m | frizzled-1 | AB017363 | 1 |
| 4400 | FCR6733 | frizzled-7 | AB017365 | 1 |
| 4401 | MIOA4564a | g1-related zinc finger protein | AF171875 | 1 |
| 4402 | hfcr1177 | GCN5 (general control of amino-acid synthesis, yeast, homolog)-like 1 (GCN5L1) | NM_001487.1 | 1 |
| 4403 | ncrc6848 | general transcription factor IIIC, polypeptide 2 (beta subunit, 110kD) (RefSeq aa 1e-82) | NP_001512.1 | 1 |
| 4404 | hfcr1834 | GT212 | L38935.1 | 1 |
| 4405 | hfcr7448 | hairy/enhancer-of-split related with YRPW motif 1 (HEY1) (=CHF2) | NM_012258.1 | 1 |
| 4406 | miob6999 | hbrm | X72889.1 | 1 |
| 4407 | miob4851 | helix-loop-helix protein (Id-2) | M97796.1 | 1 |
| 4408 | seob5302 | helix-loop-helix transcription factor sequence | M97636.1 | 1 |
| 4409 | hfcr2687 | hepatocellular carcinoma associated ring finger protein | AF247565.1 | 1 |
| 4410 | FCR3932 | HIV associated non-Hodgkin's lymphoma (clone hl1-2) | Y16715 | 1 |
| 4411 | ncr6141 | HIV-1 rev binding protein 2 (RefSeq aa 5e-83) | NP_008974.1 | 1 |
| 4412 | ncrc4444 | HIV-1 Vpr-binding protein (VprBP) | AF061935.1 | 1 |
| 4413 | SEOA5297a | HIV-associated non-Hodgkin's lymphoma (clone hl2-1) | Y17170 | 1 |
| 4414 | seob7015 | HIV-EP2/Schnurri-2 | M60119.1 | 1 |
| 4415 | MIOA1058 | HMG box containing protein 1 | AF019214 | 1 |
| 4416 | hfcr7357 | homeo box B5 (HOXB5) | NM_002147.1 | 1 |
| 4417 | hfcr8878 | homeo box C10 (HOXC10), (=homeoprotein C10) (HOXC10)) | NM_017409.1 | 1 |
| 4418 | hfcr3032 | homeobox protein mRNA, 3' end,clone HOX2.3 | M30598.1 | 1 |
| 4419 | ncr5055 | homeodomain interacting protein kinase 2 (Hipk2) | NM_010433.1 | 1 |

Figure 6A – EST Names Corresponding to Unique Known Genes of Figure 6

| | | | | |
|---|---|---|---|---|
| 4420 | ncr2576 | homeostasis endoplasmic reticulum protein (ERPROT213-21) | NM_006387.2 | 1 |
| 4421 | seoa0980m | HOX2H | X16665 | 1 |
| 4422 | ncrb8614 | HRS gene, partial cds (=SRp40-1) | AF020307.1 | 1 |
| 4423 | ncrc6336 | Hypothetical zinc finger-like protein | AAF88107.1 | 1 |
| 4424 | ncr7661 | hypoxia inducible factor (aHIF) antisense R+D2321NA sequence | U85044.1 | 1 |
| 4425 | miob0797 | hypoxia inducible gene-14 | AB017708.1 | 1 |
| 4426 | MIOA6262a | HZF2 zinc finger protein | X78925 | 1 |
| 4427 | hfcr8826 | HZF4 mRNA for zinc finger protein | X78927.1 | 1 |
| 4428 | seob7669 | HZF9 zinc finger protein | X78932.1 | 1 |
| 4429 | FCR3620 | Id1 (=U57645;S78825) | X77956 | 1 |
| 4430 | hfcr9901 | interferon regulatory factor 3 (IRF3) | NM_001571.1 | 1 |
| 4431 | MIOB0567 | Jun activation domain binding protein | U65928.1 | 1 |
| 4432 | fcrb2098 | jun dimerization protein gene | AF111167.2 | 1 |
| 4433 | ncrc4440 | KIAA0744 gene product; histone deacetylase 7 (KIAA0744) | NM_014707.1 | 1 |
| 4434 | ncrb6501 | KIAA1605 (=transcription factor LZIP-alpha gene) | AB046825.1 | 1 |
| 4435 | ncrc5260 | KIAA1611 protein (=ZINC FINGER PROTEIN 195) | BAB13437.1 | 1 |
| 4436 | FCR0476 | KNSL4 and MAZ(kinesin-like DNA binding protein and Myc-associated zinc finger protein) | AB017335 | 1 |
| 4437 | fcrb0624 | KRAB zinc finger protein (RITA) | AF272148.1 | 1 |
| 4438 | miob6993 | krueppel-like zinc finger protein HZF2 | AF220492.1 | 1 |
| 4439 | seob4333 | leucine zipper transcription factor-like 1 (LZTFL1 gene) | AJ297351.1 | 1 |
| 4440 | SEOB3239 | LIM-domain binding factor CLIM1 (CLIM1) | AF068651.1 | 1 |
| 4441 | FCR6634 | MAR/SAR DNA binding protein (SATB1) | M97287 | 1 |
| 4442 | FCR0646 | Meis1-related protein 1b (Mrg1b) | U68384 | 1 |
| 4443 | FCR2148 | Meis1-related protein 2 (MRG2) | U68385 | 1 |
| 4444 | MIOA2788a | MFH-1 (=X74040) | Y08223 | 1 |
| 4445 | FCR4082 | MIDA1 (=U53208 ZRF1) | D63784 | 1 |
| 4446 | FCR6184 | midline 1 fetal kidney isoform 2 (MID1) | AF041209 | 1 |
| 4447 | ncrc4136 | midline 1 fetal kidney isoform 3 (MID1) | AF041210.1 | 1 |
| 4448 | ncrb3541 | monocytic leukaemia zinc finger protein (MOZ) | U47742.1 | 1 |
| 4449 | miob6562 | monokine induced by gamma interferon (MIG) | NM_002416.1 | 1 |
| 4450 | SEOA6284 | MYCL2 (low match) | J03069 | 1 |
| 4451 | MIOA2374a | novH | X78354 | 1 |
| 4452 | fcrb1920 | NPAT gene | D89854.1 | 1 |
| 4453 | ncr0664 | nuclear cap binding protein 1, 80kD (NCBP1) | NM_002486.1 | 1 |
| 4454 | hfcr7676 | nuclear factor I (NFI) | U18761.1 | 1 |
| 4455 | SEOB2936 | nuclear factor NF45 | U10323.1 | 1 |
| 4456 | MIOA4135 | nuclear factor of activated T-cells 5 (NFAT5)(ORF)=transCRiption factor NFAT5 isoform b (NFAT5) =AB020634 KIAA0827 protein, | NM_006599.1 | 1 |
| 4457 | SEOA1672a | nuclear inhibitor of protein phosphatase-1 (PPP1R8) | AF064757.1 | 1 |
| 4458 | ncrc5947 | nuclear protein, ataxia-telangiectasia locus (RefSeq aa 3e-31) | NP_002510.1 | 1 |
| 4459 | SEOA6038a | OZF | X70394 | 1 |
| 4460 | hfcr8609 | paired-like homeodomain transcription factor 2 (PITX2) | NM_000325.1 | 1 |
| 4461 | BFCN0204 | PEBP2a1 protein | D14636 | 1 |
| 4462 | SOA0537 | pleomorphic adenoma gene-like 1 (PLAGL1) | U81992 | 1 |

Figure 6A – EST Names Corresponding to Unique Known Genes of Figure 6

| | | | |
|---|---|---|---|
| 4463 FCR2341 | PP15 (placental protein 15) | X07315 | 1 |
| 4464 ncr6335 | Pur (pur-alpha) | M96684.1 | 1 |
| 4465 ncr6422 | putative hepatic transcription factor (WBSCR14) gene | AF156673.1 | 1 |
| 4466 SEOA4870a | putative transCRiption factor CA150 (ORF) | AF017789 | 1 |
| 4467 ncrc2959 | putative transcription factor-like nuclear regulator (=KIAA1241) | CAC04245.1 | 1 |
| 4468 SEOA5214a | putative translation initiation factor (SUI1) =L26247= sui1iso1 (ORF) | NM_005801.1 | 1 |
| 4469 ncr1563 | putative zinc finger protein (RefSeq aa 2e-30) | NP_057688.1 | 1 |
| 4470 ncr1948 | putative zinc finger protein NY-REN-34 antigen (LOC51131) | NM_016119.1 | 1 |
| 4471 hfcr4477 | RELA (v-rel avian reticuloendotheliosis viral oncogene homolog A (nuclear factor of kappa light polypeptide gene enhancer in B-cells 3 (p65))) | CAB66119.2 | 1 |
| 4472 FCR3987 | retinoblastoma binding protein RBQ-1 | X85133 | 1 |
| 4473 FCR2174N | ring finger protein 1 (RING1) | Z14000 | 1 |
| 4474 fcrb1763 | ring finger protein 5 (RNF5) | XM_057888.1 | 1 |
| 4475 hfcr5381 | Ring1 and YY1 binding protein (RYBP) | NM_012234.1 | 1 |
| 4476 miob4886 | RING12 | X62741.1 | 1 |
| 4477 MIOB2093 | RING4 | X57522.1 | 1 |
| 4478 fcrb2715 | runt-related transcription factor 3 (RUNX3), (=PEBP2aC1 acute myeloid leukaemia ) | XM_001616.3 | 1 |
| 4479 FCR0280 | SAP18, Sin3-associated-polypeptide 18 | Z97062 | 1 |
| 4480 ncrc8880 | short form transcription factor C-MAF (c-maf) | AF055376.1 | 1 |
| 4481 ncr9977 | SIX4 gene | AB024687.1 | 1 |
| 4482 MIOA3080a | SMAD5 (Smad5) | AF010607 | 1 |
| 4483 hfcr8410 | small zinc finger-like protein (TIM13) | AF144700.1 | 1 |
| 4484 SEOA0996 | small zinc finger-like protein (TIM9a) | AF150100.1 | 1 |
| 4485 hfcr7621 | SOX11 | AB028641.1 | 1 |
| 4486 ncrc8968 | SOX6 (SOX6) gene | AF309471.1 | 1 |
| 4487 MIOA4548a | SRD-2 mutant sterol regulatory element binding protein-2 (SREBP-2) | U22818 | 1 |
| 4488 MIOA1293n | SRE-ZBP | Z11773 | 1 |
| 4489 hfcr0277 | SRF accessory protein 1B (SAP-1) | M85164.1 | 1 |
| 4490 MIOB2166 | Staf50 | X82200.1 | 1 |
| 4491 miob5098 | strain C57BL/6 zinc finger protein 106 (Zfp106) | AF060246.1 | 1 |
| 4492 SEOB0755 | survival of motor neuron protein interacting protein 1 (SIP1) | AF027150.1 | 1 |
| 4493 SEOA3419a | SYBL1 (contains L1 repeat) | gi4165269 | 1 |
| 4494 SEOA9501 | TAR (HIV) RNA-binding protein 1 (TARBP1)(ORF) = U38847.1 | NM_005646.1 | 1 |
| 4495 miob0733 | TAR DNA binding protein(TARDBP) (=DKFZp564O1716) | NM_007375.1 | 1 |
| 4496 ncr3778 | TATA binding protein associated factor (TAFII150) (=FLJ10756 fis) | AF040701.1 | 1 |
| 4497 fcrb0664 | TATA box binding protein (TBP)-associated factor, RNA polymerase II, H, 30kD (TAF2H) | NM_006284.1 | 1 |
| 4498 ncr3701 | TATA box binding protein (TBP)-associated factor, RNA polymerase I, A, 48kD (TAF1A) | NM_005681.1 | 1 |
| 4499 ncrc9215 | TATA box binding protein(TBP)-associated factor, RNA polymerase II, K, 18kD(RefSeq aa 7e-56) | NP_005636.1 | 1 |

Figure 6A – EST Names Corresponding to Unique Known Genes of Figure 6

| | | | | |
|---|---|---|---|---|
| 4500 | fcrb0956 | TATA box binding protein-related factor 2 mRNA, complete cds | AF136570 | 1 |
| 4501 | FCR1004n | TATA-binding protein (=Z22828 TFIID) | M55654 | 1 |
| 4502 | FCR0409 | Tat-SF1 | U76992 | 1 |
| 4503 | fcrb1733 | TGF(beta)-induced transcription factor 2 (LOC116040) | XM_057236.1 | 1 |
| 4504 | hfcr1053 | thyroid hormone receptor coactivating protein (SMAP) | NM_006696.1 | 1 |
| 4505 | hfcr8456 | thyroid receptor interactor (TRIP8) | L40411.1 | 1 |
| 4506 | FCR6183 | thyroid receptor interactor (TRIP9) | L40407 | 1 |
| 4507 | MIOA3674a | tissue-type pituitary Kruppel-associated box protein | AF070666 | 1 |
| 4508 | ncrb7523 | TPMT thiopurine S-methyltransferase gene | AB045146.1 | 1 |
| 4509 | SEOA5138a | transCRipt associated with monocyte to maCRophage differentiation | X85750 | 1 |
| 4510 | ncrb3369 | transcription elongation factor B (SIII), polypeptide 1 (15kD, elongin C)(TCEB1)(= polymerase II elongation factor SIII, p15 subunit mRNA)), | NM_005648.1 | 1 |
| 4511 | FCR5814 | transCRiption elongation factor TFIIS.h | AJ223473 | 1 |
| 4512 | MIOA1165 | transCRiption factor (TFIIB) | M76766 | 1 |
| 4513 | ncrc7027 | transcription factor 12 (RefSeq aa 1e-54) | NP_003196.1 | 1 |
| 4514 | ncr0138 | transcription factor 17(TCF17) (ORF) | NM_005649.1 | 1 |
| 4515 | ncr2207 | transcription factor BMAL2 (RefSeq aa 8e-35) | NP_064568.1 | 1 |
| 4516 | SEOA1646a | transCRiption factor CA150 (CA150) (=AF017789) | gi5729753 | 1 |
| 4517 | ncr0766 | transcription factor Dp-2 (E2F dimerization partner 2) (TFDP2) | NM_006286.1 | 1 |
| 4518 | BFCW0492 | transCRiption factor ETR103 | M62829 | 1 |
| 4519 | miob1362 | transcription factor IGHM enhancer 3, JM11 protein, JM4 protein, JM5 protein, T54 protein, JM10 protein, A4 differentiation-dependent protein, triple LIM domain protein 6, and synaptophysin genes, complete cds; and L-type calcium channel a> | AF196779.1 | 1 |
| 4520 | miob4574 | transcription factor IIIC102 | AF133123.1 | 1 |
| 4521 | SEOB0547 | transCRiption factor L-Sox5 | AJ010604.1 | 1 |
| 4522 | FCR2106 | transCRiption factor RTEF-1 (RTEF1) | U63824 | 1 |
| 4523 | BFCW0423 | transCRiption factor SL1 | L39060 | 1 |
| 4524 | hfcr5421 | transcription factor SOX8 (SOX8) | AF164104.1 | 1 |
| 4525 | MIOA6292a | transCRiption factor TFIIA small subunit p12 | U21242 | 1 |
| 4526 | hfcr4028 | transcription factor(HSA130894) | NM_017569.1 | 1 |
| 4527 | ncrc0608 | transcription factor-like 1(TCFL1)(= YL-1 mRNA for YL-1 protein(nuclear protein with DNA-binding ability)) | NM_005997.1 | 1 |
| 4528 | ncrc0744 | transcription initiation factor IA protein (TIF-IA gene) | AJ272050.1 | 1 |
| 4529 | SEOA3344a | transCRiption initiation factor TFIID subunit TAFII31 | U30504 | 1 |
| 4530 | SEOA2141 | transCRiption regulator protein (BACH1) | AF026199 | 1 |
| 4531 | FCR3525 | transCRiption regulator RPD3-2B (=AF039703 histone deacetylase 3;AF005482;U75696) | U75697 | 1 |
| 4532 | ncrb2027 | transcription termination factor, RNA polymerase I (RefSeq aa 9e-58) | NP_031370.1 | 1 |
| 4533 | BFCN0247 | transCRiptional activator hSNF2a (=X72889 hbrm) | D26155 | 1 |
| 4534 | MIOA6172a | transCRiptional co-activator CRSP33 (CRSP33) | AF104251 | 1 |
| 4535 | seob8200 | transcriptional enhancer factor (TEF1) | M63896.1 | 1 |
| 4536 | SEOA1776a | transCRiptional intermediary factor 1 alpha | AF119042 | 1 |
| 4537 | SEOB1026 | transCRiptional repressor (CTCF) | U25435.1 | 1 |
| 4538 | ncrb5614 | transcription-associated zinc ribbon protein (ZNRD1) | AF024617.1 | 1 |

Figure 6A – EST Names Corresponding to Unique Known Genes of Figure 6

| | | | |
|---|---|---|---|
| 4539 FCR7042 | transducin beta-2 subunit (=M16538 signal-transducing guanine nucleotide-binding regulatory (G) protein beta subunit) | M36429 | 1 |
| 4540 mioa7775a | ubinuclein (UBN1) gene, exons 1b and 2 | AF108454.1 | 1 |
| 4541 ncrb3056 | WD repeat domain 6 (WDR6) | NM_018031.2 | 1 |
| 4542 MIOA1483m | X2 box repressor | U22680 | 1 |
| 4543 seob6522 | X28 region near ALD locus containing dual specificity phosphatase 9 (DUSP9), ribosomal protein L18a (RPL18a), Ca2 /Calmodulin-dependent protein kinase I (CAMKI), creatine transporter (CRTR), CDM protein (CDM), adrenoleukodystrophy protein > | U52111.2 | 1 |
| 4544 FCR4224 | XAP-4 GDI (=X79353) | X79353 | 1 |
| 4545 hfcr2844 | YSK1 | D63780.1 | 1 |
| 4546 hfcr7831 | yz99g12.r1 Soares melanocyte 2NbHM cDNA clone IMAGE:291238 5' | W03533.1 | 1 |
| 4547 hfcr1848 | ZFX transcription activator | X59739.1 | 1 |
| 4548 seob2601 | ZHX1 protein (ZHX1) | AF195766.1 | 1 |
| 4549 SEOA0302 | zinc finger 2 (ZNF2 gene) | X60152.1 | 1 |
| 4550 miob4346 | zinc finger 5 protein | D89859.1 | 1 |
| 4551 SEOA0137 | zinc finger homeobox protein ZHX1 | AF106862.1 | 1 |
| 4552 miob4359 | zinc finger homeodomain protein | U12170.1 | 1 |
| 4553 FCR1369 | zinc finger protein (HZF6) (non-exact, 66%) | AF027513 | 1 |
| 4554 hfcr0130 | zinc finger protein (LOC51042) | NM_015871.1 | 1 |
| 4555 FCR5100 | zinc finger protein (low match) | X78933 | 1 |
| 4556 ncr4050 | zinc finger protein (ZAN75) | NM_018759.1 | 1 |
| 4557 ncrb8250 | zinc finger protein (ZNF139)mRNA | U09848.1 | 1 |
| 4558 SEOA3582a | zinc finger protein (ZNF141) | L15309 | 1 |
| 4559 SEOA1002 | zinc finger protein (ZNF155) | U09852 | 1 |
| 4560 FCR3163 | zinc finger protein (ZNF741) | U28282 | 1 |
| 4561 miob6713 | zinc finger protein (ZNF-U69274) | NM_014415.1 | 1 |
| 4562 ncrc5207 | zinc finger protein 10 (KOX 1) (RefSeq aa 3e-47) | NP_003410.1 | 1 |
| 4563 miob6768 | zinc finger protein 124 (HZF-16) (ZNF124) | NM_003431.1 | 1 |
| 4564 SEOA6638a | ZINC FINGER PROTEIN 136 (61% aa) | spP52737 | 1 |
| 4565 ncrc1031 | zinc finger protein 136 (clone pHZ-20)(RefSeq aa 3e-30) | NP_003428.1 | 1 |
| 4566 ncrc8867 | zinc finger protein 146 (ZNF146) | NM_007145.1 | 1 |
| 4567 ncr4656 | zinc finger protein 161 (RefSeq aa 1e-74) | NP_009077.1 | 1 |
| 4568 ncrc5659 | zinc finger protein 162 (ZNF162) | NM_004630.1 | 1 |
| 4569 SEOA5799 | ZINC FINGER PROTEIN 177 (69% aa) | spQ13360 | 1 |
| 4570 MIOB2841 | zinc finger protein 195 (ZNF195) | gi6005973 | 1 |
| 4571 miob4160 | zinc finger protein 198 (ZNF198) | NM_003453.1 | 1 |
| 4572 ncrc6871 | zinc finger protein 202(ZNF202) | NM_003455.1 | 1 |
| 4573 miob6438 | zinc finger protein 223 (ZNF223) | NM_013361.1 | 1 |
| 4574 ncr8794 | zinc finger protein 232 (RefSeq aa 2e-68) | NP_055334.1 | 1 |
| 4575 ncrc2874 | zinc finger protein 258 (ZNF258) | NM_007167.1 | 1 |
| 4576 seoa7032 | zinc finger protein 268 (ZNF268) mRNA, complete cds /cds=(330,3173) /gb=AF317549 /gi=12584158 /ug=Hs.183291 /len=3826 | Hs.183291 | 1 |
| 4577 SEOA9566 | zinc finger protein 281 (ZNF281) (ORF) | NM_012482.1 | 1 |
| 4578 mioa7876 | zinc finger protein 288 (ZNF288), mRNA /cds=(488,2494) /gb=NM_015642 /gi=7661651 /ug=Hs.159456 /len=2829 | Hs.159456 | 1 |

Figure 6A – EST Names Corresponding to Unique Known Genes of Figure 6

| | | | |
|---|---|---|---|
| 4579 hfcr4167 | zinc finger protein 297 (ZNF297) | NM_005453.2 | 1 |
| 4580 miob4860 | zinc finger protein 41 (ZNF41) | M92443.1 | 1 |
| 4581 FCR0278 | ZINC FINGER PROTEIN 83 (ZINC FINGER PROTEIN HPF1) | spP51522 | 1 |
| 4582 ncr7345 | zinc finger protein dp | AF153201.1 | 1 |
| 4583 SEOA6106a | zinc finger protein EZNF (EZNF) | AF116030 | 1 |
| 4584 MIOA8590 | zinc finger protein FOG-2 | AF119334.1 | 1 |
| 4585 ncrb8608 | zinc finger protein homologous to Zfp-36 in mouse (ZFP36) | NM_003407.1 | 1 |
| 4586 hfcr7805 | zinc finger protein mRNA | Y14443.1 | 1 |
| 4587 hfcr5919 | zinc finger protein NY-REN-21 antigen | AF155100.1 | 1 |
| 4588 ncrc4815 | zinc finger protein SBZF2 mRNA, complete cds | AF139460.1 | 1 |
| 4589 MIOA1375a | zinc finger protein ZNF131 | U09410 | 1 |
| 4590 SEOB1848 | zinc finger protein ZNF140 | U09368.1 | 1 |
| 4591 ncr3511 | zinc finger protein(ZF5128) | NM_014347.1 | 1 |
| 4592 MIOA4883a | zinc finger protein, C3H-type =AF061261 zinc finger protein (MBLL) mRNA, | NM_005757.1 | 1 |
| 4593 seob8297 | zinc finger protein, HZF2 | X78925.1 | 1 |
| 4594 ncr5472 | zinc finger protein219 | NM_016423.1 | 1 |
| 4595 FCR5369 | zinc finger RNA binding protein (Zfr) | AF071059.1 | 1 |
| 4596 FCR1169 | zinc-finger protein (ZNF76) | M91592 | 1 |
| 4597 SEOA3515a | zinc-finger protein PFM1, PR-domain | AF144757.1 | 1 |
| 4598 ncrb7844 | Zn-15 related zinc finger protein (rlf) mRNA, complete cds | U22377.1 | 1 |
| 4599 seob7595 | ZNF135-like protein | AF265236.1 | 1 |
| 4600 MIOA2158a | ZNF258 (ZNF258) | AF055470 | 1 |
| 4601 fCR0935 | ZNF81 (non-exact) | X68011 | 1 |
| 4602 fcrb2541 | bromodomain-containing 7 (BRD7), mRNA | NM_013263.1 | 1 |
| 4603 FCR3282 | 218 kD Mi-2 protein (= proliferating cell nucleolar protein P120) | X86691 | 1 |
| 4604 MIOA8665 | cell-line THP-1 GTP cyclohydrolase I | U66095.1 | 1 |
| 4605 mioa9719 | cleavage stimulation factor, 3' pre-RNA, subunit 3, 77kD (CSTF3) | NM_001326.1 | 1 |
| 4606 FCR2860 | CPSF (cleavage and polyadenylation specificity factor) 73 kDa subunit | X95906 | 1 |
| 4607 FCR1305 | CTD-binding SR-like protein rA8 | U49055 | 1 |
| 4608 ncr2930 | C-terminal binding protein 2 (CTBP2) | NM_001329.1 | 1 |
| 4609 hfcr2547 | dCMP deaminase (DCTD) | NM_001921.1 | 1 |
| 4610 fcrb0993 | DEAD/H (Asp-Glu-Ala-Asp/His) box polypeptide 19 (Dbp5, yeast, homolog) (DDX19), mRNA | NM_007242.1 | 1 |
| 4611 mioa9962 | DEAD/H (Asp-Glu-Ala-Asp/His) box polypeptide 6 (RNA helicase, 54kD) (DDX6) (ORF) | NM_004397.1 | 1 |
| 4612 hfcr0957 | DEAD-box protein abstrakt(ABS), (ORF) | NM_016222.1 | 1 |
| 4613 ncrb6836 | double stranded RNA activated protein kinase (PKR) gene, intron 1 | AF167458.1 | 1 |
| 4614 ncrc6031 | double-stranded RNA binding nuclear protein DRBP76 delta (ILF3 gene) | AJ271746.1 | 1 |
| 4615 ncrb6720 | endoplasmic reticulum lumenal protein (ERP28) | NM_006817.1 | 1 |
| 4616 hfcr0236 | EWS gene | AB016207.1 | 1 |
| 4617 ncr1699 | glutamyl-prolyl tRNA synthetase; proline tRNA ligase; glutamate tRNA ligase (RefSeq aa 1e-87) | NP_004437.1 | 1 |

Figure 6A – EST Names Corresponding to Unique Known Genes of Figure 6

| | | | |
|---|---|---|---|
| 4618 fcrb1312 | heterogeneous nuclear ribonucleoprotein A0 (HNRPA0) | NM_006805.1 | 1 |
| 4619 SEOA1071a | heterogeneous nuclear ribonucleoprotein L (HNRPL) | X16135 | 1 |
| 4620 FCR7405 | hnRNA-binding protein M4 (M4 protein) | S35532 | 1 |
| 4621 seob7082 | hnRNP-E1 | X78137.1 | 1 |
| 4622 SEOA1551 | LRR FLI-I interacting protein 2 (LRRFIP2) | AF115509.1 | 1 |
| 4623 miob0644 | nuclear matrix protein p84 | NM_005131.1 | 1 |
| 4624 hfcr0675 | nuclear protein (mdm-1) | M20823.1 | 1 |
| 4625 ncr2994 | nuclear protein double minute 1 | AF267851.1 | 1 |
| 4626 SEOA0898 | nuclear protein, NP220 | D83032 | 1 |
| 4627 ncrb4677 | ORF2 consensus sequence encoding endonuclease and reverse transcriptase minus RNaseH | AAB41224.1 | 1 |
| 4628 ncr1282 | partial mRNA for double stranded RNA binding nuclear protein ILF3 | AJ271747.1 | 1 |
| 4629 ncrb8464 | poly(A)-binding protein, cytoplasmic 4 (inducible form) (PABPC4) | NM_003819.2 | 1 |
| 4630 FCR0474 | pur alpha extended | X91648 | 1 |
| 4631 FCR4414 | ribonucleoprotein SS-B/La (=J04205) | X13697 | 1 |
| 4632 ncr0179 | RNA 3'-terminal phosphate cyclase (RPC) mRNA | NM_003729.1 | 1 |
| 4633 HFCR3160 | RNA binding motif protein 4 (RBM4) | gi4506444 | 1 |
| 4634 MIOA8866 | RNA binding motif protein 9 (isoform 1) (=AL009266 hypothetical protein) | CAB63054.1 | 1 |
| 4635 ncr3827 | RNA binding motif protein, X chromosome (RBMX) | NM_002139.1 | 1 |
| 4636 MIOB1523 | RNA cyclase homolog | AF067172.1 | 1 |
| 4637 hfcr9239 | RNA helicase (LOC51139)(= KIAA0801) | NM_016130.1 | 1 |
| 4638 SEOB0763 | RNA helicase (RIG-I) | AF038963.1 | 1 |
| 4639 MIOA7212a | RNA helicase HDB/DICE1 | AF141326.1 | 1 |
| 4640 SEOA2936a | RNA helicase-related protein | AF083255 | 1 |
| 4641 fcrb1789 | RNA helicase-related protein (RNAHP) | XM_044384.1 | 1 |
| 4642 fcrb0213 | RNA-binding protein (autoantigenic) (RALY) | NM_016732.1 | 1 |
| 4643 hfcr2524 | RRM RNA binding protein Gry-rbp (GRY-RBP) | AF037448.1 | 1 |
| 4644 ncrb7945 | SIR2 (silent mating type information regulation 2, S.cerevisiae, homolog)-like(SIR2L) | NM_012237.1 | 1 |
| 4645 ncr9599 | sir2-like 1 (SIRT1) | NM_012238.2 | 1 |
| 4646 hfcr2984 | small nuclear ribonucleoprotein D3 polypeptide (18kD) (SNRPD3) | NM_004175.1 | 1 |
| 4647 seob4625 | small nuclear rna (snrna) gene (clone pu1-6) and flanks | K00529.1 | 1 |
| 4648 SEOA5637a | small nuclear RNA activating complex, polypeptide 1, 43kD (SNAPC1) (=Z47542) | 4507100 | 1 |
| 4649 SEOA2391a | Smg GDS-associated protein SMAP | U59919 | 1 |
| 4650 MIOA6734a | SnRNP assembly defective 1 homologue (SAD1) (=AF132955 CGI-21) | gi5730024 | 1 |
| 4651 ncr7102 | SNRPN | U81001.1 | 1 |
| 4652 SEOA0422 | SOF1 PROTEIN | spP33750 | 1 |
| 4653 MIOA1944a | SPF31 (SPF31) | AF083190 | 1 |
| 4654 seob4693 | splicing factor (45kD) (SPF45) (ORF) | NM_006450.1 | 1 |
| 4655 MIOA9067 | splicing factor 30, survival of motor neuron-related (SPF30) (ORF) | NM_005871.1 | 1 |
| 4656 fcrb2197 | splicing factor arginine/serine-rich 5 (SFRS5) | XM_031133.1 | 1 |
| 4657 hfcr9323 | splicing factor Prp8 | AF092565.1 | 1 |
| 4658 HFCR3183 | splicing factor SC35 | M90104.1 | 1 |

Figure 6A – EST Names Corresponding to Unique Known Genes of Figure 6

| | | | |
|---|---|---|---|
| 4659 MIOB2129 | splicing factor SRp40-3 (SRp40) | U30827.1 | 1 |
| 4660 seob4001 | splicing factor SRp55-1 (SRp-55) | U30883.1 | 1 |
| 4661 mioa7701a | splicing factor, arginine/serine-rich 2, interacting protein (SFRS2IP), mRNA /cds=(1210,4656) /gb=NM_004719 /gi=4759171 /ug=Hs.51957 /len=5307 | Hs.51957 | 1 |
| 4662 FCR0770N | SPLICING FACTOR, ARGININE/SERINE-RICH 8 (SUPPRESSOR OF WHITE APRICOT PROTEIN HOMOLOG) | spQ12872 | 1 |
| 4663 ncr5046 | splicing factor, arginine/serine-rich2, interacting protein (RefSeq aa 2e-82) | NP_004710.1 | 1 |
| 4664 FCR7308 | splicing factor, SF1-HL1 isoform | Y08765 | 1 |
| 4665 hfcr9785 | SRp25 nuclear protein(LOC51329) | NM_016638.1 | 1 |
| 4666 ncr3971 | SRp46 splicing factor retropseudogene | AF031166.1 | 1 |
| 4667 hfcr3043 | SR-related protein LD2 (=RNA-binding protein S1,serine-rich domain (RNPS1)) | AF247662.1 | 1 |
| 4668 ncrb0864 | staufen (Drosophila,RNA-binding protein) homolog 2 (STAU2)(= 39k3 protein) | NM_014393.1 | 1 |
| 4669 MIOA8289 | staufen protein (STAU) | AF061940 | 1 |
| 4670 seob6467 | step II splicing factor SLU7 (SLU7) (ORF) | NM_006425.1 | 1 |
| 4671 miob6472 | SYNCRIP | AB035725.1 | 1 |
| 4672 fcrb1320 | TIA1 cytotoxic granule-associated RNA-binding protein-like 1 (TIAL1) | NM_003252.1 | 1 |
| 4673 SEOB1466 | tRNA-Lys gene (low match:nt 1e-10) | U00939.1 | 1 |
| 4674 FCR2542N | U1 small nuclear ribonucleoprotein 70 kd protein | M22636 | 1 |
| 4675 SEOB2067 | u1B-IC/SNRPN transCRipt | L80005.1 | 1 |
| 4676 ncr2574 | U2 small nuclear RNA gene | K03022.1 | 1 |
| 4677 FCR2607 | U2 snRNP auxiliary factor small subunit | M96982 | 1 |
| 4678 MIOA7299 | U5 snRNP-specific protein, 116 kD (U5-116KD) (=D21163 KIAA0031) | gi4759279 | 1 |
| 4679 seob7176 | U50' snoRNA and U50 snoRNA | AB017710.1 | 1 |
| 4680 seob4191 | U6 snRNA-associated Sm-like protein LSm6 | AF182292.1 | 1 |
| 4681 fcrb1069 | U6 snRNA-associated Sm-like protein LSm7 (LOC51690), mRNA | NM_016199.1 | 1 |
| 4682 SEOA1734a | U6 snRNA-associated Sm-like protein LSm8 | AF182294.1 | 1 |
| 4683 ncr4912 | pre-mRNA splicing factor (PRP18) | NM_003675.1 | 1 |
| 4684 FCR0272 | RNA polymerase II 14.5 kDa subunit | Z23102 | 1 |
| 4685 MIOA4064a | RNA polymerase subunit hRPB 33 | J05448 | 1 |
| 4686 fCR0138 | rsly1p | U57687 | 1 |
| 4687 miob0496 | SC35-interacting protein 1 (SRRP129)(= splicing factor Sip1) | NM_004719.1 | 1 |
| 4688 seoa7687a | TAF13 RNA polymerase II, TATA box binding protein (TBP)-associated factor, 18 kD, clone MGC:22425 IMAGE:4289451, mRNA, complete cds | BC017821.1 | 1 |
| 4689 seoa7020 | TAF7 RNA polymerase II, TATA box binding protein (TBP)-associated factor, 55 kD (TAF7), mRNA /cds=(740,1789) /gb=NM_005642 /gi=14717406 /ug=Hs.155188 /len=2310 | Hs.155188 | 1 |
| 4690 hfcr1760 | BAT2-related gene | AL096857.1 | 1 |
| 4691 SEOA7608a | BC-2 protein | AF042384 | 1 |
| 4692 ncrb0045 | chitinase 3-like 1(cartilage glycoprotein-39) (CHI3L1) | NM_001276.1 | 1 |
| 4693 ncr1055 | Ig superfamily protein (Z39IG) | NM_007268.1 | 1 |

Figure 6A – EST Names Corresponding to Unique Known Genes of Figure 6

| | | | | |
|---|---|---|---|---|
| 4694 | fcrb2502 | lymphocyte antigen 6 complex, locus E (LY6E), mRNA | XM_051298.1 | 1 |
| 4695 | hfcr6651 | natural killer cell enhancing factor (NKEFB) | L19185.1 | 1 |
| 4696 | SEOA0462 | 75-kD autoantigen (PM-Sc1) | M58460 | 1 |
| 4697 | MIOA3527a | activity and neurotransmitter-induced early gene 11 (ania-11) | AF050663 | 1 |
| 4698 | hfcr7076 | alpha-2-macroglobulin receptor-associated protein | M63959.1 | 1 |
| 4699 | FCR5392 | B-cell receptor associated protein (hBAP) | U72511 | 1 |
| 4700 | MIOA5812a | B-cell receptor-associated protein BAP29 | AF126020 | 1 |
| 4701 | FCR0787 | cartilage associated protein | X97607 | 1 |
| 4702 | hfcr0517 | cartilage associated protein(CRTAP) | NM_006371.1 | 1 |
| 4703 | ncr1218 | cbl-b | U26710.1 | 1 |
| 4704 | BFCS0261 | chromosome 1 immunoglobulin V (K)I | X17278 | 1 |
| 4705 | SEOA1571 | early activation antigen CD69 | L07555 | 1 |
| 4706 | miob0939 | early endosome antigen 1, 162kD (EEA1) | NM_003566.1 | 1 |
| 4707 | hfcr8036 | erythroblast macrophage protein EMP | AF084928.1 | 1 |
| 4708 | ncrb0328 | HLA CLASS I HISTOCOMPATIBILITY ANTIGEN, ALPHA CHAIN F PRECURSOR | P30511 | 1 |
| 4709 | miob2879 | HLA class I locus C heavy chain | X58536.1 | 1 |
| 4710 | FCR5937 | HLA class III region (NOTCH4 gene) | U89336 | 1 |
| 4711 | ncr7082 | HLA-A gene, HLA-A*0205 allele | L76290.1 | 1 |
| 4712 | hfcr5988 | HLA-B associated transcript-2 (D6S51E) =( MSH55 gene) | NM_004638.1 | 1 |
| 4713 | mioa0737m | HLA-B35 mRNA (ORF) | Z22651 | 1 |
| 4714 | ncrb2092 | hla-dr heavy chain cooh terminus | J00200.1 | 1 |
| 4715 | MIOA5165a | HMBA-inducible (HIS1)=AB021179 , HEXIM1 protein | NM_006460.1 | 1 |
| 4716 | hfcr1952 | immunoglobulin (CD79A) binding protein 1 (IGBP1) | NM_001551.1 | 1 |
| 4717 | seob4480 | immunoglobulin G Fc receptor (ORF) | J03619.1 | 1 |
| 4718 | SEOA2639 | immunoglobulin superfamily containing leucine-rich repeat (ISLR) | AB024537.1 | 1 |
| 4719 | hfcr5404 | immunoglobulin superfamily member protein (BL2) | AF132811.1 | 1 |
| 4720 | miob5010 | immunoglobulin superfamily, member 6 (IGSF6) (=AJ223183.1 DORA) | gi5031672 | 1 |
| 4721 | ncrb6762 | imogen 38 (RefSeq aa 1e-60) | NP_005821.1 | 1 |
| 4722 | MIOA0869a | leukocyte common antigen (T200) | Y00638 | 1 |
| 4723 | SEOA2970a | major histocompatibility class II antigen gamma chain | K01144 | 1 |
| 4724 | ncrb5535 | major histocompatibility complex, class I, E (HLA-E) | NM_005516.1 | 1 |
| 4725 | SEOA4683a | major Yo paraneoplastic antigen(CDR2) | M63256 | 1 |
| 4726 | ncr5192 | male-enhanced antigen(MEA) | NM_014623.1 | 1 |
| 4727 | ncr7952 | MHC binding protein-2 | AAA36202.1 | 1 |
| 4728 | FCR5905 | MHC class I promoter binding protein (=AF120161 retinoic X receptor beta (RXRB)) | X65463 | 1 |
| 4729 | SEOA4109a | miCRoglobulin (ORF){C to A point mutation at nucleotide 121} | S82300 | 1 |
| 4730 | MIOA4817a | mutant (Daudi) beta2 - miCRoglobulin (ORF) | X07621 | 1 |
| 4731 | FCR0951 | PA28 gamma subunit (Psme3) | AB007139 | 1 |
| 4732 | seob5147 | SART-1 | AB006198.1 | 1 |
| 4733 | seob4020 | strain ECOR 24 rrlB operon, complete sequence | AF053967 | 1 |
| 4734 | ncrb4439 | SWAP-70 homolog | AF134894.1 | 1 |
| 4735 | miob2897 | T-cell antigen receptor alpha-chain (TCR-ATF2) | M77167.1 | 1 |
| 4736 | SEOA3415a | T-cell nuclear receptor NOT (Nurr1) | AB019433.1 | 1 |

Figure 6A – EST Names Corresponding to Unique Known Genes of Figure 6

| | | | | |
|---|---|---|---|---|
| 4737 | SEOB1513 | T-cell receptor alpha chain-c6.1A fusion protein (c6.1A-TCRC) gene | S72931.1 | 1 |
| 4738 | ncrb1186 | T-cell receptor alpha delta locus | AF283991.1 | 1 |
| 4739 | miob0986 | T-cell receptor alpha delta locus from bases 1 to 250529 (section 1 of 5) of the Complete Nucleotide Sequence | AE000658.1 | 1 |
| 4740 | ncr7066 | TJ6 protein (RefSeq aa 8e-56) | NP_036595.1 | 1 |
| 4741 | ncrb6261 | 180 kDa transmembrane PLA2 receptor | U17033.1 | 1 |
| 4742 | SEOA1802a | adult T-cell leukemia derived factor | E01915 | 1 |
| 4743 | FCR6228 | BAG-family molecular chaperone regulator-3 | AF095193 | 1 |
| 4744 | MIOA2722a | BAG-family molecular chaperone regulator-5 (=AB020680 KIAA0873) | AF095195.2 | 1 |
| 4745 | SEOA5743a | beta-defensin-1,2 | U50931 | 1 |
| 4746 | FCR4746 | breast epithelial antigen BA46 | U58516 | 1 |
| 4747 | ncr8326 | BTK-binding protein mRNA, complete cds | AF235049.1 | 1 |
| 4748 | ncr3948 | cellular repressor of E1A-stimulated genes (CREG) | NM_003851.1 | 1 |
| 4749 | MIOA2395a | centromere autoantigen C (CENPC) | M95724 | 1 |
| 4750 | ncrc1590 | colon cancer antigen NY-CO-45 mRNA, partial cds | AF039442.1 | 1 |
| 4751 | ncr3141 | DARC | X85785.1 | 1 |
| 4752 | miob6870 | defensin, alpha 3, neutrophil-specific (DEFA3) (=PRO2832) | NM_005217.1 | 1 |
| 4753 | ncrb8817 | heat shock 105kD (HSP105B) | NM_006644.1 | 1 |
| 4754 | FCR3269 | HEAT SHOCK COGNATE 71 KD PROTEIN | spP11142 | 1 |
| 4755 | FCR4876 | heat shock factor 2 (HSF2) | M65217 | 1 |
| 4756 | SEOA6494a | heat shock protein (=AF085359.1 HSPC030) | AF170920 | 1 |
| 4757 | hfcr0923 | heat shock protein (HSP21) mRNA, chloroplast gene encoding chloroplast protein, complete cds | U66300.1 | 1 |
| 4758 | BFCW0024 | Heat shock protein 70 testis variant (=M59829 MHC class III HSP70-HOM (HLA)) | D85730 | 1 |
| 4759 | seob7030 | heat shock protein apg-2 | AB023420.1 | 1 |
| 4760 | SEOA4829a | heat shock protein hsp40 =U41290 DNAJ homolog (DNAJW) (ORF) | U40992 | 1 |
| 4761 | SEOA8776 | HEAT SHOCK PROTEIN, MITOCHONDRIAL 10 KDA D12(HSP10) (10 KDA CHAPERONIN) (CPN10) | spQ04984 | 1 |
| 4762 | mioa0511m | heat shock protein= HSPA2= L26336= U10284 | U56725 | 1 |
| 4763 | hfcr5023 | hepatocellular carcinoma-associated antigen 56A (HCA56A) | AF262403.1 | 1 |
| 4764 | seoa8052 | hepatocellular carcinoma-associated antigen 64 (HCA64) mRNA, complete cds /cds=(79,666) /gb=AF257175 /gi=7739705 /ug=Hs.314977 /len=2125 | Hs.314977 | 1 |
| 4765 | miob1830 | HSP105 alpha (=AF039695.1 antigen NY-CO-25) | AB003334.1 | 1 |
| 4766 | ncrb6037 | HSP27 | AB020027.1 | 1 |
| 4767 | FCR4897 | mixed lineage kinase (MLK-3) (=U07747 sprk) | L32976 | 1 |
| 4768 | FCR2952 | MSJ-1 | AB014888 | 1 |
| 4769 | FCR0788 | NA14 protein | Z96932 | 1 |
| 4770 | mioa9735 | novel T-cell activation protein | X94232.1 | 1 |
| 4771 | BFCS0042 | p38gamma MAP Kinase (=Y10487 stress activated protein kinase-3) | U66243 | 1 |
| 4772 | miob4058 | platelet-endothelial tetraspan antigen 3 | U14650.1 | 1 |
| 4773 | hfcr3587 | PML-1 | M79462.1 | 1 |

Figure 6A – EST Names Corresponding to Unique Known Genes of Figure 6

| | | | | |
|---|---|---|---|---|
| 4774 | ncrc9355 | polymyositis/scleroderma autoantigen 1(75kD) (RefSeq aa 4e-86) | NP_005024.1 | 1 |
| 4775 | fcrb1677 | pre-B cell stimulating factor homologue (SDF1b) | L36033.1 | 1 |
| 4776 | SEOB2950 | PX19 protein | AF112203.1 | 1 |
| 4777 | hfcr6932 | renal cell carcinoma associated antigen G250 | AJ010588.1 | 1 |
| 4778 | hfcr0737 | rheumatoid arthritis related antigen RA-A47 | AB044781.1 | 1 |
| 4779 | hfcr4170 | stannin (=DKFZp761P2414) | AF070673.1 | 1 |
| 4780 | ncrc6648 | Ste-20 related kinase (RefSeq aa 2e-41) | NP_037365.1 | 1 |
| 4781 | fCR0832 | Ste20-like kinase | X99325 | 1 |
| 4782 | seob5508 | stress 70 protein chaperone, microsome-associated, 60kD (STCH) | NM_006948.1 | 1 |
| 4783 | ncrc0864 | stromal antigen 3 (STAG3) | NM_012447.1 | 1 |
| 4784 | ncrc6242 | sulfotransferase 1C2 (SULT1C2) gene, complete cds | AF186263.1 | 1 |
| 4785 | hfcr9347 | TP53 target gene (TP53TG1) | NM_007233.1 | 1 |
| 4786 | FCR2897 | WP34 (phosphorylated lymphocyte differentiation and activation antigen) (=S67783) | X55188 | 1 |
| 4787 | ncr2408 | ATPase inhibitor precursor | NP_057395.1 | 1 |
| 4788 | BFCS0390 | BAI-associated protein 3 (=AB018277 hypothetical protein (KIAA0734)) | AB017111 | 1 |
| 4789 | ncrb5060 | beta-site APP-cleaving enzyme (RefSeq aa 5e-88) | NP_036236.1 | 1 |
| 4790 | fcrb1399 | interferon induced transmembrane protein 3 (1-8U) (IFITM3) | NM_021034.1 | 1 |
| 4791 | ncrc1999 | INTERFERON-INDUCED TRANSMEMBRANE PROTEIN 3 (INTERFERON-INDUCIBLE PROTEIN 1-8U) | spQ01628 | 1 |
| 4792 | MIOA4674 | MEMBRANE PROTEIN C21ORF4 17.9 KD | P56557 | 1 |
| 4793 | seoa0495m | trans-Golgi p230 | U41740 | 1 |
| 4794 | seob6064 | Adaptor protein containing pH domain, PTB domain and leucine zipper motif (APPL) | NM_012096.1 | 1 |
| 4795 | hfcr1731 | adaptor-related protein complex 1, gamma 2 subunit (G2AD) | NM_003917.1 | 1 |
| 4796 | MIOA1701a | apoferritin H (=M11146) | X03488 | 1 |
| 4797 | MIOA5059a | BIOTIN CARBOXYL CARRIER PROTEIN OF METHYLMALONYL-COA CARBOXYL-TRANSFERASE(TRANSCARBOXYLASE, 1.3S SUBUNIT) | P02904 | 1 |
| 4798 | SEOA5778 | cationic amino acid transporter-2A (ATRC2) | U76368 | 1 |
| 4799 | ncr1007 | coatomer protein complex, subunit beta (COPB) (=DKFZp761K102) | NM_016451.1 | 1 |
| 4800 | hfcr6394 | coatomer protein complex, subunit epsilon (COPE) | NM_007263.1 | 1 |
| 4801 | ncrb6557 | coatomer protein complex, subunit gamma 2 (RefSeq aa 2e-67) | NP_036265.1 | 1 |
| 4802 | seob5491 | constitutively expressed serum amyloid A protein (SAA4) gene | L05920.1 | 1 |
| 4803 | fcrb1019 | COPZ2 for nonclathrin coat protein zeta-COP (LOC51226) | NM_016429.1 | 1 |
| 4804 | ncr9123 | corin (RefSeq aa 7e-45) | NP_006578.1 | 1 |
| 4805 | seob8104 | DUTT1 (chromosome 3) | Z95705.1 | 1 |
| 4806 | MIOA3084a | EGF repeat transmembrane protein | U57368 | 1 |
| 4807 | hfcr5959 | ENIGMA protein | AF265209.1 | 1 |
| 4808 | SEOA9828 | epithelial membrane protein 2 (EMP2) | NM_001424.1 | 1 |
| 4809 | FCR0108 | erythrocyte adducin alpha subunit | X58141 | 1 |

Figure 6A – EST Names Corresponding to Unique Known Genes of Figure 6

| | | | | |
|---|---|---|---|---|
| 4810 | hfcr9371 | ferroportin 1; iron regulated gene 1 (FPN1)(= SLC11A3) | NM_014585.1 | 1 |
| 4811 | ncrb6320 | golgi membrane protein GP73(LOC51280) | NM_016548.1 | 1 |
| 4812 | ncrc5767 | Golgi membrane protein type II (RefSeq aa 4e-35) | NP_055313.1 | 1 |
| 4813 | fcrb0097 | Ke4 gene, mouse, human homolog of (D6S2244E), = D82060 membrane protein with histidine rich charge clusters (ORF) | NM_006979.1 | 1 |
| 4814 | hfcr2693 | LIM domain kinase 2 (LIMK2) | NM_005569.2 | 1 |
| 4815 | fcrb1815 | lysosomal apyrase-like 1 (LYSAL1) | XM_040572.1 | 1 |
| 4816 | hfcr9814 | membrane interacting protein of RGS16 (MIR16) | NM_016641.1 | 1 |
| 4817 | MIOA6999a | membrane metallo-endopeptidase (neutral endopeptidase, enkephalinase, CALLA, CD10) (MME) =J03779\|=lymphoblastic leukemia antigen (CALLA) | NM_000902.1 | 1 |
| 4818 | miob3942 | mouse SKD1 homolog (SKD1) | NM_004869.1 | 1 |
| 4819 | hfcr9241 | multispanning nuclear envelope membrane protein nurim (NRM29) | AF143676.1 | 1 |
| 4820 | fcrb2569 | myoglobin (MB), mRNA | NM_005368.1 | 1 |
| 4821 | fcrb2200 | myo-inositol monophosphatase A3 (IMPA3) | AY032885.1 | 1 |
| 4822 | SEOA9086 | N-ethylmaleimide-sensitive factor (NSF) | AF135168.1 | 1 |
| 4823 | MIOA8396 | neuronal membrane glycoprotein M6b | U45955 | 1 |
| 4824 | seob8078 | PEX13 | AB022192.1 | 1 |
| 4825 | ncrb8821 | phosphate carrier precursor isoform 1a;phosphate carrier, mitochondrial precursor (RefSeq aa 3e-36) | NP_005879.1 | 1 |
| 4826 | MIOA8946 | placental protein 17b1 (PP17)(=cargo selection protein (mannose 6 phosphate receptor binding protein) (TIP47) | AF055574.1 | 1 |
| 4827 | seoa4934a | progestin induced protein (DD5), mRNA /cds=(33,8432) /gb=NM_015902 /gi=15147336 /ug=Hs.278428 /len=8838 | Hs.278428 | 1 |
| 4828 | seob6576 | putative membrane protein, complete cds | AB020980.1 | 1 |
| 4829 | ncrc3464 | putative heme-binding protein (SOUL) | NM_014320.1 | 1 |
| 4830 | hfcr6677 | putative integral membrane transporter (LC27) | NM_018407.1 | 1 |
| 4831 | fCR0983 | putative transmembrane receptor (frizzled 4) | U43317 | 1 |
| 4832 | hfcr7393 | secretory granule neuroendocrine protein 1 (7B2 protein) (SGNE1) | NM_003020.1 | 1 |
| 4833 | MIOA1953a | seven transmembrane segment receptor | M99293 | 1 |
| 4834 | fcrb1503 | supervillin (SVIL) | XM_030478.2 | 1 |
| 4835 | ncr8118 | tetraspan 3; Tspan-3 (RefSeq aa 8e-51) | NP_005715.1 | 1 |
| 4836 | miob4475 | tetraspan NET-1 | AF065388.1 | 1 |
| 4837 | hfcr1163 | tetraspan NET-6 protein(NET-6), mRNA | NM_014399.1 | 1 |
| 4838 | seob7047 | tetraspanin TM4-D | AF133426.1 | 1 |
| 4839 | fcrb0193 | translocase of inner mitochondrial membrane 10 (yeast) homolog (TIMM10) | NM_012456.1 | 1 |
| 4840 | fcrb2059 | translocase of inner mitochondrial membrane 8 (yeast) homolog B (TIMM8B) | XM_041384.1 | 1 |
| 4841 | SEOA9931 | transmembrane 4 superfamily protein (SAS) (ORF) | U01160 | 1 |
| 4842 | SEOB2039 | transmembrane 7 superfamily member 1 (upregulated in kidney) (TM7SF1) | gi4507544 | 1 |
| 4843 | ncr2182 | transmembrane GTPase | U95822.1 | 1 |

Figure 6A – EST Names Corresponding to Unique Known Genes of Figure 6

| | | | | |
|---|---|---|---|---|
| 4844 | mioa7654a | transmembrane protein 4 (TMEM4), mRNA /cds=(144,692) /gb=NM_014255 /gi=7657175 /ug=Hs.8752 /len=814 | Hs.8752 | 1 |
| 4845 | FCR7114 | transmembrane protein CD99 type II | U82164 | 1 |
| 4846 | SEOA3949a | transmembrane protein with EGF-like and two follistatin-like domains 1 (TMEFF1) | U19878 | 1 |
| 4847 | ncrc1567 | transmembrane proteolipid (HSPC224) | NM_016951.2 | 1 |
| 4848 | mioa7738a | transmembrane trafficking protein (TMP21), mRNA /cds=(11,670) /gb=NM_006827 /gi=5803200 /ug=Hs.74137 /len=1302 | Hs.74137 | 1 |
| 4849 | hfcr7095 | VAMP (vesicle-associated membrane protein)-associated protein B and C (VAPB) | NM_004738.1 | 1 |
| 4850 | hfcr7402 | mutL (E. coli) homolog 3 (MLH3) | NM_014381.1 | 1 |
| 4851 | FCR5081 | mutY homolog (hMYH) | U63329 | 1 |
| 4852 | ncr3164 | alanyl-tRNA synthetase (AARS) | NM_001605.1 | 1 |
| 4853 | hfcr8478 | damage-specific DNA binding protein 2 (48kD) (DDB2) | NM_000107.1 | 1 |
| 4854 | SEOA0737n | DNA recombination and repair protein (MRE11B) | AF022778 | 1 |
| 4855 | SEOA6203a | DNA repair protein XRCC4 | U40622 | 1 |
| 4856 | ncrb8248 | DNA topoisomerase gene type I, exon 8 | M60694.1 | 1 |
| 4857 | FCR5288 | DNA topoisomerase II binding protein | AB019397 | 1 |
| 4858 | BFCN0116 | excision repair gene ERCC-1 | X07415 | 1 |
| 4859 | hfcr3674 | Helicase (KIAA0054) | NM_014877.1 | 1 |
| 4860 | SEOA0931 | HHR23A protein | D21235 | 1 |
| 4861 | ncrc6459 | KIAA0054 gene product; Helicase (RefSeq aa 1e-50) | NP_055692.1 | 1 |
| 4862 | hfcr3374 | nucleolar RNA-helicase (noH61 gene) | AJ131712.1 | 1 |
| 4863 | ncrc4296 | putative RNA helicase, 3' end | AJ223948.1 | 1 |
| 4864 | ncrc1811 | RAD50 (S. cerevisiae) homolog (RefSeq aa 2e-36) | NP_005723.1 | 1 |
| 4865 | MIOB2569 | RAD50-2 protein (RAD50) | AF057299.1 | 1 |
| 4866 | MIOA2851a | Rad51-interacting protein (60% aa) | AF006259 | 1 |
| 4867 | hfcr9290 | RAD9 (S. pombe)(RAD9)(=cell cycle checkpoint control protein) | NM_004584.1 | 1 |
| 4868 | hfcr6783 | SWI/SNF related, matrix associated, actin dependent regulator of chromatin, subfamily d, member 3 (SMARCD3) | NM_003078.1 | 1 |
| 4869 | hfcr6663 | SWI/SNF related, matrix associated, actin dependent regulator of chromatin, subfamily e, member 1 (SMARCE1) (=BAF57) | NM_003079.1 | 1 |
| 4870 | SEOA6734 | T-COMPLEX PROTEIN 1, EPSILON SUBUNIT (TCP-1-EPSILON) (CCT-EPSILON) (KIAA0098) | spP48643 | 1 |
| 4871 | MIOA3160a | T-COMPLEX PROTEIN 1, THETA SUBUNIT (TCP-1-THETA) (CCT-THETA) (KIAA0002) | spP50990 | 1 |
| 4872 | ncrb6282 | transketolase-like 1 (TKTL1) | NM_012253.1 | 1 |
| 4873 | ncrb7675 | xeroderma pigmentosum complementation group A (XPA) | NM_000380.1 | 1 |
| 4874 | miob3249 | adenylate kinase 2 (AK2),transcript variant AK2A, nuclear gene encoding mitochondrial protein, mRNA | NM_001625.1 | 1 |
| 4875 | fCR0657 | carbonic anhydrase III | M29452 | 1 |
| 4876 | hfcr1900 | carbonic anhydrase XII (CA12) | NM_001218.1 | 1 |
| 4877 | MIOA5355a | ceruloplasmin, exon 10 (ORF) | D45037 | 1 |
| 4878 | MIOA2224a | coagulation factor VIII | AF062515 | 1 |
| 4879 | SEOB1787 | complement C1q A chain precursor | AF135157.1 | 1 |

Figure 6A – EST Names Corresponding to Unique Known Genes of Figure 6

| | | | |
|---|---|---|---|
| 4880 ncrc0644 | complement component 2 (RefSeq aa 7e-80) | NP_000054.1 | 1 |
| 4881 ncrb5699 | complement component 3 precursor (RefSeq aa 9e-33) | NP_000055.1 | 1 |
| 4882 ncr1299 | complement component 3a receptor 1 (RefSeq aa 2e-56) | NP_004045.1 | 1 |
| 4883 MIOA2185a | complement decay-accelerating factor (DAF) (=M31516) | M15799 | 1 |
| 4884 hfcr9678 | cytochrome P450 21-hydroxylase (CYP21) gene, partial cds; TNX pseudogene ,complete sequence; and RP2 pseudogene, partial sequence (=XA (XA) gene )(= 21-hydroxylase (P-450(C21)) B gene) | AF077974.1 | 1 |
| 4885 FCR2750 | cytochrome P450 3A9 | U46118 | 1 |
| 4886 ncr9572 | cytochrome P450 monooxygenase (LOC57404) | NM_020674.1 | 1 |
| 4887 ncrb5514 | cytochrome P450, subfamily IVA, polypeptide 11; CYP4A11 (RefSeq aa 3e-48) | NP_000769.1 | 1 |
| 4888 ncr4552 | epoxide hydrolase 2, cytoplasmic (EPHX2) | NM_001979.1 | 1 |
| 4889 mioa7639a | glutathione S-transferase A4 (GSTA4) | NM_001512.1 | 1 |
| 4890 ncrb4976 | glutathione S-transferase theta 2 (GSTT2) (GSTT1) genes | AF240786.1 | 1 |
| 4891 miob6113 | glutathione S-transferase= (MICROSOMAL GST-1)=P10620 | J03746.1 | 1 |
| 4892 FCR7019 | glutathione synthetase | U34683 | 1 |
| 4893 FCR7415 | glutathione transferase M2 (GSTM2) | M63509 | 1 |
| 4894 SOA0065 | gpx1 gluthatione peroxidase (=Y00433) | X13709 | 1 |
| 4895 FCR0633 | iron-responsive element-binding protein/iron regulatory protein 1 (IRE-BP1/IRP1) | M58510 | 1 |
| 4896 FCR3878 | lactoferrin BTLF3 | L24753 | 1 |
| 4897 MIOA8851 | light chain of factor I | CAA68418.1 | 1 |
| 4898 ncrb8475 | metallothionein 2A; MT-II (RefSeq aa 8e-30) | NP_005944.1 | 1 |
| 4899 miob0795 | MHC class II DR subtype Dw12 | M16086.1 | 1 |
| 4900 SEOB1399 | MHC class II HLA-DR7-associated glycoprotein beta-chain | M16941.1 | 1 |
| 4901 SEOA3472a | MHC class II HLA-DR-beta-1 (HLA-DRB1) | M33600 | 1 |
| 4902 miob5938 | MHC HLA-Dw12 DQ-beta chain | M57650.1 | 1 |
| 4903 fcrb0607 | MHC leukocyte antigen (HLA-A) gene, HLA-A*2402 allele | L47206.1 | 1 |
| 4904 FCR7146 | MTA1 like1 | AB016591.1 | 1 |
| 4905 MIOA4704 | MTG8-like protein(MTGR1) gene | AF076461.1 | 1 |
| 4906 hfcr2599 | MTH1b (p22), MTH1c (p21), MTH1d (p18) | AB025239.1 | 1 |
| 4907 fcrb0354 | pentaxin-related gene rapidly induced by IL-1 beta (PTX3) | NM_002852.1 | 1 |
| 4908 ncrc2839 | peroxiredoxin 3; thioredoxin-dependentperoxide reductase precursor (RefSeq aa 1e-92) | NP_006784.1 | 1 |
| 4909 ncrc3228 | PHEX gene | Y10196.1 | 1 |
| 4910 miob5810 | prothrombin (F2) gene (Alu and KpnI repeats) | M17262.1 | 1 |
| 4911 ncrc0907 | small inducible cytokine subfamily A(Cys-Cys), member 8 (monocyte chemotactic protein 2)(RefSeq aa 3e-59) | NP_005614.1 | 1 |
| 4912 ncrc6232 | small inducible cytokine subfamily B (Cys-X-Cys), member 14 (BRAK) (SCYB14) | NM_004887.1 | 1 |
| 4913 MIOA0072a | Sop2p-like protein | Y08999 | 1 |
| 4914 FCR3580 | Su (P) (=Z70310 C.elegans glutathione S-transferase) | AJ011320 | 1 |

Figure 6A – EST Names Corresponding to Unique Known Genes of Figure 6

| | | | | |
|---|---|---|---|---|
| 4915 | fcrb1856 | superoxide dismutase 1 soluble (amyotrophic lateral sclerosis 1 (adult))(SOD1) | XM_047885.1 | 1 |
| 4916 | hfcr9743 | superoxide dismutase 3, extracellular (SOD3) | NM_003102.1 | 1 |
| 4917 | ncr9165 | superoxide dismutase Mn (EC 1.15.1.1+D3527) | Y00472.1 | 1 |
| 4918 | FCR2075 | thiol-specific antioxidant | X82321 | 1 |
| 4919 | ncr6012 | thioredoxin reductase 1 (TXNRD1) | NM_003330.1 | 1 |
| 4920 | seoa0981m | Chediak-Higashi syndrome 1 (CHS1) | NM_000081.1 | 1 |
| 4921 | MIOA6597a | Ankhzn mRNA, | AB011370 | 1 |
| 4922 | ncrb4490 | arfaptin 1 (HSU52521) | NM_014447.1 | 1 |
| 4923 | MIOA4771 | intersectin short form | AF064243 | 1 |
| 4924 | ncr4984 | alpha endosulfine | AF157509.1 | 1 |
| 4925 | SEOA8521 | caveolin 2 (CAV2) | NM_001233.1 | 1 |
| 4926 | hfcr7893 | caveolin 3 (CAV3) | NM_001234.2 | 1 |
| 4927 | miob3938 | caveolin-1/-2 locus, Contig1, D7S522, genes CAV2 CAV1 | AJ133269.1 | 1 |
| 4928 | FCR6969 | clathrin assembly protein 50 (AP50) (=D63475 hypothetical protein (KIAA01)) | U36188 | 1 |
| 4929 | SEOA4886a | clathrin coat assembly protein | E13406 | 1 |
| 4930 | hfcr3615 | clathrin, light polypeptide (Lcb) (CLTB) | NM_001834.1 | 1 |
| 4931 | hfcr1633 | clathrin-associated protein | X97074.1 | 1 |
| 4932 | hfcr7649 | Hermansky-Pudlak syndrome (HPS) | NM_000195.1 | 1 |
| 4933 | MIOA3939a | kanadaptin | AF035526 | 1 |
| 4934 | fcrb0099 | myoM [Dictyostelium discoideum](38%ORF) | AB017910 | 1 |
| 4935 | ncr8363 | partial SNAP-23 gene for synaptosome associated protein-23, exons 6-8 | AJ278974.1 | 1 |
| 4936 | SEOA3357a | Rab7 protein | X89650 | 1 |
| 4937 | FCR1829 | SKD1 homologue | AF038960 | 1 |
| 4938 | FCR4106 | SMCY (H-Y) | U52191 | 1 |
| 4939 | fcrb1556 | symplekin; Huntingtin interacting protein I (SPK) | XM_017129.2 | 1 |
| 4940 | MIOA9136 | synaptosome associated protein 23 kD isoform A | AJ011915.1 | 1 |
| 4941 | mioa0480m | vesicle trafficking protein (SEC22C) (ORF) | AF039568 | 1 |
| 4942 | hfcr1371 | VPS28 protein (LOC51160)(ORF) | NM_016208.1 | 1 |
| 4943 | ncr9429 | zinc/ iron regulated transporter-like (ZIRTL) (=putative metal transporter (IRT1 homologue)) | NM_014437.1 | 1 |
| 4944 | fcrb1684 | synaptosomal-associated protein 25kD (SNAP25) | XM_056115.1 | 1 |
| 4945 | hfcr4451 | 4F2 heavy chain | AB018010.1 | 1 |
| 4946 | SEOA9100 | 88-kDa Golgi protein (GM88) | AF204231.1 | 1 |
| 4947 | miob3757 | CG12935 gene product | AAF58754.1 | 1 |
| 4948 | ncr0509 | CG13865 gene product [Drosophila melanogaster] | AE003066 | 1 |
| 4949 | SEOB1219 | CG13919 gene product | AE003472 | 1 |
| 4950 | ncr9652 | CG14037 gene product | AAF52201.1 | 1 |
| 4951 | ncr5810 | CG14903 gene product | AAF55335.1 | 1 |
| 4952 | ncr0518 | CG17593 gene product [Drosophila melanogaster] | AE003579 | 1 |
| 4953 | miob3721 | CG2839 gene product | AAF51469.1 | 1 |
| 4954 | SEOB3468 | CG3358 gene product | AAF57413.1 | 1 |
| 4955 | MIOA9099 | CG3918 gene product [Drosophila melanogaster](56%ORF) | AAF46166.1 | 1 |
| 4956 | ncr7619 | CG6949 gene product | AE003739 | 1 |
| 4957 | fcrb0044 | CG8605 gene product [Drosophila melanogaster] | AE003559 | 1 |
| 4958 | miob3690 | CG9469 gene product | AAF57414.1 | 1 |
| 4959 | MIOA0528 | CGI-03 protein (=AF106798 fas-associated factor 1 (FAF1)) | AF132938.1 | 1 |

Figure 6A – EST Names Corresponding to Unique Known Genes of Figure 6

| | | | | |
|---|---|---|---|---|
| 4960 | ncr2381 | CGI-06 protein (LOC51604), | NM_015937.1 | 1 |
| 4961 | ncr2848 | CGI-10 protein (LOC51004), | NM_015940.1 | 1 |
| 4962 | ncrb3241 | CGI-12 protein (RefSeq aa 1e-68) | NP_057026.1 | 1 |
| 4963 | ncrb8649 | CGI-125 protein (RefSeq aa 1e-30) | NP_057144.1 | 1 |
| 4964 | SEOA4524 | CGI-128 protein (ORF) | AF151886 | 1 |
| 4965 | ncrb3352 | CGI-145 protein (RefSeq aa 2e-48) | NP_057159.1 | 1 |
| 4966 | SeA0222 | CGI-17 protein | AF132951.1 | 1 |
| 4967 | hfcr6971 | CGI-18 protein (LOC51008) | NM_015947.1 | 1 |
| 4968 | seob5764 | CGI-26 protein (LOC51071) | NM_015954.1 | 1 |
| 4969 | SEOA0577 | CGI-27 protein | AF132961.1 | 1 |
| 4970 | ncrb6087 | CGI-35 protein (LOC51077) | NM_015962.1 | 1 |
| 4971 | seob6703 | CGI-47 protein (LOC51095)(ORF) | NM_016000.1 | 1 |
| 4972 | hfcr2708 | CGI-48 protein (LOC51096) | NM_016001.1 | 1 |
| 4973 | SEOA7583a | CGI-54 protein (60% aa) | AF151812 | 1 |
| 4974 | ncrc3076 | CGI-79 protein (RefSeq aa 2e-76) | NP_057108.1 | 1 |
| 4975 | MIOA0936 | CGI-80 protein | AF151838.1 | 1 |
| 4976 | ncr8910 | CGI-85 protein (LOC51111) | NM_016028.1 | 1 |
| 4977 | hfcr9410 | CGI-87 protein (LOC51112) | NM_016030.1 | 1 |
| 4978 | seob4223 | cytoplasmic dynein intermediate chain 2C mRNA Length = 2460 | U39046.1 | 1 |
| 4979 | fcrb2453 | cytoskeleton-associated protein 4 (CKAP4), mRNA | XM_006940.4 | 1 |
| 4980 | miob3668 | diaphanous 1 (HDIA1) | AF051782.1 | 1 |
| 4981 | hfcr6937 | dynactin light chain (DCTN-22) | NM_007234.1 | 1 |
| 4982 | miob3257 | dynactin p62 subunit(LOC51164)(= putative tumor suppressor) | NM_016221.1 | 1 |
| 4983 | ncr0335 | dynein light chain-A (LOC51143)(ORF) | NM_016141.1 | 1 |
| 4984 | SEOA1232A | dynein light intermediate chain 2 (LIC2) | AF035812 | 1 |
| 4985 | ncr9803 | dynein, cytoplasmic, intermediate polypeptide 1 (RefSeq aa 3e-57) | NP_004402.1 | 1 |
| 4986 | fcrb2401 | dynein, cytoplasmic, light intermediate polypeptide 2, clone IMAGE:4294925, mRNA | BC010928.1 | 1 |
| 4987 | hfcr1140 | flightless I (Drosophila) homolog (FLII), mRNA | NM_002018.1 | 1 |
| 4988 | fcrb1855 | gamma-tubulin complex protein 2 (GCP2) | XM_057524.1 | 1 |
| 4989 | miob2466 | golgi SNAP receptor complex member 1 (GOSR1) | NM_004871.1 | 1 |
| 4990 | ncr3965 | golgi SNAP receptor complex member 2 (GOSR2) | NM_004287.1 | 1 |
| 4991 | ncrc3073 | Golgi transport complex protein (90 kDa) (GTC90) | NM_006348.1 | 1 |
| 4992 | hfcr7855 | golgin-67 (GOLGA5) D1886 | AF164622.1 | 1 |
| 4993 | SEOA8997 | kinectin 1 (156 kDa Protein) (=CG1) | CAA80271.1 | 1 |
| 4994 | ncr7801 | kinesin heavy chain member 2 (KIF2) | NM_004520.1 | 1 |
| 4995 | miob0589 | kinesin-like protein GAKIN | AF279865.1 | 1 |
| 4996 | FCR4306 | kinesin-like spindle protein HKSP (=X85137) | U37426 | 1 |
| 4997 | ncrc6552 | kinesin-related protein, partial cds | D14678.1 | 1 |
| 4998 | MIOA0959 | MAP1B protein | AF115776.1 | 1 |
| 4999 | ncrb2266 | microtubule-associated proteins 1A/1B light chain 3 | AF303888.1 | 1 |
| 5000 | hfcr6366 | novel centrosomal protein RanBPM (RANBPM) | NM_005493.1 | 1 |
| 5001 | FCR2182 | spindle pole body protein spc97 homologue GCP2 | AF042379 | 1 |
| 5002 | SEOA0526 | Sprague-Dawley acidic calponin | U06755 | 1 |
| 5003 | miob6988 | TACC2 protein (TACC2) (=AF176646.1 anti zuai-1) | AF095791.1 | 1 |
| 5004 | ncrc3276 | CG2974 gene product (aa 2e-41,52%) | AAF46554.1 | 1 |
| 5005 | ncrc4473 | CG6353 gene product (aa 3e-20,68%) | AAF55906.1 | 1 |
| 5006 | ncrc2377 | CG8198 gene product | AAF48498.1 | 1 |
| 5007 | fcrb2338 | CGI-01 protein (CGI-01), mRNA | NM_015935.2 | 1 |

Figure 6A – EST Names Corresponding to Unique Known Genes of Figure 6

| | | | | |
|---|---|---|---|---|
| 5008 | ncrc5768 | CGI-11 protein (RefSeq aa 2e-35) | NP_057025.1 | 1 |
| 5009 | fcrb1890 | CGI-144 protein | AF151902.1 | 1 |
| 5010 | ncrc4903 | CGI-55 protein | AF151813.1 | 1 |
| 5011 | SEOA8520 | dJ797M17.1 (Dermatopontin) | CAB46693.1 | 1 |
| 5012 | ncr2258 | adlican | AF245505.1 | 1 |
| 5013 | ncr5484 | chondrocyte expressed protein 68 kDa (CEP-68 gene)(= ASPIC(acidic secreted protein in cartilage)) | AJ279016.1 | 1 |
| 5014 | ncr1476 | chondroitin 4-O-sulfotransferase 2 | AF239822 | 1 |
| 5015 | ncr0385 | chondroitin 6-sulfotransferase | AB017915 | 1 |
| 5016 | hfcr9935 | collagen type III N-endopeptidase (PCOLN3), (=metallopeptidase PRSM1 ) (=KIAA0047 gene,) | NM_002768.1 | 1 |
| 5017 | hfcr0832 | collagen type VI alpha 2 (COL6A2) | M81836.1 | 1 |
| 5018 | ncrb2804 | collagenous repeat-containing sequence of 26kDa protein | AAG33704.1 | 1 |
| 5019 | ncr7227 | dentin matrix acidic | NM_004407.1 | 1 |
| 5020 | ncr6773 | dystroglycan 1 | NM_004393.1 | 1 |
| 5021 | MIOA5409a | EGF-containing fibulin-like extracellular matrix protein 1 (EFEMP1) =U03877= extracellular protein(S1-5) | NM_004105.1 | 1 |
| 5022 | hfcr3539 | elastin gene, partial cds and partial 3'UTR | U77846.1 | 1 |
| 5023 | BFCW0023 | EPSILON-COAT PROTEIN (EPSILON-COP; LDLF) (low match) | spAC005197 | 1 |
| 5024 | FCR0511 | extracellular protein (S1-5) | U03877 | 1 |
| 5025 | hfcr1915 | fibrillarin (FBL) | NM_001436.1 | 1 |
| 5026 | fcrb2060 | fibulin 1 (FBLN1) | XM_047231.1 | 1 |
| 5027 | hfcr1667 | fibulin 2 (FBLN2) | NM_001998.1 | 1 |
| 5028 | FCR6221 | fibulin-4 | AJ132819 | 1 |
| 5029 | hfcr5864 | germ line gene homologous to bladder carcinoma oncogene T24 (Gene code c-Ha-ras-1)with four exons | V00574.1 | 1 |
| 5030 | FCR5812 | glypican-5 (GPC5) (=AF001462) | U66033 | 1 |
| 5031 | fcrb1876 | glypican-6 (GPC6) | AF105267.1 | 1 |
| 5032 | MIOA2858a | Hakata antigen | D88587 | 1 |
| 5033 | FCR6854 | heparan-sulfate 6-sulfotransferase | AB006179 | 1 |
| 5034 | MIOA6697a | hepatic leukemia factor (HLF) | M95585 | 1 |
| 5035 | hfcr3616 | interphotoreceptor matrix proteoglycan 200 (SPACRCAN)(ORF) | NM_016247.1 | 1 |
| 5036 | SEOB0242 | lamin-like protein (low match) | M24732 | 1 |
| 5037 | hfcr1762 | linker for activation of T cells (LAT) | AF036906.1 | 1 |
| 5038 | seob4216 | LST1 mRNA, cLST1/E splice variant, complete cds | AF000426.1 | 1 |
| 5039 | ncr9060 | matrilin 4 (RefSeq aa 5e-44) | NP_003824.1 | 1 |
| 5040 | FCR1464 | miCRofibril-associated glycoprotein 4 (MFAP4) | L38486 | 1 |
| 5041 | MIOB1506 | miCRofibril-associated glycoprotein-2 MAGP-2 | U37283.1 | 1 |
| 5042 | hfcr8814 | microfibrillar-associated protein 2 (MFAP2) | NM_002403.1 | 1 |
| 5043 | FCR0056n | mucin MUC1 (=M61170) | X69118 | 1 |
| 5044 | FCR1783 | nidogen (=M27445;M30269) (low match) | X84837 | 1 |
| 5045 | fCR0125 | period (per) region proteoglycan gene | M13655 | 1 |
| 5046 | ncrb3928 | PG-M core protein | D45889.1 | 1 |
| 5047 | SOA0031 | phosphatidylinositol glycan, class H (PIGH) | L19783 | 1 |
| 5048 | fcrb2637 | phosphatidylinositol glycan, class K (PIGK)(= AF022913.1 GPI transamidase) (=Y07596.1 GPI8 protein ) | XM_039644.2 | 1 |
| 5049 | miob4595 | pRGR1 | AF041429.1 | 1 |
| 5050 | ncrb1511 | psihHbC pseudogene for hair keratin | Y19215.1 | 1 |

Figure 6A – EST Names Corresponding to Unique Known Genes of Figure 6

| | | | | |
|---|---|---|---|---|
| 5051 | miob6103 | sarcolemmal associated protein (SLAP1) mRNA, complete cds | U21155.1 | 1 |
| 5052 | ncrc2928 | sarcolipin (SLN) | NM_003063.1 | 1 |
| 5053 | FCR7548 | sarcosin | AF056929 | 1 |
| 5054 | ncr2391 | sarcospan (Kras) | NM_005086.2 | 1 |
| 5055 | ncrb2422 | sarcospan (Sspn), mRNA | NM_010656.1 | 1 |
| 5056 | ncrb4485 | serglycin gene | M90058.1 | 1 |
| 5057 | hfcr3859 | SHORT-CHAIN COLLAGEN C4 | P18503 | 1 |
| 5058 | hfcr6406 | tenascin XA (TNXA) | NM_007116.1 | 1 |
| 5059 | ncrb2155 | Z-crystallin/quinone reductase (CRYZ) gene sequence | L31526.1 | 1 |
| 5060 | ncrb4763 | Hem-2 | X80029.1 | 1 |
| 5061 | ncr2999 | LAZ3/BCL6 gene | Z79581.1 | 1 |
| 5062 | MIOA4277 | MLL (MLL) gene, exons 1-3,similar to MARINER TRANSPOSASE | AF036405 | 1 |
| 5063 | FCR6531 | 22kDa smooth muscle protein (SM22) | M95787 | 1 |
| 5064 | hfcr4068 | actin binding protein (Schizosaccharomyces pombe sop2-like) (SOP2L) | NM_006409.1 | 1 |
| 5065 | hfcr3902 | actin related protein 2/3 complex, subunit 1B (41 kD) (ARPC1B), mRNA | NM_005720.1 | 1 |
| 5066 | ncr5242 | actin-binding protein 22 kDa (SM22) gene | AF013711.1 | 1 |
| 5067 | ncr4696 | actin-binding protein homolog ABP-278 | AF043045.1 | 1 |
| 5068 | MIOA8531 | actinin-associated LIM protein | AF039018 | 1 |
| 5069 | MIOA5404a | actin-like 6 (ACTL6)=AF041474 =BAF53a (BAF53a)(ORF) | NM_004301.1 | 1 |
| 5070 | hfcr5970 | ACTN2 gene for alpha-Actinin 2, exon 21 | AJ249776.1 | 1 |
| 5071 | seob7900 | A-kinase anchoring protein 220 (=AB014529 KIAA0629) | AF176555.1 | 1 |
| 5072 | FCR2972 | alpha 1-syntrophin (SNT A1) | U40571 | 1 |
| 5073 | FCR4357 | alpha II spectrin (=J05243;X86901) | U83867 | 1 |
| 5074 | FCR4754 | alpha-adducin | L29294 | 1 |
| 5075 | hfcr1379 | alpha-tropomyosin | AJ001055.1 | 1 |
| 5076 | seob6217 | alpha-tubulin | K00557.1 | 1 |
| 5077 | BFCW0200 | ankyrin 1 (ANK1) (=M28880) | AF005213 | 1 |
| 5078 | FCR2209 | ankyrin alt. variant 2.2 (53%,aa) | X16609 | 1 |
| 5079 | FCR4743 | ankyrin binding glycoprotein-1 related mRNA sequence | L11002 | 1 |
| 5080 | miob7030 | ankyrin-repeat containing protein (Krit1) gene | U90269.1 | 1 |
| 5081 | ncr4486 | A-raf-1 oncogene | X04790.1 | 1 |
| 5082 | hfcr5237 | archvillin (SVIL) | AF109135.1 | 1 |
| 5083 | FCR2587 | beta tubulin (clone nuk_278) | X79535 | 1 |
| 5084 | MIOA1948a | beta-filamin | AF042166 | 1 |
| 5085 | seob5640 | beta-tubulin | AF141349.1 | 1 |
| 5086 | seoa7955 | capping protein alpha mRNA, partial cds /cds=UNKNOWN /gb=U03851 /gi=433307 /ug=Hs.75546 /len=2287 | Hs.75546 | 1 |
| 5087 | FCR2585 | capping protein beta-subunit isoform 1 | U10406 | 1 |
| 5088 | fcrb1101 | CDC42-binding protein kinase beta (DMPK-like) (CDC42BPB) mRNA | NM_006035.1 | 1 |
| 5089 | FCR3664 | cofilin, non-muscle type (=U21909) | X95404 | 1 |
| 5090 | ncr7207 | cytohesin 1, isoform 2 (RefSeq aa 3e-30) | NP_059430.1 | 1 |
| 5091 | hfcr4278 | cytokeratin 8 | U76549.1 | 1 |

Figure 8A – EST Names Corresponding to Unique Known Genes of Figure 6

| | | | | |
|---|---|---|---|---|
| 5092 | FCR1111 | desmosome associated protein pinin | U77716 | 1 |
| 5093 | fCR0958 | destrin-2 (=actin depolymerizing factor) | U72518 | 1 |
| 5094 | seob7941 | drebrin E | D17530.1 | 1 |
| 5095 | FCR3299 | dynamin | L07807 | 1 |
| 5096 | FCR7518 | dystrobrevin B DTN-B1 | Y15722 | 1 |
| 5097 | hfcr4011 | GLUT1 C-terminal binding protein (GLUT1CBP) | NM_005716.1 | 1 |
| 5098 | SEOA6620a | hCRNN4 | AB030656.1 | 1 |
| 5099 | ncr3649 | kelch (Drosophila)-like 3(=kelch-like protein KLHL3b )(= KLHL3c )(= KLHL3a)(= KIAA1129 protein,) | NM_017415.1 | 1 |
| 5100 | MIOB2163 | keratin type II (58 kD) | M21389.1 | 1 |
| 5101 | FCR4057 | NuMA protein (=Z11584;Z14229;Z14227) | Z11583 | 1 |
| 5102 | seoa8101 | partial TTN gene for titin | AJ277892.2 | 1 |
| 5103 | hfcr6691 | phosvitin/casein kinase type II beta subunit (EC 2.7.1.37) | X16937.1 | 1 |
| 5104 | miob0974 | regulatory factor X-associated ankyrin-containing protein (RFXANK) | NM_003721.1 | 1 |
| 5105 | mioa7812a | scinderin (SCIN), mRNA /cds=(276,1682) /gb=NM_033128 /gi=14916472 /ug=Hs.210473 /len=2571 | Hs.210473 | 1 |
| 5106 | hfcr3436 | singed (Drosophila)-like(sea urchin fascin homolog like) (SNL) | NM_003088.1 | 1 |
| 5107 | hfcr9054 | skeletal muscle alpha-actin gene (ACTA1) | AF182035.1 | 1 |
| 5108 | ncrb6644 | skeletal muscle HSB84A051 STRATAGENE cDNA library, cat. #936215. cDNA clone 84A05 | Z28721.1 | 1 |
| 5109 | fCR0373 | skeletal muscle selenoprotein W (SelW) | U25264 | 1 |
| 5110 | FCR4784 | smoothelin | AC005005 | 1 |
| 5111 | ncr0836 | spectrin, alpha,non-erythrocytic 1 (alpha-fodrin) (SPTAN1)(= alpha II spectrin) | NM_003127.1 | 1 |
| 5112 | hfcr3527 | spectrin, beta, non-erythrocytic 1 (SPTBN1)(ORF) = M96803.1 | NM_003128.1 | 1 |
| 5113 | ncr5668 | stretch regulated skeletal | CAC03620.1 | 1 |
| 5114 | ncr6399 | striated muscle contraction regulatory protein (Id2B) | M96843.1 | 1 |
| 5115 | ncrb2687 | TANKYRASE (RefSeq aa 9e-90) | NP_003738.1 | 1 |
| 5116 | FCR5483 | telethonin | AJ000491 | 1 |
| 5117 | SEOA9499 | testican-1 | AF231124 | 1 |
| 5118 | SEOA0990n | TRICHOHYALIN | spP37709 | 1 |
| 5119 | fcrb1539 | tubulin alpha 6 (TUBA6) | XM_028724.2 | 1 |
| 5120 | fcrb1618 | tubulin, alpha, ubiquitous (K-ALPHA-1) | NM_006082.1 | 1 |
| 5121 | hfcr3913 | tubulin, beta, 2 (TUBB2) (ORF) | NM_006088.1 | 1 |
| 5122 | hfcr4114 | tubulin, beta, 4 (TUBB4) | NM_006086.1 | 1 |
| 5123 | fcrb1183 | tubulin-specific chaperone d (TBCD)= AJ006417 beta-tubulin cofactor D | NM_005993.2 | 1 |
| 5124 | FCR0903 | uroporphyrinogen decarboxylase (UROD) | AF047383 | 1 |
| 5125 | hfcr6970 | vasodilator-stimulated phosphoprotein (VASP) | NM_003370.1 | 1 |
| 5126 | hfcr9862 | zyxin (ZYX) (=ESP-2 ) | NM_003461.1 | 1 |
| 5127 | ncrc5929 | actin binding protein; macrophin(microfilament and actin filament cross-linker protein)(RefSeq aa 1e-40) | NP_036222.1 | 1 |
| 5128 | fcrb1600 | alpha actinin 4 (Actn4) | NM_021895.1 | 1 |
| 5129 | seob6525 | alpha tropomyosin (tpma) | AF180892.1 | 1 |
| 5130 | fcrb2745 | aortic-type smooth muscle alpha-actin (SM-alpha-A) gene, exon 9 | M33216.1 | 1 |

Figure 6A – EST Names Corresponding to Unique Known Genes of Figure 6

| | | | | |
|---|---|---|---|---|
| 5131 | FCR5930 | fast skeletal troponin C | X07898 | 1 |
| 5132 | FCR1562 | myosin alkali light chain (ventricular) | M24122 | 1 |
| 5133 | FCR2498 | myosin binding protein H | L05606 | 1 |
| 5134 | ncr6212 | myosin IC (MYO1C) | NM_004998.1 | 1 |
| 5135 | fcrb1834 | myosin, light polypeptide 6, alkali, smooth muscle and non-muscle (MYL6) | XM_049089.1 | 1 |
| 5136 | ncr1912 | myosin, light polypeptide kinase (RefSeq aa 2e-76) | NP_005956.1 | 1 |
| 5137 | FCR1337 | myosin-IXb | U42391 | 1 |
| 5138 | ncr0808 | myotubular myopathy 1(MTM1) | NM_000252.1 | 1 |
| 5139 | FCR2218 | regulatory myosin light chain (MYL5) | L03785 | 1 |
| 5140 | FCR2935 | slow skeletal muscle troponin T (clone H22h) | M19309 | 1 |
| 5141 | FCR3155 | slow-twitch skeletal troponin I (TNN1) | J04760 | 1 |
| 5142 | SEOA1099 | SMAP-5 smooth muscle cell associated protein | AB014733 | 1 |
| 5143 | ncr9779 | SMC-like protein | AJ005015.1 | 1 |
| 5144 | hfcr8575 | smooth muscle myosin light chain kinase | M76233.1 | 1 |
| 5145 | seob5431 | troponin I, skeletal, fast 2 (Tnni2), mRNA | NM_009405.1 | 1 |
| 5146 | ncr0265 | adapt78 protein gene= U85266 | U53821.1 | 1 |
| 5147 | miob3048 | colon cancer-associated protein Mic1 | NM_013326.1 | 1 |
| 5148 | miob4322 | CRIB-containing BORG2 protein (BORG2) | AF164118.1 | 1 |
| 5149 | miob0785 | laforin (EPM2A) | AF084535.2 | 1 |
| 5150 | miob0628 | neuroligin 3 | AF217413.1 | 1 |
| 5151 | hfcr9296 | peroxisomal membrane protein 20 | AF124993.1 | 1 |
| 5152 | miob4307 | peroxisomal membrane protein 3 (35kD, Zellweger syndrome) (PXMP3) | NM_000318.1 | 1 |
| 5153 | ncrb8539 | peroxisomal targeting signal 1 (SKL type) receptor | Z48054.1 | 1 |
| 5154 | ncr5287 | peroxisome assembly factor-2 (PEX6) gene | AF108098.1 | 1 |
| 5155 | HFCR3224 | phosphatidylinositol glycan, class C (PIGC) | gi4505794 | 1 |
| 5156 | SEOA4177a | PIG-A protein | D11466 | 1 |
| 5157 | hfcr3649 | tight junction protein 1 (zona occludens 1) (TJP1) | NM_003257.1 | 1 |
| 5158 | miob1139 | tight junction protein ZO-2 (TJP2) | AF177533.1 | 1 |
| 5159 | hfcr9400 | 78 kDa gastrin-binding protein | U04627.1 | 1 |
| 5160 | SEOB3384 | AP-3 complex sigma3A subunit | U91932.1 | 1 |
| 5161 | hfcr6634 | ARE1-like protein | AJ006026.1 | 1 |
| 5162 | mioa9189 | ASIALOGLYCOPROTEIN RECEPTOR 2 (HEPATIC LECTIN 2) (MHL-2) (ASGP-R) (ASGPR)(52%ORF) | P24721 | 1 |
| 5163 | miob1441 | ESR (EST84588 Colon adenocarcinoma IV cDNA 5') | AA372592.1 | 1 |
| 5164 | FCR1308N | neuropilin-2 (a5) | AF022861 | 1 |
| 5165 | MIOA2424a | son of sevenless 1 | Z11574 | 1 |
| 5166 | ncrc6925 | toll-like receptor3 (RefSeq aa 3e-41) | NP_003256.1 | 1 |
| 5167 | MIOA6252a | trg (=AB028981 KIAA1058) | X68101 | 1 |
| 5168 | ncrb0811 | UCC1 protein (UCC1 gene) | AJ250475.2 | 1 |
| 5169 | SEOB1721 | 5-HT4 receptor gene | AJ243213.1 | 1 |
| 5170 | FCR6396 | alpha 7 neuronal nicotinic receptor | AF029838 | 1 |
| 5171 | FCR5779 | alpha-CP1 (=X78137 hnRNP-E1) | U24223 | 1 |
| 5172 | SEOB1383 | alpha-globin transCRiption factor CP2 | M84810.1 | 1 |
| 5173 | SEOB2090 | autocrine motility factor receptor (AMFR) | NM_001144.1 | 1 |
| 5174 | SEOA0085 | beta-hydroxysteroid dehydrogenase 11 (HSD11) | M76661 | 1 |
| 5175 | seob3886 | bradykinin receptor B2 (BDKRB2) | NM_000623.1 | 1 |
| 5176 | ncr1876 | breast cancer nuclear receptor-binding auxiliary protein (BRX) | AF126008.1 | 1 |
| 5177 | hfcr4457 | calcitonin receptor-like receptor activity modifying protein 2 (RAMP2) | NM_005854.1 | 1 |

Figure 6A – EST Names Corresponding to Unique Known Genes of Figure 6

| | | | | |
|---|---|---|---|---|
| 5178 | MIOA8987 | CD163 antigen (CD163) (=M130 antigen (cytosolic variant 2) | NM_004244.1 | 1 |
| 5179 | MIOA3842 | CD33 differentiation antigen (CD33) | M23197 | 1 |
| 5180 | FCR5681 | CD34 | M81104 | 1 |
| 5181 | BFCW0008 | CD39L2 (CD39L2) | AF039916 | 1 |
| 5182 | SOA0606 | CD3G antigen, gamma polypeptide (TiT3 complex) (CD3G) | X04145 | 1 |
| 5183 | SEOA0534 | CD58 | Y14785 | 1 |
| 5184 | mioa7829a | CDA11 protein (CDA11), mRNA /cds=(25,918) /gb=NM_032026 /gi=14042942 /ug=Hs.11810 /len=1039 | Hs.11810 | 1 |
| 5185 | ncr8290 | CHRM3 gene for muscarinic acetylcholine receptor m3 | AB041395.1 | 1 |
| 5186 | hfcr4497 | class I cytokine receptor (zcytor5) | AF178684.1 | 1 |
| 5187 | SEOB0038 | colony stimulating factor 1 receptor (CSF1R) gene, exon 5 | M33210.1 | 1 |
| 5188 | ncr1150 | CSF-1 receptor (FMS) gene (=KIAA0194) | U63963.1 | 1 |
| 5189 | ncr0954 | CSF2RA=GM-CSF receptor alpha subunit | S48475.1 | 1 |
| 5190 | SEOB0119 | endothelial protein C receptor | AB026584.2 | 1 |
| 5191 | ncrc3520 | endothelin receptor type A (EDNRA) | NM_001957.1 | 1 |
| 5192 | ncr6776 | endothelin receptor type B-like protein | U87460.1 | 1 |
| 5193 | MIOA2718a | epidermal growth factor repeat containing protein (=AL117610) | AF186084 | 1 |
| 5194 | MIOA8539 | Epstein-Barr virus induced gene 2(lymphocyte-specific G protein-coupled receptor) (=EBI2) | NP_004942.1 | 1 |
| 5195 | ncrb2013 | estrogen receptor gene, 5' partial (422 bp) | AJ002562.1 | 1 |
| 5196 | ncr6197 | estrogen receptor-bindingfragment-associated gene 9 (RefSeq aa 9e-68) | NP_004206.1 | 1 |
| 5197 | MIOB2814 | estrogen related receptor alpha (ESTRRA) pseudogene | U85258.1 | 1 |
| 5198 | hfcr1310 | estrogen-related receptor gamma (ESRRG) | NM_001438.1 | 1 |
| 5199 | ncr6893 | Ewing sarcoma breakpoint region 1 (EWSR1), transcript variant EWS | NM_005243.1 | 1 |
| 5200 | seob4555 | fibroblast growth factor receptor 2 (bacteria-expressed kinase, keratinocyte growth factor receptor, craniofacial dysostosis 1, Crouzon syndrome, Pfeiffer syndrome, Jackson-Weiss syndrome) (FGFR2) | NM_000141.1 | 1 |
| 5201 | fcrb1807 | fibroblast growth factor receptor 3 (achondroplasia, thanatophoric dwarfism)(FGFR3) | XM_044120.1 | 1 |
| 5202 | FCR2132 | fibroblast growth factor receptor(N-sam) | X66945 | 1 |
| 5203 | ncr7351 | FYN-binding protein (FYB-120/130) (RefSeq aa 3e-38) | NP_001456.1 | 1 |
| 5204 | ncrc2388 | G protein-coupled receptor 30 (GPR30) | NM_001505.1 | 1 |
| 5205 | ncr1029 | G protein-coupled receptor 48 (GPR48) | NM_018490.1 | 1 |
| 5206 | MIOA0483 | G protein-coupled receptor Edg-2 | Y09479 | 1 |
| 5207 | ncr6925 | G protein-coupled receptor kinase 5 (GPRK5) | NM_005308.1 | 1 |
| 5208 | MIOA0840a | GABAA receptor subunit alpha4 | U30461 | 1 |
| 5209 | seob5862 | gene for vitamin D receptor, exon 9 (=(1,25-dihydroxyvitamin D3) receptor) | AB002168.1 | 1 |
| 5210 | miob4186 | genes for vasopressin, oxytocin and a long interspersed repeated DNA element (LINE) | X59496.1 | 1 |

Figure 6A – EST Names Corresponding to Unique Known Genes of Figure 6

| | | | | |
|---|---|---|---|---|
| 5211 | ncr8751 | gephyrin (GPH) | NM_020806.1 | 1 |
| 5212 | seob7877 | G-protein coupled receptor (SH120) | gi7706703 | 1 |
| 5213 | seob7760 | G-protein-coupled receptor 48 (GPR48) | AF257182.1 | 1 |
| 5214 | seob6104 | growth factor receptor bound protein 2 (Grb2) | NM_008163.1 | 1 |
| 5215 | MIOA7317 | growth hormone receptor (contains Alu repeat) | X06562 | 1 |
| 5216 | SEOB1879 | H1 histamine receptor | Z34897.1 | 1 |
| 5217 | FCR1776 | Hin-2 (=U40396 steroid receptor coactivator SRC-1) | U19179 | 1 |
| 5218 | SEOA2040 | histamine H1-receptor | D14436.1 | 1 |
| 5219 | MIOA1794 | IL-1 receptor antagonist IL-1Ra (IL-1RN) | U65590 | 1 |
| 5220 | MIOA0925a | IL-13 receptor | Y08768 | 1 |
| 5221 | SEOA5151a | interferon alpha/beta receptor (IFNAR) gene, exon 11 and partial cds. | U06244 | 1 |
| 5222 | ncr4454 | interferon, gamma-inducible protein 16 (IFI16) | NM_005531.1 | 1 |
| 5223 | MIOA4944a | interferon,gamma-inducible protein 30 (IFI30)(ORF) =J03909 | NM_006332.1 | 1 |
| 5224 | mioa7709a | interleukin-1 receptor-associated kinase 1 (IRAK1), mRNA /cds=(79,2217) /gb=NM_001569 /gi=4755143 /ug=Hs.182018 /len=3583 | Hs.182018 | 1 |
| 5225 | FCR4385 | interleukin-11 receptor | Z38102 | 1 |
| 5226 | ncr3434 | interleukin-18 binding protein c precursor (IL18BP) | AF110801.1 | 1 |
| 5227 | hfcr0568 | laminin receptor precursor/p40 ribosome associated protein gene 37 kD ( colin carcinoma laminin) | U43901.1 | 1 |
| 5228 | miob1814 | leukemia inhibitory factor receptor (LIFR) | NM_002310.2 | 1 |
| 5229 | ncrc5039 | lymphatic vessel endothelial hyaluronan receptor 1 (LYVE-1) | NM_006691.1 | 1 |
| 5230 | FCR7369 | M2-type pyruvate kinase | M23725 | 1 |
| 5231 | ncrb4652 | m3 muscarinic acetylcholine receptor (CHRM3) gene | U29589.1 | 1 |
| 5232 | hfcr9022 | metabotropic glutamate receptor 6 (mGluR6) gene | U82083.1 | 1 |
| 5233 | fCR1023 | mineralocorticoid receptor (=hMR) (low match) | M80582 | 1 |
| 5234 | hfcr1202 | natriuretic peptide precursor B (NPPB) | NM_002521.1 | 1 |
| 5235 | hfcr7508 | neurotrophic tyrosine kinase, receptor, type 2 (NTRK2) | NM_006180.1 | 1 |
| 5236 | ncr8906 | NK receptor Ly-49L gene | AF126036.1 | 1 |
| 5237 | seob5052 | NKG2D gene | AJ001689.1 | 1 |
| 5238 | seob5319 | novel retinal pigment epithelial cell protein (NORPEG) (=KIAA1334) | AF155135.1 | 1 |
| 5239 | ncr0045 | NRBF-2 nuclear receptor binding factor-2 | AB024930.1 | 1 |
| 5240 | hfcr8885 | nuclear receptor binding protein (NRBP) | NM_013392.1 | 1 |
| 5241 | MIOB2686 | nuclear receptor interacting protein 1 (NRIP1) | gi4505454 | 1 |
| 5242 | ncr9881 | nuclear receptor Rev-ErbA-beta | U20796.1 | 1 |
| 5243 | hfcr5937 | nuclear receptor subfamily 1, group I, member 3 (NR1I3)=( orphan nuclear hormone receptor)=(similar to XIST, coding sequence) | NM_005122.1 | 1 |
| 5244 | ncrb8700 | olfactory receptor (OR2D2) gene, partial cds | AF065876.1 | 1 |
| 5245 | fcrb1162 | olfactory receptor (OR7-86) pseudogene U86281 | U86282 | 1 |
| 5246 | MIOA8639 | olfactory receptor 17-93 (OR17-93) and olfactory receptor 17-201 (OR17-201) genes | U76377 | 1 |
| 5247 | miob3120 | oncostatin M receptor (OSMR) | NM_003999.1 | 1 |
| 5248 | SEOA9619 | osteoprotegrin ligand | AF053712 | 1 |
| 5249 | fcrb1714 | outer membrane receptor Tom20 (TOM20) gene (=KIAA0016) | AF126962.1 | 1 |
| 5250 | SEOA3910 | oxytocin receptor | X64878 | 1 |

Figure 6A – EST Names Corresponding to Unique Known Genes of Figure 6

| | | | | |
|---|---|---|---|---|
| 5251 | FCR0143 | oxytocinase splice variant 1 | U62768 | 1 |
| 5252 | MIOA7209a | P2X7 | Y12853 | 1 |
| 5253 | FCR1557 | p50B/p97 (Lyt-10) transCRiption factor | D16367 | 1 |
| 5254 | hfcr1141 | PAR protein (PAR) | NM_012389.1 | 1 |
| 5255 | hfcr1101 | peroxisome proliferative activated receptor delta (PPARD) gene, exon 9 and complete cds | AF246296S8 | 1 |
| 5256 | miob6929 | peroxisome proliferative activated receptor, gamma, coactivator 1 (PPARGC1) | NM_013261.1 | 1 |
| 5257 | SEOB2131 | peroxisome receptor 1 (PXR1) | NM_000319.1 | 1 |
| 5258 | ncrb0624 | PEST-containing nuclear protein (pcnp) | NM_020357.1 | 1 |
| 5259 | ncrc3415 | photolyase, complete cds | D83702.1 | 1 |
| 5260 | MIOA1137 | pilin-like transCRiption factor | AF122004.1 | 1 |
| 5261 | hfcr2796 | PNR gene | AJ276674.1 | 1 |
| 5262 | seoa4988a | pro-oncosis receptor inducing membrane injury gene (PORIMIN), mRNA /cds=(216,785) /gb=NM_052932 /gi=16418408 /ug=Hs.172089 /len=3338 | Hs.172089 | 1 |
| 5263 | mioa9273 | prostaglandin E2 receptor EP4 | AF177934 | 1 |
| 5264 | miob0663 | putative G-protein coupled receptor RA1c | AAD12761.1 | 1 |
| 5265 | ncrb7177 | receptor (calcitonin) activity modifying protein 3 (RAMP3) | NM_005856.1 | 1 |
| 5266 | FCR1346 | receptor of retinoic acid (=M73779 PML-RAR protein (PML-RAR)) | X06614 | 1 |
| 5267 | seoa7876a | receptor tyrosine kinase-like orphan receptor 2 (ROR2), mRNA /cds=(199,3030) /gb=NM_004560 /gi=4758841 /ug=Hs.155585 /len=4092 | Hs.155585 | 1 |
| 5268 | seob6395 | receptor tyrosine phosphatase gamma (PTPRG) gene, exon 30 and complete cds | U46116.1 | 1 |
| 5269 | fcrb1582 | receptor-associated protein of the synapse, 43kD (RAPSN) | XM_037181.1 | 1 |
| 5270 | MIOA6502a | regulator of G protein signaling (RGS5) | AF030108 | 1 |
| 5271 | MIOA3679a | Rel domain-containing transCRiption factor NFAT5 (Nfat5) | AF162853.1 | 1 |
| 5272 | SEOB0641a | RETINOIC ACID- AND INTERFERON-INDUCIBLE 58 KD PROTEIN (RI58) | spQ13325 | 1 |
| 5273 | hfcr6579 | retinoic acid receptor gamma (RARG) | NM_000966.1 | 1 |
| 5274 | seob4613 | retinoic acid receptor responder (tazarotene induced) 1 (RARRES1)= U27185.1 RAR-responsive (TIG1) | NM_002888.1 | 1 |
| 5275 | SEOA4464a | retinoic acid receptor, beta (RARB) =Y00291 hap mRNA encoding a DNA-binding hormone receptor | NM_000965.1 | 1 |
| 5276 | SEOA4017a | retinoic acid-induced protein (RAI2) | AF136587.1 | 1 |
| 5277 | miob2448 | retinoid x receptor interacting protein (LOC51720) | NM_016290.1 | 1 |
| 5278 | ncrc6604 | retinoid X receptor, alpha (RXRA) | NM_002957.2 | 1 |
| 5279 | hfcr1826 | retinoid X receptor, gamma (RXRG) | NM_006917.1 | 1 |
| 5280 | HFCR3220 | RS21-C6 (Tdrg-TL1) | AF110764.1 | 1 |
| 5281 | hfcr0016 | scg | D67015.1 | 1 |
| 5282 | fcrb1299 | Sck, partial | AB001451 | 1 |
| 5283 | ncrb3569 | secreted modular calcium-binding protein 2 (smoc2 gene) | AJ249902.1 | 1 |
| 5284 | ncrc5019 | sigma receptor (SR31747 binding protein 1) (SR-BP1) | NM_005866.1 | 1 |
| 5285 | MIOA0059a | steroid receptor (TR2-11) | M29960 | 1 |
| 5286 | hfcr9953 | steroid receptor RNA activator | AF092038.1 | 1 |
| 5287 | ncr3123 | T41p (C8orf1) | AF061326.1 | 1 |

Figure 6A – EST Names Corresponding to Unique Known Genes of Figure 6

| | | | | |
|---|---|---|---|---|
| 5288 | ncr3684 | TAFII20 transcription factor TFIID(=TFIID subunits TAF20 and TAF15)(= subunit p22) | X84002.1 | 1 |
| 5289 | hfcr9936 | transmebrane receptor protein | Z17227.1 | 1 |
| 5290 | hfcr5719 | transportin-SR (TRN-SR) | AF145029.1 | 1 |
| 5291 | MIOA1947a | TRHR gene promoter (low match) | AJ011701 | 1 |
| 5292 | fCR0819 | V beta T-cell receptor (TCRBV) (low match) | U03115 | 1 |
| 5293 | hfcr7856 | vanilloid receptor-like protein (VRL) | NM_016113.1 | 1 |
| 5294 | hfcr3375 | vasoactive intestinal peptide receptor 1 (VIPR1) | NM_004624.1 | 1 |
| 5295 | SEOA0396 | very low density lipoprotein receptor | D16532 | 1 |
| 5296 | miob3937 | v-Ki-ras2 Kirsten rat sarcoma 2 viral oncogene homolog (KRAS2) | NM_004985.1 | 1 |
| 5297 | ncrb6366 | v-kit Hardy-Zuckerman 4 feline sarcoma viral oncogene homolog (KIT)(= c-kit gene)(= KIT proto-oncogene for mast/stem cell growth factor receptor, exon 21 ) | NM_000222.1 | 1 |
| 5298 | fcrb1562 | benzodiazapine receptor (peripheral) (BZRP) | XM_040167.1 | 1 |
| 5299 | FCR3957 | 14-3-3 epsilon | U54778 | 1 |
| 5300 | FCR0608 | 14-3-3 protein beta subtype=putative protein kinase C regulatory protein | S55223 | 1 |
| 5301 | hfcr0786 | 14-3-3 protein eta chain | D78577.1 | 1 |
| 5302 | FCR2293 | 14-3-3 protein gamma subtype=putative protein kinase C regulatory protein | S55305 | 1 |
| 5303 | FCR3001 | 14-3-3n protein (=D78577) | L20422 | 1 |
| 5304 | SEOA3287 | 40 kDa protein kinase related to rat ERK2 | Z11695 | 1 |
| 5305 | MIOA8767 | BIFUNCTIONAL 3'-PHOSPHOADENOSINE 5'-PHOSPHOSULFATE SYNTHETHASE 1 (PAPS SYNTHETHASE 1) (PAPSS 1) (SULFURYLASE KINASE 1) (SK1) (SK 1) | spO43252 | 1 |
| 5306 | hfcr0370 | calcineurin B | M30773.1 | 1 |
| 5307 | FCR1989 | cAMP-dependent protein kinase regulatory subunit RI-beta | M65066 | 1 |
| 5308 | hfcr3444 | CDC-like kinase 3 (CLK3) transcript variant phclk3 | NM_003992.1 | 1 |
| 5309 | MIOA0753n | DCHT (=AF030403 Ste20-like protein kinase) | AF017635 | 1 |
| 5310 | ncrb2166 | ILK-1 gene for integrin-linked kinase 1, exons 1-13 | AJ404847.1 | 1 |
| 5311 | FCR0385 | JAB1-containing signalosome subunit 3 (SGN3) | AF031647 | 1 |
| 5312 | mioa9294 | JNK2 beta2 protein kinase (JNK2B2) (ORF) | U35003.1 | 1 |
| 5313 | hfcr4168 | MAP kinase-interacting serine/threonine kinase 1 (MKNK1) | NM_003684.1 | 1 |
| 5314 | miob5888 | mitogen-activated protein kinase 5 (MAP4K5) | NM_006575.1 | 1 |
| 5315 | ncrb2570 | mitogen-activated protein kinase 8 (MAPK8)(= kinase (JNK1)) | NM_002750.1 | 1 |
| 5316 | ncr6170 | mitogen-activated protein kinase phosphatase x (MKPX) | NM_020185.1 | 1 |
| 5317 | ncr2717 | mitogen-activated proteinkinase-activated protein kinase 5 (RefSeq aa 3e-39) | NP_003659.1 | 1 |
| 5318 | hfcr1418 | mitotic spindle coiled-coil related protein (DEEPEST) | NM_006461.1 | 1 |
| 5319 | SEOA3387a | pim-1 oncogene | M16750 | 1 |
| 5320 | FCR1207 | PKU-alpha | AB004884 | 1 |
| 5321 | SEOB3076 | PKY protein kinase | AF004849.1 | 1 |
| 5322 | FCR2704 | plk-1 (=U01038) | X73458 | 1 |
| 5323 | ncrb0444 | protein kinase C delta-type | D10495.1 | 1 |
| 5324 | FCR7178 | protein kinase C zeta | Z15108 | 1 |

Figure 6A – EST Names Corresponding to Unique Known Genes of Figure 6

| | | | | |
|---|---|---|---|---|
| 5325 | ncrc1837 | protein kinase C, alpha (RefSeq aa 3e-31) | NP_002728.1 | 1 |
| 5326 | mioa9935 | protein kinase C, nu (PRKCN) | NM_005813.2 | 1 |
| 5327 | hfcr3622 | protein kinase CDK9(CDK9) gene | AF255306 | 1 |
| 5328 | hfcr9461 | protein kinase Chk2 (RAD53) | NM_007194.1 | 1 |
| 5329 | seob6432 | protein kinase C-theta (PRKCT) | L01087.1 | 1 |
| 5330 | FCR6039 | protein kinase Dyrk2 | Y13493 | 1 |
| 5331 | SEOA1689a | protein kinase inhibitor p58 | U28424 | 1 |
| 5332 | MIOA5097a | protein kinase inhibitor(testicular isoform) (ORF). | L02241 | 1 |
| 5333 | FCR4469 | PROTEIN MOV-10 | spP23249 | 1 |
| 5334 | MIOB2067 | PROTEIN N-TERMINAL ASPARAGINE AMIDOHYDROLASE (PROTEIN NH2-TERMINAL ASPARAGINE DEAMIDASE) (NTN-AMIDASE) (PNAD) (PROTEIN NH2-TERMINAL ASPARAGINE AMIDOHYDROLASE) (PNAA) | spQ64311 | 1 |
| 5335 | FCR0059n | PROTEIN OS-9 PRECURSOR (non-exact 48%) | spQ13438 | 1 |
| 5336 | FCR3856 | protein tyrosine kinase t-Ror1 (Ror1) (=AF059524 reticulon gene family protein (RTN3)) | U38894 | 1 |
| 5337 | hfcr1419 | rac protein kinase beta | M77198.1 | 1 |
| 5338 | ncr6376 | Ser/Thr protein phosphatase type 2C beta 2 isoform | AF294792.1 | 1 |
| 5339 | ncr1967 | serine racemase | AF169974.1 | 1 |
| 5340 | hfcr6276 | serine/threonine protein kinase (HSA250839) | NM_018401.1 | 1 |
| 5341 | CR0052 | serum inducible kinase (SNK) | M96163 | 1 |
| 5342 | SEOA6118a | serum/glucocorticoid regulated kinase-like | gi7019527 | 1 |
| 5343 | seob4270 | SFRS protein kinase 1 (SRPK1) | NM_003137.1 | 1 |
| 5344 | ncrb1880 | SFRS protein kinase 2 (SRPK2) | NM_003138.1 | 1 |
| 5345 | SEOA7587a | T2K protein kinase homologue | AF145705.1 | 1 |
| 5346 | hfcr2237 | tyrosine 3-monooxygenase/tryptophan 5-monooxygenase activation protein, epsilon polypeptide (YWHAE) | NM_006761.1 | 1 |
| 5347 | hfcr7957 | tyrosine 3-monooxygenase/tryptophan 5-monooxygenase activation protein, zeta polypeptide (YWHAZ) | NM_003406.1 | 1 |
| 5348 | FCR7711 | tyrosyl-tRNA synthetase | U89436 | 1 |
| 5349 | SEOA6695a | VRK2 | AB000450 | 1 |
| 5350 | SEOA3811a | cGMP phosphodiesterase delta subunit | AF022912 | 1 |
| 5351 | MIOB2104 | cGMP-binding cGMP-specific phosphodiesterase (PDE5) | AB001633.1 | 1 |
| 5352 | mioa9492 | cyclic AMP-regulated phosphoprotein (90% match) | AF112220.1 | 1 |
| 5353 | FCR5176 | CYCLIC-AMP-DEPENDENT TRANSCRIPTION FACTOR ATF-4 (DNA-BINDING PROTEIN TAXREB67) (CREB2) | spP18848 | 1 |
| 5354 | ncrc0457 | Golgi membrane sialoglycoprotein MG160 (GLG1)(= cysteine-rich fibroblast growth factor receptor (CFR-1) mRNA) | U64791.1 | 1 |
| 5355 | FCR2045 | breakpoint cluster region protein 2 (BCRG2) | AF044774 | 1 |
| 5356 | ncr7088 | cAMP-regulated guanine nucleotide exchange factor II (CAMP-GEFII) | NM_007023.1 | 1 |
| 5357 | hfcr8540 | dishevelled 2 (homologous to Drosophila dsh) (DVL2) | NM_004422.1 | 1 |
| 5358 | ncrc1681 | formin (Fmn) | NM_010230.1 | 1 |
| 5359 | fcrb1359 | formin-binding protein 17 (FBP17) | AF265550.1 | 1 |
| 5360 | seob5418 | GDP dissociation inhibitor 1(GDI1) | NM_001493.1 | 1 |
| 5361 | ncrc4588 | GRB2-associated binding protein 1 (GAB1) | NM_002039.1 | 1 |

Figure 6A – EST Names Corresponding to Unique Known Genes of Figure 6

| | | | | |
|---|---|---|---|---|
| 5362 | SEOB0096 | GTPase Rab14 (LOC51730) (=DKFZp762K0911) | NM_016322.1 | 1 |
| 5363 | SEOA1909 | GTPase-activating protein GAPIII | U20238 | 1 |
| 5364 | ncr0144 | GTP-binding protein similar to RAY/RAB1C (RAYL), (ORF) | NM_006860.1 | 1 |
| 5365 | SEOA1747a | guanine nucleotide exchange factor delta subunit (JGR1A) | M98036 | 1 |
| 5366 | FCR6502 | guanine nucleotide exchange factor GRP1 (=A223957 ARNO3 protein) | AJ005197 | 1 |
| 5367 | FCR0860 | guanine nucleotide regulatory protein (ABR) | U01147 | 1 |
| 5368 | seob4424 | guanine nucleotide regulatory protein (oncogene) (NET1A) mRNA | NM_005863.1 | 1 |
| 5369 | hfcr8772 | intracellular hyaluronan-binding protein | AF241831.1 | 1 |
| 5370 | CR0236 | mad protein homolog (hMAD-2) | U68018 | 1 |
| 5371 | FCR2340 | MAD2 protein (=U31278) | AJ000186 | 1 |
| 5372 | ncr0165 | Na /H exchanger 2 (A57644) (ORF) | D87743 | 1 |
| 5373 | FCR6497 | Na /H exchanger regulatory factor 2 (NHERF-2) (=AF004900 NHE3 kinase A regulatory protein E3KARP) | AF035771 | 1 |
| 5374 | miob0180 | N-acetylneuraminate lyase (EC 4.1.3.3)(Non-exact 35% identity) | CAA27051.1 | 1 |
| 5375 | fcrb0130 | non-receptor tyrosine kinase (TNK1) gene, complete cds | AF097738 | 1 |
| 5376 | ncrb6355 | partial RAB18 gene for RAS-related small GTPase RAB18, exons 4-6 | AJ277148.1 | 1 |
| 5377 | SEOA6137a | phosphoprotein p53 | M22898 | 1 |
| 5378 | hfcr1798 | Rab acceptor 1 (prenylated) (RABAC1) | NM_006423.1 | 1 |
| 5379 | mioa9499 | RAB10 | XM_002267 | 1 |
| 5380 | ncr0223 | RAB2, member RAS oncogene family (RAB2) (ORF) | NM_002865.1 | 1 |
| 5381 | MIOA0820 | Rab27a (=AF154840.1 Ras-like GTP-binding protein (RAB27A)) | U38654.3 | 1 |
| 5382 | hfcr1918 | RAB31, member RAS oncogene family (RAB31) | NM_006868.1 | 1 |
| 5383 | HFCR9418 | RAB39 (RAB39) | AF322067 | 1 |
| 5384 | seob5886 | RAB-8b protein (LOC51762),mRNA | NM_016530.1 | 1 |
| 5385 | BFCN0133 | rah=ras-related homologue | S72304 | 1 |
| 5386 | fcrb1018 | RalBP1 associated Eps domain containing protein (Reps1), mRNA | NM_009048.1 | 1 |
| 5387 | FCR7009 | RalGDS-like 2 (RGL2) | U68142 | 1 |
| 5388 | hfcr8663 | RAN binding protein 3 (RANBP3), transcript variant RANBP3-c | NM_007321.1 | 1 |
| 5389 | FCR0779 | RAN-SPECIFIC GTPASE-ACTIVATING PROTEIN (RAN BINDING PROTEIN 1) (RANBP1) | spP43487 | 1 |
| 5390 | ncrb4428 | Ras association (RalGDS/AF-6) domain family 2 (RASSF2)(= KIAA0168) | NM_014737.1 | 1 |
| 5391 | seob6669 | ras GTPase activating protein-like (NGAP) mRNA | NM_004841.1 | 1 |
| 5392 | MIOA0247a | ras GTPase-activating-like protein (IQGAP1) (=D29640 KIAA0051) | L33075 | 1 |
| 5393 | ncrc6844 | Ras homolog enriched in brain 2 (RHEB2) | NM_005614.1 | 1 |
| 5394 | ncrb2586 | ras homolog gene family member A (ARHA)(= GTP-binding protein(rhoA)) | NM_001664.1 | 1 |
| 5395 | seob7699 | RasGAP-related protein (IQGAP2) | U51903.1 | 1 |
| 5396 | SEOA6711 | ras-like protein | M31467 | 1 |
| 5397 | FCR7379 | ras-like protein (low match, 57% aa) | M31468 | 1 |

Figure 6A – EST Names Corresponding to Unique Known Genes of Figure 6

| | | | | |
|---|---|---|---|---|
| 5398 | MIOA6621a | ras-related protein (rab18) | L04966 | 1 |
| 5399 | hfcr9603 | RAS-RELATED PROTEIN RAH1(AS-RELATED HOMOLOG) | spQ64008 | 1 |
| 5400 | MIOA8102 | RAS-RELATED PROTEIN RAP-1A (C21KG)(KREV-1 PROTEIN) (GTP-BINDING PROTEIN SMG-P21A) (G-22K) | spP10113 | 1 |
| 5401 | MIOA3361a | rho GDP-dissociation Inhibitor 1 | X69550 | 1 |
| 5402 | ncrc2018 | Rho GTPase activating protein 6 isoform5 (RefSeq aa 3e-67) | NP_038266.1 | 1 |
| 5403 | seob6856 | Rho-associated, coiled-coil containing protein kinase 2 (ROCK2) | NM_004850.2 | 1 |
| 5404 | ncr9061 | SH3 and PX domain-containing protein SH3PX1 (SH3PX1) | NM_016224.1 | 1 |
| 5405 | hfcr3592 | SH3 domain-containing protein 6511 (LOC51165)(ORF) | NM_016223.1 | 1 |
| 5406 | hfcr8006 | SH3-containing adaptor molecule-1 | AF037261.1 | 1 |
| 5407 | ncrb7483 | SH3-containing protein EEN (EEN) and chromatin assembly factor-I p150 subunit (CAF) genes | AF190465.1 | 1 |
| 5408 | FCR4699 | signal transducer and activator of transCRiption 3 (acute-phase response factor) (STAT3) | L29277 | 1 |
| 5409 | SEOA1460a | signal transducing adaptor molecule 2A (STAM2) | AF042273 | 1 |
| 5410 | hfcr8450 | signal-induced proliferation-associated gene 1 (SIPA1) | NM_006747.1 | 1 |
| 5411 | seob6601 | small GTP-binding protein RAB1A | AF226873.1 | 1 |
| 5412 | MIOA3653a | Testin 2 (testin 3) | AF260225 | 1 |
| 5413 | SEOA7417a | T-lymphoma invasion and metastasis inducing TIAM1 protein (TIAM1) | U16296 | 1 |
| 5414 | ncrb1195 | transducer of ERBB2, 1 (RefSeq aa 2e-64) | NP_005740.1 | 1 |
| 5415 | miob6640 | transducer of ERBB2, 2(TOB2) | NM_016272.1 | 1 |
| 5416 | MIOA0474 | transducin (beta) like 1 protein | Y12781 | 1 |
| 5417 | fcrb1441 | A kinase (PRKA) anchor protein 1 (AKAP1) | XM_008154.3 | 1 |
| 5418 | hfcr2955 | ANG2 (ANG2) | AF024631.2 | 1 |
| 5419 | seob5223 | angiopoietin-like 2 (ANGPTL2) | NM_012098.1 | 1 |
| 5420 | BFCW0393 | Aspergillus nidulans sudD homologue | AF013591 | 1 |
| 5421 | FCR3277 | BB1=malignant cell expression-enhanced gene/tumor progression-enhanced gene | gi1699264 | 1 |
| 5422 | hfcr2642 | bone-derived growth factor (BPGF-1) | L42379.1 | 1 |
| 5423 | ncrb4025 | EXT-like protein 2 (EXTL2) | AF000416.1 | 1 |
| 5424 | mioa9666 | factor C=endotoxin-sensitive intracellular serine protease zymogen {clone CrFC26}[Carcinoscorpius rotundicauda=Singapore horseshoe crabs, blood, amoebocytes, Peptide, 1083 aa, 34%ORF] | S77064 | 1 |
| 5425 | SEOA0407 | gliosarcoma-related antigen MIDA1 (MIDA1) | AF118853.1 | 1 |
| 5426 | hfcr1302 | glycine amidinotransferase (L-arginine:glycine amidinotransferase) (GATM) | NM_001482.1 | 1 |
| 5427 | ncrc3435 | insulin-like growth factor binding protein 6 (IGFBP6) mRNA, complete mature peptide | M69054.1 | 1 |
| 5428 | ncr2581 | interferon-related developmental regulator 1 | NP_001541.1 | 1 |
| 5429 | FCR1724 | MAGE-Xp (non-exact 60%) (=M80840 Mouse necdin non-exact) | X82539 | 1 |
| 5430 | MIOA3799 | non-erythrocyte beta spectrin | AF017112 | 1 |
| 5431 | SEOA0449 | NOV protein | X96585 | 1 |

Figure 6A – EST Names Corresponding to Unique Known Genes of Figure 6

| | | | | |
|---|---|---|---|---|
| 5432 | FCR7095 | SKB1Hs | AF015913 | 1 |
| 5433 | ncrc4496 | angiopoietin-like factor (CTD6) | NM_021146.1 | 1 |
| 5434 | FCR0893 | activin beta-C chain | X82540 | 1 |
| 5435 | ncrb4349 | angiogenin ribonuclease RNase A family, 5 (ANG) | NM_001145.1 | 1 |
| 5436 | ncrb2458 | bone morphogenetic protein 4 precursor(RefSeq aa 8e-38) | NP_001193.1 | 1 |
| 5437 | hfcr9612 | bone morphogenetic protein 7 (osteogenic protein 1) (BMP7) (=OP-1 ) | NM_001719.1 | 1 |
| 5438 | FCR1298 | bone morphogenetic protein1 (BMP1) (clone KT2) and alternatively spliced mammalian tolloid protein (mTld) | L35279 | 1 |
| 5439 | SEOB0308 | CC-chemokine MCP-4 | AJ001634.1 | 1 |
| 5440 | miob5771 | chemokine (C-X3-C) receptor 1 (CX3CR1) | NM_001337.1 | 1 |
| 5441 | MIOA8705 | chemokine receptor X(CKRX) | AF014958 | 1 |
| 5442 | FCR0459 | chimaeric transCRipt of collagen type 1 alpha 1 and platelet derived growth factor beta | Y15913 | 1 |
| 5443 | ncr0238 | decidual protein induced by progesterone (DEPP) | NM_007021.1 | 1 |
| 5444 | ncr5509 | developmental arteries and neural crest EGF-like protein mRNA (=fibulin-5) | AF112152.1 | 1 |
| 5445 | MIOA8902 | developmental protein DG1071 | AAC67538.1 | 1 |
| 5446 | ncr1687 | endocrine regulator (RefSeq aa 2e-88) | NP_055160.1 | 1 |
| 5447 | SEOA0491 | enkephalin | K00489 | 1 |
| 5448 | hfcr6336 | fibroblast growth factor 13 (FGF13) | NM_004114.1 | 1 |
| 5449 | fcrb0979 | fibroblasts of periodontal ligament | AB019409 | 1 |
| 5450 | SEOA6364 | glia maturation factor beta | M86492 | 1 |
| 5451 | miob1789 | glia maturation factor homologous protein | AB001993.1 | 1 |
| 5452 | SEOB0938 | gonadotropin-releasing hormone (=X01059) | X15215.1 | 1 |
| 5453 | SEOB2156 | GRO3 oncogene (GRO3) | NM_002090.1 | 1 |
| 5454 | SEOA3147 | growth factor-responsive protein, vascular smooth muscle (=U06713) | A53770 | 1 |
| 5455 | ncrc2172 | growth hormone secretagogue precursor (GHRELIN) gene, complete cds | AF296558.1 | 1 |
| 5456 | SEOA6393 | growth inhibitor p33ING1 (ING1) | AF001954 | 1 |
| 5457 | FCR2761 | heparin cofactor II (HCF2) | M58600 | 1 |
| 5458 | hfcr1697 | heparin-binding growth factor binding protein (non-exact 25% a.a)(DNA sequence (chromosome 4, Accn. No. AC005598.6) | NP_005121.1 | 1 |
| 5459 | SEOA2184a | insulin-like growth factor binding protein 5 | U02026 | 1 |
| 5460 | BFCN0094 | insulin-like growth factor binding protein (IGFBP-2) (=M35410) | X16302 | 1 |
| 5461 | hfcr1037 | interferon-induced leucine zipper protein (IFP35) mRNA, partial cds | U72882.1 | 1 |
| 5462 | miob5434 | keratinocyte, normal | U33270.1 | 1 |
| 5463 | SEOA7268a | mast cell growth factor (Mgf) | U44725 | 1 |
| 5464 | SEOB0250 | monocyte seCRetory protein, JE (=S69738) | M28226.1 | 1 |
| 5465 | seob7868 | NB thymosin beta | D82345.1 | 1 |
| 5466 | MIOB2855 | neuroendoCRine seCRetory protein 55 | AF105253.1 | 1 |
| 5467 | fcrb1721 | placental growth factor vascular endothelial growth factor-related protein (PGF) | XM_040405.1 | 1 |
| 5468 | ncr5072 | prepro insulin-like growth factor-I (IGF-I) gene, exon 1 | M59812.1 | 1 |
| 5469 | ncrc4780 | preproadrenomedullin, complete cds (exon 1-4) | D43639.1 | 1 |
| 5470 | miob0487 | schwannomin interacting protein 1 (SCHIP-1) | NM_014575.1 | 1 |

Figure 6A – EST Names Corresponding to Unique Known Genes of Figure 6

| | | | |
|---|---|---|---|
| 5471 SEOA2900a | seCRetory protein clone 1.1 (=D79993 KIAA0171) | U00157 | 1 |
| 5472 MIOA0884a | thymocyte protein cThy28kD (=AF161493 HSPC144) | U34350 | 1 |
| 5473 hfcr2933 | Transformation-related protein | AAA36776.1 | 1 |
| 5474 FCR4795 | transformation-sensitive protein (IEF SSP 3521) | M86752 | 1 |
| 5475 FCR7065 | transforming acidic coiled-coil containing protein 3 (TACC3) | AF093543.1 | 1 |
| 5476 ncrc5762 | transforming growth factor, alpha (TGFA) | NM_003236.1 | 1 |
| 5477 SEOA0770 | transforming growth factor-beta type I receptor | AF035669 | 1 |
| 5478 FCR1833 | TRANSFORMING PROTEIN P21/H-RAS-1 (C-H-RAS) | spP01112 | 1 |
| 5479 hfcr3928 | TRK-fused gene (NOTE: non-standard symbol and name) (TFG) (ORF) | NM_006070.1 | 1 |
| 5480 ncrb3341 | uncharacterized bone marrow protein BM028 (=chord domain-containing protein 1 (CHP1)) | AF217505.1 | 1 |
| 5481 seob2555 | uncharacterized bone marrow protein BM029 (BM029) | NM_018450.1 | 1 |
| 5482 SEOB0261 | uncharacterized bone marrow protein BM031 | AF217508.1 | 1 |
| 5483 SEOB2810 | uncharacterized bone marrow protein BM033 | AF217510.1 | 1 |
| 5484 miob3354 | uncharacterized bone marrow protein BM044 | AF217520.1 | 1 |
| 5485 miob3308 | uncharacterized hypothalamus protein HT010 (HT010) | NM_018471.1 | 1 |
| 5486 ncrb2151 | vascular endothelial growth factor C (RefSeq aa 6e-31) | NP_005420.1 | 1 |
| 5487 ncr3837 | vascular endothelial junction-associated molecule | AF255910.1 | 1 |
| 5488 fcrb1428 | vascular Rab-GAP/TBC-containing (VRP) | XM_010826.2 | 1 |
| 5489 ncrb4957 | WNT1 inducible signalling pathway protein 2 (WISP2) | NM_003881.1 | 1 |
| 5490 hfcr8567 | adenylyl cyclase | AF070583.1 | 1 |
| 5491 FCR1828 | adenylyl cyclase type V (=AB007882 hypothetical protein (KIAA0422)) | M96159 | 1 |
| 5492 FCR0837N | bone gamma-carboxyglutamate (gla) protein (osteocalcin) (BGLAP) | X51699 | 1 |
| 5493 SEOA7517a | motch B | X68279 | 1 |
| 5494 SEOB1175 | NAALADase II protein | AJ012370.1 | 1 |
| 5495 SEOA5992a | adenylate cyclase 7 (ADCY7) (=D25538 KIAA0037) | gi4557254 | 1 |
| 5496 hfcr6322 | adenylate cyclase activating polypeptide 1 (pituitary) receptor type I (ADCYAP1R1) | NM_001118.1 | 1 |
| 5497 MIOA2560a | ADP-ribosylation factor | L38490 | 1 |
| 5498 fCR0077 | ADP-ribosylation factor (hARF5) | M57567 | 1 |
| 5499 ncr4572 | ADP-ribosylation factor 3 (ARF3) | NM_001659.1 | 1 |
| 5500 hfcr9998 | ADP-ribosylation factor binding protein (GGA1) | AF190862.1 | 1 |
| 5501 mioa7773a | ADP-ribosylation factor GTPase activating protein 1, clone MGC:10272 IMAGE:3938853, mRNA, complete cds | BC005122.1 | 1 |
| 5502 ncr8041 | ADP-ribosylation factor-like 5 (ARL5), mRNA | NM_012097.1 | 1 |
| 5503 fcrb2534 | ADP-ribosylation factor-like 6 interacting protein (ARL6IP), mRNA | XM_027365.2 | 1 |
| 5504 SEOA3989a | alpha-catenin-like protein (CTNNAL1) | AF030233 | 1 |
| 5505 seoa8146 | ARP1 (actin-related protein 1, yeast) homolog A (centractin alpha) (ACTR1A), mRNA | XM_031949.1 | 1 |
| 5506 miob1007 | beta-arrestin 2(=ARRB2) | AF106941.1 | 1 |
| 5507 ncr2862 | Ca/calmodulin-dependent protein kinase II, delta subunit (Camk2d) | NM_012519.1 | 1 |

Figure 6A – EST Names Corresponding to Unique Known Genes of Figure 6

| | | | | |
|---|---|---|---|---|
| 5508 | seob3653 | Ca2 -transporting ATPase (EC 3.6.1.38), fast skeletal muscle sarcoplasmic reticulum - edible frog (ORF) | S24359 | 1 |
| 5509 | hfcr1055 | calcium/calmodulin-dependent protein kinase I (CAMK1) (ORF) | NM_003656.2 | 1 |
| 5510 | MIOA4782a | CALCIUM-BINDING PROTEIN E63-1=U25882(ORF) | P48593 | 1 |
| 5511 | seob5379 | calcium-independent alpha-latrotoxin receptor homolog 2 (CIRL-2) mRNA, complete cds | AF063102 | 1 |
| 5512 | ncr4416 | catenin (cadherin-associated protein), beta 1 (CTNNB1) | NM_001904.1 | 1 |
| 5513 | ncrb6530 | catenin(cadherin-associated protein), delta 1 (CTNND1)(= p120 catenin isoform 1ABC (CTNND1)) | NM_001331.1 | 1 |
| 5514 | FCR6524 | collapsin response mediator protein CRMP-1 (=D78012) | U17278 | 1 |
| 5515 | hfcr5220 | ECSIT (LOC51295) | NM_016581.1 | 1 |
| 5516 | hfcr4148 | Gi3 alpha protein | X54048.1 | 1 |
| 5517 | miob6910 | grancalcin (GCL) | NM_012198.1 | 1 |
| 5518 | MIOA4677 | guanyl cyclase C gene | U20230 | 1 |
| 5519 | FCR3323 | homer-2a | AF093263 | 1 |
| 5520 | hfcr1816 | indian hedgehog protein (IHH) | L38517.1 | 1 |
| 5521 | hfcr0478 | max gene | X66867.1 | 1 |
| 5522 | MIOA7069a | NAD ADP-ribosyltransferase 3 (ADPRT3) | AF085734.1 | 1 |
| 5523 | mioa9966 | nuclear receptor subfamily 2, group C, member 1 (NR2C1), = M29960.1 steroid receptor (TR2-11) | NM_003297.1 | 1 |
| 5524 | SEOA9165 | SAR1 (SAR1) | AF261717 | 1 |
| 5525 | BFCS0319 | soluble guanylate cyclase small subunit | X66533 | 1 |
| 5526 | miob5647 | terminal transferase | M11722.1 | 1 |
| 5527 | SEOA1902 | TIRC7 protein (TCIRG1) | AF033033.2 | 1 |
| 5528 | SEOA4598 | TNF receptor-1 associated protein (TRADD) | L41690 | 1 |
| 5529 | hfcr8608 | TNF receptor-associated factor 1 (TRAF1) | NM_005658.1 | 1 |
| 5530 | hfcr6998 | TNF-alpha stimulated ABC protein (ABC50) | AF027302.1 | 1 |
| 5531 | hfcr9565 | TNF-receptor associated factor-3 (TRAF-3) | AF110908.1 | 1 |
| 5532 | SEOB1801 | TOK-1beta | AB040451.1 | 1 |
| 5533 | MIOA8439 | vitamin D3 receptor interacting protein (DRIP80) | AF105421.1 | 1 |
| 5534 | hfcr0594 | inner membrane protein mitochondrial (mitofilin) (IMMT),=( p87/89 gene)=( motor protein ) | gi5803114 | 1 |
| 5535 | ncrb0462 | thiamine transporter 1 (THT1) | AF160812.1 | 1 |
| 5536 | miob3944 | ABC transporter (ATM1) | AF078777.1 | 1 |
| 5537 | FCR6944 | calcium activated neutral protease large subunit (muCANP, calpain, EC 3.4.22.17) | X04366 | 1 |
| 5538 | ncr6874 | calcium transport ATPase ATP2C1 (ATP2C1) | AF225981.1 | 1 |
| 5539 | MIOA6483a | calcium-activated potassium channel | U093833 | 1 |
| 5540 | MIOA0304 | channel-kinase 1 (CHAK1) | AF346629 | 1 |
| 5541 | FCR1225N | chloride channel 3 (CLCN3) | X78520 | 1 |
| 5542 | SEOA8839 | chloride channel protein 4 | AB019432.1 | 1 |
| 5543 | MIOA3492a | chloride channel regulatory protein | U17899 | 1 |
| 5544 | miob0420 | connexin 26 (GJB2) | M86849.2 | 1 |
| 5545 | hfcr6043 | Creatine transporter (SLC6A8) and (CDM) paralogous genes, (=accessory protein BAP31/BAP29 ) | gi1401058 | 1 |
| 5546 | SEOB1158 | dopamine responsive protein DRG-1 | AF271994.1 | 1 |
| 5547 | ncr5975 | familial intrahepatic cholestasis 1, (progressive, Byler disease and benign recurrent) (RefSeq aa 3e-91) | NP_005594.1 | 1 |

Figure 6A – EST Names Corresponding to Unique Known Genes of Figure 6

| | | | | |
|---|---|---|---|---|
| 5548 | FCR0300 | gamma-aminobutyraldehyde dehydrogenase (=U50203 aldehyde dehydrogenase E3') | U34252 | 1 |
| 5549 | miob3968 | gamma-aminobutyric acid (GABA) A receptor, alpha 4 (GABRA4) | NM_000809.1 | 1 |
| 5550 | hfcr3391 | gamma-aminobutyric acid (GABA) B receptor, 1 (GABBR1) | NM_001471.1 | 1 |
| 5551 | seoa8040 | glycoprotein (transmembrane) nmb (GPNMB), mRNA /cds=(91,1773) /gb=NM_002510 /gi=4505404 /ug=Hs.82226 /len=2669 | Hs.82226 | 1 |
| 5552 | fcrb1892 | hemoglobin, alpha 1 (HBA1) | NM_000558.3 | 1 |
| 5553 | fcrb2704 | hemoglobin, alpha 2 (HBA2), | NM_000517.3 | 1 |
| 5554 | ncrc6005 | large conductance calcium- and voltage-dependent potassium channel alpha subunit (MaxiK) mRNA, complete cds | U11058.2 | 1 |
| 5555 | FCR0553 | L-type calcium channel beta-1 subunit (CACNLB1) (=M92303 voltage-dependent calcium channel beta-1) | U39412 | 1 |
| 5556 | ncr3527 | Machado-Joseph disease (MJD) | NM_004993.1 | 1 |
| 5557 | ncr2083 | membrane-bound aminopeptidase P (XNPEP2) gene | AF195953.1 | 1 |
| 5558 | MIOA8939 | minK-related peptide 3 | AF076533.1 | 1 |
| 5559 | MIOA2167a | OCTN2 | AB016625.1 | 1 |
| 5560 | seob7123 | PALS1 | AF199008 | 1 |
| 5561 | seob7758 | potassium channel subunit (=AB037843 KIAA1422) | AF089730 | 1 |
| 5562 | ncr5485 | potassium large conductancecalcium-activated channel, subfamily M, alpha member 1 2e-54 | NP_002238.1 | 1 |
| 5563 | seob7444 | potassium voltage-gated channel, shaker-related subfamily, beta member 1,(KCNAB1) | NM_003471.1 | 1 |
| 5564 | fCR0087 | proton pump polypeptide | M58758 | 1 |
| 5565 | mioa9604 | SODIUM/HYDROGEN EXCHANGER 6 (NA( )/H( ) EXCHANGER 6) (NHE-6) (KIAA0267) | Q92581NAH6 | 1 |
| 5566 | FCR5879 | TRPC1 protein | X89066 | 1 |
| 5567 | miob2533 | VDAC1 gene porin isoform 1 | AJ250039.1 | 1 |
| 5568 | miob5012 | voltage-gated potassium channel KCNQ5 (KCNQ5) | AF263835.1 | 1 |
| 5569 | fcrb0332 | cell surface glycoprotein P1H12 precursor | AF089868.1 | 1 |
| 5570 | MIOA8973 | killer cell lectin-like receptor subfamily B, member 1 (KLRB1) (=hNKR-P1a protein (NKR-P1A)) | NM_002258.1 | 1 |
| 5571 | FCR7419 | METAXIN | spQ13505 | 1 |
| 5572 | FCR5378 | beta 2 | X02344 | 1 |
| 5573 | FCR2180N | beta4-integrin (ITGB4) (low match) | U66534 | 1 |
| 5574 | miob6442 | cadherin 5, VE-cadherin (vascular epithelium) (CDH5) | NM_001795.1 | 1 |
| 5575 | FCR0440 | cadherin-15 | D83542 | 1 |
| 5576 | MIOA7403a | cerebral cell adhesion molecule (=AB011156 KIAA0584) (75% aa) | AF177203.1 | 1 |
| 5577 | MIOA6484a | c-type lectin DCL1 (ORF) | AF121352 | 1 |
| 5578 | SEOA2442a | cysLT1 LTD4 receptor (CYSLT1) | AF119711.1 | 1 |
| 5579 | ncr7839 | desmoplakin (DPI, DPII) (RefSeq aa 1e-88) | NP_004406.1 | 1 |
| 5580 | hfcr2732 | flotillin 1 (FLOT1) | NM_005803.2 | 1 |
| 5581 | ncr7570 | focal adhesion kinase (FAK) | L13616.1 | 1 |
| 5582 | SEOB0650a | fucosyltransferase 8 (alpha (1,6)fucosyltransferase) | NP_004471.1 | 1 |
| 5583 | MIOA6717a | GPI transamidase | AF022913 | 1 |
| 5584 | FCR0224 | hGAA1 | AB006969 | 1 |
| 5585 | hfcr1284 | ICHIT protein (52/53) | AJ010903.1 | 1 |
| 5586 | hfcr2820 | insulin-like growth factor binding protein 4 (IGFBP4) | M62403.1 | 1 |

Figure 6A – EST Names Corresponding to Unique Known Genes of Figure 6

| | | | |
|---|---|---|---|
| 5587 MIOA3469a | integrin alpha 6 | X53586 | 1 |
| 5588 miob0681 | integrin associated protein | Z25524.1 | 1 |
| 5589 ncr0912 | integrin beta 3 binding protein (beta3-endonexin) (ITGB3BP), (=nuclear receptor co-activator NRIF3 (NRIF3)) | NM_014288.1 | 1 |
| 5590 SEOB1144 | INTEGRIN BETA-8 PRECURSOR | spP26012 | 1 |
| 5591 hfcr4488 | integrin, alpha 5 (fibronectin receptor, alpha polypeptide) (ITGA5) | NM_002205.1 | 1 |
| 5592 fcrb1697 | junctional adhesion molecule 3 (JAM3) | XM_053514.1 | 1 |
| 5593 ncrc6620 | N-cadherin mRNA, complete cds | M34064.1 | 1 |
| 5594 hfcr2275 | nel (chicken)-like 2 (NELL2) | NM_006159.1 | 1 |
| 5595 hfcr0412 | neural cell adhesion molecule | X07200.1 | 1 |
| 5596 FCR1421N | neural F box protein NFB42 | AF098301 | 1 |
| 5597 hfcr8252 | ninjurin 2 (NINJ2) | NM_016533.1 | 1 |
| 5598 ncrc1368 | novel protein AHNAK mRNA, partial sequence | M80899.1 | 1 |
| 5599 MIOA3588a | p55-related MAGUK protein DLG3 (dlg3) | AF124435.1 | 1 |
| 5600 seob6797 | PCDH-psi3 pseudogene | AF152529.1 | 1 |
| 5601 MIOB2687 | PNGase | AF250924.1 | 1 |
| 5602 hfcr4046 | polycystic kidney disease 1(autosomal dominant) (PKD1) | NM_000296.1 | 1 |
| 5603 hfcr7101 | Semaphorin A (V)(SEMA5) | NM_004636.1 | 1 |
| 5604 BFCW0401 | semaphorin V | U28369 | 1 |
| 5605 FCR6016 | syntaxin 5 | U26648 | 1 |
| 5606 SEOA4296a | syntaxin4-interacting protein synip (ORF) | AF152924 | 1 |
| 5607 BFCW0288 | SYT | X79201 | 1 |
| 5608 MIOA0218a | thrombomodulin, endothelial cell | M16552 | 1 |
| 5609 hfcr9352 | TRAF interacting protein (TRIP) | NM_005879.1 | 1 |
| 5610 seob8021 | TRAF5 | AB000509.1 | 1 |
| 5611 ncr2472 | TRAF-interacting protein I-TRAF | U59863.1 | 1 |
| 5612 ncr0240 | triple functional domain(PTPRF interacting) (TRIO)(ORF) | NM_007118.1 | 1 |
| 5613 FCR0503 | Tspan-3 | AF054840 | 1 |
| 5614 ncr7239 | Nop10p | NM_018648.1 | 1 |
| 5615 fcrb1917 | chromodomain helicase DNA binding protein 3 (CHD3) | NM_001272.1 | 1 |
| 5616 FCR3274 | chromosomal protein HMG1 related gene | D14718 | 1 |
| 5617 hfcr9975 | chromosome-specific mRNA | L23207.1 | 1 |
| 5618 miob6717 | cisplatin resistance associated (CRA) | NM_006697.1 | 1 |
| 5619 hfcr9188 | H1 histone (H1F0) | NM_005318.1 | 1 |
| 5620 ncr7312 | H2A histone family, member Y (H2AFY)(= histone macroH2A1.2) | NM_004893.1 | 1 |
| 5621 hfcr6965 | H2B histone family, member Q (H2BFQ) | NM_003528.1 | 1 |
| 5622 ncrb1923 | heterochromatin protein homologue (HP1) | L07515.1 | 1 |
| 5623 SEOA1419a | heterochromatin protein p25 | U35451 | 1 |
| 5624 MIOA7408a | high mobility group 1 protein | L13804 | 1 |
| 5625 seob5574 | high mobility group 1-like protein L6 (HMG1L6) retropseudogene sequence | AF076678.1 | 1 |
| 5626 FCR3032 | high mobility group box (SSRP1) | M86737 | 1 |
| 5627 FCR7542 | high mobility group HMGIC/NFIB fusion protein (HMGIC/NFIB) | AF022215 | 1 |
| 5628 miob5699 | high mobility group-box containing protein 1 (HBP1) | NM_012257.1 | 1 |
| 5629 MIOA6807a | highly charged protein (D13S106E) (=X59131) | gi5031648 | 1 |

Figure 6A – EST Names Corresponding to Unique Known Genes of Figure 6

| | | | | |
|---|---|---|---|---|
| 5630 | fcrb2013 | high-mobility group (nonhistone chromosomal) protein 1 (HMG1) | XM_028234.1 | 1 |
| 5631 | FCR6924 | high-mobility group phosphoprotein (HMGI-C) | L41044 | 1 |
| 5632 | hfcr0858 | high-mobility group phosphoprotein isoform I-C (HMGIC) gene | U28754.1 | 1 |
| 5633 | miob5646 | histone acetylase complex subunit (SPT3) | AF073930.1 | 1 |
| 5634 | FCR0833 | histone H2A.X. | X14850 | 1 |
| 5635 | SEOA9729 | hp1-gamma+D2192 Heterochromatin protein 1 gamma | AB030905 | 1 |
| 5636 | ncrc7189 | importin beta subunit | L38951.1 | 1 |
| 5637 | FCR0508 | Nap1 protein (=AB011159 hypothetical protein (KIAA0587)) | D84346 | 1 |
| 5638 | hfcr4446 | non-histone chromosomal protein (NHC) | U90549.1 | 1 |
| 5639 | FCR4471 | nonhistone protein HMG1 | M21683 | 1 |
| 5640 | FCR6412 | nucleosome assembly protein 2 | U77456 | 1 |
| 5641 | fcrb1095 | PDNA sequence AC clone 219d7, | AF225899 | 1 |
| 5642 | seoa7966 | pericentriolar material 1 (PCM1), mRNA /cds=(409,6483) /gb=NM_006197 /gi=5453855 /ug=Hs.75737 /len=6577 | Hs.75737 | 1 |
| 5643 | FCR5019 | RecQ4 DNA helicase | AB006532 | 1 |
| 5644 | seob4224 | RPA interacting protein alpha (44% ORF) | CAB45690.1 | 1 |
| 5645 | ncr7211 | RTS gene | AF305057.1 | 1 |
| 5646 | hfcr6199 | RuvB (E coli homolog)-like 2(RUVBL2) (=erythrocyte cytosolic protein ) | NM_006666.1 | 1 |
| 5647 | SEOB1744 | telomeric repeat binding factor 2 (TERF2) | NM_005652.1 | 1 |
| 5648 | fcrb1990 | TERF1 (TRF1)-interacting nuclear factor 2 (TINF2) | XM_033252.1 | 1 |
| 5649 | hfcr9787 | TRF2-interacting telomeric RAP1 protein (RAP1) mRNA, complete cds | AF262988.1 | 1 |
| 5650 | FCR3418 | 34 kDa Mov34 homolog | U70735 | 1 |
| 5651 | MIOB2564 | BTG family, member 3 (BTG3) | 5802989 | 1 |
| 5652 | ncrc1687 | cdk inhibitor p27KIP1 | AY004255.1 | 1 |
| 5653 | SEOB0084 | MD-2 protein (MD-2) | NM_015364.1 | 1 |
| 5654 | miob3371 | M-phase phosphoprotein 4 (MMP4) | NM_012218.1 | 1 |
| 5655 | SEOA2633 | OM-1 | X67534 | 1 |
| 5656 | FCR3201 | 200 kD protein | X80169 | 1 |
| 5657 | seob4467 | 5-azacytidine induced gene 2 (Azi2) | NM_013727.1 | 1 |
| 5658 | MIOA1097 | BM-006 | AF208848 | 1 |
| 5659 | ncr8413 | BM-008 | AF208850 | 1 |
| 5660 | ncrc4227 | BM-017 (=ALEX3) | AF208859.1 | 1 |
| 5661 | ncrc0139 | BM022 mRNA | AF212225.1 | 1 |
| 5662 | SEOB3556 | CDC23 (cell division cycle 23, yeast, homolog) (CDC23) | NM_004661.1 | 1 |
| 5663 | BFCS0266 | CDC37 homologue | U43077 | 1 |
| 5664 | SEOA8684 | Cdc7 (CDC7) | AF015592.1 | 1 |
| 5665 | FCR4582 | cdk-inhibitor p57/KIP2 (CDKN1C) (=U22398) | U48869 | 1 |
| 5666 | seob5395 | cell cycle gene RCC1 | X12654.1 | 1 |
| 5667 | SEOA3895 | clk1 | L29219 | 1 |
| 5668 | hfcr5147 | cycA gene for cyclin A | X68303.1 | 1 |
| 5669 | FCR6881 | cyclin B | M25753 | 1 |
| 5670 | miob2473 | cyclin C (CCNC) | NM_005190.2 | 1 |
| 5671 | MIOA4721 | cyclin G1 interacting protein | U61837 | 1 |
| 5672 | seob5942 | cyclin H (CCNH) mRNA | NM_001239.1 | 1 |

Figure 6A – EST Names Corresponding to Unique Known Genes of Figure 6

| | | | |
|---|---|---|---|
| 5673 ncr6343 | cyclin K (RefSeq aa 5e-62) | NP_003849.1 | 1 |
| 5674 ncr6745 | cyclin T1 (RefSeq aa 7e-75) | NP_001231.1 | 1 |
| 5675 hfcr0723 | cyclin T2 (CCNT2) | NM_001241.1 | 1 |
| 5676 hfcr8598 | Cyclin-dependent kinase (CDC2-like) 10 (CDK10)(non-exact match, possibly novel) | NM_003674.1 | 1 |
| 5677 SEOA2004 | CYCLIN-DEPENDENT KINASES REGULATORY SUBUNIT 1 (CKS-1) | spP33551 | 1 |
| 5678 SEOA7296a | D-type cyclin-interacting protein 1 (DIP1) | AF082569 | 1 |
| 5679 hfcr8765 | enhancer of zeste (Drosophila) homolog 2 (EZH2) | NM_004456.1 | 1 |
| 5680 hfcr2250 | Fanconi anemia, complementation group G (FANCG) | NM_004629.1 | 1 |
| 5681 ncrb3020 | GANP protein (=KIAA0572 protein ) | AJ010089.1 | 1 |
| 5682 SEOB1834 | geminin | AF067855.1 | 1 |
| 5683 SEOA8605 | GTP binding protein similar to S. cerevisiae HBS1 (HBS1) (=eRFS) (=KIAA1038) | NM_006620.1 | 1 |
| 5684 MIOA1674a | GTP-binding protein | Z49068 | 1 |
| 5685 FCR3772 | GTP-binding protein (RAB4) | M28211 | 1 |
| 5686 FCR6577 | GTP-binding protein (rhoB) | AF098515 | 1 |
| 5687 FCR0288 | GTP-binding protein (rhoC) (=X05026;L09159) | L25080 | 1 |
| 5688 miob3175 | GTP-binding protein alpha q subunit (GNAQ) mRNA, complete cds | U40038.1 | 1 |
| 5689 SEOA4246a | GTP-binding protein NGB | AF120334 | 1 |
| 5690 MIOA4792a | GTP-binding protein rah | AF058807 | 1 |
| 5691 ncr1510 | HARP (HARP) gene | AF210835.1 | 1 |
| 5692 FCR0604 | HsGAK | D88435 | 1 |
| 5693 hfcr8947 | lodestar protein | AF080255.1 | 1 |
| 5694 MIOA6811a | Mig-6=mitogen-inducible gene mig-6 product | gi1037127 | 1 |
| 5695 miob1811 | minichromosome maintenance deficient (mis5, S. pombe) 6 (MCM6) | NM_005915.2 | 1 |
| 5696 FCR4380 | Miz-1 protein | Y09723 | 1 |
| 5697 MIOA1025 | myleoid differentiation primary response protein MyD88 | U70451 | 1 |
| 5698 ncrb5735 | NIMA (never in mitosis gene a)-related kinase 6 (NEK6) | NM_014397.1 | 1 |
| 5699 SEOB1737 | nucleolar protein p40 | AAB46731.1 | 1 |
| 5700 seob6550 | nucleolin (NCL) (=FLJ20214 fis) | NM_005381.1 | 1 |
| 5701 MIOA2447a | p85Mcm (=D55716 P1cdc47; D28480 hMCM2) | X74796 | 1 |
| 5702 FCR3143 | PRAD1 cyclin | X59798 | 1 |
| 5703 hfcr3514 | Pseudoautosomal GTP-binding protein-like (PGPL)(ORF)= Y14391.2 | NM_012227.1 | 1 |
| 5704 FCR4444 | RhoE=26 kda GTPase homolog | S82240 | 1 |
| 5705 ncrc9774 | topoisomerase II alpha-4 (AF285159) | AAG13405.1 | 1 |
| 5706 SEOB0944 | Fas-associated factor, FAF1 (Faf1 gene) | AJ271408.1 | 1 |
| 5707 ncr4771 | neuronal thread protein AD7c-NTP | NP_055301.1 | 1 |
| 5708 MIOA7544a | neutral sphingomyelinase (N-SMase) activation associated factor (NSMAF) (=X96586 FAN protein) | gi4505464 | 1 |
| 5709 SEOA4601a | Newcastle disease virus inducible protein | U25276 | 1 |
| 5710 hfcr5860 | APG5 (autophagy 5, S.cerevisiae)-like (APG5L) =( apoptosis specific protein) | NM_004849.1 | 1 |
| 5711 miob0782 | apoptosis inhibitor 1 (API1) | NM_001166.1 | 1 |
| 5712 hfcr3633 | apoptosis inhibitor survivin gene, complete cds | U75285.1 | 1 |
| 5713 SEOB0514 | apoptosis related protein APR-3 | AF144055.2 | 1 |
| 5714 ncrb1084 | apoptosis-associated nuclear protein (PHLDA1) gene | AF239986.1 | 1 |

Figure 6A – EST Names Corresponding to Unique Known Genes of Figure 6

| | | | | |
|---|---|---|---|---|
| 5715 | ncr9826 | Baculoviral IAP repeat-containing 3 (BIRC3)(=inhibitor of apoptosis protein-1 (MIHC) | NM_001165.2 | 1 |
| 5716 | MIOA0466 | Bcl-2-binding protein (BAG-1) | AF022224 | 1 |
| 5717 | ncrb0273 | bridging integrator protein-1 (BIN1) gene | U84000.1 | 1 |
| 5718 | hfcr9438 | caspase 3, apoptosis-related cysteine protease (CASP3) | NM_004346.1 | 1 |
| 5719 | ncrb4538 | caspase 6, apoptosis-related cysteine protease | XP_003600.1 | 1 |
| 5720 | FCR4834 | cell death suppressor (WA1) (=AF049672) | AF000267 | 1 |
| 5721 | MIOA4542a | cell recognition molecule Caspr2 (=AB020675 KIAA0868) (60% aa) | AF193613 | 1 |
| 5722 | miob1318 | death-associated protein kinase 1 (DAPK1) | NM_004938.1 | 1 |
| 5723 | MIOA1955a | DRAK1 | AB011420 | 1 |
| 5724 | seoa7699a | dual specificity phosphatase 6, clone MGC:3789 IMAGE:2906126, mRNA, complete cds | BC003143.1 | 1 |
| 5725 | FCR5618 | DUSP6 (=X93920 protein-tyrosine-phosphatase) | AB013382.1 | 1 |
| 5726 | MIOA7247a | ES18 | AF083930 | 1 |
| 5727 | MIOA2152 | Fas-apoptosis inhibitory molecule (Faim) | AF130367.1 | 1 |
| 5728 | SEOB0418 | neuronal apoptosis inhibitory protein 6 (Naip6); Naip3 | AF242431.1 | 1 |
| 5729 | miob0399 | neuronal cell death-related protein (LOC51616), mRNA | NM_015975.1 | 1 |
| 5730 | fCR0925 | neurotrophin-3 (NT-3) | M37763 | 1 |
| 5731 | hfcr9643 | programmed cell death 5(PDCD5),(= TFAR1) Length = 559 | NM_004708.1 | 1 |
| 5732 | SEOA9724 | programmed cell death 9 (PDCD9) (ORF) | AF146192 | 1 |
| 5733 | SEOB1323 | RIP protein kinase | U50062.1 | 1 |
| 5734 | MIOA5889a | seCReted apoptosis related protein 1 (Sarp1) | AF017989 | 1 |
| 5735 | hfcr3647 | Siva-2 (ORF) | AF033111 | 1 |
| 5736 | ncr3568 | Kin17 protein | AJ005273.1 | 1 |
| 5737 | FCR3584 | MSSP | D82352 | 1 |
| 5738 | ncrc1175 | ATP-DEPENDENT DNA HELICASE II, 80 KDA SUBUNIT (LUPUS KU AUTOANTIGEN PROTEIN P86) (KU86)(KU80) (86 KDA SUBUNIT OF KU ANTIGEN) (THYROID-LUPUS AUTOANTIGEN) (TLAA) (CTC BOX BINDING FACTOR 85 KDA SUBUNIT) (CTCBF) (CTC85) (NUCLEAR FACTOR IV) (DNA-REPAIR PRO>) | spP13010 | 1 |
| 5739 | ncrc7105 | DNA fragmentation factor, 45 kD, alpha polypeptide (DFFA) | NM_004401.1 | 1 |
| 5740 | FCR4740 | DNA polymerase delta | M81735 | 1 |
| 5741 | FCR6714 | DNA replication licensing factor (huMCM2) (=D21063 KIAA0030) | D83987 | 1 |
| 5742 | SEOA8432 | DNA-DIRECTED RNA POLYMERASE II 19 KDA POLYPEPTIDE (RPB7) | spP52433 | 1 |
| 5743 | SEOB0031 | DNA-DIRECTED RNA POLYMERASES I, II, AND III 7.0 KD POLYPEPTIDE (ABC10-ALPHA) (RPB7.0) | spP53803 | 1 |
| 5744 | ncr1522 | gene encoding splicing factor SF1 | AJ000052.1 | 1 |
| 5745 | ncr3260 | line-1 reverse transcriptase | AAC51337.1 | 1 |
| 5746 | ncrc9328 | meiotic recombination (S. cerevisiae)11 homolog B (RefSeq aa 9e-69) | NP_005582.1 | 1 |
| 5747 | ncrc4663 | meiotic recombination protein REC14 | AAG31639.1 | 1 |
| 5748 | MIOA4037a | origin recognition complex protein 2 homologue (hORC2L) | U27459 | 1 |

Figure 6A – EST Names Corresponding to Unique Known Genes of Figure 6

| | | | |
|---|---|---|---|
| 5749 FCR3743 | origin recognition complex subunit 4 (ORC4L) (=AF022108) | AF047598 | 1 |
| 5750 MIOA1775 | origin recognition complex subunit LATHEO (LATHEO) | AF093535.1 | 1 |
| 5751 ncrc7016 | origin recognition complex, subunit 3(yeast homolog)-like (RefSeq aa 2e-84) | NP_036513.1 | 1 |
| 5752 seob7392 | polymerase (RNA) II (DNA directed) polypeptide A (220kD) (POLR2A) | NM_000937.1 | 1 |
| 5753 ncr3516 | polymerase (RNA) II (DNA directed) polypeptide C (33kD) (POLR2C) mRNA(=variant beta for RNA polymerase II subunit 3)(= polymerase subunit hRPB 33) | NM_002694.1 | 1 |
| 5754 hfcr7505 | polymerase (RNA) II (DNA directed) polypeptide E (25kD) (POLR2E) | NM_002695.1 | 1 |
| 5755 hfcr6600 | polymerase (RNA) II (DNA directed) polypeptide I (14.5kD) (POLR2I) | NM_006233.2 | 1 |
| 5756 hfcr7317 | polymerase (RNA) III (DNA directed) (39kD) (RPC39) | NM_006466.1 | 1 |
| 5757 FCR6314 | polymerase II subunit hsRPB4 | U89387 | 1 |
| 5758 hfcr9549 | primase, polypeptide 1(49kD) (PRIM1)(= (subunit p48)) | NM_000946.1 | 1 |
| 5759 FCR4803 | replication factor C, 40-kDa subunit (A1) (=AF045555) | M87338 | 1 |
| 5760 ncr9686 | reverse transcriptase (non-exact) | AAB02291.1 | 1 |
| 5761 FCR4494 | BAF60b | AF068245 | 1 |
| 5762 miob3234 | binding protein(SRM300)(= HSPC075)(= splicing coactivator subunit SRm300) Length = 7789 | NM_016333.1 | 1 |
| 5763 hfcr6384 | budding uninhibited by benzimidazoles 1 (yeast homolog), beta (BUB1B) | NM_001211.2 | 1 |
| 5764 SEOB1778 | anaphase-promoting complex subunit 7 (APC7) | AF191340.1 | 1 |
| 5765 miob0682 | BCL2-associated athanogene 2 (BAG2) | NM_004282.2 | 1 |
| 5766 ncr1791 | CDEI binding protein | Z22572.1 | 1 |
| 5767 SEOA3121a | cell division protein (=AJ005892 JM23 protein) | AF063015 | 1 |
| 5768 FCR0090n | cytosolic adenylate kinase (AK1) | J04809 | 1 |
| 5769 BFCW0134 | D9 splice variant A | U95006 | 1 |
| 5770 ncrb1247 | disabled (Drosophila) homolog 1 (DAB1) | NM_021080.1 | 1 |
| 5771 SEOB0975 | discs, large (Drosophila) homolog 1 (DLG1) | gi4758161 | 1 |
| 5772 hfcr3531 | D-prohibitin | AF178980 | 1 |
| 5773 FCR0490 | hERV1 | U31176 | 1 |
| 5774 mioa0506m | hevin like protein =high endothelial venule (ORF) | X82157 | 1 |
| 5775 MIOA3685a | Murr2 (=AB018272 KIAA0729) | D85434 | 1 |
| 5776 ncrb1861 | Notch2 | D32210.1 | 1 |
| 5777 ncr5168 | progestin induced protein (RefSeq aa 6e-32) | NP_056986.1 | 1 |
| 5778 miob3315 | prohibitin (PHB) | NM_002634.2 | 1 |
| 5779 seoa7752a | proliferating cell nuclear antigen (PCNA), mRNA /cds=(118,903) /gb=NM_002592 /gi=4505640 /ug=Hs.78996 /len=1231 | Hs.78996 | 1 |
| 5780 fcrb1590 | proliferation potential-related protein | AF352051.1 | 1 |
| 5781 SEOB0376 | proto-oncogene (Wnt-5a) | L20861.1 | 1 |
| 5782 miob5412 | RFG | X77548.1 | 1 |
| 5783 fcrb2381 | SEPTIN 6 type II (SEPTIN6) mRNA, complete cds | AF403059.1 | 1 |
| 5784 ncrb8747 | tumor endothelial marker 7 precursor (aa 3e-13) | NP_065138.1 | 1 |

Figure 6A – EST Names Corresponding to Unique Known Genes of Figure 6

| | | | |
|---|---|---|---|
| 5785 MIOA3725a | tumor neCRosis factor receptor 2 (TNFR2) | U52165 | 1 |
| 5786 hfcr8925 | tumor necrosis factor type 1 receptor associated protein (LOC51721), mRNA | NM_016292.1 | 1 |
| 5787 hfcr8824 | tumor necrosis factor type 2 receptor associated protein (TRAP3) mRNA, complete cds | U12597.1 | 1 |
| 5788 seob4030 | tumor necrosis factor(ligand) superfamily, member 12 (TNFSF12) (=AF055872.1 APO3L) | NM_003809.1 | 1 |
| 5789 ncrc1203 | tumor necrosis factor, alpha-induced protein 1 (endothelial) (TNFAIP1) | NM_021137.1 | 1 |
| 5790 seob1061 | tumor necrosis factor, alpha-induced protein 3 (TNFAIP3) (=DKFZp434B029) | NM_006290.1 | 1 |
| 5791 hfcr2941 | tumor protein D52-like 2 (TPD52L2) | NM_003288.1 | 1 |
| 5792 seob5465 | tumor protein p53-binding protein, 2 (TP53BP2) mRNA | NM_005426.1 | 1 |
| 5793 hfcr2808 | tumor suppressing subtransferable candidate 1 (TSSC1) | NM_003310.1 | 1 |
| 5794 ncrb5384 | tumor susceptibility gene 101 (RefSeq aa 2e-61) | NP_006283.1 | 1 |
| 5795 SEOA6395 | raf oncogene | X03484 | 1 |
| 5796 FCR4921 | mitochondrial precursor receptor (=D13641 Human KIAA0016) | D63411 | 1 |
| 5797 SEOB0999 | mannan-binding lectin-associated serine protease-2 | X98400.1 | 1 |
| 5798 SEOA7500a | T cell-activating protein (HRF20) | M27909 | 1 |
| 5799 SEOA2846 | ragB protein | X90530 | 1 |
| 5800 SEOA6443 | mitochondrial F1Fo-ATPase synthase f subunit | AF047436 | 1 |
| 5801 hfcr0099 | actinin, alpha 4 (H. sapiens) (LOC126227) | XM_059002.1 | 1 |
| 5802 fcrb2126 | SH3 domain binding glutamic acid-rich protein (SH3BGR) | XM_049754.1 | 1 |
| 5803 hfcr5948 | fetal liver cDNA library Homo sapiens cDNA | AI174701.1 | 1 |
| 5804 ncr7813 | FSHD region gene 1 (RefSeq aa 7e-36) | NP_004468.1 | 1 |
| 5805 seoa8040 | glycoprotein (transmembrane) nmb (GPNMB), mRNA /cds=(91,1773) /gb=NM_002510 /gi=4505404 /ug=Hs.82226 /len=2669 | Hs#S1731822 | 1 |
| 5806 hfcr3425 | apurinic/apyrimidinic endonuclease(APEX nuclease)-like 2 protein (APEXL2) | NM_014481.1 | 1 |
| 5807 SEOA8838 | glutamine-fructose-6-phosphate transaminase 1 (GFPT1) | NM_002056.1 | 1 |

Figure 6B – List of EST Sequence Names From Fetal Cartilage cDNA Library

| | | | | | | | | | |
|---|---|---|---|---|---|---|---|---|---|
| 1 | BFCN0001 | 61 | BFCN0118 | 121 | BFCN0229 | 181 | BFCS0074 | 241 | BFCS0302 |
| 2 | BFCN0002 | 62 | BFCN0119 | 122 | BFCN0232 | 182 | BFCS0077 | 242 | BFCS0303 |
| 3 | BFCN0003 | 63 | BFCN0120 | 123 | BFCN0233 | 183 | BFCS0079 | 243 | BFCS0309n |
| 4 | BFCN0005 | 64 | BFCN0124 | 124 | BFCN0235 | 184 | BFCS0081 | 244 | bfcs0311 |
| 5 | BFCN0006 | 65 | bfcn0127n | 125 | BFCN0236 | 185 | BFCS0082 | 245 | BFCS0312n |
| 6 | BFCN0007 | 66 | bfcn0128 | 126 | bfcn0238n | 186 | BFCS0083 | 246 | BFCS0313 |
| 7 | BFCN0008 | 67 | bfcn0130 | 127 | BFCN0239 | 187 | BFCS0088n | 247 | BFCS0314 |
| 8 | BFCN0009 | 68 | BFCN0133 | 128 | BFCN0245 | 188 | BFCS0089 | 248 | BFCS0315n |
| 9 | BFCN0010 | 69 | bfcn0134n | 129 | BFCN0246 | 189 | BFCS0092 | 249 | BFCS0316 |
| 10 | BFCN0012 | 70 | BFCN0135 | 130 | BFCN0247 | 190 | BFCS0093 | 250 | BFCS0317 |
| 11 | BFCN0013 | 71 | BFCN0136 | 131 | bfcn0248n | 191 | BFCS0094 | 251 | BFCS0319 |
| 12 | BFCN0018 | 72 | BFCN0138 | 132 | BFCN0249 | 192 | BFCS0195n | 252 | BFCS0320 |
| 13 | BFCN0019 | 73 | BFCN0139 | 133 | BFCN0250 | 193 | BFCS0196 | 253 | BFCS0321 |
| 14 | BFCN0021 | 74 | bfcn0140n | 134 | BFCN0251 | 194 | BFCS0198 | 254 | BFCS0322 |
| 15 | BFCN0024 | 75 | BFCN0142 | 135 | BFCN0252 | 195 | BFCS0199 | 255 | BFCS0324 |
| 16 | BFCN0027 | 76 | BFCN0156 | 136 | BFCN0253 | 196 | BFCS0202 | 256 | BFCS0326 |
| 17 | BFCN0029 | 77 | BFCN0164 | 137 | BFCN0254 | 197 | BFCS0203 | 257 | BFCS0330 |
| 18 | BFCN0031 | 78 | BFCN0168n | 138 | BFCN0255 | 198 | BFCS0205 | 258 | BFCS0331 |
| 19 | BFCN0034 | 79 | BFCN0171 | 139 | BFCN0256 | 199 | BFCS0206n | 259 | BFCS0332 |
| 20 | BFCN0038 | 80 | BFCN0172 | 140 | BFCN0259 | 200 | BFCS0207n | 260 | BFCS0335 |
| 21 | BFCN0039 | 81 | BFCN0173 | 141 | BFCN0261 | 201 | BFCS0208n | 261 | BFCS0336 |
| 22 | BFCN0040 | 82 | BFCN0177 | 142 | BFCN0265 | 202 | BFCS0212 | 262 | BFCS0337 |
| 23 | BFCN0042 | 83 | BFCN0178 | 143 | BFCN0266 | 203 | BFCS0214 | 263 | BFCS0338 |
| 24 | BFCN0045 | 84 | BFCN0179 | 144 | BFCN0267 | 204 | BFCS0216 | 264 | BFCS0342 |
| 25 | BFCN0047 | 85 | BFCN0180 | 145 | BFCN0268 | 205 | BFCS0219 | 265 | BFCS0343 |
| 26 | BFCN0048 | 86 | BFCN0181 | 146 | BFCN0270 | 206 | BFCS0220 | 266 | BFCS0345 |
| 27 | bfcn0049 | 87 | bfcn0182n | 147 | bfcn0271 | 207 | BFCS0223 | 267 | BFCS0346n |
| 28 | BFCN0050 | 88 | BFCN0185n | 148 | BFCN0272 | 208 | BFCS0228 | 268 | BFCS0347n |
| 29 | BFCN0051 | 89 | BFCN0186 | 149 | BFCN0273 | 209 | BFCS0229 | 269 | BFCS0368 |
| 30 | BFCN0053 | 90 | bfcn0190n | 150 | bfcn0274 | 210 | BFCS0231 | 270 | BFCS0369 |
| 31 | BFCN0055 | 91 | BFCN0192 | 151 | bfcn0485 | 211 | BFCS0232 | 271 | BFCS0371 |
| 32 | bfcn0056nn | 92 | BFCN0194 | 152 | BFCS0001 | 212 | BFCS0233 | 272 | BFCS0377 |
| 33 | BFCN0059 | 93 | BFCN0195 | 153 | BFCS0003 | 213 | BFCS0238 | 273 | BFCS0379 |
| 34 | BFCN0060 | 94 | BFCN0196 | 154 | BFCS0005 | 214 | BFCS0239n | 274 | BFCS0384 |
| 35 | BFCN0062 | 95 | BFCN0197 | 155 | BFCS0006 | 215 | BFCS0241 | 275 | BFCS0389 |
| 36 | BFCN0065 | 96 | bfcn0198nn | 156 | BFCS0007 | 216 | BFCS0244 | 276 | BFCS0390 |
| 37 | BFCN0067 | 97 | BFCN0199 | 157 | BFCS0008 | 217 | BFCS0246 | 277 | BFCS0391 |
| 38 | BFCN0072 | 98 | BFCN0202n | 158 | BFCS0009 | 218 | BFCS0257 | 278 | bfcs0392 |
| 39 | bfcn0073n | 99 | BFCN0203 | 159 | BFCS0014 | 219 | BFCS0259 | 279 | BFCS0393 |
| 40 | BFCN0075 | 100 | BFCN0204 | 160 | BFCS0021 | 220 | BFCS0260 | 280 | BFCS0396 |
| 41 | BFCN0079 | 101 | BFCN0205 | 161 | BFCS0022 | 221 | BFCS0261 | 281 | BFCS0398 |
| 42 | BFCN0081 | 102 | BFCN0206n | 162 | BFCS0024 | 222 | BFCS0264 | 282 | BFCS0399 |
| 43 | BFCN0082 | 103 | BFCN0207 | 163 | BFCS0027 | 223 | BFCS0265 | 283 | BFCS0404 |
| 44 | bfcn0083n | 104 | BFCN0208 | 164 | BFCS0034 | 224 | BFCS0266 | 284 | BFCS0407 |
| 45 | BFCN0085 | 105 | BFCN0209 | 165 | BFCS0035 | 225 | BFCS0269n | 285 | BFCS0408 |
| 46 | BFCN0090 | 106 | BFCN0210 | 166 | BFCS0037n | 226 | BFCS0270 | 286 | BFCS0417 |
| 47 | bfcn0092 | 107 | BFCN0211 | 167 | BFCS0038 | 227 | BFCS0276 | 287 | BFCS0420 |
| 48 | BFCN0093 | 108 | BFCN0213 | 168 | bfcs0039nn | 228 | BFCS0277 | 288 | BFCS0421n |
| 49 | BFCN0094 | 109 | BFCN0214 | 169 | BFCS0041 | 229 | BFCS0280 | 289 | BFCS0457 |
| 50 | BFCN0096 | 110 | bfcn0215nn | 170 | BFCS0042 | 230 | BFCS0281 | 290 | BFCS0462 |
| 51 | BFCN0097 | 111 | BFCN0216 | 171 | BFCS0043 | 231 | BFCS0283 | 291 | BFCS0463 |
| 52 | bfcn0098 | 112 | bfcn0217n | 172 | BFCS0045 | 232 | BFCS0284 | 292 | BFCS0468n |
| 53 | BFCN0105 | 113 | BFCN0219 | 173 | BFCS0047n | 233 | BFCS0285 | 293 | BFCS0469n |
| 54 | BFCN0109 | 114 | BFCN0220 | 174 | BFCS0048n | 234 | BFCS0286 | 294 | BFCS0478 |
| 55 | BFCN0112 | 115 | BFCN0222 | 175 | bfcs0049 | 235 | BFCS0289 | 295 | BFCS0479 |
| 56 | BFCN0113 | 116 | bfcn0224n | 176 | BFCS0050 | 236 | BFCS0292 | 296 | BFCS0481 |
| 57 | BFCN0114 | 117 | BFCN0225 | 177 | BFCS0054 | 237 | BFCS0296 | 297 | BFCS0483 |
| 58 | BFCN0115 | 118 | BFCN0226 | 178 | BFCS0055 | 238 | BFCS0297 | 298 | BFCS0484 |
| 59 | BFCN0116 | 119 | BFCN0227 | 179 | bfcs0057n | 239 | BFCS0299 | 299 | BFCS0485 |
| 60 | bfcn0117n | 120 | BFCN0228 | 180 | BFCS0058 | 240 | BFCS0300 | 300 | BFCS0487 |

Figure 6B - List of EST Sequence Names From Fetal Cartilage cDNA Library

| | | | | | | | | | |
|---|---|---|---|---|---|---|---|---|---|
| 301 | BFCS0489 | 361 | BFCW0064n | 421 | BFCW0192 | 481 | BFCW0304 | 541 | BFCW0408 |
| 302 | BFCS0491 | 362 | BFCW0065 | 422 | BFCW0194 | 482 | BFCW0307 | 542 | BFCW0409 |
| 303 | BFCS0492 | 363 | BFCW0067 | 423 | BFCW0197 | 483 | BFCW0310 | 543 | BFCW0412 |
| 304 | BFCS0493 | 364 | BFCW0069n | 424 | BFCW0198 | 484 | BFCW0311 | 544 | BFCW0413n |
| 305 | BFCS0494 | 365 | BFCW0071 | 425 | BFCW0200 | 485 | bfcw0312n | 545 | BFCW0414 |
| 306 | BFCS0495 | 366 | BFCW0072 | 426 | BFCW0202n | 486 | BFCW0313 | 546 | BFCW0415 |
| 307 | BFCS0496 | 367 | BFCW0073 | 427 | BFCW0206n | 487 | bfcw0314n | 547 | BFCW0416 |
| 308 | BFCS0498 | 368 | BFCW0074 | 428 | BFCW0207n | 488 | BFCW0316 | 548 | bfcw0420 |
| 309 | BFCS0500 | 369 | BFCW0076 | 429 | BFCW0209n | 489 | BFCW0317 | 549 | BFCW0421 |
| 310 | BFCS0501 | 370 | BFCW0078 | 430 | BFCW0210 | 490 | BFCW0318 | 550 | BFCW0422 |
| 311 | BFCS0502 | 371 | BFCW0079 | 431 | BFCW0212 | 491 | BFCW0319 | 551 | BFCW0423 |
| 312 | BFCS0503 | 372 | BFCW0081 | 432 | BFCW0215 | 492 | BFCW0320 | 552 | BFCW0424 |
| 313 | BFCS0504 | 373 | BFCW0083 | 433 | BFCW0216 | 493 | BFCW0323 | 553 | BFCW0425 |
| 314 | BFCS0508 | 374 | BFCW0085 | 434 | BFCW0217n | 494 | BFCW0325 | 554 | BFCW0426 |
| 315 | BFCS0509 | 375 | BFCW0088 | 435 | BFCW0218 | 495 | BFCW0326 | 555 | BFCW0429 |
| 316 | BFCS0513 | 376 | BFCW0090 | 436 | BFCW0219n | 496 | BFCW0327 | 556 | BFCW0430n |
| 317 | BFCS0516 | 377 | BFCW0092 | 437 | BFCW0220 | 497 | BFCW0329 | 557 | BFCW0431 |
| 318 | BFCS0518n | 378 | BFCW0093 | 438 | BFCW0223 | 498 | BFCW0330n | 558 | BFCW0432 |
| 319 | BFCS0519 | 379 | BFCW0094 | 439 | BFCW0224 | 499 | BFCW0331 | 559 | BFCW0433 |
| 320 | BFCS0520n | 380 | BFCW0100n | 440 | bfcw0225n | 500 | BFCW0332 | 560 | bfcw0435n |
| 321 | BFCS0522 | 381 | BFCW0102n | 441 | BFCW0226 | 501 | BFCW0333 | 561 | BFCW0436 |
| 322 | BFCS0523 | 382 | BFCW0103 | 442 | BFCW0228n | 502 | BFCW0334n | 562 | BFCW0438 |
| 323 | BFCS0524 | 383 | BFCW0108 | 443 | BFCW0230 | 503 | BFCW0335n | 563 | BFCW0440 |
| 324 | BFCS0526 | 384 | bfcw0109nn | 444 | BFCW0231 | 504 | bfcw0336n | 564 | BFCW0445 |
| 325 | BFCS0527 | 385 | BFCW0111 | 445 | BFCW0235 | 505 | BFCW0337 | 565 | BFCW0457 |
| 326 | BFCS0531 | 386 | BFCW0112 | 446 | BFCW0236 | 506 | BFCW0339 | 566 | BFCW0458n |
| 327 | BFCS0532 | 387 | BFCW0114 | 447 | BFCW0238 | 507 | bfcw0340n | 567 | BFCW0459 |
| 328 | BFCS0533 | 388 | BFCW0115 | 448 | BFCW0239 | 508 | BFCW0341 | 568 | BFCW0460 |
| 329 | BFCS0535 | 389 | BFCW0118 | 449 | BFCW0240 | 509 | BFCW0345n | 569 | BFCW0461 |
| 330 | BFCS0538 | 390 | BFCW0132 | 450 | BFCW0241 | 510 | bfcw0348n | 570 | BFCW0462 |
| 331 | BFCS0539 | 391 | BFCW0133 | 451 | BFCW0244 | 511 | BFCW0352 | 571 | BFCW0464n |
| 332 | BFCS0541 | 392 | BFCW0134 | 452 | BFCW0245 | 512 | BFCW0369 | 572 | BFCW0467 |
| 333 | BFCS0544 | 393 | BFCW0137 | 453 | BFCW0246 | 513 | BFCW0370 | 573 | BFCW0469n |
| 334 | BFCS0545n | 394 | BFCW0139n | 454 | BFCW0248n | 514 | BFCW0371 | 574 | BFCW0472 |
| 335 | BFCS0547 | 395 | BFCW0140 | 455 | BFCW0250 | 515 | BFCW0372 | 575 | BFCW0476 |
| 336 | BFCS0548 | 396 | BFCW0144 | 456 | BFCW0251 | 516 | BFCW0373 | 576 | BFCW0478n |
| 337 | BFCS0549 | 397 | BFCW0145 | 457 | BFCW0252 | 517 | BFCW0375 | 577 | bfcw0479nn |
| 338 | BFCS0552 | 398 | BFCW0146 | 458 | BFCW0253n | 518 | BFCW0378 | 578 | BFCW0480 |
| 339 | BFCS0553n | 399 | BFCW0147 | 459 | BFCW0254n | 519 | BFCW0379n | 579 | BFCW0481 |
| 340 | BFCS0557 | 400 | BFCW0148 | 460 | BFCW0255 | 520 | BFCW0380 | 580 | bfcw0482nn |
| 341 | BFCS0559 | 401 | BFCW0150 | 461 | BFCW0256 | 521 | BFCW0382 | 581 | BFCW0483 |
| 342 | BFCS0560 | 402 | BFCW0151 | 462 | BFCW0258 | 522 | BFCW0384 | 582 | bfcw0487n |
| 343 | BFCS0563 | 403 | BFCW0154 | 463 | BFCW0261 | 523 | BFCW0386 | 583 | bfcw0488n |
| 344 | BFCW0008 | 404 | BFCW0159 | 464 | BFCW0266 | 524 | BFCW0388n | 584 | BFCW0489 |
| 345 | BFCW0009 | 405 | BFCW0160 | 465 | BFCW0268 | 525 | BFCW0389 | 585 | BFCW0490 |
| 346 | BFCW0010 | 406 | BFCW0162 | 466 | BFCW0275 | 526 | BFCW0390 | 586 | BFCW0492 |
| 347 | BFCW0014 | 407 | BFCW0166 | 467 | BFCW0276 | 527 | BFCW0391 | 587 | BFCW0493 |
| 348 | BFCW0019n | 408 | BFCW0169 | 468 | BFCW0277 | 528 | BFCW0393 | 588 | BFCW0500 |
| 349 | BFCW0020 | 409 | BFCW0170 | 469 | BFCW0280 | 529 | BFCW0394 | 589 | BFCW0506 |
| 350 | BFCW0023 | 410 | BFCW0172 | 470 | bfcw0281n | 530 | BFCW0395 | 590 | BFCW0510 |
| 351 | BFCW0024 | 411 | BFCW0176 | 471 | bfcw0282n | 531 | BFCW0396 | 591 | BFCW0511 |
| 352 | BFCW0026n | 412 | BFCW0177 | 472 | bfcw0286n | 532 | BFCW0397 | 592 | BFCW0513 |
| 353 | BFCW0035 | 413 | BFCW0179 | 473 | BFCW0287 | 533 | BFCW0398 | 593 | BFCW0515 |
| 354 | BFCW0036n | 414 | BFCW0180 | 474 | BFCW0288 | 534 | BFCW0400 | 594 | bfcw0516 |
| 355 | BFCW0038 | 415 | BFCW0183n | 475 | BFCW0289 | 535 | BFCW0401 | 595 | BFCW0517 |
| 356 | BFCW0054 | 416 | BFCW0184 | 476 | BFCW0291 | 536 | bfcw0402n | 596 | BFCW0518 |
| 357 | BFCW0055 | 417 | BFCW0186 | 477 | BFCW0292n | 537 | BFCW0403 | 597 | bfcw0519n |
| 358 | BFCW0056n | 418 | BFCW0188 | 478 | BFCW0293 | 538 | BFCW0404 | 598 | BFCW0520 |
| 359 | BFCW0060n | 419 | BFCW0189 | 479 | BFCW0294 | 539 | BFCW0406 | 599 | BFCW0521 |
| 360 | BFCW0062 | 420 | BFCW0191n | 480 | BFCW0296 | 540 | bfcw0407nn | 600 | BFCW0523 |

Figure 6B – List of EST Sequence Names From Fetal Cartilage cDNA Library

| | | | | | | | | | |
|---|---|---|---|---|---|---|---|---|---|
| 601 | BFCW0524 | 661 | CR0022 | 721 | CR0128 | 781 | CR0283 | 841 | CR0483 |
| 602 | BFCW0525 | 662 | CR0023 | 722 | cr0131n | 782 | CR0285 | 842 | CR0484 |
| 603 | BFCW0526 | 663 | CR0024 | 723 | CR0133 | 783 | CR0286 | 843 | CR0485 |
| 604 | BFCW0527 | 664 | CR0025 | 724 | CR0135 | 784 | CR0289 | 844 | CR0486 |
| 605 | BFCW0529 | 665 | cr0026 | 725 | CR0136 | 785 | CR0290 | 845 | CR0487 |
| 606 | BFCW0530 | 666 | cr0027 | 726 | CR0138 | 786 | CR0291 | 846 | CR0488 |
| 607 | BFCW0531 | 667 | CR0028 | 727 | CR0140 | 787 | CR0292 | 847 | CR0489 |
| 608 | BFCW0532 | 668 | CR0029 | 728 | CR0143 | 788 | CR0296 | 848 | CR0490 |
| 609 | BFCW0534 | 669 | CR0030 | 729 | CR0144 | 789 | CR0297 | 849 | CR0491 |
| 610 | BFCW0535 | 670 | CR0033 | 730 | CR0145 | 790 | CR0300 | 850 | CR0494 |
| 611 | BFCW0537 | 671 | CR0038 | 731 | CR0146 | 791 | CR0302 | 851 | CR0495 |
| 612 | bfcw0539 | 672 | CR0039 | 732 | CR0163 | 792 | CR0303 | 852 | CR0496 |
| 613 | bfcw0540n | 673 | CR0040 | 733 | CR0167 | 793 | cr0304 | 853 | cr0499 |
| 614 | BFCW0541 | 674 | CR0042 | 734 | CR0178 | 794 | CR0305 | 854 | CR0500 |
| 615 | BFCW0542n | 675 | CR0043 | 735 | CR0179 | 795 | CR0307 | 855 | CR0501 |
| 616 | BFCW0543 | 676 | CR0044 | 736 | CR0180 | 796 | CR0310 | 856 | cr0503N |
| 617 | BFCW0546 | 677 | cr0045 | 737 | CR0183 | 797 | CR0311 | 857 | CR0504 |
| 618 | BFCW0551n | 678 | CR0046 | 738 | CR0184 | 798 | CR0312 | 858 | CR0505 |
| 619 | BFCW0553 | 679 | CR0050 | 739 | CR0193 | 799 | CR0323 | 859 | cr0506 |
| 620 | BFCW0554 | 680 | CR0052 | 740 | CR0196 | 800 | CR0334 | 860 | CR0508 |
| 621 | BFCW0555 | 681 | CR0054 | 741 | CR0203 | 801 | cr0337N | 861 | CR0515 |
| 622 | BFCW0558 | 682 | CR0055 | 742 | cr0204 | 802 | cr0346N | 862 | CR0516 |
| 623 | BFCW0567n | 683 | cr0056N | 743 | CR0205 | 803 | CR0348 | 863 | cr0517 |
| 624 | BFCW0568n | 684 | CR0057 | 744 | CR0206 | 804 | CR0351 | 864 | CR0518 |
| 625 | BFCW0569n | 685 | CR0060 | 745 | CR0208 | 805 | CR0354 | 865 | CR0524 |
| 626 | BFCW0570 | 686 | CR0063 | 746 | CR0209 | 806 | CR0357 | 866 | CR0525 |
| 627 | BFCW0572n | 687 | CR0064 | 747 | CR0215 | 807 | CR0358 | 867 | CR0526 |
| 628 | BFCW0573 | 688 | CR0065 | 748 | CR0217 | 808 | CR0359 | 868 | CR0530 |
| 629 | BFCW0574 | 689 | CR0066 | 749 | CR0219 | 809 | cr0360N | 869 | CR0532 |
| 630 | bfcw0576n | 690 | CR0067 | 750 | cr0222N | 810 | CR0365 | 870 | CR0533 |
| 631 | bfcw0579 | 691 | CR0068 | 751 | CR0223 | 811 | cr0366 | 871 | CR0534 |
| 632 | BFCW0583 | 692 | CR0069 | 752 | CR0228 | 812 | CR0370 | 872 | CR0535 |
| 633 | BFCW0586 | 693 | CR0070 | 753 | CR0230 | 813 | CR0373 | 873 | CR0538 |
| 634 | BFCW0587 | 694 | cr0071n | 754 | CR0231 | 814 | CR0389 | 874 | cr0540N |
| 635 | BFCW0588 | 695 | CR0072 | 755 | CR0232 | 815 | CR0394 | 875 | CR0541 |
| 636 | BFCW0589 | 696 | CR0074 | 756 | CR0233 | 816 | CR0396 | 876 | cr0542 |
| 637 | BFCW0594 | 697 | CR0076 | 757 | CR0234 | 817 | CR0397 | 877 | CR0544 |
| 638 | BFCW0596n | 698 | CR0077 | 758 | CR0235 | 818 | CR0408 | 878 | CR0545 |
| 639 | BFCW0598 | 699 | cr0078 | 759 | CR0236 | 819 | CR0412 | 879 | CR0547 |
| 640 | BFCW0599 | 700 | CR0079 | 760 | CR0237 | 820 | CR0414 | 880 | CR0548 |
| 641 | bfcw0601n | 701 | CR0082 | 761 | CR0239 | 821 | CR0423 | 881 | CR0550 |
| 642 | BFCW0604 | 702 | CR0087 | 762 | CR0240 | 822 | CR0427 | 882 | CR0553 |
| 643 | BFCW0605 | 703 | CR0088 | 763 | cr0247n | 823 | CR0429 | 883 | CR0554 |
| 644 | BFCW0607 | 704 | CR0089 | 764 | CR0250 | 824 | CR0430 | 884 | CR0555 |
| 645 | BFCW0608 | 705 | CR0090 | 765 | CR0251 | 825 | CR0442 | 885 | CR0556 |
| 646 | BFCW0609 | 706 | CR0093 | 766 | CR0253 | 826 | CR0444 | 886 | CR0557 |
| 647 | BFCW0610 | 707 | CR0107 | 767 | CR0255 | 827 | CR0445 | 887 | CR0558 |
| 648 | CR0001 | 708 | CR0108 | 768 | CR0256 | 828 | CR0452 | 888 | CR0562 |
| 649 | CR0002 | 709 | CR0109 | 769 | CR0270 | 829 | CR0453 | 889 | cr0563n |
| 650 | CR0006 | 710 | CR0111 | 770 | CR0271 | 830 | CR0454 | 890 | CR0565 |
| 651 | CR0007 | 711 | CR0112 | 771 | CR0272 | 831 | CR0465 | 891 | CR0567 |
| 652 | CR0008 | 712 | CR0113 | 772 | CR0273 | 832 | CR0468 | 892 | CR0573 |
| 653 | CR0009 | 713 | CR0115 | 773 | CR0274 | 833 | CR0469 | 893 | CR0577 |
| 654 | CR0010 | 714 | CR0117 | 774 | CR0275 | 834 | CR0471 | 894 | CR0583 |
| 655 | CR0011 | 715 | CR0118 | 775 | CR0276 | 835 | CR0474 | 895 | CR0584 |
| 656 | CR0015 | 716 | CR0119 | 776 | CR0277 | 836 | CR0476 | 896 | CR0585 |
| 657 | CR0016 | 717 | CR0120 | 777 | CR0278 | 837 | CR0477 | 897 | CR0587 |
| 658 | cr0018n | 718 | CR0121 | 778 | CR0279 | 838 | CR0480 | 898 | CR0590 |
| 659 | cr0019 | 719 | CR0124 | 779 | CR0280 | 839 | CR0481 | 899 | CR0591 |
| 660 | CR0020 | 720 | CR0125 | 780 | CR0281 | 840 | CR0482 | 900 | CR0596 |

Figure 6B – List of EST Sequence Names From Fetal Cartilage cDNA Library

| | | | | | | | | | |
|---|---|---|---|---|---|---|---|---|---|
| 901 | CR0599 | 961 | cr0807n | 1021 | CR0922 | 1081 | FCR0023 | 1141 | FCR0136 |
| 902 | CR0609 | 962 | CR0808 | 1022 | CR0923 | 1082 | FCR0027 | 1142 | FCR0138 |
| 903 | CR0613 | 963 | CR0809 | 1023 | CR0925 | 1083 | FCR0030 | 1143 | FCR0139 |
| 904 | CR0614 | 964 | CR0811 | 1024 | CR0928 | 1084 | FCR0032 | 1144 | FCR0140 |
| 905 | CR0617 | 965 | CR0814 | 1025 | CR0929 | 1085 | FCR0033 | 1145 | FCR0141 |
| 906 | CR0618 | 966 | CR0816 | 1026 | CR0930 | 1086 | FCR0034 | 1146 | FCR0142 |
| 907 | CR0620 | 967 | CR0817 | 1027 | CR0935 | 1087 | FCR0035 | 1147 | FCR0143 |
| 908 | CR0623 | 968 | CR0818 | 1028 | CR0936 | 1088 | FCR0036n | 1148 | fcr0144nn |
| 909 | CR0625 | 969 | CR0819 | 1029 | cr0937 | 1089 | fcr0038n | 1149 | fcr0145nn |
| 910 | CR0627 | 970 | cr08221 | 1030 | CR0938 | 1090 | fcr0039n | 1150 | FCR0146 |
| 911 | CR0632 | 971 | CR0823 | 1031 | CR0939 | 1091 | FCR0040 | 1151 | FCR0148 |
| 912 | CR0634 | 972 | cr0824 | 1032 | CR0940 | 1092 | FCR0043n | 1152 | FCR0149 |
| 913 | cr0635N | 973 | CR0830 | 1033 | CR0941 | 1093 | FCR0045 | 1153 | FCR0150 |
| 914 | CR0637 | 974 | CR0831 | 1034 | cr0942n | 1094 | FCR0050n | 1154 | FCR0151 |
| 915 | CR0641 | 975 | CR0832 | 1035 | CR0944 | 1095 | FCR0052 | 1155 | fcr0152nn |
| 916 | CR0644 | 976 | CR0834 | 1036 | CR0946 | 1096 | FCR0055 | 1156 | FCR0153 |
| 917 | CR0650 | 977 | CR0835 | 1037 | CR0953 | 1097 | FCR0056n | 1157 | FCR0154 |
| 918 | CR0657 | 978 | CR0837 | 1038 | CR0954 | 1098 | FCR0059n | 1158 | FCR0155 |
| 919 | CR0659 | 979 | CR0838 | 1039 | CR0955 | 1099 | FCR0060 | 1159 | FCR0158 |
| 920 | CR0679 | 980 | CR0839 | 1040 | CR0956 | 1100 | FCR0061n | 1160 | FCR0159 |
| 921 | CR0682 | 981 | CR0840 | 1041 | CR0958 | 1101 | fcr0062nn | 1161 | FCR0160 |
| 922 | CR0685 | 982 | CR0841 | 1042 | CR0959 | 1102 | fcr0063n | 1162 | FCR0161 |
| 923 | CR0699 | 983 | CR0843 | 1043 | CR0969 | 1103 | FCR0064 | 1163 | FCR0162 |
| 924 | CR0702 | 984 | CR0847 | 1044 | CR0971 | 1104 | FCR0065 | 1164 | FCR0163 |
| 925 | CR0703 | 985 | cr0849N | 1045 | CR0972 | 1105 | FCR0066 | 1165 | FCR0164 |
| 926 | CR0705 | 986 | CR0857 | 1046 | CR0973 | 1106 | FCR0067n | 1166 | FCR0166 |
| 927 | CR0707 | 987 | cr0858N | 1047 | CR0974 | 1107 | FCR0068 | 1167 | FCR0167 |
| 928 | CR0708 | 988 | CR0859 | 1048 | CR0976 | 1108 | FCR0069n | 1168 | FCR0168 |
| 929 | CR0714 | 989 | CR0861 | 1049 | CR0978 | 1109 | FCR0072 | 1169 | FCR0169 |
| 930 | CR0715 | 990 | CR0866 | 1050 | CR0979 | 1110 | FCR0073 | 1170 | FCR0170 |
| 931 | CR0716 | 991 | CR0870 | 1051 | CR0981 | 1111 | FCR0075 | 1171 | FCR0171 |
| 932 | CR0718 | 992 | CR0872 | 1052 | CR0983 | 1112 | FCR0077 | 1172 | fcr0172nn |
| 933 | CR0724 | 993 | CR0873 | 1053 | CR0985 | 1113 | FCR0079 | 1173 | FCR0173 |
| 934 | CR0725 | 994 | CR0874 | 1054 | CR0989 | 1114 | FCR0081 | 1174 | FCR0174 |
| 935 | CR0726 | 995 | CR0875 | 1055 | CR0991 | 1115 | FCR0083 | 1175 | FCR0175 |
| 936 | CR0729 | 996 | CR0877 | 1056 | CR0992 | 1116 | FCR0087 | 1176 | FCR0176 |
| 937 | CR0740 | 997 | CR0878 | 1057 | CR0994 | 1117 | FCR0088 | 1177 | FCR0177 |
| 938 | CR0744 | 998 | cr0880N | 1058 | CR0995 | 1118 | FCR0089 | 1178 | FCR0179 |
| 939 | CR0750 | 999 | CR0881 | 1059 | CR0996 | 1119 | FCR0090n | 1179 | FCR0180 |
| 940 | CR0759 | 1000 | CR0882 | 1060 | cr0999 | 1120 | FCR0091 | 1180 | FCR0182 |
| 941 | CR0768 | 1001 | CR0883 | 1061 | CR1002 | 1121 | FCR0092 | 1181 | FCR0185 |
| 942 | CR0770 | 1002 | CR0885 | 1062 | CR1003 | 1122 | FCR0093 | 1182 | FCR0186 |
| 943 | CR0771 | 1003 | CR0897 | 1063 | CR1004 | 1123 | FCR0098 | 1183 | FCR0187 |
| 944 | CR0775 | 1004 | CR0899 | 1064 | CR1005 | 1124 | FCR0099 | 1184 | FCR0188 |
| 945 | CR0778 | 1005 | CR0900 | 1065 | CR1006 | 1125 | FCR0100 | 1185 | FCR0193 |
| 946 | CR0780 | 1006 | CR0903 | 1066 | CR1009 | 1126 | FCR0102 | 1186 | FCR0194 |
| 947 | CR0781 | 1007 | CR0904 | 1067 | CR1010 | 1127 | FCR0104 | 1187 | fcr0195 |
| 948 | cr0784 | 1008 | CR0905 | 1068 | CR1016 | 1128 | FCR0105 | 1188 | FCR0196 |
| 949 | CR0785 | 1009 | CR0906 | 1069 | CR1023 | 1129 | FCR0107 | 1189 | FCR0198 |
| 950 | CR0787 | 1010 | CR0907 | 1070 | CR1028 | 1130 | FCR0108 | 1190 | FCR0199 |
| 951 | CR0788 | 1011 | CR0909 | 1071 | cr1029N | 1131 | FCR0111 | 1191 | FCR0200 |
| 952 | CR0789 | 1012 | cr0910 | 1072 | CR1062 | 1132 | FCR0113 | 1192 | FCR0201 |
| 953 | CR0790 | 1013 | CR0911 | 1073 | fcr0004 | 1133 | fcr0115nn | 1193 | FCR0202 |
| 954 | CR0791 | 1014 | CR0912 | 1074 | FCR0009 | 1134 | FCR0116 | 1194 | FCR0205 |
| 955 | cr0792 | 1015 | CR0914 | 1075 | FCR0010 | 1135 | FCR0130 | 1195 | FCR0206 |
| 956 | CR0793 | 1016 | CR0916 | 1076 | fcr0014n | 1136 | FCR0131 | 1196 | FCR0207 |
| 957 | CR0794 | 1017 | cr0917 | 1077 | FCR0017 | 1137 | fcr0132n | 1197 | FCR0208 |
| 958 | cr0796N | 1018 | CR0918 | 1078 | FCR0018n | 1138 | FCR0133 | 1198 | FCR0209 |
| 959 | CR0797 | 1019 | CR0920 | 1079 | FCR0019n | 1139 | FCR0134 | 1199 | FCR0211 |
| 960 | CR0798 | 1020 | CR0921 | 1080 | FCR0020 | 1140 | FCR0135 | 1200 | FCR0216 |

Figure 6B – List of EST Sequence Names From Fetal Cartilage cDNA Library

| | | | | | | | | | |
|---|---|---|---|---|---|---|---|---|---|
| 1201 | FCR0217 | 1261 | FCR0307 | 1321 | FCR0392 | 1381 | FCR0483 | 1441 | FCR0560 |
| 1202 | FCR0222 | 1262 | FCR0309 | 1322 | FCR0393 | 1382 | FCR0485 | 1442 | FCR0561 |
| 1203 | FCR0223 | 1263 | FCR0310 | 1323 | FCR0395 | 1383 | FCR0486 | 1443 | FCR0563 |
| 1204 | FCR0224 | 1264 | FCR0311 | 1324 | FCR0398 | 1384 | FCR0488 | 1444 | fcr0564nn |
| 1205 | FCR0225 | 1265 | FCR0312 | 1325 | FCR0399 | 1385 | FCR0489 | 1445 | FCR0565 |
| 1206 | FCR0226 | 1266 | fcr0313N | 1326 | FCR0400 | 1386 | FCR0490 | 1446 | FCR0566 |
| 1207 | FCR0227 | 1267 | FCR0314 | 1327 | FCR0401 | 1387 | FCR0492 | 1447 | FCR0567 |
| 1208 | FCR0230 | 1268 | FCR0316 | 1328 | FCR0402 | 1388 | fcr0493n | 1448 | FCR0568n |
| 1209 | FCR0231 | 1269 | FCR0317 | 1329 | FCR0404 | 1389 | FCR0494 | 1449 | FCR0569 |
| 1210 | FCR0233 | 1270 | FCR0320 | 1330 | FCR0405 | 1390 | FCR0496 | 1450 | FCR0570 |
| 1211 | FCR0235 | 1271 | FCR0322 | 1331 | FCR0407 | 1391 | FCR0497 | 1451 | FCR0571 |
| 1212 | FCR0236 | 1272 | FCR0324 | 1332 | FCR0409 | 1392 | FCR0498 | 1452 | FCR0572F |
| 1213 | FCR0237 | 1273 | FCR0326 | 1333 | FCR0410 | 1393 | FCR0499 | 1453 | FCR0572N |
| 1214 | FCR0238 | 1274 | FCR0327 | 1334 | fcr0411 | 1394 | FCR0500 | 1454 | FCR0573 |
| 1215 | FCR0239 | 1275 | FCR0328 | 1335 | FCR0412 | 1395 | FCR0501 | 1455 | FCR0574 |
| 1216 | FCR0240 | 1276 | fcr0329 | 1336 | FCR0413 | 1396 | FCR0502 | 1456 | FCR0575N |
| 1217 | FCR0242 | 1277 | FCR0332 | 1337 | FCR0414 | 1397 | FCR0503 | 1457 | FCR0576 |
| 1218 | FCR0244 | 1278 | FCR0333 | 1338 | FCR0416 | 1398 | fcr0506nn | 1458 | FCR0578 |
| 1219 | fcr0245nn | 1279 | FCR0334 | 1339 | FCR0417 | 1399 | FCR0507 | 1459 | FCR0580 |
| 1220 | fcr0246n | 1280 | FCR0335 | 1340 | FCR0418 | 1400 | FCR0508 | 1460 | FCR0583 |
| 1221 | FCR0247 | 1281 | fcr0336n | 1341 | FCR0419 | 1401 | FCR0510 | 1461 | FCR0584 |
| 1222 | FCR0248 | 1282 | FCR0338 | 1342 | FCR0420 | 1402 | FCR0511 | 1462 | FCR0585 |
| 1223 | FCR0249 | 1283 | FCR0339 | 1343 | FCR0421 | 1403 | FCR0513n | 1463 | FCR0586 |
| 1224 | FCR0253 | 1284 | FCR0340 | 1344 | fcr0422 | 1404 | FCR0515 | 1464 | FCR0587 |
| 1225 | FCR0254 | 1285 | FCR0342 | 1345 | FCR0425 | 1405 | fcr0516nn | 1465 | FCR0588 |
| 1226 | FCR0257 | 1286 | FCR0343 | 1346 | FCR0429 | 1406 | FCR0517 | 1466 | FCR0589 |
| 1227 | fcr0258n | 1287 | FCR0344 | 1347 | FCR0430 | 1407 | FCR0518 | 1467 | FCR0593 |
| 1228 | FCR0259 | 1288 | fcr0346 | 1348 | FCR0431 | 1408 | FCR0519 | 1468 | FCR0594 |
| 1229 | FCR0260 | 1289 | FCR0348 | 1349 | FCR0432 | 1409 | FCR0520 | 1469 | FCR0595 |
| 1230 | FCR0262 | 1290 | FCR0349 | 1350 | fcr0434 | 1410 | FCR0522 | 1470 | FCR0596 |
| 1231 | FCR0263 | 1291 | fcr0350 | 1351 | FCR0435 | 1411 | FCR0523 | 1471 | fcr0597n |
| 1232 | FCR0264 | 1292 | fcr0351N | 1352 | FCR0437 | 1412 | FCR0524 | 1472 | FCR0598 |
| 1233 | FCR0265 | 1293 | FCR0352 | 1353 | FCR0438 | 1413 | FCR0525 | 1473 | FCR0599 |
| 1234 | FCR0266 | 1294 | FCR0353 | 1354 | FCR0439 | 1414 | FCR0529 | 1474 | FCR0601N |
| 1235 | FCR0269 | 1295 | fcr0354 | 1355 | FCR0440 | 1415 | FCR0530 | 1475 | FCR0603 |
| 1236 | fcr0270nn | 1296 | FCR0355 | 1356 | FCR0441 | 1416 | FCR0531 | 1476 | FCR0604 |
| 1237 | FCR0272 | 1297 | fcr0356n | 1357 | fcr0444 | 1417 | FCR0532 | 1477 | FCR0605 |
| 1238 | FCR0273 | 1298 | FCR0358 | 1358 | FCR0447 | 1418 | FCR0534 | 1478 | FCR0606 |
| 1239 | FCR0274 | 1299 | FCR0360 | 1359 | FCR0448 | 1419 | FCR0535 | 1479 | FCR0607 |
| 1240 | FCR0276 | 1300 | FCR0361 | 1360 | FCR0450 | 1420 | FCR0536 | 1480 | FCR0608 |
| 1241 | FCR0278 | 1301 | fcr0362n | 1361 | FCR0454 | 1421 | FCR0537 | 1481 | FCR0609 |
| 1242 | FCR0279 | 1302 | FCR0365 | 1362 | FCR0455 | 1422 | FCR0539 | 1482 | fcr0610 |
| 1243 | FCR0280 | 1303 | FCR0366 | 1363 | FCR0456 | 1423 | fcr0540n | 1483 | FCR0611 |
| 1244 | FCR0282 | 1304 | FCR0367 | 1364 | FCR0458 | 1424 | FCR0541 | 1484 | FCR0612 |
| 1245 | FCR0283 | 1305 | FCR0369 | 1365 | FCR0459 | 1425 | FCR0542 | 1485 | fcr0613nn |
| 1246 | FCR0284 | 1306 | fcr0370N | 1366 | fcr0464 | 1426 | FCR0543 | 1486 | FCR0614 |
| 1247 | FCR0285 | 1307 | FCR0371 | 1367 | FCR0466 | 1427 | FCR0545 | 1487 | FCR0615 |
| 1248 | FCR0287 | 1308 | fcr0372N | 1368 | fcr0468n | 1428 | FCR0546 | 1488 | FCR0618 |
| 1249 | FCR0288 | 1309 | fcr0373n | 1369 | FCR0469 | 1429 | FCR0547 | 1489 | FCR0620 |
| 1250 | FCR0290 | 1310 | FCR0375 | 1370 | FCR0470 | 1430 | FCR0548 | 1490 | fcr0621n |
| 1251 | FCR0291 | 1311 | FCR0376 | 1371 | FCR0471 | 1431 | fcr0549 | 1491 | FCR0622 |
| 1252 | FCR0292 | 1312 | fcr0378 | 1372 | FCR0472 | 1432 | FCR0551 | 1492 | FCR0623 |
| 1253 | fcr0293 | 1313 | fcr0379 | 1373 | FCR0473 | 1433 | FCR0552 | 1493 | FCR0624 |
| 1254 | FCR0294 | 1314 | FCR0380 | 1374 | FCR0474 | 1434 | FCR0553 | 1494 | FCR0625 |
| 1255 | FCR0297 | 1315 | FCR0383 | 1375 | FCR0476 | 1435 | FCR0554 | 1495 | FCR0628N |
| 1256 | FCR0298 | 1316 | FCR0385 | 1376 | FCR0477 | 1436 | FCR0555 | 1496 | FCR0629 |
| 1257 | FCR0300 | 1317 | FCR0388 | 1377 | FCR0478 | 1437 | FCR0556 | 1497 | FCR0630 |
| 1258 | FCR0302 | 1318 | fcr0389n | 1378 | FCR0479 | 1438 | FCR0557 | 1498 | FCR0632 |
| 1259 | FCR0304 | 1319 | FCR0390 | 1379 | FCR0481 | 1439 | FCR0558 | 1499 | FCR0633 |
| 1260 | FCR0306 | 1320 | FCR0391 | 1380 | FCR0482n | 1440 | FCR0559n | 1500 | FCR0634 |

Figure 6B – List of EST Sequence Names From Fetal Cartilage cDNA Library

| | | | | | | | | | |
|---|---|---|---|---|---|---|---|---|---|
| 1501 | fcr0636n | 1561 | FCR0727 | 1621 | FCR0817 | 1681 | FCR0895 | 1741 | FCR1004n |
| 1502 | FCR0637 | 1562 | FCR0729 | 1622 | FCR0818 | 1682 | fcr0898n | 1742 | FCR1006 |
| 1503 | FCR0638 | 1563 | FCR0730 | 1623 | FCR0821 | 1683 | FCR0899 | 1743 | FCR1007 |
| 1504 | FCR0639 | 1564 | FCR0731 | 1624 | FCR0822 | 1684 | FCR0900 | 1744 | FCR1008 |
| 1505 | FCR0640 | 1565 | FCR0734 | 1625 | FCR0824 | 1685 | FCR0901 | 1745 | FCR1009n |
| 1506 | FCR0642 | 1566 | FCR0735 | 1626 | FCR0825 | 1686 | FCR0902 | 1746 | FCR1010 |
| 1507 | FCR0646 | 1567 | FCR0736 | 1627 | fcr0826n | 1687 | FCR0903 | 1747 | FCR1011 |
| 1508 | FCR0647 | 1568 | FCR0739 | 1628 | FCR0827 | 1688 | FCR0904 | 1748 | FCR1012 |
| 1509 | FCR0648 | 1569 | FCR0740 | 1629 | FCR0828 | 1689 | FCR0905 | 1749 | FCR1013 |
| 1510 | FCR0649 | 1570 | FCR0743 | 1630 | FCR0830 | 1690 | FCR0906 | 1750 | FCR1015 |
| 1511 | FCR0650 | 1571 | FCR0748 | 1631 | FCR0833 | 1691 | FCR0908N | 1751 | FCR1016 |
| 1512 | FCR0651N | 1572 | FCR0749 | 1632 | FCR0834 | 1692 | FCR0909 | 1752 | FCR1017 |
| 1513 | FCR0652N | 1573 | FCR0750 | 1633 | FCR0835 | 1693 | FCR0910 | 1753 | FCR1018 |
| 1514 | FCR0653 | 1574 | FCR0751 | 1634 | FCR0836 | 1694 | FCR0914 | 1754 | fcr1019nn |
| 1515 | FCR0654 | 1575 | FCR0752 | 1635 | FCR0837N | 1695 | FCR0915 | 1755 | FCR1020 |
| 1516 | FCR0658 | 1576 | FCR0753 | 1636 | FCR0839 | 1696 | FCR0918 | 1756 | fcr1021nn |
| 1517 | FCR0663 | 1577 | FCR0755 | 1637 | FCR0841 | 1697 | FCR0919N | 1757 | FCR1023 |
| 1518 | FCR0665 | 1578 | FCR0756 | 1638 | FCR0842 | 1698 | FCR0920 | 1758 | FCR1029 |
| 1519 | FCR0666N | 1579 | FCR0757 | 1639 | FCR0843 | 1699 | FCR0921 | 1759 | FCR1031 |
| 1520 | FCR0667 | 1580 | FCR0758 | 1640 | FCR0844 | 1700 | fcr0923 | 1760 | FCR1032 |
| 1521 | FCR0668 | 1581 | FCR0759 | 1641 | FCR0845 | 1701 | FCR0926 | 1761 | FCR1033 |
| 1522 | FCR0669 | 1582 | FCR0761 | 1642 | FCR0846 | 1702 | FCR0927 | 1762 | FCR1036 |
| 1523 | FCR0670 | 1583 | FCR0763 | 1643 | FCR0847 | 1703 | FCR0928 | 1763 | FCR1037 |
| 1524 | FCR0671 | 1584 | FCR0765 | 1644 | FCR0848 | 1704 | FCR0932 | 1764 | FCR1040n |
| 1525 | FCR0674 | 1585 | FCR0766 | 1645 | FCR0849 | 1705 | FCR0935N | 1765 | FCR1041 |
| 1526 | FCR0675 | 1586 | FCR0767 | 1646 | FCR0850 | 1706 | FCR0937 | 1766 | FCR1042 |
| 1527 | FCR0676 | 1587 | FCR0768 | 1647 | FCR0851 | 1707 | FCR0945 | 1767 | FCR1043 |
| 1528 | FCR0677 | 1588 | FCR0769 | 1648 | FCR0852 | 1708 | FCR0946N | 1768 | fcr1044nn |
| 1529 | FCR0680 | 1589 | FCR0770N | 1649 | FCR0853 | 1709 | FCR0947N | 1769 | FCR1045 |
| 1530 | FCR0681 | 1590 | FCR0771 | 1650 | FCR0854 | 1710 | FCR0951 | 1770 | FCR1046 |
| 1531 | FCR0682 | 1591 | FCR0773 | 1651 | FCR0855 | 1711 | FCR0952 | 1771 | FCR1048n |
| 1532 | FCR0683 | 1592 | FCR0774 | 1652 | FCR0856 | 1712 | FCR0954 | 1772 | FCR1052 |
| 1533 | FCR0684 | 1593 | FCR0775 | 1653 | FCR0857 | 1713 | FCR0955 | 1773 | FCR1053 |
| 1534 | FCR0685 | 1594 | FCR0776 | 1654 | FCR0858 | 1714 | FCR0956 | 1774 | FCR1055 |
| 1535 | FCR0686N | 1595 | FCR0777 | 1655 | FCR0859 | 1715 | FCR0963 | 1775 | FCR1056 |
| 1536 | FCR0687N | 1596 | FCR0778 | 1656 | FCR0860 | 1716 | FCR0964 | 1776 | FCR1057 |
| 1537 | fcr0688n | 1597 | FCR0779 | 1657 | FCR0861 | 1717 | fcr0965n | 1777 | FCR1059 |
| 1538 | FCR0689 | 1598 | FCR0781 | 1658 | FCR0862 | 1718 | FCR0966 | 1778 | FCR1060 |
| 1539 | FCR0690 | 1599 | FCR0785 | 1659 | FCR0863 | 1719 | FCR0967 | 1779 | FCR1061n |
| 1540 | FCR0691N | 1600 | FCR0786N | 1660 | FCR0864 | 1720 | FCR0971 | 1780 | FCR1062 |
| 1541 | FCR0693 | 1601 | FCR0787 | 1661 | FCR0865 | 1721 | FCR0974 | 1781 | FCR1063 |
| 1542 | FCR0694N | 1602 | FCR0788 | 1662 | FCR0866 | 1722 | FCR0976 | 1782 | FCR1066 |
| 1543 | FCR0695 | 1603 | FCR0790 | 1663 | FCR0867 | 1723 | FCR0977 | 1783 | FCR1068 |
| 1544 | FCR0696 | 1604 | FCR0792 | 1664 | FCR0868 | 1724 | FCR0978 | 1784 | FCR1072 |
| 1545 | FCR0698 | 1605 | FCR0793N | 1665 | FCR0870 | 1725 | FCR0984 | 1785 | FCR1073 |
| 1546 | FCR0700 | 1606 | FCR0794N | 1666 | FCR0872 | 1726 | fcr0985n | 1786 | FCR1074n |
| 1547 | FCR0701 | 1607 | fcr0795n | 1667 | FCR0874 | 1727 | FCR0986 | 1787 | FCR1078 |
| 1548 | FCR0703 | 1608 | FCR0796 | 1668 | FCR0875 | 1728 | FCR0988n | 1788 | FCR1079 |
| 1549 | FCR0704 | 1609 | FCR0797 | 1669 | fcr0876n | 1729 | FCR0989n | 1789 | FCR1081 |
| 1550 | FCR0705 | 1610 | FCR0798 | 1670 | FCR0878 | 1730 | FCR0990 | 1790 | FCR1082 |
| 1551 | FCR0706 | 1611 | FCR0801 | 1671 | FCR0879 | 1731 | FCR0991 | 1791 | FCR1083 |
| 1552 | FCR0707 | 1612 | FCR0802 | 1672 | FCR0881 | 1732 | FCR0992 | 1792 | FCR1087n |
| 1553 | FCR0708 | 1613 | FCR0803 | 1673 | FCR0882 | 1733 | FCR0993 | 1793 | FCR1088 |
| 1554 | FCR0710 | 1614 | FCR0807 | 1674 | FCR0884 | 1734 | FCR0995 | 1794 | FCR1090 |
| 1555 | FCR0711 | 1615 | FCR0808 | 1675 | FCR0886 | 1735 | FCR0996 | 1795 | FCR1091 |
| 1556 | FCR0712 | 1616 | FCR0809 | 1676 | FCR0888 | 1736 | FCR0997 | 1796 | FCR1092 |
| 1557 | FCR0714N | 1617 | FCR0810 | 1677 | FCR0889 | 1737 | FCR0999 | 1797 | fcr1095 |
| 1558 | FCR0715 | 1618 | fcr0814n | 1678 | FCR0890 | 1738 | fcr1000n | 1798 | FCR1097 |
| 1559 | FCR0725 | 1619 | FCR0815 | 1679 | FCR0893 | 1739 | FCR1001 | 1799 | FCR1098 |
| 1560 | FCR0726 | 1620 | FCR0816 | 1680 | FCR0894 | 1740 | FCR1003 | 1800 | FCR1099 |

Figure 6B – List of EST Sequence Names From Fetal Cartilage cDNA Library

| | | | | | | | | | |
|---|---|---|---|---|---|---|---|---|---|
| 1801 | fcr1100nn | 1861 | fcr1219nn | 1921 | FCR1327 | 1981 | FCR1399 | 2041 | FCR1483 |
| 1802 | FCR1101 | 1862 | fcr1220nn | 1922 | FCR1328 | 1982 | FCR1400 | 2042 | FCR1484 |
| 1803 | FCR1103 | 1863 | fcr1221n | 1923 | FCR1329 | 1983 | FCR1402 | 2043 | FCR1485 |
| 1804 | FCR1104 | 1864 | FCR1225N | 1924 | FCR1330N | 1984 | FCR1404 | 2044 | FCR1486 |
| 1805 | FCR1105N | 1865 | FCR1226 | 1925 | FCR1331 | 1985 | FCR1405N | 2045 | FCR1487 |
| 1806 | FCR1106 | 1866 | FCR1235N | 1926 | FCR1332 | 1986 | FCR1407N | 2046 | FCR1489 |
| 1807 | FCR1107N | 1867 | FCR1237N | 1927 | FCR1333 | 1987 | FCR1408 | 2047 | FCR1490 |
| 1808 | FCR1111 | 1868 | FCR1238N | 1928 | fcr1334 | 1988 | FCR1411 | 2048 | FCR1492 |
| 1809 | FCR1113 | 1869 | FCR1239N | 1929 | FCR1335 | 1989 | FCR1414 | 2049 | FCR1493 |
| 1810 | FCR1114 | 1870 | FCR1241N | 1930 | FCR1336 | 1990 | FCR1415 | 2050 | FCR1494 |
| 1811 | FCR1115 | 1871 | FCR1242N | 1931 | FCR1337 | 1991 | fcr1416nn | 2051 | FCR1495N |
| 1812 | FCR1116 | 1872 | FCR1244 | 1932 | FCR1339 | 1992 | fcr1418 | 2052 | FCR1496 |
| 1813 | FCR1117N | 1873 | FCR1246 | 1933 | FCR1340N | 1993 | FCR1419 | 2053 | fcr1497n |
| 1814 | FCR1119 | 1874 | FCR1247 | 1934 | FCR1341 | 1994 | FCR1420 | 2054 | FCR1498 |
| 1815 | FCR1123 | 1875 | FCR1248 | 1935 | FCR1343 | 1995 | FCR1421N | 2055 | FCR1499 |
| 1816 | fcr1124nn | 1876 | FCR1251N | 1936 | FCR1344 | 1996 | FCR1422 | 2056 | FCR1502 |
| 1817 | FCR1125 | 1877 | FCR1252 | 1937 | FCR1345 | 1997 | FCR1423 | 2057 | FCR1503 |
| 1818 | FCR1126 | 1878 | FCR1253 | 1938 | FCR1346 | 1998 | FCR1425 | 2058 | FCR1504 |
| 1819 | FCR1127 | 1879 | FCR1257 | 1939 | FCR1347 | 1999 | FCR1426 | 2059 | FCR1507 |
| 1820 | FCR1133 | 1880 | FCR1260 | 1940 | FCR1348 | 2000 | FCR1427 | 2060 | FCR1509 |
| 1821 | FCR1134 | 1881 | FCR1261 | 1941 | FCR1349 | 2001 | FCR1428 | 2061 | FCR1510 |
| 1822 | FCR1137 | 1882 | FCR1263N | 1942 | FCR1351 | 2002 | FCR1429 | 2062 | FCR1511 |
| 1823 | FCR1138 | 1883 | FCR1271 | 1943 | FCR1352 | 2003 | FCR1430 | 2063 | FCR1512 |
| 1824 | FCR1139 | 1884 | FCR1273 | 1944 | FCR1353 | 2004 | FCR1431 | 2064 | FCR1514 |
| 1825 | FCR1140 | 1885 | FCR1275 | 1945 | FCR1354 | 2005 | FCR1434 | 2065 | FCR1515N |
| 1826 | FCR1141N | 1886 | FCR1276 | 1946 | FCR1356 | 2006 | FCR1435 | 2066 | FCR1516 |
| 1827 | FCR1143 | 1887 | FCR1277 | 1947 | FCR1359 | 2007 | FCR1436 | 2067 | FCR1521 |
| 1828 | FCR1146 | 1888 | fcr1279nn | 1948 | fcr1360nn | 2008 | FCR1438 | 2068 | FCR1522 |
| 1829 | FCR1147 | 1889 | FCR1280 | 1949 | FCR1361 | 2009 | FCR1439 | 2069 | fcr1524nn |
| 1830 | FCR1148 | 1890 | FCR1281 | 1950 | FCR1362 | 2010 | fcr1440 | 2070 | FCR1525 |
| 1831 | FCR1149 | 1891 | FCR1283 | 1951 | FCR1363N | 2011 | FCR1442 | 2071 | FCR1526 |
| 1832 | FCR1150 | 1892 | FCR1285 | 1952 | FCR1365 | 2012 | FCR1443N | 2072 | FCR1528 |
| 1833 | FCR1152 | 1893 | FCR1286 | 1953 | FCR1367 | 2013 | FCR1445 | 2073 | FCR1529 |
| 1834 | FCR1153N | 1894 | FCR1287 | 1954 | FCR1368 | 2014 | FCR1446 | 2074 | FCR1531 |
| 1835 | FCR1156 | 1895 | FCR1289 | 1955 | FCR1369 | 2015 | fcr1447n | 2075 | FCR1532 |
| 1836 | fcr1160nn | 1896 | FCR1290N | 1956 | FCR1370 | 2016 | FCR1448 | 2076 | FCR1533 |
| 1837 | FCR1163 | 1897 | FCR1291 | 1957 | FCR1371 | 2017 | fcr1449n | 2077 | FCR1534 |
| 1838 | FCR1168 | 1898 | fcr1294nn | 1958 | FCR1372 | 2018 | FCR1450 | 2078 | FCR1535 |
| 1839 | FCR1169 | 1899 | FCR1296 | 1959 | FCR1373 | 2019 | FCR1453 | 2079 | FCR1536 |
| 1840 | FCR1170 | 1900 | FCR1298 | 1960 | FCR1375 | 2020 | FCR1454 | 2080 | FCR1540 |
| 1841 | FCR1171N | 1901 | FCR1299 | 1961 | FCR1376 | 2021 | FCR1456 | 2081 | FCR1541 |
| 1842 | FCR1172 | 1902 | FCR1302 | 1962 | FCR1377 | 2022 | FCR1457 | 2082 | FCR1542 |
| 1843 | FCR1173 | 1903 | FCR1304 | 1963 | FCR1378 | 2023 | FCR1458 | 2083 | FCR1554 |
| 1844 | FCR1174 | 1904 | FCR1305 | 1964 | FCR1379 | 2024 | FCR1460 | 2084 | FCR1555 |
| 1845 | fcr1175n | 1905 | FCR1306 | 1965 | FCR1380N | 2025 | FCR1461 | 2085 | FCR1556 |
| 1846 | FCR1182 | 1906 | FCR1308N | 1966 | FCR1381 | 2026 | FCR1462 | 2086 | FCR1557 |
| 1847 | FCR1183 | 1907 | FCR1309 | 1967 | FCR1382 | 2027 | FCR1463 | 2087 | FCR1558 |
| 1848 | FCR1184 | 1908 | FCR1310 | 1968 | FCR1384 | 2028 | FCR1464 | 2088 | fcr1559n |
| 1849 | FCR1185N | 1909 | FCR1311 | 1969 | FCR1385N | 2029 | FCR1465 | 2089 | FCR1561 |
| 1850 | fcr1200nn | 1910 | FCR1312 | 1970 | FCR1386 | 2030 | FCR1466 | 2090 | FCR1562 |
| 1851 | FCR1202 | 1911 | FCR1313 | 1971 | fcr1387n | 2031 | FCR1468 | 2091 | FCR1563 |
| 1852 | FCR1203 | 1912 | FCR1316 | 1972 | FCR1388N | 2032 | fcr1469nn | 2092 | FCR1565 |
| 1853 | FCR1204 | 1913 | fcr1317nn | 1973 | FCR1389 | 2033 | FCR1470 | 2093 | FCR1566 |
| 1854 | FCR1205 | 1914 | FCR1318 | 1974 | FCR1390 | 2034 | FCR1472 | 2094 | fcr1579nn |
| 1855 | FCR1206 | 1915 | FCR1321N | 1975 | FCR1391N | 2035 | FCR1473 | 2095 | FCR1580 |
| 1856 | FCR1207 | 1916 | fcr1322n | 1976 | FCR1392 | 2036 | FCR1475 | 2096 | FCR1582 |
| 1857 | FCR1209 | 1917 | FCR1323 | 1977 | FCR1393 | 2037 | FCR1477 | 2097 | FCR1585 |
| 1858 | FCR1210 | 1918 | FCR1324 | 1978 | FCR1394 | 2038 | FCR1478 | 2098 | FCR1587 |
| 1859 | FCR1212 | 1919 | FCR1325 | 1979 | FCR1395 | 2039 | FCR1479 | 2099 | FCR1589 |
| 1860 | FCR1218 | 1920 | FCR1326 | 1980 | FCR1396 | 2040 | FCR1481 | 2100 | fcr1590nn |

Figure 6B – List of EST Sequence Names From Fetal Cartilage cDNA Library

| | | | | | | | | | |
|---|---|---|---|---|---|---|---|---|---|
| 2101 | FCR1596N | 2161 | FCR1745 | 2221 | FCR1845 | 2281 | FCR1967 | 2341 | FCR2045 |
| 2102 | fcr1597 | 2162 | FCR1746 | 2222 | FCR1848 | 2282 | fcr1969nn | 2342 | FCR2046 |
| 2103 | FCR1598N | 2163 | FCR1747 | 2223 | FCR1852 | 2283 | FCR1970 | 2343 | FCR2047 |
| 2104 | FCR1599N | 2164 | FCR1748 | 2224 | FCR1853 | 2284 | FCR1971 | 2344 | FCR2049 |
| 2105 | FCR1604 | 2165 | FCR1749 | 2225 | FCR1855 | 2285 | FCR1972 | 2345 | FCR2051 |
| 2106 | FCR1605 | 2166 | FCR1750 | 2226 | FCR1857 | 2286 | FCR1973 | 2346 | FCR2052 |
| 2107 | FCR1608 | 2167 | fcr1752nn | 2227 | FCR1858 | 2287 | FCR1974 | 2347 | fcr2053n |
| 2108 | FCR1609 | 2168 | FCR1753N | 2228 | FCR1859 | 2288 | FCR1975 | 2348 | FCR2054 |
| 2109 | FCR1611 | 2169 | FCR1754 | 2229 | FCR1860 | 2289 | FCR1976 | 2349 | FCR2055 |
| 2110 | FCR1612 | 2170 | FCR1755 | 2230 | FCR1861 | 2290 | fcr1977nn | 2350 | FCR2056 |
| 2111 | FCR1614 | 2171 | FCR1756 | 2231 | FCR1879N | 2291 | fcr1978nn | 2351 | FCR2058 |
| 2112 | fcr1616nn | 2172 | FCR1757 | 2232 | FCR1880 | 2292 | FCR1979 | 2352 | FCR2062 |
| 2113 | FCR1619 | 2173 | FCR1758 | 2233 | FCR1881N | 2293 | FCR1980 | 2353 | FCR2067 |
| 2114 | FCR1621 | 2174 | FCR1759N | 2234 | FCR1883N | 2294 | FCR1981 | 2354 | FCR2068 |
| 2115 | FCR1623 | 2175 | FCR1760 | 2235 | FCR1885 | 2295 | FCR1983 | 2355 | FCR2069 |
| 2116 | FCR1625 | 2176 | fcr1761nn | 2236 | FCR1887 | 2296 | FCR1984 | 2356 | FCR2073 |
| 2117 | FCR1626 | 2177 | FCR1762 | 2237 | FCR1891 | 2297 | FCR1985 | 2357 | FCR2074 |
| 2118 | FCR1627 | 2178 | FCR1763 | 2238 | FCR1900N | 2298 | FCR1986 | 2358 | FCR2075 |
| 2119 | FCR1629 | 2179 | FCR1764 | 2239 | FCR1905 | 2299 | FCR1987 | 2359 | FCR2076 |
| 2120 | FCR1633 | 2180 | FCR1768 | 2240 | FCR1907 | 2300 | FCR1989 | 2360 | fcr2078n |
| 2121 | FCR1638 | 2181 | FCR1769 | 2241 | FCR1908N | 2301 | FCR1990 | 2361 | FCR2079 |
| 2122 | FCR1642 | 2182 | FCR1770 | 2242 | FCR1909 | 2302 | FCR1991 | 2362 | FCR2080 |
| 2123 | FCR1643 | 2183 | FCR1771 | 2243 | FCR1910 | 2303 | FCR1992 | 2363 | FCR2081 |
| 2124 | FCR1644 | 2184 | FCR1772 | 2244 | FCR1912 | 2304 | FCR1993 | 2364 | fcr2082n |
| 2125 | FCR1645 | 2185 | FCR1774 | 2245 | FCR1913 | 2305 | FCR1994 | 2365 | FCR2083 |
| 2126 | FCR1646 | 2186 | FCR1775 | 2246 | FCR1914 | 2306 | FCR1995 | 2366 | FCR2088 |
| 2127 | FCR1647 | 2187 | FCR1776 | 2247 | FCR1918 | 2307 | FCR1997 | 2367 | FCR2089 |
| 2128 | FCR1651 | 2188 | FCR1777 | 2248 | FCR1919 | 2308 | FCR1998 | 2368 | FCR2090N |
| 2129 | FCR1652 | 2189 | FCR1779 | 2249 | FCR1921 | 2309 | FCR1999 | 2369 | FCR2092 |
| 2130 | FCR1653 | 2190 | fcr1780 | 2250 | FCR1922 | 2310 | FCR2000 | 2370 | FCR2093N |
| 2131 | FCR1654 | 2191 | FCR1781 | 2251 | FCR1925 | 2311 | FCR2002 | 2371 | FCR2095 |
| 2132 | FCR1655 | 2192 | FCR1782 | 2252 | FCR1926 | 2312 | FCR2003 | 2372 | FCR2096 |
| 2133 | FCR1656N | 2193 | FCR1783 | 2253 | FCR1927 | 2313 | FCR2005N | 2373 | FCR2097N |
| 2134 | FCR1657 | 2194 | FCR1784N | 2254 | fcr1928n | 2314 | FCR2006 | 2374 | FCR2099 |
| 2135 | FCR1658 | 2195 | FCR1786 | 2255 | FCR1929 | 2315 | FCR2007 | 2375 | FCR2102 |
| 2136 | FCR1701 | 2196 | FCR1787 | 2256 | FCR1930 | 2316 | FCR2008 | 2376 | FCR2103 |
| 2137 | FCR1702N | 2197 | FCR1790 | 2257 | FCR1931 | 2317 | FCR2009 | 2377 | FCR2105 |
| 2138 | FCR1704 | 2198 | FCR1791 | 2258 | FCR1932 | 2318 | FCR2012N | 2378 | FCR2106 |
| 2139 | FCR1705 | 2199 | FCR1792 | 2259 | fcr1936nn | 2319 | fcr2013 | 2379 | FCR2107 |
| 2140 | FCR1713 | 2200 | FCR1795 | 2260 | fcr1937nn | 2320 | FCR2014 | 2380 | FCR2108 |
| 2141 | FCR1714 | 2201 | FCR1797 | 2261 | FCR1938 | 2321 | FCR2015 | 2381 | FCR2109 |
| 2142 | FCR1716 | 2202 | FCR1817 | 2262 | FCR1940 | 2322 | FCR2016 | 2382 | FCR2110 |
| 2143 | FCR1717 | 2203 | FCR1818 | 2263 | FCR1941 | 2323 | fcr2017nn | 2383 | FCR2113 |
| 2144 | FCR1719 | 2204 | FCR1819 | 2264 | FCR1942 | 2324 | FCR2018 | 2384 | FCR2114 |
| 2145 | FCR1720 | 2205 | FCR1820 | 2265 | FCR1943 | 2325 | FCR2019N | 2385 | FCR2115 |
| 2146 | FCR1724 | 2206 | fcr1821nn | 2266 | FCR1945 | 2326 | FCR2020 | 2386 | FCR2116 |
| 2147 | FCR1726 | 2207 | FCR1823 | 2267 | FCR1946N | 2327 | FCR2026 | 2387 | FCR2117 |
| 2148 | fcr1727n | 2208 | FCR1826 | 2268 | FCR1947 | 2328 | fcr2027nn | 2388 | FCR2118 |
| 2149 | fcr1728nn | 2209 | FCR1828 | 2269 | FCR1948 | 2329 | FCR2030 | 2389 | FCR2119 |
| 2150 | FCR1729 | 2210 | FCR1829 | 2270 | FCR1949 | 2330 | FCR2032 | 2390 | FCR2120 |
| 2151 | FCR1731 | 2211 | FCR1830 | 2271 | FCR1951 | 2331 | FCR2034N | 2391 | fcr2121n |
| 2152 | FCR1732 | 2212 | FCR1831 | 2272 | FCR1953 | 2332 | FCR2035 | 2392 | FCR2122 |
| 2153 | FCR1735 | 2213 | FCR1832 | 2273 | FCR1955 | 2333 | FCR2037 | 2393 | FCR2123 |
| 2154 | fcr1736n | 2214 | FCR1833 | 2274 | FCR1957N | 2334 | FCR2038 | 2394 | FCR2124 |
| 2155 | FCR1737 | 2215 | FCR1836 | 2275 | FCR1959 | 2335 | FCR2039 | 2395 | FCR2125 |
| 2156 | FCR1738N | 2216 | FCR1837N | 2276 | fcr1960nn | 2336 | FCR2040 | 2396 | FCR2126 |
| 2157 | FCR1740 | 2217 | FCR1838 | 2277 | FCR1961 | 2337 | FCR2041 | 2397 | FCR2127 |
| 2158 | FCR1741 | 2218 | FCR1839N | 2278 | FCR1963 | 2338 | FCR2042 | 2398 | FCR2128 |
| 2159 | FCR1742 | 2219 | fcr1840nn | 2279 | FCR1964 | 2339 | FCR2043 | 2399 | FCR2129 |
| 2160 | fcr1743nn | 2220 | FCR1844 | 2280 | fcr1965 | 2340 | FCR2044 | 2400 | FCR2130 |

Figure 6B - List of EST Sequence Names From Fetal Cartilage cDNA Library

| | | | | | | | | | |
|---|---|---|---|---|---|---|---|---|---|
| 2401 | FCR2131 | 2461 | FCR2227 | 2521 | FCR2308 | 2581 | FCR2437 | 2641 | FCR2580 |
| 2402 | FCR2132 | 2462 | FCR2228 | 2522 | FCR2310 | 2582 | FCR2442 | 2642 | FCR2581 |
| 2403 | FCR2134 | 2463 | FCR2229 | 2523 | FCR2311 | 2583 | FCR2443 | 2643 | FCR2582 |
| 2404 | FCR2135 | 2464 | FCR2230 | 2524 | FCR2312 | 2584 | FCR2444 | 2644 | FCR2585 |
| 2405 | FCR2136 | 2465 | FCR2231 | 2525 | FCR2313N | 2585 | FCR2445 | 2645 | FCR2587 |
| 2406 | fcr2137n | 2466 | FCR2233 | 2526 | FCR2314 | 2586 | FCR2447 | 2646 | fcr2588n |
| 2407 | FCR2138N | 2467 | FCR2234 | 2527 | FCR2316 | 2587 | FCR2449 | 2647 | fcr2589n |
| 2408 | FCR2139 | 2468 | FCR2235N | 2528 | FCR2317 | 2588 | FCR2450 | 2648 | fcr2591n |
| 2409 | FCR2140 | 2469 | FCR2237N | 2529 | FCR2319 | 2589 | FCR2472 | 2649 | FCR2593 |
| 2410 | FCR2141 | 2470 | FCR2239 | 2530 | FCR2320 | 2590 | FCR2473 | 2650 | FCR2596 |
| 2411 | FCR2142 | 2471 | FCR2240 | 2531 | FCR2321 | 2591 | FCR2474 | 2651 | FCR2598 |
| 2412 | FCR2143 | 2472 | FCR2241 | 2532 | FCR2322 | 2592 | FCR2475 | 2652 | FCR2600 |
| 2413 | FCR2144 | 2473 | FCR2242 | 2533 | FCR2323 | 2593 | fcr2476n | 2653 | FCR2601 |
| 2414 | FCR2146 | 2474 | FCR2243 | 2534 | FCR2326 | 2594 | FCR2477 | 2654 | FCR2602 |
| 2415 | FCR2147 | 2475 | FCR2246 | 2535 | FCR2327 | 2595 | FCR2480 | 2655 | fcr2605n |
| 2416 | FCR2148 | 2476 | FCR2248N | 2536 | FCR2328N | 2596 | FCR2481 | 2656 | FCR2607 |
| 2417 | FCR2149 | 2477 | fcr2249nn | 2537 | FCR2329 | 2597 | FCR2482 | 2657 | FCR2608 |
| 2418 | FCR2152 | 2478 | FCR2250 | 2538 | FCR2330 | 2598 | FCR2484 | 2658 | FCR2609 |
| 2419 | FCR2153 | 2479 | FCR2251 | 2539 | FCR2331 | 2599 | FCR2485 | 2659 | FCR2610 |
| 2420 | fcr2157nn | 2480 | FCR2253 | 2540 | FCR2332 | 2600 | fcr2486nn | 2660 | FCR2611 |
| 2421 | fcr2158n | 2481 | FCR2255 | 2541 | FCR2333 | 2601 | FCR2490 | 2661 | FCR2612 |
| 2422 | fcr2159n | 2482 | FCR2256 | 2542 | fcr2334nn | 2602 | FCR2491 | 2662 | fcr2618 |
| 2423 | FCR2160 | 2483 | fcr2264nn | 2543 | FCR2335 | 2603 | FCR2492N | 2663 | FCR2619 |
| 2424 | FCR2161 | 2484 | FCR2265 | 2544 | FCR2336 | 2604 | FCR2493 | 2664 | FCR2620 |
| 2425 | FCR2164 | 2485 | FCR2266 | 2545 | FCR2337 | 2605 | FCR2494 | 2665 | FCR2621 |
| 2426 | FCR2165 | 2486 | FCR2267 | 2546 | FCR2338 | 2606 | fcr2495nn | 2666 | fcr2622n |
| 2427 | FCR2166 | 2487 | FCR2268 | 2547 | FCR2339 | 2607 | FCR2498 | 2667 | fcr2624n |
| 2428 | FCR2167 | 2488 | FCR2269 | 2548 | FCR2340 | 2608 | FCR2499 | 2668 | fcr2625n |
| 2429 | fcr2168n | 2489 | FCR2273 | 2549 | FCR2341 | 2609 | FCR2500 | 2669 | FCR2626 |
| 2430 | FCR2172 | 2490 | FCR2274 | 2550 | FCR2342 | 2610 | FCR2501 | 2670 | FCR2627 |
| 2431 | FCR2174N | 2491 | FCR2275 | 2551 | FCR2343 | 2611 | FCR2503 | 2671 | FCR2628 |
| 2432 | FCR2175 | 2492 | FCR2276 | 2552 | FCR2345 | 2612 | FCR2504 | 2672 | FCR2629 |
| 2433 | FCR2178 | 2493 | FCR2277 | 2553 | FCR2349 | 2613 | fcr2505nn | 2673 | FCR2631 |
| 2434 | FCR2180N | 2494 | FCR2278 | 2554 | FCR2351 | 2614 | FCR2507 | 2674 | FCR2633 |
| 2435 | FCR2182 | 2495 | fcr2279n | 2555 | fcr2352n | 2615 | FCR2508 | 2675 | FCR2636 |
| 2436 | FCR2185 | 2496 | FCR2280 | 2556 | FCR2354 | 2616 | FCR2509 | 2676 | FCR2637N |
| 2437 | FCR2186 | 2497 | FCR2281 | 2557 | FCR2355 | 2617 | FCR2510 | 2677 | FCR2638 |
| 2438 | FCR2187 | 2498 | FCR2282 | 2558 | FCR2356N | 2618 | FCR2511 | 2678 | FCR2640 |
| 2439 | FCR2188 | 2499 | FCR2283 | 2559 | FCR2357 | 2619 | FCR2512 | 2679 | FCR2641 |
| 2440 | FCR2189 | 2500 | FCR2284 | 2560 | FCR2358 | 2620 | FCR2528N | 2680 | FCR2642 |
| 2441 | FCR2190 | 2501 | FCR2285 | 2561 | FCR2361 | 2621 | FCR2530 | 2681 | FCR2644 |
| 2442 | FCR2192 | 2502 | FCR2286 | 2562 | FCR2362 | 2622 | FCR2531 | 2682 | FCR2646 |
| 2443 | FCR2193N | 2503 | FCR2287 | 2563 | FCR2410 | 2623 | FCR2535 | 2683 | FCR2647 |
| 2444 | FCR2195 | 2504 | fcr2288nn | 2564 | FCR2411 | 2624 | FCR2536 | 2684 | FCR2648 |
| 2445 | FCR2196 | 2505 | FCR2289 | 2565 | FCR2412 | 2625 | FCR2537 | 2685 | FCR2660 |
| 2446 | FCR2198 | 2506 | FCR2290 | 2566 | FCR2414 | 2626 | fcr2538nn | 2686 | FCR2661 |
| 2447 | FCR2199 | 2507 | FCR2292 | 2567 | fcr2415n | 2627 | fcr2539nn | 2687 | FCR2662 |
| 2448 | FCR2200 | 2508 | FCR2293 | 2568 | FCR2416 | 2628 | FCR2540 | 2688 | fcr2664n |
| 2449 | FCR2201 | 2509 | FCR2294 | 2569 | FCR2417 | 2629 | FCR2541 | 2689 | FCR2665 |
| 2450 | fcr2202n | 2510 | FCR2295 | 2570 | FCR2418 | 2630 | FCR2542N | 2690 | FCR2667 |
| 2451 | FCR2203 | 2511 | FCR2296 | 2571 | FCR2419 | 2631 | FCR2543 | 2691 | FCR2669 |
| 2452 | FCR2207 | 2512 | FCR2297 | 2572 | FCR2420 | 2632 | FCR2546N | 2692 | FCR2671 |
| 2453 | FCR2208 | 2513 | fcr2298n | 2573 | FCR2421 | 2633 | FCR2547N | 2693 | FCR2672 |
| 2454 | FCR2209 | 2514 | FCR2299 | 2574 | FCR2424 | 2634 | fcr2554nn | 2694 | FCR2673 |
| 2455 | FCR2210 | 2515 | FCR2301 | 2575 | FCR2425 | 2635 | fcr2556n | 2695 | FCR2679 |
| 2456 | FCR2215 | 2516 | fcr2302n | 2576 | FCR2427 | 2636 | FCR2562 | 2696 | FCR2681 |
| 2457 | FCR2216 | 2517 | FCR2303 | 2577 | FCR2430 | 2637 | FCR2569 | 2697 | FCR2682N |
| 2458 | FCR2218 | 2518 | FCR2304N | 2578 | FCR2432N | 2638 | fcr2571n | 2698 | FCR2683 |
| 2459 | FCR2220 | 2519 | FCR2306 | 2579 | FCR2433 | 2639 | FCR2572 | 2699 | FCR2684 |
| 2460 | FCR2224 | 2520 | FCR2307 | 2580 | FCR2435 | 2640 | FCR2573 | 2700 | FCR2685 |

Figure 6B – List of EST Sequence Names From Fetal Cartilage cDNA Library

| | |
|---|---|
| 2701 | FCR2686 |
| 2702 | FCR2687 |
| 2703 | FCR2688 |
| 2704 | FCR2689 |
| 2705 | FCR2692 |
| 2706 | FCR2694 |
| 2707 | FCR2698 |
| 2708 | FCR2700 |
| 2709 | FCR2702 |
| 2710 | FCR2704 |
| 2711 | fcr2707nn |
| 2712 | FCR2711 |
| 2713 | FCR2712 |
| 2714 | FCR2714 |
| 2715 | FCR2716 |
| 2716 | FCR2718 |
| 2717 | FCR2719 |
| 2718 | FCR2720 |
| 2719 | FCR2721 |
| 2720 | FCR2722 |
| 2721 | FCR2724 |
| 2722 | FCR2726 |
| 2723 | FCR2727 |
| 2724 | FCR2729 |
| 2725 | fcr2732nn |
| 2726 | FCR2735 |
| 2727 | FCR2737 |
| 2728 | FCR2738 |
| 2729 | FCR2740 |
| 2730 | FCR2741 |
| 2731 | FCR2742N |
| 2732 | FCR2743 |
| 2733 | FCR2746 |
| 2734 | FCR2749 |
| 2735 | FCR2750 |
| 2736 | FCR2752N |
| 2737 | FCR2753 |
| 2738 | FCR2755 |
| 2739 | FCR2756 |
| 2740 | FCR2757 |
| 2741 | FCR2759 |
| 2742 | fcr2760nn |
| 2743 | FCR2761 |
| 2744 | FCR2762 |
| 2745 | FCR2763 |
| 2746 | fcr2764nn |
| 2747 | FCR2765 |
| 2748 | FCR2766 |
| 2749 | FCR2769 |
| 2750 | FCR2770 |
| 2751 | FCR2771 |
| 2752 | FCR2772 |
| 2753 | FCR2775N |
| 2754 | FCR2776 |
| 2755 | FCR2778 |
| 2756 | FCR2779 |
| 2757 | FCR2781 |
| 2758 | FCR2782 |
| 2759 | FCR2784N |
| 2760 | FCR2798 |
| 2761 | FCR2801 |
| 2762 | FCR2802 |
| 2763 | FCR2806 |
| 2764 | FCR2807 |
| 2765 | FCR2809 |
| 2766 | FCR2810 |
| 2767 | FCR2812 |
| 2768 | FCR2813 |
| 2769 | FCR2814N |
| 2770 | fcr2815nn |
| 2771 | FCR2817 |
| 2772 | FCR2818 |
| 2773 | FCR2821 |
| 2774 | FCR2822 |
| 2775 | FCR2823 |
| 2776 | FCR2824 |
| 2777 | FCR2836 |
| 2778 | FCR2838 |
| 2779 | FCR2840 |
| 2780 | FCR2841 |
| 2781 | FCR2842N |
| 2782 | FCR2848N |
| 2783 | FCR2853N |
| 2784 | FCR2859 |
| 2785 | FCR2860 |
| 2786 | FCR2861 |
| 2787 | FCR2864 |
| 2788 | FCR2867 |
| 2789 | FCR2868 |
| 2790 | FCR2869 |
| 2791 | FCR2872 |
| 2792 | FCR2873 |
| 2793 | FCR2877 |
| 2794 | FCR2878 |
| 2795 | FCR2882 |
| 2796 | FCR2883 |
| 2797 | FCR2884 |
| 2798 | FCR2885 |
| 2799 | FCR2886 |
| 2800 | FCR2889 |
| 2801 | FCR2890 |
| 2802 | FCR2891 |
| 2803 | FCR2892 |
| 2804 | FCR2893 |
| 2805 | FCR2896 |
| 2806 | FCR2897 |
| 2807 | fcr2898nn |
| 2808 | FCR2906 |
| 2809 | FCR2907 |
| 2810 | FCR2908 |
| 2811 | FCR2909 |
| 2812 | fcr2911n |
| 2813 | FCR2912N |
| 2814 | FCR2913N |
| 2815 | FCR2914N |
| 2816 | FCR2915 |
| 2817 | FCR2917 |
| 2818 | FCR2918 |
| 2819 | FCR2920 |
| 2820 | FCR2921 |
| 2821 | FCR2923 |
| 2822 | FCR2927 |
| 2823 | FCR2929 |
| 2824 | FCR2935 |
| 2825 | FCR2937 |
| 2826 | fcr2938n |
| 2827 | FCR2939N |
| 2828 | FCR2940 |
| 2829 | FCR2941 |
| 2830 | FCR2946 |
| 2831 | FCR2947 |
| 2832 | FCR2949 |
| 2833 | FCR2950 |
| 2834 | FCR2951 |
| 2835 | FCR2952 |
| 2836 | FCR2953 |
| 2837 | FCR2955 |
| 2838 | FCR2957 |
| 2839 | FCR2958 |
| 2840 | FCR2959 |
| 2841 | FCR2960 |
| 2842 | FCR2961 |
| 2843 | FCR2962 |
| 2844 | FCR2963 |
| 2845 | FCR2966 |
| 2846 | FCR2967 |
| 2847 | FCR2968 |
| 2848 | FCR2969 |
| 2849 | FCR2970 |
| 2850 | FCR2972 |
| 2851 | FCR2973 |
| 2852 | FCR2974 |
| 2853 | FCR2975 |
| 2854 | FCR2977 |
| 2855 | FCR2978 |
| 2856 | fcr2979n |
| 2857 | FCR2980 |
| 2858 | FCR2982 |
| 2859 | FCR2984 |
| 2860 | fcr2985n |
| 2861 | FCR2986 |
| 2862 | FCR2987 |
| 2863 | FCR2988 |
| 2864 | FCR2989 |
| 2865 | FCR2990 |
| 2866 | FCR2991 |
| 2867 | FCR2999 |
| 2868 | FCR3001 |
| 2869 | FCR3004N |
| 2870 | FCR3005 |
| 2871 | FCR3006 |
| 2872 | FCR3007 |
| 2873 | FCR3008 |
| 2874 | FCR3009 |
| 2875 | FCR3010 |
| 2876 | FCR3013 |
| 2877 | FCR3014 |
| 2878 | FCR3016 |
| 2879 | FCR3018 |
| 2880 | FCR3019 |
| 2881 | FCR3020 |
| 2882 | FCR3021 |
| 2883 | FCR3022 |
| 2884 | FCR3023 |
| 2885 | FCR3024N |
| 2886 | FCR3025 |
| 2887 | FCR3029 |
| 2888 | FCR3030 |
| 2889 | FCR3032 |
| 2890 | FCR3033 |
| 2891 | FCR3034 |
| 2892 | FCR3035 |
| 2893 | FCR3037N |
| 2894 | fcr3038 |
| 2895 | FCR3039 |
| 2896 | FCR3042 |
| 2897 | FCR3043 |
| 2898 | FCR3045 |
| 2899 | FCR3046N |
| 2900 | FCR3047 |
| 2901 | FCR3049 |
| 2902 | FCR3050 |
| 2903 | FCR3051 |
| 2904 | FCR3052N |
| 2905 | FCR3053 |
| 2906 | FCR3054 |
| 2907 | FCR3056 |
| 2908 | FCR3057 |
| 2909 | FCR3058 |
| 2910 | FCR3060 |
| 2911 | FCR3061 |
| 2912 | FCR3062 |
| 2913 | FCR3063 |
| 2914 | FCR3064 |
| 2915 | FCR3065 |
| 2916 | FCR3066 |
| 2917 | FCR3067 |
| 2918 | FCR3068 |
| 2919 | FCR3069 |
| 2920 | FCR3070 |
| 2921 | FCR3071 |
| 2922 | FCR3072N |
| 2923 | FCR3073 |
| 2924 | FCR3074 |
| 2925 | FCR3075N |
| 2926 | FCR3076 |
| 2927 | FCR3077 |
| 2928 | FCR3078 |
| 2929 | FCR3079 |
| 2930 | FCR3080 |
| 2931 | FCR3081 |
| 2932 | FCR3083 |
| 2933 | FCR3085N |
| 2934 | FCR3092 |
| 2935 | FCR3094 |
| 2936 | FCR3097 |
| 2937 | FCR3098 |
| 2938 | FCR3100 |
| 2939 | FCR3101 |
| 2940 | FCR3102 |
| 2941 | FCR3104 |
| 2942 | FCR3106 |
| 2943 | fcr3108 |
| 2944 | fcr3109 |
| 2945 | fcr3110 |
| 2946 | fcr3111 |
| 2947 | FCR3112 |
| 2948 | FCR3113 |
| 2949 | fcr3114 |
| 2950 | FCR3115N |
| 2951 | fcr3117 |
| 2952 | FCR3118 |
| 2953 | FCR3119 |
| 2954 | FCR3121 |
| 2955 | FCR3122 |
| 2956 | fcr3124n |
| 2957 | FCR3125 |
| 2958 | FCR3126 |
| 2959 | FCR3132 |
| 2960 | fcr3133 |
| 2961 | FCR3134N |
| 2962 | fcr3138 |
| 2963 | FCR3139 |
| 2964 | fcr3140 |
| 2965 | fcr3141 |
| 2966 | fcr3142 |
| 2967 | FCR3143 |
| 2968 | fcr3144 |
| 2969 | FCR3145 |
| 2970 | fcr3146 |
| 2971 | FCR3147N |
| 2972 | fcr3148 |
| 2973 | fcr3149 |
| 2974 | FCR3151 |
| 2975 | FCR3152 |
| 2976 | FCR3153 |
| 2977 | FCR3155 |
| 2978 | FCR3156 |
| 2979 | FCR3158 |
| 2980 | FCR3159 |
| 2981 | FCR3163 |
| 2982 | FCR3165 |
| 2983 | FCR3167 |
| 2984 | FCR3168 |
| 2985 | FCR3169 |
| 2986 | FCR3170 |
| 2987 | FCR3171 |
| 2988 | FCR3173N |
| 2989 | FCR3174 |
| 2990 | FCR3175 |
| 2991 | FCR3178 |
| 2992 | FCR3179 |
| 2993 | FCR3180 |
| 2994 | FCR3181 |
| 2995 | FCR3185 |
| 2996 | FCR3187 |
| 2997 | fcr3188 |
| 2998 | FCR3189 |
| 2999 | FCR3193 |
| 3000 | FCR3199 |

Figure 6B – List of EST Sequence Names From Fetal Cartilage cDNA Library

| | | | | | | | | | |
|---|---|---|---|---|---|---|---|---|---|
| 3001 | FCR3200 | 3061 | FCR3384 | 3121 | FCR3508 | 3181 | FCR3603 | 3241 | fcr3711N |
| 3002 | FCR3201 | 3062 | FCR3386 | 3122 | fcr3509n | 3182 | FCR3608 | 3242 | FCR3712 |
| 3003 | FCR3203 | 3063 | FCR3387 | 3123 | FCR3512 | 3183 | fcr3612n | 3243 | fcr3713n |
| 3004 | fcr3206n | 3064 | FCR3389 | 3124 | FCR3513 | 3184 | FCR3614 | 3244 | FCR3714 |
| 3005 | FCR3254 | 3065 | fcr3392n | 3125 | FCR3514 | 3185 | FCR3615 | 3245 | FCR3715 |
| 3006 | fcr3256 | 3066 | FCR3396 | 3126 | FCR3518 | 3186 | FCR3617 | 3246 | FCR3716 |
| 3007 | FCR3259 | 3067 | FCR3397 | 3127 | fcr3522n | 3187 | FCR3618 | 3247 | FCR3717 |
| 3008 | FCR3260 | 3068 | FCR3398 | 3128 | fcr3524n | 3188 | FCR3620 | 3248 | FCR3719 |
| 3009 | FCR3266 | 3069 | FCR3399 | 3129 | FCR3525 | 3189 | FCR3621 | 3249 | fcr3720n |
| 3010 | FCR3267 | 3070 | FCR3400 | 3130 | FCR3528 | 3190 | FCR3622 | 3250 | fcr3721n |
| 3011 | FCR3269 | 3071 | FCR3401 | 3131 | FCR3530 | 3191 | FCR3623 | 3251 | FCR3723 |
| 3012 | FCR3270 | 3072 | FCR3402 | 3132 | fcr3534n | 3192 | FCR3624 | 3252 | FCR3724 |
| 3013 | FCR3271 | 3073 | fcr3410 | 3133 | FCR3535 | 3193 | FCR3626 | 3253 | FCR3725 |
| 3014 | FCR3272 | 3074 | FCR3416 | 3134 | FCR3536 | 3194 | FCR3629 | 3254 | fcr3726n |
| 3015 | FCR3274 | 3075 | FCR3418 | 3135 | FCR3538 | 3195 | FCR3632 | 3255 | FCR3727 |
| 3016 | FCR3275 | 3076 | fcr3422 | 3136 | FCR3539 | 3196 | fcr3633 | 3256 | FCR3728 |
| 3017 | FCR3276 | 3077 | FCR3424 | 3137 | FCR3540 | 3197 | fcr3635n | 3257 | FCR3729 |
| 3018 | FCR3277 | 3078 | FCR3430 | 3138 | FCR3541 | 3198 | FCR3637 | 3258 | fcr3730 |
| 3019 | FCR3278 | 3079 | FCR3431 | 3139 | FCR3542 | 3199 | FCR3639 | 3259 | FCR3731 |
| 3020 | FCR3282 | 3080 | FCR3435 | 3140 | FCR3543 | 3200 | FCR3654 | 3260 | FCR3732 |
| 3021 | FCR3283 | 3081 | FCR3436 | 3141 | FCR3545 | 3201 | fcr3655n | 3261 | FCR3733 |
| 3022 | FCR3286 | 3082 | FCR3440 | 3142 | FCR3548 | 3202 | FCR3656 | 3262 | FCR3734 |
| 3023 | FCR3287 | 3083 | FCR3441 | 3143 | FCR3549 | 3203 | FCR3657 | 3263 | FCR3735 |
| 3024 | FCR3290 | 3084 | FCR3443 | 3144 | FCR3550 | 3204 | FCR3658 | 3264 | FCR3736 |
| 3025 | fcr3295 | 3085 | FCR3445 | 3145 | fcr3551n | 3205 | FCR3660 | 3265 | fcr3739n |
| 3026 | FCR3297 | 3086 | FCR3447 | 3146 | fcr3553n | 3206 | FCR3661 | 3266 | FCR3740 |
| 3027 | FCR3298 | 3087 | FCR3449 | 3147 | FCR3554 | 3207 | FCR3662 | 3267 | FCR3743 |
| 3028 | FCR3299 | 3088 | FCR3451 | 3148 | FCR3555 | 3208 | FCR3663 | 3268 | FCR3744 |
| 3029 | FCR3301 | 3089 | FCR3453 | 3149 | FCR3557 | 3209 | FCR3664 | 3269 | FCR3746 |
| 3030 | FCR3306 | 3090 | FCR3455 | 3150 | FCR3559 | 3210 | FCR3665 | 3270 | FCR3747 |
| 3031 | FCR3312 | 3091 | fcr3457n | 3151 | FCR3560 | 3211 | fcr3666 | 3271 | FCR3749 |
| 3032 | fcr3318n | 3092 | FCR3458 | 3152 | FCR3561 | 3212 | fcr3667n | 3272 | FCR3750 |
| 3033 | FCR3320 | 3093 | FCR3460 | 3153 | fcr3562n | 3213 | fcr3670n | 3273 | FCR3752 |
| 3034 | fcr3321n | 3094 | FCR3461 | 3154 | FCR3564 | 3214 | fcr3673 | 3274 | FCR3754 |
| 3035 | FCR3322 | 3095 | fcr3462 | 3155 | FCR3565 | 3215 | fcr3675n | 3275 | fcr3756 |
| 3036 | FCR3323 | 3096 | FCR3463 | 3156 | FCR3566 | 3216 | fcr3676n | 3276 | fcr3757 |
| 3037 | FCR3327 | 3097 | FCR3464 | 3157 | FCR3568 | 3217 | fcr3677n | 3277 | fcr3758 |
| 3038 | FCR3328 | 3098 | FCR3466 | 3158 | FCR3569 | 3218 | fcr3678n | 3278 | FCR3759 |
| 3039 | fcr3331n | 3099 | FCR3467 | 3159 | FCR3570 | 3219 | fcr3679n | 3279 | FCR3760 |
| 3040 | FCR3332 | 3100 | FCR3469 | 3160 | FCR3571 | 3220 | FCR3680 | 3280 | FCR3761 |
| 3041 | FCR3338 | 3101 | FCR3471 | 3161 | FCR3574 | 3221 | fcr3682n | 3281 | FCR3763 |
| 3042 | FCR3355 | 3102 | FCR3472 | 3162 | FCR3575 | 3222 | FCR3685 | 3282 | FCR3764 |
| 3043 | FCR3357 | 3103 | FCR3478 | 3163 | FCR3576 | 3223 | FCR3686 | 3283 | FCR3766 |
| 3044 | FCR3359 | 3104 | FCR3479 | 3164 | FCR3577 | 3224 | FCR3687 | 3284 | FCR3768 |
| 3045 | FCR3361 | 3105 | FCR3482 | 3165 | FCR3579 | 3225 | fcr3689 | 3285 | FCR3769 |
| 3046 | FCR3364 | 3106 | FCR3483 | 3166 | FCR3580 | 3226 | FCR3690 | 3286 | FCR3770 |
| 3047 | FCR3367 | 3107 | FCR3485 | 3167 | FCR3581 | 3227 | FCR3691 | 3287 | FCR3772 |
| 3048 | fcr3368n | 3108 | FCR3487 | 3168 | FCR3582 | 3228 | FCR3695 | 3288 | fcr3773 |
| 3049 | FCR3369 | 3109 | FCR3488 | 3169 | FCR3584 | 3229 | FCR3698 | 3289 | FCR3777 |
| 3050 | FCR3370 | 3110 | FCR3490 | 3170 | FCR3585 | 3230 | FCR3699 | 3290 | FCR3779 |
| 3051 | FCR3371 | 3111 | FCR3491 | 3171 | FCR3586 | 3231 | FCR3700 | 3291 | FCR3780 |
| 3052 | FCR3372 | 3112 | FCR3492 | 3172 | FCR3587 | 3232 | FCR3701 | 3292 | fcr3785n |
| 3053 | fcr3375n | 3113 | fcr3494n | 3173 | FCR3590 | 3233 | FCR3702 | 3293 | fcr3789n |
| 3054 | FCR3376 | 3114 | fcr3495n | 3174 | FCR3592 | 3234 | FCR3703 | 3294 | FCR3790 |
| 3055 | FCR3377 | 3115 | FCR3497 | 3175 | FCR3593 | 3235 | FCR3704 | 3295 | FCR3791 |
| 3056 | FCR3378 | 3116 | FCR3498 | 3176 | FCR3594 | 3236 | FCR3705 | 3296 | fcr3792 |
| 3057 | FCR3379 | 3117 | FCR3500 | 3177 | FCR3595 | 3237 | FCR3706 | 3297 | FCR3793 |
| 3058 | FCR3380 | 3118 | FCR3503 | 3178 | FCR3599 | 3238 | FCR3707 | 3298 | FCR3794 |
| 3059 | FCR3381 | 3119 | FCR3504 | 3179 | FCR3601 | 3239 | FCR3708 | 3299 | FCR3795 |
| 3060 | FCR3382 | 3120 | FCR3505 | 3180 | FCR3602 | 3240 | FCR3710 | 3300 | fcr3796 |

Figure 6B – List of EST Sequence Names From Fetal Cartilage cDNA Library

| | | | | | | | | | |
|---|---|---|---|---|---|---|---|---|---|
| 3301 | FCR3798 | 3361 | FCR3898 | 3421 | FCR4012 | 3481 | FCR4108 | 3541 | FCR4225 |
| 3302 | FCR3799 | 3362 | fcr3902 | 3422 | FCR4013 | 3482 | FCR4109 | 3542 | FCR4226 |
| 3303 | FCR3800 | 3363 | FCR3903 | 3423 | FCR4014 | 3483 | FCR4110 | 3543 | FCR4227 |
| 3304 | fcr3802N | 3364 | fcr3904n | 3424 | FCR4015 | 3484 | FCR4111 | 3544 | FCR4228 |
| 3305 | FCR3803 | 3365 | FCR3907 | 3425 | FCR4016N | 3485 | FCR4112 | 3545 | FCR4232 |
| 3306 | fcr3805n | 3366 | fcr3908 | 3426 | FCR4017 | 3486 | FCR4113 | 3546 | fcr4233 |
| 3307 | fcr3806n | 3367 | FCR3909 | 3427 | FCR4018 | 3487 | fcr4114n | 3547 | FCR4238 |
| 3308 | fcr3809n | 3368 | FCR3910 | 3428 | FCR4019 | 3488 | FCR4116 | 3548 | FCR4240 |
| 3309 | fcr3810N | 3369 | FCR3911 | 3429 | FCR4020 | 3489 | FCR4117 | 3549 | fcr4242n |
| 3310 | FCR3812 | 3370 | FCR3912 | 3430 | fcr4021nn | 3490 | fcr4118nn | 3550 | FCR4243 |
| 3311 | FCR3813 | 3371 | fcr3913n | 3431 | FCR4022 | 3491 | FCR4125 | 3551 | FCR4246 |
| 3312 | fcr3815N | 3372 | fcr3914n | 3432 | FCR4024 | 3492 | FCR4127N | 3552 | fcr4259 |
| 3313 | FCR3816 | 3373 | FCR3915 | 3433 | FCR4026 | 3493 | FCR4128 | 3553 | FCR4260 |
| 3314 | fcr3817n | 3374 | FCR3916N | 3434 | FCR4027 | 3494 | FCR4129 | 3554 | FCR4264 |
| 3315 | FCR3818 | 3375 | FCR3918 | 3435 | FCR4029 | 3495 | FCR4131 | 3555 | FCR4266 |
| 3316 | FCR3819 | 3376 | FCR3919N | 3436 | FCR4030 | 3496 | FCR4134 | 3556 | FCR4271 |
| 3317 | FCR3821 | 3377 | FCR3920 | 3437 | FCR4031N | 3497 | FCR4135 | 3557 | FCR4272 |
| 3318 | FCR3822 | 3378 | FCR3922 | 3438 | FCR4033 | 3498 | FCR4137 | 3558 | FCR4274 |
| 3319 | FCR3823 | 3379 | fcr3924 | 3439 | FCR4034 | 3499 | FCR4138 | 3559 | fcr4275 |
| 3320 | FCR3825 | 3380 | FCR3928 | 3440 | FCR4035 | 3500 | fcr4141nn | 3560 | FCR4278 |
| 3321 | FCR3826 | 3381 | FCR3932 | 3441 | FCR4037 | 3501 | FCR4143 | 3561 | FCR4280 |
| 3322 | fcr3827 | 3382 | FCR3934 | 3442 | FCR4039 | 3502 | FCR4146 | 3562 | FCR4281 |
| 3323 | FCR3829 | 3383 | FCR3936 | 3443 | FCR4040 | 3503 | FCR4147 | 3563 | FCR4283 |
| 3324 | FCR3831 | 3384 | FCR3939 | 3444 | FCR4043 | 3504 | FCR4148 | 3564 | FCR4285 |
| 3325 | FCR3832 | 3385 | FCR3940 | 3445 | FCR4044 | 3505 | FCR4149 | 3565 | fcr4286n |
| 3326 | FCR3833 | 3386 | FCR3941 | 3446 | FCR4045 | 3506 | FCR4150 | 3566 | FCR4287 |
| 3327 | FCR3835 | 3387 | FCR3943 | 3447 | FCR4046 | 3507 | FCR4152 | 3567 | FCR4289 |
| 3328 | fcr3837N | 3388 | FCR3944 | 3448 | FCR4048 | 3508 | FCR4154 | 3568 | FCR4292 |
| 3329 | FCR3839 | 3389 | fcr3945n | 3449 | FCR4049 | 3509 | FCR4155 | 3569 | FCR4294 |
| 3330 | FCR3840 | 3390 | FCR3946 | 3450 | FCR4051 | 3510 | fcr4157n | 3570 | FCR4295 |
| 3331 | FCR3841 | 3391 | FCR3947N | 3451 | FCR4052 | 3511 | FCR4159 | 3571 | FCR4298 |
| 3332 | FCR3843 | 3392 | FCR3948 | 3452 | FCR4056 | 3512 | FCR4160 | 3572 | FCR4299 |
| 3333 | FCR3845 | 3393 | FCR3949 | 3453 | FCR4057 | 3513 | FCR4163 | 3573 | fcr4300 |
| 3334 | fcr3847 | 3394 | FCR3950 | 3454 | FCR4058 | 3514 | FCR4164 | 3574 | FCR4301 |
| 3335 | fcr3849n | 3395 | FCR3951 | 3455 | FCR4059 | 3515 | FCR4166 | 3575 | FCR4302 |
| 3336 | fcr3851n | 3396 | FCR3952N | 3456 | FCR4060 | 3516 | FCR4167 | 3576 | FCR4304 |
| 3337 | fcr3852n | 3397 | FCR3953 | 3457 | FCR4062 | 3517 | FCR4172 | 3577 | FCR4305 |
| 3338 | fcr3853 | 3398 | FCR3955 | 3458 | fcr4063n | 3518 | FCR4174 | 3578 | FCR4306 |
| 3339 | FCR3856 | 3399 | FCR3957 | 3459 | FCR4065 | 3519 | FCR4175 | 3579 | FCR4308 |
| 3340 | FCR3857 | 3400 | FCR3960N | 3460 | FCR4071 | 3520 | FCR4181 | 3580 | FCR4311 |
| 3341 | FCR3858 | 3401 | FCR3962 | 3461 | FCR4072 | 3521 | FCR4198 | 3581 | FCR4313 |
| 3342 | FCR3861 | 3402 | FCR3972 | 3462 | FCR4073N | 3522 | FCR4201 | 3582 | FCR4315 |
| 3343 | fcr3863N | 3403 | FCR3973 | 3463 | fcr4075n | 3523 | FCR4203 | 3583 | FCR4316 |
| 3344 | FCR3865 | 3404 | FCR3974 | 3464 | FCR4076 | 3524 | FCR4205 | 3584 | FCR4318 |
| 3345 | FCR3867 | 3405 | FCR3977 | 3465 | FCR4078 | 3525 | FCR4206 | 3585 | FCR4319 |
| 3346 | FCR3868 | 3406 | FCR3981 | 3466 | FCR4079 | 3526 | FCR4207 | 3586 | FCR4324 |
| 3347 | fcr3869 | 3407 | fcr3982nn | 3467 | FCR4082 | 3527 | FCR4208 | 3587 | FCR4326 |
| 3348 | fcr3869n | 3408 | FCR3983 | 3468 | FCR4084 | 3528 | FCR4209 | 3588 | FCR4328 |
| 3349 | FCR3877 | 3409 | fcr3984nn | 3469 | FCR4085 | 3529 | fcr4210n | 3589 | FCR4330 |
| 3350 | FCR3878 | 3410 | FCR3985 | 3470 | FCR4086 | 3530 | FCR4211 | 3590 | FCR4331 |
| 3351 | FCR3879 | 3411 | FCR3986 | 3471 | FCR4089 | 3531 | FCR4212 | 3591 | FCR4332 |
| 3352 | FCR3880 | 3412 | FCR3987 | 3472 | fcr4090nn | 3532 | FCR4213 | 3592 | FCR4333 |
| 3353 | FCR3883 | 3413 | fcr3988n | 3473 | FCR4092 | 3533 | FCR4214 | 3593 | FCR4334 |
| 3354 | FCR3884 | 3414 | FCR3990 | 3474 | FCR4095 | 3534 | FCR4215 | 3594 | FCR4336N |
| 3355 | FCR3885 | 3415 | FCR3993 | 3475 | FCR4096 | 3535 | FCR4216 | 3595 | fcr4337n |
| 3356 | FCR3889 | 3416 | FCR4006 | 3476 | FCR4097 | 3536 | FCR4218 | 3596 | FCR4340 |
| 3357 | FCR3890 | 3417 | FCR4007 | 3477 | FCR4099 | 3537 | fcr4219n | 3597 | FCR4341 |
| 3358 | FCR3892 | 3418 | FCR4009 | 3478 | FCR4101 | 3538 | FCR4220 | 3598 | FCR4342 |
| 3359 | FCR3894 | 3419 | FCR4010 | 3479 | FCR4106 | 3539 | FCR4221 | 3599 | FCR4344 |
| 3360 | FCR3897 | 3420 | FCR4011 | 3480 | FCR4107 | 3540 | FCR4224 | 3600 | FCR4347N |

Figure 6B – List of EST Sequence Names From Fetal Cartilage cDNA Library

| | | | | | | | | | |
|---|---|---|---|---|---|---|---|---|---|
| 3601 | FCR4348 | 3661 | FCR4442 | 3721 | FCR4597 | 3781 | FCR4684 | 3841 | FCR4775 |
| 3602 | FCR4349 | 3662 | FCR4443 | 3722 | FCR4600 | 3782 | FCR4685 | 3842 | FCR4778 |
| 3603 | FCR4350 | 3663 | FCR4444 | 3723 | FCR4604 | 3783 | FCR4686 | 3843 | FCR4779 |
| 3604 | fcr4351n | 3664 | FCR4446 | 3724 | FCR4605 | 3784 | FCR4688 | 3844 | FCR4781 |
| 3605 | FCR4353N | 3665 | FCR4447 | 3725 | FCR4606 | 3785 | FCR4690 | 3845 | FCR4782 |
| 3606 | FCR4354 | 3666 | FCR4449 | 3726 | FCR4607 | 3786 | FCR4691 | 3846 | FCR4783 |
| 3607 | FCR4355 | 3667 | FCR4450 | 3727 | FCR4608 | 3787 | FCR4693 | 3847 | FCR4784 |
| 3608 | FCR4357 | 3668 | fcr4457n | 3728 | FCR4609 | 3788 | FCR4695 | 3848 | FCR4785 |
| 3609 | FCR4359 | 3669 | FCR4459 | 3729 | FCR4610 | 3789 | FCR4697 | 3849 | FCR4786 |
| 3610 | FCR4361 | 3670 | FCR4460 | 3730 | FCR4612 | 3790 | FCR4699 | 3850 | FCR4787 |
| 3611 | FCR4363 | 3671 | fcr4463n | 3731 | fcr4613 | 3791 | FCR4700 | 3851 | FCR4790 |
| 3612 | FCR4364 | 3672 | FCR4465 | 3732 | FCR4614 | 3792 | FCR4702 | 3852 | fcr4791 |
| 3613 | FCR4365 | 3673 | fcr4466n | 3733 | FCR4615 | 3793 | FCR4703 | 3853 | FCR4792 |
| 3614 | FCR4366 | 3674 | FCR4467 | 3734 | FCR4616 | 3794 | FCR4704 | 3854 | FCR4794 |
| 3615 | FCR4367 | 3675 | FCR4468 | 3735 | FCR4617 | 3795 | FCR4705 | 3855 | FCR4795 |
| 3616 | FCR4368 | 3676 | FCR4469 | 3736 | FCR4618 | 3796 | FCR4717 | 3856 | FCR4799 |
| 3617 | FCR4370 | 3677 | FCR4471 | 3737 | FCR4620 | 3797 | FCR4719 | 3857 | FCR4800 |
| 3618 | FCR4371 | 3678 | FCR4473 | 3738 | FCR4621 | 3798 | FCR4720 | 3858 | FCR4801 |
| 3619 | fcr4372n | 3679 | FCR4474 | 3739 | FCR4622 | 3799 | FCR4721 | 3859 | FCR4802 |
| 3620 | FCR4373 | 3680 | FCR4475 | 3740 | FCR4623 | 3800 | FCR4722 | 3860 | FCR4803 |
| 3621 | FCR4376 | 3681 | FCR4477 | 3741 | FCR4624 | 3801 | FCR4723 | 3861 | FCR4804 |
| 3622 | FCR4378 | 3682 | FCR4480 | 3742 | FCR4626 | 3802 | FCR4724 | 3862 | FCR4805 |
| 3623 | FCR4379 | 3683 | FCR4483 | 3743 | FCR4628 | 3803 | FCR4725 | 3863 | FCR4806 |
| 3624 | FCR4380 | 3684 | FCR4485 | 3744 | FCR4629 | 3804 | FCR4726 | 3864 | FCR4808 |
| 3625 | FCR4382 | 3685 | FCR4486 | 3745 | FCR4631 | 3805 | FCR4727 | 3865 | fcr4809 |
| 3626 | FCR4385 | 3686 | FCR4487 | 3746 | FCR4632 | 3806 | FCR4729 | 3866 | FCR4810 |
| 3627 | FCR4386 | 3687 | FCR4489 | 3747 | FCR4633 | 3807 | FCR4730 | 3867 | FCR4811 |
| 3628 | FCR4388N | 3688 | FCR4490 | 3748 | FCR4634 | 3808 | FCR4732 | 3868 | FCR4813 |
| 3629 | FCR4390 | 3689 | FCR4494 | 3749 | FCR4637 | 3809 | FCR4733 | 3869 | FCR4814 |
| 3630 | FCR4393 | 3690 | FCR4495 | 3750 | FCR4638 | 3810 | FCR4735 | 3870 | FCR4816 |
| 3631 | fcr4394nn | 3691 | FCR4496 | 3751 | FCR4639 | 3811 | FCR4737 | 3871 | FCR4817 |
| 3632 | FCR4395N | 3692 | FCR4497 | 3752 | FCR4640 | 3812 | FCR4738 | 3872 | FCR4818 |
| 3633 | FCR4397 | 3693 | FCR4498 | 3753 | FCR4641 | 3813 | FCR4740 | 3873 | FCR4819 |
| 3634 | FCR4398 | 3694 | FCR4500 | 3754 | fcr4642 | 3814 | FCR4741 | 3874 | FCR4820 |
| 3635 | FCR4399 | 3695 | FCR4502 | 3755 | fcr4644 | 3815 | FCR4742 | 3875 | FCR4821 |
| 3636 | FCR4400 | 3696 | FCR4503 | 3756 | fcr4648 | 3816 | FCR4743 | 3876 | FCR4822 |
| 3637 | FCR4401 | 3697 | FCR4505 | 3757 | FCR4649 | 3817 | FCR4745 | 3877 | FCR4823 |
| 3638 | FCR4402 | 3698 | FCR4506 | 3758 | FCR4650 | 3818 | FCR4746 | 3878 | FCR4824 |
| 3639 | fcr4403 | 3699 | fcr4559 | 3759 | FCR4651 | 3819 | FCR4747 | 3879 | FCR4825 |
| 3640 | FCR4404 | 3700 | FCR4560 | 3760 | FCR4652 | 3820 | FCR4749 | 3880 | FCR4829 |
| 3641 | FCR4405 | 3701 | fcr4562 | 3761 | FCR4654 | 3821 | FCR4752 | 3881 | FCR4831 |
| 3642 | FCR4406 | 3702 | FCR4566 | 3762 | FCR4655 | 3822 | FCR4753 | 3882 | FCR4832 |
| 3643 | FCR4409 | 3703 | FCR4568 | 3763 | fcr4656 | 3823 | FCR4754 | 3883 | FCR4833 |
| 3644 | FCR4410 | 3704 | FCR4569 | 3764 | FCR4660 | 3824 | FCR4755 | 3884 | FCR4834 |
| 3645 | FCR4411 | 3705 | FCR4570 | 3765 | FCR4661 | 3825 | FCR4758 | 3885 | FCR4836 |
| 3646 | FCR4412 | 3706 | FCR4573 | 3766 | fcr4665 | 3826 | FCR4759 | 3886 | FCR4838 |
| 3647 | FCR4413 | 3707 | FCR4574 | 3767 | FCR4667 | 3827 | FCR4760 | 3887 | FCR4839 |
| 3648 | FCR4414 | 3708 | FCR4575 | 3768 | FCR4669 | 3828 | fcr4761 | 3888 | FCR4840 |
| 3649 | FCR4415 | 3709 | FCR4576 | 3769 | fcr4670 | 3829 | FCR4762 | 3889 | FCR4842 |
| 3650 | FCR4416 | 3710 | FCR4577 | 3770 | fcr4671 | 3830 | FCR4763 | 3890 | FCR4843 |
| 3651 | FCR4417 | 3711 | FCR4578 | 3771 | fcr4673 | 3831 | FCR4764 | 3891 | fcr4844n |
| 3652 | FCR4419 | 3712 | FCR4579 | 3772 | FCR4674 | 3832 | FCR4765 | 3892 | FCR4845 |
| 3653 | FCR4432 | 3713 | FCR4582 | 3773 | FCR4675 | 3833 | FCR4766 | 3893 | FCR4846 |
| 3654 | FCR4433 | 3714 | FCR4583 | 3774 | FCR4676 | 3834 | FCR4767 | 3894 | FCR4848 |
| 3655 | FCR4434 | 3715 | FCR4584 | 3775 | FCR4677 | 3835 | FCR4768 | 3895 | FCR4849 |
| 3656 | FCR4435 | 3716 | FCR4589 | 3776 | fcr4678n | 3836 | FCR4769 | 3896 | FCR4850 |
| 3657 | FCR4436 | 3717 | FCR4592 | 3777 | FCR4679 | 3837 | FCR4770 | 3897 | FCR4851 |
| 3658 | FCR4437 | 3718 | FCR4594 | 3778 | FCR4680 | 3838 | FCR4771 | 3898 | FCR4852 |
| 3659 | FCR4438 | 3719 | FCR4595 | 3779 | FCR4681 | 3839 | FCR4772 | 3899 | FCR4853 |
| 3660 | FCR4440 | 3720 | FCR4596 | 3780 | FCR4682 | 3840 | FCR4773 | 3900 | FCR4854 |

Figure 6B – List of EST Sequence Names From Fetal Cartilage cDNA Library

| | | | | | | | | | |
|---|---|---|---|---|---|---|---|---|---|
| 3901 | FCR4856 | 3961 | FCR4930 | 4021 | FCR5015 | 4081 | FCR5112 | 4141 | FCR5199 |
| 3902 | FCR4857 | 3962 | FCR4931 | 4022 | FCR5016 | 4082 | FCR5113 | 4142 | FCR5200 |
| 3903 | FCR4858 | 3963 | FCR4932 | 4023 | fcr5017 | 4083 | FCR5115 | 4143 | FCR5201 |
| 3904 | FCR4860 | 3964 | FCR4934 | 4024 | FCR5019 | 4084 | FCR5116 | 4144 | FCR5203 |
| 3905 | FCR4861 | 3965 | fcr4935 | 4025 | FCR5020 | 4085 | FCR5117 | 4145 | FCR5204 |
| 3906 | FCR4862 | 3966 | fcr4936n | 4026 | FCR5021 | 4086 | FCR5119 | 4146 | FCR5207 |
| 3907 | FCR4863 | 3967 | FCR4937 | 4027 | FCR5023 | 4087 | fcr5120n | 4147 | FCR5208 |
| 3908 | FCR4864 | 3968 | FCR4938 | 4028 | FCR5024 | 4088 | FCR5121 | 4148 | FCR5209 |
| 3909 | FCR4865 | 3969 | FCR4941 | 4029 | FCR5025 | 4089 | FCR5123 | 4149 | FCR5211 |
| 3910 | FCR4866 | 3970 | fcr4942 | 4030 | FCR5026 | 4090 | FCR5124 | 4150 | FCR5212 |
| 3911 | FCR4867 | 3971 | fcr4942r | 4031 | FCR5027 | 4091 | FCR5125 | 4151 | FCR5213 |
| 3912 | FCR4868 | 3972 | fcr4943 | 4032 | FCR5029 | 4092 | FCR5126 | 4152 | FCR5214 |
| 3913 | FCR4869 | 3973 | fcr4944 | 4033 | fcr5031 | 4093 | FCR5127 | 4153 | FCR5216 |
| 3914 | FCR4870 | 3974 | FCR4945 | 4034 | FCR5032 | 4094 | fcr5129 | 4154 | FCR5217 |
| 3915 | FCR4871 | 3975 | FCR4946 | 4035 | FCR5033 | 4095 | FCR5131 | 4155 | FCR5218 |
| 3916 | FCR4872 | 3976 | fcr4947 | 4036 | FCR5035 | 4096 | fcr5132 | 4156 | FCR5220 |
| 3917 | FCR4873 | 3977 | FCR4948 | 4037 | FCR5040 | 4097 | FCR5133 | 4157 | FCR5221 |
| 3918 | fcr4874n | 3978 | FCR4949 | 4038 | FCR5045 | 4098 | FCR5136 | 4158 | FCR5222 |
| 3919 | FCR4875 | 3979 | FCR4950 | 4039 | FCR5047 | 4099 | FCR5137 | 4159 | FCR5223 |
| 3920 | FCR4876 | 3980 | FCR4951 | 4040 | FCR5048 | 4100 | FCR5138 | 4160 | fcr5224n |
| 3921 | FCR4877 | 3981 | FCR4952 | 4041 | FCR5050 | 4101 | fcr5139n | 4161 | FCR5226 |
| 3922 | FCR4878 | 3982 | FCR4953 | 4042 | fcr5055 | 4102 | fcr5140 | 4162 | FCR5228 |
| 3923 | FCR4879 | 3983 | FCR4954 | 4043 | FCR5056 | 4103 | FCR5141 | 4163 | FCR5229 |
| 3924 | FCR4880 | 3984 | FCR4955 | 4044 | FCR5057 | 4104 | FCR5144 | 4164 | fcr5231n |
| 3925 | FCR4881 | 3985 | FCR4956 | 4045 | FCR5058 | 4105 | FCR5145 | 4165 | FCR5245 |
| 3926 | FCR4884 | 3986 | FCR4957 | 4046 | FCR5059 | 4106 | FCR5149 | 4166 | FCR5246 |
| 3927 | FCR4885 | 3987 | FCR4958 | 4047 | FCR5063 | 4107 | fcr5150n | 4167 | FCR5247 |
| 3928 | FCR4886 | 3988 | FCR4959 | 4048 | FCR5064 | 4108 | FCR5151 | 4168 | FCR5250 |
| 3929 | FCR4888 | 3989 | FCR4961 | 4049 | FCR5065 | 4109 | FCR5152 | 4169 | FCR5251 |
| 3930 | FCR4889 | 3990 | FCR4965 | 4050 | FCR5066 | 4110 | fcr5153n | 4170 | FCR5257 |
| 3931 | FCR4890 | 3991 | FCR4966 | 4051 | FCR5067 | 4111 | FCR5154 | 4171 | FCR5259 |
| 3932 | FCR4891 | 3992 | FCR4967 | 4052 | FCR5068 | 4112 | FCR5155 | 4172 | FCR5261 |
| 3933 | FCR4892 | 3993 | fcr4968 | 4053 | fcr5071 | 4113 | FCR5156 | 4173 | FCR5262 |
| 3934 | fcr4893 | 3994 | FCR4970 | 4054 | FCR5072 | 4114 | FCR5157 | 4174 | FCR5263 |
| 3935 | FCR4895 | 3995 | FCR4971 | 4055 | FCR5073 | 4115 | FCR5158 | 4175 | fcr5266n |
| 3936 | FCR4896 | 3996 | FCR4974 | 4056 | FCR5074 | 4116 | FCR5160 | 4176 | FCR5267 |
| 3937 | FCR4897 | 3997 | fcr4976n | 4057 | FCR5075 | 4117 | FCR5161 | 4177 | FCR5268 |
| 3938 | FCR4898 | 3998 | FCR4978 | 4058 | FCR5076 | 4118 | FCR5163 | 4178 | fcr5270n |
| 3939 | FCR4899 | 3999 | FCR4979 | 4059 | FCR5077 | 4119 | FCR5165 | 4179 | FCR5271 |
| 3940 | FCR4900 | 4000 | FCR4980 | 4060 | FCR5080 | 4120 | FCR5167 | 4180 | FCR5272 |
| 3941 | FCR4901 | 4001 | FCR4981 | 4061 | FCR5081 | 4121 | FCR5168 | 4181 | FCR5273 |
| 3942 | FCR4902 | 4002 | FCR4982 | 4062 | FCR5082 | 4122 | FCR5169 | 4182 | FCR5281 |
| 3943 | FCR4903 | 4003 | FCR4983 | 4063 | FCR5083 | 4123 | FCR5170 | 4183 | FCR5282 |
| 3944 | FCR4904 | 4004 | FCR4984 | 4064 | FCR5084 | 4124 | fcr5171 | 4184 | FCR5283 |
| 3945 | FCR4906 | 4005 | FCR4985 | 4065 | FCR5085 | 4125 | FCR5175 | 4185 | FCR5284 |
| 3946 | FCR4907 | 4006 | FCR4988 | 4066 | FCR5087 | 4126 | FCR5176 | 4186 | fcr5285n |
| 3947 | FCR4909 | 4007 | fcr4991 | 4067 | FCR5088 | 4127 | FCR5179 | 4187 | FCR5286 |
| 3948 | FCR4911 | 4008 | fcr4992n | 4068 | FCR5090 | 4128 | FCR5180 | 4188 | FCR5288 |
| 3949 | FCR4913 | 4009 | FCR4996 | 4069 | FCR5091 | 4129 | FCR5181 | 4189 | FCR5289 |
| 3950 | FCR4914 | 4010 | FCR4997 | 4070 | FCR5092 | 4130 | FCR5182 | 4190 | FCR5291 |
| 3951 | FCR4915 | 4011 | FCR4999 | 4071 | FCR5093 | 4131 | FCR5183 | 4191 | fcr5292 |
| 3952 | FCR4916 | 4012 | FCR5000 | 4072 | FCR5096 | 4132 | FCR5188 | 4192 | fcr5293n |
| 3953 | FCR4920 | 4013 | FCR5002 | 4073 | FCR5098 | 4133 | FCR5189 | 4193 | FCR5297 |
| 3954 | FCR4921 | 4014 | FCR5004 | 4074 | FCR5099 | 4134 | FCR5190 | 4194 | FCR5301 |
| 3955 | FCR4922 | 4015 | FCR5006 | 4075 | FCR5100 | 4135 | FCR5191 | 4195 | fcr5315 |
| 3956 | FCR4924 | 4016 | FCR5007 | 4076 | fcr5101 | 4136 | FCR5192 | 4196 | FCR5316 |
| 3957 | FCR4925 | 4017 | FCR5008 | 4077 | fcr5105 | 4137 | FCR5193 | 4197 | FCR5317 |
| 3958 | FCR4926 | 4018 | FCR5009 | 4078 | fcr5107 | 4138 | FCR5194 | 4198 | FCR5318 |
| 3959 | FCR4927 | 4019 | fcr5011 | 4079 | FCR5108 | 4139 | FCR5196 | 4199 | FCR5320 |
| 3960 | FCR4928 | 4020 | FCR5014 | 4080 | FCR5111 | 4140 | FCR5198 | 4200 | FCR5322 |

Figure 6B - List of EST Sequence Names From Fetal Cartilage cDNA Library

| | | | | | | | | | |
|---|---|---|---|---|---|---|---|---|---|
| 4201 | fcr5323n | 4261 | FCR5418 | 4321 | FCR5517 | 4381 | FCR5650 | 4441 | FCR5749 |
| 4202 | FCR5324 | 4262 | FCR5420 | 4322 | FCR5518 | 4382 | FCR5652 | 4442 | FCR5750 |
| 4203 | FCR5326 | 4263 | FCR5421 | 4323 | FCR5519 | 4383 | fcr5653 | 4443 | FCR5751 |
| 4204 | FCR5327 | 4264 | FCR5422 | 4324 | FCR5522 | 4384 | fcr5653nr | 4444 | fcr5752 |
| 4205 | fcr5328n | 4265 | fcr5425 | 4325 | FCR5523 | 4385 | FCR5654 | 4445 | FCR5753 |
| 4206 | FCR5329 | 4266 | FCR5426 | 4326 | FCR5524 | 4386 | fcr5659n | 4446 | FCR5755 |
| 4207 | FCR5330 | 4267 | FCR5427 | 4327 | FCR5525 | 4387 | FCR5660 | 4447 | FCR5756 |
| 4208 | FCR5331 | 4268 | fcr5428 | 4328 | FCR5529 | 4388 | FCR5661 | 4448 | FCR5758 |
| 4209 | FCR5332 | 4269 | fcr5431 | 4329 | FCR5530 | 4389 | FCR5663 | 4449 | FCR5759 |
| 4210 | FCR5333 | 4270 | FCR5436 | 4330 | FCR5532 | 4390 | FCR5664 | 4450 | FCR5760 |
| 4211 | FCR5334 | 4271 | FCR5437 | 4331 | FCR5533 | 4391 | FCR5665 | 4451 | FCR5761 |
| 4212 | FCR5336 | 4272 | FCR5438 | 4332 | FCR5534 | 4392 | FCR5668 | 4452 | FCR5762 |
| 4213 | FCR5337 | 4273 | FCR5440 | 4333 | FCR5536 | 4393 | FCR5669 | 4453 | FCR5763 |
| 4214 | FCR5338 | 4274 | FCR5442 | 4334 | FCR5537 | 4394 | FCR5670 | 4454 | FCR5764 |
| 4215 | FCR5339 | 4275 | FCR5443 | 4335 | FCR5539 | 4395 | fcr5672 | 4455 | FCR5766 |
| 4216 | FCR5340 | 4276 | fcr5445 | 4336 | FCR5541 | 4396 | FCR5675 | 4456 | FCR5767 |
| 4217 | FCR5342 | 4277 | fcr5446n | 4337 | FCR5543 | 4397 | FCR5677 | 4457 | fcr5769 |
| 4218 | FCR5343 | 4278 | FCR5447 | 4338 | FCR5559 | 4398 | FCR5679 | 4458 | FCR5770 |
| 4219 | fcr5344 | 4279 | fcr5448n | 4339 | FCR5560 | 4399 | fcr5680 | 4459 | FCR5771 |
| 4220 | FCR5345 | 4280 | fcr5449 | 4340 | fcr5561 | 4400 | FCR5681 | 4460 | fcr5774n |
| 4221 | FCR5347 | 4281 | FCR5453 | 4341 | fcr5563 | 4401 | FCR5683 | 4461 | FCR5775 |
| 4222 | FCR5348 | 4282 | FCR5455 | 4342 | FCR5571 | 4402 | FCR5685 | 4462 | FCR5777 |
| 4223 | FCR5349 | 4283 | FCR5456 | 4343 | FCR5572 | 4403 | fcr5686n | 4463 | FCR5778 |
| 4224 | FCR5350 | 4284 | FCR5460 | 4344 | FCR5574 | 4404 | FCR5687 | 4464 | FCR5779 |
| 4225 | FCR5351 | 4285 | fcr5461 | 4345 | FCR5575 | 4405 | FCR5689 | 4465 | fcr5780 |
| 4226 | fcr5353 | 4286 | FCR5462 | 4346 | FCR5579 | 4406 | fcr5690n | 4466 | FCR5786 |
| 4227 | FCR5354 | 4287 | fcr5463 | 4347 | FCR5580 | 4407 | FCR5699 | 4467 | FCR5788 |
| 4228 | FCR5355 | 4288 | fcr5464 | 4348 | FCR5581 | 4408 | FCR5701 | 4468 | fcr5789 |
| 4229 | fcr5358 | 4289 | fcr5467 | 4349 | FCR5582 | 4409 | FCR5702 | 4469 | FCR5790 |
| 4230 | FCR5359 | 4290 | FCR5468 | 4350 | FCR5584 | 4410 | FCR5703 | 4470 | FCR5791 |
| 4231 | FCR5360 | 4291 | FCR5469 | 4351 | FCR5585 | 4411 | FCR5704 | 4471 | FCR5792 |
| 4232 | FCR5362 | 4292 | FCR5470 | 4352 | FCR5586 | 4412 | FCR5707 | 4472 | FCR5793 |
| 4233 | FCR5363 | 4293 | FCR5471 | 4353 | FCR5587 | 4413 | FCR5708 | 4473 | FCR5794 |
| 4234 | FCR5365 | 4294 | FCR5472 | 4354 | FCR5589 | 4414 | fcr5710 | 4474 | FCR5795 |
| 4235 | FCR5366 | 4295 | FCR5474 | 4355 | fcr5591 | 4415 | FCR5711 | 4475 | FCR5796 |
| 4236 | FCR5369 | 4296 | fcr5475 | 4356 | FCR5594 | 4416 | FCR5712 | 4476 | FCR5797 |
| 4237 | FCR5371 | 4297 | fcr5476 | 4357 | FCR5595 | 4417 | FCR5713 | 4477 | FCR5798 |
| 4238 | FCR5373 | 4298 | FCR5477 | 4358 | FCR5596 | 4418 | FCR5714 | 4478 | FCR5799 |
| 4239 | FCR5374 | 4299 | FCR5478 | 4359 | fcr5612 | 4419 | FCR5715 | 4479 | FCR5800 |
| 4240 | FCR5376 | 4300 | FCR5479 | 4360 | fcr5615 | 4420 | FCR5716 | 4480 | FCR5801 |
| 4241 | FCR5378 | 4301 | fcr5481 | 4361 | fcr5615r | 4421 | FCR5717 | 4481 | FCR5802 |
| 4242 | FCR5380 | 4302 | FCR5482 | 4362 | FCR5617 | 4422 | FCR5719 | 4482 | FCR5803 |
| 4243 | fcr5381n | 4303 | FCR5483 | 4363 | FCR5618 | 4423 | FCR5720 | 4483 | FCR5804 |
| 4244 | FCR5382 | 4304 | fcr5484 | 4364 | FCR5619 | 4424 | FCR5721 | 4484 | FCR5805 |
| 4245 | FCR5384 | 4305 | FCR5486 | 4365 | FCR5620 | 4425 | FCR5722 | 4485 | FCR5807 |
| 4246 | fcr5387n | 4306 | fcr5488 | 4366 | fcr5621 | 4426 | FCR5723 | 4486 | FCR5808 |
| 4247 | FCR5391 | 4307 | fcr5489 | 4367 | FCR5622 | 4427 | FCR5724 | 4487 | FCR5809 |
| 4248 | FCR5392 | 4308 | FCR5490 | 4368 | FCR5623 | 4428 | FCR5725 | 4488 | FCR5810 |
| 4249 | FCR5393 | 4309 | FCR5498 | 4369 | FCR5624 | 4429 | FCR5727 | 4489 | FCR5811 |
| 4250 | FCR5394 | 4310 | fcr5499 | 4370 | fcr5625 | 4430 | FCR5728 | 4490 | FCR5812 |
| 4251 | fcr5406n | 4311 | FCR5503 | 4371 | FCR5627 | 4431 | FCR5730 | 4491 | FCR5813 |
| 4252 | FCR5407 | 4312 | FCR5505 | 4372 | FCR5628 | 4432 | fcr5731 | 4492 | FCR5814 |
| 4253 | FCR5408 | 4313 | FCR5507 | 4373 | FCR5629 | 4433 | fcr5733 | 4493 | FCR5817 |
| 4254 | FCR5409 | 4314 | FCR5508 | 4374 | FCR5630 | 4434 | fcr5734 | 4494 | FCR5818 |
| 4255 | FCR5410 | 4315 | FCR5509 | 4375 | FCR5634 | 4435 | fcr5736 | 4495 | fcr5819 |
| 4256 | FCR5412 | 4316 | fcr5510 | 4376 | FCR5639 | 4436 | FCR5743 | 4496 | FCR5822 |
| 4257 | fcr5414 | 4317 | FCR5511 | 4377 | fcr5640 | 4437 | FCR5744 | 4497 | FCR5823 |
| 4258 | FCR5415 | 4318 | FCR5513 | 4378 | FCR5642 | 4438 | FCR5746 | 4498 | fcr5824 |
| 4259 | FCR5416 | 4319 | FCR5515 | 4379 | FCR5645 | 4439 | FCR5747 | 4499 | fcr5825 |
| 4260 | FCR5417 | 4320 | FCR5516 | 4380 | FCR5648 | 4440 | FCR5748 | 4500 | FCR5827 |

Figure 6B – List of EST Sequence Names From Fetal Cartilage cDNA Library

| | | | | | | | | | |
|---|---|---|---|---|---|---|---|---|---|
| 4501 | FCR5831 | 4561 | fcr5918 | 4621 | FCR6005 | 4681 | FCR6107 | 4741 | FCR6197 |
| 4502 | FCR5833 | 4562 | FCR5919 | 4622 | FCR6007 | 4682 | FCR6108 | 4742 | fcr6198 |
| 4503 | FCR5834 | 4563 | FCR5920 | 4623 | FCR6008 | 4683 | FCR6109 | 4743 | FCR6201 |
| 4504 | FCR5835 | 4564 | FCR5921 | 4624 | fcr6010 | 4684 | FCR6116 | 4744 | FCR6202 |
| 4505 | fcr5836 | 4565 | FCR5922 | 4625 | fcr6011n | 4685 | FCR6117 | 4745 | FCR6205 |
| 4506 | FCR5837 | 4566 | FCR5925 | 4626 | fcr6013 | 4686 | FCR6118 | 4746 | FCR6206 |
| 4507 | FCR5838 | 4567 | FCR5926 | 4627 | fcr6014 | 4687 | FCR6119 | 4747 | FCR6207 |
| 4508 | fcr5842 | 4568 | fcr5927n | 4628 | fcr6015 | 4688 | FCR6122 | 4748 | FCR6208 |
| 4509 | FCR5843 | 4569 | FCR5928 | 4629 | FCR6016 | 4689 | fcr6124n | 4749 | FCR6209 |
| 4510 | FCR5844 | 4570 | fcr5929n | 4630 | FCR6017 | 4690 | fcr6125 | 4750 | FCR6210 |
| 4511 | FCR5846 | 4571 | FCR5930 | 4631 | FCR6018 | 4691 | fcr6128 | 4751 | FCR6211 |
| 4512 | FCR5847 | 4572 | fcr5931 | 4632 | FCR6019 | 4692 | FCR6129 | 4752 | fcr6212 |
| 4513 | FCR5848 | 4573 | fcr5932n | 4633 | FCR6022 | 4693 | FCR6131 | 4753 | FCR6213 |
| 4514 | FCR5850 | 4574 | FCR5935 | 4634 | FCR6023 | 4694 | fcr6132 | 4754 | fcr6217 |
| 4515 | FCR5851 | 4575 | fcr5936n | 4635 | FCR6025 | 4695 | fcr6135 | 4755 | fcr6218n |
| 4516 | FCR5852 | 4576 | FCR5937 | 4636 | FCR6026 | 4696 | FCR6136 | 4756 | FCR6219 |
| 4517 | FCR5854 | 4577 | FCR5938 | 4637 | FCR6027 | 4697 | FCR6137 | 4757 | FCR6220 |
| 4518 | FCR5856 | 4578 | FCR5940 | 4638 | FCR6028 | 4698 | fcr6138 | 4758 | FCR6221 |
| 4519 | FCR5857 | 4579 | FCR5941 | 4639 | FCR6031 | 4699 | FCR6139 | 4759 | FCR6224 |
| 4520 | FCR5858 | 4580 | FCR5942 | 4640 | FCR6032 | 4700 | FCR6140 | 4760 | FCR6225 |
| 4521 | fcr5859n | 4581 | FCR5943 | 4641 | FCR6034 | 4701 | FCR6141 | 4761 | FCR6227 |
| 4522 | FCR5860 | 4582 | FCR5944 | 4642 | FCR6035 | 4702 | FCR6142 | 4762 | FCR6228 |
| 4523 | FCR5861 | 4583 | FCR5945 | 4643 | fcr6036n | 4703 | FCR6143 | 4763 | FCR6229 |
| 4524 | FCR5862 | 4584 | FCR5946 | 4644 | FCR6038 | 4704 | FCR6144 | 4764 | FCR6230 |
| 4525 | FCR5863 | 4585 | FCR5949 | 4645 | FCR6039 | 4705 | FCR6145 | 4765 | FCR6231 |
| 4526 | FCR5865 | 4586 | FCR5950 | 4646 | fcr6041n | 4706 | FCR6146 | 4766 | FCR6232 |
| 4527 | FCR5866 | 4587 | FCR5951 | 4647 | fcr6042 | 4707 | FCR6147 | 4767 | FCR6234 |
| 4528 | fcr5867 | 4588 | FCR5952 | 4648 | fcr6043n | 4708 | FCR6150 | 4768 | FCR6235 |
| 4529 | FCR5870 | 4589 | fcr5955 | 4649 | FCR6044 | 4709 | FCR6151 | 4769 | FCR6237 |
| 4530 | FCR5871 | 4590 | fcr5956 | 4650 | fcr6045 | 4710 | FCR6152 | 4770 | FCR6240 |
| 4531 | fcr5872 | 4591 | FCR5958 | 4651 | FCR6047 | 4711 | FCR6157 | 4771 | FCR6241 |
| 4532 | FCR5875 | 4592 | FCR5959 | 4652 | FCR6050 | 4712 | FCR6158 | 4772 | fcr6242 |
| 4533 | fcr5877 | 4593 | FCR5961 | 4653 | FCR6054 | 4713 | FCR6160 | 4773 | FCR6243 |
| 4534 | FCR5879 | 4594 | FCR5964 | 4654 | FCR6055 | 4714 | FCR6161 | 4774 | FCR6245 |
| 4535 | FCR5880 | 4595 | FCR5966 | 4655 | FCR6057 | 4715 | fcr6162 | 4775 | FCR6246 |
| 4536 | FCR5881 | 4596 | FCR5967 | 4656 | FCR6058 | 4716 | FCR6163 | 4776 | FCR6252 |
| 4537 | FCR5883 | 4597 | FCR5969 | 4657 | FCR6060 | 4717 | FCR6168 | 4777 | fcr6254 |
| 4538 | fcr5884 | 4598 | FCR5971 | 4658 | FCR6062 | 4718 | FCR6169 | 4778 | FCR6255 |
| 4539 | FCR5885 | 4599 | FCR5972 | 4659 | FCR6064 | 4719 | FCR6170 | 4779 | FCR6256 |
| 4540 | fcr5886 | 4600 | FCR5973 | 4660 | FCR6065 | 4720 | FCR6171 | 4780 | FCR6257 |
| 4541 | FCR5887 | 4601 | FCR5975 | 4661 | FCR6066 | 4721 | FCR6172 | 4781 | FCR6258 |
| 4542 | FCR5889 | 4602 | fcr5976 | 4662 | FCR6067 | 4722 | FCR6174 | 4782 | FCR6259 |
| 4543 | FCR5890 | 4603 | FCR5978 | 4663 | FCR6068 | 4723 | FCR6175 | 4783 | FCR6262 |
| 4544 | FCR5894 | 4604 | FCR5980 | 4664 | FCR6069 | 4724 | FCR6176 | 4784 | FCR6263 |
| 4545 | FCR5895 | 4605 | fcr5981 | 4665 | FCR6074 | 4725 | FCR6178 | 4785 | FCR6264 |
| 4546 | FCR5897 | 4606 | FCR5982 | 4666 | FCR6076 | 4726 | FCR6179 | 4786 | FCR6266 |
| 4547 | FCR5898 | 4607 | fcr5983n | 4667 | FCR6077 | 4727 | FCR6180 | 4787 | FCR6268 |
| 4548 | FCR5900 | 4608 | FCR5986 | 4668 | FCR6079 | 4728 | FCR6181 | 4788 | FCR6269 |
| 4549 | FCR5901 | 4609 | FCR5987 | 4669 | FCR6080 | 4729 | fcr6182 | 4789 | FCR6272 |
| 4550 | fcr5902 | 4610 | FCR5989 | 4670 | FCR6085 | 4730 | FCR6183 | 4790 | FCR6273 |
| 4551 | FCR5903 | 4611 | fcr5990n | 4671 | FCR6086 | 4731 | FCR6184 | 4791 | FCR6274 |
| 4552 | fcr5904n | 4612 | fcr5991 | 4672 | FCR6088 | 4732 | FCR6185 | 4792 | FCR6275 |
| 4553 | FCR5905 | 4613 | FCR5992 | 4673 | FCR6090 | 4733 | FCR6186 | 4793 | FCR6276 |
| 4554 | fcr5909 | 4614 | FCR5995 | 4674 | FCR6091 | 4734 | FCR6187 | 4794 | FCR6277 |
| 4555 | FCR5910 | 4615 | FCR5996 | 4675 | FCR6092 | 4735 | FCR6188 | 4795 | FCR6279 |
| 4556 | FCR5911 | 4616 | FCR5998 | 4676 | FCR6096 | 4736 | FCR6189 | 4796 | fcr6281 |
| 4557 | fcr5912 | 4617 | FCR5999 | 4677 | FCR6102 | 4737 | FCR6192 | 4797 | FCR6282 |
| 4558 | FCR5915 | 4618 | fcr6002 | 4678 | FCR6103 | 4738 | FCR6193 | 4798 | FCR6284 |
| 4559 | FCR5916 | 4619 | fcr6003 | 4679 | FCR6104 | 4739 | FCR6194 | 4799 | FCR6285 |
| 4560 | fcr5917 | 4620 | FCR6004 | 4680 | FCR6106 | 4740 | FCR6195 | 4800 | FCR6286 |

Figure 6B – List of EST Sequence Names From Fetal Cartilage cDNA Library

| | | | | | | | | | |
|---|---|---|---|---|---|---|---|---|---|
| 4801 | FCR6288 | 4861 | FCR6399 | 4921 | FCR6483 | 4981 | FCR6562 | 5041 | FCR6667 |
| 4802 | fcr6291n | 4862 | FCR6400 | 4922 | FCR6484 | 4982 | FCR6564 | 5042 | FCR6669 |
| 4803 | FCR6292 | 4863 | FCR6401 | 4923 | FCR6485 | 4983 | FCR6565 | 5043 | FCR6670 |
| 4804 | FCR6295 | 4864 | FCR6402 | 4924 | FCR6486 | 4984 | FCR6566 | 5044 | FCR6683 |
| 4805 | fcr6296 | 4865 | FCR6403 | 4925 | fcr6487 | 4985 | FCR6568 | 5045 | fcr6687 |
| 4806 | FCR6299 | 4866 | FCR6404 | 4926 | fcr6488 | 4986 | FCR6571 | 5046 | FCR6688 |
| 4807 | FCR6301 | 4867 | FCR6407 | 4927 | FCR6489 | 4987 | FCR6573 | 5047 | FCR6689 |
| 4808 | FCR6303 | 4868 | FCR6408 | 4928 | FCR6491 | 4988 | fcr6574 | 5048 | FCR6690 |
| 4809 | FCR6307 | 4869 | FCR6409 | 4929 | fcr6492 | 4989 | FCR6576 | 5049 | FCR6691 |
| 4810 | fcr6308 | 4870 | FCR6410 | 4930 | FCR6493 | 4990 | FCR6577 | 5050 | FCR6692 |
| 4811 | FCR6309 | 4871 | FCR6411 | 4931 | FCR6494 | 4991 | FCR6578 | 5051 | FCR6693 |
| 4812 | fcr6310 | 4872 | FCR6412 | 4932 | FCR6495 | 4992 | FCR6579 | 5052 | FCR6696 |
| 4813 | FCR6312 | 4873 | FCR6413 | 4933 | FCR6497 | 4993 | FCR6580 | 5053 | FCR6697 |
| 4814 | FCR6314 | 4874 | FCR6414 | 4934 | FCR6498 | 4994 | FCR6581 | 5054 | FCR6698 |
| 4815 | FCR6317 | 4875 | FCR6415 | 4935 | FCR6499 | 4995 | FCR6582 | 5055 | FCR6700 |
| 4816 | FCR6319 | 4876 | FCR6416 | 4936 | FCR6502 | 4996 | fcr6583 | 5056 | FCR6701 |
| 4817 | FCR6321 | 4877 | FCR6418 | 4937 | FCR6503 | 4997 | FCR6584 | 5057 | FCR6702 |
| 4818 | FCR6322 | 4878 | FCR6419 | 4938 | FCR6505 | 4998 | FCR6585 | 5058 | FCR6703 |
| 4819 | FCR6323 | 4879 | FCR6420 | 4939 | fcr6506 | 4999 | FCR6586 | 5059 | FCR6704 |
| 4820 | FCR6324 | 4880 | FCR6421 | 4940 | fcr6507 | 5000 | FCR6587 | 5060 | fcr6707n |
| 4821 | FCR6325 | 4881 | FCR6422 | 4941 | FCR6508 | 5001 | FCR6589 | 5061 | fcr6708 |
| 4822 | FCR6326 | 4882 | FCR6423 | 4942 | fcr6509 | 5002 | FCR6592 | 5062 | FCR6709 |
| 4823 | FCR6327 | 4883 | fcr6424 | 4943 | FCR6511 | 5003 | FCR6593 | 5063 | FCR6710 |
| 4824 | FCR6328 | 4884 | FCR6425 | 4944 | fcr6512 | 5004 | FCR6596 | 5064 | FCR6712 |
| 4825 | FCR6329 | 4885 | FCR6426 | 4945 | FCR6513 | 5005 | FCR6597 | 5065 | fcr6713n |
| 4826 | FCR6330 | 4886 | FCR6427 | 4946 | FCR6514 | 5006 | fcr6606 | 5066 | FCR6714 |
| 4827 | FCR6331 | 4887 | FCR6428 | 4947 | FCR6517 | 5007 | FCR6607 | 5067 | FCR6723 |
| 4828 | FCR6332 | 4888 | FCR6429 | 4948 | FCR6521 | 5008 | fcr6608 | 5068 | FCR6725 |
| 4829 | FCR6333 | 4889 | FCR6431 | 4949 | FCR6522 | 5009 | FCR6610 | 5069 | FCR6730 |
| 4830 | FCR6334 | 4890 | FCR6432 | 4950 | FCR6523 | 5010 | FCR6611 | 5070 | FCR6733 |
| 4831 | FCR6335 | 4891 | FCR6433 | 4951 | FCR6524 | 5011 | FCR6616 | 5071 | FCR6735 |
| 4832 | FCR6336 | 4892 | FCR6434 | 4952 | FCR6525 | 5012 | FCR6617 | 5072 | FCR6737 |
| 4833 | FCR6340 | 4893 | FCR6435 | 4953 | FCR6526 | 5013 | FCR6618 | 5073 | FCR6738 |
| 4834 | fcr6344n | 4894 | FCR6437 | 4954 | FCR6528 | 5014 | FCR6619 | 5074 | FCR6739 |
| 4835 | FCR6345 | 4895 | FCR6439 | 4955 | FCR6529 | 5015 | FCR6620 | 5075 | FCR6740 |
| 4836 | FCR6350 | 4896 | FCR6442 | 4956 | FCR6530 | 5016 | FCR6621 | 5076 | FCR6744 |
| 4837 | fcr6351n | 4897 | FCR6443 | 4957 | FCR6531 | 5017 | FCR6622 | 5077 | FCR6746 |
| 4838 | FCR6352 | 4898 | FCR6449 | 4958 | FCR6532 | 5018 | FCR6623 | 5078 | FCR6747 |
| 4839 | FCR6358 | 4899 | FCR6450 | 4959 | FCR6533 | 5019 | FCR6626 | 5079 | fcr6748n |
| 4840 | FCR6360 | 4900 | fcr6452 | 4960 | FCR6534 | 5020 | FCR6627 | 5080 | FCR6751 |
| 4841 | FCR6361 | 4901 | FCR6455 | 4961 | FCR6536 | 5021 | FCR6628 | 5081 | fcr6752n |
| 4842 | FCR6362 | 4902 | FCR6457 | 4962 | fcr6537n | 5022 | FCR6629 | 5082 | FCR6753 |
| 4843 | FCR6363 | 4903 | FCR6459 | 4963 | FCR6538 | 5023 | FCR6630 | 5083 | FCR6754 |
| 4844 | FCR6367 | 4904 | FCR6460 | 4964 | FCR6539 | 5024 | FCR6631 | 5084 | FCR6756 |
| 4845 | FCR6369 | 4905 | FCR6461 | 4965 | FCR6541 | 5025 | FCR6633 | 5085 | FCR6757 |
| 4846 | FCR6375 | 4906 | FCR6462 | 4966 | FCR6543 | 5026 | FCR6634 | 5086 | FCR6759 |
| 4847 | fcr6376 | 4907 | FCR6463 | 4967 | FCR6546 | 5027 | FCR6635 | 5087 | FCR6760 |
| 4848 | fcr6378n | 4908 | FCR6464 | 4968 | FCR6547 | 5028 | FCR6636 | 5088 | FCR6766 |
| 4849 | fcr6379 | 4909 | FCR6465 | 4969 | FCR6548 | 5029 | FCR6637 | 5089 | FCR6770 |
| 4850 | FCR6382 | 4910 | FCR6466 | 4970 | FCR6549 | 5030 | fcr6639 | 5090 | FCR6773 |
| 4851 | FCR6383 | 4911 | FCR6467 | 4971 | FCR6550 | 5031 | fcr6640 | 5091 | FCR6774 |
| 4852 | fcr6385 | 4912 | FCR6468 | 4972 | FCR6551 | 5032 | fcr6641 | 5092 | FCR6775 |
| 4853 | FCR6386 | 4913 | FCR6469 | 4973 | fcr6552n | 5033 | FCR6651 | 5093 | FCR6776 |
| 4854 | FCR6389 | 4914 | FCR6471 | 4974 | FCR6553 | 5034 | FCR6657 | 5094 | FCR6778 |
| 4855 | FCR6390 | 4915 | FCR6472 | 4975 | FCR6554 | 5035 | FCR6658 | 5095 | FCR6784 |
| 4856 | FCR6393 | 4916 | FCR6476 | 4976 | FCR6555 | 5036 | FCR6660 | 5096 | FCR6785 |
| 4857 | FCR6394 | 4917 | FCR6478 | 4977 | FCR6556 | 5037 | FCR6662 | 5097 | FCR6788 |
| 4858 | FCR6395 | 4918 | FCR6479 | 4978 | FCR6557 | 5038 | FCR6663 | 5098 | FCR6789 |
| 4859 | FCR6396 | 4919 | FCR6481 | 4979 | FCR6560 | 5039 | fcr6664n | 5099 | FCR6792 |
| 4860 | FCR6398 | 4920 | FCR6482 | 4980 | FCR6561 | 5040 | FCR6665 | 5100 | FCR6793 |

Figure 6B – List of EST Sequence Names From Fetal Cartilage cDNA Library

| | | | | | | | | | |
|---|---|---|---|---|---|---|---|---|---|
| 5101 | FCR6794 | 5161 | FCR6889 | 5221 | FCR6976 | 5281 | FCR7071 | 5341 | FCR7166 |
| 5102 | FCR6795 | 5162 | fcr6891n | 5222 | FCR6977 | 5282 | FCR7072 | 5342 | FCR7167 |
| 5103 | fcr6796 | 5163 | FCR6892 | 5223 | FCR6980 | 5283 | FCR7073 | 5343 | FCR7168 |
| 5104 | FCR6797 | 5164 | FCR6893 | 5224 | FCR6983 | 5284 | FCR7074 | 5344 | FCR7169 |
| 5105 | FCR6798 | 5165 | FCR6894 | 5225 | FCR6985 | 5285 | FCR7087 | 5345 | FCR7171 |
| 5106 | FCR6800 | 5166 | FCR6895 | 5226 | FCR6987 | 5286 | FCR7089 | 5346 | FCR7175 |
| 5107 | FCR6801 | 5167 | FCR6896 | 5227 | FCR6994 | 5287 | FCR7090 | 5347 | FCR7177 |
| 5108 | FCR6802 | 5168 | FCR6897 | 5228 | FCR6996 | 5288 | FCR7091 | 5348 | FCR7178 |
| 5109 | FCR6803 | 5169 | FCR6900 | 5229 | FCR6998 | 5289 | FCR7092 | 5349 | FCR7179 |
| 5110 | FCR6804 | 5170 | FCR6901 | 5230 | FCR6999 | 5290 | FCR7095 | 5350 | FCR7180 |
| 5111 | FCR6805 | 5171 | FCR6902 | 5231 | FCR7000 | 5291 | FCR7098 | 5351 | FCR7181 |
| 5112 | FCR6807 | 5172 | fcr6903 | 5232 | FCR7001 | 5292 | FCR7099 | 5352 | FCR7183 |
| 5113 | FCR6808 | 5173 | FCR6905 | 5233 | FCR7002 | 5293 | FCR7100 | 5353 | FCR7185 |
| 5114 | FCR6809 | 5174 | FCR6907 | 5234 | FCR7004 | 5294 | FCR7101 | 5354 | FCR7188 |
| 5115 | FCR6810 | 5175 | FCR6908 | 5235 | FCR7006 | 5295 | FCR7102 | 5355 | FCR7189 |
| 5116 | FCR6811 | 5176 | FCR6909 | 5236 | FCR7007 | 5296 | FCR7103 | 5356 | FCR7190 |
| 5117 | FCR6816 | 5177 | FCR6910 | 5237 | FCR7008 | 5297 | FCR7104 | 5357 | FCR7191 |
| 5118 | FCR6817 | 5178 | fcr6911 | 5238 | FCR7009 | 5298 | FCR7106 | 5358 | FCR7193 |
| 5119 | FCR6820 | 5179 | FCR6912 | 5239 | FCR7010 | 5299 | FCR7107 | 5359 | FCR7195 |
| 5120 | FCR6821 | 5180 | FCR6913 | 5240 | FCR7011 | 5300 | FCR7108 | 5360 | FCR7196 |
| 5121 | fcr6825 | 5181 | FCR6914 | 5241 | fcr7012n | 5301 | FCR7110 | 5361 | FCR7197 |
| 5122 | FCR6826 | 5182 | FCR6915 | 5242 | FCR7015 | 5302 | FCR7111 | 5362 | FCR7198 |
| 5123 | FCR6827 | 5183 | FCR6916 | 5243 | fcr7016 | 5303 | FCR7112 | 5363 | FCR7199 |
| 5124 | fcr6829 | 5184 | FCR6920 | 5244 | FCR7018 | 5304 | FCR7114 | 5364 | FCR7200 |
| 5125 | FCR6830 | 5185 | FCR6924 | 5245 | FCR7019 | 5305 | FCR7115 | 5365 | FCR7201 |
| 5126 | FCR6831 | 5186 | FCR6925 | 5246 | FCR7020 | 5306 | FCR7116 | 5366 | FCR7202 |
| 5127 | FCR6834 | 5187 | FCR6927 | 5247 | fcr7021 | 5307 | FCR7117 | 5367 | FCR7204 |
| 5128 | FCR6836 | 5188 | FCR6928 | 5248 | FCR7025 | 5308 | FCR7118 | 5368 | FCR7205 |
| 5129 | FCR6838 | 5189 | FCR6929 | 5249 | FCR7026 | 5309 | FCR7119 | 5369 | FCR7206 |
| 5130 | fcr6840 | 5190 | FCR6930 | 5250 | FCR7027 | 5310 | FCR7120 | 5370 | FCR7207 |
| 5131 | FCR6841 | 5191 | FCR6931 | 5251 | FCR7029 | 5311 | FCR7123 | 5371 | FCR7208 |
| 5132 | FCR6847 | 5192 | FCR6932 | 5252 | FCR7031 | 5312 | FCR7124 | 5372 | FCR7209 |
| 5133 | FCR6850 | 5193 | fcr6933 | 5253 | FCR7032 | 5313 | FCR7125 | 5373 | FCR7210 |
| 5134 | FCR6851 | 5194 | FCR6936 | 5254 | FCR7033 | 5314 | FCR7127 | 5374 | FCR7216 |
| 5135 | fcr6852n | 5195 | FCR6937 | 5255 | FCR7034 | 5315 | FCR7128 | 5375 | FCR7217 |
| 5136 | FCR6854 | 5196 | FCR6938 | 5256 | FCR7039 | 5316 | FCR7129 | 5376 | FCR7220 |
| 5137 | FCR6857 | 5197 | FCR6941 | 5257 | FCR7040 | 5317 | FCR7130 | 5377 | FCR7221 |
| 5138 | fcr6858 | 5198 | FCR6942 | 5258 | FCR7041 | 5318 | FCR7133 | 5378 | FCR7222 |
| 5139 | FCR6859 | 5199 | FCR6943 | 5259 | FCR7042 | 5319 | fcr7134n | 5379 | FCR7223 |
| 5140 | FCR6862 | 5200 | FCR6944 | 5260 | FCR7043 | 5320 | FCR7136 | 5380 | FCR7225 |
| 5141 | FCR6863 | 5201 | FCR6945 | 5261 | FCR7044 | 5321 | FCR7137 | 5381 | FCR7227 |
| 5142 | FCR6866 | 5202 | FCR6947 | 5262 | FCR7045 | 5322 | FCR7138 | 5382 | FCR7228 |
| 5143 | FCR6867 | 5203 | fcr6948 | 5263 | FCR7046 | 5323 | FCR7139 | 5383 | FCR7230 |
| 5144 | FCR6869 | 5204 | fcr6950 | 5264 | fcr7047 | 5324 | FCR7140 | 5384 | fcr7232 |
| 5145 | FCR6870 | 5205 | fcr6951 | 5265 | FCR7049 | 5325 | FCR7141 | 5385 | FCR7233 |
| 5146 | FCR6871 | 5206 | FCR6952 | 5266 | FCR7050 | 5326 | FCR7143 | 5386 | FCR7236 |
| 5147 | FCR6872 | 5207 | FCR6955 | 5267 | FCR7051 | 5327 | FCR7146 | 5387 | FCR7237 |
| 5148 | FCR6873 | 5208 | FCR6957 | 5268 | FCR7054 | 5328 | FCR7147 | 5388 | fcr7238 |
| 5149 | FCR6874 | 5209 | FCR6958 | 5269 | FCR7055 | 5329 | FCR7150 | 5389 | FCR7239 |
| 5150 | FCR6876 | 5210 | FCR6960 | 5270 | FCR7056 | 5330 | FCR7151 | 5390 | FCR7240 |
| 5151 | FCR6877 | 5211 | FCR6961 | 5271 | FCR7057 | 5331 | fcr7152 | 5391 | FCR7241 |
| 5152 | FCR6878 | 5212 | FCR6962 | 5272 | FCR7058 | 5332 | FCR7153 | 5392 | FCR7243 |
| 5153 | FCR6879 | 5213 | FCR6963 | 5273 | FCR7059 | 5333 | FCR7154 | 5393 | FCR7244 |
| 5154 | FCR6881 | 5214 | FCR6964 | 5274 | FCR7060 | 5334 | FCR7155 | 5394 | FCR7245 |
| 5155 | FCR6882 | 5215 | FCR6967 | 5275 | fcr7062 | 5335 | FCR7157 | 5395 | FCR7246 |
| 5156 | FCR6883 | 5216 | FCR6968 | 5276 | FCR7063 | 5336 | FCR7158 | 5396 | FCR7247 |
| 5157 | FCR6884 | 5217 | FCR6969 | 5277 | FCR7065 | 5337 | FCR7159 | 5397 | FCR7248 |
| 5158 | FCR6886 | 5218 | FCR6970 | 5278 | FCR7067 | 5338 | FCR7161 | 5398 | FCR7249 |
| 5159 | FCR6887 | 5219 | fcr6973 | 5279 | FCR7069 | 5339 | FCR7163 | 5399 | FCR7251 |
| 5160 | FCR6888 | 5220 | FCR6975 | 5280 | FCR7070 | 5340 | FCR7164 | 5400 | FCR7252 |

Figure 6B – List of EST Sequence Names From Fetal Cartilage cDNA Library

| | | | | | | | | | |
|---|---|---|---|---|---|---|---|---|---|
| 5401 | FCR7253 | 5461 | FCR7344 | 5521 | FCR7430 | 5581 | FCR7580 | 5641 | FCR7713 |
| 5402 | FCR7254 | 5462 | FCR7345 | 5522 | FCR7431 | 5582 | FCR7585 | 5642 | FCR7714 |
| 5403 | FCR7255 | 5463 | fcr7346n | 5523 | FCR7446 | 5583 | FCR7586 | 5643 | FCR7715 |
| 5404 | FCR7256 | 5464 | FCR7349 | 5524 | FCR7448 | 5584 | FCR7587 | 5644 | FCR7719 |
| 5405 | FCR7259 | 5465 | FCR7351 | 5525 | FCR7449 | 5585 | fcr7588 | 5645 | FCR7721 |
| 5406 | FCR7261 | 5466 | FCR7353 | 5526 | FCR7453 | 5586 | FCR7591 | 5646 | FCR7725 |
| 5407 | FCR7262 | 5467 | FCR7354 | 5527 | FCR7458 | 5587 | FCR7592 | 5647 | FCR7726 |
| 5408 | FCR7264 | 5468 | FCR7357 | 5528 | fcr7460 | 5588 | FCR7597 | 5648 | FCR7727 |
| 5409 | fcr7266 | 5469 | FCR7360 | 5529 | FCR7465 | 5589 | FCR7602 | 5649 | FCR7728 |
| 5410 | FCR7267 | 5470 | FCR7361 | 5530 | FCR7468 | 5590 | FCR7604 | 5650 | FCR7729 |
| 5411 | FCR7268 | 5471 | FCR7362 | 5531 | FCR7469 | 5591 | FCR7605 | 5651 | FCR7730 |
| 5412 | FCR7269 | 5472 | FCR7363 | 5532 | FCR7470 | 5592 | FCR7609 | 5652 | fcr7731 |
| 5413 | FCR7272 | 5473 | FCR7364 | 5533 | FCR7471 | 5593 | FCR7610 | 5653 | fcr7733 |
| 5414 | FCR7274 | 5474 | FCR7365 | 5534 | fcr7472 | 5594 | fcr7613n | 5654 | fcr7734 |
| 5415 | FCR7277 | 5475 | FCR7367 | 5535 | FCR7473 | 5595 | FCR7614 | 5655 | fcr7735n |
| 5416 | FCR7280 | 5476 | FCR7368 | 5536 | fcr7474 | 5596 | FCR7621 | 5656 | FCR7737 |
| 5417 | FCR7282 | 5477 | FCR7369 | 5537 | FCR7476 | 5597 | fcr7622 | 5657 | fcr7738 |
| 5418 | fcr7283 | 5478 | FCR7370 | 5538 | FCR7477 | 5598 | FCR7623 | 5658 | FCR7739 |
| 5419 | FCR7284 | 5479 | FCR7371 | 5539 | fcr7481n | 5599 | FCR7624 | 5659 | FCR7740 |
| 5420 | FCR7286 | 5480 | fcr7372 | 5540 | FCR7498 | 5600 | FCR7625 | 5660 | FCR7741 |
| 5421 | FCR7288 | 5481 | FCR7373 | 5541 | FCR7500 | 5601 | FCR7626 | 5661 | FCR7742 |
| 5422 | FCR7289 | 5482 | FCR7374 | 5542 | FCR7502 | 5602 | FCR7630 | 5662 | FCR7743 |
| 5423 | FCR7290 | 5483 | FCR7375 | 5543 | FCR7505 | 5603 | FCR7636 | 5663 | FCR7744 |
| 5424 | FCR7291 | 5484 | FCR7377 | 5544 | FCR7508 | 5604 | FCR7637 | 5664 | FCR7745 |
| 5425 | FCR7292 | 5485 | FCR7378 | 5545 | fcr7509 | 5605 | FCR7638 | 5665 | fcrb0001 |
| 5426 | FCR7293 | 5486 | FCR7379 | 5546 | FCR7511 | 5606 | FCR7640 | 5666 | fcrb0002 |
| 5427 | FCR7294 | 5487 | FCR7380 | 5547 | FCR7512 | 5607 | FCR7642 | 5667 | fcrb0003 |
| 5428 | fcr7295 | 5488 | FCR7381 | 5548 | FCR7513 | 5608 | FCR7643 | 5668 | fcrb0004 |
| 5429 | FCR7296 | 5489 | FCR7382 | 5549 | FCR7516 | 5609 | FCR7644 | 5669 | fcrb0005 |
| 5430 | FCR7297 | 5490 | FCR7383 | 5550 | FCR7518 | 5610 | FCR7646 | 5670 | fcrb0006 |
| 5431 | FCR7299 | 5491 | FCR7385 | 5551 | FCR7519 | 5611 | FCR7648 | 5671 | fcrb0007 |
| 5432 | FCR7301 | 5492 | FCR7386 | 5552 | FCR7521 | 5612 | FCR7649 | 5672 | fcrb0008 |
| 5433 | FCR7303 | 5493 | fcr7387 | 5553 | FCR7522 | 5613 | FCR7656 | 5673 | fcrb0009 |
| 5434 | FCR7304 | 5494 | FCR7388 | 5554 | FCR7523 | 5614 | FCR7657 | 5674 | fcrb0010 |
| 5435 | FCR7305 | 5495 | FCR7390 | 5555 | FCR7527 | 5615 | FCR7658 | 5675 | fcrb0012 |
| 5436 | FCR7307 | 5496 | FCR7391 | 5556 | FCR7541 | 5616 | FCR7659 | 5676 | fcrb0013 |
| 5437 | FCR7308 | 5497 | FCR7400 | 5557 | FCR7542 | 5617 | fcr7663n | 5677 | fcrb0014 |
| 5438 | FCR7309 | 5498 | FCR7401 | 5558 | FCR7543 | 5618 | FCR7665 | 5678 | fcrb0015 |
| 5439 | FCR7310 | 5499 | FCR7403 | 5559 | FCR7544 | 5619 | FCR7667 | 5679 | fcrb0016 |
| 5440 | FCR7311 | 5500 | fcr7404n | 5560 | fcr7545n | 5620 | FCR7669 | 5680 | fcrb0017 |
| 5441 | FCR7315 | 5501 | FCR7405 | 5561 | FCR7546 | 5621 | fcr7671n | 5681 | fcrb0018 |
| 5442 | fcr7316 | 5502 | FCR7406 | 5562 | FCR7547 | 5622 | FCR7675 | 5682 | fcrb0019 |
| 5443 | FCR7318 | 5503 | FCR7407 | 5563 | FCR7548 | 5623 | FCR7680 | 5683 | fcrb0020 |
| 5444 | fcr7319 | 5504 | fcr7408n | 5564 | FCR7549 | 5624 | FCR7681 | 5684 | fcrb0021 |
| 5445 | FCR7322 | 5505 | FCR7409 | 5565 | FCR7550 | 5625 | FCR7682 | 5685 | fcrb0023 |
| 5446 | fcr7323 | 5506 | FCR7411 | 5566 | FCR7551 | 5626 | FCR7683 | 5686 | fcrb0025 |
| 5447 | FCR7324 | 5507 | FCR7412 | 5567 | fcr7552 | 5627 | FCR7684 | 5687 | fcrb0026 |
| 5448 | fcr7325 | 5508 | FCR7414 | 5568 | FCR7553 | 5628 | FCR7685 | 5688 | fcrb0027 |
| 5449 | FCR7327 | 5509 | FCR7415 | 5569 | FCR7557 | 5629 | FCR7689 | 5689 | fcrb0028 |
| 5450 | FCR7328 | 5510 | FCR7416 | 5570 | FCR7559 | 5630 | FCR7692 | 5690 | fcrb0029 |
| 5451 | FCR7329 | 5511 | FCR7418 | 5571 | FCR7561 | 5631 | FCR7693 | 5691 | fcrb0030 |
| 5452 | FCR7330 | 5512 | FCR7419 | 5572 | FCR7562 | 5632 | FCR7694 | 5692 | fcrb0032 |
| 5453 | FCR7331 | 5513 | FCR7421 | 5573 | FCR7566 | 5633 | FCR7695 | 5693 | fcrb0033 |
| 5454 | FCR7332 | 5514 | FCR7423 | 5574 | FCR7568 | 5634 | FCR7696 | 5694 | fcrb0034 |
| 5455 | FCR7333 | 5515 | FCR7424 | 5575 | fcr7569 | 5635 | FCR7697 | 5695 | fcrb0035 |
| 5456 | FCR7337 | 5516 | FCR7425 | 5576 | FCR7570 | 5636 | FCR7700 | 5696 | fcrb0036 |
| 5457 | FCR7338 | 5517 | FCR7426 | 5577 | FCR7571 | 5637 | FCR7702 | 5697 | fcrb0037 |
| 5458 | FCR7341 | 5518 | FCR7427 | 5578 | fcr7572 | 5638 | FCR7705 | 5698 | fcrb0038 |
| 5459 | fcr7342 | 5519 | FCR7428 | 5579 | FCR7573 | 5639 | FCR7710 | 5699 | fcrb0039 |
| 5460 | FCR7343 | 5520 | FCR7429 | 5580 | FCR7578 | 5640 | FCR7711 | 5700 | fcrb0040 |

Figure 6B – List of EST Sequence Names From Fetal Cartilage cDNA Library

| | | | | | | | | | |
|---|---|---|---|---|---|---|---|---|---|
| 5701 | fcrb0042 | 5761 | fcrb0121 | 5821 | fcrb0216 | 5881 | fcrb0325 | 5941 | fcrb0418 |
| 5702 | fcrb0044 | 5762 | fcrb0122 | 5822 | fcrb0218 | 5882 | fcrb0326 | 5942 | fcrb0419 |
| 5703 | fcrb0045 | 5763 | fcrb0124 | 5823 | fcrb0220 | 5883 | fcrb0327 | 5943 | fcrb0420 |
| 5704 | fcrb0046 | 5764 | fcrb0125 | 5824 | fcrb0221 | 5884 | fcrb0331 | 5944 | fcrb0422 |
| 5705 | fcrb0048 | 5765 | fcrb0126 | 5825 | fcrb0233 | 5885 | fcrb0332 | 5945 | fcrb0424 |
| 5706 | fcrb0049 | 5766 | fcrb0127 | 5826 | fcrb0241 | 5886 | fcrb0334 | 5946 | fcrb0425 |
| 5707 | fcrb0050 | 5767 | fcrb0129 | 5827 | fcrb0245 | 5887 | fcrb0335 | 5947 | fcrb0426 |
| 5708 | fcrb0051 | 5768 | fcrb0130 | 5828 | fcrb0247 | 5888 | fcrb0336 | 5948 | fcrb0427 |
| 5709 | fcrb0052 | 5769 | fcrb0131 | 5829 | fcrb0249 | 5889 | fcrb0338 | 5949 | fcrb0428 |
| 5710 | fcrb0053 | 5770 | fcrb0132 | 5830 | fcrb0250 | 5890 | fcrb0339 | 5950 | fcrb0429 |
| 5711 | fcrb0054 | 5771 | fcrb0134 | 5831 | fcrb0251 | 5891 | fcrb0342 | 5951 | fcrb0431 |
| 5712 | fcrb0055 | 5772 | fcrb0135 | 5832 | fcrb0253 | 5892 | fcrb0343 | 5952 | fcrb0433 |
| 5713 | fcrb0056 | 5773 | fcrb0136 | 5833 | fcrb0255 | 5893 | fcrb0344 | 5953 | fcrb0434 |
| 5714 | fcrb0057 | 5774 | fcrb0137 | 5834 | fcrb0256 | 5894 | fcrb0345 | 5954 | fcrb0436 |
| 5715 | fcrb0059 | 5775 | fcrb0138 | 5835 | fcrb0257 | 5895 | fcrb0346 | 5955 | fcrb0439 |
| 5716 | fcrb0061 | 5776 | fcrb0139 | 5836 | fcrb0258 | 5896 | fcrb0348 | 5956 | fcrb0440 |
| 5717 | fcrb0062 | 5777 | fcrb0140 | 5837 | fcrb0259 | 5897 | fcrb0349 | 5957 | fcrb0441 |
| 5718 | fcrb0063 | 5778 | fcrb0141 | 5838 | fcrb0260 | 5898 | fcrb0350 | 5958 | fcrb0442 |
| 5719 | fcrb0064 | 5779 | fcrb0142 | 5839 | fcrb0261 | 5899 | fcrb0352 | 5959 | fcrb0443 |
| 5720 | fcrb0066 | 5780 | fcrb0144 | 5840 | fcrb0263 | 5900 | fcrb0353 | 5960 | fcrb0444 |
| 5721 | fcrb0067 | 5781 | fcrb0145 | 5841 | fcrb0265 | 5901 | fcrb0354 | 5961 | fcrb0445 |
| 5722 | fcrb0068 | 5782 | fcrb0146 | 5842 | fcrb0266 | 5902 | fcrb0355 | 5962 | fcrb0446 |
| 5723 | fcrb0069 | 5783 | fcrb0148 | 5843 | fcrb0268 | 5903 | fcrb0356 | 5963 | fcrb0448 |
| 5724 | fcrb0071 | 5784 | fcrb0149 | 5844 | fcrb0269 | 5904 | fcrb0358 | 5964 | fcrb0450 |
| 5725 | fcrb0072 | 5785 | fcrb0150 | 5845 | fcrb0270 | 5905 | fcrb0359 | 5965 | fcrb0564 |
| 5726 | fcrb0073 | 5786 | fcrb0151 | 5846 | fcrb0272 | 5906 | fcrb0360 | 5966 | fcrb0567 |
| 5727 | fcrb0074 | 5787 | fcrb0153 | 5847 | fcrb0273 | 5907 | fcrb0361 | 5967 | fcrb0568 |
| 5728 | fcrb0079 | 5788 | fcrb0154 | 5848 | fcrb0275 | 5908 | fcrb0362 | 5968 | fcrb0569 |
| 5729 | fcrb0080 | 5789 | fcrb0155 | 5849 | fcrb0276 | 5909 | fcrb0363 | 5969 | fcrb0574 |
| 5730 | fcrb0081 | 5790 | fcrb0156 | 5850 | fcrb0277 | 5910 | fcrb0365 | 5970 | fcrb0575 |
| 5731 | fcrb0082 | 5791 | fcrb0157 | 5851 | fcrb0280 | 5911 | fcrb0366 | 5971 | fcrb0576 |
| 5732 | fcrb0083 | 5792 | fcrb0160 | 5852 | fcrb0283 | 5912 | fcrb0367 | 5972 | fcrb0577 |
| 5733 | fcrb0086 | 5793 | fcrb0163 | 5853 | fcrb0284 | 5913 | fcrb0369 | 5973 | fcrb0582 |
| 5734 | fcrb0088 | 5794 | fcrb0168 | 5854 | fcrb0285 | 5914 | fcrb0370 | 5974 | fcrb0583 |
| 5735 | fcrb0089 | 5795 | fcrb0169 | 5855 | fcrb0288 | 5915 | fcrb0371 | 5975 | fcrb0584 |
| 5736 | fcrb0091 | 5796 | fcrb0171 | 5856 | fcrb0289 | 5916 | fcrb0372 | 5976 | fcrb0585 |
| 5737 | fcrb0092 | 5797 | fcrb0172 | 5857 | fcrb0290 | 5917 | fcrb0374 | 5977 | fcrb0587 |
| 5738 | fcrb0093 | 5798 | fcrb0173 | 5858 | fcrb0292 | 5918 | fcrb0376 | 5978 | fcrb0590 |
| 5739 | fcrb0095 | 5799 | fcrb0174 | 5859 | fcrb0293 | 5919 | fcrb0377 | 5979 | fcrb0591 |
| 5740 | fcrb0096 | 5800 | fcrb0177 | 5860 | fcrb0295 | 5920 | fcrb0378 | 5980 | fcrb0592 |
| 5741 | fcrb0097 | 5801 | fcrb0178 | 5861 | fcrb0296 | 5921 | fcrb0381 | 5981 | fcrb0593 |
| 5742 | fcrb0098 | 5802 | fcrb0179 | 5862 | fcrb0298 | 5922 | fcrb0382 | 5982 | fcrb0598 |
| 5743 | fcrb0099 | 5803 | fcrb0184 | 5863 | fcrb0299 | 5923 | fcrb0384 | 5983 | fcrb0599 |
| 5744 | fcrb0100 | 5804 | fcrb0185 | 5864 | fcrb0300 | 5924 | fcrb0385 | 5984 | fcrb0600 |
| 5745 | fcrb0101 | 5805 | fcrb0187 | 5865 | fcrb0301 | 5925 | fcrb0386 | 5985 | fcrb0601 |
| 5746 | fcrb0102 | 5806 | fcrb0190 | 5866 | fcrb0302 | 5926 | fcrb0388 | 5986 | fcrb0602 |
| 5747 | fcrb0103 | 5807 | fcrb0192 | 5867 | fcrb0304 | 5927 | fcrb0389 | 5987 | fcrb0606 |
| 5748 | fcrb0104 | 5808 | fcrb0193 | 5868 | fcrb0305 | 5928 | fcrb0397 | 5988 | fcrb0607 |
| 5749 | fcrb0106 | 5809 | fcrb0194 | 5869 | fcrb0306 | 5929 | fcrb0398 | 5989 | fcrb0608 |
| 5750 | fcrb0107 | 5810 | fcrb0196 | 5870 | fcrb0308 | 5930 | fcrb0399 | 5990 | fcrb0613 |
| 5751 | fcrb0108 | 5811 | fcrb0198 | 5871 | fcrb0309 | 5931 | fcrb0401 | 5991 | fcrb0614 |
| 5752 | fcrb0109 | 5812 | fcrb0200 | 5872 | fcrb0311 | 5932 | fcrb0402 | 5992 | fcrb0615 |
| 5753 | fcrb0110 | 5813 | fcrb0201 | 5873 | fcrb0312 | 5933 | fcrb0403 | 5993 | fcrb0617 |
| 5754 | fcrb0111 | 5814 | fcrb0202 | 5874 | fcrb0313 | 5934 | fcrb0404 | 5994 | fcrb0619 |
| 5755 | fcrb0114 | 5815 | fcrb0204 | 5875 | fcrb0315 | 5935 | fcrb0406 | 5995 | fcrb0620 |
| 5756 | fcrb0115 | 5816 | fcrb0205 | 5876 | fcrb0316 | 5936 | fcrb0407 | 5996 | fcrb0621 |
| 5757 | fcrb0117 | 5817 | fcrb0207 | 5877 | fcrb0317 | 5937 | fcrb0408 | 5997 | fcrb0622 |
| 5758 | fcrb0118 | 5818 | fcrb0211 | 5878 | fcrb0318 | 5938 | fcrb0409 | 5998 | fcrb0623 |
| 5759 | fcrb0119 | 5819 | fcrb0212 | 5879 | fcrb0319 | 5939 | fcrb0414 | 5999 | fcrb0624 |
| 5760 | fcrb0120 | 5820 | fcrb0213 | 5880 | fcrb0322 | 5940 | fcrb0416 | 6000 | fcrb0625 |

Figure 6B – List of EST Sequence Names From Fetal Cartilage cDNA Library

| | | | | | | | | | |
|---|---|---|---|---|---|---|---|---|---|
| 6001 | fcrb0626 | 6061 | fcrb0752 | 6121 | fcrb0995 | 6181 | fcrb1093 | 6241 | fcrb1198 |
| 6002 | fcrb0630 | 6062 | fcrb0755 | 6122 | fcrb0997 | 6182 | fcrb1095 | 6242 | fcrb1199 |
| 6003 | fcrb0631 | 6063 | fcrb0758 | 6123 | fcrb0999 | 6183 | fcrb1096 | 6243 | fcrb1200 |
| 6004 | fcrb0632 | 6064 | fcrb0773 | 6124 | fcrb1000 | 6184 | fcrb1101 | 6244 | fcrb1201 |
| 6005 | fcrb0633 | 6065 | fcrb0784 | 6125 | fcrb1001 | 6185 | fcrb1102 | 6245 | fcrb1202 |
| 6006 | fcrb0634 | 6066 | fcrb0787 | 6126 | fcrb1002 | 6186 | fcrb1103 | 6246 | fcrb1203 |
| 6007 | fcrb0638 | 6067 | fcrb0791 | 6127 | fcrb1007 | 6187 | fcrb1107 | 6247 | fcrb1204 |
| 6008 | fcrb0639 | 6068 | fcrb0793 | 6128 | fcrb1009 | 6188 | fcrb1115 | 6248 | fcrb1206 |
| 6009 | fcrb0640 | 6069 | fcrb0796 | 6129 | fcrb1011 | 6189 | fcrb1116 | 6249 | fcrb1207 |
| 6010 | fcrb0641 | 6070 | fcrb0805 | 6130 | fcrb1012 | 6190 | fcrb1117 | 6250 | fcrb1208 |
| 6011 | fcrb0643 | 6071 | fcrb0810 | 6131 | fcrb1013 | 6191 | fcrb1120 | 6251 | fcrb1209 |
| 6012 | fcrb0646 | 6072 | fcrb0815 | 6132 | fcrb1017 | 6192 | fcrb1121 | 6252 | fcrb1210 |
| 6013 | fcrb0654 | 6073 | fcrb0819 | 6133 | fcrb1018 | 6193 | fcrb1122 | 6253 | fcrb1214 |
| 6014 | fcrb0655 | 6074 | fcrb0828 | 6134 | fcrb1019 | 6194 | fcrb1128 | 6254 | fcrb1218 |
| 6015 | fcrb0657 | 6075 | fcrb0831 | 6135 | fcrb1020 | 6195 | fcrb1130 | 6255 | fcrb1219 |
| 6016 | fcrb0662 | 6076 | fcrb0843 | 6136 | fcrb1021 | 6196 | fcrb1133 | 6256 | fcrb1223 |
| 6017 | fcrb0664 | 6077 | fcrb0845 | 6137 | fcrb1022 | 6197 | fcrb1134 | 6257 | fcrb1224 |
| 6018 | fcrb0665 | 6078 | fcrb0855 | 6138 | fcrb1023 | 6198 | fcrb1135 | 6258 | fcrb1225 |
| 6019 | fcrb0667 | 6079 | fcrb0870 | 6139 | fcrb1024 | 6199 | fcrb1136 | 6259 | fcrb1226 |
| 6020 | fcrb0670 | 6080 | fcrb0881 | 6140 | fcrb1026 | 6200 | fcrb1138 | 6260 | fcrb1227 |
| 6021 | fcrb0671 | 6081 | fcrb0887 | 6141 | fcrb1027 | 6201 | fcrb1142 | 6261 | fcrb1229 |
| 6022 | fcrb0673 | 6082 | fcrb0894 | 6142 | fcrb1030 | 6202 | fcrb1144 | 6262 | fcrb1230 |
| 6023 | fcrb0677 | 6083 | fcrb0896 | 6143 | fcrb1032 | 6203 | fcrb1145 | 6263 | fcrb1231 |
| 6024 | fcrb0678 | 6084 | fcrb0904 | 6144 | fcrb1033 | 6204 | fcrb1146 | 6264 | fcrb1232 |
| 6025 | fcrb0681 | 6085 | fcrb0907 | 6145 | fcrb1034 | 6205 | fcrb1150 | 6265 | fcrb1234 |
| 6026 | fcrb0682 | 6086 | fcrb0909 | 6146 | fcrb1035 | 6206 | fcrb1151 | 6266 | fcrb1236 |
| 6027 | fcrb0684 | 6087 | fcrb0910 | 6147 | fcrb1037 | 6207 | fcrb1152 | 6267 | fcrb1241 |
| 6028 | fcrb0686 | 6088 | fcrb0916 | 6148 | fcrb1038 | 6208 | fcrb1153 | 6268 | fcrb1242 |
| 6029 | fcrb0687 | 6089 | fcrb0920 | 6149 | fcrb1039 | 6209 | fcrb1155 | 6269 | fcrb1243 |
| 6030 | fcrb0688 | 6090 | fcrb0924 | 6150 | fcrb1040 | 6210 | fcrb1157 | 6270 | fcrb1246 |
| 6031 | fcrb0689 | 6091 | fcrb0926 | 6151 | fcrb1041 | 6211 | fcrb1158 | 6271 | fcrb1247 |
| 6032 | fcrb0693 | 6092 | fcrb0938 | 6152 | fcrb1042 | 6212 | fcrb1159 | 6272 | fcrb1248 |
| 6033 | fcrb0696 | 6093 | fcrb0946 | 6153 | fcrb1044 | 6213 | fcrb1160 | 6273 | fcrb1249 |
| 6034 | fcrb0697 | 6094 | fcrb0952 | 6154 | fcrb1045 | 6214 | fcrb1161 | 6274 | fcrb1255 |
| 6035 | fcrb0702 | 6095 | fcrb0954 | 6155 | fcrb1048 | 6215 | fcrb1162 | 6275 | fcrb1257 |
| 6036 | fcrb0703 | 6096 | fcrb0956 | 6156 | fcrb1052 | 6216 | fcrb1163 | 6276 | fcrb1258 |
| 6037 | fcrb0704 | 6097 | fcrb0957 | 6157 | fcrb1053 | 6217 | fcrb1164 | 6277 | fcrb1259 |
| 6038 | fcrb0709 | 6098 | fcrb0958 | 6158 | fcrb1054 | 6218 | fcrb1165 | 6278 | fcrb1260 |
| 6039 | fcrb0710 | 6099 | fcrb0959 | 6159 | fcrb1056 | 6219 | fcrb1166 | 6279 | fcrb1261 |
| 6040 | fcrb0712 | 6100 | fcrb0960 | 6160 | fcrb1058 | 6220 | fcrb1168 | 6280 | fcrb1262 |
| 6041 | fcrb0715 | 6101 | fcrb0961 | 6161 | fcrb1059 | 6221 | fcrb1169 | 6281 | fcrb1264 |
| 6042 | fcrb0716 | 6102 | fcrb0963 | 6162 | fcrb1063 | 6222 | fcrb1172 | 6282 | fcrb1265 |
| 6043 | fcrb0717 | 6103 | fcrb0966 | 6163 | fcrb1065 | 6223 | fcrb1173 | 6283 | fcrb1267 |
| 6044 | fcrb0718 | 6104 | fcrb0970 | 6164 | fcrb1066 | 6224 | fcrb1174 | 6284 | fcrb1271 |
| 6045 | fcrb0720 | 6105 | fcrb0971 | 6165 | fcrb1068 | 6225 | fcrb1175 | 6285 | fcrb1272 |
| 6046 | fcrb0721 | 6106 | fcrb0972 | 6166 | fcrb1069 | 6226 | fcrb1176 | 6286 | fcrb1282 |
| 6047 | fcrb0726 | 6107 | fcrb0973 | 6167 | fcrb1070 | 6227 | fcrb1178 | 6287 | fcrb1283 |
| 6048 | fcrb0727 | 6108 | fcrb0974 | 6168 | fcrb1072 | 6228 | fcrb1181 | 6288 | fcrb1286 |
| 6049 | fcrb0728 | 6109 | fcrb0975 | 6169 | fcrb1073 | 6229 | fcrb1182 | 6289 | fcrb1288 |
| 6050 | fcrb0729 | 6110 | fcrb0976 | 6170 | fcrb1075 | 6230 | fcrb1183 | 6290 | fcrb1289 |
| 6051 | fcrb0732 | 6111 | fcrb0978 | 6171 | fcrb1076 | 6231 | fcrb1184 | 6291 | fcrb1290 |
| 6052 | fcrb0734 | 6112 | fcrb0979 | 6172 | fcrb1079 | 6232 | fcrb1185 | 6292 | fcrb1291 |
| 6053 | fcrb0735 | 6113 | fcrb0984 | 6173 | fcrb1080 | 6233 | fcrb1186 | 6293 | fcrb1294 |
| 6054 | fcrb0736 | 6114 | fcrb0985 | 6174 | fcrb1081 | 6234 | fcrb1187 | 6294 | fcrb1295 |
| 6055 | fcrb0737 | 6115 | fcrb0986 | 6175 | fcrb1082 | 6235 | fcrb1190 | 6295 | fcrb1296 |
| 6056 | fcrb0742 | 6116 | fcrb0988 | 6176 | fcrb1083 | 6236 | fcrb1191 | 6296 | fcrb1297 |
| 6057 | fcrb0743 | 6117 | fcrb0991 | 6177 | fcrb1085 | 6237 | fcrb1192 | 6297 | fcrb1299 |
| 6058 | fcrb0745 | 6118 | fcrb0992 | 6178 | fcrb1088 | 6238 | fcrb1193 | 6298 | fcrb1302 |
| 6059 | fcrb0750 | 6119 | fcrb0993 | 6179 | fcrb1090 | 6239 | fcrb1194 | 6299 | fcrb1303 |
| 6060 | fcrb0751 | 6120 | fcrb0994 | 6180 | fcrb1091 | 6240 | fcrb1195 | 6300 | fcrb1304 |

Figure 6B - List of EST Sequence Names From Fetal Cartilage cDNA Library

| | | | | | | | | | |
|---|---|---|---|---|---|---|---|---|---|
| 6301 | fcrb1305 | 6361 | fcrb1387 | 6421 | fcrb1472 | 6481 | fcrb1540 | 6541 | fcrb1616 |
| 6302 | fcrb1306 | 6362 | fcrb1388 | 6422 | fcrb1473 | 6482 | fcrb1541 | 6542 | fcrb1617 |
| 6303 | fcrb1307 | 6363 | fcrb1390 | 6423 | fcrb1474 | 6483 | fcrb1544 | 6543 | fcrb1618 |
| 6304 | fcrb1310 | 6364 | fcrb1391 | 6424 | fcrb1476 | 6484 | fcrb1545 | 6544 | fcrb1619 |
| 6305 | fcrb1311 | 6365 | fcrb1392 | 6425 | fcrb1477 | 6485 | fcrb1546 | 6545 | fcrb1620 |
| 6306 | fcrb1312 | 6366 | fcrb1394 | 6426 | fcrb1478 | 6486 | fcrb1547 | 6546 | fcrb1621 |
| 6307 | fcrb1313 | 6367 | fcrb1395 | 6427 | fcrb1479 | 6487 | fcrb1548 | 6547 | fcrb1622 |
| 6308 | fcrb1314 | 6368 | fcrb1396 | 6428 | fcrb1480 | 6488 | fcrb1549 | 6548 | fcrb1623 |
| 6309 | fcrb1315 | 6369 | fcrb1397 | 6429 | fcrb1481 | 6489 | fcrb1550 | 6549 | fcrb1624 |
| 6310 | fcrb1318 | 6370 | fcrb1399 | 6430 | fcrb1482 | 6490 | fcrb1552 | 6550 | fcrb1625 |
| 6311 | fcrb1320 | 6371 | fcrb1400 | 6431 | fcrb1483 | 6491 | fcrb1553 | 6551 | fcrb1627 |
| 6312 | fcrb1321 | 6372 | fcrb1401 | 6432 | fcrb1484 | 6492 | fcrb1554 | 6552 | fcrb1628 |
| 6313 | fcrb1322 | 6373 | fcrb1402 | 6433 | fcrb1485 | 6493 | fcrb1556 | 6553 | fcrb1629 |
| 6314 | fcrb1323 | 6374 | fcrb1405 | 6434 | fcrb1486 | 6494 | fcrb1557 | 6554 | fcrb1631 |
| 6315 | fcrb1326 | 6375 | fcrb1406 | 6435 | fcrb1487 | 6495 | fcrb1558 | 6555 | fcrb1633 |
| 6316 | fcrb1327 | 6376 | fcrb1407 | 6436 | fcrb1488 | 6496 | fcrb1560 | 6556 | fcrb1635 |
| 6317 | fcrb1328 | 6377 | fcrb1409 | 6437 | fcrb1489 | 6497 | fcrb1561 | 6557 | fcrb1637 |
| 6318 | fcrb1329 | 6378 | fcrb1411 | 6438 | fcrb1490 | 6498 | fcrb1562 | 6558 | fcrb1638 |
| 6319 | fcrb1332 | 6379 | fcrb1412 | 6439 | fcrb1491 | 6499 | fcrb1563 | 6559 | fcrb1639 |
| 6320 | fcrb1333 | 6380 | fcrb1414 | 6440 | fcrb1492 | 6500 | fcrb1564 | 6560 | fcrb1640 |
| 6321 | fcrb1334 | 6381 | fcrb1416 | 6441 | fcrb1493 | 6501 | fcrb1567 | 6561 | fcrb1641 |
| 6322 | fcrb1335 | 6382 | fcrb1417 | 6442 | fcrb1494 | 6502 | fcrb1568 | 6562 | fcrb1644 |
| 6323 | fcrb1336 | 6383 | fcrb1418 | 6443 | fcrb1496 | 6503 | fcrb1569 | 6563 | fcrb1645 |
| 6324 | fcrb1337 | 6384 | fcrb1419 | 6444 | fcrb1497 | 6504 | fcrb1570 | 6564 | fcrb1647 |
| 6325 | fcrb1339 | 6385 | fcrb1420 | 6445 | fcrb1498 | 6505 | fcrb1573 | 6565 | fcrb1648 |
| 6326 | fcrb1340 | 6386 | fcrb1421 | 6446 | fcrb1500 | 6506 | fcrb1574 | 6566 | fcrb1650 |
| 6327 | fcrb1341 | 6387 | fcrb1423 | 6447 | fcrb1501 | 6507 | fcrb1575 | 6567 | fcrb1652 |
| 6328 | fcrb1343 | 6388 | fcrb1425 | 6448 | fcrb1502 | 6508 | fcrb1577 | 6568 | fcrb1653 |
| 6329 | fcrb1344 | 6389 | fcrb1427 | 6449 | fcrb1503 | 6509 | fcrb1578 | 6569 | fcrb1654 |
| 6330 | fcrb1345 | 6390 | fcrb1428 | 6450 | fcrb1504 | 6510 | fcrb1579 | 6570 | fcrb1656 |
| 6331 | fcrb1346 | 6391 | fcrb1429 | 6451 | fcrb1505 | 6511 | fcrb1580 | 6571 | fcrb1657 |
| 6332 | fcrb1348 | 6392 | fcrb1430 | 6452 | fcrb1506 | 6512 | fcrb1581 | 6572 | fcrb1659 |
| 6333 | fcrb1349 | 6393 | fcrb1431 | 6453 | fcrb1507 | 6513 | fcrb1582 | 6573 | fcrb1660 |
| 6334 | fcrb1350 | 6394 | fcrb1432 | 6454 | fcrb1508 | 6514 | fcrb1583 | 6574 | fcrb1661 |
| 6335 | fcrb1352 | 6395 | fcrb1433 | 6455 | fcrb1509 | 6515 | fcrb1584 | 6575 | fcrb1663 |
| 6336 | fcrb1353 | 6396 | fcrb1434 | 6456 | fcrb1510 | 6516 | fcrb1586 | 6576 | fcrb1664 |
| 6337 | fcrb1354 | 6397 | fcrb1435 | 6457 | fcrb1511 | 6517 | fcrb1587 | 6577 | fcrb1665 |
| 6338 | fcrb1355 | 6398 | fcrb1436 | 6458 | fcrb1513 | 6518 | fcrb1588 | 6578 | fcrb1666 |
| 6339 | fcrb1356 | 6399 | fcrb1437 | 6459 | fcrb1514 | 6519 | fcrb1589 | 6579 | fcrb1669 |
| 6340 | fcrb1357 | 6400 | fcrb1439 | 6460 | fcrb1515 | 6520 | fcrb1590 | 6580 | fcrb1670 |
| 6341 | fcrb1359 | 6401 | fcrb1441 | 6461 | fcrb1516 | 6521 | fcrb1592 | 6581 | fcrb1672 |
| 6342 | fcrb1360 | 6402 | fcrb1442 | 6462 | fcrb1518 | 6522 | fcrb1593 | 6582 | fcrb1673 |
| 6343 | fcrb1361 | 6403 | fcrb1443 | 6463 | fcrb1519 | 6523 | fcrb1594 | 6583 | fcrb1674 |
| 6344 | fcrb1362 | 6404 | fcrb1446 | 6464 | fcrb1520 | 6524 | fcrb1595 | 6584 | fcrb1676 |
| 6345 | fcrb1364 | 6405 | fcrb1448 | 6465 | fcrb1521 | 6525 | fcrb1596 | 6585 | fcrb1677 |
| 6346 | fcrb1366 | 6406 | fcrb1449 | 6466 | fcrb1522 | 6526 | fcrb1597 | 6586 | fcrb1678 |
| 6347 | fcrb1368 | 6407 | fcrb1450 | 6467 | fcrb1523 | 6527 | fcrb1598 | 6587 | fcrb1679 |
| 6348 | fcrb1369 | 6408 | fcrb1451 | 6468 | fcrb1524 | 6528 | fcrb1599 | 6588 | fcrb1680 |
| 6349 | fcrb1370 | 6409 | fcrb1452 | 6469 | fcrb1525 | 6529 | fcrb1600 | 6589 | fcrb1681 |
| 6350 | fcrb1371 | 6410 | fcrb1453 | 6470 | fcrb1527 | 6530 | fcrb1601 | 6590 | fcrb1682 |
| 6351 | fcrb1372 | 6411 | fcrb1454 | 6471 | fcrb1528 | 6531 | fcrb1602 | 6591 | fcrb1683 |
| 6352 | fcrb1373 | 6412 | fcrb1455 | 6472 | fcrb1529 | 6532 | fcrb1603 | 6592 | fcrb1684 |
| 6353 | fcrb1376 | 6413 | fcrb1457 | 6473 | fcrb1530 | 6533 | fcrb1604 | 6593 | fcrb1685 |
| 6354 | fcrb1377 | 6414 | fcrb1458 | 6474 | fcrb1531 | 6534 | fcrb1605 | 6594 | fcrb1686 |
| 6355 | fcrb1378 | 6415 | fcrb1460 | 6475 | fcrb1532 | 6535 | fcrb1607 | 6595 | fcrb1687 |
| 6356 | fcrb1379 | 6416 | fcrb1462 | 6476 | fcrb1533 | 6536 | fcrb1608 | 6596 | fcrb1688 |
| 6357 | fcrb1380 | 6417 | fcrb1464 | 6477 | fcrb1535 | 6537 | fcrb1611 | 6597 | fcrb1689 |
| 6358 | fcrb1381 | 6418 | fcrb1465 | 6478 | fcrb1536 | 6538 | fcrb1612 | 6598 | fcrb1690 |
| 6359 | fcrb1382 | 6419 | fcrb1466 | 6479 | fcrb1538 | 6539 | fcrb1614 | 6599 | fcrb1691 |
| 6360 | fcrb1386 | 6420 | fcrb1469 | 6480 | fcrb1539 | 6540 | fcrb1615 | 6600 | fcrb1693 |

Figure 6B – List of EST Sequence Names From Fetal Cartilage cDNA Library

| | | | | | | | | | |
|---|---|---|---|---|---|---|---|---|---|
| 6601 | fcrb1694 | 6661 | fcrb1773 | 6721 | fcrb1854 | 6781 | fcrb1937 | 6841 | fcrb2016 |
| 6602 | fcrb1695 | 6662 | fcrb1775 | 6722 | fcrb1855 | 6782 | fcrb1940 | 6842 | fcrb2017 |
| 6603 | fcrb1696 | 6663 | fcrb1776 | 6723 | fcrb1856 | 6783 | fcrb1941 | 6843 | fcrb2018 |
| 6604 | fcrb1697 | 6664 | fcrb1777 | 6724 | fcrb1857 | 6784 | fcrb1942 | 6844 | fcrb2020 |
| 6605 | fcrb1698 | 6665 | fcrb1778 | 6725 | fcrb1860 | 6785 | fcrb1944 | 6845 | fcrb2021 |
| 6606 | fcrb1699 | 6666 | fcrb1779 | 6726 | fcrb1862 | 6786 | fcrb1945 | 6846 | fcrb2023 |
| 6607 | fcrb1700 | 6667 | fcrb1780 | 6727 | fcrb1864 | 6787 | fcrb1947 | 6847 | fcrb2024 |
| 6608 | fcrb1701 | 6668 | fcrb1782 | 6728 | fcrb1865 | 6788 | fcrb1948 | 6848 | fcrb2025 |
| 6609 | fcrb1702 | 6669 | fcrb1784 | 6729 | fcrb1866 | 6789 | fcrb1949 | 6849 | fcrb2028 |
| 6610 | fcrb1703 | 6670 | fcrb1785 | 6730 | fcrb1867 | 6790 | fcrb1950 | 6850 | fcrb2029 |
| 6611 | fcrb1705 | 6671 | fcrb1787 | 6731 | fcrb1868 | 6791 | fcrb1951 | 6851 | fcrb2030 |
| 6612 | fcrb1706 | 6672 | fcrb1788 | 6732 | fcrb1869 | 6792 | fcrb1952 | 6852 | fcrb2031 |
| 6613 | fcrb1707 | 6673 | fcrb1789 | 6733 | fcrb1870 | 6793 | fcrb1953 | 6853 | fcrb2032 |
| 6614 | fcrb1708 | 6674 | fcrb1790 | 6734 | fcrb1871 | 6794 | fcrb1954 | 6854 | fcrb2033 |
| 6615 | fcrb1710 | 6675 | fcrb1791 | 6735 | fcrb1872 | 6795 | fcrb1956 | 6855 | fcrb2034 |
| 6616 | fcrb1711 | 6676 | fcrb1792 | 6736 | fcrb1874 | 6796 | fcrb1959 | 6856 | fcrb2036 |
| 6617 | fcrb1712 | 6677 | fcrb1793 | 6737 | fcrb1875 | 6797 | fcrb1960 | 6857 | fcrb2037 |
| 6618 | fcrb1714 | 6678 | fcrb1795 | 6738 | fcrb1876 | 6798 | fcrb1961 | 6858 | fcrb2038 |
| 6619 | fcrb1715 | 6679 | fcrb1797 | 6739 | fcrb1877 | 6799 | fcrb1962 | 6859 | fcrb2039 |
| 6620 | fcrb1716 | 6680 | fcrb1798 | 6740 | fcrb1880 | 6800 | fcrb1963 | 6860 | fcrb2040 |
| 6621 | fcrb1717 | 6681 | fcrb1800 | 6741 | fcrb1881 | 6801 | fcrb1964 | 6861 | fcrb2041 |
| 6622 | fcrb1718 | 6682 | fcrb1801 | 6742 | fcrb1884 | 6802 | fcrb1965 | 6862 | fcrb2042 |
| 6623 | fcrb1719 | 6683 | fcrb1803 | 6743 | fcrb1885 | 6803 | fcrb1967 | 6863 | fcrb2043 |
| 6624 | fcrb1720 | 6684 | fcrb1804 | 6744 | fcrb1886 | 6804 | fcrb1968 | 6864 | fcrb2044 |
| 6625 | fcrb1721 | 6685 | fcrb1805 | 6745 | fcrb1888 | 6805 | fcrb1969 | 6865 | fcrb2045 |
| 6626 | fcrb1722 | 6686 | fcrb1806 | 6746 | fcrb1889 | 6806 | fcrb1970 | 6866 | fcrb2046 |
| 6627 | fcrb1724 | 6687 | fcrb1807 | 6747 | fcrb1890 | 6807 | fcrb1972 | 6867 | fcrb2049 |
| 6628 | fcrb1725 | 6688 | fcrb1809 | 6748 | fcrb1892 | 6808 | fcrb1973 | 6868 | fcrb2051 |
| 6629 | fcrb1727 | 6689 | fcrb1811 | 6749 | fcrb1893 | 6809 | fcrb1974 | 6869 | fcrb2054 |
| 6630 | fcrb1728 | 6690 | fcrb1813 | 6750 | fcrb1894 | 6810 | fcrb1976 | 6870 | fcrb2055 |
| 6631 | fcrb1729 | 6691 | fcrb1815 | 6751 | fcrb1898 | 6811 | fcrb1977 | 6871 | fcrb2057 |
| 6632 | fcrb1730 | 6692 | fcrb1817 | 6752 | fcrb1899 | 6812 | fcrb1978 | 6872 | fcrb2058 |
| 6633 | fcrb1731 | 6693 | fcrb1819 | 6753 | fcrb1900 | 6813 | fcrb1979 | 6873 | fcrb2059 |
| 6634 | fcrb1733 | 6694 | fcrb1820 | 6754 | fcrb1901 | 6814 | fcrb1980 | 6874 | fcrb2060 |
| 6635 | fcrb1734 | 6695 | fcrb1821 | 6755 | fcrb1902 | 6815 | fcrb1981 | 6875 | fcrb2061 |
| 6636 | fcrb1737 | 6696 | fcrb1823 | 6756 | fcrb1903 | 6816 | fcrb1982 | 6876 | fcrb2063 |
| 6637 | fcrb1739 | 6697 | fcrb1824 | 6757 | fcrb1904 | 6817 | fcrb1984 | 6877 | fcrb2064 |
| 6638 | fcrb1740 | 6698 | fcrb1825 | 6758 | fcrb1906 | 6818 | fcrb1985 | 6878 | fcrb2066 |
| 6639 | fcrb1741 | 6699 | fcrb1826 | 6759 | fcrb1909 | 6819 | fcrb1986 | 6879 | fcrb2067 |
| 6640 | fcrb1742 | 6700 | fcrb1827 | 6760 | fcrb1912 | 6820 | fcrb1988 | 6880 | fcrb2068 |
| 6641 | fcrb1744 | 6701 | fcrb1828 | 6761 | fcrb1913 | 6821 | fcrb1989 | 6881 | fcrb2069 |
| 6642 | fcrb1745 | 6702 | fcrb1830 | 6762 | fcrb1914 | 6822 | fcrb1990 | 6882 | fcrb2070 |
| 6643 | fcrb1749 | 6703 | fcrb1833 | 6763 | fcrb1915 | 6823 | fcrb1992 | 6883 | fcrb2071 |
| 6644 | fcrb1750 | 6704 | fcrb1834 | 6764 | fcrb1916 | 6824 | fcrb1993 | 6884 | fcrb2072 |
| 6645 | fcrb1752 | 6705 | fcrb1835 | 6765 | fcrb1917 | 6825 | fcrb1995 | 6885 | fcrb2075 |
| 6646 | fcrb1753 | 6706 | fcrb1836 | 6766 | fcrb1918 | 6826 | fcrb1996 | 6886 | fcrb2076 |
| 6647 | fcrb1755 | 6707 | fcrb1837 | 6767 | fcrb1919 | 6827 | fcrb1998 | 6887 | fcrb2077 |
| 6648 | fcrb1756 | 6708 | fcrb1838 | 6768 | fcrb1920 | 6828 | fcrb1999 | 6888 | fcrb2078 |
| 6649 | fcrb1759 | 6709 | fcrb1839 | 6769 | fcrb1921 | 6829 | fcrb2000 | 6889 | fcrb2079 |
| 6650 | fcrb1760 | 6710 | fcrb1840 | 6770 | fcrb1922 | 6830 | fcrb2001 | 6890 | fcrb2080 |
| 6651 | fcrb1761 | 6711 | fcrb1841 | 6771 | fcrb1923 | 6831 | fcrb2002 | 6891 | fcrb2081 |
| 6652 | fcrb1762 | 6712 | fcrb1844 | 6772 | fcrb1924 | 6832 | fcrb2003 | 6892 | fcrb2083 |
| 6653 | fcrb1763 | 6713 | fcrb1845 | 6773 | fcrb1925 | 6833 | fcrb2004 | 6893 | fcrb2084 |
| 6654 | fcrb1764 | 6714 | fcrb1846 | 6774 | fcrb1926 | 6834 | fcrb2005 | 6894 | fcrb2085 |
| 6655 | fcrb1766 | 6715 | fcrb1848 | 6775 | fcrb1929 | 6835 | fcrb2007 | 6895 | fcrb2086 |
| 6656 | fcrb1767 | 6716 | fcrb1849 | 6776 | fcrb1930 | 6836 | fcrb2008 | 6896 | fcrb2087 |
| 6657 | fcrb1768 | 6717 | fcrb1850 | 6777 | fcrb1932 | 6837 | fcrb2011 | 6897 | fcrb2089 |
| 6658 | fcrb1769 | 6718 | fcrb1851 | 6778 | fcrb1933 | 6838 | fcrb2012 | 6898 | fcrb2090 |
| 6659 | fcrb1771 | 6719 | fcrb1852 | 6779 | fcrb1934 | 6839 | fcrb2013 | 6899 | fcrb2091 |
| 6660 | fcrb1772 | 6720 | fcrb1853 | 6780 | fcrb1936 | 6840 | fcrb2015 | 6900 | fcrb2092 |

Figure 6B – List of EST Sequence Names From Fetal Cartilage cDNA Library

| | |
|---|---|
| 6901 | fcrb2093 |
| 6902 | fcrb2094 |
| 6903 | fcrb2095 |
| 6904 | fcrb2097 |
| 6905 | fcrb2098 |
| 6906 | fcrb2100 |
| 6907 | fcrb2101 |
| 6908 | fcrb2102 |
| 6909 | fcrb2103 |
| 6910 | fcrb2104 |
| 6911 | fcrb2105 |
| 6912 | fcrb2106 |
| 6913 | fcrb2107 |
| 6914 | fcrb2109 |
| 6915 | fcrb2110 |
| 6916 | fcrb2111 |
| 6917 | fcrb2112 |
| 6918 | fcrb2113 |
| 6919 | fcrb2115 |
| 6920 | fcrb2116 |
| 6921 | fcrb2117 |
| 6922 | fcrb2118 |
| 6923 | fcrb2119 |
| 6924 | fcrb2120 |
| 6925 | fcrb2122 |
| 6926 | fcrb2124 |
| 6927 | fcrb2126 |
| 6928 | fcrb2127 |
| 6929 | fcrb2128 |
| 6930 | fcrb2130 |
| 6931 | fcrb2133 |
| 6932 | fcrb2134 |
| 6933 | fcrb2135 |
| 6934 | fcrb2136 |
| 6935 | fcrb2137 |
| 6936 | fcrb2138 |
| 6937 | fcrb2139 |
| 6938 | fcrb2140 |
| 6939 | fcrb2141 |
| 6940 | fcrb2143 |
| 6941 | fcrb2144 |
| 6942 | fcrb2145 |
| 6943 | fcrb2146 |
| 6944 | fcrb2149 |
| 6945 | fcrb2150 |
| 6946 | fcrb2151 |
| 6947 | fcrb2152 |
| 6948 | fcrb2153 |
| 6949 | fcrb2155 |
| 6950 | fcrb2156 |
| 6951 | fcrb2157 |
| 6952 | fcrb2158 |
| 6953 | fcrb2159 |
| 6954 | fcrb2160 |
| 6955 | fcrb2161 |
| 6956 | fcrb2162 |
| 6957 | fcrb2163 |
| 6958 | fcrb2164 |
| 6959 | fcrb2165 |
| 6960 | fcrb2166 |
| 6961 | fcrb2167 |
| 6962 | fcrb2168 |
| 6963 | fcrb2169 |
| 6964 | fcrb2173 |
| 6965 | fcrb2174 |
| 6966 | fcrb2175 |
| 6967 | fcrb2176 |
| 6968 | fcrb2177 |
| 6969 | fcrb2178 |
| 6970 | fcrb2179 |
| 6971 | fcrb2181 |
| 6972 | fcrb2182 |
| 6973 | fcrb2184 |
| 6974 | fcrb2185 |
| 6975 | fcrb2186 |
| 6976 | fcrb2187 |
| 6977 | fcrb2188 |
| 6978 | fcrb2189 |
| 6979 | fcrb2190 |
| 6980 | fcrb2191 |
| 6981 | fcrb2192 |
| 6982 | fcrb2193 |
| 6983 | fcrb2195 |
| 6984 | fcrb2196 |
| 6985 | fcrb2197 |
| 6986 | fcrb2198 |
| 6987 | fcrb2199 |
| 6988 | fcrb2200 |
| 6989 | fcrb2201 |
| 6990 | fcrb2203 |
| 6991 | fcrb2205 |
| 6992 | fcrb2206 |
| 6993 | fcrb2207 |
| 6994 | fcrb2208 |
| 6995 | fcrb2209 |
| 6996 | fcrb2210 |
| 6997 | fcrb2211 |
| 6998 | fcrb2212 |
| 6999 | fcrb2213 |
| 7000 | fcrb2214 |
| 7001 | fcrb2217 |
| 7002 | fcrb2218 |
| 7003 | fcrb2219 |
| 7004 | fcrb2220 |
| 7005 | fcrb2221 |
| 7006 | fcrb2223 |
| 7007 | fcrb2224 |
| 7008 | fcrb2225 |
| 7009 | fcrb2228 |
| 7010 | fcrb2229 |
| 7011 | fcrb2230 |
| 7012 | fcrb2232 |
| 7013 | fcrb2234 |
| 7014 | fcrb2235 |
| 7015 | fcrb2236 |
| 7016 | fcrb2237 |
| 7017 | fcrb2238 |
| 7018 | fcrb2239 |
| 7019 | fcrb2241 |
| 7020 | fcrb2244 |
| 7021 | fcrb2245 |
| 7022 | fcrb2246 |
| 7023 | fcrb2247 |
| 7024 | fcrb2248 |
| 7025 | fcrb2249 |
| 7026 | fcrb2251 |
| 7027 | fcrb2252 |
| 7028 | fcrb2253 |
| 7029 | fcrb2254 |
| 7030 | fcrb2255 |
| 7031 | fcrb2256 |
| 7032 | fcrb2257 |
| 7033 | fcrb2258 |
| 7034 | fcrb2260 |
| 7035 | fcrb2261 |
| 7036 | fcrb2262 |
| 7037 | fcrb2264 |
| 7038 | fcrb2269 |
| 7039 | fcrb2270 |
| 7040 | fcrb2271 |
| 7041 | fcrb2272 |
| 7042 | fcrb2273 |
| 7043 | fcrb2275 |
| 7044 | fcrb2276 |
| 7045 | fcrb2277 |
| 7046 | fcrb2279 |
| 7047 | fcrb2280 |
| 7048 | fcrb2282 |
| 7049 | fcrb2283 |
| 7050 | fcrb2284 |
| 7051 | fcrb2285 |
| 7052 | fcrb2286 |
| 7053 | fcrb2288 |
| 7054 | fcrb2289 |
| 7055 | fcrb2291 |
| 7056 | fcrb2292 |
| 7057 | fcrb2293 |
| 7058 | fcrb2294 |
| 7059 | fcrb2295 |
| 7060 | fcrb2297 |
| 7061 | fcrb2298 |
| 7062 | fcrb2299 |
| 7063 | fcrb2300 |
| 7064 | fcrb2301 |
| 7065 | fcrb2302 |
| 7066 | fcrb2303 |
| 7067 | fcrb2304 |
| 7068 | fcrb2305 |
| 7069 | fcrb2306 |
| 7070 | fcrb2307 |
| 7071 | fcrb2308 |
| 7072 | fcrb2309 |
| 7073 | fcrb2310 |
| 7074 | fcrb2313 |
| 7075 | fcrb2314 |
| 7076 | fcrb2315 |
| 7077 | fcrb2316 |
| 7078 | fcrb2317 |
| 7079 | fcrb2318 |
| 7080 | fcrb2319 |
| 7081 | fcrb2320 |
| 7082 | fcrb2321 |
| 7083 | fcrb2325 |
| 7084 | fcrb2326 |
| 7085 | fcrb2328 |
| 7086 | fcrb2329 |
| 7087 | fcrb2330 |
| 7088 | fcrb2331 |
| 7089 | fcrb2332 |
| 7090 | fcrb2334 |
| 7091 | fcrb2336 |
| 7092 | fcrb2337 |
| 7093 | fcrb2338 |
| 7094 | fcrb2340 |
| 7095 | fcrb2342 |
| 7096 | fcrb2343 |
| 7097 | fcrb2344 |
| 7098 | fcrb2346 |
| 7099 | fcrb2348 |
| 7100 | fcrb2349 |
| 7101 | fcrb2350 |
| 7102 | fcrb2351 |
| 7103 | fcrb2352 |
| 7104 | fcrb2353 |
| 7105 | fcrb2354 |
| 7106 | fcrb2355 |
| 7107 | fcrb2356 |
| 7108 | fcrb2358 |
| 7109 | fcrb2360 |
| 7110 | fcrb2361 |
| 7111 | fcrb2363 |
| 7112 | fcrb2364 |
| 7113 | fcrb2365 |
| 7114 | fcrb2368 |
| 7115 | fcrb2370 |
| 7116 | fcrb2371 |
| 7117 | fcrb2373 |
| 7118 | fcrb2376 |
| 7119 | fcrb2377 |
| 7120 | fcrb2379 |
| 7121 | fcrb2380 |
| 7122 | fcrb2381 |
| 7123 | fcrb2382 |
| 7124 | fcrb2383 |
| 7125 | fcrb2387 |
| 7126 | fcrb2388 |
| 7127 | fcrb2389 |
| 7128 | fcrb2390 |
| 7129 | fcrb2392 |
| 7130 | fcrb2393 |
| 7131 | fcrb2394 |
| 7132 | fcrb2395 |
| 7133 | fcrb2396 |
| 7134 | fcrb2397 |
| 7135 | fcrb2398 |
| 7136 | fcrb2400 |
| 7137 | fcrb2401 |
| 7138 | fcrb2403 |
| 7139 | fcrb2404 |
| 7140 | fcrb2406 |
| 7141 | fcrb2408 |
| 7142 | fcrb2409 |
| 7143 | fcrb2412 |
| 7144 | fcrb2413 |
| 7145 | fcrb2414 |
| 7146 | fcrb2416 |
| 7147 | fcrb2420 |
| 7148 | fcrb2421 |
| 7149 | fcrb2422 |
| 7150 | fcrb2424 |
| 7151 | fcrb2426 |
| 7152 | fcrb2427 |
| 7153 | fcrb2429 |
| 7154 | fcrb2430 |
| 7155 | fcrb2432 |
| 7156 | fcrb2433 |
| 7157 | fcrb2434 |
| 7158 | fcrb2436 |
| 7159 | fcrb2437 |
| 7160 | fcrb2438 |
| 7161 | fcrb2440 |
| 7162 | fcrb2441 |
| 7163 | fcrb2442 |
| 7164 | fcrb2444 |
| 7165 | fcrb2445 |
| 7166 | fcrb2447 |
| 7167 | fcrb2449 |
| 7168 | fcrb2450 |
| 7169 | fcrb2451 |
| 7170 | fcrb2452 |
| 7171 | fcrb2453 |
| 7172 | fcrb2454 |
| 7173 | fcrb2457 |
| 7174 | fcrb2458 |
| 7175 | fcrb2459 |
| 7176 | fcrb2460 |
| 7177 | fcrb2461 |
| 7178 | fcrb2462 |
| 7179 | fcrb2463 |
| 7180 | fcrb2466 |
| 7181 | fcrb2467 |
| 7182 | fcrb2468 |
| 7183 | fcrb2472 |
| 7184 | fcrb2473 |
| 7185 | fcrb2474 |
| 7186 | fcrb2476 |
| 7187 | fcrb2477 |
| 7188 | fcrb2478 |
| 7189 | fcrb2479 |
| 7190 | fcrb2480 |
| 7191 | fcrb2482 |
| 7192 | fcrb2483 |
| 7193 | fcrb2484 |
| 7194 | fcrb2485 |
| 7195 | fcrb2486 |
| 7196 | fcrb2487 |
| 7197 | fcrb2491 |
| 7198 | fcrb2492 |
| 7199 | fcrb2493 |
| 7200 | fcrb2494 |

Figure 6B – List of EST Sequence Names From Fetal Cartilage cDNA Library

| | | | | | | | | | |
|---|---|---|---|---|---|---|---|---|---|
| 7201 | fcrb2495 | 7261 | fcrb2574 | 7321 | fcrb2656 | 7381 | fcrb2755 | 7441 | hfcr0056 |
| 7202 | fcrb2497 | 7262 | fcrb2575 | 7322 | fcrb2657 | 7382 | fcrb2756 | 7442 | hfcr0057 |
| 7203 | fcrb2499 | 7263 | fcrb2576 | 7323 | fcrb2658 | 7383 | fcrb2757 | 7443 | hfcr0058 |
| 7204 | fcrb2500 | 7264 | fcrb2577 | 7324 | fcrb2660 | 7384 | fcrb2758 | 7444 | hfcr0059 |
| 7205 | fcrb2501 | 7265 | fcrb2579 | 7325 | fcrb2661 | 7385 | fcrb2759 | 7445 | hfcr0060 |
| 7206 | fcrb2502 | 7266 | fcrb2580 | 7326 | fcrb2662 | 7386 | fcrb2760 | 7446 | hfcr0061 |
| 7207 | fcrb2504 | 7267 | fcrb2581 | 7327 | fcrb2664 | 7387 | fcrb2761 | 7447 | hfcr0062 |
| 7208 | fcrb2505 | 7268 | fcrb2582 | 7328 | fcrb2667 | 7388 | fcrb2762 | 7448 | hfcr0063 |
| 7209 | fcrb2506 | 7269 | fcrb2583 | 7329 | fcrb2668 | 7389 | fcrb2763 | 7449 | hfcr0064 |
| 7210 | fcrb2507 | 7270 | fcrb2585 | 7330 | fcrb2671 | 7390 | fcrb2764 | 7450 | hfcr0065 |
| 7211 | fcrb2508 | 7271 | fcrb2586 | 7331 | fcrb2672 | 7391 | fcrb2765 | 7451 | hfcr0066 |
| 7212 | fcrb2509 | 7272 | fcrb2588 | 7332 | fcrb2675 | 7392 | fcrb2767 | 7452 | hfcr0067 |
| 7213 | fcrb2510 | 7273 | fcrb2590 | 7333 | fcrb2676 | 7393 | fcrb2768 | 7453 | hfcr0068 |
| 7214 | fcrb2511 | 7274 | fcrb2591 | 7334 | fcrb2677 | 7394 | fcrb2769 | 7454 | hfcr0070 |
| 7215 | fcrb2512 | 7275 | fcrb2592 | 7335 | fcrb2678 | 7395 | hfcr0001 | 7455 | hfcr0071 |
| 7216 | fcrb2513 | 7276 | fcrb2593 | 7336 | fcrb2680 | 7396 | hfcr0003 | 7456 | hfcr0073 |
| 7217 | fcrb2516 | 7277 | fcrb2594 | 7337 | fcrb2682 | 7397 | hfcr0004 | 7457 | hfcr0074 |
| 7218 | fcrb2517 | 7278 | fcrb2595 | 7338 | fcrb2685 | 7398 | hfcr0005 | 7458 | hfcr0075 |
| 7219 | fcrb2518 | 7279 | fcrb2596 | 7339 | fcrb2687 | 7399 | hfcr0006 | 7459 | hfcr0076 |
| 7220 | fcrb2520 | 7280 | fcrb2597 | 7340 | fcrb2689 | 7400 | hfcr0008 | 7460 | hfcr0077 |
| 7221 | fcrb2521 | 7281 | fcrb2598 | 7341 | fcrb2690 | 7401 | hfcr0010 | 7461 | hfcr0078 |
| 7222 | fcrb2523 | 7282 | fcrb2601 | 7342 | fcrb2692 | 7402 | hfcr0011 | 7462 | hfcr0079 |
| 7223 | fcrb2524 | 7283 | fcrb2602 | 7343 | fcrb2693 | 7403 | hfcr0012 | 7463 | hfcr0080 |
| 7224 | fcrb2525 | 7284 | fcrb2603 | 7344 | fcrb2696 | 7404 | hfcr0013 | 7464 | hfcr0081 |
| 7225 | fcrb2526 | 7285 | fcrb2605 | 7345 | fcrb2697 | 7405 | hfcr0014 | 7465 | hfcr0082 |
| 7226 | fcrb2528 | 7286 | fcrb2608 | 7346 | fcrb2700 | 7406 | hfcr0015 | 7466 | hfcr0084 |
| 7227 | fcrb2532 | 7287 | fcrb2612 | 7347 | fcrb2703 | 7407 | hfcr0016 | 7467 | hfcr0085 |
| 7228 | fcrb2534 | 7288 | fcrb2613 | 7348 | fcrb2704 | 7408 | hfcr0017 | 7468 | hfcr0086 |
| 7229 | fcrb2535 | 7289 | fcrb2614 | 7349 | fcrb2705 | 7409 | hfcr0018 | 7469 | hfcr0087 |
| 7230 | fcrb2536 | 7290 | fcrb2616 | 7350 | fcrb2709 | 7410 | hfcr0020 | 7470 | hfcr0088 |
| 7231 | fcrb2538 | 7291 | fcrb2618 | 7351 | fcrb2710 | 7411 | hfcr0021 | 7471 | hfcr0089 |
| 7232 | fcrb2540 | 7292 | fcrb2619 | 7352 | fcrb2713 | 7412 | hfcr0022 | 7472 | hfcr0091 |
| 7233 | fcrb2541 | 7293 | fcrb2620 | 7353 | fcrb2715 | 7413 | hfcr0023 | 7473 | hfcr0092 |
| 7234 | fcrb2542 | 7294 | fcrb2621 | 7354 | fcrb2717 | 7414 | hfcr0024 | 7474 | hfcr0093 |
| 7235 | fcrb2543 | 7295 | fcrb2622 | 7355 | fcrb2719 | 7415 | hfcr0025 | 7475 | hfcr0095 |
| 7236 | fcrb2544 | 7296 | fcrb2624 | 7356 | fcrb2722 | 7416 | hfcr0026 | 7476 | hfcr0096 |
| 7237 | fcrb2545 | 7297 | fcrb2625 | 7357 | fcrb2724 | 7417 | hfcr0027 | 7477 | hfcr0099 |
| 7238 | fcrb2546 | 7298 | fcrb2626 | 7358 | fcrb2725 | 7418 | hfcr0028 | 7478 | hfcr0100 |
| 7239 | fcrb2547 | 7299 | fcrb2628 | 7359 | fcrb2726 | 7419 | hfcr0029 | 7479 | hfcr0102 |
| 7240 | fcrb2548 | 7300 | fcrb2629 | 7360 | fcrb2727 | 7420 | hfcr0030 | 7480 | hfcr0108 |
| 7241 | fcrb2549 | 7301 | fcrb2630 | 7361 | fcrb2731 | 7421 | hfcr0032 | 7481 | hfcr0112 |
| 7242 | fcrb2550 | 7302 | fcrb2631 | 7362 | fcrb2732 | 7422 | hfcr0033 | 7482 | hfcr0113 |
| 7243 | fcrb2552 | 7303 | fcrb2632 | 7363 | fcrb2733 | 7423 | hfcr0034 | 7483 | hfcr0114 |
| 7244 | fcrb2553 | 7304 | fcrb2633 | 7364 | fcrb2735 | 7424 | hfcr0035 | 7484 | hfcr0116 |
| 7245 | fcrb2554 | 7305 | fcrb2634 | 7365 | fcrb2736 | 7425 | hfcr0037 | 7485 | hfcr0117 |
| 7246 | fcrb2556 | 7306 | fcrb2635 | 7366 | fcrb2737 | 7426 | hfcr0039 | 7486 | hfcr0118 |
| 7247 | fcrb2557 | 7307 | fcrb2636 | 7367 | fcrb2738 | 7427 | hfcr0040 | 7487 | hfcr0119 |
| 7248 | fcrb2558 | 7308 | fcrb2637 | 7368 | fcrb2739 | 7428 | hfcr0041 | 7488 | hfcr0120 |
| 7249 | fcrb2559 | 7309 | fcrb2638 | 7369 | fcrb2740 | 7429 | hfcr0042 | 7489 | hfcr0121 |
| 7250 | fcrb2560 | 7310 | fcrb2639 | 7370 | fcrb2742 | 7430 | hfcr0043 | 7490 | hfcr0122 |
| 7251 | fcrb2562 | 7311 | fcrb2640 | 7371 | fcrb2743 | 7431 | hfcr0044 | 7491 | hfcr0123 |
| 7252 | fcrb2563 | 7312 | fcrb2643 | 7372 | fcrb2744 | 7432 | hfcr0045 | 7492 | hfcr0124 |
| 7253 | fcrb2564 | 7313 | fcrb2644 | 7373 | fcrb2745 | 7433 | hfcr0046 | 7493 | hfcr0125 |
| 7254 | fcrb2565 | 7314 | fcrb2645 | 7374 | fcrb2746 | 7434 | hfcr0047 | 7494 | hfcr0128 |
| 7255 | fcrb2566 | 7315 | fcrb2646 | 7375 | fcrb2748 | 7435 | hfcr0048 | 7495 | hfcr0129 |
| 7256 | fcrb2568 | 7316 | fcrb2647 | 7376 | fcrb2749 | 7436 | hfcr0049 | 7496 | hfcr0130 |
| 7257 | fcrb2569 | 7317 | fcrb2648 | 7377 | fcrb2750 | 7437 | hfcr0051 | 7497 | hfcr0131 |
| 7258 | fcrb2571 | 7318 | fcrb2649 | 7378 | fcrb2751 | 7438 | hfcr0053 | 7498 | hfcr0133 |
| 7259 | fcrb2572 | 7319 | fcrb2651 | 7379 | fcrb2753 | 7439 | hfcr0054 | 7499 | hfcr0136 |
| 7260 | fcrb2573 | 7320 | fcrb2652 | 7380 | fcrb2754 | 7440 | hfcr0055 | 7500 | hfcr0138 |

Figure 6B – List of EST Sequence Names From Fetal Cartilage cDNA Library

| | |
|---|---|
| 7501 | hfcr0139 |
| 7502 | hfcr0140 |
| 7503 | hfcr0141 |
| 7504 | hfcr0142 |
| 7505 | hfcr0143 |
| 7506 | hfcr0145 |
| 7507 | hfcr0147 |
| 7508 | hfcr0149 |
| 7509 | hfcr0150 |
| 7510 | hfcr0153 |
| 7511 | hfcr0154 |
| 7512 | hfcr0155 |
| 7513 | hfcr0156 |
| 7514 | hfcr0157 |
| 7515 | hfcr0158 |
| 7516 | hfcr0159 |
| 7517 | hfcr0161 |
| 7518 | hfcr0162 |
| 7519 | hfcr0163 |
| 7520 | hfcr0164 |
| 7521 | hfcr0166 |
| 7522 | hfcr0167 |
| 7523 | hfcr0170 |
| 7524 | hfcr0171 |
| 7525 | hfcr0173 |
| 7526 | hfcr0174 |
| 7527 | hfcr0175 |
| 7528 | hfcr0177 |
| 7529 | hfcr0178 |
| 7530 | hfcr0180 |
| 7531 | hfcr0181 |
| 7532 | hfcr0182 |
| 7533 | hfcr0183 |
| 7534 | hfcr0184 |
| 7535 | hfcr0187 |
| 7536 | hfcr0188 |
| 7537 | hfcr0189 |
| 7538 | hfcr0191 |
| 7539 | hfcr0192 |
| 7540 | hfcr0196 |
| 7541 | hfcr0197 |
| 7542 | hfcr0198 |
| 7543 | hfcr0199 |
| 7544 | hfcr0200 |
| 7545 | hfcr0203 |
| 7546 | hfcr0204 |
| 7547 | hfcr0205 |
| 7548 | hfcr0206 |
| 7549 | hfcr0207 |
| 7550 | hfcr0210 |
| 7551 | hfcr0212 |
| 7552 | hfcr0214 |
| 7553 | hfcr0215 |
| 7554 | hfcr0217 |
| 7555 | hfcr0220 |
| 7556 | hfcr0221 |
| 7557 | hfcr0222 |
| 7558 | hfcr0225 |
| 7559 | hfcr0226 |
| 7560 | hfcr0227 |
| 7561 | hfcr0228 |
| 7562 | hfcr0229 |
| 7563 | hfcr0234 |
| 7564 | hfcr0235 |
| 7565 | hfcr0236 |
| 7566 | hfcr0237 |
| 7567 | hfcr0238 |
| 7568 | hfcr0239 |
| 7569 | hfcr0240 |
| 7570 | hfcr0241 |
| 7571 | hfcr0242 |
| 7572 | hfcr0243 |
| 7573 | hfcr0246 |
| 7574 | hfcr0247 |
| 7575 | hfcr0248 |
| 7576 | hfcr0250 |
| 7577 | hfcr0252 |
| 7578 | hfcr0254 |
| 7579 | hfcr0255 |
| 7580 | hfcr0256 |
| 7581 | hfcr0257 |
| 7582 | hfcr0258 |
| 7583 | hfcr0259 |
| 7584 | hfcr0260 |
| 7585 | hfcr0262 |
| 7586 | hfcr0263 |
| 7587 | hfcr0265 |
| 7588 | hfcr0266 |
| 7589 | hfcr0267 |
| 7590 | hfcr0269 |
| 7591 | hfcr0270 |
| 7592 | hfcr0271 |
| 7593 | hfcr0273 |
| 7594 | hfcr0274 |
| 7595 | hfcr0275 |
| 7596 | hfcr0276 |
| 7597 | hfcr0277 |
| 7598 | hfcr0278 |
| 7599 | hfcr0279 |
| 7600 | hfcr0280 |
| 7601 | hfcr0281 |
| 7602 | hfcr0282 |
| 7603 | hfcr0284 |
| 7604 | hfcr0285 |
| 7605 | hfcr0287 |
| 7606 | hfcr0288 |
| 7607 | hfcr0290 |
| 7608 | hfcr0291 |
| 7609 | hfcr0292 |
| 7610 | hfcr0293 |
| 7611 | hfcr0294 |
| 7612 | hfcr0295 |
| 7613 | hfcr0297 |
| 7614 | hfcr0298 |
| 7615 | hfcr0299 |
| 7616 | hfcr0300 |
| 7617 | hfcr0302 |
| 7618 | hfcr0303 |
| 7619 | hfcr0304 |
| 7620 | hfcr0305 |
| 7621 | hfcr0307 |
| 7622 | hfcr0308 |
| 7623 | hfcr0309 |
| 7624 | hfcr0310 |
| 7625 | hfcr0311 |
| 7626 | hfcr0312 |
| 7627 | hfcr0315 |
| 7628 | hfcr0316 |
| 7629 | hfcr0317 |
| 7630 | hfcr0318 |
| 7631 | hfcr0319 |
| 7632 | hfcr0320 |
| 7633 | hfcr0321 |
| 7634 | hfcr0322 |
| 7635 | hfcr0324 |
| 7636 | hfcr0325 |
| 7637 | hfcr0326 |
| 7638 | hfcr0327 |
| 7639 | hfcr0328 |
| 7640 | hfcr0330 |
| 7641 | hfcr0331 |
| 7642 | hfcr0332 |
| 7643 | hfcr0333 |
| 7644 | hfcr0334 |
| 7645 | hfcr0335 |
| 7646 | hfcr0336 |
| 7647 | hfcr0337 |
| 7648 | hfcr0338 |
| 7649 | hfcr0339 |
| 7650 | hfcr0341 |
| 7651 | hfcr0342 |
| 7652 | hfcr0343 |
| 7653 | hfcr0344 |
| 7654 | hfcr0345 |
| 7655 | hfcr0346 |
| 7656 | hfcr0347 |
| 7657 | hfcr0348 |
| 7658 | hfcr0349 |
| 7659 | hfcr0350 |
| 7660 | hfcr0351 |
| 7661 | hfcr0352 |
| 7662 | hfcr0354 |
| 7663 | hfcr0356 |
| 7664 | hfcr0357 |
| 7665 | hfcr0358 |
| 7666 | hfcr0359 |
| 7667 | hfcr0360 |
| 7668 | hfcr0361 |
| 7669 | hfcr0362 |
| 7670 | hfcr0363 |
| 7671 | hfcr0365 |
| 7672 | hfcr0366 |
| 7673 | hfcr0368 |
| 7674 | hfcr0369 |
| 7675 | hfcr0370 |
| 7676 | hfcr0371 |
| 7677 | hfcr0372 |
| 7678 | hfcr0374 |
| 7679 | hfcr0375 |
| 7680 | hfcr0376 |
| 7681 | hfcr0377 |
| 7682 | hfcr0378 |
| 7683 | hfcr0379 |
| 7684 | hfcr0380 |
| 7685 | hfcr0381 |
| 7686 | hfcr0382 |
| 7687 | hfcr0383 |
| 7688 | hfcr0384 |
| 7689 | hfcr0385 |
| 7690 | hfcr0386 |
| 7691 | hfcr0387 |
| 7692 | hfcr0390 |
| 7693 | hfcr0391 |
| 7694 | hfcr0392 |
| 7695 | hfcr0393 |
| 7696 | hfcr0394 |
| 7697 | hfcr0395 |
| 7698 | hfcr0396 |
| 7699 | hfcr0398 |
| 7700 | hfcr0399 |
| 7701 | hfcr0400 |
| 7702 | hfcr0401 |
| 7703 | hfcr0402 |
| 7704 | hfcr0403 |
| 7705 | hfcr0404 |
| 7706 | hfcr0405 |
| 7707 | hfcr0406 |
| 7708 | hfcr0407 |
| 7709 | hfcr0408 |
| 7710 | hfcr0409 |
| 7711 | hfcr0410 |
| 7712 | hfcr0411 |
| 7713 | hfcr0412 |
| 7714 | hfcr0413 |
| 7715 | hfcr0414 |
| 7716 | hfcr0415 |
| 7717 | hfcr0416 |
| 7718 | hfcr0417 |
| 7719 | hfcr0418 |
| 7720 | hfcr0419 |
| 7721 | hfcr0420 |
| 7722 | hfcr0421 |
| 7723 | hfcr0422 |
| 7724 | hfcr0423 |
| 7725 | hfcr0424 |
| 7726 | hfcr0425 |
| 7727 | hfcr0426 |
| 7728 | hfcr0427 |
| 7729 | hfcr0428 |
| 7730 | hfcr0430 |
| 7731 | hfcr0431 |
| 7732 | hfcr0432 |
| 7733 | hfcr0433 |
| 7734 | hfcr0434 |
| 7735 | hfcr0436 |
| 7736 | hfcr0438 |
| 7737 | hfcr0439 |
| 7738 | hfcr0441 |
| 7739 | hfcr0442 |
| 7740 | hfcr0444 |
| 7741 | hfcr0445 |
| 7742 | hfcr0446 |
| 7743 | hfcr0448 |
| 7744 | hfcr0449 |
| 7745 | hfcr0450 |
| 7746 | hfcr0452 |
| 7747 | hfcr0453 |
| 7748 | hfcr0454 |
| 7749 | hfcr0456 |
| 7750 | hfcr0457 |
| 7751 | hfcr0458 |
| 7752 | hfcr0459 |
| 7753 | hfcr0460 |
| 7754 | hfcr0463 |
| 7755 | hfcr0464 |
| 7756 | hfcr0465 |
| 7757 | hfcr0466 |
| 7758 | hfcr0467 |
| 7759 | hfcr0468 |
| 7760 | hfcr0469 |
| 7761 | hfcr0470 |
| 7762 | hfcr0471 |
| 7763 | hfcr0472 |
| 7764 | hfcr0473 |
| 7765 | hfcr0474 |
| 7766 | hfcr0475 |
| 7767 | hfcr0476 |
| 7768 | hfcr0477 |
| 7769 | hfcr0478 |
| 7770 | hfcr0479 |
| 7771 | hfcr0480 |
| 7772 | hfcr0481 |
| 7773 | hfcr0482 |
| 7774 | hfcr0483 |
| 7775 | hfcr0484 |
| 7776 | hfcr0485 |
| 7777 | hfcr0486 |
| 7778 | hfcr0487 |
| 7779 | hfcr0488 |
| 7780 | hfcr0489 |
| 7781 | hfcr0491 |
| 7782 | hfcr0493 |
| 7783 | hfcr0494 |
| 7784 | hfcr0495 |
| 7785 | hfcr0496 |
| 7786 | hfcr0497 |
| 7787 | hfcr0498 |
| 7788 | hfcr0499 |
| 7789 | hfcr0501 |
| 7790 | hfcr0502 |
| 7791 | hfcr0503 |
| 7792 | hfcr0504 |
| 7793 | hfcr0505 |
| 7794 | hfcr0506 |
| 7795 | hfcr0508 |
| 7796 | hfcr0509 |
| 7797 | hfcr0510 |
| 7798 | hfcr0511 |
| 7799 | hfcr0512 |
| 7800 | hfcr0513 |

Figure 6B – List of EST Sequence Names From Fetal Cartilage cDNA Library

| | | | | | | | | | |
|---|---|---|---|---|---|---|---|---|---|
| 7801 | hfcr0514 | 7861 | hfcr0581 | 7921 | hfcr0675 | 7981 | hfcr0748 | 8041 | hfcr0839 |
| 7802 | hfcr0515 | 7862 | hfcr0582 | 7922 | hfcr0676 | 7982 | hfcr0749 | 8042 | hfcr0840 |
| 7803 | hfcr0516 | 7863 | hfcr0584 | 7923 | hfcr0677 | 7983 | hfcr0750 | 8043 | hfcr0841 |
| 7804 | hfcr0517 | 7864 | hfcr0586 | 7924 | hfcr0678 | 7984 | hfcr0751 | 8044 | hfcr0842 |
| 7805 | hfcr0518 | 7865 | hfcr0587 | 7925 | hfcr0679 | 7985 | hfcr0753 | 8045 | hfcr0843 |
| 7806 | hfcr0519 | 7866 | hfcr0588 | 7926 | hfcr0681 | 7986 | hfcr0754 | 8046 | hfcr0844 |
| 7807 | hfcr0520 | 7867 | hfcr0593 | 7927 | hfcr0682 | 7987 | hfcr0756 | 8047 | hfcr0846 |
| 7808 | hfcr0521 | 7868 | hfcr0594 | 7928 | hfcr0683 | 7988 | hfcr0757 | 8048 | hfcr0847 |
| 7809 | hfcr0522 | 7869 | hfcr0595 | 7929 | hfcr0684 | 7989 | hfcr0758 | 8049 | hfcr0849 |
| 7810 | hfcr0523 | 7870 | hfcr0596 | 7930 | hfcr0686 | 7990 | hfcr0760 | 8050 | hfcr0851 |
| 7811 | hfcr0524 | 7871 | hfcr0599 | 7931 | hfcr0687 | 7991 | hfcr0761 | 8051 | hfcr0852 |
| 7812 | hfcr0525 | 7872 | hfcr0601 | 7932 | hfcr0688 | 7992 | hfcr0762 | 8052 | hfcr0853 |
| 7813 | hfcr0527 | 7873 | hfcr0602 | 7933 | hfcr0689 | 7993 | hfcr0763 | 8053 | hfcr0854 |
| 7814 | hfcr0528 | 7874 | hfcr0604 | 7934 | hfcr0691 | 7994 | hfcr0765 | 8054 | hfcr0855 |
| 7815 | hfcr0529 | 7875 | hfcr0605 | 7935 | hfcr0692 | 7995 | hfcr0766 | 8055 | hfcr0856 |
| 7816 | hfcr0530 | 7876 | hfcr0607 | 7936 | hfcr0693 | 7996 | hfcr0768 | 8056 | hfcr0857 |
| 7817 | hfcr0531 | 7877 | hfcr0608 | 7937 | hfcr0694 | 7997 | hfcr0770 | 8057 | hfcr0858 |
| 7818 | hfcr0532 | 7878 | hfcr0609 | 7938 | hfcr0695 | 7998 | hfcr0772 | 8058 | hfcr0859 |
| 7819 | hfcr0533 | 7879 | hfcr0610 | 7939 | hfcr0696 | 7999 | hfcr0774 | 8059 | hfcr0861 |
| 7820 | hfcr0534 | 7880 | hfcr0611 | 7940 | hfcr0697 | 8000 | hfcr0776 | 8060 | hfcr0862 |
| 7821 | hfcr0535 | 7881 | hfcr0612 | 7941 | hfcr0698 | 8001 | hfcr0778 | 8061 | hfcr0863 |
| 7822 | hfcr0536 | 7882 | hfcr0613 | 7942 | hfcr0699 | 8002 | hfcr0780 | 8062 | hfcr0868 |
| 7823 | hfcr0538 | 7883 | hfcr0614 | 7943 | hfcr0700 | 8003 | hfcr0782 | 8063 | hfcr0872 |
| 7824 | hfcr0539 | 7884 | hfcr0615 | 7944 | hfcr0702 | 8004 | hfcr0783 | 8064 | hfcr0873 |
| 7825 | hfcr0540 | 7885 | hfcr0616 | 7945 | hfcr0705 | 8005 | hfcr0784 | 8065 | hfcr0879 |
| 7826 | hfcr0541 | 7886 | hfcr0617 | 7946 | hfcr0706 | 8006 | hfcr0786 | 8066 | hfcr0882 |
| 7827 | hfcr0542 | 7887 | hfcr0618 | 7947 | hfcr0707 | 8007 | hfcr0787 | 8067 | hfcr0884 |
| 7828 | hfcr0543 | 7888 | hfcr0619 | 7948 | hfcr0708 | 8008 | hfcr0788 | 8068 | hfcr0886 |
| 7829 | hfcr0544 | 7889 | hfcr0621 | 7949 | hfcr0709 | 8009 | hfcr0789 | 8069 | hfcr0887 |
| 7830 | hfcr0545 | 7890 | hfcr0622 | 7950 | hfcr0710 | 8010 | hfcr0790 | 8070 | hfcr0889 |
| 7831 | hfcr0546 | 7891 | hfcr0624 | 7951 | hfcr0711 | 8011 | hfcr0791 | 8071 | hfcr0890 |
| 7832 | hfcr0547 | 7892 | hfcr0625 | 7952 | hfcr0712 | 8012 | hfcr0792 | 8072 | hfcr0892 |
| 7833 | hfcr0548 | 7893 | hfcr0626 | 7953 | hfcr0713 | 8013 | hfcr0797 | 8073 | hfcr0893 |
| 7834 | hfcr0549 | 7894 | hfcr0629 | 7954 | hfcr0715 | 8014 | hfcr0798 | 8074 | hfcr0894 |
| 7835 | hfcr0550 | 7895 | hfcr0630 | 7955 | hfcr0716 | 8015 | hfcr0801 | 8075 | hfcr0895 |
| 7836 | hfcr0551 | 7896 | hfcr0631 | 7956 | hfcr0717 | 8016 | hfcr0802 | 8076 | hfcr0896 |
| 7837 | hfcr0554 | 7897 | hfcr0632 | 7957 | hfcr0718 | 8017 | hfcr0805 | 8077 | hfcr0898 |
| 7838 | hfcr0555 | 7898 | hfcr0633 | 7958 | hfcr0720 | 8018 | hfcr0806 | 8078 | hfcr0899 |
| 7839 | hfcr0556 | 7899 | hfcr0634 | 7959 | hfcr0721 | 8019 | hfcr0807 | 8079 | hfcr0900 |
| 7840 | hfcr0557 | 7900 | hfcr0635 | 7960 | hfcr0722 | 8020 | hfcr0808 | 8080 | hfcr0901 |
| 7841 | hfcr0558 | 7901 | hfcr0636 | 7961 | hfcr0723 | 8021 | hfcr0813 | 8081 | hfcr0902 |
| 7842 | hfcr0559 | 7902 | hfcr0638 | 7962 | hfcr0724 | 8022 | hfcr0815 | 8082 | hfcr0906 |
| 7843 | hfcr0560 | 7903 | hfcr0639 | 7963 | hfcr0725 | 8023 | hfcr0817 | 8083 | hfcr0908 |
| 7844 | hfcr0561 | 7904 | hfcr0645 | 7964 | hfcr0728 | 8024 | hfcr0818 | 8084 | hfcr0910 |
| 7845 | hfcr0562 | 7905 | hfcr0650 | 7965 | hfcr0730 | 8025 | hfcr0819 | 8085 | hfcr0912 |
| 7846 | hfcr0563 | 7906 | hfcr0651 | 7966 | hfcr0731 | 8026 | hfcr0820 | 8086 | hfcr0913 |
| 7847 | hfcr0565 | 7907 | hfcr0652 | 7967 | hfcr0732 | 8027 | hfcr0821 | 8087 | hfcr0916 |
| 7848 | hfcr0566 | 7908 | hfcr0656 | 7968 | hfcr0733 | 8028 | hfcr0822 | 8088 | hfcr0918 |
| 7849 | hfcr0567 | 7909 | hfcr0657 | 7969 | hfcr0734 | 8029 | hfcr0825 | 8089 | hfcr0921 |
| 7850 | hfcr0568 | 7910 | hfcr0662 | 7970 | hfcr0735 | 8030 | hfcr0826 | 8090 | hfcr0922 |
| 7851 | hfcr0569 | 7911 | hfcr0663 | 7971 | hfcr0736 | 8031 | hfcr0827 | 8091 | hfcr0923 |
| 7852 | hfcr0570 | 7912 | hfcr0664 | 7972 | hfcr0737 | 8032 | hfcr0828 | 8092 | hfcr0928 |
| 7853 | hfcr0571 | 7913 | hfcr0665 | 7973 | hfcr0738 | 8033 | hfcr0829 | 8093 | hfcr0929 |
| 7854 | hfcr0572 | 7914 | hfcr0666 | 7974 | hfcr0739 | 8034 | hfcr0830 | 8094 | hfcr0931 |
| 7855 | hfcr0573 | 7915 | hfcr0667 | 7975 | hfcr0740 | 8035 | hfcr0831 | 8095 | hfcr0933 |
| 7856 | hfcr0574 | 7916 | hfcr0668 | 7976 | hfcr0742 | 8036 | hfcr0832 | 8096 | hfcr0934 |
| 7857 | hfcr0575 | 7917 | hfcr0669 | 7977 | hfcr0743 | 8037 | hfcr0835 | 8097 | hfcr0937 |
| 7858 | hfcr0576 | 7918 | hfcr0670 | 7978 | hfcr0745 | 8038 | hfcr0836 | 8098 | hfcr0938 |
| 7859 | hfcr0579 | 7919 | hfcr0673 | 7979 | hfcr0746 | 8039 | hfcr0837 | 8099 | hfcr0940 |
| 7860 | hfcr0580 | 7920 | hfcr0674 | 7980 | hfcr0747 | 8040 | hfcr0838 | 8100 | hfcr0941 |

Figure 6B – List of EST Sequence Names From Fetal Cartilage cDNA Library

| | | | | | | | | | |
|---|---|---|---|---|---|---|---|---|---|
| 8101 | hfcr0942 | 8161 | hfcr1038 | 8221 | hfcr1123 | 8281 | hfcr1203 | 8341 | hfcr1287 |
| 8102 | hfcr0944 | 8162 | hfcr1039 | 8222 | hfcr1124 | 8282 | hfcr1204 | 8342 | hfcr1288 |
| 8103 | hfcr0945 | 8163 | hfcr1040 | 8223 | hfcr1125 | 8283 | hfcr1205 | 8343 | hfcr1289 |
| 8104 | hfcr0946 | 8164 | hfcr1041 | 8224 | hfcr1126 | 8284 | hfcr1207 | 8344 | hfcr1290 |
| 8105 | hfcr0947 | 8165 | hfcr1042 | 8225 | hfcr1127 | 8285 | hfcr1208 | 8345 | hfcr1291 |
| 8106 | hfcr0950 | 8166 | hfcr1043 | 8226 | hfcr1128 | 8286 | hfcr1209 | 8346 | hfcr1292 |
| 8107 | hfcr0952 | 8167 | hfcr1045 | 8227 | hfcr1129 | 8287 | hfcr1210 | 8347 | hfcr1293 |
| 8108 | hfcr0953 | 8168 | hfcr1046 | 8228 | hfcr1130 | 8288 | hfcr1211 | 8348 | hfcr1295 |
| 8109 | hfcr0954 | 8169 | hfcr1047 | 8229 | hfcr1131 | 8289 | hfcr1212 | 8349 | hfcr1296 |
| 8110 | hfcr0957 | 8170 | hfcr1048 | 8230 | hfcr1132 | 8290 | hfcr1213 | 8350 | hfcr1297 |
| 8111 | hfcr0959 | 8171 | hfcr1051 | 8231 | hfcr1133 | 8291 | hfcr1214 | 8351 | hfcr1298 |
| 8112 | hfcr0960 | 8172 | hfcr1053 | 8232 | hfcr1135 | 8292 | hfcr1215 | 8352 | hfcr1302 |
| 8113 | hfcr0961 | 8173 | hfcr1054 | 8233 | hfcr1136 | 8293 | hfcr1217 | 8353 | hfcr1303 |
| 8114 | hfcr0962 | 8174 | hfcr1055 | 8234 | hfcr1137 | 8294 | hfcr1219 | 8354 | hfcr1304 |
| 8115 | hfcr0963 | 8175 | hfcr1057 | 8235 | hfcr1138 | 8295 | hfcr1220 | 8355 | hfcr1306 |
| 8116 | hfcr0964 | 8176 | hfcr1059 | 8236 | hfcr1139 | 8296 | hfcr1221 | 8356 | hfcr1307 |
| 8117 | hfcr0966 | 8177 | hfcr1060 | 8237 | hfcr1140 | 8297 | hfcr1225 | 8357 | hfcr1308 |
| 8118 | hfcr0967 | 8178 | hfcr1063 | 8238 | hfcr1141 | 8298 | hfcr1228 | 8358 | hfcr1309 |
| 8119 | hfcr0968 | 8179 | hfcr1064 | 8239 | hfcr1142 | 8299 | hfcr1229 | 8359 | hfcr1310 |
| 8120 | hfcr0969 | 8180 | hfcr1065 | 8240 | hfcr1144 | 8300 | hfcr1230 | 8360 | hfcr1311 |
| 8121 | hfcr0971 | 8181 | hfcr1066 | 8241 | hfcr1145 | 8301 | hfcr1231 | 8361 | hfcr1312 |
| 8122 | hfcr0973 | 8182 | hfcr1067 | 8242 | hfcr1148 | 8302 | hfcr1232 | 8362 | hfcr1313 |
| 8123 | hfcr0974 | 8183 | hfcr1069 | 8243 | hfcr1149 | 8303 | hfcr1233 | 8363 | hfcr1314 |
| 8124 | hfcr0975 | 8184 | hfcr1071 | 8244 | hfcr1151 | 8304 | hfcr1234 | 8364 | hfcr1315 |
| 8125 | hfcr0976 | 8185 | hfcr1072 | 8245 | hfcr1152 | 8305 | hfcr1235 | 8365 | hfcr1316 |
| 8126 | hfcr0977 | 8186 | hfcr1073 | 8246 | hfcr1156 | 8306 | hfcr1236 | 8366 | hfcr1317 |
| 8127 | hfcr0978 | 8187 | hfcr1074 | 8247 | hfcr1157 | 8307 | hfcr1238 | 8367 | hfcr1318 |
| 8128 | hfcr0979 | 8188 | hfcr1075 | 8248 | hfcr1159 | 8308 | hfcr1240 | 8368 | hfcr1320 |
| 8129 | hfcr0980 | 8189 | hfcr1076 | 8249 | hfcr1161 | 8309 | hfcr1250 | 8369 | hfcr1321 |
| 8130 | hfcr0981 | 8190 | hfcr1077 | 8250 | hfcr1163 | 8310 | hfcr1251 | 8370 | hfcr1322 |
| 8131 | hfcr0982 | 8191 | hfcr1078 | 8251 | hfcr1164 | 8311 | hfcr1252 | 8371 | hfcr1323 |
| 8132 | hfcr0985 | 8192 | hfcr1079 | 8252 | hfcr1165 | 8312 | hfcr1253 | 8372 | hfcr1324 |
| 8133 | hfcr0990 | 8193 | hfcr1080 | 8253 | hfcr1166 | 8313 | hfcr1254 | 8373 | hfcr1325 |
| 8134 | hfcr0991 | 8194 | hfcr1081 | 8254 | hfcr1167 | 8314 | hfcr1255 | 8374 | hfcr1326 |
| 8135 | hfcr0993 | 8195 | hfcr1082 | 8255 | hfcr1170 | 8315 | hfcr1256 | 8375 | hfcr1327 |
| 8136 | hfcr0996 | 8196 | hfcr1083 | 8256 | hfcr1171 | 8316 | hfcr1257 | 8376 | hfcr1328 |
| 8137 | hfcr0997 | 8197 | hfcr1084 | 8257 | hfcr1174 | 8317 | hfcr1259 | 8377 | hfcr1330 |
| 8138 | hfcr0998 | 8198 | hfcr1085 | 8258 | hfcr1175 | 8318 | hfcr1260 | 8378 | hfcr1331 |
| 8139 | hfcr1000 | 8199 | hfcr1090 | 8259 | hfcr1177 | 8319 | hfcr1262 | 8379 | hfcr1332 |
| 8140 | hfcr1001 | 8200 | hfcr1093 | 8260 | hfcr1178 | 8320 | hfcr1263 | 8380 | hfcr1333 |
| 8141 | hfcr1002 | 8201 | hfcr1095 | 8261 | hfcr1179 | 8321 | hfcr1264 | 8381 | hfcr1334 |
| 8142 | hfcr1010 | 8202 | hfcr1096 | 8262 | hfcr1180 | 8322 | hfcr1265 | 8382 | hfcr1335 |
| 8143 | hfcr1011 | 8203 | hfcr1098 | 8263 | hfcr1183 | 8323 | hfcr1267 | 8383 | hfcr1336 |
| 8144 | hfcr1013 | 8204 | hfcr1101 | 8264 | hfcr1184 | 8324 | hfcr1269 | 8384 | hfcr1338 |
| 8145 | hfcr1014 | 8205 | hfcr1103 | 8265 | hfcr1185 | 8325 | hfcr1270 | 8385 | hfcr1339 |
| 8146 | hfcr1016 | 8206 | hfcr1104 | 8266 | hfcr1188 | 8326 | hfcr1271 | 8386 | hfcr1340 |
| 8147 | hfcr1018 | 8207 | hfcr1105 | 8267 | hfcr1189 | 8327 | hfcr1272 | 8387 | hfcr1341 |
| 8148 | hfcr1019 | 8208 | hfcr1106 | 8268 | hfcr1190 | 8328 | hfcr1274 | 8388 | hfcr1342 |
| 8149 | hfcr1020 | 8209 | hfcr1107 | 8269 | hfcr1191 | 8329 | hfcr1275 | 8389 | hfcr1343 |
| 8150 | hfcr1023 | 8210 | hfcr1109 | 8270 | hfcr1192 | 8330 | hfcr1276 | 8390 | hfcr1344 |
| 8151 | hfcr1024 | 8211 | hfcr1110 | 8271 | hfcr1193 | 8331 | hfcr1277 | 8391 | hfcr1345 |
| 8152 | hfcr1025 | 8212 | hfcr1111 | 8272 | hfcr1194 | 8332 | hfcr1278 | 8392 | hfcr1346 |
| 8153 | hfcr1027 | 8213 | hfcr1112 | 8273 | hfcr1195 | 8333 | hfcr1279 | 8393 | hfcr1347 |
| 8154 | hfcr1028 | 8214 | hfcr1113 | 8274 | hfcr1196 | 8334 | hfcr1280 | 8394 | hfcr1348 |
| 8155 | hfcr1031 | 8215 | hfcr1115 | 8275 | hfcr1197 | 8335 | hfcr1281 | 8395 | hfcr1349 |
| 8156 | hfcr1032 | 8216 | hfcr1116 | 8276 | hfcr1198 | 8336 | hfcr1282 | 8396 | hfcr1350 |
| 8157 | hfcr1034 | 8217 | hfcr1117 | 8277 | hfcr1199 | 8337 | hfcr1283 | 8397 | hfcr1351 |
| 8158 | hfcr1035 | 8218 | hfcr1119 | 8278 | hfcr1200 | 8338 | hfcr1284 | 8398 | hfcr1352 |
| 8159 | hfcr1036 | 8219 | hfcr1120 | 8279 | hfcr1201 | 8339 | hfcr1285 | 8399 | hfcr1353 |
| 8160 | hfcr1037 | 8220 | hfcr1121 | 8280 | hfcr1202 | 8340 | hfcr1286 | 8400 | hfcr1354 |

Figure 6B – List of EST Sequence Names From Fetal Cartilage cDNA Library

| | | | | | | | | | |
|---|---|---|---|---|---|---|---|---|---|
| 8401 | hfcr1355 | 8461 | hfcr1428 | 8521 | hfcr1543 | 8581 | hfcr1646 | 8641 | hfcr1730 |
| 8402 | hfcr1356 | 8462 | hfcr1429 | 8522 | hfcr1544 | 8582 | hfcr1647 | 8642 | hfcr1731 |
| 8403 | hfcr1358 | 8463 | hfcr1431 | 8523 | hfcr1546 | 8583 | hfcr1648 | 8643 | hfcr1732 |
| 8404 | hfcr1359 | 8464 | hfcr1432 | 8524 | hfcr1549 | 8584 | hfcr1651 | 8644 | hfcr1733 |
| 8405 | hfcr1360 | 8465 | hfcr1433 | 8525 | hfcr1552 | 8585 | hfcr1653 | 8645 | hfcr1734 |
| 8406 | hfcr1362 | 8466 | hfcr1434 | 8526 | hfcr1553 | 8586 | hfcr1654 | 8646 | hfcr1738 |
| 8407 | hfcr1363 | 8467 | hfcr1435 | 8527 | hfcr1554 | 8587 | hfcr1655 | 8647 | hfcr1739 |
| 8408 | hfcr1364 | 8468 | hfcr1436 | 8528 | hfcr1555 | 8588 | hfcr1656 | 8648 | hfcr1740 |
| 8409 | hfcr1365 | 8469 | hfcr1438 | 8529 | hfcr1558 | 8589 | hfcr1657 | 8649 | hfcr1741 |
| 8410 | hfcr1367 | 8470 | hfcr1444 | 8530 | hfcr1560 | 8590 | hfcr1659 | 8650 | hfcr1742 |
| 8411 | hfcr1368 | 8471 | hfcr1446 | 8531 | hfcr1564 | 8591 | hfcr1661 | 8651 | hfcr1743 |
| 8412 | hfcr1369 | 8472 | hfcr1450 | 8532 | hfcr1565 | 8592 | hfcr1667 | 8652 | hfcr1744 |
| 8413 | hfcr1370 | 8473 | hfcr1453 | 8533 | hfcr1571 | 8593 | hfcr1668 | 8653 | hfcr1745 |
| 8414 | hfcr1371 | 8474 | hfcr1455 | 8534 | hfcr1573 | 8594 | hfcr1669 | 8654 | hfcr1747 |
| 8415 | hfcr1372 | 8475 | hfcr1456 | 8535 | hfcr1575 | 8595 | hfcr1671 | 8655 | hfcr1748 |
| 8416 | hfcr1373 | 8476 | hfcr1458 | 8536 | hfcr1577 | 8596 | hfcr1672 | 8656 | hfcr1749 |
| 8417 | hfcr1375 | 8477 | hfcr1461 | 8537 | hfcr1578 | 8597 | hfcr1674 | 8657 | hfcr1750 |
| 8418 | hfcr1376 | 8478 | hfcr1462 | 8538 | hfcr1580 | 8598 | hfcr1675 | 8658 | hfcr1752 |
| 8419 | hfcr1377 | 8479 | hfcr1465 | 8539 | hfcr1581 | 8599 | hfcr1677 | 8659 | hfcr1754 |
| 8420 | hfcr1378 | 8480 | hfcr1466 | 8540 | hfcr1583 | 8600 | hfcr1678 | 8660 | hfcr1755 |
| 8421 | hfcr1379 | 8481 | hfcr1468 | 8541 | hfcr1590 | 8601 | hfcr1679 | 8661 | hfcr1756 |
| 8422 | hfcr1380 | 8482 | hfcr1469 | 8542 | hfcr1591 | 8602 | hfcr1682 | 8662 | hfcr1757 |
| 8423 | hfcr1381 | 8483 | hfcr1470 | 8543 | hfcr1592 | 8603 | hfcr1683 | 8663 | hfcr1758 |
| 8424 | hfcr1382 | 8484 | hfcr1472 | 8544 | hfcr1596 | 8604 | hfcr1684 | 8664 | hfcr1759 |
| 8425 | hfcr1383 | 8485 | hfcr1477 | 8545 | hfcr1598 | 8605 | hfcr1685 | 8665 | hfcr1760 |
| 8426 | hfcr1384 | 8486 | hfcr1478 | 8546 | hfcr1599 | 8606 | hfcr1686 | 8666 | hfcr1762 |
| 8427 | hfcr1385 | 8487 | hfcr1480 | 8547 | hfcr1600 | 8607 | hfcr1688 | 8667 | hfcr1763 |
| 8428 | hfcr1386 | 8488 | hfcr1482 | 8548 | hfcr1603 | 8608 | hfcr1689 | 8668 | hfcr1764 |
| 8429 | hfcr1387 | 8489 | hfcr1483 | 8549 | hfcr1604 | 8609 | hfcr1690 | 8669 | hfcr1765 |
| 8430 | hfcr1388 | 8490 | hfcr1484 | 8550 | hfcr1605 | 8610 | hfcr1691 | 8670 | hfcr1766 |
| 8431 | hfcr1391 | 8491 | hfcr1487 | 8551 | hfcr1607 | 8611 | hfcr1692 | 8671 | hfcr1767 |
| 8432 | hfcr1392 | 8492 | hfcr1488 | 8552 | hfcr1608 | 8612 | hfcr1693 | 8672 | hfcr1768 |
| 8433 | hfcr1393 | 8493 | hfcr1490 | 8553 | hfcr1610 | 8613 | hfcr1694 | 8673 | hfcr1769 |
| 8434 | hfcr1394 | 8494 | hfcr1491 | 8554 | hfcr1611 | 8614 | hfcr1695 | 8674 | hfcr1770 |
| 8435 | hfcr1395 | 8495 | hfcr1493 | 8555 | hfcr1612 | 8615 | hfcr1696 | 8675 | hfcr1771 |
| 8436 | hfcr1396 | 8496 | hfcr1494 | 8556 | hfcr1613 | 8616 | hfcr1697 | 8676 | hfcr1772 |
| 8437 | hfcr1397 | 8497 | hfcr1499 | 8557 | hfcr1615 | 8617 | hfcr1698 | 8677 | hfcr1773 |
| 8438 | hfcr1398 | 8498 | hfcr1500 | 8558 | hfcr1616 | 8618 | hfcr1699 | 8678 | hfcr1774 |
| 8439 | hfcr1401 | 8499 | hfcr1503 | 8559 | hfcr1620 | 8619 | hfcr1700 | 8679 | hfcr1775 |
| 8440 | hfcr1402 | 8500 | hfcr1504 | 8560 | hfcr1621 | 8620 | hfcr1703 | 8680 | hfcr1776 |
| 8441 | hfcr1403 | 8501 | hfcr1505 | 8561 | hfcr1622 | 8621 | hfcr1707 | 8681 | hfcr1777 |
| 8442 | hfcr1404 | 8502 | hfcr1507 | 8562 | hfcr1623 | 8622 | hfcr1709 | 8682 | hfcr1778 |
| 8443 | hfcr1405 | 8503 | hfcr1508 | 8563 | hfcr1625 | 8623 | hfcr1710 | 8683 | hfcr1779 |
| 8444 | hfcr1406 | 8504 | hfcr1510 | 8564 | hfcr1626 | 8624 | hfcr1711 | 8684 | hfcr1781 |
| 8445 | hfcr1408 | 8505 | hfcr1512 | 8565 | hfcr1627 | 8625 | hfcr1712 | 8685 | hfcr1782 |
| 8446 | hfcr1409 | 8506 | hfcr1517 | 8566 | hfcr1628 | 8626 | hfcr1713 | 8686 | hfcr1783 |
| 8447 | hfcr1410 | 8507 | hfcr1521 | 8567 | hfcr1630 | 8627 | hfcr1714 | 8687 | hfcr1784 |
| 8448 | hfcr1411 | 8508 | hfcr1522 | 8568 | hfcr1631 | 8628 | hfcr1715 | 8688 | hfcr1785 |
| 8449 | hfcr1413 | 8509 | hfcr1523 | 8569 | hfcr1632 | 8629 | hfcr1716 | 8689 | hfcr1787 |
| 8450 | hfcr1414 | 8510 | hfcr1525 | 8570 | hfcr1633 | 8630 | hfcr1717 | 8690 | hfcr1788 |
| 8451 | hfcr1415 | 8511 | hfcr1527 | 8571 | hfcr1634 | 8631 | hfcr1719 | 8691 | hfcr1789 |
| 8452 | hfcr1416 | 8512 | hfcr1531 | 8572 | hfcr1635 | 8632 | hfcr1720 | 8692 | hfcr1791 |
| 8453 | hfcr1418 | 8513 | hfcr1532 | 8573 | hfcr1637 | 8633 | hfcr1721 | 8693 | hfcr1792 |
| 8454 | hfcr1419 | 8514 | hfcr1533 | 8574 | hfcr1638 | 8634 | hfcr1722 | 8694 | hfcr1793 |
| 8455 | hfcr1420 | 8515 | hfcr1534 | 8575 | hfcr1639 | 8635 | hfcr1723 | 8695 | hfcr1795 |
| 8456 | hfcr1422 | 8516 | hfcr1535 | 8576 | hfcr1640 | 8636 | hfcr1724 | 8696 | hfcr1796 |
| 8457 | hfcr1424 | 8517 | hfcr1536 | 8577 | hfcr1641 | 8637 | hfcr1725 | 8697 | hfcr1798 |
| 8458 | hfcr1425 | 8518 | hfcr1538 | 8578 | hfcr1642 | 8638 | hfcr1726 | 8698 | hfcr1799 |
| 8459 | hfcr1426 | 8519 | hfcr1540 | 8579 | hfcr1644 | 8639 | hfcr1727 | 8699 | hfcr1800 |
| 8460 | hfcr1427 | 8520 | hfcr1541 | 8580 | hfcr1645 | 8640 | hfcr1728 | 8700 | hfcr1802 |

Figure 6B – List of EST Sequence Names From Fetal Cartilage cDNA Library

| | | | | | | | | | |
|---|---|---|---|---|---|---|---|---|---|
| 8701 | hfcr1803 | 8761 | hfcr1873 | 8821 | hfcr1948 | 8881 | hfcr2070 | 8941 | hfcr2275 |
| 8702 | hfcr1804 | 8762 | hfcr1874 | 8822 | hfcr1949 | 8882 | hfcr2071 | 8942 | hfcr2282 |
| 8703 | hfcr1805 | 8763 | hfcr1875 | 8823 | hfcr1950 | 8883 | hfcr2073 | 8943 | hfcr2284 |
| 8704 | hfcr1806 | 8764 | hfcr1876 | 8824 | hfcr1951 | 8884 | hfcr2074 | 8944 | hfcr2287 |
| 8705 | hfcr1807 | 8765 | hfcr1877 | 8825 | hfcr1952 | 8885 | hfcr2075 | 8945 | hfcr2288 |
| 8706 | hfcr1808 | 8766 | hfcr1878 | 8826 | hfcr1955 | 8886 | hfcr2076 | 8946 | hfcr2294 |
| 8707 | hfcr1809 | 8767 | hfcr1879 | 8827 | hfcr1956 | 8887 | hfcr2077 | 8947 | hfcr2295 |
| 8708 | hfcr1810 | 8768 | hfcr1880 | 8828 | hfcr1959 | 8888 | hfcr2078 | 8948 | hfcr2296 |
| 8709 | hfcr1811 | 8769 | hfcr1881 | 8829 | hfcr1960 | 8889 | hfcr2079 | 8949 | hfcr2297 |
| 8710 | hfcr1813 | 8770 | hfcr1882 | 8830 | hfcr1963 | 8890 | hfcr2080 | 8950 | hfcr2299 |
| 8711 | hfcr1814 | 8771 | hfcr1883 | 8831 | hfcr1964 | 8891 | hfcr2081 | 8951 | hfcr2301 |
| 8712 | hfcr1815 | 8772 | hfcr1885 | 8832 | hfcr1965 | 8892 | hfcr2082 | 8952 | hfcr2306 |
| 8713 | hfcr1816 | 8773 | hfcr1886 | 8833 | hfcr1968 | 8893 | hfcr2084 | 8953 | hfcr2310 |
| 8714 | hfcr1820 | 8774 | hfcr1887 | 8834 | hfcr1973 | 8894 | hfcr2114 | 8954 | hfcr2312 |
| 8715 | hfcr1821 | 8775 | hfcr1888 | 8835 | hfcr1974 | 8895 | hfcr2128 | 8955 | hfcr2313 |
| 8716 | hfcr1822 | 8776 | hfcr1890 | 8836 | hfcr1977 | 8896 | hfcr2129 | 8956 | hfcr2314 |
| 8717 | hfcr1823 | 8777 | hfcr1891 | 8837 | hfcr1978 | 8897 | hfcr2131 | 8957 | hfcr2318 |
| 8718 | hfcr1824 | 8778 | hfcr1894 | 8838 | hfcr2017 | 8898 | hfcr2138 | 8958 | hfcr2319 |
| 8719 | hfcr1825 | 8779 | hfcr1896 | 8839 | hfcr2018 | 8899 | hfcr2140 | 8959 | hfcr2323 |
| 8720 | hfcr1826 | 8780 | hfcr1897 | 8840 | hfcr2020 | 8900 | hfcr2141 | 8960 | hfcr2324 |
| 8721 | hfcr1827 | 8781 | hfcr1898 | 8841 | hfcr2021 | 8901 | hfcr2148 | 8961 | hfcr2328 |
| 8722 | hfcr1828 | 8782 | hfcr1899 | 8842 | hfcr2022 | 8902 | hfcr2150 | 8962 | hfcr2329 |
| 8723 | hfcr1829 | 8783 | hfcr1900 | 8843 | hfcr2023 | 8903 | hfcr2166 | 8963 | hfcr2330 |
| 8724 | hfcr1830 | 8784 | hfcr1901 | 8844 | hfcr2024 | 8904 | hfcr2195 | 8964 | hfcr2332 |
| 8725 | hfcr1831 | 8785 | hfcr1902 | 8845 | hfcr2026 | 8905 | hfcr2201 | 8965 | hfcr2334 |
| 8726 | hfcr1832 | 8786 | hfcr1903 | 8846 | hfcr2027 | 8906 | hfcr2209 | 8966 | hfcr2337 |
| 8727 | hfcr1834 | 8787 | hfcr1904 | 8847 | hfcr2028 | 8907 | hfcr2212 | 8967 | hfcr2340 |
| 8728 | hfcr1835 | 8788 | hfcr1905 | 8848 | hfcr2029 | 8908 | hfcr2213 | 8968 | hfcr2341 |
| 8729 | hfcr1836 | 8789 | hfcr1906 | 8849 | hfcr2030 | 8909 | hfcr2214 | 8969 | hfcr2342 |
| 8730 | hfcr1838 | 8790 | hfcr1907 | 8850 | hfcr2031 | 8910 | hfcr2216 | 8970 | hfcr2343 |
| 8731 | hfcr1839 | 8791 | hfcr1908 | 8851 | hfcr2032 | 8911 | hfcr2217 | 8971 | hfcr2344 |
| 8732 | hfcr1840 | 8792 | hfcr1909 | 8852 | hfcr2033 | 8912 | hfcr2218 | 8972 | HFCR2365 |
| 8733 | hfcr1841 | 8793 | hfcr1910 | 8853 | hfcr2035 | 8913 | hfcr2220 | 8973 | HFCR2366 |
| 8734 | hfcr1842 | 8794 | hfcr1911 | 8854 | hfcr2037 | 8914 | hfcr2221 | 8974 | HFCR2367 |
| 8735 | hfcr1843 | 8795 | hfcr1913 | 8855 | hfcr2040 | 8915 | hfcr2224 | 8975 | HFCR2375 |
| 8736 | hfcr1844 | 8796 | hfcr1914 | 8856 | hfcr2041 | 8916 | hfcr2225 | 8976 | HFCR2376 |
| 8737 | hfcr1846 | 8797 | hfcr1915 | 8857 | hfcr2042 | 8917 | hfcr2227 | 8977 | HFCR2378 |
| 8738 | hfcr1847 | 8798 | hfcr1916 | 8858 | hfcr2043 | 8918 | hfcr2229 | 8978 | HFCR2379 |
| 8739 | hfcr1848 | 8799 | hfcr1917 | 8859 | hfcr2044 | 8919 | hfcr2230 | 8979 | HFCR2380 |
| 8740 | hfcr1850 | 8800 | hfcr1918 | 8860 | hfcr2045 | 8920 | hfcr2231 | 8980 | HFCR2381 |
| 8741 | hfcr1851 | 8801 | hfcr1919 | 8861 | hfcr2046 | 8921 | hfcr2233 | 8981 | HFCR2384 |
| 8742 | hfcr1853 | 8802 | hfcr1920 | 8862 | hfcr2047 | 8922 | hfcr2234 | 8982 | HFCR2386 |
| 8743 | hfcr1854 | 8803 | hfcr1921 | 8863 | hfcr2048 | 8923 | hfcr2235 | 8983 | HFCR2388 |
| 8744 | hfcr1855 | 8804 | hfcr1922 | 8864 | hfcr2049 | 8924 | hfcr2237 | 8984 | HFCR2389 |
| 8745 | hfcr1856 | 8805 | hfcr1924 | 8865 | hfcr2050 | 8925 | hfcr2238 | 8985 | HFCR2390 |
| 8746 | hfcr1857 | 8806 | hfcr1925 | 8866 | hfcr2051 | 8926 | hfcr2239 | 8986 | HFCR2391 |
| 8747 | hfcr1858 | 8807 | hfcr1926 | 8867 | hfcr2052 | 8927 | hfcr2243 | 8987 | HFCR2399 |
| 8748 | hfcr1859 | 8808 | hfcr1927 | 8868 | hfcr2053 | 8928 | hfcr2245 | 8988 | hfcr2497 |
| 8749 | hfcr1860 | 8809 | hfcr1928 | 8869 | hfcr2054 | 8929 | hfcr2250 | 8989 | hfcr2498 |
| 8750 | hfcr1861 | 8810 | hfcr1930 | 8870 | hfcr2055 | 8930 | hfcr2251 | 8990 | hfcr2499 |
| 8751 | hfcr1862 | 8811 | hfcr1931 | 8871 | hfcr2058 | 8931 | hfcr2252 | 8991 | hfcr2501 |
| 8752 | hfcr1863 | 8812 | hfcr1932 | 8872 | hfcr2060 | 8932 | hfcr2253 | 8992 | hfcr2502 |
| 8753 | hfcr1864 | 8813 | hfcr1933 | 8873 | hfcr2061 | 8933 | hfcr2254 | 8993 | hfcr2503 |
| 8754 | hfcr1865 | 8814 | hfcr1934 | 8874 | hfcr2062 | 8934 | hfcr2256 | 8994 | hfcr2504 |
| 8755 | hfcr1866 | 8815 | hfcr1937 | 8875 | hfcr2063 | 8935 | hfcr2262 | 8995 | hfcr2505 |
| 8756 | hfcr1867 | 8816 | hfcr1939 | 8876 | hfcr2064 | 8936 | hfcr2263 | 8996 | hfcr2506 |
| 8757 | hfcr1868 | 8817 | hfcr1941 | 8877 | hfcr2065 | 8937 | hfcr2264 | 8997 | hfcr2508 |
| 8758 | hfcr1869 | 8818 | hfcr1944 | 8878 | hfcr2066 | 8938 | hfcr2267 | 8998 | hfcr2509 |
| 8759 | hfcr1870 | 8819 | hfcr1945 | 8879 | hfcr2068 | 8939 | hfcr2269 | 8999 | hfcr2510 |
| 8760 | hfcr1872 | 8820 | hfcr1947 | 8880 | hfcr2069 | 8940 | hfcr2271 | 9000 | hfcr2511 |

Figure 6B – List of EST Sequence Names From Fetal Cartilage cDNA Library

| | | | | | | | | | |
|---|---|---|---|---|---|---|---|---|---|
| 9001 | hfcr2512 | 9061 | hfcr2586 | 9121 | hfcr2668 | 9181 | hfcr2752 | 9241 | hfcr2832 |
| 9002 | hfcr2513 | 9062 | hfcr2587 | 9122 | hfcr2669 | 9182 | hfcr2753 | 9242 | hfcr2833 |
| 9003 | hfcr2514 | 9063 | hfcr2588 | 9123 | hfcr2670 | 9183 | hfcr2754 | 9243 | hfcr2834 |
| 9004 | hfcr2515 | 9064 | hfcr2589 | 9124 | hfcr2672 | 9184 | hfcr2755 | 9244 | hfcr2836 |
| 9005 | hfcr2516 | 9065 | hfcr2590 | 9125 | hfcr2673 | 9185 | hfcr2756 | 9245 | hfcr2837 |
| 9006 | hfcr2517 | 9066 | hfcr2591 | 9126 | hfcr2674 | 9186 | hfcr2757 | 9246 | hfcr2838 |
| 9007 | hfcr2519 | 9067 | hfcr2592 | 9127 | hfcr2677 | 9187 | hfcr2758 | 9247 | hfcr2839 |
| 9008 | hfcr2520 | 9068 | hfcr2595 | 9128 | hfcr2678 | 9188 | hfcr2759 | 9248 | hfcr2842 |
| 9009 | hfcr2521 | 9069 | hfcr2596 | 9129 | hfcr2680 | 9189 | hfcr2760 | 9249 | hfcr2844 |
| 9010 | hfcr2522 | 9070 | hfcr2598 | 9130 | hfcr2682 | 9190 | hfcr2761 | 9250 | hfcr2846 |
| 9011 | hfcr2523 | 9071 | hfcr2599 | 9131 | hfcr2684 | 9191 | hfcr2763 | 9251 | hfcr2850 |
| 9012 | hfcr2524 | 9072 | hfcr2600 | 9132 | hfcr2685 | 9192 | hfcr2766 | 9252 | hfcr2851 |
| 9013 | hfcr2525 | 9073 | hfcr2601 | 9133 | hfcr2686 | 9193 | hfcr2767 | 9253 | hfcr2852 |
| 9014 | hfcr2526 | 9074 | hfcr2602 | 9134 | hfcr2687 | 9194 | hfcr2768 | 9254 | hfcr2854 |
| 9015 | hfcr2527 | 9075 | hfcr2603 | 9135 | hfcr2688 | 9195 | hfcr2770 | 9255 | hfcr2856 |
| 9016 | hfcr2528 | 9076 | hfcr2604 | 9136 | hfcr2689 | 9196 | hfcr2772 | 9256 | hfcr2857 |
| 9017 | hfcr2529 | 9077 | hfcr2607 | 9137 | hfcr2690 | 9197 | hfcr2774 | 9257 | hfcr2859 |
| 9018 | hfcr2530 | 9078 | hfcr2608 | 9138 | hfcr2693 | 9198 | hfcr2777 | 9258 | hfcr2860 |
| 9019 | hfcr2531 | 9079 | hfcr2609 | 9139 | hfcr2695 | 9199 | hfcr2778 | 9259 | hfcr2861 |
| 9020 | hfcr2532 | 9080 | hfcr2610 | 9140 | hfcr2696 | 9200 | hfcr2780 | 9260 | hfcr2862 |
| 9021 | hfcr2534 | 9081 | hfcr2613 | 9141 | hfcr2699 | 9201 | hfcr2781 | 9261 | hfcr2863 |
| 9022 | hfcr2535 | 9082 | hfcr2615 | 9142 | hfcr2700 | 9202 | hfcr2782 | 9262 | hfcr2864 |
| 9023 | hfcr2536 | 9083 | hfcr2616 | 9143 | hfcr2702 | 9203 | hfcr2783 | 9263 | hfcr2865 |
| 9024 | hfcr2537 | 9084 | hfcr2617 | 9144 | hfcr2703 | 9204 | hfcr2784 | 9264 | hfcr2866 |
| 9025 | hfcr2538 | 9085 | hfcr2618 | 9145 | hfcr2704 | 9205 | hfcr2786 | 9265 | hfcr2867 |
| 9026 | hfcr2539 | 9086 | hfcr2619 | 9146 | hfcr2705 | 9206 | hfcr2787 | 9266 | hfcr2868 |
| 9027 | hfcr2543 | 9087 | hfcr2621 | 9147 | hfcr2706 | 9207 | hfcr2789 | 9267 | hfcr2869 |
| 9028 | hfcr2544 | 9088 | hfcr2622 | 9148 | hfcr2708 | 9208 | hfcr2790 | 9268 | hfcr2870 |
| 9029 | hfcr2545 | 9089 | hfcr2623 | 9149 | hfcr2709 | 9209 | hfcr2791 | 9269 | hfcr2871 |
| 9030 | hfcr2546 | 9090 | hfcr2624 | 9150 | hfcr2710 | 9210 | hfcr2792 | 9270 | hfcr2872 |
| 9031 | hfcr2547 | 9091 | hfcr2626 | 9151 | hfcr2712 | 9211 | hfcr2793 | 9271 | hfcr2873 |
| 9032 | hfcr2548 | 9092 | hfcr2627 | 9152 | hfcr2713 | 9212 | hfcr2794 | 9272 | hfcr2874 |
| 9033 | hfcr2549 | 9093 | hfcr2628 | 9153 | hfcr2714 | 9213 | hfcr2795 | 9273 | hfcr2875 |
| 9034 | hfcr2550 | 9094 | hfcr2629 | 9154 | hfcr2715 | 9214 | hfcr2796 | 9274 | hfcr2876 |
| 9035 | hfcr2552 | 9095 | hfcr2631 | 9155 | hfcr2718 | 9215 | hfcr2797 | 9275 | hfcr2877 |
| 9036 | hfcr2553 | 9096 | hfcr2632 | 9156 | hfcr2719 | 9216 | hfcr2800 | 9276 | hfcr2878 |
| 9037 | hfcr2554 | 9097 | hfcr2633 | 9157 | hfcr2720 | 9217 | hfcr2801 | 9277 | hfcr2879 |
| 9038 | hfcr2555 | 9098 | hfcr2635 | 9158 | hfcr2721 | 9218 | hfcr2802 | 9278 | hfcr2880 |
| 9039 | hfcr2556 | 9099 | hfcr2637 | 9159 | hfcr2722 | 9219 | hfcr2803 | 9279 | hfcr2882 |
| 9040 | hfcr2557 | 9100 | hfcr2638 | 9160 | hfcr2723 | 9220 | hfcr2804 | 9280 | hfcr2883 |
| 9041 | hfcr2558 | 9101 | hfcr2639 | 9161 | hfcr2724 | 9221 | hfcr2806 | 9281 | hfcr2885 |
| 9042 | hfcr2559 | 9102 | hfcr2640 | 9162 | hfcr2725 | 9222 | hfcr2807 | 9282 | hfcr2886 |
| 9043 | hfcr2560 | 9103 | hfcr2641 | 9163 | hfcr2727 | 9223 | hfcr2808 | 9283 | hfcr2887 |
| 9044 | hfcr2563 | 9104 | hfcr2642 | 9164 | hfcr2728 | 9224 | hfcr2809 | 9284 | hfcr2888 |
| 9045 | hfcr2565 | 9105 | hfcr2643 | 9165 | hfcr2729 | 9225 | hfcr2810 | 9285 | hfcr2890 |
| 9046 | hfcr2567 | 9106 | hfcr2645 | 9166 | hfcr2730 | 9226 | hfcr2811 | 9286 | hfcr2892 |
| 9047 | hfcr2568 | 9107 | hfcr2646 | 9167 | hfcr2731 | 9227 | hfcr2812 | 9287 | hfcr2894 |
| 9048 | hfcr2569 | 9108 | hfcr2648 | 9168 | hfcr2732 | 9228 | hfcr2813 | 9288 | hfcr2895 |
| 9049 | hfcr2570 | 9109 | hfcr2651 | 9169 | hfcr2733 | 9229 | hfcr2814 | 9289 | hfcr2896 |
| 9050 | hfcr2572 | 9110 | hfcr2653 | 9170 | hfcr2735 | 9230 | hfcr2815 | 9290 | hfcr2897 |
| 9051 | hfcr2573 | 9111 | hfcr2654 | 9171 | hfcr2736 | 9231 | hfcr2817 | 9291 | hfcr2899 |
| 9052 | hfcr2574 | 9112 | hfcr2655 | 9172 | hfcr2737 | 9232 | hfcr2820 | 9292 | hfcr2900 |
| 9053 | hfcr2575 | 9113 | hfcr2656 | 9173 | hfcr2740 | 9233 | hfcr2821 | 9293 | hfcr2905 |
| 9054 | hfcr2576 | 9114 | hfcr2657 | 9174 | hfcr2742 | 9234 | hfcr2822 | 9294 | hfcr2906 |
| 9055 | hfcr2578 | 9115 | hfcr2658 | 9175 | hfcr2743 | 9235 | hfcr2823 | 9295 | hfcr2907 |
| 9056 | hfcr2580 | 9116 | hfcr2661 | 9176 | hfcr2744 | 9236 | hfcr2824 | 9296 | hfcr2908 |
| 9057 | hfcr2581 | 9117 | hfcr2664 | 9177 | hfcr2747 | 9237 | hfcr2825 | 9297 | hfcr2909 |
| 9058 | hfcr2582 | 9118 | hfcr2665 | 9178 | hfcr2748 | 9238 | hfcr2827 | 9298 | hfcr2910 |
| 9059 | hfcr2583 | 9119 | hfcr2666 | 9179 | hfcr2749 | 9239 | hfcr2828 | 9299 | hfcr2911 |
| 9060 | hfcr2584 | 9120 | hfcr2667 | 9180 | hfcr2750 | 9240 | hfcr2831 | 9300 | hfcr2912 |

Figure 6B - List of EST Sequence Names From Fetal Cartilage cDNA Library

| | | | | | | | | | |
|---|---|---|---|---|---|---|---|---|---|
| 9301 | hfcr2913 | 9361 | hfcr2992 | 9421 | hfcr3065 | 9481 | HFCR3154 | 9541 | HFCR3239 |
| 9302 | hfcr2915 | 9362 | hfcr2993 | 9422 | hfcr3067 | 9482 | HFCR3155 | 9542 | HFCR3240 |
| 9303 | hfcr2916 | 9363 | hfcr2994 | 9423 | hfcr3068 | 9483 | HFCR3156 | 9543 | HFCR3241 |
| 9304 | hfcr2917 | 9364 | hfcr2995 | 9424 | hfcr3069 | 9484 | HFCR3157 | 9544 | HFCR3243 |
| 9305 | hfcr2918 | 9365 | hfcr2996 | 9425 | hfcr3070 | 9485 | HFCR3160 | 9545 | HFCR3246 |
| 9306 | hfcr2919 | 9366 | hfcr2999 | 9426 | hfcr3072 | 9486 | hfcr3161 | 9546 | HFCR3247 |
| 9307 | hfcr2921 | 9367 | hfcr3001 | 9427 | HFCR3073 | 9487 | HFCR3162 | 9547 | HFCR3249 |
| 9308 | hfcr2923 | 9368 | hfcr3002 | 9428 | HFCR3077 | 9488 | HFCR3163 | 9548 | HFCR3250 |
| 9309 | hfcr2926 | 9369 | hfcr3003 | 9429 | hfcr3080 | 9489 | HFCR3164 | 9549 | HFCR3251 |
| 9310 | hfcr2927 | 9370 | hfcr3004 | 9430 | HFCR3081 | 9490 | HFCR3165 | 9550 | HFCR3252 |
| 9311 | hfcr2928 | 9371 | hfcr3005 | 9431 | HFCR3082 | 9491 | HFCR3166 | 9551 | HFCR3254 |
| 9312 | hfcr2930 | 9372 | hfcr3006 | 9432 | HFCR3084 | 9492 | HFCR3167 | 9552 | HFCR3255 |
| 9313 | hfcr2931 | 9373 | hfcr3007 | 9433 | HFCR3087 | 9493 | HFCR3168 | 9553 | HFCR3256 |
| 9314 | hfcr2932 | 9374 | hfcr3008 | 9434 | HFCR3088 | 9494 | HFCR3171 | 9554 | HFCR3260 |
| 9315 | hfcr2933 | 9375 | hfcr3009 | 9435 | HFCR3089 | 9495 | HFCR3175 | 9555 | HFCR3261 |
| 9316 | hfcr2934 | 9376 | hfcr3010 | 9436 | HFCR3091 | 9496 | HFCR3177 | 9556 | HFCR3262 |
| 9317 | hfcr2935 | 9377 | hfcr3011 | 9437 | HFCR3092 | 9497 | HFCR3180 | 9557 | HFCR3263 |
| 9318 | hfcr2936 | 9378 | hfcr3012 | 9438 | HFCR3093 | 9498 | HFCR3181 | 9558 | HFCR3264 |
| 9319 | hfcr2937 | 9379 | hfcr3014 | 9439 | HFCR3094 | 9499 | HFCR3182 | 9559 | HFCR3276 |
| 9320 | hfcr2938 | 9380 | hfcr3015 | 9440 | HFCR3096 | 9500 | HFCR3183 | 9560 | HFCR3282 |
| 9321 | hfcr2939 | 9381 | hfcr3016 | 9441 | HFCR3097 | 9501 | HFCR3184 | 9561 | HFCR3283 |
| 9322 | hfcr2940 | 9382 | hfcr3017 | 9442 | HFCR3099 | 9502 | HFCR3185 | 9562 | HFCR3284 |
| 9323 | hfcr2941 | 9383 | hfcr3018 | 9443 | HFCR3100 | 9503 | HFCR3186 | 9563 | HFCR3285 |
| 9324 | hfcr2942 | 9384 | hfcr3019 | 9444 | HFCR3101 | 9504 | HFCR3187 | 9564 | hfcr3362 |
| 9325 | hfcr2943 | 9385 | hfcr3020 | 9445 | HFCR3103 | 9505 | HFCR3189 | 9565 | hfcr3363 |
| 9326 | hfcr2945 | 9386 | hfcr3021 | 9446 | HFCR3107 | 9506 | HFCR3190 | 9566 | hfcr3364 |
| 9327 | hfcr2946 | 9387 | hfcr3022 | 9447 | HFCR3108 | 9507 | HFCR3191 | 9567 | hfcr3365 |
| 9328 | hfcr2947 | 9388 | hfcr3023 | 9448 | HFCR3109 | 9508 | HFCR3194 | 9568 | hfcr3366 |
| 9329 | hfcr2948 | 9389 | hfcr3024 | 9449 | HFCR3110 | 9509 | HFCR3195 | 9569 | hfcr3367 |
| 9330 | hfcr2950 | 9390 | hfcr3025 | 9450 | HFCR3113 | 9510 | HFCR3196 | 9570 | hfcr3369 |
| 9331 | hfcr2951 | 9391 | hfcr3026 | 9451 | HFCR3115 | 9511 | HFCR3197 | 9571 | hfcr3370 |
| 9332 | hfcr2952 | 9392 | hfcr3027 | 9452 | HFCR3116 | 9512 | HFCR3198 | 9572 | hfcr3371 |
| 9333 | hfcr2953 | 9393 | hfcr3028 | 9453 | HFCR3117 | 9513 | HFCR3199 | 9573 | hfcr3373 |
| 9334 | hfcr2955 | 9394 | hfcr3029 | 9454 | HFCR3118 | 9514 | HFCR3200 | 9574 | hfcr3374 |
| 9335 | hfcr2956 | 9395 | hfcr3030 | 9455 | HFCR3119 | 9515 | HFCR3201 | 9575 | hfcr3375 |
| 9336 | hfcr2957 | 9396 | hfcr3032 | 9456 | HFCR3120 | 9516 | HFCR3202 | 9576 | hfcr3376 |
| 9337 | hfcr2958 | 9397 | hfcr3033 | 9457 | HFCR3125 | 9517 | HFCR3203 | 9577 | hfcr3377 |
| 9338 | hfcr2959 | 9398 | hfcr3034 | 9458 | HFCR3128 | 9518 | HFCR3206 | 9578 | hfcr3379 |
| 9339 | hfcr2960 | 9399 | hfcr3035 | 9459 | HFCR3130 | 9519 | HFCR3207 | 9579 | hfcr3380 |
| 9340 | hfcr2961 | 9400 | hfcr3037 | 9460 | HFCR3131 | 9520 | HFCR3209 | 9580 | hfcr3381 |
| 9341 | hfcr2962 | 9401 | hfcr3038 | 9461 | HFCR3132 | 9521 | HFCR3210 | 9581 | hfcr3382 |
| 9342 | hfcr2963 | 9402 | hfcr3039 | 9462 | HFCR3133 | 9522 | HFCR3211 | 9582 | hfcr3383 |
| 9343 | hfcr2965 | 9403 | hfcr3040 | 9463 | HFCR3134 | 9523 | HFCR3212 | 9583 | hfcr3384 |
| 9344 | hfcr2966 | 9404 | hfcr3042 | 9464 | HFCR3135 | 9524 | HFCR3214 | 9584 | hfcr3385 |
| 9345 | hfcr2971 | 9405 | hfcr3043 | 9465 | HFCR3136 | 9525 | HFCR3215 | 9585 | hfcr3386 |
| 9346 | hfcr2975 | 9406 | hfcr3044 | 9466 | HFCR3137 | 9526 | HFCR3218 | 9586 | hfcr3389 |
| 9347 | hfcr2976 | 9407 | hfcr3045 | 9467 | HFCR3138 | 9527 | HFCR3220 | 9587 | hfcr3390 |
| 9348 | hfcr2977 | 9408 | hfcr3046 | 9468 | HFCR3139 | 9528 | HFCR3222 | 9588 | hfcr3391 |
| 9349 | hfcr2978 | 9409 | hfcr3047 | 9469 | HFCR3140 | 9529 | HFCR3223 | 9589 | hfcr3392 |
| 9350 | hfcr2979 | 9410 | hfcr3048 | 9470 | HFCR3141 | 9530 | HFCR3224 | 9590 | hfcr3393 |
| 9351 | hfcr2980 | 9411 | hfcr3050 | 9471 | HFCR3142 | 9531 | HFCR3225 | 9591 | hfcr3394 |
| 9352 | hfcr2981 | 9412 | hfcr3051 | 9472 | HFCR3143 | 9532 | HFCR3226 | 9592 | hfcr3395 |
| 9353 | hfcr2982 | 9413 | hfcr3052 | 9473 | HFCR3144 | 9533 | HFCR3228 | 9593 | hfcr3396 |
| 9354 | hfcr2983 | 9414 | hfcr3054 | 9474 | HFCR3145 | 9534 | HFCR3231 | 9594 | hfcr3397 |
| 9355 | hfcr2984 | 9415 | hfcr3056 | 9475 | HFCR3146 | 9535 | HFCR3233 | 9595 | hfcr3398 |
| 9356 | hfcr2985 | 9416 | hfcr3058 | 9476 | HFCR3147 | 9536 | HFCR3234 | 9596 | hfcr3399 |
| 9357 | hfcr2986 | 9417 | hfcr3059 | 9477 | HFCR3148 | 9537 | HFCR3235 | 9597 | hfcr3400 |
| 9358 | hfcr2989 | 9418 | hfcr3060 | 9478 | HFCR3149 | 9538 | HFCR3236 | 9598 | hfcr3402 |
| 9359 | hfcr2990 | 9419 | hfcr3063 | 9479 | HFCR3150 | 9539 | HFCR3237 | 9599 | hfcr3403 |
| 9360 | hfcr2991 | 9420 | hfcr3064 | 9480 | HFCR3152 | 9540 | HFCR3238 | 9600 | hfcr3404 |

Figure 6B - List of EST Sequence Names From Fetal Cartilage cDNA Library

| | | | | | | | | | |
|---|---|---|---|---|---|---|---|---|---|
| 9601 | hfcr3405 | 9661 | hfcr3475 | 9721 | hfcr3549 | 9781 | hfcr3639 | 9841 | hfcr3730 |
| 9602 | hfcr3406 | 9662 | hfcr3476 | 9722 | hfcr3550 | 9782 | hfcr3642 | 9842 | hfcr3731 |
| 9603 | hfcr3407 | 9663 | hfcr3477 | 9723 | hfcr3551 | 9783 | hfcr3644 | 9843 | hfcr3733 |
| 9604 | hfcr3408 | 9664 | hfcr3479 | 9724 | hfcr3552 | 9784 | hfcr3645 | 9844 | hfcr3734 |
| 9605 | hfcr3409 | 9665 | hfcr3481 | 9725 | hfcr3555 | 9785 | hfcr3647 | 9845 | hfcr3735 |
| 9606 | hfcr3410 | 9666 | hfcr3482 | 9726 | hfcr3556 | 9786 | hfcr3649 | 9846 | hfcr3736 |
| 9607 | hfcr3411 | 9667 | hfcr3483 | 9727 | hfcr3557 | 9787 | hfcr3650 | 9847 | hfcr3737 |
| 9608 | hfcr3412 | 9668 | hfcr3484 | 9728 | hfcr3558 | 9788 | hfcr3651 | 9848 | hfcr3738 |
| 9609 | hfcr3413 | 9669 | hfcr3485 | 9729 | hfcr3559 | 9789 | hfcr3652 | 9849 | hfcr3739 |
| 9610 | hfcr3414 | 9670 | hfcr3486 | 9730 | hfcr3562 | 9790 | hfcr3653 | 9850 | hfcr3740 |
| 9611 | hfcr3415 | 9671 | hfcr3487 | 9731 | hfcr3563 | 9791 | hfcr3654 | 9851 | hfcr3741 |
| 9612 | hfcr3416 | 9672 | hfcr3488 | 9732 | hfcr3565 | 9792 | hfcr3658 | 9852 | hfcr3742 |
| 9613 | hfcr3417 | 9673 | hfcr3489 | 9733 | hfcr3568 | 9793 | hfcr3659 | 9853 | hfcr3743 |
| 9614 | hfcr3418 | 9674 | hfcr3490 | 9734 | hfcr3570 | 9794 | hfcr3660 | 9854 | hfcr3744 |
| 9615 | hfcr3420 | 9675 | hfcr3491 | 9735 | hfcr3571 | 9795 | hfcr3665 | 9855 | hfcr3745 |
| 9616 | hfcr3421 | 9676 | hfcr3492 | 9736 | hfcr3572 | 9796 | hfcr3667 | 9856 | hfcr3746 |
| 9617 | hfcr3422 | 9677 | hfcr3493 | 9737 | hfcr3575 | 9797 | hfcr3670 | 9857 | hfcr3747 |
| 9618 | hfcr3424 | 9678 | hfcr3494 | 9738 | hfcr3576 | 9798 | hfcr3671 | 9858 | hfcr3748 |
| 9619 | hfcr3425 | 9679 | hfcr3496 | 9739 | hfcr3579 | 9799 | hfcr3672 | 9859 | hfcr3749 |
| 9620 | hfcr3427 | 9680 | hfcr3497 | 9740 | hfcr3580 | 9800 | hfcr3673 | 9860 | hfcr3750 |
| 9621 | hfcr3428 | 9681 | hfcr3498 | 9741 | hfcr3582 | 9801 | hfcr3674 | 9861 | hfcr3751 |
| 9622 | hfcr3432 | 9682 | hfcr3499 | 9742 | hfcr3583 | 9802 | hfcr3675 | 9862 | hfcr3752 |
| 9623 | hfcr3434 | 9683 | hfcr3500 | 9743 | hfcr3584 | 9803 | hfcr3676 | 9863 | hfcr3753 |
| 9624 | hfcr3435 | 9684 | hfcr3501 | 9744 | hfcr3587 | 9804 | hfcr3677 | 9864 | hfcr3754 |
| 9625 | hfcr3436 | 9685 | hfcr3502 | 9745 | hfcr3588 | 9805 | hfcr3678 | 9865 | hfcr3756 |
| 9626 | hfcr3437 | 9686 | hfcr3503 | 9746 | hfcr3589 | 9806 | hfcr3679 | 9866 | hfcr3757 |
| 9627 | hfcr3438 | 9687 | hfcr3504 | 9747 | hfcr3591 | 9807 | hfcr3680 | 9867 | hfcr3758 |
| 9628 | hfcr3439 | 9688 | hfcr3506 | 9748 | hfcr3592 | 9808 | hfcr3682 | 9868 | hfcr3759 |
| 9629 | hfcr3440 | 9689 | hfcr3507 | 9749 | hfcr3593 | 9809 | hfcr3684 | 9869 | hfcr3760 |
| 9630 | hfcr3441 | 9690 | hfcr3509 | 9750 | hfcr3594 | 9810 | hfcr3686 | 9870 | hfcr3761 |
| 9631 | hfcr3442 | 9691 | hfcr3511 | 9751 | hfcr3596 | 9811 | hfcr3687 | 9871 | hfcr3762 |
| 9632 | hfcr3443 | 9692 | hfcr3513 | 9752 | hfcr3597 | 9812 | hfcr3690 | 9872 | hfcr3763 |
| 9633 | hfcr3444 | 9693 | hfcr3514 | 9753 | hfcr3598 | 9813 | hfcr3691 | 9873 | hfcr3764 |
| 9634 | hfcr3445 | 9694 | hfcr3515 | 9754 | hfcr3600 | 9814 | hfcr3692 | 9874 | hfcr3766 |
| 9635 | hfcr3446 | 9695 | hfcr3516 | 9755 | hfcr3601 | 9815 | hfcr3693 | 9875 | hfcr3767 |
| 9636 | hfcr3447 | 9696 | hfcr3517 | 9756 | hfcr3602 | 9816 | hfcr3694 | 9876 | hfcr3769 |
| 9637 | hfcr3448 | 9697 | hfcr3518 | 9757 | hfcr3603 | 9817 | hfcr3695 | 9877 | hfcr3770 |
| 9638 | hfcr3450 | 9698 | hfcr3521 | 9758 | hfcr3604 | 9818 | hfcr3698 | 9878 | hfcr3771 |
| 9639 | hfcr3451 | 9699 | hfcr3523 | 9759 | hfcr3605 | 9819 | hfcr3699 | 9879 | hfcr3772 |
| 9640 | hfcr3453 | 9700 | hfcr3524 | 9760 | hfcr3608 | 9820 | hfcr3700 | 9880 | hfcr3773 |
| 9641 | hfcr3454 | 9701 | hfcr3525 | 9761 | hfcr3609 | 9821 | hfcr3706 | 9881 | hfcr3774 |
| 9642 | hfcr3455 | 9702 | hfcr3526 | 9762 | hfcr3610 | 9822 | hfcr3707 | 9882 | hfcr3775 |
| 9643 | hfcr3457 | 9703 | hfcr3527 | 9763 | hfcr3611 | 9823 | hfcr3708 | 9883 | hfcr3776 |
| 9644 | hfcr3458 | 9704 | hfcr3528 | 9764 | hfcr3612 | 9824 | hfcr3711 | 9884 | hfcr3777 |
| 9645 | hfcr3459 | 9705 | hfcr3529 | 9765 | hfcr3613 | 9825 | hfcr3712 | 9885 | hfcr3778 |
| 9646 | hfcr3460 | 9706 | hfcr3531 | 9766 | hfcr3614 | 9826 | hfcr3713 | 9886 | hfcr3779 |
| 9647 | hfcr3461 | 9707 | hfcr3532 | 9767 | hfcr3615 | 9827 | hfcr3715 | 9887 | hfcr3781 |
| 9648 | hfcr3462 | 9708 | hfcr3533 | 9768 | hfcr3616 | 9828 | hfcr3716 | 9888 | hfcr3783 |
| 9649 | hfcr3463 | 9709 | hfcr3534 | 9769 | hfcr3620 | 9829 | hfcr3717 | 9889 | hfcr3784 |
| 9650 | hfcr3464 | 9710 | hfcr3535 | 9770 | hfcr3622 | 9830 | hfcr3718 | 9890 | hfcr3787 |
| 9651 | hfcr3465 | 9711 | hfcr3536 | 9771 | hfcr3625 | 9831 | hfcr3719 | 9891 | hfcr3790 |
| 9652 | hfcr3466 | 9712 | hfcr3539 | 9772 | hfcr3627 | 9832 | hfcr3720 | 9892 | hfcr3793 |
| 9653 | hfcr3467 | 9713 | hfcr3540 | 9773 | hfcr3628 | 9833 | hfcr3721 | 9893 | hfcr3794 |
| 9654 | hfcr3468 | 9714 | hfcr3541 | 9774 | hfcr3629 | 9834 | hfcr3722 | 9894 | hfcr3795 |
| 9655 | hfcr3469 | 9715 | hfcr3542 | 9775 | hfcr3630 | 9835 | hfcr3723 | 9895 | hfcr3796 |
| 9656 | hfcr3470 | 9716 | hfcr3543 | 9776 | hfcr3631 | 9836 | hfcr3724 | 9896 | hfcr3797 |
| 9657 | hfcr3471 | 9717 | hfcr3545 | 9777 | hfcr3632 | 9837 | hfcr3725 | 9897 | hfcr3798 |
| 9658 | hfcr3472 | 9718 | hfcr3546 | 9778 | hfcr3633 | 9838 | hfcr3726 | 9898 | hfcr3799 |
| 9659 | hfcr3473 | 9719 | hfcr3547 | 9779 | hfcr3634 | 9839 | hfcr3727 | 9899 | hfcr3800 |
| 9660 | hfcr3474 | 9720 | hfcr3548 | 9780 | hfcr3635 | 9840 | hfcr3729 | 9900 | hfcr3801 |

Figure 6B – List of EST Sequence Names From Fetal Cartilage cDNA Library

| | | | | | | | | | |
|---|---|---|---|---|---|---|---|---|---|
| 9901 | hfcr3802 | 9961 | hfcr3888 | 10021 | hfcr3963 | 10081 | hfcr4059 | 10141 | hfcr4142 |
| 9902 | hfcr3803 | 9962 | hfcr3889 | 10022 | hfcr3964 | 10082 | hfcr4060 | 10142 | hfcr4143 |
| 9903 | hfcr3805 | 9963 | hfcr3890 | 10023 | hfcr3967 | 10083 | hfcr4061 | 10143 | hfcr4145 |
| 9904 | hfcr3806 | 9964 | hfcr3892 | 10024 | hfcr3968 | 10084 | hfcr4062 | 10144 | hfcr4146 |
| 9905 | hfcr3808 | 9965 | hfcr3893 | 10025 | hfcr3970 | 10085 | hfcr4063 | 10145 | hfcr4148 |
| 9906 | hfcr3809 | 9966 | hfcr3894 | 10026 | hfcr3971 | 10086 | hfcr4064 | 10146 | hfcr4150 |
| 9907 | hfcr3810 | 9967 | hfcr3895 | 10027 | hfcr3972 | 10087 | hfcr4066 | 10147 | hfcr4151 |
| 9908 | hfcr3816 | 9968 | hfcr3896 | 10028 | hfcr3974 | 10088 | hfcr4067 | 10148 | hfcr4152 |
| 9909 | hfcr3818 | 9969 | hfcr3897 | 10029 | hfcr3978 | 10089 | hfcr4068 | 10149 | hfcr4154 |
| 9910 | hfcr3819 | 9970 | hfcr3898 | 10030 | hfcr3979 | 10090 | hfcr4069 | 10150 | hfcr4156 |
| 9911 | hfcr3820 | 9971 | hfcr3899 | 10031 | hfcr3980 | 10091 | hfcr4072 | 10151 | hfcr4157 |
| 9912 | hfcr3821 | 9972 | hfcr3900 | 10032 | hfcr3981 | 10092 | hfcr4073 | 10152 | hfcr4158 |
| 9913 | hfcr3823 | 9973 | hfcr3901 | 10033 | hfcr3982 | 10093 | hfcr4074 | 10153 | hfcr4159 |
| 9914 | hfcr3827 | 9974 | hfcr3902 | 10034 | hfcr3983 | 10094 | hfcr4075 | 10154 | hfcr4160 |
| 9915 | hfcr3828 | 9975 | hfcr3903 | 10035 | hfcr3984 | 10095 | hfcr4076 | 10155 | hfcr4161 |
| 9916 | hfcr3830 | 9976 | hfcr3904 | 10036 | hfcr3986 | 10096 | hfcr4077 | 10156 | hfcr4162 |
| 9917 | hfcr3833 | 9977 | hfcr3905 | 10037 | hfcr3988 | 10097 | hfcr4078 | 10157 | hfcr4163 |
| 9918 | hfcr3834 | 9978 | hfcr3906 | 10038 | hfcr3990 | 10098 | hfcr4079 | 10158 | hfcr4164 |
| 9919 | hfcr3835 | 9979 | hfcr3908 | 10039 | hfcr3991 | 10099 | hfcr4080 | 10159 | hfcr4165 |
| 9920 | hfcr3837 | 9980 | hfcr3909 | 10040 | hfcr3994 | 10100 | hfcr4081 | 10160 | hfcr4166 |
| 9921 | hfcr3839 | 9981 | hfcr3911 | 10041 | hfcr3995 | 10101 | hfcr4082 | 10161 | hfcr4167 |
| 9922 | hfcr3840 | 9982 | hfcr3912 | 10042 | hfcr3996 | 10102 | hfcr4083 | 10162 | hfcr4168 |
| 9923 | hfcr3841 | 9983 | hfcr3913 | 10043 | hfcr3997 | 10103 | hfcr4084 | 10163 | hfcr4169 |
| 9924 | hfcr3842 | 9984 | hfcr3914 | 10044 | hfcr3998 | 10104 | hfcr4085 | 10164 | hfcr4170 |
| 9925 | hfcr3844 | 9985 | hfcr3915 | 10045 | hfcr3999 | 10105 | hfcr4086 | 10165 | hfcr4171 |
| 9926 | hfcr3845 | 9986 | hfcr3916 | 10046 | hfcr4000 | 10106 | hfcr4087 | 10166 | hfcr4172 |
| 9927 | hfcr3846 | 9987 | hfcr3917 | 10047 | hfcr4002 | 10107 | hfcr4089 | 10167 | hfcr4173 |
| 9928 | hfcr3847 | 9988 | hfcr3918 | 10048 | hfcr4004 | 10108 | hfcr4094 | 10168 | hfcr4174 |
| 9929 | hfcr3848 | 9989 | hfcr3919 | 10049 | hfcr4006 | 10109 | hfcr4099 | 10169 | hfcr4175 |
| 9930 | hfcr3853 | 9990 | hfcr3920 | 10050 | hfcr4007 | 10110 | hfcr4100 | 10170 | hfcr4176 |
| 9931 | hfcr3854 | 9991 | hfcr3921 | 10051 | hfcr4008 | 10111 | hfcr4101 | 10171 | hfcr4177 |
| 9932 | hfcr3855 | 9992 | hfcr3922 | 10052 | hfcr4010 | 10112 | hfcr4103 | 10172 | hfcr4179 |
| 9933 | hfcr3858 | 9993 | hfcr3923 | 10053 | hfcr4011 | 10113 | hfcr4106 | 10173 | hfcr4180 |
| 9934 | hfcr3859 | 9994 | hfcr3925 | 10054 | hfcr4012 | 10114 | hfcr4111 | 10174 | hfcr4181 |
| 9935 | hfcr3861 | 9995 | hfcr3926 | 10055 | hfcr4014 | 10115 | hfcr4112 | 10175 | hfcr4186 |
| 9936 | hfcr3862 | 9996 | hfcr3928 | 10056 | hfcr4015 | 10116 | hfcr4114 | 10176 | hfcr4187 |
| 9937 | hfcr3863 | 9997 | hfcr3929 | 10057 | hfcr4016 | 10117 | hfcr4115 | 10177 | hfcr4188 |
| 9938 | hfcr3864 | 9998 | hfcr3930 | 10058 | hfcr4018 | 10118 | hfcr4116 | 10178 | hfcr4190 |
| 9939 | hfcr3865 | 9999 | hfcr3931 | 10059 | hfcr4023 | 10119 | hfcr4117 | 10179 | hfcr4191 |
| 9940 | hfcr3866 | 10000 | hfcr3932 | 10060 | hfcr4024 | 10120 | hfcr4118 | 10180 | hfcr4193 |
| 9941 | hfcr3867 | 10001 | hfcr3933 | 10061 | hfcr4026 | 10121 | hfcr4119 | 10181 | hfcr4194 |
| 9942 | hfcr3868 | 10002 | hfcr3935 | 10062 | hfcr4027 | 10122 | hfcr4120 | 10182 | hfcr4195 |
| 9943 | hfcr3869 | 10003 | hfcr3936 | 10063 | hfcr4028 | 10123 | hfcr4121 | 10183 | hfcr4196 |
| 9944 | hfcr3871 | 10004 | hfcr3938 | 10064 | hfcr4031 | 10124 | hfcr4122 | 10184 | hfcr4197 |
| 9945 | hfcr3872 | 10005 | hfcr3940 | 10065 | hfcr4032 | 10125 | hfcr4123 | 10185 | hfcr4202 |
| 9946 | hfcr3873 | 10006 | hfcr3941 | 10066 | hfcr4034 | 10126 | hfcr4124 | 10186 | hfcr4203 |
| 9947 | hfcr3874 | 10007 | hfcr3942 | 10067 | hfcr4035 | 10127 | hfcr4125 | 10187 | hfcr4204 |
| 9948 | hfcr3875 | 10008 | hfcr3943 | 10068 | hfcr4037 | 10128 | hfcr4126 | 10188 | hfcr4205 |
| 9949 | hfcr3876 | 10009 | hfcr3944 | 10069 | hfcr4038 | 10129 | hfcr4129 | 10189 | hfcr4206 |
| 9950 | hfcr3877 | 10010 | hfcr3946 | 10070 | hfcr4044 | 10130 | hfcr4130 | 10190 | hfcr4207 |
| 9951 | hfcr3878 | 10011 | hfcr3947 | 10071 | hfcr4045 | 10131 | hfcr4131 | 10191 | hfcr4208 |
| 9952 | hfcr3879 | 10012 | hfcr3948 | 10072 | hfcr4046 | 10132 | hfcr4132 | 10192 | hfcr4211 |
| 9953 | hfcr3880 | 10013 | hfcr3951 | 10073 | hfcr4048 | 10133 | hfcr4133 | 10193 | hfcr4212 |
| 9954 | hfcr3881 | 10014 | hfcr3952 | 10074 | hfcr4049 | 10134 | hfcr4134 | 10194 | hfcr4214 |
| 9955 | hfcr3882 | 10015 | hfcr3954 | 10075 | hfcr4051 | 10135 | hfcr4135 | 10195 | hfcr4215 |
| 9956 | hfcr3883 | 10016 | hfcr3956 | 10076 | hfcr4053 | 10136 | hfcr4136 | 10196 | hfcr4219 |
| 9957 | hfcr3884 | 10017 | hfcr3958 | 10077 | hfcr4054 | 10137 | hfcr4138 | 10197 | hfcr4220 |
| 9958 | hfcr3885 | 10018 | hfcr3960 | 10078 | hfcr4055 | 10138 | hfcr4139 | 10198 | hfcr4222 |
| 9959 | hfcr3886 | 10019 | hfcr3961 | 10079 | hfcr4057 | 10139 | hfcr4140 | 10199 | hfcr4223 |
| 9960 | hfcr3887 | 10020 | hfcr3962 | 10080 | hfcr4058 | 10140 | hfcr4141 | 10200 | hfcr4226 |

Figure 6B - List of EST Sequence Names From Fetal Cartilage cDNA Library

| | |
|---|---|
| 10201 | hfcr4230 |
| 10202 | hfcr4235 |
| 10203 | hfcr4241 |
| 10204 | hfcr4244 |
| 10205 | hfcr4247 |
| 10206 | hfcr4252 |
| 10207 | hfcr4256 |
| 10208 | hfcr4260 |
| 10209 | hfcr4266 |
| 10210 | hfcr4267 |
| 10211 | hfcr4270 |
| 10212 | hfcr4273 |
| 10213 | hfcr4274 |
| 10214 | hfcr4275 |
| 10215 | hfcr4278 |
| 10216 | hfcr4279 |
| 10217 | hfcr4281 |
| 10218 | hfcr4283 |
| 10219 | hfcr4284 |
| 10220 | hfcr4289 |
| 10221 | hfcr4297 |
| 10222 | hfcr4309 |
| 10223 | hfcr4315 |
| 10224 | hfcr4316 |
| 10225 | hfcr4325 |
| 10226 | hfcr4326 |
| 10227 | hfcr4327 |
| 10228 | hfcr4333 |
| 10229 | hfcr4334 |
| 10230 | hfcr4335 |
| 10231 | hfcr4337 |
| 10232 | hfcr4341 |
| 10233 | hfcr4342 |
| 10234 | hfcr4345 |
| 10235 | hfcr4347 |
| 10236 | hfcr4348 |
| 10237 | hfcr4349 |
| 10238 | hfcr4350 |
| 10239 | hfcr4351 |
| 10240 | hfcr4417 |
| 10241 | hfcr4421 |
| 10242 | hfcr4422 |
| 10243 | hfcr4423 |
| 10244 | hfcr4424 |
| 10245 | hfcr4426 |
| 10246 | hfcr4429 |
| 10247 | hfcr4430 |
| 10248 | hfcr4437 |
| 10249 | hfcr4438 |
| 10250 | hfcr4439 |
| 10251 | hfcr4440 |
| 10252 | hfcr4441 |
| 10253 | hfcr4443 |
| 10254 | hfcr4444 |
| 10255 | hfcr4445 |
| 10256 | hfcr4446 |
| 10257 | hfcr4447 |
| 10258 | hfcr4449 |
| 10259 | hfcr4451 |
| 10260 | hfcr4452 |
| 10261 | hfcr4454 |
| 10262 | hfcr4457 |
| 10263 | hfcr4458 |
| 10264 | hfcr4460 |
| 10265 | hfcr4461 |
| 10266 | hfcr4462 |
| 10267 | hfcr4463 |
| 10268 | hfcr4464 |
| 10269 | hfcr4466 |
| 10270 | hfcr4467 |
| 10271 | hfcr4468 |
| 10272 | hfcr4469 |
| 10273 | hfcr4470 |
| 10274 | hfcr4472 |
| 10275 | hfcr4475 |
| 10276 | hfcr4476 |
| 10277 | hfcr4477 |
| 10278 | hfcr4479 |
| 10279 | hfcr4480 |
| 10280 | hfcr4482 |
| 10281 | hfcr4483 |
| 10282 | hfcr4485 |
| 10283 | hfcr4487 |
| 10284 | hfcr4488 |
| 10285 | hfcr4489 |
| 10286 | hfcr4491 |
| 10287 | hfcr4492 |
| 10288 | hfcr4493 |
| 10289 | hfcr4494 |
| 10290 | hfcr4495 |
| 10291 | hfcr4497 |
| 10292 | hfcr4498 |
| 10293 | hfcr4499 |
| 10294 | hfcr4500 |
| 10295 | hfcr4502 |
| 10296 | hfcr4504 |
| 10297 | hfcr4506 |
| 10298 | hfcr4508 |
| 10299 | hfcr4509 |
| 10300 | hfcr4510 |
| 10301 | hfcr4515 |
| 10302 | hfcr4527 |
| 10303 | hfcr4529 |
| 10304 | hfcr4530 |
| 10305 | hfcr4541 |
| 10306 | hfcr4542 |
| 10307 | hfcr4545 |
| 10308 | hfcr4557 |
| 10309 | hfcr4565 |
| 10310 | hfcr4574 |
| 10311 | hfcr4596 |
| 10312 | hfcr4598 |
| 10313 | hfcr4600 |
| 10314 | hfcr4604 |
| 10315 | hfcr4609 |
| 10316 | hfcr4612 |
| 10317 | hfcr4613 |
| 10318 | hfcr4614 |
| 10319 | hfcr4615 |
| 10320 | hfcr4621 |
| 10321 | hfcr4639 |
| 10322 | hfcr4640 |
| 10323 | hfcr4645 |
| 10324 | hfcr4651 |
| 10325 | hfcr4652 |
| 10326 | hfcr4653 |
| 10327 | hfcr4654 |
| 10328 | hfcr4659 |
| 10329 | hfcr4660 |
| 10330 | hfcr4661 |
| 10331 | hfcr4662 |
| 10332 | hfcr4663 |
| 10333 | hfcr4667 |
| 10334 | hfcr4670 |
| 10335 | hfcr4677 |
| 10336 | hfcr4680 |
| 10337 | hfcr4684 |
| 10338 | hfcr4685 |
| 10339 | hfcr4696 |
| 10340 | hfcr4707 |
| 10341 | hfcr4713 |
| 10342 | hfcr4716 |
| 10343 | hfcr4717 |
| 10344 | hfcr4730 |
| 10345 | hfcr4732 |
| 10346 | hfcr4741 |
| 10347 | hfcr4743 |
| 10348 | hfcr4748 |
| 10349 | hfcr4760 |
| 10350 | hfcr4761 |
| 10351 | hfcr4765 |
| 10352 | hfcr4766 |
| 10353 | hfcr4769 |
| 10354 | hfcr4775 |
| 10355 | hfcr4776 |
| 10356 | hfcr4782 |
| 10357 | hfcr4806 |
| 10358 | hfcr4807 |
| 10359 | hfcr4813 |
| 10360 | hfcr4816 |
| 10361 | hfcr4817 |
| 10362 | hfcr4823 |
| 10363 | hfcr4832 |
| 10364 | hfcr4834 |
| 10365 | hfcr4846 |
| 10366 | hfcr4848 |
| 10367 | hfcr4897 |
| 10368 | hfcr4901 |
| 10369 | hfcr4995 |
| 10370 | hfcr5002 |
| 10371 | hfcr5003 |
| 10372 | hfcr5009 |
| 10373 | hfcr5010 |
| 10374 | hfcr5011 |
| 10375 | hfcr5014 |
| 10376 | hfcr5017 |
| 10377 | hfcr5019 |
| 10378 | hfcr5023 |
| 10379 | hfcr5029 |
| 10380 | hfcr5030 |
| 10381 | hfcr5031 |
| 10382 | hfcr5034 |
| 10383 | hfcr5037 |
| 10384 | hfcr5038 |
| 10385 | hfcr5041 |
| 10386 | hfcr5045 |
| 10387 | hfcr5046 |
| 10388 | hfcr5053 |
| 10389 | hfcr5057 |
| 10390 | hfcr5065 |
| 10391 | hfcr5067 |
| 10392 | hfcr5070 |
| 10393 | hfcr5071 |
| 10394 | hfcr5075 |
| 10395 | hfcr5078 |
| 10396 | hfcr5079 |
| 10397 | hfcr5082 |
| 10398 | hfcr5083 |
| 10399 | hfcr5085 |
| 10400 | hfcr5086 |
| 10401 | hfcr5087 |
| 10402 | hfcr5091 |
| 10403 | hfcr5094 |
| 10404 | hfcr5095 |
| 10405 | hfcr5099 |
| 10406 | hfcr5106 |
| 10407 | hfcr5107 |
| 10408 | hfcr5108 |
| 10409 | hfcr5109 |
| 10410 | hfcr5111 |
| 10411 | hfcr5113 |
| 10412 | hfcr5114 |
| 10413 | hfcr5117 |
| 10414 | hfcr5119 |
| 10415 | hfcr5120 |
| 10416 | hfcr5121 |
| 10417 | hfcr5122 |
| 10418 | hfcr5123 |
| 10419 | hfcr5125 |
| 10420 | hfcr5126 |
| 10421 | hfcr5127 |
| 10422 | hfcr5128 |
| 10423 | hfcr5129 |
| 10424 | hfcr5131 |
| 10425 | hfcr5133 |
| 10426 | hfcr5134 |
| 10427 | hfcr5135 |
| 10428 | hfcr5138 |
| 10429 | hfcr5139 |
| 10430 | hfcr5140 |
| 10431 | hfcr5141 |
| 10432 | hfcr5147 |
| 10433 | hfcr5148 |
| 10434 | hfcr5149 |
| 10435 | hfcr5150 |
| 10436 | hfcr5153 |
| 10437 | hfcr5154 |
| 10438 | hfcr5155 |
| 10439 | hfcr5157 |
| 10440 | hfcr5158 |
| 10441 | hfcr5162 |
| 10442 | hfcr5163 |
| 10443 | hfcr5164 |
| 10444 | hfcr5166 |
| 10445 | hfcr5167 |
| 10446 | hfcr5168 |
| 10447 | hfcr5169 |
| 10448 | hfcr5170 |
| 10449 | hfcr5171 |
| 10450 | hfcr5172 |
| 10451 | hfcr5173 |
| 10452 | hfcr5174 |
| 10453 | hfcr5175 |
| 10454 | hfcr5177 |
| 10455 | hfcr5181 |
| 10456 | hfcr5182 |
| 10457 | hfcr5183 |
| 10458 | hfcr5184 |
| 10459 | hfcr5187 |
| 10460 | hfcr5188 |
| 10461 | hfcr5189 |
| 10462 | hfcr5190 |
| 10463 | hfcr5192 |
| 10464 | hfcr5193 |
| 10465 | hfcr5194 |
| 10466 | hfcr5197 |
| 10467 | hfcr5198 |
| 10468 | hfcr5199 |
| 10469 | hfcr5200 |
| 10470 | hfcr5201 |
| 10471 | hfcr5202 |
| 10472 | hfcr5203 |
| 10473 | hfcr5205 |
| 10474 | hfcr5206 |
| 10475 | hfcr5207 |
| 10476 | hfcr5209 |
| 10477 | hfcr5211 |
| 10478 | hfcr5215 |
| 10479 | hfcr5220 |
| 10480 | hfcr5222 |
| 10481 | hfcr5225 |
| 10482 | hfcr5228 |
| 10483 | hfcr5229 |
| 10484 | hfcr5232 |
| 10485 | hfcr5233 |
| 10486 | hfcr5234 |
| 10487 | hfcr5236 |
| 10488 | hfcr5237 |
| 10489 | hfcr5239 |
| 10490 | hfcr5240 |
| 10491 | hfcr5242 |
| 10492 | hfcr5243 |
| 10493 | hfcr5244 |
| 10494 | hfcr5246 |
| 10495 | hfcr5248 |
| 10496 | hfcr5249 |
| 10497 | hfcr5250 |
| 10498 | hfcr5251 |
| 10499 | hfcr5252 |
| 10500 | hfcr5253 |

Figure 6B – List of EST Sequence Names From Fetal Cartilage cDNA Library

| | | | | | | | | | |
|---|---|---|---|---|---|---|---|---|---|
| 10501 | hfcr5254 | 10561 | hfcr5449 | 10621 | hfcr5602 | 10681 | hfcr5729 | 10741 | hfcr5821 |
| 10502 | hfcr5256 | 10562 | hfcr5450 | 10622 | hfcr5603 | 10682 | hfcr5732 | 10742 | hfcr5823 |
| 10503 | hfcr5257 | 10563 | hfcr5452 | 10623 | hfcr5604 | 10683 | hfcr5733 | 10743 | hfcr5825 |
| 10504 | hfcr5258 | 10564 | hfcr5454 | 10624 | hfcr5606 | 10684 | hfcr5735 | 10744 | hfcr5827 |
| 10505 | hfcr5260 | 10565 | hfcr5458 | 10625 | hfcr5607 | 10685 | hfcr5737 | 10745 | hfcr5829 |
| 10506 | hfcr5262 | 10566 | hfcr5463 | 10626 | hfcr5608 | 10686 | hfcr5740 | 10746 | hfcr5831 |
| 10507 | hfcr5263 | 10567 | hfcr5467 | 10627 | hfcr5611 | 10687 | hfcr5741 | 10747 | hfcr5832 |
| 10508 | hfcr5264 | 10568 | hfcr5468 | 10628 | hfcr5612 | 10688 | hfcr5742 | 10748 | hfcr5834 |
| 10509 | hfcr5265 | 10569 | hfcr5469 | 10629 | hfcr5616 | 10689 | hfcr5743 | 10749 | hfcr5835 |
| 10510 | hfcr5266 | 10570 | hfcr5471 | 10630 | hfcr5618 | 10690 | hfcr5744 | 10750 | hfcr5836 |
| 10511 | hfcr5267 | 10571 | hfcr5472 | 10631 | hfcr5619 | 10691 | hfcr5745 | 10751 | hfcr5837 |
| 10512 | hfcr5268 | 10572 | hfcr5473 | 10632 | hfcr5620 | 10692 | hfcr5746 | 10752 | hfcr5839 |
| 10513 | hfcr5272 | 10573 | hfcr5474 | 10633 | hfcr5626 | 10693 | hfcr5747 | 10753 | hfcr5840 |
| 10514 | hfcr5273 | 10574 | hfcr5476 | 10634 | hfcr5628 | 10694 | hfcr5748 | 10754 | hfcr5842 |
| 10515 | hfcr5274 | 10575 | hfcr5481 | 10635 | hfcr5629 | 10695 | hfcr5756 | 10755 | hfcr5843 |
| 10516 | hfcr5275 | 10576 | hfcr5482 | 10636 | hfcr5634 | 10696 | hfcr5757 | 10756 | hfcr5845 |
| 10517 | hfcr5278 | 10577 | hfcr5483 | 10637 | hfcr5636 | 10697 | hfcr5759 | 10757 | hfcr5847 |
| 10518 | hfcr5279 | 10578 | hfcr5484 | 10638 | hfcr5640 | 10698 | hfcr5764 | 10758 | hfcr5848 |
| 10519 | hfcr5280 | 10579 | hfcr5489 | 10639 | hfcr5642 | 10699 | hfcr5765 | 10759 | hfcr5849 |
| 10520 | hfcr5281 | 10580 | hfcr5497 | 10640 | hfcr5643 | 10700 | hfcr5767 | 10760 | hfcr5850 |
| 10521 | hfcr5380 | 10581 | hfcr5498 | 10641 | hfcr5649 | 10701 | hfcr5768 | 10761 | hfcr5851 |
| 10522 | hfcr5381 | 10582 | hfcr5499 | 10642 | hfcr5654 | 10702 | hfcr5769 | 10762 | hfcr5852 |
| 10523 | hfcr5382 | 10583 | hfcr5504 | 10643 | hfcr5655 | 10703 | hfcr5771 | 10763 | hfcr5853 |
| 10524 | hfcr5383 | 10584 | hfcr5505 | 10644 | hfcr5657 | 10704 | hfcr5772 | 10764 | hfcr5854 |
| 10525 | hfcr5386 | 10585 | hfcr5506 | 10645 | hfcr5658 | 10705 | hfcr5774 | 10765 | hfcr5856 |
| 10526 | hfcr5388 | 10586 | hfcr5507 | 10646 | hfcr5659 | 10706 | hfcr5775 | 10766 | hfcr5858 |
| 10527 | hfcr5390 | 10587 | hfcr5511 | 10647 | hfcr5660 | 10707 | hfcr5776 | 10767 | hfcr5860 |
| 10528 | hfcr5391 | 10588 | hfcr5512 | 10648 | hfcr5661 | 10708 | hfcr5779 | 10768 | hfcr5861 |
| 10529 | hfcr5395 | 10589 | hfcr5513 | 10649 | hfcr5662 | 10709 | hfcr5780 | 10769 | hfcr5862 |
| 10530 | hfcr5396 | 10590 | hfcr5514 | 10650 | hfcr5663 | 10710 | hfcr5781 | 10770 | hfcr5863 |
| 10531 | hfcr5397 | 10591 | hfcr5515 | 10651 | hfcr5668 | 10711 | hfcr5782 | 10771 | hfcr5864 |
| 10532 | hfcr5398 | 10592 | hfcr5517 | 10652 | hfcr5669 | 10712 | hfcr5785 | 10772 | hfcr5865 |
| 10533 | hfcr5399 | 10593 | hfcr5521 | 10653 | hfcr5670 | 10713 | hfcr5786 | 10773 | hfcr5868 |
| 10534 | hfcr5400 | 10594 | hfcr5522 | 10654 | hfcr5671 | 10714 | hfcr5787 | 10774 | hfcr5870 |
| 10535 | hfcr5403 | 10595 | hfcr5528 | 10655 | hfcr5676 | 10715 | hfcr5789 | 10775 | hfcr5871 |
| 10536 | hfcr5404 | 10596 | hfcr5531 | 10656 | hfcr5678 | 10716 | hfcr5790 | 10776 | hfcr5872 |
| 10537 | hfcr5408 | 10597 | hfcr5534 | 10657 | hfcr5679 | 10717 | hfcr5791 | 10777 | hfcr5873 |
| 10538 | hfcr5410 | 10598 | hfcr5537 | 10658 | hfcr5683 | 10718 | hfcr5792 | 10778 | hfcr5874 |
| 10539 | hfcr5412 | 10599 | hfcr5538 | 10659 | hfcr5684 | 10719 | hfcr5794 | 10779 | hfcr5875 |
| 10540 | hfcr5413 | 10600 | hfcr5555 | 10660 | hfcr5686 | 10720 | hfcr5795 | 10780 | hfcr5876 |
| 10541 | hfcr5418 | 10601 | hfcr5556 | 10661 | hfcr5689 | 10721 | hfcr5796 | 10781 | hfcr5878 |
| 10542 | hfcr5420 | 10602 | hfcr5559 | 10662 | hfcr5690 | 10722 | hfcr5797 | 10782 | hfcr5881 |
| 10543 | hfcr5421 | 10603 | hfcr5562 | 10663 | hfcr5691 | 10723 | hfcr5798 | 10783 | hfcr5882 |
| 10544 | hfcr5422 | 10604 | hfcr5563 | 10664 | hfcr5695 | 10724 | hfcr5799 | 10784 | hfcr5883 |
| 10545 | hfcr5423 | 10605 | hfcr5564 | 10665 | hfcr5702 | 10725 | hfcr5800 | 10785 | hfcr5884 |
| 10546 | hfcr5424 | 10606 | hfcr5565 | 10666 | hfcr5704 | 10726 | hfcr5801 | 10786 | hfcr5889 |
| 10547 | hfcr5425 | 10607 | hfcr5569 | 10667 | hfcr5706 | 10727 | hfcr5802 | 10787 | hfcr5890 |
| 10548 | hfcr5426 | 10608 | hfcr5570 | 10668 | hfcr5708 | 10728 | hfcr5803 | 10788 | hfcr5891 |
| 10549 | hfcr5427 | 10609 | hfcr5571 | 10669 | hfcr5709 | 10729 | hfcr5804 | 10789 | hfcr5893 |
| 10550 | hfcr5428 | 10610 | hfcr5577 | 10670 | hfcr5715 | 10730 | hfcr5805 | 10790 | hfcr5894 |
| 10551 | hfcr5429 | 10611 | hfcr5579 | 10671 | hfcr5716 | 10731 | hfcr5807 | 10791 | hfcr5895 |
| 10552 | hfcr5432 | 10612 | hfcr5580 | 10672 | hfcr5717 | 10732 | hfcr5809 | 10792 | hfcr5896 |
| 10553 | hfcr5433 | 10613 | hfcr5582 | 10673 | hfcr5718 | 10733 | hfcr5810 | 10793 | hfcr5897 |
| 10554 | hfcr5435 | 10614 | hfcr5583 | 10674 | hfcr5719 | 10734 | hfcr5811 | 10794 | hfcr5898 |
| 10555 | hfcr5438 | 10615 | hfcr5590 | 10675 | hfcr5720 | 10735 | hfcr5813 | 10795 | hfcr5899 |
| 10556 | hfcr5439 | 10616 | hfcr5591 | 10676 | hfcr5722 | 10736 | hfcr5814 | 10796 | hfcr5900 |
| 10557 | hfcr5440 | 10617 | hfcr5592 | 10677 | hfcr5723 | 10737 | hfcr5815 | 10797 | hfcr5901 |
| 10558 | hfcr5442 | 10618 | hfcr5593 | 10678 | hfcr5724 | 10738 | hfcr5817 | 10798 | hfcr5902 |
| 10559 | hfcr5445 | 10619 | hfcr5596 | 10679 | hfcr5725 | 10739 | hfcr5818 | 10799 | hfcr5903 |
| 10560 | hfcr5447 | 10620 | hfcr5601 | 10680 | hfcr5726 | 10740 | hfcr5820 | 10800 | hfcr5905 |

Figure 6B – List of EST Sequence Names From Fetal Cartilage cDNA Library

| | | | | | | | | | |
|---|---|---|---|---|---|---|---|---|---|
| 10801 | hfcr5911 | 10861 | hfcr6006 | 10921 | hfcr6092 | 10981 | hfcr6200 | 11041 | hfcr6302 |
| 10802 | hfcr5912 | 10862 | hfcr6007 | 10922 | hfcr6093 | 10982 | hfcr6201 | 11042 | hfcr6304 |
| 10803 | hfcr5913 | 10863 | hfcr6010 | 10923 | hfcr6094 | 10983 | hfcr6202 | 11043 | hfcr6305 |
| 10804 | hfcr5919 | 10864 | hfcr6011 | 10924 | hfcr6095 | 10984 | hfcr6203 | 11044 | hfcr6306 |
| 10805 | hfcr5920 | 10865 | hfcr6012 | 10925 | hfcr6096 | 10985 | hfcr6204 | 11045 | hfcr6307 |
| 10806 | hfcr5935 | 10866 | hfcr6013 | 10926 | hfcr6098 | 10986 | hfcr6205 | 11046 | hfcr6308 |
| 10807 | hfcr5937 | 10867 | hfcr6016 | 10927 | hfcr6099 | 10987 | hfcr6206 | 11047 | hfcr6310 |
| 10808 | hfcr5938 | 10868 | hfcr6017 | 10928 | hfcr6100 | 10988 | hfcr6209 | 11048 | hfcr6311 |
| 10809 | hfcr5939 | 10869 | hfcr6018 | 10929 | hfcr6101 | 10989 | hfcr6210 | 11049 | hfcr6312 |
| 10810 | hfcr5940 | 10870 | hfcr6019 | 10930 | hfcr6102 | 10990 | hfcr6211 | 11050 | hfcr6313 |
| 10811 | hfcr5941 | 10871 | hfcr6020 | 10931 | hfcr6103 | 10991 | hfcr6212 | 11051 | hfcr6315 |
| 10812 | hfcr5942 | 10872 | hfcr6021 | 10932 | hfcr6104 | 10992 | hfcr6213 | 11052 | hfcr6316 |
| 10813 | hfcr5943 | 10873 | hfcr6022 | 10933 | hfcr6105 | 10993 | hfcr6214 | 11053 | hfcr6317 |
| 10814 | hfcr5948 | 10874 | hfcr6024 | 10934 | hfcr6106 | 10994 | hfcr6222 | 11054 | hfcr6318 |
| 10815 | hfcr5949 | 10875 | hfcr6026 | 10935 | hfcr6108 | 10995 | hfcr6223 | 11055 | hfcr6319 |
| 10816 | hfcr5950 | 10876 | hfcr6027 | 10936 | hfcr6110 | 10996 | hfcr6227 | 11056 | hfcr6320 |
| 10817 | hfcr5951 | 10877 | hfcr6028 | 10937 | hfcr6111 | 10997 | hfcr6233 | 11057 | hfcr6322 |
| 10818 | hfcr5954 | 10878 | hfcr6029 | 10938 | hfcr6112 | 10998 | hfcr6235 | 11058 | hfcr6323 |
| 10819 | hfcr5956 | 10879 | hfcr6031 | 10939 | hfcr6113 | 10999 | hfcr6242 | 11059 | hfcr6324 |
| 10820 | hfcr5958 | 10880 | hfcr6033 | 10940 | hfcr6114 | 11000 | hfcr6243 | 11060 | hfcr6325 |
| 10821 | hfcr5959 | 10881 | hfcr6035 | 10941 | hfcr6116 | 11001 | hfcr6244 | 11061 | hfcr6326 |
| 10822 | hfcr5961 | 10882 | hfcr6037 | 10942 | hfcr6117 | 11002 | hfcr6245 | 11062 | hfcr6327 |
| 10823 | hfcr5962 | 10883 | hfcr6038 | 10943 | hfcr6118 | 11003 | hfcr6247 | 11063 | hfcr6328 |
| 10824 | hfcr5963 | 10884 | hfcr6039 | 10944 | hfcr6119 | 11004 | hfcr6248 | 11064 | hfcr6330 |
| 10825 | hfcr5964 | 10885 | hfcr6040 | 10945 | hfcr6120 | 11005 | hfcr6249 | 11065 | hfcr6331 |
| 10826 | hfcr5965 | 10886 | hfcr6041 | 10946 | hfcr6121 | 11006 | hfcr6251 | 11066 | hfcr6333 |
| 10827 | hfcr5966 | 10887 | hfcr6042 | 10947 | hfcr6122 | 11007 | hfcr6252 | 11067 | hfcr6335 |
| 10828 | hfcr5967 | 10888 | hfcr6043 | 10948 | hfcr6123 | 11008 | hfcr6253 | 11068 | hfcr6336 |
| 10829 | hfcr5969 | 10889 | hfcr6044 | 10949 | hfcr6125 | 11009 | hfcr6255 | 11069 | hfcr6338 |
| 10830 | hfcr5970 | 10890 | hfcr6045 | 10950 | hfcr6127 | 11010 | hfcr6256 | 11070 | hfcr6340 |
| 10831 | hfcr5971 | 10891 | hfcr6047 | 10951 | hfcr6129 | 11011 | hfcr6265 | 11071 | hfcr6341 |
| 10832 | hfcr5972 | 10892 | hfcr6050 | 10952 | hfcr6130 | 11012 | hfcr6266 | 11072 | hfcr6342 |
| 10833 | hfcr5973 | 10893 | hfcr6052 | 10953 | hfcr6131 | 11013 | hfcr6267 | 11073 | hfcr6343 |
| 10834 | hfcr5974 | 10894 | hfcr6054 | 10954 | hfcr6132 | 11014 | hfcr6268 | 11074 | hfcr6347 |
| 10835 | hfcr5975 | 10895 | hfcr6056 | 10955 | hfcr6135 | 11015 | hfcr6270 | 11075 | hfcr6348 |
| 10836 | hfcr5976 | 10896 | hfcr6057 | 10956 | hfcr6136 | 11016 | hfcr6271 | 11076 | hfcr6350 |
| 10837 | hfcr5977 | 10897 | hfcr6058 | 10957 | hfcr6137 | 11017 | hfcr6272 | 11077 | hfcr6351 |
| 10838 | hfcr5979 | 10898 | hfcr6059 | 10958 | hfcr6138 | 11018 | hfcr6273 | 11078 | hfcr6352 |
| 10839 | hfcr5980 | 10899 | hfcr6060 | 10959 | hfcr6139 | 11019 | hfcr6274 | 11079 | hfcr6354 |
| 10840 | hfcr5981 | 10900 | hfcr6061 | 10960 | hfcr6141 | 11020 | hfcr6275 | 11080 | hfcr6355 |
| 10841 | hfcr5983 | 10901 | hfcr6063 | 10961 | hfcr6142 | 11021 | hfcr6276 | 11081 | hfcr6356 |
| 10842 | hfcr5984 | 10902 | hfcr6064 | 10962 | hfcr6143 | 11022 | hfcr6279 | 11082 | hfcr6357 |
| 10843 | hfcr5985 | 10903 | hfcr6065 | 10963 | hfcr6144 | 11023 | hfcr6280 | 11083 | hfcr6358 |
| 10844 | hfcr5986 | 10904 | hfcr6066 | 10964 | hfcr6152 | 11024 | hfcr6281 | 11084 | hfcr6361 |
| 10845 | hfcr5987 | 10905 | hfcr6067 | 10965 | hfcr6154 | 11025 | hfcr6282 | 11085 | hfcr6362 |
| 10846 | hfcr5988 | 10906 | hfcr6068 | 10966 | hfcr6164 | 11026 | hfcr6283 | 11086 | hfcr6363 |
| 10847 | hfcr5989 | 10907 | hfcr6069 | 10967 | hfcr6165 | 11027 | hfcr6285 | 11087 | hfcr6364 |
| 10848 | hfcr5991 | 10908 | hfcr6070 | 10968 | hfcr6167 | 11028 | hfcr6286 | 11088 | hfcr6366 |
| 10849 | hfcr5992 | 10909 | hfcr6072 | 10969 | hfcr6168 | 11029 | hfcr6287 | 11089 | hfcr6367 |
| 10850 | hfcr5993 | 10910 | hfcr6073 | 10970 | hfcr6176 | 11030 | hfcr6288 | 11090 | hfcr6368 |
| 10851 | hfcr5994 | 10911 | hfcr6080 | 10971 | hfcr6178 | 11031 | hfcr6289 | 11091 | hfcr6369 |
| 10852 | hfcr5995 | 10912 | hfcr6082 | 10972 | hfcr6183 | 11032 | hfcr6290 | 11092 | hfcr6370 |
| 10853 | hfcr5996 | 10913 | hfcr6083 | 10973 | hfcr6185 | 11033 | hfcr6291 | 11093 | hfcr6371 |
| 10854 | hfcr5997 | 10914 | hfcr6084 | 10974 | hfcr6189 | 11034 | hfcr6292 | 11094 | hfcr6372 |
| 10855 | hfcr5998 | 10915 | hfcr6085 | 10975 | hfcr6192 | 11035 | hfcr6293 | 11095 | hfcr6373 |
| 10856 | hfcr5999 | 10916 | hfcr6086 | 10976 | hfcr6193 | 11036 | hfcr6296 | 11096 | hfcr6374 |
| 10857 | hfcr6001 | 10917 | hfcr6087 | 10977 | hfcr6195 | 11037 | hfcr6297 | 11097 | hfcr6375 |
| 10858 | hfcr6003 | 10918 | hfcr6089 | 10978 | hfcr6196 | 11038 | hfcr6298 | 11098 | hfcr6376 |
| 10859 | hfcr6004 | 10919 | hfcr6090 | 10979 | hfcr6198 | 11039 | hfcr6300 | 11099 | hfcr6380 |
| 10860 | hfcr6005 | 10920 | hfcr6091 | 10980 | hfcr6199 | 11040 | hfcr6301 | 11100 | hfcr6381 |

Figure 6B – List of EST Sequence Names From Fetal Cartilage cDNA Library

| | | | | | | | | | |
|---|---|---|---|---|---|---|---|---|---|
| 11101 | hfcr6382 | 11161 | hfcr6475 | 11221 | hfcr6561 | 11281 | hfcr6639 | 11341 | hfcr6704 |
| 11102 | hfcr6383 | 11162 | hfcr6476 | 11222 | hfcr6562 | 11282 | hfcr6640 | 11342 | hfcr6705 |
| 11103 | hfcr6384 | 11163 | hfcr6479 | 11223 | hfcr6563 | 11283 | hfcr6641 | 11343 | hfcr6706 |
| 11104 | hfcr6388 | 11164 | hfcr6480 | 11224 | hfcr6566 | 11284 | hfcr6642 | 11344 | hfcr6707 |
| 11105 | hfcr6389 | 11165 | hfcr6482 | 11225 | hfcr6567 | 11285 | hfcr6643 | 11345 | hfcr6708 |
| 11106 | hfcr6391 | 11166 | hfcr6484 | 11226 | hfcr6568 | 11286 | hfcr6645 | 11346 | hfcr6710 |
| 11107 | hfcr6392 | 11167 | hfcr6485 | 11227 | hfcr6569 | 11287 | hfcr6646 | 11347 | hfcr6712 |
| 11108 | hfcr6393 | 11168 | hfcr6486 | 11228 | hfcr6570 | 11288 | hfcr6647 | 11348 | hfcr6713 |
| 11109 | hfcr6394 | 11169 | hfcr6487 | 11229 | hfcr6571 | 11289 | hfcr6648 | 11349 | hfcr6715 |
| 11110 | hfcr6395 | 11170 | hfcr6488 | 11230 | hfcr6572 | 11290 | hfcr6649 | 11350 | hfcr6716 |
| 11111 | hfcr6396 | 11171 | hfcr6489 | 11231 | hfcr6573 | 11291 | hfcr6650 | 11351 | hfcr6719 |
| 11112 | hfcr6397 | 11172 | hfcr6490 | 11232 | hfcr6574 | 11292 | hfcr6651 | 11352 | hfcr6720 |
| 11113 | hfcr6400 | 11173 | hfcr6491 | 11233 | hfcr6576 | 11293 | hfcr6652 | 11353 | hfcr6721 |
| 11114 | hfcr6401 | 11174 | hfcr6494 | 11234 | hfcr6577 | 11294 | hfcr6653 | 11354 | hfcr6722 |
| 11115 | hfcr6403 | 11175 | hfcr6495 | 11235 | hfcr6578 | 11295 | hfcr6655 | 11355 | hfcr6723 |
| 11116 | hfcr6404 | 11176 | hfcr6496 | 11236 | hfcr6579 | 11296 | hfcr6656 | 11356 | hfcr6724 |
| 11117 | hfcr6405 | 11177 | hfcr6498 | 11237 | hfcr6580 | 11297 | hfcr6657 | 11357 | hfcr6725 |
| 11118 | hfcr6406 | 11178 | hfcr6500 | 11238 | hfcr6581 | 11298 | hfcr6658 | 11358 | hfcr6726 |
| 11119 | hfcr6407 | 11179 | hfcr6501 | 11239 | hfcr6582 | 11299 | hfcr6659 | 11359 | hfcr6727 |
| 11120 | hfcr6408 | 11180 | hfcr6502 | 11240 | hfcr6585 | 11300 | hfcr6660 | 11360 | hfcr6728 |
| 11121 | hfcr6410 | 11181 | hfcr6503 | 11241 | hfcr6586 | 11301 | hfcr6662 | 11361 | hfcr6729 |
| 11122 | hfcr6411 | 11182 | hfcr6504 | 11242 | hfcr6587 | 11302 | hfcr6663 | 11362 | hfcr6730 |
| 11123 | hfcr6412 | 11183 | hfcr6507 | 11243 | hfcr6588 | 11303 | hfcr6664 | 11363 | hfcr6732 |
| 11124 | hfcr6413 | 11184 | hfcr6508 | 11244 | hfcr6590 | 11304 | hfcr6665 | 11364 | hfcr6733 |
| 11125 | hfcr6414 | 11185 | hfcr6509 | 11245 | hfcr6591 | 11305 | hfcr6666 | 11365 | hfcr6734 |
| 11126 | hfcr6423 | 11186 | hfcr6510 | 11246 | hfcr6592 | 11306 | hfcr6667 | 11366 | hfcr6736 |
| 11127 | hfcr6433 | 11187 | hfcr6511 | 11247 | hfcr6593 | 11307 | hfcr6668 | 11367 | hfcr6737 |
| 11128 | hfcr6434 | 11188 | hfcr6514 | 11248 | hfcr6594 | 11308 | hfcr6670 | 11368 | hfcr6740 |
| 11129 | hfcr6436 | 11189 | hfcr6515 | 11249 | hfcr6595 | 11309 | hfcr6671 | 11369 | hfcr6741 |
| 11130 | hfcr6437 | 11190 | hfcr6516 | 11250 | hfcr6597 | 11310 | hfcr6673 | 11370 | hfcr6745 |
| 11131 | hfcr6438 | 11191 | hfcr6517 | 11251 | hfcr6598 | 11311 | hfcr6674 | 11371 | hfcr6746 |
| 11132 | hfcr6439 | 11192 | hfcr6518 | 11252 | hfcr6600 | 11312 | hfcr6675 | 11372 | hfcr6747 |
| 11133 | hfcr6440 | 11193 | hfcr6519 | 11253 | hfcr6602 | 11313 | hfcr6676 | 11373 | hfcr6748 |
| 11134 | hfcr6442 | 11194 | hfcr6520 | 11254 | hfcr6603 | 11314 | hfcr6677 | 11374 | hfcr6749 |
| 11135 | hfcr6443 | 11195 | hfcr6522 | 11255 | hfcr6604 | 11315 | hfcr6678 | 11375 | hfcr6752 |
| 11136 | hfcr6444 | 11196 | hfcr6524 | 11256 | hfcr6606 | 11316 | hfcr6679 | 11376 | hfcr6753 |
| 11137 | hfcr6445 | 11197 | hfcr6526 | 11257 | hfcr6608 | 11317 | hfcr6680 | 11377 | hfcr6756 |
| 11138 | hfcr6446 | 11198 | hfcr6530 | 11258 | hfcr6609 | 11318 | hfcr6681 | 11378 | hfcr6757 |
| 11139 | hfcr6447 | 11199 | hfcr6531 | 11259 | hfcr6610 | 11319 | hfcr6682 | 11379 | hfcr6759 |
| 11140 | hfcr6448 | 11200 | hfcr6532 | 11260 | hfcr6611 | 11320 | hfcr6683 | 11380 | hfcr6760 |
| 11141 | hfcr6451 | 11201 | hfcr6533 | 11261 | hfcr6613 | 11321 | hfcr6684 | 11381 | hfcr6761 |
| 11142 | hfcr6452 | 11202 | hfcr6534 | 11262 | hfcr6614 | 11322 | hfcr6685 | 11382 | hfcr6762 |
| 11143 | hfcr6454 | 11203 | hfcr6536 | 11263 | hfcr6616 | 11323 | hfcr6686 | 11383 | hfcr6763 |
| 11144 | hfcr6456 | 11204 | hfcr6537 | 11264 | hfcr6619 | 11324 | hfcr6687 | 11384 | hfcr6765 |
| 11145 | hfcr6457 | 11205 | hfcr6539 | 11265 | hfcr6620 | 11325 | hfcr6688 | 11385 | hfcr6766 |
| 11146 | hfcr6458 | 11206 | hfcr6540 | 11266 | hfcr6621 | 11326 | hfcr6689 | 11386 | hfcr6767 |
| 11147 | hfcr6459 | 11207 | hfcr6541 | 11267 | hfcr6622 | 11327 | hfcr6690 | 11387 | hfcr6768 |
| 11148 | hfcr6460 | 11208 | hfcr6542 | 11268 | hfcr6623 | 11328 | hfcr6691 | 11388 | hfcr6769 |
| 11149 | hfcr6461 | 11209 | hfcr6543 | 11269 | hfcr6624 | 11329 | hfcr6692 | 11389 | hfcr6770 |
| 11150 | hfcr6463 | 11210 | hfcr6546 | 11270 | hfcr6626 | 11330 | hfcr6693 | 11390 | hfcr6771 |
| 11151 | hfcr6464 | 11211 | hfcr6548 | 11271 | hfcr6627 | 11331 | hfcr6694 | 11391 | hfcr6772 |
| 11152 | hfcr6465 | 11212 | hfcr6550 | 11272 | hfcr6628 | 11332 | hfcr6695 | 11392 | hfcr6773 |
| 11153 | hfcr6466 | 11213 | hfcr6552 | 11273 | hfcr6630 | 11333 | hfcr6696 | 11393 | hfcr6774 |
| 11154 | hfcr6467 | 11214 | hfcr6553 | 11274 | hfcr6631 | 11334 | hfcr6697 | 11394 | hfcr6775 |
| 11155 | hfcr6468 | 11215 | hfcr6554 | 11275 | hfcr6632 | 11335 | hfcr6698 | 11395 | hfcr6778 |
| 11156 | hfcr6470 | 11216 | hfcr6555 | 11276 | hfcr6634 | 11336 | hfcr6699 | 11396 | hfcr6779 |
| 11157 | hfcr6471 | 11217 | hfcr6557 | 11277 | hfcr6635 | 11337 | hfcr6700 | 11397 | hfcr6780 |
| 11158 | hfcr6472 | 11218 | hfcr6558 | 11278 | hfcr6636 | 11338 | hfcr6701 | 11398 | hfcr6781 |
| 11159 | hfcr6473 | 11219 | hfcr6559 | 11279 | hfcr6637 | 11339 | hfcr6702 | 11399 | hfcr6782 |
| 11160 | hfcr6474 | 11220 | hfcr6560 | 11280 | hfcr6638 | 11340 | hfcr6703 | 11400 | hfcr6783 |

Figure 6B – List of EST Sequence Names From Fetal Cartilage cDNA Library

| | | | | | | | | | |
|---|---|---|---|---|---|---|---|---|---|
| 11401 | hfcr6784 | 11461 | hfcr6863 | 11521 | hfcr6932 | 11581 | hfcr7026 | 11641 | hfcr7105 |
| 11402 | hfcr6785 | 11462 | hfcr6864 | 11522 | hfcr6934 | 11582 | hfcr7027 | 11642 | hfcr7111 |
| 11403 | hfcr6786 | 11463 | hfcr6865 | 11523 | hfcr6935 | 11583 | hfcr7031 | 11643 | hfcr7113 |
| 11404 | hfcr6787 | 11464 | hfcr6866 | 11524 | hfcr6936 | 11584 | hfcr7032 | 11644 | hfcr7115 |
| 11405 | hfcr6788 | 11465 | hfcr6867 | 11525 | hfcr6937 | 11585 | hfcr7033 | 11645 | hfcr7120 |
| 11406 | hfcr6789 | 11466 | hfcr6869 | 11526 | hfcr6938 | 11586 | hfcr7034 | 11646 | hfcr7123 |
| 11407 | hfcr6790 | 11467 | hfcr6870 | 11527 | hfcr6941 | 11587 | hfcr7035 | 11647 | hfcr7132 |
| 11408 | hfcr6791 | 11468 | hfcr6871 | 11528 | hfcr6942 | 11588 | hfcr7036 | 11648 | hfcr7133 |
| 11409 | hfcr6792 | 11469 | hfcr6872 | 11529 | hfcr6943 | 11589 | hfcr7038 | 11649 | hfcr7136 |
| 11410 | hfcr6793 | 11470 | hfcr6873 | 11530 | hfcr6945 | 11590 | hfcr7039 | 11650 | hfcr7137 |
| 11411 | hfcr6795 | 11471 | hfcr6874 | 11531 | hfcr6947 | 11591 | hfcr7040 | 11651 | hfcr7139 |
| 11412 | hfcr6796 | 11472 | hfcr6876 | 11532 | hfcr6950 | 11592 | hfcr7041 | 11652 | hfcr7140 |
| 11413 | hfcr6797 | 11473 | hfcr6877 | 11533 | hfcr6951 | 11593 | hfcr7042 | 11653 | hfcr7142 |
| 11414 | hfcr6798 | 11474 | hfcr6878 | 11534 | hfcr6952 | 11594 | hfcr7043 | 11654 | hfcr7144 |
| 11415 | hfcr6802 | 11475 | hfcr6879 | 11535 | hfcr6954 | 11595 | hfcr7045 | 11655 | hfcr7146 |
| 11416 | hfcr6803 | 11476 | hfcr6880 | 11536 | hfcr6955 | 11596 | hfcr7046 | 11656 | hfcr7151 |
| 11417 | hfcr6804 | 11477 | hfcr6881 | 11537 | hfcr6956 | 11597 | hfcr7047 | 11657 | hfcr7152 |
| 11418 | hfcr6805 | 11478 | hfcr6882 | 11538 | hfcr6958 | 11598 | hfcr7048 | 11658 | hfcr7156 |
| 11419 | hfcr6806 | 11479 | hfcr6883 | 11539 | hfcr6960 | 11599 | hfcr7050 | 11659 | hfcr7158 |
| 11420 | hfcr6807 | 11480 | hfcr6884 | 11540 | hfcr6961 | 11600 | hfcr7051 | 11660 | hfcr7160 |
| 11421 | hfcr6808 | 11481 | hfcr6886 | 11541 | hfcr6965 | 11601 | hfcr7052 | 11661 | hfcr7162 |
| 11422 | hfcr6810 | 11482 | hfcr6887 | 11542 | hfcr6966 | 11602 | hfcr7054 | 11662 | hfcr7168 |
| 11423 | hfcr6812 | 11483 | hfcr6888 | 11543 | hfcr6968 | 11603 | hfcr7056 | 11663 | hfcr7173 |
| 11424 | hfcr6813 | 11484 | hfcr6889 | 11544 | hfcr6969 | 11604 | hfcr7057 | 11664 | hfcr7176 |
| 11425 | hfcr6814 | 11485 | hfcr6891 | 11545 | hfcr6970 | 11605 | hfcr7058 | 11665 | hfcr7177 |
| 11426 | hfcr6815 | 11486 | hfcr6892 | 11546 | hfcr6971 | 11606 | hfcr7059 | 11666 | hfcr7183 |
| 11427 | hfcr6817 | 11487 | hfcr6893 | 11547 | hfcr6972 | 11607 | hfcr7060 | 11667 | hfcr7189 |
| 11428 | hfcr6818 | 11488 | hfcr6894 | 11548 | hfcr6975 | 11608 | hfcr7061 | 11668 | hfcr7190 |
| 11429 | hfcr6819 | 11489 | hfcr6895 | 11549 | hfcr6976 | 11609 | hfcr7062 | 11669 | hfcr7194 |
| 11430 | hfcr6820 | 11490 | hfcr6896 | 11550 | hfcr6981 | 11610 | hfcr7063 | 11670 | hfcr7199 |
| 11431 | hfcr6821 | 11491 | hfcr6897 | 11551 | hfcr6982 | 11611 | hfcr7065 | 11671 | hfcr7208 |
| 11432 | hfcr6823 | 11492 | hfcr6898 | 11552 | hfcr6985 | 11612 | hfcr7066 | 11672 | hfcr7215 |
| 11433 | hfcr6824 | 11493 | hfcr6900 | 11553 | hfcr6986 | 11613 | hfcr7068 | 11673 | hfcr7218 |
| 11434 | hfcr6825 | 11494 | hfcr6901 | 11554 | hfcr6988 | 11614 | hfcr7069 | 11674 | hfcr7221 |
| 11435 | hfcr6828 | 11495 | hfcr6902 | 11555 | hfcr6992 | 11615 | hfcr7070 | 11675 | hfcr7223 |
| 11436 | hfcr6829 | 11496 | hfcr6903 | 11556 | hfcr6993 | 11616 | hfcr7073 | 11676 | hfcr7224 |
| 11437 | hfcr6830 | 11497 | hfcr6904 | 11557 | hfcr6994 | 11617 | hfcr7074 | 11677 | hfcr7226 |
| 11438 | hfcr6831 | 11498 | hfcr6905 | 11558 | hfcr6996 | 11618 | hfcr7075 | 11678 | hfcr7227 |
| 11439 | hfcr6833 | 11499 | hfcr6906 | 11559 | hfcr6997 | 11619 | hfcr7076 | 11679 | hfcr7231 |
| 11440 | hfcr6835 | 11500 | hfcr6907 | 11560 | hfcr6998 | 11620 | hfcr7077 | 11680 | hfcr7232 |
| 11441 | hfcr6837 | 11501 | hfcr6911 | 11561 | hfcr6999 | 11621 | hfcr7078 | 11681 | hfcr7233 |
| 11442 | hfcr6840 | 11502 | hfcr6912 | 11562 | hfcr7001 | 11622 | hfcr7079 | 11682 | hfcr7234 |
| 11443 | hfcr6841 | 11503 | hfcr6913 | 11563 | hfcr7003 | 11623 | hfcr7081 | 11683 | hfcr7239 |
| 11444 | hfcr6842 | 11504 | hfcr6914 | 11564 | hfcr7004 | 11624 | hfcr7082 | 11684 | hfcr7244 |
| 11445 | hfcr6843 | 11505 | hfcr6915 | 11565 | hfcr7007 | 11625 | hfcr7084 | 11685 | hfcr7245 |
| 11446 | hfcr6844 | 11506 | hfcr6916 | 11566 | hfcr7008 | 11626 | hfcr7087 | 11686 | hfcr7250 |
| 11447 | hfcr6846 | 11507 | hfcr6917 | 11567 | hfcr7009 | 11627 | hfcr7088 | 11687 | hfcr7264 |
| 11448 | hfcr6847 | 11508 | hfcr6918 | 11568 | hfcr7010 | 11628 | hfcr7090 | 11688 | hfcr7266 |
| 11449 | hfcr6848 | 11509 | hfcr6919 | 11569 | hfcr7011 | 11629 | hfcr7091 | 11689 | hfcr7270 |
| 11450 | hfcr6849 | 11510 | hfcr6920 | 11570 | hfcr7012 | 11630 | hfcr7092 | 11690 | hfcr7271 |
| 11451 | hfcr6850 | 11511 | hfcr6921 | 11571 | hfcr7013 | 11631 | hfcr7093 | 11691 | hfcr7272 |
| 11452 | hfcr6851 | 11512 | hfcr6922 | 11572 | hfcr7014 | 11632 | hfcr7095 | 11692 | hfcr7274 |
| 11453 | hfcr6853 | 11513 | hfcr6923 | 11573 | hfcr7015 | 11633 | hfcr7096 | 11693 | hfcr7277 |
| 11454 | hfcr6855 | 11514 | hfcr6924 | 11574 | hfcr7016 | 11634 | hfcr7097 | 11694 | hfcr7278 |
| 11455 | hfcr6856 | 11515 | hfcr6925 | 11575 | hfcr7017 | 11635 | hfcr7098 | 11695 | hfcr7279 |
| 11456 | hfcr6857 | 11516 | hfcr6926 | 11576 | hfcr7018 | 11636 | hfcr7099 | 11696 | hfcr7280 |
| 11457 | hfcr6858 | 11517 | hfcr6927 | 11577 | hfcr7019 | 11637 | hfcr7100 | 11697 | hfcr7281 |
| 11458 | hfcr6860 | 11518 | hfcr6929 | 11578 | hfcr7020 | 11638 | hfcr7101 | 11698 | hfcr7283 |
| 11459 | hfcr6861 | 11519 | hfcr6930 | 11579 | hfcr7022 | 11639 | hfcr7102 | 11699 | hfcr7287 |
| 11460 | hfcr6862 | 11520 | hfcr6931 | 11580 | hfcr7025 | 11640 | hfcr7103 | 11700 | hfcr7288 |

Figure 6B – List of EST Sequence Names From Fetal Cartilage cDNA Library

| | |
|---|---|
| 11701 | hfcr7290 |
| 11702 | hfcr7294 |
| 11703 | hfcr7295 |
| 11704 | hfcr7300 |
| 11705 | hfcr7304 |
| 11706 | hfcr7306 |
| 11707 | hfcr7307 |
| 11708 | hfcr7308 |
| 11709 | hfcr7312 |
| 11710 | hfcr7317 |
| 11711 | hfcr7318 |
| 11712 | hfcr7319 |
| 11713 | hfcr7320 |
| 11714 | hfcr7321 |
| 11715 | hfcr7323 |
| 11716 | hfcr7324 |
| 11717 | hfcr7325 |
| 11718 | hfcr7336 |
| 11719 | hfcr7340 |
| 11720 | hfcr7341 |
| 11721 | hfcr7342 |
| 11722 | hfcr7345 |
| 11723 | hfcr7346 |
| 11724 | hfcr7348 |
| 11725 | hfcr7350 |
| 11726 | hfcr7351 |
| 11727 | hfcr7352 |
| 11728 | hfcr7353 |
| 11729 | hfcr7355 |
| 11730 | hfcr7356 |
| 11731 | hfcr7357 |
| 11732 | hfcr7359 |
| 11733 | hfcr7360 |
| 11734 | hfcr7361 |
| 11735 | hfcr7362 |
| 11736 | hfcr7363 |
| 11737 | hfcr7364 |
| 11738 | hfcr7365 |
| 11739 | hfcr7366 |
| 11740 | hfcr7369 |
| 11741 | hfcr7370 |
| 11742 | hfcr7372 |
| 11743 | hfcr7373 |
| 11744 | hfcr7374 |
| 11745 | hfcr7375 |
| 11746 | hfcr7376 |
| 11747 | hfcr7378 |
| 11748 | hfcr7380 |
| 11749 | hfcr7381 |
| 11750 | hfcr7382 |
| 11751 | hfcr7387 |
| 11752 | hfcr7388 |
| 11753 | hfcr7390 |
| 11754 | hfcr7392 |
| 11755 | hfcr7393 |
| 11756 | hfcr7394 |
| 11757 | hfcr7395 |
| 11758 | hfcr7396 |
| 11759 | hfcr7397 |
| 11760 | hfcr7398 |
| 11761 | hfcr7399 |
| 11762 | hfcr7400 |
| 11763 | hfcr7401 |
| 11764 | hfcr7402 |
| 11765 | hfcr7404 |
| 11766 | hfcr7406 |
| 11767 | hfcr7407 |
| 11768 | hfcr7408 |
| 11769 | hfcr7409 |
| 11770 | hfcr7410 |
| 11771 | hfcr7411 |
| 11772 | hfcr7412 |
| 11773 | hfcr7414 |
| 11774 | hfcr7415 |
| 11775 | hfcr7416 |
| 11776 | hfcr7417 |
| 11777 | hfcr7418 |
| 11778 | hfcr7419 |
| 11779 | hfcr7421 |
| 11780 | hfcr7422 |
| 11781 | hfcr7423 |
| 11782 | hfcr7424 |
| 11783 | hfcr7425 |
| 11784 | hfcr7426 |
| 11785 | hfcr7427 |
| 11786 | hfcr7428 |
| 11787 | hfcr7430 |
| 11788 | hfcr7432 |
| 11789 | hfcr7434 |
| 11790 | hfcr7436 |
| 11791 | hfcr7437 |
| 11792 | hfcr7438 |
| 11793 | hfcr7439 |
| 11794 | hfcr7440 |
| 11795 | hfcr7444 |
| 11796 | hfcr7445 |
| 11797 | hfcr7446 |
| 11798 | hfcr7448 |
| 11799 | hfcr7449 |
| 11800 | hfcr7450 |
| 11801 | hfcr7452 |
| 11802 | hfcr7453 |
| 11803 | hfcr7454 |
| 11804 | hfcr7455 |
| 11805 | hfcr7459 |
| 11806 | hfcr7461 |
| 11807 | hfcr7462 |
| 11808 | hfcr7464 |
| 11809 | hfcr7465 |
| 11810 | hfcr7467 |
| 11811 | hfcr7469 |
| 11812 | hfcr7472 |
| 11813 | hfcr7473 |
| 11814 | hfcr7474 |
| 11815 | hfcr7477 |
| 11816 | hfcr7480 |
| 11817 | hfcr7481 |
| 11818 | hfcr7482 |
| 11819 | hfcr7484 |
| 11820 | hfcr7485 |
| 11821 | hfcr7487 |
| 11822 | hfcr7489 |
| 11823 | hfcr7490 |
| 11824 | hfcr7491 |
| 11825 | hfcr7492 |
| 11826 | hfcr7493 |
| 11827 | hfcr7494 |
| 11828 | hfcr7495 |
| 11829 | hfcr7496 |
| 11830 | hfcr7498 |
| 11831 | hfcr7499 |
| 11832 | hfcr7500 |
| 11833 | hfcr7501 |
| 11834 | hfcr7503 |
| 11835 | hfcr7504 |
| 11836 | hfcr7505 |
| 11837 | hfcr7506 |
| 11838 | hfcr7507 |
| 11839 | hfcr7508 |
| 11840 | hfcr7509 |
| 11841 | hfcr7510 |
| 11842 | hfcr7511 |
| 11843 | hfcr7512 |
| 11844 | hfcr7513 |
| 11845 | hfcr7514 |
| 11846 | hfcr7515 |
| 11847 | hfcr7518 |
| 11848 | hfcr7519 |
| 11849 | hfcr7520 |
| 11850 | hfcr7521 |
| 11851 | hfcr7522 |
| 11852 | hfcr7525 |
| 11853 | hfcr7527 |
| 11854 | hfcr7529 |
| 11855 | hfcr7530 |
| 11856 | hfcr7531 |
| 11857 | hfcr7532 |
| 11858 | hfcr7533 |
| 11859 | hfcr7534 |
| 11860 | hfcr7537 |
| 11861 | hfcr7538 |
| 11862 | hfcr7539 |
| 11863 | hfcr7541 |
| 11864 | hfcr7542 |
| 11865 | hfcr7543 |
| 11866 | hfcr7544 |
| 11867 | hfcr7545 |
| 11868 | hfcr7546 |
| 11869 | hfcr7547 |
| 11870 | hfcr7548 |
| 11871 | hfcr7549 |
| 11872 | hfcr7550 |
| 11873 | hfcr7551 |
| 11874 | hfcr7553 |
| 11875 | hfcr7554 |
| 11876 | hfcr7555 |
| 11877 | hfcr7557 |
| 11878 | hfcr7558 |
| 11879 | hfcr7559 |
| 11880 | hfcr7560 |
| 11881 | hfcr7561 |
| 11882 | hfcr7562 |
| 11883 | hfcr7563 |
| 11884 | hfcr7564 |
| 11885 | hfcr7565 |
| 11886 | hfcr7569 |
| 11887 | hfcr7570 |
| 11888 | hfcr7571 |
| 11889 | hfcr7574 |
| 11890 | hfcr7575 |
| 11891 | hfcr7576 |
| 11892 | hfcr7577 |
| 11893 | hfcr7578 |
| 11894 | hfcr7580 |
| 11895 | hfcr7581 |
| 11896 | hfcr7582 |
| 11897 | hfcr7583 |
| 11898 | hfcr7584 |
| 11899 | hfcr7585 |
| 11900 | hfcr7586 |
| 11901 | hfcr7587 |
| 11902 | hfcr7588 |
| 11903 | hfcr7590 |
| 11904 | hfcr7591 |
| 11905 | hfcr7592 |
| 11906 | hfcr7594 |
| 11907 | hfcr7595 |
| 11908 | hfcr7596 |
| 11909 | hfcr7597 |
| 11910 | hfcr7601 |
| 11911 | hfcr7602 |
| 11912 | hfcr7603 |
| 11913 | hfcr7605 |
| 11914 | hfcr7606 |
| 11915 | hfcr7607 |
| 11916 | hfcr7608 |
| 11917 | hfcr7609 |
| 11918 | hfcr7610 |
| 11919 | hfcr7611 |
| 11920 | hfcr7612 |
| 11921 | hfcr7614 |
| 11922 | hfcr7616 |
| 11923 | hfcr7617 |
| 11924 | hfcr7618 |
| 11925 | hfcr7619 |
| 11926 | hfcr7620 |
| 11927 | hfcr7621 |
| 11928 | hfcr7622 |
| 11929 | hfcr7623 |
| 11930 | hfcr7624 |
| 11931 | hfcr7625 |
| 11932 | hfcr7626 |
| 11933 | hfcr7627 |
| 11934 | hfcr7628 |
| 11935 | hfcr7629 |
| 11936 | hfcr7631 |
| 11937 | hfcr7632 |
| 11938 | hfcr7635 |
| 11939 | hfcr7636 |
| 11940 | hfcr7637 |
| 11941 | hfcr7639 |
| 11942 | hfcr7641 |
| 11943 | hfcr7642 |
| 11944 | hfcr7643 |
| 11945 | hfcr7644 |
| 11946 | hfcr7645 |
| 11947 | hfcr7647 |
| 11948 | hfcr7648 |
| 11949 | hfcr7649 |
| 11950 | hfcr7650 |
| 11951 | hfcr7651 |
| 11952 | hfcr7652 |
| 11953 | hfcr7654 |
| 11954 | hfcr7655 |
| 11955 | hfcr7656 |
| 11956 | hfcr7657 |
| 11957 | hfcr7658 |
| 11958 | hfcr7659 |
| 11959 | hfcr7660 |
| 11960 | hfcr7663 |
| 11961 | hfcr7665 |
| 11962 | hfcr7666 |
| 11963 | hfcr7667 |
| 11964 | hfcr7668 |
| 11965 | hfcr7669 |
| 11966 | hfcr7670 |
| 11967 | hfcr7671 |
| 11968 | hfcr7672 |
| 11969 | hfcr7673 |
| 11970 | hfcr7674 |
| 11971 | hfcr7675 |
| 11972 | hfcr7676 |
| 11973 | hfcr7677 |
| 11974 | hfcr7679 |
| 11975 | hfcr7680 |
| 11976 | hfcr7683 |
| 11977 | hfcr7686 |
| 11978 | hfcr7687 |
| 11979 | hfcr7688 |
| 11980 | hfcr7690 |
| 11981 | hfcr7691 |
| 11982 | hfcr7692 |
| 11983 | hfcr7693 |
| 11984 | hfcr7695 |
| 11985 | hfcr7698 |
| 11986 | hfcr7699 |
| 11987 | hfcr7701 |
| 11988 | hfcr7702 |
| 11989 | hfcr7704 |
| 11990 | hfcr7706 |
| 11991 | hfcr7707 |
| 11992 | hfcr7708 |
| 11993 | hfcr7709 |
| 11994 | hfcr7710 |
| 11995 | hfcr7711 |
| 11996 | hfcr7712 |
| 11997 | hfcr7713 |
| 11998 | hfcr7715 |
| 11999 | hfcr7716 |
| 12000 | hfcr7717 |

Figure 6B – List of EST Sequence Names From Fetal Cartilage cDNA Library

| | | | | | | | | | |
|---|---|---|---|---|---|---|---|---|---|
| 12001 | hfcr7721 | 12061 | hfcr7821 | 12121 | hfcr7946 | 12181 | hfcr8033 | 12241 | hfcr8358 |
| 12002 | hfcr7722 | 12062 | hfcr7823 | 12122 | hfcr7948 | 12182 | hfcr8035 | 12242 | hfcr8359 |
| 12003 | hfcr7725 | 12063 | hfcr7824 | 12123 | hfcr7949 | 12183 | hfcr8036 | 12243 | hfcr8360 |
| 12004 | hfcr7726 | 12064 | hfcr7825 | 12124 | hfcr7950 | 12184 | hfcr8038 | 12244 | hfcr8361 |
| 12005 | hfcr7731 | 12065 | hfcr7827 | 12125 | hfcr7953 | 12185 | hfcr8039 | 12245 | hfcr8362 |
| 12006 | hfcr7733 | 12066 | hfcr7828 | 12126 | hfcr7954 | 12186 | hfcr8040 | 12246 | hfcr8364 |
| 12007 | hfcr7735 | 12067 | hfcr7829 | 12127 | hfcr7955 | 12187 | hfcr8044 | 12247 | hfcr8365 |
| 12008 | hfcr7737 | 12068 | hfcr7830 | 12128 | hfcr7956 | 12188 | hfcr8045 | 12248 | hfcr8368 |
| 12009 | hfcr7738 | 12069 | hfcr7831 | 12129 | hfcr7957 | 12189 | hfcr8046 | 12249 | hfcr8369 |
| 12010 | hfcr7739 | 12070 | hfcr7833 | 12130 | hfcr7958 | 12190 | hfcr8048 | 12250 | hfcr8370 |
| 12011 | hfcr7746 | 12071 | hfcr7834 | 12131 | hfcr7959 | 12191 | hfcr8051 | 12251 | hfcr8371 |
| 12012 | hfcr7747 | 12072 | hfcr7835 | 12132 | hfcr7961 | 12192 | hfcr8052 | 12252 | hfcr8372 |
| 12013 | hfcr7749 | 12073 | hfcr7836 | 12133 | hfcr7962 | 12193 | hfcr8053 | 12253 | hfcr8373 |
| 12014 | hfcr7753 | 12074 | hfcr7838 | 12134 | hfcr7963 | 12194 | hfcr8054 | 12254 | hfcr8374 |
| 12015 | hfcr7755 | 12075 | hfcr7839 | 12135 | hfcr7964 | 12195 | hfcr8057 | 12255 | hfcr8377 |
| 12016 | hfcr7756 | 12076 | hfcr7840 | 12136 | hfcr7965 | 12196 | hfcr8058 | 12256 | hfcr8378 |
| 12017 | hfcr7761 | 12077 | hfcr7841 | 12137 | hfcr7966 | 12197 | hfcr8064 | 12257 | hfcr8379 |
| 12018 | hfcr7762 | 12078 | hfcr7842 | 12138 | hfcr7967 | 12198 | hfcr8161 | 12258 | hfcr8381 |
| 12019 | hfcr7763 | 12079 | hfcr7843 | 12139 | hfcr7968 | 12199 | hfcr8163 | 12259 | hfcr8382 |
| 12020 | hfcr7766 | 12080 | hfcr7844 | 12140 | hfcr7969 | 12200 | hfcr8166 | 12260 | hfcr8383 |
| 12021 | hfcr7769 | 12081 | hfcr7845 | 12141 | hfcr7971 | 12201 | hfcr8174 | 12261 | hfcr8384 |
| 12022 | hfcr7770 | 12082 | hfcr7846 | 12142 | hfcr7974 | 12202 | hfcr8180 | 12262 | hfcr8385 |
| 12023 | hfcr7771 | 12083 | hfcr7847 | 12143 | hfcr7977 | 12203 | hfcr8184 | 12263 | hfcr8386 |
| 12024 | hfcr7772 | 12084 | hfcr7848 | 12144 | hfcr7979 | 12204 | hfcr8189 | 12264 | hfcr8387 |
| 12025 | hfcr7773 | 12085 | hfcr7849 | 12145 | hfcr7980 | 12205 | hfcr8190 | 12265 | hfcr8389 |
| 12026 | hfcr7775 | 12086 | hfcr7850 | 12146 | hfcr7981 | 12206 | hfcr8199 | 12266 | hfcr8390 |
| 12027 | hfcr7778 | 12087 | hfcr7851 | 12147 | hfcr7982 | 12207 | hfcr8202 | 12267 | hfcr8391 |
| 12028 | hfcr7779 | 12088 | hfcr7852 | 12148 | hfcr7983 | 12208 | hfcr8206 | 12268 | hfcr8393 |
| 12029 | hfcr7780 | 12089 | hfcr7853 | 12149 | hfcr7984 | 12209 | hfcr8210 | 12269 | hfcr8394 |
| 12030 | hfcr7782 | 12090 | hfcr7854 | 12150 | hfcr7985 | 12210 | hfcr8212 | 12270 | hfcr8395 |
| 12031 | hfcr7783 | 12091 | hfcr7855 | 12151 | hfcr7986 | 12211 | hfcr8219 | 12271 | hfcr8397 |
| 12032 | hfcr7784 | 12092 | hfcr7856 | 12152 | hfcr7987 | 12212 | hfcr8222 | 12272 | hfcr8398 |
| 12033 | hfcr7785 | 12093 | hfcr7857 | 12153 | hfcr7988 | 12213 | hfcr8226 | 12273 | hfcr8399 |
| 12034 | hfcr7786 | 12094 | hfcr7858 | 12154 | hfcr7989 | 12214 | hfcr8227 | 12274 | hfcr8401 |
| 12035 | hfcr7787 | 12095 | hfcr7860 | 12155 | hfcr7990 | 12215 | hfcr8228 | 12275 | hfcr8402 |
| 12036 | hfcr7788 | 12096 | hfcr7863 | 12156 | hfcr7993 | 12216 | hfcr8231 | 12276 | hfcr8403 |
| 12037 | hfcr7789 | 12097 | hfcr7864 | 12157 | hfcr7997 | 12217 | hfcr8234 | 12277 | hfcr8404 |
| 12038 | hfcr7790 | 12098 | hfcr7865 | 12158 | hfcr7998 | 12218 | hfcr8235 | 12278 | hfcr8405 |
| 12039 | hfcr7791 | 12099 | hfcr7866 | 12159 | hfcr7999 | 12219 | hfcr8237 | 12279 | hfcr8406 |
| 12040 | hfcr7792 | 12100 | hfcr7867 | 12160 | hfcr8001 | 12220 | hfcr8238 | 12280 | hfcr8407 |
| 12041 | hfcr7793 | 12101 | hfcr7868 | 12161 | hfcr8002 | 12221 | hfcr8249 | 12281 | hfcr8409 |
| 12042 | hfcr7794 | 12102 | hfcr7869 | 12162 | hfcr8003 | 12222 | hfcr8252 | 12282 | hfcr8410 |
| 12043 | hfcr7795 | 12103 | hfcr7870 | 12163 | hfcr8004 | 12223 | hfcr8254 | 12283 | hfcr8411 |
| 12044 | hfcr7796 | 12104 | hfcr7871 | 12164 | hfcr8005 | 12224 | hfcr8259 | 12284 | hfcr8412 |
| 12045 | hfcr7797 | 12105 | hfcr7872 | 12165 | hfcr8006 | 12225 | hfcr8261 | 12285 | hfcr8413 |
| 12046 | hfcr7799 | 12106 | hfcr7874 | 12166 | hfcr8007 | 12226 | hfcr8268 | 12286 | hfcr8414 |
| 12047 | hfcr7800 | 12107 | hfcr7882 | 12167 | hfcr8010 | 12227 | hfcr8273 | 12287 | hfcr8415 |
| 12048 | hfcr7802 | 12108 | hfcr7886 | 12168 | hfcr8011 | 12228 | hfcr8275 | 12288 | hfcr8416 |
| 12049 | hfcr7803 | 12109 | hfcr7893 | 12169 | hfcr8012 | 12229 | hfcr8277 | 12289 | hfcr8417 |
| 12050 | hfcr7804 | 12110 | hfcr7895 | 12170 | hfcr8015 | 12230 | hfcr8278 | 12290 | hfcr8418 |
| 12051 | hfcr7805 | 12111 | hfcr7932 | 12171 | hfcr8016 | 12231 | hfcr8279 | 12291 | hfcr8419 |
| 12052 | hfcr7806 | 12112 | hfcr7933 | 12172 | hfcr8018 | 12232 | hfcr8280 | 12292 | hfcr8420 |
| 12053 | hfcr7807 | 12113 | hfcr7936 | 12173 | hfcr8019 | 12233 | hfcr8281 | 12293 | hfcr8421 |
| 12054 | hfcr7808 | 12114 | hfcr7937 | 12174 | hfcr8024 | 12234 | hfcr8283 | 12294 | hfcr8422 |
| 12055 | hfcr7809 | 12115 | hfcr7938 | 12175 | hfcr8025 | 12235 | hfcr8284 | 12295 | hfcr8423 |
| 12056 | hfcr7812 | 12116 | hfcr7940 | 12176 | hfcr8026 | 12236 | hfcr8285 | 12296 | hfcr8424 |
| 12057 | hfcr7815 | 12117 | hfcr7941 | 12177 | hfcr8028 | 12237 | hfcr8286 | 12297 | hfcr8427 |
| 12058 | hfcr7817 | 12118 | hfcr7942 | 12178 | hfcr8029 | 12238 | hfcr8354 | 12298 | hfcr8428 |
| 12059 | hfcr7819 | 12119 | hfcr7943 | 12179 | hfcr8030 | 12239 | hfcr8355 | 12299 | hfcr8429 |
| 12060 | hfcr7820 | 12120 | hfcr7945 | 12180 | hfcr8032 | 12240 | hfcr8356 | 12300 | hfcr8430 |

Figure 6B – List of EST Sequence Names From Fetal Cartilage cDNA Library

| | | | | | | | | | |
|---|---|---|---|---|---|---|---|---|---|
| 12301 | hfcr8431 | 12361 | hfcr8512 | 12421 | hfcr8617 | 12481 | hfcr8739 | 12541 | hfcr8855 |
| 12302 | hfcr8432 | 12362 | hfcr8513 | 12422 | hfcr8619 | 12482 | hfcr8741 | 12542 | hfcr8856 |
| 12303 | hfcr8433 | 12363 | hfcr8515 | 12423 | hfcr8623 | 12483 | hfcr8742 | 12543 | hfcr8857 |
| 12304 | hfcr8434 | 12364 | hfcr8516 | 12424 | hfcr8624 | 12484 | hfcr8744 | 12544 | hfcr8858 |
| 12305 | hfcr8438 | 12365 | hfcr8518 | 12425 | hfcr8625 | 12485 | hfcr8745 | 12545 | hfcr8859 |
| 12306 | hfcr8439 | 12366 | hfcr8519 | 12426 | hfcr8627 | 12486 | hfcr8747 | 12546 | hfcr8860 |
| 12307 | hfcr8440 | 12367 | hfcr8520 | 12427 | hfcr8628 | 12487 | hfcr8749 | 12547 | hfcr8861 |
| 12308 | hfcr8441 | 12368 | hfcr8522 | 12428 | hfcr8629 | 12488 | hfcr8750 | 12548 | hfcr8862 |
| 12309 | hfcr8442 | 12369 | hfcr8523 | 12429 | hfcr8631 | 12489 | hfcr8751 | 12549 | hfcr8864 |
| 12310 | hfcr8444 | 12370 | hfcr8524 | 12430 | hfcr8632 | 12490 | hfcr8752 | 12550 | hfcr8867 |
| 12311 | hfcr8446 | 12371 | hfcr8525 | 12431 | hfcr8634 | 12491 | hfcr8754 | 12551 | hfcr8872 |
| 12312 | hfcr8448 | 12372 | hfcr8526 | 12432 | hfcr8636 | 12492 | hfcr8755 | 12552 | hfcr8874 |
| 12313 | hfcr8450 | 12373 | hfcr8528 | 12433 | hfcr8639 | 12493 | hfcr8757 | 12553 | hfcr8875 |
| 12314 | hfcr8451 | 12374 | hfcr8529 | 12434 | hfcr8640 | 12494 | hfcr8758 | 12554 | hfcr8876 |
| 12315 | hfcr8452 | 12375 | hfcr8530 | 12435 | hfcr8641 | 12495 | hfcr8759 | 12555 | hfcr8877 |
| 12316 | hfcr8454 | 12376 | hfcr8531 | 12436 | hfcr8642 | 12496 | hfcr8760 | 12556 | hfcr8878 |
| 12317 | hfcr8455 | 12377 | hfcr8532 | 12437 | hfcr8643 | 12497 | hfcr8761 | 12557 | hfcr8879 |
| 12318 | hfcr8456 | 12378 | hfcr8533 | 12438 | hfcr8646 | 12498 | hfcr8762 | 12558 | hfcr8880 |
| 12319 | hfcr8458 | 12379 | hfcr8534 | 12439 | hfcr8647 | 12499 | hfcr8765 | 12559 | hfcr8881 |
| 12320 | hfcr8459 | 12380 | hfcr8536 | 12440 | hfcr8648 | 12500 | hfcr8766 | 12560 | hfcr8882 |
| 12321 | hfcr8460 | 12381 | hfcr8537 | 12441 | hfcr8649 | 12501 | hfcr8767 | 12561 | hfcr8883 |
| 12322 | hfcr8463 | 12382 | hfcr8538 | 12442 | hfcr8655 | 12502 | hfcr8770 | 12562 | hfcr8885 |
| 12323 | hfcr8464 | 12383 | hfcr8540 | 12443 | hfcr8656 | 12503 | hfcr8772 | 12563 | hfcr8887 |
| 12324 | hfcr8465 | 12384 | hfcr8541 | 12444 | hfcr8657 | 12504 | hfcr8774 | 12564 | hfcr8891 |
| 12325 | hfcr8466 | 12385 | hfcr8542 | 12445 | hfcr8658 | 12505 | hfcr8778 | 12565 | hfcr8892 |
| 12326 | hfcr8467 | 12386 | hfcr8546 | 12446 | hfcr8659 | 12506 | hfcr8780 | 12566 | hfcr8894 |
| 12327 | hfcr8468 | 12387 | hfcr8551 | 12447 | hfcr8662 | 12507 | hfcr8781 | 12567 | hfcr8897 |
| 12328 | hfcr8469 | 12388 | hfcr8554 | 12448 | hfcr8663 | 12508 | hfcr8782 | 12568 | hfcr8898 |
| 12329 | hfcr8472 | 12389 | hfcr8557 | 12449 | hfcr8664 | 12509 | hfcr8784 | 12569 | hfcr8900 |
| 12330 | hfcr8474 | 12390 | hfcr8559 | 12450 | hfcr8666 | 12510 | hfcr8786 | 12570 | hfcr8901 |
| 12331 | hfcr8475 | 12391 | hfcr8561 | 12451 | hfcr8667 | 12511 | hfcr8787 | 12571 | hfcr8902 |
| 12332 | hfcr8477 | 12392 | hfcr8562 | 12452 | hfcr8671 | 12512 | hfcr8789 | 12572 | hfcr8906 |
| 12333 | hfcr8478 | 12393 | hfcr8567 | 12453 | hfcr8672 | 12513 | hfcr8790 | 12573 | hfcr8907 |
| 12334 | hfcr8479 | 12394 | hfcr8568 | 12454 | hfcr8674 | 12514 | hfcr8791 | 12574 | hfcr8908 |
| 12335 | hfcr8481 | 12395 | hfcr8570 | 12455 | hfcr8677 | 12515 | hfcr8796 | 12575 | hfcr8910 |
| 12336 | hfcr8482 | 12396 | hfcr8571 | 12456 | hfcr8678 | 12516 | hfcr8800 | 12576 | hfcr8913 |
| 12337 | hfcr8483 | 12397 | hfcr8575 | 12457 | hfcr8679 | 12517 | hfcr8803 | 12577 | hfcr8914 |
| 12338 | hfcr8484 | 12398 | hfcr8576 | 12458 | hfcr8680 | 12518 | hfcr8804 | 12578 | hfcr8915 |
| 12339 | hfcr8485 | 12399 | hfcr8578 | 12459 | hfcr8691 | 12519 | hfcr8807 | 12579 | hfcr8917 |
| 12340 | hfcr8488 | 12400 | hfcr8582 | 12460 | hfcr8692 | 12520 | hfcr8811 | 12580 | hfcr8918 |
| 12341 | hfcr8489 | 12401 | hfcr8584 | 12461 | hfcr8695 | 12521 | hfcr8812 | 12581 | hfcr8919 |
| 12342 | hfcr8490 | 12402 | hfcr8585 | 12462 | hfcr8696 | 12522 | hfcr8813 | 12582 | hfcr8920 |
| 12343 | hfcr8492 | 12403 | hfcr8586 | 12463 | hfcr8699 | 12523 | hfcr8814 | 12583 | hfcr8921 |
| 12344 | hfcr8493 | 12404 | hfcr8587 | 12464 | hfcr8702 | 12524 | hfcr8816 | 12584 | hfcr8922 |
| 12345 | hfcr8495 | 12405 | hfcr8590 | 12465 | hfcr8704 | 12525 | hfcr8817 | 12585 | hfcr8923 |
| 12346 | hfcr8496 | 12406 | hfcr8591 | 12466 | hfcr8709 | 12526 | hfcr8818 | 12586 | hfcr8925 |
| 12347 | hfcr8497 | 12407 | hfcr8592 | 12467 | hfcr8712 | 12527 | hfcr8819 | 12587 | hfcr8926 |
| 12348 | hfcr8498 | 12408 | hfcr8595 | 12468 | hfcr8713 | 12528 | hfcr8821 | 12588 | hfcr8929 |
| 12349 | hfcr8499 | 12409 | hfcr8598 | 12469 | hfcr8715 | 12529 | hfcr8824 | 12589 | hfcr8930 |
| 12350 | hfcr8500 | 12410 | hfcr8599 | 12470 | hfcr8716 | 12530 | hfcr8826 | 12590 | hfcr8932 |
| 12351 | hfcr8501 | 12411 | hfcr8600 | 12471 | hfcr8719 | 12531 | hfcr8827 | 12591 | hfcr8933 |
| 12352 | hfcr8502 | 12412 | hfcr8602 | 12472 | hfcr8720 | 12532 | hfcr8828 | 12592 | hfcr8934 |
| 12353 | hfcr8503 | 12413 | hfcr8604 | 12473 | hfcr8723 | 12533 | hfcr8830 | 12593 | hfcr8935 |
| 12354 | hfcr8504 | 12414 | hfcr8605 | 12474 | hfcr8727 | 12534 | hfcr8832 | 12594 | hfcr8936 |
| 12355 | hfcr8505 | 12415 | hfcr8606 | 12475 | hfcr8728 | 12535 | hfcr8834 | 12595 | hfcr8937 |
| 12356 | hfcr8506 | 12416 | hfcr8607 | 12476 | hfcr8730 | 12536 | hfcr8835 | 12596 | hfcr8938 |
| 12357 | hfcr8507 | 12417 | hfcr8608 | 12477 | hfcr8735 | 12537 | hfcr8837 | 12597 | hfcr8939 |
| 12358 | hfcr8508 | 12418 | hfcr8609 | 12478 | hfcr8736 | 12538 | hfcr8838 | 12598 | hfcr8940 |
| 12359 | hfcr8509 | 12419 | hfcr8612 | 12479 | hfcr8737 | 12539 | hfcr8843 | 12599 | hfcr8941 |
| 12360 | hfcr8510 | 12420 | hfcr8615 | 12480 | hfcr8738 | 12540 | hfcr8854 | 12600 | hfcr8942 |

Figure 6B – List of EST Sequence Names From Fetal Cartilage cDNA Library

| | | | | | | | | | |
|---|---|---|---|---|---|---|---|---|---|
| 12601 | hfcr8943 | 12661 | hfcr9025 | 12721 | hfcr9107 | 12781 | hfcr9186 | 12841 | hfcr9262 |
| 12602 | hfcr8944 | 12662 | hfcr9026 | 12722 | hfcr9110 | 12782 | hfcr9187 | 12842 | hfcr9263 |
| 12603 | hfcr8945 | 12663 | hfcr9027 | 12723 | hfcr9111 | 12783 | hfcr9188 | 12843 | hfcr9264 |
| 12604 | hfcr8946 | 12664 | hfcr9028 | 12724 | hfcr9112 | 12784 | hfcr9189 | 12844 | hfcr9265 |
| 12605 | hfcr8947 | 12665 | hfcr9029 | 12725 | hfcr9115 | 12785 | hfcr9190 | 12845 | hfcr9266 |
| 12606 | hfcr8951 | 12666 | hfcr9030 | 12726 | hfcr9116 | 12786 | hfcr9191 | 12846 | hfcr9267 |
| 12607 | hfcr8953 | 12667 | hfcr9031 | 12727 | hfcr9117 | 12787 | hfcr9192 | 12847 | hfcr9268 |
| 12608 | hfcr8954 | 12668 | hfcr9032 | 12728 | hfcr9121 | 12788 | hfcr9193 | 12848 | hfcr9270 |
| 12609 | hfcr8956 | 12669 | hfcr9033 | 12729 | hfcr9122 | 12789 | hfcr9194 | 12849 | hfcr9271 |
| 12610 | hfcr8957 | 12670 | hfcr9034 | 12730 | hfcr9123 | 12790 | hfcr9195 | 12850 | hfcr9272 |
| 12611 | hfcr8958 | 12671 | hfcr9035 | 12731 | hfcr9124 | 12791 | hfcr9196 | 12851 | hfcr9273 |
| 12612 | hfcr8959 | 12672 | hfcr9036 | 12732 | hfcr9125 | 12792 | hfcr9200 | 12852 | hfcr9276 |
| 12613 | hfcr8960 | 12673 | hfcr9038 | 12733 | hfcr9127 | 12793 | hfcr9201 | 12853 | hfcr9277 |
| 12614 | hfcr8961 | 12674 | hfcr9039 | 12734 | hfcr9128 | 12794 | hfcr9202 | 12854 | hfcr9278 |
| 12615 | hfcr8963 | 12675 | hfcr9040 | 12735 | hfcr9129 | 12795 | hfcr9203 | 12855 | hfcr9279 |
| 12616 | hfcr8964 | 12676 | hfcr9041 | 12736 | hfcr9130 | 12796 | hfcr9206 | 12856 | hfcr9280 |
| 12617 | hfcr8965 | 12677 | hfcr9042 | 12737 | hfcr9131 | 12797 | hfcr9207 | 12857 | hfcr9283 |
| 12618 | hfcr8967 | 12678 | hfcr9043 | 12738 | hfcr9133 | 12798 | hfcr9209 | 12858 | hfcr9284 |
| 12619 | hfcr8968 | 12679 | hfcr9044 | 12739 | hfcr9134 | 12799 | hfcr9210 | 12859 | hfcr9285 |
| 12620 | hfcr8969 | 12680 | hfcr9046 | 12740 | hfcr9136 | 12800 | hfcr9211 | 12860 | hfcr9286 |
| 12621 | hfcr8971 | 12681 | hfcr9047 | 12741 | hfcr9138 | 12801 | hfcr9212 | 12861 | hfcr9287 |
| 12622 | hfcr8972 | 12682 | hfcr9050 | 12742 | hfcr9139 | 12802 | hfcr9215 | 12862 | hfcr9288 |
| 12623 | hfcr8973 | 12683 | hfcr9051 | 12743 | hfcr9140 | 12803 | hfcr9216 | 12863 | hfcr9289 |
| 12624 | hfcr8974 | 12684 | hfcr9052 | 12744 | hfcr9141 | 12804 | hfcr9217 | 12864 | hfcr9290 |
| 12625 | hfcr8976 | 12685 | hfcr9053 | 12745 | hfcr9142 | 12805 | hfcr9218 | 12865 | hfcr9292 |
| 12626 | hfcr8977 | 12686 | hfcr9054 | 12746 | hfcr9143 | 12806 | hfcr9219 | 12866 | hfcr9293 |
| 12627 | hfcr8980 | 12687 | hfcr9057 | 12747 | hfcr9144 | 12807 | hfcr9221 | 12867 | hfcr9294 |
| 12628 | hfcr8981 | 12688 | hfcr9060 | 12748 | hfcr9145 | 12808 | hfcr9222 | 12868 | hfcr9295 |
| 12629 | hfcr8982 | 12689 | hfcr9061 | 12749 | hfcr9146 | 12809 | hfcr9224 | 12869 | hfcr9296 |
| 12630 | hfcr8983 | 12690 | hfcr9062 | 12750 | hfcr9148 | 12810 | hfcr9225 | 12870 | hfcr9297 |
| 12631 | hfcr8984 | 12691 | hfcr9063 | 12751 | hfcr9150 | 12811 | hfcr9226 | 12871 | hfcr9298 |
| 12632 | hfcr8986 | 12692 | hfcr9066 | 12752 | hfcr9153 | 12812 | hfcr9228 | 12872 | hfcr9299 |
| 12633 | hfcr8988 | 12693 | hfcr9068 | 12753 | hfcr9154 | 12813 | hfcr9229 | 12873 | hfcr9300 |
| 12634 | hfcr8989 | 12694 | hfcr9069 | 12754 | hfcr9156 | 12814 | hfcr9230 | 12874 | hfcr9301 |
| 12635 | hfcr8990 | 12695 | hfcr9071 | 12755 | hfcr9158 | 12815 | hfcr9231 | 12875 | hfcr9302 |
| 12636 | hfcr8992 | 12696 | hfcr9072 | 12756 | hfcr9159 | 12816 | hfcr9232 | 12876 | hfcr9303 |
| 12637 | hfcr8993 | 12697 | hfcr9073 | 12757 | hfcr9160 | 12817 | hfcr9234 | 12877 | hfcr9304 |
| 12638 | hfcr8995 | 12698 | hfcr9075 | 12758 | hfcr9161 | 12818 | hfcr9236 | 12878 | hfcr9307 |
| 12639 | hfcr8996 | 12699 | hfcr9076 | 12759 | hfcr9162 | 12819 | hfcr9237 | 12879 | hfcr9310 |
| 12640 | hfcr8997 | 12700 | hfcr9077 | 12760 | hfcr9163 | 12820 | hfcr9239 | 12880 | hfcr9312 |
| 12641 | hfcr8998 | 12701 | hfcr9079 | 12761 | hfcr9164 | 12821 | hfcr9240 | 12881 | hfcr9314 |
| 12642 | hfcr8999 | 12702 | hfcr9080 | 12762 | hfcr9165 | 12822 | hfcr9241 | 12882 | hfcr9315 |
| 12643 | hfcr9001 | 12703 | hfcr9083 | 12763 | hfcr9167 | 12823 | hfcr9242 | 12883 | hfcr9316 |
| 12644 | hfcr9002 | 12704 | hfcr9084 | 12764 | hfcr9169 | 12824 | hfcr9243 | 12884 | hfcr9317 |
| 12645 | hfcr9004 | 12705 | hfcr9085 | 12765 | hfcr9170 | 12825 | hfcr9244 | 12885 | hfcr9319 |
| 12646 | hfcr9005 | 12706 | hfcr9086 | 12766 | hfcr9171 | 12826 | hfcr9245 | 12886 | hfcr9320 |
| 12647 | hfcr9006 | 12707 | hfcr9088 | 12767 | hfcr9172 | 12827 | hfcr9246 | 12887 | hfcr9321 |
| 12648 | hfcr9007 | 12708 | hfcr9089 | 12768 | hfcr9173 | 12828 | hfcr9247 | 12888 | hfcr9323 |
| 12649 | hfcr9008 | 12709 | hfcr9090 | 12769 | hfcr9174 | 12829 | hfcr9249 | 12889 | hfcr9324 |
| 12650 | hfcr9009 | 12710 | hfcr9091 | 12770 | hfcr9175 | 12830 | hfcr9250 | 12890 | hfcr9326 |
| 12651 | hfcr9011 | 12711 | hfcr9092 | 12771 | hfcr9176 | 12831 | hfcr9251 | 12891 | hfcr9327 |
| 12652 | hfcr9012 | 12712 | hfcr9094 | 12772 | hfcr9177 | 12832 | hfcr9252 | 12892 | hfcr9337 |
| 12653 | hfcr9013 | 12713 | hfcr9095 | 12773 | hfcr9178 | 12833 | hfcr9253 | 12893 | hfcr9338 |
| 12654 | hfcr9014 | 12714 | hfcr9096 | 12774 | hfcr9179 | 12834 | hfcr9254 | 12894 | hfcr9340 |
| 12655 | hfcr9015 | 12715 | hfcr9097 | 12775 | hfcr9180 | 12835 | hfcr9255 | 12895 | hfcr9341 |
| 12656 | hfcr9017 | 12716 | hfcr9098 | 12776 | hfcr9181 | 12836 | hfcr9256 | 12896 | hfcr9342 |
| 12657 | hfcr9018 | 12717 | hfcr9099 | 12777 | hfcr9182 | 12837 | hfcr9257 | 12897 | hfcr9343 |
| 12658 | hfcr9020 | 12718 | hfcr9100 | 12778 | hfcr9183 | 12838 | hfcr9258 | 12898 | hfcr9344 |
| 12659 | hfcr9022 | 12719 | hfcr9101 | 12779 | hfcr9184 | 12839 | hfcr9260 | 12899 | hfcr9345 |
| 12660 | hfcr9023 | 12720 | hfcr9105 | 12780 | hfcr9185 | 12840 | hfcr9261 | 12900 | hfcr9346 |

Figure 6B – List of EST Sequence Names From Fetal Cartilage cDNA Library

| | | | | | | | | | |
|---|---|---|---|---|---|---|---|---|---|
| 12901 | hfcr9347 | 12961 | hfcr9426 | 13021 | hfcr9512 | 13081 | hfcr9582 | 13141 | hfcr9653 |
| 12902 | hfcr9348 | 12962 | hfcr9427 | 13022 | hfcr9513 | 13082 | hfcr9583 | 13142 | hfcr9655 |
| 12903 | hfcr9350 | 12963 | hfcr9428 | 13023 | hfcr9514 | 13083 | hfcr9585 | 13143 | hfcr9656 |
| 12904 | hfcr9351 | 12964 | hfcr9431 | 13024 | hfcr9515 | 13084 | hfcr9586 | 13144 | hfcr9657 |
| 12905 | hfcr9352 | 12965 | hfcr9432 | 13025 | hfcr9518 | 13085 | hfcr9591 | 13145 | hfcr9658 |
| 12906 | hfcr9353 | 12966 | hfcr9433 | 13026 | hfcr9519 | 13086 | hfcr9592 | 13146 | hfcr9660 |
| 12907 | hfcr9354 | 12967 | hfcr9434 | 13027 | hfcr9520 | 13087 | hfcr9593 | 13147 | hfcr9661 |
| 12908 | hfcr9355 | 12968 | hfcr9437 | 13028 | hfcr9521 | 13088 | hfcr9594 | 13148 | hfcr9663 |
| 12909 | hfcr9356 | 12969 | hfcr9438 | 13029 | hfcr9522 | 13089 | hfcr9595 | 13149 | hfcr9664 |
| 12910 | hfcr9357 | 12970 | hfcr9439 | 13030 | hfcr9523 | 13090 | hfcr9596 | 13150 | hfcr9666 |
| 12911 | hfcr9358 | 12971 | hfcr9441 | 13031 | hfcr9524 | 13091 | hfcr9597 | 13151 | hfcr9667 |
| 12912 | hfcr9359 | 12972 | hfcr9444 | 13032 | hfcr9525 | 13092 | hfcr9598 | 13152 | hfcr9668 |
| 12913 | hfcr9361 | 12973 | hfcr9445 | 13033 | hfcr9527 | 13093 | hfcr9599 | 13153 | hfcr9669 |
| 12914 | hfcr9362 | 12974 | hfcr9446 | 13034 | hfcr9528 | 13094 | hfcr9600 | 13154 | hfcr9670 |
| 12915 | hfcr9363 | 12975 | hfcr9447 | 13035 | hfcr9529 | 13095 | hfcr9601 | 13155 | hfcr9671 |
| 12916 | hfcr9364 | 12976 | hfcr9448 | 13036 | hfcr9530 | 13096 | hfcr9602 | 13156 | hfcr9673 |
| 12917 | hfcr9366 | 12977 | hfcr9449 | 13037 | hfcr9532 | 13097 | hfcr9603 | 13157 | hfcr9675 |
| 12918 | hfcr9367 | 12978 | hfcr9450 | 13038 | hfcr9533 | 13098 | hfcr9604 | 13158 | hfcr9676 |
| 12919 | hfcr9368 | 12979 | hfcr9459 | 13039 | hfcr9534 | 13099 | hfcr9605 | 13159 | hfcr9677 |
| 12920 | hfcr9369 | 12980 | hfcr9461 | 13040 | hfcr9535 | 13100 | hfcr9606 | 13160 | hfcr9678 |
| 12921 | hfcr9371 | 12981 | hfcr9462 | 13041 | hfcr9536 | 13101 | hfcr9607 | 13161 | hfcr9679 |
| 12922 | hfcr9372 | 12982 | hfcr9463 | 13042 | hfcr9537 | 13102 | hfcr9608 | 13162 | hfcr9680 |
| 12923 | hfcr9374 | 12983 | hfcr9465 | 13043 | hfcr9538 | 13103 | hfcr9609 | 13163 | hfcr9681 |
| 12924 | hfcr9375 | 12984 | hfcr9466 | 13044 | hfcr9539 | 13104 | hfcr9610 | 13164 | hfcr9682 |
| 12925 | hfcr9378 | 12985 | hfcr9468 | 13045 | hfcr9540 | 13105 | hfcr9611 | 13165 | hfcr9684 |
| 12926 | hfcr9381 | 12986 | hfcr9469 | 13046 | hfcr9541 | 13106 | hfcr9612 | 13166 | hfcr9685 |
| 12927 | hfcr9383 | 12987 | hfcr9470 | 13047 | hfcr9542 | 13107 | hfcr9613 | 13167 | hfcr9686 |
| 12928 | hfcr9384 | 12988 | hfcr9471 | 13048 | hfcr9543 | 13108 | hfcr9614 | 13168 | hfcr9687 |
| 12929 | hfcr9386 | 12989 | hfcr9472 | 13049 | hfcr9545 | 13109 | hfcr9616 | 13169 | hfcr9689 |
| 12930 | hfcr9387 | 12990 | hfcr9473 | 13050 | hfcr9546 | 13110 | hfcr9617 | 13170 | hfcr9690 |
| 12931 | hfcr9388 | 12991 | hfcr9474 | 13051 | hfcr9547 | 13111 | hfcr9619 | 13171 | hfcr9691 |
| 12932 | hfcr9389 | 12992 | hfcr9475 | 13052 | hfcr9548 | 13112 | hfcr9620 | 13172 | hfcr9692 |
| 12933 | hfcr9390 | 12993 | hfcr9477 | 13053 | hfcr9549 | 13113 | hfcr9621 | 13173 | hfcr9694 |
| 12934 | hfcr9391 | 12994 | hfcr9478 | 13054 | hfcr9550 | 13114 | hfcr9622 | 13174 | hfcr9695 |
| 12935 | hfcr9392 | 12995 | hfcr9480 | 13055 | hfcr9551 | 13115 | hfcr9623 | 13175 | hfcr9696 |
| 12936 | hfcr9396 | 12996 | hfcr9481 | 13056 | hfcr9553 | 13116 | hfcr9624 | 13176 | hfcr9698 |
| 12937 | hfcr9397 | 12997 | hfcr9482 | 13057 | hfcr9554 | 13117 | hfcr9625 | 13177 | hfcr9700 |
| 12938 | hfcr9398 | 12998 | hfcr9483 | 13058 | hfcr9555 | 13118 | hfcr9626 | 13178 | hfcr9701 |
| 12939 | hfcr9399 | 12999 | hfcr9484 | 13059 | hfcr9556 | 13119 | hfcr9627 | 13179 | hfcr9703 |
| 12940 | hfcr9400 | 13000 | hfcr9485 | 13060 | hfcr9558 | 13120 | hfcr9628 | 13180 | hfcr9704 |
| 12941 | hfcr9402 | 13001 | hfcr9488 | 13061 | hfcr9559 | 13121 | hfcr9629 | 13181 | hfcr9705 |
| 12942 | hfcr9403 | 13002 | hfcr9490 | 13062 | hfcr9560 | 13122 | hfcr9630 | 13182 | hfcr9706 |
| 12943 | hfcr9404 | 13003 | hfcr9491 | 13063 | hfcr9561 | 13123 | hfcr9631 | 13183 | hfcr9707 |
| 12944 | hfcr9405 | 13004 | hfcr9492 | 13064 | hfcr9562 | 13124 | hfcr9633 | 13184 | hfcr9708 |
| 12945 | hfcr9406 | 13005 | hfcr9493 | 13065 | hfcr9563 | 13125 | hfcr9634 | 13185 | hfcr9709 |
| 12946 | hfcr9408 | 13006 | hfcr9494 | 13066 | hfcr9564 | 13126 | hfcr9635 | 13186 | hfcr9711 |
| 12947 | hfcr9410 | 13007 | hfcr9495 | 13067 | hfcr9565 | 13127 | hfcr9637 | 13187 | hfcr9713 |
| 12948 | hfcr9411 | 13008 | hfcr9496 | 13068 | hfcr9566 | 13128 | hfcr9638 | 13188 | hfcr9715 |
| 12949 | hfcr9412 | 13009 | hfcr9497 | 13069 | hfcr9567 | 13129 | hfcr9639 | 13189 | hfcr9716 |
| 12950 | hfcr9413 | 13010 | hfcr9500 | 13070 | hfcr9569 | 13130 | hfcr9640 | 13190 | hfcr9717 |
| 12951 | hfcr9414 | 13011 | hfcr9501 | 13071 | hfcr9572 | 13131 | hfcr9643 | 13191 | hfcr9718 |
| 12952 | hfcr9415 | 13012 | hfcr9502 | 13072 | hfcr9573 | 13132 | hfcr9644 | 13192 | hfcr9719 |
| 12953 | hfcr9416 | 13013 | hfcr9503 | 13073 | hfcr9574 | 13133 | hfcr9645 | 13193 | hfcr9720 |
| 12954 | hfcr9417 | 13014 | hfcr9505 | 13074 | hfcr9575 | 13134 | hfcr9646 | 13194 | hfcr9721 |
| 12955 | hfcr9418 | 13015 | hfcr9506 | 13075 | hfcr9576 | 13135 | hfcr9647 | 13195 | hfcr9723 |
| 12956 | hfcr9419 | 13016 | hfcr9507 | 13076 | hfcr9577 | 13136 | hfcr9648 | 13196 | hfcr9725 |
| 12957 | hfcr9420 | 13017 | hfcr9508 | 13077 | hfcr9578 | 13137 | hfcr9649 | 13197 | hfcr9726 |
| 12958 | hfcr9421 | 13018 | hfcr9509 | 13078 | hfcr9579 | 13138 | hfcr9650 | 13198 | hfcr9727 |
| 12959 | hfcr9424 | 13019 | hfcr9510 | 13079 | hfcr9580 | 13139 | hfcr9651 | 13199 | hfcr9728 |
| 12960 | hfcr9425 | 13020 | hfcr9511 | 13080 | hfcr9581 | 13140 | hfcr9652 | 13200 | hfcr9729 |

Figure 6B - List of EST Sequence Names From Fetal Cartilage cDNA Library

| | |
|---|---|
| 13201 | hfcr9730 |
| 13202 | hfcr9731 |
| 13203 | hfcr9733 |
| 13204 | hfcr9736 |
| 13205 | hfcr9737 |
| 13206 | hfcr9738 |
| 13207 | hfcr9739 |
| 13208 | hfcr9740 |
| 13209 | hfcr9741 |
| 13210 | hfcr9742 |
| 13211 | hfcr9743 |
| 13212 | hfcr9744 |
| 13213 | hfcr9745 |
| 13214 | hfcr9746 |
| 13215 | hfcr9748 |
| 13216 | hfcr9751 |
| 13217 | hfcr9754 |
| 13218 | hfcr9755 |
| 13219 | hfcr9756 |
| 13220 | hfcr9757 |
| 13221 | hfcr9759 |
| 13222 | hfcr9761 |
| 13223 | hfcr9763 |
| 13224 | hfcr9764 |
| 13225 | hfcr9767 |
| 13226 | hfcr9768 |
| 13227 | hfcr9769 |
| 13228 | hfcr9771 |
| 13229 | hfcr9773 |
| 13230 | hfcr9774 |
| 13231 | hfcr9775 |
| 13232 | hfcr9776 |
| 13233 | hfcr9777 |
| 13234 | hfcr9778 |
| 13235 | hfcr9779 |
| 13236 | hfcr9782 |
| 13237 | hfcr9783 |
| 13238 | hfcr9784 |
| 13239 | hfcr9785 |
| 13240 | hfcr9787 |
| 13241 | hfcr9788 |
| 13242 | hfcr9789 |
| 13243 | hfcr9790 |
| 13244 | hfcr9791 |
| 13245 | hfcr9794 |
| 13246 | hfcr9795 |
| 13247 | hfcr9796 |
| 13248 | hfcr9797 |
| 13249 | hfcr9799 |
| 13250 | hfcr9800 |
| 13251 | hfcr9802 |
| 13252 | hfcr9803 |
| 13253 | hfcr9804 |
| 13254 | hfcr9807 |
| 13255 | hfcr9808 |
| 13256 | hfcr9809 |
| 13257 | hfcr9810 |
| 13258 | hfcr9811 |
| 13259 | hfcr9812 |
| 13260 | hfcr9814 |
| 13261 | hfcr9815 |
| 13262 | hfcr9816 |
| 13263 | hfcr9817 |
| 13264 | hfcr9819 |
| 13265 | hfcr9820 |
| 13266 | hfcr9821 |
| 13267 | hfcr9822 |
| 13268 | hfcr9823 |
| 13269 | hfcr9824 |
| 13270 | hfcr9827 |
| 13271 | hfcr9830 |
| 13272 | hfcr9835 |
| 13273 | hfcr9836 |
| 13274 | hfcr9837 |
| 13275 | hfcr9840 |
| 13276 | hfcr9841 |
| 13277 | hfcr9842 |
| 13278 | hfcr9843 |
| 13279 | hfcr9844 |
| 13280 | hfcr9845 |
| 13281 | hfcr9846 |
| 13282 | hfcr9847 |
| 13283 | hfcr9848 |
| 13284 | hfcr9853 |
| 13285 | hfcr9861 |
| 13286 | hfcr9862 |
| 13287 | hfcr9863 |
| 13288 | hfcr9866 |
| 13289 | hfcr9867 |
| 13290 | hfcr9868 |
| 13291 | hfcr9869 |
| 13292 | hfcr9871 |
| 13293 | hfcr9872 |
| 13294 | hfcr9875 |
| 13295 | hfcr9879 |
| 13296 | hfcr9880 |
| 13297 | hfcr9881 |
| 13298 | hfcr9883 |
| 13299 | hfcr9884 |
| 13300 | hfcr9885 |
| 13301 | hfcr9886 |
| 13302 | hfcr9887 |
| 13303 | hfcr9888 |
| 13304 | hfcr9889 |
| 13305 | hfcr9890 |
| 13306 | hfcr9891 |
| 13307 | hfcr9892 |
| 13308 | hfcr9893 |
| 13309 | hfcr9894 |
| 13310 | hfcr9895 |
| 13311 | hfcr9896 |
| 13312 | hfcr9897 |
| 13313 | hfcr9898 |
| 13314 | hfcr9899 |
| 13315 | hfcr9900 |
| 13316 | hfcr9901 |
| 13317 | hfcr9902 |
| 13318 | hfcr9903 |
| 13319 | hfcr9904 |
| 13320 | hfcr9905 |
| 13321 | hfcr9907 |
| 13322 | hfcr9908 |
| 13323 | hfcr9909 |
| 13324 | hfcr9910 |
| 13325 | hfcr9911 |
| 13326 | hfcr9912 |
| 13327 | hfcr9913 |
| 13328 | hfcr9914 |
| 13329 | hfcr9915 |
| 13330 | hfcr9916 |
| 13331 | hfcr9917 |
| 13332 | hfcr9918 |
| 13333 | hfcr9919 |
| 13334 | hfcr9920 |
| 13335 | hfcr9921 |
| 13336 | hfcr9922 |
| 13337 | hfcr9923 |
| 13338 | hfcr9924 |
| 13339 | hfcr9926 |
| 13340 | hfcr9927 |
| 13341 | hfcr9928 |
| 13342 | hfcr9929 |
| 13343 | hfcr9932 |
| 13344 | hfcr9933 |
| 13345 | hfcr9934 |
| 13346 | hfcr9935 |
| 13347 | hfcr9936 |
| 13348 | hfcr9938 |
| 13349 | hfcr9939 |
| 13350 | hfcr9940 |
| 13351 | hfcr9941 |
| 13352 | hfcr9942 |
| 13353 | hfcr9943 |
| 13354 | hfcr9945 |
| 13355 | hfcr9946 |
| 13356 | hfcr9947 |
| 13357 | hfcr9948 |
| 13358 | hfcr9949 |
| 13359 | hfcr9953 |
| 13360 | hfcr9954 |
| 13361 | hfcr9955 |
| 13362 | hfcr9956 |
| 13363 | hfcr9958 |
| 13364 | hfcr9959 |
| 13365 | hfcr9960 |
| 13366 | hfcr9961 |
| 13367 | hfcr9963 |
| 13368 | hfcr9965 |
| 13369 | hfcr9966 |
| 13370 | hfcr9967 |
| 13371 | hfcr9968 |
| 13372 | hfcr9969 |
| 13373 | hfcr9970 |
| 13374 | hfcr9971 |
| 13375 | hfcr9973 |
| 13376 | hfcr9974 |
| 13377 | hfcr9975 |
| 13378 | hfcr9976 |
| 13379 | hfcr9977 |
| 13380 | hfcr9979 |
| 13381 | hfcr9980 |
| 13382 | hfcr9981 |
| 13383 | hfcr9982 |
| 13384 | hfcr9985 |
| 13385 | hfcr9986 |
| 13386 | hfcr9987 |
| 13387 | hfcr9988 |
| 13388 | hfcr9989 |
| 13389 | hfcr9990 |
| 13390 | hfcr9991 |
| 13391 | hfcr9992 |
| 13392 | hfcr9993 |
| 13393 | hfcr9994 |
| 13394 | hfcr9995 |
| 13395 | hfcr9996 |
| 13396 | hfcr9997 |
| 13397 | hfcr9998 |
| 13398 | hfcr9999 |

Figure 6C – List of EST Sequence Names From Normal Cartilage cDNA Library

| | | | | | | | | | |
|---|---|---|---|---|---|---|---|---|---|
| 1 | ncr0001 | 61 | ncr0094 | 121 | ncr0178 | 181 | ncr0268 | 241 | ncr0358 |
| 2 | ncr0004 | 62 | ncr0095 | 122 | ncr0179 | 182 | ncr0269 | 242 | ncr0360 |
| 3 | ncr0005 | 63 | ncr0096 | 123 | ncr0180 | 183 | ncr0270 | 243 | ncr0363 |
| 4 | ncr0007 | 64 | ncr0097 | 124 | ncr0181 | 184 | ncr0272 | 244 | ncr0364 |
| 5 | ncr0008 | 65 | ncr0099 | 125 | ncr0182 | 185 | ncr0273 | 245 | ncr0365 |
| 6 | ncr0011 | 66 | ncr0100 | 126 | ncr0183 | 186 | ncr0274 | 246 | ncr0366 |
| 7 | ncr0013 | 67 | ncr0101 | 127 | ncr0184 | 187 | ncr0275 | 247 | ncr0368 |
| 8 | ncr0014 | 68 | ncr0103 | 128 | ncr0185 | 188 | ncr0276 | 248 | ncr0369 |
| 9 | ncr0015 | 69 | ncr0104 | 129 | ncr0186 | 189 | ncr0277 | 249 | ncr0370n |
| 10 | ncr0016 | 70 | ncr0105 | 130 | ncr0187 | 190 | ncr0279 | 250 | ncr0371n |
| 11 | ncr0018 | 71 | ncr0107 | 131 | ncr0188 | 191 | ncr0282 | 251 | ncr0372 |
| 12 | ncr0019 | 72 | ncr0108 | 132 | ncr0189 | 192 | ncr0284 | 252 | ncr0373 |
| 13 | ncr0020 | 73 | ncr0109 | 133 | ncr0191 | 193 | ncr0285 | 253 | ncr0374 |
| 14 | ncr0021 | 74 | ncr0110 | 134 | ncr0193 | 194 | ncr0286 | 254 | ncr0376 |
| 15 | ncr0023 | 75 | ncr0113 | 135 | ncr0194 | 195 | ncr0287 | 255 | ncr0377 |
| 16 | ncr0025 | 76 | ncr0114 | 136 | ncr0197 | 196 | ncr0289 | 256 | ncr0378 |
| 17 | ncr0026 | 77 | ncr0115 | 137 | ncr0198 | 197 | ncr0291 | 257 | ncr0379 |
| 18 | ncr0028 | 78 | ncr0117 | 138 | ncr0199 | 198 | ncr0292 | 258 | ncr0380 |
| 19 | ncr0029 | 79 | ncr0120 | 139 | ncr0201 | 199 | ncr0296 | 259 | ncr0381 |
| 20 | ncr0031 | 80 | ncr0122 | 140 | ncr0205 | 200 | ncr0299 | 260 | ncr0382 |
| 21 | ncr0032 | 81 | ncr0123 | 141 | ncr0206 | 201 | ncr0300 | 261 | ncr0383 |
| 22 | ncr0033 | 82 | ncr0124 | 142 | ncr0208 | 202 | ncr0301 | 262 | ncr0384 |
| 23 | ncr0034 | 83 | ncr0125 | 143 | ncr0209 | 203 | ncr0303 | 263 | ncr0385 |
| 24 | ncr0035 | 84 | ncr0126 | 144 | ncr0210 | 204 | ncr0304 | 264 | ncr0387 |
| 25 | ncr0036 | 85 | ncr0128 | 145 | ncr0211 | 205 | ncr0305 | 265 | ncr0388 |
| 26 | ncr0037 | 86 | ncr0130 | 146 | ncr0212 | 206 | ncr0306 | 266 | ncr0389 |
| 27 | ncr0041 | 87 | ncr0132 | 147 | ncr0213 | 207 | ncr0307 | 267 | ncr0392 |
| 28 | ncr0043 | 88 | ncr0133 | 148 | ncr0215 | 208 | ncr0309 | 268 | ncr0393 |
| 29 | ncr0044 | 89 | ncr0134 | 149 | ncr0218 | 209 | ncr0310n | 269 | ncr0395 |
| 30 | ncr0045 | 90 | ncr0135 | 150 | ncr0221 | 210 | ncr0312 | 270 | ncr0396 |
| 31 | ncr0046 | 91 | ncr0136 | 151 | ncr0222 | 211 | ncr0313 | 271 | ncr0400 |
| 32 | ncr0047 | 92 | ncr0137 | 152 | ncr0223 | 212 | ncr0314 | 272 | ncr0402 |
| 33 | ncr0048 | 93 | ncr0138 | 153 | ncr0224 | 213 | ncr0315 | 273 | ncr0403 |
| 34 | ncr0049 | 94 | ncr0140 | 154 | ncr0231 | 214 | ncr0316 | 274 | ncr0404 |
| 35 | ncr0051 | 95 | ncr0142 | 155 | ncr0233 | 215 | ncr0317 | 275 | ncr0407 |
| 36 | ncr0052 | 96 | ncr0143 | 156 | ncr0235 | 216 | ncr0319 | 276 | ncr0408 |
| 37 | ncr0054 | 97 | ncr0144 | 157 | ncr0236 | 217 | ncr0320 | 277 | ncr0409 |
| 38 | ncr0055 | 98 | ncr0145 | 158 | ncr0238 | 218 | ncr0323 | 278 | ncr0411 |
| 39 | ncr0056 | 99 | ncr0146 | 159 | ncr0239 | 219 | ncr0325 | 279 | ncr0412 |
| 40 | ncr0060 | 100 | ncr0148 | 160 | ncr0240 | 220 | ncr0326 | 280 | ncr0413 |
| 41 | ncr0064 | 101 | ncr0149 | 161 | ncr0241 | 221 | ncr0328 | 281 | ncr0415 |
| 42 | ncr0066 | 102 | ncr0150 | 162 | ncr0242 | 222 | ncr0329 | 282 | ncr0416 |
| 43 | ncr0067 | 103 | ncr0152 | 163 | ncr0243 | 223 | ncr0330 | 283 | ncr0417 |
| 44 | ncr0070 | 104 | ncr0153 | 164 | ncr0244 | 224 | ncr0331 | 284 | ncr0418 |
| 45 | ncr0072 | 105 | ncr0156 | 165 | ncr0245 | 225 | ncr0332 | 285 | ncr0420 |
| 46 | ncr0073 | 106 | ncr0157 | 166 | ncr0246 | 226 | ncr0333 | 286 | ncr0421 |
| 47 | ncr0074 | 107 | ncr0159 | 167 | ncr0250 | 227 | ncr0335 | 287 | ncr0422 |
| 48 | ncr0075 | 108 | ncr0160 | 168 | ncr0251 | 228 | ncr0336 | 288 | ncr0424 |
| 49 | ncr0076 | 109 | ncr0164 | 169 | ncr0252 | 229 | ncr0338 | 289 | ncr0425 |
| 50 | ncr0078 | 110 | ncr0165 | 170 | ncr0253 | 230 | ncr0339n | 290 | ncr0426 |
| 51 | ncr0079 | 111 | ncr0166n | 171 | ncr0255 | 231 | ncr0340 | 291 | ncr0427 |
| 52 | ncr0080 | 112 | ncr0167 | 172 | ncr0256 | 232 | ncr0343 | 292 | ncr0429 |
| 53 | ncr0081 | 113 | ncr0168 | 173 | ncr0257 | 233 | ncr0345 | 293 | ncr0432 |
| 54 | ncr0083 | 114 | ncr0169 | 174 | ncr0258 | 234 | ncr0347 | 294 | ncr0433 |
| 55 | ncr0084 | 115 | ncr0170 | 175 | ncr0260 | 235 | ncr0350 | 295 | ncr0434 |
| 56 | ncr0085 | 116 | ncr0171 | 176 | ncr0261 | 236 | ncr0352 | 296 | ncr0436 |
| 57 | ncr0088 | 117 | ncr0172 | 177 | ncr0262 | 237 | ncr0353 | 297 | ncr0438 |
| 58 | ncr0090 | 118 | ncr0173 | 178 | ncr0265 | 238 | ncr0355 | 298 | ncr0441 |
| 59 | ncr0091 | 119 | ncr0174 | 179 | ncr0266 | 239 | ncr0356 | 299 | ncr0442 |
| 60 | ncr0092 | 120 | ncr0176 | 180 | ncr0267 | 240 | ncr0357 | 300 | ncr0443 |

Figure 6C – List of EST Sequence Names From Normal Cartilage cDNA Library

| | | | | | | | | | |
|---|---|---|---|---|---|---|---|---|---|
| 301 | ncr0444 | 361 | ncr0531 | 421 | ncr0598 | 481 | ncr0678 | 541 | ncr0780 |
| 302 | ncr0445 | 362 | ncr0532 | 422 | ncr0600 | 482 | ncr0679 | 542 | ncr0781 |
| 303 | ncr0446 | 363 | ncr0533 | 423 | ncr0602 | 483 | ncr0680 | 543 | ncr0783 |
| 304 | ncr0448 | 364 | ncr0534 | 424 | ncr0604 | 484 | ncr0681 | 544 | ncr0785 |
| 305 | ncr0449 | 365 | ncr0535 | 425 | ncr0605 | 485 | ncr0685 | 545 | ncr0786 |
| 306 | ncr0451 | 366 | ncr0536 | 426 | ncr0608 | 486 | ncr0687 | 546 | ncr0787 |
| 307 | ncr0452 | 367 | ncr0538 | 427 | ncr0609 | 487 | ncr0688 | 547 | ncr0788 |
| 308 | ncr0453 | 368 | ncr0539 | 428 | ncr0610 | 488 | ncr0690 | 548 | ncr0791 |
| 309 | ncr0454 | 369 | ncr0540 | 429 | ncr0611 | 489 | ncr0692 | 549 | ncr0792 |
| 310 | ncr0455 | 370 | ncr0541 | 430 | ncr0612 | 490 | ncr0693 | 550 | ncr0795 |
| 311 | ncr0456 | 371 | ncr0542 | 431 | ncr0613 | 491 | ncr0694 | 551 | ncr0796 |
| 312 | ncr0457 | 372 | ncr0543 | 432 | ncr0614 | 492 | ncr0696 | 552 | ncr0797 |
| 313 | ncr0459 | 373 | ncr0544 | 433 | ncr0615 | 493 | ncr0697 | 553 | ncr0799 |
| 314 | ncr0460 | 374 | ncr0545 | 434 | ncr0617 | 494 | ncr0700 | 554 | ncr0800 |
| 315 | ncr0461 | 375 | ncr0546 | 435 | ncr0618 | 495 | ncr0701 | 555 | ncr0801 |
| 316 | ncr0463 | 376 | ncr0547 | 436 | ncr0619 | 496 | ncr0704 | 556 | ncr0802 |
| 317 | ncr0466 | 377 | ncr0548 | 437 | ncr0620 | 497 | ncr0708 | 557 | ncr0803 |
| 318 | ncr0467 | 378 | ncr0549 | 438 | ncr0621 | 498 | ncr0711 | 558 | ncr0806 |
| 319 | ncr0469 | 379 | ncr0550 | 439 | ncr0622 | 499 | ncr0713 | 559 | ncr0807 |
| 320 | ncr0470 | 380 | ncr0551 | 440 | ncr0623 | 500 | ncr0714 | 560 | ncr0808 |
| 321 | ncr0471 | 381 | ncr0553 | 441 | ncr0624 | 501 | ncr0716 | 561 | ncr0810 |
| 322 | ncr0472 | 382 | ncr0554 | 442 | ncr0625 | 502 | ncr0720 | 562 | ncr0812 |
| 323 | ncr0474 | 383 | ncr0556 | 443 | ncr0626 | 503 | ncr0721 | 563 | ncr0813 |
| 324 | ncr0475 | 384 | ncr0557 | 444 | ncr0627 | 504 | ncr0723 | 564 | ncr0814 |
| 325 | ncr0477 | 385 | ncr0559 | 445 | ncr0628 | 505 | ncr0725 | 565 | ncr0816 |
| 326 | ncr0478 | 386 | ncr0560 | 446 | ncr0630 | 506 | ncr0728 | 566 | ncr0817 |
| 327 | ncr0479 | 387 | ncr0561 | 447 | ncr0631 | 507 | ncr0729 | 567 | ncr0819 |
| 328 | ncr0480 | 388 | ncr0562 | 448 | ncr0632 | 508 | ncr0731 | 568 | ncr0820 |
| 329 | ncr0484 | 389 | ncr0563 | 449 | ncr0633 | 509 | ncr0733 | 569 | ncr0822 |
| 330 | ncr0485 | 390 | ncr0564 | 450 | ncr0634 | 510 | ncr0734 | 570 | ncr0824 |
| 331 | ncr0486 | 391 | ncr0565 | 451 | ncr0635 | 511 | ncr0736 | 571 | ncr0825 |
| 332 | ncr0488 | 392 | ncr0566 | 452 | ncr0637 | 512 | ncr0738 | 572 | ncr0826 |
| 333 | ncr0489 | 393 | ncr0567 | 453 | ncr0638 | 513 | ncr0739 | 573 | ncr0827 |
| 334 | ncr0491 | 394 | ncr0568 | 454 | ncr0640 | 514 | ncr0740 | 574 | ncr0828 |
| 335 | ncr0494 | 395 | ncr0569 | 455 | ncr0641 | 515 | ncr0741 | 575 | ncr0829 |
| 336 | ncr0495 | 396 | ncr0570 | 456 | ncr0642 | 516 | ncr0742 | 576 | ncr0830 |
| 337 | ncr0496 | 397 | ncr0571 | 457 | ncr0643 | 517 | ncr0744 | 577 | ncr0832 |
| 338 | ncr0497 | 398 | ncr0572 | 458 | ncr0644 | 518 | ncr0746 | 578 | ncr0833 |
| 339 | ncr0498 | 399 | ncr0573 | 459 | ncr0645 | 519 | ncr0747 | 579 | ncr0835 |
| 340 | ncr0500 | 400 | ncr0574 | 460 | ncr0646 | 520 | ncr0749 | 580 | ncr0836 |
| 341 | ncr0502 | 401 | ncr0575 | 461 | ncr0648 | 521 | ncr0751 | 581 | ncr0838 |
| 342 | ncr0503 | 402 | ncr0576 | 462 | ncr0649 | 522 | ncr0754 | 582 | ncr0839 |
| 343 | ncr0504 | 403 | ncr0577 | 463 | ncr0650 | 523 | ncr0755 | 583 | ncr0840 |
| 344 | ncr0505 | 404 | ncr0578 | 464 | ncr0652 | 524 | ncr0756 | 584 | ncr0842 |
| 345 | ncr0506 | 405 | ncr0580 | 465 | ncr0654 | 525 | ncr0759 | 585 | ncr0843 |
| 346 | ncr0507 | 406 | ncr0581 | 466 | ncr0656 | 526 | ncr0760 | 586 | ncr0844 |
| 347 | ncr0509 | 407 | ncr0582 | 467 | ncr0658 | 527 | ncr0761 | 587 | ncr0845 |
| 348 | ncr0511 | 408 | ncr0583 | 468 | ncr0660 | 528 | ncr0762 | 588 | ncr0846 |
| 349 | ncr0512 | 409 | ncr0584 | 469 | ncr0661 | 529 | ncr0763 | 589 | ncr0847 |
| 350 | ncr0513 | 410 | ncr0586 | 470 | ncr0662 | 530 | ncr0764 | 590 | ncr0851 |
| 351 | ncr0514 | 411 | ncr0587 | 471 | ncr0663 | 531 | ncr0765 | 591 | ncr0852 |
| 352 | ncr0516 | 412 | ncr0588 | 472 | ncr0664 | 532 | ncr0766 | 592 | ncr0853 |
| 353 | ncr0518 | 413 | ncr0589 | 473 | ncr0666 | 533 | ncr0767 | 593 | ncr0854 |
| 354 | ncr0519 | 414 | ncr0590 | 474 | ncr0667 | 534 | ncr0768 | 594 | ncr0855 |
| 355 | ncr0521 | 415 | ncr0591 | 475 | ncr0669 | 535 | ncr0769 | 595 | ncr0856 |
| 356 | ncr0522 | 416 | ncr0593 | 476 | ncr0671 | 536 | ncr0772 | 596 | ncr0859 |
| 357 | ncr0524 | 417 | ncr0594 | 477 | ncr0672 | 537 | ncr0773 | 597 | ncr0860 |
| 358 | ncr0525 | 418 | ncr0595 | 478 | ncr0673 | 538 | ncr0775 | 598 | ncr0861 |
| 359 | ncr0527 | 419 | ncr0596 | 479 | ncr0675 | 539 | ncr0776 | 599 | ncr0862 |
| 360 | ncr0528 | 420 | ncr0597 | 480 | ncr0676 | 540 | ncr0779 | 600 | ncr0863 |

Figure 6C – List of EST Sequence Names From Normal Cartilage cDNA Library

| | | | | | | | | | |
|---|---|---|---|---|---|---|---|---|---|
| 601 | ncr0865 | 661 | ncr0949 | 721 | ncr1035 | 781 | ncr1129 | 841 | ncr1221 |
| 602 | ncr0867 | 662 | ncr0950 | 722 | ncr1036 | 782 | ncr1130 | 842 | ncr1224 |
| 603 | ncr0869 | 663 | ncr0952 | 723 | ncr1038 | 783 | ncr1132 | 843 | ncr1225 |
| 604 | ncr0870 | 664 | ncr0953 | 724 | ncr1039 | 784 | ncr1134 | 844 | ncr1226 |
| 605 | ncr0871 | 665 | ncr0954 | 725 | ncr1040 | 785 | ncr1135 | 845 | ncr1228 |
| 606 | ncr0872 | 666 | ncr0956 | 726 | ncr1041 | 786 | ncr1137 | 846 | ncr1229 |
| 607 | ncr0879 | 667 | ncr0957 | 727 | ncr1042 | 787 | ncr1138 | 847 | ncr1230 |
| 608 | ncr0880 | 668 | ncr0958 | 728 | ncr1043 | 788 | ncr1139 | 848 | ncr1231 |
| 609 | ncr0881 | 669 | ncr0959 | 729 | ncr1045 | 789 | ncr1140 | 849 | ncr1232 |
| 610 | ncr0883 | 670 | ncr0960 | 730 | ncr1046 | 790 | ncr1141 | 850 | ncr1235 |
| 611 | ncr0884 | 671 | ncr0963 | 731 | ncr1047 | 791 | ncr1142 | 851 | ncr1236 |
| 612 | ncr0885 | 672 | ncr0965 | 732 | ncr1048 | 792 | ncr1147 | 852 | ncr1238 |
| 613 | ncr0888 | 673 | ncr0967 | 733 | ncr1049 | 793 | ncr1148 | 853 | ncr1240 |
| 614 | ncr0889 | 674 | ncr0968 | 734 | ncr1051 | 794 | ncr1150 | 854 | ncr1241 |
| 615 | ncr0891 | 675 | ncr0969 | 735 | ncr1052 | 795 | ncr1152 | 855 | ncr1242 |
| 616 | ncr0893 | 676 | ncr0971 | 736 | ncr1053 | 796 | ncr1155 | 856 | ncr1244 |
| 617 | ncr0895 | 677 | ncr0972 | 737 | ncr1055 | 797 | ncr1159 | 857 | ncr1245 |
| 618 | ncr0897 | 678 | ncr0974 | 738 | ncr1059 | 798 | ncr1161 | 858 | ncr1246 |
| 619 | ncr0898 | 679 | ncr0975 | 739 | ncr1060 | 799 | ncr1163 | 859 | ncr1247 |
| 620 | ncr0899 | 680 | ncr0976 | 740 | ncr1061 | 800 | ncr1165 | 860 | ncr1248 |
| 621 | ncr0900 | 681 | ncr0977 | 741 | ncr1063 | 801 | ncr1167 | 861 | ncr1249 |
| 622 | ncr0901 | 682 | ncr0979 | 742 | ncr1065 | 802 | ncr1168 | 862 | ncr1251 |
| 623 | ncr0902 | 683 | ncr0980 | 743 | ncr1067 | 803 | ncr1169 | 863 | ncr1252 |
| 624 | ncr0904 | 684 | ncr0984 | 744 | ncr1068 | 804 | ncr1171 | 864 | ncr1255 |
| 625 | ncr0906 | 685 | ncr0985 | 745 | ncr1071 | 805 | ncr1172 | 865 | ncr1256 |
| 626 | ncr0908 | 686 | ncr0987 | 746 | ncr1072 | 806 | ncr1175 | 866 | ncr1257 |
| 627 | ncr0910 | 687 | ncr0988 | 747 | ncr1073 | 807 | ncr1177 | 867 | ncr1260 |
| 628 | ncr0911 | 688 | ncr0989 | 748 | ncr1076 | 808 | ncr1179 | 868 | ncr1261 |
| 629 | ncr0912 | 689 | ncr0991 | 749 | ncr1077 | 809 | ncr1180 | 869 | ncr1263 |
| 630 | ncr0913 | 690 | ncr0992 | 750 | ncr1079 | 810 | ncr1181 | 870 | ncr1264 |
| 631 | ncr0914 | 691 | ncr0994 | 751 | ncr1080 | 811 | ncr1183 | 871 | ncr1265 |
| 632 | ncr0915 | 692 | ncr0995 | 752 | ncr1082 | 812 | ncr1184 | 872 | ncr1267 |
| 633 | ncr0916 | 693 | ncr0997 | 753 | ncr1085 | 813 | ncr1186 | 873 | ncr1268 |
| 634 | ncr0917 | 694 | ncr0998 | 754 | ncr1087 | 814 | ncr1187 | 874 | ncr1271 |
| 635 | ncr0918 | 695 | ncr0999 | 755 | ncr1090 | 815 | ncr1191 | 875 | ncr1272 |
| 636 | ncr0920 | 696 | ncr1002 | 756 | ncr1091 | 816 | ncr1192 | 876 | ncr1273 |
| 637 | ncr0921 | 697 | ncr1003 | 757 | ncr1094 | 817 | ncr1194 | 877 | ncr1274 |
| 638 | ncr0922 | 698 | ncr1004 | 758 | ncr1096 | 818 | ncr1195 | 878 | ncr1275 |
| 639 | ncr0923 | 699 | ncr1005 | 759 | ncr1098 | 819 | ncr1196 | 879 | ncr1276 |
| 640 | ncr0924 | 700 | ncr1006 | 760 | ncr1099 | 820 | ncr1197 | 880 | ncr1280 |
| 641 | ncr0925 | 701 | ncr1007 | 761 | ncr1101 | 821 | ncr1199 | 881 | ncr1281 |
| 642 | ncr0926 | 702 | ncr1008 | 762 | ncr1102 | 822 | ncr1200 | 882 | ncr1282 |
| 643 | ncr0927 | 703 | ncr1009 | 763 | ncr1103 | 823 | ncr1201 | 883 | ncr1283 |
| 644 | ncr0928 | 704 | ncr1011 | 764 | ncr1104 | 824 | ncr1203 | 884 | ncr1284 |
| 645 | ncr0929 | 705 | ncr1012 | 765 | ncr1105 | 825 | ncr1204 | 885 | ncr1285 |
| 646 | ncr0931 | 706 | ncr1013 | 766 | ncr1107 | 826 | ncr1205 | 886 | ncr1286 |
| 647 | ncr0933 | 707 | ncr1016 | 767 | ncr1108 | 827 | ncr1206 | 887 | ncr1288 |
| 648 | ncr0934 | 708 | ncr1020 | 768 | ncr1109 | 828 | ncr1208 | 888 | ncr1289 |
| 649 | ncr0935 | 709 | ncr1021 | 769 | ncr1110 | 829 | ncr1209 | 889 | ncr1290 |
| 650 | ncr0937 | 710 | ncr1023 | 770 | ncr1113 | 830 | ncr1210 | 890 | ncr1291 |
| 651 | ncr0938 | 711 | ncr1024 | 771 | ncr1114 | 831 | ncr1211 | 891 | ncr1292 |
| 652 | ncr0939 | 712 | ncr1025 | 772 | ncr1115 | 832 | ncr1212 | 892 | ncr1293 |
| 653 | ncr0941 | 713 | ncr1026 | 773 | ncr1116 | 833 | ncr1213 | 893 | ncr1294 |
| 654 | ncr0942 | 714 | ncr1028 | 774 | ncr1117 | 834 | ncr1214 | 894 | ncr1295 |
| 655 | ncr0943 | 715 | ncr1029 | 775 | ncr1119 | 835 | ncr1215 | 895 | ncr1296 |
| 656 | ncr0944 | 716 | ncr1030 | 776 | ncr1121 | 836 | ncr1216 | 896 | ncr1297 |
| 657 | ncr0945 | 717 | ncr1031 | 777 | ncr1122 | 837 | ncr1217 | 897 | ncr1298 |
| 658 | ncr0946 | 718 | ncr1032 | 778 | ncr1125 | 838 | ncr1218 | 898 | ncr1299 |
| 659 | ncr0947 | 719 | ncr1033 | 779 | ncr1126 | 839 | ncr1219 | 899 | ncr1302 |
| 660 | ncr0948 | 720 | ncr1034 | 780 | ncr1127 | 840 | ncr1220 | 900 | ncr1303 |

Figure 6C – List of EST Sequence Names From Normal Cartilage cDNA Library

| | | | | | | | | | |
|---|---|---|---|---|---|---|---|---|---|
| 901 | ncr1305 | 961 | ncr1396 | 1021 | ncr1479 | 1081 | ncr1563 | 1141 | ncr1656 |
| 902 | ncr1307 | 962 | ncr1398 | 1022 | ncr1480 | 1082 | ncr1565 | 1142 | ncr1657 |
| 903 | ncr1309 | 963 | ncr1399 | 1023 | ncr1483 | 1083 | ncr1567 | 1143 | ncr1658 |
| 904 | ncr1310 | 964 | ncr1400 | 1024 | ncr1484 | 1084 | ncr1568 | 1144 | ncr1660 |
| 905 | ncr1312 | 965 | ncr1401 | 1025 | ncr1485 | 1085 | ncr1569 | 1145 | ncr1661 |
| 906 | ncr1313 | 966 | ncr1402 | 1026 | ncr1486 | 1086 | ncr1570 | 1146 | ncr1663 |
| 907 | ncr1314 | 967 | ncr1403 | 1027 | ncr1488 | 1087 | ncr1571 | 1147 | ncr1666 |
| 908 | ncr1315 | 968 | ncr1404 | 1028 | ncr1490 | 1088 | ncr1572 | 1148 | ncr1667 |
| 909 | ncr1316 | 969 | ncr1405 | 1029 | ncr1491 | 1089 | ncr1573 | 1149 | ncr1668 |
| 910 | ncr1317 | 970 | ncr1406 | 1030 | ncr1492 | 1090 | ncr1575 | 1150 | ncr1669 |
| 911 | ncr1318 | 971 | ncr1407 | 1031 | ncr1494 | 1091 | ncr1576 | 1151 | ncr1671 |
| 912 | ncr1319 | 972 | ncr1408 | 1032 | ncr1495 | 1092 | ncr1578 | 1152 | ncr1672 |
| 913 | ncr1320 | 973 | ncr1409 | 1033 | ncr1496 | 1093 | ncr1580 | 1153 | ncr1674 |
| 914 | ncr1323 | 974 | ncr1410 | 1034 | ncr1497 | 1094 | ncr1583 | 1154 | ncr1675 |
| 915 | ncr1324 | 975 | ncr1411 | 1035 | ncr1499 | 1095 | ncr1585 | 1155 | ncr1676 |
| 916 | ncr1325 | 976 | ncr1413 | 1036 | ncr1501 | 1096 | ncr1587 | 1156 | ncr1677 |
| 917 | ncr1326 | 977 | ncr1414 | 1037 | ncr1502 | 1097 | ncr1589 | 1157 | ncr1678 |
| 918 | ncr1328 | 978 | ncr1415 | 1038 | ncr1503 | 1098 | ncr1590 | 1158 | ncr1679 |
| 919 | ncr1330 | 979 | ncr1416 | 1039 | ncr1504 | 1099 | ncr1592 | 1159 | ncr1680 |
| 920 | ncr1332 | 980 | ncr1417 | 1040 | ncr1505 | 1100 | ncr1593 | 1160 | ncr1681 |
| 921 | ncr1333 | 981 | ncr1418 | 1041 | ncr1506 | 1101 | ncr1594 | 1161 | ncr1682 |
| 922 | ncr1334 | 982 | ncr1420 | 1042 | ncr1507 | 1102 | ncr1595 | 1162 | ncr1683 |
| 923 | ncr1335 | 983 | ncr1421 | 1043 | ncr1508 | 1103 | ncr1596 | 1163 | ncr1684 |
| 924 | ncr1337 | 984 | ncr1422 | 1044 | ncr1509 | 1104 | ncr1597 | 1164 | ncr1685 |
| 925 | ncr1338 | 985 | ncr1423 | 1045 | ncr1510 | 1105 | ncr1599 | 1165 | ncr1687 |
| 926 | ncr1339 | 986 | ncr1424 | 1046 | ncr1511 | 1106 | ncr1600 | 1166 | ncr1688 |
| 927 | ncr1344 | 987 | ncr1425 | 1047 | ncr1512 | 1107 | ncr1601 | 1167 | ncr1689 |
| 928 | ncr1345 | 988 | ncr1426 | 1048 | ncr1513 | 1108 | ncr1602 | 1168 | ncr1690 |
| 929 | ncr1347 | 989 | ncr1427 | 1049 | ncr1514 | 1109 | ncr1603 | 1169 | ncr1692 |
| 930 | ncr1348 | 990 | ncr1428 | 1050 | ncr1515 | 1110 | ncr1604 | 1170 | ncr1693 |
| 931 | ncr1351 | 991 | ncr1429 | 1051 | ncr1516 | 1111 | ncr1605 | 1171 | ncr1694 |
| 932 | ncr1352 | 992 | ncr1430 | 1052 | ncr1519 | 1112 | ncr1608 | 1172 | ncr1695 |
| 933 | ncr1353 | 993 | ncr1431 | 1053 | ncr1520 | 1113 | ncr1609 | 1173 | ncr1696 |
| 934 | ncr1355 | 994 | ncr1433 | 1054 | ncr1522 | 1114 | ncr1610 | 1174 | ncr1697 |
| 935 | ncr1356 | 995 | ncr1434 | 1055 | ncr1523 | 1115 | ncr1612 | 1175 | ncr1699 |
| 936 | ncr1357 | 996 | ncr1435 | 1056 | ncr1524 | 1116 | ncr1613 | 1176 | ncr1700 |
| 937 | ncr1360 | 997 | ncr1436 | 1057 | ncr1525 | 1117 | ncr1617 | 1177 | ncr1701 |
| 938 | ncr1361 | 998 | ncr1437 | 1058 | ncr1526 | 1118 | ncr1618 | 1178 | ncr1702 |
| 939 | ncr1368 | 999 | ncr1439 | 1059 | ncr1527 | 1119 | ncr1619 | 1179 | ncr1703 |
| 940 | ncr1369 | 1000 | ncr1440 | 1060 | ncr1528 | 1120 | ncr1620 | 1180 | ncr1704 |
| 941 | ncr1370 | 1001 | ncr1444 | 1061 | ncr1529 | 1121 | ncr1622 | 1181 | ncr1707 |
| 942 | ncr1371 | 1002 | ncr1445 | 1062 | ncr1531 | 1122 | ncr1623 | 1182 | ncr1708 |
| 943 | ncr1372 | 1003 | ncr1447 | 1063 | ncr1532 | 1123 | ncr1624 | 1183 | ncr1709 |
| 944 | ncr1373 | 1004 | ncr1449 | 1064 | ncr1533 | 1124 | ncr1627 | 1184 | ncr1710 |
| 945 | ncr1375 | 1005 | ncr1451 | 1065 | ncr1534 | 1125 | ncr1628 | 1185 | ncr1711 |
| 946 | ncr1376 | 1006 | ncr1452 | 1066 | ncr1535 | 1126 | ncr1630 | 1186 | ncr1712 |
| 947 | ncr1377 | 1007 | ncr1455 | 1067 | ncr1536 | 1127 | ncr1631 | 1187 | ncr1713 |
| 948 | ncr1378 | 1008 | ncr1459 | 1068 | ncr1539 | 1128 | ncr1632 | 1188 | ncr1714 |
| 949 | ncr1379 | 1009 | ncr1460 | 1069 | ncr1544 | 1129 | ncr1636 | 1189 | ncr1715 |
| 950 | ncr1380 | 1010 | ncr1461 | 1070 | ncr1545 | 1130 | ncr1637 | 1190 | ncr1716 |
| 951 | ncr1381 | 1011 | ncr1464 | 1071 | ncr1548 | 1131 | ncr1640 | 1191 | ncr1717 |
| 952 | ncr1384 | 1012 | ncr1465 | 1072 | ncr1550 | 1132 | ncr1641 | 1192 | ncr1718 |
| 953 | ncr1386 | 1013 | ncr1466 | 1073 | ncr1551 | 1133 | ncr1644 | 1193 | ncr1719 |
| 954 | ncr1387 | 1014 | ncr1469 | 1074 | ncr1552 | 1134 | ncr1645 | 1194 | ncr1720 |
| 955 | ncr1388 | 1015 | ncr1471 | 1075 | ncr1553 | 1135 | ncr1646 | 1195 | ncr1723 |
| 956 | ncr1389 | 1016 | ncr1473 | 1076 | ncr1555 | 1136 | ncr1648 | 1196 | ncr1724 |
| 957 | ncr1390 | 1017 | ncr1474 | 1077 | ncr1556 | 1137 | ncr1649 | 1197 | ncr1725 |
| 958 | ncr1393 | 1018 | ncr1475 | 1078 | ncr1557 | 1138 | ncr1651 | 1198 | ncr1726 |
| 959 | ncr1394 | 1019 | ncr1476 | 1079 | ncr1559 | 1139 | ncr1652 | 1199 | ncr1727 |
| 960 | ncr1395 | 1020 | ncr1478 | 1080 | ncr1560 | 1140 | ncr1653 | 1200 | ncr1728 |

Figure 6C – List of EST Sequence Names From Normal Cartilage cDNA Library

| | | | | | | | | | |
|---|---|---|---|---|---|---|---|---|---|
| 1201 | ncr1731 | 1261 | ncr1812 | 1321 | ncr1909 | 1381 | ncr2000 | 1441 | ncr2098 |
| 1202 | ncr1732 | 1262 | ncr1813 | 1322 | ncr1910 | 1382 | ncr2001 | 1442 | ncr2099 |
| 1203 | ncr1733 | 1263 | ncr1814 | 1323 | ncr1911 | 1383 | ncr2004 | 1443 | ncr2100 |
| 1204 | ncr1735 | 1264 | ncr1815 | 1324 | ncr1912 | 1384 | ncr2005 | 1444 | ncr2102 |
| 1205 | ncr1736 | 1265 | ncr1816 | 1325 | ncr1913 | 1385 | ncr2006 | 1445 | ncr2104 |
| 1206 | ncr1737 | 1266 | ncr1817 | 1326 | ncr1914 | 1386 | ncr2007 | 1446 | ncr2105 |
| 1207 | ncr1739 | 1267 | ncr1818 | 1327 | ncr1916 | 1387 | ncr2009 | 1447 | ncr2110 |
| 1208 | ncr1741 | 1268 | ncr1819 | 1328 | ncr1917 | 1388 | ncr2010 | 1448 | ncr2112 |
| 1209 | ncr1743 | 1269 | ncr1820 | 1329 | ncr1918 | 1389 | ncr2011 | 1449 | ncr2115 |
| 1210 | ncr1744 | 1270 | ncr1821 | 1330 | ncr1919 | 1390 | ncr2012 | 1450 | ncr2119 |
| 1211 | ncr1745 | 1271 | ncr1822 | 1331 | ncr1920 | 1391 | ncr2013 | 1451 | ncr2123 |
| 1212 | ncr1747 | 1272 | ncr1824 | 1332 | ncr1926 | 1392 | ncr2015 | 1452 | ncr2124 |
| 1213 | ncr1748 | 1273 | ncr1825 | 1333 | ncr1928 | 1393 | ncr2016 | 1453 | ncr2125 |
| 1214 | ncr1749 | 1274 | ncr1832 | 1334 | ncr1929 | 1394 | ncr2019 | 1454 | ncr2127 |
| 1215 | ncr1752 | 1275 | ncr1833 | 1335 | ncr1930 | 1395 | ncr2021 | 1455 | ncr2129 |
| 1216 | ncr1753 | 1276 | ncr1835 | 1336 | ncr1931 | 1396 | ncr2025 | 1456 | ncr2131 |
| 1217 | ncr1754 | 1277 | ncr1839 | 1337 | ncr1932 | 1397 | ncr2029 | 1457 | ncr2135 |
| 1218 | ncr1755 | 1278 | ncr1841 | 1338 | ncr1934 | 1398 | ncr2031 | 1458 | ncr2136 |
| 1219 | ncr1756 | 1279 | ncr1845 | 1339 | ncr1935 | 1399 | ncr2033 | 1459 | ncr2137 |
| 1220 | ncr1757 | 1280 | ncr1847 | 1340 | ncr1936 | 1400 | ncr2035 | 1460 | ncr2138 |
| 1221 | ncr1759 | 1281 | ncr1848 | 1341 | ncr1937 | 1401 | ncr2036 | 1461 | ncr2139 |
| 1222 | ncr1760 | 1282 | ncr1850 | 1342 | ncr1939 | 1402 | ncr2037 | 1462 | ncr2140 |
| 1223 | ncr1763 | 1283 | ncr1851 | 1343 | ncr1940 | 1403 | ncr2039 | 1463 | ncr2141 |
| 1224 | ncr1764 | 1284 | ncr1855 | 1344 | ncr1941 | 1404 | ncr2040 | 1464 | ncr2144 |
| 1225 | ncr1765 | 1285 | ncr1856 | 1345 | ncr1942 | 1405 | ncr2042 | 1465 | ncr2145 |
| 1226 | ncr1766 | 1286 | ncr1858 | 1346 | ncr1944 | 1406 | ncr2044 | 1466 | ncr2146 |
| 1227 | ncr1767 | 1287 | ncr1861 | 1347 | ncr1945 | 1407 | ncr2045 | 1467 | ncr2147 |
| 1228 | ncr1768 | 1288 | ncr1862 | 1348 | ncr1948 | 1408 | ncr2047 | 1468 | ncr2148 |
| 1229 | ncr1771 | 1289 | ncr1863 | 1349 | ncr1949 | 1409 | ncr2048 | 1469 | ncr2149 |
| 1230 | ncr1772 | 1290 | ncr1864 | 1350 | ncr1951 | 1410 | ncr2049 | 1470 | ncr2152 |
| 1231 | ncr1774 | 1291 | ncr1867 | 1351 | ncr1953 | 1411 | ncr2050 | 1471 | ncr2153 |
| 1232 | ncr1777 | 1292 | ncr1868 | 1352 | ncr1954 | 1412 | ncr2051 | 1472 | ncr2156 |
| 1233 | ncr1778 | 1293 | ncr1869 | 1353 | ncr1957 | 1413 | ncr2052 | 1473 | ncr2157 |
| 1234 | ncr1779 | 1294 | ncr1870 | 1354 | ncr1959 | 1414 | ncr2054 | 1474 | ncr2158 |
| 1235 | ncr1780 | 1295 | ncr1871 | 1355 | ncr1964 | 1415 | ncr2055 | 1475 | ncr2159 |
| 1236 | ncr1781 | 1296 | ncr1873 | 1356 | ncr1966 | 1416 | ncr2056 | 1476 | ncr2160 |
| 1237 | ncr1782 | 1297 | ncr1874 | 1357 | ncr1967 | 1417 | ncr2058 | 1477 | ncr2161 |
| 1238 | ncr1783 | 1298 | ncr1875 | 1358 | ncr1969 | 1418 | ncr2059 | 1478 | ncr2163 |
| 1239 | ncr1784 | 1299 | ncr1876 | 1359 | ncr1970 | 1419 | ncr2060 | 1479 | ncr2164 |
| 1240 | ncr1785 | 1300 | ncr1877 | 1360 | ncr1971 | 1420 | ncr2061 | 1480 | ncr2165 |
| 1241 | ncr1786 | 1301 | ncr1879 | 1361 | ncr1972 | 1421 | ncr2062 | 1481 | ncr2168 |
| 1242 | ncr1787 | 1302 | ncr1881 | 1362 | ncr1975 | 1422 | ncr2063 | 1482 | ncr2170 |
| 1243 | ncr1788 | 1303 | ncr1882 | 1363 | ncr1976 | 1423 | ncr2066 | 1483 | ncr2171 |
| 1244 | ncr1789 | 1304 | ncr1883 | 1364 | ncr1977 | 1424 | ncr2068 | 1484 | ncr2172 |
| 1245 | ncr1791 | 1305 | ncr1886 | 1365 | ncr1978 | 1425 | ncr2070 | 1485 | ncr2173 |
| 1246 | ncr1792 | 1306 | ncr1888 | 1366 | ncr1980 | 1426 | ncr2072 | 1486 | ncr2174 |
| 1247 | ncr1793 | 1307 | ncr1889 | 1367 | ncr1981 | 1427 | ncr2073 | 1487 | ncr2175 |
| 1248 | ncr1794 | 1308 | ncr1892 | 1368 | ncr1982 | 1428 | ncr2079 | 1488 | ncr2176 |
| 1249 | ncr1795 | 1309 | ncr1893 | 1369 | ncr1983 | 1429 | ncr2081 | 1489 | ncr2178 |
| 1250 | ncr1797 | 1310 | ncr1894 | 1370 | ncr1984 | 1430 | ncr2083 | 1490 | ncr2179 |
| 1251 | ncr1798 | 1311 | ncr1895 | 1371 | ncr1985 | 1431 | ncr2084 | 1491 | ncr2180 |
| 1252 | ncr1800 | 1312 | ncr1898 | 1372 | ncr1988 | 1432 | ncr2087 | 1492 | ncr2181 |
| 1253 | ncr1802 | 1313 | ncr1900 | 1373 | ncr1989 | 1433 | ncr2088 | 1493 | ncr2182 |
| 1254 | ncr1803 | 1314 | ncr1901 | 1374 | ncr1990 | 1434 | ncr2089 | 1494 | ncr2186 |
| 1255 | ncr1804 | 1315 | ncr1903 | 1375 | ncr1992 | 1435 | ncr2091 | 1495 | ncr2187 |
| 1256 | ncr1805 | 1316 | ncr1904 | 1376 | ncr1993 | 1436 | ncr2092 | 1496 | ncr2188 |
| 1257 | ncr1806 | 1317 | ncr1905 | 1377 | ncr1994 | 1437 | ncr2094 | 1497 | ncr2189 |
| 1258 | ncr1808 | 1318 | ncr1906 | 1378 | ncr1996 | 1438 | ncr2095 | 1498 | ncr2190 |
| 1259 | ncr1809 | 1319 | ncr1907 | 1379 | ncr1997 | 1439 | ncr2096 | 1499 | ncr2191 |
| 1260 | ncr1811 | 1320 | ncr1908 | 1380 | ncr1999 | 1440 | ncr2097 | 1500 | ncr2193 |

Figure 6C – List of EST Sequence Names From Normal Cartilage cDNA Library

| | | | | | | | | | |
|---|---|---|---|---|---|---|---|---|---|
| 1501 | ncr2194 | 1561 | ncr2282 | 1621 | ncr2377 | 1681 | ncr2462 | 1741 | ncr2544 |
| 1502 | ncr2195 | 1562 | ncr2283 | 1622 | ncr2379 | 1682 | ncr2463 | 1742 | ncr2545 |
| 1503 | ncr2197 | 1563 | ncr2284 | 1623 | ncr2380 | 1683 | ncr2464 | 1743 | ncr2547 |
| 1504 | ncr2198 | 1564 | ncr2285 | 1624 | ncr2381 | 1684 | ncr2465 | 1744 | ncr2549 |
| 1505 | ncr2199 | 1565 | ncr2286 | 1625 | ncr2382 | 1685 | ncr2466 | 1745 | ncr2550 |
| 1506 | ncr2201 | 1566 | ncr2287 | 1626 | ncr2383 | 1686 | ncr2467 | 1746 | ncr2553 |
| 1507 | ncr2203 | 1567 | ncr2288 | 1627 | ncr2384 | 1687 | ncr2469 | 1747 | ncr2554 |
| 1508 | ncr2205 | 1568 | ncr2289 | 1628 | ncr2386 | 1688 | ncr2470 | 1748 | ncr2556 |
| 1509 | ncr2206 | 1569 | ncr2290 | 1629 | ncr2387 | 1689 | ncr2472 | 1749 | ncr2559 |
| 1510 | ncr2207 | 1570 | ncr2291 | 1630 | ncr2388 | 1690 | ncr2473 | 1750 | ncr2560 |
| 1511 | ncr2208 | 1571 | ncr2292 | 1631 | ncr2389 | 1691 | ncr2474 | 1751 | ncr2561 |
| 1512 | ncr2212 | 1572 | ncr2293 | 1632 | ncr2391 | 1692 | ncr2475 | 1752 | ncr2563 |
| 1513 | ncr2213 | 1573 | ncr2294 | 1633 | ncr2392 | 1693 | ncr2476 | 1753 | ncr2564 |
| 1514 | ncr2215 | 1574 | ncr2296 | 1634 | ncr2394 | 1694 | ncr2477 | 1754 | ncr2566 |
| 1515 | ncr2217 | 1575 | ncr2297 | 1635 | ncr2395 | 1695 | ncr2478 | 1755 | ncr2567 |
| 1516 | ncr2219 | 1576 | ncr2298 | 1636 | ncr2396 | 1696 | ncr2480 | 1756 | ncr2568 |
| 1517 | ncr2220 | 1577 | ncr2300 | 1637 | ncr2397 | 1697 | ncr2481 | 1757 | ncr2569 |
| 1518 | ncr2221 | 1578 | ncr2301 | 1638 | ncr2398 | 1698 | ncr2482 | 1758 | ncr2570 |
| 1519 | ncr2223 | 1579 | ncr2302 | 1639 | ncr2400 | 1699 | ncr2483 | 1759 | ncr2571 |
| 1520 | ncr2224 | 1580 | ncr2304 | 1640 | ncr2404 | 1700 | ncr2484 | 1760 | ncr2573 |
| 1521 | ncr2225 | 1581 | ncr2307 | 1641 | ncr2407 | 1701 | ncr2486 | 1761 | ncr2574 |
| 1522 | ncr2227 | 1582 | ncr2308 | 1642 | ncr2408 | 1702 | ncr2487 | 1762 | ncr2575 |
| 1523 | ncr2228 | 1583 | ncr2309 | 1643 | ncr2409 | 1703 | ncr2488 | 1763 | ncr2576 |
| 1524 | ncr2231 | 1584 | ncr2312 | 1644 | ncr2411 | 1704 | ncr2489 | 1764 | ncr2577 |
| 1525 | ncr2232 | 1585 | ncr2315 | 1645 | ncr2413 | 1705 | ncr2490 | 1765 | ncr2579 |
| 1526 | ncr2233 | 1586 | ncr2318 | 1646 | ncr2415 | 1706 | ncr2492 | 1766 | ncr2580 |
| 1527 | ncr2234 | 1587 | ncr2319 | 1647 | ncr2417 | 1707 | ncr2493 | 1767 | ncr2581 |
| 1528 | ncr2237 | 1588 | ncr2321 | 1648 | ncr2419 | 1708 | ncr2494 | 1768 | ncr2583 |
| 1529 | ncr2239 | 1589 | ncr2324 | 1649 | ncr2421 | 1709 | ncr2495 | 1769 | ncr2584 |
| 1530 | ncr2240 | 1590 | ncr2328 | 1650 | ncr2422 | 1710 | ncr2496 | 1770 | ncr2585 |
| 1531 | ncr2241 | 1591 | ncr2329 | 1651 | ncr2423 | 1711 | ncr2499 | 1771 | ncr2586 |
| 1532 | ncr2242 | 1592 | ncr2330 | 1652 | ncr2425 | 1712 | ncr2501 | 1772 | ncr2587 |
| 1533 | ncr2243 | 1593 | ncr2335 | 1653 | ncr2426 | 1713 | ncr2503 | 1773 | ncr2588 |
| 1534 | ncr2245 | 1594 | ncr2337 | 1654 | ncr2427 | 1714 | ncr2505 | 1774 | ncr2589 |
| 1535 | ncr2248 | 1595 | ncr2339 | 1655 | ncr2428 | 1715 | ncr2507 | 1775 | ncr2590 |
| 1536 | ncr2250 | 1596 | ncr2341 | 1656 | ncr2429 | 1716 | ncr2508 | 1776 | ncr2591 |
| 1537 | ncr2251 | 1597 | ncr2343 | 1657 | ncr2430 | 1717 | ncr2511 | 1777 | ncr2594 |
| 1538 | ncr2252 | 1598 | ncr2344 | 1658 | ncr2431 | 1718 | ncr2512 | 1778 | ncr2595 |
| 1539 | ncr2253 | 1599 | ncr2349 | 1659 | ncr2432 | 1719 | ncr2513 | 1779 | ncr2596 |
| 1540 | ncr2254 | 1600 | ncr2350 | 1660 | ncr2433 | 1720 | ncr2516 | 1780 | ncr2599 |
| 1541 | ncr2255 | 1601 | ncr2351 | 1661 | ncr2434 | 1721 | ncr2519 | 1781 | ncr2600 |
| 1542 | ncr2256 | 1602 | ncr2352 | 1662 | ncr2437 | 1722 | ncr2520 | 1782 | ncr2601 |
| 1543 | ncr2257 | 1603 | ncr2353 | 1663 | ncr2440 | 1723 | ncr2522 | 1783 | ncr2603 |
| 1544 | ncr2258 | 1604 | ncr2354 | 1664 | ncr2442 | 1724 | ncr2523 | 1784 | ncr2604 |
| 1545 | ncr2260 | 1605 | ncr2355 | 1665 | ncr2443 | 1725 | ncr2524 | 1785 | ncr2605 |
| 1546 | ncr2261 | 1606 | ncr2358 | 1666 | ncr2447 | 1726 | ncr2525 | 1786 | ncr2607 |
| 1547 | ncr2262 | 1607 | ncr2359 | 1667 | ncr2448 | 1727 | ncr2527 | 1787 | ncr2608 |
| 1548 | ncr2264 | 1608 | ncr2360 | 1668 | ncr2449 | 1728 | ncr2528 | 1788 | ncr2609 |
| 1549 | ncr2265 | 1609 | ncr2361 | 1669 | ncr2450 | 1729 | ncr2530 | 1789 | ncr2612 |
| 1550 | ncr2267 | 1610 | ncr2363 | 1670 | ncr2451 | 1730 | ncr2531 | 1790 | ncr2613 |
| 1551 | ncr2268 | 1611 | ncr2365 | 1671 | ncr2452 | 1731 | ncr2532 | 1791 | ncr2616 |
| 1552 | ncr2269 | 1612 | ncr2366 | 1672 | ncr2453 | 1732 | ncr2533 | 1792 | ncr2617 |
| 1553 | ncr2270 | 1613 | ncr2367 | 1673 | ncr2454 | 1733 | ncr2534 | 1793 | ncr2619 |
| 1554 | ncr2272 | 1614 | ncr2368 | 1674 | ncr2455 | 1734 | ncr2535 | 1794 | ncr2620 |
| 1555 | ncr2273 | 1615 | ncr2369 | 1675 | ncr2456 | 1735 | ncr2536 | 1795 | ncr2621 |
| 1556 | ncr2275 | 1616 | ncr2370 | 1676 | ncr2457 | 1736 | ncr2538 | 1796 | ncr2623 |
| 1557 | ncr2277 | 1617 | ncr2371 | 1677 | ncr2458 | 1737 | ncr2539 | 1797 | ncr2624 |
| 1558 | ncr2278 | 1618 | ncr2373 | 1678 | ncr2459 | 1738 | ncr2540 | 1798 | ncr2628 |
| 1559 | ncr2280 | 1619 | ncr2375 | 1679 | ncr2460 | 1739 | ncr2541 | 1799 | ncr2629 |
| 1560 | ncr2281 | 1620 | ncr2376 | 1680 | ncr2461 | 1740 | ncr2543 | 1800 | ncr2631 |

Figure 6C – List of EST Sequence Names From Normal Cartilage cDNA Library

| | | | | | | | | | |
|---|---|---|---|---|---|---|---|---|---|
| 1801 | ncr2632 | 1861 | ncr2728 | 1921 | ncr2823 | 1981 | ncr2911 | 2041 | ncr2997 |
| 1802 | ncr2634 | 1862 | ncr2730 | 1922 | ncr2824 | 1982 | ncr2913 | 2042 | ncr2999 |
| 1803 | ncr2635 | 1863 | ncr2731 | 1923 | ncr2826 | 1983 | ncr2916 | 2043 | ncr3000 |
| 1804 | ncr2636 | 1864 | ncr2732 | 1924 | ncr2827 | 1984 | ncr2918 | 2044 | ncr3001 |
| 1805 | ncr2638 | 1865 | ncr2733 | 1925 | ncr2829 | 1985 | ncr2920 | 2045 | ncr3002 |
| 1806 | ncr2639 | 1866 | ncr2734 | 1926 | ncr2830 | 1986 | ncr2922 | 2046 | ncr3003 |
| 1807 | ncr2640 | 1867 | ncr2735 | 1927 | ncr2832 | 1987 | ncr2923 | 2047 | ncr3005 |
| 1808 | ncr2642 | 1868 | ncr2736 | 1928 | ncr2833 | 1988 | ncr2925 | 2048 | ncr3007 |
| 1809 | ncr2643 | 1869 | ncr2737 | 1929 | ncr2834 | 1989 | ncr2926 | 2049 | ncr3008 |
| 1810 | ncr2644 | 1870 | ncr2738 | 1930 | ncr2835 | 1990 | ncr2927 | 2050 | ncr3012 |
| 1811 | ncr2645 | 1871 | ncr2739 | 1931 | ncr2836 | 1991 | ncr2928 | 2051 | ncr3013 |
| 1812 | ncr2646 | 1872 | ncr2740 | 1932 | ncr2837 | 1992 | ncr2929 | 2052 | ncr3015 |
| 1813 | ncr2647 | 1873 | ncr2743 | 1933 | ncr2838 | 1993 | ncr2930 | 2053 | ncr3016 |
| 1814 | ncr2648 | 1874 | ncr2749 | 1934 | ncr2840 | 1994 | ncr2931 | 2054 | ncr3017 |
| 1815 | ncr2650 | 1875 | ncr2750 | 1935 | ncr2842 | 1995 | ncr2932 | 2055 | ncr3018 |
| 1816 | ncr2652 | 1876 | ncr2751 | 1936 | ncr2844 | 1996 | ncr2934 | 2056 | ncr3019 |
| 1817 | ncr2653 | 1877 | ncr2752 | 1937 | ncr2845 | 1997 | ncr2935 | 2057 | ncr3020 |
| 1818 | ncr2654 | 1878 | ncr2756 | 1938 | ncr2847 | 1998 | ncr2936 | 2058 | ncr3021 |
| 1819 | ncr2657 | 1879 | ncr2757 | 1939 | ncr2848 | 1999 | ncr2937 | 2059 | ncr3022 |
| 1820 | ncr2658 | 1880 | ncr2760 | 1940 | ncr2850 | 2000 | ncr2939 | 2060 | ncr3023 |
| 1821 | ncr2659 | 1881 | ncr2761 | 1941 | ncr2851 | 2001 | ncr2940 | 2061 | ncr3024 |
| 1822 | ncr2660 | 1882 | ncr2762 | 1942 | ncr2853 | 2002 | ncr2942 | 2062 | ncr3026 |
| 1823 | ncr2662 | 1883 | ncr2763 | 1943 | ncr2854 | 2003 | ncr2944 | 2063 | ncr3027 |
| 1824 | ncr2663 | 1884 | ncr2764 | 1944 | ncr2855 | 2004 | ncr2945 | 2064 | ncr3028 |
| 1825 | ncr2664 | 1885 | ncr2765 | 1945 | ncr2856 | 2005 | ncr2946 | 2065 | ncr3029 |
| 1826 | ncr2665 | 1886 | ncr2767 | 1946 | ncr2857 | 2006 | ncr2947 | 2066 | ncr3030 |
| 1827 | ncr2666 | 1887 | ncr2768 | 1947 | ncr2859 | 2007 | ncr2949 | 2067 | ncr3031 |
| 1828 | ncr2668 | 1888 | ncr2770 | 1948 | ncr2861 | 2008 | ncr2951 | 2068 | ncr3032 |
| 1829 | ncr2670 | 1889 | ncr2771 | 1949 | ncr2862 | 2009 | ncr2952 | 2069 | ncr3033 |
| 1830 | ncr2671 | 1890 | ncr2772 | 1950 | ncr2863 | 2010 | ncr2953 | 2070 | ncr3034 |
| 1831 | ncr2679 | 1891 | ncr2773 | 1951 | ncr2864 | 2011 | ncr2954 | 2071 | ncr3035 |
| 1832 | ncr2681 | 1892 | ncr2774 | 1952 | ncr2865 | 2012 | ncr2955 | 2072 | ncr3036 |
| 1833 | ncr2682 | 1893 | ncr2775 | 1953 | ncr2866 | 2013 | ncr2956 | 2073 | ncr3037 |
| 1834 | ncr2684 | 1894 | ncr2776 | 1954 | ncr2867 | 2014 | ncr2957 | 2074 | ncr3038 |
| 1835 | ncr2685 | 1895 | ncr2778 | 1955 | ncr2868 | 2015 | ncr2958 | 2075 | ncr3039 |
| 1836 | ncr2687 | 1896 | ncr2779 | 1956 | ncr2869 | 2016 | ncr2961 | 2076 | ncr3040 |
| 1837 | ncr2691 | 1897 | ncr2780 | 1957 | ncr2870 | 2017 | ncr2963 | 2077 | ncr3041 |
| 1838 | ncr2692 | 1898 | ncr2783 | 1958 | ncr2872 | 2018 | ncr2964 | 2078 | ncr3042 |
| 1839 | ncr2693 | 1899 | ncr2784 | 1959 | ncr2873 | 2019 | ncr2965 | 2079 | ncr3044 |
| 1840 | ncr2695 | 1900 | ncr2785 | 1960 | ncr2874 | 2020 | ncr2966 | 2080 | ncr3045 |
| 1841 | ncr2696 | 1901 | ncr2789 | 1961 | ncr2876 | 2021 | ncr2967 | 2081 | ncr3046 |
| 1842 | ncr2697 | 1902 | ncr2792 | 1962 | ncr2877 | 2022 | ncr2968 | 2082 | ncr3047 |
| 1843 | ncr2698 | 1903 | ncr2793 | 1963 | ncr2878 | 2023 | ncr2969 | 2083 | ncr3048 |
| 1844 | ncr2700 | 1904 | ncr2795 | 1964 | ncr2879 | 2024 | ncr2971 | 2084 | ncr3049 |
| 1845 | ncr2701 | 1905 | ncr2797 | 1965 | ncr2880 | 2025 | ncr2972 | 2085 | ncr3050 |
| 1846 | ncr2703 | 1906 | ncr2798 | 1966 | ncr2883 | 2026 | ncr2973 | 2086 | ncr3051 |
| 1847 | ncr2705 | 1907 | ncr2801 | 1967 | ncr2885 | 2027 | ncr2974 | 2087 | ncr3052 |
| 1848 | ncr2707 | 1908 | ncr2803 | 1968 | ncr2888 | 2028 | ncr2975 | 2088 | ncr3053 |
| 1849 | ncr2708 | 1909 | ncr2805 | 1969 | ncr2892 | 2029 | ncr2976 | 2089 | ncr3055 |
| 1850 | ncr2712 | 1910 | ncr2807 | 1970 | ncr2893 | 2030 | ncr2977 | 2090 | ncr3058 |
| 1851 | ncr2713 | 1911 | ncr2808 | 1971 | ncr2895 | 2031 | ncr2979 | 2091 | ncr3059 |
| 1852 | ncr2714 | 1912 | ncr2809 | 1972 | ncr2896 | 2032 | ncr2982 | 2092 | ncr3060 |
| 1853 | ncr2715 | 1913 | ncr2810 | 1973 | ncr2898 | 2033 | ncr2983 | 2093 | ncr3061 |
| 1854 | ncr2717 | 1914 | ncr2811 | 1974 | ncr2899 | 2034 | ncr2984 | 2094 | ncr3062 |
| 1855 | ncr2721 | 1915 | ncr2812 | 1975 | ncr2901 | 2035 | ncr2987 | 2095 | ncr3063 |
| 1856 | ncr2722 | 1916 | ncr2813 | 1976 | ncr2905 | 2036 | ncr2990 | 2096 | ncr3065 |
| 1857 | ncr2723 | 1917 | ncr2815 | 1977 | ncr2906 | 2037 | ncr2993 | 2097 | ncr3066 |
| 1858 | ncr2724 | 1918 | ncr2817 | 1978 | ncr2908 | 2038 | ncr2994 | 2098 | ncr3068 |
| 1859 | ncr2725 | 1919 | ncr2818 | 1979 | ncr2909 | 2039 | ncr2995 | 2099 | ncr3070 |
| 1860 | ncr2727 | 1920 | ncr2820 | 1980 | ncr2910 | 2040 | ncr2996 | 2100 | ncr3071 |

Figure 6C – List of EST Sequence Names From Normal Cartilage cDNA Library

| | | | | | | | | | |
|---|---|---|---|---|---|---|---|---|---|
| 2101 | ncr3072 | 2161 | ncr3159 | 2221 | ncr3240 | 2281 | ncr3333 | 2341 | ncr3423 |
| 2102 | ncr3073 | 2162 | ncr3160 | 2222 | ncr3241 | 2282 | ncr3338 | 2342 | ncr3429 |
| 2103 | ncr3075 | 2163 | ncr3162 | 2223 | ncr3242 | 2283 | ncr3339 | 2343 | ncr3431 |
| 2104 | ncr3076 | 2164 | ncr3163 | 2224 | ncr3244 | 2284 | ncr3340 | 2344 | ncr3432 |
| 2105 | ncr3077 | 2165 | ncr3164 | 2225 | ncr3245 | 2285 | ncr3341 | 2345 | ncr3433 |
| 2106 | ncr3079 | 2166 | ncr3165 | 2226 | ncr3246 | 2286 | ncr3343 | 2346 | ncr3434 |
| 2107 | ncr3080 | 2167 | ncr3167 | 2227 | ncr3248 | 2287 | ncr3345 | 2347 | ncr3435 |
| 2108 | ncr3083 | 2168 | ncr3168 | 2228 | ncr3249 | 2288 | ncr3346 | 2348 | ncr3436 |
| 2109 | ncr3084 | 2169 | ncr3169 | 2229 | ncr3250 | 2289 | ncr3348 | 2349 | ncr3437 |
| 2110 | ncr3085 | 2170 | ncr3171 | 2230 | ncr3251 | 2290 | ncr3349 | 2350 | ncr3441 |
| 2111 | ncr3087 | 2171 | ncr3172 | 2231 | ncr3252 | 2291 | ncr3350 | 2351 | ncr3442 |
| 2112 | ncr3088 | 2172 | ncr3177 | 2232 | ncr3253 | 2292 | ncr3352 | 2352 | ncr3443 |
| 2113 | ncr3090 | 2173 | ncr3179 | 2233 | ncr3254 | 2293 | ncr3356 | 2353 | ncr3444 |
| 2114 | ncr3091 | 2174 | ncr3181 | 2234 | ncr3255 | 2294 | ncr3357 | 2354 | ncr3445 |
| 2115 | ncr3092 | 2175 | ncr3182 | 2235 | ncr3257 | 2295 | ncr3358 | 2355 | ncr3452 |
| 2116 | ncr3093 | 2176 | ncr3184 | 2236 | ncr3258 | 2296 | ncr3359 | 2356 | ncr3454 |
| 2117 | ncr3096 | 2177 | ncr3185 | 2237 | ncr3259 | 2297 | ncr3360 | 2357 | ncr3455 |
| 2118 | ncr3097 | 2178 | ncr3186 | 2238 | ncr3260 | 2298 | ncr3361 | 2358 | ncr3456 |
| 2119 | ncr3100 | 2179 | ncr3188 | 2239 | ncr3262 | 2299 | ncr3363 | 2359 | ncr3457 |
| 2120 | ncr3101 | 2180 | ncr3189 | 2240 | ncr3263 | 2300 | ncr3365 | 2360 | ncr3459 |
| 2121 | ncr3103 | 2181 | ncr3191 | 2241 | ncr3264 | 2301 | ncr3368 | 2361 | ncr3460 |
| 2122 | ncr3104 | 2182 | ncr3192 | 2242 | ncr3267 | 2302 | ncr3369 | 2362 | ncr3464 |
| 2123 | ncr3105 | 2183 | ncr3193 | 2243 | ncr3268 | 2303 | ncr3370 | 2363 | ncr3465 |
| 2124 | ncr3106 | 2184 | ncr3194 | 2244 | ncr3271 | 2304 | ncr3372 | 2364 | ncr3467 |
| 2125 | ncr3107 | 2185 | ncr3195 | 2245 | ncr3272 | 2305 | ncr3373 | 2365 | ncr3468 |
| 2126 | ncr3109 | 2186 | ncr3196 | 2246 | ncr3276 | 2306 | ncr3375 | 2366 | ncr3469 |
| 2127 | ncr3110 | 2187 | ncr3197 | 2247 | ncr3281 | 2307 | ncr3376 | 2367 | ncr3471 |
| 2128 | ncr3112 | 2188 | ncr3199 | 2248 | ncr3284 | 2308 | ncr3378 | 2368 | ncr3473 |
| 2129 | ncr3113 | 2189 | ncr3201 | 2249 | ncr3285 | 2309 | ncr3379 | 2369 | ncr3474 |
| 2130 | ncr3115 | 2190 | ncr3202 | 2250 | ncr3286 | 2310 | ncr3380 | 2370 | ncr3475 |
| 2131 | ncr3116 | 2191 | ncr3203 | 2251 | ncr3287 | 2311 | ncr3381 | 2371 | ncr3476 |
| 2132 | ncr3117 | 2192 | ncr3204 | 2252 | ncr3288 | 2312 | ncr3383 | 2372 | ncr3477 |
| 2133 | ncr3118 | 2193 | ncr3206 | 2253 | ncr3290 | 2313 | ncr3384 | 2373 | ncr3479 |
| 2134 | ncr3119 | 2194 | ncr3207 | 2254 | ncr3291 | 2314 | ncr3385 | 2374 | ncr3482 |
| 2135 | ncr3120 | 2195 | ncr3208 | 2255 | ncr3292 | 2315 | ncr3386 | 2375 | ncr3483 |
| 2136 | ncr3121 | 2196 | ncr3209 | 2256 | ncr3295 | 2316 | ncr3389 | 2376 | ncr3485 |
| 2137 | ncr3122 | 2197 | ncr3210 | 2257 | ncr3297 | 2317 | ncr3391 | 2377 | ncr3488 |
| 2138 | ncr3123 | 2198 | ncr3211 | 2258 | ncr3299 | 2318 | ncr3393 | 2378 | ncr3489 |
| 2139 | ncr3124 | 2199 | ncr3213 | 2259 | ncr3301 | 2319 | ncr3394 | 2379 | ncr3490 |
| 2140 | ncr3125 | 2200 | ncr3214 | 2260 | ncr3302 | 2320 | ncr3395 | 2380 | ncr3491 |
| 2141 | ncr3126 | 2201 | ncr3215 | 2261 | ncr3304 | 2321 | ncr3396 | 2381 | ncr3492 |
| 2142 | ncr3128 | 2202 | ncr3216 | 2262 | ncr3305 | 2322 | ncr3397 | 2382 | ncr3493 |
| 2143 | ncr3130 | 2203 | ncr3217 | 2263 | ncr3306 | 2323 | ncr3398 | 2383 | ncr3494 |
| 2144 | ncr3135 | 2204 | ncr3218 | 2264 | ncr3308 | 2324 | ncr3400 | 2384 | ncr3495 |
| 2145 | ncr3137 | 2205 | ncr3219 | 2265 | ncr3311 | 2325 | ncr3401 | 2385 | ncr3496 |
| 2146 | ncr3138 | 2206 | ncr3220 | 2266 | ncr3312 | 2326 | ncr3402 | 2386 | ncr3498 |
| 2147 | ncr3139 | 2207 | ncr3223 | 2267 | ncr3313 | 2327 | ncr3404 | 2387 | ncr3499 |
| 2148 | ncr3140 | 2208 | ncr3224 | 2268 | ncr3314 | 2328 | ncr3405 | 2388 | ncr3500 |
| 2149 | ncr3141 | 2209 | ncr3225 | 2269 | ncr3315 | 2329 | ncr3407 | 2389 | ncr3501 |
| 2150 | ncr3143 | 2210 | ncr3226 | 2270 | ncr3316 | 2330 | ncr3409 | 2390 | ncr3502 |
| 2151 | ncr3144 | 2211 | ncr3229 | 2271 | ncr3318 | 2331 | ncr3411 | 2391 | ncr3503 |
| 2152 | ncr3145 | 2212 | ncr3230 | 2272 | ncr3319 | 2332 | ncr3412 | 2392 | ncr3506 |
| 2153 | ncr3147 | 2213 | ncr3231 | 2273 | ncr3322 | 2333 | ncr3414 | 2393 | ncr3507 |
| 2154 | ncr3148 | 2214 | ncr3233 | 2274 | ncr3324 | 2334 | ncr3415 | 2394 | ncr3508 |
| 2155 | ncr3149 | 2215 | ncr3234 | 2275 | ncr3325 | 2335 | ncr3416 | 2395 | ncr3509 |
| 2156 | ncr3150 | 2216 | ncr3235 | 2276 | ncr3326 | 2336 | ncr3417 | 2396 | ncr3510 |
| 2157 | ncr3152 | 2217 | ncr3236 | 2277 | ncr3327 | 2337 | ncr3419 | 2397 | ncr3511 |
| 2158 | ncr3154 | 2218 | ncr3237 | 2278 | ncr3328 | 2338 | ncr3420 | 2398 | ncr3516 |
| 2159 | ncr3156 | 2219 | ncr3238 | 2279 | ncr3330 | 2339 | ncr3421 | 2399 | ncr3519 |
| 2160 | ncr3158 | 2220 | ncr3239 | 2280 | ncr3332 | 2340 | ncr3422 | 2400 | ncr3520 |

Figure 6C – List of EST Sequence Names From Normal Cartilage cDNA Library

| | | | | | | | | | |
|---|---|---|---|---|---|---|---|---|---|
| 2401 | ncr3522 | 2461 | ncr3609 | 2521 | ncr3696 | 2581 | ncr3780 | 2641 | ncr3858 |
| 2402 | ncr3523 | 2462 | ncr3610 | 2522 | ncr3697 | 2582 | ncr3781 | 2642 | ncr3859 |
| 2403 | ncr3524 | 2463 | ncr3611 | 2523 | ncr3698 | 2583 | ncr3782 | 2643 | ncr3861 |
| 2404 | ncr3525 | 2464 | ncr3612 | 2524 | ncr3699 | 2584 | ncr3783 | 2644 | ncr3863 |
| 2405 | ncr3526 | 2465 | ncr3613 | 2525 | ncr3700 | 2585 | ncr3785 | 2645 | ncr3864 |
| 2406 | ncr3527 | 2466 | ncr3614 | 2526 | ncr3701 | 2586 | ncr3787 | 2646 | ncr3865 |
| 2407 | ncr3528 | 2467 | ncr3615 | 2527 | ncr3702 | 2587 | ncr3788 | 2647 | ncr3868 |
| 2408 | ncr3529 | 2468 | ncr3616 | 2528 | ncr3704 | 2588 | ncr3789 | 2648 | ncr3869 |
| 2409 | ncr3530 | 2469 | ncr3617 | 2529 | ncr3705 | 2589 | ncr3790 | 2649 | ncr3871 |
| 2410 | ncr3532 | 2470 | ncr3619 | 2530 | ncr3706 | 2590 | ncr3791 | 2650 | ncr3872 |
| 2411 | ncr3534 | 2471 | ncr3620 | 2531 | ncr3707 | 2591 | ncr3793 | 2651 | ncr3874 |
| 2412 | ncr3535 | 2472 | ncr3622 | 2532 | ncr3709 | 2592 | ncr3794 | 2652 | ncr3876 |
| 2413 | ncr3537 | 2473 | ncr3623 | 2533 | ncr3710 | 2593 | ncr3795 | 2653 | ncr3877 |
| 2414 | ncr3538 | 2474 | ncr3624 | 2534 | ncr3713 | 2594 | ncr3797 | 2654 | ncr3878 |
| 2415 | ncr3539 | 2475 | ncr3626 | 2535 | ncr3714 | 2595 | ncr3798 | 2655 | ncr3879 |
| 2416 | ncr3541 | 2476 | ncr3627 | 2536 | ncr3715 | 2596 | ncr3799 | 2656 | ncr3880 |
| 2417 | ncr3544 | 2477 | ncr3628 | 2537 | ncr3716 | 2597 | ncr3800 | 2657 | ncr3882 |
| 2418 | ncr3545 | 2478 | ncr3630 | 2538 | ncr3717 | 2598 | ncr3803 | 2658 | ncr3883 |
| 2419 | ncr3549 | 2479 | ncr3631 | 2539 | ncr3718 | 2599 | ncr3804 | 2659 | ncr3885 |
| 2420 | ncr3550 | 2480 | ncr3635 | 2540 | ncr3720 | 2600 | ncr3805 | 2660 | ncr3886 |
| 2421 | ncr3551 | 2481 | ncr3636 | 2541 | ncr3722 | 2601 | ncr3806 | 2661 | ncr3887 |
| 2422 | ncr3553 | 2482 | ncr3640 | 2542 | ncr3724 | 2602 | ncr3807 | 2662 | ncr3891 |
| 2423 | ncr3556 | 2483 | ncr3641 | 2543 | ncr3725 | 2603 | ncr3808 | 2663 | ncr3893 |
| 2424 | ncr3557 | 2484 | ncr3642 | 2544 | ncr3726 | 2604 | ncr3809 | 2664 | ncr3896 |
| 2425 | ncr3559 | 2485 | ncr3644 | 2545 | ncr3727 | 2605 | ncr3810 | 2665 | ncr3899 |
| 2426 | ncr3560 | 2486 | ncr3646 | 2546 | ncr3728 | 2606 | ncr3811 | 2666 | ncr3900 |
| 2427 | ncr3564 | 2487 | ncr3648 | 2547 | ncr3729 | 2607 | ncr3814 | 2667 | ncr3901 |
| 2428 | ncr3565 | 2488 | ncr3649 | 2548 | ncr3730 | 2608 | ncr3815 | 2668 | ncr3902 |
| 2429 | ncr3566 | 2489 | ncr3651 | 2549 | ncr3731 | 2609 | ncr3816 | 2669 | ncr3903 |
| 2430 | ncr3568 | 2490 | ncr3652 | 2550 | ncr3732 | 2610 | ncr3818 | 2670 | ncr3906 |
| 2431 | ncr3569 | 2491 | ncr3653 | 2551 | ncr3733 | 2611 | ncr3819 | 2671 | ncr3907 |
| 2432 | ncr3570 | 2492 | ncr3655 | 2552 | ncr3734 | 2612 | ncr3820 | 2672 | ncr3908 |
| 2433 | ncr3571 | 2493 | ncr3656 | 2553 | ncr3735 | 2613 | ncr3821 | 2673 | ncr3909 |
| 2434 | ncr3573 | 2494 | ncr3657 | 2554 | ncr3736 | 2614 | ncr3824 | 2674 | ncr3911 |
| 2435 | ncr3575 | 2495 | ncr3658 | 2555 | ncr3738 | 2615 | ncr3825 | 2675 | ncr3912 |
| 2436 | ncr3576 | 2496 | ncr3660 | 2556 | ncr3739 | 2616 | ncr3826 | 2676 | ncr3913 |
| 2437 | ncr3577 | 2497 | ncr3661 | 2557 | ncr3740 | 2617 | ncr3827 | 2677 | ncr3914 |
| 2438 | ncr3578 | 2498 | ncr3664 | 2558 | ncr3743 | 2618 | ncr3828 | 2678 | ncr3915 |
| 2439 | ncr3579 | 2499 | ncr3665 | 2559 | ncr3744 | 2619 | ncr3829 | 2679 | ncr3916 |
| 2440 | ncr3580 | 2500 | ncr3667 | 2560 | ncr3745 | 2620 | ncr3830 | 2680 | ncr3917 |
| 2441 | ncr3581 | 2501 | ncr3668 | 2561 | ncr3748 | 2621 | ncr3831 | 2681 | ncr3918 |
| 2442 | ncr3585 | 2502 | ncr3669 | 2562 | ncr3751 | 2622 | ncr3832 | 2682 | ncr3919 |
| 2443 | ncr3587 | 2503 | ncr3671 | 2563 | ncr3752 | 2623 | ncr3833 | 2683 | ncr3920 |
| 2444 | ncr3588 | 2504 | ncr3673 | 2564 | ncr3753 | 2624 | ncr3834 | 2684 | ncr3922 |
| 2445 | ncr3589 | 2505 | ncr3674 | 2565 | ncr3755 | 2625 | ncr3835 | 2685 | ncr3925 |
| 2446 | ncr3590 | 2506 | ncr3675 | 2566 | ncr3757 | 2626 | ncr3837 | 2686 | ncr3926 |
| 2447 | ncr3591 | 2507 | ncr3676 | 2567 | ncr3761 | 2627 | ncr3839 | 2687 | ncr3927 |
| 2448 | ncr3592 | 2508 | ncr3677 | 2568 | ncr3762 | 2628 | ncr3840 | 2688 | ncr3933 |
| 2449 | ncr3594 | 2509 | ncr3680 | 2569 | ncr3763 | 2629 | ncr3841 | 2689 | ncr3934 |
| 2450 | ncr3596 | 2510 | ncr3682 | 2570 | ncr3764 | 2630 | ncr3843 | 2690 | ncr3935 |
| 2451 | ncr3597 | 2511 | ncr3683 | 2571 | ncr3765 | 2631 | ncr3845 | 2691 | ncr3936 |
| 2452 | ncr3598 | 2512 | ncr3684 | 2572 | ncr3767 | 2632 | ncr3847 | 2692 | ncr3937 |
| 2453 | ncr3599 | 2513 | ncr3685 | 2573 | ncr3768 | 2633 | ncr3849 | 2693 | ncr3940 |
| 2454 | ncr3602 | 2514 | ncr3686 | 2574 | ncr3771 | 2634 | ncr3851 | 2694 | ncr3941 |
| 2455 | ncr3603 | 2515 | ncr3687 | 2575 | ncr3772 | 2635 | ncr3852 | 2695 | ncr3943 |
| 2456 | ncr3604 | 2516 | ncr3688 | 2576 | ncr3775 | 2636 | ncr3853 | 2696 | ncr3944 |
| 2457 | ncr3605 | 2517 | ncr3690 | 2577 | ncr3776 | 2637 | ncr3854 | 2697 | ncr3945 |
| 2458 | ncr3606 | 2518 | ncr3691 | 2578 | ncr3777 | 2638 | ncr3855 | 2698 | ncr3948 |
| 2459 | ncr3607 | 2519 | ncr3693 | 2579 | ncr3778 | 2639 | ncr3856 | 2699 | ncr3949 |
| 2460 | ncr3608 | 2520 | ncr3694 | 2580 | ncr3779 | 2640 | ncr3857 | 2700 | ncr3950 |

Figure 6C – List of EST Sequence Names From Normal Cartilage cDNA Library

| | | | | | | | | | |
|---|---|---|---|---|---|---|---|---|---|
| 2701 | ncr3951 | 2761 | ncr4035 | 2821 | ncr4122 | 2881 | ncr4219 | 2941 | ncr4409 |
| 2702 | ncr3952 | 2762 | ncr4036 | 2822 | ncr4123 | 2882 | ncr4220 | 2942 | ncr4410 |
| 2703 | ncr3953 | 2763 | ncr4037 | 2823 | ncr4124 | 2883 | ncr4221 | 2943 | ncr4412 |
| 2704 | ncr3954 | 2764 | ncr4039 | 2824 | ncr4125 | 2884 | ncr4222 | 2944 | ncr4413 |
| 2705 | ncr3955 | 2765 | ncr4040 | 2825 | ncr4126 | 2885 | ncr4224 | 2945 | ncr4414 |
| 2706 | ncr3956 | 2766 | ncr4041 | 2826 | ncr4127 | 2886 | ncr4323 | 2946 | ncr4415 |
| 2707 | ncr3957 | 2767 | ncr4045 | 2827 | ncr4128 | 2887 | ncr4324 | 2947 | ncr4416 |
| 2708 | ncr3959 | 2768 | ncr4046 | 2828 | ncr4133 | 2888 | ncr4325 | 2948 | ncr4421 |
| 2709 | ncr3960 | 2769 | ncr4048 | 2829 | ncr4135 | 2889 | ncr4331 | 2949 | ncr4423 |
| 2710 | ncr3961 | 2770 | ncr4050 | 2830 | ncr4137 | 2890 | ncr4332 | 2950 | ncr4424 |
| 2711 | ncr3962 | 2771 | ncr4051 | 2831 | ncr4139 | 2891 | ncr4333 | 2951 | ncr4432 |
| 2712 | ncr3963 | 2772 | ncr4052 | 2832 | ncr4140 | 2892 | ncr4335 | 2952 | ncr4433 |
| 2713 | ncr3964 | 2773 | ncr4053 | 2833 | ncr4141 | 2893 | ncr4336 | 2953 | ncr4434 |
| 2714 | ncr3965 | 2774 | ncr4055 | 2834 | ncr4142 | 2894 | ncr4337 | 2954 | ncr4435 |
| 2715 | ncr3968 | 2775 | ncr4056 | 2835 | ncr4146 | 2895 | ncr4338 | 2955 | ncr4436 |
| 2716 | ncr3970 | 2776 | ncr4057 | 2836 | ncr4147 | 2896 | ncr4339 | 2956 | ncr4437 |
| 2717 | ncr3971 | 2777 | ncr4059 | 2837 | ncr4148 | 2897 | ncr4341 | 2957 | ncr4443 |
| 2718 | ncr3972 | 2778 | ncr4060 | 2838 | ncr4149 | 2898 | ncr4347 | 2958 | ncr4444 |
| 2719 | ncr3973 | 2779 | ncr4061 | 2839 | ncr4153 | 2899 | ncr4348 | 2959 | ncr4445 |
| 2720 | ncr3974 | 2780 | ncr4064 | 2840 | ncr4154 | 2900 | ncr4349 | 2960 | ncr4448 |
| 2721 | ncr3975 | 2781 | ncr4066 | 2841 | ncr4157 | 2901 | ncr4352 | 2961 | ncr4449 |
| 2722 | ncr3976 | 2782 | ncr4067 | 2842 | ncr4160 | 2902 | ncr4354 | 2962 | ncr4451 |
| 2723 | ncr3977 | 2783 | ncr4068 | 2843 | ncr4162 | 2903 | ncr4355 | 2963 | ncr4452 |
| 2724 | ncr3978 | 2784 | ncr4069 | 2844 | ncr4163 | 2904 | ncr4357 | 2964 | ncr4454 |
| 2725 | ncr3979 | 2785 | ncr4070 | 2845 | ncr4168 | 2905 | ncr4361 | 2965 | ncr4455 |
| 2726 | ncr3983 | 2786 | ncr4072 | 2846 | ncr4169 | 2906 | ncr4363 | 2966 | ncr4456 |
| 2727 | ncr3984 | 2787 | ncr4073 | 2847 | ncr4171 | 2907 | ncr4364 | 2967 | ncr4460 |
| 2728 | ncr3986 | 2788 | ncr4075 | 2848 | ncr4172 | 2908 | ncr4365 | 2968 | ncr4461 |
| 2729 | ncr3987 | 2789 | ncr4076 | 2849 | ncr4175 | 2909 | ncr4367 | 2969 | ncr4466 |
| 2730 | ncr3988 | 2790 | ncr4077 | 2850 | ncr4178 | 2910 | ncr4368 | 2970 | ncr4474 |
| 2731 | ncr3989 | 2791 | ncr4078 | 2851 | ncr4180 | 2911 | ncr4369 | 2971 | ncr4475 |
| 2732 | ncr3990 | 2792 | ncr4079 | 2852 | ncr4181 | 2912 | ncr4370 | 2972 | ncr4477 |
| 2733 | ncr3993 | 2793 | ncr4080 | 2853 | ncr4182 | 2913 | ncr4371 | 2973 | ncr4481 |
| 2734 | ncr3995 | 2794 | ncr4081 | 2854 | ncr4183 | 2914 | ncr4372 | 2974 | ncr4484 |
| 2735 | ncr3997 | 2795 | ncr4082 | 2855 | ncr4184 | 2915 | ncr4373 | 2975 | ncr4485 |
| 2736 | ncr3998 | 2796 | ncr4083 | 2856 | ncr4185 | 2916 | ncr4374 | 2976 | ncr4486 |
| 2737 | ncr3999 | 2797 | ncr4085 | 2857 | ncr4187 | 2917 | ncr4375 | 2977 | ncr4491 |
| 2738 | ncr4000 | 2798 | ncr4089 | 2858 | ncr4188 | 2918 | ncr4376 | 2978 | ncr4503 |
| 2739 | ncr4001 | 2799 | ncr4090 | 2859 | ncr4189 | 2919 | ncr4377 | 2979 | ncr4505 |
| 2740 | ncr4003 | 2800 | ncr4091 | 2860 | ncr4190 | 2920 | ncr4378 | 2980 | ncr4512 |
| 2741 | ncr4005 | 2801 | ncr4092 | 2861 | ncr4191 | 2921 | ncr4380 | 2981 | ncr4513 |
| 2742 | ncr4006 | 2802 | ncr4094 | 2862 | ncr4192 | 2922 | ncr4381 | 2982 | ncr4515 |
| 2743 | ncr4008 | 2803 | ncr4095 | 2863 | ncr4193 | 2923 | ncr4382 | 2983 | ncr4518 |
| 2744 | ncr4009 | 2804 | ncr4100 | 2864 | ncr4194 | 2924 | ncr4383 | 2984 | ncr4519 |
| 2745 | ncr4010 | 2805 | ncr4101 | 2865 | ncr4195 | 2925 | ncr4384 | 2985 | ncr4522 |
| 2746 | ncr4011 | 2806 | ncr4104 | 2866 | ncr4198 | 2926 | ncr4385 | 2986 | ncr4523 |
| 2747 | ncr4012 | 2807 | ncr4107 | 2867 | ncr4199 | 2927 | ncr4388 | 2987 | ncr4524 |
| 2748 | ncr4013 | 2808 | ncr4108 | 2868 | ncr4200 | 2928 | ncr4393 | 2988 | ncr4525 |
| 2749 | ncr4015 | 2809 | ncr4109 | 2869 | ncr4201 | 2929 | ncr4396 | 2989 | ncr4527 |
| 2750 | ncr4017 | 2810 | ncr4110 | 2870 | ncr4202 | 2930 | ncr4397 | 2990 | ncr4528 |
| 2751 | ncr4018 | 2811 | ncr4111 | 2871 | ncr4203 | 2931 | ncr4398 | 2991 | ncr4529 |
| 2752 | ncr4020 | 2812 | ncr4113 | 2872 | ncr4205 | 2932 | ncr4399 | 2992 | ncr4530 |
| 2753 | ncr4021 | 2813 | ncr4114 | 2873 | ncr4206 | 2933 | ncr4400 | 2993 | ncr4531 |
| 2754 | ncr4022 | 2814 | ncr4115 | 2874 | ncr4208 | 2934 | ncr4401 | 2994 | ncr4533 |
| 2755 | ncr4025 | 2815 | ncr4116 | 2875 | ncr4210 | 2935 | ncr4402 | 2995 | ncr4535 |
| 2756 | ncr4026 | 2816 | ncr4117 | 2876 | ncr4212 | 2936 | ncr4404 | 2996 | ncr4536 |
| 2757 | ncr4029 | 2817 | ncr4118 | 2877 | ncr4214 | 2937 | ncr4405 | 2997 | ncr4537 |
| 2758 | ncr4030 | 2818 | ncr4119 | 2878 | ncr4215 | 2938 | ncr4406 | 2998 | ncr4538 |
| 2759 | ncr4032 | 2819 | ncr4120 | 2879 | ncr4217 | 2939 | ncr4407 | 2999 | ncr4539 |
| 2760 | ncr4033 | 2820 | ncr4121 | 2880 | ncr4218 | 2940 | ncr4408 | 3000 | ncr4540 |

Figure 6C - List of EST Sequence Names From Normal Cartilage cDNA Library

| | | | | | | | | | |
|---|---|---|---|---|---|---|---|---|---|
| 3001 | ncr4541 | 3061 | ncr4641 | 3121 | ncr4728 | 3181 | ncr4812 | 3241 | ncr4914 |
| 3002 | ncr4543 | 3062 | ncr4642 | 3122 | ncr4730 | 3182 | ncr4813 | 3242 | ncr4915 |
| 3003 | ncr4544 | 3063 | ncr4643 | 3123 | ncr4732 | 3183 | ncr4814 | 3243 | ncr4916 |
| 3004 | ncr4545 | 3064 | ncr4646 | 3124 | ncr4733 | 3184 | ncr4815 | 3244 | ncr4917 |
| 3005 | ncr4547 | 3065 | ncr4647 | 3125 | ncr4735 | 3185 | ncr4816 | 3245 | ncr4918 |
| 3006 | ncr4548 | 3066 | ncr4648 | 3126 | ncr4737 | 3186 | ncr4818 | 3246 | ncr4920 |
| 3007 | ncr4550 | 3067 | ncr4652 | 3127 | ncr4738 | 3187 | ncr4821 | 3247 | ncr4921 |
| 3008 | ncr4551 | 3068 | ncr4653 | 3128 | ncr4739 | 3188 | ncr4823 | 3248 | ncr4925 |
| 3009 | ncr4552 | 3069 | ncr4654 | 3129 | ncr4740 | 3189 | ncr4824 | 3249 | ncr4928 |
| 3010 | ncr4553 | 3070 | ncr4655 | 3130 | ncr4742 | 3190 | ncr4827 | 3250 | ncr4929 |
| 3011 | ncr4555 | 3071 | ncr4656 | 3131 | ncr4743 | 3191 | ncr4829 | 3251 | ncr4930 |
| 3012 | ncr4566 | 3072 | ncr4657 | 3132 | ncr4745 | 3192 | ncr4831 | 3252 | ncr4932 |
| 3013 | ncr4567 | 3073 | ncr4658 | 3133 | ncr4746 | 3193 | ncr4832 | 3253 | ncr4933 |
| 3014 | ncr4568 | 3074 | ncr4661 | 3134 | ncr4747 | 3194 | ncr4833 | 3254 | ncr4935 |
| 3015 | ncr4569 | 3075 | ncr4662 | 3135 | ncr4748 | 3195 | ncr4835 | 3255 | ncr4936 |
| 3016 | ncr4572 | 3076 | ncr4664 | 3136 | ncr4749 | 3196 | ncr4836 | 3256 | ncr4938 |
| 3017 | ncr4575 | 3077 | ncr4666 | 3137 | ncr4750 | 3197 | ncr4839 | 3257 | ncr4939 |
| 3018 | ncr4577 | 3078 | ncr4667 | 3138 | ncr4751 | 3198 | ncr4840 | 3258 | ncr4944 |
| 3019 | ncr4580 | 3079 | ncr4668 | 3139 | ncr4754 | 3199 | ncr4845 | 3259 | ncr4946 |
| 3020 | ncr4581 | 3080 | ncr4671 | 3140 | ncr4755 | 3200 | ncr4846 | 3260 | ncr4949 |
| 3021 | ncr4582 | 3081 | ncr4672 | 3141 | ncr4757 | 3201 | ncr4847 | 3261 | ncr4951 |
| 3022 | ncr4583 | 3082 | ncr4673 | 3142 | ncr4758 | 3202 | ncr4851 | 3262 | ncr4953 |
| 3023 | ncr4584 | 3083 | ncr4674 | 3143 | ncr4759 | 3203 | ncr4853 | 3263 | ncr4954 |
| 3024 | ncr4585 | 3084 | ncr4675 | 3144 | ncr4760 | 3204 | ncr4854 | 3264 | ncr4957 |
| 3025 | ncr4586 | 3085 | ncr4676 | 3145 | ncr4762 | 3205 | ncr4855 | 3265 | ncr4958 |
| 3026 | ncr4587 | 3086 | ncr4677 | 3146 | ncr4763 | 3206 | ncr4856 | 3266 | ncr4959 |
| 3027 | ncr4589 | 3087 | ncr4680 | 3147 | ncr4764 | 3207 | ncr4857 | 3267 | ncr4960 |
| 3028 | ncr4590 | 3088 | ncr4681 | 3148 | ncr4765 | 3208 | ncr4858 | 3268 | ncr4961 |
| 3029 | ncr4591 | 3089 | ncr4682 | 3149 | ncr4766 | 3209 | ncr4859 | 3269 | ncr4964 |
| 3030 | ncr4595 | 3090 | ncr4683 | 3150 | ncr4767 | 3210 | ncr4860 | 3270 | ncr4965 |
| 3031 | ncr4596 | 3091 | ncr4684 | 3151 | ncr4768 | 3211 | ncr4863 | 3271 | ncr4966 |
| 3032 | ncr4597 | 3092 | ncr4685 | 3152 | ncr4769 | 3212 | ncr4864 | 3272 | ncr4967 |
| 3033 | ncr4598 | 3093 | ncr4686 | 3153 | ncr4770 | 3213 | ncr4865 | 3273 | ncr4968 |
| 3034 | ncr4600 | 3094 | ncr4687 | 3154 | ncr4771 | 3214 | ncr4866 | 3274 | ncr4969 |
| 3035 | ncr4601 | 3095 | ncr4688 | 3155 | ncr4772 | 3215 | ncr4867 | 3275 | ncr4970 |
| 3036 | ncr4603 | 3096 | ncr4689 | 3156 | ncr4773 | 3216 | ncr4870 | 3276 | ncr4971 |
| 3037 | ncr4604 | 3097 | ncr4691 | 3157 | ncr4774 | 3217 | ncr4871 | 3277 | ncr4972 |
| 3038 | ncr4605 | 3098 | ncr4692 | 3158 | ncr4775 | 3218 | ncr4873 | 3278 | ncr4973 |
| 3039 | ncr4606 | 3099 | ncr4693 | 3159 | ncr4776 | 3219 | ncr4875 | 3279 | ncr4974 |
| 3040 | ncr4607 | 3100 | ncr4694 | 3160 | ncr4778 | 3220 | ncr4876 | 3280 | ncr4975 |
| 3041 | ncr4608 | 3101 | ncr4695 | 3161 | ncr4779 | 3221 | ncr4877 | 3281 | ncr4976 |
| 3042 | ncr4609 | 3102 | ncr4696 | 3162 | ncr4780 | 3222 | ncr4878 | 3282 | ncr4978 |
| 3043 | ncr4612 | 3103 | ncr4697 | 3163 | ncr4781 | 3223 | ncr4880 | 3283 | ncr4979 |
| 3044 | ncr4613 | 3104 | ncr4698 | 3164 | ncr4783 | 3224 | ncr4881 | 3284 | ncr4981 |
| 3045 | ncr4615 | 3105 | ncr4699 | 3165 | ncr4784 | 3225 | ncr4883 | 3285 | ncr4982 |
| 3046 | ncr4617 | 3106 | ncr4700 | 3166 | ncr4785 | 3226 | ncr4884 | 3286 | ncr4983 |
| 3047 | ncr4619 | 3107 | ncr4702 | 3167 | ncr4786 | 3227 | ncr4887 | 3287 | ncr4984 |
| 3048 | ncr4620 | 3108 | ncr4704 | 3168 | ncr4787 | 3228 | ncr4888 | 3288 | ncr4985 |
| 3049 | ncr4621 | 3109 | ncr4705 | 3169 | ncr4788 | 3229 | ncr4890 | 3289 | ncr4986 |
| 3050 | ncr4623 | 3110 | ncr4708 | 3170 | ncr4789 | 3230 | ncr4892 | 3290 | ncr4989 |
| 3051 | ncr4625 | 3111 | ncr4709 | 3171 | ncr4790 | 3231 | ncr4894 | 3291 | ncr4992 |
| 3052 | ncr4628 | 3112 | ncr4712 | 3172 | ncr4792 | 3232 | ncr4895 | 3292 | ncr4993 |
| 3053 | ncr4629 | 3113 | ncr4713 | 3173 | ncr4793 | 3233 | ncr4897 | 3293 | ncr4995 |
| 3054 | ncr4631 | 3114 | ncr4716 | 3174 | ncr4794 | 3234 | ncr4900 | 3294 | ncr4996 |
| 3055 | ncr4632 | 3115 | ncr4719 | 3175 | ncr4795 | 3235 | ncr4903 | 3295 | ncr4997 |
| 3056 | ncr4634 | 3116 | ncr4720 | 3176 | ncr4798 | 3236 | ncr4907 | 3296 | ncr4999 |
| 3057 | ncr4635 | 3117 | ncr4721 | 3177 | ncr4799 | 3237 | ncr4910 | 3297 | ncr5001 |
| 3058 | ncr4637 | 3118 | ncr4722 | 3178 | ncr4805 | 3238 | ncr4911 | 3298 | ncr5003 |
| 3059 | ncr4639 | 3119 | ncr4725 | 3179 | ncr4808 | 3239 | ncr4912 | 3299 | ncr5005 |
| 3060 | ncr4640 | 3120 | ncr4727 | 3180 | ncr4809 | 3240 | ncr4913 | 3300 | ncr5007 |

Figure 6C - List of EST Sequence Names From Normal Cartilage cDNA Library

| | | | | | | | | | |
|---|---|---|---|---|---|---|---|---|---|
| 3301 | ncr5008 | 3361 | ncr5105 | 3421 | ncr5188 | 3481 | ncr5269 | 3541 | ncr5373 |
| 3302 | ncr5010 | 3362 | ncr5108 | 3422 | ncr5189 | 3482 | ncr5272 | 3542 | ncr5374 |
| 3303 | ncr5011 | 3363 | ncr5109 | 3423 | ncr5191 | 3483 | ncr5273 | 3543 | ncr5375 |
| 3304 | ncr5012 | 3364 | ncr5110 | 3424 | ncr5192 | 3484 | ncr5274 | 3544 | ncr5376 |
| 3305 | ncr5013 | 3365 | ncr5111 | 3425 | ncr5193 | 3485 | ncr5276 | 3545 | ncr5377 |
| 3306 | ncr5015 | 3366 | ncr5113 | 3426 | ncr5195 | 3486 | ncr5280 | 3546 | ncr5380 |
| 3307 | ncr5016 | 3367 | ncr5115 | 3427 | ncr5196 | 3487 | ncr5283 | 3547 | ncr5381 |
| 3308 | ncr5017 | 3368 | ncr5117 | 3428 | ncr5197 | 3488 | ncr5284 | 3548 | ncr5383 |
| 3309 | ncr5019 | 3369 | ncr5120 | 3429 | ncr5200 | 3489 | ncr5285 | 3549 | ncr5384 |
| 3310 | ncr5023 | 3370 | ncr5121 | 3430 | ncr5201 | 3490 | ncr5287 | 3550 | ncr5385 |
| 3311 | ncr5024 | 3371 | ncr5122 | 3431 | ncr5202 | 3491 | ncr5288 | 3551 | ncr5387 |
| 3312 | ncr5025 | 3372 | ncr5124 | 3432 | ncr5205 | 3492 | ncr5289 | 3552 | ncr5388 |
| 3313 | ncr5027 | 3373 | ncr5125 | 3433 | ncr5207 | 3493 | ncr5291 | 3553 | ncr5389 |
| 3314 | ncr5031 | 3374 | ncr5126 | 3434 | ncr5208 | 3494 | ncr5292 | 3554 | ncr5392 |
| 3315 | ncr5034 | 3375 | ncr5127 | 3435 | ncr5209 | 3495 | ncr5293 | 3555 | ncr5393 |
| 3316 | ncr5036 | 3376 | ncr5128 | 3436 | ncr5210 | 3496 | ncr5296 | 3556 | ncr5394 |
| 3317 | ncr5037 | 3377 | ncr5130 | 3437 | ncr5211 | 3497 | ncr5297 | 3557 | ncr5397 |
| 3318 | ncr5039 | 3378 | ncr5131 | 3438 | ncr5212 | 3498 | ncr5299 | 3558 | ncr5399 |
| 3319 | ncr5042 | 3379 | ncr5132 | 3439 | ncr5216 | 3499 | ncr5300 | 3559 | ncr5400 |
| 3320 | ncr5043 | 3380 | ncr5133 | 3440 | ncr5218 | 3500 | ncr5301 | 3560 | ncr5401 |
| 3321 | ncr5044 | 3381 | ncr5136 | 3441 | ncr5219 | 3501 | ncr5303 | 3561 | ncr5402 |
| 3322 | ncr5046 | 3382 | ncr5137 | 3442 | ncr5220 | 3502 | ncr5304 | 3562 | ncr5403 |
| 3323 | ncr5047 | 3383 | ncr5138 | 3443 | ncr5221 | 3503 | ncr5305 | 3563 | ncr5404 |
| 3324 | ncr5048 | 3384 | ncr5140 | 3444 | ncr5222 | 3504 | ncr5311 | 3564 | ncr5405 |
| 3325 | ncr5049 | 3385 | ncr5142 | 3445 | ncr5223 | 3505 | ncr5312 | 3565 | ncr5407 |
| 3326 | ncr5050 | 3386 | ncr5143 | 3446 | ncr5224 | 3506 | ncr5313 | 3566 | ncr5408 |
| 3327 | ncr5051 | 3387 | ncr5145 | 3447 | ncr5226 | 3507 | ncr5316 | 3567 | ncr5409 |
| 3328 | ncr5052 | 3388 | ncr5146 | 3448 | ncr5227 | 3508 | ncr5318 | 3568 | ncr5410 |
| 3329 | ncr5053 | 3389 | ncr5147 | 3449 | ncr5228 | 3509 | ncr5320 | 3569 | ncr5412 |
| 3330 | ncr5055 | 3390 | ncr5149 | 3450 | ncr5229 | 3510 | ncr5322 | 3570 | ncr5414 |
| 3331 | ncr5056 | 3391 | ncr5150 | 3451 | ncr5230 | 3511 | ncr5323 | 3571 | ncr5415 |
| 3332 | ncr5057 | 3392 | ncr5151 | 3452 | ncr5232 | 3512 | ncr5324 | 3572 | ncr5416 |
| 3333 | ncr5060 | 3393 | ncr5152 | 3453 | ncr5233 | 3513 | ncr5325 | 3573 | ncr5417 |
| 3334 | ncr5061 | 3394 | ncr5153 | 3454 | ncr5234 | 3514 | ncr5327 | 3574 | ncr5420 |
| 3335 | ncr5063 | 3395 | ncr5154 | 3455 | ncr5236 | 3515 | ncr5328 | 3575 | ncr5421 |
| 3336 | ncr5064 | 3396 | ncr5155 | 3456 | ncr5237 | 3516 | ncr5331 | 3576 | ncr5423 |
| 3337 | ncr5065 | 3397 | ncr5156 | 3457 | ncr5238 | 3517 | ncr5333 | 3577 | ncr5424 |
| 3338 | ncr5066 | 3398 | ncr5157 | 3458 | ncr5240 | 3518 | ncr5334 | 3578 | ncr5425 |
| 3339 | ncr5069 | 3399 | ncr5158 | 3459 | ncr5241 | 3519 | ncr5335 | 3579 | ncr5426 |
| 3340 | ncr5070 | 3400 | ncr5159 | 3460 | ncr5242 | 3520 | ncr5336 | 3580 | ncr5427 |
| 3341 | ncr5072 | 3401 | ncr5160 | 3461 | ncr5245 | 3521 | ncr5338 | 3581 | ncr5428 |
| 3342 | ncr5073 | 3402 | ncr5161 | 3462 | ncr5246 | 3522 | ncr5341 | 3582 | ncr5429 |
| 3343 | ncr5074 | 3403 | ncr5163 | 3463 | ncr5247 | 3523 | ncr5342 | 3583 | ncr5430 |
| 3344 | ncr5077 | 3404 | ncr5164 | 3464 | ncr5248 | 3524 | ncr5343 | 3584 | ncr5431 |
| 3345 | ncr5078 | 3405 | ncr5166 | 3465 | ncr5249 | 3525 | ncr5345 | 3585 | ncr5432 |
| 3346 | ncr5079 | 3406 | ncr5167 | 3466 | ncr5251 | 3526 | ncr5346 | 3586 | ncr5433 |
| 3347 | ncr5080 | 3407 | ncr5168 | 3467 | ncr5252 | 3527 | ncr5349 | 3587 | ncr5435 |
| 3348 | ncr5081 | 3408 | ncr5169 | 3468 | ncr5253 | 3528 | ncr5353 | 3588 | ncr5436 |
| 3349 | ncr5082 | 3409 | ncr5171 | 3469 | ncr5254 | 3529 | ncr5354 | 3589 | ncr5437 |
| 3350 | ncr5083 | 3410 | ncr5172 | 3470 | ncr5255 | 3530 | ncr5355 | 3590 | ncr5438 |
| 3351 | ncr5084 | 3411 | ncr5173 | 3471 | ncr5256 | 3531 | ncr5357 | 3591 | ncr5440 |
| 3352 | ncr5086 | 3412 | ncr5174 | 3472 | ncr5257 | 3532 | ncr5358 | 3592 | ncr5442 |
| 3353 | ncr5088 | 3413 | ncr5176 | 3473 | ncr5258 | 3533 | ncr5360 | 3593 | ncr5444 |
| 3354 | ncr5089 | 3414 | ncr5177 | 3474 | ncr5261 | 3534 | ncr5361 | 3594 | ncr5446 |
| 3355 | ncr5092 | 3415 | ncr5178 | 3475 | ncr5262 | 3535 | ncr5363 | 3595 | ncr5450 |
| 3356 | ncr5093 | 3416 | ncr5179 | 3476 | ncr5263 | 3536 | ncr5364 | 3596 | ncr5451 |
| 3357 | ncr5097 | 3417 | ncr5180 | 3477 | ncr5264 | 3537 | ncr5365 | 3597 | ncr5453 |
| 3358 | ncr5099 | 3418 | ncr5182 | 3478 | ncr5265 | 3538 | ncr5368 | 3598 | ncr5454 |
| 3359 | ncr5101 | 3419 | ncr5183 | 3479 | ncr5266 | 3539 | ncr5369 | 3599 | ncr5455 |
| 3360 | ncr5104 | 3420 | ncr5184 | 3480 | ncr5268 | 3540 | ncr5372 | 3600 | ncr5458 |

Figure 6C – List of EST Sequence Names From Normal Cartilage cDNA Library

| | | | | | | | | | |
|---|---|---|---|---|---|---|---|---|---|
| 3601 | ncr5459 | 3661 | ncr5537 | 3721 | ncr5630 | 3781 | ncr5712 | 3841 | ncr5808 |
| 3602 | ncr5461 | 3662 | ncr5538 | 3722 | ncr5631 | 3782 | ncr5713 | 3842 | ncr5810 |
| 3603 | ncr5462 | 3663 | ncr5539 | 3723 | ncr5632 | 3783 | ncr5714 | 3843 | ncr5811 |
| 3604 | ncr5463 | 3664 | ncr5540 | 3724 | ncr5633 | 3784 | ncr5715 | 3844 | ncr5812 |
| 3605 | ncr5464 | 3665 | ncr5541 | 3725 | ncr5635 | 3785 | ncr5718 | 3845 | ncr5814 |
| 3606 | ncr5465 | 3666 | ncr5542 | 3726 | ncr5637 | 3786 | ncr5719 | 3846 | ncr5815 |
| 3607 | ncr5466 | 3667 | ncr5543 | 3727 | ncr5639 | 3787 | ncr5720 | 3847 | ncr5816 |
| 3608 | ncr5470 | 3668 | ncr5544 | 3728 | ncr5640 | 3788 | ncr5721 | 3848 | ncr5817 |
| 3609 | ncr5471 | 3669 | ncr5545 | 3729 | ncr5641 | 3789 | ncr5722 | 3849 | ncr5818 |
| 3610 | ncr5472 | 3670 | ncr5546 | 3730 | ncr5643 | 3790 | ncr5723 | 3850 | ncr5819 |
| 3611 | ncr5473 | 3671 | ncr5547 | 3731 | ncr5644 | 3791 | ncr5724 | 3851 | ncr5820 |
| 3612 | ncr5475 | 3672 | ncr5549 | 3732 | ncr5645 | 3792 | ncr5725 | 3852 | ncr5821 |
| 3613 | ncr5476 | 3673 | ncr5550 | 3733 | ncr5646 | 3793 | ncr5727 | 3853 | ncr5822 |
| 3614 | ncr5477 | 3674 | ncr5551 | 3734 | ncr5648 | 3794 | ncr5729 | 3854 | ncr5823 |
| 3615 | ncr5478 | 3675 | ncr5552 | 3735 | ncr5649 | 3795 | ncr5734 | 3855 | ncr5825 |
| 3616 | ncr5479 | 3676 | ncr5553 | 3736 | ncr5650 | 3796 | ncr5736 | 3856 | ncr5826 |
| 3617 | ncr5481 | 3677 | ncr5554 | 3737 | ncr5651 | 3797 | ncr5738 | 3857 | ncr5828 |
| 3618 | ncr5482 | 3678 | ncr5555 | 3738 | ncr5653 | 3798 | ncr5740 | 3858 | ncr5829 |
| 3619 | ncr5484 | 3679 | ncr5557 | 3739 | ncr5654 | 3799 | ncr5741 | 3859 | ncr5830 |
| 3620 | ncr5485 | 3680 | ncr5558 | 3740 | ncr5655 | 3800 | ncr5742 | 3860 | ncr5833 |
| 3621 | ncr5488 | 3681 | ncr5559 | 3741 | ncr5657 | 3801 | ncr5744 | 3861 | ncr5835 |
| 3622 | ncr5490 | 3682 | ncr5560 | 3742 | ncr5658 | 3802 | ncr5745 | 3862 | ncr5836 |
| 3623 | ncr5491 | 3683 | ncr5564 | 3743 | ncr5659 | 3803 | ncr5746 | 3863 | ncr5838 |
| 3624 | ncr5492 | 3684 | ncr5566 | 3744 | ncr5660 | 3804 | ncr5750 | 3864 | ncr5840 |
| 3625 | ncr5493 | 3685 | ncr5568 | 3745 | ncr5661 | 3805 | ncr5751 | 3865 | ncr5842 |
| 3626 | ncr5494 | 3686 | ncr5570 | 3746 | ncr5662 | 3806 | ncr5752 | 3866 | ncr5843 |
| 3627 | ncr5495 | 3687 | ncr5571 | 3747 | ncr5663 | 3807 | ncr5753 | 3867 | ncr5844 |
| 3628 | ncr5497 | 3688 | ncr5572 | 3748 | ncr5664 | 3808 | ncr5755 | 3868 | ncr5846 |
| 3629 | ncr5499 | 3689 | ncr5573 | 3749 | ncr5667 | 3809 | ncr5756 | 3869 | ncr5848 |
| 3630 | ncr5500 | 3690 | ncr5575 | 3750 | ncr5668 | 3810 | ncr5757 | 3870 | ncr5850 |
| 3631 | ncr5501 | 3691 | ncr5576 | 3751 | ncr5671 | 3811 | ncr5758 | 3871 | ncr5854 |
| 3632 | ncr5503 | 3692 | ncr5583 | 3752 | ncr5672 | 3812 | ncr5759 | 3872 | ncr5856 |
| 3633 | ncr5505 | 3693 | ncr5585 | 3753 | ncr5673 | 3813 | ncr5760 | 3873 | ncr5859 |
| 3634 | ncr5506 | 3694 | ncr5586 | 3754 | ncr5675 | 3814 | ncr5763 | 3874 | ncr5860 |
| 3635 | ncr5507 | 3695 | ncr5587 | 3755 | ncr5676 | 3815 | ncr5764 | 3875 | ncr5861 |
| 3636 | ncr5508 | 3696 | ncr5588 | 3756 | ncr5677 | 3816 | ncr5767 | 3876 | ncr5863 |
| 3637 | ncr5509 | 3697 | ncr5591 | 3757 | ncr5679 | 3817 | ncr5768 | 3877 | ncr5864 |
| 3638 | ncr5510 | 3698 | ncr5592 | 3758 | ncr5681 | 3818 | ncr5769 | 3878 | ncr5865 |
| 3639 | ncr5512 | 3699 | ncr5594 | 3759 | ncr5682 | 3819 | ncr5771 | 3879 | ncr5867 |
| 3640 | ncr5514 | 3700 | ncr5597 | 3760 | ncr5683 | 3820 | ncr5772 | 3880 | ncr5871 |
| 3641 | ncr5515 | 3701 | ncr5599 | 3761 | ncr5684 | 3821 | ncr5776 | 3881 | ncr5872 |
| 3642 | ncr5516 | 3702 | ncr5600 | 3762 | ncr5689 | 3822 | ncr5777 | 3882 | ncr5873 |
| 3643 | ncr5518 | 3703 | ncr5601 | 3763 | ncr5691 | 3823 | ncr5779 | 3883 | ncr5875 |
| 3644 | ncr5519 | 3704 | ncr5603 | 3764 | ncr5692 | 3824 | ncr5781 | 3884 | ncr5876 |
| 3645 | ncr5520 | 3705 | ncr5604 | 3765 | ncr5693 | 3825 | ncr5783 | 3885 | ncr5877 |
| 3646 | ncr5521 | 3706 | ncr5610 | 3766 | ncr5695 | 3826 | ncr5785 | 3886 | ncr5879 |
| 3647 | ncr5522 | 3707 | ncr5612 | 3767 | ncr5696 | 3827 | ncr5787 | 3887 | ncr5880 |
| 3648 | ncr5523 | 3708 | ncr5613 | 3768 | ncr5697 | 3828 | ncr5788 | 3888 | ncr5881 |
| 3649 | ncr5524 | 3709 | ncr5614 | 3769 | ncr5699 | 3829 | ncr5789 | 3889 | ncr5882 |
| 3650 | ncr5525 | 3710 | ncr5616 | 3770 | ncr5700 | 3830 | ncr5792 | 3890 | ncr5884 |
| 3651 | ncr5526 | 3711 | ncr5617 | 3771 | ncr5701 | 3831 | ncr5793 | 3891 | ncr5887 |
| 3652 | ncr5527 | 3712 | ncr5618 | 3772 | ncr5702 | 3832 | ncr5794 | 3892 | ncr5888 |
| 3653 | ncr5529 | 3713 | ncr5620 | 3773 | ncr5703 | 3833 | ncr5795 | 3893 | ncr5890 |
| 3654 | ncr5530 | 3714 | ncr5621 | 3774 | ncr5704 | 3834 | ncr5796 | 3894 | ncr5892 |
| 3655 | ncr5531 | 3715 | ncr5622 | 3775 | ncr5706 | 3835 | ncr5797 | 3895 | ncr5894 |
| 3656 | ncr5532 | 3716 | ncr5624 | 3776 | ncr5707 | 3836 | ncr5798 | 3896 | ncr5896 |
| 3657 | ncr5533 | 3717 | ncr5625 | 3777 | ncr5708 | 3837 | ncr5800 | 3897 | ncr5898 |
| 3658 | ncr5534 | 3718 | ncr5626 | 3778 | ncr5709 | 3838 | ncr5803 | 3898 | ncr5899 |
| 3659 | ncr5535 | 3719 | ncr5628 | 3779 | ncr5710 | 3839 | ncr5804 | 3899 | ncr5900 |
| 3660 | ncr5536 | 3720 | ncr5629 | 3780 | ncr5711 | 3840 | ncr5807 | 3900 | ncr5901 |

Figure 6C – List of EST Sequence Names From Normal Cartilage cDNA Library

| | | | | | | | | | |
|---|---|---|---|---|---|---|---|---|---|
| 3901 | ncr5903 | 3961 | ncr5999 | 4021 | ncr6092 | 4081 | ncr6184 | 4141 | ncr6275 |
| 3902 | ncr5904 | 3962 | ncr6003 | 4022 | ncr6093 | 4082 | ncr6187 | 4142 | ncr6276 |
| 3903 | ncr5906 | 3963 | ncr6004 | 4023 | ncr6094 | 4083 | ncr6188 | 4143 | ncr6277 |
| 3904 | ncr5908 | 3964 | ncr6005 | 4024 | ncr6095 | 4084 | ncr6190 | 4144 | ncr6278 |
| 3905 | ncr5909 | 3965 | ncr6007 | 4025 | ncr6099 | 4085 | ncr6192 | 4145 | ncr6279 |
| 3906 | ncr5911 | 3966 | ncr6009 | 4026 | ncr6100 | 4086 | ncr6193 | 4146 | ncr6280 |
| 3907 | ncr5912 | 3967 | ncr6010 | 4027 | ncr6103 | 4087 | ncr6194 | 4147 | ncr6283 |
| 3908 | ncr5913 | 3968 | ncr6011 | 4028 | ncr6104 | 4088 | ncr6195 | 4148 | ncr6284 |
| 3909 | ncr5914 | 3969 | ncr6012 | 4029 | ncr6105 | 4089 | ncr6196 | 4149 | ncr6285 |
| 3910 | ncr5915 | 3970 | ncr6013 | 4030 | ncr6106 | 4090 | ncr6197 | 4150 | ncr6286 |
| 3911 | ncr5916 | 3971 | ncr6016 | 4031 | ncr6107 | 4091 | ncr6198 | 4151 | ncr6287 |
| 3912 | ncr5917 | 3972 | ncr6017 | 4032 | ncr6108 | 4092 | ncr6200 | 4152 | ncr6288 |
| 3913 | ncr5918 | 3973 | ncr6019 | 4033 | ncr6109 | 4093 | ncr6202 | 4153 | ncr6289 |
| 3914 | ncr5919 | 3974 | ncr6022 | 4034 | ncr6110 | 4094 | ncr6203 | 4154 | ncr6290 |
| 3915 | ncr5921 | 3975 | ncr6023 | 4035 | ncr6111 | 4095 | ncr6204 | 4155 | ncr6291 |
| 3916 | ncr5923 | 3976 | ncr6024 | 4036 | ncr6113 | 4096 | ncr6205 | 4156 | ncr6292 |
| 3917 | ncr5924 | 3977 | ncr6026 | 4037 | ncr6114 | 4097 | ncr6206 | 4157 | ncr6293 |
| 3918 | ncr5925 | 3978 | ncr6028 | 4038 | ncr6115 | 4098 | ncr6207 | 4158 | ncr6298 |
| 3919 | ncr5927 | 3979 | ncr6029 | 4039 | ncr6116 | 4099 | ncr6208 | 4159 | ncr6301 |
| 3920 | ncr5928 | 3980 | ncr6030 | 4040 | ncr6119 | 4100 | ncr6209 | 4160 | ncr6302 |
| 3921 | ncr5931 | 3981 | ncr6031 | 4041 | ncr6120 | 4101 | ncr6210 | 4161 | ncr6306 |
| 3922 | ncr5932 | 3982 | ncr6033 | 4042 | ncr6121 | 4102 | ncr6211 | 4162 | ncr6307 |
| 3923 | ncr5934 | 3983 | ncr6034 | 4043 | ncr6122 | 4103 | ncr6212 | 4163 | ncr6308 |
| 3924 | ncr5938 | 3984 | ncr6035 | 4044 | ncr6123 | 4104 | ncr6213 | 4164 | ncr6310 |
| 3925 | ncr5939 | 3985 | ncr6036 | 4045 | ncr6125 | 4105 | ncr6215 | 4165 | ncr6311 |
| 3926 | ncr5940 | 3986 | ncr6037 | 4046 | ncr6126 | 4106 | ncr6216 | 4166 | ncr6312 |
| 3927 | ncr5941 | 3987 | ncr6038 | 4047 | ncr6127 | 4107 | ncr6217 | 4167 | ncr6315 |
| 3928 | ncr5942 | 3988 | ncr6040 | 4048 | ncr6128 | 4108 | ncr6220 | 4168 | ncr6316 |
| 3929 | ncr5943 | 3989 | ncr6041 | 4049 | ncr6130 | 4109 | ncr6221 | 4169 | ncr6317 |
| 3930 | ncr5944 | 3990 | ncr6043 | 4050 | ncr6131 | 4110 | ncr6223 | 4170 | ncr6318 |
| 3931 | ncr5945 | 3991 | ncr6044 | 4051 | ncr6132 | 4111 | ncr6224 | 4171 | ncr6320 |
| 3932 | ncr5946 | 3992 | ncr6045 | 4052 | ncr6133 | 4112 | ncr6225 | 4172 | ncr6321 |
| 3933 | ncr5947 | 3993 | ncr6046 | 4053 | ncr6135 | 4113 | ncr6226 | 4173 | ncr6322 |
| 3934 | ncr5949 | 3994 | ncr6047 | 4054 | ncr6136 | 4114 | ncr6227 | 4174 | ncr6323 |
| 3935 | ncr5950 | 3995 | ncr6048 | 4055 | ncr6137 | 4115 | ncr6228 | 4175 | ncr6324 |
| 3936 | ncr5951 | 3996 | ncr6051 | 4056 | ncr6138 | 4116 | ncr6232 | 4176 | ncr6325 |
| 3937 | ncr5952 | 3997 | ncr6053 | 4057 | ncr6140 | 4117 | ncr6233 | 4177 | ncr6326 |
| 3938 | ncr5955 | 3998 | ncr6056 | 4058 | ncr6141 | 4118 | ncr6235 | 4178 | ncr6327 |
| 3939 | ncr5957 | 3999 | ncr6057 | 4059 | ncr6142 | 4119 | ncr6236 | 4179 | ncr6328 |
| 3940 | ncr5959 | 4000 | ncr6059 | 4060 | ncr6143 | 4120 | ncr6237 | 4180 | ncr6330 |
| 3941 | ncr5960 | 4001 | ncr6060 | 4061 | ncr6144 | 4121 | ncr6240 | 4181 | ncr6331 |
| 3942 | ncr5961 | 4002 | ncr6061 | 4062 | ncr6148 | 4122 | ncr6242 | 4182 | ncr6332 |
| 3943 | ncr5963 | 4003 | ncr6063 | 4063 | ncr6152 | 4123 | ncr6244 | 4183 | ncr6334 |
| 3944 | ncr5967 | 4004 | ncr6064 | 4064 | ncr6155 | 4124 | ncr6245 | 4184 | ncr6335 |
| 3945 | ncr5969 | 4005 | ncr6065 | 4065 | ncr6157 | 4125 | ncr6247 | 4185 | ncr6336 |
| 3946 | ncr5971 | 4006 | ncr6067 | 4066 | ncr6159 | 4126 | ncr6252 | 4186 | ncr6339 |
| 3947 | ncr5972 | 4007 | ncr6068 | 4067 | ncr6160 | 4127 | ncr6256 | 4187 | ncr6343 |
| 3948 | ncr5973 | 4008 | ncr6071 | 4068 | ncr6161 | 4128 | ncr6257 | 4188 | ncr6344 |
| 3949 | ncr5975 | 4009 | ncr6072 | 4069 | ncr6163 | 4129 | ncr6259 | 4189 | ncr6345 |
| 3950 | ncr5976 | 4010 | ncr6073 | 4070 | ncr6164 | 4130 | ncr6260 | 4190 | ncr6347 |
| 3951 | ncr5977 | 4011 | ncr6074 | 4071 | ncr6165 | 4131 | ncr6261 | 4191 | ncr6353 |
| 3952 | ncr5979 | 4012 | ncr6076 | 4072 | ncr6167 | 4132 | ncr6262 | 4192 | ncr6357 |
| 3953 | ncr5981 | 4013 | ncr6079 | 4073 | ncr6168 | 4133 | ncr6264 | 4193 | ncr6360 |
| 3954 | ncr5983 | 4014 | ncr6080 | 4074 | ncr6170 | 4134 | ncr6265 | 4194 | ncr6365 |
| 3955 | ncr5984 | 4015 | ncr6082 | 4075 | ncr6176 | 4135 | ncr6266 | 4195 | ncr6368 |
| 3956 | ncr5988 | 4016 | ncr6083 | 4076 | ncr6178 | 4136 | ncr6268 | 4196 | ncr6370 |
| 3957 | ncr5989 | 4017 | ncr6085 | 4077 | ncr6179 | 4137 | ncr6269 | 4197 | ncr6372 |
| 3958 | ncr5990 | 4018 | ncr6086 | 4078 | ncr6180 | 4138 | ncr6272 | 4198 | ncr6373 |
| 3959 | ncr5992 | 4019 | ncr6088 | 4079 | ncr6182 | 4139 | ncr6273 | 4199 | ncr6375 |
| 3960 | ncr5995 | 4020 | ncr6091 | 4080 | ncr6183 | 4140 | ncr6274 | 4200 | ncr6376 |

Figure 6C – List of EST Sequence Names From Normal Cartilage cDNA Library

| | | | | | | | | | |
|---|---|---|---|---|---|---|---|---|---|
| 4201 | ncr6379 | 4261 | ncr6567 | 4321 | ncr6676 | 4381 | ncr6769 | 4441 | ncr6864 |
| 4202 | ncr6381 | 4262 | ncr6570 | 4322 | ncr6677 | 4382 | ncr6771 | 4442 | ncr6866 |
| 4203 | ncr6382 | 4263 | ncr6571 | 4323 | ncr6678 | 4383 | ncr6772 | 4443 | ncr6867 |
| 4204 | ncr6383 | 4264 | ncr6573 | 4324 | ncr6679 | 4384 | ncr6773 | 4444 | ncr6868 |
| 4205 | ncr6384 | 4265 | ncr6575 | 4325 | ncr6681 | 4385 | ncr6774 | 4445 | ncr6869 |
| 4206 | ncr6385 | 4266 | ncr6577 | 4326 | ncr6682 | 4386 | ncr6775 | 4446 | ncr6870 |
| 4207 | ncr6388 | 4267 | ncr6578 | 4327 | ncr6683 | 4387 | ncr6776 | 4447 | ncr6871 |
| 4208 | ncr6389 | 4268 | ncr6579 | 4328 | ncr6684 | 4388 | ncr6779 | 4448 | ncr6873 |
| 4209 | ncr6390 | 4269 | ncr6581 | 4329 | ncr6688 | 4389 | ncr6780 | 4449 | ncr6874 |
| 4210 | ncr6391 | 4270 | ncr6582 | 4330 | ncr6690 | 4390 | ncr6782 | 4450 | ncr6875 |
| 4211 | ncr6393 | 4271 | ncr6584 | 4331 | ncr6691 | 4391 | ncr6786 | 4451 | ncr6877 |
| 4212 | ncr6394 | 4272 | ncr6585 | 4332 | ncr6693 | 4392 | ncr6787 | 4452 | ncr6878 |
| 4213 | ncr6395 | 4273 | ncr6586 | 4333 | ncr6694 | 4393 | ncr6788 | 4453 | ncr6879 |
| 4214 | ncr6396 | 4274 | ncr6588 | 4334 | ncr6695 | 4394 | ncr6791 | 4454 | ncr6880 |
| 4215 | ncr6398 | 4275 | ncr6593 | 4335 | ncr6696 | 4395 | ncr6792 | 4455 | ncr6881 |
| 4216 | ncr6399 | 4276 | ncr6594 | 4336 | ncr6697 | 4396 | ncr6793 | 4456 | ncr6882 |
| 4217 | ncr6400 | 4277 | ncr6595 | 4337 | ncr6699 | 4397 | ncr6797 | 4457 | ncr6883 |
| 4218 | ncr6401 | 4278 | ncr6596 | 4338 | ncr6700 | 4398 | ncr6800 | 4458 | ncr6884 |
| 4219 | ncr6402 | 4279 | ncr6597 | 4339 | ncr6702 | 4399 | ncr6801 | 4459 | ncr6885 |
| 4220 | ncr6403 | 4280 | ncr6598 | 4340 | ncr6703 | 4400 | ncr6802 | 4460 | ncr6886 |
| 4221 | ncr6404 | 4281 | ncr6601 | 4341 | ncr6704 | 4401 | ncr6803 | 4461 | ncr6887 |
| 4222 | ncr6405 | 4282 | ncr6602 | 4342 | ncr6705 | 4402 | ncr6805 | 4462 | ncr6888 |
| 4223 | ncr6407 | 4283 | ncr6603 | 4343 | ncr6706 | 4403 | ncr6806 | 4463 | ncr6891 |
| 4224 | ncr6408 | 4284 | ncr6604 | 4344 | ncr6709 | 4404 | ncr6807 | 4464 | ncr6892 |
| 4225 | ncr6409 | 4285 | ncr6606 | 4345 | ncr6711 | 4405 | ncr6809 | 4465 | ncr6893 |
| 4226 | ncr6410 | 4286 | ncr6608 | 4346 | ncr6714 | 4406 | ncr6810 | 4466 | ncr6894 |
| 4227 | ncr6411 | 4287 | ncr6609 | 4347 | ncr6715 | 4407 | ncr6811 | 4467 | ncr6896 |
| 4228 | ncr6412 | 4288 | ncr6610 | 4348 | ncr6716 | 4408 | ncr6813 | 4468 | ncr6897 |
| 4229 | ncr6415 | 4289 | ncr6612 | 4349 | ncr6719 | 4409 | ncr6814 | 4469 | ncr6898 |
| 4230 | ncr6416 | 4290 | ncr6613 | 4350 | ncr6723 | 4410 | ncr6815 | 4470 | ncr6899 |
| 4231 | ncr6417 | 4291 | ncr6614 | 4351 | ncr6725 | 4411 | ncr6816 | 4471 | ncr6900 |
| 4232 | ncr6419 | 4292 | ncr6619 | 4352 | ncr6729 | 4412 | ncr6817 | 4472 | ncr6901 |
| 4233 | ncr6420 | 4293 | ncr6624 | 4353 | ncr6733 | 4413 | ncr6818 | 4473 | ncr6902 |
| 4234 | ncr6422 | 4294 | ncr6628 | 4354 | ncr6734 | 4414 | ncr6819 | 4474 | ncr6903 |
| 4235 | ncr6424 | 4295 | ncr6631 | 4355 | ncr6735 | 4415 | ncr6820 | 4475 | ncr6905 |
| 4236 | ncr6425 | 4296 | ncr6632 | 4356 | ncr6736 | 4416 | ncr6821 | 4476 | ncr6907 |
| 4237 | ncr6426 | 4297 | ncr6633 | 4357 | ncr6739 | 4417 | ncr6824 | 4477 | ncr6908 |
| 4238 | ncr6427 | 4298 | ncr6635 | 4358 | ncr6740 | 4418 | ncr6825 | 4478 | ncr6909 |
| 4239 | ncr6428 | 4299 | ncr6637 | 4359 | ncr6741 | 4419 | ncr6826 | 4479 | ncr6910 |
| 4240 | ncr6429 | 4300 | ncr6639 | 4360 | ncr6743 | 4420 | ncr6827 | 4480 | ncr6911 |
| 4241 | ncr6430 | 4301 | ncr6640 | 4361 | ncr6744 | 4421 | ncr6831 | 4481 | ncr6912 |
| 4242 | ncr6431 | 4302 | ncr6641 | 4362 | ncr6745 | 4422 | ncr6832 | 4482 | ncr6916 |
| 4243 | ncr6432 | 4303 | ncr6644 | 4363 | ncr6746 | 4423 | ncr6836 | 4483 | ncr6917 |
| 4244 | ncr6533 | 4304 | ncr6647 | 4364 | ncr6747 | 4424 | ncr6837 | 4484 | ncr6919 |
| 4245 | ncr6535 | 4305 | ncr6649 | 4365 | ncr6748 | 4425 | ncr6839 | 4485 | ncr6920 |
| 4246 | ncr6537 | 4306 | ncr6650 | 4366 | ncr6749 | 4426 | ncr6841 | 4486 | ncr6921 |
| 4247 | ncr6539 | 4307 | ncr6651 | 4367 | ncr6751 | 4427 | ncr6842 | 4487 | ncr6923 |
| 4248 | ncr6540 | 4308 | ncr6656 | 4368 | ncr6752 | 4428 | ncr6843 | 4488 | ncr6924 |
| 4249 | ncr6541 | 4309 | ncr6657 | 4369 | ncr6753 | 4429 | ncr6845 | 4489 | ncr6925 |
| 4250 | ncr6543 | 4310 | ncr6658 | 4370 | ncr6754 | 4430 | ncr6847 | 4490 | ncr6927 |
| 4251 | ncr6547 | 4311 | ncr6659 | 4371 | ncr6755 | 4431 | ncr6848 | 4491 | ncr6928 |
| 4252 | ncr6548 | 4312 | ncr6661 | 4372 | ncr6756 | 4432 | ncr6850 | 4492 | ncr6931 |
| 4253 | ncr6549 | 4313 | ncr6663 | 4373 | ncr6757 | 4433 | ncr6851 | 4493 | ncr6932 |
| 4254 | ncr6552 | 4314 | ncr6664 | 4374 | ncr6758 | 4434 | ncr6852 | 4494 | ncr6933 |
| 4255 | ncr6553 | 4315 | ncr6666 | 4375 | ncr6759 | 4435 | ncr6853 | 4495 | ncr6937 |
| 4256 | ncr6557 | 4316 | ncr6669 | 4376 | ncr6760 | 4436 | ncr6854 | 4496 | ncr6938 |
| 4257 | ncr6560 | 4317 | ncr6672 | 4377 | ncr6764 | 4437 | ncr6856 | 4497 | ncr6939 |
| 4258 | ncr6562 | 4318 | ncr6673 | 4378 | ncr6765 | 4438 | ncr6858 | 4498 | ncr6941 |
| 4259 | ncr6563 | 4319 | ncr6674 | 4379 | ncr6767 | 4439 | ncr6859 | 4499 | ncr6943 |
| 4260 | ncr6564 | 4320 | ncr6675 | 4380 | ncr6768 | 4440 | ncr6860 | 4500 | ncr6944 |

Figure 6C – List of EST Sequence Names From Normal Cartilage cDNA Library

| | | | | | | | | | |
|---|---|---|---|---|---|---|---|---|---|
| 4501 | ncr6945 | 4561 | ncr7047 | 4621 | ncr7137 | 4681 | ncr7220 | 4741 | ncr7307 |
| 4502 | ncr6946 | 4562 | ncr7048 | 4622 | ncr7138 | 4682 | ncr7223 | 4742 | ncr7308 |
| 4503 | ncr6947 | 4563 | ncr7050 | 4623 | ncr7139 | 4683 | ncr7224 | 4743 | ncr7309 |
| 4504 | ncr6948 | 4564 | ncr7051 | 4624 | ncr7140 | 4684 | ncr7226 | 4744 | ncr7312 |
| 4505 | ncr6951 | 4565 | ncr7052 | 4625 | ncr7141 | 4685 | ncr7227 | 4745 | ncr7313 |
| 4506 | ncr6952 | 4566 | ncr7053 | 4626 | ncr7142 | 4686 | ncr7229 | 4746 | ncr7317 |
| 4507 | ncr6956 | 4567 | ncr7055 | 4627 | ncr7143 | 4687 | ncr7231 | 4747 | ncr7322 |
| 4508 | ncr6957 | 4568 | ncr7056 | 4628 | ncr7144 | 4688 | ncr7232 | 4748 | ncr7324 |
| 4509 | ncr6958 | 4569 | ncr7058 | 4629 | ncr7147 | 4689 | ncr7234 | 4749 | ncr7325 |
| 4510 | ncr6959 | 4570 | ncr7062 | 4630 | ncr7148 | 4690 | ncr7236 | 4750 | ncr7326 |
| 4511 | ncr6961 | 4571 | ncr7063 | 4631 | ncr7149 | 4691 | ncr7238 | 4751 | ncr7328 |
| 4512 | ncr6962 | 4572 | ncr7064 | 4632 | ncr7150 | 4692 | ncr7239 | 4752 | ncr7330 |
| 4513 | ncr6964 | 4573 | ncr7066 | 4633 | ncr7151 | 4693 | ncr7240 | 4753 | ncr7331 |
| 4514 | ncr6966 | 4574 | ncr7067 | 4634 | ncr7152 | 4694 | ncr7242 | 4754 | ncr7332 |
| 4515 | ncr6967 | 4575 | ncr7069 | 4635 | ncr7155 | 4695 | ncr7243 | 4755 | ncr7333 |
| 4516 | ncr6968 | 4576 | ncr7070 | 4636 | ncr7156 | 4696 | ncr7244 | 4756 | ncr7334 |
| 4517 | ncr6970 | 4577 | ncr7071 | 4637 | ncr7157 | 4697 | ncr7245 | 4757 | ncr7338 |
| 4518 | ncr6974 | 4578 | ncr7072 | 4638 | ncr7158 | 4698 | ncr7247 | 4758 | ncr7339 |
| 4519 | ncr6975 | 4579 | ncr7074 | 4639 | ncr7159 | 4699 | ncr7248 | 4759 | ncr7341 |
| 4520 | ncr6977 | 4580 | ncr7075 | 4640 | ncr7160 | 4700 | ncr7249 | 4760 | ncr7342 |
| 4521 | ncr6979 | 4581 | ncr7077 | 4641 | ncr7161 | 4701 | ncr7250 | 4761 | ncr7343 |
| 4522 | ncr6981 | 4582 | ncr7078 | 4642 | ncr7162 | 4702 | ncr7251 | 4762 | ncr7344 |
| 4523 | ncr6983 | 4583 | ncr7079 | 4643 | ncr7163 | 4703 | ncr7253 | 4763 | ncr7345 |
| 4524 | ncr6986 | 4584 | ncr7080 | 4644 | ncr7164 | 4704 | ncr7254 | 4764 | ncr7347 |
| 4525 | ncr6987 | 4585 | ncr7081 | 4645 | ncr7165 | 4705 | ncr7255 | 4765 | ncr7348 |
| 4526 | ncr6988 | 4586 | ncr7082 | 4646 | ncr7166 | 4706 | ncr7256 | 4766 | ncr7349 |
| 4527 | ncr6991 | 4587 | ncr7083 | 4647 | ncr7168 | 4707 | ncr7257 | 4767 | ncr7350 |
| 4528 | ncr6994 | 4588 | ncr7085 | 4648 | ncr7170 | 4708 | ncr7258 | 4768 | ncr7351 |
| 4529 | ncr6995 | 4589 | ncr7086 | 4649 | ncr7171 | 4709 | ncr7259 | 4769 | ncr7352 |
| 4530 | ncr6997 | 4590 | ncr7088 | 4650 | ncr7172 | 4710 | ncr7261 | 4770 | ncr7353 |
| 4531 | ncr6999 | 4591 | ncr7089 | 4651 | ncr7173 | 4711 | ncr7262 | 4771 | ncr7354 |
| 4532 | ncr7000 | 4592 | ncr7090 | 4652 | ncr7175 | 4712 | ncr7263 | 4772 | ncr7355 |
| 4533 | ncr7001 | 4593 | ncr7091 | 4653 | ncr7176 | 4713 | ncr7265 | 4773 | ncr7356 |
| 4534 | ncr7002 | 4594 | ncr7093 | 4654 | ncr7177 | 4714 | ncr7266 | 4774 | ncr7357 |
| 4535 | ncr7003 | 4595 | ncr7095 | 4655 | ncr7178 | 4715 | ncr7267 | 4775 | ncr7359 |
| 4536 | ncr7005 | 4596 | ncr7096 | 4656 | ncr7180 | 4716 | ncr7268 | 4776 | ncr7360 |
| 4537 | ncr7006 | 4597 | ncr7097 | 4657 | ncr7181 | 4717 | ncr7270 | 4777 | ncr7361 |
| 4538 | ncr7007 | 4598 | ncr7098 | 4658 | ncr7182 | 4718 | ncr7271 | 4778 | ncr7364 |
| 4539 | ncr7008 | 4599 | ncr7099 | 4659 | ncr7184 | 4719 | ncr7272 | 4779 | ncr7365 |
| 4540 | ncr7013 | 4600 | ncr7100 | 4660 | ncr7185 | 4720 | ncr7275 | 4780 | ncr7366 |
| 4541 | ncr7016 | 4601 | ncr7102 | 4661 | ncr7187 | 4721 | ncr7276 | 4781 | ncr7368 |
| 4542 | ncr7017 | 4602 | ncr7103 | 4662 | ncr7188 | 4722 | ncr7277 | 4782 | ncr7369 |
| 4543 | ncr7019 | 4603 | ncr7104 | 4663 | ncr7189 | 4723 | ncr7279 | 4783 | ncr7371 |
| 4544 | ncr7020 | 4604 | ncr7108 | 4664 | ncr7190 | 4724 | ncr7280 | 4784 | ncr7372 |
| 4545 | ncr7021 | 4605 | ncr7109 | 4665 | ncr7191 | 4725 | ncr7282 | 4785 | ncr7373 |
| 4546 | ncr7023 | 4606 | ncr7111 | 4666 | ncr7192 | 4726 | ncr7284 | 4786 | ncr7374 |
| 4547 | ncr7024 | 4607 | ncr7112 | 4667 | ncr7193 | 4727 | ncr7286 | 4787 | ncr7375 |
| 4548 | ncr7025 | 4608 | ncr7115 | 4668 | ncr7194 | 4728 | ncr7287 | 4788 | ncr7376 |
| 4549 | ncr7027 | 4609 | ncr7116 | 4669 | ncr7196 | 4729 | ncr7288 | 4789 | ncr7377 |
| 4550 | ncr7028 | 4610 | ncr7117 | 4670 | ncr7197 | 4730 | ncr7289 | 4790 | ncr7378 |
| 4551 | ncr7029 | 4611 | ncr7119 | 4671 | ncr7198 | 4731 | ncr7290 | 4791 | ncr7379 |
| 4552 | ncr7031 | 4612 | ncr7124 | 4672 | ncr7199 | 4732 | ncr7291 | 4792 | ncr7381 |
| 4553 | ncr7033 | 4613 | ncr7125 | 4673 | ncr7204 | 4733 | ncr7292 | 4793 | ncr7382 |
| 4554 | ncr7035 | 4614 | ncr7127 | 4674 | ncr7205 | 4734 | ncr7293 | 4794 | ncr7383 |
| 4555 | ncr7036 | 4615 | ncr7128 | 4675 | ncr7207 | 4735 | ncr7294 | 4795 | ncr7385 |
| 4556 | ncr7037 | 4616 | ncr7129 | 4676 | ncr7211 | 4736 | ncr7295 | 4796 | ncr7386 |
| 4557 | ncr7039 | 4617 | ncr7131 | 4677 | ncr7212 | 4737 | ncr7296 | 4797 | ncr7387 |
| 4558 | ncr7041 | 4618 | ncr7132 | 4678 | ncr7215 | 4738 | ncr7299 | 4798 | ncr7388 |
| 4559 | ncr7042 | 4619 | ncr7133 | 4679 | ncr7216 | 4739 | ncr7301 | 4799 | ncr7389 |
| 4560 | ncr7046 | 4620 | ncr7136 | 4680 | ncr7219 | 4740 | ncr7303 | 4800 | ncr7390 |

Figure 6C - List of EST Sequence Names From Normal Cartilage cDNA Library

| | | | | | | | | | |
|---|---|---|---|---|---|---|---|---|---|
| 4801 | ncr7392 | 4861 | ncr7493 | 4921 | ncr7574 | 4981 | ncr7672 | 5041 | ncr7754 |
| 4802 | ncr7395 | 4862 | ncr7495 | 4922 | ncr7576 | 4982 | ncr7673 | 5042 | ncr7755 |
| 4803 | ncr7396 | 4863 | ncr7499 | 4923 | ncr7577 | 4983 | ncr7674 | 5043 | ncr7756 |
| 4804 | ncr7397 | 4864 | ncr7500 | 4924 | ncr7578 | 4984 | ncr7675 | 5044 | ncr7757 |
| 4805 | ncr7399 | 4865 | ncr7501 | 4925 | ncr7579 | 4985 | ncr7676 | 5045 | ncr7758 |
| 4806 | ncr7400 | 4866 | ncr7503 | 4926 | ncr7580 | 4986 | ncr7678 | 5046 | ncr7759 |
| 4807 | ncr7407 | 4867 | ncr7504 | 4927 | ncr7581 | 4987 | ncr7679 | 5047 | ncr7760 |
| 4808 | ncr7408 | 4868 | ncr7505 | 4928 | ncr7582 | 4988 | ncr7680 | 5048 | ncr7762 |
| 4809 | ncr7409 | 4869 | ncr7507 | 4929 | ncr7588 | 4989 | ncr7682 | 5049 | ncr7763 |
| 4810 | ncr7411 | 4870 | ncr7508 | 4930 | ncr7589 | 4990 | ncr7683 | 5050 | ncr7764 |
| 4811 | ncr7412 | 4871 | ncr7509 | 4931 | ncr7591 | 4991 | ncr7684 | 5051 | ncr7765 |
| 4812 | ncr7413 | 4872 | ncr7511 | 4932 | ncr7595 | 4992 | ncr7688 | 5052 | ncr7767 |
| 4813 | ncr7417 | 4873 | ncr7512 | 4933 | ncr7596 | 4993 | ncr7691 | 5053 | ncr7768 |
| 4814 | ncr7418 | 4874 | ncr7513 | 4934 | ncr7598 | 4994 | ncr7693 | 5054 | ncr7769 |
| 4815 | ncr7419 | 4875 | ncr7514 | 4935 | ncr7600 | 4995 | ncr7694 | 5055 | ncr7770 |
| 4816 | ncr7420 | 4876 | ncr7515 | 4936 | ncr7601 | 4996 | ncr7695 | 5056 | ncr7771 |
| 4817 | ncr7423 | 4877 | ncr7516 | 4937 | ncr7603 | 4997 | ncr7696 | 5057 | ncr7772 |
| 4818 | ncr7425 | 4878 | ncr7517 | 4938 | ncr7605 | 4998 | ncr7697 | 5058 | ncr7773 |
| 4819 | ncr7426 | 4879 | ncr7519 | 4939 | ncr7606 | 4999 | ncr7699 | 5059 | ncr7774 |
| 4820 | ncr7428 | 4880 | ncr7520 | 4940 | ncr7607 | 5000 | ncr7703 | 5060 | ncr7775 |
| 4821 | ncr7429 | 4881 | ncr7522 | 4941 | ncr7609 | 5001 | ncr7705 | 5061 | ncr7776 |
| 4822 | ncr7430 | 4882 | ncr7523 | 4942 | ncr7617 | 5002 | ncr7707 | 5062 | ncr7778 |
| 4823 | ncr7431 | 4883 | ncr7525 | 4943 | ncr7618 | 5003 | ncr7708 | 5063 | ncr7780 |
| 4824 | ncr7432 | 4884 | ncr7528 | 4944 | ncr7619 | 5004 | ncr7709 | 5064 | ncr7783 |
| 4825 | ncr7434 | 4885 | ncr7530 | 4945 | ncr7621 | 5005 | ncr7711 | 5065 | ncr7784 |
| 4826 | ncr7438 | 4886 | ncr7531 | 4946 | ncr7622 | 5006 | ncr7712 | 5066 | ncr7787 |
| 4827 | ncr7448 | 4887 | ncr7532 | 4947 | ncr7623 | 5007 | ncr7713 | 5067 | ncr7788 |
| 4828 | ncr7449 | 4888 | ncr7533 | 4948 | ncr7624 | 5008 | ncr7714 | 5068 | ncr7789 |
| 4829 | ncr7450 | 4889 | ncr7534 | 4949 | ncr7626 | 5009 | ncr7715 | 5069 | ncr7791 |
| 4830 | ncr7451 | 4890 | ncr7535 | 4950 | ncr7628 | 5010 | ncr7716 | 5070 | ncr7792 |
| 4831 | ncr7452 | 4891 | ncr7537 | 4951 | ncr7629 | 5011 | ncr7719 | 5071 | ncr7793 |
| 4832 | ncr7453 | 4892 | ncr7538 | 4952 | ncr7630 | 5012 | ncr7720 | 5072 | ncr7795 |
| 4833 | ncr7454 | 4893 | ncr7539 | 4953 | ncr7631 | 5013 | ncr7722 | 5073 | ncr7796 |
| 4834 | ncr7455 | 4894 | ncr7540 | 4954 | ncr7632 | 5014 | ncr7724 | 5074 | ncr7797 |
| 4835 | ncr7456 | 4895 | ncr7541 | 4955 | ncr7633 | 5015 | ncr7725 | 5075 | ncr7799 |
| 4836 | ncr7458 | 4896 | ncr7542 | 4956 | ncr7634 | 5016 | ncr7726 | 5076 | ncr7801 |
| 4837 | ncr7460 | 4897 | ncr7543 | 4957 | ncr7636 | 5017 | ncr7727 | 5077 | ncr7802 |
| 4838 | ncr7463 | 4898 | ncr7544 | 4958 | ncr7637 | 5018 | ncr7728 | 5078 | ncr7803 |
| 4839 | ncr7464 | 4899 | ncr7545 | 4959 | ncr7638 | 5019 | ncr7729 | 5079 | ncr7805 |
| 4840 | ncr7465 | 4900 | ncr7546 | 4960 | ncr7639 | 5020 | ncr7730 | 5080 | ncr7808 |
| 4841 | ncr7467 | 4901 | ncr7547 | 4961 | ncr7642 | 5021 | ncr7731 | 5081 | ncr7809 |
| 4842 | ncr7468 | 4902 | ncr7548 | 4962 | ncr7643 | 5022 | ncr7732 | 5082 | ncr7810 |
| 4843 | ncr7470 | 4903 | ncr7549 | 4963 | ncr7644 | 5023 | ncr7733 | 5083 | ncr7812 |
| 4844 | ncr7471 | 4904 | ncr7551 | 4964 | ncr7646 | 5024 | ncr7734 | 5084 | ncr7813 |
| 4845 | ncr7472 | 4905 | ncr7555 | 4965 | ncr7647 | 5025 | ncr7735 | 5085 | ncr7815 |
| 4846 | ncr7473 | 4906 | ncr7556 | 4966 | ncr7648 | 5026 | ncr7736 | 5086 | ncr7816 |
| 4847 | ncr7475 | 4907 | ncr7557 | 4967 | ncr7649 | 5027 | ncr7737 | 5087 | ncr7818 |
| 4848 | ncr7476 | 4908 | ncr7558 | 4968 | ncr7651 | 5028 | ncr7739 | 5088 | ncr7819 |
| 4849 | ncr7477 | 4909 | ncr7559 | 4969 | ncr7652 | 5029 | ncr7740 | 5089 | ncr7820 |
| 4850 | ncr7478 | 4910 | ncr7560 | 4970 | ncr7655 | 5030 | ncr7741 | 5090 | ncr7823 |
| 4851 | ncr7479 | 4911 | ncr7561 | 4971 | ncr7657 | 5031 | ncr7742 | 5091 | ncr7824 |
| 4852 | ncr7480 | 4912 | ncr7563 | 4972 | ncr7661 | 5032 | ncr7744 | 5092 | ncr7826 |
| 4853 | ncr7481 | 4913 | ncr7564 | 4973 | ncr7663 | 5033 | ncr7746 | 5093 | ncr7827 |
| 4854 | ncr7482 | 4914 | ncr7565 | 4974 | ncr7664 | 5034 | ncr7747 | 5094 | ncr7828 |
| 4855 | ncr7483 | 4915 | ncr7567 | 4975 | ncr7665 | 5035 | ncr7748 | 5095 | ncr7829 |
| 4856 | ncr7484 | 4916 | ncr7568 | 4976 | ncr7666 | 5036 | ncr7749 | 5096 | ncr7831 |
| 4857 | ncr7485 | 4917 | ncr7569 | 4977 | ncr7668 | 5037 | ncr7750 | 5097 | ncr7834 |
| 4858 | ncr7486 | 4918 | ncr7570 | 4978 | ncr7669 | 5038 | ncr7751 | 5098 | ncr7835 |
| 4859 | ncr7487 | 4919 | ncr7571 | 4979 | ncr7670 | 5039 | ncr7752 | 5099 | ncr7836 |
| 4860 | ncr7488 | 4920 | ncr7573 | 4980 | ncr7671 | 5040 | ncr7753 | 5100 | ncr7837 |

Figure 6C – List of EST Sequence Names From Normal Cartilage cDNA Library

| | | | | | | | | | |
|---|---|---|---|---|---|---|---|---|---|
| 5101 | ncr7838 | 5161 | ncr7926 | 5221 | ncr8018 | 5281 | ncr8107 | 5341 | ncr8186 |
| 5102 | ncr7839 | 5162 | ncr7927 | 5222 | ncr8019 | 5282 | ncr8108 | 5342 | ncr8187 |
| 5103 | ncr7840 | 5163 | ncr7929 | 5223 | ncr8020 | 5283 | ncr8109 | 5343 | ncr8188 |
| 5104 | ncr7841 | 5164 | ncr7931 | 5224 | ncr8024 | 5284 | ncr8110 | 5344 | ncr8189 |
| 5105 | ncr7843 | 5165 | ncr7932 | 5225 | ncr8025 | 5285 | ncr8111 | 5345 | ncr8191 |
| 5106 | ncr7844 | 5166 | ncr7933 | 5226 | ncr8026 | 5286 | ncr8112 | 5346 | ncr8192 |
| 5107 | ncr7845 | 5167 | ncr7934 | 5227 | ncr8027 | 5287 | ncr8113 | 5347 | ncr8193 |
| 5108 | ncr7846 | 5168 | ncr7936 | 5228 | ncr8030 | 5288 | ncr8114 | 5348 | ncr8197 |
| 5109 | ncr7848 | 5169 | ncr7937 | 5229 | ncr8031 | 5289 | ncr8115 | 5349 | ncr8198 |
| 5110 | ncr7849 | 5170 | ncr7938 | 5230 | ncr8032 | 5290 | ncr8116 | 5350 | ncr8199 |
| 5111 | ncr7850 | 5171 | ncr7941 | 5231 | ncr8033 | 5291 | ncr8118 | 5351 | ncr8200 |
| 5112 | ncr7852 | 5172 | ncr7943 | 5232 | ncr8034 | 5292 | ncr8119 | 5352 | ncr8202 |
| 5113 | ncr7853 | 5173 | ncr7944 | 5233 | ncr8035 | 5293 | ncr8121 | 5353 | ncr8203 |
| 5114 | ncr7854 | 5174 | ncr7945 | 5234 | ncr8036 | 5294 | ncr8122 | 5354 | ncr8207 |
| 5115 | ncr7855 | 5175 | ncr7946 | 5235 | ncr8038 | 5295 | ncr8124 | 5355 | ncr8208 |
| 5116 | ncr7857 | 5176 | ncr7947 | 5236 | ncr8039 | 5296 | ncr8125 | 5356 | ncr8210 |
| 5117 | ncr7859 | 5177 | ncr7948 | 5237 | ncr8040 | 5297 | ncr8126 | 5357 | ncr8211 |
| 5118 | ncr7862 | 5178 | ncr7949 | 5238 | ncr8041 | 5298 | ncr8127 | 5358 | ncr8212 |
| 5119 | ncr7863 | 5179 | ncr7951 | 5239 | ncr8042 | 5299 | ncr8128 | 5359 | ncr8215 |
| 5120 | ncr7864 | 5180 | ncr7952 | 5240 | ncr8044 | 5300 | ncr8129 | 5360 | ncr8216 |
| 5121 | ncr7869 | 5181 | ncr7953 | 5241 | ncr8046 | 5301 | ncr8130 | 5361 | ncr8219 |
| 5122 | ncr7871 | 5182 | ncr7955 | 5242 | ncr8047 | 5302 | ncr8131 | 5362 | ncr8220 |
| 5123 | ncr7875 | 5183 | ncr7956 | 5243 | ncr8049 | 5303 | ncr8132 | 5363 | ncr8221 |
| 5124 | ncr7876 | 5184 | ncr7957 | 5244 | ncr8052 | 5304 | ncr8133 | 5364 | ncr8224 |
| 5125 | ncr7877 | 5185 | ncr7958 | 5245 | ncr8053 | 5305 | ncr8134 | 5365 | ncr8225 |
| 5126 | ncr7879 | 5186 | ncr7959 | 5246 | ncr8054 | 5306 | ncr8137 | 5366 | ncr8226 |
| 5127 | ncr7880 | 5187 | ncr7960 | 5247 | ncr8055 | 5307 | ncr8138 | 5367 | ncr8227 |
| 5128 | ncr7881 | 5188 | ncr7961 | 5248 | ncr8056 | 5308 | ncr8139 | 5368 | ncr8228 |
| 5129 | ncr7883 | 5189 | ncr7962 | 5249 | ncr8058 | 5309 | ncr8141 | 5369 | ncr8230 |
| 5130 | ncr7884 | 5190 | ncr7964 | 5250 | ncr8059 | 5310 | ncr8142 | 5370 | ncr8231 |
| 5131 | ncr7885 | 5191 | ncr7965 | 5251 | ncr8060 | 5311 | ncr8144 | 5371 | ncr8232 |
| 5132 | ncr7888 | 5192 | ncr7966 | 5252 | ncr8061 | 5312 | ncr8146 | 5372 | ncr8233 |
| 5133 | ncr7889 | 5193 | ncr7967 | 5253 | ncr8062 | 5313 | ncr8147 | 5373 | ncr8234 |
| 5134 | ncr7891 | 5194 | ncr7968 | 5254 | ncr8063 | 5314 | ncr8148 | 5374 | ncr8235 |
| 5135 | ncr7892 | 5195 | ncr7971 | 5255 | ncr8064 | 5315 | ncr8149 | 5375 | ncr8236 |
| 5136 | ncr7893 | 5196 | ncr7973 | 5256 | ncr8067 | 5316 | ncr8150 | 5376 | ncr8237 |
| 5137 | ncr7895 | 5197 | ncr7975 | 5257 | ncr8068 | 5317 | ncr8151 | 5377 | ncr8239 |
| 5138 | ncr7896 | 5198 | ncr7976 | 5258 | ncr8069 | 5318 | ncr8152 | 5378 | ncr8241 |
| 5139 | ncr7897 | 5199 | ncr7979 | 5259 | ncr8071 | 5319 | ncr8153 | 5379 | ncr8242 |
| 5140 | ncr7900 | 5200 | ncr7983 | 5260 | ncr8073 | 5320 | ncr8154 | 5380 | ncr8243 |
| 5141 | ncr7901 | 5201 | ncr7984 | 5261 | ncr8075 | 5321 | ncr8156 | 5381 | ncr8244 |
| 5142 | ncr7903 | 5202 | ncr7985 | 5262 | ncr8076 | 5322 | ncr8157 | 5382 | ncr8245 |
| 5143 | ncr7904 | 5203 | ncr7987 | 5263 | ncr8077 | 5323 | ncr8158 | 5383 | ncr8247 |
| 5144 | ncr7905 | 5204 | ncr7988 | 5264 | ncr8079 | 5324 | ncr8160 | 5384 | ncr8248 |
| 5145 | ncr7906 | 5205 | ncr7989 | 5265 | ncr8080 | 5325 | ncr8164 | 5385 | ncr8249 |
| 5146 | ncr7907 | 5206 | ncr7991 | 5266 | ncr8081 | 5326 | ncr8166 | 5386 | ncr8250 |
| 5147 | ncr7908 | 5207 | ncr7992 | 5267 | ncr8083 | 5327 | ncr8167 | 5387 | ncr8251 |
| 5148 | ncr7909 | 5208 | ncr7994 | 5268 | ncr8085 | 5328 | ncr8169 | 5388 | ncr8252 |
| 5149 | ncr7910 | 5209 | ncr7995 | 5269 | ncr8086 | 5329 | ncr8171 | 5389 | ncr8253 |
| 5150 | ncr7912 | 5210 | ncr7996 | 5270 | ncr8089 | 5330 | ncr8172 | 5390 | ncr8254 |
| 5151 | ncr7914 | 5211 | ncr7999 | 5271 | ncr8091 | 5331 | ncr8173 | 5391 | ncr8256 |
| 5152 | ncr7915 | 5212 | ncr8001 | 5272 | ncr8092 | 5332 | ncr8174 | 5392 | ncr8259 |
| 5153 | ncr7917 | 5213 | ncr8003 | 5273 | ncr8093 | 5333 | ncr8175 | 5393 | ncr8260 |
| 5154 | ncr7918 | 5214 | ncr8005 | 5274 | ncr8095 | 5334 | ncr8176 | 5394 | ncr8261 |
| 5155 | ncr7919 | 5215 | ncr8007 | 5275 | ncr8096 | 5335 | ncr8177 | 5395 | ncr8263 |
| 5156 | ncr7921 | 5216 | ncr8008 | 5276 | ncr8097 | 5336 | ncr8180 | 5396 | ncr8267 |
| 5157 | ncr7922 | 5217 | ncr8012 | 5277 | ncr8099 | 5337 | ncr8181 | 5397 | ncr8268 |
| 5158 | ncr7923 | 5218 | ncr8013 | 5278 | ncr8100 | 5338 | ncr8182 | 5398 | ncr8272 |
| 5159 | ncr7924 | 5219 | ncr8015 | 5279 | ncr8101 | 5339 | ncr8183 | 5399 | ncr8273 |
| 5160 | ncr7925 | 5220 | ncr8017 | 5280 | ncr8103 | 5340 | ncr8184 | 5400 | ncr8275 |

Figure 6C – List of EST Sequence Names From Normal Cartilage cDNA Library

| | | | | | | | | | |
|---|---|---|---|---|---|---|---|---|---|
| 5401 | ncr8276 | 5461 | ncr8367 | 5521 | ncr8464 | 5581 | ncr8551 | 5641 | ncr8659 |
| 5402 | ncr8277 | 5462 | ncr8368 | 5522 | ncr8467 | 5582 | ncr8555 | 5642 | ncr8660 |
| 5403 | ncr8280 | 5463 | ncr8372 | 5523 | ncr8468 | 5583 | ncr8556 | 5643 | ncr8663 |
| 5404 | ncr8281 | 5464 | ncr8373 | 5524 | ncr8469 | 5584 | ncr8560 | 5644 | ncr8665 |
| 5405 | ncr8282 | 5465 | ncr8375 | 5525 | ncr8471 | 5585 | ncr8563 | 5645 | ncr8666 |
| 5406 | ncr8284 | 5466 | ncr8376 | 5526 | ncr8472 | 5586 | ncr8565 | 5646 | ncr8667 |
| 5407 | ncr8287 | 5467 | ncr8377 | 5527 | ncr8473 | 5587 | ncr8568 | 5647 | ncr8668 |
| 5408 | ncr8288 | 5468 | ncr8378 | 5528 | ncr8475 | 5588 | ncr8569 | 5648 | ncr8669 |
| 5409 | ncr8289 | 5469 | ncr8381 | 5529 | ncr8476 | 5589 | ncr8572 | 5649 | ncr8671 |
| 5410 | ncr8290 | 5470 | ncr8386 | 5530 | ncr8477 | 5590 | ncr8573 | 5650 | ncr8672 |
| 5411 | ncr8291 | 5471 | ncr8390 | 5531 | ncr8479 | 5591 | ncr8575 | 5651 | ncr8677 |
| 5412 | ncr8292 | 5472 | ncr8392 | 5532 | ncr8481 | 5592 | ncr8578 | 5652 | ncr8678 |
| 5413 | ncr8293 | 5473 | ncr8394 | 5533 | ncr8482 | 5593 | ncr8579 | 5653 | ncr8680 |
| 5414 | ncr8294 | 5474 | ncr8395 | 5534 | ncr8483 | 5594 | ncr8584 | 5654 | ncr8684 |
| 5415 | ncr8295 | 5475 | ncr8396 | 5535 | ncr8484 | 5595 | ncr8588 | 5655 | ncr8685 |
| 5416 | ncr8296 | 5476 | ncr8397 | 5536 | ncr8485 | 5596 | ncr8589 | 5656 | ncr8686 |
| 5417 | ncr8299 | 5477 | ncr8398 | 5537 | ncr8486 | 5597 | ncr8593 | 5657 | ncr8687 |
| 5418 | ncr8300 | 5478 | ncr8399 | 5538 | ncr8487 | 5598 | ncr8594 | 5658 | ncr8688 |
| 5419 | ncr8301 | 5479 | ncr8400 | 5539 | ncr8488 | 5599 | ncr8595 | 5659 | ncr8689 |
| 5420 | ncr8302 | 5480 | ncr8401 | 5540 | ncr8490 | 5600 | ncr8596 | 5660 | ncr8692 |
| 5421 | ncr8303 | 5481 | ncr8402 | 5541 | ncr8491 | 5601 | ncr8597 | 5661 | ncr8693 |
| 5422 | ncr8304 | 5482 | ncr8404 | 5542 | ncr8492 | 5602 | ncr8598 | 5662 | ncr8694 |
| 5423 | ncr8305 | 5483 | ncr8405 | 5543 | ncr8493 | 5603 | ncr8599 | 5663 | ncr8695 |
| 5424 | ncr8309 | 5484 | ncr8406 | 5544 | ncr8494 | 5604 | ncr8601 | 5664 | ncr8698 |
| 5425 | ncr8310 | 5485 | ncr8407 | 5545 | ncr8495 | 5605 | ncr8602 | 5665 | ncr8699 |
| 5426 | ncr8311 | 5486 | ncr8409 | 5546 | ncr8498 | 5606 | ncr8603 | 5666 | ncr8701 |
| 5427 | ncr8313 | 5487 | ncr8411 | 5547 | ncr8499 | 5607 | ncr8606 | 5667 | ncr8702 |
| 5428 | ncr8314 | 5488 | ncr8413 | 5548 | ncr8500 | 5608 | ncr8607 | 5668 | ncr8703 |
| 5429 | ncr8316 | 5489 | ncr8414 | 5549 | ncr8503 | 5609 | ncr8609 | 5669 | ncr8704 |
| 5430 | ncr8317 | 5490 | ncr8415 | 5550 | ncr8504 | 5610 | ncr8610 | 5670 | ncr8705 |
| 5431 | ncr8318 | 5491 | ncr8416 | 5551 | ncr8507 | 5611 | ncr8611 | 5671 | ncr8706 |
| 5432 | ncr8320 | 5492 | ncr8418 | 5552 | ncr8508 | 5612 | ncr8612 | 5672 | ncr8707 |
| 5433 | ncr8322 | 5493 | ncr8419 | 5553 | ncr8509 | 5613 | ncr8613 | 5673 | ncr8708 |
| 5434 | ncr8324 | 5494 | ncr8420 | 5554 | ncr8511 | 5614 | ncr8615 | 5674 | ncr8709 |
| 5435 | ncr8326 | 5495 | ncr8422 | 5555 | ncr8512 | 5615 | ncr8616 | 5675 | ncr8710 |
| 5436 | ncr8328 | 5496 | ncr8423 | 5556 | ncr8514 | 5616 | ncr8619 | 5676 | ncr8711 |
| 5437 | ncr8329 | 5497 | ncr8424 | 5557 | ncr8516 | 5617 | ncr8620 | 5677 | ncr8712 |
| 5438 | ncr8330 | 5498 | ncr8426 | 5558 | ncr8517 | 5618 | ncr8621 | 5678 | ncr8713 |
| 5439 | ncr8331 | 5499 | ncr8429 | 5559 | ncr8519 | 5619 | ncr8622 | 5679 | ncr8714 |
| 5440 | ncr8335 | 5500 | ncr8431 | 5560 | ncr8521 | 5620 | ncr8623 | 5680 | ncr8715 |
| 5441 | ncr8336 | 5501 | ncr8432 | 5561 | ncr8522 | 5621 | ncr8624 | 5681 | ncr8716 |
| 5442 | ncr8337 | 5502 | ncr8433 | 5562 | ncr8523 | 5622 | ncr8627 | 5682 | ncr8717 |
| 5443 | ncr8340 | 5503 | ncr8434 | 5563 | ncr8524 | 5623 | ncr8628 | 5683 | ncr8719 |
| 5444 | ncr8341 | 5504 | ncr8436 | 5564 | ncr8527 | 5624 | ncr8629 | 5684 | ncr8720 |
| 5445 | ncr8342 | 5505 | ncr8437 | 5565 | ncr8528 | 5625 | ncr8630 | 5685 | ncr8721 |
| 5446 | ncr8343 | 5506 | ncr8438 | 5566 | ncr8529 | 5626 | ncr8631 | 5686 | ncr8723 |
| 5447 | ncr8346 | 5507 | ncr8439 | 5567 | ncr8530 | 5627 | ncr8633 | 5687 | ncr8724 |
| 5448 | ncr8347 | 5508 | ncr8440 | 5568 | ncr8532 | 5628 | ncr8634 | 5688 | ncr8725 |
| 5449 | ncr8348 | 5509 | ncr8441 | 5569 | ncr8535 | 5629 | ncr8635 | 5689 | ncr8726 |
| 5450 | ncr8349 | 5510 | ncr8442 | 5570 | ncr8536 | 5630 | ncr8636 | 5690 | ncr8727 |
| 5451 | ncr8350 | 5511 | ncr8443 | 5571 | ncr8537 | 5631 | ncr8637 | 5691 | ncr8728 |
| 5452 | ncr8351 | 5512 | ncr8444 | 5572 | ncr8538 | 5632 | ncr8639 | 5692 | ncr8730 |
| 5453 | ncr8352 | 5513 | ncr8447 | 5573 | ncr8539 | 5633 | ncr8640 | 5693 | ncr8732 |
| 5454 | ncr8355 | 5514 | ncr8448 | 5574 | ncr8540 | 5634 | ncr8645 | 5694 | ncr8733 |
| 5455 | ncr8356 | 5515 | ncr8451 | 5575 | ncr8542 | 5635 | ncr8647 | 5695 | ncr8734 |
| 5456 | ncr8357 | 5516 | ncr8452 | 5576 | ncr8543 | 5636 | ncr8648 | 5696 | ncr8735 |
| 5457 | ncr8360 | 5517 | ncr8453 | 5577 | ncr8544 | 5637 | ncr8649 | 5697 | ncr8736 |
| 5458 | ncr8361 | 5518 | ncr8456 | 5578 | ncr8546 | 5638 | ncr8651 | 5698 | ncr8739 |
| 5459 | ncr8363 | 5519 | ncr8459 | 5579 | ncr8547 | 5639 | ncr8652 | 5699 | ncr8741 |
| 5460 | ncr8364 | 5520 | ncr8463 | 5580 | ncr8548 | 5640 | ncr8655 | 5700 | ncr8743 |

Figure 6C – List of EST Sequence Names From Normal Cartilage cDNA Library

| | |
|---|---|
| 5701 | ncr8749 |
| 5702 | ncr8751 |
| 5703 | ncr8752 |
| 5704 | ncr8756 |
| 5705 | ncr8757 |
| 5706 | ncr8759 |
| 5707 | ncr8760 |
| 5708 | ncr8761 |
| 5709 | ncr8762 |
| 5710 | ncr8763 |
| 5711 | ncr8764 |
| 5712 | ncr8767 |
| 5713 | ncr8769 |
| 5714 | ncr8770 |
| 5715 | ncr8775 |
| 5716 | ncr8776 |
| 5717 | ncr8779 |
| 5718 | ncr8780 |
| 5719 | ncr8782 |
| 5720 | ncr8784 |
| 5721 | ncr8785 |
| 5722 | ncr8787 |
| 5723 | ncr8790 |
| 5724 | ncr8791 |
| 5725 | ncr8792 |
| 5726 | ncr8793 |
| 5727 | ncr8794 |
| 5728 | ncr8795 |
| 5729 | ncr8796 |
| 5730 | ncr8797 |
| 5731 | ncr8798 |
| 5732 | ncr8799 |
| 5733 | ncr8801 |
| 5734 | ncr8802 |
| 5735 | ncr8803 |
| 5736 | ncr8804 |
| 5737 | ncr8805 |
| 5738 | ncr8808 |
| 5739 | ncr8809 |
| 5740 | ncr8811 |
| 5741 | ncr8813 |
| 5742 | ncr8814 |
| 5743 | ncr8815 |
| 5744 | ncr8817 |
| 5745 | ncr8818 |
| 5746 | ncr8819 |
| 5747 | ncr8820 |
| 5748 | ncr8821 |
| 5749 | ncr8823 |
| 5750 | ncr8824 |
| 5751 | ncr8826 |
| 5752 | ncr8827 |
| 5753 | ncr8828 |
| 5754 | ncr8829 |
| 5755 | ncr8831 |
| 5756 | ncr8835 |
| 5757 | ncr8836 |
| 5758 | ncr8839 |
| 5759 | ncr8840 |
| 5760 | ncr8841 |
| 5761 | ncr8843 |
| 5762 | ncr8844 |
| 5763 | ncr8845 |
| 5764 | ncr8846 |
| 5765 | ncr8847 |
| 5766 | ncr8848 |
| 5767 | ncr8849 |
| 5768 | ncr8851 |
| 5769 | ncr8852 |
| 5770 | ncr8853 |
| 5771 | ncr8855 |
| 5772 | ncr8856 |
| 5773 | ncr8857 |
| 5774 | ncr8858 |
| 5775 | ncr8859 |
| 5776 | ncr8860 |
| 5777 | ncr8861 |
| 5778 | ncr8863 |
| 5779 | ncr8865 |
| 5780 | ncr8866 |
| 5781 | ncr8867 |
| 5782 | ncr8868 |
| 5783 | ncr8869 |
| 5784 | ncr8870 |
| 5785 | ncr8871 |
| 5786 | ncr8872 |
| 5787 | ncr8874 |
| 5788 | ncr8876 |
| 5789 | ncr8877 |
| 5790 | ncr8878 |
| 5791 | ncr8879 |
| 5792 | ncr8882 |
| 5793 | ncr8883 |
| 5794 | ncr8884 |
| 5795 | ncr8885 |
| 5796 | ncr8886 |
| 5797 | ncr8887 |
| 5798 | ncr8889 |
| 5799 | ncr8890 |
| 5800 | ncr8891 |
| 5801 | ncr8892 |
| 5802 | ncr8893 |
| 5803 | ncr8895 |
| 5804 | ncr8896 |
| 5805 | ncr8898 |
| 5806 | ncr8899 |
| 5807 | ncr8900 |
| 5808 | ncr8901 |
| 5809 | ncr8902 |
| 5810 | ncr8904 |
| 5811 | ncr8905 |
| 5812 | ncr8906 |
| 5813 | ncr8908 |
| 5814 | ncr8909 |
| 5815 | ncr8910 |
| 5816 | ncr8911 |
| 5817 | ncr8912 |
| 5818 | ncr8913 |
| 5819 | ncr8914 |
| 5820 | ncr8917 |
| 5821 | ncr8918 |
| 5822 | ncr8919 |
| 5823 | ncr8920 |
| 5824 | ncr8921 |
| 5825 | ncr8922 |
| 5826 | ncr8923 |
| 5827 | ncr8924 |
| 5828 | ncr8926 |
| 5829 | ncr8928 |
| 5830 | ncr8932 |
| 5831 | ncr8933 |
| 5832 | ncr8935 |
| 5833 | ncr8936 |
| 5834 | ncr8937 |
| 5835 | ncr8939 |
| 5836 | ncr8940 |
| 5837 | ncr8941 |
| 5838 | ncr8944 |
| 5839 | ncr8945 |
| 5840 | ncr8949 |
| 5841 | ncr8951 |
| 5842 | ncr8952 |
| 5843 | ncr8953 |
| 5844 | ncr8954 |
| 5845 | ncr8959 |
| 5846 | ncr8960 |
| 5847 | ncr8961 |
| 5848 | ncr8962 |
| 5849 | ncr8963 |
| 5850 | ncr8964 |
| 5851 | ncr8966 |
| 5852 | ncr8967 |
| 5853 | ncr8971 |
| 5854 | ncr8973 |
| 5855 | ncr8974 |
| 5856 | ncr8975 |
| 5857 | ncr8976 |
| 5858 | ncr8977 |
| 5859 | ncr8978 |
| 5860 | ncr8981 |
| 5861 | ncr8982 |
| 5862 | ncr8983 |
| 5863 | ncr8984 |
| 5864 | ncr8985 |
| 5865 | ncr8986 |
| 5866 | ncr8987 |
| 5867 | ncr8988 |
| 5868 | ncr8989 |
| 5869 | ncr8990 |
| 5870 | ncr8991 |
| 5871 | ncr8992 |
| 5872 | ncr8993 |
| 5873 | ncr8994 |
| 5874 | ncr8995 |
| 5875 | ncr8997 |
| 5876 | ncr8998 |
| 5877 | ncr9000 |
| 5878 | ncr9001 |
| 5879 | ncr9002 |
| 5880 | ncr9003 |
| 5881 | ncr9004 |
| 5882 | ncr9005 |
| 5883 | ncr9008 |
| 5884 | ncr9010 |
| 5885 | ncr9011 |
| 5886 | ncr9012 |
| 5887 | ncr9015 |
| 5888 | ncr9016 |
| 5889 | ncr9018 |
| 5890 | ncr9019 |
| 5891 | ncr9020 |
| 5892 | ncr9022 |
| 5893 | ncr9023 |
| 5894 | ncr9024 |
| 5895 | ncr9027 |
| 5896 | ncr9031 |
| 5897 | ncr9032 |
| 5898 | ncr9033 |
| 5899 | ncr9035 |
| 5900 | ncr9036 |
| 5901 | ncr9038 |
| 5902 | ncr9039 |
| 5903 | ncr9040 |
| 5904 | ncr9044 |
| 5905 | ncr9047 |
| 5906 | ncr9049 |
| 5907 | ncr9050 |
| 5908 | ncr9052 |
| 5909 | ncr9053 |
| 5910 | ncr9055 |
| 5911 | ncr9056 |
| 5912 | ncr9057 |
| 5913 | ncr9059 |
| 5914 | ncr9060 |
| 5915 | ncr9061 |
| 5916 | ncr9063 |
| 5917 | ncr9064 |
| 5918 | ncr9066 |
| 5919 | ncr9070 |
| 5920 | ncr9071 |
| 5921 | ncr9075 |
| 5922 | ncr9076 |
| 5923 | ncr9079 |
| 5924 | ncr9081 |
| 5925 | ncr9082 |
| 5926 | ncr9085 |
| 5927 | ncr9086 |
| 5928 | ncr9088 |
| 5929 | ncr9090 |
| 5930 | ncr9092 |
| 5931 | ncr9094 |
| 5932 | ncr9095 |
| 5933 | ncr9096 |
| 5934 | ncr9098 |
| 5935 | ncr9101 |
| 5936 | ncr9102 |
| 5937 | ncr9103 |
| 5938 | ncr9105 |
| 5939 | ncr9107 |
| 5940 | ncr9108 |
| 5941 | ncr9109 |
| 5942 | ncr9110 |
| 5943 | ncr9111 |
| 5944 | ncr9112 |
| 5945 | ncr9113 |
| 5946 | ncr9114 |
| 5947 | ncr9115 |
| 5948 | ncr9116 |
| 5949 | ncr9117 |
| 5950 | ncr9118 |
| 5951 | ncr9119 |
| 5952 | ncr9120 |
| 5953 | ncr9123 |
| 5954 | ncr9124 |
| 5955 | ncr9125 |
| 5956 | ncr9127 |
| 5957 | ncr9129 |
| 5958 | ncr9132 |
| 5959 | ncr9133 |
| 5960 | ncr9135 |
| 5961 | ncr9136 |
| 5962 | ncr9137 |
| 5963 | ncr9140 |
| 5964 | ncr9141 |
| 5965 | ncr9142 |
| 5966 | ncr9147 |
| 5967 | ncr9148 |
| 5968 | ncr9149 |
| 5969 | ncr9152 |
| 5970 | ncr9153 |
| 5971 | ncr9154 |
| 5972 | ncr9155 |
| 5973 | ncr9156 |
| 5974 | ncr9157 |
| 5975 | ncr9159 |
| 5976 | ncr9160 |
| 5977 | ncr9162 |
| 5978 | ncr9163 |
| 5979 | ncr9164 |
| 5980 | ncr9165 |
| 5981 | ncr9166 |
| 5982 | ncr9167 |
| 5983 | ncr9168 |
| 5984 | ncr9169 |
| 5985 | ncr9170 |
| 5986 | ncr9171 |
| 5987 | ncr9173 |
| 5988 | ncr9174 |
| 5989 | ncr9175 |
| 5990 | ncr9177 |
| 5991 | ncr9178 |
| 5992 | ncr9179 |
| 5993 | ncr9186 |
| 5994 | ncr9191 |
| 5995 | ncr9193 |
| 5996 | ncr9195 |
| 5997 | ncr9199 |
| 5998 | ncr9200 |
| 5999 | ncr9201 |
| 6000 | ncr9202 |

Figure 6C – List of EST Sequence Names From Normal Cartilage cDNA Library

| | | | | | | | | | |
|---|---|---|---|---|---|---|---|---|---|
| 6001 | ncr9203 | 6061 | ncr9371 | 6121 | ncr9463 | 6181 | ncr9544 | 6241 | ncr9625 |
| 6002 | ncr9204 | 6062 | ncr9372 | 6122 | ncr9464 | 6182 | ncr9546 | 6242 | ncr9626 |
| 6003 | ncr9206 | 6063 | ncr9373 | 6123 | ncr9465 | 6183 | ncr9547 | 6243 | ncr9627 |
| 6004 | ncr9208 | 6064 | ncr9375 | 6124 | ncr9466 | 6184 | ncr9548 | 6244 | ncr9629 |
| 6005 | ncr9209 | 6065 | ncr9376 | 6125 | ncr9469 | 6185 | ncr9549 | 6245 | ncr9631 |
| 6006 | ncr9211 | 6066 | ncr9377 | 6126 | ncr9470 | 6186 | ncr9550 | 6246 | ncr9632 |
| 6007 | ncr9214 | 6067 | ncr9378 | 6127 | ncr9472 | 6187 | ncr9551 | 6247 | ncr9634 |
| 6008 | ncr9215 | 6068 | ncr9379 | 6128 | ncr9473 | 6188 | ncr9552 | 6248 | ncr9635 |
| 6009 | ncr9274 | 6069 | ncr9381 | 6129 | ncr9475 | 6189 | ncr9553 | 6249 | ncr9639 |
| 6010 | ncr9282 | 6070 | ncr9382 | 6130 | ncr9476 | 6190 | ncr9554 | 6250 | ncr9640 |
| 6011 | ncr9289 | 6071 | ncr9383 | 6131 | ncr9477 | 6191 | ncr9555 | 6251 | ncr9643 |
| 6012 | ncr9297 | 6072 | ncr9384 | 6132 | ncr9478 | 6192 | ncr9556 | 6252 | ncr9644 |
| 6013 | ncr9298 | 6073 | ncr9385 | 6133 | ncr9479 | 6193 | ncr9557 | 6253 | ncr9645 |
| 6014 | ncr9299 | 6074 | ncr9386 | 6134 | ncr9480 | 6194 | ncr9558 | 6254 | ncr9646 |
| 6015 | ncr9304 | 6075 | ncr9388 | 6135 | ncr9481 | 6195 | ncr9560 | 6255 | ncr9647 |
| 6016 | ncr9305 | 6076 | ncr9389 | 6136 | ncr9483 | 6196 | ncr9561 | 6256 | ncr9648 |
| 6017 | ncr9307 | 6077 | ncr9390 | 6137 | ncr9485 | 6197 | ncr9562 | 6257 | ncr9649 |
| 6018 | ncr9308 | 6078 | ncr9391 | 6138 | ncr9486 | 6198 | ncr9563 | 6258 | ncr9650 |
| 6019 | ncr9310 | 6079 | ncr9392 | 6139 | ncr9487 | 6199 | ncr9564 | 6259 | ncr9651 |
| 6020 | ncr9312 | 6080 | ncr9393 | 6140 | ncr9489 | 6200 | ncr9565 | 6260 | ncr9652 |
| 6021 | ncr9313 | 6081 | ncr9395 | 6141 | ncr9491 | 6201 | ncr9566 | 6261 | ncr9655 |
| 6022 | ncr9314 | 6082 | ncr9396 | 6142 | ncr9492 | 6202 | ncr9568 | 6262 | ncr9658 |
| 6023 | ncr9316 | 6083 | ncr9398 | 6143 | ncr9493 | 6203 | ncr9569 | 6263 | ncr9659 |
| 6024 | ncr9319 | 6084 | ncr9400 | 6144 | ncr9495 | 6204 | ncr9572 | 6264 | ncr9660 |
| 6025 | ncr9320 | 6085 | ncr9401 | 6145 | ncr9496 | 6205 | ncr9573 | 6265 | ncr9661 |
| 6026 | ncr9321 | 6086 | ncr9403 | 6146 | ncr9497 | 6206 | ncr9574 | 6266 | ncr9662 |
| 6027 | ncr9323 | 6087 | ncr9404 | 6147 | ncr9498 | 6207 | ncr9576 | 6267 | ncr9664 |
| 6028 | ncr9324 | 6088 | ncr9405 | 6148 | ncr9499 | 6208 | ncr9577 | 6268 | ncr9665 |
| 6029 | ncr9325 | 6089 | ncr9407 | 6149 | ncr9500 | 6209 | ncr9578 | 6269 | ncr9666 |
| 6030 | ncr9326 | 6090 | ncr9408 | 6150 | ncr9501 | 6210 | ncr9579 | 6270 | ncr9668 |
| 6031 | ncr9327 | 6091 | ncr9413 | 6151 | ncr9502 | 6211 | ncr9580 | 6271 | ncr9673 |
| 6032 | ncr9328 | 6092 | ncr9415 | 6152 | ncr9503 | 6212 | ncr9581 | 6272 | ncr9674 |
| 6033 | ncr9331 | 6093 | ncr9416 | 6153 | ncr9504 | 6213 | ncr9582 | 6273 | ncr9676 |
| 6034 | ncr9332 | 6094 | ncr9419 | 6154 | ncr9505 | 6214 | ncr9583 | 6274 | ncr9679 |
| 6035 | ncr9336 | 6095 | ncr9420 | 6155 | ncr9507 | 6215 | ncr9584 | 6275 | ncr9680 |
| 6036 | ncr9337 | 6096 | ncr9421 | 6156 | ncr9508 | 6216 | ncr9585 | 6276 | ncr9681 |
| 6037 | ncr9339 | 6097 | ncr9422 | 6157 | ncr9509 | 6217 | ncr9587 | 6277 | ncr9682 |
| 6038 | ncr9340 | 6098 | ncr9424 | 6158 | ncr9511 | 6218 | ncr9589 | 6278 | ncr9684 |
| 6039 | ncr9341 | 6099 | ncr9425 | 6159 | ncr9515 | 6219 | ncr9590 | 6279 | ncr9685 |
| 6040 | ncr9343 | 6100 | ncr9429 | 6160 | ncr9516 | 6220 | ncr9591 | 6280 | ncr9686 |
| 6041 | ncr9344 | 6101 | ncr9431 | 6161 | ncr9517 | 6221 | ncr9592 | 6281 | ncr9687 |
| 6042 | ncr9346 | 6102 | ncr9432 | 6162 | ncr9519 | 6222 | ncr9593 | 6282 | ncr9690 |
| 6043 | ncr9347 | 6103 | ncr9433 | 6163 | ncr9520 | 6223 | ncr9594 | 6283 | ncr9693 |
| 6044 | ncr9348 | 6104 | ncr9435 | 6164 | ncr9521 | 6224 | ncr9595 | 6284 | ncr9695 |
| 6045 | ncr9349 | 6105 | ncr9436 | 6165 | ncr9523 | 6225 | ncr9596 | 6285 | ncr9699 |
| 6046 | ncr9350 | 6106 | ncr9439 | 6166 | ncr9524 | 6226 | ncr9597 | 6286 | ncr9700 |
| 6047 | ncr9351 | 6107 | ncr9440 | 6167 | ncr9525 | 6227 | ncr9598 | 6287 | ncr9703 |
| 6048 | ncr9352 | 6108 | ncr9441 | 6168 | ncr9527 | 6228 | ncr9599 | 6288 | ncr9704 |
| 6049 | ncr9356 | 6109 | ncr9442 | 6169 | ncr9528 | 6229 | ncr9600 | 6289 | ncr9705 |
| 6050 | ncr9359 | 6110 | ncr9446 | 6170 | ncr9529 | 6230 | ncr9603 | 6290 | ncr9707 |
| 6051 | ncr9360 | 6111 | ncr9448 | 6171 | ncr9530 | 6231 | ncr9605 | 6291 | ncr9708 |
| 6052 | ncr9361 | 6112 | ncr9450 | 6172 | ncr9533 | 6232 | ncr9607 | 6292 | ncr9711 |
| 6053 | ncr9362 | 6113 | ncr9453 | 6173 | ncr9535 | 6233 | ncr9608 | 6293 | ncr9712 |
| 6054 | ncr9363 | 6114 | ncr9454 | 6174 | ncr9537 | 6234 | ncr9612 | 6294 | ncr9713 |
| 6055 | ncr9364 | 6115 | ncr9456 | 6175 | ncr9538 | 6235 | ncr9616 | 6295 | ncr9715 |
| 6056 | ncr9365 | 6116 | ncr9458 | 6176 | ncr9539 | 6236 | ncr9619 | 6296 | ncr9716 |
| 6057 | ncr9366 | 6117 | ncr9459 | 6177 | ncr9540 | 6237 | ncr9620 | 6297 | ncr9717 |
| 6058 | ncr9368 | 6118 | ncr9460 | 6178 | ncr9541 | 6238 | ncr9621 | 6298 | ncr9719 |
| 6059 | ncr9369 | 6119 | ncr9461 | 6179 | ncr9542 | 6239 | ncr9623 | 6299 | ncr9721 |
| 6060 | ncr9370 | 6120 | ncr9462 | 6180 | ncr9543 | 6240 | ncr9624 | 6300 | ncr9722 |

Figure 6C – List of EST Sequence Names From Normal Cartilage cDNA Library

| | |
|---|---|
| 6301 | ncr9723 |
| 6302 | ncr9724 |
| 6303 | ncr9725 |
| 6304 | ncr9728 |
| 6305 | ncr9730 |
| 6306 | ncr9731 |
| 6307 | ncr9732 |
| 6308 | ncr9736 |
| 6309 | ncr9741 |
| 6310 | ncr9742 |
| 6311 | ncr9743 |
| 6312 | ncr9744 |
| 6313 | ncr9745 |
| 6314 | ncr9746 |
| 6315 | ncr9747 |
| 6316 | ncr9750 |
| 6317 | ncr9751 |
| 6318 | ncr9753 |
| 6319 | ncr9754 |
| 6320 | ncr9755 |
| 6321 | ncr9756 |
| 6322 | ncr9757 |
| 6323 | ncr9758 |
| 6324 | ncr9759 |
| 6325 | ncr9760 |
| 6326 | ncr9761 |
| 6327 | ncr9763 |
| 6328 | ncr9764 |
| 6329 | ncr9765 |
| 6330 | ncr9766 |
| 6331 | ncr9767 |
| 6332 | ncr9768 |
| 6333 | ncr9770 |
| 6334 | ncr9771 |
| 6335 | ncr9772 |
| 6336 | ncr9773 |
| 6337 | ncr9775 |
| 6338 | ncr9776 |
| 6339 | ncr9778 |
| 6340 | ncr9779 |
| 6341 | ncr9781 |
| 6342 | ncr9782 |
| 6343 | ncr9783 |
| 6344 | ncr9784 |
| 6345 | ncr9785 |
| 6346 | ncr9786 |
| 6347 | ncr9787 |
| 6348 | ncr9789 |
| 6349 | ncr9790 |
| 6350 | ncr9791 |
| 6351 | ncr9792 |
| 6352 | ncr9796 |
| 6353 | ncr9797 |
| 6354 | ncr9799 |
| 6355 | ncr9801 |
| 6356 | ncr9803 |
| 6357 | ncr9808 |
| 6358 | ncr9809 |
| 6359 | ncr9811 |
| 6360 | ncr9813 |
| 6361 | ncr9816 |
| 6362 | ncr9818 |
| 6363 | ncr9820 |
| 6364 | ncr9821 |
| 6365 | ncr9823 |
| 6366 | ncr9824 |
| 6367 | ncr9826 |
| 6368 | ncr9828 |
| 6369 | ncr9829 |
| 6370 | ncr9831 |
| 6371 | ncr9832 |
| 6372 | ncr9834 |
| 6373 | ncr9836 |
| 6374 | ncr9837 |
| 6375 | ncr9838 |
| 6376 | ncr9839 |
| 6377 | ncr9840 |
| 6378 | ncr9842 |
| 6379 | ncr9843 |
| 6380 | ncr9844 |
| 6381 | ncr9846 |
| 6382 | ncr9848 |
| 6383 | ncr9849 |
| 6384 | ncr9850 |
| 6385 | ncr9851 |
| 6386 | ncr9852 |
| 6387 | ncr9853 |
| 6388 | ncr9854 |
| 6389 | ncr9855 |
| 6390 | ncr9856 |
| 6391 | ncr9857 |
| 6392 | ncr9861 |
| 6393 | ncr9862 |
| 6394 | ncr9863 |
| 6395 | ncr9864 |
| 6396 | ncr9865 |
| 6397 | ncr9869 |
| 6398 | ncr9870 |
| 6399 | ncr9871 |
| 6400 | ncr9872 |
| 6401 | ncr9875 |
| 6402 | ncr9877 |
| 6403 | ncr9880 |
| 6404 | ncr9881 |
| 6405 | ncr9883 |
| 6406 | ncr9886 |
| 6407 | ncr9891 |
| 6408 | ncr9893 |
| 6409 | ncr9896 |
| 6410 | ncr9897 |
| 6411 | ncr9899 |
| 6412 | ncr9901 |
| 6413 | ncr9903 |
| 6414 | ncr9904 |
| 6415 | ncr9909 |
| 6416 | ncr9919 |
| 6417 | ncr9921 |
| 6418 | ncr9923 |
| 6419 | ncr9924 |
| 6420 | ncr9925 |
| 6421 | ncr9926 |
| 6422 | ncr9927 |
| 6423 | ncr9930 |
| 6424 | ncr9933 |
| 6425 | ncr9934 |
| 6426 | ncr9935 |
| 6427 | ncr9936 |
| 6428 | ncr9938 |
| 6429 | ncr9939 |
| 6430 | ncr9940 |
| 6431 | ncr9941 |
| 6432 | ncr9942 |
| 6433 | ncr9944 |
| 6434 | ncr9945 |
| 6435 | ncr9947 |
| 6436 | ncr9948 |
| 6437 | ncr9949 |
| 6438 | ncr9950 |
| 6439 | ncr9951 |
| 6440 | ncr9952 |
| 6441 | ncr9954 |
| 6442 | ncr9955 |
| 6443 | ncr9956 |
| 6444 | ncr9957 |
| 6445 | ncr9958 |
| 6446 | ncr9961 |
| 6447 | ncr9962 |
| 6448 | ncr9963 |
| 6449 | ncr9964 |
| 6450 | ncr9965 |
| 6451 | ncr9969 |
| 6452 | ncr9971 |
| 6453 | ncr9973 |
| 6454 | ncr9974 |
| 6455 | ncr9975 |
| 6456 | ncr9976 |
| 6457 | ncr9977 |
| 6458 | ncr9979 |
| 6459 | ncr9980 |
| 6460 | ncr9981 |
| 6461 | ncr9982 |
| 6462 | ncr9983 |
| 6463 | ncr9984 |
| 6464 | ncrb0004 |
| 6465 | ncrb0005 |
| 6466 | ncrb0008 |
| 6467 | ncrb0012 |
| 6468 | ncrb0013 |
| 6469 | ncrb0015 |
| 6470 | ncrb0016 |
| 6471 | ncrb0017 |
| 6472 | ncrb0019 |
| 6473 | ncrb0020 |
| 6474 | ncrb0021 |
| 6475 | ncrb0023 |
| 6476 | ncrb0024 |
| 6477 | ncrb0025 |
| 6478 | ncrb0027 |
| 6479 | ncrb0031 |
| 6480 | ncrb0032 |
| 6481 | ncrb0033 |
| 6482 | ncrb0034 |
| 6483 | ncrb0035 |
| 6484 | ncrb0036 |
| 6485 | ncrb0037 |
| 6486 | ncrb0039 |
| 6487 | ncrb0040 |
| 6488 | ncrb0042 |
| 6489 | ncrb0043 |
| 6490 | ncrb0044 |
| 6491 | ncrb0045 |
| 6492 | ncrb0046 |
| 6493 | ncrb0047 |
| 6494 | ncrb0048 |
| 6495 | ncrb0049 |
| 6496 | ncrb0050 |
| 6497 | ncrb0051 |
| 6498 | ncrb0054 |
| 6499 | ncrb0055 |
| 6500 | ncrb0057 |
| 6501 | ncrb0058 |
| 6502 | ncrb0059 |
| 6503 | ncrb0060 |
| 6504 | ncrb0061 |
| 6505 | ncrb0062 |
| 6506 | ncrb0063 |
| 6507 | ncrb0064 |
| 6508 | ncrb0066 |
| 6509 | ncrb0069 |
| 6510 | ncrb0072 |
| 6511 | ncrb0074 |
| 6512 | ncrb0075 |
| 6513 | ncrb0076 |
| 6514 | ncrb0077 |
| 6515 | ncrb0078 |
| 6516 | ncrb0083 |
| 6517 | ncrb0085 |
| 6518 | ncrb0086 |
| 6519 | ncrb0087 |
| 6520 | ncrb0088 |
| 6521 | ncrb0089 |
| 6522 | ncrb0090 |
| 6523 | ncrb0092 |
| 6524 | ncrb0093 |
| 6525 | ncrb0094 |
| 6526 | ncrb0095 |
| 6527 | ncrb0096 |
| 6528 | ncrb0100 |
| 6529 | ncrb0101 |
| 6530 | ncrb0102 |
| 6531 | ncrb0103 |
| 6532 | ncrb0104 |
| 6533 | ncrb0108 |
| 6534 | ncrb0109 |
| 6535 | ncrb0111 |
| 6536 | ncrb0113 |
| 6537 | ncrb0115 |
| 6538 | ncrb0116 |
| 6539 | ncrb0117 |
| 6540 | ncrb0120 |
| 6541 | ncrb0121 |
| 6542 | ncrb0122 |
| 6543 | ncrb0123 |
| 6544 | ncrb0124 |
| 6545 | ncrb0127 |
| 6546 | ncrb0129 |
| 6547 | ncrb0130 |
| 6548 | ncrb0131 |
| 6549 | ncrb0133 |
| 6550 | ncrb0134 |
| 6551 | ncrb0135 |
| 6552 | ncrb0136 |
| 6553 | ncrb0138 |
| 6554 | ncrb0139 |
| 6555 | ncrb0140 |
| 6556 | ncrb0142 |
| 6557 | ncrb0143 |
| 6558 | ncrb0145 |
| 6559 | ncrb0146 |
| 6560 | ncrb0148 |
| 6561 | ncrb0149 |
| 6562 | ncrb0150 |
| 6563 | ncrb0151 |
| 6564 | ncrb0152 |
| 6565 | ncrb0153 |
| 6566 | ncrb0154 |
| 6567 | ncrb0156 |
| 6568 | ncrb0157 |
| 6569 | ncrb0158 |
| 6570 | ncrb0159 |
| 6571 | ncrb0160 |
| 6572 | ncrb0162 |
| 6573 | ncrb0163 |
| 6574 | ncrb0164 |
| 6575 | ncrb0165 |
| 6576 | ncrb0166 |
| 6577 | ncrb0167 |
| 6578 | ncrb0169 |
| 6579 | ncrb0170 |
| 6580 | ncrb0171 |
| 6581 | ncrb0172 |
| 6582 | ncrb0175 |
| 6583 | ncrb0176 |
| 6584 | ncrb0178 |
| 6585 | ncrb0179 |
| 6586 | ncrb0180 |
| 6587 | ncrb0181 |
| 6588 | ncrb0182 |
| 6589 | ncrb0183 |
| 6590 | ncrb0185 |
| 6591 | ncrb0186 |
| 6592 | ncrb0187 |
| 6593 | ncrb0188 |
| 6594 | ncrb0189 |
| 6595 | ncrb0190 |
| 6596 | ncrb0191 |
| 6597 | ncrb0192 |
| 6598 | ncrb0196 |
| 6599 | ncrb0197 |
| 6600 | ncrb0199 |

Figure 6C – List of EST Sequence Names From Normal Cartilage cDNA Library

| | | | | | | | | | |
|---|---|---|---|---|---|---|---|---|---|
| 6601 | ncrb0200 | 6661 | ncrb0295 | 6721 | ncrb0383 | 6781 | ncrb0471 | 6841 | ncrb0573 |
| 6602 | ncrb0201 | 6662 | ncrb0299 | 6722 | ncrb0384 | 6782 | ncrb0472 | 6842 | ncrb0579 |
| 6603 | ncrb0203 | 6663 | ncrb0303 | 6723 | ncrb0387 | 6783 | ncrb0473 | 6843 | ncrb0580 |
| 6604 | ncrb0204 | 6664 | ncrb0305 | 6724 | ncrb0388 | 6784 | ncrb0474 | 6844 | ncrb0581 |
| 6605 | ncrb0205 | 6665 | ncrb0307 | 6725 | ncrb0389 | 6785 | ncrb0476 | 6845 | ncrb0585 |
| 6606 | ncrb0207 | 6666 | ncrb0308 | 6726 | ncrb0395 | 6786 | ncrb0478 | 6846 | ncrb0586 |
| 6607 | ncrb0211 | 6667 | ncrb0309 | 6727 | ncrb0396 | 6787 | ncrb0479 | 6847 | ncrb0587 |
| 6608 | ncrb0212 | 6668 | ncrb0311 | 6728 | ncrb0397 | 6788 | ncrb0481 | 6848 | ncrb0588 |
| 6609 | ncrb0213 | 6669 | ncrb0313 | 6729 | ncrb0400 | 6789 | ncrb0484 | 6849 | ncrb0589 |
| 6610 | ncrb0215 | 6670 | ncrb0316 | 6730 | ncrb0403 | 6790 | ncrb0485 | 6850 | ncrb0592 |
| 6611 | ncrb0216 | 6671 | ncrb0317 | 6731 | ncrb0404 | 6791 | ncrb0487 | 6851 | ncrb0599 |
| 6612 | ncrb0217 | 6672 | ncrb0319 | 6732 | ncrb0405 | 6792 | ncrb0488 | 6852 | ncrb0600 |
| 6613 | ncrb0218 | 6673 | ncrb0321 | 6733 | ncrb0407 | 6793 | ncrb0491 | 6853 | ncrb0601 |
| 6614 | ncrb0220 | 6674 | ncrb0323 | 6734 | ncrb0408 | 6794 | ncrb0492 | 6854 | ncrb0602 |
| 6615 | ncrb0223 | 6675 | ncrb0324 | 6735 | ncrb0409 | 6795 | ncrb0493 | 6855 | ncrb0605 |
| 6616 | ncrb0226 | 6676 | ncrb0326 | 6736 | ncrb0412 | 6796 | ncrb0496 | 6856 | ncrb0607 |
| 6617 | ncrb0227 | 6677 | ncrb0327 | 6737 | ncrb0413 | 6797 | ncrb0497 | 6857 | ncrb0608 |
| 6618 | ncrb0229 | 6678 | ncrb0328 | 6738 | ncrb0415 | 6798 | ncrb0499 | 6858 | ncrb0609 |
| 6619 | ncrb0230 | 6679 | ncrb0330 | 6739 | ncrb0416 | 6799 | ncrb0500 | 6859 | ncrb0611 |
| 6620 | ncrb0231 | 6680 | ncrb0331 | 6740 | ncrb0417 | 6800 | ncrb0503 | 6860 | ncrb0618 |
| 6621 | ncrb0232 | 6681 | ncrb0332 | 6741 | ncrb0418 | 6801 | ncrb0505 | 6861 | ncrb0619 |
| 6622 | ncrb0234 | 6682 | ncrb0333 | 6742 | ncrb0422 | 6802 | ncrb0506 | 6862 | ncrb0620 |
| 6623 | ncrb0235 | 6683 | ncrb0334 | 6743 | ncrb0423 | 6803 | ncrb0507 | 6863 | ncrb0622 |
| 6624 | ncrb0240 | 6684 | ncrb0335 | 6744 | ncrb0424 | 6804 | ncrb0509 | 6864 | ncrb0624 |
| 6625 | ncrb0242 | 6685 | ncrb0336 | 6745 | ncrb0428 | 6805 | ncrb0511 | 6865 | ncrb0627 |
| 6626 | ncrb0243 | 6686 | ncrb0337 | 6746 | ncrb0430 | 6806 | ncrb0513 | 6866 | ncrb0630 |
| 6627 | ncrb0245 | 6687 | ncrb0338 | 6747 | ncrb0431 | 6807 | ncrb0514 | 6867 | ncrb0631 |
| 6628 | ncrb0246 | 6688 | ncrb0339 | 6748 | ncrb0433 | 6808 | ncrb0519 | 6868 | ncrb0632 |
| 6629 | ncrb0247 | 6689 | ncrb0340 | 6749 | ncrb0434 | 6809 | ncrb0522 | 6869 | ncrb0634 |
| 6630 | ncrb0250 | 6690 | ncrb0341 | 6750 | ncrb0435 | 6810 | ncrb0523 | 6870 | ncrb0635 |
| 6631 | ncrb0253 | 6691 | ncrb0342 | 6751 | ncrb0436 | 6811 | ncrb0524 | 6871 | ncrb0636 |
| 6632 | ncrb0254 | 6692 | ncrb0344 | 6752 | ncrb0437 | 6812 | ncrb0525 | 6872 | ncrb0638 |
| 6633 | ncrb0256 | 6693 | ncrb0345 | 6753 | ncrb0438 | 6813 | ncrb0526 | 6873 | ncrb0639 |
| 6634 | ncrb0257 | 6694 | ncrb0346 | 6754 | ncrb0439 | 6814 | ncrb0529 | 6874 | ncrb0641 |
| 6635 | ncrb0260 | 6695 | ncrb0349 | 6755 | ncrb0440 | 6815 | ncrb0530 | 6875 | ncrb0642 |
| 6636 | ncrb0261 | 6696 | ncrb0350 | 6756 | ncrb0441 | 6816 | ncrb0531 | 6876 | ncrb0643 |
| 6637 | ncrb0262 | 6697 | ncrb0351 | 6757 | ncrb0442 | 6817 | ncrb0536 | 6877 | ncrb0644 |
| 6638 | ncrb0263 | 6698 | ncrb0353 | 6758 | ncrb0443 | 6818 | ncrb0538 | 6878 | ncrb0646 |
| 6639 | ncrb0265 | 6699 | ncrb0354 | 6759 | ncrb0444 | 6819 | ncrb0540 | 6879 | ncrb0647 |
| 6640 | ncrb0266 | 6700 | ncrb0355 | 6760 | ncrb0446 | 6820 | ncrb0541 | 6880 | ncrb0648 |
| 6641 | ncrb0267 | 6701 | ncrb0356 | 6761 | ncrb0448 | 6821 | ncrb0543 | 6881 | ncrb0651 |
| 6642 | ncrb0269 | 6702 | ncrb0358 | 6762 | ncrb0449 | 6822 | ncrb0544 | 6882 | ncrb0652 |
| 6643 | ncrb0270 | 6703 | ncrb0361 | 6763 | ncrb0450 | 6823 | ncrb0545 | 6883 | ncrb0653 |
| 6644 | ncrb0272 | 6704 | ncrb0362 | 6764 | ncrb0451 | 6824 | ncrb0547 | 6884 | ncrb0654 |
| 6645 | ncrb0273 | 6705 | ncrb0363 | 6765 | ncrb0452 | 6825 | ncrb0548 | 6885 | ncrb0655 |
| 6646 | ncrb0274 | 6706 | ncrb0364 | 6766 | ncrb0453 | 6826 | ncrb0549 | 6886 | ncrb0656 |
| 6647 | ncrb0275 | 6707 | ncrb0365 | 6767 | ncrb0454 | 6827 | ncrb0550 | 6887 | ncrb0658 |
| 6648 | ncrb0276 | 6708 | ncrb0366 | 6768 | ncrb0455 | 6828 | ncrb0551 | 6888 | ncrb0660 |
| 6649 | ncrb0277 | 6709 | ncrb0367 | 6769 | ncrb0456 | 6829 | ncrb0552 | 6889 | ncrb0661 |
| 6650 | ncrb0279 | 6710 | ncrb0368 | 6770 | ncrb0457 | 6830 | ncrb0554 | 6890 | ncrb0663 |
| 6651 | ncrb0280 | 6711 | ncrb0369 | 6771 | ncrb0458 | 6831 | ncrb0556 | 6891 | ncrb0664 |
| 6652 | ncrb0281 | 6712 | ncrb0370 | 6772 | ncrb0459 | 6832 | ncrb0559 | 6892 | ncrb0666 |
| 6653 | ncrb0282 | 6713 | ncrb0371 | 6773 | ncrb0460 | 6833 | ncrb0563 | 6893 | ncrb0667 |
| 6654 | ncrb0283 | 6714 | ncrb0372 | 6774 | ncrb0461 | 6834 | ncrb0564 | 6894 | ncrb0668 |
| 6655 | ncrb0284 | 6715 | ncrb0375 | 6775 | ncrb0462 | 6835 | ncrb0565 | 6895 | ncrb0669 |
| 6656 | ncrb0287 | 6716 | ncrb0376 | 6776 | ncrb0463 | 6836 | ncrb0567 | 6896 | ncrb0670 |
| 6657 | ncrb0288 | 6717 | ncrb0377 | 6777 | ncrb0464 | 6837 | ncrb0568 | 6897 | ncrb0671 |
| 6658 | ncrb0291 | 6718 | ncrb0379 | 6778 | ncrb0465 | 6838 | ncrb0569 | 6898 | ncrb0672 |
| 6659 | ncrb0292 | 6719 | ncrb0380 | 6779 | ncrb0466 | 6839 | ncrb0570 | 6899 | ncrb0676 |
| 6660 | ncrb0293 | 6720 | ncrb0381 | 6780 | ncrb0468 | 6840 | ncrb0571 | 6900 | ncrb0677 |

Figure 6C – List of EST Sequence Names From Normal Cartilage cDNA Library

| | | | | | | | | | |
|---|---|---|---|---|---|---|---|---|---|
| 6901 | ncrb0679 | 6961 | ncrb0764 | 7021 | ncrb0854 | 7081 | ncrb0949 | 7141 | ncrb1142 |
| 6902 | ncrb0680 | 6962 | ncrb0766 | 7022 | ncrb0855 | 7082 | ncrb0951 | 7142 | ncrb1143 |
| 6903 | ncrb0684 | 6963 | ncrb0772 | 7023 | ncrb0856 | 7083 | ncrb0952 | 7143 | ncrb1144 |
| 6904 | ncrb0687 | 6964 | ncrb0773 | 7024 | ncrb0857 | 7084 | ncrb0957 | 7144 | ncrb1146 |
| 6905 | ncrb0688 | 6965 | ncrb0777 | 7025 | ncrb0858 | 7085 | ncrb0960 | 7145 | ncrb1148 |
| 6906 | ncrb0689 | 6966 | ncrb0779 | 7026 | ncrb0859 | 7086 | ncrb1059 | 7146 | ncrb1150 |
| 6907 | ncrb0692 | 6967 | ncrb0782 | 7027 | ncrb0860 | 7087 | ncrb1063 | 7147 | ncrb1152 |
| 6908 | ncrb0693 | 6968 | ncrb0783 | 7028 | ncrb0861 | 7088 | ncrb1065 | 7148 | ncrb1153 |
| 6909 | ncrb0696 | 6969 | ncrb0784 | 7029 | ncrb0862 | 7089 | ncrb1067 | 7149 | ncrb1155 |
| 6910 | ncrb0697 | 6970 | ncrb0787 | 7030 | ncrb0864 | 7090 | ncrb1068 | 7150 | ncrb1157 |
| 6911 | ncrb0698 | 6971 | ncrb0788 | 7031 | ncrb0867 | 7091 | ncrb1069 | 7151 | ncrb1159 |
| 6912 | ncrb0699 | 6972 | ncrb0789 | 7032 | ncrb0868 | 7092 | ncrb1072 | 7152 | ncrb1161 |
| 6913 | ncrb0700 | 6973 | ncrb0794 | 7033 | ncrb0870 | 7093 | ncrb1073 | 7153 | ncrb1163 |
| 6914 | ncrb0701 | 6974 | ncrb0795 | 7034 | ncrb0872 | 7094 | ncrb1075 | 7154 | ncrb1164 |
| 6915 | ncrb0703 | 6975 | ncrb0796 | 7035 | ncrb0874 | 7095 | ncrb1079 | 7155 | ncrb1165 |
| 6916 | ncrb0704 | 6976 | ncrb0797 | 7036 | ncrb0875 | 7096 | ncrb1080 | 7156 | ncrb1167 |
| 6917 | ncrb0705 | 6977 | ncrb0799 | 7037 | ncrb0877 | 7097 | ncrb1081 | 7157 | ncrb1169 |
| 6918 | ncrb0706 | 6978 | ncrb0800 | 7038 | ncrb0878 | 7098 | ncrb1082 | 7158 | ncrb1171 |
| 6919 | ncrb0707 | 6979 | ncrb0803 | 7039 | ncrb0881 | 7099 | ncrb1083 | 7159 | ncrb1173 |
| 6920 | ncrb0708 | 6980 | ncrb0804 | 7040 | ncrb0882 | 7100 | ncrb1084 | 7160 | ncrb1175 |
| 6921 | ncrb0709 | 6981 | ncrb0805 | 7041 | ncrb0888 | 7101 | ncrb1085 | 7161 | ncrb1176 |
| 6922 | ncrb0710 | 6982 | ncrb0806 | 7042 | ncrb0891 | 7102 | ncrb1087 | 7162 | ncrb1178 |
| 6923 | ncrb0711 | 6983 | ncrb0807 | 7043 | ncrb0892 | 7103 | ncrb1088 | 7163 | ncrb1179 |
| 6924 | ncrb0716 | 6984 | ncrb0808 | 7044 | ncrb0897 | 7104 | ncrb1089 | 7164 | ncrb1180 |
| 6925 | ncrb0718 | 6985 | ncrb0810 | 7045 | ncrb0899 | 7105 | ncrb1092 | 7165 | ncrb1181 |
| 6926 | ncrb0719 | 6986 | ncrb0811 | 7046 | ncrb0901 | 7106 | ncrb1093 | 7166 | ncrb1183 |
| 6927 | ncrb0720 | 6987 | ncrb0812 | 7047 | ncrb0902 | 7107 | ncrb1094 | 7167 | ncrb1185 |
| 6928 | ncrb0721 | 6988 | ncrb0814 | 7048 | ncrb0903 | 7108 | ncrb1095 | 7168 | ncrb1186 |
| 6929 | ncrb0722 | 6989 | ncrb0815 | 7049 | ncrb0904 | 7109 | ncrb1096 | 7169 | ncrb1187 |
| 6930 | ncrb0723 | 6990 | ncrb0817 | 7050 | ncrb0908 | 7110 | ncrb1098 | 7170 | ncrb1189 |
| 6931 | ncrb0724 | 6991 | ncrb0818 | 7051 | ncrb0909 | 7111 | ncrb1100 | 7171 | ncrb1190 |
| 6932 | ncrb0725 | 6992 | ncrb0819 | 7052 | ncrb0911 | 7112 | ncrb1101 | 7172 | ncrb1191 |
| 6933 | ncrb0726 | 6993 | ncrb0820 | 7053 | ncrb0912 | 7113 | ncrb1104 | 7173 | ncrb1192 |
| 6934 | ncrb0728 | 6994 | ncrb0821 | 7054 | ncrb0913 | 7114 | ncrb1106 | 7174 | ncrb1195 |
| 6935 | ncrb0729 | 6995 | ncrb0822 | 7055 | ncrb0914 | 7115 | ncrb1108 | 7175 | ncrb1196 |
| 6936 | ncrb0730 | 6996 | ncrb0823 | 7056 | ncrb0915 | 7116 | ncrb1109 | 7176 | ncrb1197 |
| 6937 | ncrb0732 | 6997 | ncrb0825 | 7057 | ncrb0916 | 7117 | ncrb1110 | 7177 | ncrb1198 |
| 6938 | ncrb0735 | 6998 | ncrb0826 | 7058 | ncrb0917 | 7118 | ncrb1111 | 7178 | ncrb1199 |
| 6939 | ncrb0736 | 6999 | ncrb0827 | 7059 | ncrb0918 | 7119 | ncrb1112 | 7179 | ncrb1200 |
| 6940 | ncrb0737 | 7000 | ncrb0828 | 7060 | ncrb0921 | 7120 | ncrb1113 | 7180 | ncrb1202 |
| 6941 | ncrb0739 | 7001 | ncrb0829 | 7061 | ncrb0922 | 7121 | ncrb1114 | 7181 | ncrb1203 |
| 6942 | ncrb0740 | 7002 | ncrb0830 | 7062 | ncrb0923 | 7122 | ncrb1115 | 7182 | ncrb1204 |
| 6943 | ncrb0741 | 7003 | ncrb0832 | 7063 | ncrb0924 | 7123 | ncrb1116 | 7183 | ncrb1205 |
| 6944 | ncrb0743 | 7004 | ncrb0833 | 7064 | ncrb0925 | 7124 | ncrb1117 | 7184 | ncrb1206 |
| 6945 | ncrb0744 | 7005 | ncrb0834 | 7065 | ncrb0928 | 7125 | ncrb1118 | 7185 | ncrb1207 |
| 6946 | ncrb0745 | 7006 | ncrb0837 | 7066 | ncrb0929 | 7126 | ncrb1120 | 7186 | ncrb1208 |
| 6947 | ncrb0746 | 7007 | ncrb0838 | 7067 | ncrb0931 | 7127 | ncrb1121 | 7187 | ncrb1209 |
| 6948 | ncrb0748 | 7008 | ncrb0840 | 7068 | ncrb0932 | 7128 | ncrb1123 | 7188 | ncrb1213 |
| 6949 | ncrb0749 | 7009 | ncrb0841 | 7069 | ncrb0933 | 7129 | ncrb1124 | 7189 | ncrb1214 |
| 6950 | ncrb0750 | 7010 | ncrb0842 | 7070 | ncrb0934 | 7130 | ncrb1125 | 7190 | ncrb1216 |
| 6951 | ncrb0751 | 7011 | ncrb0843 | 7071 | ncrb0936 | 7131 | ncrb1126 | 7191 | ncrb1217 |
| 6952 | ncrb0752 | 7012 | ncrb0844 | 7072 | ncrb0937 | 7132 | ncrb1127 | 7192 | ncrb1218 |
| 6953 | ncrb0754 | 7013 | ncrb0845 | 7073 | ncrb0938 | 7133 | ncrb1128 | 7193 | ncrb1220 |
| 6954 | ncrb0755 | 7014 | ncrb0846 | 7074 | ncrb0939 | 7134 | ncrb1129 | 7194 | ncrb1221 |
| 6955 | ncrb0757 | 7015 | ncrb0847 | 7075 | ncrb0940 | 7135 | ncrb1131 | 7195 | ncrb1223 |
| 6956 | ncrb0758 | 7016 | ncrb0848 | 7076 | ncrb0942 | 7136 | ncrb1135 | 7196 | ncrb1224 |
| 6957 | ncrb0759 | 7017 | ncrb0849 | 7077 | ncrb0943 | 7137 | ncrb1136 | 7197 | ncrb1228 |
| 6958 | ncrb0760 | 7018 | ncrb0850 | 7078 | ncrb0945 | 7138 | ncrb1137 | 7198 | ncrb1230 |
| 6959 | ncrb0761 | 7019 | ncrb0851 | 7079 | ncrb0947 | 7139 | ncrb1139 | 7199 | ncrb1231 |
| 6960 | ncrb0763 | 7020 | ncrb0852 | 7080 | ncrb0948 | 7140 | ncrb1141 | 7200 | ncrb1232 |

Figure 6C – List of EST Sequence Names From Normal Cartilage cDNA Library

| | |
|---|---|
| 7201 | ncrb1234 |
| 7202 | ncrb1235 |
| 7203 | ncrb1240 |
| 7204 | ncrb1243 |
| 7205 | ncrb1245 |
| 7206 | ncrb1247 |
| 7207 | ncrb1248 |
| 7208 | ncrb1251 |
| 7209 | ncrb1252 |
| 7210 | ncrb1255 |
| 7211 | ncrb1256 |
| 7212 | ncrb1258 |
| 7213 | ncrb1259 |
| 7214 | ncrb1261 |
| 7215 | ncrb1262 |
| 7216 | ncrb1263 |
| 7217 | ncrb1264 |
| 7218 | ncrb1267 |
| 7219 | ncrb1268 |
| 7220 | ncrb1269 |
| 7221 | ncrb1271 |
| 7222 | ncrb1276 |
| 7223 | ncrb1277 |
| 7224 | ncrb1279 |
| 7225 | ncrb1280 |
| 7226 | ncrb1281 |
| 7227 | ncrb1285 |
| 7228 | ncrb1288 |
| 7229 | ncrb1291 |
| 7230 | ncrb1292 |
| 7231 | ncrb1295 |
| 7232 | ncrb1296 |
| 7233 | ncrb1297 |
| 7234 | ncrb1300 |
| 7235 | ncrb1301 |
| 7236 | ncrb1302 |
| 7237 | ncrb1303 |
| 7238 | ncrb1304 |
| 7239 | ncrb1305 |
| 7240 | ncrb1307 |
| 7241 | ncrb1309 |
| 7242 | ncrb1310 |
| 7243 | ncrb1311 |
| 7244 | ncrb1312 |
| 7245 | ncrb1313 |
| 7246 | ncrb1314 |
| 7247 | ncrb1315 |
| 7248 | ncrb1317 |
| 7249 | ncrb1318 |
| 7250 | ncrb1320 |
| 7251 | ncrb1322 |
| 7252 | ncrb1323 |
| 7253 | ncrb1325 |
| 7254 | ncrb1326 |
| 7255 | ncrb1327 |
| 7256 | ncrb1328 |
| 7257 | ncrb1329 |
| 7258 | ncrb1330 |
| 7259 | ncrb1331 |
| 7260 | ncrb1333 |
| 7261 | ncrb1334 |
| 7262 | ncrb1335 |
| 7263 | ncrb1336 |
| 7264 | ncrb1337 |
| 7265 | ncrb1341 |
| 7266 | ncrb1342 |
| 7267 | ncrb1344 |
| 7268 | ncrb1348 |
| 7269 | ncrb1349 |
| 7270 | ncrb1351 |
| 7271 | ncrb1352 |
| 7272 | ncrb1356 |
| 7273 | ncrb1357 |
| 7274 | ncrb1359 |
| 7275 | ncrb1360 |
| 7276 | ncrb1361 |
| 7277 | ncrb1363 |
| 7278 | ncrb1364 |
| 7279 | ncrb1365 |
| 7280 | ncrb1367 |
| 7281 | ncrb1368 |
| 7282 | ncrb1369 |
| 7283 | ncrb1370 |
| 7284 | ncrb1371 |
| 7285 | ncrb1372 |
| 7286 | ncrb1373 |
| 7287 | ncrb1375 |
| 7288 | ncrb1377 |
| 7289 | ncrb1379 |
| 7290 | ncrb1380 |
| 7291 | ncrb1381 |
| 7292 | ncrb1383 |
| 7293 | ncrb1384 |
| 7294 | ncrb1386 |
| 7295 | ncrb1387 |
| 7296 | ncrb1388 |
| 7297 | ncrb1389 |
| 7298 | ncrb1390 |
| 7299 | ncrb1391 |
| 7300 | ncrb1392 |
| 7301 | ncrb1393 |
| 7302 | ncrb1394 |
| 7303 | ncrb1395 |
| 7304 | ncrb1396 |
| 7305 | ncrb1397 |
| 7306 | ncrb1398 |
| 7307 | ncrb1399 |
| 7308 | ncrb1400 |
| 7309 | ncrb1403 |
| 7310 | ncrb1404 |
| 7311 | ncrb1406 |
| 7312 | ncrb1407 |
| 7313 | ncrb1409 |
| 7314 | ncrb1410 |
| 7315 | ncrb1411 |
| 7316 | ncrb1413 |
| 7317 | ncrb1414 |
| 7318 | ncrb1415 |
| 7319 | ncrb1416 |
| 7320 | ncrb1417 |
| 7321 | ncrb1418 |
| 7322 | ncrb1419 |
| 7323 | ncrb1420 |
| 7324 | ncrb1421 |
| 7325 | ncrb1422 |
| 7326 | ncrb1427 |
| 7327 | ncrb1428 |
| 7328 | ncrb1429 |
| 7329 | ncrb1431 |
| 7330 | ncrb1432 |
| 7331 | ncrb1433 |
| 7332 | ncrb1436 |
| 7333 | ncrb1438 |
| 7334 | ncrb1439 |
| 7335 | ncrb1440 |
| 7336 | ncrb1447 |
| 7337 | ncrb1448 |
| 7338 | ncrb1451 |
| 7339 | ncrb1454 |
| 7340 | ncrb1455 |
| 7341 | ncrb1456 |
| 7342 | ncrb1457 |
| 7343 | ncrb1459 |
| 7344 | ncrb1461 |
| 7345 | ncrb1463 |
| 7346 | ncrb1466 |
| 7347 | ncrb1467 |
| 7348 | ncrb1469 |
| 7349 | ncrb1471 |
| 7350 | ncrb1473 |
| 7351 | ncrb1475 |
| 7352 | ncrb1477 |
| 7353 | ncrb1478 |
| 7354 | ncrb1479 |
| 7355 | ncrb1480 |
| 7356 | ncrb1482 |
| 7357 | ncrb1483 |
| 7358 | ncrb1484 |
| 7359 | ncrb1485 |
| 7360 | ncrb1486 |
| 7361 | ncrb1487 |
| 7362 | ncrb1488 |
| 7363 | ncrb1491 |
| 7364 | ncrb1492 |
| 7365 | ncrb1493 |
| 7366 | ncrb1494 |
| 7367 | ncrb1495 |
| 7368 | ncrb1496 |
| 7369 | ncrb1498 |
| 7370 | ncrb1501 |
| 7371 | ncrb1504 |
| 7372 | ncrb1505 |
| 7373 | ncrb1506 |
| 7374 | ncrb1509 |
| 7375 | ncrb1510 |
| 7376 | ncrb1511 |
| 7377 | ncrb1512 |
| 7378 | ncrb1514 |
| 7379 | ncrb1515 |
| 7380 | ncrb1516 |
| 7381 | ncrb1517 |
| 7382 | ncrb1518 |
| 7383 | ncrb1519 |
| 7384 | ncrb1520 |
| 7385 | ncrb1521 |
| 7386 | ncrb1522 |
| 7387 | ncrb1523 |
| 7388 | ncrb1524 |
| 7389 | ncrb1526 |
| 7390 | ncrb1530 |
| 7391 | ncrb1531 |
| 7392 | ncrb1532 |
| 7393 | ncrb1533 |
| 7394 | ncrb1534 |
| 7395 | ncrb1539 |
| 7396 | ncrb1540 |
| 7397 | ncrb1543 |
| 7398 | ncrb1544 |
| 7399 | ncrb1546 |
| 7400 | ncrb1547 |
| 7401 | ncrb1548 |
| 7402 | ncrb1549 |
| 7403 | ncrb1551 |
| 7404 | ncrb1555 |
| 7405 | ncrb1557 |
| 7406 | ncrb1562 |
| 7407 | ncrb1563 |
| 7408 | ncrb1564 |
| 7409 | ncrb1565 |
| 7410 | ncrb1568 |
| 7411 | ncrb1569 |
| 7412 | ncrb1570 |
| 7413 | ncrb1571 |
| 7414 | ncrb1574 |
| 7415 | ncrb1575 |
| 7416 | ncrb1577 |
| 7417 | ncrb1578 |
| 7418 | ncrb1580 |
| 7419 | ncrb1583 |
| 7420 | ncrb1584 |
| 7421 | ncrb1585 |
| 7422 | ncrb1586 |
| 7423 | ncrb1587 |
| 7424 | ncrb1590 |
| 7425 | ncrb1591 |
| 7426 | ncrb1593 |
| 7427 | ncrb1594 |
| 7428 | ncrb1596 |
| 7429 | ncrb1597 |
| 7430 | ncrb1598 |
| 7431 | ncrb1599 |
| 7432 | ncrb1600 |
| 7433 | ncrb1601 |
| 7434 | ncrb1602 |
| 7435 | ncrb1603 |
| 7436 | ncrb1604 |
| 7437 | ncrb1605 |
| 7438 | ncrb1606 |
| 7439 | ncrb1607 |
| 7440 | ncrb1610 |
| 7441 | ncrb1612 |
| 7442 | ncrb1614 |
| 7443 | ncrb1615 |
| 7444 | ncrb1617 |
| 7445 | ncrb1619 |
| 7446 | ncrb1620 |
| 7447 | ncrb1621 |
| 7448 | ncrb1623 |
| 7449 | ncrb1624 |
| 7450 | ncrb1625 |
| 7451 | ncrb1626 |
| 7452 | ncrb1627 |
| 7453 | ncrb1628 |
| 7454 | ncrb1630 |
| 7455 | ncrb1632 |
| 7456 | ncrb1636 |
| 7457 | ncrb1639 |
| 7458 | ncrb1640 |
| 7459 | ncrb1644 |
| 7460 | ncrb1645 |
| 7461 | ncrb1646 |
| 7462 | ncrb1648 |
| 7463 | ncrb1653 |
| 7464 | ncrb1654 |
| 7465 | ncrb1655 |
| 7466 | ncrb1656 |
| 7467 | ncrb1658 |
| 7468 | ncrb1659 |
| 7469 | ncrb1661 |
| 7470 | ncrb1663 |
| 7471 | ncrb1664 |
| 7472 | ncrb1665 |
| 7473 | ncrb1667 |
| 7474 | ncrb1668 |
| 7475 | ncrb1669 |
| 7476 | ncrb1670 |
| 7477 | ncrb1671 |
| 7478 | ncrb1672 |
| 7479 | ncrb1675 |
| 7480 | ncrb1676 |
| 7481 | ncrb1677 |
| 7482 | ncrb1679 |
| 7483 | ncrb1680 |
| 7484 | ncrb1681 |
| 7485 | ncrb1684 |
| 7486 | ncrb1685 |
| 7487 | ncrb1686 |
| 7488 | ncrb1688 |
| 7489 | ncrb1689 |
| 7490 | ncrb1690 |
| 7491 | ncrb1691 |
| 7492 | ncrb1694 |
| 7493 | ncrb1695 |
| 7494 | ncrb1696 |
| 7495 | ncrb1697 |
| 7496 | ncrb1698 |
| 7497 | ncrb1699 |
| 7498 | ncrb1700 |
| 7499 | ncrb1701 |
| 7500 | ncrb1702 |

Figure 6C – List of EST Sequence Names From Normal Cartilage cDNA Library

| | | | | | | | | | |
|---|---|---|---|---|---|---|---|---|---|
| 7501 | ncrb1703 | 7561 | ncrb1797 | 7621 | ncrb1877 | 7681 | ncrb1962 | 7741 | ncrb2063 |
| 7502 | ncrb1705 | 7562 | ncrb1798 | 7622 | ncrb1878 | 7682 | ncrb1963 | 7742 | ncrb2065 |
| 7503 | ncrb1706 | 7563 | ncrb1800 | 7623 | ncrb1879 | 7683 | ncrb1964 | 7743 | ncrb2067 |
| 7504 | ncrb1707 | 7564 | ncrb1801 | 7624 | ncrb1880 | 7684 | ncrb1965 | 7744 | ncrb2068 |
| 7505 | ncrb1708 | 7565 | ncrb1802 | 7625 | ncrb1881 | 7685 | ncrb1968 | 7745 | ncrb2071 |
| 7506 | ncrb1709 | 7566 | ncrb1804 | 7626 | ncrb1882 | 7686 | ncrb1969 | 7746 | ncrb2072 |
| 7507 | ncrb1711 | 7567 | ncrb1805 | 7627 | ncrb1883 | 7687 | ncrb1972 | 7747 | ncrb2074 |
| 7508 | ncrb1712 | 7568 | ncrb1807 | 7628 | ncrb1884 | 7688 | ncrb1973 | 7748 | ncrb2075 |
| 7509 | ncrb1713 | 7569 | ncrb1808 | 7629 | ncrb1885 | 7689 | ncrb1975 | 7749 | ncrb2076 |
| 7510 | ncrb1715 | 7570 | ncrb1809 | 7630 | ncrb1886 | 7690 | ncrb1977 | 7750 | ncrb2077 |
| 7511 | ncrb1716 | 7571 | ncrb1810 | 7631 | ncrb1887 | 7691 | ncrb1979 | 7751 | ncrb2078 |
| 7512 | ncrb1717 | 7572 | ncrb1813 | 7632 | ncrb1888 | 7692 | ncrb1980 | 7752 | ncrb2079 |
| 7513 | ncrb1718 | 7573 | ncrb1815 | 7633 | ncrb1889 | 7693 | ncrb1982 | 7753 | ncrb2080 |
| 7514 | ncrb1719 | 7574 | ncrb1816 | 7634 | ncrb1890 | 7694 | ncrb1983 | 7754 | ncrb2082 |
| 7515 | ncrb1723 | 7575 | ncrb1817 | 7635 | ncrb1891 | 7695 | ncrb1984 | 7755 | ncrb2083 |
| 7516 | ncrb1724 | 7576 | ncrb1818 | 7636 | ncrb1892 | 7696 | ncrb1986 | 7756 | ncrb2085 |
| 7517 | ncrb1726 | 7577 | ncrb1819 | 7637 | ncrb1893 | 7697 | ncrb1987 | 7757 | ncrb2087 |
| 7518 | ncrb1727 | 7578 | ncrb1820 | 7638 | ncrb1894 | 7698 | ncrb1988 | 7758 | ncrb2088 |
| 7519 | ncrb1729 | 7579 | ncrb1821 | 7639 | ncrb1895 | 7699 | ncrb1989 | 7759 | ncrb2089 |
| 7520 | ncrb1731 | 7580 | ncrb1822 | 7640 | ncrb1896 | 7700 | ncrb1993 | 7760 | ncrb2090 |
| 7521 | ncrb1732 | 7581 | ncrb1823 | 7641 | ncrb1897 | 7701 | ncrb1994 | 7761 | ncrb2091 |
| 7522 | ncrb1733 | 7582 | ncrb1824 | 7642 | ncrb1898 | 7702 | ncrb1995 | 7762 | ncrb2092 |
| 7523 | ncrb1734 | 7583 | ncrb1825 | 7643 | ncrb1899 | 7703 | ncrb1996 | 7763 | ncrb2093 |
| 7524 | ncrb1735 | 7584 | ncrb1827 | 7644 | ncrb1901 | 7704 | ncrb1997 | 7764 | ncrb2094 |
| 7525 | ncrb1737 | 7585 | ncrb1828 | 7645 | ncrb1902 | 7705 | ncrb1998 | 7765 | ncrb2096 |
| 7526 | ncrb1738 | 7586 | ncrb1829 | 7646 | ncrb1904 | 7706 | ncrb1999 | 7766 | ncrb2097 |
| 7527 | ncrb1739 | 7587 | ncrb1831 | 7647 | ncrb1905 | 7707 | ncrb2001 | 7767 | ncrb2099 |
| 7528 | ncrb1740 | 7588 | ncrb1832 | 7648 | ncrb1907 | 7708 | ncrb2003 | 7768 | ncrb2101 |
| 7529 | ncrb1741 | 7589 | ncrb1833 | 7649 | ncrb1908 | 7709 | ncrb2006 | 7769 | ncrb2102 |
| 7530 | ncrb1743 | 7590 | ncrb1836 | 7650 | ncrb1910 | 7710 | ncrb2007 | 7770 | ncrb2104 |
| 7531 | ncrb1744 | 7591 | ncrb1839 | 7651 | ncrb1911 | 7711 | ncrb2008 | 7771 | ncrb2105 |
| 7532 | ncrb1745 | 7592 | ncrb1840 | 7652 | ncrb1912 | 7712 | ncrb2010 | 7772 | ncrb2106 |
| 7533 | ncrb1747 | 7593 | ncrb1843 | 7653 | ncrb1913 | 7713 | ncrb2011 | 7773 | ncrb2108 |
| 7534 | ncrb1753 | 7594 | ncrb1844 | 7654 | ncrb1914 | 7714 | ncrb2013 | 7774 | ncrb2109 |
| 7535 | ncrb1754 | 7595 | ncrb1845 | 7655 | ncrb1915 | 7715 | ncrb2014 | 7775 | ncrb2110 |
| 7536 | ncrb1755 | 7596 | ncrb1847 | 7656 | ncrb1916 | 7716 | ncrb2015 | 7776 | ncrb2111 |
| 7537 | ncrb1756 | 7597 | ncrb1848 | 7657 | ncrb1917 | 7717 | ncrb2016 | 7777 | ncrb2112 |
| 7538 | ncrb1757 | 7598 | ncrb1849 | 7658 | ncrb1919 | 7718 | ncrb2019 | 7778 | ncrb2115 |
| 7539 | ncrb1759 | 7599 | ncrb1850 | 7659 | ncrb1920 | 7719 | ncrb2020 | 7779 | ncrb2116 |
| 7540 | ncrb1760 | 7600 | ncrb1851 | 7660 | ncrb1923 | 7720 | ncrb2024 | 7780 | ncrb2117 |
| 7541 | ncrb1761 | 7601 | ncrb1852 | 7661 | ncrb1924 | 7721 | ncrb2027 | 7781 | ncrb2118 |
| 7542 | ncrb1765 | 7602 | ncrb1853 | 7662 | ncrb1925 | 7722 | ncrb2028 | 7782 | ncrb2119 |
| 7543 | ncrb1767 | 7603 | ncrb1856 | 7663 | ncrb1927 | 7723 | ncrb2029 | 7783 | ncrb2122 |
| 7544 | ncrb1770 | 7604 | ncrb1857 | 7664 | ncrb1928 | 7724 | ncrb2031 | 7784 | ncrb2124 |
| 7545 | ncrb1771 | 7605 | ncrb1859 | 7665 | ncrb1931 | 7725 | ncrb2032 | 7785 | ncrb2125 |
| 7546 | ncrb1772 | 7606 | ncrb1860 | 7666 | ncrb1936 | 7726 | ncrb2035 | 7786 | ncrb2126 |
| 7547 | ncrb1778 | 7607 | ncrb1861 | 7667 | ncrb1937 | 7727 | ncrb2036 | 7787 | ncrb2127 |
| 7548 | ncrb1779 | 7608 | ncrb1862 | 7668 | ncrb1939 | 7728 | ncrb2037 | 7788 | ncrb2128 |
| 7549 | ncrb1780 | 7609 | ncrb1864 | 7669 | ncrb1940 | 7729 | ncrb2038 | 7789 | ncrb2131 |
| 7550 | ncrb1781 | 7610 | ncrb1865 | 7670 | ncrb1941 | 7730 | ncrb2039 | 7790 | ncrb2133 |
| 7551 | ncrb1782 | 7611 | ncrb1866 | 7671 | ncrb1942 | 7731 | ncrb2042 | 7791 | ncrb2135 |
| 7552 | ncrb1783 | 7612 | ncrb1867 | 7672 | ncrb1943 | 7732 | ncrb2043 | 7792 | ncrb2143 |
| 7553 | ncrb1785 | 7613 | ncrb1868 | 7673 | ncrb1945 | 7733 | ncrb2045 | 7793 | ncrb2145 |
| 7554 | ncrb1787 | 7614 | ncrb1869 | 7674 | ncrb1948 | 7734 | ncrb2051 | 7794 | ncrb2146 |
| 7555 | ncrb1788 | 7615 | ncrb1871 | 7675 | ncrb1949 | 7735 | ncrb2052 | 7795 | ncrb2148 |
| 7556 | ncrb1789 | 7616 | ncrb1872 | 7676 | ncrb1953 | 7736 | ncrb2053 | 7796 | ncrb2150 |
| 7557 | ncrb1791 | 7617 | ncrb1873 | 7677 | ncrb1955 | 7737 | ncrb2056 | 7797 | ncrb2151 |
| 7558 | ncrb1792 | 7618 | ncrb1874 | 7678 | ncrb1956 | 7738 | ncrb2058 | 7798 | ncrb2152 |
| 7559 | ncrb1793 | 7619 | ncrb1875 | 7679 | ncrb1957 | 7739 | ncrb2059 | 7799 | ncrb2155 |
| 7560 | ncrb1795 | 7620 | ncrb1876 | 7680 | ncrb1959 | 7740 | ncrb2062 | 7800 | ncrb2157 |

Figure 6C – List of EST Sequence Names From Normal Cartilage cDNA Library

| | | | | | | | | | |
|---|---|---|---|---|---|---|---|---|---|
| 7801 | ncrb2159 | 7861 | ncrb2248 | 7921 | ncrb2357 | 7981 | ncrb2448 | 8041 | ncrb2547 |
| 7802 | ncrb2160 | 7862 | ncrb2250 | 7922 | ncrb2358 | 7982 | ncrb2449 | 8042 | ncrb2548 |
| 7803 | ncrb2161 | 7863 | ncrb2251 | 7923 | ncrb2359 | 7983 | ncrb2451 | 8043 | ncrb2550 |
| 7804 | ncrb2162 | 7864 | ncrb2255 | 7924 | ncrb2360 | 7984 | ncrb2452 | 8044 | ncrb2551 |
| 7805 | ncrb2164 | 7865 | ncrb2256 | 7925 | ncrb2361 | 7985 | ncrb2453 | 8045 | ncrb2552 |
| 7806 | ncrb2165 | 7866 | ncrb2257 | 7926 | ncrb2362 | 7986 | ncrb2454 | 8046 | ncrb2554 |
| 7807 | ncrb2166 | 7867 | ncrb2258 | 7927 | ncrb2364 | 7987 | ncrb2455 | 8047 | ncrb2555 |
| 7808 | ncrb2168 | 7868 | ncrb2261 | 7928 | ncrb2365 | 7988 | ncrb2456 | 8048 | ncrb2556 |
| 7809 | ncrb2169 | 7869 | ncrb2262 | 7929 | ncrb2367 | 7989 | ncrb2458 | 8049 | ncrb2557 |
| 7810 | ncrb2170 | 7870 | ncrb2263 | 7930 | ncrb2368 | 7990 | ncrb2459 | 8050 | ncrb2558 |
| 7811 | ncrb2173 | 7871 | ncrb2265 | 7931 | ncrb2369 | 7991 | ncrb2460 | 8051 | ncrb2559 |
| 7812 | ncrb2174 | 7872 | ncrb2266 | 7932 | ncrb2370 | 7992 | ncrb2461 | 8052 | ncrb2560 |
| 7813 | ncrb2175 | 7873 | ncrb2267 | 7933 | ncrb2373 | 7993 | ncrb2465 | 8053 | ncrb2562 |
| 7814 | ncrb2176 | 7874 | ncrb2268 | 7934 | ncrb2375 | 7994 | ncrb2466 | 8054 | ncrb2563 |
| 7815 | ncrb2177 | 7875 | ncrb2269 | 7935 | ncrb2377 | 7995 | ncrb2467 | 8055 | ncrb2565 |
| 7816 | ncrb2178 | 7876 | ncrb2270 | 7936 | ncrb2378 | 7996 | ncrb2468 | 8056 | ncrb2566 |
| 7817 | ncrb2179 | 7877 | ncrb2271 | 7937 | ncrb2379 | 7997 | ncrb2469 | 8057 | ncrb2568 |
| 7818 | ncrb2180 | 7878 | ncrb2272 | 7938 | ncrb2380 | 7998 | ncrb2470 | 8058 | ncrb2570 |
| 7819 | ncrb2181 | 7879 | ncrb2273 | 7939 | ncrb2381 | 7999 | ncrb2471 | 8059 | ncrb2571 |
| 7820 | ncrb2182 | 7880 | ncrb2274 | 7940 | ncrb2383 | 8000 | ncrb2472 | 8060 | ncrb2572 |
| 7821 | ncrb2183 | 7881 | ncrb2277 | 7941 | ncrb2387 | 8001 | ncrb2474 | 8061 | ncrb2573 |
| 7822 | ncrb2184 | 7882 | ncrb2278 | 7942 | ncrb2388 | 8002 | ncrb2475 | 8062 | ncrb2574 |
| 7823 | ncrb2186 | 7883 | ncrb2279 | 7943 | ncrb2389 | 8003 | ncrb2478 | 8063 | ncrb2575 |
| 7824 | ncrb2187 | 7884 | ncrb2280 | 7944 | ncrb2390 | 8004 | ncrb2479 | 8064 | ncrb2576 |
| 7825 | ncrb2188 | 7885 | ncrb2281 | 7945 | ncrb2391 | 8005 | ncrb2480 | 8065 | ncrb2579 |
| 7826 | ncrb2189 | 7886 | ncrb2282 | 7946 | ncrb2393 | 8006 | ncrb2484 | 8066 | ncrb2580 |
| 7827 | ncrb2191 | 7887 | ncrb2283 | 7947 | ncrb2394 | 8007 | ncrb2485 | 8067 | ncrb2581 |
| 7828 | ncrb2192 | 7888 | ncrb2284 | 7948 | ncrb2395 | 8008 | ncrb2486 | 8068 | ncrb2582 |
| 7829 | ncrb2193 | 7889 | ncrb2286 | 7949 | ncrb2396 | 8009 | ncrb2489 | 8069 | ncrb2583 |
| 7830 | ncrb2195 | 7890 | ncrb2288 | 7950 | ncrb2397 | 8010 | ncrb2490 | 8070 | ncrb2585 |
| 7831 | ncrb2197 | 7891 | ncrb2289 | 7951 | ncrb2398 | 8011 | ncrb2491 | 8071 | ncrb2586 |
| 7832 | ncrb2200 | 7892 | ncrb2291 | 7952 | ncrb2399 | 8012 | ncrb2492 | 8072 | ncrb2588 |
| 7833 | ncrb2201 | 7893 | ncrb2292 | 7953 | ncrb2400 | 8013 | ncrb2495 | 8073 | ncrb2590 |
| 7834 | ncrb2202 | 7894 | ncrb2293 | 7954 | ncrb2403 | 8014 | ncrb2496 | 8074 | ncrb2591 |
| 7835 | ncrb2204 | 7895 | ncrb2294 | 7955 | ncrb2404 | 8015 | ncrb2500 | 8075 | ncrb2592 |
| 7836 | ncrb2205 | 7896 | ncrb2295 | 7956 | ncrb2405 | 8016 | ncrb2503 | 8076 | ncrb2595 |
| 7837 | ncrb2206 | 7897 | ncrb2299 | 7957 | ncrb2407 | 8017 | ncrb2504 | 8077 | ncrb2597 |
| 7838 | ncrb2208 | 7898 | ncrb2307 | 7958 | ncrb2408 | 8018 | ncrb2507 | 8078 | ncrb2598 |
| 7839 | ncrb2211 | 7899 | ncrb2308 | 7959 | ncrb2412 | 8019 | ncrb2508 | 8079 | ncrb2599 |
| 7840 | ncrb2213 | 7900 | ncrb2309 | 7960 | ncrb2414 | 8020 | ncrb2510 | 8080 | ncrb2600 |
| 7841 | ncrb2215 | 7901 | ncrb2310 | 7961 | ncrb2415 | 8021 | ncrb2511 | 8081 | ncrb2601 |
| 7842 | ncrb2219 | 7902 | ncrb2311 | 7962 | ncrb2416 | 8022 | ncrb2512 | 8082 | ncrb2603 |
| 7843 | ncrb2220 | 7903 | ncrb2317 | 7963 | ncrb2419 | 8023 | ncrb2515 | 8083 | ncrb2604 |
| 7844 | ncrb2221 | 7904 | ncrb2320 | 7964 | ncrb2421 | 8024 | ncrb2516 | 8084 | ncrb2606 |
| 7845 | ncrb2223 | 7905 | ncrb2323 | 7965 | ncrb2422 | 8025 | ncrb2517 | 8085 | ncrb2607 |
| 7846 | ncrb2224 | 7906 | ncrb2324 | 7966 | ncrb2424 | 8026 | ncrb2519 | 8086 | ncrb2608 |
| 7847 | ncrb2227 | 7907 | ncrb2328 | 7967 | ncrb2426 | 8027 | ncrb2523 | 8087 | ncrb2611 |
| 7848 | ncrb2228 | 7908 | ncrb2330 | 7968 | ncrb2427 | 8028 | ncrb2524 | 8088 | ncrb2614 |
| 7849 | ncrb2229 | 7909 | ncrb2331 | 7969 | ncrb2428 | 8029 | ncrb2527 | 8089 | ncrb2615 |
| 7850 | ncrb2231 | 7910 | ncrb2335 | 7970 | ncrb2429 | 8030 | ncrb2528 | 8090 | ncrb2617 |
| 7851 | ncrb2235 | 7911 | ncrb2336 | 7971 | ncrb2431 | 8031 | ncrb2529 | 8091 | ncrb2618 |
| 7852 | ncrb2237 | 7912 | ncrb2339 | 7972 | ncrb2432 | 8032 | ncrb2531 | 8092 | ncrb2621 |
| 7853 | ncrb2239 | 7913 | ncrb2341 | 7973 | ncrb2434 | 8033 | ncrb2533 | 8093 | ncrb2623 |
| 7854 | ncrb2240 | 7914 | ncrb2342 | 7974 | ncrb2435 | 8034 | ncrb2534 | 8094 | ncrb2626 |
| 7855 | ncrb2241 | 7915 | ncrb2344 | 7975 | ncrb2437 | 8035 | ncrb2535 | 8095 | ncrb2627 |
| 7856 | ncrb2242 | 7916 | ncrb2346 | 7976 | ncrb2440 | 8036 | ncrb2539 | 8096 | ncrb2628 |
| 7857 | ncrb2243 | 7917 | ncrb2347 | 7977 | ncrb2442 | 8037 | ncrb2540 | 8097 | ncrb2630 |
| 7858 | ncrb2245 | 7918 | ncrb2348 | 7978 | ncrb2444 | 8038 | ncrb2543 | 8098 | ncrb2632 |
| 7859 | ncrb2246 | 7919 | ncrb2351 | 7979 | ncrb2445 | 8039 | ncrb2544 | 8099 | ncrb2636 |
| 7860 | ncrb2247 | 7920 | ncrb2352 | 7980 | ncrb2447 | 8040 | ncrb2546 | 8100 | ncrb2637 |

Figure 6C – List of EST Sequence Names From Normal Cartilage cDNA Library

| | | | | | | | | | |
|---|---|---|---|---|---|---|---|---|---|
| 8101 | ncrb2639 | 8161 | ncrb2728 | 8221 | ncrb2820 | 8281 | ncrb2930 | 8341 | ncrb3045 |
| 8102 | ncrb2640 | 8162 | ncrb2730 | 8222 | ncrb2821 | 8282 | ncrb2932 | 8342 | ncrb3046 |
| 8103 | ncrb2641 | 8163 | ncrb2732 | 8223 | ncrb2826 | 8283 | ncrb2933 | 8343 | ncrb3047 |
| 8104 | ncrb2642 | 8164 | ncrb2735 | 8224 | ncrb2831 | 8284 | ncrb2934 | 8344 | ncrb3048 |
| 8105 | ncrb2643 | 8165 | ncrb2736 | 8225 | ncrb2832 | 8285 | ncrb2935 | 8345 | ncrb3053 |
| 8106 | ncrb2644 | 8166 | ncrb2738 | 8226 | ncrb2833 | 8286 | ncrb2938 | 8346 | ncrb3054 |
| 8107 | ncrb2645 | 8167 | ncrb2739 | 8227 | ncrb2834 | 8287 | ncrb2939 | 8347 | ncrb3055 |
| 8108 | ncrb2646 | 8168 | ncrb2740 | 8228 | ncrb2835 | 8288 | ncrb2941 | 8348 | ncrb3056 |
| 8109 | ncrb2647 | 8169 | ncrb2741 | 8229 | ncrb2836 | 8289 | ncrb2942 | 8349 | ncrb3061 |
| 8110 | ncrb2648 | 8170 | ncrb2742 | 8230 | ncrb2838 | 8290 | ncrb2943 | 8350 | ncrb3063 |
| 8111 | ncrb2649 | 8171 | ncrb2743 | 8231 | ncrb2839 | 8291 | ncrb2945 | 8351 | ncrb3064 |
| 8112 | ncrb2650 | 8172 | ncrb2744 | 8232 | ncrb2840 | 8292 | ncrb2947 | 8352 | ncrb3071 |
| 8113 | ncrb2651 | 8173 | ncrb2745 | 8233 | ncrb2842 | 8293 | ncrb2949 | 8353 | ncrb3076 |
| 8114 | ncrb2655 | 8174 | ncrb2746 | 8234 | ncrb2844 | 8294 | ncrb2951 | 8354 | ncrb3077 |
| 8115 | ncrb2656 | 8175 | ncrb2747 | 8235 | ncrb2845 | 8295 | ncrb2952 | 8355 | ncrb3079 |
| 8116 | ncrb2657 | 8176 | ncrb2748 | 8236 | ncrb2846 | 8296 | ncrb2954 | 8356 | ncrb3080 |
| 8117 | ncrb2658 | 8177 | ncrb2749 | 8237 | ncrb2847 | 8297 | ncrb2955 | 8357 | ncrb3083 |
| 8118 | ncrb2659 | 8178 | ncrb2751 | 8238 | ncrb2848 | 8298 | ncrb2956 | 8358 | ncrb3086 |
| 8119 | ncrb2660 | 8179 | ncrb2752 | 8239 | ncrb2850 | 8299 | ncrb2957 | 8359 | ncrb3087 |
| 8120 | ncrb2661 | 8180 | ncrb2753 | 8240 | ncrb2851 | 8300 | ncrb2961 | 8360 | ncrb3091 |
| 8121 | ncrb2662 | 8181 | ncrb2754 | 8241 | ncrb2852 | 8301 | ncrb2963 | 8361 | ncrb3095 |
| 8122 | ncrb2665 | 8182 | ncrb2755 | 8242 | ncrb2853 | 8302 | ncrb2966 | 8362 | ncrb3096 |
| 8123 | ncrb2666 | 8183 | ncrb2756 | 8243 | ncrb2854 | 8303 | ncrb2968 | 8363 | ncrb3097 |
| 8124 | ncrb2667 | 8184 | ncrb2757 | 8244 | ncrb2855 | 8304 | ncrb2969 | 8364 | ncrb3098 |
| 8125 | ncrb2669 | 8185 | ncrb2759 | 8245 | ncrb2856 | 8305 | ncrb2971 | 8365 | ncrb3101 |
| 8126 | ncrb2671 | 8186 | ncrb2761 | 8246 | ncrb2857 | 8306 | ncrb2973 | 8366 | ncrb3104 |
| 8127 | ncrb2672 | 8187 | ncrb2762 | 8247 | ncrb2858 | 8307 | ncrb2976 | 8367 | ncrb3105 |
| 8128 | ncrb2676 | 8188 | ncrb2763 | 8248 | ncrb2861 | 8308 | ncrb2979 | 8368 | ncrb3107 |
| 8129 | ncrb2677 | 8189 | ncrb2765 | 8249 | ncrb2862 | 8309 | ncrb2980 | 8369 | ncrb3108 |
| 8130 | ncrb2678 | 8190 | ncrb2767 | 8250 | ncrb2864 | 8310 | ncrb2983 | 8370 | ncrb3112 |
| 8131 | ncrb2680 | 8191 | ncrb2771 | 8251 | ncrb2865 | 8311 | ncrb2991 | 8371 | ncrb3114 |
| 8132 | ncrb2681 | 8192 | ncrb2772 | 8252 | ncrb2867 | 8312 | ncrb2992 | 8372 | ncrb3115 |
| 8133 | ncrb2683 | 8193 | ncrb2773 | 8253 | ncrb2868 | 8313 | ncrb2997 | 8373 | ncrb3119 |
| 8134 | ncrb2684 | 8194 | ncrb2775 | 8254 | ncrb2869 | 8314 | ncrb3000 | 8374 | ncrb3120 |
| 8135 | ncrb2686 | 8195 | ncrb2777 | 8255 | ncrb2870 | 8315 | ncrb3001 | 8375 | ncrb3121 |
| 8136 | ncrb2687 | 8196 | ncrb2778 | 8256 | ncrb2871 | 8316 | ncrb3002 | 8376 | ncrb3122 |
| 8137 | ncrb2688 | 8197 | ncrb2779 | 8257 | ncrb2873 | 8317 | ncrb3003 | 8377 | ncrb3123 |
| 8138 | ncrb2692 | 8198 | ncrb2780 | 8258 | ncrb2874 | 8318 | ncrb3005 | 8378 | ncrb3124 |
| 8139 | ncrb2693 | 8199 | ncrb2781 | 8259 | ncrb2875 | 8319 | ncrb3007 | 8379 | ncrb3126 |
| 8140 | ncrb2696 | 8200 | ncrb2783 | 8260 | ncrb2880 | 8320 | ncrb3008 | 8380 | ncrb3127 |
| 8141 | ncrb2697 | 8201 | ncrb2784 | 8261 | ncrb2883 | 8321 | ncrb3010 | 8381 | ncrb3128 |
| 8142 | ncrb2699 | 8202 | ncrb2787 | 8262 | ncrb2884 | 8322 | ncrb3011 | 8382 | ncrb3129 |
| 8143 | ncrb2700 | 8203 | ncrb2788 | 8263 | ncrb2887 | 8323 | ncrb3013 | 8383 | ncrb3130 |
| 8144 | ncrb2701 | 8204 | ncrb2792 | 8264 | ncrb2888 | 8324 | ncrb3014 | 8384 | ncrb3131 |
| 8145 | ncrb2703 | 8205 | ncrb2795 | 8265 | ncrb2892 | 8325 | ncrb3015 | 8385 | ncrb3134 |
| 8146 | ncrb2704 | 8206 | ncrb2796 | 8266 | ncrb2897 | 8326 | ncrb3016 | 8386 | ncrb3135 |
| 8147 | ncrb2709 | 8207 | ncrb2797 | 8267 | ncrb2900 | 8327 | ncrb3018 | 8387 | ncrb3136 |
| 8148 | ncrb2711 | 8208 | ncrb2798 | 8268 | ncrb2903 | 8328 | ncrb3020 | 8388 | ncrb3140 |
| 8149 | ncrb2712 | 8209 | ncrb2799 | 8269 | ncrb2906 | 8329 | ncrb3021 | 8389 | ncrb3141 |
| 8150 | ncrb2713 | 8210 | ncrb2800 | 8270 | ncrb2908 | 8330 | ncrb3023 | 8390 | ncrb3142 |
| 8151 | ncrb2715 | 8211 | ncrb2801 | 8271 | ncrb2909 | 8331 | ncrb3024 | 8391 | ncrb3143 |
| 8152 | ncrb2716 | 8212 | ncrb2803 | 8272 | ncrb2912 | 8332 | ncrb3025 | 8392 | ncrb3144 |
| 8153 | ncrb2717 | 8213 | ncrb2804 | 8273 | ncrb2914 | 8333 | ncrb3026 | 8393 | ncrb3147 |
| 8154 | ncrb2719 | 8214 | ncrb2807 | 8274 | ncrb2916 | 8334 | ncrb3028 | 8394 | ncrb3148 |
| 8155 | ncrb2720 | 8215 | ncrb2808 | 8275 | ncrb2917 | 8335 | ncrb3029 | 8395 | ncrb3149 |
| 8156 | ncrb2722 | 8216 | ncrb2809 | 8276 | ncrb2918 | 8336 | ncrb3031 | 8396 | ncrb3150 |
| 8157 | ncrb2724 | 8217 | ncrb2812 | 8277 | ncrb2922 | 8337 | ncrb3032 | 8397 | ncrb3151 |
| 8158 | ncrb2725 | 8218 | ncrb2813 | 8278 | ncrb2924 | 8338 | ncrb3035 | 8398 | ncrb3152 |
| 8159 | ncrb2726 | 8219 | ncrb2817 | 8279 | ncrb2928 | 8339 | ncrb3037 | 8399 | ncrb3153 |
| 8160 | ncrb2727 | 8220 | ncrb2818 | 8280 | ncrb2929 | 8340 | ncrb3038 | 8400 | ncrb3156 |

Figure 6C – List of EST Sequence Names From Normal Cartilage cDNA Library

| | | | | | | | | | |
|---|---|---|---|---|---|---|---|---|---|
| 8401 | ncrb3157 | 8461 | ncrb3252 | 8521 | ncrb3349 | 8581 | ncrb3441 | 8641 | ncrb3539 |
| 8402 | ncrb3158 | 8462 | ncrb3254 | 8522 | ncrb3350 | 8582 | ncrb3442 | 8642 | ncrb3540 |
| 8403 | ncrb3160 | 8463 | ncrb3255 | 8523 | ncrb3352 | 8583 | ncrb3443 | 8643 | ncrb3541 |
| 8404 | ncrb3162 | 8464 | ncrb3256 | 8524 | ncrb3354 | 8584 | ncrb3444 | 8644 | ncrb3542 |
| 8405 | ncrb3163 | 8465 | ncrb3258 | 8525 | ncrb3355 | 8585 | ncrb3445 | 8645 | ncrb3544 |
| 8406 | ncrb3164 | 8466 | ncrb3261 | 8526 | ncrb3356 | 8586 | ncrb3446 | 8646 | ncrb3547 |
| 8407 | ncrb3165 | 8467 | ncrb3263 | 8527 | ncrb3359 | 8587 | ncrb3449 | 8647 | ncrb3548 |
| 8408 | ncrb3166 | 8468 | ncrb3264 | 8528 | ncrb3360 | 8588 | ncrb3450 | 8648 | ncrb3549 |
| 8409 | ncrb3167 | 8469 | ncrb3267 | 8529 | ncrb3362 | 8589 | ncrb3451 | 8649 | ncrb3550 |
| 8410 | ncrb3168 | 8470 | ncrb3268 | 8530 | ncrb3363 | 8590 | ncrb3452 | 8650 | ncrb3551 |
| 8411 | ncrb3171 | 8471 | ncrb3271 | 8531 | ncrb3369 | 8591 | ncrb3453 | 8651 | ncrb3552 |
| 8412 | ncrb3172 | 8472 | ncrb3275 | 8532 | ncrb3370 | 8592 | ncrb3454 | 8652 | ncrb3555 |
| 8413 | ncrb3173 | 8473 | ncrb3276 | 8533 | ncrb3371 | 8593 | ncrb3455 | 8653 | ncrb3557 |
| 8414 | ncrb3176 | 8474 | ncrb3277 | 8534 | ncrb3373 | 8594 | ncrb3459 | 8654 | ncrb3559 |
| 8415 | ncrb3177 | 8475 | ncrb3281 | 8535 | ncrb3376 | 8595 | ncrb3460 | 8655 | ncrb3560 |
| 8416 | ncrb3180 | 8476 | ncrb3284 | 8536 | ncrb3377 | 8596 | ncrb3463 | 8656 | ncrb3563 |
| 8417 | ncrb3182 | 8477 | ncrb3285 | 8537 | ncrb3379 | 8597 | ncrb3464 | 8657 | ncrb3564 |
| 8418 | ncrb3183 | 8478 | ncrb3287 | 8538 | ncrb3380 | 8598 | ncrb3468 | 8658 | ncrb3567 |
| 8419 | ncrb3184 | 8479 | ncrb3288 | 8539 | ncrb3381 | 8599 | ncrb3469 | 8659 | ncrb3568 |
| 8420 | ncrb3185 | 8480 | ncrb3289 | 8540 | ncrb3384 | 8600 | ncrb3471 | 8660 | ncrb3569 |
| 8421 | ncrb3188 | 8481 | ncrb3291 | 8541 | ncrb3385 | 8601 | ncrb3475 | 8661 | ncrb3572 |
| 8422 | ncrb3192 | 8482 | ncrb3298 | 8542 | ncrb3386 | 8602 | ncrb3476 | 8662 | ncrb3573 |
| 8423 | ncrb3197 | 8483 | ncrb3299 | 8543 | ncrb3388 | 8603 | ncrb3477 | 8663 | ncrb3574 |
| 8424 | ncrb3199 | 8484 | ncrb3300 | 8544 | ncrb3389 | 8604 | ncrb3481 | 8664 | ncrb3576 |
| 8425 | ncrb3200 | 8485 | ncrb3301 | 8545 | ncrb3390 | 8605 | ncrb3482 | 8665 | ncrb3577 |
| 8426 | ncrb3202 | 8486 | ncrb3302 | 8546 | ncrb3391 | 8606 | ncrb3483 | 8666 | ncrb3578 |
| 8427 | ncrb3203 | 8487 | ncrb3304 | 8547 | ncrb3392 | 8607 | ncrb3484 | 8667 | ncrb3579 |
| 8428 | ncrb3204 | 8488 | ncrb3306 | 8548 | ncrb3393 | 8608 | ncrb3486 | 8668 | ncrb3580 |
| 8429 | ncrb3205 | 8489 | ncrb3307 | 8549 | ncrb3394 | 8609 | ncrb3488 | 8669 | ncrb3581 |
| 8430 | ncrb3207 | 8490 | ncrb3309 | 8550 | ncrb3396 | 8610 | ncrb3492 | 8670 | ncrb3583 |
| 8431 | ncrb3211 | 8491 | ncrb3313 | 8551 | ncrb3397 | 8611 | ncrb3495 | 8671 | ncrb3584 |
| 8432 | ncrb3212 | 8492 | ncrb3314 | 8552 | ncrb3398 | 8612 | ncrb3496 | 8672 | ncrb3585 |
| 8433 | ncrb3213 | 8493 | ncrb3315 | 8553 | ncrb3400 | 8613 | ncrb3498 | 8673 | ncrb3586 |
| 8434 | ncrb3215 | 8494 | ncrb3316 | 8554 | ncrb3402 | 8614 | ncrb3500 | 8674 | ncrb3587 |
| 8435 | ncrb3216 | 8495 | ncrb3317 | 8555 | ncrb3403 | 8615 | ncrb3501 | 8675 | ncrb3588 |
| 8436 | ncrb3217 | 8496 | ncrb3318 | 8556 | ncrb3404 | 8616 | ncrb3503 | 8676 | ncrb3589 |
| 8437 | ncrb3218 | 8497 | ncrb3319 | 8557 | ncrb3408 | 8617 | ncrb3504 | 8677 | ncrb3590 |
| 8438 | ncrb3220 | 8498 | ncrb3320 | 8558 | ncrb3409 | 8618 | ncrb3506 | 8678 | ncrb3595 |
| 8439 | ncrb3221 | 8499 | ncrb3321 | 8559 | ncrb3410 | 8619 | ncrb3507 | 8679 | ncrb3596 |
| 8440 | ncrb3222 | 8500 | ncrb3322 | 8560 | ncrb3414 | 8620 | ncrb3509 | 8680 | ncrb3597 |
| 8441 | ncrb3224 | 8501 | ncrb3324 | 8561 | ncrb3415 | 8621 | ncrb3510 | 8681 | ncrb3599 |
| 8442 | ncrb3225 | 8502 | ncrb3325 | 8562 | ncrb3417 | 8622 | ncrb3511 | 8682 | ncrb3602 |
| 8443 | ncrb3226 | 8503 | ncrb3326 | 8563 | ncrb3418 | 8623 | ncrb3512 | 8683 | ncrb3603 |
| 8444 | ncrb3227 | 8504 | ncrb3327 | 8564 | ncrb3421 | 8624 | ncrb3513 | 8684 | ncrb3604 |
| 8445 | ncrb3229 | 8505 | ncrb3328 | 8565 | ncrb3422 | 8625 | ncrb3514 | 8685 | ncrb3605 |
| 8446 | ncrb3230 | 8506 | ncrb3329 | 8566 | ncrb3423 | 8626 | ncrb3516 | 8686 | ncrb3607 |
| 8447 | ncrb3232 | 8507 | ncrb3330 | 8567 | ncrb3424 | 8627 | ncrb3517 | 8687 | ncrb3608 |
| 8448 | ncrb3233 | 8508 | ncrb3331 | 8568 | ncrb3425 | 8628 | ncrb3519 | 8688 | ncrb3609 |
| 8449 | ncrb3234 | 8509 | ncrb3332 | 8569 | ncrb3426 | 8629 | ncrb3520 | 8689 | ncrb3610 |
| 8450 | ncrb3235 | 8510 | ncrb3333 | 8570 | ncrb3427 | 8630 | ncrb3521 | 8690 | ncrb3611 |
| 8451 | ncrb3236 | 8511 | ncrb3334 | 8571 | ncrb3429 | 8631 | ncrb3522 | 8691 | ncrb3612 |
| 8452 | ncrb3237 | 8512 | ncrb3335 | 8572 | ncrb3430 | 8632 | ncrb3524 | 8692 | ncrb3613 |
| 8453 | ncrb3238 | 8513 | ncrb3337 | 8573 | ncrb3431 | 8633 | ncrb3527 | 8693 | ncrb3618 |
| 8454 | ncrb3240 | 8514 | ncrb3338 | 8574 | ncrb3432 | 8634 | ncrb3528 | 8694 | ncrb3619 |
| 8455 | ncrb3241 | 8515 | ncrb3339 | 8575 | ncrb3434 | 8635 | ncrb3532 | 8695 | ncrb3620 |
| 8456 | ncrb3243 | 8516 | ncrb3340 | 8576 | ncrb3436 | 8636 | ncrb3533 | 8696 | ncrb3621 |
| 8457 | ncrb3245 | 8517 | ncrb3341 | 8577 | ncrb3437 | 8637 | ncrb3534 | 8697 | ncrb3623 |
| 8458 | ncrb3248 | 8518 | ncrb3344 | 8578 | ncrb3438 | 8638 | ncrb3535 | 8698 | ncrb3624 |
| 8459 | ncrb3249 | 8519 | ncrb3345 | 8579 | ncrb3439 | 8639 | ncrb3536 | 8699 | ncrb3625 |
| 8460 | ncrb3251 | 8520 | ncrb3348 | 8580 | ncrb3440 | 8640 | ncrb3537 | 8700 | ncrb3626 |

Figure 6C – List of EST Sequence Names From Normal Cartilage cDNA Library

| | | | | | | | | | |
|---|---|---|---|---|---|---|---|---|---|
| 8701 | ncrb3627 | 8761 | ncrb3841 | 8821 | ncrb3941 | 8881 | ncrb4039 | 8941 | ncrb4131 |
| 8702 | ncrb3628 | 8762 | ncrb3843 | 8822 | ncrb3942 | 8882 | ncrb4041 | 8942 | ncrb4132 |
| 8703 | ncrb3629 | 8763 | ncrb3844 | 8823 | ncrb3943 | 8883 | ncrb4044 | 8943 | ncrb4133 |
| 8704 | ncrb3630 | 8764 | ncrb3845 | 8824 | ncrb3944 | 8884 | ncrb4045 | 8944 | ncrb4135 |
| 8705 | ncrb3633 | 8765 | ncrb3847 | 8825 | ncrb3945 | 8885 | ncrb4047 | 8945 | ncrb4136 |
| 8706 | ncrb3636 | 8766 | ncrb3848 | 8826 | ncrb3947 | 8886 | ncrb4048 | 8946 | ncrb4139 |
| 8707 | ncrb3637 | 8767 | ncrb3850 | 8827 | ncrb3948 | 8887 | ncrb4053 | 8947 | ncrb4140 |
| 8708 | ncrb3638 | 8768 | ncrb3851 | 8828 | ncrb3949 | 8888 | ncrb4055 | 8948 | ncrb4141 |
| 8709 | ncrb3641 | 8769 | ncrb3852 | 8829 | ncrb3950 | 8889 | ncrb4056 | 8949 | ncrb4143 |
| 8710 | ncrb3646 | 8770 | ncrb3853 | 8830 | ncrb3951 | 8890 | ncrb4057 | 8950 | ncrb4144 |
| 8711 | ncrb3647 | 8771 | ncrb3854 | 8831 | ncrb3953 | 8891 | ncrb4059 | 8951 | ncrb4145 |
| 8712 | ncrb3648 | 8772 | ncrb3855 | 8832 | ncrb3955 | 8892 | ncrb4061 | 8952 | ncrb4149 |
| 8713 | ncrb3660 | 8773 | ncrb3856 | 8833 | ncrb3957 | 8893 | ncrb4063 | 8953 | ncrb4153 |
| 8714 | ncrb3663 | 8774 | ncrb3859 | 8834 | ncrb3959 | 8894 | ncrb4065 | 8954 | ncrb4154 |
| 8715 | ncrb3669 | 8775 | ncrb3860 | 8835 | ncrb3960 | 8895 | ncrb4067 | 8955 | ncrb4155 |
| 8716 | ncrb3672 | 8776 | ncrb3861 | 8836 | ncrb3965 | 8896 | ncrb4068 | 8956 | ncrb4156 |
| 8717 | ncrb3676 | 8777 | ncrb3863 | 8837 | ncrb3967 | 8897 | ncrb4072 | 8957 | ncrb4157 |
| 8718 | ncrb3677 | 8778 | ncrb3864 | 8838 | ncrb3969 | 8898 | ncrb4074 | 8958 | ncrb4161 |
| 8719 | ncrb3679 | 8779 | ncrb3866 | 8839 | ncrb3973 | 8899 | ncrb4076 | 8959 | ncrb4165 |
| 8720 | ncrb3680 | 8780 | ncrb3867 | 8840 | ncrb3975 | 8900 | ncrb4077 | 8960 | ncrb4166 |
| 8721 | ncrb3681 | 8781 | ncrb3872 | 8841 | ncrb3980 | 8901 | ncrb4079 | 8961 | ncrb4168 |
| 8722 | ncrb3683 | 8782 | ncrb3873 | 8842 | ncrb3981 | 8902 | ncrb4080 | 8962 | ncrb4170 |
| 8723 | ncrb3684 | 8783 | ncrb3875 | 8843 | ncrb3984 | 8903 | ncrb4081 | 8963 | ncrb4171 |
| 8724 | ncrb3685 | 8784 | ncrb3876 | 8844 | ncrb3985 | 8904 | ncrb4083 | 8964 | ncrb4172 |
| 8725 | ncrb3686 | 8785 | ncrb3877 | 8845 | ncrb3986 | 8905 | ncrb4084 | 8965 | ncrb4173 |
| 8726 | ncrb3687 | 8786 | ncrb3878 | 8846 | ncrb3987 | 8906 | ncrb4085 | 8966 | ncrb4175 |
| 8727 | ncrb3692 | 8787 | ncrb3879 | 8847 | ncrb3988 | 8907 | ncrb4086 | 8967 | ncrb4177 |
| 8728 | ncrb3693 | 8788 | ncrb3880 | 8848 | ncrb3989 | 8908 | ncrb4087 | 8968 | ncrb4178 |
| 8729 | ncrb3695 | 8789 | ncrb3882 | 8849 | ncrb3990 | 8909 | ncrb4088 | 8969 | ncrb4180 |
| 8730 | ncrb3700 | 8790 | ncrb3883 | 8850 | ncrb3991 | 8910 | ncrb4089 | 8970 | ncrb4181 |
| 8731 | ncrb3702 | 8791 | ncrb3887 | 8851 | ncrb3992 | 8911 | ncrb4091 | 8971 | ncrb4182 |
| 8732 | ncrb3703 | 8792 | ncrb3888 | 8852 | ncrb3993 | 8912 | ncrb4092 | 8972 | ncrb4183 |
| 8733 | ncrb3708 | 8793 | ncrb3890 | 8853 | ncrb3995 | 8913 | ncrb4093 | 8973 | ncrb4187 |
| 8734 | ncrb3712 | 8794 | ncrb3891 | 8854 | ncrb3996 | 8914 | ncrb4094 | 8974 | ncrb4188 |
| 8735 | ncrb3758 | 8795 | ncrb3893 | 8855 | ncrb3997 | 8915 | ncrb4095 | 8975 | ncrb4189 |
| 8736 | ncrb3760 | 8796 | ncrb3894 | 8856 | ncrb3998 | 8916 | ncrb4097 | 8976 | ncrb4190 |
| 8737 | ncrb3765 | 8797 | ncrb3895 | 8857 | ncrb3999 | 8917 | ncrb4098 | 8977 | ncrb4191 |
| 8738 | ncrb3766 | 8798 | ncrb3896 | 8858 | ncrb4000 | 8918 | ncrb4100 | 8978 | ncrb4192 |
| 8739 | ncrb3768 | 8799 | ncrb3900 | 8859 | ncrb4001 | 8919 | ncrb4101 | 8979 | ncrb4193 |
| 8740 | ncrb3770 | 8800 | ncrb3902 | 8860 | ncrb4002 | 8920 | ncrb4102 | 8980 | ncrb4194 |
| 8741 | ncrb3772 | 8801 | ncrb3903 | 8861 | ncrb4003 | 8921 | ncrb4103 | 8981 | ncrb4195 |
| 8742 | ncrb3776 | 8802 | ncrb3907 | 8862 | ncrb4004 | 8922 | ncrb4104 | 8982 | ncrb4196 |
| 8743 | ncrb3782 | 8803 | ncrb3908 | 8863 | ncrb4006 | 8923 | ncrb4105 | 8983 | ncrb4198 |
| 8744 | ncrb3783 | 8804 | ncrb3910 | 8864 | ncrb4007 | 8924 | ncrb4106 | 8984 | ncrb4199 |
| 8745 | ncrb3784 | 8805 | ncrb3912 | 8865 | ncrb4008 | 8925 | ncrb4108 | 8985 | ncrb4200 |
| 8746 | ncrb3792 | 8806 | ncrb3913 | 8866 | ncrb4009 | 8926 | ncrb4109 | 8986 | ncrb4201 |
| 8747 | ncrb3793 | 8807 | ncrb3916 | 8867 | ncrb4011 | 8927 | ncrb4111 | 8987 | ncrb4202 |
| 8748 | ncrb3796 | 8808 | ncrb3917 | 8868 | ncrb4014 | 8928 | ncrb4112 | 8988 | ncrb4203 |
| 8749 | ncrb3797 | 8809 | ncrb3919 | 8869 | ncrb4015 | 8929 | ncrb4116 | 8989 | ncrb4204 |
| 8750 | ncrb3798 | 8810 | ncrb3924 | 8870 | ncrb4019 | 8930 | ncrb4117 | 8990 | ncrb4206 |
| 8751 | ncrb3799 | 8811 | ncrb3926 | 8871 | ncrb4021 | 8931 | ncrb4118 | 8991 | ncrb4207 |
| 8752 | ncrb3804 | 8812 | ncrb3928 | 8872 | ncrb4022 | 8932 | ncrb4119 | 8992 | ncrb4209 |
| 8753 | ncrb3805 | 8813 | ncrb3929 | 8873 | ncrb4023 | 8933 | ncrb4120 | 8993 | ncrb4210 |
| 8754 | ncrb3812 | 8814 | ncrb3931 | 8874 | ncrb4025 | 8934 | ncrb4121 | 8994 | ncrb4211 |
| 8755 | ncrb3813 | 8815 | ncrb3932 | 8875 | ncrb4027 | 8935 | ncrb4122 | 8995 | ncrb4212 |
| 8756 | ncrb3815 | 8816 | ncrb3933 | 8876 | ncrb4030 | 8936 | ncrb4123 | 8996 | ncrb4213 |
| 8757 | ncrb3816 | 8817 | ncrb3934 | 8877 | ncrb4031 | 8937 | ncrb4125 | 8997 | ncrb4215 |
| 8758 | ncrb3821 | 8818 | ncrb3935 | 8878 | ncrb4032 | 8938 | ncrb4126 | 8998 | ncrb4216 |
| 8759 | ncrb3823 | 8819 | ncrb3936 | 8879 | ncrb4035 | 8939 | ncrb4127 | 8999 | ncrb4217 |
| 8760 | ncrb3829 | 8820 | ncrb3940 | 8880 | ncrb4037 | 8940 | ncrb4128 | 9000 | ncrb4218 |

Figure 6C – List of EST Sequence Names From Normal Cartilage cDNA Library

| | | | | | | | | | |
|---|---|---|---|---|---|---|---|---|---|
| 9001 | ncrb4220 | 9061 | ncrb4315 | 9121 | ncrb4424 | 9181 | ncrb4503 | 9241 | ncrb4590 |
| 9002 | ncrb4221 | 9062 | ncrb4316 | 9122 | ncrb4427 | 9182 | ncrb4504 | 9242 | ncrb4591 |
| 9003 | ncrb4224 | 9063 | ncrb4317 | 9123 | ncrb4428 | 9183 | ncrb4505 | 9243 | ncrb4592 |
| 9004 | ncrb4226 | 9064 | ncrb4319 | 9124 | ncrb4429 | 9184 | ncrb4506 | 9244 | ncrb4593 |
| 9005 | ncrb4227 | 9065 | ncrb4320 | 9125 | ncrb4431 | 9185 | ncrb4507 | 9245 | ncrb4595 |
| 9006 | ncrb4228 | 9066 | ncrb4327 | 9126 | ncrb4432 | 9186 | ncrb4509 | 9246 | ncrb4596 |
| 9007 | ncrb4232 | 9067 | ncrb4328 | 9127 | ncrb4433 | 9187 | ncrb4511 | 9247 | ncrb4597 |
| 9008 | ncrb4234 | 9068 | ncrb4331 | 9128 | ncrb4435 | 9188 | ncrb4512 | 9248 | ncrb4598 |
| 9009 | ncrb4235 | 9069 | ncrb4335 | 9129 | ncrb4437 | 9189 | ncrb4515 | 9249 | ncrb4600 |
| 9010 | ncrb4237 | 9070 | ncrb4336 | 9130 | ncrb4439 | 9190 | ncrb4517 | 9250 | ncrb4601 |
| 9011 | ncrb4240 | 9071 | ncrb4337 | 9131 | ncrb4440 | 9191 | ncrb4520 | 9251 | ncrb4603 |
| 9012 | ncrb4243 | 9072 | ncrb4339 | 9132 | ncrb4441 | 9192 | ncrb4523 | 9252 | ncrb4605 |
| 9013 | ncrb4244 | 9073 | ncrb4340 | 9133 | ncrb4442 | 9193 | ncrb4525 | 9253 | ncrb4606 |
| 9014 | ncrb4245 | 9074 | ncrb4341 | 9134 | ncrb4443 | 9194 | ncrb4527 | 9254 | ncrb4607 |
| 9015 | ncrb4248 | 9075 | ncrb4343 | 9135 | ncrb4444 | 9195 | ncrb4528 | 9255 | ncrb4612 |
| 9016 | ncrb4249 | 9076 | ncrb4344 | 9136 | ncrb4445 | 9196 | ncrb4529 | 9256 | ncrb4613 |
| 9017 | ncrb4250 | 9077 | ncrb4347 | 9137 | ncrb4447 | 9197 | ncrb4531 | 9257 | ncrb4615 |
| 9018 | ncrb4251 | 9078 | ncrb4349 | 9138 | ncrb4448 | 9198 | ncrb4532 | 9258 | ncrb4617 |
| 9019 | ncrb4252 | 9079 | ncrb4351 | 9139 | ncrb4449 | 9199 | ncrb4535 | 9259 | ncrb4619 |
| 9020 | ncrb4253 | 9080 | ncrb4352 | 9140 | ncrb4451 | 9200 | ncrb4536 | 9260 | ncrb4620 |
| 9021 | ncrb4254 | 9081 | ncrb4353 | 9141 | ncrb4452 | 9201 | ncrb4537 | 9261 | ncrb4621 |
| 9022 | ncrb4255 | 9082 | ncrb4355 | 9142 | ncrb4453 | 9202 | ncrb4538 | 9262 | ncrb4622 |
| 9023 | ncrb4256 | 9083 | ncrb4356 | 9143 | ncrb4456 | 9203 | ncrb4539 | 9263 | ncrb4623 |
| 9024 | ncrb4259 | 9084 | ncrb4358 | 9144 | ncrb4458 | 9204 | ncrb4540 | 9264 | ncrb4627 |
| 9025 | ncrb4260 | 9085 | ncrb4359 | 9145 | ncrb4459 | 9205 | ncrb4541 | 9265 | ncrb4628 |
| 9026 | ncrb4261 | 9086 | ncrb4360 | 9146 | ncrb4460 | 9206 | ncrb4543 | 9266 | ncrb4629 |
| 9027 | ncrb4262 | 9087 | ncrb4362 | 9147 | ncrb4461 | 9207 | ncrb4544 | 9267 | ncrb4631 |
| 9028 | ncrb4264 | 9088 | ncrb4365 | 9148 | ncrb4464 | 9208 | ncrb4547 | 9268 | ncrb4632 |
| 9029 | ncrb4266 | 9089 | ncrb4367 | 9149 | ncrb4465 | 9209 | ncrb4548 | 9269 | ncrb4633 |
| 9030 | ncrb4267 | 9090 | ncrb4368 | 9150 | ncrb4466 | 9210 | ncrb4549 | 9270 | ncrb4634 |
| 9031 | ncrb4269 | 9091 | ncrb4370 | 9151 | ncrb4467 | 9211 | ncrb4551 | 9271 | ncrb4635 |
| 9032 | ncrb4271 | 9092 | ncrb4371 | 9152 | ncrb4468 | 9212 | ncrb4552 | 9272 | ncrb4636 |
| 9033 | ncrb4272 | 9093 | ncrb4373 | 9153 | ncrb4469 | 9213 | ncrb4554 | 9273 | ncrb4637 |
| 9034 | ncrb4273 | 9094 | ncrb4375 | 9154 | ncrb4470 | 9214 | ncrb4555 | 9274 | ncrb4639 |
| 9035 | ncrb4275 | 9095 | ncrb4376 | 9155 | ncrb4471 | 9215 | ncrb4556 | 9275 | ncrb4641 |
| 9036 | ncrb4278 | 9096 | ncrb4377 | 9156 | ncrb4472 | 9216 | ncrb4557 | 9276 | ncrb4643 |
| 9037 | ncrb4279 | 9097 | ncrb4378 | 9157 | ncrb4473 | 9217 | ncrb4559 | 9277 | ncrb4644 |
| 9038 | ncrb4280 | 9098 | ncrb4380 | 9158 | ncrb4474 | 9218 | ncrb4560 | 9278 | ncrb4645 |
| 9039 | ncrb4282 | 9099 | ncrb4383 | 9159 | ncrb4475 | 9219 | ncrb4561 | 9279 | ncrb4648 |
| 9040 | ncrb4283 | 9100 | ncrb4384 | 9160 | ncrb4476 | 9220 | ncrb4562 | 9280 | ncrb4650 |
| 9041 | ncrb4284 | 9101 | ncrb4385 | 9161 | ncrb4477 | 9221 | ncrb4563 | 9281 | ncrb4651 |
| 9042 | ncrb4285 | 9102 | ncrb4386 | 9162 | ncrb4478 | 9222 | ncrb4564 | 9282 | ncrb4652 |
| 9043 | ncrb4287 | 9103 | ncrb4390 | 9163 | ncrb4479 | 9223 | ncrb4565 | 9283 | ncrb4653 |
| 9044 | ncrb4288 | 9104 | ncrb4391 | 9164 | ncrb4480 | 9224 | ncrb4566 | 9284 | ncrb4656 |
| 9045 | ncrb4290 | 9105 | ncrb4392 | 9165 | ncrb4481 | 9225 | ncrb4567 | 9285 | ncrb4659 |
| 9046 | ncrb4291 | 9106 | ncrb4393 | 9166 | ncrb4482 | 9226 | ncrb4569 | 9286 | ncrb4660 |
| 9047 | ncrb4292 | 9107 | ncrb4395 | 9167 | ncrb4483 | 9227 | ncrb4570 | 9287 | ncrb4661 |
| 9048 | ncrb4293 | 9108 | ncrb4396 | 9168 | ncrb4484 | 9228 | ncrb4572 | 9288 | ncrb4662 |
| 9049 | ncrb4296 | 9109 | ncrb4398 | 9169 | ncrb4485 | 9229 | ncrb4573 | 9289 | ncrb4663 |
| 9050 | ncrb4297 | 9110 | ncrb4399 | 9170 | ncrb4486 | 9230 | ncrb4575 | 9290 | ncrb4667 |
| 9051 | ncrb4302 | 9111 | ncrb4402 | 9171 | ncrb4487 | 9231 | ncrb4576 | 9291 | ncrb4668 |
| 9052 | ncrb4303 | 9112 | ncrb4405 | 9172 | ncrb4488 | 9232 | ncrb4578 | 9292 | ncrb4669 |
| 9053 | ncrb4304 | 9113 | ncrb4406 | 9173 | ncrb4489 | 9233 | ncrb4579 | 9293 | ncrb4671 |
| 9054 | ncrb4305 | 9114 | ncrb4407 | 9174 | ncrb4490 | 9234 | ncrb4580 | 9294 | ncrb4672 |
| 9055 | ncrb4306 | 9115 | ncrb4408 | 9175 | ncrb4491 | 9235 | ncrb4581 | 9295 | ncrb4673 |
| 9056 | ncrb4308 | 9116 | ncrb4410 | 9176 | ncrb4493 | 9236 | ncrb4583 | 9296 | ncrb4675 |
| 9057 | ncrb4309 | 9117 | ncrb4414 | 9177 | ncrb4495 | 9237 | ncrb4584 | 9297 | ncrb4677 |
| 9058 | ncrb4310 | 9118 | ncrb4419 | 9178 | ncrb4496 | 9238 | ncrb4587 | 9298 | ncrb4678 |
| 9059 | ncrb4313 | 9119 | ncrb4421 | 9179 | ncrb4497 | 9239 | ncrb4588 | 9299 | ncrb4679 |
| 9060 | ncrb4314 | 9120 | ncrb4423 | 9180 | ncrb4502 | 9240 | ncrb4589 | 9300 | ncrb4680 |

Figure 6C – List of EST Sequence Names From Normal Cartilage cDNA Library

| | |
|---|---|
| 9301 | ncrb4681 |
| 9302 | ncrb4685 |
| 9303 | ncrb4687 |
| 9304 | ncrb4691 |
| 9305 | ncrb4693 |
| 9306 | ncrb4694 |
| 9307 | ncrb4695 |
| 9308 | ncrb4696 |
| 9309 | ncrb4697 |
| 9310 | ncrb4699 |
| 9311 | ncrb4700 |
| 9312 | ncrb4701 |
| 9313 | ncrb4703 |
| 9314 | ncrb4704 |
| 9315 | ncrb4707 |
| 9316 | ncrb4708 |
| 9317 | ncrb4709 |
| 9318 | ncrb4711 |
| 9319 | ncrb4713 |
| 9320 | ncrb4715 |
| 9321 | ncrb4717 |
| 9322 | ncrb4719 |
| 9323 | ncrb4720 |
| 9324 | ncrb4723 |
| 9325 | ncrb4724 |
| 9326 | ncrb4725 |
| 9327 | ncrb4729 |
| 9328 | ncrb4730 |
| 9329 | ncrb4731 |
| 9330 | ncrb4733 |
| 9331 | ncrb4736 |
| 9332 | ncrb4738 |
| 9333 | ncrb4741 |
| 9334 | ncrb4744 |
| 9335 | ncrb4747 |
| 9336 | ncrb4749 |
| 9337 | ncrb4751 |
| 9338 | ncrb4753 |
| 9339 | ncrb4754 |
| 9340 | ncrb4756 |
| 9341 | ncrb4757 |
| 9342 | ncrb4760 |
| 9343 | ncrb4761 |
| 9344 | ncrb4762 |
| 9345 | ncrb4763 |
| 9346 | ncrb4764 |
| 9347 | ncrb4766 |
| 9348 | ncrb4767 |
| 9349 | ncrb4768 |
| 9350 | ncrb4769 |
| 9351 | ncrb4771 |
| 9352 | ncrb4773 |
| 9353 | ncrb4776 |
| 9354 | ncrb4777 |
| 9355 | ncrb4778 |
| 9356 | ncrb4779 |
| 9357 | ncrb4780 |
| 9358 | ncrb4781 |
| 9359 | ncrb4782 |
| 9360 | ncrb4784 |
| 9361 | ncrb4789 |
| 9362 | ncrb4790 |
| 9363 | ncrb4792 |
| 9364 | ncrb4793 |
| 9365 | ncrb4794 |
| 9366 | ncrb4795 |
| 9367 | ncrb4796 |
| 9368 | ncrb4798 |
| 9369 | ncrb4799 |
| 9370 | ncrb4800 |
| 9371 | ncrb4803 |
| 9372 | ncrb4804 |
| 9373 | ncrb4805 |
| 9374 | ncrb4807 |
| 9375 | ncrb4808 |
| 9376 | ncrb4813 |
| 9377 | ncrb4816 |
| 9378 | ncrb4817 |
| 9379 | ncrb4819 |
| 9380 | ncrb4820 |
| 9381 | ncrb4821 |
| 9382 | ncrb4823 |
| 9383 | ncrb4825 |
| 9384 | ncrb4826 |
| 9385 | ncrb4829 |
| 9386 | ncrb4832 |
| 9387 | ncrb4835 |
| 9388 | ncrb4836 |
| 9389 | ncrb4839 |
| 9390 | ncrb4840 |
| 9391 | ncrb4843 |
| 9392 | ncrb4845 |
| 9393 | ncrb4847 |
| 9394 | ncrb4849 |
| 9395 | ncrb4850 |
| 9396 | ncrb4852 |
| 9397 | ncrb4853 |
| 9398 | ncrb4856 |
| 9399 | ncrb4857 |
| 9400 | ncrb4859 |
| 9401 | ncrb4861 |
| 9402 | ncrb4865 |
| 9403 | ncrb4866 |
| 9404 | ncrb4867 |
| 9405 | ncrb4869 |
| 9406 | ncrb4870 |
| 9407 | ncrb4871 |
| 9408 | ncrb4874 |
| 9409 | ncrb4875 |
| 9410 | ncrb4876 |
| 9411 | ncrb4877 |
| 9412 | ncrb4878 |
| 9413 | ncrb4879 |
| 9414 | ncrb4880 |
| 9415 | ncrb4881 |
| 9416 | ncrb4883 |
| 9417 | ncrb4885 |
| 9418 | ncrb4886 |
| 9419 | ncrb4887 |
| 9420 | ncrb4888 |
| 9421 | ncrb4889 |
| 9422 | ncrb4890 |
| 9423 | ncrb4891 |
| 9424 | ncrb4892 |
| 9425 | ncrb4893 |
| 9426 | ncrb4894 |
| 9427 | ncrb4899 |
| 9428 | ncrb4901 |
| 9429 | ncrb4903 |
| 9430 | ncrb4904 |
| 9431 | ncrb4905 |
| 9432 | ncrb4907 |
| 9433 | ncrb4908 |
| 9434 | ncrb4909 |
| 9435 | ncrb4911 |
| 9436 | ncrb4912 |
| 9437 | ncrb4916 |
| 9438 | ncrb4917 |
| 9439 | ncrb4918 |
| 9440 | ncrb4919 |
| 9441 | ncrb4920 |
| 9442 | ncrb4921 |
| 9443 | ncrb4923 |
| 9444 | ncrb4927 |
| 9445 | ncrb4929 |
| 9446 | ncrb4931 |
| 9447 | ncrb4932 |
| 9448 | ncrb4933 |
| 9449 | ncrb4934 |
| 9450 | ncrb4935 |
| 9451 | ncrb4936 |
| 9452 | ncrb4938 |
| 9453 | ncrb4939 |
| 9454 | ncrb4941 |
| 9455 | ncrb4943 |
| 9456 | ncrb4944 |
| 9457 | ncrb4945 |
| 9458 | ncrb4946 |
| 9459 | ncrb4948 |
| 9460 | ncrb4950 |
| 9461 | ncrb4951 |
| 9462 | ncrb4952 |
| 9463 | ncrb4953 |
| 9464 | ncrb4955 |
| 9465 | ncrb4957 |
| 9466 | ncrb4958 |
| 9467 | ncrb4960 |
| 9468 | ncrb4961 |
| 9469 | ncrb4962 |
| 9470 | ncrb4963 |
| 9471 | ncrb4965 |
| 9472 | ncrb4966 |
| 9473 | ncrb4969 |
| 9474 | ncrb4971 |
| 9475 | ncrb4972 |
| 9476 | ncrb4973 |
| 9477 | ncrb4975 |
| 9478 | ncrb4976 |
| 9479 | ncrb4977 |
| 9480 | ncrb4979 |
| 9481 | ncrb4980 |
| 9482 | ncrb4981 |
| 9483 | ncrb4982 |
| 9484 | ncrb4983 |
| 9485 | ncrb4984 |
| 9486 | ncrb4986 |
| 9487 | ncrb4987 |
| 9488 | ncrb4988 |
| 9489 | ncrb4989 |
| 9490 | ncrb4990 |
| 9491 | ncrb4991 |
| 9492 | ncrb4992 |
| 9493 | ncrb4995 |
| 9494 | ncrb4996 |
| 9495 | ncrb4997 |
| 9496 | ncrb4999 |
| 9497 | ncrb5000 |
| 9498 | ncrb5003 |
| 9499 | ncrb5004 |
| 9500 | ncrb5005 |
| 9501 | ncrb5006 |
| 9502 | ncrb5007 |
| 9503 | ncrb5008 |
| 9504 | ncrb5011 |
| 9505 | ncrb5013 |
| 9506 | ncrb5015 |
| 9507 | ncrb5016 |
| 9508 | ncrb5017 |
| 9509 | ncrb5018 |
| 9510 | ncrb5019 |
| 9511 | ncrb5020 |
| 9512 | ncrb5021 |
| 9513 | ncrb5023 |
| 9514 | ncrb5024 |
| 9515 | ncrb5027 |
| 9516 | ncrb5028 |
| 9517 | ncrb5030 |
| 9518 | ncrb5031 |
| 9519 | ncrb5032 |
| 9520 | ncrb5035 |
| 9521 | ncrb5036 |
| 9522 | ncrb5037 |
| 9523 | ncrb5039 |
| 9524 | ncrb5040 |
| 9525 | ncrb5042 |
| 9526 | ncrb5043 |
| 9527 | ncrb5044 |
| 9528 | ncrb5045 |
| 9529 | ncrb5046 |
| 9530 | ncrb5048 |
| 9531 | ncrb5049 |
| 9532 | ncrb5050 |
| 9533 | ncrb5051 |
| 9534 | ncrb5052 |
| 9535 | ncrb5053 |
| 9536 | ncrb5055 |
| 9537 | ncrb5058 |
| 9538 | ncrb5059 |
| 9539 | ncrb5060 |
| 9540 | ncrb5062 |
| 9541 | ncrb5063 |
| 9542 | ncrb5065 |
| 9543 | ncrb5067 |
| 9544 | ncrb5068 |
| 9545 | ncrb5069 |
| 9546 | ncrb5073 |
| 9547 | ncrb5075 |
| 9548 | ncrb5076 |
| 9549 | ncrb5077 |
| 9550 | ncrb5079 |
| 9551 | ncrb5080 |
| 9552 | ncrb5083 |
| 9553 | ncrb5084 |
| 9554 | ncrb5085 |
| 9555 | ncrb5086 |
| 9556 | ncrb5088 |
| 9557 | ncrb5090 |
| 9558 | ncrb5091 |
| 9559 | ncrb5092 |
| 9560 | ncrb5094 |
| 9561 | ncrb5095 |
| 9562 | ncrb5096 |
| 9563 | ncrb5099 |
| 9564 | ncrb5100 |
| 9565 | ncrb5103 |
| 9566 | ncrb5104 |
| 9567 | ncrb5105 |
| 9568 | ncrb5107 |
| 9569 | ncrb5108 |
| 9570 | ncrb5109 |
| 9571 | ncrb5111 |
| 9572 | ncrb5112 |
| 9573 | ncrb5113 |
| 9574 | ncrb5116 |
| 9575 | ncrb5117 |
| 9576 | ncrb5119 |
| 9577 | ncrb5121 |
| 9578 | ncrb5123 |
| 9579 | ncrb5124 |
| 9580 | ncrb5126 |
| 9581 | ncrb5128 |
| 9582 | ncrb5130 |
| 9583 | ncrb5131 |
| 9584 | ncrb5133 |
| 9585 | ncrb5135 |
| 9586 | ncrb5136 |
| 9587 | ncrb5139 |
| 9588 | ncrb5140 |
| 9589 | ncrb5141 |
| 9590 | ncrb5142 |
| 9591 | ncrb5143 |
| 9592 | ncrb5145 |
| 9593 | ncrb5146 |
| 9594 | ncrb5147 |
| 9595 | ncrb5148 |
| 9596 | ncrb5150 |
| 9597 | ncrb5151 |
| 9598 | ncrb5152 |
| 9599 | ncrb5153 |
| 9600 | ncrb5154 |

Figure 6C – List of EST Sequence Names From Normal Cartilage cDNA Library

| | | | | | | | | | |
|---|---|---|---|---|---|---|---|---|---|
| 9601 | ncrb5155 | 9661 | ncrb5241 | 9721 | ncrb5326 | 9781 | ncrb5427 | 9841 | ncrb5528 |
| 9602 | ncrb5156 | 9662 | ncrb5242 | 9722 | ncrb5327 | 9782 | ncrb5428 | 9842 | ncrb5530 |
| 9603 | ncrb5157 | 9663 | ncrb5243 | 9723 | ncrb5328 | 9783 | ncrb5430 | 9843 | ncrb5531 |
| 9604 | ncrb5158 | 9664 | ncrb5244 | 9724 | ncrb5329 | 9784 | ncrb5431 | 9844 | ncrb5532 |
| 9605 | ncrb5159 | 9665 | ncrb5245 | 9725 | ncrb5332 | 9785 | ncrb5432 | 9845 | ncrb5533 |
| 9606 | ncrb5160 | 9666 | ncrb5246 | 9726 | ncrb5333 | 9786 | ncrb5433 | 9846 | ncrb5534 |
| 9607 | ncrb5161 | 9667 | ncrb5247 | 9727 | ncrb5335 | 9787 | ncrb5434 | 9847 | ncrb5535 |
| 9608 | ncrb5162 | 9668 | ncrb5248 | 9728 | ncrb5336 | 9788 | ncrb5437 | 9848 | ncrb5536 |
| 9609 | ncrb5163 | 9669 | ncrb5249 | 9729 | ncrb5337 | 9789 | ncrb5438 | 9849 | ncrb5537 |
| 9610 | ncrb5164 | 9670 | ncrb5250 | 9730 | ncrb5339 | 9790 | ncrb5439 | 9850 | ncrb5539 |
| 9611 | ncrb5165 | 9671 | ncrb5251 | 9731 | ncrb5340 | 9791 | ncrb5443 | 9851 | ncrb5540 |
| 9612 | ncrb5166 | 9672 | ncrb5253 | 9732 | ncrb5341 | 9792 | ncrb5445 | 9852 | ncrb5543 |
| 9613 | ncrb5168 | 9673 | ncrb5254 | 9733 | ncrb5343 | 9793 | ncrb5446 | 9853 | ncrb5544 |
| 9614 | ncrb5169 | 9674 | ncrb5255 | 9734 | ncrb5344 | 9794 | ncrb5447 | 9854 | ncrb5545 |
| 9615 | ncrb5171 | 9675 | ncrb5257 | 9735 | ncrb5345 | 9795 | ncrb5448 | 9855 | ncrb5546 |
| 9616 | ncrb5172 | 9676 | ncrb5258 | 9736 | ncrb5350 | 9796 | ncrb5449 | 9856 | ncrb5547 |
| 9617 | ncrb5173 | 9677 | ncrb5259 | 9737 | ncrb5351 | 9797 | ncrb5450 | 9857 | ncrb5548 |
| 9618 | ncrb5174 | 9678 | ncrb5260 | 9738 | ncrb5353 | 9798 | ncrb5452 | 9858 | ncrb5549 |
| 9619 | ncrb5175 | 9679 | ncrb5263 | 9739 | ncrb5354 | 9799 | ncrb5455 | 9859 | ncrb5550 |
| 9620 | ncrb5176 | 9680 | ncrb5264 | 9740 | ncrb5355 | 9800 | ncrb5458 | 9860 | ncrb5551 |
| 9621 | ncrb5179 | 9681 | ncrb5265 | 9741 | ncrb5356 | 9801 | ncrb5459 | 9861 | ncrb5555 |
| 9622 | ncrb5180 | 9682 | ncrb5267 | 9742 | ncrb5358 | 9802 | ncrb5460 | 9862 | ncrb5556 |
| 9623 | ncrb5181 | 9683 | ncrb5268 | 9743 | ncrb5360 | 9803 | ncrb5467 | 9863 | ncrb5559 |
| 9624 | ncrb5182 | 9684 | ncrb5269 | 9744 | ncrb5361 | 9804 | ncrb5468 | 9864 | ncrb5560 |
| 9625 | ncrb5183 | 9685 | ncrb5270 | 9745 | ncrb5362 | 9805 | ncrb5469 | 9865 | ncrb5565 |
| 9626 | ncrb5185 | 9686 | ncrb5271 | 9746 | ncrb5363 | 9806 | ncrb5470 | 9866 | ncrb5566 |
| 9627 | ncrb5187 | 9687 | ncrb5272 | 9747 | ncrb5364 | 9807 | ncrb5471 | 9867 | ncrb5567 |
| 9628 | ncrb5189 | 9688 | ncrb5275 | 9748 | ncrb5368 | 9808 | ncrb5476 | 9868 | ncrb5569 |
| 9629 | ncrb5192 | 9689 | ncrb5276 | 9749 | ncrb5371 | 9809 | ncrb5477 | 9869 | ncrb5570 |
| 9630 | ncrb5193 | 9690 | ncrb5277 | 9750 | ncrb5373 | 9810 | ncrb5479 | 9870 | ncrb5571 |
| 9631 | ncrb5195 | 9691 | ncrb5279 | 9751 | ncrb5374 | 9811 | ncrb5480 | 9871 | ncrb5575 |
| 9632 | ncrb5196 | 9692 | ncrb5280 | 9752 | ncrb5375 | 9812 | ncrb5483 | 9872 | ncrb5576 |
| 9633 | ncrb5197 | 9693 | ncrb5281 | 9753 | ncrb5376 | 9813 | ncrb5484 | 9873 | ncrb5578 |
| 9634 | ncrb5199 | 9694 | ncrb5282 | 9754 | ncrb5377 | 9814 | ncrb5485 | 9874 | ncrb5579 |
| 9635 | ncrb5200 | 9695 | ncrb5283 | 9755 | ncrb5378 | 9815 | ncrb5486 | 9875 | ncrb5580 |
| 9636 | ncrb5201 | 9696 | ncrb5284 | 9756 | ncrb5379 | 9816 | ncrb5487 | 9876 | ncrb5583 |
| 9637 | ncrb5203 | 9697 | ncrb5288 | 9757 | ncrb5380 | 9817 | ncrb5488 | 9877 | ncrb5584 |
| 9638 | ncrb5204 | 9698 | ncrb5289 | 9758 | ncrb5384 | 9818 | ncrb5491 | 9878 | ncrb5585 |
| 9639 | ncrb5209 | 9699 | ncrb5291 | 9759 | ncrb5385 | 9819 | ncrb5493 | 9879 | ncrb5587 |
| 9640 | ncrb5210 | 9700 | ncrb5292 | 9760 | ncrb5388 | 9820 | ncrb5496 | 9880 | ncrb5588 |
| 9641 | ncrb5211 | 9701 | ncrb5295 | 9761 | ncrb5395 | 9821 | ncrb5497 | 9881 | ncrb5591 |
| 9642 | ncrb5213 | 9702 | ncrb5296 | 9762 | ncrb5396 | 9822 | ncrb5499 | 9882 | ncrb5593 |
| 9643 | ncrb5215 | 9703 | ncrb5297 | 9763 | ncrb5397 | 9823 | ncrb5500 | 9883 | ncrb5594 |
| 9644 | ncrb5216 | 9704 | ncrb5299 | 9764 | ncrb5399 | 9824 | ncrb5503 | 9884 | ncrb5595 |
| 9645 | ncrb5220 | 9705 | ncrb5300 | 9765 | ncrb5400 | 9825 | ncrb5504 | 9885 | ncrb5596 |
| 9646 | ncrb5222 | 9706 | ncrb5301 | 9766 | ncrb5401 | 9826 | ncrb5507 | 9886 | ncrb5597 |
| 9647 | ncrb5223 | 9707 | ncrb5303 | 9767 | ncrb5402 | 9827 | ncrb5508 | 9887 | ncrb5598 |
| 9648 | ncrb5224 | 9708 | ncrb5304 | 9768 | ncrb5403 | 9828 | ncrb5509 | 9888 | ncrb5599 |
| 9649 | ncrb5227 | 9709 | ncrb5305 | 9769 | ncrb5404 | 9829 | ncrb5510 | 9889 | ncrb5600 |
| 9650 | ncrb5228 | 9710 | ncrb5306 | 9770 | ncrb5407 | 9830 | ncrb5512 | 9890 | ncrb5601 |
| 9651 | ncrb5229 | 9711 | ncrb5307 | 9771 | ncrb5409 | 9831 | ncrb5514 | 9891 | ncrb5603 |
| 9652 | ncrb5231 | 9712 | ncrb5309 | 9772 | ncrb5411 | 9832 | ncrb5517 | 9892 | ncrb5605 |
| 9653 | ncrb5232 | 9713 | ncrb5311 | 9773 | ncrb5415 | 9833 | ncrb5519 | 9893 | ncrb5607 |
| 9654 | ncrb5233 | 9714 | ncrb5312 | 9774 | ncrb5416 | 9834 | ncrb5521 | 9894 | ncrb5608 |
| 9655 | ncrb5234 | 9715 | ncrb5315 | 9775 | ncrb5418 | 9835 | ncrb5522 | 9895 | ncrb5609 |
| 9656 | ncrb5235 | 9716 | ncrb5316 | 9776 | ncrb5420 | 9836 | ncrb5523 | 9896 | ncrb5610 |
| 9657 | ncrb5237 | 9717 | ncrb5319 | 9777 | ncrb5422 | 9837 | ncrb5524 | 9897 | ncrb5611 |
| 9658 | ncrb5238 | 9718 | ncrb5321 | 9778 | ncrb5423 | 9838 | ncrb5525 | 9898 | ncrb5612 |
| 9659 | ncrb5239 | 9719 | ncrb5322 | 9779 | ncrb5424 | 9839 | ncrb5526 | 9899 | ncrb5614 |
| 9660 | ncrb5240 | 9720 | ncrb5323 | 9780 | ncrb5425 | 9840 | ncrb5527 | 9900 | ncrb5615 |

Figure 6C – List of EST Sequence Names From Normal Cartilage cDNA Library

| | |
|---|---|
| 9901 | ncrb5616 |
| 9902 | ncrb5617 |
| 9903 | ncrb5619 |
| 9904 | ncrb5620 |
| 9905 | ncrb5622 |
| 9906 | ncrb5623 |
| 9907 | ncrb5624 |
| 9908 | ncrb5626 |
| 9909 | ncrb5628 |
| 9910 | ncrb5630 |
| 9911 | ncrb5631 |
| 9912 | ncrb5632 |
| 9913 | ncrb5633 |
| 9914 | ncrb5634 |
| 9915 | ncrb5635 |
| 9916 | ncrb5636 |
| 9917 | ncrb5637 |
| 9918 | ncrb5638 |
| 9919 | ncrb5639 |
| 9920 | ncrb5640 |
| 9921 | ncrb5641 |
| 9922 | ncrb5642 |
| 9923 | ncrb5643 |
| 9924 | ncrb5644 |
| 9925 | ncrb5645 |
| 9926 | ncrb5646 |
| 9927 | ncrb5649 |
| 9928 | ncrb5650 |
| 9929 | ncrb5651 |
| 9930 | ncrb5653 |
| 9931 | ncrb5656 |
| 9932 | ncrb5657 |
| 9933 | ncrb5659 |
| 9934 | ncrb5660 |
| 9935 | ncrb5662 |
| 9936 | ncrb5663 |
| 9937 | ncrb5665 |
| 9938 | ncrb5666 |
| 9939 | ncrb5667 |
| 9940 | ncrb5673 |
| 9941 | ncrb5674 |
| 9942 | ncrb5676 |
| 9943 | ncrb5679 |
| 9944 | ncrb5680 |
| 9945 | ncrb5681 |
| 9946 | ncrb5683 |
| 9947 | ncrb5684 |
| 9948 | ncrb5688 |
| 9949 | ncrb5689 |
| 9950 | ncrb5692 |
| 9951 | ncrb5693 |
| 9952 | ncrb5694 |
| 9953 | ncrb5695 |
| 9954 | ncrb5696 |
| 9955 | ncrb5697 |
| 9956 | ncrb5699 |
| 9957 | ncrb5700 |
| 9958 | ncrb5701 |
| 9959 | ncrb5702 |
| 9960 | ncrb5703 |
| 9961 | ncrb5704 |
| 9962 | ncrb5705 |
| 9963 | ncrb5706 |
| 9964 | ncrb5707 |
| 9965 | ncrb5708 |
| 9966 | ncrb5712 |
| 9967 | ncrb5715 |
| 9968 | ncrb5717 |
| 9969 | ncrb5718 |
| 9970 | ncrb5721 |
| 9971 | ncrb5722 |
| 9972 | ncrb5723 |
| 9973 | ncrb5724 |
| 9974 | ncrb5725 |
| 9975 | ncrb5726 |
| 9976 | ncrb5727 |
| 9977 | ncrb5730 |
| 9978 | ncrb5732 |
| 9979 | ncrb5733 |
| 9980 | ncrb5735 |
| 9981 | ncrb5736 |
| 9982 | ncrb5737 |
| 9983 | ncrb5738 |
| 9984 | ncrb5739 |
| 9985 | ncrb5741 |
| 9986 | ncrb5742 |
| 9987 | ncrb5743 |
| 9988 | ncrb5745 |
| 9989 | ncrb5746 |
| 9990 | ncrb5748 |
| 9991 | ncrb5749 |
| 9992 | ncrb5752 |
| 9993 | ncrb5753 |
| 9994 | ncrb5754 |
| 9995 | ncrb5755 |
| 9996 | ncrb5758 |
| 9997 | ncrb5759 |
| 9998 | ncrb5760 |
| 9999 | ncrb5762 |
| 10000 | ncrb5763 |
| 10001 | ncrb5764 |
| 10002 | ncrb5765 |
| 10003 | ncrb5766 |
| 10004 | ncrb5767 |
| 10005 | ncrb5774 |
| 10006 | ncrb5779 |
| 10007 | ncrb5780 |
| 10008 | ncrb5781 |
| 10009 | ncrb5783 |
| 10010 | ncrb5786 |
| 10011 | ncrb5788 |
| 10012 | ncrb5789 |
| 10013 | ncrb5790 |
| 10014 | ncrb5791 |
| 10015 | ncrb5792 |
| 10016 | ncrb5798 |
| 10017 | ncrb5799 |
| 10018 | ncrb5800 |
| 10019 | ncrb5802 |
| 10020 | ncrb5806 |
| 10021 | ncrb5807 |
| 10022 | ncrb5808 |
| 10023 | ncrb5811 |
| 10024 | ncrb5812 |
| 10025 | ncrb5813 |
| 10026 | ncrb5814 |
| 10027 | ncrb5815 |
| 10028 | ncrb5816 |
| 10029 | ncrb5818 |
| 10030 | ncrb5821 |
| 10031 | ncrb5822 |
| 10032 | ncrb5824 |
| 10033 | ncrb5826 |
| 10034 | ncrb5827 |
| 10035 | ncrb5828 |
| 10036 | ncrb5829 |
| 10037 | ncrb5830 |
| 10038 | ncrb5831 |
| 10039 | ncrb5832 |
| 10040 | ncrb5834 |
| 10041 | ncrb5835 |
| 10042 | ncrb5837 |
| 10043 | ncrb5839 |
| 10044 | ncrb5840 |
| 10045 | ncrb5842 |
| 10046 | ncrb5845 |
| 10047 | ncrb5847 |
| 10048 | ncrb5853 |
| 10049 | ncrb5856 |
| 10050 | ncrb5857 |
| 10051 | ncrb5858 |
| 10052 | ncrb5859 |
| 10053 | ncrb5863 |
| 10054 | ncrb5865 |
| 10055 | ncrb5866 |
| 10056 | ncrb5867 |
| 10057 | ncrb5868 |
| 10058 | ncrb5869 |
| 10059 | ncrb5870 |
| 10060 | ncrb5871 |
| 10061 | ncrb5872 |
| 10062 | ncrb5873 |
| 10063 | ncrb5874 |
| 10064 | ncrb5876 |
| 10065 | ncrb5877 |
| 10066 | ncrb5880 |
| 10067 | ncrb5881 |
| 10068 | ncrb5883 |
| 10069 | ncrb5884 |
| 10070 | ncrb5885 |
| 10071 | ncrb5888 |
| 10072 | ncrb5889 |
| 10073 | ncrb5891 |
| 10074 | ncrb5892 |
| 10075 | ncrb5895 |
| 10076 | ncrb5896 |
| 10077 | ncrb5899 |
| 10078 | ncrb5900 |
| 10079 | ncrb5902 |
| 10080 | ncrb5904 |
| 10081 | ncrb5905 |
| 10082 | ncrb5909 |
| 10083 | ncrb5911 |
| 10084 | ncrb5912 |
| 10085 | ncrb5913 |
| 10086 | ncrb5916 |
| 10087 | ncrb5917 |
| 10088 | ncrb5918 |
| 10089 | ncrb5919 |
| 10090 | ncrb5921 |
| 10091 | ncrb5922 |
| 10092 | ncrb5923 |
| 10093 | ncrb5924 |
| 10094 | ncrb5925 |
| 10095 | ncrb5929 |
| 10096 | ncrb5930 |
| 10097 | ncrb5931 |
| 10098 | ncrb5934 |
| 10099 | ncrb5936 |
| 10100 | ncrb5938 |
| 10101 | ncrb5939 |
| 10102 | ncrb5940 |
| 10103 | ncrb5941 |
| 10104 | ncrb5944 |
| 10105 | ncrb5945 |
| 10106 | ncrb5946 |
| 10107 | ncrb5947 |
| 10108 | ncrb5949 |
| 10109 | ncrb5950 |
| 10110 | ncrb5951 |
| 10111 | ncrb5952 |
| 10112 | ncrb5954 |
| 10113 | ncrb5955 |
| 10114 | ncrb5956 |
| 10115 | ncrb5959 |
| 10116 | ncrb5960 |
| 10117 | ncrb5961 |
| 10118 | ncrb5964 |
| 10119 | ncrb5965 |
| 10120 | ncrb5966 |
| 10121 | ncrb5967 |
| 10122 | ncrb5971 |
| 10123 | ncrb5972 |
| 10124 | ncrb5975 |
| 10125 | ncrb5976 |
| 10126 | ncrb5977 |
| 10127 | ncrb5978 |
| 10128 | ncrb5979 |
| 10129 | ncrb5980 |
| 10130 | ncrb5981 |
| 10131 | ncrb5982 |
| 10132 | ncrb5983 |
| 10133 | ncrb5984 |
| 10134 | ncrb5985 |
| 10135 | ncrb5987 |
| 10136 | ncrb5988 |
| 10137 | ncrb5989 |
| 10138 | ncrb5992 |
| 10139 | ncrb5994 |
| 10140 | ncrb5995 |
| 10141 | ncrb5996 |
| 10142 | ncrb5999 |
| 10143 | ncrb6003 |
| 10144 | ncrb6004 |
| 10145 | ncrb6006 |
| 10146 | ncrb6007 |
| 10147 | ncrb6009 |
| 10148 | ncrb6010 |
| 10149 | ncrb6011 |
| 10150 | ncrb6012 |
| 10151 | ncrb6013 |
| 10152 | ncrb6014 |
| 10153 | ncrb6016 |
| 10154 | ncrb6019 |
| 10155 | ncrb6021 |
| 10156 | ncrb6023 |
| 10157 | ncrb6024 |
| 10158 | ncrb6026 |
| 10159 | ncrb6028 |
| 10160 | ncrb6029 |
| 10161 | ncrb6030 |
| 10162 | ncrb6031 |
| 10163 | ncrb6032 |
| 10164 | ncrb6034 |
| 10165 | ncrb6036 |
| 10166 | ncrb6037 |
| 10167 | ncrb6039 |
| 10168 | ncrb6040 |
| 10169 | ncrb6041 |
| 10170 | ncrb6042 |
| 10171 | ncrb6043 |
| 10172 | ncrb6044 |
| 10173 | ncrb6045 |
| 10174 | ncrb6046 |
| 10175 | ncrb6048 |
| 10176 | ncrb6049 |
| 10177 | ncrb6050 |
| 10178 | ncrb6052 |
| 10179 | ncrb6056 |
| 10180 | ncrb6057 |
| 10181 | ncrb6059 |
| 10182 | ncrb6062 |
| 10183 | ncrb6064 |
| 10184 | ncrb6065 |
| 10185 | ncrb6067 |
| 10186 | ncrb6068 |
| 10187 | ncrb6069 |
| 10188 | ncrb6071 |
| 10189 | ncrb6072 |
| 10190 | ncrb6073 |
| 10191 | ncrb6074 |
| 10192 | ncrb6075 |
| 10193 | ncrb6076 |
| 10194 | ncrb6077 |
| 10195 | ncrb6079 |
| 10196 | ncrb6083 |
| 10197 | ncrb6084 |
| 10198 | ncrb6085 |
| 10199 | ncrb6087 |
| 10200 | ncrb6088 |

Figure 6C – List of EST Sequence Names From Normal Cartilage cDNA Library

| | | | | | | | | | |
|---|---|---|---|---|---|---|---|---|---|
| 10201 | ncrb6089 | 10261 | ncrb6177 | 10321 | ncrb6265 | 10381 | ncrb6360 | 10441 | ncrb6461 |
| 10202 | ncrb6090 | 10262 | ncrb6179 | 10322 | ncrb6266 | 10382 | ncrb6361 | 10442 | ncrb6462 |
| 10203 | ncrb6091 | 10263 | ncrb6180 | 10323 | ncrb6267 | 10383 | ncrb6362 | 10443 | ncrb6464 |
| 10204 | ncrb6092 | 10264 | ncrb6181 | 10324 | ncrb6268 | 10384 | ncrb6363 | 10444 | ncrb6465 |
| 10205 | ncrb6095 | 10265 | ncrb6183 | 10325 | ncrb6269 | 10385 | ncrb6365 | 10445 | ncrb6467 |
| 10206 | ncrb6096 | 10266 | ncrb6184 | 10326 | ncrb6270 | 10386 | ncrb6366 | 10446 | ncrb6468 |
| 10207 | ncrb6100 | 10267 | ncrb6185 | 10327 | ncrb6271 | 10387 | ncrb6367 | 10447 | ncrb6469 |
| 10208 | ncrb6101 | 10268 | ncrb6186 | 10328 | ncrb6272 | 10388 | ncrb6368 | 10448 | ncrb6471 |
| 10209 | ncrb6102 | 10269 | ncrb6187 | 10329 | ncrb6273 | 10389 | ncrb6369 | 10449 | ncrb6472 |
| 10210 | ncrb6103 | 10270 | ncrb6188 | 10330 | ncrb6275 | 10390 | ncrb6371 | 10450 | ncrb6473 |
| 10211 | ncrb6104 | 10271 | ncrb6190 | 10331 | ncrb6277 | 10391 | ncrb6372 | 10451 | ncrb6475 |
| 10212 | ncrb6106 | 10272 | ncrb6192 | 10332 | ncrb6279 | 10392 | ncrb6375 | 10452 | ncrb6476 |
| 10213 | ncrb6107 | 10273 | ncrb6193 | 10333 | ncrb6281 | 10393 | ncrb6377 | 10453 | ncrb6480 |
| 10214 | ncrb6108 | 10274 | ncrb6195 | 10334 | ncrb6282 | 10394 | ncrb6378 | 10454 | ncrb6481 |
| 10215 | ncrb6109 | 10275 | ncrb6196 | 10335 | ncrb6284 | 10395 | ncrb6383 | 10455 | ncrb6483 |
| 10216 | ncrb6111 | 10276 | ncrb6197 | 10336 | ncrb6287 | 10396 | ncrb6385 | 10456 | ncrb6484 |
| 10217 | ncrb6112 | 10277 | ncrb6202 | 10337 | ncrb6289 | 10397 | ncrb6387 | 10457 | ncrb6485 |
| 10218 | ncrb6115 | 10278 | ncrb6203 | 10338 | ncrb6291 | 10398 | ncrb6390 | 10458 | ncrb6486 |
| 10219 | ncrb6116 | 10279 | ncrb6204 | 10339 | ncrb6292 | 10399 | ncrb6391 | 10459 | ncrb6487 |
| 10220 | ncrb6117 | 10280 | ncrb6205 | 10340 | ncrb6294 | 10400 | ncrb6393 | 10460 | ncrb6489 |
| 10221 | ncrb6119 | 10281 | ncrb6206 | 10341 | ncrb6295 | 10401 | ncrb6394 | 10461 | ncrb6491 |
| 10222 | ncrb6120 | 10282 | ncrb6208 | 10342 | ncrb6296 | 10402 | ncrb6395 | 10462 | ncrb6493 |
| 10223 | ncrb6121 | 10283 | ncrb6209 | 10343 | ncrb6297 | 10403 | ncrb6396 | 10463 | ncrb6494 |
| 10224 | ncrb6122 | 10284 | ncrb6211 | 10344 | ncrb6298 | 10404 | ncrb6397 | 10464 | ncrb6496 |
| 10225 | ncrb6123 | 10285 | ncrb6212 | 10345 | ncrb6299 | 10405 | ncrb6398 | 10465 | ncrb6497 |
| 10226 | ncrb6124 | 10286 | ncrb6213 | 10346 | ncrb6300 | 10406 | ncrb6400 | 10466 | ncrb6500 |
| 10227 | ncrb6126 | 10287 | ncrb6214 | 10347 | ncrb6301 | 10407 | ncrb6401 | 10467 | ncrb6501 |
| 10228 | ncrb6127 | 10288 | ncrb6215 | 10348 | ncrb6302 | 10408 | ncrb6403 | 10468 | ncrb6502 |
| 10229 | ncrb6128 | 10289 | ncrb6216 | 10349 | ncrb6304 | 10409 | ncrb6404 | 10469 | ncrb6503 |
| 10230 | ncrb6130 | 10290 | ncrb6217 | 10350 | ncrb6306 | 10410 | ncrb6406 | 10470 | ncrb6504 |
| 10231 | ncrb6131 | 10291 | ncrb6218 | 10351 | ncrb6307 | 10411 | ncrb6408 | 10471 | ncrb6505 |
| 10232 | ncrb6135 | 10292 | ncrb6219 | 10352 | ncrb6308 | 10412 | ncrb6412 | 10472 | ncrb6506 |
| 10233 | ncrb6136 | 10293 | ncrb6220 | 10353 | ncrb6310 | 10413 | ncrb6413 | 10473 | ncrb6507 |
| 10234 | ncrb6138 | 10294 | ncrb6221 | 10354 | ncrb6313 | 10414 | ncrb6415 | 10474 | ncrb6508 |
| 10235 | ncrb6139 | 10295 | ncrb6222 | 10355 | ncrb6314 | 10415 | ncrb6417 | 10475 | ncrb6509 |
| 10236 | ncrb6140 | 10296 | ncrb6223 | 10356 | ncrb6315 | 10416 | ncrb6426 | 10476 | ncrb6511 |
| 10237 | ncrb6141 | 10297 | ncrb6224 | 10357 | ncrb6316 | 10417 | ncrb6427 | 10477 | ncrb6513 |
| 10238 | ncrb6142 | 10298 | ncrb6225 | 10358 | ncrb6317 | 10418 | ncrb6429 | 10478 | ncrb6514 |
| 10239 | ncrb6143 | 10299 | ncrb6226 | 10359 | ncrb6319 | 10419 | ncrb6431 | 10479 | ncrb6515 |
| 10240 | ncrb6144 | 10300 | ncrb6227 | 10360 | ncrb6320 | 10420 | ncrb6432 | 10480 | ncrb6517 |
| 10241 | ncrb6145 | 10301 | ncrb6228 | 10361 | ncrb6321 | 10421 | ncrb6433 | 10481 | ncrb6520 |
| 10242 | ncrb6146 | 10302 | ncrb6229 | 10362 | ncrb6323 | 10422 | ncrb6434 | 10482 | ncrb6521 |
| 10243 | ncrb6147 | 10303 | ncrb6232 | 10363 | ncrb6324 | 10423 | ncrb6435 | 10483 | ncrb6524 |
| 10244 | ncrb6148 | 10304 | ncrb6234 | 10364 | ncrb6325 | 10424 | ncrb6436 | 10484 | ncrb6526 |
| 10245 | ncrb6151 | 10305 | ncrb6236 | 10365 | ncrb6327 | 10425 | ncrb6439 | 10485 | ncrb6528 |
| 10246 | ncrb6153 | 10306 | ncrb6237 | 10366 | ncrb6328 | 10426 | ncrb6440 | 10486 | ncrb6530 |
| 10247 | ncrb6155 | 10307 | ncrb6238 | 10367 | ncrb6330 | 10427 | ncrb6441 | 10487 | ncrb6532 |
| 10248 | ncrb6157 | 10308 | ncrb6239 | 10368 | ncrb6331 | 10428 | ncrb6443 | 10488 | ncrb6535 |
| 10249 | ncrb6158 | 10309 | ncrb6241 | 10369 | ncrb6332 | 10429 | ncrb6444 | 10489 | ncrb6540 |
| 10250 | ncrb6159 | 10310 | ncrb6245 | 10370 | ncrb6333 | 10430 | ncrb6445 | 10490 | ncrb6542 |
| 10251 | ncrb6160 | 10311 | ncrb6248 | 10371 | ncrb6334 | 10431 | ncrb6446 | 10491 | ncrb6543 |
| 10252 | ncrb6163 | 10312 | ncrb6249 | 10372 | ncrb6335 | 10432 | ncrb6448 | 10492 | ncrb6545 |
| 10253 | ncrb6164 | 10313 | ncrb6251 | 10373 | ncrb6337 | 10433 | ncrb6449 | 10493 | ncrb6547 |
| 10254 | ncrb6167 | 10314 | ncrb6252 | 10374 | ncrb6338 | 10434 | ncrb6452 | 10494 | ncrb6548 |
| 10255 | ncrb6168 | 10315 | ncrb6254 | 10375 | ncrb6347 | 10435 | ncrb6453 | 10495 | ncrb6549 |
| 10256 | ncrb6169 | 10316 | ncrb6257 | 10376 | ncrb6350 | 10436 | ncrb6455 | 10496 | ncrb6551 |
| 10257 | ncrb6170 | 10317 | ncrb6259 | 10377 | ncrb6353 | 10437 | ncrb6456 | 10497 | ncrb6552 |
| 10258 | ncrb6172 | 10318 | ncrb6260 | 10378 | ncrb6355 | 10438 | ncrb6457 | 10498 | ncrb6553 |
| 10259 | ncrb6174 | 10319 | ncrb6261 | 10379 | ncrb6357 | 10439 | ncrb6459 | 10499 | ncrb6554 |
| 10260 | ncrb6176 | 10320 | ncrb6264 | 10380 | ncrb6359 | 10440 | ncrb6460 | 10500 | ncrb6555 |

Figure 6C – List of EST Sequence Names From Normal Cartilage cDNA Library

| | | | | | | | | | |
|---|---|---|---|---|---|---|---|---|---|
| 10501 | ncrb6557 | 10561 | ncrb6644 | 10621 | ncrb6744 | 10681 | ncrb6841 | 10741 | ncrb6929 |
| 10502 | ncrb6559 | 10562 | ncrb6647 | 10622 | ncrb6745 | 10682 | ncrb6842 | 10742 | ncrb6931 |
| 10503 | ncrb6560 | 10563 | ncrb6648 | 10623 | ncrb6746 | 10683 | ncrb6843 | 10743 | ncrb6932 |
| 10504 | ncrb6561 | 10564 | ncrb6650 | 10624 | ncrb6748 | 10684 | ncrb6844 | 10744 | ncrb6933 |
| 10505 | ncrb6563 | 10565 | ncrb6653 | 10625 | ncrb6749 | 10685 | ncrb6845 | 10745 | ncrb6935 |
| 10506 | ncrb6564 | 10566 | ncrb6654 | 10626 | ncrb6750 | 10686 | ncrb6846 | 10746 | ncrb6936 |
| 10507 | ncrb6565 | 10567 | ncrb6655 | 10627 | ncrb6755 | 10687 | ncrb6847 | 10747 | ncrb6937 |
| 10508 | ncrb6567 | 10568 | ncrb6656 | 10628 | ncrb6756 | 10688 | ncrb6848 | 10748 | ncrb6938 |
| 10509 | ncrb6568 | 10569 | ncrb6659 | 10629 | ncrb6757 | 10689 | ncrb6849 | 10749 | ncrb6939 |
| 10510 | ncrb6569 | 10570 | ncrb6661 | 10630 | ncrb6759 | 10690 | ncrb6851 | 10750 | ncrb6941 |
| 10511 | ncrb6571 | 10571 | ncrb6663 | 10631 | ncrb6761 | 10691 | ncrb6852 | 10751 | ncrb6942 |
| 10512 | ncrb6572 | 10572 | ncrb6670 | 10632 | ncrb6762 | 10692 | ncrb6853 | 10752 | ncrb6943 |
| 10513 | ncrb6574 | 10573 | ncrb6671 | 10633 | ncrb6763 | 10693 | ncrb6855 | 10753 | ncrb6944 |
| 10514 | ncrb6575 | 10574 | ncrb6672 | 10634 | ncrb6765 | 10694 | ncrb6856 | 10754 | ncrb6945 |
| 10515 | ncrb6576 | 10575 | ncrb6675 | 10635 | ncrb6766 | 10695 | ncrb6857 | 10755 | ncrb6948 |
| 10516 | ncrb6577 | 10576 | ncrb6676 | 10636 | ncrb6767 | 10696 | ncrb6858 | 10756 | ncrb6949 |
| 10517 | ncrb6579 | 10577 | ncrb6679 | 10637 | ncrb6768 | 10697 | ncrb6859 | 10757 | ncrb6953 |
| 10518 | ncrb6581 | 10578 | ncrb6680 | 10638 | ncrb6772 | 10698 | ncrb6860 | 10758 | ncrb6954 |
| 10519 | ncrb6582 | 10579 | ncrb6682 | 10639 | ncrb6773 | 10699 | ncrb6862 | 10759 | ncrb6955 |
| 10520 | ncrb6583 | 10580 | ncrb6683 | 10640 | ncrb6774 | 10700 | ncrb6863 | 10760 | ncrb6956 |
| 10521 | ncrb6584 | 10581 | ncrb6685 | 10641 | ncrb6775 | 10701 | ncrb6864 | 10761 | ncrb6958 |
| 10522 | ncrb6585 | 10582 | ncrb6686 | 10642 | ncrb6776 | 10702 | ncrb6865 | 10762 | ncrb6959 |
| 10523 | ncrb6586 | 10583 | ncrb6688 | 10643 | ncrb6777 | 10703 | ncrb6867 | 10763 | ncrb6960 |
| 10524 | ncrb6587 | 10584 | ncrb6689 | 10644 | ncrb6778 | 10704 | ncrb6869 | 10764 | ncrb6961 |
| 10525 | ncrb6588 | 10585 | ncrb6691 | 10645 | ncrb6779 | 10705 | ncrb6870 | 10765 | ncrb6963 |
| 10526 | ncrb6589 | 10586 | ncrb6693 | 10646 | ncrb6780 | 10706 | ncrb6871 | 10766 | ncrb6966 |
| 10527 | ncrb6590 | 10587 | ncrb6694 | 10647 | ncrb6782 | 10707 | ncrb6872 | 10767 | ncrb6967 |
| 10528 | ncrb6591 | 10588 | ncrb6695 | 10648 | ncrb6783 | 10708 | ncrb6875 | 10768 | ncrb6968 |
| 10529 | ncrb6592 | 10589 | ncrb6696 | 10649 | ncrb6785 | 10709 | ncrb6876 | 10769 | ncrb6969 |
| 10530 | ncrb6593 | 10590 | ncrb6697 | 10650 | ncrb6787 | 10710 | ncrb6877 | 10770 | ncrb6970 |
| 10531 | ncrb6596 | 10591 | ncrb6698 | 10651 | ncrb6788 | 10711 | ncrb6878 | 10771 | ncrb6971 |
| 10532 | ncrb6597 | 10592 | ncrb6699 | 10652 | ncrb6789 | 10712 | ncrb6880 | 10772 | ncrb6972 |
| 10533 | ncrb6598 | 10593 | ncrb6700 | 10653 | ncrb6791 | 10713 | ncrb6885 | 10773 | ncrb6974 |
| 10534 | ncrb6599 | 10594 | ncrb6701 | 10654 | ncrb6792 | 10714 | ncrb6886 | 10774 | ncrb6975 |
| 10535 | ncrb6600 | 10595 | ncrb6703 | 10655 | ncrb6793 | 10715 | ncrb6888 | 10775 | ncrb6976 |
| 10536 | ncrb6602 | 10596 | ncrb6704 | 10656 | ncrb6794 | 10716 | ncrb6889 | 10776 | ncrb6977 |
| 10537 | ncrb6603 | 10597 | ncrb6708 | 10657 | ncrb6796 | 10717 | ncrb6890 | 10777 | ncrb6979 |
| 10538 | ncrb6604 | 10598 | ncrb6714 | 10658 | ncrb6799 | 10718 | ncrb6892 | 10778 | ncrb6980 |
| 10539 | ncrb6605 | 10599 | ncrb6715 | 10659 | ncrb6800 | 10719 | ncrb6894 | 10779 | ncrb6981 |
| 10540 | ncrb6607 | 10600 | ncrb6716 | 10660 | ncrb6802 | 10720 | ncrb6895 | 10780 | ncrb6982 |
| 10541 | ncrb6609 | 10601 | ncrb6717 | 10661 | ncrb6804 | 10721 | ncrb6896 | 10781 | ncrb6984 |
| 10542 | ncrb6611 | 10602 | ncrb6718 | 10662 | ncrb6807 | 10722 | ncrb6897 | 10782 | ncrb6985 |
| 10543 | ncrb6612 | 10603 | ncrb6720 | 10663 | ncrb6808 | 10723 | ncrb6898 | 10783 | ncrb6986 |
| 10544 | ncrb6615 | 10604 | ncrb6721 | 10664 | ncrb6809 | 10724 | ncrb6899 | 10784 | ncrb6990 |
| 10545 | ncrb6616 | 10605 | ncrb6723 | 10665 | ncrb6810 | 10725 | ncrb6900 | 10785 | ncrb6991 |
| 10546 | ncrb6617 | 10606 | ncrb6724 | 10666 | ncrb6811 | 10726 | ncrb6901 | 10786 | ncrb6992 |
| 10547 | ncrb6618 | 10607 | ncrb6726 | 10667 | ncrb6812 | 10727 | ncrb6903 | 10787 | ncrb6994 |
| 10548 | ncrb6620 | 10608 | ncrb6727 | 10668 | ncrb6813 | 10728 | ncrb6904 | 10788 | ncrb6995 |
| 10549 | ncrb6621 | 10609 | ncrb6729 | 10669 | ncrb6814 | 10729 | ncrb6905 | 10789 | ncrb6996 |
| 10550 | ncrb6622 | 10610 | ncrb6730 | 10670 | ncrb6815 | 10730 | ncrb6906 | 10790 | ncrb6997 |
| 10551 | ncrb6624 | 10611 | ncrb6732 | 10671 | ncrb6816 | 10731 | ncrb6907 | 10791 | ncrb6999 |
| 10552 | ncrb6626 | 10612 | ncrb6733 | 10672 | ncrb6818 | 10732 | ncrb6910 | 10792 | ncrb7001 |
| 10553 | ncrb6628 | 10613 | ncrb6735 | 10673 | ncrb6820 | 10733 | ncrb6911 | 10793 | ncrb7003 |
| 10554 | ncrb6632 | 10614 | ncrb6736 | 10674 | ncrb6824 | 10734 | ncrb6912 | 10794 | ncrb7004 |
| 10555 | ncrb6635 | 10615 | ncrb6737 | 10675 | ncrb6825 | 10735 | ncrb6919 | 10795 | ncrb7005 |
| 10556 | ncrb6636 | 10616 | ncrb6739 | 10676 | ncrb6827 | 10736 | ncrb6922 | 10796 | ncrb7006 |
| 10557 | ncrb6637 | 10617 | ncrb6740 | 10677 | ncrb6832 | 10737 | ncrb6923 | 10797 | ncrb7007 |
| 10558 | ncrb6639 | 10618 | ncrb6741 | 10678 | ncrb6833 | 10738 | ncrb6924 | 10798 | ncrb7008 |
| 10559 | ncrb6640 | 10619 | ncrb6742 | 10679 | ncrb6836 | 10739 | ncrb6927 | 10799 | ncrb7012 |
| 10560 | ncrb6641 | 10620 | ncrb6743 | 10680 | ncrb6840 | 10740 | ncrb6928 | 10800 | ncrb7015 |

Figure 6C – List of EST Sequence Names From Normal Cartilage cDNA Library

| | | | | | | | | | |
|---|---|---|---|---|---|---|---|---|---|
| 10801 | ncrb7016 | 10861 | ncrb7107 | 10921 | ncrb7198 | 10981 | ncrb7284 | 11041 | ncrb7388 |
| 10802 | ncrb7019 | 10862 | ncrb7111 | 10922 | ncrb7199 | 10982 | ncrb7288 | 11042 | ncrb7389 |
| 10803 | ncrb7027 | 10863 | ncrb7112 | 10923 | ncrb7200 | 10983 | ncrb7289 | 11043 | ncrb7391 |
| 10804 | ncrb7028 | 10864 | ncrb7115 | 10924 | ncrb7201 | 10984 | ncrb7290 | 11044 | ncrb7393 |
| 10805 | ncrb7031 | 10865 | ncrb7116 | 10925 | ncrb7207 | 10985 | ncrb7292 | 11045 | ncrb7394 |
| 10806 | ncrb7032 | 10866 | ncrb7118 | 10926 | ncrb7208 | 10986 | ncrb7294 | 11046 | ncrb7396 |
| 10807 | ncrb7034 | 10867 | ncrb7119 | 10927 | ncrb7209 | 10987 | ncrb7295 | 11047 | ncrb7400 |
| 10808 | ncrb7035 | 10868 | ncrb7120 | 10928 | ncrb7210 | 10988 | ncrb7297 | 11048 | ncrb7401 |
| 10809 | ncrb7036 | 10869 | ncrb7123 | 10929 | ncrb7211 | 10989 | ncrb7298 | 11049 | ncrb7403 |
| 10810 | ncrb7037 | 10870 | ncrb7124 | 10930 | ncrb7212 | 10990 | ncrb7300 | 11050 | ncrb7406 |
| 10811 | ncrb7038 | 10871 | ncrb7125 | 10931 | ncrb7214 | 10991 | ncrb7302 | 11051 | ncrb7407 |
| 10812 | ncrb7039 | 10872 | ncrb7127 | 10932 | ncrb7215 | 10992 | ncrb7303 | 11052 | ncrb7408 |
| 10813 | ncrb7040 | 10873 | ncrb7128 | 10933 | ncrb7216 | 10993 | ncrb7304 | 11053 | ncrb7411 |
| 10814 | ncrb7041 | 10874 | ncrb7129 | 10934 | ncrb7217 | 10994 | ncrb7305 | 11054 | ncrb7413 |
| 10815 | ncrb7043 | 10875 | ncrb7132 | 10935 | ncrb7220 | 10995 | ncrb7313 | 11055 | ncrb7420 |
| 10816 | ncrb7044 | 10876 | ncrb7137 | 10936 | ncrb7221 | 10996 | ncrb7315 | 11056 | ncrb7421 |
| 10817 | ncrb7045 | 10877 | ncrb7140 | 10937 | ncrb7223 | 10997 | ncrb7316 | 11057 | ncrb7422 |
| 10818 | ncrb7048 | 10878 | ncrb7141 | 10938 | ncrb7224 | 10998 | ncrb7319 | 11058 | ncrb7423 |
| 10819 | ncrb7051 | 10879 | ncrb7144 | 10939 | ncrb7225 | 10999 | ncrb7323 | 11059 | ncrb7427 |
| 10820 | ncrb7052 | 10880 | ncrb7145 | 10940 | ncrb7226 | 11000 | ncrb7324 | 11060 | ncrb7428 |
| 10821 | ncrb7055 | 10881 | ncrb7146 | 10941 | ncrb7228 | 11001 | ncrb7328 | 11061 | ncrb7429 |
| 10822 | ncrb7056 | 10882 | ncrb7147 | 10942 | ncrb7230 | 11002 | ncrb7329 | 11062 | ncrb7433 |
| 10823 | ncrb7059 | 10883 | ncrb7150 | 10943 | ncrb7231 | 11003 | ncrb7331 | 11063 | ncrb7434 |
| 10824 | ncrb7061 | 10884 | ncrb7151 | 10944 | ncrb7232 | 11004 | ncrb7336 | 11064 | ncrb7435 |
| 10825 | ncrb7062 | 10885 | ncrb7152 | 10945 | ncrb7233 | 11005 | ncrb7338 | 11065 | ncrb7436 |
| 10826 | ncrb7063 | 10886 | ncrb7153 | 10946 | ncrb7235 | 11006 | ncrb7339 | 11066 | ncrb7438 |
| 10827 | ncrb7064 | 10887 | ncrb7155 | 10947 | ncrb7236 | 11007 | ncrb7340 | 11067 | ncrb7444 |
| 10828 | ncrb7065 | 10888 | ncrb7156 | 10948 | ncrb7237 | 11008 | ncrb7342 | 11068 | ncrb7445 |
| 10829 | ncrb7067 | 10889 | ncrb7158 | 10949 | ncrb7239 | 11009 | ncrb7343 | 11069 | ncrb7446 |
| 10830 | ncrb7068 | 10890 | ncrb7159 | 10950 | ncrb7240 | 11010 | ncrb7344 | 11070 | ncrb7447 |
| 10831 | ncrb7069 | 10891 | ncrb7160 | 10951 | ncrb7241 | 11011 | ncrb7345 | 11071 | ncrb7449 |
| 10832 | ncrb7070 | 10892 | ncrb7161 | 10952 | ncrb7242 | 11012 | ncrb7347 | 11072 | ncrb7450 |
| 10833 | ncrb7071 | 10893 | ncrb7162 | 10953 | ncrb7246 | 11013 | ncrb7348 | 11073 | ncrb7451 |
| 10834 | ncrb7072 | 10894 | ncrb7164 | 10954 | ncrb7247 | 11014 | ncrb7349 | 11074 | ncrb7452 |
| 10835 | ncrb7073 | 10895 | ncrb7165 | 10955 | ncrb7248 | 11015 | ncrb7350 | 11075 | ncrb7453 |
| 10836 | ncrb7075 | 10896 | ncrb7166 | 10956 | ncrb7249 | 11016 | ncrb7351 | 11076 | ncrb7454 |
| 10837 | ncrb7076 | 10897 | ncrb7167 | 10957 | ncrb7251 | 11017 | ncrb7353 | 11077 | ncrb7456 |
| 10838 | ncrb7077 | 10898 | ncrb7168 | 10958 | ncrb7252 | 11018 | ncrb7354 | 11078 | ncrb7459 |
| 10839 | ncrb7079 | 10899 | ncrb7169 | 10959 | ncrb7253 | 11019 | ncrb7355 | 11079 | ncrb7460 |
| 10840 | ncrb7080 | 10900 | ncrb7171 | 10960 | ncrb7254 | 11020 | ncrb7356 | 11080 | ncrb7463 |
| 10841 | ncrb7081 | 10901 | ncrb7172 | 10961 | ncrb7256 | 11021 | ncrb7357 | 11081 | ncrb7465 |
| 10842 | ncrb7082 | 10902 | ncrb7174 | 10962 | ncrb7257 | 11022 | ncrb7358 | 11082 | ncrb7466 |
| 10843 | ncrb7085 | 10903 | ncrb7176 | 10963 | ncrb7258 | 11023 | ncrb7359 | 11083 | ncrb7467 |
| 10844 | ncrb7086 | 10904 | ncrb7177 | 10964 | ncrb7259 | 11024 | ncrb7362 | 11084 | ncrb7469 |
| 10845 | ncrb7087 | 10905 | ncrb7179 | 10965 | ncrb7260 | 11025 | ncrb7363 | 11085 | ncrb7471 |
| 10846 | ncrb7088 | 10906 | ncrb7180 | 10966 | ncrb7262 | 11026 | ncrb7367 | 11086 | ncrb7473 |
| 10847 | ncrb7089 | 10907 | ncrb7181 | 10967 | ncrb7264 | 11027 | ncrb7369 | 11087 | ncrb7475 |
| 10848 | ncrb7092 | 10908 | ncrb7182 | 10968 | ncrb7266 | 11028 | ncrb7370 | 11088 | ncrb7476 |
| 10849 | ncrb7093 | 10909 | ncrb7184 | 10969 | ncrb7268 | 11029 | ncrb7371 | 11089 | ncrb7479 |
| 10850 | ncrb7095 | 10910 | ncrb7185 | 10970 | ncrb7269 | 11030 | ncrb7372 | 11090 | ncrb7480 |
| 10851 | ncrb7096 | 10911 | ncrb7187 | 10971 | ncrb7270 | 11031 | ncrb7373 | 11091 | ncrb7481 |
| 10852 | ncrb7097 | 10912 | ncrb7188 | 10972 | ncrb7273 | 11032 | ncrb7374 | 11092 | ncrb7482 |
| 10853 | ncrb7098 | 10913 | ncrb7189 | 10973 | ncrb7274 | 11033 | ncrb7375 | 11093 | ncrb7483 |
| 10854 | ncrb7099 | 10914 | ncrb7191 | 10974 | ncrb7275 | 11034 | ncrb7376 | 11094 | ncrb7490 |
| 10855 | ncrb7100 | 10915 | ncrb7192 | 10975 | ncrb7276 | 11035 | ncrb7377 | 11095 | ncrb7491 |
| 10856 | ncrb7102 | 10916 | ncrb7193 | 10976 | ncrb7277 | 11036 | ncrb7378 | 11096 | ncrb7494 |
| 10857 | ncrb7103 | 10917 | ncrb7194 | 10977 | ncrb7278 | 11037 | ncrb7379 | 11097 | ncrb7495 |
| 10858 | ncrb7104 | 10918 | ncrb7195 | 10978 | ncrb7279 | 11038 | ncrb7383 | 11098 | ncrb7497 |
| 10859 | ncrb7105 | 10919 | ncrb7196 | 10979 | ncrb7281 | 11039 | ncrb7386 | 11099 | ncrb7502 |
| 10860 | ncrb7106 | 10920 | ncrb7197 | 10980 | ncrb7282 | 11040 | ncrb7387 | 11100 | ncrb7504 |

Figure 6C – List of EST Sequence Names From Normal Cartilage cDNA Library

| | | | | | | | | | |
|---|---|---|---|---|---|---|---|---|---|
| 11101 | ncrb7505 | 11161 | ncrb7601 | 11221 | ncrb7694 | 11281 | ncrb7799 | 11341 | ncrb7888 |
| 11102 | ncrb7507 | 11162 | ncrb7604 | 11222 | ncrb7695 | 11282 | ncrb7800 | 11342 | ncrb7889 |
| 11103 | ncrb7508 | 11163 | ncrb7605 | 11223 | ncrb7696 | 11283 | ncrb7801 | 11343 | ncrb7891 |
| 11104 | ncrb7509 | 11164 | ncrb7609 | 11224 | ncrb7699 | 11284 | ncrb7802 | 11344 | ncrb7892 |
| 11105 | ncrb7511 | 11165 | ncrb7610 | 11225 | ncrb7703 | 11285 | ncrb7803 | 11345 | ncrb7895 |
| 11106 | ncrb7512 | 11166 | ncrb7611 | 11226 | ncrb7704 | 11286 | ncrb7804 | 11346 | ncrb7897 |
| 11107 | ncrb7514 | 11167 | ncrb7612 | 11227 | ncrb7706 | 11287 | ncrb7805 | 11347 | ncrb7898 |
| 11108 | ncrb7515 | 11168 | ncrb7613 | 11228 | ncrb7711 | 11288 | ncrb7806 | 11348 | ncrb7899 |
| 11109 | ncrb7516 | 11169 | ncrb7614 | 11229 | ncrb7713 | 11289 | ncrb7811 | 11349 | ncrb7900 |
| 11110 | ncrb7519 | 11170 | ncrb7615 | 11230 | ncrb7715 | 11290 | ncrb7812 | 11350 | ncrb7902 |
| 11111 | ncrb7520 | 11171 | ncrb7616 | 11231 | ncrb7716 | 11291 | ncrb7813 | 11351 | ncrb7903 |
| 11112 | ncrb7523 | 11172 | ncrb7617 | 11232 | ncrb7717 | 11292 | ncrb7816 | 11352 | ncrb7905 |
| 11113 | ncrb7524 | 11173 | ncrb7619 | 11233 | ncrb7719 | 11293 | ncrb7818 | 11353 | ncrb7911 |
| 11114 | ncrb7525 | 11174 | ncrb7620 | 11234 | ncrb7721 | 11294 | ncrb7819 | 11354 | ncrb7912 |
| 11115 | ncrb7527 | 11175 | ncrb7621 | 11235 | ncrb7726 | 11295 | ncrb7820 | 11355 | ncrb7914 |
| 11116 | ncrb7528 | 11176 | ncrb7623 | 11236 | ncrb7727 | 11296 | ncrb7821 | 11356 | ncrb7915 |
| 11117 | ncrb7529 | 11177 | ncrb7624 | 11237 | ncrb7728 | 11297 | ncrb7822 | 11357 | ncrb7916 |
| 11118 | ncrb7531 | 11178 | ncrb7625 | 11238 | ncrb7729 | 11298 | ncrb7823 | 11358 | ncrb7918 |
| 11119 | ncrb7532 | 11179 | ncrb7626 | 11239 | ncrb7732 | 11299 | ncrb7824 | 11359 | ncrb7919 |
| 11120 | ncrb7534 | 11180 | ncrb7628 | 11240 | ncrb7737 | 11300 | ncrb7825 | 11360 | ncrb7920 |
| 11121 | ncrb7535 | 11181 | ncrb7630 | 11241 | ncrb7738 | 11301 | ncrb7827 | 11361 | ncrb7921 |
| 11122 | ncrb7536 | 11182 | ncrb7632 | 11242 | ncrb7740 | 11302 | ncrb7828 | 11362 | ncrb7924 |
| 11123 | ncrb7539 | 11183 | ncrb7633 | 11243 | ncrb7745 | 11303 | ncrb7829 | 11363 | ncrb7925 |
| 11124 | ncrb7542 | 11184 | ncrb7635 | 11244 | ncrb7746 | 11304 | ncrb7830 | 11364 | ncrb7928 |
| 11125 | ncrb7543 | 11185 | ncrb7638 | 11245 | ncrb7747 | 11305 | ncrb7834 | 11365 | ncrb7929 |
| 11126 | ncrb7544 | 11186 | ncrb7639 | 11246 | ncrb7748 | 11306 | ncrb7836 | 11366 | ncrb7930 |
| 11127 | ncrb7545 | 11187 | ncrb7640 | 11247 | ncrb7749 | 11307 | ncrb7839 | 11367 | ncrb7931 |
| 11128 | ncrb7547 | 11188 | ncrb7642 | 11248 | ncrb7750 | 11308 | ncrb7840 | 11368 | ncrb7932 |
| 11129 | ncrb7548 | 11189 | ncrb7643 | 11249 | ncrb7752 | 11309 | ncrb7841 | 11369 | ncrb7933 |
| 11130 | ncrb7549 | 11190 | ncrb7644 | 11250 | ncrb7753 | 11310 | ncrb7842 | 11370 | ncrb7934 |
| 11131 | ncrb7551 | 11191 | ncrb7647 | 11251 | ncrb7754 | 11311 | ncrb7843 | 11371 | ncrb7936 |
| 11132 | ncrb7552 | 11192 | ncrb7651 | 11252 | ncrb7755 | 11312 | ncrb7844 | 11372 | ncrb7937 |
| 11133 | ncrb7553 | 11193 | ncrb7652 | 11253 | ncrb7756 | 11313 | ncrb7845 | 11373 | ncrb7939 |
| 11134 | ncrb7555 | 11194 | ncrb7654 | 11254 | ncrb7757 | 11314 | ncrb7847 | 11374 | ncrb7940 |
| 11135 | ncrb7556 | 11195 | ncrb7655 | 11255 | ncrb7758 | 11315 | ncrb7848 | 11375 | ncrb7941 |
| 11136 | ncrb7557 | 11196 | ncrb7656 | 11256 | ncrb7759 | 11316 | ncrb7850 | 11376 | ncrb7943 |
| 11137 | ncrb7558 | 11197 | ncrb7657 | 11257 | ncrb7762 | 11317 | ncrb7852 | 11377 | ncrb7944 |
| 11138 | ncrb7560 | 11198 | ncrb7658 | 11258 | ncrb7763 | 11318 | ncrb7854 | 11378 | ncrb7945 |
| 11139 | ncrb7561 | 11199 | ncrb7659 | 11259 | ncrb7767 | 11319 | ncrb7855 | 11379 | ncrb7946 |
| 11140 | ncrb7563 | 11200 | ncrb7660 | 11260 | ncrb7768 | 11320 | ncrb7856 | 11380 | ncrb7947 |
| 11141 | ncrb7564 | 11201 | ncrb7663 | 11261 | ncrb7769 | 11321 | ncrb7858 | 11381 | ncrb7948 |
| 11142 | ncrb7565 | 11202 | ncrb7665 | 11262 | ncrb7770 | 11322 | ncrb7859 | 11382 | ncrb7949 |
| 11143 | ncrb7567 | 11203 | ncrb7667 | 11263 | ncrb7771 | 11323 | ncrb7860 | 11383 | ncrb7950 |
| 11144 | ncrb7568 | 11204 | ncrb7668 | 11264 | ncrb7772 | 11324 | ncrb7861 | 11384 | ncrb7951 |
| 11145 | ncrb7569 | 11205 | ncrb7669 | 11265 | ncrb7773 | 11325 | ncrb7864 | 11385 | ncrb7952 |
| 11146 | ncrb7571 | 11206 | ncrb7671 | 11266 | ncrb7774 | 11326 | ncrb7865 | 11386 | ncrb7953 |
| 11147 | ncrb7572 | 11207 | ncrb7672 | 11267 | ncrb7775 | 11327 | ncrb7866 | 11387 | ncrb7954 |
| 11148 | ncrb7573 | 11208 | ncrb7674 | 11268 | ncrb7776 | 11328 | ncrb7867 | 11388 | ncrb7955 |
| 11149 | ncrb7576 | 11209 | ncrb7675 | 11269 | ncrb7777 | 11329 | ncrb7869 | 11389 | ncrb7956 |
| 11150 | ncrb7578 | 11210 | ncrb7676 | 11270 | ncrb7779 | 11330 | ncrb7871 | 11390 | ncrb7959 |
| 11151 | ncrb7580 | 11211 | ncrb7677 | 11271 | ncrb7780 | 11331 | ncrb7872 | 11391 | ncrb7960 |
| 11152 | ncrb7582 | 11212 | ncrb7678 | 11272 | ncrb7783 | 11332 | ncrb7873 | 11392 | ncrb7961 |
| 11153 | ncrb7583 | 11213 | ncrb7679 | 11273 | ncrb7784 | 11333 | ncrb7874 | 11393 | ncrb7962 |
| 11154 | ncrb7584 | 11214 | ncrb7680 | 11274 | ncrb7787 | 11334 | ncrb7877 | 11394 | ncrb7964 |
| 11155 | ncrb7585 | 11215 | ncrb7683 | 11275 | ncrb7788 | 11335 | ncrb7879 | 11395 | ncrb7965 |
| 11156 | ncrb7586 | 11216 | ncrb7684 | 11276 | ncrb7792 | 11336 | ncrb7880 | 11396 | ncrb7966 |
| 11157 | ncrb7587 | 11217 | ncrb7686 | 11277 | ncrb7793 | 11337 | ncrb7882 | 11397 | ncrb7967 |
| 11158 | ncrb7591 | 11218 | ncrb7687 | 11278 | ncrb7795 | 11338 | ncrb7884 | 11398 | ncrb7968 |
| 11159 | ncrb7599 | 11219 | ncrb7690 | 11279 | ncrb7796 | 11339 | ncrb7886 | 11399 | ncrb7969 |
| 11160 | ncrb7600 | 11220 | ncrb7692 | 11280 | ncrb7797 | 11340 | ncrb7887 | 11400 | ncrb7970 |

Figure 6C – List of EST Sequence Names From Normal Cartilage cDNA Library

| | |
|---|---|
| 11401 | ncrb7971 |
| 11402 | ncrb7972 |
| 11403 | ncrb7975 |
| 11404 | ncrb7977 |
| 11405 | ncrb7978 |
| 11406 | ncrb7980 |
| 11407 | ncrb7982 |
| 11408 | ncrb7983 |
| 11409 | ncrb7985 |
| 11410 | ncrb7987 |
| 11411 | ncrb7989 |
| 11412 | ncrb7991 |
| 11413 | ncrb7993 |
| 11414 | ncrb7994 |
| 11415 | ncrb7995 |
| 11416 | ncrb7998 |
| 11417 | ncrb8000 |
| 11418 | ncrb8001 |
| 11419 | ncrb8003 |
| 11420 | ncrb8004 |
| 11421 | ncrb8005 |
| 11422 | ncrb8007 |
| 11423 | ncrb8008 |
| 11424 | ncrb8010 |
| 11425 | ncrb8012 |
| 11426 | ncrb8015 |
| 11427 | ncrb8016 |
| 11428 | ncrb8017 |
| 11429 | ncrb8019 |
| 11430 | ncrb8021 |
| 11431 | ncrb8024 |
| 11432 | ncrb8025 |
| 11433 | ncrb8026 |
| 11434 | ncrb8027 |
| 11435 | ncrb8028 |
| 11436 | ncrb8031 |
| 11437 | ncrb8032 |
| 11438 | ncrb8034 |
| 11439 | ncrb8035 |
| 11440 | ncrb8039 |
| 11441 | ncrb8040 |
| 11442 | ncrb8042 |
| 11443 | ncrb8043 |
| 11444 | ncrb8044 |
| 11445 | ncrb8046 |
| 11446 | ncrb8047 |
| 11447 | ncrb8048 |
| 11448 | ncrb8050 |
| 11449 | ncrb8051 |
| 11450 | ncrb8052 |
| 11451 | ncrb8053 |
| 11452 | ncrb8056 |
| 11453 | ncrb8059 |
| 11454 | ncrb8060 |
| 11455 | ncrb8062 |
| 11456 | ncrb8063 |
| 11457 | ncrb8064 |
| 11458 | ncrb8065 |
| 11459 | ncrb8066 |
| 11460 | ncrb8067 |
| 11461 | ncrb8071 |
| 11462 | ncrb8072 |
| 11463 | ncrb8075 |
| 11464 | ncrb8076 |
| 11465 | ncrb8079 |
| 11466 | ncrb8080 |
| 11467 | ncrb8083 |
| 11468 | ncrb8084 |
| 11469 | ncrb8085 |
| 11470 | ncrb8087 |
| 11471 | ncrb8088 |
| 11472 | ncrb8090 |
| 11473 | ncrb8091 |
| 11474 | ncrb8093 |
| 11475 | ncrb8094 |
| 11476 | ncrb8095 |
| 11477 | ncrb8097 |
| 11478 | ncrb8099 |
| 11479 | ncrb8101 |
| 11480 | ncrb8102 |
| 11481 | ncrb8103 |
| 11482 | ncrb8104 |
| 11483 | ncrb8105 |
| 11484 | ncrb8106 |
| 11485 | ncrb8107 |
| 11486 | ncrb8108 |
| 11487 | ncrb8110 |
| 11488 | ncrb8111 |
| 11489 | ncrb8112 |
| 11490 | ncrb8113 |
| 11491 | ncrb8116 |
| 11492 | ncrb8117 |
| 11493 | ncrb8120 |
| 11494 | ncrb8121 |
| 11495 | ncrb8122 |
| 11496 | ncrb8123 |
| 11497 | ncrb8124 |
| 11498 | ncrb8125 |
| 11499 | ncrb8128 |
| 11500 | ncrb8131 |
| 11501 | ncrb8132 |
| 11502 | ncrb8133 |
| 11503 | ncrb8134 |
| 11504 | ncrb8136 |
| 11505 | ncrb8137 |
| 11506 | ncrb8138 |
| 11507 | ncrb8139 |
| 11508 | ncrb8140 |
| 11509 | ncrb8141 |
| 11510 | ncrb8142 |
| 11511 | ncrb8143 |
| 11512 | ncrb8144 |
| 11513 | ncrb8145 |
| 11514 | ncrb8147 |
| 11515 | ncrb8149 |
| 11516 | ncrb8152 |
| 11517 | ncrb8153 |
| 11518 | ncrb8154 |
| 11519 | ncrb8156 |
| 11520 | ncrb8157 |
| 11521 | ncrb8159 |
| 11522 | ncrb8160 |
| 11523 | ncrb8164 |
| 11524 | ncrb8166 |
| 11525 | ncrb8167 |
| 11526 | ncrb8168 |
| 11527 | ncrb8171 |
| 11528 | ncrb8172 |
| 11529 | ncrb8176 |
| 11530 | ncrb8177 |
| 11531 | ncrb8180 |
| 11532 | ncrb8183 |
| 11533 | ncrb8185 |
| 11534 | ncrb8186 |
| 11535 | ncrb8188 |
| 11536 | ncrb8189 |
| 11537 | ncrb8190 |
| 11538 | ncrb8191 |
| 11539 | ncrb8192 |
| 11540 | ncrb8193 |
| 11541 | ncrb8197 |
| 11542 | ncrb8200 |
| 11543 | ncrb8201 |
| 11544 | ncrb8202 |
| 11545 | ncrb8203 |
| 11546 | ncrb8204 |
| 11547 | ncrb8206 |
| 11548 | ncrb8207 |
| 11549 | ncrb8208 |
| 11550 | ncrb8214 |
| 11551 | ncrb8215 |
| 11552 | ncrb8217 |
| 11553 | ncrb8219 |
| 11554 | ncrb8220 |
| 11555 | ncrb8221 |
| 11556 | ncrb8222 |
| 11557 | ncrb8223 |
| 11558 | ncrb8224 |
| 11559 | ncrb8225 |
| 11560 | ncrb8228 |
| 11561 | ncrb8229 |
| 11562 | ncrb8230 |
| 11563 | ncrb8231 |
| 11564 | ncrb8234 |
| 11565 | ncrb8237 |
| 11566 | ncrb8238 |
| 11567 | ncrb8239 |
| 11568 | ncrb8240 |
| 11569 | ncrb8242 |
| 11570 | ncrb8243 |
| 11571 | ncrb8245 |
| 11572 | ncrb8247 |
| 11573 | ncrb8248 |
| 11574 | ncrb8249 |
| 11575 | ncrb8250 |
| 11576 | ncrb8251 |
| 11577 | ncrb8252 |
| 11578 | ncrb8253 |
| 11579 | ncrb8254 |
| 11580 | ncrb8255 |
| 11581 | ncrb8256 |
| 11582 | ncrb8258 |
| 11583 | ncrb8259 |
| 11584 | ncrb8260 |
| 11585 | ncrb8264 |
| 11586 | ncrb8265 |
| 11587 | ncrb8267 |
| 11588 | ncrb8268 |
| 11589 | ncrb8269 |
| 11590 | ncrb8271 |
| 11591 | ncrb8272 |
| 11592 | ncrb8273 |
| 11593 | ncrb8275 |
| 11594 | ncrb8276 |
| 11595 | ncrb8277 |
| 11596 | ncrb8279 |
| 11597 | ncrb8280 |
| 11598 | ncrb8281 |
| 11599 | ncrb8282 |
| 11600 | ncrb8284 |
| 11601 | ncrb8285 |
| 11602 | ncrb8286 |
| 11603 | ncrb8288 |
| 11604 | ncrb8289 |
| 11605 | ncrb8291 |
| 11606 | ncrb8292 |
| 11607 | ncrb8293 |
| 11608 | ncrb8295 |
| 11609 | ncrb8296 |
| 11610 | ncrb8297 |
| 11611 | ncrb8300 |
| 11612 | ncrb8302 |
| 11613 | ncrb8303 |
| 11614 | ncrb8304 |
| 11615 | ncrb8307 |
| 11616 | ncrb8308 |
| 11617 | ncrb8310 |
| 11618 | ncrb8311 |
| 11619 | ncrb8313 |
| 11620 | ncrb8314 |
| 11621 | ncrb8315 |
| 11622 | ncrb8316 |
| 11623 | ncrb8317 |
| 11624 | ncrb8318 |
| 11625 | ncrb8319 |
| 11626 | ncrb8320 |
| 11627 | ncrb8321 |
| 11628 | ncrb8322 |
| 11629 | ncrb8323 |
| 11630 | ncrb8324 |
| 11631 | ncrb8325 |
| 11632 | ncrb8326 |
| 11633 | ncrb8327 |
| 11634 | ncrb8328 |
| 11635 | ncrb8329 |
| 11636 | ncrb8330 |
| 11637 | ncrb8331 |
| 11638 | ncrb8332 |
| 11639 | ncrb8333 |
| 11640 | ncrb8334 |
| 11641 | ncrb8335 |
| 11642 | ncrb8336 |
| 11643 | ncrb8337 |
| 11644 | ncrb8338 |
| 11645 | ncrb8339 |
| 11646 | ncrb8343 |
| 11647 | ncrb8344 |
| 11648 | ncrb8345 |
| 11649 | ncrb8346 |
| 11650 | ncrb8347 |
| 11651 | ncrb8351 |
| 11652 | ncrb8352 |
| 11653 | ncrb8355 |
| 11654 | ncrb8356 |
| 11655 | ncrb8359 |
| 11656 | ncrb8360 |
| 11657 | ncrb8364 |
| 11658 | ncrb8366 |
| 11659 | ncrb8367 |
| 11660 | ncrb8368 |
| 11661 | ncrb8369 |
| 11662 | ncrb8371 |
| 11663 | ncrb8372 |
| 11664 | ncrb8375 |
| 11665 | ncrb8376 |
| 11666 | ncrb8377 |
| 11667 | ncrb8378 |
| 11668 | ncrb8379 |
| 11669 | ncrb8380 |
| 11670 | ncrb8382 |
| 11671 | ncrb8383 |
| 11672 | ncrb8384 |
| 11673 | ncrb8385 |
| 11674 | ncrb8388 |
| 11675 | ncrb8389 |
| 11676 | ncrb8391 |
| 11677 | ncrb8392 |
| 11678 | ncrb8393 |
| 11679 | ncrb8395 |
| 11680 | ncrb8396 |
| 11681 | ncrb8398 |
| 11682 | ncrb8400 |
| 11683 | ncrb8401 |
| 11684 | ncrb8403 |
| 11685 | ncrb8404 |
| 11686 | ncrb8405 |
| 11687 | ncrb8407 |
| 11688 | ncrb8408 |
| 11689 | ncrb8409 |
| 11690 | ncrb8410 |
| 11691 | ncrb8411 |
| 11692 | ncrb8412 |
| 11693 | ncrb8414 |
| 11694 | ncrb8415 |
| 11695 | ncrb8416 |
| 11696 | ncrb8417 |
| 11697 | ncrb8419 |
| 11698 | ncrb8420 |
| 11699 | ncrb8421 |
| 11700 | ncrb8422 |

Figure 6C – List of EST Sequence Names From Normal Cartilage cDNA Library

| | | | | | | | | | |
|---|---|---|---|---|---|---|---|---|---|
| 11701 | ncrb8423 | 11761 | ncrb8516 | 11821 | ncrb8614 | 11881 | ncrb8709 | 11941 | ncrb8803 |
| 11702 | ncrb8424 | 11762 | ncrb8518 | 11822 | ncrb8615 | 11882 | ncrb8711 | 11942 | ncrb8804 |
| 11703 | ncrb8425 | 11763 | ncrb8519 | 11823 | ncrb8617 | 11883 | ncrb8712 | 11943 | ncrb8807 |
| 11704 | ncrb8426 | 11764 | ncrb8522 | 11824 | ncrb8618 | 11884 | ncrb8713 | 11944 | ncrb8808 |
| 11705 | ncrb8427 | 11765 | ncrb8524 | 11825 | ncrb8619 | 11885 | ncrb8714 | 11945 | ncrb8810 |
| 11706 | ncrb8428 | 11766 | ncrb8525 | 11826 | ncrb8621 | 11886 | ncrb8715 | 11946 | ncrb8811 |
| 11707 | ncrb8429 | 11767 | ncrb8526 | 11827 | ncrb8622 | 11887 | ncrb8716 | 11947 | ncrb8813 |
| 11708 | ncrb8430 | 11768 | ncrb8527 | 11828 | ncrb8623 | 11888 | ncrb8718 | 11948 | ncrb8814 |
| 11709 | ncrb8431 | 11769 | ncrb8528 | 11829 | ncrb8624 | 11889 | ncrb8719 | 11949 | ncrb8815 |
| 11710 | ncrb8433 | 11770 | ncrb8529 | 11830 | ncrb8626 | 11890 | ncrb8720 | 11950 | ncrb8817 |
| 11711 | ncrb8434 | 11771 | ncrb8530 | 11831 | ncrb8627 | 11891 | ncrb8721 | 11951 | ncrb8818 |
| 11712 | ncrb8435 | 11772 | ncrb8531 | 11832 | ncrb8628 | 11892 | ncrb8722 | 11952 | ncrb8819 |
| 11713 | ncrb8436 | 11773 | ncrb8533 | 11833 | ncrb8629 | 11893 | ncrb8723 | 11953 | ncrb8820 |
| 11714 | ncrb8437 | 11774 | ncrb8535 | 11834 | ncrb8631 | 11894 | ncrb8724 | 11954 | ncrb8821 |
| 11715 | ncrb8439 | 11775 | ncrb8537 | 11835 | ncrb8633 | 11895 | ncrb8725 | 11955 | ncrb8823 |
| 11716 | ncrb8442 | 11776 | ncrb8538 | 11836 | ncrb8636 | 11896 | ncrb8727 | 11956 | ncrb8824 |
| 11717 | ncrb8443 | 11777 | ncrb8539 | 11837 | ncrb8638 | 11897 | ncrb8728 | 11957 | ncrb8825 |
| 11718 | ncrb8444 | 11778 | ncrb8540 | 11838 | ncrb8640 | 11898 | ncrb8729 | 11958 | ncrb8829 |
| 11719 | ncrb8447 | 11779 | ncrb8542 | 11839 | ncrb8641 | 11899 | ncrb8731 | 11959 | ncrb8830 |
| 11720 | ncrb8448 | 11780 | ncrb8543 | 11840 | ncrb8642 | 11900 | ncrb8732 | 11960 | ncrb8832 |
| 11721 | ncrb8451 | 11781 | ncrb8544 | 11841 | ncrb8646 | 11901 | ncrb8735 | 11961 | ncrc0001 |
| 11722 | ncrb8452 | 11782 | ncrb8546 | 11842 | ncrb8647 | 11902 | ncrb8737 | 11962 | ncrc0003 |
| 11723 | ncrb8454 | 11783 | ncrb8547 | 11843 | ncrb8649 | 11903 | ncrb8738 | 11963 | ncrc0004 |
| 11724 | ncrb8457 | 11784 | ncrb8549 | 11844 | ncrb8651 | 11904 | ncrb8740 | 11964 | ncrc0007 |
| 11725 | ncrb8458 | 11785 | ncrb8551 | 11845 | ncrb8653 | 11905 | ncrb8741 | 11965 | ncrc0008 |
| 11726 | ncrb8459 | 11786 | ncrb8554 | 11846 | ncrb8654 | 11906 | ncrb8743 | 11966 | ncrc0009 |
| 11727 | ncrb8460 | 11787 | ncrb8557 | 11847 | ncrb8655 | 11907 | ncrb8744 | 11967 | ncrc0011 |
| 11728 | ncrb8461 | 11788 | ncrb8558 | 11848 | ncrb8657 | 11908 | ncrb8746 | 11968 | ncrc0014 |
| 11729 | ncrb8462 | 11789 | ncrb8559 | 11849 | ncrb8661 | 11909 | ncrb8747 | 11969 | ncrc0015 |
| 11730 | ncrb8463 | 11790 | ncrb8561 | 11850 | ncrb8663 | 11910 | ncrb8751 | 11970 | ncrc0016 |
| 11731 | ncrb8464 | 11791 | ncrb8563 | 11851 | ncrb8664 | 11911 | ncrb8752 | 11971 | ncrc0017 |
| 11732 | ncrb8468 | 11792 | ncrb8564 | 11852 | ncrb8665 | 11912 | ncrb8753 | 11972 | ncrc0020 |
| 11733 | ncrb8469 | 11793 | ncrb8565 | 11853 | ncrb8666 | 11913 | ncrb8756 | 11973 | ncrc0025 |
| 11734 | ncrb8473 | 11794 | ncrb8568 | 11854 | ncrb8667 | 11914 | ncrb8757 | 11974 | ncrc0027 |
| 11735 | ncrb8474 | 11795 | ncrb8569 | 11855 | ncrb8670 | 11915 | ncrb8760 | 11975 | ncrc0028 |
| 11736 | ncrb8475 | 11796 | ncrb8570 | 11856 | ncrb8676 | 11916 | ncrb8762 | 11976 | ncrc0029 |
| 11737 | ncrb8476 | 11797 | ncrb8571 | 11857 | ncrb8678 | 11917 | ncrb8763 | 11977 | ncrc0031 |
| 11738 | ncrb8478 | 11798 | ncrb8573 | 11858 | ncrb8679 | 11918 | ncrb8764 | 11978 | ncrc0032 |
| 11739 | ncrb8479 | 11799 | ncrb8575 | 11859 | ncrb8680 | 11919 | ncrb8765 | 11979 | ncrc0033 |
| 11740 | ncrb8480 | 11800 | ncrb8576 | 11860 | ncrb8681 | 11920 | ncrb8766 | 11980 | ncrc0035 |
| 11741 | ncrb8481 | 11801 | ncrb8577 | 11861 | ncrb8682 | 11921 | ncrb8768 | 11981 | ncrc0040 |
| 11742 | ncrb8484 | 11802 | ncrb8579 | 11862 | ncrb8683 | 11922 | ncrb8769 | 11982 | ncrc0046 |
| 11743 | ncrb8487 | 11803 | ncrb8583 | 11863 | ncrb8684 | 11923 | ncrb8772 | 11983 | ncrc0047 |
| 11744 | ncrb8489 | 11804 | ncrb8585 | 11864 | ncrb8689 | 11924 | ncrb8773 | 11984 | ncrc0048 |
| 11745 | ncrb8490 | 11805 | ncrb8586 | 11865 | ncrb8691 | 11925 | ncrb8775 | 11985 | ncrc0049 |
| 11746 | ncrb8494 | 11806 | ncrb8590 | 11866 | ncrb8693 | 11926 | ncrb8776 | 11986 | ncrc0051 |
| 11747 | ncrb8496 | 11807 | ncrb8592 | 11867 | ncrb8694 | 11927 | ncrb8778 | 11987 | ncrc0052 |
| 11748 | ncrb8499 | 11808 | ncrb8593 | 11868 | ncrb8695 | 11928 | ncrb8779 | 11988 | ncrc0053 |
| 11749 | ncrb8500 | 11809 | ncrb8595 | 11869 | ncrb8696 | 11929 | ncrb8783 | 11989 | ncrc0054 |
| 11750 | ncrb8501 | 11810 | ncrb8596 | 11870 | ncrb8697 | 11930 | ncrb8785 | 11990 | ncrc0055 |
| 11751 | ncrb8503 | 11811 | ncrb8597 | 11871 | ncrb8698 | 11931 | ncrb8788 | 11991 | ncrc0056 |
| 11752 | ncrb8505 | 11812 | ncrb8599 | 11872 | ncrb8699 | 11932 | ncrb8790 | 11992 | ncrc0057 |
| 11753 | ncrb8506 | 11813 | ncrb8600 | 11873 | ncrb8700 | 11933 | ncrb8791 | 11993 | ncrc0058 |
| 11754 | ncrb8507 | 11814 | ncrb8603 | 11874 | ncrb8701 | 11934 | ncrb8792 | 11994 | ncrc0059 |
| 11755 | ncrb8508 | 11815 | ncrb8604 | 11875 | ncrb8702 | 11935 | ncrb8793 | 11995 | ncrc0060 |
| 11756 | ncrb8509 | 11816 | ncrb8605 | 11876 | ncrb8703 | 11936 | ncrb8794 | 11996 | ncrc0061 |
| 11757 | ncrb8510 | 11817 | ncrb8607 | 11877 | ncrb8704 | 11937 | ncrb8795 | 11997 | ncrc0064 |
| 11758 | ncrb8511 | 11818 | ncrb8608 | 11878 | ncrb8705 | 11938 | ncrb8797 | 11998 | ncrc0065 |
| 11759 | ncrb8512 | 11819 | ncrb8609 | 11879 | ncrb8707 | 11939 | ncrb8800 | 11999 | ncrc0067 |
| 11760 | ncrb8515 | 11820 | ncrb8611 | 11880 | ncrb8708 | 11940 | ncrb8802 | 12000 | ncrc0069 |

Figure 6C – List of EST Sequence Names From Normal Cartilage cDNA Library

| | | | | | | | | | |
|---|---|---|---|---|---|---|---|---|---|
| 12001 | ncrc0070 | 12061 | ncrc0158 | 12121 | ncrc0253 | 12181 | ncrc0331 | 12241 | ncrc0427 |
| 12002 | ncrc0071 | 12062 | ncrc0159 | 12122 | ncrc0254 | 12182 | ncrc0332 | 12242 | ncrc0431 |
| 12003 | ncrc0072 | 12063 | ncrc0160 | 12123 | ncrc0255 | 12183 | ncrc0334 | 12243 | ncrc0432 |
| 12004 | ncrc0073 | 12064 | ncrc0161 | 12124 | ncrc0256 | 12184 | ncrc0335 | 12244 | ncrc0433 |
| 12005 | ncrc0074 | 12065 | ncrc0164 | 12125 | ncrc0257 | 12185 | ncrc0336 | 12245 | ncrc0435 |
| 12006 | ncrc0075 | 12066 | ncrc0166 | 12126 | ncrc0258 | 12186 | ncrc0339 | 12246 | ncrc0436 |
| 12007 | ncrc0076 | 12067 | ncrc0167 | 12127 | ncrc0259 | 12187 | ncrc0341 | 12247 | ncrc0437 |
| 12008 | ncrc0077 | 12068 | ncrc0170 | 12128 | ncrc0260 | 12188 | ncrc0342 | 12248 | ncrc0438 |
| 12009 | ncrc0078 | 12069 | ncrc0171 | 12129 | ncrc0261 | 12189 | ncrc0343 | 12249 | ncrc0439 |
| 12010 | ncrc0079 | 12070 | ncrc0173 | 12130 | ncrc0262 | 12190 | ncrc0344 | 12250 | ncrc0440 |
| 12011 | ncrc0081 | 12071 | ncrc0174 | 12131 | ncrc0263 | 12191 | ncrc0346 | 12251 | ncrc0441 |
| 12012 | ncrc0083 | 12072 | ncrc0175 | 12132 | ncrc0266 | 12192 | ncrc0347 | 12252 | ncrc0442 |
| 12013 | ncrc0084 | 12073 | ncrc0176 | 12133 | ncrc0267 | 12193 | ncrc0351 | 12253 | ncrc0444 |
| 12014 | ncrc0085 | 12074 | ncrc0177 | 12134 | ncrc0268 | 12194 | ncrc0354 | 12254 | ncrc0445 |
| 12015 | ncrc0087 | 12075 | ncrc0178 | 12135 | ncrc0269 | 12195 | ncrc0355 | 12255 | ncrc0446 |
| 12016 | ncrc0090 | 12076 | ncrc0179 | 12136 | ncrc0270 | 12196 | ncrc0356 | 12256 | ncrc0447 |
| 12017 | ncrc0092 | 12077 | ncrc0180 | 12137 | ncrc0271 | 12197 | ncrc0357 | 12257 | ncrc0448 |
| 12018 | ncrc0095 | 12078 | ncrc0181 | 12138 | ncrc0272 | 12198 | ncrc0358 | 12258 | ncrc0449 |
| 12019 | ncrc0096 | 12079 | ncrc0183 | 12139 | ncrc0273 | 12199 | ncrc0359 | 12259 | ncrc0451 |
| 12020 | ncrc0097 | 12080 | ncrc0184 | 12140 | ncrc0275 | 12200 | ncrc0360 | 12260 | ncrc0452 |
| 12021 | ncrc0098 | 12081 | ncrc0185 | 12141 | ncrc0276 | 12201 | ncrc0361 | 12261 | ncrc0453 |
| 12022 | ncrc0099 | 12082 | ncrc0186 | 12142 | ncrc0277 | 12202 | ncrc0364 | 12262 | ncrc0454 |
| 12023 | ncrc0100 | 12083 | ncrc0187 | 12143 | ncrc0279 | 12203 | ncrc0365 | 12263 | ncrc0455 |
| 12024 | ncrc0101 | 12084 | ncrc0188 | 12144 | ncrc0281 | 12204 | ncrc0367 | 12264 | ncrc0456 |
| 12025 | ncrc0103 | 12085 | ncrc0189 | 12145 | ncrc0282 | 12205 | ncrc0368 | 12265 | ncrc0457 |
| 12026 | ncrc0105 | 12086 | ncrc0190 | 12146 | ncrc0284 | 12206 | ncrc0369 | 12266 | ncrc0458 |
| 12027 | ncrc0110 | 12087 | ncrc0191 | 12147 | ncrc0285 | 12207 | ncrc0373 | 12267 | ncrc0461 |
| 12028 | ncrc0111 | 12088 | ncrc0193 | 12148 | ncrc0286 | 12208 | ncrc0375 | 12268 | ncrc0462 |
| 12029 | ncrc0112 | 12089 | ncrc0194 | 12149 | ncrc0287 | 12209 | ncrc0376 | 12269 | ncrc0463 |
| 12030 | ncrc0113 | 12090 | ncrc0195 | 12150 | ncrc0288 | 12210 | ncrc0377 | 12270 | ncrc0464 |
| 12031 | ncrc0115 | 12091 | ncrc0199 | 12151 | ncrc0289 | 12211 | ncrc0379 | 12271 | ncrc0467 |
| 12032 | ncrc0116 | 12092 | ncrc0203 | 12152 | ncrc0290 | 12212 | ncrc0380 | 12272 | ncrc0468 |
| 12033 | ncrc0117 | 12093 | ncrc0204 | 12153 | ncrc0292 | 12213 | ncrc0381 | 12273 | ncrc0469 |
| 12034 | ncrc0119 | 12094 | ncrc0207 | 12154 | ncrc0293 | 12214 | ncrc0383 | 12274 | ncrc0471 |
| 12035 | ncrc0120 | 12095 | ncrc0209 | 12155 | ncrc0295 | 12215 | ncrc0385 | 12275 | ncrc0472 |
| 12036 | ncrc0126 | 12096 | ncrc0211 | 12156 | ncrc0296 | 12216 | ncrc0386 | 12276 | ncrc0473 |
| 12037 | ncrc0127 | 12097 | ncrc0212 | 12157 | ncrc0297 | 12217 | ncrc0387 | 12277 | ncrc0474 |
| 12038 | ncrc0128 | 12098 | ncrc0213 | 12158 | ncrc0299 | 12218 | ncrc0388 | 12278 | ncrc0477 |
| 12039 | ncrc0131 | 12099 | ncrc0215 | 12159 | ncrc0300 | 12219 | ncrc0391 | 12279 | ncrc0478 |
| 12040 | ncrc0133 | 12100 | ncrc0216 | 12160 | ncrc0301 | 12220 | ncrc0392 | 12280 | ncrc0479 |
| 12041 | ncrc0135 | 12101 | ncrc0217 | 12161 | ncrc0303 | 12221 | ncrc0393 | 12281 | ncrc0480 |
| 12042 | ncrc0136 | 12102 | ncrc0218 | 12162 | ncrc0304 | 12222 | ncrc0397 | 12282 | ncrc0481 |
| 12043 | ncrc0137 | 12103 | ncrc0220 | 12163 | ncrc0305 | 12223 | ncrc0398 | 12283 | ncrc0482 |
| 12044 | ncrc0138 | 12104 | ncrc0222 | 12164 | ncrc0311 | 12224 | ncrc0399 | 12284 | ncrc0483 |
| 12045 | ncrc0139 | 12105 | ncrc0224 | 12165 | ncrc0312 | 12225 | ncrc0400 | 12285 | ncrc0487 |
| 12046 | ncrc0140 | 12106 | ncrc0225 | 12166 | ncrc0313 | 12226 | ncrc0401 | 12286 | ncrc0488 |
| 12047 | ncrc0142 | 12107 | ncrc0228 | 12167 | ncrc0314 | 12227 | ncrc0407 | 12287 | ncrc0489 |
| 12048 | ncrc0143 | 12108 | ncrc0233 | 12168 | ncrc0315 | 12228 | ncrc0408 | 12288 | ncrc0492 |
| 12049 | ncrc0144 | 12109 | ncrc0235 | 12169 | ncrc0317 | 12229 | ncrc0411 | 12289 | ncrc0495 |
| 12050 | ncrc0145 | 12110 | ncrc0236 | 12170 | ncrc0318 | 12230 | ncrc0413 | 12290 | ncrc0496 |
| 12051 | ncrc0147 | 12111 | ncrc0238 | 12171 | ncrc0319 | 12231 | ncrc0414 | 12291 | ncrc0497 |
| 12052 | ncrc0148 | 12112 | ncrc0240 | 12172 | ncrc0320 | 12232 | ncrc0415 | 12292 | ncrc0499 |
| 12053 | ncrc0149 | 12113 | ncrc0241 | 12173 | ncrc0321 | 12233 | ncrc0416 | 12293 | ncrc0501 |
| 12054 | ncrc0150 | 12114 | ncrc0243 | 12174 | ncrc0323 | 12234 | ncrc0417 | 12294 | ncrc0505 |
| 12055 | ncrc0151 | 12115 | ncrc0244 | 12175 | ncrc0324 | 12235 | ncrc0419 | 12295 | ncrc0506 |
| 12056 | ncrc0152 | 12116 | ncrc0246 | 12176 | ncrc0325 | 12236 | ncrc0421 | 12296 | ncrc0507 |
| 12057 | ncrc0154 | 12117 | ncrc0248 | 12177 | ncrc0327 | 12237 | ncrc0423 | 12297 | ncrc0508 |
| 12058 | ncrc0155 | 12118 | ncrc0249 | 12178 | ncrc0328 | 12238 | ncrc0424 | 12298 | ncrc0510 |
| 12059 | ncrc0156 | 12119 | ncrc0251 | 12179 | ncrc0329 | 12239 | ncrc0425 | 12299 | ncrc0511 |
| 12060 | ncrc0157 | 12120 | ncrc0252 | 12180 | ncrc0330 | 12240 | ncrc0426 | 12300 | ncrc0512 |

Figure 6C – List of EST Sequence Names From Normal Cartilage cDNA Library

| | | | | | | | | | |
|---|---|---|---|---|---|---|---|---|---|
| 12301 | ncrc0513 | 12361 | ncrc0606 | 12421 | ncrc0699 | 12481 | ncrc0798 | 12541 | ncrc0876 |
| 12302 | ncrc0515 | 12362 | ncrc0608 | 12422 | ncrc0700 | 12482 | ncrc0799 | 12542 | ncrc0878 |
| 12303 | ncrc0516 | 12363 | ncrc0610 | 12423 | ncrc0701 | 12483 | ncrc0800 | 12543 | ncrc0880 |
| 12304 | ncrc0519 | 12364 | ncrc0611 | 12424 | ncrc0703 | 12484 | ncrc0801 | 12544 | ncrc0883 |
| 12305 | ncrc0521 | 12365 | ncrc0612 | 12425 | ncrc0704 | 12485 | ncrc0802 | 12545 | ncrc0885 |
| 12306 | ncrc0523 | 12366 | ncrc0614 | 12426 | ncrc0708 | 12486 | ncrc0803 | 12546 | ncrc0889 |
| 12307 | ncrc0524 | 12367 | ncrc0617 | 12427 | ncrc0709 | 12487 | ncrc0804 | 12547 | ncrc0891 |
| 12308 | ncrc0527 | 12368 | ncrc0618 | 12428 | ncrc0714 | 12488 | ncrc0805 | 12548 | ncrc0894 |
| 12309 | ncrc0528 | 12369 | ncrc0623 | 12429 | ncrc0715 | 12489 | ncrc0807 | 12549 | ncrc0899 |
| 12310 | ncrc0529 | 12370 | ncrc0624 | 12430 | ncrc0718 | 12490 | ncrc0809 | 12550 | ncrc0900 |
| 12311 | ncrc0531 | 12371 | ncrc0625 | 12431 | ncrc0720 | 12491 | ncrc0810 | 12551 | ncrc0901 |
| 12312 | ncrc0532 | 12372 | ncrc0627 | 12432 | ncrc0721 | 12492 | ncrc0811 | 12552 | ncrc0904 |
| 12313 | ncrc0533 | 12373 | ncrc0628 | 12433 | ncrc0723 | 12493 | ncrc0813 | 12553 | ncrc0905 |
| 12314 | ncrc0534 | 12374 | ncrc0629 | 12434 | ncrc0725 | 12494 | ncrc0814 | 12554 | ncrc0906 |
| 12315 | ncrc0535 | 12375 | ncrc0630 | 12435 | ncrc0726 | 12495 | ncrc0816 | 12555 | ncrc0907 |
| 12316 | ncrc0537 | 12376 | ncrc0632 | 12436 | ncrc0728 | 12496 | ncrc0817 | 12556 | ncrc0908 |
| 12317 | ncrc0538 | 12377 | ncrc0633 | 12437 | ncrc0729 | 12497 | ncrc0819 | 12557 | ncrc0910 |
| 12318 | ncrc0539 | 12378 | ncrc0635 | 12438 | ncrc0730 | 12498 | ncrc0820 | 12558 | ncrc0912 |
| 12319 | ncrc0540 | 12379 | ncrc0636 | 12439 | ncrc0731 | 12499 | ncrc0821 | 12559 | ncrc0913 |
| 12320 | ncrc0544 | 12380 | ncrc0639 | 12440 | ncrc0732 | 12500 | ncrc0822 | 12560 | ncrc0915 |
| 12321 | ncrc0545 | 12381 | ncrc0640 | 12441 | ncrc0733 | 12501 | ncrc0823 | 12561 | ncrc0916 |
| 12322 | ncrc0547 | 12382 | ncrc0641 | 12442 | ncrc0734 | 12502 | ncrc0825 | 12562 | ncrc0917 |
| 12323 | ncrc0548 | 12383 | ncrc0643 | 12443 | ncrc0735 | 12503 | ncrc0826 | 12563 | ncrc0918 |
| 12324 | ncrc0549 | 12384 | ncrc0644 | 12444 | ncrc0737 | 12504 | ncrc0827 | 12564 | ncrc0919 |
| 12325 | ncrc0550 | 12385 | ncrc0645 | 12445 | ncrc0739 | 12505 | ncrc0828 | 12565 | ncrc0920 |
| 12326 | ncrc0551 | 12386 | ncrc0646 | 12446 | ncrc0741 | 12506 | ncrc0829 | 12566 | ncrc0922 |
| 12327 | ncrc0552 | 12387 | ncrc0647 | 12447 | ncrc0742 | 12507 | ncrc0830 | 12567 | ncrc0924 |
| 12328 | ncrc0553 | 12388 | ncrc0649 | 12448 | ncrc0743 | 12508 | ncrc0832 | 12568 | ncrc0925 |
| 12329 | ncrc0554 | 12389 | ncrc0650 | 12449 | ncrc0744 | 12509 | ncrc0835 | 12569 | ncrc0926 |
| 12330 | ncrc0555 | 12390 | ncrc0651 | 12450 | ncrc0747 | 12510 | ncrc0836 | 12570 | ncrc0928 |
| 12331 | ncrc0556 | 12391 | ncrc0653 | 12451 | ncrc0748 | 12511 | ncrc0837 | 12571 | ncrc0932 |
| 12332 | ncrc0557 | 12392 | ncrc0654 | 12452 | ncrc0749 | 12512 | ncrc0838 | 12572 | ncrc0933 |
| 12333 | ncrc0558 | 12393 | ncrc0655 | 12453 | ncrc0750 | 12513 | ncrc0839 | 12573 | ncrc0934 |
| 12334 | ncrc0561 | 12394 | ncrc0656 | 12454 | ncrc0751 | 12514 | ncrc0841 | 12574 | ncrc0936 |
| 12335 | ncrc0562 | 12395 | ncrc0658 | 12455 | ncrc0752 | 12515 | ncrc0842 | 12575 | ncrc0940 |
| 12336 | ncrc0563 | 12396 | ncrc0659 | 12456 | ncrc0753 | 12516 | ncrc0843 | 12576 | ncrc0942 |
| 12337 | ncrc0564 | 12397 | ncrc0660 | 12457 | ncrc0755 | 12517 | ncrc0844 | 12577 | ncrc0944 |
| 12338 | ncrc0568 | 12398 | ncrc0661 | 12458 | ncrc0756 | 12518 | ncrc0846 | 12578 | ncrc0945 |
| 12339 | ncrc0569 | 12399 | ncrc0663 | 12459 | ncrc0759 | 12519 | ncrc0847 | 12579 | ncrc0947 |
| 12340 | ncrc0570 | 12400 | ncrc0664 | 12460 | ncrc0763 | 12520 | ncrc0848 | 12580 | ncrc0948 |
| 12341 | ncrc0571 | 12401 | ncrc0665 | 12461 | ncrc0764 | 12521 | ncrc0849 | 12581 | ncrc0949 |
| 12342 | ncrc0572 | 12402 | ncrc0666 | 12462 | ncrc0765 | 12522 | ncrc0851 | 12582 | ncrc0951 |
| 12343 | ncrc0573 | 12403 | ncrc0667 | 12463 | ncrc0766 | 12523 | ncrc0852 | 12583 | ncrc0952 |
| 12344 | ncrc0574 | 12404 | ncrc0668 | 12464 | ncrc0767 | 12524 | ncrc0853 | 12584 | ncrc0953 |
| 12345 | ncrc0576 | 12405 | ncrc0669 | 12465 | ncrc0768 | 12525 | ncrc0855 | 12585 | ncrc0954 |
| 12346 | ncrc0579 | 12406 | ncrc0670 | 12466 | ncrc0770 | 12526 | ncrc0856 | 12586 | ncrc0955 |
| 12347 | ncrc0580 | 12407 | ncrc0671 | 12467 | ncrc0771 | 12527 | ncrc0857 | 12587 | ncrc0956 |
| 12348 | ncrc0583 | 12408 | ncrc0672 | 12468 | ncrc0774 | 12528 | ncrc0858 | 12588 | ncrc0958 |
| 12349 | ncrc0584 | 12409 | ncrc0674 | 12469 | ncrc0777 | 12529 | ncrc0860 | 12589 | ncrc0959 |
| 12350 | ncrc0585 | 12410 | ncrc0675 | 12470 | ncrc0778 | 12530 | ncrc0861 | 12590 | ncrc0960 |
| 12351 | ncrc0588 | 12411 | ncrc0676 | 12471 | ncrc0780 | 12531 | ncrc0862 | 12591 | ncrc0961 |
| 12352 | ncrc0591 | 12412 | ncrc0681 | 12472 | ncrc0783 | 12532 | ncrc0863 | 12592 | ncrc0963 |
| 12353 | ncrc0592 | 12413 | ncrc0682 | 12473 | ncrc0784 | 12533 | ncrc0864 | 12593 | ncrc0964 |
| 12354 | ncrc0595 | 12414 | ncrc0684 | 12474 | ncrc0785 | 12534 | ncrc0865 | 12594 | ncrc0965 |
| 12355 | ncrc0597 | 12415 | ncrc0688 | 12475 | ncrc0788 | 12535 | ncrc0867 | 12595 | ncrc0967 |
| 12356 | ncrc0599 | 12416 | ncrc0689 | 12476 | ncrc0792 | 12536 | ncrc0868 | 12596 | ncrc0968 |
| 12357 | ncrc0601 | 12417 | ncrc0691 | 12477 | ncrc0793 | 12537 | ncrc0871 | 12597 | ncrc0971 |
| 12358 | ncrc0602 | 12418 | ncrc0693 | 12478 | ncrc0794 | 12538 | ncrc0872 | 12598 | ncrc0972 |
| 12359 | ncrc0604 | 12419 | ncrc0695 | 12479 | ncrc0796 | 12539 | ncrc0873 | 12599 | ncrc0973 |
| 12360 | ncrc0605 | 12420 | ncrc0696 | 12480 | ncrc0797 | 12540 | ncrc0875 | 12600 | ncrc0974 |

Figure 6C – List of EST Sequence Names From Normal Cartilage cDNA Library

| | | | | | | | | | |
|---|---|---|---|---|---|---|---|---|---|
| 12601 | ncrc0976 | 12661 | ncrc1057 | 12721 | ncrc1147 | 12781 | ncrc1243 | 12841 | ncrc1335 |
| 12602 | ncrc0980 | 12662 | ncrc1059 | 12722 | ncrc1148 | 12782 | ncrc1245 | 12842 | ncrc1336 |
| 12603 | ncrc0981 | 12663 | ncrc1060 | 12723 | ncrc1149 | 12783 | ncrc1247 | 12843 | ncrc1337 |
| 12604 | ncrc0983 | 12664 | ncrc1063 | 12724 | ncrc1150 | 12784 | ncrc1248 | 12844 | ncrc1338 |
| 12605 | ncrc0984 | 12665 | ncrc1064 | 12725 | ncrc1152 | 12785 | ncrc1250 | 12845 | ncrc1339 |
| 12606 | ncrc0985 | 12666 | ncrc1065 | 12726 | ncrc1153 | 12786 | ncrc1251 | 12846 | ncrc1341 |
| 12607 | ncrc0987 | 12667 | ncrc1067 | 12727 | ncrc1156 | 12787 | ncrc1255 | 12847 | ncrc1343 |
| 12608 | ncrc0990 | 12668 | ncrc1068 | 12728 | ncrc1160 | 12788 | ncrc1257 | 12848 | ncrc1344 |
| 12609 | ncrc0991 | 12669 | ncrc1069 | 12729 | ncrc1163 | 12789 | ncrc1259 | 12849 | ncrc1345 |
| 12610 | ncrc0992 | 12670 | ncrc1071 | 12730 | ncrc1165 | 12790 | ncrc1260 | 12850 | ncrc1347 |
| 12611 | ncrc0994 | 12671 | ncrc1072 | 12731 | ncrc1168 | 12791 | ncrc1263 | 12851 | ncrc1348 |
| 12612 | ncrc0996 | 12672 | ncrc1076 | 12732 | ncrc1169 | 12792 | ncrc1264 | 12852 | ncrc1349 |
| 12613 | ncrc0997 | 12673 | ncrc1077 | 12733 | ncrc1171 | 12793 | ncrc1265 | 12853 | ncrc1352 |
| 12614 | ncrc0999 | 12674 | ncrc1079 | 12734 | ncrc1172 | 12794 | ncrc1267 | 12854 | ncrc1355 |
| 12615 | ncrc1000 | 12675 | ncrc1080 | 12735 | ncrc1173 | 12795 | ncrc1271 | 12855 | ncrc1356 |
| 12616 | ncrc1001 | 12676 | ncrc1081 | 12736 | ncrc1175 | 12796 | ncrc1272 | 12856 | ncrc1357 |
| 12617 | ncrc1002 | 12677 | ncrc1083 | 12737 | ncrc1176 | 12797 | ncrc1274 | 12857 | ncrc1358 |
| 12618 | ncrc1003 | 12678 | ncrc1084 | 12738 | ncrc1178 | 12798 | ncrc1277 | 12858 | ncrc1360 |
| 12619 | ncrc1004 | 12679 | ncrc1085 | 12739 | ncrc1180 | 12799 | ncrc1278 | 12859 | ncrc1361 |
| 12620 | ncrc1005 | 12680 | ncrc1087 | 12740 | ncrc1182 | 12800 | ncrc1279 | 12860 | ncrc1363 |
| 12621 | ncrc1006 | 12681 | ncrc1088 | 12741 | ncrc1183 | 12801 | ncrc1280 | 12861 | ncrc1367 |
| 12622 | ncrc1007 | 12682 | ncrc1089 | 12742 | ncrc1184 | 12802 | ncrc1281 | 12862 | ncrc1368 |
| 12623 | ncrc1008 | 12683 | ncrc1092 | 12743 | ncrc1188 | 12803 | ncrc1283 | 12863 | ncrc1369 |
| 12624 | ncrc1011 | 12684 | ncrc1093 | 12744 | ncrc1192 | 12804 | ncrc1284 | 12864 | ncrc1371 |
| 12625 | ncrc1012 | 12685 | ncrc1095 | 12745 | ncrc1193 | 12805 | ncrc1285 | 12865 | ncrc1372 |
| 12626 | ncrc1013 | 12686 | ncrc1096 | 12746 | ncrc1196 | 12806 | ncrc1287 | 12866 | ncrc1373 |
| 12627 | ncrc1014 | 12687 | ncrc1097 | 12747 | ncrc1198 | 12807 | ncrc1288 | 12867 | ncrc1374 |
| 12628 | ncrc1015 | 12688 | ncrc1099 | 12748 | ncrc1199 | 12808 | ncrc1290 | 12868 | ncrc1376 |
| 12629 | ncrc1016 | 12689 | ncrc1102 | 12749 | ncrc1200 | 12809 | ncrc1292 | 12869 | ncrc1379 |
| 12630 | ncrc1017 | 12690 | ncrc1103 | 12750 | ncrc1201 | 12810 | ncrc1294 | 12870 | ncrc1380 |
| 12631 | ncrc1018 | 12691 | ncrc1105 | 12751 | ncrc1203 | 12811 | ncrc1295 | 12871 | ncrc1381 |
| 12632 | ncrc1019 | 12692 | ncrc1107 | 12752 | ncrc1204 | 12812 | ncrc1296 | 12872 | ncrc1384 |
| 12633 | ncrc1020 | 12693 | ncrc1109 | 12753 | ncrc1205 | 12813 | ncrc1297 | 12873 | ncrc1385 |
| 12634 | ncrc1021 | 12694 | ncrc1111 | 12754 | ncrc1206 | 12814 | ncrc1300 | 12874 | ncrc1385 |
| 12635 | ncrc1022 | 12695 | ncrc1112 | 12755 | ncrc1207 | 12815 | ncrc1301 | 12875 | ncrc1386 |
| 12636 | ncrc1023 | 12696 | ncrc1114 | 12756 | ncrc1208 | 12816 | ncrc1302 | 12876 | ncrc1387 |
| 12637 | ncrc1024 | 12697 | ncrc1115 | 12757 | ncrc1209 | 12817 | ncrc1304 | 12877 | ncrc1388 |
| 12638 | ncrc1025 | 12698 | ncrc1118 | 12758 | ncrc1210 | 12818 | ncrc1305 | 12878 | ncrc1390 |
| 12639 | ncrc1026 | 12699 | ncrc1119 | 12759 | ncrc1211 | 12819 | ncrc1306 | 12879 | ncrc1391 |
| 12640 | ncrc1029 | 12700 | ncrc1121 | 12760 | ncrc1212 | 12820 | ncrc1307 | 12880 | ncrc1392 |
| 12641 | ncrc1030 | 12701 | ncrc1123 | 12761 | ncrc1214 | 12821 | ncrc1308 | 12881 | ncrc1393 |
| 12642 | ncrc1031 | 12702 | ncrc1125 | 12762 | ncrc1216 | 12822 | ncrc1309 | 12882 | ncrc1395 |
| 12643 | ncrc1032 | 12703 | ncrc1126 | 12763 | ncrc1217 | 12823 | ncrc1310 | 12883 | ncrc1396 |
| 12644 | ncrc1033 | 12704 | ncrc1127 | 12764 | ncrc1219 | 12824 | ncrc1311 | 12884 | ncrc1397 |
| 12645 | ncrc1035 | 12705 | ncrc1128 | 12765 | ncrc1221 | 12825 | ncrc1312 | 12885 | ncrc1398 |
| 12646 | ncrc1036 | 12706 | ncrc1129 | 12766 | ncrc1222 | 12826 | ncrc1316 | 12886 | ncrc1399 |
| 12647 | ncrc1037 | 12707 | ncrc1130 | 12767 | ncrc1223 | 12827 | ncrc1317 | 12887 | ncrc1401 |
| 12648 | ncrc1038 | 12708 | ncrc1131 | 12768 | ncrc1224 | 12828 | ncrc1319 | 12888 | ncrc1402 |
| 12649 | ncrc1041 | 12709 | ncrc1132 | 12769 | ncrc1226 | 12829 | ncrc1320 | 12889 | ncrc1404 |
| 12650 | ncrc1042 | 12710 | ncrc1133 | 12770 | ncrc1227 | 12830 | ncrc1321 | 12890 | ncrc1407 |
| 12651 | ncrc1044 | 12711 | ncrc1134 | 12771 | ncrc1230 | 12831 | ncrc1322 | 12891 | ncrc1408 |
| 12652 | ncrc1045 | 12712 | ncrc1136 | 12772 | ncrc1231 | 12832 | ncrc1323 | 12892 | ncrc1409 |
| 12653 | ncrc1046 | 12713 | ncrc1137 | 12773 | ncrc1233 | 12833 | ncrc1324 | 12893 | ncrc1411 |
| 12654 | ncrc1047 | 12714 | ncrc1138 | 12774 | ncrc1234 | 12834 | ncrc1325 | 12894 | ncrc1412 |
| 12655 | ncrc1048 | 12715 | ncrc1139 | 12775 | ncrc1235 | 12835 | ncrc1326 | 12895 | ncrc1413 |
| 12656 | ncrc1049 | 12716 | ncrc1140 | 12776 | ncrc1236 | 12836 | ncrc1328 | 12896 | ncrc1415 |
| 12657 | ncrc1050 | 12717 | ncrc1141 | 12777 | ncrc1237 | 12837 | ncrc1329 | 12897 | ncrc1416 |
| 12658 | ncrc1053 | 12718 | ncrc1143 | 12778 | ncrc1240 | 12838 | ncrc1330 | 12898 | ncrc1418 |
| 12659 | ncrc1055 | 12719 | ncrc1145 | 12779 | ncrc1241 | 12839 | ncrc1331 | 12899 | ncrc1419 |
| 12660 | ncrc1056 | 12720 | ncrc1146 | 12780 | ncrc1242 | 12840 | ncrc1332 | 12900 | ncrc1420 |

Figure 6C – List of EST Sequence Names From Normal Cartilage cDNA Library

| | |
|---|---|
| 12901 | ncrc1421 |
| 12902 | ncrc1423 |
| 12903 | ncrc1424 |
| 12904 | ncrc1425 |
| 12905 | ncrc1426 |
| 12906 | ncrc1427 |
| 12907 | ncrc1428 |
| 12908 | ncrc1429 |
| 12909 | ncrc1431 |
| 12910 | ncrc1434 |
| 12911 | ncrc1436 |
| 12912 | ncrc1437 |
| 12913 | ncrc1438 |
| 12914 | ncrc1439 |
| 12915 | ncrc1440 |
| 12916 | ncrc1441 |
| 12917 | ncrc1442 |
| 12918 | ncrc1444 |
| 12919 | ncrc1447 |
| 12920 | ncrc1449 |
| 12921 | ncrc1451 |
| 12922 | ncrc1452 |
| 12923 | ncrc1455 |
| 12924 | ncrc1456 |
| 12925 | ncrc1457 |
| 12926 | ncrc1460 |
| 12927 | ncrc1463 |
| 12928 | ncrc1465 |
| 12929 | ncrc1467 |
| 12930 | ncrc1469 |
| 12931 | ncrc1471 |
| 12932 | ncrc1472 |
| 12933 | ncrc1473 |
| 12934 | ncrc1475 |
| 12935 | ncrc1480 |
| 12936 | ncrc1481 |
| 12937 | ncrc1482 |
| 12938 | ncrc1483 |
| 12939 | ncrc1484 |
| 12940 | ncrc1486 |
| 12941 | ncrc1487 |
| 12942 | ncrc1489 |
| 12943 | ncrc1491 |
| 12944 | ncrc1492 |
| 12945 | ncrc1493 |
| 12946 | ncrc1495 |
| 12947 | ncrc1496 |
| 12948 | ncrc1497 |
| 12949 | ncrc1498 |
| 12950 | ncrc1500 |
| 12951 | ncrc1501 |
| 12952 | ncrc1502 |
| 12953 | ncrc1503 |
| 12954 | ncrc1504 |
| 12955 | ncrc1505 |
| 12956 | ncrc1508 |
| 12957 | ncrc1509 |
| 12958 | ncrc1510 |
| 12959 | ncrc1511 |
| 12960 | ncrc1513 |
| 12961 | ncrc1515 |
| 12962 | ncrc1516 |
| 12963 | ncrc1517 |
| 12964 | ncrc1518 |
| 12965 | ncrc1519 |
| 12966 | ncrc1520 |
| 12967 | ncrc1521 |
| 12968 | ncrc1523 |
| 12969 | ncrc1524 |
| 12970 | ncrc1525 |
| 12971 | ncrc1527 |
| 12972 | ncrc1529 |
| 12973 | ncrc1530 |
| 12974 | ncrc1531 |
| 12975 | ncrc1532 |
| 12976 | ncrc1533 |
| 12977 | ncrc1535 |
| 12978 | ncrc1536 |
| 12979 | ncrc1537 |
| 12980 | ncrc1538 |
| 12981 | ncrc1540 |
| 12982 | ncrc1543 |
| 12983 | ncrc1544 |
| 12984 | ncrc1547 |
| 12985 | ncrc1549 |
| 12986 | ncrc1551 |
| 12987 | ncrc1553 |
| 12988 | ncrc1555 |
| 12989 | ncrc1556 |
| 12990 | ncrc1559 |
| 12991 | ncrc1561 |
| 12992 | ncrc1562 |
| 12993 | ncrc1563 |
| 12994 | ncrc1564 |
| 12995 | ncrc1565 |
| 12996 | ncrc1566 |
| 12997 | ncrc1567 |
| 12998 | ncrc1568 |
| 12999 | ncrc1569 |
| 13000 | ncrc1571 |
| 13001 | ncrc1572 |
| 13002 | ncrc1573 |
| 13003 | ncrc1576 |
| 13004 | ncrc1577 |
| 13005 | ncrc1578 |
| 13006 | ncrc1580 |
| 13007 | ncrc1582 |
| 13008 | ncrc1583 |
| 13009 | ncrc1587 |
| 13010 | ncrc1588 |
| 13011 | ncrc1589 |
| 13012 | ncrc1590 |
| 13013 | ncrc1591 |
| 13014 | ncrc1592 |
| 13015 | ncrc1593 |
| 13016 | ncrc1595 |
| 13017 | ncrc1596 |
| 13018 | ncrc1597 |
| 13019 | ncrc1598 |
| 13020 | ncrc1599 |
| 13021 | ncrc1600 |
| 13022 | ncrc1602 |
| 13023 | ncrc1603 |
| 13024 | ncrc1605 |
| 13025 | ncrc1606 |
| 13026 | ncrc1607 |
| 13027 | ncrc1608 |
| 13028 | ncrc1609 |
| 13029 | ncrc1610 |
| 13030 | ncrc1611 |
| 13031 | ncrc1612 |
| 13032 | ncrc1613 |
| 13033 | ncrc1615 |
| 13034 | ncrc1616 |
| 13035 | ncrc1617 |
| 13036 | ncrc1619 |
| 13037 | ncrc1620 |
| 13038 | ncrc1621 |
| 13039 | ncrc1623 |
| 13040 | ncrc1624 |
| 13041 | ncrc1625 |
| 13042 | ncrc1627 |
| 13043 | ncrc1628 |
| 13044 | ncrc1629 |
| 13045 | ncrc1630 |
| 13046 | ncrc1631 |
| 13047 | ncrc1632 |
| 13048 | ncrc1633 |
| 13049 | ncrc1634 |
| 13050 | ncrc1635 |
| 13051 | ncrc1636 |
| 13052 | ncrc1639 |
| 13053 | ncrc1641 |
| 13054 | ncrc1643 |
| 13055 | ncrc1644 |
| 13056 | ncrc1645 |
| 13057 | ncrc1647 |
| 13058 | ncrc1648 |
| 13059 | ncrc1649 |
| 13060 | ncrc1651 |
| 13061 | ncrc1652 |
| 13062 | ncrc1653 |
| 13063 | ncrc1657 |
| 13064 | ncrc1659 |
| 13065 | ncrc1661 |
| 13066 | ncrc1662 |
| 13067 | ncrc1663 |
| 13068 | ncrc1665 |
| 13069 | ncrc1667 |
| 13070 | ncrc1668 |
| 13071 | ncrc1669 |
| 13072 | ncrc1671 |
| 13073 | ncrc1675 |
| 13074 | ncrc1678 |
| 13075 | ncrc1679 |
| 13076 | ncrc1680 |
| 13077 | ncrc1681 |
| 13078 | ncrc1683 |
| 13079 | ncrc1684 |
| 13080 | ncrc1687 |
| 13081 | ncrc1690 |
| 13082 | ncrc1691 |
| 13083 | ncrc1692 |
| 13084 | ncrc1693 |
| 13085 | ncrc1694 |
| 13086 | ncrc1696 |
| 13087 | ncrc1699 |
| 13088 | ncrc1700 |
| 13089 | ncrc1701 |
| 13090 | ncrc1702 |
| 13091 | ncrc1703 |
| 13092 | ncrc1704 |
| 13093 | ncrc1706 |
| 13094 | ncrc1707 |
| 13095 | ncrc1708 |
| 13096 | ncrc1709 |
| 13097 | ncrc1710 |
| 13098 | ncrc1711 |
| 13099 | ncrc1712 |
| 13100 | ncrc1713 |
| 13101 | ncrc1714 |
| 13102 | ncrc1716 |
| 13103 | ncrc1717 |
| 13104 | ncrc1719 |
| 13105 | ncrc1722 |
| 13106 | ncrc1723 |
| 13107 | ncrc1724 |
| 13108 | ncrc1725 |
| 13109 | ncrc1727 |
| 13110 | ncrc1728 |
| 13111 | ncrc1735 |
| 13112 | ncrc1736 |
| 13113 | ncrc1737 |
| 13114 | ncrc1740 |
| 13115 | ncrc1742 |
| 13116 | ncrc1743 |
| 13117 | ncrc1744 |
| 13118 | ncrc1745 |
| 13119 | ncrc1747 |
| 13120 | ncrc1748 |
| 13121 | ncrc1749 |
| 13122 | ncrc1751 |
| 13123 | ncrc1754 |
| 13124 | ncrc1756 |
| 13125 | ncrc1758 |
| 13126 | ncrc1759 |
| 13127 | ncrc1760 |
| 13128 | ncrc1761 |
| 13129 | ncrc1763 |
| 13130 | ncrc1764 |
| 13131 | ncrc1765 |
| 13132 | ncrc1767 |
| 13133 | ncrc1768 |
| 13134 | ncrc1772 |
| 13135 | ncrc1775 |
| 13136 | ncrc1776 |
| 13137 | ncrc1777 |
| 13138 | ncrc1779 |
| 13139 | ncrc1780 |
| 13140 | ncrc1783 |
| 13141 | ncrc1784 |
| 13142 | ncrc1785 |
| 13143 | ncrc1786 |
| 13144 | ncrc1787 |
| 13145 | ncrc1788 |
| 13146 | ncrc1791 |
| 13147 | ncrc1792 |
| 13148 | ncrc1795 |
| 13149 | ncrc1798 |
| 13150 | ncrc1799 |
| 13151 | ncrc1800 |
| 13152 | ncrc1801 |
| 13153 | ncrc1804 |
| 13154 | ncrc1805 |
| 13155 | ncrc1806 |
| 13156 | ncrc1807 |
| 13157 | ncrc1808 |
| 13158 | ncrc1809 |
| 13159 | ncrc1810 |
| 13160 | ncrc1811 |
| 13161 | ncrc1812 |
| 13162 | ncrc1815 |
| 13163 | ncrc1816 |
| 13164 | ncrc1817 |
| 13165 | ncrc1819 |
| 13166 | ncrc1820 |
| 13167 | ncrc1821 |
| 13168 | ncrc1824 |
| 13169 | ncrc1825 |
| 13170 | ncrc1827 |
| 13171 | ncrc1828 |
| 13172 | ncrc1831 |
| 13173 | ncrc1832 |
| 13174 | ncrc1833 |
| 13175 | ncrc1835 |
| 13176 | ncrc1836 |
| 13177 | ncrc1837 |
| 13178 | ncrc1839 |
| 13179 | ncrc1843 |
| 13180 | ncrc1844 |
| 13181 | ncrc1845 |
| 13182 | ncrc1847 |
| 13183 | ncrc1848 |
| 13184 | ncrc1849 |
| 13185 | ncrc1852 |
| 13186 | ncrc1853 |
| 13187 | ncrc1854 |
| 13188 | ncrc1855 |
| 13189 | ncrc1856 |
| 13190 | ncrc1857 |
| 13191 | ncrc1859 |
| 13192 | ncrc1860 |
| 13193 | ncrc1861 |
| 13194 | ncrc1864 |
| 13195 | ncrc1867 |
| 13196 | ncrc1868 |
| 13197 | ncrc1870 |
| 13198 | ncrc1871 |
| 13199 | ncrc1872 |
| 13200 | ncrc1873 |

Figure 6C – List of EST Sequence Names From Normal Cartilage cDNA Library

| | |
|---|---|
| 13201 | ncrc1875 |
| 13202 | ncrc1876 |
| 13203 | ncrc1877 |
| 13204 | ncrc1878 |
| 13205 | ncrc1879 |
| 13206 | ncrc1880 |
| 13207 | ncrc1881 |
| 13208 | ncrc1883 |
| 13209 | ncrc1884 |
| 13210 | ncrc1885 |
| 13211 | ncrc1886 |
| 13212 | ncrc1887 |
| 13213 | ncrc1888 |
| 13214 | ncrc1889 |
| 13215 | ncrc1891 |
| 13216 | ncrc1892 |
| 13217 | ncrc1893 |
| 13218 | ncrc1894 |
| 13219 | ncrc1896 |
| 13220 | ncrc1899 |
| 13221 | ncrc1900 |
| 13222 | ncrc1901 |
| 13223 | ncrc1902 |
| 13224 | ncrc1903 |
| 13225 | ncrc1904 |
| 13226 | ncrc1905 |
| 13227 | ncrc1906 |
| 13228 | ncrc1907 |
| 13229 | ncrc1909 |
| 13230 | ncrc1912 |
| 13231 | ncrc1913 |
| 13232 | ncrc1914 |
| 13233 | ncrc1915 |
| 13234 | ncrc1916 |
| 13235 | ncrc1917 |
| 13236 | ncrc1918 |
| 13237 | ncrc1919 |
| 13238 | ncrc1920 |
| 13239 | ncrc1921 |
| 13240 | ncrc1923 |
| 13241 | ncrc1924 |
| 13242 | ncrc1927 |
| 13243 | ncrc1929 |
| 13244 | ncrc1937 |
| 13245 | ncrc1939 |
| 13246 | ncrc1941 |
| 13247 | ncrc1944 |
| 13248 | ncrc1945 |
| 13249 | ncrc1946 |
| 13250 | ncrc1947 |
| 13251 | ncrc1949 |
| 13252 | ncrc1951 |
| 13253 | ncrc1952 |
| 13254 | ncrc1956 |
| 13255 | ncrc1959 |
| 13256 | ncrc1960 |
| 13257 | ncrc1963 |
| 13258 | ncrc1967 |
| 13259 | ncrc1968 |
| 13260 | ncrc1969 |
| 13261 | ncrc1971 |
| 13262 | ncrc1973 |
| 13263 | ncrc1975 |
| 13264 | ncrc1976 |
| 13265 | ncrc1977 |
| 13266 | ncrc1980 |
| 13267 | ncrc1981 |
| 13268 | ncrc1982 |
| 13269 | ncrc1985 |
| 13270 | ncrc1986 |
| 13271 | ncrc1988 |
| 13272 | ncrc1989 |
| 13273 | ncrc1990 |
| 13274 | ncrc1991 |
| 13275 | ncrc1992 |
| 13276 | ncrc1993 |
| 13277 | ncrc1995 |
| 13278 | ncrc1996 |
| 13279 | ncrc1997 |
| 13280 | ncrc1999 |
| 13281 | ncrc2000 |
| 13282 | ncrc2003 |
| 13283 | ncrc2004 |
| 13284 | ncrc2005 |
| 13285 | ncrc2007 |
| 13286 | ncrc2008 |
| 13287 | ncrc2010 |
| 13288 | ncrc2011 |
| 13289 | ncrc2013 |
| 13290 | ncrc2014 |
| 13291 | ncrc2015 |
| 13292 | ncrc2016 |
| 13293 | ncrc2017 |
| 13294 | ncrc2018 |
| 13295 | ncrc2019 |
| 13296 | ncrc2020 |
| 13297 | ncrc2024 |
| 13298 | ncrc2025 |
| 13299 | ncrc2027 |
| 13300 | ncrc2031 |
| 13301 | ncrc2035 |
| 13302 | ncrc2036 |
| 13303 | ncrc2037 |
| 13304 | ncrc2039 |
| 13305 | ncrc2040 |
| 13306 | ncrc2041 |
| 13307 | ncrc2042 |
| 13308 | ncrc2043 |
| 13309 | ncrc2044 |
| 13310 | ncrc2045 |
| 13311 | ncrc2047 |
| 13312 | ncrc2048 |
| 13313 | ncrc2049 |
| 13314 | ncrc2051 |
| 13315 | ncrc2052 |
| 13316 | ncrc2055 |
| 13317 | ncrc2056 |
| 13318 | ncrc2057 |
| 13319 | ncrc2058 |
| 13320 | ncrc2059 |
| 13321 | ncrc2060 |
| 13322 | ncrc2063 |
| 13323 | ncrc2064 |
| 13324 | ncrc2065 |
| 13325 | ncrc2067 |
| 13326 | ncrc2068 |
| 13327 | ncrc2069 |
| 13328 | ncrc2070 |
| 13329 | ncrc2071 |
| 13330 | ncrc2072 |
| 13331 | ncrc2073 |
| 13332 | ncrc2074 |
| 13333 | ncrc2075 |
| 13334 | ncrc2076 |
| 13335 | ncrc2078 |
| 13336 | ncrc2079 |
| 13337 | ncrc2080 |
| 13338 | ncrc2082 |
| 13339 | ncrc2085 |
| 13340 | ncrc2086 |
| 13341 | ncrc2087 |
| 13342 | ncrc2090 |
| 13343 | ncrc2091 |
| 13344 | ncrc2092 |
| 13345 | ncrc2093 |
| 13346 | ncrc2096 |
| 13347 | ncrc2097 |
| 13348 | ncrc2098 |
| 13349 | ncrc2099 |
| 13350 | ncrc2103 |
| 13351 | ncrc2106 |
| 13352 | ncrc2108 |
| 13353 | ncrc2110 |
| 13354 | ncrc2111 |
| 13355 | ncrc2112 |
| 13356 | ncrc2113 |
| 13357 | ncrc2114 |
| 13358 | ncrc2119 |
| 13359 | ncrc2120 |
| 13360 | ncrc2121 |
| 13361 | ncrc2123 |
| 13362 | ncrc2124 |
| 13363 | ncrc2128 |
| 13364 | ncrc2129 |
| 13365 | ncrc2131 |
| 13366 | ncrc2132 |
| 13367 | ncrc2133 |
| 13368 | ncrc2135 |
| 13369 | ncrc2137 |
| 13370 | ncrc2139 |
| 13371 | ncrc2140 |
| 13372 | ncrc2141 |
| 13373 | ncrc2142 |
| 13374 | ncrc2144 |
| 13375 | ncrc2145 |
| 13376 | ncrc2147 |
| 13377 | ncrc2149 |
| 13378 | ncrc2151 |
| 13379 | ncrc2152 |
| 13380 | ncrc2153 |
| 13381 | ncrc2154 |
| 13382 | ncrc2155 |
| 13383 | ncrc2156 |
| 13384 | ncrc2158 |
| 13385 | ncrc2160 |
| 13386 | ncrc2161 |
| 13387 | ncrc2164 |
| 13388 | ncrc2165 |
| 13389 | ncrc2166 |
| 13390 | ncrc2168 |
| 13391 | ncrc2171 |
| 13392 | ncrc2172 |
| 13393 | ncrc2173 |
| 13394 | ncrc2175 |
| 13395 | ncrc2176 |
| 13396 | ncrc2177 |
| 13397 | ncrc2179 |
| 13398 | ncrc2180 |
| 13399 | ncrc2181 |
| 13400 | ncrc2182 |
| 13401 | ncrc2183 |
| 13402 | ncrc2185 |
| 13403 | ncrc2186 |
| 13404 | ncrc2187 |
| 13405 | ncrc2189 |
| 13406 | ncrc2191 |
| 13407 | ncrc2192 |
| 13408 | ncrc2193 |
| 13409 | ncrc2195 |
| 13410 | ncrc2196 |
| 13411 | ncrc2199 |
| 13412 | ncrc2201 |
| 13413 | ncrc2202 |
| 13414 | ncrc2203 |
| 13415 | ncrc2204 |
| 13416 | ncrc2205 |
| 13417 | ncrc2206 |
| 13418 | ncrc2207 |
| 13419 | ncrc2208 |
| 13420 | ncrc2209 |
| 13421 | ncrc2210 |
| 13422 | ncrc2211 |
| 13423 | ncrc2215 |
| 13424 | ncrc2219 |
| 13425 | ncrc2220 |
| 13426 | ncrc2224 |
| 13427 | ncrc2225 |
| 13428 | ncrc2227 |
| 13429 | ncrc2232 |
| 13430 | ncrc2233 |
| 13431 | ncrc2234 |
| 13432 | ncrc2235 |
| 13433 | ncrc2236 |
| 13434 | ncrc2237 |
| 13435 | ncrc2239 |
| 13436 | ncrc2240 |
| 13437 | ncrc2241 |
| 13438 | ncrc2243 |
| 13439 | ncrc2244 |
| 13440 | ncrc2247 |
| 13441 | ncrc2248 |
| 13442 | ncrc2250 |
| 13443 | ncrc2251 |
| 13444 | ncrc2252 |
| 13445 | ncrc2254 |
| 13446 | ncrc2257 |
| 13447 | ncrc2259 |
| 13448 | ncrc2260 |
| 13449 | ncrc2261 |
| 13450 | ncrc2262 |
| 13451 | ncrc2263 |
| 13452 | ncrc2265 |
| 13453 | ncrc2266 |
| 13454 | ncrc2267 |
| 13455 | ncrc2268 |
| 13456 | ncrc2270 |
| 13457 | ncrc2271 |
| 13458 | ncrc2272 |
| 13459 | ncrc2273 |
| 13460 | ncrc2273 |
| 13461 | ncrc2277 |
| 13462 | ncrc2278 |
| 13463 | ncrc2279 |
| 13464 | ncrc2280 |
| 13465 | ncrc2281 |
| 13466 | ncrc2282 |
| 13467 | ncrc2283 |
| 13468 | ncrc2284 |
| 13469 | ncrc2285 |
| 13470 | ncrc2286 |
| 13471 | ncrc2287 |
| 13472 | ncrc2288 |
| 13473 | ncrc2289 |
| 13474 | ncrc2290 |
| 13475 | ncrc2292 |
| 13476 | ncrc2293 |
| 13477 | ncrc2295 |
| 13478 | ncrc2296 |
| 13479 | ncrc2298 |
| 13480 | ncrc2299 |
| 13481 | ncrc2300 |
| 13482 | ncrc2302 |
| 13483 | ncrc2303 |
| 13484 | ncrc2304 |
| 13485 | ncrc2305 |
| 13486 | ncrc2306 |
| 13487 | ncrc2307 |
| 13488 | ncrc2308 |
| 13489 | ncrc2311 |
| 13490 | ncrc2313 |
| 13491 | ncrc2315 |
| 13492 | ncrc2316 |
| 13493 | ncrc2317 |
| 13494 | ncrc2318 |
| 13495 | ncrc2319 |
| 13496 | ncrc2320 |
| 13497 | ncrc2321 |
| 13498 | ncrc2323 |
| 13499 | ncrc2324 |
| 13500 | ncrc2325 |

Figure 6C – List of EST Sequence Names From Normal Cartilage cDNA Library

| | | | | | | | | | |
|---|---|---|---|---|---|---|---|---|---|
| 13501 | ncrc2327 | 13561 | ncrc2429 | 13621 | ncrc2511 | 13681 | ncrc2609 | 13741 | ncrc2696 |
| 13502 | ncrc2330 | 13562 | ncrc2430 | 13622 | ncrc2512 | 13682 | ncrc2611 | 13742 | ncrc2699 |
| 13503 | ncrc2332 | 13563 | ncrc2432 | 13623 | ncrc2513 | 13683 | ncrc2612 | 13743 | ncrc2700 |
| 13504 | ncrc2333 | 13564 | ncrc2433 | 13624 | ncrc2515 | 13684 | ncrc2613 | 13744 | ncrc2701 |
| 13505 | ncrc2341 | 13565 | ncrc2437 | 13625 | ncrc2516 | 13685 | ncrc2617 | 13745 | ncrc2702 |
| 13506 | ncrc2347 | 13566 | ncrc2439 | 13626 | ncrc2517 | 13686 | ncrc2618 | 13746 | ncrc2704 |
| 13507 | ncrc2348 | 13567 | ncrc2440 | 13627 | ncrc2519 | 13687 | ncrc2619 | 13747 | ncrc2705 |
| 13508 | ncrc2355 | 13568 | ncrc2441 | 13628 | ncrc2521 | 13688 | ncrc2620 | 13748 | ncrc2708 |
| 13509 | ncrc2356 | 13569 | ncrc2442 | 13629 | ncrc2522 | 13689 | ncrc2621 | 13749 | ncrc2709 |
| 13510 | ncrc2357 | 13570 | ncrc2443 | 13630 | ncrc2523 | 13690 | ncrc2622 | 13750 | ncrc2711 |
| 13511 | ncrc2359 | 13571 | ncrc2444 | 13631 | ncrc2524 | 13691 | ncrc2625 | 13751 | ncrc2712 |
| 13512 | ncrc2360 | 13572 | ncrc2446 | 13632 | ncrc2528 | 13692 | ncrc2627 | 13752 | ncrc2713 |
| 13513 | ncrc2363 | 13573 | ncrc2447 | 13633 | ncrc2529 | 13693 | ncrc2628 | 13753 | ncrc2715 |
| 13514 | ncrc2365 | 13574 | ncrc2448 | 13634 | ncrc2531 | 13694 | ncrc2631 | 13754 | ncrc2716 |
| 13515 | ncrc2366 | 13575 | ncrc2451 | 13635 | ncrc2532 | 13695 | ncrc2632 | 13755 | ncrc2718 |
| 13516 | ncrc2367 | 13576 | ncrc2452 | 13636 | ncrc2533 | 13696 | ncrc2633 | 13756 | ncrc2719 |
| 13517 | ncrc2368 | 13577 | ncrc2453 | 13637 | ncrc2535 | 13697 | ncrc2635 | 13757 | ncrc2720 |
| 13518 | ncrc2369 | 13578 | ncrc2454 | 13638 | ncrc2536 | 13698 | ncrc2638 | 13758 | ncrc2724 |
| 13519 | ncrc2371 | 13579 | ncrc2458 | 13639 | ncrc2537 | 13699 | ncrc2639 | 13759 | ncrc2725 |
| 13520 | ncrc2374 | 13580 | ncrc2459 | 13640 | ncrc2538 | 13700 | ncrc2641 | 13760 | ncrc2727 |
| 13521 | ncrc2375 | 13581 | ncrc2460 | 13641 | ncrc2539 | 13701 | ncrc2643 | 13761 | ncrc2729 |
| 13522 | ncrc2376 | 13582 | ncrc2461 | 13642 | ncrc2540 | 13702 | ncrc2644 | 13762 | ncrc2730 |
| 13523 | ncrc2377 | 13583 | ncrc2462 | 13643 | ncrc2542 | 13703 | ncrc2645 | 13763 | ncrc2731 |
| 13524 | ncrc2378 | 13584 | ncrc2463 | 13644 | ncrc2551 | 13704 | ncrc2647 | 13764 | ncrc2733 |
| 13525 | ncrc2379 | 13585 | ncrc2464 | 13645 | ncrc2553 | 13705 | ncrc2648 | 13765 | ncrc2734 |
| 13526 | ncrc2380 | 13586 | ncrc2466 | 13646 | ncrc2555 | 13706 | ncrc2649 | 13766 | ncrc2735 |
| 13527 | ncrc2381 | 13587 | ncrc2467 | 13647 | ncrc2556 | 13707 | ncrc2650 | 13767 | ncrc2736 |
| 13528 | ncrc2382 | 13588 | ncrc2468 | 13648 | ncrc2557 | 13708 | ncrc2654 | 13768 | ncrc2744 |
| 13529 | ncrc2383 | 13589 | ncrc2469 | 13649 | ncrc2558 | 13709 | ncrc2655 | 13769 | ncrc2745 |
| 13530 | ncrc2384 | 13590 | ncrc2470 | 13650 | ncrc2560 | 13710 | ncrc2656 | 13770 | ncrc2746 |
| 13531 | ncrc2387 | 13591 | ncrc2471 | 13651 | ncrc2563 | 13711 | ncrc2657 | 13771 | ncrc2747 |
| 13532 | ncrc2388 | 13592 | ncrc2472 | 13652 | ncrc2564 | 13712 | ncrc2659 | 13772 | ncrc2748 |
| 13533 | ncrc2391 | 13593 | ncrc2474 | 13653 | ncrc2567 | 13713 | ncrc2661 | 13773 | ncrc2749 |
| 13534 | ncrc2392 | 13594 | ncrc2475 | 13654 | ncrc2568 | 13714 | ncrc2662 | 13774 | ncrc2752 |
| 13535 | ncrc2393 | 13595 | ncrc2476 | 13655 | ncrc2569 | 13715 | ncrc2663 | 13775 | ncrc2756 |
| 13536 | ncrc2394 | 13596 | ncrc2477 | 13656 | ncrc2571 | 13716 | ncrc2665 | 13776 | ncrc2758 |
| 13537 | ncrc2395 | 13597 | ncrc2478 | 13657 | ncrc2572 | 13717 | ncrc2666 | 13777 | ncrc2759 |
| 13538 | ncrc2396 | 13598 | ncrc2480 | 13658 | ncrc2575 | 13718 | ncrc2667 | 13778 | ncrc2760 |
| 13539 | ncrc2397 | 13599 | ncrc2481 | 13659 | ncrc2576 | 13719 | ncrc2668 | 13779 | ncrc2761 |
| 13540 | ncrc2400 | 13600 | ncrc2482 | 13660 | ncrc2577 | 13720 | ncrc2669 | 13780 | ncrc2762 |
| 13541 | ncrc2401 | 13601 | ncrc2483 | 13661 | ncrc2578 | 13721 | ncrc2670 | 13781 | ncrc2763 |
| 13542 | ncrc2402 | 13602 | ncrc2484 | 13662 | ncrc2579 | 13722 | ncrc2671 | 13782 | ncrc2765 |
| 13543 | ncrc2403 | 13603 | ncrc2485 | 13663 | ncrc2580 | 13723 | ncrc2673 | 13783 | ncrc2768 |
| 13544 | ncrc2404 | 13604 | ncrc2488 | 13664 | ncrc2581 | 13724 | ncrc2674 | 13784 | ncrc2769 |
| 13545 | ncrc2407 | 13605 | ncrc2490 | 13665 | ncrc2583 | 13725 | ncrc2675 | 13785 | ncrc2771 |
| 13546 | ncrc2408 | 13606 | ncrc2491 | 13666 | ncrc2584 | 13726 | ncrc2676 | 13786 | ncrc2772 |
| 13547 | ncrc2409 | 13607 | ncrc2492 | 13667 | ncrc2585 | 13727 | ncrc2677 | 13787 | ncrc2775 |
| 13548 | ncrc2411 | 13608 | ncrc2493 | 13668 | ncrc2586 | 13728 | ncrc2680 | 13788 | ncrc2776 |
| 13549 | ncrc2412 | 13609 | ncrc2494 | 13669 | ncrc2587 | 13729 | ncrc2681 | 13789 | ncrc2779 |
| 13550 | ncrc2413 | 13610 | ncrc2495 | 13670 | ncrc2588 | 13730 | ncrc2682 | 13790 | ncrc2780 |
| 13551 | ncrc2415 | 13611 | ncrc2496 | 13671 | ncrc2590 | 13731 | ncrc2683 | 13791 | ncrc2784 |
| 13552 | ncrc2416 | 13612 | ncrc2497 | 13672 | ncrc2591 | 13732 | ncrc2685 | 13792 | ncrc2785 |
| 13553 | ncrc2417 | 13613 | ncrc2499 | 13673 | ncrc2592 | 13733 | ncrc2686 | 13793 | ncrc2786 |
| 13554 | ncrc2421 | 13614 | ncrc2500 | 13674 | ncrc2593 | 13734 | ncrc2687 | 13794 | ncrc2788 |
| 13555 | ncrc2423 | 13615 | ncrc2503 | 13675 | ncrc2595 | 13735 | ncrc2689 | 13795 | ncrc2791 |
| 13556 | ncrc2424 | 13616 | ncrc2504 | 13676 | ncrc2596 | 13736 | ncrc2690 | 13796 | ncrc2793 |
| 13557 | ncrc2425 | 13617 | ncrc2505 | 13677 | ncrc2600 | 13737 | ncrc2691 | 13797 | ncrc2795 |
| 13558 | ncrc2426 | 13618 | ncrc2507 | 13678 | ncrc2601 | 13738 | ncrc2692 | 13798 | ncrc2796 |
| 13559 | ncrc2427 | 13619 | ncrc2508 | 13679 | ncrc2603 | 13739 | ncrc2693 | 13799 | ncrc2799 |
| 13560 | ncrc2428 | 13620 | ncrc2509 | 13680 | ncrc2607 | 13740 | ncrc2695 | 13800 | ncrc2800 |

Figure 6C – List of EST Sequence Names From Normal Cartilage cDNA Library

| | | | | | | | | | |
|---|---|---|---|---|---|---|---|---|---|
| 13801 | ncrc2801 | 13861 | ncrc2893 | 13921 | ncrc2985 | 13981 | ncrc3072 | 14041 | ncrc3161 |
| 13802 | ncrc2804 | 13862 | ncrc2894 | 13922 | ncrc2988 | 13982 | ncrc3073 | 14042 | ncrc3165 |
| 13803 | ncrc2807 | 13863 | ncrc2895 | 13923 | ncrc2989 | 13983 | ncrc3074 | 14043 | ncrc3167 |
| 13804 | ncrc2808 | 13864 | ncrc2896 | 13924 | ncrc2991 | 13984 | ncrc3075 | 14044 | ncrc3168 |
| 13805 | ncrc2811 | 13865 | ncrc2897 | 13925 | ncrc2993 | 13985 | ncrc3076 | 14045 | ncrc3169 |
| 13806 | ncrc2812 | 13866 | ncrc2900 | 13926 | ncrc2995 | 13986 | ncrc3079 | 14046 | ncrc3171 |
| 13807 | ncrc2813 | 13867 | ncrc2904 | 13927 | ncrc2997 | 13987 | ncrc3080 | 14047 | ncrc3172 |
| 13808 | ncrc2814 | 13868 | ncrc2905 | 13928 | ncrc2999 | 13988 | ncrc3083 | 14048 | ncrc3175 |
| 13809 | ncrc2815 | 13869 | ncrc2907 | 13929 | ncrc3002 | 13989 | ncrc3084 | 14049 | ncrc3177 |
| 13810 | ncrc2816 | 13870 | ncrc2909 | 13930 | ncrc3003 | 13990 | ncrc3085 | 14050 | ncrc3179 |
| 13811 | ncrc2817 | 13871 | ncrc2910 | 13931 | ncrc3004 | 13991 | ncrc3086 | 14051 | ncrc3180 |
| 13812 | ncrc2819 | 13872 | ncrc2911 | 13932 | ncrc3005 | 13992 | ncrc3087 | 14052 | ncrc3181 |
| 13813 | ncrc2820 | 13873 | ncrc2912 | 13933 | ncrc3007 | 13993 | ncrc3089 | 14053 | ncrc3188 |
| 13814 | ncrc2821 | 13874 | ncrc2913 | 13934 | ncrc3008 | 13994 | ncrc3091 | 14054 | ncrc3193 |
| 13815 | ncrc2824 | 13875 | ncrc2916 | 13935 | ncrc3009 | 13995 | ncrc3092 | 14055 | ncrc3194 |
| 13816 | ncrc2825 | 13876 | ncrc2917 | 13936 | ncrc3011 | 13996 | ncrc3093 | 14056 | ncrc3195 |
| 13817 | ncrc2826 | 13877 | ncrc2919 | 13937 | ncrc3012 | 13997 | ncrc3095 | 14057 | ncrc3196 |
| 13818 | ncrc2827 | 13878 | ncrc2920 | 13938 | ncrc3013 | 13998 | ncrc3096 | 14058 | ncrc3197 |
| 13819 | ncrc2828 | 13879 | ncrc2921 | 13939 | ncrc3016 | 13999 | ncrc3097 | 14059 | ncrc3198 |
| 13820 | ncrc2829 | 13880 | ncrc2922 | 13940 | ncrc3018 | 14000 | ncrc3098 | 14060 | ncrc3199 |
| 13821 | ncrc2830 | 13881 | ncrc2923 | 13941 | ncrc3020 | 14001 | ncrc3100 | 14061 | ncrc3200 |
| 13822 | ncrc2831 | 13882 | ncrc2924 | 13942 | ncrc3022 | 14002 | ncrc3102 | 14062 | ncrc3201 |
| 13823 | ncrc2832 | 13883 | ncrc2926 | 13943 | ncrc3023 | 14003 | ncrc3103 | 14063 | ncrc3203 |
| 13824 | ncrc2833 | 13884 | ncrc2927 | 13944 | ncrc3025 | 14004 | ncrc3104 | 14064 | ncrc3204 |
| 13825 | ncrc2835 | 13885 | ncrc2928 | 13945 | ncrc3027 | 14005 | ncrc3107 | 14065 | ncrc3207 |
| 13826 | ncrc2836 | 13886 | ncrc2929 | 13946 | ncrc3028 | 14006 | ncrc3108 | 14066 | ncrc3208 |
| 13827 | ncrc2839 | 13887 | ncrc2933 | 13947 | ncrc3029 | 14007 | ncrc3111 | 14067 | ncrc3211 |
| 13828 | ncrc2840 | 13888 | ncrc2935 | 13948 | ncrc3030 | 14008 | ncrc3112 | 14068 | ncrc3214 |
| 13829 | ncrc2841 | 13889 | ncrc2937 | 13949 | ncrc3031 | 14009 | ncrc3114 | 14069 | ncrc3215 |
| 13830 | ncrc2842 | 13890 | ncrc2938 | 13950 | ncrc3033 | 14010 | ncrc3115 | 14070 | ncrc3216 |
| 13831 | ncrc2847 | 13891 | ncrc2939 | 13951 | ncrc3034 | 14011 | ncrc3116 | 14071 | ncrc3217 |
| 13832 | ncrc2848 | 13892 | ncrc2940 | 13952 | ncrc3035 | 14012 | ncrc3119 | 14072 | ncrc3219 |
| 13833 | ncrc2849 | 13893 | ncrc2941 | 13953 | ncrc3036 | 14013 | ncrc3120 | 14073 | ncrc3220 |
| 13834 | ncrc2850 | 13894 | ncrc2942 | 13954 | ncrc3039 | 14014 | ncrc3121 | 14074 | ncrc3223 |
| 13835 | ncrc2852 | 13895 | ncrc2943 | 13955 | ncrc3040 | 14015 | ncrc3124 | 14075 | ncrc3225 |
| 13836 | ncrc2853 | 13896 | ncrc2944 | 13956 | ncrc3041 | 14016 | ncrc3126 | 14076 | ncrc3226 |
| 13837 | ncrc2855 | 13897 | ncrc2945 | 13957 | ncrc3043 | 14017 | ncrc3127 | 14077 | ncrc3227 |
| 13838 | ncrc2856 | 13898 | ncrc2948 | 13958 | ncrc3044 | 14018 | ncrc3128 | 14078 | ncrc3228 |
| 13839 | ncrc2857 | 13899 | ncrc2949 | 13959 | ncrc3045 | 14019 | ncrc3129 | 14079 | ncrc3230 |
| 13840 | ncrc2859 | 13900 | ncrc2950 | 13960 | ncrc3046 | 14020 | ncrc3130 | 14080 | ncrc3231 |
| 13841 | ncrc2861 | 13901 | ncrc2953 | 13961 | ncrc3047 | 14021 | ncrc3131 | 14081 | ncrc3233 |
| 13842 | ncrc2862 | 13902 | ncrc2955 | 13962 | ncrc3049 | 14022 | ncrc3132 | 14082 | ncrc3235 |
| 13843 | ncrc2863 | 13903 | ncrc2956 | 13963 | ncrc3050 | 14023 | ncrc3133 | 14083 | ncrc3236 |
| 13844 | ncrc2864 | 13904 | ncrc2957 | 13964 | ncrc3051 | 14024 | ncrc3135 | 14084 | ncrc3237 |
| 13845 | ncrc2865 | 13905 | ncrc2958 | 13965 | ncrc3052 | 14025 | ncrc3136 | 14085 | ncrc3238 |
| 13846 | ncrc2868 | 13906 | ncrc2959 | 13966 | ncrc3053 | 14026 | ncrc3137 | 14086 | ncrc3240 |
| 13847 | ncrc2869 | 13907 | ncrc2960 | 13967 | ncrc3054 | 14027 | ncrc3141 | 14087 | ncrc3241 |
| 13848 | ncrc2871 | 13908 | ncrc2961 | 13968 | ncrc3055 | 14028 | ncrc3144 | 14088 | ncrc3242 |
| 13849 | ncrc2872 | 13909 | ncrc2963 | 13969 | ncrc3056 | 14029 | ncrc3145 | 14089 | ncrc3243 |
| 13850 | ncrc2873 | 13910 | ncrc2965 | 13970 | ncrc3057 | 14030 | ncrc3148 | 14090 | ncrc3244 |
| 13851 | ncrc2874 | 13911 | ncrc2967 | 13971 | ncrc3059 | 14031 | ncrc3149 | 14091 | ncrc3245 |
| 13852 | ncrc2876 | 13912 | ncrc2968 | 13972 | ncrc3060 | 14032 | ncrc3150 | 14092 | ncrc3246 |
| 13853 | ncrc2878 | 13913 | ncrc2969 | 13973 | ncrc3061 | 14033 | ncrc3151 | 14093 | ncrc3248 |
| 13854 | ncrc2879 | 13914 | ncrc2970 | 13974 | ncrc3063 | 14034 | ncrc3152 | 14094 | ncrc3250 |
| 13855 | ncrc2880 | 13915 | ncrc2971 | 13975 | ncrc3065 | 14035 | ncrc3153 | 14095 | ncrc3252 |
| 13856 | ncrc2881 | 13916 | ncrc2972 | 13976 | ncrc3066 | 14036 | ncrc3154 | 14096 | ncrc3253 |
| 13857 | ncrc2884 | 13917 | ncrc2974 | 13977 | ncrc3067 | 14037 | ncrc3155 | 14097 | ncrc3255 |
| 13858 | ncrc2887 | 13918 | ncrc2975 | 13978 | ncrc3068 | 14038 | ncrc3156 | 14098 | ncrc3256 |
| 13859 | ncrc2888 | 13919 | ncrc2976 | 13979 | ncrc3070 | 14039 | ncrc3157 | 14099 | ncrc3257 |
| 13860 | ncrc2891 | 13920 | ncrc2984 | 13980 | ncrc3071 | 14040 | ncrc3159 | 14100 | ncrc3258 |

Figure 6C – List of EST Sequence Names From Normal Cartilage cDNA Library

| | | | | | | | | | |
|---|---|---|---|---|---|---|---|---|---|
| 14101 | ncrc3259 | 14161 | ncrc3358 | 14221 | ncrc3451 | 14281 | ncrc3544 | 14341 | ncrc3641 |
| 14102 | ncrc3260 | 14162 | ncrc3359 | 14222 | ncrc3452 | 14282 | ncrc3546 | 14342 | ncrc3642 |
| 14103 | ncrc3263 | 14163 | ncrc3360 | 14223 | ncrc3453 | 14283 | ncrc3547 | 14343 | ncrc3643 |
| 14104 | ncrc3268 | 14164 | ncrc3361 | 14224 | ncrc3454 | 14284 | ncrc3548 | 14344 | ncrc3644 |
| 14105 | ncrc3271 | 14165 | ncrc3362 | 14225 | ncrc3455 | 14285 | ncrc3549 | 14345 | ncrc3645 |
| 14106 | ncrc3272 | 14166 | ncrc3364 | 14226 | ncrc3456 | 14286 | ncrc3550 | 14346 | ncrc3646 |
| 14107 | ncrc3276 | 14167 | ncrc3367 | 14227 | ncrc3457 | 14287 | ncrc3551 | 14347 | ncrc3647 |
| 14108 | ncrc3277 | 14168 | ncrc3369 | 14228 | ncrc3459 | 14288 | ncrc3552 | 14348 | ncrc3648 |
| 14109 | ncrc3279 | 14169 | ncrc3372 | 14229 | ncrc3460 | 14289 | ncrc3554 | 14349 | ncrc3650 |
| 14110 | ncrc3281 | 14170 | ncrc3375 | 14230 | ncrc3461 | 14290 | ncrc3556 | 14350 | ncrc3651 |
| 14111 | ncrc3283 | 14171 | ncrc3376 | 14231 | ncrc3462 | 14291 | ncrc3559 | 14351 | ncrc3652 |
| 14112 | ncrc3285 | 14172 | ncrc3377 | 14232 | ncrc3463 | 14292 | ncrc3560 | 14352 | ncrc3655 |
| 14113 | ncrc3287 | 14173 | ncrc3380 | 14233 | ncrc3464 | 14293 | ncrc3563 | 14353 | ncrc3656 |
| 14114 | ncrc3288 | 14174 | ncrc3381 | 14234 | ncrc3465 | 14294 | ncrc3564 | 14354 | ncrc3657 |
| 14115 | ncrc3289 | 14175 | ncrc3383 | 14235 | ncrc3467 | 14295 | ncrc3568 | 14355 | ncrc3661 |
| 14116 | ncrc3290 | 14176 | ncrc3387 | 14236 | ncrc3468 | 14296 | ncrc3569 | 14356 | ncrc3664 |
| 14117 | ncrc3291 | 14177 | ncrc3388 | 14237 | ncrc3469 | 14297 | ncrc3571 | 14357 | ncrc3667 |
| 14118 | ncrc3292 | 14178 | ncrc3389 | 14238 | ncrc3471 | 14298 | ncrc3573 | 14358 | ncrc3671 |
| 14119 | ncrc3295 | 14179 | ncrc3390 | 14239 | ncrc3473 | 14299 | ncrc3575 | 14359 | ncrc3672 |
| 14120 | ncrc3296 | 14180 | ncrc3391 | 14240 | ncrc3475 | 14300 | ncrc3576 | 14360 | ncrc3676 |
| 14121 | ncrc3299 | 14181 | ncrc3392 | 14241 | ncrc3479 | 14301 | ncrc3577 | 14361 | ncrc3677 |
| 14122 | ncrc3300 | 14182 | ncrc3393 | 14242 | ncrc3480 | 14302 | ncrc3579 | 14362 | ncrc3678 |
| 14123 | ncrc3301 | 14183 | ncrc3395 | 14243 | ncrc3487 | 14303 | ncrc3581 | 14363 | ncrc3679 |
| 14124 | ncrc3303 | 14184 | ncrc3396 | 14244 | ncrc3488 | 14304 | ncrc3582 | 14364 | ncrc3680 |
| 14125 | ncrc3304 | 14185 | ncrc3400 | 14245 | ncrc3489 | 14305 | ncrc3585 | 14365 | ncrc3681 |
| 14126 | ncrc3305 | 14186 | ncrc3401 | 14246 | ncrc3491 | 14306 | ncrc3587 | 14366 | ncrc3683 |
| 14127 | ncrc3306 | 14187 | ncrc3403 | 14247 | ncrc3493 | 14307 | ncrc3589 | 14367 | ncrc3684 |
| 14128 | ncrc3307 | 14188 | ncrc3404 | 14248 | ncrc3495 | 14308 | ncrc3593 | 14368 | ncrc3685 |
| 14129 | ncrc3310 | 14189 | ncrc3407 | 14249 | ncrc3496 | 14309 | ncrc3594 | 14369 | ncrc3688 |
| 14130 | ncrc3312 | 14190 | ncrc3408 | 14250 | ncrc3497 | 14310 | ncrc3595 | 14370 | ncrc3689 |
| 14131 | ncrc3313 | 14191 | ncrc3409 | 14251 | ncrc3499 | 14311 | ncrc3596 | 14371 | ncrc3690 |
| 14132 | ncrc3315 | 14192 | ncrc3413 | 14252 | ncrc3500 | 14312 | ncrc3598 | 14372 | ncrc3691 |
| 14133 | ncrc3316 | 14193 | ncrc3415 | 14253 | ncrc3503 | 14313 | ncrc3599 | 14373 | ncrc3692 |
| 14134 | ncrc3317 | 14194 | ncrc3416 | 14254 | ncrc3504 | 14314 | ncrc3601 | 14374 | ncrc3695 |
| 14135 | ncrc3318 | 14195 | ncrc3417 | 14255 | ncrc3505 | 14315 | ncrc3604 | 14375 | ncrc3697 |
| 14136 | ncrc3319 | 14196 | ncrc3418 | 14256 | ncrc3507 | 14316 | ncrc3605 | 14376 | ncrc3699 |
| 14137 | ncrc3321 | 14197 | ncrc3419 | 14257 | ncrc3508 | 14317 | ncrc3606 | 14377 | ncrc3700 |
| 14138 | ncrc3324 | 14198 | ncrc3421 | 14258 | ncrc3509 | 14318 | ncrc3607 | 14378 | ncrc3701 |
| 14139 | ncrc3325 | 14199 | ncrc3422 | 14259 | ncrc3513 | 14319 | ncrc3609 | 14379 | ncrc3702 |
| 14140 | ncrc3326 | 14200 | ncrc3423 | 14260 | ncrc3514 | 14320 | ncrc3610 | 14380 | ncrc3703 |
| 14141 | ncrc3327 | 14201 | ncrc3424 | 14261 | ncrc3515 | 14321 | ncrc3611 | 14381 | ncrc3704 |
| 14142 | ncrc3328 | 14202 | ncrc3425 | 14262 | ncrc3516 | 14322 | ncrc3613 | 14382 | ncrc3705 |
| 14143 | ncrc3330 | 14203 | ncrc3427 | 14263 | ncrc3518 | 14323 | ncrc3616 | 14383 | ncrc3706 |
| 14144 | ncrc3332 | 14204 | ncrc3428 | 14264 | ncrc3520 | 14324 | ncrc3617 | 14384 | ncrc3707 |
| 14145 | ncrc3334 | 14205 | ncrc3429 | 14265 | ncrc3521 | 14325 | ncrc3620 | 14385 | ncrc3708 |
| 14146 | ncrc3335 | 14206 | ncrc3431 | 14266 | ncrc3523 | 14326 | ncrc3621 | 14386 | ncrc3709 |
| 14147 | ncrc3336 | 14207 | ncrc3432 | 14267 | ncrc3524 | 14327 | ncrc3622 | 14387 | ncrc3710 |
| 14148 | ncrc3338 | 14208 | ncrc3433 | 14268 | ncrc3525 | 14328 | ncrc3623 | 14388 | ncrc3712 |
| 14149 | ncrc3341 | 14209 | ncrc3434 | 14269 | ncrc3526 | 14329 | ncrc3624 | 14389 | ncrc3713 |
| 14150 | ncrc3342 | 14210 | ncrc3435 | 14270 | ncrc3529 | 14330 | ncrc3625 | 14390 | ncrc3715 |
| 14151 | ncrc3343 | 14211 | ncrc3436 | 14271 | ncrc3530 | 14331 | ncrc3626 | 14391 | ncrc3717 |
| 14152 | ncrc3344 | 14212 | ncrc3437 | 14272 | ncrc3532 | 14332 | ncrc3628 | 14392 | ncrc3718 |
| 14153 | ncrc3345 | 14213 | ncrc3439 | 14273 | ncrc3534 | 14333 | ncrc3630 | 14393 | ncrc3719 |
| 14154 | ncrc3347 | 14214 | ncrc3440 | 14274 | ncrc3535 | 14334 | ncrc3631 | 14394 | ncrc3720 |
| 14155 | ncrc3349 | 14215 | ncrc3442 | 14275 | ncrc3536 | 14335 | ncrc3632 | 14395 | ncrc3721 |
| 14156 | ncrc3351 | 14216 | ncrc3443 | 14276 | ncrc3537 | 14336 | ncrc3633 | 14396 | ncrc3722 |
| 14157 | ncrc3352 | 14217 | ncrc3444 | 14277 | ncrc3538 | 14337 | ncrc3634 | 14397 | ncrc3723 |
| 14158 | ncrc3354 | 14218 | ncrc3445 | 14278 | ncrc3540 | 14338 | ncrc3635 | 14398 | ncrc3724 |
| 14159 | ncrc3355 | 14219 | ncrc3447 | 14279 | ncrc3541 | 14339 | ncrc3637 | 14399 | ncrc3725 |
| 14160 | ncrc3356 | 14220 | ncrc3449 | 14280 | ncrc3543 | 14340 | ncrc3640 | 14400 | ncrc3727 |

Figure 6C – List of EST Sequence Names From Normal Cartilage cDNA Library

| | | | | | | | | | |
|---|---|---|---|---|---|---|---|---|---|
| 14401 | ncrc3728 | 14461 | ncrc3827 | 14521 | ncrc3916 | 14581 | ncrc4011 | 14641 | ncrc4101 |
| 14402 | ncrc3731 | 14462 | ncrc3828 | 14522 | ncrc3917 | 14582 | ncrc4012 | 14642 | ncrc4102 |
| 14403 | ncrc3733 | 14463 | ncrc3829 | 14523 | ncrc3918 | 14583 | ncrc4014 | 14643 | ncrc4103 |
| 14404 | ncrc3735 | 14464 | ncrc3832 | 14524 | ncrc3919 | 14584 | ncrc4015 | 14644 | ncrc4104 |
| 14405 | ncrc3736 | 14465 | ncrc3833 | 14525 | ncrc3920 | 14585 | ncrc4016 | 14645 | ncrc4105 |
| 14406 | ncrc3737 | 14466 | ncrc3837 | 14526 | ncrc3921 | 14586 | ncrc4017 | 14646 | ncrc4106 |
| 14407 | ncrc3738 | 14467 | ncrc3838 | 14527 | ncrc3922 | 14587 | ncrc4020 | 14647 | ncrc4107 |
| 14408 | ncrc3740 | 14468 | ncrc3839 | 14528 | ncrc3923 | 14588 | ncrc4021 | 14648 | ncrc4108 |
| 14409 | ncrc3743 | 14469 | ncrc3840 | 14529 | ncrc3925 | 14589 | ncrc4023 | 14649 | ncrc4109 |
| 14410 | ncrc3744 | 14470 | ncrc3841 | 14530 | ncrc3927 | 14590 | ncrc4024 | 14650 | ncrc4111 |
| 14411 | ncrc3748 | 14471 | ncrc3842 | 14531 | ncrc3928 | 14591 | ncrc4025 | 14651 | ncrc4112 |
| 14412 | ncrc3749 | 14472 | ncrc3844 | 14532 | ncrc3930 | 14592 | ncrc4026 | 14652 | ncrc4113 |
| 14413 | ncrc3750 | 14473 | ncrc3847 | 14533 | ncrc3932 | 14593 | ncrc4027 | 14653 | ncrc4114 |
| 14414 | ncrc3751 | 14474 | ncrc3849 | 14534 | ncrc3933 | 14594 | ncrc4028 | 14654 | ncrc4116 |
| 14415 | ncrc3752 | 14475 | ncrc3851 | 14535 | ncrc3934 | 14595 | ncrc4029 | 14655 | ncrc4117 |
| 14416 | ncrc3753 | 14476 | ncrc3852 | 14536 | ncrc3935 | 14596 | ncrc4030 | 14656 | ncrc4119 |
| 14417 | ncrc3754 | 14477 | ncrc3853 | 14537 | ncrc3935 | 14597 | ncrc4032 | 14657 | ncrc4120 |
| 14418 | ncrc3755 | 14478 | ncrc3855 | 14538 | ncrc3936 | 14598 | ncrc4033 | 14658 | ncrc4121 |
| 14419 | ncrc3756 | 14479 | ncrc3856 | 14539 | ncrc3937 | 14599 | ncrc4034 | 14659 | ncrc4122 |
| 14420 | ncrc3757 | 14480 | ncrc3857 | 14540 | ncrc3938 | 14600 | ncrc4036 | 14660 | ncrc4123 |
| 14421 | ncrc3759 | 14481 | ncrc3859 | 14541 | ncrc3939 | 14601 | ncrc4040 | 14661 | ncrc4124 |
| 14422 | ncrc3761 | 14482 | ncrc3860 | 14542 | ncrc3945 | 14602 | ncrc4041 | 14662 | ncrc4125 |
| 14423 | ncrc3762 | 14483 | ncrc3861 | 14543 | ncrc3952 | 14603 | ncrc4043 | 14663 | ncrc4128 |
| 14424 | ncrc3763 | 14484 | ncrc3863 | 14544 | ncrc3953 | 14604 | ncrc4044 | 14664 | ncrc4129 |
| 14425 | ncrc3764 | 14485 | ncrc3864 | 14545 | ncrc3955 | 14605 | ncrc4045 | 14665 | ncrc4130 |
| 14426 | ncrc3765 | 14486 | ncrc3865 | 14546 | ncrc3956 | 14606 | ncrc4047 | 14666 | ncrc4131 |
| 14427 | ncrc3766 | 14487 | ncrc3866 | 14547 | ncrc3957 | 14607 | ncrc4048 | 14667 | ncrc4132 |
| 14428 | ncrc3767 | 14488 | ncrc3867 | 14548 | ncrc3959 | 14608 | ncrc4049 | 14668 | ncrc4135 |
| 14429 | ncrc3769 | 14489 | ncrc3869 | 14549 | ncrc3960 | 14609 | ncrc4052 | 14669 | ncrc4136 |
| 14430 | ncrc3772 | 14490 | ncrc3870 | 14550 | ncrc3962 | 14610 | ncrc4055 | 14670 | ncrc4137 |
| 14431 | ncrc3773 | 14491 | ncrc3872 | 14551 | ncrc3964 | 14611 | ncrc4057 | 14671 | ncrc4139 |
| 14432 | ncrc3775 | 14492 | ncrc3873 | 14552 | ncrc3968 | 14612 | ncrc4059 | 14672 | ncrc4140 |
| 14433 | ncrc3776 | 14493 | ncrc3875 | 14553 | ncrc3969 | 14613 | ncrc4060 | 14673 | ncrc4141 |
| 14434 | ncrc3777 | 14494 | ncrc3876 | 14554 | ncrc3971 | 14614 | ncrc4063 | 14674 | ncrc4143 |
| 14435 | ncrc3778 | 14495 | ncrc3877 | 14555 | ncrc3972 | 14615 | ncrc4065 | 14675 | ncrc4144 |
| 14436 | ncrc3781 | 14496 | ncrc3879 | 14556 | ncrc3975 | 14616 | ncrc4067 | 14676 | ncrc4145 |
| 14437 | ncrc3782 | 14497 | ncrc3880 | 14557 | ncrc3976 | 14617 | ncrc4068 | 14677 | ncrc4146 |
| 14438 | ncrc3785 | 14498 | ncrc3881 | 14558 | ncrc3978 | 14618 | ncrc4069 | 14678 | ncrc4147 |
| 14439 | ncrc3786 | 14499 | ncrc3882 | 14559 | ncrc3979 | 14619 | ncrc4071 | 14679 | ncrc4148 |
| 14440 | ncrc3787 | 14500 | ncrc3883 | 14560 | ncrc3980 | 14620 | ncrc4072 | 14680 | ncrc4152 |
| 14441 | ncrc3790 | 14501 | ncrc3886 | 14561 | ncrc3982 | 14621 | ncrc4073 | 14681 | ncrc4153 |
| 14442 | ncrc3791 | 14502 | ncrc3887 | 14562 | ncrc3983 | 14622 | ncrc4074 | 14682 | ncrc4154 |
| 14443 | ncrc3794 | 14503 | ncrc3888 | 14563 | ncrc3984 | 14623 | ncrc4075 | 14683 | ncrc4159 |
| 14444 | ncrc3795 | 14504 | ncrc3889 | 14564 | ncrc3987 | 14624 | ncrc4076 | 14684 | ncrc4160 |
| 14445 | ncrc3797 | 14505 | ncrc3891 | 14565 | ncrc3988 | 14625 | ncrc4079 | 14685 | ncrc4163 |
| 14446 | ncrc3798 | 14506 | ncrc3893 | 14566 | ncrc3991 | 14626 | ncrc4080 | 14686 | ncrc4164 |
| 14447 | ncrc3799 | 14507 | ncrc3895 | 14567 | ncrc3992 | 14627 | ncrc4081 | 14687 | ncrc4165 |
| 14448 | ncrc3801 | 14508 | ncrc3896 | 14568 | ncrc3993 | 14628 | ncrc4084 | 14688 | ncrc4168 |
| 14449 | ncrc3802 | 14509 | ncrc3897 | 14569 | ncrc3994 | 14629 | ncrc4085 | 14689 | ncrc4169 |
| 14450 | ncrc3803 | 14510 | ncrc3898 | 14570 | ncrc3995 | 14630 | ncrc4086 | 14690 | ncrc4170 |
| 14451 | ncrc3805 | 14511 | ncrc3899 | 14571 | ncrc3998 | 14631 | ncrc4087 | 14691 | ncrc4171 |
| 14452 | ncrc3807 | 14512 | ncrc3900 | 14572 | ncrc3999 | 14632 | ncrc4088 | 14692 | ncrc4175 |
| 14453 | ncrc3810 | 14513 | ncrc3901 | 14573 | ncrc4000 | 14633 | ncrc4089 | 14693 | ncrc4177 |
| 14454 | ncrc3813 | 14514 | ncrc3903 | 14574 | ncrc4001 | 14634 | ncrc4090 | 14694 | ncrc4179 |
| 14455 | ncrc3814 | 14515 | ncrc3904 | 14575 | ncrc4004 | 14635 | ncrc4092 | 14695 | ncrc4180 |
| 14456 | ncrc3816 | 14516 | ncrc3905 | 14576 | ncrc4005 | 14636 | ncrc4093 | 14696 | ncrc4182 |
| 14457 | ncrc3817 | 14517 | ncrc3908 | 14577 | ncrc4006 | 14637 | ncrc4095 | 14697 | ncrc4183 |
| 14458 | ncrc3821 | 14518 | ncrc3909 | 14578 | ncrc4007 | 14638 | ncrc4097 | 14698 | ncrc4184 |
| 14459 | ncrc3825 | 14519 | ncrc3911 | 14579 | ncrc4009 | 14639 | ncrc4098 | 14699 | ncrc4185 |
| 14460 | ncrc3826 | 14520 | ncrc3914 | 14580 | ncrc4010 | 14640 | ncrc4099 | 14700 | ncrc4186 |

Figure 6C – List of EST Sequence Names From Normal Cartilage cDNA Library

| | | | | | | | | | |
|---|---|---|---|---|---|---|---|---|---|
| 14701 | ncrc4187 | 14761 | ncrc4273 | 14821 | ncrc4359 | 14881 | ncrc4459 | 14941 | ncrc4554 |
| 14702 | ncrc4188 | 14762 | ncrc4275 | 14822 | ncrc4361 | 14882 | ncrc4460 | 14942 | ncrc4555 |
| 14703 | ncrc4189 | 14763 | ncrc4276 | 14823 | ncrc4362 | 14883 | ncrc4464 | 14943 | ncrc4556 |
| 14704 | ncrc4190 | 14764 | ncrc4279 | 14824 | ncrc4366 | 14884 | ncrc4467 | 14944 | ncrc4559 |
| 14705 | ncrc4191 | 14765 | ncrc4280 | 14825 | ncrc4367 | 14885 | ncrc4469 | 14945 | ncrc4561 |
| 14706 | ncrc4192 | 14766 | ncrc4281 | 14826 | ncrc4368 | 14886 | ncrc4471 | 14946 | ncrc4563 |
| 14707 | ncrc4193 | 14767 | ncrc4282 | 14827 | ncrc4369 | 14887 | ncrc4472 | 14947 | ncrc4565 |
| 14708 | ncrc4195 | 14768 | ncrc4283 | 14828 | ncrc4371 | 14888 | ncrc4473 | 14948 | ncrc4566 |
| 14709 | ncrc4196 | 14769 | ncrc4284 | 14829 | ncrc4372 | 14889 | ncrc4476 | 14949 | ncrc4567 |
| 14710 | ncrc4197 | 14770 | ncrc4285 | 14830 | ncrc4373 | 14890 | ncrc4478 | 14950 | ncrc4568 |
| 14711 | ncrc4199 | 14771 | ncrc4286 | 14831 | ncrc4374 | 14891 | ncrc4479 | 14951 | ncrc4569 |
| 14712 | ncrc4201 | 14772 | ncrc4287 | 14832 | ncrc4376 | 14892 | ncrc4481 | 14952 | ncrc4570 |
| 14713 | ncrc4202 | 14773 | ncrc4289 | 14833 | ncrc4377 | 14893 | ncrc4485 | 14953 | ncrc4574 |
| 14714 | ncrc4203 | 14774 | ncrc4290 | 14834 | ncrc4378 | 14894 | ncrc4486 | 14954 | ncrc4575 |
| 14715 | ncrc4204 | 14775 | ncrc4291 | 14835 | ncrc4380 | 14895 | ncrc4487 | 14955 | ncrc4576 |
| 14716 | ncrc4205 | 14776 | ncrc4292 | 14836 | ncrc4381 | 14896 | ncrc4489 | 14956 | ncrc4577 |
| 14717 | ncrc4206 | 14777 | ncrc4294 | 14837 | ncrc4382 | 14897 | ncrc4490 | 14957 | ncrc4579 |
| 14718 | ncrc4207 | 14778 | ncrc4295 | 14838 | ncrc4383 | 14898 | ncrc4492 | 14958 | ncrc4580 |
| 14719 | ncrc4208 | 14779 | ncrc4296 | 14839 | ncrc4384 | 14899 | ncrc4493 | 14959 | ncrc4581 |
| 14720 | ncrc4211 | 14780 | ncrc4297 | 14840 | ncrc4387 | 14900 | ncrc4494 | 14960 | ncrc4583 |
| 14721 | ncrc4212 | 14781 | ncrc4298 | 14841 | ncrc4389 | 14901 | ncrc4495 | 14961 | ncrc4584 |
| 14722 | ncrc4213 | 14782 | ncrc4299 | 14842 | ncrc4390 | 14902 | ncrc4496 | 14962 | ncrc4585 |
| 14723 | ncrc4216 | 14783 | ncrc4300 | 14843 | ncrc4394 | 14903 | ncrc4497 | 14963 | ncrc4586 |
| 14724 | ncrc4218 | 14784 | ncrc4301 | 14844 | ncrc4395 | 14904 | ncrc4498 | 14964 | ncrc4587 |
| 14725 | ncrc4219 | 14785 | ncrc4302 | 14845 | ncrc4396 | 14905 | ncrc4499 | 14965 | ncrc4588 |
| 14726 | ncrc4220 | 14786 | ncrc4303 | 14846 | ncrc4397 | 14906 | ncrc4500 | 14966 | ncrc4589 |
| 14727 | ncrc4221 | 14787 | ncrc4304 | 14847 | ncrc4398 | 14907 | ncrc4501 | 14967 | ncrc4590 |
| 14728 | ncrc4222 | 14788 | ncrc4305 | 14848 | ncrc4399 | 14908 | ncrc4503 | 14968 | ncrc4591 |
| 14729 | ncrc4223 | 14789 | ncrc4306 | 14849 | ncrc4401 | 14909 | ncrc4504 | 14969 | ncrc4592 |
| 14730 | ncrc4224 | 14790 | ncrc4307 | 14850 | ncrc4402 | 14910 | ncrc4505 | 14970 | ncrc4593 |
| 14731 | ncrc4225 | 14791 | ncrc4308 | 14851 | ncrc4403 | 14911 | ncrc4508 | 14971 | ncrc4594 |
| 14732 | ncrc4226 | 14792 | ncrc4309 | 14852 | ncrc4404 | 14912 | ncrc4509 | 14972 | ncrc4597 |
| 14733 | ncrc4227 | 14793 | ncrc4312 | 14853 | ncrc4408 | 14913 | ncrc4511 | 14973 | ncrc4599 |
| 14734 | ncrc4228 | 14794 | ncrc4313 | 14854 | ncrc4409 | 14914 | ncrc4512 | 14974 | ncrc4600 |
| 14735 | ncrc4231 | 14795 | ncrc4314 | 14855 | ncrc4410 | 14915 | ncrc4513 | 14975 | ncrc4602 |
| 14736 | ncrc4233 | 14796 | ncrc4315 | 14856 | ncrc4411 | 14916 | ncrc4514 | 14976 | ncrc4604 |
| 14737 | ncrc4235 | 14797 | ncrc4315 | 14857 | ncrc4413 | 14917 | ncrc4515 | 14977 | ncrc4605 |
| 14738 | ncrc4237 | 14798 | ncrc4316 | 14858 | ncrc4414 | 14918 | ncrc4516 | 14978 | ncrc4606 |
| 14739 | ncrc4240 | 14799 | ncrc4317 | 14859 | ncrc4415 | 14919 | ncrc4519 | 14979 | ncrc4607 |
| 14740 | ncrc4241 | 14800 | ncrc4318 | 14860 | ncrc4416 | 14920 | ncrc4520 | 14980 | ncrc4608 |
| 14741 | ncrc4243 | 14801 | ncrc4320 | 14861 | ncrc4417 | 14921 | ncrc4521 | 14981 | ncrc4609 |
| 14742 | ncrc4244 | 14802 | ncrc4323 | 14862 | ncrc4418 | 14922 | ncrc4523 | 14982 | ncrc4610 |
| 14743 | ncrc4247 | 14803 | ncrc4327 | 14863 | ncrc4419 | 14923 | ncrc4524 | 14983 | ncrc4611 |
| 14744 | ncrc4248 | 14804 | ncrc4328 | 14864 | ncrc4420 | 14924 | ncrc4525 | 14984 | ncrc4612 |
| 14745 | ncrc4249 | 14805 | ncrc4329 | 14865 | ncrc4423 | 14925 | ncrc4527 | 14985 | ncrc4615 |
| 14746 | ncrc4250 | 14806 | ncrc4333 | 14866 | ncrc4424 | 14926 | ncrc4528 | 14986 | ncrc4616 |
| 14747 | ncrc4253 | 14807 | ncrc4335 | 14867 | ncrc4425 | 14927 | ncrc4531 | 14987 | ncrc4619 |
| 14748 | ncrc4254 | 14808 | ncrc4336 | 14868 | ncrc4427 | 14928 | ncrc4532 | 14988 | ncrc4620 |
| 14749 | ncrc4255 | 14809 | ncrc4340 | 14869 | ncrc4428 | 14929 | ncrc4533 | 14989 | ncrc4621 |
| 14750 | ncrc4257 | 14810 | ncrc4343 | 14870 | ncrc4429 | 14930 | ncrc4535 | 14990 | ncrc4623 |
| 14751 | ncrc4259 | 14811 | ncrc4344 | 14871 | ncrc4431 | 14931 | ncrc4536 | 14991 | ncrc4625 |
| 14752 | ncrc4260 | 14812 | ncrc4345 | 14872 | ncrc4436 | 14932 | ncrc4538 | 14992 | ncrc4627 |
| 14753 | ncrc4261 | 14813 | ncrc4346 | 14873 | ncrc4437 | 14933 | ncrc4539 | 14993 | ncrc4628 |
| 14754 | ncrc4263 | 14814 | ncrc4347 | 14874 | ncrc4439 | 14934 | ncrc4540 | 14994 | ncrc4629 |
| 14755 | ncrc4264 | 14815 | ncrc4349 | 14875 | ncrc4440 | 14935 | ncrc4543 | 14995 | ncrc4632 |
| 14756 | ncrc4265 | 14816 | ncrc4352 | 14876 | ncrc4441 | 14936 | ncrc4547 | 14996 | ncrc4633 |
| 14757 | ncrc4267 | 14817 | ncrc4353 | 14877 | ncrc4444 | 14937 | ncrc4548 | 14997 | ncrc4634 |
| 14758 | ncrc4268 | 14818 | ncrc4355 | 14878 | ncrc4448 | 14938 | ncrc4551 | 14998 | ncrc4637 |
| 14759 | ncrc4269 | 14819 | ncrc4356 | 14879 | ncrc4451 | 14939 | ncrc4552 | 14999 | ncrc4638 |
| 14760 | ncrc4270 | 14820 | ncrc4357 | 14880 | ncrc4456 | 14940 | ncrc4553 | 15000 | ncrc4639 |

Figure 6C – List of EST Sequence Names From Normal Cartilage cDNA Library

| | | | | | | | | | |
|---|---|---|---|---|---|---|---|---|---|
| 15001 | ncrc4641 | 15061 | ncrc4723 | 15121 | ncrc4809 | 15181 | ncrc4899 | 15241 | ncrc4996 |
| 15002 | ncrc4643 | 15062 | ncrc4724 | 15122 | ncrc4811 | 15182 | ncrc4900 | 15242 | ncrc5000 |
| 15003 | ncrc4644 | 15063 | ncrc4725 | 15123 | ncrc4812 | 15183 | ncrc4903 | 15243 | ncrc5001 |
| 15004 | ncrc4645 | 15064 | ncrc4728 | 15124 | ncrc4814 | 15184 | ncrc4904 | 15244 | ncrc5003 |
| 15005 | ncrc4647 | 15065 | ncrc4730 | 15125 | ncrc4815 | 15185 | ncrc4907 | 15245 | ncrc5004 |
| 15006 | ncrc4648 | 15066 | ncrc4730 | 15126 | ncrc4816 | 15186 | ncrc4909 | 15246 | ncrc5007 |
| 15007 | ncrc4650 | 15067 | ncrc4732 | 15127 | ncrc4819 | 15187 | ncrc4911 | 15247 | ncrc5008 |
| 15008 | ncrc4651 | 15068 | ncrc4733 | 15128 | ncrc4820 | 15188 | ncrc4912 | 15248 | ncrc5011 |
| 15009 | ncrc4654 | 15069 | ncrc4734 | 15129 | ncrc4821 | 15189 | ncrc4913 | 15249 | ncrc5013 |
| 15010 | ncrc4655 | 15070 | ncrc4735 | 15130 | ncrc4823 | 15190 | ncrc4915 | 15250 | ncrc5015 |
| 15011 | ncrc4656 | 15071 | ncrc4736 | 15131 | ncrc4824 | 15191 | ncrc4916 | 15251 | ncrc5016 |
| 15012 | ncrc4657 | 15072 | ncrc4737 | 15132 | ncrc4827 | 15192 | ncrc4917 | 15252 | ncrc5017 |
| 15013 | ncrc4659 | 15073 | ncrc4740 | 15133 | ncrc4828 | 15193 | ncrc4919 | 15253 | ncrc5018 |
| 15014 | ncrc4660 | 15074 | ncrc4741 | 15134 | ncrc4829 | 15194 | ncrc4920 | 15254 | ncrc5019 |
| 15015 | ncrc4661 | 15075 | ncrc4743 | 15135 | ncrc4830 | 15195 | ncrc4923 | 15255 | ncrc5020 |
| 15016 | ncrc4662 | 15076 | ncrc4744 | 15136 | ncrc4831 | 15196 | ncrc4924 | 15256 | ncrc5021 |
| 15017 | ncrc4663 | 15077 | ncrc4745 | 15137 | ncrc4835 | 15197 | ncrc4926 | 15257 | ncrc5022 |
| 15018 | ncrc4664 | 15078 | ncrc4746 | 15138 | ncrc4839 | 15198 | ncrc4927 | 15258 | ncrc5023 |
| 15019 | ncrc4665 | 15079 | ncrc4747 | 15139 | ncrc4840 | 15199 | ncrc4931 | 15259 | ncrc5025 |
| 15020 | ncrc4666 | 15080 | ncrc4748 | 15140 | ncrc4841 | 15200 | ncrc4932 | 15260 | ncrc5031 |
| 15021 | ncrc4667 | 15081 | ncrc4751 | 15141 | ncrc4842 | 15201 | ncrc4933 | 15261 | ncrc5033 |
| 15022 | ncrc4668 | 15082 | ncrc4752 | 15142 | ncrc4843 | 15202 | ncrc4936 | 15262 | ncrc5034 |
| 15023 | ncrc4669 | 15083 | ncrc4753 | 15143 | ncrc4844 | 15203 | ncrc4937 | 15263 | ncrc5035 |
| 15024 | ncrc4670 | 15084 | ncrc4755 | 15144 | ncrc4848 | 15204 | ncrc4939 | 15264 | ncrc5036 |
| 15025 | ncrc4671 | 15085 | ncrc4756 | 15145 | ncrc4849 | 15205 | ncrc4940 | 15265 | ncrc5038 |
| 15026 | ncrc4672 | 15086 | ncrc4757 | 15146 | ncrc4851 | 15206 | ncrc4942 | 15266 | ncrc5039 |
| 15027 | ncrc4673 | 15087 | ncrc4758 | 15147 | ncrc4852 | 15207 | ncrc4945 | 15267 | ncrc5040 |
| 15028 | ncrc4675 | 15088 | ncrc4759 | 15148 | ncrc4854 | 15208 | ncrc4947 | 15268 | ncrc5041 |
| 15029 | ncrc4676 | 15089 | ncrc4760 | 15149 | ncrc4855 | 15209 | ncrc4950 | 15269 | ncrc5044 |
| 15030 | ncrc4677 | 15090 | ncrc4761 | 15150 | ncrc4856 | 15210 | ncrc4953 | 15270 | ncrc5045 |
| 15031 | ncrc4681 | 15091 | ncrc4765 | 15151 | ncrc4857 | 15211 | ncrc4954 | 15271 | ncrc5047 |
| 15032 | ncrc4682 | 15092 | ncrc4766 | 15152 | ncrc4858 | 15212 | ncrc4955 | 15272 | ncrc5048 |
| 15033 | ncrc4683 | 15093 | ncrc4769 | 15153 | ncrc4859 | 15213 | ncrc4956 | 15273 | ncrc5050 |
| 15034 | ncrc4684 | 15094 | ncrc4771 | 15154 | ncrc4860 | 15214 | ncrc4957 | 15274 | ncrc5051 |
| 15035 | ncrc4685 | 15095 | ncrc4772 | 15155 | ncrc4861 | 15215 | ncrc4958 | 15275 | ncrc5052 |
| 15036 | ncrc4686 | 15096 | ncrc4773 | 15156 | ncrc4862 | 15216 | ncrc4964 | 15276 | ncrc5053 |
| 15037 | ncrc4687 | 15097 | ncrc4774 | 15157 | ncrc4863 | 15217 | ncrc4966 | 15277 | ncrc5054 |
| 15038 | ncrc4688 | 15098 | ncrc4775 | 15158 | ncrc4864 | 15218 | ncrc4967 | 15278 | ncrc5055 |
| 15039 | ncrc4689 | 15099 | ncrc4776 | 15159 | ncrc4867 | 15219 | ncrc4968 | 15279 | ncrc5056 |
| 15040 | ncrc4690 | 15100 | ncrc4778 | 15160 | ncrc4869 | 15220 | ncrc4969 | 15280 | ncrc5060 |
| 15041 | ncrc4692 | 15101 | ncrc4779 | 15161 | ncrc4870 | 15221 | ncrc4970 | 15281 | ncrc5061 |
| 15042 | ncrc4693 | 15102 | ncrc4780 | 15162 | ncrc4871 | 15222 | ncrc4971 | 15282 | ncrc5062 |
| 15043 | ncrc4695 | 15103 | ncrc4782 | 15163 | ncrc4872 | 15223 | ncrc4972 | 15283 | ncrc5064 |
| 15044 | ncrc4696 | 15104 | ncrc4784 | 15164 | ncrc4874 | 15224 | ncrc4973 | 15284 | ncrc5065 |
| 15045 | ncrc4697 | 15105 | ncrc4785 | 15165 | ncrc4875 | 15225 | ncrc4974 | 15285 | ncrc5066 |
| 15046 | ncrc4698 | 15106 | ncrc4786 | 15166 | ncrc4876 | 15226 | ncrc4975 | 15286 | ncrc5067 |
| 15047 | ncrc4700 | 15107 | ncrc4787 | 15167 | ncrc4877 | 15227 | ncrc4976 | 15287 | ncrc5069 |
| 15048 | ncrc4701 | 15108 | ncrc4788 | 15168 | ncrc4878 | 15228 | ncrc4977 | 15288 | ncrc5070 |
| 15049 | ncrc4703 | 15109 | ncrc4789 | 15169 | ncrc4879 | 15229 | ncrc4978 | 15289 | ncrc5071 |
| 15050 | ncrc4704 | 15110 | ncrc4792 | 15170 | ncrc4880 | 15230 | ncrc4981 | 15290 | ncrc5072 |
| 15051 | ncrc4705 | 15111 | ncrc4793 | 15171 | ncrc4882 | 15231 | ncrc4983 | 15291 | ncrc5074 |
| 15052 | ncrc4706 | 15112 | ncrc4794 | 15172 | ncrc4884 | 15232 | ncrc4985 | 15292 | ncrc5075 |
| 15053 | ncrc4707 | 15113 | ncrc4798 | 15173 | ncrc4885 | 15233 | ncrc4986 | 15293 | ncrc5076 |
| 15054 | ncrc4712 | 15114 | ncrc4799 | 15174 | ncrc4888 | 15234 | ncrc4987 | 15294 | ncrc5077 |
| 15055 | ncrc4713 | 15115 | ncrc4800 | 15175 | ncrc4890 | 15235 | ncrc4988 | 15295 | ncrc5079 |
| 15056 | ncrc4716 | 15116 | ncrc4802 | 15176 | ncrc4891 | 15236 | ncrc4989 | 15296 | ncrc5081 |
| 15057 | ncrc4717 | 15117 | ncrc4803 | 15177 | ncrc4894 | 15237 | ncrc4991 | 15297 | ncrc5083 |
| 15058 | ncrc4719 | 15118 | ncrc4804 | 15178 | ncrc4896 | 15238 | ncrc4993 | 15298 | ncrc5086 |
| 15059 | ncrc4720 | 15119 | ncrc4807 | 15179 | ncrc4897 | 15239 | ncrc4994 | 15299 | ncrc5087 |
| 15060 | ncrc4721 | 15120 | ncrc4808 | 15180 | ncrc4898 | 15240 | ncrc4995 | 15300 | ncrc5088 |

Figure 6C – List of EST Sequence Names From Normal Cartilage cDNA Library

| | | | | | | | | | |
|---|---|---|---|---|---|---|---|---|---|
| 15301 | ncrc5090 | 15361 | ncrc5176 | 15421 | ncrc5264 | 15481 | ncrc5356 | 15541 | ncrc5460 |
| 15302 | ncrc5091 | 15362 | ncrc5177 | 15422 | ncrc5265 | 15482 | ncrc5357 | 15542 | ncrc5461 |
| 15303 | ncrc5092 | 15363 | ncrc5178 | 15423 | ncrc5266 | 15483 | ncrc5358 | 15543 | ncrc5464 |
| 15304 | ncrc5095 | 15364 | ncrc5179 | 15424 | ncrc5267 | 15484 | ncrc5359 | 15544 | ncrc5468 |
| 15305 | ncrc5096 | 15365 | ncrc5180 | 15425 | ncrc5271 | 15485 | ncrc5360 | 15545 | ncrc5469 |
| 15306 | ncrc5098 | 15366 | ncrc5181 | 15426 | ncrc5273 | 15486 | ncrc5363 | 15546 | ncrc5470 |
| 15307 | ncrc5099 | 15367 | ncrc5182 | 15427 | ncrc5274 | 15487 | ncrc5365 | 15547 | ncrc5472 |
| 15308 | ncrc5100 | 15368 | ncrc5183 | 15428 | ncrc5276 | 15488 | ncrc5367 | 15548 | ncrc5473 |
| 15309 | ncrc5101 | 15369 | ncrc5184 | 15429 | ncrc5277 | 15489 | ncrc5368 | 15549 | ncrc5474 |
| 15310 | ncrc5104 | 15370 | ncrc5185 | 15430 | ncrc5278 | 15490 | ncrc5369 | 15550 | ncrc5475 |
| 15311 | ncrc5105 | 15371 | ncrc5186 | 15431 | ncrc5280 | 15491 | ncrc5370 | 15551 | ncrc5480 |
| 15312 | ncrc5107 | 15372 | ncrc5187 | 15432 | ncrc5282 | 15492 | ncrc5371 | 15552 | ncrc5481 |
| 15313 | ncrc5108 | 15373 | ncrc5191 | 15433 | ncrc5288 | 15493 | ncrc5372 | 15553 | ncrc5484 |
| 15314 | ncrc5109 | 15374 | ncrc5195 | 15434 | ncrc5289 | 15494 | ncrc5375 | 15554 | ncrc5487 |
| 15315 | ncrc5111 | 15375 | ncrc5196 | 15435 | ncrc5291 | 15495 | ncrc5376 | 15555 | ncrc5488 |
| 15316 | ncrc5113 | 15376 | ncrc5199 | 15436 | ncrc5292 | 15496 | ncrc5378 | 15556 | ncrc5489 |
| 15317 | ncrc5116 | 15377 | ncrc5200 | 15437 | ncrc5293 | 15497 | ncrc5379 | 15557 | ncrc5491 |
| 15318 | ncrc5117 | 15378 | ncrc5201 | 15438 | ncrc5295 | 15498 | ncrc5380 | 15558 | ncrc5492 |
| 15319 | ncrc5118 | 15379 | ncrc5204 | 15439 | ncrc5296 | 15499 | ncrc5383 | 15559 | ncrc5493 |
| 15320 | ncrc5121 | 15380 | ncrc5205 | 15440 | ncrc5297 | 15500 | ncrc5384 | 15560 | ncrc5496 |
| 15321 | ncrc5123 | 15381 | ncrc5207 | 15441 | ncrc5299 | 15501 | ncrc5385 | 15561 | ncrc5497 |
| 15322 | ncrc5124 | 15382 | ncrc5208 | 15442 | ncrc5300 | 15502 | ncrc5392 | 15562 | ncrc5499 |
| 15323 | ncrc5125 | 15383 | ncrc5209 | 15443 | ncrc5301 | 15503 | ncrc5393 | 15563 | ncrc5500 |
| 15324 | ncrc5127 | 15384 | ncrc5211 | 15444 | ncrc5303 | 15504 | ncrc5395 | 15564 | ncrc5501 |
| 15325 | ncrc5128 | 15385 | ncrc5212 | 15445 | ncrc5305 | 15505 | ncrc5401 | 15565 | ncrc5502 |
| 15326 | ncrc5132 | 15386 | ncrc5213 | 15446 | ncrc5307 | 15506 | ncrc5402 | 15566 | ncrc5503 |
| 15327 | ncrc5135 | 15387 | ncrc5216 | 15447 | ncrc5308 | 15507 | ncrc5405 | 15567 | ncrc5507 |
| 15328 | ncrc5136 | 15388 | ncrc5217 | 15448 | ncrc5310 | 15508 | ncrc5406 | 15568 | ncrc5508 |
| 15329 | ncrc5137 | 15389 | ncrc5219 | 15449 | ncrc5311 | 15509 | ncrc5413 | 15569 | ncrc5512 |
| 15330 | ncrc5139 | 15390 | ncrc5220 | 15450 | ncrc5312 | 15510 | ncrc5415 | 15570 | ncrc5513 |
| 15331 | ncrc5140 | 15391 | ncrc5221 | 15451 | ncrc5313 | 15511 | ncrc5416 | 15571 | ncrc5515 |
| 15332 | ncrc5141 | 15392 | ncrc5223 | 15452 | ncrc5316 | 15512 | ncrc5417 | 15572 | ncrc5516 |
| 15333 | ncrc5142 | 15393 | ncrc5224 | 15453 | ncrc5317 | 15513 | ncrc5419 | 15573 | ncrc5518 |
| 15334 | ncrc5143 | 15394 | ncrc5225 | 15454 | ncrc5319 | 15514 | ncrc5420 | 15574 | ncrc5519 |
| 15335 | ncrc5144 | 15395 | ncrc5227 | 15455 | ncrc5322 | 15515 | ncrc5422 | 15575 | ncrc5520 |
| 15336 | ncrc5145 | 15396 | ncrc5228 | 15456 | ncrc5323 | 15516 | ncrc5423 | 15576 | ncrc5521 |
| 15337 | ncrc5146 | 15397 | ncrc5230 | 15457 | ncrc5324 | 15517 | ncrc5424 | 15577 | ncrc5523 |
| 15338 | ncrc5147 | 15398 | ncrc5231 | 15458 | ncrc5326 | 15518 | ncrc5427 | 15578 | ncrc5524 |
| 15339 | ncrc5148 | 15399 | ncrc5232 | 15459 | ncrc5327 | 15519 | ncrc5429 | 15579 | ncrc5525 |
| 15340 | ncrc5149 | 15400 | ncrc5233 | 15460 | ncrc5328 | 15520 | ncrc5431 | 15580 | ncrc5526 |
| 15341 | ncrc5150 | 15401 | ncrc5235 | 15461 | ncrc5329 | 15521 | ncrc5432 | 15581 | ncrc5528 |
| 15342 | ncrc5152 | 15402 | ncrc5236 | 15462 | ncrc5331 | 15522 | ncrc5434 | 15582 | ncrc5533 |
| 15343 | ncrc5155 | 15403 | ncrc5237 | 15463 | ncrc5332 | 15523 | ncrc5435 | 15583 | ncrc5534 |
| 15344 | ncrc5156 | 15404 | ncrc5239 | 15464 | ncrc5333 | 15524 | ncrc5436 | 15584 | ncrc5536 |
| 15345 | ncrc5157 | 15405 | ncrc5240 | 15465 | ncrc5334 | 15525 | ncrc5437 | 15585 | ncrc5537 |
| 15346 | ncrc5158 | 15406 | ncrc5241 | 15466 | ncrc5335 | 15526 | ncrc5438 | 15586 | ncrc5539 |
| 15347 | ncrc5159 | 15407 | ncrc5242 | 15467 | ncrc5336 | 15527 | ncrc5439 | 15587 | ncrc5540 |
| 15348 | ncrc5160 | 15408 | ncrc5243 | 15468 | ncrc5337 | 15528 | ncrc5440 | 15588 | ncrc5542 |
| 15349 | ncrc5161 | 15409 | ncrc5244 | 15469 | ncrc5338 | 15529 | ncrc5441 | 15589 | ncrc5544 |
| 15350 | ncrc5162 | 15410 | ncrc5245 | 15470 | ncrc5339 | 15530 | ncrc5443 | 15590 | ncrc5545 |
| 15351 | ncrc5163 | 15411 | ncrc5247 | 15471 | ncrc5341 | 15531 | ncrc5444 | 15591 | ncrc5546 |
| 15352 | ncrc5164 | 15412 | ncrc5248 | 15472 | ncrc5343 | 15532 | ncrc5445 | 15592 | ncrc5547 |
| 15353 | ncrc5166 | 15413 | ncrc5251 | 15473 | ncrc5345 | 15533 | ncrc5447 | 15593 | ncrc5548 |
| 15354 | ncrc5167 | 15414 | ncrc5252 | 15474 | ncrc5347 | 15534 | ncrc5451 | 15594 | ncrc5549 |
| 15355 | ncrc5168 | 15415 | ncrc5253 | 15475 | ncrc5348 | 15535 | ncrc5453 | 15595 | ncrc5550 |
| 15356 | ncrc5169 | 15416 | ncrc5255 | 15476 | ncrc5349 | 15536 | ncrc5454 | 15596 | ncrc5551 |
| 15357 | ncrc5170 | 15417 | ncrc5257 | 15477 | ncrc5350 | 15537 | ncrc5455 | 15597 | ncrc5552 |
| 15358 | ncrc5171 | 15418 | ncrc5260 | 15478 | ncrc5351 | 15538 | ncrc5456 | 15598 | ncrc5553 |
| 15359 | ncrc5172 | 15419 | ncrc5261 | 15479 | ncrc5353 | 15539 | ncrc5458 | 15599 | ncrc5555 |
| 15360 | ncrc5175 | 15420 | ncrc5263 | 15480 | ncrc5355 | 15540 | ncrc5459 | 15600 | ncrc5556 |

Figure 6C – List of EST Sequence Names From Normal Cartilage cDNA Library

| | | | | | | | | | |
|---|---|---|---|---|---|---|---|---|---|
| 15601 | ncrc5557 | 15661 | ncrc5648 | 15721 | ncrc5737 | 15781 | ncrc5835 | 15841 | ncrc5928 |
| 15602 | ncrc5559 | 15662 | ncrc5650 | 15722 | ncrc5738 | 15782 | ncrc5836 | 15842 | ncrc5929 |
| 15603 | ncrc5560 | 15663 | ncrc5651 | 15723 | ncrc5739 | 15783 | ncrc5837 | 15843 | ncrc5930 |
| 15604 | ncrc5561 | 15664 | ncrc5652 | 15724 | ncrc5740 | 15784 | ncrc5839 | 15844 | ncrc5931 |
| 15605 | ncrc5563 | 15665 | ncrc5653 | 15725 | ncrc5741 | 15785 | ncrc5840 | 15845 | ncrc5932 |
| 15606 | ncrc5564 | 15666 | ncrc5655 | 15726 | ncrc5744 | 15786 | ncrc5842 | 15846 | ncrc5933 |
| 15607 | ncrc5565 | 15667 | ncrc5656 | 15727 | ncrc5745 | 15787 | ncrc5843 | 15847 | ncrc5934 |
| 15608 | ncrc5566 | 15668 | ncrc5659 | 15728 | ncrc5746 | 15788 | ncrc5844 | 15848 | ncrc5937 |
| 15609 | ncrc5567 | 15669 | ncrc5661 | 15729 | ncrc5747 | 15789 | ncrc5845 | 15849 | ncrc5939 |
| 15610 | ncrc5568 | 15670 | ncrc5662 | 15730 | ncrc5748 | 15790 | ncrc5848 | 15850 | ncrc5940 |
| 15611 | ncrc5569 | 15671 | ncrc5663 | 15731 | ncrc5751 | 15791 | ncrc5850 | 15851 | ncrc5943 |
| 15612 | ncrc5571 | 15672 | ncrc5664 | 15732 | ncrc5752 | 15792 | ncrc5851 | 15852 | ncrc5944 |
| 15613 | ncrc5575 | 15673 | ncrc5667 | 15733 | ncrc5754 | 15793 | ncrc5852 | 15853 | ncrc5945 |
| 15614 | ncrc5576 | 15674 | ncrc5668 | 15734 | ncrc5756 | 15794 | ncrc5854 | 15854 | ncrc5946 |
| 15615 | ncrc5577 | 15675 | ncrc5671 | 15735 | ncrc5758 | 15795 | ncrc5855 | 15855 | ncrc5947 |
| 15616 | ncrc5580 | 15676 | ncrc5672 | 15736 | ncrc5759 | 15796 | ncrc5856 | 15856 | ncrc5948 |
| 15617 | ncrc5581 | 15677 | ncrc5673 | 15737 | ncrc5760 | 15797 | ncrc5857 | 15857 | ncrc5949 |
| 15618 | ncrc5583 | 15678 | ncrc5675 | 15738 | ncrc5762 | 15798 | ncrc5858 | 15858 | ncrc5950 |
| 15619 | ncrc5585 | 15679 | ncrc5677 | 15739 | ncrc5763 | 15799 | ncrc5859 | 15859 | ncrc5951 |
| 15620 | ncrc5587 | 15680 | ncrc5679 | 15740 | ncrc5767 | 15800 | ncrc5863 | 15860 | ncrc5954 |
| 15621 | ncrc5588 | 15681 | ncrc5681 | 15741 | ncrc5768 | 15801 | ncrc5865 | 15861 | ncrc5955 |
| 15622 | ncrc5589 | 15682 | ncrc5681 | 15742 | ncrc5769 | 15802 | ncrc5867 | 15862 | ncrc5956 |
| 15623 | ncrc5591 | 15683 | ncrc5684 | 15743 | ncrc5771 | 15803 | ncrc5869 | 15863 | ncrc5959 |
| 15624 | ncrc5592 | 15684 | ncrc5685 | 15744 | ncrc5772 | 15804 | ncrc5871 | 15864 | ncrc5960 |
| 15625 | ncrc5593 | 15685 | ncrc5688 | 15745 | ncrc5775 | 15805 | ncrc5872 | 15865 | ncrc5961 |
| 15626 | ncrc5595 | 15686 | ncrc5689 | 15746 | ncrc5779 | 15806 | ncrc5873 | 15866 | ncrc5963 |
| 15627 | ncrc5597 | 15687 | ncrc5690 | 15747 | ncrc5780 | 15807 | ncrc5875 | 15867 | ncrc5964 |
| 15628 | ncrc5599 | 15688 | ncrc5691 | 15748 | ncrc5781 | 15808 | ncrc5876 | 15868 | ncrc5968 |
| 15629 | ncrc5600 | 15689 | ncrc5693 | 15749 | ncrc5783 | 15809 | ncrc5877 | 15869 | ncrc5969 |
| 15630 | ncrc5601 | 15690 | ncrc5695 | 15750 | ncrc5784 | 15810 | ncrc5881 | 15870 | ncrc5972 |
| 15631 | ncrc5603 | 15691 | ncrc5696 | 15751 | ncrc5787 | 15811 | ncrc5883 | 15871 | ncrc5973 |
| 15632 | ncrc5604 | 15692 | ncrc5697 | 15752 | ncrc5788 | 15812 | ncrc5885 | 15872 | ncrc5975 |
| 15633 | ncrc5605 | 15693 | ncrc5699 | 15753 | ncrc5790 | 15813 | ncrc5886 | 15873 | ncrc5977 |
| 15634 | ncrc5607 | 15694 | ncrc5700 | 15754 | ncrc5792 | 15814 | ncrc5887 | 15874 | ncrc5979 |
| 15635 | ncrc5608 | 15695 | ncrc5701 | 15755 | ncrc5793 | 15815 | ncrc5888 | 15875 | ncrc5981 |
| 15636 | ncrc5609 | 15696 | ncrc5704 | 15756 | ncrc5795 | 15816 | ncrc5893 | 15876 | ncrc5982 |
| 15637 | ncrc5610 | 15697 | ncrc5705 | 15757 | ncrc5796 | 15817 | ncrc5896 | 15877 | ncrc5987 |
| 15638 | ncrc5611 | 15698 | ncrc5706 | 15758 | ncrc5801 | 15818 | ncrc5897 | 15878 | ncrc5991 |
| 15639 | ncrc5612 | 15699 | ncrc5707 | 15759 | ncrc5802 | 15819 | ncrc5898 | 15879 | ncrc5993 |
| 15640 | ncrc5614 | 15700 | ncrc5708 | 15760 | ncrc5804 | 15820 | ncrc5902 | 15880 | ncrc5995 |
| 15641 | ncrc5616 | 15701 | ncrc5710 | 15761 | ncrc5806 | 15821 | ncrc5904 | 15881 | ncrc5996 |
| 15642 | ncrc5617 | 15702 | ncrc5713 | 15762 | ncrc5807 | 15822 | ncrc5905 | 15882 | ncrc5998 |
| 15643 | ncrc5619 | 15703 | ncrc5715 | 15763 | ncrc5808 | 15823 | ncrc5907 | 15883 | ncrc5999 |
| 15644 | ncrc5621 | 15704 | ncrc5716 | 15764 | ncrc5811 | 15824 | ncrc5908 | 15884 | ncrc6000 |
| 15645 | ncrc5623 | 15705 | ncrc5717 | 15765 | ncrc5812 | 15825 | ncrc5909 | 15885 | ncrc6001 |
| 15646 | ncrc5625 | 15706 | ncrc5718 | 15766 | ncrc5813 | 15826 | ncrc5910 | 15886 | ncrc6003 |
| 15647 | ncrc5626 | 15707 | ncrc5719 | 15767 | ncrc5814 | 15827 | ncrc5911 | 15887 | ncrc6004 |
| 15648 | ncrc5628 | 15708 | ncrc5720 | 15768 | ncrc5819 | 15828 | ncrc5912 | 15888 | ncrc6005 |
| 15649 | ncrc5630 | 15709 | ncrc5721 | 15769 | ncrc5820 | 15829 | ncrc5913 | 15889 | ncrc6006 |
| 15650 | ncrc5631 | 15710 | ncrc5722 | 15770 | ncrc5821 | 15830 | ncrc5914 | 15890 | ncrc6008 |
| 15651 | ncrc5633 | 15711 | ncrc5723 | 15771 | ncrc5822 | 15831 | ncrc5915 | 15891 | ncrc6010 |
| 15652 | ncrc5635 | 15712 | ncrc5724 | 15772 | ncrc5823 | 15832 | ncrc5916 | 15892 | ncrc6011 |
| 15653 | ncrc5636 | 15713 | ncrc5725 | 15773 | ncrc5824 | 15833 | ncrc5918 | 15893 | ncrc6012 |
| 15654 | ncrc5638 | 15714 | ncrc5727 | 15774 | ncrc5827 | 15834 | ncrc5918 | 15894 | ncrc6014 |
| 15655 | ncrc5640 | 15715 | ncrc5729 | 15775 | ncrc5828 | 15835 | ncrc5919 | 15895 | ncrc6015 |
| 15656 | ncrc5642 | 15716 | ncrc5731 | 15776 | ncrc5829 | 15836 | ncrc5921 | 15896 | ncrc6016 |
| 15657 | ncrc5643 | 15717 | ncrc5732 | 15777 | ncrc5830 | 15837 | ncrc5923 | 15897 | ncrc6017 |
| 15658 | ncrc5644 | 15718 | ncrc5734 | 15778 | ncrc5831 | 15838 | ncrc5924 | 15898 | ncrc6019 |
| 15659 | ncrc5645 | 15719 | ncrc5735 | 15779 | ncrc5833 | 15839 | ncrc5926 | 15899 | ncrc6020 |
| 15660 | ncrc5647 | 15720 | ncrc5736 | 15780 | ncrc5834 | 15840 | ncrc5927 | 15900 | ncrc6022 |

Figure 6C – List of EST Sequence Names From Normal Cartilage cDNA Library

| | | | | | | | | | |
|---|---|---|---|---|---|---|---|---|---|
| 15901 | ncrc6024 | 15961 | ncrc6118 | 16021 | ncrc6204 | 16081 | ncrc6292 | 16141 | ncrc6385 |
| 15902 | ncrc6025 | 15962 | ncrc6119 | 16022 | ncrc6205 | 16082 | ncrc6296 | 16142 | ncrc6387 |
| 15903 | ncrc6026 | 15963 | ncrc6120 | 16023 | ncrc6211 | 16083 | ncrc6299 | 16143 | ncrc6388 |
| 15904 | ncrc6029 | 15964 | ncrc6123 | 16024 | ncrc6212 | 16084 | ncrc6300 | 16144 | ncrc6389 |
| 15905 | ncrc6030 | 15965 | ncrc6124 | 16025 | ncrc6213 | 16085 | ncrc6301 | 16145 | ncrc6391 |
| 15906 | ncrc6031 | 15966 | ncrc6126 | 16026 | ncrc6214 | 16086 | ncrc6303 | 16146 | ncrc6392 |
| 15907 | ncrc6032 | 15967 | ncrc6127 | 16027 | ncrc6215 | 16087 | ncrc6304 | 16147 | ncrc6393 |
| 15908 | ncrc6033 | 15968 | ncrc6128 | 16028 | ncrc6216 | 16088 | ncrc6305 | 16148 | ncrc6395 |
| 15909 | ncrc6036 | 15969 | ncrc6129 | 16029 | ncrc6217 | 16089 | ncrc6307 | 16149 | ncrc6396 |
| 15910 | ncrc6037 | 15970 | ncrc6130 | 16030 | ncrc6218 | 16090 | ncrc6308 | 16150 | ncrc6399 |
| 15911 | ncrc6040 | 15971 | ncrc6131 | 16031 | ncrc6219 | 16091 | ncrc6309 | 16151 | ncrc6400 |
| 15912 | ncrc6041 | 15972 | ncrc6133 | 16032 | ncrc6220 | 16092 | ncrc6310 | 16152 | ncrc6401 |
| 15913 | ncrc6042 | 15973 | ncrc6135 | 16033 | ncrc6221 | 16093 | ncrc6311 | 16153 | ncrc6403 |
| 15914 | ncrc6043 | 15974 | ncrc6136 | 16034 | ncrc6222 | 16094 | ncrc6312 | 16154 | ncrc6404 |
| 15915 | ncrc6047 | 15975 | ncrc6137 | 16035 | ncrc6224 | 16095 | ncrc6315 | 16155 | ncrc6405 |
| 15916 | ncrc6049 | 15976 | ncrc6138 | 16036 | ncrc6225 | 16096 | ncrc6316 | 16156 | ncrc6406 |
| 15917 | ncrc6050 | 15977 | ncrc6139 | 16037 | ncrc6226 | 16097 | ncrc6317 | 16157 | ncrc6407 |
| 15918 | ncrc6052 | 15978 | ncrc6141 | 16038 | ncrc6228 | 16098 | ncrc6318 | 16158 | ncrc6408 |
| 15919 | ncrc6054 | 15979 | ncrc6142 | 16039 | ncrc6229 | 16099 | ncrc6319 | 16159 | ncrc6409 |
| 15920 | ncrc6055 | 15980 | ncrc6143 | 16040 | ncrc6231 | 16100 | ncrc6320 | 16160 | ncrc6411 |
| 15921 | ncrc6056 | 15981 | ncrc6144 | 16041 | ncrc6232 | 16101 | ncrc6321 | 16161 | ncrc6413 |
| 15922 | ncrc6057 | 15982 | ncrc6146 | 16042 | ncrc6233 | 16102 | ncrc6322 | 16162 | ncrc6414 |
| 15923 | ncrc6058 | 15983 | ncrc6147 | 16043 | ncrc6234 | 16103 | ncrc6323 | 16163 | ncrc6415 |
| 15924 | ncrc6059 | 15984 | ncrc6148 | 16044 | ncrc6236 | 16104 | ncrc6324 | 16164 | ncrc6416 |
| 15925 | ncrc6060 | 15985 | ncrc6151 | 16045 | ncrc6237 | 16105 | ncrc6325 | 16165 | ncrc6417 |
| 15926 | ncrc6061 | 15986 | ncrc6152 | 16046 | ncrc6238 | 16106 | ncrc6327 | 16166 | ncrc6418 |
| 15927 | ncrc6062 | 15987 | ncrc6153 | 16047 | ncrc6239 | 16107 | ncrc6329 | 16167 | ncrc6419 |
| 15928 | ncrc6063 | 15988 | ncrc6155 | 16048 | ncrc6240 | 16108 | ncrc6330 | 16168 | ncrc6420 |
| 15929 | ncrc6067 | 15989 | ncrc6156 | 16049 | ncrc6241 | 16109 | ncrc6331 | 16169 | ncrc6421 |
| 15930 | ncrc6068 | 15990 | ncrc6159 | 16050 | ncrc6242 | 16110 | ncrc6332 | 16170 | ncrc6423 |
| 15931 | ncrc6069 | 15991 | ncrc6160 | 16051 | ncrc6243 | 16111 | ncrc6333 | 16171 | ncrc6425 |
| 15932 | ncrc6071 | 15992 | ncrc6161 | 16052 | ncrc6245 | 16112 | ncrc6335 | 16172 | ncrc6428 |
| 15933 | ncrc6072 | 15993 | ncrc6163 | 16053 | ncrc6247 | 16113 | ncrc6336 | 16173 | ncrc6429 |
| 15934 | ncrc6073 | 15994 | ncrc6164 | 16054 | ncrc6248 | 16114 | ncrc6338 | 16174 | ncrc6430 |
| 15935 | ncrc6075 | 15995 | ncrc6165 | 16055 | ncrc6252 | 16115 | ncrc6339 | 16175 | ncrc6431 |
| 15936 | ncrc6076 | 15996 | ncrc6168 | 16056 | ncrc6253 | 16116 | ncrc6340 | 16176 | ncrc6433 |
| 15937 | ncrc6077 | 15997 | ncrc6171 | 16057 | ncrc6253 | 16117 | ncrc6345 | 16177 | ncrc6434 |
| 15938 | ncrc6079 | 15998 | ncrc6172 | 16058 | ncrc6256 | 16118 | ncrc6347 | 16178 | ncrc6435 |
| 15939 | ncrc6081 | 15999 | ncrc6173 | 16059 | ncrc6257 | 16119 | ncrc6348 | 16179 | ncrc6436 |
| 15940 | ncrc6084 | 16000 | ncrc6174 | 16060 | ncrc6259 | 16120 | ncrc6349 | 16180 | ncrc6439 |
| 15941 | ncrc6085 | 16001 | ncrc6175 | 16061 | ncrc6261 | 16121 | ncrc6351 | 16181 | ncrc6440 |
| 15942 | ncrc6087 | 16002 | ncrc6177 | 16062 | ncrc6263 | 16122 | ncrc6352 | 16182 | ncrc6443 |
| 15943 | ncrc6088 | 16003 | ncrc6179 | 16063 | ncrc6264 | 16123 | ncrc6353 | 16183 | ncrc6444 |
| 15944 | ncrc6089 | 16004 | ncrc6180 | 16064 | ncrc6265 | 16124 | ncrc6355 | 16184 | ncrc6447 |
| 15945 | ncrc6091 | 16005 | ncrc6181 | 16065 | ncrc6268 | 16125 | ncrc6356 | 16185 | ncrc6449 |
| 15946 | ncrc6092 | 16006 | ncrc6185 | 16066 | ncrc6269 | 16126 | ncrc6359 | 16186 | ncrc6451 |
| 15947 | ncrc6095 | 16007 | ncrc6187 | 16067 | ncrc6270 | 16127 | ncrc6360 | 16187 | ncrc6452 |
| 15948 | ncrc6096 | 16008 | ncrc6188 | 16068 | ncrc6272 | 16128 | ncrc6363 | 16188 | ncrc6453 |
| 15949 | ncrc6097 | 16009 | ncrc6190 | 16069 | ncrc6273 | 16129 | ncrc6367 | 16189 | ncrc6455 |
| 15950 | ncrc6099 | 16010 | ncrc6191 | 16070 | ncrc6276 | 16130 | ncrc6369 | 16190 | ncrc6456 |
| 15951 | ncrc6100 | 16011 | ncrc6192 | 16071 | ncrc6277 | 16131 | ncrc6371 | 16191 | ncrc6457 |
| 15952 | ncrc6102 | 16012 | ncrc6193 | 16072 | ncrc6279 | 16132 | ncrc6373 | 16192 | ncrc6459 |
| 15953 | ncrc6104 | 16013 | ncrc6195 | 16073 | ncrc6280 | 16133 | ncrc6375 | 16193 | ncrc6460 |
| 15954 | ncrc6105 | 16014 | ncrc6197 | 16074 | ncrc6281 | 16134 | ncrc6376 | 16194 | ncrc6461 |
| 15955 | ncrc6106 | 16015 | ncrc6198 | 16075 | ncrc6283 | 16135 | ncrc6377 | 16195 | ncrc6462 |
| 15956 | ncrc6109 | 16016 | ncrc6199 | 16076 | ncrc6284 | 16136 | ncrc6379 | 16196 | ncrc6464 |
| 15957 | ncrc6110 | 16017 | ncrc6200 | 16077 | ncrc6286 | 16137 | ncrc6380 | 16197 | ncrc6465 |
| 15958 | ncrc6112 | 16018 | ncrc6201 | 16078 | ncrc6287 | 16138 | ncrc6382 | 16198 | ncrc6467 |
| 15959 | ncrc6113 | 16019 | ncrc6202 | 16079 | ncrc6289 | 16139 | ncrc6383 | 16199 | ncrc6468 |
| 15960 | ncrc6117 | 16020 | ncrc6203 | 16080 | ncrc6291 | 16140 | ncrc6384 | 16200 | ncrc6469 |

Figure 6C – List of EST Sequence Names From Normal Cartilage cDNA Library

| | | | | | | | | | |
|---|---|---|---|---|---|---|---|---|---|
| 16201 | ncrc6471 | 16261 | ncrc6553 | 16321 | ncrc6645 | 16381 | ncrc6731 | 16441 | ncrc6839 |
| 16202 | ncrc6472 | 16262 | ncrc6555 | 16322 | ncrc6647 | 16382 | ncrc6732 | 16442 | ncrc6840 |
| 16203 | ncrc6473 | 16263 | ncrc6556 | 16323 | ncrc6648 | 16383 | ncrc6735 | 16443 | ncrc6841 |
| 16204 | ncrc6476 | 16264 | ncrc6557 | 16324 | ncrc6649 | 16384 | ncrc6739 | 16444 | ncrc6843 |
| 16205 | ncrc6478 | 16265 | ncrc6559 | 16325 | ncrc6651 | 16385 | ncrc6740 | 16445 | ncrc6844 |
| 16206 | ncrc6479 | 16266 | ncrc6560 | 16326 | ncrc6652 | 16386 | ncrc6741 | 16446 | ncrc6845 |
| 16207 | ncrc6480 | 16267 | ncrc6561 | 16327 | ncrc6654 | 16387 | ncrc6743 | 16447 | ncrc6846 |
| 16208 | ncrc6481 | 16268 | ncrc6564 | 16328 | ncrc6655 | 16388 | ncrc6745 | 16448 | ncrc6847 |
| 16209 | ncrc6483 | 16269 | ncrc6565 | 16329 | ncrc6656 | 16389 | ncrc6747 | 16449 | ncrc6848 |
| 16210 | ncrc6484 | 16270 | ncrc6567 | 16330 | ncrc6659 | 16390 | ncrc6748 | 16450 | ncrc6849 |
| 16211 | ncrc6486 | 16271 | ncrc6568 | 16331 | ncrc6660 | 16391 | ncrc6749 | 16451 | ncrc6852 |
| 16212 | ncrc6487 | 16272 | ncrc6569 | 16332 | ncrc6661 | 16392 | ncrc6753 | 16452 | ncrc6853 |
| 16213 | ncrc6488 | 16273 | ncrc6572 | 16333 | ncrc6664 | 16393 | ncrc6755 | 16453 | ncrc6855 |
| 16214 | ncrc6489 | 16274 | ncrc6574 | 16334 | ncrc6665 | 16394 | ncrc6756 | 16454 | ncrc6856 |
| 16215 | ncrc6491 | 16275 | ncrc6575 | 16335 | ncrc6666 | 16395 | ncrc6757 | 16455 | ncrc6857 |
| 16216 | ncrc6492 | 16276 | ncrc6576 | 16336 | ncrc6667 | 16396 | ncrc6759 | 16456 | ncrc6859 |
| 16217 | ncrc6495 | 16277 | ncrc6578 | 16337 | ncrc6668 | 16397 | ncrc6760 | 16457 | ncrc6860 |
| 16218 | ncrc6496 | 16278 | ncrc6581 | 16338 | ncrc6670 | 16398 | ncrc6763 | 16458 | ncrc6861 |
| 16219 | ncrc6497 | 16279 | ncrc6582 | 16339 | ncrc6671 | 16399 | ncrc6767 | 16459 | ncrc6862 |
| 16220 | ncrc6499 | 16280 | ncrc6584 | 16340 | ncrc6672 | 16400 | ncrc6768 | 16460 | ncrc6863 |
| 16221 | ncrc6500 | 16281 | ncrc6585 | 16341 | ncrc6675 | 16401 | ncrc6769 | 16461 | ncrc6864 |
| 16222 | ncrc6501 | 16282 | ncrc6586 | 16342 | ncrc6676 | 16402 | ncrc6771 | 16462 | ncrc6867 |
| 16223 | ncrc6502 | 16283 | ncrc6587 | 16343 | ncrc6677 | 16403 | ncrc6773 | 16463 | ncrc6868 |
| 16224 | ncrc6503 | 16284 | ncrc6588 | 16344 | ncrc6678 | 16404 | ncrc6774 | 16464 | ncrc6870 |
| 16225 | ncrc6504 | 16285 | ncrc6589 | 16345 | ncrc6679 | 16405 | ncrc6776 | 16465 | ncrc6871 |
| 16226 | ncrc6505 | 16286 | ncrc6590 | 16346 | ncrc6680 | 16406 | ncrc6777 | 16466 | ncrc6872 |
| 16227 | ncrc6506 | 16287 | ncrc6591 | 16347 | ncrc6681 | 16407 | ncrc6778 | 16467 | ncrc6873 |
| 16228 | ncrc6507 | 16288 | ncrc6592 | 16348 | ncrc6682 | 16408 | ncrc6780 | 16468 | ncrc6874 |
| 16229 | ncrc6508 | 16289 | ncrc6593 | 16349 | ncrc6683 | 16409 | ncrc6782 | 16469 | ncrc6875 |
| 16230 | ncrc6509 | 16290 | ncrc6595 | 16350 | ncrc6686 | 16410 | ncrc6783 | 16470 | ncrc6876 |
| 16231 | ncrc6510 | 16291 | ncrc6596 | 16351 | ncrc6687 | 16411 | ncrc6784 | 16471 | ncrc6878 |
| 16232 | ncrc6511 | 16292 | ncrc6597 | 16352 | ncrc6688 | 16412 | ncrc6785 | 16472 | ncrc6879 |
| 16233 | ncrc6512 | 16293 | ncrc6598 | 16353 | ncrc6692 | 16413 | ncrc6787 | 16473 | ncrc6881 |
| 16234 | ncrc6514 | 16294 | ncrc6600 | 16354 | ncrc6693 | 16414 | ncrc6789 | 16474 | ncrc6882 |
| 16235 | ncrc6515 | 16295 | ncrc6601 | 16355 | ncrc6694 | 16415 | ncrc6790 | 16475 | ncrc6883 |
| 16236 | ncrc6516 | 16296 | ncrc6603 | 16356 | ncrc6695 | 16416 | ncrc6794 | 16476 | ncrc6884 |
| 16237 | ncrc6517 | 16297 | ncrc6604 | 16357 | ncrc6697 | 16417 | ncrc6795 | 16477 | ncrc6885 |
| 16238 | ncrc6521 | 16298 | ncrc6605 | 16358 | ncrc6699 | 16418 | ncrc6796 | 16478 | ncrc6886 |
| 16239 | ncrc6522 | 16299 | ncrc6606 | 16359 | ncrc6700 | 16419 | ncrc6798 | 16479 | ncrc6888 |
| 16240 | ncrc6523 | 16300 | ncrc6607 | 16360 | ncrc6701 | 16420 | ncrc6799 | 16480 | ncrc6889 |
| 16241 | ncrc6524 | 16301 | ncrc6610 | 16361 | ncrc6703 | 16421 | ncrc6800 | 16481 | ncrc6890 |
| 16242 | ncrc6525 | 16302 | ncrc6612 | 16362 | ncrc6705 | 16422 | ncrc6801 | 16482 | ncrc6893 |
| 16243 | ncrc6526 | 16303 | ncrc6613 | 16363 | ncrc6706 | 16423 | ncrc6803 | 16483 | ncrc6895 |
| 16244 | ncrc6527 | 16304 | ncrc6615 | 16364 | ncrc6707 | 16424 | ncrc6804 | 16484 | ncrc6896 |
| 16245 | ncrc6528 | 16305 | ncrc6617 | 16365 | ncrc6708 | 16425 | ncrc6805 | 16485 | ncrc6897 |
| 16246 | ncrc6529 | 16306 | ncrc6618 | 16366 | ncrc6709 | 16426 | ncrc6810 | 16486 | ncrc6899 |
| 16247 | ncrc6530 | 16307 | ncrc6619 | 16367 | ncrc6712 | 16427 | ncrc6811 | 16487 | ncrc6900 |
| 16248 | ncrc6531 | 16308 | ncrc6620 | 16368 | ncrc6715 | 16428 | ncrc6813 | 16488 | ncrc6901 |
| 16249 | ncrc6535 | 16309 | ncrc6621 | 16369 | ncrc6716 | 16429 | ncrc6814 | 16489 | ncrc6904 |
| 16250 | ncrc6536 | 16310 | ncrc6623 | 16370 | ncrc6717 | 16430 | ncrc6815 | 16490 | ncrc6905 |
| 16251 | ncrc6537 | 16311 | ncrc6624 | 16371 | ncrc6718 | 16431 | ncrc6817 | 16491 | ncrc6906 |
| 16252 | ncrc6539 | 16312 | ncrc6626 | 16372 | ncrc6719 | 16432 | ncrc6818 | 16492 | ncrc6907 |
| 16253 | ncrc6541 | 16313 | ncrc6628 | 16373 | ncrc6720 | 16433 | ncrc6819 | 16493 | ncrc6908 |
| 16254 | ncrc6544 | 16314 | ncrc6632 | 16374 | ncrc6721 | 16434 | ncrc6823 | 16494 | ncrc6911 |
| 16255 | ncrc6545 | 16315 | ncrc6635 | 16375 | ncrc6722 | 16435 | ncrc6825 | 16495 | ncrc6912 |
| 16256 | ncrc6547 | 16316 | ncrc6636 | 16376 | ncrc6723 | 16436 | ncrc6827 | 16496 | ncrc6913 |
| 16257 | ncrc6548 | 16317 | ncrc6637 | 16377 | ncrc6724 | 16437 | ncrc6828 | 16497 | ncrc6914 |
| 16258 | ncrc6549 | 16318 | ncrc6641 | 16378 | ncrc6727 | 16438 | ncrc6831 | 16498 | ncrc6915 |
| 16259 | ncrc6551 | 16319 | ncrc6643 | 16379 | ncrc6728 | 16439 | ncrc6832 | 16499 | ncrc6920 |
| 16260 | ncrc6552 | 16320 | ncrc6644 | 16380 | ncrc6729 | 16440 | ncrc6833 | 16500 | ncrc6921 |

Figure 6C – List of EST Sequence Names From Normal Cartilage cDNA Library

| | | | | | | | | | |
|---|---|---|---|---|---|---|---|---|---|
| 16501 | ncrc6924 | 16561 | ncrc7009 | 16621 | ncrc7104 | 16681 | ncrc8834 | 16741 | ncrc8926 |
| 16502 | ncrc6925 | 16562 | ncrc7010 | 16622 | ncrc7105 | 16682 | ncrc8835 | 16742 | ncrc8927 |
| 16503 | ncrc6927 | 16563 | ncrc7012 | 16623 | ncrc7107 | 16683 | ncrc8836 | 16743 | ncrc8928 |
| 16504 | ncrc6928 | 16564 | ncrc7016 | 16624 | ncrc7108 | 16684 | ncrc8837 | 16744 | ncrc8930 |
| 16505 | ncrc6929 | 16565 | ncrc7017 | 16625 | ncrc7111 | 16685 | ncrc8839 | 16745 | ncrc8932 |
| 16506 | ncrc6931 | 16566 | ncrc7019 | 16626 | ncrc7113 | 16686 | ncrc8841 | 16746 | ncrc8933 |
| 16507 | ncrc6932 | 16567 | ncrc7023 | 16627 | ncrc7116 | 16687 | ncrc8844 | 16747 | ncrc8935 |
| 16508 | ncrc6935 | 16568 | ncrc7024 | 16628 | ncrc7119 | 16688 | ncrc8846 | 16748 | ncrc8937 |
| 16509 | ncrc6936 | 16569 | ncrc7027 | 16629 | ncrc7120 | 16689 | ncrc8847 | 16749 | ncrc8939 |
| 16510 | ncrc6937 | 16570 | ncrc7028 | 16630 | ncrc7121 | 16690 | ncrc8848 | 16750 | ncrc8940 |
| 16511 | ncrc6939 | 16571 | ncrc7029 | 16631 | ncrc7123 | 16691 | ncrc8849 | 16751 | ncrc8942 |
| 16512 | ncrc6941 | 16572 | ncrc7032 | 16632 | ncrc7125 | 16692 | ncrc8851 | 16752 | ncrc8943 |
| 16513 | ncrc6943 | 16573 | ncrc7033 | 16633 | ncrc7127 | 16693 | ncrc8852 | 16753 | ncrc8944 |
| 16514 | ncrc6944 | 16574 | ncrc7035 | 16634 | ncrc7128 | 16694 | ncrc8853 | 16754 | ncrc8945 |
| 16515 | ncrc6945 | 16575 | ncrc7036 | 16635 | ncrc7131 | 16695 | ncrc8855 | 16755 | ncrc8947 |
| 16516 | ncrc6947 | 16576 | ncrc7038 | 16636 | ncrc7132 | 16696 | ncrc8856 | 16756 | ncrc8948 |
| 16517 | ncrc6948 | 16577 | ncrc7039 | 16637 | ncrc7134 | 16697 | ncrc8859 | 16757 | ncrc8949 |
| 16518 | ncrc6949 | 16578 | ncrc7040 | 16638 | ncrc7136 | 16698 | ncrc8860 | 16758 | ncrc8951 |
| 16519 | ncrc6953 | 16579 | ncrc7041 | 16639 | ncrc7137 | 16699 | ncrc8861 | 16759 | ncrc8952 |
| 16520 | ncrc6954 | 16580 | ncrc7043 | 16640 | ncrc7139 | 16700 | ncrc8862 | 16760 | ncrc8954 |
| 16521 | ncrc6955 | 16581 | ncrc7044 | 16641 | ncrc7143 | 16701 | ncrc8863 | 16761 | ncrc8955 |
| 16522 | ncrc6956 | 16582 | ncrc7045 | 16642 | ncrc7144 | 16702 | ncrc8865 | 16762 | ncrc8956 |
| 16523 | ncrc6958 | 16583 | ncrc7047 | 16643 | ncrc7146 | 16703 | ncrc8867 | 16763 | ncrc8959 |
| 16524 | ncrc6959 | 16584 | ncrc7049 | 16644 | ncrc7148 | 16704 | ncrc8871 | 16764 | ncrc8961 |
| 16525 | ncrc6961 | 16585 | ncrc7050 | 16645 | ncrc7150 | 16705 | ncrc8873 | 16765 | ncrc8963 |
| 16526 | ncrc6963 | 16586 | ncrc7051 | 16646 | ncrc7151 | 16706 | ncrc8876 | 16766 | ncrc8964 |
| 16527 | ncrc6964 | 16587 | ncrc7052 | 16647 | ncrc7153 | 16707 | ncrc8878 | 16767 | ncrc8965 |
| 16528 | ncrc6965 | 16588 | ncrc7054 | 16648 | ncrc7155 | 16708 | ncrc8879 | 16768 | ncrc8967 |
| 16529 | ncrc6966 | 16589 | ncrc7055 | 16649 | ncrc7156 | 16709 | ncrc8880 | 16769 | ncrc8968 |
| 16530 | ncrc6967 | 16590 | ncrc7056 | 16650 | ncrc7158 | 16710 | ncrc8881 | 16770 | ncrc8969 |
| 16531 | ncrc6970 | 16591 | ncrc7057 | 16651 | ncrc7159 | 16711 | ncrc8883 | 16771 | ncrc8970 |
| 16532 | ncrc6971 | 16592 | ncrc7060 | 16652 | ncrc7160 | 16712 | ncrc8884 | 16772 | ncrc8971 |
| 16533 | ncrc6972 | 16593 | ncrc7062 | 16653 | ncrc7161 | 16713 | ncrc8887 | 16773 | ncrc8975 |
| 16534 | ncrc6973 | 16594 | ncrc7065 | 16654 | ncrc7162 | 16714 | ncrc8888 | 16774 | ncrc8976 |
| 16535 | ncrc6974 | 16595 | ncrc7066 | 16655 | ncrc7163 | 16715 | ncrc8889 | 16775 | ncrc8977 |
| 16536 | ncrc6976 | 16596 | ncrc7067 | 16656 | ncrc7164 | 16716 | ncrc8891 | 16776 | ncrc8979 |
| 16537 | ncrc6977 | 16597 | ncrc7068 | 16657 | ncrc7165 | 16717 | ncrc8892 | 16777 | ncrc8982 |
| 16538 | ncrc6979 | 16598 | ncrc7069 | 16658 | ncrc7167 | 16718 | ncrc8893 | 16778 | ncrc8983 |
| 16539 | ncrc6980 | 16599 | ncrc7070 | 16659 | ncrc7168 | 16719 | ncrc8895 | 16779 | ncrc8984 |
| 16540 | ncrc6981 | 16600 | ncrc7071 | 16660 | ncrc7169 | 16720 | ncrc8896 | 16780 | ncrc8987 |
| 16541 | ncrc6982 | 16601 | ncrc7076 | 16661 | ncrc7171 | 16721 | ncrc8897 | 16781 | ncrc8988 |
| 16542 | ncrc6983 | 16602 | ncrc7078 | 16662 | ncrc7173 | 16722 | ncrc8901 | 16782 | ncrc8990 |
| 16543 | ncrc6984 | 16603 | ncrc7080 | 16663 | ncrc7174 | 16723 | ncrc8903 | 16783 | ncrc8991 |
| 16544 | ncrc6985 | 16604 | ncrc7081 | 16664 | ncrc7177 | 16724 | ncrc8904 | 16784 | ncrc8992 |
| 16545 | ncrc6986 | 16605 | ncrc7082 | 16665 | ncrc7178 | 16725 | ncrc8907 | 16785 | ncrc8995 |
| 16546 | ncrc6988 | 16606 | ncrc7083 | 16666 | ncrc7179 | 16726 | ncrc8908 | 16786 | ncrc8997 |
| 16547 | ncrc6991 | 16607 | ncrc7085 | 16667 | ncrc7180 | 16727 | ncrc8909 | 16787 | ncrc8998 |
| 16548 | ncrc6992 | 16608 | ncrc7086 | 16668 | ncrc7181 | 16728 | ncrc8910 | 16788 | ncrc8999 |
| 16549 | ncrc6993 | 16609 | ncrc7089 | 16669 | ncrc7182 | 16729 | ncrc8911 | 16789 | ncrc9000 |
| 16550 | ncrc6994 | 16610 | ncrc7090 | 16670 | ncrc7184 | 16730 | ncrc8912 | 16790 | ncrc9002 |
| 16551 | ncrc6995 | 16611 | ncrc7091 | 16671 | ncrc7185 | 16731 | ncrc8915 | 16791 | ncrc9003 |
| 16552 | ncrc6996 | 16612 | ncrc7092 | 16672 | ncrc7186 | 16732 | ncrc8916 | 16792 | ncrc9004 |
| 16553 | ncrc6997 | 16613 | ncrc7095 | 16673 | ncrc7188 | 16733 | ncrc8917 | 16793 | ncrc9005 |
| 16554 | ncrc7000 | 16614 | ncrc7096 | 16674 | ncrc7189 | 16734 | ncrc8919 | 16794 | ncrc9006 |
| 16555 | ncrc7002 | 16615 | ncrc7097 | 16675 | ncrc7192 | 16735 | ncrc8920 | 16795 | ncrc9007 |
| 16556 | ncrc7003 | 16616 | ncrc7098 | 16676 | ncrc7193 | 16736 | ncrc8921 | 16796 | ncrc9008 |
| 16557 | ncrc7005 | 16617 | ncrc7099 | 16677 | ncrc7194 | 16737 | ncrc8922 | 16797 | ncrc9009 |
| 16558 | ncrc7006 | 16618 | ncrc7100 | 16678 | ncrc7195 | 16738 | ncrc8923 | 16798 | ncrc9010 |
| 16559 | ncrc7007 | 16619 | ncrc7102 | 16679 | ncrc7196 | 16739 | ncrc8924 | 16799 | ncrc9011 |
| 16560 | ncrc7008 | 16620 | ncrc7103 | 16680 | ncrc8833 | 16740 | ncrc8925 | 16800 | ncrc9012 |

Figure 6C – List of EST Sequence Names From Normal Cartilage cDNA Library

| | |
|---|---|
| 16801 | ncrc9013 |
| 16802 | ncrc9015 |
| 16803 | ncrc9016 |
| 16804 | ncrc9018 |
| 16805 | ncrc9019 |
| 16806 | ncrc9020 |
| 16807 | ncrc9021 |
| 16808 | ncrc9022 |
| 16809 | ncrc9023 |
| 16810 | ncrc9024 |
| 16811 | ncrc9025 |
| 16812 | ncrc9026 |
| 16813 | ncrc9027 |
| 16814 | ncrc9028 |
| 16815 | ncrc9031 |
| 16816 | ncrc9032 |
| 16817 | ncrc9033 |
| 16818 | ncrc9035 |
| 16819 | ncrc9037 |
| 16820 | ncrc9039 |
| 16821 | ncrc9040 |
| 16822 | ncrc9041 |
| 16823 | ncrc9043 |
| 16824 | ncrc9044 |
| 16825 | ncrc9047 |
| 16826 | ncrc9048 |
| 16827 | ncrc9049 |
| 16828 | ncrc9050 |
| 16829 | ncrc9051 |
| 16830 | ncrc9052 |
| 16831 | ncrc9053 |
| 16832 | ncrc9055 |
| 16833 | ncrc9056 |
| 16834 | ncrc9057 |
| 16835 | ncrc9060 |
| 16836 | ncrc9061 |
| 16837 | ncrc9063 |
| 16838 | ncrc9064 |
| 16839 | ncrc9065 |
| 16840 | ncrc9067 |
| 16841 | ncrc9071 |
| 16842 | ncrc9073 |
| 16843 | ncrc9077 |
| 16844 | ncrc9078 |
| 16845 | ncrc9079 |
| 16846 | ncrc9080 |
| 16847 | ncrc9081 |
| 16848 | ncrc9082 |
| 16849 | ncrc9083 |
| 16850 | ncrc9084 |
| 16851 | ncrc9085 |
| 16852 | ncrc9086 |
| 16853 | ncrc9088 |
| 16854 | ncrc9090 |
| 16855 | ncrc9092 |
| 16856 | ncrc9093 |
| 16857 | ncrc9094 |
| 16858 | ncrc9095 |
| 16859 | ncrc9096 |
| 16860 | ncrc9098 |
| 16861 | ncrc9100 |
| 16862 | ncrc9101 |
| 16863 | ncrc9103 |
| 16864 | ncrc9105 |
| 16865 | ncrc9106 |
| 16866 | ncrc9107 |
| 16867 | ncrc9108 |
| 16868 | ncrc9112 |
| 16869 | ncrc9113 |
| 16870 | ncrc9114 |
| 16871 | ncrc9115 |
| 16872 | ncrc9116 |
| 16873 | ncrc9117 |
| 16874 | ncrc9118 |
| 16875 | ncrc9119 |
| 16876 | ncrc9120 |
| 16877 | ncrc9121 |
| 16878 | ncrc9124 |
| 16879 | ncrc9127 |
| 16880 | ncrc9128 |
| 16881 | ncrc9131 |
| 16882 | ncrc9132 |
| 16883 | ncrc9135 |
| 16884 | ncrc9136 |
| 16885 | ncrc9139 |
| 16886 | ncrc9140 |
| 16887 | ncrc9141 |
| 16888 | ncrc9145 |
| 16889 | ncrc9147 |
| 16890 | ncrc9148 |
| 16891 | ncrc9149 |
| 16892 | ncrc9152 |
| 16893 | ncrc9153 |
| 16894 | ncrc9155 |
| 16895 | ncrc9157 |
| 16896 | ncrc9159 |
| 16897 | ncrc9160 |
| 16898 | ncrc9161 |
| 16899 | ncrc9163 |
| 16900 | ncrc9164 |
| 16901 | ncrc9166 |
| 16902 | ncrc9167 |
| 16903 | ncrc9168 |
| 16904 | ncrc9169 |
| 16905 | ncrc9172 |
| 16906 | ncrc9173 |
| 16907 | ncrc9174 |
| 16908 | ncrc9175 |
| 16909 | ncrc9177 |
| 16910 | ncrc9178 |
| 16911 | ncrc9179 |
| 16912 | ncrc9180 |
| 16913 | ncrc9181 |
| 16914 | ncrc9182 |
| 16915 | ncrc9183 |
| 16916 | ncrc9185 |
| 16917 | ncrc9187 |
| 16918 | ncrc9188 |
| 16919 | ncrc9189 |
| 16920 | ncrc9190 |
| 16921 | ncrc9191 |
| 16922 | ncrc9193 |
| 16923 | ncrc9194 |
| 16924 | ncrc9195 |
| 16925 | ncrc9196 |
| 16926 | ncrc9197 |
| 16927 | ncrc9200 |
| 16928 | ncrc9201 |
| 16929 | ncrc9202 |
| 16930 | ncrc9203 |
| 16931 | ncrc9204 |
| 16932 | ncrc9205 |
| 16933 | ncrc9207 |
| 16934 | ncrc9208 |
| 16935 | ncrc9210 |
| 16936 | ncrc9211 |
| 16937 | ncrc9212 |
| 16938 | ncrc9215 |
| 16939 | ncrc9217 |
| 16940 | ncrc9218 |
| 16941 | ncrc9220 |
| 16942 | ncrc9223 |
| 16943 | ncrc9224 |
| 16944 | ncrc9225 |
| 16945 | ncrc9227 |
| 16946 | ncrc9228 |
| 16947 | ncrc9229 |
| 16948 | ncrc9230 |
| 16949 | ncrc9231 |
| 16950 | ncrc9232 |
| 16951 | ncrc9233 |
| 16952 | ncrc9235 |
| 16953 | ncrc9237 |
| 16954 | ncrc9239 |
| 16955 | ncrc9240 |
| 16956 | ncrc9242 |
| 16957 | ncrc9243 |
| 16958 | ncrc9244 |
| 16959 | ncrc9245 |
| 16960 | ncrc9246 |
| 16961 | ncrc9247 |
| 16962 | ncrc9248 |
| 16963 | ncrc9249 |
| 16964 | ncrc9250 |
| 16965 | ncrc9251 |
| 16966 | ncrc9252 |
| 16967 | ncrc9253 |
| 16968 | ncrc9254 |
| 16969 | ncrc9255 |
| 16970 | ncrc9256 |
| 16971 | ncrc9257 |
| 16972 | ncrc9258 |
| 16973 | ncrc9259 |
| 16974 | ncrc9260 |
| 16975 | ncrc9261 |
| 16976 | ncrc9262 |
| 16977 | ncrc9263 |
| 16978 | ncrc9267 |
| 16979 | ncrc9268 |
| 16980 | ncrc9269 |
| 16981 | ncrc9270 |
| 16982 | ncrc9271 |
| 16983 | ncrc9272 |
| 16984 | ncrc9273 |
| 16985 | ncrc9274 |
| 16986 | ncrc9276 |
| 16987 | ncrc9278 |
| 16988 | ncrc9279 |
| 16989 | ncrc9280 |
| 16990 | ncrc9281 |
| 16991 | ncrc9283 |
| 16992 | ncrc9284 |
| 16993 | ncrc9285 |
| 16994 | ncrc9286 |
| 16995 | ncrc9288 |
| 16996 | ncrc9289 |
| 16997 | ncrc9290 |
| 16998 | ncrc9291 |
| 16999 | ncrc9292 |
| 17000 | ncrc9293 |
| 17001 | ncrc9294 |
| 17002 | ncrc9295 |
| 17003 | ncrc9296 |
| 17004 | ncrc9298 |
| 17005 | ncrc9299 |
| 17006 | ncrc9300 |
| 17007 | ncrc9301 |
| 17008 | ncrc9304 |
| 17009 | ncrc9305 |
| 17010 | ncrc9306 |
| 17011 | ncrc9307 |
| 17012 | ncrc9308 |
| 17013 | ncrc9309 |
| 17014 | ncrc9310 |
| 17015 | ncrc9311 |
| 17016 | ncrc9312 |
| 17017 | ncrc9313 |
| 17018 | ncrc9315 |
| 17019 | ncrc9316 |
| 17020 | ncrc9318 |
| 17021 | ncrc9320 |
| 17022 | ncrc9321 |
| 17023 | ncrc9322 |
| 17024 | ncrc9323 |
| 17025 | ncrc9324 |
| 17026 | ncrc9325 |
| 17027 | ncrc9326 |
| 17028 | ncrc9327 |
| 17029 | ncrc9328 |
| 17030 | ncrc9329 |
| 17031 | ncrc9331 |
| 17032 | ncrc9332 |
| 17033 | ncrc9335 |
| 17034 | ncrc9336 |
| 17035 | ncrc9338 |
| 17036 | ncrc9339 |
| 17037 | ncrc9340 |
| 17038 | ncrc9342 |
| 17039 | ncrc9343 |
| 17040 | ncrc9344 |
| 17041 | ncrc9345 |
| 17042 | ncrc9347 |
| 17043 | ncrc9349 |
| 17044 | ncrc9351 |
| 17045 | ncrc9354 |
| 17046 | ncrc9355 |
| 17047 | ncrc9356 |
| 17048 | ncrc9358 |
| 17049 | ncrc9359 |
| 17050 | ncrc9360 |
| 17051 | ncrc9361 |
| 17052 | ncrc9363 |
| 17053 | ncrc9364 |
| 17054 | ncrc9365 |
| 17055 | ncrc9366 |
| 17056 | ncrc9368 |
| 17057 | ncrc9369 |
| 17058 | ncrc9370 |
| 17059 | ncrc9371 |
| 17060 | ncrc9372 |
| 17061 | ncrc9376 |
| 17062 | ncrc9377 |
| 17063 | ncrc9381 |
| 17064 | ncrc9382 |
| 17065 | ncrc9384 |
| 17066 | ncrc9385 |
| 17067 | ncrc9386 |
| 17068 | ncrc9387 |
| 17069 | ncrc9390 |
| 17070 | ncrc9391 |
| 17071 | ncrc9392 |
| 17072 | ncrc9393 |
| 17073 | ncrc9394 |
| 17074 | ncrc9396 |
| 17075 | ncrc9397 |
| 17076 | ncrc9399 |
| 17077 | ncrc9400 |
| 17078 | ncrc9401 |
| 17079 | ncrc9403 |
| 17080 | ncrc9404 |
| 17081 | ncrc9405 |
| 17082 | ncrc9406 |
| 17083 | ncrc9408 |
| 17084 | ncrc9410 |
| 17085 | ncrc9411 |
| 17086 | ncrc9412 |
| 17087 | ncrc9415 |
| 17088 | ncrc9417 |
| 17089 | ncrc9420 |
| 17090 | ncrc9421 |
| 17091 | ncrc9424 |
| 17092 | ncrc9425 |
| 17093 | ncrc9427 |
| 17094 | ncrc9428 |
| 17095 | ncrc9429 |
| 17096 | ncrc9431 |
| 17097 | ncrc9432 |
| 17098 | ncrc9433 |
| 17099 | ncrc9434 |
| 17100 | ncrc9435 |

Figure 6C – List of EST Sequence Names From Normal Cartilage cDNA Library

| | | | | | | | | | |
|---|---|---|---|---|---|---|---|---|---|
| 17101 | ncrc9436 | 17161 | ncrc9517 | 17221 | ncrc9615 | 17281 | ncrc9707 | 17341 | ncrc9798 |
| 17102 | ncrc9437 | 17162 | ncrc9519 | 17222 | ncrc9616 | 17282 | ncrc9708 | 17342 | ncrc9802 |
| 17103 | ncrc9438 | 17163 | ncrc9523 | 17223 | ncrc9617 | 17283 | ncrc9709 | 17343 | ncrc9804 |
| 17104 | ncrc9439 | 17164 | ncrc9524 | 17224 | ncrc9619 | 17284 | ncrc9710 | 17344 | ncrc9805 |
| 17105 | ncrc9440 | 17165 | ncrc9525 | 17225 | ncrc9620 | 17285 | ncrc9711 | 17345 | ncrc9807 |
| 17106 | ncrc9443 | 17166 | ncrc9527 | 17226 | ncrc9625 | 17286 | ncrc9712 | 17346 | ncrc9808 |
| 17107 | ncrc9445 | 17167 | ncrc9528 | 17227 | ncrc9627 | 17287 | ncrc9716 | 17347 | ncrc9809 |
| 17108 | ncrc9446 | 17168 | ncrc9530 | 17228 | ncrc9629 | 17288 | ncrc9717 | 17348 | ncrc9811 |
| 17109 | ncrc9447 | 17169 | ncrc9531 | 17229 | ncrc9631 | 17289 | ncrc9720 | 17349 | ncrc9813 |
| 17110 | ncrc9448 | 17170 | ncrc9535 | 17230 | ncrc9633 | 17290 | ncrc9721 | 17350 | ncrc9815 |
| 17111 | ncrc9450 | 17171 | ncrc9539 | 17231 | ncrc9635 | 17291 | ncrc9722 | 17351 | ncrc9817 |
| 17112 | ncrc9451 | 17172 | ncrc9542 | 17232 | ncrc9637 | 17292 | ncrc9723 | 17352 | ncrc9819 |
| 17113 | ncrc9452 | 17173 | ncrc9543 | 17233 | ncrc9639 | 17293 | ncrc9724 | 17353 | ncrc9821 |
| 17114 | ncrc9455 | 17174 | ncrc9545 | 17234 | ncrc9641 | 17294 | ncrc9725 | 17354 | ncrc9822 |
| 17115 | ncrc9456 | 17175 | ncrc9546 | 17235 | ncrc9642 | 17295 | ncrc9726 | 17355 | ncrc9823 |
| 17116 | ncrc9457 | 17176 | ncrc9547 | 17236 | ncrc9643 | 17296 | ncrc9727 | 17356 | ncrc9825 |
| 17117 | ncrc9460 | 17177 | ncrc9548 | 17237 | ncrc9646 | 17297 | ncrc9728 | 17357 | ncrc9826 |
| 17118 | ncrc9461 | 17178 | ncrc9549 | 17238 | ncrc9647 | 17298 | ncrc9729 | 17358 | ncrc9830 |
| 17119 | ncrc9462 | 17179 | ncrc9550 | 17239 | ncrc9648 | 17299 | ncrc9735 | 17359 | ncrc9832 |
| 17120 | ncrc9463 | 17180 | ncrc9551 | 17240 | ncrc9649 | 17300 | ncrc9736 | 17360 | ncrc9834 |
| 17121 | ncrc9464 | 17181 | ncrc9552 | 17241 | ncrc9651 | 17301 | ncrc9737 | 17361 | ncrc9835 |
| 17122 | ncrc9466 | 17182 | ncrc9555 | 17242 | ncrc9652 | 17302 | ncrc9738 | 17362 | ncrc9836 |
| 17123 | ncrc9467 | 17183 | ncrc9557 | 17243 | ncrc9653 | 17303 | ncrc9739 | 17363 | ncrc9838 |
| 17124 | ncrc9468 | 17184 | ncrc9558 | 17244 | ncrc9654 | 17304 | ncrc9742 | 17364 | ncrc9841 |
| 17125 | ncrc9469 | 17185 | ncrc9560 | 17245 | ncrc9655 | 17305 | ncrc9743 | 17365 | ncrc9843 |
| 17126 | ncrc9470 | 17186 | ncrc9561 | 17246 | ncrc9656 | 17306 | ncrc9744 | 17366 | ncrc9844 |
| 17127 | ncrc9471 | 17187 | ncrc9562 | 17247 | ncrc9658 | 17307 | ncrc9745 | 17367 | ncrc9846 |
| 17128 | ncrc9472 | 17188 | ncrc9563 | 17248 | ncrc9659 | 17308 | ncrc9747 | 17368 | ncrc9847 |
| 17129 | ncrc9473 | 17189 | ncrc9564 | 17249 | ncrc9660 | 17309 | ncrc9748 | 17369 | ncrc9849 |
| 17130 | ncrc9474 | 17190 | ncrc9566 | 17250 | ncrc9661 | 17310 | ncrc9749 | 17370 | ncrc9850 |
| 17131 | ncrc9475 | 17191 | ncrc9567 | 17251 | ncrc9664 | 17311 | ncrc9750 | 17371 | ncrc9851 |
| 17132 | ncrc9478 | 17192 | ncrc9570 | 17252 | ncrc9669 | 17312 | ncrc9751 | 17372 | ncrc9852 |
| 17133 | ncrc9480 | 17193 | ncrc9572 | 17253 | ncrc9671 | 17313 | ncrc9752 | 17373 | ncrc9855 |
| 17134 | ncrc9481 | 17194 | ncrc9573 | 17254 | ncrc9672 | 17314 | ncrc9754 | 17374 | ncrc9858 |
| 17135 | ncrc9483 | 17195 | ncrc9574 | 17255 | ncrc9673 | 17315 | ncrc9757 | 17375 | ncrc9859 |
| 17136 | ncrc9484 | 17196 | ncrc9576 | 17256 | ncrc9674 | 17316 | ncrc9758 | 17376 | ncrc9860 |
| 17137 | ncrc9485 | 17197 | ncrc9578 | 17257 | ncrc9676 | 17317 | ncrc9759 | 17377 | ncrc9861 |
| 17138 | ncrc9486 | 17198 | ncrc9579 | 17258 | ncrc9677 | 17318 | ncrc9760 | 17378 | ncrc9862 |
| 17139 | ncrc9487 | 17199 | ncrc9581 | 17259 | ncrc9678 | 17319 | ncrc9763 | 17379 | ncrc9863 |
| 17140 | ncrc9488 | 17200 | ncrc9582 | 17260 | ncrc9679 | 17320 | ncrc9766 | 17380 | ncrc9864 |
| 17141 | ncrc9489 | 17201 | ncrc9583 | 17261 | ncrc9680 | 17321 | ncrc9768 | 17381 | ncrc9865 |
| 17142 | ncrc9491 | 17202 | ncrc9584 | 17262 | ncrc9681 | 17322 | ncrc9770 | 17382 | ncrc9866 |
| 17143 | ncrc9492 | 17203 | ncrc9585 | 17263 | ncrc9682 | 17323 | ncrc9771 | 17383 | ncrc9867 |
| 17144 | ncrc9493 | 17204 | ncrc9586 | 17264 | ncrc9683 | 17324 | ncrc9772 | 17384 | ncrc9869 |
| 17145 | ncrc9495 | 17205 | ncrc9587 | 17265 | ncrc9684 | 17325 | ncrc9773 | 17385 | ncrc9871 |
| 17146 | ncrc9496 | 17206 | ncrc9588 | 17266 | ncrc9685 | 17326 | ncrc9774 | 17386 | ncrc9872 |
| 17147 | ncrc9497 | 17207 | ncrc9591 | 17267 | ncrc9687 | 17327 | ncrc9775 | 17387 | ncrc9874 |
| 17148 | ncrc9498 | 17208 | ncrc9592 | 17268 | ncrc9688 | 17328 | ncrc9776 | 17388 | ncrc9875 |
| 17149 | ncrc9499 | 17209 | ncrc9593 | 17269 | ncrc9689 | 17329 | ncrc9777 | 17389 | ncrc9877 |
| 17150 | ncrc9500 | 17210 | ncrc9594 | 17270 | ncrc9691 | 17330 | ncrc9778 | 17390 | ncrc9879 |
| 17151 | ncrc9502 | 17211 | ncrc9596 | 17271 | ncrc9692 | 17331 | ncrc9779 | 17391 | ncrc9880 |
| 17152 | ncrc9503 | 17212 | ncrc9597 | 17272 | ncrc9694 | 17332 | ncrc9783 | 17392 | ncrc9881 |
| 17153 | ncrc9504 | 17213 | ncrc9598 | 17273 | ncrc9695 | 17333 | ncrc9784 | 17393 | ncrc9883 |
| 17154 | ncrc9505 | 17214 | ncrc9601 | 17274 | ncrc9696 | 17334 | ncrc9786 | 17394 | ncrc9885 |
| 17155 | ncrc9506 | 17215 | ncrc9603 | 17275 | ncrc9697 | 17335 | ncrc9787 | 17395 | ncrc9886 |
| 17156 | ncrc9507 | 17216 | ncrc9604 | 17276 | ncrc9698 | 17336 | ncrc9790 | 17396 | ncrc9888 |
| 17157 | ncrc9508 | 17217 | ncrc9607 | 17277 | ncrc9700 | 17337 | ncrc9793 | 17397 | ncrc9890 |
| 17158 | ncrc9513 | 17218 | ncrc9608 | 17278 | ncrc9703 | 17338 | ncrc9794 | 17398 | ncrc9891 |
| 17159 | ncrc9514 | 17219 | ncrc9611 | 17279 | ncrc9704 | 17339 | ncrc9795 | 17399 | ncrc9892 |
| 17160 | ncrc9515 | 17220 | ncrc9612 | 17280 | ncrc9705 | 17340 | ncrc9796 | 17400 | ncrc9894 |

Figure 6C – List of EST Sequence Names From Normal Cartilage cDNA Library

| | | | | | | | | | |
|---|---|---|---|---|---|---|---|---|---|
| 17401 | ncrc9899 | 17413 | ncrc9914 | 17425 | ncrc9936 | 17437 | ncrc9952 | 17449 | ncrc9969 |
| 17402 | ncrc9900 | 17414 | ncrc9916 | 17426 | ncrc9937 | 17438 | ncrc9954 | 17450 | ncrc9970 |
| 17403 | ncrc9901 | 17415 | ncrc9917 | 17427 | ncrc9939 | 17439 | ncrc9955 | 17451 | ncrc9972 |
| 17404 | ncrc9903 | 17416 | ncrc9919 | 17428 | ncrc9940 | 17440 | ncrc9956 | 17452 | ncrc9973 |
| 17405 | ncrc9904 | 17417 | ncrc9920 | 17429 | ncrc9941 | 17441 | ncrc9957 | 17453 | ncrc9975 |
| 17406 | ncrc9905 | 17418 | ncrc9921 | 17430 | ncrc9942 | 17442 | ncrc9958 | 17454 | ncrc9976 |
| 17407 | ncrc9908 | 17419 | ncrc9923 | 17431 | ncrc9943 | 17443 | ncrc9959 | 17455 | ncrc9978 |
| 17408 | ncrc9909 | 17420 | ncrc9924 | 17432 | ncrc9944 | 17444 | ncrc9960 | 17456 | ncrc9980 |
| 17409 | ncrc9910 | 17421 | ncrc9925 | 17433 | ncrc9945 | 17445 | ncrc9961 | 17457 | ncrc9982 |
| 17410 | ncrc9911 | 17422 | ncrc9928 | 17434 | ncrc9947 | 17446 | ncrc9962 | 17458 | ncrc9983 |
| 17411 | ncrc9912 | 17423 | ncrc9929 | 17435 | ncrc9948 | 17447 | ncrc9966 | | |
| 17412 | ncrc9913 | 17424 | ncrc9935 | 17436 | ncrc9949 | 17448 | ncrc9967 | | |

Figure 6C – List of EST Sequence Names From Normal Cartilage cDNA Library

| | |
|---|---|
| 17459 | contigapri02-010014 |
| 17460 | contigapri02-010015 |
| 17461 | contigapri02-010016 |
| 17462 | contigapri02-010017 |
| 17463 | contigapri02-010018 |
| 17464 | contigapri02-010019 |
| 17465 | contigapri02-010020 |
| 17466 | contigapri02-010022 |
| 17467 | contigapri02-010023 |
| 17468 | contigapri02-010024 |
| 17469 | contigapri02-010025 |
| 17470 | contigapri03-010002 |
| 17471 | contigapri03-010004 |
| 17472 | contigapri03-010006 |
| 17473 | contigapri03-010007 |
| 17474 | contigapri03-010008 |
| 17475 | contigapri03-010009 |
| 17476 | contigapri03-010010 |
| 17477 | contigapri03-010011 |
| 17478 | contigapri03-010012 |
| 17479 | contigapri03-010013 |
| 17480 | contigapri03-010014 |
| 17481 | contigapri03-010016 |
| 17482 | contigapri03-010017 |
| 17483 | contigapri05-010021 |
| 17484 | contigapri05-010022 |
| 17485 | contigapri05-010024 |
| 17486 | contigapri05-010025 |
| 17487 | contigapri05-010026 |
| 17488 | contigapri05-010027 |
| 17489 | contigapri05-010028 |
| 17490 | contigapri05-010029 |
| 17491 | contigapri05-010030 |
| 17492 | contigapri05-010031 |
| 17493 | contigapri05-010032 |
| 17494 | contigapri05-010033 |
| 17495 | contigapri05-010034 |
| 17496 | contigapri05-010035 |
| 17497 | contigapri05-010036 |
| 17498 | contigapri05-010037 |
| 17499 | contigapri05-010038 |
| 17500 | contigapri05-010039 |
| 17501 | contigapri06-010002 |
| 17502 | contigapri06-010003 |
| 17503 | contigapri06-010004 |
| 17504 | contigmar20-20010021 |
| 17505 | contigmar20-20010022 |
| 17506 | contigmar20-20010023 |
| 17507 | contigmar20-20010024 |
| 17508 | contigmar20-20010026 |
| 17509 | contigmar20-20010027 |
| 17510 | contigmar20-20010028 |
| 17511 | contigmar20-20010029 |
| 17512 | contigmar20-20010031 |
| 17513 | contigmar20-20010032 |
| 17514 | contigmar20-20010033 |
| 17515 | contigmar20-20010034 |
| 17516 | contigmar20-20010035 |
| 17517 | contigmar20-20010036 |
| 17518 | contigmar20-20010037 |
| 17519 | contigmar20-20010038 |
| 17520 | contigmar20-20010039 |
| 17521 | contigmar21-010002 |
| 17522 | contigmar21-010003 |
| 17523 | contigmar21-010004 |
| 17524 | contigmar21-010005 |
| 17525 | contigmar21-010006 |
| 17526 | contigmar21-010007 |
| 17527 | contigmar21-010008 |
| 17528 | contigmar21-010010 |
| 17529 | contigmar21-010011 |
| 17530 | contigmar21-010013 |
| 17531 | contigmar21-010014 |
| 17532 | contigmar21-010015 |
| 17533 | contigmar21-010016 |
| 17534 | contigmar21-010017 |
| 17535 | contigmar21-010018 |
| 17536 | contigmar21-010020 |
| 17537 | contigmar21-010021 |
| 17538 | contigmar21-010022 |
| 17539 | contigmar22-010003 |
| 17540 | contigmar22-010004 |
| 17541 | contigmar22-010005 |
| 17542 | contigmar22-010007 |
| 17543 | contigmar22-010008 |
| 17544 | contigmar22-010009 |
| 17545 | contigmar22-010010 |
| 17546 | contigmar22-010011 |
| 17547 | contigmar22-010012 |
| 17548 | contigmar22-010013 |
| 17549 | contigmar22-010014 |
| 17550 | contigmar22-010016 |
| 17551 | contigmar22-010017 |
| 17552 | contigmar22-010018 |
| 17553 | contigmar22-010019 |
| 17554 | contigmar22-010020 |
| 17555 | contigmar22-010021 |
| 17556 | contigmar23-010002 |
| 17557 | contigmar23-010003 |
| 17558 | contigmar23-010004 |
| 17559 | contigmar23-010008 |
| 17560 | contigmar23-010009 |
| 17561 | contigmar23-010010 |
| 17562 | contigmar23-010012 |
| 17563 | contigmar23-010013 |
| 17564 | contigmar23-010014 |
| 17565 | contigmar23-010016 |
| 17566 | contigmar23-010017 |
| 17567 | contigmar23-010018 |
| 17568 | contigmar23-010019 |
| 17569 | contigmar23-010020 |
| 17570 | contigmar26-010002 |
| 17571 | contigmar26-010003 |
| 17572 | contigmar26-010004 |
| 17573 | contigmar26-010005 |
| 17574 | contigmar26-010007 |
| 17575 | contigmar26-010008 |
| 17576 | contigmar26-010010 |
| 17577 | contigmar26-010011 |
| 17578 | contigmar26-010013 |
| 17579 | contigmar26-010016 |
| 17580 | contigmar26-010017 |
| 17581 | contigmar26-010018 |
| 17582 | contigmar26-010019 |
| 17583 | contigmar26-010020 |
| 17584 | contigmar26-010021 |
| 17585 | contigmar26-010023 |
| 17586 | contigmar26-010024 |
| 17587 | contigmar27-010002 |
| 17588 | contigmar27-010003 |
| 17589 | contigmar27-010004 |
| 17590 | contigmar27-010007 |
| 17591 | contigmar27-010008 |
| 17592 | contigmar27-010010 |
| 17593 | contigmar27-010014 |
| 17594 | contigmar27-010015 |
| 17595 | contigmar27-010016 |
| 17596 | contigmar27-010017 |
| 17597 | contigmar27-010018 |
| 17598 | contigmar28-29-010002 |
| 17599 | contigmar28-29-010003 |
| 17600 | contigmar28-29-010004 |
| 17601 | contigmar28-29-010005 |
| 17602 | contigmar28-29-010006 |
| 17603 | contigmar28-29-010007 |
| 17604 | contigmar28-29-010009 |
| 17605 | contigmar28-29-010013 |
| 17606 | contigmar28-29-010016 |
| 17607 | contigmar28-29-010017 |
| 17608 | contigmar28-29-010021 |
| 17609 | contigmar28-29-010022 |
| 17610 | contigmar28-29-010023 |
| 17611 | contigmar28-29-010026 |
| 17612 | contigmar28-29-010027 |
| 17613 | contigmar28-29-010028 |
| 17614 | contigmar28-29-010029 |
| 17615 | contigmar28-29-010031 |
| 17616 | contigmar28-29-010033 |
| 17617 | contigmar28-29-010034 |
| 17618 | contigmar28-29-010035 |
| 17619 | contigmar28-29-010036 |
| 17620 | contigmar28-29-010037 |
| 17621 | contigmar28-29-010038 |
| 17622 | contigmar30-010002 |
| 17623 | contigmar30-010003 |
| 17624 | contigmar30-010006 |
| 17625 | contigmar30-010007 |
| 17626 | contigmar30-010008 |
| 17627 | contigmar30-010010 |
| 17628 | contigmar30-010011 |
| 17629 | contigmar30-010012 |
| 17630 | contigmar30-010013 |
| 17631 | contigmar30-010014 |
| 17632 | contigmar30-010015 |
| 17633 | contigmar30-010016 |
| 17634 | contigmar30-010017 |
| 17635 | contigmar30-010018 |
| 17636 | contigmar30-010019 |
| 17637 | contigmar30-010020 |
| 17638 | contigmar30-010021 |

Figure 6C – List of EST Sequence Names From Normal Cartilage cDNA Library 17639 contigmar30-010022

Figure 6D – List of EST Sequence Names From Mild OA Cartilage cDNA Library

| | | | | | | | | | |
|---|---|---|---|---|---|---|---|---|---|
| 1 | MIOA0002a | 61 | MIOA0084a | 121 | MIOA0159 | 181 | MIOA0226a | 241 | MIOA0292 |
| 2 | MIOA0003a | 62 | MIOA0085a | 122 | MIOA0160 | 182 | MIOA0227a | 242 | MIOA0293n |
| 3 | mioa0004a | 63 | MIOA0086a | 123 | mioa0161 | 183 | mioa0228a | 243 | MIOA0294 |
| 4 | MIOA0005a | 64 | MIOA0087a | 124 | MIOA0162 | 184 | MIOA0229a | 244 | MIOA0295 |
| 5 | MIOA0006a | 65 | MIOA0088a | 125 | MIOA0164 | 185 | MIOA0230a | 245 | MIOA0296 |
| 6 | MIOA0008a | 66 | MIOA0089a | 126 | MIOA0165 | 186 | MIOA0231a | 246 | MIOA0297 |
| 7 | MIOA0010a | 67 | MIOA0090a | 127 | MIOA0166 | 187 | MIOA0232a | 247 | MIOA0298n |
| 8 | MIOA0011a | 68 | MIOA0092a | 128 | MIOA0167 | 188 | MIOA0233a | 248 | MIOA0299n |
| 9 | MIOA0013a | 69 | MIOA0093a | 129 | MIOA0168n | 189 | MIOA0234a | 249 | MIOA0300 |
| 10 | MIOA0019a | 70 | MIOA0095a | 130 | MIOA0169 | 190 | mioa0235a | 250 | MIOA0302 |
| 11 | MIOA0022a | 71 | MIOA0096a | 131 | MIOA0170 | 191 | MIOA0236a | 251 | MIOA0303 |
| 12 | MIOA0024a | 72 | MIOA0097 | 132 | MIOA0171 | 192 | MIOA0237a | 252 | mioa0304 |
| 13 | MIOA0025a | 73 | MIOA0098 | 133 | MIOA0172 | 193 | MIOA0238a | 253 | MIOA0306n |
| 14 | MIOA0026a | 74 | MIOA0099 | 134 | MIOA0174 | 194 | MIOA0240a | 254 | MIOA0307 |
| 15 | MIOA0028a | 75 | MIOA0100 | 135 | MIOA0175n | 195 | MIOA0241a | 255 | MIOA0308 |
| 16 | MIOA0029a | 76 | MIOA0101 | 136 | MIOA0176 | 196 | MIOA0242a | 256 | MIOA0309 |
| 17 | MIOA0030a | 77 | MIOA0102 | 137 | MIOA0177n | 197 | MIOA0243a | 257 | MIOA0310 |
| 18 | MIOA0031a | 78 | MIOA0103 | 138 | MIOA0178 | 198 | MIOA0245a | 258 | MIOA0311n |
| 19 | MIOA0032a | 79 | MIOA0104 | 139 | MIOA0179 | 199 | MIOA0246a | 259 | MIOA0312n |
| 20 | MIOA0033a | 80 | MIOA0105 | 140 | MIOA0180 | 200 | MIOA0247a | 260 | MIOA0314 |
| 21 | MIOA0035a | 81 | mioa0108m | 141 | MIOA0181 | 201 | MIOA0248a | 261 | MIOA0315 |
| 22 | MIOA0036a | 82 | MIOA0109 | 142 | MIOA0182 | 202 | MIOA0249a | 262 | MIOA0316 |
| 23 | MIOA0037a | 83 | mioa0110 | 143 | MIOA0183 | 203 | MIOA0250a | 263 | MIOA0317 |
| 24 | MIOA0038a | 84 | MIOA0111 | 144 | MIOA0184 | 204 | MIOA0251a | 264 | MIOA0318 |
| 25 | MIOA0039a | 85 | mioa0113 | 145 | MIOA0185 | 205 | MIOA0252a | 265 | MIOA0320 |
| 26 | MIOA0042a | 86 | mioa0114 | 146 | MIOA0186 | 206 | MIOA0253a | 266 | MIOA0321 |
| 27 | MIOA0044a | 87 | mioa0115 | 147 | MIOA0187n | 207 | MIOA0254a | 267 | MIOA0322 |
| 28 | MIOA0045a | 88 | MIOA0116 | 148 | MIOA0188 | 208 | MIOA0255a | 268 | MIOA0323 |
| 29 | MIOA0046a | 89 | MIOA0117 | 149 | MIOA0189 | 209 | MIOA0256a | 269 | MIOA0324 |
| 30 | MIOA0047a | 90 | mioa0118 | 150 | MIOA0190 | 210 | MIOA0257 | 270 | MIOA0325 |
| 31 | MIOA0049a | 91 | MIOA0119 | 151 | MIOA0191n | 211 | mioa0258n | 271 | MIOA0327 |
| 32 | MIOA0051a | 92 | MIOA0122 | 152 | MIOA0192 | 212 | MIOA0259 | 272 | MIOA0328 |
| 33 | MIOA0053a | 93 | MIOA0125 | 153 | MIOA0193a | 213 | MIOA0261 | 273 | MIOA0329n |
| 34 | MIOA0054a | 94 | MIOA0126 | 154 | MIOA0195a | 214 | MIOA0262 | 274 | MIOA0330n |
| 35 | MIOA0055a | 95 | MIOA0127 | 155 | MIOA0197a | 215 | MIOA0263 | 275 | MIOA0331 |
| 36 | MIOA0056a | 96 | MIOA0128 | 156 | MIOA0198a | 216 | MIOA0264 | 276 | MIOA0332 |
| 37 | MIOA0057a | 97 | MIOA0131 | 157 | MIOA0199a | 217 | mioa0265nn | 277 | mioa0334n |
| 38 | MIOA0058a | 98 | MIOA0132 | 158 | MIOA0201a | 218 | MIOA0266n | 278 | MIOA0335 |
| 39 | MIOA0059a | 99 | MIOA0134 | 159 | MIOA0202a | 219 | MIOA0268 | 279 | mioa0337m |
| 40 | MIOA0060a | 100 | MIOA0135 | 160 | MIOA0203a | 220 | MIOA0269 | 280 | MIOA0338 |
| 41 | MIOA0061a | 101 | mioa0136m | 161 | MIOA0204a | 221 | MIOA0270 | 281 | MIOA0339 |
| 42 | MIOA0062a | 102 | MIOA0138 | 162 | MIOA0205a | 222 | MIOA0271 | 282 | mioa0340 |
| 43 | MIOA0063a | 103 | MIOA0139 | 163 | MIOA0207a | 223 | MIOA0273 | 283 | MIOA0341 |
| 44 | MIOA0064a | 104 | MIOA0140 | 164 | MIOA0208a | 224 | MIOA0274 | 284 | MIOA0342 |
| 45 | MIOA0065a | 105 | MIOA0141 | 165 | MIOA0209a | 225 | mioa0275n | 285 | MIOA0343n |
| 46 | MIOA0066a | 106 | MIOA0142 | 166 | mioa0210a | 226 | MIOA0276 | 286 | MIOA0344 |
| 47 | MIOA0067A | 107 | MIOA0143 | 167 | MIOA0211a | 227 | MIOA0277 | 287 | MIOA0346n |
| 48 | mioa0068a | 108 | MIOA0145 | 168 | MIOA0212a | 228 | MIOA0278 | 288 | mioa0347m |
| 49 | MIOA0070a | 109 | MIOA0146 | 169 | MIOA0213a | 229 | MIOA0279 | 289 | mioa0348m |
| 50 | MIOA0071a | 110 | MIOA0147 | 170 | MIOA0214a | 230 | MIOA0280 | 290 | mioa0350m |
| 51 | MIOA0072a | 111 | MIOA0149 | 171 | MIOA0215a | 231 | MIOA0281n | 291 | mioa0351m |
| 52 | MIOA0073a | 112 | MIOA0150 | 172 | MIOA0217a | 232 | MIOA0282 | 292 | MIOA0354a |
| 53 | MIOA0074a | 113 | MIOA0151 | 173 | MIOA0218a | 233 | MIOA0283 | 293 | mioa0355a |
| 54 | MIOA0075a | 114 | MIOA0152 | 174 | MIOA0219a | 234 | MIOA0284 | 294 | MIOA0358a |
| 55 | MIOA0076a | 115 | mioa0153 | 175 | MIOA0220a | 235 | MIOA0285 | 295 | MIOA0359a |
| 56 | MIOA0077a | 116 | MIOA0154 | 176 | MIOA0221a | 236 | MIOA0286 | 296 | MIOA0360a |
| 57 | MIOA0078a | 117 | MIOA0155 | 177 | mioa0222a | 237 | MIOA0288 | 297 | MIOA0361a |
| 58 | MIOA0081a | 118 | mioa0156 | 178 | MIOA0223a | 238 | MIOA0289 | 298 | MIOA0363a |
| 59 | mioa0082a | 119 | MIOA0157 | 179 | MIOA0224a | 239 | MIOA0290 | 299 | MIOA0364a |
| 60 | mioa0083a | 120 | MIOA0158 | 180 | mioa0225a | 240 | MIOA0291 | 300 | MIOA0365a |

Figure 6D - List of EST Sequence Names From Mild OA Cartilage cDNA Library

| | | | | | | | | | |
|---|---|---|---|---|---|---|---|---|---|
| 301 | MIOA0366a | 361 | MIOA0471 | 421 | MIOA0537 | 481 | mioa0605a | 541 | mioa0709m |
| 302 | MIOA0367a | 362 | MIOA0472 | 422 | MIOA0538 | 482 | MIOA0607a | 542 | MIOA0710 |
| 303 | MIOA0368a | 363 | MIOA0473 | 423 | MIOA0540 | 483 | MIOA0608a | 543 | MIOA0711 |
| 304 | MIOA0370a | 364 | MIOA0474 | 424 | MIOA0541n | 484 | MIOA0610a | 544 | MIOA0712 |
| 305 | MIOA0372a | 365 | MIOA0475 | 425 | mioa0542n | 485 | MIOA0611a | 545 | MIOA0713 |
| 306 | MIOA0373a | 366 | MIOA0476 | 426 | MIOA0543 | 486 | MIOA0613a | 546 | MIOA0714 |
| 307 | MIOA0375a | 367 | MIOA0477 | 427 | MIOA0544 | 487 | mioa0614a | 547 | MIOA0715 |
| 308 | MIOA0378a | 368 | MIOA0478 | 428 | mioa0545a | 488 | MIOA0616a | 548 | MIOA0716 |
| 309 | MIOA0379a | 369 | MIOA0479n | 429 | MIOA0546a | 489 | MIOA0618a | 549 | mioa0717 |
| 310 | MIOA0380a | 370 | mioa0480m | 430 | mioa0548an | 490 | MIOA0621a | 550 | MIOA0718 |
| 311 | MIOA0381a | 371 | MIOA0481n | 431 | MIOA0550a | 491 | MIOA0622a | 551 | MIOA0719 |
| 312 | MIOA0382a | 372 | MIOA0482n | 432 | MIOA0551a | 492 | MIOA0624a | 552 | MIOA0720n |
| 313 | MIOA0384a | 373 | MIOA0483 | 433 | MIOA0553a | 493 | MIOA0625a | 553 | MIOA0721 |
| 314 | MIOA0387a | 374 | MIOA0484 | 434 | MIOA0554a | 494 | MIOA0626a | 554 | MIOA0722 |
| 315 | MIOA0388a | 375 | MIOA0485 | 435 | mioa0555a | 495 | mioa0629a | 555 | MIOA0723 |
| 316 | MIOA0390a | 376 | MIOA0486 | 436 | mioa0556a | 496 | MIOA0630a | 556 | MIOA0724 |
| 317 | MIOA0392a | 377 | MIOA0487 | 437 | mioa0557a | 497 | MIOA0632a | 557 | MIOA0725 |
| 318 | MIOA0393a | 378 | MIOA0488n | 438 | mioa0558a | 498 | MIOA0633a | 558 | MIOA0726n |
| 319 | MIOA0394a | 379 | MIOA0489 | 439 | MIOA0559n | 499 | MIOA0637a | 559 | MIOA0727 |
| 320 | MIOA0395a | 380 | mioa0491m | 440 | mioa0560a | 500 | MIOA0639a | 560 | MIOA0728 |
| 321 | MIOA0397a | 381 | mioa0492m | 441 | mioa0561a | 501 | mioa0640an | 561 | MIOA0729 |
| 322 | MIOA0398a | 382 | MIOA0493 | 442 | mioa0562a | 502 | MIOA0641 | 562 | MIOA0730 |
| 323 | MIOA0400a | 383 | MIOA0494 | 443 | mioa0563a | 503 | MIOA0642 | 563 | MIOA0731 |
| 324 | MIOA0401a | 384 | MIOA0495 | 444 | mioa0564a | 504 | MIOA0643n | 564 | MIOA0732 |
| 325 | MIOA0404a | 385 | MIOA0497n | 445 | MIOA0565n | 505 | MIOA0644 | 565 | MIOA0733 |
| 326 | MIOA0405a | 386 | MIOA0498n | 446 | mioa0566a | 506 | MIOA0645 | 566 | MIOA0734 |
| 327 | MIOA0407a | 387 | MIOA0500 | 447 | mioa0567a | 507 | MIOA0646 | 567 | MIOA0735 |
| 328 | MIOA0408a | 388 | MIOA0501 | 448 | mioa0568 | 508 | MIOA0647 | 568 | MIOA0736 |
| 329 | MIOA0409a | 389 | MIOA0502 | 449 | mioa0569a | 509 | MIOA0648 | 569 | mioa0737m |
| 330 | MIOA0410a | 390 | mioa0503m | 450 | mioa0571a | 510 | MIOA0650 | 570 | mioa0738m |
| 331 | MIOA0411a | 391 | MIOA0504n | 451 | MIOA0572n | 511 | MIOA0651 | 571 | mioa0739m |
| 332 | mioa0412a | 392 | MIOA0505n | 452 | mioa0573a | 512 | MIOA0652 | 572 | mioa0740m |
| 333 | MIOA0413a | 393 | mioa0506m | 453 | mioa0574 | 513 | MIOA0653 | 573 | mioa0741m |
| 334 | MIOA0414a | 394 | mioa0507m | 454 | mioa0575a | 514 | MIOA0677 | 574 | MIOA0742 |
| 335 | MIOA0415a | 395 | MIOA0508n | 455 | mioa0576a | 515 | MIOA0679 | 575 | mioa0743 |
| 336 | MIOA0416a | 396 | mioa0509 | 456 | MIOA0577a | 516 | MIOA0680 | 576 | MIOA0744 |
| 337 | MIOA0417a | 397 | MIOA0510 | 457 | MIOA0578a | 517 | MIOA0681n | 577 | MIOA0745 |
| 338 | MIOA0418a | 398 | mioa0511m | 458 | MIOA0579a | 518 | MIOA0682n | 578 | MIOA0746 |
| 339 | MIOA0419a | 399 | MIOA0513n | 459 | MIOA0580a | 519 | MIOA0683 | 579 | MIOA0747 |
| 340 | MIOA0420a | 400 | MIOA0514 | 460 | mioa0581a | 520 | MIOA0684 | 580 | MIOA0748 |
| 341 | MIOA0449 | 401 | MIOA0515 | 461 | MIOA0582a | 521 | MIOA0685 | 581 | MIOA0749 |
| 342 | MIOA0450 | 402 | MIOA0516 | 462 | MIOA0584a | 522 | MIOA0688 | 582 | MIOA0750 |
| 343 | MIOA0451 | 403 | MIOA0517 | 463 | MIOA0585a | 523 | MIOA0689 | 583 | MIOA0751 |
| 344 | MIOA0452 | 404 | MIOA0518 | 464 | MIOA0586a | 524 | mioa0690 | 584 | MIOA0752 |
| 345 | MIOA0453 | 405 | MIOA0519n | 465 | MIOA0587a | 525 | MIOA0691 | 585 | MIOA0753n |
| 346 | MIOA0454 | 406 | mioa0520n | 466 | MIOA0588a | 526 | MIOA0692 | 586 | mioa0754m |
| 347 | MIOA0455 | 407 | MIOA0521 | 467 | MIOA0589a | 527 | MIOA0693 | 587 | mioa0755m |
| 348 | MIOA0456 | 408 | MIOA0522 | 468 | MIOA0590a | 528 | MIOA0694 | 588 | MIOA0756 |
| 349 | mioa0457m | 409 | mioa0524 | 469 | MIOA0591a | 529 | MIOA0696 | 589 | MIOA0757 |
| 350 | MIOA0458 | 410 | MIOA0525 | 470 | MIOA0592a | 530 | MIOA0697 | 590 | MIOA0758 |
| 351 | MIOA0459 | 411 | MIOA0526 | 471 | MIOA0593a | 531 | MIOA0698 | 591 | MIOA0759 |
| 352 | MIOA0460 | 412 | MIOA0528 | 472 | MIOA0594a | 532 | mioa0699 | 592 | MIOA0760 |
| 353 | MIOA0461 | 413 | MIOA0529 | 473 | MIOA0595a | 533 | MIOA0701 | 593 | mioa0761 |
| 354 | mioa0462n | 414 | MIOA0530 | 474 | MIOA0597a | 534 | MIOA0702 | 594 | mioa0762m |
| 355 | mioa0463m | 415 | MIOA0531 | 475 | MIOA0598a | 535 | MIOA0703 | 595 | MIOA0763n |
| 356 | MIOA0464 | 416 | MIOA0532 | 476 | MIOA0600a | 536 | MIOA0704 | 596 | mioa0764 |
| 357 | MIOA0466 | 417 | MIOA0533 | 477 | MIOA0601a | 537 | MIOA0705 | 597 | MIOA0765n |
| 358 | MIOA0467 | 418 | MIOA0534 | 478 | MIOA0602a | 538 | MIOA0706 | 598 | mioa0766n |
| 359 | MIOA0468 | 419 | MIOA0535n | 479 | MIOA0603a | 539 | MIOA0707 | 599 | mioa0767 |
| 360 | MIOA0469 | 420 | MIOA0536 | 480 | MIOA0604a | 540 | MIOA0708 | 600 | MIOA0768n |

Figure 6D – List of EST Sequence Names From Mild OA Cartilage cDNA Library

| | | | | | | | | | |
|---|---|---|---|---|---|---|---|---|---|
| 601 | MIOA0769n | 661 | MIOA0844a | 721 | mioa0920a | 781 | MIOA0990n | 841 | mioa1059 |
| 602 | MIOA0770n | 662 | MIOA0845a | 722 | MIOA0921a | 782 | mioa0991nn | 842 | MIOA1060 |
| 603 | MIOA0772 | 663 | MIOA0846a | 723 | MIOA0923a | 783 | mioa0992n | 843 | MIOA1061 |
| 604 | MIOA0773 | 664 | MIOA0847a | 724 | MIOA0924a | 784 | MIOA0993n | 844 | MIOA1062 |
| 605 | mioa0774n | 665 | MIOA0848a | 725 | MIOA0925a | 785 | MIOA0994 | 845 | MIOA1063 |
| 606 | MIOA0775n | 666 | mioa0849a | 726 | MIOA0927a | 786 | MIOA0995 | 846 | MIOA1065 |
| 607 | MIOA0776n | 667 | MIOA0850a | 727 | MIOA0929 | 787 | mioa0996n | 847 | MIOA1066 |
| 608 | MIOA0777n | 668 | MIOA0851a | 728 | MIOA0930 | 788 | MIOA0997n | 848 | MIOA1067 |
| 609 | MIOA0778 | 669 | MIOA0852a | 729 | MIOA0931 | 789 | MIOA0998 | 849 | MIOA1068 |
| 610 | MIOA0779 | 670 | MIOA0855a | 730 | mioa0932 | 790 | mioa0999 | 850 | MIOA1070 |
| 611 | mioa0780n | 671 | MIOA0857a | 731 | MIOA0933 | 791 | MIOA1000 | 851 | MIOA1071 |
| 612 | MIOA0781 | 672 | MIOA0860a | 732 | MIOA0934 | 792 | MIOA1001 | 852 | mioa1072 |
| 613 | MIOA0782n | 673 | MIOA0861a | 733 | MIOA0935 | 793 | mioa1003 | 853 | MIOA1073 |
| 614 | MIOA0783n | 674 | MIOA0862a | 734 | MIOA0936 | 794 | MIOA1004 | 854 | MIOA1074 |
| 615 | mioa0785m | 675 | MIOA0865a | 735 | MIOA0937 | 795 | MIOA1005 | 855 | mioa1075 |
| 616 | mioa0786m | 676 | MIOA0866a | 736 | MIOA0938 | 796 | MIOA1006 | 856 | MIOA1076 |
| 617 | mioa0787m | 677 | MIOA0868a | 737 | MIOA0940 | 797 | MIOA1007 | 857 | MIOA1077 |
| 618 | mioa0788m | 678 | MIOA0869a | 738 | MIOA0941 | 798 | MIOA1008 | 858 | MIOA1078 |
| 619 | mioa0789m | 679 | MIOA0873a | 739 | MIOA0942 | 799 | MIOA1009 | 859 | MIOA1079 |
| 620 | MIOA0790 | 680 | MIOA0874a | 740 | MIOA0943 | 800 | MIOA1010 | 860 | MIOA1080 |
| 621 | MIOA0791 | 681 | MIOA0875a | 741 | MIOA0944 | 801 | MIOA1012 | 861 | MIOA1081 |
| 622 | MIOA0792 | 682 | MIOA0876a | 742 | MIOA0946 | 802 | MIOA1013 | 862 | MIOA1082 |
| 623 | MIOA0793 | 683 | MIOA0877a | 743 | MIOA0947 | 803 | MIOA1014 | 863 | MIOA1083 |
| 624 | MIOA0794 | 684 | MIOA0878a | 744 | MIOA0948 | 804 | MIOA1015 | 864 | MIOA1084 |
| 625 | MIOA0795n | 685 | MIOA0879a | 745 | MIOA0949 | 805 | MIOA1016 | 865 | MIOA1085 |
| 626 | MIOA0797 | 686 | MIOA0880a | 746 | mioa0950 | 806 | MIOA1018 | 866 | mioa1086 |
| 627 | mioa0798 | 687 | MIOA0882a | 747 | MIOA0951 | 807 | mioa1019 | 867 | mioa1087 |
| 628 | mioa0800m | 688 | MIOA0884a | 748 | MIOA0952 | 808 | mioa1021m | 868 | MIOA1088 |
| 629 | MIOA0802 | 689 | MIOA0885a | 749 | MIOA0953 | 809 | mioa1022m | 869 | MIOA1089 |
| 630 | MIOA0803 | 690 | MIOA0886a | 750 | MIOA0954 | 810 | MIOA1024 | 870 | MIOA1090 |
| 631 | MIOA0804 | 691 | MIOA0887a | 751 | MIOA0955 | 811 | MIOA1025 | 871 | MIOA1091 |
| 632 | mioa0806 | 692 | MIOA0888a | 752 | MIOA0956 | 812 | MIOA1026 | 872 | mioa1092 |
| 633 | MIOA0807 | 693 | MIOA0890a | 753 | MIOA0958 | 813 | MIOA1027 | 873 | MIOA1094 |
| 634 | MIOA0808 | 694 | MIOA0891a | 754 | MIOA0959 | 814 | MIOA1028 | 874 | MIOA1095 |
| 635 | MIOA0809 | 695 | MIOA0892a | 755 | MIOA0960 | 815 | MIOA1029 | 875 | MIOA1096 |
| 636 | MIOA0811 | 696 | MIOA0893a | 756 | MIOA0961 | 816 | mioa1030n | 876 | mioa1097 |
| 637 | MIOA0813 | 697 | MIOA0894a | 757 | MIOA0962 | 817 | mioa1031m | 877 | MIOA1099 |
| 638 | MIOA0814 | 698 | MIOA0896a | 758 | mioa0963n | 818 | mioa1032m | 878 | MIOA1100 |
| 639 | MIOA0816 | 699 | MIOA0897a | 759 | MIOA0964 | 819 | mioa1033m | 879 | mioa1101m |
| 640 | mioa0817 | 700 | MIOA0898a | 760 | MIOA0965 | 820 | mioa1034m | 880 | MIOA1102 |
| 641 | MIOA0818 | 701 | mioa0899a | 761 | MIOA0966 | 821 | mioa1035m | 881 | MIOA1103 |
| 642 | mioa0819 | 702 | MIOA0900a | 762 | MIOA0967 | 822 | mioa1036m | 882 | MIOA1104 |
| 643 | MIOA0820 | 703 | MIOA0901a | 763 | MIOA0968 | 823 | mioa1039m | 883 | MIOA1106 |
| 644 | MIOA0821 | 704 | MIOA0902a | 764 | MIOA0969n | 824 | mioa1040m | 884 | MIOA1107 |
| 645 | mioa0823 | 705 | MIOA0903a | 765 | MIOA0970 | 825 | mioa1042m | 885 | mioa1108m |
| 646 | MIOA0824 | 706 | MIOA0904a | 766 | mioa0971 | 826 | mioa1043m | 886 | mioa1109m |
| 647 | MIOA0825 | 707 | MIOA0905a | 767 | MIOA0972 | 827 | MIOA1044 | 887 | mioa1110m |
| 648 | MIOA0826 | 708 | MIOA0906a | 768 | MIOA0974 | 828 | mioa1045 | 888 | mioa1111m |
| 649 | MIOA0827 | 709 | MIOA0907a | 769 | MIOA0975n | 829 | MIOA1047 | 889 | mioa1112m |
| 650 | MIOA0830 | 710 | MIOA0908a | 770 | MIOA0977 | 830 | MIOA1048 | 890 | mioa1116m |
| 651 | MIOA0831 | 711 | MIOA0909a | 771 | mioa0978n | 831 | MIOA1049 | 891 | mioa1118m |
| 652 | MIOA0832 | 712 | MIOA0910a | 772 | MIOA0980 | 832 | MIOA1050 | 892 | mioa1119m |
| 653 | MIOA0833a | 713 | mioa0911a | 773 | MIOA0981 | 833 | MIOA1051 | 893 | MIOA1120 |
| 654 | MIOA0835a | 714 | MIOA0912a | 774 | MIOA0982 | 834 | mioa1052 | 894 | MIOA1121 |
| 655 | MIOA0837a | 715 | MIOA0913a | 775 | MIOA0983 | 835 | MIOA1053 | 895 | MIOA1122 |
| 656 | MIOA0838a | 716 | MIOA0915a | 776 | MIOA0984 | 836 | mioa1054 | 896 | MIOA1123 |
| 657 | MIOA0839a | 717 | MIOA0916a | 777 | MIOA0985 | 837 | MIOA1055 | 897 | MIOA1126 |
| 658 | MIOA0840a | 718 | MIOA0917a | 778 | MIOA0986 | 838 | MIOA1056 | 898 | mioa1127m |
| 659 | MIOA0842a | 719 | mioa0918a | 779 | mioa0987n | 839 | MIOA1057 | 899 | MIOA1128 |
| 660 | MIOA0843a | 720 | MIOA0919a | 780 | MIOA0989n | 840 | MIOA1058 | 900 | MIOA1130 |

Figure 6D - List of EST Sequence Names From Mild OA Cartilage cDNA Library

| | | | | | | | | | |
|---|---|---|---|---|---|---|---|---|---|
| 901 | MIOA1131 | 961 | MIOA1201 | 1021 | MIOA1278m | 1081 | MIOA1349a | 1141 | MIOA1421n |
| 902 | MIOA1132 | 962 | MIOA1204 | 1022 | MIOA1279m | 1082 | MIOA1350a | 1142 | MIOA1422 |
| 903 | mioa1133 | 963 | MIOA1205 | 1023 | MIOA1281m | 1083 | MIOA1351a | 1143 | MIOA1423 |
| 904 | mioa1134 | 964 | MIOA1206 | 1024 | MIOA1283m | 1084 | mioa1352a | 1144 | MIOA1424 |
| 905 | MIOA1135 | 965 | MIOA1208 | 1025 | MIOA1284 | 1085 | MIOA1353a | 1145 | MIOA1426 |
| 906 | MIOA1136 | 966 | MIOA1210 | 1026 | MIOA1285 | 1086 | MIOA1354a | 1146 | MIOA1427 |
| 907 | MIOA1137 | 967 | MIOA1211 | 1027 | MIOA1286 | 1087 | MIOA1356a | 1147 | MIOA1428 |
| 908 | mioa1138 | 968 | mioa1212 | 1028 | MIOA1287 | 1088 | MIOA1358a | 1148 | MIOA1429 |
| 909 | mioa1139 | 969 | MIOA1213 | 1029 | MIOA1288 | 1089 | MIOA1359a | 1149 | MIOA1431 |
| 910 | MIOA1140 | 970 | MIOA1214 | 1030 | MIOA1289 | 1090 | MIOA1360a | 1150 | MIOA1432 |
| 911 | MIOA1141 | 971 | mioa1215m | 1031 | MIOA1290 | 1091 | MIOA1361a | 1151 | MIOA1433 |
| 912 | mioa1142m | 972 | mioa1216m | 1032 | MIOA1291n | 1092 | MIOA1362a | 1152 | mioa1434 |
| 913 | MIOA1143 | 973 | mioa1218m | 1033 | MIOA1292 | 1093 | MIOA1363a | 1153 | MIOA1435 |
| 914 | mioa1144 | 974 | MIOA1222m | 1034 | MIOA1293n | 1094 | MIOA1364a | 1154 | mioa1436n |
| 915 | MIOA1145 | 975 | MIOA1223m | 1035 | MIOA1294n | 1095 | MIOA1365a | 1155 | mioa1438n |
| 916 | MIOA1146 | 976 | MIOA1224m | 1036 | MIOA1296 | 1096 | MIOA1366a | 1156 | MIOA1439 |
| 917 | MIOA1147 | 977 | MIOA1225 | 1037 | MIOA1297 | 1097 | MIOA1367a | 1157 | MIOA1440 |
| 918 | mioa1148n | 978 | MIOA1226 | 1038 | MIOA1299 | 1098 | MIOA1369a | 1158 | MIOA1441 |
| 919 | MIOA1149 | 979 | MIOA1227 | 1039 | MIOA1300n | 1099 | MIOA1370a | 1159 | MIOA1442 |
| 920 | MIOA1150 | 980 | MIOA1228 | 1040 | MIOA1301m | 1100 | MIOA1371a | 1160 | mioa1443 |
| 921 | MIOA1151 | 981 | MIOA1229 | 1041 | MIOA1303 | 1101 | MIOA1372a | 1161 | MIOA1444 |
| 922 | mioa1152m | 982 | MIOA1230 | 1042 | MIOA1304 | 1102 | MIOA1373a | 1162 | MIOA1445 |
| 923 | mioa1154 | 983 | mioa1231 | 1043 | MIOA1305 | 1103 | MIOA1374a | 1163 | MIOA1446 |
| 924 | mioa1156n | 984 | MIOA1233 | 1044 | MIOA1306 | 1104 | MIOA1375a | 1164 | MIOA1447 |
| 925 | MIOA1157 | 985 | MIOA1234 | 1045 | MIOA1307 | 1105 | MIOA1377a | 1165 | MIOA1448 |
| 926 | MIOA1158 | 986 | MIOA1235 | 1046 | MIOA1308m | 1106 | MIOA1379a | 1166 | MIOA1450 |
| 927 | MIOA1159 | 987 | MIOA1236 | 1047 | MIOA1309 | 1107 | MIOA1380a | 1167 | mioa1452 |
| 928 | MIOA1161 | 988 | MIOA1237 | 1048 | MIOA1310 | 1108 | MIOA1381a | 1168 | MIOA1453 |
| 929 | mioa1163 | 989 | MIOA1239 | 1049 | MIOA1311 | 1109 | MIOA1382a | 1169 | MIOA1454 |
| 930 | MIOA1164 | 990 | MIOA1241n | 1050 | mioa1312 | 1110 | MIOA1383a | 1170 | MIOA1455 |
| 931 | MIOA1165 | 991 | MIOA1242 | 1051 | MIOA1313a | 1111 | MIOA1385a | 1171 | MIOA1456 |
| 932 | MIOA1166 | 992 | MIOA1243 | 1052 | MIOA1314a | 1112 | MIOA1388a | 1172 | MIOA1457 |
| 933 | MIOA1167 | 993 | MIOA1244m | 1053 | MIOA1315a | 1113 | MIOA1390a | 1173 | MIOA1458 |
| 934 | MIOA1169 | 994 | MIOA1245 | 1054 | MIOA1316a | 1114 | MIOA1391a | 1174 | MIOA1459 |
| 935 | mioa1170 | 995 | MIOA1246 | 1055 | MIOA1317a | 1115 | MIOA1392a | 1175 | MIOA1460 |
| 936 | mioa1171n | 996 | MIOA1247 | 1056 | MIOA1318a | 1116 | MIOA1394a | 1176 | MIOA1461n |
| 937 | MIOA1172 | 997 | MIOA1248 | 1057 | MIOA1319a | 1117 | MIOA1396a | 1177 | mioa1462 |
| 938 | MIOA1173 | 998 | MIOA1249 | 1058 | MIOA1320a | 1118 | MIOA1397a | 1178 | mioa1463 |
| 939 | MIOA1174 | 999 | MIOA1252 | 1059 | MIOA1321a | 1119 | MIOA1398a | 1179 | MIOA1464 |
| 940 | MIOA1176 | 1000 | MIOA1253 | 1060 | MIOA1322a | 1120 | MIOA1399a | 1180 | MIOA1465 |
| 941 | MIOA1177 | 1001 | MIOA1254 | 1061 | MIOA1324a | 1121 | MIOA1400a | 1181 | MIOA1466 |
| 942 | MIOA1178 | 1002 | MIOA1255m | 1062 | MIOA1325a | 1122 | MIOA1401a | 1182 | mioa1467 |
| 943 | mioa1179m | 1003 | mioa1256 | 1063 | mioa1326a | 1123 | MIOA1402a | 1183 | mioa1468 |
| 944 | MIOA1180 | 1004 | MIOA1259 | 1064 | MIOA1327a | 1124 | MIOA1403a | 1184 | MIOA1469 |
| 945 | MIOA1181 | 1005 | MIOA1260 | 1065 | MIOA1329a | 1125 | mioa1405a | 1185 | MIOA1470 |
| 946 | mioa1182 | 1006 | MIOA1261 | 1066 | MIOA1330a | 1126 | MIOA1406a | 1186 | mioa1471 |
| 947 | mioa1183m | 1007 | MIOA1262n | 1067 | MIOA1331a | 1127 | MIOA1407a | 1187 | MIOA1472 |
| 948 | mioa1184m | 1008 | MIOA1263 | 1068 | MIOA1332a | 1128 | MIOA1408a | 1188 | MIOA1473 |
| 949 | MIOA1185 | 1009 | MIOA1264 | 1069 | MIOA1333a | 1129 | MIOA1409 | 1189 | MIOA1474 |
| 950 | MIOA1186 | 1010 | MIOA1265 | 1070 | MIOA1334a | 1130 | MIOA1410m | 1190 | MIOA1475 |
| 951 | MIOA1189 | 1011 | MIOA1266 | 1071 | MIOA1336a | 1131 | MIOA1411n | 1191 | MIOA1476 |
| 952 | MIOA1190n | 1012 | MIOA1267 | 1072 | MIOA1337a | 1132 | MIOA1412 | 1192 | mioa1477 |
| 953 | MIOA1191n | 1013 | MIOA1268 | 1073 | MIOA1338a | 1133 | MIOA1413 | 1193 | mioa1478 |
| 954 | MIOA1192 | 1014 | MIOA1269 | 1074 | mioa1339a | 1134 | MIOA1414 | 1194 | MIOA1479m |
| 955 | MIOA1193 | 1015 | MIOA1270 | 1075 | MIOA1341a | 1135 | MIOA1415 | 1195 | MIOA1481 |
| 956 | MIOA1196 | 1016 | MIOA1273 | 1076 | MIOA1342a | 1136 | MIOA1416 | 1196 | MIOA1482m |
| 957 | mioa1197n | 1017 | MIOA1274m | 1077 | MIOA1343a | 1137 | MIOA1417 | 1197 | MIOA1483m |
| 958 | MIOA1198 | 1018 | MIOA1275m | 1078 | MIOA1344a | 1138 | MIOA1418 | 1198 | mioa1484n |
| 959 | MIOA1199 | 1019 | MIOA1276m | 1079 | MIOA1346a | 1139 | MIOA1419 | 1199 | MIOA1485 |
| 960 | MIOA1200 | 1020 | MIOA1277m | 1080 | MIOA1347a | 1140 | MIOA1420n | 1200 | MIOA1486 |

Figure 6D – List of EST Sequence Names From Mild OA Cartilage cDNA Library

| | | | | | | | | | |
|---|---|---|---|---|---|---|---|---|---|
| 1201 | MIOA1487 | 1261 | MIOA1556 | 1321 | MIOA1622a | 1381 | MIOA1701a | 1441 | MIOA1784 |
| 1202 | MIOA1488 | 1262 | MIOA1558 | 1322 | MIOA1623a | 1382 | MIOA1702a | 1442 | MIOA1785 |
| 1203 | MIOA1491m | 1263 | mioa1559 | 1323 | MIOA1624a | 1383 | MIOA1704a | 1443 | MIOA1786 |
| 1204 | MIOA1492m | 1264 | mioa1560 | 1324 | MIOA1626a | 1384 | MIOA1706a | 1444 | MIOA1788 |
| 1205 | MIOA1494 | 1265 | mioa1561n | 1325 | MIOA1627a | 1385 | MIOA1707a | 1445 | MIOA1790 |
| 1206 | MIOA1495m | 1266 | mioa1562 | 1326 | MIOA1628a | 1386 | MIOA1708a | 1446 | MIOA1791 |
| 1207 | MIOA1496 | 1267 | MIOA1563m | 1327 | mioa1630a | 1387 | MIOA1711a | 1447 | MIOA1792 |
| 1208 | MIOA1497 | 1268 | mioa1564m | 1328 | MIOA1632a | 1388 | MIOA1713a | 1448 | MIOA1793 |
| 1209 | MIOA1498n | 1269 | MIOA1565n | 1329 | MIOA1633a | 1389 | MIOA1714a | 1449 | MIOA1794 |
| 1210 | MIOA1502 | 1270 | MIOA1566 | 1330 | MIOA1634a | 1390 | MIOA1715a | 1450 | MIOA1795 |
| 1211 | mioa1503 | 1271 | MIOA1567 | 1331 | MIOA1635a | 1391 | MIOA1716a | 1451 | MIOA1797m |
| 1212 | MIOA1504 | 1272 | mioa1568 | 1332 | MIOA1636a | 1392 | MIOA1717a | 1452 | MIOA1798m |
| 1213 | MIOA1505 | 1273 | MIOA1569 | 1333 | MIOA1637a | 1393 | MIOA1718a | 1453 | mioa1800m |
| 1214 | mioa1506 | 1274 | MIOA1570 | 1334 | MIOA1638a | 1394 | mioa1719a | 1454 | MIOA1801m |
| 1215 | MIOA1508 | 1275 | MIOA1571 | 1335 | MIOA1639a | 1395 | MIOA1720a | 1455 | MIOA1802m |
| 1216 | MIOA1509 | 1276 | mioa1572 | 1336 | MIOA1640a | 1396 | mioa1721a | 1456 | MIOA1803m |
| 1217 | MIOA1511 | 1277 | MIOA1573 | 1337 | MIOA1641a | 1397 | MIOA1722a | 1457 | MIOA1809a |
| 1218 | MIOA1512n | 1278 | mioa1574 | 1338 | MIOA1644a | 1398 | MIOA1723a | 1458 | MIOA1811a |
| 1219 | MIOA1513 | 1279 | MIOA1575 | 1339 | mioa1645a | 1399 | MIOA1724a | 1459 | MIOA1812a |
| 1220 | MIOA1514 | 1280 | MIOA1576 | 1340 | MIOA1646a | 1400 | MIOA1726a | 1460 | MIOA1814a |
| 1221 | MIOA1515 | 1281 | MIOA1577 | 1341 | MIOA1647a | 1401 | MIOA1727a | 1461 | MIOA1815a |
| 1222 | MIOA1516 | 1282 | MIOA1578 | 1342 | MIOA1648a | 1402 | MIOA1729a | 1462 | MIOA1817a |
| 1223 | MIOA1517 | 1283 | MIOA1579 | 1343 | MIOA1649a | 1403 | MIOA1731 | 1463 | MIOA1818a |
| 1224 | mioa1518 | 1284 | MIOA1580 | 1344 | MIOA1650a | 1404 | MIOA1733 | 1464 | MIOA1819a |
| 1225 | MIOA1519 | 1285 | MIOA1581 | 1345 | MIOA1651a | 1405 | MIOA1734 | 1465 | MIOA1821a |
| 1226 | MIOA1520 | 1286 | MIOA1582 | 1346 | MIOA1652a | 1406 | MIOA1735 | 1466 | MIOA1822a |
| 1227 | MIOA1521 | 1287 | MIOA1583 | 1347 | MIOA1654a | 1407 | MIOA1737 | 1467 | MIOA1823a |
| 1228 | MIOA1522 | 1288 | MIOA1584 | 1348 | MIOA1655a | 1408 | MIOA1738 | 1468 | MIOA1824a |
| 1229 | MIOA1524 | 1289 | MIOA1585 | 1349 | MIOA1656a | 1409 | MIOA1739 | 1469 | MIOA1825a |
| 1230 | MIOA1525 | 1290 | MIOA1586 | 1350 | MIOA1657a | 1410 | MIOA1741 | 1470 | MIOA1827a |
| 1231 | MIOA1526 | 1291 | MIOA1587 | 1351 | MIOA1658a | 1411 | MIOA1742 | 1471 | mioa1828a |
| 1232 | MIOA1527 | 1292 | MIOA1588 | 1352 | MIOA1660a | 1412 | MIOA1743n | 1472 | MIOA1830a |
| 1233 | MIOA1528 | 1293 | MIOA1589 | 1353 | MIOA1661a | 1413 | mioa1745n | 1473 | MIOA1832a |
| 1234 | MIOA1529 | 1294 | MIOA1590 | 1354 | MIOA1662a | 1414 | MIOA1748 | 1474 | MIOA1833a |
| 1235 | MIOA1530 | 1295 | MIOA1592 | 1355 | MIOA1664a | 1415 | mioa1750n | 1475 | MIOA1834a |
| 1236 | MIOA1531 | 1296 | MIOA1593 | 1356 | mioa1665a | 1416 | MIOA1752 | 1476 | MIOA1835a |
| 1237 | MIOA1532 | 1297 | mioa1594 | 1357 | MIOA1666a | 1417 | MIOA1753 | 1477 | MIOA1837a |
| 1238 | MIOA1533 | 1298 | mioa1595 | 1358 | mioa1667a | 1418 | MIOA1755 | 1478 | MIOA1838a |
| 1239 | MIOA1534 | 1299 | MIOA1597 | 1359 | MIOA1668a | 1419 | MIOA1756 | 1479 | MIOA1839a |
| 1240 | MIOA1535 | 1300 | MIOA1598 | 1360 | MIOA1669a | 1420 | MIOA1757 | 1480 | MIOA1840a |
| 1241 | MIOA1536 | 1301 | MIOA1599 | 1361 | MIOA1671a | 1421 | MIOA1758 | 1481 | MIOA1841a |
| 1242 | mioa1537 | 1302 | MIOA1600 | 1362 | mioa1673a | 1422 | MIOA1760 | 1482 | MIOA1843a |
| 1243 | MIOA1538 | 1303 | MIOA1601a | 1363 | MIOA1674a | 1423 | MIOA1761 | 1483 | MIOA1844a |
| 1244 | MIOA1539 | 1304 | MIOA1602a | 1364 | MIOA1676a | 1424 | MIOA1763 | 1484 | MIOA1845a |
| 1245 | MIOA1540 | 1305 | MIOA1603a | 1365 | MIOA1677a | 1425 | mioa1764 | 1485 | MIOA1846a |
| 1246 | MIOA1541m | 1306 | MIOA1604a | 1366 | MIOA1679a | 1426 | MIOA1765 | 1486 | MIOA1847a |
| 1247 | MIOA1542m | 1307 | MIOA1605A | 1367 | MIOA1680a | 1427 | MIOA1766 | 1487 | MIOA1848a |
| 1248 | MIOA1543 | 1308 | mioa1606a | 1368 | MIOA1681a | 1428 | MIOA1767 | 1488 | MIOA1849a |
| 1249 | MIOA1544 | 1309 | MIOA1607a | 1369 | MIOA1685a | 1429 | MIOA1769 | 1489 | MIOA1851a |
| 1250 | MIOA1545 | 1310 | MIOA1608a | 1370 | MIOA1686a | 1430 | MIOA1770 | 1490 | MIOA1852a |
| 1251 | MIOA1546 | 1311 | MIOA1610a | 1371 | MIOA1687a | 1431 | MIOA1771 | 1491 | MIOA1853a |
| 1252 | MIOA1547 | 1312 | MIOA1611a | 1372 | MIOA1688a | 1432 | MIOA1773 | 1492 | mioa1854a |
| 1253 | MIOA1548 | 1313 | MIOA1612a | 1373 | mioa1689a | 1433 | MIOA1774 | 1493 | MIOA1855a |
| 1254 | MIOA1549 | 1314 | MIOA1613a | 1374 | MIOA1690a | 1434 | MIOA1775 | 1494 | mioa1856m |
| 1255 | MIOA1550 | 1315 | MIOA1614a | 1375 | MIOA1693a | 1435 | mioa1776 | 1495 | MIOA1857m |
| 1256 | MIOA1551 | 1316 | MIOA1615a | 1376 | MIOA1695a | 1436 | MIOA1777n | 1496 | MIOA1858m |
| 1257 | MIOA1552 | 1317 | MIOA1616a | 1377 | MIOA1696a | 1437 | MIOA1778 | 1497 | mioa1864a |
| 1258 | MIOA1553 | 1318 | MIOA1619a | 1378 | mioa1697 | 1438 | MIOA1779 | 1498 | MIOA1865a |
| 1259 | MIOA1554n | 1319 | MIOA1620a | 1379 | MIOA1699 | 1439 | MIOA1780 | 1499 | MIOA1866a |
| 1260 | MIOA1555 | 1320 | MIOA1621a | 1380 | MIOA1700 | 1440 | MIOA1781 | 1500 | MIOA1868a |

Figure 6D – List of EST Sequence Names From Mild OA Cartilage cDNA Library

| | | | | | | | | | |
|---|---|---|---|---|---|---|---|---|---|
| 1501 | mioa1870n | 1561 | MIOA1944a | 1621 | MIOA2024 | 1681 | MIOA2096 | 1741 | MIOA2170a |
| 1502 | mioa1871an | 1562 | MIOA1945a | 1622 | MIOA2025 | 1682 | MIOA2097 | 1742 | MIOA2171a |
| 1503 | MIOA1874a | 1563 | MIOA1947a | 1623 | MIOA2027 | 1683 | MIOA2098 | 1743 | MIOA2172a |
| 1504 | MIOA1876a | 1564 | MIOA1948a | 1624 | MIOA2028 | 1684 | MIOA2099 | 1744 | MIOA2173a |
| 1505 | MIOA1880a | 1565 | MIOA1949a | 1625 | MIOA2029 | 1685 | MIOA2100 | 1745 | MIOA2174a |
| 1506 | mioa1881a | 1566 | MIOA1950a | 1626 | MIOA2031 | 1686 | MIOA2102 | 1746 | MIOA2175a |
| 1507 | MIOA1882a | 1567 | MIOA1952a | 1627 | mioa2032n | 1687 | MIOA2103 | 1747 | MIOA2176a |
| 1508 | MIOA1884a | 1568 | MIOA1953a | 1628 | MIOA2033 | 1688 | MIOA2104 | 1748 | MIOA2177a |
| 1509 | MIOA1885a | 1569 | MIOA1954a | 1629 | MIOA2034 | 1689 | mioa2106 | 1749 | MIOA2179a |
| 1510 | MIOA1887a | 1570 | MIOA1955a | 1630 | mioa2035 | 1690 | MIOA2107 | 1750 | MIOA2180a |
| 1511 | MIOA1889a | 1571 | MIOA1956a | 1631 | MIOA2037 | 1691 | MIOA2109 | 1751 | MIOA2181a |
| 1512 | MIOA1890a | 1572 | MIOA1957a | 1632 | MIOA2038 | 1692 | MIOA2110 | 1752 | MIOA2182a |
| 1513 | MIOA1891a | 1573 | MIOA1959a | 1633 | MIOA2039 | 1693 | MIOA2111 | 1753 | MIOA2183a |
| 1514 | MIOA1892a | 1574 | MIOA1961a | 1634 | MIOA2041 | 1694 | MIOA2112 | 1754 | MIOA2184a |
| 1515 | MIOA1893a | 1575 | MIOA1963a | 1635 | mioa2042 | 1695 | MIOA2113 | 1755 | MIOA2185a |
| 1516 | MIOA1894a | 1576 | MIOA1965a | 1636 | mioa2043 | 1696 | MIOA2114 | 1756 | MIOA2186a |
| 1517 | MIOA1895a | 1577 | MIOA1966a | 1637 | MIOA2044 | 1697 | MIOA2116 | 1757 | MIOA2188a |
| 1518 | MIOA1896a | 1578 | MIOA1967a | 1638 | MIOA2046 | 1698 | mioa2117m | 1758 | MIOA2189a |
| 1519 | mioa1897a | 1579 | MIOA1968a | 1639 | mioa2047m | 1699 | MIOA2118 | 1759 | MIOA2190a |
| 1520 | MIOA1898a | 1580 | MIOA1969a | 1640 | MIOA2049 | 1700 | MIOA2119 | 1760 | MIOA2191a |
| 1521 | mioa1899a | 1581 | MIOA1971a | 1641 | MIOA2050 | 1701 | MIOA2120 | 1761 | MIOA2192a |
| 1522 | MIOA1900a | 1582 | MIOA1972a | 1642 | mioa2051n | 1702 | MIOA2122 | 1762 | MIOA2193a |
| 1523 | MIOA1901a | 1583 | mioa1975a | 1643 | MIOA2052n | 1703 | MIOA2123 | 1763 | MIOA2194a |
| 1524 | MIOA1902a | 1584 | MIOA1976a | 1644 | MIOA2053 | 1704 | MIOA2124 | 1764 | MIOA2195a |
| 1525 | MIOA1903a | 1585 | MIOA1978a | 1645 | MIOA2054 | 1705 | mioa2125 | 1765 | MIOA2196a |
| 1526 | MIOA1904a | 1586 | MIOA1979a | 1646 | MIOA2055 | 1706 | mioa2126m | 1766 | MIOA2197a |
| 1527 | MIOA1905a | 1587 | MIOA1980a | 1647 | MIOA2056 | 1707 | mioa2127m | 1767 | mioa2199n |
| 1528 | MIOA1906a | 1588 | MIOA1981a | 1648 | MIOA2057 | 1708 | MIOA2128 | 1768 | MIOA2200a |
| 1529 | MIOA1907a | 1589 | MIOA1982a | 1649 | MIOA2058 | 1709 | mioa2129m | 1769 | MIOA2201a |
| 1530 | MIOA1908a | 1590 | MIOA1983a | 1650 | MIOA2059n | 1710 | mioa2130m | 1770 | MIOA2202a |
| 1531 | MIOA1909a | 1591 | mioa1984a | 1651 | MIOA2060 | 1711 | mioa2133m | 1771 | MIOA2203a |
| 1532 | MIOA1910a | 1592 | MIOA1985 | 1652 | MIOA2061n | 1712 | MIOA2134 | 1772 | MIOA2204a |
| 1533 | MIOA1911a | 1593 | mioa1986 | 1653 | mioa2062 | 1713 | MIOA2135 | 1773 | MIOA2205a |
| 1534 | MIOA1913a | 1594 | MIOA1987n | 1654 | mioa2063 | 1714 | MIOA2136 | 1774 | MIOA2206a |
| 1535 | MIOA1914a | 1595 | MIOA1988 | 1655 | MIOA2064 | 1715 | MIOA2137 | 1775 | MIOA2207a |
| 1536 | MIOA1915a | 1596 | MIOA1989 | 1656 | MIOA2065 | 1716 | MIOA2140 | 1776 | MIOA2209a |
| 1537 | mioa1916a | 1597 | MIOA1990 | 1657 | MIOA2066 | 1717 | MIOA2141 | 1777 | MIOA2210a |
| 1538 | MIOA1917a | 1598 | MIOA1991 | 1658 | MIOA2068 | 1718 | mioa2142n | 1778 | MIOA2211a |
| 1539 | MIOA1918a | 1599 | MIOA1992 | 1659 | mioa2069 | 1719 | MIOA2144 | 1779 | MIOA2212a |
| 1540 | MIOA1920a | 1600 | MIOA1994 | 1660 | MIOA2070 | 1720 | MIOA2146 | 1780 | MIOA2213a |
| 1541 | MIOA1921a | 1601 | MIOA1995 | 1661 | MIOA2071 | 1721 | mioa2147 | 1781 | MIOA2214a |
| 1542 | MIOA1922a | 1602 | MIOA1996 | 1662 | MIOA2072 | 1722 | mioa2148 | 1782 | MIOA2217a |
| 1543 | mioa1923a | 1603 | MIOA1997 | 1663 | MIOA2073 | 1723 | mioa2149 | 1783 | MIOA2222a |
| 1544 | MIOA1924a | 1604 | MIOA1999n | 1664 | MIOA2074 | 1724 | MIOA2150 | 1784 | MIOA2223a |
| 1545 | MIOA1925a | 1605 | MIOA2001n | 1665 | MIOA2075 | 1725 | mioa2151m | 1785 | MIOA2224a |
| 1546 | MIOA1927a | 1606 | MIOA2002 | 1666 | MIOA2076 | 1726 | MIOA2152 | 1786 | MIOA2225a |
| 1547 | MIOA1928a | 1607 | MIOA2004 | 1667 | MIOA2077 | 1727 | mioa2153m | 1787 | MIOA2226a |
| 1548 | MIOA1930a | 1608 | MIOA2005 | 1668 | MIOA2078 | 1728 | MIOA2154a | 1788 | MIOA2227a |
| 1549 | MIOA1932a | 1609 | MIOA2006 | 1669 | MIOA2079n | 1729 | MIOA2155a | 1789 | MIOA2229a |
| 1550 | MIOA1933a | 1610 | MIOA2007 | 1670 | MIOA2083n | 1730 | MIOA2156a | 1790 | MIOA2230a |
| 1551 | mioa1934an | 1611 | MIOA2008 | 1671 | mioa2086 | 1731 | MIOA2157a | 1791 | MIOA2232a |
| 1552 | MIOA1935a | 1612 | MIOA2009 | 1672 | MIOA2087n | 1732 | MIOA2158a | 1792 | MIOA2233a |
| 1553 | MIOA1936a | 1613 | MIOA2010 | 1673 | MIOA2088 | 1733 | MIOA2159a | 1793 | MIOA2234a |
| 1554 | MIOA1937a | 1614 | MIOA2013 | 1674 | MIOA2089 | 1734 | MIOA2160a | 1794 | MIOA2235a |
| 1555 | MIOA1938a | 1615 | MIOA2015 | 1675 | MIOA2090 | 1735 | MIOA2161a | 1795 | MIOA2236a |
| 1556 | mioa1939a | 1616 | MIOA2018 | 1676 | MIOA2091 | 1736 | MIOA2162a | 1796 | MIOA2238a |
| 1557 | MIOA1940a | 1617 | MIOA2019 | 1677 | MIOA2092n | 1737 | MIOA2163a | 1797 | MIOA2239a |
| 1558 | MIOA1941a | 1618 | MIOA2021 | 1678 | MIOA2093 | 1738 | MIOA2165a | 1798 | MIOA2241a |
| 1559 | MIOA1942a | 1619 | mioa2022 | 1679 | MIOA2094 | 1739 | MIOA2167a | 1799 | MIOA2242a |
| 1560 | MIOA1943a | 1620 | MIOA2023 | 1680 | MIOA2095 | 1740 | MIOA2168a | 1800 | MIOA2243a |

Figure 6D - List of EST Sequence Names From Mild OA Cartilage cDNA Library

| | | | | | | | | | |
|---|---|---|---|---|---|---|---|---|---|
| 1801 | MIOA2244a | 1861 | MIOA2324a | 1921 | MIOA2400a | 1981 | MIOA2483a | 2041 | MIOA2564a |
| 1802 | MIOA2245a | 1862 | MIOA2326a | 1922 | MIOA2401a | 1982 | MIOA2485a | 2042 | MIOA2565a |
| 1803 | MIOA2246a | 1863 | MIOA2327a | 1923 | MIOA2402a | 1983 | MIOA2486a | 2043 | MIOA2567a |
| 1804 | MIOA2247a | 1864 | MIOA2328a | 1924 | MIOA2409a | 1984 | MIOA2487a | 2044 | MIOA2568a |
| 1805 | MIOA2248a | 1865 | mioa2329a | 1925 | MIOA2411a | 1985 | mioa2488an | 2045 | MIOA2569a |
| 1806 | MIOA2249a | 1866 | MIOA2330a | 1926 | MIOA2412a | 1986 | MIOA2489a | 2046 | MIOA2570a |
| 1807 | MIOA2251a | 1867 | MIOA2331a | 1927 | MIOA2413a | 1987 | MIOA2490a | 2047 | MIOA2571a |
| 1808 | MIOA2252a | 1868 | MIOA2332a | 1928 | MIOA2414a | 1988 | MIOA2491a | 2048 | MIOA2572a |
| 1809 | MIOA2254a | 1869 | MIOA2333a | 1929 | MIOA2415a | 1989 | mioa2492a | 2049 | MIOA2573a |
| 1810 | MIOA2256a | 1870 | MIOA2334a | 1930 | MIOA2416a | 1990 | MIOA2493a | 2050 | MIOA2574a |
| 1811 | MIOA2257a | 1871 | MIOA2335a | 1931 | MIOA2417a | 1991 | MIOA2494a | 2051 | MIOA2575a |
| 1812 | MIOA2258a | 1872 | MIOA2337a | 1932 | MIOA2418a | 1992 | MIOA2495a | 2052 | MIOA2576a |
| 1813 | MIOA2259a | 1873 | MIOA2338a | 1933 | MIOA2419a | 1993 | MIOA2496a | 2053 | mioa2577a |
| 1814 | MIOA2260a | 1874 | MIOA2339a | 1934 | MIOA2420a | 1994 | MIOA2499a | 2054 | MIOA2580a |
| 1815 | MIOA2261a | 1875 | MIOA2340a | 1935 | MIOA2421a | 1995 | MIOA2502a | 2055 | MIOA2581a |
| 1816 | MIOA2262a | 1876 | MIOA2341a | 1936 | MIOA2422a | 1996 | mioa2503an | 2056 | MIOA2583a |
| 1817 | MIOA2263a | 1877 | MIOA2342a | 1937 | MIOA2423a | 1997 | mioa2504an | 2057 | MIOA2584a |
| 1818 | MIOA2264a | 1878 | MIOA2343a | 1938 | MIOA2424a | 1998 | MIOA2505a | 2058 | MIOA2587a |
| 1819 | MIOA2265a | 1879 | MIOA2344a | 1939 | MIOA2425a | 1999 | MIOA2506a | 2059 | MIOA2588a |
| 1820 | mioa2266a | 1880 | MIOA2346a | 1940 | MIOA2426a | 2000 | MIOA2507a | 2060 | MIOA2589a |
| 1821 | MIOA2268a | 1881 | MIOA2347a | 1941 | MIOA2427a | 2001 | MIOA2509a | 2061 | MIOA2590a |
| 1822 | MIOA2269a | 1882 | mioa2348a | 1942 | MIOA2428a | 2002 | MIOA2510a | 2062 | MIOA2591a |
| 1823 | MIOA2270a | 1883 | MIOA2349a | 1943 | MIOA2430a | 2003 | MIOA2511a | 2063 | MIOA2593a |
| 1824 | MIOA2273a | 1884 | MIOA2350a | 1944 | MIOA2432a | 2004 | MIOA2512a | 2064 | MIOA2596a |
| 1825 | MIOA2274a | 1885 | MIOA2351a | 1945 | MIOA2433a | 2005 | MIOA2515a | 2065 | MIOA2598a |
| 1826 | MIOA2275a | 1886 | MIOA2352a | 1946 | MIOA2434a | 2006 | MIOA2518a | 2066 | MIOA2599a |
| 1827 | MIOA2276a | 1887 | MIOA2353a | 1947 | MIOA2435a | 2007 | MIOA2521a | 2067 | MIOA2601a |
| 1828 | MIOA2277a | 1888 | MIOA2355a | 1948 | MIOA2436a | 2008 | MIOA2522a | 2068 | MIOA2602a |
| 1829 | MIOA2278a | 1889 | MIOA2358a | 1949 | MIOA2437a | 2009 | MIOA2523a | 2069 | MIOA2603a |
| 1830 | mioa2279a | 1890 | MIOA2360a | 1950 | MIOA2439a | 2010 | MIOA2524a | 2070 | MIOA2604a |
| 1831 | MIOA2280a | 1891 | MIOA2361a | 1951 | MIOA2441a | 2011 | MIOA2527a | 2071 | MIOA2605a |
| 1832 | MIOA2281a | 1892 | mioa2363a | 1952 | MIOA2444a | 2012 | MIOA2528a | 2072 | mioa2606an |
| 1833 | MIOA2285a | 1893 | MIOA2364a | 1953 | MIOA2445a | 2013 | MIOA2529a | 2073 | MIOA2607a |
| 1834 | MIOA2287a | 1894 | MIOA2365a | 1954 | MIOA2446a | 2014 | MIOA2531a | 2074 | MIOA2608a |
| 1835 | MIOA2288a | 1895 | MIOA2366a | 1955 | MIOA2447a | 2015 | MIOA2532a | 2075 | MIOA2609a |
| 1836 | MIOA2289a | 1896 | MIOA2368a | 1956 | mioa2448a | 2016 | MIOA2533a | 2076 | MIOA2613a |
| 1837 | MIOA2290a | 1897 | MIOA2371a | 1957 | MIOA2449a | 2017 | MIOA2534a | 2077 | MIOA2615a |
| 1838 | MIOA2291a | 1898 | MIOA2372a | 1958 | MIOA2451a | 2018 | MIOA2536a | 2078 | MIOA2616a |
| 1839 | MIOA2292a | 1899 | mioa2373a | 1959 | MIOA2452a | 2019 | MIOA2537a | 2079 | MIOA2617a |
| 1840 | MIOA2293a | 1900 | MIOA2374a | 1960 | MIOA2454a | 2020 | MIOA2540a | 2080 | mioa2618 |
| 1841 | MIOA2295a | 1901 | mioa2375a | 1961 | MIOA2455a | 2021 | MIOA2541a | 2081 | MIOA2619 |
| 1842 | MIOA2296a | 1902 | MIOA2377a | 1962 | MIOA2457a | 2022 | MIOA2542a | 2082 | MIOA2620 |
| 1843 | MIOA2297a | 1903 | MIOA2378a | 1963 | MIOA2458a | 2023 | MIOA2545a | 2083 | MIOA2621 |
| 1844 | MIOA2298a | 1904 | MIOA2379a | 1964 | mioa2459a | 2024 | MIOA2546a | 2084 | MIOA2622 |
| 1845 | MIOA2299a | 1905 | MIOA2380a | 1965 | MIOA2460a | 2025 | MIOA2547a | 2085 | mioa2623 |
| 1846 | MIOA2300a | 1906 | MIOA2381a | 1966 | MIOA2462a | 2026 | MIOA2548a | 2086 | MIOA2624 |
| 1847 | MIOA2301a | 1907 | MIOA2383a | 1967 | mioa2463a | 2027 | MIOA2549a | 2087 | MIOA2625 |
| 1848 | MIOA2302a | 1908 | MIOA2384a | 1968 | MIOA2465a | 2028 | MIOA2550a | 2088 | MIOA2626 |
| 1849 | MIOA2303a | 1909 | MIOA2385a | 1969 | MIOA2466a | 2029 | MIOA2551a | 2089 | mioa2627 |
| 1850 | MIOA2304a | 1910 | MIOA2386a | 1970 | MIOA2467a | 2030 | MIOA2552a | 2090 | MIOA2628 |
| 1851 | MIOA2305a | 1911 | MIOA2388a | 1971 | MIOA2468a | 2031 | MIOA2553a | 2091 | MIOA2629 |
| 1852 | MIOA2306a | 1912 | MIOA2389a | 1972 | MIOA2470a | 2032 | MIOA2554a | 2092 | MIOA2630 |
| 1853 | MIOA2309a | 1913 | MIOA2390a | 1973 | MIOA2471a | 2033 | MIOA2555a | 2093 | MIOA2631 |
| 1854 | MIOA2310a | 1914 | MIOA2391a | 1974 | MIOA2472a | 2034 | MIOA2556a | 2094 | MIOA2632 |
| 1855 | MIOA2311a | 1915 | MIOA2393a | 1975 | MIOA2475a | 2035 | mioa2557a | 2095 | MIOA2633 |
| 1856 | MIOA2315a | 1916 | MIOA2394a | 1976 | mioa2476a | 2036 | MIOA2558a | 2096 | MIOA2634 |
| 1857 | MIOA2316a | 1917 | MIOA2395a | 1977 | MIOA2478a | 2037 | MIOA2559a | 2097 | MIOA2635 |
| 1858 | MIOA2319a | 1918 | MIOA2397a | 1978 | MIOA2479a | 2038 | MIOA2560a | 2098 | MIOA2636 |
| 1859 | MIOA2320a | 1919 | MIOA2398a | 1979 | MIOA2481a | 2039 | MIOA2561a | 2099 | mioa2637n |
| 1860 | MIOA2323a | 1920 | MIOA2399a | 1980 | MIOA2482a | 2040 | MIOA2563a | 2100 | mioa2638m |

Figure 6D – List of EST Sequence Names From Mild OA Cartilage cDNA Library

| | | | | | | | | | |
|---|---|---|---|---|---|---|---|---|---|
| 2101 | MIOA2639 | 2161 | MIOA2757a | 2221 | MIOA2827a | 2281 | MIOA2915a | 2341 | MIOA2991a |
| 2102 | MIOA2641 | 2162 | MIOA2758a | 2222 | MIOA2828a | 2282 | MIOA2917a | 2342 | MIOA2992a |
| 2103 | MIOA2642 | 2163 | MIOA2759a | 2223 | mioa2830an | 2283 | MIOA2921a | 2343 | MIOA2993a |
| 2104 | MIOA2643 | 2164 | MIOA2760a | 2224 | MIOA2832a | 2284 | MIOA2922a | 2344 | MIOA2994a |
| 2105 | MIOA2645 | 2165 | MIOA2761a | 2225 | MIOA2833a | 2285 | MIOA2923a | 2345 | MIOA2995a |
| 2106 | MIOA2646 | 2166 | MIOA2762a | 2226 | MIOA2836a | 2286 | MIOA2925a | 2346 | MIOA2996a |
| 2107 | MIOA2647 | 2167 | MIOA2764a | 2227 | MIOA2837a | 2287 | MIOA2926a | 2347 | MIOA2997a |
| 2108 | MIOA2648 | 2168 | MIOA2765a | 2228 | MIOA2838a | 2288 | MIOA2927a | 2348 | MIOA2998a |
| 2109 | MIOA2650 | 2169 | MIOA2766a | 2229 | MIOA2839a | 2289 | MIOA2930a | 2349 | MIOA2999a |
| 2110 | MIOA2652a | 2170 | MIOA2768a | 2230 | MIOA2841a | 2290 | MIOA2931a | 2350 | MIOA3000a |
| 2111 | MIOA2657a | 2171 | MIOA2769a | 2231 | MIOA2842a | 2291 | MIOA2932a | 2351 | MIOA3001a |
| 2112 | MIOA2662a | 2172 | MIOA2770a | 2232 | MIOA2844a | 2292 | mioa2933a | 2352 | MIOA3002a |
| 2113 | MIOA2663a | 2173 | mioa2772a | 2233 | MIOA2846a | 2293 | mioa2934a | 2353 | MIOA3003a |
| 2114 | MIOA2674a | 2174 | MIOA2773a | 2234 | MIOA2847a | 2294 | MIOA2936a | 2354 | mioa3005a |
| 2115 | MIOA2675a | 2175 | MIOA2774a | 2235 | MIOA2848a | 2295 | MIOA2937a | 2355 | MIOA3007a |
| 2116 | MIOA2678a | 2176 | MIOA2775a | 2236 | MIOA2850a | 2296 | MIOA2938a | 2356 | MIOA3009a |
| 2117 | MIOA2679a | 2177 | MIOA2777a | 2237 | MIOA2851a | 2297 | MIOA2939a | 2357 | MIOA3013a |
| 2118 | MIOA2680a | 2178 | MIOA2778a | 2238 | MIOA2852a | 2298 | MIOA2940a | 2358 | MIOA3014a |
| 2119 | MIOA2681a | 2179 | MIOA2779a | 2239 | MIOA2853a | 2299 | mioa2941an | 2359 | MIOA3016a |
| 2120 | MIOA2684a | 2180 | MIOA2781a | 2240 | MIOA2854a | 2300 | MIOA2943a | 2360 | MIOA3018a |
| 2121 | MIOA2687a | 2181 | MIOA2782a | 2241 | MIOA2855a | 2301 | MIOA2944a | 2361 | MIOA3020a |
| 2122 | MIOA2689a | 2182 | MIOA2783a | 2242 | MIOA2856a | 2302 | MIOA2945a | 2362 | MIOA3021a |
| 2123 | MIOA2690a | 2183 | MIOA2784a | 2243 | MIOA2857a | 2303 | MIOA2946a | 2363 | MIOA3022a |
| 2124 | MIOA2691a | 2184 | MIOA2785a | 2244 | MIOA2858a | 2304 | MIOA2947a | 2364 | MIOA3023a |
| 2125 | MIOA2692a | 2185 | MIOA2786a | 2245 | MIOA2859a | 2305 | mioa2948a | 2365 | MIOA3024a |
| 2126 | MIOA2693a | 2186 | MIOA2787a | 2246 | MIOA2860a | 2306 | MIOA2949a | 2366 | MIOA3025a |
| 2127 | MIOA2694a | 2187 | MIOA2788a | 2247 | MIOA2861a | 2307 | MIOA2950a | 2367 | MIOA3027a |
| 2128 | MIOA2696a | 2188 | MIOA2789a | 2248 | MIOA2862a | 2308 | MIOA2951a | 2368 | MIOA3028a |
| 2129 | MIOA2697a | 2189 | MIOA2790a | 2249 | MIOA2863a | 2309 | MIOA2952a | 2369 | mioa3029an |
| 2130 | MIOA2698a | 2190 | MIOA2791a | 2250 | MIOA2864a | 2310 | MIOA2953a | 2370 | MIOA3030a |
| 2131 | MIOA2700a | 2191 | MIOA2792a | 2251 | MIOA2866a | 2311 | MIOA2954a | 2371 | MIOA3031a |
| 2132 | MIOA2702a | 2192 | MIOA2794a | 2252 | MIOA2868a | 2312 | mioa2955a | 2372 | MIOA3032a |
| 2133 | MIOA2704a | 2193 | MIOA2795a | 2253 | MIOA2869a | 2313 | MIOA2956a | 2373 | MIOA3034a |
| 2134 | MIOA2705a | 2194 | MIOA2796a | 2254 | MIOA2871a | 2314 | MIOA2958a | 2374 | MIOA3036a |
| 2135 | MIOA2706a | 2195 | MIOA2797a | 2255 | MIOA2872a | 2315 | MIOA2959a | 2375 | MIOA3037a |
| 2136 | MIOA2707a | 2196 | MIOA2798a | 2256 | MIOA2874a | 2316 | MIOA2960a | 2376 | MIOA3038a |
| 2137 | MIOA2708a | 2197 | MIOA2799a | 2257 | MIOA2875a | 2317 | MIOA2961a | 2377 | MIOA3039a |
| 2138 | MIOA2709a | 2198 | MIOA2800a | 2258 | MIOA2878a | 2318 | MIOA2962a | 2378 | MIOA3040a |
| 2139 | MIOA2711a | 2199 | MIOA2801a | 2259 | MIOA2885a | 2319 | MIOA2963a | 2379 | MIOA3041a |
| 2140 | MIOA2714a | 2200 | MIOA2802a | 2260 | MIOA2886a | 2320 | mioa2964a | 2380 | MIOA3042a |
| 2141 | MIOA2715a | 2201 | MIOA2803a | 2261 | MIOA2887a | 2321 | MIOA2965a | 2381 | MIOA3043a |
| 2142 | MIOA2716a | 2202 | MIOA2804a | 2262 | MIOA2888a | 2322 | MIOA2966a | 2382 | MIOA3044a |
| 2143 | MIOA2717a | 2203 | MIOA2805a | 2263 | MIOA2889a | 2323 | MIOA2968a | 2383 | mioa3045a |
| 2144 | MIOA2718a | 2204 | mioa2806a | 2264 | MIOA2890a | 2324 | MIOA2970a | 2384 | MIOA3047a |
| 2145 | MIOA2720a | 2205 | MIOA2807a | 2265 | MIOA2893a | 2325 | MIOA2971a | 2385 | MIOA3048a |
| 2146 | MIOA2722a | 2206 | mioa2808a | 2266 | MIOA2895a | 2326 | MIOA2973a | 2386 | mioa3049an |
| 2147 | MIOA2725a | 2207 | MIOA2809a | 2267 | MIOA2897a | 2327 | MIOA2975a | 2387 | MIOA3051a |
| 2148 | MIOA2727a | 2208 | MIOA2810a | 2268 | MIOA2898a | 2328 | MIOA2976a | 2388 | MIOA3053a |
| 2149 | MIOA2729a | 2209 | mioa2811a | 2269 | MIOA2899a | 2329 | MIOA2977a | 2389 | MIOA3055a |
| 2150 | MIOA2730a | 2210 | MIOA2812a | 2270 | mioa2900an | 2330 | MIOA2978a | 2390 | MIOA3057a |
| 2151 | MIOA2734a | 2211 | mioa2813a | 2271 | mioa2901a | 2331 | MIOA2979a | 2391 | MIOA3058a |
| 2152 | MIOA2735a | 2212 | MIOA2814a | 2272 | MIOA2902a | 2332 | MIOA2981a | 2392 | MIOA3060a |
| 2153 | MIOA2736a | 2213 | MIOA2815a | 2273 | MIOA2904a | 2333 | MIOA2982a | 2393 | MIOA3063a |
| 2154 | MIOA2740a | 2214 | MIOA2816a | 2274 | MIOA2905a | 2334 | MIOA2983a | 2394 | MIOA3064a |
| 2155 | MIOA2743a | 2215 | MIOA2818a | 2275 | MIOA2907a | 2335 | MIOA2984a | 2395 | MIOA3065a |
| 2156 | MIOA2747a | 2216 | MIOA2820a | 2276 | MIOA2908a | 2336 | MIOA2986a | 2396 | MIOA3066a |
| 2157 | MIOA2750a | 2217 | MIOA2822a | 2277 | MIOA2909a | 2337 | MIOA2987a | 2397 | MIOA3067a |
| 2158 | MIOA2753a | 2218 | MIOA2823a | 2278 | MIOA2910a | 2338 | MIOA2988a | 2398 | MIOA3070a |
| 2159 | MIOA2754a | 2219 | MIOA2825a | 2279 | MIOA2913a | 2339 | MIOA2989a | 2399 | MIOA3073a |
| 2160 | MIOA2756a | 2220 | MIOA2826a | 2280 | MIOA2914a | 2340 | MIOA2990a | 2400 | MIOA3074a |

Figure 6D – List of EST Sequence Names From Mild OA Cartilage cDNA Library

| | | | | | | | | | |
|---|---|---|---|---|---|---|---|---|---|
| 2401 | MIOA3079a | 2461 | MIOA3165a | 2521 | MIOA3255a | 2581 | MIOA3328a | 2641 | MIOA3397a |
| 2402 | MIOA3080a | 2462 | MIOA3166a | 2522 | MIOA3257a | 2582 | MIOA3329a | 2642 | MIOA3398a |
| 2403 | MIOA3081a | 2463 | MIOA3167a | 2523 | MIOA3258a | 2583 | MIOA3330a | 2643 | MIOA3399a |
| 2404 | MIOA3082a | 2464 | MIOA3169a | 2524 | MIOA3259a | 2584 | MIOA3331a | 2644 | MIOA3400a |
| 2405 | MIOA3083a | 2465 | MIOA3170a | 2525 | MIOA3260a | 2585 | MIOA3332a | 2645 | MIOA3401a |
| 2406 | MIOA3084a | 2466 | mioa3172 | 2526 | MIOA3261a | 2586 | MIOA3333a | 2646 | MIOA3402a |
| 2407 | MIOA3086a | 2467 | MIOA3173a | 2527 | MIOA3262a | 2587 | MIOA3334a | 2647 | mioa3404a |
| 2408 | MIOA3089a | 2468 | MIOA3174a | 2528 | MIOA3265a | 2588 | MIOA3335a | 2648 | MIOA3405a |
| 2409 | MIOA3090a | 2469 | MIOA3175a | 2529 | mioa3266a | 2589 | mioa3336a | 2649 | MIOA3406a |
| 2410 | MIOA3092a | 2470 | mioa3176a | 2530 | MIOA3268a | 2590 | mioa3337a | 2650 | MIOA3408a |
| 2411 | MIOA3096a | 2471 | MIOA3177a | 2531 | MIOA3269a | 2591 | MIOA3339a | 2651 | MIOA3409a |
| 2412 | MIOA3097a | 2472 | MIOA3178a | 2532 | mioa3271n | 2592 | MIOA3340a | 2652 | MIOA3410a |
| 2413 | mioa3098a | 2473 | MIOA3179a | 2533 | mioa3272n | 2593 | MIOA3341a | 2653 | MIOA3411a |
| 2414 | MIOA3101a | 2474 | mioa3182a | 2534 | MIOA3274 | 2594 | MIOA3342a | 2654 | mioa3412a |
| 2415 | MIOA3102a | 2475 | MIOA3183a | 2535 | MIOA3275 | 2595 | MIOA3343a | 2655 | MIOA3414a |
| 2416 | MIOA3103a | 2476 | MIOA3185a | 2536 | mioa3276n | 2596 | MIOA3344a | 2656 | mioa3415a |
| 2417 | MIOA3104a | 2477 | mioa3186a | 2537 | MIOA3277 | 2597 | MIOA3345a | 2657 | MIOA3416a |
| 2418 | MIOA3105a | 2478 | MIOA3187a | 2538 | MIOA3278 | 2598 | MIOA3346a | 2658 | MIOA3417a |
| 2419 | MIOA3106a | 2479 | MIOA3188a | 2539 | MIOA3279a | 2599 | MIOA3347a | 2659 | MIOA3418a |
| 2420 | MIOA3107a | 2480 | MIOA3189a | 2540 | MIOA3281a | 2600 | MIOA3348a | 2660 | MIOA3419a |
| 2421 | MIOA3109a | 2481 | MIOA3192a | 2541 | MIOA3282a | 2601 | MIOA3349a | 2661 | mioa3420an |
| 2422 | MIOA3110a | 2482 | MIOA3193a | 2542 | MIOA3283a | 2602 | MIOA3350a | 2662 | MIOA3421a |
| 2423 | MIOA3111a | 2483 | MIOA3194a | 2543 | MIOA3284a | 2603 | MIOA3351a | 2663 | MIOA3422a |
| 2424 | MIOA3112a | 2484 | mioa3195a | 2544 | MIOA3286a | 2604 | MIOA3352a | 2664 | MIOA3423a |
| 2425 | mioa3114a | 2485 | MIOA3196a | 2545 | MIOA3287a | 2605 | MIOA3353a | 2665 | mioa3424a |
| 2426 | mioa3115an | 2486 | mioa3198a | 2546 | mioa3288a | 2606 | MIOA3354a | 2666 | MIOA3425a |
| 2427 | MIOA3117a | 2487 | MIOA3199a | 2547 | MIOA3289a | 2607 | MIOA3355a | 2667 | mioa3426a |
| 2428 | MIOA3118a | 2488 | MIOA3200a | 2548 | MIOA3290a | 2608 | MIOA3357a | 2668 | MIOA3428a |
| 2429 | MIOA3121a | 2489 | MIOA3203a | 2549 | MIOA3291a | 2609 | MIOA3359a | 2669 | MIOA3429a |
| 2430 | MIOA3122a | 2490 | MIOA3204a | 2550 | MIOA3292a | 2610 | MIOA3361a | 2670 | mioa3430an |
| 2431 | MIOA3123a | 2491 | MIOA3205a | 2551 | MIOA3293a | 2611 | MIOA3362a | 2671 | mioa3431a |
| 2432 | MIOA3124a | 2492 | MIOA3206a | 2552 | MIOA3294a | 2612 | mioa3363a | 2672 | MIOA3432a |
| 2433 | MIOA3127a | 2493 | mioa3208a | 2553 | MIOA3295a | 2613 | MIOA3364a | 2673 | MIOA3433a |
| 2434 | MIOA3129a | 2494 | MIOA3209a | 2554 | MIOA3296a | 2614 | MIOA3365a | 2674 | MIOA3434a |
| 2435 | MIOA3132a | 2495 | MIOA3210a | 2555 | MIOA3297a | 2615 | MIOA3367a | 2675 | MIOA3435a |
| 2436 | MIOA3133a | 2496 | MIOA3212a | 2556 | MIOA3298a | 2616 | MIOA3368a | 2676 | MIOA3436a |
| 2437 | MIOA3135a | 2497 | MIOA3213a | 2557 | MIOA3301a | 2617 | mioa3369an | 2677 | MIOA3437a |
| 2438 | MIOA3136a | 2498 | MIOA3216a | 2558 | MIOA3303a | 2618 | MIOA3370a | 2678 | MIOA3439a |
| 2439 | mioa3137an | 2499 | MIOA3217a | 2559 | mioa3304a | 2619 | MIOA3372a | 2679 | MIOA3440a |
| 2440 | MIOA3138a | 2500 | MIOA3223a | 2560 | MIOA3305a | 2620 | MIOA3373a | 2680 | MIOA3443a |
| 2441 | mioa3140a | 2501 | MIOA3224a | 2561 | MIOA3306a | 2621 | MIOA3375a | 2681 | MIOA3444a |
| 2442 | MIOA3141a | 2502 | MIOA3226a | 2562 | MIOA3307a | 2622 | MIOA3377a | 2682 | MIOA3445a |
| 2443 | MIOA3143a | 2503 | MIOA3227a | 2563 | MIOA3308a | 2623 | MIOA3378a | 2683 | MIOA3447a |
| 2444 | MIOA3144a | 2504 | mioa3229an | 2564 | MIOA3309a | 2624 | MIOA3379a | 2684 | MIOA3449a |
| 2445 | MIOA3146a | 2505 | MIOA3231a | 2565 | mioa3310a | 2625 | MIOA3380a | 2685 | MIOA3450a |
| 2446 | MIOA3147a | 2506 | MIOA3232a | 2566 | MIOA3311a | 2626 | MIOA3381a | 2686 | MIOA3451a |
| 2447 | MIOA3148a | 2507 | MIOA3233a | 2567 | MIOA3312a | 2627 | MIOA3382a | 2687 | MIOA3452a |
| 2448 | mioa3149an | 2508 | MIOA3236a | 2568 | MIOA3313a | 2628 | MIOA3383a | 2688 | MIOA3453a |
| 2449 | MIOA3150a | 2509 | MIOA3237a | 2569 | MIOA3314a | 2629 | mioa3384a | 2689 | MIOA3455a |
| 2450 | MIOA3151a | 2510 | MIOA3239a | 2570 | MIOA3315a | 2630 | MIOA3385a | 2690 | MIOA3456a |
| 2451 | MIOA3152a | 2511 | MIOA3241a | 2571 | MIOA3316a | 2631 | MIOA3386a | 2691 | MIOA3458a |
| 2452 | MIOA3153a | 2512 | MIOA3243a | 2572 | MIOA3317a | 2632 | MIOA3387a | 2692 | MIOA3460a |
| 2453 | MIOA3154a | 2513 | MIOA3244a | 2573 | MIOA3318a | 2633 | MIOA3388a | 2693 | MIOA3461a |
| 2454 | MIOA3157a | 2514 | MIOA3245a | 2574 | MIOA3319a | 2634 | MIOA3389a | 2694 | MIOA3462a |
| 2455 | MIOA3159a | 2515 | MIOA3248a | 2575 | MIOA3320a | 2635 | MIOA3390a | 2695 | MIOA3464a |
| 2456 | MIOA3160a | 2516 | MIOA3250a | 2576 | MIOA3321a | 2636 | MIOA3392a | 2696 | MIOA3465a |
| 2457 | MIOA3161a | 2517 | mioa3251an | 2577 | MIOA3322a | 2637 | MIOA3393a | 2697 | MIOA3466a |
| 2458 | MIOA3162a | 2518 | mioa3252a | 2578 | MIOA3325a | 2638 | MIOA3394a | 2698 | MIOA3467a |
| 2459 | MIOA3163a | 2519 | MIOA3253a | 2579 | MIOA3326a | 2639 | MIOA3395a | 2699 | MIOA3468a |
| 2460 | MIOA3164a | 2520 | mioa3254an | 2580 | MIOA3327a | 2640 | MIOA3396a | 2700 | MIOA3469a |

Figure 6D - List of EST Sequence Names From Mild OA Cartilage cDNA Library

| | | | | | | | | | |
|---|---|---|---|---|---|---|---|---|---|
| 2701 | MIOA3470a | 2761 | MIOA3547a | 2821 | MIOA3619a | 2881 | mioa3694a | 2941 | MIOA3767 |
| 2702 | MIOA3471a | 2762 | MIOA3548a | 2822 | MIOA3620a | 2882 | MIOA3695a | 2942 | MIOA3768 |
| 2703 | MIOA3472a | 2763 | MIOA3549a | 2823 | mioa3625a | 2883 | MIOA3696a | 2943 | MIOA3770 |
| 2704 | MIOA3473a | 2764 | MIOA3550a | 2824 | MIOA3626a | 2884 | MIOA3697a | 2944 | MIOA3772 |
| 2705 | MIOA3474a | 2765 | MIOA3551a | 2825 | MIOA3627a | 2885 | MIOA3698a | 2945 | MIOA3773 |
| 2706 | MIOA3475a | 2766 | MIOA3552a | 2826 | MIOA3628a | 2886 | mioa3699a | 2946 | MIOA3774 |
| 2707 | MIOA3476a | 2767 | MIOA3554a | 2827 | MIOA3629a | 2887 | MIOA3700a | 2947 | MIOA3775 |
| 2708 | MIOA3478a | 2768 | MIOA3555a | 2828 | MIOA3633a | 2888 | mioa3701a | 2948 | MIOA3776 |
| 2709 | MIOA3479a | 2769 | MIOA3557a | 2829 | MIOA3634a | 2889 | MIOA3702a | 2949 | MIOA3777 |
| 2710 | MIOA3480a | 2770 | MIOA3558a | 2830 | MIOA3635a | 2890 | MIOA3703a | 2950 | mioa3778 |
| 2711 | mioa3481an | 2771 | MIOA3559a | 2831 | MIOA3636a | 2891 | mioa3704a | 2951 | MIOA3780 |
| 2712 | MIOA3482a | 2772 | MIOA3562a | 2832 | MIOA3637a | 2892 | MIOA3705a | 2952 | MIOA3781 |
| 2713 | MIOA3483a | 2773 | MIOA3564a | 2833 | MIOA3639a | 2893 | MIOA3709a | 2953 | MIOA3782 |
| 2714 | MIOA3485a | 2774 | MIOA3565a | 2834 | MIOA3640a | 2894 | MIOA3710a | 2954 | MIOA3783 |
| 2715 | MIOA3486a | 2775 | MIOA3566a | 2835 | mioa3641a | 2895 | MIOA3711a | 2955 | MIOA3784 |
| 2716 | MIOA3488a | 2776 | MIOA3567a | 2836 | MIOA3645a | 2896 | MIOA3712a | 2956 | MIOA3786 |
| 2717 | MIOA3489a | 2777 | MIOA3568a | 2837 | MIOA3646a | 2897 | MIOA3713a | 2957 | MIOA3787 |
| 2718 | MIOA3492a | 2778 | MIOA3569a | 2838 | MIOA3648a | 2898 | MIOA3714a | 2958 | MIOA3788 |
| 2719 | MIOA3493a | 2779 | MIOA3570a | 2839 | MIOA3649a | 2899 | mioa3715a | 2959 | mioa3790 |
| 2720 | mioa3495a | 2780 | MIOA3571a | 2840 | MIOA3650a | 2900 | MIOA3716a | 2960 | MIOA3791 |
| 2721 | MIOA3498a | 2781 | MIOA3572a | 2841 | MIOA3651a | 2901 | MIOA3717a | 2961 | MIOA3792 |
| 2722 | MIOA3500a | 2782 | MIOA3573a | 2842 | MIOA3652a | 2902 | MIOA3718a | 2962 | MIOA3793 |
| 2723 | MIOA3501a | 2783 | mioa3574a | 2843 | mioa3653a | 2903 | MIOA3719a | 2963 | MIOA3795 |
| 2724 | MIOA3502a | 2784 | MIOA3575a | 2844 | MIOA3654a | 2904 | mioa3720an | 2964 | MIOA3796 |
| 2725 | MIOA3503a | 2785 | MIOA3576a | 2845 | MIOA3655a | 2905 | MIOA3721a | 2965 | MIOA3797 |
| 2726 | MIOA3504a | 2786 | MIOA3577a | 2846 | MIOA3656a | 2906 | MIOA3722a | 2966 | MIOA3798 |
| 2727 | MIOA3505a | 2787 | MIOA3578a | 2847 | MIOA3657a | 2907 | MIOA3723a | 2967 | MIOA3799 |
| 2728 | MIOA3507a | 2788 | MIOA3579a | 2848 | MIOA3658a | 2908 | MIOA3724a | 2968 | MIOA3801 |
| 2729 | MIOA3508a | 2789 | MIOA3580a | 2849 | MIOA3659a | 2909 | MIOA3725a | 2969 | MIOA3802 |
| 2730 | MIOA3510a | 2790 | MIOA3581a | 2850 | MIOA3660a | 2910 | MIOA3726a | 2970 | MIOA3803 |
| 2731 | MIOA3511a | 2791 | MIOA3582a | 2851 | mioa3661a | 2911 | MIOA3727a | 2971 | MIOA3804 |
| 2732 | MIOA3512a | 2792 | MIOA3583a | 2852 | MIOA3662a | 2912 | MIOA3730a | 2972 | MIOA3805 |
| 2733 | mioa3513a | 2793 | MIOA3584a | 2853 | MIOA3663a | 2913 | MIOA3731a | 2973 | MIOA3806 |
| 2734 | MIOA3514a | 2794 | mioa3585a | 2854 | MIOA3665a | 2914 | MIOA3733a | 2974 | MIOA3807 |
| 2735 | MIOA3515a | 2795 | MIOA3586a | 2855 | MIOA3666a | 2915 | MIOA3734a | 2975 | mioa3808 |
| 2736 | MIOA3518a | 2796 | MIOA3587a | 2856 | MIOA3667 | 2916 | MIOA3735a | 2976 | MIOA3809 |
| 2737 | MIOA3519a | 2797 | MIOA3588a | 2857 | MIOA3668a | 2917 | MIOA3737a | 2977 | MIOA3811 |
| 2738 | MIOA3520a | 2798 | MIOA3589a | 2858 | MIOA3669a | 2918 | MIOA3738a | 2978 | MIOA3812 |
| 2739 | MIOA3521a | 2799 | MIOA3590a | 2859 | mioa3670an | 2919 | MIOA3739a | 2979 | MIOA3813 |
| 2740 | MIOA3522a | 2800 | MIOA3591a | 2860 | MIOA3671a | 2920 | MIOA3741a | 2980 | mioa3814n |
| 2741 | MIOA3523a | 2801 | MIOA3594a | 2861 | MIOA3672a | 2921 | MIOA3742a | 2981 | MIOA3815 |
| 2742 | MIOA3524a | 2802 | MIOA3595a | 2862 | MIOA3673a | 2922 | MIOA3743a | 2982 | mioa3816n |
| 2743 | MIOA3525a | 2803 | MIOA3596a | 2863 | MIOA3674a | 2923 | MIOA3744a | 2983 | MIOA3818 |
| 2744 | MIOA3526a | 2804 | MIOA3597a | 2864 | MIOA3675a | 2924 | MIOA3745a | 2984 | MIOA3819 |
| 2745 | MIOA3527a | 2805 | MIOA3598a | 2865 | MIOA3677a | 2925 | MIOA3746a | 2985 | MIOA3820 |
| 2746 | MIOA3528a | 2806 | MIOA3599a | 2866 | MIOA3678a | 2926 | MIOA3748a | 2986 | mioa3821 |
| 2747 | MIOA3530a | 2807 | MIOA3600a | 2867 | MIOA3679a | 2927 | MIOA3750a | 2987 | MIOA3822 |
| 2748 | MIOA3531a | 2808 | MIOA3601a | 2868 | MIOA3680a | 2928 | MIOA3751a | 2988 | MIOA3823 |
| 2749 | MIOA3532a | 2809 | MIOA3602a | 2869 | MIOA3682a | 2929 | MIOA3752a | 2989 | MIOA3826 |
| 2750 | MIOA3533a | 2810 | MIOA3604a | 2870 | MIOA3683a | 2930 | MIOA3754a | 2990 | MIOA3828 |
| 2751 | MIOA3534a | 2811 | MIOA3605a | 2871 | MIOA3684a | 2931 | MIOA3755a | 2991 | MIOA3829 |
| 2752 | MIOA3535a | 2812 | MIOA3606a | 2872 | MIOA3685a | 2932 | MIOA3756a | 2992 | MIOA3830 |
| 2753 | MIOA3536a | 2813 | MIOA3608a | 2873 | MIOA3686a | 2933 | MIOA3757a | 2993 | MIOA3831 |
| 2754 | MIOA3537a | 2814 | MIOA3611a | 2874 | MIOA3687a | 2934 | MIOA3758a | 2994 | MIOA3832 |
| 2755 | MIOA3538a | 2815 | MIOA3612a | 2875 | MIOA3688a | 2935 | MIOA3759a | 2995 | mioa3833 |
| 2756 | MIOA3540a | 2816 | MIOA3614a | 2876 | MIOA3689a | 2936 | MIOA3760a | 2996 | MIOA3834 |
| 2757 | mioa3541a | 2817 | MIOA3615a | 2877 | MIOA3690a | 2937 | MIOA3763 | 2997 | MIOA3835 |
| 2758 | MIOA3543a | 2818 | MIOA3616a | 2878 | MIOA3691a | 2938 | mioa3764 | 2998 | MIOA3836 |
| 2759 | MIOA3544a | 2819 | MIOA3617a | 2879 | MIOA3692a | 2939 | MIOA3765 | 2999 | MIOA3837 |
| 2760 | MIOA3545a | 2820 | MIOA3618a | 2880 | MIOA3693a | 2940 | mioa3766 | 3000 | MIOA3838 |

Figure 6D – List of EST Sequence Names From Mild OA Cartilage cDNA Library

| | | | | | | | | | |
|---|---|---|---|---|---|---|---|---|---|
| 3001 | MIOA3839 | 3061 | MIOA3921a | 3121 | MIOA3991a | 3181 | MIOA4068a | 3241 | MIOA4167 |
| 3002 | mioa3840 | 3062 | MIOA3922a | 3122 | MIOA3992a | 3182 | MIOA4069a | 3242 | mioa4168n |
| 3003 | MIOA3842 | 3063 | MIOA3923a | 3123 | MIOA3994a | 3183 | MIOA4072a | 3243 | mioa4169 |
| 3004 | MIOA3844 | 3064 | MIOA3924a | 3124 | MIOA3997a | 3184 | MIOA4073a | 3244 | mioa4170 |
| 3005 | MIOA3846 | 3065 | MIOA3925a | 3125 | MIOA3998a | 3185 | MIOA4074a | 3245 | mioa4171n |
| 3006 | MIOA3849 | 3066 | MIOA3926a | 3126 | mioa4002a | 3186 | MIOA4075a | 3246 | MIOA4173 |
| 3007 | MIOA3850 | 3067 | MIOA3929a | 3127 | MIOA4003a | 3187 | MIOA4076a | 3247 | MIOA4174 |
| 3008 | MIOA3851 | 3068 | MIOA3930a | 3128 | MIOA4004a | 3188 | MIOA4077a | 3248 | MIOA4176 |
| 3009 | mioa3852n | 3069 | MIOA3931a | 3129 | MIOA4005a | 3189 | MIOA4079a | 3249 | MIOA4177 |
| 3010 | MIOA3855 | 3070 | MIOA3932a | 3130 | MIOA4006a | 3190 | MIOA4081a | 3250 | mioa4178n |
| 3011 | MIOA3856 | 3071 | MIOA3933a | 3131 | MIOA4007a | 3191 | MIOA4082a | 3251 | MIOA4179 |
| 3012 | MIOA3857 | 3072 | mioa3934a | 3132 | MIOA4009a | 3192 | MIOA4083a | 3252 | mioa4180n |
| 3013 | MIOA3859 | 3073 | MIOA3935a | 3133 | MIOA4010a | 3193 | MIOA4085a | 3253 | MIOA4181 |
| 3014 | MIOA3860 | 3074 | MIOA3936a | 3134 | MIOA4011a | 3194 | MIOA4086a | 3254 | MIOA4182 |
| 3015 | MIOA3862 | 3075 | MIOA3938a | 3135 | MIOA4012a | 3195 | MIOA4088a | 3255 | MIOA4183 |
| 3016 | MIOA3863 | 3076 | MIOA3939a | 3136 | MIOA4013a | 3196 | MIOA4089a | 3256 | MIOA4184 |
| 3017 | MIOA3864 | 3077 | MIOA3940a | 3137 | MIOA4014a | 3197 | MIOA4090a | 3257 | MIOA4185 |
| 3018 | MIOA3865 | 3078 | MIOA3941a | 3138 | MIOA4015a | 3198 | MIOA4091a | 3258 | MIOA4186 |
| 3019 | MIOA3866 | 3079 | MIOA3942a | 3139 | MIOA4016a | 3199 | MIOA4092a | 3259 | MIOA4187 |
| 3020 | MIOA3867 | 3080 | mioa3943a | 3140 | MIOA4017a | 3200 | MIOA4093a | 3260 | MIOA4190 |
| 3021 | mioa3868 | 3081 | MIOA3944a | 3141 | MIOA4019a | 3201 | mioa4094a | 3261 | MIOA4191 |
| 3022 | MIOA3871 | 3082 | MIOA3945a | 3142 | mioa4020a | 3202 | MIOA4096a | 3262 | MIOA4193 |
| 3023 | MIOA3872 | 3083 | MIOA3946a | 3143 | MIOA4021a | 3203 | MIOA4098 | 3263 | mioa4194n |
| 3024 | MIOA3873 | 3084 | MIOA3947a | 3144 | MIOA4022a | 3204 | MIOA4102 | 3264 | MIOA4196 |
| 3025 | MIOA3878 | 3085 | MIOA3948a | 3145 | MIOA4023a | 3205 | MIOA4105 | 3265 | mioa4197n |
| 3026 | MIOA3880a | 3086 | MIOA3949a | 3146 | MIOA4024a | 3206 | MIOA4106 | 3266 | MIOA4199 |
| 3027 | mioa3881a | 3087 | MIOA3950a | 3147 | MIOA4025a | 3207 | MIOA4107 | 3267 | MIOA4200 |
| 3028 | MIOA3882a | 3088 | MIOA3951a | 3148 | MIOA4026a | 3208 | MIOA4109 | 3268 | MIOA4201 |
| 3029 | mioa3883a | 3089 | MIOA3953a | 3149 | MIOA4027a | 3209 | MIOA4111 | 3269 | MIOA4202 |
| 3030 | MIOA3884a | 3090 | MIOA3954a | 3150 | MIOA4028a | 3210 | MIOA4112 | 3270 | MIOA4204 |
| 3031 | MIOA3885a | 3091 | MIOA3955a | 3151 | MIOA4029a | 3211 | MIOA4113 | 3271 | MIOA4205 |
| 3032 | MIOA3886a | 3092 | MIOA3956a | 3152 | mioa4031a | 3212 | MIOA4114 | 3272 | MIOA4206 |
| 3033 | MIOA3887a | 3093 | MIOA3958a | 3153 | MIOA4033a | 3213 | mioa4115n | 3273 | MIOA4207 |
| 3034 | MIOA3888a | 3094 | MIOA3959a | 3154 | MIOA4035a | 3214 | MIOA4120 | 3274 | MIOA4209 |
| 3035 | MIOA3889a | 3095 | MIOA3960a | 3155 | MIOA4036a | 3215 | MIOA4121 | 3275 | MIOA4210 |
| 3036 | MIOA3890a | 3096 | mioa3961a | 3156 | MIOA4037a | 3216 | mioa4122 | 3276 | MIOA4211 |
| 3037 | MIOA3891a | 3097 | MIOA3962a | 3157 | MIOA4039a | 3217 | MIOA4123 | 3277 | MIOA4212 |
| 3038 | MIOA3892a | 3098 | MIOA3963a | 3158 | MIOA4040a | 3218 | MIOA4127 | 3278 | MIOA4214 |
| 3039 | mioa3893a | 3099 | MIOA3964a | 3159 | MIOA4041a | 3219 | MIOA4128 | 3279 | MIOA4215 |
| 3040 | mioa3894a | 3100 | MIOA3965a | 3160 | mioa4042an | 3220 | MIOA4130 | 3280 | MIOA4216 |
| 3041 | mioa3895a | 3101 | MIOA3966a | 3161 | MIOA4043a | 3221 | MIOA4131 | 3281 | MIOA4217 |
| 3042 | mioa3896a | 3102 | MIOA3967a | 3162 | MIOA4044a | 3222 | MIOA4133 | 3282 | MIOA4219 |
| 3043 | mioa3898a | 3103 | MIOA3969a | 3163 | mioa4045a | 3223 | MIOA4134 | 3283 | MIOA4221 |
| 3044 | MIOA3899a | 3104 | MIOA3970a | 3164 | MIOA4046a | 3224 | MIOA4135 | 3284 | MIOA4223 |
| 3045 | MIOA3900a | 3105 | MIOA3972a | 3165 | MIOA4047a | 3225 | MIOA4136 | 3285 | MIOA4224 |
| 3046 | MIOA3901a | 3106 | MIOA3973a | 3166 | MIOA4048a | 3226 | MIOA4137 | 3286 | MIOA4225 |
| 3047 | MIOA3902a | 3107 | MIOA3974a | 3167 | MIOA4049a | 3227 | MIOA4139 | 3287 | MIOA4226 |
| 3048 | MIOA3903a | 3108 | MIOA3975a | 3168 | MIOA4050a | 3228 | MIOA4142 | 3288 | MIOA4227 |
| 3049 | MIOA3904a | 3109 | MIOA3977a | 3169 | MIOA4053a | 3229 | mioa4143 | 3289 | MIOA4229 |
| 3050 | MIOA3905a | 3110 | mioa3978an | 3170 | MIOA4054a | 3230 | mioa4144 | 3290 | MIOA4230 |
| 3051 | mioa3907a | 3111 | MIOA3979a | 3171 | MIOA4055a | 3231 | MIOA4145 | 3291 | MIOA4234 |
| 3052 | MIOA3910a | 3112 | MIOA3980a | 3172 | MIOA4056a | 3232 | MIOA4148 | 3292 | MIOA4235 |
| 3053 | MIOA3911a | 3113 | MIOA3981a | 3173 | MIOA4057a | 3233 | MIOA4149 | 3293 | mioa4236 |
| 3054 | MIOA3912a | 3114 | MIOA3982a | 3174 | MIOA4058a | 3234 | MIOA4150 | 3294 | MIOA4237 |
| 3055 | MIOA3913a | 3115 | MIOA3983a | 3175 | MIOA4059a | 3235 | mioa4151n | 3295 | MIOA4238 |
| 3056 | MIOA3915a | 3116 | MIOA3985a | 3176 | MIOA4061a | 3236 | MIOA4156 | 3296 | MIOA4239 |
| 3057 | MIOA3917a | 3117 | MIOA3986a | 3177 | MIOA4064a | 3237 | MIOA4161 | 3297 | MIOA4240 |
| 3058 | MIOA3918a | 3118 | MIOA3987a | 3178 | MIOA4065a | 3238 | MIOA4162 | 3298 | MIOA4241 |
| 3059 | MIOA3919a | 3119 | MIOA3988a | 3179 | MIOA4066a | 3239 | mioa4164 | 3299 | MIOA4242 |
| 3060 | MIOA3920a | 3120 | MIOA3989a | 3180 | MIOA4067a | 3240 | MIOA4166 | 3300 | MIOA4243 |

Figure 6D – List of EST Sequence Names From Mild OA Cartilage cDNA Library

| | | | | | | | | | |
|---|---|---|---|---|---|---|---|---|---|
| 3301 | MIOA4244 | 3361 | MIOA4323a | 3421 | MIOA4415 | 3481 | MIOA4544a | 3541 | MIOA4629a |
| 3302 | MIOA4245 | 3362 | MIOA4324a | 3422 | MIOA4416 | 3482 | MIOA4547a | 3542 | MIOA4630a |
| 3303 | MIOA4246 | 3363 | MIOA4325a | 3423 | MIOA4417 | 3483 | MIOA4548a | 3543 | MIOA4631a |
| 3304 | MIOA4247 | 3364 | MIOA4326a | 3424 | MIOA4418 | 3484 | MIOA4549a | 3544 | MIOA4632a |
| 3305 | MIOA4251 | 3365 | MIOA4329a | 3425 | MIOA4419 | 3485 | mioa4550a | 3545 | MIOA4633a |
| 3306 | MIOA4252 | 3366 | MIOA4330a | 3426 | MIOA4420 | 3486 | MIOA4551a | 3546 | MIOA4634a |
| 3307 | MIOA4253 | 3367 | MIOA4331a | 3427 | MIOA4421 | 3487 | MIOA4552a | 3547 | MIOA4635a |
| 3308 | mioa4255 | 3368 | MIOA4332a | 3428 | MIOA4422 | 3488 | MIOA4555a | 3548 | MIOA4636a |
| 3309 | MIOA4256 | 3369 | MIOA4333a | 3429 | MIOA4423 | 3489 | MIOA4557a | 3549 | MIOA4638a |
| 3310 | MIOA4257 | 3370 | MIOA4334a | 3430 | MIOA4425 | 3490 | MIOA4558a | 3550 | MIOA4639a |
| 3311 | mioa4258n | 3371 | MIOA4335a | 3431 | MIOA4426 | 3491 | mioa4559a | 3551 | mioa4640an |
| 3312 | MIOA4259 | 3372 | MIOA4336a | 3432 | MIOA4427 | 3492 | MIOA4560a | 3552 | MIOA4641a |
| 3313 | mioa4261n | 3373 | MIOA4337a | 3433 | MIOA4428 | 3493 | MIOA4563a | 3553 | MIOA4642a |
| 3314 | MIOA4264 | 3374 | MIOA4338a | 3434 | mioa4429n | 3494 | MIOA4564a | 3554 | MIOA4643a |
| 3315 | MIOA4265 | 3375 | MIOA4339a | 3435 | MIOA4430 | 3495 | MIOA4565a | 3555 | MIOA4645a |
| 3316 | MIOA4266 | 3376 | MIOA4340a | 3436 | MIOA4464a | 3496 | MIOA4566a | 3556 | MIOA4646a |
| 3317 | MIOA4267 | 3377 | MIOA4341a | 3437 | MIOA4465a | 3497 | MIOA4567a | 3557 | mioa4647a |
| 3318 | MIOA4268 | 3378 | mioa4342a | 3438 | MIOA4466a | 3498 | MIOA4568a | 3558 | MIOA4650a |
| 3319 | MIOA4269 | 3379 | MIOA4343a | 3439 | mioa4468a | 3499 | MIOA4572a | 3559 | MIOA4651a |
| 3320 | mioa4270 | 3380 | MIOA4345a | 3440 | MIOA4470a | 3500 | MIOA4573a | 3560 | mioa4653an |
| 3321 | MIOA4271 | 3381 | MIOA4346a | 3441 | MIOA4472a | 3501 | MIOA4579a | 3561 | mioa4655an |
| 3322 | MIOA4272 | 3382 | MIOA4347a | 3442 | MIOA4474a | 3502 | MIOA4580a | 3562 | MIOA4658a |
| 3323 | MIOA4274 | 3383 | MIOA4348a | 3443 | MIOA4475a | 3503 | MIOA4581a | 3563 | MIOA4660a |
| 3324 | MIOA4275 | 3384 | MIOA4349a | 3444 | MIOA4476a | 3504 | MIOA4582a | 3564 | MIOA4661a |
| 3325 | mioa4276 | 3385 | MIOA4353a | 3445 | MIOA4477a | 3505 | MIOA4583a | 3565 | MIOA4663a |
| 3326 | MIOA4277 | 3386 | MIOA4354a | 3446 | mioa4483a | 3506 | MIOA4585a | 3566 | MIOA4665a |
| 3327 | MIOA4278 | 3387 | MIOA4355a | 3447 | MIOA4484a | 3507 | mioa4587a | 3567 | MIOA4667a |
| 3328 | mioa4281n | 3388 | MIOA4356a | 3448 | MIOA4485a | 3508 | MIOA4589a | 3568 | MIOA4669a |
| 3329 | MIOA4283 | 3389 | MIOA4357a | 3449 | mioa4486a | 3509 | MIOA4590a | 3569 | mioa4670an |
| 3330 | MIOA4284 | 3390 | mioa4360an | 3450 | MIOA4487a | 3510 | MIOA4594a | 3570 | MIOA4673 |
| 3331 | MIOA4285 | 3391 | MIOA4363a | 3451 | MIOA4488a | 3511 | MIOA4595a | 3571 | MIOA4674 |
| 3332 | mioa4286 | 3392 | MIOA4365a | 3452 | mioa4491a | 3512 | MIOA4596a | 3572 | MIOA4675 |
| 3333 | MIOA4287 | 3393 | MIOA4366a | 3453 | MIOA4493a | 3513 | MIOA4597a | 3573 | MIOA4677 |
| 3334 | MIOA4289a | 3394 | MIOA4367a | 3454 | mioa4496a | 3514 | mioa4598a | 3574 | MIOA4678 |
| 3335 | MIOA4290a | 3395 | MIOA4368a | 3455 | MIOA4499a | 3515 | MIOA4599a | 3575 | MIOA4679 |
| 3336 | MIOA4292a | 3396 | MIOA4370a | 3456 | MIOA4500a | 3516 | MIOA4600a | 3576 | MIOA4680 |
| 3337 | MIOA4293a | 3397 | MIOA4372a | 3457 | MIOA4501a | 3517 | MIOA4601a | 3577 | MIOA4681 |
| 3338 | MIOA4295a | 3398 | MIOA4373a | 3458 | mioa4502a | 3518 | MIOA4602a | 3578 | MIOA4682 |
| 3339 | MIOA4299a | 3399 | MIOA4378a | 3459 | MIOA4503a | 3519 | MIOA4603a | 3579 | mioa4683 |
| 3340 | MIOA4300a | 3400 | MIOA4381a | 3460 | MIOA4504a | 3520 | MIOA4604a | 3580 | MIOA4684 |
| 3341 | mioa4301a | 3401 | MIOA4382a | 3461 | MIOA4508a | 3521 | MIOA4605a | 3581 | MIOA4685 |
| 3342 | MIOA4302a | 3402 | MIOA4383a | 3462 | MIOA4509a | 3522 | MIOA4606a | 3582 | MIOA4686 |
| 3343 | MIOA4303a | 3403 | MIOA4384a | 3463 | MIOA4510a | 3523 | MIOA4608a | 3583 | MIOA4687 |
| 3344 | MIOA4304a | 3404 | MIOA4386 | 3464 | MIOA4512a | 3524 | MIOA4609a | 3584 | MIOA4688 |
| 3345 | MIOA4305a | 3405 | mioa4387 | 3465 | MIOA4515a | 3525 | MIOA4610a | 3585 | MIOA4689 |
| 3346 | MIOA4306a | 3406 | mioa4389n | 3466 | MIOA4517a | 3526 | MIOA4611a | 3586 | MIOA4690 |
| 3347 | MIOA4308a | 3407 | MIOA4390 | 3467 | mioa4518a | 3527 | MIOA4612a | 3587 | MIOA4693 |
| 3348 | mioa4309an | 3408 | MIOA4391 | 3468 | mioa4519a | 3528 | MIOA4615a | 3588 | MIOA4694 |
| 3349 | MIOA4310a | 3409 | MIOA4393 | 3469 | MIOA4520a | 3529 | MIOA4616a | 3589 | MIOA4695 |
| 3350 | MIOA4311a | 3410 | MIOA4394 | 3470 | MIOA4525a | 3530 | MIOA4617a | 3590 | MIOA4696 |
| 3351 | MIOA4312a | 3411 | mioa4396n | 3471 | MIOA4526a | 3531 | MIOA4618a | 3591 | mioa4697 |
| 3352 | MIOA4313a | 3412 | MIOA4398 | 3472 | MIOA4527a | 3532 | MIOA4619a | 3592 | MIOA4698 |
| 3353 | MIOA4315a | 3413 | MIOA4399 | 3473 | MIOA4528a | 3533 | MIOA4620a | 3593 | MIOA4699 |
| 3354 | MIOA4316a | 3414 | MIOA4400 | 3474 | MIOA4532a | 3534 | MIOA4621a | 3594 | MIOA4700 |
| 3355 | MIOA4317a | 3415 | mioa4403 | 3475 | MIOA4534a | 3535 | MIOA4622a | 3595 | mioa4701 |
| 3356 | MIOA4318a | 3416 | MIOA4406 | 3476 | MIOA4536a | 3536 | MIOA4623a | 3596 | MIOA4702 |
| 3357 | MIOA4319a | 3417 | MIOA4407 | 3477 | MIOA4539a | 3537 | MIOA4624a | 3597 | MIOA4703 |
| 3358 | MIOA4320a | 3418 | MIOA4409 | 3478 | MIOA4541a | 3538 | mioa4626a | 3598 | MIOA4704 |
| 3359 | MIOA4321a | 3419 | MIOA4410 | 3479 | MIOA4542a | 3539 | MIOA4627a | 3599 | mioa4706 |
| 3360 | MIOA4322a | 3420 | MIOA4411 | 3480 | MIOA4543a | 3540 | MIOA4628a | 3600 | MIOA4707 |

Figure 6D – List of EST Sequence Names From Mild OA Cartilage cDNA Library

| | | | | | | | | | |
|---|---|---|---|---|---|---|---|---|---|
| 3601 | MIOA4709 | 3661 | MIOA4782a | 3721 | MIOA4868a | 3781 | MIOA4957a | 3841 | MIOA5047a |
| 3602 | MIOA4710 | 3662 | MIOA4783a | 3722 | MIOA4869a | 3782 | MIOA4959a | 3842 | MIOA5049a |
| 3603 | MIOA4711 | 3663 | MIOA4785a | 3723 | MIOA4870a | 3783 | MIOA4962a | 3843 | MIOA5051a |
| 3604 | MIOA4712 | 3664 | mioa4786an | 3724 | mioa4874a | 3784 | MIOA4963a | 3844 | MIOA5052a |
| 3605 | MIOA4713 | 3665 | MIOA4787a | 3725 | MIOA4877a | 3785 | MIOA4964a | 3845 | MIOA5053a |
| 3606 | MIOA4715 | 3666 | MIOA4788a | 3726 | MIOA4878a | 3786 | MIOA4972a | 3846 | MIOA5054a |
| 3607 | MIOA4716 | 3667 | MIOA4789a | 3727 | MIOA4880a | 3787 | MIOA4973a | 3847 | MIOA5056a |
| 3608 | MIOA4717 | 3668 | MIOA4790a | 3728 | MIOA4881a | 3788 | MIOA4974a | 3848 | MIOA5057a |
| 3609 | MIOA4718 | 3669 | mioa4791an | 3729 | MIOA4882a | 3789 | MIOA4975a | 3849 | MIOA5059a |
| 3610 | mioa4719n | 3670 | MIOA4792a | 3730 | MIOA4883a | 3790 | MIOA4978a | 3850 | MIOA5061a |
| 3611 | MIOA4720 | 3671 | MIOA4793a | 3731 | MIOA4884a | 3791 | MIOA4980a | 3851 | MIOA5063a |
| 3612 | MIOA4721 | 3672 | mioa4795an | 3732 | MIOA4885a | 3792 | MIOA4982a | 3852 | MIOA5069a |
| 3613 | MIOA4722 | 3673 | MIOA4796a | 3733 | MIOA4886a | 3793 | MIOA4983a | 3853 | MIOA5070a |
| 3614 | MIOA4723 | 3674 | MIOA4797a | 3734 | MIOA4887a | 3794 | MIOA4985a | 3854 | MIOA5072a |
| 3615 | mioa4725 | 3675 | MIOA4798a | 3735 | MIOA4890a | 3795 | MIOA4987a | 3855 | mioa5073a |
| 3616 | MIOA4726 | 3676 | MIOA4800a | 3736 | MIOA4891a | 3796 | MIOA4989a | 3856 | MIOA5074a |
| 3617 | MIOA4727 | 3677 | MIOA4803a | 3737 | MIOA4892a | 3797 | MIOA4991a | 3857 | MIOA5075a |
| 3618 | MIOA4728 | 3678 | MIOA4804a | 3738 | MIOA4893a | 3798 | MIOA4992a | 3858 | MIOA5079a |
| 3619 | MIOA4729 | 3679 | MIOA4805a | 3739 | MIOA4894a | 3799 | MIOA4993a | 3859 | MIOA5080a |
| 3620 | MIOA4730 | 3680 | MIOA4806a | 3740 | MIOA4895a | 3800 | MIOA4994a | 3860 | MIOA5081a |
| 3621 | MIOA4732 | 3681 | MIOA4808a | 3741 | mioa4896a | 3801 | MIOA4995a | 3861 | MIOA5082a |
| 3622 | MIOA4733 | 3682 | MIOA4809a | 3742 | MIOA4898a | 3802 | MIOA4998a | 3862 | MIOA5084a |
| 3623 | MIOA4734 | 3683 | MIOA4810a | 3743 | MIOA4899a | 3803 | MIOA4999a | 3863 | MIOA5085a |
| 3624 | MIOA4735 | 3684 | MIOA4811a | 3744 | MIOA4901a | 3804 | MIOA5000a | 3864 | MIOA5086a |
| 3625 | mioa4736 | 3685 | MIOA4813a | 3745 | MIOA4902a | 3805 | MIOA5001a | 3865 | MIOA5087a |
| 3626 | MIOA4737 | 3686 | MIOA4814a | 3746 | MIOA4903a | 3806 | MIOA5002a | 3866 | MIOA5090a |
| 3627 | MIOA4738 | 3687 | MIOA4815a | 3747 | MIOA4905a | 3807 | MIOA5003a | 3867 | mioa5093an |
| 3628 | mioa4739 | 3688 | MIOA4816a | 3748 | MIOA4906a | 3808 | MIOA5004a | 3868 | MIOA5096a |
| 3629 | MIOA4740 | 3689 | MIOA4817a | 3749 | mioa4912an | 3809 | MIOA5005a | 3869 | MIOA5097a |
| 3630 | MIOA4742 | 3690 | MIOA4818a | 3750 | MIOA4914a | 3810 | MIOA5006a | 3870 | MIOA5098a |
| 3631 | MIOA4744 | 3691 | MIOA4819a | 3751 | MIOA4915a | 3811 | MIOA5008a | 3871 | MIOA5099a |
| 3632 | MIOA4745 | 3692 | MIOA4820a | 3752 | MIOA4916a | 3812 | MIOA5010a | 3872 | MIOA5102a |
| 3633 | MIOA4746 | 3693 | MIOA4821a | 3753 | MIOA4918a | 3813 | MIOA5011a | 3873 | MIOA5105a |
| 3634 | mioa4748 | 3694 | MIOA4823a | 3754 | MIOA4920a | 3814 | MIOA5012a | 3874 | MIOA5106a |
| 3635 | MIOA4749 | 3695 | MIOA4824a | 3755 | mioa4921a | 3815 | MIOA5013a | 3875 | MIOA5108a |
| 3636 | MIOA4750 | 3696 | MIOA4826a | 3756 | MIOA4922a | 3816 | MIOA5014a | 3876 | mioa5109a |
| 3637 | MIOA4751 | 3697 | MIOA4827a | 3757 | MIOA4923a | 3817 | MIOA5015a | 3877 | MIOA5110a |
| 3638 | MIOA4752 | 3698 | MIOA4828a | 3758 | MIOA4926a | 3818 | MIOA5016a | 3878 | MIOA5111a |
| 3639 | MIOA4753 | 3699 | MIOA4829a | 3759 | mioa4927an | 3819 | MIOA5017a | 3879 | MIOA5113a |
| 3640 | MIOA4754 | 3700 | MIOA4830a | 3760 | MIOA4928a | 3820 | mioa5018an | 3880 | MIOA5114a |
| 3641 | MIOA4755 | 3701 | MIOA4832a | 3761 | MIOA4929a | 3821 | MIOA5019a | 3881 | MIOA5115a |
| 3642 | MIOA4756 | 3702 | mioa4834a | 3762 | MIOA4930a | 3822 | MIOA5020a | 3882 | mioa5116a |
| 3643 | MIOA4757 | 3703 | MIOA4836a | 3763 | MIOA4934a | 3823 | MIOA5021a | 3883 | MIOA5117a |
| 3644 | mioa4759 | 3704 | MIOA4837a | 3764 | MIOA4935a | 3824 | MIOA5024a | 3884 | MIOA5118a |
| 3645 | MIOA4760 | 3705 | mioa4838a | 3765 | MIOA4937a | 3825 | MIOA5025a | 3885 | MIOA5119a |
| 3646 | MIOA4763 | 3706 | MIOA4841a | 3766 | MIOA4939a | 3826 | MIOA5027a | 3886 | MIOA5120a |
| 3647 | mioa4764 | 3707 | MIOA4842a | 3767 | MIOA4940a | 3827 | MIOA5029a | 3887 | MIOA5121a |
| 3648 | MIOA4765 | 3708 | MIOA4843a | 3768 | MIOA4941a | 3828 | MIOA5030a | 3888 | mioa5122a |
| 3649 | MIOA4766 | 3709 | MIOA4845a | 3769 | MIOA4942a | 3829 | MIOA5031a | 3889 | MIOA5124a |
| 3650 | MIOA4767 | 3710 | MIOA4846a | 3770 | MIOA4943a | 3830 | MIOA5033a | 3890 | MIOA5126a |
| 3651 | MIOA4769 | 3711 | MIOA4847a | 3771 | MIOA4944a | 3831 | MIOA5034a | 3891 | MIOA5127a |
| 3652 | MIOA4770 | 3712 | mioa4849an | 3772 | MIOA4945a | 3832 | MIOA5035a | 3892 | MIOA5129a |
| 3653 | MIOA4771 | 3713 | MIOA4850a | 3773 | MIOA4946a | 3833 | MIOA5036a | 3893 | MIOA5131a |
| 3654 | MIOA4774 | 3714 | MIOA4851a | 3774 | MIOA4947a | 3834 | MIOA5037a | 3894 | MIOA5132a |
| 3655 | MIOA4775 | 3715 | MIOA4852a | 3775 | MIOA4949a | 3835 | MIOA5038a | 3895 | MIOA5133a |
| 3656 | mioa4776 | 3716 | MIOA4853a | 3776 | MIOA4951a | 3836 | MIOA5040a | 3896 | MIOA5134a |
| 3657 | MIOA4777 | 3717 | mioa4854an | 3777 | mioa4953an | 3837 | MIOA5042a | 3897 | MIOA5138a |
| 3658 | MIOA4778 | 3718 | MIOA4855a | 3778 | MIOA4954a | 3838 | MIOA5043a | 3898 | MIOA5139a |
| 3659 | MIOA4779 | 3719 | MIOA4858a | 3779 | MIOA4955a | 3839 | MIOA5045a | 3899 | MIOA5140a |
| 3660 | MIOA4781a | 3720 | MIOA4864a | 3780 | MIOA4956a | 3840 | MIOA5046a | 3900 | MIOA5141a |

Figure 6D – List of EST Sequence Names From Mild OA Cartilage cDNA Library

| | | | | | | | | | |
|---|---|---|---|---|---|---|---|---|---|
| 3901 | MIOA5142a | 3961 | MIOA5229a | 4021 | MIOA5397a | 4081 | MIOA5478a | 4141 | MIOA5545a |
| 3902 | MIOA5143a | 3962 | MIOA5231a | 4022 | MIOA5398a | 4082 | MIOA5479a | 4142 | MIOA5546a |
| 3903 | MIOA5144a | 3963 | MIOA5233a | 4023 | MIOA5399a | 4083 | MIOA5480a | 4143 | MIOA5547a |
| 3904 | MIOA5145a | 3964 | MIOA5236a | 4024 | mioa5400a | 4084 | MIOA5481a | 4144 | MIOA5548a |
| 3905 | MIOA5146a | 3965 | MIOA5237a | 4025 | MIOA5401a | 4085 | MIOA5482a | 4145 | mioa5549a |
| 3906 | MIOA5147a | 3966 | MIOA5244a | 4026 | mioa5402a | 4086 | MIOA5484a | 4146 | MIOA5550a |
| 3907 | MIOA5149a | 3967 | mioa5245a | 4027 | MIOA5403a | 4087 | MIOA5485a | 4147 | MIOA5551a |
| 3908 | MIOA5150a | 3968 | MIOA5247a | 4028 | MIOA5404a | 4088 | MIOA5486a | 4148 | MIOA5552a |
| 3909 | MIOA5151a | 3969 | MIOA5248a | 4029 | MIOA5408a | 4089 | MIOA5487a | 4149 | MIOA5554a |
| 3910 | MIOA5155a | 3970 | MIOA5249a | 4030 | MIOA5409a | 4090 | MIOA5488a | 4150 | MIOA5555a |
| 3911 | MIOA5156a | 3971 | MIOA5254a | 4031 | MIOA5410a | 4091 | MIOA5489a | 4151 | MIOA5556a |
| 3912 | MIOA5157a | 3972 | MIOA5257a | 4032 | MIOA5411m | 4092 | MIOA5490a | 4152 | mioa5557a |
| 3913 | MIOA5158a | 3973 | MIOA5261a | 4033 | MIOA5412a | 4093 | mioa5491a | 4153 | MIOA5558a |
| 3914 | MIOA5159a | 3974 | MIOA5265a | 4034 | MIOA5413a | 4094 | MIOA5492a | 4154 | MIOA5561a |
| 3915 | MIOA5160a | 3975 | MIOA5266a | 4035 | MIOA5416a | 4095 | MIOA5493a | 4155 | MIOA5562a |
| 3916 | MIOA5161a | 3976 | MIOA5273a | 4036 | MIOA5418a | 4096 | MIOA5494a | 4156 | MIOA5563a |
| 3917 | MIOA5162a | 3977 | MIOA5278a | 4037 | MIOA5420a | 4097 | MIOA5495a | 4157 | MIOA5564a |
| 3918 | MIOA5163a | 3978 | MIOA5281a | 4038 | MIOA5421a | 4098 | MIOA5496a | 4158 | mioa5565a |
| 3919 | MIOA5164a | 3979 | MIOA5286a | 4039 | mioa5422an | 4099 | MIOA5497a | 4159 | MIOA5566a |
| 3920 | MIOA5165a | 3980 | MIOA5289a | 4040 | MIOA5425a | 4100 | MIOA5498a | 4160 | MIOA5567a |
| 3921 | MIOA5169a | 3981 | MIOA5293a | 4041 | MIOA5427a | 4101 | MIOA5499a | 4161 | MIOA5569a |
| 3922 | MIOA5170a | 3982 | MIOA5294a | 4042 | MIOA5430a | 4102 | MIOA5500a | 4162 | MIOA5570a |
| 3923 | MIOA5171a | 3983 | MIOA5297a | 4043 | mioa5431an | 4103 | MIOA5501a | 4163 | MIOA5571a |
| 3924 | MIOA5172a | 3984 | MIOA5302a | 4044 | MIOA5435a | 4104 | mioa5502a | 4164 | MIOA5572a |
| 3925 | mioa5173a | 3985 | MIOA5305a | 4045 | MIOA5436a | 4105 | MIOA5503a | 4165 | MIOA5573a |
| 3926 | MIOA5174a | 3986 | mioa5306a | 4046 | MIOA5437a | 4106 | MIOA5504a | 4166 | MIOA5574a |
| 3927 | MIOA5175a | 3987 | MIOA5310a | 4047 | MIOA5439a | 4107 | MIOA5505a | 4167 | MIOA5575a |
| 3928 | MIOA5176a | 3988 | mioa5316a | 4048 | MIOA5440a | 4108 | MIOA5506a | 4168 | MIOA5576a |
| 3929 | MIOA5178a | 3989 | MIOA5317a | 4049 | MIOA5441a | 4109 | MIOA5507a | 4169 | MIOA5577a |
| 3930 | mioa5180a | 3990 | MIOA5324a | 4050 | MIOA5443a | 4110 | MIOA5508a | 4170 | MIOA5578a |
| 3931 | MIOA5181a | 3991 | mioa5325a | 4051 | MIOA5444a | 4111 | MIOA5510a | 4171 | MIOA5579a |
| 3932 | mioa5186a | 3992 | MIOA5326a | 4052 | MIOA5446a | 4112 | MIOA5511a | 4172 | MIOA5580a |
| 3933 | MIOA5188a | 3993 | MIOA5329a | 4053 | MIOA5447a | 4113 | MIOA5512a | 4173 | MIOA5581a |
| 3934 | MIOA5189a | 3994 | MIOA5330a | 4054 | MIOA5448a | 4114 | mioa5513a | 4174 | MIOA5582a |
| 3935 | MIOA5192a | 3995 | MIOA5331a | 4055 | MIOA5449a | 4115 | MIOA5514a | 4175 | MIOA5583a |
| 3936 | MIOA5193a | 3996 | MIOA5333a | 4056 | MIOA5450a | 4116 | MIOA5516a | 4176 | MIOA5584a |
| 3937 | MIOA5194a | 3997 | MIOA5334a | 4057 | MIOA5451a | 4117 | MIOA5518a | 4177 | MIOA5585a |
| 3938 | MIOA5195a | 3998 | MIOA5346a | 4058 | MIOA5452a | 4118 | MIOA5519a | 4178 | MIOA5586a |
| 3939 | MIOA5196a | 3999 | MIOA5348a | 4059 | MIOA5453a | 4119 | mioa5520a | 4179 | MIOA5587a |
| 3940 | MIOA5197a | 4000 | mioa5349a | 4060 | mioa5454a | 4120 | MIOA5522a | 4180 | MIOA5588a |
| 3941 | MIOA5198a | 4001 | MIOA5351a | 4061 | MIOA5455a | 4121 | MIOA5524a | 4181 | MIOA5589a |
| 3942 | MIOA5199a | 4002 | MIOA5354a | 4062 | MIOA5456a | 4122 | MIOA5525a | 4182 | MIOA5590a |
| 3943 | MIOA5200a | 4003 | MIOA5355a | 4063 | MIOA5457a | 4123 | MIOA5526a | 4183 | MIOA5591a |
| 3944 | MIOA5202a | 4004 | MIOA5356a | 4064 | mioa5458a | 4124 | mioa5527a | 4184 | MIOA5592a |
| 3945 | MIOA5203a | 4005 | MIOA5357a | 4065 | MIOA5459a | 4125 | MIOA5528a | 4185 | MIOA5593a |
| 3946 | MIOA5204a | 4006 | MIOA5358a | 4066 | MIOA5460a | 4126 | MIOA5530a | 4186 | MIOA5594a |
| 3947 | MIOA5205a | 4007 | mioa5359a | 4067 | MIOA5461a | 4127 | MIOA5531a | 4187 | MIOA5595a |
| 3948 | MIOA5209a | 4008 | MIOA5364a | 4068 | MIOA5462a | 4128 | MIOA5532a | 4188 | MIOA5597a |
| 3949 | MIOA5210a | 4009 | MIOA5366a | 4069 | MIOA5463a | 4129 | MIOA5533a | 4189 | MIOA5598a |
| 3950 | MIOA5211a | 4010 | MIOA5367a | 4070 | MIOA5464a | 4130 | MIOA5534a | 4190 | MIOA5599a |
| 3951 | MIOA5212a | 4011 | MIOA5368a | 4071 | MIOA5465a | 4131 | MIOA5535a | 4191 | MIOA5600a |
| 3952 | MIOA5216a | 4012 | MIOA5369a | 4072 | MIOA5466a | 4132 | MIOA5536a | 4192 | MIOA5601a |
| 3953 | MIOA5217a | 4013 | MIOA5371a | 4073 | mioa5467a | 4133 | MIOA5537a | 4193 | MIOA5602a |
| 3954 | MIOA5218a | 4014 | MIOA5373a | 4074 | MIOA5468a | 4134 | MIOA5538a | 4194 | MIOA5603a |
| 3955 | mioa5219a | 4015 | MIOA5390a | 4075 | MIOA5469a | 4135 | MIOA5539a | 4195 | MIOA5604a |
| 3956 | MIOA5220 | 4016 | MIOA5391a | 4076 | MIOA5470a | 4136 | MIOA5540a | 4196 | MIOA5605a |
| 3957 | MIOA5221a | 4017 | MIOA5393a | 4077 | MIOA5472a | 4137 | MIOA5541a | 4197 | MIOA5606a |
| 3958 | MIOA5224a | 4018 | MIOA5394a | 4078 | MIOA5473a | 4138 | MIOA5542a | 4198 | MIOA5607a |
| 3959 | MIOA5225a | 4019 | MIOA5395a | 4079 | MIOA5474a | 4139 | MIOA5543a | 4199 | MIOA5608a |
| 3960 | MIOA5226a | 4020 | MIOA5396a | 4080 | mioa5477a | 4140 | MIOA5544a | 4200 | MIOA5609a |

Figure 6D – List of EST Sequence Names From Mild OA Cartilage cDNA Library

| | | | | | | | | | |
|---|---|---|---|---|---|---|---|---|---|
| 4201 | MIOA5610a | 4261 | MIOA5687 | 4321 | mioa5775a | 4381 | mioa5856a | 4441 | MIOA5933a |
| 4202 | mioa5611a | 4262 | MIOA5688 | 4322 | MIOA5776a | 4382 | MIOA5858a | 4442 | MIOA5934a |
| 4203 | MIOA5612a | 4263 | MIOA5689 | 4323 | MIOA5777a | 4383 | MIOA5859a | 4443 | MIOA5935a |
| 4204 | MIOA5613a | 4264 | MIOA5690 | 4324 | MIOA5779a | 4384 | MIOA5860a | 4444 | MIOA5937a |
| 4205 | MIOA5614a | 4265 | MIOA5691 | 4325 | MIOA5780a | 4385 | mioa5861an | 4445 | MIOA5938a |
| 4206 | MIOA5616a | 4266 | MIOA5692 | 4326 | MIOA5781a | 4386 | MIOA5862a | 4446 | MIOA5939a |
| 4207 | MIOA5617a | 4267 | mioa5693 | 4327 | mioa5782an | 4387 | MIOA5865a | 4447 | MIOA5940a |
| 4208 | MIOA5618a | 4268 | MIOA5695 | 4328 | mioa5783an | 4388 | MIOA5866a | 4448 | MIOA5941a |
| 4209 | mioa5619a | 4269 | mioa5696n | 4329 | MIOA5784a | 4389 | mioa5867an | 4449 | mioa5942an |
| 4210 | MIOA5620a | 4270 | MIOA5697 | 4330 | MIOA5786a | 4390 | MIOA5869a | 4450 | MIOA5943a |
| 4211 | MIOA5621a | 4271 | MIOA5698 | 4331 | mioa5787an | 4391 | MIOA5873a | 4451 | MIOA5944a |
| 4212 | MIOA5622a | 4272 | MIOA5699 | 4332 | MIOA5788a | 4392 | MIOA5874a | 4452 | MIOA5945a |
| 4213 | MIOA5623a | 4273 | MIOA5701 | 4333 | MIOA5789a | 4393 | MIOA5875a | 4453 | mioa5946a |
| 4214 | MIOA5624a | 4274 | MIOA5705 | 4334 | MIOA5790a | 4394 | MIOA5877a | 4454 | MIOA5947a |
| 4215 | MIOA5625a | 4275 | mioa5706n | 4335 | MIOA5791a | 4395 | MIOA5878a | 4455 | MIOA5948a |
| 4216 | mioa5626a | 4276 | MIOA5709 | 4336 | MIOA5792a | 4396 | mioa5879a | 4456 | MIOA5949a |
| 4217 | mioa5627a | 4277 | MIOA5710 | 4337 | MIOA5793a | 4397 | MIOA5880a | 4457 | MIOA5950a |
| 4218 | MIOA5628a | 4278 | mioa5711n | 4338 | MIOA5795a | 4398 | mioa5881an | 4458 | MIOA5951a |
| 4219 | MIOA5629a | 4279 | MIOA5712 | 4339 | mioa5796a | 4399 | MIOA5882a | 4459 | MIOA5952a |
| 4220 | MIOA5631a | 4280 | mioa5713n | 4340 | MIOA5797a | 4400 | mioa5883an | 4460 | MIOA5953a |
| 4221 | MIOA5632a | 4281 | MIOA5714 | 4341 | MIOA5799a | 4401 | MIOA5884a | 4461 | MIOA5954a |
| 4222 | mioa5633a | 4282 | mioa5715 | 4342 | mioa5800a | 4402 | MIOA5885a | 4462 | MIOA5955a |
| 4223 | MIOA5634a | 4283 | MIOA5718 | 4343 | MIOA5802a | 4403 | MIOA5886a | 4463. | MIOA5956a |
| 4224 | MIOA5636a | 4284 | MIOA5719 | 4344 | MIOA5803a | 4404 | MIOA5887a | 4464 | MIOA5957a |
| 4225 | MIOA5637a | 4285 | mioa5722n | 4345 | MIOA5804a | 4405 | MIOA5888a | 4465 | MIOA5958a |
| 4226 | MIOA5639a | 4286 | MIOA5724 | 4346 | MIOA5808a | 4406 | MIOA5889a | 4466 | MIOA5959a |
| 4227 | MIOA5640a | 4287 | MIOA5725 | 4347 | MIOA5809a | 4407 | mioa5891a | 4467 | MIOA5960a |
| 4228 | MIOA5641a | 4288 | MIOA5726 | 4348 | mioa5811a | 4408 | MIOA5892a | 4468 | MIOA5961a |
| 4229 | MIOA5642a | 4289 | MIOA5727 | 4349 | MIOA5812a | 4409 | MIOA5893a | 4469 | MIOA5963a |
| 4230 | MIOA5644a | 4290 | MIOA5728 | 4350 | MIOA5813a | 4410 | MIOA5894a | 4470 | MIOA5964a |
| 4231 | MIOA5645a | 4291 | MIOA5729a | 4351 | MIOA5814a | 4411 | MIOA5895a | 4471 | MIOA5965a |
| 4232 | MIOA5648 | 4292 | MIOA5730a | 4352 | MIOA5817a | 4412 | MIOA5896a | 4472 | MIOA5966a |
| 4233 | MIOA5649 | 4293 | MIOA5731a | 4353 | mioa5818a | 4413 | MIOA5897a | 4473 | mioa5968a |
| 4234 | MIOA5650 | 4294 | MIOA5733a | 4354 | mioa5819an | 4414 | MIOA5898a | 4474 | MIOA5969a |
| 4235 | mioa5651n | 4295 | MIOA5738a | 4355 | MIOA5820a | 4415 | MIOA5899a | 4475 | MIOA5970a |
| 4236 | MIOA5652 | 4296 | MIOA5744a | 4356 | MIOA5821a | 4416 | MIOA5901a | 4476 | MIOA5971a |
| 4237 | mioa5653n | 4297 | MIOA5746a | 4357 | MIOA5822a | 4417 | MIOA5902a | 4477 | MIOA5974a |
| 4238 | MIOA5654 | 4298 | MIOA5747a | 4358 | MIOA5823a | 4418 | mioa5903an | 4478 | MIOA5975a |
| 4239 | MIOA5655 | 4299 | MIOA5748a | 4359 | MIOA5824a | 4419 | MIOA5904a | 4479 | MIOA5976a |
| 4240 | MIOA5656 | 4300 | MIOA5750a | 4360 | MIOA5825a | 4420 | MIOA5905a | 4480 | MIOA5978a |
| 4241 | mioa5659 | 4301 | mioa5751a | 4361 | MIOA5826a | 4421 | MIOA5906a | 4481 | MIOA5979a |
| 4242 | mioa5661n | 4302 | MIOA5752a | 4362 | MIOA5827a | 4422 | mioa5910an | 4482 | MIOA5980a |
| 4243 | MIOA5663 | 4303 | MIOA5753a | 4363 | MIOA5828a | 4423 | MIOA5912a | 4483 | mioa5981a |
| 4244 | mioa5665n | 4304 | mioa5754a | 4364 | mioa5829a | 4424 | MIOA5913a | 4484 | MIOA5982a |
| 4245 | mioa5666n | 4305 | mioa5755a | 4365 | MIOA5833a | 4425 | MIOA5914a | 4485 | MIOA5983a |
| 4246 | MIOA5667 | 4306 | MIOA5756a | 4366 | MIOA5834a | 4426 | MIOA5915a | 4486 | mioa5984a |
| 4247 | mioa5668n | 4307 | MIOA5758a | 4367 | mioa5835an | 4427 | MIOA5916a | 4487 | MIOA5985a |
| 4248 | MIOA5669 | 4308 | MIOA5759a | 4368 | MIOA5836a | 4428 | MIOA5917a | 4488 | MIOA5986a |
| 4249 | MIOA5672 | 4309 | MIOA5760a | 4369 | MIOA5837a | 4429 | mioa5918an | 4489 | mioa5988a |
| 4250 | MIOA5674 | 4310 | MIOA5761a | 4370 | MIOA5841a | 4430 | MIOA5919a | 4490 | MIOA5989a |
| 4251 | MIOA5676 | 4311 | mioa5762a | 4371 | MIOA5842a | 4431 | MIOA5920a | 4491 | MIOA5990a |
| 4252 | MIOA5677 | 4312 | MIOA5764a | 4372 | mioa5843a | 4432 | MIOA5922a | 4492 | MIOA5991a |
| 4253 | MIOA5678 | 4313 | MIOA5765a | 4373 | MIOA5844a | 4433 | MIOA5923a | 4493 | MIOA5992a |
| 4254 | mioa5679n | 4314 | MIOA5766a | 4374 | MIOA5846a | 4434 | MIOA5924a | 4494 | MIOA5993a |
| 4255 | MIOA5681 | 4315 | MIOA5768a | 4375 | MIOA5847a | 4435 | MIOA5925a | 4495 | MIOA5994a |
| 4256 | MIOA5682 | 4316 | MIOA5769a | 4376 | MIOA5848a | 4436 | MIOA5926a | 4496 | MIOA5995a |
| 4257 | mioa5683n | 4317 | MIOA5771a | 4377 | MIOA5849a | 4437 | MIOA5928a | 4497 | MIOA5996a |
| 4258 | MIOA5684 | 4318 | mioa5772a | 4378 | MIOA5851a | 4438 | MIOA5929a | 4498 | MIOA5997a |
| 4259 | MIOA5685 | 4319 | MIOA5773a | 4379 | MIOA5852a | 4439 | MIOA5930a | 4499 | MIOA5999a |
| 4260 | MIOA5686 | 4320 | MIOA5774a | 4380 | MIOA5854a | 4440 | MIOA5932a | 4500 | MIOA6000a |

Figure 6D – List of EST Sequence Names From Mild OA Cartilage cDNA Library

| | | | | | | | | | |
|---|---|---|---|---|---|---|---|---|---|
| 4501 | MIOA6003a | 4561 | mioa6082an | 4621 | MIOA6155a | 4681 | MIOA6244a | 4741 | MIOA6394a |
| 4502 | MIOA6004a | 4562 | MIOA6083a | 4622 | MIOA6156a | 4682 | mioa6246a | 4742 | MIOA6398a |
| 4503 | MIOA6005a | 4563 | MIOA6084a | 4623 | MIOA6157a | 4683 | MIOA6248a | 4743 | MIOA6401a |
| 4504 | MIOA6006a | 4564 | MIOA6085a | 4624 | mioa6158a | 4684 | MIOA6250a | 4744 | MIOA6402a |
| 4505 | MIOA6008a | 4565 | MIOA6086a | 4625 | MIOA6161a | 4685 | MIOA6251a | 4745 | MIOA6403a |
| 4506 | MIOA6010a | 4566 | MIOA6087a | 4626 | MIOA6162a | 4686 | MIOA6252a | 4746 | MIOA6404a |
| 4507 | mioa6011a | 4567 | MIOA6088a | 4627 | MIOA6164a | 4687 | MIOA6256a | 4747 | MIOA6409a |
| 4508 | MIOA6014a | 4568 | MIOA6089a | 4628 | MIOA6165a | 4688 | MIOA6262a | 4748 | MIOA6410a |
| 4509 | MIOA6015a | 4569 | MIOA6090a | 4629 | MIOA6166a | 4689 | MIOA6264a | 4749 | MIOA6411a |
| 4510 | mioa6018a | 4570 | MIOA6091 | 4630 | MIOA6167a | 4690 | mioa6266a | 4750 | MIOA6412a |
| 4511 | MIOA6019a | 4571 | MIOA6092 | 4631 | MIOA6168a | 4691 | MIOA6268a | 4751 | MIOA6413a |
| 4512 | MIOA6020a | 4572 | MIOA6093a | 4632 | MIOA6169a | 4692 | MIOA6270a | 4752 | MIOA6417a |
| 4513 | MIOA6021a | 4573 | MIOA6094a | 4633 | MIOA6170a | 4693 | MIOA6274a | 4753 | MIOA6418a |
| 4514 | MIOA6022a | 4574 | MIOA6095a | 4634 | MIOA6171a | 4694 | MIOA6280a | 4754 | MIOA6419a |
| 4515 | MIOA6023a | 4575 | mioa6096a | 4635 | MIOA6172a | 4695 | MIOA6282a | 4755 | mioa6420a |
| 4516 | MIOA6024a | 4576 | MIOA6098a | 4636 | MIOA6173a | 4696 | MIOA6284a | 4756 | MIOA6421a |
| 4517 | MIOA6026a | 4577 | MIOA6099a | 4637 | MIOA6174a | 4697 | MIOA6288a | 4757 | MIOA6422a |
| 4518 | MIOA6027a | 4578 | MIOA6100a | 4638 | MIOA6175a | 4698 | MIOA6290a | 4758 | MIOA6423a |
| 4519 | MIOA6029a | 4579 | MIOA6101a | 4639 | MIOA6178a | 4699 | MIOA6292a | 4759 | MIOA6424a |
| 4520 | MIOA6030 | 4580 | MIOA6102a | 4640 | MIOA6179a | 4700 | MIOA6294a | 4760 | MIOA6425a |
| 4521 | MIOA6032 | 4581 | MIOA6103a | 4641 | MIOA6180a | 4701 | MIOA6296a | 4761 | MIOA6426a |
| 4522 | MIOA6033 | 4582 | MIOA6104a | 4642 | MIOA6181a | 4702 | mioa6298a | 4762 | mioa6427a |
| 4523 | MIOA6034 | 4583 | MIOA6106a | 4643 | MIOA6182a | 4703 | MIOA6300a | 4763 | MIOA6428a |
| 4524 | MIOA6035 | 4584 | MIOA6108a | 4644 | MIOA6185a | 4704 | MIOA6302a | 4764 | MIOA6429a |
| 4525 | mioa6036 | 4585 | MIOA6109a | 4645 | MIOA6186a | 4705 | mioa6305a | 4765 | MIOA6430a |
| 4526 | MIOA6037 | 4586 | MIOA6110a | 4646 | MIOA6188a | 4706 | mioa6307a | 4766 | MIOA6431a |
| 4527 | MIOA6038 | 4587 | mioa6111a | 4647 | mioa6189a | 4707 | MIOA6312a | 4767 | MIOA6432a |
| 4528 | MIOA6039 | 4588 | MIOA6112a | 4648 | MIOA6190a | 4708 | MIOA6314a | 4768 | MIOA6434a |
| 4529 | MIOA6040 | 4589 | MIOA6113a | 4649 | MIOA6191a | 4709 | MIOA6315a | 4769 | MIOA6435a |
| 4530 | MIOA6041 | 4590 | MIOA6114a | 4650 | mioa6192a | 4710 | MIOA6316a | 4770 | MIOA6436a |
| 4531 | mioa6042n | 4591 | MIOA6115a | 4651 | MIOA6194a | 4711 | MIOA6317a | 4771 | MIOA6437a |
| 4532 | MIOA6043 | 4592 | MIOA6116a | 4652 | mioa6195an | 4712 | MIOA6320a | 4772 | MIOA6439a |
| 4533 | MIOA6044 | 4593 | mioa6117a | 4653 | MIOA6196a | 4713 | MIOA6323a | 4773 | MIOA6440a |
| 4534 | MIOA6045 | 4594 | MIOA6118a | 4654 | MIOA6197a | 4714 | MIOA6326a | 4774 | MIOA6441a |
| 4535 | MIOA6047a | 4595 | MIOA6121a | 4655 | MIOA6198a | 4715 | MIOA6328a | 4775 | MIOA6442a |
| 4536 | mioa6048a | 4596 | MIOA6122a | 4656 | MIOA6199a | 4716 | mioa6332a | 4776 | MIOA6444a |
| 4537 | MIOA6049a | 4597 | mioa6123a | 4657 | MIOA6200a | 4717 | MIOA6334a | 4777 | mioa6445a |
| 4538 | MIOA6053a | 4598 | MIOA6124a | 4658 | MIOA6202a | 4718 | MIOA6336a | 4778 | MIOA6446a |
| 4539 | MIOA6054a | 4599 | MIOA6125a | 4659 | MIOA6203a | 4719 | MIOA6340a | 4779 | MIOA6448a |
| 4540 | MIOA6056a | 4600 | MIOA6126a | 4660 | MIOA6204a | 4720 | MIOA6342a | 4780 | mioa6449a |
| 4541 | MIOA6057a | 4601 | MIOA6127a | 4661 | MIOA6205a | 4721 | MIOA6346a | 4781 | mioa6450a |
| 4542 | MIOA6058a | 4602 | MIOA6128a | 4662 | MIOA6206a | 4722 | mioa6355a | 4782 | MIOA6451a |
| 4543 | MIOA6059a | 4603 | MIOA6129a | 4663 | MIOA6207a | 4723 | MIOA6356a | 4783 | MIOA6452a |
| 4544 | MIOA6060a | 4604 | MIOA6130a | 4664 | MIOA6208a | 4724 | MIOA6358a | 4784 | MIOA6453a |
| 4545 | MIOA6061a | 4605 | MIOA6131a | 4665 | MIOA6210a | 4725 | MIOA6360a | 4785 | MIOA6454a |
| 4546 | MIOA6062 | 4606 | MIOA6132a | 4666 | MIOA6211a | 4726 | MIOA6362a | 4786 | MIOA6455a |
| 4547 | MIOA6063a | 4607 | MIOA6133a | 4667 | MIOA6212a | 4727 | MIOA6363a | 4787 | MIOA6456a |
| 4548 | MIOA6064a | 4608 | MIOA6134a | 4668 | MIOA6214a | 4728 | MIOA6364a | 4788 | mioa6457a |
| 4549 | MIOA6065a | 4609 | MIOA6135a | 4669 | MIOA6216a | 4729 | MIOA6368a | 4789 | MIOA6458a |
| 4550 | mioa6066an | 4610 | MIOA6136a | 4670 | MIOA6220a | 4730 | MIOA6370a | 4790 | MIOA6459a |
| 4551 | MIOA6068a | 4611 | mioa6142a | 4671 | MIOA6222a | 4731 | MIOA6372a | 4791 | MIOA6460a |
| 4552 | MIOA6069a | 4612 | MIOA6145a | 4672 | MIOA6226a | 4732 | MIOA6374a | 4792 | mioa6461a |
| 4553 | MIOA6071a | 4613 | MIOA6147a | 4673 | MIOA6228a | 4733 | MIOA6376a | 4793 | MIOA6463a |
| 4554 | MIOA6072a | 4614 | MIOA6148a | 4674 | MIOA6230a | 4734 | MIOA6378a | 4794 | MIOA6464a |
| 4555 | MIOA6075a | 4615 | MIOA6149a | 4675 | MIOA6232a | 4735 | MIOA6379a | 4795 | MIOA6465a |
| 4556 | MIOA6076a | 4616 | MIOA6150a | 4676 | MIOA6234a | 4736 | MIOA6386a | 4796 | MIOA6466a |
| 4557 | MIOA6077a | 4617 | MIOA6151a | 4677 | MIOA6236a | 4737 | mioa6387an | 4797 | MIOA6467a |
| 4558 | MIOA6078a | 4618 | MIOA6152a | 4678 | MIOA6238a | 4738 | MIOA6388a | 4798 | MIOA6469a |
| 4559 | MIOA6080a | 4619 | MIOA6153a | 4679 | MIOA6240a | 4739 | MIOA6389a | 4799 | MIOA6471a |
| 4560 | mioa6081a | 4620 | MIOA6154a | 4680 | MIOA6242a | 4740 | MIOA6392a | 4800 | MIOA6472a |

Figure 6D – List of EST Sequence Names From Mild OA Cartilage cDNA Library

| | |
|---|---|
| 4801 | MIOA6474a |
| 4802 | MIOA6475a |
| 4803 | MIOA6476a |
| 4804 | MIOA6477a |
| 4805 | MIOA6478a |
| 4806 | mioa6480a |
| 4807 | MIOA6483a |
| 4808 | MIOA6484a |
| 4809 | MIOA6485a |
| 4810 | MIOA6486a |
| 4811 | MIOA6487a |
| 4812 | MIOA6488a |
| 4813 | MIOA6489a |
| 4814 | MIOA6490a |
| 4815 | MIOA6491a |
| 4816 | MIOA6492a |
| 4817 | MIOA6493a |
| 4818 | MIOA6496a |
| 4819 | MIOA6500a |
| 4820 | MIOA6501a |
| 4821 | MIOA6502a |
| 4822 | MIOA6504a |
| 4823 | MIOA6508a |
| 4824 | MIOA6509a |
| 4825 | MIOA6510a |
| 4826 | MIOA6511a |
| 4827 | mioa6512a |
| 4828 | MIOA6513a |
| 4829 | mioa6514a |
| 4830 | mioa6515a |
| 4831 | MIOA6516a |
| 4832 | MIOA6517a |
| 4833 | MIOA6519a |
| 4834 | mioa6520an |
| 4835 | MIOA6521a |
| 4836 | MIOA6523a |
| 4837 | mioa6524a |
| 4838 | MIOA6525a |
| 4839 | MIOA6526a |
| 4840 | MIOA6527a |
| 4841 | MIOA6529a |
| 4842 | MIOA6530a |
| 4843 | MIOA6531a |
| 4844 | MIOA6532a |
| 4845 | MIOA6533a |
| 4846 | mioa6534an |
| 4847 | mioa6536a |
| 4848 | MIOA6537a |
| 4849 | MIOA6539a |
| 4850 | MIOA6540a |
| 4851 | MIOA6541a |
| 4852 | MIOA6542a |
| 4853 | MIOA6543a |
| 4854 | MIOA6544a |
| 4855 | MIOA6545a |
| 4856 | MIOA6546a |
| 4857 | MIOA6547a |
| 4858 | mioa6549an |
| 4859 | MIOA6550a |
| 4860 | mioa6551a |
| 4861 | MIOA6552a |
| 4862 | MIOA6553a |
| 4863 | MIOA6554a |
| 4864 | MIOA6556a |
| 4865 | MIOA6558a |
| 4866 | MIOA6560a |
| 4867 | MIOA6561a |
| 4868 | MIOA6562a |
| 4869 | MIOA6563a |
| 4870 | MIOA6565a |
| 4871 | MIOA6566a |
| 4872 | MIOA6567a |
| 4873 | MIOA6568a |
| 4874 | MIOA6569a |
| 4875 | MIOA6570a |
| 4876 | MIOA6571a |
| 4877 | mioa6572a |
| 4878 | mioa6573a |
| 4879 | MIOA6574a |
| 4880 | MIOA6575a |
| 4881 | MIOA6576a |
| 4882 | MIOA6577a |
| 4883 | MIOA6578a |
| 4884 | MIOA6580a |
| 4885 | MIOA6581a |
| 4886 | MIOA6582a |
| 4887 | MIOA6583a |
| 4888 | MIOA6584a |
| 4889 | MIOA6585a |
| 4890 | MIOA6586a |
| 4891 | MIOA6587a |
| 4892 | MIOA6588a |
| 4893 | mioa6590a |
| 4894 | MIOA6591a |
| 4895 | mioa6593a |
| 4896 | MIOA6594a |
| 4897 | MIOA6595a |
| 4898 | MIOA6596a |
| 4899 | MIOA6597a |
| 4900 | MIOA6598a |
| 4901 | MIOA6599a |
| 4902 | MIOA6600a |
| 4903 | MIOA6601a |
| 4904 | MIOA6603a |
| 4905 | MIOA6604a |
| 4906 | MIOA6605a |
| 4907 | MIOA6606a |
| 4908 | MIOA6607a |
| 4909 | MIOA6608a |
| 4910 | MIOA6609a |
| 4911 | MIOA6610a |
| 4912 | MIOA6612a |
| 4913 | MIOA6613a |
| 4914 | mioa6616a |
| 4915 | MIOA6619a |
| 4916 | MIOA6620a |
| 4917 | MIOA6621a |
| 4918 | MIOA6622a |
| 4919 | MIOA6623a |
| 4920 | MIOA6624a |
| 4921 | mioa6625a |
| 4922 | MIOA6626a |
| 4923 | MIOA6627a |
| 4924 | MIOA6628a |
| 4925 | mioa6629a |
| 4926 | MIOA6630a |
| 4927 | MIOA6631a |
| 4928 | MIOA6632a |
| 4929 | MIOA6633a |
| 4930 | mioa6634a |
| 4931 | MIOA6635a |
| 4932 | MIOA6637a |
| 4933 | mioa6638a |
| 4934 | MIOA6639a |
| 4935 | MIOA6640a |
| 4936 | MIOA6641a |
| 4937 | MIOA6643a |
| 4938 | MIOA6644a |
| 4939 | mioa6645a |
| 4940 | MIOA6646a |
| 4941 | MIOA6647a |
| 4942 | MIOA6648a |
| 4943 | MIOA6649a |
| 4944 | MIOA6651a |
| 4945 | MIOA6652a |
| 4946 | MIOA6653a |
| 4947 | MIOA6654a |
| 4948 | MIOA6655a |
| 4949 | MIOA6656a |
| 4950 | MIOA6657a |
| 4951 | MIOA6659a |
| 4952 | MIOA6661a |
| 4953 | MIOA6662a |
| 4954 | MIOA6663a |
| 4955 | MIOA6664a |
| 4956 | mioa6665a |
| 4957 | MIOA6666a |
| 4958 | MIOA6668a |
| 4959 | MIOA6670a |
| 4960 | MIOA6672a |
| 4961 | MIOA6673a |
| 4962 | MIOA6674a |
| 4963 | MIOA6675a |
| 4964 | mioa6676a |
| 4965 | MIOA6677a |
| 4966 | MIOA6678a |
| 4967 | MIOA6679a |
| 4968 | MIOA6680a |
| 4969 | MIOA6681a |
| 4970 | MIOA6683a |
| 4971 | MIOA6684a |
| 4972 | MIOA6687a |
| 4973 | MIOA6688a |
| 4974 | MIOA6690a |
| 4975 | mioa6691a |
| 4976 | MIOA6697a |
| 4977 | MIOA6698a |
| 4978 | MIOA6700a |
| 4979 | MIOA6701a |
| 4980 | mioa6702a |
| 4981 | MIOA6703a |
| 4982 | MIOA6704a |
| 4983 | mioa6705an |
| 4984 | MIOA6706a |
| 4985 | MIOA6708a |
| 4986 | MIOA6710a |
| 4987 | MIOA6711a |
| 4988 | MIOA6712a |
| 4989 | mioa6714a |
| 4990 | MIOA6715a |
| 4991 | MIOA6716a |
| 4992 | MIOA6717a |
| 4993 | MIOA6718a |
| 4994 | MIOA6719a |
| 4995 | MIOA6720a |
| 4996 | MIOA6721a |
| 4997 | MIOA6722a |
| 4998 | MIOA6723a |
| 4999 | MIOA6724a |
| 5000 | MIOA6725a |
| 5001 | MIOA6726a |
| 5002 | mioa6727a |
| 5003 | MIOA6728a |
| 5004 | MIOA6730a |
| 5005 | MIOA6731a |
| 5006 | MIOA6732a |
| 5007 | MIOA6733a |
| 5008 | MIOA6734a |
| 5009 | MIOA6735a |
| 5010 | MIOA6736a |
| 5011 | MIOA6737a |
| 5012 | MIOA6738a |
| 5013 | MIOA6739a |
| 5014 | MIOA6740a |
| 5015 | mioa6743an |
| 5016 | MIOA6744a |
| 5017 | MIOA6745a |
| 5018 | MIOA6746a |
| 5019 | MIOA6749a |
| 5020 | MIOA6750a |
| 5021 | MIOA6756a |
| 5022 | MIOA6759a |
| 5023 | MIOA6762a |
| 5024 | MIOA6763a |
| 5025 | MIOA6765a |
| 5026 | MIOA6766a |
| 5027 | MIOA6767a |
| 5028 | MIOA6768a |
| 5029 | mioa6770an |
| 5030 | MIOA6771a |
| 5031 | MIOA6772a |
| 5032 | MIOA6773a |
| 5033 | MIOA6774a |
| 5034 | MIOA6775a |
| 5035 | MIOA6776a |
| 5036 | MIOA6777a |
| 5037 | MIOA6778a |
| 5038 | mioa6779a |
| 5039 | MIOA6780a |
| 5040 | MIOA6781a |
| 5041 | mioa6782a |
| 5042 | MIOA6783a |
| 5043 | MIOA6784a |
| 5044 | mioa6786a |
| 5045 | MIOA6790a |
| 5046 | MIOA6791a |
| 5047 | mioa6792an |
| 5048 | MIOA6794a |
| 5049 | mioa6795a |
| 5050 | MIOA6797a |
| 5051 | MIOA6798a |
| 5052 | MIOA6799a |
| 5053 | mioa6800a |
| 5054 | mioa6801a |
| 5055 | MIOA6802a |
| 5056 | MIOA6803a |
| 5057 | MIOA6804a |
| 5058 | MIOA6805a |
| 5059 | MIOA6806a |
| 5060 | MIOA6807a |
| 5061 | MIOA6808a |
| 5062 | MIOA6809a |
| 5063 | MIOA6810a |
| 5064 | MIOA6811a |
| 5065 | mioa6812a |
| 5066 | mioa6813a |
| 5067 | MIOA6814a |
| 5068 | MIOA6815a |
| 5069 | MIOA6816a |
| 5070 | MIOA6818a |
| 5071 | MIOA6819a |
| 5072 | MIOA6820a |
| 5073 | MIOA6821a |
| 5074 | MIOA6822a |
| 5075 | MIOA6823a |
| 5076 | MIOA6824a |
| 5077 | MIOA6825a |
| 5078 | MIOA6826a |
| 5079 | MIOA6827a |
| 5080 | MIOA6828a |
| 5081 | MIOA6830a |
| 5082 | MIOA6831a |
| 5083 | MIOA6832a |
| 5084 | MIOA6833a |
| 5085 | MIOA6834a |
| 5086 | MIOA6835a |
| 5087 | mioa6836a |
| 5088 | mioa6838an |
| 5089 | MIOA6839a |
| 5090 | MIOA6840a |
| 5091 | MIOA6841a |
| 5092 | MIOA6842a |
| 5093 | MIOA6843a |
| 5094 | MIOA6844a |
| 5095 | MIOA6845a |
| 5096 | MIOA6846a |
| 5097 | MIOA6850a |
| 5098 | MIOA6851a |
| 5099 | MIOA6853a |
| 5100 | MIOA6854a |

Figure 6D – List of EST Sequence Names From Mild OA Cartilage cDNA Library

| | | | | | | | | | |
|---|---|---|---|---|---|---|---|---|---|
| 5101 | MIOA6855a | 5161 | MIOA6959a | 5221 | MIOA7050a | 5281 | MIOA7134a | 5341 | MIOA7214a |
| 5102 | mioa6856a | 5162 | MIOA6960a | 5222 | mioa7051a | 5282 | mioa7136a | 5342 | MIOA7215a |
| 5103 | mioa6858an | 5163 | MIOA6961a | 5223 | MIOA7058a | 5283 | MIOA7137a | 5343 | MIOA7216a |
| 5104 | MIOA6860a | 5164 | MIOA6962a | 5224 | MIOA7059a | 5284 | MIOA7138a | 5344 | MIOA7218a |
| 5105 | MIOA6862a | 5165 | MIOA6964a | 5225 | MIOA7060a | 5285 | MIOA7139a | 5345 | MIOA7219a |
| 5106 | MIOA6864a | 5166 | mioa6965a | 5226 | MIOA7063a | 5286 | MIOA7140a | 5346 | mioa7220a |
| 5107 | MIOA6865a | 5167 | MIOA6967a | 5227 | MIOA7066a | 5287 | MIOA7141a | 5347 | MIOA7223a |
| 5108 | MIOA6866a | 5168 | MIOA6969a | 5228 | MIOA7067a | 5288 | MIOA7142a | 5348 | MIOA7224a |
| 5109 | MIOA6867a | 5169 | MIOA6978a | 5229 | MIOA7068a | 5289 | MIOA7147a | 5349 | MIOA7225a |
| 5110 | MIOA6869a | 5170 | MIOA6979a | 5230 | MIOA7069a | 5290 | MIOA7148a | 5350 | MIOA7226a |
| 5111 | MIOA6870a | 5171 | MIOA6980a | 5231 | MIOA7070a | 5291 | MIOA7149a | 5351 | MIOA7227a |
| 5112 | MIOA6874a | 5172 | MIOA6981a | 5232 | MIOA7071a | 5292 | MIOA7150a | 5352 | MIOA7229a |
| 5113 | MIOA6875a | 5173 | MIOA6982a | 5233 | MIOA7072a | 5293 | MIOA7151a | 5353 | MIOA7230a |
| 5114 | MIOA6877a | 5174 | MIOA6983a | 5234 | MIOA7073a | 5294 | MIOA7152a | 5354 | MIOA7231a |
| 5115 | MIOA6878a | 5175 | mioa6984a | 5235 | MIOA7075a | 5295 | MIOA7153a | 5355 | MIOA7232a |
| 5116 | MIOA6879a | 5176 | MIOA6986a | 5236 | MIOA7077a | 5296 | MIOA7154a | 5356 | MIOA7233a |
| 5117 | MIOA6880a | 5177 | MIOA6987a | 5237 | mioa7078a | 5297 | MIOA7155a | 5357 | mioa7234a |
| 5118 | MIOA6881a | 5178 | MIOA6988a | 5238 | MIOA7079a | 5298 | MIOA7156a | 5358 | MIOA7235a |
| 5119 | mioa6882an | 5179 | MIOA6989a | 5239 | MIOA7080a | 5299 | MIOA7158a | 5359 | MIOA7236a |
| 5120 | mioa6883a | 5180 | MIOA6990a | 5240 | MIOA7082a | 5300 | MIOA7162a | 5360 | MIOA7237a |
| 5121 | MIOA6885a | 5181 | MIOA6991a | 5241 | MIOA7084a | 5301 | mioa7163a | 5361 | mioa7238a |
| 5122 | MIOA6886a | 5182 | mioa6994a | 5242 | MIOA7087a | 5302 | MIOA7165a | 5362 | MIOA7239a |
| 5123 | mioa6887a | 5183 | MIOA6995a | 5243 | MIOA7088a | 5303 | MIOA7166a | 5363 | MIOA7240a |
| 5124 | MIOA6888a | 5184 | MIOA6999a | 5244 | MIOA7089a | 5304 | MIOA7169a | 5364 | MIOA7241a |
| 5125 | MIOA6889a | 5185 | MIOA7000a | 5245 | mioa7090a | 5305 | MIOA7170a | 5365 | MIOA7242a |
| 5126 | MIOA6891a | 5186 | MIOA7002a | 5246 | MIOA7091a | 5306 | MIOA7173a | 5366 | MIOA7243a |
| 5127 | MIOA6892a | 5187 | MIOA7003a | 5247 | MIOA7092a | 5307 | MIOA7174a | 5367 | mioa7244a |
| 5128 | MIOA6894a | 5188 | MIOA7005a | 5248 | MIOA7093a | 5308 | MIOA7175a | 5368 | MIOA7245a |
| 5129 | MIOA6896a | 5189 | MIOA7006a | 5249 | MIOA7094a | 5309 | MIOA7177a | 5369 | MIOA7246a |
| 5130 | mioa6897a | 5190 | MIOA7007a | 5250 | MIOA7095a | 5310 | MIOA7178a | 5370 | MIOA7247a |
| 5131 | MIOA6898a | 5191 | MIOA7008a | 5251 | MIOA7096a | 5311 | MIOA7179a | 5371 | MIOA7248a |
| 5132 | MIOA6899a | 5192 | MIOA7009a | 5252 | MIOA7097a | 5312 | MIOA7180a | 5372 | MIOA7249a |
| 5133 | MIOA6901a | 5193 | MIOA7010a | 5253 | MIOA7099a | 5313 | MIOA7181a | 5373 | MIOA7250a |
| 5134 | MIOA6903a | 5194 | MIOA7011a | 5254 | MIOA7101a | 5314 | MIOA7182a | 5374 | MIOA7251a |
| 5135 | MIOA6904a | 5195 | mioa7012a | 5255 | MIOA7102a | 5315 | MIOA7183a | 5375 | MIOA7252a |
| 5136 | MIOA6908a | 5196 | MIOA7013a | 5256 | MIOA7103a | 5316 | mioa7184a | 5376 | mioa7253a |
| 5137 | MIOA6913a | 5197 | MIOA7014a | 5257 | MIOA7104a | 5317 | MIOA7186a | 5377 | mioa7254a |
| 5138 | MIOA6914a | 5198 | MIOA7015a | 5258 | MIOA7105a | 5318 | MIOA7187a | 5378 | MIOA7255a |
| 5139 | MIOA6916a | 5199 | MIOA7018a | 5259 | MIOA7107a | 5319 | MIOA7188a | 5379 | MIOA7256a |
| 5140 | MIOA6918a | 5200 | MIOA7019a | 5260 | MIOA7108a | 5320 | MIOA7189a | 5380 | MIOA7257a |
| 5141 | MIOA6922a | 5201 | MIOA7020a | 5261 | MIOA7109a | 5321 | MIOA7190a | 5381 | MIOA7258a |
| 5142 | MIOA6923a | 5202 | MIOA7022a | 5262 | MIOA7110a | 5322 | MIOA7191a | 5382 | MIOA7259a |
| 5143 | MIOA6928a | 5203 | MIOA7024a | 5263 | MIOA7111a | 5323 | MIOA7192a | 5383 | MIOA7260a |
| 5144 | MIOA6929a | 5204 | MIOA7026a | 5264 | MIOA7113a | 5324 | MIOA7193a | 5384 | MIOA7261a |
| 5145 | MIOA6930a | 5205 | MIOA7027a | 5265 | MIOA7114a | 5325 | MIOA7194a | 5385 | MIOA7262a |
| 5146 | MIOA6933a | 5206 | mioa7028a | 5266 | mioa7115an | 5326 | MIOA7195a | 5386 | MIOA7263a |
| 5147 | MIOA6934a | 5207 | MIOA7031a | 5267 | MIOA7116a | 5327 | mioa7196a | 5387 | MIOA7264a |
| 5148 | MIOA6937a | 5208 | MIOA7034a | 5268 | MIOA7118a | 5328 | MIOA7197a | 5388 | MIOA7265a |
| 5149 | MIOA6942a | 5209 | MIOA7036a | 5269 | mioa7119a | 5329 | mioa7198a | 5389 | MIOA7266a |
| 5150 | MIOA6943a | 5210 | MIOA7037a | 5270 | MIOA7120a | 5330 | MIOA7200a | 5390 | MIOA7267a |
| 5151 | MIOA6944a | 5211 | MIOA7038a | 5271 | MIOA7121a | 5331 | MIOA7201a | 5391 | MIOA7269a |
| 5152 | MIOA6945a | 5212 | MIOA7039a | 5272 | MIOA7123a | 5332 | MIOA7202a | 5392 | mioa7270a |
| 5153 | MIOA6947a | 5213 | MIOA7040a | 5273 | MIOA7125a | 5333 | MIOA7204a | 5393 | MIOA7271 |
| 5154 | MIOA6948a | 5214 | MIOA7041a | 5274 | MIOA7126a | 5334 | MIOA7205a | 5394 | MIOA7272 |
| 5155 | MIOA6949a | 5215 | MIOA7042a | 5275 | MIOA7127a | 5335 | MIOA7206a | 5395 | MIOA7273 |
| 5156 | MIOA6951a | 5216 | MIOA7045a | 5276 | mioa7128a | 5336 | MIOA7207a | 5396 | MIOA7274 |
| 5157 | MIOA6953a | 5217 | MIOA7046a | 5277 | MIOA7129a | 5337 | MIOA7208a | 5397 | MIOA7275 |
| 5158 | MIOA6955a | 5218 | MIOA7047a | 5278 | MIOA7130a | 5338 | MIOA7209a | 5398 | MIOA7277 |
| 5159 | MIOA6956a | 5219 | MIOA7048a | 5279 | MIOA7132a | 5339 | MIOA7211a | 5399 | MIOA7278 |
| 5160 | MIOA6957a | 5220 | MIOA7049a | 5280 | MIOA7133a | 5340 | MIOA7212a | 5400 | mioa7279 |

Figure 6D – List of EST Sequence Names From Mild OA Cartilage cDNA Library

| | | | | | | | | | |
|---|---|---|---|---|---|---|---|---|---|
| 5401 | MIOA7280 | 5461 | MIOA7359a | 5521 | MIOA7436a | 5581 | MIOA7521a | 5641 | MIOA7597a |
| 5402 | MIOA7283 | 5462 | MIOA7361a | 5522 | MIOA7437a | 5582 | MIOA7522a | 5642 | MIOA7598a |
| 5403 | MIOA7284 | 5463 | MIOA7362a | 5523 | MIOA7438a | 5583 | MIOA7523a | 5643 | mioa7600a |
| 5404 | MIOA7285 | 5464 | MIOA7363a | 5524 | MIOA7441a | 5584 | MIOA7526a | 5644 | MIOA7602a |
| 5405 | MIOA7286 | 5465 | MIOA7364a | 5525 | MIOA7442a | 5585 | MIOA7527a | 5645 | MIOA7603a |
| 5406 | mioa7287 | 5466 | MIOA7365a | 5526 | MIOA7443a | 5586 | mioa7529an | 5646 | MIOA7604a |
| 5407 | MIOA7288 | 5467 | MIOA7366a | 5527 | MIOA7444a | 5587 | MIOA7530a | 5647 | MIOA7606a |
| 5408 | MIOA7289 | 5468 | MIOA7367a | 5528 | mioa7445a | 5588 | MIOA7531a | 5648 | MIOA7607a |
| 5409 | MIOA7290 | 5469 | MIOA7368a | 5529 | MIOA7446a | 5589 | MIOA7532a | 5649 | MIOA7608a |
| 5410 | MIOA7291 | 5470 | MIOA7371a | 5530 | MIOA7447a | 5590 | MIOA7533a | 5650 | MIOA7609a |
| 5411 | MIOA7295 | 5471 | MIOA7372a | 5531 | MIOA7448a | 5591 | MIOA7534a | 5651 | MIOA7610a |
| 5412 | MIOA7296 | 5472 | MIOA7373a | 5532 | MIOA7451a | 5592 | MIOA7536a | 5652 | MIOA7611a |
| 5413 | MIOA7297 | 5473 | MIOA7374a | 5533 | MIOA7452a | 5593 | mioa7537a | 5653 | MIOA7612a |
| 5414 | MIOA7298 | 5474 | MIOA7375a | 5534 | mioa7453a | 5594 | MIOA7538a | 5654 | MIOA7613a |
| 5415 | MIOA7299 | 5475 | MIOA7377a | 5535 | MIOA7454a | 5595 | MIOA7539a | 5655 | MIOA7617a |
| 5416 | MIOA7300 | 5476 | MIOA7378a | 5536 | MIOA7455a | 5596 | MIOA7541a | 5656 | MIOA7618a |
| 5417 | MIOA7301 | 5477 | MIOA7381a | 5537 | MIOA7456a | 5597 | MIOA7542a | 5657 | mioa7620a |
| 5418 | MIOA7302 | 5478 | MIOA7382a | 5538 | MIOA7457a | 5598 | MIOA7543a | 5658 | MIOA7622a |
| 5419 | MIOA7303 | 5479 | MIOA7383a | 5539 | mioa7458a | 5599 | MIOA7544a | 5659 | MIOA7623a |
| 5420 | MIOA7306 | 5480 | MIOA7385a | 5540 | MIOA7459a | 5600 | MIOA7545a | 5660 | MIOA7624a |
| 5421 | MIOA7307 | 5481 | mioa7386a | 5541 | MIOA7461a | 5601 | MIOA7547a | 5661 | MIOA7625a |
| 5422 | MIOA7308 | 5482 | MIOA7387a | 5542 | MIOA7465a | 5602 | MIOA7548a | 5662 | MIOA7628a |
| 5423 | MIOA7309 | 5483 | MIOA7388a | 5543 | mioa7466an | 5603 | MIOA7549a | 5663 | MIOA7629a |
| 5424 | MIOA7310 | 5484 | MIOA7390a | 5544 | MIOA7467a | 5604 | MIOA7550a | 5664 | MIOA7630a |
| 5425 | mioa7312 | 5485 | MIOA7392a | 5545 | MIOA7472a | 5605 | MIOA7553a | 5665 | MIOA7631a |
| 5426 | MIOA7313 | 5486 | MIOA7395a | 5546 | MIOA7474a | 5606 | MIOA7554a | 5666 | MIOA7632a |
| 5427 | MIOA7314 | 5487 | MIOA7399a | 5547 | MIOA7476a | 5607 | MIOA7555a | 5667 | mioa7636a |
| 5428 | MIOA7315 | 5488 | MIOA7400a | 5548 | MIOA7478a | 5608 | MIOA7556a | 5668 | mioa7637a |
| 5429 | MIOA7316 | 5489 | MIOA7401a | 5549 | MIOA7479a | 5609 | MIOA7558a | 5669 | mioa7639a |
| 5430 | MIOA7317 | 5490 | MIOA7402a | 5550 | MIOA7480a | 5610 | MIOA7559a | 5670 | mioa7640a |
| 5431 | MIOA7318 | 5491 | MIOA7403a | 5551 | MIOA7481a | 5611 | MIOA7560a | 5671 | mioa7641a |
| 5432 | MIOA7319 | 5492 | MIOA7404a | 5552 | MIOA7482a | 5612 | MIOA7561a | 5672 | mioa7642a |
| 5433 | MIOA7320 | 5493 | MIOA7405a | 5553 | MIOA7484a | 5613 | MIOA7562a | 5673 | mioa7643a |
| 5434 | MIOA7322 | 5494 | MIOA7406a | 5554 | MIOA7485a | 5614 | MIOA7564a | 5674 | mioa7644a |
| 5435 | MIOA7323 | 5495 | MIOA7407a | 5555 | MIOA7487a | 5615 | MIOA7565a | 5675 | mioa7645a |
| 5436 | MIOA7324 | 5496 | MIOA7408a | 5556 | MIOA7488a | 5616 | MIOA7566a | 5676 | mioa7646a |
| 5437 | mioa7325 | 5497 | MIOA7409a | 5557 | MIOA7489a | 5617 | MIOA7568a | 5677 | mioa7647a |
| 5438 | MIOA7326 | 5498 | MIOA7411a | 5558 | MIOA7490a | 5618 | MIOA7569a | 5678 | mioa7649a |
| 5439 | MIOA7327 | 5499 | MIOA7412a | 5559 | MIOA7493a | 5619 | MIOA7570a | 5679 | mioa7650a |
| 5440 | MIOA7328 | 5500 | MIOA7413a | 5560 | mioa7494an | 5620 | mioa7571a | 5680 | mioa7652a |
| 5441 | MIOA7331 | 5501 | MIOA7414a | 5561 | MIOA7495a | 5621 | MIOA7572a | 5681 | mioa7653a |
| 5442 | MIOA7333a | 5502 | MIOA7415a | 5562 | MIOA7497a | 5622 | MIOA7573a | 5682 | mioa7654a |
| 5443 | MIOA7334a | 5503 | MIOA7416a | 5563 | MIOA7498a | 5623 | MIOA7574a | 5683 | mioa7656a |
| 5444 | MIOA7335a | 5504 | MIOA7417a | 5564 | MIOA7499a | 5624 | MIOA7576a | 5684 | mioa7657a |
| 5445 | MIOA7336a | 5505 | MIOA7418a | 5565 | MIOA7500a | 5625 | MIOA7578a | 5685 | mioa7659a |
| 5446 | MIOA7337a | 5506 | MIOA7419a | 5566 | MIOA7501a | 5626 | MIOA7579a | 5686 | mioa7660a |
| 5447 | MIOA7338a | 5507 | MIOA7420a | 5567 | MIOA7502a | 5627 | MIOA7581a | 5687 | mioa7661a |
| 5448 | MIOA7339a | 5508 | MIOA7421a | 5568 | MIOA7503a | 5628 | MIOA7582a | 5688 | mioa7667a |
| 5449 | MIOA7341a | 5509 | MIOA7422a | 5569 | MIOA7506a | 5629 | MIOA7583a | 5689 | mioa7670a |
| 5450 | MIOA7344a | 5510 | MIOA7423a | 5570 | MIOA7508a | 5630 | MIOA7584a | 5690 | mioa7671a |
| 5451 | MIOA7345a | 5511 | MIOA7424a | 5571 | mioa7509a | 5631 | MIOA7585a | 5691 | mioa7672a |
| 5452 | MIOA7346a | 5512 | MIOA7425a | 5572 | MIOA7510a | 5632 | MIOA7586a | 5692 | mioa7673a |
| 5453 | MIOA7347a | 5513 | MIOA7426a | 5573 | MIOA7512a | 5633 | MIOA7587a | 5693 | mioa7677a |
| 5454 | MIOA7348a | 5514 | MIOA7427a | 5574 | MIOA7513a | 5634 | MIOA7588a | 5694 | mioa7678a |
| 5455 | MIOA7350a | 5515 | MIOA7428a | 5575 | MIOA7514a | 5635 | MIOA7589a | 5695 | mioa7679a |
| 5456 | MIOA7351a | 5516 | MIOA7429a | 5576 | MIOA7515a | 5636 | MIOA7590a | 5696 | mioa7681a |
| 5457 | MIOA7352a | 5517 | MIOA7430a | 5577 | MIOA7516a | 5637 | MIOA7592a | 5697 | mioa7682a |
| 5458 | MIOA7353a | 5518 | MIOA7432a | 5578 | MIOA7518a | 5638 | MIOA7593a | 5698 | mioa7684a |
| 5459 | mioa7354a | 5519 | MIOA7433a | 5579 | MIOA7519a | 5639 | MIOA7594a | 5699 | mioa7685a |
| 5460 | MIOA7357a | 5520 | MIOA7435a | 5580 | MIOA7520a | 5640 | MIOA7596a | 5700 | mioa7687a |

Figure 6D - List of EST Sequence Names From Mild OA Cartilage cDNA Library

| | |
|---|---|
| 5701 | mioa7688a |
| 5702 | mioa7692a |
| 5703 | mioa7693a |
| 5704 | mioa7694a |
| 5705 | mioa7695a |
| 5706 | mioa7696a |
| 5707 | mioa7698a |
| 5708 | mioa7699a |
| 5709 | mioa7700a |
| 5710 | mioa7701a |
| 5711 | mioa7702a |
| 5712 | mioa7703a |
| 5713 | mioa7704a |
| 5714 | mioa7705a |
| 5715 | mioa7706a |
| 5716 | mioa7707a |
| 5717 | mioa7708a |
| 5718 | mioa7709a |
| 5719 | mioa7710a |
| 5720 | mioa7711a |
| 5721 | mioa7713a |
| 5722 | mioa7714a |
| 5723 | mioa7715a |
| 5724 | mioa7716a |
| 5725 | mioa7717a |
| 5726 | mioa7718a |
| 5727 | mioa7719a |
| 5728 | mioa7720a |
| 5729 | mioa7721a |
| 5730 | mioa7722a |
| 5731 | mioa7723a |
| 5732 | mioa7725a |
| 5733 | mioa7727a |
| 5734 | mioa7728a |
| 5735 | mioa7730a |
| 5736 | mioa7731a |
| 5737 | mioa7732a |
| 5738 | mioa7733a |
| 5739 | mioa7735a |
| 5740 | mioa7736a |
| 5741 | mioa7737a |
| 5742 | mioa7738a |
| 5743 | mioa7739a |
| 5744 | mioa7740a |
| 5745 | mioa7741a |
| 5746 | mioa7745a |
| 5747 | mioa7746a |
| 5748 | mioa7754a |
| 5749 | mioa7755a |
| 5750 | mioa7757a |
| 5751 | mioa7758a |
| 5752 | mioa7762a |
| 5753 | mioa7763a |
| 5754 | mioa7766a |
| 5755 | mioa7767a |
| 5756 | mioa7768a |
| 5757 | mioa7772a |
| 5758 | mioa7773a |
| 5759 | mioa7775a |
| 5760 | mioa7776a |
| 5761 | mioa7780a |
| 5762 | mioa7783a |
| 5763 | mioa7788a |
| 5764 | mioa7789a |
| 5765 | mioa7790a |
| 5766 | mioa7791a |
| 5767 | mioa7794a |
| 5768 | mioa7798a |
| 5769 | mioa7799a |
| 5770 | mioa7800a |
| 5771 | mioa7801a |
| 5772 | mioa7803a |
| 5773 | mioa7804a |
| 5774 | mioa7805a |
| 5775 | mioa7806a |
| 5776 | mioa7807a |
| 5777 | mioa7808a |
| 5778 | mioa7809a |
| 5779 | mioa7810a |
| 5780 | mioa7812a |
| 5781 | mioa7813a |
| 5782 | mioa7814a |
| 5783 | mioa7815a |
| 5784 | mioa7816a |
| 5785 | mioa7817a |
| 5786 | mioa7818a |
| 5787 | mioa7819a |
| 5788 | mioa7820a |
| 5789 | mioa7821a |
| 5790 | mioa7823a |
| 5791 | mioa7824a |
| 5792 | mioa7825a |
| 5793 | mioa7826a |
| 5794 | mioa7827a |
| 5795 | mioa7829a |
| 5796 | mioa7830a |
| 5797 | mioa7831a |
| 5798 | mioa7832a |
| 5799 | mioa7835a |
| 5800 | mioa7836a |
| 5801 | mioa7838a |
| 5802 | mioa7839a |
| 5803 | mioa7840a |
| 5804 | mioa7841a |
| 5805 | mioa7842a |
| 5806 | mioa7843a |
| 5807 | mioa7844a |
| 5808 | mioa7845a |
| 5809 | mioa7846a |
| 5810 | mioa7848 |
| 5811 | mioa7849 |
| 5812 | mioa7852 |
| 5813 | mioa7854 |
| 5814 | mioa7855 |
| 5815 | mioa7856 |
| 5816 | mioa7857 |
| 5817 | mioa7858 |
| 5818 | mioa7859 |
| 5819 | mioa7860 |
| 5820 | mioa7861 |
| 5821 | mioa7862 |
| 5822 | mioa7864 |
| 5823 | mioa7866 |
| 5824 | mioa7867 |
| 5825 | mioa7868 |
| 5826 | mioa7869 |
| 5827 | mioa7870 |
| 5828 | mioa7873 |
| 5829 | mioa7874 |
| 5830 | mioa7875 |
| 5831 | mioa7876 |
| 5832 | mioa7878 |
| 5833 | mioa7879 |
| 5834 | mioa7880 |
| 5835 | mioa7881 |
| 5836 | mioa7882 |
| 5837 | mioa7883 |
| 5838 | mioa7884 |
| 5839 | mioa7885 |
| 5840 | mioa7886 |
| 5841 | mioa7887 |
| 5842 | mioa7888 |
| 5843 | mioa7889 |
| 5844 | mioa7890 |
| 5845 | mioa7891 |
| 5846 | mioa7892 |
| 5847 | mioa7893 |
| 5848 | mioa7894 |
| 5849 | mioa7895 |
| 5850 | mioa7896 |
| 5851 | mioa7897 |
| 5852 | mioa7898 |
| 5853 | mioa7899 |
| 5854 | mioa7900 |
| 5855 | mioa7901 |
| 5856 | mioa7904 |
| 5857 | mioa7905 |
| 5858 | mioa7906 |
| 5859 | mioa7907 |
| 5860 | mioa7908 |
| 5861 | mioa7909 |
| 5862 | mioa7910 |
| 5863 | mioa7911 |
| 5864 | mioa7913 |
| 5865 | mioa7915 |
| 5866 | mioa7916 |
| 5867 | mioa7917 |
| 5868 | mioa7918 |
| 5869 | mioa7919 |
| 5870 | mioa7920 |
| 5871 | mioa7922 |
| 5872 | mioa7923 |
| 5873 | mioa7924 |
| 5874 | mioa7927 |
| 5875 | mioa7928 |
| 5876 | mioa7929 |
| 5877 | mioa7930 |
| 5878 | mioa7931 |
| 5879 | mioa7932 |
| 5880 | mioa7933 |
| 5881 | mioa7934 |
| 5882 | mioa7935 |
| 5883 | mioa7936 |
| 5884 | mioa7937 |
| 5885 | mioa7943 |
| 5886 | mioa7946 |
| 5887 | MIOA7949a |
| 5888 | MIOA7950a |
| 5889 | MIOA7951a |
| 5890 | MIOA7953a |
| 5891 | MIOA7954a |
| 5892 | MIOA7955a |
| 5893 | MIOA7956a |
| 5894 | MIOA7957a |
| 5895 | MIOA7958a |
| 5896 | MIOA7959a |
| 5897 | MIOA7967a |
| 5898 | MIOA7968a |
| 5899 | MIOA7969a |
| 5900 | MIOA7970a |
| 5901 | MIOA7973a |
| 5902 | MIOA7976a |
| 5903 | MIOA7977a |
| 5904 | MIOA7980a |
| 5905 | MIOA7981a |
| 5906 | MIOA7982a |
| 5907 | MIOA7983a |
| 5908 | MIOA7986a |
| 5909 | MIOA7988a |
| 5910 | MIOA7989a |
| 5911 | mioa7990an |
| 5912 | MIOA7992a |
| 5913 | MIOA7993a |
| 5914 | MIOA7994a |
| 5915 | MIOA7995a |
| 5916 | MIOA7997a |
| 5917 | MIOA7998a |
| 5918 | MIOA8001a |
| 5919 | MIOA8002a |
| 5920 | MIOA8003a |
| 5921 | MIOA8004a |
| 5922 | MIOA8005a |
| 5923 | MIOA8007a |
| 5924 | MIOA8009a |
| 5925 | mioa8010a |
| 5926 | MIOA8011a |
| 5927 | MIOA8012a |
| 5928 | MIOA8013a |
| 5929 | MIOA8014a |
| 5930 | MIOA8015a |
| 5931 | MIOA8016a |
| 5932 | MIOA8018a |
| 5933 | MIOA8019a |
| 5934 | MIOA8020a |
| 5935 | MIOA8021a |
| 5936 | MIOA8022a |
| 5937 | MIOA8024a |
| 5938 | MIOA8025a |
| 5939 | MIOA8026a |
| 5940 | MIOA8027a |
| 5941 | MIOA8028a |
| 5942 | MIOA8029a |
| 5943 | MIOA8030a |
| 5944 | MIOA8031a |
| 5945 | MIOA8032a |
| 5946 | MIOA8033a |
| 5947 | MIOA8034a |
| 5948 | MIOA8035a |
| 5949 | MIOA8036a |
| 5950 | MIOA8037a |
| 5951 | MIOA8039a |
| 5952 | MIOA8040a |
| 5953 | MIOA8041a |
| 5954 | MIOA8043a |
| 5955 | MIOA8045a |
| 5956 | MIOA8048a |
| 5957 | MIOA8049a |
| 5958 | MIOA8050a |
| 5959 | MIOA8051a |
| 5960 | MIOA8053a |
| 5961 | mioa8056a |
| 5962 | MIOA8057a |
| 5963 | MIOA8058a |
| 5964 | MIOA8059a |
| 5965 | MIOA8062a |
| 5966 | MIOA8063a |
| 5967 | MIOA8064a |
| 5968 | MIOA8065a |
| 5969 | MIOA8066 |
| 5970 | MIOA8067 |
| 5971 | mioa8068n |
| 5972 | MIOA8069 |
| 5973 | MIOA8070 |
| 5974 | MIOA8071 |
| 5975 | MIOA8072 |
| 5976 | MIOA8073 |
| 5977 | MIOA8074 |
| 5978 | MIOA8075 |
| 5979 | MIOA8076 |
| 5980 | MIOA8077 |
| 5981 | MIOA8078 |
| 5982 | mioa8079 |
| 5983 | MIOA8080 |
| 5984 | MIOA8081 |
| 5985 | MIOA8082 |
| 5986 | MIOA8083 |
| 5987 | MIOA8084 |
| 5988 | MIOA8085 |
| 5989 | MIOA8088 |
| 5990 | MIOA8089 |
| 5991 | MIOA8090 |
| 5992 | MIOA8092 |
| 5993 | mioa8094 |
| 5994 | MIOA8095 |
| 5995 | MIOA8096 |
| 5996 | MIOA8097 |
| 5997 | MIOA8099 |
| 5998 | MIOA8100 |
| 5999 | MIOA8101 |
| 6000 | MIOA8102 |

Figure 6D – List of EST Sequence Names From Mild OA Cartilage cDNA Library

| | | | | | | | | | |
|---|---|---|---|---|---|---|---|---|---|
| 6001 | MIOA8103 | 6061 | MIOA8176 | 6121 | MIOA8251 | 6181 | MIOA8334 | 6241 | MIOA8417 |
| 6002 | mioa8104 | 6062 | MIOA8177 | 6122 | MIOA8252 | 6182 | MIOA8335 | 6242 | MIOA8418 |
| 6003 | MIOA8105 | 6063 | mioa8179 | 6123 | MIOA8255 | 6183 | mioa8336 | 6243 | MIOA8421 |
| 6004 | MIOA8106 | 6064 | MIOA8181 | 6124 | MIOA8258 | 6184 | MIOA8337 | 6244 | MIOA8422 |
| 6005 | MIOA8107 | 6065 | MIOA8182 | 6125 | mioa8259 | 6185 | MIOA8338 | 6245 | MIOA8423 |
| 6006 | MIOA8108 | 6066 | MIOA8183 | 6126 | MIOA8261 | 6186 | MIOA8339 | 6246 | MIOA8428 |
| 6007 | MIOA8109 | 6067 | mioa8184 | 6127 | MIOA8262 | 6187 | MIOA8341 | 6247 | MIOA8429 |
| 6008 | MIOA8110 | 6068 | MIOA8185 | 6128 | MIOA8263 | 6188 | MIOA8343 | 6248 | MIOA8432 |
| 6009 | MIOA8111 | 6069 | MIOA8186 | 6129 | MIOA8264 | 6189 | mioa8345n | 6249 | MIOA8433 |
| 6010 | MIOA8112 | 6070 | MIOA8187 | 6130 | MIOA8266 | 6190 | MIOA8346 | 6250 | mioa8434 |
| 6011 | MIOA8113 | 6071 | MIOA8188 | 6131 | MIOA8267 | 6191 | MIOA8347 | 6251 | MIOA8435 |
| 6012 | MIOA8115 | 6072 | MIOA8191 | 6132 | MIOA8269 | 6192 | MIOA8348 | 6252 | MIOA8437 |
| 6013 | MIOA8116 | 6073 | MIOA8192 | 6133 | mioa8271 | 6193 | MIOA8349 | 6253 | MIOA8438 |
| 6014 | mioa8117 | 6074 | MIOA8193 | 6134 | MIOA8272 | 6194 | MIOA8350 | 6254 | MIOA8439 |
| 6015 | MIOA8118 | 6075 | MIOA8196 | 6135 | MIOA8273 | 6195 | MIOA8351 | 6255 | MIOA8440 |
| 6016 | MIOA8120 | 6076 | MIOA8198 | 6136 | MIOA8274 | 6196 | mioa8352n | 6256 | mioa8443n |
| 6017 | MIOA8121 | 6077 | mioa8199n | 6137 | MIOA8275 | 6197 | MIOA8353 | 6257 | MIOA8444 |
| 6018 | MIOA8122 | 6078 | MIOA8200 | 6138 | MIOA8276 | 6198 | MIOA8354 | 6258 | mioa8445n |
| 6019 | MIOA8123 | 6079 | MIOA8201 | 6139 | MIOA8282 | 6199 | MIOA8355 | 6259 | MIOA8446 |
| 6020 | MIOA8124 | 6080 | MIOA8202 | 6140 | MIOA8283 | 6200 | MIOA8356 | 6260 | MIOA8447 |
| 6021 | MIOA8125 | 6081 | mioa8203n | 6141 | MIOA8284 | 6201 | MIOA8359 | 6261 | MIOA8449 |
| 6022 | MIOA8126 | 6082 | MIOA8204 | 6142 | mioa8286 | 6202 | MIOA8360 | 6262 | MIOA8451 |
| 6023 | MIOA8127 | 6083 | MIOA8205 | 6143 | mioa8287n | 6203 | MIOA8361 | 6263 | MIOA8452 |
| 6024 | MIOA8128 | 6084 | MIOA8206 | 6144 | mioa8288 | 6204 | MIOA8363 | 6264 | MIOA8453 |
| 6025 | MIOA8129 | 6085 | MIOA8208 | 6145 | MIOA8289 | 6205 | mioa8364n | 6265 | MIOA8454 |
| 6026 | MIOA8130 | 6086 | MIOA8209 | 6146 | MIOA8290 | 6206 | MIOA8365 | 6266 | MIOA8455 |
| 6027 | MIOA8131 | 6087 | MIOA8210 | 6147 | MIOA8291 | 6207 | MIOA8366 | 6267 | MIOA8456 |
| 6028 | MIOA8134 | 6088 | MIOA8211 | 6148 | mioa8294n | 6208 | MIOA8367 | 6268 | MIOA8457 |
| 6029 | MIOA8135 | 6089 | MIOA8213 | 6149 | mioa8296n | 6209 | MIOA8368 | 6269 | MIOA8460 |
| 6030 | mioa8136 | 6090 | mioa8214 | 6150 | MIOA8297 | 6210 | mioa8369n | 6270 | mioa8461n |
| 6031 | MIOA8144 | 6091 | MIOA8215 | 6151 | mioa8298n | 6211 | MIOA8371 | 6271 | MIOA8462 |
| 6032 | MIOA8146 | 6092 | MIOA8216 | 6152 | MIOA8299 | 6212 | MIOA8374 | 6272 | MIOA8463 |
| 6033 | MIOA8147 | 6093 | MIOA8218 | 6153 | MIOA8300 | 6213 | MIOA8376 | 6273 | mioa8464 |
| 6034 | MIOA8148 | 6094 | MIOA8219 | 6154 | mioa8301n | 6214 | MIOA8377 | 6274 | MIOA8465 |
| 6035 | MIOA8149 | 6095 | MIOA8220 | 6155 | MIOA8302 | 6215 | MIOA8378 | 6275 | MIOA8466 |
| 6036 | MIOA8150 | 6096 | MIOA8221 | 6156 | MIOA8303 | 6216 | MIOA8380 | 6276 | mioa8467 |
| 6037 | MIOA8151 | 6097 | MIOA8222 | 6157 | MIOA8304 | 6217 | mioa8381 | 6277 | MIOA8468 |
| 6038 | MIOA8152 | 6098 | MIOA8223 | 6158 | MIOA8305 | 6218 | MIOA8383 | 6278 | MIOA8469 |
| 6039 | MIOA8153 | 6099 | MIOA8224 | 6159 | MIOA8307 | 6219 | mioa8384 | 6279 | mioa8470 |
| 6040 | MIOA8154 | 6100 | MIOA8225 | 6160 | MIOA8308 | 6220 | mioa8385 | 6280 | mioa8471n |
| 6041 | MIOA8155 | 6101 | mioa8226 | 6161 | MIOA8309 | 6221 | MIOA8386 | 6281 | MIOA8472 |
| 6042 | MIOA8156 | 6102 | MIOA8227 | 6162 | MIOA8310 | 6222 | MIOA8387 | 6282 | MIOA8473 |
| 6043 | MIOA8157 | 6103 | MIOA8228 | 6163 | MIOA8311 | 6223 | mioa8388 | 6283 | mioa8474 |
| 6044 | mioa8158 | 6104 | MIOA8229 | 6164 | MIOA8313 | 6224 | mioa8389 | 6284 | MIOA8476 |
| 6045 | MIOA8159 | 6105 | MIOA8230 | 6165 | MIOA8314 | 6225 | mioa8391 | 6285 | MIOA8477 |
| 6046 | MIOA8160 | 6106 | MIOA8232 | 6166 | MIOA8315 | 6226 | MIOA8392 | 6286 | MIOA8478 |
| 6047 | MIOA8161 | 6107 | MIOA8233 | 6167 | MIOA8316 | 6227 | mioa8393 | 6287 | mioa8481 |
| 6048 | MIOA8162 | 6108 | MIOA8235 | 6168 | MIOA8317 | 6228 | MIOA8394 | 6288 | MIOA8482 |
| 6049 | MIOA8163 | 6109 | MIOA8236 | 6169 | MIOA8318 | 6229 | MIOA8395 | 6289 | mioa8483 |
| 6050 | MIOA8164 | 6110 | MIOA8237 | 6170 | MIOA8320 | 6230 | MIOA8396 | 6290 | MIOA8484 |
| 6051 | MIOA8165 | 6111 | MIOA8238 | 6171 | mioa8323 | 6231 | mioa8397a | 6291 | MIOA8485 |
| 6052 | mioa8166 | 6112 | MIOA8239 | 6172 | mioa8324 | 6232 | MIOA8398 | 6292 | MIOA8486 |
| 6053 | MIOA8167 | 6113 | MIOA8241 | 6173 | mioa8326n | 6233 | MIOA8399 | 6293 | MIOA8487 |
| 6054 | mioa8168 | 6114 | MIOA8242 | 6174 | MIOA8327 | 6234 | mioa8403 | 6294 | MIOA8488 |
| 6055 | MIOA8169 | 6115 | mioa8243 | 6175 | MIOA8328 | 6235 | MIOA8404 | 6295 | MIOA8489 |
| 6056 | MIOA8170 | 6116 | MIOA8244 | 6176 | MIOA8329 | 6236 | MIOA8405 | 6296 | mioa8491n |
| 6057 | MIOA8171 | 6117 | MIOA8245 | 6177 | mioa8330n | 6237 | MIOA8407 | 6297 | MIOA8494 |
| 6058 | MIOA8173 | 6118 | MIOA8246 | 6178 | MIOA8331 | 6238 | MIOA8408 | 6298 | MIOA8495 |
| 6059 | mioa8174 | 6119 | MIOA8247 | 6179 | mioa8332 | 6239 | MIOA8409 | 6299 | MIOA8497 |
| 6060 | MIOA8175 | 6120 | MIOA8248 | 6180 | MIOA8333 | 6240 | MIOA8416 | 6300 | MIOA8498 |

Figure 6D – List of EST Sequence Names From Mild OA Cartilage cDNA Library

| | | | | | | | | | |
|---|---|---|---|---|---|---|---|---|---|
| 6301 | MIOA8499 | 6361 | MIOA8573 | 6421 | MIOA8651 | 6481 | MIOA8724 | 6541 | MIOA8795 |
| 6302 | MIOA8500 | 6362 | MIOA8574 | 6422 | MIOA8652 | 6482 | mioa8725 | 6542 | MIOA8796 |
| 6303 | MIOA8501 | 6363 | MIOA8576 | 6423 | MIOA8653 | 6483 | mioa8726 | 6543 | MIOA8797 |
| 6304 | MIOA8502 | 6364 | MIOA8577 | 6424 | MIOA8655 | 6484 | MIOA8727 | 6544 | MIOA8798 |
| 6305 | MIOA8503 | 6365 | MIOA8578 | 6425 | MIOA8656 | 6485 | MIOA8728 | 6545 | MIOA8799 |
| 6306 | mioa8506n | 6366 | MIOA8580 | 6426 | MIOA8657 | 6486 | MIOA8729 | 6546 | MIOA8800 |
| 6307 | MIOA8507 | 6367 | MIOA8581 | 6427 | MIOA8658 | 6487 | MIOA8730 | 6547 | mioa8802 |
| 6308 | mioa8508 | 6368 | MIOA8582 | 6428 | MIOA8660 | 6488 | MIOA8732 | 6548 | MIOA8803 |
| 6309 | MIOA8509 | 6369 | MIOA8583 | 6429 | mioa8661 | 6489 | MIOA8733 | 6549 | MIOA8804 |
| 6310 | MIOA8510 | 6370 | MIOA8584 | 6430 | mioa8662 | 6490 | MIOA8734 | 6550 | MIOA8805 |
| 6311 | MIOA8511 | 6371 | mioa8585 | 6431 | MIOA8663 | 6491 | MIOA8735 | 6551 | MIOA8806 |
| 6312 | MIOA8512 | 6372 | MIOA8586 | 6432 | MIOA8664 | 6492 | mioa8736n | 6552 | MIOA8808 |
| 6313 | mioa8513n | 6373 | MIOA8587 | 6433 | MIOA8665 | 6493 | mioa8737n | 6553 | MIOA8809 |
| 6314 | MIOA8515 | 6374 | MIOA8588 | 6434 | MIOA8666 | 6494 | MIOA8739 | 6554 | MIOA8810 |
| 6315 | mioa8516 | 6375 | MIOA8589 | 6435 | MIOA8667 | 6495 | MIOA8740 | 6555 | MIOA8811 |
| 6316 | MIOA8517 | 6376 | MIOA8590 | 6436 | MIOA8668 | 6496 | MIOA8741 | 6556 | MIOA8812 |
| 6317 | MIOA8518 | 6377 | MIOA8591 | 6437 | MIOA8669 | 6497 | MIOA8742 | 6557 | MIOA8813 |
| 6318 | MIOA8520 | 6378 | MIOA8592 | 6438 | MIOA8670 | 6498 | MIOA8743 | 6558 | mioa8816 |
| 6319 | MIOA8521 | 6379 | MIOA8594 | 6439 | MIOA8671 | 6499 | MIOA8744 | 6559 | MIOA8817 |
| 6320 | MIOA8522 | 6380 | MIOA8595 | 6440 | MIOA8672 | 6500 | mioa8745 | 6560 | MIOA8818 |
| 6321 | MIOA8523 | 6381 | MIOA8596 | 6441 | MIOA8674 | 6501 | MIOA8746 | 6561 | MIOA8820 |
| 6322 | MIOA8524 | 6382 | MIOA8597 | 6442 | MIOA8675 | 6502 | MIOA8747 | 6562 | mioa8821 |
| 6323 | MIOA8525 | 6383 | MIOA8598 | 6443 | MIOA8676 | 6503 | MIOA8748 | 6563 | MIOA8822 |
| 6324 | MIOA8526 | 6384 | MIOA8599 | 6444 | MIOA8677 | 6504 | MIOA8749 | 6564 | MIOA8823 |
| 6325 | MIOA8529 | 6385 | MIOA8600 | 6445 | MIOA8678 | 6505 | mioa8750 | 6565 | MIOA8824 |
| 6326 | MIOA8531 | 6386 | MIOA8601 | 6446 | MIOA8679 | 6506 | MIOA8751 | 6566 | MIOA8825 |
| 6327 | MIOA8532 | 6387 | MIOA8602 | 6447 | mioa8681 | 6507 | mioa8753 | 6567 | MIOA8826 |
| 6328 | MIOA8533 | 6388 | MIOA8603 | 6448 | MIOA8682 | 6508 | MIOA8754 | 6568 | MIOA8827 |
| 6329 | MIOA8535 | 6389 | MIOA8604 | 6449 | MIOA8683 | 6509 | MIOA8755 | 6569 | MIOA8828 |
| 6330 | MIOA8536 | 6390 | MIOA8606 | 6450 | mioa8684 | 6510 | MIOA8757 | 6570 | MIOA8830 |
| 6331 | MIOA8538 | 6391 | MIOA8607 | 6451 | MIOA8685 | 6511 | MIOA8758 | 6571 | MIOA8831 |
| 6332 | MIOA8539 | 6392 | MIOA8608 | 6452 | MIOA8686 | 6512 | MIOA8759 | 6572 | MIOA8832 |
| 6333 | MIOA8541 | 6393 | MIOA8611 | 6453 | MIOA8687 | 6513 | mioa8761 | 6573 | MIOA8833 |
| 6334 | MIOA8542 | 6394 | MIOA8613 | 6454 | MIOA8691 | 6514 | MIOA8762 | 6574 | MIOA8834 |
| 6335 | MIOA8543 | 6395 | MIOA8615 | 6455 | MIOA8692 | 6515 | MIOA8763 | 6575 | MIOA8835 |
| 6336 | mioa8544 | 6396 | MIOA8617 | 6456 | MIOA8693 | 6516 | MIOA8764 | 6576 | MIOA8836 |
| 6337 | MIOA8545 | 6397 | MIOA8618 | 6457 | MIOA8694 | 6517 | MIOA8767 | 6577 | MIOA8837 |
| 6338 | MIOA8546 | 6398 | MIOA8620 | 6458 | MIOA8695 | 6518 | MIOA8768 | 6578 | MIOA8839 |
| 6339 | MIOA8547 | 6399 | MIOA8621 | 6459 | MIOA8696 | 6519 | MIOA8769 | 6579 | MIOA8840 |
| 6340 | MIOA8548 | 6400 | MIOA8622 | 6460 | MIOA8697 | 6520 | MIOA8770 | 6580 | mioa8841 |
| 6341 | MIOA8549 | 6401 | MIOA8624 | 6461 | MIOA8700 | 6521 | MIOA8772 | 6581 | MIOA8842 |
| 6342 | MIOA8550 | 6402 | MIOA8625 | 6462 | MIOA8702 | 6522 | MIOA8773 | 6582 | mioa8843 |
| 6343 | MIOA8551 | 6403 | MIOA8627 | 6463 | MIOA8703 | 6523 | MIOA8774 | 6583 | MIOA8844 |
| 6344 | MIOA8552 | 6404 | MIOA8629 | 6464 | MIOA8704 | 6524 | MIOA8775 | 6584 | MIOA8845 |
| 6345 | MIOA8553 | 6405 | MIOA8630 | 6465 | MIOA8705 | 6525 | MIOA8776 | 6585 | mioa8846 |
| 6346 | MIOA8557 | 6406 | MIOA8631 | 6466 | mioa8707 | 6526 | mioa8777 | 6586 | mioa8848 |
| 6347 | MIOA8558 | 6407 | MIOA8632 | 6467 | MIOA8708 | 6527 | MIOA8778 | 6587 | mioa8849 |
| 6348 | MIOA8559 | 6408 | MIOA8634 | 6468 | MIOA8710 | 6528 | MIOA8779 | 6588 | MIOA8850 |
| 6349 | MIOA8560 | 6409 | MIOA8635 | 6469 | MIOA8711 | 6529 | MIOA8780 | 6589 | MIOA8851 |
| 6350 | MIOA8561 | 6410 | MIOA8637 | 6470 | MIOA8712 | 6530 | MIOA8781 | 6590 | MIOA8852 |
| 6351 | MIOA8563 | 6411 | MIOA8638 | 6471 | MIOA8713 | 6531 | MIOA8782 | 6591 | MIOA8853 |
| 6352 | MIOA8564 | 6412 | MIOA8639 | 6472 | MIOA8714 | 6532 | MIOA8783 | 6592 | MIOA8854 |
| 6353 | MIOA8565 | 6413 | MIOA8641 | 6473 | MIOA8715 | 6533 | MIOA8785 | 6593 | MIOA8855 |
| 6354 | MIOA8566 | 6414 | MIOA8644 | 6474 | MIOA8716 | 6534 | MIOA8786 | 6594 | MIOA8856 |
| 6355 | mioa8567 | 6415 | MIOA8645 | 6475 | MIOA8717 | 6535 | MIOA8787 | 6595 | MIOA8857 |
| 6356 | MIOA8568 | 6416 | MIOA8646 | 6476 | MIOA8718 | 6536 | MIOA8788 | 6596 | MIOA8858 |
| 6357 | MIOA8569 | 6417 | MIOA8647 | 6477 | MIOA8719 | 6537 | MIOA8789 | 6597 | MIOA8859 |
| 6358 | mioa8570 | 6418 | MIOA8648 | 6478 | MIOA8720 | 6538 | MIOA8790 | 6598 | MIOA8860 |
| 6359 | MIOA8571 | 6419 | MIOA8649 | 6479 | MIOA8721 | 6539 | MIOA8793 | 6599 | MIOA8861 |
| 6360 | MIOA8572 | 6420 | MIOA8650 | 6480 | MIOA8723 | 6540 | MIOA8794 | 6600 | MIOA8862 |

Figure 6D – List of EST Sequence Names From Mild OA Cartilage cDNA Library

| | | | | | | | | | |
|---|---|---|---|---|---|---|---|---|---|
| 6601 | MIOA8863 | 6661 | MIOA8939 | 6721 | MIOA9009 | 6781 | MIOA9075 | 6841 | MIOA9144 |
| 6602 | MIOA8864 | 6662 | MIOA8940 | 6722 | MIOA9010 | 6782 | MIOA9076 | 6842 | MIOA9145 |
| 6603 | MIOA8865 | 6663 | MIOA8941 | 6723 | MIOA9011 | 6783 | MIOA9078 | 6843 | MIOA9146 |
| 6604 | MIOA8866 | 6664 | MIOA8942 | 6724 | MIOA9012 | 6784 | MIOA9079 | 6844 | MIOA9147 |
| 6605 | MIOA8869 | 6665 | MIOA8943 | 6725 | MIOA9013 | 6785 | MIOA9080 | 6845 | MIOA9148 |
| 6606 | MIOA8870 | 6666 | MIOA8945 | 6726 | MIOA9014 | 6786 | MIOA9081 | 6846 | MIOA9150 |
| 6607 | MIOA8872 | 6667 | MIOA8946 | 6727 | MIOA9015 | 6787 | MIOA9083 | 6847 | MIOA9151 |
| 6608 | MIOA8873 | 6668 | MIOA8947 | 6728 | MIOA9016 | 6788 | MIOA9084 | 6848 | MIOA9154 |
| 6609 | MIOA8874 | 6669 | MIOA8948 | 6729 | MIOA9017 | 6789 | MIOA9086 | 6849 | MIOA9157 |
| 6610 | MIOA8875 | 6670 | MIOA8949 | 6730 | MIOA9018 | 6790 | MIOA9087 | 6850 | MIOA9158 |
| 6611 | MIOA8876 | 6671 | MIOA8950 | 6731 | MIOA9019 | 6791 | MIOA9089 | 6851 | MIOA9159 |
| 6612 | MIOA8877 | 6672 | MIOA8951 | 6732 | MIOA9020 | 6792 | MIOA9090 | 6852 | MIOA9160 |
| 6613 | MIOA8878 | 6673 | MIOA8952 | 6733 | MIOA9021 | 6793 | MIOA9091 | 6853 | MIOA9161 |
| 6614 | mioa8879 | 6674 | MIOA8953 | 6734 | MIOA9022 | 6794 | MIOA9092 | 6854 | MIOA9162 |
| 6615 | MIOA8880 | 6675 | MIOA8954 | 6735 | mioa9023 | 6795 | MIOA9093 | 6855 | MIOA9163 |
| 6616 | MIOA8881 | 6676 | MIOA8955 | 6736 | MIOA9024 | 6796 | MIOA9095 | 6856 | MIOA9164 |
| 6617 | MIOA8882 | 6677 | mioa8956 | 6737 | MIOA9025 | 6797 | MIOA9096 | 6857 | MIOA9165 |
| 6618 | MIOA8885 | 6678 | MIOA8957 | 6738 | MIOA9026 | 6798 | MIOA9097 | 6858 | MIOA9166 |
| 6619 | MIOA8886 | 6679 | MIOA8958 | 6739 | MIOA9027 | 6799 | MIOA9098 | 6859 | MIOA9167 |
| 6620 | MIOA8887 | 6680 | MIOA8959 | 6740 | MIOA9028 | 6800 | MIOA9099 | 6860 | MIOA9168 |
| 6621 | MIOA8888 | 6681 | MIOA8960 | 6741 | MIOA9029 | 6801 | MIOA9100 | 6861 | MIOA9169 |
| 6622 | MIOA8889 | 6682 | MIOA8962 | 6742 | MIOA9030 | 6802 | MIOA9102 | 6862 | MIOA9170 |
| 6623 | MIOA8890 | 6683 | MIOA8963 | 6743 | MIOA9031 | 6803 | MIOA9103 | 6863 | MIOA9171 |
| 6624 | MIOA8891 | 6684 | MIOA8965 | 6744 | MIOA9032 | 6804 | MIOA9104 | 6864 | MIOA9172 |
| 6625 | MIOA8893 | 6685 | MIOA8966 | 6745 | MIOA9033 | 6805 | MIOA9106 | 6865 | MIOA9173 |
| 6626 | MIOA8894 | 6686 | MIOA8967 | 6746 | MIOA9034 | 6806 | MIOA9107 | 6866 | MIOA9174 |
| 6627 | MIOA8895 | 6687 | MIOA8968 | 6747 | MIOA9035 | 6807 | MIOA9108 | 6867 | MIOA9175 |
| 6628 | MIOA8897 | 6688 | MIOA8969 | 6748 | MIOA9036 | 6808 | MIOA9109 | 6868 | MIOA9177 |
| 6629 | MIOA8898 | 6689 | MIOA8970 | 6749 | MIOA9037 | 6809 | MIOA9110 | 6869 | MIOA9178 |
| 6630 | MIOA8899 | 6690 | MIOA8971 | 6750 | MIOA9039 | 6810 | MIOA9111 | 6870 | MIOA9179 |
| 6631 | MIOA8900 | 6691 | mioa8972 | 6751 | MIOA9040 | 6811 | MIOA9112 | 6871 | MIOA9180 |
| 6632 | MIOA8901 | 6692 | MIOA8973 | 6752 | MIOA9041 | 6812 | MIOA9113 | 6872 | MIOA9181 |
| 6633 | MIOA8902 | 6693 | MIOA8974 | 6753 | MIOA9042 | 6813 | MIOA9114 | 6873 | MIOA9184 |
| 6634 | MIOA8904 | 6694 | MIOA8975 | 6754 | MIOA9044 | 6814 | MIOA9115 | 6874 | mioa9185 |
| 6635 | MIOA8905 | 6695 | MIOA8976 | 6755 | MIOA9045 | 6815 | MIOA9116 | 6875 | mioa9187 |
| 6636 | MIOA8907 | 6696 | MIOA8977 | 6756 | MIOA9046 | 6816 | MIOA9117 | 6876 | mioa9188 |
| 6637 | MIOA8908 | 6697 | MIOA8978 | 6757 | MIOA9048 | 6817 | MIOA9118 | 6877 | mioa9189 |
| 6638 | MIOA8910 | 6698 | MIOA8979 | 6758 | MIOA9049 | 6818 | MIOA9119 | 6878 | mioa9190 |
| 6639 | MIOA8911 | 6699 | MIOA8984 | 6759 | MIOA9050 | 6819 | MIOA9120 | 6879 | mioa9191 |
| 6640 | MIOA8912 | 6700 | MIOA8985 | 6760 | MIOA9051 | 6820 | MIOA9121 | 6880 | mioa9193 |
| 6641 | MIOA8913 | 6701 | MIOA8986 | 6761 | MIOA9052 | 6821 | MIOA9122 | 6881 | mioa9194 |
| 6642 | MIOA8914 | 6702 | MIOA8987 | 6762 | MIOA9053 | 6822 | MIOA9124 | 6882 | mioa9195 |
| 6643 | mioa8915n | 6703 | MIOA8988 | 6763 | MIOA9054 | 6823 | MIOA9125 | 6883 | mioa9196 |
| 6644 | MIOA8916 | 6704 | MIOA8990 | 6764 | MIOA9055 | 6824 | MIOA9126 | 6884 | mioa9197 |
| 6645 | MIOA8917 | 6705 | MIOA8991 | 6765 | MIOA9056 | 6825 | MIOA9127 | 6885 | mioa9198 |
| 6646 | MIOA8918 | 6706 | MIOA8992 | 6766 | MIOA9057 | 6826 | MIOA9129 | 6886 | mioa9199 |
| 6647 | MIOA8919 | 6707 | MIOA8993 | 6767 | mioa9058 | 6827 | MIOA9130 | 6887 | mioa9200 |
| 6648 | MIOA8920 | 6708 | MIOA8995 | 6768 | MIOA9060 | 6828 | MIOA9131 | 6888 | mioa9202 |
| 6649 | MIOA8921 | 6709 | MIOA8996 | 6769 | MIOA9061 | 6829 | MIOA9132 | 6889 | mioa9203 |
| 6650 | MIOA8922 | 6710 | MIOA8997 | 6770 | MIOA9062 | 6830 | MIOA9133 | 6890 | mioa9204 |
| 6651 | MIOA8925 | 6711 | MIOA8998 | 6771 | MIOA9063 | 6831 | MIOA9134 | 6891 | mioa9205 |
| 6652 | MIOA8928 | 6712 | MIOA8999 | 6772 | MIOA9064 | 6832 | MIOA9135 | 6892 | mioa9206 |
| 6653 | MIOA8929 | 6713 | MIOA9000 | 6773 | MIOA9065 | 6833 | MIOA9136 | 6893 | mioa9207 |
| 6654 | MIOA8930 | 6714 | MIOA9001 | 6774 | MIOA9066 | 6834 | MIOA9137 | 6894 | mioa9208 |
| 6655 | MIOA8931 | 6715 | MIOA9002 | 6775 | MIOA9067 | 6835 | MIOA9138 | 6895 | mioa9209 |
| 6656 | MIOA8932 | 6716 | MIOA9004 | 6776 | MIOA9068 | 6836 | MIOA9139 | 6896 | mioa9210 |
| 6657 | MIOA8933 | 6717 | MIOA9005 | 6777 | MIOA9070 | 6837 | MIOA9140 | 6897 | mioa9212 |
| 6658 | MIOA8936 | 6718 | MIOA9006 | 6778 | MIOA9071 | 6838 | MIOA9141 | 6898 | mioa9213 |
| 6659 | MIOA8937 | 6719 | MIOA9007 | 6779 | mioa9072n | 6839 | MIOA9142 | 6899 | mioa9214 |
| 6660 | MIOA8938 | 6720 | MIOA9008 | 6780 | MIOA9074 | 6840 | MIOA9143 | 6900 | mioa9215 |

Figure 6D – List of EST Sequence Names From Mild OA Cartilage cDNA Library

| | | | | | | | | | |
|---|---|---|---|---|---|---|---|---|---|
| 6901 | mioa9216 | 6961 | mioa9306 | 7021 | mioa9372 | 7081 | mioa9464 | 7141 | mioa9539 |
| 6902 | mioa9223 | 6962 | mioa9308 | 7022 | mioa9373 | 7082 | mioa9465 | 7142 | mioa9540 |
| 6903 | mioa9224n | 6963 | mioa9309 | 7023 | mioa9374 | 7083 | mioa9466 | 7143 | mioa9541 |
| 6904 | mioa9225 | 6964 | mioa9311 | 7024 | mioa9375 | 7084 | mioa9467 | 7144 | mioa9542 |
| 6905 | mioa9226 | 6965 | mioa9312 | 7025 | mioa9376 | 7085 | mioa9469 | 7145 | mioa9543 |
| 6906 | mioa9227 | 6966 | mioa9313 | 7026 | mioa9380 | 7086 | mioa9470 | 7146 | mioa9545 |
| 6907 | mioa9228 | 6967 | mioa9314 | 7027 | mioa9381 | 7087 | mioa9472 | 7147 | mioa9546 |
| 6908 | mioa9230 | 6968 | mioa9315 | 7028 | mioa9383 | 7088 | mioa9473 | 7148 | mioa9547 |
| 6909 | mioa9231 | 6969 | mioa9316 | 7029 | mioa9386 | 7089 | mioa9474 | 7149 | mioa9548 |
| 6910 | mioa9232 | 6970 | mioa9317 | 7030 | mioa9388 | 7090 | mioa9476 | 7150 | mioa9549 |
| 6911 | mioa9234 | 6971 | mioa9318 | 7031 | mioa9389 | 7091 | mioa9477n | 7151 | mioa9550 |
| 6912 | mioa9235 | 6972 | mioa9319 | 7032 | mioa9391n | 7092 | mioa9478 | 7152 | mioa9551 |
| 6913 | mioa9236 | 6973 | mioa9320 | 7033 | mioa9395 | 7093 | mioa9479 | 7153 | mioa9553 |
| 6914 | mioa9237 | 6974 | mioa9321 | 7034 | mioa9396 | 7094 | mioa9483 | 7154 | mioa9554 |
| 6915 | mioa9238 | 6975 | mioa9322 | 7035 | mioa9398 | 7095 | mioa9484 | 7155 | mioa9555 |
| 6916 | mioa9240 | 6976 | mioa9323 | 7036 | mioa9401 | 7096 | mioa9486 | 7156 | mioa9556 |
| 6917 | mioa9241 | 6977 | mioa9324 | 7037 | mioa9402 | 7097 | mioa9487 | 7157 | mioa9557 |
| 6918 | mioa9242 | 6978 | mioa9325 | 7038 | mioa9403 | 7098 | mioa9489 | 7158 | mioa9558 |
| 6919 | mioa9243 | 6979 | mioa9326 | 7039 | mioa9404 | 7099 | mioa9490 | 7159 | mioa9559 |
| 6920 | mioa9244 | 6980 | mioa9327 | 7040 | mioa9405 | 7100 | mioa9491 | 7160 | mioa9562 |
| 6921 | mioa9245 | 6981 | mioa9328 | 7041 | mioa9406 | 7101 | mioa9492 | 7161 | mioa9563 |
| 6922 | mioa9246 | 6982 | mioa9329 | 7042 | mioa9407 | 7102 | mioa9493 | 7162 | mioa9564 |
| 6923 | mioa9249 | 6983 | mioa9330 | 7043 | mioa9408 | 7103 | mioa9494 | 7163 | mioa9565 |
| 6924 | mioa9250 | 6984 | mioa9331 | 7044 | mioa9412 | 7104 | mioa9495 | 7164 | mioa9567 |
| 6925 | mioa9251 | 6985 | mioa9333 | 7045 | mioa9413 | 7105 | mioa9497 | 7165 | mioa9570 |
| 6926 | mioa9252 | 6986 | mioa9334 | 7046 | mioa9414 | 7106 | mioa9498 | 7166 | mioa9571 |
| 6927 | mioa9254 | 6987 | mioa9335 | 7047 | mioa9415 | 7107 | mioa9499n | 7167 | mioa9572 |
| 6928 | mioa9255 | 6988 | mioa9336 | 7048 | mioa9416 | 7108 | mioa9500 | 7168 | mioa9574 |
| 6929 | mioa9256 | 6989 | mioa9337 | 7049 | mioa9417 | 7109 | mioa9501 | 7169 | mioa9575 |
| 6930 | mioa9258 | 6990 | mioa9338 | 7050 | mioa9418 | 7110 | mioa9502 | 7170 | mioa9576 |
| 6931 | mioa9259 | 6991 | mioa9339 | 7051 | mioa9419 | 7111 | mioa9503 | 7171 | mioa9577 |
| 6932 | mioa9260 | 6992 | mioa9340 | 7052 | mioa9420 | 7112 | mioa9505 | 7172 | mioa9578 |
| 6933 | mioa9261 | 6993 | mioa9341 | 7053 | mioa9421 | 7113 | mioa9506 | 7173 | mioa9579 |
| 6934 | mioa9262 | 6994 | mioa9342 | 7054 | mioa9422 | 7114 | mioa9507 | 7174 | mioa9580 |
| 6935 | mioa9263 | 6995 | mioa9343 | 7055 | mioa9423 | 7115 | mioa9508 | 7175 | mioa9581 |
| 6936 | mioa9266 | 6996 | mioa9346 | 7056 | mioa9425 | 7116 | mioa9509 | 7176 | mioa9582 |
| 6937 | mioa9267 | 6997 | mioa9347 | 7057 | mioa9426 | 7117 | mioa9510 | 7177 | mioa9583 |
| 6938 | mioa9269 | 6998 | mioa9349 | 7058 | mioa9429 | 7118 | mioa9511 | 7178 | mioa9584 |
| 6939 | mioa9272 | 6999 | mioa9350 | 7059 | mioa9430 | 7119 | mioa9512n | 7179 | mioa9586 |
| 6940 | mioa9273 | 7000 | mioa9351 | 7060 | mioa9431 | 7120 | mioa9513 | 7180 | mioa9587 |
| 6941 | mioa9274 | 7001 | mioa9352 | 7061 | mioa9432 | 7121 | mioa9515 | 7181 | mioa9588 |
| 6942 | mioa9276 | 7002 | mioa9353 | 7062 | mioa9434 | 7122 | mioa9516 | 7182 | mioa9590 |
| 6943 | mioa9277 | 7003 | mioa9354 | 7063 | mioa9436 | 7123 | mioa9517n | 7183 | mioa9591 |
| 6944 | mioa9278 | 7004 | mioa9355 | 7064 | mioa9438 | 7124 | mioa9518 | 7184 | mioa9592 |
| 6945 | mioa9279 | 7005 | mioa9356 | 7065 | mioa9439 | 7125 | mioa9519 | 7185 | mioa9594 |
| 6946 | mioa9280 | 7006 | mioa9357 | 7066 | mioa9441 | 7126 | mioa9521 | 7186 | mioa9597 |
| 6947 | mioa9287 | 7007 | mioa9358 | 7067 | mioa9442 | 7127 | mioa9522 | 7187 | mioa9599 |
| 6948 | mioa9288 | 7008 | mioa9359 | 7068 | mioa9443 | 7128 | mioa9523 | 7188 | mioa9600 |
| 6949 | mioa9289 | 7009 | mioa9360 | 7069 | mioa9445 | 7129 | mioa9524 | 7189 | mioa9601 |
| 6950 | mioa9291 | 7010 | mioa9361 | 7070 | mioa9446 | 7130 | mioa9525 | 7190 | mioa9604 |
| 6951 | mioa9292 | 7011 | mioa9362 | 7071 | mioa9447 | 7131 | mioa9526 | 7191 | mioa9607 |
| 6952 | mioa9294 | 7012 | mioa9363 | 7072 | mioa9448 | 7132 | mioa9527 | 7192 | mioa9608 |
| 6953 | mioa9295 | 7013 | mioa9364 | 7073 | mioa9452 | 7133 | mioa9529 | 7193 | mioa9610 |
| 6954 | mioa9296 | 7014 | mioa9365 | 7074 | mioa9453 | 7134 | mioa9530 | 7194 | mioa9611 |
| 6955 | mioa9297 | 7015 | mioa9366 | 7075 | mioa9454 | 7135 | mioa9531 | 7195 | mioa9612 |
| 6956 | mioa9298n | 7016 | mioa9367 | 7076 | mioa9456 | 7136 | mioa9532 | 7196 | mioa9614 |
| 6957 | mioa9299 | 7017 | mioa9368 | 7077 | mioa9459 | 7137 | mioa9533 | 7197 | mioa9615 |
| 6958 | mioa9300 | 7018 | mioa9369 | 7078 | mioa9460 | 7138 | mioa9534 | 7198 | mioa9616 |
| 6959 | mioa9302 | 7019 | mioa9370 | 7079 | mioa9462 | 7139 | mioa9535 | 7199 | mioa9617n |
| 6960 | mioa9304 | 7020 | mioa9371 | 7080 | mioa9463 | 7140 | mioa9537 | 7200 | mioa9618 |

Figure 6D – List of EST Sequence Names From Mild OA Cartilage cDNA Library

| | | | | | | | | | |
|---|---|---|---|---|---|---|---|---|---|
| 7201 | mioa9619 | 7261 | mioa9694 | 7321 | mioa9775 | 7381 | mioa9847 | 7441 | mioa9920 |
| 7202 | mioa9620 | 7262 | mioa9695 | 7322 | mioa9776 | 7382 | mioa9849 | 7442 | mioa9921 |
| 7203 | mioa9621 | 7263 | mioa9696 | 7323 | mioa9777 | 7383 | mioa9850 | 7443 | mioa9924 |
| 7204 | mioa9622 | 7264 | mioa9697 | 7324 | mioa9778 | 7384 | mioa9852 | 7444 | mioa9925 |
| 7205 | mioa9623 | 7265 | mioa9699 | 7325 | mioa9780 | 7385 | mioa9853 | 7445 | mioa9926 |
| 7206 | mioa9624 | 7266 | mioa9700 | 7326 | mioa9781 | 7386 | mioa9854 | 7446 | mioa9927 |
| 7207 | mioa9625 | 7267 | mioa9701 | 7327 | mioa9783 | 7387 | mioa9855 | 7447 | mioa9929 |
| 7208 | mioa9626 | 7268 | mioa9704 | 7328 | mioa9784 | 7388 | mioa9856 | 7448 | mioa9930 |
| 7209 | mioa9627 | 7269 | mioa9705 | 7329 | mioa9785 | 7389 | mioa9857 | 7449 | mioa9931 |
| 7210 | mioa9628 | 7270 | mioa9706 | 7330 | mioa9786 | 7390 | mioa9858 | 7450 | mioa9932 |
| 7211 | mioa9629 | 7271 | mioa9707 | 7331 | mioa9787 | 7391 | mioa9859 | 7451 | mioa9933 |
| 7212 | mioa9630 | 7272 | mioa9709 | 7332 | mioa9788 | 7392 | mioa9860 | 7452 | mioa9934 |
| 7213 | mioa9632 | 7273 | mioa9710 | 7333 | mioa9789 | 7393 | mioa9861 | 7453 | mioa9935 |
| 7214 | mioa9633 | 7274 | mioa9711 | 7334 | mioa9790 | 7394 | mioa9864 | 7454 | mioa9936 |
| 7215 | mioa9634 | 7275 | mioa9712 | 7335 | mioa9791 | 7395 | mioa9865 | 7455 | mioa9937 |
| 7216 | mioa9636 | 7276 | mioa9714 | 7336 | mioa9792 | 7396 | mioa9868 | 7456 | mioa9938 |
| 7217 | mioa9640 | 7277 | mioa9715 | 7337 | mioa9793 | 7397 | mioa9869 | 7457 | mioa9939 |
| 7218 | mioa9641 | 7278 | mioa9716 | 7338 | mioa9794 | 7398 | mioa9870 | 7458 | mioa9940 |
| 7219 | mioa9643 | 7279 | mioa9717 | 7339 | mioa9795 | 7399 | mioa9871 | 7459 | mioa9941 |
| 7220 | mioa9645 | 7280 | mioa9718 | 7340 | mioa9796 | 7400 | mioa9872 | 7460 | mioa9942 |
| 7221 | mioa9646 | 7281 | mioa9719 | 7341 | mioa9797 | 7401 | mioa9873 | 7461 | mioa9943 |
| 7222 | mioa9647 | 7282 | mioa9721 | 7342 | mioa9798 | 7402 | mioa9874 | 7462 | mioa9945 |
| 7223 | mioa9648 | 7283 | mioa9722 | 7343 | mioa9799 | 7403 | mioa9875 | 7463 | mioa9946 |
| 7224 | mioa9649 | 7284 | mioa9725 | 7344 | mioa9801 | 7404 | mioa9876 | 7464 | mioa9948 |
| 7225 | mioa9650 | 7285 | mioa9726 | 7345 | mioa9802 | 7405 | mioa9877 | 7465 | mioa9949 |
| 7226 | mioa9651 | 7286 | mioa9728 | 7346 | mioa9803 | 7406 | mioa9878 | 7466 | mioa9950 |
| 7227 | mioa9653 | 7287 | mioa9729 | 7347 | mioa9804 | 7407 | mioa9880 | 7467 | mioa9951 |
| 7228 | mioa9654 | 7288 | mioa9730 | 7348 | mioa9805 | 7408 | mioa9882 | 7468 | mioa9952 |
| 7229 | mioa9655 | 7289 | mioa9731 | 7349 | mioa9806 | 7409 | mioa9883 | 7469 | mioa9953 |
| 7230 | mioa9657 | 7290 | mioa9732 | 7350 | mioa9807 | 7410 | mioa9884 | 7470 | mioa9954 |
| 7231 | mioa9658 | 7291 | mioa9734 | 7351 | mioa9808 | 7411 | mioa9885 | 7471 | mioa9955 |
| 7232 | mioa9659n | 7292 | mioa9735 | 7352 | mioa9809 | 7412 | mioa9886 | 7472 | mioa9958 |
| 7233 | mioa9661 | 7293 | mioa9737 | 7353 | mioa9810 | 7413 | mioa9887 | 7473 | mioa9960 |
| 7234 | mioa9662 | 7294 | mioa9738 | 7354 | mioa9811 | 7414 | mioa9888 | 7474 | mioa9961 |
| 7235 | mioa9663 | 7295 | mioa9739 | 7355 | mioa9812 | 7415 | mioa9889 | 7475 | mioa9962 |
| 7236 | mioa9664 | 7296 | mioa9740 | 7356 | mioa9813 | 7416 | mioa9890 | 7476 | mioa9963 |
| 7237 | mioa9665 | 7297 | mioa9741 | 7357 | mioa9814 | 7417 | mioa9891 | 7477 | mioa9964 |
| 7238 | mioa9666 | 7298 | mioa9742 | 7358 | mioa9816 | 7418 | mioa9892 | 7478 | mioa9966 |
| 7239 | mioa9667 | 7299 | mioa9743 | 7359 | mioa9817 | 7419 | mioa9893 | 7479 | mioa9967 |
| 7240 | mioa9668 | 7300 | mioa9745 | 7360 | mioa9818 | 7420 | mioa9894 | 7480 | mioa9968 |
| 7241 | mioa9669 | 7301 | mioa9747 | 7361 | mioa9820 | 7421 | mioa9895 | 7481 | mioa9969 |
| 7242 | mioa9670 | 7302 | mioa9748 | 7362 | mioa9821 | 7422 | mioa9896 | 7482 | mioa9971 |
| 7243 | mioa9672 | 7303 | mioa9749 | 7363 | mioa9822 | 7423 | mioa9897 | 7483 | mioa9972 |
| 7244 | mioa9674 | 7304 | mioa9750 | 7364 | mioa9823 | 7424 | mioa9899 | 7484 | mioa9974n |
| 7245 | mioa9675 | 7305 | mioa9751 | 7365 | mioa9824 | 7425 | mioa9900 | 7485 | mioa9975n |
| 7246 | mioa9676 | 7306 | mioa9754 | 7366 | mioa9825 | 7426 | mioa9901 | 7486 | mioa9976 |
| 7247 | mioa9677 | 7307 | mioa9755 | 7367 | mioa9827 | 7427 | mioa9902 | 7487 | mioa9977 |
| 7248 | mioa9679 | 7308 | mioa9756 | 7368 | mioa9828 | 7428 | mioa9903 | 7488 | mioa9978 |
| 7249 | mioa9680 | 7309 | mioa9757 | 7369 | mioa9829 | 7429 | mioa9905 | 7489 | mioa9979 |
| 7250 | mioa9681 | 7310 | mioa9758 | 7370 | mioa9831 | 7430 | mioa9906 | 7490 | mioa9980 |
| 7251 | mioa9682 | 7311 | mioa9760 | 7371 | mioa9832 | 7431 | mioa9907 | 7491 | mioa9981 |
| 7252 | mioa9683 | 7312 | mioa9761 | 7372 | mioa9836 | 7432 | mioa9908 | 7492 | mioa9982 |
| 7253 | mioa9684 | 7313 | mioa9762 | 7373 | mioa9838 | 7433 | mioa9909 | 7493 | mioa9983 |
| 7254 | mioa9685 | 7314 | mioa9765 | 7374 | mioa9839 | 7434 | mioa9910 | 7494 | mioa9984 |
| 7255 | mioa9686 | 7315 | mioa9766 | 7375 | mioa9840 | 7435 | mioa9911 | 7495 | mioa9985 |
| 7256 | mioa9687 | 7316 | mioa9767 | 7376 | mioa9841 | 7436 | mioa9913 | 7496 | mioa9986n |
| 7257 | mioa9688 | 7317 | mioa9768 | 7377 | mioa9842 | 7437 | mioa9914 | 7497 | mioa9987 |
| 7258 | mioa9690 | 7318 | mioa9771 | 7378 | mioa9843 | 7438 | mioa9916 | 7498 | mioa9988 |
| 7259 | mioa9692n | 7319 | mioa9772 | 7379 | mioa9844 | 7439 | mioa9918 | 7499 | mioa9989 |
| 7260 | mioa9693 | 7320 | mioa9773 | 7380 | mioa9845 | 7440 | mioa9919 | 7500 | mioa9990 |

Figure 6D – List of EST Sequence Names From Mild OA Cartilage cDNA Library

| | | | | | | | | | |
|---|---|---|---|---|---|---|---|---|---|
| 7501 | mioa9991n | 7561 | miob0091 | 7621 | miob0185 | 7681 | miob0269 | 7741 | miob0362 |
| 7502 | mioa9992 | 7562 | miob0093 | 7622 | miob0186 | 7682 | miob0270 | 7742 | miob0363 |
| 7503 | mioa9993n | 7563 | miob0100 | 7623 | miob0187 | 7683 | miob0271 | 7743 | miob0364 |
| 7504 | mioa9994 | 7564 | miob0102n | 7624 | miob0188 | 7684 | miob0272n | 7744 | miob0365 |
| 7505 | mioa9995 | 7565 | miob0106 | 7625 | miob0189 | 7685 | miob0273 | 7745 | miob0366 |
| 7506 | mioa9996 | 7566 | miob0107 | 7626 | miob0191 | 7686 | miob0275 | 7746 | miob0367 |
| 7507 | mioa9997 | 7567 | miob0108 | 7627 | miob0193 | 7687 | miob0276 | 7747 | miob0368 |
| 7508 | mioa9998 | 7568 | miob0109 | 7628 | miob0194 | 7688 | miob0277 | 7748 | miob0369 |
| 7509 | miob0001 | 7569 | miob0110n | 7629 | miob0195 | 7689 | miob0278 | 7749 | miob0370 |
| 7510 | miob0002 | 7570 | miob0111 | 7630 | miob0196 | 7690 | miob0279 | 7750 | miob0371 |
| 7511 | miob0004n | 7571 | miob0112 | 7631 | miob0197 | 7691 | miob0280n | 7751 | miob0372n |
| 7512 | miob0005 | 7572 | miob0113 | 7632 | miob0198 | 7692 | miob0281 | 7752 | miob0373 |
| 7513 | miob0008 | 7573 | miob0114n | 7633 | miob0199 | 7693 | miob0287 | 7753 | miob0375 |
| 7514 | miob0009 | 7574 | miob0115 | 7634 | miob0201 | 7694 | miob0288 | 7754 | miob0376 |
| 7515 | miob0010 | 7575 | miob0117 | 7635 | miob0202 | 7695 | miob0293 | 7755 | miob0377 |
| 7516 | miob0014n | 7576 | miob0119 | 7636 | miob0204 | 7696 | miob0298 | 7756 | miob0378 |
| 7517 | miob0016 | 7577 | miob0120 | 7637 | miob0206 | 7697 | miob0299 | 7757 | miob0379 |
| 7518 | miob0018 | 7578 | miob0126 | 7638 | miob0207 | 7698 | miob0300 | 7758 | miob0380 |
| 7519 | miob0019n | 7579 | miob0129 | 7639 | miob0208 | 7699 | miob0301 | 7759 | miob0381n |
| 7520 | miob0022 | 7580 | miob0130n | 7640 | miob0209 | 7700 | miob0304 | 7760 | miob0382 |
| 7521 | miob0023 | 7581 | miob0132 | 7641 | miob0210 | 7701 | miob0305 | 7761 | miob0384 |
| 7522 | miob0024 | 7582 | miob0135 | 7642 | miob0212 | 7702 | miob0307 | 7762 | miob0385 |
| 7523 | miob0025 | 7583 | miob0137 | 7643 | miob0213 | 7703 | miob0308 | 7763 | miob0387n |
| 7524 | miob0031n | 7584 | miob0139 | 7644 | miob0214 | 7704 | miob0310 | 7764 | miob0390 |
| 7525 | miob0036 | 7585 | miob0140 | 7645 | miob0215 | 7705 | miob0311 | 7765 | miob0392 |
| 7526 | miob0038 | 7586 | miob0141 | 7646 | miob0218 | 7706 | miob0313 | 7766 | miob0393 |
| 7527 | miob0039 | 7587 | miob0143 | 7647 | miob0219 | 7707 | miob0316 | 7767 | miob0395 |
| 7528 | miob0042 | 7588 | miob0144 | 7648 | miob0220 | 7708 | miob0318 | 7768 | miob0399 |
| 7529 | miob0043 | 7589 | miob0147 | 7649 | miob0222 | 7709 | miob0319 | 7769 | miob0400 |
| 7530 | miob0044 | 7590 | miob0149 | 7650 | miob0225 | 7710 | miob0320 | 7770 | miob0403 |
| 7531 | miob0045 | 7591 | miob0150 | 7651 | miob0229 | 7711 | miob0321 | 7771 | miob0404 |
| 7532 | miob0046 | 7592 | miob0151 | 7652 | miob0230 | 7712 | miob0323 | 7772 | miob0405 |
| 7533 | miob0047 | 7593 | miob0153 | 7653 | miob0231 | 7713 | miob0324 | 7773 | miob0406 |
| 7534 | miob0048 | 7594 | miob0154 | 7654 | miob0232 | 7714 | miob0325 | 7774 | miob0407 |
| 7535 | miob0050 | 7595 | miob0155 | 7655 | miob0233 | 7715 | miob0326 | 7775 | miob0409 |
| 7536 | miob0051n | 7596 | miob0156 | 7656 | miob0234 | 7716 | miob0327 | 7776 | miob0410 |
| 7537 | miob0054 | 7597 | miob0157 | 7657 | miob0235 | 7717 | MIOB0328 | 7777 | miob0411 |
| 7538 | miob0055 | 7598 | miob0158 | 7658 | miob0236 | 7718 | MIOB0329 | 7778 | miob0412 |
| 7539 | miob0056 | 7599 | miob0159 | 7659 | miob0237n | 7719 | MIOB0330 | 7779 | miob0413 |
| 7540 | miob0057 | 7600 | miob0163 | 7660 | miob0238 | 7720 | MIOB0331 | 7780 | miob0415 |
| 7541 | miob0060 | 7601 | miob0164 | 7661 | miob0239 | 7721 | MIOB0332 | 7781 | miob0416 |
| 7542 | miob0062 | 7602 | miob0165 | 7662 | miob0240 | 7722 | MIOB0336 | 7782 | miob0417 |
| 7543 | miob0063 | 7603 | miob0166 | 7663 | miob0241 | 7723 | MIOB0337 | 7783 | miob0418 |
| 7544 | miob0065 | 7604 | miob0167 | 7664 | miob0242 | 7724 | miob0338 | 7784 | miob0419 |
| 7545 | miob0066 | 7605 | miob0168 | 7665 | miob0243 | 7725 | miob0341 | 7785 | miob0420 |
| 7546 | miob0068 | 7606 | miob0169 | 7666 | miob0244 | 7726 | miob0343 | 7786 | miob0421 |
| 7547 | miob0071 | 7607 | miob0170 | 7667 | miob0245 | 7727 | miob0346 | 7787 | miob0422 |
| 7548 | miob0072 | 7608 | miob0171 | 7668 | miob0246 | 7728 | miob0347 | 7788 | miob0423 |
| 7549 | miob0073 | 7609 | miob0172 | 7669 | miob0248 | 7729 | miob0348 | 7789 | miob0425 |
| 7550 | miob0074n | 7610 | miob0173 | 7670 | miob0252 | 7730 | miob0349 | 7790 | miob0426 |
| 7551 | miob0075 | 7611 | miob0174 | 7671 | miob0253 | 7731 | miob0350 | 7791 | miob0427 |
| 7552 | miob0076 | 7612 | miob0175 | 7672 | miob0255 | 7732 | miob0351 | 7792 | miob0428 |
| 7553 | miob0078 | 7613 | miob0176 | 7673 | miob0256 | 7733 | miob0353 | 7793 | miob0429 |
| 7554 | miob0080 | 7614 | miob0177 | 7674 | miob0258 | 7734 | miob0354 | 7794 | miob0430 |
| 7555 | miob0082 | 7615 | miob0178 | 7675 | miob0260 | 7735 | miob0356 | 7795 | miob0431 |
| 7556 | miob0084 | 7616 | miob0179 | 7676 | miob0263 | 7736 | miob0357 | 7796 | miob0432 |
| 7557 | miob0087 | 7617 | miob0180 | 7677 | miob0264 | 7737 | miob0358 | 7797 | miob0433 |
| 7558 | miob0088 | 7618 | miob0181 | 7678 | miob0266 | 7738 | miob0359 | 7798 | miob0434 |
| 7559 | miob0089 | 7619 | miob0182 | 7679 | miob0267 | 7739 | miob0360 | 7799 | miob0435 |
| 7560 | miob0090 | 7620 | miob0184 | 7680 | miob0268 | 7740 | miob0361 | 7800 | miob0436 |

Figure 6D – List of EST Sequence Names From Mild OA Cartilage cDNA Library

| | | | | | | | | | |
|---|---|---|---|---|---|---|---|---|---|
| 7801 | miob0439 | 7861 | MIOB0552 | 7921 | miob0665 | 7981 | miob0728 | 8041 | miob0796 |
| 7802 | miob0440 | 7862 | MIOB0554 | 7922 | miob0667 | 7982 | miob0729 | 8042 | miob0797 |
| 7803 | miob0441 | 7863 | MIOB0556 | 7923 | miob0668 | 7983 | miob0731 | 8043 | miob0798n |
| 7804 | miob0442 | 7864 | MIOB0557 | 7924 | miob0669 | 7984 | miob0733 | 8044 | miob0799 |
| 7805 | miob0443 | 7865 | MIOB0559 | 7925 | miob0670 | 7985 | miob0734 | 8045 | miob0801 |
| 7806 | miob0444 | 7866 | MIOB0561 | 7926 | miob0671 | 7986 | miob0735n | 8046 | miob0803 |
| 7807 | miob0445 | 7867 | MIOB0564 | 7927 | miob0672 | 7987 | miob0736 | 8047 | miob0804 |
| 7808 | miob0446 | 7868 | miob0565n | 7928 | miob0673 | 7988 | miob0739 | 8048 | miob0805 |
| 7809 | miob0447 | 7869 | miob0566n | 7929 | miob0674 | 7989 | miob0741 | 8049 | miob0806 |
| 7810 | miob0448 | 7870 | MIOB0567 | 7930 | miob0675 | 7990 | miob0742 | 8050 | miob0807 |
| 7811 | miob0449 | 7871 | miob0568 | 7931 | miob0676 | 7991 | miob0743 | 8051 | miob0808 |
| 7812 | miob0450 | 7872 | MIOB0569 | 7932 | miob0677 | 7992 | miob0744 | 8052 | miob0809 |
| 7813 | miob0451 | 7873 | MIOB0572 | 7933 | miob0678 | 7993 | miob0745 | 8053 | miob0811 |
| 7814 | miob0452 | 7874 | MIOB0573 | 7934 | miob0680 | 7994 | miob0746 | 8054 | miob0812 |
| 7815 | miob0453 | 7875 | MIOB0574 | 7935 | miob0681 | 7995 | miob0747 | 8055 | miob0814 |
| 7816 | miob0454 | 7876 | miob0578 | 7936 | miob0682 | 7996 | miob0748 | 8056 | miob0815 |
| 7817 | miob0455 | 7877 | miob0579 | 7937 | miob0683 | 7997 | miob0749 | 8057 | miob0816 |
| 7818 | miob0456 | 7878 | miob0581 | 7938 | miob0684 | 7998 | miob0750 | 8058 | miob0817 |
| 7819 | miob0457 | 7879 | miob0582n | 7939 | miob0685 | 7999 | miob0751 | 8059 | miob0818 |
| 7820 | miob0465 | 7880 | miob0586 | 7940 | miob0686 | 8000 | miob0752 | 8060 | miob0819 |
| 7821 | MIOB0466 | 7881 | miob0588 | 7941 | miob0687n | 8001 | miob0753 | 8061 | miob0820 |
| 7822 | miob0467n | 7882 | miob0589 | 7942 | miob0688 | 8002 | miob0755 | 8062 | miob0821 |
| 7823 | MIOB0468 | 7883 | miob0590 | 7943 | miob0689 | 8003 | miob0756 | 8063 | miob0822 |
| 7824 | MIOB0469 | 7884 | miob0593 | 7944 | miob0690 | 8004 | miob0757 | 8064 | miob0824 |
| 7825 | MIOB0472 | 7885 | miob0596 | 7945 | miob0691 | 8005 | miob0758 | 8065 | miob0825 |
| 7826 | MIOB0473 | 7886 | miob0597 | 7946 | miob0692 | 8006 | miob0759 | 8066 | miob0826 |
| 7827 | MIOB0474 | 7887 | miob0598 | 7947 | miob0693 | 8007 | miob0760 | 8067 | miob0827 |
| 7828 | miob0482 | 7888 | miob0600 | 7948 | miob0694 | 8008 | miob0761 | 8068 | miob0828 |
| 7829 | miob0483 | 7889 | miob0601 | 7949 | miob0695 | 8009 | miob0762 | 8069 | miob0829 |
| 7830 | miob0487 | 7890 | miob0620 | 7950 | miob0696 | 8010 | miob0763 | 8070 | miob0830 |
| 7831 | miob0490 | 7891 | miob0625 | 7951 | miob0697 | 8011 | miob0764 | 8071 | miob0831 |
| 7832 | miob0491 | 7892 | miob0627 | 7952 | miob0698 | 8012 | miob0765 | 8072 | miob0832 |
| 7833 | miob0492 | 7893 | miob0628 | 7953 | miob0699 | 8013 | miob0766 | 8073 | miob0833 |
| 7834 | miob0493 | 7894 | miob0629 | 7954 | miob0700 | 8014 | miob0767 | 8074 | miob0834 |
| 7835 | miob0496 | 7895 | miob0630 | 7955 | miob0701n | 8015 | miob0768 | 8075 | miob0835n |
| 7836 | miob0497 | 7896 | miob0633 | 7956 | miob0703 | 8016 | miob0769 | 8076 | miob0836 |
| 7837 | miob0498 | 7897 | miob0634 | 7957 | miob0704 | 8017 | miob0770 | 8077 | miob0837 |
| 7838 | miob0500n | 7898 | miob0635 | 7958 | miob0705 | 8018 | miob0772 | 8078 | miob0838 |
| 7839 | miob0502 | 7899 | miob0636 | 7959 | miob0706 | 8019 | miob0773 | 8079 | miob0839 |
| 7840 | miob0507 | 7900 | miob0637 | 7960 | miob0707 | 8020 | miob0774 | 8080 | miob0840 |
| 7841 | miob0508 | 7901 | miob0638 | 7961 | miob0708 | 8021 | miob0775 | 8081 | miob0841 |
| 7842 | miob0510 | 7902 | miob0642 | 7962 | miob0709 | 8022 | miob0776 | 8082 | miob0842 |
| 7843 | miob0515 | 7903 | miob0644 | 7963 | miob0710 | 8023 | miob0777 | 8083 | miob0843 |
| 7844 | miob0519 | 7904 | miob0645 | 7964 | miob0711 | 8024 | miob0778 | 8084 | miob0845 |
| 7845 | miob0520 | 7905 | miob0646 | 7965 | miob0712 | 8025 | miob0779 | 8085 | miob0846 |
| 7846 | miob0522 | 7906 | miob0647 | 7966 | miob0713 | 8026 | miob0780 | 8086 | miob0848n |
| 7847 | miob0523 | 7907 | miob0648 | 7967 | miob0714 | 8027 | miob0781 | 8087 | miob0850 |
| 7848 | miob0524 | 7908 | miob0649 | 7968 | miob0715 | 8028 | miob0782 | 8088 | miob0851 |
| 7849 | miob0528 | 7909 | miob0650 | 7969 | miob0716 | 8029 | miob0783 | 8089 | miob0852 |
| 7850 | MIOB0535 | 7910 | miob0651 | 7970 | miob0717 | 8030 | miob0784 | 8090 | miob0853 |
| 7851 | MIOB0536 | 7911 | miob0652 | 7971 | miob0718 | 8031 | miob0785 | 8091 | miob0854 |
| 7852 | MIOB0537 | 7912 | miob0653 | 7972 | miob0719 | 8032 | miob0786 | 8092 | miob0855 |
| 7853 | MIOB0538 | 7913 | miob0654 | 7973 | miob0720 | 8033 | miob0787 | 8093 | miob0856 |
| 7854 | MIOB0541 | 7914 | miob0656 | 7974 | miob0721 | 8034 | miob0788 | 8094 | miob0857 |
| 7855 | MIOB0542 | 7915 | miob0657 | 7975 | miob0722 | 8035 | miob0789 | 8095 | miob0858 |
| 7856 | MIOB0544 | 7916 | miob0658 | 7976 | miob0723 | 8036 | miob0791 | 8096 | miob0860 |
| 7857 | MIOB0545 | 7917 | miob0660 | 7977 | miob0724 | 8037 | miob0792 | 8097 | miob0861 |
| 7858 | miob0547n | 7918 | miob0661 | 7978 | miob0725 | 8038 | miob0793 | 8098 | miob0862 |
| 7859 | MIOB0549 | 7919 | miob0662 | 7979 | miob0726 | 8039 | miob0794 | 8099 | miob0863 |
| 7860 | MIOB0550 | 7920 | miob0663 | 7980 | miob0727 | 8040 | miob0795 | 8100 | miob0865 |

Figure 6D – List of EST Sequence Names From Mild OA Cartilage cDNA Library

| | | | | | | | | | |
|---|---|---|---|---|---|---|---|---|---|
| 8101 | miob0866 | 8161 | miob0937 | 8221 | miob1005 | 8281 | miob1076 | 8341 | miob1147 |
| 8102 | miob0867 | 8162 | miob0938 | 8222 | miob1006 | 8282 | miob1078 | 8342 | miob1148 |
| 8103 | miob0868 | 8163 | miob0939 | 8223 | miob1007 | 8283 | miob1079n | 8343 | miob1149 |
| 8104 | miob0869 | 8164 | miob0940 | 8224 | miob1008 | 8284 | miob1080 | 8344 | miob1150 |
| 8105 | miob0870 | 8165 | miob0941 | 8225 | miob1009 | 8285 | miob1083 | 8345 | miob1151 |
| 8106 | miob0873 | 8166 | miob0942 | 8226 | miob1010 | 8286 | miob1085 | 8346 | miob1152 |
| 8107 | miob0874 | 8167 | miob0943 | 8227 | miob1011 | 8287 | miob1087 | 8347 | miob1153n |
| 8108 | miob0875 | 8168 | miob0944 | 8228 | miob1012 | 8288 | miob1089 | 8348 | miob1154 |
| 8109 | miob0876 | 8169 | miob0945 | 8229 | miob1013 | 8289 | miob1090 | 8349 | miob1155 |
| 8110 | miob0877 | 8170 | miob0946 | 8230 | miob1014 | 8290 | miob1091 | 8350 | miob1156 |
| 8111 | miob0879 | 8171 | miob0947 | 8231 | miob1015 | 8291 | miob1092 | 8351 | miob1157 |
| 8112 | miob0880 | 8172 | miob0948 | 8232 | miob1016 | 8292 | miob1093 | 8352 | miob1158 |
| 8113 | miob0881 | 8173 | miob0949 | 8233 | miob1017 | 8293 | miob1094 | 8353 | miob1159 |
| 8114 | miob0883 | 8174 | miob0950 | 8234 | miob1018 | 8294 | miob1095 | 8354 | miob1160 |
| 8115 | miob0884 | 8175 | miob0951 | 8235 | miob1019 | 8295 | miob1096 | 8355 | miob1161 |
| 8116 | miob0886 | 8176 | miob0952 | 8236 | miob1020 | 8296 | miob1097n | 8356 | miob1165 |
| 8117 | miob0888 | 8177 | miob0953 | 8237 | miob1021 | 8297 | miob1098 | 8357 | miob1168 |
| 8118 | miob0889 | 8178 | miob0954 | 8238 | miob1022 | 8298 | miob1099 | 8358 | miob1171 |
| 8119 | miob0890 | 8179 | miob0955 | 8239 | miob1023 | 8299 | miob1100 | 8359 | miob1172 |
| 8120 | miob0891 | 8180 | miob0956 | 8240 | miob1025n | 8300 | miob1101 | 8360 | miob1177 |
| 8121 | miob0892 | 8181 | miob0959 | 8241 | miob1026 | 8301 | miob1102 | 8361 | miob1178 |
| 8122 | miob0893 | 8182 | miob0960 | 8242 | miob1027 | 8302 | miob1103 | 8362 | miob1180 |
| 8123 | miob0897 | 8183 | miob0962 | 8243 | miob1029 | 8303 | miob1104 | 8363 | miob1181 |
| 8124 | miob0898 | 8184 | miob0963 | 8244 | miob1030 | 8304 | miob1105 | 8364 | miob1182 |
| 8125 | miob0899 | 8185 | miob0964 | 8245 | miob1031 | 8305 | miob1106 | 8365 | miob1183 |
| 8126 | miob0900 | 8186 | miob0965 | 8246 | miob1032 | 8306 | miob1107 | 8366 | miob1184 |
| 8127 | miob0901 | 8187 | miob0967 | 8247 | miob1033 | 8307 | miob1108 | 8367 | miob1185 |
| 8128 | miob0902 | 8188 | miob0968 | 8248 | miob1034 | 8308 | miob1111 | 8368 | miob1186 |
| 8129 | miob0903 | 8189 | miob0969 | 8249 | miob1035 | 8309 | miob1112 | 8369 | miob1187 |
| 8130 | miob0904 | 8190 | miob0971 | 8250 | miob1036 | 8310 | miob1113 | 8370 | miob1188 |
| 8131 | miob0905 | 8191 | miob0972 | 8251 | miob1037 | 8311 | miob1114 | 8371 | miob1189 |
| 8132 | miob0906 | 8192 | miob0973 | 8252 | miob1038 | 8312 | miob1115 | 8372 | miob1190 |
| 8133 | miob0907 | 8193 | miob0974 | 8253 | miob1040 | 8313 | miob1116 | 8373 | miob1191 |
| 8134 | miob0908 | 8194 | miob0975 | 8254 | miob1041 | 8314 | miob1117 | 8374 | miob1192 |
| 8135 | miob0909 | 8195 | miob0976 | 8255 | miob1042 | 8315 | miob1118 | 8375 | miob1194 |
| 8136 | miob0910 | 8196 | miob0977 | 8256 | miob1043 | 8316 | miob1119 | 8376 | miob1195 |
| 8137 | miob0911 | 8197 | miob0978 | 8257 | miob1044 | 8317 | miob1122 | 8377 | miob1196 |
| 8138 | miob0912 | 8198 | miob0979 | 8258 | miob1046 | 8318 | miob1123 | 8378 | miob1197 |
| 8139 | miob0913 | 8199 | miob0980 | 8259 | miob1048 | 8319 | miob1124 | 8379 | miob1198 |
| 8140 | miob0914 | 8200 | miob0981 | 8260 | miob1049 | 8320 | miob1125 | 8380 | miob1199 |
| 8141 | miob0915 | 8201 | miob0982 | 8261 | miob1050 | 8321 | miob1126 | 8381 | miob1200 |
| 8142 | miob0916 | 8202 | miob0983 | 8262 | miob1051 | 8322 | miob1127 | 8382 | miob1202 |
| 8143 | miob0918 | 8203 | miob0984 | 8263 | miob1052 | 8323 | miob1128 | 8383 | miob1203 |
| 8144 | miob0919 | 8204 | miob0986 | 8264 | miob1053 | 8324 | miob1129 | 8384 | miob1204 |
| 8145 | miob0920 | 8205 | miob0987 | 8265 | miob1056 | 8325 | miob1130 | 8385 | miob1205 |
| 8146 | miob0921 | 8206 | miob0988 | 8266 | miob1059 | 8326 | miob1131 | 8386 | miob1206 |
| 8147 | miob0922 | 8207 | miob0989n | 8267 | miob1060 | 8327 | miob1132 | 8387 | miob1208 |
| 8148 | miob0923 | 8208 | miob0990 | 8268 | miob1061 | 8328 | miob1133 | 8388 | miob1209 |
| 8149 | miob0925 | 8209 | miob0992 | 8269 | miob1062 | 8329 | miob1134 | 8389 | miob1210 |
| 8150 | miob0926 | 8210 | miob0993 | 8270 | miob1063 | 8330 | miob1135 | 8390 | miob1211 |
| 8151 | miob0927 | 8211 | miob0994 | 8271 | miob1064 | 8331 | miob1136 | 8391 | miob1214 |
| 8152 | miob0928 | 8212 | miob0995 | 8272 | miob1065 | 8332 | miob1138 | 8392 | miob1215 |
| 8153 | miob0929 | 8213 | miob0996 | 8273 | miob1067 | 8333 | miob1139 | 8393 | miob1218 |
| 8154 | miob0930n | 8214 | miob0997 | 8274 | miob1068 | 8334 | miob1140 | 8394 | miob1219 |
| 8155 | miob0931 | 8215 | miob0999 | 8275 | miob1070 | 8335 | miob1141 | 8395 | miob1220 |
| 8156 | miob0932 | 8216 | miob1000 | 8276 | miob1071 | 8336 | miob1142 | 8396 | miob1221 |
| 8157 | miob0933 | 8217 | miob1001 | 8277 | miob1072 | 8337 | miob1143 | 8397 | miob1222 |
| 8158 | miob0934 | 8218 | miob1002 | 8278 | miob1073 | 8338 | miob1144 | 8398 | miob1223 |
| 8159 | miob0935 | 8219 | miob1003 | 8279 | miob1074 | 8339 | miob1145 | 8399 | miob1224 |
| 8160 | miob0936 | 8220 | miob1004 | 8280 | miob1075 | 8340 | miob1146 | 8400 | miob1225 |

Figure 6D – List of EST Sequence Names From Mild OA Cartilage cDNA Library

| | | | | | | | | | |
|---|---|---|---|---|---|---|---|---|---|
| 8401 | miob1226 | 8461 | miob1301 | 8521 | miob1365 | 8581 | MIOB1498 | 8641 | MIOB1570 |
| 8402 | miob1227 | 8462 | miob1302 | 8522 | miob1366 | 8582 | MIOB1499 | 8642 | MIOB1571 |
| 8403 | miob1228 | 8463 | miob1303 | 8523 | miob1367 | 8583 | MIOB1501 | 8643 | MIOB1572 |
| 8404 | miob1229 | 8464 | miob1304 | 8524 | miob1368 | 8584 | MIOB1502 | 8644 | MIOB1573 |
| 8405 | miob1230 | 8465 | miob1305 | 8525 | miob1369 | 8585 | MIOB1504 | 8645 | MIOB1575 |
| 8406 | miob1231 | 8466 | miob1306 | 8526 | miob1370 | 8586 | MIOB1505 | 8646 | MIOB1577 |
| 8407 | miob1233 | 8467 | miob1307 | 8527 | miob1371 | 8587 | MIOB1506 | 8647 | MIOB1579 |
| 8408 | miob1234 | 8468 | miob1308 | 8528 | miob1372 | 8588 | MIOB1507 | 8648 | MIOB1580 |
| 8409 | miob1235 | 8469 | miob1309 | 8529 | miob1373 | 8589 | MIOB1508 | 8649 | MIOB1582 |
| 8410 | miob1236 | 8470 | miob1310 | 8530 | miob1374 | 8590 | MIOB1509 | 8650 | MIOB1583 |
| 8411 | miob1237 | 8471 | miob1312 | 8531 | miob1375 | 8591 | MIOB1510 | 8651 | MIOB1584 |
| 8412 | miob1238 | 8472 | miob1313 | 8532 | miob1376 | 8592 | MIOB1511 | 8652 | miob1687 |
| 8413 | miob1242 | 8473 | miob1314 | 8533 | miob1377n | 8593 | MIOB1512 | 8653 | miob1689 |
| 8414 | miob1243 | 8474 | miob1315 | 8534 | miob1378 | 8594 | MIOB1513 | 8654 | miob1690 |
| 8415 | miob1244 | 8475 | miob1316 | 8535 | miob1379 | 8595 | MIOB1514 | 8655 | miob1691 |
| 8416 | miob1245 | 8476 | miob1317 | 8536 | miob1380 | 8596 | MIOB1515 | 8656 | miob1692n |
| 8417 | miob1246 | 8477 | miob1318 | 8537 | miob1381 | 8597 | MIOB1518 | 8657 | miob1693 |
| 8418 | miob1247 | 8478 | miob1319 | 8538 | miob1382 | 8598 | MIOB1519 | 8658 | miob1694 |
| 8419 | miob1249 | 8479 | miob1320 | 8539 | miob1383 | 8599 | MIOB1520 | 8659 | miob1696 |
| 8420 | miob1250 | 8480 | miob1321 | 8540 | miob1384 | 8600 | MIOB1521 | 8660 | miob1698 |
| 8421 | miob1251 | 8481 | miob1322 | 8541 | miob1385 | 8601 | MIOB1523 | 8661 | miob1699 |
| 8422 | miob1252 | 8482 | miob1323 | 8542 | miob1386 | 8602 | MIOB1524 | 8662 | miob1701 |
| 8423 | miob1253 | 8483 | miob1324 | 8543 | miob1387 | 8603 | MIOB1525 | 8663 | miob1704 |
| 8424 | miob1254 | 8484 | miob1325 | 8544 | miob1388 | 8604 | MIOB1526 | 8664 | miob1706 |
| 8425 | miob1255 | 8485 | miob1326 | 8545 | miob1389 | 8605 | MIOB1527 | 8665 | miob1707 |
| 8426 | miob1258 | 8486 | miob1327 | 8546 | miob1390n | 8606 | MIOB1528 | 8666 | miob1708 |
| 8427 | miob1259n | 8487 | miob1329 | 8547 | miob1391 | 8607 | miob1529 | 8667 | miob1709 |
| 8428 | miob1260 | 8488 | miob1330 | 8548 | miob1392 | 8608 | MIOB1530 | 8668 | miob1710 |
| 8429 | miob1263 | 8489 | miob1331 | 8549 | miob1393 | 8609 | MIOB1531 | 8669 | miob1711 |
| 8430 | miob1265 | 8490 | miob1332 | 8550 | miob1440 | 8610 | MIOB1533 | 8670 | miob1712 |
| 8431 | miob1266 | 8491 | miob1333 | 8551 | miob1441 | 8611 | MIOB1535 | 8671 | miob1713 |
| 8432 | miob1267 | 8492 | miob1334 | 8552 | miob1442 | 8612 | MIOB1536 | 8672 | miob1714 |
| 8433 | miob1268 | 8493 | miob1335 | 8553 | miob1443 | 8613 | miob1537n | 8673 | miob1716 |
| 8434 | miob1269 | 8494 | miob1336 | 8554 | miob1445 | 8614 | MIOB1538 | 8674 | miob1718 |
| 8435 | miob1270 | 8495 | miob1337 | 8555 | miob1446 | 8615 | MIOB1539 | 8675 | miob1719 |
| 8436 | miob1271 | 8496 | miob1338 | 8556 | miob1447n | 8616 | MIOB1540 | 8676 | miob1720 |
| 8437 | miob1272 | 8497 | miob1340 | 8557 | miob1448 | 8617 | MIOB1541 | 8677 | miob1721 |
| 8438 | miob1273 | 8498 | miob1341 | 8558 | miob1449 | 8618 | MIOB1542 | 8678 | miob1722 |
| 8439 | miob1274 | 8499 | miob1342 | 8559 | miob1450 | 8619 | MIOB1543 | 8679 | miob1723 |
| 8440 | miob1275 | 8500 | miob1343 | 8560 | miob1451 | 8620 | MIOB1545 | 8680 | miob1724 |
| 8441 | miob1276 | 8501 | miob1344 | 8561 | miob1452 | 8621 | MIOB1546 | 8681 | miob1725 |
| 8442 | miob1277 | 8502 | miob1345 | 8562 | miob1453 | 8622 | MIOB1547 | 8682 | miob1726 |
| 8443 | miob1278 | 8503 | miob1346 | 8563 | miob1454 | 8623 | MIOB1550 | 8683 | miob1727 |
| 8444 | miob1279 | 8504 | miob1347 | 8564 | miob1455 | 8624 | MIOB1552 | 8684 | miob1728 |
| 8445 | miob1281 | 8505 | miob1348 | 8565 | miob1456 | 8625 | MIOB1553 | 8685 | miob1729 |
| 8446 | miob1282 | 8506 | miob1349 | 8566 | miob1457 | 8626 | MIOB1554 | 8686 | miob1734 |
| 8447 | miob1283 | 8507 | miob1350 | 8567 | miob1458 | 8627 | MIOB1555 | 8687 | miob1735 |
| 8448 | miob1285 | 8508 | miob1352 | 8568 | miob1460 | 8628 | MIOB1556 | 8688 | miob1737 |
| 8449 | miob1286 | 8509 | miob1353 | 8569 | miob1461 | 8629 | MIOB1557 | 8689 | miob1738 |
| 8450 | miob1287 | 8510 | miob1354 | 8570 | miob1479 | 8630 | MIOB1558 | 8690 | miob1739 |
| 8451 | miob1289 | 8511 | miob1355 | 8571 | miob1480 | 8631 | MIOB1559 | 8691 | miob1740 |
| 8452 | miob1290 | 8512 | miob1356 | 8572 | miob1481 | 8632 | MIOB1560 | 8692 | miob1741 |
| 8453 | miob1291 | 8513 | miob1357 | 8573 | MIOB1490 | 8633 | MIOB1561 | 8693 | miob1742 |
| 8454 | miob1293 | 8514 | miob1358 | 8574 | MIOB1491 | 8634 | MIOB1562 | 8694 | miob1743 |
| 8455 | miob1294 | 8515 | miob1359 | 8575 | MIOB1492 | 8635 | MIOB1563 | 8695 | miob1744 |
| 8456 | miob1295 | 8516 | miob1360 | 8576 | MIOB1493 | 8636 | MIOB1565 | 8696 | miob1745 |
| 8457 | miob1296 | 8517 | miob1361 | 8577 | MIOB1494 | 8637 | MIOB1566 | 8697 | miob1746 |
| 8458 | miob1298 | 8518 | miob1362 | 8578 | MIOB1495 | 8638 | MIOB1567 | 8698 | miob1747 |
| 8459 | miob1299 | 8519 | miob1363 | 8579 | MIOB1496 | 8639 | MIOB1568 | 8699 | miob1748 |
| 8460 | miob1300 | 8520 | miob1364 | 8580 | MIOB1497 | 8640 | MIOB1569 | 8700 | miob1749 |

Figure 6D – List of EST Sequence Names From Mild OA Cartilage cDNA Library

| | | | | | | | | | |
|---|---|---|---|---|---|---|---|---|---|
| 8701 | miob1750 | 8761 | miob1823 | 8821 | miob1885 | 8881 | miob1950 | 8941 | MIOB2117 |
| 8702 | miob1751 | 8762 | miob1824 | 8822 | miob1886 | 8882 | miob1951 | 8942 | MIOB2118 |
| 8703 | miob1752 | 8763 | miob1825 | 8823 | miob1887 | 8883 | miob1952 | 8943 | miob2119n |
| 8704 | miob1754 | 8764 | miob1826 | 8824 | miob1888 | 8884 | miob1953 | 8944 | MIOB2120 |
| 8705 | miob1755 | 8765 | miob1827 | 8825 | miob1889 | 8885 | miob1954 | 8945 | MIOB2121 |
| 8706 | miob1756 | 8766 | miob1828 | 8826 | miob1890 | 8886 | miob1955 | 8946 | MIOB2122 |
| 8707 | miob1757 | 8767 | miob1829 | 8827 | miob1891 | 8887 | miob1956 | 8947 | MIOB2123 |
| 8708 | miob1758 | 8768 | miob1830 | 8828 | miob1892 | 8888 | miob1957 | 8948 | MIOB2124 |
| 8709 | miob1759 | 8769 | miob1831 | 8829 | miob1893 | 8889 | miob1958 | 8949 | MIOB2125 |
| 8710 | miob1760 | 8770 | miob1832 | 8830 | miob1894 | 8890 | miob1959 | 8950 | MIOB2126 |
| 8711 | miob1761 | 8771 | miob1833 | 8831 | miob1895 | 8891 | miob1960 | 8951 | miob2127 |
| 8712 | miob1762 | 8772 | miob1834 | 8832 | miob1896 | 8892 | miob1961 | 8952 | MIOB2128 |
| 8713 | miob1763 | 8773 | miob1835 | 8833 | miob1897 | 8893 | miob1962 | 8953 | MIOB2129 |
| 8714 | miob1764 | 8774 | miob1836 | 8834 | miob1898 | 8894 | miob1963 | 8954 | MIOB2130 |
| 8715 | miob1765 | 8775 | miob1837 | 8835 | miob1899 | 8895 | miob1964 | 8955 | MIOB2131 |
| 8716 | miob1767 | 8776 | miob1838 | 8836 | miob1900 | 8896 | miob1965 | 8956 | MIOB2133 |
| 8717 | miob1768 | 8777 | miob1839 | 8837 | miob1901 | 8897 | miob1966 | 8957 | MIOB2134 |
| 8718 | miob1769 | 8778 | miob1840 | 8838 | miob1902 | 8898 | miob1967 | 8958 | MIOB2135 |
| 8719 | miob1770 | 8779 | miob1841 | 8839 | miob1903 | 8899 | miob1968 | 8959 | MIOB2136 |
| 8720 | miob1771 | 8780 | miob1842n | 8840 | miob1904 | 8900 | miob1969 | 8960 | MIOB2137 |
| 8721 | miob1772 | 8781 | miob1843 | 8841 | miob1905 | 8901 | MIOB2067 | 8961 | MIOB2138 |
| 8722 | miob1774 | 8782 | miob1844 | 8842 | miob1906 | 8902 | MIOB2068 | 8962 | MIOB2139 |
| 8723 | miob1775 | 8783 | miob1845 | 8843 | miob1907 | 8903 | miob2070n | 8963 | MIOB2140 |
| 8724 | miob1776 | 8784 | miob1846 | 8844 | miob1908 | 8904 | miob2072 | 8964 | MIOB2141 |
| 8725 | miob1777 | 8785 | miob1847 | 8845 | miob1909 | 8905 | MIOB2073 | 8965 | MIOB2142 |
| 8726 | miob1778 | 8786 | miob1848 | 8846 | miob1911 | 8906 | MIOB2074 | 8966 | MIOB2144 |
| 8727 | miob1781 | 8787 | miob1849 | 8847 | miob1912 | 8907 | MIOB2077 | 8967 | MIOB2145 |
| 8728 | miob1783 | 8788 | miob1850n | 8848 | miob1913 | 8908 | MIOB2079 | 8968 | MIOB2146 |
| 8729 | miob1785 | 8789 | miob1851 | 8849 | miob1914 | 8909 | MIOB2080 | 8969 | MIOB2147 |
| 8730 | miob1786 | 8790 | miob1852n | 8850 | miob1915 | 8910 | MIOB2082 | 8970 | MIOB2149 |
| 8731 | miob1787 | 8791 | miob1853 | 8851 | miob1916 | 8911 | MIOB2084 | 8971 | MIOB2150 |
| 8732 | miob1789 | 8792 | miob1854 | 8852 | miob1917 | 8912 | MIOB2085 | 8972 | MIOB2151 |
| 8733 | miob1791 | 8793 | miob1855 | 8853 | miob1918 | 8913 | MIOB2087 | 8973 | MIOB2152 |
| 8734 | miob1792 | 8794 | miob1856 | 8854 | miob1919 | 8914 | MIOB2088 | 8974 | MIOB2153 |
| 8735 | miob1793 | 8795 | miob1857 | 8855 | miob1920 | 8915 | MIOB2089 | 8975 | MIOB2154 |
| 8736 | miob1794 | 8796 | miob1858 | 8856 | miob1921 | 8916 | MIOB2090 | 8976 | MIOB2157 |
| 8737 | miob1795 | 8797 | miob1859 | 8857 | miob1924 | 8917 | MIOB2091 | 8977 | MIOB2158 |
| 8738 | miob1796 | 8798 | miob1860 | 8858 | miob1925 | 8918 | MIOB2092 | 8978 | MIOB2159 |
| 8739 | miob1797 | 8799 | miob1861 | 8859 | miob1926n | 8919 | MIOB2093 | 8979 | MIOB2163 |
| 8740 | miob1798 | 8800 | miob1862 | 8860 | miob1927 | 8920 | MIOB2094 | 8980 | MIOB2164 |
| 8741 | miob1800 | 8801 | miob1863 | 8861 | miob1928 | 8921 | MIOB2095 | 8981 | MIOB2166 |
| 8742 | miob1801 | 8802 | miob1864 | 8862 | miob1929 | 8922 | MIOB2096 | 8982 | MIOB2167 |
| 8743 | miob1802 | 8803 | miob1865 | 8863 | miob1930 | 8923 | MIOB2097 | 8983 | MIOB2168 |
| 8744 | miob1803 | 8804 | miob1866 | 8864 | miob1932 | 8924 | MIOB2098 | 8984 | MIOB2169 |
| 8745 | miob1804 | 8805 | miob1867 | 8865 | miob1933 | 8925 | MIOB2099 | 8985 | MIOB2172 |
| 8746 | miob1806 | 8806 | miob1868 | 8866 | miob1934 | 8926 | MIOB2100 | 8986 | MIOB2173 |
| 8747 | miob1807 | 8807 | miob1869 | 8867 | miob1935 | 8927 | MIOB2102 | 8987 | MIOB2174 |
| 8748 | miob1808 | 8808 | miob1871 | 8868 | miob1936 | 8928 | MIOB2103 | 8988 | MIOB2175 |
| 8749 | miob1809 | 8809 | miob1872 | 8869 | miob1937 | 8929 | MIOB2104 | 8989 | MIOB2177 |
| 8750 | miob1810 | 8810 | miob1873 | 8870 | miob1938 | 8930 | MIOB2105 | 8990 | MIOB2178 |
| 8751 | miob1811 | 8811 | miob1874 | 8871 | miob1939 | 8931 | MIOB2107 | 8991 | miob2180n |
| 8752 | miob1812 | 8812 | miob1875 | 8872 | miob1940 | 8932 | MIOB2108 | 8992 | MIOB2181 |
| 8753 | miob1813 | 8813 | miob1876 | 8873 | miob1941 | 8933 | MIOB2109 | 8993 | MIOB2183 |
| 8754 | miob1814 | 8814 | miob1877 | 8874 | miob1942 | 8934 | MIOB2110 | 8994 | MIOB2184 |
| 8755 | miob1815 | 8815 | miob1879 | 8875 | miob1943 | 8935 | MIOB2111 | 8995 | MIOB2185 |
| 8756 | miob1816 | 8816 | miob1880 | 8876 | miob1944 | 8936 | MIOB2112 | 8996 | miob2186 |
| 8757 | miob1818 | 8817 | miob1881 | 8877 | miob1945 | 8937 | MIOB2113 | 8997 | MIOB2187 |
| 8758 | miob1820 | 8818 | miob1882 | 8878 | miob1946 | 8938 | MIOB2114 | 8998 | MIOB2188 |
| 8759 | miob1821 | 8819 | miob1883 | 8879 | miob1947 | 8939 | MIOB2115 | 8999 | MIOB2189 |
| 8760 | miob1822 | 8820 | miob1884 | 8880 | miob1949 | 8940 | MIOB2116 | 9000 | miob2191 |

Figure 6D – List of EST Sequence Names From Mild OA Cartilage cDNA Library

| | | | | | | | | | |
|---|---|---|---|---|---|---|---|---|---|
| 9001 | MIOB2192 | 9061 | MIOB2285 | 9121 | miob2386 | 9181 | miob2457 | 9241 | miob2527 |
| 9002 | MIOB2193 | 9062 | MIOB2287 | 9122 | miob2387 | 9182 | miob2458 | 9242 | miob2528 |
| 9003 | MIOB2194 | 9063 | miob2289n | 9123 | miob2388 | 9183 | miob2459n | 9243 | miob2530 |
| 9004 | miob2197 | 9064 | MIOB2291 | 9124 | miob2391 | 9184 | miob2461 | 9244 | miob2531 |
| 9005 | miob2199 | 9065 | MIOB2293 | 9125 | miob2392 | 9185 | miob2462 | 9245 | miob2532 |
| 9006 | MIOB2201 | 9066 | MIOB2297 | 9126 | miob2393 | 9186 | miob2463 | 9246 | miob2533 |
| 9007 | MIOB2202 | 9067 | MIOB2299 | 9127 | miob2394 | 9187 | miob2464 | 9247 | miob2534 |
| 9008 | miob2203 | 9068 | MIOB2300 | 9128 | miob2395 | 9188 | miob2465 | 9248 | miob2535 |
| 9009 | MIOB2206 | 9069 | MIOB2301 | 9129 | miob2396 | 9189 | miob2466 | 9249 | miob2536 |
| 9010 | MIOB2207 | 9070 | MIOB2303 | 9130 | miob2397 | 9190 | miob2467 | 9250 | miob2537 |
| 9011 | MIOB2209 | 9071 | MIOB2304 | 9131 | miob2398 | 9191 | miob2469 | 9251 | miob2538 |
| 9012 | MIOB2210 | 9072 | MIOB2305 | 9132 | miob2399 | 9192 | miob2470 | 9252 | miob2539 |
| 9013 | MIOB2211 | 9073 | MIOB2306 | 9133 | miob2400 | 9193 | miob2471 | 9253 | miob2540 |
| 9014 | MIOB2212 | 9074 | MIOB2307 | 9134 | miob2401 | 9194 | miob2472 | 9254 | miob2541 |
| 9015 | MIOB2213 | 9075 | miob2308n | 9135 | miob2402 | 9195 | miob2473 | 9255 | miob2542 |
| 9016 | MIOB2214 | 9076 | MIOB2309 | 9136 | miob2403 | 9196 | miob2474 | 9256 | miob2543 |
| 9017 | MIOB2215 | 9077 | MIOB2310 | 9137 | miob2404 | 9197 | miob2475 | 9257 | miob2544 |
| 9018 | MIOB2216 | 9078 | MIOB2311 | 9138 | miob2405 | 9198 | miob2477 | 9258 | miob2545 |
| 9019 | miob2217 | 9079 | MIOB2312 | 9139 | miob2406 | 9199 | miob2478 | 9259 | MIOB2547 |
| 9020 | MIOB2219 | 9080 | MIOB2313 | 9140 | miob2407 | 9200 | miob2479 | 9260 | MIOB2548 |
| 9021 | miob2220 | 9081 | MIOB2314 | 9141 | miob2408 | 9201 | miob2480 | 9261 | MIOB2549 |
| 9022 | MIOB2225 | 9082 | MIOB2317 | 9142 | miob2409 | 9202 | miob2481 | 9262 | MIOB2551 |
| 9023 | MIOB2226 | 9083 | MIOB2319 | 9143 | miob2411 | 9203 | miob2482 | 9263 | MIOB2553 |
| 9024 | MIOB2227 | 9084 | MIOB2324 | 9144 | miob2412 | 9204 | miob2484 | 9264 | MIOB2554 |
| 9025 | MIOB2228 | 9085 | MIOB2330 | 9145 | miob2414 | 9205 | miob2485 | 9265 | MIOB2556 |
| 9026 | MIOB2229 | 9086 | MIOB2338 | 9146 | miob2415 | 9206 | miob2486 | 9266 | MIOB2557 |
| 9027 | MIOB2231 | 9087 | MIOB2341 | 9147 | miob2416 | 9207 | miob2487 | 9267 | MIOB2559 |
| 9028 | MIOB2232 | 9088 | MIOB2342 | 9148 | miob2418 | 9208 | miob2489 | 9268 | MIOB2561 |
| 9029 | MIOB2233 | 9089 | MIOB2344 | 9149 | miob2419 | 9209 | miob2490 | 9269 | MIOB2563 |
| 9030 | MIOB2234 | 9090 | MIOB2345 | 9150 | miob2420 | 9210 | miob2491 | 9270 | MIOB2564 |
| 9031 | MIOB2235 | 9091 | miob2353n | 9151 | miob2421 | 9211 | miob2492 | 9271 | MIOB2565 |
| 9032 | MIOB2239 | 9092 | miob2355 | 9152 | miob2422 | 9212 | miob2493 | 9272 | MIOB2566 |
| 9033 | MIOB2240 | 9093 | miob2356 | 9153 | miob2423 | 9213 | miob2494 | 9273 | MIOB2567 |
| 9034 | miob2241 | 9094 | miob2357n | 9154 | miob2424 | 9214 | miob2495 | 9274 | MIOB2568 |
| 9035 | MIOB2242 | 9095 | miob2358 | 9155 | miob2425 | 9215 | miob2496 | 9275 | MIOB2569 |
| 9036 | miob2243 | 9096 | miob2359 | 9156 | miob2426 | 9216 | miob2497 | 9276 | MIOB2570 |
| 9037 | MIOB2244 | 9097 | miob2360 | 9157 | miob2428 | 9217 | miob2498 | 9277 | MIOB2571 |
| 9038 | MIOB2247 | 9098 | miob2361 | 9158 | miob2429 | 9218 | miob2499 | 9278 | MIOB2573 |
| 9039 | MIOB2248 | 9099 | miob2362 | 9159 | miob2430 | 9219 | miob2500 | 9279 | MIOB2574 |
| 9040 | MIOB2249 | 9100 | miob2363 | 9160 | miob2431 | 9220 | miob2502 | 9280 | MIOB2575 |
| 9041 | MIOB2250 | 9101 | miob2364 | 9161 | miob2432 | 9221 | miob2503 | 9281 | miob2576n |
| 9042 | MIOB2252 | 9102 | miob2365 | 9162 | miob2433 | 9222 | miob2504 | 9282 | MIOB2577 |
| 9043 | MIOB2253 | 9103 | miob2366 | 9163 | miob2434 | 9223 | miob2505 | 9283 | MIOB2578 |
| 9044 | MIOB2256 | 9104 | miob2367n | 9164 | miob2436 | 9224 | miob2506 | 9284 | MIOB2579 |
| 9045 | MIOB2257 | 9105 | miob2368 | 9165 | miob2437 | 9225 | miob2507 | 9285 | MIOB2581 |
| 9046 | MIOB2259 | 9106 | miob2369n | 9166 | miob2438 | 9226 | miob2508 | 9286 | miob2582n |
| 9047 | MIOB2261 | 9107 | miob2371 | 9167 | miob2440 | 9227 | miob2509 | 9287 | MIOB2583 |
| 9048 | miob2262n | 9108 | miob2372 | 9168 | miob2442 | 9228 | miob2510 | 9288 | MIOB2584 |
| 9049 | MIOB2263 | 9109 | miob2373 | 9169 | miob2443 | 9229 | miob2511 | 9289 | MIOB2585 |
| 9050 | MIOB2265 | 9110 | miob2374 | 9170 | miob2444 | 9230 | miob2512 | 9290 | MIOB2586 |
| 9051 | MIOB2267 | 9111 | miob2375 | 9171 | miob2445 | 9231 | miob2514 | 9291 | MIOB2587 |
| 9052 | MIOB2269 | 9112 | miob2376 | 9172 | miob2446 | 9232 | miob2515 | 9292 | MIOB2588 |
| 9053 | MIOB2271 | 9113 | miob2377 | 9173 | miob2447 | 9233 | miob2516 | 9293 | MIOB2589 |
| 9054 | MIOB2273 | 9114 | miob2378 | 9174 | miob2448 | 9234 | miob2518 | 9294 | MIOB2591 |
| 9055 | MIOB2274 | 9115 | miob2380 | 9175 | miob2449 | 9235 | miob2519 | 9295 | MIOB2592 |
| 9056 | miob2276n | 9116 | miob2381 | 9176 | miob2452 | 9236 | miob2520 | 9296 | MIOB2593 |
| 9057 | MIOB2277 | 9117 | miob2382 | 9177 | miob2453 | 9237 | miob2521 | 9297 | MIOB2594 |
| 9058 | MIOB2279 | 9118 | miob2383 | 9178 | miob2454 | 9238 | miob2522 | 9298 | MIOB2595 |
| 9059 | MIOB2282 | 9119 | miob2384 | 9179 | miob2455 | 9239 | miob2523 | 9299 | MIOB2596 |
| 9060 | miob2284 | 9120 | miob2385 | 9180 | miob2456 | 9240 | miob2526 | 9300 | MIOB2597 |

Figure 6D – List of EST Sequence Names From Mild OA Cartilage cDNA Library

| | | | | | | | | | |
|---|---|---|---|---|---|---|---|---|---|
| 9301 | MIOB2599 | 9361 | MIOB2679 | 9421 | MIOB2771 | 9481 | MIOB2861 | 9541 | miob2932 |
| 9302 | MIOB2600 | 9362 | MIOB2682 | 9422 | miob2776n | 9482 | MIOB2862 | 9542 | miob2933 |
| 9303 | MIOB2601 | 9363 | MIOB2683 | 9423 | MIOB2780 | 9483 | MIOB2864 | 9543 | miob2934 |
| 9304 | MIOB2602 | 9364 | MIOB2684 | 9424 | MIOB2781 | 9484 | MIOB2865 | 9544 | miob2935 |
| 9305 | MIOB2603 | 9365 | MIOB2685 | 9425 | MIOB2787 | 9485 | MIOB2866 | 9545 | miob2936 |
| 9306 | MIOB2605 | 9366 | MIOB2686 | 9426 | MIOB2788 | 9486 | MIOB2867 | 9546 | miob2937 |
| 9307 | MIOB2606 | 9367 | MIOB2687 | 9427 | MIOB2789 | 9487 | MIOB2868 | 9547 | miob2938 |
| 9308 | miob2607 | 9368 | MIOB2688 | 9428 | MIOB2795 | 9488 | MIOB2869 | 9548 | miob2939 |
| 9309 | MIOB2609 | 9369 | MIOB2691 | 9429 | MIOB2796 | 9489 | MIOB2870 | 9549 | miob2941 |
| 9310 | MIOB2610 | 9370 | MIOB2692 | 9430 | MIOB2798 | 9490 | MIOB2872 | 9550 | miob2942 |
| 9311 | MIOB2611 | 9371 | MIOB2693 | 9431 | miob2800 | 9491 | MIOB2874 | 9551 | miob2943 |
| 9312 | MIOB2612 | 9372 | MIOB2695 | 9432 | MIOB2802 | 9492 | MIOB2875 | 9552 | miob2944 |
| 9313 | MIOB2613 | 9373 | MIOB2698 | 9433 | MIOB2803 | 9493 | miob2876 | 9553 | miob2945 |
| 9314 | MIOB2615 | 9374 | MIOB2699 | 9434 | MIOB2804 | 9494 | miob2877 | 9554 | miob2946 |
| 9315 | MIOB2616 | 9375 | MIOB2700 | 9435 | MIOB2805 | 9495 | miob2878 | 9555 | miob2947 |
| 9316 | MIOB2617 | 9376 | MIOB2701 | 9436 | MIOB2806 | 9496 | miob2879 | 9556 | miob2948 |
| 9317 | MIOB2619 | 9377 | MIOB2703 | 9437 | MIOB2807 | 9497 | miob2881 | 9557 | miob2949 |
| 9318 | MIOB2620 | 9378 | MIOB2705 | 9438 | MIOB2808 | 9498 | miob2882 | 9558 | miob2950 |
| 9319 | MIOB2621 | 9379 | MIOB2707 | 9439 | miob2810n | 9499 | miob2883 | 9559 | miob2951 |
| 9320 | MIOB2622 | 9380 | MIOB2708 | 9440 | MIOB2811 | 9500 | miob2884 | 9560 | miob2952 |
| 9321 | MIOB2623 | 9381 | MIOB2709 | 9441 | MIOB2812 | 9501 | miob2885 | 9561 | miob2953 |
| 9322 | miob2624 | 9382 | MIOB2711 | 9442 | MIOB2814 | 9502 | miob2886 | 9562 | miob2954 |
| 9323 | MIOB2626 | 9383 | MIOB2712 | 9443 | MIOB2817 | 9503 | miob2887 | 9563 | miob2955 |
| 9324 | MIOB2627 | 9384 | MIOB2714 | 9444 | MIOB2818 | 9504 | miob2888 | 9564 | miob2956 |
| 9325 | miob2629 | 9385 | MIOB2715 | 9445 | MIOB2819 | 9505 | miob2889 | 9565 | miob2957 |
| 9326 | MIOB2630 | 9386 | MIOB2716 | 9446 | MIOB2821 | 9506 | miob2896 | 9566 | miob2958 |
| 9327 | MIOB2631 | 9387 | MIOB2717 | 9447 | MIOB2822 | 9507 | miob2897 | 9567 | miob2959 |
| 9328 | MIOB2634 | 9388 | MIOB2718 | 9448 | MIOB2823 | 9508 | miob2898 | 9568 | miob2960 |
| 9329 | MIOB2635 | 9389 | MIOB2720 | 9449 | MIOB2824 | 9509 | miob2899 | 9569 | miob2961 |
| 9330 | MIOB2636 | 9390 | MIOB2721 | 9450 | MIOB2825 | 9510 | miob2900 | 9570 | miob2962 |
| 9331 | miob2639n | 9391 | MIOB2723 | 9451 | MIOB2826 | 9511 | miob2901 | 9571 | miob2963 |
| 9332 | MIOB2641 | 9392 | MIOB2724 | 9452 | MIOB2827 | 9512 | miob2902 | 9572 | miob2964 |
| 9333 | MIOB2642 | 9393 | MIOB2725 | 9453 | MIOB2828 | 9513 | miob2903 | 9573 | miob2965 |
| 9334 | MIOB2643 | 9394 | MIOB2727 | 9454 | MIOB2829 | 9514 | miob2904 | 9574 | miob2966 |
| 9335 | MIOB2644 | 9395 | MIOB2728 | 9455 | MIOB2831 | 9515 | miob2905 | 9575 | miob2967 |
| 9336 | MIOB2645 | 9396 | MIOB2731 | 9456 | MIOB2833 | 9516 | miob2906 | 9576 | miob2968 |
| 9337 | MIOB2646 | 9397 | MIOB2733 | 9457 | MIOB2834 | 9517 | miob2907 | 9577 | miob2969 |
| 9338 | miob2647 | 9398 | MIOB2735 | 9458 | MIOB2835 | 9518 | miob2908 | 9578 | miob2970 |
| 9339 | MIOB2648 | 9399 | MIOB2736 | 9459 | MIOB2836 | 9519 | miob2909 | 9579 | miob2971 |
| 9340 | MIOB2650 | 9400 | MIOB2737 | 9460 | MIOB2837 | 9520 | miob2910 | 9580 | miob2972 |
| 9341 | MIOB2651 | 9401 | MIOB2739 | 9461 | miob2839n | 9521 | miob2911 | 9581 | miob2973 |
| 9342 | MIOB2652 | 9402 | MIOB2740 | 9462 | MIOB2840 | 9522 | miob2912 | 9582 | miob2974 |
| 9343 | miob2655n | 9403 | MIOB2743 | 9463 | MIOB2841 | 9523 | miob2913 | 9583 | miob2975 |
| 9344 | MIOB2656 | 9404 | miob2744n | 9464 | MIOB2842 | 9524 | miob2914 | 9584 | miob2976 |
| 9345 | MIOB2658 | 9405 | MIOB2745 | 9465 | MIOB2843 | 9525 | miob2915 | 9585 | miob2977 |
| 9346 | MIOB2660 | 9406 | MIOB2746 | 9466 | MIOB2845 | 9526 | miob2916 | 9586 | miob2978 |
| 9347 | MIOB2664 | 9407 | MIOB2750 | 9467 | MIOB2846 | 9527 | miob2917 | 9587 | miob2979 |
| 9348 | MIOB2665 | 9408 | MIOB2751 | 9468 | MIOB2847 | 9528 | miob2918 | 9588 | miob2980 |
| 9349 | MIOB2666 | 9409 | MIOB2752 | 9469 | MIOB2849 | 9529 | miob2919 | 9589 | miob2981 |
| 9350 | MIOB2667 | 9410 | MIOB2753 | 9470 | MIOB2850 | 9530 | miob2920 | 9590 | miob2982 |
| 9351 | MIOB2668 | 9411 | MIOB2754 | 9471 | MIOB2851 | 9531 | miob2921 | 9591 | miob2984 |
| 9352 | MIOB2669 | 9412 | miob2755n | 9472 | MIOB2852 | 9532 | miob2922 | 9592 | miob2985 |
| 9353 | MIOB2670 | 9413 | MIOB2756 | 9473 | MIOB2853 | 9533 | miob2923 | 9593 | miob2986 |
| 9354 | MIOB2671 | 9414 | MIOB2757 | 9474 | MIOB2854 | 9534 | miob2925 | 9594 | miob2987 |
| 9355 | miob2672n | 9415 | MIOB2759 | 9475 | MIOB2855 | 9535 | miob2926 | 9595 | miob2988 |
| 9356 | MIOB2673 | 9416 | MIOB2761 | 9476 | MIOB2856 | 9536 | miob2927 | 9596 | miob2989 |
| 9357 | MIOB2674 | 9417 | MIOB2762 | 9477 | MIOB2857 | 9537 | miob2928 | 9597 | miob2990 |
| 9358 | MIOB2675 | 9418 | MIOB2763 | 9478 | MIOB2858 | 9538 | miob2929 | 9598 | miob2991 |
| 9359 | MIOB2676 | 9419 | MIOB2768 | 9479 | MIOB2859 | 9539 | miob2930 | 9599 | miob2992 |
| 9360 | miob2677n | 9420 | MIOB2770 | 9480 | MIOB2860 | 9540 | miob2931 | 9600 | miob2993 |

Figure 6D – List of EST Sequence Names From Mild OA Cartilage cDNA Library

| | | | | | | | | | |
|---|---|---|---|---|---|---|---|---|---|
| 9601 | miob2994 | 9661 | miob3059 | 9721 | miob3132 | 9781 | miob3194 | 9841 | miob3257 |
| 9602 | miob2995 | 9662 | miob3060 | 9722 | miob3133 | 9782 | miob3195 | 9842 | miob3258 |
| 9603 | miob2996 | 9663 | miob3062 | 9723 | miob3134 | 9783 | miob3196 | 9843 | miob3259 |
| 9604 | miob2997 | 9664 | miob3063 | 9724 | miob3135 | 9784 | miob3197 | 9844 | miob3261 |
| 9605 | miob2998 | 9665 | miob3064 | 9725 | miob3137 | 9785 | miob3198 | 9845 | miob3262 |
| 9606 | miob2999 | 9666 | miob3065 | 9726 | miob3138 | 9786 | miob3199 | 9846 | miob3263 |
| 9607 | miob3001 | 9667 | miob3066 | 9727 | miob3139 | 9787 | miob3200 | 9847 | miob3264 |
| 9608 | miob3002 | 9668 | miob3068 | 9728 | miob3140 | 9788 | miob3201 | 9848 | miob3265 |
| 9609 | miob3003 | 9669 | miob3069 | 9729 | miob3141 | 9789 | miob3202 | 9849 | miob3266 |
| 9610 | miob3004 | 9670 | miob3070 | 9730 | miob3142 | 9790 | miob3203 | 9850 | miob3267 |
| 9611 | miob3005 | 9671 | miob3071 | 9731 | miob3143 | 9791 | miob3204 | 9851 | miob3268 |
| 9612 | miob3007 | 9672 | miob3072 | 9732 | miob3144 | 9792 | miob3205 | 9852 | miob3269 |
| 9613 | miob3008 | 9673 | miob3073 | 9733 | miob3145 | 9793 | miob3206 | 9853 | miob3270 |
| 9614 | miob3009 | 9674 | miob3074 | 9734 | miob3146 | 9794 | miob3207 | 9854 | miob3271 |
| 9615 | miob3010 | 9675 | miob3075 | 9735 | miob3147 | 9795 | miob3208 | 9855 | miob3272 |
| 9616 | miob3011 | 9676 | miob3076 | 9736 | miob3148 | 9796 | miob3209 | 9856 | miob3273 |
| 9617 | miob3012 | 9677 | miob3077 | 9737 | miob3149 | 9797 | miob3210 | 9857 | miob3275 |
| 9618 | miob3013 | 9678 | miob3078 | 9738 | miob3150 | 9798 | miob3211 | 9858 | miob3276 |
| 9619 | miob3014 | 9679 | miob3079 | 9739 | miob3151 | 9799 | miob3212 | 9859 | miob3278 |
| 9620 | miob3015 | 9680 | miob3080 | 9740 | miob3152 | 9800 | miob3213 | 9860 | miob3279 |
| 9621 | miob3016 | 9681 | miob3081 | 9741 | miob3153 | 9801 | miob3214 | 9861 | miob3280 |
| 9622 | miob3017 | 9682 | miob3082 | 9742 | miob3155 | 9802 | miob3215 | 9862 | miob3281 |
| 9623 | miob3018 | 9683 | miob3083 | 9743 | miob3156 | 9803 | miob3216 | 9863 | miob3283 |
| 9624 | miob3019 | 9684 | miob3084 | 9744 | miob3157 | 9804 | miob3217 | 9864 | miob3284 |
| 9625 | miob3020 | 9685 | miob3085 | 9745 | miob3158 | 9805 | miob3218 | 9865 | miob3285 |
| 9626 | miob3021 | 9686 | miob3086 | 9746 | miob3159 | 9806 | miob3219 | 9866 | miob3286 |
| 9627 | miob3022 | 9687 | miob3088 | 9747 | miob3160 | 9807 | miob3220 | 9867 | miob3287 |
| 9628 | miob3024 | 9688 | miob3089 | 9748 | miob3161 | 9808 | miob3221 | 9868 | miob3288 |
| 9629 | miob3025 | 9689 | miob3090 | 9749 | miob3162 | 9809 | miob3222 | 9869 | miob3289 |
| 9630 | miob3026 | 9690 | miob3091 | 9750 | miob3163 | 9810 | miob3223 | 9870 | miob3290 |
| 9631 | miob3027 | 9691 | miob3092 | 9751 | miob3164 | 9811 | miob3224 | 9871 | miob3291 |
| 9632 | miob3028 | 9692 | miob3093 | 9752 | miob3165 | 9812 | miob3225 | 9872 | miob3295 |
| 9633 | miob3029 | 9693 | miob3094 | 9753 | miob3166 | 9813 | miob3228 | 9873 | miob3296 |
| 9634 | miob3030 | 9694 | miob3095 | 9754 | miob3167 | 9814 | miob3229 | 9874 | miob3297 |
| 9635 | miob3032 | 9695 | miob3096 | 9755 | miob3168 | 9815 | miob3230 | 9875 | miob3298 |
| 9636 | miob3033 | 9696 | miob3097 | 9756 | miob3169 | 9816 | miob3231 | 9876 | miob3299 |
| 9637 | miob3034 | 9697 | miob3098 | 9757 | miob3170 | 9817 | miob3232 | 9877 | miob3300 |
| 9638 | miob3035 | 9698 | miob3100 | 9758 | miob3171 | 9818 | miob3233 | 9878 | miob3301 |
| 9639 | miob3036 | 9699 | miob3101 | 9759 | miob3172 | 9819 | miob3234 | 9879 | miob3306 |
| 9640 | miob3037 | 9700 | miob3102 | 9760 | miob3173 | 9820 | miob3235 | 9880 | miob3307 |
| 9641 | miob3038 | 9701 | miob3103 | 9761 | miob3174 | 9821 | miob3236 | 9881 | miob3308 |
| 9642 | miob3040 | 9702 | miob3105 | 9762 | miob3175 | 9822 | miob3238 | 9882 | miob3309 |
| 9643 | miob3041 | 9703 | miob3106 | 9763 | miob3176 | 9823 | miob3239 | 9883 | miob3310 |
| 9644 | miob3042 | 9704 | miob3107 | 9764 | miob3177 | 9824 | miob3240 | 9884 | miob3311 |
| 9645 | miob3043 | 9705 | miob3113 | 9765 | miob3178 | 9825 | miob3241 | 9885 | miob3312 |
| 9646 | miob3044 | 9706 | miob3116 | 9766 | miob3179 | 9826 | miob3242 | 9886 | miob3313 |
| 9647 | miob3045 | 9707 | miob3117 | 9767 | miob3180 | 9827 | miob3243 | 9887 | miob3314 |
| 9648 | miob3046 | 9708 | miob3118 | 9768 | miob3181 | 9828 | miob3244 | 9888 | miob3315 |
| 9649 | miob3047 | 9709 | miob3119 | 9769 | miob3182 | 9829 | miob3245 | 9889 | miob3316 |
| 9650 | miob3048 | 9710 | miob3120 | 9770 | miob3183 | 9830 | miob3246 | 9890 | miob3317 |
| 9651 | miob3049 | 9711 | miob3121 | 9771 | miob3184 | 9831 | miob3247 | 9891 | miob3319 |
| 9652 | miob3050 | 9712 | miob3122 | 9772 | miob3185 | 9832 | miob3248 | 9892 | miob3320 |
| 9653 | miob3051 | 9713 | miob3124 | 9773 | miob3186 | 9833 | miob3249 | 9893 | miob3321 |
| 9654 | miob3052 | 9714 | miob3125 | 9774 | miob3187 | 9834 | miob3250 | 9894 | miob3322 |
| 9655 | miob3053 | 9715 | miob3126 | 9775 | miob3188 | 9835 | miob3251 | 9895 | miob3323 |
| 9656 | miob3054 | 9716 | miob3127 | 9776 | miob3189 | 9836 | miob3252 | 9896 | miob3324 |
| 9657 | miob3055 | 9717 | miob3128 | 9777 | miob3190 | 9837 | miob3253 | 9897 | miob3325 |
| 9658 | miob3056 | 9718 | miob3129 | 9778 | miob3191 | 9838 | miob3254 | 9898 | miob3326 |
| 9659 | miob3057 | 9719 | miob3130 | 9779 | miob3192 | 9839 | miob3255 | 9899 | miob3328 |
| 9660 | miob3058 | 9720 | miob3131 | 9780 | miob3193 | 9840 | miob3256 | 9900 | miob3329 |

Figure 6D – List of EST Sequence Names From Mild OA Cartilage cDNA Library

| | | | | | | | | | |
|---|---|---|---|---|---|---|---|---|---|
| 9901 | miob3330 | 9961 | miob3399 | 10021 | miob3463 | 10081 | miob3583 | 10141 | miob3657 |
| 9902 | miob3331 | 9962 | miob3401 | 10022 | miob3464 | 10082 | miob3586 | 10142 | miob3658 |
| 9903 | miob3333 | 9963 | miob3402 | 10023 | miob3465 | 10083 | miob3588 | 10143 | miob3659 |
| 9904 | miob3334 | 9964 | miob3403 | 10024 | miob3466 | 10084 | miob3590 | 10144 | miob3660 |
| 9905 | miob3335 | 9965 | miob3404 | 10025 | miob3467 | 10085 | miob3591 | 10145 | miob3661 |
| 9906 | miob3336 | 9966 | miob3405 | 10026 | miob3468 | 10086 | miob3592 | 10146 | miob3662 |
| 9907 | miob3337 | 9967 | miob3406 | 10027 | miob3469 | 10087 | miob3593 | 10147 | miob3663 |
| 9908 | miob3338 | 9968 | miob3407 | 10028 | miob3470 | 10088 | miob3594 | 10148 | miob3664 |
| 9909 | miob3339 | 9969 | miob3408 | 10029 | miob3471 | 10089 | miob3595 | 10149 | miob3665 |
| 9910 | miob3340 | 9970 | miob3410 | 10030 | miob3472 | 10090 | miob3596 | 10150 | miob3666 |
| 9911 | miob3342 | 9971 | miob3411 | 10031 | miob3473 | 10091 | miob3597 | 10151 | miob3668 |
| 9912 | miob3344 | 9972 | miob3412 | 10032 | miob3474 | 10092 | miob3598 | 10152 | miob3669 |
| 9913 | miob3345 | 9973 | miob3413 | 10033 | miob3475 | 10093 | miob3600 | 10153 | miob3672 |
| 9914 | miob3348 | 9974 | miob3414 | 10034 | miob3476 | 10094 | miob3601 | 10154 | miob3674 |
| 9915 | miob3349 | 9975 | miob3415 | 10035 | miob3477 | 10095 | miob3602 | 10155 | miob3676 |
| 9916 | miob3350 | 9976 | miob3416 | 10036 | miob3478 | 10096 | miob3604 | 10156 | miob3677 |
| 9917 | miob3351 | 9977 | miob3417 | 10037 | miob3479 | 10097 | miob3605 | 10157 | miob3678 |
| 9918 | miob3352 | 9978 | miob3418 | 10038 | miob3480 | 10098 | miob3606 | 10158 | miob3679 |
| 9919 | miob3353 | 9979 | miob3419 | 10039 | miob3482 | 10099 | miob3608 | 10159 | miob3680 |
| 9920 | miob3354 | 9980 | miob3420 | 10040 | miob3483 | 10100 | miob3609 | 10160 | miob3681 |
| 9921 | miob3355 | 9981 | miob3421 | 10041 | miob3484 | 10101 | miob3610 | 10161 | miob3682 |
| 9922 | miob3356 | 9982 | miob3423 | 10042 | miob3485 | 10102 | miob3611 | 10162 | miob3683 |
| 9923 | miob3357 | 9983 | miob3424 | 10043 | miob3486 | 10103 | miob3612 | 10163 | miob3684 |
| 9924 | miob3358 | 9984 | miob3425 | 10044 | miob3487 | 10104 | miob3613 | 10164 | miob3687 |
| 9925 | miob3359 | 9985 | miob3426 | 10045 | miob3488 | 10105 | miob3614 | 10165 | miob3688 |
| 9926 | miob3360 | 9986 | miob3427 | 10046 | miob3489 | 10106 | miob3617 | 10166 | miob3689 |
| 9927 | miob3361 | 9987 | miob3428 | 10047 | miob3491 | 10107 | miob3618 | 10167 | miob3690 |
| 9928 | miob3363 | 9988 | miob3429 | 10048 | miob3492 | 10108 | miob3619 | 10168 | miob3691 |
| 9929 | miob3364 | 9989 | miob3430 | 10049 | miob3493 | 10109 | miob3620 | 10169 | miob3692 |
| 9930 | miob3365 | 9990 | miob3431 | 10050 | miob3494 | 10110 | miob3621 | 10170 | miob3693 |
| 9931 | miob3366 | 9991 | miob3432 | 10051 | miob3496 | 10111 | miob3622 | 10171 | miob3695 |
| 9932 | miob3367 | 9992 | miob3433 | 10052 | miob3498 | 10112 | miob3623 | 10172 | miob3696 |
| 9933 | miob3368 | 9993 | miob3434 | 10053 | miob3501 | 10113 | miob3624 | 10173 | miob3697 |
| 9934 | miob3369 | 9994 | miob3435 | 10054 | miob3502 | 10114 | miob3625 | 10174 | miob3698 |
| 9935 | miob3370 | 9995 | miob3437 | 10055 | miob3507 | 10115 | miob3626 | 10175 | miob3700 |
| 9936 | miob3371 | 9996 | miob3438 | 10056 | miob3508 | 10116 | miob3627 | 10176 | miob3701 |
| 9937 | miob3372 | 9997 | miob3439 | 10057 | miob3531 | 10117 | miob3628 | 10177 | miob3702 |
| 9938 | miob3373 | 9998 | miob3440 | 10058 | miob3532 | 10118 | miob3629 | 10178 | miob3703 |
| 9939 | miob3374 | 9999 | miob3441 | 10059 | miob3534 | 10119 | miob3630 | 10179 | miob3704 |
| 9940 | miob3375 | 10000 | miob3442 | 10060 | miob3537 | 10120 | miob3631 | 10180 | miob3705 |
| 9941 | miob3376 | 10001 | miob3443 | 10061 | miob3540 | 10121 | miob3632 | 10181 | miob3706 |
| 9942 | miob3377 | 10002 | miob3444 | 10062 | miob3542 | 10122 | miob3634 | 10182 | miob3707 |
| 9943 | miob3378 | 10003 | miob3445 | 10063 | miob3546 | 10123 | miob3636 | 10183 | miob3708 |
| 9944 | miob3380 | 10004 | miob3446 | 10064 | miob3547 | 10124 | miob3637 | 10184 | miob3709 |
| 9945 | miob3381 | 10005 | miob3447 | 10065 | miob3548 | 10125 | miob3638 | 10185 | miob3710 |
| 9946 | miob3382 | 10006 | miob3448 | 10066 | miob3549 | 10126 | miob3639 | 10186 | miob3712 |
| 9947 | miob3383 | 10007 | miob3449 | 10067 | miob3552 | 10127 | miob3640 | 10187 | miob3713 |
| 9948 | miob3384 | 10008 | miob3450 | 10068 | miob3553 | 10128 | miob3641 | 10188 | miob3714 |
| 9949 | miob3385 | 10009 | miob3451 | 10069 | miob3558 | 10129 | miob3642 | 10189 | miob3715 |
| 9950 | miob3386 | 10010 | miob3452 | 10070 | miob3560 | 10130 | miob3643 | 10190 | miob3716 |
| 9951 | miob3387 | 10011 | miob3453 | 10071 | miob3561 | 10131 | miob3644 | 10191 | miob3718 |
| 9952 | miob3388 | 10012 | miob3454 | 10072 | miob3562 | 10132 | miob3645 | 10192 | miob3719 |
| 9953 | miob3389 | 10013 | miob3455 | 10073 | miob3564 | 10133 | miob3646 | 10193 | miob3721 |
| 9954 | miob3391 | 10014 | miob3456 | 10074 | miob3565 | 10134 | miob3648 | 10194 | miob3722 |
| 9955 | miob3392 | 10015 | miob3457 | 10075 | miob3566 | 10135 | miob3649 | 10195 | miob3723 |
| 9956 | miob3394 | 10016 | miob3458 | 10076 | miob3567 | 10136 | miob3650 | 10196 | miob3724 |
| 9957 | miob3395 | 10017 | miob3459 | 10077 | miob3568 | 10137 | miob3651 | 10197 | miob3725 |
| 9958 | miob3396 | 10018 | miob3460 | 10078 | miob3571 | 10138 | miob3652 | 10198 | miob3726 |
| 9959 | miob3397 | 10019 | miob3461 | 10079 | miob3573 | 10139 | miob3655 | 10199 | miob3727 |
| 9960 | miob3398 | 10020 | miob3462 | 10080 | miob3577 | 10140 | miob3656 | 10200 | miob3728 |

Figure 6D – List of EST Sequence Names From Mild OA Cartilage cDNA Library

| | | | | | | | | | |
|---|---|---|---|---|---|---|---|---|---|
| 10201 | miob3729 | 10261 | miob3802 | 10321 | miob3870 | 10381 | miob3934 | 10441 | miob4001 |
| 10202 | miob3731 | 10262 | miob3803 | 10322 | miob3871 | 10382 | miob3935 | 10442 | miob4002 |
| 10203 | miob3732 | 10263 | miob3804 | 10323 | miob3872 | 10383 | miob3937 | 10443 | miob4003 |
| 10204 | miob3733 | 10264 | miob3805 | 10324 | miob3873 | 10384 | miob3938 | 10444 | miob4004 |
| 10205 | miob3735 | 10265 | miob3808 | 10325 | miob3874 | 10385 | miob3939 | 10445 | miob4005 |
| 10206 | miob3736 | 10266 | miob3809 | 10326 | miob3875 | 10386 | miob3940 | 10446 | miob4006 |
| 10207 | miob3739 | 10267 | miob3810 | 10327 | miob3876 | 10387 | miob3941 | 10447 | miob4007 |
| 10208 | miob3741 | 10268 | miob3811 | 10328 | miob3877 | 10388 | miob3942 | 10448 | miob4008 |
| 10209 | miob3742 | 10269 | miob3812 | 10329 | miob3878 | 10389 | miob3943 | 10449 | miob4009 |
| 10210 | miob3743 | 10270 | miob3813 | 10330 | miob3879 | 10390 | miob3944 | 10450 | miob4010 |
| 10211 | miob3744 | 10271 | miob3814 | 10331 | miob3880 | 10391 | miob3945 | 10451 | miob4011 |
| 10212 | miob3745 | 10272 | miob3816 | 10332 | miob3881 | 10392 | miob3946 | 10452 | miob4012 |
| 10213 | miob3746 | 10273 | miob3818 | 10333 | miob3882 | 10393 | miob3947 | 10453 | miob4013 |
| 10214 | miob3748 | 10274 | miob3819 | 10334 | miob3883 | 10394 | miob3948 | 10454 | miob4014 |
| 10215 | miob3749 | 10275 | miob3820 | 10335 | miob3884 | 10395 | miob3950 | 10455 | miob4015 |
| 10216 | miob3750 | 10276 | miob3821 | 10336 | miob3885 | 10396 | miob3951 | 10456 | miob4016 |
| 10217 | miob3751 | 10277 | miob3822 | 10337 | miob3886 | 10397 | miob3952 | 10457 | miob4017 |
| 10218 | miob3752 | 10278 | miob3823 | 10338 | miob3887 | 10398 | miob3953 | 10458 | miob4019 |
| 10219 | miob3753 | 10279 | miob3824 | 10339 | miob3888 | 10399 | miob3954 | 10459 | miob4020 |
| 10220 | miob3754 | 10280 | miob3825 | 10340 | miob3889 | 10400 | miob3955 | 10460 | miob4021 |
| 10221 | miob3755 | 10281 | miob3826 | 10341 | miob3890 | 10401 | miob3956 | 10461 | miob4022 |
| 10222 | miob3756 | 10282 | miob3828 | 10342 | miob3891 | 10402 | miob3958 | 10462 | miob4023 |
| 10223 | miob3757 | 10283 | miob3829 | 10343 | miob3892 | 10403 | miob3959 | 10463 | miob4024 |
| 10224 | miob3758 | 10284 | miob3830 | 10344 | miob3893 | 10404 | miob3960 | 10464 | miob4025 |
| 10225 | miob3759 | 10285 | miob3831 | 10345 | miob3894 | 10405 | miob3961 | 10465 | miob4026 |
| 10226 | miob3760 | 10286 | miob3832 | 10346 | miob3895 | 10406 | miob3962 | 10466 | miob4027 |
| 10227 | miob3761 | 10287 | miob3833 | 10347 | miob3896 | 10407 | miob3963 | 10467 | miob4028 |
| 10228 | miob3762 | 10288 | miob3834 | 10348 | miob3897 | 10408 | miob3964 | 10468 | miob4029 |
| 10229 | miob3763 | 10289 | miob3835 | 10349 | miob3898 | 10409 | miob3965 | 10469 | miob4030 |
| 10230 | miob3765 | 10290 | miob3836 | 10350 | miob3899 | 10410 | miob3966 | 10470 | miob4031 |
| 10231 | miob3766 | 10291 | miob3837 | 10351 | miob3900 | 10411 | miob3967 | 10471 | miob4032 |
| 10232 | miob3767 | 10292 | miob3838 | 10352 | miob3901 | 10412 | miob3968 | 10472 | miob4033 |
| 10233 | miob3768 | 10293 | miob3839 | 10353 | miob3902 | 10413 | miob3969 | 10473 | miob4034 |
| 10234 | miob3769 | 10294 | miob3840 | 10354 | miob3904 | 10414 | miob3970 | 10474 | miob4035 |
| 10235 | miob3770 | 10295 | miob3841 | 10355 | miob3905 | 10415 | miob3972 | 10475 | miob4036 |
| 10236 | miob3771 | 10296 | miob3842 | 10356 | miob3906 | 10416 | miob3973 | 10476 | miob4037 |
| 10237 | miob3773 | 10297 | miob3843 | 10357 | miob3907 | 10417 | miob3974 | 10477 | miob4038 |
| 10238 | miob3774 | 10298 | miob3844 | 10358 | miob3908 | 10418 | miob3975 | 10478 | miob4039 |
| 10239 | miob3775 | 10299 | miob3845 | 10359 | miob3909 | 10419 | miob3976 | 10479 | miob4040 |
| 10240 | miob3776 | 10300 | miob3846 | 10360 | miob3910 | 10420 | miob3977 | 10480 | miob4043 |
| 10241 | miob3777 | 10301 | miob3847 | 10361 | miob3911 | 10421 | miob3978 | 10481 | miob4045 |
| 10242 | miob3778 | 10302 | miob3848 | 10362 | miob3912 | 10422 | miob3979 | 10482 | miob4046 |
| 10243 | miob3779 | 10303 | miob3849 | 10363 | miob3913 | 10423 | miob3980 | 10483 | miob4047 |
| 10244 | miob3781 | 10304 | miob3850 | 10364 | miob3914 | 10424 | miob3981 | 10484 | miob4048 |
| 10245 | miob3782 | 10305 | miob3851 | 10365 | miob3915 | 10425 | miob3982 | 10485 | miob4049 |
| 10246 | miob3784 | 10306 | miob3853 | 10366 | miob3916 | 10426 | miob3983 | 10486 | miob4050 |
| 10247 | miob3785 | 10307 | miob3854 | 10367 | miob3917 | 10427 | miob3984 | 10487 | miob4051 |
| 10248 | miob3787 | 10308 | miob3855 | 10368 | miob3918 | 10428 | miob3985 | 10488 | miob4052 |
| 10249 | miob3788 | 10309 | miob3856 | 10369 | miob3919 | 10429 | miob3986 | 10489 | miob4053 |
| 10250 | miob3789 | 10310 | miob3857 | 10370 | miob3920 | 10430 | miob3987 | 10490 | miob4054 |
| 10251 | miob3790 | 10311 | miob3858 | 10371 | miob3921 | 10431 | miob3988 | 10491 | miob4055 |
| 10252 | miob3791 | 10312 | miob3859 | 10372 | miob3923 | 10432 | miob3989 | 10492 | miob4056 |
| 10253 | miob3792 | 10313 | miob3860 | 10373 | miob3925 | 10433 | miob3990 | 10493 | miob4057 |
| 10254 | miob3793 | 10314 | miob3861 | 10374 | miob3926 | 10434 | miob3991 | 10494 | miob4058 |
| 10255 | miob3794 | 10315 | miob3862 | 10375 | miob3927 | 10435 | miob3992 | 10495 | miob4059 |
| 10256 | miob3796 | 10316 | miob3863 | 10376 | miob3928 | 10436 | miob3993 | 10496 | miob4060 |
| 10257 | miob3797 | 10317 | miob3865 | 10377 | miob3929 | 10437 | miob3994 | 10497 | miob4061 |
| 10258 | miob3798 | 10318 | miob3867 | 10378 | miob3930 | 10438 | miob3995 | 10498 | miob4062 |
| 10259 | miob3799 | 10319 | miob3868 | 10379 | miob3932 | 10439 | miob3996 | 10499 | miob4064 |
| 10260 | miob3800 | 10320 | miob3869 | 10380 | miob3933 | 10440 | miob4000 | 10500 | miob4065 |

Figure 6D - List of EST Sequence Names From Mild OA Cartilage cDNA Library

| | | | | | | | | | |
|---|---|---|---|---|---|---|---|---|---|
| 10501 | miob4066 | 10561 | miob4134 | 10621 | miob4202 | 10681 | miob4270 | 10741 | miob4340 |
| 10502 | miob4067 | 10562 | miob4135 | 10622 | miob4203 | 10682 | miob4271 | 10742 | miob4341 |
| 10503 | miob4068 | 10563 | miob4136 | 10623 | miob4204 | 10683 | miob4272 | 10743 | miob4342 |
| 10504 | miob4069 | 10564 | miob4137 | 10624 | miob4205 | 10684 | miob4273 | 10744 | miob4343 |
| 10505 | miob4070 | 10565 | miob4138 | 10625 | miob4206 | 10685 | miob4274 | 10745 | miob4344 |
| 10506 | miob4071 | 10566 | miob4139 | 10626 | miob4207 | 10686 | miob4275 | 10746 | miob4345 |
| 10507 | miob4073 | 10567 | miob4140 | 10627 | miob4208 | 10687 | miob4276 | 10747 | miob4346 |
| 10508 | miob4074 | 10568 | miob4141 | 10628 | miob4210 | 10688 | miob4277 | 10748 | miob4347 |
| 10509 | miob4075 | 10569 | miob4142 | 10629 | miob4211 | 10689 | miob4278 | 10749 | miob4349 |
| 10510 | miob4076 | 10570 | miob4143 | 10630 | miob4212 | 10690 | miob4279 | 10750 | miob4351 |
| 10511 | miob4077 | 10571 | miob4144 | 10631 | miob4213 | 10691 | miob4280 | 10751 | miob4352 |
| 10512 | miob4078 | 10572 | miob4145 | 10632 | miob4214 | 10692 | miob4281 | 10752 | miob4353 |
| 10513 | miob4079 | 10573 | miob4146 | 10633 | miob4217 | 10693 | miob4282 | 10753 | miob4354 |
| 10514 | miob4080 | 10574 | miob4147 | 10634 | miob4218 | 10694 | miob4283 | 10754 | miob4355 |
| 10515 | miob4081 | 10575 | miob4148 | 10635 | miob4220 | 10695 | miob4285 | 10755 | miob4356 |
| 10516 | miob4082 | 10576 | miob4149 | 10636 | miob4221 | 10696 | miob4286 | 10756 | miob4357 |
| 10517 | miob4083 | 10577 | miob4150 | 10637 | miob4222 | 10697 | miob4289 | 10757 | miob4358 |
| 10518 | miob4084 | 10578 | miob4151 | 10638 | miob4223 | 10698 | miob4290 | 10758 | miob4359 |
| 10519 | miob4085 | 10579 | miob4152 | 10639 | miob4224 | 10699 | miob4291 | 10759 | miob4360 |
| 10520 | miob4086 | 10580 | miob4153 | 10640 | miob4225 | 10700 | miob4292 | 10760 | miob4361 |
| 10521 | miob4087 | 10581 | miob4154 | 10641 | miob4226 | 10701 | miob4293 | 10761 | miob4362 |
| 10522 | miob4088 | 10582 | miob4156 | 10642 | miob4227 | 10702 | miob4294 | 10762 | miob4363 |
| 10523 | miob4089 | 10583 | miob4157 | 10643 | miob4228 | 10703 | miob4295 | 10763 | miob4364 |
| 10524 | miob4090 | 10584 | miob4158 | 10644 | miob4229 | 10704 | miob4296 | 10764 | miob4365 |
| 10525 | miob4091 | 10585 | miob4159 | 10645 | miob4230 | 10705 | miob4297 | 10765 | miob4367 |
| 10526 | miob4092 | 10586 | miob4160 | 10646 | miob4231 | 10706 | miob4298 | 10766 | miob4368 |
| 10527 | miob4093 | 10587 | miob4162 | 10647 | miob4232 | 10707 | miob4300 | 10767 | miob4369 |
| 10528 | miob4094 | 10588 | miob4163 | 10648 | miob4234 | 10708 | miob4302 | 10768 | miob4370 |
| 10529 | miob4096 | 10589 | miob4165 | 10649 | miob4235 | 10709 | miob4303 | 10769 | miob4371 |
| 10530 | miob4097 | 10590 | miob4166 | 10650 | miob4236 | 10710 | miob4305 | 10770 | miob4373 |
| 10531 | miob4098 | 10591 | miob4167 | 10651 | miob4237 | 10711 | miob4306 | 10771 | miob4374 |
| 10532 | miob4099 | 10592 | miob4168 | 10652 | miob4238 | 10712 | miob4307 | 10772 | miob4377 |
| 10533 | miob4100 | 10593 | miob4169 | 10653 | miob4239 | 10713 | miob4308 | 10773 | miob4378 |
| 10534 | miob4101 | 10594 | miob4171 | 10654 | miob4240 | 10714 | miob4309 | 10774 | miob4380 |
| 10535 | miob4102 | 10595 | miob4172 | 10655 | miob4242 | 10715 | miob4310 | 10775 | miob4381 |
| 10536 | miob4103 | 10596 | miob4173 | 10656 | miob4243 | 10716 | miob4311 | 10776 | miob4382 |
| 10537 | miob4104 | 10597 | miob4174 | 10657 | miob4244 | 10717 | miob4312 | 10777 | miob4384 |
| 10538 | miob4106 | 10598 | miob4175 | 10658 | miob4245 | 10718 | miob4313 | 10778 | miob4385 |
| 10539 | miob4108 | 10599 | miob4176 | 10659 | miob4246 | 10719 | miob4314 | 10779 | miob4386 |
| 10540 | miob4109 | 10600 | miob4177 | 10660 | miob4248 | 10720 | miob4315 | 10780 | miob4387 |
| 10541 | miob4110 | 10601 | miob4178 | 10661 | miob4249 | 10721 | miob4316 | 10781 | miob4389 |
| 10542 | miob4111 | 10602 | miob4181 | 10662 | miob4250 | 10722 | miob4317 | 10782 | miob4390 |
| 10543 | miob4112 | 10603 | miob4182 | 10663 | miob4251 | 10723 | miob4318 | 10783 | miob4391 |
| 10544 | miob4114 | 10604 | miob4183 | 10664 | miob4252 | 10724 | miob4320 | 10784 | miob4392 |
| 10545 | miob4116 | 10605 | miob4184 | 10665 | miob4253 | 10725 | miob4321 | 10785 | miob4394 |
| 10546 | miob4117 | 10606 | miob4185 | 10666 | miob4254 | 10726 | miob4322 | 10786 | miob4395 |
| 10547 | miob4119 | 10607 | miob4186 | 10667 | miob4255 | 10727 | miob4323 | 10787 | miob4396 |
| 10548 | miob4120 | 10608 | miob4187 | 10668 | miob4257 | 10728 | miob4324 | 10788 | miob4397 |
| 10549 | miob4121 | 10609 | miob4188 | 10669 | miob4258 | 10729 | miob4326 | 10789 | miob4398 |
| 10550 | miob4122 | 10610 | miob4189 | 10670 | miob4259 | 10730 | miob4328 | 10790 | miob4399 |
| 10551 | miob4124 | 10611 | miob4190 | 10671 | miob4260 | 10731 | miob4329 | 10791 | miob4400 |
| 10552 | miob4125 | 10612 | miob4192 | 10672 | miob4261 | 10732 | miob4330 | 10792 | miob4401 |
| 10553 | miob4126 | 10613 | miob4194 | 10673 | miob4262 | 10733 | miob4331 | 10793 | miob4402 |
| 10554 | miob4127 | 10614 | miob4195 | 10674 | miob4263 | 10734 | miob4332 | 10794 | miob4403 |
| 10555 | miob4128 | 10615 | miob4196 | 10675 | miob4264 | 10735 | miob4333 | 10795 | miob4404 |
| 10556 | miob4129 | 10616 | miob4197 | 10676 | miob4265 | 10736 | miob4334 | 10796 | miob4405 |
| 10557 | miob4130 | 10617 | miob4198 | 10677 | miob4266 | 10737 | miob4335 | 10797 | miob4406 |
| 10558 | miob4131 | 10618 | miob4199 | 10678 | miob4267 | 10738 | miob4336 | 10798 | miob4407 |
| 10559 | miob4132 | 10619 | miob4200 | 10679 | miob4268 | 10739 | miob4338 | 10799 | miob4408 |
| 10560 | miob4133 | 10620 | miob4201 | 10680 | miob4269 | 10740 | miob4339 | 10800 | miob4409 |

Figure 6D – List of EST Sequence Names From Mild OA Cartilage cDNA Library

| | | | | | | | | | |
|---|---|---|---|---|---|---|---|---|---|
| 10801 | miob4410 | 10861 | miob4481 | 10921 | miob4566 | 10981 | miob4634 | 11041 | miob4701 |
| 10802 | miob4411 | 10862 | miob4482 | 10922 | miob4567 | 10982 | miob4635 | 11042 | miob4702 |
| 10803 | miob4412 | 10863 | miob4483 | 10923 | miob4568 | 10983 | miob4636 | 11043 | miob4703 |
| 10804 | miob4413 | 10864 | miob4484 | 10924 | miob4569 | 10984 | miob4637 | 11044 | miob4704 |
| 10805 | miob4414 | 10865 | miob4485 | 10925 | miob4570 | 10985 | miob4639 | 11045 | miob4705 |
| 10806 | miob4415 | 10866 | miob4487 | 10926 | miob4572 | 10986 | miob4641 | 11046 | miob4708 |
| 10807 | miob4416 | 10867 | miob4488 | 10927 | miob4573 | 10987 | miob4642 | 11047 | miob4709 |
| 10808 | miob4417 | 10868 | miob4489 | 10928 | miob4574 | 10988 | miob4643 | 11048 | miob4710 |
| 10809 | miob4418 | 10869 | miob4490 | 10929 | miob4575 | 10989 | miob4644 | 11049 | miob4712 |
| 10810 | miob4419 | 10870 | miob4492 | 10930 | miob4576 | 10990 | miob4645 | 11050 | miob4713 |
| 10811 | miob4420 | 10871 | miob4494 | 10931 | miob4577 | 10991 | miob4646 | 11051 | miob4714 |
| 10812 | miob4421 | 10872 | miob4495 | 10932 | miob4578 | 10992 | miob4648 | 11052 | miob4715 |
| 10813 | miob4422 | 10873 | miob4496 | 10933 | miob4579 | 10993 | miob4649 | 11053 | miob4716 |
| 10814 | miob4423 | 10874 | miob4500 | 10934 | miob4580 | 10994 | miob4651 | 11054 | miob4717 |
| 10815 | miob4424 | 10875 | miob4501 | 10935 | miob4581 | 10995 | miob4652 | 11055 | miob4719 |
| 10816 | miob4425 | 10876 | miob4503 | 10936 | miob4582 | 10996 | miob4653 | 11056 | miob4720 |
| 10817 | miob4427 | 10877 | miob4504 | 10937 | miob4583 | 10997 | miob4654 | 11057 | miob4721 |
| 10818 | miob4428 | 10878 | miob4505 | 10938 | miob4584 | 10998 | miob4655 | 11058 | miob4722 |
| 10819 | miob4429 | 10879 | miob4506 | 10939 | miob4586 | 10999 | miob4656 | 11059 | miob4723 |
| 10820 | miob4430 | 10880 | miob4507 | 10940 | miob4588 | 11000 | miob4657 | 11060 | miob4724 |
| 10821 | miob4431 | 10881 | miob4508 | 10941 | miob4589 | 11001 | miob4658 | 11061 | miob4725 |
| 10822 | miob4433 | 10882 | miob4509 | 10942 | miob4590 | 11002 | miob4659 | 11062 | miob4726 |
| 10823 | miob4434 | 10883 | miob4511 | 10943 | miob4591 | 11003 | miob4661 | 11063 | miob4727 |
| 10824 | miob4435 | 10884 | miob4512 | 10944 | miob4592 | 11004 | miob4662 | 11064 | miob4729 |
| 10825 | miob4436 | 10885 | miob4513 | 10945 | miob4593 | 11005 | miob4663 | 11065 | miob4730 |
| 10826 | miob4437 | 10886 | miob4514 | 10946 | miob4594 | 11006 | miob4664 | 11066 | miob4733 |
| 10827 | miob4438 | 10887 | miob4516 | 10947 | miob4595 | 11007 | miob4665 | 11067 | miob4735 |
| 10828 | miob4439 | 10888 | miob4518 | 10948 | miob4596 | 11008 | miob4666 | 11068 | miob4736 |
| 10829 | miob4440 | 10889 | miob4520 | 10949 | miob4597 | 11009 | miob4667 | 11069 | miob4737 |
| 10830 | miob4441 | 10890 | miob4521 | 10950 | miob4598 | 11010 | miob4668 | 11070 | miob4738 |
| 10831 | miob4442 | 10891 | miob4522 | 10951 | miob4599 | 11011 | miob4669 | 11071 | miob4739 |
| 10832 | miob4443 | 10892 | miob4524 | 10952 | miob4600 | 11012 | miob4670 | 11072 | miob4740 |
| 10833 | miob4444 | 10893 | miob4526 | 10953 | miob4601 | 11013 | miob4671 | 11073 | miob4741 |
| 10834 | miob4445 | 10894 | miob4527 | 10954 | miob4602 | 11014 | miob4672 | 11074 | miob4742 |
| 10835 | miob4446 | 10895 | miob4528 | 10955 | miob4603 | 11015 | miob4673 | 11075 | miob4743 |
| 10836 | miob4447 | 10896 | miob4529 | 10956 | miob4604 | 11016 | miob4674 | 11076 | miob4744 |
| 10837 | miob4448 | 10897 | miob4530 | 10957 | miob4606 | 11017 | miob4675 | 11077 | miob4745 |
| 10838 | miob4451 | 10898 | miob4531 | 10958 | miob4607 | 11018 | miob4676 | 11078 | miob4746 |
| 10839 | miob4452 | 10899 | miob4535 | 10959 | miob4608 | 11019 | miob4677 | 11079 | miob4748 |
| 10840 | miob4456 | 10900 | miob4536 | 10960 | miob4609 | 11020 | miob4678 | 11080 | miob4750 |
| 10841 | miob4457 | 10901 | miob4538 | 10961 | miob4610 | 11021 | miob4679 | 11081 | miob4751 |
| 10842 | miob4458 | 10902 | miob4540 | 10962 | miob4611 | 11022 | miob4680 | 11082 | miob4752 |
| 10843 | miob4459 | 10903 | miob4541 | 10963 | miob4612 | 11023 | miob4681 | 11083 | miob4753 |
| 10844 | miob4460 | 10904 | miob4542 | 10964 | miob4613 | 11024 | miob4682 | 11084 | miob4754 |
| 10845 | miob4462 | 10905 | miob4543 | 10965 | miob4615 | 11025 | miob4684 | 11085 | miob4755 |
| 10846 | miob4463 | 10906 | miob4545 | 10966 | miob4616 | 11026 | miob4685 | 11086 | miob4756 |
| 10847 | miob4464 | 10907 | miob4547 | 10967 | miob4617 | 11027 | miob4686 | 11087 | miob4757 |
| 10848 | miob4465 | 10908 | miob4549 | 10968 | miob4619 | 11028 | miob4687 | 11088 | miob4758 |
| 10849 | miob4466 | 10909 | miob4550 | 10969 | miob4620 | 11029 | miob4688 | 11089 | miob4759 |
| 10850 | miob4467 | 10910 | miob4551 | 10970 | miob4621 | 11030 | miob4689 | 11090 | miob4760 |
| 10851 | miob4468 | 10911 | miob4554 | 10971 | miob4622 | 11031 | miob4690 | 11091 | miob4761 |
| 10852 | miob4469 | 10912 | miob4555 | 10972 | miob4623 | 11032 | miob4691 | 11092 | miob4762 |
| 10853 | miob4470 | 10913 | miob4556 | 10973 | miob4624 | 11033 | miob4692 | 11093 | miob4763 |
| 10854 | miob4471 | 10914 | miob4557 | 10974 | miob4625 | 11034 | miob4693 | 11094 | miob4764 |
| 10855 | miob4473 | 10915 | miob4558 | 10975 | miob4627 | 11035 | miob4694 | 11095 | miob4765 |
| 10856 | miob4475 | 10916 | miob4559 | 10976 | miob4628 | 11036 | miob4695 | 11096 | miob4767 |
| 10857 | miob4476 | 10917 | miob4561 | 10977 | miob4629 | 11037 | miob4696 | 11097 | miob4768 |
| 10858 | miob4477 | 10918 | miob4563 | 10978 | miob4630 | 11038 | miob4697 | 11098 | miob4770 |
| 10859 | miob4478 | 10919 | miob4564 | 10979 | miob4631 | 11039 | miob4699 | 11099 | miob4772 |
| 10860 | miob4480 | 10920 | miob4565 | 10980 | miob4633 | 11040 | miob4700 | 11100 | miob4773 |

Figure 6D - List of EST Sequence Names From Mild OA Cartilage cDNA Library

| | | | | | | | | | |
|---|---|---|---|---|---|---|---|---|---|
| 11101 | miob4774 | 11161 | miob4847 | 11221 | miob4918 | 11281 | miob4991 | 11341 | miob5063 |
| 11102 | miob4775 | 11162 | miob4848 | 11222 | miob4919 | 11282 | miob4992 | 11342 | miob5065 |
| 11103 | miob4776 | 11163 | miob4849 | 11223 | miob4920 | 11283 | miob4993 | 11343 | miob5066 |
| 11104 | miob4777 | 11164 | miob4850 | 11224 | miob4923 | 11284 | miob4994 | 11344 | miob5067 |
| 11105 | miob4778 | 11165 | miob4851 | 11225 | miob4924 | 11285 | miob4995 | 11345 | miob5068 |
| 11106 | miob4779 | 11166 | miob4852 | 11226 | miob4925 | 11286 | miob4996 | 11346 | miob5069 |
| 11107 | miob4780 | 11167 | miob4853 | 11227 | miob4926 | 11287 | miob4997 | 11347 | miob5071 |
| 11108 | miob4781 | 11168 | miob4854 | 11228 | miob4927 | 11288 | miob4998 | 11348 | miob5072 |
| 11109 | miob4782 | 11169 | miob4855 | 11229 | miob4928 | 11289 | miob4999 | 11349 | miob5073 |
| 11110 | miob4783 | 11170 | miob4856 | 11230 | miob4929 | 11290 | miob5000 | 11350 | miob5074 |
| 11111 | miob4784 | 11171 | miob4857 | 11231 | miob4930 | 11291 | miob5001 | 11351 | miob5076 |
| 11112 | miob4786 | 11172 | miob4858 | 11232 | miob4931 | 11292 | miob5003 | 11352 | miob5077 |
| 11113 | miob4787 | 11173 | miob4859 | 11233 | miob4932 | 11293 | miob5004 | 11353 | miob5079 |
| 11114 | miob4788 | 11174 | miob4860 | 11234 | miob4933 | 11294 | miob5005 | 11354 | miob5080 |
| 11115 | miob4791 | 11175 | miob4861 | 11235 | miob4934 | 11295 | miob5006 | 11355 | miob5081 |
| 11116 | miob4792 | 11176 | miob4862 | 11236 | miob4935 | 11296 | miob5007 | 11356 | miob5082 |
| 11117 | miob4793 | 11177 | miob4863 | 11237 | miob4936 | 11297 | miob5008 | 11357 | miob5083 |
| 11118 | miob4794 | 11178 | miob4864 | 11238 | miob4937 | 11298 | miob5009 | 11358 | miob5087 |
| 11119 | miob4796 | 11179 | miob4866 | 11239 | miob4938 | 11299 | miob5010 | 11359 | miob5089 |
| 11120 | miob4797 | 11180 | miob4867 | 11240 | miob4939 | 11300 | miob5011 | 11360 | miob5090 |
| 11121 | miob4798 | 11181 | miob4869 | 11241 | miob4940 | 11301 | miob5012 | 11361 | miob5091 |
| 11122 | miob4801 | 11182 | miob4870 | 11242 | miob4945 | 11302 | miob5013 | 11362 | miob5092 |
| 11123 | miob4802 | 11183 | miob4871 | 11243 | miob4948 | 11303 | miob5014 | 11363 | miob5093 |
| 11124 | miob4803 | 11184 | miob4872 | 11244 | miob4949 | 11304 | miob5015 | 11364 | miob5094 |
| 11125 | miob4806 | 11185 | miob4873 | 11245 | miob4950 | 11305 | miob5016 | 11365 | miob5095 |
| 11126 | miob4807 | 11186 | miob4874 | 11246 | miob4952 | 11306 | miob5018 | 11366 | miob5098 |
| 11127 | miob4808 | 11187 | miob4875 | 11247 | miob4953 | 11307 | miob5019 | 11367 | miob5099 |
| 11128 | miob4809 | 11188 | miob4876 | 11248 | miob4954 | 11308 | miob5020 | 11368 | miob5100 |
| 11129 | miob4810 | 11189 | miob4877 | 11249 | miob4955 | 11309 | miob5021 | 11369 | miob5101 |
| 11130 | miob4811 | 11190 | miob4878 | 11250 | miob4956 | 11310 | miob5022 | 11370 | miob5102 |
| 11131 | miob4812 | 11191 | miob4879 | 11251 | miob4957 | 11311 | miob5025 | 11371 | miob5104 |
| 11132 | miob4813 | 11192 | miob4882 | 11252 | miob4958 | 11312 | miob5026 | 11372 | miob5105 |
| 11133 | miob4815 | 11193 | miob4883 | 11253 | miob4959 | 11313 | miob5028 | 11373 | miob5107 |
| 11134 | miob4816 | 11194 | miob4884 | 11254 | miob4960 | 11314 | miob5029 | 11374 | miob5108 |
| 11135 | miob4817 | 11195 | miob4885 | 11255 | miob4961 | 11315 | miob5031 | 11375 | miob5109 |
| 11136 | miob4818 | 11196 | miob4886 | 11256 | miob4963 | 11316 | miob5032 | 11376 | miob5110 |
| 11137 | miob4819 | 11197 | miob4887 | 11257 | miob4964 | 11317 | miob5034 | 11377 | miob5111 |
| 11138 | miob4820 | 11198 | miob4889 | 11258 | miob4965 | 11318 | miob5035 | 11378 | miob5112 |
| 11139 | miob4821 | 11199 | miob4890 | 11259 | miob4966 | 11319 | miob5036 | 11379 | miob5114 |
| 11140 | miob4822 | 11200 | miob4891 | 11260 | miob4967 | 11320 | miob5037 | 11380 | miob5115 |
| 11141 | miob4824 | 11201 | miob4892 | 11261 | miob4968 | 11321 | miob5038 | 11381 | miob5116 |
| 11142 | miob4825 | 11202 | miob4893 | 11262 | miob4969 | 11322 | miob5040 | 11382 | miob5117 |
| 11143 | miob4826 | 11203 | miob4894 | 11263 | miob4970 | 11323 | miob5041 | 11383 | miob5118 |
| 11144 | miob4828 | 11204 | miob4895 | 11264 | miob4971 | 11324 | miob5043 | 11384 | miob5119 |
| 11145 | miob4830 | 11205 | miob4896 | 11265 | miob4973 | 11325 | miob5044 | 11385 | miob5120 |
| 11146 | miob4832 | 11206 | miob4897 | 11266 | miob4974 | 11326 | miob5045 | 11386 | miob5122 |
| 11147 | miob4833 | 11207 | miob4899 | 11267 | miob4975 | 11327 | miob5046 | 11387 | miob5123 |
| 11148 | miob4834 | 11208 | miob4900 | 11268 | miob4976 | 11328 | miob5047 | 11388 | miob5124 |
| 11149 | miob4835 | 11209 | miob4902 | 11269 | miob4977 | 11329 | miob5048 | 11389 | miob5125 |
| 11150 | miob4836 | 11210 | miob4906 | 11270 | miob4978 | 11330 | miob5049 | 11390 | miob5126 |
| 11151 | miob4837 | 11211 | miob4907 | 11271 | miob4979 | 11331 | miob5050 | 11391 | miob5127 |
| 11152 | miob4838 | 11212 | miob4908 | 11272 | miob4980 | 11332 | miob5051 | 11392 | miob5128 |
| 11153 | miob4839 | 11213 | miob4909 | 11273 | miob4981 | 11333 | miob5054 | 11393 | miob5129 |
| 11154 | miob4840 | 11214 | miob4910 | 11274 | miob4983 | 11334 | miob5055 | 11394 | miob5410 |
| 11155 | miob4841 | 11215 | miob4911 | 11275 | miob4984 | 11335 | miob5056 | 11395 | miob5411 |
| 11156 | miob4842 | 11216 | miob4912 | 11276 | miob4985 | 11336 | miob5057 | 11396 | miob5412 |
| 11157 | miob4843 | 11217 | miob4913 | 11277 | miob4987 | 11337 | miob5059 | 11397 | miob5414 |
| 11158 | miob4844 | 11218 | miob4914 | 11278 | miob4988 | 11338 | miob5060 | 11398 | miob5415 |
| 11159 | miob4845 | 11219 | miob4915 | 11279 | miob4989 | 11339 | miob5061 | 11399 | miob5417 |
| 11160 | miob4846 | 11220 | miob4917 | 11280 | miob4990 | 11340 | miob5062 | 11400 | miob5418 |

Figure 6D – List of EST Sequence Names From Mild OA Cartilage cDNA Library

| | | | | | | | | | |
|---|---|---|---|---|---|---|---|---|---|
| 11401 | miob5420 | 11461 | miob5499 | 11521 | miob5665 | 11581 | miob5733 | 11641 | miob5802 |
| 11402 | miob5422 | 11462 | miob5500 | 11522 | miob5666 | 11582 | miob5734 | 11642 | miob5803 |
| 11403 | miob5424 | 11463 | miob5502 | 11523 | miob5667 | 11583 | miob5735 | 11643 | miob5804 |
| 11404 | miob5425 | 11464 | miob5504 | 11524 | miob5668 | 11584 | miob5736 | 11644 | miob5806 |
| 11405 | miob5426 | 11465 | miob5505 | 11525 | miob5669 | 11585 | miob5739 | 11645 | miob5808 |
| 11406 | miob5427 | 11466 | miob5602 | 11526 | miob5670 | 11586 | miob5740 | 11646 | miob5809 |
| 11407 | miob5428 | 11467 | miob5604 | 11527 | miob5671 | 11587 | miob5741 | 11647 | miob5810 |
| 11408 | miob5429 | 11468 | miob5605 | 11528 | miob5672 | 11588 | miob5743 | 11648 | miob5812 |
| 11409 | miob5430 | 11469 | miob5606 | 11529 | miob5673 | 11589 | miob5744 | 11649 | miob5813 |
| 11410 | miob5431 | 11470 | miob5607 | 11530 | miob5674 | 11590 | miob5745 | 11650 | miob5814 |
| 11411 | miob5432 | 11471 | miob5608 | 11531 | miob5675 | 11591 | miob5746 | 11651 | miob5815 |
| 11412 | miob5434 | 11472 | miob5609 | 11532 | miob5676 | 11592 | miob5747 | 11652 | miob5816 |
| 11413 | miob5435 | 11473 | miob5610 | 11533 | miob5677 | 11593 | miob5748 | 11653 | miob5817 |
| 11414 | miob5436 | 11474 | miob5611 | 11534 | miob5678 | 11594 | miob5749 | 11654 | miob5818 |
| 11415 | miob5437 | 11475 | miob5612 | 11535 | miob5679 | 11595 | miob5750 | 11655 | miob5819 |
| 11416 | miob5439 | 11476 | miob5613 | 11536 | miob5680 | 11596 | miob5751 | 11656 | miob5820 |
| 11417 | miob5440 | 11477 | miob5614 | 11537 | miob5681 | 11597 | miob5752 | 11657 | miob5821 |
| 11418 | miob5443 | 11478 | miob5615 | 11538 | miob5683 | 11598 | miob5753 | 11658 | miob5822 |
| 11419 | miob5444 | 11479 | miob5616 | 11539 | miob5684 | 11599 | miob5754 | 11659 | miob5824 |
| 11420 | miob5445 | 11480 | miob5617 | 11540 | miob5685 | 11600 | miob5755 | 11660 | miob5825 |
| 11421 | miob5446 | 11481 | miob5618 | 11541 | miob5686 | 11601 | miob5757 | 11661 | miob5826 |
| 11422 | miob5447 | 11482 | miob5621 | 11542 | miob5687 | 11602 | miob5758 | 11662 | miob5827 |
| 11423 | miob5448 | 11483 | miob5622 | 11543 | miob5688 | 11603 | miob5759 | 11663 | miob5828 |
| 11424 | miob5449 | 11484 | miob5623 | 11544 | miob5690 | 11604 | miob5760 | 11664 | miob5829 |
| 11425 | miob5451 | 11485 | miob5624 | 11545 | miob5691 | 11605 | miob5761 | 11665 | miob5830 |
| 11426 | miob5452 | 11486 | miob5625 | 11546 | miob5692 | 11606 | miob5762 | 11666 | miob5832 |
| 11427 | miob5453 | 11487 | miob5626 | 11547 | miob5694 | 11607 | miob5763 | 11667 | miob5833 |
| 11428 | miob5454 | 11488 | miob5627 | 11548 | miob5695 | 11608 | miob5764 | 11668 | miob5834 |
| 11429 | miob5456 | 11489 | miob5628 | 11549 | miob5696 | 11609 | miob5765 | 11669 | miob5835 |
| 11430 | miob5458 | 11490 | miob5629 | 11550 | miob5697 | 11610 | miob5766 | 11670 | miob5836 |
| 11431 | miob5459 | 11491 | miob5630 | 11551 | miob5698 | 11611 | miob5769 | 11671 | miob5837 |
| 11432 | miob5460 | 11492 | miob5632 | 11552 | miob5699 | 11612 | miob5770 | 11672 | miob5839 |
| 11433 | miob5461 | 11493 | miob5633 | 11553 | miob5700 | 11613 | miob5771 | 11673 | miob5840 |
| 11434 | miob5462 | 11494 | miob5635 | 11554 | miob5701 | 11614 | miob5772 | 11674 | miob5841 |
| 11435 | miob5463 | 11495 | miob5636 | 11555 | miob5702 | 11615 | miob5773 | 11675 | miob5842 |
| 11436 | miob5464 | 11496 | miob5638 | 11556 | miob5703 | 11616 | miob5774 | 11676 | miob5843 |
| 11437 | miob5465 | 11497 | miob5639 | 11557 | miob5704 | 11617 | miob5775 | 11677 | miob5844 |
| 11438 | miob5467 | 11498 | miob5640 | 11558 | miob5705 | 11618 | miob5776 | 11678 | miob5845 |
| 11439 | miob5469 | 11499 | miob5641 | 11559 | miob5706 | 11619 | miob5777 | 11679 | miob5846 |
| 11440 | miob5470 | 11500 | miob5642 | 11560 | miob5707 | 11620 | miob5778 | 11680 | miob5847 |
| 11441 | miob5472 | 11501 | miob5643 | 11561 | miob5708 | 11621 | miob5779 | 11681 | miob5848 |
| 11442 | miob5474 | 11502 | miob5644 | 11562 | miob5709 | 11622 | miob5780 | 11682 | miob5849 |
| 11443 | miob5475 | 11503 | miob5645 | 11563 | miob5710 | 11623 | miob5781 | 11683 | miob5850 |
| 11444 | miob5476 | 11504 | miob5646 | 11564 | miob5712 | 11624 | miob5782 | 11684 | miob5851 |
| 11445 | miob5477 | 11505 | miob5647 | 11565 | miob5713 | 11625 | miob5783 | 11685 | miob5852 |
| 11446 | miob5478 | 11506 | miob5648 | 11566 | miob5714 | 11626 | miob5784 | 11686 | miob5853 |
| 11447 | miob5479 | 11507 | miob5649 | 11567 | miob5716 | 11627 | miob5785 | 11687 | miob5854 |
| 11448 | miob5480 | 11508 | miob5650 | 11568 | miob5718 | 11628 | miob5786 | 11688 | miob5855 |
| 11449 | miob5485 | 11509 | miob5652 | 11569 | miob5719 | 11629 | miob5787 | 11689 | miob5856 |
| 11450 | miob5486 | 11510 | miob5653 | 11570 | miob5720 | 11630 | miob5788 | 11690 | miob5857 |
| 11451 | miob5487 | 11511 | miob5654 | 11571 | miob5721 | 11631 | miob5789 | 11691 | miob5858 |
| 11452 | miob5488 | 11512 | miob5655 | 11572 | miob5722 | 11632 | miob5791 | 11692 | miob5859 |
| 11453 | miob5489 | 11513 | miob5656 | 11573 | miob5723 | 11633 | miob5793 | 11693 | miob5860 |
| 11454 | miob5490 | 11514 | miob5657 | 11574 | miob5724 | 11634 | miob5794 | 11694 | miob5861 |
| 11455 | miob5491 | 11515 | miob5658 | 11575 | miob5725 | 11635 | miob5795 | 11695 | miob5862 |
| 11456 | miob5493 | 11516 | miob5659 | 11576 | miob5728 | 11636 | miob5796 | 11696 | miob5863 |
| 11457 | miob5494 | 11517 | miob5660 | 11577 | miob5729 | 11637 | miob5797 | 11697 | miob5864 |
| 11458 | miob5495 | 11518 | miob5661 | 11578 | miob5730 | 11638 | miob5798 | 11698 | miob5866 |
| 11459 | miob5496 | 11519 | miob5663 | 11579 | miob5731 | 11639 | miob5799 | 11699 | miob5867 |
| 11460 | miob5498 | 11520 | miob5664 | 11580 | miob5732 | 11640 | miob5801 | 11700 | miob5868 |

Figure 6D – List of EST Sequence Names From Mild OA Cartilage cDNA Library

| | |
|---|---|
| 11701 | miob5869 |
| 11702 | miob5870 |
| 11703 | miob5871 |
| 11704 | miob5873 |
| 11705 | miob5874 |
| 11706 | miob5875 |
| 11707 | miob5876 |
| 11708 | miob5877 |
| 11709 | miob5878 |
| 11710 | miob5879 |
| 11711 | miob5880 |
| 11712 | miob5881 |
| 11713 | miob5883 |
| 11714 | miob5884 |
| 11715 | miob5885 |
| 11716 | miob5886 |
| 11717 | miob5887 |
| 11718 | miob5888 |
| 11719 | miob5889 |
| 11720 | miob5890 |
| 11721 | miob5891 |
| 11722 | miob5892 |
| 11723 | miob5893 |
| 11724 | miob5894 |
| 11725 | miob5895 |
| 11726 | miob5896 |
| 11727 | miob5897 |
| 11728 | miob5898 |
| 11729 | miob5899 |
| 11730 | miob5900 |
| 11731 | miob5901 |
| 11732 | miob5903 |
| 11733 | miob5904 |
| 11734 | miob5905 |
| 11735 | miob5906 |
| 11736 | miob5907 |
| 11737 | miob5908 |
| 11738 | miob5909 |
| 11739 | miob5910 |
| 11740 | miob5911 |
| 11741 | miob5912 |
| 11742 | miob5913 |
| 11743 | miob5914 |
| 11744 | miob5915 |
| 11745 | miob5916 |
| 11746 | miob5917 |
| 11747 | miob5920 |
| 11748 | miob5921 |
| 11749 | miob5922 |
| 11750 | miob5923 |
| 11751 | miob5924 |
| 11752 | miob5925 |
| 11753 | miob5927 |
| 11754 | miob5928 |
| 11755 | miob5929 |
| 11756 | miob5930 |
| 11757 | miob5931 |
| 11758 | miob5932 |
| 11759 | miob5934 |
| 11760 | miob5936 |
| 11761 | miob5937 |
| 11762 | miob5938 |
| 11763 | miob5939 |
| 11764 | miob5940 |
| 11765 | miob5941 |
| 11766 | miob5942 |
| 11767 | miob5943 |
| 11768 | miob5945 |
| 11769 | miob5946 |
| 11770 | miob5947 |
| 11771 | miob5948 |
| 11772 | miob5949 |
| 11773 | miob5950 |
| 11774 | miob5951 |
| 11775 | miob5952 |
| 11776 | miob5953 |
| 11777 | miob5954 |
| 11778 | miob5955 |
| 11779 | miob5956 |
| 11780 | miob5957 |
| 11781 | miob5958 |
| 11782 | miob5959 |
| 11783 | miob5960 |
| 11784 | miob5961 |
| 11785 | miob5962 |
| 11786 | miob5963 |
| 11787 | miob5965 |
| 11788 | miob5966 |
| 11789 | miob5967 |
| 11790 | miob5968 |
| 11791 | miob5969 |
| 11792 | miob5970 |
| 11793 | miob5972 |
| 11794 | miob5973 |
| 11795 | miob5974 |
| 11796 | miob5975 |
| 11797 | miob5976 |
| 11798 | miob5977 |
| 11799 | miob5978 |
| 11800 | miob5979 |
| 11801 | miob5980 |
| 11802 | miob5981 |
| 11803 | miob5982 |
| 11804 | miob5983 |
| 11805 | miob5984 |
| 11806 | miob5985 |
| 11807 | miob5986 |
| 11808 | miob5988 |
| 11809 | miob5989 |
| 11810 | miob5992 |
| 11811 | miob5993 |
| 11812 | miob5994 |
| 11813 | miob5995 |
| 11814 | miob5996 |
| 11815 | miob5997 |
| 11816 | miob5998 |
| 11817 | miob5999 |
| 11818 | miob6000 |
| 11819 | miob6001 |
| 11820 | miob6002 |
| 11821 | miob6004 |
| 11822 | miob6005 |
| 11823 | miob6006 |
| 11824 | miob6007 |
| 11825 | miob6008 |
| 11826 | miob6009 |
| 11827 | miob6010 |
| 11828 | miob6011 |
| 11829 | miob6013 |
| 11830 | miob6014 |
| 11831 | miob6016 |
| 11832 | miob6017 |
| 11833 | miob6019 |
| 11834 | miob6021 |
| 11835 | miob6022 |
| 11836 | miob6023 |
| 11837 | miob6024 |
| 11838 | miob6025 |
| 11839 | miob6026 |
| 11840 | miob6027 |
| 11841 | miob6028 |
| 11842 | miob6029 |
| 11843 | miob6030 |
| 11844 | miob6031 |
| 11845 | miob6032 |
| 11846 | miob6034 |
| 11847 | miob6035 |
| 11848 | miob6038 |
| 11849 | miob6041 |
| 11850 | miob6042 |
| 11851 | miob6043 |
| 11852 | miob6045 |
| 11853 | miob6046 |
| 11854 | miob6047 |
| 11855 | miob6049 |
| 11856 | miob6050 |
| 11857 | miob6051 |
| 11858 | miob6052 |
| 11859 | miob6053 |
| 11860 | miob6054 |
| 11861 | miob6055 |
| 11862 | miob6056 |
| 11863 | miob6057 |
| 11864 | miob6058 |
| 11865 | miob6059 |
| 11866 | miob6061 |
| 11867 | miob6064 |
| 11868 | miob6065 |
| 11869 | miob6066 |
| 11870 | miob6067 |
| 11871 | miob6068 |
| 11872 | miob6069 |
| 11873 | miob6070 |
| 11874 | miob6071 |
| 11875 | miob6072 |
| 11876 | miob6074 |
| 11877 | miob6075 |
| 11878 | miob6076 |
| 11879 | miob6077 |
| 11880 | miob6078 |
| 11881 | miob6079 |
| 11882 | miob6080 |
| 11883 | miob6081 |
| 11884 | miob6082 |
| 11885 | miob6085 |
| 11886 | miob6086 |
| 11887 | miob6087 |
| 11888 | miob6088 |
| 11889 | miob6089 |
| 11890 | miob6090 |
| 11891 | miob6091 |
| 11892 | miob6092 |
| 11893 | miob6093 |
| 11894 | miob6095 |
| 11895 | miob6096 |
| 11896 | miob6097 |
| 11897 | miob6098 |
| 11898 | miob6099 |
| 11899 | miob6100 |
| 11900 | miob6101 |
| 11901 | miob6102 |
| 11902 | miob6103 |
| 11903 | miob6104 |
| 11904 | miob6105 |
| 11905 | miob6106 |
| 11906 | miob6107 |
| 11907 | miob6108 |
| 11908 | miob6109 |
| 11909 | miob6110 |
| 11910 | miob6112 |
| 11911 | miob6113 |
| 11912 | miob6115 |
| 11913 | miob6116 |
| 11914 | miob6117 |
| 11915 | miob6118 |
| 11916 | miob6119 |
| 11917 | miob6120 |
| 11918 | miob6121 |
| 11919 | miob6122 |
| 11920 | miob6123 |
| 11921 | miob6124 |
| 11922 | miob6125 |
| 11923 | miob6126 |
| 11924 | miob6127 |
| 11925 | miob6128 |
| 11926 | miob6129 |
| 11927 | miob6130 |
| 11928 | miob6131 |
| 11929 | miob6132 |
| 11930 | miob6134 |
| 11931 | miob6136 |
| 11932 | miob6137 |
| 11933 | miob6138 |
| 11934 | miob6139 |
| 11935 | miob6140 |
| 11936 | miob6141 |
| 11937 | miob6142 |
| 11938 | miob6143 |
| 11939 | miob6144 |
| 11940 | miob6145 |
| 11941 | miob6146 |
| 11942 | miob6147 |
| 11943 | miob6148 |
| 11944 | miob6149 |
| 11945 | miob6150 |
| 11946 | miob6151 |
| 11947 | miob6152 |
| 11948 | miob6153 |
| 11949 | miob6162 |
| 11950 | miob6163 |
| 11951 | miob6164 |
| 11952 | miob6165 |
| 11953 | miob6166 |
| 11954 | miob6168 |
| 11955 | miob6169 |
| 11956 | miob6170 |
| 11957 | miob6171 |
| 11958 | miob6172 |
| 11959 | miob6173 |
| 11960 | miob6175 |
| 11961 | miob6176 |
| 11962 | miob6177 |
| 11963 | miob6178 |
| 11964 | miob6180 |
| 11965 | miob6181 |
| 11966 | miob6182 |
| 11967 | miob6184 |
| 11968 | miob6185 |
| 11969 | miob6187 |
| 11970 | miob6188 |
| 11971 | miob6189 |
| 11972 | miob6191 |
| 11973 | miob6192 |
| 11974 | miob6193 |
| 11975 | miob6195 |
| 11976 | miob6196 |
| 11977 | miob6198 |
| 11978 | miob6199 |
| 11979 | miob6201 |
| 11980 | miob6202 |
| 11981 | miob6203 |
| 11982 | miob6204 |
| 11983 | miob6205 |
| 11984 | miob6206 |
| 11985 | miob6208 |
| 11986 | miob6209 |
| 11987 | miob6211 |
| 11988 | miob6212 |
| 11989 | miob6213 |
| 11990 | miob6215 |
| 11991 | miob6216 |
| 11992 | miob6219 |
| 11993 | miob6220 |
| 11994 | miob6221 |
| 11995 | miob6222 |
| 11996 | miob6223 |
| 11997 | miob6224 |
| 11998 | miob6226 |
| 11999 | miob6227 |
| 12000 | miob6228 |

Figure 6D - List of EST Sequence Names From Mild OA Cartilage cDNA Library

| | | | | | | | | | |
|---|---|---|---|---|---|---|---|---|---|
| 12001 | miob6229 | 12061 | miob6306 | 12121 | miob6381 | 12181 | miob6459 | 12241 | miob6534 |
| 12002 | miob6231 | 12062 | miob6307 | 12122 | miob6382 | 12182 | miob6460 | 12242 | miob6535 |
| 12003 | miob6233 | 12063 | miob6308 | 12123 | miob6384 | 12183 | miob6461 | 12243 | miob6536 |
| 12004 | miob6235 | 12064 | miob6309 | 12124 | miob6385 | 12184 | miob6462 | 12244 | miob6537 |
| 12005 | miob6236 | 12065 | miob6310 | 12125 | miob6386 | 12185 | miob6463 | 12245 | miob6538 |
| 12006 | miob6238 | 12066 | miob6312 | 12126 | miob6389 | 12186 | miob6464 | 12246 | miob6539 |
| 12007 | miob6239 | 12067 | miob6313 | 12127 | miob6390 | 12187 | miob6465 | 12247 | miob6540 |
| 12008 | miob6240 | 12068 | miob6314 | 12128 | miob6391 | 12188 | miob6466 | 12248 | miob6542 |
| 12009 | miob6242 | 12069 | miob6316 | 12129 | miob6393 | 12189 | miob6467 | 12249 | miob6543 |
| 12010 | miob6243 | 12070 | miob6317 | 12130 | miob6394 | 12190 | miob6468 | 12250 | miob6544 |
| 12011 | miob6244 | 12071 | miob6318 | 12131 | miob6395 | 12191 | miob6469 | 12251 | miob6545 |
| 12012 | miob6245 | 12072 | miob6319 | 12132 | miob6396 | 12192 | miob6470 | 12252 | miob6546 |
| 12013 | miob6246 | 12073 | miob6320 | 12133 | miob6397 | 12193 | miob6471 | 12253 | miob6547 |
| 12014 | miob6247 | 12074 | miob6321 | 12134 | miob6400 | 12194 | miob6472 | 12254 | miob6548 |
| 12015 | miob6248 | 12075 | miob6323 | 12135 | miob6401 | 12195 | miob6474 | 12255 | miob6549 |
| 12016 | miob6249 | 12076 | miob6324 | 12136 | miob6402 | 12196 | miob6475 | 12256 | miob6551 |
| 12017 | miob6251 | 12077 | miob6325 | 12137 | miob6403 | 12197 | miob6477 | 12257 | miob6552 |
| 12018 | miob6252 | 12078 | miob6326 | 12138 | miob6404 | 12198 | miob6478 | 12258 | miob6553 |
| 12019 | miob6253 | 12079 | miob6327 | 12139 | miob6405 | 12199 | miob6479 | 12259 | miob6554 |
| 12020 | miob6254 | 12080 | miob6328 | 12140 | miob6406 | 12200 | miob6480 | 12260 | miob6555 |
| 12021 | miob6255 | 12081 | miob6329 | 12141 | miob6408 | 12201 | miob6482 | 12261 | miob6556 |
| 12022 | miob6256 | 12082 | miob6330 | 12142 | miob6409 | 12202 | miob6483 | 12262 | miob6557 |
| 12023 | miob6257 | 12083 | miob6332 | 12143 | miob6410 | 12203 | miob6484 | 12263 | miob6558 |
| 12024 | miob6258 | 12084 | miob6333 | 12144 | miob6412 | 12204 | miob6485 | 12264 | miob6559 |
| 12025 | miob6259 | 12085 | miob6334 | 12145 | miob6414 | 12205 | miob6486 | 12265 | miob6560 |
| 12026 | miob6260 | 12086 | miob6335 | 12146 | miob6415 | 12206 | miob6487 | 12266 | miob6562 |
| 12027 | miob6261 | 12087 | miob6336 | 12147 | miob6417 | 12207 | miob6489 | 12267 | miob6565 |
| 12028 | miob6262 | 12088 | miob6337 | 12148 | miob6419 | 12208 | miob6490 | 12268 | miob6566 |
| 12029 | miob6263 | 12089 | miob6338 | 12149 | miob6422 | 12209 | miob6492 | 12269 | miob6567 |
| 12030 | miob6265 | 12090 | miob6340 | 12150 | miob6423 | 12210 | miob6493 | 12270 | miob6569 |
| 12031 | miob6266 | 12091 | miob6341 | 12151 | miob6424 | 12211 | miob6496 | 12271 | miob6570 |
| 12032 | miob6267 | 12092 | miob6343 | 12152 | miob6425 | 12212 | miob6497 | 12272 | miob6571 |
| 12033 | miob6268 | 12093 | miob6344 | 12153 | miob6426 | 12213 | miob6499 | 12273 | miob6572 |
| 12034 | miob6269 | 12094 | miob6345 | 12154 | miob6427 | 12214 | miob6501 | 12274 | miob6573 |
| 12035 | miob6270 | 12095 | miob6346 | 12155 | miob6429 | 12215 | miob6503 | 12275 | miob6576 |
| 12036 | miob6271 | 12096 | miob6348 | 12156 | miob6430 | 12216 | miob6504 | 12276 | miob6578 |
| 12037 | miob6272 | 12097 | miob6350 | 12157 | miob6431 | 12217 | miob6505 | 12277 | miob6579 |
| 12038 | miob6274 | 12098 | miob6351 | 12158 | miob6432 | 12218 | miob6506 | 12278 | miob6581 |
| 12039 | miob6276 | 12099 | miob6352 | 12159 | miob6433 | 12219 | miob6507 | 12279 | miob6582 |
| 12040 | miob6277 | 12100 | miob6354 | 12160 | miob6434 | 12220 | miob6508 | 12280 | miob6583 |
| 12041 | miob6279 | 12101 | miob6355 | 12161 | miob6435 | 12221 | miob6509 | 12281 | miob6586 |
| 12042 | miob6281 | 12102 | miob6356 | 12162 | miob6436 | 12222 | miob6511 | 12282 | miob6587 |
| 12043 | miob6282 | 12103 | miob6357 | 12163 | miob6437 | 12223 | miob6512 | 12283 | miob6589 |
| 12044 | miob6284 | 12104 | miob6358 | 12164 | miob6438 | 12224 | miob6513 | 12284 | miob6590 |
| 12045 | miob6285 | 12105 | miob6359 | 12165 | miob6440 | 12225 | miob6516 | 12285 | miob6592 |
| 12046 | miob6287 | 12106 | miob6360 | 12166 | miob6441 | 12226 | miob6517 | 12286 | miob6593 |
| 12047 | miob6288 | 12107 | miob6361 | 12167 | miob6442 | 12227 | miob6518 | 12287 | miob6595 |
| 12048 | miob6289 | 12108 | miob6362 | 12168 | miob6443 | 12228 | miob6519 | 12288 | miob6596 |
| 12049 | miob6290 | 12109 | miob6364 | 12169 | miob6444 | 12229 | miob6520 | 12289 | miob6597 |
| 12050 | miob6291 | 12110 | miob6365 | 12170 | miob6446 | 12230 | miob6521 | 12290 | miob6598 |
| 12051 | miob6292 | 12111 | miob6366 | 12171 | miob6447 | 12231 | miob6522 | 12291 | miob6599 |
| 12052 | miob6293 | 12112 | miob6367 | 12172 | miob6448 | 12232 | miob6523 | 12292 | miob6600 |
| 12053 | miob6295 | 12113 | miob6368 | 12173 | miob6449 | 12233 | miob6525 | 12293 | miob6601 |
| 12054 | miob6297 | 12114 | miob6370 | 12174 | miob6450 | 12234 | miob6526 | 12294 | miob6602 |
| 12055 | miob6298 | 12115 | miob6372 | 12175 | miob6451 | 12235 | miob6528 | 12295 | miob6603 |
| 12056 | miob6299 | 12116 | miob6373 | 12176 | miob6452 | 12236 | miob6529 | 12296 | miob6604 |
| 12057 | miob6301 | 12117 | miob6376 | 12177 | miob6453 | 12237 | miob6530 | 12297 | miob6605 |
| 12058 | miob6302 | 12118 | miob6377 | 12178 | miob6455 | 12238 | miob6531 | 12298 | miob6606 |
| 12059 | miob6304 | 12119 | miob6378 | 12179 | miob6456 | 12239 | miob6532 | 12299 | miob6607 |
| 12060 | miob6305 | 12120 | miob6380 | 12180 | miob6458 | 12240 | miob6533 | 12300 | miob6608 |

Figure 6D – List of EST Sequence Names From Mild OA Cartilage cDNA Library

| | | | | | | | | | |
|---|---|---|---|---|---|---|---|---|---|
| 12301 | miob6609 | 12361 | miob6678 | 12421 | miob6753 | 12481 | miob6831 | 12541 | miob6906 |
| 12302 | miob6610 | 12362 | miob6679 | 12422 | miob6756 | 12482 | miob6833 | 12542 | miob6907 |
| 12303 | miob6611 | 12363 | miob6681 | 12423 | miob6757 | 12483 | miob6834 | 12543 | miob6908 |
| 12304 | miob6612 | 12364 | miob6682 | 12424 | miob6758 | 12484 | miob6835 | 12544 | miob6909 |
| 12305 | miob6613 | 12365 | miob6684 | 12425 | miob6760 | 12485 | miob6836 | 12545 | miob6910 |
| 12306 | miob6614 | 12366 | miob6685 | 12426 | miob6761 | 12486 | miob6837 | 12546 | miob6911 |
| 12307 | miob6615 | 12367 | miob6686 | 12427 | miob6762 | 12487 | miob6838 | 12547 | miob6912 |
| 12308 | miob6616 | 12368 | miob6688 | 12428 | miob6763 | 12488 | miob6839 | 12548 | miob6913 |
| 12309 | miob6617 | 12369 | miob6690 | 12429 | miob6764 | 12489 | miob6840 | 12549 | miob6914 |
| 12310 | miob6618 | 12370 | miob6691 | 12430 | miob6765 | 12490 | miob6841 | 12550 | miob6915 |
| 12311 | miob6619 | 12371 | miob6692 | 12431 | miob6766 | 12491 | miob6842 | 12551 | miob6916 |
| 12312 | miob6620 | 12372 | miob6693 | 12432 | miob6768 | 12492 | miob6843 | 12552 | miob6917 |
| 12313 | miob6621 | 12373 | miob6695 | 12433 | miob6769 | 12493 | miob6844 | 12553 | miob6918 |
| 12314 | miob6622 | 12374 | miob6696 | 12434 | miob6770 | 12494 | miob6845 | 12554 | miob6919 |
| 12315 | miob6623 | 12375 | miob6697 | 12435 | miob6771 | 12495 | miob6846 | 12555 | miob6920 |
| 12316 | miob6625 | 12376 | miob6698 | 12436 | miob6772 | 12496 | miob6847 | 12556 | miob6921 |
| 12317 | miob6626 | 12377 | miob6699 | 12437 | miob6773 | 12497 | miob6848 | 12557 | miob6922 |
| 12318 | miob6627 | 12378 | miob6700 | 12438 | miob6774 | 12498 | miob6849 | 12558 | miob6923 |
| 12319 | miob6628 | 12379 | miob6701 | 12439 | miob6775 | 12499 | miob6852 | 12559 | miob6924 |
| 12320 | miob6629 | 12380 | miob6702 | 12440 | miob6776 | 12500 | miob6853 | 12560 | miob6926 |
| 12321 | miob6630 | 12381 | miob6704 | 12441 | miob6777 | 12501 | miob6854 | 12561 | miob6928 |
| 12322 | miob6631 | 12382 | miob6705 | 12442 | miob6778 | 12502 | miob6855 | 12562 | miob6929 |
| 12323 | miob6632 | 12383 | miob6706 | 12443 | miob6779 | 12503 | miob6857 | 12563 | miob6930 |
| 12324 | miob6633 | 12384 | miob6707 | 12444 | miob6781 | 12504 | miob6858 | 12564 | miob6932 |
| 12325 | miob6634 | 12385 | miob6708 | 12445 | miob6782 | 12505 | miob6860 | 12565 | miob6933 |
| 12326 | miob6635 | 12386 | miob6710 | 12446 | miob6784 | 12506 | miob6861 | 12566 | miob6934 |
| 12327 | miob6636 | 12387 | miob6712 | 12447 | miob6785 | 12507 | miob6862 | 12567 | miob6935 |
| 12328 | miob6637 | 12388 | miob6713 | 12448 | miob6788 | 12508 | miob6864 | 12568 | miob6937 |
| 12329 | miob6638 | 12389 | miob6714 | 12449 | miob6792 | 12509 | miob6865 | 12569 | miob6938 |
| 12330 | miob6640 | 12390 | miob6715 | 12450 | miob6794 | 12510 | miob6866 | 12570 | miob6939 |
| 12331 | miob6641 | 12391 | miob6716 | 12451 | miob6795 | 12511 | miob6868 | 12571 | miob6940 |
| 12332 | miob6643 | 12392 | miob6717 | 12452 | miob6796 | 12512 | miob6870 | 12572 | miob6944 |
| 12333 | miob6644 | 12393 | miob6718 | 12453 | miob6797 | 12513 | miob6871 | 12573 | miob6945 |
| 12334 | miob6645 | 12394 | miob6720 | 12454 | miob6798 | 12514 | miob6872 | 12574 | miob6946 |
| 12335 | miob6646 | 12395 | miob6721 | 12455 | miob6799 | 12515 | miob6873 | 12575 | miob6948 |
| 12336 | miob6648 | 12396 | miob6722 | 12456 | miob6800 | 12516 | miob6874 | 12576 | miob6949 |
| 12337 | miob6649 | 12397 | miob6723 | 12457 | miob6801 | 12517 | miob6876 | 12577 | miob6952 |
| 12338 | miob6650 | 12398 | miob6724 | 12458 | miob6802 | 12518 | miob6877 | 12578 | miob6953 |
| 12339 | miob6651 | 12399 | miob6725 | 12459 | miob6804 | 12519 | miob6878 | 12579 | miob6954 |
| 12340 | miob6652 | 12400 | miob6726 | 12460 | miob6805 | 12520 | miob6881 | 12580 | miob6955 |
| 12341 | miob6653 | 12401 | miob6727 | 12461 | miob6806 | 12521 | miob6882 | 12581 | miob6956 |
| 12342 | miob6656 | 12402 | miob6728 | 12462 | miob6807 | 12522 | miob6883 | 12582 | miob6957 |
| 12343 | miob6657 | 12403 | miob6730 | 12463 | miob6808 | 12523 | miob6884 | 12583 | miob6958 |
| 12344 | miob6658 | 12404 | miob6731 | 12464 | miob6809 | 12524 | miob6886 | 12584 | miob6959 |
| 12345 | miob6660 | 12405 | miob6732 | 12465 | miob6810 | 12525 | miob6888 | 12585 | miob6960 |
| 12346 | miob6661 | 12406 | miob6733 | 12466 | miob6811 | 12526 | miob6889 | 12586 | miob6961 |
| 12347 | miob6662 | 12407 | miob6735 | 12467 | miob6813 | 12527 | miob6890 | 12587 | miob6963 |
| 12348 | miob6664 | 12408 | miob6736 | 12468 | miob6814 | 12528 | miob6891 | 12588 | miob6964 |
| 12349 | miob6665 | 12409 | miob6737 | 12469 | miob6816 | 12529 | miob6892 | 12589 | miob6965 |
| 12350 | miob6667 | 12410 | miob6738 | 12470 | miob6817 | 12530 | miob6893 | 12590 | miob6966 |
| 12351 | miob6668 | 12411 | miob6739 | 12471 | miob6818 | 12531 | miob6894 | 12591 | miob6967 |
| 12352 | miob6669 | 12412 | miob6741 | 12472 | miob6819 | 12532 | miob6896 | 12592 | miob6968 |
| 12353 | miob6670 | 12413 | miob6742 | 12473 | miob6821 | 12533 | miob6897 | 12593 | miob6969 |
| 12354 | miob6671 | 12414 | miob6743 | 12474 | miob6822 | 12534 | miob6898 | 12594 | miob6970 |
| 12355 | miob6672 | 12415 | miob6744 | 12475 | miob6823 | 12535 | miob6899 | 12595 | miob6971 |
| 12356 | miob6673 | 12416 | miob6746 | 12476 | miob6824 | 12536 | miob6901 | 12596 | miob6972 |
| 12357 | miob6674 | 12417 | miob6747 | 12477 | miob6826 | 12537 | miob6902 | 12597 | miob6976 |
| 12358 | miob6675 | 12418 | miob6749 | 12478 | miob6827 | 12538 | miob6903 | 12598 | miob6978 |
| 12359 | miob6676 | 12419 | miob6750 | 12479 | miob6828 | 12539 | miob6904 | 12599 | miob6979 |
| 12360 | miob6677 | 12420 | miob6752 | 12480 | miob6829 | 12540 | miob6905 | 12600 | miob6980 |

Figure 6D – List of EST Sequence Names From Mild OA Cartilage cDNA Library

| | |
|---|---|
| 12601 | miob6981 |
| 12602 | miob6982 |
| 12603 | miob6983 |
| 12604 | miob6984 |
| 12605 | miob6985 |
| 12606 | miob6987 |
| 12607 | miob6988 |
| 12608 | miob6989 |
| 12609 | miob6990 |
| 12610 | miob6993 |
| 12611 | miob6995 |
| 12612 | miob6996 |
| 12613 | miob6997 |
| 12614 | miob6998 |
| 12615 | miob6999 |
| 12616 | miob7000 |
| 12617 | miob7001 |
| 12618 | miob7003 |
| 12619 | miob7004 |
| 12620 | miob7005 |
| 12621 | miob7006 |
| 12622 | miob7007 |
| 12623 | miob7008 |
| 12624 | miob7009 |
| 12625 | miob7010 |
| 12626 | miob7011 |
| 12627 | miob7012 |
| 12628 | miob7014 |
| 12629 | miob7015 |
| 12630 | miob7016 |
| 12631 | miob7017 |
| 12632 | miob7018 |
| 12633 | miob7020 |
| 12634 | miob7021 |
| 12635 | miob7022 |
| 12636 | miob7024 |
| 12637 | miob7026 |
| 12638 | miob7027 |
| 12639 | miob7028 |
| 12640 | miob7029 |
| 12641 | miob7030 |
| 12642 | miob7031 |
| 12643 | miob7032 |
| 12644 | miob7034 |
| 12645 | miob7035 |
| 12646 | miob7036 |
| 12647 | miob7037 |
| 12648 | miob7038 |
| 12649 | miob7039 |
| 12650 | miob7040 |
| 12651 | miob7041 |

Figure 6E – List of EST Sequence Names From Severe OA Cartilage cDNA Library

| | | | | | | | | | |
|---|---|---|---|---|---|---|---|---|---|
| 1 | saeoa2593m | 61 | SEOA0065 | 121 | SEOA0137 | 181 | SEOA0207a | 241 | SEOA0284n |
| 2 | seoa0002m | 62 | SEOA0066 | 122 | SEOA0138 | 182 | SEOA0208a | 242 | SEOA0285 |
| 3 | seoa0003m | 63 | SEOA0067 | 123 | SEOA0139 | 183 | SEOA0209a | 243 | SEOA0286 |
| 4 | seoa0004m | 64 | SEOA0068 | 124 | SEOA0142 | 184 | seoa0210a | 244 | SEOA0287 |
| 5 | seoa0005m | 65 | SEOA0069 | 125 | SEOA0143 | 185 | SEOA0211a | 245 | SEOA0288 |
| 6 | seoa0006m | 66 | SEOA0070 | 126 | SEOA0144 | 186 | seoa0212a | 246 | SEOA0289 |
| 7 | seoa0007m | 67 | SEOA0071 | 127 | SEOA0145 | 187 | SEOA0213a | 247 | seoa0290 |
| 8 | seoa0008m | 68 | SEOA0072 | 128 | SEOA0146 | 188 | SEOA0216a | 248 | SEOA0291 |
| 9 | seoa0009m | 69 | SEOA0074 | 129 | SEOA0147 | 189 | SEOA0217a | 249 | SEOA0293 |
| 10 | seoa0010m | 70 | SEOA0075n | 130 | seoa0148m | 190 | SEOA0218a | 250 | SEOA0294 |
| 11 | seoa0012m | 71 | SEOA0076 | 131 | SEOA0149 | 191 | SEOA0219a | 251 | SEOA0295 |
| 12 | seoa0013m | 72 | SEOA0078 | 132 | SEOA0150 | 192 | SEOA0221a | 252 | SEOA0296 |
| 13 | SEOA0014 | 73 | SEOA0079 | 133 | SEOA0152 | 193 | SEOA0224a | 253 | SEOA0297 |
| 14 | SEOA0015 | 74 | SEOA0080 | 134 | SEOA0154 | 194 | SEOA0226a | 254 | SEOA0301 |
| 15 | SEOA0017 | 75 | SEOA0081 | 135 | SEOA0155 | 195 | SEOA0228a | 255 | SEOA0302 |
| 16 | SEOA0018 | 76 | SEOA0082 | 136 | SEOA0156 | 196 | SEOA0231a | 256 | SEOA0304n |
| 17 | SEOA0019 | 77 | SEOA0083 | 137 | SEOA0157 | 197 | SEOA0234a | 257 | SEOA0306 |
| 18 | SEOA0020 | 78 | SEOA0084 | 138 | SEOA0158 | 198 | SEOA0235a | 258 | SEOA0307 |
| 19 | SEOA0021 | 79 | SEOA0085 | 139 | SEOA0159 | 199 | SEOA0236a | 259 | SEOA0308 |
| 20 | SEOA0022 | 80 | SEOA0086 | 140 | SEOA0160 | 200 | seoa0237a | 260 | SEOA0309 |
| 21 | SEOA0023 | 81 | SEOA0088 | 141 | seoa0161a | 201 | SEOA0238a | 261 | SEOA0310 |
| 22 | SEOA0024 | 82 | SEOA0089n | 142 | SEOA0162a | 202 | SEOA0239a | 262 | SEOA0311 |
| 23 | SEOA0025 | 83 | SEOA0090n | 143 | SEOA0163a | 203 | SEOA0240a | 263 | SEOA0312 |
| 24 | seoa0027 | 84 | SEOA0091n | 144 | SEOA0164a | 204 | SEOA0243a | 264 | SEOA0313 |
| 25 | SEOA0028 | 85 | seoa0093m | 145 | SEOA0166a | 205 | SEOA0244a | 265 | SEOA0314 |
| 26 | SEOA0029 | 86 | seoa0094m | 146 | SEOA0167a | 206 | SEOA0245a | 266 | SEOA0315n |
| 27 | SEOA0030 | 87 | seoa0095m | 147 | SEOA0168a | 207 | SEOA0246a | 267 | SEOA0316 |
| 28 | SEOA0031 | 88 | SEOA0096n | 148 | SEOA0169a | 208 | SEOA0247a | 268 | SEOA0317 |
| 29 | SEOA0032 | 89 | seoa0097m | 149 | SEOA0170a | 209 | SEOA0248a | 269 | SEOA0318 |
| 30 | SEOA0033 | 90 | SEOA0099 | 150 | SEOA0171a | 210 | SEOA0249a | 270 | SEOA0319 |
| 31 | seoa0034m | 91 | SEOA0100 | 151 | SEOA0172a | 211 | SEOA0250a | 271 | SEOA0320 |
| 32 | SEOA0035 | 92 | SEOA0101 | 152 | SEOA0174a | 212 | SEOA0251a | 272 | SEOA0321 |
| 33 | SEOA0036 | 93 | seoa0102m | 153 | SEOA0175a | 213 | SEOA0252a | 273 | SEOA0323 |
| 34 | SEOA0037 | 94 | SEOA0103 | 154 | SEOA0176a | 214 | SEOA0254a | 274 | SEOA0324 |
| 35 | SEOA0038 | 95 | seoa0106n | 155 | SEOA0177a | 215 | SEOA0255a | 275 | SEOA0325 |
| 36 | SEOA0039 | 96 | SEOA0107 | 156 | SEOA0179a | 216 | SEOA0256a | 276 | SEOA0326n |
| 37 | SEOA0040 | 97 | SEOA0108 | 157 | SEOA0180a | 217 | seoa0257m | 277 | SEOA0328 |
| 38 | SEOA0041n | 98 | SEOA0109n | 158 | seoa0182a | 218 | seoa0259m | 278 | SEOA0329n |
| 39 | SEOA0042 | 99 | SEOA0110n | 159 | seoa0183a | 219 | seoa0260m | 279 | SEOA0331 |
| 40 | SEOA0043 | 100 | SEOA0111 | 160 | SEOA0184a | 220 | seoa0261m | 280 | SEOA0333n |
| 41 | SEOA0044n | 101 | SEOA0112 | 161 | SEOA0185a | 221 | seoa0262m | 281 | SEOA0334 |
| 42 | SEOA0045n | 102 | SEOA0114 | 162 | SEOA0186a | 222 | seoa0263m | 282 | SEOA0335 |
| 43 | SEOA0046 | 103 | SEOA0115 | 163 | SEOA0187a | 223 | seoa0264m | 283 | SEOA0336 |
| 44 | SEOA0047 | 104 | SEOA0116 | 164 | SEOA0188A | 224 | seoa0265m | 284 | SEOA0337 |
| 45 | SEOA0048 | 105 | SEOA0117 | 165 | SEOA0189A | 225 | seoa0266m | 285 | SEOA0338 |
| 46 | SEOA0049 | 106 | SEOA0118 | 166 | SEOA0190A | 226 | seoa0268m | 286 | seoa0339m |
| 47 | SEOA0050 | 107 | SEOA0121 | 167 | SEOA0191A | 227 | seoa0269m | 287 | seoa0340m |
| 48 | SEOA0051 | 108 | SEOA0122 | 168 | SEOA0193A | 228 | seoa0270m | 288 | seoa0342m |
| 49 | SEOA0052n | 109 | SEOA0123n | 169 | SEOA0194A | 229 | SEOA0271 | 289 | seoa0343m |
| 50 | SEOA0053 | 110 | seoa0124nn | 170 | SEOA0195A | 230 | SEOA0272 | 290 | seoa0344m |
| 51 | SEOA0054 | 111 | SEOA0125 | 171 | SEOA0196A | 231 | SEOA0274 | 291 | seoa0345m |
| 52 | seoa0055 | 112 | SEOA0126 | 172 | SEOA0197A | 232 | SEOA0275 | 292 | seoa0347m |
| 53 | SEOA0056 | 113 | SEOA0127 | 173 | SEOA0198A | 233 | seoa0276 | 293 | seoa0348m |
| 54 | SEOA0057 | 114 | SEOA0129 | 174 | SEOA0200A | 234 | seoa0277 | 294 | seoa0349m |
| 55 | SEOA0058 | 115 | SEOA0130 | 175 | seoa0201a | 235 | SEOA0278n | 295 | seoa0352m |
| 56 | SEOA0059 | 116 | SEOA0131 | 176 | SEOA0202A | 236 | SEOA0279 | 296 | SEOA0353 |
| 57 | SEOA0060 | 117 | SEOA0133 | 177 | seoa0203a | 237 | SEOA0280 | 297 | SEOA0354 |
| 58 | SEOA0061 | 118 | SEOA0134 | 178 | SEOA0204A | 238 | seoa0281 | 298 | SEOA0356 |
| 59 | seoa0062m | 119 | SEOA0135 | 179 | SEOA0205A | 239 | SEOA0282 | 299 | SEOA0357 |
| 60 | SEOA0064 | 120 | SEOA0136 | 180 | SEOA0206a | 240 | SEOA0283 | 300 | SEOA0360 |

Figure 6E – List of EST Sequence Names From Severe OA Cartilage cDNA Library

| | | | | | | | | | |
|---|---|---|---|---|---|---|---|---|---|
| 301 | SEOA0361 | 361 | SEOA0432 | 421 | SEOA0500 | 481 | SEOA0576n | 541 | seoa0766m |
| 302 | SEOA0362 | 362 | SEOA0433 | 422 | SEOA0501 | 482 | SEOA0577 | 542 | seoa0767m |
| 303 | SEOA0363 | 363 | seoa0434m | 423 | SEOA0502 | 483 | seoa0579n | 543 | SEOA0769 |
| 304 | SEOA0364 | 364 | SEOA0435 | 424 | SEOA0505 | 484 | SEOA0580 | 544 | SEOA0770 |
| 305 | SEOA0366 | 365 | SEOA0436n | 425 | SEOA0506 | 485 | SEOA0581 | 545 | SEOA0771 |
| 306 | SEOA0367n | 366 | seoa0437 | 426 | SEOA0508 | 486 | SEOA0582 | 546 | SEOA0772n |
| 307 | SEOA0368 | 367 | SEOA0438 | 427 | SEOA0509 | 487 | SEOA0583 | 547 | SEOA0773 |
| 308 | SEOA0369 | 368 | SEOA0440 | 428 | SEOA0511 | 488 | SEOA0584 | 548 | SEOA0774 |
| 309 | SEOA0370 | 369 | SEOA0441n | 429 | SEOA0512 | 489 | SEOA0585 | 549 | SEOA0775 |
| 310 | SEOA0372 | 370 | seoa0442n | 430 | SEOA0513 | 490 | SEOA0587 | 550 | SEOA0777 |
| 311 | SEOA0373 | 371 | SEOA0444 | 431 | SEOA0514 | 491 | SEOA0588a | 551 | SEOA0778 |
| 312 | SEOA0374 | 372 | SEOA0445 | 432 | SEOA0515 | 492 | SEOA0589a | 552 | SEOA0779 |
| 313 | SEOA0375 | 373 | seoa0446 | 433 | seoa0516m | 493 | SEOA0590a | 553 | SEOA0780 |
| 314 | SEOA0376 | 374 | SEOA0448 | 434 | SEOA0517 | 494 | SEOA0591a | 554 | SEOA0782 |
| 315 | SEOA0377 | 375 | SEOA0449 | 435 | SEOA0518 | 495 | SEOA0592a | 555 | SEOA0783 |
| 316 | SEOA0379 | 376 | SEOA0450 | 436 | SEOA0519 | 496 | SEOA0593a | 556 | SEOA0784n |
| 317 | SEOA0380n | 377 | SEOA0451n | 437 | SEOA0520 | 497 | SEOA0596a | 557 | SEOA0785n |
| 318 | seoa0381 | 378 | SEOA0453 | 438 | SEOA0521 | 498 | SEOA0597a | 558 | SEOA0786 |
| 319 | SEOA0382 | 379 | SEOA0454 | 439 | SEOA0524 | 499 | SEOA0598a | 559 | SEOA0787 |
| 320 | SEOA0383 | 380 | SEOA0455 | 440 | SEOA0525 | 500 | SEOA0599a | 560 | SEOA0789 |
| 321 | SEOA0385 | 381 | SEOA0456 | 441 | SEOA0526 | 501 | SEOA0600a | 561 | SEOA0790 |
| 322 | seoa0386 | 382 | SEOA0457 | 442 | SEOA0527 | 502 | SEOA0601a | 562 | SEOA0791 |
| 323 | SEOA0387 | 383 | SEOA0458n | 443 | SEOA0528n | 503 | SEOA0602a | 563 | SEOA0792 |
| 324 | SEOA0388 | 384 | seoa0459m | 444 | SEOA0529 | 504 | SEOA0614a | 564 | SEOA0794 |
| 325 | SEOA0390 | 385 | SEOA0460 | 445 | SEOA0530 | 505 | SEOA0721a | 565 | SEOA0795 |
| 326 | SEOA0391 | 386 | seoa0461m | 446 | seoa0532 | 506 | SEOA0722a | 566 | SEOA0796 |
| 327 | SEOA0393 | 387 | SEOA0462 | 447 | SEOA0533 | 507 | SEOA0723a | 567 | SEOA0799 |
| 328 | SEOA0394 | 388 | SEOA0463 | 448 | SEOA0534 | 508 | SEOA0724a | 568 | seoa0800m |
| 329 | SEOA0395 | 389 | SEOA0464 | 449 | seoa0535 | 509 | seoa0725a | 569 | SEOA0801 |
| 330 | SEOA0396 | 390 | SEOA0465 | 450 | SEOA0536 | 510 | SEOA0727a | 570 | SEOA0802 |
| 331 | SEOA0397 | 391 | SEOA0466 | 451 | SEOA0537 | 511 | SEOA0728a | 571 | SEOA0803 |
| 332 | SEOA0398 | 392 | SEOA0467 | 452 | SEOA0539n | 512 | SEOA0729a | 572 | SEOA0804 |
| 333 | SEOA0399 | 393 | SEOA0468 | 453 | SEOA0540n | 513 | SEOA0730a | 573 | SEOA0805 |
| 334 | SEOA0400 | 394 | SEOA0469n | 454 | SEOA0541n | 514 | SEOA0731a | 574 | SEOA0806 |
| 335 | SEOA0401 | 395 | SEOA0470n | 455 | SEOA0542n | 515 | SEOA0733a | 575 | seoa0807m |
| 336 | SEOA0402 | 396 | seoa0471n | 456 | SEOA0543 | 516 | SEOA0734a | 576 | SEOA0808 |
| 337 | SEOA0404 | 397 | SEOA0472 | 457 | SEOA0544 | 517 | SEOA0737n | 577 | seoa0809 |
| 338 | SEOA0405 | 398 | SEOA0473 | 458 | SEOA0545A | 518 | SEOA0738 | 578 | SEOA0811 |
| 339 | SEOA0407 | 399 | SEOA0475 | 459 | SEOA0546A | 519 | seoa0739m | 579 | SEOA0812 |
| 340 | SEOA0408 | 400 | SEOA0476 | 460 | SEOA0547A | 520 | SEOA0740 | 580 | SEOA0814 |
| 341 | SEOA0409 | 401 | SEOA0477 | 461 | SEOA0548A | 521 | seoa0741 | 581 | SEOA0815 |
| 342 | SEOA0410 | 402 | SEOA0478 | 462 | SEOA0549A | 522 | SEOA0742 | 582 | SEOA0816 |
| 343 | SEOA0412 | 403 | SEOA0479 | 463 | SEOA0550A | 523 | SEOA0743 | 583 | SEOA0817 |
| 344 | SEOA0413 | 404 | SEOA0480 | 464 | SEOA0551A | 524 | SEOA0744 | 584 | SEOA0818 |
| 345 | SEOA0414n | 405 | SEOA0481 | 465 | SEOA0552A | 525 | SEOA0745 | 585 | SEOA0819n |
| 346 | SEOA0416 | 406 | SEOA0482 | 466 | SEOA0554A | 526 | SEOA0746 | 586 | SEOA0820 |
| 347 | SEOA0417 | 407 | SEOA0483 | 467 | SEOA0555A | 527 | SEOA0747 | 587 | SEOA0821 |
| 348 | SEOA0418 | 408 | SEOA0485 | 468 | SEOA0556A | 528 | SEOA0748 | 588 | SEOA0822 |
| 349 | SEOA0420 | 409 | SEOA0486 | 469 | SEOA0558A | 529 | SEOA0749 | 589 | SEOA0823 |
| 350 | SEOA0421 | 410 | SEOA0487 | 470 | seoa0559a | 530 | SEOA0751 | 590 | SEOA0824 |
| 351 | SEOA0422 | 411 | SEOA0488 | 471 | SEOA0560A | 531 | SEOA0752 | 591 | SEOA0825 |
| 352 | SEOA0423 | 412 | SEOA0489 | 472 | SEOA0562A | 532 | SEOA0754 | 592 | SEOA0826 |
| 353 | SEOA0424n | 413 | SEOA0491 | 473 | SEOA0563A | 533 | SEOA0755 | 593 | SEOA0827 |
| 354 | SEOA0425 | 414 | SEOA0492 | 474 | SEOA0564A | 534 | SEOA0757 | 594 | SEOA0829 |
| 355 | SEOA0426 | 415 | SEOA0493 | 475 | SEOA0568 | 535 | SEOA0758 | 595 | SEOA0830 |
| 356 | SEOA0427 | 416 | seoa0495m | 476 | SEOA0569 | 536 | SEOA0759 | 596 | SEOA0831 |
| 357 | SEOA0428 | 417 | seoa0496m | 477 | SEOA0572 | 537 | SEOA0760 | 597 | SEOA0832 |
| 358 | SEOA0429 | 418 | SEOA0497 | 478 | SEOA0573 | 538 | SEOA0761 | 598 | SEOA0833 |
| 359 | SEOA0430 | 419 | seoa0498m | 479 | SEOA0574a | 539 | seoa0764m | 599 | SEOA0834 |
| 360 | SEOA0431 | 420 | seoa0499m | 480 | SEOA0575 | 540 | seoa0765m | 600 | SEOA0835 |

Figure 6E – List of EST Sequence Names From Severe OA Cartilage cDNA Library

| | | | | | | | | | |
|---|---|---|---|---|---|---|---|---|---|
| 601 | SEOA0836 | 661 | SEOA0901 | 721 | seoa0968m | 781 | SEOA1045a | 841 | SEOA1124a |
| 602 | SEOA0837 | 662 | SEOA0902 | 722 | SEOA0969 | 782 | SEOA1046a | 842 | SEOA1126a |
| 603 | SEOA0838 | 663 | SEOA0903 | 723 | seoa0970 | 783 | SEOA1048a | 843 | SEOA1128a |
| 604 | SEOA0839 | 664 | SEOA0904 | 724 | SEOA0971 | 784 | SEOA1049a | 844 | SEOA1130a |
| 605 | SEOA0840 | 665 | SEOA0905 | 725 | seoa0972m | 785 | SEOA1053a | 845 | SEOA1131a |
| 606 | SEOA0841 | 666 | SEOA0906 | 726 | SEOA0973 | 786 | SEOA1054a | 846 | SEOA1132a |
| 607 | SEOA0842 | 667 | SEOA0907 | 727 | SEOA0974 | 787 | SEOA1056a | 847 | SEOA1134a |
| 608 | SEOA0843 | 668 | SEOA0908 | 728 | SEOA0975 | 788 | SEOA1057a | 848 | SEOA1135a |
| 609 | SEOA0844 | 669 | SEOA0909 | 729 | SEOA0977 | 789 | SEOA1058a | 849 | SEOA1137a |
| 610 | SEOA0845 | 670 | SEOA0911 | 730 | SEOA0978 | 790 | SEOA1062a | 850 | SEOA1138a |
| 611 | SEOA0846 | 671 | SEOA0913 | 731 | seoa0979m | 791 | SEOA1063a | 851 | SEOA1139a |
| 612 | SEOA0847 | 672 | SEOA0914 | 732 | seoa0980m | 792 | SEOA1065a | 852 | SEOA1140a |
| 613 | SEOA0848 | 673 | SEOA0915 | 733 | seoa0981m | 793 | SEOA1066a | 853 | SEOA1141a |
| 614 | SEOA0849 | 674 | SEOA0916 | 734 | SEOA0982n | 794 | SEOA1067a | 854 | SEOA1144a |
| 615 | SEOA0850n | 675 | SEOA0917 | 735 | SEOA0984 | 795 | SEOA1068a | 855 | SEOA1145a |
| 616 | SEOA0851 | 676 | seoa0918m | 736 | seoa0985m | 796 | SEOA1069a | 856 | SEOA1146a |
| 617 | SEOA0852 | 677 | SEOA0920 | 737 | SEOA0986 | 797 | SEOA1070a | 857 | SEOA1147a |
| 618 | SEOA0853 | 678 | SEOA0921 | 738 | seoa0987m | 798 | SEOA1071a | 858 | SEOA1148a |
| 619 | seoa0854 | 679 | SEOA0922 | 739 | SEOA0988 | 799 | SEOA1072a | 859 | SEOA1149a |
| 620 | SEOA0855 | 680 | SEOA0923 | 740 | SEOA0989 | 800 | SEOA1073a | 860 | SEOA1150a |
| 621 | SEOA0857 | 681 | SEOA0924 | 741 | SEOA0990n | 801 | SEOA1074a | 861 | SEOA1151a |
| 622 | SEOA0858 | 682 | SEOA0925 | 742 | SEOA0991 | 802 | SEOA1075a | 862 | SEOA1152a |
| 623 | SEOA0859 | 683 | SEOA0926 | 743 | seoa0992m | 803 | SEOA1076a | 863 | SEOA1153a |
| 624 | SEOA0860 | 684 | seoa0928 | 744 | seoa0993m | 804 | SEOA1078a | 864 | SEOA1155a |
| 625 | SEOA0861 | 685 | SEOA0929n | 745 | SEOA0994 | 805 | SEOA1079a | 865 | SEOA1157a |
| 626 | SEOA0862 | 686 | SEOA0930 | 746 | SEOA0995 | 806 | SEOA1080a | 866 | SEOA1158a |
| 627 | SEOA0863 | 687 | SEOA0931 | 747 | SEOA0996 | 807 | SEOA1081a | 867 | SEOA1159A |
| 628 | SEOA0864 | 688 | SEOA0932n | 748 | SEOA0998 | 808 | SEOA1082a | 868 | SEOA1161A |
| 629 | SEOA0865 | 689 | SEOA0933 | 749 | SEOA1001 | 809 | SEOA1083a | 869 | SEOA1164A |
| 630 | SEOA0866 | 690 | SEOA0934 | 750 | SEOA1002 | 810 | SEOA1084a | 870 | SEOA1166A |
| 631 | SEOA0868 | 691 | SEOA0935 | 751 | seoa1004m | 811 | SEOA1085a | 871 | SEOA1169A |
| 632 | SEOA0869 | 692 | SEOA0936 | 752 | SEOA1005n | 812 | SEOA1086a | 872 | SEOA1173A |
| 633 | SEOA0870 | 693 | SEOA0937 | 753 | SEOA1006n | 813 | SEOA1087a | 873 | SEOA1176A |
| 634 | seoa0873n | 694 | SEOA0938n | 754 | SEOA1007n | 814 | SEOA1089a | 874 | SEOA1178A |
| 635 | SEOA0874 | 695 | SEOA0939 | 755 | seoa1008m | 815 | SEOA1090a | 875 | SEOA1181A |
| 636 | SEOA0875 | 696 | SEOA0940 | 756 | SEOA1009n | 816 | SEOA1092a | 876 | SEOA1182A |
| 637 | SEOA0876 | 697 | SEOA0941 | 757 | seoa1012m | 817 | SEOA1094a | 877 | SEOA1183A |
| 638 | SEOA0877 | 698 | SEOA0942 | 758 | SEOA1013n | 818 | SEOA1095a | 878 | SEOA1184A |
| 639 | SEOA0878 | 699 | SEOA0943 | 759 | seoa1014m | 819 | SEOA1096a | 879 | SEOA1186A |
| 640 | SEOA0879 | 700 | SEOA0944 | 760 | SEOA1015n | 820 | SEOA1097a | 880 | SEOA1187a |
| 641 | SEOA0880 | 701 | SEOA0945 | 761 | seoa1017m | 821 | SEOA1098a | 881 | SEOA1188A |
| 642 | SEOA0881 | 702 | SEOA0946 | 762 | SEOA1018 | 822 | SEOA1099a | 882 | SEOA1189A |
| 643 | SEOA0882 | 703 | SEOA0947 | 763 | SEOA1020 | 823 | SEOA1100a | 883 | SEOA1190A |
| 644 | SEOA0883 | 704 | SEOA0948 | 764 | SEOA1022 | 824 | SEOA1101a | 884 | SEOA1191A |
| 645 | SEOA0884 | 705 | SEOA0949n | 765 | SEOA1023 | 825 | SEOA1102a | 885 | SEOA1192A |
| 646 | SEOA0885n | 706 | SEOA0950 | 766 | SEOA1024 | 826 | SEOA1104a | 886 | SEOA1193A |
| 647 | SEOA0886 | 707 | SEOA0952 | 767 | SEOA1025 | 827 | SEOA1105a | 887 | SEOA1194A |
| 648 | SEOA0887 | 708 | SEOA0953 | 768 | SEOA1026 | 828 | SEOA1106a | 888 | SEOA1196A |
| 649 | SEOA0888 | 709 | SEOA0955 | 769 | seoa1028m | 829 | SEOA1107a | 889 | SEOA1198A |
| 650 | SEOA0889n | 710 | SEOA0956 | 770 | SEOA1030 | 830 | SEOA1108a | 890 | SEOA1199A |
| 651 | SEOA0890n | 711 | SEOA0957 | 771 | SEOA1032a | 831 | SEOA1109a | 891 | SEOA1200A |
| 652 | SEOA0891 | 712 | SEOA0958 | 772 | SEOA1034a | 832 | SEOA1112a | 892 | SEOA1201A |
| 653 | SEOA0892 | 713 | SEOA0959 | 773 | SEOA1035a | 833 | SEOA1113a | 893 | SEOA1202A |
| 654 | SEOA0893 | 714 | SEOA0960n | 774 | SEOA1036a | 834 | SEOA1114a | 894 | SEOA1203A |
| 655 | SEOA0895 | 715 | SEOA0962n | 775 | SEOA1038a | 835 | SEOA1115a | 895 | SEOA1204A |
| 656 | SEOA0896 | 716 | SEOA0963n | 776 | SEOA1039a | 836 | SEOA1116a | 896 | SEOA1206A |
| 657 | SEOA0897n | 717 | SEOA0964 | 777 | SEOA1040a | 837 | SEOA1117a | 897 | SEOA1208A |
| 658 | SEOA0898 | 718 | SEOA0965 | 778 | SEOA1041a | 838 | SEOA1118a | 898 | SEOA1209A |
| 659 | SEOA0899 | 719 | SEOA0966 | 779 | SEOA1042a | 839 | SEOA1119a | 899 | SEOA1213A |
| 660 | SEOA0900 | 720 | SEOA0967 | 780 | SEOA1044a | 840 | SEOA1120a | 900 | SEOA1215A |

Figure 6E – List of EST Sequence Names From Severe OA Cartilage cDNA Library

| | | | | | | | | | |
|---|---|---|---|---|---|---|---|---|---|
| 901 | SEOA1216A | 961 | SEOA1297a | 1021 | SEOA1366a | 1081 | SEOA1439a | 1141 | SEOA1513 |
| 902 | SEOA1218A | 962 | SEOA1298a | 1022 | SEOA1368 | 1082 | SEOA1440a | 1142 | SEOA1515 |
| 903 | SEOA1220A | 963 | SEOA1300a | 1023 | SEOA1369 | 1083 | SEOA1442a | 1143 | SEOA1516 |
| 904 | SEOA1222A | 964 | SEOA1301a | 1024 | SEOA1370 | 1084 | SEOA1443a | 1144 | SEOA1517n |
| 905 | SEOA1224A | 965 | SEOA1302a | 1025 | SEOA1371 | 1085 | SEOA1444a | 1145 | SEOA1518 |
| 906 | SEOA1226A | 966 | SEOA1303a | 1026 | SEOA1372 | 1086 | seoa1445an | 1146 | SEOA1519 |
| 907 | SEOA1227A | 967 | SEOA1304a | 1027 | SEOA1373 | 1087 | SEOA1447a | 1147 | SEOA1520 |
| 908 | SEOA1228A | 968 | SEOA1306a | 1028 | SEOA1374 | 1088 | SEOA1448a | 1148 | SEOA1521 |
| 909 | SEOA1229A | 969 | SEOA1307a | 1029 | SEOA1375 | 1089 | SEOA1449a | 1149 | SEOA1522n |
| 910 | SEOA1232A | 970 | SEOA1308 | 1030 | SEOA1376 | 1090 | SEOA1451a | 1150 | seoa1523 |
| 911 | SEOA1234A | 971 | SEOA1309a | 1031 | SEOA1377 | 1091 | SEOA1452a | 1151 | SEOA1524 |
| 912 | SEOA1236A | 972 | SEOA1310a | 1032 | SEOA1378 | 1092 | SEOA1454a | 1152 | SEOA1525 |
| 913 | SEOA1237A | 973 | SEOA1311a | 1033 | SEOA1379 | 1093 | SEOA1455a | 1153 | SEOA1526 |
| 914 | SEOA1238A | 974 | SEOA1312a | 1034 | SEOA1380 | 1094 | SEOA1456a | 1154 | SEOA1527n |
| 915 | SEOA1239A | 975 | SEOA1313 | 1035 | seoa1381n | 1095 | SEOA1457a | 1155 | SEOA1528 |
| 916 | SEOA1240A | 976 | SEOA1314 | 1036 | SEOA1382 | 1096 | SEOA1458a | 1156 | SEOA1529 |
| 917 | SEOA1241A | 977 | SEOA1315 | 1037 | SEOA1383 | 1097 | SEOA1459a | 1157 | SEOA1530 |
| 918 | SEOA1242A | 978 | SEOA1316n | 1038 | SEOA1384 | 1098 | SEOA1460a | 1158 | SEOA1532 |
| 919 | SEOA1244A | 979 | SEOA1318 | 1039 | SEOA1385 | 1099 | SEOA1461a | 1159 | SEOA1534 |
| 920 | SEOA1245A | 980 | SEOA1320 | 1040 | SEOA1387 | 1100 | SEOA1463a | 1160 | SEOA1535 |
| 921 | SEOA1246A | 981 | SEOA1321 | 1041 | SEOA1388 | 1101 | SEOA1464a | 1161 | SEOA1536 |
| 922 | SEOA1247A | 982 | SEOA1323 | 1042 | SEOA1389 | 1102 | SEOA1465a | 1162 | SEOA1537 |
| 923 | SEOA1248A | 983 | SEOA1324 | 1043 | SEOA1390 | 1103 | SEOA1466a | 1163 | SEOA1538 |
| 924 | SEOA1249A | 984 | SEOA1325n | 1044 | SEOA1391 | 1104 | seoa1468a | 1164 | seoa1539 |
| 925 | SEOA1250A | 985 | SEOA1326 | 1045 | SEOA1392 | 1105 | SEOA1469a | 1165 | SEOA1540 |
| 926 | SEOA1251A | 986 | SEOA1327 | 1046 | SEOA1394 | 1106 | SEOA1470a | 1166 | seoa1541n |
| 927 | SEOA1252A | 987 | SEOA1328 | 1047 | SEOA1395 | 1107 | SEOA1471a | 1167 | SEOA1542 |
| 928 | SEOA1253A | 988 | SEOA1329 | 1048 | SEOA1396 | 1108 | SEOA1472a | 1168 | SEOA1543 |
| 929 | SEOA1255A | 989 | SEOA1330 | 1049 | SEOA1398 | 1109 | seoa1473m | 1169 | SEOA1544 |
| 930 | SEOA1258A | 990 | SEOA1331 | 1050 | SEOA1399 | 1110 | SEOA1474 | 1170 | seoa1545 |
| 931 | SEOA1259A | 991 | SEOA1332 | 1051 | SEOA1400 | 1111 | SEOA1475 | 1171 | SEOA1546 |
| 932 | SEOA1260A | 992 | SEOA1334 | 1052 | SEOA1401 | 1112 | SEOA1477 | 1172 | SEOA1547 |
| 933 | SEOA1262A | 993 | SEOA1335 | 1053 | SEOA1403 | 1113 | SEOA1478 | 1173 | seoa1548m |
| 934 | SEOA1263A | 994 | SEOA1336 | 1054 | SEOA1404 | 1114 | SEOA1479 | 1174 | SEOA1550 |
| 935 | SEOA1265A | 995 | SEOA1337 | 1055 | SEOA1405 | 1115 | SEOA1480 | 1175 | SEOA1551 |
| 936 | SEOA1266A | 996 | seoa1338 | 1056 | seoa1406 | 1116 | SEOA1483n | 1176 | SEOA1552 |
| 937 | SEOA1267A | 997 | SEOA1339n | 1057 | SEOA1407 | 1117 | SEOA1484n | 1177 | SEOA1554 |
| 938 | SEOA1268A | 998 | SEOA1340 | 1058 | SEOA1409a | 1118 | SEOA1486 | 1178 | SEOA1555 |
| 939 | SEOA1269a | 999 | SEOA1341 | 1059 | SEOA1410a | 1119 | SEOA1487 | 1179 | SEOA1559 |
| 940 | SEOA1270a | 1000 | SEOA1342 | 1060 | SEOA1411a | 1120 | SEOA1488 | 1180 | SEOA1560 |
| 941 | SEOA1273a | 1001 | SEOA1343 | 1061 | SEOA1413a | 1121 | SEOA1489 | 1181 | SEOA1563 |
| 942 | SEOA1275a | 1002 | SEOA1344 | 1062 | SEOA1414a | 1122 | SEOA1490n | 1182 | SEOA1564 |
| 943 | SEOA1276a | 1003 | SEOA1346 | 1063 | SEOA1415a | 1123 | SEOA1491 | 1183 | SEOA1566 |
| 944 | SEOA1277a | 1004 | seoa1347 | 1064 | SEOA1416a | 1124 | SEOA1492n | 1184 | SEOA1567 |
| 945 | SEOA1278a | 1005 | SEOA1348 | 1065 | SEOA1419a | 1125 | SEOA1493 | 1185 | seoa1568m |
| 946 | SEOA1279a | 1006 | SEOA1349 | 1066 | SEOA1420a | 1126 | SEOA1494 | 1186 | SEOA1570 |
| 947 | SEOA1280a | 1007 | SEOA1350 | 1067 | SEOA1421a | 1127 | SEOA1496n | 1187 | SEOA1571 |
| 948 | SEOA1281a | 1008 | SEOA1351 | 1068 | SEOA1422a | 1128 | SEOA1497 | 1188 | SEOA1572 |
| 949 | SEOA1282a | 1009 | SEOA1352 | 1069 | SEOA1423a | 1129 | SEOA1499 | 1189 | SEOA1573a |
| 950 | SEOA1283a | 1010 | SEOA1353 | 1070 | SEOA1424a | 1130 | SEOA1501 | 1190 | SEOA1574a |
| 951 | SEOA1284a | 1011 | seoa1354m | 1071 | seoa1425a | 1131 | SEOA1503 | 1191 | SEOA1575a |
| 952 | SEOA1286a | 1012 | SEOA1356 | 1072 | SEOA1427a | 1132 | SEOA1504 | 1192 | SEOA1576a |
| 953 | SEOA1287a | 1013 | seoa1357m | 1073 | SEOA1428a | 1133 | SEOA1505 | 1193 | seoa1577a |
| 954 | SEOA1288a | 1014 | seoa1358m | 1074 | SEOA1429a | 1134 | SEOA1506 | 1194 | SEOA1579a |
| 955 | SEOA1289a | 1015 | SEOA1360 | 1075 | SEOA1430a | 1135 | seoa1507n | 1195 | SEOA1580a |
| 956 | SEOA1290a | 1016 | SEOA1361 | 1076 | SEOA1431a | 1136 | SEOA1508 | 1196 | SEOA1581a |
| 957 | SEOA1291a | 1017 | SEOA1362a | 1077 | SEOA1432a | 1137 | SEOA1509 | 1197 | SEOA1582a |
| 958 | SEOA1292a | 1018 | SEOA1363 | 1078 | SEOA1434a | 1138 | SEOA1510 | 1198 | SEOA1583a |
| 959 | SEOA1295a | 1019 | SEOA1364 | 1079 | SEOA1436a | 1139 | SEOA1511 | 1199 | SEOA1584a |
| 960 | SEOA1296a | 1020 | SEOA1365 | 1080 | SEOA1437a | 1140 | SEOA1512 | 1200 | SEOA1585a |

Figure 6E – List of EST Sequence Names From Severe OA Cartilage cDNA Library

| | | | | | | | | | |
|---|---|---|---|---|---|---|---|---|---|
| 1201 | SEOA1586a | 1261 | SEOA1666a | 1321 | SEOA1741a | 1381 | SEOA1813a | 1441 | SEOA1907 |
| 1202 | SEOA1589a | 1262 | SEOA1667a | 1322 | SEOA1742a | 1382 | seoa1814a | 1442 | SEOA1909 |
| 1203 | SEOA1590a | 1263 | SEOA1668a | 1323 | SEOA1743a | 1383 | seoa1815a | 1443 | SEOA1910 |
| 1204 | SEOA1592a | 1264 | SEOA1669a | 1324 | SEOA1747a | 1384 | seoa1817a | 1444 | SEOA1911n |
| 1205 | SEOA1594a | 1265 | SEOA1670a | 1325 | SEOA1748a | 1385 | SEOA1819a | 1445 | SEOA1912n |
| 1206 | seoa1595an | 1266 | SEOA1671a | 1326 | SEOA1749a | 1386 | SEOA1821a | 1446 | SEOA1913n |
| 1207 | SEOA1596a | 1267 | SEOA1672a | 1327 | SEOA1750a | 1387 | SEOA1822a | 1447 | seoa1914n |
| 1208 | SEOA1597a | 1268 | SEOA1673a | 1328 | SEOA1751a | 1388 | seoa1823a | 1448 | SEOA1915 |
| 1209 | SEOA1598a | 1269 | SEOA1674a | 1329 | SEOA1752a | 1389 | seoa1825a | 1449 | SEOA1916n |
| 1210 | SEOA1599a | 1270 | SEOA1675a | 1330 | SEOA1753a | 1390 | seoa1826a | 1450 | SEOA1917 |
| 1211 | SEOA1600a | 1271 | SEOA1676a | 1331 | SEOA1754a | 1391 | seoa1830a | 1451 | seoa1918m |
| 1212 | SEOA1601a | 1272 | SEOA1677a | 1332 | SEOA1755a | 1392 | SEOA1833a | 1452 | SEOA1919n |
| 1213 | SEOA1602a | 1273 | SEOA1678a | 1333 | SEOA1756a | 1393 | SEOA1834a | 1453 | SEOA1921n |
| 1214 | SEOA1604a | 1274 | SEOA1679a | 1334 | SEOA1757a | 1394 | SEOA1835a | 1454 | SEOA1923 |
| 1215 | SEOA1606a | 1275 | SEOA1680a | 1335 | SEOA1758a | 1395 | SEOA1837a | 1455 | SEOA1924n |
| 1216 | SEOA1607a | 1276 | SEOA1681a | 1336 | SEOA1759a | 1396 | SEOA1839a | 1456 | SEOA1925n |
| 1217 | SEOA1608a | 1277 | SEOA1682a | 1337 | SEOA1760a | 1397 | SEOA1844a | 1457 | seoa1926m |
| 1218 | SEOA1609a | 1278 | SEOA1683a | 1338 | SEOA1761a | 1398 | SEOA1845a | 1458 | SEOA1927 |
| 1219 | SEOA1610a | 1279 | SEOA1684a | 1339 | SEOA1762a | 1399 | SEOA1847a | 1459 | seoa1928n |
| 1220 | SEOA1611a | 1280 | SEOA1685a | 1340 | SEOA1763a | 1400 | SEOA1848a | 1460 | SEOA1931 |
| 1221 | SEOA1614a | 1281 | SEOA1686a | 1341 | SEOA1764a | 1401 | SEOA1850a | 1461 | SEOA1932 |
| 1222 | SEOA1615a | 1282 | SEOA1687a | 1342 | SEOA1765a | 1402 | SEOA1851a | 1462 | SEOA1935 |
| 1223 | SEOA1616a | 1283 | SEOA1688a | 1343 | seoa1766a | 1403 | SEOA1853a | 1463 | SEOA1936 |
| 1224 | SEOA1617a | 1284 | SEOA1689a | 1344 | SEOA1767a | 1404 | SEOA1854a | 1464 | SEOA1937n |
| 1225 | SEOA1620a | 1285 | SEOA1690a | 1345 | SEOA1768a | 1405 | SEOA1856a | 1465 | SEOA1938n |
| 1226 | SEOA1621a | 1286 | SEOA1691a | 1346 | SEOA1769a | 1406 | SEOA1857a | 1466 | SEOA1940 |
| 1227 | SEOA1622a | 1287 | SEOA1692a | 1347 | SEOA1770a | 1407 | SEOA1858a | 1467 | SEOA1942 |
| 1228 | SEOA1623a | 1288 | seoa1694a | 1348 | SEOA1771a | 1408 | SEOA1861a | 1468 | SEOA1943 |
| 1229 | seoa1629a | 1289 | SEOA1695a | 1349 | SEOA1772a | 1409 | SEOA1866a | 1469 | SEOA1946 |
| 1230 | SEOA1631a | 1290 | SEOA1696a | 1350 | SEOA1773a | 1410 | SEOA1867a | 1470 | SEOA1947 |
| 1231 | SEOA1632a | 1291 | SEOA1697a | 1351 | SEOA1774a | 1411 | SEOA1869a | 1471 | SEOA1949 |
| 1232 | SEOA1634a | 1292 | SEOA1698a | 1352 | SEOA1775a | 1412 | SEOA1872a | 1472 | SEOA1950 |
| 1233 | SEOA1635a | 1293 | SEOA1700a | 1353 | SEOA1776a | 1413 | SEOA1873a | 1473 | SEOA1952 |
| 1234 | SEOA1636a | 1294 | SEOA1701a | 1354 | SEOA1778a | 1414 | SEOA1874a | 1474 | SEOA1953 |
| 1235 | SEOA1637a | 1295 | SEOA1703a | 1355 | SEOA1782a | 1415 | SEOA1875a | 1475 | SEOA1954 |
| 1236 | SEOA1638a | 1296 | SEOA1705a | 1356 | SEOA1783a | 1416 | SEOA1876a | 1476 | SEOA1955 |
| 1237 | SEOA1639a | 1297 | SEOA1710a | 1357 | SEOA1784a | 1417 | seoa1877a | 1477 | SEOA1956 |
| 1238 | SEOA1640a | 1298 | SEOA1711a | 1358 | SEOA1785a | 1418 | SEOA1878 | 1478 | SEOA1957 |
| 1239 | SEOA1641a | 1299 | SEOA1712a | 1359 | SEOA1786a | 1419 | SEOA1879 | 1479 | SEOA1958 |
| 1240 | SEOA1643a | 1300 | SEOA1713a | 1360 | SEOA1787a | 1420 | SEOA1880 | 1480 | SEOA1960 |
| 1241 | SEOA1644a | 1301 | SEOA1714a | 1361 | SEOA1788a | 1421 | seoa1881 | 1481 | SEOA1961a |
| 1242 | SEOA1645a | 1302 | SEOA1715a | 1362 | SEOA1789a | 1422 | SEOA1882 | 1482 | SEOA1962a |
| 1243 | SEOA1646a | 1303 | SEOA1717a | 1363 | SEOA1790a | 1423 | SEOA1883 | 1483 | SEOA1963a |
| 1244 | SEOA1647a | 1304 | SEOA1718a | 1364 | SEOA1791a | 1424 | SEOA1884 | 1484 | SEOA1964a |
| 1245 | SEOA1648a | 1305 | SEOA1720a | 1365 | SEOA1792a | 1425 | SEOA1885 | 1485 | SEOA1965a |
| 1246 | SEOA1650a | 1306 | SEOA1721a | 1366 | SEOA1793a | 1426 | SEOA1886n | 1486 | SEOA1966a |
| 1247 | SEOA1651a | 1307 | SEOA1722a | 1367 | SEOA1794a | 1427 | SEOA1887 | 1487 | SEOA1967a |
| 1248 | SEOA1652a | 1308 | SEOA1723a | 1368 | SEOA1795a | 1428 | SEOA1888 | 1488 | SEOA1968a |
| 1249 | SEOA1653a | 1309 | SEOA1725a | 1369 | SEOA1797a | 1429 | SEOA1889n | 1489 | SEOA1969a |
| 1250 | SEOA1654a | 1310 | SEOA1726a | 1370 | SEOA1799a | 1430 | SEOA1890n | 1490 | SEOA1971a |
| 1251 | SEOA1655a | 1311 | SEOA1727a | 1371 | SEOA1802a | 1431 | SEOA1891 | 1491 | SEOA1972a |
| 1252 | SEOA1656a | 1312 | SEOA1729a | 1372 | SEOA1803a | 1432 | SEOA1894 | 1492 | SEOA1973a |
| 1253 | SEOA1657a | 1313 | SEOA1730a | 1373 | SEOA1804a | 1433 | SEOA1896 | 1493 | SEOA1977a |
| 1254 | SEOA1658a | 1314 | SEOA1731a | 1374 | seoa1805a | 1434 | SEOA1897 | 1494 | SEOA1979a |
| 1255 | SEOA1660a | 1315 | SEOA1732a | 1375 | seoa1806a | 1435 | SEOA1898 | 1495 | SEOA1980a |
| 1256 | SEOA1661a | 1316 | SEOA1733a | 1376 | seoa1807a | 1436 | SEOA1899 | 1496 | SEOA1981a |
| 1257 | SEOA1662a | 1317 | SEOA1734a | 1377 | seoa1809a | 1437 | SEOA1900n | 1497 | SEOA1982a |
| 1258 | SEOA1663a | 1318 | SEOA1736a | 1378 | seoa1810a | 1438 | SEOA1901 | 1498 | seoa1983a |
| 1259 | SEOA1664a | 1319 | SEOA1737a | 1379 | SEOA1811a | 1439 | SEOA1902 | 1499 | SEOA1985 |
| 1260 | SEOA1665a | 1320 | SEOA1739a | 1380 | SEOA1812a | 1440 | SEOA1903 | 1500 | SEOA1987 |

Figure 6E – List of EST Sequence Names From Severe OA Cartilage cDNA Library

| | | | | | | | | | |
|---|---|---|---|---|---|---|---|---|---|
| 1501 | SEOA1988a | 1561 | SEOA2067n | 1621 | SEOA2137 | 1681 | seoa2212an | 1741 | SEOA2294a |
| 1502 | SEOA1989 | 1562 | SEOA2068 | 1622 | SEOA2138 | 1682 | SEOA2213a | 1742 | SEOA2295a |
| 1503 | SEOA1990 | 1563 | SEOA2069 | 1623 | SEOA2139 | 1683 | SEOA2214a | 1743 | SEOA2296a |
| 1504 | SEOA1991 | 1564 | SEOA2071 | 1624 | SEOA2140 | 1684 | SEOA2215a | 1744 | SEOA2298a |
| 1505 | SEOA1992 | 1565 | seoa2072n | 1625 | SEOA2141 | 1685 | SEOA2217a | 1745 | SEOA2300a |
| 1506 | SEOA1993 | 1566 | SEOA2074n | 1626 | SEOA2142 | 1686 | seoa2218a | 1746 | SEOA2301a |
| 1507 | SEOA1995 | 1567 | SEOA2075n | 1627 | SEOA2143 | 1687 | SEOA2219a | 1747 | SEOA2302a |
| 1508 | SEOA1996 | 1568 | SEOA2076 | 1628 | SEOA2146n | 1688 | SEOA2220a | 1748 | SEOA2303a |
| 1509 | SEOA1997 | 1569 | seoa2077n | 1629 | SEOA2147 | 1689 | SEOA2221a | 1749 | SEOA2304a |
| 1510 | SEOA2000a | 1570 | SEOA2078 | 1630 | SEOA2148n | 1690 | SEOA2224a | 1750 | SEOA2305a |
| 1511 | SEOA2001 | 1571 | SEOA2079 | 1631 | SEOA2149 | 1691 | SEOA2227a | 1751 | SEOA2308a |
| 1512 | SEOA2004 | 1572 | SEOA2080n | 1632 | SEOA2150 | 1692 | SEOA2230a | 1752 | SEOA2309a |
| 1513 | SEOA2005 | 1573 | SEOA2081 | 1633 | SEOA2151 | 1693 | SEOA2232a | 1753 | seoa2311a |
| 1514 | SEOA2006 | 1574 | SEOA2082 | 1634 | SEOA2152 | 1694 | SEOA2233a | 1754 | SEOA2313a |
| 1515 | SEOA2007 | 1575 | SEOA2083n | 1635 | SEOA2153n | 1695 | SEOA2234a | 1755 | SEOA2320a |
| 1516 | seoa2008n | 1576 | SEOA2084 | 1636 | SEOA2154n | 1696 | SEOA2235a | 1756 | SEOA2326a |
| 1517 | SEOA2011 | 1577 | SEOA2085 | 1637 | SEOA2155 | 1697 | SEOA2236a | 1757 | SEOA2327a |
| 1518 | SEOA2012 | 1578 | SEOA2087 | 1638 | SEOA2156n | 1698 | SEOA2237a | 1758 | SEOA2328a |
| 1519 | SEOA2013 | 1579 | SEOA2088 | 1639 | SEOA2157 | 1699 | SEOA2238a | 1759 | SEOA2331a |
| 1520 | SEOA2015 | 1580 | SEOA2089 | 1640 | SEOA2158 | 1700 | SEOA2239a | 1760 | SEOA2333a |
| 1521 | SEOA2016 | 1581 | SEOA2090 | 1641 | SEOA2159n | 1701 | SEOA2240a | 1761 | SEOA2337a |
| 1522 | SEOA2018 | 1582 | SEOA2092 | 1642 | SEOA2160 | 1702 | SEOA2241a | 1762 | SEOA2340a |
| 1523 | SEOA2019 | 1583 | SEOA2093 | 1643 | SEOA2162 | 1703 | SEOA2242a | 1763 | SEOA2341a |
| 1524 | seoa2022n | 1584 | SEOA2094 | 1644 | SEOA2163n | 1704 | SEOA2243a | 1764 | SEOA2343a |
| 1525 | SEOA2024a | 1585 | SEOA2095 | 1645 | SEOA2164 | 1705 | SEOA2244a | 1765 | SEOA2345a |
| 1526 | SEOA2025 | 1586 | SEOA2096 | 1646 | SEOA2165 | 1706 | SEOA2245a | 1766 | SEOA2349a |
| 1527 | SEOA2027 | 1587 | seoa2097nn | 1647 | SEOA2166 | 1707 | SEOA2246a | 1767 | SEOA2350a |
| 1528 | SEOA2028 | 1588 | SEOA2098 | 1648 | SEOA2168n | 1708 | SEOA2251a | 1768 | SEOA2351a |
| 1529 | SEOA2029 | 1589 | SEOA2099 | 1649 | SEOA2169 | 1709 | SEOA2253a | 1769 | SEOA2352a |
| 1530 | SEOA2030 | 1590 | SEOA2100 | 1650 | SEOA2170 | 1710 | SEOA2254a | 1770 | SEOA2354a |
| 1531 | seoa2032m | 1591 | SEOA2101 | 1651 | SEOA2171 | 1711 | SEOA2255a | 1771 | SEOA2355a |
| 1532 | SEOA2034 | 1592 | SEOA2102n | 1652 | SEOA2173 | 1712 | SEOA2256a | 1772 | SEOA2356a |
| 1533 | SEOA2035 | 1593 | SEOA2103n | 1653 | seoa2174n | 1713 | SEOA2257a | 1773 | SEOA2357a |
| 1534 | seoa2036 | 1594 | SEOA2104n | 1654 | SEOA2175 | 1714 | SEOA2258a | 1774 | SEOA2358a |
| 1535 | seoa2037 | 1595 | SEOA2106 | 1655 | SEOA2176 | 1715 | SEOA2259a | 1775 | SEOA2361a |
| 1536 | SEOA2039 | 1596 | SEOA2107 | 1656 | seoa2177a | 1716 | SEOA2260a | 1776 | SEOA2362a |
| 1537 | SEOA2040 | 1597 | SEOA2109 | 1657 | SEOA2178a | 1717 | SEOA2261a | 1777 | SEOA2363a |
| 1538 | SEOA2041 | 1598 | SEOA2110n | 1658 | SEOA2179a | 1718 | SEOA2262a | 1778 | SEOA2365a |
| 1539 | SEOA2042 | 1599 | SEOA2111 | 1659 | SEOA2180a | 1719 | seoa2263a | 1779 | SEOA2369a |
| 1540 | SEOA2043 | 1600 | SEOA2112n | 1660 | SEOA2181a | 1720 | SEOA2266a | 1780 | SEOA2371a |
| 1541 | SEOA2044 | 1601 | SEOA2113n | 1661 | SEOA2183a | 1721 | SEOA2268a | 1781 | SEOA2372a |
| 1542 | seoa2045m | 1602 | SEOA2114 | 1662 | SEOA2184a | 1722 | SEOA2269a | 1782 | SEOA2375a |
| 1543 | SEOA2046 | 1603 | SEOA2115 | 1663 | SEOA2185a | 1723 | SEOA2270a | 1783 | SEOA2378a |
| 1544 | SEOA2047 | 1604 | SEOA2117 | 1664 | SEOA2186a | 1724 | SEOA2271a | 1784 | SEOA2381a |
| 1545 | SEOA2048 | 1605 | SEOA2118 | 1665 | SEOA2188a | 1725 | SEOA2272a | 1785 | SEOA2383a |
| 1546 | SEOA2050 | 1606 | SEOA2119 | 1666 | SEOA2191a | 1726 | SEOA2273a | 1786 | SEOA2385a |
| 1547 | SEOA2051 | 1607 | seoa2120 | 1667 | SEOA2193a | 1727 | SEOA2274a | 1787 | SEOA2386a |
| 1548 | SEOA2052 | 1608 | seoa2121 | 1668 | SEOA2194a | 1728 | SEOA2278a | 1788 | SEOA2387a |
| 1549 | SEOA2053 | 1609 | SEOA2122 | 1669 | SEOA2195a | 1729 | SEOA2279 | 1789 | SEOA2388a |
| 1550 | SEOA2054a | 1610 | seoa2123m | 1670 | SEOA2199a | 1730 | SEOA2283a | 1790 | SEOA2389a |
| 1551 | SEOA2055n | 1611 | SEOA2124 | 1671 | SEOA2200a | 1731 | SEOA2284a | 1791 | SEOA2390a |
| 1552 | SEOA2056 | 1612 | seoa2125 | 1672 | SEOA2201a | 1732 | SEOA2285a | 1792 | SEOA2391a |
| 1553 | SEOA2057 | 1613 | SEOA2126n | 1673 | SEOA2202a | 1733 | SEOA2286a | 1793 | SEOA2394a |
| 1554 | seoa2058n | 1614 | SEOA2127n | 1674 | SEOA2203a | 1734 | SEOA2287a | 1794 | SEOA2400a |
| 1555 | SEOA2059 | 1615 | SEOA2128 | 1675 | SEOA2204a | 1735 | SEOA2288a | 1795 | SEOA2401a |
| 1556 | SEOA2061 | 1616 | SEOA2130n | 1676 | SEOA2205a | 1736 | SEOA2289a | 1796 | SEOA2402a |
| 1557 | SEOA2062 | 1617 | SEOA2132 | 1677 | SEOA2208a | 1737 | SEOA2290a | 1797 | seoa2403a |
| 1558 | SEOA2063 | 1618 | SEOA2134n | 1678 | SEOA2209a | 1738 | SEOA2291a | 1798 | SEOA2404a |
| 1559 | SEOA2064 | 1619 | SEOA2135 | 1679 | SEOA2210a | 1739 | SEOA2292a | 1799 | SEOA2407 |
| 1560 | SEOA2065 | 1620 | SEOA2136 | 1680 | SEOA2211a | 1740 | seoa2293an | 1800 | SEOA2409 |

Figure 6E - List of EST Sequence Names From Severe OA Cartilage cDNA Library

| | | | | | | | | | |
|---|---|---|---|---|---|---|---|---|---|
| 1801 | SEOA2410 | 1861 | SEOA2481 | 1921 | SEOA2557 | 1981 | SEOA2636 | 2041 | SEOA2708 |
| 1802 | SEOA2411 | 1862 | seoa2482 | 1922 | seoa2559m | 1982 | SEOA2638 | 2042 | seoa2710 |
| 1803 | seoa2412n | 1863 | SEOA2484 | 1923 | SEOA2561 | 1983 | SEOA2639 | 2043 | SEOA2712 |
| 1804 | SEOA2413 | 1864 | SEOA2486 | 1924 | SEOA2562 | 1984 | seoa2640n | 2044 | SEOA2713 |
| 1805 | SEOA2414 | 1865 | SEOA2487 | 1925 | SEOA2564 | 1985 | seoa2641n | 2045 | SEOA2714 |
| 1806 | seoa2415 | 1866 | SEOA2488 | 1926 | SEOA2566 | 1986 | SEOA2642 | 2046 | SEOA2715 |
| 1807 | SEOA2417a | 1867 | seoa2489m | 1927 | SEOA2567 | 1987 | seoa2643m | 2047 | SEOA2716 |
| 1808 | SEOA2418a | 1868 | SEOA2490 | 1928 | SEOA2568 | 1988 | SEOA2644 | 2048 | seoa2718 |
| 1809 | SEOA2419a | 1869 | seoa2491 | 1929 | SEOA2571 | 1989 | SEOA2645 | 2049 | SEOA2719 |
| 1810 | SEOA2420a | 1870 | SEOA2492 | 1930 | seoa2572n | 1990 | seoa2647n | 2050 | SEOA2720 |
| 1811 | SEOA2421a | 1871 | seoa2493 | 1931 | SEOA2573 | 1991 | SEOA2648 | 2051 | SEOA2723 |
| 1812 | SEOA2423a | 1872 | SEOA2495 | 1932 | SEOA2574 | 1992 | SEOA2649 | 2052 | SEOA2726 |
| 1813 | SEOA2424a | 1873 | seoa2496 | 1933 | SEOA2575 | 1993 | seoa2650n | 2053 | SEOA2727 |
| 1814 | SEOA2425a | 1874 | SEOA2497 | 1934 | seoa2576m | 1994 | SEOA2651 | 2054 | SEOA2728 |
| 1815 | SEOA2426a | 1875 | SEOA2498 | 1935 | SEOA2578 | 1995 | SEOA2652 | 2055 | SEOA2729 |
| 1816 | SEOA2428a | 1876 | SEOA2499 | 1936 | seoa2579m | 1996 | SEOA2653 | 2056 | SEOA2732 |
| 1817 | SEOA2429a | 1877 | seoa2500m | 1937 | seoa2580m | 1997 | SEOA2654 | 2057 | SEOA2734 |
| 1818 | SEOA2430a | 1878 | SEOA2501 | 1938 | SEOA2581 | 1998 | seoa2655n | 2058 | seoa2738m |
| 1819 | SEOA2431a | 1879 | SEOA2502 | 1939 | SEOA2583 | 1999 | SEOA2656 | 2059 | SEOA2739 |
| 1820 | SEOA2432a | 1880 | SEOA2504 | 1940 | seoa2584 | 2000 | SEOA2657 | 2060 | SEOA2740 |
| 1821 | SEOA2433a | 1881 | SEOA2505 | 1941 | seoa2585 | 2001 | SEOA2658 | 2061 | SEOA2741 |
| 1822 | SEOA2434a | 1882 | SEOA2506 | 1942 | SEOA2585 | 2002 | SEOA2659 | 2062 | SEOA2742 |
| 1823 | SEOA2435a | 1883 | SEOA2507 | 1943 | SEOA2586 | 2003 | seoa2660m | 2063 | SEOA2744 |
| 1824 | SEOA2436a | 1884 | SEOA2508 | 1944 | SEOA2588 | 2004 | SEOA2661 | 2064 | SEOA2746 |
| 1825 | SEOA2437a | 1885 | SEOA2509 | 1945 | SEOA2589 | 2005 | seoa2662 | 2065 | SEOA2747 |
| 1826 | SEOA2439a | 1886 | seoa2510m | 1946 | SEOA2592 | 2006 | SEOA2664 | 2066 | SEOA2750 |
| 1827 | SEOA2441a | 1887 | SEOA2511 | 1947 | SEOA2593m | 2007 | SEOA2665 | 2067 | SEOA2751 |
| 1828 | SEOA2442a | 1888 | SEOA2512 | 1948 | SEOA2594 | 2008 | SEOA2666 | 2068 | seoa2752n |
| 1829 | SEOA2443a | 1889 | SEOA2513 | 1949 | seoa2595 | 2009 | SEOA2667 | 2069 | SEOA2754 |
| 1830 | SEOA2444a | 1890 | SEOA2514 | 1950 | SEOA2596 | 2010 | SEOA2668 | 2070 | SEOA2755 |
| 1831 | SEOA2445a | 1891 | seoa2515 | 1951 | seoa2599m | 2011 | SEOA2669 | 2071 | SEOA2756 |
| 1832 | SEOA2447a | 1892 | seoa2516 | 1952 | SEOA2601 | 2012 | SEOA2670 | 2072 | seoa2757n |
| 1833 | SEOA2448a | 1893 | SEOA2517 | 1953 | seoa2602n | 2013 | seoa2672m | 2073 | SEOA2758 |
| 1834 | SEOA2449a | 1894 | SEOA2518 | 1954 | SEOA2603 | 2014 | seoa2674 | 2074 | SEOA2759 |
| 1835 | SEOA2451a | 1895 | SEOA2519 | 1955 | seoa2604m | 2015 | SEOA2675n | 2075 | seoa2760n |
| 1836 | SEOA2452a | 1896 | seoa2520m | 1956 | seoa2606m | 2016 | seoa2676 | 2076 | SEOA2761 |
| 1837 | SEOA2453a | 1897 | SEOA2522 | 1957 | seoa2607mn | 2017 | SEOA2676n | 2077 | seoa2762 |
| 1838 | SEOA2454a | 1898 | SEOA2523 | 1958 | SEOA2609 | 2018 | seoa2678m | 2078 | SEOA2763 |
| 1839 | SEOA2455a | 1899 | SEOA2524 | 1959 | SEOA2611 | 2019 | seoa2679m | 2079 | SEOA2764 |
| 1840 | SEOA2456a | 1900 | SEOA2525 | 1960 | seoa2612n | 2020 | seoa2680m | 2080 | SEOA2765 |
| 1841 | SEOA2458a | 1901 | SEOA2527 | 1961 | SEOA2613 | 2021 | SEOA2681 | 2081 | SEOA2766 |
| 1842 | SEOA2459a | 1902 | SEOA2528 | 1962 | SEOA2614 | 2022 | seoa2682m | 2082 | SEOA2767 |
| 1843 | SEOA2460a | 1903 | SEOA2529 | 1963 | SEOA2615 | 2023 | SEOA2683 | 2083 | SEOA2768 |
| 1844 | SEOA2461a | 1904 | SEOA2530 | 1964 | SEOA2616 | 2024 | SEOA2684 | 2084 | SEOA2769 |
| 1845 | SEOA2462a | 1905 | SEOA2532 | 1965 | seoa2617n | 2025 | SEOA2685 | 2085 | SEOA2770 |
| 1846 | SEOA2463a | 1906 | SEOA2534 | 1966 | SEOA2618 | 2026 | SEOA2686 | 2086 | SEOA2771 |
| 1847 | seoa2465 | 1907 | SEOA2535 | 1967 | SEOA2619 | 2027 | seoa2688m | 2087 | seoa2773 |
| 1848 | SEOA2466 | 1908 | SEOA2536 | 1968 | SEOA2620 | 2028 | seoa2690m | 2088 | seoa2774n |
| 1849 | SEOA2467 | 1909 | SEOA2537 | 1969 | seoa2621 | 2029 | seoa2691m | 2089 | SEOA2775 |
| 1850 | SEOA2468 | 1910 | seoa2539 | 1970 | seoa2622 | 2030 | seoa2692m | 2090 | seoa2776m |
| 1851 | seoa2469 | 1911 | SEOA2540 | 1971 | seoa2623 | 2031 | seoa2693m | 2091 | SEOA2777 |
| 1852 | seoa2470n | 1912 | SEOA2542 | 1972 | SEOA2625 | 2032 | seoa2696m | 2092 | seoa2782n |
| 1853 | SEOA2471 | 1913 | SEOA2544 | 1973 | SEOA2626 | 2033 | seoa2698m | 2093 | seoa2783 |
| 1854 | SEOA2472 | 1914 | SEOA2546 | 1974 | SEOA2627 | 2034 | SEOA2699 | 2094 | SEOA2784 |
| 1855 | seoa2473m | 1915 | seoa2547 | 1975 | SEOA2628 | 2035 | SEOA2700 | 2095 | SEOA2786 |
| 1856 | SEOA2476 | 1916 | SEOA2548 | 1976 | SEOA2629 | 2036 | SEOA2702 | 2096 | SEOA2788 |
| 1857 | SEOA2477 | 1917 | SEOA2550 | 1977 | SEOA2631 | 2037 | SEOA2703 | 2097 | SEOA2789 |
| 1858 | SEOA2478 | 1918 | seoa2554 | 1978 | SEOA2632 | 2038 | seoa2704n | 2098 | SEOA2790n |
| 1859 | SEOA2479 | 1919 | SEOA2555 | 1979 | SEOA2633 | 2039 | seoa2705m | 2099 | SEOA2792 |
| 1860 | SEOA2480 | 1920 | SEOA2556 | 1980 | SEOA2635 | 2040 | SEOA2707 | 2100 | SEOA2793 |

Figure 6E – List of EST Sequence Names From Severe OA Cartilage cDNA Library

| | | | | | | | | | |
|---|---|---|---|---|---|---|---|---|---|
| 2101 | SEOA2794 | 2161 | SEOA2866 | 2221 | SEOA2941a | 2281 | SEOA3016a | 2341 | SEOA3106a |
| 2102 | SEOA2795n | 2162 | SEOA2867 | 2222 | SEOA2942a | 2282 | SEOA3017a | 2342 | SEOA3108a |
| 2103 | SEOA2796n | 2163 | SEOA2868 | 2223 | SEOA2943a | 2283 | SEOA3018a | 2343 | SEOA3109a |
| 2104 | SEOA2797 | 2164 | seoa2869m | 2224 | SEOA2944a | 2284 | SEOA3019a | 2344 | SEOA3110a |
| 2105 | SEOA2799 | 2165 | SEOA2870 | 2225 | SEOA2945a | 2285 | SEOA3020a | 2345 | SEOA3111a |
| 2106 | SEOA2800 | 2166 | SEOA2871 | 2226 | SEOA2946a | 2286 | SEOA3021a | 2346 | seoa3116an |
| 2107 | SEOA2801 | 2167 | SEOA2872 | 2227 | SEOA2949a | 2287 | SEOA3023a | 2347 | SEOA3117a |
| 2108 | SEOA2802 | 2168 | SEOA2874 | 2228 | SEOA2952a | 2288 | SEOA3026a | 2348 | SEOA3118a |
| 2109 | SEOA2803 | 2169 | SEOA2875 | 2229 | SEOA2954a | 2289 | SEOA3027a | 2349 | SEOA3121a |
| 2110 | SEOA2804 | 2170 | SEOA2876 | 2230 | SEOA2955a | 2290 | SEOA3028a | 2350 | SEOA3122a |
| 2111 | SEOA2805 | 2171 | SEOA2877 | 2231 | SEOA2956a | 2291 | SEOA3029a | 2351 | SEOA3124a |
| 2112 | SEOA2806 | 2172 | SEOA2879 | 2232 | SEOA2957a | 2292 | SEOA3031a | 2352 | SEOA3125a |
| 2113 | seoa2807 | 2173 | SEOA2882 | 2233 | SEOA2958a | 2293 | SEOA3032a | 2353 | SEOA3126a |
| 2114 | seoa2809m | 2174 | SEOA2883n | 2234 | SEOA2959a | 2294 | SEOA3033a | 2354 | SEOA3127a |
| 2115 | seoa2811 | 2175 | SEOA2884n | 2235 | SEOA2961a | 2295 | SEOA3034a | 2355 | SEOA3128a |
| 2116 | seoa2812m | 2176 | SEOA2885n | 2236 | SEOA2962a | 2296 | SEOA3035a | 2356 | SEOA3129a |
| 2117 | SEOA2813 | 2177 | SEOA2886a | 2237 | SEOA2964a | 2297 | SEOA3036a | 2357 | SEOA3130a |
| 2118 | SEOA2814 | 2178 | SEOA2889a | 2238 | SEOA2965a | 2298 | SEOA3038a | 2358 | SEOA3131a |
| 2119 | SEOA2815 | 2179 | seoa2891a | 2239 | SEOA2966a | 2299 | SEOA3041a | 2359 | SEOA3132a |
| 2120 | seoa2816n | 2180 | SEOA2892a | 2240 | SEOA2967a | 2300 | SEOA3042a | 2360 | SEOA3133a |
| 2121 | SEOA2817n | 2181 | SEOA2893a | 2241 | SEOA2968a | 2301 | SEOA3043a | 2361 | SEOA3134a |
| 2122 | SEOA2818 | 2182 | SEOA2895a | 2242 | SEOA2970a | 2302 | SEOA3048a | 2362 | SEOA3135a |
| 2123 | SEOA2819 | 2183 | SEOA2896a | 2243 | SEOA2971a | 2303 | SEOA3049a | 2363 | seoa3137m |
| 2124 | seoa2820n | 2184 | seoa2898a | 2244 | SEOA2972a | 2304 | seoa3051a | 2364 | SEOA3138 |
| 2125 | SEOA2822 | 2185 | SEOA2899a | 2245 | SEOA2974a | 2305 | SEOA3052a | 2365 | SEOA3139 |
| 2126 | SEOA2823 | 2186 | SEOA2900a | 2246 | SEOA2975a | 2306 | SEOA3053a | 2366 | SEOA3140 |
| 2127 | SEOA2824 | 2187 | SEOA2901a | 2247 | SEOA2977a | 2307 | seoa3055a | 2367 | seoa3143n |
| 2128 | SEOA2825n | 2188 | SEOA2903a | 2248 | SEOA2978a | 2308 | SEOA3057a | 2368 | SEOA3144 |
| 2129 | seoa2826 | 2189 | SEOA2904a | 2249 | SEOA2979a | 2309 | SEOA3062a | 2369 | seoa3145m |
| 2130 | SEOA2827 | 2190 | SEOA2905a | 2250 | SEOA2981a | 2310 | SEOA3063a | 2370 | seoa3146m |
| 2131 | SEOA2828 | 2191 | SEOA2906a | 2251 | SEOA2982a | 2311 | SEOA3064a | 2371 | SEOA3147 |
| 2132 | SEOA2829 | 2192 | SEOA2907a | 2252 | SEOA2983a | 2312 | SEOA3065a | 2372 | SEOA3149 |
| 2133 | SEOA2830 | 2193 | SEOA2908a | 2253 | SEOA2984a | 2313 | SEOA3067a | 2373 | seoa3150m |
| 2134 | SEOA2831n | 2194 | SEOA2909a | 2254 | SEOA2985a | 2314 | SEOA3069a | 2374 | seoa3152m |
| 2135 | SEOA2832 | 2195 | SEOA2910a | 2255 | SEOA2986a | 2315 | SEOA3070a | 2375 | seoa3153m |
| 2136 | SEOA2833n | 2196 | SEOA2911a | 2256 | SEOA2987a | 2316 | SEOA3074a | 2376 | seoa3156mn |
| 2137 | SEOA2837 | 2197 | SEOA2912a | 2257 | SEOA2989a | 2317 | SEOA3075a | 2377 | seoa3157m |
| 2138 | SEOA2838 | 2198 | SEOA2913a | 2258 | SEOA2990a | 2318 | seoa3076a | 2378 | seoa3162m |
| 2139 | SEOA2839 | 2199 | SEOA2914a | 2259 | SEOA2992a | 2319 | SEOA3077a | 2379 | seoa3164m |
| 2140 | SEOA2840 | 2200 | SEOA2915a | 2260 | SEOA2993a | 2320 | SEOA3078a | 2380 | SEOA3165 |
| 2141 | SEOA2841 | 2201 | SEOA2917a | 2261 | SEOA2994a | 2321 | seoa3079a | 2381 | SEOA3166 |
| 2142 | SEOA2842 | 2202 | seoa2918an | 2262 | SEOA2995a | 2322 | SEOA3080a | 2382 | seoa3167m |
| 2143 | SEOA2843 | 2203 | SEOA2919a | 2263 | SEOA2996a | 2323 | seoa3081a | 2383 | seoa3168mn |
| 2144 | SEOA2844 | 2204 | SEOA2920a | 2264 | SEOA2997a | 2324 | SEOA3083a | 2384 | seoa3170m |
| 2145 | SEOA2845 | 2205 | SEOA2921a | 2265 | SEOA2998a | 2325 | seoa3084an | 2385 | SEOA3171n |
| 2146 | SEOA2846 | 2206 | SEOA2922a | 2266 | SEOA2999a | 2326 | SEOA3085a | 2386 | seoa3173n |
| 2147 | SEOA2847n | 2207 | SEOA2924a | 2267 | SEOA3000a | 2327 | SEOA3088a | 2387 | SEOA3174 |
| 2148 | SEOA2848 | 2208 | SEOA2926a | 2268 | SEOA3001a | 2328 | SEOA3090a | 2388 | SEOA3175 |
| 2149 | SEOA2850 | 2209 | SEOA2927a | 2269 | SEOA3002a | 2329 | SEOA3091a | 2389 | seoa3176m |
| 2150 | SEOA2851 | 2210 | SEOA2928a | 2270 | SEOA3003a | 2330 | SEOA3092a | 2390 | seoa3177m |
| 2151 | SEOA2852 | 2211 | SEOA2929a | 2271 | SEOA3004a | 2331 | SEOA3093a | 2391 | seoa3178m |
| 2152 | SEOA2853 | 2212 | SEOA2930a | 2272 | SEOA3006a | 2332 | SEOA3094a | 2392 | SEOA3179n |
| 2153 | SEOA2854 | 2213 | SEOA2931a | 2273 | SEOA3007a | 2333 | SEOA3095a | 2393 | SEOA3180n |
| 2154 | SEOA2856 | 2214 | SEOA2932a | 2274 | SEOA3008a | 2334 | SEOA3097a | 2394 | SEOA3181 |
| 2155 | SEOA2858 | 2215 | SEOA2933a | 2275 | seoa3009a | 2335 | SEOA3098a | 2395 | SEOA3183 |
| 2156 | SEOA2859 | 2216 | SEOA2934a | 2276 | SEOA3010a | 2336 | SEOA3099a | 2396 | SEOA3184 |
| 2157 | SEOA2860 | 2217 | SEOA2936a | 2277 | SEOA3012a | 2337 | SEOA3101a | 2397 | SEOA3186 |
| 2158 | SEOA2861 | 2218 | SEOA2937a | 2278 | SEOA3013a | 2338 | SEOA3102a | 2398 | SEOA3187 |
| 2159 | SEOA2862 | 2219 | SEOA2938a | 2279 | SEOA3014a | 2339 | SEOA3103a | 2399 | SEOA3188 |
| 2160 | SEOA2863 | 2220 | SEOA2940a | 2280 | SEOA3015a | 2340 | SEOA3105a | 2400 | SEOA3189 |

Figure 6E - List of EST Sequence Names From Severe OA Cartilage cDNA Library

| | | | | | | | | | |
|---|---|---|---|---|---|---|---|---|---|
| 2401 | SEOA3190 | 2461 | SEOA3263 | 2521 | SEOA3359a | 2581 | seoa3449a | 2641 | SEOA3544a |
| 2402 | seoa3191n | 2462 | SEOA3264 | 2522 | SEOA3361a | 2582 | SEOA3450a | 2642 | SEOA3545a |
| 2403 | SEOA3192 | 2463 | SEOA3266 | 2523 | SEOA3363a | 2583 | SEOA3451a | 2643 | SEOA3546a |
| 2404 | SEOA3194 | 2464 | SEOA3267 | 2524 | SEOA3366a | 2584 | SEOA3454a | 2644 | SEOA3547a |
| 2405 | SEOA3195 | 2465 | SEOA3268 | 2525 | SEOA3369a | 2585 | SEOA3456a | 2645 | SEOA3548a |
| 2406 | SEOA3196 | 2466 | SEOA3269 | 2526 | SEOA3371a | 2586 | SEOA3457a | 2646 | SEOA3549a |
| 2407 | SEOA3197 | 2467 | seoa3270n | 2527 | SEOA3373a | 2587 | SEOA3458a | 2647 | SEOA3551a |
| 2408 | SEOA3198 | 2468 | seoa3271n | 2528 | SEOA3374a | 2588 | SEOA3466a | 2648 | SEOA3552a |
| 2409 | seoa3199m | 2469 | seoa3272n | 2529 | SEOA3375a | 2589 | SEOA3467a | 2649 | SEOA3554a |
| 2410 | SEOA3200 | 2470 | SEOA3273n | 2530 | SEOA3376a | 2590 | SEOA3468a | 2650 | SEOA3555a |
| 2411 | SEOA3201 | 2471 | SEOA3274n | 2531 | seoa3378an | 2591 | SEOA3469a | 2651 | SEOA3556a |
| 2412 | SEOA3202 | 2472 | SEOA3276 | 2532 | seoa3379an | 2592 | SEOA3472a | 2652 | SEOA3557a |
| 2413 | SEOA3204 | 2473 | SEOA3277n | 2533 | SEOA3381a | 2593 | SEOA3473a | 2653 | SEOA3559a |
| 2414 | seoa3205n | 2474 | SEOA3287 | 2534 | SEOA3382a | 2594 | SEOA3474a | 2654 | SEOA3560a |
| 2415 | SEOA3207 | 2475 | SEOA3288 | 2535 | SEOA3383a | 2595 | seoa3475an | 2655 | SEOA3561a |
| 2416 | SEOA3208 | 2476 | seoa3289n | 2536 | SEOA3384a | 2596 | seoa3476a | 2656 | SEOA3563a |
| 2417 | seoa3209 | 2477 | seoa3290n | 2537 | SEOA3385a | 2597 | SEOA3477a | 2657 | SEOA3564a |
| 2418 | SEOA3212 | 2478 | SEOA3291 | 2538 | SEOA3386a | 2598 | SEOA3478a | 2658 | SEOA3565a |
| 2419 | SEOA3213 | 2479 | SEOA3293 | 2539 | SEOA3387a | 2599 | SEOA3486a | 2659 | SEOA3566a |
| 2420 | SEOA3214 | 2480 | SEOA3294 | 2540 | SEOA3388a | 2600 | SEOA3489a | 2660 | SEOA3567a |
| 2421 | SEOA3215 | 2481 | seoa3295n | 2541 | SEOA3389a | 2601 | SEOA3490a | 2661 | SEOA3568a |
| 2422 | seoa3216 | 2482 | SEOA3296 | 2542 | SEOA3390a | 2602 | SEOA3491a | 2662 | SEOA3571a |
| 2423 | seoa3217 | 2483 | SEOA3299 | 2543 | SEOA3391a | 2603 | SEOA3492a | 2663 | SEOA3572a |
| 2424 | SEOA3218 | 2484 | SEOA3300 | 2544 | SEOA3392a | 2604 | SEOA3494a | 2664 | SEOA3573a |
| 2425 | SEOA3219 | 2485 | SEOA3303 | 2545 | SEOA3393a | 2605 | SEOA3495a | 2665 | SEOA3575a |
| 2426 | seoa3221m | 2486 | SEOA3305n | 2546 | SEOA3394a | 2606 | SEOA3496a | 2666 | SEOA3576a |
| 2427 | SEOA3222 | 2487 | SEOA3306 | 2547 | SEOA3395a | 2607 | SEOA3498a | 2667 | SEOA3577a |
| 2428 | SEOA3223 | 2488 | SEOA3307 | 2548 | SEOA3396a | 2608 | SEOA3499a | 2668 | SEOA3578a |
| 2429 | SEOA3224 | 2489 | SEOA3308 | 2549 | SEOA3397a | 2609 | SEOA3500a | 2669 | SEOA3579a |
| 2430 | SEOA3225 | 2490 | SEOA3309 | 2550 | SEOA3399a | 2610 | SEOA3501a | 2670 | SEOA3580a |
| 2431 | seoa3226 | 2491 | seoa3311m | 2551 | SEOA3400a | 2611 | SEOA3502a | 2671 | SEOA3582a |
| 2432 | SEOA3227 | 2492 | seoa3314a | 2552 | SEOA3401a | 2612 | SEOA3503a | 2672 | SEOA3583a |
| 2433 | SEOA3228 | 2493 | SEOA3315a | 2553 | SEOA3402a | 2613 | SEOA3504a | 2673 | SEOA3584a |
| 2434 | SEOA3229 | 2494 | seoa3317a | 2554 | SEOA3403a | 2614 | SEOA3505a | 2674 | SEOA3587a |
| 2435 | SEOA3230 | 2495 | SEOA3318a | 2555 | SEOA3404a | 2615 | SEOA3506a | 2675 | SEOA3588a |
| 2436 | seoa3231 | 2496 | SEOA3319a | 2556 | SEOA3405a | 2616 | SEOA3507a | 2676 | SEOA3589a |
| 2437 | SEOA3232 | 2497 | SEOA3322a | 2557 | SEOA3408a | 2617 | SEOA3509a | 2677 | SEOA3591a |
| 2438 | SEOA3233n | 2498 | SEOA3324a | 2558 | seoa3411an | 2618 | SEOA3510a | 2678 | seoa3592a |
| 2439 | seoa3235mn | 2499 | SEOA3325a | 2559 | SEOA3412a | 2619 | SEOA3511a | 2679 | SEOA3593a |
| 2440 | seoa3238 | 2500 | SEOA3328a | 2560 | seoa3414an | 2620 | seoa3512a | 2680 | seoa3596an |
| 2441 | seoa3239m | 2501 | SEOA3329a | 2561 | SEOA3415a | 2621 | SEOA3513a | 2681 | seoa3597a |
| 2442 | SEOA3240 | 2502 | SEOA3330a | 2562 | SEOA3416a | 2622 | SEOA3514a | 2682 | SEOA3598a |
| 2443 | SEOA3241 | 2503 | SEOA3331a | 2563 | SEOA3417a | 2623 | SEOA3515a | 2683 | SEOA3600a |
| 2444 | SEOA3242n | 2504 | SEOA3335a | 2564 | SEOA3419a | 2624 | SEOA3516a | 2684 | SEOA3601a |
| 2445 | SEOA3243 | 2505 | SEOA3337a | 2565 | SEOA3420a | 2625 | SEOA3521a | 2685 | SEOA3602a |
| 2446 | SEOA3244 | 2506 | SEOA3338a | 2566 | SEOA3421a | 2626 | SEOA3524a | 2686 | SEOA3603a |
| 2447 | SEOA3245 | 2507 | SEOA3340a | 2567 | SEOA3422a | 2627 | SEOA3525a | 2687 | SEOA3604a |
| 2448 | SEOA3246 | 2508 | SEOA3341a | 2568 | seoa3423an | 2628 | SEOA3527a | 2688 | SEOA3606a |
| 2449 | SEOA3247 | 2509 | SEOA3343a | 2569 | seoa3424an | 2629 | SEOA3529a | 2689 | SEOA3608a |
| 2450 | seoa3248 | 2510 | SEOA3344a | 2570 | SEOA3425a | 2630 | SEOA3530a | 2690 | SEOA3609a |
| 2451 | seoa3249 | 2511 | SEOA3345a | 2571 | SEOA3426a | 2631 | SEOA3531a | 2691 | seoa3610an |
| 2452 | seoa3250m | 2512 | SEOA3348a | 2572 | SEOA3428a | 2632 | SEOA3533a | 2692 | SEOA3613a |
| 2453 | seoa3251m | 2513 | SEOA3349a | 2573 | SEOA3429a | 2633 | SEOA3535a | 2693 | SEOA3614a |
| 2454 | seoa3252m | 2514 | SEOA3350a | 2574 | SEOA3430a | 2634 | SEOA3537a | 2694 | SEOA3615a |
| 2455 | seoa3254m | 2515 | SEOA3352a | 2575 | SEOA3433a | 2635 | SEOA3538a | 2695 | SEOA3616a |
| 2456 | SEOA3255 | 2516 | SEOA3353a | 2576 | SEOA3434a | 2636 | SEOA3539a | 2696 | SEOA3617a |
| 2457 | SEOA3256n | 2517 | SEOA3355a | 2577 | seoa3443a | 2637 | SEOA3540a | 2697 | SEOA3618a |
| 2458 | seoa3257m | 2518 | SEOA3356a | 2578 | seoa3444an | 2638 | SEOA3541a | 2698 | SEOA3620a |
| 2459 | seoa3258m | 2519 | SEOA3357a | 2579 | SEOA3445a | 2639 | SEOA3542a | 2699 | SEOA3622a |
| 2460 | SEOA3261 | 2520 | SEOA3358a | 2580 | SEOA3446a | 2640 | SEOA3543a | 2700 | SEOA3623a |

Figure 6E – List of EST Sequence Names From Severe OA Cartilage cDNA Library

| | | | | | | | | | |
|---|---|---|---|---|---|---|---|---|---|
| 2701 | SEOA3624a | 2761 | SEOA3697a | 2821 | SEOA3775a | 2881 | SEOA3859 | 2941 | SEOA3931 |
| 2702 | SEOA3625a | 2762 | SEOA3698a | 2822 | SEOA3776a | 2882 | SEOA3860 | 2942 | SEOA3932 |
| 2703 | SEOA3627a | 2763 | SEOA3700a | 2823 | SEOA3777a | 2883 | SEOA3861 | 2943 | SEOA3933 |
| 2704 | SEOA3628a | 2764 | SEOA3701a | 2824 | SEOA3778a | 2884 | SEOA3862 | 2944 | SEOA3934 |
| 2705 | seoa3629an | 2765 | SEOA3702a | 2825 | SEOA3779a | 2885 | SEOA3863 | 2945 | SEOA3935 |
| 2706 | SEOA3630a | 2766 | SEOA3703a | 2826 | SEOA3780a | 2886 | SEOA3864 | 2946 | SEOA3936 |
| 2707 | SEOA3631a | 2767 | SEOA3704a | 2827 | seoa3790a | 2887 | SEOA3867 | 2947 | SEOA3937 |
| 2708 | SEOA3632a | 2768 | SEOA3705a | 2828 | SEOA3791a | 2888 | seoa3868 | 2948 | seoa3938n |
| 2709 | SEOA3633a | 2769 | SEOA3706a | 2829 | SEOA3792a | 2889 | SEOA3870 | 2949 | SEOA3939 |
| 2710 | SEOA3634a | 2770 | SEOA3708a | 2830 | SEOA3793a | 2890 | SEOA3871 | 2950 | SEOA3940 |
| 2711 | SEOA3635a | 2771 | SEOA3709a | 2831 | seoa3794an | 2891 | SEOA3872 | 2951 | SEOA3941 |
| 2712 | SEOA3637a | 2772 | SEOA3710a | 2832 | seoa3795a | 2892 | SEOA3875 | 2952 | SEOA3942a |
| 2713 | seoa3638an | 2773 | SEOA3711a | 2833 | SEOA3796a | 2893 | SEOA3876 | 2953 | SEOA3944a |
| 2714 | SEOA3639a | 2774 | SEOA3712a | 2834 | SEOA3797a | 2894 | seoa3877n | 2954 | SEOA3946a |
| 2715 | SEOA3640a | 2775 | SEOA3713a | 2835 | SEOA3799a | 2895 | SEOA3878 | 2955 | SEOA3947a |
| 2716 | SEOA3641a | 2776 | SEOA3714a | 2836 | seoa3800a | 2896 | SEOA3879 | 2956 | SEOA3948a |
| 2717 | SEOA3642a | 2777 | SEOA3715a | 2837 | SEOA3801a | 2897 | SEOA3881 | 2957 | SEOA3949a |
| 2718 | SEOA3643a | 2778 | seoa3716a | 2838 | SEOA3802a | 2898 | SEOA3883 | 2958 | SEOA3953a |
| 2719 | SEOA3644a | 2779 | SEOA3717a | 2839 | SEOA3803a | 2899 | SEOA3884 | 2959 | SEOA3954a |
| 2720 | SEOA3645a | 2780 | SEOA3718a | 2840 | SEOA3804a | 2900 | SEOA3885 | 2960 | SEOA3956a |
| 2721 | SEOA3646a | 2781 | SEOA3719a | 2841 | SEOA3807a | 2901 | SEOA3886 | 2961 | SEOA3957a |
| 2722 | SEOA3647a | 2782 | SEOA3720a | 2842 | SEOA3808a | 2902 | SEOA3887 | 2962 | SEOA3958a |
| 2723 | SEOA3648a | 2783 | SEOA3721a | 2843 | SEOA3810a | 2903 | seoa3890n | 2963 | SEOA3959a |
| 2724 | SEOA3650a | 2784 | SEOA3722a | 2844 | SEOA3811a | 2904 | SEOA3891 | 2964 | SEOA3960a |
| 2725 | SEOA3651a | 2785 | SEOA3725a | 2845 | SEOA3812a | 2905 | SEOA3892 | 2965 | SEOA3961a |
| 2726 | SEOA3652a | 2786 | SEOA3729a | 2846 | SEOA3813a | 2906 | SEOA3893 | 2966 | SEOA3962a |
| 2727 | SEOA3653a | 2787 | SEOA3731a | 2847 | SEOA3814a | 2907 | SEOA3894 | 2967 | SEOA3963a |
| 2728 | SEOA3654a | 2788 | SEOA3733a | 2848 | SEOA3815a | 2908 | SEOA3895 | 2968 | SEOA3964a |
| 2729 | SEOA3655a | 2789 | SEOA3734a | 2849 | SEOA3816a | 2909 | seoa3896n | 2969 | SEOA3965a |
| 2730 | SEOA3658a | 2790 | SEOA3735a | 2850 | SEOA3817a | 2910 | SEOA3897 | 2970 | SEOA3966a |
| 2731 | SEOA3659a | 2791 | SEOA3736a | 2851 | SEOA3819a | 2911 | seoa3898n | 2971 | SEOA3967a |
| 2732 | SEOA3660a | 2792 | SEOA3737a | 2852 | SEOA3820a | 2912 | seoa3899n | 2972 | SEOA3968a |
| 2733 | SEOA3662a | 2793 | SEOA3738a | 2853 | SEOA3821a | 2913 | SEOA3900 | 2973 | SEOA3970a |
| 2734 | SEOA3663a | 2794 | SEOA3739a | 2854 | SEOA3822a | 2914 | SEOA3901 | 2974 | SEOA3971a |
| 2735 | SEOA3664a | 2795 | SEOA3740a | 2855 | SEOA3824a | 2915 | SEOA3902 | 2975 | SEOA3972a |
| 2736 | SEOA3665a | 2796 | SEOA3741a | 2856 | SEOA3825a | 2916 | SEOA3904 | 2976 | SEOA3973a |
| 2737 | SEOA3666a | 2797 | SEOA3742a | 2857 | SEOA3827a | 2917 | SEOA3905 | 2977 | SEOA3974a |
| 2738 | SEOA3667a | 2798 | seoa3743an | 2858 | SEOA3828a | 2918 | SEOA3906 | 2978 | seoa3975a |
| 2739 | SEOA3668a | 2799 | SEOA3744a | 2859 | SEOA3835 | 2919 | SEOA3907 | 2979 | SEOA3976a |
| 2740 | SEOA3669a | 2800 | SEOA3746a | 2860 | seoa3836n | 2920 | SEOA3908 | 2980 | SEOA3977a |
| 2741 | SEOA3670a | 2801 | SEOA3747a | 2861 | SEOA3837 | 2921 | SEOA3909 | 2981 | SEOA3978a |
| 2742 | SEOA3671a | 2802 | SEOA3748a | 2862 | SEOA3838 | 2922 | SEOA3910 | 2982 | SEOA3980a |
| 2743 | SEOA3673a | 2803 | SEOA3749a | 2863 | SEOA3839 | 2923 | SEOA3911 | 2983 | SEOA3981a |
| 2744 | seoa3674an | 2804 | SEOA3750a | 2864 | SEOA3840 | 2924 | SEOA3912 | 2984 | SEOA3982a |
| 2745 | seoa3675a | 2805 | SEOA3751a | 2865 | SEOA3841 | 2925 | SEOA3913 | 2985 | SEOA3983a |
| 2746 | SEOA3678a | 2806 | SEOA3752a | 2866 | SEOA3842 | 2926 | seoa3914n | 2986 | SEOA3987a |
| 2747 | SEOA3679a | 2807 | SEOA3755a | 2867 | SEOA3843 | 2927 | SEOA3916 | 2987 | SEOA3988a |
| 2748 | SEOA3680a | 2808 | SEOA3757a | 2868 | SEOA3844 | 2928 | SEOA3917 | 2988 | SEOA3989a |
| 2749 | SEOA3683a | 2809 | SEOA3758a | 2869 | SEOA3845 | 2929 | SEOA3918 | 2989 | SEOA3990a |
| 2750 | SEOA3685a | 2810 | SEOA3759a | 2870 | SEOA3846 | 2930 | SEOA3919 | 2990 | SEOA3993a |
| 2751 | SEOA3686a | 2811 | SEOA3761a | 2871 | SEOA3847 | 2931 | SEOA3920 | 2991 | SEOA3995a |
| 2752 | seoa3687an | 2812 | SEOA3763a | 2872 | SEOA3848 | 2932 | SEOA3921 | 2992 | SEOA3996a |
| 2753 | SEOA3688a | 2813 | SEOA3765a | 2873 | SEOA3849 | 2933 | SEOA3922 | 2993 | SEOA3997a |
| 2754 | SEOA3689a | 2814 | SEOA3766a | 2874 | SEOA3850 | 2934 | SEOA3923 | 2994 | SEOA3998a |
| 2755 | SEOA3690a | 2815 | SEOA3767a | 2875 | SEOA3852 | 2935 | seoa3924 | 2995 | seoa3999a |
| 2756 | SEOA3691a | 2816 | SEOA3768a | 2876 | SEOA3853 | 2936 | SEOA3925 | 2996 | SEOA4000a |
| 2757 | SEOA3692a | 2817 | SEOA3770a | 2877 | SEOA3855 | 2937 | SEOA3926 | 2997 | seoa4001a |
| 2758 | SEOA3693a | 2818 | SEOA3771 | 2878 | SEOA3856 | 2938 | SEOA3927 | 2998 | SEOA4002a |
| 2759 | SEOA3694a | 2819 | SEOA3773a | 2879 | SEOA3857 | 2939 | SEOA3929 | 2999 | SEOA4003a |
| 2760 | SEOA3695a | 2820 | SEOA3774a | 2880 | SEOA3858 | 2940 | SEOA3930 | 3000 | SEOA4005a |

Figure 6E - List of EST Sequence Names From Severe OA Cartilage cDNA Library

| | | | | | | | | | |
|---|---|---|---|---|---|---|---|---|---|
| 3001 | SEOA4006a | 3061 | SEOA4098a | 3121 | SEOA4183a | 3181 | SEOA4281a | 3241 | SEOA4370a |
| 3002 | SEOA4007a | 3062 | SEOA4099a | 3122 | SEOA4184a | 3182 | SEOA4282a | 3242 | SEOA4371a |
| 3003 | SEOA4009a | 3063 | seoa4100a | 3123 | SEOA4185a | 3183 | SEOA4284a | 3243 | SEOA4373a |
| 3004 | SEOA4010a | 3064 | SEOA4101a | 3124 | SEOA4186a | 3184 | SEOA4288a | 3244 | SEOA4376a |
| 3005 | SEOA4011a | 3065 | seoa4102an | 3125 | SEOA4187a | 3185 | SEOA4289a | 3245 | SEOA4377a |
| 3006 | SEOA4012a | 3066 | SEOA4106a | 3126 | SEOA4188a | 3186 | SEOA4291a | 3246 | SEOA4378a |
| 3007 | SEOA4013a | 3067 | SEOA4107a | 3127 | SEOA4189a | 3187 | SEOA4292a | 3247 | SEOA4379a |
| 3008 | seoa4014a | 3068 | SEOA4108a | 3128 | SEOA4190a | 3188 | SEOA4293a | 3248 | SEOA4380a |
| 3009 | SEOA4017a | 3069 | SEOA4109a | 3129 | SEOA4193a | 3189 | SEOA4294a | 3249 | SEOA4381a |
| 3010 | SEOA4019a | 3070 | SEOA4110a | 3130 | SEOA4194a | 3190 | SEOA4296a | 3250 | SEOA4382a |
| 3011 | SEOA4020a | 3071 | SEOA4111a | 3131 | SEOA4197a | 3191 | SEOA4298a | 3251 | seoa4383a |
| 3012 | SEOA4021a | 3072 | SEOA4112a | 3132 | SEOA4198a | 3192 | SEOA4299a | 3252 | SEOA4384a |
| 3013 | SEOA4022a | 3073 | SEOA4115a | 3133 | SEOA4199a | 3193 | seoa4300a | 3253 | SEOA4385a |
| 3014 | SEOA4023a | 3074 | SEOA4116a | 3134 | SEOA4200a | 3194 | SEOA4301a | 3254 | SEOA4386a |
| 3015 | SEOA4024a | 3075 | SEOA4119a | 3135 | SEOA4201a | 3195 | SEOA4302a | 3255 | SEOA4387a |
| 3016 | SEOA4025a | 3076 | SEOA4120a | 3136 | SEOA4202a | 3196 | SEOA4303a | 3256 | seoa4388a |
| 3017 | SEOA4026a | 3077 | SEOA4121a | 3137 | SEOA4204a | 3197 | SEOA4305a | 3257 | SEOA4390a |
| 3018 | SEOA4027a | 3078 | seoa4122a | 3138 | SEOA4205a | 3198 | SEOA4306a | 3258 | SEOA4391a |
| 3019 | SEOA4029a | 3079 | seoa4123an | 3139 | SEOA4206a | 3199 | seoa4309a | 3259 | SEOA4392a |
| 3020 | SEOA4031a | 3080 | SEOA4125a | 3140 | SEOA4207a | 3200 | SEOA4310a | 3260 | SEOA4394a |
| 3021 | SEOA4032a | 3081 | SEOA4127a | 3141 | SEOA4208a | 3201 | SEOA4311a | 3261 | SEOA4395a |
| 3022 | SEOA4034a | 3082 | SEOA4128a | 3142 | SEOA4210a | 3202 | SEOA4312a | 3262 | SEOA4396a |
| 3023 | SEOA4035a | 3083 | SEOA4129a | 3143 | seoa4211a | 3203 | SEOA4314a | 3263 | SEOA4397a |
| 3024 | SEOA4036a | 3084 | SEOA4131a | 3144 | SEOA4213a | 3204 | SEOA4315a | 3264 | SEOA4398a |
| 3025 | SEOA4037a | 3085 | SEOA4132a | 3145 | SEOA4214a | 3205 | SEOA4316a | 3265 | SEOA4400a |
| 3026 | SEOA4038a | 3086 | SEOA4133a | 3146 | SEOA4215a | 3206 | SEOA4317a | 3266 | SEOA4402a |
| 3027 | SEOA4040a | 3087 | SEOA4135a | 3147 | SEOA4217a | 3207 | SEOA4319a | 3267 | SEOA4403a |
| 3028 | SEOA4041a | 3088 | SEOA4137a | 3148 | SEOA4218a | 3208 | SEOA4320a | 3268 | SEOA4404a |
| 3029 | SEOA4043a | 3089 | SEOA4139a | 3149 | SEOA4221a | 3209 | SEOA4322a | 3269 | SEOA4405a |
| 3030 | SEOA4044a | 3090 | SEOA4140a | 3150 | SEOA4223a | 3210 | SEOA4323a | 3270 | SEOA4406a |
| 3031 | SEOA4048a | 3091 | SEOA4141a | 3151 | SEOA4224a | 3211 | SEOA4324a | 3271 | SEOA4408a |
| 3032 | SEOA4052a | 3092 | SEOA4142a | 3152 | SEOA4225a | 3212 | SEOA4325a | 3272 | SEOA4409a |
| 3033 | SEOA4053a | 3093 | SEOA4144a | 3153 | SEOA4229a | 3213 | SEOA4327a | 3273 | SEOA4410a |
| 3034 | SEOA4055 | 3094 | SEOA4146a | 3154 | SEOA4230a | 3214 | SEOA4329a | 3274 | SEOA4411a |
| 3035 | SEOA4056 | 3095 | SEOA4147a | 3155 | SEOA4231a | 3215 | SEOA4330a | 3275 | SEOA4412a |
| 3036 | seoa4057 | 3096 | SEOA4148a | 3156 | seoa4232a | 3216 | SEOA4332a | 3276 | SEOA4413a |
| 3037 | seoa4058n | 3097 | seoa4149an | 3157 | SEOA4234a | 3217 | SEOA4333 | 3277 | SEOA4414a |
| 3038 | SEOA4061 | 3098 | SEOA4151a | 3158 | SEOA4239a | 3218 | SEOA4335a | 3278 | SEOA4416a |
| 3039 | SEOA4062 | 3099 | SEOA4152a | 3159 | SEOA4241a | 3219 | SEOA4336a | 3279 | SEOA4418a |
| 3040 | SEOA4063 | 3100 | SEOA4154a | 3160 | SEOA4242a | 3220 | seoa4337an | 3280 | SEOA4420a |
| 3041 | SEOA4066 | 3101 | SEOA4155a | 3161 | SEOA4245a | 3221 | SEOA4338a | 3281 | SEOA4421a |
| 3042 | seoa4068 | 3102 | SEOA4156a | 3162 | SEOA4246a | 3222 | SEOA4341a | 3282 | SEOA4422a |
| 3043 | SEOA4070 | 3103 | SEOA4157a | 3163 | SEOA4247a | 3223 | SEOA4342a | 3283 | SEOA4423a |
| 3044 | SEOA4072 | 3104 | SEOA4158a | 3164 | SEOA4248a | 3224 | SEOA4343a | 3284 | SEOA4424a |
| 3045 | SEOA4075 | 3105 | SEOA4159a | 3165 | SEOA4250a | 3225 | SEOA4346a | 3285 | SEOA4425a |
| 3046 | SEOA4076 | 3106 | SEOA4160a | 3166 | SEOA4253a | 3226 | SEOA4347a | 3286 | seoa4427a |
| 3047 | SEOA4077 | 3107 | SEOA4163a | 3167 | SEOA4255a | 3227 | SEOA4348a | 3287 | SEOA4428a |
| 3048 | SEOA4078 | 3108 | SEOA4164a | 3168 | SEOA4257a | 3228 | SEOA4350a | 3288 | SEOA4429a |
| 3049 | seoa4079 | 3109 | SEOA4165a | 3169 | SEOA4258a | 3229 | SEOA4352a | 3289 | SEOA4430a |
| 3050 | SEOA4081 | 3110 | SEOA4167a | 3170 | seoa4261a | 3230 | SEOA4354a | 3290 | SEOA4431a |
| 3051 | SEOA4082 | 3111 | SEOA4169a | 3171 | SEOA4262a | 3231 | SEOA4355a | 3291 | SEOA4436a |
| 3052 | SEOA4083 | 3112 | SEOA4170a | 3172 | SEOA4263a | 3232 | SEOA4356a | 3292 | SEOA4437a |
| 3053 | SEOA4084 | 3113 | SEOA4171a | 3173 | SEOA4264a | 3233 | SEOA4358a | 3293 | SEOA4440 |
| 3054 | SEOA4085 | 3114 | SEOA4172a | 3174 | SEOA4265a | 3234 | SEOA4359a | 3294 | SEOA4443a |
| 3055 | SEOA4086 | 3115 | SEOA4173a | 3175 | SEOA4266a | 3235 | SEOA4360a | 3295 | SEOA4444a |
| 3056 | SEOA4087 | 3116 | SEOA4174a | 3176 | SEOA4271a | 3236 | SEOA4363a | 3296 | seoa4445a |
| 3057 | SEOA4088 | 3117 | SEOA4175a | 3177 | SEOA4274a | 3237 | SEOA4366a | 3297 | SEOA4446a |
| 3058 | SEOA4092 | 3118 | SEOA4177a | 3178 | SEOA4277a | 3238 | seoa4367an | 3298 | seoa4447a |
| 3059 | SEOA4094 | 3119 | SEOA4178a | 3179 | SEOA4278a | 3239 | SEOA4368a | 3299 | SEOA4448a |
| 3060 | SEOA4095 | 3120 | SEOA4181a | 3180 | SEOA4280a | 3240 | SEOA4369a | 3300 | SEOA4449a |

Figure 6E – List of EST Sequence Names From Severe OA Cartilage cDNA Library

| | | | | | | | | | |
|---|---|---|---|---|---|---|---|---|---|
| 3301 | SEOA4450a | 3361 | SEOA4535 | 3421 | SEOA4612a | 3481 | SEOA4694a | 3541 | SEOA4767a |
| 3302 | SEOA4451a | 3362 | SEOA4536 | 3422 | SEOA4613a | 3482 | SEOA4695a | 3542 | SEOA4768a |
| 3303 | SEOA4452a | 3363 | SEOA4537 | 3423 | SEOA4614a | 3483 | SEOA4696a | 3543 | SEOA4769a |
| 3304 | SEOA4453a | 3364 | SEOA4538 | 3424 | SEOA4616a | 3484 | SEOA4697a | 3544 | SEOA4770a |
| 3305 | SEOA4455a | 3365 | SEOA4539 | 3425 | SEOA4617a | 3485 | SEOA4698a | 3545 | SEOA4771a |
| 3306 | SEOA4457a | 3366 | SEOA4540 | 3426 | SEOA4618a | 3486 | SEOA4699a | 3546 | SEOA4772a |
| 3307 | SEOA4458a | 3367 | SEOA4541 | 3427 | SEOA4619a | 3487 | seoa4700a | 3547 | SEOA4773a |
| 3308 | SEOA4460a | 3368 | SEOA4542 | 3428 | SEOA4620a | 3488 | SEOA4703a | 3548 | SEOA4775a |
| 3309 | SEOA4461a | 3369 | SEOA4543 | 3429 | SEOA4623a | 3489 | seoa4704 | 3549 | SEOA4778a |
| 3310 | SEOA4462a | 3370 | SEOA4544 | 3430 | SEOA4625a | 3490 | seoa4705an | 3550 | SEOA4780a |
| 3311 | SEOA4463a | 3371 | SEOA4545 | 3431 | SEOA4626a | 3491 | SEOA4706a | 3551 | SEOA4781a |
| 3312 | SEOA4464a | 3372 | SEOA4546 | 3432 | SEOA4628a | 3492 | SEOA4707a | 3552 | SEOA4783a |
| 3313 | SEOA4467a | 3373 | SEOA4548 | 3433 | SEOA4630a | 3493 | SEOA4708a | 3553 | SEOA4784a |
| 3314 | SEOA4469a | 3374 | SEOA4549 | 3434 | SEOA4631a | 3494 | SEOA4709a | 3554 | SEOA4785a |
| 3315 | SEOA4473a | 3375 | SEOA4550 | 3435 | seoa4632a | 3495 | SEOA4710a | 3555 | SEOA4786a |
| 3316 | SEOA4475a | 3376 | SEOA4554 | 3436 | SEOA4634a | 3496 | seoa4711an | 3556 | SEOA4787a |
| 3317 | SEOA4476a | 3377 | SEOA4555 | 3437 | SEOA4635a | 3497 | seoa4712a | 3557 | SEOA4789a |
| 3318 | SEOA4477a | 3378 | SEOA4557 | 3438 | SEOA4636a | 3498 | SEOA4713a | 3558 | SEOA4790a |
| 3319 | SEOA4478a | 3379 | SEOA4558 | 3439 | SEOA4637a | 3499 | SEOA4714a | 3559 | SEOA4791a |
| 3320 | SEOA4479a | 3380 | SEOA4559 | 3440 | SEOA4639a | 3500 | SEOA4715a | 3560 | SEOA4792a |
| 3321 | SEOA4481 | 3381 | SEOA4560 | 3441 | SEOA4640a | 3501 | SEOA4716a | 3561 | SEOA4794a |
| 3322 | SEOA4482 | 3382 | SEOA4561 | 3442 | SEOA4641a | 3502 | SEOA4717a | 3562 | SEOA4795a |
| 3323 | SEOA4484 | 3383 | SEOA4562 | 3443 | SEOA4642a | 3503 | SEOA4718a | 3563 | SEOA4796a |
| 3324 | SEOA4485 | 3384 | SEOA4563 | 3444 | SEOA4643a | 3504 | SEOA4719a | 3564 | SEOA4798a |
| 3325 | SEOA4487 | 3385 | SEOA4564 | 3445 | seoa4644an | 3505 | SEOA4720a | 3565 | SEOA4799a |
| 3326 | SEOA4489 | 3386 | SEOA4569 | 3446 | SEOA4645a | 3506 | SEOA4721a | 3566 | SEOA4802a |
| 3327 | SEOA4490 | 3387 | SEOA4570 | 3447 | SEOA4646a | 3507 | SEOA4722a | 3567 | SEOA4803a |
| 3328 | SEOA4491 | 3388 | SEOA4571 | 3448 | SEOA4647a | 3508 | SEOA4723a | 3568 | SEOA4804a |
| 3329 | SEOA4492 | 3389 | SEOA4573 | 3449 | SEOA4649a | 3509 | SEOA4724a | 3569 | SEOA4805a |
| 3330 | SEOA4494 | 3390 | SEOA4574 | 3450 | SEOA4651a | 3510 | seoa4726a | 3570 | SEOA4806a |
| 3331 | SEOA4495 | 3391 | SEOA4575 | 3451 | SEOA4653a | 3511 | SEOA4727a | 3571 | SEOA4808a |
| 3332 | SEOA4496 | 3392 | SEOA4576 | 3452 | SEOA4655a | 3512 | SEOA4728a | 3572 | SEOA4809a |
| 3333 | SEOA4497 | 3393 | SEOA4577 | 3453 | seoa4656a | 3513 | SEOA4730a | 3573 | SEOA4810a |
| 3334 | SEOA4498 | 3394 | SEOA4578 | 3454 | SEOA4657a | 3514 | SEOA4731a | 3574 | SEOA4811a |
| 3335 | SEOA4499 | 3395 | SEOA4579 | 3455 | SEOA4658a | 3515 | seoa4732an | 3575 | SEOA4812a |
| 3336 | SEOA4501 | 3396 | SEOA4580 | 3456 | SEOA4660a | 3516 | SEOA4734a | 3576 | SEOA4813a |
| 3337 | SEOA4502 | 3397 | SEOA4581 | 3457 | SEOA4662a | 3517 | SEOA4736a | 3577 | SEOA4814a |
| 3338 | SEOA4504 | 3398 | SEOA4582 | 3458 | SEOA4663a | 3518 | SEOA4737a | 3578 | SEOA4815a |
| 3339 | SEOA4505 | 3399 | SEOA4583 | 3459 | SEOA4665a | 3519 | SEOA4739a | 3579 | SEOA4816a |
| 3340 | SEOA4506 | 3400 | SEOA4584 | 3460 | SEOA4667a | 3520 | SEOA4740a | 3580 | SEOA4818a |
| 3341 | SEOA4507 | 3401 | SEOA4585 | 3461 | SEOA4669a | 3521 | SEOA4741a | 3581 | SEOA4819a |
| 3342 | SEOA4508 | 3402 | SEOA4586 | 3462 | SEOA4670a | 3522 | SEOA4742a | 3582 | SEOA4820a |
| 3343 | SEOA4510 | 3403 | SEOA4587 | 3463 | SEOA4671a | 3523 | SEOA4743a | 3583 | SEOA4821a |
| 3344 | SEOA4511 | 3404 | SEOA4588 | 3464 | SEOA4673a | 3524 | SEOA4744a | 3584 | SEOA4822a |
| 3345 | SEOA4513 | 3405 | SEOA4590 | 3465 | SEOA4674a | 3525 | SEOA4745a | 3585 | SEOA4824a |
| 3346 | SEOA4515 | 3406 | SEOA4591 | 3466 | SEOA4675a | 3526 | SEOA4746a | 3586 | SEOA4825a |
| 3347 | SEOA4516 | 3407 | SEOA4594 | 3467 | SEOA4678a | 3527 | SEOA4747a | 3587 | SEOA4826a |
| 3348 | SEOA4517 | 3408 | SEOA4595 | 3468 | SEOA4681a | 3528 | SEOA4748a | 3588 | SEOA4827a |
| 3349 | SEOA4518 | 3409 | SEOA4598 | 3469 | SEOA4682a | 3529 | SEOA4751a | 3589 | SEOA4828a |
| 3350 | SEOA4519 | 3410 | SEOA4599 | 3470 | SEOA4683a | 3530 | SEOA4752a | 3590 | SEOA4829a |
| 3351 | SEOA4521 | 3411 | SEOA4600a | 3471 | SEOA4684a | 3531 | SEOA4753a | 3591 | SEOA4830a |
| 3352 | SEOA4522 | 3412 | SEOA4601a | 3472 | SEOA4685a | 3532 | SEOA4754a | 3592 | SEOA4831a |
| 3353 | SEOA4523 | 3413 | SEOA4602a | 3473 | SEOA4686a | 3533 | SEOA4755a | 3593 | SEOA4834a |
| 3354 | SEOA4524 | 3414 | SEOA4603a | 3474 | SEOA4687a | 3534 | SEOA4756a | 3594 | SEOA4836a |
| 3355 | seoa4526 | 3415 | SEOA4605a | 3475 | SEOA4688a | 3535 | SEOA4758a | 3595 | SEOA4837a |
| 3356 | SEOA4529 | 3416 | SEOA4606a | 3476 | SEOA4689a | 3536 | SEOA4759a | 3596 | SEOA4838a |
| 3357 | SEOA4530 | 3417 | SEOA4607a | 3477 | SEOA4690a | 3537 | SEOA4760a | 3597 | SEOA4839a |
| 3358 | SEOA4531 | 3418 | SEOA4608a | 3478 | SEOA4691a | 3538 | SEOA4764a | 3598 | SEOA4840a |
| 3359 | SEOA4532 | 3419 | SEOA4610a | 3479 | SEOA4692a | 3539 | SEOA4765a | 3599 | SEOA4846a |
| 3360 | SEOA4534 | 3420 | SEOA4611a | 3480 | seoa4693a | 3540 | SEOA4766a | 3600 | SEOA4847a |

Figure 6E – List of EST Sequence Names From Severe OA Cartilage cDNA Library

| | | | | | | | | | |
|---|---|---|---|---|---|---|---|---|---|
| 3601 | SEOA4848a | 3661 | seoa4929a | 3721 | SEOA5033a | 3781 | SEOA5115a | 3841 | SEOA5225a |
| 3602 | SEOA4849a | 3662 | seoa4930a | 3722 | SEOA5034a | 3782 | SEOA5116a | 3842 | SEOA5226a |
| 3603 | SEOA4850a | 3663 | seoa4931a | 3723 | SEOA5035a | 3783 | SEOA5117a | 3843 | seoa5227a |
| 3604 | SEOA4852a | 3664 | seoa4932a | 3724 | SEOA5036a | 3784 | SEOA5118a | 3844 | SEOA5228a |
| 3605 | SEOA4853a | 3665 | seoa4933a | 3725 | SEOA5037a | 3785 | SEOA5119a | 3845 | SEOA5229a |
| 3606 | SEOA4854a | 3666 | seoa4934a | 3726 | SEOA5038a | 3786 | SEOA5121a | 3846 | SEOA5231a |
| 3607 | SEOA4855a | 3667 | seoa4938a | 3727 | seoa5043an | 3787 | SEOA5125a | 3847 | SEOA5232a |
| 3608 | SEOA4857a | 3668 | seoa4939a | 3728 | SEOA5046a | 3788 | SEOA5126a | 3848 | SEOA5234a |
| 3609 | SEOA4858a | 3669 | seoa4940a | 3729 | SEOA5047a | 3789 | SEOA5127a | 3849 | SEOA5235a |
| 3610 | SEOA4859a | 3670 | seoa4941a | 3730 | SEOA5048a | 3790 | SEOA5128a | 3850 | SEOA5239a |
| 3611 | SEOA4860a | 3671 | seoa4942a | 3731 | SEOA5051a | 3791 | SEOA5129a | 3851 | SEOA5242a |
| 3612 | SEOA4862a | 3672 | seoa4943a | 3732 | SEOA5052a | 3792 | SEOA5131a | 3852 | SEOA5244a |
| 3613 | SEOA4863a | 3673 | seoa4945a | 3733 | SEOA5055a | 3793 | SEOA5133a | 3853 | SEOA5245a |
| 3614 | SEOA4865a | 3674 | seoa4946a | 3734 | SEOA5056a | 3794 | SEOA5135a | 3854 | SEOA5246a |
| 3615 | SEOA4866a | 3675 | seoa4948a | 3735 | SEOA5057a | 3795 | SEOA5136a | 3855 | SEOA5247a |
| 3616 | SEOA4867a | 3676 | seoa4949a | 3736 | seoa5058an | 3796 | SEOA5137a | 3856 | SEOA5248a |
| 3617 | SEOA4868a | 3677 | seoa4950a | 3737 | SEOA5059a | 3797 | SEOA5138a | 3857 | SEOA5249a |
| 3618 | SEOA4869a | 3678 | seoa4952a | 3738 | seoa5060an | 3798 | SEOA5139a | 3858 | SEOA5250a |
| 3619 | SEOA4870a | 3679 | seoa4953a | 3739 | SEOA5061a | 3799 | SEOA5140a | 3859 | SEOA5251a |
| 3620 | SEOA4871a | 3680 | seoa4954a | 3740 | SEOA5062a | 3800 | SEOA5141a | 3860 | SEOA5253a |
| 3621 | SEOA4872a | 3681 | seoa4955a | 3741 | SEOA5063a | 3801 | SEOA5142a | 3861 | SEOA5254a |
| 3622 | SEOA4873a | 3682 | seoa4956a | 3742 | SEOA5065a | 3802 | SEOA5143a | 3862 | SEOA5255a |
| 3623 | seoa4875a | 3683 | seoa4957a | 3743 | SEOA5067a | 3803 | SEOA5144a | 3863 | SEOA5258a |
| 3624 | SEOA4876a | 3684 | seoa4958a | 3744 | SEOA5068a | 3804 | SEOA5145a | 3864 | SEOA5264a |
| 3625 | SEOA4877a | 3685 | seoa4959a | 3745 | SEOA5069a | 3805 | SEOA5146a | 3865 | SEOA5265a |
| 3626 | SEOA4878a | 3686 | seoa4961a | 3746 | SEOA5070a | 3806 | SEOA5147a | 3866 | SEOA5267a |
| 3627 | SEOA4879a | 3687 | seoa4962a | 3747 | SEOA5074a | 3807 | SEOA5148a | 3867 | SEOA5269a |
| 3628 | SEOA4880a | 3688 | seoa4963a | 3748 | SEOA5076a | 3808 | SEOA5149a | 3868 | SEOA5270a |
| 3629 | SEOA4881a | 3689 | seoa4964a | 3749 | SEOA5077a | 3809 | SEOA5151a | 3869 | SEOA5272a |
| 3630 | SEOA4883a | 3690 | seoa4966a | 3750 | SEOA5078a | 3810 | SEOA5153a | 3870 | SEOA5273a |
| 3631 | SEOA4885a | 3691 | seoa4969a | 3751 | SEOA5079a | 3811 | SEOA5154a | 3871 | SEOA5274a |
| 3632 | SEOA4886a | 3692 | seoa4970a | 3752 | SEOA5081a | 3812 | SEOA5155a | 3872 | SEOA5275a |
| 3633 | SEOA4887a | 3693 | seoa4971a | 3753 | SEOA5082a | 3813 | SEOA5156a | 3873 | SEOA5276a |
| 3634 | SEOA4890a | 3694 | seoa4973a | 3754 | SEOA5083a | 3814 | SEOA5157a | 3874 | seoa5277a |
| 3635 | seoa4891a | 3695 | seoa4974a | 3755 | SEOA5084a | 3815 | SEOA5158a | 3875 | SEOA5278a |
| 3636 | seoa4892a | 3696 | seoa4977a | 3756 | seoa5085a | 3816 | SEOA5162a | 3876 | SEOA5279a |
| 3637 | seoa4893a | 3697 | seoa4978a | 3757 | SEOA5086a | 3817 | SEOA5163a | 3877 | SEOA5280a |
| 3638 | seoa4894a | 3698 | seoa4980a | 3758 | SEOA5087a | 3818 | SEOA5164a | 3878 | SEOA5281a |
| 3639 | seoa4895a | 3699 | seoa4981a | 3759 | SEOA5088a | 3819 | SEOA5165a | 3879 | SEOA5282a |
| 3640 | seoa4896a | 3700 | seoa4985a | 3760 | SEOA5089a | 3820 | SEOA5166a | 3880 | SEOA5284a |
| 3641 | seoa4899a | 3701 | seoa4986a | 3761 | SEOA5090a | 3821 | SEOA5167a | 3881 | SEOA5285a |
| 3642 | seoa4901a | 3702 | seoa4987a | 3762 | SEOA5091a | 3822 | SEOA5170a | 3882 | seoa5286a |
| 3643 | seoa4903a | 3703 | seoa4988a | 3763 | SEOA5093a | 3823 | SEOA5173a | 3883 | SEOA5289a |
| 3644 | seoa4905a | 3704 | seoa4989a | 3764 | SEOA5094a | 3824 | SEOA5174a | 3884 | SEOA5290a |
| 3645 | seoa4906a | 3705 | seoa4993a | 3765 | SEOA5095a | 3825 | SEOA5176a | 3885 | SEOA5291a |
| 3646 | seoa4909a | 3706 | seoa4996a | 3766 | SEOA5096a | 3826 | SEOA5196a | 3886 | SEOA5292a |
| 3647 | seoa4910a | 3707 | seoa4997a | 3767 | SEOA5098a | 3827 | SEOA5201a | 3887 | SEOA5293a |
| 3648 | seoa4911a | 3708 | seoa4998a | 3768 | SEOA5099a | 3828 | SEOA5202a | 3888 | SEOA5294a |
| 3649 | seoa4914a | 3709 | SEOA5004a | 3769 | SEOA5101a | 3829 | SEOA5203a | 3889 | SEOA5296a |
| 3650 | seoa4915a | 3710 | SEOA5005a | 3770 | seoa5103a | 3830 | SEOA5204a | 3890 | SEOA5297a |
| 3651 | seoa4916a | 3711 | SEOA5009a | 3771 | SEOA5104a | 3831 | SEOA5209a | 3891 | SEOA5298a |
| 3652 | seoa4917a | 3712 | SEOA5010a | 3772 | SEOA5105a | 3832 | SEOA5210 | 3892 | SEOA5299a |
| 3653 | seoa4919a | 3713 | SEOA5011a | 3773 | SEOA5106a | 3833 | SEOA5211a | 3893 | SEOA5300a |
| 3654 | seoa4920a | 3714 | SEOA5012a | 3774 | SEOA5107a | 3834 | SEOA5212a | 3894 | SEOA5302a |
| 3655 | seoa4922a | 3715 | SEOA5017a | 3775 | SEOA5109a | 3835 | SEOA5214a | 3895 | SEOA5303a |
| 3656 | seoa4923a | 3716 | SEOA5025a | 3776 | SEOA5110a | 3836 | SEOA5217a | 3896 | SEOA5304a |
| 3657 | seoa4924a | 3717 | SEOA5026a | 3777 | SEOA5111a | 3837 | SEOA5218a | 3897 | SEOA5309a |
| 3658 | seoa4925a | 3718 | SEOA5028a | 3778 | SEOA5112a | 3838 | SEOA5220a | 3898 | SEOA5310a |
| 3659 | seoa4926a | 3719 | SEOA5029a | 3779 | SEOA5113a | 3839 | seoa5223a | 3899 | SEOA5311a |
| 3660 | seoa4927a | 3720 | SEOA5030a | 3780 | SEOA5114a | 3840 | SEOA5224a | 3900 | SEOA5312a |

Figure 6E – List of EST Sequence Names From Severe OA Cartilage cDNA Library

| | | | | | | | | | |
|---|---|---|---|---|---|---|---|---|---|
| 3901 | SEOA5313a | 3961 | SEOA5393 | 4021 | SEOA5471a | 4081 | SEOA5539a | 4141 | SEOA5614a |
| 3902 | SEOA5314a | 3962 | SEOA5394 | 4022 | SEOA5472a | 4082 | SEOA5540a | 4142 | SEOA5615a |
| 3903 | SEOA5315a | 3963 | seoa5395n | 4023 | SEOA5473a | 4083 | SEOA5541a | 4143 | SEOA5616a |
| 3904 | SEOA5316a | 3964 | SEOA5396 | 4024 | SEOA5474a | 4084 | seoa5543an | 4144 | SEOA5617a |
| 3905 | SEOA5317a | 3965 | SEOA5397 | 4025 | seoa5475a | 4085 | SEOA5544a | 4145 | SEOA5620a |
| 3906 | SEOA5318a | 3966 | SEOA5398 | 4026 | SEOA5476a | 4086 | SEOA5545a | 4146 | SEOA5621a |
| 3907 | SEOA5319a | 3967 | SEOA5399 | 4027 | SEOA5477a | 4087 | SEOA5546a | 4147 | SEOA5622a |
| 3908 | seoa5320an | 3968 | SEOA5401 | 4028 | SEOA5478a | 4088 | SEOA5547a | 4148 | SEOA5623a |
| 3909 | SEOA5323a | 3969 | SEOA5403 | 4029 | SEOA5479a | 4089 | SEOA5548a | 4149 | SEOA5624a |
| 3910 | SEOA5324a | 3970 | SEOA5404 | 4030 | SEOA5481a | 4090 | SEOA5549a | 4150 | SEOA5626a |
| 3911 | SEOA5325a | 3971 | SEOA5405 | 4031 | SEOA5483a | 4091 | SEOA5550a | 4151 | SEOA5627a |
| 3912 | SEOA5327a | 3972 | SEOA5407 | 4032 | SEOA5485a | 4092 | SEOA5551a | 4152 | SEOA5628a |
| 3913 | SEOA5328a | 3973 | SEOA5408 | 4033 | SEOA5486a | 4093 | SEOA5552a | 4153 | SEOA5630a |
| 3914 | SEOA5329a | 3974 | SEOA5409 | 4034 | SEOA5488a | 4094 | SEOA5553a | 4154 | SEOA5634a |
| 3915 | SEOA5330a | 3975 | SEOA5410 | 4035 | SEOA5489a | 4095 | SEOA5554a | 4155 | SEOA5635a |
| 3916 | SEOA5331a | 3976 | SEOA5411 | 4036 | SEOA5490a | 4096 | SEOA5555a | 4156 | SEOA5636a |
| 3917 | SEOA5333a | 3977 | SEOA5412 | 4037 | SEOA5491a | 4097 | SEOA5556a | 4157 | SEOA5637a |
| 3918 | seoa5335a | 3978 | SEOA5413 | 4038 | SEOA5492a | 4098 | SEOA5557a | 4158 | SEOA5639a |
| 3919 | SEOA5341 | 3979 | SEOA5414 | 4039 | SEOA5493a | 4099 | SEOA5558a | 4159 | SEOA5640a |
| 3920 | SEOA5342 | 3980 | SEOA5415 | 4040 | SEOA5494a | 4100 | SEOA5559a | 4160 | SEOA5641a |
| 3921 | SEOA5343 | 3981 | SEOA5416 | 4041 | SEOA5497a | 4101 | SEOA5560a | 4161 | SEOA5642a |
| 3922 | SEOA5345 | 3982 | SEOA5418 | 4042 | SEOA5498a | 4102 | SEOA5563a | 4162 | SEOA5643a |
| 3923 | SEOA5347 | 3983 | SEOA5419 | 4043 | SEOA5499a | 4103 | SEOA5565a | 4163 | SEOA5644a |
| 3924 | seoa5348 | 3984 | SEOA5420 | 4044 | SEOA5500a | 4104 | SEOA5566a | 4164 | SEOA5646a |
| 3925 | SEOA5349 | 3985 | SEOA5422 | 4045 | SEOA5501a | 4105 | SEOA5567a | 4165 | SEOA5648a |
| 3926 | SEOA5350 | 3986 | SEOA5425 | 4046 | SEOA5502a | 4106 | SEOA5568a | 4166 | SEOA5649a |
| 3927 | SEOA5351 | 3987 | SEOA5426 | 4047 | SEOA5503a | 4107 | SEOA5569a | 4167 | SEOA5651a |
| 3928 | SEOA5352 | 3988 | SEOA5428 | 4048 | seoa5504an | 4108 | SEOA5572a | 4168 | SEOA5652a |
| 3929 | SEOA5353 | 3989 | SEOA5429 | 4049 | SEOA5505a | 4109 | SEOA5573a | 4169 | SEOA5653a |
| 3930 | SEOA5354 | 3990 | SEOA5432 | 4050 | SEOA5506a | 4110 | SEOA5574a | 4170 | SEOA5654a |
| 3931 | SEOA5355 | 3991 | SEOA5433 | 4051 | SEOA5507a | 4111 | SEOA5575a | 4171 | SEOA5655a |
| 3932 | SEOA5356 | 3992 | SEOA5436 | 4052 | seoa5508a | 4112 | SEOA5576a | 4172 | SEOA5656a |
| 3933 | SEOA5357 | 3993 | SEOA5437 | 4053 | SEOA5509a | 4113 | SEOA5577a | 4173 | SEOA5657a |
| 3934 | SEOA5358 | 3994 | SEOA5438 | 4054 | SEOA5510a | 4114 | SEOA5578a | 4174 | SEOA5658a |
| 3935 | SEOA5359 | 3995 | SEOA5441 | 4055 | SEOA5511a | 4115 | SEOA5579a | 4175 | SEOA5659a |
| 3936 | SEOA5360 | 3996 | SEOA5442 | 4056 | SEOA5512a | 4116 | SEOA5580a | 4176 | SEOA5660a |
| 3937 | SEOA5363 | 3997 | SEOA5443 | 4057 | SEOA5513a | 4117 | SEOA5581a | 4177 | SEOA5662a |
| 3938 | SEOA5365 | 3998 | SEOA5444 | 4058 | SEOA5515a | 4118 | SEOA5582a | 4178 | SEOA5663a |
| 3939 | SEOA5366 | 3999 | SEOA5445 | 4059 | SEOA5517a | 4119 | SEOA5583a | 4179 | seoa5664a |
| 3940 | SEOA5367 | 4000 | SEOA5446 | 4060 | SEOA5518a | 4120 | SEOA5584a | 4180 | SEOA5665a |
| 3941 | SEOA5368 | 4001 | SEOA5447 | 4061 | SEOA5519a | 4121 | SEOA5585a | 4181 | SEOA5666a |
| 3942 | SEOA5370 | 4002 | SEOA5448 | 4062 | SEOA5520a | 4122 | SEOA5586a | 4182 | SEOA5667a |
| 3943 | SEOA5371 | 4003 | SEOA5449 | 4063 | SEOA5521a | 4123 | SEOA5587a | 4183 | SEOA5668a |
| 3944 | SEOA5372 | 4004 | seoa5450 | 4064 | SEOA5522a | 4124 | seoa5588a | 4184 | SEOA5669a |
| 3945 | SEOA5373 | 4005 | SEOA5452 | 4065 | SEOA5523a | 4125 | SEOA5589a | 4185 | SEOA5670a |
| 3946 | SEOA5374 | 4006 | SEOA5453 | 4066 | SEOA5524a | 4126 | SEOA5590a | 4186 | SEOA5671a |
| 3947 | SEOA5376 | 4007 | SEOA5454 | 4067 | SEOA5525a | 4127 | SEOA5591a | 4187 | SEOA5673a |
| 3948 | SEOA5380 | 4008 | SEOA5455 | 4068 | SEOA5526a | 4128 | SEOA5592a | 4188 | SEOA5674a |
| 3949 | SEOA5381 | 4009 | SEOA5456 | 4069 | SEOA5527a | 4129 | SEOA5595a | 4189 | SEOA5675a |
| 3950 | SEOA5382 | 4010 | SEOA5458 | 4070 | SEOA5528a | 4130 | SEOA5596a | 4190 | SEOA5676a |
| 3951 | SEOA5383 | 4011 | SEOA5460 | 4071 | SEOA5529a | 4131 | SEOA5597a | 4191 | SEOA5677a |
| 3952 | SEOA5384 | 4012 | SEOA5461 | 4072 | SEOA5530a | 4132 | SEOA5600a | 4192 | seoa5678a |
| 3953 | SEOA5385 | 4013 | SEOA5462 | 4073 | SEOA5531a | 4133 | SEOA5601a | 4193 | SEOA5679a |
| 3954 | SEOA5386 | 4014 | SEOA5463a | 4074 | SEOA5532a | 4134 | seoa5603an | 4194 | SEOA5680a |
| 3955 | SEOA5387 | 4015 | SEOA5464a | 4075 | SEOA5533a | 4135 | SEOA5604a | 4195 | seoa5681a |
| 3956 | SEOA5388 | 4016 | SEOA5465a | 4076 | SEOA5534a | 4136 | SEOA5605a | 4196 | SEOA5682a |
| 3957 | SEOA5389 | 4017 | SEOA5466a | 4077 | SEOA5535a | 4137 | SEOA5606a | 4197 | SEOA5683a |
| 3958 | SEOA5390 | 4018 | SEOA5468a | 4078 | SEOA5536a | 4138 | SEOA5608a | 4198 | SEOA5684a |
| 3959 | SEOA5391 | 4019 | SEOA5469a | 4079 | SEOA5537a | 4139 | SEOA5612a | 4199 | SEOA5685a |
| 3960 | SEOA5392 | 4020 | SEOA5470a | 4080 | SEOA5538a | 4140 | SEOA5613a | 4200 | SEOA5687a |

Figure 6E – List of EST Sequence Names From Severe OA Cartilage cDNA Library

| | |
|---|---|
| 4201 | SEOA5689a |
| 4202 | SEOA5691a |
| 4203 | SEOA5694a |
| 4204 | SEOA5697a |
| 4205 | SEOA5698a |
| 4206 | SEOA5699a |
| 4207 | SEOA5700a |
| 4208 | SEOA5702a |
| 4209 | SEOA5703a |
| 4210 | SEOA5704a |
| 4211 | SEOA5705a |
| 4212 | SEOA5710a |
| 4213 | SEOA5711a |
| 4214 | SEOA5712a |
| 4215 | SEOA5713a |
| 4216 | SEOA5714a |
| 4217 | SEOA5717a |
| 4218 | SEOA5718a |
| 4219 | SEOA5720a |
| 4220 | SEOA5721a |
| 4221 | SEOA5722a |
| 4222 | SEOA5723a |
| 4223 | SEOA5724a |
| 4224 | SEOA5726a |
| 4225 | SEOA5727a |
| 4226 | SEOA5728a |
| 4227 | SEOA5729a |
| 4228 | SEOA5730a |
| 4229 | SEOA5731a |
| 4230 | SEOA5732a |
| 4231 | SEOA5733a |
| 4232 | SEOA5734a |
| 4233 | SEOA5735a |
| 4234 | SEOA5736a |
| 4235 | SEOA5737a |
| 4236 | SEOA5741a |
| 4237 | SEOA5742a |
| 4238 | SEOA5743a |
| 4239 | SEOA5744a |
| 4240 | SEOA5745a |
| 4241 | SEOA5746a |
| 4242 | SEOA5747a |
| 4243 | SEOA5748a |
| 4244 | SEOA5749a |
| 4245 | seoa5750a |
| 4246 | SEOA5752a |
| 4247 | SEOA5753a |
| 4248 | SEOA5754a |
| 4249 | SEOA5755a |
| 4250 | SEOA5756a |
| 4251 | seoa5757an |
| 4252 | SEOA5759 |
| 4253 | SEOA5760 |
| 4254 | SEOA5761 |
| 4255 | SEOA5762 |
| 4256 | SEOA5763 |
| 4257 | seoa5764n |
| 4258 | SEOA5765 |
| 4259 | SEOA5766 |
| 4260 | SEOA5767 |
| 4261 | SEOA5769 |
| 4262 | SEOA5770 |
| 4263 | seoa5771 |
| 4264 | SEOA5772 |
| 4265 | SEOA5773 |
| 4266 | SEOA5774 |
| 4267 | SEOA5775 |
| 4268 | seoa5777 |
| 4269 | SEOA5778 |
| 4270 | SEOA5779 |
| 4271 | SEOA5780 |
| 4272 | SEOA5781 |
| 4273 | SEOA5782 |
| 4274 | SEOA5783 |
| 4275 | SEOA5784 |
| 4276 | SEOA5785 |
| 4277 | SEOA5786 |
| 4278 | SEOA5787 |
| 4279 | SEOA5788 |
| 4280 | SEOA5789 |
| 4281 | SEOA5790 |
| 4282 | SEOA5791 |
| 4283 | SEOA5792 |
| 4284 | SEOA5793 |
| 4285 | seoa5794 |
| 4286 | SEOA5795 |
| 4287 | SEOA5798 |
| 4288 | SEOA5799 |
| 4289 | SEOA5800 |
| 4290 | SEOA5801 |
| 4291 | seoa5805n |
| 4292 | SEOA5806 |
| 4293 | SEOA5807 |
| 4294 | SEOA5808 |
| 4295 | SEOA5809 |
| 4296 | SEOA5810 |
| 4297 | SEOA5811 |
| 4298 | SEOA5812 |
| 4299 | SEOA5813 |
| 4300 | SEOA5814 |
| 4301 | SEOA5815 |
| 4302 | SEOA5816 |
| 4303 | SEOA5817 |
| 4304 | SEOA5818 |
| 4305 | SEOA5819 |
| 4306 | SEOA5820 |
| 4307 | SEOA5821 |
| 4308 | SEOA5822 |
| 4309 | SEOA5823 |
| 4310 | SEOA5824 |
| 4311 | SEOA5825 |
| 4312 | SEOA5826 |
| 4313 | SEOA5827 |
| 4314 | SEOA5828 |
| 4315 | SEOA5829 |
| 4316 | SEOA5830 |
| 4317 | SEOA5831 |
| 4318 | SEOA5832 |
| 4319 | SEOA5833 |
| 4320 | SEOA5834 |
| 4321 | SEOA5835 |
| 4322 | SEOA5836 |
| 4323 | SEOA5837 |
| 4324 | SEOA5838 |
| 4325 | seoa5839 |
| 4326 | SEOA5840 |
| 4327 | SEOA5841 |
| 4328 | SEOA5842 |
| 4329 | SEOA5843 |
| 4330 | SEOA5844 |
| 4331 | SEOA5845 |
| 4332 | SEOA5846 |
| 4333 | SEOA5848 |
| 4334 | SEOA5849 |
| 4335 | SEOA5850 |
| 4336 | SEOA5851 |
| 4337 | SEOA5854 |
| 4338 | SEOA5855 |
| 4339 | seoa5857n |
| 4340 | SEOA5858 |
| 4341 | seoa5859 |
| 4342 | SEOA5862 |
| 4343 | SEOA5863 |
| 4344 | SEOA5864 |
| 4345 | SEOA5865 |
| 4346 | seoa5866 |
| 4347 | SEOA5868 |
| 4348 | SEOA5869 |
| 4349 | seoa5870 |
| 4350 | SEOA5871 |
| 4351 | SEOA5873 |
| 4352 | SEOA5874 |
| 4353 | SEOA5876 |
| 4354 | SEOA5877 |
| 4355 | SEOA5878 |
| 4356 | SEOA5879 |
| 4357 | SEOA5881 |
| 4358 | SEOA5882 |
| 4359 | SEOA5883 |
| 4360 | SEOA5885 |
| 4361 | SEOA5887 |
| 4362 | SEOA5889 |
| 4363 | SEOA5890 |
| 4364 | SEOA5893 |
| 4365 | SEOA5894 |
| 4366 | SEOA5896 |
| 4367 | SEOA5898 |
| 4368 | SEOA5899 |
| 4369 | SEOA5900 |
| 4370 | SEOA5901 |
| 4371 | SEOA5902 |
| 4372 | SEOA5903 |
| 4373 | SEOA5904 |
| 4374 | SEOA5906 |
| 4375 | SEOA5909 |
| 4376 | SEOA5911 |
| 4377 | SEOA5912 |
| 4378 | SEOA5915 |
| 4379 | SEOA5916 |
| 4380 | SEOA5917 |
| 4381 | SEOA5918 |
| 4382 | SEOA5919 |
| 4383 | SEOA5920 |
| 4384 | SEOA5924 |
| 4385 | SEOA5926 |
| 4386 | seoa5927 |
| 4387 | SEOA5928 |
| 4388 | SEOA5929 |
| 4389 | SEOA5930 |
| 4390 | SEOA5932 |
| 4391 | SEOA5933 |
| 4392 | seoa5935 |
| 4393 | SEOA5937 |
| 4394 | SEOA5938 |
| 4395 | SEOA5939 |
| 4396 | SEOA5940 |
| 4397 | SEOA5942 |
| 4398 | SEOA5943 |
| 4399 | SEOA5944 |
| 4400 | SEOA5945 |
| 4401 | SEOA5946 |
| 4402 | SEOA5947 |
| 4403 | SEOA5948 |
| 4404 | SEOA5950 |
| 4405 | SEOA5953 |
| 4406 | SEOA5955 |
| 4407 | SEOA5957 |
| 4408 | SEOA5958 |
| 4409 | SEOA5959 |
| 4410 | SEOA5960 |
| 4411 | SEOA5961 |
| 4412 | SEOA5962 |
| 4413 | SEOA5963 |
| 4414 | SEOA5964 |
| 4415 | SEOA5966 |
| 4416 | SEOA5967a |
| 4417 | SEOA5969a |
| 4418 | SEOA5970a |
| 4419 | SEOA5971a |
| 4420 | SEOA5972a |
| 4421 | SEOA5973a |
| 4422 | SEOA5974a |
| 4423 | SEOA5976a |
| 4424 | SEOA5977a |
| 4425 | SEOA5978a |
| 4426 | SEOA5979a |
| 4427 | SEOA5981a |
| 4428 | SEOA5982a |
| 4429 | SEOA5983a |
| 4430 | SEOA5985a |
| 4431 | SEOA5986a |
| 4432 | SEOA5987a |
| 4433 | SEOA5988a |
| 4434 | SEOA5989a |
| 4435 | SEOA5990a |
| 4436 | SEOA5991a |
| 4437 | SEOA5992a |
| 4438 | SEOA5994a |
| 4439 | SEOA5997a |
| 4440 | SEOA5998a |
| 4441 | SEOA5999a |
| 4442 | SEOA6000a |
| 4443 | SEOA6001a |
| 4444 | SEOA6002a |
| 4445 | SEOA6003a |
| 4446 | SEOA6005a |
| 4447 | SEOA6006a |
| 4448 | SEOA6007a |
| 4449 | SEOA6008a |
| 4450 | SEOA6009a |
| 4451 | SEOA6010a |
| 4452 | SEOA6012a |
| 4453 | SEOA6013a |
| 4454 | SEOA6015a |
| 4455 | SEOA6018a |
| 4456 | SEOA6019a |
| 4457 | SEOA6020a |
| 4458 | SEOA6021a |
| 4459 | SEOA6022a |
| 4460 | SEOA6023a |
| 4461 | SEOA6024a |
| 4462 | SEOA6025a |
| 4463 | SEOA6026a |
| 4464 | SEOA6027a |
| 4465 | SEOA6028a |
| 4466 | SEOA6029a |
| 4467 | SEOA6030a |
| 4468 | SEOA6031a |
| 4469 | SEOA6032a |
| 4470 | SEOA6033a |
| 4471 | SEOA6034a |
| 4472 | seoa6035an |
| 4473 | SEOA6036a |
| 4474 | SEOA6037a |
| 4475 | SEOA6038a |
| 4476 | SEOA6039a |
| 4477 | SEOA6040a |
| 4478 | SEOA6041a |
| 4479 | SEOA6042a |
| 4480 | SEOA6043a |
| 4481 | SEOA6046a |
| 4482 | SEOA6048a |
| 4483 | SEOA6049a |
| 4484 | SEOA6050a |
| 4485 | SEOA6051a |
| 4486 | SEOA6052a |
| 4487 | SEOA6053a |
| 4488 | SEOA6054a |
| 4489 | SEOA6056a |
| 4490 | SEOA6057a |
| 4491 | seoa6058a |
| 4492 | SEOA6060a |
| 4493 | SEOA6061a |
| 4494 | SEOA6062a |
| 4495 | SEOA6063a |
| 4496 | SEOA6064a |
| 4497 | SEOA6066a |
| 4498 | SEOA6067a |
| 4499 | SEOA6068a |
| 4500 | SEOA6069a |

Figure 6E – List of EST Sequence Names From Severe OA Cartilage cDNA Library

| | | | | | | | | | |
|---|---|---|---|---|---|---|---|---|---|
| 4501 | SEOA6070a | 4561 | SEOA6146a | 4621 | SEOA6219a | 4681 | SEOA6297 | 4741 | SEOA6386 |
| 4502 | SEOA6071a | 4562 | SEOA6148a | 4622 | SEOA6220 | 4682 | SEOA6298 | 4742 | SEOA6387 |
| 4503 | SEOA6073a | 4563 | SEOA6150a | 4623 | SEOA6221 | 4683 | SEOA6299 | 4743 | SEOA6388 |
| 4504 | SEOA6075a | 4564 | SEOA6151 | 4624 | SEOA6222 | 4684 | SEOA6300 | 4744 | SEOA6389 |
| 4505 | SEOA6076a | 4565 | SEOA6151a | 4625 | SEOA6223 | 4685 | SEOA6304 | 4745 | SEOA6390 |
| 4506 | SEOA6078a | 4566 | SEOA6152a | 4626 | SEOA6226 | 4686 | SEOA6307 | 4746 | SEOA6391 |
| 4507 | SEOA6079a | 4567 | SEOA6153a | 4627 | SEOA6228 | 4687 | SEOA6308 | 4747 | SEOA6392 |
| 4508 | SEOA6080a | 4568 | SEOA6155a | 4628 | seoa6229 | 4688 | SEOA6310 | 4748 | SEOA6393 |
| 4509 | SEOA6082a | 4569 | SEOA6156a | 4629 | SEOA6230 | 4689 | SEOA6311 | 4749 | SEOA6394 |
| 4510 | SEOA6083a | 4570 | SEOA6157a | 4630 | SEOA6231 | 4690 | SEOA6313 | 4750 | SEOA6395 |
| 4511 | SEOA6084a | 4571 | SEOA6158a | 4631 | SEOA6233 | 4691 | SEOA6314 | 4751 | SEOA6397 |
| 4512 | SEOA6085a | 4572 | SEOA6159a | 4632 | SEOA6234 | 4692 | SEOA6315 | 4752 | SEOA6398 |
| 4513 | SEOA6086a | 4573 | SEOA6160a | 4633 | SEOA6235 | 4693 | SEOA6316 | 4753 | SEOA6399 |
| 4514 | SEOA6087a | 4574 | SEOA6161a | 4634 | SEOA6236 | 4694 | SEOA6317 | 4754 | SEOA6400 |
| 4515 | SEOA6088a | 4575 | SEOA6162a | 4635 | SEOA6238 | 4695 | SEOA6321 | 4755 | SEOA6401 |
| 4516 | SEOA6089a | 4576 | seoa6163an | 4636 | SEOA6239 | 4696 | SEOA6322 | 4756 | SEOA6402 |
| 4517 | SEOA6090a | 4577 | SEOA6164a | 4637 | SEOA6240 | 4697 | SEOA6323 | 4757 | SEOA6403 |
| 4518 | SEOA6091a | 4578 | SEOA6165a | 4638 | SEOA6241 | 4698 | SEOA6325 | 4758 | seoa6404 |
| 4519 | SEOA6093a | 4579 | SEOA6166a | 4639 | SEOA6243 | 4699 | SEOA6326 | 4759 | SEOA6405 |
| 4520 | SEOA6094a | 4580 | SEOA6167a | 4640 | SEOA6244 | 4700 | SEOA6329 | 4760 | SEOA6407 |
| 4521 | SEOA6095a | 4581 | SEOA6168a | 4641 | seoa6246n | 4701 | SEOA6330 | 4761 | SEOA6408 |
| 4522 | SEOA6097a | 4582 | SEOA6169a | 4642 | SEOA6248 | 4702 | SEOA6331 | 4762 | SEOA6409 |
| 4523 | SEOA6099a | 4583 | SEOA6170a | 4643 | SEOA6249 | 4703 | SEOA6332 | 4763 | SEOA6412 |
| 4524 | SEOA6100a | 4584 | SEOA6171a | 4644 | SEOA6250 | 4704 | SEOA6333 | 4764 | SEOA6413 |
| 4525 | SEOA6101a | 4585 | SEOA6172a | 4645 | SEOA6252 | 4705 | SEOA6334 | 4765 | SEOA6414 |
| 4526 | SEOA6102a | 4586 | SEOA6173a | 4646 | seoa6253 | 4706 | SEOA6335 | 4766 | SEOA6415 |
| 4527 | SEOA6103a | 4587 | SEOA6174a | 4647 | SEOA6254 | 4707 | SEOA6336 | 4767 | SEOA6416 |
| 4528 | SEOA6104a | 4588 | SEOA6175a | 4648 | seoa6255n | 4708 | seoa6337 | 4768 | SEOA6418 |
| 4529 | SEOA6106a | 4589 | SEOA6176a | 4649 | SEOA6257 | 4709 | SEOA6340 | 4769 | seoa6419n |
| 4530 | SEOA6107a | 4590 | seoa6177a | 4650 | SEOA6258 | 4710 | SEOA6342 | 4770 | SEOA6420 |
| 4531 | SEOA6108a | 4591 | SEOA6178a | 4651 | SEOA6260 | 4711 | SEOA6344 | 4771 | seoa6421n |
| 4532 | SEOA6109a | 4592 | seoa6181a | 4652 | SEOA6261 | 4712 | SEOA6345 | 4772 | SEOA6422 |
| 4533 | SEOA6111a | 4593 | SEOA6183a | 4653 | seoa6262n | 4713 | SEOA6346 | 4773 | SEOA6423 |
| 4534 | SEOA6113a | 4594 | SEOA6184a | 4654 | SEOA6263 | 4714 | SEOA6347 | 4774 | SEOA6426 |
| 4535 | seoa6114an | 4595 | SEOA6186a | 4655 | SEOA6265 | 4715 | SEOA6348 | 4775 | SEOA6428 |
| 4536 | SEOA6115a | 4596 | SEOA6189a | 4656 | SEOA6267 | 4716 | SEOA6351 | 4776 | SEOA6429 |
| 4537 | SEOA6116a | 4597 | SEOA6190a | 4657 | SEOA6268 | 4717 | SEOA6354 | 4777 | seoa6430 |
| 4538 | SEOA6117a | 4598 | SEOA6191a | 4658 | seoa6270n | 4718 | SEOA6355 | 4778 | SEOA6431 |
| 4539 | SEOA6118a | 4599 | SEOA6192a | 4659 | seoa6271 | 4719 | SEOA6356 | 4779 | SEOA6432 |
| 4540 | SEOA6119a | 4600 | SEOA6193a | 4660 | SEOA6272 | 4720 | SEOA6357 | 4780 | SEOA6433 |
| 4541 | SEOA6122a | 4601 | SEOA6194a | 4661 | SEOA6273 | 4721 | SEOA6358 | 4781 | SEOA6434 |
| 4542 | SEOA6123a | 4602 | SEOA6195a | 4662 | SEOA6274 | 4722 | SEOA6359 | 4782 | SEOA6435 |
| 4543 | SEOA6124a | 4603 | SEOA6196a | 4663 | SEOA6276 | 4723 | SEOA6360 | 4783 | SEOA6437 |
| 4544 | SEOA6127a | 4604 | SEOA6197a | 4664 | seoa6277 | 4724 | SEOA6363 | 4784 | SEOA6440 |
| 4545 | SEOA6128a | 4605 | SEOA6198a | 4665 | SEOA6278 | 4725 | SEOA6364 | 4785 | SEOA6442 |
| 4546 | SEOA6129a | 4606 | SEOA6199a | 4666 | SEOA6279 | 4726 | SEOA6365 | 4786 | SEOA6443 |
| 4547 | SEOA6130a | 4607 | SEOA6200a | 4667 | SEOA6280 | 4727 | SEOA6367 | 4787 | SEOA6444a |
| 4548 | SEOA6131a | 4608 | SEOA6201a | 4668 | SEOA6281 | 4728 | SEOA6368 | 4788 | seoa6445an |
| 4549 | SEOA6132a | 4609 | SEOA6202a | 4669 | SEOA6282 | 4729 | SEOA6370 | 4789 | SEOA6446a |
| 4550 | SEOA6133a | 4610 | SEOA6203a | 4670 | SEOA6283 | 4730 | SEOA6371 | 4790 | SEOA6447a |
| 4551 | SEOA6134a | 4611 | SEOA6204a | 4671 | SEOA6284 | 4731 | SEOA6372 | 4791 | SEOA6448a |
| 4552 | SEOA6135a | 4612 | SEOA6205a | 4672 | SEOA6286 | 4732 | SEOA6373 | 4792 | SEOA6449a |
| 4553 | seoa6136a | 4613 | SEOA6209a | 4673 | SEOA6287 | 4733 | SEOA6374 | 4793 | SEOA6450a |
| 4554 | SEOA6137a | 4614 | SEOA6210a | 4674 | SEOA6289 | 4734 | SEOA6375 | 4794 | SEOA6451a |
| 4555 | SEOA6138a | 4615 | SEOA6212a | 4675 | SEOA6290 | 4735 | SEOA6376 | 4795 | SEOA6452a |
| 4556 | SEOA6139a | 4616 | SEOA6213a | 4676 | SEOA6291 | 4736 | SEOA6377 | 4796 | SEOA6453a |
| 4557 | SEOA6140a | 4617 | SEOA6214a | 4677 | SEOA6292 | 4737 | SEOA6379 | 4797 | SEOA6454a |
| 4558 | SEOA6143a | 4618 | SEOA6216a | 4678 | SEOA6293 | 4738 | SEOA6380 | 4798 | SEOA6455a |
| 4559 | SEOA6144a | 4619 | SEOA6217a | 4679 | SEOA6295 | 4739 | SEOA6381 | 4799 | SEOA6456a |
| 4560 | SEOA6145a | 4620 | SEOA6218a | 4680 | seoa6296n | 4740 | SEOA6385 | 4800 | SEOA6458a |

Figure 6E – List of EST Sequence Names From Severe OA Cartilage cDNA Library

| | | | | | | | | | |
|---|---|---|---|---|---|---|---|---|---|
| 4801 | SEOA6459a | 4861 | SEOA6533a | 4921 | SEOA6611a | 4981 | SEOA6685a | 5041 | seoa6756 |
| 4802 | SEOA6460a | 4862 | SEOA6535a | 4922 | SEOA6612a | 4982 | SEOA6686a | 5042 | seoa6757 |
| 4803 | SEOA6461a | 4863 | SEOA6536a | 4923 | SEOA6613a | 4983 | SEOA6687a | 5043 | seoa6758 |
| 4804 | SEOA6462a | 4864 | SEOA6537a | 4924 | SEOA6614a | 4984 | SEOA6688a | 5044 | seoa6759 |
| 4805 | SEOA6463a | 4865 | seoa6538a | 4925 | seoa6615an | 4985 | SEOA6689a | 5045 | seoa6760 |
| 4806 | SEOA6464a | 4866 | SEOA6539a | 4926 | SEOA6617a | 4986 | SEOA6693a | 5046 | seoa6761 |
| 4807 | SEOA6465a | 4867 | SEOA6540a | 4927 | SEOA6620a | 4987 | SEOA6694a | 5047 | seoa6762 |
| 4808 | SEOA6466a | 4868 | SEOA6541a | 4928 | SEOA6621a | 4988 | SEOA6695a | 5048 | seoa6763 |
| 4809 | SEOA6467a | 4869 | seoa6543an | 4929 | SEOA6622a | 4989 | SEOA6696a | 5049 | seoa6764 |
| 4810 | SEOA6468a | 4870 | SEOA6545a | 4930 | SEOA6623a | 4990 | SEOA6697a | 5050 | seoa6765 |
| 4811 | SEOA6470a | 4871 | SEOA6546a | 4931 | SEOA6624a | 4991 | SEOA6698a | 5051 | seoa6766 |
| 4812 | SEOA6471a | 4872 | SEOA6547a | 4932 | SEOA6625a | 4992 | SEOA6699a | 5052 | seoa6768 |
| 4813 | SEOA6473a | 4873 | SEOA6548a | 4933 | SEOA6626a | 4993 | SEOA6700a | 5053 | seoa6769 |
| 4814 | SEOA6476a | 4874 | SEOA6549a | 4934 | SEOA6627a | 4994 | SEOA6701a | 5054 | seoa6771 |
| 4815 | SEOA6478a | 4875 | SEOA6550a | 4935 | SEOA6629a | 4995 | SEOA6702a | 5055 | seoa6772 |
| 4816 | SEOA6479a | 4876 | SEOA6551a | 4936 | seoa6630a | 4996 | SEOA6704a | 5056 | seoa6773 |
| 4817 | SEOA6480a | 4877 | SEOA6552a | 4937 | SEOA6631a | 4997 | SEOA6705a | 5057 | seoa6774 |
| 4818 | SEOA6481a | 4878 | SEOA6553a | 4938 | seoa6632an | 4998 | SEOA6706 | 5058 | seoa6775 |
| 4819 | SEOA6482a | 4879 | SEOA6554a | 4939 | SEOA6633a | 4999 | SEOA6707 | 5059 | seoa6776 |
| 4820 | SEOA6484a | 4880 | SEOA6555a | 4940 | SEOA6634a | 5000 | SEOA6710 | 5060 | seoa6778 |
| 4821 | SEOA6485a | 4881 | SEOA6556a | 4941 | SEOA6635a | 5001 | SEOA6711 | 5061 | seoa6779 |
| 4822 | SEOA6486a | 4882 | SEOA6557a | 4942 | SEOA6636a | 5002 | SEOA6713 | 5062 | seoa6780 |
| 4823 | SEOA6487a | 4883 | SEOA6559a | 4943 | SEOA6637a | 5003 | SEOA6715 | 5063 | seoa6781 |
| 4824 | SEOA6488a | 4884 | SEOA6560a | 4944 | SEOA6638a | 5004 | SEOA6716 | 5064 | seoa6782 |
| 4825 | SEOA6490a | 4885 | SEOA6561a | 4945 | SEOA6639a | 5005 | SEOA6718 | 5065 | seoa6783 |
| 4826 | SEOA6491a | 4886 | seoa6563a | 4946 | SEOA6640a | 5006 | SEOA6719 | 5066 | seoa6784 |
| 4827 | SEOA6492a | 4887 | SEOA6564a | 4947 | SEOA6641a | 5007 | SEOA6720 | 5067 | seoa6785 |
| 4828 | seoa6493an | 4888 | SEOA6565a | 4948 | SEOA6642a | 5008 | SEOA6721 | 5068 | seoa6786 |
| 4829 | SEOA6494a | 4889 | SEOA6566a | 4949 | SEOA6643a | 5009 | SEOA6722 | 5069 | seoa6787 |
| 4830 | SEOA6495a | 4890 | SEOA6567a | 4950 | SEOA6644a | 5010 | SEOA6723 | 5070 | seoa6788 |
| 4831 | SEOA6496a | 4891 | SEOA6568a | 4951 | SEOA6645a | 5011 | SEOA6724 | 5071 | seoa6789 |
| 4832 | SEOA6497a | 4892 | SEOA6569a | 4952 | SEOA6646a | 5012 | SEOA6726 | 5072 | seoa6790 |
| 4833 | SEOA6498a | 4893 | SEOA6571a | 4953 | SEOA6647a | 5013 | SEOA6727 | 5073 | seoa6791 |
| 4834 | SEOA6501a | 4894 | SEOA6572a | 4954 | SEOA6648a | 5014 | SEOA6728 | 5074 | seoa6792 |
| 4835 | SEOA6503a | 4895 | SEOA6573a | 4955 | SEOA6649a | 5015 | SEOA6730 | 5075 | seoa6793 |
| 4836 | SEOA6504a | 4896 | SEOA6574a | 4956 | SEOA6650a | 5016 | SEOA6731 | 5076 | seoa6794 |
| 4837 | SEOA6505a | 4897 | SEOA6575a | 4957 | seoa6651a | 5017 | SEOA6732 | 5077 | seoa6795 |
| 4838 | SEOA6506a | 4898 | SEOA6576a | 4958 | SEOA6652a | 5018 | SEOA6733 | 5078 | seoa6797 |
| 4839 | SEOA6507a | 4899 | SEOA6578a | 4959 | SEOA6653a | 5019 | SEOA6734 | 5079 | seoa6798 |
| 4840 | SEOA6508a | 4900 | SEOA6579a | 4960 | SEOA6654a | 5020 | SEOA6735 | 5080 | seoa6800 |
| 4841 | SEOA6510a | 4901 | SEOA6580a | 4961 | seoa6657an | 5021 | SEOA6736 | 5081 | seoa6801 |
| 4842 | SEOA6512a | 4902 | SEOA6582a | 4962 | SEOA6658a | 5022 | SEOA6737 | 5082 | seoa6802 |
| 4843 | seoa6514an | 4903 | SEOA6583a | 4963 | SEOA6660a | 5023 | SEOA6738 | 5083 | seoa6803 |
| 4844 | SEOA6516a | 4904 | SEOA6585a | 4964 | SEOA6661a | 5024 | SEOA6739 | 5084 | seoa6804 |
| 4845 | SEOA6517a | 4905 | SEOA6587a | 4965 | seoa6664an | 5025 | SEOA6740 | 5085 | seoa6805 |
| 4846 | SEOA6518a | 4906 | SEOA6590a | 4966 | SEOA6666a | 5026 | SEOA6741 | 5086 | seoa6806 |
| 4847 | SEOA6519a | 4907 | SEOA6591a | 4967 | SEOA6667a | 5027 | SEOA6742 | 5087 | seoa6807 |
| 4848 | SEOA6520a | 4908 | SEOA6594a | 4968 | SEOA6668a | 5028 | SEOA6743 | 5088 | seoa6809 |
| 4849 | SEOA6521a | 4909 | SEOA6595a | 4969 | SEOA6670a | 5029 | SEOA6744 | 5089 | seoa6810 |
| 4850 | SEOA6522a | 4910 | SEOA6597a | 4970 | SEOA6671a | 5030 | seoa6745n | 5090 | seoa6811 |
| 4851 | SEOA6523a | 4911 | SEOA6598a | 4971 | SEOA6672a | 5031 | SEOA6746 | 5091 | seoa6812 |
| 4852 | SEOA6524a | 4912 | SEOA6599a | 4972 | SEOA6673a | 5032 | SEOA6747 | 5092 | seoa6813 |
| 4853 | SEOA6525a | 4913 | SEOA6600a | 4973 | SEOA6674a | 5033 | SEOA6748 | 5093 | seoa6814 |
| 4854 | SEOA6526a | 4914 | SEOA6601a | 4974 | SEOA6675a | 5034 | SEOA6749 | 5094 | seoa6815 |
| 4855 | SEOA6527a | 4915 | SEOA6602a | 4975 | SEOA6676a | 5035 | seoa6750 | 5095 | seoa6816 |
| 4856 | SEOA6528a | 4916 | SEOA6604a | 4976 | SEOA6677a | 5036 | SEOA6751 | 5096 | seoa6818 |
| 4857 | SEOA6529a | 4917 | SEOA6606a | 4977 | SEOA6678a | 5037 | SEOA6752 | 5097 | seoa6819 |
| 4858 | SEOA6530a | 4918 | SEOA6607a | 4978 | SEOA6681a | 5038 | SEOA6753 | 5098 | seoa6823 |
| 4859 | SEOA6531a | 4919 | SEOA6608a | 4979 | SEOA6682a | 5039 | SEOA6754 | 5099 | seoa6825 |
| 4860 | SEOA6532a | 4920 | SEOA6610a | 4980 | SEOA6683a | 5040 | seoa6755 | 5100 | seoa6828 |

Figure 6E – List of EST Sequence Names From Severe OA Cartilage cDNA Library

| | | | | | | | | | |
|---|---|---|---|---|---|---|---|---|---|
| 5101 | seoa6829 | 5161 | SEOA6911 | 5221 | seoa6985 | 5281 | seoa7056 | 5341 | SEOA7134a |
| 5102 | seoa6830 | 5162 | seoa6913n | 5222 | seoa6986 | 5282 | seoa7057 | 5342 | SEOA7135a |
| 5103 | seoa6832 | 5163 | SEOA6914 | 5223 | seoa6987 | 5283 | seoa7058 | 5343 | SEOA7136a |
| 5104 | seoa6833 | 5164 | SEOA6915 | 5224 | seoa6988 | 5284 | SEOA7060a | 5344 | SEOA7138a |
| 5105 | seoa6834 | 5165 | SEOA6917 | 5225 | seoa6989 | 5285 | SEOA7061a | 5345 | SEOA7143a |
| 5106 | seoa6836 | 5166 | seoa6918 | 5226 | seoa6990 | 5286 | SEOA7062a | 5346 | SEOA7145a |
| 5107 | seoa6837 | 5167 | SEOA6920 | 5227 | seoa6991 | 5287 | SEOA7063a | 5347 | SEOA7146a |
| 5108 | seoa6838 | 5168 | SEOA6921 | 5228 | seoa6992 | 5288 | SEOA7064a | 5348 | SEOA7147a |
| 5109 | seoa6839 | 5169 | SEOA6922 | 5229 | seoa6993 | 5289 | SEOA7065a | 5349 | SEOA7149a |
| 5110 | seoa6841 | 5170 | SEOA6923 | 5230 | seoa6994 | 5290 | seoa7066an | 5350 | SEOA7150a |
| 5111 | seoa6842 | 5171 | SEOA6924 | 5231 | seoa6995 | 5291 | SEOA7067a | 5351 | SEOA7151a |
| 5112 | seoa6845 | 5172 | SEOA6925 | 5232 | seoa6996 | 5292 | SEOA7068a | 5352 | SEOA7153a |
| 5113 | seoa6846 | 5173 | SEOA6926 | 5233 | seoa6997 | 5293 | SEOA7069a | 5353 | SEOA7154a |
| 5114 | seoa6847 | 5174 | SEOA6927 | 5234 | seoa6998 | 5294 | SEOA7070a | 5354 | SEOA7155a |
| 5115 | seoa6848 | 5175 | SEOA6928 | 5235 | seoa7000 | 5295 | SEOA7072a | 5355 | SEOA7157a |
| 5116 | seoa6849 | 5176 | SEOA6929 | 5236 | seoa7001 | 5296 | SEOA7073a | 5356 | seoa7159an |
| 5117 | seoa6855 | 5177 | SEOA6930 | 5237 | seoa7002 | 5297 | SEOA7074a | 5357 | SEOA7160a |
| 5118 | seoa6856 | 5178 | SEOA6932 | 5238 | seoa7003 | 5298 | SEOA7075a | 5358 | SEOA7161a |
| 5119 | SEOA6860 | 5179 | seoa6933 | 5239 | seoa7004 | 5299 | SEOA7076a | 5359 | SEOA7162a |
| 5120 | SEOA6862 | 5180 | seoa6934 | 5240 | seoa7006 | 5300 | SEOA7077a | 5360 | SEOA7165a |
| 5121 | SEOA6863 | 5181 | seoa6936 | 5241 | seoa7007 | 5301 | SEOA7078a | 5361 | SEOA7166a |
| 5122 | SEOA6864 | 5182 | seoa6937 | 5242 | seoa7008 | 5302 | SEOA7080a | 5362 | SEOA7167a |
| 5123 | SEOA6867 | 5183 | seoa6938 | 5243 | seoa7009 | 5303 | SEOA7081a | 5363 | SEOA7168a |
| 5124 | SEOA6868 | 5184 | seoa6939 | 5244 | seoa7010 | 5304 | SEOA7082a | 5364 | SEOA7169a |
| 5125 | SEOA6869 | 5185 | seoa6940 | 5245 | seoa7011 | 5305 | SEOA7083a | 5365 | SEOA7170a |
| 5126 | SEOA6871 | 5186 | seoa6941 | 5246 | seoa7012 | 5306 | SEOA7085a | 5366 | SEOA7171a |
| 5127 | SEOA6872 | 5187 | seoa6942 | 5247 | seoa7013 | 5307 | SEOA7086a | 5367 | SEOA7174a |
| 5128 | SEOA6873 | 5188 | seoa6943 | 5248 | seoa7014 | 5308 | SEOA7087a | 5368 | SEOA7175a |
| 5129 | SEOA6875 | 5189 | seoa6944 | 5249 | seoa7015 | 5309 | SEOA7089a | 5369 | SEOA7176a |
| 5130 | SEOA6876 | 5190 | seoa6945 | 5250 | seoa7017 | 5310 | SEOA7090a | 5370 | SEOA7177a |
| 5131 | SEOA6877 | 5191 | seoa6946 | 5251 | seoa7018 | 5311 | SEOA7091a | 5371 | SEOA7178a |
| 5132 | SEOA6878 | 5192 | seoa6948 | 5252 | seoa7019 | 5312 | SEOA7092a | 5372 | SEOA7179a |
| 5133 | SEOA6879 | 5193 | seoa6950 | 5253 | seoa7020 | 5313 | SEOA7093a | 5373 | SEOA7180a |
| 5134 | SEOA6881 | 5194 | seoa6951 | 5254 | seoa7021 | 5314 | SEOA7094a | 5374 | SEOA7181a |
| 5135 | seoa6883 | 5195 | seoa6952 | 5255 | seoa7022 | 5315 | SEOA7095a | 5375 | SEOA7182a |
| 5136 | SEOA6884 | 5196 | seoa6953 | 5256 | seoa7024 | 5316 | SEOA7097a | 5376 | SEOA7183a |
| 5137 | SEOA6885 | 5197 | seoa6955 | 5257 | seoa7026 | 5317 | SEOA7098a | 5377 | SEOA7184a |
| 5138 | SEOA6886 | 5198 | seoa6956 | 5258 | seoa7027 | 5318 | SEOA7099a | 5378 | SEOA7186a |
| 5139 | SEOA6887 | 5199 | seoa6957 | 5259 | seoa7028 | 5319 | SEOA7105a | 5379 | SEOA7187a |
| 5140 | SEOA6888 | 5200 | seoa6958 | 5260 | seoa7029 | 5320 | SEOA7109a | 5380 | SEOA7188a |
| 5141 | SEOA6889 | 5201 | seoa6959 | 5261 | seoa7030 | 5321 | SEOA7110a | 5381 | seoa7190an |
| 5142 | SEOA6891 | 5202 | seoa6960 | 5262 | seoa7032 | 5322 | SEOA7111a | 5382 | SEOA7192a |
| 5143 | SEOA6892 | 5203 | seoa6962 | 5263 | seoa7033 | 5323 | SEOA7112a | 5383 | SEOA7194a |
| 5144 | SEOA6893 | 5204 | seoa6963 | 5264 | seoa7034 | 5324 | SEOA7113a | 5384 | SEOA7195a |
| 5145 | SEOA6894 | 5205 | seoa6965 | 5265 | seoa7036 | 5325 | SEOA7114a | 5385 | seoa7196an |
| 5146 | SEOA6895 | 5206 | seoa6966 | 5266 | seoa7038 | 5326 | SEOA7115a | 5386 | seoa7197an |
| 5147 | SEOA6896 | 5207 | seoa6968 | 5267 | seoa7039 | 5327 | SEOA7116a | 5387 | SEOA7198a |
| 5148 | seoa6897n | 5208 | seoa6969 | 5268 | seoa7040 | 5328 | SEOA7117a | 5388 | SEOA7199a |
| 5149 | SEOA6898 | 5209 | seoa6971 | 5269 | seoa7041 | 5329 | SEOA7119a | 5389 | SEOA7200a |
| 5150 | SEOA6899 | 5210 | seoa6972 | 5270 | seoa7042 | 5330 | SEOA7120a | 5390 | SEOA7201a |
| 5151 | SEOA6901 | 5211 | seoa6974 | 5271 | seoa7043 | 5331 | SEOA7122a | 5391 | SEOA7203a |
| 5152 | SEOA6902 | 5212 | seoa6975 | 5272 | seoa7044 | 5332 | SEOA7123a | 5392 | SEOA7204a |
| 5153 | SEOA6903 | 5213 | seoa6976 | 5273 | seoa7045 | 5333 | SEOA7124a | 5393 | SEOA7205a |
| 5154 | SEOA6904 | 5214 | seoa6977 | 5274 | seoa7046 | 5334 | SEOA7125a | 5394 | SEOA7206a |
| 5155 | SEOA6905 | 5215 | seoa6978 | 5275 | seoa7047 | 5335 | SEOA7126a | 5395 | SEOA7210a |
| 5156 | SEOA6906 | 5216 | seoa6979 | 5276 | seoa7049 | 5336 | SEOA7127a | 5396 | SEOA7211a |
| 5157 | SEOA6907 | 5217 | seoa6980 | 5277 | seoa7051 | 5337 | SEOA7128a | 5397 | SEOA7212a |
| 5158 | SEOA6908 | 5218 | seoa6981 | 5278 | seoa7052 | 5338 | SEOA7129a | 5398 | seoa7213an |
| 5159 | SEOA6909 | 5219 | seoa6982 | 5279 | seoa7053 | 5339 | SEOA7132a | 5399 | SEOA7214a |
| 5160 | SEOA6910 | 5220 | seoa6983 | 5280 | seoa7054 | 5340 | SEOA7133a | 5400 | SEOA7215a |

Figure 6E – List of EST Sequence Names From Severe OA Cartilage cDNA Library

| | |
|---|---|
| 5401 | SEOA7216a |
| 5402 | SEOA7217a |
| 5403 | SEOA7218a |
| 5404 | SEOA7219a |
| 5405 | SEOA7220a |
| 5406 | SEOA7221a |
| 5407 | SEOA7222a |
| 5408 | SEOA7223a |
| 5409 | SEOA7224a |
| 5410 | SEOA7225a |
| 5411 | SEOA7226a |
| 5412 | SEOA7227a |
| 5413 | seoa7228a |
| 5414 | SEOA7229a |
| 5415 | SEOA7231a |
| 5416 | SEOA7232a |
| 5417 | SEOA7233a |
| 5418 | SEOA7235a |
| 5419 | SEOA7237a |
| 5420 | SEOA7238a |
| 5421 | SEOA7239a |
| 5422 | SEOA7240a |
| 5423 | SEOA7241a |
| 5424 | SEOA7243a |
| 5425 | SEOA7244a |
| 5426 | SEOA7245a |
| 5427 | SEOA7248a |
| 5428 | SEOA7249a |
| 5429 | SEOA7250a |
| 5430 | SEOA7251a |
| 5431 | SEOA7254a |
| 5432 | SEOA7256a |
| 5433 | seoa7257an |
| 5434 | SEOA7259a |
| 5435 | SEOA7260a |
| 5436 | SEOA7261a |
| 5437 | seoa7263an |
| 5438 | SEOA7264a |
| 5439 | SEOA7265a |
| 5440 | SEOA7266a |
| 5441 | SEOA7267a |
| 5442 | SEOA7268a |
| 5443 | SEOA7270a |
| 5444 | SEOA7271a |
| 5445 | SEOA7272a |
| 5446 | seoa7274an |
| 5447 | SEOA7275a |
| 5448 | SEOA7276a |
| 5449 | SEOA7277a |
| 5450 | SEOA7278a |
| 5451 | SEOA7280a |
| 5452 | SEOA7281a |
| 5453 | SEOA7282a |
| 5454 | SEOA7283a |
| 5455 | SEOA7285a |
| 5456 | SEOA7286a |
| 5457 | SEOA7288a |
| 5458 | SEOA7289a |
| 5459 | SEOA7290a |
| 5460 | SEOA7291a |
| 5461 | SEOA7292a |
| 5462 | SEOA7293a |
| 5463 | SEOA7294a |
| 5464 | SEOA7295a |
| 5465 | SEOA7296a |
| 5466 | SEOA7298a |
| 5467 | SEOA7299a |
| 5468 | seoa7300an |
| 5469 | SEOA7301a |
| 5470 | SEOA7302a |
| 5471 | SEOA7304a |
| 5472 | SEOA7306a |
| 5473 | SEOA7307a |
| 5474 | SEOA7308a |
| 5475 | SEOA7309a |
| 5476 | SEOA7310a |
| 5477 | SEOA7311a |
| 5478 | SEOA7313a |
| 5479 | seoa7314a |
| 5480 | seoa7315a |
| 5481 | SEOA7316a |
| 5482 | SEOA7317a |
| 5483 | seoa7318a |
| 5484 | SEOA7319a |
| 5485 | SEOA7320a |
| 5486 | SEOA7322a |
| 5487 | SEOA7323a |
| 5488 | SEOA7324a |
| 5489 | SEOA7325a |
| 5490 | SEOA7326a |
| 5491 | SEOA7327a |
| 5492 | SEOA7328a |
| 5493 | SEOA7329a |
| 5494 | SEOA7330a |
| 5495 | SEOA7331a |
| 5496 | SEOA7332a |
| 5497 | SEOA7333a |
| 5498 | SEOA7334a |
| 5499 | SEOA7335a |
| 5500 | SEOA7336a |
| 5501 | SEOA7337a |
| 5502 | SEOA7338a |
| 5503 | SEOA7339a |
| 5504 | SEOA7340a |
| 5505 | SEOA7341a |
| 5506 | SEOA7342a |
| 5507 | SEOA7343a |
| 5508 | SEOA7344a |
| 5509 | SEOA7345a |
| 5510 | SEOA7347a |
| 5511 | SEOA7348a |
| 5512 | SEOA7352a |
| 5513 | SEOA7353a |
| 5514 | SEOA7354a |
| 5515 | SEOA7358a |
| 5516 | SEOA7360a |
| 5517 | SEOA7361a |
| 5518 | SEOA7362a |
| 5519 | SEOA7363a |
| 5520 | SEOA7364a |
| 5521 | SEOA7365a |
| 5522 | SEOA7366a |
| 5523 | SEOA7367a |
| 5524 | SEOA7368a |
| 5525 | SEOA7369a |
| 5526 | SEOA7370a |
| 5527 | SEOA7371a |
| 5528 | SEOA7372a |
| 5529 | SEOA7373a |
| 5530 | SEOA7376a |
| 5531 | SEOA7378a |
| 5532 | SEOA7379a |
| 5533 | SEOA7380a |
| 5534 | SEOA7383a |
| 5535 | SEOA7384a |
| 5536 | SEOA7385a |
| 5537 | SEOA7386a |
| 5538 | SEOA7387a |
| 5539 | SEOA7389a |
| 5540 | SEOA7390a |
| 5541 | SEOA7391a |
| 5542 | SEOA7393a |
| 5543 | SEOA7394a |
| 5544 | SEOA7395a |
| 5545 | SEOA7396a |
| 5546 | SEOA7397a |
| 5547 | SEOA7398a |
| 5548 | SEOA7399a |
| 5549 | SEOA7400a |
| 5550 | SEOA7401a |
| 5551 | SEOA7403a |
| 5552 | SEOA7404a |
| 5553 | SEOA7405a |
| 5554 | SEOA7406a |
| 5555 | SEOA7408a |
| 5556 | SEOA7409a |
| 5557 | seoa7411an |
| 5558 | SEOA7413a |
| 5559 | SEOA7415a |
| 5560 | SEOA7416a |
| 5561 | SEOA7417a |
| 5562 | SEOA7418a |
| 5563 | SEOA7419a |
| 5564 | SEOA7420a |
| 5565 | SEOA7421a |
| 5566 | seoa7422a |
| 5567 | SEOA7423a |
| 5568 | SEOA7424a |
| 5569 | SEOA7425a |
| 5570 | SEOA7426a |
| 5571 | SEOA7427a |
| 5572 | SEOA7428a |
| 5573 | SEOA7429a |
| 5574 | SEOA7430a |
| 5575 | SEOA7431a |
| 5576 | SEOA7432a |
| 5577 | seoa7433an |
| 5578 | SEOA7434a |
| 5579 | SEOA7436a |
| 5580 | SEOA7438a |
| 5581 | SEOA7440a |
| 5582 | SEOA7441a |
| 5583 | SEOA7442a |
| 5584 | SEOA7443a |
| 5585 | seoa7444an |
| 5586 | SEOA7446a |
| 5587 | SEOA7448a |
| 5588 | SEOA7449a |
| 5589 | SEOA7451a |
| 5590 | SEOA7453a |
| 5591 | SEOA7455a |
| 5592 | SEOA7456a |
| 5593 | SEOA7458a |
| 5594 | SEOA7459a |
| 5595 | SEOA7460a |
| 5596 | SEOA7461a |
| 5597 | SEOA7464a |
| 5598 | seoa7466an |
| 5599 | SEOA7467a |
| 5600 | SEOA7468a |
| 5601 | SEOA7469a |
| 5602 | SEOA7471a |
| 5603 | SEOA7472a |
| 5604 | SEOA7474a |
| 5605 | SEOA7476a |
| 5606 | SEOA7477a |
| 5607 | SEOA7478a |
| 5608 | SEOA7479a |
| 5609 | SEOA7481a |
| 5610 | SEOA7482a |
| 5611 | SEOA7483a |
| 5612 | seoa7484an |
| 5613 | SEOA7485a |
| 5614 | SEOA7487a |
| 5615 | SEOA7488a |
| 5616 | seoa7489an |
| 5617 | SEOA7491a |
| 5618 | SEOA7492a |
| 5619 | SEOA7493a |
| 5620 | SEOA7495a |
| 5621 | SEOA7496a |
| 5622 | SEOA7497a |
| 5623 | SEOA7498a |
| 5624 | SEOA7500a |
| 5625 | SEOA7501a |
| 5626 | seoa7503an |
| 5627 | SEOA7504a |
| 5628 | SEOA7507a |
| 5629 | SEOA7508a |
| 5630 | SEOA7509a |
| 5631 | SEOA7511a |
| 5632 | SEOA7512a |
| 5633 | SEOA7514a |
| 5634 | SEOA7515a |
| 5635 | SEOA7516a |
| 5636 | SEOA7517a |
| 5637 | SEOA7519a |
| 5638 | SEOA7520a |
| 5639 | SEOA7521a |
| 5640 | SEOA7522a |
| 5641 | SEOA7523a |
| 5642 | SEOA7524a |
| 5643 | SEOA7525a |
| 5644 | SEOA7526a |
| 5645 | SEOA7527a |
| 5646 | SEOA7528a |
| 5647 | SEOA7529a |
| 5648 | SEOA7530a |
| 5649 | SEOA7531a |
| 5650 | SEOA7532a |
| 5651 | SEOA7534a |
| 5652 | SEOA7535a |
| 5653 | SEOA7536a |
| 5654 | SEOA7538a |
| 5655 | SEOA7539a |
| 5656 | SEOA7540a |
| 5657 | SEOA7541a |
| 5658 | SEOA7542a |
| 5659 | SEOA7543a |
| 5660 | seoa7544an |
| 5661 | SEOA7546a |
| 5662 | SEOA7547a |
| 5663 | SEOA7548a |
| 5664 | seoa7549an |
| 5665 | SEOA7550a |
| 5666 | SEOA7551a |
| 5667 | SEOA7552a |
| 5668 | SEOA7553a |
| 5669 | SEOA7555a |
| 5670 | SEOA7556a |
| 5671 | SEOA7558a |
| 5672 | SEOA7560a |
| 5673 | SEOA7561a |
| 5674 | SEOA7562a |
| 5675 | SEOA7563a |
| 5676 | SEOA7564a |
| 5677 | seoa7565an |
| 5678 | SEOA7566a |
| 5679 | SEOA7568a |
| 5680 | SEOA7569a |
| 5681 | SEOA7570a |
| 5682 | SEOA7571a |
| 5683 | SEOA7573a |
| 5684 | SEOA7574a |
| 5685 | SEOA7575a |
| 5686 | SEOA7577a |
| 5687 | SEOA7578a |
| 5688 | SEOA7579a |
| 5689 | SEOA7580a |
| 5690 | SEOA7581a |
| 5691 | SEOA7582a |
| 5692 | SEOA7583a |
| 5693 | SEOA7584a |
| 5694 | SEOA7585a |
| 5695 | SEOA7586a |
| 5696 | SEOA7587a |
| 5697 | SEOA7588a |
| 5698 | SEOA7589a |
| 5699 | SEOA7591a |
| 5700 | SEOA7592a |

Figure 6E – List of EST Sequence Names From Severe OA Cartilage cDNA Library

| | | | | | | | | | |
|---|---|---|---|---|---|---|---|---|---|
| 5701 | SEOA7593a | 5761 | SEOA7664a | 5821 | seoa7740a | 5881 | seoa7822a | 5941 | SEOA7908a |
| 5702 | SEOA7595a | 5762 | SEOA7666a | 5822 | seoa7741a | 5882 | seoa7824a | 5942 | SEOA7910a |
| 5703 | SEOA7597a | 5763 | SEOA7668a | 5823 | seoa7742a | 5883 | seoa7825a | 5943 | SEOA7911a |
| 5704 | SEOA7598a | 5764 | SEOA7669a | 5824 | seoa7743a | 5884 | seoa7827a | 5944 | SEOA7914a |
| 5705 | SEOA7600a | 5765 | SEOA7670a | 5825 | seoa7744a | 5885 | seoa7828a | 5945 | SEOA7915a |
| 5706 | SEOA7601a | 5766 | SEOA7672a | 5826 | seoa7745a | 5886 | seoa7829a | 5946 | SEOA7917a |
| 5707 | SEOA7602a | 5767 | SEOA7674a | 5827 | seoa7746a | 5887 | seoa7830a | 5947 | SEOA7918a |
| 5708 | SEOA7603a | 5768 | SEOA7675a | 5828 | seoa7748a | 5888 | seoa7831a | 5948 | seoa7919an |
| 5709 | SEOA7604a | 5769 | SEOA7676a | 5829 | seoa7749a | 5889 | seoa7832a | 5949 | SEOA7920a |
| 5710 | SEOA7605a | 5770 | seoa7677a | 5830 | seoa7750a | 5890 | seoa7833a | 5950 | SEOA7921a |
| 5711 | SEOA7606a | 5771 | seoa7679a | 5831 | seoa7751a | 5891 | seoa7834a | 5951 | SEOA7923a |
| 5712 | SEOA7607a | 5772 | seoa7680a | 5832 | seoa7752a | 5892 | seoa7835a | 5952 | seoa7924an |
| 5713 | SEOA7608a | 5773 | seoa7681a | 5833 | seoa7753a | 5893 | seoa7836a | 5953 | SEOA7925a |
| 5714 | SEOA7610a | 5774 | seoa7682a | 5834 | seoa7754a | 5894 | seoa7837a | 5954 | SEOA7926a |
| 5715 | SEOA7611a | 5775 | seoa7684a | 5835 | seoa7755a | 5895 | seoa7838a | 5955 | SEOA7927a |
| 5716 | SEOA7612a | 5776 | seoa7686a | 5836 | seoa7757a | 5896 | seoa7839a | 5956 | SEOA7928a |
| 5717 | SEOA7613a | 5777 | seoa7687a | 5837 | seoa7758a | 5897 | seoa7840a | 5957 | SEOA7929a |
| 5718 | SEOA7614a | 5778 | seoa7688a | 5838 | seoa7759a | 5898 | seoa7842a | 5958 | SEOA7930a |
| 5719 | seoa7615an | 5779 | seoa7691a | 5839 | seoa7760a | 5899 | seoa7844a | 5959 | SEOA7931a |
| 5720 | SEOA7616a | 5780 | seoa7692a | 5840 | seoa7761a | 5900 | seoa7845a | 5960 | SEOA7932a |
| 5721 | SEOA7617a | 5781 | seoa7693a | 5841 | seoa7762a | 5901 | seoa7846a | 5961 | SEOA7933a |
| 5722 | SEOA7618a | 5782 | seoa7694a | 5842 | seoa7764a | 5902 | seoa7847a | 5962 | SEOA7935a |
| 5723 | SEOA7619a | 5783 | seoa7695a | 5843 | seoa7765a | 5903 | seoa7848a | 5963 | SEOA7936a |
| 5724 | seoa7620an | 5784 | seoa7696a | 5844 | seoa7766a | 5904 | seoa7850a | 5964 | SEOA7937a |
| 5725 | SEOA7621a | 5785 | seoa7697a | 5845 | seoa7767a | 5905 | seoa7851a | 5965 | SEOA7938a |
| 5726 | SEOA7622a | 5786 | seoa7698a | 5846 | seoa7769a | 5906 | seoa7853a | 5966 | SEOA7939a |
| 5727 | seoa7623an | 5787 | seoa7699a | 5847 | seoa7772a | 5907 | seoa7854a | 5967 | SEOA7940a |
| 5728 | SEOA7624a | 5788 | seoa7700a | 5848 | seoa7773a | 5908 | seoa7855a | 5968 | SEOA7942a |
| 5729 | SEOA7626a | 5789 | seoa7701a | 5849 | seoa7774a | 5909 | seoa7856a | 5969 | SEOA7943a |
| 5730 | SEOA7627a | 5790 | seoa7702a | 5850 | seoa7775a | 5910 | seoa7859a | 5970 | seoa7945an |
| 5731 | SEOA7628a | 5791 | seoa7704a | 5851 | seoa7776a | 5911 | seoa7860a | 5971 | SEOA7946a |
| 5732 | SEOA7629a | 5792 | seoa7705a | 5852 | seoa7777a | 5912 | seoa7861a | 5972 | SEOA7947a |
| 5733 | SEOA7630a | 5793 | seoa7707a | 5853 | seoa7778a | 5913 | seoa7862a | 5973 | SEOA7948a |
| 5734 | SEOA7633a | 5794 | seoa7708a | 5854 | seoa7782a | 5914 | seoa7863a | 5974 | SEOA7949a |
| 5735 | SEOA7634a | 5795 | seoa7709a | 5855 | seoa7786a | 5915 | seoa7867a | 5975 | SEOA7950a |
| 5736 | SEOA7635a | 5796 | seoa7710a | 5856 | seoa7788a | 5916 | seoa7868a | 5976 | SEOA7951a |
| 5737 | SEOA7636a | 5797 | seoa7711a | 5857 | seoa7790a | 5917 | seoa7869a | 5977 | SEOA7952a |
| 5738 | SEOA7638a | 5798 | seoa7712a | 5858 | seoa7791a | 5918 | seoa7870a | 5978 | SEOA7953a |
| 5739 | SEOA7639a | 5799 | seoa7713a | 5859 | seoa7793a | 5919 | seoa7871a | 5979 | seoa7955 |
| 5740 | SEOA7640a | 5800 | seoa7714a | 5860 | seoa7795a | 5920 | seoa7872a | 5980 | seoa7956 |
| 5741 | SEOA7641a | 5801 | seoa7715a | 5861 | seoa7796a | 5921 | seoa7876a | 5981 | seoa7957 |
| 5742 | SEOA7642a | 5802 | seoa7716a | 5862 | seoa7800a | 5922 | seoa7877a | 5982 | seoa7958 |
| 5743 | SEOA7643a | 5803 | seoa7717a | 5863 | seoa7801a | 5923 | seoa7878a | 5983 | seoa7959 |
| 5744 | SEOA7644a | 5804 | seoa7718a | 5864 | seoa7802a | 5924 | seoa7879a | 5984 | seoa7960 |
| 5745 | SEOA7645a | 5805 | seoa7719a | 5865 | seoa7803a | 5925 | seoa7880a | 5985 | seoa7961 |
| 5746 | SEOA7646a | 5806 | seoa7721a | 5866 | seoa7805a | 5926 | seoa7883a | 5986 | seoa7962 |
| 5747 | SEOA7647a | 5807 | seoa7722a | 5867 | seoa7806a | 5927 | seoa7885a | 5987 | seoa7963 |
| 5748 | SEOA7648a | 5808 | seoa7723a | 5868 | seoa7807a | 5928 | seoa7886a | 5988 | seoa7965 |
| 5749 | SEOA7649a | 5809 | seoa7725a | 5869 | seoa7808a | 5929 | seoa7887a | 5989 | seoa7966 |
| 5750 | SEOA7650a | 5810 | seoa7726a | 5870 | seoa7809a | 5930 | seoa7890a | 5990 | seoa7967 |
| 5751 | SEOA7651a | 5811 | seoa7727a | 5871 | seoa7811a | 5931 | SEOA7892a | 5991 | seoa7968 |
| 5752 | SEOA7652a | 5812 | seoa7728a | 5872 | seoa7812a | 5932 | SEOA7893a | 5992 | seoa7969 |
| 5753 | SEOA7653a | 5813 | seoa7729a | 5873 | seoa7813a | 5933 | SEOA7894a | 5993 | seoa7970 |
| 5754 | SEOA7654a | 5814 | seoa7732a | 5874 | seoa7814a | 5934 | SEOA7895a | 5994 | seoa7972 |
| 5755 | SEOA7655a | 5815 | seoa7733a | 5875 | seoa7815a | 5935 | SEOA7897a | 5995 | seoa7973 |
| 5756 | SEOA7656a | 5816 | seoa7734a | 5876 | seoa7816a | 5936 | SEOA7899a | 5996 | seoa7974 |
| 5757 | SEOA7657a | 5817 | seoa7735a | 5877 | seoa7817a | 5937 | SEOA7900a | 5997 | seoa7975 |
| 5758 | SEOA7659a | 5818 | seoa7736a | 5878 | seoa7818a | 5938 | SEOA7902a | 5998 | seoa7977 |
| 5759 | SEOA7662a | 5819 | seoa7738a | 5879 | seoa7819a | 5939 | SEOA7904a | 5999 | seoa7978 |
| 5760 | SEOA7663a | 5820 | seoa7739a | 5880 | seoa7820a | 5940 | SEOA7907a | 6000 | seoa7980 |

Figure 6E – List of EST Sequence Names From Severe OA Cartilage cDNA Library

| | | | | | | | | | |
|---|---|---|---|---|---|---|---|---|---|
| 6001 | seoa7981 | 6061 | seoa8052 | 6121 | seoa8131 | 6181 | SEOA8214 | 6241 | SEOA8285 |
| 6002 | seoa7982 | 6062 | seoa8054 | 6122 | seoa8132 | 6182 | SEOA8215 | 6242 | SEOA8286 |
| 6003 | seoa7983 | 6063 | seoa8055 | 6123 | seoa8133 | 6183 | SEOA8217 | 6243 | SEOA8288 |
| 6004 | seoa7984 | 6064 | seoa8058 | 6124 | seoa8134 | 6184 | SEOA8220 | 6244 | SEOA8289 |
| 6005 | seoa7985 | 6065 | seoa8059 | 6125 | seoa8137 | 6185 | SEOA8221 | 6245 | SEOA8290 |
| 6006 | seoa7986 | 6066 | seoa8060 | 6126 | seoa8138 | 6186 | SEOA8222 | 6246 | SEOA8291 |
| 6007 | seoa7988 | 6067 | seoa8063 | 6127 | seoa8139 | 6187 | SEOA8223 | 6247 | SEOA8294 |
| 6008 | seoa7989 | 6068 | seoa8064 | 6128 | seoa8141 | 6188 | SEOA8226 | 6248 | SEOA8296 |
| 6009 | seoa7990 | 6069 | seoa8065 | 6129 | seoa8142 | 6189 | SEOA8227 | 6249 | SEOA8298 |
| 6010 | seoa7991 | 6070 | seoa8066 | 6130 | seoa8144 | 6190 | SEOA8229 | 6250 | SEOA8299 |
| 6011 | seoa7996 | 6071 | seoa8067 | 6131 | seoa8146 | 6191 | SEOA8230 | 6251 | SEOA8300 |
| 6012 | seoa7997 | 6072 | seoa8070 | 6132 | seoa8148 | 6192 | SEOA8231 | 6252 | SEOA8301 |
| 6013 | seoa7998 | 6073 | seoa8071 | 6133 | seoa8149 | 6193 | SEOA8232 | 6253 | SEOA8304 |
| 6014 | seoa7999 | 6074 | seoa8072 | 6134 | seoa8150 | 6194 | SEOA8233 | 6254 | SEOA8306a |
| 6015 | seoa8001 | 6075 | seoa8073 | 6135 | seoa8151 | 6195 | SEOA8234 | 6255 | SEOA8307a |
| 6016 | seoa8002 | 6076 | seoa8074 | 6136 | seoa8153 | 6196 | SEOA8236 | 6256 | SEOA8308a |
| 6017 | seoa8003 | 6077 | seoa8075 | 6137 | seoa8154 | 6197 | SEOA8237 | 6257 | SEOA8309a |
| 6018 | seoa8004 | 6078 | seoa8077 | 6138 | seoa8156 | 6198 | SEOA8238 | 6258 | SEOA8310a |
| 6019 | seoa8005 | 6079 | seoa8078 | 6139 | seoa8158 | 6199 | SEOA8239 | 6259 | SEOA8311a |
| 6020 | seoa8006 | 6080 | seoa8080 | 6140 | seoa8159 | 6200 | SEOA8240 | 6260 | SEOA8312a |
| 6021 | seoa8007 | 6081 | seoa8082 | 6141 | seoa8160 | 6201 | SEOA8241 | 6261 | SEOA8313a |
| 6022 | seoa8008 | 6082 | seoa8083 | 6142 | seoa8161 | 6202 | SEOA8242 | 6262 | SEOA8315a |
| 6023 | seoa8009 | 6083 | seoa8084 | 6143 | seoa8164 | 6203 | SEOA8243 | 6263 | SEOA8316a |
| 6024 | seoa8010 | 6084 | seoa8086 | 6144 | SEOA8165a | 6204 | SEOA8244 | 6264 | SEOA8317a |
| 6025 | seoa8011 | 6085 | seoa8087 | 6145 | SEOA8166a | 6205 | SEOA8245 | 6265 | SEOA8318a |
| 6026 | seoa8012 | 6086 | seoa8088 | 6146 | SEOA8167a | 6206 | SEOA8246 | 6266 | SEOA8321a |
| 6027 | seoa8014 | 6087 | seoa8089 | 6147 | SEOA8171a | 6207 | SEOA8248 | 6267 | SEOA8322a |
| 6028 | seoa8015 | 6088 | seoa8090 | 6148 | SEOA8172a | 6208 | SEOA8250 | 6268 | SEOA8323a |
| 6029 | seoa8016 | 6089 | seoa8091 | 6149 | seoa8173an | 6209 | SEOA8251 | 6269 | SEOA8324a |
| 6030 | seoa8017 | 6090 | seoa8092 | 6150 | SEOA8174a | 6210 | SEOA8252 | 6270 | SEOA8325a |
| 6031 | seoa8018 | 6091 | seoa8093 | 6151 | SEOA8175a | 6211 | SEOA8253 | 6271 | SEOA8326a |
| 6032 | seoa8019 | 6092 | seoa8094 | 6152 | SEOA8176a | 6212 | SEOA8254 | 6272 | SEOA8327a |
| 6033 | seoa8020 | 6093 | seoa8095 | 6153 | SEOA8177a | 6213 | SEOA8255 | 6273 | SEOA8330a |
| 6034 | seoa8021 | 6094 | seoa8096 | 6154 | SEOA8179a | 6214 | SEOA8256 | 6274 | SEOA8331a |
| 6035 | seoa8023 | 6095 | seoa8097 | 6155 | SEOA8181a | 6215 | SEOA8257 | 6275 | seoa8334an |
| 6036 | seoa8024 | 6096 | seoa8098 | 6156 | SEOA8184a | 6216 | SEOA8258 | 6276 | SEOA8335a |
| 6037 | seoa8025 | 6097 | seoa8099 | 6157 | SEOA8186a | 6217 | SEOA8259 | 6277 | SEOA8336a |
| 6038 | seoa8026 | 6098 | seoa8101 | 6158 | seoa8187a | 6218 | SEOA8260 | 6278 | SEOA8340a |
| 6039 | seoa8027 | 6099 | seoa8102 | 6159 | SEOA8188a | 6219 | SEOA8262 | 6279 | SEOA8341a |
| 6040 | seoa8028 | 6100 | seoa8104 | 6160 | SEOA8189a | 6220 | SEOA8263 | 6280 | SEOA8342a |
| 6041 | seoa8029 | 6101 | seoa8105 | 6161 | SEOA8190a | 6221 | SEOA8264 | 6281 | SEOA8343a |
| 6042 | seoa8030 | 6102 | seoa8106 | 6162 | SEOA8191a | 6222 | SEOA8265 | 6282 | SEOA8344a |
| 6043 | seoa8031 | 6103 | seoa8107 | 6163 | SEOA8192a | 6223 | SEOA8266 | 6283 | SEOA8347a |
| 6044 | seoa8032 | 6104 | seoa8108 | 6164 | SEOA8193a | 6224 | SEOA8267 | 6284 | SEOA8348a |
| 6045 | seoa8033 | 6105 | seoa8109 | 6165 | SEOA8194a | 6225 | SEOA8268 | 6285 | SEOA8350a |
| 6046 | seoa8035 | 6106 | seoa8110 | 6166 | SEOA8195a | 6226 | SEOA8269 | 6286 | SEOA8351a |
| 6047 | seoa8036 | 6107 | seoa8111 | 6167 | SEOA8197a | 6227 | SEOA8270 | 6287 | SEOA8352a |
| 6048 | seoa8037 | 6108 | seoa8113 | 6168 | SEOA8199a | 6228 | SEOA8271 | 6288 | SEOA8354a |
| 6049 | seoa8038 | 6109 | seoa8114 | 6169 | SEOA8200a | 6229 | SEOA8272 | 6289 | SEOA8355a |
| 6050 | seoa8039 | 6110 | seoa8115 | 6170 | SEOA8201a | 6230 | SEOA8273 | 6290 | SEOA8356a |
| 6051 | seoa8040 | 6111 | seoa8116 | 6171 | SEOA8202a | 6231 | SEOA8274 | 6291 | seoa8357an |
| 6052 | seoa8041 | 6112 | seoa8118 | 6172 | SEOA8203a | 6232 | SEOA8275 | 6292 | SEOA8358a |
| 6053 | seoa8043 | 6113 | seoa8119 | 6173 | SEOA8204 | 6233 | SEOA8276 | 6293 | seoa8359an |
| 6054 | seoa8045 | 6114 | seoa8120 | 6174 | SEOA8206 | 6234 | SEOA8277 | 6294 | SEOA8360a |
| 6055 | seoa8046 | 6115 | seoa8121 | 6175 | SEOA8207 | 6235 | SEOA8278 | 6295 | SEOA8361a |
| 6056 | seoa8047 | 6116 | seoa8122 | 6176 | SEOA8208 | 6236 | seoa8279n | 6296 | SEOA8363a |
| 6057 | seoa8048 | 6117 | seoa8124 | 6177 | SEOA8209 | 6237 | seoa8280n | 6297 | SEOA8364a |
| 6058 | seoa8049 | 6118 | seoa8126 | 6178 | SEOA8211 | 6238 | seoa8281 | 6298 | SEOA8365a |
| 6059 | seoa8050 | 6119 | seoa8127 | 6179 | SEOA8212 | 6239 | SEOA8283 | 6299 | SEOA8366a |
| 6060 | seoa8051 | 6120 | seoa8129 | 6180 | SEOA8213 | 6240 | seoa8284n | 6300 | SEOA8367a |

Figure 6E - List of EST Sequence Names From Severe OA Cartilage cDNA Library

| | | | | | | | | | |
|---|---|---|---|---|---|---|---|---|---|
| 6301 | SEOA8368a | 6361 | SEOA8446 | 6421 | SEOA8521 | 6481 | SEOA8585 | 6541 | SEOA8652 |
| 6302 | SEOA8369a | 6362 | SEOA8447 | 6422 | SEOA8522 | 6482 | SEOA8586 | 6542 | SEOA8653 |
| 6303 | SEOA8370a | 6363 | SEOA8449 | 6423 | SEOA8523 | 6483 | SEOA8587 | 6543 | seoa8654n |
| 6304 | SEOA8371a | 6364 | SEOA8451 | 6424 | SEOA8524 | 6484 | SEOA8588 | 6544 | SEOA8655 |
| 6305 | SEOA8372a | 6365 | SEOA8452 | 6425 | SEOA8525 | 6485 | SEOA8590 | 6545 | SEOA8656 |
| 6306 | SEOA8374a | 6366 | SEOA8453 | 6426 | SEOA8526 | 6486 | SEOA8592 | 6546 | SEOA8657 |
| 6307 | SEOA8376a | 6367 | SEOA8454 | 6427 | seoa8527n | 6487 | SEOA8593 | 6547 | SEOA8658 |
| 6308 | seoa8377an | 6368 | SEOA8455 | 6428 | SEOA8528 | 6488 | SEOA8594 | 6548 | SEOA8661 |
| 6309 | SEOA8378a | 6369 | SEOA8456 | 6429 | SEOA8529 | 6489 | SEOA8595 | 6549 | SEOA8663 |
| 6310 | SEOA8379a | 6370 | SEOA8457 | 6430 | SEOA8530 | 6490 | SEOA8597 | 6550 | SEOA8664 |
| 6311 | SEOA8380a | 6371 | SEOA8458 | 6431 | SEOA8531 | 6491 | SEOA8598 | 6551 | SEOA8668 |
| 6312 | SEOA8381a | 6372 | SEOA8459 | 6432 | SEOA8532 | 6492 | SEOA8599 | 6552 | SEOA8669 |
| 6313 | SEOA8382a | 6373 | SEOA8460 | 6433 | SEOA8533 | 6493 | SEOA8600 | 6553 | SEOA8670 |
| 6314 | SEOA8383a | 6374 | SEOA8461 | 6434 | SEOA8534 | 6494 | SEOA8601 | 6554 | SEOA8671 |
| 6315 | SEOA8384a | 6375 | SEOA8462 | 6435 | SEOA8535 | 6495 | seoa8602n | 6555 | SEOA8672 |
| 6316 | SEOA8386a | 6376 | SEOA8463 | 6436 | SEOA8537 | 6496 | SEOA8603 | 6556 | SEOA8673 |
| 6317 | SEOA8387a | 6377 | SEOA8464 | 6437 | SEOA8538 | 6497 | SEOA8604 | 6557 | SEOA8674 |
| 6318 | SEOA8388a | 6378 | SEOA8466 | 6438 | SEOA8539 | 6498 | SEOA8605 | 6558 | SEOA8675 |
| 6319 | SEOA8389a | 6379 | SEOA8467 | 6439 | SEOA8540 | 6499 | SEOA8606 | 6559 | SEOA8676 |
| 6320 | SEOA8390a | 6380 | SEOA8468 | 6440 | SEOA8541 | 6500 | SEOA8608 | 6560 | SEOA8677 |
| 6321 | SEOA8391a | 6381 | SEOA8469 | 6441 | SEOA8542 | 6501 | SEOA8609 | 6561 | SEOA8678 |
| 6322 | SEOA8392a | 6382 | SEOA8471 | 6442 | SEOA8543 | 6502 | SEOA8610 | 6562 | SEOA8679 |
| 6323 | seoa8393an | 6383 | SEOA8472 | 6443 | SEOA8544 | 6503 | SEOA8611 | 6563 | SEOA8680 |
| 6324 | SEOA8394a | 6384 | SEOA8474 | 6444 | SEOA8546 | 6504 | SEOA8612 | 6564 | SEOA8681 |
| 6325 | SEOA8395a | 6385 | SEOA8475 | 6445 | seoa8547n | 6505 | SEOA8613 | 6565 | SEOA8682 |
| 6326 | SEOA8396a | 6386 | SEOA8477 | 6446 | seoa8548n | 6506 | SEOA8614 | 6566 | SEOA8683 |
| 6327 | SEOA8397a | 6387 | SEOA8478 | 6447 | SEOA8549 | 6507 | SEOA8615 | 6567 | SEOA8684 |
| 6328 | SEOA8398a | 6388 | SEOA8479 | 6448 | SEOA8550 | 6508 | SEOA8616 | 6568 | SEOA8685 |
| 6329 | SEOA8399a | 6389 | SEOA8480 | 6449 | SEOA8551 | 6509 | SEOA8617 | 6569 | SEOA8686 |
| 6330 | SEOA8401a | 6390 | SEOA8481 | 6450 | SEOA8552 | 6510 | SEOA8618 | 6570 | SEOA8687 |
| 6331 | SEOA8402a | 6391 | SEOA8482 | 6451 | SEOA8553 | 6511 | SEOA8619 | 6571 | SEOA8690 |
| 6332 | SEOA8403a | 6392 | SEOA8483 | 6452 | SEOA8554 | 6512 | SEOA8620 | 6572 | SEOA8691 |
| 6333 | SEOA8406a | 6393 | SEOA8484 | 6453 | SEOA8555 | 6513 | SEOA8621 | 6573 | SEOA8692 |
| 6334 | SEOA8407a | 6394 | SEOA8486 | 6454 | SEOA8556 | 6514 | SEOA8622 | 6574 | SEOA8693 |
| 6335 | SEOA8417 | 6395 | SEOA8487 | 6455 | SEOA8557 | 6515 | SEOA8623 | 6575 | SEOA8694 |
| 6336 | SEOA8418 | 6396 | SEOA8488 | 6456 | SEOA8558 | 6516 | SEOA8624 | 6576 | SEOA8696 |
| 6337 | SEOA8419 | 6397 | SEOA8489 | 6457 | SEOA8559 | 6517 | SEOA8625 | 6577 | SEOA8698 |
| 6338 | SEOA8420 | 6398 | SEOA8491 | 6458 | SEOA8560 | 6518 | SEOA8626 | 6578 | SEOA8699 |
| 6339 | SEOA8421 | 6399 | SEOA8492 | 6459 | SEOA8562 | 6519 | SEOA8627 | 6579 | SEOA8700 |
| 6340 | SEOA8422 | 6400 | SEOA8493 | 6460 | SEOA8563 | 6520 | SEOA8628 | 6580 | SEOA8701 |
| 6341 | SEOA8423 | 6401 | SEOA8498 | 6461 | SEOA8564 | 6521 | SEOA8630 | 6581 | SEOA8702 |
| 6342 | SEOA8424 | 6402 | SEOA8499 | 6462 | SEOA8565 | 6522 | SEOA8631 | 6582 | SEOA8703 |
| 6343 | SEOA8425 | 6403 | SEOA8501 | 6463 | SEOA8566 | 6523 | SEOA8632 | 6583 | SEOA8704 |
| 6344 | SEOA8426 | 6404 | SEOA8502 | 6464 | SEOA8567 | 6524 | SEOA8633 | 6584 | SEOA8705 |
| 6345 | SEOA8428 | 6405 | SEOA8504 | 6465 | SEOA8568 | 6525 | SEOA8634 | 6585 | SEOA8706 |
| 6346 | SEOA8429 | 6406 | SEOA8505 | 6466 | SEOA8569 | 6526 | SEOA8635 | 6586 | SEOA8707 |
| 6347 | SEOA8430 | 6407 | SEOA8506 | 6467 | SEOA8570 | 6527 | SEOA8636 | 6587 | SEOA8708 |
| 6348 | SEOA8432 | 6408 | SEOA8507 | 6468 | SEOA8571 | 6528 | SEOA8637 | 6588 | SEOA8709 |
| 6349 | SEOA8433 | 6409 | SEOA8508 | 6469 | SEOA8572 | 6529 | SEOA8638 | 6589 | SEOA8710 |
| 6350 | SEOA8434 | 6410 | SEOA8509 | 6470 | SEOA8573 | 6530 | SEOA8640 | 6590 | SEOA8712 |
| 6351 | SEOA8436 | 6411 | SEOA8510 | 6471 | SEOA8575 | 6531 | SEOA8642 | 6591 | SEOA8714 |
| 6352 | SEOA8437 | 6412 | SEOA8511 | 6472 | SEOA8576 | 6532 | SEOA8643 | 6592 | SEOA8715 |
| 6353 | SEOA8438 | 6413 | SEOA8512 | 6473 | SEOA8577 | 6533 | SEOA8644 | 6593 | SEOA8716 |
| 6354 | SEOA8439 | 6414 | SEOA8514 | 6474 | SEOA8578 | 6534 | SEOA8645 | 6594 | SEOA8719 |
| 6355 | SEOA8440 | 6415 | SEOA8515 | 6475 | SEOA8579 | 6535 | SEOA8646 | 6595 | SEOA8720 |
| 6356 | SEOA8441 | 6416 | SEOA8516 | 6476 | SEOA8580 | 6536 | SEOA8647 | 6596 | SEOA8722 |
| 6357 | SEOA8442 | 6417 | SEOA8517 | 6477 | SEOA8581 | 6537 | SEOA8648 | 6597 | SEOA8723 |
| 6358 | SEOA8443 | 6418 | SEOA8518 | 6478 | SEOA8582 | 6538 | SEOA8649 | 6598 | SEOA8724 |
| 6359 | SEOA8444 | 6419 | SEOA8519 | 6479 | SEOA8583 | 6539 | SEOA8650 | 6599 | SEOA8725 |
| 6360 | SEOA8445 | 6420 | SEOA8520 | 6480 | SEOA8584 | 6540 | SEOA8651 | 6600 | SEOA8727 |

Figure 6E – List of EST Sequence Names From Severe OA Cartilage cDNA Library

| | | | | | | | | | |
|---|---|---|---|---|---|---|---|---|---|
| 6601 | SEOA8728 | 6661 | SEOA8797 | 6721 | SEOA8883 | 6781 | SEOA8962 | 6841 | SEOA9032 |
| 6602 | SEOA8729 | 6662 | SEOA8798 | 6722 | SEOA8884 | 6782 | SEOA8963 | 6842 | SEOA9033 |
| 6603 | SEOA8731 | 6663 | SEOA8799 | 6723 | SEOA8885 | 6783 | SEOA8964 | 6843 | SEOA9034 |
| 6604 | SEOA8733 | 6664 | SEOA8800 | 6724 | SEOA8890 | 6784 | SEOA8966 | 6844 | SEOA9037 |
| 6605 | SEOA8734 | 6665 | SEOA8801 | 6725 | SEOA8891 | 6785 | SEOA8967 | 6845 | SEOA9038 |
| 6606 | SEOA8735 | 6666 | SEOA8802 | 6726 | SEOA8892 | 6786 | SEOA8968 | 6846 | SEOA9039 |
| 6607 | SEOA8737 | 6667 | SEOA8803 | 6727 | SEOA8894 | 6787 | SEOA8969 | 6847 | SEOA9040 |
| 6608 | SEOA8738 | 6668 | SEOA8804 | 6728 | SEOA8895 | 6788 | SEOA8970 | 6848 | SEOA9042 |
| 6609 | SEOA8739 | 6669 | SEOA8805 | 6729 | SEOA8898 | 6789 | SEOA8971 | 6849 | SEOA9046 |
| 6610 | SEOA8740 | 6670 | SEOA8806 | 6730 | SEOA8899 | 6790 | SEOA8972 | 6850 | SEOA9047 |
| 6611 | SEOA8741 | 6671 | SEOA8808 | 6731 | SEOA8900 | 6791 | SEOA8973 | 6851 | SEOA9049 |
| 6612 | SEOA8742 | 6672 | SEOA8809 | 6732 | SEOA8902 | 6792 | SEOA8974 | 6852 | SEOA9051 |
| 6613 | SEOA8743 | 6673 | seoa8812n | 6733 | SEOA8903 | 6793 | SEOA8975 | 6853 | SEOA9060 |
| 6614 | SEOA8744 | 6674 | SEOA8813 | 6734 | SEOA8904 | 6794 | SEOA8976 | 6854 | SEOA9064 |
| 6615 | SEOA8745 | 6675 | SEOA8814 | 6735 | SEOA8905 | 6795 | SEOA8977 | 6855 | SEOA9065 |
| 6616 | SEOA8746 | 6676 | SEOA8816 | 6736 | SEOA8906 | 6796 | SEOA8978 | 6856 | SEOA9066 |
| 6617 | SEOA8747 | 6677 | SEOA8817 | 6737 | SEOA8907 | 6797 | SEOA8979 | 6857 | SEOA9067 |
| 6618 | SEOA8748 | 6678 | SEOA8818 | 6738 | SEOA8908 | 6798 | SEOA8980 | 6858 | SEOA9068 |
| 6619 | SEOA8749 | 6679 | SEOA8819 | 6739 | SEOA8909 | 6799 | SEOA8981 | 6859 | SEOA9070 |
| 6620 | SEOA8750 | 6680 | SEOA8820 | 6740 | SEOA8910 | 6800 | SEOA8982 | 6860 | SEOA9071 |
| 6621 | SEOA8751 | 6681 | SEOA8821 | 6741 | SEOA8911 | 6801 | SEOA8983 | 6861 | SEOA9072 |
| 6622 | SEOA8752 | 6682 | SEOA8822 | 6742 | SEOA8912 | 6802 | SEOA8984 | 6862 | SEOA9074 |
| 6623 | SEOA8753 | 6683 | SEOA8823 | 6743 | SEOA8913 | 6803 | SEOA8985 | 6863 | SEOA9075 |
| 6624 | SEOA8754 | 6684 | SEOA8824 | 6744 | SEOA8914 | 6804 | SEOA8986 | 6864 | SEOA9076 |
| 6625 | SEOA8756 | 6685 | SEOA8825 | 6745 | SEOA8916 | 6805 | SEOA8987 | 6865 | SEOA9078 |
| 6626 | SEOA8757 | 6686 | SEOA8826 | 6746 | SEOA8917 | 6806 | SEOA8988 | 6866 | SEOA9079 |
| 6627 | SEOA8758 | 6687 | SEOA8827 | 6747 | SEOA8918 | 6807 | SEOA8989 | 6867 | SEOA9081 |
| 6628 | SEOA8759 | 6688 | SEOA8828 | 6748 | SEOA8919 | 6808 | SEOA8990 | 6868 | SEOA9082 |
| 6629 | SEOA8760 | 6689 | SEOA8830 | 6749 | SEOA8920 | 6809 | SEOA8991 | 6869 | SEOA9083 |
| 6630 | SEOA8761 | 6690 | SEOA8831 | 6750 | SEOA8921 | 6810 | SEOA8992 | 6870 | SEOA9084 |
| 6631 | SEOA8762 | 6691 | SEOA8832 | 6751 | SEOA8922 | 6811 | SEOA8993 | 6871 | SEOA9085 |
| 6632 | SEOA8764 | 6692 | SEOA8833 | 6752 | SEOA8923 | 6812 | SEOA8996 | 6872 | SEOA9086 |
| 6633 | SEOA8765 | 6693 | SEOA8834 | 6753 | SEOA8924 | 6813 | SEOA8997 | 6873 | SEOA9088 |
| 6634 | SEOA8766 | 6694 | SEOA8835 | 6754 | SEOA8925 | 6814 | SEOA8999 | 6874 | SEOA9089 |
| 6635 | SEOA8767 | 6695 | SEOA8836 | 6755 | SEOA8926 | 6815 | SEOA9000 | 6875 | SEOA9090 |
| 6636 | SEOA8768 | 6696 | SEOA8837 | 6756 | SEOA8927 | 6816 | SEOA9001 | 6876 | SEOA9094 |
| 6637 | SEOA8770 | 6697 | SEOA8838 | 6757 | SEOA8934 | 6817 | SEOA9003 | 6877 | SEOA9095 |
| 6638 | SEOA8771 | 6698 | SEOA8839 | 6758 | SEOA8935 | 6818 | SEOA9004 | 6878 | SEOA9096 |
| 6639 | SEOA8772 | 6699 | SEOA8840 | 6759 | seoa8936n | 6819 | SEOA9006 | 6879 | SEOA9097 |
| 6640 | SEOA8773 | 6700 | SEOA8841 | 6760 | SEOA8938 | 6820 | SEOA9007 | 6880 | SEOA9098 |
| 6641 | SEOA8774 | 6701 | SEOA8842 | 6761 | SEOA8939 | 6821 | SEOA9010 | 6881 | SEOA9099 |
| 6642 | SEOA8776 | 6702 | SEOA8844 | 6762 | SEOA8940 | 6822 | SEOA9012 | 6882 | SEOA9100 |
| 6643 | SEOA8777 | 6703 | SEOA8845 | 6763 | SEOA8943 | 6823 | SEOA9013 | 6883 | SEOA9101 |
| 6644 | SEOA8779 | 6704 | SEOA8846 | 6764 | SEOA8944 | 6824 | SEOA9014 | 6884 | SEOA9103 |
| 6645 | SEOA8780 | 6705 | SEOA8847 | 6765 | SEOA8945 | 6825 | SEOA9015 | 6885 | SEOA9104 |
| 6646 | SEOA8781 | 6706 | SEOA8848 | 6766 | SEOA8946 | 6826 | SEOA9016 | 6886 | SEOA9105 |
| 6647 | SEOA8782 | 6707 | SEOA8851 | 6767 | SEOA8947 | 6827 | SEOA9017 | 6887 | SEOA9106 |
| 6648 | SEOA8783 | 6708 | SEOA8852 | 6768 | SEOA8948 | 6828 | SEOA9018 | 6888 | SEOA9107 |
| 6649 | SEOA8784 | 6709 | SEOA8854 | 6769 | SEOA8949 | 6829 | SEOA9020 | 6889 | SEOA9108 |
| 6650 | SEOA8785 | 6710 | SEOA8856 | 6770 | SEOA8950 | 6830 | SEOA9021 | 6890 | SEOA9110 |
| 6651 | SEOA8786 | 6711 | SEOA8859 | 6771 | SEOA8951 | 6831 | SEOA9022 | 6891 | SEOA9111 |
| 6652 | SEOA8787 | 6712 | SEOA8867 | 6772 | SEOA8952 | 6832 | SEOA9023 | 6892 | SEOA9115 |
| 6653 | SEOA8788 | 6713 | SEOA8870 | 6773 | SEOA8954 | 6833 | SEOA9024 | 6893 | SEOA9117 |
| 6654 | SEOA8789 | 6714 | SEOA8873 | 6774 | SEOA8955 | 6834 | SEOA9025 | 6894 | SEOA9118 |
| 6655 | SEOA8790 | 6715 | SEOA8874 | 6775 | SEOA8956 | 6835 | SEOA9026 | 6895 | SEOA9119 |
| 6656 | SEOA8791 | 6716 | SEOA8876 | 6776 | SEOA8957 | 6836 | SEOA9027 | 6896 | SEOA9120 |
| 6657 | SEOA8792 | 6717 | SEOA8877 | 6777 | SEOA8958 | 6837 | seoa9028n | 6897 | SEOA9121 |
| 6658 | SEOA8794 | 6718 | SEOA8878 | 6778 | SEOA8959 | 6838 | SEOA9029 | 6898 | SEOA9122 |
| 6659 | SEOA8795 | 6719 | SEOA8879 | 6779 | SEOA8960 | 6839 | SEOA9030 | 6899 | SEOA9123 |
| 6660 | SEOA8796 | 6720 | SEOA8880 | 6780 | SEOA8961 | 6840 | SEOA9031 | 6900 | SEOA9124 |

Figure 6E – List of EST Sequence Names From Severe OA Cartilage cDNA Library

| | | | | | | | | | |
|---|---|---|---|---|---|---|---|---|---|
| 6901 | SEOA9125 | 6961 | SEOA9194 | 7021 | SEOA9269 | 7081 | SEOA9356 | 7141 | SEOA9432 |
| 6902 | seoa9127 | 6962 | SEOA9195 | 7022 | SEOA9270 | 7082 | SEOA9357 | 7142 | SEOA9433 |
| 6903 | SEOA9128 | 6963 | SEOA9196 | 7023 | SEOA9272 | 7083 | SEOA9359 | 7143 | SEOA9435 |
| 6904 | SEOA9129 | 6964 | SEOA9197 | 7024 | SEOA9273 | 7084 | SEOA9360 | 7144 | SEOA9438 |
| 6905 | SEOA9130 | 6965 | SEOA9199 | 7025 | SEOA9281 | 7085 | SEOA9361 | 7145 | SEOA9441 |
| 6906 | SEOA9131 | 6966 | SEOA9200 | 7026 | SEOA9282 | 7086 | SEOA9363 | 7146 | SEOA9442 |
| 6907 | SEOA9132 | 6967 | SEOA9201 | 7027 | SEOA9283 | 7087 | SEOA9364 | 7147 | SEOA9443 |
| 6908 | SEOA9133 | 6968 | SEOA9202 | 7028 | SEOA9284 | 7088 | SEOA9365 | 7148 | SEOA9444 |
| 6909 | SEOA9134 | 6969 | SEOA9203 | 7029 | SEOA9286 | 7089 | SEOA9366 | 7149 | SEOA9445 |
| 6910 | SEOA9135 | 6970 | SEOA9204 | 7030 | SEOA9287 | 7090 | SEOA9367 | 7150 | SEOA9449 |
| 6911 | SEOA9136 | 6971 | SEOA9205 | 7031 | SEOA9288 | 7091 | SEOA9368 | 7151 | SEOA9451 |
| 6912 | SEOA9137 | 6972 | SEOA9207 | 7032 | SEOA9289 | 7092 | SEOA9370 | 7152 | seoa9452 |
| 6913 | SEOA9138 | 6973 | SEOA9208 | 7033 | SEOA9291 | 7093 | SEOA9371 | 7153 | SEOA9453 |
| 6914 | SEOA9139 | 6974 | SEOA9209 | 7034 | SEOA9294 | 7094 | SEOA9372 | 7154 | SEOA9454 |
| 6915 | SEOA9140 | 6975 | SEOA9210 | 7035 | SEOA9295 | 7095 | SEOA9373 | 7155 | SEOA9455 |
| 6916 | SEOA9142 | 6976 | SEOA9211 | 7036 | SEOA9296 | 7096 | SEOA9374 | 7156 | SEOA9457 |
| 6917 | SEOA9143 | 6977 | SEOA9212 | 7037 | SEOA9297 | 7097 | SEOA9376 | 7157 | SEOA9458 |
| 6918 | SEOA9145 | 6978 | SEOA9213 | 7038 | SEOA9302 | 7098 | SEOA9377 | 7158 | SEOA9459 |
| 6919 | SEOA9146 | 6979 | SEOA9214 | 7039 | SEOA9303 | 7099 | SEOA9378 | 7159 | SEOA9460 |
| 6920 | SEOA9147 | 6980 | SEOA9215 | 7040 | SEOA9304 | 7100 | SEOA9379 | 7160 | SEOA9461 |
| 6921 | SEOA9148 | 6981 | SEOA9216 | 7041 | SEOA9307 | 7101 | SEOA9381 | 7161 | SEOA9462 |
| 6922 | SEOA9149 | 6982 | SEOA9217 | 7042 | SEOA9308 | 7102 | SEOA9383 | 7162 | SEOA9464 |
| 6923 | SEOA9150 | 6983 | SEOA9218 | 7043 | SEOA9311 | 7103 | SEOA9385 | 7163 | SEOA9465 |
| 6924 | SEOA9151 | 6984 | SEOA9219 | 7044 | SEOA9312 | 7104 | SEOA9387 | 7164 | SEOA9467 |
| 6925 | SEOA9152 | 6985 | SEOA9220 | 7045 | SEOA9313 | 7105 | SEOA9388 | 7165 | SEOA9469 |
| 6926 | SEOA9153 | 6986 | SEOA9221 | 7046 | SEOA9315 | 7106 | SEOA9389 | 7166 | SEOA9470 |
| 6927 | SEOA9154 | 6987 | SEOA9223 | 7047 | SEOA9316 | 7107 | SEOA9390 | 7167 | SEOA9471 |
| 6928 | SEOA9155 | 6988 | SEOA9224 | 7048 | SEOA9317 | 7108 | SEOA9391 | 7168 | SEOA9473 |
| 6929 | SEOA9156 | 6989 | SEOA9225 | 7049 | SEOA9319 | 7109 | SEOA9392 | 7169 | seoa9474n |
| 6930 | SEOA9157 | 6990 | SEOA9226 | 7050 | SEOA9320 | 7110 | SEOA9393 | 7170 | SEOA9476 |
| 6931 | SEOA9158 | 6991 | SEOA9228 | 7051 | SEOA9321 | 7111 | SEOA9395 | 7171 | SEOA9477 |
| 6932 | SEOA9159 | 6992 | SEOA9229 | 7052 | SEOA9322 | 7112 | SEOA9397 | 7172 | SEOA9478 |
| 6933 | SEOA9160 | 6993 | SEOA9230 | 7053 | SEOA9323 | 7113 | seoa9398 | 7173 | SEOA9479 |
| 6934 | SEOA9161 | 6994 | seoa9232n | 7054 | SEOA9324 | 7114 | SEOA9399 | 7174 | SEOA9480 |
| 6935 | SEOA9162 | 6995 | SEOA9233 | 7055 | SEOA9325 | 7115 | SEOA9400 | 7175 | SEOA9482 |
| 6936 | SEOA9163 | 6996 | SEOA9234 | 7056 | SEOA9326 | 7116 | SEOA9401 | 7176 | SEOA9483 |
| 6937 | seoa9164n | 6997 | SEOA9235 | 7057 | SEOA9327 | 7117 | SEOA9403 | 7177 | SEOA9484 |
| 6938 | SEOA9165 | 6998 | SEOA9236 | 7058 | SEOA9328 | 7118 | SEOA9404 | 7178 | SEOA9485 |
| 6939 | SEOA9167 | 6999 | SEOA9237 | 7059 | SEOA9331 | 7119 | SEOA9405 | 7179 | SEOA9486 |
| 6940 | SEOA9168 | 7000 | SEOA9240 | 7060 | SEOA9332 | 7120 | SEOA9406 | 7180 | SEOA9487 |
| 6941 | SEOA9169 | 7001 | SEOA9241 | 7061 | SEOA9333 | 7121 | SEOA9407 | 7181 | SEOA9488 |
| 6942 | SEOA9170 | 7002 | SEOA9242 | 7062 | SEOA9334 | 7122 | SEOA9408 | 7182 | SEOA9491 |
| 6943 | SEOA9171 | 7003 | seoa9243n | 7063 | SEOA9335 | 7123 | SEOA9409 | 7183 | SEOA9492 |
| 6944 | SEOA9172 | 7004 | SEOA9245 | 7064 | SEOA9336 | 7124 | SEOA9414 | 7184 | SEOA9493 |
| 6945 | seoa9173 | 7005 | SEOA9246 | 7065 | SEOA9337 | 7125 | seoa9415n | 7185 | SEOA9494 |
| 6946 | SEOA9174 | 7006 | SEOA9247 | 7066 | SEOA9338 | 7126 | SEOA9416 | 7186 | SEOA9495 |
| 6947 | SEOA9175 | 7007 | SEOA9248 | 7067 | SEOA9339 | 7127 | SEOA9417 | 7187 | SEOA9499 |
| 6948 | SEOA9176 | 7008 | SEOA9249 | 7068 | SEOA9340 | 7128 | SEOA9418 | 7188 | SEOA9500 |
| 6949 | SEOA9181 | 7009 | SEOA9250 | 7069 | SEOA9341 | 7129 | SEOA9419 | 7189 | SEOA9501 |
| 6950 | SEOA9182 | 7010 | SEOA9251 | 7070 | SEOA9342 | 7130 | SEOA9420 | 7190 | SEOA9502 |
| 6951 | SEOA9183 | 7011 | SEOA9252 | 7071 | SEOA9343 | 7131 | SEOA9421 | 7191 | SEOA9503 |
| 6952 | SEOA9184 | 7012 | SEOA9253 | 7072 | SEOA9344 | 7132 | SEOA9422 | 7192 | SEOA9504 |
| 6953 | SEOA9185 | 7013 | SEOA9254 | 7073 | SEOA9345 | 7133 | SEOA9423 | 7193 | SEOA9505 |
| 6954 | SEOA9186 | 7014 | SEOA9256 | 7074 | SEOA9346 | 7134 | SEOA9424 | 7194 | SEOA9507 |
| 6955 | SEOA9187 | 7015 | SEOA9257 | 7075 | SEOA9348 | 7135 | SEOA9425 | 7195 | SEOA9508 |
| 6956 | SEOA9188 | 7016 | SEOA9258 | 7076 | SEOA9349 | 7136 | SEOA9427 | 7196 | SEOA9509 |
| 6957 | SEOA9190 | 7017 | SEOA9262 | 7077 | SEOA9350 | 7137 | SEOA9428 | 7197 | SEOA9510 |
| 6958 | SEOA9191 | 7018 | SEOA9265 | 7078 | SEOA9351 | 7138 | SEOA9429 | 7198 | SEOA9511 |
| 6959 | SEOA9192 | 7019 | SEOA9267 | 7079 | SEOA9353 | 7139 | SEOA9430 | 7199 | SEOA9512 |
| 6960 | SEOA9193 | 7020 | SEOA9268 | 7080 | SEOA9355 | 7140 | SEOA9431 | 7200 | SEOA9513 |

Figure 6E – List of EST Sequence Names From Severe OA Cartilage cDNA Library

| | | | | | | | | | |
|---|---|---|---|---|---|---|---|---|---|
| 7201 | SEOA9515 | 7261 | SEOA9592 | 7321 | SEOA9665 | 7381 | SEOA9740 | 7441 | SEOA9813 |
| 7202 | SEOA9516 | 7262 | SEOA9593 | 7322 | SEOA9666 | 7382 | SEOA9742 | 7442 | SEOA9814 |
| 7203 | SEOA9517 | 7263 | SEOA9595 | 7323 | SEOA9667 | 7383 | SEOA9743 | 7443 | SEOA9817 |
| 7204 | SEOA9518 | 7264 | SEOA9598 | 7324 | SEOA9668 | 7384 | SEOA9744 | 7444 | SEOA9818 |
| 7205 | SEOA9519 | 7265 | SEOA9599 | 7325 | SEOA9670 | 7385 | SEOA9747 | 7445 | SEOA9819 |
| 7206 | SEOA9522 | 7266 | SEOA9601 | 7326 | SEOA9671 | 7386 | SEOA9748 | 7446 | SEOA9820 |
| 7207 | SEOA9523 | 7267 | SEOA9603 | 7327 | SEOA9672 | 7387 | SEOA9750 | 7447 | SEOA9821 |
| 7208 | SEOA9524 | 7268 | SEOA9605 | 7328 | SEOA9673 | 7388 | SEOA9751 | 7448 | SEOA9822 |
| 7209 | SEOA9525 | 7269 | SEOA9606 | 7329 | SEOA9674 | 7389 | SEOA9752 | 7449 | SEOA9823 |
| 7210 | SEOA9526 | 7270 | SEOA9609 | 7330 | SEOA9675 | 7390 | SEOA9753 | 7450 | SEOA9824 |
| 7211 | SEOA9528 | 7271 | SEOA9610 | 7331 | SEOA9676 | 7391 | SEOA9754 | 7451 | SEOA9825 |
| 7212 | SEOA9529 | 7272 | SEOA9611 | 7332 | SEOA9678 | 7392 | SEOA9755 | 7452 | SEOA9826 |
| 7213 | SEOA9532 | 7273 | SEOA9612 | 7333 | SEOA9679 | 7393 | SEOA9756 | 7453 | SEOA9827 |
| 7214 | SEOA9534 | 7274 | SEOA9613 | 7334 | SEOA9680 | 7394 | SEOA9757 | 7454 | SEOA9828 |
| 7215 | SEOA9535 | 7275 | SEOA9614 | 7335 | SEOA9682 | 7395 | SEOA9758 | 7455 | SEOA9829 |
| 7216 | SEOA9537 | 7276 | SEOA9615 | 7336 | SEOA9683 | 7396 | SEOA9759 | 7456 | seoa9830n |
| 7217 | SEOA9538 | 7277 | SEOA9616 | 7337 | SEOA9684 | 7397 | SEOA9760 | 7457 | SEOA9831 |
| 7218 | SEOA9539 | 7278 | SEOA9617 | 7338 | SEOA9688 | 7398 | SEOA9761 | 7458 | SEOA9832 |
| 7219 | SEOA9541 | 7279 | SEOA9618 | 7339 | SEOA9689 | 7399 | SEOA9762 | 7459 | SEOA9833 |
| 7220 | SEOA9545 | 7280 | SEOA9619 | 7340 | SEOA9690 | 7400 | SEOA9764 | 7460 | SEOA9834 |
| 7221 | SEOA9546 | 7281 | SEOA9620 | 7341 | SEOA9691 | 7401 | SEOA9765 | 7461 | SEOA9835 |
| 7222 | SEOA9547 | 7282 | seoa9621n | 7342 | SEOA9692 | 7402 | SEOA9766 | 7462 | SEOA9836 |
| 7223 | SEOA9548 | 7283 | SEOA9623 | 7343 | SEOA9693 | 7403 | SEOA9767 | 7463 | SEOA9837 |
| 7224 | SEOA9549 | 7284 | SEOA9624 | 7344 | SEOA9694 | 7404 | SEOA9768 | 7464 | SEOA9838 |
| 7225 | SEOA9552 | 7285 | SEOA9625 | 7345 | SEOA9695 | 7405 | SEOA9769 | 7465 | SEOA9839 |
| 7226 | SEOA9553 | 7286 | SEOA9626 | 7346 | SEOA9696 | 7406 | SEOA9770 | 7466 | SEOA9840 |
| 7227 | SEOA9554 | 7287 | SEOA9627 | 7347 | SEOA9697 | 7407 | SEOA9771 | 7467 | SEOA9841 |
| 7228 | SEOA9555 | 7288 | SEOA9628 | 7348 | SEOA9699 | 7408 | SEOA9772 | 7468 | SEOA9843 |
| 7229 | SEOA9556 | 7289 | SEOA9629 | 7349 | SEOA9700 | 7409 | SEOA9773 | 7469 | SEOA9844 |
| 7230 | SEOA9557 | 7290 | SEOA9630 | 7350 | SEOA9701 | 7410 | SEOA9775 | 7470 | SEOA9847 |
| 7231 | SEOA9558 | 7291 | SEOA9631 | 7351 | SEOA9702 | 7411 | SEOA9777 | 7471 | SEOA9848 |
| 7232 | SEOA9559 | 7292 | SEOA9632 | 7352 | SEOA9703 | 7412 | SEOA9778 | 7472 | SEOA9849 |
| 7233 | SEOA9560 | 7293 | SEOA9633 | 7353 | SEOA9704 | 7413 | SEOA9779 | 7473 | SEOA9850 |
| 7234 | SEOA9561 | 7294 | SEOA9634 | 7354 | SEOA9705 | 7414 | SEOA9780 | 7474 | SEOA9851 |
| 7235 | SEOA9562 | 7295 | SEOA9635 | 7355 | SEOA9706 | 7415 | SEOA9781 | 7475 | SEOA9852 |
| 7236 | SEOA9563 | 7296 | SEOA9636 | 7356 | SEOA9707 | 7416 | SEOA9783 | 7476 | SEOA9853 |
| 7237 | SEOA9565 | 7297 | SEOA9637 | 7357 | SEOA9709 | 7417 | SEOA9784 | 7477 | SEOA9854 |
| 7238 | SEOA9566 | 7298 | SEOA9638 | 7358 | SEOA9710 | 7418 | SEOA9785 | 7478 | SEOA9855 |
| 7239 | SEOA9567 | 7299 | SEOA9639 | 7359 | SEOA9711 | 7419 | SEOA9788 | 7479 | SEOA9856 |
| 7240 | SEOA9568 | 7300 | SEOA9640 | 7360 | SEOA9712 | 7420 | SEOA9789 | 7480 | SEOA9858 |
| 7241 | SEOA9570 | 7301 | SEOA9642 | 7361 | seoa9715n | 7421 | SEOA9790 | 7481 | SEOA9861 |
| 7242 | SEOA9571 | 7302 | SEOA9643 | 7362 | SEOA9716 | 7422 | SEOA9791 | 7482 | SEOA9862 |
| 7243 | SEOA9572 | 7303 | SEOA9644 | 7363 | SEOA9718 | 7423 | SEOA9792 | 7483 | SEOA9864 |
| 7244 | SEOA9573 | 7304 | SEOA9645 | 7364 | SEOA9719 | 7424 | SEOA9793 | 7484 | SEOA9867 |
| 7245 | SEOA9574 | 7305 | SEOA9647 | 7365 | SEOA9720 | 7425 | SEOA9794 | 7485 | SEOA9868 |
| 7246 | SEOA9575 | 7306 | SEOA9649 | 7366 | SEOA9722 | 7426 | SEOA9795 | 7486 | SEOA9869 |
| 7247 | SEOA9576 | 7307 | SEOA9650 | 7367 | SEOA9723 | 7427 | SEOA9796 | 7487 | SEOA9870 |
| 7248 | SEOA9577 | 7308 | SEOA9651 | 7368 | SEOA9724 | 7428 | SEOA9797 | 7488 | SEOA9871 |
| 7249 | SEOA9578 | 7309 | SEOA9652 | 7369 | SEOA9725 | 7429 | SEOA9798 | 7489 | SEOA9872 |
| 7250 | SEOA9580 | 7310 | SEOA9653 | 7370 | SEOA9726 | 7430 | SEOA9799 | 7490 | SEOA9873 |
| 7251 | SEOA9581 | 7311 | SEOA9654 | 7371 | SEOA9728 | 7431 | SEOA9800 | 7491 | SEOA9874 |
| 7252 | SEOA9582 | 7312 | SEOA9655 | 7372 | SEOA9729 | 7432 | SEOA9801 | 7492 | SEOA9875 |
| 7253 | SEOA9583 | 7313 | SEOA9656 | 7373 | SEOA9731 | 7433 | SEOA9802 | 7493 | SEOA9876 |
| 7254 | SEOA9584 | 7314 | SEOA9657 | 7374 | SEOA9732 | 7434 | SEOA9803 | 7494 | SEOA9877 |
| 7255 | SEOA9585 | 7315 | SEOA9658 | 7375 | SEOA9733 | 7435 | SEOA9804 | 7495 | SEOA9878 |
| 7256 | SEOA9586 | 7316 | SEOA9659 | 7376 | SEOA9734 | 7436 | SEOA9805 | 7496 | SEOA9879 |
| 7257 | SEOA9587 | 7317 | SEOA9660 | 7377 | SEOA9735 | 7437 | SEOA9809 | 7497 | SEOA9880 |
| 7258 | SEOA9589 | 7318 | SEOA9661 | 7378 | SEOA9736 | 7438 | SEOA9810 | 7498 | SEOA9881 |
| 7259 | SEOA9590 | 7319 | seoa9663n | 7379 | SEOA9738 | 7439 | SEOA9811 | 7499 | SEOA9882 |
| 7260 | SEOA9591 | 7320 | SEOA9664 | 7380 | SEOA9739 | 7440 | SEOA9812 | 7500 | SEOA9883 |

Figure 6E – List of EST Sequence Names From Severe OA Cartilage cDNA Library

| | | | | | | | | | |
|---|---|---|---|---|---|---|---|---|---|
| 7501 | SEOA9884 | 7561 | SEOA9955 | 7621 | SEOB0042 | 7681 | SEOB0112 | 7741 | SEOB0185 |
| 7502 | SEOA9885 | 7562 | SEOA9956 | 7622 | SEOB0043 | 7682 | SEOB0113 | 7742 | SEOB0186 |
| 7503 | SEOA9886 | 7563 | SEOA9957 | 7623 | SEOB0044 | 7683 | SEOB0114 | 7743 | SEOB0187 |
| 7504 | SEOA9887 | 7564 | SEOA9958 | 7624 | SEOB0045 | 7684 | SEOB0115 | 7744 | SEOB0188 |
| 7505 | SEOA9888 | 7565 | SEOA9959 | 7625 | SEOB0046 | 7685 | SEOB0116 | 7745 | SEOB0189 |
| 7506 | SEOA9889 | 7566 | SEOA9977 | 7626 | SEOB0047 | 7686 | SEOB0117 | 7746 | SEOB0190 |
| 7507 | SEOA9890 | 7567 | SEOA9978 | 7627 | SEOB0049 | 7687 | SEOB0118 | 7747 | SEOB0191 |
| 7508 | SEOA9891 | 7568 | SEOA9980 | 7628 | SEOB0050 | 7688 | SEOB0119 | 7748 | SEOB0192 |
| 7509 | SEOA9892 | 7569 | SEOA9981 | 7629 | seob0051n | 7689 | SEOB0121 | 7749 | SEOB0193 |
| 7510 | SEOA9893 | 7570 | SEOA9982 | 7630 | SEOB0052 | 7690 | SEOB0122 | 7750 | SEOB0194 |
| 7511 | SEOA9895 | 7571 | SEOA9983 | 7631 | SEOB0055 | 7691 | SEOB0123 | 7751 | SEOB0195 |
| 7512 | SEOA9896 | 7572 | SEOA9984 | 7632 | SEOB0056 | 7692 | SEOB0124 | 7752 | SEOB0196 |
| 7513 | SEOA9897 | 7573 | SEOA9985 | 7633 | SEOB0057 | 7693 | SEOB0125 | 7753 | SEOB0198 |
| 7514 | SEOA9898 | 7574 | SEOA9986 | 7634 | SEOB0058 | 7694 | SEOB0126 | 7754 | SEOB0200 |
| 7515 | SEOA9900 | 7575 | SEOA9987 | 7635 | SEOB0059 | 7695 | SEOB0127 | 7755 | SEOB0201 |
| 7516 | SEOA9901 | 7576 | SEOA9988 | 7636 | SEOB0060 | 7696 | SEOB0128 | 7756 | SEOB0202 |
| 7517 | SEOA9902 | 7577 | SEOA9989 | 7637 | SEOB0061 | 7697 | SEOB0129 | 7757 | SEOB0203 |
| 7518 | SEOA9905 | 7578 | SEOA9990 | 7638 | SEOB0062 | 7698 | SEOB0130 | 7758 | SEOB0204 |
| 7519 | SEOA9907 | 7579 | SEOA9991 | 7639 | SEOB0063 | 7699 | SEOB0132 | 7759 | SEOB0205 |
| 7520 | SEOA9908 | 7580 | SEOA9992 | 7640 | SEOB0065 | 7700 | SEOB0133 | 7760 | SEOB0206 |
| 7521 | SEOA9909 | 7581 | SEOA9993 | 7641 | SEOB0066 | 7701 | SEOB0136 | 7761 | SEOB0207 |
| 7522 | SEOA9910 | 7582 | SEOA9995 | 7642 | SEOB0067 | 7702 | SEOB0137 | 7762 | seob0208n |
| 7523 | SEOA9912 | 7583 | SEOA9997 | 7643 | SEOB0068 | 7703 | SEOB0138 | 7763 | SEOB0209 |
| 7524 | SEOA9913 | 7584 | SEOA9998 | 7644 | SEOB0069 | 7704 | SEOB0139 | 7764 | SEOB0210 |
| 7525 | SEOA9914 | 7585 | SEOB0001 | 7645 | SEOB0070 | 7705 | SEOB0140 | 7765 | SEOB0211 |
| 7526 | SEOA9915 | 7586 | SEOB0002 | 7646 | SEOB0071 | 7706 | SEOB0141 | 7766 | SEOB0212 |
| 7527 | SEOA9916 | 7587 | SEOB0003 | 7647 | seob0073 | 7707 | SEOB0143 | 7767 | SEOB0213 |
| 7528 | SEOA9917 | 7588 | SEOB0004 | 7648 | SEOB0075 | 7708 | SEOB0144 | 7768 | SEOB0214 |
| 7529 | SEOA9918 | 7589 | SEOB0005 | 7649 | SEOB0076 | 7709 | SEOB0147 | 7769 | seob0215n |
| 7530 | SEOA9919 | 7590 | SEOB0006 | 7650 | SEOB0077 | 7710 | SEOB0149 | 7770 | SEOB0216 |
| 7531 | SEOA9920 | 7591 | SEOB0007 | 7651 | SEOB0079 | 7711 | SEOB0150 | 7771 | SEOB0218 |
| 7532 | SEOA9921 | 7592 | SEOB0008 | 7652 | SEOB0080 | 7712 | SEOB0151 | 7772 | SEOB0219 |
| 7533 | SEOA9922 | 7593 | SEOB0009 | 7653 | SEOB0081 | 7713 | SEOB0152 | 7773 | SEOB0220 |
| 7534 | SEOA9923 | 7594 | SEOB0010 | 7654 | SEOB0082 | 7714 | SEOB0153 | 7774 | SEOB0221 |
| 7535 | SEOA9924 | 7595 | SEOB0011 | 7655 | SEOB0084 | 7715 | SEOB0154 | 7775 | SEOB0222 |
| 7536 | SEOA9925 | 7596 | SEOB0012 | 7656 | SEOB0085 | 7716 | SEOB0155 | 7776 | SEOB0223 |
| 7537 | SEOA9926 | 7597 | SEOB0013 | 7657 | SEOB0086 | 7717 | SEOB0156 | 7777 | SEOB0224 |
| 7538 | SEOA9927 | 7598 | SEOB0014 | 7658 | SEOB0087 | 7718 | SEOB0157 | 7778 | SEOB0225 |
| 7539 | SEOA9928 | 7599 | SEOB0015 | 7659 | SEOB0088 | 7719 | SEOB0158 | 7779 | SEOB0226 |
| 7540 | SEOA9929 | 7600 | SEOB0016 | 7660 | SEOB0089 | 7720 | SEOB0159 | 7780 | SEOB0227 |
| 7541 | SEOA9930 | 7601 | SEOB0017 | 7661 | SEOB0090 | 7721 | SEOB0160 | 7781 | SEOB0228 |
| 7542 | SEOA9931 | 7602 | SEOB0018 | 7662 | SEOB0092 | 7722 | SEOB0161 | 7782 | SEOB0229 |
| 7543 | SEOA9932 | 7603 | SEOB0019 | 7663 | SEOB0093 | 7723 | SEOB0162 | 7783 | SEOB0230 |
| 7544 | SEOA9933 | 7604 | SEOB0020 | 7664 | SEOB0094 | 7724 | SEOB0163 | 7784 | SEOB0231 |
| 7545 | SEOA9934 | 7605 | seob0022n | 7665 | SEOB0095 | 7725 | SEOB0164 | 7785 | SEOB0232 |
| 7546 | SEOA9935 | 7606 | SEOB0023 | 7666 | SEOB0096 | 7726 | SEOB0165 | 7786 | SEOB0233 |
| 7547 | SEOA9936 | 7607 | SEOB0025 | 7667 | SEOB0097 | 7727 | SEOB0166 | 7787 | SEOB0234 |
| 7548 | SEOA9937 | 7608 | SEOB0026 | 7668 | SEOB0098 | 7728 | SEOB0167 | 7788 | SEOB0235 |
| 7549 | SEOA9938 | 7609 | SEOB0027 | 7669 | SEOB0099 | 7729 | SEOB0168 | 7789 | SEOB0236 |
| 7550 | SEOA9940 | 7610 | SEOB0029 | 7670 | SEOB0100 | 7730 | SEOB0169 | 7790 | SEOB0237 |
| 7551 | SEOA9941 | 7611 | SEOB0030 | 7671 | SEOB0101 | 7731 | SEOB0171 | 7791 | SEOB0238 |
| 7552 | SEOA9943 | 7612 | SEOB0031 | 7672 | SEOB0102 | 7732 | SEOB0173 | 7792 | SEOB0239 |
| 7553 | SEOA9944 | 7613 | SEOB0033 | 7673 | SEOB0103 | 7733 | SEOB0174 | 7793 | SEOB0240 |
| 7554 | SEOA9945 | 7614 | SEOB0034 | 7674 | SEOB0105 | 7734 | SEOB0175 | 7794 | SEOB0241 |
| 7555 | SEOA9946 | 7615 | SEOB0035 | 7675 | SEOB0106 | 7735 | SEOB0176 | 7795 | SEOB0242 |
| 7556 | SEOA9947 | 7616 | SEOB0036 | 7676 | SEOB0107 | 7736 | seob0177 | 7796 | SEOB0243 |
| 7557 | SEOA9948 | 7617 | SEOB0037 | 7677 | SEOB0108 | 7737 | SEOB0178 | 7797 | SEOB0247 |
| 7558 | SEOA9949 | 7618 | SEOB0038 | 7678 | SEOB0109 | 7738 | SEOB0180 | 7798 | SEOB0248 |
| 7559 | SEOA9950 | 7619 | SEOB0039 | 7679 | SEOB0110 | 7739 | SEOB0182 | 7799 | SEOB0249 |
| 7560 | SEOA9951 | 7620 | SEOB0041 | 7680 | SEOB0111 | 7740 | SEOB0184 | 7800 | SEOB0250 |

Figure 6E – List of EST Sequence Names From Severe OA Cartilage cDNA Library

| | | | | | | | | | |
|---|---|---|---|---|---|---|---|---|---|
| 7801 | SEOB0251 | 7861 | SEOB0320 | 7921 | SEOB0396 | 7981 | SEOB0478 | 8041 | SEOB0559 |
| 7802 | SEOB0253 | 7862 | SEOB0321 | 7922 | SEOB0398 | 7982 | SEOB0482 | 8042 | SEOB0561 |
| 7803 | SEOB0254 | 7863 | SEOB0322 | 7923 | SEOB0399 | 7983 | SEOB0483 | 8043 | SEOB0562 |
| 7804 | SEOB0255 | 7864 | SEOB0323 | 7924 | SEOB0400 | 7984 | SEOB0484 | 8044 | SEOB0563 |
| 7805 | SEOB0256 | 7865 | SEOB0324 | 7925 | SEOB0402 | 7985 | SEOB0485 | 8045 | SEOB0564 |
| 7806 | SEOB0257 | 7866 | SEOB0325 | 7926 | SEOB0403 | 7986 | SEOB0486 | 8046 | SEOB0565 |
| 7807 | SEOB0258 | 7867 | SEOB0326 | 7927 | SEOB0404 | 7987 | SEOB0487 | 8047 | SEOB0566 |
| 7808 | SEOB0259 | 7868 | SEOB0328 | 7928 | SEOB0405 | 7988 | SEOB0490 | 8048 | SEOB0568 |
| 7809 | SEOB0260 | 7869 | SEOB0329 | 7929 | SEOB0406 | 7989 | SEOB0491 | 8049 | SEOB0569 |
| 7810 | SEOB0261 | 7870 | SEOB0330 | 7930 | SEOB0407 | 7990 | SEOB0496 | 8050 | SEOB0570 |
| 7811 | SEOB0262 | 7871 | seob0331n | 7931 | SEOB0408 | 7991 | SEOB0497 | 8051 | SEOB0571 |
| 7812 | SEOB0263 | 7872 | SEOB0334 | 7932 | SEOB0409 | 7992 | SEOB0499 | 8052 | SEOB0572 |
| 7813 | SEOB0264 | 7873 | SEOB0335 | 7933 | SEOB0410 | 7993 | SEOB0501 | 8053 | SEOB0574 |
| 7814 | SEOB0265 | 7874 | SEOB0336 | 7934 | SEOB0411 | 7994 | SEOB0502 | 8054 | SEOB0575 |
| 7815 | SEOB0266 | 7875 | SEOB0338 | 7935 | SEOB0412 | 7995 | SEOB0504 | 8055 | SEOB0577 |
| 7816 | SEOB0267 | 7876 | SEOB0339 | 7936 | SEOB0413 | 7996 | SEOB0506 | 8056 | SEOB0578 |
| 7817 | SEOB0268 | 7877 | SEOB0340 | 7937 | SEOB0414 | 7997 | SEOB0507 | 8057 | SEOB0579 |
| 7818 | SEOB0269 | 7878 | SEOB0342 | 7938 | SEOB0415 | 7998 | SEOB0508 | 8058 | SEOB0584 |
| 7819 | SEOB0270 | 7879 | SEOB0343 | 7939 | SEOB0417 | 7999 | SEOB0509 | 8059 | SEOB0585 |
| 7820 | SEOB0271 | 7880 | SEOB0344 | 7940 | SEOB0418 | 8000 | SEOB0510 | 8060 | SEOB0586 |
| 7821 | SEOB0272 | 7881 | SEOB0345 | 7941 | SEOB0419 | 8001 | SEOB0511 | 8061 | SEOB0587 |
| 7822 | SEOB0273 | 7882 | SEOB0346 | 7942 | SEOB0420 | 8002 | SEOB0512 | 8062 | SEOB0590 |
| 7823 | SEOB0274 | 7883 | SEOB0347 | 7943 | SEOB0421 | 8003 | SEOB0513 | 8063 | SEOB0592 |
| 7824 | SEOB0275 | 7884 | SEOB0349 | 7944 | SEOB0422 | 8004 | SEOB0514 | 8064 | SEOB0593 |
| 7825 | SEOB0277 | 7885 | SEOB0350 | 7945 | SEOB0423 | 8005 | SEOB0516 | 8065 | SEOB0595 |
| 7826 | SEOB0278 | 7886 | SEOB0351 | 7946 | SEOB0424 | 8006 | SEOB0517 | 8066 | SEOB0596 |
| 7827 | SEOB0279 | 7887 | SEOB0352 | 7947 | SEOB0425 | 8007 | SEOB0519 | 8067 | SEOB0598 |
| 7828 | SEOB0281 | 7888 | SEOB0353 | 7948 | SEOB0426 | 8008 | SEOB0520 | 8068 | SEOB0599 |
| 7829 | SEOB0282 | 7889 | SEOB0355 | 7949 | SEOB0429 | 8009 | SEOB0521 | 8069 | SEOB0600 |
| 7830 | SEOB0283 | 7890 | SEOB0357 | 7950 | SEOB0431 | 8010 | SEOB0522 | 8070 | SEOB0601 |
| 7831 | SEOB0284 | 7891 | SEOB0360 | 7951 | SEOB0433 | 8011 | SEOB0523 | 8071 | SEOB0604 |
| 7832 | SEOB0285 | 7892 | SEOB0361 | 7952 | SEOB0434 | 8012 | SEOB0524 | 8072 | SEOB0605 |
| 7833 | SEOB0286 | 7893 | SEOB0362 | 7953 | SEOB0435 | 8013 | SEOB0526 | 8073 | SEOB0606 |
| 7834 | SEOB0287 | 7894 | SEOB0363 | 7954 | SEOB0437 | 8014 | SEOB0527 | 8074 | SEOB0607 |
| 7835 | SEOB0288 | 7895 | SEOB0364 | 7955 | SEOB0438 | 8015 | SEOB0528 | 8075 | SEOB0608 |
| 7836 | SEOB0289 | 7896 | SEOB0365 | 7956 | SEOB0439 | 8016 | SEOB0529 | 8076 | SEOB0609 |
| 7837 | seob0290n | 7897 | SEOB0367 | 7957 | SEOB0440 | 8017 | SEOB0530 | 8077 | SEOB0610 |
| 7838 | SEOB0291 | 7898 | SEOB0368 | 7958 | SEOB0441 | 8018 | SEOB0531 | 8078 | SEOB0611 |
| 7839 | SEOB0293 | 7899 | SEOB0369 | 7959 | SEOB0442 | 8019 | SEOB0532 | 8079 | SEOB0612 |
| 7840 | SEOB0294 | 7900 | SEOB0370 | 7960 | SEOB0446 | 8020 | SEOB0533 | 8080 | SEOB0615 |
| 7841 | SEOB0295 | 7901 | SEOB0371 | 7961 | SEOB0447 | 8021 | SEOB0534 | 8081 | SEOB0617 |
| 7842 | SEOB0296 | 7902 | SEOB0372 | 7962 | SEOB0449 | 8022 | SEOB0535 | 8082 | SEOB0618 |
| 7843 | SEOB0298 | 7903 | SEOB0373 | 7963 | SEOB0450 | 8023 | SEOB0536 | 8083 | SEOB0621 |
| 7844 | SEOB0299 | 7904 | SEOB0374 | 7964 | SEOB0452 | 8024 | SEOB0537 | 8084 | SEOB0622 |
| 7845 | SEOB0300 | 7905 | SEOB0375 | 7965 | SEOB0453 | 8025 | SEOB0538 | 8085 | SEOB0623 |
| 7846 | SEOB0301 | 7906 | SEOB0376 | 7966 | SEOB0456 | 8026 | SEOB0539 | 8086 | SEOB0624 |
| 7847 | SEOB0302 | 7907 | SEOB0378 | 7967 | SEOB0458 | 8027 | SEOB0540 | 8087 | SEOB0625 |
| 7848 | SEOB0303 | 7908 | SEOB0379 | 7968 | SEOB0459 | 8028 | SEOB0541 | 8088 | SEOB0627a |
| 7849 | SEOB0304 | 7909 | SEOB0380 | 7969 | SEOB0461 | 8029 | SEOB0543 | 8089 | SEOB0628a |
| 7850 | SEOB0307 | 7910 | SEOB0381 | 7970 | SEOB0462 | 8030 | SEOB0546 | 8090 | SEOB0629a |
| 7851 | SEOB0308 | 7911 | SEOB0382 | 7971 | SEOB0464 | 8031 | SEOB0547 | 8091 | SEOB0630a |
| 7852 | SEOB0309 | 7912 | SEOB0385 | 7972 | SEOB0465 | 8032 | SEOB0548 | 8092 | SEOB0631a |
| 7853 | SEOB0310 | 7913 | SEOB0386 | 7973 | SEOB0466 | 8033 | SEOB0549 | 8093 | SEOB0632a |
| 7854 | SEOB0312 | 7914 | SEOB0387 | 7974 | SEOB0467 | 8034 | SEOB0550 | 8094 | SEOB0633a |
| 7855 | SEOB0313 | 7915 | SEOB0389 | 7975 | SEOB0469 | 8035 | SEOB0551 | 8095 | SEOB0636a |
| 7856 | SEOB0314 | 7916 | SEOB0390 | 7976 | SEOB0471 | 8036 | SEOB0553 | 8096 | SEOB0637a |
| 7857 | SEOB0315 | 7917 | SEOB0392 | 7977 | SEOB0474 | 8037 | SEOB0554 | 8097 | SEOB0639a |
| 7858 | SEOB0317 | 7918 | SEOB0393 | 7978 | SEOB0475 | 8038 | SEOB0555 | 8098 | SEOB0641a |
| 7859 | SEOB0318 | 7919 | SEOB0394 | 7979 | SEOB0476 | 8039 | SEOB0556 | 8099 | SEOB0643a |
| 7860 | SEOB0319 | 7920 | SEOB0395 | 7980 | SEOB0477 | 8040 | SEOB0558 | 8100 | SEOB0646a |

Figure 6E – List of EST Sequence Names From Severe OA Cartilage cDNA Library

| | | | | | | | | | |
|---|---|---|---|---|---|---|---|---|---|
| 8101 | SEOB0648a | 8161 | SEOB0716a | 8221 | SEOB0797 | 8281 | SEOB0875a | 8341 | SEOB0959 |
| 8102 | SEOB0649a | 8162 | SEOB0717a | 8222 | SEOB0803 | 8282 | SEOB0876a | 8342 | SEOB0962 |
| 8103 | SEOB0650a | 8163 | SEOB0721a | 8223 | SEOB0804 | 8283 | SEOB0878a | 8343 | seob0963n |
| 8104 | SEOB0651a | 8164 | SEOB0723 | 8224 | SEOB0808a | 8284 | SEOB0879a | 8344 | SEOB0964 |
| 8105 | seob0652an | 8165 | SEOB0725 | 8225 | SEOB0809 | 8285 | SEOB0880a | 8345 | SEOB0965 |
| 8106 | SEOB0654a | 8166 | SEOB0726 | 8226 | SEOB0810 | 8286 | SEOB0882a | 8346 | SEOB0967 |
| 8107 | SEOB0655a | 8167 | SEOB0727 | 8227 | seob0811n | 8287 | SEOB0883a | 8347 | SEOB0968 |
| 8108 | SEOB0656a | 8168 | SEOB0728 | 8228 | SEOB0812 | 8288 | SEOB0884a | 8348 | SEOB0970 |
| 8109 | SEOB0657a | 8169 | SEOB0729 | 8229 | SEOB0813 | 8289 | SEOB0885a | 8349 | SEOB0971 |
| 8110 | SEOB0658a | 8170 | SEOB0731 | 8230 | SEOB0814 | 8290 | SEOB0886a | 8350 | SEOB0972 |
| 8111 | SEOB0659a | 8171 | SEOB0732 | 8231 | SEOB0815 | 8291 | SEOB0888a | 8351 | SEOB0973 |
| 8112 | SEOB0660a | 8172 | SEOB0733 | 8232 | seob0816n | 8292 | SEOB0889a | 8352 | SEOB0974 |
| 8113 | SEOB0662a | 8173 | SEOB0735 | 8233 | SEOB0817 | 8293 | SEOB0891a | 8353 | SEOB0975 |
| 8114 | SEOB0663a | 8174 | SEOB0736 | 8234 | SEOB0818a | 8294 | SEOB0892a | 8354 | SEOB0976 |
| 8115 | SEOB0664a | 8175 | SEOB0737 | 8235 | SEOB0819a | 8295 | SEOB0893a | 8355 | SEOB0977 |
| 8116 | SEOB0665a | 8176 | SEOB0739 | 8236 | SEOB0820a | 8296 | SEOB0894a | 8356 | SEOB0978 |
| 8117 | SEOB0667a | 8177 | SEOB0742 | 8237 | SEOB0821a | 8297 | SEOB0895a | 8357 | SEOB0980 |
| 8118 | SEOB0668a | 8178 | SEOB0743 | 8238 | SEOB0823a | 8298 | SEOB0896a | 8358 | SEOB0983 |
| 8119 | seob0669a | 8179 | SEOB0745 | 8239 | SEOB0824a | 8299 | SEOB0897a | 8359 | SEOB0984 |
| 8120 | SEOB0670a | 8180 | SEOB0746 | 8240 | SEOB0825a | 8300 | SEOB0899a | 8360 | SEOB0985 |
| 8121 | SEOB0671a | 8181 | seob0747n | 8241 | SEOB0826a | 8301 | SEOB0900a | 8361 | SEOB0987 |
| 8122 | SEOB0672a | 8182 | SEOB0748 | 8242 | SEOB0827a | 8302 | SEOB0901a | 8362 | SEOB0989 |
| 8123 | SEOB0673a | 8183 | SEOB0749 | 8243 | SEOB0829a | 8303 | SEOB0902a | 8363 | SEOB0990 |
| 8124 | SEOB0674a | 8184 | SEOB0750 | 8244 | SEOB0830a | 8304 | SEOB0903a | 8364 | SEOB0991 |
| 8125 | SEOB0675a | 8185 | SEOB0751 | 8245 | SEOB0831a | 8305 | SEOB0904a | 8365 | SEOB0992 |
| 8126 | SEOB0676a | 8186 | SEOB0752 | 8246 | SEOB0832a | 8306 | SEOB0905a | 8366 | SEOB0993 |
| 8127 | SEOB0678a | 8187 | SEOB0753 | 8247 | SEOB0833a | 8307 | SEOB0906a | 8367 | SEOB0995 |
| 8128 | seob0679a | 8188 | SEOB0754 | 8248 | SEOB0834a | 8308 | SEOB0907a | 8368 | SEOB0999 |
| 8129 | SEOB0680a | 8189 | SEOB0755 | 8249 | SEOB0835a | 8309 | SEOB0908a | 8369 | SEOB1000 |
| 8130 | SEOB0681a | 8190 | SEOB0756 | 8250 | SEOB0836a | 8310 | SEOB0910a | 8370 | SEOB1001 |
| 8131 | SEOB0682a | 8191 | SEOB0757 | 8251 | SEOB0837a | 8311 | SEOB0911a | 8371 | SEOB1004 |
| 8132 | SEOB0684a | 8192 | SEOB0758 | 8252 | SEOB0840a | 8312 | SEOB0912a | 8372 | SEOB1007 |
| 8133 | SEOB0685a | 8193 | SEOB0759 | 8253 | SEOB0841a | 8313 | SEOB0914 | 8373 | SEOB1008 |
| 8134 | SEOB0688a | 8194 | SEOB0760 | 8254 | SEOB0842a | 8314 | SEOB0915 | 8374 | SEOB1009 |
| 8135 | SEOB0689a | 8195 | SEOB0761 | 8255 | SEOB0843a | 8315 | SEOB0916 | 8375 | SEOB1010 |
| 8136 | SEOB0690a | 8196 | SEOB0763 | 8256 | SEOB0844a | 8316 | SEOB0917 | 8376 | seob1011n |
| 8137 | SEOB0691a | 8197 | SEOB0764 | 8257 | SEOB0845a | 8317 | SEOB0918 | 8377 | SEOB1012 |
| 8138 | SEOB0692a | 8198 | SEOB0765 | 8258 | SEOB0846a | 8318 | SEOB0919 | 8378 | SEOB1013 |
| 8139 | SEOB0693a | 8199 | SEOB0767 | 8259 | SEOB0847a | 8319 | SEOB0921 | 8379 | SEOB1014 |
| 8140 | SEOB0694a | 8200 | SEOB0768 | 8260 | SEOB0848a | 8320 | SEOB0922 | 8380 | SEOB1015 |
| 8141 | SEOB0695a | 8201 | SEOB0770 | 8261 | SEOB0849a | 8321 | SEOB0923 | 8381 | SEOB1016 |
| 8142 | seob0696an | 8202 | SEOB0771 | 8262 | SEOB0850a | 8322 | SEOB0924 | 8382 | SEOB1017 |
| 8143 | SEOB0697a | 8203 | SEOB0772 | 8263 | SEOB0851a | 8323 | SEOB0925 | 8383 | SEOB1019 |
| 8144 | SEOB0698a | 8204 | SEOB0773 | 8264 | SEOB0852a | 8324 | SEOB0926 | 8384 | SEOB1020 |
| 8145 | SEOB0699a | 8205 | SEOB0774a | 8265 | SEOB0853a | 8325 | SEOB0927 | 8385 | SEOB1021 |
| 8146 | SEOB0700a | 8206 | SEOB0776a | 8266 | SEOB0855a | 8326 | SEOB0928 | 8386 | SEOB1022 |
| 8147 | SEOB0701a | 8207 | SEOB0777a | 8267 | SEOB0856a | 8327 | SEOB0933 | 8387 | SEOB1023 |
| 8148 | SEOB0702a | 8208 | SEOB0778a | 8268 | SEOB0857a | 8328 | SEOB0937 | 8388 | SEOB1024 |
| 8149 | SEOB0703a | 8209 | SEOB0779a | 8269 | SEOB0858a | 8329 | SEOB0938 | 8389 | SEOB1025 |
| 8150 | SEOB0704a | 8210 | SEOB0782a | 8270 | SEOB0859a | 8330 | SEOB0939 | 8390 | SEOB1026 |
| 8151 | SEOB0705a | 8211 | SEOB0783a | 8271 | SEOB0864a | 8331 | SEOB0941 | 8391 | seob1027n |
| 8152 | SEOB0706a | 8212 | SEOB0786a | 8272 | SEOB0865a | 8332 | SEOB0943 | 8392 | SEOB1028 |
| 8153 | SEOB0707a | 8213 | SEOB0787a | 8273 | SEOB0866a | 8333 | SEOB0944 | 8393 | SEOB1029 |
| 8154 | SEOB0708a | 8214 | SEOB0788a | 8274 | SEOB0867a | 8334 | SEOB0945 | 8394 | SEOB1030 |
| 8155 | SEOB0709a | 8215 | SEOB0789 | 8275 | SEOB0868a | 8335 | SEOB0949 | 8395 | SEOB1031 |
| 8156 | SEOB0710a | 8216 | seob0790 | 8276 | SEOB0869a | 8336 | SEOB0950 | 8396 | SEOB1032 |
| 8157 | SEOB0712a | 8217 | SEOB0791 | 8277 | SEOB0870a | 8337 | SEOB0952 | 8397 | SEOB1033 |
| 8158 | SEOB0713a | 8218 | SEOB0794 | 8278 | SEOB0871a | 8338 | SEOB0953 | 8398 | SEOB1034 |
| 8159 | SEOB0714a | 8219 | SEOB0795 | 8279 | SEOB0872a | 8339 | SEOB0954 | 8399 | seob1036 |
| 8160 | SEOB0715a | 8220 | SEOB0796 | 8280 | SEOB0874a | 8340 | SEOB0958 | 8400 | seob1037 |

Figure 6E – List of EST Sequence Names From Severe OA Cartilage cDNA Library

| | | | | | | | | | |
|---|---|---|---|---|---|---|---|---|---|
| 8401 | seob1039 | 8461 | SEOB1132 | 8521 | SEOB1199 | 8581 | SEOB1267 | 8641 | SEOB1337 |
| 8402 | seob1040 | 8462 | SEOB1133 | 8522 | SEOB1200 | 8582 | SEOB1268 | 8642 | SEOB1339 |
| 8403 | seob1041 | 8463 | SEOB1134 | 8523 | SEOB1201 | 8583 | SEOB1269 | 8643 | SEOB1340 |
| 8404 | seob1042 | 8464 | SEOB1136 | 8524 | SEOB1202 | 8584 | SEOB1270 | 8644 | SEOB1342 |
| 8405 | seob1043 | 8465 | SEOB1137 | 8525 | SEOB1203 | 8585 | SEOB1271 | 8645 | SEOB1343 |
| 8406 | seob1044 | 8466 | SEOB1138 | 8526 | SEOB1205 | 8586 | SEOB1272 | 8646 | SEOB1344 |
| 8407 | seob1046 | 8467 | seob1139 | 8527 | SEOB1207 | 8587 | SEOB1273 | 8647 | SEOB1345 |
| 8408 | seob1052 | 8468 | SEOB1140 | 8528 | SEOB1208 | 8588 | SEOB1274 | 8648 | SEOB1346 |
| 8409 | seob1053 | 8469 | SEOB1141 | 8529 | SEOB1209 | 8589 | SEOB1275 | 8649 | seob1347n |
| 8410 | seob1054 | 8470 | SEOB1142 | 8530 | SEOB1211 | 8590 | SEOB1277 | 8650 | SEOB1349 |
| 8411 | seob1055 | 8471 | SEOB1143 | 8531 | SEOB1212 | 8591 | SEOB1279 | 8651 | SEOB1350 |
| 8412 | seob1057 | 8472 | SEOB1144 | 8532 | SEOB1213 | 8592 | SEOB1280 | 8652 | SEOB1351 |
| 8413 | seob1061 | 8473 | SEOB1145 | 8533 | SEOB1214 | 8593 | SEOB1282 | 8653 | SEOB1352 |
| 8414 | SEOB1064 | 8474 | SEOB1146 | 8534 | SEOB1215 | 8594 | SEOB1283 | 8654 | SEOB1353 |
| 8415 | SEOB1070 | 8475 | SEOB1147 | 8535 | SEOB1216 | 8595 | SEOB1284 | 8655 | SEOB1354 |
| 8416 | SEOB1071 | 8476 | SEOB1148 | 8536 | SEOB1218 | 8596 | SEOB1285 | 8656 | SEOB1355 |
| 8417 | SEOB1072 | 8477 | SEOB1149 | 8537 | SEOB1219 | 8597 | SEOB1286 | 8657 | SEOB1356 |
| 8418 | SEOB1073 | 8478 | SEOB1150 | 8538 | SEOB1220 | 8598 | SEOB1287 | 8658 | SEOB1357 |
| 8419 | SEOB1075 | 8479 | SEOB1151 | 8539 | SEOB1221 | 8599 | SEOB1288 | 8659 | SEOB1358 |
| 8420 | SEOB1076 | 8480 | SEOB1152 | 8540 | SEOB1223 | 8600 | SEOB1289 | 8660 | seob1359n |
| 8421 | SEOB1077 | 8481 | SEOB1153 | 8541 | SEOB1224 | 8601 | SEOB1290 | 8661 | SEOB1360 |
| 8422 | SEOB1078 | 8482 | SEOB1154 | 8542 | SEOB1225 | 8602 | SEOB1291 | 8662 | SEOB1362 |
| 8423 | SEOB1079 | 8483 | SEOB1155 | 8543 | SEOB1226 | 8603 | SEOB1292 | 8663 | SEOB1363 |
| 8424 | SEOB1081 | 8484 | SEOB1156 | 8544 | SEOB1227 | 8604 | SEOB1293 | 8664 | SEOB1364 |
| 8425 | SEOB1083 | 8485 | SEOB1157 | 8545 | SEOB1228 | 8605 | SEOB1294 | 8665 | SEOB1365 |
| 8426 | SEOB1085 | 8486 | SEOB1158 | 8546 | SEOB1229 | 8606 | SEOB1295 | 8666 | SEOB1366 |
| 8427 | SEOB1086 | 8487 | SEOB1160 | 8547 | SEOB1230 | 8607 | SEOB1296 | 8667 | SEOB1367 |
| 8428 | SEOB1088 | 8488 | SEOB1161 | 8548 | SEOB1231 | 8608 | SEOB1297 | 8668 | SEOB1368 |
| 8429 | SEOB1090 | 8489 | SEOB1162 | 8549 | SEOB1232 | 8609 | SEOB1298 | 8669 | SEOB1370 |
| 8430 | SEOB1091 | 8490 | SEOB1164 | 8550 | SEOB1233 | 8610 | SEOB1300 | 8670 | SEOB1371 |
| 8431 | SEOB1093 | 8491 | SEOB1165 | 8551 | SEOB1234 | 8611 | seob1301n | 8671 | SEOB1372 |
| 8432 | SEOB1094 | 8492 | SEOB1166 | 8552 | SEOB1236 | 8612 | SEOB1302 | 8672 | seob1373n |
| 8433 | SEOB1095 | 8493 | SEOB1167 | 8553 | SEOB1237 | 8613 | SEOB1303 | 8673 | SEOB1374 |
| 8434 | SEOB1098 | 8494 | SEOB1168 | 8554 | SEOB1238 | 8614 | SEOB1305 | 8674 | seob1378 |
| 8435 | SEOB1099 | 8495 | SEOB1170 | 8555 | SEOB1240 | 8615 | SEOB1306 | 8675 | SEOB1380 |
| 8436 | SEOB1100 | 8496 | SEOB1171 | 8556 | SEOB1241 | 8616 | SEOB1307 | 8676 | SEOB1381 |
| 8437 | SEOB1102 | 8497 | SEOB1172 | 8557 | SEOB1242 | 8617 | SEOB1310 | 8677 | SEOB1382 |
| 8438 | SEOB1103 | 8498 | SEOB1173 | 8558 | SEOB1243 | 8618 | SEOB1311 | 8678 | SEOB1383 |
| 8439 | SEOB1107 | 8499 | SEOB1174 | 8559 | SEOB1244 | 8619 | SEOB1312 | 8679 | SEOB1384 |
| 8440 | SEOB1109 | 8500 | SEOB1175 | 8560 | SEOB1246 | 8620 | SEOB1313 | 8680 | SEOB1385 |
| 8441 | SEOB1110 | 8501 | SEOB1176 | 8561 | SEOB1247 | 8621 | SEOB1314 | 8681 | SEOB1386 |
| 8442 | SEOB1111 | 8502 | SEOB1180 | 8562 | SEOB1248 | 8622 | SEOB1315 | 8682 | SEOB1387 |
| 8443 | SEOB1112 | 8503 | SEOB1181 | 8563 | SEOB1249 | 8623 | SEOB1316 | 8683 | seob1389n |
| 8444 | SEOB1113 | 8504 | SEOB1182 | 8564 | SEOB1250 | 8624 | SEOB1318 | 8684 | SEOB1391 |
| 8445 | SEOB1114 | 8505 | SEOB1183 | 8565 | SEOB1251 | 8625 | SEOB1319 | 8685 | SEOB1392 |
| 8446 | SEOB1116 | 8506 | SEOB1184 | 8566 | SEOB1252 | 8626 | SEOB1321 | 8686 | SEOB1393 |
| 8447 | SEOB1117 | 8507 | SEOB1185 | 8567 | SEOB1253 | 8627 | SEOB1322 | 8687 | SEOB1394 |
| 8448 | SEOB1118 | 8508 | SEOB1186 | 8568 | SEOB1254 | 8628 | SEOB1323 | 8688 | SEOB1395 |
| 8449 | SEOB1119 | 8509 | SEOB1187 | 8569 | SEOB1255 | 8629 | SEOB1324 | 8689 | SEOB1396 |
| 8450 | SEOB1120 | 8510 | SEOB1188 | 8570 | SEOB1256 | 8630 | SEOB1325 | 8690 | SEOB1397 |
| 8451 | SEOB1121 | 8511 | SEOB1189 | 8571 | SEOB1257 | 8631 | SEOB1327 | 8691 | SEOB1398 |
| 8452 | SEOB1123 | 8512 | SEOB1190 | 8572 | SEOB1258 | 8632 | SEOB1328 | 8692 | SEOB1399 |
| 8453 | SEOB1124 | 8513 | SEOB1191 | 8573 | SEOB1259 | 8633 | SEOB1329 | 8693 | SEOB1400 |
| 8454 | SEOB1125 | 8514 | SEOB1192 | 8574 | SEOB1260 | 8634 | SEOB1330 | 8694 | SEOB1401 |
| 8455 | SEOB1126 | 8515 | SEOB1193 | 8575 | SEOB1261 | 8635 | SEOB1331 | 8695 | SEOB1402 |
| 8456 | SEOB1127 | 8516 | SEOB1194 | 8576 | SEOB1262 | 8636 | SEOB1332 | 8696 | SEOB1403 |
| 8457 | seob1128n | 8517 | SEOB1195 | 8577 | SEOB1263 | 8637 | SEOB1333 | 8697 | SEOB1405 |
| 8458 | SEOB1129 | 8518 | SEOB1196 | 8578 | SEOB1264 | 8638 | SEOB1334 | 8698 | SEOB1406 |
| 8459 | SEOB1130 | 8519 | SEOB1197 | 8579 | SEOB1265 | 8639 | SEOB1335 | 8699 | SEOB1407 |
| 8460 | SEOB1131 | 8520 | SEOB1198 | 8580 | SEOB1266 | 8640 | SEOB1336 | 8700 | SEOB1408 |

Figure 6E – List of EST Sequence Names From Severe OA Cartilage cDNA Library

| | | | | | | | | | |
|---|---|---|---|---|---|---|---|---|---|
| 8701 | SEOB1409 | 8761 | SEOB1491 | 8821 | SEOB1565 | 8881 | SEOB1631 | 8941 | SEOB1700 |
| 8702 | SEOB1410 | 8762 | SEOB1493 | 8822 | SEOB1566 | 8882 | SEOB1632 | 8942 | seob1701n |
| 8703 | SEOB1411 | 8763 | SEOB1494 | 8823 | SEOB1567 | 8883 | SEOB1633 | 8943 | SEOB1702 |
| 8704 | SEOB1412 | 8764 | SEOB1495 | 8824 | SEOB1568 | 8884 | SEOB1634 | 8944 | SEOB1703 |
| 8705 | SEOB1413 | 8765 | SEOB1496 | 8825 | SEOB1570 | 8885 | SEOB1635 | 8945 | SEOB1704 |
| 8706 | SEOB1414 | 8766 | SEOB1497 | 8826 | SEOB1571 | 8886 | SEOB1636 | 8946 | SEOB1705 |
| 8707 | SEOB1416 | 8767 | SEOB1499 | 8827 | SEOB1572 | 8887 | SEOB1637 | 8947 | SEOB1706 |
| 8708 | SEOB1417 | 8768 | SEOB1500 | 8828 | SEOB1573 | 8888 | SEOB1638 | 8948 | SEOB1707 |
| 8709 | SEOB1418 | 8769 | SEOB1501 | 8829 | SEOB1574 | 8889 | SEOB1639 | 8949 | SEOB1708 |
| 8710 | SEOB1419 | 8770 | SEOB1502 | 8830 | SEOB1575 | 8890 | SEOB1640 | 8950 | SEOB1709 |
| 8711 | SEOB1420 | 8771 | SEOB1503 | 8831 | SEOB1576 | 8891 | SEOB1641 | 8951 | SEOB1710 |
| 8712 | SEOB1422 | 8772 | SEOB1504 | 8832 | SEOB1577 | 8892 | SEOB1642 | 8952 | SEOB1711 |
| 8713 | SEOB1423 | 8773 | SEOB1505 | 8833 | SEOB1578 | 8893 | SEOB1643 | 8953 | SEOB1712 |
| 8714 | SEOB1424 | 8774 | SEOB1506 | 8834 | SEOB1579 | 8894 | SEOB1644 | 8954 | SEOB1714 |
| 8715 | SEOB1426 | 8775 | SEOB1507 | 8835 | SEOB1581 | 8895 | SEOB1645 | 8955 | SEOB1715 |
| 8716 | SEOB1428 | 8776 | SEOB1508 | 8836 | SEOB1582 | 8896 | SEOB1646 | 8956 | SEOB1716 |
| 8717 | SEOB1430 | 8777 | SEOB1510 | 8837 | SEOB1583 | 8897 | SEOB1647 | 8957 | SEOB1717 |
| 8718 | SEOB1431 | 8778 | SEOB1512 | 8838 | SEOB1584 | 8898 | SEOB1648 | 8958 | SEOB1718 |
| 8719 | SEOB1432 | 8779 | SEOB1513 | 8839 | SEOB1586 | 8899 | SEOB1649 | 8959 | SEOB1719 |
| 8720 | SEOB1433 | 8780 | SEOB1514 | 8840 | SEOB1587 | 8900 | SEOB1650 | 8960 | SEOB1720 |
| 8721 | SEOB1434 | 8781 | SEOB1516 | 8841 | SEOB1588 | 8901 | SEOB1652 | 8961 | SEOB1721 |
| 8722 | SEOB1435 | 8782 | SEOB1517 | 8842 | SEOB1589 | 8902 | SEOB1653 | 8962 | SEOB1722 |
| 8723 | SEOB1437 | 8783 | SEOB1518 | 8843 | SEOB1590 | 8903 | SEOB1654 | 8963 | SEOB1723 |
| 8724 | SEOB1438 | 8784 | SEOB1520 | 8844 | SEOB1591 | 8904 | SEOB1655 | 8964 | SEOB1724 |
| 8725 | SEOB1439 | 8785 | SEOB1521 | 8845 | SEOB1592 | 8905 | SEOB1656 | 8965 | SEOB1725 |
| 8726 | SEOB1440 | 8786 | SEOB1522 | 8846 | SEOB1593 | 8906 | seob1657 | 8966 | SEOB1726 |
| 8727 | SEOB1441 | 8787 | SEOB1523 | 8847 | SEOB1594 | 8907 | SEOB1659 | 8967 | SEOB1727 |
| 8728 | SEOB1442 | 8788 | SEOB1525 | 8848 | SEOB1595 | 8908 | SEOB1660 | 8968 | SEOB1728 |
| 8729 | SEOB1443 | 8789 | SEOB1526 | 8849 | SEOB1596 | 8909 | SEOB1661 | 8969 | SEOB1730 |
| 8730 | SEOB1445 | 8790 | SEOB1527 | 8850 | SEOB1597 | 8910 | SEOB1662 | 8970 | SEOB1731 |
| 8731 | SEOB1447 | 8791 | SEOB1528 | 8851 | SEOB1598 | 8911 | SEOB1663 | 8971 | SEOB1732 |
| 8732 | SEOB1448 | 8792 | SEOB1529 | 8852 | SEOB1599 | 8912 | SEOB1664 | 8972 | SEOB1733 |
| 8733 | SEOB1449 | 8793 | SEOB1530 | 8853 | SEOB1600 | 8913 | SEOB1665 | 8973 | SEOB1734 |
| 8734 | SEOB1450 | 8794 | SEOB1532 | 8854 | SEOB1602 | 8914 | SEOB1666 | 8974 | SEOB1735 |
| 8735 | SEOB1451 | 8795 | SEOB1533 | 8855 | SEOB1603 | 8915 | seob1667n | 8975 | SEOB1736 |
| 8736 | SEOB1452 | 8796 | SEOB1534 | 8856 | SEOB1604 | 8916 | SEOB1668 | 8976 | SEOB1737 |
| 8737 | SEOB1453 | 8797 | SEOB1535 | 8857 | SEOB1605 | 8917 | SEOB1669 | 8977 | SEOB1738 |
| 8738 | SEOB1454 | 8798 | SEOB1536 | 8858 | SEOB1606 | 8918 | SEOB1671 | 8978 | SEOB1739 |
| 8739 | SEOB1455 | 8799 | SEOB1537 | 8859 | SEOB1608 | 8919 | SEOB1672 | 8979 | SEOB1740 |
| 8740 | SEOB1456 | 8800 | SEOB1538 | 8860 | SEOB1609 | 8920 | SEOB1673 | 8980 | SEOB1741 |
| 8741 | SEOB1457 | 8801 | SEOB1540 | 8861 | SEOB1610 | 8921 | SEOB1674 | 8981 | SEOB1742 |
| 8742 | SEOB1458 | 8802 | SEOB1541 | 8862 | SEOB1611 | 8922 | SEOB1675 | 8982 | SEOB1743 |
| 8743 | SEOB1459 | 8803 | SEOB1542 | 8863 | SEOB1612 | 8923 | SEOB1676 | 8983 | SEOB1744 |
| 8744 | SEOB1461 | 8804 | SEOB1543 | 8864 | SEOB1613 | 8924 | SEOB1677 | 8984 | SEOB1745 |
| 8745 | SEOB1462 | 8805 | SEOB1544 | 8865 | SEOB1614 | 8925 | SEOB1678 | 8985 | SEOB1746 |
| 8746 | SEOB1463 | 8806 | SEOB1546 | 8866 | SEOB1615 | 8926 | seob1679n | 8986 | SEOB1748 |
| 8747 | SEOB1464 | 8807 | SEOB1547 | 8867 | SEOB1616 | 8927 | SEOB1680 | 8987 | SEOB1749 |
| 8748 | SEOB1465 | 8808 | SEOB1549 | 8868 | SEOB1617 | 8928 | SEOB1681 | 8988 | SEOB1750 |
| 8749 | SEOB1466 | 8809 | SEOB1551 | 8869 | SEOB1618 | 8929 | SEOB1682 | 8989 | SEOB1752 |
| 8750 | SEOB1467 | 8810 | SEOB1552 | 8870 | SEOB1619 | 8930 | SEOB1683 | 8990 | SEOB1753 |
| 8751 | SEOB1468 | 8811 | SEOB1553 | 8871 | SEOB1620 | 8931 | SEOB1684 | 8991 | SEOB1754 |
| 8752 | SEOB1469 | 8812 | SEOB1554 | 8872 | SEOB1622 | 8932 | SEOB1685 | 8992 | SEOB1755 |
| 8753 | SEOB1470 | 8813 | SEOB1555 | 8873 | SEOB1623 | 8933 | SEOB1686 | 8993 | SEOB1756 |
| 8754 | SEOB1471 | 8814 | SEOB1556 | 8874 | SEOB1624 | 8934 | SEOB1689 | 8994 | SEOB1757 |
| 8755 | SEOB1472 | 8815 | seob1557n | 8875 | SEOB1625 | 8935 | SEOB1690 | 8995 | SEOB1758 |
| 8756 | SEOB1473 | 8816 | SEOB1558 | 8876 | SEOB1626 | 8936 | SEOB1691 | 8996 | SEOB1759 |
| 8757 | SEOB1474 | 8817 | SEOB1560 | 8877 | SEOB1627 | 8937 | SEOB1692 | 8997 | SEOB1762 |
| 8758 | SEOB1475 | 8818 | SEOB1561 | 8878 | SEOB1628 | 8938 | SEOB1696 | 8998 | SEOB1763 |
| 8759 | SEOB1476 | 8819 | SEOB1562 | 8879 | SEOB1629 | 8939 | SEOB1697 | 8999 | SEOB1764 |
| 8760 | SEOB1490 | 8820 | SEOB1564 | 8880 | SEOB1630 | 8940 | SEOB1698 | 9000 | SEOB1766 |

Figure 6E – List of EST Sequence Names From Severe OA Cartilage cDNA Library

| | | | | | | | | | |
|---|---|---|---|---|---|---|---|---|---|
| 9001 | SEOB1767 | 9061 | SEOB1837 | 9121 | SEOB1907 | 9181 | SEOB1981 | 9241 | SEOB2058 |
| 9002 | SEOB1768 | 9062 | SEOB1838 | 9122 | SEOB1908 | 9182 | SEOB1982 | 9242 | SEOB2059 |
| 9003 | SEOB1769 | 9063 | SEOB1839 | 9123 | SEOB1909 | 9183 | SEOB1984 | 9243 | SEOB2060 |
| 9004 | SEOB1770 | 9064 | SEOB1840 | 9124 | SEOB1910 | 9184 | SEOB1985 | 9244 | SEOB2062 |
| 9005 | SEOB1771 | 9065 | SEOB1841 | 9125 | SEOB1911 | 9185 | SEOB1986 | 9245 | SEOB2064 |
| 9006 | SEOB1772 | 9066 | SEOB1842 | 9126 | SEOB1915 | 9186 | SEOB1987 | 9246 | SEOB2065 |
| 9007 | SEOB1773 | 9067 | SEOB1843 | 9127 | SEOB1916 | 9187 | SEOB1988 | 9247 | SEOB2067 |
| 9008 | SEOB1774 | 9068 | SEOB1844 | 9128 | SEOB1917 | 9188 | SEOB1991 | 9248 | SEOB2069 |
| 9009 | SEOB1775 | 9069 | SEOB1845 | 9129 | SEOB1918 | 9189 | SEOB1992 | 9249 | SEOB2070 |
| 9010 | SEOB1776 | 9070 | SEOB1846 | 9130 | SEOB1920 | 9190 | SEOB1993 | 9250 | SEOB2071 |
| 9011 | SEOB1777 | 9071 | SEOB1847 | 9131 | SEOB1921 | 9191 | SEOB1994 | 9251 | SEOB2074 |
| 9012 | SEOB1778 | 9072 | SEOB1848 | 9132 | SEOB1922 | 9192 | SEOB1996 | 9252 | SEOB2076 |
| 9013 | SEOB1780 | 9073 | SEOB1849 | 9133 | SEOB1923 | 9193 | SEOB1997 | 9253 | SEOB2077 |
| 9014 | SEOB1781 | 9074 | SEOB1850 | 9134 | SEOB1924 | 9194 | SEOB1998 | 9254 | SEOB2078 |
| 9015 | SEOB1782 | 9075 | SEOB1851 | 9135 | SEOB1926 | 9195 | SEOB1999 | 9255 | SEOB2079 |
| 9016 | SEOB1783 | 9076 | SEOB1852 | 9136 | SEOB1928 | 9196 | SEOB2001 | 9256 | SEOB2080 |
| 9017 | SEOB1784 | 9077 | SEOB1853 | 9137 | SEOB1929 | 9197 | SEOB2002 | 9257 | SEOB2081 |
| 9018 | SEOB1785 | 9078 | SEOB1854 | 9138 | SEOB1930 | 9198 | SEOB2004 | 9258 | SEOB2082 |
| 9019 | SEOB1786 | 9079 | SEOB1855 | 9139 | SEOB1931 | 9199 | SEOB2005 | 9259 | SEOB2083 |
| 9020 | SEOB1787 | 9080 | SEOB1856 | 9140 | SEOB1932 | 9200 | SEOB2006 | 9260 | SEOB2084 |
| 9021 | SEOB1788 | 9081 | SEOB1857 | 9141 | SEOB1933 | 9201 | SEOB2007 | 9261 | SEOB2085 |
| 9022 | SEOB1789 | 9082 | SEOB1858 | 9142 | SEOB1934 | 9202 | SEOB2008 | 9262 | SEOB2086 |
| 9023 | SEOB1790 | 9083 | SEOB1859 | 9143 | SEOB1935 | 9203 | SEOB2009 | 9263 | SEOB2087 |
| 9024 | SEOB1792 | 9084 | SEOB1860 | 9144 | SEOB1936 | 9204 | SEOB2010 | 9264 | SEOB2088 |
| 9025 | SEOB1793 | 9085 | SEOB1862 | 9145 | SEOB1937 | 9205 | SEOB2011 | 9265 | SEOB2089 |
| 9026 | SEOB1794 | 9086 | SEOB1864 | 9146 | SEOB1938 | 9206 | SEOB2015 | 9266 | SEOB2090 |
| 9027 | SEOB1795 | 9087 | SEOB1865 | 9147 | SEOB1939 | 9207 | SEOB2016 | 9267 | seob2091n |
| 9028 | SEOB1796 | 9088 | SEOB1866 | 9148 | SEOB1940 | 9208 | SEOB2019 | 9268 | SEOB2092 |
| 9029 | SEOB1797 | 9089 | SEOB1867 | 9149 | SEOB1941 | 9209 | SEOB2022 | 9269 | SEOB2094 |
| 9030 | seob1798 | 9090 | SEOB1868 | 9150 | seob1942n | 9210 | SEOB2023 | 9270 | SEOB2096 |
| 9031 | seob1799 | 9091 | SEOB1869 | 9151 | SEOB1943 | 9211 | SEOB2024 | 9271 | SEOB2098 |
| 9032 | seob1800n | 9092 | SEOB1870 | 9152 | SEOB1944 | 9212 | SEOB2025 | 9272 | SEOB2100 |
| 9033 | SEOB1801 | 9093 | SEOB1871 | 9153 | SEOB1945 | 9213 | SEOB2026 | 9273 | SEOB2101 |
| 9034 | SEOB1804 | 9094 | SEOB1873 | 9154 | SEOB1946 | 9214 | SEOB2027 | 9274 | SEOB2102 |
| 9035 | seob1805n | 9095 | SEOB1874 | 9155 | SEOB1947 | 9215 | SEOB2028 | 9275 | SEOB2103 |
| 9036 | SEOB1807 | 9096 | SEOB1876 | 9156 | SEOB1948 | 9216 | SEOB2029 | 9276 | SEOB2104 |
| 9037 | SEOB1808 | 9097 | SEOB1877 | 9157 | SEOB1949 | 9217 | SEOB2030 | 9277 | SEOB2105 |
| 9038 | SEOB1809 | 9098 | SEOB1878 | 9158 | SEOB1951 | 9218 | SEOB2031 | 9278 | SEOB2106 |
| 9039 | SEOB1810 | 9099 | SEOB1879 | 9159 | SEOB1952 | 9219 | SEOB2032 | 9279 | SEOB2107 |
| 9040 | SEOB1811 | 9100 | SEOB1881 | 9160 | SEOB1953 | 9220 | SEOB2033 | 9280 | SEOB2108 |
| 9041 | SEOB1812 | 9101 | SEOB1882 | 9161 | SEOB1954 | 9221 | SEOB2034 | 9281 | SEOB2109 |
| 9042 | SEOB1814 | 9102 | SEOB1883 | 9162 | SEOB1955 | 9222 | SEOB2038 | 9282 | SEOB2110 |
| 9043 | SEOB1815 | 9103 | SEOB1884 | 9163 | SEOB1956 | 9223 | SEOB2039 | 9283 | SEOB2111 |
| 9044 | SEOB1817 | 9104 | SEOB1886 | 9164 | SEOB1958 | 9224 | SEOB2041 | 9284 | SEOB2112 |
| 9045 | SEOB1818 | 9105 | SEOB1887 | 9165 | SEOB1960 | 9225 | SEOB2042 | 9285 | SEOB2113 |
| 9046 | SEOB1819 | 9106 | SEOB1889 | 9166 | SEOB1961 | 9226 | SEOB2043 | 9286 | SEOB2114 |
| 9047 | SEOB1821 | 9107 | SEOB1890 | 9167 | SEOB1963 | 9227 | SEOB2044 | 9287 | SEOB2115 |
| 9048 | SEOB1822 | 9108 | SEOB1891 | 9168 | SEOB1964 | 9228 | SEOB2045 | 9288 | SEOB2116 |
| 9049 | SEOB1823 | 9109 | SEOB1892 | 9169 | SEOB1965 | 9229 | SEOB2046 | 9289 | SEOB2118 |
| 9050 | SEOB1824 | 9110 | SEOB1893 | 9170 | SEOB1966 | 9230 | SEOB2047 | 9290 | SEOB2119 |
| 9051 | SEOB1825 | 9111 | SEOB1894 | 9171 | SEOB1967 | 9231 | SEOB2048 | 9291 | SEOB2120 |
| 9052 | SEOB1826 | 9112 | SEOB1895 | 9172 | SEOB1968 | 9232 | SEOB2049 | 9292 | SEOB2121 |
| 9053 | SEOB1827 | 9113 | SEOB1897 | 9173 | SEOB1971 | 9233 | SEOB2050 | 9293 | SEOB2122 |
| 9054 | SEOB1828 | 9114 | SEOB1898 | 9174 | SEOB1972 | 9234 | SEOB2051 | 9294 | SEOB2123 |
| 9055 | SEOB1829 | 9115 | SEOB1899 | 9175 | SEOB1974 | 9235 | SEOB2052 | 9295 | SEOB2125 |
| 9056 | SEOB1831 | 9116 | SEOB1900 | 9176 | SEOB1976 | 9236 | SEOB2053 | 9296 | SEOB2126 |
| 9057 | SEOB1833 | 9117 | SEOB1902 | 9177 | SEOB1977 | 9237 | SEOB2054 | 9297 | SEOB2128 |
| 9058 | SEOB1834 | 9118 | SEOB1903 | 9178 | SEOB1978 | 9238 | SEOB2055 | 9298 | SEOB2129 |
| 9059 | SEOB1835 | 9119 | SEOB1904 | 9179 | SEOB1979 | 9239 | SEOB2056 | 9299 | SEOB2130 |
| 9060 | SEOB1836 | 9120 | SEOB1906 | 9180 | SEOB1980 | 9240 | SEOB2057 | 9300 | SEOB2131 |

Figure 6E - List of EST Sequence Names From Severe OA Cartilage cDNA Library

| | | | | | | | | | |
|---|---|---|---|---|---|---|---|---|---|
| 9301 | SEOB2132 | 9361 | SEOB2213 | 9421 | SEOB2288 | 9481 | seob2557 | 9541 | SEOB2658 |
| 9302 | SEOB2134 | 9362 | SEOB2214 | 9422 | SEOB2290 | 9482 | seob2559 | 9542 | SEOB2659 |
| 9303 | SEOB2138 | 9363 | SEOB2215 | 9423 | SEOB2291 | 9483 | seob2560 | 9543 | SEOB2660 |
| 9304 | SEOB2139 | 9364 | SEOB2216 | 9424 | SEOB2292 | 9484 | seob2563 | 9544 | SEOB2661 |
| 9305 | SEOB2141 | 9365 | SEOB2217 | 9425 | SEOB2293 | 9485 | seob2564 | 9545 | SEOB2662 |
| 9306 | seob2144n | 9366 | SEOB2218 | 9426 | SEOB2294 | 9486 | seob2566 | 9546 | SEOB2663 |
| 9307 | SEOB2145 | 9367 | SEOB2219 | 9427 | SEOB2295 | 9487 | seob2567 | 9547 | SEOB2665 |
| 9308 | SEOB2146 | 9368 | SEOB2220 | 9428 | seob2297 | 9488 | seob2568 | 9548 | SEOB2666 |
| 9309 | SEOB2147 | 9369 | SEOB2221 | 9429 | seob2299 | 9489 | seob2569 | 9549 | seob2667n |
| 9310 | SEOB2148 | 9370 | SEOB2223 | 9430 | seob2300 | 9490 | seob2570 | 9550 | SEOB2668 |
| 9311 | SEOB2149 | 9371 | SEOB2224 | 9431 | seob2301 | 9491 | seob2572 | 9551 | SEOB2669 |
| 9312 | SEOB2150 | 9372 | SEOB2225 | 9432 | seob2302 | 9492 | seob2573 | 9552 | SEOB2670 |
| 9313 | SEOB2151 | 9373 | SEOB2226 | 9433 | seob2303 | 9493 | seob2574 | 9553 | SEOB2671 |
| 9314 | SEOB2152 | 9374 | SEOB2228 | 9434 | seob2304 | 9494 | seob2575 | 9554 | SEOB2674 |
| 9315 | SEOB2153 | 9375 | SEOB2229 | 9435 | seob2306 | 9495 | seob2579 | 9555 | SEOB2676 |
| 9316 | SEOB2154 | 9376 | SEOB2230 | 9436 | seob2307 | 9496 | seob2582 | 9556 | SEOB2677 |
| 9317 | SEOB2155 | 9377 | SEOB2232 | 9437 | seob2308 | 9497 | seob2585 | 9557 | SEOB2678 |
| 9318 | SEOB2156 | 9378 | SEOB2234 | 9438 | seob2309 | 9498 | seob2587 | 9558 | SEOB2679 |
| 9319 | SEOB2157 | 9379 | SEOB2235 | 9439 | seob2310 | 9499 | seob2588 | 9559 | SEOB2680 |
| 9320 | SEOB2158 | 9380 | SEOB2238 | 9440 | seob2311 | 9500 | seob2589 | 9560 | SEOB2681 |
| 9321 | SEOB2159 | 9381 | SEOB2239 | 9441 | seob2312 | 9501 | seob2590 | 9561 | SEOB2683 |
| 9322 | SEOB2160 | 9382 | SEOB2240 | 9442 | seob2314 | 9502 | seob2592 | 9562 | SEOB2685 |
| 9323 | SEOB2161 | 9383 | SEOB2241 | 9443 | seob2315 | 9503 | seob2593 | 9563 | SEOB2686 |
| 9324 | SEOB2163 | 9384 | SEOB2242 | 9444 | seob2316 | 9504 | seob2594 | 9564 | SEOB2688 |
| 9325 | SEOB2165 | 9385 | SEOB2243 | 9445 | seob2317 | 9505 | seob2595 | 9565 | SEOB2689 |
| 9326 | seob2167n | 9386 | SEOB2245 | 9446 | seob2321 | 9506 | seob2597 | 9566 | SEOB2690 |
| 9327 | SEOB2168 | 9387 | SEOB2246 | 9447 | seob2322 | 9507 | seob2599 | 9567 | SEOB2691 |
| 9328 | SEOB2169 | 9388 | SEOB2247 | 9448 | seob2325 | 9508 | seob2600 | 9568 | SEOB2692 |
| 9329 | SEOB2171 | 9389 | seob2248n | 9449 | seob2327 | 9509 | seob2601 | 9569 | SEOB2696 |
| 9330 | SEOB2173 | 9390 | SEOB2249 | 9450 | seob2328 | 9510 | seob2604 | 9570 | SEOB2697 |
| 9331 | SEOB2176 | 9391 | SEOB2252 | 9451 | seob2329 | 9511 | seob2605 | 9571 | SEOB2699 |
| 9332 | SEOB2178 | 9392 | SEOB2253 | 9452 | seob2330 | 9512 | seob2607 | 9572 | SEOB2701 |
| 9333 | SEOB2179 | 9393 | SEOB2254 | 9453 | seob2331 | 9513 | seob2608 | 9573 | SEOB2704 |
| 9334 | SEOB2180 | 9394 | SEOB2255 | 9454 | seob2333 | 9514 | seob2610 | 9574 | SEOB2705 |
| 9335 | SEOB2181 | 9395 | SEOB2256 | 9455 | seob2334 | 9515 | seob2611 | 9575 | SEOB2706 |
| 9336 | SEOB2184 | 9396 | SEOB2257 | 9456 | seob2335 | 9516 | seob2612 | 9576 | SEOB2707 |
| 9337 | SEOB2185 | 9397 | SEOB2258 | 9457 | seob2336 | 9517 | seob2613 | 9577 | SEOB2709 |
| 9338 | SEOB2187 | 9398 | SEOB2259 | 9458 | seob2337 | 9518 | seob2614 | 9578 | SEOB2710 |
| 9339 | SEOB2188 | 9399 | SEOB2260 | 9459 | seob2530 | 9519 | seob2616 | 9579 | SEOB2711 |
| 9340 | SEOB2189 | 9400 | SEOB2261 | 9460 | seob2531 | 9520 | seob2619 | 9580 | SEOB2712 |
| 9341 | SEOB2190 | 9401 | SEOB2262 | 9461 | seob2534 | 9521 | seob2620 | 9581 | SEOB2713 |
| 9342 | SEOB2192 | 9402 | SEOB2263 | 9462 | seob2535 | 9522 | seob2621 | 9582 | SEOB2714 |
| 9343 | SEOB2193 | 9403 | SEOB2264 | 9463 | seob2536 | 9523 | seob2622 | 9583 | SEOB2716 |
| 9344 | SEOB2194 | 9404 | SEOB2265 | 9464 | seob2537 | 9524 | seob2624 | 9584 | SEOB2717 |
| 9345 | SEOB2195 | 9405 | SEOB2266 | 9465 | seob2538 | 9525 | seob2625 | 9585 | SEOB2719 |
| 9346 | SEOB2196 | 9406 | SEOB2267 | 9466 | seob2539 | 9526 | SEOB2627 | 9586 | SEOB2722 |
| 9347 | SEOB2197 | 9407 | SEOB2268 | 9467 | seob2540 | 9527 | SEOB2629 | 9587 | SEOB2723 |
| 9348 | SEOB2198 | 9408 | SEOB2269 | 9468 | seob2541 | 9528 | SEOB2631 | 9588 | SEOB2724 |
| 9349 | SEOB2199 | 9409 | SEOB2270 | 9469 | seob2543 | 9529 | SEOB2633 | 9589 | SEOB2726 |
| 9350 | SEOB2200 | 9410 | SEOB2271 | 9470 | seob2544 | 9530 | SEOB2635 | 9590 | SEOB2727 |
| 9351 | SEOB2201 | 9411 | SEOB2273 | 9471 | seob2545 | 9531 | SEOB2639 | 9591 | SEOB2728 |
| 9352 | seob2202n | 9412 | SEOB2275 | 9472 | seob2546 | 9532 | SEOB2642 | 9592 | SEOB2729 |
| 9353 | SEOB2204 | 9413 | SEOB2276 | 9473 | seob2547 | 9533 | SEOB2643 | 9593 | SEOB2730 |
| 9354 | SEOB2205 | 9414 | SEOB2277 | 9474 | seob2548 | 9534 | SEOB2645 | 9594 | SEOB2731 |
| 9355 | SEOB2206 | 9415 | SEOB2280 | 9475 | seob2549 | 9535 | SEOB2648 | 9595 | SEOB2732 |
| 9356 | SEOB2208 | 9416 | SEOB2282 | 9476 | seob2551 | 9536 | SEOB2649 | 9596 | SEOB2733 |
| 9357 | SEOB2209 | 9417 | SEOB2283 | 9477 | seob2553 | 9537 | SEOB2650 | 9597 | SEOB2734 |
| 9358 | SEOB2210 | 9418 | SEOB2284 | 9478 | seob2554 | 9538 | SEOB2651 | 9598 | SEOB2735 |
| 9359 | SEOB2211 | 9419 | SEOB2286 | 9479 | seob2555 | 9539 | SEOB2653 | 9599 | SEOB2736 |
| 9360 | SEOB2212 | 9420 | SEOB2287 | 9480 | seob2556 | 9540 | SEOB2657 | 9600 | SEOB2737 |

Figure 6E – List of EST Sequence Names From Severe OA Cartilage cDNA Library

| | |
|---|---|
| 9601 | SEOB2738 |
| 9602 | SEOB2739 |
| 9603 | SEOB2740 |
| 9604 | SEOB2741 |
| 9605 | SEOB2742 |
| 9606 | SEOB2744 |
| 9607 | SEOB2745 |
| 9608 | SEOB2746 |
| 9609 | SEOB2749 |
| 9610 | SEOB2750 |
| 9611 | SEOB2751 |
| 9612 | SEOB2752 |
| 9613 | SEOB2753 |
| 9614 | SEOB2754 |
| 9615 | SEOB2755 |
| 9616 | SEOB2756 |
| 9617 | SEOB2757 |
| 9618 | SEOB2760 |
| 9619 | SEOB2761 |
| 9620 | SEOB2762 |
| 9621 | SEOB2763 |
| 9622 | SEOB2764 |
| 9623 | SEOB2765 |
| 9624 | SEOB2766 |
| 9625 | SEOB2767 |
| 9626 | SEOB2768 |
| 9627 | SEOB2770 |
| 9628 | SEOB2771 |
| 9629 | SEOB2772 |
| 9630 | SEOB2773 |
| 9631 | SEOB2774 |
| 9632 | SEOB2775 |
| 9633 | SEOB2777 |
| 9634 | SEOB2778 |
| 9635 | SEOB2779 |
| 9636 | SEOB2780 |
| 9637 | SEOB2781 |
| 9638 | SEOB2783 |
| 9639 | SEOB2785 |
| 9640 | SEOB2786 |
| 9641 | SEOB2787 |
| 9642 | SEOB2788 |
| 9643 | SEOB2789 |
| 9644 | SEOB2790 |
| 9645 | SEOB2791 |
| 9646 | SEOB2792 |
| 9647 | SEOB2793 |
| 9648 | SEOB2794 |
| 9649 | SEOB2795 |
| 9650 | SEOB2796 |
| 9651 | SEOB2797 |
| 9652 | SEOB2798 |
| 9653 | SEOB2800 |
| 9654 | SEOB2801 |
| 9655 | SEOB2802 |
| 9656 | SEOB2803 |
| 9657 | SEOB2804 |
| 9658 | SEOB2805 |
| 9659 | SEOB2806 |
| 9660 | SEOB2807 |
| 9661 | SEOB2808 |
| 9662 | SEOB2809 |
| 9663 | SEOB2810 |
| 9664 | SEOB2811 |
| 9665 | SEOB2812 |
| 9666 | SEOB2813 |
| 9667 | SEOB2814 |
| 9668 | SEOB2816 |
| 9669 | SEOB2817 |
| 9670 | SEOB2914 |
| 9671 | SEOB2916 |
| 9672 | SEOB2917 |
| 9673 | SEOB2918 |
| 9674 | SEOB2919 |
| 9675 | SEOB2920 |
| 9676 | SEOB2921 |
| 9677 | SEOB2924 |
| 9678 | SEOB2925 |
| 9679 | SEOB2926 |
| 9680 | SEOB2927 |
| 9681 | SEOB2929 |
| 9682 | SEOB2930 |
| 9683 | SEOB2932 |
| 9684 | SEOB2934 |
| 9685 | SEOB2936 |
| 9686 | SEOB2937 |
| 9687 | SEOB2938 |
| 9688 | SEOB2939 |
| 9689 | SEOB2940 |
| 9690 | SEOB2941 |
| 9691 | SEOB2942 |
| 9692 | SEOB2944 |
| 9693 | SEOB2945 |
| 9694 | SEOB2946 |
| 9695 | SEOB2947 |
| 9696 | SEOB2948 |
| 9697 | SEOB2950 |
| 9698 | SEOB2951 |
| 9699 | SEOB2952 |
| 9700 | SEOB2953 |
| 9701 | SEOB2954 |
| 9702 | SEOB2955 |
| 9703 | SEOB2956 |
| 9704 | SEOB2957 |
| 9705 | SEOB2958 |
| 9706 | SEOB2959 |
| 9707 | seob2960n |
| 9708 | SEOB2962 |
| 9709 | SEOB2964 |
| 9710 | SEOB2965 |
| 9711 | SEOB2966 |
| 9712 | SEOB2967 |
| 9713 | SEOB2969 |
| 9714 | SEOB2972 |
| 9715 | SEOB2973 |
| 9716 | SEOB2974 |
| 9717 | SEOB2976 |
| 9718 | SEOB2978 |
| 9719 | SEOB2979 |
| 9720 | SEOB2980 |
| 9721 | SEOB2981 |
| 9722 | SEOB2983 |
| 9723 | SEOB2984 |
| 9724 | SEOB2985 |
| 9725 | SEOB2986 |
| 9726 | SEOB2987 |
| 9727 | SEOB2988 |
| 9728 | SEOB2989 |
| 9729 | SEOB2990 |
| 9730 | SEOB2991 |
| 9731 | SEOB2994 |
| 9732 | SEOB2995 |
| 9733 | SEOB2996 |
| 9734 | SEOB2998 |
| 9735 | SEOB2999 |
| 9736 | SEOB3000 |
| 9737 | SEOB3002 |
| 9738 | SEOB3003 |
| 9739 | SEOB3004 |
| 9740 | SEOB3005 |
| 9741 | SEOB3006 |
| 9742 | SEOB3007 |
| 9743 | SEOB3008 |
| 9744 | SEOB3009 |
| 9745 | SEOB3010 |
| 9746 | SEOB3011 |
| 9747 | SEOB3012 |
| 9748 | SEOB3014 |
| 9749 | SEOB3015 |
| 9750 | SEOB3017 |
| 9751 | SEOB3018 |
| 9752 | SEOB3020 |
| 9753 | SEOB3025 |
| 9754 | SEOB3026 |
| 9755 | SEOB3027 |
| 9756 | SEOB3029 |
| 9757 | SEOB3033 |
| 9758 | SEOB3035 |
| 9759 | SEOB3037 |
| 9760 | SEOB3038 |
| 9761 | SEOB3039 |
| 9762 | SEOB3041 |
| 9763 | SEOB3042 |
| 9764 | SEOB3045 |
| 9765 | SEOB3047 |
| 9766 | SEOB3048 |
| 9767 | SEOB3049 |
| 9768 | SEOB3050 |
| 9769 | SEOB3051 |
| 9770 | SEOB3052 |
| 9771 | SEOB3053 |
| 9772 | SEOB3054 |
| 9773 | SEOB3055 |
| 9774 | SEOB3056 |
| 9775 | SEOB3057 |
| 9776 | SEOB3058 |
| 9777 | SEOB3059 |
| 9778 | SEOB3061 |
| 9779 | SEOB3063 |
| 9780 | SEOB3064 |
| 9781 | seob3065n |
| 9782 | SEOB3066 |
| 9783 | SEOB3067 |
| 9784 | SEOB3068 |
| 9785 | SEOB3069 |
| 9786 | SEOB3072 |
| 9787 | SEOB3073 |
| 9788 | SEOB3074 |
| 9789 | SEOB3075 |
| 9790 | SEOB3076 |
| 9791 | SEOB3077 |
| 9792 | SEOB3078 |
| 9793 | SEOB3079 |
| 9794 | SEOB3081 |
| 9795 | SEOB3082 |
| 9796 | SEOB3083 |
| 9797 | SEOB3085 |
| 9798 | SEOB3086 |
| 9799 | SEOB3088 |
| 9800 | SEOB3090 |
| 9801 | SEOB3091 |
| 9802 | SEOB3092 |
| 9803 | SEOB3093 |
| 9804 | SEOB3095 |
| 9805 | SEOB3096 |
| 9806 | SEOB3097 |
| 9807 | SEOB3098 |
| 9808 | SEOB3099 |
| 9809 | SEOB3100 |
| 9810 | SEOB3101 |
| 9811 | SEOB3102 |
| 9812 | SEOB3103 |
| 9813 | SEOB3104 |
| 9814 | SEOB3105 |
| 9815 | SEOB3106 |
| 9816 | SEOB3107 |
| 9817 | SEOB3108 |
| 9818 | SEOB3109 |
| 9819 | SEOB3110 |
| 9820 | SEOB3111 |
| 9821 | SEOB3112 |
| 9822 | SEOB3113 |
| 9823 | SEOB3114 |
| 9824 | SEOB3115 |
| 9825 | SEOB3116 |
| 9826 | SEOB3117 |
| 9827 | SEOB3118 |
| 9828 | SEOB3119 |
| 9829 | SEOB3120 |
| 9830 | SEOB3121 |
| 9831 | SEOB3122 |
| 9832 | SEOB3123 |
| 9833 | SEOB3127 |
| 9834 | SEOB3128 |
| 9835 | seob3129n |
| 9836 | SEOB3130 |
| 9837 | SEOB3131 |
| 9838 | SEOB3133 |
| 9839 | SEOB3134 |
| 9840 | SEOB3135 |
| 9841 | SEOB3136 |
| 9842 | SEOB3137 |
| 9843 | SEOB3138 |
| 9844 | SEOB3139 |
| 9845 | SEOB3140 |
| 9846 | SEOB3141 |
| 9847 | SEOB3142 |
| 9848 | SEOB3143 |
| 9849 | SEOB3144 |
| 9850 | SEOB3145 |
| 9851 | SEOB3148 |
| 9852 | SEOB3149 |
| 9853 | SEOB3150 |
| 9854 | SEOB3151 |
| 9855 | SEOB3152 |
| 9856 | SEOB3153 |
| 9857 | SEOB3154 |
| 9858 | SEOB3155 |
| 9859 | SEOB3156 |
| 9860 | SEOB3157 |
| 9861 | SEOB3158 |
| 9862 | SEOB3162 |
| 9863 | SEOB3163 |
| 9864 | SEOB3164 |
| 9865 | SEOB3165 |
| 9866 | SEOB3166 |
| 9867 | SEOB3168 |
| 9868 | SEOB3169 |
| 9869 | SEOB3170 |
| 9870 | SEOB3171 |
| 9871 | SEOB3172 |
| 9872 | SEOB3174 |
| 9873 | SEOB3175 |
| 9874 | SEOB3176 |
| 9875 | SEOB3177 |
| 9876 | SEOB3178 |
| 9877 | SEOB3179 |
| 9878 | SEOB3180 |
| 9879 | SEOB3181 |
| 9880 | SEOB3182 |
| 9881 | SEOB3183 |
| 9882 | SEOB3184 |
| 9883 | seob3185 |
| 9884 | SEOB3186 |
| 9885 | SEOB3187 |
| 9886 | SEOB3189 |
| 9887 | SEOB3190 |
| 9888 | SEOB3191 |
| 9889 | SEOB3192 |
| 9890 | SEOB3193 |
| 9891 | SEOB3194 |
| 9892 | SEOB3195 |
| 9893 | SEOB3196 |
| 9894 | SEOB3197 |
| 9895 | SEOB3201 |
| 9896 | SEOB3203 |
| 9897 | SEOB3204 |
| 9898 | SEOB3206 |
| 9899 | SEOB3207 |
| 9900 | SEOB3209 |

Figure 6E – List of EST Sequence Names From Severe OA Cartilage cDNA Library

| | | | | | | | | | |
|---|---|---|---|---|---|---|---|---|---|
| 9901 | SEOB3210 | 9961 | seob3279n | 10021 | SEOB3364 | 10081 | SEOB3432 | 10141 | SEOB3503 |
| 9902 | SEOB3211 | 9962 | SEOB3281 | 10022 | SEOB3365 | 10082 | SEOB3435 | 10142 | SEOB3504 |
| 9903 | SEOB3212 | 9963 | SEOB3291 | 10023 | SEOB3366 | 10083 | SEOB3436 | 10143 | SEOB3506 |
| 9904 | SEOB3213 | 9964 | SEOB3294 | 10024 | SEOB3367 | 10084 | SEOB3437 | 10144 | SEOB3507 |
| 9905 | SEOB3214 | 9965 | SEOB3295 | 10025 | SEOB3368 | 10085 | SEOB3440 | 10145 | SEOB3508 |
| 9906 | SEOB3215 | 9966 | SEOB3296 | 10026 | SEOB3369 | 10086 | SEOB3441 | 10146 | SEOB3509 |
| 9907 | SEOB3216 | 9967 | SEOB3297 | 10027 | SEOB3370 | 10087 | SEOB3443 | 10147 | SEOB3510 |
| 9908 | SEOB3217 | 9968 | SEOB3299 | 10028 | SEOB3371 | 10088 | SEOB3444 | 10148 | SEOB3511 |
| 9909 | SEOB3218 | 9969 | SEOB3300 | 10029 | SEOB3374 | 10089 | SEOB3446 | 10149 | SEOB3512 |
| 9910 | SEOB3219 | 9970 | SEOB3301 | 10030 | SEOB3376 | 10090 | SEOB3447 | 10150 | SEOB3513 |
| 9911 | SEOB3220 | 9971 | SEOB3302 | 10031 | SEOB3377 | 10091 | SEOB3448 | 10151 | SEOB3514 |
| 9912 | SEOB3221 | 9972 | SEOB3303 | 10032 | SEOB3378 | 10092 | SEOB3450 | 10152 | SEOB3517 |
| 9913 | SEOB3224 | 9973 | SEOB3304 | 10033 | SEOB3379 | 10093 | SEOB3451 | 10153 | SEOB3518 |
| 9914 | SEOB3225 | 9974 | SEOB3305 | 10034 | SEOB3380 | 10094 | SEOB3452 | 10154 | SEOB3519 |
| 9915 | SEOB3226 | 9975 | SEOB3307 | 10035 | SEOB3381 | 10095 | SEOB3453 | 10155 | SEOB3520 |
| 9916 | SEOB3227 | 9976 | SEOB3308 | 10036 | SEOB3382 | 10096 | SEOB3454 | 10156 | SEOB3521 |
| 9917 | SEOB3228 | 9977 | SEOB3309 | 10037 | SEOB3383 | 10097 | SEOB3455 | 10157 | SEOB3522 |
| 9918 | SEOB3229 | 9978 | SEOB3310 | 10038 | SEOB3384 | 10098 | SEOB3456 | 10158 | SEOB3523 |
| 9919 | SEOB3230 | 9979 | SEOB3312 | 10039 | SEOB3385 | 10099 | SEOB3457 | 10159 | SEOB3524 |
| 9920 | SEOB3231 | 9980 | SEOB3313 | 10040 | SEOB3386 | 10100 | SEOB3458 | 10160 | SEOB3525 |
| 9921 | SEOB3233 | 9981 | SEOB3314 | 10041 | seob3387n | 10101 | SEOB3459 | 10161 | SEOB3526 |
| 9922 | SEOB3234 | 9982 | SEOB3315 | 10042 | SEOB3388 | 10102 | SEOB3460 | 10162 | SEOB3528 |
| 9923 | SEOB3235 | 9983 | SEOB3316 | 10043 | SEOB3389 | 10103 | SEOB3461 | 10163 | SEOB3530 |
| 9924 | SEOB3236 | 9984 | SEOB3317 | 10044 | SEOB3390 | 10104 | SEOB3462 | 10164 | SEOB3531 |
| 9925 | SEOB3237 | 9985 | SEOB3318 | 10045 | SEOB3392 | 10105 | SEOB3463 | 10165 | SEOB3532 |
| 9926 | SEOB3238 | 9986 | SEOB3319 | 10046 | SEOB3393 | 10106 | SEOB3464 | 10166 | SEOB3533 |
| 9927 | SEOB3239 | 9987 | SEOB3320 | 10047 | SEOB3394 | 10107 | SEOB3465 | 10167 | SEOB3534 |
| 9928 | SEOB3240 | 9988 | SEOB3321 | 10048 | SEOB3395 | 10108 | SEOB3466 | 10168 | SEOB3535 |
| 9929 | SEOB3241 | 9989 | SEOB3322 | 10049 | SEOB3397 | 10109 | SEOB3467 | 10169 | SEOB3537 |
| 9930 | SEOB3243 | 9990 | SEOB3323 | 10050 | SEOB3398 | 10110 | SEOB3468 | 10170 | SEOB3538 |
| 9931 | SEOB3244 | 9991 | SEOB3325 | 10051 | SEOB3399 | 10111 | SEOB3469 | 10171 | seob3539n |
| 9932 | SEOB3245 | 9992 | SEOB3326 | 10052 | SEOB3400 | 10112 | SEOB3470 | 10172 | SEOB3540 |
| 9933 | SEOB3247 | 9993 | SEOB3327 | 10053 | SEOB3401 | 10113 | SEOB3471 | 10173 | SEOB3541 |
| 9934 | SEOB3248 | 9994 | SEOB3328 | 10054 | SEOB3402 | 10114 | SEOB3474 | 10174 | SEOB3542 |
| 9935 | SEOB3249 | 9995 | SEOB3329 | 10055 | SEOB3403 | 10115 | SEOB3475 | 10175 | SEOB3545 |
| 9936 | SEOB3252 | 9996 | SEOB3330 | 10056 | SEOB3404 | 10116 | SEOB3476 | 10176 | SEOB3546 |
| 9937 | SEOB3253 | 9997 | SEOB3331 | 10057 | SEOB3405 | 10117 | SEOB3477 | 10177 | SEOB3547 |
| 9938 | SEOB3254 | 9998 | SEOB3332 | 10058 | SEOB3407 | 10118 | SEOB3478 | 10178 | SEOB3548 |
| 9939 | SEOB3255 | 9999 | SEOB3333 | 10059 | SEOB3408 | 10119 | SEOB3479 | 10179 | SEOB3549 |
| 9940 | SEOB3256 | 10000 | SEOB3336 | 10060 | SEOB3409 | 10120 | SEOB3480 | 10180 | SEOB3550 |
| 9941 | SEOB3257 | 10001 | SEOB3337 | 10061 | SEOB3411 | 10121 | seob3481 | 10181 | SEOB3551 |
| 9942 | SEOB3258 | 10002 | SEOB3338 | 10062 | SEOB3413 | 10122 | SEOB3483 | 10182 | SEOB3553 |
| 9943 | seob3259n | 10003 | SEOB3341 | 10063 | SEOB3414 | 10123 | SEOB3485 | 10183 | SEOB3554 |
| 9944 | SEOB3260 | 10004 | SEOB3343 | 10064 | SEOB3415 | 10124 | SEOB3486 | 10184 | SEOB3555 |
| 9945 | SEOB3261 | 10005 | SEOB3344 | 10065 | SEOB3416 | 10125 | SEOB3487 | 10185 | SEOB3556 |
| 9946 | SEOB3262 | 10006 | SEOB3346 | 10066 | SEOB3417 | 10126 | SEOB3488 | 10186 | SEOB3558 |
| 9947 | SEOB3263 | 10007 | SEOB3347 | 10067 | SEOB3418 | 10127 | SEOB3489 | 10187 | SEOB3559 |
| 9948 | seob3264 | 10008 | SEOB3348 | 10068 | SEOB3419 | 10128 | SEOB3490 | 10188 | SEOB3560 |
| 9949 | SEOB3265 | 10009 | SEOB3349 | 10069 | SEOB3420 | 10129 | SEOB3491 | 10189 | SEOB3561 |
| 9950 | seob3266 | 10010 | SEOB3350 | 10070 | SEOB3421 | 10130 | SEOB3492 | 10190 | SEOB3562 |
| 9951 | seob3267n | 10011 | SEOB3351 | 10071 | SEOB3422 | 10131 | SEOB3493 | 10191 | SEOB3563 |
| 9952 | seob3268 | 10012 | SEOB3354 | 10072 | SEOB3423 | 10132 | seob3494n | 10192 | SEOB3564 |
| 9953 | seob3269 | 10013 | SEOB3355 | 10073 | SEOB3424 | 10133 | SEOB3495 | 10193 | SEOB3565 |
| 9954 | SEOB3270 | 10014 | SEOB3356 | 10074 | SEOB3425 | 10134 | SEOB3496 | 10194 | SEOB3566 |
| 9955 | seob3271 | 10015 | SEOB3357 | 10075 | SEOB3426 | 10135 | SEOB3497 | 10195 | SEOB3568 |
| 9956 | seob3272 | 10016 | SEOB3358 | 10076 | SEOB3427 | 10136 | SEOB3498 | 10196 | SEOB3569 |
| 9957 | SEOB3273 | 10017 | SEOB3359 | 10077 | SEOB3428 | 10137 | SEOB3499 | 10197 | SEOB3570 |
| 9958 | SEOB3275 | 10018 | SEOB3360 | 10078 | SEOB3429 | 10138 | SEOB3500 | 10198 | SEOB3571 |
| 9959 | SEOB3277 | 10019 | SEOB3361 | 10079 | SEOB3430 | 10139 | SEOB3501 | 10199 | SEOB3573 |
| 9960 | SEOB3278 | 10020 | SEOB3362 | 10080 | SEOB3431 | 10140 | SEOB3502 | 10200 | SEOB3574 |

Figure 6E - List of EST Sequence Names From Severe OA Cartilage cDNA Library

| | | | | | | | | | |
|---|---|---|---|---|---|---|---|---|---|
| 10201 | SEOB3575 | 10261 | seob3682 | 10321 | seob3834 | 10381 | seob3912 | 10441 | seob3986 |
| 10202 | SEOB3576 | 10262 | seob3683 | 10322 | seob3836 | 10382 | seob3913 | 10442 | seob3987 |
| 10203 | SEOB3577 | 10263 | seob3684 | 10323 | seob3837 | 10383 | seob3914 | 10443 | seob3989 |
| 10204 | SEOB3578 | 10264 | seob3685 | 10324 | seob3838 | 10384 | seob3915 | 10444 | seob3990 |
| 10205 | SEOB3580 | 10265 | seob3686 | 10325 | seob3840 | 10385 | seob3916 | 10445 | seob3991 |
| 10206 | SEOB3581 | 10266 | seob3688 | 10326 | seob3841 | 10386 | seob3917 | 10446 | seob3992 |
| 10207 | SEOB3582 | 10267 | seob3689 | 10327 | seob3842 | 10387 | seob3918 | 10447 | seob3994 |
| 10208 | SEOB3584 | 10268 | seob3690 | 10328 | seob3843 | 10388 | seob3919 | 10448 | seob3995 |
| 10209 | SEOB3585 | 10269 | seob3692 | 10329 | seob3844 | 10389 | seob3920 | 10449 | seob3996 |
| 10210 | SEOB3587 | 10270 | seob3694 | 10330 | seob3845 | 10390 | seob3921 | 10450 | seob3997 |
| 10211 | SEOB3588 | 10271 | seob3695 | 10331 | seob3847 | 10391 | seob3922 | 10451 | seob3998 |
| 10212 | SEOB3589 | 10272 | seob3696 | 10332 | seob3852 | 10392 | seob3923 | 10452 | seob3999 |
| 10213 | SEOB3590 | 10273 | seob3697 | 10333 | seob3854 | 10393 | seob3924 | 10453 | seob4000 |
| 10214 | SEOB3591 | 10274 | seob3698 | 10334 | seob3855 | 10394 | seob3925 | 10454 | seob4001 |
| 10215 | SEOB3593 | 10275 | seob3699 | 10335 | seob3856 | 10395 | seob3926 | 10455 | seob4002 |
| 10216 | SEOB3594 | 10276 | seob3700 | 10336 | seob3857 | 10396 | seob3927 | 10456 | seob4003 |
| 10217 | SEOB3595 | 10277 | seob3701 | 10337 | seob3858 | 10397 | seob3929 | 10457 | seob4004 |
| 10218 | SEOB3596 | 10278 | seob3702 | 10338 | seob3859 | 10398 | seob3930 | 10458 | seob4005 |
| 10219 | SEOB3597 | 10279 | seob3703 | 10339 | seob3860 | 10399 | seob3933 | 10459 | seob4006 |
| 10220 | SEOB3599 | 10280 | seob3704 | 10340 | seob3861 | 10400 | seob3935 | 10460 | seob4008 |
| 10221 | seob3601 | 10281 | seob3705 | 10341 | seob3862 | 10401 | seob3936 | 10461 | seob4009 |
| 10222 | seob3602 | 10282 | seob3707 | 10342 | seob3865 | 10402 | seob3937 | 10462 | seob4010 |
| 10223 | seob3603 | 10283 | seob3709 | 10343 | seob3866 | 10403 | seob3938 | 10463 | seob4011 |
| 10224 | seob3642 | 10284 | seob3710 | 10344 | seob3867 | 10404 | seob3940 | 10464 | seob4012 |
| 10225 | seob3643n | 10285 | seob3711 | 10345 | seob3868 | 10405 | seob3941 | 10465 | seob4013 |
| 10226 | seob3644 | 10286 | seob3712 | 10346 | seob3869 | 10406 | seob3942 | 10466 | seob4014 |
| 10227 | seob3645 | 10287 | seob3713 | 10347 | seob3870 | 10407 | seob3943 | 10467 | seob4017 |
| 10228 | seob3646 | 10288 | seob3714 | 10348 | seob3872 | 10408 | seob3944 | 10468 | seob4018 |
| 10229 | seob3647 | 10289 | seob3715 | 10349 | seob3873 | 10409 | seob3945 | 10469 | seob4019 |
| 10230 | seob3648 | 10290 | seob3716 | 10350 | seob3875 | 10410 | seob3946 | 10470 | seob4020 |
| 10231 | seob3649 | 10291 | seob3717 | 10351 | seob3876 | 10411 | seob3947 | 10471 | seob4021 |
| 10232 | seob3650 | 10292 | seob3718 | 10352 | seob3877 | 10412 | seob3948 | 10472 | seob4022 |
| 10233 | seob3653 | 10293 | seob3719 | 10353 | seob3878 | 10413 | seob3949 | 10473 | seob4023 |
| 10234 | seob3654 | 10294 | seob3720 | 10354 | seob3879 | 10414 | seob3951 | 10474 | seob4026 |
| 10235 | seob3655 | 10295 | seob3722 | 10355 | seob3881 | 10415 | seob3952 | 10475 | seob4028 |
| 10236 | seob3657 | 10296 | seob3723 | 10356 | seob3882 | 10416 | seob3953 | 10476 | seob4029 |
| 10237 | seob3658 | 10297 | seob3725 | 10357 | seob3883 | 10417 | seob3955 | 10477 | seob4030 |
| 10238 | seob3659 | 10298 | seob3726 | 10358 | seob3884 | 10418 | seob3956 | 10478 | seob4032 |
| 10239 | seob3660 | 10299 | seob3727 | 10359 | seob3885 | 10419 | seob3958 | 10479 | seob4033 |
| 10240 | seob3661 | 10300 | seob3729 | 10360 | seob3886 | 10420 | seob3960 | 10480 | seob4034 |
| 10241 | seob3662 | 10301 | seob3730 | 10361 | seob3887 | 10421 | seob3961 | 10481 | seob4035 |
| 10242 | seob3663 | 10302 | seob3731 | 10362 | seob3888 | 10422 | seob3962 | 10482 | seob4036 |
| 10243 | seob3664 | 10303 | seob3732 | 10363 | seob3889 | 10423 | seob3963 | 10483 | seob4037 |
| 10244 | seob3665 | 10304 | seob3734 | 10364 | seob3890 | 10424 | seob3964 | 10484 | seob4038 |
| 10245 | seob3666 | 10305 | seob3738 | 10365 | seob3891 | 10425 | seob3965 | 10485 | seob4039 |
| 10246 | seob3667 | 10306 | seob3739 | 10366 | seob3892 | 10426 | seob3966 | 10486 | seob4040 |
| 10247 | seob3668 | 10307 | seob3740 | 10367 | seob3893 | 10427 | seob3969 | 10487 | seob4041 |
| 10248 | seob3669 | 10308 | seob3741 | 10368 | seob3894 | 10428 | seob3970 | 10488 | seob4042 |
| 10249 | seob3670 | 10309 | seob3743 | 10369 | seob3896 | 10429 | seob3972 | 10489 | seob4044 |
| 10250 | seob3671 | 10310 | seob3744 | 10370 | seob3897 | 10430 | seob3973 | 10490 | seob4045 |
| 10251 | seob3672 | 10311 | seob3747 | 10371 | seob3898 | 10431 | seob3975 | 10491 | seob4047 |
| 10252 | seob3673 | 10312 | seob3748 | 10372 | seob3899 | 10432 | seob3976 | 10492 | seob4049 |
| 10253 | seob3674 | 10313 | seob3749 | 10373 | seob3901 | 10433 | seob3977 | 10493 | seob4050 |
| 10254 | seob3675 | 10314 | seob3750 | 10374 | seob3902 | 10434 | seob3978 | 10494 | seob4051 |
| 10255 | seob3676 | 10315 | seob3751 | 10375 | seob3903 | 10435 | seob3979 | 10495 | seob4053 |
| 10256 | seob3677 | 10316 | seob3753 | 10376 | seob3904 | 10436 | seob3980 | 10496 | seob4054 |
| 10257 | seob3678 | 10317 | seob3754 | 10377 | seob3905 | 10437 | seob3982 | 10497 | seob4056 |
| 10258 | seob3679 | 10318 | seob3755 | 10378 | seob3908 | 10438 | seob3983 | 10498 | seob4057 |
| 10259 | seob3680 | 10319 | seob3756 | 10379 | seob3910 | 10439 | seob3984 | 10499 | seob4058 |
| 10260 | seob3681 | 10320 | seob3757 | 10380 | seob3911 | 10440 | seob3985 | 10500 | seob4059 |

Figure 6E – List of EST Sequence Names From Severe OA Cartilage cDNA Library

| | | | | | | | | | |
|---|---|---|---|---|---|---|---|---|---|
| 10501 | seob4060 | 10561 | seob4125 | 10621 | seob4191 | 10681 | seob4263 | 10741 | seob4342 |
| 10502 | seob4061 | 10562 | seob4126 | 10622 | seob4192 | 10682 | seob4264 | 10742 | seob4345 |
| 10503 | seob4062 | 10563 | seob4127 | 10623 | seob4195 | 10683 | seob4265 | 10743 | seob4346 |
| 10504 | seob4063 | 10564 | seob4128 | 10624 | seob4196 | 10684 | seob4266 | 10744 | seob4349 |
| 10505 | seob4064 | 10565 | seob4129 | 10625 | seob4197 | 10685 | seob4267 | 10745 | seob4351 |
| 10506 | seob4065 | 10566 | seob4130 | 10626 | seob4198 | 10686 | seob4268 | 10746 | seob4352 |
| 10507 | seob4066 | 10567 | seob4131 | 10627 | seob4199 | 10687 | seob4269 | 10747 | seob4353 |
| 10508 | seob4067 | 10568 | seob4132 | 10628 | seob4200 | 10688 | seob4270 | 10748 | seob4355 |
| 10509 | seob4068 | 10569 | seob4133 | 10629 | seob4201 | 10689 | seob4271 | 10749 | seob4356 |
| 10510 | seob4069 | 10570 | seob4134 | 10630 | seob4202 | 10690 | seob4272 | 10750 | seob4357 |
| 10511 | seob4070 | 10571 | seob4135 | 10631 | seob4203 | 10691 | seob4273 | 10751 | seob4358 |
| 10512 | seob4071 | 10572 | seob4136 | 10632 | seob4204 | 10692 | seob4274 | 10752 | seob4359 |
| 10513 | seob4073 | 10573 | seob4137 | 10633 | seob4205 | 10693 | seob4276 | 10753 | seob4360 |
| 10514 | seob4074 | 10574 | seob4138 | 10634 | seob4206 | 10694 | seob4277 | 10754 | seob4362 |
| 10515 | seob4075 | 10575 | seob4139 | 10635 | seob4207 | 10695 | seob4278 | 10755 | seob4363 |
| 10516 | seob4076 | 10576 | seob4140 | 10636 | seob4208 | 10696 | seob4280 | 10756 | seob4366 |
| 10517 | seob4077 | 10577 | seob4141 | 10637 | seob4209 | 10697 | seob4281 | 10757 | seob4368 |
| 10518 | seob4078 | 10578 | seob4143 | 10638 | seob4210 | 10698 | seob4282 | 10758 | seob4369 |
| 10519 | seob4079 | 10579 | seob4144 | 10639 | seob4211 | 10699 | seob4283 | 10759 | seob4370 |
| 10520 | seob4080 | 10580 | seob4145 | 10640 | seob4212 | 10700 | seob4284 | 10760 | seob4372 |
| 10521 | seob4081 | 10581 | seob4146 | 10641 | seob4213 | 10701 | seob4285 | 10761 | seob4374 |
| 10522 | seob4082 | 10582 | seob4147 | 10642 | seob4214 | 10702 | seob4286 | 10762 | seob4375 |
| 10523 | seob4083 | 10583 | seob4148 | 10643 | seob4215 | 10703 | seob4287 | 10763 | seob4377 |
| 10524 | seob4084 | 10584 | seob4149 | 10644 | seob4216 | 10704 | seob4288 | 10764 | seob4378 |
| 10525 | seob4085 | 10585 | seob4150 | 10645 | seob4217 | 10705 | seob4290 | 10765 | seob4379 |
| 10526 | seob4086 | 10586 | seob4152 | 10646 | seob4218 | 10706 | seob4291 | 10766 | seob4380 |
| 10527 | seob4087 | 10587 | seob4153 | 10647 | seob4219 | 10707 | seob4292 | 10767 | seob4381 |
| 10528 | seob4088 | 10588 | seob4154 | 10648 | seob4220 | 10708 | seob4293 | 10768 | seob4382 |
| 10529 | seob4089 | 10589 | seob4155 | 10649 | seob4223 | 10709 | seob4294 | 10769 | seob4383 |
| 10530 | seob4090 | 10590 | seob4156 | 10650 | seob4224 | 10710 | seob4295 | 10770 | seob4384 |
| 10531 | seob4091 | 10591 | seob4157 | 10651 | seob4225 | 10711 | seob4296 | 10771 | seob4385n |
| 10532 | seob4092 | 10592 | seob4158 | 10652 | seob4226 | 10712 | seob4297 | 10772 | seob4389 |
| 10533 | seob4093 | 10593 | seob4160 | 10653 | seob4228 | 10713 | seob4298 | 10773 | seob4390 |
| 10534 | seob4094 | 10594 | seob4161 | 10654 | seob4229 | 10714 | seob4301n | 10774 | seob4393 |
| 10535 | seob4095 | 10595 | seob4162 | 10655 | seob4230 | 10715 | seob4302 | 10775 | seob4394 |
| 10536 | seob4096 | 10596 | seob4163 | 10656 | seob4231 | 10716 | seob4303 | 10776 | seob4400 |
| 10537 | seob4097 | 10597 | seob4164 | 10657 | seob4232 | 10717 | seob4304 | 10777 | seob4401 |
| 10538 | seob4098 | 10598 | seob4165 | 10658 | seob4233 | 10718 | seob4305 | 10778 | seob4404 |
| 10539 | seob4099 | 10599 | seob4166 | 10659 | seob4234 | 10719 | seob4306 | 10779 | seob4409 |
| 10540 | seob4100 | 10600 | seob4167 | 10660 | seob4235 | 10720 | seob4308 | 10780 | seob4410 |
| 10541 | seob4101 | 10601 | seob4168 | 10661 | seob4237 | 10721 | seob4309 | 10781 | seob4411 |
| 10542 | seob4102 | 10602 | seob4169 | 10662 | seob4240 | 10722 | seob4311 | 10782 | seob4412 |
| 10543 | seob4103 | 10603 | seob4170 | 10663 | seob4241 | 10723 | seob4312 | 10783 | seob4413 |
| 10544 | seob4104 | 10604 | seob4171 | 10664 | seob4242 | 10724 | seob4313 | 10784 | seob4414 |
| 10545 | seob4105 | 10605 | seob4172 | 10665 | seob4243 | 10725 | seob4314 | 10785 | seob4415 |
| 10546 | seob4107 | 10606 | seob4173 | 10666 | seob4244 | 10726 | seob4317 | 10786 | seob4416 |
| 10547 | seob4108 | 10607 | seob4174 | 10667 | seob4246 | 10727 | seob4321 | 10787 | seob4417 |
| 10548 | seob4109 | 10608 | seob4175 | 10668 | seob4247 | 10728 | seob4322 | 10788 | seob4418 |
| 10549 | seob4110 | 10609 | seob4176 | 10669 | seob4248 | 10729 | seob4325 | 10789 | seob4419 |
| 10550 | seob4112 | 10610 | seob4177 | 10670 | seob4249 | 10730 | seob4326 | 10790 | seob4420 |
| 10551 | seob4113 | 10611 | seob4178 | 10671 | seob4251 | 10731 | seob4327 | 10791 | seob4421 |
| 10552 | seob4114 | 10612 | seob4179 | 10672 | seob4252 | 10732 | seob4331 | 10792 | seob4422 |
| 10553 | seob4115 | 10613 | seob4182 | 10673 | seob4254 | 10733 | seob4332 | 10793 | seob4423 |
| 10554 | seob4116 | 10614 | seob4183 | 10674 | seob4255 | 10734 | seob4333 | 10794 | seob4424 |
| 10555 | seob4117 | 10615 | seob4184 | 10675 | seob4256 | 10735 | seob4335 | 10795 | seob4425 |
| 10556 | seob4118 | 10616 | seob4185 | 10676 | seob4258 | 10736 | seob4337 | 10796 | seob4426 |
| 10557 | seob4119 | 10617 | seob4187 | 10677 | seob4259 | 10737 | seob4338 | 10797 | seob4427 |
| 10558 | seob4120 | 10618 | seob4188 | 10678 | seob4260 | 10738 | seob4339 | 10798 | seob4429 |
| 10559 | seob4121 | 10619 | seob4189 | 10679 | seob4261n | 10739 | seob4340 | 10799 | seob4430 |
| 10560 | seob4122 | 10620 | seob4190 | 10680 | seob4262 | 10740 | seob4341 | 10800 | seob4431 |

Figure 6E – List of EST Sequence Names From Severe OA Cartilage cDNA Library

| | | | | | | | | | |
|---|---|---|---|---|---|---|---|---|---|
| 10801 | seob4433 | 10861 | seob4500 | 10921 | seob4586 | 10981 | seob4654 | 11041 | seob4726 |
| 10802 | seob4434 | 10862 | seob4502 | 10922 | seob4587 | 10982 | seob4655 | 11042 | seob4728 |
| 10803 | seob4435 | 10863 | seob4503 | 10923 | seob4589 | 10983 | seob4656 | 11043 | seob4730 |
| 10804 | seob4438 | 10864 | seob4504 | 10924 | seob4590 | 10984 | seob4657 | 11044 | seob4731 |
| 10805 | seob4439 | 10865 | seob4505 | 10925 | seob4591 | 10985 | seob4658 | 11045 | seob4732 |
| 10806 | seob4440 | 10866 | seob4506 | 10926 | seob4592 | 10986 | seob4659 | 11046 | seob4733 |
| 10807 | seob4441 | 10867 | seob4508 | 10927 | seob4593 | 10987 | seob4660 | 11047 | seob4734 |
| 10808 | seob4442 | 10868 | seob4515 | 10928 | seob4594 | 10988 | seob4661 | 11048 | seob4735 |
| 10809 | seob4443 | 10869 | seob4516 | 10929 | seob4595 | 10989 | seob4662 | 11049 | seob4736 |
| 10810 | seob4444 | 10870 | seob4517 | 10930 | seob4596 | 10990 | seob4663 | 11050 | seob4737 |
| 10811 | seob4445 | 10871 | seob4518 | 10931 | seob4598 | 10991 | seob4664 | 11051 | seob4738 |
| 10812 | seob4446 | 10872 | seob4522 | 10932 | seob4599 | 10992 | seob4665 | 11052 | seob4739 |
| 10813 | seob4447 | 10873 | seob4523 | 10933 | seob4600 | 10993 | seob4666 | 11053 | seob4740 |
| 10814 | seob4448 | 10874 | seob4524 | 10934 | seob4601 | 10994 | seob4667 | 11054 | seob4741 |
| 10815 | seob4450 | 10875 | seob4525 | 10935 | seob4602 | 10995 | seob4668 | 11055 | seob4742 |
| 10816 | seob4451 | 10876 | seob4526 | 10936 | seob4603 | 10996 | seob4669 | 11056 | seob4743 |
| 10817 | seob4452 | 10877 | seob4527 | 10937 | seob4604 | 10997 | seob4670 | 11057 | seob4744 |
| 10818 | seob4453 | 10878 | seob4528 | 10938 | seob4605 | 10998 | seob4671 | 11058 | seob4745 |
| 10819 | seob4454 | 10879 | seob4529 | 10939 | seob4606 | 10999 | seob4672 | 11059 | seob4746 |
| 10820 | seob4455 | 10880 | seob4530 | 10940 | seob4607 | 11000 | seob4673 | 11060 | seob4747 |
| 10821 | seob4456 | 10881 | seob4531 | 10941 | seob4608 | 11001 | seob4675 | 11061 | seob4748 |
| 10822 | seob4457 | 10882 | seob4532 | 10942 | seob4609 | 11002 | seob4676 | 11062 | seob4749 |
| 10823 | seob4458 | 10883 | seob4534 | 10943 | seob4611 | 11003 | seob4677 | 11063 | seob4750 |
| 10824 | seob4459 | 10884 | seob4536 | 10944 | seob4612 | 11004 | seob4679 | 11064 | seob4751 |
| 10825 | seob4460 | 10885 | seob4537 | 10945 | seob4613 | 11005 | seob4680 | 11065 | seob4752 |
| 10826 | seob4461 | 10886 | seob4538 | 10946 | seob4614 | 11006 | seob4681 | 11066 | seob4753 |
| 10827 | seob4462 | 10887 | seob4539 | 10947 | seob4615 | 11007 | seob4685 | 11067 | seob4754 |
| 10828 | seob4463 | 10888 | seob4540 | 10948 | seob4616 | 11008 | seob4686 | 11068 | seob4755 |
| 10829 | seob4465 | 10889 | seob4541 | 10949 | seob4617 | 11009 | seob4689 | 11069 | seob4756 |
| 10830 | seob4466 | 10890 | seob4542 | 10950 | seob4618 | 11010 | seob4690 | 11070 | seob4757 |
| 10831 | seob4467 | 10891 | seob4543 | 10951 | seob4619 | 11011 | seob4691 | 11071 | seob4758 |
| 10832 | seob4468 | 10892 | seob4545 | 10952 | seob4621 | 11012 | seob4692 | 11072 | seob4759 |
| 10833 | seob4469 | 10893 | seob4553 | 10953 | seob4622 | 11013 | seob4693 | 11073 | seob4760 |
| 10834 | seob4470 | 10894 | seob4555 | 10954 | seob4623 | 11014 | seob4694 | 11074 | seob4761 |
| 10835 | seob4471 | 10895 | seob4557 | 10955 | seob4624 | 11015 | seob4695 | 11075 | seob4762 |
| 10836 | seob4472 | 10896 | seob4560 | 10956 | seob4625 | 11016 | seob4696 | 11076 | seob4763 |
| 10837 | seob4474 | 10897 | seob4561 | 10957 | seob4626 | 11017 | seob4697 | 11077 | seob4764 |
| 10838 | seob4475 | 10898 | seob4562 | 10958 | seob4627 | 11018 | seob4698 | 11078 | seob4765 |
| 10839 | seob4476 | 10899 | seob4563 | 10959 | seob4628 | 11019 | seob4700 | 11079 | seob4766 |
| 10840 | seob4477 | 10900 | seob4564 | 10960 | seob4629 | 11020 | seob4701 | 11080 | seob4767 |
| 10841 | seob4479 | 10901 | seob4565 | 10961 | seob4630 | 11021 | seob4702 | 11081 | seob4768 |
| 10842 | seob4480 | 10902 | seob4566 | 10962 | seob4632 | 11022 | seob4704 | 11082 | seob4769 |
| 10843 | seob4481 | 10903 | seob4567 | 10963 | seob4634 | 11023 | seob4705 | 11083 | seob4770 |
| 10844 | seob4482 | 10904 | seob4568 | 10964 | seob4635 | 11024 | seob4706 | 11084 | seob4771 |
| 10845 | seob4483 | 10905 | seob4569 | 10965 | seob4636 | 11025 | seob4707 | 11085 | seob4772 |
| 10846 | seob4484 | 10906 | seob4570 | 10966 | seob4638 | 11026 | seob4708 | 11086 | seob4773 |
| 10847 | seob4485 | 10907 | seob4571 | 10967 | seob4639 | 11027 | seob4709 | 11087 | seob4774 |
| 10848 | seob4486 | 10908 | seob4573 | 10968 | seob4640 | 11028 | seob4712 | 11088 | seob4775 |
| 10849 | seob4487 | 10909 | seob4574 | 10969 | seob4641 | 11029 | seob4713 | 11089 | seob4777 |
| 10850 | seob4488 | 10910 | seob4575 | 10970 | seob4642 | 11030 | seob4714 | 11090 | seob4778 |
| 10851 | seob4489 | 10911 | seob4576 | 10971 | seob4643 | 11031 | seob4715 | 11091 | seob4779 |
| 10852 | seob4490 | 10912 | seob4577 | 10972 | seob4644 | 11032 | seob4716 | 11092 | seob4780 |
| 10853 | seob4491 | 10913 | seob4578 | 10973 | seob4645 | 11033 | seob4718 | 11093 | seob4781 |
| 10854 | seob4492 | 10914 | seob4579 | 10974 | seob4646 | 11034 | seob4719 | 11094 | seob4782 |
| 10855 | seob4493 | 10915 | seob4580 | 10975 | seob4647 | 11035 | seob4720 | 11095 | seob4783 |
| 10856 | seob4494 | 10916 | seob4581 | 10976 | seob4648 | 11036 | seob4721 | 11096 | seob4784 |
| 10857 | seob4495 | 10917 | seob4582 | 10977 | seob4650 | 11037 | seob4722 | 11097 | seob4785 |
| 10858 | seob4497 | 10918 | seob4583 | 10978 | seob4651 | 11038 | seob4723 | 11098 | seob4786 |
| 10859 | seob4498 | 10919 | seob4584 | 10979 | seob4652 | 11039 | seob4724 | 11099 | seob4787 |
| 10860 | seob4499 | 10920 | seob4585 | 10980 | seob4653 | 11040 | seob4725 | 11100 | seob4790 |

Figure 6E – List of EST Sequence Names From Severe OA Cartilage cDNA Library

| | | | | | | | | | |
|---|---|---|---|---|---|---|---|---|---|
| 11101 | seob4791 | 11161 | seob4860 | 11221 | seob4932 | 11281 | seob5022 | 11341 | seob5092 |
| 11102 | seob4793 | 11162 | seob4861 | 11222 | seob4933 | 11282 | seob5023 | 11342 | seob5093 |
| 11103 | seob4794 | 11163 | seob4863 | 11223 | seob4934 | 11283 | seob5024 | 11343 | seob5094 |
| 11104 | seob4795 | 11164 | seob4864 | 11224 | seob4936 | 11284 | seob5025 | 11344 | seob5095 |
| 11105 | seob4796 | 11165 | seob4865 | 11225 | seob4937 | 11285 | seob5026 | 11345 | seob5096 |
| 11106 | seob4797 | 11166 | seob4866 | 11226 | seob4938 | 11286 | seob5027 | 11346 | seob5097 |
| 11107 | seob4798 | 11167 | seob4867 | 11227 | seob4939 | 11287 | seob5028 | 11347 | seob5098 |
| 11108 | seob4799 | 11168 | seob4868 | 11228 | seob4941 | 11288 | seob5029 | 11348 | seob5099 |
| 11109 | seob4801 | 11169 | seob4869 | 11229 | seob4944 | 11289 | seob5030 | 11349 | seob5100 |
| 11110 | seob4802 | 11170 | seob4870 | 11230 | seob4945 | 11290 | seob5031 | 11350 | seob5101 |
| 11111 | seob4804 | 11171 | seob4871 | 11231 | seob4955 | 11291 | seob5032 | 11351 | seob5103 |
| 11112 | seob4805 | 11172 | seob4872 | 11232 | seob4956 | 11292 | seob5033 | 11352 | seob5104 |
| 11113 | seob4807 | 11173 | seob4873 | 11233 | seob4958 | 11293 | seob5034 | 11353 | seob5106 |
| 11114 | seob4808 | 11174 | seob4874 | 11234 | seob4961 | 11294 | seob5036 | 11354 | seob5107 |
| 11115 | seob4809 | 11175 | seob4875 | 11235 | seob4962 | 11295 | seob5037 | 11355 | seob5109 |
| 11116 | seob4810 | 11176 | seob4877 | 11236 | seob4963 | 11296 | seob5038 | 11356 | seob5110 |
| 11117 | seob4811 | 11177 | seob4878 | 11237 | seob4964 | 11297 | seob5039 | 11357 | seob5112 |
| 11118 | seob4812 | 11178 | seob4880 | 11238 | seob4965 | 11298 | seob5040 | 11358 | seob5113 |
| 11119 | seob4813 | 11179 | seob4881 | 11239 | seob4966 | 11299 | seob5041 | 11359 | seob5114 |
| 11120 | seob4814 | 11180 | seob4882 | 11240 | seob4967 | 11300 | seob5042 | 11360 | seob5115 |
| 11121 | seob4815 | 11181 | seob4883 | 11241 | seob4969 | 11301 | seob5043 | 11361 | seob5116 |
| 11122 | seob4816 | 11182 | seob4884 | 11242 | seob4970 | 11302 | seob5044 | 11362 | seob5117 |
| 11123 | seob4817 | 11183 | seob4885 | 11243 | seob4972 | 11303 | seob5045 | 11363 | seob5118 |
| 11124 | seob4818 | 11184 | seob4887 | 11244 | seob4973 | 11304 | seob5046 | 11364 | seob5120 |
| 11125 | seob4819 | 11185 | seob4888 | 11245 | seob4975 | 11305 | seob5048 | 11365 | seob5121 |
| 11126 | seob4820 | 11186 | seob4889 | 11246 | seob4976 | 11306 | seob5049 | 11366 | seob5122 |
| 11127 | seob4821 | 11187 | seob4891 | 11247 | seob4977 | 11307 | seob5052 | 11367 | seob5123 |
| 11128 | seob4822 | 11188 | seob4892 | 11248 | seob4978 | 11308 | seob5053 | 11368 | seob5124 |
| 11129 | seob4824 | 11189 | seob4893 | 11249 | seob4979 | 11309 | seob5054 | 11369 | seob5126 |
| 11130 | seob4825 | 11190 | seob4894 | 11250 | seob4981 | 11310 | seob5055 | 11370 | seob5128 |
| 11131 | seob4826 | 11191 | seob4896 | 11251 | seob4982 | 11311 | seob5056 | 11371 | seob5130 |
| 11132 | seob4827 | 11192 | seob4897 | 11252 | seob4983 | 11312 | seob5057 | 11372 | seob5131 |
| 11133 | seob4828 | 11193 | seob4898 | 11253 | seob4985 | 11313 | seob5058 | 11373 | seob5132 |
| 11134 | seob4829 | 11194 | seob4899 | 11254 | seob4986 | 11314 | seob5059 | 11374 | seob5135 |
| 11135 | seob4831 | 11195 | seob4900 | 11255 | seob4987 | 11315 | seob5060 | 11375 | seob5136 |
| 11136 | seob4832 | 11196 | seob4902 | 11256 | seob4990 | 11316 | seob5063 | 11376 | seob5137 |
| 11137 | seob4833 | 11197 | seob4903 | 11257 | seob4992 | 11317 | seob5064 | 11377 | seob5138 |
| 11138 | seob4835 | 11198 | seob4904 | 11258 | seob4993 | 11318 | seob5065 | 11378 | seob5140 |
| 11139 | seob4836 | 11199 | seob4906 | 11259 | seob4994 | 11319 | seob5066 | 11379 | seob5142 |
| 11140 | seob4837 | 11200 | seob4907 | 11260 | seob4995 | 11320 | seob5067 | 11380 | seob5143 |
| 11141 | seob4838 | 11201 | seob4910 | 11261 | seob4996 | 11321 | seob5068 | 11381 | seob5144 |
| 11142 | seob4839 | 11202 | seob4911 | 11262 | seob4997 | 11322 | seob5069 | 11382 | seob5146 |
| 11143 | seob4840 | 11203 | seob4912 | 11263 | seob4999 | 11323 | seob5070 | 11383 | seob5147 |
| 11144 | seob4841 | 11204 | seob4913 | 11264 | seob5000 | 11324 | seob5071 | 11384 | seob5150 |
| 11145 | seob4843 | 11205 | seob4915 | 11265 | seob5001 | 11325 | seob5073 | 11385 | seob5152 |
| 11146 | seob4844 | 11206 | seob4916 | 11266 | seob5002 | 11326 | seob5075 | 11386 | seob5153 |
| 11147 | seob4845 | 11207 | seob4917 | 11267 | seob5003 | 11327 | seob5076 | 11387 | seob5154 |
| 11148 | seob4846 | 11208 | seob4918 | 11268 | seob5004 | 11328 | seob5077 | 11388 | seob5155 |
| 11149 | seob4847 | 11209 | seob4919 | 11269 | seob5006 | 11329 | seob5078 | 11389 | seob5157 |
| 11150 | seob4848 | 11210 | seob4920 | 11270 | seob5007 | 11330 | seob5079 | 11390 | seob5158 |
| 11151 | seob4849 | 11211 | seob4921 | 11271 | seob5009 | 11331 | seob5080 | 11391 | seob5159 |
| 11152 | seob4850 | 11212 | seob4922 | 11272 | seob5010 | 11332 | seob5081 | 11392 | seob5161 |
| 11153 | seob4851 | 11213 | seob4923 | 11273 | seob5011 | 11333 | seob5082 | 11393 | seob5162 |
| 11154 | seob4852 | 11214 | seob4925 | 11274 | seob5012 | 11334 | seob5084 | 11394 | seob5163 |
| 11155 | seob4853 | 11215 | seob4926 | 11275 | seob5013 | 11335 | seob5085 | 11395 | seob5164 |
| 11156 | seob4854 | 11216 | seob4927 | 11276 | seob5014 | 11336 | seob5086 | 11396 | seob5165 |
| 11157 | seob4855 | 11217 | seob4928 | 11277 | seob5016 | 11337 | seob5087 | 11397 | seob5168 |
| 11158 | seob4857 | 11218 | seob4929 | 11278 | seob5018 | 11338 | seob5088 | 11398 | seob5169 |
| 11159 | seob4858 | 11219 | seob4930 | 11279 | seob5019 | 11339 | seob5089 | 11399 | seob5172 |
| 11160 | seob4859 | 11220 | seob4931 | 11280 | seob5021 | 11340 | seob5090 | 11400 | seob5174 |

Figure 6E – List of EST Sequence Names From Severe OA Cartilage cDNA Library

| | | | | | | | | | |
|---|---|---|---|---|---|---|---|---|---|
| 11401 | seob5175 | 11461 | seob5243 | 11521 | seob5316 | 11581 | seob5383 | 11641 | seob5452 |
| 11402 | seob5176 | 11462 | seob5244 | 11522 | seob5317 | 11582 | seob5384 | 11642 | seob5453 |
| 11403 | seob5177 | 11463 | seob5245 | 11523 | seob5318 | 11583 | seob5385 | 11643 | seob5454 |
| 11404 | seob5180 | 11464 | seob5246 | 11524 | seob5319 | 11584 | seob5386 | 11644 | seob5455 |
| 11405 | seob5181 | 11465 | seob5247 | 11525 | seob5320 | 11585 | seob5388 | 11645 | seob5456 |
| 11406 | seob5182 | 11466 | seob5249 | 11526 | seob5321 | 11586 | seob5389 | 11646 | seob5457 |
| 11407 | seob5183 | 11467 | seob5251 | 11527 | seob5322 | 11587 | seob5391 | 11647 | seob5458 |
| 11408 | seob5184 | 11468 | seob5252 | 11528 | seob5323 | 11588 | seob5392 | 11648 | seob5460 |
| 11409 | seob5185 | 11469 | seob5253 | 11529 | seob5324 | 11589 | seob5393 | 11649 | seob5461 |
| 11410 | seob5187 | 11470 | seob5254 | 11530 | seob5325 | 11590 | seob5394 | 11650 | seob5462 |
| 11411 | seob5188 | 11471 | seob5255 | 11531 | seob5326 | 11591 | seob5395 | 11651 | seob5463 |
| 11412 | seob5189 | 11472 | seob5256 | 11532 | seob5327 | 11592 | seob5396 | 11652 | seob5464 |
| 11413 | seob5190 | 11473 | seob5257 | 11533 | seob5328 | 11593 | seob5397 | 11653 | seob5465 |
| 11414 | seob5191 | 11474 | seob5258 | 11534 | seob5329 | 11594 | seob5398 | 11654 | seob5466 |
| 11415 | seob5192 | 11475 | seob5259 | 11535 | seob5330 | 11595 | seob5399 | 11655 | seob5469 |
| 11416 | seob5193 | 11476 | seob5260 | 11536 | seob5331 | 11596 | seob5400 | 11656 | seob5470 |
| 11417 | seob5194 | 11477 | seob5261 | 11537 | seob5332 | 11597 | seob5401 | 11657 | seob5471 |
| 11418 | seob5195 | 11478 | seob5262 | 11538 | seob5333 | 11598 | seob5402 | 11658 | seob5472 |
| 11419 | seob5196 | 11479 | seob5263 | 11539 | seob5334 | 11599 | seob5403 | 11659 | seob5473 |
| 11420 | seob5197 | 11480 | seob5266 | 11540 | seob5335 | 11600 | seob5404 | 11660 | seob5475 |
| 11421 | seob5198 | 11481 | seob5268 | 11541 | seob5336 | 11601 | seob5405 | 11661 | seob5476 |
| 11422 | seob5199 | 11482 | seob5269 | 11542 | seob5337 | 11602 | seob5406 | 11662 | seob5478 |
| 11423 | seob5201 | 11483 | seob5270 | 11543 | seob5339 | 11603 | seob5407 | 11663 | seob5479 |
| 11424 | seob5202 | 11484 | seob5271 | 11544 | seob5340 | 11604 | seob5408 | 11664 | seob5480 |
| 11425 | seob5203 | 11485 | seob5272 | 11545 | seob5341 | 11605 | seob5409 | 11665 | seob5481 |
| 11426 | seob5204 | 11486 | seob5273 | 11546 | seob5342 | 11606 | seob5410 | 11666 | seob5485 |
| 11427 | seob5205 | 11487 | seob5274 | 11547 | seob5343 | 11607 | seob5411 | 11667 | seob5486 |
| 11428 | seob5206 | 11488 | seob5276 | 11548 | seob5344 | 11608 | seob5412 | 11668 | seob5487 |
| 11429 | seob5208 | 11489 | seob5277 | 11549 | seob5345 | 11609 | seob5413 | 11669 | seob5488 |
| 11430 | seob5209 | 11490 | seob5278 | 11550 | seob5346 | 11610 | seob5414 | 11670 | seob5489 |
| 11431 | seob5210 | 11491 | seob5280 | 11551 | seob5347 | 11611 | seob5415 | 11671 | seob5490 |
| 11432 | seob5211 | 11492 | seob5281 | 11552 | seob5349 | 11612 | seob5417 | 11672 | seob5491 |
| 11433 | seob5212 | 11493 | seob5282 | 11553 | seob5351 | 11613 | seob5418 | 11673 | seob5492 |
| 11434 | seob5213 | 11494 | seob5284 | 11554 | seob5352 | 11614 | seob5419 | 11674 | seob5493 |
| 11435 | seob5214 | 11495 | seob5285 | 11555 | seob5353 | 11615 | seob5420 | 11675 | seob5494 |
| 11436 | seob5216 | 11496 | seob5286 | 11556 | seob5354 | 11616 | seob5421 | 11676 | seob5498 |
| 11437 | seob5217 | 11497 | seob5287 | 11557 | seob5355 | 11617 | seob5423 | 11677 | seob5500 |
| 11438 | seob5218 | 11498 | seob5288 | 11558 | seob5356 | 11618 | seob5424 | 11678 | seob5501 |
| 11439 | seob5219 | 11499 | seob5289 | 11559 | seob5358 | 11619 | seob5427 | 11679 | seob5504 |
| 11440 | seob5220 | 11500 | seob5290 | 11560 | seob5359 | 11620 | seob5428 | 11680 | seob5505 |
| 11441 | seob5221 | 11501 | seob5291 | 11561 | seob5360 | 11621 | seob5429 | 11681 | seob5506 |
| 11442 | seob5222 | 11502 | seob5292 | 11562 | seob5361 | 11622 | seob5430 | 11682 | seob5507 |
| 11443 | seob5223 | 11503 | seob5295 | 11563 | seob5363 | 11623 | seob5431 | 11683 | seob5508 |
| 11444 | seob5224 | 11504 | seob5296 | 11564 | seob5364 | 11624 | seob5432 | 11684 | seob5509 |
| 11445 | seob5225 | 11505 | seob5297 | 11565 | seob5365 | 11625 | seob5433 | 11685 | seob5511 |
| 11446 | seob5227 | 11506 | seob5298 | 11566 | seob5367 | 11626 | seob5434 | 11686 | seob5512 |
| 11447 | seob5228 | 11507 | seob5299 | 11567 | seob5368 | 11627 | seob5435 | 11687 | seob5514 |
| 11448 | seob5229 | 11508 | seob5300 | 11568 | seob5369 | 11628 | seob5436 | 11688 | seob5515 |
| 11449 | seob5230 | 11509 | seob5301 | 11569 | seob5371 | 11629 | seob5437 | 11689 | seob5516 |
| 11450 | seob5231 | 11510 | seob5302 | 11570 | seob5372 | 11630 | seob5438 | 11690 | seob5517 |
| 11451 | seob5232 | 11511 | seob5304 | 11571 | seob5373 | 11631 | seob5439 | 11691 | seob5519 |
| 11452 | seob5233 | 11512 | seob5305 | 11572 | seob5374 | 11632 | seob5440 | 11692 | seob5520 |
| 11453 | seob5234 | 11513 | seob5306 | 11573 | seob5375 | 11633 | seob5441 | 11693 | seob5521 |
| 11454 | seob5235 | 11514 | seob5307 | 11574 | seob5376 | 11634 | seob5443 | 11694 | seob5523 |
| 11455 | seob5236 | 11515 | seob5308 | 11575 | seob5377 | 11635 | seob5444 | 11695 | seob5524 |
| 11456 | seob5237 | 11516 | seob5309 | 11576 | seob5378 | 11636 | seob5445 | 11696 | seob5526 |
| 11457 | seob5238 | 11517 | seob5311 | 11577 | seob5379 | 11637 | seob5447 | 11697 | seob5527 |
| 11458 | seob5239 | 11518 | seob5312 | 11578 | seob5380 | 11638 | seob5449 | 11698 | seob5528 |
| 11459 | seob5240 | 11519 | seob5313 | 11579 | seob5381 | 11639 | seob5450 | 11699 | seob5529 |
| 11460 | seob5241 | 11520 | seob5315 | 11580 | seob5382 | 11640 | seob5451 | 11700 | seob5531 |

Figure 6E – List of EST Sequence Names From Severe OA Cartilage cDNA Library

| | | | | | | | | | |
|---|---|---|---|---|---|---|---|---|---|
| 11701 | seob5533 | 11761 | seob5600 | 11821 | seob5666 | 11881 | seob5745 | 11941 | seob5814 |
| 11702 | seob5534 | 11762 | seob5601 | 11822 | seob5668 | 11882 | seob5746 | 11942 | seob5815 |
| 11703 | seob5535 | 11763 | seob5602 | 11823 | seob5669 | 11883 | seob5747 | 11943 | seob5816 |
| 11704 | seob5536 | 11764 | seob5603 | 11824 | seob5670 | 11884 | seob5748 | 11944 | seob5817 |
| 11705 | seob5537 | 11765 | seob5604 | 11825 | seob5671 | 11885 | seob5749 | 11945 | seob5818 |
| 11706 | seob5538 | 11766 | seob5605 | 11826 | seob5673 | 11886 | seob5750 | 11946 | seob5819 |
| 11707 | seob5539 | 11767 | seob5606 | 11827 | seob5676 | 11887 | seob5751 | 11947 | seob5820 |
| 11708 | seob5540 | 11768 | seob5607 | 11828 | seob5678 | 11888 | seob5752 | 11948 | seob5821 |
| 11709 | seob5541 | 11769 | seob5608 | 11829 | seob5679 | 11889 | seob5753 | 11949 | seob5822 |
| 11710 | seob5542 | 11770 | seob5609 | 11830 | seob5680 | 11890 | seob5754 | 11950 | seob5823 |
| 11711 | seob5543 | 11771 | seob5610 | 11831 | seob5682 | 11891 | seob5755 | 11951 | seob5825 |
| 11712 | seob5544 | 11772 | seob5611 | 11832 | seob5683 | 11892 | seob5756 | 11952 | seob5826 |
| 11713 | seob5547 | 11773 | seob5612 | 11833 | seob5684 | 11893 | seob5757 | 11953 | seob5827 |
| 11714 | seob5548 | 11774 | seob5613 | 11834 | seob5685 | 11894 | seob5758 | 11954 | seob5828 |
| 11715 | seob5549 | 11775 | seob5614 | 11835 | seob5686 | 11895 | seob5759 | 11955 | seob5829 |
| 11716 | seob5550 | 11776 | seob5615 | 11836 | seob5688 | 11896 | seob5760 | 11956 | seob5830 |
| 11717 | seob5551 | 11777 | seob5616 | 11837 | seob5689 | 11897 | seob5761 | 11957 | seob5831 |
| 11718 | seob5552 | 11778 | seob5618 | 11838 | seob5690 | 11898 | seob5762 | 11958 | seob5832 |
| 11719 | seob5554 | 11779 | seob5619 | 11839 | seob5691 | 11899 | seob5763 | 11959 | seob5834 |
| 11720 | seob5555 | 11780 | seob5620 | 11840 | seob5692 | 11900 | seob5764 | 11960 | seob5835 |
| 11721 | seob5556 | 11781 | seob5621 | 11841 | seob5693 | 11901 | seob5765 | 11961 | seob5836 |
| 11722 | seob5557 | 11782 | seob5622 | 11842 | seob5695 | 11902 | seob5766 | 11962 | seob5837 |
| 11723 | seob5558 | 11783 | seob5623 | 11843 | seob5696 | 11903 | seob5767 | 11963 | seob5838 |
| 11724 | seob5559 | 11784 | seob5624 | 11844 | seob5700 | 11904 | seob5769 | 11964 | seob5840 |
| 11725 | seob5560 | 11785 | seob5626 | 11845 | seob5701 | 11905 | seob5770 | 11965 | seob5841 |
| 11726 | seob5561 | 11786 | seob5627 | 11846 | seob5702 | 11906 | seob5771 | 11966 | seob5842 |
| 11727 | seob5562 | 11787 | seob5629 | 11847 | seob5703 | 11907 | seob5772 | 11967 | seob5843 |
| 11728 | seob5563 | 11788 | seob5630 | 11848 | seob5705 | 11908 | seob5773 | 11968 | seob5844 |
| 11729 | seob5564 | 11789 | seob5631 | 11849 | seob5706 | 11909 | seob5774 | 11969 | seob5845 |
| 11730 | seob5565 | 11790 | seob5632 | 11850 | seob5707 | 11910 | seob5776 | 11970 | seob5846 |
| 11731 | seob5566 | 11791 | seob5633 | 11851 | seob5708 | 11911 | seob5777 | 11971 | seob5847 |
| 11732 | seob5567 | 11792 | seob5634 | 11852 | seob5709 | 11912 | seob5778 | 11972 | seob5848 |
| 11733 | seob5568 | 11793 | seob5635 | 11853 | seob5710 | 11913 | seob5779 | 11973 | seob5849 |
| 11734 | seob5569 | 11794 | seob5636 | 11854 | seob5711 | 11914 | seob5780 | 11974 | seob5850 |
| 11735 | seob5570 | 11795 | seob5638 | 11855 | seob5714 | 11915 | seob5781 | 11975 | seob5851 |
| 11736 | seob5572 | 11796 | seob5639 | 11856 | seob5715 | 11916 | seob5782 | 11976 | seob5852 |
| 11737 | seob5573 | 11797 | seob5640 | 11857 | seob5716 | 11917 | seob5784 | 11977 | seob5853 |
| 11738 | seob5574 | 11798 | seob5641 | 11858 | seob5717 | 11918 | seob5785 | 11978 | seob5855 |
| 11739 | seob5575 | 11799 | seob5642 | 11859 | seob5718 | 11919 | seob5786 | 11979 | seob5856 |
| 11740 | seob5576 | 11800 | seob5643 | 11860 | seob5720 | 11920 | seob5787 | 11980 | seob5857 |
| 11741 | seob5578 | 11801 | seob5644 | 11861 | seob5721 | 11921 | seob5788 | 11981 | seob5858 |
| 11742 | seob5579 | 11802 | seob5645 | 11862 | seob5723 | 11922 | seob5789 | 11982 | seob5859 |
| 11743 | seob5580 | 11803 | seob5646 | 11863 | seob5724 | 11923 | seob5790 | 11983 | seob5860 |
| 11744 | seob5581 | 11804 | seob5647 | 11864 | seob5725 | 11924 | seob5791 | 11984 | seob5861 |
| 11745 | seob5582 | 11805 | seob5648 | 11865 | seob5726 | 11925 | seob5792 | 11985 | seob5862 |
| 11746 | seob5583 | 11806 | seob5649 | 11866 | seob5727 | 11926 | seob5793 | 11986 | seob5863 |
| 11747 | seob5584 | 11807 | seob5650 | 11867 | seob5728 | 11927 | seob5794 | 11987 | seob5864 |
| 11748 | seob5585 | 11808 | seob5651 | 11868 | seob5730 | 11928 | seob5796 | 11988 | seob5865 |
| 11749 | seob5586 | 11809 | seob5652 | 11869 | seob5731 | 11929 | seob5797 | 11989 | seob5866 |
| 11750 | seob5587 | 11810 | seob5653 | 11870 | seob5733 | 11930 | seob5798 | 11990 | seob5867 |
| 11751 | seob5588 | 11811 | seob5656 | 11871 | seob5734 | 11931 | seob5800 | 11991 | seob5869 |
| 11752 | seob5589 | 11812 | seob5657 | 11872 | seob5735 | 11932 | seob5801 | 11992 | seob5871 |
| 11753 | seob5590 | 11813 | seob5658 | 11873 | seob5736 | 11933 | seob5802 | 11993 | seob5872 |
| 11754 | seob5592 | 11814 | seob5659 | 11874 | seob5738 | 11934 | seob5803 | 11994 | seob5873 |
| 11755 | seob5593 | 11815 | seob5660 | 11875 | seob5739 | 11935 | seob5806 | 11995 | seob5876 |
| 11756 | seob5594 | 11816 | seob5661 | 11876 | seob5740 | 11936 | seob5807 | 11996 | seob5877 |
| 11757 | seob5595 | 11817 | seob5662 | 11877 | seob5741 | 11937 | seob5809 | 11997 | seob5878 |
| 11758 | seob5596 | 11818 | seob5663 | 11878 | seob5742 | 11938 | seob5811 | 11998 | seob5879 |
| 11759 | seob5597 | 11819 | seob5664 | 11879 | seob5743 | 11939 | seob5812 | 11999 | seob5880 |
| 11760 | seob5598 | 11820 | seob5665 | 11880 | seob5744 | 11940 | seob5813 | 12000 | seob5881 |

Figure 6E – List of EST Sequence Names From Severe OA Cartilage cDNA Library

| | | | | | | | | | |
|---|---|---|---|---|---|---|---|---|---|
| 12001 | seob5882 | 12061 | seob5957 | 12121 | seob6024 | 12181 | seob6095 | 12241 | seob6164 |
| 12002 | seob5884 | 12062 | seob5958 | 12122 | seob6025 | 12182 | seob6096 | 12242 | seob6165 |
| 12003 | seob5885 | 12063 | seob5960 | 12123 | seob6026 | 12183 | seob6097 | 12243 | seob6167 |
| 12004 | seob5886 | 12064 | seob5961 | 12124 | seob6027 | 12184 | seob6098 | 12244 | seob6169 |
| 12005 | seob5887 | 12065 | seob5962 | 12125 | seob6028 | 12185 | seob6099 | 12245 | seob6170 |
| 12006 | seob5888 | 12066 | seob5963 | 12126 | seob6029 | 12186 | seob6100 | 12246 | seob6171 |
| 12007 | seob5889 | 12067 | seob5964 | 12127 | seob6030 | 12187 | seob6101 | 12247 | seob6173 |
| 12008 | seob5890 | 12068 | seob5966 | 12128 | seob6031 | 12188 | seob6102 | 12248 | seob6175 |
| 12009 | seob5891 | 12069 | seob5967 | 12129 | seob6032 | 12189 | seob6103 | 12249 | seob6176 |
| 12010 | seob5892 | 12070 | seob5969 | 12130 | seob6033 | 12190 | seob6104 | 12250 | seob6177 |
| 12011 | seob5893 | 12071 | seob5970 | 12131 | seob6034 | 12191 | seob6105 | 12251 | seob6178 |
| 12012 | seob5894 | 12072 | seob5972 | 12132 | seob6036 | 12192 | seob6106 | 12252 | seob6179 |
| 12013 | seob5895 | 12073 | seob5973 | 12133 | seob6037 | 12193 | seob6107 | 12253 | seob6181 |
| 12014 | seob5896 | 12074 | seob5974 | 12134 | seob6039 | 12194 | seob6108 | 12254 | seob6182 |
| 12015 | seob5897 | 12075 | seob5976 | 12135 | seob6040 | 12195 | seob6109 | 12255 | seob6183 |
| 12016 | seob5899 | 12076 | seob5977 | 12136 | seob6041 | 12196 | seob6111 | 12256 | seob6184 |
| 12017 | seob5900 | 12077 | seob5978 | 12137 | seob6042 | 12197 | seob6112 | 12257 | seob6185 |
| 12018 | seob5902 | 12078 | seob5979 | 12138 | seob6043 | 12198 | seob6113 | 12258 | seob6186 |
| 12019 | seob5903 | 12079 | seob5980 | 12139 | seob6044 | 12199 | seob6114 | 12259 | seob6187 |
| 12020 | seob5904 | 12080 | seob5981 | 12140 | seob6045 | 12200 | seob6115 | 12260 | seob6188 |
| 12021 | seob5905 | 12081 | seob5982 | 12141 | seob6046 | 12201 | seob6116 | 12261 | seob6189 |
| 12022 | seob5906 | 12082 | seob5983 | 12142 | seob6047 | 12202 | seob6117 | 12262 | seob6190 |
| 12023 | seob5908 | 12083 | seob5984 | 12143 | seob6048 | 12203 | seob6119 | 12263 | seob6192 |
| 12024 | seob5909 | 12084 | seob5985 | 12144 | seob6049 | 12204 | seob6120 | 12264 | seob6193 |
| 12025 | seob5910 | 12085 | seob5986 | 12145 | seob6050 | 12205 | seob6122 | 12265 | seob6194 |
| 12026 | seob5911 | 12086 | seob5987 | 12146 | seob6052 | 12206 | seob6123 | 12266 | seob6196 |
| 12027 | seob5914 | 12087 | seob5988 | 12147 | seob6054 | 12207 | seob6125 | 12267 | seob6197 |
| 12028 | seob5915 | 12088 | seob5989 | 12148 | seob6056 | 12208 | seob6126 | 12268 | seob6198 |
| 12029 | seob5917 | 12089 | seob5990 | 12149 | seob6057 | 12209 | seob6127 | 12269 | seob6200 |
| 12030 | seob5919 | 12090 | seob5991 | 12150 | seob6058 | 12210 | seob6128 | 12270 | seob6201 |
| 12031 | seob5921 | 12091 | seob5992 | 12151 | seob6060 | 12211 | seob6130 | 12271 | seob6202 |
| 12032 | seob5922 | 12092 | seob5993 | 12152 | seob6061 | 12212 | seob6131 | 12272 | seob6203 |
| 12033 | seob5924 | 12093 | seob5994 | 12153 | seob6062 | 12213 | seob6132 | 12273 | seob6204 |
| 12034 | seob5925 | 12094 | seob5995 | 12154 | seob6064 | 12214 | seob6133 | 12274 | seob6205 |
| 12035 | seob5926 | 12095 | seob5996 | 12155 | seob6066 | 12215 | seob6134 | 12275 | seob6206 |
| 12036 | seob5927 | 12096 | seob5997 | 12156 | seob6067 | 12216 | seob6135 | 12276 | seob6207 |
| 12037 | seob5929 | 12097 | seob5999 | 12157 | seob6068 | 12217 | seob6136 | 12277 | seob6208 |
| 12038 | seob5930 | 12098 | seob6000 | 12158 | seob6069 | 12218 | seob6137 | 12278 | seob6211 |
| 12039 | seob5931 | 12099 | seob6001 | 12159 | seob6072 | 12219 | seob6138 | 12279 | seob6212 |
| 12040 | seob5932 | 12100 | seob6002 | 12160 | seob6073 | 12220 | seob6139 | 12280 | seob6213 |
| 12041 | seob5933 | 12101 | seob6003 | 12161 | seob6074 | 12221 | seob6140 | 12281 | seob6214 |
| 12042 | seob5934 | 12102 | seob6004 | 12162 | seob6075 | 12222 | seob6141 | 12282 | seob6215 |
| 12043 | seob5935 | 12103 | seob6005 | 12163 | seob6076 | 12223 | seob6142 | 12283 | seob6216 |
| 12044 | seob5936 | 12104 | seob6006 | 12164 | seob6077 | 12224 | seob6143 | 12284 | seob6217 |
| 12045 | seob5937 | 12105 | seob6007 | 12165 | seob6078 | 12225 | seob6144 | 12285 | seob6218 |
| 12046 | seob5938 | 12106 | seob6008 | 12166 | seob6079 | 12226 | seob6145 | 12286 | seob6221 |
| 12047 | seob5939 | 12107 | seob6009 | 12167 | seob6080 | 12227 | seob6146 | 12287 | seob6223 |
| 12048 | seob5940 | 12108 | seob6010 | 12168 | seob6081 | 12228 | seob6147 | 12288 | seob6224 |
| 12049 | seob5941 | 12109 | seob6011 | 12169 | seob6082 | 12229 | seob6148 | 12289 | seob6226 |
| 12050 | seob5942 | 12110 | seob6012 | 12170 | seob6084 | 12230 | seob6149 | 12290 | seob6227 |
| 12051 | seob5943 | 12111 | seob6013 | 12171 | seob6085 | 12231 | seob6150 | 12291 | seob6228 |
| 12052 | seob5944 | 12112 | seob6014 | 12172 | seob6086 | 12232 | seob6151 | 12292 | seob6229 |
| 12053 | seob5945 | 12113 | seob6015 | 12173 | seob6087 | 12233 | seob6152 | 12293 | seob6230 |
| 12054 | seob5946 | 12114 | seob6017 | 12174 | seob6088 | 12234 | seob6153 | 12294 | seob6231 |
| 12055 | seob5947 | 12115 | seob6018 | 12175 | seob6089 | 12235 | seob6156 | 12295 | seob6232 |
| 12056 | seob5948 | 12116 | seob6019 | 12176 | seob6090 | 12236 | seob6157 | 12296 | seob6234 |
| 12057 | seob5951 | 12117 | seob6020 | 12177 | seob6091 | 12237 | seob6159 | 12297 | seob6236 |
| 12058 | seob5954 | 12118 | seob6021 | 12178 | seob6092 | 12238 | seob6160 | 12298 | seob6237 |
| 12059 | seob5955 | 12119 | seob6022 | 12179 | seob6093 | 12239 | seob6161 | 12299 | seob6238 |
| 12060 | seob5956 | 12120 | seob6023 | 12180 | seob6094 | 12240 | seob6162 | 12300 | seob6239 |

Figure 6E – List of EST Sequence Names From Severe OA Cartilage cDNA Library

| | | | | | | | | | |
|---|---|---|---|---|---|---|---|---|---|
| 12301 | seob6240 | 12361 | seob6310 | 12421 | seob6386 | 12481 | seob6463 | 12541 | seob6541 |
| 12302 | seob6242 | 12362 | seob6311 | 12422 | seob6387 | 12482 | seob6464 | 12542 | seob6542 |
| 12303 | seob6243 | 12363 | seob6312 | 12423 | seob6389 | 12483 | seob6465 | 12543 | seob6543 |
| 12304 | seob6244 | 12364 | seob6313 | 12424 | seob6390 | 12484 | seob6467 | 12544 | seob6544 |
| 12305 | seob6245 | 12365 | seob6314 | 12425 | seob6391 | 12485 | seob6469 | 12545 | seob6545 |
| 12306 | seob6246 | 12366 | seob6315 | 12426 | seob6393 | 12486 | seob6470 | 12546 | seob6546 |
| 12307 | seob6247 | 12367 | seob6316 | 12427 | seob6395 | 12487 | seob6471 | 12547 | seob6547 |
| 12308 | seob6248 | 12368 | seob6318 | 12428 | seob6396 | 12488 | seob6472 | 12548 | seob6548 |
| 12309 | seob6250 | 12369 | seob6319 | 12429 | seob6397 | 12489 | seob6473 | 12549 | seob6549 |
| 12310 | seob6251 | 12370 | seob6320 | 12430 | seob6398 | 12490 | seob6474 | 12550 | seob6550 |
| 12311 | seob6252 | 12371 | seob6321 | 12431 | seob6399 | 12491 | seob6479 | 12551 | seob6552 |
| 12312 | seob6253 | 12372 | seob6322 | 12432 | seob6401 | 12492 | seob6480 | 12552 | seob6553 |
| 12313 | seob6254 | 12373 | seob6323 | 12433 | seob6402 | 12493 | seob6481 | 12553 | seob6554 |
| 12314 | seob6255 | 12374 | seob6324 | 12434 | seob6403 | 12494 | seob6482 | 12554 | seob6555 |
| 12315 | seob6256 | 12375 | seob6325 | 12435 | seob6405 | 12495 | seob6483 | 12555 | seob6556 |
| 12316 | seob6257 | 12376 | seob6327 | 12436 | seob6407 | 12496 | seob6484 | 12556 | seob6557 |
| 12317 | seob6258 | 12377 | seob6328 | 12437 | seob6408 | 12497 | seob6486 | 12557 | seob6558 |
| 12318 | seob6259 | 12378 | seob6329 | 12438 | seob6409 | 12498 | seob6489 | 12558 | seob6559 |
| 12319 | seob6260 | 12379 | seob6330 | 12439 | seob6410 | 12499 | seob6490 | 12559 | seob6560 |
| 12320 | seob6261 | 12380 | seob6333 | 12440 | seob6411 | 12500 | seob6491 | 12560 | seob6562 |
| 12321 | seob6262 | 12381 | seob6334 | 12441 | seob6412 | 12501 | seob6492 | 12561 | seob6563 |
| 12322 | seob6264 | 12382 | seob6335 | 12442 | seob6413 | 12502 | seob6494 | 12562 | seob6564 |
| 12323 | seob6265 | 12383 | seob6336 | 12443 | seob6414 | 12503 | seob6495 | 12563 | seob6565 |
| 12324 | seob6266 | 12384 | seob6337 | 12444 | seob6415 | 12504 | seob6499 | 12564 | seob6566 |
| 12325 | seob6268 | 12385 | seob6338 | 12445 | seob6416 | 12505 | seob6500 | 12565 | seob6567 |
| 12326 | seob6270 | 12386 | seob6339 | 12446 | seob6417 | 12506 | seob6501 | 12566 | seob6568 |
| 12327 | seob6271 | 12387 | seob6342 | 12447 | seob6418 | 12507 | seob6502 | 12567 | seob6569 |
| 12328 | seob6272 | 12388 | seob6343 | 12448 | seob6419 | 12508 | seob6503 | 12568 | seob6570 |
| 12329 | seob6273 | 12389 | seob6344 | 12449 | seob6422 | 12509 | seob6504 | 12569 | seob6571 |
| 12330 | seob6275 | 12390 | seob6345 | 12450 | seob6424 | 12510 | seob6505 | 12570 | seob6572 |
| 12331 | seob6277 | 12391 | seob6346 | 12451 | seob6425 | 12511 | seob6506 | 12571 | seob6573 |
| 12332 | seob6278 | 12392 | seob6348 | 12452 | seob6426 | 12512 | seob6507 | 12572 | seob6574 |
| 12333 | seob6279 | 12393 | seob6349 | 12453 | seob6427 | 12513 | seob6508 | 12573 | seob6575 |
| 12334 | seob6280 | 12394 | seob6350 | 12454 | seob6428 | 12514 | seob6510 | 12574 | seob6576 |
| 12335 | seob6281 | 12395 | seob6351 | 12455 | seob6429 | 12515 | seob6511 | 12575 | seob6577 |
| 12336 | seob6282 | 12396 | seob6352 | 12456 | seob6431 | 12516 | seob6512 | 12576 | seob6579 |
| 12337 | seob6283 | 12397 | seob6353 | 12457 | seob6432 | 12517 | seob6513 | 12577 | seob6580 |
| 12338 | seob6284 | 12398 | seob6354 | 12458 | seob6433 | 12518 | seob6514 | 12578 | seob6581 |
| 12339 | seob6285 | 12399 | seob6355 | 12459 | seob6434 | 12519 | seob6515 | 12579 | seob6582 |
| 12340 | seob6287 | 12400 | seob6357 | 12460 | seob6435 | 12520 | seob6516 | 12580 | seob6583 |
| 12341 | seob6288 | 12401 | seob6358 | 12461 | seob6436 | 12521 | seob6517 | 12581 | seob6584 |
| 12342 | seob6289 | 12402 | seob6360 | 12462 | seob6437 | 12522 | seob6519 | 12582 | seob6585 |
| 12343 | seob6290 | 12403 | seob6361 | 12463 | seob6438 | 12523 | seob6520 | 12583 | seob6586 |
| 12344 | seob6291 | 12404 | seob6363 | 12464 | seob6439 | 12524 | seob6521 | 12584 | seob6587 |
| 12345 | seob6292 | 12405 | seob6364 | 12465 | seob6440 | 12525 | seob6522 | 12585 | seob6588 |
| 12346 | seob6293 | 12406 | seob6368 | 12466 | seob6441 | 12526 | seob6524 | 12586 | seob6589 |
| 12347 | seob6294 | 12407 | seob6370 | 12467 | seob6444 | 12527 | seob6525 | 12587 | seob6590 |
| 12348 | seob6295 | 12408 | seob6371 | 12468 | seob6446 | 12528 | seob6526 | 12588 | seob6591 |
| 12349 | seob6296 | 12409 | seob6372 | 12469 | seob6448 | 12529 | seob6527 | 12589 | seob6592 |
| 12350 | seob6297 | 12410 | seob6373 | 12470 | seob6449 | 12530 | seob6528 | 12590 | seob6593 |
| 12351 | seob6298 | 12411 | seob6374 | 12471 | seob6450 | 12531 | seob6530 | 12591 | seob6595 |
| 12352 | seob6299 | 12412 | seob6376 | 12472 | seob6451 | 12532 | seob6532 | 12592 | seob6596 |
| 12353 | seob6301 | 12413 | seob6377 | 12473 | seob6453 | 12533 | seob6533 | 12593 | seob6597 |
| 12354 | seob6302 | 12414 | seob6378 | 12474 | seob6454 | 12534 | seob6534 | 12594 | seob6598 |
| 12355 | seob6303 | 12415 | seob6379 | 12475 | seob6455 | 12535 | seob6535 | 12595 | seob6599 |
| 12356 | seob6305 | 12416 | seob6380 | 12476 | seob6456 | 12536 | seob6536 | 12596 | seob6600 |
| 12357 | seob6306 | 12417 | seob6381 | 12477 | seob6457 | 12537 | seob6537 | 12597 | seob6601 |
| 12358 | seob6307 | 12418 | seob6382 | 12478 | seob6458 | 12538 | seob6538 | 12598 | seob6602 |
| 12359 | seob6308 | 12419 | seob6383 | 12479 | seob6460 | 12539 | seob6539 | 12599 | seob6603 |
| 12360 | seob6309 | 12420 | seob6384 | 12480 | seob6462 | 12540 | seob6540 | 12600 | seob6605 |

Figure 6E - List of EST Sequence Names From Severe OA Cartilage cDNA Library

| | | | | | | | | | |
|---|---|---|---|---|---|---|---|---|---|
| 12601 | seob6606 | 12661 | seob6675 | 12721 | seob6747 | 12781 | seob6814 | 12841 | seob6881 |
| 12602 | seob6607 | 12662 | seob6676 | 12722 | seob6748 | 12782 | seob6816 | 12842 | seob6882 |
| 12603 | seob6608 | 12663 | seob6678 | 12723 | seob6749 | 12783 | seob6817 | 12843 | seob6883 |
| 12604 | seob6609 | 12664 | seob6679 | 12724 | seob6751 | 12784 | seob6818 | 12844 | seob6884 |
| 12605 | seob6611 | 12665 | seob6680 | 12725 | seob6752 | 12785 | seob6820 | 12845 | seob6886 |
| 12606 | seob6612 | 12666 | seob6681 | 12726 | seob6754 | 12786 | seob6821 | 12846 | seob6887 |
| 12607 | seob6613 | 12667 | seob6682 | 12727 | seob6755 | 12787 | seob6822 | 12847 | seob6889 |
| 12608 | seob6614 | 12668 | seob6683 | 12728 | seob6756 | 12788 | seob6823 | 12848 | seob6890 |
| 12609 | seob6616 | 12669 | seob6685 | 12729 | seob6757 | 12789 | seob6824 | 12849 | seob6891 |
| 12610 | seob6617 | 12670 | seob6686 | 12730 | seob6758 | 12790 | seob6826 | 12850 | seob6892 |
| 12611 | seob6618 | 12671 | seob6687 | 12731 | seob6759 | 12791 | seob6827 | 12851 | seob6893 |
| 12612 | seob6619 | 12672 | seob6688 | 12732 | seob6762 | 12792 | seob6828 | 12852 | seob6894 |
| 12613 | seob6622 | 12673 | seob6689 | 12733 | seob6763 | 12793 | seob6829 | 12853 | seob6895 |
| 12614 | seob6623 | 12674 | seob6690 | 12734 | seob6764 | 12794 | seob6830 | 12854 | seob6897 |
| 12615 | seob6624 | 12675 | seob6691 | 12735 | seob6765 | 12795 | seob6832 | 12855 | seob6898 |
| 12616 | seob6625 | 12676 | seob6692 | 12736 | seob6766 | 12796 | seob6833 | 12856 | seob6899 |
| 12617 | seob6626 | 12677 | seob6693 | 12737 | seob6767 | 12797 | seob6834 | 12857 | seob6900 |
| 12618 | seob6627 | 12678 | seob6694 | 12738 | seob6768 | 12798 | seob6835 | 12858 | seob6901 |
| 12619 | seob6628 | 12679 | seob6695 | 12739 | seob6769 | 12799 | seob6836 | 12859 | seob6902 |
| 12620 | seob6629 | 12680 | seob6696 | 12740 | seob6770 | 12800 | seob6837 | 12860 | seob6904 |
| 12621 | seob6630 | 12681 | seob6697 | 12741 | seob6771 | 12801 | seob6838 | 12861 | seob6905 |
| 12622 | seob6631 | 12682 | seob6699 | 12742 | seob6772 | 12802 | seob6840 | 12862 | seob7002 |
| 12623 | seob6632 | 12683 | seob6700 | 12743 | seob6773 | 12803 | seob6841 | 12863 | seob7003 |
| 12624 | seob6633 | 12684 | seob6701 | 12744 | seob6774 | 12804 | seob6842 | 12864 | seob7004 |
| 12625 | seob6635 | 12685 | seob6703 | 12745 | seob6775 | 12805 | seob6843 | 12865 | seob7005 |
| 12626 | seob6636 | 12686 | seob6704 | 12746 | seob6776 | 12806 | seob6844 | 12866 | seob7006 |
| 12627 | seob6637 | 12687 | seob6705 | 12747 | seob6777 | 12807 | seob6845 | 12867 | seob7007 |
| 12628 | seob6638 | 12688 | seob6707 | 12748 | seob6778 | 12808 | seob6846 | 12868 | seob7008 |
| 12629 | seob6639 | 12689 | seob6708 | 12749 | seob6779 | 12809 | seob6847 | 12869 | seob7010 |
| 12630 | seob6640 | 12690 | seob6710 | 12750 | seob6780 | 12810 | seob6848 | 12870 | seob7011 |
| 12631 | seob6641 | 12691 | seob6711 | 12751 | seob6781 | 12811 | seob6849 | 12871 | seob7012 |
| 12632 | seob6642 | 12692 | seob6713 | 12752 | seob6782 | 12812 | seob6850 | 12872 | seob7013 |
| 12633 | seob6643 | 12693 | seob6714 | 12753 | seob6783 | 12813 | seob6851 | 12873 | seob7014 |
| 12634 | seob6644 | 12694 | seob6716 | 12754 | seob6784 | 12814 | seob6852 | 12874 | seob7015 |
| 12635 | seob6645 | 12695 | seob6717 | 12755 | seob6785 | 12815 | seob6853 | 12875 | seob7016 |
| 12636 | seob6646 | 12696 | seob6718 | 12756 | seob6786 | 12816 | seob6854 | 12876 | seob7017 |
| 12637 | seob6647 | 12697 | seob6720 | 12757 | seob6787 | 12817 | seob6855 | 12877 | seob7019 |
| 12638 | seob6648 | 12698 | seob6721 | 12758 | seob6788 | 12818 | seob6856 | 12878 | seob7020 |
| 12639 | seob6649 | 12699 | seob6722 | 12759 | seob6789 | 12819 | seob6857 | 12879 | seob7021 |
| 12640 | seob6650 | 12700 | seob6723 | 12760 | seob6790 | 12820 | seob6858 | 12880 | seob7022 |
| 12641 | seob6651 | 12701 | seob6724 | 12761 | seob6791 | 12821 | seob6859 | 12881 | seob7023 |
| 12642 | seob6652 | 12702 | seob6725 | 12762 | seob6792 | 12822 | seob6860 | 12882 | seob7024 |
| 12643 | seob6653 | 12703 | seob6726 | 12763 | seob6793 | 12823 | seob6861 | 12883 | seob7025 |
| 12644 | seob6654 | 12704 | seob6727 | 12764 | seob6794 | 12824 | seob6862 | 12884 | seob7026 |
| 12645 | seob6655 | 12705 | seob6728 | 12765 | seob6795 | 12825 | seob6863 | 12885 | seob7027 |
| 12646 | seob6656 | 12706 | seob6729 | 12766 | seob6796 | 12826 | seob6864 | 12886 | seob7028 |
| 12647 | seob6658 | 12707 | seob6730 | 12767 | seob6797 | 12827 | seob6865 | 12887 | seob7030 |
| 12648 | seob6659 | 12708 | seob6731 | 12768 | seob6798 | 12828 | seob6868 | 12888 | seob7031 |
| 12649 | seob6660 | 12709 | seob6732 | 12769 | seob6799 | 12829 | seob6869 | 12889 | seob7032 |
| 12650 | seob6661 | 12710 | seob6733 | 12770 | seob6800 | 12830 | seob6870 | 12890 | seob7033 |
| 12651 | seob6662 | 12711 | seob6734 | 12771 | seob6801 | 12831 | seob6871 | 12891 | seob7035 |
| 12652 | seob6663 | 12712 | seob6736 | 12772 | seob6802 | 12832 | seob6872 | 12892 | seob7036 |
| 12653 | seob6664 | 12713 | seob6737 | 12773 | seob6803 | 12833 | seob6873 | 12893 | seob7037 |
| 12654 | seob6665 | 12714 | seob6738 | 12774 | seob6805 | 12834 | seob6874 | 12894 | seob7038n |
| 12655 | seob6667 | 12715 | seob6739 | 12775 | seob6806 | 12835 | seob6875 | 12895 | seob7039 |
| 12656 | seob6668 | 12716 | seob6741 | 12776 | seob6807 | 12836 | seob6876 | 12896 | seob7040 |
| 12657 | seob6669 | 12717 | seob6742 | 12777 | seob6808 | 12837 | seob6877 | 12897 | seob7041 |
| 12658 | seob6670 | 12718 | seob6744 | 12778 | seob6809 | 12838 | seob6878 | 12898 | seob7042 |
| 12659 | seob6671 | 12719 | seob6745 | 12779 | seob6812 | 12839 | seob6879 | 12899 | seob7043 |
| 12660 | seob6674 | 12720 | seob6746 | 12780 | seob6813 | 12840 | seob6880 | 12900 | seob7044 |

Figure 6E – List of EST Sequence Names From Severe OA Cartilage cDNA Library

| | | | | | | | | | |
|---|---|---|---|---|---|---|---|---|---|
| 12901 | seob7045 | 12961 | seob7118 | 13021 | seob7200 | 13081 | seob7284 | 13141 | seob7357 |
| 12902 | seob7046 | 12962 | seob7119 | 13022 | seob7201 | 13082 | seob7285 | 13142 | seob7358 |
| 12903 | seob7047 | 12963 | seob7120 | 13023 | seob7202 | 13083 | seob7286 | 13143 | seob7360 |
| 12904 | seob7049 | 12964 | seob7123 | 13024 | seob7203 | 13084 | seob7287 | 13144 | seob7361 |
| 12905 | seob7050 | 12965 | seob7124 | 13025 | seob7205 | 13085 | seob7288 | 13145 | seob7362 |
| 12906 | seob7051 | 12966 | seob7125 | 13026 | seob7207 | 13086 | seob7289 | 13146 | seob7364 |
| 12907 | seob7052 | 12967 | seob7126 | 13027 | seob7208 | 13087 | seob7290 | 13147 | seob7365 |
| 12908 | seob7053 | 12968 | seob7127 | 13028 | seob7209 | 13088 | seob7292 | 13148 | seob7366 |
| 12909 | seob7055 | 12969 | seob7128 | 13029 | seob7210 | 13089 | seob7293 | 13149 | seob7367 |
| 12910 | seob7056 | 12970 | seob7129 | 13030 | seob7212 | 13090 | seob7294 | 13150 | seob7368 |
| 12911 | seob7057 | 12971 | seob7130 | 13031 | seob7213 | 13091 | seob7296 | 13151 | seob7369 |
| 12912 | seob7058 | 12972 | seob7131 | 13032 | seob7216 | 13092 | seob7297 | 13152 | seob7370 |
| 12913 | seob7060 | 12973 | seob7132 | 13033 | seob7217 | 13093 | seob7298 | 13153 | seob7373 |
| 12914 | seob7061 | 12974 | seob7135 | 13034 | seob7218 | 13094 | seob7301 | 13154 | seob7374 |
| 12915 | seob7062 | 12975 | seob7136 | 13035 | seob7220 | 13095 | seob7302 | 13155 | seob7375 |
| 12916 | seob7063 | 12976 | seob7138 | 13036 | seob7222 | 13096 | seob7304 | 13156 | seob7376 |
| 12917 | seob7064 | 12977 | seob7139 | 13037 | seob7224 | 13097 | seob7305 | 13157 | seob7377 |
| 12918 | seob7065 | 12978 | seob7140 | 13038 | seob7225 | 13098 | seob7306 | 13158 | seob7378 |
| 12919 | seob7067 | 12979 | seob7143 | 13039 | seob7226 | 13099 | seob7307 | 13159 | seob7379 |
| 12920 | seob7068 | 12980 | seob7144 | 13040 | seob7227 | 13100 | seob7308 | 13160 | seob7380 |
| 12921 | seob7069 | 12981 | seob7148 | 13041 | seob7228 | 13101 | seob7309 | 13161 | seob7381 |
| 12922 | seob7070 | 12982 | seob7151 | 13042 | seob7229 | 13102 | seob7310 | 13162 | seob7382 |
| 12923 | seob7071 | 12983 | seob7152 | 13043 | seob7231 | 13103 | seob7311 | 13163 | seob7383 |
| 12924 | seob7072 | 12984 | seob7153 | 13044 | seob7232 | 13104 | seob7313 | 13164 | seob7384 |
| 12925 | seob7073 | 12985 | seob7154 | 13045 | seob7233 | 13105 | seob7314 | 13165 | seob7385 |
| 12926 | seob7074 | 12986 | seob7155 | 13046 | seob7234 | 13106 | seob7315 | 13166 | seob7388 |
| 12927 | seob7075 | 12987 | seob7156 | 13047 | seob7235 | 13107 | seob7317 | 13167 | seob7389 |
| 12928 | seob7076 | 12988 | seob7157 | 13048 | seob7237 | 13108 | seob7318 | 13168 | seob7390 |
| 12929 | seob7077 | 12989 | seob7158 | 13049 | seob7239 | 13109 | seob7320 | 13169 | seob7392 |
| 12930 | seob7078 | 12990 | seob7159 | 13050 | seob7240 | 13110 | seob7321 | 13170 | seob7393 |
| 12931 | seob7079 | 12991 | seob7160 | 13051 | seob7241 | 13111 | seob7322 | 13171 | seob7394 |
| 12932 | seob7081 | 12992 | seob7161 | 13052 | seob7243 | 13112 | seob7324 | 13172 | seob7396 |
| 12933 | seob7082 | 12993 | seob7162 | 13053 | seob7244 | 13113 | seob7326 | 13173 | seob7397 |
| 12934 | seob7083 | 12994 | seob7163 | 13054 | seob7245 | 13114 | seob7327 | 13174 | seob7398 |
| 12935 | seob7086 | 12995 | seob7164 | 13055 | seob7246 | 13115 | seob7328 | 13175 | seob7399 |
| 12936 | seob7087 | 12996 | seob7165 | 13056 | seob7247 | 13116 | seob7329 | 13176 | seob7400 |
| 12937 | seob7088 | 12997 | seob7166 | 13057 | seob7248 | 13117 | seob7330 | 13177 | seob7401 |
| 12938 | seob7089 | 12998 | seob7167 | 13058 | seob7249 | 13118 | seob7331 | 13178 | seob7402 |
| 12939 | seob7091 | 12999 | seob7169 | 13059 | seob7250 | 13119 | seob7332 | 13179 | seob7403 |
| 12940 | seob7093 | 13000 | seob7171 | 13060 | seob7251 | 13120 | seob7333 | 13180 | seob7404 |
| 12941 | seob7094 | 13001 | seob7172 | 13061 | seob7252 | 13121 | seob7334 | 13181 | seob7405 |
| 12942 | seob7095 | 13002 | seob7173 | 13062 | seob7253 | 13122 | seob7335 | 13182 | seob7406 |
| 12943 | seob7096 | 13003 | seob7175 | 13063 | seob7254 | 13123 | seob7336 | 13183 | seob7407 |
| 12944 | seob7097 | 13004 | seob7176 | 13064 | seob7255 | 13124 | seob7337 | 13184 | seob7408 |
| 12945 | seob7098 | 13005 | seob7177 | 13065 | seob7256 | 13125 | seob7338 | 13185 | seob7409 |
| 12946 | seob7099 | 13006 | seob7179 | 13066 | seob7257 | 13126 | seob7339 | 13186 | seob7410 |
| 12947 | seob7100 | 13007 | seob7180 | 13067 | seob7258 | 13127 | seob7340 | 13187 | seob7411 |
| 12948 | seob7101 | 13008 | seob7182 | 13068 | seob7259 | 13128 | seob7341 | 13188 | seob7412 |
| 12949 | seob7102 | 13009 | seob7184 | 13069 | seob7261 | 13129 | seob7342 | 13189 | seob7413 |
| 12950 | seob7103n | 13010 | seob7185 | 13070 | seob7262 | 13130 | seob7345 | 13190 | seob7414 |
| 12951 | seob7104 | 13011 | seob7186 | 13071 | seob7263 | 13131 | seob7346 | 13191 | seob7416 |
| 12952 | seob7105 | 13012 | seob7187 | 13072 | seob7264 | 13132 | seob7347 | 13192 | seob7417 |
| 12953 | seob7107 | 13013 | seob7188 | 13073 | seob7265 | 13133 | seob7348 | 13193 | seob7418 |
| 12954 | seob7108 | 13014 | seob7189 | 13074 | seob7266 | 13134 | seob7349 | 13194 | seob7419 |
| 12955 | seob7110 | 13015 | seob7190 | 13075 | seob7273 | 13135 | seob7350 | 13195 | seob7420 |
| 12956 | seob7111 | 13016 | seob7191 | 13076 | seob7274 | 13136 | seob7351 | 13196 | seob7421 |
| 12957 | seob7112 | 13017 | seob7193 | 13077 | seob7275 | 13137 | seob7352 | 13197 | seob7422 |
| 12958 | seob7114 | 13018 | seob7194 | 13078 | seob7277 | 13138 | seob7354 | 13198 | seob7423 |
| 12959 | seob7115 | 13019 | seob7196 | 13079 | seob7278 | 13139 | seob7355 | 13199 | seob7424 |
| 12960 | seob7117 | 13020 | seob7199 | 13080 | seob7282 | 13140 | seob7356 | 13200 | seob7425 |

Figure 6E – List of EST Sequence Names From Severe OA Cartilage cDNA Library

| | | | | | | | | | |
|---|---|---|---|---|---|---|---|---|---|
| 13201 | seob7427 | 13261 | seob7498 | 13321 | seob7568 | 13381 | seob7640 | 13441 | seob7715 |
| 13202 | seob7428 | 13262 | seob7499 | 13322 | seob7569 | 13382 | seob7641 | 13442 | seob7720 |
| 13203 | seob7429 | 13263 | seob7500 | 13323 | seob7570 | 13383 | seob7642 | 13443 | seob7722 |
| 13204 | seob7430 | 13264 | seob7501 | 13324 | seob7571 | 13384 | seob7643 | 13444 | seob7723 |
| 13205 | seob7431 | 13265 | seob7502 | 13325 | seob7572 | 13385 | seob7645 | 13445 | seob7724 |
| 13206 | seob7432 | 13266 | seob7504 | 13326 | seob7573 | 13386 | seob7646 | 13446 | seob7726 |
| 13207 | seob7433 | 13267 | seob7505 | 13327 | seob7575 | 13387 | seob7647 | 13447 | seob7728 |
| 13208 | seob7434 | 13268 | seob7506 | 13328 | seob7576 | 13388 | seob7648 | 13448 | seob7729 |
| 13209 | seob7435 | 13269 | seob7507 | 13329 | seob7577 | 13389 | seob7649 | 13449 | seob7730 |
| 13210 | seob7436 | 13270 | seob7508 | 13330 | seob7578 | 13390 | seob7651 | 13450 | seob7732 |
| 13211 | seob7437 | 13271 | seob7509 | 13331 | seob7580 | 13391 | seob7652 | 13451 | seob7733 |
| 13212 | seob7438 | 13272 | seob7510 | 13332 | seob7581 | 13392 | seob7653 | 13452 | seob7737 |
| 13213 | seob7439 | 13273 | seob7512 | 13333 | seob7582 | 13393 | seob7654 | 13453 | seob7738 |
| 13214 | seob7440 | 13274 | seob7514 | 13334 | seob7584 | 13394 | seob7655 | 13454 | seob7739 |
| 13215 | seob7441 | 13275 | seob7515 | 13335 | seob7585 | 13395 | seob7656 | 13455 | seob7740 |
| 13216 | seob7442 | 13276 | seob7516 | 13336 | seob7586 | 13396 | seob7658 | 13456 | seob7741 |
| 13217 | seob7443 | 13277 | seob7517 | 13337 | seob7588 | 13397 | seob7659 | 13457 | seob7742 |
| 13218 | seob7444 | 13278 | seob7518 | 13338 | seob7589 | 13398 | seob7660 | 13458 | seob7743 |
| 13219 | seob7445 | 13279 | seob7519 | 13339 | seob7590 | 13399 | seob7661 | 13459 | seob7744 |
| 13220 | seob7446 | 13280 | seob7521 | 13340 | seob7591 | 13400 | seob7662 | 13460 | seob7745 |
| 13221 | seob7447 | 13281 | seob7523 | 13341 | seob7592 | 13401 | seob7663 | 13461 | seob7746 |
| 13222 | seob7448 | 13282 | seob7524 | 13342 | seob7593 | 13402 | seob7664 | 13462 | seob7747 |
| 13223 | seob7449 | 13283 | seob7525 | 13343 | seob7594 | 13403 | seob7665 | 13463 | seob7748 |
| 13224 | seob7450 | 13284 | seob7527 | 13344 | seob7595 | 13404 | seob7666 | 13464 | seob7749 |
| 13225 | seob7451 | 13285 | seob7528 | 13345 | seob7596 | 13405 | seob7667 | 13465 | seob7750 |
| 13226 | seob7452 | 13286 | seob7529 | 13346 | seob7597 | 13406 | seob7668 | 13466 | seob7751 |
| 13227 | seob7454 | 13287 | seob7530 | 13347 | seob7600 | 13407 | seob7669 | 13467 | seob7752 |
| 13228 | seob7457 | 13288 | seob7531 | 13348 | seob7601 | 13408 | seob7670 | 13468 | seob7753 |
| 13229 | seob7458 | 13289 | seob7532 | 13349 | seob7602 | 13409 | seob7674 | 13469 | seob7754 |
| 13230 | seob7459 | 13290 | seob7533 | 13350 | seob7603 | 13410 | seob7675 | 13470 | seob7755 |
| 13231 | seob7460 | 13291 | seob7534 | 13351 | seob7604 | 13411 | seob7678 | 13471 | seob7756 |
| 13232 | seob7461 | 13292 | seob7535 | 13352 | seob7608 | 13412 | seob7679 | 13472 | seob7757 |
| 13233 | seob7462 | 13293 | seob7536 | 13353 | seob7610 | 13413 | seob7680 | 13473 | seob7758 |
| 13234 | seob7463 | 13294 | seob7537 | 13354 | seob7611 | 13414 | seob7681 | 13474 | seob7759 |
| 13235 | seob7464 | 13295 | seob7538 | 13355 | seob7612 | 13415 | seob7682 | 13475 | seob7760 |
| 13236 | seob7465 | 13296 | seob7539 | 13356 | seob7613 | 13416 | seob7684 | 13476 | seob7763 |
| 13237 | seob7466 | 13297 | seob7540 | 13357 | seob7614 | 13417 | seob7685 | 13477 | seob7764 |
| 13238 | seob7467 | 13298 | seob7541 | 13358 | seob7615 | 13418 | seob7686 | 13478 | seob7765 |
| 13239 | seob7469 | 13299 | seob7543 | 13359 | seob7617 | 13419 | seob7687 | 13479 | seob7766 |
| 13240 | seob7470 | 13300 | seob7544 | 13360 | seob7618 | 13420 | seob7689 | 13480 | seob7769 |
| 13241 | seob7471 | 13301 | seob7545 | 13361 | seob7619 | 13421 | seob7691 | 13481 | seob7866 |
| 13242 | seob7472 | 13302 | seob7546 | 13362 | seob7620 | 13422 | seob7692 | 13482 | seob7868 |
| 13243 | seob7473 | 13303 | seob7547 | 13363 | seob7621 | 13423 | seob7693 | 13483 | seob7869 |
| 13244 | seob7474 | 13304 | seob7548 | 13364 | seob7622 | 13424 | seob7694 | 13484 | seob7870 |
| 13245 | seob7475 | 13305 | seob7549 | 13365 | seob7623 | 13425 | seob7695 | 13485 | seob7871 |
| 13246 | seob7476 | 13306 | seob7550 | 13366 | seob7624 | 13426 | seob7696 | 13486 | seob7872 |
| 13247 | seob7477 | 13307 | seob7551 | 13367 | seob7625 | 13427 | seob7698 | 13487 | seob7873 |
| 13248 | seob7478 | 13308 | seob7552 | 13368 | seob7626 | 13428 | seob7699 | 13488 | seob7874 |
| 13249 | seob7479 | 13309 | seob7553 | 13369 | seob7627 | 13429 | seob7701 | 13489 | seob7875 |
| 13250 | seob7482 | 13310 | seob7554 | 13370 | seob7629 | 13430 | seob7702 | 13490 | seob7876 |
| 13251 | seob7484 | 13311 | seob7555 | 13371 | seob7630 | 13431 | seob7703 | 13491 | seob7877 |
| 13252 | seob7485 | 13312 | seob7556 | 13372 | seob7631 | 13432 | seob7704 | 13492 | seob7878 |
| 13253 | seob7486 | 13313 | seob7557 | 13373 | seob7632 | 13433 | seob7705 | 13493 | seob7879 |
| 13254 | seob7488 | 13314 | seob7558 | 13374 | seob7633 | 13434 | seob7706 | 13494 | seob7880 |
| 13255 | seob7490 | 13315 | seob7561 | 13375 | seob7634 | 13435 | seob7707 | 13495 | seob7883 |
| 13256 | seob7492 | 13316 | seob7562 | 13376 | seob7635 | 13436 | seob7709 | 13496 | seob7885 |
| 13257 | seob7493 | 13317 | seob7563 | 13377 | seob7636 | 13437 | seob7710 | 13497 | seob7886 |
| 13258 | seob7494 | 13318 | seob7564 | 13378 | seob7637 | 13438 | seob7711 | 13498 | seob7887 |
| 13259 | seob7495 | 13319 | seob7566 | 13379 | seob7638 | 13439 | seob7712 | 13499 | seob7888 |
| 13260 | seob7497 | 13320 | seob7567 | 13380 | seob7639 | 13440 | seob7714 | 13500 | seob7889 |

Figure 6E - List of EST Sequence Names From Severe OA Cartilage cDNA Library

| | | | | | | | | | |
|---|---|---|---|---|---|---|---|---|---|
| 13501 | seob7890 | 13561 | seob7965 | 13621 | seob8039 | 13681 | seob8141 | 13741 | seob8227 |
| 13502 | seob7891 | 13562 | seob7966 | 13622 | seob8040 | 13682 | seob8154 | 13742 | seob8229 |
| 13503 | seob7893 | 13563 | seob7968 | 13623 | seob8041 | 13683 | seob8155 | 13743 | seob8231 |
| 13504 | seob7895 | 13564 | seob7969 | 13624 | seob8042 | 13684 | seob8157 | 13744 | seob8232 |
| 13505 | seob7896 | 13565 | seob7970 | 13625 | seob8044 | 13685 | seob8158 | 13745 | seob8233 |
| 13506 | seob7897 | 13566 | seob7972 | 13626 | seob8045 | 13686 | seob8159 | 13746 | seob8235 |
| 13507 | seob7898 | 13567 | seob7973 | 13627 | seob8046 | 13687 | seob8160 | 13747 | seob8236 |
| 13508 | seob7899 | 13568 | seob7974 | 13628 | seob8047 | 13688 | seob8161 | 13748 | seob8237 |
| 13509 | seob7900 | 13569 | seob7975 | 13629 | seob8048 | 13689 | seob8162 | 13749 | seob8238 |
| 13510 | seob7901 | 13570 | seob7977 | 13630 | seob8051 | 13690 | seob8163 | 13750 | seob8239 |
| 13511 | seob7902 | 13571 | seob7978 | 13631 | seob8052 | 13691 | seob8164 | 13751 | seob8240 |
| 13512 | seob7903 | 13572 | seob7979 | 13632 | seob8053 | 13692 | seob8166 | 13752 | seob8241 |
| 13513 | seob7905 | 13573 | seob7980 | 13633 | seob8054 | 13693 | seob8167 | 13753 | seob8242 |
| 13514 | seob7906 | 13574 | seob7981 | 13634 | seob8055 | 13694 | seob8168 | 13754 | seob8243 |
| 13515 | seob7907 | 13575 | seob7982 | 13635 | seob8060 | 13695 | seob8169 | 13755 | seob8244 |
| 13516 | seob7908 | 13576 | seob7983 | 13636 | seob8063 | 13696 | seob8171 | 13756 | seob8245 |
| 13517 | seob7909 | 13577 | seob7984 | 13637 | seob8065 | 13697 | seob8172 | 13757 | seob8246 |
| 13518 | seob7910 | 13578 | seob7986 | 13638 | seob8066 | 13698 | seob8173 | 13758 | seob8247 |
| 13519 | seob7911 | 13579 | seob7987 | 13639 | seob8067 | 13699 | seob8174 | 13759 | seob8248 |
| 13520 | seob7912 | 13580 | seob7989 | 13640 | seob8068 | 13700 | seob8176 | 13760 | seob8249 |
| 13521 | seob7915 | 13581 | seob7990 | 13641 | seob8069 | 13701 | seob8177 | 13761 | seob8250 |
| 13522 | seob7916 | 13582 | seob7992 | 13642 | seob8071 | 13702 | seob8178 | 13762 | seob8252 |
| 13523 | seob7917 | 13583 | seob7993 | 13643 | seob8072 | 13703 | seob8179 | 13763 | seob8254 |
| 13524 | seob7918 | 13584 | seob7994 | 13644 | seob8073 | 13704 | seob8180 | 13764 | seob8255 |
| 13525 | seob7919 | 13585 | seob7995 | 13645 | seob8076 | 13705 | seob8181 | 13765 | seob8256 |
| 13526 | seob7920 | 13586 | seob7996 | 13646 | seob8077 | 13706 | seob8182 | 13766 | seob8257 |
| 13527 | seob7921 | 13587 | seob7998 | 13647 | seob8078 | 13707 | seob8184 | 13767 | seob8258 |
| 13528 | seob7923 | 13588 | seob7999 | 13648 | seob8079 | 13708 | seob8185 | 13768 | seob8260 |
| 13529 | seob7924 | 13589 | seob8000 | 13649 | seob8080 | 13709 | seob8186 | 13769 | seob8261 |
| 13530 | seob7926 | 13590 | seob8001 | 13650 | seob8081 | 13710 | seob8187 | 13770 | seob8262 |
| 13531 | seob7928 | 13591 | seob8002 | 13651 | seob8082 | 13711 | seob8188 | 13771 | seob8263 |
| 13532 | seob7929 | 13592 | seob8004 | 13652 | seob8083 | 13712 | seob8189 | 13772 | seob8264 |
| 13533 | seob7930 | 13593 | seob8006 | 13653 | seob8084 | 13713 | seob8190 | 13773 | seob8265 |
| 13534 | seob7931 | 13594 | seob8007 | 13654 | seob8085 | 13714 | seob8191 | 13774 | seob8266 |
| 13535 | seob7933 | 13595 | seob8008 | 13655 | seob8086 | 13715 | seob8192 | 13775 | seob8267 |
| 13536 | seob7934 | 13596 | seob8009 | 13656 | seob8087 | 13716 | seob8193 | 13776 | seob8268 |
| 13537 | seob7935 | 13597 | seob8010 | 13657 | seob8088 | 13717 | seob8194 | 13777 | seob8269 |
| 13538 | seob7936 | 13598 | seob8011 | 13658 | seob8089 | 13718 | seob8196 | 13778 | seob8271 |
| 13539 | seob7937 | 13599 | seob8012 | 13659 | seob8090 | 13719 | seob8198 | 13779 | seob8275 |
| 13540 | seob7938 | 13600 | seob8013 | 13660 | seob8092 | 13720 | seob8200 | 13780 | seob8276 |
| 13541 | seob7939 | 13601 | seob8015 | 13661 | seob8093 | 13721 | seob8202 | 13781 | seob8277 |
| 13542 | seob7940 | 13602 | seob8016 | 13662 | seob8094 | 13722 | seob8204 | 13782 | seob8278 |
| 13543 | seob7941 | 13603 | seob8017 | 13663 | seob8095 | 13723 | seob8205 | 13783 | seob8279 |
| 13544 | seob7942 | 13604 | seob8018 | 13664 | seob8096 | 13724 | seob8207 | 13784 | seob8280 |
| 13545 | seob7944 | 13605 | seob8019 | 13665 | seob8097 | 13725 | seob8208 | 13785 | seob8281 |
| 13546 | seob7945 | 13606 | seob8020 | 13666 | seob8099 | 13726 | seob8209 | 13786 | seob8282 |
| 13547 | seob7946 | 13607 | seob8021 | 13667 | seob8100 | 13727 | seob8210 | 13787 | seob8284 |
| 13548 | seob7947 | 13608 | seob8022 | 13668 | seob8101 | 13728 | seob8211 | 13788 | seob8285 |
| 13549 | seob7948 | 13609 | seob8024 | 13669 | seob8102 | 13729 | seob8212 | 13789 | seob8286 |
| 13550 | seob7949 | 13610 | seob8025 | 13670 | seob8104 | 13730 | seob8214 | 13790 | seob8287 |
| 13551 | seob7951 | 13611 | seob8026 | 13671 | seob8106 | 13731 | seob8215 | 13791 | seob8288 |
| 13552 | seob7952 | 13612 | seob8027 | 13672 | seob8107 | 13732 | seob8216 | 13792 | seob8289 |
| 13553 | seob7953 | 13613 | seob8028 | 13673 | seob8108 | 13733 | seob8217 | 13793 | seob8291 |
| 13554 | seob7954 | 13614 | seob8029 | 13674 | seob8110 | 13734 | seob8219 | 13794 | seob8292 |
| 13555 | seob7955 | 13615 | seob8030 | 13675 | seob8129 | 13735 | seob8220 | 13795 | seob8293 |
| 13556 | seob7956 | 13616 | seob8031 | 13676 | seob8130 | 13736 | seob8221 | 13796 | seob8294 |
| 13557 | seob7957 | 13617 | seob8032 | 13677 | seob8132 | 13737 | seob8223 | 13797 | seob8296 |
| 13558 | seob7958 | 13618 | seob8034 | 13678 | seob8135 | 13738 | seob8224 | 13798 | seob8297 |
| 13559 | seob7960 | 13619 | seob8035 | 13679 | seob8138 | 13739 | seob8225 | 13799 | seob8298 |
| 13560 | seob7962 | 13620 | seob8037 | 13680 | seob8140 | 13740 | seob8226 | 13800 | seob8299 |

Figure 6E - List of EST Sequence Names From Severe OA Cartilage cDNA Library

| | | | | | | | | | |
|---|---|---|---|---|---|---|---|---|---|
| 13801 | seob8300 | 13861 | SOA0046 | 13921 | soa0196n | 13981 | soa0292n | 14041 | SOA0393 |
| 13802 | seob8301 | 13862 | SOA0047 | 13922 | soa0197n | 13982 | soa0294n | 14042 | SOA0397 |
| 13803 | seob8303 | 13863 | soa0049n | 13923 | soa0198n | 13983 | soa0298n | 14043 | SOA0399 |
| 13804 | seob8305 | 13864 | SOA0050 | 13924 | soa0201n | 13984 | soa0300n | 14044 | SOA0401 |
| 13805 | seob8306 | 13865 | soa0053n | 13925 | soa0204n | 13985 | soa0301n | 14045 | SOA0403 |
| 13806 | seob8308 | 13866 | SOA0055 | 13926 | SOA0207 | 13986 | SOA0303 | 14046 | soa0405n |
| 13807 | seob8309 | 13867 | SOA0056 | 13927 | SOA0208 | 13987 | SOA0304 | 14047 | SOA0406 |
| 13808 | seob8310 | 13868 | SOA0058 | 13928 | SOA0209 | 13988 | soa0306n | 14048 | SOA0409 |
| 13809 | seob8311 | 13869 | SOA0059 | 13929 | SOA0210 | 13989 | SOA0307 | 14049 | SOA0410 |
| 13810 | seob8312 | 13870 | SOA0060 | 13930 | SOA0212 | 13990 | SOA0308 | 14050 | SOA0411 |
| 13811 | seob8313 | 13871 | SOA0064 | 13931 | SOA0213 | 13991 | SOA0310 | 14051 | SOA0412 |
| 13812 | seob8314 | 13872 | SOA0065 | 13932 | SOA0214 | 13992 | SOA0315 | 14052 | SOA0413 |
| 13813 | seob8315 | 13873 | SOA0068 | 13933 | SOA0215 | 13993 | SOA0317 | 14053 | SOA0415 |
| 13814 | seob8317 | 13874 | SOA0070 | 13934 | SOA0216 | 13994 | SOA0319 | 14054 | SOA0416 |
| 13815 | seob8319 | 13875 | SOA0071 | 13935 | SOA0217 | 13995 | SOA0322 | 14055 | SOA0417 |
| 13816 | seob8320 | 13876 | SOA0076 | 13936 | SOA0219 | 13996 | SOA0323 | 14056 | SOA0419 |
| 13817 | seob8321 | 13877 | SOA0077 | 13937 | SOA0220 | 13997 | SOA0327 | 14057 | SOA0420 |
| 13818 | seob8322 | 13878 | soa0078n | 13938 | SOA0221 | 13998 | SOA0328 | 14058 | SOA0421 |
| 13819 | seob8323 | 13879 | SOA0079 | 13939 | SOA0222 | 13999 | soa0329n | 14059 | SOA0426 |
| 13820 | seob8324 | 13880 | SOA0082 | 13940 | SOA0223 | 14000 | SOA0330 | 14060 | SOA0427 |
| 13821 | seob8326 | 13881 | SOA0083 | 13941 | SOA0224 | 14001 | SOA0331 | 14061 | SOA0428 |
| 13822 | seob8328 | 13882 | SOA0085 | 13942 | SOA0225 | 14002 | SOA0332 | 14062 | SOA0429 |
| 13823 | seob8329 | 13883 | SOA0089 | 13943 | SOA0228 | 14003 | SOA0334 | 14063 | SOA0434 |
| 13824 | seob8330 | 13884 | SOA0092 | 13944 | SOA0229 | 14004 | SOA0335 | 14064 | soa0435n |
| 13825 | seob8332 | 13885 | soa0093n | 13945 | soa0230n | 14005 | SOA0337 | 14065 | SOA0436 |
| 13826 | seob8333 | 13886 | SOA0095 | 13946 | SOA0231 | 14006 | SOA0338 | 14066 | SOA0437 |
| 13827 | seob8334 | 13887 | SOA0096 | 13947 | SOA0233 | 14007 | SOA0340 | 14067 | soa0439 |
| 13828 | seob8335 | 13888 | SOA0100 | 13948 | SOA0234 | 14008 | SOA0341 | 14068 | SOA0440 |
| 13829 | seob8336 | 13889 | SOA0101 | 13949 | SOA0236 | 14009 | SOA0342 | 14069 | SOA0442N |
| 13830 | seob8337 | 13890 | SOA0103 | 13950 | soa0237n | 14010 | soa0343n | 14070 | SOA0444 |
| 13831 | seob8338 | 13891 | SOA0105 | 13951 | SOA0239 | 14011 | soa0345n | 14071 | SOA0445 |
| 13832 | seob8339 | 13892 | SOA0107 | 13952 | soa0240n | 14012 | soa0346n | 14072 | SOA0448 |
| 13833 | seob8341 | 13893 | SOA0109 | 13953 | SOA0241 | 14013 | SOA0347 | 14073 | SOA0449 |
| 13834 | seob8343 | 13894 | soa0111n | 13954 | SOA0242 | 14014 | SOA0348 | 14074 | SOA0450 |
| 13835 | seob8344 | 13895 | SOA0116 | 13955 | soa0245n | 14015 | SOA0349 | 14075 | SOA0453 |
| 13836 | seob8345 | 13896 | SOA0117 | 13956 | SOA0248 | 14016 | SOA0351 | 14076 | soa0461n |
| 13837 | soa0001n | 13897 | SOA0121 | 13957 | SOA0249 | 14017 | SOA0353 | 14077 | soa0463n |
| 13838 | SOA0002 | 13898 | SOA0122 | 13958 | SOA0251 | 14018 | SOA0354 | 14078 | SOA0464 |
| 13839 | soa0004n | 13899 | SOA0125 | 13959 | SOA0253 | 14019 | SOA0356 | 14079 | soa0466n |
| 13840 | soa0005n | 13900 | SOA0131 | 13960 | SOA0256 | 14020 | SOA0357 | 14080 | SOA0467 |
| 13841 | soa0006n | 13901 | SOA0132 | 13961 | SOA0257 | 14021 | soa0360n | 14081 | SOA0468 |
| 13842 | soa0007n | 13902 | SOA0133 | 13962 | SOA0262 | 14022 | SOA0362 | 14082 | SOA0470 |
| 13843 | SOA0008 | 13903 | SOA0134 | 13963 | SOA0263 | 14023 | soa0363n | 14083 | SOA0471 |
| 13844 | soa0012n | 13904 | SOA0138 | 13964 | SOA0264 | 14024 | SOA0365 | 14084 | SOA0473 |
| 13845 | SOA0017 | 13905 | soa0140n | 13965 | SOA0267 | 14025 | SOA0368 | 14085 | SOA0476 |
| 13846 | SOA0021 | 13906 | SOA0141 | 13966 | SOA0269 | 14026 | SOA0369 | 14086 | soa0477n |
| 13847 | soa0022n | 13907 | SOA0142 | 13967 | soa0271n | 14027 | SOA0370 | 14087 | SOA0478 |
| 13848 | SOA0024 | 13908 | SOA0143 | 13968 | SOA0274 | 14028 | SOA0372 | 14088 | SOA0481 |
| 13849 | soa0026 | 13909 | SOA0145 | 13969 | SOA0275 | 14029 | soa0373n | 14089 | SOA0482 |
| 13850 | SOA0027 | 13910 | soa0146n | 13970 | soa0277n | 14030 | SOA0375 | 14090 | SOA0483 |
| 13851 | soa0028n | 13911 | SOA0147 | 13971 | SOA0278 | 14031 | SOA0376 | 14091 | SOA0484 |
| 13852 | SOA0031 | 13912 | SOA0148 | 13972 | SOA0281 | 14032 | SOA0377 | 14092 | SOA0485 |
| 13853 | SOA0033 | 13913 | SOA0149 | 13973 | SOA0282 | 14033 | SOA0379 | 14093 | soa0486n |
| 13854 | SOA0035 | 13914 | SOA0154 | 13974 | SOA0283 | 14034 | SOA0381 | 14094 | SOA0487 |
| 13855 | soa0038n | 13915 | SOA0156 | 13975 | SOA0284 | 14035 | soa0382n | 14095 | SOA0488 |
| 13856 | soa0039n | 13916 | SOA0158 | 13976 | SOA0285 | 14036 | SOA0384 | 14096 | soa0489n |
| 13857 | soa0040n | 13917 | SOA0161 | 13977 | SOA0286 | 14037 | SOA0387 | 14097 | SOA0490 |
| 13858 | soa0042n | 13918 | SOA0163 | 13978 | SOA0288 | 14038 | soa0388n | 14098 | SOA0491 |
| 13859 | soa0043n | 13919 | SOA0165 | 13979 | SOA0289 | 14039 | SOA0389 | 14099 | SOA0493 |
| 13860 | SOA0044 | 13920 | SOA0195 | 13980 | soa0291n | 14040 | SOA0391 | 14100 | SOA0495 |

Figure 6E – List of EST Sequence Names From Severe OA Cartilage cDNA Library

| | |
|---|---|
| 14101 | SOA0496 |
| 14102 | SOA0498 |
| 14103 | SOA0501 |
| 14104 | SOA0503 |
| 14105 | SOA0505 |
| 14106 | SOA0506 |
| 14107 | SOA0514 |
| 14108 | SOA0516 |
| 14109 | SOA0518 |
| 14110 | SOA0520 |
| 14111 | soa0521n |
| 14112 | SOA0523 |
| 14113 | SOA0525 |
| 14114 | SOA0526 |
| 14115 | SOA0527 |
| 14116 | soa0529n |
| 14117 | SOA0532 |
| 14118 | soa0533n |
| 14119 | SOA0535 |
| 14120 | SOA0536 |
| 14121 | SOA0537 |
| 14122 | soa0539n |
| 14123 | soa0540n |
| 14124 | SOA0541 |
| 14125 | SOA0542 |
| 14126 | SOA0544 |
| 14127 | SOA0545 |
| 14128 | SOA0546 |
| 14129 | SOA0549 |
| 14130 | SOA0550 |
| 14131 | SOA0552 |
| 14132 | SOA0554 |
| 14133 | SOA0558 |
| 14134 | SOA0559 |
| 14135 | SOA0560 |
| 14136 | SOA0561 |
| 14137 | SOA0563 |
| 14138 | soa0564n |
| 14139 | SOA0565 |
| 14140 | SOA0567 |
| 14141 | soa0568n |
| 14142 | SOA0569 |
| 14143 | SOA0570 |
| 14144 | SOA0571 |
| 14145 | SOA0575 |
| 14146 | SOA0579 |
| 14147 | SOA0580 |
| 14148 | SOA0583 |
| 14149 | soa0585n |
| 14150 | SOA0589 |
| 14151 | SOA0591 |
| 14152 | SOA0593 |
| 14153 | SOA0594 |
| 14154 | SOA0598 |
| 14155 | SOA0600 |
| 14156 | SOA0601 |
| 14157 | SOA0602 |
| 14158 | SOA0604 |
| 14159 | SOA0605 |
| 14160 | SOA0606 |
| 14161 | SOA0608 |
| 14162 | soa0609n |
| 14163 | SOA0611 |
| 14164 | SOA0612 |
| 14165 | soa0613n |
| 14166 | SOA0614 |
| 14167 | SOA0615 |
| 14168 | SOA0616 |
| 14169 | SOA0619 |
| 14170 | SOA0620 |
| 14171 | SOA0621 |
| 14172 | SOA0622 |
| 14173 | SOA0623 |
| 14174 | SOA0630 |
| 14175 | SOA0631 |
| 14176 | SOA0632 |
| 14177 | soa0633n |
| 14178 | SOA0634 |
| 14179 | soa0636n |
| 14180 | soa0637n |
| 14181 | SOA0639 |
| 14182 | SOA0640 |
| 14183 | SOA0641 |
| 14184 | SOA0642 |
| 14185 | SOA0643 |
| 14186 | SOA0646 |
| 14187 | SOA0647 |
| 14188 | SOA0648 |
| 14189 | SOA0650 |
| 14190 | SOA0651 |
| 14191 | SOA0652 |
| 14192 | SOA0654 |
| 14193 | SOA0659 |
| 14194 | SOA0660 |
| 14195 | SOA0661 |
| 14196 | SOA0662 |
| 14197 | SOA0667 |
| 14198 | SOA0670 |
| 14199 | SOA0673 |
| 14200 | SOA0674n |
| 14201 | SOA0675 |
| 14202 | SOA0677n |
| 14203 | SOA0678 |
| 14204 | SOA0679 |
| 14205 | SOA0684 |
| 14206 | SOA0685 |
| 14207 | SOA0688 |
| 14208 | SOA0690 |
| 14209 | SOA0692 |
| 14210 | SOA0693 |
| 14211 | SOA0694 |
| 14212 | SOA0698 |
| 14213 | SOA0701 |
| 14214 | SOA0704 |
| 14215 | soa0705n |
| 14216 | SOA0706 |
| 14217 | SOA0707 |
| 14218 | soa0712 |
| 14219 | SOA0713 |
| 14220 | SOA0715 |
| 14221 | SOA0716 |
| 14222 | SOA0718 |

Figure 7 - Characterization of Human Cartilage cDNA Libraries Based on Functional Classification of Known/Unique Genes

| **Functional Classification** | **Fetal** | | **Normal** | | **Mild** | | **Severe** | |
|---|---|---|---|---|---|---|---|---|
| | # of ESTs | | # of ESTs | | # of ESTs | | # of ESTs | |
| Cell division | 60 | 4.50% | 11 | 3.27% | 64 | 4.10% | 65 | 3.90% |
| Cell signaling/communication | 162 | 12.10% | 42 | 12.50% | 170 | 10.80% | 161 | 9.60% |
| Cell structure/motility | 136 | 10.20% | 31 | 9.23% | 88 | 5.60% | 110 | 6.60% |
| Cell/organism defense | 66 | 4.90% | 14 | 4.17% | 62 | 3.90% | 63 | 3.80% |
| Gene/protein expression | 340 | 25.40% | 104 | 30.95% | 306 | 19.40% | 345 | 20.60% |
| Metabolism | 166 | 12.40% | 54 | 16.07% | 193 | 12.20% | 208 | 12.40% |
| Unclassified | 406 | 30.40% | 80 | 23.81% | 693 | 44.00% | 724 | 43.20% |
| Total known/unique genes analyzed | 1336 | | 336 | | 1576 | | 1676 | |

Total of 19,893 ESTs from the four libraries were analyzed

Note: See Figure 7A for graphical breakdown in each of the four human cartilage cDNA libraries

Characterization of Different Cartilage Libraries Based on Functional Classification of Known/Unique Genes Figure 8 - List of Novel and Known Gene Clones from Mild OA and Severe OA Libraries on Microarray (page 1 of 10)

| | | | | | | | | |
|---|---|---|---|---|---|---|---|---|
| 1 | SEOA0002 | SEOA0159 | SEOA0320 | SEOA0488 | SEOA0759 | SEOA0904 | SEOA1069a | SEOA1259A |
| 2 | SEOA0004 | SEOA0160 | SEOA0325 | SEOA0492 | SEOA0761 | SEOA0905 | SEOA1070a | SEOA1267A |
| 3 | SEOA0005 | SEOA0161a | SEOA0326n | SEOA0500 | SEOA0769 | SEOA0906 | SEOA1071a | SEOA1268A |
| 4 | SEOA0009 | SEOA0163a | SEOA0329n | SEOA0501 | SEOA0770 | SEOA0913 | SEOA1072a | SEOA1269a |
| 5 | SEOA0010 | SEOA0166a | SEOA0331 | SEOA0511 | SEOA0772n | SEOA0914 | SEOA1073a | SEOA1270a |
| 6 | SEOA0014 | SEOA0167a | SEOA0333n | SEOA0512 | SEOA0775 | SEOA0917 | SEOA1074a | SEOA1273a |
| 7 | SEOA0017 | SEOA0168a | SEOA0334 | SEOA0514 | SEOA0783 | SEOA0918 | SEOA1076a | SEOA1277a |
| 8 | SEOA0020 | SEOA0169a | SEOA0353 | SEOA0515 | SEOA0784n | SEOA0920 | SEOA1080a | SEOA1278a |
| 9 | SEOA0021 | SEOA0172a | SEOA0357 | SEOA0518 | SEOA0785n | SEOA0925 | SEOA1082a | SEOA1282a |
| 10 | SEOA0023 | SEOA0174a | SEOA0360 | SEOA0519 | SEOA0786 | SEOA0928 | SEOA1083a | SEOA1284a |
| 11 | SEOA0024 | SEOA0177a | SEOA0361 | SEOA0520 | SEOA0787 | SEOA0930 | SEOA1084a | SEOA1287a |
| 12 | SEOA0027 | SEOA0182a | SEOA0367n | SEOA0524 | SEOA0790 | SEOA0934 | SEOA1086a | SEOA1288a |
| 13 | SEOA0028 | SEOA0183a | SEOA0368 | SEOA0526 | SEOA0791 | SEOA0935 | SEOA1089a | SEOA1290a |
| 14 | SEOA0031 | SEOA0186a | SEOA0370 | SEOA0528n | SEOA0792 | SEOA0936 | SEOA1092a | SEOA1292a |
| 15 | SEOA0033 | SEOA0187a | SEOA0373 | SEOA0529 | SEOA0794 | SEOA0939 | SEOA1095a | SEOA1295a |
| 16 | SEOA0036 | SEOA0190A | SEOA0374 | SEOA0532 | SEOA0795 | SEOA0940 | SEOA1099a | SEOA1297a |
| 17 | SEOA0037 | SEOA0191A | SEOA0377 | SEOA0534 | SEOA0799 | SEOA0941 | SEOA1100a | SEOA1300a |
| 18 | SEOA0038 | SEOA0193A | SEOA0379 | SEOA0535 | SEOA0801 | SEOA0947 | SEOA1102a | SEOA1301a |
| 19 | SEOA0039 | SEOA0196A | SEOA0380n | SEOA0536 | SEOA0803 | SEOA0949n | SEOA1104a | SEOA1304a |
| 20 | SEOA0041n | SEOA0197A | SEOA0381 | SEOA0539n | SEOA0804 | SEOA0952 | SEOA1106a | SEOA1307a |
| 21 | SEOA0045n | SEOA0198A | SEOA0382 | SEOA0541n | SEOA0805 | SEOA0953 | SEOA1108a | SEOA1310a |
| 22 | SEOA0046 | SEOA0200A | SEOA0383 | SEOA0542n | SEOA0809 | SEOA0958 | SEOA1109a | SEOA1312a |
| 23 | SEOA0048 | SEOA0201A | SEOA0386 | SEOA0545A | SEOA0811 | SEOA0959 | SEOA1114a | SEOA1316n |
| 24 | SEOA0051 | SEOA0202A | SEOA0388 | SEOA0546A | SEOA0812 | SEOA0960n | SEOA1116a | SEOA1318 |
| 25 | SEOA0052n | SEOA0203A | SEOA0390 | SEOA0548A | SEOA0819n | SEOA0962n | SEOA1128a | SEOA1320 |
| 26 | SEOA0055 | SEOA0206a | SEOA0391 | SEOA0549A | SEOA0821 | SEOA0963n | SEOA1130a | SEOA1323 |
| 27 | SEOA0057 | SEOA0207a | SEOA0396 | SEOA0550A | SEOA0822 | SEOA0964 | SEOA1132a | SEOA1326 |
| 28 | SEOA0061 | SEOA0208a | SEOA0399 | SEOA0552A | SEOA0824 | SEOA0966 | SEOA1134a | SEOA1327 |
| 29 | SEOA0064 | SEOA0210a | SEOA0401 | SEOA0554A | SEOA0827 | SEOA0967 | SEOA1137a | SEOA1329 |
| 30 | SEOA0065 | SEOA0211a | SEOA0404 | SEOA0559A | SEOA0830 | SEOA0969 | SEOA1141a | SEOA1336 |
| 31 | SEOA0066 | SEOA0212a | SEOA0407 | SEOA0560A | SEOA0832 | SEOA0970 | SEOA1145a | SEOA1338 |
| 32 | SEOA0071 | SEOA0213a | SEOA0409 | SEOA0562A | SEOA0840 | SEOA0971 | SEOA1148a | SEOA1340 |
| 33 | SEOA0072 | SEOA0218a | SEOA0410 | SEOA0563A | SEOA0841 | SEOA0973 | SEOA1159A | SEOA1341 |
| 34 | SEOA0074 | SEOA0219a | SEOA0413 | SEOA0564A | SEOA0844 | SEOA0974 | SEOA1161A | SEOA1343 |
| 35 | SEOA0076 | SEOA0221a | SEOA0418 | SEOA0568 | SEOA0845 | SEOA0975 | SEOA1166A | SEOA1347 |
| 36 | SEOA0080 | SEOA0224a | SEOA0420 | SEOA0572 | SEOA0847 | SEOA0982 | SEOA1169A | SEOA1348 |
| 37 | SEOA0082 | SEOA0226a | SEOA0422 | SEOA0574a | SEOA0848 | SEOA0982n | SEOA1173A | SEOA1349 |
| 38 | SEOA0085 | SEOA0228a | SEOA0423 | SEOA0575 | SEOA0849 | SEOA0986 | SEOA1181A | SEOA1362a |
| 39 | SEOA0088 | SEOA0235a | SEOA0424n | SEOA0577 | SEOA0850n | SEOA0990n | SEOA1182A | SEOA1363 |
| 40 | SEOA0091n | SEOA0237a | SEOA0425 | SEOA0579n | SEOA0851 | SEOA0996 | SEOA1183A | SEOA1365 |
| 41 | SEOA0096n | SEOA0238a | SEOA0427 | SEOA0587 | SEOA0852 | SEOA1002 | SEOA1184A | SEOA1366a |
| 42 | SEOA0100 | SEOA0240a | SEOA0437 | SEOA0596a | SEOA0853 | SEOA1005n | SEOA1187a | SEOA1368 |
| 43 | SEOA0101 | SEOA0243a | SEOA0438 | SEOA0597a | SEOA0854 | SEOA1006n | SEOA1188A | SEOA1369 |
| 44 | SEOA0106 | SEOA0245a | SEOA0441n | SEOA0598a | SEOA0855 | SEOA1009n | SEOA1190A | SEOA1372 |
| 45 | SEOA0107 | SEOA0248a | SEOA0444 | SEOA0599a | SEOA0861 | SEOA1022 | SEOA1192A | SEOA1373 |
| 46 | SEOA0111 | SEOA0250a | SEOA0446 | SEOA0600a | SEOA0862 | SEOA1023 | SEOA1198A | SEOA1374 |
| 47 | SEOA0114 | SEOA0252a | SEOA0449 | SEOA0601a | SEOA0864 | SEOA1030 | SEOA1201A | SEOA1376 |
| 48 | SEOA0116 | SEOA0272 | SEOA0450 | SEOA0721a | SEOA0865 | SEOA1032a | SEOA1203A | SEOA1378 |
| 49 | SEOA0118 | SEOA0276 | SEOA0451n | SEOA0725a | SEOA0866 | SEOA1036a | SEOA1204A | SEOA1379 |
| 50 | SEOA0121 | SEOA0277 | SEOA0455 | SEOA0727a | SEOA0869 | SEOA1038a | SEOA1208A | SEOA1380 |
| 51 | SEOA0124n | SEOA0279 | SEOA0462 | SEOA0728a | SEOA0870 | SEOA1039a | SEOA1213A | SEOA1381 |
| 52 | SEOA0125 | SEOA0280 | SEOA0463 | SEOA0729a | SEOA0873 | SEOA1040a | SEOA1216A | SEOA1382 |
| 53 | SEOA0126 | SEOA0281 | SEOA0464 | SEOA0730a | SEOA0874 | SEOA1042a | SEOA1220A | SEOA1389 |
| 54 | SEOA0127 | SEOA0284n | SEOA0465 | SEOA0731a | SEOA0875 | SEOA1044a | SEOA1222A | SEOA1390 |
| 55 | SEOA0137 | SEOA0290 | SEOA0466 | SEOA0733a | SEOA0880 | SEOA1045a | SEOA1227A | SEOA1392 |
| 56 | SEOA0138 | SEOA0295 | SEOA0468 | SEOA0737n | SEOA0882 | SEOA1046a | SEOA1232A | SEOA1394 |
| 57 | SEOA0139 | SEOA0297 | SEOA0470n | SEOA0738 | SEOA0883 | SEOA1049a | SEOA1234A | SEOA1399 |
| 58 | SEOA0145 | SEOA0301 | SEOA0471 | SEOA0741 | SEOA0884 | SEOA1053a | SEOA1236A | SEOA1403 |
| 59 | SEOA0147 | SEOA0302 | SEOA0473 | SEOA0744 | SEOA0890n | SEOA1054a | SEOA1237A | SEOA1405 |
| 60 | SEOA0149 | SEOA0310 | SEOA0477 | SEOA0745 | SEOA0895 | SEOA1056a | SEOA1239A | SEOA1406 |
| 61 | SEOA0150 | SEOA0312 | SEOA0479 | SEOA0746 | SEOA0896 | SEOA1058a | SEOA1240A | SEOA1415a |
| 62 | SEOA0155 | SEOA0315n | SEOA0481 | SEOA0749 | SEOA0897n | SEOA1062a | SEOA1245A | SEOA1419a |
| 63 | SEOA0156 | SEOA0316 | SEOA0483 | SEOA0751 | SEOA0900 | SEOA1065a | SEOA1248A | SEOA1420a |
| 64 | SEOA0157 | SEOA0317 | SEOA0485 | SEOA0752 | SEOA0901 | SEOA1066a | SEOA1249A | SEOA1421a |
| 65 | SEOA0158 | SEOA0318 | SEOA0486 | SEOA0755 | SEOA0902 | SEOA1067a | SEOA1250A | SEOA1422a |
| 66 | SEOA1425a | SEOA1580a | SEOA1725a | SEOA1872a | SEOA2072 | SEOA2230a | SEOA2421a | SEOA2572 |
| 67 | SEOA1428a | SEOA1581a | SEOA1726a | SEOA1874a | SEOA2079 | SEOA2232a | SEOA2423a | SEOA2574 |

Figure 8 - List of Novel and Known Gene Clones from Mild OA and Severe OA Libraries on Microarray (page 2 of 10)

| | | | | | | | | |
|---|---|---|---|---|---|---|---|---|
| 68 | SEOA1430a | SEOA1582a | SEOA1727a | SEOA1875a | SEOA2084 | SEOA2233a | SEOA2424a | SEOA2575 |
| 69 | SEOA1431a | SEOA1583a | SEOA1729a | SEOA1877a | SEOA2095 | SEOA2234a | SEOA2425a | SEOA2578 |
| 70 | SEOA1432a | SEOA1584a | SEOA1730a | SEOA1880 | SEOA2096 | SEOA2235a | SEOA2428a | SEOA2579m |
| 71 | SEOA1434a | SEOA1585a | SEOA1731a | SEOA1881 | SEOA2097n | SEOA2239a | SEOA2429a | SEOA2580m |
| 72 | SEOA1436a | SEOA1586a | SEOA1741a | SEOA1885 | SEOA2099 | SEOA2240a | SEOA2431a | SEOA2581 |
| 73 | SEOA1439a | SEOA1589a | SEOA1742a | SEOA1886n | SEOA2100 | SEOA2243a | SEOA2432a | SEOA2583 |
| 74 | SEOA1440a | SEOA1595a | SEOA1747a | SEOA1896 | SEOA2103n | SEOA2246a | SEOA2442a | SEOA2584 |
| 75 | SEOA1442a | SEOA1596a | SEOA1748a | SEOA1897 | SEOA2106 | SEOA2251a | SEOA2443a | SEOA2585 |
| 76 | SEOA1443a | SEOA1598a | SEOA1749a | SEOA1900n | SEOA2109 | SEOA2253a | SEOA2445a | SEOA2589 |
| 77 | SEOA1445a | SEOA1599a | SEOA1750a | SEOA1901 | SEOA2111 | SEOA2256a | SEOA2447a | SEOA2592 |
| 78 | SEOA1448a | SEOA1601a | SEOA1751a | SEOA1902 | SEOA2112n | SEOA2261a | SEOA2448a | SEOA2595 |
| 79 | SEOA1452a | SEOA1606a | SEOA1755a | SEOA1909 | SEOA2117 | SEOA2263a | SEOA2449a | SEOA2599m |
| 80 | SEOA1454a | SEOA1610a | SEOA1756a | SEOA1912n | SEOA2120 | SEOA2270a | SEOA2452a | SEOA2602 |
| 81 | SEOA1457a | SEOA1611a | SEOA1759a | SEOA1913n | SEOA2121 | SEOA2272a | SEOA2454a | SEOA2603 |
| 82 | SEOA1458a | SEOA1614a | SEOA1760a | SEOA1914 | SEOA2122 | SEOA2279a | SEOA2456a | SEOA2606m |
| 83 | SEOA1460a | SEOA1615a | SEOA1761a | SEOA1917 | SEOA2125 | SEOA2283a | SEOA2458a | SEOA2607m |
| 84 | SEOA1465a | SEOA1617a | SEOA1762a | SEOA1921 | SEOA2126n | SEOA2286a | SEOA2461a | SEOA2611 |
| 85 | SEOA1468a | SEOA1621a | SEOA1765a | SEOA1923 | SEOA2127 | SEOA2287a | SEOA2465 | SEOA2612 |
| 86 | SEOA1471a | SEOA1623a | SEOA1766a | SEOA1924n | SEOA2127n | SEOA2288a | SEOA2467 | SEOA2616 |
| 87 | SEOA1474 | SEOA1629a | SEOA1768a | SEOA1925n | SEOA2128 | SEOA2291a | SEOA2469 | SEOA2617 |
| 88 | SEOA1477 | SEOA1631a | SEOA1770a | SEOA1932 | SEOA2130n | SEOA2292a | SEOA2470 | SEOA2618 |
| 89 | SEOA1483n | SEOA1632a | SEOA1771a | SEOA1936 | SEOA2132 | SEOA2293a | SEOA2471 | SEOA2620 |
| 90 | SEOA1484n | SEOA1634a | SEOA1773a | SEOA1940 | SEOA2135 | SEOA2294a | SEOA2472 | SEOA2621 |
| 91 | SEOA1487 | SEOA1635a | SEOA1776a | SEOA1947 | SEOA2136 | SEOA2295a | SEOA2473m | SEOA2622 |
| 92 | SEOA1491 | SEOA1640a | SEOA1778a | SEOA1954 | SEOA2138 | SEOA2298a | SEOA2479 | SEOA2623 |
| 93 | SEOA1492n | SEOA1643a | SEOA1782a | SEOA1955 | SEOA2141 | SEOA2300a | SEOA2481 | SEOA2629 |
| 94 | SEOA1493 | SEOA1647a | SEOA1786a | SEOA1964a | SEOA2142 | SEOA2301a | SEOA2482 | SEOA2631 |
| 95 | SEOA1496n | SEOA1648a | SEOA1787a | SEOA1965a | SEOA2146n | SEOA2302a | SEOA2484 | SEOA2632 |
| 96 | SEOA1501 | SEOA1653a | SEOA1789a | SEOA1969a | SEOA2147 | SEOA2303a | SEOA2486 | SEOA2633 |
| 97 | SEOA1507n | SEOA1654a | SEOA1791a | SEOA1971a | SEOA2148n | SEOA2308a | SEOA2487 | SEOA2635 |
| 98 | SEOA1508 | SEOA1655a | SEOA1793a | SEOA1977a | SEOA2149 | SEOA2309a | SEOA2488 | SEOA2636 |
| 99 | SEOA1513 | SEOA1656a | SEOA1795a | SEOA1979a | SEOA2154n | SEOA2311a | SEOA2489m | SEOA2639 |
| 100 | SEOA1517n | SEOA1657a | SEOA1797a | SEOA1980a | SEOA2157 | SEOA2313a | SEOA2491 | SEOA2640 |
| 101 | SEOA1521 | SEOA1658a | SEOA1799a | SEOA1983a | SEOA2158 | SEOA2320a | SEOA2492 | SEOA2641 |
| 102 | SEOA1522n | SEOA1662a | SEOA1802a | SEOA1988a | SEOA2159 | SEOA2326a | SEOA2493 | SEOA2642 |
| 103 | SEOA1523 | SEOA1665a | SEOA1803a | SEOA1991 | SEOA2163 | SEOA2328a | SEOA2496 | SEOA2645 |
| 104 | SEOA1525 | SEOA1666a | SEOA1804a | SEOA1996 | SEOA2163n | SEOA2331a | SEOA2499 | SEOA2647 |
| 105 | SEOA1526 | SEOA1667a | SEOA1805a | SEOA2000a | SEOA2166 | SEOA2349a | SEOA2500m | SEOA2648 |
| 106 | SEOA1527n | SEOA1669a | SEOA1806a | SEOA2004 | SEOA2173 | SEOA2351a | SEOA2507 | SEOA2653 |
| 107 | SEOA1529 | SEOA1670a | SEOA1807a | SEOA2005 | SEOA2174 | SEOA2355a | SEOA2512 | SEOA2654 |
| 108 | SEOA1532 | SEOA1671a | SEOA1809a | SEOA2006 | SEOA2175 | SEOA2358a | SEOA2515 | SEOA2655 |
| 109 | SEOA1535 | SEOA1672a | SEOA1810a | SEOA2008 | SEOA2177a | SEOA2361a | SEOA2516 | SEOA2658 |
| 110 | SEOA1536 | SEOA1673a | SEOA1812a | SEOA2012 | SEOA2178a | SEOA2363a | SEOA2517 | SEOA2659 |
| 111 | SEOA1539 | SEOA1674a | SEOA1813a | SEOA2013 | SEOA2179a | SEOA2369a | SEOA2518 | SEOA2660m |
| 112 | SEOA1541 | SEOA1675a | SEOA1814a | SEOA2015 | SEOA2181a | SEOA2371a | SEOA2523 | SEOA2662 |
| 113 | SEOA1542 | SEOA1676a | SEOA1815a | SEOA2022 | SEOA2183a | SEOA2372a | SEOA2525 | SEOA2666 |
| 114 | SEOA1543 | SEOA1677a | SEOA1817a | SEOA2025 | SEOA2188a | SEOA2375a | SEOA2527 | SEOA2667 |
| 115 | SEOA1545 | SEOA1678a | SEOA1819a | SEOA2027 | SEOA2191a | SEOA2378a | SEOA2528 | SEOA2670 |
| 116 | SEOA1546 | SEOA1680a | SEOA1821a | SEOA2029 | SEOA2194a | SEOA2381a | SEOA2534 | SEOA2674 |
| 117 | SEOA1547 | SEOA1681a | SEOA1822a | SEOA2040 | SEOA2201a | SEOA2385a | SEOA2535 | SEOA2675n |
| 118 | SEOA1551 | SEOA1685a | SEOA1823a | SEOA2041 | SEOA2202a | SEOA2388a | SEOA2536 | SEOA2676 |
| 119 | SEOA1555 | SEOA1688a | SEOA1825a | SEOA2042 | SEOA2203a | SEOA2389a | SEOA2537 | SEOA2678m |
| 120 | SEOA1563 | SEOA1689a | SEOA1826a | SEOA2043 | SEOA2204a | SEOA2391a | SEOA2539 | SEOA2679m |
| 121 | SEOA1564 | SEOA1691a | SEOA1830a | SEOA2048 | SEOA2209a | SEOA2401a | SEOA2540 | SEOA2685 |
| 122 | SEOA1566 | SEOA1694a | SEOA1833a | SEOA2052 | SEOA2210a | SEOA2402a | SEOA2547 | SEOA2690m |
| 123 | SEOA1567 | SEOA1698a | SEOA1844a | SEOA2054a | SEOA2211a | SEOA2403a | SEOA2550 | SEOA2691m |
| 124 | SEOA1570 | SEOA1710a | SEOA1845a | SEOA2056 | SEOA2212a | SEOA2410 | SEOA2554 | SEOA2692m |
| 125 | SEOA1571 | SEOA1714a | SEOA1854a | SEOA2057 | SEOA2215a | SEOA2411 | SEOA2558 | SEOA2693m |
| 126 | SEOA1573a | SEOA1717a | SEOA1856a | SEOA2058 | SEOA2217a | SEOA2412 | SEOA2559m | SEOA2696m |
| 127 | SEOA1574a | SEOA1718a | SEOA1857a | SEOA2065 | SEOA2218a | SEOA2413 | SEOA2562 | SEOA2698m |
| 128 | SEOA1575a | SEOA1720a | SEOA1858a | SEOA2067n | SEOA2219a | SEOA2415 | SEOA2564 | SEOA2699 |
| 129 | SEOA1577a | SEOA1722a | SEOA1866a | SEOA2068 | SEOA2221a | SEOA2417a | SEOA2566 | SEOA2700 |
| 130 | SEOA1579a | SEOA1723a | SEOA1867a | SEOA2069 | SEOA2224a | SEOA2418a | SEOA2567 | SEOA2702 |
| 131 | SEOA2703 | SEOA2830 | SEOA2986a | SEOA3174 | SEOA3352a | SEOA3512a | SEOA3669a | SEOA3835 |
| 132 | SEOA2704 | SEOA2831n | SEOA2990a | SEOA3176m | SEOA3353a | SEOA3515a | SEOA3670a | SEOA3836 |
| 133 | SEOA2704n | SEOA2833n | SEOA2994a | SEOA3178m | SEOA3356a | SEOA3516a | SEOA3673a | SEOA3838 |
| 134 | SEOA2705m | SEOA2838 | SEOA2995a | SEOA3181 | SEOA3358a | SEOA3524a | SEOA3674a | SEOA3839 |

Figure 8 - List of Novel and Known Gene Clones from Mild OA and Severe OA Libraries on Microarray (page 3 of 10)

| | | | | | | | | |
|---|---|---|---|---|---|---|---|---|
| 135 | SEOA2706 | SEOA2839 | SEOA2996a | SEOA3184 | SEOA3359a | SEOA3525a | SEOA3675a | SEOA3840 |
| 136 | SEOA2710 | SEOA2840 | SEOA3002a | SEOA3186 | SEOA3369a | SEOA3531a | SEOA3679a | SEOA3847 |
| 137 | SEOA2716 | SEOA2846 | SEOA3007a | SEOA3188 | SEOA3373a | SEOA3533a | SEOA3687a | SEOA3852 |
| 138 | SEOA2718 | SEOA2847n | SEOA3009a | SEOA3191 | SEOA3374a | SEOA3538a | SEOA3689a | SEOA3853 |
| 139 | SEOA2719 | SEOA2851 | SEOA3010a | SEOA3196 | SEOA3375a | SEOA3543a | SEOA3692a | SEOA3856 |
| 140 | SEOA2720 | SEOA2853 | SEOA3016a | SEOA3199m | SEOA3376a | SEOA3548a | SEOA3693a | SEOA3857 |
| 141 | SEOA2723 | SEOA2859 | SEOA3017a | SEOA3205 | SEOA3378a | SEOA3549a | SEOA3694a | SEOA3860 |
| 142 | SEOA2728 | SEOA2862 | SEOA3018a | SEOA3209 | SEOA3379a | SEOA3551a | SEOA3698a | SEOA3861 |
| 143 | SEOA2729 | SEOA2863 | SEOA3028a | SEOA3212 | SEOA3381a | SEOA3554a | SEOA3700a | SEOA3862 |
| 144 | SEOA2732 | SEOA2868 | SEOA3032a | SEOA3216 | SEOA3382a | SEOA3556a | SEOA3701a | SEOA3863 |
| 145 | SEOA2734 | SEOA2870 | SEOA3034a | SEOA3217 | SEOA3383a | SEOA3560a | SEOA3704a | SEOA3864 |
| 146 | SEOA2738m | SEOA2874 | SEOA3038a | SEOA3219 | SEOA3384a | SEOA3561a | SEOA3708a | SEOA3868 |
| 147 | SEOA2744 | SEOA2875 | SEOA3042a | SEOA3221m | SEOA3385a | SEOA3563a | SEOA3709a | SEOA3870 |
| 148 | SEOA2746 | SEOA2876 | SEOA3049a | SEOA3223 | SEOA3387a | SEOA3566a | SEOA3711a | SEOA3871 |
| 149 | SEOA2747 | SEOA2883n | SEOA3051a | SEOA3224 | SEOA3389a | SEOA3567a | SEOA3714a | SEOA3875 |
| 150 | SEOA2750 | SEOA2889a | SEOA3052a | SEOA3226 | SEOA3391a | SEOA3571a | SEOA3716a | SEOA3876 |
| 151 | SEOA2751 | SEOA2891a | SEOA3053a | SEOA3230 | SEOA3392a | SEOA3572a | SEOA3720a | SEOA3877 |
| 152 | SEOA2752 | SEOA2892a | SEOA3055a | SEOA3231 | SEOA3393a | SEOA3573a | SEOA3731a | SEOA3885 |
| 153 | SEOA2757 | SEOA2895a | SEOA3062a | SEOA3235m | SEOA3394a | SEOA3575a | SEOA3734a | SEOA3886 |
| 154 | SEOA2758 | SEOA2898a | SEOA3063a | SEOA3238 | SEOA3395a | SEOA3577a | SEOA3737a | SEOA3887 |
| 155 | SEOA2759 | SEOA2899a | SEOA3065a | SEOA3239m | SEOA3396a | SEOA3579a | SEOA3739a | SEOA3890 |
| 156 | SEOA2760 | SEOA2900a | SEOA3069a | SEOA3241 | SEOA3397a | SEOA3582a | SEOA3740a | SEOA3891 |
| 157 | SEOA2762 | SEOA2901a | SEOA3074a | SEOA3242n | SEOA3399a | SEOA3583a | SEOA3741a | SEOA3895 |
| 158 | SEOA2764 | SEOA2903a | SEOA3075a | SEOA3245 | SEOA3400a | SEOA3587a | SEOA3743a | SEOA3896 |
| 159 | SEOA2765 | SEOA2904a | SEOA3076a | SEOA3248 | SEOA3403a | SEOA3588a | SEOA3744a | SEOA3898 |
| 160 | SEOA2767 | SEOA2906a | SEOA3079a | SEOA3249 | SEOA3405a | SEOA3589a | SEOA3746a | SEOA3899 |
| 161 | SEOA2768 | SEOA2907a | SEOA3081a | SEOA3250m | SEOA3411a | SEOA3592a | SEOA3748a | SEOA3901 |
| 162 | SEOA2770 | SEOA2910a | SEOA3084a | SEOA3251m | SEOA3414a | SEOA3597a | SEOA3749a | SEOA3907 |
| 163 | SEOA2771 | SEOA2911a | SEOA3088a | SEOA3252m | SEOA3415a | SEOA3598a | SEOA3750a | SEOA3910 |
| 164 | SEOA2773 | SEOA2913a | SEOA3092a | SEOA3255 | SEOA3416a | SEOA3600a | SEOA3751a | SEOA3913 |
| 165 | SEOA2774 | SEOA2914a | SEOA3093a | SEOA3256 | SEOA3417a | SEOA3602a | SEOA3752a | SEOA3919 |
| 166 | SEOA2775 | SEOA2918a | SEOA3094a | SEOA3257m | SEOA3419a | SEOA3603a | SEOA3758a | SEOA3921 |
| 167 | SEOA2777 | SEOA2921a | SEOA3095a | SEOA3263 | SEOA3423a | SEOA3606a | SEOA3761a | SEOA3924 |
| 168 | SEOA2782 | SEOA2922a | SEOA3097a | SEOA3268 | SEOA3424a | SEOA3610a | SEOA3763a | SEOA3926 |
| 169 | SEOA2783 | SEOA2930a | SEOA3101a | SEOA3269 | SEOA3428a | SEOA3613a | SEOA3766a | SEOA3929 |
| 170 | SEOA2784 | SEOA2931a | SEOA3105a | SEOA3270 | SEOA3429a | SEOA3614a | SEOA3767a | SEOA3931 |
| 171 | SEOA2788 | SEOA2932a | SEOA3106a | SEOA3271 | SEOA3433a | SEOA3615a | SEOA3770a | SEOA3935 |
| 172 | SEOA2792 | SEOA2934a | SEOA3118a | SEOA3272 | SEOA3434a | SEOA3622a | SEOA3771 | SEOA3937 |
| 173 | SEOA2793 | SEOA2936a | SEOA3121a | SEOA3274n | SEOA3443a | SEOA3623a | SEOA3773a | SEOA3938 |
| 174 | SEOA2795n | SEOA2937a | SEOA3122a | SEOA3287 | SEOA3444a | SEOA3627a | SEOA3778a | SEOA3946a |
| 175 | SEOA2796n | SEOA2943a | SEOA3124a | SEOA3288 | SEOA3445a | SEOA3628a | SEOA3779a | SEOA3949a |
| 176 | SEOA2800 | SEOA2944a | SEOA3125a | SEOA3289 | SEOA3449a | SEOA3629a | SEOA3790a | SEOA3964a |
| 177 | SEOA2801 | SEOA2949a | SEOA3127a | SEOA3290 | SEOA3454a | SEOA3632a | SEOA3794a | SEOA3967a |
| 178 | SEOA2802 | SEOA2952a | SEOA3129a | SEOA3293 | SEOA3466a | SEOA3633a | SEOA3795a | SEOA3968a |
| 179 | SEOA2803 | SEOA2956a | SEOA3130a | SEOA3295 | SEOA3467a | SEOA3634a | SEOA3799a | SEOA3970a |
| 180 | SEOA2805 | SEOA2958a | SEOA3131a | SEOA3296 | SEOA3472a | SEOA3635a | SEOA3800a | SEOA3971a |
| 181 | SEOA2807 | SEOA2961a | SEOA3139 | SEOA3299 | SEOA3474a | SEOA3638a | SEOA3803a | SEOA3973a |
| 182 | SEOA2809m | SEOA2962a | SEOA3140 | SEOA3308 | SEOA3476a | SEOA3639a | SEOA3804a | SEOA3974a |
| 183 | SEOA2811 | SEOA2964a | SEOA3143 | SEOA3309 | SEOA3477a | SEOA3641a | SEOA3807a | SEOA3975a |
| 184 | SEOA2813 | SEOA2966a | SEOA3144 | SEOA3311m | SEOA3486a | SEOA3646a | SEOA3808a | SEOA3976a |
| 185 | SEOA2814 | SEOA2967a | SEOA3147 | SEOA3314a | SEOA3489a | SEOA3647a | SEOA3811a | SEOA3977a |
| 186 | SEOA2816 | SEOA2968a | SEOA3153m | SEOA3315a | SEOA3490a | SEOA3648a | SEOA3812a | SEOA3981a |
| 187 | SEOA2817n | SEOA2970a | SEOA3156m | SEOA3317a | SEOA3491a | SEOA3650a | SEOA3814a | SEOA3987a |
| 188 | SEOA2818 | SEOA2971a | SEOA3157m | SEOA3318a | SEOA3494a | SEOA3651a | SEOA3815a | SEOA3988a |
| 189 | SEOA2819 | SEOA2972a | SEOA3162m | SEOA3324a | SEOA3495a | SEOA3658a | SEOA3816a | SEOA3989a |
| 190 | SEOA2820 | SEOA2974a | SEOA3164m | SEOA3325a | SEOA3499a | SEOA3660a | SEOA3819a | SEOA3990a |
| 191 | SEOA2822 | SEOA2975a | SEOA3166 | SEOA3328a | SEOA3501a | SEOA3662a | SEOA3820a | SEOA3993a |
| 192 | SEOA2823 | SEOA2978a | SEOA3167m | SEOA3330a | SEOA3504a | SEOA3664a | SEOA3821a | SEOA3995a |
| 193 | SEOA2824 | SEOA2979a | SEOA3168m | SEOA3337a | SEOA3506a | SEOA3665a | SEOA3822a | SEOA3998a |
| 194 | SEOA2825n | SEOA2981a | SEOA3171n | SEOA3343a | SEOA3510a | SEOA3666a | SEOA3825a | SEOA3999a |
| 195 | SEOA2826 | SEOA2985a | SEOA3173 | SEOA3344a | SEOA3511a | SEOA3667a | SEOA3827a | SEOA4000a |
| 196 | SEOA4001a | SEOA4165a | SEOA4354a | SEOA4530 | SEOA4692a | SEOA4869a | SEOA5228a | SEOA5403 |
| 197 | SEOA4005a | SEOA4167a | SEOA4358a | SEOA4532 | SEOA4693a | SEOA4870a | SEOA5229a | SEOA5405 |
| 198 | SEOA4006a | SEOA4170a | SEOA4367a | SEOA4536 | SEOA4694a | SEOA4873a | SEOA5232a | SEOA5413 |
| 199 | SEOA4007a | SEOA4173a | SEOA4373a | SEOA4537 | SEOA4699a | SEOA4875a | SEOA5234a | SEOA5414 |
| 200 | SEOA4010a | SEOA4174a | SEOA4377a | SEOA4538 | SEOA4700a | SEOA4876a | SEOA5235a | SEOA5415 |
| 201 | SEOA4011a | SEOA4175a | SEOA4380a | SEOA4541 | SEOA4704 | SEOA4878a | SEOA5239a | SEOA5418 |

Figure 8 - List of Novel and Known Gene Clones from Mild OA and Severe OA Libraries on Microarray (page 4 of 10)

| | | | | | | | | |
|---|---|---|---|---|---|---|---|---|
| 202 | SEOA4012a | SEOA4177a | SEOA4382a | SEOA4543 | SEOA4705a | SEOA4879a | SEOA5245a | SEOA5422 |
| 203 | SEOA4014a | SEOA4181a | SEOA4383a | SEOA4544 | SEOA4709a | SEOA4880a | SEOA5246a | SEOA5432 |
| 204 | SEOA4017a | SEOA4184a | SEOA4384a | SEOA4545 | SEOA4711a | SEOA4883a | SEOA5249a | SEOA5433 |
| 205 | SEOA4019a | SEOA4185a | SEOA4386a | SEOA4546 | SEOA4712a | SEOA4886a | SEOA5253a | SEOA5436 |
| 206 | SEOA4020a | SEOA4187a | SEOA4387a | SEOA4549 | SEOA4713a | SEOA5010a | SEOA5258a | SEOA5442 |
| 207 | SEOA4021a | SEOA4190a | SEOA4388a | SEOA4550 | SEOA4715a | SEOA5035a | SEOA5265a | SEOA5444 |
| 208 | SEOA4022a | SEOA4193a | SEOA4392a | SEOA4558 | SEOA4716a | SEOA5036a | SEOA5267a | SEOA5445 |
| 209 | SEOA4025a | SEOA4194a | SEOA4395a | SEOA4560 | SEOA4717a | SEOA5038a | SEOA5270a | SEOA5447 |
| 210 | SEOA4029a | SEOA4197a | SEOA4396a | SEOA4564 | SEOA4726a | SEOA5043a | SEOA5272a | SEOA5448 |
| 211 | SEOA4034a | SEOA4198a | SEOA4397a | SEOA4570 | SEOA4727a | SEOA5047a | SEOA5273a | SEOA5449 |
| 212 | SEOA4035a | SEOA4200a | SEOA4398a | SEOA4571 | SEOA4731a | SEOA5048a | SEOA5275a | SEOA5450 |
| 213 | SEOA4037a | SEOA4204a | SEOA4402a | SEOA4577 | SEOA4732a | SEOA5055a | SEOA5277a | SEOA5452 |
| 214 | SEOA4040a | SEOA4206a | SEOA4403a | SEOA4579 | SEOA4739a | SEOA5057a | SEOA5278a | SEOA5453 |
| 215 | SEOA4043a | SEOA4207a | SEOA4404a | SEOA4580 | SEOA4740a | SEOA5058a | SEOA5279a | SEOA5454 |
| 216 | SEOA4044a | SEOA4210a | SEOA4405a | SEOA4587 | SEOA4747a | SEOA5060a | SEOA5281a | SEOA5455 |
| 217 | SEOA4048a | SEOA4211a | SEOA4406a | SEOA4588 | SEOA4748a | SEOA5068a | SEOA5282a | SEOA5461 |
| 218 | SEOA4053a | SEOA4213a | SEOA4409a | SEOA4595 | SEOA4752a | SEOA5074a | SEOA5285a | SEOA5463a |
| 219 | SEOA4055 | SEOA4214a | SEOA4410a | SEOA4598 | SEOA4753a | SEOA5077a | SEOA5286a | SEOA5464a |
| 220 | SEOA4056 | SEOA4215a | SEOA4411a | SEOA4600a | SEOA4754a | SEOA5078a | SEOA5291a | SEOA5465a |
| 221 | SEOA4057 | SEOA4221a | SEOA4412a | SEOA4601a | SEOA4756a | SEOA5082a | SEOA5294a | SEOA5468a |
| 222 | SEOA4058 | SEOA4223a | SEOA4418a | SEOA4603a | SEOA4767a | SEOA5085a | SEOA5299a | SEOA5469a |
| 223 | SEOA4061 | SEOA4229a | SEOA4421a | SEOA4606a | SEOA4768a | SEOA5088a | SEOA5300a | SEOA5473a |
| 224 | SEOA4062 | SEOA4232a | SEOA4422a | SEOA4608a | SEOA4771a | SEOA5089a | SEOA5302a | SEOA5475a |
| 225 | SEOA4063 | SEOA4234a | SEOA4423a | SEOA4611a | SEOA4772a | SEOA5090a | SEOA5311a | SEOA5478a |
| 226 | SEOA4068 | SEOA4239a | SEOA4424a | SEOA4613a | SEOA4773a | SEOA5094a | SEOA5314a | SEOA5479a |
| 227 | SEOA4070 | SEOA4242a | SEOA4425a | SEOA4614a | SEOA4778a | SEOA5098a | SEOA5315a | SEOA5483a |
| 228 | SEOA4076 | SEOA4246a | SEOA4427a | SEOA4616a | SEOA4780a | SEOA5103a | SEOA5318a | SEOA5489a |
| 229 | SEOA4079 | SEOA4250a | SEOA4430a | SEOA4617a | SEOA4783a | SEOA5105a | SEOA5319a | SEOA5491a |
| 230 | SEOA4082 | SEOA4255a | SEOA4431a | SEOA4620a | SEOA4785a | SEOA5110a | SEOA5320a | SEOA5493a |
| 231 | SEOA4257a | SEOA4084 | SEOA4436a | SEOA4626a | SEOA4786a | SEOA5114a | SEOA5323a | SEOA5498a |
| 232 | SEOA4258a | SEOA4085 | SEOA4440 | SEOA4628a | SEOA4791a | SEOA5115a | SEOA5325a | SEOA5502a |
| 233 | SEOA4261a | SEOA4092 | SEOA4445a | SEOA4630a | SEOA4795a | SEOA5116a | SEOA5328a | SEOA5503a |
| 234 | SEOA4263a | SEOA4098a | SEOA4447a | SEOA4632a | SEOA4796a | SEOA5121a | SEOA5330a | SEOA5504a |
| 235 | SEOA4264a | SEOA4100a | SEOA4452a | SEOA4635a | SEOA4798a | SEOA5127a | SEOA5335a | SEOA5508a |
| 236 | SEOA4265a | SEOA4102a | SEOA4453a | SEOA4637a | SEOA4802a | SEOA5128a | SEOA5342 | SEOA5509a |
| 237 | SEOA4271a | SEOA4106a | SEOA4457a | SEOA4639a | SEOA4806a | SEOA5136a | SEOA5343 | SEOA5520a |
| 238 | SEOA4274a | SEOA4111a | SEOA4461a | SEOA4640a | SEOA4808a | SEOA5138a | SEOA5348 | SEOA5522a |
| 239 | SEOA4280a | SEOA4112a | SEOA4463a | SEOA4641a | SEOA4809a | SEOA5146a | SEOA5351 | SEOA5525a |
| 240 | SEOA4282a | SEOA4116a | SEOA4464a | SEOA4644a | SEOA4810a | SEOA5148a | SEOA5352 | SEOA5527a |
| 241 | SEOA4284a | SEOA4122a | SEOA4475a | SEOA4645a | SEOA4811a | SEOA5151a | SEOA5356 | SEOA5528a |
| 242 | SEOA4289a | SEOA4123a | SEOA4477a | SEOA4646a | SEOA4815a | SEOA5153a | SEOA5358 | SEOA5530a |
| 243 | SEOA4291a | SEOA4125a | SEOA4478a | SEOA4647a | SEOA4816a | SEOA5156a | SEOA5359 | SEOA5533a |
| 244 | SEOA4292a | SEOA4127a | SEOA4479a | SEOA4653a | SEOA4818a | SEOA5157a | SEOA5363 | SEOA5537a |
| 245 | SEOA4294a | SEOA4128a | SEOA4482 | SEOA4656a | SEOA4822a | SEOA5162a | SEOA5365 | SEOA5540a |
| 246 | SEOA4296a | SEOA4129a | SEOA4485 | SEOA4657a | SEOA4829a | SEOA5163a | SEOA5366 | SEOA5543a |
| 247 | SEOA4300a | SEOA4132a | SEOA4487 | SEOA4658a | SEOA4830a | SEOA5164a | SEOA5368 | SEOA5544a |
| 248 | SEOA4303a | SEOA4133a | SEOA4489 | SEOA4662a | SEOA4834a | SEOA5166a | SEOA5370 | SEOA5546a |
| 249 | SEOA4309a | SEOA4135a | SEOA4490 | SEOA4667a | SEOA4837a | SEOA5170a | SEOA5371 | SEOA5549a |
| 250 | SEOA4310a | SEOA4139a | SEOA4491 | SEOA4670a | SEOA4839a | SEOA5176a | SEOA5372 | SEOA5552a |
| 251 | SEOA4311a | SEOA4140a | SEOA4498 | SEOA4671a | SEOA4840a | SEOA5196a | SEOA5376 | SEOA5554a |
| 252 | SEOA4317a | SEOA4141a | SEOA4502 | SEOA4674a | SEOA4846a | SEOA5202a | SEOA5382 | SEOA5556a |
| 253 | SEOA4322a | SEOA4146a | SEOA4505 | SEOA4678a | SEOA4847a | SEOA5203a | SEOA5386 | SEOA5557a |
| 254 | SEOA4324a | SEOA4147a | SEOA4511 | SEOA4682a | SEOA4849a | SEOA5209a | SEOA5387 | SEOA5559a |
| 255 | SEOA4327a | SEOA4149a | SEOA4515 | SEOA4683a | SEOA4857a | SEOA5211a | SEOA5388 | SEOA5563a |
| 256 | SEOA4332a | SEOA4154a | SEOA4517 | SEOA4684a | SEOA4858a | SEOA5212a | SEOA5391 | SEOA5567a |
| 257 | SEOA4333 | SEOA4157a | SEOA4518 | SEOA4685a | SEOA4860a | SEOA5214a | SEOA5393 | SEOA5572a |
| 258 | SEOA4336a | SEOA4158a | SEOA4519 | SEOA4686a | SEOA4862a | SEOA5220a | SEOA5394 | SEOA5575a |
| 259 | SEOA4337a | SEOA4160a | SEOA4524 | SEOA4687a | SEOA4867a | SEOA5223a | SEOA5395 | SEOA5577a |
| 260 | SEOA4338a | SEOA4163a | SEOA4526 | SEOA4691a | SEOA4868a | SEOA5227a | SEOA5396 | SEOA5580a |
| 261 | SEOA5583a | SEOA5743a | SEOA5871 | SEOA6071a | SEOA6229 | SEOA6391 | SEOA6556a | SEOA6705a |
| 262 | SEOA5584a | SEOA5744a | SEOA5873 | SEOA6075a | SEOA6230 | SEOA6392 | SEOA6563a | SEOA6711 |
| 263 | SEOA5586a | SEOA5746a | SEOA5876 | SEOA6078a | SEOA6231 | SEOA6393 | SEOA6564a | SEOA6718 |
| 264 | SEOA5588a | SEOA5748a | SEOA5877 | SEOA6080a | SEOA6234 | SEOA6395 | SEOA6565a | SEOA6721 |
| 265 | SEOA5590a | SEOA5749a | SEOA5878 | SEOA6082a | SEOA6235 | SEOA6397 | SEOA6567a | SEOA6723 |
| 266 | SEOA5592a | SEOA5750a | SEOA5881 | SEOA6084a | SEOA6241 | SEOA6398 | SEOA6571a | SEOA6724 |
| 267 | SEOA5595a | SEOA5753a | SEOA5887 | SEOA6087a | SEOA6246 | SEOA6399 | SEOA6572a | SEOA6726 |
| 268 | SEOA5596a | SEOA5755a | SEOA5890 | SEOA6088a | SEOA6248 | SEOA6400 | SEOA6573a | SEOA6728 |

Figure 8 - List of Novel and Known Gene Clones from Mild OA and Severe OA Libraries on Microarray (page 5 of 10)

| | | | | | | | | |
|---|---|---|---|---|---|---|---|---|
| 269 | SEOA5597a | SEOA5757a | SEOA5894 | SEOA6090a | SEOA6249 | SEOA6401 | SEOA6574a | SEOA6730 |
| 270 | SEOA5603a | SEOA5759 | SEOA5896 | SEOA6091a | SEOA6253 | SEOA6402 | SEOA6575a | SEOA6731 |
| 271 | SEOA5605a | SEOA5760 | SEOA5900 | SEOA6093a | SEOA6254 | SEOA6404 | SEOA6579a | SEOA6732 |
| 272 | SEOA5606a | SEOA5762 | SEOA5909 | SEOA6095a | SEOA6255 | SEOA6405 | SEOA6580a | SEOA6733 |
| 273 | SEOA5612a | SEOA5764 | SEOA5911 | SEOA6099a | SEOA6260 | SEOA6413 | SEOA6583a | SEOA6734 |
| 274 | SEOA5613a | SEOA5765 | SEOA5915 | SEOA6100a | SEOA6261 | SEOA6414 | SEOA6591a | SEOA6736 |
| 275 | SEOA5616a | SEOA5766 | SEOA5917 | SEOA6102a | SEOA6262 | SEOA6419 | SEOA6594a | SEOA6739 |
| 276 | SEOA5621a | SEOA5767 | SEOA5918 | SEOA6103a | SEOA6265 | SEOA6421 | SEOA6607a | SEOA6743 |
| 277 | SEOA5622a | SEOA5771 | SEOA5924 | SEOA6106a | SEOA6267 | SEOA6423 | SEOA6608a | SEOA6745 |
| 278 | SEOA5623a | SEOA5774 | SEOA5926 | SEOA6107a | SEOA6270 | SEOA6426 | SEOA6610a | SEOA6747 |
| 279 | SEOA5627a | SEOA5775 | SEOA5927 | SEOA6108a | SEOA6271 | SEOA6429 | SEOA6612a | SEOA6748 |
| 280 | SEOA5636a | SEOA5777 | SEOA5930 | SEOA6114a | SEOA6273 | SEOA6432 | SEOA6613a | SEOA6750 |
| 281 | SEOA5637a | SEOA5778 | SEOA5932 | SEOA6115a | SEOA6277 | SEOA6433 | SEOA6614a | SEOA6751 |
| 282 | SEOA5640a | SEOA5780 | SEOA5933 | SEOA6118a | SEOA6281 | SEOA6434 | SEOA6615a | SEOA6752 |
| 283 | SEOA5641a | SEOA5784 | SEOA5935 | SEOA6119a | SEOA6284 | SEOA6435 | SEOA6617a | SEOA6753 |
| 284 | SEOA5642a | SEOA5785 | SEOA5937 | SEOA6123a | SEOA6286 | SEOA6445a | SEOA6620a | SEOA6754 |
| 285 | SEOA5644a | SEOA5787 | SEOA5938 | SEOA6129a | SEOA6287 | SEOA6449a | SEOA6621a | SEOA7061a |
| 286 | SEOA5646a | SEOA5790 | SEOA5942 | SEOA6130a | SEOA6289 | SEOA6450a | SEOA6622a | SEOA7064a |
| 287 | SEOA5649a | SEOA5792 | SEOA5945 | SEOA6132a | SEOA6293 | SEOA6452a | SEOA7109a | SEOA7066a |
| 288 | SEOA5651a | SEOA5793 | SEOA5946 | SEOA6134a | SEOA6295 | SEOA6453a | SEOA6624a | SEOA7069a |
| 289 | SEOA5655a | SEOA5794 | SEOA5950 | SEOA6136a | SEOA6296 | SEOA6454a | SEOA6626a | SEOA7072a |
| 290 | SEOA5656a | SEOA5795 | SEOA5955 | SEOA6137a | SEOA6299 | SEOA6456a | SEOA6630a | SEOA7074a |
| 291 | SEOA5658a | SEOA5798 | SEOA5958 | SEOA6140a | SEOA6304 | SEOA6466a | SEOA6632a | SEOA7075a |
| 292 | SEOA5662a | SEOA5799 | SEOA5969a | SEOA6143a | SEOA6308 | SEOA6470a | SEOA6633a | SEOA7077a |
| 293 | SEOA5664a | SEOA5800 | SEOA5971a | SEOA6144a | SEOA6311 | SEOA6476a | SEOA6637a | SEOA7078a |
| 294 | SEOA5665a | SEOA5801 | SEOA5976a | SEOA6146a | SEOA6313 | SEOA6479a | SEOA6638a | SEOA7085a |
| 295 | SEOA5670a | SEOA5805 | SEOA5977a | SEOA6150a | SEOA6314 | SEOA6481a | SEOA6642a | SEOA7086a |
| 296 | SEOA5671a | SEOA5807 | SEOA5978a | SEOA6151a | SEOA6315 | SEOA6484a | SEOA6643a | SEOA7091a |
| 297 | SEOA5675a | SEOA5809 | SEOA5979a | SEOA6152a | SEOA6316 | SEOA6487a | SEOA6645a | SEOA7094a |
| 298 | SEOA5677a | SEOA5811 | SEOA5982a | SEOA6155a | SEOA6317 | SEOA6490a | SEOA6647a | SEOA7095a |
| 299 | SEOA5678a | SEOA5813 | SEOA5988a | SEOA6156a | SEOA6323 | SEOA6491a | SEOA6650a | SEOA7098a |
| 300 | SEOA5679a | SEOA5815 | SEOA5991a | SEOA6160a | SEOA6332 | SEOA6493a | SEOA6651a | SEOA7099a |
| 301 | SEOA5680a | SEOA5816 | SEOA5992a | SEOA6161a | SEOA6334 | SEOA6494a | SEOA6652a | SEOA7110a |
| 302 | SEOA5681a | SEOA5817 | SEOA5994a | SEOA6163a | SEOA6337 | SEOA6503a | SEOA6654a | SEOA7114a |
| 303 | SEOA5682a | SEOA5818 | SEOA6001a | SEOA6164a | SEOA6342 | SEOA6505a | SEOA6657a | SEOA7123a |
| 304 | SEOA5683a | SEOA5820 | SEOA6008a | SEOA6166a | SEOA6344 | SEOA6508a | SEOA6658a | SEOA7126a |
| 305 | SEOA5685a | SEOA5823 | SEOA6009a | SEOA6168a | SEOA6345 | SEOA6510a | SEOA6661a | SEOA7129a |
| 306 | SEOA5687a | SEOA5826 | SEOA6015a | SEOA6172a | SEOA6346 | SEOA6512a | SEOA6664a | SEOA7133a |
| 307 | SEOA5689a | SEOA5829 | SEOA6019a | SEOA6174a | SEOA6347 | SEOA6514a | SEOA6671a | SEOA7135a |
| 308 | SEOA5691a | SEOA5830 | SEOA6027a | SEOA6175a | SEOA6355 | SEOA6516a | SEOA6672a | SEOA7146a |
| 309 | SEOA5694a | SEOA5832 | SEOA6029a | SEOA6177a | SEOA6357 | SEOA6517a | SEOA6674a | SEOA7147a |
| 310 | SEOA5697a | SEOA5833 | SEOA6032a | SEOA6178a | SEOA6358 | SEOA6519a | SEOA6675a | SEOA7151a |
| 311 | SEOA5698a | SEOA5836 | SEOA6033a | SEOA6181a | SEOA6359 | SEOA6521a | SEOA6676a | SEOA7153a |
| 312 | SEOA5699a | SEOA5838 | SEOA6034a | SEOA6183a | SEOA6360 | SEOA6523a | SEOA6677a | SEOA7155a |
| 313 | SEOA5703a | SEOA5839 | SEOA6035a | SEOA6184a | SEOA6363 | SEOA6524a | SEOA6682a | SEOA7157a |
| 314 | SEOA5710a | SEOA5841 | SEOA6036a | SEOA6189a | SEOA6364 | SEOA6526a | SEOA6685a | SEOA7159a |
| 315 | SEOA5714a | SEOA5844 | SEOA6038a | SEOA6191a | SEOA6365 | SEOA6528a | SEOA6686a | SEOA7160a |
| 316 | SEOA5717a | SEOA5845 | SEOA6039a | SEOA6192a | SEOA6367 | SEOA6532a | SEOA6687a | SEOA7166a |
| 317 | SEOA5720a | SEOA5848 | SEOA6050a | SEOA6193a | SEOA6371 | SEOA6536a | SEOA6693a | SEOA7167a |
| 318 | SEOA5721a | SEOA5849 | SEOA6051a | SEOA6198a | SEOA6373 | SEOA6539a | SEOA6694a | SEOA7174a |
| 319 | SEOA5723a | SEOA5857 | SEOA6058a | SEOA6201a | SEOA6374 | SEOA6540a | SEOA6695a | SEOA7175a |
| 320 | SEOA5731a | SEOA5858 | SEOA6060a | SEOA6203a | SEOA6377 | SEOA6541a | SEOA6696a | SEOA7177a |
| 321 | SEOA5733a | SEOA5859 | SEOA6064a | SEOA6210a | SEOA6379 | SEOA6543a | SEOA6697a | SEOA7178a |
| 322 | SEOA5734a | SEOA5863 | SEOA6066a | SEOA6220 | SEOA6386 | SEOA6550a | SEOA6698a | SEOA7181a |
| 323 | SEOA5736a | SEOA5866 | SEOA6068a | SEOA6221 | SEOA6387 | SEOA6552a | SEOA6701a | SEOA7184a |
| 324 | SEOA5741a | SEOA5868 | SEOA6069a | SEOA6223 | SEOA6389 | SEOA6553a | SEOA6702a | SEOA7186a |
| 325 | SEOA5742a | SEOA5870 | SEOA6070a | SEOA6226 | SEOA6390 | SEOA6554a | SEOA6704a | SEOA7187a |
| 326 | SEOA7188a | SEOA7352a | SEOA7526a | SEOA7675a | SEOA8370a | MIOA0105 | MIOA0240a | MIOA0384a |
| 327 | SEOA7190a | SEOA7361a | SEOA7535a | SEOA7676a | SEOA8371a | MIOA0109 | MIOA0243a | MIOA0394a |
| 328 | SEOA7192a | SEOA7365a | SEOA7536a | SEOA7892a | SEOA8372a | MIOA0110 | MIOA0245a | MIOA0395a |
| 329 | SEOA7196a | SEOA7366a | SEOA7541a | SEOA7899a | SEOA8374a | MIOA0111 | MIOA0247a | MIOA0397a |
| 330 | SEOA7197a | SEOA7369a | SEOA7542a | SEOA7902a | SEOA8377a | MIOA0113 | MIOA0248a | MIOA0400a |
| 331 | SEOA7199a | SEOA7373a | SEOA7543a | SEOA7910a | SEOA8383a | MIOA0114 | MIOA0251a | MIOA0401a |
| 332 | SEOA7201a | SEOA7378a | SEOA7544a | SEOA7914a | SEOA8384a | MIOA0115 | MIOA0252a | MIOA0407a |
| 333 | SEOA7204a | SEOA7380a | SEOA7546a | SEOA7915a | SEOA8387a | MIOA0117 | MIOA0253a | MIOA0408a |
| 334 | SEOA7206a | SEOA7383a | SEOA7547a | SEOA7917a | SEOA8388a | MIOA0118 | MIOA0255a | MIOA0411a |
| 335 | SEOA7211a | SEOA7385a | SEOA7549a | SEOA7918a | SEOA8389a | MIOA0122 | MIOA0256a | MIOA0412a |

Figure 8 - List of Novel and Known Gene Clones from Mild OA and Severe OA Libraries on Microarray (page 6 of 10)

| | | | | | | | | |
|---|---|---|---|---|---|---|---|---|
| 336 | SEOA7212a | SEOA7386a | SEOA7551a | SEOA7919a | SEOA8391a | MIOA0126 | MIOA0257 | MIOA0419a |
| 337 | SEOA7213a | SEOA7387a | SEOA7552a | SEOA7920a | SEOA8392a | MIOA0128 | MIOA0258n | MIOA0449 |
| 338 | SEOA7214a | SEOA7390a | SEOA7553a | SEOA7924a | SEOA8393a | MIOA0132 | MIOA0261 | MIOA0450 |
| 339 | SEOA7216a | SEOA7393a | SEOA7555a | SEOA7926a | SEOA8395a | MIOA0135 | MIOA0263 | MIOA0451 |
| 340 | SEOA7218a | SEOA7394a | SEOA7563a | SEOA7928a | SEOA8396a | MIOA0143 | MIOA0264 | MIOA0452 |
| 341 | SEOA7220a | SEOA7399a | SEOA7564a | SEOA7929a | SEOA8397a | MIOA0145 | MIOA0265n | MIOA0453 |
| 342 | SEOA7223a | SEOA7403a | SEOA7565a | SEOA7930a | SEOA8399a | MIOA0147 | MIOA0266n | MIOA0454 |
| 343 | SEOA7225a | SEOA7404a | SEOA7571a | SEOA7931a | SEOA8401a | MIOA0152 | MIOA0269 | MIOA0455 |
| 344 | SEOA7226a | SEOA7408a | SEOA7573a | SEOA7933a | SEOA8406a | MIOA0153 | MIOA0270 | MIOA0456 |
| 345 | SEOA7228a | SEOA7411a | SEOA7574a | SEOA7935a | SEOA8407a | MIOA0154 | MIOA0273 | MIOA0459 |
| 346 | SEOA7229a | SEOA7415a | SEOA7577a | SEOA7940a | MIOA0010a | MIOA0156 | MIOA0274 | MIOA0461 |
| 347 | SEOA7231a | SEOA7416a | SEOA7580a | SEOA7943a | MIOA0013a | MIOA0157 | MIOA0275n | MIOA0462n |
| 348 | SEOA7239a | SEOA7417a | SEOA7582a | SEOA7945a | MIOA0022a | MIOA0158 | MIOA0281n | MIOA0466 |
| 349 | SEOA7240a | SEOA7419a | SEOA7583a | SEOA7948a | MIOA0024a | MIOA0161 | MIOA0286 | MIOA0467 |
| 350 | SEOA7244a | SEOA7421a | SEOA7584a | SEOA7951a | MIOA0026a | MIOA0162 | MIOA0288 | MIOA0473 |
| 351 | SEOA7245a | SEOA7422a | SEOA7587a | SEOA7952a | MIOA0029a | MIOA0164 | MIOA0289 | MIOA0474 |
| 352 | SEOA7249a | SEOA7433a | SEOA7589a | SEOA7953a | MIOA0032a | MIOA0165 | MIOA0291 | MIOA0477 |
| 353 | SEOA7250a | SEOA7436a | SEOA7595a | SEOA8165a | MIOA0033a | MIOA0166 | MIOA0294 | MIOA0478 |
| 354 | SEOA7251a | SEOA7442a | SEOA7602a | SEOA8167a | MIOA0037a | MIOA0168n | MIOA0296 | MIOA0482n |
| 355 | SEOA7256a | SEOA7443a | SEOA7603a | SEOA8171a | MIOA0039a | MIOA0169 | MIOA0299n | MIOA0483 |
| 356 | SEOA7257a | SEOA7444a | SEOA7605a | SEOA8173a | MIOA0044a | MIOA0171 | MIOA0300 | MIOA0484 |
| 357 | SEOA7261a | SEOA7448a | SEOA7607a | SEOA8174a | MIOA0045a | MIOA0172 | MIOA0303 | MIOA0485 |
| 358 | SEOA7263a | SEOA7449a | SEOA7608a | SEOA8177a | MIOA0046a | MIOA0174 | MIOA0304 | MIOA0487 |
| 359 | SEOA7268a | SEOA7451a | SEOA7610a | SEOA8179a | MIOA0049a | MIOA0175n | MIOA0306n | MIOA0488n |
| 360 | SEOA7271a | SEOA7453a | SEOA7612a | SEOA8186a | MIOA0051a | MIOA0177n | MIOA0307 | MIOA0493 |
| 361 | SEOA7272a | SEOA7455a | SEOA7615a | SEOA8187a | MIOA0053a | MIOA0181 | MIOA0308 | MIOA0494 |
| 362 | SEOA7274a | SEOA7458a | SEOA7620a | SEOA8188a | MIOA0054a | MIOA0183 | MIOA0309 | MIOA0497n |
| 363 | SEOA7277a | SEOA7459a | SEOA7622a | SEOA8191a | MIOA0057a | MIOA0189 | MIOA0311n | MIOA0498n |
| 364 | SEOA7278a | SEOA7460a | SEOA7623a | SEOA8195a | MIOA0058a | MIOA0190 | MIOA0314 | MIOA0501 |
| 365 | SEOA7281a | SEOA7466a | SEOA7624a | SEOA8199a | MIOA0059a | MIOA0192 | MIOA0315 | MIOA0502 |
| 366 | SEOA7286a | SEOA7467a | SEOA7629a | SEOA8200a | MIOA0061a | MIOA0195a | MIOA0316 | MIOA0504n |
| 367 | SEOA7289a | SEOA7471a | SEOA7633a | SEOA8202a | MIOA0062a | MIOA0197a | MIOA0320 | MIOA0508n |
| 368 | SEOA7294a | SEOA7472a | SEOA7635a | SEOA8306a | MIOA0065a | MIOA0201a | MIOA0321 | MIOA0510 |
| 369 | SEOA7295a | SEOA7474a | SEOA7639a | SEOA8310a | MIOA0066a | MIOA0203a | MIOA0322 | MIOA0513n |
| 370 | SEOA7296a | SEOA7476a | SEOA7640a | SEOA8313a | MIOA0068a | MIOA0204a | MIOA0323 | MIOA0514 |
| 371 | SEOA7298a | SEOA7477a | SEOA7642a | SEOA8317a | MIOA0070a | MIOA0207a | MIOA0325 | MIOA0516 |
| 372 | SEOA7299a | SEOA7478a | SEOA7643a | SEOA8321a | MIOA0071a | MIOA0209a | MIOA0328 | MIOA0520n |
| 373 | SEOA7300a | SEOA7481a | SEOA7645a | SEOA8323a | MIOA0072a | MIOA0210a | MIOA0329n | MIOA0521 |
| 374 | SEOA7301a | SEOA7483a | SEOA7647a | SEOA8324a | MIOA0074a | MIOA0212a | MIOA0332 | MIOA0524 |
| 375 | SEOA7313a | SEOA7484a | SEOA7648a | SEOA8327a | MIOA0075a | MIOA0213a | MIOA0334 | MIOA0525 |
| 376 | SEOA7314a | SEOA7485a | SEOA7649a | SEOA8331a | MIOA0076a | MIOA0215a | MIOA0335 | MIOA0528 |
| 377 | SEOA7315a | SEOA7487a | SEOA7651a | SEOA8334a | MIOA0078a | MIOA0218a | MIOA0341 | MIOA0529 |
| 378 | SEOA7316a | SEOA7489a | SEOA7652a | SEOA8335a | MIOA0081a | MIOA0219a | MIOA0342 | MIOA0530 |
| 379 | SEOA7317a | SEOA7496a | SEOA7653a | SEOA8343a | MIOA0082a | MIOA0220a | MIOA0343n | MIOA0531 |
| 380 | SEOA7318a | SEOA7500a | MIOA0003a | SEOA8347a | MIOA0083a | MIOA0221a | MIOA0354a | MIOA0533 |
| 381 | SEOA7320a | SEOA7503a | MIOA0004A | SEOA8351a | MIOA0084a | MIOA0222a | MIOA0355a | MIOA0535n |
| 382 | SEOA7322a | SEOA7504a | MIOA0005a | SEOA8354a | MIOA0085a | MIOA0223a | MIOA0361a | MIOA0538 |
| 383 | SEOA7324a | SEOA7509a | MIOA0008a | SEOA8355a | MIOA0089a | MIOA0224a | MIOA0363a | MIOA0541n |
| 384 | SEOA7328a | SEOA7511a | SEOA7655a | SEOA8357a | MIOA0090a | MIOA0225a | MIOA0364a | MIOA0542 |
| 385 | SEOA7334a | SEOA7517a | SEOA7659a | SEOA8358a | MIOA0092a | MIOA0228a | MIOA0365a | MIOA0544 |
| 386 | SEOA7335a | SEOA7519a | SEOA7662a | SEOA8359a | MIOA0093a | MIOA0230a | MIOA0375a | MIOA0545a |
| 387 | SEOA7337a | SEOA7521a | SEOA7666a | SEOA8360a | MIOA0095a | MIOA0235a | MIOA0378a | MIOA0546a |
| 388 | SEOA7341a | SEOA7522a | SEOA7668a | SEOA8361a | MIOA0098 | MIOA0236a | MIOA0380a | MIOA0548a |
| 389 | SEOA7342a | SEOA7523a | SEOA7669a | SEOA8364a | MIOA0102 | MIOA0237a | MIOA0381a | MIOA0550a |
| 390 | SEOA7344a | SEOA7524a | SEOA7672a | SEOA8366a | MIOA0104 | MIOA0238a | MIOA0382a | MIOA0551a |
| 391 | MIOA0553a | MIOA0730 | MIOA0876a | MIOA0987 | MIOA1143 | MIOA1304 | MIOA1444 | MIOA1559 |
| 392 | MIOA0554a | MIOA0731 | MIOA0879a | MIOA0989n | MIOA1144 | MIOA1310 | MIOA1445 | MIOA1560 |
| 393 | MIOA0572n | MIOA0734 | MIOA0880a | MIOA0991n | MIOA1145 | MIOA1312 | MIOA1446 | MIOA1561 |
| 394 | MIOA0577a | MIOA0736 | MIOA0882a | MIOA0992n | MIOA1147 | MIOA1314a | MIOA1447 | MIOA1562 |
| 395 | MIOA0578a | MIOA0743 | MIOA0884a | MIOA0993n | MIOA1149 | MIOA1318a | MIOA1448 | MIOA1564m |
| 396 | MIOA0579a | MIOA0744 | MIOA0885a | MIOA0994 | MIOA1150 | MIOA1319a | MIOA1450 | MIOA1565n |
| 397 | MIOA0580a | MIOA0745 | MIOA0886a | MIOA0995 | MIOA1151 | MIOA1320a | MIOA1452 | MIOA1566 |
| 398 | MIOA0581a | MIOA0747 | MIOA0887a | MIOA0996n | MIOA1154 | MIOA1321a | MIOA1454 | MIOA1568 |
| 399 | MIOA0582a | MIOA0750 | MIOA0890a | MIOA0999 | MIOA1156 | MIOA1322a | MIOA1455 | MIOA1569 |
| 400 | MIOA0586a | MIOA0751 | MIOA0891a | MIOA1003 | MIOA1158 | MIOA1325a | MIOA1459 | MIOA1570 |
| 401 | MIOA0588a | MIOA0752 | MIOA0892a | MIOA1004 | MIOA1159 | MIOA1326a | MIOA1461n | MIOA1571 |
| 402 | MIOA0589a | MIOA0753n | MIOA0893a | MIOA1006 | MIOA1161 | MIOA1327a | MIOA1462 | MIOA1572 |

Figure 8 - List of Novel and Known Gene Clones from Mild OA and Severe OA Libraries on Microarray (page 7 of 10)

| | | | | | | | | |
|---|---|---|---|---|---|---|---|---|
| 403 | MIOA0591a | MIOA0758 | MIOA0894a | MIOA1008 | MIOA1163 | MIOA1329a | MIOA1463 | MIOA1573 |
| 404 | MIOA0592a | MIOA0759 | MIOA0896a | MIOA1009 | MIOA1165 | MIOA1337a | MIOA1464 | MIOA1574 |
| 405 | MIOA0594a | MIOA0760 | MIOA0897a | MIOA1010 | MIOA1166 | MIOA1339a | MIOA1465 | MIOA1580 |
| 406 | MIOA0595a | MIOA0761 | MIOA0898a | MIOA1015 | MIOA1169 | MIOA1342a | MIOA1467 | MIOA1582 |
| 407 | MIOA0597a | MIOA0763n | MIOA0899a | MIOA1019 | MIOA1170 | MIOA1343a | MIOA1468 | MIOA1584 |
| 408 | MIOA0600a | MIOA0764 | MIOA0900a | MIOA1024 | MIOA1171 | MIOA1344a | MIOA1469 | MIOA1585 |
| 409 | MIOA0601a | MIOA0765n | MIOA0902a | MIOA1025 | MIOA1172 | MIOA1349a | MIOA1471 | MIOA1590 |
| 410 | MIOA0602a | MIOA0766 | MIOA0905a | MIOA1027 | MIOA1173 | MIOA1352a | MIOA1473 | MIOA1592 |
| 411 | MIOA0605a | MIOA0767 | MIOA0906a | MIOA1030 | MIOA1176 | MIOA1353a | MIOA1476 | MIOA1593 |
| 412 | MIOA0610a | MIOA0768n | MIOA0908a | MIOA1044 | MIOA1177 | MIOA1354a | MIOA1477 | MIOA1594 |
| 413 | MIOA0611a | MIOA0769n | MIOA0909a | MIOA1045 | MIOA1180 | MIOA1356a | MIOA1479m | MIOA1595 |
| 414 | MIOA0614a | MIOA0772 | MIOA0910a | MIOA1048 | MIOA1182 | MIOA1361a | MIOA1483m | MIOA1597 |
| 415 | MIOA0616a | MIOA0774n | MIOA0911a | MIOA1049 | MIOA1185 | MIOA1362a | MIOA1484 | MIOA1602a |
| 416 | MIOA0618a | MIOA0775n | MIOA0912a | MIOA1052 | MIOA1186 | MIOA1364a | MIOA1485 | MIOA1603a |
| 417 | MIOA0621a | MIOA0776n | MIOA0915a | MIOA1054 | MIOA1189 | MIOA1369a | MIOA1488 | MIOA1604a |
| 418 | MIOA0624a | MIOA0777n | MIOA0916a | MIOA1057 | MIOA1192 | MIOA1370a | MIOA1491m | MIOA1605A |
| 419 | MIOA0625a | MIOA0778 | MIOA0918a | MIOA1058 | MIOA1193 | MIOA1373a | MIOA1494 | MIOA1606a |
| 420 | MIOA0626a | MIOA0780n | MIOA0920a | MIOA1059 | MIOA1197n | MIOA1375a | MIOA1495m | MIOA1607a |
| 421 | MIOA0629a | MIOA0781 | MIOA0924a | MIOA1060 | MIOA1198 | MIOA1377a | MIOA1496 | MIOA1608a |
| 422 | MIOA0630a | MIOA0782n | MIOA0925a | MIOA1062 | MIOA1199 | MIOA1379a | MIOA1498n | MIOA1610a |
| 423 | MIOA0632a | MIOA0783 | MIOA0932 | MIOA1068 | MIOA1200 | MIOA1380a | MIOA1503 | MIOA1612a |
| 424 | MIOA0633a | MIOA0783n | MIOA0933 | MIOA1070 | MIOA1212 | MIOA1383a | MIOA1505 | MIOA1621a |
| 425 | MIOA0637a | MIOA0790 | MIOA0934 | MIOA1071 | MIOA1213 | MIOA1385a | MIOA1506 | MIOA1626a |
| 426 | MIOA0639a | MIOA0791 | MIOA0935 | MIOA1072 | MIOA1223m | MIOA1388a | MIOA1508 | MIOA1628a |
| 427 | MIOA0644 | MIOA0795n | MIOA0936 | MIOA1073 | MIOA1228 | MIOA1391a | MIOA1509 | MIOA1630a |
| 428 | MIOA0645 | MIOA0797 | MIOA0937 | MIOA1075 | MIOA1230 | MIOA1392a | MIOA1512n | MIOA1632a |
| 429 | MIOA0647 | MIOA0798 | MIOA0938 | MIOA1076 | MIOA1231 | MIOA1394a | MIOA1513 | MIOA1636a |
| 430 | MIOA0677 | MIOA0803 | MIOA0941 | MIOA1078 | MIOA1236 | MIOA1397a | MIOA1517 | MIOA1640a |
| 431 | MIOA0680 | MIOA0804 | MIOA0942 | MIOA1079 | MIOA1239 | MIOA1398a | MIOA1518 | MIOA1641a |
| 432 | MIOA0682n | MIOA0806 | MIOA0943 | MIOA1081 | MIOA1241n | MIOA1399a | MIOA1519 | MIOA1645a |
| 433 | MIOA0683 | MIOA0809 | MIOA0948 | MIOA1082 | MIOA1242 | MIOA1400a | MIOA1520 | MIOA1646a |
| 434 | MIOA0684 | MIOA0811 | MIOA0949 | MIOA1084 | MIOA1243 | MIOA1401a | MIOA1522 | MIOA1647a |
| 435 | MIOA0685 | MIOA0813 | MIOA0950 | MIOA1085 | MIOA1248 | MIOA1403a | MIOA1524 | MIOA1648a |
| 436 | MIOA0689 | MIOA0814 | MIOA0952 | MIOA1086 | MIOA1252 | MIOA1405a | MIOA1527 | MIOA1649a |
| 437 | MIOA0690 | MIOA0817 | MIOA0953 | MIOA1087 | MIOA1255m | MIOA1409 | MIOA1528 | MIOA1650a |
| 438 | MIOA0692 | MIOA0819 | MIOA0954 | MIOA1088 | MIOA1256 | MIOA1410m | MIOA1529 | MIOA1652a |
| 439 | MIOA0694 | MIOA0820 | MIOA0955 | MIOA1091 | MIOA1259 | MIOA1411n | MIOA1531 | MIOA1654a |
| 440 | MIOA0697 | MIOA0823 | MIOA0958 | MIOA1092 | MIOA1263 | MIOA1412 | MIOA1532 | MIOA1655a |
| 441 | MIOA0699 | MIOA0824 | MIOA0959 | MIOA1094 | MIOA1264 | MIOA1413 | MIOA1533 | MIOA1656a |
| 442 | MIOA0701 | MIOA0826 | MIOA0960 | MIOA1097 | MIOA1266 | MIOA1414 | MIOA1534 | MIOA1657a |
| 443 | MIOA0702 | MIOA0831 | MIOA0961 | MIOA1099 | MIOA1267 | MIOA1416 | MIOA1537 | MIOA1658a |
| 444 | MIOA0706 | MIOA0832 | MIOA0963 | MIOA1100 | MIOA1276m | MIOA1420n | MIOA1538 | MIOA1661a |
| 445 | MIOA0707 | MIOA0840a | MIOA0964 | MIOA1120 | MIOA1278m | MIOA1424 | MIOA1539 | MIOA1662a |
| 446 | MIOA0708 | MIOA0842a | MIOA0965 | MIOA1123 | MIOA1279m | MIOA1426 | MIOA1541m | MIOA1665a |
| 447 | MIOA0712 | MIOA0843a | MIOA0968 | MIOA1128 | MIOA1285 | MIOA1427 | MIOA1542m | MIOA1667a |
| 448 | MIOA0717 | MIOA0849a | MIOA0969n | MIOA1130 | MIOA1286 | MIOA1431 | MIOA1546 | MIOA1671a |
| 449 | MIOA0718 | MIOA0855a | MIOA0971 | MIOA1133 | MIOA1287 | MIOA1434 | MIOA1547 | MIOA1673a |
| 450 | MIOA0719 | MIOA0857a | MIOA0972 | MIOA1134 | MIOA1290 | MIOA1435 | MIOA1548 | MIOA1674a |
| 451 | MIOA0720n | MIOA0860a | MIOA0977 | MIOA1136 | MIOA1291n | MIOA1438 | MIOA1550 | MIOA1676a |
| 452 | MIOA0721 | MIOA0861a | MIOA0978n | MIOA1137 | MIOA1293n | MIOA1439 | MIOA1551 | MIOA1677a |
| 453 | MIOA0723 | MIOA0868a | MIOA0983 | MIOA1138 | MIOA1294n | MIOA1440 | MIOA1554n | MIOA1679a |
| 454 | MIOA0724 | MIOA0869a | MIOA0984 | MIOA1139 | MIOA1300n | MIOA1442 | MIOA1555 | MIOA1685a |
| 455 | MIOA0726n | MIOA0874a | MIOA0986 | MIOA1140 | MIOA1303 | MIOA1443 | MIOA1556 | MIOA1686a |
| 456 | MIOA1687a | MIOA1844a | MIOA1980a | MIOA2124 | MIOA2285a | MIOA2430a | MIOA2573a | MIOA2759a |
| 457 | MIOA1689a | MIOA1845a | MIOA1981a | MIOA2125 | MIOA2287a | MIOA2434a | MIOA2574a | MIOA2760a |
| 458 | MIOA1690a | MIOA1847a | MIOA1982a | MIOA2128 | MIOA2288a | MIOA2436a | MIOA2575a | MIOA2762a |
| 459 | MIOA1693a | MIOA1848a | MIOA1984a | MIOA2137 | MIOA2291a | MIOA2437a | MIOA2576a | MIOA2764a |
| 460 | MIOA1695a | MIOA1849a | MIOA1985 | MIOA2140 | MIOA2292a | MIOA2446a | MIOA2577a | MIOA2766a |
| 461 | MIOA1697 | MIOA1851a | MIOA1986 | MIOA2142 | MIOA2295a | MIOA2447a | MIOA2580a | MIOA2768a |
| 462 | MIOA1699 | MIOA1852a | MIOA1991 | MIOA2146 | MIOA2300a | MIOA2448a | MIOA2584a | MIOA2769a |
| 463 | MIOA1701a | MIOA1854a | MIOA1992 | MIOA2147 | MIOA2301a | MIOA2449a | MIOA2587a | MIOA2772a |
| 464 | MIOA1706a | MIOA1856m | MIOA1994 | MIOA2148 | MIOA2303a | MIOA2451a | MIOA2589a | MIOA2775a |
| 465 | MIOA1708a | MIOA1857m | MIOA1996 | MIOA2149 | MIOA2306a | MIOA2452a | MIOA2596a | MIOA2783a |
| 466 | MIOA1711a | MIOA1864a | MIOA1997 | MIOA2150 | MIOA2316a | MIOA2454a | MIOA2598a | MIOA2786a |
| 467 | MIOA1714a | MIOA1868a | MIOA2004 | MIOA2152 | MIOA2320a | MIOA2457a | MIOA2601a | MIOA2788a |
| 468 | MIOA1715a | MIOA1870a | MIOA2006 | MIOA2158a | MIOA2327a | MIOA2459a | MIOA2604a | MIOA2790a |
| 469 | MIOA1716a | MIOA1871a | MIOA2008 | MIOA2160a | MIOA2328a | MIOA2463a | MIOA2606a | MIOA2791a |

Figure 8 - List of Novel and Known Gene Clones from Mild OA and Severe OA Libraries on Microarray (page 8 of 10)

| | | | | | | | | |
|---|---|---|---|---|---|---|---|---|
| 470 | MIOA1717a | MIOA1874a | MIOA2009 | MIOA2167a | MIOA2330a | MIOA2465a | MIOA2607a | MIOA2794a |
| 471 | MIOA1719a | MIOA1881a | MIOA2010 | MIOA2172a | MIOA2331a | MIOA2466a | MIOA2608a | MIOA2795a |
| 472 | MIOA1723a | MIOA1882a | MIOA2013 | MIOA2173a | MIOA2333a | MIOA2470a | MIOA2609a | MIOA2796a |
| 473 | MIOA1726a | MIOA1885a | MIOA2015 | MIOA2174a | MIOA2334a | MIOA2471a | MIOA2615a | MIOA2798a |
| 474 | MIOA1729a | MIOA1887a | MIOA2021 | MIOA2177a | MIOA2335a | MIOA2472a | MIOA2616a | MIOA2800a |
| 475 | MIOA1731 | MIOA1889a | MIOA2022 | MIOA2183a | MIOA2337a | MIOA2475a | MIOA2618 | MIOA2801a |
| 476 | MIOA1737 | MIOA1890a | MIOA2028 | MIOA2185a | MIOA2339a | MIOA2476a | MIOA2621 | MIOA2805a |
| 477 | MIOA1743n | MIOA1891a | MIOA2031 | MIOA2190a | MIOA2340a | MIOA2479a | MIOA2622 | MIOA2806a |
| 478 | MIOA1745n | MIOA1894a | MIOA2032 | MIOA2192a | MIOA2342a | MIOA2481a | MIOA2623 | MIOA2807a |
| 479 | MIOA1750n | MIOA1896a | MIOA2033 | MIOA2193a | MIOA2343a | MIOA2482a | MIOA2624 | MIOA2808a |
| 480 | MIOA1752 | MIOA1897a | MIOA2035 | MIOA2199a | MIOA2344a | MIOA2483a | MIOA2625 | MIOA2811a |
| 481 | MIOA1756 | MIOA1899a | MIOA2039 | MIOA2203a | MIOA2346a | MIOA2485a | MIOA2626 | MIOA2812a |
| 482 | MIOA1757 | MIOA1900a | MIOA2042 | MIOA2204a | MIOA2348a | MIOA2487a | MIOA2627 | MIOA2813a |
| 483 | MIOA1761 | MIOA1901a | MIOA2043 | MIOA2205a | MIOA2350a | MIOA2488a | MIOA2629 | MIOA2814a |
| 484 | MIOA1763 | MIOA1903a | MIOA2044 | MIOA2207a | MIOA2351a | MIOA2490a | MIOA2632 | MIOA2815a |
| 485 | MIOA1764 | MIOA1906a | MIOA2046 | MIOA2209a | MIOA2352a | MIOA2492a | MIOA2635 | MIOA2816a |
| 486 | MIOA1765 | MIOA1907a | MIOA2050 | MIOA2210a | MIOA2353a | MIOA2493a | MIOA2639 | MIOA2818a |
| 487 | MIOA1766 | MIOA1910a | MIOA2051 | MIOA2222a | MIOA2360a | MIOA2496a | MIOA2642 | MIOA2825a |
| 488 | MIOA1767 | MIOA1913a | MIOA2054 | MIOA2223a | MIOA2361a | MIOA2499a | MIOA2646 | MIOA2828a |
| 489 | MIOA1769 | MIOA1914a | MIOA2058 | MIOA2224a | MIOA2363a | MIOA2503a | MIOA2647 | MIOA2830a |
| 490 | MIOA1773 | MIOA1915a | MIOA2059n | MIOA2225a | MIOA2364a | MIOA2504a | MIOA2657a | MIOA2832a |
| 491 | MIOA1774 | MIOA1916a | MIOA2060 | MIOA2226a | MIOA2366a | MIOA2505a | MIOA2674a | MIOA2833a |
| 492 | MIOA1775 | MIOA1920a | MIOA2062 | MIOA2229a | MIOA2368a | MIOA2506a | MIOA2675a | MIOA2842a |
| 493 | MIOA1776 | MIOA1921a | MIOA2063 | MIOA2230a | MIOA2372a | MIOA2507a | MIOA2678a | MIOA2844a |
| 494 | MIOA1777n | MIOA1922a | MIOA2065 | MIOA2235a | MIOA2373a | MIOA2509a | MIOA2679a | MIOA2846a |
| 495 | MIOA1778 | MIOA1923a | MIOA2068 | MIOA2236a | MIOA2374a | MIOA2511a | MIOA2684a | MIOA2848a |
| 496 | MIOA1779 | MIOA1927a | MIOA2069 | MIOA2238a | MIOA2375a | MIOA2515a | MIOA2687a | MIOA2851a |
| 497 | MIOA1780 | MIOA1928a | MIOA2070 | MIOA2239a | MIOA2377a | MIOA2521a | MIOA2691a | MIOA2852a |
| 498 | MIOA1785 | MIOA1930a | MIOA2071 | MIOA2242a | MIOA2379a | MIOA2522a | MIOA2693a | MIOA2853a |
| 499 | MIOA1791 | MIOA1932a | MIOA2073 | MIOA2247a | MIOA2381a | MIOA2528a | MIOA2694a | MIOA2854a |
| 500 | MIOA1792 | MIOA1933a | MIOA2075 | MIOA2248a | MIOA2384a | MIOA2531a | MIOA2696a | MIOA2856a |
| 501 | MIOA1794 | MIOA1934a | MIOA2076 | MIOA2249a | MIOA2385a | MIOA2533a | MIOA2698a | MIOA2857a |
| 502 | MIOA1795 | MIOA1935a | MIOA2079n | MIOA2251a | MIOA2386a | MIOA2534a | MIOA2702a | MIOA2858a |
| 503 | MIOA1797m | MIOA1936a | MIOA2086 | MIOA2256a | MIOA2388a | MIOA2536a | MIOA2707a | MIOA2861a |
| 504 | MIOA1798m | MIOA1939a | MIOA2087n | MIOA2259a | MIOA2393a | MIOA2537a | MIOA2708a | MIOA2864a |
| 505 | MIOA1800m | MIOA1941a | MIOA2090 | MIOA2260a | MIOA2394a | MIOA2541a | MIOA2709a | MIOA2868a |
| 506 | MIOA1802m | MIOA1942a | MIOA2091 | MIOA2261a | MIOA2395a | MIOA2546a | MIOA2714a | MIOA2869a |
| 507 | MIOA1803m | MIOA1944a | MIOA2092n | MIOA2262a | MIOA2398a | MIOA2547a | MIOA2717a | MIOA2886a |
| 508 | MIOA1811a | MIOA1947a | MIOA2093 | MIOA2263a | MIOA2399a | MIOA2548a | MIOA2718a | MIOA2887a |
| 509 | MIOA1818a | MIOA1948a | MIOA2094 | MIOA2264a | MIOA2400a | MIOA2550a | MIOA2720a | MIOA2890a |
| 510 | MIOA1819a | MIOA1949a | MIOA2097 | MIOA2265a | MIOA2402a | MIOA2551a | MIOA2722a | MIOA2893a |
| 511 | MIOA1822a | MIOA1952a | MIOA2098 | MIOA2266a | MIOA2409a | MIOA2555a | MIOA2725a | MIOA2895a |
| 512 | MIOA1827a | MIOA1953a | MIOA2103 | MIOA2268a | MIOA2412a | MIOA2556a | MIOA2730a | MIOA2898a |
| 513 | MIOA1828a | MIOA1955a | MIOA2104 | MIOA2269a | MIOA2413a | MIOA2557a | MIOA2734a | MIOA2900a |
| 514 | MIOA1830a | MIOA1963a | MIOA2106 | MIOA2273a | MIOA2421a | MIOA2561a | MIOA2740a | MIOA2901a |
| 515 | MIOA1832a | MIOA1965a | MIOA2111 | MIOA2274a | MIOA2423a | MIOA2563a | MIOA2743a | MIOA2902a |
| 516 | MIOA1834a | MIOA1966a | MIOA2112 | MIOA2275a | MIOA2424a | MIOA2564a | MIOA2747a | MIOA2905a |
| 517 | MIOA1835a | MIOA1967a | MIOA2114 | MIOA2277a | MIOA2425a | MIOA2565a | MIOA2750a | MIOA2907a |
| 518 | MIOA1839a | MIOA1971a | MIOA2116 | MIOA2278a | MIOA2426a | MIOA2567a | MIOA2753a | MIOA2908a |
| 519 | MIOA1840a | MIOA1978a | MIOA2118 | MIOA2279a | MIOA2427a | MIOA2568a | MIOA2756a | MIOA2909a |
| 520 | MIOA1841a | MIOA1979a | MIOA2122 | MIOA2281a | MIOA2428a | MIOA2570a | MIOA2758a | MIOA2915a |
| 521 | MIOA2917a | MIOA3073a | MIOA3243a | MIOA3369a | MIOA3504a | MIOA3636a | MIOA3744a | MIOA3873 |
| 522 | MIOA2922a | MIOA3079a | MIOA3248a | MIOA3370a | MIOA3505a | MIOA3637a | MIOA3748a | MIOA3878 |
| 523 | MIOA2923a | MIOA3080a | MIOA3251a | MIOA3375a | MIOA3510a | MIOA3639a | MIOA3751a | MIOA3881a |
| 524 | MIOA2926a | MIOA3082a | MIOA3252a | MIOA3377a | MIOA3512a | MIOA3640a | MIOA3752a | MIOA3883a |
| 525 | MIOA2933a | MIOA3083a | MIOA3254a | MIOA3378a | MIOA3513a | MIOA3641a | MIOA3754a | MIOA3888a |
| 526 | MIOA2934a | MIOA3084a | MIOA3255a | MIOA3380a | MIOA3514a | MIOA3645a | MIOA3755a | MIOA3889a |
| 527 | MIOA2937a | MIOA3086a | MIOA3259a | MIOA3384a | MIOA3518a | MIOA3646a | MIOA3757a | MIOA3890a |
| 528 | MIOA2939a | MIOA3089a | MIOA3262a | MIOA3387a | MIOA3519a | MIOA3648a | MIOA3758a | MIOA3891a |
| 529 | MIOA2940a | MIOA3092a | MIOA3265a | MIOA3388a | MIOA3520a | MIOA3649a | MIOA3760a | MIOA3893a |
| 530 | MIOA2941a | MIOA3097a | MIOA3266a | MIOA3389a | MIOA3521a | MIOA3650a | MIOA3764 | MIOA3894a |
| 531 | MIOA2945a | MIOA3098a | MIOA3268a | MIOA3390a | MIOA3524a | MIOA3652a | MIOA3765 | MIOA3895a |
| 532 | MIOA2946a | MIOA3101a | MIOA3269a | MIOA3392a | MIOA3525a | MIOA3653a | MIOA3766 | MIOA3899a |
| 533 | MIOA2948a | MIOA3102a | MIOA3271 | MIOA3393a | MIOA3527a | MIOA3654a | MIOA3767 | MIOA3903a |
| 534 | MIOA2949a | MIOA3104a | MIOA3272 | MIOA3394a | MIOA3528a | MIOA3655a | MIOA3770 | MIOA3904a |
| 535 | MIOA2950a | MIOA3111a | MIOA3274 | MIOA3395a | MIOA3530a | MIOA3657a | MIOA3772 | MIOA3905a |
| 536 | MIOA2953a | MIOA3112a | MIOA3275 | MIOA3396a | MIOA3531a | MIOA3658a | MIOA3773 | MIOA3907a |

Figure 8 - List of Novel and Known Gene Clones from Mild OA and Severe OA Libraries on Microarray (page 9 of 10)

| | | | | | | | | |
|---|---|---|---|---|---|---|---|---|
| 537 | MIOA2955a | MIOA3114a | MIOA3276 | MIOA3397a | MIOA3532a | MIOA3661a | MIOA3775 | MIOA3911a |
| 538 | MIOA2962a | MIOA3115a | MIOA3277 | MIOA3398a | MIOA3533a | MIOA3662a | MIOA3778 | MIOA3913a |
| 539 | MIOA2963a | MIOA3117a | MIOA3278 | MIOA3399a | MIOA3535a | MIOA3665a | MIOA3780 | MIOA3915a |
| 540 | MIOA2964a | MIOA3118a | MIOA3279a | MIOA3402a | MIOA3538a | MIOA3666a | MIOA3784 | MIOA3920a |
| 541 | MIOA2965a | MIOA3122a | MIOA3281a | MIOA3404a | MIOA3540a | MIOA3668a | MIOA3786 | MIOA3921a |
| 542 | MIOA2970a | MIOA3124a | MIOA3282a | MIOA3412a | MIOA3541a | MIOA3669a | MIOA3788 | MIOA3924a |
| 543 | MIOA2971a | MIOA3129a | MIOA3288a | MIOA3414a | MIOA3543a | MIOA3670a | MIOA3790 | MIOA3925a |
| 544 | MIOA2977a | MIOA3132a | MIOA3289a | MIOA3415a | MIOA3545a | MIOA3672a | MIOA3792 | MIOA3926a |
| 545 | MIOA2979a | MIOA3133a | MIOA3291a | MIOA3416a | MIOA3547a | MIOA3673a | MIOA3793 | MIOA3931a |
| 546 | MIOA2981a | MIOA3135a | MIOA3292a | MIOA3417a | MIOA3548a | MIOA3674a | MIOA3795 | MIOA3932a |
| 547 | MIOA2982a | MIOA3136a | MIOA3293a | MIOA3420a | MIOA3549a | MIOA3675a | MIOA3796 | MIOA3934a |
| 548 | MIOA2983a | MIOA3137a | MIOA3294a | MIOA3421a | MIOA3550a | MIOA3677a | MIOA3797 | MIOA3936a |
| 549 | MIOA2984a | MIOA3138a | MIOA3297a | MIOA3424a | MIOA3554a | MIOA3678a | MIOA3799 | MIOA3938a |
| 550 | MIOA2986a | MIOA3140a | MIOA3301a | MIOA3425a | MIOA3558a | MIOA3679a | MIOA3801 | MIOA3939a |
| 551 | MIOA2987a | MIOA3143a | MIOA3303a | MIOA3426a | MIOA3559a | MIOA3680a | MIOA3803 | MIOA3940a |
| 552 | MIOA2988a | MIOA3144a | MIOA3304a | MIOA3428a | MIOA3562a | MIOA3683 | MIOA3804 | MIOA3942a |
| 553 | MIOA2989a | MIOA3147a | MIOA3307a | MIOA3430a | MIOA3564a | MIOA3683a | MIOA3805 | MIOA3943a |
| 554 | MIOA2991a | MIOA3148a | MIOA3308a | MIOA3431a | MIOA3565a | MIOA3685a | MIOA3806 | MIOA3944a |
| 555 | MIOA2992a | MIOA3149a | MIOA3310a | MIOA3432a | MIOA3566a | MIOA3686a | MIOA3807 | MIOA3946a |
| 556 | MIOA2993a | MIOA3150a | MIOA3314a | MIOA3436a | MIOA3567a | MIOA3687a | MIOA3808 | MIOA3947a |
| 557 | MIOA2995a | MIOA3153a | MIOA3316a | MIOA3437a | MIOA3568a | MIOA3688a | MIOA3811 | MIOA3949a |
| 558 | MIOA2997a | MIOA3159a | MIOA3318a | MIOA3439a | MIOA3569a | MIOA3689a | MIOA3812 | MIOA3953a |
| 559 | MIOA2998a | MIOA3160a | MIOA3320a | MIOA3445a | MIOA3571a | MIOA3692a | MIOA3814 | MIOA3954a |
| 560 | MIOA2999a | MIOA3163a | MIOA3327a | MIOA3449a | MIOA3574a | MIOA3693a | MIOA3816 | MIOA3956a |
| 561 | MIOA3000a | MIOA3167a | MIOA3328a | MIOA3450a | MIOA3576a | MIOA3694a | MIOA3819 | MIOA3961a |
| 562 | MIOA3002a | MIOA3169a | MIOA3329a | MIOA3453a | MIOA3577a | MIOA3697a | MIOA3821 | MIOA3962a |
| 563 | MIOA3003a | MIOA3170a | MIOA3331a | MIOA3456a | MIOA3578a | MIOA3699a | MIOA3822 | MIOA3963a |
| 564 | MIOA3005a | MIOA3176a | MIOA3333a | MIOA3458a | MIOA3579a | MIOA3700a | MIOA3826 | MIOA3966a |
| 565 | MIOA3013a | MIOA3182a | MIOA3335a | MIOA3460a | MIOA3581a | MIOA3701a | MIOA3828 | MIOA3967a |
| 566 | MIOA3014a | MIOA3185a | MIOA3336a | MIOA3467a | MIOA3582a | MIOA3702a | MIOA3829 | MIOA3969a |
| 567 | MIOA3016a | MIOA3186a | MIOA3337a | MIOA3468a | MIOA3584a | MIOA3703a | MIOA3830 | MIOA3970a |
| 568 | MIOA3018a | MIOA3195a | MIOA3339a | MIOA3469a | MIOA3585a | MIOA3704a | MIOA3833 | MIOA3974a |
| 569 | MIOA3024a | MIOA3198a | MIOA3342a | MIOA3470a | MIOA3588a | MIOA3713a | MIOA3835 | MIOA3977a |
| 570 | MIOA3027a | MIOA3203a | MIOA3343a | MIOA3471a | MIOA3594a | MIOA3715a | MIOA3837 | MIOA3979a |
| 571 | MIOA3029a | MIOA3205a | MIOA3345a | MIOA3472a | MIOA3597a | MIOA3716 | MIOA3838 | MIOA3980a |
| 572 | MIOA3030a | MIOA3208a | MIOA3348a | MIOA3473a | MIOA3598a | MIOA3716a | MIOA3839 | MIOA3981a |
| 573 | MIOA3031a | MIOA3209a | MIOA3349a | MIOA3474a | MIOA3599a | MIOA3717a | MIOA3840 | MIOA3983a |
| 574 | MIOA3032a | MIOA3210a | MIOA3350a | MIOA3476a | MIOA3602a | MIOA3720a | MIOA3842 | MIOA3985a |
| 575 | MIOA3034a | MIOA3216a | MIOA3351a | MIOA3479a | MIOA3604a | MIOA3721a | MIOA3852 | MIOA3988a |
| 576 | MIOA3041a | MIOA3217a | MIOA3352a | MIOA3481a | MIOA3606a | MIOA3722a | MIOA3855 | MIOA3992a |
| 577 | MIOA3042a | MIOA3224a | MIOA3354a | MIOA3482a | MIOA3614a | MIOA3723a | MIOA3856 | MIOA3997a |
| 578 | MIOA3045a | MIOA3226a | MIOA3355a | MIOA3486a | MIOA3616a | MIOA3724a | MIOA3857 | MIOA3998a |
| 579 | MIOA3047a | MIOA3227a | MIOA3357a | MIOA3488a | MIOA3617a | MIOA3725a | MIOA3859 | MIOA4002a |
| 580 | MIOA3049a | MIOA3229a | MIOA3359a | MIOA3489a | MIOA3618a | MIOA3726a | MIOA3860 | MIOA4004a |
| 581 | MIOA3058a | MIOA3231a | MIOA3361a | MIOA3492a | MIOA3620a | MIOA3727a | MIOA3863 | MIOA4005a |
| 582 | MIOA3060a | MIOA3232a | MIOA3363a | MIOA3495a | MIOA3625a | MIOA3738a | MIOA3864 | MIOA4012a |
| 583 | MIOA3063a | MIOA3233a | MIOA3364a | MIOA3498a | MIOA3627a | MIOA3739a | MIOA3868 | MIOA4013a |
| 584 | MIOA3064a | MIOA3237a | MIOA3365a | MIOA3500a | MIOA3629a | MIOA3742a | MIOA3871 | MIOA4014a |
| 585 | MIOA3066a | MIOA3239a | MIOA3367a | MIOA3503a | MIOA3634a | MIOA3743a | MIOA3872 | MIOA4016a |
| 586 | MIOA4017a | MIOA4173 | MIOA4326a | MIOA4552a | MIOA4707 | MIOA4849a | MIOA5037a | MIOA5249a |
| 587 | MIOA4020a | MIOA4176 | MIOA4330a | MIOA4557a | MIOA4711 | MIOA4850a | MIOA5040a | MIOA5254a |
| 588 | MIOA4023a | MIOA4177 | MIOA4332a | MIOA4558a | MIOA4712 | MIOA4852a | MIOA5043a | MIOA5266a |
| 589 | MIOA4024a | MIOA4178 | MIOA4336a | MIOA4559a | MIOA4713 | MIOA4854a | MIOA5054a | MIOA5273a |
| 590 | MIOA4026a | MIOA4179 | MIOA4338a | MIOA4560a | MIOA4715 | MIOA4855a | MIOA5057a | MIOA5278a |
| 591 | MIOA4027a | MIOA4180 | MIOA4339a | MIOA4564a | MIOA4716 | MIOA4864a | MIOA5059a | MIOA5289a |
| 592 | MIOA4031a | MIOA4184 | MIOA4342a | MIOA4565a | MIOA4719 | MIOA4868a | MIOA5061a | MIOA5293a |
| 593 | MIOA4035a | MIOA4185 | MIOA4346a | MIOA4567a | MIOA4721 | MIOA4869a | MIOA5063a | MIOA5294a |
| 594 | MIOA4036a | MIOA4186 | MIOA4347a | MIOA4568a | MIOA4725 | MIOA4874a | MIOA5072a | MIOA5305a |
| 595 | MIOA4037a | MIOA4190 | MIOA4348a | MIOA4572a | MIOA4730 | MIOA4877a | MIOA5073a | MIOA5306a |
| 596 | MIOA4041a | MIOA4191 | MIOA4354a | MIOA4579a | MIOA4732 | MIOA4880a | MIOA5074a | MIOA5310a |
| 597 | MIOA4042a | MIOA4194 | MIOA4355a | MIOA4580a | MIOA4734 | MIOA4883a | MIOA5079a | MIOA5316a |
| 598 | MIOA4045a | MIOA4196 | MIOA4360a | MIOA4582a | MIOA4735 | MIOA4884a | MIOA5084a | MIOA5317a |
| 599 | MIOA4046a | MIOA4197 | MIOA4363a | MIOA4583a | MIOA4736 | MIOA4885a | MIOA5085a | MIOA5324a |
| 600 | MIOA4047a | MIOA4204 | MIOA4365a | MIOA4587a | MIOA4738 | MIOA4886a | MIOA5087a | MIOA5325a |
| 601 | MIOA4048a | MIOA4206 | MIOA4367a | MIOA4590a | MIOA4739 | MIOA4887a | MIOA5093a | MIOA5326a |
| 602 | MIOA4054a | MIOA4212 | MIOA4372a | MIOA4596a | MIOA4742 | MIOA4890a | MIOA5097a | MIOA5329a |
| 603 | MIOA4056a | MIOA4219 | MIOA4381a | MIOA4598a | MIOA4744 | MIOA4891a | MIOA5108a | MIOA5331a |

Figure 8 - List of Novel and Known Gene Clones from Mild OA and Severe OA Libraries on Microarray (page 10 of 10)

| | | | | | | | | |
|---|---|---|---|---|---|---|---|---|
| 604 | MIOA4057a | MIOA4224 | MIOA4384a | MIOA4600a | MIOA4748 | MIOA4893a | MIOA5109a | MIOA5333a |
| 605 | MIOA4058a | MIOA4226 | MIOA4386 | MIOA4601a | MIOA4749 | MIOA4896a | MIOA5111a | MIOA5346a |
| 606 | MIOA4059a | MIOA4229 | MIOA4387 | MIOA4602a | MIOA4751 | MIOA4898a | MIOA5113a | MIOA5348a |
| 607 | MIOA4061a | MIOA4236 | MIOA4389 | MIOA4605a | MIOA4753 | MIOA4902a | MIOA5115a | MIOA5349a |
| 608 | MIOA4064a | MIOA4238 | MIOA4390 | MIOA4606a | MIOA4756 | MIOA4905a | MIOA5116a | MIOA5351a |
| 609 | MIOA4066a | MIOA4241 | MIOA4391 | MIOA4612a | MIOA4759 | MIOA4912a | MIOA5117a | MIOA5355a |
| 610 | MIOA4069a | MIOA4242 | MIOA4394 | MIOA4616a | MIOA4763 | MIOA4916a | MIOA5120a | MIOA5356a |
| 611 | MIOA4072a | MIOA4244 | MIOA4396 | MIOA4619a | MIOA4764 | MIOA4921a | MIOA5122a | MIOA5357a |
| 612 | MIOA4073a | MIOA4245 | MIOA4403 | MIOA4621a | MIOA4765 | MIOA4927a | MIOA5127a | MIOA5359a |
| 613 | MIOA4076a | MIOA4246 | MIOA4409 | MIOA4622a | MIOA4766 | MIOA4939a | MIOA5131a | MIOA5364a |
| 614 | MIOA4077a | MIOA4247 | MIOA4410 | MIOA4626a | MIOA4767 | MIOA4941a | MIOA5133a | MIOA5366a |
| 615 | MIOA4081a | MIOA4251 | MIOA4411 | MIOA4627a | MIOA4769 | MIOA4943a | MIOA5138a | MIOA5368a |
| 616 | MIOA4083a | MIOA4252 | MIOA4417 | MIOA4628a | MIOA4770 | MIOA4944a | MIOA5139a | MIOA5373a |
| 617 | MIOA4086a | MIOA4255 | MIOA4419 | MIOA4630a | MIOA4771 | MIOA4953a | MIOA5141a | MIOA5390a |
| 618 | MIOA4089a | MIOA4258 | MIOA4421 | MIOA4632a | MIOA4775 | MIOA4954a | MIOA5143a | MIOA5391a |
| 619 | MIOA4090a | MIOA4261 | MIOA4427 | MIOA4635a | MIOA4776 | MIOA4955a | MIOA5144a | MIOA5394a |
| 620 | MIOA4092a | MIOA4264 | MIOA4429 | MIOA4636a | MIOA4778 | MIOA4956a | MIOA5147a | MIOA5395a |
| 621 | MIOA4094a | MIOA4265 | MIOA4466a | MIOA4638a | MIOA4779 | MIOA4957a | MIOA5150a | MIOA5396a |
| 622 | MIOA4096a | MIOA4267 | MIOA4468a | MIOA4639a | MIOA4782a | MIOA4959a | MIOA5156a | MIOA5397a |
| 623 | MIOA4102 | MIOA4268 | MIOA4472a | MIOA4640a | MIOA4783a | MIOA4963a | MIOA5157a | MIOA5400a |
| 624 | MIOA4106 | MIOA4269 | MIOA4474a | MIOA4641a | MIOA4786a | MIOA4964a | MIOA5165a | MIOA5402a |
| 625 | MIOA4109 | MIOA4270 | MIOA4476a | MIOA4643a | MIOA4787a | MIOA4972a | MIOA5170a | MIOA5403a |
| 626 | MIOA4111 | MIOA4272 | MIOA4477a | MIOA4646a | MIOA4788a | MIOA4973a | MIOA5171a | MIOA5404a |
| 627 | MIOA4112 | MIOA4275 | MIOA4483a | MIOA4647a | MIOA4789a | MIOA4975a | MIOA5172a | MIOA5408a |
| 628 | MIOA4114 | MIOA4276 | MIOA4484a | MIOA4650a | MIOA4791a | MIOA4978a | MIOA5173a | MIOA5409a |
| 629 | MIOA4115 | MIOA4277 | MIOA4486a | MIOA4653a | MIOA4792a | MIOA4982a | MIOA5176a | MIOA5411m |
| 630 | MIOA4120 | MIOA4278 | MIOA4491a | MIOA4655a | MIOA4793a | MIOA4985a | MIOA5178a | MIOA5412a |
| 631 | MIOA4121 | MIOA4281 | MIOA4493a | MIOA4658a | MIOA4795a | MIOA4987a | MIOA5180a | MIOA5420a |
| 632 | MIOA4122 | MIOA4285 | MIOA4496a | MIOA4661a | MIOA4796a | MIOA4989a | MIOA5186a | MIOA5421a |
| 633 | MIOA4128 | MIOA4286 | MIOA4499a | MIOA4667a | MIOA4800a | MIOA4991a | MIOA5189a | MIOA5422a |
| 634 | MIOA4131 | MIOA4287 | MIOA4501a | MIOA4669a | MIOA4803a | MIOA4992a | MIOA5196a | MIOA5427a |
| 635 | MIOA4134 | MIOA4290a | MIOA4502a | MIOA4670a | MIOA4804a | MIOA5000a | MIOA5198a | |
| 636 | MIOA4135 | MIOA4292a | MIOA4504a | MIOA4677 | MIOA4806a | MIOA5001a | MIOA5199a | |
| 637 | MIOA4136 | MIOA4295a | MIOA4508a | MIOA4678 | MIOA4809a | MIOA5002a | MIOA5202a | |
| 638 | MIOA4143 | MIOA4299a | MIOA4509a | MIOA4683 | MIOA4810a | MIOA5004a | MIOA5203a | |
| 639 | MIOA4144 | MIOA4300a | MIOA4518a | MIOA4686 | MIOA4813a | MIOA5006a | MIOA5204a | |
| 640 | MIOA4149 | MIOA4301a | MIOA4519a | MIOA4688 | MIOA4818a | MIOA5010a | MIOA5205a | |
| 641 | MIOA4150 | MIOA4303a | MIOA4525a | MIOA4690 | MIOA4820a | MIOA5013a | MIOA5209a | |
| 642 | MIOA4151 | MIOA4308a | MIOA4528a | MIOA4694 | MIOA4824a | MIOA5014a | MIOA5212a | |
| 643 | MIOA4156 | MIOA4309a | MIOA4532a | MIOA4695 | MIOA4826a | MIOA5015a | MIOA5216a | |
| 644 | MIOA4161 | MIOA4311a | MIOA4534a | MIOA4696 | MIOA4827a | MIOA5016a | MIOA5217a | |
| 645 | MIOA4164 | MIOA4317a | MIOA4536a | MIOA4697 | MIOA4829a | MIOA5017a | MIOA5219a | |
| 646 | MIOA4167 | MIOA4318a | MIOA4539a | MIOA4700 | MIOA4830a | MIOA5018a | MIOA5221a | |
| 647 | MIOA4168 | MIOA4320a | MIOA4542a | MIOA4701 | MIOA4834a | MIOA5020a | MIOA5229a | |
| 648 | MIOA4169 | MIOA4321a | MIOA4548a | MIOA4702 | MIOA4838a | MIOA5021a | MIOA5231a | |
| 649 | MIOA4170 | MIOA4323a | MIOA4550a | MIOA4704 | MIOA4845a | MIOA5030a | MIOA5233a | |
| 650 | MIOA4171 | MIOA4324a | MIOA4551a | MIOA4706 | MIOA4846a | MIOA5033a | MIOA5245a | |

Figure 9

Candidate Upregulated Genes in Mild OA Library

| | No. | Sequence Name | Gene Name | Accession Number |
|---|---|---|---|---|
| | 1 | SEOA0290 | No sequence match | |
| | 2 | MIOA0601a | Beta-globin | emb\|V00497 |
| | 3 | MIOA4572a | Cytochrome b-245, beta polypeptide (chronic granulomatous disease) (CYBB) (=X04011) | gi\|4557506 |
| | 4 | SEOA4040a | Class II invariant gamma-chain | emb\|X03340 |
| | 5 | MIOA1839a | Thymosin beta-4 | gb\|M17733 |
| | 6 | SEOA3887 | EST(nz80g08.s1 NCI_CGAP_GCB1 clone IMAGE:1301822) | gb\|AA767226 |
| | 7 | SEOA3860 | EST(tm54e09.x1 NCI_CGAP_Kid11 clone IMAGE:2161860 3' contains Alu repeat) | gb\|AI478625 1 |
| | 8 | SEOA0200A | Ia-associated invariant gamma-chain gene | gb\|M13560 |
| | 9 | SEOA3935 | DNA sequence (UWGC:y18c282 from 6p21) | gb\|AC004190 |
| | 10 | SEOA0174a | Promyelocytic leukemia cell | gb\|M11948 |
| ** | 11 | MIOA2983a | Megakaryocyte stimulating factor | gb\|U70136 |
| | 12 | SEOA3648a | Ribosomal protein S23 | dbj\|AB007158 |
| | 13 | SEOA2970a | Major histocompatibility class II antigen gamma chain | gb\|K01144 |
| | 14 | MIOA3581a | EST(om82e10.s1 NCI_CGAP_Kid3 clone IMAGE:1553706 3') | gb\|AA983535 |
| | 15 | MIOA0682n | DNA sequence (HS_3009_A2_C04_T7 CIT Approved Human Genomic Sperm Library D) | gb\|AQ130698 |
| | 16 | SEOA4204a | Monocyte chemotactic protein-3 (MCP-3) | X72308\| |
| | 17 | SEOA4214a | EST zt99d07.r1 Soares testis NHT cDNA clone 730477 5' | AA412384\| |
| | 18 | MIOA1996 | DNA sequence (Chromosome X) | gb\|AC002418 |
| | 19 | SEOA4382a | Vacuolar H( )-ATPase subunit mRNA, complete cds | AF038954\| |
| | 20 | MIOA1556 | MHC class I HLA-C-alpha-2 chain | gb\|M24097 |
| | 21 | MIOA2114 | No sequence match | |
| | 22 | MIOA3163a | Stearoyl-CoA desaturase (SCD) | gb\|AF097514.1 |
| * | 23 | MIOA2451a | Adipocyte lipid-binding protein | gb\|J02874 |
| | 24 | SEOA0279 | S100E calcium binding protein | emb\|Z18950 |
| | 25 | MIOA5127a | EST ng06h03.s1 NCI_CGAP_Li1 IMAGE:928661 | AA501695\| |
| | 26 | SEOA2892a | Fc-gamma-receptorIIIB(FCGR3B) | gb\|M90746 |
| | 27 | SEOA3665a | Growth arrest and DNA-damage-inducible protein (gadd45) | gb\|M60974 |
| | 28 | SEOA1448a | MHC class I HLA-Bw62 , haplotype A1/A2,B8/Bw62,Cw3/Cw7 (clone pMF28) | gb\|M28204 |
| | 29 | MIOA1773 | EST(zc34b09.s1 Soares senescent fibroblasts NbHSF clone 324185 3') | gb\|W47478 |
| | 30 | SEOA2833n | Hypothetical protein cDNA DKFZp586J021 similar to Cavia porcellus metalloproteinase inhibitor TIMP-2 mRNA, complete cds(AF127803.1) | AL110197.1\| |
| | 31 | MIOA4827a | mRNA expressed only in placental villi, clone SMAP47 | AB019564\| |
| | 32 | SEOA2974a | Metalloproteinase inhibitor TIMP-2 | gb\|AF127803.1 |
| | 33 | MIOA2436a | EST(nc50d05.r1 NCI_CGAP_Pr3 clone IMAGE:1011561 contains Alu repeat) | gb\|AA229076 |
| | 34 | MIOA4601a | Cytochrome c oxidase subunit II gene (ORF), mitochondrial gene encoding mitochondrial protein. | AF004339\| |
| | 35 | SEOA0409 | NADH dehydrogenase subunit 2 (ND2) | gb\|AF014897.2 |
| | 36 | MIOA0501 | DNA sequence (clone 1000E10 on chromosome 1p12-13.3) | emb\|AL096773 6 |

Median ratio is equal to or greater than 2.0

* detected only in severe OA library by EST analysis, ie not detected in mild OA library

** observed to have higher expression in severe OA library as compared to mild OA libaray by EST analysis

Figure 10

Candidate Downregulated Genes in Mild OA Library

| No. | Sequence Name | Gene Name | Accession Number | |
|---|---|---|---|---|
| 1 | SEOA0866 | EST (wj34b11.x1 NCI_CGAP_Kid12 clone IMAGE:2404701 3') | gb\|AI816793.1 | |
| 2 | seoa1145a | small acidic protein | gb\|U51678 | |
| 3 | seoa1596a | B-cell translocation protein 1 (BTG1) | emb\|X61123 | |
| 4 | seoa1300a | osteopontin | dbj\|D14813 | |
| 5 | SEOA2136 | EST(EST78578 Pineal gland I 5') | gb\|AA387442 | |
| 6 | seoa2534 | EST(zk86d01.s1 Soares pregnant uterus NbHPU clone 489697 3') | gb\|AA099585 | |
| 7 | seoa2358a | vimentin (HuVim3) | gb\|M25246 | |
| 8 | seoa5366 | tenascin= hexabrachion | emb\|X56160 | |
| 9 | seoa5498a | EST(ol31g10.s1 Soares_NFL_T_GBC_S1 clone IMAGE:1525122 3') | gb\|AA913562 | |
| 10 | seoa5694a | EST(wk80f06.x1 NCI_CGAP_Pan1 clone IMAGE:2421731 3') | gb\|AI813984.1 | |
| 11 | seoa5932 | EST(tg37c12.x1 Soares_NFL_T_GBC_S1 clone IMAGE:2110966 3') | gb\|AI418593 | |
| 12 | MIOA0764 | Novel | | |
| 13 | seoa7289a | EST(df04e10.y1 Morton Fetal Cochlea clone IMAGE:2482675 5') | gb\|AW020116.1 | |
| 14 | mioa1647a | EST (wg44e11.x1 Soares_NSF_F8_9W_OT_PA_P_S1 clone IMAGE:2367980 3') | gb\|AI742654.1 | |
| 15 | mioa1677a | EST (ok24e10.s1 Soares_NSF_F8_9W_OT_PA_P_S1 clone IMAGE:1508778 3') | gb\|AA897786 | |
| 16 | mioa3124a | EST(df19f04.y1 Morton Fetal Cochlea clone IMAGE:2483862 5') | gb\|AW021164.1 | |
| 17 | mioa2454a | EST(wj32h12.x1 NCI_CGAP_Kid12 clone IMAGE:2404583 3') | gb\|AI819228.1 | |
| 18 | mioa2878a | EST(yo59a03.r1 clone 182188 5') | gb\|H30104 | |
| 19 | mioa3277 | EST(zx10c10 s1 Soares total fetus Nb2HF8 9w clone 786066 3') | gb\|AA448648 | |
| 20 | mioa3473a | Id-2H | dbj\|D13891 | |
| 21 | mioa3872 | DNA sequence (CpG island DNA genomic Mse1 fragment, clone 70g11, reverse read cpg70g11.rt1a) | emb\|Z62622 | |
| 22 | mioa4394 | EST yd36b07.r1 cDNA clone 110293 5'. | T82005\| | |
| 23 | mioa3873 | DNA sequence (DKFZp586P2421 clone DKFZp586P2421) | emb\|AL110267.1 | |
| 24 | mioa4311a | EST(aorta GEN-204H02 5') | dbj\|D61737 | |
| 25 | seoa0890n | chitinase precursor (HUMTCHIT) | gb\|U58514 | |
| 26 | SEOA1380 | EST(yh88a12.s1 clone 136798 3') | gb\|R36451 | |
| 27 | SEOA1523 | Novel | | |
| 28 | SEOA1914 | Novel | | |
| 29 | seoa2979a | connective tissue growth factor | gb\|U14750 | |
| 30 | seoa3740a | EST(tm33a02.x1 NCI_CGAP_Kid11 clone IMAGE:2159882 3') | gb\|AI480082.1 | |
| 31 | seoa5267a | ribonuclease, RNase A family, 4 (RNASE4), =D37931 | NM_002937.1\| | |
| 32 | seoa6160a | EST(qt26b11.x1 Soares_pregnant_uterus_NbHPU clone IMAGE:1949085 3') | gb\|AI342123 | |
| 33 | seoa6647a | EST(zd17g02.s1 Soares fetal heart NbHH19W clone 340946 3') | gb\|W57810 | |
| 34 | seoa6721 | EST(yw24e10.r1 clone 253194 5') | gb\|H88893 | |
| 35 | mioa0074a | EST (tm33a02.x1 NCI_CGAP_Kid11 clone IMAGE:2159882 3') | gb\|AI480082.1 | |
| 36 | MIOA0751 | EST (aorta GEN-233F03 5') | dbj\|D62028 | |
| 37 | mioa1414 | EST(EST98866 Thyroid 5') | gb\|AA385002 | |
| 38 | mioa1580 | Novel | | |
| 39 | mioa1690a | EST (tz92d08.x1 NCI_CGAP_Kid11 clone IMAGE:2296047 3') | gb\|AI636068.1 | |
| 40 | mioa1542m | EST yw36b06.s1 cDNA clone 254291 3'. | N22257\| | |
| 41 | mioa1841a | EST(tj57e04.x1 Soares_NSF_F8_9W_OT_PA_P_S1 clone IMAGE:2145630 3' contains Alu repeat) | gb\|AI453569 | |
| 42 | mioa1737 | EST(zw18b09.s1 Soares ovary tumor NbHOT clone 769625 3' contains L1.t1 MER12 repeat) | gb\|AA428305 | |
| 43 | mioa2568a | osteoinductive factor OIF | gb\|AF100758.1 | |
| 44 | mioa2564a | EST(tm33a02.x1 NCI_CGAP_Kid11 clone IMAGE:2159882 3') | gb\|AI480082.1 | |
| 45 | mioa2398a | collagen alpha-1 type XI (COL11A1) | gb\|J04177 | |
| 46 | mioa4136 | EST qe49g12.x1 Soares_fetal_lung_NbHL19W IMAGE:1742374 3', | AI185817\| | |
| 47 | mioa4587a | Novel | | |

Median ratio is equal to or less than 0.2

Figure 11

Candidate Upregulated Genes In Severe OA Library

| | No. | Sequence Name | Gene Name | Accession Number |
|---|---|---|---|---|
| | 1 | MIOA5310a | Proline arginine-rich end leucine-rich repeat protein (PRELP) =U29089 (ORF) | NM_002725.1\| |
| | 2 | MIOA4136 | EST qe49g12.x1 Soares_fetal_lung_NbHL19W IMAGE:1742374 3', | AI185817\| |
| | 3 | MIOA4421 | EST zx10c10.r1 Soares total fetus Nb2HF8 9w cDNA clone 786066 5' | AA448744\| |
| | 4 | MIOA4208 | EST th94b03.x1 Soares_NSF_F8_9W_OT_PA_P_S1 IMAGE:2126285 3', | AI435408\| |
| | 5 | MIOA3944a | RASF-A PLA2 (synovial phospholipase) | gb\|M22431 |
| | 6 | MIOA3807 | DNA sequence (clone 23767 and 23782) | gb\|AF007150 |
| | 7 | MIOA2564a | EST(tm33a02.x1 NCI_CGAP_Kid11 clone IMAGE:2159882 3') | gb\|AI480082.1 |
| | 8 | MIOA1841a | EST(tj57e04.x1 Soares_NSF_F8_9W_OT_PA_P_S1 clone IMAGE:2145630 3' contains Alu repeat) | gb\|AI453569 |
| | 9 | MIOA1542m | EST yw36b08.s1 cDNA clone 254291 3'. | N22257\| |
| | 10 | MIOA1690a | EST (tz92d08.x1 NCI_CGAP_Kid11 clone IMAGE:2296047 3') | gb\|AI636068.1 |
| | 11 | MIOA1134 | Novel | |
| | 12 | MIOA0751 | EST (aorta GEN-233F03 5') | dbj\|D62028 |
| | 13 | SEOA3836 | Novel | |
| | 14 | MIOA0074a | EST (tm33a02.x1 NCI_CGAP_Kid11 clone IMAGE:2159882 3') | gb\|AI480082.1 |
| | 15 | SEOA7373a | Hypothetical protein (KIAA0693) | dbj\|AB014593 |
| | 16 | SEOA3740a | EST(tm33a02.x1 NCI_CGAP_Kid11 clone IMAGE:2159882 3') | gb\|AI480082.1 |
| | 17 | SEOA3924 | Novel | |
| | 18 | SEOA3543a | EST(zt07g07.r1 NCI_CGAP_GCB1 clone IMAGE:712476 5') | gb\|AA280112 |
| | 19 | SEOA3739a | Chondroitin/dermatan sulfate proteoglycan (PG40) core protein (decorin) | gb\|M14219 |
| | 20 | SEOA3766a | SP40,40 (=M63379 TRPM-2 protein) | gb\|L00974 |
| * | 21 | SEOA3538a | YKL-39 precursor (=U58514 chitinase precursor) | gb\|U49835 |
| | 22 | SEOA2603 | Novel | |
| * | 23 | SEOA0890n | Chitinase precursor (HUMTCHIT) | gb\|U58514 |
| | 24 | MIOA4567a | Hypothetical protein (KIAA0062) | dbj\|D31887 |
| | 25 | SEOA3556a | Maternal-embryonic 3 (Mem3) | gb\|U47024 |
| ** | 26 | MIOA3872 | Ribosomal protein S29 | NM_001032 |
| | 27 | MIOA2678a | EST(yo59a03.r1 clone 182188 5') | gb\|H30104 |
| | 28 | MIOA2561a | EST(df04e10.y1 Morton Fetal Cochlea clone IMAGE:2482675 5') | gb\|AW020116.1 |
| | 29 | MIOA0958 | EST (aorta GEN-328B10 5') | dbj\|D62811 |
| | 30 | SEOA7289a | EST(df04e10.y1 Morton Fetal Cochlea clone IMAGE:2482675 5') | gb\|AW020116.1 |
| ** | 31 | SEOA2358a | Vimentin (HuVim3) | gb\|M25246 |
| | 32 | SEOA2986a | DNA sequence (chromosome 6 clone 608E8) | emb\|AL022343.5 |
| | 33 | SEOA2136 | EST(EST78578 Pineal gland I 5') | gb\|AA367442 |
| * | 34 | SEOA1300a | Osteopontin | dbj\|D14813 |
| | 35 | SEOA0379 | Integral membrane serine protease Seprase | gb\|U76833 |
| ** | 36 | SEOA0218a | Hexabrachion (HXB) (=tenascin) | gb\|M55618 |
| | 37 | SEOA1403 | Phospholipase A2, membrane associated precursor (Phosphatidylcholine 2-acylhydrolase) | sp\|P14555 |
| | 38 | SEOA0866 | EST (wj34b11.x1 NCI_CGAP_Kid12 clone IMAGE:2404701 3') | gb\|AI816793.1 |

Median ratio is equal to or greater than 2.0

* detected only in severe OA library by EST analysis and not in mild OA library

** observed to have higher expression in severe OA library as compared to mild OA library by EST analysis

Figure 12

Candidate Downregulated Genes in Severe OA Library

| No. | Sequence Name | Gene Name | Accession Number | |
|---|---|---|---|---|
| 1 | seoa0541n | DNA sequence (chromosome 21q22.1, D21S226-AML region, clone B2344F14-f50E8, segment 5/9) | dbj\|AP000169.1 | |
| 2 | mioa1561 | EST(zp01h08.r1 Stratagene ovarian cancer (#937219) clone 595167 5') | gb\|AA174046 | |
| 3 | mioa2531a | high endothelial venule | emb\|X82157 | |
| 4 | SEOA0200A | Ia-associated invariant gamma-chain gene | gb\|M13560 | |
| 5 | seoa0174a | promyelocytic leukemia cell | gb\|M11948 | |
| 6 | seoa3935 | DNA sequence (UWGC:y18c282 from 6p21) | gb\|AC004190 | |
| 7 | mioa1839a | thymosin beta-4 | gb\|M17733 | |
| 8 | mioa2451a | adipocyte lipid-binding protein | gb\|J02874 | |
| 9 | mioa3765 | selenoprotein P | emb\|Z11793 | |
| 10 | MIOA1605A | hypothetical protein (clone PLACE1005167) (weakly similar to APAG PROTEIN) | dbj\|AK001943.1 | |
| 11 | seoa3472a | MHC class II HLA-DR-beta-1 (HLA-DRB1) | gb\|M33600 | |
| 12 | seoa3887 | EST(nz80g08.s1 NCI_CGAP_GCB1 clone IMAGE:1301822) | gb\|AA787226 | |
| 13 | mioa0682n | DNA sequence (HS_3009_A2_C04_T7 CIT Approved Human Genomic Sperm Library D) | gb\|AQ130698 | |
| 14 | mioa2963a | heparin-binding EGF-like growth factor | gb\|M60278 | |
| 15 | mioa2223a | EST(zd60a07.r1 Soares fetal heart NbHH19W clone 345012 5') | gb\|W76307 | |
| 16 | seoa2892a | Fc-gamma-receptorIIIB(FCGR3B) | gb\|M90746 | |
| 17 | mioa1556 | MHC class I HLA-C-alpha-2 chain | gb\|M24097 | |
| 18 | mioa2983a | megakaryocyte stimulating factor | gb\|U70136 | |
| 19 | mioa0601a | beta-globin | emb\|V00497 | |
| 20 | mioa1750n | Novel | | |
| 21 | mioa4572a | cytochrome b-245, beta polypeptide (chronic granulomatous disease) (CYBB) (=X04011) | gi\|4557508 | |
| 22 | seoa1448a | MHC class I HLA-Bw62 , haplotype A1/A2,B8/Bw62,Cw3/Cw7 (clone pMF28) | gb\|M28204 | |
| 23 | mioa3754a | EST(wl18b08.x1 NCI_CGAP_Kid12 clone IMAGE:2403159 3') | gb\|AI796445.1 | |
| 24 | mioa2499a | DNA sequence (chromosome 17, clone hRPK.259_G_18) | gb\|AC005829 | |
| 25 | mioa2642 | lipoprotein lipase | gb\|M15856 | |
| 26 | mioa1803m | EST yq20a12.s1 Soares fetal liver spleen 1NFLS cDNA clone 274102 3' | H49472\| | |
| 27 | mioa1555 | EST(yi10e03.r1 clone 148348 5') | gb\|H13072 | |
| 28 | mioa2238a | DNA sequence (BAC clone RG118P15 from 8q21) | gb\|AC005068 | |
| 29 | mioa3149a | DNA sequence (HS_5336_B2_E05_T7A RPCI-11 Male BAC Library) | gb\|AQ569402.1 | |
| 30 | seoa6514a | Novel | | |
| 31 | mioa1998 | DNA sequence (Chromosome X) | gb\|AC002416 | |
| 32 | mioa3657a | unnamed protein product | dbj\|AK001832 | |
| 33 | SEOA0759 | DNA sequence (BAC clone NH0494A09 from 7p21-p15.1) | gb\|AC006381 | |
| 34 | seoa3949a | transmembrane protein with EGF-like and two follistatin-like domains 1 (TMEFF1) | gb\|U19878 | |
| 35 | mioa2635 | Sec62 (Sec62) | gb\|U93239 | |
| 36 | mioa3163a | stearoyl-CoA desaturase (SCD) | gb\|AF097514.1 | |
| 37 | mioa2292a | caldesmon | gb\|M64110 | |
| 38 | mioa1777n | EST (ng20f01.s1 NCI_CGAP_Ov2 clone IMAGE:929977) | gb\|AA503150 | |
| 39 | seoa3993a | uncharacterized protein | dbj\|AK001049 | |
| 40 | mioa1582 | EST(qb82d07.x1 Soares_fetal_heart_NbHH19W clone IMAGE:1706605 3') | gb\|AI131563 | |
| 41 | mioa4114 | unnamed protein product (ORF) | AK001925\| | |
| 42 | mioa1737 | EST(zw18b09.s1 Soares ovary tumor NbHOT clone 769625 3' contains L1.t1 MER12 repeat) | gb\|AA428305 | |
| 43 | mioa2608a | EST(as39c11.x1 Barstead aorta HPLRB6 clone IMAGE:2319572 3') | gb\|AI708684.1 | |
| 44 | SEOA1526 | EST (EST100124 Pancreas tumor I 5') | gb\|AA294981 | |
| 45 | seoa2826 | Novel | | |
| 46 | SEOA0427 | EST (zo25g06.s1 Stratagene colon (#937204) clone 587962 3') | gb\|AA135431 | |
| 47 | mioa1479m | unnamed protein product (ORF) | AK001241\| | |
| 48 | SEOA0913 | antigen (p24/CD9) | gb\|L34068 | |
| 49 | seoa3794a | Novel | | |
| 50 | mioa1719a | Novel | | |
| 51 | seoa3563a | CD59 protein | emb\|Z14115 | |

Median ratio is equal to or less than 0.2

Figure 12

Candidate Downregulated Genes in Severe OA Library

| No. | Sequence Name | Gene Name | Accession Number | |
|---|---|---|---|---|
| 1 | seoa0541n | DNA sequence (chromosome 21q22.1, D21S226-AML region, clone B2344F14-f50E8, segment 5/9) | dbj\|AP000169.1 | |
| 2 | mioa1561 | EST(zp01h08.r1 Stratagene ovarian cancer (#937219) clone 595167 5') | gb\|AA174046 | |
| 3 | mioa2531a | high endothelial venule | emb\|X82157 | |
| 4 | SEOA0200A | Ia-associated invariant gamma-chain gene | gb\|M13560 | |
| 5 | seoa0174a | promyelocytic leukemia cell | gb\|M11948 | |
| 6 | seoa3935 | DNA sequence (UWGC:y18c282 from 6p21) | gb\|AC004190 | |
| 7 | mioa1839a | thymosin beta-4 | gb\|M17733 | |
| 8 | mioa2451a | adipocyte lipid-binding protein | gb\|J02874 | |
| 9 | mioa3765 | selenoprotein P | emb\|Z11793 | |
| 10 | MIOA1605A | hypothetical protein (clone PLACE1005187) (weakly similar to APAG PROTEIN) | dbj\|AK001943.1 | |
| 11 | seoa3472a | MHC class II HLA-DR-beta-1 (HLA-DRB1) | gb\|M33600 | |
| 12 | seoa3887 | EST(nz80g08.s1 NCI_CGAP_GCB1 clone IMAGE:1301822) | gb\|AA767226 | |
| 13 | mioa0682n | DNA sequence (HS_3009_A2_C04_T7 CIT Approved Human Genomic Sperm Library D) | gb\|AQ130898 | |
| 14 | mioa2963a | heparin-binding EGF-like growth factor | gb\|M60278 | |
| 15 | mioa2223a | EST(zd60e07.r1 Soares fetal heart NbHH19W clone 345012 5') | gb\|W76307 | |
| 16 | seoa2892a | Fc-gamma-receptorIIIB(FCGR3B) | gb\|M90746 | |
| 17 | mioa1558 | MHC class I HLA-C-alpha-2 chain | gb\|M24097 | |
| 18 | mioa2983a | megakaryocyte stimulating factor | gb\|U70136 | |
| 19 | mioa0601a | beta-globin | emb\|V00497 | |
| 20 | mioa1750n | Novel | | |
| 21 | mioa4572a | cytochrome b-245, beta polypeptide (chronic granulomatous disease) (CYBB) (=X04011) | gi\|4557506 | |
| 22 | seoa1448a | MHC class I HLA-Bw62 , haplotype A1/A2,B8/Bw62,Cw3/Cw7 (clone pMF28) | gb\|M28204 | |
| 23 | mioa3754a | EST(wj18b08 x1 NCI_CGAP_Kid12 clone IMAGE:2403159 3') | gb\|AI796445.1 | |
| 24 | mioa2499a | DNA sequence (chromosome 17, clone hRPK 259_G_18) | gb\|AC005829 | |
| 25 | mioa2642 | lipoprotein lipase | gb\|M15856 | |
| 26 | mioa1803m | EST yq20a12 s1 Soares fetal liver spleen 1NFLS cDNA clone 274102 3' | H49472\| | |
| 27 | mioa1555 | EST(yj10e03.r1 clone 148348 5') | gb\|H13072 | |
| 28 | mioa2238a | DNA sequence (BAC clone RG118P15 from 8q21) | gb\|AC005066 | |
| 29 | mioa3149a | DNA sequence (HS_5336_B2_E05_T7A RPCI-11 Male BAC Library) | gb\|AQ569402.1 | |
| 30 | seoa6514a | Novel | | |
| 31 | mioa1998 | DNA sequence (Chromosome X) | gb\|AC002416 | |
| 32 | mioa3657a | unnamed protein product | dbj\|AK001832 | |
| 33 | SEOA0759 | DNA sequence (BAC clone NH0494A09 from 7p21-p15 1) | gb\|AC006381 | |
| 34 | seoa3949a | transmembrane protein with EGF-like and two follistatin-like domains 1 (TMEFF1) | gb\|U19878 | |
| 35 | mioa2635 | Sec62 (Sec62) | gb\|U93239 | |
| 36 | mioa3163a | stearoyl-CoA desaturase (SCD) | gb\|AF097514.1 | |
| 37 | mioa2292a | caldesmon | gb\|M64110 | |
| 38 | mioa1777n | EST (ng20f01.s1 NCI_CGAP_Ov2 clone IMAGE:929977) | gb\|AA503150 | |
| 39 | seoa3993a | uncharacterized protein | dbj\|AK001049 | |
| 40 | mioa1582 | EST(qb82d07.x1 Soares_fetal_heart_NbHH19W clone IMAGE.1706605 3') | gb\|AI131563 | |
| 41 | mioa4114 | unnamed protein product (ORF) | AK001925\| | |
| 42 | mioa1737 | EST(zw18b09.s1 Soares ovary tumor NbHOT clone 769625 3' contains L1 t1 MER12 repeat) | gb\|AA428305 | |
| 43 | mioa2608a | EST(as39c11 x1 Barstead aorta HPLRB6 clone IMAGE 2319572 3') | gb\|AI708884 1 | |
| 44 | SEOA1526 | EST (EST100124 Pancreas tumor I 5') | gb\|AA294981 | |
| 45 | seoa2826 | Novel | | |
| 46 | SEOA0427 | EST (zo25g08 s1 Stratagene colon (#937204) clone 587982 3') | gb\|AA135431 | |
| 47 | mioa1479m | unnamed protein product (ORF) | AK001241\| | |
| 48 | SEOA0913 | antigen (p24/CD9) | gb\|L34068 | |
| 49 | seoa3794a | Novel | | |
| 50 | mioa1719a | Novel | | |
| 51 | seoa3563a | CD59 protein | emb\|Z14115 | |

Median ratio is equal to or less than 0.2

Figure 13 - List of Novel Sequence Names

| | | | | | | | | | |
|---|---|---|---|---|---|---|---|---|---|
| [illegible] | bfcn0190n | [illegible] | fcr6825 | [illegible] | hfcr1523 | [illegible] | hfcr7359 | [illegible] | MIOA0954 |
| [illegible] | BFCN0252 | [illegible] | FCR6908 | [illegible] | hfcr1541 | [illegible] | hfcr7407 | [illegible] | mioa1072 |
| [illegible] | bfcs0049 | [illegible] | fcr7232 | [illegible] | hfcr1549 | [illegible] | hfcr7575 | [illegible] | MIOA1078 |
| [illegible] | bfcs0311 | [illegible] | fcr7238 | [illegible] | hfcr1552 | [illegible] | hfcr7628 | [illegible] | MIOA1081 |
| [illegible] | BFCW0074 | [illegible] | FCR7315 | [illegible] | hfcr1554 | [illegible] | hfcr7710 | [illegible] | MIOA1084 |
| [illegible] | bfcw0312n | [illegible] | fcr7325 | [illegible] | hfcr1555 | [illegible] | hfcr7795 | [illegible] | MIOA1094 |
| [illegible] | contigmar22-010017 | [illegible] | FCR7368 | [illegible] | hfcr1581 | [illegible] | hfcr7984 | [illegible] | MIOA1136 |
| [illegible] | cr0304 | [illegible] | FCR7370 | [illegible] | hfcr1596 | [illegible] | hfcr8005 | [illegible] | mioa1212 |
| [illegible] | cr0506 | [illegible] | fcr7387 | [illegible] | hfcr1603 | [illegible] | hfcr8046 | [illegible] | MIOA1259 |
| [illegible] | cr0517 | [illegible] | FCR7388 | [illegible] | hfcr1611 | [illegible] | hfcr8190 | [illegible] | MIOA1267 |
| [illegible] | FCR0196 | [illegible] | FCR7446 | [illegible] | hfcr1612 | [illegible] | hfcr8237 | [illegible] | mioa1339a |
| [illegible] | fcr0356n | [illegible] | FCR7549 | [illegible] | hfcr1613 | [illegible] | hfcr8378 | [illegible] | mioa1434 |
| [illegible] | fcr0434 | [illegible] | FCR7637 | [illegible] | hfcr1620 | [illegible] | hfcr8634 | [illegible] | MIOA1459 |
| [illegible] | FCR0680 | [illegible] | fcr7731 | [illegible] | hfcr1621 | [illegible] | hfcr8691 | [illegible] | mioa1463 |
| [illegible] | FCR0708 | [illegible] | fcrb0045 | [illegible] | hfcr1626 | [illegible] | hfcr8699 | [illegible] | MIOA1765 |
| [illegible] | FCR1090 | [illegible] | fcrb0205 | [illegible] | hfcr1627 | [illegible] | hfcr8702 | [illegible] | MIOA2033 |
| [illegible] | fcr1220nn | [illegible] | fcrb0280 | [illegible] | hfcr1628 | [illegible] | hfcr8709 | [illegible] | MIOA2114 |
| [illegible] | fcr1418 | [illegible] | fcrb0350 | [illegible] | hfcr1630 | [illegible] | hfcr8713 | [illegible] | mioa2476a |
| [illegible] | fcr1440 | [illegible] | fcrb0363 | [illegible] | hfcr1631 | [illegible] | hfcr8716 | [illegible] | mioa3098a |
| [illegible] | fcr1597 | [illegible] | fcrb0613 | [illegible] | hfcr1640 | [illegible] | hfcr8723 | [illegible] | mioa3701a |
| [illegible] | fcr1821nn | [illegible] | fcrb0620 | [illegible] | hfcr1672 | [illegible] | hfcr8728 | [illegible] | mioa3881a |
| [illegible] | fcr1965 | [illegible] | fcrb0938 | [illegible] | hfcr1690 | [illegible] | hfcr8730 | [illegible] | mioa3895a |
| [illegible] | fcr1969nn | [illegible] | fcrb0958 | [illegible] | hfcr1821 | [illegible] | hfcr8817 | [illegible] | mioa3896a |
| [illegible] | fcr1978nn | [illegible] | fcrb1175 | [illegible] | hfcr1978 | [illegible] | hfcr8843 | [illegible] | mioa4045a |
| [illegible] | FCR2268 | [illegible] | fcrb1379 | [illegible] | hfcr2243 | [illegible] | hfcr8897 | [illegible] | MIOA4275 |
| [illegible] | FCR2609 | [illegible] | fcrb1516 | [illegible] | hfcr2521 | [illegible] | hfcr8977 | [illegible] | MIOA4330a |
| [illegible] | fcr2618 | [illegible] | fcrb1870 | [illegible] | hfcr2627 | [illegible] | hfcr9013 | [illegible] | MIOA4391 |
| [illegible] | fcr2622n | [illegible] | fcrb2358 | [illegible] | hfcr2654 | [illegible] | hfcr9115 | [illegible] | MIOA4616a |
| [illegible] | FCR2951 | [illegible] | fcrb2388 | [illegible] | hfcr3001 | [illegible] | hfcr9165 | [illegible] | mioa4706 |
| [illegible] | fcr2979n | [illegible] | fcrb2603 | [illegible] | hfcr3006 | [illegible] | hfcr9229 | [illegible] | MIOA4880a |
| [illegible] | FCR3004N | [illegible] | hfcr0080 | [illegible] | hfcr3008 | [illegible] | hfcr9268 | [illegible] | MIOA5324a |
| [illegible] | fcr3534n | [illegible] | hfcr0081 | [illegible] | hfcr3069 | [illegible] | hfcr9298 | [illegible] | MIOA5496a |
| [illegible] | FCR3639 | [illegible] | hfcr0133 | [illegible] | hfcr3377 | [illegible] | hfcr9411 | [illegible] | mioa5619a |
| [illegible] | fcr3756 | [illegible] | hfcr0203 | [illegible] | hfcr3382 | [illegible] | hfcr9424 | [illegible] | MIOA5655 |
| [illegible] | fcr3792 | [illegible] | hfcr0275 | [illegible] | hfcr3550 | [illegible] | hfcr9466 | [illegible] | mioa5829a |
| [illegible] | FCR4720 | [illegible] | hfcr0463 | [illegible] | hfcr3672 | [illegible] | hfcr9470 | [illegible] | mioa5861an |
| [illegible] | FCR4735 | [illegible] | hfcr0604 | [illegible] | hfcr3990 | [illegible] | hfcr9701 | [illegible] | MIOA5905a |
| [illegible] | fcr4844n | [illegible] | hfcr0721 | [illegible] | hfcr4281 | [illegible] | hfcr9815 | [illegible] | mioa5984a |
| [illegible] | FCR4868 | [illegible] | hfcr0791 | [illegible] | hfcr4342 | [illegible] | hfcr9893 | [illegible] | MIOA6003a |
| [illegible] | FCR4951 | [illegible] | hfcr1014 | [illegible] | hfcr4730 | [illegible] | hfcr9895 | [illegible] | mioa6111a |
| [illegible] | FCR4980 | [illegible] | hfcr1019 | [illegible] | hfcr4732 | [illegible] | hfcr9916 | [illegible] | mioa6117a |
| [illegible] | FCR4996 | [illegible] | hfcr1028 | [illegible] | hfcr4782 | [illegible] | hfcr9974 | [illegible] | MIOA6409a |
| [illegible] | fcr5017 | [illegible] | hfcr1035 | [illegible] | hfcr4848 | [illegible] | hfcr9980 | [illegible] | MIOA6628a |
| [illegible] | fcr5071 | [illegible] | hfcr1041 | [illegible] | hfcr6138 | [illegible] | hfcr9981 | [illegible] | mioa6634a |
| [illegible] | fcr5120n | [illegible] | hfcr1429 | [illegible] | hfcr6319 | [illegible] | mioa0492m | [illegible] | MIOA6666a |
| [illegible] | FCR5221 | [illegible] | hfcr1438 | [illegible] | hfcr6383 | [illegible] | mioa0524 | [illegible] | MIOA6670a |
| [illegible] | fcr5414 | [illegible] | hfcr1446 | [illegible] | hfcr6423 | [illegible] | MIOA0602a | [illegible] | MIOA6865a |
| [illegible] | fcr5591 | [illegible] | hfcr1450 | [illegible] | hfcr6593 | [illegible] | MIOA0718 | [illegible] | MIOA6955a |
| [illegible] | fcr5612 | [illegible] | hfcr1461 | [illegible] | hfcr6757 | [illegible] | MIOA0772 | [illegible] | mioa7198a |
| [illegible] | fcr5621 | [illegible] | hfcr1462 | [illegible] | hfcr6897 | [illegible] | mioa0780n | [illegible] | mioa7458a |
| [illegible] | fcr6010 | [illegible] | hfcr1465 | [illegible] | hfcr7156 | [illegible] | MIOA0782n | [illegible] | mioa7571a |
| [illegible] | fcr6014 | [illegible] | hfcr1466 | [illegible] | hfcr7189 | [illegible] | mioa0798 | [illegible] | mioa7933 |
| [illegible] | fcr6015 | [illegible] | hfcr1472 | [illegible] | hfcr7215 | [illegible] | mioa0806 | [illegible] | MIOA8210 |
| [illegible] | fcr6351n | [illegible] | hfcr1480 | [illegible] | hfcr7266 | [illegible] | mioa0932 | [illegible] | MIOA8258 |
| [illegible] | fcr6488 | [illegible] | hfcr1505 | [illegible] | hfcr7336 | [illegible] | MIOA0948 | [illegible] | MIOA8297 |

Figure 13:
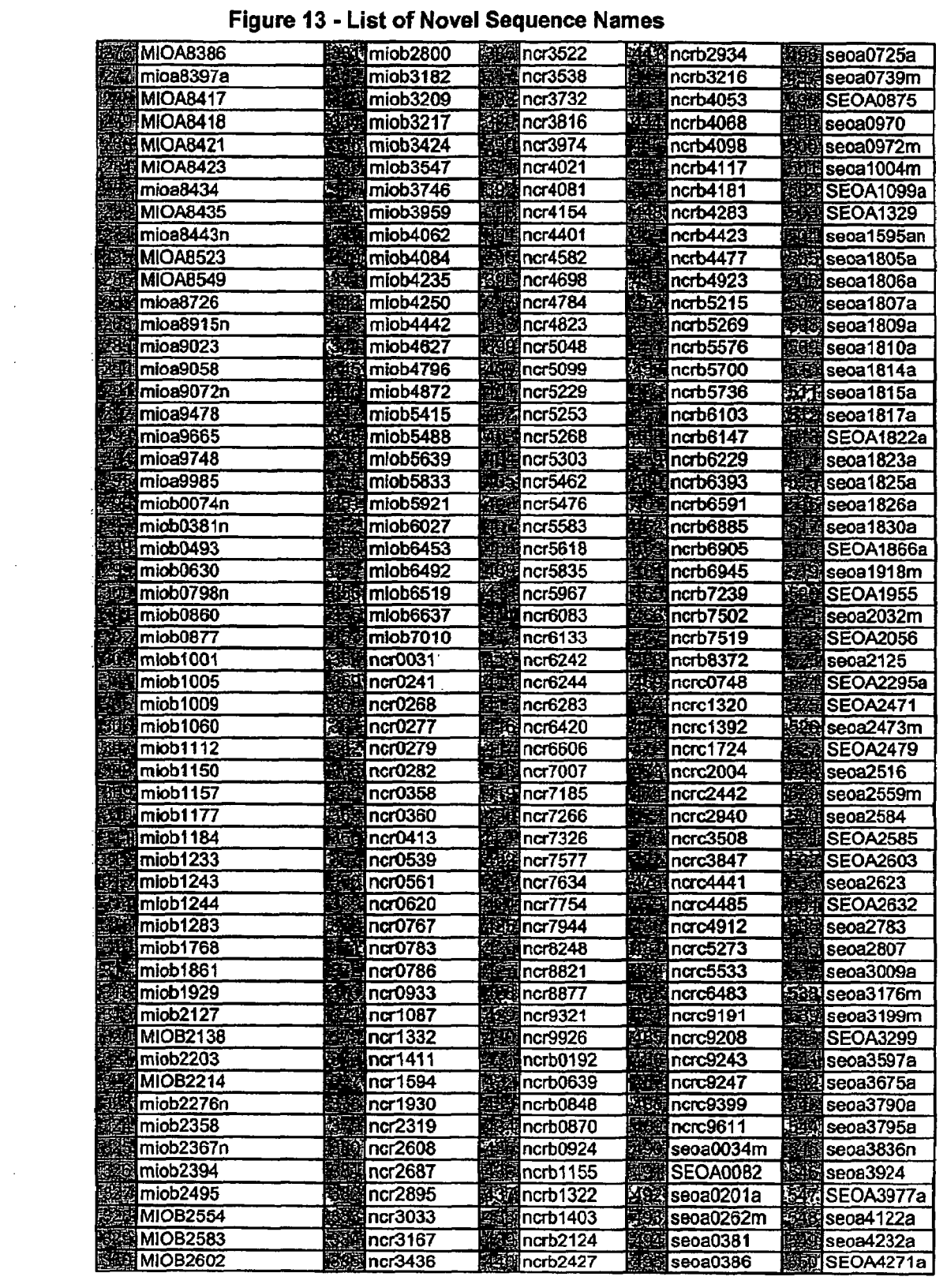

Figure 13 - List of Novel Sequence Names

| | | | | | | | | | |
|---|---|---|---|---|---|---|---|---|---|
| [illegible] | MIOA8386 | [illegible] | miob2800 | [illegible] | ncr3522 | [illegible] | ncrb2934 | [illegible] | seoa0725a |
| [illegible] | mioa8397a | [illegible] | miob3182 | [illegible] | ncr3538 | [illegible] | ncrb3216 | [illegible] | seoa0739m |
| [illegible] | MIOA8417 | [illegible] | miob3209 | [illegible] | ncr3732 | [illegible] | ncrb4053 | [illegible] | SEOA0875 |
| [illegible] | MIOA8418 | [illegible] | miob3217 | [illegible] | ncr3816 | [illegible] | ncrb4068 | [illegible] | seoa0970 |
| [illegible] | MIOA8421 | [illegible] | miob3424 | [illegible] | ncr3974 | [illegible] | ncrb4098 | [illegible] | seoa0972m |
| [illegible] | MIOA8423 | [illegible] | miob3547 | [illegible] | ncr4021 | [illegible] | ncrb4117 | [illegible] | seoa1004m |
| [illegible] | mioa8434 | [illegible] | miob3746 | [illegible] | ncr4081 | [illegible] | ncrb4181 | [illegible] | SEOA1099a |
| [illegible] | MIOA8435 | [illegible] | miob3959 | [illegible] | ncr4154 | [illegible] | ncrb4283 | [illegible] | SEOA1329 |
| [illegible] | mioa8443n | [illegible] | miob4062 | [illegible] | ncr4401 | [illegible] | ncrb4423 | [illegible] | seoa1595an |
| [illegible] | MIOA8523 | [illegible] | miob4084 | [illegible] | ncr4582 | [illegible] | ncrb4477 | [illegible] | seoa1805a |
| [illegible] | MIOA8549 | [illegible] | miob4235 | [illegible] | ncr4698 | [illegible] | ncrb4923 | [illegible] | seoa1806a |
| [illegible] | mioa8726 | [illegible] | miob4250 | [illegible] | ncr4784 | [illegible] | ncrb5215 | [illegible] | seoa1807a |
| [illegible] | mioa8915n | [illegible] | miob4442 | [illegible] | ncr4823 | [illegible] | ncrb5269 | [illegible] | seoa1809a |
| [illegible] | mioa9023 | [illegible] | miob4627 | [illegible] | ncr5048 | [illegible] | ncrb5576 | [illegible] | seoa1810a |
| [illegible] | mioa9058 | [illegible] | miob4796 | [illegible] | ncr5099 | [illegible] | ncrb5700 | [illegible] | seoa1814a |
| [illegible] | mioa9072n | [illegible] | miob4872 | [illegible] | ncr5229 | [illegible] | ncrb5736 | 511 | seoa1815a |
| [illegible] | mioa9478 | [illegible] | miob5415 | [illegible] | ncr5253 | [illegible] | ncrb6103 | [illegible] | seoa1817a |
| [illegible] | mioa9665 | [illegible] | miob5488 | [illegible] | ncr5268 | [illegible] | ncrb6147 | [illegible] | SEOA1822a |
| [illegible] | mioa9748 | [illegible] | miob5639 | [illegible] | ncr5303 | [illegible] | ncrb6229 | [illegible] | seoa1823a |
| [illegible] | mioa9985 | [illegible] | miob5833 | [illegible] | ncr5462 | [illegible] | ncrb6393 | [illegible] | seoa1825a |
| [illegible] | miob0074n | [illegible] | miob5921 | [illegible] | ncr5476 | [illegible] | ncrb6591 | [illegible] | seoa1826a |
| [illegible] | miob0381n | [illegible] | miob6027 | [illegible] | ncr5583 | [illegible] | ncrb6885 | [illegible] | seoa1830a |
| [illegible] | miob0493 | [illegible] | miob6453 | [illegible] | ncr5618 | [illegible] | ncrb6905 | [illegible] | SEOA1866a |
| [illegible] | miob0630 | [illegible] | miob6492 | [illegible] | ncr5835 | [illegible] | ncrb6945 | [illegible] | seoa1918m |
| [illegible] | miob0798n | [illegible] | miob6519 | [illegible] | ncr5967 | [illegible] | ncrb7239 | 520 | SEOA1955 |
| [illegible] | miob0860 | [illegible] | miob6637 | [illegible] | ncr6083 | [illegible] | ncrb7502 | [illegible] | seoa2032m |
| [illegible] | miob0877 | [illegible] | miob7010 | [illegible] | ncr6133 | [illegible] | ncrb7519 | [illegible] | SEOA2056 |
| [illegible] | miob1001 | [illegible] | ncr0031 | [illegible] | ncr6242 | [illegible] | ncrb8372 | [illegible] | seoa2125 |
| [illegible] | miob1005 | [illegible] | ncr0241 | [illegible] | ncr6244 | [illegible] | ncrc0748 | [illegible] | SEOA2295a |
| [illegible] | miob1009 | [illegible] | ncr0268 | [illegible] | ncr6283 | [illegible] | ncrc1320 | [illegible] | SEOA2471 |
| [illegible] | miob1060 | [illegible] | ncr0277 | [illegible] | ncr6420 | [illegible] | ncrc1392 | 526 | seoa2473m |
| [illegible] | miob1112 | [illegible] | ncr0279 | [illegible] | ncr6606 | [illegible] | ncrc1724 | [illegible] | SEOA2479 |
| [illegible] | miob1150 | [illegible] | ncr0282 | [illegible] | ncr7007 | [illegible] | ncrc2004 | [illegible] | seoa2516 |
| [illegible] | miob1157 | [illegible] | ncr0358 | [illegible] | ncr7185 | [illegible] | ncrc2442 | [illegible] | seoa2559m |
| [illegible] | miob1177 | [illegible] | ncr0360 | [illegible] | ncr7266 | [illegible] | ncrc2940 | [illegible] | seoa2584 |
| [illegible] | miob1184 | [illegible] | ncr0413 | [illegible] | ncr7326 | [illegible] | ncrc3508 | [illegible] | SEOA2585 |
| [illegible] | miob1233 | [illegible] | ncr0539 | [illegible] | ncr7577 | [illegible] | ncrc3847 | [illegible] | SEOA2603 |
| [illegible] | miob1243 | [illegible] | ncr0561 | [illegible] | ncr7634 | [illegible] | ncrc4441 | [illegible] | seoa2623 |
| [illegible] | miob1244 | [illegible] | ncr0620 | [illegible] | ncr7754 | [illegible] | ncrc4485 | [illegible] | SEOA2632 |
| [illegible] | miob1283 | [illegible] | ncr0767 | [illegible] | ncr7944 | [illegible] | ncrc4912 | [illegible] | seoa2783 |
| [illegible] | miob1768 | [illegible] | ncr0783 | [illegible] | ncr8248 | [illegible] | ncrc5273 | [illegible] | seoa2807 |
| [illegible] | miob1861 | [illegible] | ncr0786 | [illegible] | ncr8821 | [illegible] | ncrc5533 | [illegible] | seoa3009a |
| [illegible] | miob1929 | [illegible] | ncr0933 | [illegible] | ncr8877 | [illegible] | ncrc6483 | 538 | seoa3176m |
| [illegible] | miob2127 | [illegible] | ncr1087 | [illegible] | ncr9321 | [illegible] | ncrc9191 | [illegible] | seoa3199m |
| [illegible] | MIOB2138 | [illegible] | ncr1332 | [illegible] | ncr9926 | [illegible] | ncrc9208 | [illegible] | SEOA3299 |
| [illegible] | miob2203 | [illegible] | ncr1411 | [illegible] | ncrb0192 | [illegible] | ncrc9243 | [illegible] | seoa3597a |
| [illegible] | MIOB2214 | [illegible] | ncr1594 | [illegible] | ncrb0639 | [illegible] | ncrc9247 | [illegible] | seoa3675a |
| [illegible] | miob2276n | [illegible] | ncr1930 | [illegible] | ncrb0848 | [illegible] | ncrc9399 | [illegible] | seoa3790a |
| [illegible] | miob2358 | [illegible] | ncr2319 | [illegible] | ncrb0870 | [illegible] | ncrc9611 | [illegible] | seoa3795a |
| [illegible] | miob2367n | [illegible] | ncr2608 | [illegible] | ncrb0924 | [illegible] | seoa0034m | [illegible] | seoa3836n |
| [illegible] | miob2394 | [illegible] | ncr2687 | [illegible] | ncrb1155 | [illegible] | SEOA0082 | [illegible] | seoa3924 |
| [illegible] | miob2495 | [illegible] | ncr2895 | [illegible] | ncrb1322 | 492 | seoa0201a | 547 | SEOA3977a |
| [illegible] | MIOB2554 | [illegible] | ncr3033 | [illegible] | ncrb1403 | [illegible] | seoa0262m | [illegible] | seoa4122a |
| [illegible] | MIOB2583 | [illegible] | ncr3167 | [illegible] | ncrb2124 | [illegible] | seoa0381 | [illegible] | seoa4232a |
| [illegible] | MIOB2602 | [illegible] | ncr3436 | [illegible] | ncrb2427 | [illegible] | seoa0386 | 550 | SEOA4271a |

Figure 13:
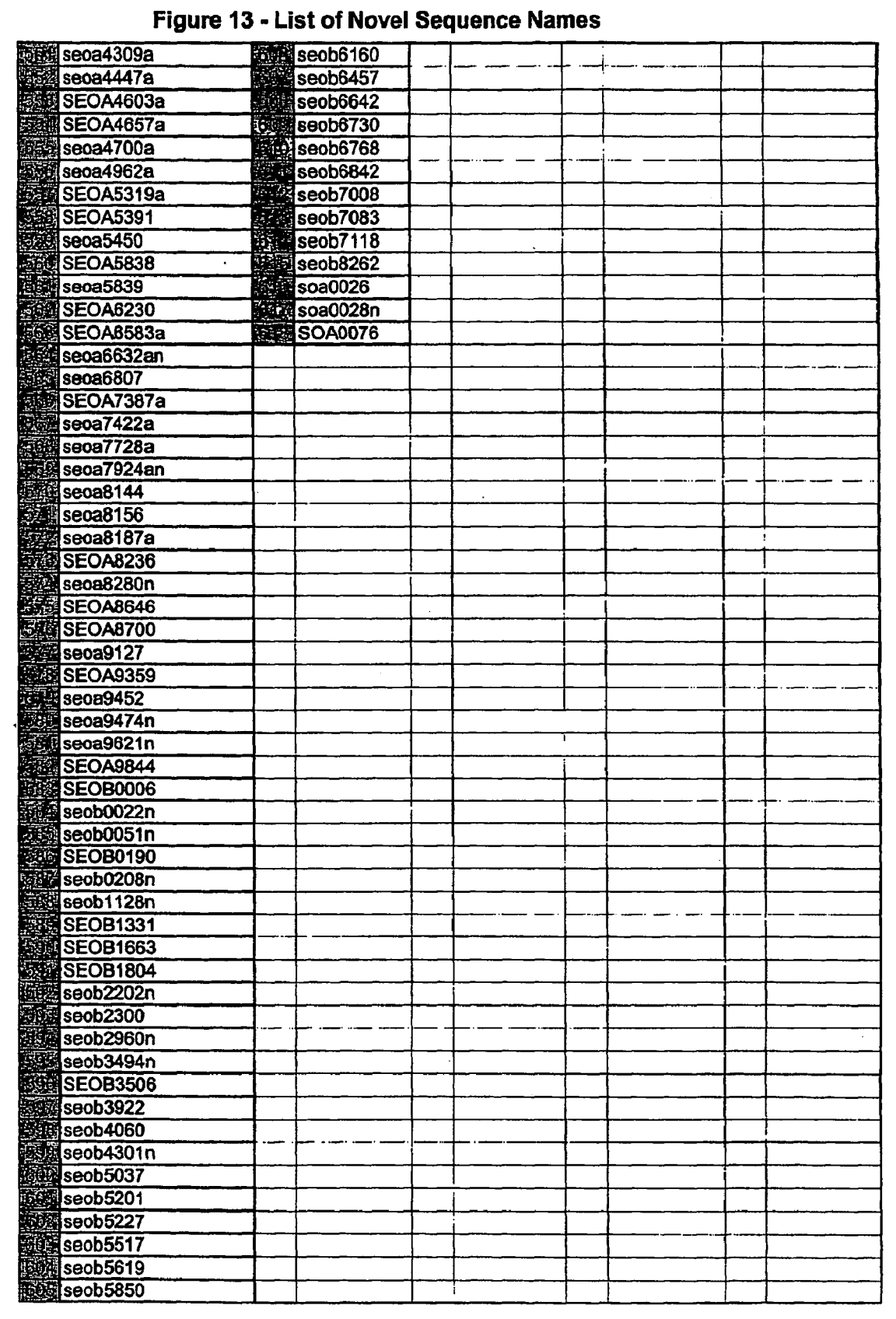

Figure 13 - List of Novel Sequence Names

| | | | | | | | | | |
|---|---|---|---|---|---|---|---|---|---|
| [illegible] | seoa4309a | [illegible] | seob6160 | | | | | | |
| 552 | seoa4447a | [illegible] | seob6457 | | | | | | |
| 553 | SEOA4603a | [illegible] | seob6642 | | | | | | |
| [illegible] | SEOA4657a | 609 | seob6730 | | | | | | |
| 555 | seoa4700a | 610 | seob6768 | | | | | | |
| 556 | seoa4962a | [illegible] | seob6842 | | | | | | |
| [illegible] | SEOA5319a | 612 | seob7008 | | | | | | |
| 558 | SEOA5391 | [illegible] | seob7083 | | | | | | |
| 559 | seoa5450 | [illegible] | seob7118 | | | | | | |
| 560 | SEOA5838 | 615 | seob8262 | | | | | | |
| 561 | seoa5839 | [illegible] | soa0026 | | | | | | |
| 562 | SEOA6230 | [illegible] | soa0028n | | | | | | |
| 563 | SEOA6583a | [illegible] | SOA0076 | | | | | | |
| [illegible] | seoa6632an | | | | | | | | |
| [illegible] | seoa6807 | | | | | | | | |
| [illegible] | SEOA7387a | | | | | | | | |
| [illegible] | seoa7422a | | | | | | | | |
| [illegible] | seoa7728a | | | | | | | | |
| [illegible] | seoa7924an | | | | | | | | |
| 570 | seoa8144 | | | | | | | | |
| 571 | seoa8156 | | | | | | | | |
| [illegible] | seoa8187a | | | | | | | | |
| 573 | SEOA8236 | | | | | | | | |
| [illegible] | seoa8280n | | | | | | | | |
| 575 | SEOA8646 | | | | | | | | |
| 576 | SEOA8700 | | | | | | | | |
| [illegible] | seoa9127 | | | | | | | | |
| [illegible] | SEOA9359 | | | | | | | | |
| [illegible] | seoa9452 | | | | | | | | |
| 580 | seoa9474n | | | | | | | | |
| [illegible] | seoa9621n | | | | | | | | |
| [illegible] | SEOA9844 | | | | | | | | |
| [illegible] | SEOB0006 | | | | | | | | |
| [illegible] | seob0022n | | | | | | | | |
| [illegible] | seob0051n | | | | | | | | |
| 586 | SEOB0190 | | | | | | | | |
| 587 | seob0208n | | | | | | | | |
| [illegible] | seob1128n | | | | | | | | |
| [illegible] | SEOB1331 | | | | | | | | |
| [illegible] | SEOB1663 | | | | | | | | |
| [illegible] | SEOB1804 | | | | | | | | |
| 592 | seob2202n | | | | | | | | |
| [illegible] | seob2300 | | | | | | | | |
| [illegible] | seob2960n | | | | | | | | |
| [illegible] | seob3494n | | | | | | | | |
| 596 | SEOB3506 | | | | | | | | |
| [illegible] | seob3922 | | | | | | | | |
| [illegible] | seob4060 | | | | | | | | |
| [illegible] | seob4301n | | | | | | | | |
| 600 | seob5037 | | | | | | | | |
| [illegible] | seob5201 | | | | | | | | |
| 602 | seob5227 | | | | | | | | |
| [illegible] | seob5517 | | | | | | | | |
| 604 | seob5619 | | | | | | | | |
| 605 | seob5850 | | | | | | | | |

Figure 14 - Relative EST Frequency of Unique Known Genes Common to Fetal and Normal cDNA Libraries - Page 1 of 17

| | Total ESTs from each library | | 13398 | | 17151 | |
|---|---|---|---|---|---|---|
| | Gene Name | Accession # | Fetal | | Normal | |
| 1 | alpha gene sequence (=HSP90) | AF203815.1 | 11 | 0.08% | 561 | 3.27% |
| 2 | ribosomal DNA complete repeating unit | U13369.1 | 11 | 0.08% | 303 | 1.77% |
| 3 | mitochondrial genome (consensus sequence) | X62996 | 112 | 0.84% | 181 | 1.06% |
| 4 | decorin (DCN) | NM_001920.1 | 14 | 0.10% | 172 | 1.00% |
| 5 | collagen type II alpha 1 (COL2A1) | J00116.1 | 172 | 1.28% | 169 | 0.99% |
| 6 | osteonectin gene (SPARC) secreted protein, acidic,cysteine-rich | M25746.1 | 42 | 0.31% | 149 | 0.87% |
| 7 | mitochondrion, complete genome (=AF382012.1 haplotype M*1 mitochond | NC_001807.2 | 96 | 0.72% | 141 | 0.82% |
| 8 | matrix Gla protein (MGP) | X53331 | 6 | 0.04% | 140 | 0.82% |
| 9 | proteoglycan 4 (=megakaryocyte stimulating factor) | AAB09089.1 | 10 | 0.07% | 138 | 0.80% |
| 10 | ribosomal protein S27 (=(metallopanstimulin 1 MPS1) | NM_001030.1 | 36 | 0.27% | 105 | 0.61% |
| 11 | putative p150 | AAC51271.1 | 4 | 0.03% | 99 | 0.58% |
| 12 | collagen type I alpha 2 (COL1A2) | NM_000089.1 | 153 | 1.14% | 88 | 0.51% |
| 13 | beta-2 microglobulin gene (B2M) | gb\|AF072097.1 | 6 | 0.04% | 88 | 0.51% |
| 14 | metallothionein 1L (MT1L) | NM_002450.1 | 2 | 0.01% | 85 | 0.50% |
| 15 | connective tissue growth factor (CTGF) | U14750 | 6 | 0.04% | 78 | 0.45% |
| 16 | collagen type III alpha 1 (COL3A1) | X06700\| | 54 | 0.40% | 77 | 0.45% |
| 17 | elongation factor 1 alpha 1 (EEF1A1) | NM_001402.1 | 150 | 1.12% | 66 | 0.38% |
| 18 | scrapie responsive protein 1 (SCRG1) | NM_007281.1 | 3 | 0.02% | 59 | 0.34% |
| 19 | tumor protein translationally-controlled 1 (TPT1) | NM_003295.1 | 45 | 0.34% | 50 | 0.29% |
| 20 | fibronectin (FN) | X02761.1 | 16 | 0.12% | 50 | 0.29% |
| 21 | ribosomal protein L41 | AF026844.1 | 22 | 0.16% | 47 | 0.27% |
| 22 | ribosomal RNA 18S | X03205 | 12 | 0.09% | 47 | 0.27% |
| 23 | LINE-1 REVERSE TRANSCRIPTASE HOMOLOG (=putative p150) | spP08547 | 1 | 0.01% | 46 | 0.27% |
| 24 | reverse transCRiptase | D84391 | 1 | 0.01% | 45 | 0.26% |
| 25 | ribosomal protein L7 | X52967 | 45 | 0.34% | 44 | 0.26% |
| 26 | fibromodulin (FMOD) | NM_002023.2 | 8 | 0.06% | 41 | 0.24% |
| 27 | thymosin beta-4 (TMSB4X) | M17733 | 14 | 0.10% | 40 | 0.23% |
| 28 | ribosomal protein S8 (RPS8) | NM_001012.1 | 42 | 0.31% | 35 | 0.20% |
| 29 | ribosomal protein S6 | M20020 | 27 | 0.20% | 35 | 0.20% |
| 30 | ribosomal protein L21 | U14967.1 | 17 | 0.13% | 34 | 0.20% |
| 31 | lumican (LUM) | NM_002345.1 | 9 | 0.07% | 33 | 0.19% |
| 32 | ubiquitin A-52 residue ribosomal protein fusion product 1 (UBA52) | gi4507760 | 7 | 0.05% | 32 | 0.19% |
| 33 | vimentin gene (VIM) | Z19554 | 33 | 0.25% | 31 | 0.18% |
| 34 | ribosomal protein S3a | M77234 | 22 | 0.16% | 31 | 0.18% |
| 35 | ribosomal protein L31 | NM_000993.1 | 15 | 0.11% | 31 | 0.18% |
| 36 | ribosomal protein L9 | U09953 | 47 | 0.35% | 30 | 0.17% |
| 37 | annexin A2 (ANXA2)(lipocortin II) | NM_004039.1 | 14 | 0.10% | 28 | 0.16% |
| 38 | ribonuclease, RNase A family, 1(pancreatic) (RefSeq aa 9e-73) | NP_002924.1 | 1 | 0.01% | 28 | 0.16% |
| 39 | ribosomal protein L34 (RPL34) | NM_000995.1 | 23 | 0.17% | 27 | 0.16% |
| 40 | Ribosomal protein L4 | NM_000968.1 | 18 | 0.13% | 27 | 0.16% |
| 41 | ribosomal protein L23 | NM_000978.1 | 18 | 0.13% | 27 | 0.16% |
| 42 | ribonuclease, RNase A | NM_002937.1 | 1 | 0.01% | 27 | 0.16% |
| 43 | actin, beta (ACTB) | NM_001101.2 | 21 | 0.16% | 25 | 0.15% |
| 44 | PRO2003 | AF116679.1 | 14 | 0.10% | 24 | 0.14% |
| 45 | ribosomal protein, large, P0 (RPLP0) | NM_001002.1 | 56 | 0.42% | 23 | 0.13% |
| 46 | calmodulin 1 (phosphorylase kinase, delta) (CALM1) | NM_006888.1 | 7 | 0.05% | 23 | 0.13% |
| 47 | collagen type I alpha 1 (COL1A1) | X06269 | 90 | 0.67% | 22 | 0.13% |
| 48 | guanine nucleotide binding protein (G protein), beta polypeptide 2-like 1 (G | NM_006098.1 | 21 | 0.16% | 20 | 0.12% |
| 49 | SUI1 isolog | AF083441.1 | 8 | 0.06% | 20 | 0.12% |

Figure 14 - Relative EST Frequency of Unique Known Genes Common to Fetal and Normal cDNA Libraries - Page 2 of 17

| | | | | | | |
|---|---|---|---|---|---|---|
| 50 | NADH dehydrogenase | X81900 | 2 | 0.01% | 20 | 0.12% |
| 51 | transcription elongation factor B (SIII), polypeptide 1-like (TCEB1L) | NM_003197.2 | 1 | 0.01% | 20 | 0.12% |
| 52 | ribosomal protein S11 (RPS11) | NM_001015.1 | 38 | 0.28% | 19 | 0.11% |
| 53 | ribosomal protein L37 | L11567 | 34 | 0.25% | 19 | 0.11% |
| 54 | H factor 1 (complement) (HF1) | NM_000186.1 | 1 | 0.01% | 19 | 0.11% |
| 55 | collagen type XI alpha 1 (COL11A1) | NM_001854.1 | 46 | 0.34% | 18 | 0.10% |
| 56 | ribosomal protein S4, X-linked (RPS4X) | NM_001007.1 | 33 | 0.25% | 18 | 0.10% |
| 57 | S100 calcium-binding protein A4 (calcium protein, calvasculin, metastasin, | gi4506764 | 1 | 0.01% | 18 | 0.10% |
| 58 | ribosomal protein L13a (RPL13A) | NM_012423.1 | 64 | 0.48% | 17 | 0.10% |
| 59 | Ribosomal protein S20 (RPS20) | NM_001023.1 | 42 | 0.31% | 17 | 0.10% |
| 60 | ribosomal protein L6 | X69391 | 24 | 0.18% | 17 | 0.10% |
| 61 | brain-expressed HHCPA78 homologue (VDUP1) | S73591 | 2 | 0.01% | 17 | 0.10% |
| 62 | ribosomal protein L32 (RPL32) | NM_000994.1 | 38 | 0.28% | 16 | 0.09% |
| 63 | ribosomal protein S29 | L31610.1 | 18 | 0.13% | 16 | 0.09% |
| 64 | transmembrane protein BRI | AF246221.1 | 4 | 0.03% | 16 | 0.09% |
| 65 | cytochrome c oxidase subunit VIc (COX6C) | NM_004374.1 | 3 | 0.02% | 16 | 0.09% |
| 66 | ribosomal protein L7a (surf 3) large subunit | M36072 | 25 | 0.19% | 15 | 0.09% |
| 67 | signal recognition particle 14kD (homologous Alu RNA-binding protein)(SR | NM_003134.1 | 3 | 0.02% | 15 | 0.09% |
| 68 | ribosomal protein L30 | L05095.1 | 24 | 0.18% | 14 | 0.08% |
| 69 | translationally controlled tumor protein (TCTP) | X16064 | 23 | 0.17% | 14 | 0.08% |
| 70 | TSC-22 protein | U35048 | 8 | 0.06% | 14 | 0.08% |
| 71 | ribosomal protein L22 (RPL22) | NM_000983.1 | 6 | 0.04% | 14 | 0.08% |
| 72 | nucleolar phosphoprotein B23 (NPM1) | M28699 | 4 | 0.03% | 14 | 0.08% |
| 73 | clusterin (CLU) SP40,40 (=M63379 TRPM-2 protein) | NM_001831.1 | 1 | 0.01% | 14 | 0.08% |
| 74 | RIBOSOMAL PROTEIN L10 (QM PROTEIN) (TUMOR SUPRESSOR QM) | spP27635 | 53 | 0.40% | 13 | 0.08% |
| 75 | ribosomal protein S12 | X53505 | 35 | 0.26% | 13 | 0.08% |
| 76 | ribosomal protein S25 (RPS25) | NM_001028.1 | 17 | 0.13% | 13 | 0.08% |
| 77 | ribosomal protein S23 (RPS23) =D14530 (ORF) | NM_001025.1 | 8 | 0.06% | 13 | 0.08% |
| 78 | thioredoxin (TXN) | J04026 | 4 | 0.03% | 13 | 0.08% |
| 79 | SRY (sex-determining region Y)-box 9 (campomelic dysplasia, autosomal s | NM_000346.1 | 4 | 0.03% | 13 | 0.08% |
| 80 | heat shock 10kD protein 1 (chaperonin 10) (HSPE1) | NM_002157.1 | 1 | 0.01% | 13 | 0.08% |
| 81 | ribosomal protein L37a | L22154 | 56 | 0.42% | 12 | 0.07% |
| 82 | RIBOSOMAL PROTEIN L17 | spP18621 | 31 | 0.23% | 12 | 0.07% |
| 83 | ribosomal protein S17 | M13932 | 28 | 0.21% | 12 | 0.07% |
| 84 | ribosomal protein L27 (RPL27) | NM_000988.1 | 27 | 0.20% | 12 | 0.07% |
| 85 | hH3.3B gene for histone H3.3 | Z48950.1 | 10 | 0.07% | 12 | 0.07% |
| 86 | ferritin L chain | M11147 | 9 | 0.07% | 12 | 0.07% |
| 87 | ribosomal protein L24 (RPL24) (=ribosomal protein L30) | NM_000986.1 | 8 | 0.06% | 12 | 0.07% |
| 88 | lysosomal membrane glycoprotein CD63 (=M59907 ME491;X07982) | M58485 | 7 | 0.05% | 12 | 0.07% |
| 89 | CD63 antigen (melanoma 1 antigen) (CD63) | NM_001780.1 | 7 | 0.05% | 12 | 0.07% |
| 90 | histone H3.3 | Z48950 | 3 | 0.02% | 12 | 0.07% |
| 91 | t-complex-associated-testis-expressed 1-like 1 (TCTEL1) | NM_006519.1 | 2 | 0.01% | 12 | 0.07% |
| 92 | procollagen C-endopeptidase enhancer 2 (PCOLCE2) | NM_013363.1 | 1 | 0.01% | 12 | 0.07% |
| 93 | electron transfer flavoprotein alpha-subunit | J04058.1 | 1 | 0.01% | 12 | 0.07% |
| 94 | Ribosomal protein L36 (=RPL44) | AF077043.1 | 20 | 0.15% | 11 | 0.06% |
| 95 | ribosomal protein L39 | D79205 | 15 | 0.11% | 11 | 0.06% |
| 96 | MORF-related gene X (KIAA0026) (=MRG15) | NM_012286.1 | 2 | 0.01% | 11 | 0.06% |
| 97 | PRO1574 (mitochondrial proteolipid 68MP homolog (PLPM) | AF116639.1 | 2 | 0.01% | 11 | 0.06% |
| 98 | reverse transcriptase related protein | prf1207289A | 1 | 0.01% | 11 | 0.06% |
| 99 | ribosomal protein L3 (RPL3) | NM_000967.1 | 42 | 0.31% | 10 | 0.06% |
| 100 | ribosomal protein L13 | AF112214 | 33 | 0.25% | 10 | 0.06% |
| 101 | actin, gamma 1 (ACTG1) | NM_001614.1 | 31 | 0.23% | 10 | 0.06% |

Figure 14- Relative EST Frequency of Unique Known Genes Common to Fetal and Normal cDNA Libraries - Page 3 of 17

| | | | | | | |
|---|---|---|---|---|---|---|
| 102 | RIBOSOMAL PROTEIN L10A (CSA-19)(RPL10A) | P53025 | 18 | 0.13% | 10 | 0.06% |
| 103 | ribosomal protein L35a | NM_000996.1 | 14 | 0.10% | 10 | 0.06% |
| 104 | eukaryotic translation initiation factor 3 (EIF3S6) (=INT6) | NM_001568.1 | 13 | 0.10% | 10 | 0.06% |
| 105 | H2A histone family, member Z (H2AFZ) = D28450.1 | NM_002106.1 | 4 | 0.03% | 10 | 0.06% |
| 106 | zinc finger protein 216 (ZNF216) | AF062072.1 | 3 | 0.02% | 10 | 0.06% |
| 107 | cytochrome c oxidase subunit II gene (ORF) | AF004339 | 3 | 0.02% | 10 | 0.06% |
| 108 | TPT1 gene for translationally controlled tumor protein (TCTP), exons 1-6 | AJ400717.1 | 2 | 0.01% | 10 | 0.06% |
| 109 | selenoprotein P (SEPP1) | Z11793 | 1 | 0.01% | 10 | 0.06% |
| 110 | ribosomal protein S15a | X84407 | 23 | 0.17% | 9 | 0.05% |
| 111 | cytoskeletal gamma-actin | X04098 | 19 | 0.14% | 9 | 0.05% |
| 112 | prothymosin alpha | M14630 | 18 | 0.13% | 9 | 0.05% |
| 113 | ribosomal protein S13 | NM_001017.1 | 17 | 0.13% | 9 | 0.05% |
| 114 | ATP synthase, H transporting, mitochondrial F0 complex, subunit g (ATP5I | Hs.107476 | 4 | 0.03% | 9 | 0.05% |
| 115 | defender against cell death 1 (DAD1) | NM_001344.1 | 3 | 0.02% | 9 | 0.05% |
| 116 | TI-227H (=tomoregulin; mitchondrial) | D50525 | 2 | 0.01% | 9 | 0.05% |
| 117 | ATPase, H transporting, lysosomal (vacuolar proton pump) 9kD (ATP6H) | NM_003945.1 | 1 | 0.01% | 9 | 0.05% |
| 118 | nuclear pore complex interacting protein (NPIP) | AF132984.1 | 1 | 0.01% | 9 | 0.05% |
| 119 | ribosomal protein S24 | M31520 | 23 | 0.17% | 8 | 0.05% |
| 120 | ribosomal protein L5 | U76609 | 23 | 0.17% | 8 | 0.05% |
| 121 | heterogeneous nuclear ribonucleoprotein A1 (HNRPA1) | NM_002136.1 | 14 | 0.10% | 8 | 0.05% |
| 122 | polyubiquitin | E12605 | 13 | 0.10% | 8 | 0.05% |
| 123 | ribosomal protein L12 | L06505 | 12 | 0.09% | 8 | 0.05% |
| 124 | ribosomal protein L38 | Z26876 | 8 | 0.06% | 8 | 0.05% |
| 125 | poly(A)-binding protein (PABP) | U68105 | 6 | 0.04% | 8 | 0.05% |
| 126 | carboxypeptidase E (CPE) | NM_001873.1 | 6 | 0.04% | 8 | 0.05% |
| 127 | cytochrome b (ORF) | U09500 | 5 | 0.04% | 8 | 0.05% |
| 128 | Tigger1 transposable element | U49973.1 | 5 | 0.04% | 8 | 0.05% |
| 129 | NADH dehydrogenase(ubiquinone) Fe-S protein 5 (15kD) (NADH-coenzym | NM_004552.1 | 4 | 0.03% | 8 | 0.05% |
| 130 | thrombospondin 4 (THBS4) | NM_003248.1 | 4 | 0.03% | 8 | 0.05% |
| 131 | F1-ATPase epsilon-subunit (ATP5E) | AF052955.1 | 3 | 0.02% | 8 | 0.05% |
| 132 | frizzled-related protein (FRZB) | NM_001463.1 | 3 | 0.02% | 8 | 0.05% |
| 133 | glucocorticoid-induced GILZ | AF228339 | 3 | 0.02% | 8 | 0.05% |
| 134 | Fritz mRNA, complete cds | U91903.1 | 2 | 0.01% | 8 | 0.05% |
| 135 | actin, alpha, cardiac muscle | NP_005150.1 | 2 | 0.01% | 8 | 0.05% |
| 136 | vacuolar H-ATPase subunit | AF038954 | 1 | 0.01% | 8 | 0.05% |
| 137 | serine/threonine protein kinase Kp78 splice variant CTAK75a | AF159295.1 | 1 | 0.01% | 8 | 0.05% |
| 138 | ribosomal protein L27A | AB020236.1 | 34 | 0.25% | 7 | 0.04% |
| 139 | ribosomal protein, large P2 (RPLP2) | NM_001004.1 | 14 | 0.10% | 7 | 0.04% |
| 140 | tumor rejection antigen (gp96) 1 (TRA1) | X15187 | 10 | 0.07% | 7 | 0.04% |
| 141 | ribosomal protein S7 | M77233 | 8 | 0.06% | 7 | 0.04% |
| 142 | guanine nucleotide binding protein (G protein), alpha stimulating activity po | BC008855.1 | 8 | 0.06% | 7 | 0.04% |
| 143 | matrilin-3 (MATR3) | Y13341 | 7 | 0.05% | 7 | 0.04% |
| 144 | guanine nucleotide binding protein (G protein), alpha stimulating activity po | NM_000516.2 | 7 | 0.05% | 7 | 0.04% |
| 145 | lysosome-associated protein, transmembane - 4alpha (=D14696.1 Human | U34259.1 | 6 | 0.04% | 7 | 0.04% |
| 146 | Cyr61 protein (CYR61) | AF031385 | 6 | 0.04% | 7 | 0.04% |
| 147 | ribosomal protein S26 | NM_001029.1 | 6 | 0.04% | 7 | 0.04% |
| 148 | serine protease=HTRA serine protease (PRSS11)=AF157623.1 | Y07921 | 5 | 0.04% | 7 | 0.04% |
| 149 | hexabrachion (tenascin C, cytotactin) (HXB) | NM_002160.1 | 4 | 0.03% | 7 | 0.04% |
| 150 | palladin (KIAA0992)= CGI-151 | NM_016081.1 | 3 | 0.02% | 7 | 0.04% |
| 151 | collagen lysyl hydroxylase isoform 2 (PLOD2) | U84573 | 2 | 0.01% | 7 | 0.04% |
| 152 | myosin, light polypeptide, regulatory, non-sarcomeric (20kD) (MLCB), mRN | Hs.233936 | 2 | 0.01% | 7 | 0.04% |
| 153 | procollagen-lysine, 2-oxoglutarate 5-dioxygenase (lysine hydroxylase) 2 (P | Hs.41270 | 2 | 0.01% | 7 | 0.04% |

Figure 14. Relative EST Frequency of Unique Known Genes Common to Fetal and Normal cDNA Libraries - Page 4 of 17

| | | | | | | |
|---|---|---|---|---|---|---|
| 154 | KVLQT1 gene (=p150) | AJ006345.1 | 2 | 0.01% | 7 | 0.04% |
| 155 | suppression of tumorigenicity 13 (Hsp70-interacting protein) (ST13) | NM_003932.1 | 2 | 0.01% | 7 | 0.04% |
| 156 | spermidine/spermine N1-acetyltransferase | Z14136 | 1 | 0.01% | 7 | 0.04% |
| 157 | epithelial membrane protein 1 (EMP1) | NM_001423.1 | 1 | 0.01% | 7 | 0.04% |
| 158 | muscleblind (Drosophila)-like (MBNL) (=KIAA0428) | NM_021038.1 | 1 | 0.01% | 7 | 0.04% |
| 159 | SOD-2 manganese superoxide dismutase | X65965 | 1 | 0.01% | 7 | 0.04% |
| 160 | heat shock 70kD protein 10 (HSC71) (HSPA10) | NM_006597.1 | 1 | 0.01% | 7 | 0.04% |
| 161 | MADS/MEF2-family transcription factor (MEF2C) mRNA, complete cds | L08895.1 | 1 | 0.01% | 7 | 0.04% |
| 162 | ribosomal protein L15 | NM_002948.1 | 26 | 0.19% | 6 | 0.03% |
| 163 | collagen type IX alpha 3 (COL9A3) | AF026802.1 | 26 | 0.19% | 6 | 0.03% |
| 164 | ribosomal protein L28 | X69392 | 18 | 0.13% | 6 | 0.03% |
| 165 | FK506 binding protein (Fkbp63) | AF090334 | 8 | 0.06% | 6 | 0.03% |
| 166 | nascent-polypeptide-associated complex alpha polypeptide (NACA) | NM_005594.1 | 6 | 0.04% | 6 | 0.03% |
| 167 | collagen type XIV variant C-terminal NC1 and 3'UTR | Y11711 | 6 | 0.04% | 6 | 0.03% |
| 168 | Tis11d gene | U07802 | 5 | 0.04% | 6 | 0.03% |
| 169 | transforming growth factor beta-stimulated protein TSC-22 (TSC22) | NM_006022.1 | 5 | 0.04% | 6 | 0.03% |
| 170 | ADP/ATP translocase | J03592 | 5 | 0.04% | 6 | 0.03% |
| 171 | ferritin heavy chain | L20941.1 | 4 | 0.03% | 6 | 0.03% |
| 172 | testis enhanced gene transCRipt protein (TEGT) | AF033095 | 4 | 0.03% | 6 | 0.03% |
| 173 | translocation protein 1(TLOC1) | NM_003262.1 | 3 | 0.02% | 6 | 0.03% |
| 174 | mannosidase, beta A, lysosomal (MANBA) gene, and ubiquitin-conjugating | AF224669.1 | 3 | 0.02% | 6 | 0.03% |
| 175 | lactate dehydrogenase B (LDH-B) | Y00711 | 3 | 0.02% | 6 | 0.03% |
| 176 | peroxiredoxin 1 (PRDX1) (=NKEFA) | NM_002574.1 | 3 | 0.02% | 6 | 0.03% |
| 177 | membrane protein CH1 (CH1) | AB020980 | 3 | 0.02% | 6 | 0.03% |
| 178 | fibroblast activation protein, alpha; seprase (FAP) | NM_004460.1 | 2 | 0.01% | 6 | 0.03% |
| 179 | cig19 (=D31887.1 KIAA0062) | AF026940.1 | 1 | 0.01% | 6 | 0.03% |
| 180 | transmembrane protein (CD59) | M84349.1 | 1 | 0.01% | 6 | 0.03% |
| 181 | chloride intracellular channel 4 like (CLIC4L) | NM_013943.1 | 1 | 0.01% | 6 | 0.03% |
| 182 | protein C inhibitor [human, leukocytes, Genomic, 1402 nt, segment 5 of 5] | S69366.1 | 1 | 0.01% | 6 | 0.03% |
| 183 | ubiquitin-conjugating enzyme E2B (RAD6 homolog) (UBE2B) | NM_003337.1 | 1 | 0.01% | 6 | 0.03% |
| 184 | nuclear factor of kappa light polypeptide gene enhancer in B-cells 1(NFKB1 | AF213884.1 | 1 | 0.01% | 6 | 0.03% |
| 185 | tubulin beta | AF070561 | 19 | 0.14% | 5 | 0.03% |
| 186 | ribosomal protein L44 (RPL44) | NM_001001.1 | 14 | 0.10% | 5 | 0.03% |
| 187 | v-fos FBJ murine osteosarcoma viral oncogene homolog (FOS) | NM_005252.2 | 12 | 0.09% | 5 | 0.03% |
| 188 | triosephosphate isomerase (TPI1) | M10036 | 8 | 0.06% | 5 | 0.03% |
| 189 | myosin regulatory light chain | X54304 | 6 | 0.04% | 5 | 0.03% |
| 190 | lysyl oxidase | U22384 | 6 | 0.04% | 5 | 0.03% |
| 191 | insulin-like growth factor binding protein 5 (IGFBP5) gene | L27556.1 | 6 | 0.04% | 5 | 0.03% |
| 192 | cathepsin K (pycnodysostosis)(CTSK) | NM_000396.1 | 5 | 0.04% | 5 | 0.03% |
| 193 | B-cell translocation protein 1 (BTG1) | X61123 | 5 | 0.04% | 5 | 0.03% |
| 194 | cytochrome c oxidase subunit VIIb | Z14244 | 4 | 0.03% | 5 | 0.03% |
| 195 | cell division cycle 10 (homologous to CDC10 of S. cerevisiae) (CDC10) | NM_001788.1 | 4 | 0.03% | 5 | 0.03% |
| 196 | activating transCRiption factor 4 (tax-responsive enhancer element B67) (A | gi4502264 | 4 | 0.03% | 5 | 0.03% |
| 197 | integral membrane protein 2A (ITM2A) | NM_004867.1 | 4 | 0.03% | 5 | 0.03% |
| 198 | transforming growth factor beta-induced, 68kD (TGFBI) | NM_000358.1 | 3 | 0.02% | 5 | 0.03% |
| 199 | eukaryotic translation initiation factor 4 gamma, 2 (EIF4G2) | NM_001418.1 | 3 | 0.02% | 5 | 0.03% |
| 200 | Sec61 gamma | AF054184 | 3 | 0.02% | 5 | 0.03% |
| 201 | miCRosomal signal peptidase | AF061737 | 3 | 0.02% | 5 | 0.03% |
| 202 | actin binding protein ABP620 | AB029290.1 | 3 | 0.02% | 5 | 0.03% |
| 203 | WSB-1 isoform | AF106684.1 | 3 | 0.02% | 5 | 0.03% |
| 204 | heterogeneous nuclear ribonucleoprotein A2/B1 (HNRPA2B1) | NM_002137.1 | 3 | 0.02% | 5 | 0.03% |
| 205 | peptidylglycine alpha-amidating monooxygenase (PAM) | M37721 | 2 | 0.01% | 5 | 0.03% |

Figure 14 Relative EST Frequency of Unique Known Genes Common to Fetal and Normal cDNA Libraries - Page 5 of 17

| | | | | | | |
|---|---|---|---|---|---|---|
| 206 | small nuclear ribonucleoprotein D2 polypeptide (16.5kD) (SNRPD2) | NM_004597.3 | 2 | 0.01% | 5 | 0.03% |
| 207 | syndecan binding protein (syntenin) (SDCBP)(ORF) = AF000652.1 | NM_005625.1 | 2 | 0.01% | 5 | 0.03% |
| 208 | JKTBP2, JKTBP1, complete cds | AB017018.1 | 2 | 0.01% | 5 | 0.03% |
| 209 | cartilage intermediate layer protein, CILP | AB022430.1 | 1 | 0.01% | 5 | 0.03% |
| 210 | ring-box 1 (RBX1) | NM_014248.1 | 1 | 0.01% | 5 | 0.03% |
| 211 | allograft inflammatory factor 1 (AIF1) | NM_001623.2 | 1 | 0.01% | 5 | 0.03% |
| 212 | fragile 16D oxido reductase (FOR) | AF217490.1 | 1 | 0.01% | 5 | 0.03% |
| 213 | PRO1873 | AF119859.1 | 1 | 0.01% | 5 | 0.03% |
| 214 | poly(rC)-binding protein 2 (PCBP2) | NM_005016.1 | 1 | 0.01% | 5 | 0.03% |
| 215 | collagen type IX alpha 1 (COL9A1)(ORF) | NM_001851.1 | 74 | 0.55% | 4 | 0.02% |
| 216 | collagen type XI alpha2 (COL11A2) | U41068.1 | 34 | 0.25% | 4 | 0.02% |
| 217 | lectin, galactoside-binding, soluble, 1 (galectin 1) (LGALS1)mRNA (=14 kd | NM_002305.2 | 22 | 0.16% | 4 | 0.02% |
| 218 | T-cell cyclophilin | Y00052 | 18 | 0.13% | 4 | 0.02% |
| 219 | chondromodulin I precursor (CHM-I) | NM_007015.1 | 15 | 0.11% | 4 | 0.02% |
| 220 | ribosomal protein L14 | D87735 | 12 | 0.09% | 4 | 0.02% |
| 221 | heparan sulfate proteoglycan (HSPG) (OCI5) | J04621.1 | 9 | 0.07% | 4 | 0.02% |
| 222 | annexin A5 (ANXA5)(lipocortin-V) | NM_001154.2 | 9 | 0.07% | 4 | 0.02% |
| 223 | solute carrier family 25 (mitochondrial carrier; phosphate carrier), member | NM_005888.1 | 6 | 0.04% | 4 | 0.02% |
| 224 | nuclear protein SDK3 (=MEMA) | Y10351 | 6 | 0.04% | 4 | 0.02% |
| 225 | NADH dehydrogenase (ubiquinone) 1 alpha subcomplex, 4 (9kD, MLRQ) (I | NM_002489.1 | 5 | 0.04% | 4 | 0.02% |
| 226 | collagen type VI alpha 3 (COL6A3) | NM_004369.1 | 5 | 0.04% | 4 | 0.02% |
| 227 | enhancer of rudimentary homologue | U66871 | 5 | 0.04% | 4 | 0.02% |
| 228 | HSPC330 mRNA(=HSPC016) | AF161448.1 | 5 | 0.04% | 4 | 0.02% |
| 229 | peripheral myelin protein 22 | M94048 | 5 | 0.04% | 4 | 0.02% |
| 230 | bone sialoprotein (BNSP) | L10363.1 | 5 | 0.04% | 4 | 0.02% |
| 231 | lactate dehydrogenase A (LDHA) | NM_005566.1 | 4 | 0.03% | 4 | 0.02% |
| 232 | tyrosine 3-monooxygenase/tryptophan 5-monooxygenase activation protein | NM_003404.1 | 4 | 0.03% | 4 | 0.02% |
| 233 | heterogeneous nuclear ribonucleoprotein D-like (HNRPDL) | NM_005463.1 | 4 | 0.03% | 4 | 0.02% |
| 234 | heterogeneous nuclear ribonucleoprotein D (hnRNP D) (52% aa) | D55671 | 4 | 0.03% | 4 | 0.02% |
| 235 | platelet-derived growth factor receptor alpha (PDGFRA) | M21574 | 4 | 0.03% | 4 | 0.02% |
| 236 | cyclin I | D50310 | 4 | 0.03% | 4 | 0.02% |
| 237 | protein phosphatase 2 (formerly 2A), catalytic subunit, alpha isoform (PPP2 | NM_002715.1 | 4 | 0.03% | 4 | 0.02% |
| 238 | melanoma growth regulatory protein MIA | X75450 | 4 | 0.03% | 4 | 0.02% |
| 239 | phosphoglycerate kinase 1 (PGK1) (ORF) | NM_000291.1 | 3 | 0.02% | 4 | 0.02% |
| 240 | Heterogeneous nuclear ribonucleoprotein U (scaffold attachment factor A) | NM_004501.1 | 3 | 0.02% | 4 | 0.02% |
| 241 | alpha-2-macroglobulin | D83196 | 3 | 0.02% | 4 | 0.02% |
| 242 | sin3 associated polypeptide (SAP18) | AF153608 | 3 | 0.02% | 4 | 0.02% |
| 243 | ubiquinol-cytochrome c reductase complex (7.2 kD); hypothetical protein (F | NP_037519.1 | 2 | 0.01% | 4 | 0.02% |
| 244 | DEAD/H (Asp-Glu-Ala-Asp/His) box polypeptide 5 (RNA helicase, 68kD) (D | NM_004396.1 | 2 | 0.01% | 4 | 0.02% |
| 245 | GAP-associated tyrosine phosphoprotein p62 (Sam68) (SAM68) (=p62) | NM_006559.1 | 2 | 0.01% | 4 | 0.02% |
| 246 | latent transforming growth factor beta binding protein 1 (LTBP1) | NM_000627.1 | 2 | 0.01% | 4 | 0.02% |
| 247 | myosin, light polypeptide 1, alkali; skeletal, fast (MYL1) | NM_002475.1 | 2 | 0.01% | 4 | 0.02% |
| 248 | melanoma inhibitory | NM_006533.1 | 2 | 0.01% | 4 | 0.02% |
| 249 | integrin beta 1 subunit | X07979.1 | 1 | 0.01% | 4 | 0.02% |
| 250 | TGF-betaIIR alpha | D50683 | 1 | 0.01% | 4 | 0.02% |
| 251 | CGI-110 protein | AF151868.1 | 1 | 0.01% | 4 | 0.02% |
| 252 | HS1 protein (=YWHAQ) | X57347 | 1 | 0.01% | 4 | 0.02% |
| 253 | cytochrome c oxidase subunit VIIa polypeptide 2 like (COX7A2L) | NM_004718.1 | 1 | 0.01% | 4 | 0.02% |
| 254 | zinc finger transCRiption factor GKLF | AF105036.1 | 1 | 0.01% | 4 | 0.02% |
| 255 | KIAA0438 | AB007898.1 | 1 | 0.01% | 4 | 0.02% |
| 256 | T245 protein (T245) =TM4SF6=TM4-D | AF043906 | 1 | 0.01% | 4 | 0.02% |
| 257 | SMT3 (suppressor of mif two 3, yeast) homolog 2 (SMT3H2) | NM_006937.1 | 1 | 0.01% | 4 | 0.02% |

Figure 14 Relative EST Frequency of Unique Known Genes Common to Fetal and Normal cDNA Libraries - Page 6 of 17

| | | | | | | |
|---|---|---|---|---|---|---|
| 258 | AD-017 protein | AF157318.1 | 1 | 0.01% | 4 | 0.02% |
| 259 | KIAA0164 | D79986 | 1 | 0.01% | 4 | 0.02% |
| 260 | laminin B2 chain | M55210 | 1 | 0.01% | 4 | 0.02% |
| 261 | TRAM protein | CAA45218.1 | 1 | 0.01% | 4 | 0.02% |
| 262 | dual specificity phosphatase 1 (DUSP1) | NM_004417.2 | 1 | 0.01% | 4 | 0.02% |
| 263 | over-expressed breast tumor protein | L34839 | 1 | 0.01% | 4 | 0.02% |
| 264 | cathepsin L (CTSL) | NM_001912.1 | 1 | 0.01% | 4 | 0.02% |
| 265 | chondroitin sulfate proteoglycan 2 (versican) (CSPG2) | NM_004385.1 | 1 | 0.01% | 4 | 0.02% |
| 266 | ubiquitin-conjugating enzyme E2 variant 1 (UBE2V1) | NM_003349.1 | 1 | 0.01% | 4 | 0.02% |
| 267 | integrin alpha 10 subunit (ITGA10) | AF112345.1 | 1 | 0.01% | 4 | 0.02% |
| 268 | signal sequence receptor, gamma (translocon-associated protein gamma) ( | NM_007107.1 | 1 | 0.01% | 4 | 0.02% |
| 269 | fragile X mental retardation 1 (FMR1) | NM_002024.1 | 1 | 0.01% | 4 | 0.02% |
| 270 | X-linked anhidroitic ectodermal dysplasia protein gene (EDA), exon 2 and f | AF003528.1 | 1 | 0.01% | 4 | 0.02% |
| 271 | secreted frizzled-related protein 1 (SFRP1) | NM_003012.2 | 1 | 0.01% | 4 | 0.02% |
| 272 | proteasome (prosome macropain) beta type, 4 (PSMB4) | NM_002796.1 | 1 | 0.01% | 4 | 0.02% |
| 273 | thrombospondin 3 (THBS3) (RefSeq aa 3e-59) | NP_009043.1 | 1 | 0.01% | 4 | 0.02% |
| 274 | laminin, gamma 1 (formerly LAMB2) (LAMC1), | NM_002293.2 | 1 | 0.01% | 4 | 0.02% |
| 275 | ribosomal protein S21 (RPS21) | L04483 | 21 | 0.16% | 3 | 0.02% |
| 276 | ribosomal protein L19 | X63527 | 16 | 0.12% | 3 | 0.02% |
| 277 | Tubulin alpha isoform 1 | AF081484 | 16 | 0.12% | 3 | 0.02% |
| 278 | H3 histone, family 3A (H3F3A) | NM_002107.1 | 8 | 0.06% | 3 | 0.02% |
| 279 | ribophorin II (RPN2) | Y00282 | 7 | 0.05% | 3 | 0.02% |
| 280 | neural precursor cell expressed, developmentally down-regulated 5 (NEDD | NM_004404.1 | 6 | 0.04% | 3 | 0.02% |
| 281 | heat shock 90kD protein 1 beta (HSPCB) | NM_007355.1 | 6 | 0.04% | 3 | 0.02% |
| 282 | eukaryotic translation elongation factor 1 gamma (EEF1G) | NM_001404.1 | 6 | 0.04% | 3 | 0.02% |
| 283 | dynein light chain 1 (hdlc1), cytoplasmic | U32944 | 5 | 0.04% | 3 | 0.02% |
| 284 | GABA(A) receptor-associated protein (GABARAP) | NM_007278.1 | 5 | 0.04% | 3 | 0.02% |
| 285 | cyclophilin B (hCyPB) | M60857 | 5 | 0.04% | 3 | 0.02% |
| 286 | cytochrome c oxidase, liver specific (EC 1.9.3.1.) | X15822 | 4 | 0.03% | 3 | 0.02% |
| 287 | mitochondrial ubiquinone-binding protein | M26700 | 4 | 0.03% | 3 | 0.02% |
| 288 | low molecular mass ubiquinone-binding protein | D50369 | 4 | 0.03% | 3 | 0.02% |
| 289 | protein tyrosine phosphatase (hR-PTPu) | X58288 | 4 | 0.03% | 3 | 0.02% |
| 290 | Huntingtin interacting protein | AF049103 | 4 | 0.03% | 3 | 0.02% |
| 291 | interCRine-alpha (hIRH) | U19495 | 4 | 0.03% | 3 | 0.02% |
| 292 | cathepsin B (CTSB) | L22569 | 3 | 0.02% | 3 | 0.02% |
| 293 | thyroid receptor interactor (TRIP7) | L40357 | 3 | 0.02% | 3 | 0.02% |
| 294 | pre-mRNA splicing factor (SFRS3) | AF107405.1 | 3 | 0.02% | 3 | 0.02% |
| 295 | alpha E-catenin (CTNNA1) gene | AF102803.1 | 3 | 0.02% | 3 | 0.02% |
| 296 | profilin II | L10678.1 | 3 | 0.02% | 3 | 0.02% |
| 297 | 16.7Kd protein | AF078845.1 | 3 | 0.02% | 3 | 0.02% |
| 298 | tyrosine 3-monooxygenase/tryptophan 5-monooxygenase activation protein | NM_006826.1 | 3 | 0.02% | 3 | 0.02% |
| 299 | prostatic binding protein (PBP) | NM_002567.1 | 3 | 0.02% | 3 | 0.02% |
| 300 | nidogen-2 | AJ223500 | 3 | 0.02% | 3 | 0.02% |
| 301 | valosin-containing protein(VCP) | NM_007126.2 | 3 | 0.02% | 3 | 0.02% |
| 302 | tissue inhibitor of metalloproteinase 3 (Sorsby fundus dystrophy, pseudoinfl | NM_000362.1 | 2 | 0.01% | 3 | 0.02% |
| 303 | cytochrome c oxidase subunit VIIc (COX7C) | NM_001867.1 | 2 | 0.01% | 3 | 0.02% |
| 304 | ubiquitin-like 1 (sentrin) (UBL1) (=SUMO-1) | NM_003352.1 | 2 | 0.01% | 3 | 0.02% |
| 305 | cytosolic selenium-dependent glutathione peroxidase (=L09159 RHOA prot | M83094 | 2 | 0.01% | 3 | 0.02% |
| 306 | BCL2/adenovirus E1B 19kD-interacting protein 3 (BNIP3) | U15174 | 2 | 0.01% | 3 | 0.02% |
| 307 | NADH dehydrogenase subunit 2 (ND2) | AF014897.2 | 2 | 0.01% | 3 | 0.02% |
| 308 | poly(A)-binding protein, cytoplasmic 1 (PABPC1) | NM_002568.1 | 2 | 0.01% | 3 | 0.02% |
| 309 | PAPS synthetase-2 (PAPSS2) | AF074331.1 | 2 | 0.01% | 3 | 0.02% |

Figure 14 - Relative EST Frequency of Unique Known Genes Common to Fetal and Normal cDNA Libraries - Page 7 of 17

| | | | | | | |
|---|---|---|---|---|---|---|
| 310 | TATA box binding protein (TBP)-associated factor, RNA polymerase II, F, 5 | NM_005642.1 | 2 | 0.01% | 3 | 0.02% |
| 311 | MAGUK protein p55T (=AB002323 KIAA0325) | AF162130.1 | 2 | 0.01% | 3 | 0.02% |
| 312 | adaptor-related protein complex 3, sigma 1 subunit (CLAPS3) | NM_001284.1 | 2 | 0.01% | 3 | 0.02% |
| 313 | KIAA0372 | AB002370.1 | 2 | 0.01% | 3 | 0.02% |
| 314 | ubiquinol-cytochrome c reductase hinge protein (UQCRH) | NM_006004.1 | 2 | 0.01% | 3 | 0.02% |
| 315 | non-histone chromosome protein 2 (S. cerevisiae)-like 1 (NHP2L1)=D5042 | NM_005008.1 | 2 | 0.01% | 3 | 0.02% |
| 316 | heterogeneous nuclear ribonucleoprotein M (HNRPM) | 5174610 | 2 | 0.01% | 3 | 0.02% |
| 317 | Golgi apparatus protein 1 (GLG1) | NM_012201.1 | 2 | 0.01% | 3 | 0.02% |
| 318 | moesin (MSN) | NM_002444.1 | 2 | 0.01% | 3 | 0.02% |
| 319 | nucleolar phosphoprotein p130 (P130) | NM_004741.1 | 2 | 0.01% | 3 | 0.02% |
| 320 | neuroendocrine-specific protein C like (foocen) (NSP-CL) reticulon 4 (RTN | NM_007008.1 | 1 | 0.01% | 3 | 0.02% |
| 321 | mitochondrial proteolipid 68MP homolog (PLPM) | NM_004894.1 | 1 | 0.01% | 3 | 0.02% |
| 322 | hepatitis B virus X interacting protein (XIP) | AF029890 | 1 | 0.01% | 3 | 0.02% |
| 323 | activated RNA polymerase (PC4) | NM_006713.1 | 1 | 0.01% | 3 | 0.02% |
| 324 | FRG1 | L76159 | 1 | 0.01% | 3 | 0.02% |
| 325 | CD164 antigen, sialomucin (CD164) | NM_006016.1 | 1 | 0.01% | 3 | 0.02% |
| 326 | ganglioside expression factor 2 (GEF-2) | NM_007285.1 | 1 | 0.01% | 3 | 0.02% |
| 327 | S164 (=AC004858 U1 small ribonucleoprotein 1SNRP homologue) | AF109907 | 1 | 0.01% | 3 | 0.02% |
| 328 | sema domain immunoglobulin domain (Ig)(semaphorin) 3E (SEMA3E)(= K | NM_012431.1 | 1 | 0.01% | 3 | 0.02% |
| 329 | prion protein (p27-30) (Creutzfeld-Jakob disease, Gerstmann-Strausler-Sc | NM_000311.1 | 1 | 0.01% | 3 | 0.02% |
| 330 | interleukin 1 receptor, type I (IL1R1) = M27492.1 | NM_000877.1 | 1 | 0.01% | 3 | 0.02% |
| 331 | zinc finger protein 9 (a cellular retroviral nucleic acid binding protein) ( | gi4827070 | 1 | 0.01% | 3 | 0.02% |
| 332 | KIAA0242 | D87684 | 1 | 0.01% | 3 | 0.02% |
| 333 | PPP1R5 | AF110824.1 | 1 | 0.01% | 3 | 0.02% |
| 334 | transforming, acidic coiled-coil containing protein 1 (TACC1=AF049910 | NM_006283.1 | 1 | 0.01% | 3 | 0.02% |
| 335 | clathrin, light polypeptide (Lca) (CLTA) | NM_007096.1 | 1 | 0.01% | 3 | 0.02% |
| 336 | KIAA0069 gene | D31885.1 | 1 | 0.01% | 3 | 0.02% |
| 337 | uncharacterized bone marrow protein BM034 (=AK000571 FLJ20564 fis) ( | AF217511.1 | 1 | 0.01% | 3 | 0.02% |
| 338 | Membrane cofactor protein | X59408.1 | 1 | 0.01% | 3 | 0.02% |
| 339 | KIAA0349 gene | AB002347.1 | 1 | 0.01% | 3 | 0.02% |
| 340 | TGF-beta inducible early protein (TIEG) | U21847 | 1 | 0.01% | 3 | 0.02% |
| 341 | CD59 antigen p18-20 (antigen identified by monoclonal antibodies 16.3A5, | NM_000611.1 | 1 | 0.01% | 3 | 0.02% |
| 342 | signal peptidase complex (18kD) (SPC18) | NM_014300.1 | 1 | 0.01% | 3 | 0.02% |
| 343 | archain 1 (ARCN1) | gi4502194 | 1 | 0.01% | 3 | 0.02% |
| 344 | selenoprotein W (hSelW) | AF015283.1 | 1 | 0.01% | 3 | 0.02% |
| 345 | nuclear factor I/B (NFIB) | NM_005596.1 | 1 | 0.01% | 3 | 0.02% |
| 346 | KIAA0174 | D79996 | 1 | 0.01% | 3 | 0.02% |
| 347 | heterogeneous nuclear ribonucleoprotein H1 (H) (HNRPH1) | NM_005520.1 | 1 | 0.01% | 3 | 0.02% |
| 348 | calcium modulating cyclophilin ligand CAMLG (CAMLG) | AF068179.1 | 1 | 0.01% | 3 | 0.02% |
| 349 | KIAA0527 | AB011099.1 | 1 | 0.01% | 3 | 0.02% |
| 350 | retrovirus-related hypothetical protein II (=X52235 ORFII) | S23650 | 1 | 0.01% | 3 | 0.02% |
| 351 | polymerase (RNA) II polypeptide G (POLR2G) | NM_002696.1 | 1 | 0.01% | 3 | 0.02% |
| 352 | peptidylprolyl isomerase A (cyclophilin A) (PPIA), mRNA /cds=(44,541) /gb | Hs.342389 | 1 | 0.01% | 3 | 0.02% |
| 353 | S100 calcium-binding protein, beta (neural) (S100B) | NM_006272.1 | 1 | 0.01% | 3 | 0.02% |
| 354 | phosphatidic acid phosphatase 2b (PPAP2B) | AB000889 | 1 | 0.01% | 3 | 0.02% |
| 355 | KIAA1354 | AB037775 | 1 | 0.01% | 3 | 0.02% |
| 356 | glycyl-tRNA synthetase; glycine tRNAligase (RefSeq aa 1e-45) | NP_002038.1 | 1 | 0.01% | 3 | 0.02% |
| 357 | coagulation factor XIII, A1 polypeptide (F13A1) | NM_000129.1 | 1 | 0.01% | 3 | 0.02% |
| 358 | CGI-31 protein (LOC51075), | NM_015959.1 | 1 | 0.01% | 3 | 0.02% |
| 359 | caltractin (20kD calcium-binding protein) (CALT) | NM_004344.1 | 1 | 0.01% | 3 | 0.02% |
| 360 | PC3 cell line (TL27) | X75684.1 | 1 | 0.01% | 3 | 0.02% |
| 361 | glyceraldehyde 3-phosphate dehydrogenase (GADPH) | J02642 | 41 | 0.31% | 2 | 0.01% |

Figure 14- Relative EST Frequency of Unique Known Genes Common to Fetal and Normal cDNA Libraries - Page 8 of 17

| | | | | | | |
|---|---|---|---|---|---|---|
| 362 | ribosomal protein S5 (RPS5) | NM_001009.1 | 29 | 0.22% | 2 | 0.01% |
| 363 | ribosomal protein L35 | U12465 | 27 | 0.20% | 2 | 0.01% |
| 364 | ribosomal protein S3 (RPS3) | NM_001005.1 | 21 | 0.16% | 2 | 0.01% |
| 365 | cartilage link protein (CRTL1) | U43328.1 | 20 | 0.15% | 2 | 0.01% |
| 366 | ribosomal protein S16 | M60854 | 14 | 0.10% | 2 | 0.01% |
| 367 | laminin receptor 1 (67kD, ribosomal protein SA) (LAMR1)(ORF) | NM_002295.1 | 12 | 0.09% | 2 | 0.01% |
| 368 | ribosomal protein L23a | U43701 | 11 | 0.08% | 2 | 0.01% |
| 369 | ribosomal protein S15 (RPS15) (=insulinoma rig-analog encoding DNA-bind | NM_001018.1 | 11 | 0.08% | 2 | 0.01% |
| 370 | elongation factor 1 beta 2 (EEF1B2) | NM_001959.1 | 10 | 0.07% | 2 | 0.01% |
| 371 | collagenase type IV | J03210 | 10 | 0.07% | 2 | 0.01% |
| 372 | RNA polymerase II elongation factor-like protein | Z47087 | 8 | 0.06% | 2 | 0.01% |
| 373 | calumein (Calu) (calumenin) | AF013759 | 8 | 0.06% | 2 | 0.01% |
| 374 | calreticulin (CALR) | M84739 | 7 | 0.05% | 2 | 0.01% |
| 375 | 1-8U gene from interferon-inducible gene family | X57352.1 | 6 | 0.04% | 2 | 0.01% |
| 376 | BiP protein | X87949 | 5 | 0.04% | 2 | 0.01% |
| 377 | ATP synthase, H transporting, mitochondrial F1 complex, gamma polypept | NM_005174.1 | 5 | 0.04% | 2 | 0.01% |
| 378 | ATP synthase, H transporting, mitochondrial F1 complex, alpha subunit, is | NM_004046.1 | 5 | 0.04% | 2 | 0.01% |
| 379 | thrombospondin 2 (THBS2) | L12350 | 5 | 0.04% | 2 | 0.01% |
| 380 | thrombospondin 1 (THBS1) | NM_003246.1 | 5 | 0.04% | 2 | 0.01% |
| 381 | cytosolic thyroid hormone-binding protein (=M23725 M2-type pyruvate kina | M26252 | 5 | 0.04% | 2 | 0.01% |
| 382 | fatty acid binding protein (adipocyte lipid-binding protein) | NM_001442.1 | 4 | 0.03% | 2 | 0.01% |
| 383 | 78 kD glucose-regulated protein (GRP78) gene (=BiP protein) | M19645.1 | 4 | 0.03% | 2 | 0.01% |
| 384 | fibrillin (FBN1) | X63556 | 4 | 0.03% | 2 | 0.01% |
| 385 | nuclease sensitive element binding protein 1 (NSEP1) = L28809.1 dbpB-lik | NM_004559.1 | 4 | 0.03% | 2 | 0.01% |
| 386 | HSPC016, mRNA /cds=(38,232) /gb=NM_015933 /gi=7705430 /ug=Hs.171 | Hs.171774 | 4 | 0.03% | 2 | 0.01% |
| 387 | cellular growth-regulating protein | L10844 | 4 | 0.03% | 2 | 0.01% |
| 388 | anti-oxidant protein 2 (non-selenium glutathione peroxidase, acidic calcium | NM_004905.1 | 4 | 0.03% | 2 | 0.01% |
| 389 | small EDRK-rich factor 2 (SERF2) | NM_005770.1 | 4 | 0.03% | 2 | 0.01% |
| 390 | chondroadherin (CHAD) | U96769 | 4 | 0.03% | 2 | 0.01% |
| 391 | general transcription factor 2-I (GTF2I) | AF038968 | 4 | 0.03% | 2 | 0.01% |
| 392 | CD9 antigen (p24/CD9) | L08125 | 3 | 0.02% | 2 | 0.01% |
| 393 | prefoldin 5 (PFDN5) (=D89667 c-myc binding protein) | NP_002615.1 | 3 | 0.02% | 2 | 0.01% |
| 394 | tomoregulin | AB004064.1 | 3 | 0.02% | 2 | 0.01% |
| 395 | phenylalkylamine binding protein gene | AF196969.1 | 3 | 0.02% | 2 | 0.01% |
| 396 | ERF-1 | X79067.1 | 3 | 0.02% | 2 | 0.01% |
| 397 | collagen type VI alpha 1(COL6A1) | X15880 | 3 | 0.02% | 2 | 0.01% |
| 398 | KIAA1077 | AB029000.1 | 3 | 0.02% | 2 | 0.01% |
| 399 | SWI/SNF related, matrix associated (SMARCA1) | gi4507066 | 3 | 0.02% | 2 | 0.01% |
| 400 | ornithine aminotransferase | M29927 | 3 | 0.02% | 2 | 0.01% |
| 401 | reticulocalbin 2, EF-hand calcium binding domain (RCN2) =X78669 (ORF) | NM_002902.1 | 3 | 0.02% | 2 | 0.01% |
| 402 | KIAA0143 gene | D63477.1 | 3 | 0.02% | 2 | 0.01% |
| 403 | myristoylated alanine-rich C-kinase substrate (=D10522 80K-L protein) | M68956 | 3 | 0.02% | 2 | 0.01% |
| 404 | laminin, alpha 4 (LAMA4) | NM_002290.1 | 3 | 0.02% | 2 | 0.01% |
| 405 | vascular endothelial growth factor (VEGF) | AF024710.1 | 3 | 0.02% | 2 | 0.01% |
| 406 | RNA-binding protein regulatory subunit | AF021819 | 3 | 0.02% | 2 | 0.01% |
| 407 | ATP SYNTHASE A CHAIN (PROTEIN 6)(ORF) | P00846 | 3 | 0.02% | 2 | 0.01% |
| 408 | S100 calcium-binding protein A13 (S100A13) | NM_005979.1 | 3 | 0.02% | 2 | 0.01% |
| 409 | glucocorticoid receptor AF-1 specific elongation factor | AF174496.1 | 3 | 0.02% | 2 | 0.01% |
| 410 | complement factor H (=M17517) | Y00716 | 2 | 0.01% | 2 | 0.01% |
| 411 | SPARC-like 1 (mast9, hevin) (SPARCL1) | NM_004684.1 | 2 | 0.01% | 2 | 0.01% |
| 412 | vacuolar sorting protein VPS29/PEP11 (LOC51699) | NM_016226.1 | 2 | 0.01% | 2 | 0.01% |
| 413 | UDP-glucose dehydrogenase (UGDH) | AF061016 | 2 | 0.01% | 2 | 0.01% |

Figure 14. Relative EST Frequency of Unique Known Genes Common to Fetal and Normal cDNA Libraries - Page 9 of 17

| | | | | | | |
|---|---|---|---|---|---|---|
| 414 | SET translocation (myeloid leukemia-associated) (SET) =M93651 | NM_003011.1 | 2 | 0.01% | 2 | 0.01% |
| 415 | HSPC035 protein (LOC51669), NPD003 | NM_016127.1 | 2 | 0.01% | 2 | 0.01% |
| 416 | karyopherin alpha 4 (=importin alpha 3) (KPNA4) | NM_002268.1 | 2 | 0.01% | 2 | 0.01% |
| 417 | CYTOCHROME C OXIDASE POLYPEPTIDE II | spP00403 | 2 | 0.01% | 2 | 0.01% |
| 418 | apoptosis related protein APR-1 | AF143235.2 | 2 | 0.01% | 2 | 0.01% |
| 419 | HSPC194 | AF151028.1 | 2 | 0.01% | 2 | 0.01% |
| 420 | KDEL (Lys-Asp-Glu-Leu) endoplasmic reticulum protein retention receptor | NM_006854.2 | 2 | 0.01% | 2 | 0.01% |
| 421 | poly(rC)-binding protein 1 (PCBP1) | NM_006196.1 | 2 | 0.01% | 2 | 0.01% |
| 422 | immunoglobulin lambda gene | D87003.1 | 2 | 0.01% | 2 | 0.01% |
| 423 | NADH dehydrogenase (ubiquinone) 1 beta subcomplex, 8 (19kD, ASHI) (N | NM_005004.1 | 2 | 0.01% | 2 | 0.01% |
| 424 | cyclophilin-related protein (NKTR) gene (=PAC RPCI4-613B23) | AF184110.1 | 2 | 0.01% | 2 | 0.01% |
| 425 | chaperonin containing T-complex subunit 6 (CCT6) = L27706.1 | NM_001762.1 | 2 | 0.01% | 2 | 0.01% |
| 426 | low density lipoprotein receptor | L00352 | 2 | 0.01% | 2 | 0.01% |
| 427 | chaperonin containing TCP1 subunit 4 (delta) (CCT4) | NM_006430.1 | 2 | 0.01% | 2 | 0.01% |
| 428 | translocase of outer mitochondrial membrane 20 (yeast) homolog (KIAA00 | NM_014765.1 | 2 | 0.01% | 2 | 0.01% |
| 429 | serine/threonine kinase KPM | AF207547.1 | 2 | 0.01% | 2 | 0.01% |
| 430 | alcohol dehydrogenase,class III (ADH5) chi subunit | M30471 | 2 | 0.01% | 2 | 0.01% |
| 431 | phosphatidic acid phosphatase 2a | AB000888 | 2 | 0.01% | 2 | 0.01% |
| 432 | KIAA0670 protein/acinusL (no-exact match 42% a.a.) | NP_055792.1 | 2 | 0.01% | 2 | 0.01% |
| 433 | aspartyl-tRNA synthetase (DARS) | NM_001349.1 | 2 | 0.01% | 2 | 0.01% |
| 434 | cystatin B | U46692 | 2 | 0.01% | 2 | 0.01% |
| 435 | cytoplasmic beta-actin | M10277 | 2 | 0.01% | 2 | 0.01% |
| 436 | YEAF1 (YY1 and E4TF1 associated factor 1) | AB029551.1 | 2 | 0.01% | 2 | 0.01% |
| 437 | Zn-15 transCRiption factor (Zfp-15) (=AB011102 Human KIAA0530) | AF017806 | 2 | 0.01% | 2 | 0.01% |
| 438 | proteasome (prosome, macropain) subunit, beta type, 7 (PSMB7) | NM_002799.1 | 2 | 0.01% | 2 | 0.01% |
| 439 | gelsolin, plasma (GSN) | X04412 | 2 | 0.01% | 2 | 0.01% |
| 440 | C9ORF3 | AF043897.1 | 2 | 0.01% | 2 | 0.01% |
| 441 | splicing factor 3b, subunit 2, 145kD (SF3B2) | NM_006842.1 | 2 | 0.01% | 2 | 0.01% |
| 442 | splicing factor, arginine/serine-rich 4 (SFRS4) | NM_005626.1 | 2 | 0.01% | 2 | 0.01% |
| 443 | CGI-120 protein (LOC51644) | NM_016057.1 | 2 | 0.01% | 2 | 0.01% |
| 444 | tumor antigen (L6) | M90657.1 | 2 | 0.01% | 2 | 0.01% |
| 445 | heat shock factor binding protein 1 (HSBP1) | NM_001537.1 | 1 | 0.01% | 2 | 0.01% |
| 446 | 15 kDa selenoprotein (SEP15) | AF051894 | 1 | 0.01% | 2 | 0.01% |
| 447 | epidermal growth factor receptor kinase substrate (Eps8) | U12535 | 1 | 0.01% | 2 | 0.01% |
| 448 | Down syndrome candidate region 1 (DSCR1) | NM_004414.2 | 1 | 0.01% | 2 | 0.01% |
| 449 | matrilin-2 precursor | U69263 | 1 | 0.01% | 2 | 0.01% |
| 450 | CYTOCHROME C OXIDASE POLYPEPTIDE I | P00395 | 1 | 0.01% | 2 | 0.01% |
| 451 | KIAA0663 | AB014563 | 1 | 0.01% | 2 | 0.01% |
| 452 | palmitoyl-protein thioesterase (PPT) | AF022211 | 1 | 0.01% | 2 | 0.01% |
| 453 | KIAA0102 | D14658 | 1 | 0.01% | 2 | 0.01% |
| 454 | NADH dehydrogenase (ubiquinone) 1 alpha subcomplex, 5 (13kD, B13) (N | NM_005000.1 | 1 | 0.01% | 2 | 0.01% |
| 455 | GW128 | AF107406 | 1 | 0.01% | 2 | 0.01% |
| 456 | SLC11A3 iron transporter | AF215636.1 | 1 | 0.01% | 2 | 0.01% |
| 457 | esterase D | AF112219 | 1 | 0.01% | 2 | 0.01% |
| 458 | DRP-2 dihydropyrimidinase related protein 2 | AB020777.1 | 1 | 0.01% | 2 | 0.01% |
| 459 | KIAA0530 | AB011102 | 1 | 0.01% | 2 | 0.01% |
| 460 | ribosomal protein L33-like protein | AF047440 | 1 | 0.01% | 2 | 0.01% |
| 461 | synaptophysin-like protein (SYPL) | gi5803184 | 1 | 0.01% | 2 | 0.01% |
| 462 | conserved gene amplified in osteosarcoma (OS4) | NM_005730.1 | 1 | 0.01% | 2 | 0.01% |
| 463 | DNA-binding protein A gene | L29073.1 | 1 | 0.01% | 2 | 0.01% |
| 464 | YME1 (S.cerevisiae)-like 1(YME1L1), = AJ132637.1 ATP-dependent metal | NM_014263.1 | 1 | 0.01% | 2 | 0.01% |
| 465 | jumping translocation breakpoint (JTB) =AB016488 hJTB (ORF) | NM_006694.1 | 1 | 0.01% | 2 | 0.01% |

Figure 14 - Relative EST Frequency of Unique Known Genes Common to Fetal and Normal cDNA Libraries - Page 11 of 17

| | | | | | | |
|---|---|---|---|---|---|---|
| 518 | quiescin Q6 (QSCN6)(= bone-derived growth factor (BPGF-1)) | NM_002826.1 | 1 | 0.01% | 2 | 0.01% |
| 519 | brain-specific STE20-like protein kinase 3 (STK3) | AF083420.1 | 1 | 0.01% | 2 | 0.01% |
| 520 | Sec31 protein | AF139184.1 | 1 | 0.01% | 2 | 0.01% |
| 521 | high-mobility group (nonhistone chromosomal) protein 14 (HMG14) | NM_004965.1 | 1 | 0.01% | 2 | 0.01% |
| 522 | ribosomal protein, large, P1 (RPLP1) | NM_001003.1 | 40 | 0.30% | 1 | 0.01% |
| 523 | ribosomal protein S28, yeast homologue | D14530 | 38 | 0.28% | 1 | 0.01% |
| 524 | ribosomal protein S18 | X69150.1 | 33 | 0.25% | 1 | 0.01% |
| 525 | ribosomal protein L18 (RPL18) | NM_000979.1 | 28 | 0.21% | 1 | 0.01% |
| 526 | ribosomal protein L18a | L05093.1 | 27 | 0.20% | 1 | 0.01% |
| 527 | H19 (=PRO2605) | M32053 | 25 | 0.19% | 1 | 0.01% |
| 528 | RIBOSOMAL PROTEIN S2 (S4) (LLREP3 PROTEIN) | spP15880 | 24 | 0.18% | 1 | 0.01% |
| 529 | ribosomal protein S10 | NM_001014.1 | 22 | 0.16% | 1 | 0.01% |
| 530 | ribosomal protein L29 (RPL29) | NM_000992.1 | 21 | 0.16% | 1 | 0.01% |
| 531 | elongation factor 2 | X51466 | 16 | 0.12% | 1 | 0.01% |
| 532 | aggrecan (chondroitin sulfate proteoglycan 1, large aggregating proteoglyc | U13613 | 14 | 0.10% | 1 | 0.01% |
| 533 | dolichyl-phosphate beta-glucosyltransferase (ALG5) | AF102850.1 | 13 | 0.10% | 1 | 0.01% |
| 534 | calcyclin (=M14300 growth factor-inducible 2A9 gene; U04815 protein kina | J02763 | 10 | 0.07% | 1 | 0.01% |
| 535 | mesoderm specific transcript (mouse) homolog (MEST) | NM_002402.1 | 10 | 0.07% | 1 | 0.01% |
| 536 | androgen receptor associated protein 24 (ARA24) (=AF054183 GTP bindin | AF052578 | 8 | 0.06% | 1 | 0.01% |
| 537 | transmembrane protein (p63) | X69910 | 8 | 0.06% | 1 | 0.01% |
| 538 | ATP synthase, H transporting, mitochondrial F1F0, subunit g (ATP5JG) | NM_006476.1 | 7 | 0.05% | 1 | 0.01% |
| 539 | ADP-ribosylation factor 1 | M84326.1 | 7 | 0.05% | 1 | 0.01% |
| 540 | melanoma-associated antigen MG50 | AF200348.1 | 7 | 0.05% | 1 | 0.01% |
| 541 | phosphoglycerate mutase (PGAM-B) | J04173 | 6 | 0.04% | 1 | 0.01% |
| 542 | transCRiption factor BTF 3 | X74070 | 6 | 0.04% | 1 | 0.01% |
| 543 | DEK oncogene (DNA binding) (DEK) | gi4503248 | 5 | 0.04% | 1 | 0.01% |
| 544 | titin (TTN) gene | CAA49245.1 | 5 | 0.04% | 1 | 0.01% |
| 545 | ISLR (immunoglobulin superfamily containing leucine-rich repeat) gene, | AB024537 | 5 | 0.04% | 1 | 0.01% |
| 546 | Finkel-Biskis-Reilly murine sarcoma virus (FBR-MuSV) | NM_001997.1 | 5 | 0.04% | 1 | 0.01% |
| 547 | shox gene | U82668 | 5 | 0.04% | 1 | 0.01% |
| 548 | high mobility group-1 protein (HMG-1) | X12597 | 4 | 0.03% | 1 | 0.01% |
| 549 | collagen type V alpha 2 (COL5A2) | M11718 | 4 | 0.03% | 1 | 0.01% |
| 550 | cyclin | M74091 | 4 | 0.03% | 1 | 0.01% |
| 551 | sphingolipid activator protein 1 | J03015 | 4 | 0.03% | 1 | 0.01% |
| 552 | non-metastatic cells 2, protein (NM23B) expressed in (NME2) | NM_002512.1 | 4 | 0.03% | 1 | 0.01% |
| 553 | filamin (FLNB) | AF191633.1 | 4 | 0.03% | 1 | 0.01% |
| 554 | H3 histone, family 3B (H3.3B) (H3F3B) | NM_005324.1 | 4 | 0.03% | 1 | 0.01% |
| 555 | 6-phosphofructo-2-kinase/fructose-2,6-bisphosphatase (PF2K) (=AB00790 | AF041832 | 4 | 0.03% | 1 | 0.01% |
| 556 | ornithine decarboxylase antizyme | D87914 | 4 | 0.03% | 1 | 0.01% |
| 557 | myeloid leukemia factor 2 (MLF2) | NM_005439.1 | 4 | 0.03% | 1 | 0.01% |
| 558 | PRO2605 | AF116709.1 | 4 | 0.03% | 1 | 0.01% |
| 559 | Cu/Zn superoxide dismutase (SOD) | X02317 | 3 | 0.02% | 1 | 0.01% |
| 560 | YAP65 | X80507.1 | 3 | 0.02% | 1 | 0.01% |
| 561 | prolyl 4-hydroxylase gene | U14608.1 | 3 | 0.02% | 1 | 0.01% |
| 562 | protein phosphatase 2A catalytic subunit-beta | M60484 | 3 | 0.02% | 1 | 0.01% |
| 563 | ubiquitin gene | U49869 | 3 | 0.02% | 1 | 0.01% |
| 564 | Arp2/3 protein complex subunit p16 (ARC16) =AF006088 (ORF) | NM_005717.1 | 3 | 0.02% | 1 | 0.01% |
| 565 | eukaryotic translation initiation factor 3, subunit 3 (gamma, 40kD) | gi4503514 | 3 | 0.02% | 1 | 0.01% |
| 566 | zinc finger protein SLUG (SLUG) gene | AF084243.1 | 3 | 0.02% | 1 | 0.01% |
| 567 | KIAA0038 gene | D26068.1 | 3 | 0.02% | 1 | 0.01% |
| 568 | U50HG genes for U50' snoRNA and U50 snoRNA, complete sequence | AB017710 | 3 | 0.02% | 1 | 0.01% |
| 569 | RAD21 (S. pombe) homolog (RAD21) (=X98294) | gi5453993 | 3 | 0.02% | 1 | 0.01% |

Figure 14 - Relative EST Frequency of Unique Known Genes Common to Fetal and Normal cDNA Libraries - Page 10 of 17

| | | | | | | |
|---|---|---|---|---|---|---|
| 466 | MHC class 1 region | AF055066 | 1 | 0.01% | 2 | 0.01% |
| 467 | plastin 3 (T isoform) (PLS3) | NM_005032.2 | 1 | 0.01% | 2 | 0.01% |
| 468 | fibroblast growth factor 2 (basic)(FGF2) | NM_002006.1 | 1 | 0.01% | 2 | 0.01% |
| 469 | NADH dehydrogenase(ubiquinone) 1, alpha/beta subcomplex, 1 (8kD, SDA | NM_005003.1 | 1 | 0.01% | 2 | 0.01% |
| 470 | steroid sensitive gene-1 protein (SSG-1) | AF223677.1 | 1 | 0.01% | 2 | 0.01% |
| 471 | NADH-UBIQUINONE OXIDOREDUCTASE CHAIN 4 | P03905 | 1 | 0.01% | 2 | 0.01% |
| 472 | PROS-27 | X59417 | 1 | 0.01% | 2 | 0.01% |
| 473 | prolylcarboxypeptidase (angiotensinase C) (PRCP) | NM_005040.1 | 1 | 0.01% | 2 | 0.01% |
| 474 | GLI-Kruppel family member GLI3 (Greig cephalopolysyndactyly syndrome) | gi4504014 | 1 | 0.01% | 2 | 0.01% |
| 475 | zinc finger protein 84 (HPF2) (ZNF84) | NM_003428.1 | 1 | 0.01% | 2 | 0.01% |
| 476 | oxysterol-binding protein | AB017026 | 1 | 0.01% | 2 | 0.01% |
| 477 | translation initiation factor (=D21853 hypothetical protein (KIAA0111)) | X79538 | 1 | 0.01% | 2 | 0.01% |
| 478 | prostate cancer tumor suppressor (N33) | NM_006765.1 | 1 | 0.01% | 2 | 0.01% |
| 479 | cytoskeletal tropomyosin TM30(nm) | X04588.1 | 1 | 0.01% | 2 | 0.01% |
| 480 | capping protein (actin filament) muscle Z-line, alpha 2 (CAPZA2) | NM_006136.1 | 1 | 0.01% | 2 | 0.01% |
| 481 | chaperonin containing TCP1,subunit 8 (theta) (CCT8)(ORF) | NM_006585.1 | 1 | 0.01% | 2 | 0.01% |
| 482 | integrin, alpha E (antigen CD103, human mucosal lymphocyte antigen 1; a | NM_002208.3 | 1 | 0.01% | 2 | 0.01% |
| 483 | chondrosarcoma-associated protein 2 (CSA2) | AF182645.1 | 1 | 0.01% | 2 | 0.01% |
| 484 | housekeeping (Q1Z 7F5) gene | M81806.1 | 1 | 0.01% | 2 | 0.01% |
| 485 | KIAA0671 | AB014571.1 | 1 | 0.01% | 2 | 0.01% |
| 486 | KIAA1376 protein | AB037797.1 | 1 | 0.01% | 2 | 0.01% |
| 487 | serine palmitoyl transferase | AF111168.2 | 1 | 0.01% | 2 | 0.01% |
| 488 | NADH-ubiquinone oxidoreductase B17 | AF067167.1 | 1 | 0.01% | 2 | 0.01% |
| 489 | basic transcription factor 3 (RefSeq aa 4e-39) | NP_001198.1 | 1 | 0.01% | 2 | 0.01% |
| 490 | CGI-74 protein | AF151832.1 | 1 | 0.01% | 2 | 0.01% |
| 491 | coxsackievirus and adenovirus receptor (CXADR) | AF200465.1 | 1 | 0.01% | 2 | 0.01% |
| 492 | insulin receptor | L07782 | 1 | 0.01% | 2 | 0.01% |
| 493 | leptin receptor (ORF) | U66496 | 1 | 0.01% | 2 | 0.01% |
| 494 | protein-kinase, interferon-inducible double stranded RNA dependent inhibit | NP_006251.1 | 1 | 0.01% | 2 | 0.01% |
| 495 | high-glucose-regulated protein 8 (HGRG8) | AF192968.1 | 1 | 0.01% | 2 | 0.01% |
| 496 | prefoldin 1 (PFDN1) | NM_002622.1 | 1 | 0.01% | 2 | 0.01% |
| 497 | KIAA0993 | AB023210.1 | 1 | 0.01% | 2 | 0.01% |
| 498 | Nijmegen breakage syndrome 1 (nibrin) (NBS1) | NM_002485.2 | 1 | 0.01% | 2 | 0.01% |
| 499 | topoisomerase IIb mRNA,(= TOP2 mRNA for DNA topoisomeraseII ) | U54831.1 | 1 | 0.01% | 2 | 0.01% |
| 500 | CUG triplet repeat,RNA-binding protein 2 (CUGBP2), (=apoptosis-related F | NM_006561.1 | 1 | 0.01% | 2 | 0.01% |
| 501 | galactosidase, alpha (GLA) | NM_000169.1 | 1 | 0.01% | 2 | 0.01% |
| 502 | methionine adenosyltransferase alpha subunit | L43509 | 1 | 0.01% | 2 | 0.01% |
| 503 | cysteine protease | D55696.1 | 1 | 0.01% | 2 | 0.01% |
| 504 | six transmembrane epithelial antigen of prostate (STEAP1) | AF186249.1 | 1 | 0.01% | 2 | 0.01% |
| 505 | GTT1 | AF270647 | 1 | 0.01% | 2 | 0.01% |
| 506 | HSPC033 protein (HSPC033) | NM_014041.1 | 1 | 0.01% | 2 | 0.01% |
| 507 | retinal pigment epithelium | L07393.1 | 1 | 0.01% | 2 | 0.01% |
| 508 | pyrroline-5-carboxylate reductase 1 (PYCR1) | NM_006907.1 | 1 | 0.01% | 2 | 0.01% |
| 509 | S-adenosylmethionine decarboxylase 1 (AMD1) | NM_001634.3 | 1 | 0.01% | 2 | 0.01% |
| 510 | sorting nexin 1 (SNX1) | NM_003099.1 | 1 | 0.01% | 2 | 0.01% |
| 511 | TRAM-like protein (KIAA0057), mRNA | NM_012288.1 | 1 | 0.01% | 2 | 0.01% |
| 512 | bromodomain-containing 2 (BRD2)= KIAA9001 | NM_005104.1 | 1 | 0.01% | 2 | 0.01% |
| 513 | laminin, beta 2 (laminin S)(LAMB2) mRNA | NM_002292.1 | 1 | 0.01% | 2 | 0.01% |
| 514 | glutamate dehydrogenase 1 (GLUD1) | NM_005271.1 | 1 | 0.01% | 2 | 0.01% |
| 515 | leptin receptor gene-related protein (HSOBRGRP) | NM_017526.1 | 1 | 0.01% | 2 | 0.01% |
| 516 | Ser/Arg-related nuclear matrix protein (plenty of prolines 101-like) (SRM16 | NM_005839.1 | 1 | 0.01% | 2 | 0.01% |
| 517 | serum-inducible kinase (SNK) | AF223574.1 | 1 | 0.01% | 2 | 0.01% |

Figure 14 - Relative EST Frequency of Unique Known Genes Common to Fetal and Normal cDNA Libraries - Page 12 of 17

| | | | | | | |
|---|---|---|---|---|---|---|
| 570 | transformer-2 alpha (htra-2 alpha) | U53209.1 | 3 | 0.02% | 1 | 0.01% |
| 571 | karyopherin (importin) beta 1 (KPNB1) (=L38951 importin beta subunit) | gi4504904 | 3 | 0.02% | 1 | 0.01% |
| 572 | endothelial differentiation-related factor 1 (EDF1) | NM_003792.1 | 3 | 0.02% | 1 | 0.01% |
| 573 | G8 protein (G8) | NM_016947.1 | 3 | 0.02% | 1 | 0.01% |
| 574 | KIAA0107 | D14663 | 3 | 0.02% | 1 | 0.01% |
| 575 | KIAA0325 gene | AB002323.1 | 3 | 0.02% | 1 | 0.01% |
| 576 | xeroderma pigmentosum group E UV-damaged DNA binding factor = NM_( | U32986.1 | 3 | 0.02% | 1 | 0.01% |
| 577 | replication factor C (activator 1) 1 (145kD) (RFC1) mRNA | NM_002913.1 | 3 | 0.02% | 1 | 0.01% |
| 578 | hexokinase 1 (HK1) (=AF016365;X66957) | M75126 | 3 | 0.02% | 1 | 0.01% |
| 579 | DNA-dependent protein kinase catalytic subunit (DNA-PKcs) | U47077.3 | 3 | 0.02% | 1 | 0.01% |
| 580 | nucleosome assembly protein 1-like 1 (NAP1L1) | XM_047969.1 | 3 | 0.02% | 1 | 0.01% |
| 581 | MHC class I (HLA-A) | U59701 | 3 | 0.02% | 1 | 0.01% |
| 582 | signal sequence receptor, beta (translocon-associated protein beta) (SSR2 | X74104 | 3 | 0.02% | 1 | 0.01% |
| 583 | KIAA0251 | D87438 | 3 | 0.02% | 1 | 0.01% |
| 584 | eIF4E-like cap-binding protein (4EHP) (=translation initiation factor 4e ) | NM_004846.1 | 3 | 0.02% | 1 | 0.01% |
| 585 | RNA binding motif protein 5 (RBM5) | AF091263.1 | 3 | 0.02% | 1 | 0.01% |
| 586 | isolate Liv chaperone protein HSP90 beta (HSP90BETA) | AF275719.1 | 3 | 0.02% | 1 | 0.01% |
| 587 | echinoderm miCRotubule-associated protein homolog HuEMAP | U97018 | 3 | 0.02% | 1 | 0.01% |
| 588 | endozepine (putative ligand of benzodiazepine receptor) | M15887.1 | 2 | 0.01% | 1 | 0.01% |
| 589 | RAN, member RAS oncogene family (RAN), mRNA /cds=(114,764) /gb=NI | Hs.10842 | 2 | 0.01% | 1 | 0.01% |
| 590 | actin-related protein Arp3 (ARP3)(actin-related protein 3 yeast)homolog(AC | AF006083.1 | 2 | 0.01% | 1 | 0.01% |
| 591 | biglycan BGN | U11686.1 | 2 | 0.01% | 1 | 0.01% |
| 592 | Eukaryotic translation initiation factor 2, subunit 2 (beta, 38kD)(EIF2S2) | NM_003908.1 | 2 | 0.01% | 1 | 0.01% |
| 593 | CGI-149 protein | AF151907.1 | 2 | 0.01% | 1 | 0.01% |
| 594 | basic transCRiption factor 2 p44 (btf2p44) gene, partial cds, neuronal apop | U80017.1 | 2 | 0.01% | 1 | 0.01% |
| 595 | CD36 antigen | L06850.1 | 2 | 0.01% | 1 | 0.01% |
| 596 | KIAA0436 | AB007896 | 2 | 0.01% | 1 | 0.01% |
| 597 | growth arrest specific transCRipt 5 gene | AF141346.1 | 2 | 0.01% | 1 | 0.01% |
| 598 | ARP2/3 protein complex subunit 34 (ARC34) | NM_005731.1 | 2 | 0.01% | 1 | 0.01% |
| 599 | high mobility group 2 protein (HMG-2) | M83665 | 2 | 0.01% | 1 | 0.01% |
| 600 | pyruvate dehydrogenase (lipoamide) alpha 1 (PDHA1) | NM_000284.1 | 2 | 0.01% | 1 | 0.01% |
| 601 | sarcoglycan, beta (43kD dystrophin-associated glycoprotein) (SGCB) | NM_000232.1 | 2 | 0.01% | 1 | 0.01% |
| 602 | tubulin-specific chaperone a (TBCA) (=AF038952 cofactor A protein) | gi4759211 | 2 | 0.01% | 1 | 0.01% |
| 603 | KIAA0810 | AB018353.1 | 2 | 0.01% | 1 | 0.01% |
| 604 | fatty acid binding protein 5 (psoriasis-associated) (FABP5) | NM_001444.1 | 2 | 0.01% | 1 | 0.01% |
| 605 | ubiquinol-cytochrome c reductase core protein II (UQCRC2)(ORF) = J0497 | NM_003366.1 | 2 | 0.01% | 1 | 0.01% |
| 606 | phosphoglycerate mutase 1 (brain) (PGAM1), mRNA /cds=(31,795) /gb=NI | Hs.181013 | 2 | 0.01% | 1 | 0.01% |
| 607 | enhancer of polycomb (Epc1) | AF079765 | 2 | 0.01% | 1 | 0.01% |
| 608 | KIAA0136 | D50926.1 | 2 | 0.01% | 1 | 0.01% |
| 609 | ubiquinol-cytochrome c reductase (6.4kD) subunit (UQCR) | NM_006830.1 | 2 | 0.01% | 1 | 0.01% |
| 610 | proteasome-associated pad1 homologue (POH1) 26S | U86782 | 2 | 0.01% | 1 | 0.01% |
| 611 | cathepsin F (CATSF) | AF071749 | 2 | 0.01% | 1 | 0.01% |
| 612 | membrane component, chromosome 11, surface marker 1 (M11S1) = Z48( | NM_005898.1 | 2 | 0.01% | 1 | 0.01% |
| 613 | signal transducer and activator of transcription 1, 91kD (STAT1)(=transcrip | NM_007315.1 | 2 | 0.01% | 1 | 0.01% |
| 614 | cyclin D2(=KIAK0002 gene) | NM_001759.1 | 2 | 0.01% | 1 | 0.01% |
| 615 | deoxyuridine triphosphatase(DUT) mRNA, complete cds | U62891.1 | 2 | 0.01% | 1 | 0.01% |
| 616 | cysteinyl-tRNA synthetase | L06845.1 | 2 | 0.01% | 1 | 0.01% |
| 617 | smooth muscle myosin alkali light chain | U02629.1 | 2 | 0.01% | 1 | 0.01% |
| 618 | DiGeorge syndrome critical region gene 6 (DGCR6) | NM_005675.1 | 2 | 0.01% | 1 | 0.01% |
| 619 | cold inducible RNA-binding protein (CIRBP) | NM_001280.1 | 2 | 0.01% | 1 | 0.01% |
| 620 | HSPC037 protein (LOC51659) | NM_016095.1 | 2 | 0.01% | 1 | 0.01% |
| 621 | nuclear distribution gene C (A.nidulans) homolog (NUDC) | NM_006600.1 | 2 | 0.01% | 1 | 0.01% |

Figure 14 - Relative EST Frequency of Unique Known Genes Common to Fetal and Normal cDNA Libraries - Page 13 of 17

| | | | | | | |
|---|---|---|---|---|---|---|
| 622 | thiosulfate sulfurtransferase (rhodanese) (TST) | X59434 | 2 | 0.01% | 1 | 0.01% |
| 623 | TL27 (from PC3 cell line) | X75684 | 2 | 0.01% | 1 | 0.01% |
| 624 | WW domain binding protein-1 (ORF) | U79457.17 | 2 | 0.01% | 1 | 0.01% |
| 625 | acyl-Coenzyme A dehydrogenase, very long chain (ACADVL), nuclear gen | NM_000018.1 | 2 | 0.01% | 1 | 0.01% |
| 626 | transducin (beta) like 2 (TBL2) | NM_012453.1 | 2 | 0.01% | 1 | 0.01% |
| 627 | small nuclear ribonucleoprotein polypeptide F (SNRPF) | NM_003095.1 | 2 | 0.01% | 1 | 0.01% |
| 628 | coatomer protein complex, subunit alpha (COPA), mRNA | NM_004371.2 | 2 | 0.01% | 1 | 0.01% |
| 629 | sorcin (SRI) | L12387.1 | 2 | 0.01% | 1 | 0.01% |
| 630 | capping protein (actin filament), gelsolin-like (CAPG) | M94345 | 2 | 0.01% | 1 | 0.01% |
| 631 | inositol 1,4,5-triphosphate receptor, type 3 (ITPR3) | U01062 | 2 | 0.01% | 1 | 0.01% |
| 632 | interleukin 11 receptor, alpha (IL11RA) | NM_004512.1 | 2 | 0.01% | 1 | 0.01% |
| 633 | EGR1 gene for early growth response protein 1 (=zinc finger protein)(= trar | AJ243425.1 | 2 | 0.01% | 1 | 0.01% |
| 634 | coatomer protein (COPA) | U24105 | 2 | 0.01% | 1 | 0.01% |
| 635 | mimecan (OGN) (OIF) | AF202167.1 | 1 | 0.01% | 1 | 0.01% |
| 636 | MAFB/Kreisler basic region/leucine zipper transCRiption factor (MAFB) | AF134157.1 | 1 | 0.01% | 1 | 0.01% |
| 637 | Ku autoimmune antigen gene | J04977.1 | 1 | 0.01% | 1 | 0.01% |
| 638 | myosin light chain 3 non-muscle (MLC3nm) | M31212 | 1 | 0.01% | 1 | 0.01% |
| 639 | ARP2/3 protein complex subunit p21 (ARC21=AF006086 (ORF) | NM_005719.1 | 1 | 0.01% | 1 | 0.01% |
| 640 | NS1-binding protein (NS1-BP) (=AB020657 KIAA0850) | AJ012449 | 1 | 0.01% | 1 | 0.01% |
| 641 | inositol polyphosphate 1-phosphatase gene (INPP1) (low match) | AF141324.1 | 1 | 0.01% | 1 | 0.01% |
| 642 | uridine diphosphoglucose pyrophosphorylase | U27460 | 1 | 0.01% | 1 | 0.01% |
| 643 | UDP-glucose pyrophosphorylase 2 (ORF) | NM_006759.1 | 1 | 0.01% | 1 | 0.01% |
| 644 | KIAA0332 | AB002330 | 1 | 0.01% | 1 | 0.01% |
| 645 | ras-related GTP-binding protein | AF106681.1 | 1 | 0.01% | 1 | 0.01% |
| 646 | non-histone chromosomal protein (HMG-1) | L08048.1 | 1 | 0.01% | 1 | 0.01% |
| 647 | lysosomal-associated membrane glycoprotein-1 (LAMP1) (=J04182) | L08582 | 1 | 0.01% | 1 | 0.01% |
| 648 | cornichon protein | AF070654.1 | 1 | 0.01% | 1 | 0.01% |
| 649 | KIAA0766 | AB018309.1 | 1 | 0.01% | 1 | 0.01% |
| 650 | Id-2H | D13891 | 1 | 0.01% | 1 | 0.01% |
| 651 | transCRiption factor (CBFB) | L20298 | 1 | 0.01% | 1 | 0.01% |
| 652 | KIAA1025 | AB028948.1 | 1 | 0.01% | 1 | 0.01% |
| 653 | LGMD2B | AJ007973 | 1 | 0.01% | 1 | 0.01% |
| 654 | KIAA0103 | D14659 | 1 | 0.01% | 1 | 0.01% |
| 655 | basic helix-loop-helix domain containing, class B, 2 (BHLHB2), mRNA /cds | Hs.171825 | 1 | 0.01% | 1 | 0.01% |
| 656 | eukaryotic translation initiation factor 3, subunit 10 (theta, 150/170kD) | gi4503508 | 1 | 0.01% | 1 | 0.01% |
| 657 | protein kinase C inhibitor-I | U27143 | 1 | 0.01% | 1 | 0.01% |
| 658 | heterogeneous nuclear ribonucleoprotein R (ORF) | AF000364 | 1 | 0.01% | 1 | 0.01% |
| 659 | growth arrest and DNA-damage-inducible, alpha (GADD45A) | NM_001924.1 | 1 | 0.01% | 1 | 0.01% |
| 660 | KIAA0077 gene | D38521.1 | 1 | 0.01% | 1 | 0.01% |
| 661 | CYTOCHROME C OXIDASE POLYPEPTIDE III | P00414 | 1 | 0.01% | 1 | 0.01% |
| 662 | farnesyl-protein transferase alpha-subunit | L00634 | 1 | 0.01% | 1 | 0.01% |
| 663 | Polyadenylate binding protein | U75686.1 | 1 | 0.01% | 1 | 0.01% |
| 664 | Splicing factor proline/glutamine rich (polypyrimidine tract-binding protein-a | NM_005066.1 | 1 | 0.01% | 1 | 0.01% |
| 665 | myosin class I, myh-1c | AJ001382 | 1 | 0.01% | 1 | 0.01% |
| 666 | activin A receptor, type I (ACVR1) =Z22534 ALK-2 | NM_001105.1 | 1 | 0.01% | 1 | 0.01% |
| 667 | KIAA1058 protein | AB028981.1 | 1 | 0.01% | 1 | 0.01% |
| 668 | tetraspan TM4SF(TSPAN-6) | AF053453 | 1 | 0.01% | 1 | 0.01% |
| 669 | Rosenthal fiber protein (alpha-B-CRystallin) | M24906 | 1 | 0.01% | 1 | 0.01% |
| 670 | ring finger protein 4 (RNF4) | gi4506560 | 1 | 0.01% | 1 | 0.01% |
| 671 | nuclear factor (erythroid-derived 2)-like 2 (NFE2L2) (=S74017 Nrf2=NF-E2- | gi5453775 | 1 | 0.01% | 1 | 0.01% |
| 672 | myosin-binding protein C, cardiac (MYBPC3) | NM_000256.1 | 1 | 0.01% | 1 | 0.01% |
| 673 | IQ motif containing GTPase activating protein 1 (IQGAP1) | NM_003870.1 | 1 | 0.01% | 1 | 0.01% |

Figure 14 Relative EST Frequency of Unique Known Genes Common to Fetal and Normal cDNA Libraries - Page 14 of 17

| | | | | | | |
|---|---|---|---|---|---|---|
| 674 | ATP synthase, H transporting, mitochondrial F0 complex, subunit f, isoform | NM_004889.1 | 1 | 0.01% | 1 | 0.01% |
| 675 | cytochrome c oxidase subunit Vb (coxVb) | M19961 | 1 | 0.01% | 1 | 0.01% |
| 676 | hect domain and RLD 2(HERC2) (=KIAA0393) | NM_004667.2 | 1 | 0.01% | 1 | 0.01% |
| 677 | integrin cytoplasmic domain associated protein (Icap-1a) | AF012023 | 1 | 0.01% | 1 | 0.01% |
| 678 | KIAA0235 | D87078 | 1 | 0.01% | 1 | 0.01% |
| 679 | KIAA0252 | D87440 | 1 | 0.01% | 1 | 0.01% |
| 680 | KIAA0693 | AB014593 | 1 | 0.01% | 1 | 0.01% |
| 681 | nickel-specific induction protein (Cap43) | AF004162.1 | 1 | 0.01% | 1 | 0.01% |
| 682 | PRO1608 | AF119850.1 | 1 | 0.01% | 1 | 0.01% |
| 683 | phosphoribosyl pyrophosphate synthetase subunit I | D00860.1 | 1 | 0.01% | 1 | 0.01% |
| 684 | phospholipid sCRamblase 1 PLSCR1) | AF098642 | 1 | 0.01% | 1 | 0.01% |
| 685 | cytochrome oxidase subunit I (COI) and subunit II (COII) pseudogenes | AF035429.1 | 1 | 0.01% | 1 | 0.01% |
| 686 | wbsCR1 (WBSCR1) | AF045555.1 | 1 | 0.01% | 1 | 0.01% |
| 687 | proteasome (prosome, macropain) subunit, alpha type, 3 (PSMA3) | NM_002788.1 | 1 | 0.01% | 1 | 0.01% |
| 688 | CLP (CLPP) | L54057.1 | 1 | 0.01% | 1 | 0.01% |
| 689 | platelet-activating factor acetylhydrolase, isoform 1b, alpha subunit (PAFAH | 4557740 | 1 | 0.01% | 1 | 0.01% |
| 690 | P311 protein (P311), mRNA /cds=(202,408) /gb=NM_004772 /gi=4758865 | Hs.142827 | 1 | 0.01% | 1 | 0.01% |
| 691 | small EDRK-rich factor 1, long isoform (SERF1) (=btf2p44) | AF073519.1 | 1 | 0.01% | 1 | 0.01% |
| 692 | KIAA0592 (ORF) | AB011164 | 1 | 0.01% | 1 | 0.01% |
| 693 | lysophospholipase (LPL1) | AF081281 | 1 | 0.01% | 1 | 0.01% |
| 694 | KARP-1-binding protein 3 (=KIAA0470) | AB022859.1 | 1 | 0.01% | 1 | 0.01% |
| 695 | inducible 6-phosphofructo-2-kinase/fructose 2,6-bisphosphatase (IPFK-2) | AF056320 | 1 | 0.01% | 1 | 0.01% |
| 696 | reticulocalbin 1, EF-hand calcium binding domain (RCN1) | NM_002901.1 | 1 | 0.01% | 1 | 0.01% |
| 697 | NADH dehydrogenase (ubiquinone) 1 beta subcomplex, 5 (16kD, SGDH) | NM_002492.1 | 1 | 0.01% | 1 | 0.01% |
| 698 | major histocompatibility complex, class II, DR beta 1 (HLA-DRB1) | NM_002124.1 | 1 | 0.01% | 1 | 0.01% |
| 699 | nerve growth factor (HBNF-1)(= OSF-1)(= pleiotropin) | M57399.1 | 1 | 0.01% | 1 | 0.01% |
| 700 | ras-related C3 botulinum toxin substrate (rac) | M29870 | 1 | 0.01% | 1 | 0.01% |
| 701 | HSPC328 | AF161446.1 | 1 | 0.01% | 1 | 0.01% |
| 702 | Glutathione transferase omega (GSTO1) | AF212303.1 | 1 | 0.01% | 1 | 0.01% |
| 703 | NRAS-related gene (D1S155E) (=DKFZp586J0620) | NM_007158.1 | 1 | 0.01% | 1 | 0.01% |
| 704 | RAB13, member RAS oncogene family (RAB13) mRNA | NM_002870.1 | 1 | 0.01% | 1 | 0.01% |
| 705 | NADH dehydrogenase (ubiquinone) 1, subcomplex unknown, 1 (6kD, KFYI | NM_002494.1 | 1 | 0.01% | 1 | 0.01% |
| 706 | NADH dehydrogenase (ubiquinone) Fe-S protein 6 (13kD) (NADH-coenzym | NM_004553.1 | 1 | 0.01% | 1 | 0.01% |
| 707 | Na,K-ATPase beta subunit (ATP1B) | M25160 | 1 | 0.01% | 1 | 0.01% |
| 708 | retinoblastoma-binding protein 7 (RBBP7) | NM_002893.1 | 1 | 0.01% | 1 | 0.01% |
| 709 | zinc finger protein 133 (clone pHZ-13) (ZNF133) | NM_003434.1 | 1 | 0.01% | 1 | 0.01% |
| 710 | retinoic acid suppression protein A (RSG-A) | AF038964.1 | 1 | 0.01% | 1 | 0.01% |
| 711 | latent transforming growth factor beta binding protein 2 (LTBP2) | NM_000428.1 | 1 | 0.01% | 1 | 0.01% |
| 712 | fer-1 (C. elegans)-like 3 (FER1L3) (=AF182317 myoferlin (MYOF)) | NM_013451.1 | 1 | 0.01% | 1 | 0.01% |
| 713 | telomeric repeat binding factor (TRF1) | U40705.1 | 1 | 0.01% | 1 | 0.01% |
| 714 | prefoldin 2 (PFDN2) | NM_012394.1 | 1 | 0.01% | 1 | 0.01% |
| 715 | ELK1 (ELK1) | AF080616 | 1 | 0.01% | 1 | 0.01% |
| 716 | HSPC162 protein (HSPC162) | NM_014183.1 | 1 | 0.01% | 1 | 0.01% |
| 717 | HSPC218 | AF151052.1 | 1 | 0.01% | 1 | 0.01% |
| 718 | HSPC337 | AF161455.1 | 1 | 0.01% | 1 | 0.01% |
| 719 | iduronate sulphate sulphatase (IDS) gene | L35485.1 | 1 | 0.01% | 1 | 0.01% |
| 720 | KIAA0081 | D42039 | 1 | 0.01% | 1 | 0.01% |
| 721 | KIAA0099 protein, partial cds | D43951.1 | 1 | 0.01% | 1 | 0.01% |
| 722 | KIAA0152 (cytotoxic T-cell membrane glycoprotein Ly-3 isolog) | NM_014730.1 | 1 | 0.01% | 1 | 0.01% |
| 723 | KIAA0188 | D80010 | 1 | 0.01% | 1 | 0.01% |
| 724 | KIAA0419 gene product (KIAA0419) | NM_014711.1 | 1 | 0.01% | 1 | 0.01% |
| 725 | KIAA0458 | AB007927.1 | 1 | 0.01% | 1 | 0.01% |

Figure 14 - Relative EST Frequency of Unique Known Genes Common to Fetal and Normal cDNA Libraries - Page 15 of 17

| | | | | | | |
|---|---|---|---|---|---|---|
| 726 | KIAA0484 | AB007953.1 | 1 | 0.01% | 1 | 0.01% |
| 727 | KIAA0698 protein | AB014596 | 1 | 0.01% | 1 | 0.01% |
| 728 | KIAA0851 gene | AJ297357.1 | 1 | 0.01% | 1 | 0.01% |
| 729 | KIAA1162 | AB032988.1 | 1 | 0.01% | 1 | 0.01% |
| 730 | channel-like integral membrane protein (AQP-1) | U41518.1 | 1 | 0.01% | 1 | 0.01% |
| 731 | citrin (SLC25A13) | AF118838.1 | 1 | 0.01% | 1 | 0.01% |
| 732 | L3 pigment (L3) | AF189062.3 | 1 | 0.01% | 1 | 0.01% |
| 733 | ubiquinol-cytochrome c reductase, Rieske iron-sulfur polypeptide 1 (UQCR | 5174742 | 1 | 0.01% | 1 | 0.01% |
| 734 | matrix metalloprotease(ADAMTS1) mRNA, complete cds | AF207664.1 | 1 | 0.01% | 1 | 0.01% |
| 735 | myocyte-specific enhancer factor 2A (MEF2A) | U49020 | 1 | 0.01% | 1 | 0.01% |
| 736 | retinoblastoma-binding protein 4 (RBBP4) =X74262 RbAp48 | NM_005610.1 | 1 | 0.01% | 1 | 0.01% |
| 737 | T-box transCRiption factor (Tbx15) | AF041822 | 1 | 0.01% | 1 | 0.01% |
| 738 | Y-linked zinc finger protein (ZFY) gene (=DKFZp434F2311) | AF114156.1 | 1 | 0.01% | 1 | 0.01% |
| 739 | polyadenylate binding protein(TIA-1) | M77142 | 1 | 0.01% | 1 | 0.01% |
| 740 | tetraspanin TM4-A | AF133423.1 | 1 | 0.01% | 1 | 0.01% |
| 741 | calponin 3, acidic (CNN3) | NM_001839.1 | 1 | 0.01% | 1 | 0.01% |
| 742 | nonmuscle myosin heavy chain (NMHC) | M31013 | 1 | 0.01% | 1 | 0.01% |
| 743 | glucocorticoid receptor (GRL) gene | U80947.1 | 1 | 0.01% | 1 | 0.01% |
| 744 | CDC-like kinase (CLK) | NM_004071.1 | 1 | 0.01% | 1 | 0.01% |
| 745 | tyrosylprotein sulfotransferase-1(TPST1) | AF038009 | 1 | 0.01% | 1 | 0.01% |
| 746 | GTPase-activating protein ras p21 (RASA) | M23379 | 1 | 0.01% | 1 | 0.01% |
| 747 | CC chemokine gene cluster | AF088219.1 | 1 | 0.01% | 1 | 0.01% |
| 748 | ARP2 (actin-related protein 2, yeast) homolog (ACTR2) | NM_005722.1 | 1 | 0.01% | 1 | 0.01% |
| 749 | cdk inhibitor p21 binding protein (TOK-1),(ORF)= AB040450.1 | NM_016567.1 | 1 | 0.01% | 1 | 0.01% |
| 750 | KIAA0160 | D63881 | 1 | 0.01% | 1 | 0.01% |
| 751 | PRO0989 | AF116614 | 1 | 0.01% | 1 | 0.01% |
| 752 | transposon-like element | M23161 | 1 | 0.01% | 1 | 0.01% |
| 753 | WSB1 isoform 2 (WSB1) | AF240696.1 | 1 | 0.01% | 1 | 0.01% |
| 754 | UDP-N-acetyl-alpha-D-galactosamine:polypeptide | NM_004481.1 | 1 | 0.01% | 1 | 0.01% |
| 755 | Rab5 GDP/GTP exchange factor homologue (RABEX5) | NM_014504.1 | 1 | 0.01% | 1 | 0.01% |
| 756 | eukaryotic translation initiation factor 3, subunit 7 (zeta, 66/67kD) | NM_003753.1 | 1 | 0.01% | 1 | 0.01% |
| 757 | Id3 gene for HLH type transcription factor | X73428.1 | 1 | 0.01% | 1 | 0.01% |
| 758 | nuclear autoantigenic sperm protein (histone-binding) (NASP) | NM_002482.1 | 1 | 0.01% | 1 | 0.01% |
| 759 | APEX nuclease (multifunctional DNA repair enzyme) (RefSeq aa 4e-74) | NP_001632.1 | 1 | 0.01% | 1 | 0.01% |
| 760 | phosphoribosyl pyrophosphate synthetase-associated protein 1 (PRPSAP1 | NM_002766.1 | 1 | 0.01% | 1 | 0.01% |
| 761 | low density lipoprotein-related protein 1 (alpha-2-macroglobulin receptor) (l | NM_002332.1 | 1 | 0.01% | 1 | 0.01% |
| 762 | poly(A)-binding protein, nuclear 1 (PABPN1) | gi4758875 | 1 | 0.01% | 1 | 0.01% |
| 763 | microfibrillar-associated protein 1 (MFAP1) | NM_005926.1 | 1 | 0.01% | 1 | 0.01% |
| 764 | lamin B receptor (LBR) | NM_002296.1 | 1 | 0.01% | 1 | 0.01% |
| 765 | guanine nucleotide binding protein 10 (GNG10) | NM_004125.1 | 1 | 0.01% | 1 | 0.01% |
| 766 | histone H2A.F/Z variant (H2AV) | AF081192 | 1 | 0.01% | 1 | 0.01% |
| 767 | adipose differentiation-related protein (ADFP) | XM_048266.2 | 1 | 0.01% | 1 | 0.01% |
| 768 | GL004 protein (RefSeq aa 2e-34) | NP_064579.1 | 1 | 0.01% | 1 | 0.01% |
| 769 | HDCMC29P | AF068295.1 | 1 | 0.01% | 1 | 0.01% |
| 770 | HSPC229 | AF151063.1 | 1 | 0.01% | 1 | 0.01% |
| 771 | KIAA0117 | D38491 | 1 | 0.01% | 1 | 0.01% |
| 772 | KIAA0324 | AB002322.2 | 1 | 0.01% | 1 | 0.01% |
| 773 | KIAA0447 | AB007916 | 1 | 0.01% | 1 | 0.01% |
| 774 | KIAA0470 | AB007939 | 1 | 0.01% | 1 | 0.01% |
| 775 | KIAA0488 | AB007957.1 | 1 | 0.01% | 1 | 0.01% |
| 776 | KIAA0770 | AB018313.1 | 1 | 0.01% | 1 | 0.01% |
| 777 | KIAA0772 gene | NM_014835.1 | 1 | 0.01% | 1 | 0.01% |

Figure 14 - Relative EST Frequency of Unique Known Genes Common to Fetal and Normal cDNA Libraries - Page 16 of 17

| | | | | | | |
|---|---|---|---|---|---|---|
| 778 | KIAA1190 | AB033016.1 | 1 | 0.01% | 1 | 0.01% |
| 779 | KIAA1404 | AB037825.1 | 1 | 0.01% | 1 | 0.01% |
| 780 | KIAA1507(=FLJ20654) | AB040940.1 | 1 | 0.01% | 1 | 0.01% |
| 781 | MCT-1 protein (MCT-1) | NM_014060.1 | 1 | 0.01% | 1 | 0.01% |
| 782 | microspherule protein 1 (MCRS1) | NM_006337.1 | 1 | 0.01% | 1 | 0.01% |
| 783 | neuroblastoma-amplified protein | AF056195 | 1 | 0.01% | 1 | 0.01% |
| 784 | NICE-5 protein =AF116721) PRO3094 | AJ243666 | 1 | 0.01% | 1 | 0.01% |
| 785 | non-ocogenic Rho GTPase-specific GTP exchange factor (proto-LBC) | AF127481.1 | 1 | 0.01% | 1 | 0.01% |
| 786 | PTPRF interacting protein, bindingprotein 1 (liprin beta 1) (RefSeq aa 2e-3 | NP_003613.1 | 1 | 0.01% | 1 | 0.01% |
| 787 | testis specific protein | AF146738.1 | 1 | 0.01% | 1 | 0.01% |
| 788 | WRN (WRN) | AF181897.1 | 1 | 0.01% | 1 | 0.01% |
| 789 | sodium calcium exchanger 1 (NCX1) | U83657 | 1 | 0.01% | 1 | 0.01% |
| 790 | paraoxonase 2 (PON2) | NM_000305.1 | 1 | 0.01% | 1 | 0.01% |
| 791 | TPI1 gene for triosephosphate isomerase | X69723.1 | 1 | 0.01% | 1 | 0.01% |
| 792 | adenylosuccinate lyase(ADSL) | NM_000026.1 | 1 | 0.01% | 1 | 0.01% |
| 793 | purine nucleoside phosphorylase | X00737 | 1 | 0.01% | 1 | 0.01% |
| 794 | enoyl-CoA hydratase/3-hydroxyacyl-CoA dehydrogenese alpha-subunit of t | D16480 | 1 | 0.01% | 1 | 0.01% |
| 795 | dolichyl-phosphate mannosyltransferase polypeptide 1, catalytic subunit (D | NM_003859.1 | 1 | 0.01% | 1 | 0.01% |
| 796 | leucine zipper, down-regulated in cancer 1 (LDOC1) | NM_012317.1 | 1 | 0.01% | 1 | 0.01% |
| 797 | ORNITHINE DECARBOXYLASE (ODC) | spP00860 | 1 | 0.01% | 1 | 0.01% |
| 798 | alpha-1-antitrypsin | K01396.1 | 1 | 0.01% | 1 | 0.01% |
| 799 | F-box protein 7 (FBX7) | NM_012179.1 | 1 | 0.01% | 1 | 0.01% |
| 800 | peroxisomal biogenesis factor 12 (PEX12) | NM_000286.1 | 1 | 0.01% | 1 | 0.01% |
| 801 | bithoraxoid-like protein (BLP)(= HSPC162 protein (HSPC162)) | AF165516.1 | 1 | 0.01% | 1 | 0.01% |
| 802 | glioma-amplified sequence-41 (GAS41) | NM_006530.1 | 1 | 0.01% | 1 | 0.01% |
| 803 | B cell RAG associated protein (BRAG) (=AB011170 hypothetical protein (K | AF026477 | 1 | 0.01% | 1 | 0.01% |
| 804 | jun D proto-oncogene (JUND) | NM_005354.1 | 1 | 0.01% | 1 | 0.01% |
| 805 | mel transforming oncogene (derived from cell line NK14)- RAB8 homolog ( | NM_005370.2 | 1 | 0.01% | 1 | 0.01% |
| 806 | nuclear factor of activated T-cells, cytoplasmic 4 (NFATC4) mRNA | NM_004554.1 | 1 | 0.01% | 1 | 0.01% |
| 807 | transCRiption factor ETR101 | M62831 | 1 | 0.01% | 1 | 0.01% |
| 808 | M5-14 protein (LOC51300) | NM_016589.1 | 1 | 0.01% | 1 | 0.01% |
| 809 | splicing factor arginine/serine-rich 7 (SFRS7) gene | L41887.1 | 1 | 0.01% | 1 | 0.01% |
| 810 | splicing factor similar to dnaJ (SPF31) | NM_014280.1 | 1 | 0.01% | 1 | 0.01% |
| 811 | splicing factor SRp30c gene | U87279.1 | 1 | 0.01% | 1 | 0.01% |
| 812 | U5 snRNP-associated 102 kDa protein | AF221842.1 | 1 | 0.01% | 1 | 0.01% |
| 813 | RNA polymerase I 40kD subunit | AF047441 | 1 | 0.01% | 1 | 0.01% |
| 814 | EBNA-2 co-activator (100kD) (p100) | NM_014390.1 | 1 | 0.01% | 1 | 0.01% |
| 815 | brain and reproductive organ-expressed (TNFRSF1A modulator) (BRE) | NM_004899.1 | 1 | 0.01% | 1 | 0.01% |
| 816 | ALEX3 protein (ALEX3) | NM_016607.1 | 1 | 0.01% | 1 | 0.01% |
| 817 | beta-subunit signal transducing proteins GS/Gi (clone 24596) | AF070597 | 1 | 0.01% | 1 | 0.01% |
| 818 | carbonyl reductase 1 (CBR1) | NM_001757.1 | 1 | 0.01% | 1 | 0.01% |
| 819 | thioredoxin-like, 32kD (TXNL) | NM_004786.1 | 1 | 0.01% | 1 | 0.01% |
| 820 | clathrin heavy chain (=D21260 human hypothetical protein (KIAA0034)) | J03583 | 1 | 0.01% | 1 | 0.01% |
| 821 | sodium-dependent multivitamin transporter (SMVT) gene, partial cds | AF116241.1 | 1 | 0.01% | 1 | 0.01% |
| 822 | synaptic glycoprotein SC2 spliced variant | AF038958 | 1 | 0.01% | 1 | 0.01% |
| 823 | microtubule-associated protein 1a (MAP1A) | U38292.1 | 1 | 0.01% | 1 | 0.01% |
| 824 | platelet-derived growth factor A chain (PDGFA) (=X06374) | M83575 | 1 | 0.01% | 1 | 0.01% |
| 825 | v-jun avian sarcoma virus 17 oncogene homolog (JUN), (=c-jun proto onco | NM_002228.2 | 1 | 0.01% | 1 | 0.01% |
| 826 | Rab9 effector p40 | Z97074 | 1 | 0.01% | 1 | 0.01% |
| 827 | Rho guanine nucleotide-exchange factor, splice variant NET1A | AJ010045.1 | 1 | 0.01% | 1 | 0.01% |
| 828 | p8 protein (candidate of metastasis 1) (P8) | NM_012385.1 | 1 | 0.01% | 1 | 0.01% |
| 829 | uncharacterized bone marrow protein BM042 (BM042) (=DKFZp761A1124 | NM_018458.1 | 1 | 0.01% | 1 | 0.01% |

Figure 14 - Relative EST Frequency of Unique Known Genes Common to Fetal and Normal cDNA Libraries - Page 17 of 17

| | | | | | | |
|---|---|---|---|---|---|---|
| 830 | cullin 5 (CUL5) | NM_003478.1 | 1 | 0.01% | 1 | 0.01% |
| 831 | ADP-ribosylation factor 6 (ARF6) | NM_001663.2 | 1 | 0.01% | 1 | 0.01% |
| 832 | chloride channel nucleotide-sensitive, 1A (CLNS1A) | NM_001293.1 | 1 | 0.01% | 1 | 0.01% |
| 833 | JTV-1 (JTV-1) | U24169 | 1 | 0.01% | 1 | 0.01% |
| 834 | membrane protein-like protein | U21556 | 1 | 0.01% | 1 | 0.01% |
| 835 | integrin alpha-11 subunit precursor (ITGA11) | AF109681.1 | 1 | 0.01% | 1 | 0.01% |
| 836 | TRAF and TNF receptor associated protein (ttrap gene) | AJ269473.1 | 1 | 0.01% | 1 | 0.01% |
| 837 | chromodomain helicase DNA binding protein 4 (CHD4) | NM_001273.1 | 1 | 0.01% | 1 | 0.01% |
| 838 | Gu protein = PC6010 RNA helicase Gu | U41387.1 | 1 | 0.01% | 1 | 0.01% |
| 839 | camptothecin resistant clone CEM/C2 DNA topoisomerase I mRNA, partial | U07806.1 | 1 | 0.01% | 1 | 0.01% |
| 840 | cdc14 homologue | AF000367 | 1 | 0.01% | 1 | 0.01% |
| 841 | G1 to S phase transition 1 (GSPT1) | XM_055673.1 | 1 | 0.01% | 1 | 0.01% |
| 842 | CASP8 associated protein 2 (RefSeq aa 2e-87) | NP_036247.1 | 1 | 0.01% | 1 | 0.01% |
| 843 | programmed cell death 6 (PDCD6) | NM_013232.1 | 1 | 0.01% | 1 | 0.01% |
| 844 | polymerase (DNA-directed) kappa (POLK), mRNA /cds=(172,2784) /gb=NI | Hs.135756 | 1 | 0.01% | 1 | 0.01% |
| 845 | replication protein A2 (32kD)(RPA2) | NM_002946.1 | 1 | 0.01% | 1 | 0.01% |
| 846 | tumor neCRosis factor receptor | M58286 | 1 | 0.01% | 1 | 0.01% |
| 847 | tumor suppressor protein (101F6), putative | AF040704 | 1 | 0.01% | 1 | 0.01% |
| 848 | integral type I protein | NM_007364.1 | 1 | 0.01% | 1 | 0.01% |
| 849 | musculus DnaJ-like protein 1 (Dnajl1) | NM_007869.1 | 1 | 0.01% | 1 | 0.01% |
| 850 | BRI3 | AF272043.1 | 1 | 0.01% | 1 | 0.01% |
| 851 | novel protein (HSNOV1) | XM_017365.2 | 1 | 0.01% | 1 | 0.01% |
| 852 | basic leucine zipper nuclear factor 1 (JEM-1) (BLZF1) | NM_003666.1 | 1 | 0.01% | 1 | 0.01% |
| 853 | glycine cleavage system protein H (aminomethyl carrier) (RefSeq aa 2e-43 | NP_004474.1 | 1 | 0.01% | 1 | 0.01% |
| 854 | mitochondrial isoleucine tRNA synthetase, Length = 3387 | D28500.1 | 1 | 0.01% | 1 | 0.01% |
| 855 | LENG5 protein (LENG5), mRNA | NM_024075.1 | 1 | 0.01% | 1 | 0.01% |

Figure 15- Relative Est Frequency of Unique Known Genes Common to Mild and Severe cDNA Libraries - Page 1 of 19

| | Total ESTs from each library | | 12651 | | 14222 | |
|---|---|---|---|---|---|---|
| | Gene Name | Accession # | Mild OA | | Severe OA | |
| 1 | alpha gene sequence (=HSP90) | AF203815.1 | 580 | 4.58% | 408 | 2.87% |
| 2 | fibronectin (FN) | X02761.1 | 198 | 1.57% | 379 | 2.66% |
| 3 | collagen type III alpha 1 (COL3A1) | X06700 | 95 | 0.75% | 337 | 2.37% |
| 4 | beta-2 microglobulin gene (B2M) | gb\|AF072097.1 | 200 | 1.58% | 196 | 1.38% |
| 5 | mitochondrial genome (consensus sequence) | X62996 | 291 | 2.30% | 194 | 1.36% |
| 6 | lumican (LUM) | NM_002345.1 | 116 | 0.92% | 182 | 1.28% |
| 7 | collagen type I alpha 2 (COL1A2) | NM_000089.1 | 32 | 0.25% | 176 | 1.24% |
| 8 | thymosin beta-4 (TMSB4X) | M17733 | 95 | 0.75% | 156 | 1.10% |
| 9 | decorin (DCN) | NM_001920.1 | 234 | 1.85% | 154 | 1.08% |
| 10 | osteoblast specific factor 2 (OSF-2os) | D13666.1 | 1 | 0.01% | 123 | 0.86% |
| 11 | vimentin gene (VIM) | Z19554 | 46 | 0.36% | 102 | 0.72% |
| 12 | mitochondrion, complete genome (=AF382012.1 haplotype M*1 mitoch | NC_001807.2 | 114 | 0.90% | 92 | 0.65% |
| 13 | elongation factor 1 alpha 1 (EEF1A1) | NM_001402.1 | 36 | 0.28% | 89 | 0.63% |
| 14 | matrix Gla protein (MGP) | X53331 | 97 | 0.77% | 80 | 0.56% |
| 15 | ribosomal protein S27 (=(metallopanstimulin 1 MPS1) | NM_001030.1 | 36 | 0.28% | 70 | 0.49% |
| 16 | serine protease=HTRA serine protease (PRSS11)=AF157623.1 | Y07921 | 32 | 0.25% | 57 | 0.40% |
| 17 | ribosomal protein L7 | X52967 | 63 | 0.50% | 54 | 0.38% |
| 18 | proteoglycan 4 (=megakaryocyte stimulating factor) | AAB09089.1 | 287 | 2.27% | 51 | 0.36% |
| 19 | scrapie responsive protein 1 (SCRG1) | NM_007281.1 | 56 | 0.44% | 50 | 0.35% |
| 20 | transforming growth factor beta-induced, 68kD (TGFBI) | NM_000358.1 | 3 | 0.02% | 47 | 0.33% |
| 21 | calmodulin 1 (phosphorylase kinase, delta) (CALM1) | NM_006888.1 | 31 | 0.25% | 46 | 0.32% |
| 22 | NADH dehydrogenase (ubiquinone) 1 alpha subcomplex, 4 (9kD, MLR | NM_002489.1 | 14 | 0.11% | 46 | 0.32% |
| 23 | cytochrome c oxidase subunit VIc (COX6C) | NM_004374.1 | 22 | 0.17% | 44 | 0.31% |
| 24 | Ribosomal protein S20 (RPS20) | NM_001023.1 | 23 | 0.18% | 42 | 0.30% |
| 25 | osteonectin gene (SPARC) secreted protein, acidic,cysteine-rich | M25746.1 | 15 | 0.12% | 42 | 0.30% |
| 26 | tumor protein translationally-controlled 1 (TPT1) | NM_003295.1 | 26 | 0.21% | 37 | 0.26% |
| 27 | hexabrachion (tenascin C, cytotactin) (HXB) | NM_002160.1 | 7 | 0.06% | 37 | 0.26% |
| 28 | ribosomal protein L34 (RPL34) | NM_000995.1 | 22 | 0.17% | 36 | 0.25% |
| 29 | thioredoxin (TXN) | J04026 | 22 | 0.17% | 36 | 0.25% |
| 30 | asporin (ASPN) (LRR class 1) | NM_017680.1 | 24 | 0.19% | 35 | 0.25% |
| 31 | annexin A2 (ANXA2)(lipocortin II) | NM_004039.1 | 7 | 0.06% | 34 | 0.24% |
| 32 | transmembrane protein BRI | AF246221.1 | 37 | 0.29% | 33 | 0.23% |
| 33 | ferritin heavy chain | L20941.1 | 7 | 0.06% | 33 | 0.23% |
| 34 | ribosomal protein S25 (RPS25) | NM_001028.1 | 17 | 0.13% | 32 | 0.23% |
| 35 | connective tissue growth factor (CTGF) | U14750 | 44 | 0.35% | 31 | 0.22% |
| 36 | ribosomal protein L9 | U09953 | 12 | 0.09% | 30 | 0.21% |
| 37 | small nuclear ribonucleoprotein polypeptide G (SNRPG) | X85373 | 7 | 0.06% | 29 | 0.20% |
| 38 | ribosomal protein S3a | M77234 | 18 | 0.14% | 28 | 0.20% |
| 39 | translationally controlled tumor protein (TCTP) | X16064 | 17 | 0.13% | 28 | 0.20% |
| 40 | RIBOSOMAL PROTEIN L17 | spP18621 | 10 | 0.08% | 27 | 0.19% |
| 41 | ribosomal protein L21 | U14967.1 | 14 | 0.11% | 26 | 0.18% |
| 42 | ribosomal protein L31 | NM_000993.1 | 13 | 0.10% | 25 | 0.18% |
| 43 | mimecan (OGN) (OIF) | AF202167.1 | 19 | 0.15% | 24 | 0.17% |
| 44 | annexin I (lipocortin I) (ANX1) =X05908 (ORF) | NM_000700.1 | 11 | 0.09% | 24 | 0.17% |
| 45 | putative p150 | AAC51271.1 | 20 | 0.16% | 22 | 0.15% |
| 46 | deleted in split hand/split foot 1 (DSS1) | U41515 | 11 | 0.09% | 22 | 0.15% |
| 47 | mitochondrial ATPase coupling factor 6 subunit (ATP5A) | M37104 | 6 | 0.05% | 22 | 0.15% |
| 48 | collagen type VI alpha 3 (COL6A3) | NM_004369.1 | 5 | 0.04% | 22 | 0.15% |
| 49 | ribosomal protein S13 | NM_001017.1 | 8 | 0.06% | 21 | 0.15% |

Figure 75 Relative Est Frequency of Unique Known Genes Common to Mild and Severe cDNA Libraries - Page 2 of 19

| | | | | | | |
|---|---|---|---|---|---|---|
| 50 | ribosomal RNA 18S | X03205 | 24 | 0.19% | 20 | 0.14% |
| 51 | ribosomal protein L41 | AF026844.1 | 14 | 0.11% | 20 | 0.14% |
| 52 | cytochrome c oxidase subunit VIIb | Z14244 | 12 | 0.09% | 20 | 0.14% |
| 53 | ribosomal protein S11 (RPS11) | NM_001015.1 | 11 | 0.09% | 19 | 0.13% |
| 54 | ribosomal protein L27 (RPL27) | NM_000988.1 | 7 | 0.06% | 19 | 0.13% |
| 55 | vitamin A responsive cytoskeleton related (JWA) | NM_006407.2 | 18 | 0.14% | 18 | 0.13% |
| 56 | nascent-polypeptide-associated complex alpha polypeptide (NACA) | NM_005594.1 | 13 | 0.10% | 18 | 0.13% |
| 57 | HSPC036 protein (=AF077200.1 HSPC014) | AF125097.1 | 8 | 0.06% | 18 | 0.13% |
| 58 | CGI-134 protein (LOC51023) | NM_016067.1 | 4 | 0.03% | 18 | 0.13% |
| 59 | ribosomal protein S6 | M20020 | 13 | 0.10% | 17 | 0.12% |
| 60 | ribosomal protein S29 | L31610.1 | 8 | 0.06% | 17 | 0.12% |
| 61 | androgen receptor associated protein 24 (ARA24) (=AF054183 GTP bi | AF052578 | 7 | 0.06% | 17 | 0.12% |
| 62 | eukaryotic translation initiation factor 4 gamma, 2 (EIF4G2) | NM_001418.1 | 4 | 0.03% | 17 | 0.12% |
| 63 | Sec61 gamma | AF054184 | 3 | 0.02% | 17 | 0.12% |
| 64 | ribosomal protein L37 | L11567 | 6 | 0.05% | 16 | 0.11% |
| 65 | integrin beta 1 subunit | X07979.1 | 6 | 0.05% | 16 | 0.11% |
| 66 | myosin regulatory light chain | X54304 | 4 | 0.03% | 16 | 0.11% |
| 67 | gap junction protein, alpha 1, 43kD (connexin 43) (GJA1) | NM_000165.2 | 1 | 0.01% | 16 | 0.11% |
| 68 | ribosomal DNA complete repeating unit | U13369.1 | 28 | 0.22% | 15 | 0.11% |
| 69 | tumor rejection antigen (gp96) 1 (TRA1) | X15187 | 19 | 0.15% | 15 | 0.11% |
| 70 | lysosome-associated protein, transmembrane - 4alpha (=O14696.1 Hun | U34259.1 | 10 | 0.08% | 15 | 0.11% |
| 71 | cytochrome c oxidase, liver specific (EC 1.9.3.1.) | X15822 | 10 | 0.08% | 15 | 0.11% |
| 72 | prothymosin alpha | M14630 | 9 | 0.07% | 15 | 0.11% |
| 73 | F1-ATPase epsilon-subunit (ATP5E) | AF052955.1 | 7 | 0.06% | 15 | 0.11% |
| 74 | cartilage intermediate layer protein, CILP | AB022430.1 | 17 | 0.13% | 14 | 0.10% |
| 75 | ribosomal protein L6 | X69391 | 11 | 0.09% | 14 | 0.10% |
| 76 | S100 calcium-binding protein A4 (calcium protein, calvasculin, metasta | gi4506764 | 11 | 0.09% | 14 | 0.10% |
| 77 | ribosomal protein L38 | Z26876 | 7 | 0.06% | 14 | 0.10% |
| 78 | ribosomal protein L35a | NM_000996.1 | 3 | 0.02% | 14 | 0.10% |
| 79 | H4 histone family, member G (H4FG) | NM_003542.2 | 3 | 0.02% | 14 | 0.10% |
| 80 | KIAA0005 | D13630 | 19 | 0.15% | 13 | 0.09% |
| 81 | ribosomal protein L26 | X69392 | 11 | 0.09% | 13 | 0.09% |
| 82 | ribosomal protein S24 | M31520 | 10 | 0.08% | 13 | 0.09% |
| 83 | ribosomal protein L44 (RPL44) | NM_001001.1 | 10 | 0.08% | 13 | 0.09% |
| 84 | collagen lysyl hydroxylase isoform 2 (PLOD2) | U84573 | 8 | 0.06% | 13 | 0.09% |
| 85 | RIBOSOMAL PROTEIN L10 (QM PROTEIN) (TUMOR SUPRESSOR ( | spP27635 | 6 | 0.05% | 13 | 0.09% |
| 86 | ribosomal protein L30 | L05095.1 | 6 | 0.05% | 13 | 0.09% |
| 87 | hH3.3B gene for histone H3.3 | Z48950.1 | 6 | 0.05% | 13 | 0.09% |
| 88 | ribosomal protein L39 | D79205 | 4 | 0.03% | 13 | 0.09% |
| 89 | calpactin 1 light chain | M81457 | 3 | 0.02% | 13 | 0.09% |
| 90 | ribosomal protein L23a | U43701 | 13 | 0.10% | 12 | 0.08% |
| 91 | Ribosomal protein L36 (=RPL44) | AF077043.1 | 10 | 0.08% | 12 | 0.08% |
| 92 | cysteine dioxygenase | D85777 | 10 | 0.08% | 12 | 0.08% |
| 93 | ribosomal protein L13 | AF112214 | 6 | 0.05% | 12 | 0.08% |
| 94 | endozepine (putative ligand of benzodiazepine receptor) | M15887.1 | 6 | 0.05% | 12 | 0.08% |
| 95 | Ribosomal protein L4 | NM_000968.1 | 4 | 0.03% | 12 | 0.08% |
| 96 | heparan sulfate proteoglycan (HSPG) (OCI5) | J04621.1 | 4 | 0.03% | 12 | 0.08% |
| 97 | pp21 homolog | AF125535.1 | 4 | 0.03% | 12 | 0.08% |
| 98 | ribosomal protein S8 (RPS8) | NM_001012.1 | 3 | 0.02% | 12 | 0.08% |
| 99 | calmodulin 2 (phosphorylase kinase, delta) (CALM2) | NM_001743.1 | 25 | 0.20% | 11 | 0.08% |
| 100 | fibromodulin (FMOD) | NM_002023.2 | 19 | 0.15% | 11 | 0.08% |
| 101 | caveolin 1 (CAV1) | AF125348.1 | 11 | 0.09% | 11 | 0.08% |

Figure 15:
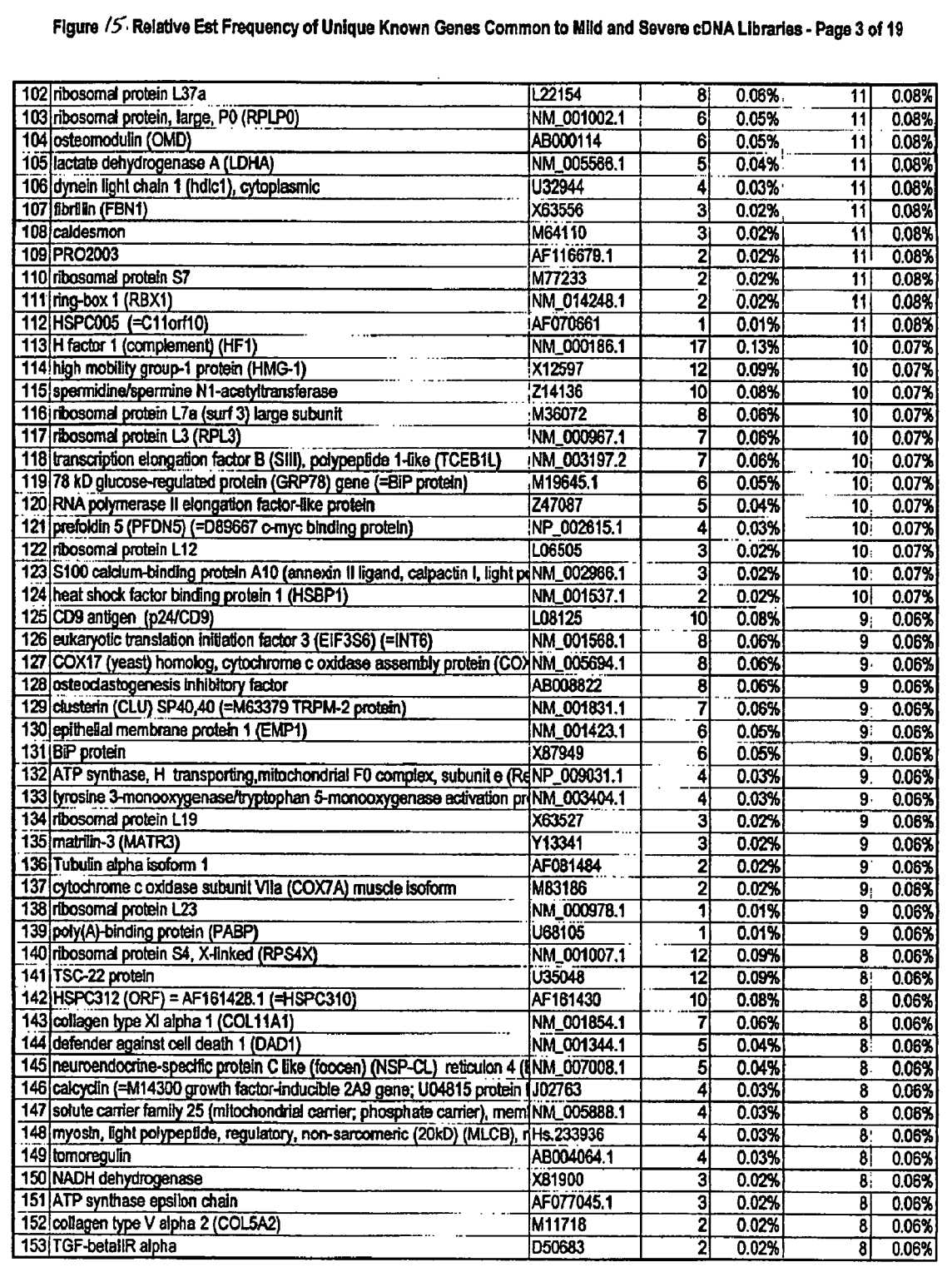

Figure 15 Relative Est Frequency of Unique Known Genes Common to Mild and Severe cDNA Libraries - Page 3 of 19

| | | | | | | |
|---|---|---|---|---|---|---|
| 102 | ribosomal protein L37a | L22154 | 8 | 0.06% | 11 | 0.08% |
| 103 | ribosomal protein, large, P0 (RPLP0) | NM_001002.1 | 6 | 0.05% | 11 | 0.08% |
| 104 | osteomodulin (OMD) | AB000114 | 6 | 0.05% | 11 | 0.08% |
| 105 | lactate dehydrogenase A (LDHA) | NM_005566.1 | 5 | 0.04% | 11 | 0.08% |
| 106 | dynein light chain 1 (hdlc1), cytoplasmic | U32944 | 4 | 0.03% | 11 | 0.08% |
| 107 | fibrillin (FBN1) | X63556 | 3 | 0.02% | 11 | 0.08% |
| 108 | caldesmon | M64110 | 3 | 0.02% | 11 | 0.08% |
| 109 | PRO2003 | AF116679.1 | 2 | 0.02% | 11 | 0.08% |
| 110 | ribosomal protein S7 | M77233 | 2 | 0.02% | 11 | 0.08% |
| 111 | ring-box 1 (RBX1) | NM_014248.1 | 2 | 0.02% | 11 | 0.08% |
| 112 | HSPC005 (=C11orf10) | AF070661 | 1 | 0.01% | 11 | 0.08% |
| 113 | H factor 1 (complement) (HF1) | NM_000186.1 | 17 | 0.13% | 10 | 0.07% |
| 114 | high mobility group-1 protein (HMG-1) | X12597 | 12 | 0.09% | 10 | 0.07% |
| 115 | spermidine/spermine N1-acetyltransferase | Z14136 | 10 | 0.08% | 10 | 0.07% |
| 116 | ribosomal protein L7a (surf 3) large subunit | M36072 | 8 | 0.06% | 10 | 0.07% |
| 117 | ribosomal protein L3 (RPL3) | NM_000967.1 | 7 | 0.06% | 10 | 0.07% |
| 118 | transcription elongation factor B (SIII), polypeptide 1-like (TCEB1L) | NM_003197.2 | 7 | 0.06% | 10 | 0.07% |
| 119 | 78 kD glucose-regulated protein (GRP78) gene (=BiP protein) | M19645.1 | 6 | 0.05% | 10 | 0.07% |
| 120 | RNA polymerase II elongation factor-like protein | Z47087 | 5 | 0.04% | 10 | 0.07% |
| 121 | prefoldin 5 (PFDN5) (=D89667 c-myc binding protein) | NP_002615.1 | 4 | 0.03% | 10 | 0.07% |
| 122 | ribosomal protein L12 | L06505 | 3 | 0.02% | 10 | 0.07% |
| 123 | S100 calcium-binding protein A10 (annexin II ligand, calpactin I, light p | NM_002966.1 | 3 | 0.02% | 10 | 0.07% |
| 124 | heat shock factor binding protein 1 (HSBP1) | NM_001537.1 | 2 | 0.02% | 10 | 0.07% |
| 125 | CD9 antigen (p24/CD9) | L08125 | 10 | 0.08% | 9 | 0.06% |
| 126 | eukaryotic translation initiation factor 3 (EIF3S6) (=INT6) | NM_001568.1 | 8 | 0.06% | 9 | 0.06% |
| 127 | COX17 (yeast) homolog, cytochrome c oxidase assembly protein (CO) | NM_005694.1 | 8 | 0.06% | 9 | 0.06% |
| 128 | osteoclastogenesis inhibitory factor | AB008822 | 8 | 0.06% | 9 | 0.06% |
| 129 | clusterin (CLU) SP40,40 (=M63379 TRPM-2 protein) | NM_001831.1 | 7 | 0.06% | 9 | 0.06% |
| 130 | epithelial membrane protein 1 (EMP1) | NM_001423.1 | 6 | 0.05% | 9 | 0.06% |
| 131 | BiP protein | X87949 | 6 | 0.05% | 9 | 0.06% |
| 132 | ATP synthase, H transporting,mitochondrial F0 complex, subunit e (Re | NP_009031.1 | 4 | 0.03% | 9 | 0.06% |
| 133 | tyrosine 3-monooxygenase/tryptophan 5-monooxygenase activation pr | NM_003404.1 | 4 | 0.03% | 9 | 0.06% |
| 134 | ribosomal protein L19 | X63527 | 3 | 0.02% | 9 | 0.06% |
| 135 | matrilin-3 (MATR3) | Y13341 | 3 | 0.02% | 9 | 0.06% |
| 136 | Tubulin alpha isoform 1 | AF081484 | 2 | 0.02% | 9 | 0.06% |
| 137 | cytochrome c oxidase subunit VIIa (COX7A) muscle isoform | M83186 | 2 | 0.02% | 9 | 0.06% |
| 138 | ribosomal protein L23 | NM_000978.1 | 1 | 0.01% | 9 | 0.06% |
| 139 | poly(A)-binding protein (PABP) | U68105 | 1 | 0.01% | 9 | 0.06% |
| 140 | ribosomal protein S4, X-linked (RPS4X) | NM_001007.1 | 12 | 0.09% | 8 | 0.06% |
| 141 | TSC-22 protein | U35048 | 12 | 0.09% | 8 | 0.06% |
| 142 | HSPC312 (ORF) = AF161428.1 (=HSPC310) | AF161430 | 10 | 0.08% | 8 | 0.06% |
| 143 | collagen type XI alpha 1 (COL11A1) | NM_001854.1 | 7 | 0.06% | 8 | 0.06% |
| 144 | defender against cell death 1 (DAD1) | NM_001344.1 | 5 | 0.04% | 8 | 0.06% |
| 145 | neuroendocrine-specific protein C like (foocen) (NSP-CL) reticulon 4 ( | NM_007008.1 | 5 | 0.04% | 8 | 0.06% |
| 146 | calcyclin (=M14300 growth factor-inducible 2A9 gene; U04815 protein | J02763 | 4 | 0.03% | 8 | 0.06% |
| 147 | solute carrier family 25 (mitochondrial carrier; phosphate carrier), mem | NM_005888.1 | 4 | 0.03% | 8 | 0.06% |
| 148 | myosin, light polypeptide, regulatory, non-sarcomeric (20kD) (MLCB), r | Hs.233936 | 4 | 0.03% | 8 | 0.06% |
| 149 | tomoregulin | AB004064.1 | 4 | 0.03% | 8 | 0.06% |
| 150 | NADH dehydrogenase | X81900 | 3 | 0.02% | 8 | 0.06% |
| 151 | ATP synthase epsilon chain | AF077045.1 | 3 | 0.02% | 8 | 0.06% |
| 152 | collagen type V alpha 2 (COL5A2) | M11718 | 2 | 0.02% | 8 | 0.06% |
| 153 | TGF-betaIIR alpha | D50683 | 2 | 0.02% | 8 | 0.06% |

Figure/5 - Relative Est Frequency of Unique Known Genes Common to Mild and Severe cDNA Libraries - Page 4 of 19

| | | | | | | |
|---|---|---|---|---|---|---|
| 154 | thrombospondin 2 (THBS2) | L12350 | 1 | 0.01% | 8 | 0.06% |
| 155 | ribosomal protein L11 | L05092.1 | 16 | 0.13% | 7 | 0.05% |
| 156 | LINE-1 REVERSE TRANSCRIPTASE HOMOLOG (=putative p150) | spP08547 | 14 | 0.11% | 7 | 0.05% |
| 157 | ribosomal protein L5 | U76609 | 10 | 0.08% | 7 | 0.05% |
| 158 | mitochondrial ubiquinone-binding protein | M26700 | 10 | 0.08% | 7 | 0.05% |
| 159 | HSPC310 (=HSPC312) | AF161428.1 | 8 | 0.06% | 7 | 0.05% |
| 160 | ATP synthase, H transporting, mitochondrial F1F0, subunit g (ATP5JG | NM_006476.1 | 7 | 0.06% | 7 | 0.05% |
| 161 | cytochrome c oxidase subunit VIIc (COX7C) | NM_001867.1 | 7 | 0.06% | 7 | 0.05% |
| 162 | epididymal seCRetory protein (19.5kD) (HE1) | gi5453677 | 6 | 0.05% | 7 | 0.05% |
| 163 | ribosomal protein S17 | M13932 | 5 | 0.04% | 7 | 0.05% |
| 164 | cytochrome b (ORF) | U09500 | 5 | 0.04% | 7 | 0.05% |
| 165 | UMP-CMP kinase | AF110643.1 | 5 | 0.04% | 7 | 0.05% |
| 166 | nucleolar phosphoprotein B23 (NPM1) | M28699 | 4 | 0.03% | 7 | 0.05% |
| 167 | cartilage-derived C-type lectin (CLECSF1) | AF077345 | 4 | 0.03% | 7 | 0.05% |
| 168 | histone H3.3 | Z48950 | 4 | 0.03% | 7 | 0.05% |
| 169 | ATP synthase, H transporting, mitochondrial F0 complex, subunit g (A | Hs.107476 | 4 | 0.03% | 7 | 0.05% |
| 170 | MORF-related gene X (KIAA0026) (=MRG15) | NM_012286.1 | 4 | 0.03% | 7 | 0.05% |
| 171 | ATP synthase, H transporting, mitochondrial F1 complex, gamma poly | NM_005174.1 | 4 | 0.03% | 7 | 0.05% |
| 172 | ATP synthase, H transporting, mitochondrial F1 complex, alpha subun | NM_004046.1 | 4 | 0.03% | 7 | 0.05% |
| 173 | HSPC163 | AF161512 | 4 | 0.03% | 7 | 0.05% |
| 174 | actin, gamma 1 (ACTG1) | NM_001614.1 | 3 | 0.02% | 7 | 0.05% |
| 175 | ribosomal protein L22 (RPL22) | NM_000983.1 | 3 | 0.02% | 7 | 0.05% |
| 176 | muscleblind (Drosophila)-like (MBNL) (=KIAA0428) | NM_021038.1 | 3 | 0.02% | 7 | 0.05% |
| 177 | ADP-ribosylation factor 4 (ARF4) | AF104238.1 | 3 | 0.02% | 7 | 0.05% |
| 178 | vacuolar sorting protein VPS29/PEP11 (LOC51699) | NM_016226.1 | 3 | 0.02% | 7 | 0.05% |
| 179 | palladin (KIAA0992)= CGI-151 | NM_016081.1 | 2 | 0.02% | 7 | 0.05% |
| 180 | vacuolar H-ATPase subunit | AF038954 | 2 | 0.02% | 7 | 0.05% |
| 181 | calnexin (CANX) integral membrane protein, calnexin, (IP90) | M94859 | 2 | 0.02% | 7 | 0.05% |
| 182 | annexin A5 (ANXA5)(lipocortin-V) | NM_001154.2 | 1 | 0.01% | 7 | 0.05% |
| 183 | phosphoglycerate mutase (PGAM-B) | J04173 | 1 | 0.01% | 7 | 0.05% |
| 184 | tissue inhibitor of metalloproteinase 3 (Sorsby fundus dystrophy, pseud | NM_000362.1 | 15 | 0.12% | 6 | 0.04% |
| 185 | reverse transCRiptase | D84391 | 12 | 0.09% | 6 | 0.04% |
| 186 | decay-accelerating factor | M31516 | 7 | 0.06% | 6 | 0.04% |
| 187 | ribosomal protein L32 (RPL32) | NM_000994.1 | 6 | 0.05% | 6 | 0.04% |
| 188 | PRO1574 (mitochondrial proteolipid 68MP homolog (PLPM) | AF116639.1 | 5 | 0.04% | 6 | 0.04% |
| 189 | heterogeneous nuclear ribonucleoprotein D-like (HNRPDL) | NM_005463.1 | 5 | 0.04% | 6 | 0.04% |
| 190 | heterogeneous nuclear ribonucleoprotein D (hnRNP D) (52% aa) | D55671 | 5 | 0.04% | 6 | 0.04% |
| 191 | phospholipase A2 | M86400 | 5 | 0.04% | 6 | 0.04% |
| 192 | procollagen-lysine, 2-oxoglutarate 5-dioxygenase (lysine hydroxylase) | Hs.41270 | 4 | 0.03% | 6 | 0.04% |
| 193 | Cu/Zn superoxide dismutase (SOD) | X02317 | 4 | 0.03% | 6 | 0.04% |
| 194 | ribosomal protein S12 | X53505 | 3 | 0.02% | 6 | 0.04% |
| 195 | ribosomal protein S23 (RPS23) =D14530 (ORF) | NM_001025.1 | 3 | 0.02% | 6 | 0.04% |
| 196 | cathepsin K (pycnodysostosis)(CTSK) | NM_000396.1 | 3 | 0.02% | 6 | 0.04% |
| 197 | p40 | AAC51266.1 | 3 | 0.02% | 6 | 0.04% |
| 198 | integrin, beta 1(fibronectin receptor, beta polypeptide, antigen CD29 in | NM_002211.1 | 3 | 0.02% | 6 | 0.04% |
| 199 | 15 kDa selenoprotein (SEP15) | AF051894 | 3 | 0.02% | 6 | 0.04% |
| 200 | Fn54 | AF001533.2 | 3 | 0.02% | 6 | 0.04% |
| 201 | ribosomal protein S15a | X84407 | 2 | 0.02% | 6 | 0.04% |
| 202 | T-cell cyclophilin | Y00052 | 2 | 0.02% | 6 | 0.04% |
| 203 | FK506 binding protein (Fkbp63) | AF090334 | 2 | 0.02% | 6 | 0.04% |
| 204 | ATPase, H transporting, lysosomal (vacuolar proton pump) 9kD (ATP6 | NM_003945.1 | 2 | 0.02% | 6 | 0.04% |
| 205 | calumein (Calu) (calumenin) | AF013759 | 2 | 0.02% | 6 | 0.04% |

Figure 15- Relative Est Frequency of Unique Known Genes Common to Mild and Severe cDNA Libraries - Page 5 of 19

| | | | | | | |
|---|---|---|---|---|---|---|
| 206 | cell division cycle 10 (homologous to CDC10 of S. cerevisiae) (CDC10) | NM_001788.1 | 2 | 0.02% | 6 | 0.04% |
| 207 | cig19 (=D31887.1 KIAA0062) | AF026940.1 | 2 | 0.02% | 6 | 0.04% |
| 208 | phosphoglycerate kinase 1 (PGK1) (ORF) | NM_000291.1 | 2 | 0.02% | 6 | 0.04% |
| 209 | nuclease sensitive element binding protein 1 (NSEP1) = L28809.1 dbp | NM_004559.1 | 2 | 0.02% | 6 | 0.04% |
| 210 | cathepsin B (CTSB) | L22569 | 2 | 0.02% | 6 | 0.04% |
| 211 | CGI-110 protein | AF151868.1 | 2 | 0.02% | 6 | 0.04% |
| 212 | HS1 protein (=YWHAQ) | X57347 | 2 | 0.02% | 6 | 0.04% |
| 213 | cell cycle progression 8 protein (CPR8)(ORF)=AF011794 | NM_004748.1 | 2 | 0.02% | 6 | 0.04% |
| 214 | inositol polyphosphate 1-phosphatase gene (INPP1) (low match) | AF141324.1 | 2 | 0.02% | 6 | 0.04% |
| 215 | ribosomal protein L24 (RPL24) (=ribosomal protein L30) | NM_000986.1 | 1 | 0.01% | 6 | 0.04% |
| 216 | cyclin | M74091 | 1 | 0.01% | 6 | 0.04% |
| 217 | NADH dehydrogenase subunit 2 (ND2) | AF014897.2 | 1 | 0.01% | 6 | 0.04% |
| 218 | Down syndrome candidate region 1 (DSCR1) | NM_004414.2 | 1 | 0.01% | 6 | 0.04% |
| 219 | NAP (nucleosome assembly protein) | M86667 | 1 | 0.01% | 6 | 0.04% |
| 220 | MRG15 protein (MRG15) | AF100615.1 | 1 | 0.01% | 6 | 0.04% |
| 221 | PRO2853 | AF119905.1 | 10 | 0.08% | 5 | 0.04% |
| 222 | RIBOSOMAL PROTEIN L10A (CSA-19)(RPL10A) | P53025 | 7 | 0.06% | 5 | 0.04% |
| 223 | peptidylglycine alpha-amidating monooxygenase (PAM) | M37721 | 7 | 0.06% | 5 | 0.04% |
| 224 | selenoprotein P (SEPP1) | Z11793 | 5 | 0.04% | 5 | 0.04% |
| 225 | insulin-like growth factor binding protein 7 (IGFBP7) | 4504618 | 5 | 0.04% | 5 | 0.04% |
| 226 | growth arrest-specific 1 (GAS1) | NM_002048.1 | 5 | 0.04% | 5 | 0.04% |
| 227 | extracellular matrix protein | AB011792 | 5 | 0.04% | 5 | 0.04% |
| 228 | SOD-2 manganese superoxide dismutase | X65965 | 4 | 0.03% | 5 | 0.04% |
| 229 | miCRosomal signal peptidase | AF061737 | 4 | 0.03% | 5 | 0.04% |
| 230 | transmembrane glycoprotein (GPNMB) | X76534 | 4 | 0.03% | 5 | 0.04% |
| 231 | transcription elongation factor A (SII), 1 (TCEA1) | NM_006756.1 | 4 | 0.03% | 5 | 0.04% |
| 232 | HSPC297 (=HSPC030) | AF161415.1 | 4 | 0.03% | 5 | 0.04% |
| 233 | cyclin I | D50310 | 3 | 0.02% | 5 | 0.04% |
| 234 | mitochondrial proteolipid 68MP homolog (PLPM) | NM_004894.1 | 3 | 0.02% | 5 | 0.04% |
| 235 | hepatitis B virus X interacting protein (XIP) | AF029890 | 3 | 0.02% | 5 | 0.04% |
| 236 | activated RNA polymerase (PC4) | NM_006713.1 | 3 | 0.02% | 5 | 0.04% |
| 237 | myosin light chain 3 non-muscle (MLC3nm) | M31212 | 3 | 0.02% | 5 | 0.04% |
| 238 | heat shock protein 86 (HSP86) | M30626.1 | 3 | 0.02% | 5 | 0.04% |
| 239 | PTD014 | AF092135.1 | 3 | 0.02% | 5 | 0.04% |
| 240 | polyubiquitin | E12605 | 2 | 0.02% | 5 | 0.04% |
| 241 | B-cell translocation protein 1 (BTG1) | X61123 | 2 | 0.02% | 5 | 0.04% |
| 242 | small nuclear ribonucleoprotein D2 polypeptide (16.5kD) (SNRPD2) | NM_004597.3 | 2 | 0.02% | 5 | 0.04% |
| 243 | pre-mRNA splicing factor (SFRS3) | AF107405.1 | 2 | 0.02% | 5 | 0.04% |
| 244 | cytochrome c oxidase subunit VIIa polypeptide 2 like (COX7A2L) | NM_004718.1 | 2 | 0.02% | 5 | 0.04% |
| 245 | FRG1 | L76159 | 2 | 0.02% | 5 | 0.04% |
| 246 | ribosomal protein S16 | M60854 | 1 | 0.01% | 5 | 0.04% |
| 247 | NADH dehydrogenase subunit 4L (RefSeq aa 2e-45) | gi5835396 | 1 | 0.01% | 5 | 0.04% |
| 248 | mannosidase, beta A, lysosomal (MANBA) gene, and ubiquitin-conjuga | AF224669.1 | 1 | 0.01% | 5 | 0.04% |
| 249 | CD164 antigen, sialomucin (CD164) | NM_006016.1 | 1 | 0.01% | 5 | 0.04% |
| 250 | ganglioside expression factor 2 (GEF-2) | NM_007285.1 | 1 | 0.01% | 5 | 0.04% |
| 251 | factor H homologue | M65294.1 | 1 | 0.01% | 5 | 0.04% |
| 252 | dihydropyrimidinase-like 3 (DPYSL3) | NM_001387.1 | 1 | 0.01% | 5 | 0.04% |
| 253 | stromal cell derived factor receptor 1 (SDFR1) | NM_012428.1 | 1 | 0.01% | 5 | 0.04% |
| 254 | Pcp-2=Purkinje cell protein 2 | S40022 | 1 | 0.01% | 5 | 0.04% |
| 255 | IGSF4 gene | AB017563.1 | 1 | 0.01% | 5 | 0.04% |
| 256 | collagen type II alpha 1 (COL2A1) | J00116.1 | 15 | 0.12% | 4 | 0.03% |
| 257 | complement factor H (=M17517) | Y00716 | 15 | 0.12% | 4 | 0.03% |

Figure 15 Relative Est Frequency of Unique Known Genes Common to Mild and Severe cDNA Libraries - Page 6 of 19

| | | | | | | |
|---|---|---|---|---|---|---|
| 258 | MEN1 region clone epsilon/beta | AF001893.1 | 8 | 0.06% | 4 | 0.03% |
| 259 | ubiquinol-cytochrome c reductase complex (7.2 kD); hypothetical prote | NP_037519.1 | 8 | 0.06% | 4 | 0.03% |
| 260 | breast carcinoma amplified sequence 2 (BCAS2) | NM_005872.1 | 8 | 0.06% | 4 | 0.03% |
| 261 | SUI1 isolog | AF083441.1 | 6 | 0.05% | 4 | 0.03% |
| 262 | DEAD/H (Asp-Glu-Ala-Asp/His) box polypeptide 5 (RNA helicase, 68kD | NM_004396.1 | 6 | 0.05% | 4 | 0.03% |
| 263 | hypoxia-inducible factor 1 alpha (HIF-1 alpha) | U22431 | 6 | 0.05% | 4 | 0.03% |
| 264 | KIAA0728 | AB018271.1 | 6 | 0.05% | 4 | 0.03% |
| 265 | heat shock 10kD protein 1 (chaperonin 10) (HSPE1) | NM_002157.1 | 5 | 0.04% | 4 | 0.03% |
| 266 | platelet-derived growth factor receptor alpha (PDGFRA) | M21574 | 5 | 0.04% | 4 | 0.03% |
| 267 | Clk-associated RS cyclophilin CARS-Cyp | U40763 | 5 | 0.04% | 4 | 0.03% |
| 268 | ribosomal protein L13a (RPL13A) | NM_012423.1 | 4 | 0.03% | 4 | 0.03% |
| 269 | ribosomal protein L15 | NM_002948.1 | 4 | 0.03% | 4 | 0.03% |
| 270 | thyroid receptor interactor (TRIP7) | L40357 | 4 | 0.03% | 4 | 0.03% |
| 271 | vesicle docking protein p115 (P115) | NM_003715.1 | 4 | 0.03% | 4 | 0.03% |
| 272 | heat shock J2 protein (HSJ2) | AF075601.1 | 4 | 0.03% | 4 | 0.03% |
| 273 | tumor neCRosis factor-inducible (TSG-6) | M31165 | 4 | 0.03% | 4 | 0.03% |
| 274 | ribosomal protein, large, P1 (RPLP1) | NM_001003.1 | 3 | 0.02% | 4 | 0.03% |
| 275 | heterogeneous nuclear ribonucleoprotein A1 (HNRPA1) | NM_002136.1 | 3 | 0.02% | 4 | 0.03% |
| 276 | lysosomal membrane glycoprotein CD63 (=M59907 ME491;X07982) | M58485 | 3 | 0.02% | 4 | 0.03% |
| 277 | Cyr61 protein (CYR61) | AF031385 | 3 | 0.02% | 4 | 0.03% |
| 278 | BCL2/adenovirus E1B 19kD-interacting protein 3 (BNIP3) | U15174 | 3 | 0.02% | 4 | 0.03% |
| 279 | amyloid-beta protein (APP) | M33112.1 | 3 | 0.02% | 4 | 0.03% |
| 280 | hereditary haemochromatosis region, histone 2A-like protein gene, her | U91328.1 | 3 | 0.02% | 4 | 0.03% |
| 281 | SEC24 (S. cerevisiae)related gene family, member D (SEC24D), = AK( | NM_014822.1 | 3 | 0.02% | 4 | 0.03% |
| 282 | annexin A4 (ANXA4) | NM_001153.2 | 3 | 0.02% | 4 | 0.03% |
| 283 | semaphorin E | AB000220 | 3 | 0.02% | 4 | 0.03% |
| 284 | single-stranded DNA-binding protein (SSBP), nuclear gene encoding m | NM_003143.1 | 3 | 0.02% | 4 | 0.03% |
| 285 | 5' nucleotidase (EC 3.1.3.5) | X55740 | 3 | 0.02% | 4 | 0.03% |
| 286 | AgX-1 antigen | S73498 | 3 | 0.02% | 4 | 0.03% |
| 287 | frizzled-related protein (FRZB) | NM_001463.1 | 2 | 0.02% | 4 | 0.03% |
| 288 | alpha E-catenin (CTNNA1) gene | AF102803.1 | 2 | 0.02% | 4 | 0.03% |
| 289 | zinc finger transCRiption factor GKLF | AF105036.1 | 2 | 0.02% | 4 | 0.03% |
| 290 | KIAA1247 | AB033073.1 | 2 | 0.02% | 4 | 0.03% |
| 291 | Lsm3 protein | AJ238095.1 | 2 | 0.02% | 4 | 0.03% |
| 292 | SET translocation (myeloid leukemia-associated) (SET) =M93651 | NM_003011.1 | 2 | 0.02% | 4 | 0.03% |
| 293 | arginine-rich nuclear protein | M74002 | 2 | 0.02% | 4 | 0.03% |
| 294 | actin-related protein Arp3 (ARP3)(actin-related protein 3 yeast)homolo( | AF006083.1 | 2 | 0.02% | 4 | 0.03% |
| 295 | CYTOCHROME C OXIDASE POLYPEPTIDE I | P00395 | 2 | 0.02% | 4 | 0.03% |
| 296 | PRO0530 | AF111849.1 | 2 | 0.02% | 4 | 0.03% |
| 297 | small acidic protein | U51678 | 2 | 0.02% | 4 | 0.03% |
| 298 | ATP SYNTHASE E CHAIN, MITOCHONDRIAL | spP56385 | 2 | 0.02% | 4 | 0.03% |
| 299 | lost on transformation LOT1 (=PLAGL1) | U72621.2 | 2 | 0.02% | 4 | 0.03% |
| 300 | N2A3 (=DPYSL2) (=dihydropyrimidinase related protein-2) | U97105 | 2 | 0.02% | 4 | 0.03% |
| 301 | HIC protein | AF054589 | 2 | 0.02% | 4 | 0.03% |
| 302 | CGI-148 protein | AF151906 | 2 | 0.02% | 4 | 0.03% |
| 303 | ribosomal protein S21 (RPS21) | L04483 | 1 | 0.01% | 4 | 0.03% |
| 304 | TI-227H (=tomoregulin; mitchondrial) | D50525 | 1 | 0.01% | 4 | 0.03% |
| 305 | glucocorticoid-induced GILZ | AF228339 | 1 | 0.01% | 4 | 0.03% |
| 306 | heat shock 70kD protein 10 (HSC71) (HSPA10) | NM_006597.1 | 1 | 0.01% | 4 | 0.03% |
| 307 | actin binding protein ABP620 | AB029290.1 | 1 | 0.01% | 4 | 0.03% |
| 308 | profilin II | L10678.1 | 1 | 0.01% | 4 | 0.03% |
| 309 | tyrosine 3-monooxygenase/tryptophan 5-monooxygenase activation pr | NM_006826.1 | 1 | 0.01% | 4 | 0.03% |

Figure 15 Relative Est Frequency of Unique Known Genes Common to Mild and Severe cDNA Libraries - Page 7 of 19

| | | | | | | |
|---|---|---|---|---|---|---|
| 310 | sphingolipid activator protein 1 | J03015 | 1 | 0.01% | 4 | 0.03% |
| 311 | prolyl 4-hydroxylase gene | U14608.1 | 1 | 0.01% | 4 | 0.03% |
| 312 | prion protein (p27-30) (Creutzfeld-Jakob disease, Gerstmann-Strausler | NM_000311.1 | 1 | 0.01% | 4 | 0.03% |
| 313 | interleukin 1 receptor, type I (IL1R1) = M27492.1 | NM_000877.1 | 1 | 0.01% | 4 | 0.03% |
| 314 | KIAA0663 | AB014563 | 1 | 0.01% | 4 | 0.03% |
| 315 | palmitoyl-protein thioesterase (PPT) | AF022211 | 1 | 0.01% | 4 | 0.03% |
| 316 | N-acylsphingosine amidohydrolase (ASAH) (acid ceramidase) | NM_004315.1 | 1 | 0.01% | 4 | 0.03% |
| 317 | biglycan BGN | U11686.1 | 1 | 0.01% | 4 | 0.03% |
| 318 | KIAA0102 | D14658 | 1 | 0.01% | 4 | 0.03% |
| 319 | vascular cell adhesion molecule 1 (VCAM1) | M30257 | 1 | 0.01% | 4 | 0.03% |
| 320 | signal recognition particle subunit 9 (SRP9) | U20998 | 1 | 0.01% | 4 | 0.03% |
| 321 | somatic cytochrome c (HCS) gene | M22877.1 | 1 | 0.01% | 4 | 0.03% |
| 322 | calpastatin | D50827 | 1 | 0.01% | 4 | 0.03% |
| 323 | H-2K binding factor-2 | D14041 | 1 | 0.01% | 4 | 0.03% |
| 324 | nucleobindin 2 (NUCB2)(NEFA protein) | X76732 | 1 | 0.01% | 4 | 0.03% |
| 325 | Rap1B | U07795 | 1 | 0.01% | 4 | 0.03% |
| 326 | X (inactive)-specific transCRipt (XIST) | M97168 | 1 | 0.01% | 4 | 0.03% |
| 327 | NADH-UBIQUINONE OXIDOREDUCTASE MLRQ SUBUNIT (COMPL | spO00483 | 1 | 0.01% | 4 | 0.03% |
| 328 | XAGL protein | Y15906.1 | 1 | 0.01% | 4 | 0.03% |
| 329 | KIAA1038 | AB028961 | 1 | 0.01% | 4 | 0.03% |
| 330 | Ku autoimmune antigen gene | J04977.1 | 9 | 0.07% | 3 | 0.02% |
| 331 | hypoxia-inducible gene 1 (HIG1) (=HSPC010) | AF145385.1 | 8 | 0.06% | 3 | 0.02% |
| 332 | Tigger1 transposable element | U49973.1 | 7 | 0.06% | 3 | 0.02% |
| 333 | cytosolic selenium-dependent glutathione peroxidase (=L09159 RHOA | M83094 | 7 | 0.06% | 3 | 0.02% |
| 334 | sterol carrier protein 2 | S52450 | 6 | 0.05% | 3 | 0.02% |
| 335 | ribosomal protein S3 (RPS3) | NM_001005.1 | 5 | 0.04% | 3 | 0.02% |
| 336 | enhancer of rudimentary homologue | U66871 | 5 | 0.04% | 3 | 0.02% |
| 337 | Heterogeneous nuclear ribonucleoprotein U (scaffold attachment factor | NM_004501.1 | 5 | 0.04% | 3 | 0.02% |
| 338 | epidermal growth factor receptor kinase substrate (Eps8) | U12535 | 5 | 0.04% | 3 | 0.02% |
| 339 | protein disulfide isomerase-related protein (P5)= D49489 | NM_005742.1 | 5 | 0.04% | 3 | 0.02% |
| 340 | paired mesoderm homeo box 1 (PMX1) | gi5902023 | 5 | 0.04% | 3 | 0.02% |
| 341 | actin, beta (ACTB) | NM_001101.2 | 4 | 0.03% | 3 | 0.02% |
| 342 | guanine nucleotide binding protein (G protein), beta polypeptide 2-like | NM_006098.1 | 4 | 0.03% | 3 | 0.02% |
| 343 | aggrecan (chondroitin sulfate proteoglycan 1, large aggregating proteo | U13613 | 4 | 0.03% | 3 | 0.02% |
| 344 | trophoblast STAT utron | AF080092.1 | 4 | 0.03% | 3 | 0.02% |
| 345 | testis enhanced gene transCRipt protein (TEGT) | AF033095 | 4 | 0.03% | 3 | 0.02% |
| 346 | heterogeneous nuclear ribonucleoprotein K (HNRPK) | NM_002140.1 | 4 | 0.03% | 3 | 0.02% |
| 347 | UDP-glucose dehydrogenase (UGDH) | AF061016 | 4 | 0.03% | 3 | 0.02% |
| 348 | uridine diphosphoglucose pyrophosphorylase | U27460 | 4 | 0.03% | 3 | 0.02% |
| 349 | kinectin 1 (kinesin receptor) (KTN1)(= KIAA0004) | NM_004986.1 | 4 | 0.03% | 3 | 0.02% |
| 350 | GOLGI 4-TRANSMEMBRANE SPANNING TRANSPORTER MTP (KIA | spQ15012 | 4 | 0.03% | 3 | 0.02% |
| 351 | neural precursor cell expressed, developmentally down-regulated 5 (NI | NM_004404.1 | 3 | 0.02% | 3 | 0.02% |
| 352 | chloride intracellular channel 4 like (CLIC4L) | NM_013943.1 | 3 | 0.02% | 3 | 0.02% |
| 353 | DEK oncogene (DNA binding) (DEK) | gi4503248 | 3 | 0.02% | 3 | 0.02% |
| 354 | S164 (=AC004858 U1 small ribonucleoprotein 1SNRP homologue) | AF109907 | 3 | 0.02% | 3 | 0.02% |
| 355 | malate dehydrogenase 1, NAD (soluble) (MDH1) | NM_005917.1 | 3 | 0.02% | 3 | 0.02% |
| 356 | matrilin-2 precursor | U69263 | 3 | 0.02% | 3 | 0.02% |
| 357 | Golgi autoantigen, golgin subfamily a, 4 (GOLGA4) | NM_002078.2 | 3 | 0.02% | 3 | 0.02% |
| 358 | spectrin SH3 domain binding protein 1 (SSH3BP1) | NM_005470.1 | 3 | 0.02% | 3 | 0.02% |
| 359 | GTP-binding protein Sara | AF092130.1 | 3 | 0.02% | 3 | 0.02% |
| 360 | C2H2 zinc finger protein (ZNF189) | AF025772.1 | 3 | 0.02% | 3 | 0.02% |
| 361 | SON protein | AF193606 | 3 | 0.02% | 3 | 0.02% |

Figure 15 - Relative Est Frequency of Unique Known Genes Common to Mild and Severe cDNA Libraries - Page 8 of 19

| | | | | | | |
|---|---|---|---|---|---|---|
| 362 | ribosomal protein L14 | D87735 | 2 | 0.02% | 3 | 0.02% |
| 363 | collagen type XII alpha 1 (COL12A1) | U57362 | 2 | 0.02% | 3 | 0.02% |
| 364 | protein tyrosine phosphatase (hR-PTPu) | X58288 | 2 | 0.02% | 3 | 0.02% |
| 365 | titin (TTN) gene | CAA49245.1 | 2 | 0.02% | 3 | 0.02% |
| 366 | 16.7Kd protein | AF078845.1 | 2 | 0.02% | 3 | 0.02% |
| 367 | KIAA0438 | AB007898.1 | 2 | 0.02% | 3 | 0.02% |
| 368 | PAPS synthetase-2 (PAPSS2) | AF074331.1 | 2 | 0.02% | 3 | 0.02% |
| 369 | ataxia telangiectasia (ATM) gene | U82828.1 | 2 | 0.02% | 3 | 0.02% |
| 370 | constitutive fragile region FRA3B | AF152363.1 | 2 | 0.02% | 3 | 0.02% |
| 371 | NADH dehydrogenase (ubiquinone) 1 alpha subcomplex, 5 (13kD, B13 | NM_005000.1 | 2 | 0.02% | 3 | 0.02% |
| 372 | small membrane protein 1 (SMP1) | AF081282 | 2 | 0.02% | 3 | 0.02% |
| 373 | glutaredoxin | X76648.1 | 2 | 0.02% | 3 | 0.02% |
| 374 | KIAA0569 | AB011141 | 2 | 0.02% | 3 | 0.02% |
| 375 | KIAA0942 protein (KIAA0942) | NM_015310.1 | 2 | 0.02% | 3 | 0.02% |
| 376 | cullin 4A (CUL4A) | AF077188.1 | 2 | 0.02% | 3 | 0.02% |
| 377 | voltage-dependent anion channel (VDAC1) | AF151097.1 | 2 | 0.02% | 3 | 0.02% |
| 378 | exportin 1 (CRM1,yeast, homolog) (XPO1)(ORF) =D89729, CRM1 prot | NM_003400.1 | 2 | 0.02% | 3 | 0.02% |
| 379 | progesterone membrane binding protein (PMBP) | 5453915 | 2 | 0.02% | 3 | 0.02% |
| 380 | HSPC204 | AF151038.1 | 2 | 0.02% | 3 | 0.02% |
| 381 | HSPCO34 protein | AF100747.1 | 2 | 0.02% | 3 | 0.02% |
| 382 | TATA element modulatory factor | L01042.1 | 2 | 0.02% | 3 | 0.02% |
| 383 | CGI-121 protein (LOC51002) | NM_016058.1 | 2 | 0.02% | 3 | 0.02% |
| 384 | activin beta-A subunit (=(cDNA FLJ11041 fis, clone PLACE1004405, d | X57580.1 | 2 | 0.02% | 3 | 0.02% |
| 385 | ferritin L chain | M11147 | 1 | 0.01% | 3 | 0.02% |
| 386 | guanine nucleotide binding protein (G protein), alpha stimulating activit | NM_000516.2 | 1 | 0.01% | 3 | 0.02% |
| 387 | nicotinamide N-methyltransferase (NNMT) | U08021 | 1 | 0.01% | 3 | 0.02% |
| 388 | protein C inhibitor [human, leukocytes, Genomic, 1402 nt, segment 5 o | S69366.1 | 1 | 0.01% | 3 | 0.02% |
| 389 | transCRiption factor BTF 3 | X74070 | 1 | 0.01% | 3 | 0.02% |
| 390 | GAP-associated tyrosine phosphoprotein p62 (Sam68) (SAM68) (=p62 | NM_006559.1 | 1 | 0.01% | 3 | 0.02% |
| 391 | collagen type VI alpha 1(COL6A1) | X15880 | 1 | 0.01% | 3 | 0.02% |
| 392 | t-complex-associated-testis-expressed 1-like (TCTE1L)=U02556=RP3 | NM_006520.1 | 1 | 0.01% | 3 | 0.02% |
| 393 | NADH-ubiquinone oxidoreductase AGGG subunit precursor homolog | AF067166.1 | 1 | 0.01% | 3 | 0.02% |
| 394 | ubiquitin gene | U49869 | 1 | 0.01% | 3 | 0.02% |
| 395 | CYTOCHROME C OXIDASE POLYPEPTIDE II | spP00403 | 1 | 0.01% | 3 | 0.02% |
| 396 | cisplatin resistance-associated overexpressed protein | AB034205.1 | 1 | 0.01% | 3 | 0.02% |
| 397 | Arp2/3 protein complex subunit p16 (ARC16) =AF006088 (ORF) | NM_005717.1 | 1 | 0.01% | 3 | 0.02% |
| 398 | Eukaryotic translation initiation factor 2, subunit 2 (beta, 38kD)(EIF2S2 | NM_003908.1 | 1 | 0.01% | 3 | 0.02% |
| 399 | p75NTR-associated cell death executor (NADE) | AF187064.1 | 1 | 0.01% | 3 | 0.02% |
| 400 | GW128 | AF107406 | 1 | 0.01% | 3 | 0.02% |
| 401 | SLC11A3 iron transporter | AF215636.1 | 1 | 0.01% | 3 | 0.02% |
| 402 | line-1 protein ORF2 (=p150) | B28096 | 1 | 0.01% | 3 | 0.02% |
| 403 | esterase D | AF112219 | 1 | 0.01% | 3 | 0.02% |
| 404 | inositol 1,4,5-triphosphate receptor, type 2 (ITPR2) | NM_002223.1 | 1 | 0.01% | 3 | 0.02% |
| 405 | SPHAR gene for cyclin-related protein | X82554.1 | 1 | 0.01% | 3 | 0.02% |
| 406 | mitochondrial 16S rRNA | Z70759 | 1 | 0.01% | 3 | 0.02% |
| 407 | murine leukemia viral (bmi-1) oncogene homolog (BMI1) | NM_005180.1 | 1 | 0.01% | 3 | 0.02% |
| 408 | S1R protein (S1R) (=CGI-119) | AF113127.1 | 1 | 0.01% | 3 | 0.02% |
| 409 | basic helix-loop-helix domain containing, class B, 2 (BHLHB2), mRNA / | Hs.171825 | 1 | 0.01% | 3 | 0.02% |
| 410 | predicted osteoblast protein (GS3786), mRNA | NM_014888.1 | 1 | 0.01% | 3 | 0.02% |
| 411 | frizzled (Drosophila) homolog 1 (FZD1) | NM_003505.1 | 1 | 0.01% | 3 | 0.02% |
| 412 | Diff33 protein homolog | AF164794.1 | 1 | 0.01% | 3 | 0.02% |
| 413 | KIAA0244 gene | D87685 | 1 | 0.01% | 3 | 0.02% |

Figure 15 Relative Est Frequency of Unique Known Genes Common to Mild and Severe cDNA Libraries - Page 9 of 19

| | | | | | | |
|---|---|---|---|---|---|---|
| 414 | PRO2751 | AF119896.1 | 1 | 0.01% | 3 | 0.02% |
| 415 | protein x 0001 | AF117230 | 1 | 0.01% | 3 | 0.02% |
| 416 | dihydrofolate reductase (DHFR) | NM_000791.2 | 1 | 0.01% | 3 | 0.02% |
| 417 | sorting nexin 3 (SNX3) | AF034546 | 1 | 0.01% | 3 | 0.02% |
| 418 | two-handed zinc finger protein ZEB | U19969 | 1 | 0.01% | 3 | 0.02% |
| 419 | beta-COP | X82103 | 1 | 0.01% | 3 | 0.02% |
| 420 | RAD23 (S. cerevisiae) homolog B (RAD23B) | NM_002874.1 | 1 | 0.01% | 3 | 0.02% |
| 421 | oligodendrocyte myelin glycoprotein (OMG) | L05367 | 1 | 0.01% | 3 | 0.02% |
| 422 | KIAA1073 | AB028996.1 | 1 | 0.01% | 3 | 0.02% |
| 423 | PTD011 | AF078864 | 1 | 0.01% | 3 | 0.02% |
| 424 | Arginine-rich protein (ARP) | NM_006010.1 | 1 | 0.01% | 3 | 0.02% |
| 425 | cyclin G2 | U47414 | 1 | 0.01% | 3 | 0.02% |
| 426 | Hmob33 protein | Y14155.1 | 1 | 0.01% | 3 | 0.02% |
| 427 | HSPC039 protein | AF125100.1 | 1 | 0.01% | 3 | 0.02% |
| 428 | Nuclear antigen Sp100 (SP100) | NM_003113.1 | 1 | 0.01% | 3 | 0.02% |
| 429 | cytochrome-c oxidase subunit VIIaL precursor (COX7AL) | AF134406.1 | 1 | 0.01% | 3 | 0.02% |
| 430 | metalloproteinase inhibitor TIMP-2 | AF127803.1 | 1 | 0.01% | 3 | 0.02% |
| 431 | DNAJ domain-containing protein MCJ (MCJ) | AF126743.1 | 1 | 0.01% | 3 | 0.02% |
| 432 | steroid dehydrogenase homolog | AF078850.1 | 1 | 0.01% | 3 | 0.02% |
| 433 | KIAA0829 | AB020636 | 1 | 0.01% | 3 | 0.02% |
| 434 | tubulin beta | AF070561 | 6 | 0.05% | 2 | 0.01% |
| 435 | ARP2/3 protein complex subunit p21 (ARC21=AF006086 (ORF) | NM_005719.1 | 6 | 0.05% | 2 | 0.01% |
| 436 | NS1-binding protein (NS1-BP) (=AB020657 KIAA0850) | AJ012449 | 6 | 0.05% | 2 | 0.01% |
| 437 | syndecan binding protein (syntenin) (SDCBP)(ORF) = AF000652.1 | NM_005625.1 | 5 | 0.04% | 2 | 0.01% |
| 438 | proline-rich protein with nuclear targeting signal (B4-2) | NM_006813.1 | 5 | 0.04% | 2 | 0.01% |
| 439 | Nck-associated protein 1 (Nap1) (=AB011159 KIAA0587) | AB014509.1 | 5 | 0.04% | 2 | 0.01% |
| 440 | CD63 antigen (melanoma 1 antigen) (CD63) | NM_001780.1 | 4 | 0.03% | 2 | 0.01% |
| 441 | zinc finger protein 216 (ZNF216) | AF062072.1 | 4 | 0.03% | 2 | 0.01% |
| 442 | sin3 associated polypeptide (SAP18) | AF153608 | 4 | 0.03% | 2 | 0.01% |
| 443 | sema domain immunoglobulin domain (Ig)(semaphorin) 3E (SEMA3E)( | NM_012431.1 | 4 | 0.03% | 2 | 0.01% |
| 444 | HepG2 | D17039 | 4 | 0.03% | 2 | 0.01% |
| 445 | RGC32 protein (RGC32) | NM_014059.1 | 4 | 0.03% | 2 | 0.01% |
| 446 | UDP-glucose pyrophosphorylase 2 (ORF) | NM_006759.1 | 4 | 0.03% | 2 | 0.01% |
| 447 | HSPC238 | AF151072.1 | 4 | 0.03% | 2 | 0.01% |
| 448 | polyposis locus (DP1 gene) | M73547 | 4 | 0.03% | 2 | 0.01% |
| 449 | proteasome (prosome, maCRopain) subunit, beta type, 1 (PSMB1) | NM_002793.1 | 4 | 0.03% | 2 | 0.01% |
| 450 | cytoskeletal gamma-actin | X04098 | 3 | 0.02% | 2 | 0.01% |
| 451 | elongation factor 1 beta 2 (EEF1B2) | NM_001959.1 | 3 | 0.02% | 2 | 0.01% |
| 452 | NADH dehydrogenase(ubiquinone) Fe-S protein 5 (15kD) (NADH-coer | NM_004552.1 | 3 | 0.02% | 2 | 0.01% |
| 453 | hairy (Drosophila)-homolog (HRY) | NM_005524.2 | 3 | 0.02% | 2 | 0.01% |
| 454 | HSPC035 protein (LOC51669), NPD003 | NM_016127.1 | 3 | 0.02% | 2 | 0.01% |
| 455 | KIAA0970 | AB023187.1 | 3 | 0.02% | 2 | 0.01% |
| 456 | KIAA0332 | AB002330 | 3 | 0.02% | 2 | 0.01% |
| 457 | PTD010 | AF078863.1 | 3 | 0.02% | 2 | 0.01% |
| 458 | glyoxalase-I (GLO1) | AF146651.1 | 3 | 0.02% | 2 | 0.01% |
| 459 | ras-related GTP-binding protein | AF106681.1 | 3 | 0.02% | 2 | 0.01% |
| 460 | non-histone chromosomal protein (HMG-1) | L08048.1 | 3 | 0.02% | 2 | 0.01% |
| 461 | SON DNA binding protein (SON) | X63753 | 3 | 0.02% | 2 | 0.01% |
| 462 | N-terminal acetyltransferase complex ard1 subunit | AF085355.1 | 3 | 0.02% | 2 | 0.01% |
| 463 | CMP-N-acetylneuraminic acid hydroxylase | AF074480.1 | 3 | 0.02% | 2 | 0.01% |
| 464 | KIAA1250 | AB033076.1 | 3 | 0.02% | 2 | 0.01% |
| 465 | 5-aminoimidazole-4-carboxamide ribonucleotide | NM_004044.1 | 3 | 0.02% | 2 | 0.01% |

Figure 15 - Relative Est Frequency of Unique Known Genes Common to Mild and Severe cDNA Libraries - Page 10 of 19

| | | | | | | |
|---|---|---|---|---|---|---|
| 466 | adenylyl cyclase-associated protein (CAP) | L12168 | 3 | 0.02% | 2 | 0.01% |
| 467 | enterocyte differentiation associated factor EDAF-1 | U62136.2 | 3 | 0.02% | 2 | 0.01% |
| 468 | E6-AP ubiquitin-protein ligase (UBE3A) | AF009341.1 | 3 | 0.02% | 2 | 0.01% |
| 469 | AKAP450 protein | AJ131693.1 | 3 | 0.02% | 2 | 0.01% |
| 470 | protein-L-isoaspartate (D-aspartate) O-methyltransferase (PCMT1) (O | NM_005389.1 | 3 | 0.02% | 2 | 0.01% |
| 471 | ribosomal protein, large P2 (RPLP2) | NM_001004.1 | 2 | 0.02% | 2 | 0.01% |
| 472 | metallothionein-Ie (hMT-Ie) | M10942 | 2 | 0.02% | 2 | 0.01% |
| 473 | thymosin beta-10 | S54005 | 2 | 0.02% | 2 | 0.01% |
| 474 | ubiquitin-conjugating enzyme E2B (RAD6 homolog) (UBE2B) | NM_003337.1 | 2 | 0.02% | 2 | 0.01% |
| 475 | SMT3 (suppressor of mif two 3, yeast) homolog 2 (SMT3H2) | NM_006937.1 | 2 | 0.02% | 2 | 0.01% |
| 476 | AD-017 protein | AF157318.1 | 2 | 0.02% | 2 | 0.01% |
| 477 | KIAA0164 | D79986 | 2 | 0.02% | 2 | 0.01% |
| 478 | KIAA1077 | AB029000.1 | 2 | 0.02% | 2 | 0.01% |
| 479 | trichorhinophalangeal syndrome I gene (TRPS1) | NM_014112.1 | 2 | 0.02% | 2 | 0.01% |
| 480 | TATA box binding protein (TBP)-associated factor, RNA polymerase II, | NM_005642.1 | 2 | 0.02% | 2 | 0.01% |
| 481 | SWI/SNF related, matrix associated (SMARCA1) | gi4507066 | 2 | 0.02% | 2 | 0.01% |
| 482 | karyopherin alpha 4 (=importin alpha 3) (KPNA4) | NM_002268.1 | 2 | 0.02% | 2 | 0.01% |
| 483 | apoptosis related protein APR-1 | AF143235.2 | 2 | 0.02% | 2 | 0.01% |
| 484 | sorting nexin 6 (SNX6) | AF121856.1 | 2 | 0.02% | 2 | 0.01% |
| 485 | progesterone binding protein (HPR6.6) | gi5729874 | 2 | 0.02% | 2 | 0.01% |
| 486 | proteasome subunit HC9 | D00763 | 2 | 0.02% | 2 | 0.01% |
| 487 | dermatopontin | Z22865 | 2 | 0.02% | 2 | 0.01% |
| 488 | KIAA0766 | AB018309.1 | 2 | 0.02% | 2 | 0.01% |
| 489 | Id-2H | D13891 | 2 | 0.02% | 2 | 0.01% |
| 490 | CGI-07 protein | AF132941.1 | 2 | 0.02% | 2 | 0.01% |
| 491 | DNA polymerase zeta catalytic subunit (REV3) | AF157476.1 | 2 | 0.02% | 2 | 0.01% |
| 492 | KIAA0382 | AB002380 | 2 | 0.02% | 2 | 0.01% |
| 493 | KIAA1053 | AB028976.1 | 2 | 0.02% | 2 | 0.01% |
| 494 | NY-REN-45 antigen (LOC51133) | NM_016121.1 | 2 | 0.02% | 2 | 0.01% |
| 495 | splicing factor (CC1.4) | L10911.1 | 2 | 0.02% | 2 | 0.01% |
| 496 | t-complex polypeptide 1 | X52882 | 2 | 0.02% | 2 | 0.01% |
| 497 | restin (Reed-Steinberg cell-expressed intermediate filament-associated | NM_002956.1 | 2 | 0.02% | 2 | 0.01% |
| 498 | mannose 6-phosphate receptor, 46 kD (MPR46) | X56257 | 2 | 0.02% | 2 | 0.01% |
| 499 | replication protein A3 (14kD) (RPA3) | NM_002947.1 | 2 | 0.02% | 2 | 0.01% |
| 500 | anaphase promoting complex subunit 10 | AF132794.1 | 2 | 0.02% | 2 | 0.01% |
| 501 | KIAA0729 | AB018272.1 | 2 | 0.02% | 2 | 0.01% |
| 502 | lysophospholipase I (LYPLA1) | NM_006330.1 | 2 | 0.02% | 2 | 0.01% |
| 503 | cofilin isoform 1 | AF134802 | 2 | 0.02% | 2 | 0.01% |
| 504 | HSPC213 (=HSPC327) | AAF36133.1 | 2 | 0.02% | 2 | 0.01% |
| 505 | sperm antigen-36 | AF187554.1 | 2 | 0.02% | 2 | 0.01% |
| 506 | epb72 | X85117 | 2 | 0.02% | 2 | 0.01% |
| 507 | ribosomal protein L27A | AB020236.1 | 1 | 0.01% | 2 | 0.01% |
| 508 | ubiquitin A-52 residue ribosomal protein fusion product 1 (UBA52) | gi4507760 | 1 | 0.01% | 2 | 0.01% |
| 509 | enolase 1 (alpha) (ENO1) | NM_001428.1 | 1 | 0.01% | 2 | 0.01% |
| 510 | dolichyl-phosphate beta-glucosyltransferase (ALG5) | AF102850.1 | 1 | 0.01% | 2 | 0.01% |
| 511 | glutamine synthetase | S70290 | 1 | 0.01% | 2 | 0.01% |
| 512 | syntaxin 4 binding protein UNC-18c (UNC-18c) | AF032922.1 | 1 | 0.01% | 2 | 0.01% |
| 513 | lactate dehydrogenase B (LDH-B) | Y00711 | 1 | 0.01% | 2 | 0.01% |
| 514 | protein phosphatase 2 (formerly 2A), catalytic subunit, alpha isoform (F | NM_002715.1 | 1 | 0.01% | 2 | 0.01% |
| 515 | cellular growth-regulating protein | L10844 | 1 | 0.01% | 2 | 0.01% |
| 516 | ornithine aminotransferase | M29927 | 1 | 0.01% | 2 | 0.01% |
| 517 | ORF2 contains a reverse transcriptase domain | AAA51622.1 | 1 | 0.01% | 2 | 0.01% |

Figure 15 Relative Est Frequency of Unique Known Genes Common to Mild and Severe cDNA Libraries - Page 11 of 19

| | | | | | | |
|---|---|---|---|---|---|---|
| 518 | ORF2 contains a reverse transcriptase domain | AAB59368.1 | 1 | 0.01% | 2 | 0.01% |
| 519 | transforming, acidic coiled-coil containing protein 1 (TACC1=AF049910 | NM_006283.1 | 1 | 0.01% | 2 | 0.01% |
| 520 | KDEL (Lys-Asp-Glu-Leu) endoplasmic reticulum protein retention recep | NM_006854.2 | 1 | 0.01% | 2 | 0.01% |
| 521 | poly(rC)-binding protein 1 (PCBP1) | NM_006196.1 | 1 | 0.01% | 2 | 0.01% |
| 522 | Ia-associated invariant gamma-chain gene | M13560 | 1 | 0.01% | 2 | 0.01% |
| 523 | uncharacterized bone marrow protein BM034 (=AK000571 FLJ20564 f | AF217511.1 | 1 | 0.01% | 2 | 0.01% |
| 524 | zinc finger protein SLUG (SLUG) gene | AF084243.1 | 1 | 0.01% | 2 | 0.01% |
| 525 | basic transCRiption factor 2 p44 (btf2p44) gene, partial cds, neuronal a | U80017.1 | 1 | 0.01% | 2 | 0.01% |
| 526 | homeobox protein CDX4 (CDX4) gene | AF003530.1 | 1 | 0.01% | 2 | 0.01% |
| 527 | KIAA0530 | AB011102 | 1 | 0.01% | 2 | 0.01% |
| 528 | ribosomal protein L33-like protein | AF047440 | 1 | 0.01% | 2 | 0.01% |
| 529 | SOX4 | AF124147.1 | 1 | 0.01% | 2 | 0.01% |
| 530 | growth arrest specific transCRipt 5 gene | AF141346.1 | 1 | 0.01% | 2 | 0.01% |
| 531 | protein phosphatase 1 catalytic subunit, beta isoform (PPP1CB) | NM_002709.1 | 1 | 0.01% | 2 | 0.01% |
| 532 | glutaminase C | AF158555.1 | 1 | 0.01% | 2 | 0.01% |
| 533 | DNA-binding protein A gene | L29073.1 | 1 | 0.01% | 2 | 0.01% |
| 534 | YME1 (S.cerevisiae)-like 1(YME1L1), = AJ132637.1 ATP-dependent m | NM_014263.1 | 1 | 0.01% | 2 | 0.01% |
| 535 | LIM and SH3 protein 1 (LASP1) (=X82456 MLN50) | gi5453709 | 1 | 0.01% | 2 | 0.01% |
| 536 | high mobility group 2 protein (HMG-2) | M83665 | 1 | 0.01% | 2 | 0.01% |
| 537 | eukaryotic translation initiation factor 3, subunit 10 (theta, 150/170kD) | gi4503508 | 1 | 0.01% | 2 | 0.01% |
| 538 | protein kinase C inhibitor-I | U27143 | 1 | 0.01% | 2 | 0.01% |
| 539 | diphosphoinositol polyphosphate phosphohydrolase type 2 (NUDT4) | AF191654.2 | 1 | 0.01% | 2 | 0.01% |
| 540 | copine III (CPNE3) (=AB014536 KIAA0636) | gi4503014 | 1 | 0.01% | 2 | 0.01% |
| 541 | KIAA0077 gene | D38521.1 | 1 | 0.01% | 2 | 0.01% |
| 542 | KIAA0680 gene product (KIAA0680) | NM_014721.1 | 1 | 0.01% | 2 | 0.01% |
| 543 | KIAA1013 | AB023230.1 | 1 | 0.01% | 2 | 0.01% |
| 544 | seCReted protein of unknown function (SPUF) | AF173937.1 | 1 | 0.01% | 2 | 0.01% |
| 545 | CYTOCHROME C OXIDASE POLYPEPTIDE III | P00414 | 1 | 0.01% | 2 | 0.01% |
| 546 | farnesyl-protein transferase alpha-subunit | L00634 | 1 | 0.01% | 2 | 0.01% |
| 547 | sequestosome 1 (SQSTM1) (=U46751.1 phosphotyrosine independent | NM_003900.1 | 1 | 0.01% | 2 | 0.01% |
| 548 | Splicing factor proline/glutamine rich (polypyrimidine tract-binding prote | NM_005066.1 | 1 | 0.01% | 2 | 0.01% |
| 549 | activin A receptor, type I (ACVR1) =Z22534 ALK-2 | NM_001105.1 | 1 | 0.01% | 2 | 0.01% |
| 550 | M-phase phosphoprotein homologue | AF100742.1 | 1 | 0.01% | 2 | 0.01% |
| 551 | KIAA0336 gene | NM_014635.1 | 1 | 0.01% | 2 | 0.01% |
| 552 | CGI-130 protein | AF151888.1 | 1 | 0.01% | 2 | 0.01% |
| 553 | KIAA1058 protein | AB028981.1 | 1 | 0.01% | 2 | 0.01% |
| 554 | LIV-1 protein, estrogen regulated (LIV-1) (=U41060) | 7106340 | 1 | 0.01% | 2 | 0.01% |
| 555 | Rosenthal fiber protein (alpha-B-CRystallin) | M24906 | 1 | 0.01% | 2 | 0.01% |
| 556 | BPTF mRNA for bromodomain PHD finger transcription factor | AB032251.1 | 1 | 0.01% | 2 | 0.01% |
| 557 | alpha subunit of GsGTP binding protein (GSA) | X56009 | 1 | 0.01% | 2 | 0.01% |
| 558 | proteasome (prosome, maCRopain) subunit, beta type, 3 (PSMB3) | NM_002795.1 | 1 | 0.01% | 2 | 0.01% |
| 559 | heterogeneous nuclear protein similar to rat helix destabilizing protein ( | NM_005758.1 | 1 | 0.01% | 2 | 0.01% |
| 560 | Golgi vesicular membrane trafficking protein p18 (BET1) | gi5031610 | 1 | 0.01% | 2 | 0.01% |
| 561 | fukutin | AB038490.1 | 1 | 0.01% | 2 | 0.01% |
| 562 | KIAA0276 | D87466 | 1 | 0.01% | 2 | 0.01% |
| 563 | promyelocytic leukemia cell | M11948 | 1 | 0.01% | 2 | 0.01% |
| 564 | phosphoglucomutase 1 (PGM1) | M83088 | 1 | 0.01% | 2 | 0.01% |
| 565 | nucleotide binding protein, estradiol-induced (E2IG3) | NM_014366.1 | 1 | 0.01% | 2 | 0.01% |
| 566 | Lysyl tRNA Synthetase | D32053.1 | 1 | 0.01% | 2 | 0.01% |
| 567 | TPRC (=X97124 papillary renal cell carcinoma (translocation-associate | X99720 | 1 | 0.01% | 2 | 0.01% |
| 568 | nuclear matrix protein 55 | U89867.1 | 1 | 0.01% | 2 | 0.01% |
| 569 | RNA binding motif protein 3 (RBM3) (=U28686) | 5803136 | 1 | 0.01% | 2 | 0.01% |

Figure 15 Relative Est Frequency of Unique Known Genes Common to Mild and Severe cDNA Libraries - Page 12 of 19

| | | | | | | |
|---|---|---|---|---|---|---|
| 570 | CGI-34 protein | AF132968.1 | 1 | 0.01% | 2 | 0.01% |
| 571 | mitogen-activated protein kinase 3 (MAP4K3) | 4506376 | 1 | 0.01% | 2 | 0.01% |
| 572 | calcium channel alpha1E subunit (CACNA1E) gene | AF223391.1 | 1 | 0.01% | 2 | 0.01% |
| 573 | brain cellular apoptosis susceptibility protein (CSE1) | AF053641 | 1 | 0.01% | 2 | 0.01% |
| 574 | vacuolar ATPase isoform VA68 | AF113129.1 | 1 | 0.01% | 2 | 0.01% |
| 575 | septin 2-like cell division control protein | AF146760.1 | 1 | 0.01% | 2 | 0.01% |
| 576 | KIAA1265 | AB033091 | 1 | 0.01% | 2 | 0.01% |
| 577 | guanylate binding protein isoform II (GBP-2) | M55543 | 1 | 0.01% | 2 | 0.01% |
| 578 | RING zinc finger protein (RZF) | AF037204 | 1 | 0.01% | 2 | 0.01% |
| 579 | L-isoaspartyl/D-aspartyl protein carboxyl methyltransferase isozyme I | M93009 | 1 | 0.01% | 2 | 0.01% |
| 580 | cytochrome succinate dehydrogenase, small subunit | AB026906.1 | 1 | 0.01% | 2 | 0.01% |
| 581 | interleukin 13 receptor alpha 1 (IL13RA1) | NM_001560.1 | 1 | 0.01% | 2 | 0.01% |
| 582 | 15 kDa selenoprotein (SEP15), mRNA /cds=(4,492) /gb=NM_004261 /( | Hs.90606 | 1 | 0.01% | 2 | 0.01% |
| 583 | HSPC019 | AF077205.1 | 1 | 0.01% | 2 | 0.01% |
| 584 | KIAA0783 | AB018326.1 | 1 | 0.01% | 2 | 0.01% |
| 585 | NDPP-1 protein | D10727.1 | 1 | 0.01% | 2 | 0.01% |
| 586 | Sid3177 | AB024935.1 | 1 | 0.01% | 2 | 0.01% |
| 587 | SON DNA binding protein isoform E (SON) mRNA, complete cds, alter | Hs.92909 | 1 | 0.01% | 2 | 0.01% |
| 588 | split hand/foot deleted gene 1 | NP_033195.1 | 1 | 0.01% | 2 | 0.01% |
| 589 | MKP-1 like protein tyrosine phosphatase | AF038844 | 1 | 0.01% | 2 | 0.01% |
| 590 | Gem GTPase (gem) | U10550 | 1 | 0.01% | 2 | 0.01% |
| 591 | plasma cell membrane glycoprotein (PC-1) | M57736.1 | 1 | 0.01% | 2 | 0.01% |
| 592 | acyl-CoA synthetase 4 (ACS4) | AF030555 | 1 | 0.01% | 2 | 0.01% |
| 593 | NADH-ubiquinone oxidoreductase MNLL subunit | AF050638.1 | 1 | 0.01% | 2 | 0.01% |
| 594 | leucine-rich repeat (LRR) protein (P37NB) 37 kDa | NM_005824.1 | 1 | 0.01% | 2 | 0.01% |
| 595 | beta-migrating plasminogen activator inhibitor I | M14083 | 1 | 0.01% | 2 | 0.01% |
| 596 | proteasome subunit X (=X95586 MB1) | D29011 | 1 | 0.01% | 2 | 0.01% |
| 597 | FUSE binding protein 3 (FBP3) | U69127.1 | 1 | 0.01% | 2 | 0.01% |
| 598 | transCRiptional activation factor TAFII32 (=AF151895 CGI-137 protein | U21858 | 1 | 0.01% | 2 | 0.01% |
| 599 | CGI-114 protein (=DKFZp566E144) | AF151872.1 | 1 | 0.01% | 2 | 0.01% |
| 600 | CGI-123 protein | AF151881.1 | 1 | 0.01% | 2 | 0.01% |
| 601 | CGI-24 protein | AF132958.1 | 1 | 0.01% | 2 | 0.01% |
| 602 | nuclear pore complex protein hnup153 | Z25535 | 1 | 0.01% | 2 | 0.01% |
| 603 | ras-related YPT1 protein (ORF) | P11476 | 1 | 0.01% | 2 | 0.01% |
| 604 | Opa-interacting protein OIP2 | AF025438 | 1 | 0.01% | 2 | 0.01% |
| 605 | cartilage link protein (CRTL1) | U43328.1 | 31 | 0.25% | 1 | 0.01% |
| 606 | fatty acid binding protein (adipocyte lipid-binding protein) | NM_001442.1 | 18 | 0.14% | 1 | 0.01% |
| 607 | hemoglobin beta chain (HBB) | AF117710 | 16 | 0.13% | 1 | 0.01% |
| 608 | fatty acid binding protein 4, adipocyte (FABP4), mRNA /cds=(47,445) /( | Hs.83213 | 15 | 0.12% | 1 | 0.01% |
| 609 | ubiquitin-like 1 (sentrin) (UBL1) (=SUMO-1) | NM_003352.1 | 9 | 0.07% | 1 | 0.01% |
| 610 | phenylalkylamine binding protein gene | AF196969.1 | 7 | 0.06% | 1 | 0.01% |
| 611 | signal recognition particle 14kD (homologous Alu RNA-binding protein) | NM_003134.1 | 6 | 0.05% | 1 | 0.01% |
| 612 | KVLQT1 gene (=p150) | AJ006345.1 | 6 | 0.05% | 1 | 0.01% |
| 613 | alpha-2-macroglobulin | D83196 | 6 | 0.05% | 1 | 0.01% |
| 614 | metallothionein 1L (MT1L) | NM_002450.1 | 5 | 0.04% | 1 | 0.01% |
| 615 | thrombospondin 1 (THBS1) | NM_003246.1 | 5 | 0.04% | 1 | 0.01% |
| 616 | Kallmann syndrome 1 (KAL1) (=ADMLX=putative adhesion molecule) | NM_000216.1 | 5 | 0.04% | 1 | 0.01% |
| 617 | YAP65 | X80507.1 | 4 | 0.03% | 1 | 0.01% |
| 618 | protein phosphatase 2A catalytic subunit-beta | M60484 | 4 | 0.03% | 1 | 0.01% |
| 619 | KIAA0191 (zinc finger homolog) | D83776 | 4 | 0.03% | 1 | 0.01% |
| 620 | protein immuno-reactive with anti-PTH polyclonal antibodies | U28831.1 | 4 | 0.03% | 1 | 0.01% |
| 621 | ATP SYNTHASE GAMMA CHAIN, MITOCHONDRIAL PRECURSOR | spP36542 | 4 | 0.03% | 1 | 0.01% |

Figure 15 Relative Est Frequency of Unique Known Genes Common to Mild and Severe cDNA Libraries - Page 13 of 19

| | | | | | | |
|---|---|---|---|---|---|---|
| 622 | catalase | X04076 | 4 | 0.03% | 1 | 0.01% |
| 623 | HSPC067 | AF161552_1 | 4 | 0.03% | 1 | 0.01% |
| 624 | ribosomal RNA 16S gene | AF036006.1 | 4 | 0.03% | 1 | 0.01% |
| 625 | ribosomal protein L8 | Z28407 | 3 | 0.02% | 1 | 0.01% |
| 626 | peripheral myelin protein 22 | M94048 | 3 | 0.02% | 1 | 0.01% |
| 627 | dioxin-inducible cytochrome P450 (CYP1B1) | U03688.1 | 3 | 0.02% | 1 | 0.01% |
| 628 | MAGUK protein p55T (=AB002323 KIAA0325) | AF162130.1 | 3 | 0.02% | 1 | 0.01% |
| 629 | PPP1R5 | AF110824.1 | 3 | 0.02% | 1 | 0.01% |
| 630 | splicing factor SRp40-1 (SRp40) | U30826.1 | 3 | 0.02% | 1 | 0.01% |
| 631 | splicing factor, arginine/serine-rich 5 (RefSeq aa 1e-54) | NP_008856.1 | 3 | 0.02% | 1 | 0.01% |
| 632 | NADH-UBIQUINONE OXIDOREDUCTASE CHAIN 1 | spP03886 | 3 | 0.02% | 1 | 0.01% |
| 633 | HSPC307 | AF161425.1 | 3 | 0.02% | 1 | 0.01% |
| 634 | immunoglobulin light chain | D87000 | 3 | 0.02% | 1 | 0.01% |
| 635 | lysosomal-associated membrane glycoprotein-1 (LAMP1) (=J04182) | L08582 | 3 | 0.02% | 1 | 0.01% |
| 636 | cornichon protein | AF070654.1 | 3 | 0.02% | 1 | 0.01% |
| 637 | okadaic acid-inducible and cAMP-regulated phosphoprotein 19 (ARPP | AF084555.1 | 3 | 0.02% | 1 | 0.01% |
| 638 | SH3 domain-containing protein SH3P18 | U61167 | 3 | 0.02% | 1 | 0.01% |
| 639 | KIAA1025 | AB028948.1 | 3 | 0.02% | 1 | 0.01% |
| 640 | LGMD2B | AJ007973 | 3 | 0.02% | 1 | 0.01% |
| 641 | CAR (RFP2) | AF279660 | 3 | 0.02% | 1 | 0.01% |
| 642 | NADH dehydrogenase(ubiquinone) 1 beta subcomplex, 3 (12kD, B12) | NM_002491.1 | 3 | 0.02% | 1 | 0.01% |
| 643 | KIAA0579 | AB011151.1 | 3 | 0.02% | 1 | 0.01% |
| 644 | KIAA0977 | AB023194.1 | 3 | 0.02% | 1 | 0.01% |
| 645 | KIAA0573 | AB011145 | 3 | 0.02% | 1 | 0.01% |
| 646 | polyadenylate binding protein-interacting protein 1 (PAIP1) | NM_006451.1 | 3 | 0.02% | 1 | 0.01% |
| 647 | Translocon associated protein gamma subunit | spQ9UNL2 | 3 | 0.02% | 1 | 0.01% |
| 648 | secreted frizzled-related protein 4 (SFRP4) | NM_003014.2 | 3 | 0.02% | 1 | 0.01% |
| 649 | phosphatase 1, catalytic subunit, gamma isoform (PPP1CC) mRNA | NM_002710.1 | 3 | 0.02% | 1 | 0.01% |
| 650 | ring finger protein (C3H2C3 type) 6 (RNF6) | NM_005977.1 | 3 | 0.02% | 1 | 0.01% |
| 651 | putative transmembrane protein E3-16 | AF092128.1 | 3 | 0.02% | 1 | 0.01% |
| 652 | epithelial protein lost in neoplasm beta (EPLIN) | NM_016357.1 | 3 | 0.02% | 1 | 0.01% |
| 653 | laminin receptor 1 (67kD, ribosomal protein SA) (LAMR1)(ORF) | NM_002295.1 | 2 | 0.02% | 1 | 0.01% |
| 654 | t-complex-associated-testis-expressed 1-like 1 (TCTEL1) | NM_006519.1 | 2 | 0.02% | 1 | 0.01% |
| 655 | collagen type XIV variant C-terminal NC1 and 3'UTR | Y11711 | 2 | 0.02% | 1 | 0.01% |
| 656 | reverse transcriptase related protein | prf1207289A | 2 | 0.02% | 1 | 0.01% |
| 657 | JKTBP2, JKTBP1, complete cds | AB017018.1 | 2 | 0.02% | 1 | 0.01% |
| 658 | latent transforming growth factor beta binding protein 1 (LTBP1) | NM_000627.1 | 2 | 0.02% | 1 | 0.01% |
| 659 | laminin B2 chain | M55210 | 2 | 0.02% | 1 | 0.01% |
| 660 | HSPC025 (HSPC025) | NM_016091.1 | 2 | 0.02% | 1 | 0.01% |
| 661 | insulin-like growth factor I | X57025 | 2 | 0.02% | 1 | 0.01% |
| 662 | clathrin, light polypeptide (Lca) (CLTA) | NM_007096.1 | 2 | 0.02% | 1 | 0.01% |
| 663 | IDN3 | AB019494.1 | 2 | 0.02% | 1 | 0.01% |
| 664 | KIAA0069 gene | D31885.1 | 2 | 0.02% | 1 | 0.01% |
| 665 | immunoglobulin lambda gene | D87003.1 | 2 | 0.02% | 1 | 0.01% |
| 666 | KIAA0038 gene | D26068.1 | 2 | 0.02% | 1 | 0.01% |
| 667 | disabled 2 p93 (DAB2) (mitogen-responsive phosphoprotein) (DAB2) | AF188298.1 | 2 | 0.02% | 1 | 0.01% |
| 668 | CD36 antigen | L06850.1 | 2 | 0.02% | 1 | 0.01% |
| 669 | guanine nucleotide binding protein 11 (GNG11) = U31384.1 | NM_004126.1 | 2 | 0.02% | 1 | 0.01% |
| 670 | KIAA0436 | AB007896 | 2 | 0.02% | 1 | 0.01% |
| 671 | conserved gene amplified in osteosarcoma (OS4) | NM_005730.1 | 2 | 0.02% | 1 | 0.01% |
| 672 | mitochondrial coxII | X55654.1 | 2 | 0.02% | 1 | 0.01% |
| 673 | cytochrome C oxidase II subunit (ORF) | X55654 | 2 | 0.02% | 1 | 0.01% |

Figure 15:
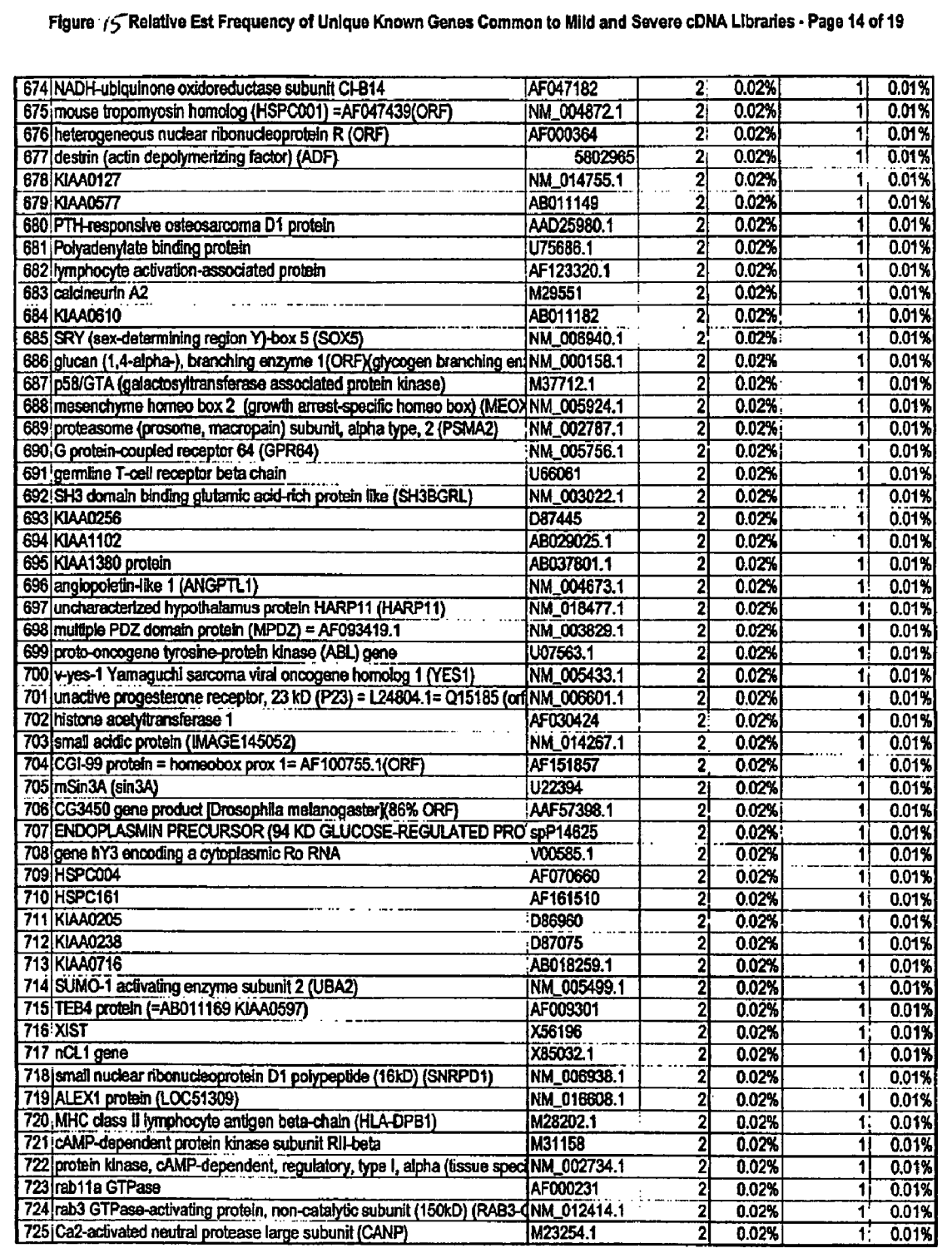

Figure 15 Relative Est Frequency of Unique Known Genes Common to Mild and Severe cDNA Libraries - Page 14 of 19

| | | | | | | |
|---|---|---|---|---|---|---|
| 674 | NADH-ubiquinone oxidoreductase subunit CI-B14 | AF047182 | 2 | 0.02% | 1 | 0.01% |
| 675 | mouse tropomyosin homolog (HSPC001) =AF047439(ORF) | NM_004872.1 | 2 | 0.02% | 1 | 0.01% |
| 676 | heterogeneous nuclear ribonucleoprotein R (ORF) | AF000364 | 2 | 0.02% | 1 | 0.01% |
| 677 | destrin (actin depolymerizing factor) (ADF) | 5802965 | 2 | 0.02% | 1 | 0.01% |
| 678 | KIAA0127 | NM_014755.1 | 2 | 0.02% | 1 | 0.01% |
| 679 | KIAA0577 | AB011149 | 2 | 0.02% | 1 | 0.01% |
| 680 | PTH-responsive osteosarcoma D1 protein | AAD25980.1 | 2 | 0.02% | 1 | 0.01% |
| 681 | Polyadenylate binding protein | U75686.1 | 2 | 0.02% | 1 | 0.01% |
| 682 | lymphocyte activation-associated protein | AF123320.1 | 2 | 0.02% | 1 | 0.01% |
| 683 | calcineurin A2 | M29551 | 2 | 0.02% | 1 | 0.01% |
| 684 | KIAA0610 | AB011182 | 2 | 0.02% | 1 | 0.01% |
| 685 | SRY (sex-determining region Y)-box 5 (SOX5) | NM_006940.1 | 2 | 0.02% | 1 | 0.01% |
| 686 | glucan (1,4-alpha-), branching enzyme 1(ORF)(glycogen branching en: | NM_000158.1 | 2 | 0.02% | 1 | 0.01% |
| 687 | p58/GTA (galactosyltransferase associated protein kinase) | M37712.1 | 2 | 0.02% | 1 | 0.01% |
| 688 | mesenchyme homeo box 2 (growth arrest-specific homeo box) (MEOX | NM_005924.1 | 2 | 0.02% | 1 | 0.01% |
| 689 | proteasome (prosome, macropain) subunit, alpha type, 2 (PSMA2) | NM_002787.1 | 2 | 0.02% | 1 | 0.01% |
| 690 | G protein-coupled receptor 64 (GPR64) | NM_005756.1 | 2 | 0.02% | 1 | 0.01% |
| 691 | germline T-cell receptor beta chain | U66061 | 2 | 0.02% | 1 | 0.01% |
| 692 | SH3 domain binding glutamic acid-rich protein like (SH3BGRL) | NM_003022.1 | 2 | 0.02% | 1 | 0.01% |
| 693 | KIAA0256 | D87445 | 2 | 0.02% | 1 | 0.01% |
| 694 | KIAA1102 | AB029025.1 | 2 | 0.02% | 1 | 0.01% |
| 695 | KIAA1380 protein | AB037801.1 | 2 | 0.02% | 1 | 0.01% |
| 696 | angiopoietin-like 1 (ANGPTL1) | NM_004673.1 | 2 | 0.02% | 1 | 0.01% |
| 697 | uncharacterized hypothalamus protein HARP11 (HARP11) | NM_018477.1 | 2 | 0.02% | 1 | 0.01% |
| 698 | multiple PDZ domain protein (MPDZ) = AF093419.1 | NM_003829.1 | 2 | 0.02% | 1 | 0.01% |
| 699 | proto-oncogene tyrosine-protein kinase (ABL) gene | U07563.1 | 2 | 0.02% | 1 | 0.01% |
| 700 | v-yes-1 Yamaguchi sarcoma viral oncogene homolog 1 (YES1) | NM_005433.1 | 2 | 0.02% | 1 | 0.01% |
| 701 | unactive progesterone receptor, 23 kD (P23) = L24804.1= Q15185 (orf | NM_006601.1 | 2 | 0.02% | 1 | 0.01% |
| 702 | histone acetyltransferase 1 | AF030424 | 2 | 0.02% | 1 | 0.01% |
| 703 | small acidic protein (IMAGE145052) | NM_014267.1 | 2 | 0.02% | 1 | 0.01% |
| 704 | CGI-99 protein = homeobox prox 1= AF100755.1(ORF) | AF151857 | 2 | 0.02% | 1 | 0.01% |
| 705 | mSin3A (sin3A) | U22394 | 2 | 0.02% | 1 | 0.01% |
| 706 | CG3450 gene product [Drosophila melanogaster](86% ORF) | AAF57398.1 | 2 | 0.02% | 1 | 0.01% |
| 707 | ENDOPLASMIN PRECURSOR (94 KD GLUCOSE-REGULATED PRO | spP14625 | 2 | 0.02% | 1 | 0.01% |
| 708 | gene hY3 encoding a cytoplasmic Ro RNA | V00585.1 | 2 | 0.02% | 1 | 0.01% |
| 709 | HSPC004 | AF070660 | 2 | 0.02% | 1 | 0.01% |
| 710 | HSPC161 | AF161510 | 2 | 0.02% | 1 | 0.01% |
| 711 | KIAA0205 | D86960 | 2 | 0.02% | 1 | 0.01% |
| 712 | KIAA0238 | D87075 | 2 | 0.02% | 1 | 0.01% |
| 713 | KIAA0716 | AB018259.1 | 2 | 0.02% | 1 | 0.01% |
| 714 | SUMO-1 activating enzyme subunit 2 (UBA2) | NM_005499.1 | 2 | 0.02% | 1 | 0.01% |
| 715 | TEB4 protein (=AB011169 KIAA0597) | AF009301 | 2 | 0.02% | 1 | 0.01% |
| 716 | XIST | X56196 | 2 | 0.02% | 1 | 0.01% |
| 717 | nCL1 gene | X85032.1 | 2 | 0.02% | 1 | 0.01% |
| 718 | small nuclear ribonucleoprotein D1 polypeptide (16kD) (SNRPD1) | NM_006938.1 | 2 | 0.02% | 1 | 0.01% |
| 719 | ALEX1 protein (LOC51309) | NM_016608.1 | 2 | 0.02% | 1 | 0.01% |
| 720 | MHC class II lymphocyte antigen beta-chain (HLA-DPB1) | M28202.1 | 2 | 0.02% | 1 | 0.01% |
| 721 | cAMP-dependent protein kinase subunit RII-beta | M31158 | 2 | 0.02% | 1 | 0.01% |
| 722 | protein kinase, cAMP-dependent, regulatory, type I, alpha (tissue spec | NM_002734.1 | 2 | 0.02% | 1 | 0.01% |
| 723 | rab11a GTPase | AF000231 | 2 | 0.02% | 1 | 0.01% |
| 724 | rab3 GTPase-activating protein, non-catalytic subunit (150kD) (RAB3-( | NM_012414.1 | 2 | 0.02% | 1 | 0.01% |
| 725 | Ca2-activated neutral protease large subunit (CANP) | M23254.1 | 2 | 0.02% | 1 | 0.01% |

Figure 5 - Relative Est Frequency of Unique Known Genes Common to Mild and Severe cDNA Libraries - Page 15 of 19

| | | | | | | |
|---|---|---|---|---|---|---|
| 726 | histone H2A.Z= M37583 | X52317 | 2 | 0.02% | 1 | 0.01% |
| 727 | inhibitor of apoptosis protein 2 | U45879 | 2 | 0.02% | 1 | 0.01% |
| 728 | KIAA0594 | AB011166 | 2 | 0.02% | 1 | 0.01% |
| 729 | ring finger protein 13 (RNF13), mRNA /cds=(151,1296) /gb=NM_0072ℇ | Hs.6900 | 2 | 0.02% | 1 | 0.01% |
| 730 | ribosomal protein S18 | X69150.1 | 1 | 0.01% | 1 | 0.01% |
| 731 | ribosomal protein S5 (RPS5) | NM_001009.1 | 1 | 0.01% | 1 | 0.01% |
| 732 | metallothionein-II (mt-II) | J00271 | 1 | 0.01% | 1 | 0.01% |
| 733 | v-fos FBJ murine osteosarcoma viral oncogene homolog (FOS) | NM_005252.2 | 1 | 0.01% | 1 | 0.01% |
| 734 | deiodinase, iodothyronine, type II (DIO2), transCRipt variant 1 | gi7549802 | 1 | 0.01% | 1 | 0.01% |
| 735 | insulin-like growth factor binding protein 5 (IGFBP5) gene | L27556.1 | 1 | 0.01% | 1 | 0.01% |
| 736 | enhancer-of-split and hairy-related protein 1 (SHARP-1) | AF009329.1 | 1 | 0.01% | 1 | 0.01% |
| 737 | colon carcinoma laminin-binding protein (=RIBOSOMAL PROTEIN SA | J03799.1 | 1 | 0.01% | 1 | 0.01% |
| 738 | transmembrane protein (p63) | X69910 | 1 | 0.01% | 1 | 0.01% |
| 739 | peroxiredoxin 1 (PRDX1) (=NKEFA) | NM_002574.1 | 1 | 0.01% | 1 | 0.01% |
| 740 | RIBOSOMAL PROTEIN SA (P40) | spP08865 | 1 | 0.01% | 1 | 0.01% |
| 741 | WSB-1 isoform | AF106684.1 | 1 | 0.01% | 1 | 0.01% |
| 742 | high-mobility group (nonhistone chromosomal) protein 17 (HMG17) | NM_005517.1 | 1 | 0.01% | 1 | 0.01% |
| 743 | prostatic binding protein (PBP) | NM_002567.1 | 1 | 0.01% | 1 | 0.01% |
| 744 | complement component 1, s subcomponent (C1S) | NM_001734.1 | 1 | 0.01% | 1 | 0.01% |
| 745 | dual specificity phosphatase 1 (DUSP1) | NM_004417.2 | 1 | 0.01% | 1 | 0.01% |
| 746 | KIAA0143 gene | D63477.1 | 1 | 0.01% | 1 | 0.01% |
| 747 | non-metastatic cells 2, protein (NM23B) expressed in (NME2) | NM_002512.1 | 1 | 0.01% | 1 | 0.01% |
| 748 | high density lipoprotein binding protein (HBP) | M64098 | 1 | 0.01% | 1 | 0.01% |
| 749 | cathepsin L (CTSL) | NM_001912.1 | 1 | 0.01% | 1 | 0.01% |
| 750 | NADH dehydrogenase (ubiquinone) 1 beta subcomplex, 1 (7kD, MNLL | NM_004545.1 | 1 | 0.01% | 1 | 0.01% |
| 751 | cyclophilin-related protein (NKTR) gene (=PAC RPCI4-613B23) | AF184110.1 | 1 | 0.01% | 1 | 0.01% |
| 752 | U50HG genes for U50' snoRNA and U50 snoRNA, complete sequence | AB017710 | 1 | 0.01% | 1 | 0.01% |
| 753 | RAD21 (S. pombe) homolog (RAD21) (=X98294) | gi5453993 | 1 | 0.01% | 1 | 0.01% |
| 754 | myeloid/lymphoid or mixed-lineage leukemia (trithorax (Drosophila) hor | NM_005935.1 | 1 | 0.01% | 1 | 0.01% |
| 755 | chaperonin containing TCP1 subunit 4 (delta) (CCT4) | NM_006430.1 | 1 | 0.01% | 1 | 0.01% |
| 756 | Membrane cofactor protein | X59408.1 | 1 | 0.01% | 1 | 0.01% |
| 757 | KIAA0349 gene | AB002347.1 | 1 | 0.01% | 1 | 0.01% |
| 758 | p130 (130K protein) | X76061.1 | 1 | 0.01% | 1 | 0.01% |
| 759 | ORF2 [Canis familiaris](60%) | AB012223 | 1 | 0.01% | 1 | 0.01% |
| 760 | karyopherin (importin) beta 1 (KPNB1) (=L38951 importin beta subunit | gi4504904 | 1 | 0.01% | 1 | 0.01% |
| 761 | signal peptidase complex (18kD) (SPC18) | NM_014300.1 | 1 | 0.01% | 1 | 0.01% |
| 762 | hexosaminidase B (beta polypeptide) (HEXB)(ORF) | NM_000521.1 | 1 | 0.01% | 1 | 0.01% |
| 763 | four and a half LIM domains 1 (FHL1) | NM_001449.1 | 1 | 0.01% | 1 | 0.01% |
| 764 | fibroblast growth factor 2 (basic)(FGF2) | NM_002006.1 | 1 | 0.01% | 1 | 0.01% |
| 765 | NADH dehydrogenase(ubiquinone) 1, alpha/beta subcomplex, 1 (8kD, | NM_005003.1 | 1 | 0.01% | 1 | 0.01% |
| 766 | 5T4 oncofetal trophoblast glycoprotein (5T4) | NM_006670.1 | 1 | 0.01% | 1 | 0.01% |
| 767 | Autosomal Highly Conserved Protein (AHCP) (=DKFZp586G051) | NM_016255.1 | 1 | 0.01% | 1 | 0.01% |
| 768 | KIAA0853 | AB020660.1 | 1 | 0.01% | 1 | 0.01% |
| 769 | meningioma-expressed antigen 5 (MEA5) (=KIAA0679) | AF036145 | 1 | 0.01% | 1 | 0.01% |
| 770 | PTEN (PTEN) gene | AF143312.1 | 1 | 0.01% | 1 | 0.01% |
| 771 | prolylcarboxypeptidase (angiotensinase C) (PRCP) | NM_005040.1 | 1 | 0.01% | 1 | 0.01% |
| 772 | GLI-Kruppel family member GLI3 (Greig cephalopolysyndactyly syndro | gi4504014 | 1 | 0.01% | 1 | 0.01% |
| 773 | zinc finger protein 84 (HPF2) (ZNF84) | NM_003428.1 | 1 | 0.01% | 1 | 0.01% |
| 774 | RNA polymerase II subunit hsRPB7 | U20659.1 | 1 | 0.01% | 1 | 0.01% |
| 775 | tubulin-specific chaperone a (TBCA) (=AF038952 cofactor A protein) | gi4759211 | 1 | 0.01% | 1 | 0.01% |
| 776 | polycystic kidney disease 2 (autosomal dominant) | NM_000297.1 | 1 | 0.01% | 1 | 0.01% |
| 777 | oxysterol-binding protein | AB017026 | 1 | 0.01% | 1 | 0.01% |

Figure 15- Relative Est Frequency of Unique Known Genes Common to Mild and Severe cDNA Libraries - Page 16 of 19

| | | | | | | |
|---|---|---|---|---|---|---|
| 778 | ubiquinol-cytochrome c reductase core protein II (UQCRC2)(ORF) = J( | NM_003366.1 | 1 | 0.01% | 1 | 0.01% |
| 779 | NADH-UBIQUINONE OXIDOREDUCTASE CHAIN 4L | spP03901 | 1 | 0.01% | 1 | 0.01% |
| 780 | thioredoxin peroxidase (antioxidant enzyme) (AOE372) =U25182(ORF | NM_006406.1 | 1 | 0.01% | 1 | 0.01% |
| 781 | cytoskeletal tropomyosin TM30(nm) | X04588.1 | 1 | 0.01% | 1 | 0.01% |
| 782 | ring finger protein 4 (RNF4) | gi4506560 | 1 | 0.01% | 1 | 0.01% |
| 783 | TSE1=protein kinase A regulatory subunit | S54711 | 1 | 0.01% | 1 | 0.01% |
| 784 | SUMO-1-specific protease (KIAA0797) | NM_015571.1 | 1 | 0.01% | 1 | 0.01% |
| 785 | myosin-binding protein C, cardiac (MYBPC3) | NM_000256.1 | 1 | 0.01% | 1 | 0.01% |
| 786 | ATP synthase, H transporting, mitochondrial F0 complex, subunit f, iso | NM_004889.1 | 1 | 0.01% | 1 | 0.01% |
| 787 | hect domain and RLD 2(HERC2) (=KIAA0393) | NM_004667.2 | 1 | 0.01% | 1 | 0.01% |
| 788 | integrin cytoplasmic domain associated protein (Icap-1a) | AF012023 | 1 | 0.01% | 1 | 0.01% |
| 789 | BUP | AF078848.1 | 1 | 0.01% | 1 | 0.01% |
| 790 | KIAA0235 | D87078 | 1 | 0.01% | 1 | 0.01% |
| 791 | PDNP1 gene (nucleotide pyrophosphatase) | AF110304.1 | 1 | 0.01% | 1 | 0.01% |
| 792 | phosphoribosyl pyrophosphate synthetase subunit I | D00860.1 | 1 | 0.01% | 1 | 0.01% |
| 793 | wbsCR1 (WBSCR1) | AF045555.1 | 1 | 0.01% | 1 | 0.01% |
| 794 | proteasome (prosome, macropain) subunit, alpha type, 3 (PSMA3) | NM_002788.1 | 1 | 0.01% | 1 | 0.01% |
| 795 | CLP (CLPP) | L54057.1 | 1 | 0.01% | 1 | 0.01% |
| 796 | Tax1 (human T-cell leukemia virus type I) binding protein 1 (TAX1BP1) | NM_006024.2 | 1 | 0.01% | 1 | 0.01% |
| 797 | platelet-activating factor acetylhydrolase, isoform 1b, alpha subunit (PA | 4557740 | 1 | 0.01% | 1 | 0.01% |
| 798 | transferrin receptor (TFRC) gene | AF187320 | 1 | 0.01% | 1 | 0.01% |
| 799 | CGI-127 protein | AF151885.1 | 1 | 0.01% | 1 | 0.01% |
| 800 | microvascular endothelial differentiation gene 1 product | AB026908.1 | 1 | 0.01% | 1 | 0.01% |
| 801 | vanilloid receptor; CARKL and CTNS; TIP1; P2X5b and P2X5a | AF168787.1 | 1 | 0.01% | 1 | 0.01% |
| 802 | vitiligo-associated protein VIT-1 (VIT1) (=DKFZp564K2364) | AF264714.1 | 1 | 0.01% | 1 | 0.01% |
| 803 | small EDRK-rich factor 1, long isoform (SERF1) (=btf2p44) | AF073519.1 | 1 | 0.01% | 1 | 0.01% |
| 804 | translin | X78627 | 1 | 0.01% | 1 | 0.01% |
| 805 | ionizing radiation resistance conferring protein (=X83544 DAP-3) | U18321 | 1 | 0.01% | 1 | 0.01% |
| 806 | CGI-116 protein(LOC51019)(ORF)= AF155655 protein x 0009 mRNA | NM_016053.1 | 1 | 0.01% | 1 | 0.01% |
| 807 | tropomyosin | M19267 | 1 | 0.01% | 1 | 0.01% |
| 808 | hXBP-1 transcription factor DNA (=TREB protein) | L13850.1 | 1 | 0.01% | 1 | 0.01% |
| 809 | KARP-1-binding protein 3 (=KIAA0470) | AB022659.1 | 1 | 0.01% | 1 | 0.01% |
| 810 | inducible 6-phosphofructo-2-kinase/fructose 2,6-bisphosphatase (iPFK | AF056320 | 1 | 0.01% | 1 | 0.01% |
| 811 | GTPase activating protein (rap1GAP) | M64788 | 1 | 0.01% | 1 | 0.01% |
| 812 | guanine nucleotide binding protein (G protein), alpha inhibiting activity | NM_006496.1 | 1 | 0.01% | 1 | 0.01% |
| 813 | COX VIa-L cytochrome c oxidase liver-specific subunit VIa (EC 1.9.3.1 | X15341.1 | 1 | 0.01% | 1 | 0.01% |
| 814 | integrin, beta 5 (ITGB5) | NM_002213.1 | 1 | 0.01% | 1 | 0.01% |
| 815 | DNA topoisomerase II (TOP2) | Z15115 | 1 | 0.01% | 1 | 0.01% |
| 816 | squalene epoxidase | D78129 | 1 | 0.01% | 1 | 0.01% |
| 817 | Krueppel-related DNA-binding protein (PF4) | M61866 | 1 | 0.01% | 1 | 0.01% |
| 818 | RNA helicase | AJ223948 | 1 | 0.01% | 1 | 0.01% |
| 819 | nuclear receptor subfamily 3, group C, member 1 (NR3C1) | NM_000176.1 | 1 | 0.01% | 1 | 0.01% |
| 820 | potassium channel modulatory factor (=DKFZp434L1021) | AF155652.1 | 1 | 0.01% | 1 | 0.01% |
| 821 | nuclear phosphoprotein similar to S. cerevisiae | NM_007062.1 | 1 | 0.01% | 1 | 0.01% |
| 822 | COP9 complex subunit 4 (LOC51138) | NM_016129.1 | 1 | 0.01% | 1 | 0.01% |
| 823 | endomembrane protein EMP70 precusor isologue | U95973 | 1 | 0.01% | 1 | 0.01% |
| 824 | adipocyte acid phosphatase beta=phenylarsine oxide-sensitive tyrosyl | S62885.1 | 1 | 0.01% | 1 | 0.01% |
| 825 | dead box, X isoform (DBX) | AF000982.1 | 1 | 0.01% | 1 | 0.01% |
| 826 | major histocompatibility locus class III regions Hsc70t (smRNP, G7A, N | AF109905 | 1 | 0.01% | 1 | 0.01% |
| 827 | ankyrin G (ANK-3) | U13616.1 | 1 | 0.01% | 1 | 0.01% |
| 828 | spectrin beta protein (pAZSP 3' end) | X91849.2 | 1 | 0.01% | 1 | 0.01% |
| 829 | antigen NY-CO-1 (NY-CO-1) | AF039687.1 | 1 | 0.01% | 1 | 0.01% |

Figure 15 Relative Est Frequency of Unique Known Genes Common to Mild and Severe cDNA Libraries - Page 17 of 19

| | | | | | | |
|---|---|---|---|---|---|---|
| 830 | GS3955 | D87119 | 1 | 0.01% | 1 | 0.01% |
| 831 | HBV pX associated protein-8 (LOC51773) | NM_016578.1 | 1 | 0.01% | 1 | 0.01% |
| 832 | hyperion gene | AJ010770 | 1 | 0.01% | 1 | 0.01% |
| 833 | KIAA0090 | D42044 | 1 | 0.01% | 1 | 0.01% |
| 834 | KIAA0170 | D79992 | 1 | 0.01% | 1 | 0.01% |
| 835 | KIAA0379 | AB002377 | 1 | 0.01% | 1 | 0.01% |
| 836 | myeloid cell nuclear differentiation antigen | M81750 | 1 | 0.01% | 1 | 0.01% |
| 837 | peroxisomal acyl-CoA:dihydroxyacetonephosphate acyltransferase (DH | AF043937 | 1 | 0.01% | 1 | 0.01% |
| 838 | serologically defined colon cancer antigen 1 (SDCCAG1) | NM_004713.1 | 1 | 0.01% | 1 | 0.01% |
| 839 | suppressor of G2 allele | NM_006704.1 | 1 | 0.01% | 1 | 0.01% |
| 840 | methylene tetrahydrofolate dehydrogenase (NAD dependent), methen | NM_006636.1 | 1 | 0.01% | 1 | 0.01% |
| 841 | aspartyl glucosaminidase (AGA) | X55330 | 1 | 0.01% | 1 | 0.01% |
| 842 | osteoblast specific cysteine-rich protein, complete cds | AB008375 | 1 | 0.01% | 1 | 0.01% |
| 843 | glutamic-oxaloacetic transaminase 2, mitochondrial (aspartate aminotr | NM_002080.1 | 1 | 0.01% | 1 | 0.01% |
| 844 | proteinx0008 (AD013) | NM_013395.1 | 1 | 0.01% | 1 | 0.01% |
| 845 | ubiquitin-activating enzyme E1C (homologous to yeast UBA3) (UBE1C | gi4507764 | 1 | 0.01% | 1 | 0.01% |
| 846 | CCAAT-box-binding transcription factor (CBF2) | NM_005760.1 | 1 | 0.01% | 1 | 0.01% |
| 847 | c-Cbl-interacting protein (CIN85) | AF230904.1 | 1 | 0.01% | 1 | 0.01% |
| 848 | GA-binding protein transcription factor, beta subunit 1 (53kD) (GABPB1 | NM_016654.1 | 1 | 0.01% | 1 | 0.01% |
| 849 | thyroid receptor interactor (TRIP3) | L40410.1 | 1 | 0.01% | 1 | 0.01% |
| 850 | ZNF01 and HUMORFKG1B genes, partial sequence | AF205588.1 | 1 | 0.01% | 1 | 0.01% |
| 851 | endoplasmic reticulum lumenal Ca2 binding protein grp78 | AF216292.1 | 1 | 0.01% | 1 | 0.01% |
| 852 | leukophysin (LKP) = NM_001357.1 DEAD/H box polypeptide 9 (DDX9) | U03643.1 | 1 | 0.01% | 1 | 0.01% |
| 853 | CGI-129 protein | AF151887.1 | 1 | 0.01% | 1 | 0.01% |
| 854 | CGI-86 protein (LOC51635) | NM_016029.1 | 1 | 0.01% | 1 | 0.01% |
| 855 | LIC-2 dynein light intermediate chain 53/55 | U15138.1 | 1 | 0.01% | 1 | 0.01% |
| 856 | protein 4.1-G, erythrocyte membrane protein (clone 24719) | AF054999 | 1 | 0.01% | 1 | 0.01% |
| 857 | tropomodulin (TMOD) | M77016 | 1 | 0.01% | 1 | 0.01% |
| 858 | TIP120 (=AB020636 KIAA0829) | D87671 | 1 | 0.01% | 1 | 0.01% |
| 859 | orphan G protein-coupled receptor (RDC1) | U67784 | 1 | 0.01% | 1 | 0.01% |
| 860 | mitogen-activated protein kinase 14 (MAPK14) | 4503068 | 1 | 0.01% | 1 | 0.01% |
| 861 | ralA binding protein 1 (RALBP1) | NM_006788.1 | 1 | 0.01% | 1 | 0.01% |
| 862 | C-type lectin | BAA95671.1 | 1 | 0.01% | 1 | 0.01% |
| 863 | non-histone chromosomal protein HMG-14 | M21339.1 | 1 | 0.01% | 1 | 0.01% |
| 864 | NCK adaptor protein 1(NCK1)=X17576 melanoma mRNA for nck prote | NM_006153.1 | 1 | 0.01% | 1 | 0.01% |
| 865 | cargo selection protein TIP47 (TIP47)(=PP17) | AF057140 | 1 | 0.01% | 1 | 0.01% |
| 866 | CGI-43 protein | AF151801.1 | 1 | 0.01% | 1 | 0.01% |
| 867 | DNA repair helicase (ERCC3) | M31899.1 | 1 | 0.01% | 1 | 0.01% |
| 868 | UDP-GalNAc:polypeptide N-acetylgalactosaminyltransferase (T1) | X85018 | 1 | 0.01% | 1 | 0.01% |
| 869 | SMT3 (suppressor of mif two 3, yeast) homolog 1 (SMT3H1) | NM_006936.1 | 1 | 0.01% | 1 | 0.01% |
| 870 | solute carrier family 20 (phosphate transporter), member 1 (SLC20A1) | 7382462 | 1 | 0.01% | 1 | 0.01% |
| 871 | glycogen phosphorylase | Y15233 | 1 | 0.01% | 1 | 0.01% |
| 872 | ribonuclease L (2',5'-oligoisoadenylate synthetase-dependent) inhibitor | 4506558 | 1 | 0.01% | 1 | 0.01% |
| 873 | lymphocyte dihydropyrimidine dehydrogenase (DPYD) | U20938 | 1 | 0.01% | 1 | 0.01% |
| 874 | ubiquitin carboxyl-terminal esterase L3 (ubiquitin thiolesterase) (UCHL | NM_006002.1 | 1 | 0.01% | 1 | 0.01% |
| 875 | nuclear receptor coactivator (=TRBP) | AF245115 | 1 | 0.01% | 1 | 0.01% |
| 876 | serine kinase SRPK2 | U88666 | 1 | 0.01% | 1 | 0.01% |
| 877 | acyl-coenzyme A:cholesterol acyltransferase (ORF) | L21934.2 | 1 | 0.01% | 1 | 0.01% |
| 878 | NADP dependent cytoplasmic malic enzyme (=U43944) | X77244 | 1 | 0.01% | 1 | 0.01% |
| 879 | leucine rich repeat (in FLII) interacting protein 1 (LRRFIP1) (=GCF2) | NM_004735.1 | 1 | 0.01% | 1 | 0.01% |
| 880 | metalloprotease/disintegrin/cysteine-rich protein precursor (MDC9) (=D | U41766 | 1 | 0.01% | 1 | 0.01% |
| 881 | host cell factor 2 (HCF-2) | NM_013320.1 | 1 | 0.01% | 1 | 0.01% |

Figure 15 Relative Est Frequency of Unique Known Genes Common to Mild and Severe cDNA Libraries - Page 18 of 19

| | | | | | | |
|---|---|---|---|---|---|---|
| 882 | X-ray repair complementing defective repair in Chinese hamster cells 4 | gi4507944 | 1 | 0.01% | 1 | 0.01% |
| 883 | cardiac myosin binding protein-C (ORF) | X84075 | 1 | 0.01% | 1 | 0.01% |
| 884 | unc-50 related protein homologue | AF077038.1 | 1 | 0.01% | 1 | 0.01% |
| 885 | activated in tumor suppression | AJ012502.1 | 1 | 0.01% | 1 | 0.01% |
| 886 | cytokine-inducible SH2 protein 6 (CISH6) (=AB014571 KIAA0671) | AF073958.1 | 1 | 0.01% | 1 | 0.01% |
| 887 | DAPIT protein | AJ271158 | 1 | 0.01% | 1 | 0.01% |
| 888 | HepG2 3' region MboI cDNA, clone hmd3c06m3 | D17196.1 | 1 | 0.01% | 1 | 0.01% |
| 889 | KIAA0006 | D25304 | 1 | 0.01% | 1 | 0.01% |
| 890 | KIAA0041 | D26069 | 1 | 0.01% | 1 | 0.01% |
| 891 | KIAA0095 gene | NM_014669.1 | 1 | 0.01% | 1 | 0.01% |
| 892 | KIAA0227 | D86980 | 1 | 0.01% | 1 | 0.01% |
| 893 | KIAA0862=leucine-rich repeat protein SHOC-2 (SHOC-2)=AF054828 | AB020669 | 1 | 0.01% | 1 | 0.01% |
| 894 | KIAA0934 protein | AB023151.1 | 1 | 0.01% | 1 | 0.01% |
| 895 | KIAA0997 | NM_014950.1 | 1 | 0.01% | 1 | 0.01% |
| 896 | KIAA1033 | AB028956.1 | 1 | 0.01% | 1 | 0.01% |
| 897 | KIAA1423 | AB037844.1 | 1 | 0.01% | 1 | 0.01% |
| 898 | La/SS-B protein | X69804 | 1 | 0.01% | 1 | 0.01% |
| 899 | maternal-embryonic 3 (Mem3) | U47024 | 1 | 0.01% | 1 | 0.01% |
| 900 | PB1 | X90849 | 1 | 0.01% | 1 | 0.01% |
| 901 | SCID complementing gene 2 | D78188.1 | 1 | 0.01% | 1 | 0.01% |
| 902 | TCTEL1 (t-complex-associated-testis-expressed 1-like 1) | D50663.1 | 1 | 0.01% | 1 | 0.01% |
| 903 | UDP-N-acetyl-alpha-D-galactosamine:polypeptide N-acetylgalactosami | gi8393408 | 1 | 0.01% | 1 | 0.01% |
| 904 | galactocerebrosidase (GALC) gene | L38559 | 1 | 0.01% | 1 | 0.01% |
| 905 | QUINONE OXIDOREDUCTASE (NADPH:QUINONE REDUCTASE) (Z | spQ08257 | 1 | 0.01% | 1 | 0.01% |
| 906 | proline arginine-rich end leucine-rich repeat protein (PRELP) =U29089 | NM_002725.1 | 1 | 0.01% | 1 | 0.01% |
| 907 | selenoprotein T(LOC51714) | NM_016275.1 | 1 | 0.01% | 1 | 0.01% |
| 908 | eukaryotic translation initiation factor 2 alpha kinase PEK | AF110146 | 1 | 0.01% | 1 | 0.01% |
| 909 | EUKARYOTIC TRANSLATION INITIATION FACTOR 5 (EIF-5) | spP55010 | 1 | 0.01% | 1 | 0.01% |
| 910 | translational inhibitor protein p14.5 (UK114) = X95384.1 | NM_005836.1 | 1 | 0.01% | 1 | 0.01% |
| 911 | translin associated protein X | X95073 | 1 | 0.01% | 1 | 0.01% |
| 912 | ATP-dependent metalloprotease YME1L (contains Alu repeat) | AJ132637.1 | 1 | 0.01% | 1 | 0.01% |
| 913 | proteasome subunit p42 | D78275 | 1 | 0.01% | 1 | 0.01% |
| 914 | sorting nexin 14 (SNX14) | AF121863.1 | 1 | 0.01% | 1 | 0.01% |
| 915 | TIMP3 tissue inhibitor of metalloproteinases-3 | X76227 | 1 | 0.01% | 1 | 0.01% |
| 916 | ubiquitin conjugating enzyme, UbcH6 | X92963 | 1 | 0.01% | 1 | 0.01% |
| 917 | ubiquitin-conjugating enzyme E2D 3 (homologous to yeast UBC4/5) (U | NM_003340.1 | 1 | 0.01% | 1 | 0.01% |
| 918 | ubiquitin-conjugating enzyme E2L 6 (UBE2L6) =AF061736 ubiquitin-co | NM_004223.1 | 1 | 0.01% | 1 | 0.01% |
| 919 | WDR1 protein | AF020260 | 1 | 0.01% | 1 | 0.01% |
| 920 | kaiso (ZNF-kaiso) | gi5803228 | 1 | 0.01% | 1 | 0.01% |
| 921 | retinoblastoma-binding protein 2 (RBBP2) | NM_005056.1 | 1 | 0.01% | 1 | 0.01% |
| 922 | Nuclear protein SA-2 (=STAG2) | Z75331.1 | 1 | 0.01% | 1 | 0.01% |
| 923 | small nuclear ribonucleoprotein polypeptide B" (SNRPB2) | NM_003092.1 | 1 | 0.01% | 1 | 0.01% |
| 924 | mitochondrial 12S and 16S rRNA | J01438 | 1 | 0.01% | 1 | 0.01% |
| 925 | pre-mRNA cleavage factor Im (68kD) (CFIM) (=X67336) | 5901927 | 1 | 0.01% | 1 | 0.01% |
| 926 | male-specific lethal-3 (Drosophila)-like 1 (MSL3L1) (=DKFZp586J1822 | NM_006800.1 | 1 | 0.01% | 1 | 0.01% |
| 927 | nuclear protein stromal antigen 1 (SA-1) | NM_005862.1 | 1 | 0.01% | 1 | 0.01% |
| 928 | coagulation factor V (proaccelerin, labile factor) (F5) | NM_000130.1 | 1 | 0.01% | 1 | 0.01% |
| 929 | truncated SON protein (Son) (=AF161430.1 HSPC312) | AF193607.1 | 1 | 0.01% | 1 | 0.01% |
| 930 | CGI-107 protein | AF151865.1 | 1 | 0.01% | 1 | 0.01% |
| 931 | CGI-60 protein (LOC51626), | NM_016008.1 | 1 | 0.01% | 1 | 0.01% |
| 932 | CGI-81 protein | AF151839.1 | 1 | 0.01% | 1 | 0.01% |
| 933 | Norrie disease protein (NDP) | X65882 | 1 | 0.01% | 1 | 0.01% |

Figure 15- Relative Est Frequency of Unique Known Genes Common to Mild and Severe cDNA Libraries - Page 19 of 19

| | | | | | | |
|---|---|---|---|---|---|---|
| 934 | osteonidogen (=AJ223500 nidogen-2) | D86425 | 1 | 0.01% | 1 | 0.01% |
| 935 | adapter protein CMS | AF146277.1 | 1 | 0.01% | 1 | 0.01% |
| 936 | keratin 18 (K18) | M24842 | 1 | 0.01% | 1 | 0.01% |
| 937 | myotubularin related protein 6 | AF072928 | 1 | 0.01% | 1 | 0.01% |
| 938 | nucleoporin p54 | U63840 | 1 | 0.01% | 1 | 0.01% |
| 939 | B219/OB receptor isoform HuB219.1 | U52912 | 1 | 0.01% | 1 | 0.01% |
| 940 | G protein-coupled receptor 69A (GPR69A) (=p40) | NM_006055.1 | 1 | 0.01% | 1 | 0.01% |
| 941 | h-ryk | X69970.1 | 1 | 0.01% | 1 | 0.01% |
| 942 | RYK tyrosine kinase | S59184.1 | 1 | 0.01% | 1 | 0.01% |
| 943 | low-Mr GTP-binding protein (RAB32) | U59878 | 1 | 0.01% | 1 | 0.01% |
| 944 | abundant in neuroepithelium area (BTG3) (=D64110 ANA) | gi5802989 | 1 | 0.01% | 1 | 0.01% |
| 945 | glioblastoma amplified sequence (GBAS) | AF029786 | 1 | 0.01% | 1 | 0.01% |
| 946 | macrophage-specific colony-stimulating factor (CSF-1) | M37435.1 | 1 | 0.01% | 1 | 0.01% |
| 947 | monocyte chemotactic protein-3 (MCP-3) | X72308 | 1 | 0.01% | 1 | 0.01% |
| 948 | ecotropic viral integration site 5 (EVI5) | NM_005665.1 | 1 | 0.01% | 1 | 0.01% |
| 949 | potassium voltage-gated channel, delayed-rectifier, subfamily S, memb | NM_002252.1 | 1 | 0.01% | 1 | 0.01% |
| 950 | integrin, alpha V(vitronectin receptor, alpha polypeptide, antigen CD51 | NM_002210.1 | 1 | 0.01% | 1 | 0.01% |
| 951 | chromodomain protein, Y chromosome-like (CDYL) =AF081259 | NM_004824.1 | 1 | 0.01% | 1 | 0.01% |
| 952 | GTP-binding protein RAB21 (RAB21) = KIAA0118 | AF091035 | 1 | 0.01% | 1 | 0.01% |
| 953 | neuronal apoptosis inhibitory protein | U19251 | 1 | 0.01% | 1 | 0.01% |
| 954 | proto-oncogene (Wnt-5a) | L20681.1 | 1 | 0.01% | 1 | 0.01% |
| 955 | tumor necrosis factor alpha-induced protein 6 (TNFAIP6) | NM_007115.1 | 1 | 0.01% | 1 | 0.01% |
| 956 | solute carrier family 16 (monocarboxylic acid transporters), member 7 ( | NM_004731.1 | 1 | 0.01% | 1 | 0.01% |
| 957 | 5' cap guanine-N-7 methyltransferase (RNMT) | AF067791.1 | 1 | 0.01% | 1 | 0.01% |

Figure 16. B2M level in synovial fluid
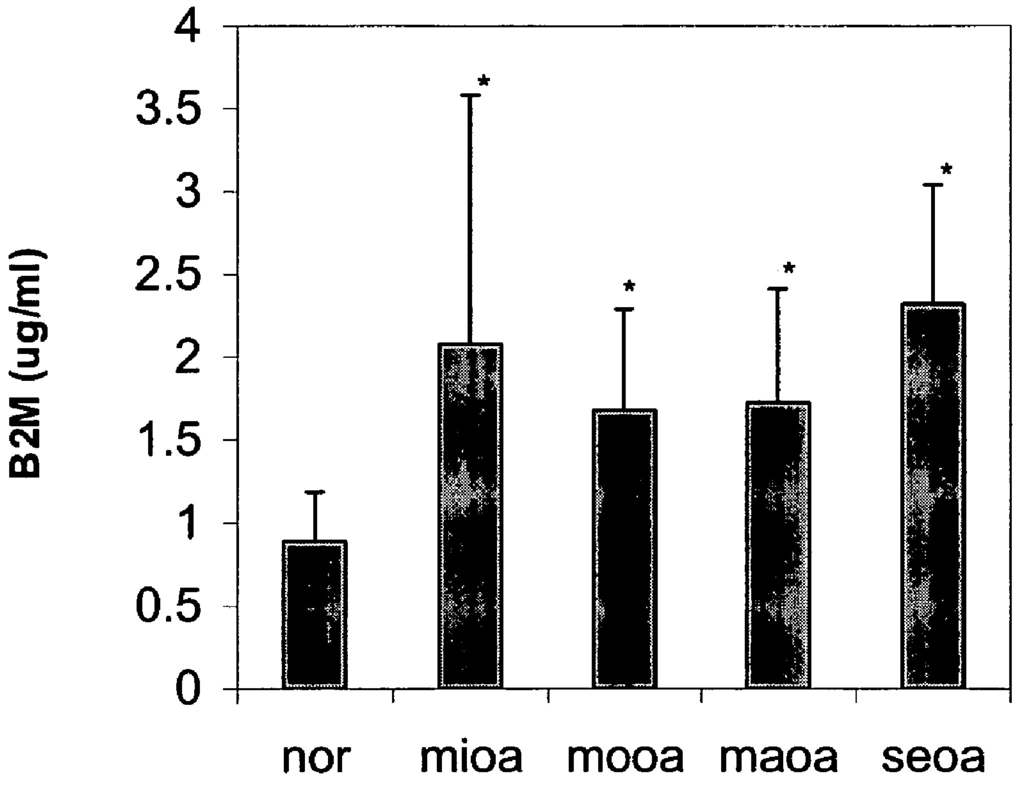

Figure 17. B2M levels in severe OA cartilage cultured medium
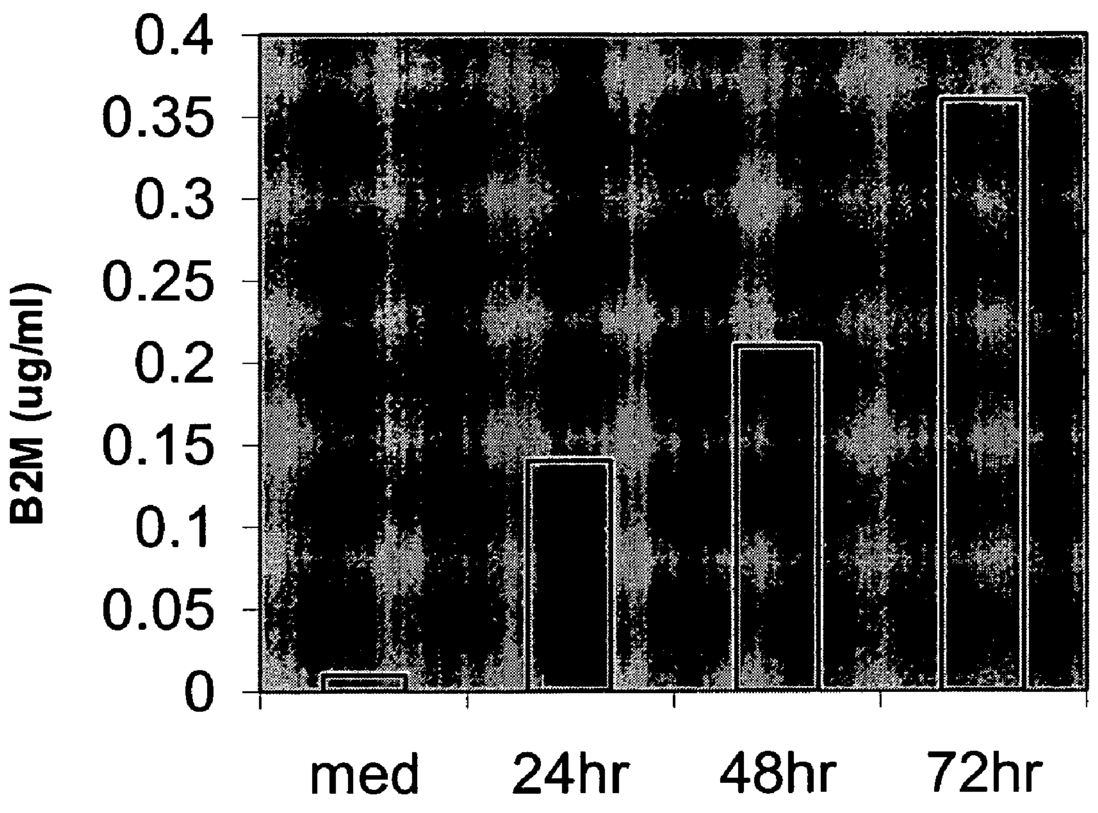

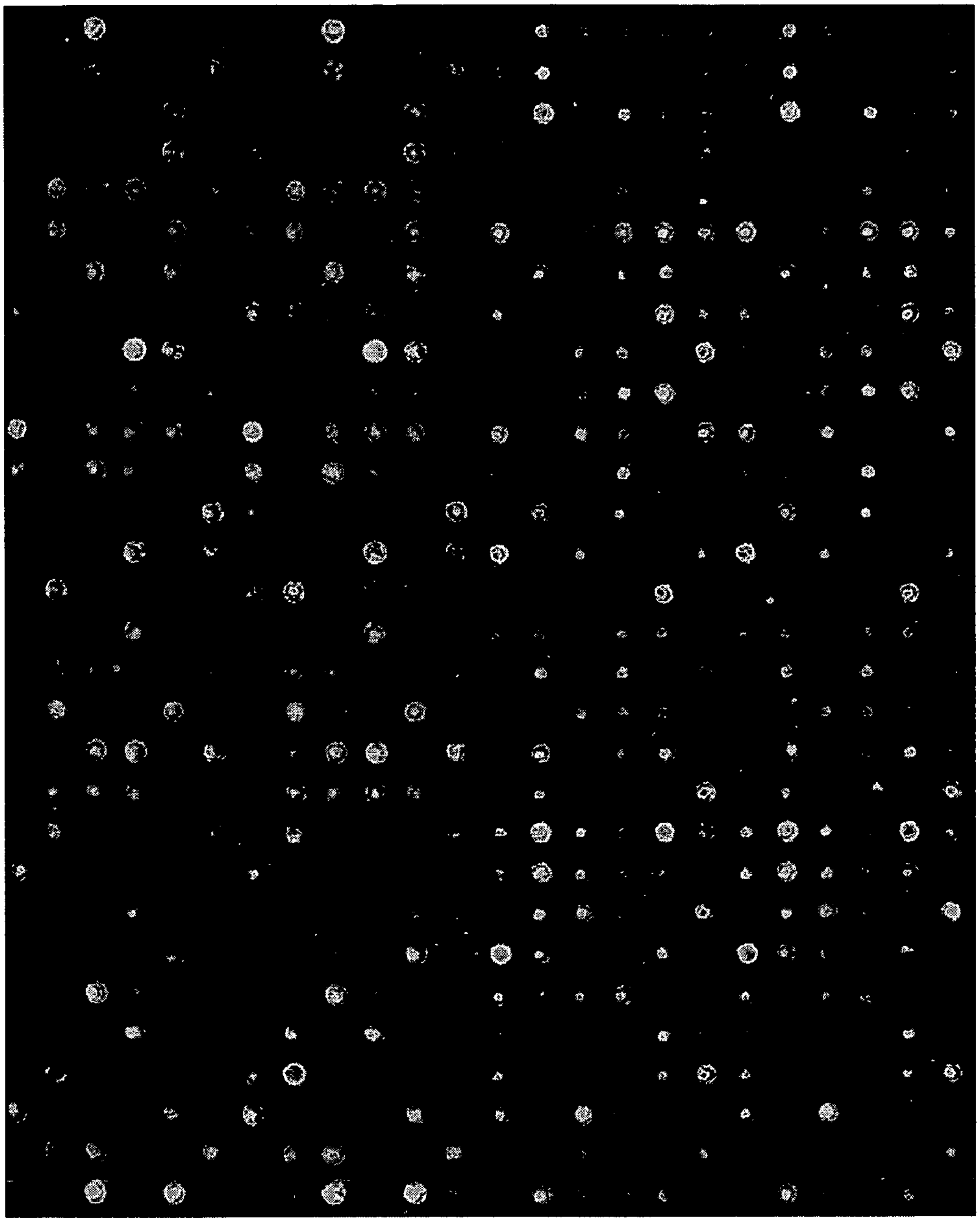
Figure 18. Differential gene expression of B2M treated chondrocytes detected by microarray.

COMPOSITIONS AND METHODS RELATING TO OSTEOARTHRITIS

This application includes a compact disc in duplicate (2 compact discs: COPY 1 REPLACEMENT (Feb. 21, 2008" and COPY 2 REPLACEMENT Feb. 21, 2008"), which are hereby incorporated by reference in their entirely. Each compact disc is identical and contains the following file: MIchelel Deng seq listing.txt.

FIELD OF THE INVENTION

The invention relates to the profiling of differential gene expression in specific human tissue types through the construction and use of cDNA libraries and microarrays.

BACKGROUND OF THE INVENTION

Osteoarthritis (OA) is a chronic disease in which the articular cartilage that lies on the ends of bones that forms the articulating surface of the joints gradually degenerates over time. There are many factors that are believed to predispose a patient to osteoarthritis including genetic susceptibility, obesity, accidental or athletic trauma, surgery, drugs and heavy physical demands. Osteoarthritis is initiated by damage to the cartilage of joints. The two most common injuries to joints are sports-related injuries and long term "repetitive use" joint injuries. Joints most commonly affected by osteoarthritis are the knees, hips and hands. In most cases, due to the essential weight-bearing function of the knees and hips, osteoarthritis in these joints causes much more disability than osteoarthritis of the hands. As cartilage degeneration progresses, secondary changes occur in other tissues in and around joints including bone, muscle, ligaments, menisci and synovium. The net effect of the primary failure of cartilage tissue and secondary damage to other tissues is that the patient experiences pain, swelling, weakness and loss of functional ability in the afflicted joint(s). These symptoms frequently progress to the point that they have a significant impact in terms of lost productivity and or quality of life consequences for the patient.

Articular cartilage is predominantly composed of chondrocytes, type II collagen, proteoglycans and water. Articular cartilage has no blood or nerve supply and chondrocytes are the only type of cell in this tissue. Chondrocytes are responsible for manufacturing the type II collagen and proteoglycans that form the cartilage matrix. This matrix in turn has physical-chemical properties that allow for saturation of the matrix with water. The net effect of this structural-functional relationship is that articular cartilage has exceptional wear characteristics and allows for almost frictionless movement between the articulating cartilage surfaces. In the absence of osteoarthritis, articular cartilage often provides a lifetime of pain-free weight bearing and unrestricted joint motion even under demanding physical conditions.

During fetal development, articular cartilage is initially derived from the interzone of mesenchymal condensations. The mesenchymal cells cluster together and synthesize matrix proteins. The tissue is recognized as cartilage when the accumulation of matrix separates the cells, which are spherical in shape and are now called chondrocytes. During cartilage formation and growth, chondrocytes proliferate rapidly and synthesize large volumes of matrix. Prior to skeletal maturity, chondrocytes are at their highest level of metabolic activity. As skeletal maturation is reached, the rate of chondrocyte metabolic activity and cell division declines. After completion of skeletal growth, most chondrocytes do not divide but do continue to synthesize matrix proteins such as collagens, proteoglycans and other noncollagenous proteins (1, 2).

Like all living tissues, articular cartilage is continually undergoing a process of renewal in which "old" cells and matrix components are being removed (catabolic activity) and "new" cells and molecules are being produced (anabolic activity). Relative to most tissues, the rate of anabolic/catabolic turnover in articular cartilage is low. Long-term maintenance of the structural integrity of mature cartilage relies on the proper balance between matrix synthesis and degradation. Chondrocytes maintain matrix equilibrium by responding to chemical and mechanical stimuli from their environment. Appropriate and effective chondrocyte responses to these stimuli are essential for cartilage homeostasis. Disruption of homeostasis through either inadequate anabolic activity or excessive catabolic activity can result in cartilage degradation and osteoarthritis (3). Most tissues that are damaged and have increased catabolic activity are able to mount an increased anabolic response that allows for tissue healing. Unfortunately, chondrocytes have very limited ability to up-regulate their anabolic activity and increase the synthesis of proteoglycan and type II collagen in response to damage or loss of cartilage matrix. This fundamental limitation of chondrocytes is the core problem that has precluded the development of therapies that can prevent and cure osteoarthritis. Additionally, there is a need for a definitive diagnostic test for detecting early osteoarthritis, and a prognostic test that effectively monitors a patient's response to therapy.

Joint pain is the most common manifestation of early osteoarthritis. The pain tends to be episodic lasting days to weeks and remitting spontaneously. Although redness and swelling of joints is uncommon, joints become tender during a flare-up of osteoarthritis.

"Mild" or "early stage osteoarthritis" is difficult to diagnose. The physician relies primarily on the patient's history and physical exam to make the diagnosis of mild osteoarthritis. X-rays do not show the underlying early changes in articular cartilage. There are no recognized biochemical markers used to confirm the diagnosis of early stage osteoarthritis.

X-ray changes confirm the diagnosis of moderate osteoarthritis. X-rays of normal joints reveal well preserved symmetrical joint spaces. Changes seen on the x-rays of patients with osteoarthritis include new bone formation (osteophytes), joint space narrowing and sclerosis (bone thickening). There are no recognized biochemical markers used to confirm the diagnosis of "moderate osteoarthritis" at this stage.

The clinical exam of a joint with severe osteoarthritis reveals tenderness, joint deformity and a loss of mobility. Passive joint movement during examination may elicit crepitus or the grinding of bone-on-bone as the joint moves. X-ray changes are often profound: the joint space may be obliterated and misalignment of the joint can be seen. New bone formation (osteophytes) is prominent. Again, there are no recognized biochemical markers used to confirm the diagnosis of "severe osteoarthritis".

"Osteoarthritis" is the most common chronic joint disease. It is characterized by progressive degeneration and eventual loss of cartilage. Currently, there is a need for an effective therapy that will alter the course of osteoarthritis. Further advances in preventing, modifying or curing the osteoarthritic disease process critically depends, at least in part, on a thorough understanding of the molecular mechanisms underlying anabolic and catabolic processes in cartilage. Since cellular functions are substantially determined by the genes that the cells express, elucidating the genes expressed in articular cartilage at different developmental and disease stages will inevitably provide new insights into the molecules and mechanisms involved in cartilage formation, injury, disease and repair.

cDNA libraries from putatively normal and severe osteoarthritic human cartilage tissue have been constructed (Kumar et al., $46^{th}$ Annual Meeting, Orthopaedic Res. Soc., Abstract, p. 1031). However, this work does not adequately address the differentiation of chondrocyte gene expression from differing severities of osteoarthritic human cartilage (mild, moderate, marked and severe). In addition, the "normal cartilage" samples were obtained from deceased donors more than 24 hours after death. Thus, this cDNA library does not truly reflect normal chondrocyte gene expression due to the rapid degeneration of RNA that occurs after cessation of perfusion to the sampled joint, as demonstrated by baboon studies, presented herein below.

SUMMARY OF THE INVENTION

The invention relates to one or more profiles of gene expression for human fetal articular cartilage, and the cartilage of normal, mild, moderate, marked and severe osteoarthritic individuals, and thus to a method for identifying genes that play critical roles in cartilage injury, repair and disease progression. Given the inherently low anabolic activity in adult chondrocytes, identification of key replicative and/or anabolic genes expressed by fetal but not adult chondrocytes, has important implications for developing novel disease modifying therapies for adult cartilage injury and osteoarthritis.

One aspect of the invention is to isolate chondrocyte enriched or chondrocyte-specific nucleic acid sequences.

In one embodiment, one or more nucleic acid sequences selected from the group consisting of the sequences identified in FIG. 6A which correspond to genes 1-5807 identified in FIG. 6 and/or sequences identified in FIG. 13 are isolated.

In another embodiment, a vector comprising one or more nucleic acid sequences selected from the sequences identified in FIG. 6A corresponding to genes 1-5807 of FIG. 6 and/or sequences identified in FIG. 13 are constructed.

In yet another embodiment, a host cell comprising the vector is constructed.

Another aspect of the invention is to provide a composition comprising one or more chondrocyte enriched or chondrocyte-specific nucleic acid sequences.

Another aspect of the invention is to provide a composition comprising one or more chondrocyte enriched or chondrocyte-specific nucleic acid sequences isolated from one or more of (a) a fetus, (b) normal, (c) mild osteoarthritic, (d) moderate osteoarthritic, (e) marked osteoarthritic, or (f) severe osteoarthritic cartilage samples.

Another embodiment of the invention provides a composition comprising one or more nucleic acid sequences selected from the group of sequences identified in FIG. 6B which are isolated from a fetal cDNA library as disclosed herein.

Another embodiment of the invention provides a composition comprising one or more nucleic acid sequences selected from the group of sequences identified in FIG. 6C which are isolated from a normal cDNA library as disclosed herein.

Another embodiment of the invention provides a composition comprising one or more nucleic acid sequences selected from the group of sequences identified in FIG. 6D which are isolated from a mild osteoarthritic chondrocyte library as disclosed herein.

Another embodiment of the invention provides a composition comprising one or more nucleic acid sequences selected from the group of sequences identified in FIG. 6E which are isolated from a severe osteoarthritic chondrocyte library as disclosed herein.

Another embodiment of the invention provides a composition comprising one or more nucleic acid sequences selected from the group consisting of sequences as identified in FIGS. 6B, 6C, 6D and 6E.

Another embodiment of the invention provides a composition comprising one or more nucleic acid sequences where at least one of the nucleic acid sequences is differentially expressed in cartilage from a patient diagnosed with mild osteoarthritis relative to cartilage from a normal individual, and where cartilage isolated from the normal individual is isolated from cartilage tissue obtained less than 14 hours post-mortem.

Another embodiment of the invention provides a composition comprising one or more nucleic acid sequences where at least one of the nucleic acid sequences is differentially expressed in cartilage from a patient diagnosed with severe osteoarthritis relative to cartilage derived from a normal individual, where cartilage isolated from the normal individual is isolated from cartilage tissue obtained less than 14 hours post-mortem.

Another embodiment of the invention provides a composition comprising one or more nucleic acid sequences where at least one of the nucleic acid sequences is differentially expressed in cartilage from a patient diagnosed with moderate osteoarthritis relative to cartilage from a normal individual, where cartilage isolated from the normal individual is isolated from cartilage tissue obtained less than 14 hours post-mortem.

Another embodiment of the invention provides a composition comprising one or more nucleic acid sequences where at least one of the nucleic acid sequences is differentially expressed in cartilage from a patient diagnosed with marked osteoarthritis relative to cartilage derived from a normal individual, where cartilage isolated from the normal individual is isolated from cartilage tissue obtained less than 14 hours post-mortem.

Another embodiment of the invention provides a composition comprising one or more nucleic acid sequences where at least one of the nucleic acid sequences is differentially expressed in cartilage isolated from any two or more of the following sources: (a) fetus, or (b) patient with mild osteoarthritis, (c) patient with moderate osteoarthritis, (d) patient with marked osteoarthritis, (e) patient with severe osteoarthritis, and (f) cartilage isolated from cartilage tissue obtained from a normal individual.

Another embodiment of the invention provides a composition comprising one or more nucleic acids identified in FIG. 9 and/or nucleic acid sequences identified in FIG. 6A which correspond to the genes disclosed in FIG. 9.

Another embodiment of the invention provides a composition comprising one or more nucleic acids identified in FIG. 6A which correspond to the genes disclosed in FIGS. 14 and 15.

Another embodiment of the invention provides a composition comprising one or more nucleic acids identified in FIG. 6A which correspond to the genes disclosed in FIGS. 14 and 15.

Another embodiment of the invention provides a composition comprising one or more nucleic acids identified in FIG. 6A which correspond to the genes disclosed in FIG. 6.

Another embodiment of the invention provides a composition comprising one or more nucleic acid sequences selected from sequences identified in FIG. 13.

A further aspect of the invention relates to nucleic acid arrays comprising a plurality of chondrocyte enriched or chondrocyte-specific nucleic acid member sequences.

In one embodiment, the invention provides an array comprising a plurality of nucleic acid members, where at least one member is differentially expressed in cartilage from a patient diagnosed with mild osteoarthritis, as compared to cartilage from a normal individual, and a solid substrate, where each nucleic acid member has a unique position on the array and is stably associated with the solid substrate.

In another embodiment, the invention provides an array comprising a plurality of nucleic acid members, where at least one member is differentially expressed in cartilage isolated from a patient diagnosed with severe osteoarthritis, as compared to cartilage from a normal individual, and a solid substrate, where each nucleic acid member has a unique position on the array and is stably associated with the solid substrate.

In another embodiment, the invention provides an array comprising a plurality of nucleic acid members, where at least one member is differentially expressed in cartilage isolated from a patient diagnosed with moderate osteoarthritis, as compared to cartilage from a normal individual, and a solid substrate, where each nucleic acid member has a unique position on the array and is stably associated with the solid substrate.

In another embodiment, the invention provides an array comprising a plurality of nucleic acid members, where at least one member is differentially expressed in cartilage isolated from a patient diagnosed with marked osteoarthritis, as compared to cartilage from a normal individual, and a solid substrate, where each nucleic acid member has a unique position on the array and is stably associated with the solid substrate.

In another embodiment, the invention provides an array comprising a plurality of nucleic acid members, where at least one member is differentially expressed in cartilage isolated from a fetus, as compared to cartilage from a normal individual, and a solid substrate, where each nucleic acid member has a unique position on the array and is stably associated with the solid substrate.

In a preferred embodiment, cartilage is isolated from a living normal individual.

In another preferred embodiment, the cartilage is isolated from the normal individual in less than 14 hours post-mortem.

In another embodiment, the invention provides an array comprising a plurality of nucleic acid members and a solid substrate, where at least one member is differentially expressed in cartilage isolated from any two or more of the following sources: (a) fetus, (b) patient with mild osteoarthritis, (c) patient with moderate osteoarthritis, (d) patient with marked osteoarthritis, (e) patient with severe osteoarthritis or (f) cartilage isolated from normal individual, and where each nucleic acid member has a unique position on the array and is stably associated with the solid substrate.

In one embodiment, each nucleic acid member on an array according to the invention, is at least 50 nucleotides.

In another embodiment, an array according to the invention comprises from 10 to 20,000 positions.

In yet another embodiment, an array according to the invention further includes negative and positive control sequences and RNA quality control sequences. Control sequences can be selected from the group consisting of cDNA sequences of housekeeping genes, plant gene sequences (and/or their cDNA sequences), bacterial sequences, PCR products, vector sequences, and combinations thereof.

Another aspect of the invention relates to novel methods for diagnosing osteoarthritis.

In one embodiment, a method for diagnosing mild osteoarthritis in a patient comprises hybridizing a nucleic acid sample corresponding to RNA (e.g., a sample comprising RNA or cDNA or amplified products of RNA or cDNA) to an array comprising a solid substrate and a plurality of nucleic acid members, where at least one member is differentially expressed in cartilage isolated from a patient diagnosed with mild osteoarthritis, as compared to cartilage isolated from a normal individual and where each nucleic acid member has a unique position and is stably associated with the solid substrate. The cartilage isolated from the normal individual is isolated from cartilage tissue less than 14 hours post-mortem. Hybridization of the nucleic acid sample to one or more of the nucleic acid members is indicative of mild osteoarthritis.

In another embodiment, a method of diagnosing moderate osteoarthritis in a patient comprises hybridizing a nucleic acid sample corresponding to RNA to an array comprising a solid substrate and a plurality of nucleic acid members, where at least one member is differentially expressed in cartilage isolated from a patient diagnosed with moderate osteoarthritis, as compared to cartilage isolated from a normal individual and where each nucleic acid member has a unique position and is stably associated with the solid substrate. Cartilage isolated from the normal individual is isolated from cartilage tissue less than 14 hours post-mortem. Hybridization of the nucleic acid sample to one or more of the nucleic acid members on the array is indicative of moderate osteoarthritis.

In yet another embodiment, a method of diagnosing marked osteoarthritis in a patient comprises hybridizing a nucleic acid sample corresponding to RNA to an array comprising a solid substrate and a plurality of nucleic acid members, where at least one member is differentially expressed in cartilage isolated from a patient diagnosed with marked osteoarthritis, as compared to cartilage isolated from a normal individual and each nucleic acid member has a unique position and is stably associated with the solid substrate. Like the above arrays, cartilage isolated from the normal individual is isolated from cartilage tissue less than 14 hours post-mortem. Hybridization of the nucleic acid sample to one or more of the nucleic acid members is indicative of marked osteoarthritis.

In a further embodiment, a method of diagnosing severe osteoarthritis in a patient comprises hybridizing a nucleic acid sample corresponding to RNA to an array comprising a solid substrate and a plurality of nucleic acid members, where at least one member is differentially expressed in cartilage isolated from a patient diagnosed with severe osteoarthritis, as compared to cartilage isolated from a normal individual and each nucleic acid member has a unique position and is stably associated with the solid substrate. Like the above arrays, cartilage from the normal individual is isolated from cartilage tissue less than 14 hours post-mortem. Hybridization of the nucleic acid sample to one or more of the nucleic acid members is indicative of severe osteoarthritis.

In a preferred embodiment, the method of diagnosis comprises isolating a cartilage sample from a patient at a specific stage of osteoarthritis (e.g., mild, moderate, marked, or severe).

In another preferred embodiment, the method of diagnosis further comprises the step of preparing an RNA sample from a cartilage sample.

In another preferred embodiment, the method of diagnosis further comprises the step of preparing an RNA sample from blood.

In another preferred embodiment, the method of diagnosis further comprises the step of preparing an RNA sample from synovial fluid.

Another aspect of the invention relates to a method of identifying an agent that increases or decreases the expression of one or more nucleic acid sequences that are differentially expressed in a chondrocyte derived from a fetus or from patient(s) with a chondrocyte disease selected from the group consisting of: mild osteoarthritis, moderate osteoarthritis, marked osteoarthritis and severe osteoarthritis. The method comprises incubating a chondrocyte isolated from a cartilage sample obtained from a normal individual less than 14 hours post-mortem with a candidate agent. RNA is isolated from the chondrocyte and a probe is hybridized to the RNA which corresponds to a nucleic acid sequence which is differentially expressed in a chondrocyte from any two or more of the following developmental or disease stages: a fetus, normal, mild osteoarthritic, moderate osteoarthritic, marked osteoarthritic and severe osteoarthritic. Differential hybridization of the probe to the RNA from normal individual(s) relative to hybridization of the probe to RNA from any one or more of: fetus(es), patient(s) with mild osteoarthritis, patient(s) with moderate osteoarthritis, patient(s) with marked osteoarthritis and patient(s) with severe osteoarthritis identifies the RNA which specifically hybridizes to the probe as a differentially expressed chondrocyte-specific nucleic acid sequence and identifies the candidate agent as one which increases or decreases the expression of the chondrocyte-specific nucleic acid sequence.

The method also can be performed by evaluating cDNA corresponding to RNAs obtained from chondrocytes.

This method also can be performed by evaluating cDNA corresponding to RNAs obtained from blood.

This method also can be performed by evaluating cDNA corresponding to RNAs obtained from synovial fluid.

The invention further relates to methods of preparing chondrocyte cDNA libraries.

In one embodiment, a method of preparing a chondrocyte cDNA library comprises: a) isolating chondrocytes from a cartilage sample from a normal individual, where the cartilage sample is obtained less than 14 hours post-mortem, b) isolating total RNA from the chondrocytes, c) synthesizing cDNA from the mRNA in the total RNA, and d) ligating the cDNA into a vector.

In another embodiment, a method of preparing a chondrocyte cDNA library comprises: a) isolating chondrocytes from a cartilage sample from a normal individual, wherein the normal individual is living, b) isolating total RNA from the chondrocytes, c) synthesizing cDNA from mRNA in the total RNA, and d) ligating the cDNA into a vector.

In another embodiment, a method of preparing a chondrocyte cDNA library comprises: a) isolating chondrocytes from a cartilage sample from a fetus, b) isolating total RNA from the chondrocytes, c) synthesizing cDNA from mRNA in the total RNA, and d) ligating the cDNA into a vector.

In another embodiment, a method of preparing a chondrocyte cDNA library is provided comprising, a) isolating chondrocytes from a cartilage sample from a patient diagnosed with mild, moderate, marked or severe osteoarthritis, b) isolating total RNA from the chondrocytes, c) synthesizing cDNA from mRNA in the total RNA, and d) ligating the cDNA into a vector.

The invention also relates to a method of making an array which comprises a plurality of nucleic acid members comprising nucleic acid sequences selected from the group consisting of sequences of FIG. 14 on a solid support comprising a surface with a plurality of pre-selected unique regions. The method comprises: spotting each nucleic acid member individually onto a unique pre-selected region, and stably associating each nucleic acid member with the solid support at the pre-selected region.

In a preferred embodiment, at least one nucleic acid member is differentially expressed in cartilage isolated from a patient diagnosed with mild, moderate, marked, or severe osteoarthritis, as compared to cartilage isolated from a normal individual, where cartilage isolated from the normal individual is isolated from cartilage tissue less than 14 hours post-mortem.

In another preferred embodiment, at least one nucleic acid member is differentially expressed in cartilage isolated from a patient diagnosed with mild, moderate, marked, or severe osteoarthritis, as compared to cartilage isolated from a fetus.

In another preferred embodiment, at least one nucleic acid member is differentially expressed in cartilage isolated from a fetus, as compared to a cartilage isolated from a normal individual, where cartilage isolated from the normal individual is isolated from cartilage tissue less than 14 hours post-mortem.

In another preferred embodiment, at least one nucleic acid member is differentially expressed in cartilage isolated from any two of the following sources: (a) fetus, (b) a normal individual where cartilage isolated from the normal individual is isolated from cartilage tissue less than 14 hours post-mortem, and (c) a patient diagnosed with mild osteoarthritis, (d) a patient diagnosed with moderate osteoarthritis, (e) a patient diagnosed with marked osteoarthritis, or (f) a patient diagnosed with severe osteoarthritis.

The invention also provides kits comprising one or more of the compositions and/or arrays described above and packaging means therefore.

BRIEF DESCRIPTION OF THE DRAWINGS

The objects and features of the invention can be better understood with reference to the following detailed description and drawings.

FIG. 1, is a graph according to one embodiment of the invention showing the relative EST frequency level of selected extracellular matrix (ECM) proteins among the fetal, normal, mild osteoarthritic and severe osteoarthritic cartilage cDNA libraries. The percentages were calculated by dividing the number of ESTs matched to a certain type of ECM protein by the total number of ECM. ESTs per library. Legend: COL=collagen, PGL=proteoglycan, CMP=cartilage matrix proteins, OSN=osteonectin, FN=fibronectin, CRTL 1=cartilage link protein.

FIG. 2, is a graph according to one embodiment of the invention showing the relative EST frequency level of collagens among the fetal, normal, mild osteoarthritic and severe osteoarthritic cartilage cDNA libraries. The percentages were calculated by dividing the total number of collagen ESTs in a particular library by the total number of collagen ESTs from the four cartilage libraries.

FIG. 3, is a graph according to one embodiment of the invention showing the relative EST levels of specific collagen types among the fetal, normal, mild osteoarthritic and severe osteoarthritic cartilage cDNA libraries. Percentages were calculated by dividing the total number of ESTs for each type of collagen in a particular library by the total number of collagen ESTs from each library.

FIG. 4, is a graph according to one embodiment of the invention showing the relative EST frequency level of selected chondrocyte genes among the fetal, normal, mild osteoarthritic and severe osteoarthritic cDNA libraries. Percentages were calculated by dividing the number of ESTs for each gene by the total number of unique genes in each library. Legend: DCN=decorin/chondroitin dermatan sulfate proteoglycan (PG40), HSP90=heatshock protein 90/alpha gene sequence, MSF=megakaryocyte stimulating factor/proteoglycan 4/superficial zone protein, B2M=beta 2 microglobulin, MGP=matrix Gla protein, LUM=lumican, TB4=thymosin beta 4, OSF-2=mRNA for osteoblast specific factor 2, CHI=chitinase, Vim=vimentin.

FIG. 5, is a table according to one embodiment of the invention showing the total number of ESTs in each of the four cDNA libraries and the breakdown of what the ESTs represent, including the number of novel sequences (ie. ESTs with no significant match) in each library.

FIG. 6, is a table listing the unique known genes (5,807) identified in the four cDNA libraries to date according to one embodiment of the invention.

FIG. 6A, is a table listing the names of the EST sequences identified in the four cDNA libraries that represent each of the unique known genes identified in FIG. 6 according to one embodiment of the invention.

FIG. 6B is a table listing the names of all of the EST sequences identified from the cDNA library constructed from fetal cartilage tissue according to one embodiment of the invention.

FIG. 6C is a table listing the names of all of the EST sequences identified from the cDNA library constructed from normal cartilage tissue where such tissue is obtained less than 14 hours post-mortem according to one embodiment of the invention.

FIG. 6D is a table listing the names of all of the EST sequences identified from the cDNA library constructed from cartilage of patients with mild osteoarthritis according to one embodiment of the invention.

FIG. 6E is a table listing the names of all of the EST sequences identified from the cDNA library constructed from cartilage of patients with severe osteoarthritis according to one embodiment of the invention.

FIG. 7, is a table showing the characterization of the total number of ESTs from the four cDNA libraries (57,422) based on the functional classification of unique known genes represented by the ESTs according to one embodiment of the invention.

FIG. 8, is a list of known and novel EST clones from the mild and severe cDNA libraries comprising a microarray according to one embodiment of the invention.

FIG. 9, is a table showing candidate upregulated genes detected in the mild osteoarthritis cDNA library based on the microarray analysis according to one embodiment of the invention.

FIG. 10, is a table showing candidate down-regulated genes detected in the mild osteoarthritis cDNA library based on the microarray analysis according to one embodiment of the invention.

FIG. 11, is a table showing candidate up-regulated genes detected in the severe osteoarthritis cDNA library based on the microarray analysis according to one embodiment of the invention.

FIG. 12, is a table showing candidate down-regulated genes detected in the severe osteoarthritic cDNA library based on the microarray analysis according to one embodiment of the invention.

FIG. 13, is a table listing the EST sequence names representing novel sequences identified in each of the four cDNA libraries to date according to one embodiment of the invention.

FIG. 14, contains a list of genes that have been identified through EST frequency analysis as being differentially expressed between fetal and normal cDNA libraries according to one embodiment of the invention.

FIG. 15, contains a list of genes that have been identified through EST frequency analysis as being differentially expressed between mild and severe osteoarthritis cDNA libraries according to one embodiment of the invention.

FIG. 16, is a bar graph showing the level of beta-2 microglobulin (B2M) in synovial fluid from normal individuals and patients with different stages of osteoarthritis according to one embodiment of the invention. Legend: nor=normal individual, mioa=patient with mild osteoarthritis, mooa=patient with moderate osteoarthritis, maoa=patient with marked osteoarthritis, seoa=patient with severe osteoarthritis.

FIG. 17, is a bar graph showing the level of beta 2 microglobulin (B2M) in medium cultured from cartilage from patients with severe osteoarthritis at varying time periods during culturing according to one embodiment of the invention.

FIG. 18, is a black and white representation of a two-color fluorescent scan according to one embodiment of the invention showing genes preferentially expressed in non-B2M-treated chondrocytes and genes preferentially expressed in B2M-treated chondrocytes. B2M=beta 2 microglobulin.

DETAILED DESCRIPTION OF THE INVENTION

Figure 5A:
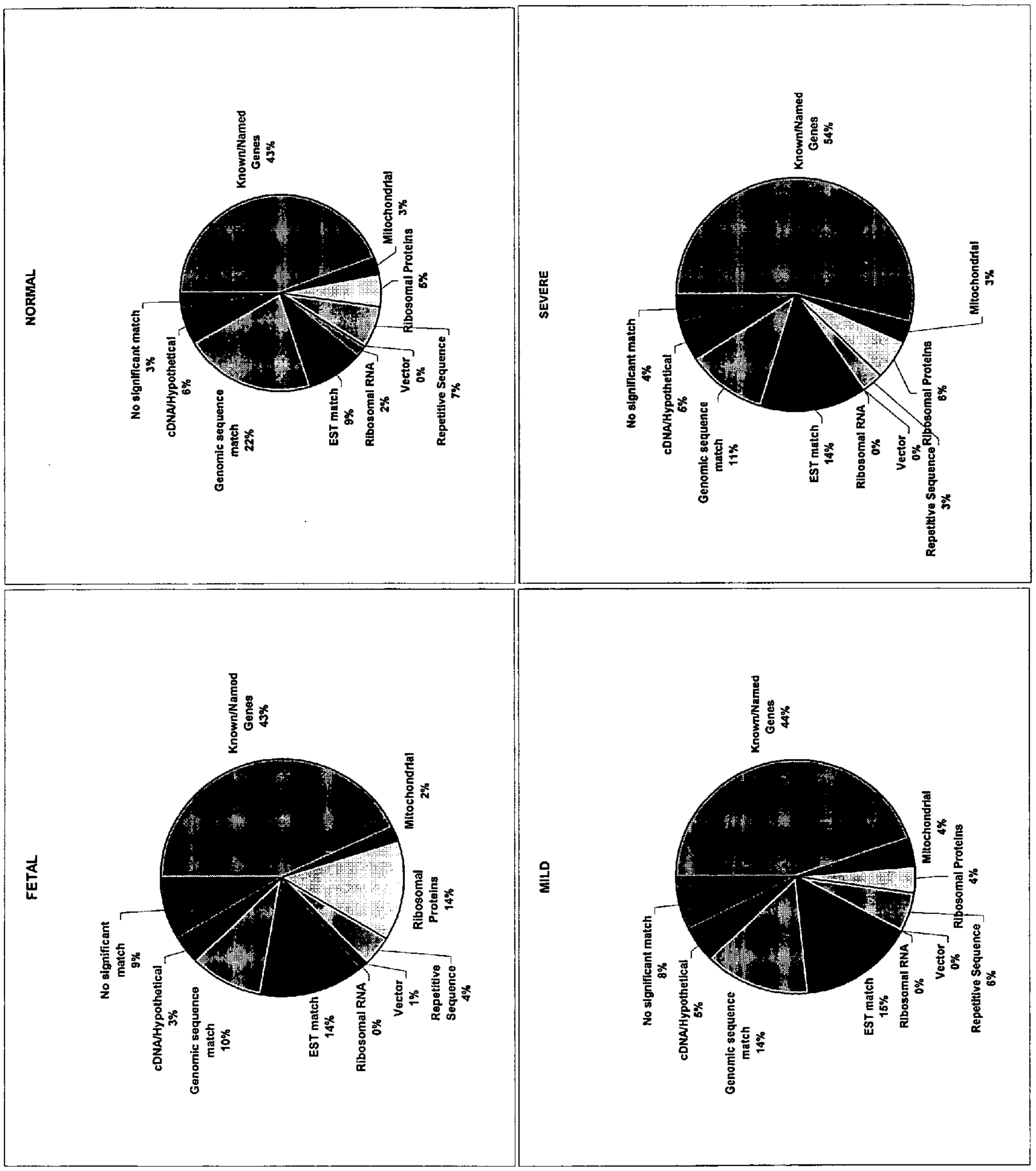
FIG. 5A, is a graphical representation of the data presented in FIG. 5 according to one embodiment of the invention.

The invention relates to methods of profiling gene sequences expressed in human chondrocytes to identify differential gene expression in chondrocytes at different stages of development and disease. Differentially expressed genes and their products (e.g., mRNAs and proteins) can be used in methods for diagnosis, prognosis, screening, or treatment of osteoarthritis.

Definitions

The following definitions are provided for specific terms which are used in the following written description.

As used herein, "osteoarthritis" refers to a chronic disease in which the articular cartilage that lies on the ends of bones that form the articulating surface of the joints gradually degenerates over time. Cartilage degeneration can be caused by an imbalanced catabolic activity (removal of "old" cells and matrix components) and anabolic activity (production of "new" cells and molecules) (Westacott et al., 1996, *Semin Arthritis Rheum,* 25:254-72).

As used herein, "cartilage" or "articular cartilage" refers to elastic, translucent connective tissue in mammals, including human and other species. Cartilage is composed predominantly of chondrocytes, type II collagen, small amounts of other collagen types, other noncollagenous proteins, proteoglycans and water, and is usually surrounded by a perichondrium, made up of fibroblasts, in a matrix of type I and type II collagen as well as other proteoglycans. Although most cartilage becomes bone upon maturation, some cartilage remains in its original form in locations such as the nose, ears, knees, and other joints. The cartilage has no blood or nerve supply and chondrocytes are the only type of cell in this tissue.

As used herein, "chondrocyte" refers to cartilage cells.

As used herein, "synovial fluid" refers to fluid secreted from the "synovial sac" which surrounds each joint. Synovial fluid serves to protect the joint, lubricate the joint and provide nourishment to the articular cartilage. Synovial fluid useful according to the invention contains cells from which RNA can be isolated according to methods well known in the art as described herein.

As used herein, the term “osteoarthritis (OA) staging” or “osteoarthritis (OA) grading” refers to determining the degree of advancement or progression of the disease in the cartilage. In order to classify cartilage into different disease stages, a scoring system is used according to known methods in the art. Preferably the scoring system described in Marshall (Marshall W., 1996, *The Journal of Rheumatology,* 23:582-584, incorporated by reference) is used. According to this method, each of the 6 articular surfaces (patella, femoral trochlea, medial femoral condyle, medial tibial plateau, lateral femoral condyle and lateral tibial plateau) is assigned a cartilage grade based on the worst lesion present on that specific surface. A scoring system is then applied in which each articular surface receives an OA severity number value that reflects the cartilage severity grade for that surface. For example, if the medial femoral condyle has a grade I lesion as its most severe cartilage damage a value of 1 is assigned. A total score for the patient is then derived from the sum of the scores on the 6 articular surfaces. Based on the total score, each patient is placed into one of 4 OA groups: mild (early) (1-6), moderate (7-12), marked (13-18) and severe (>18).

As used herein, “diagnosis” refers to a process of determining if an individual is afflicted with a disease or ailment. “Diagnosis of OA” or “OA diagnosis”, according to the invention, means determining if an individual is afflicted with OA, or, once a patient is diagnosed, determining the OA stage or grade as used herein based on the medical history and physical examination of the patient using methods known in the art (i.e., joint X ray). Preferably, OA stages are measured using the scoring system described by Marshall, supra. “Prognosis of OA” refers to a prediction of the probable occurrence and/or progression of OA in a patient, as well as the likelihood of recovery from OA, or the likelihood of ameliorating symptoms of OA or the likelihood of reversing the effects of OA.

As used herein, “patient” refers to a mammal who is diagnosed with a mild, moderate, marked, or severe form of OA.

As used herein, “normal” refers to an individual who has not shown any OA symptoms or has not been diagnosed with cartilage injury or OA. “Normal”, according to the invention, also refers to a sample taken from a normal individual within 14 hours post-mortem. A normal cartilage tissue sample, for example, refers to the whole or a piece of cartilage isolated from cartilage tissue within 14 hours post-mortem from an individual who was not diagnosed with OA and whose corpse does not show any symptoms of OA at the time of tissue removal. In alternative embodiments of the invention, the “normal” cartilage tissue sample is isolated from cartilage tissue less than 14 hours post-mortem, e.g., within 13 hours, 12 hours, 11 hours, 10 hours, 9 hours, 8 hours, 7 hours, 6 hours, 5 hours, 4 hours, 3 hours, 2 hours, or 1 hour post-mortem. In one embodiment of the invention, the “normal” cartilage sample is isolated at 14 hours post-mortem and the integrity of mRNA samples extracted is confirmed.

As used herein, “mRNA integrity” refers to the quality of mRNA extracts from cartilage samples. mRNA extracts with good integrity do not appear to be degraded when examined by methods well known in the art, for example, by RNA agarose gel electrophoresis (e.g., Ausubel et al., John Weley & Sons, Inc., 1997, *Current Protocols in Molecular Biology*). Preferably, the mRNA samples have good integrity (e.g., less than 10%, preferably, less than 5%, and more preferably, less than 1% of the mRNA is degraded) to truly represent the gene expression levels of the cartilage samples from which they are extracted.

As used herein, “fetal” cartilage samples refer to samples taken from a fetus. The chondrocytes of fetal cartilage have a higher level of metabolic activity and cell division rates as compared to chondrocytes from cartilage derived from either a normal adult or from an adult diagnosed with any stage of OA (mild, moderate, marked and severe).

As used herein, “nucleic acid(s)” generally refers to any polyribonucleotide or poly-deoxyribonucleotide, which may be unmodified RNA or DNA or modified RNA or DNA. “Nucleic acids” include, without limitation, single-and double-stranded nucleic acids. As used herein, the term “nucleic acid(s)” also includes DNAs or RNAs as described above, that contain one or more modified bases. Thus, DNAs or RNAs with backbones modified for stability or for other reasons are “nucleic acids”. The term “nucleic acids” as it is used herein embraces such chemically, enzymatically or metabolically modified forms of nucleic acids, as well as the chemical forms of DNA and RNA characteristic of viruses and cells, including for example, simple and complex cells. A “nucleic acid” or “nucleic acid sequence” may also be an expressed sequence tag (EST) according to some embodiments of the invention. An EST is a small part of the expressed sequence of a gene (i.e., the “tag” of a sequence), made from cDNA. An EST can be used to fish the rest of the gene out of the chromosome, by matching base pairs with part of the expressed sequence of the gene.

As used herein, “isolated” or “purified” when used in reference to a nucleic acid means that a naturally occurring sequence has been removed from its normal cellular (e.g., chromosomal) environment or is synthesized in a non-natural environment (e.g., artificially synthesized). Thus, an “isolated” or “purified” sequence may be in a cell-free solution or placed in a different cellular environment. The term “purified” does not imply that the sequence is the only nucleotide present, but that it is essentially free (about 90-95% pure) of non-nucleotide material naturally associated with it, and thus is distinguished from isolated chromosomes.

As used herein, the term “probe” refers to an oligonucleotide which forms a duplex structure with a sequence in the target nucleic acid, due to complementarity of at least one sequence in the probe with a sequence in the target region.

As defined herein, a “nucleic acid array” refers a plurality of unique nucleic acids (or “nucleic acid members”) attached to one surface of a solid support at a density exceeding 20 different nucleic acids/$cm^2$ where each of the nucleic acid members is attached to the surface of the solid support in a non-identical pre-selected region. In one embodiment, the nucleic acid member attached to the surface of the solid support is DNA. In a preferred embodiment, the nucleic acid member attached to the surface of the solid support is cDNA. In another preferred embodiment the nucleic acid member attached to the surface of the solid support is cDNA synthesized by polymerase chain reaction (PCR). Preferably, a nucleic acid member of the array according to the invention is at least 50 nucleotides in length. Preferably, a nucleic acid member of the array is less than 6,000 nucleotides in length. More preferably, a nucleic acid member of the array comprises an array less than 500 nucleotides in length. In one embodiment, the array comprises at least 500 different nucleic acid members attached to one surface of the solid support. In another embodiment, the array comprises at least 10 different nucleic acid members attached to one surface of the solid support. In yet another embodiment, the array comprises at least 10,000 different nucleic acid members attached to one surface of the solid support. In yet another embodiment, the array comprises at least 15,000 different nucleic acid members attached to one surface of the solid support. The term "nucleic acid", as used herein, is interchangeable with the term "nucleic acid".

As used herein, "a plurality of" or "a set of" refers to more than two, for example, 3 or more, 100 or more, or 1000 or more.

As used herein, "attaching" or "spotting" refers to a process of depositing a nucleic acid onto a solid substrate to form a nucleic acid array such that the nucleic acid is irreversibly bound to the solid substrate via covalent bonds, hydrogen bonds or ionic interactions.

As used herein, "stably associated" refers to a nucleic acid that is irreversibly bound to a solid substrate to form an array via covalent bonds, hydrogen bonds or ionic interactions such that the nucleic acid retains its unique pre-selected position relative to all other nucleic acids that are stably associated with an array, or to all other pre-selected regions on the solid substrate under conditions in which an array is typically analyzed (i.e., during one or more steps of hybridization, washes, and/or scanning, etc.).

As used herein, "solid substrate" or "solid support" refers to a material having a rigid or semi-rigid surface. The terms "substrate" and "support" are used interchangeably herein with the terms "solid substrate" and "solid support". The solid support may be biological, non-biological, organic, inorganic, or a combination of any of these, existing as particles, strands, precipitates, gels, sheets, tubing, spheres, beads, containers, capillaries, pads, slices, films, plates, slides, chips, etc. Often, the substrate is a silicon or glass surface, (poly)tetrafluoroethylene, (poly)vinylidendifluoride, polystyrene, polycarbonate, a charged membrane, such as nylon 66 or nitrocellulose, or combinations thereof. In a preferred embodiment, the solid support is glass. Preferably, at least one surface of the substrate will be substantially flat. Preferably, the surface of the solid support will contain reactive groups, including, but not limited to, carboxyl, amino, hydroxyl, thiol, and the like. In one embodiment, the surface is optically transparent.

As used herein, "pre-selected region", "predefined region", or "unique position" refers to a localized area on a substrate which is, was, or is intended to be used for the deposit of a nucleic acid and is otherwise referred to herein in the alternative as a "selected region" or simply a "region." The pre-selected region may have any convenient shape, e.g., circular, rectangular, elliptical, wedge-shaped, etc. In some embodiments, a pre-selected region is smaller than about 1 $cm^2$, more preferably less than 1 $mm^2$, still more preferably less than 0.5 $mm^2$, and in some embodiments less than 0.1 $mm^2$. A nucleic acid member at a "pre-selected region", "predefined region", or "unique position" is one whose identity (e.g., sequence) can be determined by virtue of its position at the region or unique position.

As used herein, a "nucleic acid target" or "a target nucleic acid" is defined as a nucleic acid capable of binding to a nucleic acid member of complementary sequence through one or more types of chemical bonds, usually through complementary base pairing, i.e., through hydrogen bond formation. As used herein, a nucleic acid target may include natural (i. e., A, G, C, or T) or modified bases (7-deazaguanosine, inosine, etc.). In addition, the bases in nucleic acid probe may be joined by a linkage other than a phosphodiester bond, so long as it does not interfere with hybridization (i.e., the probe still specifically binds to its complementary sequence under standard stringent or selective hybridization conditions). Thus, nucleic acid targets may be peptide nucleic acids in which the constituent bases are joined by peptide bonds rather than phosphodiester linkages. Preferably, the nucleic acid targets are derived from human cartilage, blood or synovial fluid extracts. More preferably, the nucleic acid targets are single- or double-stranded DNA, RNA, or DNA-RNA hybrids, from human cartilage, blood or synovial fluid RNA extracts, and preferably from mRNA extracts.

As used herein, a "cartilage nucleic acid sample", refers to nucleic acids derived from cartilage. Preferably, a cartilage nucleic acid sample is RNA or is a nucleic acid corresponding to RNA, for example, cDNA.

As used herein, the term "hybridizing to" or "hybridization" refers to the hydrogen binding with a complementary nucleic acid, via an interaction between for example, a target nucleic acid sequence and a nucleic acid member in an array.

As used herein, "specific hybridization" or "selective hybridization" refers to hybridization which occurs when two nucleic acid sequences are substantially complementary (at least about 65% complementary over a stretch of at least 14 to 25 nucleotides, preferably at least about 75%, more preferably at least about 90% complementary). See Kanehisa, M., 1984, *Nucleic acids Res.,* 12:203, incorporated herein by reference. As a result, it is expected that a certain degree of mismatch is tolerated. Such mismatch may be small, such as a mono-, di- or tri-nucleotide. Alternatively, a region of mismatch can encompass loops, which are defined as regions in which there exists a mismatch in an uninterrupted series of four or more nucleotides. Numerous factors influence the efficiency and selectivity of hybridization of two nucleic acids, for example, a nucleic acid member on a array, to a target nucleic acid sequence. These factors include nucleic acid member length, nucleotide sequence and/or composition, hybridization temperature, buffer composition and potential for steric hindrance in the region to which the nucleic acid member is required to hybridize. A positive correlation exists between the nucleic acid member length and both the efficiency and accuracy with which a nucleic acid member will anneal to a target sequence. In particular, longer sequences have a higher melting temperature ($T_M$) than do shorter ones, and are less likely to be repeated within a given target sequence, thereby minimizing promiscuous hybridization. Hybridization temperature varies inversely with nucleic acid member annealing efficiency, as does the concentration of organic solvents, e.g., formamide, that might be included in a hybridization mixture, while increases in salt concentration facilitate binding. Under stringent annealing conditions, longer nucleic acids, hybridize more efficiently than do shorter ones, which are sufficient under more permissive conditions.

As used herein, the term "differential hybridization" refers to a situation where a probe hybridizes to the same nucleic acid sequence obtained from two or more samples at different levels. "Differential hybridization" means that the ratio of the level of hybridization of the probe to the nucleic acid sequence isolated from one sample as compared to the nucleic acid sequence isolated from another sample is not equal to 1.0. For example, the ratio of the level of hybridization of the probe to the nucleic acid sequence isolated from one sample as compared to the nucleic acid sequence isolated from another sample is greater than or less than 1.0 and includes greater than 1.2 and less than 0.7, greater than 1.5 and less than 0.5. A differential hybridization also exists if the hybridization is detectable in one sample but not another sample.

As herein used, the term "standard stringent conditions" means hybridization will occur only if there is at least 95% and preferably, at least 97% identity between the sequences, where the region of identity comprises at least 10 nucleotides. In one embodiment, the sequences hybridize under stringent conditions following incubation of the sequences overnight at 42° C., followed by stringent washes (0.2×SSC at 65° C.). As several factors affect the stringency of hybridization, the combination of parameters is more important than the absolute measure of a single factor.

As used herein, the term "level of expression" refers to the measurable expression level of a given nucleic acid. The level of expression of a nucleic acid is determined by methods well known in the art. The term "differentially expressed" or "changes in the level of expression" refers to an increase or decrease in the measurable expression level of a given nucleic acid. As used herein, "differentially expressed" when referring to microarray analysis means the ratio of the expression level of a given nucleic acid in one sample and the expression level of the given nucleic acid in another sample is not equal to 1.0. "Differentially expressed" when referring to microarray analysis according to the invention also means the ratio of the expression level of a given nucleic acid in one sample and the expression level of the given nucleic acid in another sample is greater than or less than 1.0 and includes greater than 1.2 and less than 0.7, as well as greater than 1.5 and less than 0.5. A nucleic acid also is said to be differentially expressed in two samples if one of the two samples contains no detectable expression of the nucleic acid. Absolute quantification of the level of expression of a nucleic acid can be accomplished by including known concentration(s) of one or more control nucleic acid species, generating a standard curve based on the amount of the control nucleic acid and extrapolating the expression level of the "unknown" nucleic acid species from the hybridization intensities of the unknown with respect to the standard curve. The level of expression is measured by hybridization analysis using labeled target nucleic acids according to methods well known in the art. The label on the target nucleic acid can be a luminescent label, an enzymatic label, a radioactive label, a chemical label or a physical label. Preferably, target nucleic acids are labeled with a fluorescent molecule. Preferred fluorescent labels include, but are not limited to, fluorescein, amino coumarin acetic acid, tetramethylrhodamine isothiocyanate (TRITC), Texas Red, Cy3 and Cy5.

As used herein "differentially expressed" when referring to EST analysis refers to the relative expression level of a gene based on the frequency of ESTs representing the gene derived from a cDNA library as compared to the frequency of ESTs representing the same gene derived from another cDNA library. As described herein, the "relative EST frequency" of an EST is calculated by dividing the number of ESTs representing each specific gene by the total number of ESTs analyzed. Differences in "relative EST frequency" may be used as an indication of differential gene expression.

As used herein, the term "significant match", when referring to nucleic acid sequences, means that two nucleic acid sequences exhibit at least 65% identity, at least 70%, at least 75%, at least 80%, at least 85%, and preferably, at least 90% identity, using comparison methods well known in the art (i.e., Altschul, S. F. et al., 1997, *Nucl. Acids Res.,* 25:3389-3402; Schäffer, A. A. et al., 1999, *Bioinformatics* 15:1000-1011). As used herein, "significant match" encompasses non-contiguous or scattered identical nucleotides so long as the sequences exhibit at least 65%, and preferably, at least 70%, at least 75%, at least 80%, at least 85%, and preferably, at least 90% identity, when maximally aligned using alignment methods routine in the art.

As used herein, a "novel sequence" or "novel expressed sequence tag (EST)" refers to a nucleic acid sequence which has no significant match to any existing sequence in the "nt", "nr", "est", "gss" and "htg" databases available through NCBI at the time each novel sequence was compared. "No significant match" preferably refers to a less than 65% match between a novel sequence being queried against other sequences in the database, and preferably, a less than 50% match, a less than 40% match, or a less than 30% match, after maximally aligning sequences using methods routine in the art.

As used herein, a "known sequence" refers to a nucleic acid sequence which has significant match to at least one existing sequence in the "nt", "nr", "est", "gss" and "htg" databases available through NCBI. "Known sequence with a function" refers to a nucleic acid with significant match to an existing sequence which encodes a polypeptide with a known function. "Known sequence with no function" refers to a nucleic acid that exhibits a significant match to an existing sequence which encodes a polypeptide of unknown function.

As used herein, a "chondrocyte-specific nucleic acid" is a nucleic acid sequence which is expressed at a detectable level in a chondrocyte and is not expressed at a detectable level in any other cell types as indicated by having no significant match to any sequence in any of the available databases comprising sequences from other cell types.

As used herein, a "chondrocyte enriched nucleic acid" or "chondrocyte enriched sequence" refers to a sequence which is differentially expressed in chondrocytes as compared to non-chondrocytes.

As used herein, "indicative of disease" refers to an expression pattern which is diagnostic of disease such that the expression pattern is found significantly more often in patients with a disease than in patients without the disease (as determined using routine statistical methods setting confidence levels at 95%). Preferably, an expression pattern which is indicative of disease is found in at least 70% of patients who have the disease and is found in less than 10% of patients who do not have the disease. More preferably, an expression pattern which is indicative of disease is found in at least 75%, at least 80%, at least 85%, at least 90%, at least 95% or more in patients who have the disease and is found in less than 10%, less than 8%, less than 5%, less than 2.5%, or less than 1% of patients who do not have the disease.

As used herein, "gene expression pattern" or "gene expression profile" comprises the pattern (i.e., qualitatively and/or quantitatively) of expression of one or more expressed nucleic acid sequences where one or more members of the set are differentially expressed.

As used herein, "a nucleic acid array expression profile" is generated from the hybridization of nucleic acids derived from a sample to one or more nucleic acid members comprising an array according to the invention.

As used herein, a "therapeutic agent" or "agent" refers to a compound that increases or decreases the expression of a nucleic acid sequence that is differentially expressed in a chondrocyte from any two of the following developmental or osteoarthritis disease stages: (a) fetal, (b) mild, (c) moderate, (d) marked and (e) severe, or (f) chondrocyte from a normal individual, as defined herein. A therapeutic agent according to the invention also refers to a compound that increases or decreases the anabolic activity of a chondrocyte. The invention provides for a "therapeutic agent" that 1) prevents the onset of osteoarthritis; 2) reduces, delays, or eliminates osteoarthritis symptoms such as pain, swelling, weakness and loss of functional ability in the afflicted joints; 3) reduces, delays, or eliminates cartilage degeneration, and/or enhances chondrocyte metabolic activity and cell division rates; and/or 4) restores one or more expression profiles of one or more disease-indicative nucleic acids of a patient to a profile more similar to that of a normal individual when administered to a patient.

Identifying Chondrocyte Enriched and Chondrocyte-Specific Nucleic Acid Sequences cDNA libraries were constructed from human fetal, normal, mild osteoarthritic and severe osteoarthritic cartilage samples. The known and novel clones derived from these libraries were then used to construct human chondrocyte-specific microarrays to generate differential gene expression profiles useful as a diagnostic tool for detection of mild (early stage) osteoarthritis. Arrays of the invention are useful as a gold standard for osteoarthritis diagnosis and for use to identify and monitor therapeutic efficacy of new drug targets.

One effective and rapid way of characterizing gene expression patterns in a given tissue is through large-scale partial sequencing of a cDNA library produced from such a tissue to generate expressed sequence tags (ESTs). This approach has provided both quantitative and qualitative information on gene expression in a variety of tissues and cells (4-7). Since cDNA libraries represent gene transcription in the cells of the tissue used to construct the library, gene expression profiles generated by random sampling and sequencing is used for detailed genetic-level comparison between developmental, normal and pathological states of the tissue examined.

Many human genes are expressed at different levels in cartilage of different developmental (fetal vs. mature) or disease states. In some cases, a gene is not expressed at all in some developmental or disease states, and at high levels in others (see FIGS. 6, 14 and 15 for examples). According to the invention, differential analysis of chondrocyte gene expression during different stages of cartilage developmental and in different disease states using an EST-based approach has identified genes that play important roles in osteoarthritis pathogenesis and cartilage repair. The advantage of this method is that it provides gene expression information on a larger scale than other methods. The cDNA clones generated by this approach are also useful for functional studies of certain genes. This type of genomic-based approach has provided important novel insights into our understanding of the osteoarthritis disease process and provides for novel diagnostic, prognostic and therapeutic approaches.

Samples

Cartilage

In one aspect, cartilage is obtained from a fetus using methods known in the art. The chondrocytes of fetal cartilage have a higher level of metabolic activity and cell division rates as compared to chondrocytes from cartilage from either a normal adult or from an individual diagnosed with any stage of osteoarthritis (mild, moderate, marked and severe).

In another aspect, cartilage is obtained from a normal individual who is alive or is obtained from cartilage tissue less than 14 hours post mortem, according to methods known in the art and described below. Normal articular cartilage from human adults are obtained using any known method. However, truly normal cartilage cannot generally be sampled from live donors due to ethical considerations. Preferably, normal cartilage samples are obtained from deceased donors, within a fourteen-hour post-mortem window, after cessation of perfusion to the sampled joint, minimize the degradation of RNA observed beyond the window. In other embodiments, the "normal" tissue is obtained less than 14 hours post-mortem, such as 13, 12, 11, 10, 9, 8, 6, 4, 2, or 1 hour post-mortem. A baboon study was conducted to confirm this approach and is described herein below in Example 11. Preferably the normal cartilage is obtained less than 14 hours post-mortem. More preferably, the normal cartilage is obtained less than 12 hours post-mortem.

Preferably, cartilage also is isolated from the following disease stages of osteoarthritis: mild, marked, moderate and severe. Human cartilage samples from osteoarthritic individuals are obtained using any known method. Preferably the cartilage is obtained from individuals undergoing arthroscopy or total knee replacements and samples are stored in liquid nitrogen until needed. In a preferred embodiment, a minimum of 0.05 g of cartilage sample is isolated to obtain 2 μg total RNA extract for the construction of a cDNA library. In another preferred embodiment, a minimum of 0.025 g cartilage sample is isolated to obtain 1 μg total RNA extract to use as a target sample for a microarray. A cartilage sample that is useful according to the invention is in an amount that is sufficient for the detection of one or more polynucleotide sequences according to the invention.

Blood and Synovial Fluid

Samples useful according to the invention also include blood and synovial fluid samples.

In one aspect, blood is obtained from a normal patient or from an individual diagnosed with, or suspected of having, osteoarthritis according to methods of phlebotomy well known in the art. A blood sample useful according to the invention is in an amount ranging from 1 μl to 100 ml, preferably 10 μl to 50 ml, more preferably 10 μl to 25 ml and most preferably10 μl to 1 ml. A blood sample that is useful according to the invention is in an amount that is sufficient for the detection of one or more nucleic acid sequences according to the invention. In one embodiment, nucleic acids contained within the blood sample are amplified, for example, by polymerase chain reaction (PCR) or by RT-PCR. Other amplification methods known in the art are also encompassed within the scope of the invention (e.g., ligase chain reaction, NASBA, 3SR, and the like).

A synovial fluid sample is obtained from an individual diagnosed with, or suspected of having osteoarthritis according to methods well known in the art. Preferably, synovial fluid is collected from a human knee joint by aspiration at arthroscopy. A synovial fluid sample useful according to the invention is in an amount ranging from 0.1 ml to 20 ml and preferably 0.5 ml to 10 ml. A synovial fluid sample that is useful according to the invention is in an amount that is sufficient for the detection of one or more nucleic acid sequences according to the invention.

Developmental and Disease Stages of Articular Cartilage

Chondrocytes are preferably obtained from any of the following developmental and disease stages: fetal, normal, mild osteoarthritic, moderate osteoarthritic, marked osteoarthritic or severe osteoarthritic.

Cartilage isolated from a human fetus (e.g., during fetal development) is characterized above, and is useful according to the invention for analysis of fetal chondrocytes.

Cartilage isolated from a "normal" individual, defined herein, also is useful according to the invention for isolation and analysis of "normal" chondrocytes.

Cartilage isolated from a patient diagnosed with any one of: mild, moderate, marked and severe osteoarthritis also is useful in the present invention.

In order to classify cartilage according to disease state, a scoring system is used, whereby subjective decisions by the arthroscopist are minimized. The scoring system which defines disease states described herein is that of Marshall, supra, incorporated herein by reference. According to this method, each of the 6 articular surfaces (patella, femoral trochlea, medial femoral condyle, medial tibial plateau, lateral femoral condyle and lateral tibial plateau) is assigned a cartilage grade based on the worst lesion present on that specific surface. A scoring system is then applied in which each articular surface receives an osteoarthritis severity number value that reflects the cartilage severity grade for that surface, as described in Table 1.

TABLE 1

Articular Cartilage Grading System

| Grade | Articular Cartilage | Points |
|---|---|---|
| 0 | Normal | 0 |
| I | Surface intact-softening, edema | 1 |
| II | Surface-disrupted-partial thickness lesions (no extension to bone) | 2 |
| III | Full thickness lesions-extensions to intact bone | 3 |
| IV | Bone erosion or eburnation | 4 |

For example, if the medial femoral condyle has a grade I lesion as its most severe cartilage damage a value of 1 is assigned. A total score for the patient is then derived from the sum of the scores of the 6 articular surfaces. Based on the total score, each patient is placed into one of 4 osteoarthritis groups: mild (1-6), moderate (7-12), marked (13-18) and severe (>18).

RNA Preparation

In one aspect, RNA is isolated from cartilage samples from various disease or developmental stages as described herein. Samples can be from single patients or can be pooled from multiple patients.

In another aspect, RNA is isolated directly from synovial fluid of persons with various disease or developmental stages of osteoarthritis as described herein. Samples can be from single patients or can be pooled from multiple patients.

In another aspect, RNA is isolated directly from blood samples of persons with various disease or developmental stages of osteoarthritis as described herein. Samples can be from single patients or can be pooled from multiple patients.

Total RNA is extracted from the cartilage samples according to methods well known in the art. In one embodiment, RNA is purified from cartilage tissue according to the following method. Following removal of a tissue of interest from an individual or patient, the tissue is quick frozen in liquid nitrogen, to prevent degradation of RNA. Upon the addition of a volume of tissue guanidinium solution, tissue samples are ground in a tissuemizer with two or three 10-second bursts. To prepare tissue guanidinium solution (1 L) 590.8 g guanidinium isothiocyanate is dissolved in approximately 400 ml DEPC-treated $H_2O$. 25 ml of 2 M Tris-Cl, pH 7.5 (0.05 M final) and 20 ml $Na_2EDTA$ (0.01 M final) is added, the solution is stirred overnight, the volume is adjusted to 950 ml, and 50 ml 2-ME is added.

Homogenized tissue samples are subjected to centrifugation for 10 min at 12,000×g at 12° C. The resulting supernatant is incubated for 2 min at 65° C. in the presence of 0.1 volume of 20% Sarkosyl, layered over 9 ml of a 5.7M CsCl solution (0.1 g CsCl/ml), and separated by centrifugation overnight at 113,000×g at 22° C. After careful removal of the supernatant, the tube is inverted and drained. The bottom of the tube (containing the RNA pellet) is placed in a 50 ml plastic tube and incubated overnight (or longer) at 4° C. in the presence of 3 ml tissue resuspension buffer (5 mM EDTA, 0.5% (v/v) Sarkosyl, 5% (v/v) 2-ME) to allow complete resuspension of the RNA pellet. The resulting RNA solution is extracted sequentially with 25:24:1 phenol/chloroform/isoamyl alcohol, followed by 24:1 chloroform/isoamyl alcohol, precipitated by the addition of 3 M sodium acetate, pH 5.2, and 2.5 volumes of 100% ethanol, and resuspended in DEPC water (Chirgwin et al., 1979, *Biochemistry,* 18:5294).

Alternatively, RNA is isolated from cartilage tissue according to the following single step protocol. The tissue of interest is prepared by homogenization in a glass teflon homogenizer in 1 ml denaturing solution (4M guanidinium thiosulfate, 25 mM sodium citrate, pH 7.0, 0.1M 2-ME, 0.5% (w/v) N-laurylsarkosine) per 100 mg tissue. Following transfer of the homogenate to a 5-ml polypropylene tube, 0.1 ml of 2 M sodium acetate, pH 4, 1 ml water-saturated phenol, and 0.2 ml of 49:1 chloroform/isoamyl alcohol are added sequentially. The sample is mixed after the addition of each component, and incubated for 15 min at 0-4° C. after all components have been added. The sample is separated by centrifugation for 20 min at 10,000×g, 4° C., precipitated by the addition of 1 ml of 100% isopropanol, incubated for 30 minutes at −20° C. and pelleted by centrifugation for 10 minutes at 10,000×g, 4° C. The resulting RNA pellet is dissolved in 0.3 ml denaturing solution, transferred to a microfuge tube, precipitated by the addition of 0.3 ml of 100% isopropanol for 30 minutes at −20° C., and centrifuged for 10 minutes at 10,000×g at 4° C. The RNA pellet is washed in 70% ethanol, dried, and resuspended in 100-200 μl DEPC-treated water or DEPC-treated 0.5% SDS (Chomczynski and Sacchi, 1987, *Anal. Biochem.,* 162: 156).

Preferably, the cartilage samples are finely powdered under liquid nitrogen and total RNA is extracted using TRIzol® reagent (GIBCO/BRL).

Alternatively, RNA is isolated from blood by the following protocol. Lysis Buffer is added to blood sample in a ratio of 3 parts Lysis Buffer to 1 part blood (Lysis Buffer (1 L) 0.6 g EDTA; 1.0 g $KHCO_2$, 8.2 g $NH_4Cl$ adjusted to pH 7.4 (using NaOH)). Sample is mixed and placed on ice for 5-10 minutes until transparent. Lysed sample is centrifuged at 1000 rpm for 10 minutes at 4° C., and supernatant is aspirated. Pellet is resuspended in 5 ml Lysis Buffer, and centrifuged again at 1000 rpm for 10 minutes at 4° C. Pelleted cells are homogenized using TRIzol® (GIBCO/BRL) in a ratio of approximately 6 ml of TRIzol® for every 10 ml of the original blood sample and vortexed well. Samples are left for 5 minutes at room temperature. RNA is extracted using 1.2 ml of chloroform per 1 ml of TRIzol®. Sample is centrifuged at 12,000×g for 5 minutes at 4° C. and upper layer is collected. To upper layer, isopropanol is added in ratio of 0.5 ml per 1 ml of TRIzol®. Sample is left overnight at −20° C. or for one hour at −20° C. RNA is pelleted in accordance with known methods, RNA pellet air dried, and pellet resuspended in DEPC treated $ddH_2O$. RNA samples can also be stored in 75% ethanol where the samples are stable at room temperature for transportation.

Alternatively, RNA is isolated from synovial fluid using TRIzol® reagent (GIBCO/BRL).

Purity and integrity of RNA is assessed by absorbance at 260/280 nm and agarose gel electrophoresis followed by inspection under ultraviolet light.

Construction of cDNA Libraries cDNA libraries are constructed according to methods well known in the art (see for example Ausubel, supra, and Sambrook, supra, incorporated herein by reference).

In one aspect, cDNA samples, i.e., DNA that is complementary to RNA such as mRNA are prepared. The preparation of cDNA is well-known and well-documented in the prior art.

cDNA may be prepared according to the following method. Total cellular RNA is isolated (as described) and passed through a column of oligo(dT)-cellulose to isolate polyA RNA. The bound polyA mRNAs are eluted from the column with a low ionic strength buffer. To produce cDNA molecules, short deoxythymidine oligonucleotides (12-20 nucleotides) are hybridized to the polyA tails to be used as primers for reverse transcriptase, an enzyme that uses RNA as a template for DNA synthesis. Alternatively, or additionally, mRNA species are primed from many positions by using short oligonucleotide fragments comprising numerous sequences complementary to the mRNA of interest as primers for cDNA synthesis. The resultant RNA-DNA hybrid is converted to a double stranded DNA molecule by a variety of enzymatic steps well-known in the art (Watson et al., 1992, *Recombinant DNA,* 2nd edition, Scientific American Books, New York).

To construct a cDNA library, the poly $(A)^+$ RNA fraction may be isolated by oligo-dT cellulose chromatography (Pharmacia), and 3-5 ug poly $(A)^+$ RNA is used to construct a cDNA library in the λZAP Express vector (Stratagene). Alternatively, cDNA libraries may be constructed into λTriplEx2 vector through a PCR-based method, using SMART (Switching Mechanism At 5' end of RNA Transcript) cDNA Library Construction Kit (Clontech). First-strand cDNA is synthesized with an Xho I-oligo (dT) adapter-primer in the presence of 5'-methyl dCTP. After second-strand synthesis and ligation of EcoRI adapters, the cDNAs are digested with Xho I, resulting in cDNA flanked by EcoRI sites at the 5'-ends and Xho I sites at the 3'-ends. Digested cDNAs are size-fractionated in Sephacryl S-500 spin columns (Stratagene), then ligated into the λZAP Express vector predigested with EcoRI and Xho I. The resulting DNA/cDNA concatomers are packaged using Gigapack Gold packaging extracts. After titration, aliquots of primary packaging mix are stored in 7% DMSO at −80° C. as primary library stocks, and the rest are amplified to establish stable library stocks.

From the amplified library, phage plaques are plated onto an appropriate medium. Preferably, phage plaques are plated at a density of 200-500 pfu/150 mm plate onto an *Escherichia coli* XL1-blue MRF' lawn with IPTG/X-gal for color selection. The plaques are then randomly picked and positive inserts are identified by polymerase chain reaction (PCR), according to methods well known in the art and described hereinbelow. Preferably, plaques are picked into 75 ul suspension media buffer (100 mM NaCl, 10 mM $MgSO_4$, 1 mM Tris, pH7.5, 0.02% gelatin). Phage elutes (5 ul) may be used for PCR reactions (50 ul total volume) with 125 umol/L of each dNTP (Pharmacia), 10 pmol each of modified T3 (5'-GCCAAGCTCGAAATTAACCCTCACTAAAGGG-3') (SEQ ID NO: 58993) and T7 (5'-CCAGTGAATTGTAATACGACTCACTATAGGGCG-3') (SEQ ID NO: 58994) primers, and 2 U of Taq DNA polymerase (Pharmacia). Reactions are cycled in a DNA Thermal Cycler (Perkin-Elmer) [denaturation at 95° C. for 5 minutes, followed by 30 cycles of amplification (94° C., 45 seconds; 55° C., 30 seconds; 72° C., 3 minutes) and a terminal isothermal extension (72° C., 3 minutes)]. Agarose gel electrophoresis is used to assess the presence and purity of inserts.

The PCR product is then subjected to DNA sequencing using known methods (see Ausubel et al., supra and Sambrook et al., supra). Methods of sequencing employ such enzymes as the Klenow fragment of DNA polymerase I, Sequenase® (US Biochemical Corp, Cleveland, Ohio), Taq polymerase (Perkin Elmer, Norwalk, Conn.), thermostable T7 polymerase (Amersham, Chicago, Ill.), or combinations of recombinant polymerases and proofreading exonucleases such as the ELONGASE Amplification System (Gibco BRL, Gaithersburg, Md.). Preferably, the process is automated with machines such as the Hamilton Micro Lab 2200 (Hamilton, Reno Nev.), Peltier Thermal Cycler (PTC200; MJ Research, Watertown, Mass.), the ABI 377 DNA sequencers (Perkin Elmer), and the PE Biosystems ABI Prism 3700 DNA Analyzer.

PCR products are first subjected to DNA sequencing reactions using specific primers, BigDye™ Terminator Cycle Sequencing v2.0 Ready Reaction (PE Biosystems), Tris MgCl buffer and water in a thermocycler. Sequencing reactions were incubated at 94° C. for 2 minutes, followed by 25 cycles of 94° C., 30 seconds; 55° C., 20 seconds; and 72° C., 1 minute; and 15 cycles of 94° C., 30 seconds; and 72° C. for 1 minute; and 72° C. for 5 minutes Reactions were then put on hold at 4° C. until purified using methods well known in the prior art (i.e. alcohol precipitation or ethanol precipitation). Automated sequencing is preferably carried out with a PE Biosystems ABI Prism 3700 DNA Analyzer.

PCR

In one aspect, nucleic acid sequences of the invention are amplified by the polymerase chain reaction (PCR). PCR methods are well-known to those skilled in the art.

PCR provides a method for rapidly amplifying a particular nucleic acid sequence by using multiple cycles of DNA replication catalyzed by a thermostable, DNA-dependent DNA polymerase to amplify the target sequence of interest. PCR requires the presence of a nucleic acid to be amplified, two single-stranded oligonucleotide primers flanking the sequence to be amplified, a DNA polymerase, deoxyribonucleoside triphosphates, a buffer and salts.

The method of PCR is well known in the art. PCR, is performed as described in Mullis and Faloona, 1987, *Methods Enzymol.,* 155: 335, herein incorporated by reference.

PCR is performed using template DNA (at least 1 fg; more usefully, 1-1000 ng) and at least 25 pmol of oligonucleotide primers. A typical reaction mixture includes: 2 μl of DNA, 25 pmol of oligonucleotide primer, 2.5 μl of 10H PCR buffer 1 (Perkin-Elmer, Foster City, Calif.), 0.4 μl of 1.25 μM dNTP, 0.15 μl (or 2.5 units) of Taq DNA polymerase (Perkin Elmer, Foster City, Calif.) and deionized water to a total volume of 25 μl. Mineral oil is overlaid and the PCR is performed using a programmable thermal cycler.

The length and temperature of each step of a PCR cycle, as well as the number of cycles, are adjusted according to the stringency requirements in effect. Annealing temperature and timing are determined both by the efficiency with which a primer is expected to anneal to a template and the degree of mismatch that is to be tolerated. The ability to optimize the stringency of primer annealing conditions is well within the knowledge of one of moderate skill in the art. An annealing temperature of between 30° C. and 72° C. is used. Initial denaturation of the template molecules normally occurs at between 92° C. and 99° C. for 4 minutes, followed by 20-40 cycles consisting of denaturation (94-99° C. for 15 seconds to 1 minute), annealing (temperature determined as discussed above; 1-2 minutes), and extension (72° C. for 1 minute). The final extension step is generally carried out for 4 minutes at 72° C., and may be followed by an indefinite (0-24 hour) step at 4° C.

Several techniques for detecting PCR products quantitatively without electrophoresis may be useful according to the invention. One of these techniques, for which there are commercially available kits such as Taqman™ (Perkin Elmer, Foster City, Calif.), is performed with a transcript-specific antisense probe. This probe is specific for the PCR product (e.g. a nucleic acid fragment derived from a gene) and is prepared with a quencher and fluorescent reporter probe complexed to the 5' end of the oligonucleotide. Different fluorescent markers are attached to different reporters, allowing for measurement of two products in one reaction. When Taq DNA polymerase is activated, it cleaves off the fluorescent reporters of the probe bound to the template by virtue of its 5'-to-3' exonuclease activity. In the absence of the quenchers, the reporters now fluoresce. The color change in the reporters is proportional to the amount of each specific product and is measured by a fluorometer; therefore, the amount of each color is measured and the PCR product is quantified. The PCR reactions are performed in 96 well plates so that samples derived from many individuals are processed and measured simultaneously. The Taqman™ system has the additional advantage of not requiring gel electrophoresis and allows for quantification when used with a standard curve.

Nucleic Acid Sequences Useful According to the Invention

The invention provides for isolated nucleic acid sequences including ESTs which can be used as probes, arrayed on microarrays, and/or used for the development of therapies to treat osteoarthritis.

In one aspect, cartilage gene expression profiles at different developmental stages are identified. Another aspect of the invention is to monitor cartilage gene expression profiles of osteoarthritis patients diagnosed with different stages of osteoarthritis. A third aspect of the invention is to screen for potential therapeutic agents which alter the gene expression profile of diseased cartilage cells. The invention therefore provides for nucleic acid sequences that are present at each of the following developmental and disease stages: normal, fetal, mild osteoarthritic, moderate osteoarthritic, marked osteoarthritic and severe osteoarthritic. The invention also provides for nucleic acid sequences that are differentially expressed in any two of the following developmental and disease stages: normal, fetal, mild osteoarthritic, moderate osteoarthritic, marked osteoarthritic and severe osteoarthritic.

Nucleic acids useful according to the invention are prepared by isolating cartilage tissue samples from a developmental or disease stage (normal, fetal, mild osteoarthritic, moderate osteoarthritic, marked osteoarthritic and severe osteoarthritic), preparing a cDNA library (as described above), and performing large-scale partial sequencing (described herein) of the cDNA library to generate Expressed Sequence Tags (ESTs). An EST useful according to the invention is preferably in the range of 50-1000 nucleotides and most preferably 100-500 nucleotides in length.

The invention provides for nucleic acid sequences or ESTs that are categorized as “novel” or “known”, including “known sequences with a function” and “known sequences without a known function”, all defined herein.

Nucleic Acid Members and Probes

In one aspect, the invention provides nucleic acid members and probes that bind specifically to a target nucleic acid sequence (e.g., present in a cartilage nucleic acid sample).

Nucleic acid members are stably associated with a solid support to comprise an array according to the invention. The length of a nucleic acid member can range from 50 to 6000 nucleotides, 100 to 500 nucleotides, and in other embodiments, from 500 to 1500 nucleotides. The nucleic acid members may be single or double stranded, and/or may be PCR fragments amplified from cDNA.

The invention also provides for nucleic acid sequences comprising a probe. In a certain embodiment, a probe is labeled, according to methods known in the art. A probe according to the invention is 50 to 5000 nucleotides, more preferably 100-500 nucleotides and most preferably 50 to 250 nucleotides in length. The probe may be single or double stranded, and may be a PCR fragment amplified from cDNA.

The nucleic acid members and probes according to the invention can be used to detect target sequences such as chondrocyte enriched or chondrocyte-specific sequences, and preferably sequences whose presence in a sample are indicative, or diagnostic or prognostic, of a stage of osteoarthritis.

The target nucleic acid sequences to be analyzed are preferably from human cartilage, blood or synovial fluid and preferably comprise RNA or nucleic acid corresponding to RNA, (i.e., cDNA or amplified products of RNA or cDNAs).

Data Acquisition and Analysis of EST Sequences

The invention provides for EST sequences including “novel sequences”, “novel expressed sequence tags (ESTs)” and “known sequences” including “known sequences with a function” and “known sequences with no known function”.

The generated EST sequences are searched against available databases, including the “nt”, “nr”, “est”, “gss” and “htg” databases available through NCBI to determine putative identities for ESTs matching to known genes or other ESTs. Relative EST frequency level can then be calculated using known methods. Functional characterization of ESTs with known gene matches are made according to any known method. Preferably, generated EST sequences are compared to the non-redundant Genbank/EMBL/DDBJ and dbEST databases using the BLAST algorithm (8). A minimum value of $P=10^{-10}$ and nucleotide sequence identity >95%, where the sequence identity is non-contiguous or scattered, are required for assignments of putative identities for ESTs matching to known genes or to other ESTs. Construction of a non-redundant list of genes represented in the EST set is done with the help of Unigene, Entrez and PubMed at the National Center for Biotechnology Information (NCBI) site (http://www.ncbi.nlm.nih.gov/). Relative gene expression frequency is calculated by dividing the number of EST copies for each gene by the total number of ESTs analyzed.

Genes are identified from ESTs according to known methods. To identify novel genes from an EST sequence, the EST should preferably be at least 100 nucleotides in length, and more preferably 150 nucleotides in length, for annotation. Preferably, the EST exhibits open reading frame characteristics (i.e., can encode a putative polypeptide).

Because of the completion of the Human Genome Project, a specific EST which matches with a genomic sequence can be mapped onto a specific chromosome based on the chromosomal location of the genomic sequence. However, no function may be known for the protein encoded by the sequence and the EST would then be considered “novel” in a functional sense. In one aspect, the invention is used to identify a novel EST which is part of a larger known sequence for which no function is known is used to determine the function of a gene comprising the EST (e.g., such as the role of expression products produced by the gene in chondrogenesis and/or in a pathology affecting chondrocytes). Alternatively, or additionally, the EST can be used to identify an mRNA or polypeptide encoded by the larger sequence as a diagnostic or prognostic marker of chondrogenesis and/or of a pathology affecting chondrocytes.

Having identified an EST corresponding to a larger sequence as chondrocyte enriched or chondrocyte-specific, other portions of the larger sequence which comprises the EST can be used in assays to elucidate gene function, e.g., to isolate polypeptides encoded by the gene, to generate antibodies specifically reactive with these polypeptides, to identify binding partners of the polypeptides (receptors, ligands, agonists, antagonists and the like) and/or to detect the expression of the gene (or lack thereof) in chondrocytes in fetal, adult, normal, and/or diseased individuals.

In another aspect, the invention provides for nucleic acid sequences that do not demonstrate a "significant match" to any of the publicly known sequences in sequence databases at the time a query is done. Longer genomic segments comprising these types of novel EST sequences can be identified by probing genomic libraries, while longer expressed sequences can be identified in cDNA libraries and/or by performing polymerase extension reactions (e.g., RACE) using EST sequences to derive primer sequences as is known in the art. Longer fragments can be mapped to particular chromosomes by FISH and other techniques and their sequences compared to known sequences in genomic and/or expressed sequence databases and further functional analysis can be performed as described above.

Using the methods according to the invention, out of a total of 57,422 ESTs from the four cDNA libraries, no significant match was found for 618 sequences. The remaining sequences were characterized as shown in FIGS. 5 and 5A.

Figure 7A:
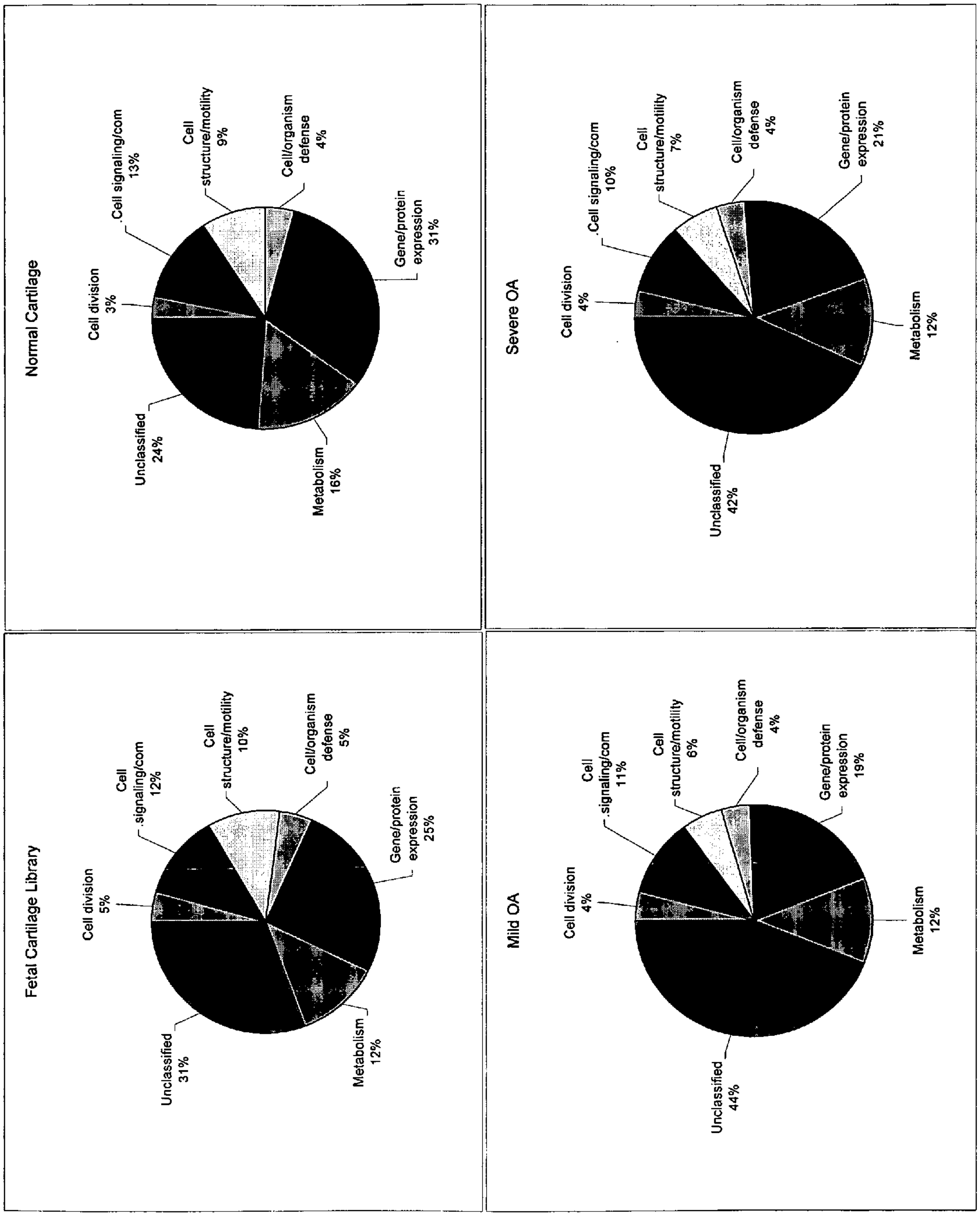
FIG. 7A, is a graphical representation of the data presented in FIG. 7 according to one embodiment of the invention.

Identified genes can be catalogued according to their putative function. Functional characterization of ESTs with known gene matches is preferably made according to the categories described by Hwang et al (5). The distribution of genes in each of the subcellular categories is indicative of the dynamic state of the tissue and will provide important insights into the osteoarthritis disease process. The results of this analysis are provided in FIGS. 7 and 7A where the total number of ESTs identified by the method in different human cartilage libraries are characterized based on the functional classification of known genes identified in each library.

Alternative methods for analyzing ESTs are also available. For example, the ESTs from each library may be assembled into contigs with sequence alignment, editing, and assembly programs such as PHRED and PHRAP (Ewing, et al., 1998, *Genome Res.* 3:175, incorporated herein; http://bozeman.genome.washington.edu/). Contig redundancy is reduced by clustering nonoverlapping sequence contigs using the EST clone identification number, which is common for the non-overlapping 5 and 3 sequence reads for a single EST cDNA clone. In one aspect, the consensus sequence from each cluster is compared to the non-redundant Genbank/EMBL/DDBJ and dbEST databases using the BLAST algorithm with the help of unigene, Entrez and PubMed at the NCBI site.

Known Nucleic Acid Sequences or ESTs and Novel Nucleic Acid Sequences or ESTs

An EST that exhibits a significant match (>65%, and preferably 90% or greater, identity) to at least one existing sequence in an existing nucleic acid sequence database is characterized as a "known" sequence according to the invention. Within this category, some known ESTs match to existing sequences which encode polypeptides with known function(s) and are referred to as a "known sequence with a function". Other "known" ESTs exhibit significant match to existing sequences which encode polypeptides of unknown function(s) and are referred to as a "known sequence with no known function".

In one aspect, the invention also provides for known nucleic acid sequences that are chondrocyte enriched or chondrocyte-specific.

EST sequences which have no significant match (less than 65% identity) to any existing sequence in the above cited available databases are categorized as novel ESTs. These novel ESTs are considered chondrocyte-specific since they are not matched to any other genes or ESTs derived from any other tissue. To identify a novel gene from an EST sequence, the EST is preferably at least 150 nucleotides in length. More preferably, the EST encodes at least part of an open reading frame, that is, a nucleic acid sequence between a translation initiation codon and a termination codon, which is potentially translated into a polypeptide sequence.

The invention provides for known and novel nucleic acid sequences that are uniquely expressed in normal, fetal, mild osteoarthritic, moderate osteoarthritic, marked osteoarthritic and severe osteoarthritic cartilage. FIGS. 6 and 13, show unique known genes and names of the novel sequences identified to date in the fetal, normal, mild osteoarthritic and severe osteoarthritic cDNA libraries using the methods according to the invention.

The invention also provides for known and novel nucleic acid sequences that are upregulated and downregulated in normal, fetal, mild osteoarthritic, moderate osteoarthritic, marked osteoarthritic and severe osteoarthritic cartilage. In one aspect, nucleic acid sequences are enriched in chondrocytes compared to cells which are non-chondrocytes, or in chondrocytes from individuals with osteoarthritis compared to normal individuals, or in chondrocytes from particular stages of development or disease compared to particular other stages of development or disease.

The invention also provides for nucleic acid sequences that are differentially expressed in cartilage from any two of the following developmental and disease stages: fetal, normal, mild osteoarthritic, moderate osteoarthritic, marked osteoarthritic and severe osteoarthritic.

Relative EST frequency is calculated by dividing the number of EST copies for each gene by the total number of ESTs analyzed. The chondrocyte-specific expression of a number of novel ESTs has been confirmed by methods known in the art. Useful methods for measuring gene expression in a tissue include RT PCR, Northern blot, etc.

Novel Nucleic Acid Molecules

Many of the novel nucleic acid molecules of the present invention are differentially expressed between the mild and severe osteoarthritis disease states and are thus useful as potential drug targets or markers for the osteoarthritis disease process. The invention also provides one or more nucleic acid molecules that are differentially expressed in two or more of the following developmental and disease stages: fetal, normal, mild osteoarthritic, moderate osteoarthritic, marked osteoarthritic and severe osteoarthritic. The invention further provides one or more novel clones that are differentially expressed in two or more of the following developmental and disease stages: fetal, normal, mild osteoarthritic, moderate osteoarthritic, marked osteoarthritic and severe osteoarthritic.

Microarrays

Nucleic Acid Microarrays

Any combination of the nucleic acid sequences generated from any of the chondrocyte cDNA libraries are used for the construction of a microarray. In one embodiment, the microarray is chondrocyte-specific and is anticipated to encompass the entire spectrum of genes that are important in the osteoarthritis disease process. A microarray according to the invention preferably comprises between 10 and 20,000 nucleic acid members, and more preferably comprises at least 5000 nucleic acid members. The nucleic acid members are known or novel nucleic acid sequences described herein, or any combination thereof. A microarray according to the invention is used to confirm differential gene expression profiles of genes that are specifically expressed at different cartilage development and osteoarthritis disease stages.

The invention also provides for a microarray comprising genes that are differentially expressed between normal and mild osteoarthritis patients to allow for the identification of early risk factors for osteoarthritis development. The invention also provides for a microarray for osteoarthritis diagnosis comprising one or more nucleic acid sequences that are differentially expressed between a normal individual and a patient diagnosed with mild, moderate, marked or severe osteoarthritis. Such arrays also may be used for prognostic methods to monitor a patient's response to therapy. Preferably, an array for osteoarthritis diagnosis comprises 10-20,000 nucleic acid members and more preferably 50-15,000 nucleic acid members. In one embodiment, the above microarrays are used to identify a therapeutic agent that modulates the anabolic activity of a chondrocyte or changes (e.g., increases or decreases) the level of expression of at least one nucleic acid sequence that is differentially expressed in a chondrocyte derived from any of the following chondrocyte disease or developmental stages: fetal, normal, mild osteoarthritic, moderate osteoarthritic, marked osteoarthritic and severe osteoarthritic.

The target nucleic acid samples that are hybridized to and analyzed with a microarray of the invention are preferably from human cartilage, blood or synovial fluid. A limitation for this procedure lies in the amount of RNA available for use as a target nucleic acid sample. Preferably, at least 1 microgram of total RNA is obtained for use according to this invention. This is advantageous because the amount of RNA in synovial fluid and in many cartilage biopsy samples is very minimal.

Construction of a Microarray

In one aspect, cDNAs generated from human cartilage cDNA libraries are arrayed on a microarray. Preferably, a microarray according to the invention comprises chondrocyte enriched or chondrocyte-specific genes and includes the whole spectrum of genes that are important in the osteoarthritis disease process.

The EST frequency analysis in FIG. 6 (and portions thereof shown in FIGS. 14 and 15) shows the differential gene expression profiles for known genes. Microarrays according to the invention may be used to confirm these profiles and may also be used to show differential expression profiles between different developmental stages and osteoarthritis disease states for novel EST sequences. These novel EST sequences may be further characterized by cluster and alignment analyses to determine how many unique genes are represented by the novel EST sequences. The novel unique genes identified may provide a basis for identifying key markers in osteoarthritis disease progression and treatment.

In the subject methods, an array of nucleic acid members stably associated with the surface of a substantially solid support is contacted with a sample comprising target nucleic acids under hybridization conditions sufficient to produce a hybridization pattern of complementary nucleic acid members/target complexes in which one or more complementary nucleic acid members at unique positions on the array specifically hybridize to target nucleic acids. The identity of target nucleic acids which hybridize can be determined with reference to location of nucleic acid members on the array.

The nucleic acid members may be produced using established techniques such as polymerase chain reaction (PCR) and reverse transcription (RT). These methods are similar to those currently known in the art (see e.g., *PCR Strategies,* Michael A. Innis (Editor), et al. (1995) and *PCR: Introduction to Biotechniques Series,* C. R. Newton, A. Graham (1997)). Amplified nucleic acids are purified by methods well known in the art (e.g., column purification or alcohol precipitation). A nucleic acid is considered pure when it has been isolated so as to be substantially free of primers and incomplete products produced during the synthesis of the desired nucleic acid. Preferably, a purified nucleic acid will also be substantially free of contaminants which may hinder or otherwise mask the specific binding activity of the molecule.

A microarray according to the invention comprises a plurality of unique nucleic acids attached to one surface of a solid support at a density exceeding 20 different nucleic acids/$cm^2$, where each of the nucleic acids is attached to the surface of the solid support in a non-identical pre-selected region. Each associated sample on the array comprises a nucleic acid composition, of known identity, usually of known sequence, as described in greater detail below. Any conceivable substrate may be employed in the invention.

In one embodiment, the nucleic acid attached to the surface of the solid support is DNA. In a preferred embodiment, the nucleic acid attached to the surface of the solid support is cDNA or RNA. In another preferred embodiment, the nucleic acid attached to the surface of the solid support is cDNA synthesized by polymerase chain reaction (PCR). Preferably, a nucleic acid member in the array, according to the invention, is at least 50 nucleotides in length. In one embodiment, a nucleic acid member is at least 150 nucleotides in length. Preferably, a nucleic acid member is less than 1000 nucleotides in length. More preferably, a nucleic acid member is less than 500 nucleotides in length. In one embodiment, an array comprises at least 10 different nucleic acids attached to one surface of the solid support. In another embodiment, the array comprises at least 100 different nucleic acids attached to one surface of the solid support. In yet another embodiment, the array comprises at least 10,000 different nucleic acids attached to one surface of the solid support. In yet another embodiment, the array comprises at least 15,000 different nucleic acids attached to one surface of the solid support.

In the arrays of the invention, the nucleic acid compositions are stably associated with the surface of a solid support, where the support may be a flexible or rigid solid support. By "stably associated" is meant that each nucleic acid member maintains a unique position relative to the solid support under hybridization and washing conditions. As such, the samples are non-covalently or covalently stably associated with the support surface. Examples of non-covalent association include non-specific adsorption, binding based on electrostatic interactions (e.g., ion pair interactions), hydrophobic interactions, hydrogen bonding interactions, specific binding through a specific binding pair member covalently attached to the support surface, and the like. Examples of covalent binding include covalent bonds formed between the nucleic acids and a functional group present on the surface of the rigid support (e.g., —OH), where the functional group may be naturally occurring or present as a member of an introduced linking group, as described in greater detail below The amount of nucleic acid present in each composition will be sufficient to provide for adequate hybridization and detection of target nucleic acid sequences during the assay in which the array is employed. Generally, the amount of each nucleic acid member stably associated with the solid support of the array is at least about 0.001 ng, preferably at least about 0.02 ng and more preferably at least about 0.05 ng, where the amount may be as high as 1000 ng or higher, but will usually not exceed about 20 ng. Where the nucleic acid member is "spotted" onto the solid support in a spot comprising an overall circular dimension, the diameter of the "spot" will generally range from about 10 to 5,000 μm, usually from about 20 to 2,000 μm and more usually from about 100 to 200 μm.

Control nucleic acid members may be present on the array including nucleic acid members comprising oligonucleotides or nucleic acids corresponding to genomic DNA, housekeeping genes, vector sequences, plant nucleic acid sequence, negative and positive control genes, and the like. Control nucleic acid members are calibrating or control genes whose function is not to tell whether a particular "key" gene of interest is expressed, but rather to provide other useful information, such as background or basal level of expression.

Other control nucleic acids are spotted on the array and used as target expression control nucleic acids and mismatch control nucleotides to monitor non-specific binding or cross-hybridization to a nucleic acid in the sample other than the target to which the probe is directed. Mismatch probes thus indicate whether a hybridization is specific or not. For example, if the target is present, the perfectly matched probes should be consistently brighter than the mismatched probes. In addition, if all control mismatches are present, the mismatch probes are used to detect a mutation.

Solid Substrate

An array according to the invention comprises either a flexible or rigid substrate. A flexible substrate is capable of being bent, folded or similarly manipulated without breakage. Examples of solid materials which are flexible solid supports with respect to the present invention include membranes, e.g., nylon, flexible plastic films, and the like. By "rigid" is meant that the support is solid and does not readily bend, i.e., the support is not flexible. As such, the rigid substrates of the subject arrays are sufficient to provide physical support and structure to the associated nucleic acids present thereon under the assay conditions in which the array is employed, particularly under high throughput handling conditions.

The substrate may be biological, non-biological, organic, inorganic, or a combination of any of these, existing as particles, strands, precipitates, gels, sheets, tubing, spheres, beads, containers, capillaries, pads, slices, films, plates, slides, chips, etc. The substrate may have any convenient shape, such as a disc, square, sphere, circle, etc. The substrate is preferably flat or planar but may take on a variety of alternative surface configurations. The substrate may be a polymerized Langmuir Blodgett film, functionalized glass, Si, Ge, GaAs, GaP, $SiO_2$, $SIN_4$, modified silicon, or any one of a wide variety of gels or polymers such as (poly)tetrafluoroethylene, (poly)vinylidenedifluoride, polystyrene, polycarbonate, or combinations thereof. Other substrate materials will be readily apparent to those of skill in the art upon review of this disclosure.

In a preferred embodiment the substrate is flat glass or single-crystal silicon. According to some embodiments, the surface of the substrate is etched using well-known techniques to provide for desired surface features. For example, by way of formation of trenches, v-grooves, mesa structures, or the like, the synthesis regions may be more closely placed within the focus point of impinging light, be provided with reflective "mirror" structures for maximization of light collection from fluorescent sources, etc.

Surfaces on the solid substrate will usually, though not always, be composed of the same material as the substrate. Alternatively, the surface may be composed of any of a wide variety of materials, for example, polymers, plastics, resins, polysaccharides, silica or silica-based materials, carbon, metals, inorganic glasses, membranes, or any of the above-listed substrate materials. In some embodiments the surface may provide for the use of caged binding members which are attached firmly to the surface of the substrate. Preferably, the surface will contain reactive groups, which are carboxyl, amino, hydroxyl, or the like. Most preferably, the surface will be optically transparent and will have surface Si—OH functionalities, such as are found on silica surfaces.

The surface of the substrate is preferably provided with a layer of linker molecules, although it will be understood that the linker molecules are not required elements of the invention. The linker molecules are preferably of sufficient length to permit nucleic acids of the invention and on a substrate to hybridize to other nucleic acid molecules and to interact freely with molecules exposed to the substrate.

Often, the substrate is a silicon or glass surface, (poly) tetrafluoroethylene, (poly)vinylidendifluoride, polystyrene, polycarbonate, a charged membrane, such as nylon 66 or nitrocellulose, or combinations thereof. In a preferred embodiment, the solid support is glass. Preferably, at least one surface of the substrate will be substantially flat. Preferably, the surface of the solid support will contain reactive groups, including, but not limited to, carboxyl, amino, hydroxyl, thiol, or the like. In one embodiment, the surface is optically transparent. In a preferred embodiment, the substrate is a poly-lysine coated slide or Gamma amino propyl silane-coated Coming Microarray Technology-GAPS or CMT-GAP2 coated slides.

Any solid support to which a nucleic acid member may be attached may be used in the invention. Examples of suitable solid support materials include, but are not limited to, silicates such as glass and silica gel, cellulose and nitrocellulose papers, nylon, polystyrene, polymethacrylate, latex, rubber, and fluorocarbon resins such as TEFLON™.

The solid support material may be used in a wide variety of shapes including, but not limited to slides and beads. Slides provide several functional advantages and thus are a preferred form of solid support. Due to their flat surface, probe and hybridization reagents are minimized using glass slides. Slides also enable the targeted application of reagents, are easy to keep at a constant temperature, are easy to wash and facilitate the direct visualization of RNA and/or DNA immobilized on the solid support. Removal of RNA and/or DNA immobilized on the solid support is also facilitated using slides.

The particular material selected as the solid support is not essential to the invention, as long as it provides the described function. Normally, those who make or use the invention will select the best commercially available material based upon the economics of cost and availability, the expected application requirements of the final product, and the demands of the overall manufacturing process.

Spotting Method

In one aspect, The invention provides for arrays where each nucleic acid member comprising the array is spotted onto a solid support.

Preferably, spotting is carried out as follows. PCR products (~40 ul) of cDNA clones from osteoarthritis, fetal or normal cartilage cDNA libraries, in the same 96-well tubes used for amplification, are precipitated with 4 ul (1/10 volume) of 3M sodium acetate (pH 5.2) and 100 ul (2.5 volumes) of ethanol and stored overnight at −20° C. They are then centrifuged at 3,300 rpm at 4° C. for 1 hour. The obtained pellets are washed with 50 ul ice-cold 70% ethanol and centrifuged again for 30 minutes. The pellets are then air-dried and resuspended well in 20 ul 3×SSC or in 50% dimethylsulfoxide (DMSO) overnight. The samples are then spotted, either singly or in duplicate, onto polylysine-coated slides (Sigma Cat. No. P0425) using a robotic GMS 417 or 427 arrayer (Affymetrix, Calif.).

The boundaries of the spots on the microarray may be marked with a diamond scriber (as the spots become invisible after post-processing). The arrays are rehydrated by suspending the slides over a dish of warm particle free $ddH_2O$ for approximately one minute (the spots will swell slightly but will not run into each other) and snap-dried on a 70-80° C. inverted heating block for 3 seconds. Nucleic acid is then UV crosslinked to the slide (Stratagene, Stratalinker, 65 mJ—set display to "650" which is 650×100 uJ) or the array is baked at 80 C. for two to four hours prior to hybridization. The arrays are placed in a slide rack. An empty slide chamber is prepared and filled with the following solution: 3.0 grams of succinic anhydride (Aldrich) was dissolved in 189 ml of 1-methyl-2-pyrrolidinone (rapid addition of reagent is crucial); immediately after the last flake of succinic anhydride is dissolved, −21.0 ml of 0.2 M sodium borate is mixed in and the solution is poured into the slide chamber. The slide rack is plunged rapidly and evenly in the slide chamber and vigorously shaken up and down for a few seconds, making sure the slides never leave the solution, and then mixed on an orbital shaker for 15-20 minutes. The slide rack is then gently plunged in 95° C. $ddH_2O$ for 2 minutes, followed by plunging five times in 95% ethanol. The slides are then air dried by allowing excess ethanol to drip onto paper towels. The arrays are stored in the slide box at room temperature until use.

Numerous methods may be used for attachment of the nucleic acid members of the invention to the substrate (a process referred to as "spotting"). For example, nucleic acids are attached using the techniques of, for example U.S. Pat. No. 5,807,522, which is incorporated herein by reference, for teaching methods of polymer attachment.

Alternatively, spotting may be carried out using contact printing technology as is known in the art.

Kits

The invention provides for kits for performing expression assays using the arrays of the present invention. Such kits according to the subject invention will at least comprise the arrays of the invention having associated nucleic acid members and packaging means therefore. The kits may further comprise one or more additional reagents employed in the various methods, such as: 1) primers for generating test nucleic acids; 2) dNTPs and/or rNTPs (either premixed or separate), optionally with one or more uniquely labeled dNTPs and/or rNTPs (e.g., biotinylated or Cy3 or Cy5 tagged dNTPs); 3) post synthesis labeling reagents, such as chemically active derivatives of fluorescent dyes; 4) enzymes, such as reverse transcriptases, DNA polymerases, and the like; 5) various buffer mediums, e.g., hybridization and washing buffers; 6) labeled probe purification reagents and components, like spin columns, etc.; and 7) signal generation and detection reagents, e.g., streptavidin-alkaline phosphatase conjugate, chemifluorescent or chemiluminescent substrate, and the like.

Use of a Microarray

Nucleic acid arrays according to the invention can be used in high throughput techniques that can assay a large number of nucleic acids in a sample comprising one or more target nucleic acid sequences. The arrays of the subject invention find use in a variety of applications, including gene expression analysis, diagnosis of osteoarthritis and prognosis of osteoarthritis (e.g., monitoring a patient's response to therapy, drug screening, and the like).

In one aspect, the arrays of the invention are used in, among other applications, differential gene expression assays. For example, arrays are useful in the differential expression analysis of: (a) diseased osteoarthritis and normal tissue; (b) tissues representing different stages of osteoarthritis; (c) developing cartilage (e.g., fetal cartilage); (d) chondrocyte responses to external or internal stimuli; (e) cartilage/chondrocyte response to treatment; (f) cartilage tissue engineering; (g) pharmacogenomics; and the like. The arrays are also useful in broad scale expression screening for drug discovery and research, such as the effect of a particular active agent on the expression pattern of genes in a particular cell, where such information is used to reveal drug efficacy and toxicity, environmental monitoring, disease research and the like. For example, high expression of a particular nucleic acid sequence in an osteoarthritis sample (mild, moderate, marked, or severe), which is not observed in a corresponding normal cell, can indicate an osteoarthritis-specific gene product.

Target Preparation

The targets for the microarrays according to the invention are preferably derived from human cartilage, blood or synovial fluid.

A target nucleic acid is capable of binding to a nucleic acid probe or nucleic acid member of complementary sequence through one or more types of chemical bonds, usually through complementary base pairing, usually through hydrogen bond formation.

As used herein, a "nucleic acid derived from an mRNA transcript: or a "nucleic acid corresponding to an mRNA" refers to a nucleic acid for which synthesis of the mRNA transcript or a sub-sequence thereof has ultimately served as a template. Thus, a cDNA reverse transcribed from an mRNA, an RNA transcribed from that cDNA, a DNA amplified from the cDNA, an RNA transcribed from the amplified DNA, etc., are all derived from or correspond to the mRNA transcript and detection of such derived or corresponding products is indicative of or proportional to the presence and/or abundance of the original transcript in a sample. Thus, suitable target nucleic acid samples include, but are not limited to, mRNA transcripts of a gene or genes, cDNA reverse transcribed from the mRNA, cRNA transcribed from the cDNA, DNA amplified from a gene or genes, RNA transcribed from amplified DNA, and the like. The nucleic acid targets used herein are preferably derived from human cartilage, blood or synovial fluid. Preferably, the targets are nucleic acids derived from human cartilage, blood or synovial fluid extracts. Nucleic acids can be single- or double-stranded DNA, RNA, or DNA-RNA hybrids synthesized from human cartilage, blood or synovial fluid mRNA extracts using methods known in the art, for example, reverse transcription or PCR.

In the simplest embodiment, such a nucleic acid target comprises total mRNA or a nucleic acid sample corresponding to mRNA (e.g., cDNA) isolated from cartilage, blood, or synovial fluid samples. In another embodiment, total mRNA is isolated from a given sample using, for example, an acid guanidinium-phenol-chloroform extraction method and polyA+ mRNA is isolated by oligo dT column chromatography or by using (dT)n magnetic beads (see, e.g., Sambrook et al., *Molecular Cloning: A Laboratory Manual* (2nd ed.), Vols. 1-3, Cold Spring Harbor Laboratory, (1989), or Current Protocols in Molecular Biology, F. Ausubel et al., ed. Greene Publishing and Wiley-Interscience, New York (1987). In a preferred embodiment, total RNA is extracted using TRIzol® reagent (GIBCO/BRL, Invitrogen Life Technologies, Cat. No. 15596). Purity and integrity of RNA is assessed by absorbance at 260/280 nm and agarose gel electrophoresis followed by inspection under ultraviolet light.

In some embodiments, it is desirable to amplify the target nucleic acid sample prior to hybridization, for example, when synovial fluid is used. One of skill in the art will appreciate that whatever amplification method is used, if a quantitative result is desired, care must be taken to use a method that maintains or controls for the relative frequencies of the amplified nucleic acids. Methods of "quantitative" amplification are well known to those of skill in the art. For example, quantitative PCR involves simultaneously co-amplifying a known quantity of a control sequence using the same primers. This provides an internal standard that may be used to calibrate the PCR reaction. The high density array may then include probes specific to the internal standard for quantification of the amplified nucleic acid. Detailed protocols for quantitative PCR are provided in *PCR Protocols, A Guide to Methods and Applications,* Innis et al., Academic Press, Inc. N.Y., (1990).

Other suitable amplification methods include, but are not limited to polymerase chain reaction (PCR) (Innis, et al., *PCR Protocols. A Guide to Methods and Application.* Academic Press, Inc. San Diego, (1990)), ligase chain reaction (LCR) (see Wu and Wallace, 1989, *Genomics,* 4:560; Landegren, et al., 1988, *Science,* 241:1077 and Barringer, et al., 1990, *Gene,* 89:117, transcription amplification (Kwoh, et al., 1989, *Proc. Natl. Acad. Sci. USA,* 86: 1173), and self-sustained sequence replication (Guatelli, et al., 1990, *Proc. Nat. Acad. Sci. USA,* 87: 1874).

In a particularly preferred embodiment, the target nucleic acid sample mRNA is reverse transcribed with a reverse transcriptase and a primer consisting of oligo dT and a sequence encoding the phage T7 promoter to provide single-stranded DNA template. The second DNA strand is polymerized using a DNA polymerase. After synthesis of double-stranded cDNA, T7 RNA polymerase is added and RNA is transcribed from the cDNA template. Successive rounds of transcription from each single cDNA template results in amplified RNA. Methods of in vitro transcription are well known to those of skill in the art (see, e.g., Sambrook, supra.) and this particular method is described in detail by Van Gelder, et al., 1990, *Proc. Natl. Acad. Sci. USA,* 87: 1663-1667 who demonstrate that in vitro amplification according to this method preserves the relative frequencies of the various RNA transcripts. Moreover, Eberwine et al. *Proc. Natl. Acad. Sci. USA,* 89: 3010-3014 provide a protocol that uses two rounds of amplification via in vitro transcription to achieve greater than $10^6$ fold amplification of the original starting material thereby permitting expression monitoring even where biological samples are limited.

Labeling of Target or Nucleic Acid Probe

Either the target or the probe can be labeled.

Any analytically detectable marker that is attached to or incorporated into a molecule may be used in the invention. An analytically detectable marker refers to any molecule, moiety or atom which is analytically detected and quantified.

Detectable labels suitable for use in the present invention include any composition detectable by spectroscopic, photochemical, biochemical, immunochemical, electrical, optical or chemical means. Useful labels in the present invention include biotin for staining with labeled streptavidin conjugate, magnetic beads (e.g., Dynabeads™), fluorescent dyes (e.g., fluorescein, texas red, rhodamine, green fluorescent protein, and the like), radiolabels (e.g., $^3H$, $^{125}I$, 35S, $^{14}C$, or $^{32}P$) enzymes (e.g., horse radish peroxidase, alkaline phosphatase and others commonly used in an ELISA), and colorimetric labels such as colloidal gold or colored glass or plastic (e.g., polystyrene, polypropylene, latex, etc.) beads. Patents teaching the use of such labels include U.S. Pat. Nos. 3,817,837; 3,850,752; 3,939,350; 3,996,345; 4,277,437; 4,275,149; and 4,366,241, the entireties of which are incorporated by reference herein.

Means of detecting such labels are well known to those of skill in the art. Thus, for example, radiolabels may be detected using photographic film or scintillation counters, fluorescent markers may be detected using a photodetector to detect emitted light. Enzymatic labels are typically detected by providing the enzyme with a substrate and detecting the reaction product produced by the action of the enzyme on the substrate, and colorimetric labels are detected by simply visualizing the colored label.

The labels may be incorporated by any of a number of means well known to those of skill in the art. However, in a preferred embodiment, the label is simultaneously incorporated during the amplification step in the preparation of the sample nucleic acids. Thus, for example, polymerase chain reaction (PCR) with labeled primers or labeled nucleotides will provide a labeled amplification product. In a preferred embodiment, transcription amplification, as described above, using a labeled nucleotide (e.g. fluorescein-labeled UTP and/or CTP) incorporates a label into the transcribed nucleic acids.

Alternatively, a label may be added directly to the original nucleic acid sample (e.g., mRNA, polyA mRNA, cDNA, etc.) or to the amplification product after the amplification is completed. Means of attaching labels to nucleic acids are well known to those of skill in the art and include, for example, nick translation or end-labeling (e.g. with a labeled RNA) by kinasing of the nucleic acid and subsequent attachment (ligation) of a nucleic acid linker joining the sample nucleic acid to a label (e.g., a fluorophore).

In a preferred embodiment, the fluorescent modifications are by cyanine dyes e.g. Cy-3/Cy-5 dUTP, Cy-3/Cy-5 dCTP (Amersham Pharmacia) or alexa dyes (Khan, et al., 1998, *Cancer Res.* 58:5009-5013).

In a preferred embodiment, the two target samples used for comparison are labeled with different fluorescent dyes which produce distinguishable detection signals, for example, targets made from normal cartilage are labeled with Cy5 and targets made from mild osteoarthritis cartilage are labeled with Cy3. The differently labeled target samples are hybridized to the same microarray simultaneously. In a preferred embodiment, the labeled targets are purified using methods known in the art, e.g., by ethanol purification or column purification.

In a preferred embodiment, the target will include one or more control molecules which hybridize to control probes on the microarray to normalize signals generated from the microarray. Preferably, labeled normalization targets are nucleic acid sequences that are perfectly complementary to control oligonucleotides that are spotted onto the microarray as described above. The signals obtained from the normalization controls after hybridization provide a control for variations in hybridization conditions, label intensity, "reading" efficiency and other factors that may cause the signal of a perfect hybridization to vary between arrays. In a preferred embodiment, signals (e.g., fluorescence intensity) read from all other probes in the array are divided by the signal (e.g., fluorescence intensity) from the control probes, thereby normalizing the measurements.

Preferred normalization targets are selected to reflect the average length of the other targets present in the sample, however, they are selected to cover a range of lengths. The normalization control(s) also can be selected to reflect the (average) base composition of the other probes in the array, however, in a preferred embodiment, only one or a few normalization probes are used and they are selected such that they hybridize well (i.e., have no secondary structure and do not self hybridize) and do not match any target molecules.

Normalization probes are localized at any position in the array or at multiple positions throughout the array to control for spatial variation in hybridization efficiency. In a preferred embodiment, normalization controls are located at the corners or edges of the array as well as in the middle.

Hybridization Conditions

Nucleic acid hybridization involves providing a denatured probe or target nucleic acid member and target nucleic acid under conditions where the probe or target nucleic acid member and its complementary target can form stable hybrid duplexes through complementary base pairing. The nucleic acids that do not form hybrid duplexes are then washed away leaving the hybridized nucleic acids to be detected, typically through detection of an attached detectable label. It is generally recognized that nucleic acids are denatured by increasing the temperature or decreasing the salt concentration of the buffer containing the nucleic acids. Under low stringency conditions (e.g., low temperature and/or high salt) hybrid duplexes (e.g., DNA:DNA, RNA:RNA, or RNA:DNA) will form even where the annealed sequences are not perfectly complementary. Thus specificity of hybridization is reduced at lower stringency. Conversely, at higher stringency (e.g., higher temperature or lower salt) successful hybridization requires fewer mismatches.

The invention provides for hybridization conditions comprising the Dig hybridization mix (Boehringer); or formamide-based hybridization solutions, for example as described in Ausubel et al., supra and Sambrook et al. supra.

Methods of optimizing hybridization conditions are well known to those of skill in the art (see, e.g., *Laboratory Techniques in Biochemistry and Molecular Biology,* Vol. 24: *Hybridization With Nucleic acid Probes,* P. Tijssen, ed. Elsevier, N.Y., (1993)).

Following hybridization, non-hybridized labeled or unlabeled nucleic acid is removed from the support surface, conveniently by washing, thereby generating a pattern of hybridized target nucleic acid on the substrate surface. A variety of wash solutions are known to those of skill in the art and may be used. The resultant hybridization patterns of labeled, hybridized oligonucleotides and/or nucleic acids may be visualized or detected in a variety of ways, with the particular manner of detection being chosen based on the particular label of the test nucleic acid, where representative detection means include scintillation counting, autoradiography, fluorescence measurement, calorimetric measurement, light emission measurement and the like.

Image Acquisition and Data Analysis

Following hybridization and any washing step(s) and/or subsequent treatments, as described above, the resultant hybridization pattern is detected. In detecting or visualizing the hybridization pattern, the intensity or signal value of the label will be not only be detected but quantified, by which is meant that the signal from each spot of the hybridization will be measured and compared to a unit value corresponding to the signal emitted by a known number of end labeled target nucleic acids to obtain a count or absolute value of the copy number of each end-labeled target that is hybridized to a particular spot on the array in the hybridization pattern.

Methods for analyzing the data collected from hybridization to arrays are well known in the art. For example, where detection of hybridization involves a fluorescent label, data analysis can include the steps of determining fluorescent intensity as a function of substrate position from the data collected, removing outliers, i.e., data deviating from a predetermined statistical distribution, and calculating the relative binding affinity of the test nucleic acids from the remaining data. The resulting data is displayed as an image with the intensity in each region varying according to the binding affinity between associated oligonucleotides and/or nucleic acids and the test nucleic acids.

The following detection protocol is used for the simultaneous analysis of two cartilage samples to be compared, where each sample is labeled with a different fluorescent dye.

Each element of the microarray is scanned for the first fluorescent color. The intensity of the fluorescence at each array element is proportional to the expression level of that gene in the sample.

The scanning operation is repeated for the second fluorescent label. The ratio of the two fluorescent intensities provides a highly accurate and quantitative measurement of the relative gene expression level in the two tissue samples.

In a preferred embodiment, fluorescence intensities of immobilized target nucleic acid sequences were determined from images taken with a custom confocal microscope equipped with laser excitation sources and interference filters appropriate for the Cy3 and Cy5 fluors. Separate scans were taken for each fluor at a resolution of 225 $\mu m^2$ per pixel and 65,536 gray levels. Image segmentation to identify areas of hybridization, normalization of the intensities between the two fluor images, and calculation of the normalized mean fluorescent values at each target are as described (Khan, et al., 1998, *Cancer Res.* 58:5009-5013. Chen, et al., 1997, *Biomed. Optics* 2:364-374). Normalization between the images is used to adjust for the different efficiencies in labeling and detection with the two different fluors. This is achieved by equilibrating to a value of one the signal intensity ratio of a set of internal control genes spotted on the array.

In another preferred embodiment, the array is scanned in the Cy 3 and Cy5 channels and stored as separate 16-bit TIFF images. The images are incorporated and analysed using software which includes a gridding process to capture the hybridization intensity data from each spot on the array. The fluorescence intensity and background-subtracted hybridization intensity of each spot is collected and a ratio of measured mean intensities of Cy5 to Cy3 is calculated. A liner regression approach is used for normalization and assumes that a scatter plot of the measured Cy5 versus Cy3 intensities should have a scope of one. The average of the ratios is calculated and used to rescale the data and adjust the slope to one. A post-normalization cutoff of greater than 1.0 fold up- or down-regulation is used to identify differentially expressed genes.

Following detection or visualization, the hybridization pattern is used to determine quantitative information about the genetic profile of the labeled target nucleic acid sample that was contacted with the array to generate the hybridization pattern, as well as the physiological source from which the labeled target nucleic acid sample was derived. By "genetic profile" is meant information regarding the types of nucleic acids present in the sample, e.g., such as the types of genes to which they are complementary, and/or the copy number of each particular nucleic acid in the sample. From this data, one can also derive information about the physiological source from which the target nucleic acid sample was derived, such as the types of genes expressed in the tissue or cell which is the physiological source of the target, as well as the levels of expression of each gene, particularly in quantitative terms.

Where one uses the subject methods to compare target nucleic acids from two or more physiological sources, the hybridization patterns may be compared to identify differences between the patterns. Where arrays in which each of the different nucleic acid members corresponds to a known gene are employed, any discrepancies are related to a differential expression of a particular gene in the physiological sources being compared. Thus, the subject methods find use in differential gene expression assays, where one may use the subject methods in the differential expression analysis of: (a) diseased vs. normal tissue, e.g., osteoarthritic and normal tissue, (b) tissue derived from different stages of osteoarthritis; and the like.

In a particularly preferred embodiment, where it is desired to quantify the transcription level (and thereby expression) of one or more nucleic acid sequences in a sample, the target nucleic acid sample is one in which the concentration of the mRNA transcript(s) of the gene or genes, or the concentration of the nucleic acids derived from the mRNA transcript(s), is proportional to the transcription level (and therefore expression level) of that gene. Similarly, it is preferred that the hybridization signal intensity be proportional to the amount of hybridized nucleic acid. While it is preferred that the proportionality be relatively strict (e.g., a doubling in transcription rate results in a doubling in mRNA transcript in the sample nucleic acid pool and a doubling in hybridization signal), one of skill will appreciate that the proportionality can be more relaxed and even non-linear and still provide meaningful results. Thus, for example, an assay where a 5 fold difference in concentration of the target mRNA results in a 3- to 6-fold difference in hybridization intensity is sufficient for most purposes. Where more precise quantification is required, appropriate controls are run to correct for variations introduced in sample preparation and hybridization as described herein. In addition, serial dilutions of "standard" target mRNAs are used to prepare calibration curves according to methods well known to those of skill in the art. Of course, where simple detection of the presence or absence of a transcript is desired, no elaborate control or calibration is required.

For example, if a microarray nucleic acid member is not labeled after hybridization, this indicates that the gene comprising that nucleic acid member is not expressed in either sample. If a nucleic acid member is labeled with a single color, it indicates that a labeled gene was expressed only in one sample. The labeling of a nucleic acid member comprising an array with both colors indicates that the gene was expressed in both samples. Even genes expressed once per cell are detected (1 part in 100,000 sensitivity). A difference in expression intensity in the two samples being compared is indicative of differential expression, the ratio of the intensity in the two samples being not equal to 1.0, preferably less than 0.7 or greater than 1.2, more preferably less than 0.5 or greater than 1.5.

Many human genes are expressed at different levels in cartilage of different developmental (fetal vs. mature) or disease states. In some cases, a gene is not expressed at all in some developmental or disease states, and at high levels in others. Differential analysis of chondrocyte gene expression in differing cartilage states using an EST-based approach is used to identify genes that may play important roles in osteoarthritis pathogenesis and cartilage repair. The advantage of this method is that it can provide gene expression information on a larger scale than other methods. The cDNA clones generated by this approach is useful for future functional studies of certain genes. This type of genomic-based approach can provide important novel insights into our understanding of the osteoarthritis disease process and provide for novel diagnostic, prognostic and therapeutic approaches.

Diagnostic or Prognostic Tests

The invention also provides for diagnostic tests for detecting osteoarthritis. The invention also provides for prognostic tests for monitoring a patient's response to therapy.

According to the method of the invention, mild, moderate, marked or severe osteoarthritis is detected by obtaining a cartilage sample from a patient. In alternative embodiments, a blood or synovial fluid sample is obtained from a patient. A sample comprising nucleic acid corresponding to RNA (i.e., RNA or cDNA) is prepared from the patient cartilage (or blood or synovial fluid) sample. The sample comprising nucleic acid corresponding to RNA is hybridized to an array comprising a solid substrate and a plurality of nucleic acid members, where at least one member is differentially expressed in cartilage isolated from a patient diagnosed with mild, moderate, marked or severe osteoarthritis, as compared to a "normal individual", according to the invention. According to this diagnostic test, hybridization of the sample comprising nucleic acid corresponding to RNA to one or more nucleic acid members on the array is indicative of disease.

A patient response to therapy is monitored by using a prognostic test according to the invention. In one aspect, a prognostic test according to the invention comprises obtaining a cartilage sample from a patient prior to treatment, during the course of treatment and after treatment. Preferably, the patient is treated for at least 12 hours before a sample is taken. In alternative embodiments, blood or synovial fluid samples are obtained from a patient prior to treatment, during the course of treatment and after treatment. A sample comprising nucleic acid corresponding to RNA (i.e., RNA or cDNA) is prepared from the patient cartilage (or blood or synovial fluid) samples. The samples comprising nucleic acid corresponding to RNA are hybridized to an array comprising a solid substrate and a plurality of nucleic acid members, where at least one member is differentially expressed in cartilage isolated from a patient diagnosed with mild, moderate, marked or severe osteoarthritis, as compared to a normal individual, according to the invention. Arrays are selected in accordance with the diagnostic state of the patient whose treatment is being monitored. According to this prognostic test, differential hybridization of the samples comprising nucleic acid corresponding to RNA isolated prior to and after treatment to one or more nucleic acid members on the array is indicative of an effective treatment. Preferably, gene expression profiles in patients being treated changes to resemble more closely gene expression profiles in patients with less severe forms of the disease or more preferably more closely resembles gene expression profiles in normal patients. The extent of change in a gene expression profile can be further correlated with various therapeutic endpoints such as a decrease in the severity and/or occurrence of one or more symptoms associated with the disease.

Therapeutic Agents

A useful therapeutic agent according to the invention can increase or decrease the anabolic and/or the catabolic activity of a chondrocyte. Preferably, a therapeutic agent can increase or decrease the anabolic and/or catabolic activity of a chondrocyte by greater than 1.0-fold, more preferably, 1.5-5-fold, and most preferably, 5-100-fold, as compared to an untreated chondrocyte.

In one embodiment, a therapeutic agent changes (e.g., increases or decreases) the level of expression of at least one nucleic acid sequence that is differentially expressed in a chondrocyte derived from any of the following chondrocyte disease or developmental stages: fetal, normal, mild osteoarthritic, moderate osteoarthritic, marked osteoarthritic and severe osteoarthritic. Preferably, a therapeutic agent causes a change in the level of expression of a nucleic acid sequence or increase or decrease in the expression of a nucleic acid sequence that is differentially expressed in a chondrocyte derived from any of the following chondrocyte disease or developmental stages: fetal, normal, mild osteoarthritic, moderate osteoarthritic, marked osteoarthritic and severe osteoarthritic, where the change is greater than 1.0-fold, more preferably 1.5-5-fold, and most preferably 5-100-fold, more or less than the level of expression in the absence of a candidate therapeutic agent.

In another embodiment, a therapeutic agent according to the invention can ameliorate at least one of the symptoms and/or changes associated with osteoarthritis including cartilage degeneration, or pain, swelling, weakness and/or loss of functional ability in the afflicted joints, associated with cartilage degeneration.

The candidate therapeutic agent may be a synthetic compound, or a mixture of compounds, or may be a natural product (e.g. a plant extract or culture supernatant).

Candidate therapeutic agents or compounds from large libraries of synthetic or natural compounds can be screened. Numerous means are currently used for random and directed synthesis of saccharide, peptide, and nucleic acid-based compounds. Synthetic compound libraries are commercially available from a number of companies including Maybridge Chemical Co. (Trevillet, Cornwall, UK), Comgenex (Princeton, N.J.), Brandon Associates (Merrimack, N.H.), and Microsource (New Milford, Conn.). A rare chemical library is available from Aldrich (Milwaukee, Wis.). Combinatorial libraries are available and are prepared. Alternatively, libraries of natural compounds in the form of bacterial, fungal, plant and animal extracts are available from e.g., Pan Laboratories (Bothell, Wash.) or MycoSearch (NC), or are readily produceable by methods well known in the art. Additionally, natural and synthetically produced libraries and compounds are readily modified through conventional chemical, physical, and biochemical means.

Useful compounds may be found within numerous chemical classes. Useful compounds may be organic compounds, or small organic compounds. Small organic compounds have a molecular weight of more than 50 yet less than about 2,500 daltons, preferably less than about 750, more preferably less than about 350 daltons. Exemplary classes include heterocycles, peptides, saccharides, steroids, and the like. The compounds may be modified to enhance efficacy, stability, pharmaceutical compatibility, and the like. Structural identification of an agent may be used to identify, generate, or screen additional agents. For example, where peptide agents are identified, they may be modified in a variety of ways to enhance their stability, such as using an unnatural amino acid, such as a D-amino acid, particularly D-alanine, by functionalizing the amino or carboxylic terminus, e.g. for the amino group, acylation or alkylation, and for the carboxyl group, esterification or amidification, or the like.

A therapeutic agent, according to the invention, can be a gene corresponding to an EST sequence identified from any of the cDNA libraries constructed from cartilage of different development and disease stages.

Each cDNA library revealed a number of EST sequences specific to the particular stage. The ESTs are first characterized according to their putative function (Tables 2-6) and their expression is confirmed by using microarrays, as described herein. Since osteoarthritis is a chronic disease caused by an imbalance between catabolic activity and anabolic activity, that is, an increase in catabolic activity and/or a decrease in anabolic activity, normal- or fetal-specific ESTs may be important in maintaining the normal metabolic function of cartilage so as to maintain a balance between the catabolic activity and the anabolic activity. Therefore, an increased expression of a full length gene sequence corresponding to one or more of these ESTs may restore the anabolic activity in disease cartilage. Therapy involving altered gene expression (e.g., gene therapy, gene disruption, antisense therapy, and the like) is useful according to the invention.

A full-length gene sequence corresponding to one of the normal- or fetal-specific genes is cloned by methods known in the art (e.g., Ausubel et al., John Weley & Sons, Inc., 1997, *Current Protocols in Molecular Biology*). A cloned sequence is transfected into disease chondrocytes isolated from any stage of osteoarthritis (e.g., mild, moderate, marked, and severe). The ability of normal- or fetal-specific genes to complement the anabolic defect in the disease chondrocytes is accessed.

In one embodiment, this is achieved by examining the expression profile of disease chondrocytes transfected with a normal- or fetal-specific gene. A normal- or fetal-specific gene which is capable of restoring the expression profile of disease chondrocytes to more closely resemble that of normal or fetal chondrocytes is a useful candidate for treatment of osteoarthritis.

In another embodiment, the anabolic activity of disease chondrocytes transfected with a normal- or fetal-specific gene is measured as described by Westacott et al. (1996, *Semin Arthritis Rheum,* 25:254-72). A normal- or fetal-specific gene which increases the anabolic activity is useful for treatment of osteoarthritis.

Once a therapeutic gene is defined, the gene sequence is subcloned into a vector suitable for the purpose of gene therapy. Murine leukemia virus (MLV)-based retroviral vectors are one of the most widely used gene delivery vehicles in gene therapy clinical trials and have been employed in almost 70% of approved protocols (Ali, M. et al., 1994, *Gene Ther.,* 1:367-384; Marshall, 1995, *Science,* 269:1050-1055, 1995). Other useful vectors are also known in the art (e.g., Carter and Samulski, 2000, *Int. J. Mol. Med.* 6:17-27; Lever et al., 1999, *Biochem. Soc. Trans.* 27: 841-7). Methods for gene therapy of human diseases are described in U.S. Pat. Nos. 6,190,907; 6,187,305; 6,140,087; and 6,129,705, for example, the entireties of which are incorporated by reference herein.

Dosage and Administration

Therapeutic agents of the invention are administered to a patient, preferably in a biologically compatible solution or a pharmaceutically acceptable delivery vehicle, by ingestion, injection, inhalation or any number of other methods routine in the art. The dosages administered will vary from patient to patient. A "therapeutically effective dose" is determined, for example, by the level of enhancement of function (e.g., increased or decreased chondrocyte anabolic activity, or an increase or decrease in the expression of at least one nucleic acid sequence that is differentially expressed in a chondrocyte derived from any of the following chondrocyte disease or developmental stages: fetal, normal, mild osteoarthritic, moderate osteoarthritic, marked osteoarthritic or severe osteoarthritic).

A therapeutic agent according to the invention is administered in a single dose. This dosage may be repeated daily, weekly, monthly, yearly, or as considered appropriate by the treating physician.

Pharmaceutical Compositions

The invention provides for compositions comprising a therapeutic agent according to the invention admixed with a physiologically compatible carrier. As used herein, "physiologically compatible carrier" refers to a physiologically acceptable diluent such as water, phosphate buffered saline, or saline, and further may include an adjuvant. Adjuvants such as incomplete Freund's adjuvant, aluminum phosphate, aluminum hydroxide, or alum are materials well known in the art.

The invention also provides for pharmaceutical compositions. In addition to the active ingredients, these pharmaceutical compositions may contain suitable pharmaceutically acceptable carrier preparations which is used pharmaceutically.

Pharmaceutical compositions for oral administration are formulated using pharmaceutically acceptable carriers well known in the art in dosages suitable for oral administration. Such carriers enable the pharmaceutical compositions to be formulated as tablets, pills, dragees, capsules, liquids, gels, syrups, slurries, suspensions and the like, for ingestion by the patient.

Pharmaceutical preparations for oral use are obtained through a combination of active compounds with solid excipient, optionally grinding a resulting mixture, and processing the mixture of granules, after adding suitable auxiliaries, if desired, to obtain tablets or dragee cores. Suitable excipients are carbohydrate or protein fillers such as sugars, including lactose, sucrose, mannitol, or sorbitol; starch from corn, wheat, rice, potato, or other plants; cellulose such as methyl cellulose, hydroxypropylmethyl-cellulose, or sodium carboxymethyl cellulose; and gums including arabic and tragacanth; and proteins such as gelatin and collagen. If desired, disintegrating or solubilizing agents may be added, such as the cross-linked polyvinyl pyrrolidone, agar, alginic acid, or a salt thereof, such as sodium alginate.

Dragee cores are provided with suitable coatings such as concentrated sugar solutions, which may also contain gum arabic, talc, polyvinylpyrrolidone, carbopol gel, polyethylene glycol, and/or titanium dioxide, lacquer solutions, and suitable organic solvents or solvent mixtures. Dyestuffs or pigments may be added to the tablets or dragee coatings for product identification or to characterize the quantity of active compound, i.e., dosage.

Pharmaceutical preparations which are used orally include push-fit capsules made of gelatin, as well as soft, sealed capsules made of gelatin and a coating such as glycerol or sorbitol. Push-fit capsules can contain active ingredients mixed with a filler or binders such as lactose or starches, lubricants such as talc or magnesium stearate, and, optionally, stabilizers. In soft capsules, the active compounds may be dissolved or suspended in suitable liquids, such as fatty oils, liquid paraffin, or liquid polyethylene glycol with or without stabilizers.

Pharmaceutical formulations for parenteral administration include aqueous solutions of active compounds. For injection, the pharmaceutical compositions of the invention may be formulated in aqueous solutions, preferably in physiologically compatible buffers such as Hank's solution, Ringer' solution, or physiologically buffered saline. Aqueous injection suspensions may contain substances which increase the viscosity of the suspension, such as sodium carboxymethyl cellulose, sorbitol, or dextran. Additionally, suspensions of the active solvents or vehicles include fatty oils such as sesame oil, or synthetic fatty acid esters, such as ethyl oleate or triglycerides, or liposomes. Optionally, the suspension may also contain suitable stabilizers or agents which increase the solubility of the compounds to allow for the preparation of highly concentrated solutions.

For nasal administration, penetrants appropriate to the particular barrier to be permeated are used in the formulation. Such penetrants are generally known in the art.

The pharmaceutical compositions of the present invention may be manufactured in a manner known in the art, e.g. by means of conventional mixing, dissolving, granulating, dragee-making, levitating, emulsifying, encapsulating, entrapping or lyophilizing processes.

The pharmaceutical composition may be provided as a salt and are formed with many acids, including but not limited to hydrochloric, sulfuric, acetic, lactic, tartaric, malic, succinic, etc. Salts tend to be more soluble in aqueous or other protonic solvents that are the corresponding free base forms. In other cases, the preferred preparation may be a lyophilized powder in 1 mM-50 mM histidine, 0.1%-2% sucrose, 2%-7% mannitol at a pH range of 4.5 to 5.5 that is combined with buffer prior to use.

After pharmaceutical compositions comprising a therapeutic agent of the invention formulated in a acceptable carrier have been prepared, they are placed in an appropriate container and labeled for treatment of an indicated condition with information including amount, frequency and method of administration.

Efficacy of Osteoarthritis Therapy Using Defined Therapeutic Agents

The efficacy of the therapy using any of the therapeutic agents according to the invention is determined by a medical practitioner. This determination may be related to alleviating osteoarthritis symptoms such as pain, swelling, weakness and loss of functional ability in the afflicted joint(s), and/or criteria for osteoarthritis diagnosis and staging described in Marshall (1996, supra).

The above disclosure generally describes the present invention. A more complete understanding can be obtained by reference to the following specific examples, which are provided herein for purposes of illustration only and are not intended to limit the scope of the invention.

EXAMPLES

The examples below are non-limiting and are merely representative of various aspects and features of the present invention

Example 1

RNA Extraction and Fetal cDNA Library Construction

A cDNA library was prepared from fetal cartilage. ESTs were obtained from the cDNA library and evaluated to create one or more gene expression profiles for fetal chondrocytes.

Human fetal femoral cartilage RNA was extracted from pooled specimens of aborted fetuses (8-12 weeks). Samples were finely powdered under liquid nitrogen, and total RNA was extracted using TRIzol® reagent (GIBCO/BRL). Purity and integrity of RNA was assessed by absorbance at 260/280 nm and agarose gel electrophoresis. The poly $(A)^+$ RNA fraction was isolated by oligo-dT cellulose chromatography (Pharmacia), and 3-5 ug poly $(A)^+$ RNA was used to construct a cDNA library in the λ ZAP Express vector (Stratagene). First-strand cDNA was synthesized with an Xho I-oligo (dT) adapter-primer in the presence of 5'-methyl dCTP. After second-strand synthesis and ligation of EcoRI adapters, the cDNA was digested with Xho I, resulting in cDNA flanked by EcoRI sites at the 5'-ends and Xho I sites at the 3'-ends.

Digested cDNAs were size-fractionated in Sephacryl S-500 spin columns (Stratagene), then ligated into the λ ZAP Express vector predigested with EcoRI and Xho I. The resulting DNA/cDNA concatomers were packaged using Gigapack Gold packaging extracts. After titration, aliquots of primary packaging mix were stored in 7% DMSO at −80° C. as primary library stocks, and the rest were amplified to establish stable library stocks.

Large-scale Sequencing of cDNA Inserts

From the amplified λZAP Express library, phage plaques were plated at a density of 200-500 pfu/150 mm plate onto *Escherichia coli* XL1-blue MRF' lawn with IPTG/X-gal for color selection. Plaques were picked into 75 ul suspension media buffer (100 mM NaCl, 10 mM $MgSO_4$, 1 mM Tris, pH7.5, 0.02% gelatin). Phage elutes (5 ul) were used for PCR reactions (50 ul total volume) with 125 umol/L of each dNTP (Pharmacia), 10 pmol each of modified T3 (5'-GCCAAGCTCGAAATTAACCCTCACTAAAG GG-3') (SEQ ID NO: 58993) and T7 (5'-CCAGTGAATTGTAATACGACTCACTATAGGGCG-3') (SEQ ID NO: 58994) primers, and 2 U of Taq DNA polymerase (Pharmacia). Reactions were cycled in a DNA Thermal Cycler (Perkin-Elmer) [denaturation at 95° C. for 5 minutes, followed by 30 cycles of amplification (94° C., 45 seconds; 55C, 30 seconds; 72° C., 3 minutes) and a terminal isothermal extension (72° C., 3 minutes)]. Agarose gel electrophoresis was used to assess the presence and purity of inserts. PCR products are subjected to DNA sequencing reactions using specific primers, BigDye™ Terminator Cycle Sequencing v2.0 Ready Reaction (PE Biosystems), Tris MgCl buffer and water in a thermocycler. Sequencing reactions were incubated at 94° C. for 2 minutes, followed by 25 cycles of 94° C., 30 seconds; 55° C., 20 seconds; and 72° C., 1 minute; and 15 cycles of 94° C., 30 seconds; and 72° C. for 1 minute; and 72° C. for 5 minutes. Reactions were then put on hold at 4° C. until purified through methods well known in the prior art (i.e. column purification or alcohol precipitation). Automated sequencing was carried out with a PE Biosystems ABI Prism 3700 DNA Analyzer.

Sequences were manually edited or edited using Sequencher software (GeneCodes). All edited EST sequences were compared to the non-redundant Genbank/EMBL/DDBJ and a dbEST databases using the BLAST algorithm (8). A minimum value of $P=10^{-10}$ and nucleotide sequence identity >95% were required for assignments of putative identities for ESTs matching to known genes or to other ESTs. Construction of a non-redundant list of genes represented in the EST set was done with the help of Unigene, Entrez and PubMed at the National Center for Biotechnology Information (NCBI) site (http://www.ncbi.nlm.nih.gov/). Relative gene expression frequency was calculated by dividing the number of EST copies for each gene by the total number of ESTs analyzed. Functional characterization of ESTs with known gene matches was made according to the categories described by Hwang et al., "A Genome-Based Resource for Molecular Cardiovascular Medicine: Toward a Compendium of Cardiovascular Genes." *Circulation* 1997; 96:4146-203).

A total of 13,398 ESTs were obtained from the human fetal cartilage cDNA library. Of these, 5,747 ESTs (41.8%) matched to known gene sequences, 1,855 ESTs (13.4%) matched to other ESTs, and 3,053 (22.0%) matched to mitochondrial, ribosomal, vector and cDNA/hypothetical protein sequences. The 209 ESTs (4.7%) that did not match to any known sequences were designated as novel. The remainder matched to genomic DNA sequences (1,948 ESTs, 13.8%) and repetitive sequences (586 ESTs, 4.3%).

The 13,398 EST sequences in the fetal library were characterized based on the functional classification of the 2,579 unique known genes they represented. The following table sets out the results of this analysis.

TABLE 2

Fetal Cartilage Library

| Putative Function | Percent (%) of Representation in the Library | Number of genes |
|---|---|---|
| Cell division | 7.06 | 182 |
| Cell signaling/communication | 15.01 | 387 |
| Cell structure/motility | 10.90 | 281 |
| Cell/organism defense | 7.60 | 196 |
| Gene/protein expression | 22.22 | 573 |
| Metabolism | 14.89 | 384 |
| Unclassified | 22.33 | 576 |
| Total known/unique genes analyzed | 100.00 | 2,579 |

Example 2

RNA Extraction and Normal Adult cDNA Library Construction

A cDNA library was prepared from normal adult cartilage. ESTs were obtained from the cDNA library and characterized to create one or more gene expression profiles for normal adult chondrocytes.

Large-scale Sequencing of cDNA Inserts cDNA libraries were constructed into λTripleEx2 vector through a PCR-based method, using SMART (Switching Mechanism At 5' end of RNA Transcript) cDNA Library Construction Kit (Clontech). Phage plaques were randomly picked and positive inserts were identified by PCR. Agarose gel electrophoresis was used to assess the presence and purity of inserts. PCR product was then subjected to automated DNA sequencing with a 5' vector-specific forward primer and sequenced by ABI PRISM 377 DNA sequencer (Perkin Elmer) and ABI PRISM 3700 DNA Analyzer (Applied Biosystems). All generated EST sequences were searched against the nonredundant Genebank/EMBL/DDBL, dbEST and GSS databases. A minimum value of $p=10^{-10}$ and nucleotide sequence identity >90% were required for assignments of putative identities for EST-matching to known genes or other ESTs. Relative EST frequency level was calculated by dividing the EST number matched to that gene into the total number of ESTs obtained from the library.

Sequences were manually edited or edited using Sequencher software (GeneCodes). All edited EST sequences were compared to the non-redundant Genbank/EMBL/DDBJ and dbEST databases using the BLAST algorithm (8). A minimum value of $P=10^{-10}$ and nucleotide sequence identity >95% were required for assignments of putative identities for ESTs matching to known genes or to other ESTs. Construction of a non-redundant list of genes represented in the EST set was done with the help of Unigene, Entrez and PubMed at the National Center for Biotechnology Information (NCBI) site (http://www.ncbi.nlm.nih.gov/). Relative gene expression frequency was calculated by dividing the number of EST copies for each gene by the total number of ESTs analyzed. Functional characterization of ESTs with known gene matches was made according to the categories described by Hwang et al (Hwang D M, Dempsey A A, Wang R X, Rezvani M, Barrans J D, Dai K S, et al. A Genome-Based Resource for Molecular Cardiovascular Medicine: Toward a Compendium of Cardiovascular Genes. Circulation 1997; 96:4146-203).

A total of 17,151 ESTs were obtained from the normal cartilage cDNA library. Of these, 6,755 ESTs (44.2%) matched to 2,518 known genes. 1.4% (132 ESTs) showed no significant match and were thus designated as novel. Characterization of the 17,151 EST sequences based on functional classification of known/unique genes resulted in the following table:

TABLE 3

Normal Adult Cartilage Library

| Putative function | Percent (%) of representation in the library | Number of genes |
|---|---|---|
| Cell division | 6.13 | 160 |
| Cell signaling/communication | 13.52 | 353 |
| Cell structure/motility | 9.00 | 235 |
| Cell/organism defense | 7.51 | 196 |
| Gene/protein expression | 20.08 | 524 |
| Metabolism | 13.14 | 343 |
| Unclassified | 27.09 | 707 |
| Total known/unique genes analyzed | 100.00 | 2518 |

Example 3

RNA Extraction and cDNA Library Construction from Mild Osteoarthritic Chondrocytes and Severe Osteoarthritic Chondrocytes A cDNA library was prepared from mild osteoarthritic cartilage and severe osteoarthritic cartilage. ESTs were obtained from the cDNA libraries and characterized to create one or more gene expression profiles for mild osteoarthritic chondrocytes and severe osteoarthritic chondrocytes.

Articular cartilage was obtained during either arthroscopic knee surgery or total knee replacement. The cartilage samples were obtained from either areas of very early cartilage degeneration (mild) or from sites of end stage disease (severe). cDNA libraries were constructed as described for normal adult samples (Example 2).

Large-Scale Sequencing of cDNA Inserts cDNA libraries were constructed into λTripleEx2 vector through a PCR-based method, using SMART (Switching Mechanism At 5' end of RNA Transcript) cDNA Library Construction Kit (Clontech). Phage plaques were randomly picked and positive inserts were identified by PCR. Agarose gel electrophoresis was used to assess the presence and purity of inserts. PCR product was then subjected to automated DNA sequencing with a 5' vector-specific forward primer and sequenced by ABI PRISM 377 DNA sequencer (Perkin Elmer) and ABI PRISM 3700 DNA Analyzer (Applied Biosystems). All generated EST sequences were searched against the nonredundant Genebank/EMBL/DDBL, dbEST and GSS databases. A minimum value of $p=10^{-10}$ and nucleotide sequence identity >90% were required for assignments of putative identities for EST-matching to known genes or other ESTs. Relative EST frequency level was calculated by dividing the EST number matched to that gene into the total number of ESTs obtained from the library.

Sequences were manually edited or edited using Sequencher software (GeneCodes). All edited EST sequences were compared to the non-redundant Genbank/EMBL/DDBJ and dbEST databases using the BLAST algorithm (8). A minimum value of $P=10^{-10}$ and nucleotide sequence identity >95% were required for assignments of putative identities for ESTs matching to known genes or to other ESTs.

Construction of a non-redundant list of genes represented in the EST set was done with the help of Unigene, Entrez and PubMed at the National Center for Biotechnology Information (NCBI) site (http://www.ncbi.nlm.nih.gov/). Relative gene expression frequency was calculated by dividing the number of EST copies for each gene by the total number of ESTs analyzed.

Functional characterization of ESTs with known gene matches was made according to the categories described by Hwang et al (Hwang D M, Dempsey A A, Wang R X, Rezvani M, Barrans J D, Dai K S, et al. A Genome-Based Resource for Molecular Cardiovascular Medicine: Toward a Compendium of Cardiovascular Genes. Circulation 1997;96:4146-203).

A total of 12,651 ESTs and 14,222 ESTs were obtained from the mild and severe OA cDNA libraries (Table 5 and Table 6), respectively. About 43% of mild and 51% of severe OA ESTs matched to known genes in the database. Approximately 2.6% and 1.5% of the ESTs, respectively, resulted in no significant match and were thus designated as novel.

Characterization of the 12,651 EST sequences from the mild OA library and of the 14,222 EST sequences from the severe OA library based on functional characterization of the known genes represented resulted in the following tables:

TABLE 4

Mild OA Cartilage Library

| Putative Function | Percent (%) of Representation in the Library | Number of Genes |
|---|---|---|
| Cell division | 6.39 | 127 |
| Cell signaling/communication | 15.31 | 304 |
| Cell structure/motility | 9.16 | 182 |
| Cell/organism defense | 8.41 | 167 |
| Gene/protein expression | 21.60 | 429 |
| Metabolism | 13.95 | 277 |
| Unclassified | 22.76 | 452 |
| Total known/unique genes analyzed | 100.00 | 1938 |

TABLE 5

Severe OA Cartilage Library

| Putative Function | Percent (%) of Representation in the Library | Number of genes |
|---|---|---|
| Cell division | 6.81 | 157 |
| Cell signaling/communication | 14.14 | 326 |
| Cell structure/motility | 8.50 | 196 |
| Cell/organism defense | 7.98 | 184 |
| Gene/protein expression | 22.94 | 529 |
| Metabolism | 13.53 | 312 |
| Unclassified | 23.94 | 552 |
| Total known/unique genes analyzed | 100.00 | 2256 |

Example 4

Identification of Differentially Expressed Genes in Fetal, Normal Mild Osteoarthritic, and Severe Osteoarthritic Cartilage Genes that are differentially expressed as defined herein between normal, mild, severe and fetal cartilage were identified through relative EST frequency analysis (see FIG. 6). Of the 5,807 known unique genes identified in FIG. 6, 405 genes were found to be expressed in all four tissue types. Examples of possible subanalysis are shown in FIGS. 14 and 15. Some of these genes with particularly marked differential expression are shown in FIG. 4. The relative frequency of ESTs representing collagens (FIGS. 2 and 3) and selected extracellular matrix proteins (see FIG. 1) were also analyzed.

Example 5

Microarray Construction

A microarray according to the invention was constructed as follows.

PCR products (~40 ul) of cDNA clones from OA cartilage cDNA libraries, in the same 96-well tubes used for amplification, are precipitated with 4 ul (1/10 volume) of 3M sodium acetate (pH 5.2) and 100 ul (2.5 volumes) of ethanol and stored overnight at −20° C. They are then centrifuged at 3,300 rpm at 4° C. for 1 hour. The obtained pellets were washed with 50 ul ice-cold 70% ethanol and centrifuged again for 30 minutes. The pellets are then air-dried and resuspended well in 50% dimethylsulfoxide (DMSO) or 20 ul 3×SSC overnight. The samples are then deposited either singly or in duplicate onto Gamma Amino Propyl Silane (Coming CMT-GAPS or CMT-GAP2, Catalog No. 40003, 40004) or polylysine-coated slides (Sigma Cat. No. P0425) using a robotic GMS 417 or 427 arrayer (Affymetrix, Calif.). The boundaries of the DNA spots on the microarray are marked with a diamond scriber. The invention provides for arrays where 10-20,000 PCR products are spotted onto a solid support to prepare an array.

The arrays are rehydrated by suspending the slides over a dish of warm particle free $ddH_2O$ for approximately one minute (the spots will swell slightly but not run into each other) and snap-dried on a 70-80° C. inverted heating block for 3 seconds. DNA is then UV crosslinked to the slide (Stratagene, Stratalinker, 65 mJ—set display to "650" which is 650×100 uJ) or baked at 80 C. for two to four hours. The arrays are placed in a slide rack. An empty slide chamber is prepared and filled with the following solution: 3.0 grams of succinic anhydride (Aldrich) is dissolved in 189 ml of 1-methyl-2-pyrrolidinone (rapid addition of reagent is crucial); immediately after the last flake of succinic anhydride dissolved, 21.0 ml of 0.2 M sodium borate is mixed in and the solution is poured into the slide chamber. The slide rack is plunged rapidly and evenly in the slide chamber and vigorously shaken up and down for a few seconds, making sure the slides never leave the solution, and then mixed on an orbital shaker for 15-20 minutes. The slide rack is then gently plunged in 95° C. $ddH_2O$ for 2 minutes, followed by plunging five times in 95% ethanol. The slides are then air dried by allowing excess ethanol to drip onto paper towels. The arrays are then stored in the slide box at room temperature until use.

Example 6

Target Nucleic Acid Preparation and Hybridization

Preparation of Fluorescent DNA Probe from mRNA

Fluorescently labeled target nucleic acid samples are prepared for analysis with an array of the invention.

2 μg Oligo-dT primers are annealed to 2 ug of mRNA isolated from a cartilage sample from patient diagnosed with osteoarthritis or suspected of having osteoarthritis in a total volume of 15 ul, by heating to 70° C. for 10 min, and cooled on ice. The mRNA is reverse transcribed by incubating the sample at 42° C. for 1.5-2 hours in a 100 μl volume containing a final concentration of 50 mM Tris-HCl (pH 8.3), 75 mM KCl, 3 mM MgCl2, 25 mM DTT, 25 mM unlabeled dNTPs, 400 units of Superscript II (200 U/uL, Gibco BRL), and 15 mM of Cy3 or Cy5 (Amersham). RNA is then degraded by addition of 15 μl of 0.1N NaOH, and incubation at 70° C. for 10 min. The reaction mixture is neutralized by addition of 15 μl of 0.1N HCL, and the volume is brought to 500 μl with TE (10 mM Tris, 1 mM EDTA), and 20 μg of Cot1 human DNA (Gibco-BRL) is added.

The labeled target nucleic acid sample is purified by centrifugation in a Centricon-30 micro-concentrator (Amicon). If two different target nucleic acid samples (e.g., two samples derived from different patients) are being analyzed and compared by hybridization to the same array, each target nucleic acid sample is labeled with a different fluorescent label (e.g., Cy3 and Cy5) and separately concentrated. The separately concentrated target nucleic acid samples (Cy3 and Cy5 labeled) are combined into a fresh centricon, washed with 500 μl TE, and concentrated again to a volume of less than 7 μl. 1 μL of 10 μg/μl polyA RNA (Sigma, #P9403) and 1 μl of 10 μg/ul tRNA (Gibco-BRL, #15401-011) is added and the volume is adjusted to 9.5 μl with distilled water. For final target nucleic acid preparation 2.1 μl 20×SSC (1.5M NaCl, 150 mM NaCitrate (pH 8.0)) and 0.35 μl 10% SDS is added.

Hybridization

Labeled nucleic acid is denatured by heating for 2 min at 100° C., and incubated at 37° C. for 20-30 min before being placed on a nucleic acid array under a 22 mm×22 mm glass cover slip. Hybridization is carried out at 65° C. for 14 to 18 hours in a custom slide chamber with humidity maintained by a small reservoir of 3×SSC. The array is washed by submersion and agitation for 2-5 min in 2×SSC with 0.1% SDS, followed by 1×SSC, and 0.1×SSC. Finally, the array is dried by centrifugation for 2 min in a slide rack in a Beckman GS-6 tabletop centrifuge in Microplus carriers at 650 RPM for 2 min.

Example 7

Signal Detection and Data Generation

Following hybridization of an array with one or more labeled target nucleic acid samples, arrays are scanned immediately using a GMS Scanner 418 and Scanalyzer software (Michael Eisen, Stanford University), followed by GeneSpring software (Silicon Genetics, CA) analysis. Alternatively, a GMS Scanner 428 and Jaguar software may be used followed by GeneSpring software analysis.

If one target nucleic acid sample is analyzed, the sample is labeled with one fluorescent dye (e.g., Cy3 or Cy5).

After hybridization to a microarray as described in Example 6, fluorescence intensities at the associated nucleic acid members on the microarray are determined from images taken with a custom confocal microscope equipped with laser excitation sources and interference filters appropriate for the Cy3 or Cy5 fluors.

The presence of Cy3 or Cy5 fluorescent dye on the microarray indicates hybridization of a target nucleic acid and a specific nucleic acid member on the microarray. The intensity of Cy3 or Cy5 fluorescence represents the amount of target nucleic acid which is hybridized to the nucleic acid member on the microarray, and is indicative of the expression level of the specific nucleic acid member sequence in the target sample.

When two target nucleic acid samples are being analyzed and compared (e.g., mild osteoarthritic vs severe osteoarthritic), one target nucleic acid sample (for example, mild osteoarthritic) is labeled with fluorescent dye Cy3, the other target nucleic acid sample (for example, severe osteoarthritis) is labeled with fluorescent dye Cy5.

After hybridization as described in Example 6, fluorescence intensities at the associated nucleic acid members on the microarray are determined from images taken with a custom confocal microscope equipped with laser excitation sources and interference filters appropriate for the Cy3 and Cy5 fluors. Separate scans are taken for each fluor at a resolution of 225 $\mu m^2$ per pixel and 65,536 gray levels. Normalization between the images is used to adjust for the different efficiencies in labeling and detection with the two different fluors. This is achieved by manual matching of the detection sensitivities to bring a set of internal control genes to nearly equal intensity followed by computational calculation of the residual scalar required for optimal intensity matching for this set of genes.

The presence of Cy3 or Cy5 fluorescent dye on the microarray indicates hybridization of a target nucleic acid and a specific nucleic acid member on the microarray. The intensities of Cy3 or Cy5 fluorescence represent the amount of target nucleic acid which is hybridized to the nucleic acid member on the microarray, and is indicative of the expression level of the specific nucleic acid member sequence in the target sample. If a nucleic acid member on the array shows no color, it indicates that the gene in that element is not expressed in either sample. If a nucleic acid member on the array shows a single color, it indicates that a labeled gene is expressed only in that cell sample. The appearance of both colors indicates that the gene is expressed in both tissue samples. The ratios of Cy3 and Cy5 fluorescence intensities, after normalization, are indicative of differences of expression levels of the associated nucleic acid member sequence in the two samples for comparison. A ratio of expression intensity not equal to 1.0 is used as an indication of differential gene expression.

The array is scanned in the Cy 3 and Cy5 channels and stored as separate 16-bit TIFF images. The images are incorporated and analysed using Scanalyzer software which includes a gridding process to capture the hybridization intensity data from each spot on the array. The fluorescence intensity and background-subtracted hybridization intensity of each spot is collected and a ratio of measured mean intensities of Cy5 to Cy3 is calculated. A liner regression approach is used for normalization and assumes that a scatter plot of the measured Cy5 versus Cy3 intensities should have a scope of one. The average of the ratios is calculated and used to rescale the data and adjust the slope to one. A post-normalization cutoff of a ratio not equal to 1.0 is used to identify differentially expressed genes.

Analysis of a microarray comprising some of the sequences in the sequence listing, resulted in 36 candidate upregulated genes in the mild OA library that showed a greater than 2-fold median ratio and 47 candidate downregulated genes that showed a less than 0.2-fold median ratio (FIGS. 9 and 10, respectively). A total of 38 candidate upregulated genes were also identified in the severe OA library that showed a greater than 2-fold median ratio and 51 candidate downregulated genes that showed a less than 0.2-fold median ratio (FIGS. 11 and 12, respectively). According to this embodiment, the microarray was hybridized with a target nucleic acid sample derived from an individual diagnosed with mild osteoarthritis and a target nucleic acid sample derived from an individual diagnosed with severe osteoarthritis. As would be clear to a person skilled in the art, similar analysis can be performed for any of the sequences identified in FIG. 13, or the sequences identified in FIG. 6A which correspond to the genes disclosed in FIG. 6 using the methods disclosed herein.

Example 8

Chondrocyte-Specific Gene Microarray and Diagnosis Microarray Construction

A collection of nucleic acid members are spotted on a glass slide as described in Example 5 for the construction of a mild OA diagnosis microarray. A collection of nucleic acid members are spotted on a glass slide as described in Example 5 for the construction of a severe OA diagnosis microarray. A collection of chondrocyte specific nucleic acid members are spotted on a glass slide as described in Example 5 for the construction of a chondrocyte-specific gene microarray. The nucleic acid members spotted onto the microarrays described are selected from those named in FIGS. 6B, 6C, 6D and 6E.

Example 9

Diagnosis

Target nucleic acid samples are prepared from cartilage RNA extracts of an individual (as described in Example 6) and hybridized to a microarray comprising a collection of nucleic acid members where at least one member is differentially expressed in cartilage isolated from a patient diagnosed with mild, moderate, marked or severe osteoarthritis, as compared to cartilage isolated from a normal individual as defined herein (as described in Example 6). A hybridization pattern is generated and analyzed as in Example 7. For example, the hybridization of target nucleic acid samples to one or more nucleic acid members on the microarray comprising a collection of nucleic acid members where at least one member is differentially expressed in mild osteoarthritis cartilage as compared to a normal individual is indicative of a mild osteoarthritis of the individual from whom the target nucleic acid sample is derived. The hybridization of target nucleic acid samples to one or more nucleic acid members on the microarray comprising a collection of nucleic acid members differentially expressed in severe osteoarthritis cartilage as compared to the normal individual is indicative of severe osteoarthritis of the individual from whom the target nucleic acid sample is derived.

Example 10

Therapeutic Agent Screening

A candidate therapeutic agent that increases or decreases the expression of one or more nucleic acid sequences that are differentially expressed in a chondrocyte derived from any of the following chondrocyte disease or developmental stages:

fetal, mild osteoarthritic, moderate osteoarthritic, marked osteoarthritic and severe osteoarthritic, is screened according to the following method.

Chondrocytes are isolated from a "normal" individual and are incubated in the presence and absence of a candidate agent for varying amounts of time (i.e., 30 min, 1 hr, 5 hr, 24 hr, 48 hr and 96 hrs). When screening for therapeutic genes, a clone of a full gene sequence corresponding to an EST in FIG. 6A or FIG. 13 is used to transfect chondrocytes. The transfected chondrocytes are cultured for varying amounts of time (i.e., 1, 2, 3, 5, 7, 10, or 14 days). Following incubation, target nucleic acid samples are prepared from the chondrocytes and hybridized to a nucleic acid probe corresponding to a nucleic acid sequence which is differentially expressed in a chondrocyte derived from at least any two of the following of: fetal, normal, mild osteoarthritic, moderate osteoarthritic and severe osteoarthritic. The nucleic acid probe is labeled, for example with a radioactive label, according to methods well-known in the art and described herein. Hybridization is carried out by northern blot, for example as described in Ausubel et al., supra or Sambrook et al., supra). The differential hybridization, as defined herein, of the probe to the target nucleic acid samples from normal relative to RNA from any one of fetal, mild osteoarthritic, moderate osteoarthritic, marked osteoarthritic and severe osteoarthritic is indicative of the level of expression of RNA corresponding to a differentially expressed chondrocyte specific nucleic acid sequence. A change in the level of expression of the probe sequence as a result of the incubation step in the presence of the candidate agent, is indicative of an agent that increases or decreases the expression of the corresponding chondrocyte specific nucleic acid sequence.

Example 11

Assessing the Integrity of Cartilage RNA Isolated Post-Mortem

The following Baboon cartilage study was preformed to evaluate the quality of freshly isolated RNA and RNA isolated at various times post-mortem.

Nine vials of baboon cartilage were obtained, and stored in liquid nitrogen till use.

Baboon cartilage from each vial was weighed and finely powdered under liquid nitrogen. The sample was then homogenized in TRIzol® reagent (0.1 g/ml TRIzol®) and total RNA was extracted. The quantity of RNA was calculated according to the $OD_{260}$ value. The appearance of two sharp bands on the RNA gel indicated that the RNA was of good quality.

RT-PCR was performed for the gene expression of collagen type II (COL2A1), B-actin and GAPDH, using 0.1 ug total RNA from each sample.

The RNA gel pattern clearly shows that the RNA was not degraded up to 12 hours post mortem (Table 7). Therefore stable RNA should be expected from the biopsy sample within 12 hours after death.

TABLE 7

Integrity Of Cartilage RNA Isolated Post-Mortem

| Sample No. | Time Taken | Weight (g) | Total RNA (ug)-Based on OD260 | RNA Gel (non Dil) | Col2A1 | β-actin | GAPDH |
|---|---|---|---|---|---|---|---|
| 1 | Fresh | 0.175 | 8 | OK | ++ | ++ | ++ |
| 2 | 1 hr pm | 0.29 | 9 | OK | ++ | ++ | ++ |
| 3 | 2 hr | 0.29 | 11.36 | OK | ++ | +/− | +/− |
| 4 | 3 hr | 0.25 | 2.8 | OK | ++ | +/− | +/− |
| 5 | 6 hr | 0.53 | 8.0 | OK | ++ | + | +/− |
| 6 | 8 hr | 0.18 | 5.26 | OK | ++ | + | − |
| 7 | 10 hr | 0.38 | 9.35 | OK | ++ | + | +/− |
| 8 | 12 hr | 0.20 | 6.7 | OK | ++ | +/− | − |
| 9 | 24 hr | 0.41 | 9.35 | SMEAR | +/− | − | − |

Collagen type II is abundant and specific to normal articular cartilage. Its mRNA level was comparable among all the samples except #9 (24 hours post-mortem). It should be noted that samples taken earlier will better reflect the natural in vivo state.

Example 12

Expressed Sequence Tags (ESTs) Analysis of Human Chondrocyte Gene Expression in Mild and Severe Osteoarthritic Cartilage Large-scale partial sequencing of cDNA libraries obtained from human fetal cartilage was performed to identify expressed sequence tags (ESTs) corresponding to genes that might play critical roles in OA progression. Large scale sequencing of cDNA libraries from human normal, mild and severe OA cartilage was also performed and a total of over 44,000 ESTs from the three cDNA libraries were analyzed.

Normal cartilage was obtained from the donor program of Department of Orthopaedics and Rehabilitation, University of Miami. OA cartilage samples were obtained from either areas of very early cartilage degeneration (mild) or from sites of end stage disease (severe) during either arthroscopic knee surgery or total knee replacement. Total RNA from cartilage was extracted using TRIzol® reagent (GIBCO). cDNA libraries were constructed into λTriplEx2 vector through a PCR-based method, using SMART (Switching Mechanism At 5' end of RNA Transcript) cDNA Library Construction Kit (Clontech) as described above. Phage plaques were randomly picked and positive inserts were identified by PCR. Agarose gel electrophoresis was used to assess the presence and purity of inserts. PCR product was then subjected to automated DNA sequencing with a 5' vector-specific forward primer and sequenced by ABI PRISM 377 DNA sequencer (Perkin Elmer) and ABI PRISM 3700 DNA Analyzer (Applied Biosystems). All generated EST sequences were searched against the nonredundant Genebank/EMBL/DDBL, dbEST and GSS databases. A minimum value of $p=10^{-10}$ and nucleotide sequence identity >90% were required for assignments of putative identities for EST-matching to known genes or other ESTs. Relative EST frequency level was calculated by dividing the EST number matched to that gene into the total number of ESTs obtained from the library.

A total of 17,151 ESTs, 12,651 ESTs and 14,222 ESTs were obtained from normal, mild and severe OA cDNA libraries respectively and used for gene expression profiling. About 44% of the total ESTs from these three cDNA libraries matched to known genes in the database, and about 0.9% of the ESTs (409) resulted in no significant match to known sequences and were thus designated as novel. Nonredundancy analysis of the known gene matches resulted in the identification of 2,518 unique genes in normal, 1,938 in mild and 2,256 in severe OA cartilage. Differentially expressed known genes amongst fetal (22), normal, mild, and severe OA cartilage (23)were identified by examining relative EST frequency levels as shown in FIG. 6.

Some of the genes with particularly marked differential expression are shown in FIG. 4 provided herewith. Heat shock protein 90 (HSP90) was the gene with the most abundant ESTs matches in mild OA. Its transcript level was low in fetal cartilage. Beta-2 microglobulin (B2M) level was higher in diseased cartilage than normal cartilage, and significantly higher in diseased cartilage than in fetal cartilage. Its EST levels in mild and severe OA were similar. Osteoblast specific factor 2 (OSF-2p1) was highly expressed in severe OA compared to fetal, mild and normal cartilage. Another differentially expressed gene was megakaryocyte stimulating factor (MSF, also known as superficial zone protein, or proteoglycan 4). It had a significantly higher expression in mild OA than in severe OA.

The relative frequency of ESTs representing the collagens was also analyzed as shown in FIG. 3.

Noncollagenous matrix protein profiles showed higher EST levels of decorin (DCN), fibronectin (FN), lumican (LUM) and matrix G1a protein (MGP) in both mild and severe OA cartilage as shown in FIGS. 1 and 4 provided herewith.

Example 13

Microarray Analysis of Beta-2 Microglobulin (B2M) Expression in Human Osteoarthritis As discussed above, Beta-2 microglobulin (B2M) had a high EST expression level in mild and severe OA cartilage. B2M is a nonglycosylated polypeptide that is elevated in inflammatory and malignant diseases. It has been shown to induce stromelysin and cyclooxygenase-2 synthesis in human synovial fibroblasts (24, 25).

B2M expression during different stages of osteoarthritis was evaluated. Human OA synovial fluid (SF) was collected from human knee joint by aspiration at arthroscopy or total knee replacement. Normal samples were collected from volunteers with no history of knee injury or arthritis. Organ culture was performed as follows: human severe OA cartilage slices were cultured at one slice/well in a 24-well plate in DMEM (Dulbecco's modified Eagle medium), with 10% FCS, 100 units/ml penicillin and 100 mg/ml streptomycin (DMEM++) at 37° C. in a humidified atmosphere of 5% $CO_2$. Cultured medium (20 ul) was then collected at different time points for B2M testing. B2M levels in synovial fluid and cartilage organ cultured medium were measured using a B2M enzyme immunoassay test kit (ALPCO). Statistical significance was assessed by Student's t-test with P values less than 0.05 being considered significant. Cell culture of chondrocytes from patients with severe OA was performed as follows. Chondrocytes were derived from cartilage from patients with severe OA through collagenase type II digestion. Cells were then seeded at $6.5\times10^4$/well ($3.2\times10^4$/ml) in a 6-well plate and treated with or without 10 ug/ml B2M (Sigma) for 72 hr. Microarrays containing 5184 chondrocyte-specific cDNA clones were used for gene expression profiling.

The average B2M levels detected in normal (nor), mild (mioa), moderate (mooa), marked (maoa) and severe OA (seoa) synovial fluid are shown in FIG. 16. B2M in osteoarthritis synovial fluid is significantly higher than that in normal. However, no significant difference was found in B2M levels among different osteoarthritis stages.

To assess if chondrocytes contribute B2M secretion, medium from cultured severe OA cartilage was collected and tested for B2M. FIG. 17 shows the release of B2M is detectable after 24 hour culture and continues to increase during the 72 hour study period. At 72 hours, the accumulation of B2M was about 2.1 ug/g cartilage. Similar results were obtained across three experimental runs, each using cartilage from a different donor.

Genes regulated by B2M were detected through microarray technology as described above. FIG. 18 shows a black and white representation of a two-color fluorescent scan. Cy3 labeling (which would appear as green spots) correspond to genes preferentially expressed in non-B2M treated chondrocytes, while Cy5 labeling (which would appear as reddish spots) represent genes preferentially expressed in B2M treated chondrocytes. Genes expressed at approximately equal levels would appear as yellow spots. The identity of genes was determined by the location of nucleic acid members on the array. Some of the genes that were up or down-regulated at least two-fold by B2M are listed in Table 8.

TABLE 8

Genes Regulated by B2M

| Up-Regulated | Down-Regulated |
|---|---|
| Adrenomedullin | hypothetical protein (KIAA0102) |
| chitinase precursor = YKL-39 | intersectin short form |
| collagen type III, alpha 1 | KARP-1 binding protein 2 (KAB2) |
| manganese superoxide dismutase (SOD-2) | peripheral myelin protein 22 (PMP22) |
| syntaxin 7 | putative GTP binding protein |

Variations, modifications, and other implementations of what is described herein will occur to those of ordinary skill in the art without departing from the spirit and scope of the invention. The references provided below are incorporated herein by reference in their entireties.

REFERENCES

1. Zaleske D J. Cartilage and Bone Development. Instr Course Lect 1998; 47:461-
2. Buckwalter J A, Mankin H J. Articular Cartilage: Tissue Design and Chondrocyte-Matrix Interactions. Instr Course Lect 1998; 47:477-86.
3. Westacott C I, Sharif M. Cytokines in Osteoarthritis: Mediators or Markers of Joint Destruction? Semin Arthritis Rheum 1996; 25:254-72

4. Adams M D, Kerlavage A R, Fleischmann R D, Fuldner R A, Bult C J, Lee N H, et al. Initial assessment of human gene diversity and expression patterns based upon 83 million nucleotides of cDNA sequence. Nature 1995; 377 Suppl:3-174.
5. Hwang D M, Dempsey A A, Wang R X, Rezvani M, Barrans J D, Dai K S, et al. A Genome-Based Resource for Molecular Cardiovascular Medicine: Toward a Compendium of Cardiovascular Genes. Circulation 1997; 96:4146-203.
6. Mao M, Fu G, Wu J S, Zhang Q H, Zhou J, Kan L X, et al. Identification of genes expressed in human $CD34^+$ hematopoietic stem/progenitor cells by expressed sequence tags and efficient full-length cDNA cloning. Proc Natl Acad Sci 1998; 95:8175-80.
7. Hillier L D, Lennon G, Becker M, Bonaldo M F, Chiapelli B, Chissoe S, et al. Generation and analysis of 280,000 human expressed sequence tags. Genome Res. 1996; 6:807-28.
8. Altschul S F, Gish W, Miller W, Myers E W, Lipman D J. Basic local alignment search tool. J Mol Biol 1990; 215: 403-10.
9. Mundlos S, Zabel B. Developmental Expression of Human Cartilage Matrix Protein. Dev Dyn 1994; 199:241-52.
10. Nakamura S, Kamihagi K, Satakeda H, Katayama M, Pan H, Okamoto H, et al. Enhancement of SPARC (osteonectin) synthesis in arthritic cartilage. Increased levels in synovial fluids from patients with rheumatoid arthritis and regulation by growth factors and cytokines in chondrocyte cultures. Arthritis Rheum 1996; 39:539-51.
11. Eyre D R, The Collagens of Articular Cartilage. Semin Arthritis Rheum 1991; 21 (3 Suppl 2):2-11.
12. Okihana H, Yamada K. Preparation of a cDNA Library and Preliminary Assessment of 1400 Genes from Mouse Growth Cartilage. J Bone Miner Res 1999; 14:304-10.
13. Morrison E H, Ferguson M W J, Bayliss M T, Archer C W. The developmental of articular cartilage: I. The spatial and temporal patterns of collagen types. J Anat 1996; 189:9-22.
14. Treilleux I, Mallein-Gerin F, le Guellec D, Herbage D. Localization of the Expression of Type I, II, III Collagens, and Aggrecan Core Protein Genes in Developing Human Articular Cartilage. Matrix 1992; 12:221-32.
15. Eyre D R, Wu J J, Niyibizi C. The collagens of bone and cartilage: Molecular diversity and supramolecular assembly. In Cohn D V, Glorieux F H, Martin T J, editors. Calcium Regulation and Bone Metabolism. Amsterdam. The Netherlands: Elsevier; 1990. p. 188-94.
16. Bimbacher R. Amann G, Breitschopf H, Lassmann H, Suchanek G, Heinz-Erian P. Cellular localization of insulin-like growth factor II mRNA in the human fetus and the placenta: detection with a digoxigenin-labeled cRNA probe and immunocytochemistry. Pediatr Res 1998; 43:614-20.
17. Wang E, Wang J, Chin E, Zhou J, Bondy C A. Cellular patterns of insulin-like growth factor system gene expression in murine chondrogenesis and osteogenesis. Endocrinology 1995; 136:2741-51.
18. van Kleffens M, Groffen C, Rosato R R, van den Eijnde S M, van Neck J W, Lindenbergh-Kortleve D J, et al. mRNA expression patterns of the IGF system during mouse limb bud development, determined by whole mount in situ hybridization. Mol Cell Endocrinol 1998; 138:151-61.
19. Braulke T, Gotz W, Claussen M. Immunohistochemical localization of insulin-like growth factor binding protein-1, -3, and -4 in human fetal tissues and their analysis in media from fetal tissue explants. Growth Regul 1996; 6:55-65.
20. Kessler E, Takahara K, Biniaminov L, Brusel M, Greenspan D S. Bone Morphogenetic Protein-1: The Type I Procollagen C-Proteinase. Science 1996; 271:360-2.
21. Ausubel et al., John Weley & Sons, Inc., 1997, Current Protocols in Molecular Biology
22. Marshall, K. et al., 2000, $46^{th}$ Annual Meeting, ORS, paper No. 919.
23. Kumar, S., et al., 2000, $46^{th}$ Annual Meeting, ORS, paper No. 1031.
24. Marshall K., et al., 2002, $48^{th}$ Annual meeting, ORS (submitted).
25. Migita K., et al., Biochem Biophys Res Commun 1997, 239:621-625.
26. Migita K., et al., Kidney Int 1999, 55:572-578.

SEQUENCE LISTING (58994 sequences)

SEQ ID NO: 1 - DNA, 377 bp, Homo sapiens
cggaggtgcaggtcctggtgcttgatggtcgaggccatctcctgggccgcctggcgcaattccgtggctaaacaggtactgctgggccggaaggtggtggtcgtacgctgtgaaggcatcaccatttctggcaatttctacagaaccaagttgaagtacctggctttcctccccaagcggatgaacaccaacccttcccggggcccctatccctttccgggccccaagccgatttttttgggcgacccgggcggggatttctcccaaaaaaccaagcaggccaggccgtctctgaccgttaagggtgtttacggaatccaccgccatcgaatgaaaagcgatgtgttcctgctgcctatggtcgtcgtactaatgca

SEQ ID NO: 2 - DNA, 209 bp, Homo sapiens
ggaaaggaaagctgtgggaccatcctggcaaccccggtgtttggctgggttctagcgtagcggtctgtattcggccggtgggggaccttgcgtcggagtgggagggccagtttgcacccaagaggtggaagaggacgggctttaggctggaagcgccttagaggagccatttttcccaggatgcctgggttgcttttatagtgtaaccc

SEQ ID NO: 3 - DNA, 499 bp, Homo sapiens
tttgatggcgtgatgtctcacagaaagttctccgctcccagacatgggtccctcggcttcctgcctcggaagcgcagagcaggcatcgtgggaaggtgaagagcttccctaaggatgacccgtccaagccggtccaccttacagccttcctgggatacaaggctggcatgactcacatcgtgcggggagtcgacaggcccggatcccaggtgtaacacagaaggaggtggtgtagagctctttccccatttgagacacaccacctatggtgtttgtggactttgtggtcctacgtggacacctctcgaggtctccgcaccctacaagactgtcttttgctgagcacatcagtgatgattgcagaggcgtttctatatgaatttgcataatctaagaggaggctttaccagtacttcagacatgcaggatgaggatgcagagcagctgagaggactcagcagcatgagagatctccaagtcatcgtgtcattgccacacc

SEQ ID NO: 4 - DNA, 406 bp, Homo sapiens
aaggaaatggctacccaacttgccttcatgcgcctgctggccaactatgcctctcagaacatcacctaccactgcaagaacagcattgcatacatggatgaggagactggcaacctgaaaaaggctgtcattctacagggctctaatgatgttgaactgttgctgagggcaacagcaggttcacttacacttgttcttgtagggtgggtgctttaaaagggcaaattgatggggggaggcacatattcgatcacaacacatagagcctacagcttgccttcctttgtattcgccacttgggactaggttggcatcgcccgggtttcttggggactgggccagtcttcacatagaaagctcatatccatagaaaggtagattttggatactccttcttttgctacgc

SEQ ID NO: 5 - DNA, 440 bp, Homo sapiens
gagacttagagccaaactgtttaagctgtatcatcccaacaaagtatcctttcatgaacgggggcatgcaatagcttaagaattgctaggattaaattaaggaaagtaaagctactcagagcagcaggttccacaagcacaaactttacacatttgtacacttttgaaatgcactacattaacacattagagcacacatttgaaatacaggcttctttacatacactgagaggttatacacactcagtttcacacgggcacactctatacctctctaaaggtaatatctcaggtctctataggcagagtattttactctctaaatctgcctctctgaccacaaaaaaaaaaaaaacctggggggtccttctgggcgccggggcccatcgatttccacccgggggggaccaggaagttccccaatcgcctatgtagtcata

SEQ ID NO: 6 - DNA, 403 bp, Homo sapiens
aaaaaatagttttttcattagtatttctcgggaggacccaaaagttaaggtcagcttgttcactgtaatttctggaaggagttcactcagaccttcctgaattcagatcatctcagaagtcttgagggaaatcttgcgaaaccctcgtttgaggacttatgttagtttattgccacctcacttggtgcaccgagaacttacttccttggattaggtcacttctttgatttctaataggatgacttccagagagtgagatttgttatgtctggcttataaaggtaaatataaatatatacatacttaatctaaaaaaaaaaaaaaacctcgggggtctttttggacgccggggcccattcgattccccccgggtggggccaaggtaagtaccccaatcgcctat

SEQ ID NO: 7 - DNA, 231 bp, Homo sapiens
ctttgcagatcttttccgacacacatgtctgaagacttattttcaaagacagcacatttttggaaactaatctcttttccgtaatatttcctttatttcaatgattctcagaaggcccattcaaacaaaccccccatttaagggtctttagggttataggataaaattgggctcctagagtttagcccccagtagagctaggaaagccccactcgtatatttgttcccttc

SEQ ID NO: 8 - DNA, 114 bp, Homo sapiens
tgcttctattaccaggctgtaatagctggtatagttttttatttttctcttaaggtgttcttttattagtctgaggacagccattttttttttttaagggaaaatatcagtcag

SEQ ID NO: 9 - DNA, 166 bp, Homo sapiens
aagtatgatgcttttttggcctcagagtctctgatcaagcagattccacgaatcctcggcccaggtttaaataaggcaggaaagttcccttccctgctcacacaaaaacggaaacatggtggccaaagtggattaggtgaagtccccaatcaagttttcccaatga

SEQ ID NO: 10 - DNA, 297 bp, Homo sapiens
ttttttttttgaataatagaggcaatatttttaatcagttcccagataaggtcaattagaaacatgcactgctaaaatgcaagttacaattcaaatggtaccataaataattagggtacacactgagcattttcaggaatcagcttccatatcttgatccactaaatggggagggtcttcaggacacggtcccttacccctttatacacagagggggaggaatttaagggtcgcctcatggacactttacagtaaatcgggacacatttatttgagtacactatttagacatgtaaa

SEQ ID NO: 11 - DNA, 218 bp, Homo sapiens
cttggatgaagagaggaccgtgagggtccccatgatgtcggaccctaaggctgttttacgctatggcttggattcagatctcagctgcaagattgcccagctgcccttgaccggaaggcatgagtatcatttttttcctgcccctgtaagtgcaccagaatttgaccttgatagaggagagcctcaacctccgagttcattcatgacatagaccgaga

SEQ ID NO: 12 - DNA, 232 bp, Homo sapiens
cttcagggtgatgccaggttctatttgggaatttatatacaacctgcttgggtggagaagccattgtcttcggaaaccttggtgttagttgaacctgataagttacttttgtgacctgaagttcaccattaaaaggggattacccaaggcaaaatcatgggattggtataaaagggattgttgggcaatccattgcaatatattcaaaaattgaataatgggccccataaaa

SEQ ID NO: 13 - DNA, 136 bp, Homo sapiens
gcagaatcacatggcaaaagctttgaaaatcataaagatataagttggtgtggctaagatggaaacagggctgattcttgattcccaattctcaactctccttttcctatttgaatttctttggggctgtagaaac

SEQ ID NO: 14 - DNA, 251 bp, Homo sapiens
cttttatgtatccatcccatctaaaaactcttcaaactccacttgttcagtctgaaatgcagctccctgtccaagtgccttggagaactcacagcagcacggcttaatcaaagggttttaccagcccttggacactattgggaggagggcaagagtacaccaatttgttaaaagcaaggaaaccacagatgtctcttcactagtcatttagagcatggttatcatccaagactactctaccctgcaacaat

SEQ ID NO: 15 - DNA, 251 bp, Homo sapiens
cagagatgtactgttattagctgggaagaccaattctaacagcaaataacagtctgagactcctcataccctcagtggttagaagcatgtctctcttgagctacagtagagggggagggatttttgtgtagtcaagtcaccatgctggaatgtacactgattcctctatgatgactgcttaactccccactgtcctgtcccagagaggctttccaatgtagctcagtaattcctcttactctacagacagg

SEQ ID NO: 16 - DNA, 162 bp, Homo sapiens
attgcatgcaagtttgctgagctgaaggaaaagattgatcgcccgttctgggtaaaaatgctggaaggatgggccctaaaattcttgaagtctgggtgatgctgcccattgttgatatgggtcccgggcaagcccatttttttttgagaggcttctcagact

SEQ ID NO: 17 - DNA, 225 bp, Homo sapiens
gcagctgacagaggaagccgctcaaataccttcacaataaatagtggcaatatatatatagtttaagaaggctctccatttggcatcgtttaatttatatgttatgttctaagcacagctctcttctcctattttcatcctgcaagcaactcaaaatatttaaaataaagtttacatatgtagttattttcaaatctttgctttataagtattaagagatatgtg

SEQ ID NO: 18 - DNA, 215 bp, Homo sapiens
ccctgacagccagtatattgacaacaggagtgtgaacagtgcagggcttcacacggtgcagagagcaccccgactgaaccacccgcctgagcagatagactctcactcaagactacctcatagcgcacacccctcgggaaaaccaccatccgcttcagccttggcaccttagaatgtatttagtacggctttaagcagtgtgttattacaccaca

SEQ ID NO: 19 - DNA, 285 bp, Homo sapiens
gtcgccgctgcgaagggagccgccgccatgtctgcgcatctgcaatggatggtcgtgcggaactgctccagtttcctgatcaagaggataagcagacctacagcactgagcccaataacttgaaggcccgcaatttcttccgctacaacggacttattcaacgccaagactgtgggcgtggagcccgcagaccgacggcaaaaggtgttcgttggtgggtcaataagcggagattcccgccagcggaagccttccaccttctatgtgcggagcaccaataacaag

SEQ ID NO: 20 - DNA, 307 bp, Homo sapiens
ctcgtgccgaattcggcacgagcggcacgagctggagttggcgacttcgatattaacaaggatggcggcggccgcagcaagtcggataagtcgggccaaagctgggcctaccgtaagattcgcatccacttatgtcagcgctcgcccggcagccagggcgtcagggacttcattgagaaccgctacgtggagctgaggagggcgaatcccgacctacccatcctaatccgcgaattctccgatgtgcagcccaagctctggcccgctacgcatttggccagagacgaatgtcctttgacaacttcag

SEQ ID NO: 21 - DNA, 138 bp, Homo sapiens
gtcgcggcgacatggccaaacgtaccaagaaagtcgggatcgtcggtaaatacggggacccgctattggggccttccttcggaaaattgtgtaaggaaaattgaaattcagccagcacggccaagtgacactttgctc

SEQ ID NO: 22 - DNA, 138 bp, Homo sapiens
aaagaagtagcaaattatcttcagtataatccatggtaatgtatgcagtaattcaaattgatctctctctcaatagggttcttaacaatcttaaacttggaacatcaatggttaattttcagggacctttttgggttt

SEQ ID NO: 23 - DNA, 132 bp, Homo sapiens
ccctacgacaagaaaaagcggatggtggtttctgctgcctcaaggtcgtgcgtcttaaggcctacaaggaaaggttggctaatcttgggcggcttgcttaagaaggttgcttgaagtaccaagcagttacaa

SEQ ID NO: 24 - DNA, 247 bp, Homo sapiens
ctcacgcaagcatggttaacgtccctaaaacccgccggactttctgtaagaagtgtggcaagcaccaaccccataaagtgacacagtacaaggagggcaaggattctctgtacggccagggaaagccgccttatgacaagaagcagagatggttattgttggcaaactaagccgattttccggaaaaaggctaaaactacacagaagagttgtgctaaggctctagtgcgctgagccccactccaga

SEQ ID NO: 25 - DNA, 213 bp, Homo sapiens
gtttgagaagtcccccctgcgggtgaagaacttcgggatctggctgcgctatgacttccggagcggcacccacaacatgtaccgggaataccgggacctgaacaacgcaggcgctgtcacccagtgctaccgagacatgggtgcccggcaccgcggccgagcccacttcattcagatcatgtaaggttgaggagatcgcggccagcaagtgtc

SEQ ID NO: 26 - DNA, 237 bp, Homo sapiens
gaaaaatgagtatgttccttctcaggagagctcttagacaacaagcaaagaatgtcaatgaaatttttaagtgctcagtgttccaggccagagtacagagggagggacactttgctgtctttcagtcctttctttttaattgtattgattcttttcctcggtaataaataagtgcatactagtgtttattaaggaaagacaggtacaagccaaattgtattcatttaatcatattcg

SEQ ID NO: 27 - DNA, 132 bp, Homo sapiens
cctgtgccgaaattcggcacgaggcttgcgggaatcccattcacccttgtccttctcacctaaatcctgcagcctggcttcctgacccaatgaatcccttaggtgaatttcgtcagttcaagagccccttgg

SEQ ID NO: 28 - DNA, 110 bp, Homo sapiens
cagagatgaactgaggtccttgttttgttttgttcataatacaaaggtgctaattaatagtatttcagatacttgaggaatgttgatggtcctagaggaatttgagaggg

SEQ ID NO: 29 - DNA, 257 bp, Homo sapiens
gccgttctggtaaaaagctggaagatggccctaaattcttgaagtctggtgatgctgccattgttgatatgggttcctggcaagcccatgtgtgttgaggagcttctcaagctatccacctttgggtcggtttgctgttcgggatatgaggacaagacaagtgcggggggtgtcatcaaaggcaggtggcaaggaggctgctgggagctggcaaggtcacaagtctgcccagaaagctcagagggctaaatgaatat

SEQ ID NO: 30 - DNA, 361 bp, Homo sapiens
tgtcaatcttgcctggacagcaggaaacagtaacacgcgcttcggaatagcagccaagactcagattgaccctgacggctgcttctcggctaaagtgaacaacttcacgcctgataggtttagggatacaactcaggactctaaagccaggtattaaactgacaactgtcagctcttctgaatggcaagaacgtcaatgctggtggccacaagcttggtctaggactggaatttcaagcataaatgaatactgtacattgtttaattttaaactatttgcagcatagctaccttcagagtgtagtgtatctttaatgttgtatgtctgtatgcagtattgctaatatgttagccctcagat

SEQ ID NO: 31 - DNA, 398 bp, Homo sapiens
ccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggaggaggagaaacctggacaggcacggaagatgccaggtgctcctgagatcttggaaatagcagacacaccagtgagacaaacttccttgagacacgtttcatgacgatctctctaccggagctatcgaacctccgagagtcttcaggagttcatcaagatgacactatgacgtgagacacatcagaggagatgtctgggatgtaggaatgcatttgtg

SEQ ID NO: 32 - DNA, 210 bp, Homo sapiens
cggcacgagtagtgacagaccgttggcatgttagaactaaggaagggggaaaacttatgaagccctgttctttcactaaattacctgcgtgtatttgaccaatgcaaataaaccaggcaatatccagtgtttggaatattaaagtaattcatggattaatttttagtgggttagagcctctaattaaagcttaatatatattaagtgcac

SEQ ID NO: 33 - DNA, 275 bp, Homo sapiens
ggcttgtgcagcaatggccaagatcaaggctcgagatcttcgcgggaagaagaaggaggagctgctgaaacagctggacgacctgaaggtggagctgttcccagctgcgcgtcgccaaagtacaggcggtcggcctccaagctctctaagatccgagtcgtccggaaatccattgcccgttttctaacagttattaaccagactcagaaggaaacctcaggaaattctacaaggcaagaggtacaagcccttggacctgcggcctaagagacacg

SEQ ID NO: 34 - DNA, 131 bp, Homo sapiens
cagtcttgctttattcatcctccatctcaaaatgaacttggaattaaatattgtaagatatgtataatgctggccattttaaaggggttttctcaaaaggtaaaccttttgttattgacttgtgtttttgc

SEQ ID NO: 35 - DNA, 155 bp, Homo sapiens
gtggcgataagggagagcccggtgaaaaggggcccagaggtcttcctggcttaaaggggacacaatggattgcaaggtctgcctgggtatcggctggtcaaccatgggtgatcaagggtgcctcctggctccgtggggtcctcttggtccttggg

SEQ ID NO: 36 - DNA, 150 bp, Homo sapiens
gtcagctctgaatgaggaggggagaagcccctggggtctttctttgaaaggaatcccgctgcttgagggcttgcctcccttcaatggtgttccgtttcgtttcttttccctgaccggacttttttatattcaagaggtacctattgcaaa

SEQ ID NO: 37 - DNA, 199 bp, Homo sapiens
ctgaaatctagcagagtttaactcttctgcctccatgtctgtcacttataattcaggttctgctgttggcttcagaacatgagcaggaggatcgttttatgctaggttattgcaatcaatggtgaaactcaacttagggaaagggttccaatgtataaggcaatgggctgcttctccccaatcctccctaacaatttgt

SEQ ID NO: 38 - DNA, 315 bp, Homo sapiens
catcatctcctgtgatcgaggatgctcgacacccacacaaataccgcatgctcatcgcaatggtggatgtgatctatcctgaatgtggcccagccagtcccagaccccgagttgtggcccttaatgcccacaccttccctgcgtaatggaggacaatttgtgatttccattaaggccaacctcaattacttcacaagcgtaagccgaggccggtgttttcctccgaagtgaaaaggatgcaacaaggagacaatgaggccgcaggagcaggttgacccttagccaatattaaagagaccaattccgtgccgtggg

SEQ ID NO: 39 - DNA, 160 bp, Homo sapiens
ctaactcctctgacacgtccttcgcagttcttgagcgcttgtgcattactttcctatgagggtctgtgcttcacagcaacctgacagtggcgttcgggggcgttgttcccgtacgtagaggacgtggagcgtcacaacaggcagtggagcccaacgtcag

SEQ ID NO: 40 - DNA, 220 bp, Homo sapiens
gtaagattggcctaagagccctgcctgaccacgtgagcattgtggacccaagatgagatactgcccaccacccccatctcagaacagaagggtggggagccagagcccgcctgccatgccccagccagtcccaacagcataacagggtcttcttggcagctgtattctggagtctggatgttgctctgtaaggacctttagtaaaattttgtacaaagac

SEQ ID NO: 41 - DNA, 355 bp, Homo sapiens
cctcgtccgaggtcacaccttcaaatcctgtctctaaggccagaaccaaagtgggccttctgtgaacaggtccttgggtcacttctcaccttcctaagctgatggaggcctggcttagcagccggaagcctaccaggcactgtgcactatgagcatgtgtkcaaagagtactctctctgagccaaagcatgcctgctcatctcccctgtggcagaagggagccctgagggggcctcttccataggctgggcccgagcattgagtccaggtggctgggtaggctttggccgcacctcagaggtccagacatactttgatgagtaatttccccatctgggtactatttcctggaagg

SEQ ID NO: 42 - DNA, 330 bp, Homo sapiens
gcctatctggacgaagcagctggcaacctcaagaaggccctgctcatccagggctccaatgacgtggagatccgggcagagggcaatagcaggttcacgtacactgccctgaaggattggctgcacgraacataccggtaagttgggcaagacttttatcgagtaccggtcacagaagacctcacgcctccccatcatttacatttcacccatggacataggagggcccgagcaggaattcggttttgacatagggccggtcttctttttgtaaaacctgaacccagaaacaacacattctttgcaaaccaaaggaccaagtatttccat

SEQ ID NO: 43 - DNA, 210 bp, Homo sapiens
  misc_feature 18: n = A,T,C or G
gggacagtcagccgcatnttcttttgcgtcgcagccgagccacatcgctcagacaccatggggaaggtgaaggtcggrgtcaacggatttggtcgtattgggcgcctggtcaccagggctgcttttaactctggtaaagtggatatttttgccatcaatgacccttcaattgacctaacttacatggtttacatttcccaatatgttccc

SEQ ID NO: 44 - DNA, 240 bp, Homo sapiens
gtgaacactgagaatactgagtcaggattagctcttcacacttttccacccttttctgagcatgtagttggtgggttgacctgtcaaggtcatcctggatgatctagacttgtttctctcttcttttcccttcagtatgccttagggatcacagggatgaatatagggtcaccgtttatacctaaggatccaccttatactttccttagggttcacacattagggttttaaggaaagggg

SEQ ID NO: 45 - DNA, 139 bp, Homo sapiens
acttctgaagatgtccttgatgtgcagctggcattccttcgacttctctccaaccgagcttcccagaacatacacatatcactgccaaaaatagcattgcatacatggatcaggccagtgggaatgtaaagaaggccct

SEQ ID NO: 46 - DNA, 320 bp, Homo sapiens
gttcccaaggcagtcacggcttgaagtgaggccagtgccacaaccgggggatgaattttagtttttacttttaataaatttgagtagccacttgtgttggtggccactgaacctacggggcagtgcagccatagtgactcctactatacggagccgtcttcccacatccttccttagctgtcacttctcctggagcaggagacagctccaggtcctgcgaagtgtgggcagttcttacctcctggggctgagctcatgtggaaaacctttgtgcaggttcatgggggctgaccagccggaccggaggaatcctaggttag

SEQ ID NO: 47 - DNA, 136 bp, Homo sapiens
ctcagtggaagactcagagtctgaaccctggtcagcctgacgttagagcctccgatggttcagccactgggctatatctgcctctgttgtcatgtctgttcacaacagggaggggaaagacatctgtatttccttt

SEQ ID NO: 48 - DNA, 198 bp, Homo sapiens
ggccgcggactgctgcagtcttcgcgcctctcgccctcccacgacatcatgctcagttcctgcttggatttacactgggcaacgtggttggaatgtatctggctcagacctatgatataccaaacctggctaaaaaacttgaagaaattaaaaaggactttgatgccaagaagaaaccccctagtgcatgagacttcc

SEQ ID NO: 49 - DNA, 231 bp, Homo sapiens
ggtcactgagcagcaccggcagatgggcaagggtggcaagcatcaccttggcctggaggagccaagaagctgcgaccaccccctgccaggactccctgccaacaggaactggaccaggtcctggagcggatctccaccatgcgccttccggatgagcggggccctctggagcacctttacttcctgcacatcccaactgtgacaagcatggcctgtacaacctcaaacagt

SEQ ID NO: 50 - DNA, 265 bp, Homo sapiens
cctgtccccatcagcaaccatgttcttgcaggctgggggcaagggattctgctcatgtgtttgcagaccggctgggatagcctccccaccccttatcagagccaagacacctgctgcagctctccacctagctgcagatagctcccaaagagaaatcagtgtgtctctttcaccatcagctcctccctttcaccaccagctcctctccacttcccaagggagactccggcaaccttcagcaacatatatcctcgaccagatgcag

SEQ ID NO: 51 - DNA, 266 bp, Homo sapiens
aaaccaaacacctcccttgaataaatttatactcctgttcccaggatcttgagctttagtgtgctatacctatgtgtcttatcgtgggccactgtgccaataaacaaaaacaactgtttggtttacctcagttgcagtagttattttcatttagaagttgttctcagattattgtttcagttatatagaggattactagactagttatgaggaaaccccactacattcaatggaattgtgcttaaaatctcatcgatgtgctgtct

SEQ ID NO: 52 - DNA, 235 bp, Homo sapiens
cttgggtgtcagcctccaatagggaagagcagcccaggacacctggaccctgccatacatgcacaatttttccttaagcctcagtttccccacctgtataacatggggagtggcccagctgctccctaaggatccatgtggtttaggggtttaggactcaggcctgagttagagagccccaaggtcaaatctgggctctgtcaacaaaaccaacaaacctttagataggctgatt

SEQ ID NO: 53 - DNA, 570 bp, Homo sapiens
cggcacgagtagtgacagaccgttggcatgttagaactaagaaggaggaaaacttatgaagccctgttctttcactaaattacctgcgtgtatttgaacaatgcaaataaaacaggcaatatccagtgtttggaatattaaagtaattcatggattaatttttagtggtgtagaagcctctgattaaagcttaatatatattaaatgcactttcttcatttatgcagatatgaggaatggtccagataagtataagtcttgagtaactacaaaaatctagaaatgttgcagtgattcttttggtaaaacactgtattgagtttatcttttacatcaacagtaagtacttaggaatgatggaagtgagatacttaaaactcaatccagtgcgggaagttacatattcttaaatatcacttctaactttctattttgtggatacaaacatttacttggtaggcataatggttatttaaactcttctttgggcttatttgacatatatttaagactaagcaagctgctgagataaaggtcagtggacctttttatgttaagaaagaaaattaa

SEQ ID NO: 54 - DNA, 205 bp, Homo sapiens
gtcacaggcgctcgtgaggctgccttccggaacattaagaccattgctgagtgcctggcagatgagctcatcaatgctgccaagggtcctcgaactcctatgccattaagaagaaggacgagcttgagcgtgtggccaagtccaaccgctgattttcccagctgctgcccaataaacctgtctgccctttgggcagttcccagcc

SEQ ID NO: 55 - DNA, 262 bp, Homo sapiens
ggacgctgctgcccctttctttttttcaggcggccaggaagatggcggacattcagactgagcgtgcctaccaaaagcagccgaccatctttcaaaacaagaagagggtcctgctgggagaaactggcaaggagaagctcccgcggtactacaagaacatcggtctgggcttcaagacacccaaggaggctattgagggcacctacattgacaagaatgccccttcactggtaatgtgtccattcgaggccggatcctctct

SEQ ID NO: 56 - DNA, 261 bp, Homo sapiens
gtaaagccaataatatatcattttataggagcattgtcttcttgtgtttttcaagttgactatgtagttcaatgtcagtctccattttaatatcttgtttgtttatcagcctgagcatatttcattttaaaatgtatttgttgagaggtcatggtggttttttgttttccacaggtcaggtggcttgaccactatcacttgtccaatggggaagttgatgcttatctttatggcaaatgcttggttgattaatatatttgc

SEQ ID NO: 57 - DNA, 261 bp, Homo sapiens
cggcacgagacagaatgttatccttacgtcctgagccggtttaagtctgtggaaaaggaagcacgggagaaatccacgtaacctttgctttctttttaagggaagcggttccgccgtgaacttggaaccctcagctccgggtgttctcggcagaagggcagctggaagggcacacagtggggcaggctttggggttgctcccttgttctcccccgaggccgggcacgcagggcagcccacgtctccgtggtcccattctgt

SEQ ID NO: 58 - DNA, 254 bp, Homo sapiens
cagctaggcttagccctctgccctcccttcattgtactttatcattaaaaatcaacttccagccctgtctgctgtctacgtggtgggttgtggggatgcagtttggcatctgcagtacaccaagcacatgattcatgtctgagccaggtctgcttattctcccattgggcagctgaggaccgaggcacagaggtgcggtgacttccccggggctccaggtagcctgcaggttaactggcggtaagtgctagact

SEQ ID NO: 59 - DNA, 256 bp, Homo sapiens
ctcgtcaattttcgggcaagggttaaagaccaacaggttcgtatgcccatttgcacagtaacaaaccatttgcagcagagaaagagtttaatcattgcaagtgcagatcagggagataagaggaaaccctcaaatccatctccctgaaggagttctgggctgggatttttaaagggattatgaagagtgaggggctggaaatttgggattcttgattggttggagtaaggaggatgaaatcatcaggttttggaaa

SEQ ID NO: 60 - DNA, 261 bp, Homo sapiens
gtctcctgcacctgagggtgggcgggaggcggccccgcgggtttgtgttgctggaaaaaggggtctcgatccagaccccaagagagggttcttgggtctacttcagggaagaattggaggcgagtcacagagcgcagtgaagggagcaagtttattggaatctactccgttagagagtgcaagtcctcagactgcaggaggaggactccgtccttcggtagtgtcactacttagaggcagctgtgaggagctgtgattaat

SEQ ID NO: 61 - DNA, 260 bp, Homo sapiens
ctagggctggcccttcttggctggaaagtgtccacttcccacataaagtggaaaagtaattgtctgctgggctcaatggtcaaaacaaatcgaagctaaagcaaatattctctcttctcttccattttgtgcaggaaagcaggctccttctcgcacagtttgcagagggatagtgtagaccatgtgcatcctcactaagagggtcctgccctgatccttgtacccgtcatctcacctctactcaatcagccttcagtgca

SEQ ID NO: 62 - DNA, 187 bp, Homo sapiens
ggccagcaaatgttcctttttgttcaaagtctatttttattccttgatatttttctttttttttttttttggggggggggctttttgattttttctaaaggggcctttttaacatgggggggggagcgtgtgcggctccagcccagcccgttgttcattttccaccctttttccacctgcctttggt

SEQ ID NO: 63 - DNA, 263 bp, Homo sapiens
gcctccttccgcaacacgggcgagatcaaagcactggccggctgtgacttcctcaccatctcacccaagctcctgggagagctgctgcaggacaacgccaagctggtgcctgtgctctcagccaaggcggcccaagccagtgacctcgaaaaaatccacctcgatgagaagtctctccgttggttgcacaacgaggaccagatggctgtggagaagctctctgacgggatccgcaagtttgccgctgatgcagtaaagctgga

SEQ ID NO: 64 - DNA, 263 bp, Homo sapiens
  misc_feature 200: n = A,T,C or G
acacgccgccgcttgtgctgcagccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaanctcactgaggatgagaatccacgccagtacaagatccagactggttcttgaacagacagaggh

SEQ ID NO: 65 - DNA, 261 bp, Homo sapiens
cttggatggcggtggtttcaaaggtcaccgcagatttgagaataaatgactatttccttcatagaaactcacacctcctgagaaagcacagcctgcaagaccacctccgccagcccagcccggagaaatcggagaagctatagccaaatacaacttcaacgcagacacaaatgtggagctgtcactgagaaagggagatagagttattcttcttaaaagagttgatcaaaactggtatgaaggtaaaatccagggaccaac

SEQ ID NO: 66 - DNA, 261 bp, Homo sapiens
cggcacgagtaaatgaggccctttacctttaaaaggaatataatctagtggaagagaggaaacgtatctgtattttttaacagaaaacaaaaggagatcacgtagagtaaggccctgattaatgtacatcatagcctgggtcacgtacctccaccccacaagaccaagaagtgaaatgagggaattgaaggatcaaatagaaaaaggcaaagccaatacaatgatgcactatctagtttgttacttctgaggatgactact

SEQ ID NO: 67 - DNA, 257 bp, Homo sapiens
gtgaatgtttagcctttttgcctaacaaaaagaaaaactgaatttggcgggtttctttctgtaattgttaaaacagtttgtgttagagctgtaattgatttaaagtctaaacctcattcaagagtatgatactacacattagttttcactaaccaaacaaaaccaaagggttagatttttgcctttttgtgtaaccttgtccatcttttagaaaagcagaactagggtggtacaattgaggttctggataactctca

SEQ ID NO: 68 - DNA, 417 bp, Homo sapiens
ttccctgtctggtaattcccaagatttgtttttttttctcctaccctggcatggcccctgctagtcaatgacaactttccataacatgtttctactccccaaatattccccatgaattccagtttctatcaagctgttttcctgcttccaaacaatactacatcacacatagcaggttgcaaaggcagcatgcttttatctaactcatggctttcttgcaataaaagggcatttcccctgttattgtcattaactaccatttagtaaatacctacgatatgccaagcaccgcaataggcattcaacatacaaaatttaggtcttcaaaatagtccatgaaatcagtgttataattctctttttataaatgatggacccagggcaaagaagctaagtagcatacccagtgtttcatcg

SEQ ID NO: 69 - DNA, 435 bp, Homo sapiens
cggtgggtgaagacttgcctcattaataggttctgcaaagacacctttgataagaattacaaggccaccattggagtggacttcgagatggaacgatttgaggtgctgggcattcccttcagtttgcagctttgggataccgctgggcaggagaggttcaaatgcattgcatcaacctactatagaggagctcaagccatcatcattgtcttcaacctgaatgatgtggcatctctggacataccaagcagtggctggccgatgccctaaaggagaatgaccttccagtgtgcttctcttccttgtaggttccaagaaggatctgagtacccctctcagtattcgctgatgagaaagacgcctccaggtggccaagagatgaagctgagtactggcagctcatcttcactggtagaatgtccagaatcttcttcc

SEQ ID NO: 70 - DNA, 317 bp, Homo sapiens
gggctacaccatctgtatgagggaaaagccttgggggagaggggtggggtcctgcctcctgccgagggtaagcctgcaggtgagagccatcagagggaccttcgctgcctgggagttgggttccctccaagggtgcctctttcagtgttctctctctcacctggggctgccaccctaacaggtggcaactcggcagggctgctggggggcacttcctgcccagtggggggtgccgcccaaccttctccctcccaccccgcccctggggccgttttttaccagggtccgtgcactatttatatttttcaaactgaggt

SEQ ID NO: 71 - DNA, 149 bp, Homo sapiens
  misc_feature 39: n = A,T,C or G
ctcgtccattttcgggcaagggttcccgctttaaggttntcaaagtagccaatgtttctcttttggccctatacaaaggcaagaaggaaagaccaagatcataaatattaatggtgaaaacactgtagtaataaattttcatatgccaa

SEQ ID NO: 72 - DNA, 320 bp, Homo sapiens
tctgggctccaccacgcttttcatctgtcccgctgcgtgttttcctcttgatcgggaactcctgcttctccttgcctcgaaatggaccccaactgctcctgctcgcctgttggctcctgtgcctgtgccggctcctgcaaatgcaaagagtgcaaatgcacctcctgcaagaagagctgctgctcctgctgccctgtggtggtgccaagtgtgcccagggctgcatctgcaaagggacgtcagacaagtgcagctgctgtgcctcatgccaggacagctgtgctctcagatgtaaatagagcacctatataaacctggat

SEQ ID NO: 73 - DNA, 240 bp, Homo sapiens
ggtttttcctttcaaaaaatttgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcccttccaaaaaaaattga

SEQ ID NO: 74 - DNA, 347 bp, Homo sapiens
ctactcctttcctggaaaactcatgaataattcacctcttgtttagcatataatcaagaaataactcaggccaggcatggtgactcacgcctgtaatccgagcactttgggaggctgaggtgggtggatcacctgaggtgtcaggagttccagaccagactggccaacatggtgaaaccccatctgtactaaaaatacaaaattagtcaggcatagtggcatgcgcctataatcccagctactcaggtggctgagacgagaatcgctttgaacccgggaggtggaggttgcagtgagccgagattgcaccattgcactccagcctgggcaacacagcgagactgtca

SEQ ID NO: 75 - DNA, 389 bp, Homo sapiens
acatcctggagcattgcagagaatgccacccagcaaaataggagctgtccccagcaccagagagggaggccccgcccctcaaagcaccgcaggcatcagcaagcccctccctctcgtttaactaggcaccccctttgtaaagacagctgtaggcgcagtcagaaaatcacctgcatttctttccactgaagtaaaaatacatgaaatgaaatctaatcttcatgaatttttacacgcatgctgctcagggtagacattcggagttgcattttgaaggcttttctttaaatccccatctttgtttcccgggcgacgggtcccagtcgccggcggaatggcacgggcgcccccaggtgtcccgaagtgcggcgtgccggcgttgcacaccg

SEQ ID NO: 76 - DNA, 380 bp, Homo sapiens
ttttcctgcgcaggagccgcaggccgttagagcccaatggcgcccagccggaatggcatggtcttgaagccccacttccacaaggactggcagcggcgcgtggccacgtggttcaaccagccggcccgtaagatccgcagacgtaaggcccggcaagccaaggcgcgccgcatcgccccgcgccccgstcgggtccccatccggcccatcgtgcgctgccccacggttcggtaccacacgaaggtgcgcgccggccgcgctttcagcctggaggagctcagggtggccggcattcacaagaaggtggcccggaccatcggcatttctgtggatccgaggaggcggaacaagtccacggagtccctgcaggccaacgtcaa

SEQ ID NO: 77 - DNA, 143 bp, Homo sapiens
cagacttcaggcacagaccacggacgcttttgtttcctggagttgaggaggtgaccgagacttgggcttttcagccacccgttacgcatttccttcaagccggcccttttaatttgacgtacaacgttacagaaaaagcaagg

SEQ ID NO: 78 - DNA, 179 bp, Homo sapiens
ggacattcagactgagcgtgcctaccaaaagcagccgaccatctttcaaacaagaagagggtcctgcttgggagaaacttggcaaggagaagctcccgcgggtactacaaggaacatcggtcttgggcttcaagacacccaaggggggctattgagggcacctacattgacaaggaatt

SEQ ID NO: 79 - DNA, 109 bp, Homo sapiens
ggcgaaaggcttcatcaacaaatcagaatgaattataagggaagtaaaaaaggaatgttcaagagcgcattaccttttgatgtcaaaggaatacaattctatgctttga

SEQ ID NO: 80 - DNA, 124 bp, Homo sapiens
ctcgtcggaggaacttgagctggtgagagttcatcagtcagatcgtggatacgctggacgtgtcagccaagctggcccaggttgggctgggtgcagtacttcaagctctgtgcgccaagagttc

SEQ ID NO: 81 - DNA, 104 bp, Homo sapiens
gaacccacgaggactctctcattgagatcatctgctccagacccaaccaggagctgcaggaaataaacagagtcttcaagggaaatgtacaggactgatcttgg

SEQ ID NO: 82 - DNA, 106 bp, Homo sapiens
gctcgatcccacctggctcatcagggagggtgcaggaggcttcaagaaaaggaagtcccttgaggactcactgagaggaacgtgcccgtccacttgttcaaatagc

SEQ ID NO: 83 - DNA, 163 bp, Homo sapiens
cccaagcagtccgcttcaacccagcttcttttcacccttcctgacccctcacaaaagctcttccgtgaccagacccaacccaacttgcccctggtcccaagagcagatgagcttcttgggccttccacttggtgttccatgccaggcggacctggaggtgtca

SEQ ID NO: 84 - DNA, 171 bp, Homo sapiens
cggcacgagacttccttaattgtgtactgttgtctttgtgtttgacctgtagcatctaagtactggtttcaaaagttgcctagatgagttcttttctttctttccacctcctgcaaattatgtgatttgcataatttgtacatagttaggttcatttgttagtttgtattc

SEQ ID NO: 85 - DNA, 130 bp, Homo sapiens
aagaattgataagtcagaagaggagcagagcagcagctccgtgaagaaagatgagactatgtgaagattgagtctaaggggggtgcagatgactcttcttaaggagggggacctacttggatgatgatga

SEQ ID NO: 86 - DNA, 112 bp, Homo sapiens
attacatttgactaccacaactcaacggctacatagaaaaatccaccccttacggagtgccggcttcgaccctatatccccccgcccgcgtccctttcttcataaaaatact

SEQ ID NO: 87 - DNA, 154 bp, Homo sapiens
cccaggccgtgggcccatggcgccagcggaattgcatggtcttgaggcccacttccacagggacttgcagcggcgctggccacgtggttcaaccagccggcccgtaagatccgcagacgtaaggcccggccaagccaaggcgcgcgcatcgccc

SEQ ID NO: 88 - DNA, 103 bp, Homo sapiens
gtcatctcttgggagatggataacaatagtatctccatcgtcagtctttatgctactgggctggcagttaagtaggaagttatgatccatgtatgactgagct

SEQ ID NO: 89 - DNA, 121 bp, Homo sapiens
tatcagtgggtagaggtcaaagatgctgttaaacatcctacactgcatggagcagcttctcacactaaagaatgatcttgttccacmaatatctattgcactctacttgggaaaaccctgg

SEQ ID NO: 90 - DNA, 140 bp, Homo sapiens
cgcctcctttcatccggctaatatttgctttactttccactgggagacacggtattcctccgaaacccacctcagccggctccgtgtggtccttttctggcatcgtaggaggtggcctcctgatgctcctcccaccattt

SEQ ID NO: 91 - DNA, 205 bp, Homo sapiens
tcttggctacgtgaatcaccatgtaattgcattcattgccatggttttaaaggtccgctatgtgctgtacgatgtccacacctgttttcctggaattcacacagccagctccctgcttagcatctgcccttgaggatctcaggagaatctgaaactcaacatgttcaaggcagaactcctgatctcaccctcatgtaaaatctgt

SEQ ID NO: 92 - DNA, 310 bp, Homo sapiens
cggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccgtcctcttcgagacccagtcgtgatgtggaggagagccacctccaagatggacacgagccacaagctgcactgtgaacctgggcactccgcgccgatgccacccgcctgtgggtctctg

SEQ ID NO: 93 - DNA, 210 bp, Homo sapiens
cagacacagtcaatcttcaccgaaagcccaagcctagctcatcttgctgttgattgttagattgttgatgcattctaaccacctcacacatatacacaaaatcaccatgggggatggagaggagaattagcgtttgcagcagtgtatcatctcctaataaaattaacctaatgttgctgcttcattagttggtgggagaagggccacatc

SEQ ID NO: 94 - DNA, 305 bp, Homo sapiens
ctcggggtcaccgacgatggcatggctgtggccacgggctcctgggactccttcctcaagatctggaactaatggccccacccccactgggcccaggccaggaggggccctgccatgcccacactacaggccagggctgcggggctggcgcaatcccagcccccttccccgggccacggggcctttgggtccctgccctcccacccaggtttggttcctcccggggcccccactgtggagataagaaggggatggaatgggggaagaggaggagcaggaggccctcatccttctgctgccctggg

SEQ ID NO: 95 - DNA, 306 bp, Homo sapiens
cacaatttgcgcgctctctttctgctgctccccagctctcggatacagccgacaccatgggtttcggagacctgaaaagccctgccggcctccaggtgctcaacgattacctggcggacaagagctacatcgaggggtatgtgccatcacaagcagatgtggcagtatttgaagccgtgtccagcccaccgcctgccgacttgtgtcatgccctacgttggtataatcacatcaagtcttacgaaaaggaaaaggccagcctgccaggagtgaagaaagctttgggcaaatatggtcctcccgatg

SEQ ID NO: 96 - DNA, 305 bp, Homo sapiens
agttggtccagcatattggaatccctgccagtaagatcatctgcgccaacccctgtaagcaaattgcacagatcaaatatgctgccaagcatgggatccagctgctgagctttgacaatgagatggagctggcaaaggtggtaaagagccaccccagtgccaagatggttctgtgcattgctaccgatgactcccactccctgagctgcctgagcctaaagtttggagtgtcactgaaatcctgcagacacctgcttgaaaatgcggagaagcaccatgtggagggtggtgggtgttgagttttc

SEQ ID NO: 97 - DNA, 122 bp, Homo sapiens
gtcaaatcaaaggattttatttcatttctgagaataattttgtatctcacttgctgtttctcaataatattgtataattttatttctgatttttaaaaataagcaaactgccttgacctcaa

SEQ ID NO: 98 - DNA, 302 bp, Homo sapiens
tctctttcgttgagtgtaggcgctgctaatgttaacatcgaaataatcaagcttggagcaaaccgacagcagaacaggatatgagtttacatgatttgatttgctgatgttttaaacacttagcaggagacagctatagaagccaattaaatctctccaaggtgcatagagttatctcctttgtgagaaacaatttaagggaattgcattggccctttaactgaggggagaaaagcattaggaatgaaatttcagatgcaaagtgctgatcaatcctgcctctttttgtgttttcagctttg

SEQ ID NO: 99 - DNA, 651 bp, Homo sapiens
ggcgaagcaggcttccatccaacacatccagaatgcaattgatacggagaagtcacaacaggcactggttcagaagcgccattacctttttgatgtgcaaaggaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtccttctgtgttggtgtctactgaagttatagtttacccttcctaaaaaatgaaaagtttggttcatatagtgagagaacgaaatctctatcgggcagtcagatgttctcatccttcttgctctgcctttgagttgttccgtgatcacttctgaataagcagtttgcctttataaaacttgctgctgactaaagattacaggttatagttaaatttgta

SEQ ID NO: 100 - DNA, 575 bp, Homo sapiens
gtcattctcttgggggagatggattaaacaaatgatgtattctcccatcggtcagtgcttttatgctaactagagactgggcaggttgagtagaaagtgtatgaatgccattgtatgatctgagctgaaatctggtgtgcacatacttcacactgaagcagcagaaagctctgtgaaataggtctaattattcccattttatagataacaacactgagacatagctggtaagtggtaggaccaggacttgaactcatgactctgattccaaagttcatggttgcctggctgttccatgcactatgcttagagaaaaggcaaatttctcagtctttactcacataccctgatatctaccataagaaaaagaagcaaagaggctgttacccahaatgggcccatggatcaaggtatgtgtgtaagctcctgtttatttcaacgcaccatgcccaagaacttcatatggattccttcagctcagagtcagagccaccttcaggagacagaggctgtgagcgagaaaaactttgagcccaaatctgttgaacacagtaacagagaaaattctgtttcca

SEQ ID NO: 101 - DNA, 510 bp, Homo sapiens
tatcagtgggtagaggtcaaagatgctgttaaacatcctacaatgcatggaacagcttctcacaataaagaatgatcttgtccaaaatatctattgcactctacttgggaaaaccctgggttagaggtaattagagtagataacaggaagtgaaagaatggagcaaacctgcatggcaccatggaagtagaacacacagaattttgaaaacatatagggcagagagaaggcaggattaaaaagaaaattctaagggttagagctgataactgagaagatgatggtgtcacgaacagaaacagagaaattagaaggagaatcaaatcttaaggggggccaggtgtgatggctcatgcctgtaatcccagaacattgggaggccaaggcaggcagatcacttgaggtcaggagttcaacaccagcctgggcaacatggcaaaaccatatctctactaaatatataaaaattacctggtgtggtggcacgtgcccattctcccagctactcgg

SEQ ID NO: 102 - DNA, 500 bp, Homo sapiens
tcttggcctacgtgaatcaccatgtaattgcattcattgccatggttttaaaggtccgctatgtgctgacgatgtccacacctgtttcctgaattcacacagccagctccctgcttagcatctccccttgaagatctcaggaaaatctgaaactcaacatgttcaaggcagaactcctgatctcaccctcatgtaaaatctgtcccaacctaggttcctccatgtcaatagtggtgtaaccatccacctgccctttgtcctaaacatccaacacatcagcaagtcctgccgtatcaagttcctgcatttatctctaatctttgtggccactacctaggtttaggccattatcacctctggcctggattgtgcaatagcttcctatctagtcaccctacctccactcctgtctctcccaatccattctcacagagcaatgaatgtgatcctttcataatgagaactgcttcgtatcaattatctgcctaaaccttctaatg

SEQ ID NO: 103 - DNA, 105 bp, Homo sapiens
gagtacttctagagcggccgcgggcccatcgattttccacccgggtggggtaccaggtaagtgtacccaattcgccctatagtgagtcgtattacaadtcactgg

SEQ ID NO: 104 - DNA, 120 bp, Homo sapiens
aaggattctctgtaccgcccaagggaaagccgccgttattgacaagaagcagaagtggctatatggttggccaaacattaagccgattttcccgggaaaaaaggcttaaaactacaaagg

SEQ ID NO: 105 - DNA, 145 bp, Homo sapiens
cccagctctggttccccgcctctgggctacctgcctccatggctaccctgaaccaaatgcaccgcctggggccccccaagcggccgcctcggaaggtgggccccaaggaaggccggccgcagctgaagggtgtggtcatgtgcaa

SEQ ID NO: 106 - DNA, 305 bp, Homo sapiens
aaaacggatgcatttaaaaatattttctatgtcagaattttttagatgtgtgtttacttcatgtttacaaataactgtttgctttttaatgcagtactttgaaatatatcagccaaaaccataacttacaataatttcttagggattctgaataaaattccatttctcttggatatgctttaccattcttaggggtctgtgggacaaaaatatttgtaggattttgtgtaaatacaagctttcatttttattgtgtgccaattgctattgcccaaggattgctttccatgcacatattgtaaaac

SEQ ID NO: 107 - DNA, 185 bp, Homo sapiens
tggggcccccaagggtgcaacttccttcggtcgtcccgaatccgggttcatccgacaacagccggctccaccatgccgccgaggttcgaccccaacgggatcaaagtcgtataccttaggtgcaccgcggtaggttcggtgccacttctgccctggcccccaggatcggcccctgggtctgtctc

SEQ ID NO: 108 - DNA, 432 bp, Homo sapiens
cttagacactggagactgaacactgttgctattgtctaggtgaatgatagaagaactgcatgagtatcctacaaactgggggggcctaaaacaacaggaaattactttatctcagctccacatggccttctcttctctccttttgtctcctctaaataaggacccctgccattggatgttgggcccaccaggatgatacagactgcccatctccagatccttcatttaatcacatctgcaaggtctttttttcaaatatggtacaattctcaggccctgggcattaggacatggacatgtatttttgggagccaaccttcaactgactacaaggactgtggggttggaatgaaggaagagagaggttgattcagaggcgttcagctgacactaggcatagagggatgggaggagaggcaggatatttgttaa

SEQ ID NO: 109 - DNA, 315 bp, Homo sapiens
aaacttctctcttcttttcttggttaatttctctaatgacctttcaattttgtttatcttttcaaggaaccatctttttggtttcatttacattttgtatttcgctgtttacaatttcttttagttctgctctgaattcaccactaaagaactcatccatgtaaccaataactacctgtacgcccaaaactattaaaattttaaaaggttttttatcatggagggagagattaaagcagtgtttaccagagactggagaggggaagttggggaggggaggataaagagagttgtataccaggcacaatgtgcatt

SEQ ID NO: 110 - DNA, 370 bp, Homo sapiens
gagaggtcagattgctgtcagacatggcccatgaacatggacatgagcatggacatcataaaatggaacttccagattatagacaatggaagatagaagggacaccattagaaactatccagaagaagctggctgcaaaagggctaagggatccatggggccgcaatgaagcttggagatacatgggtggctttgcaaagagtgtttccttttctgatgtattctttaaaggattcaaatggggatttgctgcatttgtggtagctgtaggagctgaatattacctggagtccctgaataaagataagaggcatcacttagataatacctggagcatcatagtggttcttaactctccaaataaggttct

SEQ ID NO: 111 - DNA, 245 bp, Homo sapiens
ctggtagcctttgcatttaacaaactagcatgaggctttttatatctaaatgctacgtgatagacaatttcagctagccacatattgtatgtatgagattcataaagactttcaatcatttcattttcagacaactgaaattttgtttagtatgtgaattctttttttgaaatgtatagtgaataggatgttgcactggtggcaattcatcatggagcataataaaattaatttgacccaataga

SEQ ID NO: 112 - DNA, 320 bp, Homo sapiens
ggcagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtgaaggaacaacacctaaacccaagagggcagcttttgcagcatccagttcatcttaagaatgtcaacgatt

SEQ ID NO: 113 - DNA, 170 bp, Homo sapiens
ctgcacgagtcacaccggagcctggggcaagacagtgattgaatacaaaaccaccaagacctcccgcctgcccatcatcgatgtggcccccttggacgttggtgccccagaccaggaattcggcttcgacgttggccctctctgcttcctgtaaactccctccatcccaa

SEQ ID NO: 114 - DNA, 160 bp, Homo sapiens
aatttggagcatgtttgtttctctctgcctggttcctctggaatttggaactatctgtgagtattcttaacatatggcaatatagttgtttccatctagtgcaataagaatccatttcttgttgcaccaggatgcaattagagagactggttgttttccc

SEQ ID NO: 115 - DNA, 280 bp, Homo sapiens
ctacaacaaagtgttcctggccaagggtaacatccccgccgagagctacaccttcttcattgacatcctgctcgacactatcagggatgagatcgctgggtgcatcgagaaggcctacgagaaaatccttttcacttaggccacccggatcctcttcttcaacacacccaaaagatgacagactacgccaagaagcgagggtgggtcctcggccccaacaactactacagttttccaagccagcagcactttggcctgcaggagggcatgccccacggta

SEQ ID NO: 116 - DNA, 220 bp, Homo sapiens
gcagtgatggttgtgtgcctgtcacagccacccacctgtgcctccccccacctgccacggccattgtcctacacccagcgcacactcctgtccacggtgcgcacgtgaacccgcccgggtacacacacctgtccctgccatggtgacaggactgtgtggggatctctgccctccctgcctgaagttccctgccattggggacctgtcacaggcacacagg

SEQ ID NO: 117 - DNA, 98 bp, Homo sapiens
aacgccggctcttcggcatacgggcaaaaagagccaaggaagccgcagaacaggatgttgaaaagaaaaaataaagccctcctggggacttggattca

SEQ ID NO: 118 - DNA, 245 bp, Homo sapiens
ggtgaaatgaaggaatgataacttgcgagtgcagaaaacaacatgaaccaagacatgatgaagtagcaaggagtaaagtagatacagtataatgaaggcaaagagtagatactagggaattggtagggaaatgagtataatcatgtttgagattgttttcctccctttgcataatttaccctcatttctaatcaaagaaaacaagggtattcagattgcctgcagcccttcaagagccatggtgt

SEQ ID NO: 119 - DNA, 300 bp, Homo sapiens
ggctgctcccagccaatgtcagagcatggcaaaggtactagagccaagccattcctgctcaacatgggagtcttctgacaagcactctgctcaggagctcagcagcctggtccactctttctcagaggtgcacagcaacctggcacttttcctagccagtcctcctttcccctctccttctataggtgggattacaggtgtgccaccaggcctggcataattttagtgatgagttctcaccatgttgctcagactggtctcgaactcctggtttcaagggatcctccgctgtgtgaggct

SEQ ID NO: 120 - DNA, 314 bp, Homo sapiens
  misc_feature 259: n = A,T,C or G
ctcgggcacgctacgagagtacaaggtagtgggtcgctacctgcccacccccaaatgccacacgccgcccctttaccgcatgcgaatctttgcgcctaatcatgtcgtcgccaagtccctcttctggtactttgtatctcagttaaagaggatgaagaagtcttcaggggagattgtctactgtgggcaggtgtttgagaagtcccccctgcggtgaagaacttcgggatctggctgcgctatgactcccggagcggcnacccacaacatgtaccggtataccgggacctaaccaccggaggggttgtcaccag

SEQ ID NO: 121 - DNA, 115 bp, Homo sapiens
gccaacatgggccgggttcgcaccaaaaccgtgaggagggcggccccggtcatcatagaaaggtactacacgcgcctgggcaacgacttccacacgaacaagcccgtttgcacgg

SEQ ID NO: 122 - DNA, 143 bp, Homo sapiens
gcatatttagctacatagggaattctctggatatttaaatgatggggcgcatgcacctgaaatgagtaggtggccaaggaatgccattttctaaagctcttcgaaataatttattagccatgtagaaggaagttgagtactct

SEQ ID NO: 123 - DNA, 110 bp, Homo sapiens
ggactggcagacttcaaaatgaaatctcgggggttctatttatttatggtcttcctgtaggaccttcgggtcagggcagaggcaggaaactaactgggtttgagtcaaat

SEQ ID NO: 124 - DNA, 129 bp, Homo sapiens
gtcgtagttccgaccataaacgatgccgaccgcgatgcggcggcggttatttccatggacccggccgggcagcttcctggacagcctcttgggtccagcccccacccgaaagtggacactggctccgcc

SEQ ID NO: 125 - DNA, 184 bp, Homo sapiens
cttttcaagatgcattccagatgaactgctaggtgagggggaagcttcatttttgtttacctgatagaatagctttcttatgagatatatataatgtgatactatgttggatattttggtcttaaagcaagactcagtggtgtatctccattaaaagctcctttaaaaagttacagagttacta

SEQ ID NO: 126 - DNA, 125 bp, Homo sapiens
ggggaacagtaacagggaagcatcttcccttgccctgggacttggggtctaggggatttccaacttgtcttctctccctggaggcataaggatctgggaggaggcttgtaacctggaacttctgt

SEQ ID NO: 127 - DNA, 207 bp, Homo sapiens
gaaaaatcagggatgagcagctttatcccatttggggtatttttgtaagtgatttacatgtgtcaattttagtaatacttttacttttttgtaacttcatccttcatatatgcttgctatacaggtatgttcatctttgtgtacagaggtttaataaattagttttcatataaaaaaaaaaaaaaaaaaaccctcgggggtcctttg

SEQ ID NO: 128 - DNA, 210 bp, Homo sapiens
ggggaccagtgtgctttgaaaccaaattaggaacacattccttgggggaggcaaagttttctggggacttgatcatacattttatatgggtggggcttctctcttcgggagatgatatcttgtttaaggagacctcttttcagttcatcaagttcatcagatatttgagtccccactctgtgccccaaataaatatgagctggggattaa

SEQ ID NO: 129 - DNA, 115 bp, Homo sapiens
ggatgatccacctgcctcagctgggattacaggcgtgcagcccaaacccgggccaagaatgtgttttcaacatcatgtctacgttatagggcatctgtctcatgaggcctcatca

SEQ ID NO: 130 - DNA, 224 bp, Homo sapiens
taaataaaatgtaaaaaggccactcccaggtaaaatccagggggaagagtcatctaagtttaccatgcagttgttttaccaaaaaatagaggaggagagtcttaacttttgctcttggatttaagtcaaggtactgtatagaagttgtgtaaaacagtatgaaagttcaatgttgctgttcttgctcagtgattttaaagaaattgagtagtccctatgtgaat

SEQ ID NO: 131 - DNA, 246 bp, Homo sapiens
gcagccaggtgaggctctctagtttaataaaaatcatggaaagactcttaatgcagactcttcttaaggtgttaataggggatttttttcaagctttatttttggttgccagtttccaattttttaaaaaatgttgagggtaatctttcccaccttcccaaacctaattcttgtagatgccattagtgttgaaccaatgctttctcatgtctcaatctttgtatatgcatcttttcagatgtatta

SEQ ID NO: 132 - DNA, 160 bp, Homo sapiens
gcctcttctatacagtttcttcaatctcatttcagatcatatttctgtaataattaaggcttttgagaaggaccatccctatataattgtaagacacacattttaaagcattagaattgaaaaatgaaaaccctttaggcatttttgagcaatattttcc

SEQ ID NO: 133 - DNA, 220 bp, Homo sapiens
ccaggatcttgagctttagtgtgctatacctatgtgtcttatcgtgggccactgtgccaataaacaaaaaacaactgtttgggtttacctcagttgcagtagttattttcatttagaagttgttctcagattattgtttcagttatatagaggattactagactagttatgaggaaccccactacattcaatggaattggtgcttaaaatctcatcgatg

SEQ ID NO: 134 - DNA, 276 bp, Homo sapiens
ctgcagcctgcagcacatcagctacccggagaacgcggacggaaagaccgctgctcagcacccccgaagaaacacggaattccagagaggcacaaggcaccgccccggcgcgcacagcttgcacttaagcggctttcctttcctaacttcaaacaaacatagggggtgggagccgaggaccacttggttgcttgcgggctttctcttagcataaaagttgggaaggaaacacacaccgcgtcaagggcccaaaggcccaaaaaagaacgcgaggtc

SEQ ID NO: 135 - DNA, 285 bp, Homo sapiens
cccattcctgcactttcagtctgagtgtattttaaggtgaaattagtctcttgcaggcagcatacagttgggtcttgttttgttttgctttttaaatttttttaatccagtcatccactctatgccttttgattggataatttaatccatttacattcaaggtaattactgaatggtaagaacttaccaatgccagcttattaattgatttcctgattgctacattgagagttaaataaattttgtattttggggggccaaattcagttcttaacaagaggttcc

SEQ ID NO: 136 - DNA, 280 bp, Homo sapiens
gtcagagtccgaggcaaaatcagtcaaggtgaaaattaagctcaataaaaaagatgacaaaggccgggacaaagggaaaaggcaagaaaaggccaaatcgaggaaaagccaaacctgtagtaagccattttgacagccatgaggagcaggatgaacgtgaccagtcagaaggaagttggacggatgatgagtgatcagtatggacctttttccttggtagaccttaattccttcctccctgttttatttctacccagtgagttatttgtatataggcact

SEQ ID NO: 137 - DNA, 286 bp, Homo sapiens
gaaattaaaaatgctggattaaatgaaacattttcataaaagtattgtggatctgacagatgatgataagaactgtgaggccaaaaccagtaagcgaatctgaaaaattcacataagctgagcgttgaagctgcttttgccctggtaaacctaacaaacttgagagtattgattttcaatgcctcatagtgtagatggggatagaaaatacaactctgcccatgatcaaggtggaagcccaccaggggacactcccattcagttgagactccctcctgccttaata

SEQ ID NO: 138 - DNA, 150 bp, Homo sapiens
gagttccctacctaagagaatgttaccacctgaacagtccttcggtgaatctgagaggagaggatggggtaaggcagaagcaccagctgtactactagaagggagcttttggtggtagatccctggtgtctccaacctcactaggtggac

SEQ ID NO: 139 - DNA, 143 bp, Homo sapiens
aagatgcaccttctgagctgccttgtgcaccctccccattaagcgtaggttaggaggtttccgggaggctgctcagctggatctggagccagctggcttttgctccgttccctggctagtctgtgcctggttcaccagggagg

SEQ ID NO: 140 - DNA, 122 bp, Homo sapiens
  misc_feature 18: n = A,T,C or G
caaccaaacgcgcttggnttgcagatgtcaaagaatctgcagagggtgctactgaagatccagccttagccaatcaccacctcattgggtgaaagttccagggctcaatccaggaccacact

SEQ ID NO: 141 - DNA, 214 bp, Homo sapiens
gtagtgctagagtgcaatttacctgaggaaggcgagtctagtgtattccactgatgaattaatttctgataggaagggtgtacagagcctaacaaatagttcagatgaagaaactaataaaacaacttagaaaagtttgttgatatattcagaaactctgaactatgggcttatgttaaatcacaggtccttggaatatgaagatgaattagat

SEQ ID NO: 142 - DNA, 454 bp, Homo sapiens
ggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttgggggggctgtgtcacccagcccgcccgtcctgtgggctgcacagctcaccttgttcctcctgccccggttcgagagcgagtctgtggcactctctgccttcatgcacctctctttctacacgtcgccttcactgtaatcacacatcctgactcgtcatttataaggagg

SEQ ID NO: 143 - DNA, 372 bp, Homo sapiens
cacataccaaggccaccacacaccacctgtccaaaaaggccttcgatacgggataatcctatttattacctcagaaatttttttcttcgcaggattttttctgagccttttaccactccagcctagcccctaccccccaattaggagggcactggcccccaacaggcatcaccccgctaaatcccctagaagtcccactcctaaacacatccgtattactcgcatcaggagtatcaatcacctgagctcaccatagtctaatagaaaacaaccgaaaccaaataattcaagcactgcttattacaattttactggtctctattttaccctcctacagcctcaggagtacttcgagtctccttcaccatttcc

SEQ ID NO: 144 - DNA, 301 bp, Homo sapiens
gccaaacagccaaattctgccattaggaagtgtgtaagggtccagctgatcaagaatggcaagaaaatcacagcctttgtacccaatgacggttgcttgaactttattgaggaaaatgatgaagttctggttgctggatttggtcgcaaaggtcatgctgttggtgatattcctggagtccgctttaaggttgtcaaagtagccaatgtttctcttttggccctatacaaaggcaagaaggaaagaccaagatcataaatattaatggtgaaacactgtagtaataaattttcatatgcca

SEQ ID NO: 145 - DNA, 342 bp, Homo sapiens
ccatcatgggtcgcatgcatgctcccgggaaggcctgtccagtcggctttaccctatcgacgcagcgtccccacttggttgaagttgacatctgacgacgtgaaggagcagatttacaaactggccaagaagggccttactccttcacagatcggtgtaatcctgagagattcacatggtgttgcacaagtacgttttgtgacaggcaataaaatttttagaattcttaagtctaagggacttgctcctgatcttctgaagatctctaccatttaattaagaaagcagttgctgttcgaaagcatcttgagaggacagaaaggataaggatgctaaattccg

SEQ ID NO: 146 - DNA, 411 bp, Homo sapiens
ctcaagtgaccacccacctcagcctctcaaagtgctgggattacagccgtgcgtcccggcccctgtgagcagtaatgattactccagagatacctaataaaggaacactttaaacactggtatgaaaaggactagcagtcctaggtaactaagccgatgattttagtagggtatctctctaatatatctcaatagaagtctagcaattttcaaataaaacaacttgaaaccagaagactacggagaagacggcaaaaatttattaaagacctagaaaatagacatggttaggcttctaggatattgctagaaagttaagggaatgacactattctcaggtaccggattatttcacagaactagataagtctctctcctttggtcctctatcttgctatactattcgtctaa

SEQ ID NO: 147 - DNA, 382 bp, Homo sapiens
ggcagaagtagagcagaagaagaagcggaccttccgcaagttcacctaccgcggcgtggacctcgaccagctgctggacatgtcctacgagcagctgatgcagctgtacagtgcgcgccaggcggcgggctgaaccggggcctgcggggaagagcacttcctgctgaagcgcctcgaaaggccaagaaggaggcgccgcccatggagaagccggaagtggttaagacgcacctccggacatgatcatcctaccgagatggtgggcagcatggtgggcgtctacacggcaagacttcaccaggtgagatcagccgagatgatcggcactacctggcgagtctcatcacctacaagccgtaaggatggccggccgcatcgggcc

SEQ ID NO: 148 - DNA, 200 bp, Homo sapiens
ggttgaactagagatggacaggttatcaacgaaacttctcagcatcacgatgaccttgaataaaaattgcacacactcagtgccagcaatatattaccagccaaggataaaaaaggaattcatatcttaaggaaccagcttttcagtgcctttctgcagtttttcaaggggcccaagttagatttggaataggaattagc

SEQ ID NO: 149 - DNA, 300 bp, Homo sapiens
ggcacgaggtcaggagcagcagtgctgtgccagctccaagcccagccctcagccatggcatgcccctggatcaggccatttggcctcctcggtgggccatcttccacaagtacttcggcagggaggggttacaagcacacccttgagcaagaaggagcttaaggagcttatccagaaggagcttaccatttgctcgagctgcaggattctgaaattccaaggcttattgaagactttgaccgacaaggaccaggaggtaaccttcaggagtatgtaccttcctgggggccttggtttgat

SEQ ID NO: 150 - DNA, 205 bp, Homo sapiens
tgaatctctcctttgcctttgagctcatgcaagatggagggttggaaagcaaaccgcggccagaagacatagtcaactgtgacctgaaatctacactacgagtgttgtacaaccttttaaccaagtaccgttacggtggaggtaggggcttccctgggcccaccacttcccaagaggttctttctgttgcggtattgaccctcct

SEQ ID NO: 151 - DNA, 215 bp, Homo sapiens
agttcggacttttcttccctctctttctaagagacctgaactgggcagactgcaaaataaaatctcgggtgttctatttatttattggtcttcctgtaagaccttcgggtcaaggcagaggcagggaaattaacttggtgttagtcaaatgccccctgaggtacttcccccagcccaggccagaagacctcctttaggttccgggcgcaggaact

SEQ ID NO: 152 - DNA, 152 bp, Homo sapiens
cagaaacctgaagttagaaggctcaacgagaacaagctatcagggctgctaaggagcaaaaaaggctaagcaagcatcttaaaaagacttccaatggctgctgctaaggcacctacaaagggcagcacctaagcaaaagattgttgaaggcc

SEQ ID NO: 153 - DNA, 204 bp, Homo sapiens
  misc_feature 35, 53: n = A,T,C or G
tcgtccaatttcggcacgttactaataaagtctangataacattatatatttnatgttgatgtagcttactgttggcaaatgtacttgtgatcagccaaagcccaaggcctttccataatattcagatggatatttctgtctcagactgtgtgtggtatttcttttttacctaaatatgtatgtctctcaattattgctgttta

SEQ ID NO: 154 - DNA, 110 bp, Homo sapiens
gcaccaagctgcagaccaaggagcatgtgattgaggccctgcgcagggcacggttcagttttcctggccgccaggaggatccacatcttaaaggaggtgggctttcacca

SEQ ID NO: 155 - DNA, 120 bp, Homo sapiens
agtgtgggtgatcagcccagatttgacgtgcactcaaagactcgagaatgcagattaatcttctttccatcccgccaattttggtttcaattggacctacaaccttaagttggcatcatt

SEQ ID NO: 156 - DNA, 110 bp, Homo sapiens
tagagcagaggaggagcggaccttcgcaagttacctacgcgcgtgactggaccagcttcttgacatgtctacgagcagcttattgaactttacaattcgtgcagggggcg

SEQ ID NO: 157 - DNA, 297 bp, Homo sapiens
caaggattctctgtacgcccagggaaagcggcgttatgacaggaagcagagtggctatggtgggcaaactaagccgattttccggaaaaaggctaaaactacaaagaagattgtgctaaggcttgagtgcgttgagcccaactgcagatctaagagaatgctggctattaaaagatgcaagcattttgaactgggaggagataagaagagaaagggccaagtgatccagttctaagtgtcatcttttattatgaagacaataaaatcttgagtttatgttcaaaaaaaaaaaaaaaa

SEQ ID NO: 158 - DNA, 526 bp, Homo sapiens
cttagacactggagactgaacactgttgctattgtctaggtgaatgatagaagaactgcatgagtatcctacaaactggggggcctaaaacaacaggaaattactttatctcagctccacatggccttctcttctctccttttgtctcctctaaataaggacccctgccattggatgttgggcccaccaggatgatacagactgcccatctccagatccttcatttaatcacatctgcaaggtctttttttcaaatatggtacaattctcaggccctgggcattaggacatggacatgtatttttgggagccacccttcaactgactacaaggacctgtggggttggaatgaaaggaagagaagaggttgattcagaggccgttcagctgacagctaggcatagagggatgggagggagaaggcaggatattttgtttatttgttcatctggtgatagacttttgggctgtttccaatttgaggctattataaataatgctgctatgaacattcccatatacattt

SEQ ID NO: 159 - DNA, 482 bp, Homo sapiens
gcagtgatggttgtgtgcctgtcacacccacccacctgtgcctccccccacctgccacgcccattgtcctacacccagcgcacactcctctccacgctgcgcacgtgaacccgcccgggtcacacacctgccctgccatggtgacaggactgtgtgggatctctgcctccctgcctgaagttcctgccattgggacctgtcacaggcacacaggacacagctggctcaccctcttctctgacagcacctgggccatccctgatagtgatcagccctgctgaggaagggttagggtgggctgcaggctggaggccagggagaggccctggaccgggcctggcatttactcaccctcctcccatcccacactgtcccggagcctccatctccacctgagccagctgggttgatgcggatttccaggcatcctcagcgggacccatggcctggggtcaccaccttcctgagctgcgtggatctca

SEQ ID NO: 160 - DNA, 179 bp, Homo sapiens
gcatatttagctacataggaaattctctggaatatttaaatgatggggcgcatgcacctgaaatgagtaggtggccaaggaatgccattttctaaagctcttcgaaataatttattagccatgtagaaggaggtgagtactctgtgttcctggaagagattgaaaaaaaaaaaaaaaaa

SEQ ID NO: 161 - DNA, 135 bp, Homo sapiens
gtcaaatcaaaggattttatttcatttctgagaataattttgtatctcacttgctgtttctcaataatattgtataattttatttctgatttttaaaaataagcaaactgcccttgacctcaaaaaaaaaaaaaa

SEQ ID NO: 162 - DNA, 100 bp, Homo sapiens
  misc_feature 38: n = A,T,C or G
ttttaagttattagatttaaaatcagtactttttaatnggaaacaacttgaccaaaaatttgaaacaagaattttgagacccataacaaaagttaaatga

SEQ ID NO: 163 - DNA, 170 bp, Homo sapiens
cagagttctgcctgtgtgtgctgggttttggcatagcctgtgtttgcagtgagagtgacttgctgtcagtcacggggcacagcctcctgttcacccactggcttcccccttcccactgaagtgtgagctctatgtttcagggcatctattaaagagtgagccacaggcaa

SEQ ID NO: 164 - DNA, 270 bp, Homo sapiens
ggagaaaacaggaggagatgttaaagtaacccatcttgcaggacgacattgaagattggtcttctgttgatctaagatgattattttgtaaaagactttctagtgtacaagacaccattgtgtccaactgtatatagctgccaattagttttctttgtttttactttgtccttgcgctatctgtgttatgactcagtgtggatgtgtttatacacattttatttgtatcattcatgtaaacctcaaataaatgcttccttatgtgaaaaa

SEQ ID NO: 165 - DNA, 295 bp, Homo sapiens
cgacagcaacgtggtcttggacacaaccatgcggggtggccgcctgggggtcttctgcttctcccaggagaacatcatctgggccaacctgcgttaccgctgcaatgacaccatcccagaggactatgagacccatcagctgcggcaagcctagggaccagggtgaggaccgccggatgacagccaccctcaccgcggctggatgggggctctgcacccagccccaagcggtggccgtcctgaggggaagtgagaagggctcagagaggacaaaataaagtgtgtgtccagggaa

SEQ ID NO: 166 - DNA, 235 bp, Homo sapiens
ggcacgagggcaggtgtgcgcaggccaagcaatggggctggacacaaggtcggtggcccaaaaagagtgctgaatttttgctgcacatgcttaaaaacgcagagagtaatgctgaacttaagggtttagatgtagattctctggtcatttcagcatatccaagtgaacagagcacctagagatgcgaccggcgagacctacagagctcattgttcggattaaccgatacatgaga

SEQ ID NO: 167 - DNA, 150 bp, Homo sapiens
gaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctcaat

SEQ ID NO: 168 - DNA, 235 bp, Homo sapiens
gcggctccatcctggcctcgctgtccaccttccagcagatgtggatcaccaagcaggagtacgacgaggccggcccttccatcgtccaccgcaaatgcttctagacacactccacctccagcacgcgacttctcaggacgacgaatcttctcaatgggggggcggctgagctccagccacccagcagtcactttctttgtaacaactaccgttgctgccatcggtaacctgacac

SEQ ID NO: 169 - DNA, 106 bp, Homo sapiens
atggttctaatcctggaaattgtgattgtgaccatgagtagaggactttcagttctaagctgataagtgtgtaggcagagaggtactttttttttgtaccccactg

SEQ ID NO: 170 - DNA, 178 bp, Homo sapiens
gtttggctctggtaactgaccttcaaagctaaaatataaaactatttgggaagtatgaaacgatgtctcgtgatctggtgtacccttatccctgtgacacgttgcctctgacaatactggtataattgtaaataatgtcaaactccgttttctagcaagtattaagggagctgtgtct

SEQ ID NO: 171 - DNA, 190 bp, Homo sapiens
ccggaaaacctctacgtgaaggaggtggccaagccgagcccgggggagggtgaagtcctcctgaaggtggcggccagcgccctgaaccgagcggacttaatgcagagacaaggccagtatgacccacctccaggagccagcaacatttttgggacttgaggcatcttgacatgtggcagagcttgggcct

SEQ ID NO: 172 - DNA, 224 bp, Homo sapiens
caaacccaaagatgttaacagtattttaagaagttgctgcagattcctttggccactgtatttgttaatttcttgcaatttgaaggtacgagtagaggtttaaagaaaaatcagtttttgttcttaaaaatgcatttaagttgtaaacgtcttttttaagcctttgaagtgcctctgattctatgtaacttgttgcagactggtgttaatgagtatatgtaaca

SEQ ID NO: 173 - DNA, 244 bp, Homo sapiens
ctagttttctgtaatttgtactttcccacactataattggcttctgttttacaaaatggtgggtggctttttcttttttgtacgtgtacaggattctgctggtacgagaggccttcctctttctgtttttaaaaaaagttttactgccatattggcattccattccctgttgccatcctcactgttacctgttttgggttctggtctactttgactttcaaagtacctccagcctcctcatacg

SEQ ID NO: 174 - DNA, 111 bp, Homo sapiens
gctgaaggaaagattgatcgccgttctggtaaaaagctggaagatggccctaaattccttgaggtctggtgaatgctgccattgtggatatggtccctggcaagcccatgt

SEQ ID NO: 175 - DNA, 121 bp, Homo sapiens
ctttgtttcttggggcaagcaggaaaatttaaatttgtacctattttggtatatgttgaggatggtttaaataaatttggtggaaaaaatggaaataaaggcatggttttgggttttccca

SEQ ID NO: 176 - DNA, 113 bp, Homo sapiens
cttcgttgccgaatttcggcacgagggcagcgcgggaggccgcacgattgccttggagttacttgttaaagacgttgaacccagccaaggagtttcgttcagagctcttggca

SEQ ID NO: 177 - DNA, 150 bp, Homo sapiens
atcacggagctgaatctgccgcagctagaaatgctcaagaaccagctggaccaggaagtggagttcttgtccacgtccattgctcagctcaaggtgggtacagaccaaggtatgtggaagccaaggactgtctggaacgtcctgaacaag

SEQ ID NO: 178 - DNA, 125 bp, Homo sapiens
tcctttttcaagtccattttggaaagatgaaggcagtgaatttcccatttcacccttgatcccaccaggaaggcaaaaaggattgttctcatcaaggaaaaccaaaggagatggcctattgacca

SEQ ID NO: 179 - DNA, 111 bp, Homo sapiens
ctcggagaagcaggggagagtggcgggccgctgaataagcttccaaaatgatgaccacaccagtttatcctattgcacagagggggactgatagctccccaaggcatcccc

SEQ ID NO: 180 - DNA, 204 bp, Homo sapiens
gggagaagaagggattttgcctctatcctgaccaatgcaagccctctggctgtgaacctcctgggaggagattgctgggtgcctgggacggcggagcagccgggtgacggccaggcggaggcgctgggcccatcccttactttcggagtcccttccacggacacgggaaggattgaccccccaaggtccaggaggtattgatgg

SEQ ID NO: 181 - DNA, 206 bp, Homo sapiens
cacagaagtctggtcacctctgggcgcctgggatggtcaccgaagagaagcacgctgtccccgtctcttcctggcttctgccagaaaatcgaacaagtgcaattaacacactgttactgccggagcctgaaactcccaggacttgtccttgatccttccagaaaccaccaggtccggcacttggagcccccgggagagggacctcc

SEQ ID NO: 182 - DNA, 221 bp, Homo sapiens
cggaggtgcaggtcctggtgcttgatggtcgaggccatctcctgggccgcctggcggccattcgtggctaaacaggccggaaggtggtggtcgtacgctgtgaaggcatcaacatttcttgcaatttctacagaaacaagttgaagtaccttgcttttctccgcaagcggattgaacaccaaccctttccgagggccctaccactttccgggccccagccg

SEQ ID NO: 183 - DNA, 182 bp, Homo sapiens
attggagagacaagagaaagggcgaatgaggcgaagaagagggttaggaaaataaatggaaccgtatcaacgaaatgtcgttaagtaatagagttagattaagtgtattaagagagttagagagagtattgaatatattcctttaagtaaaaatttctggaatatatgttcgtgaattagag

SEQ ID NO: 184 - DNA, 101 bp, Homo sapiens
gcctagtggtcctgttcaagccgagctcgatgccgttcggccgggggcgcctcggtgtgcccagatgggtgctcccgttcctccaggagcttgggggggtt

SEQ ID NO: 185 - DNA, 111 bp, Homo sapiens
acacaacgtaacaataacatatttagccaatgtagtagactgctatataatacattagagtgtcaattcattccgtttacagccccattgggtgtcaaattttttttgtty

SEQ ID NO: 186 - DNA, 195 bp, Homo sapiens
catcagaaagattcattggcatgccacaggggattctcctccttcatcctgtaaaggtcaacaataaaaaccaaattattggggctgcttttgtcacactagcatagagaatgtgttgaaatttaactttgtaagcttgtatgtgggtgttgatcttttttttccttacagacacccataattaaatatcatatt

SEQ ID NO: 187 - DNA, 157 bp, Homo sapiens
tggtttgtgctccccctactgcctatatcgacttcgcccggcagaagctagatcccaagattgctgtggctgcgcagaacttctacaaagtggactaattggggctttactggggaggatcagccctggcatgaatcaaaggactgcggagccacgt

SEQ ID NO: 188 - DNA, 283 bp, Homo sapiens
tcgtgccgaattcggcacgagggcggcgcgtggtctacgccgagtgacagagacgctcaggctgtgttctcaggatgacccagtgggagacagcagcaccagcggtggcagagaccccagacatcaagctctttgggaagctgagcacccatgatgtgcagatcaatgacatttccctgcaggattacatttcagttaaggagaagtatgccaagtaccttcctcacaatgcagagcggtattcctccaaacgctttcccaaagctcagtgtccccttctggr

SEQ ID NO: 189 - DNA, 152 bp, Homo sapiens
gtcctcttcaatcgtagatttcacactttttaaaactacccattatacctctgcaaacaaattactccccccatttcattccctattacccaataaaacgtcttaccacccctcaaagactttgtgttacaaaaagataaacaaaagcgtct

SEQ ID NO: 190 - DNA, 157 bp, Homo sapiens
ctcgtgccgaattcggcacgagcacaagcacagggagatgcgtgggctgacatctgcaggccgaaagagccgtggcctttggaaagaggtccacaagttccaccacactatttgtggctctcgccgggcagcttggagaaggcgcaatactctccar

SEQ ID NO: 191 - DNA, 74 bp, Homo sapiens
cttattaatcatacaaactctcaccatgatgtgaagagtttcacaaatccttcaaaataaaaggtaatgacttt

SEQ ID NO: 192 - DNA, 150 bp, Homo sapiens
ctccaccaaccaactttccccaacccggcaagacagcacccaactaaccccacaaagcaaaaatgggggacaatttacatggcctttggaaatattttttccttgcattcatctctcaaccttggttttatctttgacccacccgacatg

SEQ ID NO: 193 - DNA, 138 bp, Homo sapiens
cccacacgccgcgggacctccaggggcgactctagtggcctgaggagatgtatttatagggcccccagcagggctgcttcccccctcgggccggtgcccaaggatgggctcctcccggcgggggctttggccaaagct

SEQ ID NO: 194 - DNA, 154 bp, Homo sapiens
ttgggtgtttatgaagttgaagaccagattacagctgtcagaaaattcatagagatggggtttcattgaatgaaaaaaggatagccaatatgggggctcgtcctcttgagggataccggttcatcacttggccctttcccatcttggacctggg

SEQ ID NO: 195 - DNA, 129 bp, Homo sapiens
taatcacccaccatagggcatgattaacaaagcaacctttcccttccccggagtgattttgcgaaaccccccttttcccttcaagcttgcttaagatgttccaaatttagaaaggctttaaggcggccc

SEQ ID NO: 196 - DNA, 130 bp, Homo sapiens
gtggcagccatctccttctgggcatcatggccgccctcagacccttgtgaagcccaagattcgtcaaaaagagaacccaaggaggttaatcccgccaccacgttaagaccccttttttcaaaaattaags

SEQ ID NO: 197 - DNA, 117 bp, Homo sapiens
ctctatctctgtaagagataaaaaaggccatgcatcatagggcttagaagggcgagatgtcctatgtagggtggccatgccctctattgaacatatatcgtaataggagcctgagta

SEQ ID NO: 198 - DNA, 156 bp, Homo sapiens
ggcatatcctgtcggggtgacgggcccatggggcggagctcgtccgcatggtgctgaatggctaggaccttcccagtcttcccagagttcgtgcctttccctgtgtgaattttgtatctagcctaaagtttcccatgggctttcttgatctagaac

SEQ ID NO: 199 - DNA, 101 bp, Homo sapiens
ctcgtgccgaattcggcacgagcccaagaagcatctgaagcgggtcggcagctccaaagcatttggatgcttggataaattgaccgtgtgggttgtctgtc

SEQ ID NO: 200 - DNA, 137 bp, Homo sapiens
cggacattcagactgagcgtgcctaccaaaagcagccgaccatctttcaaaacaaggagaggggtcctgctgggagaaacttggcaaggagaagcttccgcggtactacaaggaacattcggtcttgggcttcaagg

SEQ ID NO: 201 - DNA, 148 bp, Homo sapiens
tctgcaccaactttctccaccgttacggcatcagagaccagcattccaatggtacataggacaggcaggtttgtacagaggacagtattgggaacacaaggcctgtattaattgccagtttgctggctgggcacagtggcttatgcct

SEQ ID NO: 202 - DNA, 528 bp, Homo sapiens
ctcgtgccgaattcggcacgaggcagcgcggaggccgcacgatgcctggagttactgtaaaagacgtgaaccagcaggagttcgtcagagctctggcagccttcctcaaaaagtccgggaagctgaaagtccccgaatgggtggataccgtcaagctggccaagcacaaagagcttgctccctacgatgagaactggttctacacgcgagctgcttccacagcgcggcacctgtacctccggggtggcgctggggttggctccatgaccaagatctatgggggacgtcagagaaacggcgtcatgcccagccacttcagccgaggctccaagagtgtggcccgccgggtcctccaagccctggaggggctgaaaatggtggaaaaggaccaagatggcggccgcaaactgacacctcagggacaaagagatctggacagaatcgccggacaagtggcagctgccaacaagaagcattagaacaaaccatgctgggttaataaattgcctcattcgtaaaaaaaaaaaa

SEQ ID NO: 203 - DNA, 450 bp, Homo sapiens
tgctttttcaagtccattttggaaagatgaaggcagtgattcccatttcacccttgacccaccaggaagcaaaaagatgttctcatcaagaaacaaggagatgcctattgaccaaaaaagcctaaataagtgttcactcaactatatctgtgagaagcttgaacatctccagtcagctgagaaccaagactcacttagaagtttgtctatgcactgtctatgtgctgaagaaaatgcctcttcctttgtcccccacacactcttcaggagtcagccaaaatccggatggtctttcatgctgagaattcctgagaagaagaatatgatgtcttcccggcaatggggaccaatttttctgaaagttttgcctggaggaatttgcagatgtattatgaacagggattagaaaaaccatttaaagagatacagcttgatccaaattgtaggctt

SEQ ID NO: 204 - DNA, 470 bp, Homo sapiens
ctcgtgccgaattcggcacgagacacagagaacaggaggaactgaggcgacagcaagagggctttaagccaaactacatggaaaatggtgataaaagaaaatgtggctgaagttacccgaagttcagcttgcagtgtaattcagaagagttaagaccagaagtactggaatcatacttcctttcaggtcaaaacattttgtgggaaatatcctgttcgtgacctaggagaaacaagacagaaaacaaatctttcttcatttatgaatttcttactccatacaagcagtttatggatgtctgggcaatcatagcacttgccatttaaaaacatgctacaggggcacattttctgtggttaaaaatgatctccagaataagtgtaaactgcagttttcctttgcattgagggttttggctttttatttgtaaattaaatcaagatgttacccaaaaaaaaaaaaaaaaaaaa

SEQ ID NO: 205 - DNA, 584 bp, Homo sapiens
ctcgtgccgaattcggcacgagggcagccatcaggtaagccaagatgggtgcatacaagtacatccaggagctatggagaaagaagcagtctgatgtcatgcgctttcttctgagggtccgctgctggcagtaccgccagctctctgctctccacagggctccccgccccacccggcctgataaagcgcgccgactgggctacaaggccaagcaaggttacgttatatataggattcgtgttcgccgtggtggccgaaaacgcccagttcctaagggtgcaacttacggcaagcctgtccatcatggtgttaaccagctaaagtttgctcgaagccttcagtccgttgcagaggagcgagctggacgccactgtggggctctgagagtcctgaattcttactgggttggtgaagattccacatacaaattttttgaggttatcctcattgatccattccataaagctatcagaagaaatcctgacacccagtggatcacaaaccagtccacaagcacagggagatgcgtgggctgacatctgcaggccgaaagagcccgtggccttggaaaggggcacaagttc

SEQ ID NO: 206 - DNA, 166 bp, Homo sapiens
ggtcaagaatgtgttgaccttcaaccgcagacccagaacggcagaagttccaagggaggccttccagctggtttggaccgaacaggtgaatggcaaagagtcctgtacaagccaagtgttgggggaatgtgtatggagggcccctggggccagaaacccttaccca

SEQ ID NO: 207 - DNA, 297 bp, Homo sapiens
aacttactcccctgtggtgagtaccgtggaaccccagcccacctcactatcatactcagcttcccctgattggcccatcccagcccctgaagctctatgccaagaaccaaagctaccggacaccacctgaaacagccacagccaaggtaggcatgcatatgaggtcttcccataccctctgggtgttgagaggtttagccacatgagggagcagaggacaatctctgcagggctgggagtgggtagggcctgaggtctcaataaaccttcagtacctgaatgaacttgcttcataca

SEQ ID NO: 208 - DNA, 154 bp, Homo sapiens
aacaataccagccttaactatgcagctcatgctgtgacatccaggggtccagggaccacccagcctctgctgagtttgttttacagggagacacagaagagctccaagctaatgcctgcaccaatccagctgtgcatgacaagctgaagacatg

SEQ ID NO: 209 - DNA, 247 bp, Homo sapiens
ctgtcgaaatgcaccatgaaggctttgaggtcgaaggctcttccttggggacaaatgtgggcttcaatgtcaagaatgtgtctgtcaaggatgttcgtcgtggcaacgttgctggtgacaacaaaatgacccaccaatggcagcagctggcttcactgctcaggtgattatcctgaaccatccaggccaaataagcgccggctatgcccctgtattggattgccacacggctcacattgcatgccac

SEQ ID NO: 210 - DNA, 617 bp, Homo sapiens
gtcaagatgtgtgacttcaccgaagaccagaccgcagagttcaaggaggccttccagctgtttgaccgaacaggtgatggcaagatcctgtacagccagtgtggggatgtgatgagggccctgggccagaaccctaccaacgccgaggtgctcaaggtcctggggaaccccaagagtgatgagatgaatgtgaaggtgctggactttgagcactttctgcccatgctgcagacagtggccaagaacaaggaccagggcacctatgaggattatgtcgaaggacttcgggtgtttgacaaggaaggaaatggcaccgtcatgggtgctgaaatccggcatgttcttgtcacactgggtgagaagatgacagaggaagaagtagagatgctggtggcagggcatgaggacagcaatggttgtatcaactatgaagcgtttgtgaggcatatcctgtcggggtgacgggcccatggggcggagctcgtccgcatggtgctgaatggctgaggaccttcccagtctccccagagtccgtgcctttccctgtgtgaattttgtatctagcctaaagtttccctaggctttctgtctcagcaactttcccatcttgtctctcc

SEQ ID NO: 211 - DNA, 228 bp, Homo sapiens
aaccactgcagctggcgtggctgtgggctctgctgtggggcacacattgggtcacgccattactgggggcttcagtggaggaagtaatgctgagcctgccaggcctgacatcacttaccaggagcctcagggaacccagccagcacagcagcagcagccttgcctctatgagatcaaacagtttctggagtgtgcccagacccagggtgacatcaagctctgtgaggg

SEQ ID NO: 212 - DNA, 251 bp, Homo sapiens
accagggagattaaggacctgaagctgaagggtgatggacctccgtgggaaggttcaagcgcccgacccctccgtcgaagtccgtgtctcggctgaggccatgctccgggccctgctggctccaagcacaaggtgtccatggatctgccgggccaacctaaagtctgtgaggagggaggacacagagagggagcggcctgtggaggtgggtgactggagaaagacgtggagccatgtctggcatgcaggcc

SEQ ID NO: 213 - DNA, 95 bp, Homo sapiens
tgccgaattcggcacgagcaaaggatacaatttctcagtcctgtctgttcttattgatgtcctttacagttaataaatttgagcacactaaaaca

SEQ ID NO: 214 - DNA, 109 bp, Homo sapiens
ggaaagcaggagagcttgctttgtggacacagcctggcaggaagaattttactgccttaggccccactgatcatcccagaaccgatgattatcgtagtgtatttccacc

SEQ ID NO: 215 - DNA, 101 bp, Homo sapiens
cactgaagaacatcacctaagagcatttatttttgcaccagtatgggacaacattgacgtgcattgcaccatcatgactgcaccgaggccagtggccaaag

SEQ ID NO: 216 - DNA, 118 bp, Homo sapiens
gtggactggggctctgagtccacctggctccccctgcatgccccggggtcccaccctctcccgacgaccttccgagccgcgggttacttgccctgtccctcaagtacgtccccgccgg

SEQ ID NO: 217 - DNA, 120 bp, Homo sapiens
attttcagggtgctatcggacatcatgacaagacacggggatttcagaagacgtattgtcaccaaattcatactttgtcatcatctttgcactatcatgcatcacagtgcattcacacgt

SEQ ID NO: 218 - DNA, 301 bp, Homo sapiens
ctggaatagtgagttgggaggatgcggagacagctagccaactgcattaccaaaccatattgcacttttcagttccctagttttctaggtcagcttcgattccctgactaggaggatgatgatatctaggcataacctagcctgtcgaggaccctagttcaggacagacaactgacatttattgcaatatcatgcactagtccttacatatgtcatattttcgattatagacatcagtagcacacagcatcttggggattttcatctgacttccctggccatcttatcccatccttgcact

SEQ ID NO: 219 - DNA, 193 bp, Homo sapiens
gtgtgatggtgcatgcctgtcatcccagctcctcagtaggctgagacaggagcatcacttcgacgtgggaggcagaggttgcagtcagccgagattgcaccaccgcactccagcctgggtgacacagcgagacttatctcatacatcatagatagatactccagcctgggtgacagagcgagacttatagata

SEQ ID NO: 220 - DNA, 147 bp, Homo sapiens
gctaaaggagcagaggcatggagacggtcatccctgtagatgtcatgaggcgagcctgggattcaggtcaccgttgcaggcctggctgggcacagacccagtacagtgtagccgtgcatgtggtcatttgtcctgatgccagccttg

SEQ ID NO: 221 - DNA, 156 bp, Homo sapiens
gacatttttgtattttcagtagagacggggtttcaccatattgatcaggttggtcccacactcctgacctcaggtgatccacctgcacttggcctcccacagtgctaggcattacaggcgtgagccccgtgcccagccagcacacatatagtctct

SEQ ID NO: 222 - DNA, 136 bp, Homo sapiens
caactcccaatttcgtggttgacgttataaagactgactgatggcacgacaggcccttgtgttggactgtcattatccagaggatgaggttggacaagaagacgaggctgagcagttcacatcttctctatcaggg

SEQ ID NO: 223 - DNA, 241 bp, Homo sapiens
ggaggacagaaacctcccgttggagcagaagggcaaaagctcgcttgatcttgattttcagtacgaatacagaccgtgaaagcggggcctcacgatccttctgaccttttgggttttaagcaggaggtgtcagaaaagttaccacaggccagaaagcagcgccttgcttcaaaagctcagaagggtcaaaaagctccagcccagaaagcaccttctccaaaggcatctggcaagaaagcat

SEQ ID NO: 224 - DNA, 129 bp, Homo sapiens
ccaaaatctgcatgttggtgtgtgcccaggcagacttcgaggggttcgtgctgtaagacctaaaggtccttatgagattgttccaaacaaaggaaaccatgtcaagcagggccctatggtggttccatg

SEQ ID NO: 225 - DNA, 159 bp, Homo sapiens
gttccagcaggaatacttcggcagctaggctccctggagggcacggtgaagaggccttcaagccctgcagcctccgacttcctgctggctccaggaccggccgtgcgcgcggccagcagatggcgatgcaggaccagcctggcttcgaggaagcccgcg

SEQ ID NO: 226 - DNA, 170 bp, Homo sapiens
ctctggaaccattaaagagatcctgggggactgccagtcagtgggctgtaatgttgatgggccgccatcctcatgacatcatcgatgacatcaacagtggtgctgtggatgccagccagttaaggacaaagggaaacattcaattaaaggatcaattgacaacttggtga

SEQ ID NO: 227 - DNA, 112 bp, Homo sapiens
ccctctcttttacccagagacagcacatacgtgtgcacacgcatgcacacacacattcagtattttaaaaggattgttttcctaggttgccatcttcaattttaattttaat

SEQ ID NO: 228 - DNA, 182 bp, Homo sapiens
ctgaactgtgtctaagggtcggtcggtttaccacttggacgggtgctgcatcggcaaggccaaggttgaaccaccggatgggtgccaacccattcggtttgtttttggcaagcagcttttgaaaccggtaggcgcctctgtcaaaccttcaagggcattgcacaagtttgactttggggaag

SEQ ID NO: 229 - DNA, 143 bp, Homo sapiens
aacgcctgccacgcgtcggaactcggccgcgggacatccacggggcgcgagtgacacgcgggaaggagaagcagtgttctgcttggagccgatgccaaacaccatgcatttcttattcagattcattgttttcttttatctgt

SEQ ID NO: 230 - DNA, 133 bp, Homo sapiens
gaccgacaaaattccagttatttatttccaaatgttttggacacagtataatttgacacaggacaattggatacttcctctttttttggcttgttccaaccaaatacaattcaacttgctttttggttttaat

SEQ ID NO: 231 - DNA, 169 bp, Homo sapiens
aatggagtgtgtattgttccagtgacacttcagagagctggtagttagtagcatgttgagccaggcctgggtctgtgtctcttttctctttctccttagtcttctcatagcattaactaatctaattggggttcaatattggcattcaacctcggtgctggatattttc

SEQ ID NO: 232 - DNA, 164 bp, Homo sapiens
ctaggttgaagtctagattgacagacatctgaatccatgtcattcataaccccttgatctgtagtgtcatgggtcctgccgcaggaggcagttgaacctgggggtgcctgcagccttccactcctgccccgccttacccacatgctccctgttttctcatgctt

SEQ ID NO: 233 - DNA, 166 bp, Homo sapiens
cacacctggctaaaattttttttttgttgagacggattctctatgttccccaggctggtctcaggctcctgggctcagatkggtcctcctttttcaagttccaaaaggcacaagccaaagtttttaggtttttgcccttgcccatcatgcccaacaaggaggttct

SEQ ID NO: 234 - DNA, 346 bp, Homo sapiens
gccaccagcccctcactgtggttcggaggagagtcaggaagggccacgacaaagcagaaacatcggattttggggaaccgcgtgtcaatccctttttcccgcaggcttgggttgggagagacttttctgttccttgtgtaactgtgttggctgaaagactacctcgttctggtcttgatgtgtcaccggggcaactcctggggggcgggaatgggggcaggttggaagcggctccccattttataccaaaggtgctacatctatgtgatgggtggggtggggagggaatcactggtgctatagaaattgagatgccccccaggccagcaaatgttcctttttgtca

SEQ ID NO: 235 - DNA, 219 bp, Homo sapiens
agacatgggggaaatcgccagcttcgataaggccaagctgaagaaaacggagacgcaggaagaagaacaaccttgccgaacaaagagaccaattgagcaaggagaaggcggagtgaaactttcctaaagatcctggaggatttcctcacccccgtcctcttcgagcaccccagtcgtgtatgtgggaggaagagccacctgcaagatggcacacgagcc

SEQ ID NO: 236 - DNA, 120 bp, Homo sapiens
cataccacacgatcacgtgtcacgacattagcttcacatttgttcaggcaacagaaagacttcggtgaccacaccttataaaccagacagttttgtcgatcactttgggcaatttcaatt

SEQ ID NO: 237 - DNA, 135 bp, Homo sapiens
cagcaacatgctttaaccccattgtatgtttgtggccagagcatagtttcacatcttgagacatttgggacatcaaggtttcatggtagacaggtcatgcagtatatggcatttacatcattggcaattcgattr

SEQ ID NO: 238 - DNA, 186 bp, Homo sapiens
gttagcatggcaatcattacacagtcaggccacaggccatcattaccaagtagtgacacaggaaccacttttacactgttagtaggactttccactagttccacccttgttggaggccagttttggccatttcttcagggtcttggacctggaattaccatttgacccaaccatcccattactggg

SEQ ID NO: 239 - DNA, 170 bp, Homo sapiens
gcggctcggccccggcggcgctggaccccgtcgaggatctaacgcaagtccctacctgaggaactccagaagtcgcttcgatgttgaaggacgtgcagatgctgcaggacggcatcagcaagatggaaccccacccaccgaaaaggtaccacatgcaggcgattgcaatt

SEQ ID NO: 240 - DNA, 120 bp, Homo sapiens
cggcacgagtgttcattcagccttgtacctgtgctcttcaataaacctcttgggttttttgggcaggaaataaattttgggaacatttgtttgcctggttgtttcctgttgaaaaaatam

SEQ ID NO: 241 - DNA, 140 bp, Homo sapiens
ggcttatcatcattttaggcttatctattactgtgtttggactgctataatacacaacaaccgaacgtgccgggaatgctgtgtaacctgcctttgaagcactcctcagtacgttttgccaacctatgtgaatggccgtg

SEQ ID NO: 242 - DNA, 145 bp, Homo sapiens
caaaacagaccaggcacagaaagctgaaggtgctggagatgccaagtgaagtgtgtgcatttttgataactgtgtacttctggtgactgtacagtttgatatactatttttatcaagttttataaaagtgcagaattttgtttac

SEQ ID NO: 243 - DNA, 265 bp, Homo sapiens
tatgctggaatatgaagtctgagaccttccggtgctgggaacacacaagagttgttgaaagttgacaagcagactgcgcatgtctctgatgctttgtatcattcttgagcaatcgctcggtccgtggacaataaacagtattatcaaaaaaaaacggcacgagctcgtgccgaattcggcacgagagtaaaacccagcccatgaccctaacaggggccctctcagccctcctaatgacctccggcctagccatgtgatttcactc

SEQ ID NO: 244 - DNA, 310 bp, Homo sapiens
gccatgtctctagtgatccctgaaaagttccagcatattttgcgagtactcaacaccaacatcgatgggcggcggaaaatagcctttgccatcactgccattaagggtgtgggccgaagatatgctcatgtggtgttgaggaaagcagacattgacctcaccaagagggcgggagaactcactgaggatgaggtgacgtgtgatcaccattatgcagaattcacgccagtacaagatccagactgttcttgaacagcagaggatgtcaaggatggaaatacagcaggtcctagccaattgctggacaaca

SEQ ID NO: 245 - DNA, 250 bp, Homo sapiens
taaatagcctagtctggggagtcttccataaagttttgcatggagcaaacaaacaggattaaactaggtttggttccttcagccctctaaaagcatagggcttagcctgcaggcttccttggctttctctgtgtgtgtagtttgtaaacactatagcatcttttaaggtccagtgtccattgaaaccttccacatccgtgtactctctggctatatacaagtttttgggagcgagggttccctctccctc

SEQ ID NO: 246 - DNA, 200 bp, Homo sapiens
cctggtcggcagagagtagcctgcaacattcggccgtgttacgatgagtttacccctcaatcccaaacctttcctcaatgactaacaggaaagccagtatggtgaaacttaagtggggaatgagtacaagggctatcttggtatctgtagatggctacatgaacatgcagcttgcaatcaagaggattcacataggtggg

SEQ ID NO: 247 - DNA, 230 bp, Homo sapiens
cttttgggagcacggactgtcagttctctgggaagtggtcagcgcatcctgcagggcttctcctcctctgtcttttggagaaccagggctcttctcaggggctctagggactgccaggctgtttcagccaggaaggccaaaatcaagagtagatgtagaagtgtaaaatagaatagttggagtgttaattcgtgttcctttcctaacatttggatgattgtcatagggtt

SEQ ID NO: 248 - DNA, 180 bp, Homo sapiens
tactatgcagccataaaaatatgatgagtttatgtcctttgtagggacatggatgaaattggaaatcatcattctcagtaaactattgcaagaacaaaaaaccaaacactgcatattctcactcataggtggtattaacaattagacatgttgacacaggtagtggtacatcacactctg

SEQ ID NO: 249 - DNA, 300 bp, Homo sapiens
acaagtggtattggacaggagatgtcgccacaatgaatgagcagggcttctgcaagatcgtgggccgctctaaggatatgatcatccggggtggtgagaacatctaccccgcagagctcgaggacttctttcacacacacccaaggtgcaggaagtgcaggtggtgggagttaaggacgatcggatgggggaagagatttttgccttcattcggcttaaggacggggagtagaccacggtgagagataaaacatttctcaaagggaagatctctcacttcaagatccagagtcaatcgtt

SEQ ID NO: 250 - DNA, 228 bp, Homo sapiens
ctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagcttgtggagaagcggcgttcgtgagatcagttgtagctgccatcagatgccggagactctgcctctcaat

SEQ ID NO: 251 - DNA, 233 bp, Homo sapiens
ctcgtgccgcagaacatcacctaccactgcaagaacagcatttgcctattctggacggaagcagctagcaaccctcaaggaaggccctttctcatccagggcttccaattgacggtggagattccgggcaggagggcaattagcagggttcacggtacacttgccctgaagggatggtctgcacggaacatcccgttaggtggggccaagctctgtatctcggagtacccggt

SEQ ID NO: 252 - DNA, 101 bp, Homo sapiens
tgtaaatctttttattagataatgtaaagatgtatatcagtatttttggatcatgttatagattatggatatattgtttaataaataaaggtatttttggg

SEQ ID NO: 253 - DNA, 167 bp, Homo sapiens
cggcggcgttggcggcttgtgcagcaatggccaagatcaaggctcgagatcttcgcgggaagaagaaggaggagcttctgaaacagccttgacgaccctaaggttgagcttgtcccagcttcgcgtcgccaaagttacaagccgttccgccttcaagctttctttag

SEQ ID NO: 254 - DNA, 222 bp, Homo sapiens
gggcgcccagctgccaacaccaagattggcccccgccgcatccacacagtccgtgtgcgggaggtaacaagaaataccgtgccctggaggttgggacgtgggggaatttctcctggggctcagagtgttgtactcgtaaaacaagggatcatcgatgttgtctaccaatgcatcttaataacggggctggttcggtacccaggccctggtggagggattgca

SEQ ID NO: 255 - DNA, 487 bp, Homo sapiens
ggaaagcaggtagagttggctttgtgggacacagctgggcaggaagattatgatcgcctgaggcccctctcctacccagataccgatgttatactgatgtgtttttccatcgacagccctgatagtttagaaaacatcccagaaaagtggaccccagaagtcaagcatttctgtcccaacgtgcccatcatcctggttgggaataagaaggatcttcggaatgatgagcacacaaggcgggagctagccaagatgaagcaggagccggtgaaacctgaagaaggcagagatatggcaaacaggattggcgcttttgggtacatggagtgttcagcaaagaccaaagatggagtgagagaggtttttgaaatggctacgagagctgctctgcaagctagacgtgggaagaaaaaatctgggtgccttgtcttgtgaaaccttgctgcaagcacagcccttatgcggttaattttgaagtgctgtttat

SEQ ID NO: 256 - DNA, 613 bp, Homo sapiens
cactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggtaatgatggaagcaattttggaggtggtggaagctacaatgattttgggaattacaacaatcagtcttcaaattttggacccatgaagggaggaaattttggaggcagaagctctggccctatggcggtggaggcaatactttgcaaaaccacgaaaccaaggtggctatggcgggtccagcagcagcagtagctatgcagtggcagaagattt

SEQ ID NO: 257 - DNA, 496 bp, Homo sapiens
gtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccgggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaa

SEQ ID NO: 258 - DNA, 564 bp, Homo sapiens
aacgcctgccacgcgtcggaactcggccgcgggacatccacggggcgcgagtgacacgcgggagggagagcagtgttctgctggagccgatgccaaaaaccatgcatttcttattcagattcattgttttcttttatctgtggggcctttttactgctcagagacaaaagaaagaggagagcaccgaagaagtgaaaatagaagttttgcatcgtccagaaaactgctctaagacaagcaagaagggagacctactaaatgcccattatgacggctacctggctaaagacggctcgaaattctactgcagccggacacaaaatgaaggccaccccaaatggtttgttcttggtgttgggcaagtcataaaagggctagacattgctatgacagatatgtgcccctggagaaaagcgaaaagtagttatacccccttcatttgcatacggaaagggaggctatgcagaaggcaagattccaccgggtgctacattgatttttgagattggaactttatgctgtgaccaaaggaccacggagcattgaggacatttaaacaaattg

SEQ ID NO: 259 - DNA, 108 bp, Homo sapiens
atgaatcctctggcatttgtttgagatttgctctatggcctagtatgtggttgtaaatgttccatctgtgcctgaaaaaatgtatatttctaattcagtagtctctgc

SEQ ID NO: 260 - DNA, 214 bp, Homo sapiens
gtcatttgcatacgacagtagcattctgaccacacttgtacgctgtaacctcatctacttctgatgtttttaaaaaatgacttttaacaaggagagggaaaagaaacccactaaattttgctttgtttccttgaaagaatgtggcaacactgttttgtgattttatttgtgcaggtcatgcacaccgttttgataaagggccgtacccagtatt

SEQ ID NO: 261 - DNA, 76 bp, Homo sapiens
cagatacaattttcaccagtgttttttgtctaccttgctgcttctgaaaatatacatataagccttttaaaatgaa

SEQ ID NO: 262 - DNA, 100 bp, Homo sapiens
gatcatggcatgtttccactgttatacacagagtagtttcactagccctaaaaatactctatgttctacctcgtcataccttcatacttctcataatcct

SEQ ID NO: 263 - DNA, 110 bp, Homo sapiens
cgggggtttaatgtgattggccaggctggtctaggactcctgtaccatccaagtgatctgcccacacttggccttgcaaagattctggattagcaggtgtcaagtgcact

SEQ ID NO: 264 - DNA, 249 bp, Homo sapiens
aagccctttgagtcatggaaataggcaccattctctttggcaatctctttgcgagtgtcttctcgagaagacactccccgtttcactgcacttggcccacagtaaggctgtcctggggcccttgaaggcacatttttggtgctgtccaggaggagagcctagaaatcacagggaggttgccattcacttctctaggccaaactaggggaaacacctcaactgaggggcttgatcatctcccgatgtccm

SEQ ID NO: 265 - DNA, 176 bp, Homo sapiens
gccatggccctgagccactgagtatgttcattgccacccctgtccctcccctgggcacccctcactttccctgatcctgcaattaaagggttaatgtgtggcatatggaagggactcccaggaccctgtgcccagcttccatgctgactgatggttaaataatgtgattgtcttct

SEQ ID NO: 266 - DNA, 186 bp, Homo sapiens
gtcgcgcggaggcggaggcttgggtgcgttcaagattcaacttcacccgtaacccaccgccatggccgaggaaggcattgctgctggaggtgtaatggacgttaatactgctttacaagaggttctgaagactgccctcatccacgatggcctagcacgtggaattcgcgaagtgccaaagcctta

SEQ ID NO: 267 - DNA, 112 bp, Homo sapiens
gattgaagtaattgaacgttaaatagtgcaaaattggatggatggatttattactaatgtaatgtaactttgctcatgtatgttatgttcaattataccaggagcttttatg

SEQ ID NO: 268 - DNA, 259 bp, Homo sapiens
aggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagagatcaagaggtttcacattaaaattagaatttctggcctctctcgdtcggtcagaatgtgtggcaattctgatct

SEQ ID NO: 269 - DNA, 207 bp, Homo sapiens
aaaaaaagtttatgtttagtttggtagaggtgttatgtataatgctttgttaaagaaccccctttccgtgccactggtgaatagggattgatgaatgggaagagttgagtcagaccagtaagcccgtcctgggttccttgaacatgttcccatgtaggaggtaaaaccaatttggaagtatctatgaacttccataaataactttaa

SEQ ID NO: 270 - DNA, 252 bp, Homo sapiens
ttactttttaggctttagtatattatctagaaggtttggcttttgatgtggatgatgtgagcttcatgtgtcttagaatctactacaagcattacctaacatggtgatctgcaagtagtaggcacccagataaatatttgttgaatttagttaaatgaaactgaacagtgtttggccatgtgtatatttatatcatgtttaccagatctgtttagtttccacatatatgtatatgtatatttggatgactat

SEQ ID NO: 271 - DNA, 269 bp, Homo sapiens
ccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggtacaaattgcgaagagacgcagactttcctctctccgagcttctacttctaagtctgaatccagtcaagaaataaggttttttgagttacaaataaataagatc

SEQ ID NO: 272 - DNA, 109 bp, Homo sapiens
ccgcttctggcctcttggagccatgggccaaaggccaaggggatgggcagaggtctgtgtttggtctggcccagttccccatcattaaactcagcctgactgctgccta

SEQ ID NO: 273 - DNA, 169 bp, Homo sapiens
agcagctccatttctggagtctgggtcttccgaggccaggagcttgcctttaccgctgagtccagattggcaggtggactacgagtcatacacatggcggaaactggacctggcagcgaggagacccagacgctggttcgagagtacttttcctgggagggggccttcc

SEQ ID NO: 274 - DNA, 262 bp, Homo sapiens
ctcgtgccgaattcggcacgagcagggacacatggagtgcctctaactccatcctgtttgtgtctgtttctcacagctggagttgatcaaggatgatgaaaaagaggcttaggaaggagaggatgacagagacagcgccaatggcgaggatgactcttaagcacatagttgggtttagaaatcttatcccattatttctttacctaggcgcgttgtctaagatcaaatttttcaaccagatcctctcccctagtatcttcag

SEQ ID NO: 275 - DNA, 105 bp, Homo sapiens
gtttcttgggcaagcagaaaaattaaattgtacctattttgtatatgttagatgtttaaataaattgtgaaaaaaatgaaataaagcatgtttggttttccaaag

SEQ ID NO: 276 - DNA, 198 bp, Homo sapiens
ctttggtcttccacagtcatgttgaggtgggctccctggtatggtaaaaagccaggtataatgcaacttcaccccagcctttgtactaaggctcttgatagtggatatactccttttaaggttaggcccaatatagggtaatggaaatttcctgccctcttgggttccccattttttactaataaggaggcccagtgt

SEQ ID NO: 277 - DNA, 162 bp, Homo sapiens
aaactaaatcaacccaatgtctctcctacccactcaccattgctacccttctcacctctgcctcctggtggcctctatggggtttccgactcatgagatcccctatatcatgggtgtccaactttccaggatcgtaaccagctttatccgctcctgcctttc

SEQ ID NO: 278 - DNA, 209 bp, Homo sapiens
ctcgtgccgaattcggcacgaggaagattctaggaggggagggaccagcaaatctgagagaaccgtcctggggccttccttcgaggagccctctgatgtgaggagggacttgagttgagttacgctgtggtgttaggtgtcctagctacttacccggaagtccaggtgaatctcgtcataggtgactctcaggcttctaccaggatccg

SEQ ID NO: 279 - DNA, 221 bp, Homo sapiens
gaagctttgagtgaagctcttcctggggacaatgtgggcttcaatgtcaagaatgtgtctgtcaaggatgttcgtcgtggcaacgttgctggtgacagcaaaactgacccaccaatggaagcagctggcttcactgctcaggtgattatcctgaaccatccaggccaaataagcgccggctatgccctgtattggattgccacaaggcttcacattgcgtg

SEQ ID NO: 280 - DNA, 168 bp, Homo sapiens
ggacagagatggatgatggggagggggctggcctggaaggacccccagtgcaggtgacattgaagccaggtttcaaagctcccacagggagctgcccagagagagtccccaaggggcaaggtgactcgggggcaggggtaggtccttagtaggagagcttaggatatg

SEQ ID NO: 281 - DNA, 177 bp, Homo sapiens
cggacatggcccagctggaggcctgtgtgcgctctatccagctggacgggctggtctggggggcttccaagctggtgcccgtgggctacggtatccggaagctacagattcagtgtgtggtggaggacgacaaggtcgggttcagacttgctgtgaggaggaggatcaccaagtttg

SEQ ID NO: 282 - DNA, 176 bp, Homo sapiens
aggggtggggggaggggttgggttgggctcttatcttcagtggagcttaggaaacgctcccactcccacgggccatcgagggcccagcacggctgagcggctgaaaaaccgtagccatagatcctgtccacctccacttccctctgaccctcaggctttcccagcttcctcccctt

SEQ ID NO: 283 - DNA, 224 bp, Homo sapiens
cggaaggaaccgttacgggaactgaagttgcgggattaaggcctgatcaagatgacaaccctccgaaaaggcaccgaggacttcgtggcagaggcccatgggggagaaggccagttgggagccctggcttggaagtgtgttgaagtccggggcgaagagagctgagaggaaagggggttttggcaaggcgctgtgttgtgccgtgtgcgcggtgtgctggtgtg

SEQ ID NO: 284 - DNA, 146 bp, Homo sapiens
gtccaataccacctccaagccgagtcacttggtggatgcgcacactgccgaagtcaactggcctctcattcaagtccctacagcgaatttattctagccaccgctctgcgggtaagaccgtagctgtgtgggatctggcgtgagcc

SEQ ID NO: 285 - DNA, 183 bp, Homo sapiens
gaccaggagcgttttgataacagttacctctctgcgtgacagtggtccctctccccggacttgcacttgttccttgtttcctctgggttttatagtgatacagtggtgtcccggggccaggctgcgctctgcccagcccagcctacagtccggataaaggtgcggcatcctgctggccctgca

SEQ ID NO: 286 - DNA, 110 bp, Homo sapiens
cttaacatggtcgctgagctagccacggactgatcggagccccttggggcgttgctcggattggcagcgcagcgacctgccagccagcttcatctcccagggcccccatt

SEQ ID NO: 287 - DNA, 129 bp, Homo sapiens
tgaaactctgccaccctgatgtggaagatgttggagactacttgaattgacccctaatccattgtcttgcatccattaggacgtccaataaatgggtttttctgtcaacatttgtagactatgtcgata

SEQ ID NO: 288 - DNA, 315 bp, Homo sapiens
tcgtactacacgacacgtactacgttgtagctcacttccactatgtcctatcaataggagctgtatttgccatcataggaggcttcattcactgatttcccctattctcaggctacaccctagaccaaacctacgccaaaatccatttcactatcatattcatcggcgtaaatctaactttcttcccacaacactttctcggcctatccggaatgccccgacgttactcggactaccccgatgcatacaccacatgagacatcctatcatctgtaggctcattcatttctcttacagcagtaatattaataattt

SEQ ID NO: 289 - DNA, 181 bp, Homo sapiens
agaagaaccaagttgcattattaatctgccctgtggttttttccttttaacaatcagtttgagctgctgctgttatgagtttctcatcaagatgaaagccctaatatgtaaaggtcaaatccgagtttaaattttgtgcttttataggaaagaatttcttcataggcggggtgatatatca

SEQ ID NO: 290 - DNA, 174 bp, Homo sapiens
cggcacgagcttgtgctaggcaggccaccgctgtgactgggcttccggccctttccactacgttggaagaagaaaacctatttttcaatgtaaataaaatatcttggtagcctctcttggaaaccttgccccgtttaagaaagttggcattgtccctttgaaaggggccaagaa

SEQ ID NO: 291 - DNA, 260 bp, Homo sapiens
gtggagccgccaccaatatgcagatttttgtgatatcccttacggggtagaccatcaccctcgaggtttaaccctcggatacgatagataatgtaaaggccaagatccaggataaggttggtattcctcctgatcagcagagactgatctttgctggcaagcagctggaagatggacgtactttgtctgactacaatattcaataggagtctactcttcatcttgtgttgagacttcgtggtggtgctaagataaggaga

SEQ ID NO: 292 - DNA, 186 bp, Homo sapiens
cttctctggccaaagtctgtgccaaccgcaccaccatcgtagtggcacacaggctctcaactgtggtcaatgctgaccagatcctcgtcatcaaggatggctgcatcgtggagaggggacgacacgaggctcttttgtcccgaggtggggtgtattctgacatgttgcagcttcagcagggacagg

SEQ ID NO: 293 - DNA, 181 bp, Homo sapiens
ctccacaagtatctgaagatgggaaagcccatcctttcaaaatcaacttagaatcagaaccacaggaattcaaacccattggtaccgcgcacaacagaagggcccagccttttgttgcagctgcaaacattgatgacaaaagacaggtagtgagcgcttcctataactcgccaatttggct

SEQ ID NO: 294 - DNA, 102 bp, Homo sapiens
cggaggtggcagccatcttcttctcggcatcatggccgcccttagaccccttgtgtaaggccaagatcgtcaaatagaggaccaaggaggttattccgcaac

SEQ ID NO: 295 - DNA, 118 bp, Homo sapiens
tgaggtttggaaaggaatcaagaaacggcagacagacttagggttgcagacacatatttttttcaggcttggtgacgagaaaatctagagacaatgagggacataaattggccttgca

SEQ ID NO: 296 - DNA, 152 bp, Homo sapiens
ctcgtgccgatttttatagaagctattacaactgataggctagcttcatgggtattgatgatacattgcttaaccatactaacagctgctttccctctcttaattgtaaaaaggtgaatgaaggttcacttgatgtgagacatactatatat

SEQ ID NO: 297 - DNA, 96 bp, Homo sapiens
gagtacttctagagcggccgcgggcccatcgattttcacccgggttgggtaccaggtaagtttacccaattcggcctatagtgctaggcgctattw

SEQ ID NO: 298 - DNA, 116 bp, Homo sapiens
ggcccatgtgcccactgtctcttccacttcgtctaggattgcgcaggcactacctccttacttgagggcacaggatgacttccccaaggaaagaaaccgaatagtgtgagggtgat

SEQ ID NO: 299 - DNA, 172 bp, Homo sapiens
ccaccctgcaccttggtgctccgctctcagaggttggatgcagatcttcgtgaagaccctgacttgtaagaccatcaccctcgaggtggagcccagtgacaacatcgagaagttcaaggcaaagattcacagatatagggagggcatatccttctctatcagacagagggtt

SEQ ID NO: 300 - DNA, 184 bp, Homo sapiens
gcacacgaggaacatgctctctcgcaaaggatcttcttcatccctctttcagaagaggagaagagggaaacacaaggagaaacggctggtgcagagccccaattcctcacttcatgggatgtttaaattcccaggatgctatatacatcaccacgggccttttaggcatgtcacaaacgggtag

SEQ ID NO: 301 - DNA, 212 bp, Homo sapiens
tttatttaaaaatagcagtagtaaaccaagtacacattaacataaatacttttaaaaaacatatttttaaaaactgagaacagcagcattgtttacattttgcaaatctcattgtctggcttaacaaaagtggctgtattctcagagtctacttctgcattcaatccattttgatatgctgttttggctggagtatattacaaactcttacc

SEQ ID NO: 302 - DNA, 570 bp, Homo sapiens
gatcatggcatgtttccactgttatacacagagtagtttcactgccctaaaaatcctctgtgttctgcctgtcatcccttcatctcctctaatcctggcaacattttttctgtctccatagttttacctttgatcttttatatcatatagttgaaattatacagtgtgtagccttttcaaattgacttctttcacttagtaatgtggatttcagtttcctccatgtcttttcatggcttgataatgcatttctttttagagccaaattatgttccatcgtctggatgtttatttattcacctactgaaggactgttggatgcttccttttggcaattatgaggaaagctgttataaatatctgtgcaggctttttgtgtggacataactgaaatatttttaaagttatatttattgaggtataatttacattcagtaatagtcacactttttagtgtagagttctgagttttgacagttgtatctaatcatgcaatcaacaccacaatcaagatgaagaacaggcccctcacttccctaacttctttcctatccctttttagtccttttc

SEQ ID NO: 303 - DNA, 440 bp, Homo sapiens
aagccctttgagtcatggaaataggcaccattctctttggcaatctcttggggagtgtcttctcgagaagacactccccgtttcactgcacttggcccacagtaaggctgtcctggggcccttgaaggcacatttttggtgctgtccaggaggagagcctagaaatcacagggaggttgccattcacttctctaggccaaactaggggaaacacctaactgaggggcttgaacatcacccagatgtccatgcagcgctggcctgtcccctgaggcctgcttacctggcttagtaccatggtcagctcctgggaatcattccctcctggaagatgagacgaccctgtgttcattcagatcgggctcccagcagtgtgcattgtgacgtcttctgggtgtcatcctgctgggcagcctccatgccagtgtctcctgtgttcc

SEQ ID NO: 304 - DNA, 330 bp, Homo sapiens
gcttgacgtacttgcagttaactgtgcaaaattggctggctgcctctgttcctactgtactgtaactttgatcatgtctgttcctgttccattctcccaggagcttctctgcagactgacacaccctcccccaccccgggtagtggagatgctggtgtctgggtagtcatggatttctgctggacatttgaatgtgataaacaatccagcattacttaggaaatgctacatgcggaatgtgcacgtttccaggggcgagtattgtcaatcaaaaggtttgcaatgatttccttcctgccaaaaataaacatgtgaaactgcaaaaaaaaa

SEQ ID NO: 305 - DNA, 250 bp, Homo sapiens
cgaccaggagcgttttgataacagtgacctctctgcgtgacagtggtccctctccccggacttgcacttgttccttgtttcctctgggttttatagtgatacagtggtgtccccggggccaggcgcgctctgcccagcccagcctacagtgcggataaaggtgcggatgctgctggccctgaaaaaaaaaaaaaaaaaaaaaaaaaaaaaaaaaaaaaaaaaaaaaaaaaaaaaaaaaaaaaaaaaaaaa

SEQ ID NO: 306 - DNA, 390 bp, Homo sapiens
tcgtgccgaattcggcacgagccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctctttctagggacaatgtgggcttcaatgtcaagaatgtgtctgtcaaggatgttcgtcgtggcaacgttgctggtgacagcaaaaatgaccaccaatgggagcagcttgcttcactgctcaggtgattatcctgaccatccaggccaaataagcgccgctattcccctctattt

SEQ ID NO: 307 - DNA, 325 bp, Homo sapiens
agaaggccccgtgatacaagaatcagctgaaccaagccagttggaagttccagccacagaagaaataaaagagactgatggaagctctcagatcaagcaagaaccagaccccacgtggtagacctcttccctcctaggcttaaagtatcagtggttgagaagagcttttcggacctgttactacccaagctgtgtaatatacttgtataacagaaataccttctatacaaacctctttttctacttttagatagatatgtctactctttcagcagttctgtgtattaaagagcagagtgactctggcttcgaatagctggtgtac

SEQ ID NO: 308 - DNA, 255 bp, Homo sapiens
gctctcttccaggacatcaagaagccagctgaagatgagtggggtaaaaccccagacgccatgaaagctgccatggccctggagaaaaagctgaaccaggcccttttggatcttcatgccctcggttctgcccgcacggacccccatctctgtgacttcctggagactcacttcctagatgaggagtgtaagcttatcaagaagatagggtgaccacctgaccaacctccacaagctcggtgccccgaggcttgg

SEQ ID NO: 309 - DNA, 110 bp, Homo sapiens
caaaacgaagaagaactgattgggcttccacagccctcctctcccaagaaatccaggctcctctcccaagaaatccaggtcgctttccagacttcaaacggcgatcttac

SEQ ID NO: 310 - DNA, 220 bp, Homo sapiens
ggaagatgaacgggcggaagcagagtctcgcggagctcatcggcactctgaacgcggccaaggtgccggccgacacgaggtggtttgtgctccccctactgcctatatcgacttcggccggcagaagctagatcccaagattgctgtcgctgcgcagaacttctacaaagtgactaatgggggttttactgggagatcagccctggcataatcaaagact

SEQ ID NO: 311 - DNA, 130 bp, Homo sapiens
aaaaaggggaattcaattacacgagatacacgcaatcataaacaatgagccaaagacaaagagtacctaacagaacttagccataaactttcaggtacaatgtacttatccttcttttattcatccagac

SEQ ID NO: 312 - DNA, 119 bp, Homo sapiens
gcaagcattcatttttagctcgctcattttttaccatgttttccagtctgtttaacttctgcagtgccttcactacactgccttacataaaccaaatcacaataaagttcatattcagt

SEQ ID NO: 313 - DNA, 129 bp, Homo sapiens
catcatggacaccagccgtgttgcagcctttcaagctggccagggtcaccaaggtccttggcaggaccggttccttagggacagtgtcacggaggttcgcgtgtggaattctatttggacggcacgggg

SEQ ID NO: 314 - DNA, 116 bp, Homo sapiens
cctgcggctgttggatttgggaatgaccttggtgagagtctcactgctccagggtctctttttggtccaaaggctaggacctatagaagttggatcacatttttttctttcccggt

SEQ ID NO: 315 - DNA, 113 bp, Homo sapiens
ccccgaggtgttacagaaatagatatgaagttgttgcctggacttgcataccggcaagattggcattgggtatatttaaaattcctcctttatatggcctggtttatatttcc

SEQ ID NO: 316 - DNA, 126 bp, Homo sapiens
ctcggtgatttaactggacctccggacccattggcgcagaatatgcacctgttttaggttaccccccagctcacatatgcatgcgagatttgctgagactgggggaaaggataaatccgacgttct

SEQ ID NO: 317 - DNA, 180 bp, Homo sapiens
ctgaccaataactaggtcaatctcaagttgaatgaagagtgaccatcattgcatcttcaccttgagataatagagaagttagatgtcataattgtgctaactatgttttaccatcaatacatcataacctcttttcaatgcattaagtacacaacatgtctgggcacacatgcatcaaca

SEQ ID NO: 318 - DNA, 260 bp, Homo sapiens
actatgcgctgcccctgggccgcaagaagggagccaagctgactcctgaggaagaagagattttaaacaaaaaacgatctaaaaaaattcagaagatatatgatgaaaggtaaagaatgccaaaatcagcagtctcctggaggagcagttccagcagggcaagcttcttgcgtgcatcgctttcaaggccggacagttttggcccaccagatggctattttctagagggcctaaggttggagttctatcttagggaaatc

SEQ ID NO: 319 - DNA, 110 bp, Homo sapiens
tttttagagaatagctttatcttggttcaactctttagttttatttcgaggcgcacacaaaaatatcttgcaagcagaaccttggcaaacaaaagccatgaacacttatt

SEQ ID NO: 320 - DNA, 270 bp, Homo sapiens
gccacgtgttgctcagacagggtgtgctgggcatcaaggtgaagatcatgctgccctgggacccaacctggtaagatttggccctaaggaaggcccctgccctgaccacggtgagcatttgtggaacccaaagatgagatacttcccaccacccccattttaagaacagaagggtggggaagccagagccgcctcccatgcccaccagtcccacagcataacagggtctccttggcagctgtattctggaggctggatgttgctctctta

SEQ ID NO: 321 - DNA, 195 bp, Homo sapiens
gagaaatattctcttaaaatgacctttgttttaatctcattcatgatgttgattttttcaatgtggtgcaatatatacaataaaatttgtcataactattttaagtgtacagttcagtatattacatatgttcataagttgttacaaccatcaccaccatccatcttcagaattattttcatcttatacaattga

SEQ ID NO: 322 - DNA, 210 bp, Homo sapiens
gtcttaaaagtaatctctgccttatctctgccttattgctttggactcaactgccacaccaaaggatattggatatggcttttatactgcctgccaaccagagataaatcaagcaagttttggaggatttaattcctgataacacaaactttgcagaatgggaggaaaatatttgcaacctacctctctgacaaggggtttataacttgg

SEQ ID NO: 323 - DNA, 335 bp, Homo sapiens
gaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccatttcttcgccaggccaggtatcacaagctccgggtggataaggcagctgctgcagcagggccactacaagccaaatcagatgagaaggcggcggttgcaggcaagaagcctgttgtaggtagaaaggaaagaaggctcttttggttttaagagcagaagaagcctcttgttggaaaaaagcagcactaccaggaa

SEQ ID NO: 324 - DNA, 321 bp, Homo sapiens
aggttgtaccttcataaggtggtatggggggttggggtcaggccctgaacatcgtcctacttgagaatctgtcaggggaaaaagtcaaggggagcaggaggaagagccaggagggccagagcagaagaagagatggagtcttaggggccagggtgagccaggggtccagggcctagaggtgcttcctgggggcgggggaattcagccagtgtccccctcccctcttccaccccagctccagccctggtcttgtcttttcatccctcttccccacgacagaagaagttgttgccctcgcaatcgtcatcgtgttcctgtgtc

SEQ ID NO: 325 - DNA, 305 bp, Homo sapiens
gcaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaggtggggcttcaccaagttcaattctgatgaattttgaagacatggtggcttaaaagcggctcatcccagatggctgttggggtcagtacatccccaatcggggccctttggacaagtggcgggccctt

SEQ ID NO: 326 - DNA, 330 bp, Homo sapiens
tttgcttaggcgcagacgggggaagcggagcaaacatgccagtggcccggagctgggtttgttcgcaaaaacttatgtgaccccgcggaggaccctttcgagaaatctcgttctcgaccaagagcctgaagctgatcggcgagtattggctccggaacaaacgtgaggtctggagggtcaaatttaccctggccaagatccccaaggcgcccgggaacttcttacgctttatgagaaggacccacggcgtcttttcgaaggaacgccctcctcggcggctggtcccattggggttctgatgagggcaagatgaagctggattacatcctg

SEQ ID NO: 327 - DNA, 339 bp, Homo sapiens
cgatgacccaaacctgctcagcctggacgcctacgtgttcaacaccgaagcccaccctctgcctatctggacccctgcctagggtgggatggcttgctggtgtggggacttcgggtgggcagaggcaccttgctgggtctgtggcattttccaagggcccacgtagcaccggcaaccgccaagtggcccaggctctgaactggctctgggctcctcctcgtctcttctttaatcaggacaccgtgagacaagtaaggccgtcagtctttgtgttatgcggggtggcttggcccttggagcctccccttgcttcctccagaggcacgaattatgcttacg

SEQ ID NO: 328 - DNA, 231 bp, Homo sapiens
ctgccaggccctccagcaggaggacagagtgccctggggcatccaccttctgcccaggggacgtggcgctgtcggtgtttggaggctgctgccccctggcttttggcgccccatgggccctcagcgtctccccatgctgggctcactacatgggccagcccttgctctaccctggccggtagtggctgggcgcctaggttgtgttgagagggggatgccctggccctgcct

SEQ ID NO: 329 - DNA, 160 bp, Homo sapiens
gtgagaagcttcatttagtgtttaaaaatgtggggagataaatcagacttaacatgtatgtaagatcaatttcacttaaaagtattggtccaaatagcaaaaatagggccaggtgaaacatgtagtcatttttttaaaaacatgtacttgggctttgtgt

SEQ ID NO: 330 - DNA, 138 bp, Homo sapiens
gacatctctggtgttcccaccaccctagatgaaaatccacagcacagacctctaccgtgttttctctttccatccctaaacccacttcccttaaaatgtttggatttgcaaaggcaatttgggggcctgctggagcct

SEQ ID NO: 331 - DNA, 158 bp, Homo sapiens
cggcacgagcgcgagtgggagcaccaggatctcgggctcggaacgagacttcacggatttgtttaagaaaatggcagacaaaccagacatgggggaaaatcgccagcttcgttaaggccaagctgaagaaacggagacgcaggagaagacacctcccg

SEQ ID NO: 332 - DNA, 420 bp, Homo sapiens
aaaaaggggaatttcaattacatcgagttcacacgcatcctgaaacatggagccaaagacaaagatgactgaaagaactttagctaaaatcttccagttacattgtcttactctcttttacttctcagacacttcccccaccctcatagaacctgttgcatgcaacttagtttcacagctttgcctcttctttttgatgtatttattccagacctttctgccacttagcacttgtataatcagactggaaatggggatgagggtgtaaattgtattgaaaaagatcgcgaataaaaatcaacaaatgtgaaagcccagaaaaatatattcgtatttctggttttgctggatttttacatttttatataataaaaatgttattttgaaataaaaaaaaaaaaaaaaaaaaaaaaaaaaaaa

SEQ ID NO: 333 - DNA, 290 bp, Homo sapiens
cccagggaagaaacggaatagtgtggggtgtgtgcagggctgcatcccgcagatggctggaatattaaaattcttctatattggctggtaaattgccatggccctgagccactgagtatgttcattgccacccctgtccctcccctgggcacccctcactttccctgatcctgcaattaaagggttaatgtgtggcatatggaagggactcccaagaccctgtgcccagcttccatgctgactgatggttaaataatgtgattgtctcctcaaaaaaaaaaaaaaaaaaa

SEQ ID NO: 334 - DNA, 507 bp, Homo sapiens
ctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattgggcatttaagtttagtagtaaaagactggttaatgataacaatgcatcggtaaaaccttcagaagg

SEQ ID NO: 335 - DNA, 149 bp, Homo sapiens
attggattgccacacggctcacattgcatgcaagtttgctgagctgaaggaaagattgatcgccgttctggtaaaaagctggaagatggccctaaattcttgaagtctggtgatgctgccattgttgatatggttcctggcaagcccat

SEQ ID NO: 336 - DNA, 181 bp, Homo sapiens
caagagtgtgaggccagagaactttgagctggtgaagaagttcatcagtcagatcgtgggatacgctgggacgtgtcagacaagctggcccaggtggggctggttgcagtactcaagctctgtgccgccaaggagttcccctgggtcgcttcccacaccaagagggacatcaaggcggcct

SEQ ID NO: 337 - DNA, 161 bp, Homo sapiens
gttacaccaaccaggacagaaatcattatcttagccaccagaacacagaatgttcttggtgagaagggccggcggatttcgggaactgactgctgttagttcagaagaggttttgctttccagagggcagtttagagctttatgctgaaaaggtggccact

SEQ ID NO: 338 - DNA, 104 bp, Homo sapiens
tgtaaatgctgtatagatttggttttcctttctttacttaccctggtttggatttttttttttttttttgaaaatggattttatccttcttttggcaaattaac

SEQ ID NO: 339 - DNA, 194 bp, Homo sapiens
atcgtccaccgcaaatgcttctaaacggactcagcagatgcgtagtttgctgcatgggttaattgagaatagaaatttgcccctggcaaatgcacacacctcatgctagcctcacgaaactggaataagccttcgaaaagaaattgtcctttaagcttgtatctgatatcagcactgggttgtgagaacttgtt

SEQ ID NO: 340 - DNA, 195 bp, Homo sapiens
tttaaaattgattagcatcatatttccatcttattccattaaagtatgcagattatttgcccaaatcttcttcagattcagcatttgttctttgccagtctcattttcatcttcctcccatggttcccagaagcttttgtttcttgggcaagcagaaaaataaattgtaccccttttgtatatgtgagatgttta

SEQ ID NO: 341 - DNA, 190 bp, Homo sapiens
atttcagctatggagatgacaatctggctcccaacactgccaacgtcagatgaccttcctacggctgctgtccacggaaggctcccagaacatcacctaccactgcaagaacagcatttcctatcttgacgagcagctggcaacctcaagaaggccctgctcatccagggctccaatgacgtggagatcc

SEQ ID NO: 342 - DNA, 170 bp, Homo sapiens
gaaataccaccggaactggtcgaatgaggcacctaaaaattgtataccgcagattcaggcatgggattccgtgaagggaacaacacctaaacccaagagggcagcttttgcagcatccgttcatcttaagattgtcaacgtttagtcatgcaataaatgttctggtttta

SEQ ID NO: 343 - DNA, 121 bp, Homo sapiens
tcatggcacccaagtcaaaggcacatggcaagaaggtgctgacttcttggagatgccataaagcacctggattgatctcaaagggcacctttgcccagctgagtgaactgcaacttgtgac

SEQ ID NO: 344 - DNA, 100 bp, Homo sapiens
aatattctggtattattacaatgcagaatttttagtattctagctttcaaaattagtaagtcttttactgaattgtgacatttacataatgaattctatt

SEQ ID NO: 345 - DNA, 152 bp, Homo sapiens
ctgcttcgtgtttcaggacatcaagcagcctatggagagatccagttgtccaggaactgtttgtagcctcctaccaaatgccacggagtgaggtcaattttggaagtaggaacctccaaccttggtcaagcctttagctgtactacaaactt

SEQ ID NO: 346 - DNA, 100 bp, Homo sapiens
gacaccacggaggagtgatctgggctcttgcctccacctgagcctttacccttagagagcttagaccctatttaaacctacctccaatacccaaccaaat

SEQ ID NO: 347 - DNA, 270 bp, Homo sapiens
tccaggactccgaggaccaaagggccagcaaggtgaaccgggtccaaagggaccagatggccctcggggtggaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacggtgatggctcaccaggccagaagggccttcccggaaag

SEQ ID NO: 348 - DNA, 275 bp, Homo sapiens
cggcacgaggcaggacatgcctccgccggggggctatgggcccatcgactacaaacggaacttgcccgcgtcgaggactgtcgggctacagcatgctggccatagggattggaaccctgatctacgggcactggagcataatgaagtggaaccctgagcgcaggcgcctacaaatcgaggacttcgaggctcgcatcggcttgttgccactgttacaggcagaacccacccgaggcccttcagatgcttcgggagaacctggaggaggagcccat

SEQ ID NO: 349 - DNA, 145 bp, Homo sapiens
gtcctatgaaggggtgtggggtgaggtagtgaaaagggcggtagttggtggtggaaccagaaacggacgccggtgcttggaggggttcttaaattatatttaaaaaagtaacttttttgtataaataaaagaaaatggggcgtga

SEQ ID NO: 350 - DNA, 240 bp, Homo sapiens
gggactacaggtgcacaccaccatgcccagctaaccacagaaactttcatctcttcattttttcctttgggcaccatttaatacctaaggacaggtagaaagggtcccagaaagacaccattggtaatggccgattgccggctgcagtcatcgcccccagatcaggctggtacaggatgccttaaggtgatgagaggtaagggtgcattgagaatattgagcacagggagggagaagcag

SEQ ID NO: 351 - DNA, 280 bp, Homo sapiens
gcaggctgaagcgcaaaagaagaaagatgaggcagaggtccaagtaaaccgctagcttgttgcaccgtggaggccacaggagcagaaacatggaatgccagacgctggggatgctggtacaagttgtgggactgcatgctactgtctagagcttgtctcaatggatctagaacttcatcgccctctgatcgccgatcacctctgagaccaccttgctcataaacaaaatgccatgttggtcctctcccctggcctgtgacatctggactatttctgtttt

SEQ ID NO: 352 - DNA, 235 bp, Homo sapiens
agtctcggtttttttcgttgttgttgttgttgtttttctttttctttttttttttgaggacagcaattaaccacagtacatattactgtagttctctataggtttacatacattcataccataactctgttctctcctcttttttggttttcaactttaaaaacaaaaataaacggtgataatctttactggtgaaaagggtgggaaaataaatcaaccaattgcaccagtttgt

SEQ ID NO: 353 - DNA, 102 bp, Homo sapiens
taaaaactgactttctgtatttatgatagatatgaccatttttggtgttgagtagattgttgcattggaaatgaactgaagcagtatggtagatttaaaagg

SEQ ID NO: 354 - DNA, 190 bp, Homo sapiens
gccatgagcagcaaagtctctcgcgacaccctgtacgaggcggtgcgggaagtctgcacgggaaccagcgcaagcccgcaagttcctggagacggtggagttgcagatcagcttgaagaactatgatccccagaagggacaagcgcttctcgggcacctcagcttaagtccactccccccctaagttctc

SEQ ID NO: 355 - DNA, 295 bp, Homo sapiens
gccagaggatgtcagctgccaattgtgttttcctgcagcaattcataacacatcctggtgtcatcacagccaaggtttttaggttgctataccaatggcttattaaatgaaaatggcactaaaagtttcttgagattctttatactctctgccttcagcaatcaattccattcatacatcagcactctgctggttctgtttgaaatatgttctgtatttaacctcaaatctggtgggatctctgcgggcttgtgccactgagcatatttgtggagggtggacaagcttgctccac

SEQ ID NO: 356 - DNA, 150 bp, Homo sapiens
ctaaaacatatatattgagaaaaactaaatgtacatgaccagagctgaggcgagtggatcacttgatcccatgaggcggaggttacagtgagccaggatcccaccattgttttccaacctgggttacaaggagtgaaactctgtcttcaa

SEQ ID NO: 357 - DNA, 102 bp, Homo sapiens
cccatgggagtagagcccgagatacctgggccactatgtccagttctgacctcgaaatacccctaaccccgaggcccatgcaggtctggggaacatagaccg

SEQ ID NO: 358 - DNA, 107 bp, Homo sapiens
ggaaatcgtccgtgcattaaggagaggctgtcctacgtggccctgggactttcgagcaggagattggcaacgcttgctttccagcttcctccttggggaaggagcta

SEQ ID NO: 359 - DNA, 102 bp, Homo sapiens
tcctttgacctggatgccagcggctggcatccatggccacgctgctggcccggctggcgtctcttcctgtgacctggctaaggaggccttcctggcggtctc

SEQ ID NO: 360 - DNA, 107 bp, Homo sapiens
ccggcacgagctaagttttcatttgtagtacccaattacacaaaaaggttcccttttagggaaattaaaggaattcaggtgttatatatccataaccatttttacac

SEQ ID NO: 361 - DNA, 107 bp, Homo sapiens
gacagacttgaagatttcagatctataaatactgaggtggtagcatgctctgttgattcacagtttaccaatttggcctggataatacccctcgaggacaagaagga

SEQ ID NO: 362 - DNA, 107 bp, Homo sapiens
ctgccagggccagacccaggtggggacagcctgaaccctgcttccccctgtggccggacatgccccgatctttacacacattggtgaccctagagagagagaggaag

SEQ ID NO: 363 - DNA, 158 bp, Homo sapiens
aaggagcttgccatgcccggggaggacctgaagttcaacctaatcttgccggcacaaattgattctaagagaaagggccagcgtttaaccctccgagatgcaacccgacttattggaaccggtctagtaaccacaacgttggcaatgactaaaggagg

SEQ ID NO: 364 - DNA, 189 bp, Homo sapiens
acgtctgaggttatcaataagctcctagtccagacgccatgggtcatttcacagaggaggacaaggctactatcacaagcctgttggggcaaggtgaatttttgaagatccttggaggagaaacccctcggaaggctcctggttgtcttccccattgccccagaggttcctttacagattctgcaacct

SEQ ID NO: 365 - DNA, 150 bp, Homo sapiens
tacaggcagagcaggaactactgttagtcaatccctagtactcccagcaggcagagctccttaggtccggccaggactttttttcctaaatggtcttttttttaacacctttattttaacacaattgattaaatgaaggtattggaggta

SEQ ID NO: 366 - DNA, 100 bp, Homo sapiens
cgctgagctgcgattagatatgaggaggaatgctcgtacttgtgatacaagacctgctcaatgttagatggccttgaatttagattgcacctacaggagt

SEQ ID NO: 367 - DNA, 190 bp, Homo sapiens
ctgaccaacatggagaaccctgtctgtactaaaaatacaaaattagcaggtgtggtggcacatgcctgttaattcccagcttacttggggaggcttgaggcagggggactcttctggaaccttgggaggcagaggtttacagttagctgagattcgcgccatttcacttccagccttggcaacaaaagcg

SEQ ID NO: 368 - DNA, 160 bp, Homo sapiens
gtcttgagtttttttttaggagacgcggtcgtaaggctgaggattttgtcgcacgctccttcttctgactaacccctgttcgcctcttgccgaggaacaaatcggtcaagaagcccccgcgcaacaaccattgctttttagggctacccgaaaaacaccc

SEQ ID NO: 369 - DNA, 175 bp, Homo sapiens
cgcgggttcgagcccggtgtcgggcggcgtgaacttgttcgcaacgacggcagcttcctggagctgttcaagcggaagatggaggaggagcagcggcaggccaaggaggagccgcccccgggtccgcagacgaccccaacaatcggccgccgcgcttgccccggggattccaaga

SEQ ID NO: 370 - DNA, 450 bp, Homo sapiens
atgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggtttctcttggttgtagagtggcccagaattgcattctgaatgaataaagggtaaaaaaaaaaaaaaaaaaaaaaaaaaa

SEQ ID NO: 371 - DNA, 508 bp, Homo sapiens
ggacaccccacgggaggagtggcatctggggctcttggccctcccacctggagcctgttacccgttagagagctgagacccttatttaaaactcacctcccaatcaccccaaacaaatggaagagaagagaaaggacatggcgtattttgtatttaaaagtaattgtattaattatttaaagtgtggaaagcaaaataacaaaaaagagaaacgccaacaaaaatcagcagatgttgaagacaggggtctcgggggtgggctccggcacccacatcctggagtcaggactttcctcagtgactgtgtgtaggggggtttcagggctgaaccccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctcttccacttggtctgggttttggca

SEQ ID NO: 372 - DNA, 430 bp, Homo sapiens
cggcacgagctaagttttcatttgagtacccaaatacacaaaaggtgtccctttaaggaaaataaagaattaagttttaaataacattacattttacaatctgacatctggagtatattgaacataggctatttcttgatataacactcatttaattgtggccatccaaatgaatattattgcagaatttatcttgttcataatgatttgtaaatggtgttatagctgaatacctgtgcatgaaaatgggcaatattttcatctgtttacttgtagtgccatagaggccaatatgcacaatattaactaatgccaagacatggctgtttaaaaaatttaatgttcaaacagttatcactgatgcttttgcactatttattaataaaatcatatattggtgtaaaaaaaaaaaaaaaaaaaaaaaaaaaaa

SEQ ID NO: 373 - DNA, 250 bp, Homo sapiens
tcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagtaaaaaaaaaaaaaaaaaaaaaaaaaaaaaaaaaaaaaaaaaaaaaaaaa

SEQ ID NO: 374 - DNA, 542 bp, Homo sapiens
gtcctctgcaatcgtagatttcacactttttaaaactacccatgatacctctgcaaacaaatgactccccccattgcattcccgtattacccaataaaacgtcttacgacggctgaagactttttcttacaagaaataaacaaaaacgtctgacagcatagtagatgagttccatgcccaagtgctactcaattgcctgagcttgaattgaattgtgtgacttaaacgcgctctggtacaatctctgggtgccctctgaacttcaggctcttgctgtaacagtagtctgtcttgcactagagttgtttatatgtttgtctttctctttcactagattgtaagtgcaacagagcccaagacctagtcttgttcctgtttgtacatgctatagcacctaacaaggaatgtatgatgtttgttgtttcattgaatttgtgaaatataaataatagtatctattccgatcctcatgtcctcttccccacctcatcttccaatcccttgctcataaaacatgtttataaaaaaaacatccttccata

SEQ ID NO: 375 - DNA, 253 bp, Homo sapiens
cggcacgagtgttatcagcttgtactggtctcataactctggttttggaagaataatttggaaattgttgctgtgttctgtgaaaataacctccccaaaataattagtaactggttgttctacttggtaatttgacaccctgttaataacgcaattatttctgtgttcttaaacagtataaatagttgtaagtttgcatgcatgatggaaaaataaaaacctgtatctctgttaaaaaaaaaaaaaaaaaaaa

SEQ ID NO: 376 - DNA, 440 bp, Homo sapiens
cagctttctacttctttgtaagaacaccaaccaaccaaggtttaagtgattaataggcttgagcaccgggtggcagatgttctatgcagtgtggttcaagtttctttgaccgcacttatatgcattgctaatatggaatttaagataccatacacagtctctcatggacctatctctattgtagaattatgacttatgtcttacttggcaaatttttctgaatgtgacctttttttgctgatttgctgggtttgggattaactagcattattttgccacctttatattgtatttataaaaaaaaagtactatcaatcaatcatactactttggattgttgtgctggtgtaatgtggatttaacatcaataaatatttgacaaataataaaaaaaaaaaaaaaaaaaaaaaaaaaaaaaaaaaaaaaaaaaaaaaaaaaaa

SEQ ID NO: 377 - DNA, 414 bp, Homo sapiens
ttaacatggtgctgagctagccaggactgatggagcccctgggggtgtgggatggaggagggtctgcagccagttcattcccagggccccatcttgatgggccaagggctaaacatgcatgtgtcagtggctttggagcaggttaggctggggctcatcgagggtctcaggccgaggccactgcggtgccagtgcccccctgaggactagggcaggcagctgggggcacttggttccatggagcctggataaacagtgctttggaggctctggacagctgtgtggtgtttgtgtcttaactatgcactgggcccttgtctgcgtcggcttgcatacagagggcccctggggtttggccctccggcctggcctcagcagtgggatggacagggccaggcaggcctctgaacttcc

SEQ ID NO: 378 - DNA, 444 bp, Homo sapiens
atcacttcaagctacagcaatttgagctgttttgtcatttgttacataaagcaggtgataatgatctgttgccagtgattttgacttgtgtctctgggaaaacaaacaaacaaagaaagaaacaagaaagaagctctactgcgtttataaagctgtactccaaagtgattttaaaataattccaggacagtattcatggtagatgatatatattctttaacaaaaaaaattaaatattaggtagctttatggagagttgacatttttaaaacaagtaaagcaattcaccaagactgagccggccaggcatggtggctcatgcctgtaatcccagcactttgggaggctgaggcgggtggatcatgaggtcaagagattgaggccatcctggccaacgtggtgaaaccccatctctactaaaaatacaaaaaaaaaaaaaaaaaa

SEQ ID NO: 379 - DNA, 636 bp, Homo sapiens
gaggaggacaccgatgtcccagcagaaggcggcatgagaccaacgtgggagccagaagagagaggttcctggctggcccaggtctagtcccttagtcacacacgtcaaagttcatcactagggtgttagtgaagaggaaatgggaccaggcgcggtggcttacgcctgtaatctcagcactttgggagatcgaggcgggtggatcacttgaggccatgagttcaagaccagcctggccaatatggcaaaaccctgtctctacaaaaaacacaaaaaaattagctgagcatggtggtacatgcctgtaatcccagctacttgggaggctgaggcacaagaatcatttgaacctgggaggtggaggtggcagtgagccaggattgcaccaccgcactccagcctgggcagcagagcaagactccgtctcaaaaaaaaggaaatggaccctgacaccagaactgactttggatcctttactaaaatcaatgcttctcgatttttaatgaaaaaacaaacaaacaaaaccacgtggggattttattaaagtataggctctgagtcatcaaagttcccaggggatgctgatgttgctggacctcggagcacacagagagaagcacgttttggagtatgaat

SEQ ID NO: 380 - DNA, 599 bp, Homo sapiens
ctcgtgccgaattcggcacgagctgacagctggtgcgcctgcccgggaacatcctcctggactcaatcatggcttgtggtctggtcgccagcaacctgaatctcaaacctggagagtgccttcgagtgcgaggcgaggtggctcctgacgctaagagcttcgtgctgaacctgggcaaagacagcaacaacctgtgcctgcacttcaaccctcgcttcaacgcccacggcgacgccaacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatgggccccaataaaggcaagctgcctctgctccctctgaaaaaaaaaaaaaaaaaaaaaaaaaaaaaaaaaaaaaaaaaaaaaaaaaaaaaaaaaaaaaaaaaaaaaaa

SEQ ID NO: 381 - DNA, 550 bp, Homo sapiens
tgacagtcgcagtgccatggaggagcccagcagctccgaggctcccgccaagaatggggcaggctccctgagaagccggcatctgcccaacagcaacaacaactccagcagctggttgaacgtgaaggggcccctctccccgttcaacagccgggcagcggcagggcctgcacaccacaagctcagctacctgggccgagtggtgcgggagatcgtggagacagagcgcatgtacgtacaggacctgcgcagcatcgtggaggactacctcttgaagatcattgacacacccgggctgctgaagccagaacaggtcagcgccctctttgggaacatagaaaatatctacgcgctgaacagccagatggaggagcccatccccaggagactcaagcagtggcctggagaggctttgttctgtaacggtgccttttcttagggtccaggcaggaatgaagccaataatttattgctttccaaaaaaaaaaaaaaaaaaaaaaaaaaaaaaaaaaaaaaaaaaaaaaaaaaaaaaaaaaaaaaaaaaaaaaaa

SEQ ID NO: 382 - DNA, 608 bp, Homo sapiens
agcatcttggagagttttgtggggtgctggcatccatcaaccaacaaaataccaaaatgactctaggtaattataagtgaagcaaaaccactgggcagggatgataacaggcactgtacttaacaggagtcagcgtatcacaatgctgctcggactatgttcagacactaaactctaagtgtcatgagggcagggactccctctatcttctcaccattgtagcattgctagcacaatgcccacacacagaagataatgatatatttatcaaacaaatggatgctgttcaaaataaaaatatagctctcttgaaaaacaattctccctgcaagaacttcctcttcttactgtttcttttctcaatttttttgcttcctacttccaccaacccctcttgcagagactgctccattccagtaaaaggtgaaggttcaactggagacctccaaagtcggctgggcctagggtttgggtaggcaattgctggaagagcacagagagggaaagatttcaggcagtggtgataagaaaaggcccacctgggtcaggtgtggtggctcacgcctgtaatcccagcactttgggaggccgaggtgggcggatcacga

SEQ ID NO: 383 - DNA, 253 bp, Homo sapiens
gaacaattcatacagaggggctaacaagccaaaccagcagccttcagtgggagggaacttggaaagttggaatgttcaaggaaaatgacaaaatacaagtttacaaaaattgttttttcaaaaaatgctcaaatggccaggcacagtggctcatgcctgtattcccaacacttgggaggctgaggtgggtggatcacttgagtctaggagttcgagaccagcctgggtgacgtggcaaaaaaaaaaaaaaaaa

SEQ ID NO: 384 - DNA, 615 bp, Homo sapiens
gtgaccaggtgtcagctgtgacgtattatcattgcctgcacctgtgcaactttgatgttattggcatggcgtgactggttagctgtactccctggcttttcagttaataaataatttaaggacattttgagaaagaagcatgaatcctggctgttgtctgaaaacttttcattgatggattctcataagatccagattgtatccccattaacacatccagttaatggtgtcagtgacttgcagagaaatctgagacattagtggaatgaaatacagttttaaaagatacttttctctctaaaattcctgcttgcacataggagagtgtcatgtggaaaaatgtatgcattaatgactgagtgaaaagtgattcagaagtttcttctgtacaaaagggaatatgttaattcattttgcttccatttctttgccatatatacatagtattttctctttctcaatagtacataattaaattacatcactgacatcctagcatcagtgaaatatggtatctacttttcaatatgtagattttttgcagctaagacattttaattttctaaaaaatatattaattttggctctgaaaaatcagagtgaagtcttgcggta

SEQ ID NO: 385 - DNA, 540 bp, Homo sapiens
ctgtctcacaagaacttcactcaaccccgtgccaggactcagcagtggcctggacaacagcctcagcttcctctacccatcttcttttcttaaagcaggctatgtgccctacatggcaaggcaccatgactgcccatcgagatgccaagaagggctatggaactatgcaggtggctagtggtcagactgaagtcaccagctgaataccttaaggaggactcttgaggctcataatggagttcctggggcacagggattagttatgagcattaaagttcctaagacccagtgacagtactgggagaaaccaaggctgaagagtcaggttgaagcacaggcttttgttttttgttgtttttgttttttgagacagagtctcattctgtcacccaggctggagtgcagtggcgcaatcttggctcactgcaacctccgactcccaggttcaagcaattctcctgcctcggcctcctttagtaggtgggattacaggtgcataccaccacacctttctaatttttgcatttttagtagagatgg

SEQ ID NO: 386 - DNA, 270 bp, Homo sapiens
  misc_feature 107: n = A,T,C or G
gcttggttcatggacaggtaaatatgttattcagtcttgtcattattgtgatttttttcagtcaatatttggataggggataaaagatttggataaaacttaatggngtatagatccattaagttttcttcctagataaaagtctcagtccaggctggacattgtggctcacgcctgtaattccagcactttgggaggccgaagtggctggattacctgaggtcaggagttcgagaccagcctggtcaacatggtgaaacctcatctcct

SEQ ID NO: 387 - DNA, 322 bp, Homo sapiens
ggctttaaaaaaatcagctttctgatttatattctgtggaaatgaggcttgtttgtttcaggttattctataatgtcttttggtgtggctgaagctgctgaggccatggggggagatttgtaaacaaggatttaaaaagtatgtttatttaatctaattgaatttggccaaaggacttaaatgcaggaattgagtggccaaagctttgtttttgggtcacttgctcttaataactaaaaataaataaatgcatgtcatatttgtcactggttgtcaccgtgttgtgaaaatatggcacattgtaattggtccaatgaagttt

SEQ ID NO: 388 - DNA, 313 bp, Homo sapiens
caggtgcccacctttcagggagtctcccagcatgggcggatccgggcatgagctgctgtaaactatttgtggctgtgctgcttgagtgacgtctctgtcgtgtgggtgccaagtgcttgtgtagaactgtgttctgagcccctgttctggacacaactgtgtcctgtgagtgtatcgctactgtgagcgttccggcctagcagggcatgtcttaggtgcagctgtgcacgggtcagctgagcacagtccagaaccagctctcggtgtctgggccacatccgcccactgggctgaccccctcctccatgtcgat

SEQ ID NO: 389 - DNA, 131 bp, Homo sapiens
gcggggcacccagtctgcgtgtacacgagggatgaggtgacgggtgaagctgccctgcgggcgaccgacgctgcagttgtttggcctgaccgtggggcagcgcaccatcaggtttgtcatgaggtgctacg

SEQ ID NO: 390 - DNA, 106 bp, Homo sapiens
ctcgtccgcgccgcttggccttcatgtctctttcgagcagcggacgccggtctctgttccgcagaatgggggcttttttaaagattgtttaagaataaggcctact

SEQ ID NO: 391 - DNA, 102 bp, Homo sapiens
ccttatcaaggacggcaagctgtatcaagaacaatgtctccactgactatgatctatcttacaagagcatcaaccctctgtggtgggctgtgtccactgatg

SEQ ID NO: 392 - DNA, 121 bp, Homo sapiens
gcatatagttcagacatgatgctagttgacactctgtgttataggcgtataatgatgtctctcatctttgcccattagacaatcaacaatattgtaggtggtccaggaccaagatgccagt

SEQ ID NO: 393 - DNA, 157 bp, Homo sapiens
gcctattctctaagaatcagattggagataaagaaaagctgggaggtaactttctctgaagataaggagaccatggaaaaagctgtagaagaaaagattgaatggctggaaagcacccaagatgctgacattgaagacttcaaagctaagtagaggg

SEQ ID NO: 394 - DNA, 104 bp, Homo sapiens
ggaggccgctgagggcctgctgcaggaggcgctagacaaggatagtcgctacccagagacgctggtcaacctcattgtgtcctgtcccagcaccttgggcaagc

SEQ ID NO: 395 - DNA, 146 bp, Homo sapiens
atttcattcccctcatcttcaaacatcattattattcttgaccagacctgaatctaagttaccatccccttggaaattctggagaaggagtctcatgcaccacctatcacactccctcacatcctgtttctggactttggattgga

SEQ ID NO: 396 - DNA, 110 bp, Homo sapiens
caacttcccaatacactcggctaattctaaagtactctctatacaaactgattccgacccagtctacttcccagatgtcggaccaccacacctctgacatcttctaacgg

SEQ ID NO: 397 - DNA, 165 bp, Homo sapiens
agagtttcgccatggcccggcccaagaagcacttaaagcgtgttgcagccctcagacattgggattctttgacaaactaacggggtgtattttgacctcggtccatcggacaggtccccacaagctgaggggatgtcttcctctagatcggcttcctcaaggatt

SEQ ID NO: 398 - DNA, 212 bp, Homo sapiens
ggtctaacaacagtgacttcaaggcctgttgaagccaccaattctggggcaaacaatccttacccagtggatgatgttccctctagaaattgataaccttgtgaagtggtggtttcccctccagttgccaaaatggccatatcctcaagctccttctggccccacattctactccaaaacatttccaattttaggctcaggttggggacaca

SEQ ID NO: 399 - DNA, 165 bp, Homo sapiens
tacccgaccctgcagccgcagaaatgttgatgcctaagaagaaccggattgccatttatgaactccttttttaaggagggagtcatgttggccaaaaaggatgtccacatacctaagcacccggagctggcaacaaaatatgcccaaccttcatgtcatgaaggc

SEQ ID NO: 400 - DNA, 145 bp, Homo sapiens
actgacacagctgagcttgttatccatctccccaaactttctctttcttggacttctggcatgcccactcccaggccctattcctctatggggacagctggctaggacccctctgccttcctcccaatcctgactggctcctagg

SEQ ID NO: 401 - DNA, 134 bp, Homo sapiens
ttggagctcatctgcaatgtagggccggtggcctcctccaccagcttggtgctgcaccagcaggaggtcctgccccctccactgttgctgctccagctggaggagaggaaagtgggagcaaagaaagaggatcc

SEQ ID NO: 402 - DNA, 117 bp, Homo sapiens
cctcttcctactgccaggtcgatcagtggctttcctggacctcccagctttagagtctttctatcacctctgcaccagcctctaggaaggaggatgggcatagtggagaccaccaag

SEQ ID NO: 403 - DNA, 104 bp, Homo sapiens
tgaacagtcgcagtgccatggaggagcccagcagctccgaggctcccgccaagaatggggcaggctccctagagaggccggcatctgcccaacagcaacacaca

SEQ ID NO: 404 - DNA, 135 bp, Homo sapiens
ctgaactggcagactgcaaataaatctcggggtcctattattattgtctcctgtaagacctccgggtcaaggcagaggcaggaactaactggtgtgagtcaaatgcccctgagtgactgcccccagcccaggcca

SEQ ID NO: 405 - DNA, 144 bp, Homo sapiens
agctggtgcgctccggacatctctgactaatatgctgtgtctgtgcagcacctgatctaaactgagagtgcttcgagtcgagcgagtgctctgacgctagagctcgtgctgaacctggcaagcagcacaacctgtgcttcactt

SEQ ID NO: 406 - DNA, 124 bp, Homo sapiens
attaagatcacttgtgttgaggctgtggggtaatgagcactcagcctttggggtacctgttcctaaagtgggccaaaagagccctccctacaatgatgccccagtttttgctttattcctattt

SEQ ID NO: 407 - DNA, 148 bp, Homo sapiens
tggtcctgtttgtttcttggctaagattagacaagacatatcaatcacagaaatataccttggtgccaccaacccattttgtgccacatgcaagttttgaataaggatggtatagaaaacaacgctgcatatacaggtaccatttagg

SEQ ID NO: 408 - DNA, 123 bp, Homo sapiens
gtaggaccatggtcatcctgtcatctgtcactgctggatgacatcctccctgttagatggacctcagggggaggggagtcttccacacgtcyctttggggagagggatctccccagcccccag

SEQ ID NO: 409 - DNA, 186 bp, Homo sapiens
ttcagactcctagtccagagctctcagcaatcctcatcttgtaatgctgtctacagactccaagtatgcaatgggccaagccacaccctctccctcttcctcctgccccaagggcagagattcatggaaggttgtctgtttatgaggaatggagtcgttgccccggcccaaatcgcacccaggcct

SEQ ID NO: 410 - DNA, 302 bp, Homo sapiens
  misc_feature 280: n = A,T,C or G
tttattctagggatgaaggttatgctgggtaatcatacaaaaccttgtattgaaataagttgaggatcttataaaaggaaaaaactgattcaacaggtttaaagcattttctgcatttcagaaaaaaaataaaagctgtaatttacaagccagccaatgaatctgcttacctgattgtgtttgtgcagacatactttaaaaactggcaatagtaaagccatgttacgagccttaaggacattgaagtcgttaaggtccctgagaatggctataacacatncttagtgatgggaacatttcta

SEQ ID NO: 411 - DNA, 136 bp, Homo sapiens
gggcggactgcttaatcccaggcgtttcgagaccatcctaggcaacgtggcaaaaccccatctctacaaaaaatagaaaaattcgccgggcatggtggctcacgcatgtaattccagcactcttggaggccgaggc

SEQ ID NO: 412 - DNA, 120 bp, Homo sapiens
gtttgagccaactttaagactgcttcctattagacataataacatacagttaaggccacaattcgaatcctactcttcagacgaccggccatgactaggagcacacatttgtcccttgat

SEQ ID NO: 413 - DNA, 290 bp, Homo sapiens
tggtggccctgctgggaagcccaactgctgggggagacgtttctgccaccctgggtgatgagcagcttttcccccctggctttctgggggaggagttggcctccttagggagacaggtgacccttggtgccacccctgccccgtgtgtcccccgggtgttctcagtggttgctgaaggcaggtagagggtgctgtccagtatccccccatgtaaaggtcacttcccttctcatggagtcagctgagcatcactcagcccttccatgtcccactcaccttcctcgtctcct

SEQ ID NO: 414 - DNA, 219 bp, Homo sapiens
gctgatgcagctgtacagtgcgcgccagcggcggcttgaacccggggcctgcgcgggaagagcacttccctgctgaagcgcctgccaaaggccaagaaggaggcgccgcccatggagaagccggaagttgtgaagacgcacctcggacatgatcatcctacccagatggtggcagcatggtgggcgtctacaacgccaagaccttcaaccaggtggaga

SEQ ID NO: 415 - DNA, 294 bp, Homo sapiens
gtccgttttccggcaggggggaagggtgtagaagagaagaagaaggaggttcctgctgtcccagaaacccttaagaaaaagcgaaggaatttcgcagagctgaagatcaagcgcctgagaaagaagtttgcccaaaagatgcttcgaaaggcaaggaggaagcttatctatgaaaaagcaaagcactatcacaaggaatataggcagatgtacagacctgaaattcgaatggcgaggatggcaagaaaagctggcaacttctatgtacctcagacccaaattggcgtttgtcat

SEQ ID NO: 416 - DNA, 295 bp, Homo sapiens
ggcgcgtccggggcctgaaggaggacctgggcgcgtgtctgctgcagtcggactgtgtggtccaggaaggaaaatcacctcggcagtgtttgaaggaaggatactgcaactctttgaagtacgcattttttgagtgtaaaagatcagtgttggataacagggcaagattcagaggaagaaaaggatattgatgcattatgttgaagccaacatggaaaacaacaaatattttccctggtcattaacacaaaggagccaacacaggaaacatactttttactacatctgtttggtt

SEQ ID NO: 417 - DNA, 287 bp, Homo sapiens
agcagctccatttctggagtctgggtcttccgaggccaggagcttgcctttccgctgagtccagattggcaggtggactacgagtcatacacatggcggaaactggatcctggcagctaggagacccagacgctggttcgagagtacttttcctgggagggggccttccagcatgtgggcaaagcttcaatcagggcaagatcttcaagtgaacatctcttgccatcacctagctgcctgcacctgcccttcagggagatgggggtcattaaaggaaactgaacatt

SEQ ID NO: 418 - DNA, 359 bp, Homo sapiens
atcttgacattaaaagttctggctaactttggaatccattagagaaaatcttgtcaccagattcattacaattcaaatcgaagagttgtgaactgttatcccattgataagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtctcaataaa

SEQ ID NO: 419 - DNA, 214 bp, Homo sapiens
caccatcgtgtgcaacagcaaggacggcggggcctgggtggaccgagcagcgggaggctgtcttttcccttccagcctggaagtgttgcagaggtgtgcatcaccttcgaccaggccaacctgtaccgtcaagctgccagatggatacgaattcagttccccaaccgcctcaacctggaggccatcaactacatgggcagctggacgggtgact

SEQ ID NO: 420 - DNA, 200 bp, Homo sapiens
aaaaccaccaagactcccgctgcccatcatcgatgtggccccttgacgttggtgcccagaccaggaattcggcttcgacgttggccctgtctgcttcctgtaaactccctccatcccaacctggctcctcccacccaaccaactttcccccaacccggaaacagacaagcaacccaaactgaaccccaacaaaaggccaa

SEQ ID NO: 421 - DNA, 115 bp, Homo sapiens
gttcagtaaccgagatcacacaattgcactccagcctgggtgacagagcagactctgtctcaggaaaaaaaaaaagttctaggagagttttttaccacaacgatgtgaacagttg

SEQ ID NO: 422 - DNA, 205 bp, Homo sapiens
atactggccacacccctgatcaggtacgactgctgtggacagacccacgaaatgtgggctggcgggacaagacctcctatcgctggcagcttctgcaccggcctcaagttggctacattcgggtgaagctctatgagggaccccagcttgtggcggattctggggtgatcattgacacatccatgccaggggggcgtcttggtgt

SEQ ID NO: 423 - DNA, 262 bp, Homo sapiens
ccagggtcagagacagggcttggttctgcttcctggtgaagcatggcttcggggtgctgcctctccctccctgtttgaatctgcagattgtgttaggcccccagctgagggcctggagtggtgggattggtcccagtgcctggcgcacattggcctgcagagtagattaactgaatgaccaaagagcaacaaaagtctagtgattcttgtctttgaggttctgactggtgttttacaactgagtccaaggcttttcccttct

SEQ ID NO: 424 - DNA, 591 bp, Homo sapiens
gaaatatcagtttcagaaatgaatgaaaagttgacaactctgtgttataggaagtataatgatgtctctgatctttgcaaattagaaaataaacaatattgtaggtggtccaagaaccaagatgacagttttacaatttgcaggaaacttacatatcctttagaaactctttgcaatagtccaaatagaagtacaaatacattgaaagaaatgccttggggacatatcaataacaacgtaacacagagctattctattggttatgaaggtagctatgatgcctctgctgatctctttgatgatattgctaaagaaatggacattgcaactgagattaccaaaaaatcacaggatattttgttaaaatggggaacatctttggcagaaagtcacccttcagagtctgatttttcactgagatcactttctgaagacttcatccagccttcacaaaaattatccttgcaaagcctatctgactctaggcattcaagaacatgctctccaacacctcattttcaatcagattcagaatataattttgaaaatagtcaagactttgttccatgttcacagtcaactccaatttca

SEQ ID NO: 425 - DNA, 520 bp, Homo sapiens
gcagcgtgggcgccatgagcagctcgggactgaattcggagaaggtagctgctctgatacagaaactgaattccgacccccagttcgtacttgcccagaatgtcgggaccacccacgacctgctggacatctgtctgaagcgggccacggtgcagcgcgcgcagcatgtgttccagcacgccgtgccccaggagggcaagccaatcaccaaccagaagagctcagggcgatgctggatcttttcttgtctgaatgttatgaggcttccattcatgaaaaagttaaatattgaagaatttgagtttagccaatcttacctgtttttttgggacaaggttgaacgctgttatttcttcttgagtgcttttgtggacacagcccagagaaaggagcctgaggatgggaggctggtgcagtttttgcttatgaaccctgcaaatgatggtggccaatgggatatgcttgttaatattgttgaaaaatatggtgttatccctaagaaatgcttccctgaatctta

SEQ ID NO: 426 - DNA, 304 bp, Homo sapiens
ccctgcttcccctcactgcccaggtcgatcaagtggcttttcctgggacctgcccagctttgagaatctcttctcatccaccctctggcacccagcctctgagggaaggagggatggggcatagtgggagacccagccaagactgagggtaagggcaggtaggcgtaaggctgtggcaatttccggaaggtttgggtttggttttttttaaaccgggcaatattgtgtccagtccaggctgtgaaaaaaattatataccaaggttttcaattaaaattcagtgcctacctgaaaaaaaaaaaaa

SEQ ID NO: 427 - DNA, 284 bp, Homo sapiens
cactggctcgaaaaaaaaaaagcaatataaattggctctgatttatgctacagaggaaagggttggggcgctctgtgggcctgtgataggaaggtttgccaattggagttcgtaggcaaagaggaaggaaggagcattccaggcagatggagtagcaagtcagaaggagcatggggcaggctgggttggtggacacagagcaggccactcgggaacttgtagttcatggtaaggagattttttttttttttgaaatggatttttgccctgtcacccaggctgga

SEQ ID NO: 428 - DNA, 162 bp, Homo sapiens
aagcattcaaatgaggaattctgagtgcatctccaagatccacctgcacttcctcattcagcccctttataactaatgtttgtgccagaggccttctcgagtctttggccataggtgtttggcatttagtgaccttcgagagctcaaaacaatgatctaagg

SEQ ID NO: 429 - DNA, 104 bp, Homo sapiens
gaaaaaagagacacatgagagtggcttttagtgggtttctttcctccctattccggggcccgtacgacttctttctttggaactgccaacgtgtgttcttggta

SEQ ID NO: 430 - DNA, 114 bp, Homo sapiens
ttttctgtgaatagaacattaaaacatttggtattacactttataagatttctgtgatttcacttttaatataatagcataatcttctactaataaggatatactgttaattat

SEQ ID NO: 431 - DNA, 185 bp, Homo sapiens
gcttacttctcttccttctctccttaatgacattaacactattctcaccagacctcctaggcgacccagacaattatacctagccaaccccttaaacaccctccccacatcaagcccgaatgatatttcctattcgcctacacaattctccgatccgtccataacaaactaggaggcgtcctcgc

SEQ ID NO: 432 - DNA, 105 bp, Homo sapiens
atagttgtcacttagctctacctgggcagctctaaaatattaaaagacccaagtcctaccctcagaattttttaactcgtctagcatgcaaataggggcattgag

SEQ ID NO: 433 - DNA, 290 bp, Homo sapiens
tttactttaaaaaaaaggatttcttttacgaagtattttttgtttttttgagattgagtctcgctctttcacccagacttgagttcagttgcagattcttggctcacttcaatctcttcctcccggattcaagtgattcttctgcctcagcctcccaagtagcttggaaaacaggcctttccaccacaccggagtagttttggtatttttagtagagatggggttcacattctggccaggctggtcttgaactcctacctcaggtgatctttttccccaacctccaaagc

SEQ ID NO: 434 - DNA, 170 bp, Homo sapiens
gtcgctcatacttgtaatcccagcactttgggaggccgaggcgggtggatcaaaaggtaagcagatcgagaccatcctggccaacattgtgaaaccctgtctctactaaaaatacaaaagtaagccggtgtggtggcacatgcctgtaatgccagctactcggaagctga

SEQ ID NO: 435 - DNA, 339 bp, Homo sapiens
cagaagcgagatgacgaagggaacgtcatcgtttggaaagcgtcgcaataagacgcacacgttgtgccgccgctgtggctctaaggcctaccaccttcagaagtcgacctgtggcaaatgtggctaccctgccaagcgcaagagaaagtataactggagtgccaaggctaaaagacgaaataccaccggaactggtcgaatgaggcacctaaaaattgtataccgcagattcaggcatggattccgtaaggacacacctaacccagaggcagcttttgcagcatccagttcatcttaagatgtcacgattagtcatgcataaatgtctggtttaaaatt

SEQ ID NO: 436 - DNA, 320 bp, Homo sapiens
gtgacaatgttgacacccgcaccgtcatggaagagatgcgggccttggtcagtcagtgcaacctctatatggcagcccggaaagccgtgagaagaggcccaaccaggctcttctggagaacatcgccctgtacctcacccatatgctgaagatctttggggccgtagaagaggacagctcctgggattcccggtcggagggcctggaaccagcttcagtctcgaggccacagtcatgccctaccttcaggtgttatcagaattccgagaaggagtccggagattcccagacaaaagtcctagatctcagctcagcatgcc

SEQ ID NO: 437 - DNA, 105 bp, Homo sapiens
attacttccttggctttcttgctttactgtcgcccctccagcgcttagagcctccctgctgctagcagcactgtgttcaggctcttgtcttaacaccgcagcccc

SEQ ID NO: 438 - DNA, 109 bp, Homo sapiens
ctgtaatcccagctactctggaggctgaggcacaagaatcacttgaatcaagtggatcacttaaggtgaagagttcgagaccagcctcgcccaacatggtgaaaactcg

SEQ ID NO: 439 - DNA, 186 bp, Homo sapiens
ctggaacgagcgtgctgtcaacagagtcagtgcgatccgatttgtggaggatgagaaagatgaagaagacaatgagacgagaacacttctaaggcgagccacttcacacctctggggagttaaagcacatgtaaaagacagttgagaatttacggattgacatgaattctgctaaaggactggact

SEQ ID NO: 440 - DNA, 108 bp, Homo sapiens
cggtcatggagggagcaggagctggatccggcttccggaaggagctggtgagcaggctctgcacctgcacttcaagggattgacaaggaccaaagaaggcagcagtcc

SEQ ID NO: 441 - DNA, 135 bp, Homo sapiens
ctaggtcgcggcgatatggccaacgtaccagaaagtcgggatcgtcggtaatacgggcccccctattggggcctccctccggaaaattggtgaaggaaaatttgaaattcaagccaaccacggccaagtacactt

SEQ ID NO: 442 - DNA, 105 bp, Homo sapiens
agtttgttaaaggttatggtactatgttaagtatgaaaggcagtcgtgctcagcttagcagcactttggagctaggtgggttcaagccatctggaaatgaaactg

SEQ ID NO: 443 - DNA, 102 bp, Homo sapiens
attttttcactagattttttccaattgagaaaatatatactaacacatagcatatacataatcactctatttgaggaaatatcttgttttctgccaatagat

SEQ ID NO: 444 - DNA, 375 bp, Homo sapiens
tcccacctcagcctcctgagtagctgggactacaggtgccacaccaccacggccagctcattttttgtatgttttgtagagactgtgttttgccacgttgccaggctattcttaaacgtccgagctcaagtgatccctccacctcagccttccaaagtgctgggattacagatgtatccacacacccagccaaatgcattcatgtctaccatagaaatacatctctttgctgctatcttgaatttgtagactccacaatcaataaagagaggcatccataaaaaatgggtagagccagcagtgctacactgtatcaagacttagagccagcagcagatcactgagtcagagtcagacagctgcacatgacaaacc

SEQ ID NO: 445 - DNA, 455 bp, Homo sapiens
gctatgtggacattgccatcccatgcaacaacaagggagctcactcagtgggtttgatgtggtggatgctggctcgggaagttctgcgcatgcgtggcaccatttcccgtgaacaaccatgggaggtcatgcctgatctgtacttctacagagatcctgaagagattgaaaaagaagagcaggctgctgctgagaaggcagtgaccaaggaggaatttcagggtgaatggactgctccgctcctgagttcactgctactcagcctgaggttgcagactggtctgaaggtgtacaggtgccctctgtgcctattcagcaattcctactgaagactggagcgtcagcctgccacggaagactggtctcagctccactgctcaggccactaatgggtggagcaccactgactggtcttaagctgttcttgcataggctctaagcagcatggaaaatgg

SEQ ID NO: 446 - DNA, 241 bp, Homo sapiens
gtttgtatatattttaaaaaattgttttaaaagtcagtttgcaacatgtctgtaccaagatggtactttgccttaaccgtttatatgcactttcatggagactgcaatacgttgctatgagcactttctttatccttggagtttaatcctttgcttcatctttctacagtatgacataatgatttgctatgttgtaaaatctttgtaaaaaatttctatataaaaatattttgaaaatctt

SEQ ID NO: 447 - DNA, 295 bp, Homo sapiens
cggcacgagaaaaatattaaaaaataaatagcgactgggctgggcatgggtggctcatgcctggtaaatttcagcactttgggaggtcaaggcaggcaggtcacttaagcccaagagttccagaccagcctggccaagatggtgaaactggtctctactaaaaatgtaaaacctacccggccatggtgtcgcatgcctgtaatccagctactcgggaggctgaggcttgaggatcgcttgaacctgggaggcagaggttgcagttagccaagatcgcgcacttcactccagcctg

SEQ ID NO: 448 - DNA, 360 bp, Homo sapiens
aataggtaaatccatggagacagaaagtagattataagttaccagggctgggcgacaaggggagtgggcattattgtttagtgggtacggagtttctatgtggggtgataaaaaagttttggaggctgggcacgatggctcatgcctgtaatcccaacacgttggaggcccaggcgggtggatcacttgaggtcaggagttccagactagcctggccaacatggtgaacccccgtatctgctcgttgttggtggcgcctataatccagctactcaggaggctgaggcaggagaatcacttgaccccggaggtggaagttgcagttagcaagattgtccactcactccagcccggttacaa

SEQ ID NO: 449 - DNA, 421 bp, Homo sapiens
gacactactttagtccccttttctttggatcattctttgactctatagagattcctcccgttttcttcccatggctgatggtgtgagctttaattttgaaggcttttcccattgttgtatgacttctgctcctggtgtatcttccactggctagggactcattcagaacaggtattaggacattcttctgtgcattttaaaggtctaagatggcactgtctaatatagtagtccctaggcccatgtgattgccaatcacttgaaatatgtgaggcaggtggatcacgaggtctggagttcgagaacagcctggccaagatggtgaaccccgtctctactaaaacacaaagttagcgggtgcgtggtgggtcctgtagtccggttctcggaggctgaggcaggagaatcacttgacccagga

SEQ ID NO: 450 - DNA, 274 bp, Homo sapiens
cttggctcaacgcctgtaatcccagcactttgggaggctgaggcgggtggatcacctgaggtcgggagtttgagaccagcctggccaacatggtgaaaccccatcgctactaaaaatataaaaaattagctgggcatggtggcgcacgctcgttagttccagctactcaggaggctgaggcaggagatcgcttgaacccgggagttgaggttgcagtgagctgagatcgcaccattgcactccagcctgggcaacaagagcgaaactctgtctc

SEQ ID NO: 451 - DNA, 305 bp, Homo sapiens
accccagtgggagaaagttcaaaggtgattagattaataatttaatagaggatgagtgacctctgataaattactgctagaatgaacttgtcaatgatggatggtaaattttcatggaagttataaaagtgataaataaaacccttgcttttacccctgtcagtagccctcctcctaccactgaaccccattgcccctacccctccttctaactttattgctgtattctctcactctatattcctctctattcgctaatattgcattgctgtcacataaaattcataaaggtttagtggttagtg

SEQ ID NO: 452 - DNA, 326 bp, Homo sapiens
acattctttctaatgatgcatagtggtccatggtacatgtaggtatactataatttattgcctgattgatgtatatgtgggttattttttgttttcttgtaataatgctgcatttgacatctttttatacattttgtgaacttatgcaaatatttctgtaaaatagattcttaaaagtaaaattgttttgatgaggtgtgtggatatatacattttactagagaccaccgtattgccctttaaaaaggtggacccagctatttgggaggcggaggttgcggtgagccgagatcgcaccagtccactccagccttgggtgacaaagg

SEQ ID NO: 453 - DNA, 324 bp, Homo sapiens
tttctcagtgcacgagtattgttcctttccctttgaattgttctattgcattctcatttgtagagtgtaggtttgttgcagatggggaaggtttgttttgttgtaaataaaataaagtatgggattctttccttgtgccttcagatggtaccttgccagcaagacgaaacaggcgggccttcggggacaagcagagctgtcttcgcccgttcactgaagatgatgctgctgatccaaatgattctgacatagacccaggtctgttagggcaagatcaaacagtgtcctactgtttgatgtgaattctctctcatgctctcacct

SEQ ID NO: 454 - DNA, 162 bp, Homo sapiens
ctcgtccacttttcgggcaggggttatggcttcgacatgtcttgcatcaaagatgtggccattaaggagcccctagtggatgtcgtggaccccaaacagctggtcaccaacgccttcctcataaaggaggtggacatctataccgtcaaggttgtaagacct

SEQ ID NO: 455 - DNA, 269 bp, Homo sapiens
gcactgcaacatggtgctggagaacgtgaaggagatgtggactgaggtacccaagagtggcaagggcaagaagaagtccaagccagtcaacaaagaccgctacatctccaagatgttcctgcgcggggactcagtcatcgtggtcctgcggaacccgctcatcgccggcaagtaggggccgcctgtctgttgacagaactcactcctctgtcctatgaagaccgctgccattggtgttgagaataataaagctctgtgtttttttctaa

SEQ ID NO: 456 - DNA, 277 bp, Homo sapiens
ctggatcccttccttacaccttatacaaaaattaattcaagatggattaaagacttacatgttagacctaaaaccataaaaaccctagaagaaaacctaggcaataccattcaggacataggcatgggcaaggacttcatgtctaaaacaccaaaagcaatggcaacaaaagccaaaattgacatatgggatctaattaaactaaagagcttctgcacagcaaaagacacttccatcagagttaacaggcaacctacagagtgggagaaatttttcg

SEQ ID NO: 457 - DNA, 293 bp, Homo sapiens
tcccaacactcccatcatcctagtgggaactaaacttgatcttagggatgataaagacacgatcgagaaactgaaggagaagaagctgactcccatcacctatccgcaggtctagccatggctaaggagattggtgctgtaaaatacctggagtgctcggcgctcacacagcgaggcctcaagacagtgtttgacgagcgatccgagcagtcctctgcccgcctcccgtgaagaagaggagagaaaatgcctcctgttgtaaatgtctcagcccctcgttcttggtcctgtcc

SEQ ID NO: 458 - DNA, 305 bp, Homo sapiens
ctgcagtacattggaacctgaattgaaagaaagtcttccttgaataattggagtttgtcttgagaggcaaatatagccccaagaatcacaagtttcgaggaccatgtaggtcttttacgtagcccaaatccataaattagtctcactttttgtatttatcgtttcatattaaaccctctatatcaaatgttcatcatgattttgtatgatttttataactattttattcattttattagatttattctaaaattttttaatggaaaattcttaaactgtggacaccactgaaggggcttattaac

SEQ ID NO: 459 - DNA, 220 bp, Homo sapiens
aaagaaggcgatccgagttctgctacttcctagtaagggacgtctctggagagattctgaggtgtttgagcctcttttggcctacacaccggcagtgttccttcccgcactcagagggcctctcttggagccagttccaggccacccatgggcccttggcccgcccccctattcatggctggcagattgggggccccccccttttggaggccctgtggcc

SEQ ID NO: 460 - DNA, 225 bp, Homo sapiens
ggaatttgaaagttgtattcagtattatttggaaaacaattggcttcaacatagagaaagctcctacagaagggaaaaaaagagctgctgttccctaagtaacgcgaacccctcgctgctggagcggcactgtgcctacctctaagccaagatcacagcatgtgagggagacagtggacatcttcttttatgctggacccctaagatgaggaagtcgggcagtac

SEQ ID NO: 461 - DNA, 130 bp, Homo sapiens
acctgcaaaaccagggcaaggcagtaccgggaaactggcgtgagttgctgcggtttgggggaagttgcacacccttttcatagatacctcccttaaccctcagtgcagattcttgagaaaactccaaggc

SEQ ID NO: 462 - DNA, 170 bp, Homo sapiens
cgccgccacaatggtgcgcatgaatgtcctggcagatgctctcaagagtatcaacaatgccgaaaagagaggcaaacgccaggtgcttattaggccgtgctccaaagtcatcgtccggtttctcactgtaatgatgagcatggttacattggcgaatttgaatcatttgt

SEQ ID NO: 463 - DNA, 166 bp, Homo sapiens
gacattcatacagaggggctacaagccaaaccagcagccttcagtgggagggactttgcaagttggattgttcaaggaaattgacaaaatacaagtttacaaaaattgttttttcaaaaaatgctcaaatggccaaagcacagtcgctcagcctgtattcccacaa

SEQ ID NO: 464 - DNA, 181 bp, Homo sapiens
gtttcaccgtgtttggccaggatggtctcgatctcatgacctcgtgatccacccacctcgggcctcccaaaagtgctggggattacaggcgtgacacccgcacccggccctgagtgctttctttaagtcaggcattgttctaaggtctttctgtacctgtatcatctcatttaatcctcag

SEQ ID NO: 465 - DNA, 138 bp, Homo sapiens
aggggctcgagagccctcttctaacatccctaaggtgggccatcatttgttacagatggggaggccccagggaccaggtgaattaaggtggcggctcggggcccaagcatctcggtattgagctctatgctgtgggcg

SEQ ID NO: 466 - DNA, 102 bp, Homo sapiens
aaggcactttcctcctccaccttttctatattgttcaagctgacaaagtaggtatttttaggaaaagttctaaagttataaaaaatgttttctgcaagtaaa

SEQ ID NO: 467 - DNA, 105 bp, Homo sapiens
cggcacgagtagttaccagcatgccattgaagaatctgtcgttctcatttattgattcccataaaacctgcccaggatcttctcttcactaaaggcatacagact

SEQ ID NO: 468 - DNA, 101 bp, Homo sapiens
gcttggttcatggacaggtaaatatgttattcagtcttgtcattattgtgatttttttcagtcaatttttggatgaggggataaaagttttggagaaaact

SEQ ID NO: 469 - DNA, 273 bp, Homo sapiens
tgcctaacttaattttcaaaggggcccaagtgaaattccaagggatggatccagggatggaaaatataccctgggtactgaacaaaaaaacccaaattacactccttattaaagaatactaaggtcgggcacggtggctcaagcctgtaatcccagcactttgggaagctggggtgggcagatcatgaggtcagaagttcaagaccagcctgatcaacatggtgaaaccctgcctctctaaaatacaaaaattaaccaggcatggtggcacag

SEQ ID NO: 470 - DNA, 236 bp, Homo sapiens
aacatgccatccagactgaggaagacccggaaacttaggggccacgtgagccacggccacggcccaataggcaagcaccggaagcaccccggccggccgcggtaatgctggtggtctgcatcaccaccggatcaactttcgacaaataccacccaggctactttgggaaagttggtatgaagcattaccacttaaagaggaaccagagcttctgccaactgtcaaccttgacaaat

SEQ ID NO: 471 - DNA, 255 bp, Homo sapiens
ccaggatggagtgcagtggcatgatctcggctcactgcaacctctgcttcctgggttcaagcgattctctccttcctcagcctcccgagtggctgggactacaggcgtgcaccaccacgcccaactaatttttgtatttttcatacagacggggtttcaccatgttggccaggatggtctcgatctcttgacctcatgacctgcccgccttggcctccctaagtgctgccattacaggcgtgacacccatgtctg

SEQ ID NO: 472 - DNA, 254 bp, Homo sapiens
aaaagatgaatgtcagacatttgaagaacctatagtaaaatgataaacactaaatatacttgagaaaactttcttaatatgccaatgaggtaggcctgatctttgaaatagtgaataggaatacaatgcatttcctcagtgatcactgattagaatgagttggtgggatccttgggaagccaaacggagcggagttctggatcatgtccatccagtccagtgaatccacgaccgcagacctgccccccgcaaca

SEQ ID NO: 473 - DNA, 580 bp, Homo sapiens
aagcattcaaatgaggaattctgagtgcatctccaagatccacctgcacttcctcattcagcccctttataactaatgtttgtgccagaggccatctcgagtctgtggccataggtgtgtggcatttagtgaccttcgagaagctcaaaacaatgatctaaggacagacaagacgttaaaagacaacccacggaatgggagaaaatatttgcaaatcatatatctgataagcgtccagtctccagaatgtataaagaacaactcagcgataaagacaagcaatccaattgtaaactgggcaaaggatttaaataaacatttccccaaagaagatgtacagattccaatgagcacgtgaaaagattctcagcatcattagtcactagggaaatggaaatcaaaatcacagtaagtttccatttcacatcactaggatggctataatttcaaaagaaaaaagcaaaattaacaagtgatggcaagaaagttatcagaatccccctacatcactggtatgaatataaaatagtgcaatcattgtgagaaaaatcctgggcagtttctcaaaatgctaaacata

SEQ ID NO: 474 - DNA, 453 bp, Homo sapiens
gaaaaaagaagacacaagagaggtggctttgagtgggtttcctttcctcccctattcccggggcccggacgacttctgcttgggaactgccaacgcttctgcttgggaattgcgtgcagcagagcctagaggagctgttccttccttcacagatacttaagacctccaccatgtctgattcgagttctccctgggagggtttagaagaaacgcaggaacattctgggtggcgtcgaaggagcctttcccgatcatcatgtgtgacttctgcgaggtccagatcactgaattcatgtttacattctcgtgcaagcagggacctcttgcttctgagaaatggggaagagaccttttagccaaaatgcccttcttaaaaagagagacctttttttttaaagttcggttaaaaatgtgacagatgagtacaaaaatgcagacacttatcaaaaagca

SEQ ID NO: 475 - DNA, 121 bp, Homo sapiens
aaaatagttgtcaacttagctctacctgggcagctctaaaatattaaaagacccaagtcctaccctcagaattttttaactcgtctagcatgcaaatagggcattgagttttttttttttt

SEQ ID NO: 476 - DNA, 340 bp, Homo sapiens
aagttatgggataaaaaaggttatgggtaacttatggtataaaagttatgataaaaggccaggtgcaagtggctcacgcctgtaatcccagcacttttgggaggctgaggttgggagttcaagaccagcctggtcaacatggtgaaactgtgtctctactaaaaatacaaaaattagccaggcatggtggcacgtgcctgtaatcccagctactcgggaggctgaggcaggagaatcgcttgaacctgggaggtggaggttgcagtgggctgagatcacgccattgcactccagcctgggcgacagagtgagactctgtctcaaaaaaaaaaaaaaaaaa

SEQ ID NO: 477 - DNA, 112 bp, Homo sapiens
tcaggcttcattctgcctcttgcatgacagctgatctttcggaccaggacacaaagcagcaagaagcggggagagagaggatagaaacacgcgcaggagagccttcgaacga

SEQ ID NO: 478 - DNA, 109 bp, Homo sapiens
ctggaaggcttgatgctcagacatgttacagccacatagctttgtcctagtcatgctgcactgcagcttgaaggccacgtcacatggggcactctctcttctctctcat

SEQ ID NO: 479 - DNA, 157 bp, Homo sapiens
atctgcaatgtgaccttcttactaaatacaaattagctggcatagtgcacggctcagtccagctactcaggagctgaggcaggagaatccttcacccaggaggcagagtttctgttagcgagattcacactcactcagcctggcacagagtagactc

SEQ ID NO: 480 - DNA, 144 bp, Homo sapiens
gagtagtatatgtgctagtctttaattctaaggaatttctatgtatctctacgatataacctagttaagtgattatctatggatgtgtggtctggataactaaaatcaccagtaacactctgtgtaccattacagaaatacttc

SEQ ID NO: 481 - DNA, 139 bp, Homo sapiens
gaatagtgctgcagtgaacatgggggtgcacatgtttttttgacatactgatttcaagttcttaagatattagattcacaagtgggtttgctgaatatggagttgatttgtgtgggtgaggcgggcatccagataacat

SEQ ID NO: 482 - DNA, 141 bp, Homo sapiens
gagactggtgtctcaacccggtatggtggtcacctttgctccagtcaacgttacacggaagtaaaatctgtcgaaatgcaccatgaagctttgagtgaagctcttcctggggacaatgtggggcttcaatgtcaggaatgt

SEQ ID NO: 483 - DNA, 134 bp, Homo sapiens
tgtgctgtaatcccagctacccaggagggtgaggcaggagaatcacttgaacctgggaaggcagagaggttgcagtgacccaagatcgagccactgcactccagcctgggcgacagagcgagactctccatctg

SEQ ID NO: 484 - DNA, 250 bp, Homo sapiens
atccacaaggtctaatatctagaattcataaggaaagtaagcaaatcaacaagaaaaaaaaaccccttaaaaactgggcaagcataaacagacacttctcaaaagaagatacataagcagcttctgggcgcagtggctcacgcctgtaatcccagcacttggggaggcgaggttggcggatcacctcaggttaggagttcgagaccagcccgccaacatggtgaaaccccatctcttttaaaatacaaaa

SEQ ID NO: 485 - DNA, 299 bp, Homo sapiens
ggaggtgtttgataataaagtaaagattcagccagacacaatcatacaggtgtggcgagaggatattccagtgaactatatgaaggagctggaactggtcaccaaggccggcttccgggcccttctctctgccccttggtacctgaaccgtatatcctatggccctgacttggaaggatttctacgtagtggaacccctcgcatttgaaggtacccctgagcagaaggctcttgtgattggtggagaggcttgtatgtggggagaatatgtggacaacacaaacctggtcccaggctct

SEQ ID NO: 486 - DNA, 190 bp, Homo sapiens
ttatttctgaaaaacaaagaaatacattttaaaatagcaaaggagaccatgaatgggatgtcttctctgaaggccagggcttccagtgttcctgatcctgttgtaagagatcctccatgcatccagagaggacagattttttttggaaaccctttcagtagctgtttttcatgcaactttattactgtca

SEQ ID NO: 487 - DNA, 220 bp, Homo sapiens
ctgactggggtcaattcaagtcatgcaggctgtgagaaacgcggggtcgcggttcctgcggtcctggacttggccccagacaaccggggtcgtggccagaacgccggccgggaccatctgcacaggcgctcgacagctccaagacggtgcggccaagcagaaagttgcacagaacgcggctcccagccacaccaagttcagcatttaccctccccttcca

SEQ ID NO: 488 - DNA, 240 bp, Homo sapiens
gactgctcctcattacccactcacctcagcccctagcaatcatcaatctatgttctgtctctggatttatctattctgaatatttcgtatacatggacttatctgtgaccttttgtgtcgagcttctttcacttagcatgatgtttgcaaggttcttcccattatagtatgtatcagtactacactttttaatgagtaatattgtaaaggatgtatacatcacaatttgtttatacatca

SEQ ID NO: 489 - DNA, 220 bp, Homo sapiens
aactgttgggcaacaaatgctgagctttcctcaactcctgcaaacagtgctgcacaatcatccaggtggtcataagctacttcctcatgctcatcttcatgacctacaacgggtacctctgcattgcagtagcagcaggggccggtacaagatacttcctcttcagctgggaggaggcagtggtagtggattcacagagcattgccttgacatcaaactc

SEQ ID NO: 490 - DNA, 251 bp, Homo sapiens
gcggctgggaggcggtttggggagtggcgggtggtaacagcacacgagagccgctgctgtctgcgcttgaggacttggaggtcctgtctagggaacttatagaaatgctggcaatttcaagaaaccaaaagttgttacaggctggagaggaaaccaggtctcgagttgttaattcaccgagatggggaatttcaagacctaatgaaattcgcacttaatcagggaaaattcatcatgaaatgcaagtttta

SEQ ID NO: 491 - DNA, 170 bp, Homo sapiens
ctcgtccgaatttcggcacgggtcttaattccactcacccttcttcattcttgctcagcaacactgaacatcttacaatttcttgaaaatgccgagcttgctgtccaccacagggatccacacttgtctttgctctgtacccgggaatgttcatccctgggactatcccg

SEQ ID NO: 492 - DNA, 120 bp, Homo sapiens
gttaaagtccatctctcccactagaaagaaagcgtcaagaaagctgaatctaatgtctatttactcctgtgcccctagcacctagcagcacagtgcctggcacataatggcattcaatat

SEQ ID NO: 493 - DNA, 178 bp, Homo sapiens
gaaaagccactttggaaaccccaacatttgcccagaaacgtcggcgtaccctgggatatgttgattagatctttacaccaggatttgatgccagatttgcataagaacatgcttaatagacgatcttttagtgatgtcttaccagagtcacccaagtcagcgcggaagacagaggagg

SEQ ID NO: 494 - DNA, 287 bp, Homo sapiens
tccactcctactggagaccatgtcggttccggacccaccagtttaccataagcaagactaaacctgatccttgggcaaaagttcctaaccctactttaccctcccaccctcacttttaaatccaccatactgaatgccacactatggaatgcagctacctgccaagcaaggcaatagagggcaaaaaatggaggtgaattaagatggacctcatctgaaatacacaaatgcattactatctgaggtaccagcaagagtttagtctacgtgtataaggctccagtagg

SEQ ID NO: 495 - DNA, 103 bp, Homo sapiens
gaggatgagtaatgagtactctgtaaggaggaccatgtcagactattgtaagctaagcattaggactgatacacatatatatgctcctggcatagacacataa

SEQ ID NO: 496 - DNA, 184 bp, Homo sapiens
tttctttaatttgaagataatgcaggagtcatagtgaacattaaaggcgagatgaaaggtctgccattacaggcccagtagcaaaggagtgtccagacttgttggccccggattgcatccaattgctggcagcattcaatgattctccagtatatttgtaaaaataaaaaaaacctaaccccaa

SEQ ID NO: 497 - DNA, 124 bp, Homo sapiens
attttgactaccacaactcaacggctacatagaaaaatccaccccttacgagtgcggcttcgaccctatatcccccgcccgcgtcccctttctccataaaattcttcttaagtagctattacct

SEQ ID NO: 498 - DNA, 122 bp, Homo sapiens
ggcttcggatggtgggcccctggttatcccagctactcgggaggctgaggcagaagaatcacttgaaccttgaaggaggaggttgcagtaagctgaggtagcgccgctgcactctagcctgg

SEQ ID NO: 499 - DNA, 180 bp, Homo sapiens
tctgcttcttgtaaaacctgacccagaaccaacacaatccgttgcaacccaaggacccaagtactttccaatctcagtcactctaggactctgcactgaatggctgacctgacctgatgtccattcatcccaccctctcacagttcggacttttctcccctctctttctaagagacctga

SEQ ID NO: 500 - DNA, 236 bp, Homo sapiens
cacccacccagctgctgtcattccgctcactgagctcttcttcattctcacctgatccctggggggactcaaagccaaaactgcccaaagaggaaagattgaatcctaaaggggatccttgcccccatggagggccccctactagaaggacgtgaaagcagcttttgggggaaactgaggcagttgggaagacagagcagaatgagccctcaccctggctgggggtccagcacagg

SEQ ID NO: 501 - DNA, 137 bp, Homo sapiens
ctcgcccctccctgttcagcgcagtacctggatggcagcctggctttctgggatctcaccaccatgcctagaccattgacctccacctgttcctcgagccttcagctggatcctgggcttttccctacccgggttgg

SEQ ID NO: 502 - DNA, 106 bp, Homo sapiens
tacagttcttaatggttgcacagacccaaagagtagagcagcagcaagatctattgtggagagcgaaagaacaatgctttctatcagcattggatgggtgacctaa

SEQ ID NO: 503 - DNA, 162 bp, Homo sapiens
gtctactgtgggcaggtgtttgagaagtcccccctccggtgtaagaacttcggatctgtgctgcgctatgacttccggagcggcacccacaacatgtaccgggaataccgggacctgaccaccgcagcgctgtcacccagtgctaccgagacatgggttacc

SEQ ID NO: 504 - DNA, 276 bp, Homo sapiens
cggaggtgcaggtcctggtgcttgatggtcgaggccatctccttggccgcctggcgattccggtggctaaacaggtactgctgggccggaaggtggtggtcgtacgctgtgaaggcatcaacatttctggcaatttctacagaaacaagttgaggtacctggctttcctccgcaagcggatggaacaccaacccttccggaggcccctaccactttcgggtccccagccgcatcttctggcggacgtccgaggtatgcttccccacaaaaccaagc

SEQ ID NO: 505 - DNA, 279 bp, Homo sapiens
gaactgtctcgccttcgccggctttaccagggtcatctccaagaagagagtggccccccacctgagtcaatgcccaagatgccccctagaacaccagcggaagctcctccactgggcagacaggcctcagagtgctctgtaggagctgtagactgggaagagaggccaggcgtggtggctcactcctgttatcccagcactttggggagccaaggtgggctgatcacttgatcccaggagtttgagaccagcctgggcaccatggtgaacctcgtcttt

SEQ ID NO: 506 - DNA, 252 bp, Homo sapiens
gcaaaattaaatgcaccaatagtactaaataaaggtaggcaggaaggcacctaatgtactacaatagcttgtataacatcagcctcatccagtgatcaaggtgaccaaataaattatctttaacacacacacacacacacagagtatagactccacagtttccattgtaagacacattctctgacactagtgcacacttgatgccctggatcctcaagacatcaccgggtgccgggtgcagggctcacgcct

SEQ ID NO: 507 - DNA, 248 bp, Homo sapiens
attcgataagtcgaaactgaagaagacagagacgcaagagaaaaatccactgccttccaaagaaacgattgaacaggagaagcaagcaggcgaatcgtaatgaggcgtgcgccgccaatatgcactgtacattccacaagcattgccttcttattttacttcttttagctgtttaactttgtaagatgcaaagaggttggatcaagtttaaatgactgttctgcccctttcacatcaaagaacttact

SEQ ID NO: 508 - DNA, 145 bp, Homo sapiens
cggtgtctcacgctgtaatcaagcactttgggaggcaaggcaagcagatcacatgaggtcaggagttcgagaacagcctggctacatggtgaaaccccgtctctactaaaatacaaaaattagccgcgtgtggtggcacatgcct

SEQ ID NO: 509 - DNA, 154 bp, Homo sapiens
caatggttgcattctttgagtttccgattagcctttccaaaggcagcagtcagatatgcatttatctcagttgagccagaggggatgatttttgaaattctgtctgtccctttgtccactaggaaaattcccttgtgagggagggtgtgtatct

SEQ ID NO: 510 - DNA, 151 bp, Homo sapiens
gaggaggacaccgatgtcccagcagaaggcggcatgagaccaacgtgggagcagaagagagaggttcctggctggcccaggtttagttcccttagttacacaacgtcaaagttcatcactagggttttagttaagaggaattggaccagcc

SEQ ID NO: 511 - DNA, 204 bp, Homo sapiens
atcacttcaagctacagcaatttgagctgttttgtcatttgttacataagcaggtgataatgatctgttgccagtcattttgacttgtgtctctggggaaacaaacaaacaaagagagaacagaaagaagctctactgcgtttataaagctgtactccaaagtgattttaaaataattccaggcagtattcattggtagatgat

SEQ ID NO: 512 - DNA, 198 bp, Homo sapiens
gcattttcggtttctagggttgttacgaagctgcaggagcgagatggaggtggacgaccgcgtcgttgatggtcgagatggtctccgggagccggcgaggctttagcgagggagggaggcaaaacttcgatgtaaggcctcaatcttgggcaaataggcttccaaacactcctactggttggacctcttgcttttcaa

SEQ ID NO: 513 - DNA, 228 bp, Homo sapiens
ctggatttgaatctgagtgagatttacctagtgatataagtgatgtatcagcagcctatatagcttttgaaacagtttcttaatctttctggccttagtttaatcctctgtgaaatgggaatgaaaatgtctatttcacaatgtggttgcagggtacacatgaaaggcagctatgttgaaataacacaaatggtagaaaattgcttttgatatcacaataaattgagc

SEQ ID NO: 514 - DNA, 135 bp, Homo sapiens
ggtcagtcgaacagacacgggtgaatgctgctaaaaacaagactcgggctgctccatcattccatgctggtgcgatcgggctactacaaagttctggctaaggggaaagtctcccaaagcagccctgtcatcgtt

SEQ ID NO: 515 - DNA, 110 bp, Homo sapiens
atggtctcaactcctaacctcaagtgatccgcccgcctcagctcttccaaagtgctaagatttatagggcggtagagcaccccatggcctgaggcttattttccctcact

SEQ ID NO: 516 - DNA, 128 bp, Homo sapiens
ttagggagtcgtgccgcgactgtggtcgtcttttataccttcccgcgcggacgccggcgctgccaacggaagggcgggctctgctgccatgaaggtgaagattaagtgctggaacggcgtggccactt

SEQ ID NO: 517 - DNA, 167 bp, Homo sapiens
ggtcaagaagccagtcatcgctgctgtcaatggctatgctttgggggggctgtgagcttgccatgatgtgtgatatcatctatgccggtgagaaggcccagtttgcacagccggagatcttaatagggaccatcccaggtgcgggcggcacccagagactcacccgt

SEQ ID NO: 518 - DNA, 314 bp, Homo sapiens
ccatggtctgggaggggctgaatgtggtgaagacgggccgagtcatgctcggggagaccaaccctgcagactccaagcctgggaccatccgtggagacttctgcatacaagttggcaggacattatacatggcagtgattctgtggagagtgcagagaaggagatcggcttgtggtttcaccttagaggaactcgtagattacacgagctgtcctcagaactcgatctatgaatgacaggaggacagacacattgcttttcacatccatttaccctacttaccattgacagaggacaggctgtaggaatctagt

SEQ ID NO: 519 - DNA, 325 bp, Homo sapiens
ctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaattgaaagatacagatagtgaagaggaaatccgtgagcattccgagtctttgacaaggatggcatggttatatca

SEQ ID NO: 520 - DNA, 190 bp, Homo sapiens
tagatgcagaaaagaccctaataaaattcaacatctcttcatgttaaaatctctcaataaactagttattgaaggggaacatacctcaccataatgcgcgctatttatgacaaacccatagctaatatcatacaggatgggcaaaagctggcagcattcttcttgaaaaccatcgtaggcaaggttactt

SEQ ID NO: 521 - DNA, 250 bp, Homo sapiens
gaaaaagcttgtggtgaaggggggcaaaaaaaagaagcaagttctgaagttcactcttgattgcacccaccctgtagaagatggaatcatggatgctgccaattttgagcagtttttgcaagcaggmacaaagtgaacggcaaagctgggcaccttggtggaggggtggtgcccatcgacaggagcaagagcaagatccaccgtcacatccgagggtgcctttctccaaaaggtatttgacatatctcac

SEQ ID NO: 522 - DNA, 130 bp, Homo sapiens
ttaaaacttaccaaaatatggaaagtgattaaatattttcagaatgtataaaagatatttccagatcagtaaattctgcattagtccattggagattctggaataaacacctttagggtacttctaaagc

SEQ ID NO: 523 - DNA, 215 bp, Homo sapiens
gaaaacactttttacattgcagcagaccttaagtcttctagccttagggacagccggtcatttctcgtgtatccagtcctgtctttcagtcaaccagagtaacaaatggcttcttttgtccttccctttgtttactactccaaccaggatctttaagatagagcgtgcaagggcgatatgccaggcgatatacaagcccatataaggcaggcttc

SEQ ID NO: 524 - DNA, 130 bp, Homo sapiens
aggcaaggagaaaacgaagagaaagaaagttttgaaaaacaaaaggagaggaagaagaagaggcagcaggcatggaagacgtcaactagtccttagatagaagtagtggcacccgtacagacgggtaact

SEQ ID NO: 525 - DNA, 195 bp, Homo sapiens
tctcgctctagggagattcttcaagcaatcactatgtcaacagacacaggtgtttcccttccttcatatgaggaagatcagggatcaaaactcattcgaaaagctaaagaggcaccattcgtacccgtttgtttttggagacagtcccgctctagtcgcccaggctggagtcacagtggcaggatctcgtctcac

SEQ ID NO: 526 - DNA, 136 bp, Homo sapiens
gcacacatatgtccctgttctgttctcatagaggagatcaaatcccttttatctattagataatcaagggcactgtgatacagttttgagtaaaaggccatttttttaaaagccttccagttttgtggattaacct

SEQ ID NO: 527 - DNA, 191 bp, Homo sapiens
ttttatttatttcattttatttcatttctttcatttatttctgagacagagtctcactctattgcccaggctggagtccagtggcgcaatcttggctcactgcaacctccacctccaggctcaaatgattctcctgcctcagcctctcaaatagctgggattacaggtgtccaccaccatgcccagttaat

SEQ ID NO: 528 - DNA, 105 bp, Homo sapiens
cgcttaaatgctgaaggtgattgtaaaaataataaatactcacatagttcaaggaacactggaaagggaaaggcctatgagggcgtaatttaaaggggtacagtt

SEQ ID NO: 529 - DNA, 151 bp, Homo sapiens
ctgtctacaagacctcactaacccgtccaggctagcagtgcctgcacagcctagctcctctccatctcttcttaagcaggctgttccctcatgcaggcaccagtcctccatgagagtccagagggcattgaccttcaggtgcatgtgtcag

SEQ ID NO: 530 - DNA, 100 bp, Homo sapiens
gtcaatgctgattgggtaattatacattcttgtgctaatttacaccttaaatttgcctcttcaaggtgattgtcctctgagtcatgattggtagatacat

SEQ ID NO: 531 - DNA, 146 bp, Homo sapiens
gagactttcctgatggtgtccccgagaggctgtctcgcagcatgtccttactagaattggtgttatgtctttgattcgcagaaggttcaggagtttgaacatgttaatgggcgctggggcatgcctcaactggctcaggtggagga

SEQ ID NO: 532 - DNA, 113 bp, Homo sapiens
cttttggaggctgaggcgggtggattgcttgaggccacgagttcgagaccacccttggccaccgtggtgaaacggttttctcttattaaaattacaaaaaattagggcttggg

SEQ ID NO: 533 - DNA, 480 bp, Homo sapiens
gtttttctggcataaggagaggaagatgggggtggggaggtggaatcaaatccatatgtttgtgatgcagttgccctgaaataataagaaagcattgctgggaaagagcctttggatgtctcaggaaccatgtttacaagccccacattggccttttggtcccctcagttcatgctgccacttgccaggctttgaaaggaccaagttcacatggggacactactcttctttcttctcctgattttttgcagcctttgctcccaatgaccttgtctctttctctgtatcatcaacatgaggtgaaggacaaatgcttgaatctttacttctctgcagagctcaatgaggcatactgctttttgccgccctatgacctcactatctgagctaaatatcatttcttcttgtcatctgtaatgctgacaactcctgggtaaagctgggtgcctcacctacagctaactggaccctgtaaaactt

SEQ ID NO: 534 - DNA, 304 bp, Homo sapiens
ggcacctgggctgggcacggtggctcacgcctgtaatcctagcactttgggaggccgaggcgggcagatcacgaggtcaagagatcaaaaccatcctggccaaaatggtgaaccctgtctctactaaaaatacaaaaattagctgggcatagtggcacgcgcctgcagtcccagctactcaggaagctgaggcaggagaatcgcttgaacccaggaggcagaggttgctgtgagccgagattgcaccactgcactccagcctgggcaacagagtgagactccatctgaaaaaaaaaaaaaaaaa

SEQ ID NO: 535 - DNA, 210 bp, Homo sapiens
gtaaaaatcaaaattcttttaaatatcaacttaattttttctaagtaagatacaaaaaattttcatctaaagtaatatttcactttatattgtaaagaaggtaggtatattggtggctgaggtctcctgaaattgctaaagggaaatttttccatggtaatgctcctacggatataaacctcagttaaatggaattaaccaagggatgtg

SEQ ID NO: 536 - DNA, 506 bp, Homo sapiens
gtttatatatatatgtgtcacatttcctttgtccattcatctgttgatggacatggctttattccataacttggctattgtgaatagtgctgcagtgaacatgggagtgcacatgtctctttgacatactgatttcaagttcttaagatatagattcacaagtgggattgctgaatatggaattgatttgtgtgggtgaggcgggcatccagataacatttttgtccaaatggatgcccagttgacctagtgccattgattgaaaaggtcatcctctccccactgcactgcagcgtcaccactggcatggatccaatgacctgtgttgtgtgtggttctgcttctggttaagccagatgctctgcccttccatgaatgcgtgctgccttaattactataatttgtcaagcattttgtgacacaaaatacacaacgcaatgatgttttgtgtaaaggtttggtatgattttccttttaaggtttttgttatttacatttcattttcc

SEQ ID NO: 537 - DNA, 294 bp, Homo sapiens
aggccgggaactgcatcatggaggtgtcctcgttggccacgcggaaagcagtcagaagcccaaccgtgagggacatgacatccaaagattactacttttgactcctacgcacactttggcatccacgaggagatgctgaaggacgaggtgcgcaccctcacttaccgcaactccatgtttcataacccgcacctcttcaaggacaaggtcgtgctggacgtcggctcgggcaccggcatcctgtgcatgttgtgctgccaaggccgtgcccgcaaggtcatcgggatcgagtgt

SEQ ID NO: 538 - DNA, 179 bp, Homo sapiens
tctggccttcccaaactgcttttgatcttttgattcctcttgggctgaagcagaccaagttccccccaggcaccccagttgtgggggagcctgtattttttttaacaacatccccatttcccacctggtcctcccccttccatgctgcaacttctaaccgcaatagtgactctgtgctt

SEQ ID NO: 539 - DNA, 250 bp, Homo sapiens
gccggctgcgggaagatggcggctcagccgttgcggcatcgctcacgttgtgcaacgccgccccggggggacttttgtggtggcactgagagggcgattgaccaagcttcttttacgacctccatggagttggatacgcaggttgtgaaggggtcctgccgctcggcccgcaggcttgggggctgaggagccagccgccggcccgcagctgccgtcttggctgcagcctgagaggtgcgctgtgttccag

SEQ ID NO: 540 - DNA, 305 bp, Homo sapiens
cgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaagaacaacacagtcactcctggcggcaaaccaaacaaaaccagagtcatctggggaaaagtaactcgggcccatggaaacagtggcatggttcgtgccaaattcgagcaatcttcctgctaaggc

SEQ ID NO: 541 - DNA, 83 bp, Homo sapiens
tgtgtacatagtaaccagtcttatcttgagatgtacagagatttgcaaatttttacatgaggaggtaagcaatgtacttaatc

SEQ ID NO: 542 - DNA, 255 bp, Homo sapiens
  misc_feature 219: n = A,T,C or G
gacagatggtagagacttccatagaattaagagggttctcatggaggggataggaagtaggtttaaagcctaccagtgtaacctaccagtacaactgtgaatcctaggcgaggcaaaaatgcacttccactgaaacgaagcatttctgaccgctttttcttggttatgatctcaatttcgaatataagatgataggtaagcgcactttctcggatactnctgaattcccaagtgccaggagtaggatttcattat

SEQ ID NO: 543 - DNA, 170 bp, Homo sapiens
gtaagttctaatcatttgataagttactactgaatggcaagctatttctatataactatctagaggcgtctctcctctttagttgtagaataacctactttagactacatatttatcatattcgtcatgtactaccatcagaccttgcttgcctgcatcaaaatgaaatg

SEQ ID NO: 544 - DNA, 150 bp, Homo sapiens
tgcccttgtatcttgcatgttaaacgttggattattgggcatgtgtgcagcctgcctctacatgctagacaagtgttcctttagtacataggccacaaggtcttcattctttaaaatggtttgacaggttctcctatataaaattaattc

SEQ ID NO: 545 - DNA, 165 bp, Homo sapiens
gccaaaacagcagtggctcacaggcccggggcattcaaagctgagctgtcaagctggtgatcgtggccaaggcattcgcgcactgagctgtgaccagcagccctgttgcgggtgcaccttctcatctccggtgaagctgaaggggcctttgcctgaaaggccagc

SEQ ID NO: 546 - DNA, 160 bp, Homo sapiens
cgaacgcaacatgaaggtgctccttgccgcgccctcatcgcggggtcgtcttcttctgctgctgccgggaccttctgcggccgatgagaaggaagaaggggcccaaagtcaccgtcaaggtgtatttgacctacggatttgagataaggattaggccggg

SEQ ID NO: 547 - DNA, 160 bp, Homo sapiens
ctctgaccagcaccatggcggttggcaagaacagcggcttacgaaggcggcaaaagggagccaagaagaaagtgtttatccattttctagaaagatttgtattatgttaaagcaacctcctattgtcaatattaggcaatattggaagcggttcgctaac

SEQ ID NO: 548 - DNA, 170 bp, Homo sapiens
aaaaatctcattcccagagtcagaggagaagagacatgtaccttgaccatcgtgctttctctcaagctagccagagggtggagcctaagggaagcgttggggtagcagatggagtaattggtcaacgaggttccagaccacttcccaaagcttcagacttgccaaggttc

SEQ ID NO: 549 - DNA, 150 bp, Homo sapiens
cgaggagatcaagtgagttgtcatttatactgtactctgtgactgtacagttgaatatcttatcaagtttataaaatgcagattttgtttacttttttaagtatgttgtagcacacacgaccctcatgttgttttggggaaggggatggt

SEQ ID NO: 550 - DNA, 206 bp, Homo sapiens
cctcgtgccggaatttcggccacgagttaaatgtggagttttttgtgaattcacatgaagtatggaatggttgttttattatgactttagtttgcattttccccaattctcgttaaatccctcattctaatgggcaatttattgtgtaaggacccgttcatatcccgtgtctctaactttgtatttggattaattttctctcggat

SEQ ID NO: 551 - DNA, 197 bp, Homo sapiens
ccagggtttttgtggagccaggctgaggctctgaaggccaaggggagtccaggtggtggcctgtctgagttttaatgatgcctttgttacttgcgagttgggcccagcccacaaggcggaaggcaaggttccgcttcttgcttatcccacttgggccctttgggaaggagacaagcttatttacttgagttagttcc

SEQ ID NO: 552 - DNA, 242 bp, Homo sapiens
gtttcgctcttgtttcccaggccggagtgcaatggcgccatctcggctcacccaaacctctgcctcccaggttcaagcaattctcctgcctaagccctcccgaatagctgggattacaagcgccaaccacaatgcctggctacttttcaaaatttaatggagatggggttttaccaagttggccaagctgggctcgaactcctgacctcaaggtgaaccgccttccttgggcctcccgagtc

SEQ ID NO: 553 - DNA, 221 bp, Homo sapiens
ggctgctctcaagtacctcattgacaattccttcactgtgtccagtggggctaggcccggggcccagaaggtgggcattgtcttcactgatggccggagccaggactacattaatgatgctgccaagaaggccaaagacctcggctttaagatgtttgctgtgggttttggcaattccctggaggatgaccttagggaaatagccccagaacccttggcam

SEQ ID NO: 554 - DNA, 221 bp, Homo sapiens
gggcaaacacagaaattttaaaaaagagtcttaactaccacagagttaattgcctcacttttcaaaaagggaaacttaagtgcttttttttccaccttcttttttgcaaaatagtcccttcacttttaagttacttaacccattttcactttcccttccactttgttttattcctaattgaaagattttattactttttaaatgaaagaaaattaaaccca

SEQ ID NO: 555 - DNA, 186 bp, Homo sapiens
gtctggcccaagccattcagaggtggggtctggggcctgggggttttgtgtcgtgacactttgtctcaaggagattccacatagggatttgaattaggctttctgcttgccaaggcctgttgcatcttagcctggcttagggccgggcaaggcctccccttagcctttggaagccgaggttcacty

SEQ ID NO: 556 - DNA, 169 bp, Homo sapiens
agaagacgatctgcacttcgcattttggcattgacatttaattttagggtcctttatatagaagggagagtaggtaaactgatttttttttttaacagggagggtttgacaatctttggcagacttggagcaaaagattgaggtgcatttcatgcctccttttgagagt

SEQ ID NO: 557 - DNA, 225 bp, Homo sapiens
ccaagcagaggctcccgtgcaggaagagaagctgtcaggtgggtgattgtctgggaacccgacacgtcccgtcgtttgtttttggttttagtatcttccccatataccaagagcacaggtggaaaaggccgcaccacatggcaattagggcaagcgctttgccgggaagtttgattggccagaaccttgggagaaatttttttctagatgtggcttgggcttgca

SEQ ID NO: 558 - DNA, 118 bp, Homo sapiens
ccttcttacttaaaggatcagaattatgccgggcgtggtgcgcatcccattattccagctacctaggagaccttaggatggagaataccttaaccctagccgcggaggttcagtagtt

SEQ ID NO: 559 - DNA, 234 bp, Homo sapiens
cggatggagtccagcaggggagtgtggaaagtggggcttgtgctgctgcctagaacaataagggatgtaaaaggcctgggaggctaagaaccctccccaaggcccaattccatgcacatttactttagctaacaatttaggggaggacttggtaagggccagggccctgttcttgggaacattagctgttatcaacaagcaggaaaggggtcgctttccccttaattgcgcttt

SEQ ID NO: 560 - DNA, 187 bp, Homo sapiens
ctcgtgcgaattcggcacgagaatattttctgtttctctttttcactctctaaactctttttgtataaataaggattatcctggaccataattcatttgaatatgaaaccaacatactttctttcatttttgtgaaaaaataaccaaaacatgtattaatgtgatacaaaggaaggctcatttccac

SEQ ID NO: 561 - DNA, 377 bp, Homo sapiens
cagactgttgcactctaaacctagggaggttgaagaatgagacccttaggttttaacacgaatcctgacaccaccatctatagggtcccaacttggttattgtaggcaaccttcctcttcttccttggtgaaggaccatccaaggccagaaggacgttaaccttacagtgttttcctttgcaccgttccccaccccaattcatcccggaaggaacttcactgaggaaacccttctttactagatatcctggccccctgggcttgtgaacacctcctagccacatcactacagtacagtgagtgaccccagcctcctgcctaccccaggatgcccctccccaccctgaccgtgctaactgtgtgtacatatatatgct

SEQ ID NO: 562 - DNA, 198 bp, Homo sapiens
gaccctgtgcgcatcttcaaacatgagccacagccaccacactctgtcctcaagttcctgcaggacgtgtttggcagcccggccacagctgccatcttctaccacacagacatgatggctctcattgacatcactggtgcggaacatcggaggcctgttaaccagggggcaagcttccgattgagtgcctctccctta

SEQ ID NO: 563 - DNA, 278 bp, Homo sapiens
gggctttaaaaaaatcagctttctgatttatattctgtggaaatgaggcttgtttgtttcaggttattctataatgtcttttggtgtggctgaagctgctgaggccatggggggagatttgtaaacaaggatttaaaaagtatgtttatttaatctcaattgaatttggcccaaggacttaaatatcaggaattgagatgggcccagctctgttttttgggcacactctctctatatctctaaatatatatagacaaatcacatatgtcacacgggtt

SEQ ID NO: 564 - DNA, 253 bp, Homo sapiens
ctcgtgccgaattcggcacgagagaaggccctgctcatccagggctccaatgacgtggagatccgggcagagggcaatagcaggttcacgtacactgccctgaaggatggctgcacgaaacataccggtaagtggggcaagactgttatcgagtacccgtcacagaagagcctcacggcttccatcattgacatatcacccataggacatatggagggccccagcacagatttcggtgtgtgacatagaggcc

SEQ ID NO: 565 - DNA, 110 bp, Homo sapiens
gatgaggacctcaccatccggatccatcagccaatggccccaaaactgggatccggaaggggcggggcaatcaacggggcccggggagaaaggattggaagagaacctcc

SEQ ID NO: 566 - DNA, 237 bp, Homo sapiens
ctctgtggcccctgcgaggaagcttgctccgggagtggtctttgggcataggcacctgcgtcactgtggcgaggtctgcttttgtctctgaccagctaacatcctcagatggctgccggcttccaccgcagagcaaatgccgctgccttctgttgagaacagagttagaatcggcgaggcaacattgttttttagcttaaggcaagcccggcccggggaaattgatatggatatgct

SEQ ID NO: 567 - DNA, 243 bp, Homo sapiens
ctctgtggtcctgctgccaccatggccactcaccgcctcgtgatggtccggcacggcgagagcacatggaaccaggagaaccgtttctgtggctggttcgatgcagagctgagtgaaaaggggaccaggaggccaagccgggagccaaggcatcaaggatgccaagataggagttgacaactgctacacagtcaatcttgaagccggccctcccacacctcttgggcctactcgagcaggaca

SEQ ID NO: 568 - DNA, 345 bp, Homo sapiens
caaacccctacagaccatcacctggaattgccactcacactgggttggagtcattgggcagctgtgcctgtccgagaggtgtctgtggtctgggcagcccctggaaaagcacctttcctgcctgtcattgttgcctgaggagggctggagttgctctgagagcagtttgggtttggagtattatatttggcttctatttttattattttggatcaccattctccctatcccttcttgcctccctcccttctaaacatgtttaataactatacagagactgctacaaaattgtatatagttttgggatcaaatagcatgaggggggaggaaccattaaaattgggg

SEQ ID NO: 569 - DNA, 250 bp, Homo sapiens
attgacattttaataatagtctcctagtctcaaaatgaattcggatgacatcacaccccggggcctgtcagggtctgggggactaggggaggttagcattaggaaaatacctaatgtagatgacgggttgatgggtccagcaaaccaccatggcacatgtatacctatgtaacaacctgacacattctgcaaatgtatcccaggatcttaaggtatattaaaaaattttttttaatgaattaggatggag

SEQ ID NO: 570 - DNA, 178 bp, Homo sapiens
tcttcctggacgagtcccgctccacgcagtacatgaaggagtaccaggacgccttcctcttcaacgaactcaaaggcgagaccatggacacctcctgagttggatgtcatccccgacccaacctgttttccaccagagttctgacactgtgactctgtataaaatggttgggagctgc

SEQ ID NO: 571 - DNA, 101 bp, Homo sapiens
gttgtgtagtagttaaggactatggcaaggagtctcaggccaaggatgtcattgaagagtatttcaaatgcaagacatgaggacataaatctttggctcac

SEQ ID NO: 572 - DNA, 346 bp, Homo sapiens
gttcattgtcatcaatcatggtttttgaagatagctagttttatccatctccagcaaagaatcatcaatagtttatattgctttacctgtgcctggcttccagagatggaacaaacccaggtgtctctcaacaagctacttttttactgggtggggaatctatgcaaggagtaaagtaaaaccatccagaatcaaagcagcaaccacatagttcaaatcaaagatcaaggtgaatttttgtatcactcctgtggaaatctatcctaatcaagtcattgcatttttccccgccataacttgctccctttcctactgtgtttcaggtacttcccttctgttaaagggt

SEQ ID NO: 573 - DNA, 325 bp, Homo sapiens
gaatggtccagcgtttgacataccgacgtaggctttcctacaatacagcctctaacaaaactaggctgtcccgaacccctggtaatagaattgtttacctttataccaagaaggttgggaaagcaccaaaatctgcatgtggtgtgtgcccaggcagacttcgaggggttcgtgctgtaagacctaaagttcttatgagattgtccaaacaaagaaacatgtcagcagggcctatggtggttcatgtgtgctaaatgtgttcgtgacaaggatcaagcgtgctttccttatcgaggagcagaaaatcgttgtgaaagtgttgaag

SEQ ID NO: 574 - DNA, 234 bp, Homo sapiens
ctgcactgaatggctgacctgacctgatgtccattcatcccaccctctcacagtttggacttttctcccctctctttctaagagacctgaactgggcagactgcaaaataaaatctcggtgttctatttattattgtcttcctgtaagaccttcgggtcaaggcagaggcaggaaactaactggtgtgagtcaaatgccccctgagtgacttcccccagcccaggccagaagac

SEQ ID NO: 575 - DNA, 150 bp, Homo sapiens
cctctttctgccaaaaatttatagtattggtatatgtcccaatccaaaatctcactgttagaactcagattttcaggtctttccggttagtctcacttttttccacttggaccaccttcacttttttcaaattgtgtcagcacctgtgaa

SEQ ID NO: 576 - DNA, 190 bp, Homo sapiens
gggaaaggggttaacttcagccaggattgatggcagctgagggaaatttctttgccccaacttaaacccagaacttcaaactttaacatttggaaaattagggttccagggcccggacacagttggcccattgccttgttaatcccagccacttttggggggccaaggcgaggcttgggatctaccttta

SEQ ID NO: 577 - DNA, 240 bp, Homo sapiens
gtaatatggactttggcttaattttgtctcgttcttataaataatcctttgaaatgtgtctcagaaaatcattaacactgaaaaagggaatatggaagacttagaattctgaaaattataacatagtagactttttaattattatcaattgtgaattcaacaattttgtggggttacttagagccatgacactgtacacttggtaatttggtaaagtgccgagtgtcatatatgtccagt

SEQ ID NO: 578 - DNA, 171 bp, Homo sapiens
cggaggtggcagccatcttcttcttggcatcatggccggcctcagacccttgtgaaggccaagatcgtcaaaaagagaaccaaggaggttaatccgcaacagttagagcccatatatgcaaaattaagcgctaacttggccggaacccagaggggatttacaacacaggtt

SEQ ID NO: 579 - DNA, 100 bp, Homo sapiens
cggtcgtggagcacgtttcctgcggcgcgatggccgtagtctttcggcagttgtgaggagctcctcagctagattgcggcaggccgttgcaagcaaaccc

SEQ ID NO: 580 - DNA, 250 bp, Homo sapiens
gagaaagaacattggtaaaaggtatgaattccagaattaaagaaataatttggggatttctagataagaggatatatatgaccatgcataccttacaccttcatatacacaaccttaaatcacaaattaaccaaattaccaattcaaattttacccccaggttcagaaggtatcagacgagataattagagaaagtaaaaatatgctgtctcccatatatccataatgtgtcaaactcgacactaataat

SEQ ID NO: 581 - DNA, 269 bp, Homo sapiens
gtttggcaggcactgcctgctacttgagggccaggatgctcccccagggaagaaacggaatagtgtgggggtgtgtgcaggggctgcatcccgcagatgggctgggaatattaaaaattcttctatattgggctgggtaaattgccatggccctgagccactgagtatgttcattgccacccctgtccctcccctgggcacccctcactttccctgatcctgcaattaagggggtaatgtgggcatatggaggggactccacggagccc

SEQ ID NO: 582 - DNA, 274 bp, Homo sapiens
gaaattggctacaaccccgacacagtagcatttgtgccaatttctggttggaatggtgacacatgctggagccaagtgctaacatgccttggtttcaagggatggaaagtcacccgtaaggatggcaatgccagtggaaccacgctgcttgaggctctggactgcatctaccaccaacttgtccaactgacaagcccttgcgcctgcctctccaggatgtctacaaaattggtggtattggtactgttcccgtttgccgaggtggagacttgtg

SEQ ID NO: 583 - DNA, 255 bp, Homo sapiens
cttaggagtccgaggtgggtggatcacgaggtcaggagatccagcccatcctggccaacatggtgaaaccccatctctactaaaaatacaaaaattagccgggcgtggtgacacgtgcctttagtcccagctactcgggaggctgaggcaggagaatcacttgaaccttggaggcggaggttgcagttagctaagatcacgccacttcacttcagccttcggacagaccaagagtttattccccccaaaaaaaaa

SEQ ID NO: 584 - DNA, 320 bp, Homo sapiens
tgcgtctttccttgaatattttattggcccagagttagcctttctcaattatgtttccagactgtggccgtgattctaaaggaaaatgtgtgctctttagtgggtagaacaaatggaaatttggtttcagaatggctgacagaaatcgacataagtcatgtaatttttgttgatatatcatgaaaatgaacagaattctttttccatacttatatctaagaaaaggcatcataggttctgaaagagataactatataacagcttttaaactatccagtcaactttcagctttctccatttaggtaaatggtaggtataac

SEQ ID NO: 585 - DNA, 317 bp, Homo sapiens
gtactttgaaattgttatgggttcgttttccaaaatatgtaacttattttttaaaggaataaggtgtgctgtgtatttgttgattaaaaatcatttgtcttgcagagtatccttttttgaaggaaatatacatccttataacacatcaggtagttttcttttttctgtatttaaattatatatttcccttacttgactataatttccgttacatataattctatataccggttacatattgccttatggttctaatctgtttagggaagaatgaatttctaagcatttaatacatttgggtaattttgttctaaaag

SEQ ID NO: 586 - DNA, 309 bp, Homo sapiens
agtgcatcaacgggatacagttccatattgccttaaacctccttgttttagacacactaacatttataccaaattgcagattattctgcagagagggaattgcatgtttgtgttgtatatttagtatgaacttttttcagaatataatatttcttaggtatcaaaagtagttggaaaacatttgcaagactatgaacatagaattgctgcttttatattttaactgcagattgtgaatttcactgccttatattatttatttctgaaacaaaagaggcatttttcaataaaactactgaaaatttgaat

SEQ ID NO: 587 - DNA, 222 bp, Homo sapiens
caggtagctaaagatgacttaggtcaggagatcgagaccatcttggcaaacgtggtgaaaccccgttctctactaaaaatacaaaaaaaattagccaggcgtggtggcgggcacctgtagtcccagctacttgggaggctgaggcaggagaatggcaggaaccccgggggcggagctttcagttagcggacatcgcaccacttcactccagcctgggcaaca

SEQ ID NO: 588 - DNA, 113 bp, Homo sapiens
acagtgtctcactatgttgcccaaggtggcctcgaactcctgagctcaagtgatctgcccacctgagcctcccaaagtgctgggattacaggcatgagccactacggctagcc

SEQ ID NO: 589 - DNA, 217 bp, Homo sapiens
ctcgtgccgaattcggcacgaggtaagttgctattttcatcacagttgcctatgcccagggaataagatgtattctttataattgaattggtttttcccacgtctaactggaaacaaaacagaaggggcgtcataaatttgaataagcagaacatactgttctcaacatactgtaatcaaaggaggaatttcagtgggtctctgtgtgtgtatgaga

SEQ ID NO: 590 - DNA, 280 bp, Homo sapiens
  misc_feature 20, 62, 217, 222: n = A,T,C or G
gtaagttctaatcatttganaagttactaatgaatggaaaactatttttatataaactatcnagaggcttttcttctctttgttgttagaataacttctttaaactacatatttatcatattgtcatgtactaccatcagtgcttgtctttccctgtatcaaaatgaaaatgtgtgatatgatattttagaaattatgaagtactttttatatgaanttacntctttgttttatgaaatacgcaaggcagaaattatcattctcattttaagatttaaaa

SEQ ID NO: 591 - DNA, 600 bp, Homo sapiens
cctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttcctggttattttttgtaccatattgtaaattatattatttattctttaccaattttgggaataaaaggtgttttggttatttaatataataagagctgttaaacttctgtttaaatttccagttcaaccttgtaa

SEQ ID NO: 592 - DNA, 490 bp, Homo sapiens
cctgtctctactaaaagtacagaattagccgggcgtggtggcgcatgcccataatcccagctactgaggagacttgaggtaggagaatcacttgaacctcagcggcggaggttgcagtgagtcgagatcgcgccagtgcactccagcctgggcaagaagagcgaaactgggtctcaagttaaaaaaagaaagcaaggaaagagtaatttacaacgaaggaaaaaaacccacagcacacccttcgcggctgtcaagcgctctcctgatgtcacagtggctgcgtgtccttggggtgggtgaggtgtggggagcccagcccctggccctgcctcccgcgccccgctccccttctctctcttactcggttaagccatagcgaggcctccgctcgtttcagatatgaatttgttttatagattataaatatgcatatacagtgtatgtataaagcagaatgcctgcctttccctgggtaatttttgtaccatat

SEQ ID NO: 593 - DNA, 531 bp, Homo sapiens
cggatggagtccagcaggggagtgggaaagtgggcttgtgctgctgcctagacagtagggatgtaaaggcctgggagctagaccctccccaagcccatccatgcacattacttagctaacaattagggagactcgtaaggccaggccctgtgctgggcacatagctgtgatcacagcagacagggtcgctgccctgatggcgcttacattccagtgggtctaatgaccatatcttaggacacagatgtgcccagggaggtggtgtcactgcacaggaagtatgaggactttagtgtcctgagttcaaatcctgattcaggaactcacaaagctatgtgaccttacaccagtcacttaacttgttagccatccattatcgcatctgcaaaatggggattaagaatagaatcttggggttagtgtggagattagattaaatgtatgtaagacacttggcacaaaacctggcacatagtaaaggctcaataaaaacaagtgcctctcactgggctttgtcaacaaaaaaaaaaa

SEQ ID NO: 594 - DNA, 340 bp, Homo sapiens
ccaggctggagtgcagtggcgcgatcttggctcactgcaagctccgcctcctgggttcatgccattctcctgcctcagtctcccaagtacctgggatgacaggcgccttccaccacgcccggctaatttttaattttttgtatttttagtagagacagggtttcaccatgttagccaggatggtctcgatctcctgacgtcgtgatcagtccgcctcgtcctcccaaagtgctgggattacaggtgtgagccacttgcacccgaccgatactcacatttttaaactttttttttaattttattttggtagctaggtttatattggtcttaaatttattta

SEQ ID NO: 595 - DNA, 270 bp, Homo sapiens
cgagagaggagccagacagaccctgaaaagaaggacgggttggggccgggcacattgggggtcaccggccgatggagacaccaaccgacaggccctggctgagggcagctgcgcgggcttatttattaacaggataacccttgaatgtagcagccccgggagggcggcacaggtcgggcgcaggattcagccggagggaagggacggggaagccgagctccagagcaacgaccagggcccgaggaggttccttgagttcccacccttgga

SEQ ID NO: 596 - DNA, 171 bp, Homo sapiens
taatatacctagggtgtataatatggtaaccctatgattaactttttttgagggaacccacctacacttttttcaccagcagcccattatcaatttttattaattcccaccgccaattgttattgaggggtttcccggttttttttcaaccttcatggacaaacaactttc

SEQ ID NO: 597 - DNA, 195 bp, Homo sapiens
aggtaattctacaagggcaagaagtacagcccctggacctgcggcctaagaagacacgtgccatgcgccgccggctcaacagcacgaggagaacctgaagaccaagaagcagcagcggaaggagcggctgtacccctgcggaagtacgcggtcaaggcctgtagggcgcattgtcataagcacacttgctgtgga

SEQ ID NO: 598 - DNA, 220 bp, Homo sapiens
cgacgagtcgggccctccatcgtccaccgcaaatgcttctaaacggactcagcagatgcgtagatttgctgcatgggttaattgagatagaatttgcccctgcaaatgcacacacctcatgctagcctcacgaaactggataagccttcgaaaagaaattgtccttgaagcttagtatctcgatatcaagcactggattatagacctgtgctgattagaa

SEQ ID NO: 599 - DNA, 240 bp, Homo sapiens
ctaacaggggccctctcagccctcctaatgacctccggcctagccatgtgatttcacttccactccataacgtcctcatactaggcctactaccaacacactaaccatataccatgatggcggcatgtaacaggggaagcacataccaaggcaccacacaccacctgtccaaaaggccttggtacggggtatcctatttattacctagaatttttttttcgcgagggttttcttgcgctt

SEQ ID NO: 600 - DNA, 115 bp, Homo sapiens
ggttgtgtctccattcctttctggaggtgccagccagtgaccacaatagtggaggtctttatacattttggcctgtttatccctagaagtagttggaaatttatatctcactaca

SEQ ID NO: 601 - DNA, 145 bp, Homo sapiens
aacgagtccattccggctaacacggtgaaactctactccacaaatacaaaaatagattagccggtcgagggggcgctagccttaagttccaacacacaaggaggcagagctagggaacgttttaccacgaaggcggagattccat

SEQ ID NO: 602 - DNA, 160 bp, Homo sapiens
tgtctgccctcccagccacccaaggtaagttgtgaaggcaccaacacagttatatttaaagaaatattcaagtgcatcagagagagtcttggatgaagggaggagtcctcccgcagggtcttggtcacctaggcaaaaccccagaagcaacccatttaag

SEQ ID NO: 603 - DNA, 235 bp, Homo sapiens
ttgagggtgaggccctcacttcatccggcgactagcaccgcgtccggcagcgccagccctacactcgcccgcgccatggcctctgtctccgagctcgcctgcatctactcggccctcattcttcacgacgatgaggtgacagttacggaggataagatcaatgccctcataaagcagccggtgttaatgttgaccctttttggcctgcttgtttgcaaaggccttgccaacgtaa

SEQ ID NO: 604 - DNA, 135 bp, Homo sapiens
ggatacgcgctatttacttatcagcacaaggagagagcaccatcttaagggtgttgcaaggatcgaaaaattttcgagtccaggaaggtcatgtaatcgacttcagaagtatgcgcgtataataatagaattttc

SEQ ID NO: 605 - DNA, 295 bp, Homo sapiens
agaagttctacagatggatggtggtgctggtcgtacaacagtgtgaacatacttaaactgaactgtacacctagaaatggttacagtggtaaaattttgttatattttgctataataaaaaatgcaactgatacatccaaggaataagactgaacaattcatgatcataaagcaactctatttttcttctcattgtctctctaggcctttttttgtgggctacttcctcccctgcccctgggtgaaatctcatagcttccatggtgtttctagagattgttatataataagagag

SEQ ID NO: 606 - DNA, 285 bp, Homo sapiens
aagaagctcatcactgatgagtttgtgaagcagaagtacctggactatgccagagtccccaatagcaatccccctgaatatgagttcttctggggcctgcgctcttactatgagaccagcaagatgaaagtcctcagtttgcctgcaaggtacaaaagaaggatcccaaggattgggcagctcagtaccgagaggcgatggaagccgatttgaaggctgcagctgaggctgcagcttgaagccaaggctagggcccagattagagctctcattggcatttggctc

SEQ ID NO: 607 - DNA, 284 bp, Homo sapiens
caaagagtaatgcctttgctaatcactattatgcacttaagaggaagccagtgggtatttttcccttcatagctttctagtacaaattaataaaatttagaaaattagaaaatgattgtgcataaatgtgtataatcatgtatctgttagggggcaaaaattagttggggaattatctttctttgataagtcttatcataagtttgaaaatggggcattggcaattcaatctgtttggctgggtgtcctcagaacaatcccagtcaattctgttttgcaactct

SEQ ID NO: 608 - DNA, 249 bp, Homo sapiens
ataaaatttatattaagtaaacgcagtcattttaacaattaggcaacaatcatcccagctttcagaaattgcctttttttggaattcttatagcacgaaattatctccaagacttgtgctaccattagtatatgtgtatatattggatgtatatattcttttcctcctgtaaggcccattagggctatgacattgtcattgctgctcattctacaaataggtgttgctactgagaaaggggggctgccc

SEQ ID NO: 609 - DNA, 284 bp, Homo sapiens
ctggtgtcaagcctcacctccagaatccagtactgcctcctacctcattagaattgttttcactgtgtgtcaacatgatcattcctctgttttaacaagggaataaacttaatgaacttcaacttcaggggattttttttttaaatgcaatttgagggccgggcgcggtggctcacggctgtaatcccagcactttgggaagccgaggcgggcggatcaggaggtcaagagatcgagaccattctggctaacaattgagagacccctctgctacctaaatataa

SEQ ID NO: 610 - DNA, 259 bp, Homo sapiens
tttttttttacataaattaacccatttattataggccagtgatgtctcaaagagtagaggagcgtctactggtctttcaactccttcagtcttctgatggcggactttaccgtgacaacggaagtggtattgtacggccaggcaccgccagccactgtccttcatgcagggaccacagttccagattcccacagcttgtcttttcatcttgggttttgcacacagagaggcaaggtaatcctgggggtctggctgatta

SEQ ID NO: 611 - DNA, 214 bp, Homo sapiens
cggaagtgaaattctattttatcatcccaaaagcaacatggagagtttcaatacttttgctaaccggatgaaaaatattggcgtcatgaattatttaaaggtctccttacaacatgcattaatacctgctgcatcatgggaatgcttaaaggtgctaaggaaatctgagtgaggccagagactaggagacaattgtagaaataccgtccttccc

SEQ ID NO: 612 - DNA, 225 bp, Homo sapiens
gccaccatgcctggctaattttttgtatttttagtagagacaggggtttcactatgttggctaggctggtcttgaactcctgacctcgtgatccacccgccttggcctcccaaagtgctgggattacaggcatgagccaccgcacctggccttccctgcttctctctagaatccaattagggatggttgttactactcatattgattaaaccagagtaacaaacc

SEQ ID NO: 613 - DNA, 238 bp, Homo sapiens
ctcgtgccgaattcggcacgagctcccctctctttctaagagacctgaactgggcagactgcaaaataaaatctcggtgttctattaatttattgtcttcctgtaaggtccctcgggtcaaggcagaggcaggaaactaacttgtgtgagtcaaatgccccctgaggtgactgcccccaggcccaggccaagagggctccctcaagtgtccgagcgaggaccttgttgtccatacaca

SEQ ID NO: 614 - DNA, 328 bp, Homo sapiens
ggaattcatatctaatgctgacatatgtaaaaccaaaagaatcttaacagaagaaaggagcagcagaatgctataacctcagctttagtccttaacattactctaaatttcctgtttgttcagtatttctggcttttattattaatatctttgttagcttacctgtctctgagtgtcctggggcctaaataaggatataggtttcccttaagcctccctttgatgagatgacccagggtttcatgtaggaaaggttgacgctgtgtatatacatttcctaccccctaacacaggggaaatggctccttatgtcatttttggggaattt

SEQ ID NO: 615 - DNA, 129 bp, Homo sapiens
tggagaaaaacattccaacgttattgtgcagaattcattaaacatttaacaacagataggtgatagttggggaatggagaccattaaaaggactgttctgactggcttacattgtgcaaaattcacttt

SEQ ID NO: 616 - DNA, 194 bp, Homo sapiens
caaacagacatcaatcaaatacatgtaaggtgtacatcgattctgccgggaaaggcggtacaacctgaggtgggaaggggggcccaagtgtgtatccagctgcctgagaaggccgtgccaggttacatggccagcaccctagttcaggttcttgccacatgccttgtcttcttgtttaagcatgctttctgacc

SEQ ID NO: 617 - DNA, 179 bp, Homo sapiens
ttgatgcacaatattagacattatttgtaaaccatctatctccaagggattactatccagactatataaagaactgtaactcaacaacaaaaacaactcaattgaaaaacgggtaacggcctagaattgacacaatctccaaagtaggatatataacttggctcacaagcatatgaaaa

SEQ ID NO: 618 - DNA, 138 bp, Homo sapiens
cttgtttagcatatcatgaagaattaaccacaaaaatgggccaagccagccagccccttgggggcctgcatcctgccctatgggaggtaggccaatgctggtttaatctccctccaccatgtgctaaaatgaaacact

SEQ ID NO: 619 - DNA, 325 bp, Homo sapiens
gcaggatcaaggtgaaaaggagaaccccatgcgggaacttcgcatccgcaaactctgtctcaacatctgtgttgggggagagtggagacagactgacgcgagcagccaaggtgttggagcagctcacagggcagacccctgtgttttccaaagctagatacactgtcagatcccttggcatccggagaaatgaaaagattgctgtccactgcacagttcgaggggcccaaggtagaagaaatcttggagaagggtctaaaggtgcgggagttttatttaggaaaaacaccttctcagaatctggaacctttgttctgggtccagg

SEQ ID NO: 620 - DNA, 254 bp, Homo sapiens
cactggctcgaaaaaaaaaaggcaatataaattggctctgatttatgctacagaggagagggttggggcgctctgtgggcctgtgataggaaggtttgccaattggagttcgtaggcaaagaggaaggaaggagcattccaggcagatggagtagcaagttcagagggagcattggggcaggctgggttggtggacacagagcaggcacttcgggagctttgagttgcatggtagaggagatgtgtgtgtgttt

SEQ ID NO: 621 - DNA, 333 bp, Homo sapiens
gcagcaatggccaagatcaaggctcgagatcttcgcgggaagaagaaggaggagctgctgaaacagctggacgacctgaaggtggagctgtcccagctgcgcgtcgccaaagtacaggcggtgcggcctccaagctctctaagatccgagtcgtccggaaatccattgcccgtgttctcaaagttatttaccagagcttaggagagaaacctcaggggatttctacaaggccaagaaggtacaagcccctggacccttcggcttaagaggacacgttccatgcgccgccgctttaacaagcgcggaggagacctgaggcgccagagcagcacg

SEQ ID NO: 622 - DNA, 321 bp, Homo sapiens
gccaaaatcatgccgcttcactccagcctggacaacagagtgagactctgcctcaaaaaaagaaagaaagaaagaaattggagtcctcatacgttgctggcaggaatgtaaaatagtccagccactgtgggaaatagtttggtatttcctcaaaaaggttaaacagagtcaccatatgagccacacagttccacttcctaagtatatatcccaagagaaatgaaaatacatggtttacacaaacacttggtacacaawatattttataggtgsmvttwtytacaattagccacaaaggtgggaaatgtggtggggccacaa

SEQ ID NO: 623 - DNA, 160 bp, Homo sapiens
cttgaacctgggaggcaaaggtttgcagtgaactgagattgcgccaccgcactccagccttgggcgacagagcggagacttcatctttaaaaaaaaacaagacgggccggcacggttggctcaaggctcttattcccaggcacttgagaaggccagttca

SEQ ID NO: 624 - DNA, 286 bp, Homo sapiens
tccactccctcagtaaataagtcaaaattgttaacccatgtgcccattcctgagtagggcagactcttcacaagaggcccatgacaagaattctagggtccagattgaactttaatatagacctttgtctgtgtagaccagtttgtcttgtaaactgtcttacttatgtggtgtaaacattatacattcacatgaaaagttattttcctttatataattggattcaggatcataagggcaggctgaaattaattctacagtaccagtaggataaggatcggccggc

SEQ ID NO: 625 - DNA, 207 bp, Homo sapiens
gtaattgtattaattatttaaagtgtggaaagcaaaatacaaaaaagagaaacgccaacaaaaatcagcagatgttgaagacaggggtctcgggggtgggctccggcacccacatcctggagtcaggactttcctcagtgactgtgtgtaggggggtttcaaggctgaacctcaacctccttccaccttcctccacctaactgtcga

SEQ ID NO: 626 - DNA, 162 bp, Homo sapiens
catgcctgtaatcccatcatgctgactacgagggagggctgtagggcaagggagaatttggctttgtaatccccagggagggacgggagggtttgccagtgaagcccagggatttgcttgcccattggcaactcgccaggcctcgggcaaacaaggaaccaa

SEQ ID NO: 627 - DNA, 159 bp, Homo sapiens
ttttattttattatttttagagacagggtcttgctttgtcactcacctggaatgtagtggtgcaatcatagctcacggtaaccctgacctcctgggctaaagcgcccctcccatatcaacttccctaagtagctgggcctattatgtagtaatataagt

SEQ ID NO: 628 - DNA, 154 bp, Homo sapiens
gcagccccatgctacgtgattctttatgttgtgttgttttgttttgtaaattgtataatttttaaatatctgagttttaaaaaaagaaaaaagtgacaaaaaattcttgttatgggccttaaggagggtttagtggcatctttcaggggtcact

SEQ ID NO: 629 - DNA, 202 bp, Homo sapiens
ctcgtgccgaattcggcacgagctagcatctgctcagtttctggggaggactcagggagttttattttatggtggaaggcaaaatggggacagactaattgttaaacatattaaaatttgttcatctacactggcaagccctttcgtttagtttacctattctgaaaaactgatttcttttttattctgacattcattgcat

SEQ ID NO: 630 - DNA, 219 bp, Homo sapiens
aaaagtaccagctctggctggggtccgtgaagcccaggccaggcagccaaatcttgcctgtgctgggcatacaaccctctgctttcacatctctgagctatatcctcattagtgaggtggcttttgcctttatagtttggctggggagcacttaattcttcccatttcaaaaggtaatgttgccctgggcttaacccacctcccctttggcaaggttgg

SEQ ID NO: 631 - DNA, 200 bp, Homo sapiens
gaaccttttccatttttttttcctttattctcagcaaacagcaattccactgccagagaggtagtttcctcttttctgcaccatgcagctccctgtcaaccagcttatatacagcggtttccccttgtgtctcctgtgttaagctctaagcaccttgaggccgggcctcacactctggtcagtcctgtctgaagcggcat

SEQ ID NO: 632 - DNA, 200 bp, Homo sapiens
agcccatatgtgccagtccactttgatgcttctgtggaggactctacctaaggtcagagcagcgagataccccacctccctcaacctcatcctctccacagctgcctcttccctcttccttccctgctgtgaaagaagtaactacagttagggctcctattcaacacaaacaatgcttcccctttcctgagtcccaatcc

SEQ ID NO: 633 - DNA, 153 bp, Homo sapiens
caagctactgactgtaagaaaatgttttaaaatcatttctccagcaagggactcgtgtacagaatatataaagaaccttccaaactctataatacaaaacaaacatactcagtttaaaaagaggcaagagacttggaccaaaataaggcacat

SEQ ID NO: 634 - DNA, 184 bp, Homo sapiens
gggtggctcatgcctgtaataccagcacttttggaggcccaggcaggccggatcacaaaggtcaggcgatcaagacccatcttgccaacatgggtgaaaccccctctctaccccaaaataccaaaacttaggctcggcgctggttgcaccccccctctaattccccctcctccggggggtttag

SEQ ID NO: 635 - DNA, 148 bp, Homo sapiens
ctggatttcaaatttttgaattagggatgctgaactggtaaatataatgagaatattttaaaatatgaaaaatctgaaagctgtaaccacttctggtcctgagccatttctggataaggggatactcaactctgtactcggacaatct

SEQ ID NO: 636 - DNA, 284 bp, Homo sapiens
ggcaaaaataagggaggaatatttcaggtagagggaatagcttgtgcaaaggccctgtggcaagagaaaataaagtgagatcaagaatagaaagaaggccaatgtgactggagatgagtaagtaagggggagaaagcacaaggtggctccagaagatggaagcaggttcctaatcttacttctttggtcaggttaccaaggtattttggtttccattctaaggactatcatgattcatttaaagagtgttaacgttaaggggtgacatccatttaaattkatct

SEQ ID NO: 637 - DNA, 235 bp, Homo sapiens
tttagttattgtgaaatttgttttctatgctagtaattcagtttggcatattagaagaatttcttatgtataaaaagaaactgttgcctcctacaaaaaaaagtaattttcaaaattcttaaataattttgaaaatggtgcccggatactagtgatgtaaatagtccaaaggttagacacgtgaaagcgagaaagggactatctaactagcccgaagagaagtagctgaaaaaac

SEQ ID NO: 638 - DNA, 124 bp, Homo sapiens
cctgtctgtactaaaaatacaaaaattagccaggcatggtggcacggacctttagttccagctactggtggggggctgaggcaggagaatttctttaacccaggtggtggatctcaaaaaaaaa

SEQ ID NO: 639 - DNA, 156 bp, Homo sapiens
gttttcttcattcgaagacgctaaagaagctttaaattccttgtaataaaaaggggaatttgaggggcagagcaattcaagctctgagtttgtcaaagaccccacgggggttcaactcaatattccaaaaggccagccattcccaaaatactattt

SEQ ID NO: 640 - DNA, 128 bp, Homo sapiens
gtgaccaggtgtcagctgtgacgtattatcattgcctgcacctgtgcaactttggatgttattgggcatggcggtgacttggttaggctggtacttccttggcttttccaggttaataaaataaattt

SEQ ID NO: 641 - DNA, 153 bp, Homo sapiens
gcccagaggaaactggctggagcctggaccagctggggctgatgcttttgcagtggtcatgtgattgtgaccttgtagctacttatcagagagccagaccctcctgtcctgggagacaagagccatgcctcaaggatcaagcccaatgttcta

SEQ ID NO: 642 - DNA, 114 bp, Homo sapiens
ctcgtgccgaattcggcacgagaaggtggctctgctcactgtggcaattctcaaagaggaatgagagctgagggctgtcgggctcaaggcaaccccaaacaagttgggaggaag

SEQ ID NO: 643 - DNA, 121 bp, Homo sapiens
ttaaccaggatggcctgttaaaaatgcagagagctggcagagtgaacagtaaatgttttaattcgctgtgtcatttgcccttagctaggctgtttcacctgccggctcattgtgttgctat

SEQ ID NO: 644 - DNA, 170 bp, Homo sapiens
gtaatatcctgccacctggaaggcctccttaaacttattgtaggcagtaatcacatcttgagtggttagatgccaggacaacatgttaggactttaatggacatatgactcttgtcctcatggggcttatggttttctgcatagttatttcataaacaggtgtttctgtt

SEQ ID NO: 645 - DNA, 245 bp, Homo sapiens
ttgatggctggtaaatcagatgctttttactcactttcctgcctaagagcaggggtttttaaaaatcaagcacaggtaggtaggtatatataaatgcctttattatcccctatgagaaaagagctgtttccctatttaaagattccccttaagctgttatcacttcttgactgatgggctttcttgttccaaatatgggtctgatcattagcagtctgcattgtcatctttgccttggattgaga

SEQ ID NO: 646 - DNA, 307 bp, Homo sapiens
gaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtggccttggagtctaagagacgtggttgcaaacttagctcttggttattgcaattagggccttgcaccaggtcattttcttcacattctcatctgtaaatggagatatacctacagatattgcagattaatacc

SEQ ID NO: 647 - DNA, 308 bp, Homo sapiens
ctcgtccattttagggcaaaaaccaatgctcacctctagccttaaggggggcagggagtgatgatttgggggaggctttgggagcaaaataaggaagagggctgagctgagcttcggttctccagaatgtaagaaaacaaaatctaaaacaaaatctgaactctcaaaagtctatttttttaactgaaaatgtaaatttataaatatattcaggagttggatgttgtagttacctactgagtaggcggcgatttttgtatgttatgacatgcagttcattattatgtggtctatttacttgtactgtg

SEQ ID NO: 648 - DNA, 311 bp, Homo sapiens
ctgtctccagtgggcgtcttgggccccgctctattctgggctgcgggcctgggaagggctcgccgggtgccaaatgagctgtcctaactctgcggggctgcagcttcctgcatgatgctggggagcttggcgcctgacccaggatctagaaggcactctgggcaggccgcgctccgcccacgaaggtttaaccaccaaggactctgagagctggcaggtcttagtaaccctggtaacaattctcttcaccttatcaaaacctgagctaaaaccaatgcatcagctgatgatgacagcagaaagtggcaggg

SEQ ID NO: 649 - DNA, 139 bp, Homo sapiens
cacggttgtgtctccattcctttctggaggtgccagccagtgaccacaatagtggaggtctttatacattttggcctgtttatccctagaagtagtttggaaaattttatatcctcactacattttttttttttttttt

SEQ ID NO: 650 - DNA, 380 bp, Homo sapiens
cagcgctgccccctgctggctgtgtgacctgtgcacaaggattacgcgctgttttacttctccagctacaaaggagagagcacctacttcatagggttgttgcaaggatcgaaaaataatgtcgaagtcccaggaagttccatgtgataccgcctctcagatgttagctgctgttttaattatagttatttgctggcacacagctccctgtaggcttcataactgtcaaaatgtgagcagaggcggggtgcagtggctcacgcctgtaatcccagcactttgagaggccgaggcaggaggatcacttgagctcaggagttccagaccagcctgggcaacatggtagaccctgtctccaccaaaaatattaaaatctgtag

SEQ ID NO: 651 - DNA, 399 bp, Homo sapiens
caaacagacatcaatcaaatacatgtaaggtgtacatcgattctgccgggaaaggcggtacaacctgaggtgggaggggggcccaagtgtgtatccagctgcctggaaggccgtgccaggttacatggccagcaccctagctcaggctctttccacattccttgtcttctgtttaagcatgctttctacctctaggccctttttgttgcatcacttctgctgtgatttgaatgtttgtcccctacaaaattcgtgttgaaacttaatccccaatgtgacagtcttgaaagatgggatgtttaacaagtgattgggtcttgagggctctgccctcatgaatacattaatccattaataggtcaattaattatcatgggagtcatactggtggcttcaaaa

SEQ ID NO: 652 - DNA, 406 bp, Homo sapiens
catgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaataattccaacgggggaaaaaaaaaaaaaaaaaaa

SEQ ID NO: 653 - DNA, 309 bp, Homo sapiens
gttccctgcacaaaatgcccggcgacgaccaagaaaaccgtccctgctacagagcaggagttgccgcagccccaggctgagacagggtctggaacagaatctgacagtgatgaatcagtaccagagcttgaagaccaggattccacccaggcaaccacacaacaggcccagctggcggcagagctgacattgatgagacccagtcagtaaagcaaaacagagtcggagtgaaaagaaggcacgaaggctatgtccaactggtcttcggcagttacaggagttactagagtcactatccggaaatctaag

SEQ ID NO: 654 - DNA, 120 bp, Homo sapiens
caagctacgcctctaggcttcatgccattagcctgcctcagactccagagtagctgggactacaggcacctcccactgtccctagctaattttagtatattttgagtagagtatgagggt

SEQ ID NO: 655 - DNA, 306 bp, Homo sapiens
gctatgtctccttatgtattactcaatactgttttgcagagaaaacatttttcaagcatgtgcttcctgaagacacctcagtctttgggccatttgatttccaatacatagggtggaggaatgtgattttggggctgaccataaactggaaatttgtgaaatggcagttattgggcaatcttcagtttattttttcagttgaagtggactcatttctggaatggatttaataggctgtgtctaatgtacaaactgggtgagtcctgccttagtgtgtcctgccccaccggtacggttccaggatac

SEQ ID NO: 656 - DNA, 310 bp, Homo sapiens
cagccaaggcggcccaagccagtgacctggaaaaaatccacctggatgagaagtctttccgttggttgcacaacgaggaccagatggctgtggagaagctctctgacgggatccgcaagtttgccgctgatgcagtaagctggagcggatctgacagaacgaatgttcaatgcagagaatggaaagtagcgcatccctaaggctggactccagatctgcaccgccggccagctggatctgactcacgtggcttctgatgaatctgcgtttttacaaattgagcaggacagatcatagattctgatttatg

SEQ ID NO: 657 - DNA, 275 bp, Homo sapiens
cttgaaggagtggctaaggttggacaattacacgttcactgcagctgctgtcggggccgtgtttggcctcaccacctgcatcagcgcccatgtccgcgagaagcccgacgaccccctgaactacttcctcggtggctgcgcggagctgaactctgggagcacgcacgcacaactacgggattggcgccgcgcctgcgtgtactttggcatagcggcctccttggtcaagatgggccgcctggagggctgggaggtttttacaaacccaaggtgtg

SEQ ID NO: 658 - DNA, 270 bp, Homo sapiens
ccggcaccagcaaggacggccaggacggtgctcccggcgagcctgggcctcccggagatcctgggcttccaggtgccatttgggcccaggggacaccggggatctgcgacacctcagcctgccaaggagccgtgttaggaggggtcggggagaaatcaggctctcgaagctcataaaattcaccgtgaggaggcaagtgacaaaggacgcccgaagcacaattggacggtcattaaggagccggggttttgcagcgggtgacgtccagag

SEQ ID NO: 659 - DNA, 280 bp, Homo sapiens
tgaccatctgccaaaccagatgcaggcagaaacctgctagttagctgaacatacgaagcagattattctcactgttctgggtcaaagccaccagctaataaatccagttggtatacccacaaataaaaactcactgtaaattaggggctaccagtggagactgtgtcccagaaatcaatagagatttctgacatcaagtctccatgcactggccatgctcaaagtcaggtgctgtgtcagcttcatgggtctgcgtactccaccagcttgggaggaggat

SEQ ID NO: 660 - DNA, 185 bp, Homo sapiens
ggactgtttagtgtgttcccctttgtgggtgggttcctatgatacttattatagaacacagtggatcctttttgaatgttccgtggaaggcccaggagttcctcgtgaacccaggatactgcagctttattaaagttaaagaaactgtaacatatctcttatatattaccaccgtttaacgtttt

SEQ ID NO: 661 - DNA, 250 bp, Homo sapiens
gaagaaataacagtcaggttgttggagtccctgaagaagaaaaacaaaataatatgttaaaactgagaaaccaaatagtagaaggttagatttaaaaacagagaactggctgggtgtgatggctcatacttgtaatccagcagtttgggaggctgaggcaggcgagtcacacagtcaggagttcgagaccagcctgtccaatatggtgaaaccccgtttctactgaaaaatacaaaaattggccaggcac

SEQ ID NO: 662 - DNA, 315 bp, Homo sapiens
agctcaccagggcctacatggcctttattttctgcactataaaaggaaaaaggattagaaggataatagttacatttgatattaagtaaaattttggtatgcattgtattaagggatgtaaagtaagagaaattgtgtattatcaaatgacaaagacctgatcagccttgagtaaggggctcaggaggcagtagtactagcatcttaggagtagaggagtcctgtgggataagtaaaagtatgtctttggtttgataacagtgagagctattaattttagaaagtcgagttactttgtatgtagcaatacaagga

SEQ ID NO: 663 - DNA, 325 bp, Homo sapiens
ggtgaagcaggcaggtcaggtccaccactgacacgttggcagtggggacacggaaggccatgcagttagcttccgttcagctcagggatgaccttgcccacagccttggcagcgcagtagaggcagggatgatgttctggagagccccgcgcccatcacctcgtgccgaattcggcagaccaggccatcaggtaagccaagatgggtgcatacaagtacatccaggagctatggagaaagaagcagtcttatgtcatgcgctttctctgaggctcgctgctggcagtaccgcagctctctgctctcacagggctcccgcccaccg

SEQ ID NO: 664 - DNA, 365 bp, Homo sapiens
gctttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagttacattccttcactccttttcctacccaagggggaagactggagcctaagctgcctgctactgggctttacatggtgacagacatttccgtgggatagggagatagcaggaagaaaggtaaactcatagagtgtcattcactgggtttgatattggcttagctgccagtctccatttgtgactatgccatccatctataatggagg

SEQ ID NO: 665 - DNA, 294 bp, Homo sapiens
gcagactgtgagtcaattaaccgtcctttttataaattactcagtctcaggtagttctttacagcagtgtgagaatggactaatacacttaccaccagcacaaagctagtaagtggtggaattgggatacgtaataataatgctaataactcacacctgtaatcccagcactttgagaggccaaggcaggtggatcacaaggtcaggagttcaagaccagcctggccaagatggtgaaccccatctctactaaaatacaaaaatgagccggatgtggtccgtgcttaatccccc

SEQ ID NO: 666 - DNA, 270 bp, Homo sapiens
agatattctgctgtcatggaggtttatcaccagatcttcaatctatggagcagattcggcgaattatgcgaccaactgatgtaccagatcaaggtcttctttgtgatcttttgtggtctgaccccgataaagatgtcttaggctggggtgaaaatgacagaggagtgtccttcacatttggtgcagaagtggttgcaaaatttcttcataagcatgatttggatcttatatgtagagcccatcagggattgattttgaattttacatgta

SEQ ID NO: 667 - DNA, 295 bp, Homo sapiens
cggcacgagcttatcttttagcgtgtaaatcagatcatattcctcccctcactaaacgaacaaaccagccagaaaactctttaactccttcctttaataaaatccaggcctggcgcaatggctctcgcctgtaatcccagcactttgggggcccgaggtgggtggatcatttgaggtcaagagttcgagaccagcctggccaacatggtgaaaccctgcctctacttaaaatacaaaaacaaattagccgggcgtggtggcagctcctgtagtcgctacttggggggttaggcag

SEQ ID NO: 668 - DNA, 255 bp, Homo sapiens
ctggttcctgcagccattgaaaaacctttttccttgcaaattataatgtttttgatagatttttatcaactgtgggaaaccaaacacaaagctgataacctttcttaaaaacgacccagtcacagtaaagaagacacaagacggccggccgtggtagctcacgcctgtaatcccagcactttgggaggccgaggcgggcggatcacaagggcaggagatcgagaccatcctggttaacacggtgaaaccccgact

SEQ ID NO: 669 - DNA, 150 bp, Homo sapiens
attcgttgcctcaatcttgtctcaggatcagtctgggttctgggttcttctttttctttttttttttttgacggggttcggttctctcgcccagcctggagtccagtggtcccatctcagctcactgcaagctcccccttcccgggttaa

SEQ ID NO: 670 - DNA, 245 bp, Homo sapiens
gttgagtggatccccaacaatgtgaaaacggctgtctgtgacatcccacctcggggggctaaaaatgtccgccaccttcattggcaacagcacggccatccaggagctgttcaagcgcatctccgagcagttcacggccatgttccggcgcaaggccttcctgcactggtacacgggcgagggcatggacgagatggagttcaccgaggccgagagcaacatgaatgacctggggtccgagtacc

SEQ ID NO: 671 - DNA, 155 bp, Homo sapiens
cagaagtagaccttccagagccccagtttgtaaatgaacctgtgtcacatttgataaacactatcctgggcgcccccgggccacccgccgagtgacgccaaagccctggttgactcttacagccccgtgggtgtgtgggaggccggccgttctgg

SEQ ID NO: 672 - DNA, 270 bp, Homo sapiens
gaacacagtttgggaaactttttgttcatttgttttaataagataccttaggtagctatttccttagaacacgagccgggtgcagtggctcacgcctgtaatcccagcactttgggaggcccaggcggcggatcacctgaggtcaggagatcgagatcatccggcccaacatggtgaaaccccgtctctactaaaaggacaaatattagccagccatggtggcaggcacctttagtcctagctactgtggaggctgaggcagggaattca

SEQ ID NO: 673 - DNA, 185 bp, Homo sapiens
caaaacagaccaggcacagaaagctgaaggttgctggagatgccaagtgaagtgtgtgcatttttggataactgtgtacttctggtgactgtacagtttgaaatactattttttatcaggttttataaaaatgcagagttttgttttacttttttttttttttaaaaggctatgttgtgggccac

SEQ ID NO: 674 - DNA, 228 bp, Homo sapiens
tggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctctaagatagaggatttcttagagagacgcctgcagacccaggtcttcaagcttgggct

SEQ ID NO: 675 - DNA, 252 bp, Homo sapiens
cttttgctgaggagagctttacttccaactatgtggtcaattttgggaataggtgtggtgtggtgctgaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgttaaattctcccattattaatgtgtgggagtctaagtctct

SEQ ID NO: 676 - DNA, 259 bp, Homo sapiens
cgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttgaggtaacatctctggttgtaccaaaggaggaaataaatatggtttcttaatctcttgcatgttttcttataaataat

SEQ ID NO: 677 - DNA, 208 bp, Homo sapiens
agtagctacacagtccggccgtggtgcagtaaaggcggatcagcagaggttgaggtcgatggggcaggaccaaggtccagagaggaagcacaggggtatgactcccaggtgcagggaattgccagagctgtcttgagctccaagtacaacacttctcatctagccagcgaacgtggatgtcggtgttggctgctgaaaaacagtcaat

SEQ ID NO: 678 - DNA, 198 bp, Homo sapiens
cttggactggagcagaaggctgagaacaggaaggggctggtccctggtactagttttggttttttggtggtttttttttttcttgttttttctcacagaacagggcaaagctgagtgtccctggatgagttaagcaggaggattaatcatgcccagtgcttctccactttaaactggttttcctgggaatttgcaatt

SEQ ID NO: 679 - DNA, 257 bp, Homo sapiens
gttttcgagaaaaatgtcttcaacaagaccagccggactgagagtgagattgcattttttgggggtatgaccatcgtctacaagaacagcattgacctcttcctatacgtggtgggctcatcctacgagaatgagctgatgctcatgtctgttctcacctgcctgtttgagtctctgaaccacatgttaaggaagaacgtggagaagcgctggttgcctggagaacatggacggagccttcttggtgctggacgaga

SEQ ID NO: 680 - DNA, 227 bp, Homo sapiens
ggctgaccagatgggaaaatgcaccccctcaggcaggtggccaattagaaaaatatgtccttttggcagctgcagccctggggttaatatgtgagacttggcaagttagagcctgggcaggatctcagatccactcccactcccgggatctggcatccaagtgtctgacacagccatacgtggcagtgggtgtaggagcctgcctggggtgctgacccactggacct

SEQ ID NO: 681 - DNA, 195 bp, Homo sapiens
ctcgtgccgaatcatcagagaattgcaaatcaaaaccacagtgagctatcatctcaccccaattagaatggctatcatcaaaagacccaaaaaataaatgctggggaaaatgtggataaacggaaactcttacatacattgtttgtggatgtaaggtagtatagttattatggaaaagagtatgaaggttcctca

SEQ ID NO: 682 - DNA, 145 bp, Homo sapiens
ttaagtcatataatgtccatccagcattaaaggttgcacttattgaccctaaaactggcgattctgcaaccaagcaccttaaacaagcaggtctctattttaggtaacattgaaaatttaaagttacttggtccaaggagatgct

SEQ ID NO: 683 - DNA, 125 bp, Homo sapiens
cgtgcgattcgcagagcacttggtttgctttgcgttggcatttagtatagttttaaatcagtactctatggaacaactgccaaaattgtacgaatttgaggccattaaaaggtaatggaaaaaaa

SEQ ID NO: 684 - DNA, 235 bp, Homo sapiens
aatagttactgaaatgacgagacctgtttgcacagcattaataagaaccttgataagaaccatattctgttgacaagccagctcacagtttcttgcctgaagcttggtgcaccctccagtagacacaagatctctcttttaccaaagttgagaccagagctggtggattaattaatagcttcgatatctggccatgggtacctcattgtacctatcatcagaatggcagagatga

SEQ ID NO: 685 - DNA, 130 bp, Homo sapiens
ctgacctccttgaataataccctggccaacatacgtttggattctgtttctctcaggcatgccaccaaggatttgcatggaggtcgaggttagcacttgaagtagccactttatcaagtcatttatggag

SEQ ID NO: 686 - DNA, 220 bp, Homo sapiens
tgatgcgtgatagcttaagcttggggagaaggtcttttccactgcctagctaagcagtctgggagagcatggggatcatttctatgtgtgttggtaatctggtcagtaaggttgagacttaggttaaggttcccctggaaattccttaattgtttattagctctacctaggtgtggtaggccgatgccagatttggagatttgagttctcttacatggct

SEQ ID NO: 687 - DNA, 165 bp, Homo sapiens
gttttgtcttgcgggtctgtcagggttggaaagtccaagccgtaggacccagtttcctttcttagctgatgtctttggcagaacaccgtggctgttacttgctttgaggtggaggcggttgcatttacgcctgtaaatgtaatcaatcctaaataagtgtagggt

SEQ ID NO: 688 - DNA, 108 bp, Homo sapiens
gacctctcccaggagcaagcccctggatgcccagacagggcccccccgacctgcaacacgagtctctctaagcaaggttaattcgaaggcccaaggatgaacgctatt

SEQ ID NO: 689 - DNA, 170 bp, Homo sapiens
ccaatatctactggctgtgtgacctggagcaggtcccctaacttctccaggcttttgtttccttatgtgaaaatgggatgagcaacacctggatcttgctatcttttggactactgacccagtacttttggatggaatatacttactattttaaaaaattcaaggcaggt

SEQ ID NO: 690 - DNA, 164 bp, Homo sapiens
gaaaacctgaagcctttcctcttatatgtggacatgacagggatacccacttttaccaccattattcaacttgattactggaggtcttaggctacagcaatcaaagggaagaaataaggggatcccaacccgaagggaggaagttgaattatccctgtttgcag

SEQ ID NO: 691 - DNA, 270 bp, Homo sapiens
cttaaggttacttttatattactctggaatcaagtattttaaattgtatttttttttaaatgatctctcagcaataattgtttgaaactatccatatataaggttatcagacctacagttccctaagaggaactgcatgttctcttcaatcagaatatacagtagaagcaggtatatcttccatgcagtttcagtagtaagcactacttatacctacataagagttaaaatccagatgtgggaccttttgataccatcagtgatatatat

SEQ ID NO: 692 - DNA, 200 bp, Homo sapiens
agcatcttggagagttttgtggggtgctggcatccatcaaccaacaaaataccaaaatgactctaggtaattataagtgaagcaaaaccactgggcagggatgataacaggcactgtactttacaggagtcagcgtatcacaatcgcatgctcgggactatgttcagccactaaacctttaggtttcatgagggccaggg

SEQ ID NO: 693 - DNA, 161 bp, Homo sapiens
gtgaagagaagtgaaatgttgtgcctgacactgtaacactgtaaggattgttccaaatactagttgcactgctctgtttataattgttaatattaggacaaccagtagacaaatgcagcagcaagtcaattgttattagcagatattgtcctcattgcatg

SEQ ID NO: 694 - DNA, 180 bp, Homo sapiens
ccgaactgatataacctaccctgctggattcatggatgtcatcagcattgacaagacgggagagaatttccgtctgatctatgacaccaagggtcgctttgctgtacatcgtattacacctgaggaggccaagtacaagttgtgcaaagtgaggaagatctttgttggcacaaaagggat

SEQ ID NO: 695 - DNA, 207 bp, Homo sapiens
agccttttaggtgctgacatcagacatcagagattaccaccaggtccatggtgtagatggatagcacatctcagtttgcaggtctcagtgctgaggtcttcaagatctgacagacatgcttttcgcaactacttttaggagttaatgggccaaagttgggatatccatttccattaaagtgtatttgttaatcataatatacacagg

SEQ ID NO: 696 - DNA, 203 bp, Homo sapiens
aaagcagtggacaagaaggctgctggagctggcaaggtcaccaagtctgcccagaaagctcagaaggctaaatgaatattatccctaatacctgccaccccactcttaatcagttgtggaaggacggtctcagaactgtttgtttcaatttggccattaaggttaggtagtaaaggcttggtaatgataacacatgcatacgt

SEQ ID NO: 697 - DNA, 161 bp, Homo sapiens
ccatcctggctaatacggtgaaaccccgtctgtactaaaaaatacaaagagaaaaattagccgggcatggtggcgggcacctgtaggtamccagctaactcaaggaggctgaaggcaaggagaattgacggtggaacccggggaggcgggactttgccagt

SEQ ID NO: 698 - DNA, 143 bp, Homo sapiens
tctcagggacaagtgcaacgcaggtgcgcgtggaattcatggacgacaacgagccgatccatcaatccgaactgtaaaaggccccgtgcgcgagggcgacgtgctcacccttttggaagtcaagagcgagaagcccgaaggtt

SEQ ID NO: 699 - DNA, 191 bp, Homo sapiens
ttcagagtccatgaggcattttatttgtaaatatatgtattacatccctagaaaaagaatcccaggattttccctcctgtgtgttttcgtcttgcttcttcatggtccatgatgccagctgaggttgtcaagacaattgaaccaacttgcggattggaggaggttattctgccatttttccaggctttaag

SEQ ID NO: 700 - DNA, 125 bp, Homo sapiens
taatgcccacaaggtactctgtggatatccccttggacaaacctgtcgtcaataaggatgtctcaagagacctcctctaaaccgcaaggccccccgggagccaaggctcaagttttgaagggggg

SEQ ID NO: 701 - DNA, 313 bp, Homo sapiens
agaaccccaacatgcggctgtcgcagctgaaacagctgctcaagaaggagtggctccgctctcctgacaaccccatgaaccagcgggccgtgccttcaatgcccccaagtgagcccagaacttggggagccagttcacccacgggtggtccaggtcacgactctgcacgcccttaggccaggtcagctgcgagggtcacagagcgttccgggggccaaggcgccgggccctggggcattgctcttatcaccagccacccgtcctcccgccagagggtccctgccccgagtgacaccccatcccctcccatccc

SEQ ID NO: 702 - DNA, 240 bp, Homo sapiens
cggcacgagcggcacgagctcaggaccctccagtcgttcaagctggaattggcaggttttctgcctgtataggcatcggcttcagagtctcaggtgctgcttggcaggaaaatgcagggcaggaggggctgggcctcagctcgaggctcccaggtgcagccccccactccactgcagggcccaggggggccaagaacagccacaacaacacaaaagccaaactgggaacggattcgtaga

SEQ ID NO: 703 - DNA, 167 bp, Homo sapiens
ctagggggcaactcctcccccagcgccaaggacatcaagaagatcttggacagcgtgggtatcgaggcggacgacgaccggctcaacaaggttatcagtgagctgaatgaaaaaacattgaagacgtcattgcccagggtattggcaagcttgcagatgtacctcct

SEQ ID NO: 704 - DNA, 125 bp, Homo sapiens
cttggttatgagactaaaaccattcctcactgctctaacatgctgaggaaatcatctgaaggggaagggagatggatgctcagtagtaacatcaaaggataaagcattattctagcagcatccat

SEQ ID NO: 705 - DNA, 432 bp, Homo sapiens
  misc_feature 156: n = A,T,C or G
cttggactggagcagaaggctgagaacaggaaggggctggtccctggtactagttttggttttttggtggtttttttttttcttgttttttctcacagaacagggcaaagctgagtgtccctggatgagtgaaccaggaggattaatcatgcccantgcttctccactttaaactggttttcctgggaatttgcaattgaaagtggggaggggtaagaatcgtgggaaaaggctgatggtgttcagccaaattcatccttcacgtgcccacccttctacaggcacatgctttggggccatccacggttgcagccaccccatccttaggaagcaccactggccttcctttccggtacctggactcagcatcactcccagcctcttggagatgcagccttcattcagcacacagctcagctctgagttcggttt

SEQ ID NO: 706 - DNA, 480 bp, Homo sapiens
ggctgaccagatgggaaaatgcaccccctcaggcaggtggccaattagaaaaatatgtccttttggcagctgcagccctgggttaatatgtgagacttggcaagtgagagcctgggcaggatctcagatccactcccactcccgggatctggcatccaagtgtctgacacagccatacgtggcagtgggtgtaggagcctgcctggggtgctgaccccactggaccgtcttcctagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcctcatcctccgcctggcgtacaggtctaagccaggcgagggcaagctcatcttctgctcaggcc

SEQ ID NO: 707 - DNA, 270 bp, Homo sapiens
ctcgtgccgaattcggcacgagccactttggttttcttttttgcgtgtggcagttttaagttattagtttttaaaatcagtactttttaatggaaacaacttgaccaaaaatttgtcacagaattttgagacccattaaaaaagttaaatgagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 708 - DNA, 450 bp, Homo sapiens
gacctctcccaggagcagcccctggatgcccagcagggcccccccgaacctgcacaagagtctctctcaggcagtgaatcgaagcccaaggatgagctatgacagcgtccaggtcagacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcatgacagcgatacagtacttaagtgtctgtgtagacaaccaaagaataaatgattcatgggtttttttaaaaaaatcgagtttttttttttttt

SEQ ID NO: 709 - DNA, 122 bp, Homo sapiens
gacagacctctaattcacaatgatgtaagagttctttgttattcaggcaaaggcaaagcgaataaacaatatcaattggaatggtgctggtcttaagtttaacaactcaagtaaatgggtcc

SEQ ID NO: 710 - DNA, 108 bp, Homo sapiens
ctcgtgccgaattcggcacgagctccagcctaggcggcagaacaagactctgtctcagaaaaaaaaaaaaagggaaaggaaaattggccttaaggtgaatttcccatt

SEQ ID NO: 711 - DNA, 282 bp, Homo sapiens
cagccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatgcccaacattggttatggaagcaacaaaaaaacaaagcacatgctgcccagtggcttccggaagttcctggtccacaacgtcaaggagctggaagt

SEQ ID NO: 712 - DNA, 182 bp, Homo sapiens
cggcacgagctggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctttcaaggatgttcgtcgtggcaacgttgct

SEQ ID NO: 713 - DNA, 256 bp, Homo sapiens
gcgcggtgaggttgtctagtccacgctcggagccatgccgtccaagggcccgctgcagtctgtgcaggtcttcggacgcaagacagcgacagctgtggcgcactgcaaacgcggcaatggtctcatcaaggtgaacgggcggcccctgtgagatgattgagccgcgcacgctacagtacaagctgctgggagccagttcttcttctcggcaaggagcgattttctgtgtttagacatccgtgtccctgtaaagggt

SEQ ID NO: 714 - DNA, 239 bp, Homo sapiens
gaacactggtctcgggcccgagaagacctcctttttccaggctttaggtatcaccactaaaatctccaggggcaccattgaaatcctgggtgtccgcaatgttgccagtgtctgtctgcagattggctacccaactgttgcatcagtaccccattctatcatcaacgggtacaaacgagttctggccttgtctkttgagacggattacaccttcccactttctgaaaaggtcaaggcct

SEQ ID NO: 715 - DNA, 226 bp, Homo sapiens
tccttctgcacatgaggccagtataggcaacgtcacatttgtttgtttcaaatatgcagtgtggtattttgtttactttgcatttaccgtgagcaaagatacttcttggaatggctgcagtgaggccgtgtcattggctcacaaaagtgactcataggtaatttctgtgtttgcattccactgctctgttccctaaggtccttgactttctccccaggattccact

SEQ ID NO: 716 - DNA, 359 bp, Homo sapiens
ccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaaaaaaaatatatatcaatgttttccaataaaatacagtgactacctgaaaaaaaaaaaaaaaaaaaaaaaaaaaaaaaaaaaaaaaaaaaaaaaaaaaaaaaaaaaaaaaaaaa

SEQ ID NO: 717 - DNA, 432 bp, Homo sapiens
gaaaaactgaaagcctttcctcttatatgtggaacatgacaaggatacccacttttaccaccattattcaactgattactggaagtcttagctacagcaatcaaagagaaagaaataaaggggatccaaaccggaagggaggaagttgaattatccctgtttgcagatgatatgatcttatattggaaaaacctaaagactccaccaaaaaatgattagaactgataagcagattcagtaaagtttcaggactcgaagtcaacatacaaaattggtagcatttctatatgccaacagtgaacaatctgaaaaagaaataaaaaaggaatcccatttacaatagccaccaataaaatacctaggaattaaccaaagaagtaaaagatctctacaataaaaactataaaacaccaatgaaaaaaaaaaaaaaaa

SEQ ID NO: 718 - DNA, 555 bp, Homo sapiens
ccaatatctactggctgtgtgacctggagcaagtcccctaacttctccaagcttttgtttccttatgtgaaaatgggaatagcaacacctagatcttgctatcttttagactactgaccagtacttttgaatgaaatatacttactattttaaaaaattcaagcaagatgaaaattacaagaagttctgaaatctcaccactctcatagtgattttagagttaaaagaaataacatgtgtaagatggtcagcacagagcctggcactggataagtactcagtggacatcagcccgggccacccatcctgcctgtcactcagagagggctgggccaggttgatcgctgagctcctctcacccccagcaccagctcattccaggcagctgccagagaggaagacagcccagctacaggagaacatcgtatggggacaagggcactcccctgacagaaatgcccatcctggtcgggcatggtgcctcatgcctgtaatcccagcactttgggaggccgaggcgggtggggtcacctgaggtcaggtgtttgagacagc

SEQ ID NO: 719 - DNA, 510 bp, Homo sapiens
caagctactgactgtaagaaaatgttttaaaatcatttctccagcaagggactcgtgtacagaatatataaagaaccttccaaactctataatacaaaacaaacatactcagtttaaaaagaggcaagagacttgaccaaaaataagcacatgaaaagtcattccacatcattagacattagggaaatgcaacttaaaattatagggaaagggaaaaaaataggatgcgataccactatacacctatgaaaatggctaaaataattactggtaattctaagtgagggtgaagatgtggagcaagtgaactctcatgcattgccggtgggaatgtaaagtgatgctgccaccttggaaaacagctgggcagttttttttgttttgttttgtttttgtttttttgagatggagtctcgctctttcacccaggctggagtgcagtggacgatctcagctcattgcacctctgcctcggtcaagcgattcttctgctcagctagctccatactg

SEQ ID NO: 720 - DNA, 527 bp, Homo sapiens
gtaggacatggtcatcctgtcatctgtcactgctggatgacatcctccctgtagatgaactcagggagaagggagtcttccacacgtgcttggagagaggatctccccagcccccagtcttaaactcagagcacatacatgggaaaatgtgcagaataccattccccattcagcaaggatcaggccatcttcagcctgaacgcaaacccatgcgggtccagggtatcagccctgggcgagagggctgcgtgacccaggcaggatgggggtgcagagcctggacaggcagcaagtccacgggagagttaaaatgtctatgggaaaatgggctgggcacggtggctcacgcctgtaatcccagcagtttgggagaccaaggcgggtgtaccacttgaggtcaggagttccagaccagcctgaccaacatgacgaaaccccatctctaccaaaaatacaaatattagccgggcgtggtggcacatgcctgtagtcccagctactctggaggctgagacaggagaatctct

SEQ ID NO: 721 - DNA, 579 bp, Homo sapiens
gaaccttttccattttttttcctttattctcagcaaacagcaattccactgccagagaggtagtttcctcttttctgcaccatgcagctccctgtcaacagcttatatacagcggtttccacttgtgtctcctgtgttaagctctaagcaacttgaggacggggctcacactctagtcagtgctgtctgaaagcagcataatatgagtcaccagtgtaacacagccacataattaaagattttttaacagccacattataaatgtaaagaaaaaagtcggccgggcgcggtggctcacgcctgtaatcccagcactttgggagaccgaggcaggcggatcacgacgtcggaagatcgagaccatccttgttaacacggtgaaactccgtctctactaaaaatacaaaaaattagccaggcatggtggcggatgcctgtagtcccagctacttgggaggctgaggcaggagaatggcgtgaacccgggaggcagagcttgcagtgagctgagatagcaccactgcactccaccagcctgggcgacagagacagactctgtctcagaaaaaaaaaaaaaaa

SEQ ID NO: 722 - DNA, 396 bp, Homo sapiens
gcgagaaggtgtcaggagcagcccatttgtgtctctctctctacctctgtgaagggcgcgaatgggcagagcagaacttctagaagggaagatgagcacccaggatccctcagatctgtggagcagatccgatggagaggctgagctgctccaggacttggggtggtatcacggcaacctcacacgccatgctgctgaagctcttctcctctcaaatggatgtgacggcagctaccttctgagggacagcaatgagaccaccgggctgtactctctctctgtgagggccaaagattctgttaaacactttcatgttgaatatactggatattcatttaaatttggctttaatgaattctcatctttgaaggagtttgtcaagcattttgcaaatca

SEQ ID NO: 723 - DNA, 384 bp, Homo sapiens
cctctttctgccaaaaatttatagtattggtatatgtcccaatccaaaatctcactgttagaactcagattttcaggtctttccgttagtctcactttttccactggaacaccttcacttttttcaaatgtgtcagcaactgtgaataaaaacaagccagagaatagctagaaaacagaggctgcaagagataacagtcaatttagagaaaacaccgttagcttattatcttaaattgtgcagaaatctgttcaactaatagagacagaagatccatgaaaaatagaaattttcagatttttggccaggtgcggttgctcatgtctgtaatcccagcactttgggaggcagaggcgggcaaatcacctgaggttaggagtttga

SEQ ID NO: 724 - DNA, 620 bp, Homo sapiens
tttagttattgtgaatttgttttctatgctagtaattcagtttggcatttagaagatttctttgtataaatgaaactgttgcctcctacaaataaagtattttcaaattcttaaatatttttaaatgttccaggatctgtaatttaaatgtcaaaggttaccagtgaatcgtaattgtctttatacttccttaatgagttgctaaatactctttaatccttaaaaagaaaatagaaacacccatactttaaatcagtttttaggtctgatatgcttgctacctgtcaaatttctctgatagttttttccttgtgtacctctgttcatgacattcctccttaactggcataccctttcagttcttgggttggctcaatctttaagatcctgatggaaacccaggccagtgtttcttaaagtagtttccataaaacattagttacatgatctgttactagatatcatgggaaaaatgggttccaaggtcaaataagtttgggaaactcaaatgacacattttaagcagacttgcagaagtgttttttaatttcaaagatctcaaaggcttagtctgctgatatccattgtgactctcaagatgacagtatagtctataattt

SEQ ID NO: 725 - DNA, 617 bp, Homo sapiens
ggcaaaaataagggaggaatatttcaggtagagggaatagcttgtgcaaaggccctgtggcaagagaaaataaagtgagatcaagaaatagaaagaaggccaatgtgactggagatgagtgagtaagggggagaaagcacaaggtggctccagagatggaagcaggttcctcatcttacttcttggtcaggttaccaaggtatttggttttcattctaagaatatcaggaatcatttaagaattttaagtgaggggtgacatgatttaaattttttaaagtttattctggcttaatgtagaaattagattggaggggaacaaaagcaaatgcagctgggtgcagtggcacacacctgtaatcccagcactttgggaagccgatgtgggaggatcacttgaaaggtcatgagttcaagaccagcctggccaacatggagaaacccatctctacaaaaaatacaaaaagtagccggccctggtggtacacacctgtaatcccagctgcttgggaggcgaggcatgagaattacttgaacccaggaggcggatggaggtggaggttgcagtgaaccaagatcacaccactgcactgcagcctggacagagcaagacccca

SEQ ID NO: 726 - DNA, 355 bp, Homo sapiens
gagaaagaacattggtaaaaggtatgaattccagaattaaagaaataatttggggatttctagataagaggatatatatgaacatgcataccttacaccttcatatacacaaccttaaatcacaaataaaacaaaataaacaatacaaattataccaccaagattcagaagatatcagacgaaataattagagaaagtaaaaatatgctgtctccattatattcataatgtttcattcttgacactaataattagaggctttaaatttttaaatgatttactttttactaacattgctgaaaaaaactaaagacatacataaatggaaagatgtcytgtgtttatggattggtaa

SEQ ID NO: 727 - DNA, 270 bp, Homo sapiens
gactgctcctcattacccactcacctcagcccctagcaatcatcaatctatgttctgtctctggatttatctattctgaatatttcgtatacatggacttatctgtgaccttttgtgtcgagcttctttcacttagcatgatgtttgcaaggttcttccccattatagtatgtatcagtactacactttttaagagtaatattgtaaagtatgtatacatcacaatttgtttatacattcatccaatgatggacatttgggctgtttcca

SEQ ID NO: 728 - DNA, 589 bp, Homo sapiens
gttatttctgaaaaacaaagaaatacattttaaaatagcaaaggagaccatgaatgggatgtcttctctgaaggccagggcttccagtgtgctgatcctgttgtgagagatcctccatgcatccagagaggacagatttttttggaaaacctttcagtagctgttttcatgcaactttattactgtcagttaaaatgaaaagactggattggtggaggtggagtcattcccagcatctcttggtgaatcagagctgtgaagctattctgcttagaagttgacccaaggatttggtgggagaactggataaattagttttaatctaaaagccttgacactaacaggatgtgggggaaaacataaacttctaggacttaggagacctgtgcagccatcttggttgcctcactagctcttcctctgttggaggataggtgaaattattgccataaccacctcagaaggccatttgaaaatcttggccaggcgtggtggctgacgcctttaatcctactagcactttgagaggtcaggcaggcggatcatttgcagtcaggagtttgagaccagtctggccaacatgatgaaa

SEQ ID NO: 729 - DNA, 560 bp, Homo sapiens
cggcacgagcggcacgagctcaggaccctccagtcgttcaagctggaattggcaggtttctgcctgtataggcatcggcttcagagtctcaggtgctgcttggcaggaaaatgcagggcaggaggggctgggcctcagctcgaggctcccaggtgcagccccccactccactgcagggcccaggggggccaagaacagccacaacaacaacaaaagccaaactgggaacggaatcgtggaaaaaaccctcataggcttttgggaacttacaaagaaatgcccacatccattctactaacatggcatctactaacgtggcatctactaggatgccacaaaacagacaaatccttccacgtaaggctggacacgtgtcagggcggtgtctcaaagctgggccacaggcagcatccacggccaagccactgggtggaggagacggtgctggggaggagccggagggaggggccggggctgttccttaggcagaacggctcacctgtggtgtgcgcacagcaggattgtggggacacaagatgcccccttcattcatcagttac

SEQ ID NO: 730 - DNA, 468 bp, Homo sapiens
gttcccactcctactggaagacccatgtcggtttccggaaccccaccagtttacccataagcaagactaaacctgatccttgggcaaaagttcctaacccctactttaccctcccaccctcacttttaaatccaccatactgaatgccacactatggaatgcagctacctgccaagcaaggcaatagaaggcaaaaaatggaagtgaattaagatgaactcatctgaaatacacaaatgcattactatctgaagataccagcaagagtttagtctacgtgtataaggctcccagtaggatttagctaggctactagaagttagactgctttcgcattaaacagctaacttcatccacagcaaattgactcaatcaggaaccttcatttgaaggtgtgttagaggatggggtcgatagctgtctttttggtgaaagaaaaggtgcatttcaagaacttggggggcaaga

SEQ ID NO: 731 - DNA, 460 bp, Homo sapiens
gttaaagtccatctctcccactagaaagaaagcgtcaagaaagctgaatctaatgtctatttactcctgtgcccctagcacctagcagcacagtgcctggcacataatggcattcaatatagatttgctaatacgcttattgcccagtgaatcagcagtttctgaaaggaggggaaggaggagacaagctctctgaagaaaacctgaatcagttttatagcctttgcttatgctcagccctggtgctctccatattgtctaccacactaagcattgtggacaaacataaaaatttaggactgttatttttgttttgttttttgtctgttggtttttcatgagagactattaatctagtccatgtgattccagaagaagtaggatccagggtaaattcaaaggagaaaaagcatatttgacttagctgctttaaattttatgttctttcctgacttttggg

SEQ ID NO: 732 - DNA, 454 bp, Homo sapiens
ctcgtgccgaattcggcacgagatattttctgtttctctttttcactctctaaactctttttgtataaataaggattatcctgggcataattcatttgaatatgaaaccaacatactttctttcatttttgtgaaaaaataaccaaaaacatgtattaatgtgatacaaagaaagtctcattcacacaatcaacaatgaggctaagaggtagctaccatgtggctaatgaatgtgcctaggtaacttcctgtttctattcaaaactgctgctttatttgtacattcagaaatatttttttcaactatgaaatttcaatatcaattttttaagccagtttctgcaaaaggaaatgacctgtcatttgatgtgttcatgtgtgttttgtgtttggatagtttatatcatgccattctataaaatgtatgttttcaaaccaaaaaaaaaaaaaaaaa

SEQ ID NO: 733 - DNA, 355 bp, Homo sapiens
ctctgtggcccctgcgaggaagcttgctccgggagtggtctttgggcataggcacctgcgtcactgtggcgaggtctgcttttgtctctgaccagctaacatcctcagatggctgccggcttccaccgcagagcaaatgccgctgccttctgtggagagcagagtgagagtcggcgaggcagcattgtttgtagctgaaggcaggccgggccgcgggaaatggatggtgatggctgtaatttggccctgttacttattcattaatcgcatgcaggtggtcagccagccagcaagacctgctttttgaaatttcaatttccagagggctcctcgtgtctgcactgtgtggcattaa

SEQ ID NO: 734 - DNA, 536 bp, Homo sapiens
gcaaaattaaatgcaccaatagtactaaataaaggtaggcaggaaggcacctaatgtactacaatagcttgtataacatcagcctcatccagtgatcaaggtgaccaaataaattatctttaacacacacacacacacacagagtatagactccaaagtttccattgtaagacaaattctctgacactagtgcacacttgatgccctggatcctcaagacatcaccgggtgccgggtgcaggggctcacgcctataatcccagcactttgggagcccaaggtgggcggatcacgaggtcaggagttcaagatcagcctggccaacatagtgaaaccccgtctctactaaaaatacaaaaaaaaattagctggatgtggtgccaggtgcctgtaatcccagttacttgggaggttgaggcaaggagagtcacttgaacctgggaggtggaggttgcagtgagccgagatcgtgccactgcactccaacctgggtgacagcacgagactccatctcaaaaaaaaaaaaaaaaaaaaaa

SEQ ID NO: 735 - DNA, 347 bp, Homo sapiens
gatgatgacttcaccacctggacccagcttgccaagtgcctccatatctgggacctggatgtgcgtggcaaccatcggggcctgtggagattgtttcggaagaagaaccacttcctggtggtgggggtcccggcttccccctactcagtgaagaagccaccctcagtcaccccaattttcctggagccacccccaaaggaggagggagccccaggagccccagaacagacatgagacctcctccaagaccctgcggggctgggcctggctcagaatctaacctatttattgactgtcctgagggccttgaaaacaggccgaacctggagggcctggatttcttttgg

SEQ ID NO: 736 - DNA, 256 bp, Homo sapiens
catccctggcatccctgggcccccgggtcccatgggccagccaggcaaggctggccactgtaatccctctgactgctttggggccatgcgatggagcagcagtacccacccatgaaaaccatgaaggggccttttggctgaaattcccacctgctttgatgaagactccgttgggataaatggcaaagcttataggactttttacaggtgtgaatgtttttttggtgtggtgtggtttattgctgtaaaattttaa

SEQ ID NO: 737 - DNA, 256 bp, Homo sapiens
atttataagttacctgtatttatatttatatgcccgctctcatggtgaaggctggacaaggtgctcctctggcccctccttcttacctcagatgcctgaacagaacaaggcaaacccgtagcagcctctcaggagctgacaggtcctctttcggggctcaggagggttggcacacacccagcggcctgcagagtagcttattaccacaactgtccgctttgtgcttctagggtgacacatggcatgggtagaactg

SEQ ID NO: 738 - DNA, 159 bp, Homo sapiens
cctggacgtacaataccacttccgctgtcacggtaaagtccgccatcagaagactgaaggagttgaaagaccagtagacgctcctctactctttgagacatcactggcctataataaatggggttaatttatgtaacaaaaaaaaaaaaaacccttggg

SEQ ID NO: 739 - DNA, 252 bp, Homo sapiens
aagaactgggtagatgctcatatgaactgtgaagatattgccatgaacttcctggtggccaacgtcacgggaaaagcagttatcaaggtaacccacgaaagaaattcaagtgtcctgagtccacagccatagatgggctttcactagaccaaacacacatggtggagaggtcagagtgcatcaacaggtttcttcagtcttcgggaccatgcctctaaggtggtcgacacgagctgaccctgtctgtcaaag

SEQ ID NO: 740 - DNA, 284 bp, Homo sapiens
gtccaacctgcgctacaaccacatgctgcggaagaagaagaacctgctgcttcagtacaacagcggggaggacctggccgtcaacatcatcttccccgagaagatcgacatgaccaccttcagcaaggaggccggcgacgaggagatctaagcagcgttcccacagccccctctagattcttggagttccgcagatcttactatacgcggtctgtcctaatctttgtggtgtcgctatctctagtataaatctggtaacgctacgcttacatatattgtctttg

SEQ ID NO: 741 - DNA, 270 bp, Homo sapiens
cacacctgcagtcctcgctactttgaaggcctgagcctgcagaggttgaggctgtagtgagtcaaaattacaccactgcactccagcctggcaatcagagtgagaccttgtctcaaaaacaaaaatacctagaaatcatctactctgtctttaatgtgaaatgttcttatgatagctatctttctgagttccttttttctgagcactaaacacacctgtggtcttatctttggggtctggaacagaccttatgtacaggtcaaagcaacg

SEQ ID NO: 742 - DNA, 270 bp, Homo sapiens
aagccctcggcccccaagaagggagacagttctgctgaagaactgaaactggccacccagctgaccggaccggtaatgcccgtccggaacgtctataagaaggagaaagctcgagtcatcactgaggaagagaagaatttcaaagccttcgctagtctccgtatggcccgtgccaacgcccggctcttcggcatagggcaaaaagagccaaggaagccgcagaacaggatgttgaaaagaaaaataaagccctcctgggacttggaataa

SEQ ID NO: 743 - DNA, 159 bp, Homo sapiens
ggaaaggtgatagtagttttatttgatactgataaatattgaattgattttctagttattttttatcattttctcaatggagtagtataggactgtgctttgtcctttttatgaatgaaaaaattagtataaagtaataactgtcttatgttacccaaa

SEQ ID NO: 744 - DNA, 281 bp, Homo sapiens
cagcgccgcgatgactgccactctccgcccctacctgagtgccgtgcgggccacattgcaggctgccctctgcctggagaacttctcctccaggttgtggacgacacaacaagccggaagtggagtcaggagtagcaaagagctcctgttacaacctgtgaccatcagcagggattagaggaaaggttcttattgagggctccatcaactctgtccgggtcagcattgctgtaaacaggctgatagaggtcaggaggttttgtaccaaaggtcatgcgcta

SEQ ID NO: 745 - DNA, 209 bp, Homo sapiens
cctggctttcctccgcaagcggatagaacaccaaccctttccgaggcccctaccacttccggggcccccagccgcatcttcttgcggaccgtcgcgaggatgctgccccacaaaaccaagcgaggccaggccgttcttggaccgttcaaggtgtttgacggcatccaccgcctcacgacaagaaaagcggatggtggttgtccgtcgcc

SEQ ID NO: 746 - DNA, 182 bp, Homo sapiens
atattatattatgtaccataaatatttcctgtatctgactgcctgaacatattaccacatcctgtgccttagtatcctacagagacaaaaagaaaggaaaaaaaaaaaccctttgttcaggtttttatgtaaatatttttcatgtccccttctttcctttacgcactaatttatacccaggt

SEQ ID NO: 747 - DNA, 266 bp, Homo sapiens
aaaactcaggggctggcggggtgtgcaggtatggtgagaatttgccctctgcaagctctcctggagctcttgtctgtttgatggatggtccgccgctttatagcttctcattctggctcctactgcttccttgaggatacttccctgcttgtagtccctagccagaggttgatgcactagaggaaaggccctctgatcacagatcagagcttgtgaataataataatttttatctctctggtaacagctgatagggtgagtaagag

SEQ ID NO: 748 - DNA, 200 bp, Homo sapiens
ttcggtttttctcttccttcgctaacgcctcccggctctcgtcagcctcccgccggccgtctccttaacaccgacaccatgccttcaattaagttgcagagttctgatggagagatatttgaagttgatgtggaaatgccaacaatctgtgactattaagccatgttggaggatttgggatggatgatgaggagatgata

SEQ ID NO: 749 - DNA, 252 bp, Homo sapiens
gagccgccgccatgtctgcgcatctgcaatggatggtcgtgcggaactgctccagtttcctgatcaagaggataagcagacctacagcactgagcccaataacttgaaggcccgcaattccttccgttacaacggactgattcaccgcagactgtggcgtgagcggcagccgacgcaaaggtgtcgtggtggtcattaagcggagatcggccagcgaagctgccacctctatgtgcggacacatacaagatt

SEQ ID NO: 750 - DNA, 141 bp, Homo sapiens
ccctggcctggtctgctgatggccagactctgtttgctggctacacggaacaacctggtagcgagtgtggcaggtgaccattggcacacgctagaagtttatggcagagctttacaataaaaaaaaactggcttttctgaa

SEQ ID NO: 751 - DNA, 213 bp, Homo sapiens
agtcgccaatatgcagctctttgtccgcgcccaggagctacacaccttcgaggtgaccgcccaggaaacggtcgcccagatcaagtctcatgtagcctcacttgaggacattccccgaaagatcaagtcgtgctcctcgcaggcgcgcccctagaggatgaggccactctgggcagttcggtgtagaggcctatctaccctgagtagcaggcc

SEQ ID NO: 752 - DNA, 202 bp, Homo sapiens
aaactattatacaactgtttttgcgactttataggcaggtaaattttgctattactattgaatacaaatgacaattcatttatgaccactcaaacagcgttagtaaccatttagtgacaaaggattaaaacatccatctggatgttaattttgaagatgtaattatatgttgtttaaatttttccaggcatctgaaaaccct

SEQ ID NO: 753 - DNA, 217 bp, Homo sapiens
ggtttttggtttggagacatccaaagcctgaagccaggtgggtgtgggcaggggctgcattttatgaaactgcccagcaagctgtgctccctggggccccaggatccacctaactggcctggcacctggtgccaacgtgctgctgccgccaggataatgcgccttcccacaggtgccctgcctgagtcgtgtcatccaggggcctggtagccccaag

SEQ ID NO: 754 - DNA, 202 bp, Homo sapiens
caaacccactccaccttactaccagacaaccttagccaaaccatttacccaaataaggtataggcgatagaaattgaaacctggcgcaatagatatagtaccgcaagggaaaagatgaaaaatttatacccaggcataatatagcagggtctaacccctataccttctgcataatgaattaactagagatacctttgcaagg

SEQ ID NO: 755 - DNA, 222 bp, Homo sapiens
ctcgtgccaattcggcagggggtttcaaaggctgttattgagacagcagatagagccaagctgcaacctatagctttaagctgtgtactgaatattggggcttgtaaactgaagatgtcaaattggcagggagcaatttacagattgttttagagggctctttaactagagccctcaaataccaaagcattttaccccagagctcaagatggcaaggattaa

SEQ ID NO: 756 - DNA, 190 bp, Homo sapiens
gacaaatgggactgatgtcatcttgagctcttcatttattttgactgtgatttatttggagtggaggcattgtttttaagaaaacatgtcatgtaggttgtctaaaaataaaatgcatttaacctcatttgagagaatgccctttagtttaatgcatatttaaactcaaattgatcccgtagtgttcccg

SEQ ID NO: 757 - DNA, 175 bp, Homo sapiens
cggcacgaggaagcgcgcccccggggccggtcccggaggttcggatccgcatctacagcatgaggttctgcccgtttgctgagaggacgcgtctagtcctgaaggccaagggaatcaggcatgaagtcatcaatatcaacctcgaaaaataagcctcagtcgttctttaagaaaa

SEQ ID NO: 758 - DNA, 190 bp, Homo sapiens
ccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttagtaa

SEQ ID NO: 759 - DNA, 253 bp, Homo sapiens
gcagcctgaggtgatctgtgaaaatggttcgctattcacttgacccggagaaccccacgaaatcatgcaaatcaagaggttccaatcttcgtgttcactttaagaccactcgtgaaactgctcaggccatcaagggtatgcatatacgaaaagccacgagtatcttaaagatgtcactttacagaaacagtttgtaccattcgacgttacaatggtggagttggcaggtgtcccaggccaagcaatgggcttg

SEQ ID NO: 760 - DNA, 219 bp, Homo sapiens
ggctgatgatgccaatgtggttcgtgaccgtgacctcgaggtggacaccaccctcaagagcctgagccagcagatcgagaacatccggagcccagagtgcagccgcaagaaccccgcccgcaccttccgtgacctcaagatgttccactcttacttgagagtggagagtactggatttaccccaccaaggctgcaacctggatgccatcaaagtctttt

SEQ ID NO: 761 - DNA, 167 bp, Homo sapiens
gcaagaccattagctctttttataggctcgagaacaacaggatgctttggtcctgtatcagcaggacgctttttgggtagatcctacttccaccctactatcgggtagatcctactttaccctagctatgtgcacatttcaaattccatgtaataaagtagacacaa

SEQ ID NO: 762 - DNA, 225 bp, Homo sapiens
aaaggacccaagtactttccaatctcagtcactctaggactctgcactgaatggctgacctgacctgatgtccattcatcccaccctctcacagttcggacttttctcccctctctttctaagagacctgaactgggcagactgcaaaataaaatctcggtgttctatttatttattgtctccccgtaagaccttcgggtcaaggcagaggcaggaactcactcg

SEQ ID NO: 763 - DNA, 150 bp, Homo sapiens
ccccgaccccctgcagtacatgcgggccgaccaggcagcccggtggcctgagacagcatgacgccgaggtggatgccacacttaagggccctgaacaaccagtttgggagcatcccgagccccggggttcccgaaagaccctttttgaac

SEQ ID NO: 764 - DNA, 178 bp, Homo sapiens
tgaacttgctgattctgtagcaaaacctgggtgggggttggggtggggggtagtttactttgttgtaaggacttgataacctggctacagcgttttctatgaaatctacttggatcccatgcctaaaatttggagcatatgtacaaaaatcattttacggttttattttataatcatt

SEQ ID NO: 765 - DNA, 160 bp, Homo sapiens
tgaacttgctgattctgtagcaaaacctgggtgggggttggggtgggggggtagtttactttgttgtaaggacttgataacctggctacagcggttttctatgaaatctacttggatcccatgcctgaaatttgggaagcatatgtacaaaaatcatttt

SEQ ID NO: 766 - DNA, 141 bp, Homo sapiens
gcgtgtgcggctccagcccagcccgctgctcactttccaccctctatccacctgcctctggcttctcaggcctctgctctccgacctctctcctctgaaaccctcctccacagatgcagccatctccgggtccctcctagt

SEQ ID NO: 767 - DNA, 150 bp, Homo sapiens
gcgtgtgcggctccagcccagcccgctgctcactttccaccctctctccacctgcctctgggttctcaggcctctgctctccgacctctctcctctgaaaccctcctccacagatgcagccatctccgggttccctcctagtctttcctt

SEQ ID NO: 768 - DNA, 209 bp, Homo sapiens
gtggcagccatctccttctcggcatcatggccgccctcagaccccttgtgaagcccaagatcgtcaaaaagagaaccagagttcatccggcaccagtcagaccgatatgtcaaaattaagcgtaactgcggaacccagagcattcacaacaggttcgtagagattcaagggccagtctttatgcccaacattggttatggagcacaaaa

SEQ ID NO: 769 - DNA, 225 bp, Homo sapiens
gtggcagccatctccttctcggcatcatggccgccctcagaccccttgtgaagcccaagatcgtcaaaaagagaaccaagagttcatccggcaccagtcagaccgatatgtcaaaattaagcgtaacttggcggaacccagaggcattcacaacagggttcgtagaggattcaagggccagatctttatgcccaacattggttatggagcacaaaaacacgcaca

SEQ ID NO: 770 - DNA, 197 bp, Homo sapiens
taacaaacgtgttttttaaaaaagcctggtttttctcaatacgcctttaaaggtttttaaattgtttcatatcttggtcaagttgagatttttaagaccttcatttttaatttgtaataaaagtttacaccttgattttttcaaaaaagtcaacaaactgcaagcacctgttattaaggtcttaatataaaaaaaaa

SEQ ID NO: 771 - DNA, 176 bp, Homo sapiens
ggagattccaagggcttctctggagggggattggctgcagtgtagatttgcctctgaggaggctgccccagacttggcctcctcatagcccctcctgacctctcccttctctggtcctggcatccctggagaagtaggggtcttgacctaagttagatttagatctccatgtcaca

SEQ ID NO: 772 - DNA, 295 bp, Homo sapiens
ctcgtgccatttcggcagctccccagctgccaccaccaagattggcccccccgcatccacacagtccgtgtgcggggaggtaacaaggaattccgtsccctgtaggttggacgtggggattttttcctggggctcagagtgttgtactcgtaaaacaagggatcatcggatgttgtctaccaattgcatctaattaccgagctggttcgtccaagaccctgtgaaggattccattgtgctcatcgacagcacaccgtacccacagtggtacgggtccactattcgctgcccctgg

SEQ ID NO: 773 - DNA, 210 bp, Homo sapiens
ggctgcacgaaacataccggtaagtggggcaagactgttatcgagtaccggtcacagaagacctcacgcctccccatcattgacattgcacccatggacataggagggcccgagcaggaattcggtgtggacatagggccggtcttcttcttgtaaaacctgacccagacacaacacatccgttgcaacccaaggccccgtgctctctct

SEQ ID NO: 774 - DNA, 265 bp, Homo sapiens
ctcgtccggaaaagcgttcaagctcaacacccactacctaaaaaatcccaaacagataactgaacttctcacacccaatgggaccaattgataacccgatagaggactaatgttagtagaagtaacatgaaaacattgtcctccccataagcctccgtcagattaaaacactgaactgacaattaacagcccattatctacatcacccaccaggtcatatttaccctcactgtcacccacaaagggcgtgcttataggaagggta

SEQ ID NO: 775 - DNA, 320 bp, Homo sapiens
ccaacatgggccgcgttcgcaccaaaaccgtgaagaaggcggcccgggtcatcatgagataagtactacacgcgcctgtggctaacgacttccacacgagactaagcgcgtgtgctgaggagatcgccattatccccagcaaaaagctccgcaacaagatagcaggttatgtcacgcatctgatgaagcgaattcagagaggcccagtaagaggtatctccatcaagctgcaggaggaggagagagaaaggagagacaattatgttcctgaggtctcagccttggatcaggagattattgaagtagatcctgacacttaa

SEQ ID NO: 776 - DNA, 215 bp, Homo sapiens
gagcagcttttggctgcgtaactgtgaactatgtgaccatatataattctcgatcattaatttttgaagatacttgtggctggacaaagtgcattcctctgttaataaactttttatttattacagcccaaagagcagtatttattatcaaaatgtcttttttttttatgttgaccattttaaaccgttggcaataaagagtatgaaaacgcaaa

SEQ ID NO: 777 - DNA, 277 bp, Homo sapiens
tgcagaaggagatcactgccctggcacccagcacaatgaagatcaagatcattgctcctcctgagcgcaagtactccgtgtggatcggcggctccatacctggcctcgctgtccaccttccagcagatgtggatcagcaagcaggagtatgacgagtccggcccctccatcgtccaccgcaaatagcttctaggcggactatgacttagttgcgttacaccctttcttgacaaaacctaacttgcgcagaaaacaagatgagattggcatggcttta

SEQ ID NO: 778 - DNA, 305 bp, Homo sapiens
tctacgccgagtgacagagacgctcaggctgtgttctcaggatgaccgagtgggagacagcagcaccagcggtggcagagaccccagacatcaagctctttgggaagtggagcaccgatgatgtgcagatcaatgacatttccctgcaggattacattgcagttaaggagaagtatgccaagtacctgcctcacagtgcagggcggtatgccgccaaacgcttccgcaaagctcagtgtcccattgtggagcgcctcactaactccatgatgatgcacggccgcaacaacggcaagaggctcatg

SEQ ID NO: 779 - DNA, 200 bp, Homo sapiens
ccccaatggaaaaatcccttctcccacttttcttaaccctacaagatatgccaagattctatagcatctgaatttgaaaacctctactaattcatgaggcaatctatttgataatggcatgatttagttagtgttccttttttagagataaagcctcactgcactccagccggtccacagagtgagaccctgtctccaaa

SEQ ID NO: 780 - DNA, 314 bp, Homo sapiens
cggcacgagctctcatggaaagggggctggtacctgtcaaagtgttattttatgcaacaatatagtcactttttattttggcaattagaagtagactcaaaggagattacaatttggttgctggcagccattctgggtttcttgattttagtactccaaagaatatggtggtctcatggagtagctgaccactaaggaggggaggattaaaagggaatcacttatcagtttttagcataggatgcattaaggaatttcaacgggtaactgacaatcgtttgttaagaagttaactgtatcatagctcactactg

SEQ ID NO: 781 - DNA, 317 bp, Homo sapiens
gcaattcctacaagctcccgtacagctggatcggcacaggccacgtggtatacaatggcgccttctactacaatcgcgccttcacccgcaacatcatcaagtacgacctgaagcagcgctacgtggctgcctgggccatgctgcatgacgtggcctacgaggaggccaccccctggcgatggcagggccactcagacgtggactttgctgtggacgagaatggcctatggctcatctacccggccctggacgatgaggcttcagccaggaggtcattgtcctgagcaagctcaatgccgcggacctgagcacacaga

SEQ ID NO: 782 - DNA, 375 bp, Homo sapiens
gaacaatggcggagctgggcgaagcgaatgaagcggagtttgcagcgccttggttggccgccgagcagcagaaggcgcagtttattgcacaggggcatcacttcatggggttatgttgggtataaatgtgtggagaagccagggtatcgcctagactctcgcactgaaaattgtctctccagctgtgtagaccccttcattgacaccactcttgccatcaccagtcggtgtgcccagattgtacagagaggaggccagtaggccatcccccaggagagtgacagacgcaaggcacttgttcactaacgcagatttaagggtcagtgggggagggctatcacccatttgtcagatcagcatcacgctgttgatcaa

SEQ ID NO: 783 - DNA, 371 bp, Homo sapiens
ggtcatccagcaggtgttcgacaatggcagcatctcaaccctagaagtgcttgatatcacagaggaaactctgacattctcgcttcctggagggtgtccgcaatgttaccagtgtctgtctgcagattgagctacccaactgttgcatcagtaccccattctatcatcaacgggtacaaacgagtcctggccttgtctgtaggagacggattacaccttcccacttgctgaaaaggtcaaggccttcttggctgatccatctgcctttgtggctgctgcccctgtggctgctgacaaccacagctgctcctgctgctgctgcagccccagctaaggttgaagccaaggaagagtcggaggagtcgaccgag

SEQ ID NO: 784 - DNA, 300 bp, Homo sapiens
gcttctccccatctttcaaaagaatcacgaaatttcttctgcaccttggctattctgtttaaatctgataatcagttgatctcaggtttttcactgtacattactttgcagatatggacagcctttacacaaaataatttttaaatgcttaattattttaatttgttctcttaaggtaaccttcagttattttgaattaatttaacttctcaattatgccaaagttgcacttgcatgaaataaatattattttgtccttgtatagactggaacagtaataaatttatctgaattaaaaaa

SEQ ID NO: 785 - DNA, 172 bp, Homo sapiens
tggtgctgcaccagcaggaggtcctgccccctccactgctgctgctccagctgaggagaagaaagtggaagcaaagaaagaagaatccgaggagtctgatgatgacatgggctttggtctttttgactaaacctcttttataacatgttcaataaaaagctgaactttaaaa

SEQ ID NO: 786 - DNA, 377 bp, Homo sapiens
gagataaccgtgcctgttcagagtgtctacagtaagagctggacaaactctggagggacacagtctttgagacagctcttttggttgctttccacttttctgaaaggttcacagtaaccttctagataatagaaactcccagttaaagcctaggctagcaattttttttagttgcaactaagtaagatatactacaaactaaggatgctgctagactaaggaataaacagcaaggtaccaaagtacagcaaagcaacaacaaaggctctgtatttgcagaggggtctatcatgcttttaagagaaaagaagagtacagggaaaaaattcagatagacataagagtattttggatgccattaaactttgtcaataacc

SEQ ID NO: 787 - DNA, 172 bp, Homo sapiens
catgattggatacatttctattttgttttcccttctgctttttgatggaacagcacagtaagttgaatcaagtcctgctcatgtgtgaagaagaaactcttccttctttacattaatgccatagaagaagtcaaaaaaggacaattagcaagcagtgggcttctgggaaaaa

SEQ ID NO: 788 - DNA, 379 bp, Homo sapiens
cgaccctgcacctggtcctgcgtctgagaggtggtatgcagatcttcgtgaagaccctgaccggcaagaccatcactctggaggtggagcccagtgacaccatcgaaaatgtgaaggccaagatccaagataaagaaggcatcccccccgaccagcagaggctcatctttgcaggcaagcagctggaagatggccgcactctttctgactacaacatccagaaagagtcgaccctgcacctggtcctgcgccttaggggtggctgttaattcttcagtcatggcattcgcagtgccccagtgatggcattactctgcactatagccatttgccccaacttaagtttagaaattacacgtttcagtaatagctgaacccg

SEQ ID NO: 789 - DNA, 376 bp, Homo sapiens
ctcgtgccgctcacattgcatgcaagtttgctgagctgaaggaaaagattgatcgccgttctggtaaaaagctggaagatggccctaaattcttgaagtctggtgatgctgccattgttgatatggttcctggcaagcccatgtgttttgagagcttctcagactatccacctttgggtcgctttgctgttcgtgatattagacagacagttgcggtgggtgtcatcaaagcagttgacaagaaggcttcttgagcttgcaaggtcaccaagtcttcccagaaagctcagaaggctaaatgaatattatccctaatacctgccaccccactttttattcagttgtggaagaacgctctcagcactcttttttccaa

SEQ ID NO: 790 - DNA, 340 bp, Homo sapiens
attcacacacctaccaatggaagatgagagctaagaaagtcagctatcccgaattggtgagtcgcagctttacagtcttcaagaactacaactcatttataccacaagtatgttgacgtaattttcagcttaccgaacatatgaaaatttccctctctctctaataaataccctccaaagcccagaaatttggctttgctactgacaaccctttggtaaaccactactcgcaggtaaaagagtttaacctcacaaagctgcaattatctggatttgaatatgcttcccccctctacacatatacctctctcctctaaggccatccatgcttttctgagct

SEQ ID NO: 791 - DNA, 280 bp, Homo sapiens
cagcatttcaagtgccagaagtataactttctaaggagagaagggttgtcacattataaaatctttaggaaaatgtgaactggaaaacgcttcggtcagttttagtgacatagcctgtgatgatgggtctggtgactattattgcggaccgtggtacccagttttaggaatgtggagaaaggaattctgttgattccgttgaggaatctgtagcgtatgcattcgttctgttaagagcaaatctaggagaagtgcttcagctgcccagtgcgccgtgggg

SEQ ID NO: 792 - DNA, 217 bp, Homo sapiens
tggccgtacgcctaaccgctaacattactgcaggccacctactcatgcacctaattggaagcgccaccctagcaatatcaaccattaaccttccctctacacttatcatcttcacaattctaattctactgactatcctagaaatcgctgtcggcttaatccaagcctacggttttcacacttctagtaagcctctacctgcacgacaacacataaa

SEQ ID NO: 793 - DNA, 287 bp, Homo sapiens
aaaaggagggaaacgtcaactccattgcaattacttatcttcctcttctatctctgttatacgccggggcatagaatgctcgtatacatctctttaacaaccacaaaccttaagccatgtagatgaagttagtgcatcaacgggatacagttccatattgccttaaaccttcttgttttagacacacttacatttatatccaaattgcagattattctgcagagagggaattgcatgtttgtgttgtatatttagtatgaactttttcagaatataatatttcttag

SEQ ID NO: 794 - DNA, 288 bp, Homo sapiens
tgtcaaagcgctaaccagccaggggcaggcccctgatgcccggaagctcctgcgtgcatccccgggatgaccagactcccggactcctcaggcagtgccctttcctcccacttttccttcccccataggcacaaggctctgcttctgcttctgcctgcaagttctctctgttgttggagccttgagccttgctctctggggcacagagggggttcactctcctgcctgctggggacctatggaagggggcttcctggccaaggcccccctctttccagaggaggagca

SEQ ID NO: 795 - DNA, 275 bp, Homo sapiens
cttccatcagtcccactggaatcactggagctgggatggccttcagagttgttccacatgaggcaagggggccatgtttttgtaccccacattgaagagtactggatatgggctggccctgggaagaggtgtgacctagggtgaggaggctccctgaagtagaaggcaatttgtagcttgagagcttatagtgtaacagcaatcccaacatcagggaaaaggagccccttagtcctctaagaaaggtaactgcatggcacactactgcatcccac

SEQ ID NO: 796 - DNA, 275 bp, Homo sapiens
gaacaagagagctgtaagacgcctccgtactgcttgtgaacgtgctaagcgtaccctctcttccagcacccaggccagtattgagatcgattctctctatgaaggaatcgacttctatacctccattacccgtgcccgatttgaagaactgaatgctgacctgttccgtggcaacctggacccagtagagaaagcccttcgagatgccaaactagacaagtcacagattcatgatattgtcctcggttggtggttctactcgtatccccaagatt

SEQ ID NO: 797 - DNA, 150 bp, Homo sapiens
cggcacgagaaagactaaatcagtagagttggaaaagctttataaccggtgtgtcatatgcttgctatttaaagctgtgtgttggttttgtttttctgccacattcactaggtttttaataaatattttcccaaaatgggaaaacaaaaa

SEQ ID NO: 798 - DNA, 345 bp, Homo sapiens
gcagccctggctaagttaatcccaccgctttcagtggtagaaagaattccctgagtgggccaggctggtgccctcctcctaccctggcttttctgagtgagctgcctggagccctcatcccctctcccaggctgggctggccctgggcggggccactgtgtgctggcccactgtgacctgacccgaccttgtgcagcccccctgccctggtgtcctgggttttcgtgatgatctttgctctgtttccagtggggtttgaagcagagttcaggggaaccctgcccaaggtcctcctgttcagacattcctatgttgaataaagtatgtttgacttccccggaaaaa

SEQ ID NO: 799 - DNA, 245 bp, Homo sapiens
cggtctcagaactgtttgtttcaattggccatttaagtttagtagtaaaagactggttaatgataacaatgcatcgtaaaaccttcagaaggaaaggagaatgttttgtggaccactttggttttcttttttgcgtgtcgcagttttaagttattagtttttaaaatcagtactttttaatggacacacttgaccacaaatttgtcacagaattttgagacccattaaaaaagttaaatgagaaa

SEQ ID NO: 800 - DNA, 268 bp, Homo sapiens
cccaactggagtgttgctttgaagatgacgccttcttatattttcatagcaaatgggtggtatcaaaatcagacattgcttcttgctgataaaaagcctgaaggaaataagtgaaactacatctatgggaaaaaaaaaaacattgagaagtgcaaatgttcgcatccttttgtttttaaaagatatgatgtcagaataaaatgtggaaacatacgggaaactagtctagactttaaagaattgtgatcaggtcacattgttaataaaa

SEQ ID NO: 801 - DNA, 135 bp, Homo sapiens
ctaggatggggggcatggccctggctgccagatgcccacagcaccctggcatgacctgccacctctgcttccacaccggagccagctacctctcctgtgcctgccactcaataaacagtgtctgcgccccaaaaa

SEQ ID NO: 802 - DNA, 150 bp, Homo sapiens
attgtgcaatacagtttcattaactccttcccccgctcccccaaaaatttgaatttttttttcaacactcttacacctgttatggaaaatgtcaacctttgtaagaaaaccaaaataaaaattgaaaaataaaaaccataaacattaaaa

SEQ ID NO: 803 - DNA, 384 bp, Homo sapiens
tcttccctctgctcctgaagaagacactatctttatctaccaagccactttgctatgcaaacgtccttgaaaagatagtccagaaaaaaagctgtcagatactttctttgcaagacgtgcagacatatgactctctcccaagggtggtctcattaacttagagcaaaatgaaagtatagatatcttttttgatgtgcaataagtgacaataattttgcagcagaagatatgctccacacactggtataatatatataatcaattctgattcttacacatagcagtgtcaattgacataccattgcagtaattgttgcctaattcttgcctccaaatgaattcaatatgcaattgcatttggcccattaaaaattctcttgggac

SEQ ID NO: 804 - DNA, 369 bp, Homo sapiens
tcgttgcataaatttgcgctccgccagcccggagcatttaggggcggttggctttgttgggtgagcttgtttgtgtccctgtgggtggacgtggttggtgattggcaggatcctggtatccgctaacaggtcaaaatgcagatcttcgtgaaaacccttaccggcaagaccatcacccttgaggtggagcccagtgacaccatcgaaaatgtgaaggccaggatccaggataagggaggcattccccccgaccagcagaggctcatctttgcaggcaagcagcttggaagatggccgtactctttcctgactacaacatccagagggagtcgacccttcacttggtcttcgcttagaggtgcattcagg

SEQ ID NO: 805 - DNA, 382 bp, Homo sapiens
ctcgtgccgaattcggcacgaggccccactccgcgcctggggacgatttcttcccgggttccgatcgctttgcccggccggacttcagggacatttccaaatggaacaaccgcgtagtgagcaacctgctctattaccagaccaactacctggtggtggctgccatgatgatttccattgtggggtttctgagtccttcaacatgatcctggaggaatcgtggtggtgctggtgttcacagggtttgtgttggcagcccacaattaaggcgtgcttcgccggatgaagaagcgctacccacgacgttcgatataggtggtcatattcgcgagctatttcctcatctccatgttttgaggagatcataggctttgtgtttgca

SEQ ID NO: 806 - DNA, 345 bp, Homo sapiens
aattcataggttttgatgtcattgttgaagttatttgtaattcagaaaccttgcttgtgtgatacatagtaagtctcttcatttattactgcttgtctgttgttatatctggagttatcaaaagcaatagtgcaccaattaagatgtgctcaaatcaggacttaaatcataggcaccacattttttcatgtcagactagttactttgttgattctcagttactgtaggcatcaaaaggcaaaaatcaaaaaaaaaaaaaaaaacttcgggggttccttttggggcggccgggggcccatcgtttttccccccggggggggtcccaggtaagtttccccattcgcc

SEQ ID NO: 807 - DNA, 396 bp, Homo sapiens
caccagtggggcatttttacgaaccccaggctccctctgctgaggtgggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaaggactgggaggctgcacaggtgactatccagtcttcagggacattttcagcaaattcaagtggacaacaacaaccgcctgttactgcagcaggtctcattgccagagctgcctggggatacagcatgaaagtgacagggaagggtgtgtctact

SEQ ID NO: 808 - DNA, 394 bp, Homo sapiens
gtcccaggtgcggctgctgtggaaggacccgcgaaacgtgggttggaaggacaagaagtcctatcgttggttcctgcagcaccggccccaagtgggctacatcagggtgcgattctatgagggccctgagctggtggccgcacagcaacgtggtcttggacacaaccatgcggggtggccgccttggggtcttcttcttctcccaggagaacatcatcttgggcaacctgcgttaccgctgcaatgacaccatcccagaggtctatgagacccatcagctgcggcaagcctagggaccacgggtgaggaccccccggatgacagcaccctcaccgcggctagatgggggctcttcacccagccccaggggtggccctcctcagggggagttaga

SEQ ID NO: 809 - DNA, 403 bp, Homo sapiens
gaacatcacctaccactgcaagaacagcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagccttgggcaagacagttatttaatacaaaaccaccaaggccttccgtctcgcccatcatcgatgtggcccccttggacgtttgtgtcccagaccaggatttcggcttcgacgtttgccctctcttcttctcgtaaactccctccataccaacctggctaccttccacccaacaaattttcccccaacccggaaacagaaaagcaacccaaactgaaccccacaaaagccaaaa

SEQ ID NO: 810 - DNA, 351 bp, Homo sapiens
ccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaacttgctacaaaagccgctcgcaagagtgcgccctctacttgaggggtgaagaaacctcatcgttacaggccttgtactgttgcgctccgtgaaattagacgttatcagaagtcactgaacttcttattcgcaaacttcccttccagcgtcttgtgcgagaaattgctcaaggctttaaacagatcttcgcttcagag

SEQ ID NO: 811 - DNA, 218 bp, Homo sapiens
  misc_feature 11, 12, 13, 14, 15, 16, 17, 18: n = A,T,C or G
aagagatcgannnnnnnntggcccacatggtgagaccccaactctactaaaaatacaaaaattagctgggtgtggtggcattgtgcctgtagtcttagctacttgagaggcttaggcaggagaatcgcttgaaccttggaggcagaggttgcagtgtagctcgagatcatagccactcgtgctccagcctctgtgtgcacagttgagactctcacctc

SEQ ID NO: 812 - DNA, 352 bp, Homo sapiens
ctcgtgccgaattcggcacgaggatccctgcagaacccaccaaccagaacgtggtttgcctgaggctgtaactgagagaaagattctggggctgtcttatgaaaatatagacattctcacataagcccagttcatcaccatttcctcctttacctttcagtgcagtttcttttcacattaggctgttggttcaaacttttgggagcacggactgtcagttctctggggagtggtcagcgcatcctgcagggcttctcctcctctgtcttttggagaaccagggctcttctcaagggctctagggctcccaggctgtttcagccaggaaggccaaatcaagggtgagtgtgga

SEQ ID NO: 813 - DNA, 340 bp, Homo sapiens
cggcacgagactcaacaacctaattttaaaactggacaaacacttgaatagacatttcttcaaagaagagatacagatggccaataagcacattgtcttagtccacttttgtgttgctgtaaaggaatacctcaggcttgggtatattagtccaccttttatactcctgataaagacatgcccacgactcagcaatctgcaaaataaagaggtttaatggacttacagcttccacctggctcgggaagcctcataatcatggtggagggcaacgaggagcaaggccatgtcttacgtcattgcagcaggcaaagagagagcttgtccaggcaaactcccc

SEQ ID NO: 814 - DNA, 367 bp, Homo sapiens
cccccacaagaccttcgacccctctctgaagccaaaatatgcaaagtgtgaccagtgtggaaacccaaagatgtgtgttcagcctgtgccgcggctgctgcaagaagcgagcctccaaagagactgcagactgcccaggtcacggattgctttttaaaaccaaattggagaggtctctggcctggaaaggaggcccacccttagctccaggagcctcaaccagcagcacctggaccaccaggtggcttctcgaggtcatgggcagtccttggccttaaggcccacaacccccacccccaggacttcttctggagcctggacacgcctacttaaggaaattccttttactcagggatctctcctactc

SEQ ID NO: 815 - DNA, 296 bp, Homo sapiens
ggccagttgtggtgctggtgcagctggagcgagaggaggaagtcacaggccctgtcattgcggcctctctttccgcagaaacgtgaagagggccttgttggttggtgattggagatgccaggtccaataggcctcatctccatcaagggggcttaccttccagcaagaggcccaaggtgaagttggacttttttggccccagccacttggtgcccacaactacactctgtactacagtgagtaagcgcttacaatgggattgtgaccaggagtacaaattcagcgtggatgtaaaa

SEQ ID NO: 816 - DNA, 221 bp, Homo sapiens
cggaccctgggccaaagcccggatccaggcgggagcagaagctaaagccaaagcccaagagagttgcagttcagcacttgtgccagtaccagtaccaataacagttccagttccagttccagcaccagttgttggtttagttcttgtgccaaccttaaccgcaattttaaaatttgggtcttcggttggccttgggtagatctgtgtccaagaccaattgg

SEQ ID NO: 817 - DNA, 230 bp, Homo sapiens
ggaaaatatgttgtgttcttcttttaccctcttgacttcacctttgtgtgccccacggagatcattgctttcagtgatagggcagaaggatttaaggaactcaactgcccaagtgattgggcctcttgtggatctcacatcctttcaactaggaatgggcaaatcaacctaggaacaaggggggcctgtgcccccttgcaaatcctttggtatadagccccgaggcgaac

SEQ ID NO: 818 - DNA, 163 bp, Homo sapiens
atcctaccaacttttacctccaacaccttgtaacagatcagagcgtaacgagcactgctcactctgtaaaggggcctcaacattagtgggtacacatttcacatgggcctttgggaaaaccctttttgtcccgctgaaagtcaggctcacaaaaattacgggt

SEQ ID NO: 819 - DNA, 194 bp, Homo sapiens
ccatttgcttcccagccctgtgagtttttacccggctttgcctgccacctctgtcccaggacacgctttccctctcggggatgtgtgatgaactcccaggagaagggaagattgggagccacggcaagatatggaagctcttcccctcagcttttccactagggcacgccagccacgagccctttataagcgtg

SEQ ID NO: 820 - DNA, 351 bp, Homo sapiens
aatgaactagttaaacatggtctgcgtgccttaagagagacgcttcctgcagaacaggacctgactacaaagaatgtttccattggaattgttggaaagacttggagttacaatctatgatgatgatgatgtgtctccattcctggaaggtcttgaagaaagaccacagagaaaggcacagcctgctcaacctgctgatgaacctgcagaaaaggctgatgaaccaatgggacattaagtgataagccagtctatatatgtattatcaaatatgtaagaatacaggcaccacatactgatgacaataatctatactttgacccaaaagttgcagagtggtggaatgctatg

SEQ ID NO: 821 - DNA, 214 bp, Homo sapiens
ctggctccctcccacccaaccaactttccccccaacccggaaacagacaagcaacccaaactgaaccccctcaaaggccaaaaattgggagacaatttcacatggactttggaaaatatttttttcctttgcattcatctctcaaacttagtttttatctttgaccaaccgaacatgaccaaaaaccaaaagtgcattcaaccttaccaaaaaa

SEQ ID NO: 822 - DNA, 345 bp, Homo sapiens
ctgaggctgatttggagcaatataaaaaagctttaactgatgcaggatgcaaccttaatcctttacaatatatcaaccagttggaaggccttttaccaagatggcctcagctccggccagctatggcagcactaccactaaaccaatgggtcttttatcacgagtcatgattacaggatcacagtttgtgatggaagaagtaagaacctggttttgaaacagcaaaatctacctgttactcgtattttggcacactctcatggagatgaagtccacaccccgacactgatgcctatagatattttgacccaaaatgctgcgggacaatcacagctcagtcccaga

SEQ ID NO: 823 - DNA, 360 bp, Homo sapiens
ctggcatcaaaggacatcgaggattccctggtaatccaggtgccccaggttcttccaggcccttcttggtcaacagggttgcaattcggcaagtccaaggacctgcaaggccccagaaggacctgttggacccagtggacctcctggcaaagatggaaccagtggacatccaggtcccattggaccaccagggcctcgaggtaacagaggtgaaagaggatctgaggtctccccaggccacccagggcaaccaggccctcctggacctcctggtgcccctggtccttgctgtggtggtgttggagccgctgccattgctgggattggaggtgaaaaagctggcggttttgccccgtatta

SEQ ID NO: 824 - DNA, 150 bp, Homo sapiens
cttttatattgctaagggtaaatatgcatcatttttagtggctgcatagagttccattgtgtggctcttgcattatttatttaaccaaccccaataaatacaactgctaatttttcacctattaaagttcaatacccactcttaatatat

SEQ ID NO: 825 - DNA, 151 bp, Homo sapiens
gcctccaagatgacaaagaaaagaaggaacaatggtcgtgccaaaaagggccgcggccacgtgcagcctattcgctgcactaactgtgccccatgccgtgcccaaggaccaagggccaattaaggaattccggtccaattccggaacacta

SEQ ID NO: 826 - DNA, 173 bp, Homo sapiens
gcaaatattccaggggaaagaaaagacaaaagtttgctgcaatgcacttccacagtactctttcccgttctaatgacatctggttaatgaggcacaagctgagcgtgacttcctttcatattggagggaaggcaggacattaagggacccagagggagccaaggaggcaggac

SEQ ID NO: 827 - DNA, 190 bp, Homo sapiens
tgaactgttatcccattgaaaagaccgagccttgtatgtatgttatggatacataaaatgcacgcaagccatatctctccatgggaagctaagttataaaaataggtgcttggtgtacaaaactttttataccaaagggtttgcaacattctataatgagtggtttactggtaaatataggtatattttt

SEQ ID NO: 828 - DNA, 150 bp, Homo sapiens
ctttgctttatttttcaggctacaatacaggtcagagacaatggcttataaaggtttagtgttggcttcaggatgttacaaggcagtccagccttaacctttttttacaattcaggcaaaacttccaggaaagagtccttttgtccctct

SEQ ID NO: 829 - DNA, 197 bp, Homo sapiens
ggaggtgcagccatctccttctcgctggcgatttggaagacactctgcgacagtgttcagtccctgggcaggagagcctccttccaggattcttcctcacctggggccgcttcttccccaaaaggcatcatggcggccctcagaccctttttgaaggcccaagatcgtcaaaaggagaccaagagttcatccgcaca

SEQ ID NO: 830 - DNA, 165 bp, Homo sapiens
ctaaactaccaaacctgcattaaaatttcggttggggcgaccttggagcagaacccaacctccgagcagtacatgttaagacttcaccagtcaaagcggacttactttaactcaattgtatccaataacttgaccaacggaccaagtttacccttagggttaaca

SEQ ID NO: 831 - DNA, 141 bp, Homo sapiens
gaagatcaccattgctgactgtggacaactcgaataagtttgacttgtgttttatcttaaccaccagatcattccttctgtagctcaggagagcaccccttccacccaatttgctcgaagtaatcctaggaatccttggtg

SEQ ID NO: 832 - DNA, 150 bp, Homo sapiens
agggataacagcgcaatcctattctagagtccatatcaacaatagggtttacgacctcgatgttggatcaggacatcccgatggtgcagccgctattaaagggttcgtttgttcaaccgattaaggtcctagcgtgatcttgggttcaag

SEQ ID NO: 833 - DNA, 150 bp, Homo sapiens
cacagattccgtcctttaccagctgcagaatcttgggcaagttacatagcctctgtgagcctcatcggtaaacagtgggggttatgatacccacctcacagggttgttgtgaggatccaattaggttgatttagggaagcacctaggcaa

SEQ ID NO: 834 - DNA, 150 bp, Homo sapiens
atagaatacacccttttacatcactcacactagggctcatacacctctcccaggacctttaactgaagggaatcaaatggctgatggcctagttgctactacattatctattgccagccaatttcacattttacccatgtttaatgcctt

SEQ ID NO: 835 - DNA, 251 bp, Homo sapiens
cccagttgaccgcccggcaccactagctggctgggtgcacccaccatcaacctggttgacctgtcatggccgcctgtgccctgcctccacccccatcctgacactcccccagggcgtgcggggctgttcagactggggtgccaggcatcttctagcccacccggggtgttccccacatgcagtactttatacccccatccctcccttggtccacttaacttagagcagttccattcctccccgccatcttt

SEQ ID NO: 836 - DNA, 251 bp, Homo sapiens
atttgctgcctggaaaattctcggatatgaccgctgtgatgcgggctggttggcggatggcagcgtccgctaccccatctctaggccaagaaggcgctgcagtcctactgaggctgcagtgcgcttcgtgggtttcccagataaaaagcataagctgtatggtgtctactgcttcagagcatacaacttaatgtccccttagggcgcatcagttttaaaggtcattaagcacatgtaaaggtgtttttttt

SEQ ID NO: 837 - DNA, 363 bp, Homo sapiens
ctgaaaacaccaggtatttcaggagacgcctgaaagagatggggtttcatcatctatggaaattgaagactctccagtagtgcctttgatgctctacatgcctgcaaaattggcgcctttggacgggagatgctgaagcggaacatgcggtgttcgttgtggttggatttcttgcaccccaattattgagtccatagccaggttttgctgtcagcagctcataccaaagactacttgatactgctttaaagagatagatgagtaggggactattgacggtcagtgattcctgactcggttgtgactctactgacaggcctttgacgagacgacgtatgaggaacaaagtcatagcctttttgg

SEQ ID NO: 838 - DNA, 256 bp, Homo sapiens
ctcgtcacattttcggcaggttaaaagttctgttaactaactgaaagggggaaaagaactcttaagaagcagcaaggcagttaactccagaaagtggcttctacacctcagactaagggaaaaatgaacagggagggactccaacgattggaaaggtcctgccagcctggattcagacctctgaggagagtactcggtgtacaggacatgctgcctgtagtctagtgccaggaaacttctgagggtaccctgttaw

SEQ ID NO: 839 - DNA, 380 bp, Homo sapiens
caaacaccagagtctgtacttttctataacacagctcagattaaggtagggcatatgcaaggaggttctcacctccctaaagaagggacttgaatttagggcttaattcaccctccttcaatacaactttccccttcttgtttgacatgccagatactgctttatgcaggctgtaccccttgaaaatcctttctacagtgctgctcacaaagagcccagttcgcctcctacctccattgctgacttgaattcacagtcgccgagtctacctagctttcttggagcagtctagcaaaatttctatttgtacgttcactaattatctacaaggacaaaatcagttgtatttacaaactctacttcagtgtttgtttaggttt

SEQ ID NO: 840 - DNA, 272 bp, Homo sapiens
cggcaccgcgctcgcctgattcgggccgaacccaaaggatcaatcgatccgagtgcaagaccacgccggacttcaagcctccagaagcctttacaacgccaatcaacgaacctaataagtagcttgtcctgcctgaggagcgcttcgaggtgccataaagacagcaggaggatttagtagggccagaggactcttctcggcctttagcccgttcatccttgctaccctcgctcaggtacaaacgaggagagccgccgtccagcatgccgctt

SEQ ID NO: 841 - DNA, 119 bp, Homo sapiens
ggactattagagatggcatctcatcgatgagagagaatcacaatcagaatggaagcactttgagtatctgaagagtgaagagcattcatgttttgacaggtcctgcttcccactatcct

SEQ ID NO: 842 - DNA, 320 bp, Homo sapiens
ctctgaagttataggcatttcttgctgtttaatagttacattatcacaaaacaagccctattcatgattgaggactatggaaatagtgacttcttgaggaggcaccaaactttcctagaactgggtactctcagatagtggctgctatttctattctatttcagtgacgtagggttgggctgatgtaaatagacatcatattactaaatagagtcctataaaatgcaatcacaggtgcccgggagtactagttttaaacatttccttaacaggagacaatccagcaaaagcttcttctctatacaggtatatctctaact

SEQ ID NO: 843 - DNA, 223 bp, Homo sapiens
ctgggcatttgccttgtagctgaagctatgggtctctgcattgtttgatggttgctttcttgattttgtttgccatgtaacaaattactgcttgacatgttggcattcatattaattacgggagtaattctgtgtatcttactgtgactccgaaaactgtagtattggtgtcatggggatgtacgttattttcaagttatttcattaaagagaaactttaaaa

SEQ ID NO: 844 - DNA, 231 bp, Homo sapiens
gcgatatgccaacgtaccaagaagtcgggatcgtcggtaaatacgggaccgctatagggcctcctccgaaaataggtgaggaaattgaaatcagccagcacgcaagtacacttgctctttctgtcgcaaaaccagatggagagacgagctgtcgggatctgcactgtggttcctcatgagacagtgctgcggtctcgacgtacatacactccgtgtacggtaagtcccatc

SEQ ID NO: 845 - DNA, 180 bp, Homo sapiens
ttgcactttttgggccttttttttatagcttggaacaacaaaataccaccctacaaacctgtatttaaaagagacagagatgaccacgtgaaatttgcctctgtccaaacaattcatccgtgtgtatgtgtatgtgtgtgagtgtgtaagccgccagttcatctttttatatggggtgtg

SEQ ID NO: 846 - DNA, 151 bp, Homo sapiens
attaaaaggtctaacatacatgagtcccagacaataaaagggtatgatgttggggcagggaaaaaaattggaggacatcatgccatcatttcccacatttggcgaagcatataaatgtacatggtcagaggttcagccaaactccaggcag

SEQ ID NO: 847 - DNA, 250 bp, Homo sapiens
cggcacgaggttttgttgagcatgacagcctgcagcaggaaatatatgtgtgcctatttgtgtggacaaaaatatttacacttaggggtttagagctattcaggaggagatgtcacagaagcagctaaaccaagggctgagcaccctctggattctgaatctcaagatgggggcagggctgtgctttaaaggccctctgagtcatctgttagggccttggttcaataaagcactagcaagttgaaaaaaa

SEQ ID NO: 848 - DNA, 150 bp, Homo sapiens
catcgttccaatgcttgttcactgttcctctgtcatactgtatctggcatgctttgtaatacttgcatgcttcttagaccagaacatgtaggtccccttgtgtctcaagacttttttttttcttaattgcatttgttggctctattttaa

SEQ ID NO: 849 - DNA, 205 bp, Homo sapiens
gagtcatttgtgcaagtagacggggtctgtgggtgcaggccctggagggaacacaattgcctggaggcttctgtgagatcgggagaggaaggagaggcagtctcttgacaaaataagtatttttattcatttgtatttattaaatgaaaaacaattccaatggtgtcctgttgtgtggtggaacctaatgactgttgaataaagt

SEQ ID NO: 850 - DNA, 259 bp, Homo sapiens
gccatctccttctcggcatcatggccgccctcagaccccttgtgaagcccaagatcgtcaaaaagagaaccaagaagttcatccggcaccagtcagaccgatatgtcaaaattaagcgtaactggcggaaacccagaggcattgacaacagggttcgtagaagattcaagggccagatcttgatcgcccaacatttggttatgggagcaacaaaaaaacagggcacattctgcccagtggcttccggagttcctggtcc

SEQ ID NO: 851 - DNA, 336 bp, Homo sapiens
gtggtgggctgagccagggtctaggtttctgtgggggacactgaatctcccagtgttcagtctcccaggactctgctgcctcagccagagcctccatatgcttgaagtgctgattacctacaaatgatttcagatcatgtttgctaaagagaaatctggaagtgtgagatctgtaagaaatgaaagaaatgactcttggagtcaagagatctggaaatcttttaatcagttaaattgtgcagcaatagatttttactttaactgaccatttaagttttttaataagtttttacaagaaagttaacattaaaagattacagcttctgtctccttaaa

SEQ ID NO: 852 - DNA, 216 bp, Homo sapiens
gtcaacaaccgcttcgagctgataaacattgacgatcttgaggatgaccctgtggtgaacggggagaggtctggctgtgcgctcacagacgctgtggcaccagggaacaaaggaaggggtcagcgtggaacacagagagcaagacggatggagatgacaccgagacagtgccctcagagcagtctcatgcaagtggcaaactccggaggaggaaaa

SEQ ID NO: 853 - DNA, 327 bp, Homo sapiens
ccctcttcctccttgtttctctctttcctctggaactcccaccttttcttctattagctgcatgttggtttttgtctgttacaaattgagctactgtaatcattagtgtgtaggtctttgtgtgggaatattctttctcttctcttgtgttattatctaaaagtgcaatgcctttgttgcagggtaggtgaatattttacattttaagaaactcccaaattgtgttctaaagttattataccattttacatcccctgcctcctgattggtgagcaagagttccagtttcgtcacataatcaccaccaattgctatgatctgtgtttt

SEQ ID NO: 854 - DNA, 160 bp, Homo sapiens
ttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcaaaaa

SEQ ID NO: 855 - DNA, 188 bp, Homo sapiens
ttgatctaggcaaacctttataaagttgcagtacctaatctgttattcccacttctctgttatttttgtgtgtcttttttaatatataatatatatcaagattttcaaattatttagaagcagattttcctgtagaaaaactaatttttctgccttttaccaaaaataaactctttgggggaagagaa

SEQ ID NO: 856 - DNA, 337 bp, Homo sapiens
cttattcaggaccggcacttcttaatgtttgtggctttctctccagcctctcttaggaggggtaatggtggagttggcatcttgtaactctcctttctcctttcttcccctttctctgcccgcctttcccatcctgctgtagacttcttgattgtcagtctgtgtcacatccagtgattgttttggtttctgttccctttctgactgcccaagggctcagaaccccagcaatcccttcctttcactaccttcttttttgggggtaagttggaagggactaaaattgtggggggaggtaggaggcacatcaataaagaggaaccaccaagctgaaaaa

SEQ ID NO: 857 - DNA, 183 bp, Homo sapiens
tgcacacggaaagaactctgtttaaatgctcagttcagaacactttgggccacatagtgattttggaaaacaggataatcgtggtgtaaatgagtgtttcctttcaaagtccactgcagagcttttatccatatggtatgcacatgtagccaatattggtttctttttcttaatatatatatt

SEQ ID NO: 858 - DNA, 303 bp, Homo sapiens
gagtagttcttggtaggtgcaggaatagtagtgtcatttggaatactggtcatctttctgacatcacagtagaaaccaaaccttggatttagattcaaaagggggggaaatgggtcttttcatcaaggcaactccccttctccaagtcacttacatcatagataaattttagcttccagtaactgagggatttgtttcctaacggcattggaggcttcatcctctctacgataaggttgcagaaatgggaggagctacccgtgggttgcttttgattacccttaggagggagacaggtttttg

SEQ ID NO: 859 - DNA, 243 bp, Homo sapiens
attggtcaaccaaggtggaagccaagagaacaagaggggaggttaatgtggtccattcggatcaatcttcctgggcacagaacaagatgaagaaaaatggaaagtagattttgagaggcaaatagaaatttcccgcatagcccttttaaagacactctaattctgaaaaaaggttacttctagttggttgcctctcataatctcgcctcaaaattccatggtttctataaataaaggtagtaa

SEQ ID NO: 860 - DNA, 335 bp, Homo sapiens
gcaaaaacagggggtgctgtagaccggctgacggacaccagcagatacacgggctcccacaaggagcgctgtcgatgagagcggcaagggtcaagggcattgcgggacggcaggacatcctggacgacagtggctacgtgagcgcctacaagaatgcaggcacctacgatgcctaaggtgaacgaagtaaggcttgggaagaccgccctcccaagtgcggctgccctgccagagtcaggctgggtctaagggcacgtggagcaagaaatcctggtccctcctctggaccttccaccagagcttcctgcctagtccactggcttggccaccaggct

SEQ ID NO: 861 - DNA, 283 bp, Homo sapiens
gtggggaagagcaacaggcgagatgcctcattctactggaacatcactgtgggtgaacagagatttccaggttttaccctcttaaaatatttgtaccacaccgacaagagtccagtcaccagggctcaaaggaacttctgcttgtagcagcccgcctccctgtgccccagcctccttaatgtgtgcactctcgaggggcacagctcacgaggctgggtttggggccaagtgcttgttcattccagcatctaacatcataaggtggcccagatttcttgattcg

SEQ ID NO: 862 - DNA, 219 bp, Homo sapiens
caaaggctgcgaggttgtggtgtctgggaaactccgaggacagagggctaaatccatgaagtttgtggatggcctaatgatccacagcggagaccctgttaactactacgttgacactgctgtgcgccacgtgttgctcagacagggtgtgctgggcatcaaggtgaggatcatgctgccctggcacccaactggtaaggttggccctaaggagccctt

SEQ ID NO: 863 - DNA, 206 bp, Homo sapiens
gtccacatgacccttgtggcacagatgcccacgtatgtgaaacacacatggacatgtgtcccagccacagtgttatgctctgtggctggctcacctttgctgagttccggggtgcaatgggggagggagggagggaaagcttcctcctaaatcaagcatctttctgttactgatgttcaataaaagatagttgccaaggctgaaaa

SEQ ID NO: 864 - DNA, 221 bp, Homo sapiens
ctcatcgcagttctccccacggctactccaggtccagtcttgaaatccgtcctctccatggacttcccacatccctctctgctctaggtttgattaacagaaggttgtaaatgaaaaccagcatctccgagggcagccatggtctactgacagatggcaagttactttgtaacctgtaattttgtttttttgaattttgtataaataaacaggctaactaa

SEQ ID NO: 865 - DNA, 90 bp, Homo sapiens
tacacaatggtgctattctgtgtcaaacacctctgtattttttaaaacatcaattgatattaagcatgaaaagattattggaaagtaaaa

SEQ ID NO: 866 - DNA, 380 bp, Homo sapiens
gattaaggaagtccaggagttttacaaggacacctacaacaagctgaaaaccaaggatgagccccagcgggaaacgctgaaagccatccactatgcgttgaactgctgtggtttggctggggggcgtggaacagtttatctcagacatctgccccaagaaggacgtactcgaaaccttcaccgtgaagtgctgtgctgatgccatcaaagaggtcttcgacaataaattccacatcatcggcgcagtgggcatcggcattgccgtggtcatgatatttggcatgatcttcagtatgatcttgtgctgtgctatccgcaggaaccgcgagatggtctagagtcagcttacatccctgagcaggaaagtttacccatgaaga

SEQ ID NO: 867 - DNA, 379 bp, Homo sapiens
acagattcacaatttagaagaccgtttgaagaaatatgaaaagaatgtatatgcaacaactgtggggacaccttacaaaggtggcaatttgtaccatacggatgtctcactctttggagaacctaccgaatttgagtatttgcgaaaagtgctttttgagtatatgatgggtcgtgagactaagaccatggcaaaagttataaccaccgtactgaagttccctgatgatcagactcagagaattttggagagagaagatgctcggctgatgtcatggctccgatcttcatcttgaagaagagtgacattgggtgactgctgcttggaaaactgtccacacttgctactctttgagaatgaagttgtcattcagggccct

SEQ ID NO: 868 - DNA, 105 bp, Homo sapiens
cacccagaggctggcccagtgagggcccgcacaccacccacgtgcctccagacagcgagtgacatcccatctcctcctctgcattaaagatgacctgctgaaaaa

SEQ ID NO: 869 - DNA, 362 bp, Homo sapiens
ctcgtgccgaattcggcacgaggaagaatgttgatggtgctagaagaatttgagaagaaatactcctgtattgagttgtatcgcagtggtgtattttttaaaaaatttgatttagcattcatattttccatcttattcccaattaaaagtatgcagattatttgcccaaagttgtcctcttcttcagattcagcatttgttctttgccagtctcattttcatcttcttccatggttccacagaagctttgtttcttgggcaagcagaaaaattaaattgtacctattttgtatatgtgagatgtttaaataaattgtgaaaaaaatgaaataaagcatgtttggtttcccaaagagaaacaa

SEQ ID NO: 870 - DNA, 368 bp, Homo sapiens
gtgaaaatggttcgctattcacttgacccggagaaccccacgaaatcatgcaaatcaagaggttccaatcttcgtgttcactttaagaacactcgtgaaactgctcaggccatcaagggtatgcatatacgaaaagccacgaagtatctgaaagatgtcactttacagaaacagtgtgtaccattccgacgttacaatggtggagtttgcaggttttcgcaggccaagcaattggggcttggacacaaggtcggtggcccaaaaagagttctgaatttttgctgcacatgcttaaaaacgcagagaggtattctgaacttaagggtttagattagagtctctggtcattgagcatatccaagtgcaca

SEQ ID NO: 871 - DNA, 200 bp, Homo sapiens
ggcagaggcaggaaactaactggtgtgagtcaaatgcccctgagtgactgcccccagcccaggccagaagacctcccttcaggtgccgggcgcaggaactgtgtgtgtcctacacaatggtgctattctgtgtcaaacacctctgtattttttaaaacatcaattgatattaaaaatgaaaagattattggaaagtaaaa

SEQ ID NO: 872 - DNA, 307 bp, Homo sapiens
gagactccatctcaaaaaaaaaaaggaatcggacgaagacccacaggatgttgaagacaactttctgaagtatttttgagggacagcgatgtggccctcttttttaaagaataacgtgtcctgctttggcagagaagaagaaattagccactgcccgttttaaaggaaagatcgacctcttctgttttgttttgttttcctttcttttccctggccatgaggacaaaaattacttgagtggcccttaaaagagggaagtttgtttttcagctgttctcttttgcccgtaggggggagggttgggatt

SEQ ID NO: 873 - DNA, 306 bp, Homo sapiens
atagaataggaagtttctaaaagaaaacaattaagagcaaaattggttttgagtatagaaactgaaggatggcagtcttaactcataagtttttttacagagcacagatgggtaaactagcatgcaccatgttttttgtacatatcatgtgagcatgagacatggttttttacaatttttttaaatggtgaaaaaaagtcaaaaagaagggagggacatttttgtgacacatgaaaacactattaaattaaatttcagtatccaggaaataaagttttattggcacagctgtgctttattgtcttt

SEQ ID NO: 874 - DNA, 180 bp, Homo sapiens
ccggaaacagacaagcaacccaaactgaaccccctcaaaagccaaaaaatgggagacaatttcacatggactttggaaaatatttttttcctttgcattcatctctcaaacttagtttttatctttgaccaaccgaacatgaccaaaaaccaaaagtgcattcaaccttaccaaaaaaaa

SEQ ID NO: 875 - DNA, 192 bp, Homo sapiens
ggaacatcaagattggaagcagaccagttaggaagttatagccatgattcaggtgagaaacatggtagttgagaccaagatggtagttctagaggtggttagaagtagtcacattctgtatatactttaaagatagagcggacacatttttcctggtgaatacgatggggttagtgttaaggagtagagaaa

SEQ ID NO: 876 - DNA, 199 bp, Homo sapiens
cggaaagctatcataatctttgttcccgttcctcaactgaaatctttccagaaaatccaagtccggctagtacgcgaattggagaaaaagttcagtggggagcatttcgtctttatcgctcagaggggaattcttccctaagccaactcggaaaaggccggtccaaaaaataagcaaaagcgtccccggggcccgtcct

SEQ ID NO: 877 - DNA, 317 bp, Homo sapiens
tacactcgcccgcgccatggcctctgtctccgagctcgcctgcatctactcggccctcattctgcacgacgatgaggtgacagtcacgggggataagatcaatgccctcattaaagcagccggtgtaaatgttgagccttttttggcctggcttgtttgcaaaggccctggccaacgtcaacattgggagcctcatctgcaatgtaggggccggtggacctgctccagcagctggtgctgcaccagcaggagggtctgcccccctccactgctgctgctccagctgaggagagaaagtgaagcaagaaagaggatcc

SEQ ID NO: 878 - DNA, 170 bp, Homo sapiens
ctcgtgccgaattcggcacgaggagactttgaggatcccaggattcagtattcctggcccagagggcccttgctggctactgggtgttagtttgcagtcctgtgtgcttccctctcttatgactgtgtccctggttgtcaataaaatatttcctggcctcctggagaaaa

SEQ ID NO: 879 - DNA, 306 bp, Homo sapiens
acacaccacggaaagagaagggttcacgggaagagaagcagaagccccaggctgagcggaaggaggagaaaaaggcggctgcccctgctcctgaggagggagatggatgaatgtaagcaggcgctggctgctgagcccaaggccaaggaccccttcgctcacctgcccaagagtacctttgtgttggatgaatttaagcgcaagtactccaatgaggacacactctctgtggcactgccatatttctgggggcactctgataaggacgggctgggtccctgtggtactcagagtatcgcttccctg

SEQ ID NO: 880 - DNA, 217 bp, Homo sapiens
cagatctgaatgttcagttctagccaaggtagattttactttcaactttttaatcagtatcactttctgtgcttaactatttggtggttaccttgtctgttttcatttgtctaaaattctgcagagatgactaaaatttgacataatgggggtaaatggattgttaagggtaacttcagtagaggattaaagcaagatgccattttccccatgactt

SEQ ID NO: 881 - DNA, 173 bp, Homo sapiens
ctcgtgccgctggaacacccacgctgacttcgccgacgagtgccccaagccagagctgctggccatccgcttcctgaatgctgagaatgcacagaaattcaaaacaaagtttgaagaatgcaggaaagagatcgagagagagaaagaaagggtcaggcaaaatgatcatgccg

SEQ ID NO: 882 - DNA, 187 bp, Homo sapiens
gtttgaatataatgtagaaggagtgacttccaaggaaatggctacccaacttgccttcatgcgcctgctggccaactatgcctctcagaacatcacctaccactgcaagaacagcattgcatacatggatgaggagactgcaacctgaaaaggctgtcattctacagggctcttatgatggtggact

SEQ ID NO: 883 - DNA, 183 bp, Homo sapiens
ccaagatgccgaaaggaaagaaggccaagggaaagaaggtggctccggccccagctgtcgtgaagaagcaggaggctaagaaagtggtgaatcccctgttttgagaaaaaggcctaagaattttggacatggacaagagcaacccgcccaaaagagacctcaccgctttgtgaaatggcccgc

SEQ ID NO: 884 - DNA, 313 bp, Homo sapiens
tttccgtggagctgtcgccatgaaggtcgagctgtgcagttttagcgggtacaagatctaccccggacacgggaggcgctacgccaggaccgacgggaaggttttccagtttcttaatgcgaaatgcgagtcggctttcctttccaagaggaatcctcggcagataaactggactgtcctctacagaaggaagcacaaaaagggacagtcggaagaaattcaaaagaaaagaacccgccgagcagtcaaattccagagggccattactggtgcatctcttgctgatataatggccaagaggaatcagaaacct

SEQ ID NO: 885 - DNA, 197 bp, Homo sapiens
tcagccgctacctatccatcttatggaggacacgcggacctatactaccccattgactttccctatcaggaccttaggactcgtctactttgggactggtgatggccattgtacgactgatggatatctctatctcccgtatcccccatctatacaccctacatcaaggactccccatcagagttgtcccctatttt

SEQ ID NO: 886 - DNA, 335 bp, Homo sapiens
tgtgacccccgccacggccgatacctcaccgtggctgctgtcttccgtggtcggatgtccatgaaggaggtcgatgagcagatgcttaacgtgcagaacaagaacagcagctactttgtggaatggatccccaacaatgtcaagacagccgtctgtgacattccaccttgtgggctcaagatggcagttaactttcattggcaatagcacagccattcaggagctctttcaagcgcatattggagcagttcactctccatatttcccccgcgaagggccttctcccactctgtgacacagagcgcaggggcattggacgcagcatttgagtttta

SEQ ID NO: 887 - DNA, 275 bp, Homo sapiens
aaaaaaccttgtaaaaaaagcaaaaatgacaacagaaaaacaatcttattccgagcattccagtaacttttttgtgtatgtacttagctgtactataagtagttggtttgtatgagatggttaaaaaggccaaagataaaaggtttctttttttttccttttttgtctatgaaggtgctgtttattttttttgggcctgtttgatgtatgggttaaacaatgttgtccaacaattaacaggggattttattttgctgagttgttctaacacaaaa

SEQ ID NO: 888 - DNA, 317 bp, Homo sapiens
ctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatcccacaagattttttaggcacatattaattacctgaactcgaaaaccattatgggcattcaagtgtgggcactctagttttgccccatagccacgtgacgtgat

SEQ ID NO: 889 - DNA, 399 bp, Homo sapiens
cggcacgagcccctgtgtgtggggatgaatgcttcaaggttgctgtcaggaaattcttaatctttgaatttgtatcttataagtcaagtccaatggaatgtccatgagagggctgggctttggattgcacacagtcctgccacctcccagcgtccctgtgcggttctcaccttctggccccccggcatcttaggccctgccagacctccctatcttcctcctacgtagagacttctactgccctctaccgcggaagagacatgggtgtgagcacgggagggtttggggtcaagtgcacactccctgggtatcttgggattggagcgtggtggtaccagcccagtctgggctggcaacactgctgtttgttcaccaggcgacttagttgggggtaagcct

SEQ ID NO: 890 - DNA, 124 bp, Homo sapiens
aaaaactcgaggactgtatttgtgactaattgtataacaggttattttagtttctgttctgtggaaagtgtaaagcattccaacaaagggttttaatgtagattttttttttgcaccccatgct

SEQ ID NO: 891 - DNA, 322 bp, Homo sapiens
ctcgtgccgaattcggcacgagtgaaattttactgccaatttttcaaaatacctgcttttgatgagtacagttacagtcaaatactgtagttagacaaattcttttttaatggtatattaatgttgcataccaaattgtatgagttaaacgtctcttcctgtgcagtttcatattagtggtgttttcagtgtaggtatcttaatatcaacttatcgtgggttttgggtatgtaatataattttagctcaatttgcaattctgtctgtatactttatgtcaatgtgaggttggaattaaaaggtagccctatgtcttaaaaaa

SEQ ID NO: 892 - DNA, 403 bp, Homo sapiens
gttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatcttgggcgcctggctcacgaggttggctggaagtaccaggcagtgacagccaccctggaggagaagaggaaagagaaagccaagatccactaccggaggaagaacagctcatgaggctacggaaacaggccgagaagaacgttg

SEQ ID NO: 893 - DNA, 255 bp, Homo sapiens
gtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaaaaaaa

SEQ ID NO: 894 - DNA, 305 bp, Homo sapiens
ctttggcaggatgtctggggcctcaccagcaggagcgcgtgcaagccgggcaggcggtccacctagacccacagcccctcgggagcaccccacctctgtgtgtgatgtagctttctctccctcagcctgcaagggtccgatttgccatcgaaaaagacaacctctacttttttcttttgtattttgataaacactgaagctggagctgttaaatttatcttgggggaacctcagaacttggtctattttggtgtcgtggaacctcttactgctttcaatacacgattaggtaatcaactgttttg

SEQ ID NO: 895 - DNA, 179 bp, Homo sapiens
gctacctgacccccgacctctggaaggagactgtattcaccaagtctccctatcaggagttcactgaccacctcgtcaagacccacaccagagtctccgtgcagcggactcaggctccagctgtggctacaacataggggttttatacaagaaaaataaagtgaattaagcgtgaaaaa

SEQ ID NO: 896 - DNA, 123 bp, Homo sapiens
caacctgaaaaaggctgtcattctacagggctctaatgatgttgaccttgttgctgagggcaccagcaggttcacttacactgtttcttgtggatggctgctctaaaaggacaaatgatgggg

SEQ ID NO: 897 - DNA, 265 bp, Homo sapiens
gaattcggcacgaggggaagttcagcttaatgtttaagaaaataagttttaactctatgaagattcctttaaaaactaaaggtagatctaccatttgatccagcaatcccactactggatctaccagaggaaaagaagtcattatatgagaaagacgccttcacattcacgtttgtagcagcaccattcacatttgcaaagcatggacccaccccaaatcccataatcaacaggtggataagaaacatggtatgtatataccaga

SEQ ID NO: 898 - DNA, 238 bp, Homo sapiens
tgctgacccagtttcctcccattgtggagggtctgcaggaatagcagtggtggctgcttgatttccctgtcgacagactgatcagccggtgtttctgcttggcttaaagtactctatgccctgtttttgagttgagagatgtcagtacctaaaggctttacactaagatggaatatgagaggagagtttagtcccctcctaatggttgtaaggaggtcagggcggacatttccttcag

SEQ ID NO: 899 - DNA, 100 bp, Homo sapiens
ctttacaaaaaacatatatgagtgtttgtgatgacatttattcctacatttgatttattgcttggttgattgcagagtatttgagcagactagtgactca

SEQ ID NO: 900 - DNA, 255 bp, Homo sapiens
cgtgggtgtatctgtaagagtaggatctgttaggattagtcataagactgtcagtaatcctgaagatggatgagataatccaggcccaggttcccaggggagggaaaatggagaaaatataaaagatgtgaaaaggaaaaggaaggtaataacaacaccaaagtgataatgatagttaaggaggttgctgacagggattatattagttacatacatactccttaacagttaatacattacaccttcaaaaaaaaa

SEQ ID NO: 901 - DNA, 354 bp, Homo sapiens
gccaaaatgaagtttaatccctttgtgacttccgaccgaaggaagaatcgcaaaaggcatttcaatgcaccttcccacattcgaaggaagattatgtcttcccctctttccaaagagctggagacagaagtacaacgtgcgatccatgcccatcccaaagatgaatgaagttcaggttgtacgtggacactataaaggtcagcaaattggcaaagtagtccaggtttacaggaaggaatatgttatctacattgaacgggtccagcgggaaaaggctaatggcacacctgtccacgtggcattcaccccaccaggtggttatcactaggctaaactggacaaagcccccaaaag

SEQ ID NO: 902 - DNA, 199 bp, Homo sapiens
aagccatgagcagcaaagtctctcgcgacaccctgtacgaggcggtgcgggaagtcctgcacgggaaccagcgcaagcccgccaagttcctggcctaagacggtggagttgcagatcagcttaaggaactatgatccccagaagggacaaggcgcttcttcgggcaccgtcagcttaagtcactcccggcctaagttct

SEQ ID NO: 903 - DNA, 277 bp, Homo sapiens
aagcattctaccacagttctattttgactcccacttgtaataactcctttaaaaaattccatgtttaaccatatgaccctgcttgcttactcatattctccctccctctcccttcctttctctctcttccagaagtcatttgcctggtttgaaatattttgtagggattgcttattatattatttgagctgatgacctcaggacaatgtctacacacacacacatacatacacgcacacaaattctcagctgttggaggagtgggcttgggattcag

SEQ ID NO: 904 - DNA, 282 bp, Homo sapiens
tccatttcagctatggagatgacaatctggctcccaacactgccaacgtccagatgaccttcctacgcctgctgtccacggaaggctcccagaacatcacctaccactgcaagaccagcattgcctatctggacgagcagctggcaacctcaagaaggccctcctcatccagggctccaatgacgtggagatccgggcagagggcaattagcaggttcacgtacacttgcccttaaggatggctccacgaacataccggtaagtgggcaagtcttgttatcg

SEQ ID NO: 905 - DNA, 131 bp, Homo sapiens
cccaggcaccagggcgtcgattggtgggcatgggtcagaaggattcctatgtgggcgacgaggcccagagcaagagaggcatccttcacccttaagtaccccatcgagcacggcatcgtaaccaactggga

SEQ ID NO: 906 - DNA, 227 bp, Homo sapiens
gaaaaacatagccaagattgttttcctgagacacttagagaagaaagtgttttaaatgctatttttaaaaagcagtagtaagacctcatatacaggttgcgactttttactcattggatatggataaacctccaccatccccctctctcaactacttgcccccgaccttggatagttggcttgcttggaagcctacttgaattatccaaacatagttattagaaaaa

SEQ ID NO: 907 - DNA, 123 bp, Homo sapiens
gagagagaagagagaactagtctcgagtttagtttttgttttgttttgtttgagacagggtctaactttctgcactccagcctgggcgacaaagcaagactccgtctcaaaaaaaaaaaaaaa

SEQ ID NO: 908 - DNA, 304 bp, Homo sapiens
aaagaatagatgagctggctattctcagttttgtcctaagccacatgtacttagagaggtgatatagtctttgacatccaacgcagttatttatttatagtatgttatttagtcatagtatgagcttgtatatgttattgaatgccatcaaagaaatttgacataacagatacacatctttgttttgagggggaaaagggaataaatagtcaacacttatcacagtgcttggcaattattagtgttcaataatgctggcattacagtgtgctttgtaatagctgctgctttcatttgacaactc

SEQ ID NO: 909 - DNA, 263 bp, Homo sapiens
tcttctcaggggctctagggactgccaggctgtttcagccaggaaggccaaaatcaagagtgagatgtagaaagttgtaaaatagaaaaagtggagttggtgaatcggttgttctttcctcacatttggatgattgtcataaggtttttagcatgttcctccttttcttcaccctccccttttttctctattaatcaagggaacttcaaaggtaatgggatggtcggactcacaggctgagacctcgttcaccccaagcattt

SEQ ID NO: 910 - DNA, 171 bp, Homo sapiens
ccaggtgggaggttagtgtggcccgggcgtccgctcctcagcggatgtggcagccccgagccatggctctcgccgtccgagtcgtttattgtggcgcttgaggctacaagtccaagtattcttcagctcaagaagaagttagaagatgagttccccggccgcctggaacaa

SEQ ID NO: 911 - DNA, 194 bp, Homo sapiens
gtccttttagccttttttaaaaactccatttatattacatttgtaaccatggatactttaatcagaagcttagccttggaaattgtggactcttggagatgttattagtgaaggttcggcacctaaactaaacctgtaaattatgatgatggtattcaaagattatggaaattaacattctggcccctgaaaaa

SEQ ID NO: 912 - DNA, 192 bp, Homo sapiens
atgcgctacttaatggaagaagatgaagatgcttacaagaaacagttctctcaatacataagacagcgtaactccagacatgatggaggagatgtataagaaagctcatgctgctatacgagagatccagtctattgaaaagaagcccaagaagaagttaaaaggagaggttgaccgtcccaaaatgccctg

SEQ ID NO: 913 - DNA, 184 bp, Homo sapiens
ttggactcagcttccatcattgccacagacccgacatgtaaggaccaggggggcctagcttgggcggtggctgaaggaatacaagtcagaaaatgaggaagactttgtggctaggaagaaagacctttccagcctgggcaacaatagtgagacccaatctttaaaaaaaaatttaaaaatttag

SEQ ID NO: 914 - DNA, 157 bp, Homo sapiens
caaaaagatgactgagaagactgttaaagcaaaaagctctgttcctgcctcagatgatgcctatccagaaataggaaaattctttcccttcaatcctctagactttgaggagttttgaaccctgccctaagggcaccagattgcgaaccttcccctt

SEQ ID NO: 915 - DNA, 176 bp, Homo sapiens
ccaggcagggcgatgtctgccatccgtggccatttgcaaagaccccaaagacccctgttctggttccctcttctcccccatgaatatcctcttcacacacatgtacatgcgaaccacacacaacacgcaactcgtgagacccgggacctccccaggacccccagtttcctggtttg

SEQ ID NO: 916 - DNA, 186 bp, Homo sapiens
ctgtagtaagaagagattcaggatgctagaggtgaatatttgggtcatttacatgtacactacatagcaagttgatactcatgttgcatgttcttttaaattagtaattttgtgtcttaggtctttaacttccaatactccatcatgtatgtacccttcccatgtttgcttctgataatgggaaat

SEQ ID NO: 917 - DNA, 217 bp, Homo sapiens
acaagcgcgtgtgcaaggagatcgccattatccccagcaaaaagctccgcaacaagatagcaggttatgtcacgcatctgatgaggcgaattcagagaggcccagtaagaggtatctccatcaagctgcaggaggaggagagagaaaggggagacattattggttcctgaggtctcaccttggatcaggagattattgaggagtcctcacataagga

SEQ ID NO: 918 - DNA, 153 bp, Homo sapiens
cgcctatttaaaggttcgtttggttcaaccgtttaaagctcctacgttgatcctgaggttcagaccggagtattccaggttcgggttcctatcctacttctaaattccttccttgtaccgaaaggccaagagaaattaaggcctacttacaaa

SEQ ID NO: 919 - DNA, 184 bp, Homo sapiens
ctcgtccgaatttcggcacggccgggcctttcagcctaggaggagctcaagggtcggccgcaattcacaggagggtggcccggaccatcggcatttctgttggatccgaggaggcggaccaccgttccaacttatcctttcccaggaggccctggcccccaagagggagcaagtcttcttgagg

SEQ ID NO: 920 - DNA, 246 bp, Homo sapiens
gcattgcctatctggacgaagcagctggcaacctcaagaaggccctgctcatccagggctccaatgacgtggagatccgggcagagggcaatagcaggttcacgtacactgccctcaaggatggctgcacgaacataccggtaagtggggcaagactgttaatcgagtaccggtacagaagacctacgcctcccatcatgacattgcacccatggacaaggagggcccagcaggattcgggtttgg

SEQ ID NO: 921 - DNA, 268 bp, Homo sapiens
ccagagcaaaactgttgtgccttctatttatctttgatttcagtcttggcaattgtttaaaaaaaaaatctaggatttgttttattaggttcagagtatgtggggaattatagaatccctctttcatcactttgtgtatgtctttgttaacatattgttatgcctaatctaaaattgagtctcaactggaatgcctttaagacagatgcttctttagaggtctttgacctaaataggttcagcatttgattttattccggtacaatca

SEQ ID NO: 922 - DNA, 251 bp, Homo sapiens
ggctgacctgacctgatgtccattcatcccaccctctcacagttcggacttttctcccctctctttctaagagacctgaactgggcagactgcaaaataaactctcgggtgttctatttatttattgtcttcctgtaagaccttcgggtcaaggcagaggcaggaaactacctggtgtgagtaaatgccccctgagtacttcccccagcccaggcagagacctccttcagtgccggcgcaggacttttttt

SEQ ID NO: 923 - DNA, 271 bp, Homo sapiens
ttaaaccgaagtaaatttaaaagaccttgaaatccatgacgcagggagaattgcgtcatttaaagcctagttaacgcatttactaaacgcagacgaaaatggaaagattaattgggagtggtaggatgaaacaatttggagaagatagaagtttgaagtggaaaactggaagacagagtacgggaaggcgaagaaagatagaggaagatagggaattaggagataaaacatacttttggaggaaaagttaatttcacctcaaagtaggaaa

SEQ ID NO: 924 - DNA, 140 bp, Homo sapiens
gctgaggcaacttctcctagaatctcaatctcagctcgatgccgccaagagcgaagccagaaacagagcgatgagcttgccctggtcaggcagcagttgagtgaatgaagagccacgtagaggatggtgacatagcttgg

SEQ ID NO: 925 - DNA, 139 bp, Homo sapiens
ctggtaggatggtcctcttgtacttcgtgtgctccgacccatggtgacgatgacacaccctggtggcatgcccgtgtatgttggtttagcgttgtctgcattgttctagagtgaacaggtgtcaaggctgtcaactgtt

SEQ ID NO: 926 - DNA, 141 bp, Homo sapiens
atggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcctt

SEQ ID NO: 927 - DNA, 142 bp, Homo sapiens
cttgcaccagcccttgtgggactcccaacacaaggacaaagctcaggatgctggtgatgctaggaggatgtccctcccctcactgccccacattctcccagtggctctaccagccttaacccattcaaaccagttaaatttt

SEQ ID NO: 928 - DNA, 152 bp, Homo sapiens
atggatgaagtgccttcccattatgctgtaccctgggcagagtggacagttacgacccttggttcgagcccagggtcagcttcgggcactcttgggttaccaagcaaagtgacaaatggtccatgagcggaaggttaggcaccttaaggcag

SEQ ID NO: 929 - DNA, 189 bp, Homo sapiens
ggcatggcagcatcttcctgacggtcaccttagggcggctggcgtcgcgtgcagcacagcattctgagaccttcggggccggagcagacttcctttggtctgcttctcgaaggttcaattcacagagcacttcatatctaccacgggtatgttcctaaaacatccctgagttcaccaccttggccagaa

SEQ ID NO: 930 - DNA, 201 bp, Homo sapiens
gccatccagactgaggaagacccggaaacttaggggccacgtgagccacggccacggcccaataggaagcaccggaagcaccccggcggccgcggtaatgctggtgggctgcatcaccaccgaatcaacttcgacaaataccacccggctactttgggaaagttggtattgagcctttaccctttaagagggaccagactt

SEQ ID NO: 931 - DNA, 151 bp, Homo sapiens
ctcgtccaatttcggcacggttaaaaaccctgtcctacacataccattctcaagcaccggctcctagggtaatcaatcatgggcatactgctaatgcctctgattccagctcatatggaggaatatgtttactctctttgctaaagtgaag

SEQ ID NO: 932 - DNA, 152 bp, Homo sapiens
gtgcgatgtttcaggaggcttggaggaagggggtttccagttggagagggacaccccactgagaaggtcaaacaatttcaaagtttgggattgtatcaggtggcatggtcctggtcaccaatttataatgtaagtagagattttacaatagg

SEQ ID NO: 933 - DNA, 232 bp, Homo sapiens
aaaacatggagttgttcctttggccacatatattccgaatctataagaagggtgatattgtagacatcaagggaattgggtcctgttcaaaaagggatggccccacaggtgttaccatggcaaactggaggagtctacactgttacccagcatgctgttggcattgttggtaacaaccaggttagggcagatcctgccagggattatgtcgtatggcccattagcactctag

SEQ ID NO: 934 - DNA, 246 bp, Homo sapiens
taaagaaggccctgaaagctgaatgggggtcaaaatgaaaggtgaattcaaggctgaaggaaatagcaaattcaactacacagttctggaggatggttgcacgaaacacactgggggaatggagcaaaacagtctttgaatatcgcacacgcaaggctgttagactacctattgtagatattgcaccctatgacaatggtggtcctcatcaagaatttggtgtggcgttggccctctttgcttttt

SEQ ID NO: 935 - DNA, 171 bp, Homo sapiens
agttggggcgcccagctgccaacaccaagattggcccccgccgcatccacacaggtccgtgtgcggggaggtaacaggaaataccgtgccctaggttgggacgtggggaatttctcctggggctcagagtgttgtactcgtaaacaaggagtcatcgatgttgtctacaat

SEQ ID NO: 936 - DNA, 316 bp, Homo sapiens
tttcttacaactatttgtctctgaatagttttctcttaaaatttgacaaatattaaaaacattgtccttccttctttggttacagtggagtctcttctgttttgccaggaaagttaacatattttttcttcatttttgttcatcatttataaattagatggtatagattttagcaaatagatctcaagagctggattcaattagcagctttttaggacataaacattaaagggttagatggaaaagattgttttgactgacttgataaatgacaggctgtgtttgatgtccgccaggattggctggagctggtccc

SEQ ID NO: 937 - DNA, 297 bp, Homo sapiens
ctcgtccaatttcggcacggaaaaaacgttgaattgatgatgcagttttcatatatcgagatgttcgctcgtccagtactgttggttaaatgacaattttatgtggattttgcatgtaatacacagtgagacacagtaattttatctaaattacagtgcagtttagttaatctattaatactgactcagtgtctgcctttaaatataaatgatatgttgaaacttaggaggcaaatgctacatatatgcaatataaagtggtaatgtgatgctgatgctgtaaccaagggcagataa

SEQ ID NO: 938 - DNA, 318 bp, Homo sapiens
gccacatctgccagagcctggagtctgcgaaggccgggacccggttccccggcccacagtgggggtgtgcaacccgagagactgggttgcaaattcgtgaagaatcagcatcatgtttggcagctgagtattggagccaggagcctcccatgaggttttgagaacagagtgctgtttgagagctggcagcagcatctcagcccaagagaagtgtatattccagaggatgtcagtccaaggaccagtagctgccatagtttggattctgaaactaactggcatcaacactggggtagaacatgctttccttatgtatca

SEQ ID NO: 939 - DNA, 405 bp, Homo sapiens
gaaatttgaaaaaactttctctttgccatttcttcttcttcttttttaactgaaagctgaatccttccatttcttctgcacatctacttgcttaaattgtgggcaaaagagaaaaagaaggattgctcagagcattgtgcaatacagtttcattaactccttccccgctcccccaaaaatttgagtttgtttttcaacactcttacacctgttatggaaaatgtcaacctttgtgaggaacccaaattaaagttgagaaatataaacccttaacatttgcaccacttgtggcttttgagtatcttcacagaggggaggtttaaaccccaacttccaagggtttaactacctcagacactttcccatgggtgtgatcccaatgttaggtgctgcctcgcagagatg

SEQ ID NO: 940 - DNA, 406 bp, Homo sapiens
ctcgtgccgaattcggcacgagctcatccagggctccaatgacgtggagatccgggcagagggcaatagcaggttcacgtacactgccctgaaggatggctgcacgaaacataccggtaagttgggcaagactgttatcgagtaccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaagggcccaagtactttccaatctcagtcactctagggctctgcactgaatggctgacctgacctgatgtcattcatccaccctctcacagtttggcttttctccctctcttt

SEQ ID NO: 941 - DNA, 405 bp, Homo sapiens
gtctgaggttatcaataagctcctagtccagacgccatgggtcatttcacagaggaggacaaggctactatcacaagcctgtggggcaaggtgaatgtggaagatgctggaggagaaaccctgggaaggctcctggttgtctacccatggacccagaggttctttgacagcttttgcaacctgtcctctgcctctgccatcatgggcaaccccaaagtcaaggcacatggcaagaaggtgctgacttccttgggagatgccataaagcacctgatgatctcaagggcacctttgcccagctgagtgaacttcactgtgacaagctgcatgtggatcctgagaacttcaagctcctgggaaatgtgctggtgacccgttttggcaatccatttcgggcaagaatta

SEQ ID NO: 942 - DNA, 409 bp, Homo sapiens
ttcagacacactcccttctgccttccggcttaaagctgtggatgatccacgtttttgtttttttaatgttaaatgtgtaactcagtattactgaaaaggtacccacattttgaatagtagttatcactcttaggtcagacagccatcagaattctcccacaccaagtgcatgtcagttgttgagaaaacatagcaaaaagagccgtacgctctttacagatactaatgtcaagagttaaacctcctcaggttcaacctgtgataaaagactagtgcttcccagtacttgcatgggggttcactatttataggtttcttgggagtatcacagggaaatcacaattacaccactttaggccctatgtgtagcaggtcacaacttacccttgtgtgtttagatgtgtatgaa

SEQ ID NO: 943 - DNA, 185 bp, Homo sapiens
taacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaaaa

SEQ ID NO: 944 - DNA, 346 bp, Homo sapiens
ggaattcctgggagccccgagccggaacacggttctgtccaggagagccaggtatcggagcagccggccacggaagcagcaggagagaaccccctggagttcctgcgggaccagccccagttccagaacatgcggcaggtgattcagcagaaccctgcgctgctgcccgccctgctccagcagctgggccaggagaaccctcagcttttacagcaaatcagccggcaccaggagcagttcatccaggatgctgaacgagcccccttgggagcttgcggacatctcagatgttgagggggaggttggcgccattaggagaagggggcccccagattgaacttcattc

SEQ ID NO: 945 - DNA, 340 bp, Homo sapiens
agttggctatgccttttcagacattgatttggacagctcaccaacccctgaaggggccgttcagcctggttagttttctacctactccgagtgtcctcccctgccccaccagattgctgcaggggcgcggtgtgcctggcagccaaattgttgacacttcttttttcctatgcactggttttacacagctgtcatttttctttcaaaattgcagcagttccacagatgtgtgcatttggacaaatagtacttaaaaccaaaccaaccaggcacttagcccagctcctcaatactacctggaaaagcattggcattattttcaataatatcacagcactta

SEQ ID NO: 946 - DNA, 371 bp, Homo sapiens
ctgcatggttgggagtcctgggtggaggggcctttgtgaggctggacccggctcagggcaggtggaggagctgggcctcccacagggtgcccgggcagtgccatcctggtgggggagggcagccttcaaacgtgtggggtctacagtcctcaggtctaggcagggctgccggttctccacctccccattccgccccagggcccctgcctgtgcctgccttgcaaccccctctgcttgggcacggtgtctcttgcattgcctgcctttttgccttcacctcttttctgccccgcccctgcacatttggggtttcagcccccaggcttgacagctccttgggggcaggcctcaataaatgtgaacctgctaaa

SEQ ID NO: 947 - DNA, 387 bp, Homo sapiens
cttctgaagaccgaggaggcaaaggccgagggggcccaggacctgctcagagagtgcccaaatctgggcgttccagctccttagacggagagcaccacgatggataccacagagatgaaccttttgggggccctccaggcagtggcaacccttctcgagggggccggagtggcagtaactggggtagagggagtaacatgaactctggcccgccgaggcgaggagcttcacggggtggtggaaggggtcggtagaagcttggactgagtaccctgaggcctctctggacaatatgtaagagactcttgtgggctcaccaagagaaacaaaaggaggctgcaccatgttagccctgaaatctttttcgggcactgaatcccaggacct

SEQ ID NO: 948 - DNA, 333 bp, Homo sapiens
ggctgactgactgatgtccattcatcccaccctctcacagttcggacttttctcccctctctttctaagagacctgaactgggcagactgcaaaataaaatctcggtgttctatttatttattgtcttcctgtaagaccttcgggtcaaggcagaggcaggaaactaactggtgtgagtcaaatgccccctgagtgactgcccccagcccaggccagaagacctcccttcaggtgccgggcgcaggaactgtgtgtgtcctacacaatggtgctattctgtgtcaaacacctctgtattttttaaaccatcaattgatattaaaaatgaaaga

SEQ ID NO: 949 - DNA, 329 bp, Homo sapiens
gcagcctcagcggctctgagtctcccagcctcgaccctggccgccgcctgccaatcttcagccgcctctccatctccgacgactgaggcaagagggcgccagtgaggaggaagggaaggcggttcagagatgttggaggacacccctcgccatctcgcccttgctgggggcacgggagtggggggggtgacatggggccctaggcagactgcaagcccgaccgagcacttggactcgaactctgtgccgggaggggccccacccctcctttttcggtttcctctggtcttttttttcaatttctattacgaggttcattcttttcgagc

SEQ ID NO: 950 - DNA, 244 bp, Homo sapiens
ccgtattgacaccataatggtgcaataaatacggcacagaggcaggaactgtgtttctttcctcaatgccgtatttattgcaccattattgtgtcaatacggtgaccaataaggccagttatggccgaatgaataaattgacactctgaactcaaactttggtcggtattagggccatttatattgccatatgagtccaattaggcagtcacttatttccaaacttggtccgaattcggcacgg

SEQ ID NO: 951 - DNA, 260 bp, Homo sapiens
cggcacgagccagatagtaagacagctgagttttcctcagttttctcgtcttaacactagtggacaattctagcattttgtttggaggatttcagagttaacctcatggaattcaggattttttagcaagtttgcttttgggtttatctttgcttttagtaatcatgtgtggctgtgtcttgtcacacagtgtactttgaaacagagtgtcccttgtctctgcgcttcactcactctcaggggtcatgtaagtgctcatc

SEQ ID NO: 952 - DNA, 227 bp, Homo sapiens
acagtgcacaggctagcctggagctcaccaggcctggggagctgggacggggccccgctgccggacctgcagcccttggacaaatggggaacaatttgccttcctgaacgggaattgcaggggaggaggctgatgctttaaatgaagaggatgtgttgggtttggaggtataaccctgctcctctctcccagatctgtgtcaatataaggtcgtgtaagatctctca

SEQ ID NO: 953 - DNA, 272 bp, Homo sapiens
gttgctgaactgcagggtcaaattcgtgtttgatttaaacaacttcaggagacctatttaataaatctttcttaaatctttattatgcctaaagtagtatactgaagttagaattgttatacaatgtgagatagcatgaaatataaaacaaaggatacagggaaggtttcaattttcatatagccttttccaaaaactgaattagcattcctatcttttagagttagcaagtaagtattttatttaaacccaggggccaaagcccctaatat

SEQ ID NO: 954 - DNA, 252 bp, Homo sapiens
gtttgccgagaggtctgtggcaaagttggagaaaaccatcgatgacctagaagatgaagtctatgcccagaagatgaagtacaaggccattagcgaggaactggacaacggactcaatgacatcaccttcctctgagcccacaacagcgtggccacctcagctctcttctctccctctcctttccattctctctatatgggagagggagcacagcacagagggagccgagattttccacacattttacacac

SEQ ID NO: 955 - DNA, 156 bp, Homo sapiens
ggaaggagactgtattcaccaagtctccctatcaggagttcactgaccacctcgtcaagacccacaccagagtctccgtgcagcggactcaggctccagctgtggctacaacatagggtttttataccaggaaaataaagttgaattaagcgtaaa

SEQ ID NO: 956 - DNA, 253 bp, Homo sapiens
gcctgactacttcatctgcaaaatggagacgataataatatctatttcatatagctgtcaggagaatgaaaaaatatatgtaagtacttaggtcaatacaaataaagggctaaataaatttggctactgttgttagggacttagtcatggtttttagagccattaaatcaaatgtcattgattggtgttaaaaggcccgtttgtacaatctgtgggattaaaatcactatgtgagtagggccctataattgtt

SEQ ID NO: 957 - DNA, 252 bp, Homo sapiens
ccgggatgtggggtgtggtgtgtgccctcatagatgggggtgggagtgtggctggtgtgtgtgtcaaaccctcactcacccacgcactcacacacagcattctgttctccatgcaaagttaagatcgaatccatccccttgtagggggaaaaaagggaaaaattaacccgaggagggtctgtaatctcgcaggccacagacagatccgttcccttctctgtggcattccccctcaggtctatatagagtgtt

SEQ ID NO: 958 - DNA, 391 bp, Homo sapiens
tttccctttatgtatatattttaacaatccgcttggacacgaacaaagccacacttctaactgcttctggcgaactgattttatttttaatttttttcaataaagatattcttagatactgaaagaaatagttaatgagtttgcatttgtgcttgagaaaatttggctcaagtccatttggctgtagtgtcaacgatgtttccagtagtgtttagatttggtgtcttcaaaggtagttgattaaaaccaagtgtgtcttaaatatcttggtatcagaataactttgtatgttaccaacttaaattgctagaataaggtaaattgatacacaactgctatttttaatttagactttgacctaatttgggtttcaaaaccattttggctactg

SEQ ID NO: 959 - DNA, 601 bp, Homo sapiens
cagaattcccctttccctcaaagaagaaggatctttccctggaggaaattcagaagaaattagaagctgcagaagaaagacgcaagtcccatgaagctgaggtcttgaagcagctggctgagaaacgagagcacgagaaagaagtgcttcagaaggcaatagaagagaacaacaacttcagtaaaatggcagaagagaaactgacccacaaaatggaagctaataaagagaaccgagaggcacaaatggctgccaaactggaacgtttgcgagagaaggataagcacattgaagaagtgcggaagaacaaagaatccaaagaccctgctgacgagactgaagctgactaatttgttctgagaactgactttctccccatccccttcctaaatatccaaagactgtactggccagtgtcattttattttttccctcctgacaaatattttagaagctaatgtaggactgtataggtagatccagatccagactgtaagatgttgttttaggggctaaaggggagaaactgaaagtgttttactctttttctaaagtgtttgggctttctaatgtaggctattttccttgttgcatcttttct

SEQ ID NO: 960 - DNA, 577 bp, Homo sapiens
ctcgatttttaagaggtatttaactctttacttgcactgagaatggcaaatctccctgttctatcacccgcctgtccactgggctcaccgtatctgtacaacgcttggcttcctgtctcactgcagctgtgtgcctgtctcccctgactttggggtctgtgtgggtcaggcggtcccttccagctctcggccacaggtactgtctcttcaagagtgttctaacactgctgctccaccgaaaacattcaagtccttcatccctctggactccgccatggtcaggcgtgggagcagcactccaagcccctcctctcactcgtggagcacaaggtgtgcggcacattcatgacagaaaggccctccagttactgcgacagccaacctttgtaacatgcgaaatccccatgggtgccgggctatctgccccgacaccaacagcacccttatgcagtttggggggttcccatggctcatagtggggcacactcccacccgcaacacttagcatcatgatggcggccttcatcaggacgtccacactgcaaggacattggcaccaccttacccaaccgtgtgt

SEQ ID NO: 961 - DNA, 453 bp, Homo sapiens
caactttctgtgaacacccagtctgcgtcctgggtctgctaggttcgatgatggcgaactcgtatctgcatccggtgcaagttttagctggcagaggtgagaccggtggtgctggtctgcctttgccaactatagccagtctggagacttgataaaatacttcagtgagaccagcttctcatcaacttgggcccggcgtgctgggcctgaaagtcacactacatgcactgcctttgggagtcagctcactccctgctcccacctggaaccttgccagcgtgaaggaggcttccaggtacttcaccctgtcaaccacctctgaatccccaccaggcgccttcctgggtggattcaacaagatgattttgccctttcccagttctctccttcactttcgcatcagttgttttctatgaaaacagtggattggttgggttttgtgcagggtcttgg

SEQ ID NO: 962 - DNA, 404 bp, Homo sapiens
gaagtttgctgcttagagttggaagtgcagcaggcaggtgatcatgctgcaagttctttctggacctctggcaaagggagtggtcagtgaaggccatcgttaccttgggatctgccaggctggggtgttttcggtatctgctgttcacagctctccactgtaatccgaatactttgccagtgcactaatctctttggagataaaattcattagtgtgttactaaatgttaattttcttttgcggaaaatacagtaccgtgtctgaattaattattaatatttatgctacttcattccttaactctccctcatttgctttgcccacagcctattcagttcctttgtttggcaggattctgcaaaatgtgtctcacccactactgagattgttcagcccccgatgt

SEQ ID NO: 963 - DNA, 403 bp, Homo sapiens
ctccgtctcaaaaaaaataaaaataaaaataaaaagtaaaacaggtaaaattaattgtaatatgtcttatttaacccaatgtatttaaaatattattttaatatgtaattaatatagaaattatcaagataattaagatatattttccttttctactaagtctttgaaagcttactccacatctcaattgggactagccacatttcgagtactcattagctacatatggctagtggctaccatattaacacaggtgtaggtcaccaacgtcttaacaaaggagtccacttgctgcagggaccagagatggaacatcacttgctaattttctcattagggatcacatctccatgactgtctgagtgacctttggggagtatggattatgactgagtggctcacc

SEQ ID NO: 964 - DNA, 305 bp, Homo sapiens
ccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacagtctgctcctttttttttgtccgccacacgtaacttagatgctcctttaaataaagcgtttgtgtttcaaa

SEQ ID NO: 965 - DNA, 404 bp, Homo sapiens
ccgccaccaaaatgcagattttcgtgaaaacccttacggggaagaccatcaccctcgaggttgaaccctcggatacgatagaaaatgtaaaggccaagatccaggataaggaaggaattcctcctgatcagcagagactgatctttgctggcaagcagctggaagatggacgtactttgtctgactacaatattcaaaaggagtctactcttcatcttgtgttgagacttcgtggtggtgctaagaaaaggaagaagaagtcttacaccactcccaagaagaataagcacaagagaaagaaggttaagctggctgtcctgaaatattataaggtggatgagaatggcaaaattagtcgccttcgtcgagagtgcccttctgatgaatgtggtgctggggtgttt

SEQ ID NO: 966 - DNA, 367 bp, Homo sapiens
cgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatgggcacaactgtccacgtaggcattcaccccagcaaggtggttatcactaggctaaaacttggacaaagaccgcaaaaag

SEQ ID NO: 967 - DNA, 261 bp, Homo sapiens
ggggaacgcagcgttctccaggagggggacccggctctccttctgcagtgcaggcgaaggcctagatgccagtgtgacctcccacaaggcgtggcttccagactccccggccggaagtgatgcttttttgccttgggccctgggtttgaagcagcctggctttctcttggtaagtggctggtgtcttagcagctgcaatctgagctcagccacctacacaccaccgtggccgacactttcattaaaaagtttcctgagaaa

SEQ ID NO: 968 - DNA, 324 bp, Homo sapiens
tgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtgccctgttttgtgttgtgtctcttgggtggggttgttttgggg

SEQ ID NO: 969 - DNA, 381 bp, Homo sapiens
cgcggactggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcttagaatacaggtcaacccacagaacaaagcggatttccaaggcatctccccagagcgagcctttgctggattttctctttgccagcaccatcctgcaccttgttgtcatgaacttggttgggctgactcattctca

SEQ ID NO: 970 - DNA, 351 bp, Homo sapiens
ctcgtgccgaattcggcacgaggccgggtcagccctgacaaaggtcagctagccccttgaggacatcagctttggcctcaggtccctaatggcagcagaaccactgacagagctagaggagtccattgagaccgtggtcaccaccttcttcacctttgcaaggcaggagggccggaaggatagcctcagcgtcaacgagttcacagagctggttacccagcagttgccccatctgctcaaggatgtggsctctcttgatgagaagatgaagagcttggatgtgaatcaggactcggagctcaagttgcaatgagtactggagcttgattggggagtggccaggaactcagg

SEQ ID NO: 971 - DNA, 280 bp, Homo sapiens
tttcccatttgaataatcgtacctctttatattaacaaactttatggtgatattttcaaattctttctatatcacttcttaactggccacaaatgtttgtaatacttgagtgtcttctctgagtttcaaaatgacttgctcagatagggacctcacattatttttccatttctgattcctccctttccccaacttttaccaaaggataccacatgcgttggtaaattcagcctattttcatcattaaaaaaaaaaaaaaaccctcggggactttctggag

SEQ ID NO: 972 - DNA, 390 bp, Homo sapiens
ggaaggaaaggaagagaaacgggcgggtggcctgacacccagcagccaggtgtctataggttttctgtcctgggagggggctgtcagggtgatgccgcctgcagagagggggtcattctgcgaggtttggcttcagacccctgtgccagccggccctgtgattcggaaatgatggggcactgtgtgagagaccccaggagaaacacaccagtgctgctttttgacatatctctctccatctccccttttcagcgcgctgctctgtctctggataaacacacattcaagagtctcagtccccgctcttgccaccatctcctcctctcgatctcctctcccgcttcaaaagactccagagtcttctcgggtctcagagaagggctgagtcca

SEQ ID NO: 973 - DNA, 300 bp, Homo sapiens
gcttgggcttgtaaagagagatattcatgcaaatttcaactggagaatgaggattaggtctaatttgggagaataacagcagctgattgacagtttattaggtattgcctcttttaatcatctgaagagcctaggaggtaaaaattagtattattcctgtattgcagataatgaaattagagtataaagagaggatattatttgtcccggggggatatatatatatagtatgcatctcagcccagcaggcttgactcatgagtcacatttttcaccacacccctttgagcccacaccacc

SEQ ID NO: 974 - DNA, 300 bp, Homo sapiens
cccaaagaaactgaaaaacctgatacatgaaaaaatgtgttatagggatagattatgggcaattgcacagaagtagccctaaaaacctggctgactttcactgtcattaactatattttgaagtgttgcattaaaatattatcaatctgttactggaaggcaggaaaggcaatcttgtgatacatgtttttcttagtaaggagctcccaatttatattttcttttctcaaaatttagaggaaaatttcctatggagcctagagatcatgtactgctagctactggcattaaaatttaaaa

SEQ ID NO: 975 - DNA, 335 bp, Homo sapiens
ctcgtgccgaattcggcacgagcaggatcaaggtgaaaaggagaaccccatgcgggaacttcgcatccgcaaactctgtctcaacatctgtgttggggagagtggagacagactgacgcgagcagccaaggtgttggagcagctcacagggcagacccctgtgttttccaaagctagatacactgtcagatcctttggcatccggagaaatgaaaagattgctgtccactgcacagttcgaggggccacggcagaggaaatctgggagagggtctaaaggtgcgggagtttgatttaagaaaaccacttctacagatactggactcttggtttgg

SEQ ID NO: 976 - DNA, 213 bp, Homo sapiens
ccagggtaatggggcctggatagggagactctgtggccatacaggtctcacctctgcactggatgcctagggacaaagtccacctgcctcctggggccttccaggcccctgcagtctgtctctgccagaccccacacgctgctattgaccggctctccagatcacctctgaacttccaataagagaagaggaggaagggagttgttaagagcg

SEQ ID NO: 977 - DNA, 207 bp, Homo sapiens
cctgctgggaggtgattggatcatgggggtggtttctaatggtttagcaccatcctgctagtgctttctcgtgatagagttcttcacaatatcctggttgttttaaaaagtgtggtatcaccgtgcccctgtacctggtctcttctcctggctgggccatgtcgaagatgtggcctcgcttcttcgtgtgaactcttckggtcatgg

SEQ ID NO: 978 - DNA, 321 bp, Homo sapiens
  misc_feature 276: n = A,T,C or G
ctcgtgccgaattcggcacgagagcaaattcacctacacagttctggaggatggttgcacgaaacacactggggaatggagcaaaacagtctttgaatatcgaacacgcaaggctgtgagactacctattgtagatattgcaccctatgacattggtggtcctgatcaagaatttggtgtggacgttggccctgtttgctttttataaaccaaactctatctgaaatcccaacaaaaaaatttaactccatatgtgttcctcttgttctaatcttngtcaaccagtgcaagtgacccacaaaattccagttatttatttcc

SEQ ID NO: 979 - DNA, 329 bp, Homo sapiens
cttgccccctgtccatttatttaagcccccataggtgcccttcacccccaaaaccagctgtacagaatctttgatacagacctatttgctaggggtgctgccggggatttggggtcagcatctggccccctatctcctgaccagctgagtcatgaggccggtttctctctctctcccacttttgttccccagccaagctcttaagcacatgtaggcccctgagaccttcctggttcctgcctgggggccaggctcctcttcccccagcccccgggagcctcccccaggttcctcgaggcccgacctgttaggggtagagcccttggccc

SEQ ID NO: 980 - DNA, 320 bp, Homo sapiens
tttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctataataggcctgtgtgtaagctgacttgcccaaggactcttgttaacagttaacttaggagtcaagtctcagtgataaagcgtgcaccgtgcaggccgccatatgccg

SEQ ID NO: 981 - DNA, 265 bp, Homo sapiens
ctcgtgccgcctggtgctttatttttgttttaatcttttgttgccagtgatgattttcctattctgcaaatagtgtatttcctggattacacatagtatggtttcctgaagtattctgataaatgtgttttttaaaacctcaatatactttttaggaaaggagcatcttgttatgcataaagcagagctaaaactaaatttctttcatgtgctctcctacttcctctagtgtcaatcacggtataagtgtgtaatcctctaaaaa

SEQ ID NO: 982 - DNA, 327 bp, Homo sapiens
gccagtcttaagcgtccagactcaggtgccactgggcttcctggaaggcctggccctcctggtccccccggccctcctggagagaatggtttcccaggccagatgggaattcgtggccttccgggcattaaggggccccctggtgctcttggtttgaggggacctaaaggtgactttggagaaaagggggagccttgccctccaggaagaggtcccaacggtttgccttgagctataggtctcccaggtgacccagagcccttccagctatgtgcagaaatgtgccgcagacgggtgagcgcaggccccccagggggttggcaggaa

SEQ ID NO: 983 - DNA, 326 bp, Homo sapiens
gaaaattgtgagagccaagttgacttcaggaactgaaacatcagcacaaagaagcaatcatcaaataattctgaacacaaatttaatattttcgcttctgaatgagaaacatgagggacattgtggagttagcctcctgtggagttagcctcctgtggtaaaggaatttaagaaaatataacaccttacaccctttttcatcttgacattaaaggttctggctaactttggggatccattagagaaaaatcctctgtcaccagattcattacaattcaaatcggagagttgtgaactgttatcccattgaagagaccgagcctctg

SEQ ID NO: 984 - DNA, 322 bp, Homo sapiens
aagtgcttcttgccaccatgaacatcttgttcacacagtttaagaggctcaaggggacaagtccatcctcgtcatccaggccccagcgagtcatcgaggaccgcgactctcaactccgaagtcaagcccgcactctgattacctttgctggaatgataccataccgaacgtctggggacaacaatgcgaggctggtgcagatggaggtcctccatagaattaagtgccatgctttgtgggagtctgggtcggcacactgtcagtacatcaggcacatgggcccactaggctggggtttctggttttgtttctgttgtgtttt

SEQ ID NO: 985 - DNA, 305 bp, Homo sapiens
aagaattccagcttgaggtgagtgggctactaggggagatgaactgcccgtatctttcactgacatctggggatgtgaccaagcgccttctcattcagaagaactgcctcctcttgctcacatacctcatctcagaactagaagctgccagaatgctctgtgtgaatgctcctccaaaaaaagctcaagaaggaggcggtagttaggtctttcaagagttgaaaggcatatgttattgctctaggattgtccacaccctccagccattataactatgttcccaattttttcagcgggatttaaaa

SEQ ID NO: 986 - DNA, 295 bp, Homo sapiens
gtttgctgagcccctggtgtgtaccatttagagtataagctacataaggacaaatgaatcctctaacaagcagtttgccaatgactggtgggaaaaatagctactgctattaagaacttactatgtgctaggtattgtggtaagaatatacaatactgtctaatgaggtagcgacttgatacccgttttgtggattgaaaaacaaggctcagaaagctttagggacatatccaggatcacacggctaagtagtgaatcctgttgaccgcctttctgtccgtgagggtgttggcta

SEQ ID NO: 987 - DNA, 270 bp, Homo sapiens
cagactgcaaaataaaatctcggtgttctatttatttattgtcttcctgtaagaccttcgggtcaaggcagaggcaggaaactaactggtgtgagtcaaatgccccctgagtgacttcccccagcccagggccagaagacctcccttcaggtggccggcgcaggaactgtgtgttgtcctacacaatgggtgctattctgtgtcaaacacctctgtattttttaaaacatcaattggatattaaagatgggagggttattggggaaatga

SEQ ID NO: 988 - DNA, 228 bp, Homo sapiens
tacataaaaaagtaagactaagtattgctgaatttgcagttatgttgtcgtgtataagagctacttccaggtgtggttacaaatgaacccatggaatgatgactcatgttctcctcgtgggtttgtgccgtcctgctttccaaataggtattgaatttatgcattagtctggtgatttcagtctgtgaaatattttgggtctataccactaaacatttcatagtctgc

SEQ ID NO: 989 - DNA, 221 bp, Homo sapiens
gaacgagctgatgttttgcgcttgctttgtaattttggcttggttttactaatacataacctcatgtaatctctaaaaatctacacaggcattgatccatttcaacacaaaggtaaatttaaaatgcaggctttgttatttgccacaggaggtgcatgraaaattttcggccactattttccaaataggtagtgtcatttgggtgtgccatggcctcctgt

SEQ ID NO: 990 - DNA, 187 bp, Homo sapiens
gtcgtcttgtttttgcttcattgcatgacataacccttcccctcaagctgttcctatatatacatgcacacacaaaataagccagacagatggcaatttgatcttccttttttaaaaaaaaaaaaaaacctggggggtctttctggggccgccgggccccattcgttttccccccgggggggtcccm

SEQ ID NO: 991 - DNA, 235 bp, Homo sapiens
agacactcatgtagaaattattcaagaagttattgtctaagagatgagcagtaggtaagaaaacctcagtcattgactcttcaatgtaatgatcagagtttaaaccattttctaataataaattaaatcttcagttgaacaaattattttgtgaatctgtttcactcaatggattgtaagaggctcctaaatttgagttgtttgctaatcatttcattcgcatcattagggatct

SEQ ID NO: 992 - DNA, 246 bp, Homo sapiens
gttttatagcctggactgctacctttcaaagcttggagggaagccgtgaattcagttggttcgttctgtactgttactgggccctgagtctgggcagctgtccttgcttgcctgcagggccatggctcagggtggtctcttcttggggccagtgcatggtggccagaggtgtcaccaaaccggcagtgcgattttgttaaccagcgacgaactttcgaaaataagcactggttgctacctgataaa

SEQ ID NO: 993 - DNA, 344 bp, Homo sapiens
caggcactcagaatggtccagcgttttgacataccgacgtaggcttttcctacaatacagcctctaacaaaactaggctgttccgaacccctggtaatagaattgtttacctttataccaggagggtttgggaagcaccaaaatctgcatgtggtgtgtcccaggcagacttcgaggggttcgttgctgtaagacctaaagttcttatgagattgtccaacaacaagaacatgtaagcagggcctatggtgggttcatgtgtctaaatgtgttcgtaacaagatcaagcgtgctttccttatcggggggcagaaatcgttgtaaagttttgaggcacagcacag

SEQ ID NO: 994 - DNA, 317 bp, Homo sapiens
ctttccgtggagctgtcgccatgaagggtcgagctgttcagttttagcggggtacaagatctaccccggacacggaagggcgctacgcagggaccgacgggaaggttttccagtttcttaatgcgaaatgcgagtcggctttcctttccaagaggatctcggcagataaactggactgtctctacagagggagcacaaaagggacaatcggagaattcaaagaaagacccccgagcagtcaattcagagacatactgtcatctctgctgatatatgccagaggatcagaacctcagtggaaggctcacgggacagct

SEQ ID NO: 995 - DNA, 327 bp, Homo sapiens
cccaacaagatagcaggttatgtcacgcatcttatgaagcgaattcagagaggcccagtaagaggtatctccatcaagctgcaggaggaggagagagaaaggagagacaattatgttcctgaggtctcagccttggatcaggagattattgaagtagatcctgacactaaggaaatgctgaagcttttggacttcggcagtctgtccaccctccaggtcactcagcctacagttggggatgaatttcaaaacgcctcggggccctcttttgaatttttttctgtagtgctgtattatttccaataaatctgggacacaaaaaaaata

SEQ ID NO: 996 - DNA, 315 bp, Homo sapiens
ggaaggccaaaatcaagagtgagatgtagaaagttgtaaaatagaaaaagtggagttggtgaatcggttgttctttcctcacattggatgattgtcataaggttttagcatgttcctccttttcttcaccctccccttttttcttctattaatcaagagaaacttcaaagttaatggggatggtcggatctcacaggctgagaactcgttcacctccaagcatttcatgaaaaagctgcttcttattaatcatacaaactctcaccatgatgtgaggggttcacaaatcctccaaataaaaggtatgacttaaaa

SEQ ID NO: 997 - DNA, 296 bp, Homo sapiens
tagactagttatgaagaaaccccactacattcaatggaattggtgcttaaaatctcatcgatgtgctgtctctggagtgataagaaagggctacatctcccgaaatgatttctttacgtcatgtattggtttccttcttcaccttgaacttttgttgacctgtatgtactttaccccaaacctgttaatattttgagcgcttctatgttaaagcaaagaaataattttaatactctggcattcataaattttattgatgagattattattttaaaggttggggtaacactctggtg

SEQ ID NO: 998 - DNA, 187 bp, Homo sapiens
ctcgtccaatttcggcagggaaaagcccggagtttgcgctgagcttggctgctcgctgggtcttggatgtcgggttcgaccacttggccgatgggaatggtctgtcacaatctgctccttttttttttgtccgccacacgtaactcagatgctcctttaaataaagcgtttgtgtttcaagttaaaa

SEQ ID NO: 999 - DNA, 192 bp, Homo sapiens
ccggaatgccaacgcagagccagctgttcagcgtactcttttagagaaatagaagattgtcggcagaaacagcccaggcgttggcagcagggttagaacagctgactgaggcttactacctgaaggacaactgactgagagcagagatggaggacttctgttaacggcggattctttgtttaaatcttgacg

SEQ ID NO: 1000 - DNA, 265 bp, Homo sapiens
ctttcgggaagttgaatattaatctgtacccaaaacgtatttagtaaaatatttgcccccgccaccctgccatgctgacataacaacttttataatgttgaatagatgatatgggaaatactaataacaacagtgtaattttgcaggcagctttaacttatatacattgcttgatttttttcaaagactaaatatgtcatttatactttgtttattttctccaaggaggttgtgtaaaatatgcctgctgctttcctttggagga

SEQ ID NO: 1001 - DNA, 191 bp, Homo sapiens
ggatgatgaatggcatgaagctgagtggccgagagattgtacgttcgaattgatagaaacgcttaagcagttgccttttttaacatcgatacgagacctctgaatttgtatttttccttgttaccattttaatttgttggctggatgtataagatgtttaaaaaattcagttgcttttgggggtaatttga

SEQ ID NO: 1002 - DNA, 251 bp, Homo sapiens
cggcacgagggaagacattgaacgtatggtccaggaagctgagaagtacaaagctgaagatgagaagcagagggacaaggtgtcatccagaattcacttgagtcctatgccttcaacatgaaagcaactgttgaagatgagaaacttcaaggcaagattaacgatgaggacaaacagaagattctggacaagtgtaatgaaattatcaactggcttaataagatcagtcttctgagagggagtatttgcac

SEQ ID NO: 1003 - DNA, 173 bp, Homo sapiens
agaccttcatgagctgcaatctcatcactggaatgttccagcgactggacaagctgaggaagaatgccttcgccagtgtcatcctttttggaaccaacaatagcagctccatttctggagtctgggtcttccgaggccaggatcttccctttcccttgagtccagattgcgca

SEQ ID NO: 1004 - DNA, 213 bp, Homo sapiens
tgagggagtacgtcgagtcgcagctgcagcgcacagagactggagcgacggagaccgtcacgccctcagaggccccggtgctggcagctgagcccgaggtgtacaggggcactgtgttggcactcactggaaataacttcgttgacaccattgacagaaggattaaccttcatcaagttttatgtacatggtgtgagtcattgtaagactgct

SEQ ID NO: 1005 - DNA, 150 bp, Homo sapiens
gacccccgaagctccagagggcatgttacagtgctcttctggctctgcatttgtggacggcttaagtgttaacagctcagtgcggccctttccccccgtgtgtgcggtggctgcctctgcagcaacggcaacgggcacgtgtcacaacct

SEQ ID NO: 1006 - DNA, 162 bp, Homo sapiens
atacttaattgcaaatatcccttgtatgaggttaactaaaaaaattttgctatgtctgatctacatgtttgcattttgttcaactaattaatatttgkagattgcaagtttgtttaaaataactttattgaggttttaagtccgattcgttctaaggtgcct

SEQ ID NO: 1007 - DNA, 150 bp, Homo sapiens
gaagagttctcattatattttcttataagttattcctagtaatttgatatcattatttatattttaaacctaggaccagtaatttctttgccagttccaccagcttaagctatatctcatacttactttctccctccctacaagtagacg

SEQ ID NO: 1008 - DNA, 285 bp, Homo sapiens
gtgaaactgcactgctccatgctggctgaagatgcaatcaaggccgccctggctgattacaaattgaaacaggaacccaaaaaggagaggcagagaagaaatgagccctccctcggcgaacgtcccagcaggccacaccagctgtttcccacctgctgtgcagtacaccttagatgttcagaggccgcttctctccactgaggagctatgagatacgcacaatacttgctgttcacgttatgactctcatgcaagcaaaatacacagtttcattgttctgaaaaa

SEQ ID NO: 1009 - DNA, 260 bp, Homo sapiens
attttctggaaacacagaagtacttgacggagagttaggcctgtattctataaatctattaatggtagcaaagtgcataagacagggatttctttgagatgaaaggagtcctgaagaagagcattggaattaatatttggatgtggtattgtagaaatacaatgggtaaagtaaccctaatgtgggaataaaagtcaagggaaaggtcttgaataagtacacagaatataggctaaaaatattaaggggaggaaaatgga

SEQ ID NO: 1010 - DNA, 163 bp, Homo sapiens
aaacttggtgtatatcatatatcactttactttagaggaattaagatttcacataaatccatttccaggttccaaagaccaggaagaggcttggtttttgttttctcttttatctgtctttacagtctccttgtcttttcttaggagagaaggtactgagaaa

SEQ ID NO: 1011 - DNA, 173 bp, Homo sapiens
ttcggttagggggatatttttcaaacctctcgctttatactctgatatagggtgtgtttatgaacttgttaaatgttatttaatcatgcagatttccaatcagtgtattgctcatttactgacaaaaagggaaaataccgaacacagaaaggggaaataaactgacttttata

SEQ ID NO: 1012 - DNA, 160 bp, Homo sapiens
caccgctacacgaccgggggtatactacggtcaatgctctaaaatctgtggagcaaaccacagtttcatgcccatcgtcctagaattaattcccctaaaaatctttgaaatagggcccgtatttaccctatagcaccccctctgccccctctagagcaaa

SEQ ID NO: 1013 - DNA, 189 bp, Homo sapiens
gctgggcgaaatgcagcacatgtggcctttagggacctcaagagcatgtgaccctgaaccagctctgacccaggaagaagactccacccctgaattcaagtgctccattggatcagcttcccaggagttcagcttcgggttagtacataaggccaccacaatgctcaggaaattattttggaaaaacgt

SEQ ID NO: 1014 - DNA, 157 bp, Homo sapiens
aaaccgctagcttgttgcaccgtggaggccacaggagcagaaacatggaatgccaaacgctggggatgctggtacaagttgtgggactgcatgctactgttctagagcttgtctcaatggatctagaacttcatcgccctcttatcgccgatcaacc

SEQ ID NO: 1015 - DNA, 192 bp, Homo sapiens
ggcgactctgcaccacgcaggggaagagaaagcaggagccgtccagcacggaggaaggcgaccatggccaaggagttggggtacgcagttcacaacggtcctgaccacttggcatgaactttttccaaatgccaaggggggaaaaccagtcgcccttgagctgcatacttaagacatcaggcatgcccttct

SEQ ID NO: 1016 - DNA, 232 bp, Homo sapiens
tgaacacagtggacatctcagaacgagagaaaagtggcacagctgcgaggtctctacaagaaggctgggcttggcaaggagagacgccatgtcacctacgttgtagccaaaaaaggtgtggccgcaaagtgcgccggccagctggagtcagaggtcatttcaaggtggtggactcacggatgaggaggaccacagagcacagcaacgtaaggacacaggaaaaacacacacg

SEQ ID NO: 1017 - DNA, 151 bp, Homo sapiens
cggcacgagtttccggtttgggggatgagcgttgctatttaattactaatattattgaattgccttagaggaggccgggcgagcccgttgtttcttgaaggaccctttggccccagcagagcctcttacagtaaagtttttggttccgcaa

SEQ ID NO: 1018 - DNA, 167 bp, Homo sapiens
ctcgtccaattttgggccgaggggaaaaattgcccaggatgctattaaattcaccacggtctttagccattgcacaaacggtagttttgttgttgttgggcttgcttccacttgttcctttgccagccttacaggggggaaaaggcagggtttacagagggattgtt

SEQ ID NO: 1019 - DNA, 197 bp, Homo sapiens
acagcaacagggtggtggacctcatggcccacatggcctccaaggagtaagaccctggaccaccagcccagcaagagcacaagaggaagagagagaccctcactgctggggagtcctcccacactcagtcccccaccacactgaattctcccctcctcacagttcgcatgtagacccttgagagggaggctcctagg

SEQ ID NO: 1020 - DNA, 152 bp, Homo sapiens
cgcgccgccatcatggacaccagccgtgtgcagcctatcaagctggccagggtcaccaaggtcctgggcaggaccggttctcagggacagtgcacgcaggtcgcggtgggagtttcattggacgacacgagccgatccattccattccggtc

SEQ ID NO: 1021 - DNA, 230 bp, Homo sapiens
taaatttatactcctgtttcccaggatcttgagcttttagtgtgctatacctatgtgtcttaatcgtgggccactgtgccaataaacaaaaacatctgtttgggtttacctcagttgcagtagttattttcatttgagaagttgttctcagattattgtttcagttatatagaggattactagactagttatgaggaaccccactacatccaatagaattggtgcttaaa

SEQ ID NO: 1022 - DNA, 244 bp, Homo sapiens
gcgaaaggtgctggaccatcgagacaaggtatatgagcagctggccaaataccttcaactgagaaatgtcattgagcgactccaggaagctaagcactcggagttatatatgcaggtggatttgggctgtaacttcttcgtttgacacagtggtcccagatacttcacggatctatgtggccctgggatatggttttctcctggagttgacactgcaggagctcttcaagtcaattgaatcgag

SEQ ID NO: 1023 - DNA, 174 bp, Homo sapiens
aacctgcatattctttctatcattcttctaattgtgggcctctattccttaggatattccttcctctctttttttccttttctcacctgttcacaaagtatttttttttgaaatagggataaatacgtacgtgaggaacagatgtgttcatcttaaatcattatttgctcacat

SEQ ID NO: 1024 - DNA, 231 bp, Homo sapiens
ctcgtccaattgggcgaggggggcccctcttgggtccctcctctgccatcacctgaagacccacgcaaacactgaatgtcacctgtgcctgccgcctcggtccaccttgcggcccgtgtttgactcaactcagctcctttaacgctaatatttccggcaaaatcccatgcttgggttttgtctttaaccttgtaacgcttgcaatcccaataaagcattaaagtcatgaaa

SEQ ID NO: 1025 - DNA, 276 bp, Homo sapiens
gcattacctggcatgggaggtccagggccagtgggaactccggacatacctcttggtacagctccatccatgccaggccacaaccccatgagaccaccagcctttctccaacagggcatgatgggacctaaccatcggatgatgtcaccagcacaatctacaatccccgcccagcccaccctgtatgagcaatccagctactcccgtgggatgattcctggcaagaatcgggggcctgccgggttctacaccaccctggggctgtggctctccagg

SEQ ID NO: 1026 - DNA, 162 bp, Homo sapiens
ccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggggtagctgacctgacacag

SEQ ID NO: 1027 - DNA, 246 bp, Homo sapiens
ggcaacgttgctggtgacacaaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggagatggccctaaattcttgagtctggtgattgctgccattgttgatatgg

SEQ ID NO: 1028 - DNA, 185 bp, Homo sapiens
cttcaccgaagaaaaatatctaaacatcgaaaaacttaaatattatggaaaaaaaacattgcaaaatataaaataaataaaaaaaggaaaggaaactttgaaccttatgtaccgagcaaatgccaggtctagcaaacataatgctagtcctagattacttattgatttaaaacaaaaaccacaaa

SEQ ID NO: 1029 - DNA, 224 bp, Homo sapiens
ccactctttgatcatggctctctctgccagaattgtgtgcactctgtaacatctttgtggtagtcctgttttcctaataactttgttactgtgctgtgaaagattacagatttgaacatgtagtgtacgtgctgttgagttgtgaactggtggccgtatgtaacagctgaccacgtgaagatactggtacttgatagctcttaggaaatttgctccaaatttag

SEQ ID NO: 1030 - DNA, 228 bp, Homo sapiens
ggatctcctgctggtcagtggggcggcggcagcaccttacccgtggcctggtaccaggtgagcccgctggccgcccgcctgctctaccctacctggcctggctggccttcgcgaccacactcactactgcgtatggcgggacaaccatggctggcgtggggacggcggctgcagagtgagtgccggcccaccagggactgcagctgcaccagcaggtccattcacgtt

SEQ ID NO: 1031 - DNA, 260 bp, Homo sapiens
cacgcctgcccttccttgatattgcacctttggacatcggtggtgctgaccaggaattctttgtggacattggcccagtctgtttcaaataaatgaactcaatctaaattaaaaaagaaagaaatttgaaaaaactttctctttgccatttcttcttcttctttttaactgaaagctgaatccttccatttcttctgcacatctacttgcttaaattgtgggcaaagagaaaagagggtttgatcagagcattgtgcaat

SEQ ID NO: 1032 - DNA, 261 bp, Homo sapiens
gcgtggcctacatggaccagcagactggcaacctcaagaaggccctgctcctccagggctccaacgagatcgagatccgcgccgagggcaacagccgcttcacctacagcgtcactgtcgatggctgcacgagtcacaccggagcctggggcaagacagtaatttaatacaaaaccaccaggacctcccgcctgcccatcatcgatgtggccccttggacgttggtgccccagaccaggatttcggcttcgacgttggcct

SEQ ID NO: 1033 - DNA, 334 bp, Homo sapiens
caggggcaccattgaaatcctgagtgatgtgcagctgatcaagactggagacaaagtgggagccagcgaacgcacgctgctgaacatgctcaacatctcccccttctcctttgggctggtcatccagcaggtgttcgacaatggcagcatctacaaccctgaagtgcttgatatcacagaggaaactctgcattctcgcttcctggagggtgtccgcaatgttgccagtgtctgtctgcagattggctacccaactgttgcatcagtacccattctatcatcagcgggaacaaacgagtctggccttgtctgtggagacggattacacctccca

SEQ ID NO: 1034 - DNA, 225 bp, Homo sapiens
cctcattcttcctccggtagcctctcccacctaacctctgcatcccccagcctcatgtcctgccccatcctatcctgcctgatccctggatctcctcagatccctcttctcagacagcgccaggccggggtggggccggggttggggccgagcccacaagctgccccctcccctccctttttgtataatttaataaagaatggtcgcgcttctgtttttaaaaaa

SEQ ID NO: 1035 - DNA, 311 bp, Homo sapiens
tgaactcatatctgtaagaaataaagagaagatatattagttttttaattggtattttaatttttatatatgcaggaaggatagaagtgattgaatattgttaattataccaccgtgtgttagaaaagtaagaggcagtcaattttcacatcaaagacagcatctaagaggttttgttctgtcctggaattattttagtagtgtctcagtaatgttgactgtatttctccaacttgttcaaattattaccagtgaatctttgtcagcagttcccttttaaatgcaaatcaataaattcccaaaatttaaaa

SEQ ID NO: 1036 - DNA, 268 bp, Homo sapiens
gcaagactgttatcgagtaccggtcacagaagacctcacgcctccccatcattgacattgcacccatggacataggagggcccgagcaggaattcggtgtggacatagggccggtctgcttcttgtaaaacctgaacccagaaacaacacaatccgttgcaacccaaggacccaagtacttttcaatctcagtcactctaggactctgcactgaatggctgacctgacctgatgtccattcatcccacctcttaaagttgggactttt

SEQ ID NO: 1037 - DNA, 286 bp, Homo sapiens
tttcagagactgcttaaaattaatccagactggaaaacccacagacttcttgatttaggtgctggagatggagaagtcacaaaaatcatgagccctcattttgaagaaatctaatgccactgagctttctgaaactatgatatggcagcttcagaaaagaatacagagtccttggtataaatgatggcagatacggggttcagtatgatgtcatcagctgcctgacttgctggaccctgtaatcagccctgactttgttaaaggtatcagagggtttggggccact

SEQ ID NO: 1038 - DNA, 251 bp, Homo sapiens
aaaaagcaaaaatgacaacagaaaaacaatcttattccgagcattccagtaacttttttgtgtatgtacttagctgtactataagtagttggtttgtatgagatggttaaaaaggccaaagataaaagggttctttttttttcctcttttgtctattaagttgctgtttattttttttggcctgtttgatgtatgtgtgaacaatgttgtccaccaataacaggattttattttgctgagtgttctaaaaa

SEQ ID NO: 1039 - DNA, 204 bp, Homo sapiens
tctaggtaaagctgagatcacaggaacagcaggtgacaggcctagctatagttaggaatacacaagccgtaaatcgggtccttacagccataccacaaggtacgtccatttggactacaagaagagcttcctttaaagttcctatttcagcataaagaggctgtccttttttttgaggaatagtttggccttgtcctcctgtgg

SEQ ID NO: 1040 - DNA, 218 bp, Homo sapiens
aacccacttggtttaattcaacccccaatgtcaggtttttataggtcagcccagagttctcaagcccagtcacaaagcagagccaggactcaaattcacaccctgtgactgagctgtttccactgtaccatgagacactacccacaaatcgctccttctccagtatctatgacacggccataacaaaccataccccttggacagatattccttaaaaa

SEQ ID NO: 1041 - DNA, 289 bp, Homo sapiens
aaaccaggccctttagaggatcccagagagggaagagaaccaggggcccttttctcttttagaattttcttttaatcagcccaccttttgactccccgcccgccccaatccattatttttttctgccttccgggtcccatccttagagctcgagtcgttccttcccctcctggattccgggtagcagaggcagccccgaaggagggcgggtccccgtttgtccaaggcctggtcgtggtggaggaaggtgttctggaacaataaacggcactatccaaatgtaaaaaaa

SEQ ID NO: 1042 - DNA, 346 bp, Homo sapiens
ctccgccgaccccctggtcgtgaggcctatcctggtgatgtgttctacctacactcccggttgctggagagagcagccaaaatgaacgatgcttttggtggtggctccttgactgctttgccagctcatagaaacacaggctggtgatgtgtctgcttacattccaacaaatgtcatttccatcactgacggacagatcttcttggaaacagaattgttctacaaaggtatcccgccctgcaattaacgttgggtctgtctgtatctcgtgtcggatccgctgcccaaaccaggtctatcaagcaggtagcaggtaccatgaagctggaattcggctcagtatcgt

SEQ ID NO: 1043 - DNA, 166 bp, Homo sapiens
ggctttcaggtgtttagagattttttttgttgttgttaacattcattgcaaaagtactagatggtgtataactctagagttgaattttaagggattccctaatatgtatactatctttttatctgaagtaataaataaacaatgatcttgaaagtccctcaaaaaa

SEQ ID NO: 1044 - DNA, 140 bp, Homo sapiens
taaaaggatagtatatctttaaattctgactggggagtaagaagagaagatattcttacctactaaataaaccacttttgagtagtatgcaatattatgaaatgttacaacactatattaaaataataaaatatttgggt

SEQ ID NO: 1045 - DNA, 250 bp, Homo sapiens
acagtacacacccagcttttctatagagatgaaatatgagcctgtagcttatagctcagcagctgactgcagccagaccccctctttgtttcttaatccttaggggaagtgtgaagttcctgtttctgctttgaaggatgggttggatctctctaaaggatttgaaccacaccttcaaatctagaagtggcctccaccataatctatctgtagactacacaggctttactactgatgcaggcattcatgt

SEQ ID NO: 1046 - DNA, 308 bp, Homo sapiens
ctcctttgaagtcatttattattttataaattgagaacaaccacaccaccaaatgtcacaccttcttataaagtgtgaacaaggaaggtcatgtttttgttggtattttgtcagacttagaggtttcatttcagggcatagtcaaaggcatcatcctccaactacccacttgattatgtatttcagatcctccgtggggccttcttctgacagagattctttgaggtccgcagtagtccttttgtcagcacagctgctaatctacaacttgctgccttctgtttgctggggttgggcttatcatttac

SEQ ID NO: 1047 - DNA, 166 bp, Homo sapiens
agagagggaggagtacagaaggaaggcacttctgggtacttaattcagaaatttctttatatttcagcactggattatcatataatgcaagtgactatggactaagagttagttatggtgtcttatgactagatttattatggtatattaaagtaacaataatatt

SEQ ID NO: 1048 - DNA, 179 bp, Homo sapiens
gtcgagagctgatgggcggcattgggaaaaccatgatgcagagtggcggcacctttggcacattcatggccattgggatgggcatccgatgctaaccatggttgccaactacatctgtcccttcccatcaatcccagcccatgtactaataaaagaaagtctttgagtagtcaaaaaaa

SEQ ID NO: 1049 - DNA, 231 bp, Homo sapiens
tcagcggttcaactttataataattataaataaacctgttaaatttttctggacaatgccagcatttggatttttttaaaacaagtaaatttcttattgatggcaactaaatggtgtttgtagcatttttatcatacagtagattccatccattcactatacttttctaactgaggttgtcctacatgcaagtacatgtttttaatggtggtctgtcttctgtgctgtccc

SEQ ID NO: 1050 - DNA, 280 bp, Homo sapiens
aaataaggaaaggaaaccacagagaaacttgtgtcttcctgctctcctctccggctgcctggcagttattaacctaaacagatagccacaagaggttgggacagaggagggtaaaggctcagaaggaggttcaacctctgactcacctgcccatctctgggccctctgctgacacttggatgctattgttgggtggaagataaatagagtggagaggttggaggaaagtactggtattgcatttaggaggatgtttatcatcccggccctggagggcaac

SEQ ID NO: 1051 - DNA, 251 bp, Homo sapiens
gggccttcaagctctacgacttggacaatgatggctacatcaccaggaatgagatgctggacattgtggatgccatttaccagatggtggggaataccgtggagctcccagaggaggagaacactcctgagaagagggtggaccggatctttgccatgatggataagaatgccgacgggaagctgacccttcaggagttccaggagggtcccaaggcagaccgtccattgtgcaggcgctgtccctttacg

SEQ ID NO: 1052 - DNA, 334 bp, Homo sapiens
  misc_feature 100: n = A,T,C or G
ccccaggagagttggaaaagcttagttctgtggtcactgtgataccatagtccccctgccttgggtagctaacgtagcataccagctggcgttaggaaanctagctaaagctcacagagaggctctgcaaagtgatcgatctttctctgtaatgtctgtaactcatttggcctgctccaggttactacttgattctcttcagcagttaagagttgcattctgaaacactttcagagagtagtgctagtgttgatttctggatctaattctggaaataccagctgtaaaattatatttggaatttacatttaagaaaagcaagcccagtaattct

SEQ ID NO: 1053 - DNA, 342 bp, Homo sapiens
gcgagcccagcgcccccttctcggccctacgtggtgtcgggctacagcggtcgcgtgtacgagaggcccgtgcaggtccttatatcaccttcacggatgcggtcaatgagaccaccatcatgctcaagtggatgtacatcccagcaagtaacaacaacaccccaatccatggcttttatatctattatcgacccacagacagtgacaatgatagtgactacagaaggatatggtggaaggggacaagtacttggcactccatcagccacctgcagccagagacctcctacgacattaagatgcagttcttcaatgaagggggggagagcgagttcagcaacg

SEQ ID NO: 1054 - DNA, 326 bp, Homo sapiens
ggaagaggtcccaacggtttgcctggagctataggtctcccaggtgacccaggccctgccagctatggcagaaatggccgagacggtgagcgaggccccccagggtggcaggaattcctggagtgcctggacccccgggacctctgggcttccggtttctgtgagcagcctcctgcaccatgcaggctggtcagcgagcatttaacaaagggcctgacccttgaaaggcttactgctgcatggctgtttgcatgaaccacgcctggtgaaggagcctgggtgagaacaccatccaaagctggggcaaagatgattccttcagcatg

SEQ ID NO: 1055 - DNA, 272 bp, Homo sapiens
  misc_feature 7, 197: n = A,T,C or G
ccggaancccttggcccctcagcaatagaaggtaagacaagatcacatcccaaggtgggagggggctcgtgccagccctgaaggtggttggaaggtcttttttgtagcagccaggaagggctggctctgcttctagatccacaaagctgcttggatgggggccgtctcaggcggagggccacgagggctgaggagtncaggtctactcttgcctcgggctgcccaggcgacatgccaggggtctgtgttctcctggagcctgtcaggtttgg

SEQ ID NO: 1056 - DNA, 330 bp, Homo sapiens
gtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtctgtaccagaaacattttcttttattgttacttgctttttaaactttgtttagccacttaaaatctgcttatggcacaatttgcctcaaaatccattccaggttgtatatttgtttccaataaaaaaattcaa

SEQ ID NO: 1057 - DNA, 245 bp, Homo sapiens
gccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccaaaa

SEQ ID NO: 1058 - DNA, 267 bp, Homo sapiens
gttgggaagcggacccggggcctggggacccggcggcgtcagagccaggcaagttgaaccggagcaaacgacttccgatccagtctgcgctgttgcggctcccgtttgggatttgatttgcagcatctttgagcctctacgacaaaaaaccgcgagacggcccagcccttccccggcaccccgaaagagctacttctagagccgccggcgcccatcgattttccacccgggtggggtacacggtaagtctacccaattcgcctatag

SEQ ID NO: 1059 - DNA, 296 bp, Homo sapiens
ctcgtccaatttcgggcgacgggggccactcagaatggtccagcgtttgacataccgacgtaggctttcctacaatacagcctctaacaaaactaggctgtcccgaacccctggtaatgagaattgtttacctttataccaagaaggttgggaaagcaccaaaatctgcatgttgtgtgtgcccaggcagacttcggggggttcgtgctgtgagacctaaagttcttgatgagattctccaaacaaagaacatgtcagcaggcctatggggggtccatgtgtactaaatgtgtgcg

SEQ ID NO: 1060 - DNA, 255 bp, Homo sapiens
ctgtagtcctagttacttaagaggctgagttgggaggatcagttgaacccagtggttctgggttgcagtgagctgtggtcacaccactgaactccagcctgtgcgactgagtgagacctgtgtctaaaaaaataaaatataatgaatgtgatttatgtagataaattgataatatagtaaataggtaaatgccttaaaaagcatttttaagatttgtaaattctaaaacaataaaaatttggtatacatcaaaaa

SEQ ID NO: 1061 - DNA, 242 bp, Homo sapiens
tgacagcatacctcaaaaggcccctagctaataaacctgtaagcccagcattttgagagaaggtagggtgtgtatatataacaggttgtgtacaactccacgaggtgaaaaatattcagtaacttgttttacatagcatttgtgtaaagactatgatctcatcccaataaaatgatatattacaccttcagattaatgactggctacagagtaacaaaaaataaagaattaatgcacagtaa

SEQ ID NO: 1062 - DNA, 174 bp, Homo sapiens
ccaacctcattttagttgcctaagcattgcctggccttcctgtctagtctctcctgtaagccaaagaaatgaacattccaaggagttggaagtgaagtctatgatgtgaaacactttgcctcctgtgtactgtgtcataaacagatgaataaactgaatttgtactttaaaaaa

SEQ ID NO: 1063 - DNA, 233 bp, Homo sapiens
ccggtcacagaagacctcacgcctccccatcattgacattgcacccatggacataggagggcccgagcaggaattcggtgtggacatagggccggtctgcttcttgtaaaaacctgaacccagaaacaacacaatccgttgcaaacccaaaggacccagtactttccaatctcagtcactctagggctctgcactgaatggctgcctgacctgatgtcattaatccaccctct

SEQ ID NO: 1064 - DNA, 275 bp, Homo sapiens
ggctcatgcctgtggtcccagcactttgggaggccaaggcggatggattgcctgaggtcaggagttcgaaaccagcctgatcaatatggtgaaaccccatctctactaaaaaatacaaaaaattagcttggtgtggtggcgcaccctgtggtcctagctactcgggaggctgaggcgggagaactgctttaacccaggaggcggaggttgcagttagccaagattgttgcacttcacttccagcctgggtgacaaagtacactcggtctcaaaaa

SEQ ID NO: 1065 - DNA, 252 bp, Homo sapiens
gataagaaagggctacatctcccgaaatgatttctttacgtcatgtattggtttccttcttcaccttgaacttttgttgaactgtatgtactttaccccaaacctgttaatattttgagcgcttctatgtgaaagcaaagaaataattttaatactctggcattcataaattttattgatgagattatttattttaaaggtttggggaacatctcttggtgtccaaagaggaaataaatatggttcttaaaa

SEQ ID NO: 1066 - DNA, 289 bp, Homo sapiens
cggcacgagagcaggacacgcatgacagcccatgacagagttagtgtttggggaaaatggaatgcaccttgggccaggaaaaaaaaatttaagtacacctttaaatgtatatgtgggggctgttgtggttagagtcatcatagtctaggccaggggttgacagactttctgtaaggtcagagagtaaatatcttaggcttatgagccatgcagttcctgcggcaactactcaattctgctgttgtaggcgggaagcaccctggccaatatgtaagtcaccaagctggct

SEQ ID NO: 1067 - DNA, 295 bp, Homo sapiens
ctgctgtgtcgtttgttttccacaagttgggatggattcatgtcgatacatccccatgcccttgacctcttctggcattctcctgtgctctgacaaactgagccagccttttagatctacatgaataaacaaactattttaccaagaaaaatctcagcttgcttactgcttaattaaaacctacaatttacacacctccctggccttcaagactgtgagctttggatagccctgcttaaatgtttgtcaacaacaagggtcggtaatgtgtcaggtccaatctgggctcctttgg

SEQ ID NO: 1068 - DNA, 256 bp, Homo sapiens
ggctgctggagctggcaaggtcaccaagtctgcccagaaagctcagaaggctaaatgaatattatccctaatacctgccaccccactcttaatcagtggtggaagaacggtcttagaactgtttgtttcaattggccatttaagtttagtagtaaaagactggttaatgataacaatgcatcgtaaaaccttcagaagggaaggagaatgttttgttgaccactttggttttcttttttgcgtgtgtgcacgtttt

SEQ ID NO: 1069 - DNA, 253 bp, Homo sapiens
cactgatgtgtggaagcagcctctccttgccttctgtgctcctcctgtggctgcaggagtttggctctgggtgtctgtgtgtggtggacggtaaattcgctgcccagtcaggtcccacaaggccacggggctcagtcacagccagtgggagaaccatggtgagccatgcaggttgagaacaggaccagttcattttcgagaaaaaaaaggaagggagaaaagcctattgaaaaagtatgccttgcttaatttt

SEQ ID NO: 1070 - DNA, 207 bp, Homo sapiens
gcctggacttctatgtggtgctgggtaggccaggtttcagcatcgcagacaagaagcgcaggacaggctgcattggggccaaacacagaatcagcaaagaggaggccatgcgctggttccagcagaagtatgatgggatcaaccttcctggcaaattaattcccgtttctattccaaaggggcattgaaaaggttttcagttgaaaa

SEQ ID NO: 1071 - DNA, 205 bp, Homo sapiens
tctttccgcgccgccacaatggtgcgcatgaatgtcctggcagatgctctcaagagtatcaacaatgccgaaaagagaggcaaacgccaggtgcttatttagggccgtgctccaaagtcatcgtccggtttctcactgtgatgatgagcatggttacattggcgaatttgaatcattgatgaccccagagcttgggaaattgttg

SEQ ID NO: 1072 - DNA, 215 bp, Homo sapiens
gtcgtttgtttttgttctgagctccataagaactgtgctgacttggaaggtgccctgtgctatgtcgtgcctgcagggacacgtcggatcccgtgggcctcacatgccaggtcaccaggtcaccgtctccttccaaccctgcagtgtgctgttgtgccaggtcaaggacggtgttctctatgcccactggccttcttcctttcctggcccagcag

SEQ ID NO: 1073 - DNA, 362 bp, Homo sapiens
gtgaagtgtgagacaatggtctatcaccccaacattgacctcgagggcaacgtctgcctcaacatcctcaggtgaggacactggccctctaatgccctcctcagcgctgcctgccaggcctccctcatggtcttgtgggcactacatcagactctgtcccttcccacccctttgttgtctgtggtacgagatttcccagtcatcttcctcatgggctgaccttggttttctccttggcctgtcctgctcacaccctccttccaggcctttcacatgctcactctcctatgccctgggtctgacctgcccaacaccagagggggcctgtggaggtttccacttaccaaggcctgacccttatg

SEQ ID NO: 1074 - DNA, 135 bp, Homo sapiens
cgtcagtacgcgaaggatatcggtttcattaagttggactaaatgctcttccttcagaggattatccggggcatctactcaatgaaaaaccatgataattctttgtatataaaataaacatttgaaaaaaccaaa

SEQ ID NO: 1075 - DNA, 80 bp, Homo sapiens
gttttatgattttacctcaaatcagaaaacaaaatgatgtgctttggtcagttaataaaaatggttttacccactaaaaa

SEQ ID NO: 1076 - DNA, 340 bp, Homo sapiens
gtcgtgctcctggcaggcgcgcccctggaggatgaggccactctgggccagtgcggggtagaggccctgactaccctggaagtagcaggccgcatgcttggaggtaaagtccatggttccctggcccgtgctggaaaagtgagaggtcagactcctaaggtggccaaacaggagaagaagaagaagaagacaggtcgggctaagcggcggatgcagtacaaccggcgctttgtcaacgttgtgcccacctttggcaagaagaagggccccaatgccaactcttaagtcttttgtaattctggctttctctaataaaaaagccacttagttcagtcaaaaa

SEQ ID NO: 1077 - DNA, 189 bp, Homo sapiens
gtcttgccagcactccaaaatctctgtgtgtcccctcttgacactcactgtttcccccagagctaactatcctgacgtatggtaattctccctctgtccttttaagaattattttaccagttatgtgtataacaatatggtttacattttgctcacttttgacttatataaaatagaataatactaaaa

SEQ ID NO: 1078 - DNA, 270 bp, Homo sapiens
cctcaaggtcctccaggctatggcaagatgggtgcaacaggaccaatgggccagcaaggcatccctggcatccctgggcccccgggtcccatgggccagccaggcaaggctggccactgtaatccctctgactgctttggggccatgccgatggagcagcagtacccacccatgaaaaccatgaaggggccttttggctgaaattccccacctgcctttggatgaaagactccgttgggaataaatggccaaagcttataggaaaaaaaa

SEQ ID NO: 1079 - DNA, 385 bp, Homo sapiens
aagccgaccacgttccgcgggctacggccccgagaggttcaggatcctgccccagcccaggtacaagcacagtgaagagttgcaccaccaactgcagccccaggctttggactgttactccggtaaaggtggttcttcccctttgggattccaagcccaggcaaatggaacccatcaatgggcaagttgacagaggttctgcttgggataatgaagagctgcctgtttctttccagtgcctgcttctgggggcagtgaccttgtgaaccactcatttttatgcaagtggcatccctaaaacctgagatgaggaagacttcaagggttttacaaggcccttgttttttaaatccaaattgataataatgatctcaaaacacagtta

SEQ ID NO: 1080 - DNA, 45 bp, Homo sapiens
aagtttttctaagactagtgaagaactgaaggagtcctgcatctt

SEQ ID NO: 1081 - DNA, 381 bp, Homo sapiens
gttaacggaagacatgatgcagagcaagcctctgtgattcctgcccagcacctgtgaggcctgacgtgtcagttcccaataaatgctcttctgatttgtttcccgtacaggcaaggaggcttgggtagtgcagatttgtgtatttcaatctttgaaagctctgatgtaatttagaaatgaaatccaatcatgagtccaggtagagaacgcctgctgtaatctacactgttgctgggactgcgcattctgtatataactgtgttggatgagtgacagatgattgtccagactaggacagcggcatgaacatgactttggttgggattgtggatagttaggggtactctgaatcgtgtagtttatgagagcaagtgtgcaagt

SEQ ID NO: 1082 - DNA, 377 bp, Homo sapiens
ttcaaaacaaaatgccaaagaagagagaaacaaaatagcaataacaaaagaagctttgtccttatcctagaaaaggtgattttaatactactccttgaagagtgtaagctgttgtaactaagctgacaacagcaagatctgattgttcaaatgaatactctcaaagcacctttggactacaagataagaacattgaatattttagttattttgttgtgtaaaaaaagcagaaggcaagaattagccaaagttgtacagaacatatttcagtacacagtattcactatgtatgaatgaatgcatatagtggtactatggtcttttgaagctggagatagggaaatttgatacagcaccggggggcctctagtgtcaaa

SEQ ID NO: 1083 - DNA, 170 bp, Homo sapiens
tctgaacgcccccagaaaatttgtgccaaaagagtttagaaaattaaatatacaataaaagtaaacacatacacacaaaacagcaacttcaggtaactattttggattgcaaacaggataaattaaatgttcaaacaatctgataaaataaccatttggagactgaaaaa

SEQ ID NO: 1084 - DNA, 158 bp, Homo sapiens
ggtttatgtttatgcagttcataattttgcagtttagtttgtgtgggttagtggccctactgttcaactggatggcaaatctgtgctaggaggataccatatgcacaagtattttcttaaataatgttggcgtttgcactggtgttaggggaaaaaaa

SEQ ID NO: 1085 - DNA, 208 bp, Homo sapiens
tgttgagcctttttggcctggcttgttttgcaaaggccctggcaacggtcaacattgggagcctcatcttcaatgtaggggccggtggaccttgctccagcagcttggtgctcgaccacaggaggtcctccccctccacttcttcttctccacttgaggagaagaaagttgagcaaagaaagaagattcgaggagtctttatgatgac

SEQ ID NO: 1086 - DNA, 219 bp, Homo sapiens
ggagcctcatctgcaatgtaggggccggtggacctgctccagcagctggtgctgcaccagcaggaggtcctgccccctccactgctgctgctccagctgaggagaagaaagtggaagcaaagaaacgaagaatccgaggagtcttatgatgacatgggctttggtctttttgactaaacctcttttataacatgttcaataaaaagctgactttaaaaa

SEQ ID NO: 1087 - DNA, 228 bp, Homo sapiens
gcagagagggaattgcatgtttgtgttgtatatttagtatgaacttttttcagaatataatatttcttagttatcaaagtagttggaaaacatttggcaagactatgaacatagaattgactgacttttatattttaactacagattggtgaatttcactgaccttatattatttatttctgaaacaaaagaggcatttttcaataaaactactgaaatttgaaaaaa

SEQ ID NO: 1088 - DNA, 192 bp, Homo sapiens
gtcacaccggagcctggggcaagacagtgattgaatacaaaaccaccaagacctcccgcctgcccatcatcgatgtggcccccttggacgttggtgccccagaccaggaattcggcttcgacgttggccctgtctgcttcctgtaaactccctccatcccaacctggctacctcccacccaaccaactttcc

SEQ ID NO: 1089 - DNA, 258 bp, Homo sapiens
gctgagtcacgtgcatatccagtccatgctgcgtcgctggttcgtggagacggagggggctgtcaaggcctacttgtgggacaacaaccaggtggttgtgcagtggctggaacagacctggcaggcaggggatggcccgcgctccaccatccgtgagaacatcacgtagccttaagcacgactctgtcctcaagaccatccgaggcctgtttgaagaaaccccgaggtcgccgtggactgtgtgatataccttaggca

SEQ ID NO: 1090 - DNA, 168 bp, Homo sapiens
ctcctgagcgcaagtactccgtgtggatcggcggctccatcctggcctcgctgtccaccttccagcagatgtggatcagcaagcaggagtatgacgagtccggcccctccatcgtccaccgcaaattgcttcttaggcggactatgacttagttgcgttacacccttt

SEQ ID NO: 1091 - DNA, 228 bp, Homo sapiens
caggtcgacactagtggatccaaagaattcggcacgaggcagattacatgcgctacttaatggaagaagatgaagatgcttacaagaaacagttctctcaatacataaagamcagcgtaactccagacatgatggaggagatgtataagaaagctcatgctgctatacgagagaatccagtctatgaaaagaagcccaagaaagaagttaaaaggaggaggtggcacc

SEQ ID NO: 1092 - DNA, 274 bp, Homo sapiens
gtcgaagcgaaggacgtggtggggtcctcttggtgcgaaattccggatttcctttgggtctctccggtagagctgtaatcaattgtgctgacacacagagccaaaaacctgtatatcatctccgtaaggggatcaaggggcggctgaacagacttcccgctgctggtgtgggtcacatggtgatgccacagtcaagaagggcacccagacctcagaaaaaggtccatccgacagtggtcattcgacaccaaagtatccgtagaaaagttggcgt

SEQ ID NO: 1093 - DNA, 298 bp, Homo sapiens
ctagatgaacggcgcaaaaggaggcaagaagaatcggagaaagttcgaaaacctgaagatccagaagaatgtccagaggaggtttatgaccctcgatctctatatgaaaggctacaggaacagaaggacaggaagcagcaggagtacgaggaacagttcaaattcaaaaacatggtaagaggcttagatgaagatgagaccaccttccttgatgaggtttctcgacagcaggatctattataaaggcaccgagagaaggaggactcaaagcactcgagggatacagaaatacctcaag

SEQ ID NO: 1094 - DNA, 261 bp, Homo sapiens
aatggagtgcctactgcatgccagcaacagggcttggcctgggggaattgggaggaaccaagccctcttcatctgttcatgtgcccagcatttattaagcacctgctgtatgcaaggttcccatgttacggcagtgaatgaggcataattgttccctccatcagcgattgattcagtcatcaggcaggttactgatcagattaagaatcaggcactaggtgatacacattcatttttaaaattcattcaggggtttataaa

SEQ ID NO: 1095 - DNA, 292 bp, Homo sapiens
gcaactttgtcctccctacatgtttgcacatacatatcattctctgtcatgggaattcaagtctgtgtaccttcccatctacactcaaatttgaggttgtcaaagatggaagaatgtatatgtaccagttctaaaaattctgtctcagccataaccatttgatgttctttttccagagataagctttgccaaggcatacatatgataatttgtgagagtatataattcagcatatttggagatgaggaaatgagacttaggataaataactttaagtgcaccagctaagagg

SEQ ID NO: 1096 - DNA, 281 bp, Homo sapiens
ctgagacggggtgggaaggatggatccccaaagcctgggttcttggcctcagtgattccagtggacaggcgtccaggagctccaaacctgtagaggacccaggagggcttcgggcagattccacctataattctgtcttgctggtgtggatagaaaccaggcaggacagtagatccctatggttggatctcagctggaagttctgtttggagcccatttctgtaagaccctctatttcaaatttgcagctgaaaggtgcttctacctctgatttcacccca

SEQ ID NO: 1097 - DNA, 291 bp, Homo sapiens
ctcgagtttttatcatattttgtgtccatgcaccatttttcttaaaatggcttacaaaaaagaatgtaaacaatttgtgatctggccagttgtacttttagctcccagaggggagttggtggtattatgagttgagtaaaaaccatccaggggaacttgagggagcagtctgttgccagtaatgttcctcgtgtgccattaaaccacctccagatgagtggaggaacatcactttttaattttttaattgtatttggattgttgccgtgtactaagaccttgactaaataa

SEQ ID NO: 1098 - DNA, 231 bp, Homo sapiens
taacactcttatcctaccttggccgtggatttaaacgtcatccattagcctaatacaacgttgctgaaagccaaatttttctacactatatgcttcaaacccaagaaagtactggagctgactaataagggagtcattagcagtacacagctgctacaaagagcctgaacaaagtaacacaaaattatcaggagaaatgttttacacagaacagatgtagcagagtttaga

SEQ ID NO: 1099 - DNA, 288 bp, Homo sapiens
attggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtgggctgaatgttctgacattaacagttttccatgaaacgttttattgggttt

SEQ ID NO: 1100 - DNA, 357 bp, Homo sapiens
ctcgtgccgaattcggcacgagttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgacccagctggctaacaggcttgtctgcctggttttcc

SEQ ID NO: 1101 - DNA, 360 bp, Homo sapiens
gtttaagtcctgtaatgcaggcctgtaaggtggagggttgaaccctgtttggattgcagagtgttactcagaattgggaaatccagctagcggcagtattctgtacagtagacacaagaattatgtacgccttttatcaaagacttaagagccaaaaagcttttcatctctccagggggaaaactgtctagttccctttctgtgtctaaattttccaaaacgttgatttgcataatacagtggtatgtgcaatggataaattgccgttatttcaaaaattaaaattctcattttctttcttttttttcccccctgctccacacttcaaaactcccgttagatcagcattctactacaaga

SEQ ID NO: 1102 - DNA, 195 bp, Homo sapiens
caaaaattaaagtgattgaaggcagtcttcagcctattatcaaaactgaaggacccacactaacaaaagtcaaaattgaaggtgaacctgaattcagactgattaaagaaggtgaaacaataactgaagtgataccatggagagccaattattaaaaaatacaccaaaatcattgatggagtgtctctcgagaaa

SEQ ID NO: 1103 - DNA, 355 bp, Homo sapiens
cacctgtgctcaggatgcagccctgggatccagcacccatggaagcttctgctgggatggtgtcacctatgggttttgaaccagtgtggtatggtccttgggagctctgctctgagcttgccacactgctgagagcacccactgtcctgaccagagtctcagtggtccctgacccccaatgtgggcaggggctgggcaggagggtggggtctgctgttggttcagaggactccacctcctggctggtttacctgctgctgcccattttctctgggtactgctggcagaggactttagcctacccctgaagagctgtcatgtaattttcctactgcatagatacctaaggccaggg

SEQ ID NO: 1104 - DNA, 340 bp, Homo sapiens
gaggcgtgcgccgccaatatgcactgtacattccacaagcattgccttcttattttacttcttttagctgtttaactttgtaagatgcaaagaggttggatcaagtttaaatgactgtgctgcccctttcacatcaaagaactactgacaacgaaggccgcgccttcctttcccatctgtctatctatctggctggcagggaaggaaagaacttgcatgttggtgaaggaagaagttgggttgaagaagttgggttggacgacagttaaatctagagttaaaccaagcttgcccaaggtgtcctgcaggctgtaatgcagttttaatcagagtgccattt

SEQ ID NO: 1105 - DNA, 321 bp, Homo sapiens
cggcacgaggtggcgaatgatcacagcaatgaacaccatccgaagcggggcaggcgtctgcgtcctgcacaactgtatctatgctgctgggggctatgatggtcaggaccagctgaacagcgttgagcgctacgatgttgaaacagagacgttgactttcgtagcccccatgaagcacccgcgaagtgtcccttgggatcactgttccaccaggggagaatctacgtccttcgaggctattatgggtcacacagctccttgacacatgtgtgagtgttaccgaccccgatacagacacctgcgcagcgcggtgacccgcat

SEQ ID NO: 1106 - DNA, 266 bp, Homo sapiens
gttttaatatattattcttcaacgacattttttgtaactttacacttttttggttattttattttaaaaaaatgaaaaattaatttaaaaaaatgcaaaaaactgttggattatttattttagaaattcccccctttgtgttggactgcaacttgagtttctttctctttaggcctttcacaactaggactgagaatgtatgtaaaagttctgtgacagtacagaaggaaaacaacttttttatgtatagcttctaaaaggggaaa

SEQ ID NO: 1107 - DNA, 280 bp, Homo sapiens
ccccgggccaccgccgagtgacgccaaagccctggttgactctgacagccccgtgggtgtgtgggaggccgggcgctctggggtctgtctgtcagtgcaatcgtttagtgttttttcagtcgggcggggcgggaagcgggttggacccggcagccagttctcaaaggctgttgggccgactggaggccacagcccctcacccctagacgttgccaaccagaactgacgtgtgactcctgggtgttgatgccattaaaaccaacgttggtgcccggtaaaa

SEQ ID NO: 1108 - DNA, 337 bp, Homo sapiens
ccgaagtcatatatagggctagtaagtggtgggattccaattcagttttgactcactgcagttaaactcaattacccaacctgatgataaacaatgggtctaatacttgtaaatacatttggtagaatattaattgactttacttatttatttatgtgagacactctctctctattgcccaggctggagtgcagtcgcgcagtctcagttcattgcagcctccaccgcctggattcaagcgattctgcctcaacctcctaagtagctgggattgcacgcatgcaccaccacgcccagttaatttttgtatttttagtagagacagggtttcgccatg

SEQ ID NO: 1109 - DNA, 325 bp, Homo sapiens
attttctggtacccgtgtttcatttaattactttgttgctttctctccctccctgagttcaattaagttgagaaaagtgttcattgttattactgatggattagactttatttgctcttcattgaatgtttcagttaatttacagactagtaaattatctgagtcatcaaggttatgtacgtgtattgtgggtatctatatacataacgtatagatacgttaatgcaggaggctgaatacttgcaagtcgctttaggatgatttgttatatccctgtggttcctgcttcccaagaaatgttttctgtaattacatcaagtgtctc

SEQ ID NO: 1110 - DNA, 349 bp, Homo sapiens
gaaaccccttggccaagtaagctgtgggcaggcaagcccttcggtcacctgttggctacacagacccctcccctcgtgtcagctcaggcagctcgaggcccccgaccaacacttgcaggggtccctgctagttagcgccccaccgccgttgagttcgtaccgcttccttagaacttctacagaggccaagctccctgggagcccttttggacagcttaggctttacagttcggttaattggccccaagttaattgttttccctcgccataactcccaccaaggtgtctagagacatgatgagcttcgtgtcatcctccggggctcgccacacgattagactcctctgtt

SEQ ID NO: 1111 - DNA, 276 bp, Homo sapiens
taaaaagacaaatgaatggggaaagacaatcattgaatacaaaccaaataagccatcacgcctgcccttccttgatattgcacctttggacatcggtggtgctgaccaggaattctttgtgtgacattggcccagtctgtttcaaataaatgacctcaatctaaattaaaaaagggagggattttgaaaaacctttctcttttgccattcttcttccttcttaattaaccttaaagctgggtccctccatttcttctagcacacttcttcacttaa

SEQ ID NO: 1112 - DNA, 142 bp, Homo sapiens
gtgtgcgctcactgcttgggaagtgcagggggtcctgggcacattgccagctgggtgctgagcattgagtcactgatctcttgtgatggggccaatgagtcaattgaattcatgggccaaacaggtcccatcctcttcaaaa

SEQ ID NO: 1113 - DNA, 310 bp, Homo sapiens
tccagatcccagtctcaccacacatctacaccagtgtcagctgggctgctgccccctccgccgcctgctctctctctccggtccggagccggtcgctaagcttcagcgagccccagcagccagcacctgcgatgaaatctcatctgatcgtcacttctccaccccgggcccagagtggtgccaggaaagcccgaggggaggctaagaagttccgcaaggtgtattgcatcgagcaaccgggaccaagtggtcacaggccttccggttggagaaggcccttcaaaggctctctgtggcactgacgcgtgtc

SEQ ID NO: 1114 - DNA, 300 bp, Homo sapiens
ttaaaggacactttttttctgaatatatgaacactcatctacaagtatactttacctcatagtgacaggttatctgcaaggtgataaaagatagaaccaagatctttagtggaataactgttctccctgagaagttcttatttacattttgtcaatgaaaaaataacagcaaataaaggtaaaatgtctactattctaatgggtcttacttgaaaaggataggtataggtttattctctattgcttgaaaatgaatatgtgaatatattatagacatccagcatctcatgtccaattact

SEQ ID NO: 1115 - DNA, 302 bp, Homo sapiens
ctcgtgccgaattcggcacgagattgtctggagtagtgcaggccctgcgaggccgcctgttgcccagcctggggcccccaggatcaacccggagcccccctggaccccacacagcagtcctggccctggaagatgaggacgatgtgctactggtgccactggctgagccgggggtgttggtagctgaggcagaagatgagccacttcttaccttagagggaccttggggctcttacttagagcctctttcccttggggctcttactcatatgtgtgcacaaccctttagagagtgggtaact

SEQ ID NO: 1116 - DNA, 291 bp, Homo sapiens
actgtgtgtaggggggtttcagggctgaatcccacctccctcccaccttcctcccacctcacctgtcgcacccactgtgaaagttggaatatgtggtctccctggcctcagggctctgactctgccagggtggggctctctaacccacaggtgttggctgcctggcccatgtgcccactgtctctcccacttggtctgggtttggcaggcactggcctgctacttgagggccaaggatgctcccccaggggaggaaacggtatagtgtggggtatgtccaaggctgcatcc

SEQ ID NO: 1117 - DNA, 295 bp, Homo sapiens
gttcaaaggtgattagattaataatttaatagaggatgagtgacctctgataaattactgctagaatgaacttgtcaatgatggatggtaaattttcatggaagttataaagtgataataaaacccttgcttttacccctgtcagtagccctcctcctaccactgaacccaattgcccctacccctccttctaactttattgctgtattctcttcactctatatttctctctatttgctaatattgcattgctgttacactaaaaattcataaagatttagtggtaaggtgccaa

SEQ ID NO: 1118 - DNA, 221 bp, Homo sapiens
gctggaagatggccctaaattcttgaagtctggtgatgctgccattgttgatatggttcctggcaagcccatgtgtgttgagagcttctcagactatccacctttgggtcgctttgctgttcgtgatattgagacagacagttgcggtgggtgtcatcaaagcaggttgacaagaaggcttgcttgagcttgcaaggtcaccaagtcttgcccagaaagct

SEQ ID NO: 1119 - DNA, 376 bp, Homo sapiens
ctggtttgtgttttgctgctgcatttatcccaagaaaaacagctttaatctccagaaggaaaccaaaataccatgggatttatgctgtattgacaacttgcgacctaaacgtacaacatcatagtaatttgtcatgggcaacatgacccaagagagaaggtttttgtccaattggaatttaaatacacattggcacacggctaacctgtgtggggtaaaatttaaacactgtgtttaatcctgcgcgagaaattctctctcacaatataccctgtcgcatatactctggaatagtcgcatacccttttgtgcacactccctttctctcagtgtatatattaaaaagtgttgcgctgcatttgcgcaatgtgtcaaa

SEQ ID NO: 1120 - DNA, 249 bp, Homo sapiens
gttgacctttatttattaaacttcagcaaccctacagtatataagcttttttctcaataaaatcagtgtgcttgccttccctcagggctctttccatactgttaaaactttgtttttgtgatccgcgctctcagagagtcactctgtaaaatctgtgtacacacagatattttgacatatcagatatatgttgcacaggccatagtacatgtttgtgtttagatgaaactctgttgaaaaatcacaaaa

SEQ ID NO: 1121 - DNA, 256 bp, Homo sapiens
cccaaacccacgtccacccgtacgtaccagacaaccttagccaaaccatttacccaaatgaaagtatgaggcgatagaaattgaaacctggcgcaatagatatagtaccgcaagggaaagatgaaaaattgatgacccagcataatatagccaggactctaaccctataaactctctcgcactatatagaatttgaactctagagaatatactcytttgcgacaggagagagcacaagctgctagagcccccgaga

SEQ ID NO: 1122 - DNA, 324 bp, Homo sapiens
cgcatcccaacataggttaagagcaagttgaaaacaaaggccatggcattctgccactgcatccttcagacagttatatcctccttttaaaccattgttgttgagtgtaagatgtccctcatggtttcttattaaggttccagggttaggaatggtaacccttcttaggtatatacagagatcaagtgtgcctttggctcttcacacgatcacatccatacattgtgacactctgtctgtctcgatcacacagacaccaggcatctgtctcaaatggatccttattgtgatgatttgtctgatggctatcagcatctctaatgt

SEQ ID NO: 1123 - DNA, 210 bp, Homo sapiens
  misc_feature 210: n = A,T,C or G
gaaatggcccgcaaggtgattgagcactgcagtaactttaaagaggagaacatggacacgtctagatagaggcctccgtccccatggccgccaccgctctggaccacaggcggggaggaagcatgctcaagcagcccagccggcgggcccctttccgagggagccttccacggagttaagagacatatggggaccttttgcacacacccn

SEQ ID NO: 1124 - DNA, 400 bp, Homo sapiens
tatgagtgcagtgactgtgggaagtctttcactaaaaaatcacagctccaagtgcatcagcgaattcacactggagagaagccttacgtgtgtgctgagtgtgggaaggcctttactgacaggtccaatttgaataaacatcagacaacacacactggagacaaaccctacaagtgtggcatctgttggaaaggcttcgttcagaaatcagtgttcagcgtccatcagagcagccacgcttgagagaaacagtgtgagaaaaccccactgagggttgggtctgattgtacactgttgcatgcatgcagcagaaaaatatgtatattattgtaaatagaatgacccatcagagtgtcacacatggctgttcttgagagggcctctgagaaggcaccttatt

SEQ ID NO: 1125 - DNA, 403 bp, Homo sapiens
tgccgccatggctcctgtgaaaaagcttgtggtgaaggggggcaaaaaaaagaagcaagttctgaagttcactcttgattgcacccaccctgtagaagatggaatcatggatgctgccaattttgagcagtttttgcaagaaaggatcaaagtgaacggaaaagctgggaaccttggtggaggggtggtgaccatcgaaaggagcaagagcaagatcaccgtgacatccgaggtgcctttctccaaaaggtatttgaaatatctcaccaaaaaatatttgaagaagaataatctacgtgactggttgcgcgtagttgctaacagcaaagagagttacgaattacgttacttccagattaaccaggacgaagaagaggaggaagacgaggattaaatttcatat

SEQ ID NO: 1126 - DNA, 403 bp, Homo sapiens
gtcacttgcagccttcattcccactccaatcaagggcttttgtcacaatggatacctgagctaaccattataaaagatatataactagtaaagtcctggcccctgccctcattgtgcctatcccaaggtttggcattcaataagtattcaatctatatttgattaattgatcttccccttgctcaccaggtacaggggatatattccctgaaggcatctttcttccctttactaagcctcactgattatctttaagtttcagcctcacattttgactgtggtctcaacattactgaccaggtccttctccatagtctcctcccacctctgaggatcaaactaaaagcaaggtactcacacttggcccagagagaccatcagcgaaactcctcattcctaaata

SEQ ID NO: 1127 - DNA, 305 bp, Homo sapiens
gtgatcaccattatgcagaatccacgccagtacaagatcccagactggttcttgaacagacagaaggatgtaaaggatggaaaatacagccaggtcctagccaatggtctggacaacaagctccgtgaagaccttgagcgacttaagaagattcgggcccatagagggctgcgtcacttctggggccttcgtgtccgaggccagcacaccaagaccactggccgccgtggccgcaccgtgggtgtgtccaagaagaaataagtctgtaggccttgtctgttaataaatagtttatataccaaaaa

SEQ ID NO: 1128 - DNA, 378 bp, Homo sapiens
ctcgtgccgaattcggcacgagcaaaaaattagccgggcatggtgggtgggcacctgtagtctcagctacttgggaggctgatgcaggagaattgcgttaacccgggaggcggagcttcagttagctgagatcacgccacttcacttccgccttggcaacagagcgagacttcatctcaaacaaacaaacaaaaaaagaatttcagtgagattcaaaagaacacagatagataactaaaaagtttcataatactatatttgaacaaaatgagacttttaatagagaaatagaaaccattaaaagacccaaacagaaatcttggcactaaagtgaacaatgggagagcttaaaaaatgtaacacgttttacacggactc

SEQ ID NO: 1129 - DNA, 396 bp, Homo sapiens
gtgaaacctcgtctactaaaaatacaaaaaattggctgggcgtggtggcgggcgcctgtagtcccagctactcaggaggctgaggcaggagaatggcatgaacccgggaagcaggctttcagttagccgagactgttccacttcacttcagccttggtgacaaagcgagacttcatctcaaaaaaacaaaacaaaacaacaaaacccacaattcttctacaacagagcctacgtattcaccacggtcaagtaaattaccccttaaccccacaccaagtgtagcaaattccaacagtttaaagagagtagggagagaacaccttaattatctctgtactgccagtgacgcacaggtgttaagcctgttaggggatcaagctgcaggggcacatagac

SEQ ID NO: 1130 - DNA, 210 bp, Homo sapiens
gttcgaaagcatcttgagaggaacagaaaggataaggatgctaaattccgtctgattctaatagagagccggattcaccgtttggctcgatattataagaccaagcgagttcttcctcccaattggaaatatgaatcatctacagcctctgccctggtcgcataaatttgtctgtgtactcaagcaataaaatgattgtttaacttaaaa

SEQ ID NO: 1131 - DNA, 378 bp, Homo sapiens
agaaaataaagaggaaaatgcatccttgggctaggctctttccgatctttctctcaacattctttcgatggcagcagctcagagacaatgaggacctatcaatctgcctttctccaattctcctaccccagtcacctaatgttacctaaacccaaaaagggaatatataccacttcaaactcttctcttaacactaattctctcctggcggagctttcaacaaggatgccctccacctctctaagggcacaccacccactctaatctctctgtgcccgagagacctatatgtggcgagaggagaatatagcgctgaggtgtactcttataccatgtgacacgagcacagtgtaatctgtgacacatttaccctataat

SEQ ID NO: 1132 - DNA, 269 bp, Homo sapiens
gcggactatgacttagttgcgttacaccctttcttgacaaaacctaacttgcgcagaaaacaagatgagattggcatggctttatttgttttttttgttttgttttgggttttttttttttttttggcttgactcaggatttaaaaactgggaccgtgtaaggttcaacaattggtttgagccagcattccccaaagttcacaatttgggcccgggctttttttttcacacattttttttttttaaaaggcactccacaattgggattt

SEQ ID NO: 1133 - DNA, 165 bp, Homo sapiens
ttgaaagtctaacttttttttacttatatatttgatacatataattctcttggctttgaaacttgcaactttgagaacaaaacagtcctttaaattttgcactgctcaattctgtttttcgtttgcattgtctttaatataataagagttattaccttacataaa

SEQ ID NO: 1134 - DNA, 150 bp, Homo sapiens
cgcgctgtgggtagtgtgtgaccgtggctgtactgtatagtggaacatagttggcatatctttgttttgaagtttgttggtgactccaccaaactggtgtgaaaaaggaaaaaggctcaaaaaatccacaaaaggacaacacacacaaaa

SEQ ID NO: 1135 - DNA, 224 bp, Homo sapiens
ctcgtcaccttctctgcaagaggagtattgaaaactggtggactgtcagctttatttagctcacctagtgttttcaagaaattgagccaccctctaagaaatcaagaggtttcacattaaaattagatttctggcctctctcgattggtcagattgtgtgcgcaattctgatctgcattttcagaggaggacaatcattgaaactaagtagggggttcttcttt

SEQ ID NO: 1136 - DNA, 232 bp, Homo sapiens
tgcctaccaagactttgagaatcactacaagaaaaactccttgtggtgaaggttctaagacgtgggatcgtttccagatgagaattcacaagcgactcattgacttgcacagtccttctgagattgttaagcagattacttccatcagtattgagccaggagttgaggtggagtcaccattgcagatgcttaagtcacctattttaataaattgatgaccagttgttaaaaa

SEQ ID NO: 1137 - DNA, 263 bp, Homo sapiens
ctgactggaagagtggagagtactggattgaccccaaccaaggctgcaacctggatgccatcaaagtcttctgcaacatggagactggtgagacctgcgtgtaccccactcagcccagtgtggcccagaagaactggtacatcagcaagaacccaaggacaagaggcatgtcttggttcggcgagacatgaccgctggattccagttcgagtatggcggccagggctcccgccctgccgatgtcgccatccagctgaccttcc

SEQ ID NO: 1138 - DNA, 294 bp, Homo sapiens
gtgaggaggacggtctgcatactcgctgcccgccggctccctcccccgcgtccctgcgaccgccgcggcgaagatggcctcaggagtgcaagtagctgatgaagtatgtcgcattttttatgacatgaaagttcgtaaatgctccacaccagaagagatcaagaaaagaaagagggctgtcattttttgtctcagtacagacaaaaagtgcatcattttagaggagggcaaagagatcttggttggagatgttggtcgtcacctaactcatcctttcaagcattttgtgggtat

SEQ ID NO: 1139 - DNA, 289 bp, Homo sapiens
ccgtgatgtggcccctcaggctcctgtgcacttcctggtcattcctaagaagcccattcctcggattagccaggctgaagaagaagaccagcagcttctaggacacctactccttgtggccaagcagacagcaaaggctgagggcctcggagatggataccgacttgctcaatttcagtgatcaacgatgggaagctgggtcacaatctgtgtatcatcttcacattcatgtacttggggccggcagctccagttgcctccaggtggacctgccactgattaaggacac

SEQ ID NO: 1140 - DNA, 152 bp, Homo sapiens
ccggaacggcggttgtccggggcaggggcaggggcttggggccttggccttaaggagccttaggcttaggggcacttccgagagcccctttttggtgataattgtttgcactttttcgtacagggtggcggggccgggagggcctagcgccc

SEQ ID NO: 1141 - DNA, 211 bp, Homo sapiens
ttttaaaagacaaaaacccaactctttgtggattttttatcaactcttttactcagagccactctccaattgcaggtcacactccaattatgatggaagatattttttatacttaattgcagtagggacttattcccagacaaagcaatagtcacgtcttcatggacccactcaatggattgtttttgaagactggcaataaagctgccat

SEQ ID NO: 1142 - DNA, 362 bp, Homo sapiens
gagcttaggtataacatcatcaagtgtgttcacacgcggggtcggtttaatggagtgtccacgcggagataactgcgatattggcacacctgtagagagagattgttctatagggctggaatattacagagttacattctgggaggttctgtttttactcgcatcaaacacccctctgttgttctccatcatctttaatagcaactggagaccactttggtcattggtaagggggtgcattctcctcacaaaggggttttatggacttcctcaggcggagagcttcttaacacacaggcaggatggaaaagactactagccacttttgcttcccacccccttaatgcatccttcattgtctt

SEQ ID NO: 1143 - DNA, 150 bp, Homo sapiens
atgctgtcccttctaactgaacacattctttccatcctggttgggcttctgtactcctattattatgaacctgagttgcttgagtgtttgggctaataatgggtgaagtataggtagacgtacacctacactaacactaaccttggatct

SEQ ID NO: 1144 - DNA, 280 bp, Homo sapiens
gtccatacggcgttgttctggattcccgtcgtaacttaaagggaaattttcacaatgtccggagcccttgatgtcctgcaaatgaaggaggaggatgtccttaagttccttgcagcaggaacccacttaggtggcaccaatcttgacttccagatggaacagtacatctataaaaggaaagtgatggcatctatatcataaatctcaagaggacctgggagaagcttcttctggcagcttcgttcaatttttccattaaaaccctcctgatgtagtttaa

SEQ ID NO: 1145 - DNA, 219 bp, Homo sapiens
gcaggttggagccgctgccgtcgccatgacccgcggtaaccagcgtgagtcggcccgccagaggaatatggaaaagcagagcgacttcggttaagggaaagcgccgagattgacgggctttcctggctgccgcccgcaagcagagggactcggagatcatgcagcagagcagaaaaaggcaaacgagaagaggaggacccaagtagctttgtgcttcgt

SEQ ID NO: 1146 - DNA, 253 bp, Homo sapiens
gtttttttagggtttattcttgaccacagatcttaagaaatggacaaaacccctcttcaatcttaagattagtatggttttggtgttctaacagtatcccctagaagttggatgtctaaaactcaagtaaatggaggtgggaggcaatttagataagtgtaaagccttgtaactcaggatgattttttttagaaagtgtatagaaactattttaatgccaagatagttacagtgctgtggggtttaaagactt

SEQ ID NO: 1147 - DNA, 300 bp, Homo sapiens
tcttggatttttgtaccagagatgtgctaaactgatgaaatacatttgagaagtttccatcttattctctttatatgggactgatgatgtgtgttggggtagactgctcctgcagagtttggaagaagtcaccagcaaagccggcctaaccaagaaaagtcaaggcccttcatgacctttctgggcacagaaaacaccctcgtggagtacactaatttgactggactggtctcagtgtgagcacttggcacactttactaaacacatatccaccccaccgtgagtcaactttaaggtaac

SEQ ID NO: 1148 - DNA, 198 bp, Homo sapiens
tcctggtcctcctggggaacctggccctgcaggtcaagatggtgttggtggtgacaagggtgaagatggagatcctggtcaaccggtcctcctggcccatcttgttaaggttggcccaccaggtcctcctggaaaacgaggtcctccttggagctccaggtccagagggaagacaagtgaaaaaggtctaagggggag

SEQ ID NO: 1149 - DNA, 260 bp, Homo sapiens
agcggcgctgcgaccccatccgcatctccatgtgccagaacctcggctacaacgtgaccaagatgcccaacctggttggcaacgagctgcagacggacgccgagctgcagctgacaactttcacaccgctcatccagtacggctgctccagccagctgcaggctggagttcagtcgcatgatcatggcttactgtggcctcaaccttccaggctcaaggtatcctccagttaagctcctattaaggtgaccagtggcctc

SEQ ID NO: 1150 - DNA, 281 bp, Homo sapiens
cgctacataacaaaccacctcaaaacttagtagcataaacaacaaccattttttgggccactgtcaaggagtcagaagggcaattctctgctctacgacggctaggatgactggattgactcgaggtgactcgaataactgggagttggacagctggggctgaagggtcacttgtaagatggttgttcacttggcaaagagagctggaggctggctcagttgggacttttgaccagagagactcacatgatgtctccagcaccatggcctggtcattggac

SEQ ID NO: 1151 - DNA, 290 bp, Homo sapiens
cggcacgagccatcactctcatcctgtatttttataagacaacacaagagtgcataccagaaattgaatataccatatgggattggagaaagacaaatgtggaaggaaatcatagagctggagactacttttgtgctttacaaaactgttaaggattgtggtcacctggaacaggtctccaatctatgttagcactatgtggctcagcctctgttaccccttggattatatatcaacctgtaaacatgtgcctgtaacttactccaaaacaaaatcatacttattagaga

SEQ ID NO: 1152 - DNA, 176 bp, Homo sapiens
cggcacgagagaagaggaagaagaagaggaagaaacttaaaccagtgatgtggagctggagtttgtccttccaccgagactacgagggcctttgatgcttagtggaatgtgtgtctaacttgctctctgacatttagcagatgaaataaaatatatatctgtttagtctttaaaaa

SEQ ID NO: 1153 - DNA, 250 bp, Homo sapiens
ctgaggtccttgttttgttttgttcataatacaacggtgctaattaatagtatttcagatacttgaagaatgttgatggtgctagaagaatttgagaagaaatactcctgtattgagttgtatcgtgtggtgtatttttaaaaaatttgatttagcattcatatttcccatcttattcccaattaaaagtatgcagattatttcccaaatcttctacagattcagcatttgttcttcgccagcctcattt

SEQ ID NO: 1154 - DNA, 288 bp, Homo sapiens
atttagaagattataacagctgtatttcatatttgcctccttatatatatcaaagaccaaggtatttccttctgcttcaaaagaacaaaattgggaaagaaaactcacttgagtcttgatcaaacaagtgtcttttacttaagaagaaacttggtaatcattgtggcacccacagcaagcagttccttaccagtaaaaagggtgcactgaggtaacatctaaaacagagatgtggttcttaatgtttaacagaacagttcttaatcctgccacgtgttatcattatag

SEQ ID NO: 1155 - DNA, 284 bp, Homo sapiens
tgggcacatgccttttaaaagttctttaagcaacacagagctgagtcctctttgtcatacctttggatttagtgtttcatcagctgtttttagttataaacatttttgttaaaatagatattggtttaaatgatacagtattttaggtatgatttaagactatgatttcacctatacattatatatattttatagagatactaaaccagcatacccttactctccagagtagtgagctaataaacacggttggtttctgaattaaattgaactaaatccaactt

SEQ ID NO: 1156 - DNA, 180 bp, Homo sapiens
aatatgtaccttattctaccactagaaagaagattcaggagtggatcccaccttcaacaccttacaagtaaagacaattaagaacagttgaaacatgcaaaatatggagcttttcatgtaattactcttttactgtttaccattcactataattcacaattaaaattgtgtgactaaaaa

SEQ ID NO: 1157 - DNA, 266 bp, Homo sapiens
cacaactgttgcatgataaattagtctttgtccaagtgaaagcaagtttcctgattaagacaaagcctagccattgccagaagctgcttgaactaactcagctcctaaattgcatttacatccaagagcttgggggttctttctggctgtccaaaattgaaatgttgtcagtgcaaggacacaccatccatcaatttcttctcagaggttcctctctaccttctaggactttgctatggcatttgttggctctcatgctggcctca

SEQ ID NO: 1158 - DNA, 327 bp, Homo sapiens
ataagattacttcagttttgtcactggcacatctcgggtgcctatgaatggatttgctgaactatacggttcaaatggaccacagtcatttacagttgaacagtggggtactcctgaaaagctgccaagagctcatacctgttttaatcgcctggacttgccaccttatgaatcatttgaagaattatgggataaacttcagatggcaattgaaacacccagggctttgatggagttgattagattacaaattaacaatctgtagtgtttttactgccatagttttataaccaaaatcttgacttaaattttccggggactactaaa

SEQ ID NO: 1159 - DNA, 359 bp, Homo sapiens
agatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaggaggaaatccaggagctgcaggctcagattcaggaacagcatgtccaaatcgatgtggatgtttccaagcctgcacctcacggctgccctgcgtgacgtacgtagcaatatgaaagtgtggctgccaagaacctgcaggaggcagaagatggtacaaatccaagtttgctgccctctctgagctgccaccggaccaataccgccctgcccaggaaa

SEQ ID NO: 1160 - DNA, 245 bp, Homo sapiens
ggccgctactccgccctgttcctcggtgtggcctacggagccacgcgctacaattacctaaaacctcgggcagaagaggagaggaggatagcagcagaagagaagaagaagcaggatgacctggaaacggattgccagagaattggcagaagatgacagcatattaaagtgagtgaccctccgacccactctttggaccagcagcggatgaataaagcttcctgtgttgtgtgataaaaaaaaaa

SEQ ID NO: 1161 - DNA, 181 bp, Homo sapiens
cttgcagagggtgggggtctcagggtcttaggtgatacgggagagaaagaacgtgccaggcaggaggcccctgaagtctgtgtactccgaggtggatctccatccccatccacctgtacggacatcttttccgttgcggtttgagaatgttcctataataaacccctctgctttgtaaaaa

SEQ ID NO: 1162 - DNA, 294 bp, Homo sapiens
aagtaacaaatgaagacttcaaaaaatctaaagaaaatgttctttataagaaacaggaaggcacccctgagggctgtatctctaatgaaccatggctgtcatcaggaaaatggttgggagatttctcaatccctgaaagattgaggttgggggagttcccagacgaatccctgttcccactgatttttattagcaaacatcctgtgtctttggagtacgatgtgtaagttcccattggtggcctgttggtcactgtcagcagtctgcttccaataaagcgtgctctttaaaaaa

SEQ ID NO: 1163 - DNA, 264 bp, Homo sapiens
ctttctcgattccgtgggtggtggtgcatggccgttcttagttggtggagcgatttgtctggttaattccgataacgaacgagactctggcatgctaactagttacgcgacccccgagcggtcggcgtcccccaacttcttagagggacaagtggcgttcagcacccgagattgagcaataacaggtctgtgatgcccttagatgtccggggctgcacgcgcgctacactgactggctcagcgtgtgcctaccctacggccggc

SEQ ID NO: 1164 - DNA, 289 bp, Homo sapiens
ggcgcagacggggaagcggagccaacatgccagttgccccggagctgggtttgtcgcaaaacttatgtgaccccgcggagacccttcgagaaatctcgtctcgaccaagagctgaagctgatcggcgagtatgggctccggaacaaacgtgaggtcttggagggtcaaatttaccctggccaagatccgcaagcccgcccgggaatcttctgacgtttatgagaaggacccacggcgtcttttcgaggcacgccttctgcgcggctggtcccattgggttctgatgagg

SEQ ID NO: 1165 - DNA, 281 bp, Homo sapiens
caggactcaaaatggcgtcagttgtaccagtgaaggacaagaaacttctggaggtcaaactgggggagctgccaagctggatcttgatgcgggacttcagtcctagtggcattttcggagcgtttcaaagaggttactaccggtactacaacaagtacatcaatgtgaagaaggggagcatctcggggattaccatggtgctggcatgctacgtgctctttagctactccttttcctacaagcatctaagcacgacggctcccaaataccacttaaggagg

SEQ ID NO: 1166 - DNA, 289 bp, Homo sapiens
ctcttccatctctactaacccctgactacaaacagcctccacctatttcacctgacattgtactttatgaaagcagcagttctcagatggggctattttgccccctgggacattagggagtatctggagacacttagggttgtgtctacttggggggagttgtgttactgcatccagtgagtccagggatccagggatgccgctcaacatctgaaatgcacagggcacccccacacatagaacagagaattgctgagccaaatgtcagcggtgtcacagctgacacctg

SEQ ID NO: 1167 - DNA, 185 bp, Homo sapiens
caaaatttttttaatcttcgccttaatacttttttattttgttttattttgaatgatgagccttcgtgcccccccttcccccttttttgtccccaacttagagatgtatgaaggctttggtctccctgggagtgggtggaggcagcagggttacctgtacattgattgagaccagttgataaatg

SEQ ID NO: 1168 - DNA, 167 bp, Homo sapiens
gagcctaaaatttataggaacaataaacgtaaaggccatttatattggagatataaatttaaaactggtaagatttcatttctacatgattaatcatgtagagttgcccttttatcaaaggacttttttgacaatagagacaagttttgtttaaaagcagattttta

SEQ ID NO: 1169 - DNA, 208 bp, Homo sapiens
aaaaatcacattctctgttcagctgttaatgctgggatccatatttagttttataagcttttccctgtttttagttttgttttgggttttttggctcatgaattttatttctgtttgtcgataagaaatgtaagagtggattgttaataaatttcagttttagttctgtaatgtcaagattttaagatttaaaaacgggttggttaaa

SEQ ID NO: 1170 - DNA, 200 bp, Homo sapiens
gagaaactgaacaaaaggctagaggcatgggccaggtaaaaattgggcctagagtgaagactgttctgtcgttaagagctttcgaggaaggagtacttactccccaatgatgatgaatggaaaagtacttttcagggagaattgaaggggttaaagtgttaaatatgttgcctagacaagggttctttaaagaagacagc

SEQ ID NO: 1171 - DNA, 235 bp, Homo sapiens
gcacgtgtggaccatctaatgaaagtgggaaagaataacttcagaccaccgcccaaggtggaatccagtgttgtaaggatagaacctaagaatccaccaccacccatcaattttcaggaaatgggactggtctagtaaggataacctctgttaggaaaaccaagacactctctgctgcatttaaatcaagtgcagtgcaacaactcttggaaaaaagctacagaattcactgttc

SEQ ID NO: 1172 - DNA, 173 bp, Homo sapiens
  misc_feature 157: n = A,T,C or G
cctccctctgtcccgagcctggatcgcagttccaagtccaaggctcggcgggaaagtcctcagcctaggacgccctggagccccccagcccagctgcagcgaaatactggcgcgccccgccccaccatggacggggccggtgatttcgagctgccantattgagcattttttt

SEQ ID NO: 1173 - DNA, 500 bp, Homo sapiens
cctccctctgtcccgagcctggatcgcagttccaagtccaaggctcggcgggaaagtcctcagcctaggacgccctggagccccccagcccagctgcagcgaaatgctggcgcgccccgccccaccatggacggggccggtgatttcgagctgcctttattgagcatttctttgaccctccctcacccaccaaccaccaaatcactgtgacatcttggctattatacacttcctgatctagaatgagctcgaaaggagaggctaacccccgcccccagtacagtacttggcaaatagtatgttgatccttaaaacttcttgcccttttatctctcgtaacagacctagggctagacccctgaccccatctgttattcagggcactgacattttctacaagcccactaacctttggaggatgtgtccagagggagcctaactctggcttttttaaaaataacgctaataagaaagcctttctaatcctttggactactttc

SEQ ID NO: 1174 - DNA, 115 bp, Homo sapiens
ttcgttatcgtggaggcccctggcacggggattctacaaggaatcatgtctcgaaggtagctgctacagccaacttttgctcggctataagcggggtcccggaaccaaagggagc

SEQ ID NO: 1175 - DNA, 114 bp, Homo sapiens
cagaactccgttttattccggcattttgcagaacgttacagcttggactagtaactaggaatcggaggggctcaaccaggaaagccatcaaatcaaaagacgccaagcccaatt

SEQ ID NO: 1176 - DNA, 559 bp, Homo sapiens
cagaaatcagctctattgacgaattctgccgcaagttccgcctggactgcccgctggccatggagcggatcaaggaggaccggcccatcaccatcaaggacgacaagggcaacctcaaccgctgcatcgcagacgtggtctcgctcttcatcacggtcatggacaagctgcgcctggagatccgcgccatggatgagatccagcccgacctgcgagagctgatggagaccatgcaccgcatgagccacctcccacccgactttgagggccgccagacggtcagccagtggctgcagaccctgagcggcatgtcggcgtcagatgagctggacgactcacaggtgcgtcagatgctgttcgacctggagtcagcctacaacgccttcaaccgcttcctgcatgcctgagcccggggcactagcccttgcacagaagggcagagtctgaggcgatggctcctggtcccctgtccggcacacaaggccgtgtcatccacacaactcactgtctgcagctgctgtctggtgtcgtccttggtgtcagaactttgggggccggg

SEQ ID NO: 1177 - DNA, 106 bp, Homo sapiens
cgaagtctctgcgggtaccggagcagcagattttgccgcctttcggccaccttcctgtttcagaaccttagttccatctcttcgcgacgagcccactggtagacgt

SEQ ID NO: 1178 - DNA, 510 bp, Homo sapiens
ggacagtatctgtgggtacccggagcacggagatctcgccggctttacgttcacctcggtgtctgcagcaccctccgcttcctctcctaggcgacgagacccagtggctagaagttcaccatgtctattctcaagatccatgccagggagatctttgactctcgcgggaatcccactgttgaggttgatctcttcacctcaaaaggtctcttcagagctgctgtgcccagtggtgcttcaactggtatctatgaggccctagagctccgggacaatgataagactcgctatatggggaagggtgtctcaaaggctgttgagcacatcaataaaactattgcgcctgccctggttagcaagaaactgaacgtcacagaacaagagaagattgacaaactgatgatcgagatggatggaacagaaaataaatctaagtttggtgcgaacgccattctgggggtgtcccttgccgtctgcaaagctggtgccgttgagaaagggggtcccctg

SEQ ID NO: 1179 - DNA, 114 bp, Homo sapiens
cactgcagcctcaacttcccaggctcaagtgatcctctcatctcagcctctccagtagctgggactacaggcatgtgccgtcacgtccaactaatttattttaatttaatttaa

SEQ ID NO: 1180 - DNA, 279 bp, Homo sapiens
caaggcagagtttaaagtgaggaattttatatttaaagaactttttggttggataaaaacataatttgagcatccagttttagtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggtttccatgtgattcccctttcatatgatcttctaagttga

SEQ ID NO: 1181 - DNA, 292 bp, Homo sapiens
ctcgtccaatatcggcacgggggttaagttggggaccgccgttcagtcgccaatatgcagctctttgtccgcgcccaggaaaaacacaccttcgaggaaaccggccaggaaacggtcgcccagatcaaggctcatgtagcctcactggagggcattcccccggaagatcaagtcgtgctcctggcaggcgcgcccctggaggatgaggccactctggccagtccggggtggaggccctcactaccctggaagtagcaggccgcattcttggaggtaaagtccatggttccct

SEQ ID NO: 1182 - DNA, 211 bp, Homo sapiens
aagcggctccccattttataccaaaggtgctacatctatgtgatgggtggggtggggagggaatcactggtgctatagaaattgagatgcccccccaggccaccaaatgttcctttttgttcaaagtctatttttattccttgatatttttctatattttttttttttggggagggggccttgtgaattttcctaaagggtctattaaaca

SEQ ID NO: 1183 - DNA, 215 bp, Homo sapiens
gttatttcttgccttctgttagcttttgaatttgtttgctcttgcttctctagttcttttaattgtgatgttagggtgtcaattttagatctttcctgcattctcttgtgggcatttagtgctataaatttccctctacacactgctttaaatatgtcccagagattctggtatgttgtgtctttgttcttgttgggatccaaagaacatctata

SEQ ID NO: 1184 - DNA, 246 bp, Homo sapiens
tacagattttgctttctgtggaattgaaaattcacacaaattcacagcttaaatttcccatcagtgactggaggaatttttttcaggagcttcctatattaccatccctcatgcatattaactctttagaatattaggttaagtgatgtctatagaagtagcctggaaaaccatgagttttggagttcagtgaccccctgcttcctctgctcctccttccaaggcattgaggctgaatgtgccact

SEQ ID NO: 1185 - DNA, 190 bp, Homo sapiens
cttttgtttgccacaaaaatcttcatttgtaaaatgaggatatttggataagccacatttcagggcaataaaaagtgtgtgtgtgtgttttatatgcatatacgatgtatataccaatattatacacacatacatatttatgtgcatgtaagtattattttatatagagatatacagatacatagataaa

SEQ ID NO: 1186 - DNA, 103 bp, Homo sapiens
ttgttgggcgtcgctctaagcagagatgtgcccaagagacgaaaagtcgctgagtcgatcactctaggcttcaatctgagtattaaaagttgaagtacgtcct

SEQ ID NO: 1187 - DNA, 101 bp, Homo sapiens
gatagattgttgacgttgcctttctttataacaactttctaatccacaaaaattactcatatttctctgtcatctgtcaccgtcagtacacaaatcagcta

SEQ ID NO: 1188 - DNA, 369 bp, Homo sapiens
gatcaagaatttggtgtggacgttggccctgtttgctttttataaaccaaactctatctgaaatcccaacaaaaaaaatttaactccatatgtgttcctcttgttctaatcttgtcaaccagtgcaagtgaccgacaaaattccagttatttatttccaaaatgtttggaaacagtataatttgacaaagaaaaatgatacttctctttttttgctgttccaccaaatacaattcaaatgctttttgttttatttttttaccaattccaatttcaaaatgtctcaatggtgctataataaataaacttcaacactctttatgataacaaaaaaaaaaaaaaaaaaaaaaaaaaaaaaaaaaaaaaaaaa

SEQ ID NO: 1189 - DNA, 101 bp, Homo sapiens
ctccatctacacagatgtcttagagtttgacgatggcaacccagctaccatgtgccagatagccaaggatgtgtgcaccttcctgcgctgggcattgctga

SEQ ID NO: 1190 - DNA, 316 bp, Homo sapiens
ctcactttccaccctctctccacctgcctctggcttctcaggcctctgctctccgacctctctcctctgaaaccctcctccacagctgcagcccatcctcccggctccctcctagtctgtcctgcgtcctctgtccccgggtttcagagacaacttcccaaagcacaaagcagtttttccccctaggggtgggaggaagcaaaagactctgtacctattttgtatgtgtataataatttgagatgtttttaattattttgattgctggaataaagcatgtggaaatgacccaaacataaaaaaaaaaaaaaaaaaa

SEQ ID NO: 1191 - DNA, 103 bp, Homo sapiens
ctattcacctttcactcttgctttagcttctctcgactctctctctgaacctctcacagatgcagcatctacgctcttctagtctgtctgcgtctctgtcccg

SEQ ID NO: 1192 - DNA, 100 bp, Homo sapiens
gatgggcatctctcgggacaactggcacaagcgccgcaaaaccgggggcaagagaaagccctaccacaagaagcgggaagtatgagtttggggcgccgct

SEQ ID NO: 1193 - DNA, 109 bp, Homo sapiens
atttagagataatccctggagaaatgtcatgggatcaacagagatcttgtttaatatgtactgtacgactgatatcatatacatgaggatcatgttctgtatcaatctg

SEQ ID NO: 1194 - DNA, 325 bp, Homo sapiens
atttttggagaataaatccccttggaggaaaatggtccatggggtatacaaaaagagtatctttgttttcactcatgtacttgtacctgtctggattattcattattacatgaagtatcatgtttctggtgatacaattctggagactggagaagtaattccaccaatgaaagaatttcctgatcaacatcattaaagattatgtaaaaagttaaaaggcttatgagcctaagtttgttcctatattaccatatttactgaattttctggaaaagtaactttaataaagtttaatctcagaaattgtcaaaaaaaaaaaaaaaaa

SEQ ID NO: 1195 - DNA, 118 bp, Homo sapiens
gaggaacgggagtaaccgagagcgtagtaaccatcatgagcctcctcaacaagcccaagagtgagtatgaccccagaagagctgccagaagcgaggaggaggagggattttaacaacc

SEQ ID NO: 1196 - DNA, 323 bp, Homo sapiens
gccaagtattaagtactgttacatctaaaatacagaatgtcaaatggttgcatagcttgtttcccacaacaaggaggaaaagaacaggaatacaaactctgtaatatgctgataaagaagccttagaactgccaactggcttgatggttcaattagtaagctaatttctcccacaccccctccttggtttttagactaattttcccaaagcaaggtttagtcacacaaacttgaaagtacatttaaaatgttctgagttgtcatcctacttttattgcctatggattatgctaatttctaaaaaaaatacgggggaggcacaa

SEQ ID NO: 1197 - DNA, 367 bp, Homo sapiens
gccaagtattaagtactgttacatctaaaatacagaatgtcaaatggttgcatagcttgtttcccacaacaaggaggaaaagaacaggaatacaaactctgtaatatgctgataaagaagccttagaactgccaactggcttgatggttcaattagtaagctaatttctcccacacccgctccttggtttttagactaattttcccaaagcaaggtttagtcacacaaacttgaaagtacatttaaaatgttcttagttgtcatcctacttttattgcctatggaatatgctaatttctaaaaaaaatacgggagaggcaccaaacccctaaattctagtgcaataatttaaaaaaaaaaaaaaaaa

SEQ ID NO: 1198 - DNA, 307 bp, Homo sapiens
gtgtgtaaggatggtagagtgatatatagtgttagctggtaccttagtccaatgtgtgccattaatgagggaccccactggggttggggtcaatctctcctagccaagcagttacattgttataggctgggaggggggtgtcgtatcagtaacagggcagaggaaggcagatctaacagatgagcccaatagagtttagcaggtacgttttgcaggcaagaacagagcataaaattgatcaataccctatgtgagatgcaatgtacaacagagagcatggcaagggacaaatatctggggtgaatgg

SEQ ID NO: 1199 - DNA, 208 bp, Homo sapiens
cggagcggaaggcttgggtgcggttcaagattcagcttcacccgtaacccaccgccatggccgaggaaggcattcctgcttggaggtgtaatggacgttaatactgctttacaagaggttctgaagactgccctcatccacgatggcctagcacgtggaattcgcgaagtgcccaaaggcttagaacaagcgccaagcccatctttgt

SEQ ID NO: 1200 - DNA, 101 bp, Homo sapiens
tagtagctaccctttcagctcatttgcagcaagttttacaaggccgttattgaatatacgcacatttaacccccaggccaaagcttgcaacacaacacatg

SEQ ID NO: 1201 - DNA, 129 bp, Homo sapiens
cacccttcaggggatgagaagttttcaaggggtattactcaggcactaaccccaggaaagatgacagcacattgccataaagttttggttgttttctaaaaaaaaaaaaaaaaaaaaaaaaaaaaaaaa

SEQ ID NO: 1202 - DNA, 102 bp, Homo sapiens
gtagcgtattagctgttcaaattacgcaaggatgttgccaatgattgcgtttgcggcaaagaagcagaaaagagcatggcttcataagcgcggctctgcaac

SEQ ID NO: 1203 - DNA, 578 bp, Homo sapiens
ggaagaagaaaaggattataaaggccctaatccaagagagcttttggagccactatttaaacaaagcagttgttcctacagaattgagtcttattggacttacgaagtatgtcatggaaaacacattcggcagtaccatgaagagaaagaaactggtcagaaaataaatattcacgagtactaccttgggaatatgttggccaagaaccttctatttgaaaaagaacgagaagcagaagaaaaggaaaaatcaaatgagattcccactaaaaatatcgaaggtcagatgacaccatactatcctgtgggaatgggaaatggtacaccttgtagtttgaaacagaaccggcccagatcaagtactgtgatgtacatatgtcatcctgaatctaagcatgaaattctttcagtagctgaagttacaacttgtgaatatgaagttgtcattttgacaccactcctgtgcagtcatcctaaatataggttcagagcatctcctggtgaatgacatattttgtcaatcactgccagggtctccatttaaggcccctcaaccctgaggcaactgggagcaagca

SEQ ID NO: 1204 - DNA, 139 bp, Homo sapiens
gagctcgaagccatggccagatgccacctacggcactggttctgcatcacgggcctcagcagtttctgagctgagtcctcgggagcgaagccagcctctcaaaagcccccctacagtctgtggttgtgaggcggcgtca

SEQ ID NO: 1205 - DNA, 129 bp, Homo sapiens
cttcggcacgaggtccatttaaactcattatcttaaactgtgcttgtcaacttattgacttattcatcagacaaatatcctcttgagtaactactgtactgtcactgttctagacatggaaaggataat

SEQ ID NO: 1206 - DNA, 468 bp, Homo sapiens
gagctcgaagccatggccagatgccacctacggcactggttctgcatcacgggcctcagcagtttctgagctgagtcctcgggagcgaagcccagctctcaaaagccccctccagtctgtggtggtgaggcggcggtcaccccgtcctagccccgtgccaaaacctagtcctccactttccagcacatcccagatgggctcaactctgccgagtggtgccgggtatcagtctgggacacaccaaggtcagttcgaccatggttctgggtccctgagtccatccaaaaagagccctgtgggtaagagtccaccatccactggctccacatatggctcatctcagaaggaggagagtgctgcttcaggaggagcagcctatacaaagaggtatctagaagagcagaagacagagaatggaaaagataagggacagaaacaaacaaataccgataaaaaaaaaaaaaaaaa

SEQ ID NO: 1207 - DNA, 145 bp, Homo sapiens
gtccatttaaactcattatcttaaactgtgcttgtcaattattgatttattcatcaaacaaatatttcttgagtaactactgtatgtcactgtgctagacatggaaagtataatatttgtgagaagaactaaattcaataaggat

SEQ ID NO: 1208 - DNA, 499 bp, Homo sapiens
gtccatttaaactcattatcttaaactgtgcttgtcaattattgatttattcatcaaacaaatatttcttgagtaactactgtatgtcactgtgctagacatggaaagtataatatttggagaaaaactaaattcaataaggatttttttttagttcagccgtggaaaatatgcaaaaagtgttttttatgagcgaattttacataaaagcaacccattgtcataatgtgccttttacatcttcttcctcagacatcagtgaaatttttaggcaaaaaatagagcttgtcttcacttggtcatgtttttttcacaagacagtttcttttgaaagaaaaaatgaaagataatagagataagagcaaaaatgcttgtcttaaaattgctgtccatcaggctctcttttatgacctggagaatggaacttttaatactatagtactaagagttgaccagtggcaataagaacagtgttatgcattgtacaatatactaggta

SEQ ID NO: 1209 - DNA, 103 bp, Homo sapiens
ctcgtgcagatgcgggcagcttgggccacgcatgacgatgacactcgcacgcgtacaccacagcaggtctgacagcgagagggtcattggctcgcctagtaga

SEQ ID NO: 1210 - DNA, 140 bp, Homo sapiens
gaccatttctgtgcctcaagaataaaagcgttgcagctgtggaaggagatagaaactcgacatcctggattggctgatgttagaaatcagataatatttgctgttcgtcaaggatatgtcgagcttggagatcagctcct

SEQ ID NO: 1211 - DNA, 161 bp, Homo sapiens
ctgtcaaattggcaggaaaacagagagaattcatggtgctgaagctggtgttcttgcttctttttcttgagcaatataaccagtttttacttagtttgatttatattctgggcaaggaagcgttgctactttatttgcacaatcccttgttctgtcggtag

SEQ ID NO: 1212 - DNA, 149 bp, Homo sapiens
cacatcctagcaccgagctgcagacagaatttccacctcatacataaggcatcagtcttcaagtccgaggctcgttaaggaacagtttccttgagacaattctacttgtaccttaccaattagggtatccagtatctccgtgattacct

SEQ ID NO: 1213 - DNA, 120 bp, Homo sapiens
ctcaccaggaggagtcgtgcacatgacacgaccagctgcttggttacatgctcatgctgattcgggcacgttcctgtacacgtcacgatgacgcttcggctcatttttgctaccggcaac

SEQ ID NO: 1214 - DNA, 520 bp, Homo sapiens
gtggtgctcaaccagggaagggagatcgtgcagacaatgaacagcgacccaggcctggctgtgggttacactgccttcaatggcgtggacttcgagggcacgttccatgtgaacacggtcacggatgacgactatgcgggcttcatctttggctaccaggacagctccagcttctacgtggtcatgtggaagcagatggagcaaacgtattggcaggcgaaccccttccgtgctgtggccgagcctggcatccaactcaaggctgtgaagtcttccacaggccccggggaacagctgcggaacgctctgtggcatacaggagacacagagtcccaggtgcggctgctgtggaaggacccgcgaaacgtgggttggaaggacaagaagtcctatcgttggttcctgcagcaccgggcccaagtgggctacatcagggtgcgattctatgaggggcctgagctggtggccgacagcaacgtggtccttggacacaaacaatgcggggtgggccgcctggggg

SEQ ID NO: 1215 - DNA, 180 bp, Homo sapiens
caaggatgtcctgagtgtggccttctcctcttgacaacccggcagattgtctctggatctcgagataaaaccatcaagctatgggaataccctgggtgtgtgcaaatacactgtccaggatgagagccactcagagttggtgtcttgtgtcccgtttttggccaacagcagcaacctatt

SEQ ID NO: 1216 - DNA, 100 bp, Homo sapiens
gaggccatagaccgtctgacgacgcagcacagcaggacacgaccgcgcgaactaaaaacaccgcccgggtcaagtcggccgacacaactacgtccgatcg

SEQ ID NO: 1217 - DNA, 534 bp, Homo sapiens
gtgaagggccccagaggaaccctgcggagggacttcaatcacatcaatgtagaactcagccttcttggaaagaaaaaaaagaggctccgggttgacaaatggtggggtaacagaaaggaactggctaccgttcggactatttgtagtcatgtacagaacatgatcaagggtgttacactgggcttccgttacaagatgaggtctgtgtatgctcacttccccatcaacgttgttatccaggagaatgggtctcttgttgaaatccgaaatttcttgggtgaaaaatacatccgcagggttcggatgagaccagcggctttgattcagcaagccacaacagttaaaaacaaggatatcaggaaatttttggatggtatctatgtctctgaaaaaggaactgttcagcaggctgatgaataagatctaagagttacctggctacagaaagaagatgccagatgacacttaagacctacttgtgatatttaaatgatgcaataaaagacctattgatttgggaaaaaaaaaaaaaaa

SEQ ID NO: 1218 - DNA, 116 bp, Homo sapiens
aagtctggtggatctgagctgagaggcactcatgctgtatggaaagacaaggagcaagggcttgccttaaacctgatcttccagagcaaaaggctcttccagagcaaaaagggggg

SEQ ID NO: 1219 - DNA, 202 bp, Homo sapiens
gagccgttgagggcactttccagtccccgaggcggatccggtgttgcatccttggagagagctgagagctcgagtacagaacctctaaggccatcaaaccttttgatcggaagtcagtccatcagatttgctcttggccggtggtacttagtctaagcacttcgggttaagagatagtagggaacagtcttggattctgtgc

SEQ ID NO: 1220 - DNA, 210 bp, Homo sapiens
cacagaatgtgaaggagacatccagaagaattacgagtgtgccaacttcggcgatcagggcatcaccatgggctgctgggacatgtaccgccatgacatcgactgccagtggggtgacatcacttacgtgcccccctggagactacctgtttccaggtggttccttcagcgagagacgggaaaaaaggtttagcacttaagcgggctctt

SEQ ID NO: 1221 - DNA, 125 bp, Homo sapiens
cagcaatggccaagatcaaggctcgagatcttcgcgggaagaagaaggaggagctgctgaaacaacctggacgacctcaaggtggagctgtcccagctgcggtcgccaaagttacaaggcggttc

SEQ ID NO: 1222 - DNA, 130 bp, Homo sapiens
ctcgtccaaattcggcagggggtcgccatggccgccgccccgcccgttgttaccggtattgtaagaacaagccgtacccaaagtctcgcttctgccgaggtgtccctgatgccaagattcgcatttttga

SEQ ID NO: 1223 - DNA, 290 bp, Homo sapiens
cttatagaaaaaagtaaccaacaggtaaataaaaatctccaagcacacattaaaaaaaaagccagatagagaagactagaataaataaataatgcaaacactttcaatgcaaagactagatgtacattcacaagatacaatgcaaacagagaaccatgacctccttaaactgacaaaactagagacagtaactgaccctcacaagatggcaatatgttattagctccctgatgaggagttcaaaataccagttttaagggactcagtgaccttgaggtacacagagagca

SEQ ID NO: 1224 - DNA, 305 bp, Homo sapiens
tttttttttagtgctgaataatattccattttctaggtttaccacagttgatttatccattcacctactgaaggatatcttgggtttcttccaagttttggcaattatgaaaaaagctggtataaacgtgtgtgtccaggtttttgtgtggatataatttttcaactatggggaaaaaccaaggtgcatgattgctggattgtatggtaaactatgtttagttgtagaggaactgccaaactgtcttccaatgtgattgtgttgatttgtattctacagcaatgaatgagagtcttgtgactcac

SEQ ID NO: 1225 - DNA, 235 bp, Homo sapiens
cgcaggctgaagcgcaaaagaagaaagatgaggcagaggtccaagtaaacccctagcttgttgcaccctggaggccacaggagcagaaacatggaatgccagacgctggggatgctggtacaagatgtgggactgcatgctactgtctagagcttgtctcaatggatctagaacttcaatcgccctctgatcgccgatcacctctgagacccaccttgctcataaacaaaatgcc

SEQ ID NO: 1226 - DNA, 320 bp, Homo sapiens
gaggatttttggtccgcacgctcctgctcctgactcaccgctgttcgctctcgccgaggaacaagtcggtcaggaagcccgcgcgcaacagccatggcttttaaggataccggaaaaacacccgtggagccggagtggcaattcaccgaattcgaatcaccctaacaagccgcaacgtaaaatccttggaaagggtgtgtgctgacttgataagaggcgcaaaagaaaagaatctcaaagtgaaaggaccagttcgaatgcctaccaaggcctttgaggaatcactacaagaaaaactcctttgtggtgaagggtctaag

SEQ ID NO: 1227 - DNA, 343 bp, Homo sapiens
aacaccccagcagatcgctgtgatgacctcagaggagatggccagtgatgagctgaaggagatccgtaagccatgaccaaggaggccatccgagagcaccagatggcccgcactggcgcacgaggacagacctagttcacctgcggcaagtgcaggaaaaagaactgcacctacacacaggtgcagacccgcagctctgatgagcccatgaccacctttgttgtctgcaacgagtgtggaaaccgctggaagttctgctgacccctcgtgtagatgtgctgcagccttgggccctccccggccaacgtcctccgttgacacaacttctctggagacctagagg

SEQ ID NO: 1228 - DNA, 110 bp, Homo sapiens
ccatgcagatcgctgtgatgacctcagtggagatgagccagtagtgagctgacggacgatccgtaagccaatcgaccaacgacgccatcccagagcaccatataggcccg

SEQ ID NO: 1229 - DNA, 484 bp, Homo sapiens
gggtgggcctggctcagggaagggcacccagtgtgagaagatcgtgcagaagtatggctacacccacctctccaccggggacctcctgcggtccgaggtcagctcaggctcggccaggggcaagaagctgtcggaaatcatggagaaggggcagctggttccactggagacagtgttggacatgctccgggatgccatggtggccaaagtcaatacttccaaaggcttcctgattgatggctacccgcgggaggtgcagcaaggagaagagtttgagccacggattggacaacccacactgctgctgtattggacgcagggcctgagaccatgacccagcggctcttgaaacgtggagagacagcgggcgtgtggacgacaattagggagacatcaaaaagcggctggagacctattacagggcacaaaaacccgtcatcgccttctatgagaaacgtggcatgtgcgcaagggtcaacgctga

SEQ ID NO: 1230 - DNA, 330 bp, Homo sapiens
ggacattcagactgagcgtgcctaccaaaagcagccgaccatctttcaaaacaagaagagggtcctgctgggagaaactggcaaggagaagctcccgccggtactacaagaacatcggtctgggcttcaagacacccaaggaggctattgagggcactacattgacagaaatgcccttcactggtaatgtgtccattcgagggcggatctctctggcgtggtgaccaagatgaagatgcagaggaccattgtcatccgccgagactatctccactacatccgcaagtacaaccgcttcgagaggcgccacaagaacatgtctttacacct

SEQ ID NO: 1231 - DNA, 325 bp, Homo sapiens
cttggctcctgtggaggcctgctgggaacgggacttctaaaaggaactatgtctggaaggctgtggtccaaggccatttttgctggctataagcggggtctccggaaccaaagggagcacacagctcttcttaaaattgaaggtgtttacgcccgagatgaaacagaattctatttgggcaagagatgcgcttatgtatataaagcaaaggacaacacagtcactcctggcggcaaaccaaacaaaaccagagtcatctggggaaaagaactcgggccatgaacagtgcatggtcgtgcaaatccgagcatctcctgctaggcat

SEQ ID NO: 1232 - DNA, 191 bp, Homo sapiens
gctaaaataaaaatacagactggctgataagcctaaagagatctttgactttattagtaatcaaagaattgcaaataaaattataatagtatttcctttccccactgataagatttgtcaaaattatggaaattgttaaaacacagttttagcaaatatgtggtaaacacacctgtgtactttcggtagga

SEQ ID NO: 1233 - DNA, 131 bp, Homo sapiens
atgcctggccccgaatgaccccagatttgactccaacaacgtggtcctcattgaggacaaccgggaaccctgttggggacaaggaatttaaggcaaccattccccaaccagccttcgcaacgggggaaggc

SEQ ID NO: 1234 - DNA, 139 bp, Homo sapiens
ctcacgcaagcatggttaacgtccctaaaacccgccggactttctgtaagaagtgttggcaagcacccaacccattaaagtgacacagtacaagaagggcaaggattctctgttacggcccagggaaagcgggcttatg

SEQ ID NO: 1235 - DNA, 131 bp, Homo sapiens
cggcacgaggaggccacaggagcagaaacatggaatgccagacgcttgggatgctggtacaagtttgttgggactgcatgctactgttctagagcttggctcaattggatcttggacttcatcggcctttg

SEQ ID NO: 1236 - DNA, 137 bp, Homo sapiens
ctggtgttatcaccgtgggctccctgactcggagttgatcgcctttcccaagtgctacaacctttttcagctggatgaggaatttgaggtctctgattcctcttcaaagcgttccctgactctaatctgtaaggggc

SEQ ID NO: 1237 - DNA, 124 bp, Homo sapiens
ccaaacagcccccgaaaacgctacgtgagctgggccctgggcaagggcagaaaacggacggaagaaaaggtcttggcccgagatgggtctcactctgtcacccagacttgagttcagttagttg

SEQ ID NO: 1238 - DNA, 148 bp, Homo sapiens
gcaagtgaaagtgtcttcacccaatcttctgaacgtaaaaggaaatagctgaaatgaaattctaaaatatttgagaagagccaattttataggccttttggaggtcaaagatgaaaggacccatgtattcaggatttcccgattatta

SEQ ID NO: 1239 - DNA, 444 bp, Homo sapiens
gttaaaccctgtggcggttactgcaatgtggtcatgcaaggctgtatggcaggtgtggtggagattgacaagtactggagagattacattctgtcccttgaagaacttgtgaatggcatgtacagaatctatgacatggagaacgtactgcttggtctcttttcaacaatccatgattctatccagtatgtccagaagaatgcaggaaagctgaccaccactattggcaagttatgtgcccattctcaacaacgccaatatagatctgcttattatcctgaagatctctttattgacaagaaagtattaaaagttgctcatgtagaacatgaagagaccttatccagccgaagaaggggactaattcagaagttgaagtctttcatcagcttctatagtgctttgcctcgctacatctgcagccatagccctctgcggaaacgg

SEQ ID NO: 1240 - DNA, 404 bp, Homo sapiens
aggcaagcttgtgtgggcccaacaggcccttggtagagctggtgccagatgtgggctcagatcctgggcatgatgggccgagccacctcggatcccactgattggccagccgagcgagaaccaggctgctgcatggcactgaccgccgcttccagcttcctctgagccgcaggcctgctacgcgggcaagcgtgctgcctctcttctgtgtcgttttgttgccaaggcagaatgaaaagtccttaaccgtggactcttcctttatcccctcctttaccccacatatgcaatgactcttaattttcactcttgtagtgtaatcctctgtattacaacatgagatatagttgcatatatggacaccgacttgggaggacaggtcctgaatgtcctytctcagtgta

SEQ ID NO: 1241 - DNA, 106 bp, Homo sapiens
ggcacgagagtacttctagagcggccgcgggcccatcgattttccacccgggtggggtaccaggtaagtgtacccaattcgccctatagtgagtcgtattacaatt

SEQ ID NO: 1242 - DNA, 229 bp, Homo sapiens
atgagcctggttaaccaagtaccgaaaatagttcccgatgactttgagaccatgctcaacagcaacatcaatgaccttttgatggtgacctacctggccaacctcacacagtcacagattgcactcaatgaaaaacttgttaacctgtgaattgagcccaagcagtacacttgcttgtctaggtattaaccccaggactcagaagtgaaggagagatatgggtttttgt

SEQ ID NO: 1243 - DNA, 203 bp, Homo sapiens
gagaagccctttgccatcgccaaggagtagggcacagggacatctttctttgagtgaccctctgtgcaggccctgtagtccgccacagggctctgagctgcactgtgccccggtgctgggcatctgtgtggagcggacccactcccctcacaatccacaaggcccatggactcacttttgtaacaaactcctaaccacactga

SEQ ID NO: 1244 - DNA, 209 bp, Homo sapiens
ctcctccttttttctttcttgcccatctcattatctgataagtaatttgtgtttttaagtttttttctccctagataatagaaagggaaagaaggtagaacataaataaggattacttaataatttttcattcagttatttagctgtgtttcccactggcaaaaatatttctctactatctttgtatatattgaataatacattatttt

SEQ ID NO: 1245 - DNA, 334 bp, Homo sapiens
ctcctccttttttctttcttgcccatctcattatcttataagtaatttgtgtttttaagtttttttctccctagataatagaaagggaaagaaggtagaacataaataaggattacttaataatttttcattcagttatttagctgtgtttcccactggcaaaaatatttctctactatctttgtatatattgaataatacattatttttaaactatatatatcagttactcttatcagtccaaaagcttatagaattactcgtgccgaattcggcacgaggttttgttaaactgtatcacattttataccttgcagaaattaatttcattggt

SEQ ID NO: 1246 - DNA, 325 bp, Homo sapiens
ctcgtgccgaattcggcacgagtatcaatcacctgagctcaccatagtctaatagaaaacaaccgaaaccaaataattcaagcactgattattacaattttactgggtctctattttaccctcctacaagcctcagagtacttcgagtctcccttcaccatttccgacggcatctacggctcaacattttttgtagccacaggcttccacggacttcacgtcattattggctcaactttcctcactatctgcttcatccgccaacttatatttcactttacatccacacacacttttgcgtttgagcggccgcctaatacttggc

SEQ ID NO: 1247 - DNA, 267 bp, Homo sapiens
cctcgtgccsaatttcggcacgagcctcgtccccctcttcttcattgccaataaaaaggagacacctaaagaagaaaagcaccaaccaactttgattgattgtgttctgccactggccaaaccatggcactttgaaggccacgccgtattgaggacgccgggattccttggttccaggccatccagagccagttccttggcaggcctgcagttatgcgagagccgttaaaagcaaggctccagctttaccagccagagcgaggccat

SEQ ID NO: 1248 - DNA, 239 bp, Homo sapiens
aaaatataaaaaattagtcgggcatggtggcgggcgctgtagtccaactactcgggagactgaggcagaagaatggcgtgaactcaggaggcggactttgcagttaggccaagggcgacagaagcaagactctgtctcaaaaaattaaaaaataggtgcacttgtccttcgaggaaagttttctacatctggtaatttgtaccttgaaggtgggtgtccctgtgggtgtcttttttgca

SEQ ID NO: 1249 - DNA, 246 bp, Homo sapiens
cagttatctcgttatgtgaccatacaaccaaagtgttgtaatggagtacaatttctgttttatttctgaggaagtggaagctgaagaagattaagagacttagattaagcagagccagattgaaaacgtaggtcttttgactccaaatctacaatcttccttattatgacccagcctgttgagctcttagtatacactttggagatttcaaaagcagatataagcctcagagattttatagctcct

SEQ ID NO: 1250 - DNA, 450 bp, Homo sapiens
cagttatctcgttatgtgaccatacaaccaaagtgttgtaatggagtacaatttctgttttatttctgaggaagtggaagctgaagaagattaagagacttagattaagcagagccagaatgaaaacgtaggtcttttgactccaaatcctacactcttcctttattatgacccagcctgtggagctctagtaatacctttggtatttcaaaagcagtataagcctcagatttttagctcctgacctgatttttcagagtaatcaagaacctgttggctacacagtttgggatattgtctgtgaagaatgtgggaattgcttagtgtcccgtcctgcacatggctttcactgccataatggccagccctgagccctcatttaaagcctgagaagtactcatgtttggatatggaaacatttgtttcccttaacttttaatttacagcttg

SEQ ID NO: 1251 - DNA, 315 bp, Homo sapiens
gaaagttaaacgttttaaacatggtagtactggaaattttacaagacttttacctagcacttaaatatgtataaatgtacataaagacaaactagtaagcatgacctggggaaatggtcagaccttgtattgtgtttttggccttgaaagtagcaagtgaccagaatctgccattgcaacaggctttaaaaaaagacccttaaaaagacactgtctcaactgttgtgttagcaccacgccagctctctgtacatttgctagcgtgtaggtttctcagactatgttaactctttatttgtagggagtagagagtcg

SEQ ID NO: 1252 - DNA, 197 bp, Homo sapiens
aataattctgtggtttcatttttctgtaaacaactaaaagaataattagatcatattctagtatgttctgaaatatctttaagactgatcttaaaaactaacttctaagatgatttcagcttctcatagtatagagtttactttgtacacgtttgacgaaccaactacctgtagaagagtgagggatctattgtaat

SEQ ID NO: 1253 - DNA, 253 bp, Homo sapiens
aaaaagctgtggttctcaaaggggcaaatgacttagatatcaaagcagagggaaatattagattccggtatatcgttcttcaagacacttgctctaagcggaatggaaatgtgggcaagactgtctttgaatatagaacacagaatgtggcacgcttgcccatcatagatcttgctcctcttggatgtttggcggcacaaaccacggaattcggcgttgaaattgggccagtttgttttgtgtaaagtaggca

SEQ ID NO: 1254 - DNA, 238 bp, Homo sapiens
gaatggcataaatttgtgaggtgaactgtttaaaacaaagatgggcagactcctctcagaaaatgaggccatgttcctagaggtccaactctatgtaatggtcttaggggttgatgaagcactgtagtcctgcttctcactcatacctcccctccagaaaggataaaattataaatgtcccaattagggtctttattagtctcttcccatgtaggatttatcaatagtttgacaggtt

SEQ ID NO: 1255 - DNA, 191 bp, Homo sapiens
atgaaatcagattgcatggaagaatataaagacactcactcggatgaaaactataacggttttcaaactattttgatggtcattgtacgagctattgtatggattactgtggagtgctgtttaccacatgatgtgtgcaatacatcatgcaatgttatttagcaatgcgtaataaaagtgtttaaaagaga

SEQ ID NO: 1256 - DNA, 270 bp, Homo sapiens
ctcgtgcgcacggattccctcattaaaatagatcatttagttaagccccgaagacaagctgtgtcagaggcttctgctcgcatacctgagcagcttgatgtgactgctcgtggagtttatgccccagaggatgtgtacaagtttcctgccgactagtgtggggggaatcacggacacttaaagtcaatctgcgaaataattcttttattacacactaactgaagttttgagtccagagagcattctatgtcaaacattccaagtactttt

SEQ ID NO: 1257 - DNA, 203 bp, Homo sapiens
cagacagttgcggtgggtgtcatcaaagcagtggacaagaaggctgctggagctggcaaggtcaccaaggtctgcccagaaagctcaggagggctaaatgaatattatccctaatacctgccaccccactcttaatcagtgggtggaggaccggtctcagaactgtttgtttccaattggccatttaagtttagtagtaaaag

SEQ ID NO: 1258 - DNA, 215 bp, Homo sapiens
gtcccggagagcaagaacggcggcagccgggcgctcaacaacaaccccgaggaggagcggcacaaagcggggtgctgctcatctgcctcgacctcttctgcctcttcatggcgggcctccccttcctcatcatcgagacaagcaccatcaagccttaccaccgagggttttacctgcaatgatgagagccttcaagtacccactgaaaaactggt

SEQ ID NO: 1259 - DNA, 190 bp, Homo sapiens
gctggaggccctttatccttagcagaccaacacagaaagagaaaacccaaatactgcatgttctcacttataagtgaggagttaaatgatgagaacatatggacacatagaggggaacaacacacactggggcccttttggaggatagagggtttaaggagggagaggatcaagaaaacaactaatgggt

SEQ ID NO: 1260 - DNA, 157 bp, Homo sapiens
tggttaatgaaagtagcctgaatggagataaactttccgaacacagaaggctgtctttttatcattagaacagtgggtcgacaattttccctggacacttactggcatgggattttgtcaaagagaactggaataagcttgtacagagttccctctg

SEQ ID NO: 1261 - DNA, 179 bp, Homo sapiens
ggaaattgaaagtgaaaacgctgaaacattgaggactaaaattccaaagagggagtttaagggtgtaccatcgcaaatttattggcttgtgttgggagattcttaatcttcctgttggtttgagtcatcctaaaaaatggttcatttaatcattcattcccttctgccctttgctaggt

SEQ ID NO: 1262 - DNA, 440 bp, Homo sapiens
ggaaattgaaagtgaaaacgctgaaacaatgaggactaaaattccaaagaggagtttaaggtgtaccatcgcaaattattggcttgtgtgggagattctaattttctgttggtttgagtcatcctaaaaaatggttcatttaatcattcattccttctgcctttgctagtttgcccgaagttattaagattatctttgtgttttcatcctcaaacacaaatgtgtattgcgcatagccagtgtgttttaaaagatcaagacttttcttaaaatgatgtcgataacttccaaaggcaactgtgaggtttttttgttttgtttgtttgtttgtcgttttcctttggtttggtccttgggaggttataaagatagtctgtcctaacgtatgacaacaatatcatccatgtttccaaaaaagacatgattccgactgcagcatt

SEQ ID NO: 1263 - DNA, 152 bp, Homo sapiens
ggcatttgattggctgaagaacagaaacctgatgtaatggagcaaaatcctcagtacttaacagttaaggcaaggtcttgtgtctacctagggtgtgaattgtaacctgtttaaacttgcaggcaggcaatggggcaagcttgggaaattct

SEQ ID NO: 1264 - DNA, 500 bp, Homo sapiens
ggcatttgattggttgaagaacagaaacctgatgtaatggagcaaaatcctcagtacttaacagtgaaggcaaggtcttgtgtctacctaggtgtgattgtaactgttaaaaattgcaggcaggcatggggcagttgggaaatgctcaggtttttttttactgtagttcaatgaatttaagcaagccacttgaattttctgcattaatttactgagcaccatcctgtatcttatttatgcttgtctttataaacaacacgtaatgcacattttgattcgtttttcaaggcttactgtgttggttcatatcctagttccaagaaaagcacgtttggcagaaataaaagtttttactccaaattatttgataagaaatttggattcaattttagcatctttttgtgtccttattgtttctctctgtcttaaggattatagtggcatggtaagtgcttaagatgcagtcatgaatgtatttttatacaattaggaactataga

SEQ ID NO: 1265 - DNA, 150 bp, Homo sapiens
cgaagatggcggaggtacaggtcctggtgcttgatggtcgaggccatctctgggccgcctggccccattcggtggctaaacaggtacttcttggccggaaggtggttgtcgtaccgcttgtaaggcatcaaccatttcttggcaatttct

SEQ ID NO: 1266 - DNA, 168 bp, Homo sapiens
ctgtattttgctgatcggctgtatgactccatgagggcaaggggacgcgagataaggtcctgatcagaatcatgggtctcccgcagtgaaggttggacatgttgaaaattagggtctgaattcaagagaaagtacggcaagtccctgttacttattatatccagcaag

SEQ ID NO: 1267 - DNA, 182 bp, Homo sapiens
ggtgaggaaggtcaaggtctaggactctaactccttgccactcaagaaatgtcctcctttcagaatatgccttccgcatgtctcgtctcagttcccggctatttggtgaagtcaccaggcctactaattccaagtctattaaagtgggtaaacttgttagtgaactgccttgccaagaagag

SEQ ID NO: 1268 - DNA, 184 bp, Homo sapiens
gtttgcgtgagagtcatacaagaacattttgctgagatggctgccagtcttaagcgtccagactcaggtgccactgggcttcctggaaggcctggccctcctggtccccccggccctcctggaggagaatggtttcccaaggccagatggggattcgtggcctttccgggcattaaggggcccc

SEQ ID NO: 1269 - DNA, 272 bp, Homo sapiens
ctcgtgccgaattcggcacgagcagaagcgagatgacgaagggaacgtcatcgtttggaaagcgtcgcaataagacgcacacgttgtaccgccgctgtggctctaaggcctaccaccttcagaagtcgacctatggcaaatgtagctaccctgccaagcgcaagagaaagtataactggagtggccaaggctaaaagaccggaataccaccggaccttgtcgaataaggcacctaaaaattgtataccccagattcaggcatggattccgtb

SEQ ID NO: 1270 - DNA, 243 bp, Homo sapiens
ctgcaacgccggagcttgccaggagggtctcagggaagtttcactttctgaattaaatatgcaaatactagaaataattagcttcaaagtactttacttagtacagttactccttaaggccttctttaaaacctttagctaaaggctgagaaccattctctaaagaaagcaaaccgcatggctagaaaggacctccagaagtagagatgcaacgtgcccgtgaaccccagttcccttccagag

SEQ ID NO: 1271 - DNA, 460 bp, Homo sapiens
ctgcaacgccggagcttgccaggagggtctcagggaagtttcactttctgaattaaatatgcaaatactagaaataattagcttcaaagtactttacttagtacagttactccttaaggccttctttaaaacctttagctaaaggctgagaaccattctctaaagaaagcaaaccgcatggctagaaaggaccctgagaagtagaatgcaacgtccagtaaccccagttccctgcagaagaaaggggagagagattattttttgaaagaaaagcagctctttttaggacagaaatacactgagtgatcatgtcccagagtgaattgtatcttagaatggctagtatgggccattgttattctggcaggttcctcttatccattctccgagtggcttcccgaattcacagaggttcaggcgctgtggagacccaccgggggtacagatccacaccaccacc

SEQ ID NO: 1272 - DNA, 257 bp, Homo sapiens
accagctcccctcaaaaagaagacactgtctcatgggcctgtgctgtcacgagaggaacagctgcccctcctgggccgcttggtgagaggtttggtttgatacctctgcctccctcctgccagcatggattctgggtggacacagaccttgttgaaggtccagtaccaccaagagctgcccattcacttccaccccacactgtatcaaatgtatcacatattctcatgttgaacactcttagccytaattgagaatg

SEQ ID NO: 1273 - DNA, 242 bp, Homo sapiens
ttagaagccatcagaggtgcaagggcttagaaaagaccctggccagacctgactccactcttaaacctgggtcttctccttggcggtgctgtcagcgcacagacccatgcgcatccccacccacaaccctttaccctgatgatctgtattatattttaatgtatatgtgaatatattggaaataatttggtttgtcctcggttttggtttggtttcggtttgcttttaggccctcacattct

SEQ ID NO: 1274 - DNA, 240 bp, Homo sapiens
ctgaggcagcactgctctcgtcagctgtgttgcctttaccaagtgtcttcagagggttatgagttagagtagctggcctggggagagggtgcctccctggggtttgatctttagggtctgactttctgcagagaagatgttttacagatgtgtcaaagctgatgtaatgtgggttgggggagggaatccaagaccaaagtgtttgtcagctgggtgtacaactgcctatgtgatcccctg

SEQ ID NO: 1275 - DNA, 117 bp, Homo sapiens
caggagcagaaacatggaatgccagacgctggggatcgctggtacaagttgtgggactgcatgctactcgtctagagcttgtctcaatggatcctacgaactccatccgccctcctg

SEQ ID NO: 1276 - DNA, 135 bp, Homo sapiens
agatggtggccgcaaagaagacgaaaaagtcgctggagtcgatcaactctaggctccaactcgttatgaaaagtgggaagtacgtcctggggtacaagcagactctcaaagatgatcagaccaaggccaaagcgg

SEQ ID NO: 1277 - DNA, 201 bp, Homo sapiens
cctcactccaaaataggtgctgatccttcctattcctattctttgccaccttttgggtgtggtgtcaccagcctgtttagccaagtagctttgggcaataggctgcccaatctgagcaaacaccagtgaggctctattgagccaaagaccaaggtcctcaaaagcacctgaaccactgtggccttctcagcctacagcagt

SEQ ID NO: 1278 - DNA, 208 bp, Homo sapiens
caaccgactacttcagaggaaacaaatggtcattgatgtccttcaccccgggaaggcgacagtgcctaagacagaaattcgggaaaaactagccaaaatgtacaagaccacaaccggatgtcatctttgtatttggattcagaactcattttggtggtggcaggacaactggctttggcatgatttatgattccctggattatgcaag

SEQ ID NO: 1279 - DNA, 209 bp, Homo sapiens
cttccaaggaaatggctacccaacttgccttcatgcgcctgctggccaactatgcctctcagaacatcacctaccactgcaagaacagcattgcatacatgggtgagaggactggcaacctgaaaaaggctgtcattctacaaggctctaatgatgttgaacttgttgctgagggcaacagcagggtcacttacactgttcttgtagag

SEQ ID NO: 1280 - DNA, 211 bp, Homo sapiens
gtggcttctccttggctgagagatggaaggcgtggtgggatttgctcctgggttccctaggccctagtgagggcagaagagaaaccatcctctcccttcttacaccgtgagccaagatcccctcagaaggcaggagtgctgccctttccaatggtgcccgtgcctctgtgctgtgtatgtgaaccaccatgtgagggaataaacctggact

SEQ ID NO: 1281 - DNA, 193 bp, Homo sapiens
ctcgtgccgaattcggcacgagggatgcgccgccggacctacagagctcatggtcggattaacccatacatgagctctccctgccacattgagatgatccttacggaaaggaacagattgttcctaaaccaggagaggaggttgcccagaagaaaagatattcccagaaggaacttaagggacacaaacttat

SEQ ID NO: 1282 - DNA, 232 bp, Homo sapiens
catgcacccaacaagcgcatcactgactgctatcgctgggtcatccatgctgggagcaagagcccaacagaacccatgccccccaagggcagcccttacaggggtgcagacctgcagaaccacgcgttgtgatgggggtgcagaccccccttatggagtattggggcgcttggacacatggccgcggctgcaccaagggacccatgggggcttgcccagcttgacagatggc

SEQ ID NO: 1283 - DNA, 199 bp, Homo sapiens
gagaaatgaaaagattgctgtccactgcacagttcgaggggccaaggcagaagaaatcttggagaagggtctaaaggtgccggagtatgagttaagaaaaaacaacttctcagatacttgaaactttgtgttttgggatccacggaacacatcgatctgggtattcaaatattgacccaggcatttgtatctacgggct

SEQ ID NO: 1284 - DNA, 197 bp, Homo sapiens
ctcgtgccaattcggcacgagttgctgttcgtgatattagacagacagttgcggtgggtgtcatcaaagcagttgacaattcagtgggggaagaaccggtctcagaactgtttgtttcaattggccatttaagtttagtagtaaaagacttggtaatgataacaatgcattcgtaaaaccttcagagaggaaggaga

SEQ ID NO: 1285 - DNA, 222 bp, Homo sapiens
gtggtgtgttcttgactccgctgctcgccatgtcttctcacaagactttcaggattaagcgattcctggccaagaaacaaaagcaaaatcgtcccattccccagtggattcggatgaaaactggaaataaaatcaggtacaactcccaaaaggagacattgggagaagaaccaagcttgggtctatataggaattgcgacatgagattggcacacatattta

SEQ ID NO: 1286 - DNA, 215 bp, Homo sapiens
caaacccacttccaccctactaccagacaaccttagccaaaccatttacccaaataaagtataggcgatagaaattgaaacctggcgcaatagatatagtaccgcaaggaaagatgaaaaattataaccaagcataatatagcaaggactaacccctatacctctgcataattgaattaactagagataactttgcaaggagagccaaagctaag

SEQ ID NO: 1287 - DNA, 192 bp, Homo sapiens
cagacccgcgtgtggcgcaggcaaggaccctcaaaataaacagcctctaccttgcgagccgtcttccccaggcctgcgtccgagtcttcgcgttgcgggcccgttccgacgcggaagatcttgacttcagccatgagcagcaattagttcttaagttttgacgattttgcactggcccggaatttgcatctg

SEQ ID NO: 1288 - DNA, 123 bp, Homo sapiens
gccctctggaggtgaggagaagccacccaggggagctcccccccacccccagcacacccagtgtcttccttatctctttcctgccagtgtcactagatggacactggattcactagatgatct

SEQ ID NO: 1289 - DNA, 569 bp, Homo sapiens
gccctctggaggtgaggagaagccacccaggggagctcccccccacccccagcacacccagtgtcttccttatctctttcctgccagtgtcactagatggacactggattcactagatgatctctgtgatcacttctagttttaagattctatgatcctgttaatgataataagaacttctagagcccttaccatgtgtcagactcaatgccatgtgtcttagtctgtttggactgctattttacagagtaccataaattgagtgtctcataaaaaacagaaaggtgttgcttacatttctggaggctgagaagtccacggtgccagcacgttcagcatctggtgagggtctgcttcccggttcatagacagcatcttactgcatcatcatgccatagaaggggcaagagaaccctctgaagtcttttttataaggtcactaatcccattcacgaaggcttcaagttcatgacctaattatctcccaaagtcctcagctccagataccatcacactgcagattagatttcaacatatacattttgggagggcacacacattttagtctc

SEQ ID NO: 1290 - DNA, 145 bp, Homo sapiens
ggaaaatggtgccaaatagacttgcctgatgccaggctgctacaaaccttcaatttaaaaaaaaaacacagtattcacaaggcatagtaggatgaggtatgcctgtattgctctttcctgaaggtgggtgtgatattaaccatct

SEQ ID NO: 1291 - DNA, 187 bp, Homo sapiens
  misc_feature 1: n = A,T,C or G
ncgcactagtgatcaagattcggcacgaggtttaagaaaatcagtttttgttcttaaaaatgcatttaagttgtaacgtctttttaagcctttgaagkscctctgattctatgtaacttgttgcagactggtgttaatgrgtatatgtaacagtttaaaaaaaaggttggtatttttaaaggccaag

SEQ ID NO: 1292 - DNA, 170 bp, Homo sapiens
agacaactcacattgttcaactcccttctcggggtgggacagacgagacaacagcacacaggcagccagccgtggccagaggttcgaggggctcaagggctcaagcaccgttcccacaagaaggcccccttggttggccttggccttctttctacgcaatgttattccaa

SEQ ID NO: 1293 - DNA, 183 bp, Homo sapiens
gtggcctgcacctataatcccagctacttggaaggctgagacgggaggatcatttgaacctgggaggcagaggttgcagttagctgagatcacataactttacttctgtatcagtgtactgctgctcttgcaagaccctgtctcaaaaaaggaaggtaaattaaaaattcaagtatatattac

SEQ ID NO: 1294 - DNA, 177 bp, Homo sapiens
caccccatcatccccccacatcaggccttggccacggtctcaggtcaatggggaccgagataacttgatagggacacccccaacccagagcccaacccggggacaattgggagactcacaaggagtaggttccggaccccgtaaagctctgttggtcccacggctggaaatgcatgg

SEQ ID NO: 1295 - DNA, 187 bp, Homo sapiens
caacaactcaccgttgcgcatgtaggctgccggtggctttctataatcaaatcaatattgttctggggcatcacaaagaggaagggggtcccccggggttatgcaatgtggctgctttgactgtactggacataaaaataaggaaaatgttcttcattttacttaaaatgtgtcttttaaataaaat

SEQ ID NO: 1296 - DNA, 195 bp, Homo sapiens
ctcatgcctgtaatcccaacactttggggaggctgaggtgggtggatcacctgaggtcaggagtttgagaccagcctggccaacatggtgaaacctcatctctactaaaaatacaaaaatgtgttgggtttgggtggtgcatgcctgtaatcctagctactagggaggctgaggtaagagaattcgcttgaacct

SEQ ID NO: 1297 - DNA, 164 bp, Homo sapiens
gcctttgtaaccttctctaaacgtcaggcctggacttaaaagattttttaaaacctccataagtagtccaggggcggtggctcacggctgtaattccagcactttgggaggccgaggcaggcggatcacaaggtcaacgagatcgagaccatcctggccaacat

SEQ ID NO: 1298 - DNA, 168 bp, Homo sapiens
aggagcccaccaccacatccggctacctttgtgtattttttagtagagacgggggttttgccaagttggaggggcttggtcttgaactcttgacctcagatgatccacccggctaggctcccaaaggtctgggatttacaggcattaagcaccgtcccgaccttttct

SEQ ID NO: 1299 - DNA, 263 bp, Homo sapiens
gccgggtggtgctggccctggagggaggccatgacttgaccgccatctgtgatgcctctgaggcttgtgtctcggctctgctcagtgtagagctgcagcccttggatgaggcagtcttgcagcaaaagcccaacatcaacgcagtgcccacgctagagaaagtcatcgagatccagagcaaacactggagctgtgtgcagagttcgccgtggtctgggccggtccctgcgagaggcccaggcaggtggaccgaggaggccgag

SEQ ID NO: 1300 - DNA, 253 bp, Homo sapiens
cacagggctgaggccagcccctagcagctggatgtggcagaggcaggccagaggacctaagttttatggaccagagtcacttctcctcctcctttctccagccagccctgacccctcatgctctctggctgggccagtgggcagccctcgcttcccttggatggagctgccctgctggtgcctggtcagagaagaggcctctgtgcccagcctgattctctgctcccaggagccagtacatgaggtcagaggc

SEQ ID NO: 1301 - DNA, 204 bp, Homo sapiens
ctgtttctcaggcacttgaggctttcagtgatatctttctcattaccagtgactaattttgccacagggtactaaaagaaactatgatgtggagaaaggactaacatctcctccaataaaccccaaatgggttaatccaactgtcagatctggatcggtatctactgactatattttccctattactgcttgcagtaattcaac

SEQ ID NO: 1302 - DNA, 226 bp, Homo sapiens
atcgccatcatgaacgacaccgtaactatccgcactagaagttcatgaccaaccgactacttcagaggaaacaaatggtcattgatgtccttcaccccgggaaggcgacagttccttaggcagaaattcggggaaaagctagccaaaatgtacaaggccacaaccggatgtcatctttgtatttgggttcagacctattttggggggggcgagggaacctggcttg

SEQ ID NO: 1303 - DNA, 201 bp, Homo sapiens
ggatcacattttataatgaagattaccagtgtagtaattctgatattgcaaatgattgagggacaaacaaaggaacttaatagaggaaggtaggtcttagagggaattcccattaattgtaggatttttttggctttgaaatatactctctctatatgagagagattccatttaaaaaaaaaaacacacccttttgtctct

SEQ ID NO: 1304 - DNA, 248 bp, Homo sapiens
ctctccaagaggctgaagaaagtgtggaagccacagctgtttgagcgagagttctacagtgagatcttggacaagaagttcacagtgactgtgaccatgcggaccctggacctcatcgatgaggcttacgggctcgacttttacatcctcaaggcaagcggggtggggcgagtcagttccacacagggtctgggatgggccagtcagatcacgggagcccaaggtcagctcacaccgggcacacgctg

SEQ ID NO: 1305 - DNA, 354 bp, Homo sapiens
ccgccgcagtcttcgccaccatgccgccctacaccgtggtctattttccagttcgagggccgctgcgggcccttgcgcatgctgctggcagatcaagggccaagagcctggaagggaggaggtggtaaccgtggagaccgtggacaggaggcttacatctcaaagcctcctgcctatacgggacagctccccaagttccagggacggagacctcaccctgtaccagtccaataccatcctgcgtcacctggcccgcaccttgggtctctatgggaaggaccagcaggaggcagccctggtggacatggtgaatgacggcgtggagcacctccgctgcaaatacgtctcctcatc

SEQ ID NO: 1306 - DNA, 155 bp, Homo sapiens
gtgacatcgcatataaacactgcgtggcaactccttcgacgcacctgccgtgactgcccaggtcaagacaggtcgaccctaggaagtccaactaccttcccttcaaggtcaatccaacctatttggaatgagtatcccaagatgaccaatctggc

SEQ ID NO: 1307 - DNA, 140 bp, Homo sapiens
ctgaggcctccctggaggaaggagggttaggggtacctatcctcaaggtattggaagagcagaatttgagggagagacctttcttccttgttgagggtaaaaattaaataagattccatgtccaaaaaaaaaaaaaaaaa

SEQ ID NO: 1308 - DNA, 200 bp, Homo sapiens
aattggaatgagtccactttaaatcctttaacgaggatccattggagggccaaggtctggtgccagcagccgcggtaatttccagctccaattaggcgtatattaaaggttgctgccagttcaaaaagcttcgtggttgggatcttggggacgcggccggccgtcccgccgcgaggagcccaaaccgcccgtccccgccc

SEQ ID NO: 1309 - DNA, 326 bp, Homo sapiens
ccgcagtgaagtggacatgttgaaaattaggtctgaattcaagagaaagtacggcaagtccctgtactattatatccagcaagacactaagggcgactaccaaaaagcgctgctgtacctgtgttggtgaggtgacctaaggcccgcaaggccttaggcttccagaattggtctcacaccatggcttccacgctaacaggtctagaaacccagctcgcgatatacacagtcccgtgtggccatccctgtgaggcacgcgtgagcatcacccccaccctcattttgagtcgcctaagcatcgcttcgcctccctgtctagtctctct

SEQ ID NO: 1310 - DNA, 240 bp, Homo sapiens
tggcagtggagtgattgcatgaatttttctgtaacacattaactttggtattattattaagggagcttgagaaagctttgcttataattgtcaaggcaaggagggtaaaaacttgggagcccaaggaaattcccttggggccaggatttatttatatataggaaaatttgaatttccctgaggccagttggtctcccaccccttttccagtatgttgagtcctgcaaatagcatctctct

SEQ ID NO: 1311 - DNA, 253 bp, Homo sapiens
ttttgagtctgacattctaataaaataatttgtagaaaccatttgtctttgtagtgattccaaattaaaaggtttctttcttccacctgagggcacggcccaaaaggtcttggtaattttttaggcaaggacggtccttttaattagagatatgtctgggagaccagacctctctcatagagggtgtccttgtcccctgagagccctcgtgagtcaccccaagaggagggacacatgcgacttctggcctgcc

SEQ ID NO: 1312 - DNA, 190 bp, Homo sapiens
ctctatattgctggtaattgccatgccctgagcactgagtatgtcatgccaccctgtccctcccctgggcacccctcactttccctgatcctgcaattaaagggttaatgtgtggcatatggaagggactccaggaccctgtgcccagcttccatgctgactgatggttaaataatgtgattgtctcctc

SEQ ID NO: 1313 - DNA, 130 bp, Homo sapiens
agctaattcagagactgcttcaatcagcagatgaagaagccattgctgactttgatgaacaccttaaatcagcaaaataaatactaacttattattattaatgattatataaatgaaatggacctatatc

SEQ ID NO: 1314 - DNA, 187 bp, Homo sapiens
aagcgcccttaattgagtatgaagctattggaggtccttcaggagagaatgaccttatctgttttatgttttaaaatactcactctgacctagtattagggttctccccaaaacagaaacaatgggagctgtttaggtaggtaaggagagagatttattgtggaattggctcacaggataatagagc

SEQ ID NO: 1315 - DNA, 230 bp, Homo sapiens
aaaatttaacacccatagtaggcctaaaagcagccaccaattaagaagcgttcagctcaacacccactacctaaaaaatcccaaacatataactgaactcctcacaccaattggaccaatctatcaccctttagaggacctattgtaggattaagtacaatgaaacaattctcctccgacatagcctcggtgagtttaaacactctactctgcacattacacagccctat

SEQ ID NO: 1316 - DNA, 221 bp, Homo sapiens
ttccgacggcatctacggctcaacattttttgtagccacaggcttcacggacttcacgtcattattggctcaactttcctcactatctgcttcatccgccaacctattatttcactttaccatccaacatcactttggctcggaggccgccgcctgtaactggcattttgaggatatggtgtagtctatatctatatgtctacatctatgaatgagggtct

SEQ ID NO: 1317 - DNA, 238 bp, Homo sapiens
ggaagaggaagaggacagtgatgaggaagaagttgagctgtgcccatccttctgccaaaaaggcagggggggcaggccctagccctcctaggtcagctccatgtgccatgaaccgccatgcaccctgttccctgaaggtttcaccattggtatatatttctccttgagggggagagttgggtggggtttgggtgggaggctctgggtcttgggctataggagagctctctctcacaca

SEQ ID NO: 1318 - DNA, 213 bp, Homo sapiens
ccactgtcccggaggaaagctgtagacatgcggctgcggatggagttggtgctccagaagagatggggcaggtgccccacttgactctcgcccagctccccggccctctacttcaccacgatgccagcctggtcaaaaatctccagaccctctggagcagtagcagctcaaagtcaagcctggcccactctatgtgggcatacatgtgtacac

SEQ ID NO: 1319 - DNA, 229 bp, Homo sapiens
gttggtgcatgtgctttggactagcatttatgcttgcaggtgtattctaggaggagcatacttgtacaaatattttgcacttcaaccagatgacgtgtactactgtggaataaagtacatcaaagatgagtgtcatctaaaatgagccctcgcagttgccccagctgctctctaccagacattgcgggagaatataaactctttagagaggagaggtgatatttatcgt

SEQ ID NO: 1320 - DNA, 206 bp, Homo sapiens
ggggatcaagggacggctgacaagacttcccgcttgctggtgtgggtgacatggtgatggccacagtcaagaaaggcaaaccagagctcagaaaaaaggtacatccagcagtggtcattcgacaacgaaagtcataccctagaaaagatggcgtgtttctttattttgaagataatgcaagggtacatggtgaaccataaagggcg

SEQ ID NO: 1321 - DNA, 190 bp, Homo sapiens
agaaaacaaaatcagataaagataagagatttatatataaatttatgataatgaacaattctccccccattaataaagggaaatcattccttttgtaaataaatttgggatggacaaaatattaaggaaaaaatcccgaaaatgtgccccccaaaaacaattgggggggtgttgcctctctaaaacgggg

SEQ ID NO: 1322 - DNA, 239 bp, Homo sapiens
agggtgtggggctggcctcgctcgtggcacctctgctgatctcacaggccatgggactggccctctatgtcctgccagtggctggggccaacacgttgccacccagcactttccagtggcagaggctgaggcttggtgctgacacttgctggcgatttatgcagctgggcctcgccctgccccacaatacccaccgggtggtaagcacacaggccccagacaggggctggatggcactc

SEQ ID NO: 1323 - DNA, 350 bp, Homo sapiens
cttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgaggcctttaggtttcatacattgtacatagatcacagtttgctttgatcttcttcaatatgtgagtttggggtcacagagtcaaagtgtatgctttgtgtaatgctcgcactctgagctctcgagcacatatattcatctctcgtagtgtgggaaaaaaaaaaaaaa

SEQ ID NO: 1324 - DNA, 250 bp, Homo sapiens
cccggccacctgcggtgctatctccccagccccgatcctctgtacagagcccacgcccccacttggtgacatgtcttttcttgcatgaggctagtgtggtgtttcctggcactgcttccagtgaggctctgcccttgggtaggcattgtgggaaaggggagataagggtatctggttgactttcctctttgggtctaacctgtgtctgaagtctgaaggcttgggtctgaatcccaggtccccctaaagg

SEQ ID NO: 1325 - DNA, 202 bp, Homo sapiens
caagaagtatgatgcgtttttggcctcagagtctctgatcaagcagattccacgaatcctcggcccaggtttaaataaggcaggaaagttcccttccctgctcacacacaaccggaaacatggtggccaaagttgatgaggtgaagtccacaatcaagttccaaatgtgaggaggtgtttatgtctttgctgtagctttttg

SEQ ID NO: 1326 - DNA, 263 bp, Homo sapiens
attctagtgctgagaagaaacacgtttggtttggagagtccatggatggtggttttcagtttagctacggcaatcctgaacttcctgaagatgtccttgatgtgcagctggcattccttcgacttctctccagccgagcttcccagaacatcacatatcactgcaaaaatagcatatgcatacatgggtcagagcccatggggaatgtaaaagaaggccctcacagcttataggggtcacatagaaggtgatttcacaggtct

SEQ ID NO: 1327 - DNA, 278 bp, Homo sapiens
aggtggcatgcaaggaaagctaacaaattcagaaactcgattctgtgggagcaggattctttggtactaatcacgatagtgggtccagctttggagttaaccatttgatttgtgatggtttttcttttctcctccccaccccaggatgaagtgtcctctcgctagcaccaataaaagatttctaattaacacaattaaaaacacaattgccctctcatatagagcaagaccatgaacaaaaagagggcgataaggaccagcgcagagccaggcccaca

SEQ ID NO: 1328 - DNA, 207 bp, Homo sapiens
caaagacctgtacgccaacacagtgctgtctggcggcaccaccatgtaccctggcattgccgacaggatgcagaaggagatcactgccctggcacccagcacaatgaagatcaagatcattgctcctcctgagcgcaagtacttcgtgtggatcggcggcttcacttcttggcttgcttttcacccttcagcagattttgggtagca

SEQ ID NO: 1329 - DNA, 359 bp, Homo sapiens
ttgcagccatctccttctcggcatcatggccgcctcagacccttgtgaagcccaagatcgtcaaaaagagaaccaagaagttcatccggcaccagtcagaccgatatgtcaaaattaagcgtaactggcggaaacccagaggcattgacacagggttcgtagagattcaagggcccagatctggatgccaacattggttatggagcacacaaaccacgcacatgctgccagtgcttccggagttctggtcacacgtcaggagctggagtgctgctgatgtgcacaaatcttactgtgccgagattgctcaaatgtttctcaagaaccgcaagccatcgtggaagagctgccaactggcg

SEQ ID NO: 1330 - DNA, 332 bp, Homo sapiens
cttggtttgaggggacctaaaggtgacttgggagaaaagggggagcgtggccctccaggaagaggtcccaacggtttgcctggagctataggtctcccaggtgacccaggccctgccagctatggcagaaatggccgagacggtaagcgaggccccccaggggtggcaggaattcctggagtgcctggacccccgggacctcctgggccttcccggtttctgtaagcagcctcctgcaccatgcagcctggtcagcgagcattcaacagagggcctcaccttagaaaggcttactgctgcatggctgtctgcatgaaccacgcctggtgagg

SEQ ID NO: 1331 - DNA, 309 bp, Homo sapiens
agccaccgtgcccaacctcacttgcttcttatccttacactcccagccccagagaaactgccacatacaccacaaaaaccaaacatcccccaatgaccttagccccattgctccattcactcccaggtgagatttcaggcaaacgtccacaaggttcacaggcagcgtacatacggtttctgttataccccatatataacccctccatgtcctaagagaggacattttctctgagagattgtcatttgagtgtatctctaaaaaaaactctcgtgtcactcgcctccatctctttctgggtgaggacac

SEQ ID NO: 1332 - DNA, 381 bp, Homo sapiens
  misc_feature 349: n = A,T,C or G
tctgagctttcctgtctttcctttttttctgagagattcaaagcctccacgactcttgtttccccccgttcccttctgaattttaaatttgcactaggttcattggcaactggtttggagttgtggagagcggccttaagctctcggtcgcgagtttccgtagagtttgagccacctcggacaggtgcctcgcgcagggcccggcccgccctcacatctggcccggggtgactggggcgccgtctgtgtgcccgaggtctcaccgttctctcgcctagtctggacgctccgaccgacatcgcggagcagccttacaggcattccattacgcccatctcgctctgtgccncctcccaccaggtctacagcaggagccctgga

SEQ ID NO: 1333 - DNA, 324 bp, Homo sapiens
cagaaggctaaatgaatattatccctaatacctgccacccactcttaatcagtgggtgggaggaccggtctcagacctttttgtttcaatgggccatttaagtttagtagtaaaggactggttattgataccattgcatcgtaaaccctccagagggaaagggagattgttttgtggcccactttggtttctctttttccgcgtgtggcagtttataagatatgagtttataaactcagtactctaaatggacacatctagaccaaatatttgtcacagattctgagacctattaaaagtgttaattgagaaaaaaaaaaaaaa

SEQ ID NO: 1334 - DNA, 137 bp, Homo sapiens
gctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacaga

SEQ ID NO: 1335 - DNA, 222 bp, Homo sapiens
gctgccgatgtggtgcttagtgattgcggtttcggtcgctctccgtgtttcccgggcctgggtatttgcctcgcaccatggcgcccaagggcaaagtgggcacgagagggaagaggcagatatttgaggagaccagagagactctaaggttctacctccggatcatactgggggccattgccatttactgccttgtgacgtgggtctactttcactcatcts

SEQ ID NO: 1336 - DNA, 210 bp, Homo sapiens
cggcacgagatggcggaggtgcaggtcctggtgcttgatggtcgaggcatctctcggccgcctggcgcaattcgtggctaacaaggtactgctgggccggaaggtggtggtcgtacgttgtgaaggcatcaccatttctggcaatttctccagaaccaagttgaagtacctggctttcctccacaagcggatgaccaccaacccttcccg

SEQ ID NO: 1337 - DNA, 387 bp, Homo sapiens
cggcacgagatggcggaggtgcaggtcctggtgcttgatggtcgaggccatctcctggggccgcctggcgccaattcgttggctaaacaggtactgctgggccggaaggtggtggtcgtacgctgtgaaggcatcaccatttctggcattttctacagagacagttgaggtacctggcttcctccgcaagcggatgcacaccaacccttcccagaggcccttaccacttccgggcccaaagccgtatcttctggcgcaccgtgcgatgtatgctgccccacaacaaccaggcgaggccaggccgctctggaccgtctcaggtgtttcgacgccatcccaccgccctacgacagaaaaagcggatggtggctcctcctgccctcaagg

SEQ ID NO: 1338 - DNA, 210 bp, Homo sapiens
aaccctgggaaggctcctggttgtctacccatggacccagaggttcttgacagctttgcaacctgtcctctgcctctgccatcatgggcaaccccaaagtcaaggcacatggcaagaaggtgtctgacttccttgggagatgccataaagcacctggatgatctcaagggcacctttgcccagctgagtgaactgtactctgaaaagctc

SEQ ID NO: 1339 - DNA, 377 bp, Homo sapiens
  misc_feature 305: n = A,T,C or G
accctgggaaggctcctggttgtctacccatggacccagaggttctttgacagcttttggcaacctgtcctctgcctctgccatcatgggcaaccccaaaggtcaaggcacatggcaggagggtcctgacttccttgggagatgccataaggcactggatgatctcaggggcacctttgcccagctgagtgacctgcactgtggacaggctgcatgtggatcctggagaactacacgctcctggatatgtcctggtgaccgtttgggcaatccatttcggcagagatacaccctgaggtgcaggncttcctggcagagatggtgactgagtcgccagtccctctctcagatacactaagctcactgcccatgatgca

SEQ ID NO: 1340 - DNA, 150 bp, Homo sapiens
ggatactcatatggtcctggtgctctttgagactgaatgtagagagtgatggattatggtgttaatgacttatcttctgctattacttggctgtgctgggcatgcattttctgcgatagctgaaaaaaaaagccaggggttaaggggaag

SEQ ID NO: 1341 - DNA, 516 bp, Homo sapiens
aggatactcatatggtcctggtgctctttgagactgaatgtagagagtgatggattatggtgttaatgacttatcttctgctattacttggctgtgctgggcatgcattttctgcgatagctgaaaaaaaaaagccaggggttaaggggaagtggaataaagctgatttcaactcaaacatcatcagaacaataaaagcttgacccactttgtgcaacacataggccttctctaaaaacaaactcagctttctcccactcctaggaccaccaccaaactcctgtgttgaaaacaccaattacttcttgacagttccattgctcctgaagttgttacaccaaaagaacctttctatcataggcttattcctgcctaagagccaggcatcatgttaaaacctaattcttattggctcagctactttttcttacatgggaagtcaaagtttggtaatatgtataaaagtatttctctgttcacatgataataatcagcacacatttacattggattatt

SEQ ID NO: 1342 - DNA, 291 bp, Homo sapiens
aggatactcatatggtcctggtgctctttgagactgatgtagagagtgatggattattggtgttaattgaccttatcttccttcctattaaccttgggcttgtccttgggccatgcattttcctccggatacgtgaaaaaaaaaaaaggccagggggtttaaggggggagggtggaattaagggctaatttacaccctcacacatcattcagaccatttaaagggcttgccccacttgtgtacaacacataggcccttctctaaacacactctaatgctctctcctactcc

SEQ ID NO: 1343 - DNA, 230 bp, Homo sapiens
ctcgtgccggtcatttcaaagaagagatcttggaaggtaaaggataacacaagcagttttagggtaatgaatgtgaagaaatcactaggctaaggaaagaggttatattcaggatccccgaaaccttcactctccccttcctctgtgactttctgtgaaggcaaagttgaaggtccaccttaggattagggggaccaatattctcaggctaggggcactttttttaacct

SEQ ID NO: 1344 - DNA, 349 bp, Homo sapiens
ctcgtgccggtcatttcaaagaagagatcttggaaggtaaaggataacaaaagcagttttagggtaatgaatgtgaagaaatcactaggctaaggaaagaggttatattcaggatcccccgaaaccttcactctccccttcctctgtgactttctgtgaaggcaaagttgaagtccaccttaggattagagggaaccaataattctcaggctaggggcactttttttaactccgaagaatttaatatgtcattaataggatgaaatttttgtgccaatggcaaagtagcccctggtggccaacaactctccccccacaccaccacatccataaaaaaaaaaaaaaaaaa

SEQ ID NO: 1345 - DNA, 185 bp, Homo sapiens
cagattgtattctatgagtcccagaagatgaaaaaaattttatacgttgataaacttataaatttcattgattaatctcctggaagattggtttaaaaagaaaagtgtaatgcaagaatttaaagaaatatttttaaagccacaattattttaatattggatatcaactgcttgtaaaggtgctc

SEQ ID NO: 1346 - DNA, 162 bp, Homo sapiens
cagattgtattctatgagtcccagaagatgaaaaaaattttatacgttgataaaacttataaatttcattgattaatctcctgggaagattgggtttaaaaagaaaagtgttaattgcaagactttaaaggaatttatttttaaaggcacaattattttaat

SEQ ID NO: 1347 - DNA, 270 bp, Homo sapiens
ccctcatctggtgactcatgatgcccgcaccatccgctaccccgatccctcatcaaggtgaatgataccattcagattgatttggagactggcaagattactgatttcatcaagttcgacactggtaacctgtgtatggtgactggaggtgctaacctaggaagaattggtgtgatcaccaacagagagaggcaccctggatcttttgacggtgttcacggtaaagatgccaattggcacagctttgccactggactttccaacattttt

SEQ ID NO: 1348 - DNA, 180 bp, Homo sapiens
ccctcatctggtgactcatgatgcccgcaccatccgctaccccgatcccctcatcaaggtgaatgataccattcagattgatttggagactggcaagattactgatttcatcaagttcgacactggtaaccttgtttatggtgacctggaggtccttacctaggaaggatttgggtttat

SEQ ID NO: 1349 - DNA, 230 bp, Homo sapiens
actttttgtttttccttcctttttgtgaaatgtattaagttgtggttcttattgaaacagtattatataatgtttgcttaattatatcatgtgatgctcagttctattttgatttattcattagtattcacttttacctttaaagtttacttgtagcaaatatgtttacattataaagccgatatgttttgacaatgaaatttacatatcaggtactgcaaataaaggtg

SEQ ID NO: 1350 - DNA, 162 bp, Homo sapiens
tactttttgtttttccttcctttttgtgaaatgtattaagttgtggttcttattgaaacagtattatataatgttctgcttaattatatcatgtgatgctcagttctattttgatttattcattaggattcacttttacctttaaaggttacttgtaagcaa

SEQ ID NO: 1351 - DNA, 255 bp, Homo sapiens
cttgccttaaatcttcctcaaccaaataagtattttattagtgcttgagagaatctgaatgtaggatgggttcaactgcacaaaaggaaaagatttttaccactttttttatatagatataaagtgaagcaaccgccttagtgctgaaatatgtagtacatgaatatgccttgtttaattacaggaaattccaaaacttgtactattttttttcccatgtgaaggcaggaattctcctaggcttcctggacagca

SEQ ID NO: 1352 - DNA, 142 bp, Homo sapiens
cttgccttaaatctttctcaaccaaataagtattttattagtgcttgagagaatctgaatgtaggatgggttcaactgcacaaaaggaaaagatttttaccactttttttatataggatataaagtgaggcaaccgccttag

SEQ ID NO: 1353 - DNA, 190 bp, Homo sapiens
aagggccctgaggccaaatatcactcccaggattccattgttaagcccaattccaccattaaattccacttggatcacagatgctgcacatacacaaccatggccaagcctcttcaattttcattgtttattgaacatgcaggacagcagacatcattaaaaaggcgttctcagtcatgcccagttttcc

SEQ ID NO: 1354 - DNA, 177 bp, Homo sapiens
aagggccctgaggccaaatatcactcccaggattccattgttaagccccaattccaccattaaatttccacttggatcacagatgctgcacatacacacccatggccaagcctctcaattttaatggttattggaccatgcaggaccagcaggcaatcactaaaaagggcgttttca

SEQ ID NO: 1355 - DNA, 180 bp, Homo sapiens
ctgacggccgcgccatcttcagaatggaggatgagcagctgaaggtgtgggatgtgattggccgcagcctgattattgatgagggagaagatgaccttggcccggggaggccatcccttatccaagatcaccagggaactccggggagaaggttggccttttgccataattcaccgttcc

SEQ ID NO: 1356 - DNA, 265 bp, Homo sapiens
aatgcattctctgaaacactttccatcctagacattccagcctgggggcaaagataccctcttttagttggatttggttctgccaagttgaatgggggcccaaggcctaaccgaacagttgaggggcgagatgtggcaagagtggaaagcagaacacttaaaagtatgtttggtagacactgggctggacttggcttccacctgagattaaagttgacaattgggaggatgttttatacaatgtatgggttaagggcacaaatcc

SEQ ID NO: 1357 - DNA, 584 bp, Homo sapiens
gccaatgcattctctgaaacactttccatcctagacattccagcctgggggcaaagataccctcttttagttggattttggttctgccaagttgatggggcccaagggccctacgacagttgagggcgagatgtggcaagagtggaaaagcagaacactgaaaagtatgtttggtagacactgggctggacttggcttccactgagattaaagttgacaaatggggaggatgtattatacaatgtatgggttaagagcacaaatcctgcagctgaactgagtttgcaaatcttggcttaggtaaacatgagcaaaatatttgaacctcaattattttatcagtaaaatgtagataactatagtttctacctttgggattttgtggggattaaacgtgataatcaaggtaaagtgactctggctactaggtggagaatggattgcaggtaggcaagagtgggagtggagagatcagcatgtggcagttgtctggaaaggaaaccacagtggctgagactttagtggtggtaaggagagacgtcaagaaagcgggtaaccagagtcaggccatgtcatcacactgg

SEQ ID NO: 1358 - DNA, 202 bp, Homo sapiens
aacactttccatcctagacattccagcctgggggcaaagataccctcttttagttggattttggttctgccaagttgatggggcccaagggccttacgacaattgagggcgagatgttggcaagagttggaaaagcagaacactgaaaagtatgtttggtagacactggcctggacttggctttccactagagattaaaggt

SEQ ID NO: 1359 - DNA, 155 bp, Homo sapiens
cagcgtggcgagcaggcttgccgccgagtgcatcctgagcaagcggcatcgaaggcaagctgagtaccttggtcaagtggcgcggcttgtcctccaaggagggtgttttgcattcccggaaggccttctcttgcacaactgcttccgcggccccg

SEQ ID NO: 1360 - DNA, 187 bp, Homo sapiens
agcagcgtgggcgagcaggtcttcgccgccgagtgcatcctgagcaagcggctccgcaagggcaagctggagtacctggtcaagtggcgcggctggtccttcaaggagggtgtttggcattcccggaagggcctctctgcacagcttgcttccgcggccccgttcctccgtttccccggaccccgtt

SEQ ID NO: 1361 - DNA, 273 bp, Homo sapiens
ggcacgaggcaagatggcagtgcaaatatccaagaagaggaagtttgtcgctgatggcatcttcaaagctgaactgaatgagtttcttactcgggagctggctgaagatggctactctggagttgaggtgcgagttacaccaaccaggacagaaatcattatcttagccaccagaacacagaatgttcttggtgagaagggcccgccgattcgggaactgactgctgtagttcagaagaggtttgctttccagagggcagtgtagagctttat

SEQ ID NO: 1362 - DNA, 156 bp, Homo sapiens
cggcacgaggcaagatggcagtgcaaatatccaagaagaggaagtttgtcgctgatggcatcttcaaagctgaactgaatgagtttcttactcgggagcttgctgaagatggctactctggagttgaggttcgagttacaaccacccaggacaaga

SEQ ID NO: 1363 - DNA, 353 bp, Homo sapiens
atttttcttaactggagtgtgtgctgcctttcaggtacaatttttgtgtaataaaagccagtgcattaagtttatatagactactttctatgcaagactgagatatggaatagataggaagagatatgtactgctgggtacatggacagtaagtgtgttttcagatggagtaccagcaccgaaaatgggttgagggaggatggttgtatgtatgtttctgccactaattttgagcagccatattatgaattaaatcgtcacagccaggtaataccccaggatggtatgagtttcatgtgtaatagctcaaatggaataggcatgaatgctggagtggaccatatctcaaatat

SEQ ID NO: 1364 - DNA, 115 bp, Homo sapiens
gaactctctgtgctagtaaccacgttgctcctcattcaatatcactctccgccttacaggagtcaacatactagttacagcccctatactccctctacatatttaccacaccaca

SEQ ID NO: 1365 - DNA, 203 bp, Homo sapiens
gaactctctgtgctagtaaccacgttctcctgatcaaatatcactctcctacttacaggactcaacatactagtcacagccctatactccctctacatatttaccacaacacaatggggctcactcacccaccacattaacaccataaaaccctcattcacacgagaaaacacctcatgttcatacacctattccccatctct

SEQ ID NO: 1366 - DNA, 155 bp, Homo sapiens
gagggagagagagactgataagtggatgcatggatgacggaccatgagccagtgcctcagttgacccagaagcctagtcaggtcggctgggcccaaggttggggggagcaaaactaggtcatctcacacccctgtactcctctgaaggccctatc

SEQ ID NO: 1367 - DNA, 300 bp, Homo sapiens
gagggagagagagactgataagtggatgcatggatgacggaccatgagccagtgactcagttgaaccagaagcctagtcaggtcggctgggaccagggttgggggagcaaaactaggtcatcttacagcccctgtacttctcttgagggtcctttctctttccaccattctcccttttctgtcccagggaccgggatgtagagaagtgtcccatctccaccaggcctggcagcaggaacaaagggtgactttttccctggcctatgatggagctcttcagcggcaccacgggcaggatca

SEQ ID NO: 1368 - DNA, 225 bp, Homo sapiens
cggcacgagaaatccaaggttgaaaagaaaaagaaggagaaggttctcgcaactgttacaaaaccagttggtggtgacaagaacggcggtacccgggtggttaaacttcgcaaaatgtctagatattatcctactgaagatgtgtctcgaaagctgttgagccacggcaaaaaaccctctcagtcagcacgctgagaaaactgcgagccaacatttacccccggg

SEQ ID NO: 1369 - DNA, 199 bp, Homo sapiens
cggcacgagaaatccaaggttgaaaagaaaaagaaggagaaggttctcgcaactgttacaaaaccagttggtggtgacaagaccgccggtacccgggtggttaaattcggaaattgcctaggatattatcctcctgaggatgtgcctggaaagctgtgtgagcaacgcaaaaaaccctcaagtaagacgcgtgagaaac

SEQ ID NO: 1370 - DNA, 266 bp, Homo sapiens
ggagacccagtttcttaaaacaaacaaacaaactcaaaataagagcaaatgtttatatagtatcatgtaccaggtacaggtactgctctgaatgctttacatatattaactcactttaaattattttaatagggttttaatatataactatagagggaagggcataagtcagacacaaaagcctaactcataaattctttctcatctgtaaagggggtagctaatattatcccttctaaaactgtcaggaactttctggttaggct

SEQ ID NO: 1371 - DNA, 148 bp, Homo sapiens
cttgagtggcatgtttattctaactgaatgaagaatgactattgaattaggtatattccccatgccaaataattttaactgtgatgtaatcctagccgctttcttatttttactccgaataaatttaaaatatttaggattggccagg

SEQ ID NO: 1372 - DNA, 269 bp, Homo sapiens
gaaaaagctgcctgccaaaaatcagtgaagtcttaaaactaaatagttttttaaattagaaaaatattaacatgaattgttgaagagatttgagtccaatgggggatcaagtgtatgtgaaattgcattttttaaagttgttcttttccagtagaccataacaaaaacttacatgaaaccacaagagagggtgtctccctgccttccccaaatttgggctcattttttaacaaagcagataaaacagttgaactaaattagatgttgaa

SEQ ID NO: 1373 - DNA, 566 bp, Homo sapiens
gaaaaagctgcctgccaaaaatcagtgaagtcttaaaactaaatagttttttaaattagaaaaatattaacatgaattgttgaagagatttgagtccaatgggggatcaagtgtatgtgaaattgcattttttaaagttgttcttttccagtagaccataacaaaaaattacatgaaaccacaagagagggtgtctccctgccttccccaaatttgggctcattttttaacaaaacagaataaaaacagttgaactaaattagaatgttgaaatggtgagagtgggtggaaagatgaaaggcacttcacttcaaacagactctaacggggaaatcaaaaactgataataagaccacccagctgacctgactcacctattcaggatccttctgaaagcctctcatcccttgtattgtacgtcctttaggctagtaataatatcattgaagtacagaaataaaatgtctcaaacgtgttacaggaacatccagaaaaatgaacagcatattttccaattaaatccttcagtacttccctttccagtttttcctccggatcaattgaca

SEQ ID NO: 1374 - DNA, 180 bp, Homo sapiens
gaaaaagctgcctgccaaaaatcagtgaagtcttaaaactaaatagtttttaaattagaaaatattaacatgaattgttgaagagatttgagtccaatgggggatcaagtgtatgtgaaattgcattttttaaaggtggttcttttccagtagccataacaaaaaattacatgaacccca

SEQ ID NO: 1375 - DNA, 161 bp, Homo sapiens
cgggctgcgcgtcgccatggagcccgacggacttacgagccgggcttcgtggggtattcgcttctgccaggaatgtaacaacatgctgtacccaaggaggacaaggagacccgcaattctgcctctacgcgtgccgaacctgtgataccacagggaggccg

SEQ ID NO: 1376 - DNA, 106 bp, Homo sapiens
ctcgattctttgaagggatgacaacaaattttgggttctactgttatgtgaggacattagggcccagcaacacggcattgttaaggaaaaataaaagtactgccgt

SEQ ID NO: 1377 - DNA, 286 bp, Homo sapiens
atgtcagtcgccgcagttgagcaaaaaacacttcttcctttgagtggctgttctggtgaaatctgtttctgacatatccacttttctctctcttttctctctctctgactgcgagccccacagggagaaggaattggatgtatcggatgttggtattagattttctttctccgttcgagtctctgactcgtgcatactttgcaaaggtgtgttcctcgcaattgcaagagttagaaaatgcaccttctctggtggccgttggggtgttgtttcacaggcagtggtg

SEQ ID NO: 1378 - DNA, 311 bp, Homo sapiens
tgtcagtcgccgcagttgagcaaaaaacacttcttcctttgagtggctgttctggtgaatctgtttctgacatatccacttttctctctcttttctctctctctgactgcgaagaccccacagggaggagggaattggatgtatcggatgttggtattagattttctttctccgcttcgagtctctgactggtgcatactttgcaaaggtgtgttccgggcaattgccaagagttagaaaatgcaccttctctcgtggccttggggtgttgtttcacaggcagtggtgacagggccccttggctgtggctg

SEQ ID NO: 1379 - DNA, 286 bp, Homo sapiens
gtacagttcagccttactctgtttttaagtagttgtgttgtcaatttcatgcttttaagtcctgatgatccttggagatgggagaaaaagataccagggataattaaaatccacagccagtttcatcagtttcctcatccatcctgcaaataaaaatgttaacaaggagccaaacttattcgttctggttttacaatttattttgaccgtcttttgggtgaaaattgcaaacagccaagcaagtggctggatgccccagtctaagaattcaaaacaatcactgagt

SEQ ID NO: 1380 - DNA, 209 bp, Homo sapiens
gtacagttcagccttactctgtttttaagtagttgtgttgtcaatttcatgcttttaagtcctgatgatccttgggaggatggggagaaaaaaggataccaggggataatttaaatcccacaagccagttttcatcagtttccctcaatcccatccctgccaaaataaaaaatgtttaacaagggggcccaaacttatttcgttctggg

SEQ ID NO: 1381 - DNA, 287 bp, Homo sapiens
agaatccacactggagagaaaccttacaaatgtaatgagtgtggcaaggtcttcagtcacaagtcatccctagtaaatcactggagaattcatactggagagaaaccttacaaatgtaatgagtgtcgcaaggtcttcagtcacaagtcatccctagtaaatcactggagaatccacactggagagaaaccttacaaatgtaatgaatgtggcaaggtcttcagtcgcaattcataccttgcccacatctgataattcatgccggtgagaaccttataagtgtgatg

SEQ ID NO: 1382 - DNA, 161 bp, Homo sapiens
agaattcacactcggagagaaaccttacaaatgtaatgagtgtggcaaggtcttcagtcacaagtcatccctcaggttaaatccactgggaggaattccatacttgggaggaggaaaccccttaccaaaatgttaattgaggtgttgtggcaaagggtctt

SEQ ID NO: 1383 - DNA, 260 bp, Homo sapiens
attgtaaatctgtgttttaaatattttataacagagcactaatggaaacctaataaatacaaacaagataactattacccaagataacatggaaatacttctgtctttgaagttaacaacaccgtctgccctcaaagcacatttaggagtatcaaccaagaccagccagttgacatgtttttctgtgtggcaacctgcccttaaattgtcagatcttaactatcttgtggttgctgtcttgcagccataaggtttcctcc

SEQ ID NO: 1384 - DNA, 145 bp, Homo sapiens
attgtaaatctgtgttttaaatattttataacagagcactaatggaaacctaataaatacaaacaagataacctatttacccaagataacaatggaaataactttcttgttttttgaaggttaaacaaacaaccgtcttgcccct

SEQ ID NO: 1385 - DNA, 281 bp, Homo sapiens
cgtctcgcaggccgtagaggaagatggcggtggagtcgcgcgttacccaggaggaaattaagaaggagccagagaaaccgatcgaccgcgagaagacatgcccactgttgctacgggtcttcaccaccaataacggccgccaccaccgaatggacgagttctcccggggaaatgtaccgtccagcgagttgcagatctacacttggatggatgcactttgaaagactgacaagcttagtaaaagaagtctacccagagctagaaagaagggcactcacttc

SEQ ID NO: 1386 - DNA, 246 bp, Homo sapiens
cgtctcgcaggccgtaggaggaagatggcggtggagtcgcgcgttacccaggaggaaattaagaaggagcagagaaacctattcgaccgcgagaagacatgcccacttttttctacgggtttttcaccaccaataacggccgccaccaccctattggagcgagtttttcccggggaaaatttacccctccagcgagtttgcagatctacacatgggggggatggcaactttgaaagaactcacaag

SEQ ID NO: 1387 - DNA, 281 bp, Homo sapiens
gcaccttgcagagcaacttctgtgccagcagccttgtggtgactgcgacagtgaagtccatggttcgggagccaggggagggccttgccgtgactgtcagtcttattggtgcttataaaactggaggactggacctgccttctccacccactggtgcctccctgaaggtttacgtgccttgcaagaagtcccccccatgaagaaaggagtaagttatcttctgatgggccaagtagaagagaacagaggccccctccttcctccagagagctttgttggtt

SEQ ID NO: 1388 - DNA, 213 bp, Homo sapiens
gcaccttgcagagcaacttctgtgccagcagccttgtggtgactgcgacagtgaagtccatggttcgggagccaggggagggccttgccgtgactttcagtcttattggtgcttataaaactggagggctggaccgcccttctccacccactggtgcctccctgaaggttttacgtgccttgcaagcagtgccccccatgaaggaaggggtaa

SEQ ID NO: 1389 - DNA, 153 bp, Homo sapiens
ggaagttgaagatgattgtgggtaggaaagagtgaactggccgtgagccactctgcccggcttattttctttatgttttttgcttcgtaagaggttctttttgagcagtgattttgcaactctttgcttgacggttgcttgggggaagctttt

SEQ ID NO: 1390 - DNA, 278 bp, Homo sapiens
taagggctgaggatttttggtccgcacgctcctgctcctgactcaccgctgttcgctctcgccgaggaacaagtcggtcaggaagcccgcgcgcaacagccatggcttttaaggataccggaaaaacacccgtggagccggagtggcaattcaccgaattcgaatcaccttaacaagccgcaacgtaaaatccttggaaaaggtgtgttctgacttgataagaggcgcaaaagaaaagattctcaaagtgaaaggaccagttcgaatgcctaccaaga

SEQ ID NO: 1391 - DNA, 218 bp, Homo sapiens
taagggctgaggatttttggtccgcacgctcctgctcctgactcaccgctgttcgctctcgccgaggaacaagtcgggtcaaggaagccccgcgcggcaacaagccattgcttttaaggatacccggaaaaacaccccttggagcccggaggttggcaattcacccgaatttggaatcaccctaacaaggccgcaaacgtaaaattccttggaaaagg

SEQ ID NO: 1392 - DNA, 155 bp, Homo sapiens
ccatacggcgttgttctggattcccgtcgtaacttaaagggaaattttcacaatgtcggagcccttgatgttcctgccaaatgaaggaaggaagggaatgtccttaaggttccttgccagagagggaacccaattaaggggggcgaccaatcttt

SEQ ID NO: 1393 - DNA, 206 bp, Homo sapiens
attcaccatggcttcttctgatatccaggtgaaagaactggagaagcgtgcctcaggccaggcttttgagctgattctcagccctcggtcaaaagaatctgttccagaattccccctttcccctccaagaagaagggtctttcccctggaggaaattcaaaaggaaattagaagctgcagaaggaagacgcaagtcccatgaagct

SEQ ID NO: 1394 - DNA, 304 bp, Homo sapiens
gctaaaaggacctatttttctttcctctgctaggagccggtgaaacctgaggaaggcagagatatggcaaccaggattggcgcttttgggtacatggagttttcagcaaagaccaaagatggagttagaaaggtttttgaaatggctacgagagcttcttttcaagctagacgtgggaagaaaaaatcttgggtgccctgtcttgtgaaacccttgctgcaagacaagcccttatgcggttaattttgaaggtccgttattaatctagggtattattactggccttttcatttatccataattt

SEQ ID NO: 1395 - DNA, 327 bp, Homo sapiens
cggactccttggtagtctgttagtgggagatccttgttgccgtcccttcgcctccttcaccgccggagaccccttcaaggtctagtcatgcgttagttcatctctcatcccaaggttgccaagcttggttccagattggcaattcttcttggagctctctcttgccttggacaaggcatccagccccattggccaaattccaaggtacaaggccctttggggaggggattgattccttcaacaccctcttcaagtaaacgggtccttgcaagcattgtccccgggaagtttttatagctttggacccaaaagtaattgttgaggtcg

SEQ ID NO: 1396 - DNA, 238 bp, Homo sapiens
cgaaaagtggggggctttttgtcaacaaacccattaaccaaggtgaccctgacgagttttggatataccctttgccatggtttgctcccaaggatttggggcttgaggatacccattccatgggtaattcttcaggtttcccagagaacttaattctcttttcagggcaggcttcacattaggttggttcagacgggggcaacaggtggcaattacccattatgacttttgtaatgat

SEQ ID NO: 1397 - DNA, 316 bp, Homo sapiens
gtaaaagataacctttctttctgacatagtcaaatacgaaattagaaaagccctccctattttaactacctcaactggtcagaaacacagattgtattctatgagtcccagaggatgaaaaaaattttataccgtgataaaacctataaattcattgattaatctctggagattggttaaaagaaagtgtatgcaggatttaagaatattttaagcacattatttatatggatatcactcttgtaagctctctctttctctgtcatcgctgctcagattactaatattgggagccttaaagcgcatgatatggtct

SEQ ID NO: 1398 - DNA, 337 bp, Homo sapiens
ttggcctataccacagtgggtgtgaaaattgcaaggtaaaataaaacagatgagaccatttaaggttgaaatggaaggacagatcactggcaacagctatttactttcacaggcactaaaatagggggttttgttggtaaaactatcaatcaggggtattggtataccctgcttaaaggcccaattatgatgccattctgaactgtaaacggtttcatcacatggatatggggaacctttaaacatgacattacggtgcgactatattgtaggtcacatgggaaaacatttcagagtaagtataggagactataccatgcagtagaggcactgtatt

SEQ ID NO: 1399 - DNA, 334 bp, Homo sapiens
ggattccagttcgagtatggcggccagggctccgaccctgccgatgtggccatccagctgaccttcctgcgcctgatgtccaccgaggccttccagaacatcaacctaccactgcaagaacaagcgtggcctacatggaccagcagactggcaacctaaaggagggccctcttcctccagggttccaaccgggatcgagatccggcccgaggcaaacagccgttaaacctacagcgtaactgtgatggctcaacgatgtaacaccggagcctggccaagacagttattgatacaacaccacaaggactccgtctgcccatatggtgtgccgcgt

SEQ ID NO: 1400 - DNA, 323 bp, Homo sapiens
cgggagcgcgcttaagtaactagtccgtagttcgagggtgcgccgtgtccttttgcgttggtaccagccgcgacatgacggggtacaatccggatgagaaacttcggcttcaacaacttccaaaaacttaaaaagggcgattgcttaaggaccaagaaccttaaccctcgggagccggttcctgcccccaaaagaagatggggccctatggagaaattctggaataaatttttgggagaataaatcccttgggaggaaaatggtcccatgggttatacaaaaggagtatctttgattctcacctcaggtacttttcacactct

SEQ ID NO: 1401 - DNA, 270 bp, Homo sapiens
ccccgaccaacacttgcaggggtccctgctagttagcgccccaccgccgtgggagttcgtaccgctttcttagaccttcttcaagaggcaagcttccttggagccctttttgcaactttgcttttcaagcggtgtaatttgccaaggtcaatgttttttcccgcctaactttccaccaaggtgctaggggtcattgtaagcctcggtttcatctcccggggtggccacaagctaagtcccccggtgtgtttttttctcaaaattaataag

SEQ ID NO: 1402 - DNA, 280 bp, Homo sapiens
ctcgtgccgaattcggcacgagcttcaatgtggtgcagggaggggctgccacaggccagttttctgtgtcagcatccccgatgtggcggaaagtctcccttattttgggcccacgtataatgttaatttctcttggcgtattttcaaagacttgttccctggctgatccaaagtgcagtggtatttacaactaatttgatcacaccagtttgtagatttctctgttccttctcattccactgcttcacttgcctagtctgaggagaaagacacaaaaaaa

SEQ ID NO: 1403 - DNA, 250 bp, Homo sapiens
attctggccacattccttctcagaacatctctattctgcaagaccctctgccatgccagggcacggcccattcccagctaggagtcgtaggggctgggcacaggggaaatttttacagagctgagcctcacgactgcatcttaaggaatgcttagaaggttcccagacaccagagccagtttggccccaccaccggtcaagacctccttgaggtcacaagcacggtttcctcttagtttcacaccaggcc

SEQ ID NO: 1404 - DNA, 200 bp, Homo sapiens
gcaagaacagcattgcatacatggatgaggagactggcaactgaaaaggctgtcattctacagggctctaatgatgttgaaccttgttgctgagggcacagcaggttcacttacactgttcttgtggatggctgctctaaaaggacaaatgaatggggaaggacattcattgaattacaaaacattaggccatcaggctg

SEQ ID NO: 1405 - DNA, 160 bp, Homo sapiens
cagcaacatgctttaaccccattgtatgtttgtggaaagagcatagtttaacatcttgagaaatttgggacataaaggttttcatgggtagacagttcaatgcagtatatgaattgacataattggaaataatctgattttatttttacaactaacatcc

SEQ ID NO: 1406 - DNA, 340 bp, Homo sapiens
gttcccttaagcaaaattgaatttgctttgaacttttagttatgcacagactgataataaacctctaaacctgccccagcggaagtggtgttttttttttaaatttaaatacaggaaacaactgggcaaaaattgaacctaaggatttacttttttttcccataggctgggatataggcctgcagctatagttgacaaggcagtctttaaaaactgctgtgaaacacagggccatcaggaaacgagatgctgcactattaaatagaggtgtttgaaaatccacctctcatcctcggcagaggtgcctagttgtatagatgtaagttcagaagttcacctc

SEQ ID NO: 1407 - DNA, 258 bp, Homo sapiens
gtaccgccgcgtgccagacatcactgagtgcaaggaggaggacatcatgtgcatgtatgaagccgaaatgcagttgaagagggactacaaagtcgaccaagaaattatcaacattatgcaggatcggctcaaagcctttcagcagagggaaggacagaactaccagcagagctgtatcaaggaagtagagcagttcacccaggtggccaaggcctaccaggaccgctatcaggacctcgggggcctacagtctgccag

SEQ ID NO: 1408 - DNA, 180 bp, Homo sapiens
tatcagttggggtatcagtagtgccagcaatcatcatctttgccaggatagaagaaaataactcgcccatcacttggtcaaggaggtccattgccctcttgggctgtaattaacaagggcattcacaattgtggacaccacgcggttggctggcagattaggctgcaggcattcctattc

SEQ ID NO: 1409 - DNA, 180 bp, Homo sapiens
attctggccacattccttcctcagaacatctctattctgcagaccctctgcatgccagggcacgccattcccagctggagtcgtggggcttgggcacaaggggaatttttccaggacttgagcctaacggcttctcttaaggatgcttaagaaggttccccagcaaccagacccattggt

SEQ ID NO: 1410 - DNA, 230 bp, Homo sapiens
atttgccatcataggaggcttcattcactgatttccctattctcaggctacaccctagaccaaacctacgcaaaatccattaactatcatattcatcggcgtaaatctaactttcttccacaacactttctcggcctatccggaatgcccgacgttactcggactaccccgatgcatacaccacatgaacatcctatcatctgtaggctcattcatttctctaaaaggaa

SEQ ID NO: 1411 - DNA, 180 bp, Homo sapiens
cttgcccaaggccacagagttaataaatactaaaacaccacacatgtaaatttttgtattctggactcctaaatcccatattctttttttctacatagctgcctcttgtgggaaatgcatgtactttattttctgctatttatcatacaggacaggaggtttttaagcttatttaaaaaa

SEQ ID NO: 1412 - DNA, 325 bp, Homo sapiens
gagctgcagcatccaggggacaagatgccaactggcaagcagctagctgacattggctataagaccttctctacctccatgatgcttctcactgtgtatggggggtacctctgcagtgtccgagtctaccactatttccagtgcgcagggcccagcgccaggccgcagaaggacagaagactcaggatcatgtagactcgggggcttttctcctgagcagagaggccaaggcatgctgtggagagacttcacctgccaccatttccaggtcacaggactagagcgttgatggtttcaaacctgttggagaaagtgccatggttct

SEQ ID NO: 1413 - DNA, 190 bp, Homo sapiens
gctgcccgtgctggtgccattgccccatgtgaagtcactgtgcagcccagaacactggtctcgggcccgagaagacctcctttttccaggctttaggtatcaccactaaaatctccaggggcaccattgaaatcctgagttatgtccagctgatcaaggactggacaaagtgggagccagcaagccacgt

SEQ ID NO: 1414 - DNA, 185 bp, Homo sapiens
gccagatgccactttatccatggtgacacaagagcaggttgctaccctcggagcttatcagagacaagtggcaagactgaggaaggaaaggagggacccctctcctgtgtctgacgttcctggtgttactcagctgtcaaggagatgggagcctctgcactacaatttcaactacagtcgtgcct

SEQ ID NO: 1415 - DNA, 124 bp, Homo sapiens
ccatcatgggagtggacatcgccataacaaggaccgaaaggttcggcgcaaggagcccaagagccaggatatctacctgaggcttttggtcaagttatacaggtttctggccagagaaccactt

SEQ ID NO: 1416 - DNA, 137 bp, Homo sapiens
gtttgggagctcgtgtgtgtatgtgtgcgtgtgtgtatgtgtgcatgtgtgtgtgtgtgtgtgtgtgtacacgtgcgcctgagggggggcatgagtcttgccagaatgtgagtgtgagagttgataatgcaggggtg

SEQ ID NO: 1417 - DNA, 275 bp, Homo sapiens
aaaaaggatagtctcttttcttactctggcaaacctgtgagtgattccacaaagatacagtattacttagctatctgaattatgatagaaaaggtcctagttaggttcctatataaagcatttggaagatgaccttgttgcccttgaaacttgaaaatagggattctggggtgaggatacaaagacattgtcttgcatatcataagcaggtcttagagcattattcaaactctagctgtttcagtagttctatgaggattgcaggtcataggtgt

SEQ ID NO: 1418 - DNA, 190 bp, Homo sapiens
gcggctttggcggtggtagtggaagcaattttggaggtggtggaagctacaatgattttgggaattacaacaatcagtcttcaaattttgggacccatgaagggaggaaattttggaggcagaagctctggcccctatggcggttgaggccaatactttgacaaaaccacgaaaccaagggtgctattgc

SEQ ID NO: 1419 - DNA, 146 bp, Homo sapiens
actttattagctcacacctgtccactcacatgaaactcgtgttaggccctgggaggccgacggtaactctcaccgtgccctcagatgaagcacggagaggttgttacttgcccggccatccagtgggctggctgggtctttgtgtc

SEQ ID NO: 1420 - DNA, 121 bp, Homo sapiens
taagcctgcgtcagattaaaacactgaactgacaattaacagcccaatatctacaatcaaccaacaagtcattattaccctcactgtcaacccaacacaggcatgctcatagggaaggtta

(The sequence listing continues in the following parts.)

The invention claimed is:

1. A method for detecting expression of a group of genes consisting of tumor necrosis factor alpha-induced protein (TNFAIP6), calmodulin 1 (CALM1), and laminin, gamma 1 (LAMC1) in a human test individual, said method comprising:

for each gene of said group of genes, detecting and quantifying RNA encoded by said gene in a cartilage sample of said test individual, comparing said level of RNA to a quantified level of control RNA encoded by said gene in cartilage samples of control individuals, wherein said control individuals are classified as healthy individuals, classifying said test individual as being a candidate for having osteoarthritis if, for TNFAIP6 and CALM1, said level of RNA encoded by said gene in said cartilage sample of said human test individual is higher than in said samples of said control individuals, and, for LAMC1, said level of RNA encoded by said gene in said cartilage sample of said human test individual is lower than in said samples of said control individuals, wherein said gene is differentially expressed in said cartilage samples of said human test individual relative to said samples of said control individuals with a p value of less than 0.05.

2. A method of screening a human test individual for being a candidate for having osteoarthritis, comprising, for each gene selected from a group of genes consisting of tumor necrosis factor alpha-induced protein (TNFAIP6), calmodulin 1 (CALM1), and laminin, gamma 1 (LAMC1);

(a) detecting RNA encoded by said gene in a cartilage sample of said test individual; and (b) quantifying a level of RNA encoded by said gene detected in step (a); and (c) comparing said level of RNA quantified in step (b) to a quantified level of control RNA encoded by said gene in cartilage samples of control individuals classified as healthy individuals;

wherein said test individual is a candidate for having osteoarthritis if, for TNFAIP6 and CALM1, said level of RNA encoded by said gene in said cartilage sample of said human test individual is higher than in said samples of said control individuals classified as healthy individuals with a p value less than 0.05, and, for LAMC1, said level of RNA encoded by said gene in said cartilage sample of said human test individual is lower than in said samples of said control individuals classified as healthy individuals with a p value less than 0.05.

3. A method of classifying expression of a group of genes consisting of tumor necrosis factor alpha-induced protein (TNFAIP6), calmodulin 1 (CALM 1), and laminin, gamma 1 (LAMC1) in a human test individual, said method comprising, for each gene of said group of genes:

(a) quantifying a level of RNA encoded by said gene in a cartilage sample of said test individual;

(b) comparing said level of step (a) with quantified levels of RNA encoded by said gene in cartilage samples of control individuals classified as having osteoarthritis; and (c) comparing said level of step (a) with quantified levels of RNA encoded by said gene in cartilage samples of control individuals classified as healthy individuals;

wherein a determination from steps (b) and (c) that said level of step (a) is: (i) statistically similar to said levels in said samples of said individuals classified as having osteoarthritis; (ii) statistically higher for TNFAIP6 and CALM1 relative to said levels in said samples of said individuals classified as healthy individuals; and (iii) statistically lower for LAMC1 relative to said levels in said samples of said individuals classified as healthy individuals, results in a classification of expression of said group of genes in said test individual with that of said individuals classified as having osteoarthritis, and wherein a determination from steps (b) and (c) that said level of step (a) is: (1) statistically lower for TNFAIP6 and CALM1 relative to said levels in said samples of said individuals classified as having osteoarthritis; (2) statistically higher for LAMC1 relative to said levels in said samples of said individuals classified as having osteoarthritis; and is (3) statistically similar to said levels in said samples of said individuals classified as healthy individuals, results in a classification of expression of said group of genes in said test individual with that of said individuals classified as healthy individuals.

4. The method of claim 3, wherein said quantifying of said level of RNA encoded by said gene is effected by quantifying said level of RNA relative to a housekeeping gene.

5. The method of claim 3, wherein said quantifying of said level of RNA encoded by said gene is effected by quantification of cDNA complementary to RNA encoded by said gene.

6. The method of claim 3, wherein said quantifying of said level of RNA encoded by said gene is effected using PCR.

7. The method of claim 3, wherein said quantifying of said level of RNA encoded by said gene is effected using an array.

8. A method of determining osteoarthritis may be present in a human test individual suspected of having or being afflicted with osteoarthritis, said method comprising:

for each gene of a group of genes consisting of tumor necrosis factor alpha-induced protein (TNFAIP6); calmodulin 1 (CALM1); and laminin, gamma 1 (LAMC1):

(a) determining a level of RNA encoded by said gene in a cartilage sample of said test individual; and (b) comparing said level with levels of RNA encoded by said gene in cartilage samples of control individuals who are healthy individuals, wherein a determination from step (b) that said gene has statistically significant differential expression between said sample of said test individual and said samples of said control individuals is indicative of osteoarthritis in said test individual, said differential expression consisting, for TNFAIP6 and CALM1, of an increase in expression in said sample of said test individual compared to said samples of said control individuals, and, for LAMC 1, of a decrease in expression in said sample of said test individual compared to said samples of said control individuals.

9. The method of claim 7, further comprising the step of isolating RNA from said cartilage sample of said test individual.

10. The method of claim 7, wherein said determining of said levels of RNA encoded by said gene in said cartilage sample of said test individual, comprises hybridizing a nucleic acid sample from said cartilage sample to an array comprising a substrate and a plurality of nucleic acid members, wherein each nucleic acid member is attached to a distinct addressable location on said substrate, and wherein hybridization of said nucleic acid sample to said nucleic acid members results in a determination of said level of said RNA transcripts.

* * * * *

UNITED STATES PATENT AND TRADEMARK OFFICE

CERTIFICATE OF CORRECTION

PATENT NO. : 7,432,049 B2
APPLICATION NO. : 10/085783
DATED : October 7, 2008
INVENTOR(S) : Choong-Chin Liew et al.

It is certified that error appears in the above-identified patent and that said Letters Patent is hereby corrected as shown below:

Claim 9, line 1, incorrectly recites: "The method of claim 7, . . . .".

The correct recitation of Claim 9, line 1, is: "The method of claim 8, . . . .".

Claim 10, line 1, incorrectly recites: "The method of claim 7, . . . .".
The correct recitation of Claim 10, line 1, is: "The method of claim 8, . . . .".

Col. 57, line 1 should read "sample of said human test individual relative to said".

Signed and Sealed this

Twenty-fifth Day of November, 2008

JON W. DUDAS
*Director of the United States Patent and Trademark Office*

UNITED STATES PATENT AND TRADEMARK OFFICE

CERTIFICATE OF CORRECTION

PATENT NO. : 7,432,049 B2
APPLICATION NO. : 10/085783
DATED : October 7, 2008
INVENTOR(S) : Choong-Chin Liew et al.

It is certified that error appears in the above-identified patent and that said Letters Patent is hereby corrected as shown below:

Column 58, Claim 9, line 40, incorrectly recites: “The method of claim 7, . . . .”.

The correct recitation of Column 58, Claim 9, line 40, is: “The method of claim 8, . . . .”.

Column 58, Claim 10, line 43, incorrectly recites: “The method of claim 7, . . . .”.

The correct recitation of Column 58, Claim 10, line 43, is: “The method of claim 8, . . . .”.

Col. 57, line 1 should read “sample of said human test individual relative to said”.

This certificate supersedes the Certificate of Correction issued November 25, 2008.

Signed and Sealed this

Twenty-third Day of December, 2008

JON W. DUDAS
*Director of the United States Patent and Trademark Office*